United States Patent 7,888,497 (BIOINFORMATICALLY DETECTABLE GROUP OF NOVEL REGULATORY OLIGONUCLEOTIDES AND USES THEREOF) - sequence listing, part 56

SEQ ID NO: 2351677 - DNA, 20 bp, Homo sapiens
actctagtgacttcctggtg

SEQ ID NO: 2351678 - DNA, 22 bp, Homo sapiens
actctagtgacttcctggtgag

SEQ ID NO: 2351679 - DNA, 22 bp, Homo sapiens
actctataagcaaattgctttt

SEQ ID NO: 2351680 - DNA, 20 bp, Homo sapiens
actctcctaggcattctgga

SEQ ID NO: 2351681 - DNA, 12 bp, Homo sapiens
actctctttcct

SEQ ID NO: 2351682 - DNA, 22 bp, Homo sapiens
actctgaagctaattgtactaa

SEQ ID NO: 2351683 - DNA, 17 bp, Homo sapiens
actctgaaggagaggag

SEQ ID NO: 2351684 - DNA, 17 bp, Homo sapiens
actctgcacatgtcttg

SEQ ID NO: 2351685 - DNA, 18 bp, Homo sapiens
actctgcacatgtcttgt

SEQ ID NO: 2351686 - DNA, 21 bp, Homo sapiens
actctgcacatgtcttgtaca

SEQ ID NO: 2351687 - DNA, 14 bp, Homo sapiens
actctgcatgtaga

SEQ ID NO: 2351688 - DNA, 22 bp, Homo sapiens
actctgcccctggacctgggaa

SEQ ID NO: 2351689 - DNA, 22 bp, Homo sapiens
actctgggagtaatacttttta

SEQ ID NO: 2351690 - DNA, 12 bp, Homo sapiens
actcttatctca

SEQ ID NO: 2351691 - DNA, 14 bp, Homo sapiens
actcttccctctct

SEQ ID NO: 2351692 - DNA, 11 bp, Homo sapiens
actcttcctgc

SEQ ID NO: 2351693 - DNA, 21 bp, Homo sapiens
actcttctttaagccatagac

SEQ ID NO: 2351694 - DNA, 18 bp, Homo sapiens
actctttatgatctggcc

SEQ ID NO: 2351695 - DNA, 22 bp, Homo sapiens
acttgctgtgtgaccctgggca

SEQ ID NO: 2351696 - DNA, 16 bp, Homo sapiens
acttgcttaaatttct

SEQ ID NO: 2351697 - DNA, 23 bp, Homo sapiens
acttgcttaaatttcttatgtga

SEQ ID NO: 2351698 - DNA, 21 bp, Homo sapiens
acttgctttaccttttcaggg

SEQ ID NO: 2351699 - DNA, 20 bp, Homo sapiens
acttggctggggaggaccag

SEQ ID NO: 2351700 - DNA, 22 bp, Homo sapiens
acttgggaggctgaggcaggag

SEQ ID NO: 2351701 - DNA, 20 bp, Homo sapiens
acttggtgattacctgaaag

SEQ ID NO: 2351702 - DNA, 16 bp, Homo sapiens
acttgtcacctgagtg

SEQ ID NO: 2351703 - DNA, 17 bp, Homo sapiens
acttgtgttttaaaata

SEQ ID NO: 2351704 - DNA, 15 bp, Homo sapiens
acttgttatattata

SEQ ID NO: 2351705 - DNA, 19 bp, Homo sapiens
acttgttatgttgtaatat

SEQ ID NO: 2351706 - DNA, 13 bp, Homo sapiens
actttaaattgtg

SEQ ID NO: 2351707 - DNA, 18 bp, Homo sapiens
actttaaattgtggatga

SEQ ID NO: 2351708 - DNA, 23 bp, Homo sapiens
actttaatgtacatgggccgcac

SEQ ID NO: 2351709 - DNA, 19 bp, Homo sapiens
actttaattaccaacctgt

SEQ ID NO: 2351710 - DNA, 20 bp, Homo sapiens
actttaattaccaacctgtt

SEQ ID NO: 2351711 - DNA, 15 bp, Homo sapiens
actttacagaaatgg

SEQ ID NO: 2351712 - DNA, 16 bp, Homo sapiens
actttactttcaagta

SEQ ID NO: 2351713 - DNA, 13 bp, Homo sapiens
actttattgctat

SEQ ID NO: 2351714 - DNA, 20 bp, Homo sapiens
actttcaaaatgaattttta

SEQ ID NO: 2351715 - DNA, 18 bp, Homo sapiens
actttcacttcttcctat

SEQ ID NO: 2351716 - DNA, 13 bp, Homo sapiens
actttctcagttt

SEQ ID NO: 2351717 - DNA, 14 bp, Homo sapiens
actttctcagtttt

SEQ ID NO: 2351718 - DNA, 18 bp, Homo sapiens
actttctgttatgggctt

SEQ ID NO: 2351719 - DNA, 19 bp, Homo sapiens
actttgaaaagttggaagg

SEQ ID NO: 2351720 - DNA, 21 bp, Homo sapiens
actttgaagggcaagaaatgg

SEQ ID NO: 2351721 - DNA, 23 bp, Homo sapiens
actttgaagggcaagaaatggcg

SEQ ID NO: 2351722 - DNA, 15 bp, Homo sapiens
actttgatctctgct

SEQ ID NO: 2351723 - DNA, 19 bp, Homo sapiens
actttgggaaaacatgtta

SEQ ID NO: 2351724 - DNA, 19 bp, Homo sapiens
actttgggattctttccat

SEQ ID NO: 2351725 - DNA, 17 bp, Homo sapiens
actttgtaaaaatcttt

SEQ ID NO: 2351726 - DNA, 14 bp, Homo sapiens
actttgtattttga

SEQ ID NO: 2351727 - DNA, 15 bp, Homo sapiens
actttgtgttcattt

SEQ ID NO: 2351728 - DNA, 17 bp, Homo sapiens
actttgttgcaagatgt

SEQ ID NO: 2351729 - DNA, 20 bp, Homo sapiens
actttgttgcaagatgtgaa

SEQ ID NO: 2351730 - DNA, 18 bp, Homo sapiens
acttttaaggataaatca

SEQ ID NO: 2351731 - DNA, 16 bp, Homo sapiens
acttttataaagcatg

SEQ ID NO: 2351732 - DNA, 16 bp, Homo sapiens
acttttgtactgaatt

SEQ ID NO: 2351733 - DNA, 14 bp, Homo sapiens
actttttaaattac

SEQ ID NO: 2351734 - DNA, 13 bp, Homo sapiens
actttttgcattt

SEQ ID NO: 2351735 - DNA, 16 bp, Homo sapiens
agaaaaaaaagtgtct

SEQ ID NO: 2351736 - DNA, 14 bp, Homo sapiens
agaaaaaggggcct

SEQ ID NO: 2351737 - DNA, 15 bp, Homo sapiens
agaaaaataaccctt

SEQ ID NO: 2351738 - DNA, 21 bp, Homo sapiens
agaaaaatctcattatttcaa

SEQ ID NO: 2351739 - DNA, 22 bp, Homo sapiens
agaaaaatctcattatttcaaa

SEQ ID NO: 2351740 - DNA, 21 bp, Homo sapiens
agaaaacaaaaaacgaatgaa

SEQ ID NO: 2351741 - DNA, 14 bp, Homo sapiens
agaaaagtgaattg

SEQ ID NO: 2351742 - DNA, 19 bp, Homo sapiens
agaaaagtgaattgaagtt

SEQ ID NO: 2351743 - DNA, 19 bp, Homo sapiens
agaaaatgagccatttttt

SEQ ID NO: 2351744 - DNA, 19 bp, Homo sapiens
agaaaatgtgaccctccaa

SEQ ID NO: 2351745 - DNA, 22 bp, Homo sapiens
agaaaattgagttgcacttatt

SEQ ID NO: 2351746 - DNA, 19 bp, Homo sapiens
agaaacactgaaaagaagg

SEQ ID NO: 2351747 - DNA, 15 bp, Homo sapiens
agaaacagtttaaca

SEQ ID NO: 2351748 - DNA, 16 bp, Homo sapiens
agaaacagtttaacag

SEQ ID NO: 2351749 - DNA, 17 bp, Homo sapiens
agaaacagtttaacaga

SEQ ID NO: 2351750 - DNA, 15 bp, Homo sapiens
agaaacgcctgcccc

SEQ ID NO: 2351751 - DNA, 12 bp, Homo sapiens
agaaagaagcca

SEQ ID NO: 2351752 - DNA, 12 bp, Homo sapiens
agaaataaatga

SEQ ID NO: 2351753 - DNA, 17 bp, Homo sapiens
agaaatataacacattt

SEQ ID NO: 2351754 - DNA, 16 bp, Homo sapiens
agaaatctttctccct

SEQ ID NO: 2351755 - DNA, 22 bp, Homo sapiens
agaaatgcatatttgccacaaa

SEQ ID NO: 2351756 - DNA, 16 bp, Homo sapiens
agaaatggcgtctgct

SEQ ID NO: 2351757 - DNA, 14 bp, Homo sapiens
agaaattttgtaag

SEQ ID NO: 2351758 - DNA, 21 bp, Homo sapiens
agaaattttgtaagaaggcaa

SEQ ID NO: 2351759 - DNA, 20 bp, Homo sapiens
agaacacgttgccaggggct

SEQ ID NO: 2351760 - DNA, 18 bp, Homo sapiens
agaacactaactcaccag

SEQ ID NO: 2351761 - DNA, 20 bp, Homo sapiens
agaacactaactcaccagcc

SEQ ID NO: 2351762 - DNA, 12 bp, Homo sapiens
agaacagcttca

SEQ ID NO: 2351763 - DNA, 13 bp, Homo sapiens
agaacagcttcag

SEQ ID NO: 2351764 - DNA, 14 bp, Homo sapiens
agaacatactgatt

SEQ ID NO: 2351765 - DNA, 16 bp, Homo sapiens
agaaccagagggcatg

SEQ ID NO: 2351766 - DNA, 19 bp, Homo sapiens
agaaccagagggcatgctg

SEQ ID NO: 2351767 - DNA, 23 bp, Homo sapiens
agaaccagagggcatgctgaatg

SEQ ID NO: 2351768 - DNA, 16 bp, Homo sapiens
agaacccaagtgcctc

SEQ ID NO: 2351769 - DNA, 17 bp, Homo sapiens
agaacctgcacacagga

SEQ ID NO: 2351770 - DNA, 21 bp, Homo sapiens
agaacctgcacacaggacagc

SEQ ID NO: 2351771 - DNA, 23 bp, Homo sapiens
agaaccttgtcccagccagtgag

SEQ ID NO: 2351772 - DNA, 17 bp, Homo sapiens
agaactagccaaaccag

SEQ ID NO: 2351773 - DNA, 19 bp, Homo sapiens
agaactagccaaaccagga

SEQ ID NO: 2351774 - DNA, 16 bp, Homo sapiens
agaactccaggccctc

SEQ ID NO: 2351775 - DNA, 18 bp, Homo sapiens
agaactcgcgctcagtaa

SEQ ID NO: 2351776 - DNA, 20 bp, Homo sapiens
agaactcgcgctcagtaaac

SEQ ID NO: 2351777 - DNA, 21 bp, Homo sapiens
agaactcgcgctcagtaaacg

SEQ ID NO: 2351778 - DNA, 13 bp, Homo sapiens
agaactctctgga

SEQ ID NO: 2351779 - DNA, 21 bp, Homo sapiens
agaactctctggaagcccctg

SEQ ID NO: 2351780 - DNA, 14 bp, Homo sapiens
agaactctggcttt

SEQ ID NO: 2351781 - DNA, 20 bp, Homo sapiens
agaactctggcttttggaag

SEQ ID NO: 2351782 - DNA, 14 bp, Homo sapiens
agaactgtctgtga

SEQ ID NO: 2351783 - DNA, 22 bp, Homo sapiens
agaacttagcctttacctgtga

SEQ ID NO: 2351784 - DNA, 16 bp, Homo sapiens
aactctgcttgatttt

SEQ ID NO: 2351785 - DNA, 18 bp, Homo sapiens
aactctgtataatagaga

SEQ ID NO: 2351786 - DNA, 23 bp, Homo sapiens
aactctgtataatagagataagt

SEQ ID NO: 2351787 - DNA, 15 bp, Homo sapiens
aactcttatctcagt

SEQ ID NO: 2351788 - DNA, 17 bp, Homo sapiens
aactgaagacctccaca

SEQ ID NO: 2351789 - DNA, 10 bp, Homo sapiens
aactgaaggg

SEQ ID NO: 2351790 - DNA, 14 bp, Homo sapiens
aactgagagaaaga

SEQ ID NO: 2351791 - DNA, 18 bp, Homo sapiens
aactgaggaatttcacct

SEQ ID NO: 2351792 - DNA, 19 bp, Homo sapiens
aactgcctggggggcaggg

SEQ ID NO: 2351793 - DNA, 13 bp, Homo sapiens
aactgctcctcct

SEQ ID NO: 2351794 - DNA, 15 bp, Homo sapiens
aactggaataatatt

SEQ ID NO: 2351795 - DNA, 16 bp, Homo sapiens
aactggtattgtttac

SEQ ID NO: 2351796 - DNA, 11 bp, Homo sapiens
aactgtattta

SEQ ID NO: 2351797 - DNA, 17 bp, Homo sapiens
aactgtatttacttgtt

SEQ ID NO: 2351798 - DNA, 22 bp, Homo sapiens
aactgtatttacttgttatgtt

SEQ ID NO: 2351799 - DNA, 18 bp, Homo sapiens
aactgtccgtaagcagta

SEQ ID NO: 2351800 - DNA, 14 bp, Homo sapiens
aactgtcctttcct

SEQ ID NO: 2351801 - DNA, 14 bp, Homo sapiens
aactgtcttcctca

SEQ ID NO: 2351802 - DNA, 13 bp, Homo sapiens
aactgtgtggcag

SEQ ID NO: 2351803 - DNA, 18 bp, Homo sapiens
aacttaaagctactgtag

SEQ ID NO: 2351804 - DNA, 14 bp, Homo sapiens
aacttaagcaaagg

SEQ ID NO: 2351805 - DNA, 13 bp, Homo sapiens
aacttagctcagg

SEQ ID NO: 2351806 - DNA, 19 bp, Homo sapiens
aacttagctcaggtgcctt

SEQ ID NO: 2351807 - DNA, 13 bp, Homo sapiens
aacttcatttgac

SEQ ID NO: 2351808 - DNA, 14 bp, Homo sapiens
aacttcatttgaca

SEQ ID NO: 2351809 - DNA, 22 bp, Homo sapiens
aacttcatttgacacaaagctt

SEQ ID NO: 2351810 - DNA, 16 bp, Homo sapiens
aacttccaaagaaagt

SEQ ID NO: 2351811 - DNA, 22 bp, Homo sapiens
aacttctgcaacaagcatgcag

SEQ ID NO: 2351812 - DNA, 22 bp, Homo sapiens
aacttgcacttgttatattata

SEQ ID NO: 2351813 - DNA, 14 bp, Homo sapiens
aacttgcttaaatt

SEQ ID NO: 2351814 - DNA, 16 bp, Homo sapiens
agaaggcttctctcca

SEQ ID NO: 2351815 - DNA, 16 bp, Homo sapiens
agaagggagaagaaag

SEQ ID NO: 2351816 - DNA, 20 bp, Homo sapiens
agaagtaagaggctacctct

SEQ ID NO: 2351817 - DNA, 15 bp, Homo sapiens
agaagtctggaaaaa

SEQ ID NO: 2351818 - DNA, 15 bp, Homo sapiens
agaagtctggctttg

SEQ ID NO: 2351819 - DNA, 18 bp, Homo sapiens
agaagtctggctttgctc

SEQ ID NO: 2351820 - DNA, 18 bp, Homo sapiens
agaagtgggggcagccca

SEQ ID NO: 2351821 - DNA, 19 bp, Homo sapiens
agaagtgggggcagcccag

SEQ ID NO: 2351822 - DNA, 14 bp, Homo sapiens
agaataaaattcct

SEQ ID NO: 2351823 - DNA, 21 bp, Homo sapiens
agaataatcacgctttcctga

SEQ ID NO: 2351824 - DNA, 17 bp, Homo sapiens
agaataccacatcaaat

SEQ ID NO: 2351825 - DNA, 13 bp, Homo sapiens
agaatatttacta

SEQ ID NO: 2351826 - DNA, 19 bp, Homo sapiens
agaatatttctattgaatt

SEQ ID NO: 2351827 - DNA, 23 bp, Homo sapiens
agaatatttttatatttccttta

SEQ ID NO: 2351828 - DNA, 19 bp, Homo sapiens
agaatcttgttttgaaaat

SEQ ID NO: 2351829 - DNA, 21 bp, Homo sapiens
agaatgaaagctgttccttgg

SEQ ID NO: 2351830 - DNA, 20 bp, Homo sapiens
agaatgagtccttgatttca

SEQ ID NO: 2351831 - DNA, 21 bp, Homo sapiens
agaatgagtccttgatttcaa

SEQ ID NO: 2351832 - DNA, 14 bp, Homo sapiens
agaatgccatttct

SEQ ID NO: 2351833 - DNA, 18 bp, Homo sapiens
agaattctgattgatttg

SEQ ID NO: 2351834 - DNA, 23 bp, Homo sapiens
agaattctgattgatttgattgg

SEQ ID NO: 2351835 - DNA, 12 bp, Homo sapiens
agaatttgagaa

SEQ ID NO: 2351836 - DNA, 19 bp, Homo sapiens
agacaaaaagtatattaaa

SEQ ID NO: 2351837 - DNA, 17 bp, Homo sapiens
agacaaaatttgagaat

SEQ ID NO: 2351838 - DNA, 12 bp, Homo sapiens
agacaaatattc

SEQ ID NO: 2351839 - DNA, 14 bp, Homo sapiens
agacaaatggagga

SEQ ID NO: 2351840 - DNA, 14 bp, Homo sapiens
agacaacctttctg

SEQ ID NO: 2351841 - DNA, 23 bp, Homo sapiens
agacaaggctggcaaaccctccc

SEQ ID NO: 2351842 - DNA, 15 bp, Homo sapiens
agacaaggtgctaac

SEQ ID NO: 2351843 - DNA, 18 bp, Homo sapiens
agacaagtaatttcagtg

SEQ ID NO: 2351844 - DNA, 17 bp, Homo sapiens
agacaatgttttcttca

SEQ ID NO: 2351845 - DNA, 20 bp, Homo sapiens
agacacattttttaggaaat

SEQ ID NO: 2351846 - DNA, 13 bp, Homo sapiens
agacaccagagca

SEQ ID NO: 2351847 - DNA, 14 bp, Homo sapiens
agacactgttgata

SEQ ID NO: 2351848 - DNA, 17 bp, Homo sapiens
agacactgttgataaaa

SEQ ID NO: 2351849 - DNA, 15 bp, Homo sapiens
agacagagacaagta

SEQ ID NO: 2351850 - DNA, 17 bp, Homo sapiens
agacagagacaagtaat

SEQ ID NO: 2351851 - DNA, 23 bp, Homo sapiens
agacagaggaaagggctggctcc

SEQ ID NO: 2351852 - DNA, 15 bp, Homo sapiens
agacagaggatgtgg

SEQ ID NO: 2351853 - DNA, 23 bp, Homo sapiens
agacagggtcttgctctgtcccc

SEQ ID NO: 2351854 - DNA, 19 bp, Homo sapiens
agacagggtgggcttcctg

SEQ ID NO: 2351855 - DNA, 21 bp, Homo sapiens
agacagggtgggcttcctgcc

SEQ ID NO: 2351856 - DNA, 13 bp, Homo sapiens
agacagtttctta

SEQ ID NO: 2351857 - DNA, 20 bp, Homo sapiens
agacagtttcttagcttttt

SEQ ID NO: 2351858 - DNA, 21 bp, Homo sapiens
agacagtttcttagcttttta

SEQ ID NO: 2351859 - DNA, 22 bp, Homo sapiens
agacagtttcttagctttttaa

SEQ ID NO: 2351860 - DNA, 17 bp, Homo sapiens
agacataacgtttttcc

SEQ ID NO: 2351861 - DNA, 20 bp, Homo sapiens
agacataacgtttttccttt

SEQ ID NO: 2351862 - DNA, 16 bp, Homo sapiens
agacatacagctgcct

SEQ ID NO: 2351863 - DNA, 15 bp, Homo sapiens
agacatactgcttga

SEQ ID NO: 2351864 - DNA, 22 bp, Homo sapiens
agacatactgcttgattttaat

SEQ ID NO: 2351865 - DNA, 20 bp, Homo sapiens
agacatggacctccaggctc

SEQ ID NO: 2351866 - DNA, 20 bp, Homo sapiens
agacatgtctgttctacata

SEQ ID NO: 2351867 - DNA, 12 bp, Homo sapiens
agacatttcaaa

SEQ ID NO: 2351868 - DNA, 13 bp, Homo sapiens
agacatttcaaaa

SEQ ID NO: 2351869 - DNA, 18 bp, Homo sapiens
agacatttgtttgctgta

SEQ ID NO: 2351870 - DNA, 21 bp, Homo sapiens
agacatttgtttgctgtacag

SEQ ID NO: 2351871 - DNA, 15 bp, Homo sapiens
agacattttaagttt

SEQ ID NO: 2351872 - DNA, 20 bp, Homo sapiens
agaccacagggttcaaaatg

SEQ ID NO: 2351873 - DNA, 14 bp, Homo sapiens
agaccatcctggct

SEQ ID NO: 2351874 - DNA, 17 bp, Homo sapiens
agacccccatttgtccc

SEQ ID NO: 2351875 - DNA, 21 bp, Homo sapiens
agacccccatttgtcccagac

SEQ ID NO: 2351876 - DNA, 18 bp, Homo sapiens
agacccccccccaactcc

SEQ ID NO: 2351877 - DNA, 24 bp, Homo sapiens
agacccctaaccctttgtgtgctc

SEQ ID NO: 2351878 - DNA, 20 bp, Homo sapiens
agaccctactgaagtggctg

SEQ ID NO: 2351879 - DNA, 14 bp, Homo sapiens
agaccctatctccc

SEQ ID NO: 2351880 - DNA, 18 bp, Homo sapiens
agaccctatctcccacaa

SEQ ID NO: 2351881 - DNA, 19 bp, Homo sapiens
agaccctcttgcccatcct

SEQ ID NO: 2351882 - DNA, 16 bp, Homo sapiens
agaccctgccacagcc

SEQ ID NO: 2351883 - DNA, 20 bp, Homo sapiens
agaccctgggtgggctctgt

SEQ ID NO: 2351884 - DNA, 16 bp, Homo sapiens
agaccgagaggccagt

SEQ ID NO: 2351885 - DNA, 15 bp, Homo sapiens
agacctagcaggctg

SEQ ID NO: 2351886 - DNA, 15 bp, Homo sapiens
agacctcaagccatc

SEQ ID NO: 2351887 - DNA, 15 bp, Homo sapiens
agacctcatgcccag

SEQ ID NO: 2351888 - DNA, 20 bp, Homo sapiens
agacctcatgcccagctctc

SEQ ID NO: 2351889 - DNA, 13 bp, Homo sapiens
agacctccacatt

SEQ ID NO: 2351890 - DNA, 22 bp, Homo sapiens
agacctgagtattttttataat

SEQ ID NO: 2351891 - DNA, 15 bp, Homo sapiens
agacctgggatttga

SEQ ID NO: 2351892 - DNA, 18 bp, Homo sapiens
agacgccactccctggga

SEQ ID NO: 2351893 - DNA, 17 bp, Homo sapiens
agacgtcaggccctgac

SEQ ID NO: 2351894 - DNA, 14 bp, Homo sapiens
agacgttgcctgag

SEQ ID NO: 2351895 - DNA, 16 bp, Homo sapiens
agacgtttataaacag

SEQ ID NO: 2351896 - DNA, 21 bp, Homo sapiens
agacgtttataaacagaaatg

SEQ ID NO: 2351897 - DNA, 16 bp, Homo sapiens
agactaaaagttgcat

SEQ ID NO: 2351898 - DNA, 19 bp, Homo sapiens
agactaccggacactcgtc

SEQ ID NO: 2351899 - DNA, 18 bp, Homo sapiens
agactctttttttgagtg

SEQ ID NO: 2351900 - DNA, 13 bp, Homo sapiens
agactgggcccca

SEQ ID NO: 2351901 - DNA, 21 bp, Homo sapiens
agactgtaacttccaaataaa

SEQ ID NO: 2351902 - DNA, 23 bp, Homo sapiens
agactgtagatatgtattctttt

SEQ ID NO: 2351903 - DNA, 15 bp, Homo sapiens
agactgtttgaatgt

SEQ ID NO: 2351904 - DNA, 21 bp, Homo sapiens
agacttaaagggcccaatgaa

SEQ ID NO: 2351905 - DNA, 14 bp, Homo sapiens
agactttaattata

SEQ ID NO: 2351906 - DNA, 21 bp, Homo sapiens
agactttgtgttcatttcatt

SEQ ID NO: 2351907 - DNA, 12 bp, Homo sapiens
agagaaaataaa

SEQ ID NO: 2351908 - DNA, 19 bp, Homo sapiens
agagagccattttgtgaat

SEQ ID NO: 2351909 - DNA, 12 bp, Homo sapiens
agagaggcacct

SEQ ID NO: 2351910 - DNA, 18 bp, Homo sapiens
agagaggcacctgctgga

SEQ ID NO: 2351911 - DNA, 23 bp, Homo sapiens
agagaggcgcgtctgccccaccc

SEQ ID NO: 2351912 - DNA, 17 bp, Homo sapiens
agagaggtagcgagctg

SEQ ID NO: 2351913 - DNA, 20 bp, Homo sapiens
agagagttagcatgtatgaa

SEQ ID NO: 2351914 - DNA, 17 bp, Homo sapiens
agagatgagcccaccct

SEQ ID NO: 2351915 - DNA, 15 bp, Homo sapiens
agagattataacaaa

SEQ ID NO: 2351916 - DNA, 12 bp, Homo sapiens
agagatttctca

SEQ ID NO: 2351917 - DNA, 13 bp, Homo sapiens
agagatttctcat

SEQ ID NO: 2351918 - DNA, 18 bp, Homo sapiens
agagattttatgtttaaa

SEQ ID NO: 2351919 - DNA, 18 bp, Homo sapiens
agagcaaaagcctcagaa

SEQ ID NO: 2351920 - DNA, 23 bp, Homo sapiens
agagcaagagtctgtctcaaaaa

SEQ ID NO: 2351921 - DNA, 19 bp, Homo sapiens
agagcagctccctttctca

SEQ ID NO: 2351922 - DNA, 21 bp, Homo sapiens
agagcagctccctttctcagg

SEQ ID NO: 2351923 - DNA, 12 bp, Homo sapiens
agagcagctggc

SEQ ID NO: 2351924 - DNA, 17 bp, Homo sapiens
agagcagtcagagtcca

SEQ ID NO: 2351925 - DNA, 17 bp, Homo sapiens
agagcagtggtaagaat

SEQ ID NO: 2351926 - DNA, 19 bp, Homo sapiens
agagcagtggtaagaatag

SEQ ID NO: 2351927 - DNA, 20 bp, Homo sapiens
agagcataatttaaaaatat

SEQ ID NO: 2351928 - DNA, 21 bp, Homo sapiens
agagcataatttaaaaatata

SEQ ID NO: 2351929 - DNA, 14 bp, Homo sapiens
agagccacctgcaa

SEQ ID NO: 2351930 - DNA, 19 bp, Homo sapiens
agagccatgtcttctccct

SEQ ID NO: 2351931 - DNA, 22 bp, Homo sapiens
agagccatgtcttctccctgga

SEQ ID NO: 2351932 - DNA, 14 bp, Homo sapiens
agagcccttgcctc

SEQ ID NO: 2351933 - DNA, 19 bp, Homo sapiens
agagcccttgcctccccat

SEQ ID NO: 2351934 - DNA, 15 bp, Homo sapiens
agagccgggccccgg

SEQ ID NO: 2351935 - DNA, 11 bp, Homo sapiens
agagcctgctg

SEQ ID NO: 2351936 - DNA, 19 bp, Homo sapiens
agagcctgctggcacccac

SEQ ID NO: 2351937 - DNA, 17 bp, Homo sapiens
agagcctggccccaggc

SEQ ID NO: 2351938 - DNA, 15 bp, Homo sapiens
agagccttctcagaa

SEQ ID NO: 2351939 - DNA, 14 bp, Homo sapiens
agagcgccaggaag

SEQ ID NO: 2351940 - DNA, 19 bp, Homo sapiens
agagcgccaggaagccaga

SEQ ID NO: 2351941 - DNA, 20 bp, Homo sapiens
agagctaaactccttcctgg

SEQ ID NO: 2351942 - DNA, 21 bp, Homo sapiens
agagctagctgccactttcac

SEQ ID NO: 2351943 - DNA, 15 bp, Homo sapiens
agagctatggtgagg

SEQ ID NO: 2351944 - DNA, 17 bp, Homo sapiens
agagctcaccatggaat

SEQ ID NO: 2351945 - DNA, 22 bp, Homo sapiens
agagctctccttagcattcata

SEQ ID NO: 2351946 - DNA, 17 bp, Homo sapiens
agagctggagcccccag

SEQ ID NO: 2351947 - DNA, 15 bp, Homo sapiens
agagcttagatttcc

SEQ ID NO: 2351948 - DNA, 15 bp, Homo sapiens
agagcttgctccaga

SEQ ID NO: 2351949 - DNA, 16 bp, Homo sapiens
agagcttgctccagat

SEQ ID NO: 2351950 - DNA, 15 bp, Homo sapiens
agaggaaagggctgg

SEQ ID NO: 2351951 - DNA, 21 bp, Homo sapiens
agaggaatcctggcagcccag

SEQ ID NO: 2351952 - DNA, 13 bp, Homo sapiens
agaggatgagagc

SEQ ID NO: 2351953 - DNA, 12 bp, Homo sapiens
agaggatgcctt

SEQ ID NO: 2351954 - DNA, 22 bp, Homo sapiens
agaggcaagctgaaattttaga

SEQ ID NO: 2351955 - DNA, 13 bp, Homo sapiens
agaggcaggctgg

SEQ ID NO: 2351956 - DNA, 21 bp, Homo sapiens
agaggcagtgatgacttgctg

SEQ ID NO: 2351957 - DNA, 13 bp, Homo sapiens
agaggccaatgcc

SEQ ID NO: 2351958 - DNA, 21 bp, Homo sapiens
agaggcgcgtctgccccaccc

SEQ ID NO: 2351959 - DNA, 16 bp, Homo sapiens
agaggctagcttctgc

SEQ ID NO: 2351960 - DNA, 20 bp, Homo sapiens
agaggctctggacagcagaa

SEQ ID NO: 2351961 - DNA, 21 bp, Homo sapiens
agaggctctggacagcagaag

SEQ ID NO: 2351962 - DNA, 23 bp, Homo sapiens
agaggctctggacagcagaagcc

SEQ ID NO: 2351963 - DNA, 19 bp, Homo sapiens
agaggctgaaagaggccaa

SEQ ID NO: 2351964 - DNA, 18 bp, Homo sapiens
agaggctgcccctctcac

SEQ ID NO: 2351965 - DNA, 16 bp, Homo sapiens
agaggcttctccgcca

SEQ ID NO: 2351966 - DNA, 19 bp, Homo sapiens
agaggcttctccgccagcc

SEQ ID NO: 2351967 - DNA, 21 bp, Homo sapiens
agaggcttctccgccagcctc

SEQ ID NO: 2351968 - DNA, 23 bp, Homo sapiens
agaggcttctccgccagcctcct

SEQ ID NO: 2351969 - DNA, 19 bp, Homo sapiens
agagggagaagcatgaaaa

SEQ ID NO: 2351970 - DNA, 20 bp, Homo sapiens
agagggaggtcactggaaag

SEQ ID NO: 2351971 - DNA, 20 bp, Homo sapiens
agagggagtagaatacgcag

SEQ ID NO: 2351972 - DNA, 15 bp, Homo sapiens
agagggatttccctg

SEQ ID NO: 2351973 - DNA, 16 bp, Homo sapiens
agagggatttccctgc

SEQ ID NO: 2351974 - DNA, 22 bp, Homo sapiens
agagggatttccctgcagacct

SEQ ID NO: 2351975 - DNA, 12 bp, Homo sapiens
agagggggtgga

SEQ ID NO: 2351976 - DNA, 16 bp, Homo sapiens
agagggtatttttgta

SEQ ID NO: 2351977 - DNA, 22 bp, Homo sapiens
agagggtgtggctttccaggca

SEQ ID NO: 2351978 - DNA, 22 bp, Homo sapiens
agaggtaacagaacagcttcag

SEQ ID NO: 2351979 - DNA, 17 bp, Homo sapiens
agaggtagcgagctgct

SEQ ID NO: 2351980 - DNA, 23 bp, Homo sapiens
agaggtagcgagctgctctgcta

SEQ ID NO: 2351981 - DNA, 22 bp, Homo sapiens
agaggtcaggacggctcctcag

SEQ ID NO: 2351982 - DNA, 17 bp, Homo sapiens
agaggtcctctggagcc

SEQ ID NO: 2351983 - DNA, 22 bp, Homo sapiens
agaggtggatgttatgaacagc

SEQ ID NO: 2351984 - DNA, 21 bp, Homo sapiens
agagtaaaggaaataagagca

SEQ ID NO: 2351985 - DNA, 14 bp, Homo sapiens
agagtatttccctt

SEQ ID NO: 2351986 - DNA, 15 bp, Homo sapiens
agagtcagctctctg

SEQ ID NO: 2351987 - DNA, 19 bp, Homo sapiens
agagtccagtgctctgcct

SEQ ID NO: 2351988 - DNA, 23 bp, Homo sapiens
agagtccagtgctctgcctcaga

SEQ ID NO: 2351989 - DNA, 19 bp, Homo sapiens
agagtccggatttctaaca

SEQ ID NO: 2351990 - DNA, 23 bp, Homo sapiens
agagtctggtgaagctcacttct

SEQ ID NO: 2351991 - DNA, 18 bp, Homo sapiens
agagtgatttgtaaaaca

SEQ ID NO: 2351992 - DNA, 19 bp, Homo sapiens
agagtgcaacccagtcaca

SEQ ID NO: 2351993 - DNA, 12 bp, Homo sapiens
agagtggcccac

SEQ ID NO: 2351994 - DNA, 12 bp, Homo sapiens
agagtgtagaag

SEQ ID NO: 2351995 - DNA, 22 bp, Homo sapiens
agagtgtagaagcattccttct

SEQ ID NO: 2351996 - DNA, 18 bp, Homo sapiens
agagtgtagactgtggct

SEQ ID NO: 2351997 - DNA, 15 bp, Homo sapiens
agagttaagaagctg

SEQ ID NO: 2351998 - DNA, 13 bp, Homo sapiens
agagttagcatgt

SEQ ID NO: 2351999 - DNA, 12 bp, Homo sapiens
agagttccttct

SEQ ID NO: 2352000 - DNA, 17 bp, Homo sapiens
agataaagaccagaaat

SEQ ID NO: 2352001 - DNA, 18 bp, Homo sapiens
agataaagaccagaaatt

SEQ ID NO: 2352002 - DNA, 19 bp, Homo sapiens
agataaagaccagaaattc

SEQ ID NO: 2352003 - DNA, 20 bp, Homo sapiens
agataactctctttccttga

SEQ ID NO: 2352004 - DNA, 13 bp, Homo sapiens
agataagcaagag

SEQ ID NO: 2352005 - DNA, 17 bp, Homo sapiens
agataagcaagagagat

SEQ ID NO: 2352006 - DNA, 14 bp, Homo sapiens
agcagcagcccaag

SEQ ID NO: 2352007 - DNA, 18 bp, Homo sapiens
agcagcccaagcttccct

SEQ ID NO: 2352008 - DNA, 21 bp, Homo sapiens
agcagcccaagcttccctcca

SEQ ID NO: 2352009 - DNA, 16 bp, Homo sapiens
agcagcctctggacag

SEQ ID NO: 2352010 - DNA, 11 bp, Homo sapiens
agcagctacca

SEQ ID NO: 2352011 - DNA, 21 bp, Homo sapiens
agcagctcatagaattttgag

SEQ ID NO: 2352012 - DNA, 18 bp, Homo sapiens
agcagctccctttctcag

SEQ ID NO: 2352013 - DNA, 17 bp, Homo sapiens
agcagctggtcagtctt

SEQ ID NO: 2352014 - DNA, 21 bp, Homo sapiens
agcagctggtcagtctttgct

SEQ ID NO: 2352015 - DNA, 20 bp, Homo sapiens
agcaggaatatatgtgtgcc

SEQ ID NO: 2352016 - DNA, 21 bp, Homo sapiens
agcaggaggcccttgtcgtgg

SEQ ID NO: 2352017 - DNA, 13 bp, Homo sapiens
agcaggctgttcc

SEQ ID NO: 2352018 - DNA, 14 bp, Homo sapiens
agcaggctgttcca

SEQ ID NO: 2352019 - DNA, 19 bp, Homo sapiens
agcaggtgattggaccagg

SEQ ID NO: 2352020 - DNA, 11 bp, Homo sapiens
agcagtatttt

SEQ ID NO: 2352021 - DNA, 17 bp, Homo sapiens
agcataatttaaaaata

SEQ ID NO: 2352022 - DNA, 22 bp, Homo sapiens
agcataatttaaaaatatattt

SEQ ID NO: 2352023 - DNA, 20 bp, Homo sapiens
agcatagaaaccactagaaa

SEQ ID NO: 2352024 - DNA, 20 bp, Homo sapiens
agcatcttcacttctaaatg

SEQ ID NO: 2352025 - DNA, 12 bp, Homo sapiens
agcatcttctgg

SEQ ID NO: 2352026 - DNA, 19 bp, Homo sapiens
agcatgatggctgtagctg

SEQ ID NO: 2352027 - DNA, 14 bp, Homo sapiens
agcatgcttccttt

SEQ ID NO: 2352028 - DNA, 15 bp, Homo sapiens
agcatgcttcctttc

SEQ ID NO: 2352029 - DNA, 21 bp, Homo sapiens
agcatgcttcctttctctcct

SEQ ID NO: 2352030 - DNA, 17 bp, Homo sapiens
agcatggacatttagaa

SEQ ID NO: 2352031 - DNA, 22 bp, Homo sapiens
agcatgtatgaatgtaaggatg

SEQ ID NO: 2352032 - DNA, 21 bp, Homo sapiens
agcattccttctttgataatg

SEQ ID NO: 2352033 - DNA, 23 bp, Homo sapiens
agcattccttctttgataatgtt

SEQ ID NO: 2352034 - DNA, 19 bp, Homo sapiens
agcattctttggagttaaa

SEQ ID NO: 2352035 - DNA, 22 bp, Homo sapiens
agcattctttggagttaaaatg

SEQ ID NO: 2352036 - DNA, 13 bp, Homo sapiens
agcatttaaaatg

SEQ ID NO: 2352037 - DNA, 14 bp, Homo sapiens
agcatttcatgaaa

SEQ ID NO: 2352038 - DNA, 16 bp, Homo sapiens
agcattttagaaacta

SEQ ID NO: 2352039 - DNA, 14 bp, Homo sapiens
agcattttcacatt

SEQ ID NO: 2352040 - DNA, 21 bp, Homo sapiens
agcatttttattatatttatg

SEQ ID NO: 2352041 - DNA, 16 bp, Homo sapiens
agcatttttcaatata

SEQ ID NO: 2352042 - DNA, 22 bp, Homo sapiens
agcatttttcaatatattgaac

SEQ ID NO: 2352043 - DNA, 17 bp, Homo sapiens
agccaaaagtccctccc

SEQ ID NO: 2352044 - DNA, 19 bp, Homo sapiens
agccaaaagtccctccctg

SEQ ID NO: 2352045 - DNA, 20 bp, Homo sapiens
agccaacaactctgccttta

SEQ ID NO: 2352046 - DNA, 20 bp, Homo sapiens
agccaagattttcctcttgt

SEQ ID NO: 2352047 - DNA, 15 bp, Homo sapiens
agccaagcgctcatg

SEQ ID NO: 2352048 - DNA, 16 bp, Homo sapiens
agccaagctttaaatt

SEQ ID NO: 2352049 - DNA, 22 bp, Homo sapiens
agccaagctttaaattatgtga

SEQ ID NO: 2352050 - DNA, 13 bp, Homo sapiens
agccaagtggggt

SEQ ID NO: 2352051 - DNA, 16 bp, Homo sapiens
agccaagtggggtgct

SEQ ID NO: 2352052 - DNA, 22 bp, Homo sapiens
agccaatctacaatctcttttt

SEQ ID NO: 2352053 - DNA, 16 bp, Homo sapiens
agccaatgtctcctcc

SEQ ID NO: 2352054 - DNA, 12 bp, Homo sapiens
agccacaagctg

SEQ ID NO: 2352055 - DNA, 21 bp, Homo sapiens
agccacaagctgcactgtgaa

SEQ ID NO: 2352056 - DNA, 13 bp, Homo sapiens
agccacagctgct

SEQ ID NO: 2352057 - DNA, 21 bp, Homo sapiens
agccacagctgctgttctcag

SEQ ID NO: 2352058 - DNA, 22 bp, Homo sapiens
agccacaggaaggaggggagag

SEQ ID NO: 2352059 - DNA, 23 bp, Homo sapiens
agccacaggaaggaggggagaga

SEQ ID NO: 2352060 - DNA, 11 bp, Homo sapiens
agccacctgca

SEQ ID NO: 2352061 - DNA, 13 bp, Homo sapiens
agccacctgcaag

SEQ ID NO: 2352062 - DNA, 15 bp, Homo sapiens
agccactcccctcca

SEQ ID NO: 2352063 - DNA, 21 bp, Homo sapiens
agccagacaaaatttgagaat

SEQ ID NO: 2352064 - DNA, 17 bp, Homo sapiens
agccagaggagggcaga

SEQ ID NO: 2352065 - DNA, 22 bp, Homo sapiens
agccagaggagggcagagggag

SEQ ID NO: 2352066 - DNA, 21 bp, Homo sapiens
agccagcagcagcccaagctt

SEQ ID NO: 2352067 - DNA, 19 bp, Homo sapiens
agccagccaagctttaaat

SEQ ID NO: 2352068 - DNA, 20 bp, Homo sapiens
agccagccaagctttaaatt

SEQ ID NO: 2352069 - DNA, 16 bp, Homo sapiens
agccagcccctcttcc

SEQ ID NO: 2352070 - DNA, 13 bp, Homo sapiens
agccagctttccc

SEQ ID NO: 2352071 - DNA, 14 bp, Homo sapiens
agccagctttccct

SEQ ID NO: 2352072 - DNA, 16 bp, Homo sapiens
agccaggaggcctgct

SEQ ID NO: 2352073 - DNA, 20 bp, Homo sapiens
agccaggatcatggtgtaat

SEQ ID NO: 2352074 - DNA, 22 bp, Homo sapiens
agccaggatcatggtgtaataa

SEQ ID NO: 2352075 - DNA, 23 bp, Homo sapiens
agccaggcagaggttttaatgtc

SEQ ID NO: 2352076 - DNA, 13 bp, Homo sapiens
agccaggcctggc

SEQ ID NO: 2352077 - DNA, 16 bp, Homo sapiens
agccagtgacctttga

SEQ ID NO: 2352078 - DNA, 21 bp, Homo sapiens
agccagtgacctttgacctcg

SEQ ID NO: 2352079 - DNA, 18 bp, Homo sapiens
agccagtggcgggtgatg

SEQ ID NO: 2352080 - DNA, 19 bp, Homo sapiens
agccagtggggaagtgcgt

SEQ ID NO: 2352081 - DNA, 17 bp, Homo sapiens
agccatagaccctgagg

SEQ ID NO: 2352082 - DNA, 19 bp, Homo sapiens
agccatatatgaccagaag

SEQ ID NO: 2352083 - DNA, 17 bp, Homo sapiens
agccatattcacacctc

SEQ ID NO: 2352084 - DNA, 19 bp, Homo sapiens
agccatcctccctccacct

SEQ ID NO: 2352085 - DNA, 23 bp, Homo sapiens
agccatctcatgaggggagagga

SEQ ID NO: 2352086 - DNA, 21 bp, Homo sapiens
agccatgccgtctgccggacc

SEQ ID NO: 2352087 - DNA, 15 bp, Homo sapiens
agccatgtcttctcc

SEQ ID NO: 2352088 - DNA, 14 bp, Homo sapiens
agcccaagcttccc

SEQ ID NO: 2352089 - DNA, 16 bp, Homo sapiens
agcccaagcttccctc

SEQ ID NO: 2352090 - DNA, 19 bp, Homo sapiens
agcccaagcttccctccat

SEQ ID NO: 2352091 - DNA, 23 bp, Homo sapiens
agcccaccagacgtcaggccctg

SEQ ID NO: 2352092 - DNA, 22 bp, Homo sapiens
agcccacgcccgactagcaggc

SEQ ID NO: 2352093 - DNA, 17 bp, Homo sapiens
agcccagaggtaacaga

SEQ ID NO: 2352094 - DNA, 20 bp, Homo sapiens
agcccagaggtaacagaaca

SEQ ID NO: 2352095 - DNA, 21 bp, Homo sapiens
agcccagattcccctgtgtca

SEQ ID NO: 2352096 - DNA, 11 bp, Homo sapiens
agcccagccca

SEQ ID NO: 2352097 - DNA, 19 bp, Homo sapiens
agcccagccccactcctct

SEQ ID NO: 2352098 - DNA, 20 bp, Homo sapiens
agcccagcccctactgctgt

SEQ ID NO: 2352099 - DNA, 23 bp, Homo sapiens
agcccaggatactggcacagagg

SEQ ID NO: 2352100 - DNA, 17 bp, Homo sapiens
agcccatggagattgac

SEQ ID NO: 2352101 - DNA, 19 bp, Homo sapiens
agcccatggagattgacct

SEQ ID NO: 2352102 - DNA, 13 bp, Homo sapiens
agccccactcctc

SEQ ID NO: 2352103 - DNA, 20 bp, Homo sapiens
agccccactgccagcagcag

SEQ ID NO: 2352104 - DNA, 10 bp, Homo sapiens
agccccaggg

SEQ ID NO: 2352105 - DNA, 13 bp, Homo sapiens
agccccagtgctg

SEQ ID NO: 2352106 - DNA, 19 bp, Homo sapiens
agccccatcagaacctgag

SEQ ID NO: 2352107 - DNA, 13 bp, Homo sapiens
agcccccaccctg

SEQ ID NO: 2352108 - DNA, 17 bp, Homo sapiens
agcccccagcagaggca

SEQ ID NO: 2352109 - DNA, 18 bp, Homo sapiens
agcccccagcagaggcag

SEQ ID NO: 2352110 - DNA, 15 bp, Homo sapiens
agcccccgccccaga

SEQ ID NO: 2352111 - DNA, 17 bp, Homo sapiens
agcccccgccccagagt

SEQ ID NO: 2352112 - DNA, 23 bp, Homo sapiens
agccccgcgaccatgtggccaca

SEQ ID NO: 2352113 - DNA, 19 bp, Homo sapiens
agccccggtggctgggcag

SEQ ID NO: 2352114 - DNA, 17 bp, Homo sapiens
agcccctactgctgtga

SEQ ID NO: 2352115 - DNA, 18 bp, Homo sapiens
agcccctatagcactgag

SEQ ID NO: 2352116 - DNA, 19 bp, Homo sapiens
agcccctatagcactgagc

SEQ ID NO: 2352117 - DNA, 12 bp, Homo sapiens
agcccctcttcc

SEQ ID NO: 2352118 - DNA, 17 bp, Homo sapiens
agcccctcttccccaat

SEQ ID NO: 2352119 - DNA, 14 bp, Homo sapiens
agcccgcagggcca

SEQ ID NO: 2352120 - DNA, 20 bp, Homo sapiens
agcccgcagggccatgcaga

SEQ ID NO: 2352121 - DNA, 13 bp, Homo sapiens
agccctactccct

SEQ ID NO: 2352122 - DNA, 15 bp, Homo sapiens
agcccttccctgagt

SEQ ID NO: 2352123 - DNA, 22 bp, Homo sapiens
agcccttgcacagctggagaaa

SEQ ID NO: 2352124 - DNA, 13 bp, Homo sapiens
agcccttgcctcc

SEQ ID NO: 2352125 - DNA, 17 bp, Homo sapiens
agcctagcacagcagct

SEQ ID NO: 2352126 - DNA, 13 bp, Homo sapiens
agcctatagtaaa

SEQ ID NO: 2352127 - DNA, 18 bp, Homo sapiens
agcctatagtaaatgtgt

SEQ ID NO: 2352128 - DNA, 17 bp, Homo sapiens
agcctatttttttagat

SEQ ID NO: 2352129 - DNA, 13 bp, Homo sapiens
agcctcagactgg

SEQ ID NO: 2352130 - DNA, 14 bp, Homo sapiens
agcctcagactgga

SEQ ID NO: 2352131 - DNA, 18 bp, Homo sapiens
agcctcatactcctgggc

SEQ ID NO: 2352132 - DNA, 14 bp, Homo sapiens
agcctccacagcga

SEQ ID NO: 2352133 - DNA, 21 bp, Homo sapiens
agcctccacagcgagggcagc

SEQ ID NO: 2352134 - DNA, 18 bp, Homo sapiens
agcctccccatctgtcca

SEQ ID NO: 2352135 - DNA, 17 bp, Homo sapiens
agcctccgccattccaa

SEQ ID NO: 2352136 - DNA, 18 bp, Homo sapiens
agcctcctgtgcctggcc

SEQ ID NO: 2352137 - DNA, 22 bp, Homo sapiens
agcctcctgtgcctggccccag

SEQ ID NO: 2352138 - DNA, 18 bp, Homo sapiens
agcctctcagtgccctcc

SEQ ID NO: 2352139 - DNA, 18 bp, Homo sapiens
agcctctctctccctccc

SEQ ID NO: 2352140 - DNA, 13 bp, Homo sapiens
agcctgaggtccc

SEQ ID NO: 2352141 - DNA, 14 bp, Homo sapiens
agcctgaggtcccc

SEQ ID NO: 2352142 - DNA, 15 bp, Homo sapiens
agcctgaggtcccct

SEQ ID NO: 2352143 - DNA, 21 bp, Homo sapiens
agcctgccctcactccctctg

SEQ ID NO: 2352144 - DNA, 22 bp, Homo sapiens
agcctgccctcactccctctgc

SEQ ID NO: 2352145 - DNA, 11 bp, Homo sapiens
agcctgctgga

SEQ ID NO: 2352146 - DNA, 18 bp, Homo sapiens
agcctgctggcacccacc

SEQ ID NO: 2352147 - DNA, 16 bp, Homo sapiens
agcctggccaccagcc

SEQ ID NO: 2352148 - DNA, 14 bp, Homo sapiens
agcctggccccagg

SEQ ID NO: 2352149 - DNA, 17 bp, Homo sapiens
agcctgggccatctctt

SEQ ID NO: 2352150 - DNA, 15 bp, Homo sapiens
agccttaagcaaatt

SEQ ID NO: 2352151 - DNA, 21 bp, Homo sapiens
agccttcaaaactatagcttg

SEQ ID NO: 2352152 - DNA, 14 bp, Homo sapiens
agccttcagctcca

SEQ ID NO: 2352153 - DNA, 18 bp, Homo sapiens
agccttccaactagctgg

SEQ ID NO: 2352154 - DNA, 23 bp, Homo sapiens
agccttccagggatttgcctcac

SEQ ID NO: 2352155 - DNA, 16 bp, Homo sapiens
agccttgagccctggc

SEQ ID NO: 2352156 - DNA, 21 bp, Homo sapiens
agccttggaaccagccccatc

SEQ ID NO: 2352157 - DNA, 16 bp, Homo sapiens
agcctttactgtttga

SEQ ID NO: 2352158 - DNA, 19 bp, Homo sapiens
agcctttactgtttgatat

SEQ ID NO: 2352159 - DNA, 14 bp, Homo sapiens
agcctttgaatgta

SEQ ID NO: 2352160 - DNA, 13 bp, Homo sapiens
agcgaacttcaca

SEQ ID NO: 2352161 - DNA, 23 bp, Homo sapiens
agcgaacttcacataggaaggga

SEQ ID NO: 2352162 - DNA, 16 bp, Homo sapiens
agcgaaggaacctctc

SEQ ID NO: 2352163 - DNA, 19 bp, Homo sapiens
agcgacctcaagtgtcctg

SEQ ID NO: 2352164 - DNA, 15 bp, Homo sapiens
agcgagctgctctgc

SEQ ID NO: 2352165 - DNA, 17 bp, Homo sapiens
agcgagctgctctgcta

SEQ ID NO: 2352166 - DNA, 22 bp, Homo sapiens
agcgatacacaaagctttcttt

SEQ ID NO: 2352167 - DNA, 17 bp, Homo sapiens
agcgatctctcctggcc

SEQ ID NO: 2352168 - DNA, 19 bp, Homo sapiens
agcgatctctcctggccta

SEQ ID NO: 2352169 - DNA, 13 bp, Homo sapiens
agcgccagcctca

SEQ ID NO: 2352170 - DNA, 11 bp, Homo sapiens
agcgccctcac

SEQ ID NO: 2352171 - DNA, 18 bp, Homo sapiens
agcgctcatgttgagcca

SEQ ID NO: 2352172 - DNA, 21 bp, Homo sapiens
agcggaggttgcagtgagctg

SEQ ID NO: 2352173 - DNA, 22 bp, Homo sapiens
agcggaggttgcagtgagctga

SEQ ID NO: 2352174 - DNA, 13 bp, Homo sapiens
agcggctcccctc

SEQ ID NO: 2352175 - DNA, 21 bp, Homo sapiens
agcggctcccctctgcttctc

SEQ ID NO: 2352176 - DNA, 23 bp, Homo sapiens
agcggtggataactagccagaca

SEQ ID NO: 2352177 - DNA, 21 bp, Homo sapiens
agcgtcagctgctccctggca

SEQ ID NO: 2352178 - DNA, 15 bp, Homo sapiens
agcgtccctggcgca

SEQ ID NO: 2352179 - DNA, 20 bp, Homo sapiens
agcgtctgggaacttgcgag

SEQ ID NO: 2352180 - DNA, 12 bp, Homo sapiens
agctaattattt

SEQ ID NO: 2352181 - DNA, 15 bp, Homo sapiens
agctacaaactttta

SEQ ID NO: 2352182 - DNA, 18 bp, Homo sapiens
agctacaaacttttaaga

SEQ ID NO: 2352183 - DNA, 19 bp, Homo sapiens
agctacaattgtaaactag

SEQ ID NO: 2352184 - DNA, 18 bp, Homo sapiens
agctacagtgcatagttg

SEQ ID NO: 2352185 - DNA, 22 bp, Homo sapiens
agctaccaccacggccaccact

SEQ ID NO: 2352186 - DNA, 22 bp, Homo sapiens
agctacctacatgctgaaaaat

SEQ ID NO: 2352187 - DNA, 14 bp, Homo sapiens
agctactctcttgc

SEQ ID NO: 2352188 - DNA, 19 bp, Homo sapiens
agctactctcttgccagca

SEQ ID NO: 2352189 - DNA, 13 bp, Homo sapiens
agctactgtagaa

SEQ ID NO: 2352190 - DNA, 16 bp, Homo sapiens
agctactgtagaaaca

SEQ ID NO: 2352191 - DNA, 18 bp, Homo sapiens
agctacttgggaggctga

SEQ ID NO: 2352192 - DNA, 21 bp, Homo sapiens
agctacttgggaggctgaggc

SEQ ID NO: 2352193 - DNA, 13 bp, Homo sapiens
agctagctgccac

SEQ ID NO: 2352194 - DNA, 19 bp, Homo sapiens
agctaggcttaaacctgga

SEQ ID NO: 2352195 - DNA, 14 bp, Homo sapiens
agctagtgtttcta

SEQ ID NO: 2352196 - DNA, 22 bp, Homo sapiens
agctataaaagcccatgcttaa

SEQ ID NO: 2352197 - DNA, 16 bp, Homo sapiens
agctatcctttcaaac

SEQ ID NO: 2352198 - DNA, 14 bp, Homo sapiens
agctatgagttgaa

SEQ ID NO: 2352199 - DNA, 14 bp, Homo sapiens
agctattagccagg

SEQ ID NO: 2352200 - DNA, 18 bp, Homo sapiens
agctattagccaggatca

SEQ ID NO: 2352201 - DNA, 21 bp, Homo sapiens
agctattcacctcagtagaaa

SEQ ID NO: 2352202 - DNA, 21 bp, Homo sapiens
agctatttaagtggactgtat

SEQ ID NO: 2352203 - DNA, 13 bp, Homo sapiens
agctatttcatct

SEQ ID NO: 2352204 - DNA, 21 bp, Homo sapiens
agctatttcatctatttttgg

SEQ ID NO: 2352205 - DNA, 13 bp, Homo sapiens
agctattttccag

SEQ ID NO: 2352206 - DNA, 15 bp, Homo sapiens
agctattttcctctg

SEQ ID NO: 2352207 - DNA, 17 bp, Homo sapiens
agctattttcctctggc

SEQ ID NO: 2352208 - DNA, 22 bp, Homo sapiens
agctcaaataggtcatcatgaa

SEQ ID NO: 2352209 - DNA, 16 bp, Homo sapiens
agctcaaatgaaatgt

SEQ ID NO: 2352210 - DNA, 23 bp, Homo sapiens
agctcaaatgaaatgtatgcatt

SEQ ID NO: 2352211 - DNA, 17 bp, Homo sapiens
agctcactgcagcctca

SEQ ID NO: 2352212 - DNA, 13 bp, Homo sapiens
agctcacttctgg

SEQ ID NO: 2352213 - DNA, 12 bp, Homo sapiens
agctccctcctg

SEQ ID NO: 2352214 - DNA, 16 bp, Homo sapiens
agctccctttctcagg

SEQ ID NO: 2352215 - DNA, 19 bp, Homo sapiens
agctcctccccttcctctt

SEQ ID NO: 2352216 - DNA, 17 bp, Homo sapiens
agctcctgtcccctgct

SEQ ID NO: 2352217 - DNA, 17 bp, Homo sapiens
agctcgagcaaaattca

SEQ ID NO: 2352218 - DNA, 20 bp, Homo sapiens
agctcgagcaaaattcaaaa

SEQ ID NO: 2352219 - DNA, 11 bp, Homo sapiens
agctctctgac

SEQ ID NO: 2352220 - DNA, 16 bp, Homo sapiens
agctctctgccctgtg

SEQ ID NO: 2352221 - DNA, 19 bp, Homo sapiens
agctctctgccctgtgtac

SEQ ID NO: 2352222 - DNA, 13 bp, Homo sapiens
agctctgaaatct

SEQ ID NO: 2352223 - DNA, 21 bp, Homo sapiens
agctctgaagaactctctgga

SEQ ID NO: 2352224 - DNA, 22 bp, Homo sapiens
agctctgaagaactctctggaa

SEQ ID NO: 2352225 - DNA, 20 bp, Homo sapiens
agctctggaggtgctgctct

SEQ ID NO: 2352226 - DNA, 13 bp, Homo sapiens
agctctttccaaa

SEQ ID NO: 2352227 - DNA, 14 bp, Homo sapiens
agctctttccaaat

SEQ ID NO: 2352228 - DNA, 15 bp, Homo sapiens
agctctttccaaatt

SEQ ID NO: 2352229 - DNA, 17 bp, Homo sapiens
agctctttccaaattaa

SEQ ID NO: 2352230 - DNA, 13 bp, Homo sapiens
agctgaaatttta

SEQ ID NO: 2352231 - DNA, 12 bp, Homo sapiens
agctgagcagcc

SEQ ID NO: 2352232 - DNA, 16 bp, Homo sapiens
agctgagcagcctctg

SEQ ID NO: 2352233 - DNA, 17 bp, Homo sapiens
agctgatattatttctt

SEQ ID NO: 2352234 - DNA, 18 bp, Homo sapiens
agctgatattatttcttc

SEQ ID NO: 2352235 - DNA, 20 bp, Homo sapiens
agctgcatcatccttgcagg

SEQ ID NO: 2352236 - DNA, 23 bp, Homo sapiens
agctgcatcatccttgcaggtgg

SEQ ID NO: 2352237 - DNA, 23 bp, Homo sapiens
agctgccctcccctccggactgg

SEQ ID NO: 2352238 - DNA, 13 bp, Homo sapiens
agctgccttccct

SEQ ID NO: 2352239 - DNA, 18 bp, Homo sapiens
agctgcgcttgcttttct

SEQ ID NO: 2352240 - DNA, 18 bp, Homo sapiens
agctgctatccccatctc

SEQ ID NO: 2352241 - DNA, 21 bp, Homo sapiens
agctgctatccccatctccct

SEQ ID NO: 2352242 - DNA, 22 bp, Homo sapiens
agctgctatccccatctccctg

SEQ ID NO: 2352243 - DNA, 20 bp, Homo sapiens
agctgctatttattttccta

SEQ ID NO: 2352244 - DNA, 21 bp, Homo sapiens
agctgctatttattttcctaa

SEQ ID NO: 2352245 - DNA, 12 bp, Homo sapiens
agctgctctgct

SEQ ID NO: 2352246 - DNA, 21 bp, Homo sapiens
agctgctgttctcaggacagc

SEQ ID NO: 2352247 - DNA, 14 bp, Homo sapiens
agctggagccccca

SEQ ID NO: 2352248 - DNA, 18 bp, Homo sapiens
agctggctctgtgagggt

SEQ ID NO: 2352249 - DNA, 21 bp, Homo sapiens
agctggctctgtgagggtgct

SEQ ID NO: 2352250 - DNA, 21 bp, Homo sapiens
agctggctttgaaacctcagg

SEQ ID NO: 2352251 - DNA, 15 bp, Homo sapiens
agctgggccgggacc

SEQ ID NO: 2352252 - DNA, 18 bp, Homo sapiens
agctgggccgggacccag

SEQ ID NO: 2352253 - DNA, 13 bp, Homo sapiens
agctggtcagtct

SEQ ID NO: 2352254 - DNA, 14 bp, Homo sapiens
agctggtcagtctt

SEQ ID NO: 2352255 - DNA, 19 bp, Homo sapiens
agctgtacttcttgaatat

SEQ ID NO: 2352256 - DNA, 20 bp, Homo sapiens
agctgtacttcttgaatata

SEQ ID NO: 2352257 - DNA, 14 bp, Homo sapiens
agctgtcctttttc

SEQ ID NO: 2352258 - DNA, 17 bp, Homo sapiens
agctgtcctttttcctc

SEQ ID NO: 2352259 - DNA, 17 bp, Homo sapiens
agctgttaccattcaca

SEQ ID NO: 2352260 - DNA, 20 bp, Homo sapiens
agctgttccttggtcctagt

SEQ ID NO: 2352261 - DNA, 14 bp, Homo sapiens
agctgttctaatta

SEQ ID NO: 2352262 - DNA, 16 bp, Homo sapiens
agctgttgtacattta

SEQ ID NO: 2352263 - DNA, 22 bp, Homo sapiens
agctgttgtacatttatgattt

SEQ ID NO: 2352264 - DNA, 20 bp, Homo sapiens
agctgttgtgagctttgaag

SEQ ID NO: 2352265 - DNA, 21 bp, Homo sapiens
agctgttgtgagctttgaagt

SEQ ID NO: 2352266 - DNA, 16 bp, Homo sapiens
agcttaaataggaaag

SEQ ID NO: 2352267 - DNA, 11 bp, Homo sapiens
agcttccaaag

SEQ ID NO: 2352268 - DNA, 16 bp, Homo sapiens
agcttccaaagcctag

SEQ ID NO: 2352269 - DNA, 14 bp, Homo sapiens
agcttctaaagcag

SEQ ID NO: 2352270 - DNA, 19 bp, Homo sapiens
agcttctgcttttctgccc

SEQ ID NO: 2352271 - DNA, 21 bp, Homo sapiens
agcttctgcttttctgccctg

SEQ ID NO: 2352272 - DNA, 22 bp, Homo sapiens
agcttctgggagatttttttga

SEQ ID NO: 2352273 - DNA, 13 bp, Homo sapiens
agcttcttgtttc

SEQ ID NO: 2352274 - DNA, 18 bp, Homo sapiens
agcttcttgtttccttgt

SEQ ID NO: 2352275 - DNA, 19 bp, Homo sapiens
agcttcttgtttccttgtt

SEQ ID NO: 2352276 - DNA, 21 bp, Homo sapiens
agcttgagccgggcccctggg

SEQ ID NO: 2352277 - DNA, 14 bp, Homo sapiens
agcttgctccagat

SEQ ID NO: 2352278 - DNA, 19 bp, Homo sapiens
agcttgctccagattctga

SEQ ID NO: 2352279 - DNA, 21 bp, Homo sapiens
agcttgctccagattctgatg

SEQ ID NO: 2352280 - DNA, 23 bp, Homo sapiens
agcttgctccagattctgatgca

SEQ ID NO: 2352281 - DNA, 23 bp, Homo sapiens
agcttggggccaccaaagctgcc

SEQ ID NO: 2352282 - DNA, 18 bp, Homo sapiens
agcttggttctgtgaaca

SEQ ID NO: 2352283 - DNA, 12 bp, Homo sapiens
agctttaaatta

SEQ ID NO: 2352284 - DNA, 19 bp, Homo sapiens
agctttagaccctgggtgg

SEQ ID NO: 2352285 - DNA, 22 bp, Homo sapiens
agctttagaccctgggtgggct

SEQ ID NO: 2352286 - DNA, 12 bp, Homo sapiens
agctttctcaat

SEQ ID NO: 2352287 - DNA, 17 bp, Homo sapiens
agctttctcaatgtctt

SEQ ID NO: 2352288 - DNA, 17 bp, Homo sapiens
agctttgagaagccttc

SEQ ID NO: 2352289 - DNA, 21 bp, Homo sapiens
agctttgcaaacccattaagg

SEQ ID NO: 2352290 - DNA, 13 bp, Homo sapiens
agctttggctgag

SEQ ID NO: 2352291 - DNA, 22 bp, Homo sapiens
agctttttaattgttgtttctt

SEQ ID NO: 2352292 - DNA, 13 bp, Homo sapiens
agctttttggaat

SEQ ID NO: 2352293 - DNA, 16 bp, Homo sapiens
agcttttttattttaa

SEQ ID NO: 2352294 - DNA, 14 bp, Homo sapiens
aggaaaatgtctgt

SEQ ID NO: 2352295 - DNA, 14 bp, Homo sapiens
aggaaacattttat

SEQ ID NO: 2352296 - DNA, 16 bp, Homo sapiens
aggaaactccacatct

SEQ ID NO: 2352297 - DNA, 18 bp, Homo sapiens
aggaaactcttatctcag

SEQ ID NO: 2352298 - DNA, 17 bp, Homo sapiens
aggaaagggctggctcc

SEQ ID NO: 2352299 - DNA, 16 bp, Homo sapiens
aggaaatatctgtgaa

SEQ ID NO: 2352300 - DNA, 23 bp, Homo sapiens
aggaaatgtttttaataaaagaa

SEQ ID NO: 2352301 - DNA, 11 bp, Homo sapiens
aggaagagcca

SEQ ID NO: 2352302 - DNA, 17 bp, Homo sapiens
aggaagagccacctgca

SEQ ID NO: 2352303 - DNA, 19 bp, Homo sapiens
aggaagagcccgcagggcc

SEQ ID NO: 2352304 - DNA, 11 bp, Homo sapiens
aggaagccaga

SEQ ID NO: 2352305 - DNA, 17 bp, Homo sapiens
aggaaggattgtaaaaa

SEQ ID NO: 2352306 - DNA, 13 bp, Homo sapiens
aggaaggcaagag

SEQ ID NO: 2352307 - DNA, 15 bp, Homo sapiens
aggaaggcctttctt

SEQ ID NO: 2352308 - DNA, 19 bp, Homo sapiens
aggaagtggggtctggcct

SEQ ID NO: 2352309 - DNA, 21 bp, Homo sapiens
aggaagtggggtctggcctgt

SEQ ID NO: 2352310 - DNA, 17 bp, Homo sapiens
aggaatatatgtgtgcc

SEQ ID NO: 2352311 - DNA, 17 bp, Homo sapiens
aggaatcattcagaaat

SEQ ID NO: 2352312 - DNA, 14 bp, Homo sapiens
aggaatcctggcag

SEQ ID NO: 2352313 - DNA, 22 bp, Homo sapiens
aggaatctcttcactaccctga

SEQ ID NO: 2352314 - DNA, 19 bp, Homo sapiens
aggaatgcaccacggcagc

SEQ ID NO: 2352315 - DNA, 16 bp, Homo sapiens
aggaattacgtgctct

SEQ ID NO: 2352316 - DNA, 19 bp, Homo sapiens
aggaattctcaagacctga

SEQ ID NO: 2352317 - DNA, 20 bp, Homo sapiens
aggaatttgatgattttcat

SEQ ID NO: 2352318 - DNA, 16 bp, Homo sapiens
aggacacagttcctgg

SEQ ID NO: 2352319 - DNA, 18 bp, Homo sapiens
aggacacagttcctggga

SEQ ID NO: 2352320 - DNA, 20 bp, Homo sapiens
aggacatgcaataaaattta

SEQ ID NO: 2352321 - DNA, 19 bp, Homo sapiens
aggaccagattgctctgcc

SEQ ID NO: 2352322 - DNA, 12 bp, Homo sapiens
aggaccagggcc

SEQ ID NO: 2352323 - DNA, 20 bp, Homo sapiens
aggaccagggccctgggcag

SEQ ID NO: 2352324 - DNA, 14 bp, Homo sapiens
aggacgcctgcagg

SEQ ID NO: 2352325 - DNA, 15 bp, Homo sapiens
aggacggctcctcag

SEQ ID NO: 2352326 - DNA, 21 bp, Homo sapiens
aggacggttgtaagcagttgt

SEQ ID NO: 2352327 - DNA, 15 bp, Homo sapiens
aggactgcagtgtgg

SEQ ID NO: 2352328 - DNA, 14 bp, Homo sapiens
aggagaaatctcag

SEQ ID NO: 2352329 - DNA, 16 bp, Homo sapiens
aggagacaaaagagca

SEQ ID NO: 2352330 - DNA, 20 bp, Homo sapiens
aggagagggcgctcctctct

SEQ ID NO: 2352331 - DNA, 17 bp, Homo sapiens
aggagcttcagtattgt

SEQ ID NO: 2352332 - DNA, 22 bp, Homo sapiens
aggagcttcttgtttccttgtt

SEQ ID NO: 2352333 - DNA, 19 bp, Homo sapiens
aggagcttgggcagtgccc

SEQ ID NO: 2352334 - DNA, 15 bp, Homo sapiens
aggagcttttctgga

SEQ ID NO: 2352335 - DNA, 17 bp, Homo sapiens
aggagggagagagatgt

SEQ ID NO: 2352336 - DNA, 12 bp, Homo sapiens
aggagggagagg

SEQ ID NO: 2352337 - DNA, 14 bp, Homo sapiens
aggagggagaggga

SEQ ID NO: 2352338 - DNA, 16 bp, Homo sapiens
aggaggggctgtaaaa

SEQ ID NO: 2352339 - DNA, 17 bp, Homo sapiens
aggagggggccgggcgc

SEQ ID NO: 2352340 - DNA, 16 bp, Homo sapiens
aggagtaaaattcagt

SEQ ID NO: 2352341 - DNA, 21 bp, Homo sapiens
aggataagaaagcctaaaatt

SEQ ID NO: 2352342 - DNA, 16 bp, Homo sapiens
aggataccttcttatt

SEQ ID NO: 2352343 - DNA, 17 bp, Homo sapiens
aggatattggttcttcc

SEQ ID NO: 2352344 - DNA, 20 bp, Homo sapiens
aggatattggttcttcccct

SEQ ID NO: 2352345 - DNA, 15 bp, Homo sapiens
aggatcatggtgtaa

SEQ ID NO: 2352346 - DNA, 14 bp, Homo sapiens
aggatccagagagc

SEQ ID NO: 2352347 - DNA, 19 bp, Homo sapiens
aggatcggactctgcccct

SEQ ID NO: 2352348 - DNA, 20 bp, Homo sapiens
aggatcggactctgcccctg

SEQ ID NO: 2352349 - DNA, 21 bp, Homo sapiens
aggcttctgctggggcctggg

SEQ ID NO: 2352350 - DNA, 18 bp, Homo sapiens
aggcttgcataataagct

SEQ ID NO: 2352351 - DNA, 19 bp, Homo sapiens
aggctttgccatgggcctg

SEQ ID NO: 2352352 - DNA, 22 bp, Homo sapiens
aggctttgccatgggcctgctg

SEQ ID NO: 2352353 - DNA, 23 bp, Homo sapiens
aggctttgccatgggcctgctgc

SEQ ID NO: 2352354 - DNA, 19 bp, Homo sapiens
agggaagaaaaagcaagtg

SEQ ID NO: 2352355 - DNA, 23 bp, Homo sapiens
agtgacacccagagggagtagaa

SEQ ID NO: 2352356 - DNA, 18 bp, Homo sapiens
agtgacagctttctggga

SEQ ID NO: 2352357 - DNA, 16 bp, Homo sapiens
agtgacttcctggtga

SEQ ID NO: 2352358 - DNA, 12 bp, Homo sapiens
agtgagcagaac

SEQ ID NO: 2352359 - DNA, 13 bp, Homo sapiens
agtgagcagaaca

SEQ ID NO: 2352360 - DNA, 16 bp, Homo sapiens
agtgagcagaacaggt

SEQ ID NO: 2352361 - DNA, 17 bp, Homo sapiens
agtgagcagaacaggta

SEQ ID NO: 2352362 - DNA, 16 bp, Homo sapiens
agtgagccaaaatcat

SEQ ID NO: 2352363 - DNA, 20 bp, Homo sapiens
agtgagcctcctgtgcctgg

SEQ ID NO: 2352364 - DNA, 21 bp, Homo sapiens
agtgagcctcctgtgcctggc

SEQ ID NO: 2352365 - DNA, 16 bp, Homo sapiens
agtgatgacttgctgt

SEQ ID NO: 2352366 - DNA, 14 bp, Homo sapiens
agtgattctgtttg

SEQ ID NO: 2352367 - DNA, 21 bp, Homo sapiens
agtgattctgtttgccttttg

SEQ ID NO: 2352368 - DNA, 13 bp, Homo sapiens
agtgatttgtaaa

SEQ ID NO: 2352369 - DNA, 17 bp, Homo sapiens
agtgatttgtaaaacag

SEQ ID NO: 2352370 - DNA, 22 bp, Homo sapiens
agtgcatagttgtagacaaagt

SEQ ID NO: 2352371 - DNA, 18 bp, Homo sapiens
agtgccctccagccccgc

SEQ ID NO: 2352372 - DNA, 12 bp, Homo sapiens
agtgccctctcc

SEQ ID NO: 2352373 - DNA, 18 bp, Homo sapiens
agtgccctctcccaccct

SEQ ID NO: 2352374 - DNA, 21 bp, Homo sapiens
agtgccctctcccaccctctt

SEQ ID NO: 2352375 - DNA, 10 bp, Homo sapiens
agtgcctaca

SEQ ID NO: 2352376 - DNA, 14 bp, Homo sapiens
agtgcctcttccag

SEQ ID NO: 2352377 - DNA, 17 bp, Homo sapiens
agtgcctcttccagtga

SEQ ID NO: 2352378 - DNA, 21 bp, Homo sapiens
agtgcctcttccagtgaacat

SEQ ID NO: 2352379 - DNA, 19 bp, Homo sapiens
agtgccttcctgtttttca

SEQ ID NO: 2352380 - DNA, 16 bp, Homo sapiens
agtgctcaaggccagc

SEQ ID NO: 2352381 - DNA, 15 bp, Homo sapiens
agtgctcaccagccc

SEQ ID NO: 2352382 - DNA, 17 bp, Homo sapiens
agtgctctgcctcagac

SEQ ID NO: 2352383 - DNA, 18 bp, Homo sapiens
agtgctggaagggaggaa

SEQ ID NO: 2352384 - DNA, 16 bp, Homo sapiens
agtgcttaaaaatcat

SEQ ID NO: 2352385 - DNA, 17 bp, Homo sapiens
agtgcttaaaaatcatt

SEQ ID NO: 2352386 - DNA, 22 bp, Homo sapiens
agtgcttggaacatactgttca

SEQ ID NO: 2352387 - DNA, 20 bp, Homo sapiens
agtggaagtatgtatattaa

SEQ ID NO: 2352388 - DNA, 21 bp, Homo sapiens
agtggaagtatgtatattaaa

SEQ ID NO: 2352389 - DNA, 13 bp, Homo sapiens
agtggactgtatt

SEQ ID NO: 2352390 - DNA, 16 bp, Homo sapiens
agtggactgtatttcg

SEQ ID NO: 2352391 - DNA, 18 bp, Homo sapiens
agtggatcactcaccatt

SEQ ID NO: 2352392 - DNA, 14 bp, Homo sapiens
agtggatggaatat

SEQ ID NO: 2352393 - DNA, 13 bp, Homo sapiens
agtggcagtattg

SEQ ID NO: 2352394 - DNA, 18 bp, Homo sapiens
agtggctgcggtgtttgg

SEQ ID NO: 2352395 - DNA, 18 bp, Homo sapiens
agtggctggtagaaaaag

SEQ ID NO: 2352396 - DNA, 18 bp, Homo sapiens
agtggggtgctgggagga

SEQ ID NO: 2352397 - DNA, 21 bp, Homo sapiens
agtggggtgctgggaggaggg

SEQ ID NO: 2352398 - DNA, 15 bp, Homo sapiens
agtggtctctgctgg

SEQ ID NO: 2352399 - DNA, 20 bp, Homo sapiens
agtggtctctgctggggaag

SEQ ID NO: 2352400 - DNA, 14 bp, Homo sapiens
agtggtctttgtaa

SEQ ID NO: 2352401 - DNA, 24 bp, Homo sapiens
agtggtctttgtaagagtgtagaa

SEQ ID NO: 2352402 - DNA, 16 bp, Homo sapiens
agtggtgggggaaggc

SEQ ID NO: 2352403 - DNA, 18 bp, Homo sapiens
agtggttttatactgaag

SEQ ID NO: 2352404 - DNA, 21 bp, Homo sapiens
agtggttttatactgaaggaa

SEQ ID NO: 2352405 - DNA, 14 bp, Homo sapiens
agtgtaaaaaatgt

SEQ ID NO: 2352406 - DNA, 18 bp, Homo sapiens
agtgtaacttgcttaaat

SEQ ID NO: 2352407 - DNA, 16 bp, Homo sapiens
agtgtagaagcattcc

SEQ ID NO: 2352408 - DNA, 22 bp, Homo sapiens
agtgtagaagcattccttcttt

SEQ ID NO: 2352409 - DNA, 17 bp, Homo sapiens
agtgtattaggaagtgt

SEQ ID NO: 2352410 - DNA, 19 bp, Homo sapiens
agtgtccagcttccaaagc

SEQ ID NO: 2352411 - DNA, 17 bp, Homo sapiens
agtgtccttcttgctcc

SEQ ID NO: 2352412 - DNA, 16 bp, Homo sapiens
agtgtctattatcaca

SEQ ID NO: 2352413 - DNA, 14 bp, Homo sapiens
agtgtctcaaagga

SEQ ID NO: 2352414 - DNA, 16 bp, Homo sapiens
agtgtctgttcagcaa

SEQ ID NO: 2352415 - DNA, 20 bp, Homo sapiens
agtgtgaattgcaaaaccca

SEQ ID NO: 2352416 - DNA, 14 bp, Homo sapiens
agtgtgctaaaaat

SEQ ID NO: 2352417 - DNA, 21 bp, Homo sapiens
agtgtgtaaatgcttaaattt

SEQ ID NO: 2352418 - DNA, 13 bp, Homo sapiens
agtgtgtctgctg

SEQ ID NO: 2352419 - DNA, 15 bp, Homo sapiens
agtgtgtctgctgag

SEQ ID NO: 2352420 - DNA, 14 bp, Homo sapiens
agtgttctgtggct

SEQ ID NO: 2352421 - DNA, 19 bp, Homo sapiens
agtgttgcatatgagcctg

SEQ ID NO: 2352422 - DNA, 21 bp, Homo sapiens
agtgttggtatattttatatt

SEQ ID NO: 2352423 - DNA, 20 bp, Homo sapiens
agtgtttatgtttaaaagaa

SEQ ID NO: 2352424 - DNA, 15 bp, Homo sapiens
agtgtttccacactt

SEQ ID NO: 2352425 - DNA, 20 bp, Homo sapiens
agttaaaattgttatcaaaa

SEQ ID NO: 2352426 - DNA, 13 bp, Homo sapiens
agttaaagaaagg

SEQ ID NO: 2352427 - DNA, 14 bp, Homo sapiens
agttaaagaaagga

SEQ ID NO: 2352428 - DNA, 16 bp, Homo sapiens
agttaaataactgtgt

SEQ ID NO: 2352429 - DNA, 21 bp, Homo sapiens
agttaagaagctgttgtacat

SEQ ID NO: 2352430 - DNA, 17 bp, Homo sapiens
agttaatataaatgttg

SEQ ID NO: 2352431 - DNA, 20 bp, Homo sapiens
agttacacagaaatgctgct

SEQ ID NO: 2352432 - DNA, 21 bp, Homo sapiens
agttacacagaaatgctgctg

SEQ ID NO: 2352433 - DNA, 14 bp, Homo sapiens
agttacagtggcag

SEQ ID NO: 2352434 - DNA, 15 bp, Homo sapiens
agttacagtggcagt

SEQ ID NO: 2352435 - DNA, 19 bp, Homo sapiens
agttacttaattgccagca

SEQ ID NO: 2352436 - DNA, 20 bp, Homo sapiens
agttagcatgtatgaatgta

SEQ ID NO: 2352437 - DNA, 17 bp, Homo sapiens
agttagctccataaagt

SEQ ID NO: 2352438 - DNA, 17 bp, Homo sapiens
agttagtggattactgc

SEQ ID NO: 2352439 - DNA, 20 bp, Homo sapiens
agttagtggattactgccat

SEQ ID NO: 2352440 - DNA, 18 bp, Homo sapiens
agttatctttgaatatgt

SEQ ID NO: 2352441 - DNA, 20 bp, Homo sapiens
agttattcttgtcattttga

SEQ ID NO: 2352442 - DNA, 15 bp, Homo sapiens
agttatttttctctt

SEQ ID NO: 2352443 - DNA, 16 bp, Homo sapiens
agttatttttctcttt

SEQ ID NO: 2352444 - DNA, 15 bp, Homo sapiens
agttcaccttggaag

SEQ ID NO: 2352445 - DNA, 16 bp, Homo sapiens
agttcaccttggaagg

SEQ ID NO: 2352446 - DNA, 16 bp, Homo sapiens
agttcatatatcaaga

SEQ ID NO: 2352447 - DNA, 19 bp, Homo sapiens
agttcatcagagttatggt

SEQ ID NO: 2352448 - DNA, 17 bp, Homo sapiens
agttcatcgattttcta

SEQ ID NO: 2352449 - DNA, 15 bp, Homo sapiens
agttcattgcaatta

SEQ ID NO: 2352450 - DNA, 19 bp, Homo sapiens
agttcccatttccttgtct

SEQ ID NO: 2352451 - DNA, 17 bp, Homo sapiens
agttcccttgaaacttt

SEQ ID NO: 2352452 - DNA, 14 bp, Homo sapiens
agttcctcttttgt

SEQ ID NO: 2352453 - DNA, 13 bp, Homo sapiens
agttcctgggaac

SEQ ID NO: 2352454 - DNA, 16 bp, Homo sapiens
agttctctgggaagtg

SEQ ID NO: 2352455 - DNA, 22 bp, Homo sapiens
agttctctttggaaatagcatg

SEQ ID NO: 2352456 - DNA, 13 bp, Homo sapiens
agttcttgtgcca

SEQ ID NO: 2352457 - DNA, 14 bp, Homo sapiens
agttcttgtgccat

SEQ ID NO: 2352458 - DNA, 14 bp, Homo sapiens
agttctttcctctt

SEQ ID NO: 2352459 - DNA, 18 bp, Homo sapiens
agttctttcctctttctg

SEQ ID NO: 2352460 - DNA, 20 bp, Homo sapiens
agttctttcctctttctgct

SEQ ID NO: 2352461 - DNA, 22 bp, Homo sapiens
agttctttcctctttctgctct

SEQ ID NO: 2352462 - DNA, 23 bp, Homo sapiens
agttctttcctctttctgctctg

SEQ ID NO: 2352463 - DNA, 22 bp, Homo sapiens
agttctttggattctaaataca

SEQ ID NO: 2352464 - DNA, 13 bp, Homo sapiens
agttgaaatgttc

SEQ ID NO: 2352465 - DNA, 22 bp, Homo sapiens
agttgactgactgagcaggctg

SEQ ID NO: 2352466 - DNA, 14 bp, Homo sapiens
agttgcattttaac

SEQ ID NO: 2352467 - DNA, 14 bp, Homo sapiens
atcaactgaatgag

SEQ ID NO: 2352468 - DNA, 16 bp, Homo sapiens
atcaagaaaaaaaggg

SEQ ID NO: 2352469 - DNA, 21 bp, Homo sapiens
atcaagagtccggatttctaa

SEQ ID NO: 2352470 - DNA, 20 bp, Homo sapiens
atcaagcaatccagcctcat

SEQ ID NO: 2352471 - DNA, 18 bp, Homo sapiens
atcaagggaagaactatt

SEQ ID NO: 2352472 - DNA, 23 bp, Homo sapiens
atcaaggttataattttttttaa

SEQ ID NO: 2352473 - DNA, 12 bp, Homo sapiens
atcaatacacta

SEQ ID NO: 2352474 - DNA, 13 bp, Homo sapiens
atcaatagttgaa

SEQ ID NO: 2352475 - DNA, 17 bp, Homo sapiens
atcaatagttgaattag

SEQ ID NO: 2352476 - DNA, 15 bp, Homo sapiens
atcacactttaatgt

SEQ ID NO: 2352477 - DNA, 13 bp, Homo sapiens
atcaccgctgggt

SEQ ID NO: 2352478 - DNA, 19 bp, Homo sapiens
atcaccgctgggtggtttt

SEQ ID NO: 2352479 - DNA, 15 bp, Homo sapiens
atcacgatgtaaatt

SEQ ID NO: 2352480 - DNA, 13 bp, Homo sapiens
atcacgctttcct

SEQ ID NO: 2352481 - DNA, 14 bp, Homo sapiens
atcacgctttcctg

SEQ ID NO: 2352482 - DNA, 12 bp, Homo sapiens
atcactcaccat

SEQ ID NO: 2352483 - DNA, 18 bp, Homo sapiens
atcactgtatcattttct

SEQ ID NO: 2352484 - DNA, 20 bp, Homo sapiens
atcagaaagtaacaatctat

SEQ ID NO: 2352485 - DNA, 22 bp, Homo sapiens
atcagaaagtaacaatctatgg

SEQ ID NO: 2352486 - DNA, 16 bp, Homo sapiens
atcagaacctgagcta

SEQ ID NO: 2352487 - DNA, 16 bp, Homo sapiens
atcagaagactttaat

SEQ ID NO: 2352488 - DNA, 13 bp, Homo sapiens
atcagacatacag

SEQ ID NO: 2352489 - DNA, 22 bp, Homo sapiens
atcagagacaaaatatttccca

SEQ ID NO: 2352490 - DNA, 14 bp, Homo sapiens
atcagcaaagaaaa

SEQ ID NO: 2352491 - DNA, 22 bp, Homo sapiens
atcagcattttagaaactacaa

SEQ ID NO: 2352492 - DNA, 20 bp, Homo sapiens
atcaggggtaggaatggaaa

SEQ ID NO: 2352493 - DNA, 18 bp, Homo sapiens
atcaggtgtataaatgta

SEQ ID NO: 2352494 - DNA, 15 bp, Homo sapiens
atcagtaaccccctt

SEQ ID NO: 2352495 - DNA, 19 bp, Homo sapiens
atcagtaacccccttaaat

SEQ ID NO: 2352496 - DNA, 23 bp, Homo sapiens
atcagtaacccccttaaatttaa

SEQ ID NO: 2352497 - DNA, 12 bp, Homo sapiens
atcataaagcat

SEQ ID NO: 2352498 - DNA, 13 bp, Homo sapiens
atcataaagtcag

SEQ ID NO: 2352499 - DNA, 16 bp, Homo sapiens
atcatgaatgctttta

SEQ ID NO: 2352500 - DNA, 16 bp, Homo sapiens
atcatgagcctgctgg

SEQ ID NO: 2352501 - DNA, 14 bp, Homo sapiens
aggttatcgaaata

SEQ ID NO: 2352502 - DNA, 18 bp, Homo sapiens
aggttatcgaaataacaa

SEQ ID NO: 2352503 - DNA, 22 bp, Homo sapiens
aggttccgtatctccctggaga

SEQ ID NO: 2352504 - DNA, 19 bp, Homo sapiens
aggttcttaaaaaggaaca

SEQ ID NO: 2352505 - DNA, 23 bp, Homo sapiens
aggttgaagccaagtggggtgct

SEQ ID NO: 2352506 - DNA, 15 bp, Homo sapiens
aggttggatggatgg

SEQ ID NO: 2352507 - DNA, 13 bp, Homo sapiens
agtaaaaactaga

SEQ ID NO: 2352508 - DNA, 18 bp, Homo sapiens
agtaaaagtggtctctgc

SEQ ID NO: 2352509 - DNA, 22 bp, Homo sapiens
agtaaaagtggtctctgctggg

SEQ ID NO: 2352510 - DNA, 12 bp, Homo sapiens
agtaaaattcag

SEQ ID NO: 2352511 - DNA, 22 bp, Homo sapiens
atgagaaactttgatctctgct

SEQ ID NO: 2352512 - DNA, 14 bp, Homo sapiens
atgagaagccaagc

SEQ ID NO: 2352513 - DNA, 16 bp, Homo sapiens
atgagaatgacagcct

SEQ ID NO: 2352514 - DNA, 20 bp, Homo sapiens
atgagacagggtcttgctct

SEQ ID NO: 2352515 - DNA, 21 bp, Homo sapiens
atgagacagggtcttgctctg

SEQ ID NO: 2352516 - DNA, 20 bp, Homo sapiens
atgagagcataatttaaaaa

SEQ ID NO: 2352517 - DNA, 13 bp, Homo sapiens
atgagagcccaga

SEQ ID NO: 2352518 - DNA, 16 bp, Homo sapiens
atgagagcccagaggt

SEQ ID NO: 2352519 - DNA, 15 bp, Homo sapiens
atgagagttccttct

SEQ ID NO: 2352520 - DNA, 17 bp, Homo sapiens
atgagagttccttctca

SEQ ID NO: 2352521 - DNA, 19 bp, Homo sapiens
atgagagttccttctcact

SEQ ID NO: 2352522 - DNA, 20 bp, Homo sapiens
atgagcaaccacatttagaa

SEQ ID NO: 2352523 - DNA, 17 bp, Homo sapiens
atgagcctgctggaagc

SEQ ID NO: 2352524 - DNA, 14 bp, Homo sapiens
atgagcgccacctc

SEQ ID NO: 2352525 - DNA, 17 bp, Homo sapiens
atgagctatcctttcaa

SEQ ID NO: 2352526 - DNA, 20 bp, Homo sapiens
atgagctatcctttcaaaca

SEQ ID NO: 2352527 - DNA, 23 bp, Homo sapiens
atgagctatcctttcaaacagct

SEQ ID NO: 2352528 - DNA, 15 bp, Homo sapiens
atgagcttgattaaa

SEQ ID NO: 2352529 - DNA, 19 bp, Homo sapiens
atgaggaaaattcttaaaa

SEQ ID NO: 2352530 - DNA, 14 bp, Homo sapiens
atgaggaggggagc

SEQ ID NO: 2352531 - DNA, 14 bp, Homo sapiens
atgaggaggggagg

SEQ ID NO: 2352532 - DNA, 15 bp, Homo sapiens
atgaggaggggaggg

SEQ ID NO: 2352533 - DNA, 12 bp, Homo sapiens
atgaggagggtg

SEQ ID NO: 2352534 - DNA, 11 bp, Homo sapiens
atgaggggaga

SEQ ID NO: 2352535 - DNA, 16 bp, Homo sapiens
atgaggtgccacccag

SEQ ID NO: 2352536 - DNA, 13 bp, Homo sapiens
atgaggtgggagg

SEQ ID NO: 2352537 - DNA, 21 bp, Homo sapiens
atgataaactcagatctgatc

SEQ ID NO: 2352538 - DNA, 22 bp, Homo sapiens
atgataatgctaattttattat

SEQ ID NO: 2352539 - DNA, 19 bp, Homo sapiens
atgatagtataaaaaatgg

SEQ ID NO: 2352540 - DNA, 22 bp, Homo sapiens
atgatcctggaaattgcagtaa

SEQ ID NO: 2352541 - DNA, 13 bp, Homo sapiens
atgatgatgttaa

SEQ ID NO: 2352542 - DNA, 15 bp, Homo sapiens
atgatgatgttaacc

SEQ ID NO: 2352543 - DNA, 14 bp, Homo sapiens
atgatgattgaact

SEQ ID NO: 2352544 - DNA, 14 bp, Homo sapiens
atgatggttcacgt

SEQ ID NO: 2352545 - DNA, 14 bp, Homo sapiens
atgatgtacagatt

SEQ ID NO: 2352546 - DNA, 21 bp, Homo sapiens
atgatgtacagattctttcag

SEQ ID NO: 2352547 - DNA, 14 bp, Homo sapiens
atgattaaattatg

SEQ ID NO: 2352548 - DNA, 18 bp, Homo sapiens
atgattaaattatgaagc

SEQ ID NO: 2352549 - DNA, 20 bp, Homo sapiens
atgattctttgttacaggca

SEQ ID NO: 2352550 - DNA, 14 bp, Homo sapiens
atgatttaataaaa

SEQ ID NO: 2352551 - DNA, 20 bp, Homo sapiens
atgatttagggaagcaggga

SEQ ID NO: 2352552 - DNA, 19 bp, Homo sapiens
atgatttccttcaatgtgc

SEQ ID NO: 2352553 - DNA, 22 bp, Homo sapiens
atgattttcatttcatgaaaat

SEQ ID NO: 2352554 - DNA, 13 bp, Homo sapiens
atggcagaagaca

SEQ ID NO: 2352555 - DNA, 19 bp, Homo sapiens
atggcagaagacaccagag

SEQ ID NO: 2352556 - DNA, 16 bp, Homo sapiens
atggcatatggtccta

SEQ ID NO: 2352557 - DNA, 21 bp, Homo sapiens
atggcatccctttttcataaa

SEQ ID NO: 2352558 - DNA, 22 bp, Homo sapiens
atggcatccctttttcataaat

SEQ ID NO: 2352559 - DNA, 20 bp, Homo sapiens
atggcatttagcacagtatt

SEQ ID NO: 2352560 - DNA, 21 bp, Homo sapiens
atggcatttagcacagtattt

SEQ ID NO: 2352561 - DNA, 17 bp, Homo sapiens
atggcatttctctttaa

SEQ ID NO: 2352562 - DNA, 23 bp, Homo sapiens
atggcatttctctttaaactatg

SEQ ID NO: 2352563 - DNA, 22 bp, Homo sapiens
atggccagcccctggggcccag

SEQ ID NO: 2352564 - DNA, 17 bp, Homo sapiens
atggccatgcaggaggt

SEQ ID NO: 2352565 - DNA, 20 bp, Homo sapiens
atggccatgcaggaggtgga

SEQ ID NO: 2352566 - DNA, 22 bp, Homo sapiens
atggccatggagtgtacaagta

SEQ ID NO: 2352567 - DNA, 14 bp, Homo sapiens
atggccattttaaa

SEQ ID NO: 2352568 - DNA, 16 bp, Homo sapiens
atggccattttaaaat

SEQ ID NO: 2352569 - DNA, 19 bp, Homo sapiens
atggccctgtagctctgaa

SEQ ID NO: 2352570 - DNA, 18 bp, Homo sapiens
atggccctgtcccaggcc

SEQ ID NO: 2352571 - DNA, 14 bp, Homo sapiens
atggccgtggatgc

SEQ ID NO: 2352572 - DNA, 16 bp, Homo sapiens
atggccgtggatggcc

SEQ ID NO: 2352573 - DNA, 18 bp, Homo sapiens
atggcctatgcacatatg

SEQ ID NO: 2352574 - DNA, 19 bp, Homo sapiens
atggccttaatttcctttt

SEQ ID NO: 2352575 - DNA, 13 bp, Homo sapiens
atggcctttcctt

SEQ ID NO: 2352576 - DNA, 15 bp, Homo sapiens
atggcctttccttcc

SEQ ID NO: 2352577 - DNA, 17 bp, Homo sapiens
atggcctttccttccct

SEQ ID NO: 2352578 - DNA, 13 bp, Homo sapiens
atggcgccctgcc

SEQ ID NO: 2352579 - DNA, 20 bp, Homo sapiens
atggcgccctgcctcctgga

SEQ ID NO: 2352580 - DNA, 22 bp, Homo sapiens
atggcgccctgcctcctggagg

SEQ ID NO: 2352581 - DNA, 23 bp, Homo sapiens
atggcgccctgcctcctggagga

SEQ ID NO: 2352582 - DNA, 18 bp, Homo sapiens
atggctacctcagaaaga

SEQ ID NO: 2352583 - DNA, 21 bp, Homo sapiens
atggcttatttctatgacaaa

SEQ ID NO: 2352584 - DNA, 14 bp, Homo sapiens
atggcttgttcatc

SEQ ID NO: 2352585 - DNA, 23 bp, Homo sapiens
atggcttgttcatcatccagatg

SEQ ID NO: 2352586 - DNA, 22 bp, Homo sapiens
atggctttcaatacccttttaa

SEQ ID NO: 2352587 - DNA, 20 bp, Homo sapiens
atgggaaaaatctaaaatgt

SEQ ID NO: 2352588 - DNA, 12 bp, Homo sapiens
atgggaagccat

SEQ ID NO: 2352589 - DNA, 17 bp, Homo sapiens
atgggaatgaggtggga

SEQ ID NO: 2352590 - DNA, 18 bp, Homo sapiens
atgggaatgaggtgggag

SEQ ID NO: 2352591 - DNA, 19 bp, Homo sapiens
atgggagaagtgggggcag

SEQ ID NO: 2352592 - DNA, 22 bp, Homo sapiens
atgggatggtcggatctcacag

SEQ ID NO: 2352593 - DNA, 20 bp, Homo sapiens
atgggcttcactgtataaat

SEQ ID NO: 2352594 - DNA, 16 bp, Homo sapiens
atgggggcacttgagt

SEQ ID NO: 2352595 - DNA, 14 bp, Homo sapiens
atgggggcagggct

SEQ ID NO: 2352596 - DNA, 15 bp, Homo sapiens
atgggggcagggctg

SEQ ID NO: 2352597 - DNA, 22 bp, Homo sapiens
atgggggcatctcttccccaga

SEQ ID NO: 2352598 - DNA, 13 bp, Homo sapiens
atggtaggggagg

SEQ ID NO: 2352599 - DNA, 16 bp, Homo sapiens
atggtcggatctcaca

SEQ ID NO: 2352600 - DNA, 17 bp, Homo sapiens
atggtcggatctcacag

SEQ ID NO: 2352601 - DNA, 13 bp, Homo sapiens
atgtttattaaat

SEQ ID NO: 2352602 - DNA, 16 bp, Homo sapiens
atgtttcttttgtttg

SEQ ID NO: 2352603 - DNA, 21 bp, Homo sapiens
atgtttggaaaaaactctgaa

SEQ ID NO: 2352604 - DNA, 22 bp, Homo sapiens
atgtttggaaaaaactctgaag

SEQ ID NO: 2352605 - DNA, 22 bp, Homo sapiens
atgttttcaaaaggtattatac

SEQ ID NO: 2352606 - DNA, 14 bp, Homo sapiens
atgtttttccctcc

SEQ ID NO: 2352607 - DNA, 17 bp, Homo sapiens
atgtttttccctcccca

SEQ ID NO: 2352608 - DNA, 19 bp, Homo sapiens
atgtttttccctccccaga

SEQ ID NO: 2352609 - DNA, 15 bp, Homo sapiens
attaaaaaaaaattg

SEQ ID NO: 2352610 - DNA, 14 bp, Homo sapiens
attaaaaagaagat

SEQ ID NO: 2352611 - DNA, 20 bp, Homo sapiens
attaaaaatgagatttctta

SEQ ID NO: 2352612 - DNA, 21 bp, Homo sapiens
attaaaaatgagatttcttat

SEQ ID NO: 2352613 - DNA, 22 bp, Homo sapiens
attaaaaattacctttaatttt

SEQ ID NO: 2352614 - DNA, 13 bp, Homo sapiens
attaaaacaaata

SEQ ID NO: 2352615 - DNA, 16 bp, Homo sapiens
attaaaactaaatttc

SEQ ID NO: 2352616 - DNA, 20 bp, Homo sapiens
attaaacaaagtttcagagt

SEQ ID NO: 2352617 - DNA, 17 bp, Homo sapiens
attaaacttccaaagaa

SEQ ID NO: 2352618 - DNA, 21 bp, Homo sapiens
attaaataaaatttttatgta

SEQ ID NO: 2352619 - DNA, 15 bp, Homo sapiens
attaaattatcattg

SEQ ID NO: 2352620 - DNA, 11 bp, Homo sapiens
attaaattatg

SEQ ID NO: 2352621 - DNA, 15 bp, Homo sapiens
attaacacaaaggaa

SEQ ID NO: 2352622 - DNA, 14 bp, Homo sapiens
attaacggtgctaa

SEQ ID NO: 2352623 - DNA, 16 bp, Homo sapiens
attaagattggaaatg

SEQ ID NO: 2352624 - DNA, 14 bp, Homo sapiens
attaagcaaatgtt

SEQ ID NO: 2352625 - DNA, 17 bp, Homo sapiens
attaagcaaatgttaaa

SEQ ID NO: 2352626 - DNA, 20 bp, Homo sapiens
attaagcattttgaaacaaa

SEQ ID NO: 2352627 - DNA, 17 bp, Homo sapiens
attaagctttttggaat

SEQ ID NO: 2352628 - DNA, 21 bp, Homo sapiens
attaagggacatttctataaa

SEQ ID NO: 2352629 - DNA, 15 bp, Homo sapiens
attaaggggaagaat

SEQ ID NO: 2352630 - DNA, 17 bp, Homo sapiens
attaataagatttttca

SEQ ID NO: 2352631 - DNA, 20 bp, Homo sapiens
attaataagatttttcaaaa

SEQ ID NO: 2352632 - DNA, 16 bp, Homo sapiens
attaatatcaactctg

SEQ ID NO: 2352633 - DNA, 13 bp, Homo sapiens
attaatatttgca

SEQ ID NO: 2352634 - DNA, 18 bp, Homo sapiens
attaatcaagagaaactt

SEQ ID NO: 2352635 - DNA, 18 bp, Homo sapiens
attaatcatacaaactct

SEQ ID NO: 2352636 - DNA, 14 bp, Homo sapiens
attaatgataaact

SEQ ID NO: 2352637 - DNA, 15 bp, Homo sapiens
attaatgcctgcttt

SEQ ID NO: 2352638 - DNA, 15 bp, Homo sapiens
attaatgttttcaaa

SEQ ID NO: 2352639 - DNA, 16 bp, Homo sapiens
attaattaatttggag

SEQ ID NO: 2352640 - DNA, 21 bp, Homo sapiens
attacaccaccggccccctcc

SEQ ID NO: 2352641 - DNA, 21 bp, Homo sapiens
attacagaggtattaaaacta

SEQ ID NO: 2352642 - DNA, 19 bp, Homo sapiens
attacattgctttttcttg

SEQ ID NO: 2352643 - DNA, 16 bp, Homo sapiens
attaccaacctgttac

SEQ ID NO: 2352644 - DNA, 14 bp, Homo sapiens
attacctccatcca

SEQ ID NO: 2352645 - DNA, 13 bp, Homo sapiens
attaccttactgt

SEQ ID NO: 2352646 - DNA, 16 bp, Homo sapiens
attactgaataatatc

SEQ ID NO: 2352647 - DNA, 16 bp, Homo sapiens
attactgacatttctt

SEQ ID NO: 2352648 - DNA, 20 bp, Homo sapiens
attactgctttaatcagaaa

SEQ ID NO: 2352649 - DNA, 21 bp, Homo sapiens
attactgctttaatcagaaac

SEQ ID NO: 2352650 - DNA, 15 bp, Homo sapiens
attactttgtcccgc

SEQ ID NO: 2352651 - DNA, 15 bp, Homo sapiens
attagaagacaacag

SEQ ID NO: 2352652 - DNA, 14 bp, Homo sapiens
attagccaggatca

SEQ ID NO: 2352653 - DNA, 15 bp, Homo sapiens
attagccaggatcat

SEQ ID NO: 2352654 - DNA, 21 bp, Homo sapiens
attagccaggatcatggtgta

SEQ ID NO: 2352655 - DNA, 21 bp, Homo sapiens
attaggactaaggaactaaaa

SEQ ID NO: 2352656 - DNA, 21 bp, Homo sapiens
attagtatgtatgtgtaccta

SEQ ID NO: 2352657 - DNA, 19 bp, Homo sapiens
attagtcctaattcaatcc

SEQ ID NO: 2352658 - DNA, 19 bp, Homo sapiens
attagttccagtttctcct

SEQ ID NO: 2352659 - DNA, 16 bp, Homo sapiens
attataattggaagtg

SEQ ID NO: 2352660 - DNA, 21 bp, Homo sapiens
attatacatgtgatacatttt

SEQ ID NO: 2352661 - DNA, 15 bp, Homo sapiens
attgccacggaaaca

SEQ ID NO: 2352662 - DNA, 13 bp, Homo sapiens
attgccagcaaat

SEQ ID NO: 2352663 - DNA, 18 bp, Homo sapiens
attgccccatctagacta

SEQ ID NO: 2352664 - DNA, 17 bp, Homo sapiens
attgccctatgctgtgc

SEQ ID NO: 2352665 - DNA, 13 bp, Homo sapiens
attgcctctgaaa

SEQ ID NO: 2352666 - DNA, 20 bp, Homo sapiens
attgcgtagaggctacaggg

SEQ ID NO: 2352667 - DNA, 14 bp, Homo sapiens
attgctctgcccca

SEQ ID NO: 2352668 - DNA, 16 bp, Homo sapiens
attgctgactgtagct

SEQ ID NO: 2352669 - DNA, 22 bp, Homo sapiens
attgctggaggaaccagaggca

SEQ ID NO: 2352670 - DNA, 21 bp, Homo sapiens
attgctttgtattgtatatta

SEQ ID NO: 2352671 - DNA, 23 bp, Homo sapiens
attgcttttttccaaaacaaaaa

SEQ ID NO: 2352672 - DNA, 23 bp, Homo sapiens
attggaactctactcaacccatt

SEQ ID NO: 2352673 - DNA, 14 bp, Homo sapiens
attggaatgccttg

SEQ ID NO: 2352674 - DNA, 20 bp, Homo sapiens
attggattatttaataacat

SEQ ID NO: 2352675 - DNA, 22 bp, Homo sapiens
attgggcacagtccagacccaa

SEQ ID NO: 2352676 - DNA, 22 bp, Homo sapiens
attggtaaaaacagcagctcat

SEQ ID NO: 2352677 - DNA, 21 bp, Homo sapiens
attggtaaaactcactgtgat

SEQ ID NO: 2352678 - DNA, 15 bp, Homo sapiens
attggttttcctgtg

SEQ ID NO: 2352679 - DNA, 22 bp, Homo sapiens
attgtaaaaaaggttttctata

SEQ ID NO: 2352680 - DNA, 15 bp, Homo sapiens
attgtaatcgtgtgc

SEQ ID NO: 2352681 - DNA, 18 bp, Homo sapiens
attgtaatcgtgtgccat

SEQ ID NO: 2352682 - DNA, 18 bp, Homo sapiens
attgtactaatctgagat

SEQ ID NO: 2352683 - DNA, 20 bp, Homo sapiens
attgtatattacaatgatca

SEQ ID NO: 2352684 - DNA, 18 bp, Homo sapiens
attgtatctcctttaata

SEQ ID NO: 2352685 - DNA, 13 bp, Homo sapiens
attgtcctccttt

SEQ ID NO: 2352686 - DNA, 19 bp, Homo sapiens
attgtcctccttttcactt

SEQ ID NO: 2352687 - DNA, 24 bp, Homo sapiens
attgtgcttcacagtagagccagc

SEQ ID NO: 2352688 - DNA, 22 bp, Homo sapiens
attgtggggctcataaaacatg

SEQ ID NO: 2352689 - DNA, 18 bp, Homo sapiens
attgtgggtaacgtgaga

SEQ ID NO: 2352690 - DNA, 15 bp, Homo sapiens
attgtggtttagatc

SEQ ID NO: 2352691 - DNA, 12 bp, Homo sapiens
attgtgtttcta

SEQ ID NO: 2352692 - DNA, 17 bp, Homo sapiens
attgtgtttgttcataa

SEQ ID NO: 2352693 - DNA, 12 bp, Homo sapiens
attgttatcaaa

SEQ ID NO: 2352694 - DNA, 12 bp, Homo sapiens
attgttgtttct

SEQ ID NO: 2352695 - DNA, 17 bp, Homo sapiens
attgtttggtaaatgtt

SEQ ID NO: 2352696 - DNA, 15 bp, Homo sapiens
attgttttacaatag

SEQ ID NO: 2352697 - DNA, 15 bp, Homo sapiens
atttaaaaatatatt

SEQ ID NO: 2352698 - DNA, 17 bp, Homo sapiens
atttaaaacagacactg

SEQ ID NO: 2352699 - DNA, 18 bp, Homo sapiens
atttaaacttacaaactt

SEQ ID NO: 2352700 - DNA, 18 bp, Homo sapiens
atttaaaggcagacagtt

SEQ ID NO: 2352701 - DNA, 20 bp, Homo sapiens
atttaaatcctgaagagcat

SEQ ID NO: 2352702 - DNA, 20 bp, Homo sapiens
atttaacattcttggtcaca

SEQ ID NO: 2352703 - DNA, 19 bp, Homo sapiens
atttaagagattttatgtt

SEQ ID NO: 2352704 - DNA, 13 bp, Homo sapiens
atttaagcacaaa

SEQ ID NO: 2352705 - DNA, 14 bp, Homo sapiens
atttaagcacaaaa

SEQ ID NO: 2352706 - DNA, 20 bp, Homo sapiens
atttaagtgcgtgtgtagag

SEQ ID NO: 2352707 - DNA, 18 bp, Homo sapiens
atttaagtggactgtatt

SEQ ID NO: 2352708 - DNA, 19 bp, Homo sapiens
atttaagtggactgtattt

SEQ ID NO: 2352709 - DNA, 19 bp, Homo sapiens
atttaataaaataattcta

SEQ ID NO: 2352710 - DNA, 22 bp, Homo sapiens
atttaataaaataattctaaag

SEQ ID NO: 2352711 - DNA, 11 bp, Homo sapiens
atttaataaag

SEQ ID NO: 2352712 - DNA, 13 bp, Homo sapiens
atttaataaagat

SEQ ID NO: 2352713 - DNA, 14 bp, Homo sapiens
atttaataacatta

SEQ ID NO: 2352714 - DNA, 17 bp, Homo sapiens
atttaataacattacct

SEQ ID NO: 2352715 - DNA, 23 bp, Homo sapiens
atttaataacattaccttactgt

SEQ ID NO: 2352716 - DNA, 18 bp, Homo sapiens
atttacaagggaagattt

SEQ ID NO: 2352717 - DNA, 17 bp, Homo sapiens
atttacacatcttaaaa

SEQ ID NO: 2352718 - DNA, 22 bp, Homo sapiens
atttactaacagtaactgccat

SEQ ID NO: 2352719 - DNA, 23 bp, Homo sapiens
atttactaacagtaactgccatt

SEQ ID NO: 2352720 - DNA, 21 bp, Homo sapiens
atttacttgttatgttgtaat

SEQ ID NO: 2352721 - DNA, 13 bp, Homo sapiens
cagtcttcctgac

SEQ ID NO: 2352722 - DNA, 16 bp, Homo sapiens
cagtcttcctgacact

SEQ ID NO: 2352723 - DNA, 15 bp, Homo sapiens
cagtctttgctcagt

SEQ ID NO: 2352724 - DNA, 12 bp, Homo sapiens
cagtgaacattc

SEQ ID NO: 2352725 - DNA, 18 bp, Homo sapiens
cagtgaacattcccagcc

SEQ ID NO: 2352726 - DNA, 21 bp, Homo sapiens
cagtgaacattcccagcccag

SEQ ID NO: 2352727 - DNA, 23 bp, Homo sapiens
cagtgaacattcccagcccagcc

SEQ ID NO: 2352728 - DNA, 14 bp, Homo sapiens
cagtgaactcctgc

SEQ ID NO: 2352729 - DNA, 16 bp, Homo sapiens
cagtgaactcctgcca

SEQ ID NO: 2352730 - DNA, 21 bp, Homo sapiens
cagtgaactcctgccaggcac

SEQ ID NO: 2352731 - DNA, 19 bp, Homo sapiens
cagtgacctttgacctcgg

SEQ ID NO: 2352732 - DNA, 19 bp, Homo sapiens
cagtgagcctcctgtgcct

SEQ ID NO: 2352733 - DNA, 21 bp, Homo sapiens
cagtgagcctcctgtgcctgg

SEQ ID NO: 2352734 - DNA, 22 bp, Homo sapiens
cagtgagcctcctgtgcctggc

SEQ ID NO: 2352735 - DNA, 14 bp, Homo sapiens
cagtgaggatgaca

SEQ ID NO: 2352736 - DNA, 20 bp, Homo sapiens
cagtgatatggcagaagaca

SEQ ID NO: 2352737 - DNA, 21 bp, Homo sapiens
cagtgatatggcagaagacac

SEQ ID NO: 2352738 - DNA, 22 bp, Homo sapiens
cagtgatatggcagaagacacc

SEQ ID NO: 2352739 - DNA, 23 bp, Homo sapiens
cagtgatatggcagaagacacca

SEQ ID NO: 2352740 - DNA, 19 bp, Homo sapiens
cagtgatgacttgctgtcc

SEQ ID NO: 2352741 - DNA, 19 bp, Homo sapiens
caggcatagaggcttctcc

SEQ ID NO: 2352742 - DNA, 20 bp, Homo sapiens
caggcatgaaattcttccta

SEQ ID NO: 2352743 - DNA, 22 bp, Homo sapiens
caggccacctggctctcacctc

SEQ ID NO: 2352744 - DNA, 11 bp, Homo sapiens
caggccagcct

SEQ ID NO: 2352745 - DNA, 13 bp, Homo sapiens
caggccagcctcc

SEQ ID NO: 2352746 - DNA, 16 bp, Homo sapiens
caggccattctgccgc

SEQ ID NO: 2352747 - DNA, 13 bp, Homo sapiens
caggccccagaca

SEQ ID NO: 2352748 - DNA, 14 bp, Homo sapiens
caggccccagacag

SEQ ID NO: 2352749 - DNA, 16 bp, Homo sapiens
caggccgtgccttgtt

SEQ ID NO: 2352750 - DNA, 14 bp, Homo sapiens
caggcctgcctccc

SEQ ID NO: 2352751 - DNA, 23 bp, Homo sapiens
caggccttgtcctacgtccaagg

SEQ ID NO: 2352752 - DNA, 16 bp, Homo sapiens
caggctcactgccagg

SEQ ID NO: 2352753 - DNA, 20 bp, Homo sapiens
caggctcactgccaggccag

SEQ ID NO: 2352754 - DNA, 16 bp, Homo sapiens
caggctggagaccccc

SEQ ID NO: 2352755 - DNA, 17 bp, Homo sapiens
caggctgggccatgtcc

SEQ ID NO: 2352756 - DNA, 19 bp, Homo sapiens
caggcttctgctggggcct

SEQ ID NO: 2352757 - DNA, 14 bp, Homo sapiens
caggctttatgtac

SEQ ID NO: 2352758 - DNA, 14 bp, Homo sapiens
cagggaatccaagc

SEQ ID NO: 2352759 - DNA, 18 bp, Homo sapiens
cagggaatccaagcctcc

SEQ ID NO: 2352760 - DNA, 13 bp, Homo sapiens
cagggactctcca

SEQ ID NO: 2352761 - DNA, 18 bp, Homo sapiens
cagggagagctcaccatg

SEQ ID NO: 2352762 - DNA, 13 bp, Homo sapiens
cagggagcctccc

SEQ ID NO: 2352763 - DNA, 22 bp, Homo sapiens
catttagcacagtatttaacat

SEQ ID NO: 2352764 - DNA, 20 bp, Homo sapiens
catttagcttttttatttta

SEQ ID NO: 2352765 - DNA, 14 bp, Homo sapiens
catttagtaagaat

SEQ ID NO: 2352766 - DNA, 18 bp, Homo sapiens
catttatgatttaataaa

SEQ ID NO: 2352767 - DNA, 21 bp, Homo sapiens
catttatgatttaataaaata

SEQ ID NO: 2352768 - DNA, 13 bp, Homo sapiens
catttcatgaaaa

SEQ ID NO: 2352769 - DNA, 15 bp, Homo sapiens
catttcatgaaaaag

SEQ ID NO: 2352770 - DNA, 21 bp, Homo sapiens
catttcattcctaacacagca

SEQ ID NO: 2352771 - DNA, 21 bp, Homo sapiens
catttccaccaggccgtgcct

SEQ ID NO: 2352772 - DNA, 17 bp, Homo sapiens
caacacttaagtctcag

SEQ ID NO: 2352773 - DNA, 22 bp, Homo sapiens
caacagaacatatgttgcaaga

SEQ ID NO: 2352774 - DNA, 19 bp, Homo sapiens
caacagcctttgaatgtaa

SEQ ID NO: 2352775 - DNA, 9 bp, Homo sapiens
caacatgtg

SEQ ID NO: 2352776 - DNA, 13 bp, Homo sapiens
caacatgtgatgt

SEQ ID NO: 2352777 - DNA, 14 bp, Homo sapiens
caaccaagtgtgct

SEQ ID NO: 2352778 - DNA, 21 bp, Homo sapiens
caaccacatttagaaatgttt

SEQ ID NO: 2352779 - DNA, 14 bp, Homo sapiens
caaccattaaagtc

SEQ ID NO: 2352780 - DNA, 20 bp, Homo sapiens
caacccagtcacactgtggc

SEQ ID NO: 2352781 - DNA, 22 bp, Homo sapiens
caacccattgttgtcaaggaag

SEQ ID NO: 2352782 - DNA, 19 bp, Homo sapiens
caaccctatctcctgacag

SEQ ID NO: 2352783 - DNA, 20 bp, Homo sapiens
caacctaacacattaaatgt

SEQ ID NO: 2352784 - DNA, 17 bp, Homo sapiens
caacctcaccttcctgt

SEQ ID NO: 2352785 - DNA, 18 bp, Homo sapiens
caacctcagggctcccag

SEQ ID NO: 2352786 - DNA, 15 bp, Homo sapiens
caacctctttgctca

SEQ ID NO: 2352787 - DNA, 19 bp, Homo sapiens
caacctctttttcctcctg

SEQ ID NO: 2352788 - DNA, 20 bp, Homo sapiens
caacctctttttcctcctgg

SEQ ID NO: 2352789 - DNA, 16 bp, Homo sapiens
caacctgctctcctct

SEQ ID NO: 2352790 - DNA, 12 bp, Homo sapiens
caacctgctctg

SEQ ID NO: 2352791 - DNA, 13 bp, Homo sapiens
caacctgctctgt

SEQ ID NO: 2352792 - DNA, 19 bp, Homo sapiens
caacctgctctgtccccaa

SEQ ID NO: 2352793 - DNA, 13 bp, Homo sapiens
caacctttctgta

SEQ ID NO: 2352794 - DNA, 14 bp, Homo sapiens
caacgcattgccac

SEQ ID NO: 2352795 - DNA, 22 bp, Homo sapiens
caacggaagccccctcttcctc

SEQ ID NO: 2352796 - DNA, 15 bp, Homo sapiens
caactacctgagcta

SEQ ID NO: 2352797 - DNA, 21 bp, Homo sapiens
caactacctgagctaaataaa

SEQ ID NO: 2352798 - DNA, 19 bp, Homo sapiens
caactcaagttataggaaa

SEQ ID NO: 2352799 - DNA, 23 bp, Homo sapiens
caactcagagaaaaatgctcccc

SEQ ID NO: 2352800 - DNA, 19 bp, Homo sapiens
caactccaggaaagagcag

SEQ ID NO: 2352801 - DNA, 12 bp, Homo sapiens
caactctgaagc

SEQ ID NO: 2352802 - DNA, 21 bp, Homo sapiens
caactgaaggggtgcacccac

SEQ ID NO: 2352803 - DNA, 21 bp, Homo sapiens
caactgaggttcttgggatac

SEQ ID NO: 2352804 - DNA, 22 bp, Homo sapiens
caactgcctactccaaaatgtt

SEQ ID NO: 2352805 - DNA, 22 bp, Homo sapiens
caactgctcccacctcctgaca

SEQ ID NO: 2352806 - DNA, 22 bp, Homo sapiens
caactgtgtgattaaaaggtat

SEQ ID NO: 2352807 - DNA, 17 bp, Homo sapiens
caacttagagattgcat

SEQ ID NO: 2352808 - DNA, 15 bp, Homo sapiens
caacttagctcaggt

SEQ ID NO: 2352809 - DNA, 18 bp, Homo sapiens
caacttattctttgagta

SEQ ID NO: 2352810 - DNA, 20 bp, Homo sapiens
caacttcccattaaaaatga

SEQ ID NO: 2352811 - DNA, 13 bp, Homo sapiens
caactttcacttc

SEQ ID NO: 2352812 - DNA, 18 bp, Homo sapiens
caactttcacttcttcct

SEQ ID NO: 2352813 - DNA, 12 bp, Homo sapiens
cactgccaggcc

SEQ ID NO: 2352814 - DNA, 16 bp, Homo sapiens
cactgccaggccagcc

SEQ ID NO: 2352815 - DNA, 17 bp, Homo sapiens
cactgccaggccagcct

SEQ ID NO: 2352816 - DNA, 20 bp, Homo sapiens
cactgccaggccagcctccg

SEQ ID NO: 2352817 - DNA, 20 bp, Homo sapiens
cactgcccacatgggacctg

SEQ ID NO: 2352818 - DNA, 20 bp, Homo sapiens
cactgcttgaactaggctga

SEQ ID NO: 2352819 - DNA, 16 bp, Homo sapiens
cactggaaaggggaga

SEQ ID NO: 2352820 - DNA, 18 bp, Homo sapiens
cactggaaaggggagagc

SEQ ID NO: 2352821 - DNA, 23 bp, Homo sapiens
cactggaaaggggagagcctgct

SEQ ID NO: 2352822 - DNA, 20 bp, Homo sapiens
cactggagccatctcttcct

SEQ ID NO: 2352823 - DNA, 14 bp, Homo sapiens
cactggctctcctg

SEQ ID NO: 2352824 - DNA, 17 bp, Homo sapiens
cactggctctcctggcc

SEQ ID NO: 2352825 - DNA, 19 bp, Homo sapiens
cactgggaagaagcaaggg

SEQ ID NO: 2352826 - DNA, 21 bp, Homo sapiens
cactgggaagaagcaagggca

SEQ ID NO: 2352827 - DNA, 20 bp, Homo sapiens
cactgggaggctccccttct

SEQ ID NO: 2352828 - DNA, 18 bp, Homo sapiens
cactgggtgcgtctccag

SEQ ID NO: 2352829 - DNA, 20 bp, Homo sapiens
cactgtacaaggtacccctt

SEQ ID NO: 2352830 - DNA, 19 bp, Homo sapiens
cactgtagtttagttctgt

SEQ ID NO: 2352831 - DNA, 23 bp, Homo sapiens
cactgtataaataggagaggatg

SEQ ID NO: 2352832 - DNA, 12 bp, Homo sapiens
cactgtccgcct

SEQ ID NO: 2352833 - DNA, 18 bp, Homo sapiens
cactgtccgcctctgccc

SEQ ID NO: 2352834 - DNA, 19 bp, Homo sapiens
cactgtgatcaatattttt

SEQ ID NO: 2352835 - DNA, 21 bp, Homo sapiens
cactgtgatcaatatttttat

SEQ ID NO: 2352836 - DNA, 11 bp, Homo sapiens
cactgtggttt

SEQ ID NO: 2352837 - DNA, 14 bp, Homo sapiens
cactgttctgttca

SEQ ID NO: 2352838 - DNA, 16 bp, Homo sapiens
cactgttgagccccag

SEQ ID NO: 2352839 - DNA, 13 bp, Homo sapiens
cactgttgataaa

SEQ ID NO: 2352840 - DNA, 11 bp, Homo sapiens
cactgtttaag

SEQ ID NO: 2352841 - DNA, 13 bp, Homo sapiens
cactgtttcctgg

SEQ ID NO: 2352842 - DNA, 22 bp, Homo sapiens
cactgtttctcttgagctggcc

SEQ ID NO: 2352843 - DNA, 14 bp, Homo sapiens
cacttagatttaaa

SEQ ID NO: 2352844 - DNA, 16 bp, Homo sapiens
cacttattattaataa

SEQ ID NO: 2352845 - DNA, 15 bp, Homo sapiens
cacttattgaatata

SEQ ID NO: 2352846 - DNA, 21 bp, Homo sapiens
cacttattggaactctgcttg

SEQ ID NO: 2352847 - DNA, 15 bp, Homo sapiens
cacttccagagccag

SEQ ID NO: 2352848 - DNA, 16 bp, Homo sapiens
cacttccagagccaga

SEQ ID NO: 2352849 - DNA, 23 bp, Homo sapiens
cacttcgcaccggagtgtctgga

SEQ ID NO: 2352850 - DNA, 18 bp, Homo sapiens
cacttctgggcttcatct

SEQ ID NO: 2352851 - DNA, 15 bp, Homo sapiens
cacttcttgaaacag

SEQ ID NO: 2352852 - DNA, 19 bp, Homo sapiens
cacttcttgaaacagcctg

SEQ ID NO: 2352853 - DNA, 16 bp, Homo sapiens
cacttgttatattata

SEQ ID NO: 2352854 - DNA, 14 bp, Homo sapiens
cactttacccacct

SEQ ID NO: 2352855 - DNA, 20 bp, Homo sapiens
cactttacccacctagaaca

SEQ ID NO: 2352856 - DNA, 19 bp, Homo sapiens
cactttctcagttttcata

SEQ ID NO: 2352857 - DNA, 12 bp, Homo sapiens
cactttgaaaag

SEQ ID NO: 2352858 - DNA, 14 bp, Homo sapiens
cactttgaagggca

SEQ ID NO: 2352859 - DNA, 22 bp, Homo sapiens
cactttgttgcaagatgtgaat

SEQ ID NO: 2352860 - DNA, 15 bp, Homo sapiens
cacttttcccactcc

SEQ ID NO: 2352861 - DNA, 18 bp, Homo sapiens
cagaaacacccctctgtc

SEQ ID NO: 2352862 - DNA, 19 bp, Homo sapiens
cagaaacacccctctgtct

SEQ ID NO: 2352863 - DNA, 22 bp, Homo sapiens
cagaaaccctcattgtgtttct

SEQ ID NO: 2352864 - DNA, 14 bp, Homo sapiens
cagaaagctgcctg

SEQ ID NO: 2352865 - DNA, 20 bp, Homo sapiens
cagaaatagacaaaaagtat

SEQ ID NO: 2352866 - DNA, 17 bp, Homo sapiens
cagaaatgctgctggcc

SEQ ID NO: 2352867 - DNA, 18 bp, Homo sapiens
cagaaatgctgctggcca

SEQ ID NO: 2352868 - DNA, 12 bp, Homo sapiens
cagaacagcttc

SEQ ID NO: 2352869 - DNA, 13 bp, Homo sapiens
cagaacagcttca

SEQ ID NO: 2352870 - DNA, 16 bp, Homo sapiens
cagaacagcttcaggt

SEQ ID NO: 2352871 - DNA, 17 bp, Homo sapiens
cagaacagcttcaggtt

SEQ ID NO: 2352872 - DNA, 19 bp, Homo sapiens
cagaacagcttcaggttat

SEQ ID NO: 2352873 - DNA, 13 bp, Homo sapiens
cagaacaggtagt

SEQ ID NO: 2352874 - DNA, 22 bp, Homo sapiens
cagaacatactgattgggaggt

SEQ ID NO: 2352875 - DNA, 16 bp, Homo sapiens
cagaaccacacttgaa

SEQ ID NO: 2352876 - DNA, 13 bp, Homo sapiens
cagaacctgagct

SEQ ID NO: 2352877 - DNA, 17 bp, Homo sapiens
cagaacctgcacacagg

SEQ ID NO: 2352878 - DNA, 17 bp, Homo sapiens
cagaactgtgccacaat

SEQ ID NO: 2352879 - DNA, 18 bp, Homo sapiens
cagaagacaccagagcag

SEQ ID NO: 2352880 - DNA, 14 bp, Homo sapiens
cagaagcaagccag

SEQ ID NO: 2352881 - DNA, 15 bp, Homo sapiens
cagaagcaagccaga

SEQ ID NO: 2352882 - DNA, 16 bp, Homo sapiens
cagaagcaagccagac

SEQ ID NO: 2352883 - DNA, 18 bp, Homo sapiens
cagaagcaagccagacct

SEQ ID NO: 2352884 - DNA, 23 bp, Homo sapiens
cagaagccaatctacaatctctt

SEQ ID NO: 2352885 - DNA, 20 bp, Homo sapiens
cagaagtcacacattacaaa

SEQ ID NO: 2352886 - DNA, 23 bp, Homo sapiens
cagaatccctttgcacctgagac

SEQ ID NO: 2352887 - DNA, 13 bp, Homo sapiens
cagaatcttctgg

SEQ ID NO: 2352888 - DNA, 13 bp, Homo sapiens
cagaatcttgttt

SEQ ID NO: 2352889 - DNA, 20 bp, Homo sapiens
cagaattggtaaaaacagca

SEQ ID NO: 2352890 - DNA, 17 bp, Homo sapiens
cagacaaaatttgagaa

SEQ ID NO: 2352891 - DNA, 20 bp, Homo sapiens
cagacaatagtatagaagtc

SEQ ID NO: 2352892 - DNA, 23 bp, Homo sapiens
cagacagggtgggcttcctgccc

SEQ ID NO: 2352893 - DNA, 14 bp, Homo sapiens
cagacataaaggaa

SEQ ID NO: 2352894 - DNA, 15 bp, Homo sapiens
cagacatacagctgc

SEQ ID NO: 2352895 - DNA, 12 bp, Homo sapiens
cagacatggacc

SEQ ID NO: 2352896 - DNA, 17 bp, Homo sapiens
cagaccagtactgggaa

SEQ ID NO: 2352897 - DNA, 18 bp, Homo sapiens
cagacctaaagcaagcct

SEQ ID NO: 2352898 - DNA, 16 bp, Homo sapiens
cagacctagcaggctg

SEQ ID NO: 2352899 - DNA, 20 bp, Homo sapiens
cagacctagcaggctgttcc

SEQ ID NO: 2352900 - DNA, 21 bp, Homo sapiens
cagacctagcaggctgttcca

SEQ ID NO: 2352901 - DNA, 12 bp, Homo sapiens
attttcctctgg

SEQ ID NO: 2352902 - DNA, 14 bp, Homo sapiens
attttctaaagact

SEQ ID NO: 2352903 - DNA, 14 bp, Homo sapiens
attttctactttaa

SEQ ID NO: 2352904 - DNA, 18 bp, Homo sapiens
attttctgtgcctgaata

SEQ ID NO: 2352905 - DNA, 18 bp, Homo sapiens
attttgacataagtaact

SEQ ID NO: 2352906 - DNA, 18 bp, Homo sapiens
attttgagtattccatga

SEQ ID NO: 2352907 - DNA, 19 bp, Homo sapiens
attttgagtattccatgag

SEQ ID NO: 2352908 - DNA, 14 bp, Homo sapiens
attttgctggaata

SEQ ID NO: 2352909 - DNA, 20 bp, Homo sapiens
attttggaataatttctatt

SEQ ID NO: 2352910 - DNA, 21 bp, Homo sapiens
attttggcgaatctcaaaatt

SEQ ID NO: 2352911 - DNA, 19 bp, Homo sapiens
attttgtagttaatataaa

SEQ ID NO: 2352912 - DNA, 10 bp, Homo sapiens
attttgtatg

SEQ ID NO: 2352913 - DNA, 22 bp, Homo sapiens
attttgtctaggagatgctttc

SEQ ID NO: 2352914 - DNA, 13 bp, Homo sapiens
attttgtgaatgg

SEQ ID NO: 2352915 - DNA, 15 bp, Homo sapiens
attttgtgaatggat

SEQ ID NO: 2352916 - DNA, 14 bp, Homo sapiens
attttgtgtaaaaa

SEQ ID NO: 2352917 - DNA, 15 bp, Homo sapiens
atttttaaattaaat

SEQ ID NO: 2352918 - DNA, 17 bp, Homo sapiens
atttttatatcatgcaa

SEQ ID NO: 2352919 - DNA, 23 bp, Homo sapiens
atttttatgtaattatatatact

SEQ ID NO: 2352920 - DNA, 12 bp, Homo sapiens
atttttcaaaat

SEQ ID NO: 2352921 - DNA, 12 bp, Homo sapiens
atttttcaaggc

SEQ ID NO: 2352922 - DNA, 17 bp, Homo sapiens
atttttcaatatattga

SEQ ID NO: 2352923 - DNA, 20 bp, Homo sapiens
atttttcttttattcttctt

SEQ ID NO: 2352924 - DNA, 12 bp, Homo sapiens
atttttgcctct

SEQ ID NO: 2352925 - DNA, 19 bp, Homo sapiens
atttttggtgggaatccaa

SEQ ID NO: 2352926 - DNA, 15 bp, Homo sapiens
atttttgtaaagttt

SEQ ID NO: 2352927 - DNA, 18 bp, Homo sapiens
atttttgtaaagtttccg

SEQ ID NO: 2352928 - DNA, 14 bp, Homo sapiens
attttttaggaaat

SEQ ID NO: 2352929 - DNA, 16 bp, Homo sapiens
attttttatcatgcat

SEQ ID NO: 2352930 - DNA, 21 bp, Homo sapiens
attttttatcatgcatgtcct

SEQ ID NO: 2352931 - DNA, 18 bp, Homo sapiens
attttttattaatatttg

SEQ ID NO: 2352932 - DNA, 16 bp, Homo sapiens
attttttcccttttta

SEQ ID NO: 2352933 - DNA, 16 bp, Homo sapiens
attttttgtctgtgat

SEQ ID NO: 2352934 - DNA, 23 bp, Homo sapiens
attttttgtctgtgataacagag

SEQ ID NO: 2352935 - DNA, 15 bp, Homo sapiens
atttttttagattga

SEQ ID NO: 2352936 - DNA, 22 bp, Homo sapiens
atttttttgcatgcatgcaaat

SEQ ID NO: 2352937 - DNA, 18 bp, Homo sapiens
attttttttcaaacaagt

SEQ ID NO: 2352938 - DNA, 18 bp, Homo sapiens
atttttttttctaagaga

SEQ ID NO: 2352939 - DNA, 21 bp, Homo sapiens
caaaaaagacttgagacaatg

SEQ ID NO: 2352940 - DNA, 23 bp, Homo sapiens
caaaaaagacttgagacaatgtt

SEQ ID NO: 2352941 - DNA, 15 bp, Homo sapiens
caaaaaatttaagag

SEQ ID NO: 2352942 - DNA, 13 bp, Homo sapiens
caaaaacatttga

SEQ ID NO: 2352943 - DNA, 23 bp, Homo sapiens
caaaaacatttgattaataaaat

SEQ ID NO: 2352944 - DNA, 12 bp, Homo sapiens
caaaaaccaaat

SEQ ID NO: 2352945 - DNA, 16 bp, Homo sapiens
caaaaataatcatgaa

SEQ ID NO: 2352946 - DNA, 21 bp, Homo sapiens
caaaagagggtttattttcag

SEQ ID NO: 2352947 - DNA, 13 bp, Homo sapiens
cagcccagagact

SEQ ID NO: 2352948 - DNA, 22 bp, Homo sapiens
cagcccagattcccctgtgtca

SEQ ID NO: 2352949 - DNA, 23 bp, Homo sapiens
cagcccagcagtgtggagaccct

SEQ ID NO: 2352950 - DNA, 16 bp, Homo sapiens
cagcccagccccactc

SEQ ID NO: 2352951 - DNA, 20 bp, Homo sapiens
cagcccaggatactggcaca

SEQ ID NO: 2352952 - DNA, 13 bp, Homo sapiens
cagcccatggaga

SEQ ID NO: 2352953 - DNA, 15 bp, Homo sapiens
cagccccactcctct

SEQ ID NO: 2352954 - DNA, 18 bp, Homo sapiens
cagccccactcctctgct

SEQ ID NO: 2352955 - DNA, 12 bp, Homo sapiens
cagccccactgc

SEQ ID NO: 2352956 - DNA, 13 bp, Homo sapiens
cagccccactgcc

SEQ ID NO: 2352957 - DNA, 21 bp, Homo sapiens
cagccccactgccagcagcag

SEQ ID NO: 2352958 - DNA, 22 bp, Homo sapiens
cagccccatcagaacctgagct

SEQ ID NO: 2352959 - DNA, 23 bp, Homo sapiens
cagccccatcagaacctgagcta

SEQ ID NO: 2352960 - DNA, 17 bp, Homo sapiens
cagcccccgccccagag

SEQ ID NO: 2352961 - DNA, 18 bp, Homo sapiens
cagcccccgccccagagt

SEQ ID NO: 2352962 - DNA, 14 bp, Homo sapiens
cagcccctactgct

SEQ ID NO: 2352963 - DNA, 15 bp, Homo sapiens
cagcccctactgctg

SEQ ID NO: 2352964 - DNA, 20 bp, Homo sapiens
cagcccctgtttactggttc

SEQ ID NO: 2352965 - DNA, 21 bp, Homo sapiens
cagccctgctcattcctcacg

SEQ ID NO: 2352966 - DNA, 15 bp, Homo sapiens
cagccctgctgggga

SEQ ID NO: 2352967 - DNA, 20 bp, Homo sapiens
cagccctgctggggatcccc

SEQ ID NO: 2352968 - DNA, 17 bp, Homo sapiens
cagcctagcacagcagc

SEQ ID NO: 2352969 - DNA, 19 bp, Homo sapiens
cagcctagcacagcagctt

SEQ ID NO: 2352970 - DNA, 14 bp, Homo sapiens
cagcctagggcaga

SEQ ID NO: 2352971 - DNA, 23 bp, Homo sapiens
cctatttcagtgttacctgtgtg

SEQ ID NO: 2352972 - DNA, 14 bp, Homo sapiens
cctcaaaccctgtg

SEQ ID NO: 2352973 - DNA, 18 bp, Homo sapiens
cctcaaacgacagaggag

SEQ ID NO: 2352974 - DNA, 20 bp, Homo sapiens
cctcaaacgacagaggagct

SEQ ID NO: 2352975 - DNA, 12 bp, Homo sapiens
cctcaagccatc

SEQ ID NO: 2352976 - DNA, 18 bp, Homo sapiens
cctcaatagatctccagc

SEQ ID NO: 2352977 - DNA, 17 bp, Homo sapiens
cctcaattgacattcct

SEQ ID NO: 2352978 - DNA, 14 bp, Homo sapiens
cctcacctcatgcc

SEQ ID NO: 2352979 - DNA, 22 bp, Homo sapiens
cctcacctcatgcccaccccct

SEQ ID NO: 2352980 - DNA, 15 bp, Homo sapiens
cctcaccttcctgtg

SEQ ID NO: 2352981 - DNA, 22 bp, Homo sapiens
cctcacgcccttcaatgctgca

SEQ ID NO: 2352982 - DNA, 15 bp, Homo sapiens
cctcacgctctggac

SEQ ID NO: 2352983 - DNA, 14 bp, Homo sapiens
cctcactccctctg

SEQ ID NO: 2352984 - DNA, 18 bp, Homo sapiens
cctcactggctctcctgg

SEQ ID NO: 2352985 - DNA, 18 bp, Homo sapiens
cctcagacgttgcctgag

SEQ ID NO: 2352986 - DNA, 19 bp, Homo sapiens
cctcagacgttgcctgaga

SEQ ID NO: 2352987 - DNA, 14 bp, Homo sapiens
cctggacaggcagc

SEQ ID NO: 2352988 - DNA, 17 bp, Homo sapiens
cctggacaggcagcctc

SEQ ID NO: 2352989 - DNA, 19 bp, Homo sapiens
cctggacaggcagcctcct

SEQ ID NO: 2352990 - DNA, 20 bp, Homo sapiens
cctggacaggcagcctcctt

SEQ ID NO: 2352991 - DNA, 22 bp, Homo sapiens
cctggacaggcagcctcctttg

SEQ ID NO: 2352992 - DNA, 23 bp, Homo sapiens
cctggacagtatcccacatccaa

SEQ ID NO: 2352993 - DNA, 13 bp, Homo sapiens
cctggacctggga

SEQ ID NO: 2352994 - DNA, 16 bp, Homo sapiens
cctggagaagcaccag

SEQ ID NO: 2352995 - DNA, 17 bp, Homo sapiens
cctggagaagcaccagc

SEQ ID NO: 2352996 - DNA, 16 bp, Homo sapiens
cctggagacaaggtgc

SEQ ID NO: 2352997 - DNA, 16 bp, Homo sapiens
cctggagcatcccagg

SEQ ID NO: 2352998 - DNA, 17 bp, Homo sapiens
cctggagcatcccaggc

SEQ ID NO: 2352999 - DNA, 23 bp, Homo sapiens
cctggagttgactgactgagcag

SEQ ID NO: 2353000 - DNA, 18 bp, Homo sapiens
cctggatggggcaggcca

SEQ ID NO: 2353001 - DNA, 15 bp, Homo sapiens
cctggcacacatcag

SEQ ID NO: 2353002 - DNA, 18 bp, Homo sapiens
cctggcactgggaggcag

SEQ ID NO: 2353003 - DNA, 11 bp, Homo sapiens
cctggcagccc

SEQ ID NO: 2353004 - DNA, 13 bp, Homo sapiens
cctggcagcccag

SEQ ID NO: 2353005 - DNA, 17 bp, Homo sapiens
cctggcatgacactcta

SEQ ID NO: 2353006 - DNA, 13 bp, Homo sapiens
cctggccaccagc

SEQ ID NO: 2353007 - DNA, 14 bp, Homo sapiens
cctggccaccagcc

SEQ ID NO: 2353008 - DNA, 12 bp, Homo sapiens
cctggccaggag

SEQ ID NO: 2353009 - DNA, 13 bp, Homo sapiens
cctggccccaggc

SEQ ID NO: 2353010 - DNA, 19 bp, Homo sapiens
cctggccccaggccccaga

SEQ ID NO: 2353011 - DNA, 21 bp, Homo sapiens
cctggccccaggccccagaca

SEQ ID NO: 2353012 - DNA, 19 bp, Homo sapiens
ccctgtttactggttcttg

SEQ ID NO: 2353013 - DNA, 14 bp, Homo sapiens
cccttcatcttcct

SEQ ID NO: 2353014 - DNA, 15 bp, Homo sapiens
cccttcatcttcctg

SEQ ID NO: 2353015 - DNA, 17 bp, Homo sapiens
cccttcatcttcctgtg

SEQ ID NO: 2353016 - DNA, 12 bp, Homo sapiens
cccttccaaaga

SEQ ID NO: 2353017 - DNA, 16 bp, Homo sapiens
cccttcccacatgcct

SEQ ID NO: 2353018 - DNA, 13 bp, Homo sapiens
cccttcccccacc

SEQ ID NO: 2353019 - DNA, 21 bp, Homo sapiens
cccttccttttccctgcttcc

SEQ ID NO: 2353020 - DNA, 14 bp, Homo sapiens
cccttctcccactc

SEQ ID NO: 2353021 - DNA, 19 bp, Homo sapiens
cccttctgggcttcattct

SEQ ID NO: 2353022 - DNA, 15 bp, Homo sapiens
cccttgcctccccat

SEQ ID NO: 2353023 - DNA, 20 bp, Homo sapiens
catgccgcggtaggtaaggg

SEQ ID NO: 2353024 - DNA, 16 bp, Homo sapiens
catgccgtctgccgga

SEQ ID NO: 2353025 - DNA, 19 bp, Homo sapiens
catgcctgcgcctgctgcc

SEQ ID NO: 2353026 - DNA, 21 bp, Homo sapiens
catgcctgcgcctgctgcctg

SEQ ID NO: 2353027 - DNA, 23 bp, Homo sapiens
catgcctgcgcctgctgcctgct

SEQ ID NO: 2353028 - DNA, 17 bp, Homo sapiens
catgctaacaaagacaa

SEQ ID NO: 2353029 - DNA, 15 bp, Homo sapiens
catgctccaaatata

SEQ ID NO: 2353030 - DNA, 20 bp, Homo sapiens
catgctgaaaaatatagcct

SEQ ID NO: 2353031 - DNA, 18 bp, Homo sapiens
catgctggcggcgcagag

SEQ ID NO: 2353032 - DNA, 14 bp, Homo sapiens
catgcttaaatttt

SEQ ID NO: 2353033 - DNA, 16 bp, Homo sapiens
catggacctccaggct

SEQ ID NO: 2353034 - DNA, 20 bp, Homo sapiens
catggcagcctactctcctt

SEQ ID NO: 2353035 - DNA, 19 bp, Homo sapiens
catggcatgcttaaatttt

SEQ ID NO: 2353036 - DNA, 18 bp, Homo sapiens
ccacagcgccagcctcag

SEQ ID NO: 2353037 - DNA, 24 bp, Homo sapiens
ccacagcgccagcctcagactgga

SEQ ID NO: 2353038 - DNA, 12 bp, Homo sapiens
ccacagcgtccc

SEQ ID NO: 2353039 - DNA, 16 bp, Homo sapiens
ccacagcgtccctggc

SEQ ID NO: 2353040 - DNA, 17 bp, Homo sapiens
ccacagctgctgttctc

SEQ ID NO: 2353041 - DNA, 21 bp, Homo sapiens
ccacagctgctgttctcagga

SEQ ID NO: 2353042 - DNA, 18 bp, Homo sapiens
ccacagggttcaaaatgt

SEQ ID NO: 2353043 - DNA, 17 bp, Homo sapiens
ccacaggtcatcagatg

SEQ ID NO: 2353044 - DNA, 15 bp, Homo sapiens
ccacataccctgacc

SEQ ID NO: 2353045 - DNA, 21 bp, Homo sapiens
ccacatagcatgcttcctttc

SEQ ID NO: 2353046 - DNA, 23 bp, Homo sapiens
ccacatagcatgcttcctttctc

SEQ ID NO: 2353047 - DNA, 16 bp, Homo sapiens
ccacatcaaataagaa

SEQ ID NO: 2353048 - DNA, 23 bp, Homo sapiens
ccacatctgccttaaaaccaaag

SEQ ID NO: 2353049 - DNA, 19 bp, Homo sapiens
ccacatgcctgcgcctgct

SEQ ID NO: 2353050 - DNA, 12 bp, Homo sapiens
ccacatgggacc

SEQ ID NO: 2353051 - DNA, 15 bp, Homo sapiens
ccacatgtgacacat

SEQ ID NO: 2353052 - DNA, 19 bp, Homo sapiens
ccacatgtgacacatatgc

SEQ ID NO: 2353053 - DNA, 16 bp, Homo sapiens
ccacattgaagaatgt

SEQ ID NO: 2353054 - DNA, 12 bp, Homo sapiens
ccacatttgatg

SEQ ID NO: 2353055 - DNA, 14 bp, Homo sapiens
ccaccaaaaacaaa

SEQ ID NO: 2353056 - DNA, 18 bp, Homo sapiens
ccaccaaagctgcccact

SEQ ID NO: 2353057 - DNA, 21 bp, Homo sapiens
ccacccaaccctatctcctga

SEQ ID NO: 2353058 - DNA, 15 bp, Homo sapiens
ccacccactgtccgc

SEQ ID NO: 2353059 - DNA, 16 bp, Homo sapiens
ccacccagtagcccag

SEQ ID NO: 2353060 - DNA, 16 bp, Homo sapiens
ccaccccaacctgctc

SEQ ID NO: 2353061 - DNA, 14 bp, Homo sapiens
ccaccccctgccct

SEQ ID NO: 2353062 - DNA, 15 bp, Homo sapiens
ccaccccctgccctg

SEQ ID NO: 2353063 - DNA, 20 bp, Homo sapiens
ccaccccggggaccctgtga

SEQ ID NO: 2353064 - DNA, 13 bp, Homo sapiens
ccacccctgcccc

SEQ ID NO: 2353065 - DNA, 21 bp, Homo sapiens
ccaccctagccaatgtctcct

SEQ ID NO: 2353066 - DNA, 12 bp, Homo sapiens
ccaccctcactg

SEQ ID NO: 2353067 - DNA, 14 bp, Homo sapiens
ccaccctcactggc

SEQ ID NO: 2353068 - DNA, 21 bp, Homo sapiens
ccaccctcactggctctcctg

SEQ ID NO: 2353069 - DNA, 13 bp, Homo sapiens
ccaccctgcctgc

SEQ ID NO: 2353070 - DNA, 19 bp, Homo sapiens
ccaccctgcgggccagggt

SEQ ID NO: 2353071 - DNA, 20 bp, Homo sapiens
ccaccctgctcatccactct

SEQ ID NO: 2353072 - DNA, 19 bp, Homo sapiens
ccaccctgtcctatgactt

SEQ ID NO: 2353073 - DNA, 19 bp, Homo sapiens
ccaccctgttcctgctgct

SEQ ID NO: 2353074 - DNA, 23 bp, Homo sapiens
ccaccggcctgtgggtctctgaa

SEQ ID NO: 2353075 - DNA, 18 bp, Homo sapiens
ccaccgtgaaccagaggg

SEQ ID NO: 2353076 - DNA, 23 bp, Homo sapiens
ccaccgtgaaccagagggtgtgg

SEQ ID NO: 2353077 - DNA, 20 bp, Homo sapiens
ccacctacacccctgtgctc

SEQ ID NO: 2353078 - DNA, 23 bp, Homo sapiens
ccacctacttttctttcctcaga

SEQ ID NO: 2353079 - DNA, 14 bp, Homo sapiens
ccacctagaacact

SEQ ID NO: 2353080 - DNA, 18 bp, Homo sapiens
ccacctagaacactaact

SEQ ID NO: 2353081 - DNA, 21 bp, Homo sapiens
ccacctcctgacacccttctc

SEQ ID NO: 2353082 - DNA, 11 bp, Homo sapiens
ccacctgcaag

SEQ ID NO: 2353083 - DNA, 17 bp, Homo sapiens
ccacctgcaagatggac

SEQ ID NO: 2353084 - DNA, 17 bp, Homo sapiens
ccacctgcatctggggc

SEQ ID NO: 2353085 - DNA, 15 bp, Homo sapiens
ccacctgccttggcc

SEQ ID NO: 2353086 - DNA, 17 bp, Homo sapiens
ccacctgttttctgaaa

SEQ ID NO: 2353087 - DNA, 14 bp, Homo sapiens
ccaccttgccaggg

SEQ ID NO: 2353088 - DNA, 21 bp, Homo sapiens
ccacctttgggatcagcctcc

SEQ ID NO: 2353089 - DNA, 13 bp, Homo sapiens
ccacgattctccc

SEQ ID NO: 2353090 - DNA, 15 bp, Homo sapiens
ccacgcagaggacgc

SEQ ID NO: 2353091 - DNA, 19 bp, Homo sapiens
ccacgcagtgcctggagtt

SEQ ID NO: 2353092 - DNA, 20 bp, Homo sapiens
ccacgcgtgccgtggcacca

SEQ ID NO: 2353093 - DNA, 17 bp, Homo sapiens
ccacgcttctccggatc

SEQ ID NO: 2353094 - DNA, 23 bp, Homo sapiens
ccactaaaaatattgtttctgca

SEQ ID NO: 2353095 - DNA, 13 bp, Homo sapiens
ccactacacctgg

SEQ ID NO: 2353096 - DNA, 15 bp, Homo sapiens
ccactacacctggct

SEQ ID NO: 2353097 - DNA, 17 bp, Homo sapiens
ccactacacctggctga

SEQ ID NO: 2353098 - DNA, 13 bp, Homo sapiens
ccactcattttga

SEQ ID NO: 2353099 - DNA, 20 bp, Homo sapiens
ccactccacctccacccact

SEQ ID NO: 2353100 - DNA, 15 bp, Homo sapiens
ccactcctctgctga

SEQ ID NO: 2353101 - DNA, 23 bp, Homo sapiens
ccactcggatggaccaacctgct

SEQ ID NO: 2353102 - DNA, 17 bp, Homo sapiens
ccactcttttgctgtgc

SEQ ID NO: 2353103 - DNA, 14 bp, Homo sapiens
ccactgccagcagc

SEQ ID NO: 2353104 - DNA, 16 bp, Homo sapiens
ccactgccagcagcag

SEQ ID NO: 2353105 - DNA, 17 bp, Homo sapiens
ccactgccagcagcagc

SEQ ID NO: 2353106 - DNA, 15 bp, Homo sapiens
ccactgcttctcttt

SEQ ID NO: 2353107 - DNA, 13 bp, Homo sapiens
ccactgtccgcct

SEQ ID NO: 2353108 - DNA, 22 bp, Homo sapiens
ccactgtctccacccaccttga

SEQ ID NO: 2353109 - DNA, 17 bp, Homo sapiens
ccactgtgccactgact

SEQ ID NO: 2353110 - DNA, 22 bp, Homo sapiens
ccactgttctgttcatttccta

SEQ ID NO: 2353111 - DNA, 18 bp, Homo sapiens
ccactgtttctcttgagc

SEQ ID NO: 2353112 - DNA, 18 bp, Homo sapiens
ccactttcacgtggcctc

SEQ ID NO: 2353113 - DNA, 13 bp, Homo sapiens
ccagaaacatctc

SEQ ID NO: 2353114 - DNA, 18 bp, Homo sapiens
ccagaaagcctctctctc

SEQ ID NO: 2353115 - DNA, 21 bp, Homo sapiens
ccagaaagcctctctctccct

SEQ ID NO: 2353116 - DNA, 16 bp, Homo sapiens
ccagaaagggtgccag

SEQ ID NO: 2353117 - DNA, 10 bp, Homo sapiens
ccagaaattc

SEQ ID NO: 2353118 - DNA, 16 bp, Homo sapiens
ccagaacccagtgttt

SEQ ID NO: 2353119 - DNA, 21 bp, Homo sapiens
ccagaacgtggtttgcctgag

SEQ ID NO: 2353120 - DNA, 13 bp, Homo sapiens
ccagaagagccca

SEQ ID NO: 2353121 - DNA, 14 bp, Homo sapiens
ccagaagagcccat

SEQ ID NO: 2353122 - DNA, 23 bp, Homo sapiens
ccagaagccttggaaccagcccc

SEQ ID NO: 2353123 - DNA, 17 bp, Homo sapiens
ccagacataaaggaaaa

SEQ ID NO: 2353124 - DNA, 17 bp, Homo sapiens
ccagacatggacctcca

SEQ ID NO: 2353125 - DNA, 22 bp, Homo sapiens
ccagacgtcaggccctgactcc

SEQ ID NO: 2353126 - DNA, 22 bp, Homo sapiens
ccagactaaaggatccagagag

SEQ ID NO: 2353127 - DNA, 14 bp, Homo sapiens
ccagagactttagg

SEQ ID NO: 2353128 - DNA, 15 bp, Homo sapiens
ccagagagcagctcc

SEQ ID NO: 2353129 - DNA, 13 bp, Homo sapiens
ccagagaggacct

SEQ ID NO: 2353130 - DNA, 16 bp, Homo sapiens
ccagagaggcactcag

SEQ ID NO: 2353131 - DNA, 14 bp, Homo sapiens
ccagagcagatgca

SEQ ID NO: 2353132 - DNA, 16 bp, Homo sapiens
ccagagcagatgcaga

SEQ ID NO: 2353133 - DNA, 14 bp, Homo sapiens
ccagagccccaagc

SEQ ID NO: 2353134 - DNA, 15 bp, Homo sapiens
ccagagccccaagca

SEQ ID NO: 2353135 - DNA, 16 bp, Homo sapiens
ccagagccccaagcag

SEQ ID NO: 2353136 - DNA, 12 bp, Homo sapiens
ccagagctgcct

SEQ ID NO: 2353137 - DNA, 14 bp, Homo sapiens
ccagagctggtgga

SEQ ID NO: 2353138 - DNA, 22 bp, Homo sapiens
ccagaggaatcctggcagccca

SEQ ID NO: 2353139 - DNA, 16 bp, Homo sapiens
ccagaggagggcagag

SEQ ID NO: 2353140 - DNA, 19 bp, Homo sapiens
ccagaggctgggagtccct

SEQ ID NO: 2353141 - DNA, 18 bp, Homo sapiens
ccagagggcatgctgaat

SEQ ID NO: 2353142 - DNA, 15 bp, Homo sapiens
ccagagggtgtggct

SEQ ID NO: 2353143 - DNA, 18 bp, Homo sapiens
ccagagggtgtggctttc

SEQ ID NO: 2353144 - DNA, 21 bp, Homo sapiens
ccagagggtgtggctttccag

SEQ ID NO: 2353145 - DNA, 21 bp, Homo sapiens
ccagaggtaacagaacagctt

SEQ ID NO: 2353146 - DNA, 23 bp, Homo sapiens
ccagaggtaacagaacagcttca

SEQ ID NO: 2353147 - DNA, 11 bp, Homo sapiens
ccagaggtgga

SEQ ID NO: 2353148 - DNA, 14 bp, Homo sapiens
ccagaggtggatgt

SEQ ID NO: 2353149 - DNA, 16 bp, Homo sapiens
ccagaggtggatgtta

SEQ ID NO: 2353150 - DNA, 14 bp, Homo sapiens
ccagagtggcccac

SEQ ID NO: 2353151 - DNA, 18 bp, Homo sapiens
ccagatcactgccacact

SEQ ID NO: 2353152 - DNA, 22 bp, Homo sapiens
ccagatctttctcttccctgaa

SEQ ID NO: 2353153 - DNA, 15 bp, Homo sapiens
ctctctgatgtccca

SEQ ID NO: 2353154 - DNA, 16 bp, Homo sapiens
ctctctgccctgtgta

SEQ ID NO: 2353155 - DNA, 17 bp, Homo sapiens
ctctctgccctgtgtac

SEQ ID NO: 2353156 - DNA, 17 bp, Homo sapiens
ctctcttctcagagtgg

SEQ ID NO: 2353157 - DNA, 14 bp, Homo sapiens
ctctctttccttga

SEQ ID NO: 2353158 - DNA, 15 bp, Homo sapiens
ctctgaaatcttccc

SEQ ID NO: 2353159 - DNA, 19 bp, Homo sapiens
ctctgaagaactctctgga

SEQ ID NO: 2353160 - DNA, 19 bp, Homo sapiens
ctctgaagccacaaatagg

SEQ ID NO: 2353161 - DNA, 15 bp, Homo sapiens
ctctgaagggacccc

SEQ ID NO: 2353162 - DNA, 13 bp, Homo sapiens
ctctgaagttaaa

SEQ ID NO: 2353163 - DNA, 17 bp, Homo sapiens
ctctgaagttaaaatga

SEQ ID NO: 2353164 - DNA, 19 bp, Homo sapiens
ctctgaatgctatttgtgt

SEQ ID NO: 2353165 - DNA, 10 bp, Homo sapiens
ctctgagaac

SEQ ID NO: 2353166 - DNA, 16 bp, Homo sapiens
ctctgagaagctctga

SEQ ID NO: 2353167 - DNA, 14 bp, Homo sapiens
ctctgatgtcccag

SEQ ID NO: 2353168 - DNA, 22 bp, Homo sapiens
ctctgcacaccctccagagaca

SEQ ID NO: 2353169 - DNA, 13 bp, Homo sapiens
ctctgcacatgtc

SEQ ID NO: 2353170 - DNA, 16 bp, Homo sapiens
ctctgcacatgtcttg

SEQ ID NO: 2353171 - DNA, 13 bp, Homo sapiens
ctctgcagatgtg

SEQ ID NO: 2353172 - DNA, 15 bp, Homo sapiens
ctctgcccctggacc

SEQ ID NO: 2353173 - DNA, 15 bp, Homo sapiens
ctctgccccttgccc

SEQ ID NO: 2353174 - DNA, 16 bp, Homo sapiens
ctctgcccgcagagcc

SEQ ID NO: 2353175 - DNA, 16 bp, Homo sapiens
ctctgcctacagccag

SEQ ID NO: 2353176 - DNA, 20 bp, Homo sapiens
ctctgcctgccccgccccca

SEQ ID NO: 2353177 - DNA, 21 bp, Homo sapiens
ctctgcctttatgatgctaag

SEQ ID NO: 2353178 - DNA, 21 bp, Homo sapiens
ctctgcttactaatgtgcccc

SEQ ID NO: 2353179 - DNA, 16 bp, Homo sapiens
ctctgcttctttgcct

SEQ ID NO: 2353180 - DNA, 15 bp, Homo sapiens
ctctggaatgttttt

SEQ ID NO: 2353181 - DNA, 17 bp, Homo sapiens
ctctggacagcagaagc

SEQ ID NO: 2353182 - DNA, 18 bp, Homo sapiens
ctctggacagcagaagcc

SEQ ID NO: 2353183 - DNA, 19 bp, Homo sapiens
ctctggacagcagaagcct

SEQ ID NO: 2353184 - DNA, 20 bp, Homo sapiens
ctctggacagcagaagcctc

SEQ ID NO: 2353185 - DNA, 17 bp, Homo sapiens
ctctggacggcaggctc

SEQ ID NO: 2353186 - DNA, 18 bp, Homo sapiens
ctctggacggcaggctca

SEQ ID NO: 2353187 - DNA, 18 bp, Homo sapiens
ctctggaggtgctgctct

SEQ ID NO: 2353188 - DNA, 19 bp, Homo sapiens
ctctggaggtgctgctcta

SEQ ID NO: 2353189 - DNA, 21 bp, Homo sapiens
ctctggatgatggattccaca

SEQ ID NO: 2353190 - DNA, 17 bp, Homo sapiens
ctctggctttcccagga

SEQ ID NO: 2353191 - DNA, 20 bp, Homo sapiens
ctctgggtcagaaccagagg

SEQ ID NO: 2353192 - DNA, 16 bp, Homo sapiens
ctctgtaagtgtagct

SEQ ID NO: 2353193 - DNA, 19 bp, Homo sapiens
ctctgtaagtgtagctcaa

SEQ ID NO: 2353194 - DNA, 16 bp, Homo sapiens
ctctgtctacctggtc

SEQ ID NO: 2353195 - DNA, 22 bp, Homo sapiens
ctctgtctaggactgcagtgtg

SEQ ID NO: 2353196 - DNA, 17 bp, Homo sapiens
ctctgtgggctggcagt

SEQ ID NO: 2353197 - DNA, 20 bp, Homo sapiens
ctgaggatgggtcagagcta

SEQ ID NO: 2353198 - DNA, 23 bp, Homo sapiens
ctgaggccagagtcaccttttct

SEQ ID NO: 2353199 - DNA, 21 bp, Homo sapiens
ctgaggccctgggctgggtgc

SEQ ID NO: 2353200 - DNA, 19 bp, Homo sapiens
ctgaggcctagactctgtc

SEQ ID NO: 2353201 - DNA, 17 bp, Homo sapiens
ctgaggcggaggctgtg

SEQ ID NO: 2353202 - DNA, 15 bp, Homo sapiens
ctgagggcagtaccc

SEQ ID NO: 2353203 - DNA, 20 bp, Homo sapiens
ctgaggtcccctcgtcccat

SEQ ID NO: 2353204 - DNA, 16 bp, Homo sapiens
ctgaggtgcactggga

SEQ ID NO: 2353205 - DNA, 17 bp, Homo sapiens
ctgaggtgcactgggag

SEQ ID NO: 2353206 - DNA, 16 bp, Homo sapiens
ctgaggttcctctgcc

SEQ ID NO: 2353207 - DNA, 20 bp, Homo sapiens
ctgaggttcctctgcctgcc

SEQ ID NO: 2353208 - DNA, 13 bp, Homo sapiens
ctgagtatttttt

SEQ ID NO: 2353209 - DNA, 14 bp, Homo sapiens
ctgagtcagagcca

SEQ ID NO: 2353210 - DNA, 21 bp, Homo sapiens
ctgagtcagagccatgtcttc

SEQ ID NO: 2353211 - DNA, 13 bp, Homo sapiens
ctgagtcagtgct

SEQ ID NO: 2353212 - DNA, 18 bp, Homo sapiens
ctgagtcagtgctctcag

SEQ ID NO: 2353213 - DNA, 18 bp, Homo sapiens
ctgagtcgtacagaaagc

SEQ ID NO: 2353214 - DNA, 20 bp, Homo sapiens
ctgagtcgtacagaaagctg

SEQ ID NO: 2353215 - DNA, 21 bp, Homo sapiens
ctgagtcgtacagaaagctgc

SEQ ID NO: 2353216 - DNA, 23 bp, Homo sapiens
ctgagtgcgggctgaggccagag

SEQ ID NO: 2353217 - DNA, 19 bp, Homo sapiens
ctgagttctgggtttctag

SEQ ID NO: 2353218 - DNA, 16 bp, Homo sapiens
ctgatatattttacaa

SEQ ID NO: 2353219 - DNA, 18 bp, Homo sapiens
ctgatattatttcttctc

SEQ ID NO: 2353220 - DNA, 23 bp, Homo sapiens
ctgatcaagagtccggatttcta

SEQ ID NO: 2353221 - DNA, 22 bp, Homo sapiens
ctgatcagtgggcctccaagga

SEQ ID NO: 2353222 - DNA, 12 bp, Homo sapiens
ctgatcccatgg

SEQ ID NO: 2353223 - DNA, 17 bp, Homo sapiens
ctgatcttttaaaatca

SEQ ID NO: 2353224 - DNA, 23 bp, Homo sapiens
ctgatgcatacggctatattggt

SEQ ID NO: 2353225 - DNA, 14 bp, Homo sapiens
ctgatggccttaat

SEQ ID NO: 2353226 - DNA, 13 bp, Homo sapiens
ctgatgtcccagt

SEQ ID NO: 2353227 - DNA, 12 bp, Homo sapiens
ctgattatgtaa

SEQ ID NO: 2353228 - DNA, 18 bp, Homo sapiens
ctgattatgtaagcattt

SEQ ID NO: 2353229 - DNA, 14 bp, Homo sapiens
ctgattctggcttt

SEQ ID NO: 2353230 - DNA, 18 bp, Homo sapiens
ctgattctggctttaagc

SEQ ID NO: 2353231 - DNA, 19 bp, Homo sapiens
ctgattctggctttaagcc

SEQ ID NO: 2353232 - DNA, 18 bp, Homo sapiens
ctgatttgtaacccactg

SEQ ID NO: 2353233 - DNA, 19 bp, Homo sapiens
ctgatttgtaacccactga

SEQ ID NO: 2353234 - DNA, 15 bp, Homo sapiens
ctgcaaaaggcctct

SEQ ID NO: 2353235 - DNA, 19 bp, Homo sapiens
ctgcaaaaggcctcttgta

SEQ ID NO: 2353236 - DNA, 21 bp, Homo sapiens
ctgcaaaaggcctcttgtaaa

SEQ ID NO: 2353237 - DNA, 18 bp, Homo sapiens
ctgcaaaatacattattc

SEQ ID NO: 2353238 - DNA, 20 bp, Homo sapiens
ctgcaaacctgacccctgct

SEQ ID NO: 2353239 - DNA, 15 bp, Homo sapiens
ctgcaaactgggaac

SEQ ID NO: 2353240 - DNA, 16 bp, Homo sapiens
ctgcaaactgggaacc

SEQ ID NO: 2353241 - DNA, 21 bp, Homo sapiens
ctgcaaactgggaaccccttt

SEQ ID NO: 2353242 - DNA, 12 bp, Homo sapiens
ctgcaaagcttt

SEQ ID NO: 2353243 - DNA, 15 bp, Homo sapiens
ctgcaaagctttggc

SEQ ID NO: 2353244 - DNA, 20 bp, Homo sapiens
ctgcaaagctttggctgaga

SEQ ID NO: 2353245 - DNA, 21 bp, Homo sapiens
ctgcaagatggacacgagcca

SEQ ID NO: 2353246 - DNA, 19 bp, Homo sapiens
ctgcaattccctggataga

SEQ ID NO: 2353247 - DNA, 13 bp, Homo sapiens
ctgcacagtgttg

SEQ ID NO: 2353248 - DNA, 16 bp, Homo sapiens
ctgcacatgtcttgta

SEQ ID NO: 2353249 - DNA, 17 bp, Homo sapiens
ctgcacccctgggccag

SEQ ID NO: 2353250 - DNA, 21 bp, Homo sapiens
ctgcactaaaacccatcttcc

SEQ ID NO: 2353251 - DNA, 16 bp, Homo sapiens
ctgcactccagcctgg

SEQ ID NO: 2353252 - DNA, 20 bp, Homo sapiens
ctgcactccagcctggggga

SEQ ID NO: 2353253 - DNA, 11 bp, Homo sapiens
ctgcactgtga

SEQ ID NO: 2353254 - DNA, 12 bp, Homo sapiens
ctgcactgtgaa

SEQ ID NO: 2353255 - DNA, 22 bp, Homo sapiens
ctgcagaaaattaattgaaata

SEQ ID NO: 2353256 - DNA, 13 bp, Homo sapiens
ctgcagaacccac

SEQ ID NO: 2353257 - DNA, 20 bp, Homo sapiens
ctgcagacctcaagccatca

SEQ ID NO: 2353258 - DNA, 21 bp, Homo sapiens
ctgcagagaaacttaagcaaa

SEQ ID NO: 2353259 - DNA, 14 bp, Homo sapiens
ctgcagagatttct

SEQ ID NO: 2353260 - DNA, 15 bp, Homo sapiens
ctgcagagctatggt

SEQ ID NO: 2353261 - DNA, 21 bp, Homo sapiens
ctgcagagctatggtgaggtg

SEQ ID NO: 2353262 - DNA, 16 bp, Homo sapiens
ctgcagatgccaccct

SEQ ID NO: 2353263 - DNA, 20 bp, Homo sapiens
ctgcaggagagagcagcact

SEQ ID NO: 2353264 - DNA, 22 bp, Homo sapiens
ctgcaggagagagcagcactcc

SEQ ID NO: 2353265 - DNA, 14 bp, Homo sapiens
ctgcaggcaggaac

SEQ ID NO: 2353266 - DNA, 15 bp, Homo sapiens
ctgcagggagcaact

SEQ ID NO: 2353267 - DNA, 15 bp, Homo sapiens
ctgcagtgtgccccc

SEQ ID NO: 2353268 - DNA, 20 bp, Homo sapiens
ctgcagttctactcaggctg

SEQ ID NO: 2353269 - DNA, 23 bp, Homo sapiens
ctgcagttctactcaggctggtg

SEQ ID NO: 2353270 - DNA, 22 bp, Homo sapiens
ctgcagttttgctatctgggct

SEQ ID NO: 2353271 - DNA, 13 bp, Homo sapiens
ctgcatgcagaaa

SEQ ID NO: 2353272 - DNA, 22 bp, Homo sapiens
ctgcatgcagaaacttggatgt

SEQ ID NO: 2353273 - DNA, 23 bp, Homo sapiens
ctgcattcatttttatagcaaca

SEQ ID NO: 2353274 - DNA, 14 bp, Homo sapiens
gaaataatttgaat

SEQ ID NO: 2353275 - DNA, 21 bp, Homo sapiens
gaaatagacaaaaagtatatt

SEQ ID NO: 2353276 - DNA, 20 bp, Homo sapiens
gaaatagatatcctctcccc

SEQ ID NO: 2353277 - DNA, 22 bp, Homo sapiens
gaaatagatatcctctccccct

SEQ ID NO: 2353278 - DNA, 17 bp, Homo sapiens
gaaatataacacatttt

SEQ ID NO: 2353279 - DNA, 18 bp, Homo sapiens
gaaatataacacattttt

SEQ ID NO: 2353280 - DNA, 19 bp, Homo sapiens
gaaatattttctactttaa

SEQ ID NO: 2353281 - DNA, 17 bp, Homo sapiens
gaaatcatgtccataca

SEQ ID NO: 2353282 - DNA, 16 bp, Homo sapiens
gaaatgaaaacatgta

SEQ ID NO: 2353283 - DNA, 15 bp, Homo sapiens
gaaatgaattaaagt

SEQ ID NO: 2353284 - DNA, 16 bp, Homo sapiens
gaaatggaaagcagag

SEQ ID NO: 2353285 - DNA, 20 bp, Homo sapiens
gaaatgttctgtcaaatgtg

SEQ ID NO: 2353286 - DNA, 19 bp, Homo sapiens
gaaatgtttttaataaaag

SEQ ID NO: 2353287 - DNA, 22 bp, Homo sapiens
gaaattaagcattttgaaacaa

SEQ ID NO: 2353288 - DNA, 12 bp, Homo sapiens
gaaattctgtgg

SEQ ID NO: 2353289 - DNA, 13 bp, Homo sapiens
gaaattcttccta

SEQ ID NO: 2353290 - DNA, 23 bp, Homo sapiens
gaaattgatttgtcaagaggata

SEQ ID NO: 2353291 - DNA, 19 bp, Homo sapiens
gaaattgcagtaacaaaag

SEQ ID NO: 2353292 - DNA, 16 bp, Homo sapiens
gaaattgcatactttg

SEQ ID NO: 2353293 - DNA, 22 bp, Homo sapiens
gaaattttaacctatgatattt

SEQ ID NO: 2353294 - DNA, 19 bp, Homo sapiens
gaaattttgtaagaaggca

SEQ ID NO: 2353295 - DNA, 20 bp, Homo sapiens
gaaattttgtaagaaggcaa

SEQ ID NO: 2353296 - DNA, 16 bp, Homo sapiens
gaacacagtgtctgtt

SEQ ID NO: 2353297 - DNA, 15 bp, Homo sapiens
gaacacatttctctg

SEQ ID NO: 2353298 - DNA, 19 bp, Homo sapiens
gaacactaactcaccagcc

SEQ ID NO: 2353299 - DNA, 13 bp, Homo sapiens
gaacactcttagc

SEQ ID NO: 2353300 - DNA, 13 bp, Homo sapiens
gaacactggacct

SEQ ID NO: 2353301 - DNA, 11 bp, Homo sapiens
gaacagctgtg

SEQ ID NO: 2353302 - DNA, 12 bp, Homo sapiens
gaacagctgtgt

SEQ ID NO: 2353303 - DNA, 16 bp, Homo sapiens
gaacagctgtgtctgc

SEQ ID NO: 2353304 - DNA, 15 bp, Homo sapiens
gaacagcttcaggtt

SEQ ID NO: 2353305 - DNA, 12 bp, Homo sapiens
gaacaggatgcc

SEQ ID NO: 2353306 - DNA, 17 bp, Homo sapiens
gaacatactgattggga

SEQ ID NO: 2353307 - DNA, 13 bp, Homo sapiens
gaacatgccccct

SEQ ID NO: 2353308 - DNA, 14 bp, Homo sapiens
gaacatgccccctg

SEQ ID NO: 2353309 - DNA, 23 bp, Homo sapiens
gaacattcgaggtgtcaccctgc

SEQ ID NO: 2353310 - DNA, 23 bp, Homo sapiens
gaaccaagtggaccttgagacca

SEQ ID NO: 2353311 - DNA, 24 bp, Homo sapiens
gaaccaagtggaccttgagaccac

SEQ ID NO: 2353312 - DNA, 18 bp, Homo sapiens
gaaccactgcttctcttt

SEQ ID NO: 2353313 - DNA, 18 bp, Homo sapiens
gaaccagccggggcctta

SEQ ID NO: 2353314 - DNA, 23 bp, Homo sapiens
gaaccccccgcccatgctgtccg

SEQ ID NO: 2353315 - DNA, 18 bp, Homo sapiens
gaacctatagcatcttct

SEQ ID NO: 2353316 - DNA, 16 bp, Homo sapiens
gaacctctcgccatga

SEQ ID NO: 2353317 - DNA, 20 bp, Homo sapiens
gaacctctcgccatgatcag

SEQ ID NO: 2353318 - DNA, 20 bp, Homo sapiens
gaacctgcacacaggacagc

SEQ ID NO: 2353319 - DNA, 18 bp, Homo sapiens
gaaccttggaccactcct

SEQ ID NO: 2353320 - DNA, 24 bp, Homo sapiens
gaaccttgtcccagccagtgagga

SEQ ID NO: 2353321 - DNA, 14 bp, Homo sapiens
gaacgttaaactat

SEQ ID NO: 2353322 - DNA, 16 bp, Homo sapiens
gaactaaatatgcaat

SEQ ID NO: 2353323 - DNA, 12 bp, Homo sapiens
gaactaatatat

SEQ ID NO: 2353324 - DNA, 14 bp, Homo sapiens
gaactaatatatga

SEQ ID NO: 2353325 - DNA, 14 bp, Homo sapiens
gaactccaggccct

SEQ ID NO: 2353326 - DNA, 23 bp, Homo sapiens
gaactccaggccctcctctccca

SEQ ID NO: 2353327 - DNA, 18 bp, Homo sapiens
gaactcctgccaggcaca

SEQ ID NO: 2353328 - DNA, 17 bp, Homo sapiens
gaactcctgccatagtc

SEQ ID NO: 2353329 - DNA, 18 bp, Homo sapiens
gaactcgcgctcagtaaa

SEQ ID NO: 2353330 - DNA, 17 bp, Homo sapiens
gaactctactcaaccca

SEQ ID NO: 2353331 - DNA, 13 bp, Homo sapiens
gaactgcaaagct

SEQ ID NO: 2353332 - DNA, 15 bp, Homo sapiens
gaactgcaaagcttt

SEQ ID NO: 2353333 - DNA, 15 bp, Homo sapiens
gaactgcagggttca

SEQ ID NO: 2353334 - DNA, 16 bp, Homo sapiens
gaactgtgccacaatg

SEQ ID NO: 2353335 - DNA, 13 bp, Homo sapiens
gaacttataatga

SEQ ID NO: 2353336 - DNA, 19 bp, Homo sapiens
gaacttgcgagtccaaggc

SEQ ID NO: 2353337 - DNA, 14 bp, Homo sapiens
gaacttgctgctgt

SEQ ID NO: 2353338 - DNA, 16 bp, Homo sapiens
gaacttttgtactgaa

SEQ ID NO: 2353339 - DNA, 12 bp, Homo sapiens
gaagaaagatgt

SEQ ID NO: 2353340 - DNA, 23 bp, Homo sapiens
gaagaaatctttctccctcaact

SEQ ID NO: 2353341 - DNA, 15 bp, Homo sapiens
gaagaagggagaaga

SEQ ID NO: 2353342 - DNA, 16 bp, Homo sapiens
gaagaagggagaagaa

SEQ ID NO: 2353343 - DNA, 12 bp, Homo sapiens
gaagaattccag

SEQ ID NO: 2353344 - DNA, 21 bp, Homo sapiens
gaagaattgaaaagtttttgt

SEQ ID NO: 2353345 - DNA, 23 bp, Homo sapiens
gaagacaccagagcagatgcaga

SEQ ID NO: 2353346 - DNA, 23 bp, Homo sapiens
gaagaccctcttgcccatcctga

SEQ ID NO: 2353347 - DNA, 23 bp, Homo sapiens
gaagagacagagacaagtaattt

SEQ ID NO: 2353348 - DNA, 15 bp, Homo sapiens
gaagagacagcccag

SEQ ID NO: 2353349 - DNA, 20 bp, Homo sapiens
gaagagaggcacctgctgga

SEQ ID NO: 2353350 - DNA, 10 bp, Homo sapiens
gaagagccac

SEQ ID NO: 2353351 - DNA, 17 bp, Homo sapiens
gaagagccacctgcaag

SEQ ID NO: 2353352 - DNA, 22 bp, Homo sapiens
gaagagccacctgcaagatgga

SEQ ID NO: 2353353 - DNA, 23 bp, Homo sapiens
gaagagcccgcagggccatgcag

SEQ ID NO: 2353354 - DNA, 21 bp, Homo sapiens
gaagatagtcttggaagctgt

SEQ ID NO: 2353355 - DNA, 14 bp, Homo sapiens
gaagatcactgtag

SEQ ID NO: 2353356 - DNA, 12 bp, Homo sapiens
gaagatttaatt

SEQ ID NO: 2353357 - DNA, 16 bp, Homo sapiens
gaagcaagccagacct

SEQ ID NO: 2353358 - DNA, 14 bp, Homo sapiens
gaagcaagggcaag

SEQ ID NO: 2353359 - DNA, 17 bp, Homo sapiens
gaagcagggtttctttt

SEQ ID NO: 2353360 - DNA, 16 bp, Homo sapiens
gaagcatgaaaaagca

SEQ ID NO: 2353361 - DNA, 22 bp, Homo sapiens
gaagcattccttctttgataat

SEQ ID NO: 2353362 - DNA, 14 bp, Homo sapiens
gaagccaagggaaa

SEQ ID NO: 2353363 - DNA, 17 bp, Homo sapiens
gaagccaagggaaaggg

SEQ ID NO: 2353364 - DNA, 23 bp, Homo sapiens
gaagccaagtggggtgctgggag

SEQ ID NO: 2353365 - DNA, 21 bp, Homo sapiens
gaagccatatatgaccagaag

SEQ ID NO: 2353366 - DNA, 14 bp, Homo sapiens
gaagcccctgggcc

SEQ ID NO: 2353367 - DNA, 19 bp, Homo sapiens
gaagcctccaagcacagag

SEQ ID NO: 2353368 - DNA, 15 bp, Homo sapiens
gaagccttcagctcc

SEQ ID NO: 2353369 - DNA, 16 bp, Homo sapiens
gaagccttcagctcca

SEQ ID NO: 2353370 - DNA, 17 bp, Homo sapiens
gaagccttcagctccag

SEQ ID NO: 2353371 - DNA, 16 bp, Homo sapiens
gaagccttggaaccag

SEQ ID NO: 2353372 - DNA, 20 bp, Homo sapiens
gaagccttggaaccagcccc

SEQ ID NO: 2353373 - DNA, 22 bp, Homo sapiens
gaagcggtggataactagccag

SEQ ID NO: 2353374 - DNA, 20 bp, Homo sapiens
gaagctcttactctttccta

SEQ ID NO: 2353375 - DNA, 22 bp, Homo sapiens
gaagctgttgtacatttatgat

SEQ ID NO: 2353376 - DNA, 15 bp, Homo sapiens
gaagctgtttggaaa

SEQ ID NO: 2353377 - DNA, 18 bp, Homo sapiens
gaagctgtttggaaaaga

SEQ ID NO: 2353378 - DNA, 14 bp, Homo sapiens
gaaggaaaatattt

SEQ ID NO: 2353379 - DNA, 19 bp, Homo sapiens
gaaggaaggcctgagcccc

SEQ ID NO: 2353380 - DNA, 23 bp, Homo sapiens
gaaggaggggagagacaggcagc

SEQ ID NO: 2353381 - DNA, 23 bp, Homo sapiens
gacagcatcccttcccacatgcc

SEQ ID NO: 2353382 - DNA, 23 bp, Homo sapiens
gacagcccaggatactggcacag

SEQ ID NO: 2353383 - DNA, 15 bp, Homo sapiens
gacagcttgagccgg

SEQ ID NO: 2353384 - DNA, 15 bp, Homo sapiens
gacagctttctggga

SEQ ID NO: 2353385 - DNA, 16 bp, Homo sapiens
gacaggcagcccagca

SEQ ID NO: 2353386 - DNA, 21 bp, Homo sapiens
gacaggcagcctcctttgtgt

SEQ ID NO: 2353387 - DNA, 21 bp, Homo sapiens
gacagggtcttgctctgtccc

SEQ ID NO: 2353388 - DNA, 22 bp, Homo sapiens
gacagggtcttgctctgtcccc

SEQ ID NO: 2353389 - DNA, 15 bp, Homo sapiens
gacaggtcttttcaa

SEQ ID NO: 2353390 - DNA, 21 bp, Homo sapiens
gacagtatcccacatccaact

SEQ ID NO: 2353391 - DNA, 15 bp, Homo sapiens
gacagtgaatttggg

SEQ ID NO: 2353392 - DNA, 22 bp, Homo sapiens
gacagtgcctcttccagtgaac

SEQ ID NO: 2353393 - DNA, 14 bp, Homo sapiens
gacagtttcttagc

SEQ ID NO: 2353394 - DNA, 21 bp, Homo sapiens
gacagtttcttagctttttaa

SEQ ID NO: 2353395 - DNA, 22 bp, Homo sapiens
gacttgctgtccaggcagctcc

SEQ ID NO: 2353396 - DNA, 12 bp, Homo sapiens
gacttgtgtctg

SEQ ID NO: 2353397 - DNA, 21 bp, Homo sapiens
gactttacccatttgggtggg

SEQ ID NO: 2353398 - DNA, 19 bp, Homo sapiens
gactttctttttgtagctg

SEQ ID NO: 2353399 - DNA, 20 bp, Homo sapiens
gacttttgtctgatcaagtg

SEQ ID NO: 2353400 - DNA, 17 bp, Homo sapiens
gactttttttgtatgtg

SEQ ID NO: 2353401 - DNA, 14 bp, Homo sapiens
gagaaaaataaatg

SEQ ID NO: 2353402 - DNA, 19 bp, Homo sapiens
gagaaacactgaaaagaag

SEQ ID NO: 2353403 - DNA, 14 bp, Homo sapiens
gagaaattctgtgg

SEQ ID NO: 2353404 - DNA, 20 bp, Homo sapiens
gagaacacgttgccaggggc

SEQ ID NO: 2353405 - DNA, 22 bp, Homo sapiens
gagaactcgcgctcagtaaacg

SEQ ID NO: 2353406 - DNA, 21 bp, Homo sapiens
gagaactcgttcacctccaag

SEQ ID NO: 2353407 - DNA, 13 bp, Homo sapiens
gagaagcatgaaa

SEQ ID NO: 2353408 - DNA, 20 bp, Homo sapiens
gagaagcggtggataactag

SEQ ID NO: 2353409 - DNA, 13 bp, Homo sapiens
gagaagctctgaa

SEQ ID NO: 2353410 - DNA, 12 bp, Homo sapiens
gagaagctgcag

SEQ ID NO: 2353411 - DNA, 13 bp, Homo sapiens
gagaagctgcagg

SEQ ID NO: 2353412 - DNA, 21 bp, Homo sapiens
gagaagtgggggcagcccagg

SEQ ID NO: 2353413 - DNA, 16 bp, Homo sapiens
gagaataaaattccta

SEQ ID NO: 2353414 - DNA, 23 bp, Homo sapiens
gagaatgagtccttgatttcaaa

SEQ ID NO: 2353415 - DNA, 20 bp, Homo sapiens
gagaatggtgtgaacccggg

SEQ ID NO: 2353416 - DNA, 21 bp, Homo sapiens
gagaatggtgtgaacccggga

SEQ ID NO: 2353417 - DNA, 21 bp, Homo sapiens
gagaatgtagatattgtgaag

SEQ ID NO: 2353418 - DNA, 19 bp, Homo sapiens
gagacagaggaaagggctg

SEQ ID NO: 2353419 - DNA, 13 bp, Homo sapiens
gagacagcccagg

SEQ ID NO: 2353420 - DNA, 13 bp, Homo sapiens
gagacaggcagcc

SEQ ID NO: 2353421 - DNA, 14 bp, Homo sapiens
gagaccatcctggc

SEQ ID NO: 2353422 - DNA, 16 bp, Homo sapiens
gagaccatcctggcta

SEQ ID NO: 2353423 - DNA, 23 bp, Homo sapiens
gagacccccccccaactccagga

SEQ ID NO: 2353424 - DNA, 20 bp, Homo sapiens
gagacgtttataaacagaaa

SEQ ID NO: 2353425 - DNA, 23 bp, Homo sapiens
gagacgtttataaacagaaatgg

SEQ ID NO: 2353426 - DNA, 16 bp, Homo sapiens
gagactgcgttctgca

SEQ ID NO: 2353427 - DNA, 17 bp, Homo sapiens
gagactgcgttctgcaa

SEQ ID NO: 2353428 - DNA, 13 bp, Homo sapiens
gagactttgtaga

SEQ ID NO: 2353429 - DNA, 12 bp, Homo sapiens
gagagaagctgg

SEQ ID NO: 2353430 - DNA, 13 bp, Homo sapiens
gagagacaggcag

SEQ ID NO: 2353431 - DNA, 13 bp, Homo sapiens
gagagagagagga

SEQ ID NO: 2353432 - DNA, 14 bp, Homo sapiens
gagagagagaggac

SEQ ID NO: 2353433 - DNA, 13 bp, Homo sapiens
gagagaggacagc

SEQ ID NO: 2353434 - DNA, 14 bp, Homo sapiens
gagagagttagcat

SEQ ID NO: 2353435 - DNA, 14 bp, Homo sapiens
gagagcagcactcc

SEQ ID NO: 2353436 - DNA, 13 bp, Homo sapiens
gagagcagctccc

SEQ ID NO: 2353437 - DNA, 12 bp, Homo sapiens
gagagcagctgg

SEQ ID NO: 2353438 - DNA, 19 bp, Homo sapiens
gagagcagctggctctcca

SEQ ID NO: 2353439 - DNA, 17 bp, Homo sapiens
gagagccagtggcgggt

SEQ ID NO: 2353440 - DNA, 21 bp, Homo sapiens
gagagcccagaggtaacagaa

SEQ ID NO: 2353441 - DNA, 23 bp, Homo sapiens
gagagcccagaggtaacagaaca

SEQ ID NO: 2353442 - DNA, 14 bp, Homo sapiens
gagagccctgaggc

SEQ ID NO: 2353443 - DNA, 14 bp, Homo sapiens
gagagcctgctggc

SEQ ID NO: 2353444 - DNA, 15 bp, Homo sapiens
gagagcctgctggca

SEQ ID NO: 2353445 - DNA, 13 bp, Homo sapiens
gagagctcaccat

SEQ ID NO: 2353446 - DNA, 10 bp, Homo sapiens
gagaggacag

SEQ ID NO: 2353447 - DNA, 18 bp, Homo sapiens
gagaggagacggagggga

SEQ ID NO: 2353448 - DNA, 18 bp, Homo sapiens
gagaggatgagagcccag

SEQ ID NO: 2353449 - DNA, 19 bp, Homo sapiens
gagaggcactcagtgagcc

SEQ ID NO: 2353450 - DNA, 16 bp, Homo sapiens
gagaggcgcgtctgcc

SEQ ID NO: 2353451 - DNA, 16 bp, Homo sapiens
gagaggtagcgagctg

SEQ ID NO: 2353452 - DNA, 18 bp, Homo sapiens
gagaggtagcgagctgct

SEQ ID NO: 2353453 - DNA, 22 bp, Homo sapiens
gagagtatttttatacaaacct

SEQ ID NO: 2353454 - DNA, 20 bp, Homo sapiens
gagagtcagctctctgccct

SEQ ID NO: 2353455 - DNA, 14 bp, Homo sapiens
gagagttagcatgt

SEQ ID NO: 2353456 - DNA, 18 bp, Homo sapiens
gagatcgagaccatcctg

SEQ ID NO: 2353457 - DNA, 19 bp, Homo sapiens
gagatcgagaccatcctgg

SEQ ID NO: 2353458 - DNA, 21 bp, Homo sapiens
gagatcgagaccatcctggct

SEQ ID NO: 2353459 - DNA, 18 bp, Homo sapiens
gagatctgctgtcctgtt

SEQ ID NO: 2353460 - DNA, 12 bp, Homo sapiens
gagatgagccca

SEQ ID NO: 2353461 - DNA, 15 bp, Homo sapiens
gagatgcttctctcc

SEQ ID NO: 2353462 - DNA, 15 bp, Homo sapiens
gagatgtagaaagtt

SEQ ID NO: 2353463 - DNA, 17 bp, Homo sapiens
gagattgggatactgta

SEQ ID NO: 2353464 - DNA, 18 bp, Homo sapiens
gagcaaaattcaaaaaga

SEQ ID NO: 2353465 - DNA, 18 bp, Homo sapiens
gagcaaacccagaggtgg

SEQ ID NO: 2353466 - DNA, 15 bp, Homo sapiens
gagcaactctccact

SEQ ID NO: 2353467 - DNA, 21 bp, Homo sapiens
gagcacaaaattcaaagcatg

SEQ ID NO: 2353468 - DNA, 14 bp, Homo sapiens
gagcaccctctgga

SEQ ID NO: 2353469 - DNA, 15 bp, Homo sapiens
gagcaccctctggat

SEQ ID NO: 2353470 - DNA, 16 bp, Homo sapiens
gagcactggactccgg

SEQ ID NO: 2353471 - DNA, 13 bp, Homo sapiens
gagcagcctctgg

SEQ ID NO: 2353472 - DNA, 14 bp, Homo sapiens
gagcagctggctct

SEQ ID NO: 2353473 - DNA, 21 bp, Homo sapiens
gagcaggcacgggtggtcccc

SEQ ID NO: 2353474 - DNA, 19 bp, Homo sapiens
gagcagggagagctcacca

SEQ ID NO: 2353475 - DNA, 15 bp, Homo sapiens
gagcagtcagagtcc

SEQ ID NO: 2353476 - DNA, 21 bp, Homo sapiens
gagcagttggccaagcagaaa

SEQ ID NO: 2353477 - DNA, 15 bp, Homo sapiens
gagccacaagctgca

SEQ ID NO: 2353478 - DNA, 22 bp, Homo sapiens
gagccagtgggccagccacaga

SEQ ID NO: 2353479 - DNA, 14 bp, Homo sapiens
gagccattttgtga

SEQ ID NO: 2353480 - DNA, 23 bp, Homo sapiens
gagcccacgcccgactagcaggc

SEQ ID NO: 2353481 - DNA, 16 bp, Homo sapiens
gagcccagtctgttga

SEQ ID NO: 2353482 - DNA, 14 bp, Homo sapiens
gagccccagtgctg

SEQ ID NO: 2353483 - DNA, 15 bp, Homo sapiens
gagcccccaccctgt

SEQ ID NO: 2353484 - DNA, 22 bp, Homo sapiens
gagcccccaccctgttcctgct

SEQ ID NO: 2353485 - DNA, 23 bp, Homo sapiens
gagcccccaccctgttcctgctg

SEQ ID NO: 2353486 - DNA, 13 bp, Homo sapiens
gagcccccagcag

SEQ ID NO: 2353487 - DNA, 17 bp, Homo sapiens
gagcccccagcagaggc

SEQ ID NO: 2353488 - DNA, 15 bp, Homo sapiens
gagtcagctctctgc

SEQ ID NO: 2353489 - DNA, 18 bp, Homo sapiens
gagtcagctctctgccct

SEQ ID NO: 2353490 - DNA, 22 bp, Homo sapiens
gagtcagggtgaactgcaaagc

SEQ ID NO: 2353491 - DNA, 23 bp, Homo sapiens
gagtccagggtttctctgcagat

SEQ ID NO: 2353492 - DNA, 16 bp, Homo sapiens
gagtccagtgctctgc

SEQ ID NO: 2353493 - DNA, 15 bp, Homo sapiens
gagtccattctccca

SEQ ID NO: 2353494 - DNA, 17 bp, Homo sapiens
gagtccattctcccagg

SEQ ID NO: 2353495 - DNA, 15 bp, Homo sapiens
gagtctggggacctg

SEQ ID NO: 2353496 - DNA, 19 bp, Homo sapiens
gagtgacagctttctggga

SEQ ID NO: 2353497 - DNA, 22 bp, Homo sapiens
gagtgacagctttctgggatgt

SEQ ID NO: 2353498 - DNA, 20 bp, Homo sapiens
gagtgcgggctgaggccaga

SEQ ID NO: 2353499 - DNA, 22 bp, Homo sapiens
gagtgtaaaatgtatattttta

SEQ ID NO: 2353500 - DNA, 13 bp, Homo sapiens
gagtgtatgagta

SEQ ID NO: 2353501 - DNA, 12 bp, Homo sapiens
gagtgtgtctgc

SEQ ID NO: 2353502 - DNA, 13 bp, Homo sapiens
gagtgtgtctgct

SEQ ID NO: 2353503 - DNA, 15 bp, Homo sapiens
gagtgtgtctgctga

SEQ ID NO: 2353504 - DNA, 14 bp, Homo sapiens
gagttaagaagctg

SEQ ID NO: 2353505 - DNA, 21 bp, Homo sapiens
gagttagcatgtatgaatgta

SEQ ID NO: 2353506 - DNA, 12 bp, Homo sapiens
gagttcaccttg

SEQ ID NO: 2353507 - DNA, 14 bp, Homo sapiens
gagttcaccttgga

SEQ ID NO: 2353508 - DNA, 17 bp, Homo sapiens
gagttcaccttggaagg

SEQ ID NO: 2353509 - DNA, 19 bp, Homo sapiens
gagttcaccttggaagggc

SEQ ID NO: 2353510 - DNA, 15 bp, Homo sapiens
gagttccagttgaag

SEQ ID NO: 2353511 - DNA, 13 bp, Homo sapiens
gagttccttctca

SEQ ID NO: 2353512 - DNA, 16 bp, Homo sapiens
gagttgaggccactgt

SEQ ID NO: 2353513 - DNA, 15 bp, Homo sapiens
gagttttgtctgtct

SEQ ID NO: 2353514 - DNA, 16 bp, Homo sapiens
gataaaataaataatt

SEQ ID NO: 2353515 - DNA, 19 bp, Homo sapiens
gataaaataaataatttta

SEQ ID NO: 2353516 - DNA, 18 bp, Homo sapiens
gataaaccaaaaacattt

SEQ ID NO: 2353517 - DNA, 10 bp, Homo sapiens
cctctgccta

SEQ ID NO: 2353518 - DNA, 14 bp, Homo sapiens
cctctgcttctcat

SEQ ID NO: 2353519 - DNA, 22 bp, Homo sapiens
cctctggacagccagtgacctt

SEQ ID NO: 2353520 - DNA, 21 bp, Homo sapiens
cctctggacggcaggctcact

SEQ ID NO: 2353521 - DNA, 17 bp, Homo sapiens
cctctggagccctaacc

SEQ ID NO: 2353522 - DNA, 20 bp, Homo sapiens
cctctggctttcccaggaga

SEQ ID NO: 2353523 - DNA, 10 bp, Homo sapiens
cctctgtcta

SEQ ID NO: 2353524 - DNA, 14 bp, Homo sapiens
cctctgtctaggac

SEQ ID NO: 2353525 - DNA, 19 bp, Homo sapiens
cctctgtgtgctcctcctt

SEQ ID NO: 2353526 - DNA, 21 bp, Homo sapiens
cctcttcctactggtctctct

SEQ ID NO: 2353527 - DNA, 23 bp, Homo sapiens
cctctttagtttttggttgggaa

SEQ ID NO: 2353528 - DNA, 15 bp, Homo sapiens
cctctttccctagga

SEQ ID NO: 2353529 - DNA, 11 bp, Homo sapiens
cctctttctgc

SEQ ID NO: 2353530 - DNA, 16 bp, Homo sapiens
cctctttttcctcctg

SEQ ID NO: 2353531 - DNA, 17 bp, Homo sapiens
cctctttttcctcctgg

SEQ ID NO: 2353532 - DNA, 21 bp, Homo sapiens
cctctttttcctcctggacac

SEQ ID NO: 2353533 - DNA, 17 bp, Homo sapiens
cctgaaacgctcctttg

SEQ ID NO: 2353534 - DNA, 21 bp, Homo sapiens
cctgaaacgctcctttgtgtg

SEQ ID NO: 2353535 - DNA, 21 bp, Homo sapiens
cctgaaccgcacagctcagga

SEQ ID NO: 2353536 - DNA, 17 bp, Homo sapiens
cctgaacgttttcttct

SEQ ID NO: 2353537 - DNA, 16 bp, Homo sapiens
cctggcccccaacctc

SEQ ID NO: 2353538 - DNA, 14 bp, Homo sapiens
cctggcccctctcc

SEQ ID NO: 2353539 - DNA, 16 bp, Homo sapiens
cctggcccctctccct

SEQ ID NO: 2353540 - DNA, 19 bp, Homo sapiens
cctggccgcggagcctgca

SEQ ID NO: 2353541 - DNA, 16 bp, Homo sapiens
cctggcctgagagtca

SEQ ID NO: 2353542 - DNA, 15 bp, Homo sapiens
cctggcctggcacac

SEQ ID NO: 2353543 - DNA, 23 bp, Homo sapiens
cctggcgagttctctttggaaat

SEQ ID NO: 2353544 - DNA, 19 bp, Homo sapiens
cctggcgcaggtgggctgg

SEQ ID NO: 2353545 - DNA, 22 bp, Homo sapiens
cctggcgcaggtgggctggact

SEQ ID NO: 2353546 - DNA, 14 bp, Homo sapiens
cctggctccctcct

SEQ ID NO: 2353547 - DNA, 15 bp, Homo sapiens
cctggctctaccctg

SEQ ID NO: 2353548 - DNA, 20 bp, Homo sapiens
cctggctctaccctgtctgt

SEQ ID NO: 2353549 - DNA, 16 bp, Homo sapiens
cctggctctcacctct

SEQ ID NO: 2353550 - DNA, 24 bp, Homo sapiens
cctggctgaggttcctctgcctgc

SEQ ID NO: 2353551 - DNA, 15 bp, Homo sapiens
cctggctgctgcccc

SEQ ID NO: 2353552 - DNA, 18 bp, Homo sapiens
cctggctgctgcccccac

SEQ ID NO: 2353553 - DNA, 22 bp, Homo sapiens
cctgggacaactgctcccacct

SEQ ID NO: 2353554 - DNA, 15 bp, Homo sapiens
cctgggacacagacc

SEQ ID NO: 2353555 - DNA, 19 bp, Homo sapiens
cctgggacacagacccagg

SEQ ID NO: 2353556 - DNA, 19 bp, Homo sapiens
cctgggcactccgcgccga

SEQ ID NO: 2353557 - DNA, 23 bp, Homo sapiens
cctgggcactccgcgccgatgcc

SEQ ID NO: 2353558 - DNA, 22 bp, Homo sapiens
cctgggccagcggggctgctca

SEQ ID NO: 2353559 - DNA, 23 bp, Homo sapiens
cctgggctcaagcaatcctcctg

SEQ ID NO: 2353560 - DNA, 18 bp, Homo sapiens
cctgggctgccaccagcc

SEQ ID NO: 2353561 - DNA, 17 bp, Homo sapiens
cctgggctgggtgctgg

SEQ ID NO: 2353562 - DNA, 13 bp, Homo sapiens
cctgggcttggcc

SEQ ID NO: 2353563 - DNA, 13 bp, Homo sapiens
cctggggcctgac

SEQ ID NO: 2353564 - DNA, 19 bp, Homo sapiens
cctgggggccccaggatgg

SEQ ID NO: 2353565 - DNA, 14 bp, Homo sapiens
cctggggtaaagta

SEQ ID NO: 2353566 - DNA, 17 bp, Homo sapiens
cctgggtgggctctgtg

SEQ ID NO: 2353567 - DNA, 22 bp, Homo sapiens
cctgggttgctgctgtccagtg

SEQ ID NO: 2353568 - DNA, 15 bp, Homo sapiens
cctggtacagcaggg

SEQ ID NO: 2353569 - DNA, 16 bp, Homo sapiens
cctggtacagcagggt

SEQ ID NO: 2353570 - DNA, 12 bp, Homo sapiens
cctgtagctcag

SEQ ID NO: 2353571 - DNA, 14 bp, Homo sapiens
cctgtagctcagtc

SEQ ID NO: 2353572 - DNA, 15 bp, Homo sapiens
cctgtagctcagtca

SEQ ID NO: 2353573 - DNA, 18 bp, Homo sapiens
cctgtagttgcgtggact

SEQ ID NO: 2353574 - DNA, 20 bp, Homo sapiens
cctgtagttgcgtggactct

SEQ ID NO: 2353575 - DNA, 15 bp, Homo sapiens
cctgtatacagtgca

SEQ ID NO: 2353576 - DNA, 20 bp, Homo sapiens
cctgtattactgaataatat

SEQ ID NO: 2353577 - DNA, 16 bp, Homo sapiens
cctgtccaatctttga

SEQ ID NO: 2353578 - DNA, 14 bp, Homo sapiens
cctgtcccctgcta

SEQ ID NO: 2353579 - DNA, 15 bp, Homo sapiens
cctgtcccttgacct

SEQ ID NO: 2353580 - DNA, 14 bp, Homo sapiens
cctgtctgccccag

SEQ ID NO: 2353581 - DNA, 16 bp, Homo sapiens
cctgtctgtccctttt

SEQ ID NO: 2353582 - DNA, 17 bp, Homo sapiens
cctgtctgtcccttttc

SEQ ID NO: 2353583 - DNA, 21 bp, Homo sapiens
cctgtctgtcccttttctttg

SEQ ID NO: 2353584 - DNA, 22 bp, Homo sapiens
cctgtcttatcctccaccgtct

SEQ ID NO: 2353585 - DNA, 19 bp, Homo sapiens
cctgtgacatggtgcctga

SEQ ID NO: 2353586 - DNA, 20 bp, Homo sapiens
cctgtgatccacccaaccct

SEQ ID NO: 2353587 - DNA, 23 bp, Homo sapiens
cctgtgcacaccccactcccaca

SEQ ID NO: 2353588 - DNA, 14 bp, Homo sapiens
cctgtgcatgtatg

SEQ ID NO: 2353589 - DNA, 12 bp, Homo sapiens
cctgtgcctggc

SEQ ID NO: 2353590 - DNA, 13 bp, Homo sapiens
cctgtgcctggcc

SEQ ID NO: 2353591 - DNA, 20 bp, Homo sapiens
cctgtgcctggccccagcct

SEQ ID NO: 2353592 - DNA, 18 bp, Homo sapiens
cctgtgctcccctgccac

SEQ ID NO: 2353593 - DNA, 15 bp, Homo sapiens
cctgtggcataaatt

SEQ ID NO: 2353594 - DNA, 13 bp, Homo sapiens
cctgtggctgtcg

SEQ ID NO: 2353595 - DNA, 17 bp, Homo sapiens
cctgtggggcctgatgg

SEQ ID NO: 2353596 - DNA, 16 bp, Homo sapiens
cctgtgggtctctgaa

SEQ ID NO: 2353597 - DNA, 15 bp, Homo sapiens
cctgtgtgcttggtc

SEQ ID NO: 2353598 - DNA, 18 bp, Homo sapiens
cctgttacctactttgac

SEQ ID NO: 2353599 - DNA, 14 bp, Homo sapiens
cctgttccctggag

SEQ ID NO: 2353600 - DNA, 14 bp, Homo sapiens
cctgttcctgctgc

SEQ ID NO: 2353601 - DNA, 17 bp, Homo sapiens
cctgttgattatcttca

SEQ ID NO: 2353602 - DNA, 18 bp, Homo sapiens
cctgttgattatcttcag

SEQ ID NO: 2353603 - DNA, 15 bp, Homo sapiens
cctgttttctgaaac

SEQ ID NO: 2353604 - DNA, 16 bp, Homo sapiens
cctgtttttcacattt

SEQ ID NO: 2353605 - DNA, 20 bp, Homo sapiens
cctgtttttcacattttcct

SEQ ID NO: 2353606 - DNA, 15 bp, Homo sapiens
ccttaagcaaatttt

SEQ ID NO: 2353607 - DNA, 15 bp, Homo sapiens
ccttaatttcctttt

SEQ ID NO: 2353608 - DNA, 15 bp, Homo sapiens
ccttacatcttttct

SEQ ID NO: 2353609 - DNA, 22 bp, Homo sapiens
ccttactcttcttgaaatttta

SEQ ID NO: 2353610 - DNA, 18 bp, Homo sapiens
ccttagaggtcctctgga

SEQ ID NO: 2353611 - DNA, 15 bp, Homo sapiens
ccttagcaccttcag

SEQ ID NO: 2353612 - DNA, 22 bp, Homo sapiens
ccttagcaccttcagggctgag

SEQ ID NO: 2353613 - DNA, 16 bp, Homo sapiens
ccttaggcctctgaga

SEQ ID NO: 2353614 - DNA, 16 bp, Homo sapiens
ccttcaatgctgcagg

SEQ ID NO: 2353615 - DNA, 14 bp, Homo sapiens
ccttcactcatttt

SEQ ID NO: 2353616 - DNA, 16 bp, Homo sapiens
ccttcagggctgagtt

SEQ ID NO: 2353617 - DNA, 17 bp, Homo sapiens
ccttcatcttcctgtgt

SEQ ID NO: 2353618 - DNA, 18 bp, Homo sapiens
ccttcatgtgccatctct

SEQ ID NO: 2353619 - DNA, 13 bp, Homo sapiens
ccttcccacatgc

SEQ ID NO: 2353620 - DNA, 15 bp, Homo sapiens
ccttcccacatgcct

SEQ ID NO: 2353621 - DNA, 21 bp, Homo sapiens
ccttcccccaccggtccagct

SEQ ID NO: 2353622 - DNA, 13 bp, Homo sapiens
ccttccctctctg

SEQ ID NO: 2353623 - DNA, 21 bp, Homo sapiens
ccttccctctctgatgtccca

SEQ ID NO: 2353624 - DNA, 21 bp, Homo sapiens
ccttcctcttgtctgatttct

SEQ ID NO: 2353625 - DNA, 15 bp, Homo sapiens
ccttcctgctgcgca

SEQ ID NO: 2353626 - DNA, 13 bp, Homo sapiens
ccttcctggcctg

SEQ ID NO: 2353627 - DNA, 20 bp, Homo sapiens
ccttccttttccctgcttcc

SEQ ID NO: 2353628 - DNA, 21 bp, Homo sapiens
ccttccttttccctgcttcca

SEQ ID NO: 2353629 - DNA, 14 bp, Homo sapiens
ccttctacaaggac

SEQ ID NO: 2353630 - DNA, 14 bp, Homo sapiens
ccttctcccactct

SEQ ID NO: 2353631 - DNA, 17 bp, Homo sapiens
ccttctcccactctcct

SEQ ID NO: 2353632 - DNA, 18 bp, Homo sapiens
ccttctcccactctccta

SEQ ID NO: 2353633 - DNA, 21 bp, Homo sapiens
ccttctcctacttagggaaga

SEQ ID NO: 2353634 - DNA, 21 bp, Homo sapiens
ccttctttgataatgttaaat

SEQ ID NO: 2353635 - DNA, 19 bp, Homo sapiens
ccttgaaactttgggaaaa

SEQ ID NO: 2353636 - DNA, 22 bp, Homo sapiens
ccttgaaaggcaggaagggaag

SEQ ID NO: 2353637 - DNA, 15 bp, Homo sapiens
ccttgagggctgcag

SEQ ID NO: 2353638 - DNA, 16 bp, Homo sapiens
ccttgatgactgcctt

SEQ ID NO: 2353639 - DNA, 23 bp, Homo sapiens
ccttgatgactgccttgcctcct

SEQ ID NO: 2353640 - DNA, 18 bp, Homo sapiens
ccttgccagggcagggtc

SEQ ID NO: 2353641 - DNA, 19 bp, Homo sapiens
ccttgccccccgccctcat

SEQ ID NO: 2353642 - DNA, 12 bp, Homo sapiens
ccttgcctcccc

SEQ ID NO: 2353643 - DNA, 17 bp, Homo sapiens
ccttgcctccccatttc

SEQ ID NO: 2353644 - DNA, 19 bp, Homo sapiens
ccttgcctttcgaggcctg

SEQ ID NO: 2353645 - DNA, 12 bp, Homo sapiens
ccttgctggccc

SEQ ID NO: 2353646 - DNA, 16 bp, Homo sapiens
ccttgctggccccagc

SEQ ID NO: 2353647 - DNA, 19 bp, Homo sapiens
ccttgctggccccagccct

SEQ ID NO: 2353648 - DNA, 16 bp, Homo sapiens
ccttgcttacctctca

SEQ ID NO: 2353649 - DNA, 17 bp, Homo sapiens
ccttgcttacctctcag

SEQ ID NO: 2353650 - DNA, 13 bp, Homo sapiens
ccttgcttcctga

SEQ ID NO: 2353651 - DNA, 22 bp, Homo sapiens
ccttggaaatagaaagaagcca

SEQ ID NO: 2353652 - DNA, 19 bp, Homo sapiens
ccttggaaatgtctgctgg

SEQ ID NO: 2353653 - DNA, 20 bp, Homo sapiens
ccttggaaatgtctgctggt

SEQ ID NO: 2353654 - DNA, 16 bp, Homo sapiens
ctaactcaaatacaca

SEQ ID NO: 2353655 - DNA, 13 bp, Homo sapiens
ctaagaaaatgta

SEQ ID NO: 2353656 - DNA, 15 bp, Homo sapiens
ctaagaaaatgtagt

SEQ ID NO: 2353657 - DNA, 13 bp, Homo sapiens
ctaagactatata

SEQ ID NO: 2353658 - DNA, 18 bp, Homo sapiens
ctaagatgtgttcttatt

SEQ ID NO: 2353659 - DNA, 20 bp, Homo sapiens
ctaagatgtgttcttatttt

SEQ ID NO: 2353660 - DNA, 15 bp, Homo sapiens
ctaagccaggcctgg

SEQ ID NO: 2353661 - DNA, 18 bp, Homo sapiens
ctaagccaggcctggctg

SEQ ID NO: 2353662 - DNA, 23 bp, Homo sapiens
ctaagccaggcctggctggagga

SEQ ID NO: 2353663 - DNA, 21 bp, Homo sapiens
ctaagctgatattatttcttc

SEQ ID NO: 2353664 - DNA, 22 bp, Homo sapiens
ctaagctgatattatttcttct

SEQ ID NO: 2353665 - DNA, 17 bp, Homo sapiens
ctaaggaactaaaactt

SEQ ID NO: 2353666 - DNA, 23 bp, Homo sapiens
ctaaggccatggcatcccttttt

SEQ ID NO: 2353667 - DNA, 18 bp, Homo sapiens
ctaataagtgacaaataa

SEQ ID NO: 2353668 - DNA, 20 bp, Homo sapiens
ctaataatcttgtttctgaa

SEQ ID NO: 2353669 - DNA, 21 bp, Homo sapiens
ctaataatcttgtttctgaaa

SEQ ID NO: 2353670 - DNA, 19 bp, Homo sapiens
ctaatacagcaacaattta

SEQ ID NO: 2353671 - DNA, 23 bp, Homo sapiens
ctaatacagcaacaatttatgaa

SEQ ID NO: 2353672 - DNA, 15 bp, Homo sapiens
ctaatacctctgtgt

SEQ ID NO: 2353673 - DNA, 13 bp, Homo sapiens
ctaatcacagtgt

SEQ ID NO: 2353674 - DNA, 15 bp, Homo sapiens
ctaatcaccatgtaa

SEQ ID NO: 2353675 - DNA, 12 bp, Homo sapiens
ctaatcagattg

SEQ ID NO: 2353676 - DNA, 14 bp, Homo sapiens
ctaatctgagattg

SEQ ID NO: 2353677 - DNA, 13 bp, Homo sapiens
ctaatgatgtttt

SEQ ID NO: 2353678 - DNA, 16 bp, Homo sapiens
ctaatgcctcttcatt

SEQ ID NO: 2353679 - DNA, 18 bp, Homo sapiens
ctaatgtttatgagccag

SEQ ID NO: 2353680 - DNA, 17 bp, Homo sapiens
ctaattaagaaaactat

SEQ ID NO: 2353681 - DNA, 22 bp, Homo sapiens
ctaattaatagccaaagatttc

SEQ ID NO: 2353682 - DNA, 23 bp, Homo sapiens
ctaattaatatattaaaattcca

SEQ ID NO: 2353683 - DNA, 19 bp, Homo sapiens
ctaattccacaggtcatca

SEQ ID NO: 2353684 - DNA, 20 bp, Homo sapiens
ctaatttctcctcccttcct

SEQ ID NO: 2353685 - DNA, 17 bp, Homo sapiens
ctacaaacttttaagat

SEQ ID NO: 2353686 - DNA, 19 bp, Homo sapiens
ctacaaacttttaagattt

SEQ ID NO: 2353687 - DNA, 13 bp, Homo sapiens
ctacaaatatagg

SEQ ID NO: 2353688 - DNA, 21 bp, Homo sapiens
ctacaaggactccattggatc

SEQ ID NO: 2353689 - DNA, 18 bp, Homo sapiens
ctacaattgtaaactagt

SEQ ID NO: 2353690 - DNA, 13 bp, Homo sapiens
ctacacaaagcag

SEQ ID NO: 2353691 - DNA, 15 bp, Homo sapiens
ctacacccctgtgct

SEQ ID NO: 2353692 - DNA, 16 bp, Homo sapiens
ctacacccctgtgctc

SEQ ID NO: 2353693 - DNA, 16 bp, Homo sapiens
ctacacctattatccc

SEQ ID NO: 2353694 - DNA, 17 bp, Homo sapiens
ctacacctattatccca

SEQ ID NO: 2353695 - DNA, 23 bp, Homo sapiens
ctacacttcgcaccggagtgtct

SEQ ID NO: 2353696 - DNA, 19 bp, Homo sapiens
ctacagccttgtccccctc

SEQ ID NO: 2353697 - DNA, 23 bp, Homo sapiens
ctacaggtgcgcgccaccgtgcc

SEQ ID NO: 2353698 - DNA, 16 bp, Homo sapiens
ctacagtctcgtctct

SEQ ID NO: 2353699 - DNA, 16 bp, Homo sapiens
ctacagtggttttata

SEQ ID NO: 2353700 - DNA, 18 bp, Homo sapiens
ctacatatgctgatcttt

SEQ ID NO: 2353701 - DNA, 17 bp, Homo sapiens
ctacatcccgggcctca

SEQ ID NO: 2353702 - DNA, 17 bp, Homo sapiens
ctacatctgatatcagg

SEQ ID NO: 2353703 - DNA, 22 bp, Homo sapiens
ctacatgcataaactaaaaact

SEQ ID NO: 2353704 - DNA, 12 bp, Homo sapiens
ctaccaaaatgg

SEQ ID NO: 2353705 - DNA, 13 bp, Homo sapiens
ctaccccttggaa

SEQ ID NO: 2353706 - DNA, 13 bp, Homo sapiens
ctaccctggactt

SEQ ID NO: 2353707 - DNA, 23 bp, Homo sapiens
ctaccctgtctgtcccttttctt

SEQ ID NO: 2353708 - DNA, 22 bp, Homo sapiens
ctaccggacactcgtcacccca

SEQ ID NO: 2353709 - DNA, 20 bp, Homo sapiens
ctacctcaaagggcagtttt

SEQ ID NO: 2353710 - DNA, 16 bp, Homo sapiens
ctacctcccttgcctt

SEQ ID NO: 2353711 - DNA, 12 bp, Homo sapiens
ctacctgccctc

SEQ ID NO: 2353712 - DNA, 16 bp, Homo sapiens
ctacctgccctcaagg

SEQ ID NO: 2353713 - DNA, 19 bp, Homo sapiens
ctacgcctcttctgtccct

SEQ ID NO: 2353714 - DNA, 20 bp, Homo sapiens
ctacgtttctttaaccttgt

SEQ ID NO: 2353715 - DNA, 18 bp, Homo sapiens
ctactaataaaccagttc

SEQ ID NO: 2353716 - DNA, 13 bp, Homo sapiens
ctactaatgatgt

SEQ ID NO: 2353717 - DNA, 14 bp, Homo sapiens
ctactaatgatgtt

SEQ ID NO: 2353718 - DNA, 17 bp, Homo sapiens
ctactcaagcgggtggc

SEQ ID NO: 2353719 - DNA, 14 bp, Homo sapiens
ctactcacttttcc

SEQ ID NO: 2353720 - DNA, 19 bp, Homo sapiens
ctactcacttttcccactc

SEQ ID NO: 2353721 - DNA, 18 bp, Homo sapiens
ctactccctgcagatgcc

SEQ ID NO: 2353722 - DNA, 18 bp, Homo sapiens
ctactgcactccagcctg

SEQ ID NO: 2353723 - DNA, 19 bp, Homo sapiens
ctactgcactccagcctgg

SEQ ID NO: 2353724 - DNA, 16 bp, Homo sapiens
ctactggggaaactgg

SEQ ID NO: 2353725 - DNA, 14 bp, Homo sapiens
ctcaagtgtcctga

SEQ ID NO: 2353726 - DNA, 20 bp, Homo sapiens
ctcaataaagtgctttaaaa

SEQ ID NO: 2353727 - DNA, 16 bp, Homo sapiens
ctcaatagatctccag

SEQ ID NO: 2353728 - DNA, 22 bp, Homo sapiens
ctcaatgcagttagctgaagaa

SEQ ID NO: 2353729 - DNA, 16 bp, Homo sapiens
ctcaatgtcttcccac

SEQ ID NO: 2353730 - DNA, 23 bp, Homo sapiens
ctcaatgtttagcagatttaaga

SEQ ID NO: 2353731 - DNA, 16 bp, Homo sapiens
ctcacagcaaacctct

SEQ ID NO: 2353732 - DNA, 12 bp, Homo sapiens
ctcacaggctga

SEQ ID NO: 2353733 - DNA, 13 bp, Homo sapiens
ctcacataagccc

SEQ ID NO: 2353734 - DNA, 17 bp, Homo sapiens
ctcacatctacacgtgg

SEQ ID NO: 2353735 - DNA, 12 bp, Homo sapiens
ctcacatgggac

SEQ ID NO: 2353736 - DNA, 23 bp, Homo sapiens
ctcaccaaggatcggactctgcc

SEQ ID NO: 2353737 - DNA, 16 bp, Homo sapiens
ctcaccagccccactg

SEQ ID NO: 2353738 - DNA, 18 bp, Homo sapiens
ctcaccagccccactgcc

SEQ ID NO: 2353739 - DNA, 22 bp, Homo sapiens
ctcaccagccccactgccagca

SEQ ID NO: 2353740 - DNA, 12 bp, Homo sapiens
ctcaccattcca

SEQ ID NO: 2353741 - DNA, 17 bp, Homo sapiens
ctcaccgcccatcaggg

SEQ ID NO: 2353742 - DNA, 14 bp, Homo sapiens
ctcaccgctggccc

SEQ ID NO: 2353743 - DNA, 23 bp, Homo sapiens
ctcacctaatgtttatgagccag

SEQ ID NO: 2353744 - DNA, 13 bp, Homo sapiens
ctcaccttcctgt

SEQ ID NO: 2353745 - DNA, 15 bp, Homo sapiens
ctcaccttcctgtgg

SEQ ID NO: 2353746 - DNA, 17 bp, Homo sapiens
ctcaccttcctgtgggt

SEQ ID NO: 2353747 - DNA, 14 bp, Homo sapiens
ctcaccttggggcc

SEQ ID NO: 2353748 - DNA, 13 bp, Homo sapiens
ctcacgctctgga

SEQ ID NO: 2353749 - DNA, 22 bp, Homo sapiens
ctcactattcttggaccatgcc

SEQ ID NO: 2353750 - DNA, 14 bp, Homo sapiens
ctcactgcagcctc

SEQ ID NO: 2353751 - DNA, 15 bp, Homo sapiens
ctcactgcagcctca

SEQ ID NO: 2353752 - DNA, 18 bp, Homo sapiens
ctcactgcttgaactagg

SEQ ID NO: 2353753 - DNA, 18 bp, Homo sapiens
ctcactggctctcctggc

SEQ ID NO: 2353754 - DNA, 10 bp, Homo sapiens
ctcactgtga

SEQ ID NO: 2353755 - DNA, 16 bp, Homo sapiens
ctcactttactttcaa

SEQ ID NO: 2353756 - DNA, 15 bp, Homo sapiens
ctcacttttcccact

SEQ ID NO: 2353757 - DNA, 14 bp, Homo sapiens
ctcagaaagatttg

SEQ ID NO: 2353758 - DNA, 21 bp, Homo sapiens
ctcagaacatactgattggga

SEQ ID NO: 2353759 - DNA, 14 bp, Homo sapiens
ctcagaaccttgtc

SEQ ID NO: 2353760 - DNA, 18 bp, Homo sapiens
ctcagaaccttgtcccag

SEQ ID NO: 2353761 - DNA, 22 bp, Homo sapiens
ctcagaaccttgtcccagccag

SEQ ID NO: 2353762 - DNA, 16 bp, Homo sapiens
ctcagacgttgcctga

SEQ ID NO: 2353763 - DNA, 16 bp, Homo sapiens
ctcagactgatttctt

SEQ ID NO: 2353764 - DNA, 20 bp, Homo sapiens
ctcagagaaaaatgctcccc

SEQ ID NO: 2353765 - DNA, 18 bp, Homo sapiens
ctcagagcgccaggaagc

SEQ ID NO: 2353766 - DNA, 23 bp, Homo sapiens
ctcagagcggatgggcacacaca

SEQ ID NO: 2353767 - DNA, 14 bp, Homo sapiens
ctcagatctgatca

SEQ ID NO: 2353768 - DNA, 17 bp, Homo sapiens
ctcagatctgatcaaga

SEQ ID NO: 2353769 - DNA, 17 bp, Homo sapiens
ctcagatttctgaggaa

SEQ ID NO: 2353770 - DNA, 13 bp, Homo sapiens
ctcagccctcagt

SEQ ID NO: 2353771 - DNA, 20 bp, Homo sapiens
ctcagccttccaactagctg

SEQ ID NO: 2353772 - DNA, 17 bp, Homo sapiens
ctcagctggcagtgcaa

SEQ ID NO: 2353773 - DNA, 22 bp, Homo sapiens
ctcagctttgagaagccttcag

SEQ ID NO: 2353774 - DNA, 22 bp, Homo sapiens
ctcaggacagcatcccttccca

SEQ ID NO: 2353775 - DNA, 15 bp, Homo sapiens
ctccacccatccagt

SEQ ID NO: 2353776 - DNA, 18 bp, Homo sapiens
ctccacccatccagtgga

SEQ ID NO: 2353777 - DNA, 23 bp, Homo sapiens
ctccaccgagccacgcagtgcct

SEQ ID NO: 2353778 - DNA, 20 bp, Homo sapiens
ctccaccttgttacacatta

SEQ ID NO: 2353779 - DNA, 15 bp, Homo sapiens
ctccactccacctcc

SEQ ID NO: 2353780 - DNA, 19 bp, Homo sapiens
ctccactctctaccagata

SEQ ID NO: 2353781 - DNA, 20 bp, Homo sapiens
ctccagataactctctttcc

SEQ ID NO: 2353782 - DNA, 22 bp, Homo sapiens
ctccagataactctctttcctt

SEQ ID NO: 2353783 - DNA, 14 bp, Homo sapiens
ctccagattctgat

SEQ ID NO: 2353784 - DNA, 15 bp, Homo sapiens
ctccagattctgatg

SEQ ID NO: 2353785 - DNA, 16 bp, Homo sapiens
ctccagattctgatgc

SEQ ID NO: 2353786 - DNA, 12 bp, Homo sapiens
ctccagcctgaa

SEQ ID NO: 2353787 - DNA, 22 bp, Homo sapiens
ctccagcgatctctccactgtg

SEQ ID NO: 2353788 - DNA, 18 bp, Homo sapiens
ctccagcgtcagctgctc

SEQ ID NO: 2353789 - DNA, 20 bp, Homo sapiens
ctccaggaaagagcagtcag

SEQ ID NO: 2353790 - DNA, 12 bp, Homo sapiens
ctccaggccaaa

SEQ ID NO: 2353791 - DNA, 13 bp, Homo sapiens
ctccaggccctcc

SEQ ID NO: 2353792 - DNA, 18 bp, Homo sapiens
ctccaggccctcctctcc

SEQ ID NO: 2353793 - DNA, 15 bp, Homo sapiens
ctccaggcctgcctc

SEQ ID NO: 2353794 - DNA, 16 bp, Homo sapiens
ctccaggcctgcctcc

SEQ ID NO: 2353795 - DNA, 12 bp, Homo sapiens
ctccaggctcca

SEQ ID NO: 2353796 - DNA, 21 bp, Homo sapiens
ctccagggaaggtggccacag

SEQ ID NO: 2353797 - DNA, 19 bp, Homo sapiens
ctccagggaatccaagcct

SEQ ID NO: 2353798 - DNA, 20 bp, Homo sapiens
ctccagggaatccaagcctc

SEQ ID NO: 2353799 - DNA, 21 bp, Homo sapiens
ctccagggaatccaagcctcc

SEQ ID NO: 2353800 - DNA, 18 bp, Homo sapiens
ctccagggacacacagcc

SEQ ID NO: 2353801 - DNA, 20 bp, Homo sapiens
ctccatatctccatggccct

SEQ ID NO: 2353802 - DNA, 22 bp, Homo sapiens
ctccatcaccctcttcctgtga

SEQ ID NO: 2353803 - DNA, 12 bp, Homo sapiens
ctccatctccca

SEQ ID NO: 2353804 - DNA, 20 bp, Homo sapiens
ctccatctcccaaggctgcc

SEQ ID NO: 2353805 - DNA, 22 bp, Homo sapiens
ctccatctcccaaggctgccag

SEQ ID NO: 2353806 - DNA, 16 bp, Homo sapiens
ctccattcatccttcc

SEQ ID NO: 2353807 - DNA, 21 bp, Homo sapiens
ctccattcatccttccatcca

SEQ ID NO: 2353808 - DNA, 17 bp, Homo sapiens
ctccattctgctccttc

SEQ ID NO: 2353809 - DNA, 15 bp, Homo sapiens
ctcccaaagtgctga

SEQ ID NO: 2353810 - DNA, 22 bp, Homo sapiens
ctcccacaaataagttcccatt

SEQ ID NO: 2353811 - DNA, 15 bp, Homo sapiens
ctcccaccctcttcc

SEQ ID NO: 2353812 - DNA, 16 bp, Homo sapiens
ctcccaccctcttcct

SEQ ID NO: 2353813 - DNA, 14 bp, Homo sapiens
ctcccacctcctga

SEQ ID NO: 2353814 - DNA, 16 bp, Homo sapiens
ctcccactctcctagg

SEQ ID NO: 2353815 - DNA, 18 bp, Homo sapiens
ctcccagaaacatctctg

SEQ ID NO: 2353816 - DNA, 22 bp, Homo sapiens
ctcccagagctggtggacccag

SEQ ID NO: 2353817 - DNA, 18 bp, Homo sapiens
ctcccaggggtctccctg

SEQ ID NO: 2353818 - DNA, 19 bp, Homo sapiens
ctcccaggggtctccctgg

SEQ ID NO: 2353819 - DNA, 20 bp, Homo sapiens
ctcccaggggtctccctggc

SEQ ID NO: 2353820 - DNA, 23 bp, Homo sapiens
ctcccaggggtctccctggctcc

SEQ ID NO: 2353821 - DNA, 18 bp, Homo sapiens
ctcccagtgaactcctgc

SEQ ID NO: 2353822 - DNA, 21 bp, Homo sapiens
ctccccaaatcaatacactag

SEQ ID NO: 2353823 - DNA, 15 bp, Homo sapiens
ctccccacagcgtcc

SEQ ID NO: 2353824 - DNA, 19 bp, Homo sapiens
ctccccacagcgtccctgg

SEQ ID NO: 2353825 - DNA, 18 bp, Homo sapiens
ctccccagagctgcctgc

SEQ ID NO: 2353826 - DNA, 16 bp, Homo sapiens
ctccccatctgtccag

SEQ ID NO: 2353827 - DNA, 17 bp, Homo sapiens
ctccccatctgtccagc

SEQ ID NO: 2353828 - DNA, 18 bp, Homo sapiens
ctccccatttcccatctg

SEQ ID NO: 2353829 - DNA, 16 bp, Homo sapiens
ctccccccagactctt

SEQ ID NO: 2353830 - DNA, 13 bp, Homo sapiens
ctccccctcccca

SEQ ID NO: 2353831 - DNA, 22 bp, Homo sapiens
ctcccctcctggcgagttctct

SEQ ID NO: 2353832 - DNA, 22 bp, Homo sapiens
ctcccctctcagaacatactga

SEQ ID NO: 2353833 - DNA, 18 bp, Homo sapiens
ctcccgagaccgggccct

SEQ ID NO: 2353834 - DNA, 14 bp, Homo sapiens
ctccctagctcctc

SEQ ID NO: 2353835 - DNA, 13 bp, Homo sapiens
ctccctcaactga

SEQ ID NO: 2353836 - DNA, 14 bp, Homo sapiens
ctccctcctccagg

SEQ ID NO: 2353837 - DNA, 16 bp, Homo sapiens
ctccctcctccaggcc

SEQ ID NO: 2353838 - DNA, 16 bp, Homo sapiens
aaaaatgcttgaccct

SEQ ID NO: 2353839 - DNA, 13 bp, Homo sapiens
aaaaatgtatgtt

SEQ ID NO: 2353840 - DNA, 21 bp, Homo sapiens
aaaaatgttacgtgaagaaat

SEQ ID NO: 2353841 - DNA, 14 bp, Homo sapiens
aaaaattaactttt

SEQ ID NO: 2353842 - DNA, 15 bp, Homo sapiens
aaaaattaacttttt

SEQ ID NO: 2353843 - DNA, 20 bp, Homo sapiens
aaaaattacctttaatttta

SEQ ID NO: 2353844 - DNA, 23 bp, Homo sapiens
aaaaattacctttaattttaatg

SEQ ID NO: 2353845 - DNA, 20 bp, Homo sapiens
aaaacaactttcacttcttc

SEQ ID NO: 2353846 - DNA, 22 bp, Homo sapiens
aaaacaactttcacttcttcct

SEQ ID NO: 2353847 - DNA, 16 bp, Homo sapiens
aaaacagaatttgaga

SEQ ID NO: 2353848 - DNA, 17 bp, Homo sapiens
aaaacagaatttgagaa

SEQ ID NO: 2353849 - DNA, 18 bp, Homo sapiens
aaaacatttgattaataa

SEQ ID NO: 2353850 - DNA, 18 bp, Homo sapiens
aaaacattttttatacat

SEQ ID NO: 2353851 - DNA, 18 bp, Homo sapiens
aaaaccaccaaaaacaaa

SEQ ID NO: 2353852 - DNA, 15 bp, Homo sapiens
aaaactcactgtgat

SEQ ID NO: 2353853 - DNA, 17 bp, Homo sapiens
aaaacttcatgtaattt

SEQ ID NO: 2353854 - DNA, 17 bp, Homo sapiens
aaaactttgactttgcc

SEQ ID NO: 2353855 - DNA, 17 bp, Homo sapiens
aaaagaaaaaaaaaaga

SEQ ID NO: 2353856 - DNA, 21 bp, Homo sapiens
aaaagaaaaatctcattattt

SEQ ID NO: 2353857 - DNA, 11 bp, Homo sapiens
aaaagaaatat

SEQ ID NO: 2353858 - DNA, 23 bp, Homo sapiens
aaaagaaatatattttttgttat

SEQ ID NO: 2353859 - DNA, 19 bp, Homo sapiens
aaaagaaatcatgtccata

SEQ ID NO: 2353860 - DNA, 15 bp, Homo sapiens
aaaagaccaagactt

SEQ ID NO: 2353861 - DNA, 23 bp, Homo sapiens
aaaagagcgatacacaaagcttt

SEQ ID NO: 2353862 - DNA, 12 bp, Homo sapiens
aaaagataaaga

SEQ ID NO: 2353863 - DNA, 22 bp, Homo sapiens
aaaagataaagaccagaaattc

SEQ ID NO: 2353864 - DNA, 16 bp, Homo sapiens
aaaagatggtatcata

SEQ ID NO: 2353865 - DNA, 14 bp, Homo sapiens
aaaagattgctgaa

SEQ ID NO: 2353866 - DNA, 13 bp, Homo sapiens
aaaagcaacttca

SEQ ID NO: 2353867 - DNA, 15 bp, Homo sapiens
aaaagcactcctgct

SEQ ID NO: 2353868 - DNA, 15 bp, Homo sapiens
aaaagctattagcca

SEQ ID NO: 2353869 - DNA, 17 bp, Homo sapiens
aaaagctattagccagg

SEQ ID NO: 2353870 - DNA, 13 bp, Homo sapiens
aaaagctttcatg

SEQ ID NO: 2353871 - DNA, 13 bp, Homo sapiens
aaaaggaagacta

SEQ ID NO: 2353872 - DNA, 16 bp, Homo sapiens
aaaaggacacctttta

SEQ ID NO: 2353873 - DNA, 21 bp, Homo sapiens
aaaaggatgtataaattttta

SEQ ID NO: 2353874 - DNA, 15 bp, Homo sapiens
aaaaggcctcttgta

SEQ ID NO: 2353875 - DNA, 21 bp, Homo sapiens
aaaaggcctcttgtaaagact

SEQ ID NO: 2353876 - DNA, 23 bp, Homo sapiens
aaaaggcctcttgtaaagactgg

SEQ ID NO: 2353877 - DNA, 14 bp, Homo sapiens
aaaaggcttgaagc

SEQ ID NO: 2353878 - DNA, 12 bp, Homo sapiens
aaaagggaagga

SEQ ID NO: 2353879 - DNA, 14 bp, Homo sapiens
aaaaggtattatac

SEQ ID NO: 2353880 - DNA, 19 bp, Homo sapiens
aaaaggtggagtttctctg

SEQ ID NO: 2353881 - DNA, 15 bp, Homo sapiens
aaaaggttgaataat

SEQ ID NO: 2353882 - DNA, 14 bp, Homo sapiens
aaaagtctgtcttt

SEQ ID NO: 2353883 - DNA, 19 bp, Homo sapiens
aaaagtgaagtgaatctga

SEQ ID NO: 2353884 - DNA, 13 bp, Homo sapiens
aaaagtgtccttc

SEQ ID NO: 2353885 - DNA, 19 bp, Homo sapiens
aaaagtgtggcttgggcat

SEQ ID NO: 2353886 - DNA, 19 bp, Homo sapiens
aaaagtgtgtatatatttt

SEQ ID NO: 2353887 - DNA, 15 bp, Homo sapiens
aaaagttattttgta

SEQ ID NO: 2353888 - DNA, 17 bp, Homo sapiens
aaaagttgcattttaac

SEQ ID NO: 2353889 - DNA, 16 bp, Homo sapiens
aaaagtttttgtttgg

SEQ ID NO: 2353890 - DNA, 20 bp, Homo sapiens
aaaataaaaagatcactttc

SEQ ID NO: 2353891 - DNA, 13 bp, Homo sapiens
aaaataaaacaca

SEQ ID NO: 2353892 - DNA, 17 bp, Homo sapiens
aaaataaataattttaa

SEQ ID NO: 2353893 - DNA, 13 bp, Homo sapiens
aaaataaatgaaa

SEQ ID NO: 2353894 - DNA, 13 bp, Homo sapiens
aaaataaatggaa

SEQ ID NO: 2353895 - DNA, 20 bp, Homo sapiens
aaaataaccctttggttttt

SEQ ID NO: 2353896 - DNA, 17 bp, Homo sapiens
aaaataacctaattaat

SEQ ID NO: 2353897 - DNA, 18 bp, Homo sapiens
aaaataacctaattaata

SEQ ID NO: 2353898 - DNA, 18 bp, Homo sapiens
aaaataacttagactcta

SEQ ID NO: 2353899 - DNA, 17 bp, Homo sapiens
aaaatacatttgtaagt

SEQ ID NO: 2353900 - DNA, 17 bp, Homo sapiens
aaaatactattgcctca

SEQ ID NO: 2353901 - DNA, 18 bp, Homo sapiens
aaaatagaataattcttt

SEQ ID NO: 2353902 - DNA, 14 bp, Homo sapiens
aaaatataaaatta

SEQ ID NO: 2353903 - DNA, 18 bp, Homo sapiens
aaaatatagcctttaaat

SEQ ID NO: 2353904 - DNA, 16 bp, Homo sapiens
aaaatatcataaagca

SEQ ID NO: 2353905 - DNA, 11 bp, Homo sapiens
aaaatattgtt

SEQ ID NO: 2353906 - DNA, 15 bp, Homo sapiens
aaaatattgtttctg

SEQ ID NO: 2353907 - DNA, 15 bp, Homo sapiens
aaaatcactttcata

SEQ ID NO: 2353908 - DNA, 18 bp, Homo sapiens
aaaatcatgccagtattt

SEQ ID NO: 2353909 - DNA, 19 bp, Homo sapiens
aaaatcatgccagtatttt

SEQ ID NO: 2353910 - DNA, 22 bp, Homo sapiens
aaaatcattgattgtcagctac

SEQ ID NO: 2353911 - DNA, 17 bp, Homo sapiens
aaaatccccttcgctga

SEQ ID NO: 2353912 - DNA, 16 bp, Homo sapiens
aaaatgaaaattgtat

SEQ ID NO: 2353913 - DNA, 16 bp, Homo sapiens
aaaatgaaatgcatat

SEQ ID NO: 2353914 - DNA, 18 bp, Homo sapiens
aaaatgatagacatatac

SEQ ID NO: 2353915 - DNA, 16 bp, Homo sapiens
aaaatgccatgaatta

SEQ ID NO: 2353916 - DNA, 12 bp, Homo sapiens
aaaatgcctttg

SEQ ID NO: 2353917 - DNA, 22 bp, Homo sapiens
aaaatgcctttgagacagtttc

SEQ ID NO: 2353918 - DNA, 23 bp, Homo sapiens
aaaatgcctttgagacagtttct

SEQ ID NO: 2353919 - DNA, 20 bp, Homo sapiens
aaaatgcttgaccctgaaat

SEQ ID NO: 2353920 - DNA, 12 bp, Homo sapiens
aaaatggaaaat

SEQ ID NO: 2353921 - DNA, 19 bp, Homo sapiens
aaaatggcatttagcacag

SEQ ID NO: 2353922 - DNA, 14 bp, Homo sapiens
aaaatgtaatttaa

SEQ ID NO: 2353923 - DNA, 19 bp, Homo sapiens
aaaatgtaatttaaatgaa

SEQ ID NO: 2353924 - DNA, 12 bp, Homo sapiens
aaaatgtatgtt

SEQ ID NO: 2353925 - DNA, 21 bp, Homo sapiens
aaaatgtattcctttaaaata

SEQ ID NO: 2353926 - DNA, 23 bp, Homo sapiens
aaaatgtattcctttaaaatatt

SEQ ID NO: 2353927 - DNA, 12 bp, Homo sapiens
aaaatgtctgta

SEQ ID NO: 2353928 - DNA, 21 bp, Homo sapiens
aaaatgtctgtagctcctcaa

SEQ ID NO: 2353929 - DNA, 20 bp, Homo sapiens
aaaatgtgtatttttcaagg

SEQ ID NO: 2353930 - DNA, 13 bp, Homo sapiens
aaaattaactttt

SEQ ID NO: 2353931 - DNA, 18 bp, Homo sapiens
aaaattacctttaatttt

SEQ ID NO: 2353932 - DNA, 20 bp, Homo sapiens
aaaattacctttaattttaa

SEQ ID NO: 2353933 - DNA, 18 bp, Homo sapiens
aaaattcaaaagtattga

SEQ ID NO: 2353934 - DNA, 13 bp, Homo sapiens
aaaattctttaga

SEQ ID NO: 2353935 - DNA, 20 bp, Homo sapiens
aaaattgctgactgtagctt

SEQ ID NO: 2353936 - DNA, 13 bp, Homo sapiens
aaaattgttattt

SEQ ID NO: 2353937 - DNA, 15 bp, Homo sapiens
aaaatttaagtgcgt

SEQ ID NO: 2353938 - DNA, 19 bp, Homo sapiens
aaaatttacacatcttaaa

SEQ ID NO: 2353939 - DNA, 24 bp, Homo sapiens
aaaatttgtcttaaaaatttatac

SEQ ID NO: 2353940 - DNA, 18 bp, Homo sapiens
aaacaaaaacagaatttg

SEQ ID NO: 2353941 - DNA, 14 bp, Homo sapiens
aaacaaataaatat

SEQ ID NO: 2353942 - DNA, 18 bp, Homo sapiens
aaacaacatttatatgta

SEQ ID NO: 2353943 - DNA, 19 bp, Homo sapiens
aaacaactttcacttcttc

SEQ ID NO: 2353944 - DNA, 14 bp, Homo sapiens
aaacaagtatgaat

SEQ ID NO: 2353945 - DNA, 11 bp, Homo sapiens
aaacacacatt

SEQ ID NO: 2353946 - DNA, 14 bp, Homo sapiens
aaacacacctcgtg

SEQ ID NO: 2353947 - DNA, 20 bp, Homo sapiens
aaacacccctctgtctagga

SEQ ID NO: 2353948 - DNA, 16 bp, Homo sapiens
aaacactgaaaagaag

SEQ ID NO: 2353949 - DNA, 14 bp, Homo sapiens
aaacagaaatggaa

SEQ ID NO: 2353950 - DNA, 16 bp, Homo sapiens
aaacagaatcttctgg

SEQ ID NO: 2353951 - DNA, 18 bp, Homo sapiens
aaacagatgtgaatattc

SEQ ID NO: 2353952 - DNA, 11 bp, Homo sapiens
aaacagcctgg

SEQ ID NO: 2353953 - DNA, 22 bp, Homo sapiens
aaacagttgctgtgaactttca

SEQ ID NO: 2353954 - DNA, 22 bp, Homo sapiens
aaagtataatgtttattaaatg

SEQ ID NO: 2353955 - DNA, 23 bp, Homo sapiens
aaagtataatgtttattaaatgc

SEQ ID NO: 2353956 - DNA, 14 bp, Homo sapiens
aaagtatatgttag

SEQ ID NO: 2353957 - DNA, 19 bp, Homo sapiens
aaagtatgcattattaaat

SEQ ID NO: 2353958 - DNA, 15 bp, Homo sapiens
aaagtatttactttt

SEQ ID NO: 2353959 - DNA, 13 bp, Homo sapiens
aaagtattttctt

SEQ ID NO: 2353960 - DNA, 20 bp, Homo sapiens
aaagtgaagtgaatctgatt

SEQ ID NO: 2353961 - DNA, 15 bp, Homo sapiens
aaagtggaagtatgt

SEQ ID NO: 2353962 - DNA, 14 bp, Homo sapiens
aaagtgtctcaaag

SEQ ID NO: 2353963 - DNA, 18 bp, Homo sapiens
aaagtgtctcaaaggagc

SEQ ID NO: 2353964 - DNA, 18 bp, Homo sapiens
aaagtgtgtatatatttt

SEQ ID NO: 2353965 - DNA, 17 bp, Homo sapiens
aaagttaaaattgttat

SEQ ID NO: 2353966 - DNA, 18 bp, Homo sapiens
aaagttaatgggatggtc

SEQ ID NO: 2353967 - DNA, 12 bp, Homo sapiens
aaagttattctt

SEQ ID NO: 2353968 - DNA, 13 bp, Homo sapiens
aaagttattttgt

SEQ ID NO: 2353969 - DNA, 18 bp, Homo sapiens
aaagttggaaggatctgc

SEQ ID NO: 2353970 - DNA, 12 bp, Homo sapiens
aaagttttgaaa

SEQ ID NO: 2353971 - DNA, 13 bp, Homo sapiens
aaagttttgaaaa

SEQ ID NO: 2353972 - DNA, 14 bp, Homo sapiens
aaagttttgaaaag

SEQ ID NO: 2353973 - DNA, 18 bp, Homo sapiens
aaagttttgaaaagctat

SEQ ID NO: 2353974 - DNA, 12 bp, Homo sapiens
aaagttttgttg

SEQ ID NO: 2353975 - DNA, 12 bp, Homo sapiens
aaataaaacaca

SEQ ID NO: 2353976 - DNA, 14 bp, Homo sapiens
aaataaaatatatc

SEQ ID NO: 2353977 - DNA, 19 bp, Homo sapiens
aaataaaatgaaaattgta

SEQ ID NO: 2353978 - DNA, 23 bp, Homo sapiens
aaataaaatgaaaattgtattat

SEQ ID NO: 2353979 - DNA, 22 bp, Homo sapiens
aaataaaccaaaggaaaatgtc

SEQ ID NO: 2353980 - DNA, 14 bp, Homo sapiens
aaataaaccactgt

SEQ ID NO: 2353981 - DNA, 22 bp, Homo sapiens
aaataaagaacaattgttagat

SEQ ID NO: 2353982 - DNA, 13 bp, Homo sapiens
aaataaagaagta

SEQ ID NO: 2353983 - DNA, 22 bp, Homo sapiens
aaataaagtttcagcggaacac

SEQ ID NO: 2353984 - DNA, 13 bp, Homo sapiens
aaataaataattt

SEQ ID NO: 2353985 - DNA, 14 bp, Homo sapiens
aaataaataatttt

SEQ ID NO: 2353986 - DNA, 16 bp, Homo sapiens
aaataacaatgttaag

SEQ ID NO: 2353987 - DNA, 22 bp, Homo sapiens
aaataactgtgtggcagttaat

SEQ ID NO: 2353988 - DNA, 16 bp, Homo sapiens
aaataagaaataatgc

SEQ ID NO: 2353989 - DNA, 22 bp, Homo sapiens
aaataaggatttttctcttatt

SEQ ID NO: 2353990 - DNA, 14 bp, Homo sapiens
aaataagtaaatgt

SEQ ID NO: 2353991 - DNA, 19 bp, Homo sapiens
aaataatgctacaatttta

SEQ ID NO: 2353992 - DNA, 12 bp, Homo sapiens
aaataattcata

SEQ ID NO: 2353993 - DNA, 14 bp, Homo sapiens
aaataattctaaag

SEQ ID NO: 2353994 - DNA, 15 bp, Homo sapiens
aaataattctaaagg

SEQ ID NO: 2353995 - DNA, 20 bp, Homo sapiens
aaataatttgaatgtatttg

SEQ ID NO: 2353996 - DNA, 21 bp, Homo sapiens
aaataatttgaatgtatttga

SEQ ID NO: 2353997 - DNA, 12 bp, Homo sapiens
aaatacacattt

SEQ ID NO: 2353998 - DNA, 16 bp, Homo sapiens
aaatacctattcaaga

SEQ ID NO: 2353999 - DNA, 16 bp, Homo sapiens
aaatactattgcctca

SEQ ID NO: 2354000 - DNA, 14 bp, Homo sapiens
aaatagaaattttg

SEQ ID NO: 2354001 - DNA, 14 bp, Homo sapiens
aaatagacaaaaag

SEQ ID NO: 2354002 - DNA, 18 bp, Homo sapiens
aaatagacaaaaagtata

SEQ ID NO: 2354003 - DNA, 19 bp, Homo sapiens
aaatagacaaaaagtatat

SEQ ID NO: 2354004 - DNA, 16 bp, Homo sapiens
aaataggagaggatga

SEQ ID NO: 2354005 - DNA, 18 bp, Homo sapiens
aaataggtttatattatt

SEQ ID NO: 2354006 - DNA, 13 bp, Homo sapiens
aaatataaaatta

SEQ ID NO: 2354007 - DNA, 14 bp, Homo sapiens
aaatataacacatt

SEQ ID NO: 2354008 - DNA, 17 bp, Homo sapiens
aaatataacacattttt

SEQ ID NO: 2354009 - DNA, 16 bp, Homo sapiens
aaatatacattttcta

SEQ ID NO: 2354010 - DNA, 18 bp, Homo sapiens
aaatatacattttctaaa

SEQ ID NO: 2354011 - DNA, 15 bp, Homo sapiens
aaatatatatacata

SEQ ID NO: 2354012 - DNA, 17 bp, Homo sapiens
aaatatcataaagcatt

SEQ ID NO: 2354013 - DNA, 12 bp, Homo sapiens
aaatatctgtga

SEQ ID NO: 2354014 - DNA, 17 bp, Homo sapiens
aaatatgaagaactgag

SEQ ID NO: 2354015 - DNA, 14 bp, Homo sapiens
aaatatgcagtgat

SEQ ID NO: 2354016 - DNA, 22 bp, Homo sapiens
aaatatgcagtgatatggcaga

SEQ ID NO: 2354017 - DNA, 20 bp, Homo sapiens
aaatatgtaatttcaaaata

SEQ ID NO: 2354018 - DNA, 16 bp, Homo sapiens
aaatattgtttctgca

SEQ ID NO: 2354019 - DNA, 15 bp, Homo sapiens
aaatcaatagttgaa

SEQ ID NO: 2354020 - DNA, 16 bp, Homo sapiens
aaatcagaaagtaaca

SEQ ID NO: 2354021 - DNA, 22 bp, Homo sapiens
aaatcagagacaaaatatttcc

SEQ ID NO: 2354022 - DNA, 13 bp, Homo sapiens
aaatcataaagtc

SEQ ID NO: 2354023 - DNA, 17 bp, Homo sapiens
aaatcctgaagagcatt

SEQ ID NO: 2354024 - DNA, 20 bp, Homo sapiens
aaatcgatgagcgccacctc

SEQ ID NO: 2354025 - DNA, 15 bp, Homo sapiens
aaatctaaaatgtgt

SEQ ID NO: 2354026 - DNA, 15 bp, Homo sapiens
aaatctaaaatgttt

SEQ ID NO: 2354027 - DNA, 18 bp, Homo sapiens
aaatgaaatttaagcaca

SEQ ID NO: 2354028 - DNA, 13 bp, Homo sapiens
aaatgaagaaagt

SEQ ID NO: 2354029 - DNA, 16 bp, Homo sapiens
aaatgaagaaagtcaa

SEQ ID NO: 2354030 - DNA, 18 bp, Homo sapiens
aaatgaatgattaaatta

SEQ ID NO: 2354031 - DNA, 13 bp, Homo sapiens
aaatgaattttta

SEQ ID NO: 2354032 - DNA, 13 bp, Homo sapiens
aaatgagatttct

SEQ ID NO: 2354033 - DNA, 14 bp, Homo sapiens
aaatgagatttctt

SEQ ID NO: 2354034 - DNA, 13 bp, Homo sapiens
aaatgagtaaaaa

SEQ ID NO: 2354035 - DNA, 16 bp, Homo sapiens
aaatgcaataatttta

SEQ ID NO: 2354036 - DNA, 19 bp, Homo sapiens
aaatgcatatcctgagcca

SEQ ID NO: 2354037 - DNA, 20 bp, Homo sapiens
aaatgcatatcctgagccat

SEQ ID NO: 2354038 - DNA, 13 bp, Homo sapiens
aaatgcctttgag

SEQ ID NO: 2354039 - DNA, 17 bp, Homo sapiens
aaatgcctttgagacag

SEQ ID NO: 2354040 - DNA, 18 bp, Homo sapiens
aaatgcctttgagacagt

SEQ ID NO: 2354041 - DNA, 16 bp, Homo sapiens
aaatgcggggtggggg

SEQ ID NO: 2354042 - DNA, 13 bp, Homo sapiens
aaatgctccccac

SEQ ID NO: 2354043 - DNA, 18 bp, Homo sapiens
aaatgcttaaatttcaga

SEQ ID NO: 2354044 - DNA, 23 bp, Homo sapiens
aaatgcttcatttgtatgtcaaa

SEQ ID NO: 2354045 - DNA, 18 bp, Homo sapiens
aaatggaaacaccactgc

SEQ ID NO: 2354046 - DNA, 21 bp, Homo sapiens
aaatggaaagcagagttttca

SEQ ID NO: 2354047 - DNA, 17 bp, Homo sapiens
aaatggagaagctgcag

SEQ ID NO: 2354048 - DNA, 23 bp, Homo sapiens
aaatggaggatctctaaagagca

SEQ ID NO: 2354049 - DNA, 16 bp, Homo sapiens
aaatggcatttagcac

SEQ ID NO: 2354050 - DNA, 18 bp, Homo sapiens
aaatggccatgcaggagg

SEQ ID NO: 2354051 - DNA, 20 bp, Homo sapiens
aaatggcgtctgctctggtg

SEQ ID NO: 2354052 - DNA, 21 bp, Homo sapiens
aaatggggataataatactga

SEQ ID NO: 2354053 - DNA, 19 bp, Homo sapiens
aaatggtcccaattaagaa

SEQ ID NO: 2354054 - DNA, 16 bp, Homo sapiens
aaatggttaaatttta

SEQ ID NO: 2354055 - DNA, 17 bp, Homo sapiens
aaatggttaaattttac

SEQ ID NO: 2354056 - DNA, 14 bp, Homo sapiens
aaatgtaatttaaa

SEQ ID NO: 2354057 - DNA, 22 bp, Homo sapiens
aaatgtacatttccaaatgaac

SEQ ID NO: 2354058 - DNA, 16 bp, Homo sapiens
aaatgtataaatatac

SEQ ID NO: 2354059 - DNA, 21 bp, Homo sapiens
aaatgtatccaaggaaacatt

SEQ ID NO: 2354060 - DNA, 15 bp, Homo sapiens
aaatgtattagaaga

SEQ ID NO: 2354061 - DNA, 15 bp, Homo sapiens
aaatgtcttcatgtt

SEQ ID NO: 2354062 - DNA, 16 bp, Homo sapiens
aaatgttacttctgat

SEQ ID NO: 2354063 - DNA, 18 bp, Homo sapiens
aaatgtttaatggtgaaa

SEQ ID NO: 2354064 - DNA, 10 bp, Homo sapiens
aaatgtttct

SEQ ID NO: 2354065 - DNA, 19 bp, Homo sapiens
aaatgtttcttttgtttgg

SEQ ID NO: 2354066 - DNA, 20 bp, Homo sapiens
aaatgtttttaataaaagaa

SEQ ID NO: 2354067 - DNA, 22 bp, Homo sapiens
aaatgtttttaataaaagaaaa

SEQ ID NO: 2354068 - DNA, 12 bp, Homo sapiens
aaattaaaaaaa

SEQ ID NO: 2354069 - DNA, 22 bp, Homo sapiens
aaattaaaacaaatatacattt

SEQ ID NO: 2354070 - DNA, 18 bp, Homo sapiens
aaattaaataaaattttt

SEQ ID NO: 2354071 - DNA, 11 bp, Homo sapiens
aaattaacaca

SEQ ID NO: 2354072 - DNA, 12 bp, Homo sapiens
aaattaactttt

SEQ ID NO: 2354073 - DNA, 16 bp, Homo sapiens
aaattaagcaaatgtt

SEQ ID NO: 2354074 - DNA, 12 bp, Homo sapiens
aaattaagcatt

SEQ ID NO: 2354075 - DNA, 21 bp, Homo sapiens
aaattacctttacatatatag

SEQ ID NO: 2354076 - DNA, 15 bp, Homo sapiens
aaattatcattgttt

SEQ ID NO: 2354077 - DNA, 22 bp, Homo sapiens
aaattatgagctatcctttcaa

SEQ ID NO: 2354078 - DNA, 21 bp, Homo sapiens
aaattatgtgaccataatgta

SEQ ID NO: 2354079 - DNA, 13 bp, Homo sapiens
aaattcaaccaca

SEQ ID NO: 2354080 - DNA, 21 bp, Homo sapiens
aaattcaagagctagaaaaat

SEQ ID NO: 2354081 - DNA, 21 bp, Homo sapiens
aaattcatggcatgcttaaat

SEQ ID NO: 2354082 - DNA, 19 bp, Homo sapiens
aaattccatacttctctca

SEQ ID NO: 2354083 - DNA, 21 bp, Homo sapiens
aaattcccttttcaccttttc

SEQ ID NO: 2354084 - DNA, 19 bp, Homo sapiens
aaattgagttgcacttatt

SEQ ID NO: 2354085 - DNA, 22 bp, Homo sapiens
aaattgatttgtcaagaggata

SEQ ID NO: 2354086 - DNA, 15 bp, Homo sapiens
aaattgcatactttg

SEQ ID NO: 2354087 - DNA, 17 bp, Homo sapiens
aaattgcatactttgta

SEQ ID NO: 2354088 - DNA, 18 bp, Homo sapiens
aaattgccctatgctgtg

SEQ ID NO: 2354089 - DNA, 19 bp, Homo sapiens
aaattgctgactgtagctt

SEQ ID NO: 2354090 - DNA, 23 bp, Homo sapiens
aaattgctgactgtagctttgga

SEQ ID NO: 2354091 - DNA, 12 bp, Homo sapiens
aaattgcttttt

SEQ ID NO: 2354092 - DNA, 18 bp, Homo sapiens
aaattgtcgggggagaga

SEQ ID NO: 2354093 - DNA, 19 bp, Homo sapiens
aaatttaaaaaataaataa

SEQ ID NO: 2354094 - DNA, 21 bp, Homo sapiens
aaatttaagagattttatgtt

SEQ ID NO: 2354095 - DNA, 16 bp, Homo sapiens
aaatttagccgggcgc

SEQ ID NO: 2354096 - DNA, 17 bp, Homo sapiens
aaatttgagaatacata

SEQ ID NO: 2354097 - DNA, 12 bp, Homo sapiens
aaatttgtaagt

SEQ ID NO: 2354098 - DNA, 13 bp, Homo sapiens
aaatttgtaagtt

SEQ ID NO: 2354099 - DNA, 17 bp, Homo sapiens
aaatttgtaagtttcag

SEQ ID NO: 2354100 - DNA, 22 bp, Homo sapiens
aaatttgtcttaaaaatttata

SEQ ID NO: 2354101 - DNA, 22 bp, Homo sapiens
aaattttaaagccattctgatt

SEQ ID NO: 2354102 - DNA, 21 bp, Homo sapiens
aaattttacaagggcataaag

SEQ ID NO: 2354103 - DNA, 14 bp, Homo sapiens
aaattttagaaata

SEQ ID NO: 2354104 - DNA, 15 bp, Homo sapiens
aaattttctccttgg

SEQ ID NO: 2354105 - DNA, 12 bp, Homo sapiens
aaattttttgac

SEQ ID NO: 2354106 - DNA, 23 bp, Homo sapiens
aaattttttgactttttttgtat

SEQ ID NO: 2354107 - DNA, 20 bp, Homo sapiens
aaattttttgatgtcagcct

SEQ ID NO: 2354108 - DNA, 13 bp, Homo sapiens
aacaaaatttgaa

SEQ ID NO: 2354109 - DNA, 16 bp, Homo sapiens
aacaaagggttttctt

SEQ ID NO: 2354110 - DNA, 16 bp, Homo sapiens
aacaaataaatatgaa

SEQ ID NO: 2354111 - DNA, 12 bp, Homo sapiens
aacaaatttttc

SEQ ID NO: 2354112 - DNA, 17 bp, Homo sapiens
aacaacatttatatgta

SEQ ID NO: 2354113 - DNA, 14 bp, Homo sapiens
aacaacctcaactg

SEQ ID NO: 2354114 - DNA, 18 bp, Homo sapiens
aacaacctcaactgccta

SEQ ID NO: 2354115 - DNA, 15 bp, Homo sapiens
aacaactttcacttc

SEQ ID NO: 2354116 - DNA, 13 bp, Homo sapiens
aacaatgttaagg

SEQ ID NO: 2354117 - DNA, 13 bp, Homo sapiens
aacaatttatgaa

SEQ ID NO: 2354118 - DNA, 16 bp, Homo sapiens
aacaatttatgaattg

SEQ ID NO: 2354119 - DNA, 17 bp, Homo sapiens
aacaattttttttaatt

SEQ ID NO: 2354120 - DNA, 16 bp, Homo sapiens
aacacaagcaaaaaaa

SEQ ID NO: 2354121 - DNA, 18 bp, Homo sapiens
aacacattgaaactgtat

SEQ ID NO: 2354122 - DNA, 20 bp, Homo sapiens
aacacattgaaactgtattt

SEQ ID NO: 2354123 - DNA, 16 bp, Homo sapiens
aacacccatttttcct

SEQ ID NO: 2354124 - DNA, 17 bp, Homo sapiens
aacacccatttttcctt

SEQ ID NO: 2354125 - DNA, 17 bp, Homo sapiens
aacacggagcagggaga

SEQ ID NO: 2354126 - DNA, 17 bp, Homo sapiens
aacactaactcaccagc

SEQ ID NO: 2354127 - DNA, 14 bp, Homo sapiens
aacactcagtccac

SEQ ID NO: 2354128 - DNA, 17 bp, Homo sapiens
aacactcagtccactgt

SEQ ID NO: 2354129 - DNA, 14 bp, Homo sapiens
aacagaacagcttc

SEQ ID NO: 2354130 - DNA, 15 bp, Homo sapiens
aacagaacagcttca

SEQ ID NO: 2354131 - DNA, 18 bp, Homo sapiens
aacagataagcaagagag

SEQ ID NO: 2354132 - DNA, 16 bp, Homo sapiens
aacagcctttgaatgt

SEQ ID NO: 2354133 - DNA, 19 bp, Homo sapiens
aacagcctttgaatgtaac

SEQ ID NO: 2354134 - DNA, 21 bp, Homo sapiens
aacagctacaaacttttaaga

SEQ ID NO: 2354135 - DNA, 13 bp, Homo sapiens
aacagctgtgtct

SEQ ID NO: 2354136 - DNA, 16 bp, Homo sapiens
aacagctgtgtctgcc

SEQ ID NO: 2354137 - DNA, 16 bp, Homo sapiens
aacagggccacataga

SEQ ID NO: 2354138 - DNA, 20 bp, Homo sapiens
aacagggccacatagatgct

SEQ ID NO: 2354139 - DNA, 23 bp, Homo sapiens
aacaggtagtattacaccaccgg

SEQ ID NO: 2354140 - DNA, 19 bp, Homo sapiens
aacagtaaagaaagcagaa

SEQ ID NO: 2354141 - DNA, 13 bp, Homo sapiens
aacagtaactgcc

SEQ ID NO: 2354142 - DNA, 20 bp, Homo sapiens
aacagtatgtgggatattga

SEQ ID NO: 2354143 - DNA, 20 bp, Homo sapiens
aacagtgaagttttactgtc

SEQ ID NO: 2354144 - DNA, 21 bp, Homo sapiens
aacagtgaagttttactgtct

SEQ ID NO: 2354145 - DNA, 15 bp, Homo sapiens
aacagttctcactgg

SEQ ID NO: 2354146 - DNA, 16 bp, Homo sapiens
aacagttctcactggg

SEQ ID NO: 2354147 - DNA, 12 bp, Homo sapiens
aacataaataaa

SEQ ID NO: 2354148 - DNA, 18 bp, Homo sapiens
aacatatatttattgagt

SEQ ID NO: 2354149 - DNA, 19 bp, Homo sapiens
aacatatatttattgagta

SEQ ID NO: 2354150 - DNA, 21 bp, Homo sapiens
aacatccaaaaaaagggaagg

SEQ ID NO: 2354151 - DNA, 23 bp, Homo sapiens
aacatctcaataaagtgctttaa

SEQ ID NO: 2354152 - DNA, 21 bp, Homo sapiens
aacatctctggcccagaaagc

SEQ ID NO: 2354153 - DNA, 19 bp, Homo sapiens
aacatctttattgaaattc

SEQ ID NO: 2354154 - DNA, 22 bp, Homo sapiens
aacatgccccctgcagacacgt

SEQ ID NO: 2354155 - DNA, 14 bp, Homo sapiens
aacatgtgatgtgt

SEQ ID NO: 2354156 - DNA, 15 bp, Homo sapiens
aacatgtgatgtgtt

SEQ ID NO: 2354157 - DNA, 14 bp, Homo sapiens
aacatgttctccat

SEQ ID NO: 2354158 - DNA, 16 bp, Homo sapiens
aacatgtttaatgggt

SEQ ID NO: 2354159 - DNA, 18 bp, Homo sapiens
aacattaatgcctgcttt

SEQ ID NO: 2354160 - DNA, 16 bp, Homo sapiens
aacattaccttactgt

SEQ ID NO: 2354161 - DNA, 17 bp, Homo sapiens
aacattaccttactgtg

SEQ ID NO: 2354162 - DNA, 21 bp, Homo sapiens
aacattttacagtaaatgtta

SEQ ID NO: 2354163 - DNA, 12 bp, Homo sapiens
aaccaaaaacat

SEQ ID NO: 2354164 - DNA, 19 bp, Homo sapiens
aaccaagctataaaagccc

SEQ ID NO: 2354165 - DNA, 22 bp, Homo sapiens
aaccaagtatcacactttaatg

SEQ ID NO: 2354166 - DNA, 17 bp, Homo sapiens
aaccacacttcttgaaa

SEQ ID NO: 2354167 - DNA, 12 bp, Homo sapiens
aaccactagaaa

SEQ ID NO: 2354168 - DNA, 20 bp, Homo sapiens
aaccactgcttctcttttga

SEQ ID NO: 2354169 - DNA, 22 bp, Homo sapiens
aaccagaaacacccctctgtct

SEQ ID NO: 2354170 - DNA, 12 bp, Homo sapiens
aaccagaaccca

SEQ ID NO: 2354171 - DNA, 15 bp, Homo sapiens
aaccagccaggcaga

SEQ ID NO: 2354172 - DNA, 15 bp, Homo sapiens
aaccattaaagtcag

SEQ ID NO: 2354173 - DNA, 16 bp, Homo sapiens
aacccagtttcccgtc

SEQ ID NO: 2354174 - DNA, 23 bp, Homo sapiens
aacccattaaggggaagaatgaa

SEQ ID NO: 2354175 - DNA, 23 bp, Homo sapiens
aacccattccagtacagtattct

SEQ ID NO: 2354176 - DNA, 15 bp, Homo sapiens
aaccctatctcctga

SEQ ID NO: 2354177 - DNA, 22 bp, Homo sapiens
aaccctatctcctgacagaagg

SEQ ID NO: 2354178 - DNA, 23 bp, Homo sapiens
aaccctatctcctgacagaaggt

SEQ ID NO: 2354179 - DNA, 18 bp, Homo sapiens
aaccctctccatctccca

SEQ ID NO: 2354180 - DNA, 22 bp, Homo sapiens
aaccctgctgaacacagtgtct

SEQ ID NO: 2354181 - DNA, 16 bp, Homo sapiens
aacccttcatcttcct

SEQ ID NO: 2354182 - DNA, 22 bp, Homo sapiens
aacccttcatcttcctgtgtcc

SEQ ID NO: 2354183 - DNA, 17 bp, Homo sapiens
aaccgagtagaaaatgt

SEQ ID NO: 2354184 - DNA, 19 bp, Homo sapiens
aaccgagtagaaaatgtga

SEQ ID NO: 2354185 - DNA, 22 bp, Homo sapiens
aagacaccagagcagatgcaga

SEQ ID NO: 2354186 - DNA, 21 bp, Homo sapiens
aagacataacgtttttccttt

SEQ ID NO: 2354187 - DNA, 23 bp, Homo sapiens
aagacatactgcttgattttaat

SEQ ID NO: 2354188 - DNA, 19 bp, Homo sapiens
aagacatgtctgttctaca

SEQ ID NO: 2354189 - DNA, 22 bp, Homo sapiens
aagacattttaagtttgtagta

SEQ ID NO: 2354190 - DNA, 20 bp, Homo sapiens
aagacccccatttgtcccag

SEQ ID NO: 2354191 - DNA, 15 bp, Homo sapiens
aagacccctaaccct

SEQ ID NO: 2354192 - DNA, 16 bp, Homo sapiens
aagaccctcttgccca

SEQ ID NO: 2354193 - DNA, 21 bp, Homo sapiens
aagaccctcttgcccatcctg

SEQ ID NO: 2354194 - DNA, 12 bp, Homo sapiens
aagactaaaagt

SEQ ID NO: 2354195 - DNA, 20 bp, Homo sapiens
aagactatatatataaatgt

SEQ ID NO: 2354196 - DNA, 18 bp, Homo sapiens
aagactgagccagcttag

SEQ ID NO: 2354197 - DNA, 16 bp, Homo sapiens
aagactgtagatatgt

SEQ ID NO: 2354198 - DNA, 22 bp, Homo sapiens
aagacttaaagggcccaatgaa

SEQ ID NO: 2354199 - DNA, 11 bp, Homo sapiens
aagagaactcg

SEQ ID NO: 2354200 - DNA, 18 bp, Homo sapiens
aagagacagagacaagta

SEQ ID NO: 2354201 - DNA, 15 bp, Homo sapiens
aagagacatccaaat

SEQ ID NO: 2354202 - DNA, 14 bp, Homo sapiens
aagagacatttcaa

SEQ ID NO: 2354203 - DNA, 15 bp, Homo sapiens
aagagagatgttttg

SEQ ID NO: 2354204 - DNA, 12 bp, Homo sapiens
aagagaggcacc

SEQ ID NO: 2354205 - DNA, 13 bp, Homo sapiens
aagagaggcacct

SEQ ID NO: 2354206 - DNA, 16 bp, Homo sapiens
aagagaggcacctgct

SEQ ID NO: 2354207 - DNA, 17 bp, Homo sapiens
aagagaggcacctgctg

SEQ ID NO: 2354208 - DNA, 15 bp, Homo sapiens
aagagataagtcttt

SEQ ID NO: 2354209 - DNA, 19 bp, Homo sapiens
aagagatgaattgcattat

SEQ ID NO: 2354210 - DNA, 13 bp, Homo sapiens
aagagattcgaat

SEQ ID NO: 2354211 - DNA, 19 bp, Homo sapiens
aagagattttatgtttaaa

SEQ ID NO: 2354212 - DNA, 16 bp, Homo sapiens
aagagcagtcacaaca

SEQ ID NO: 2354213 - DNA, 12 bp, Homo sapiens
aagagccacctg

SEQ ID NO: 2354214 - DNA, 14 bp, Homo sapiens
aagagccacctgca

SEQ ID NO: 2354215 - DNA, 15 bp, Homo sapiens
aagagccacctgcaa

SEQ ID NO: 2354216 - DNA, 18 bp, Homo sapiens
aagagccacctgcaagat

SEQ ID NO: 2354217 - DNA, 23 bp, Homo sapiens
aagagcccagtctgttgagttag

SEQ ID NO: 2354218 - DNA, 23 bp, Homo sapiens
aagagcccgcagggccatgcaga

SEQ ID NO: 2354219 - DNA, 14 bp, Homo sapiens
aagagcccttgcct

SEQ ID NO: 2354220 - DNA, 18 bp, Homo sapiens
aagagcccttgcctcccc

SEQ ID NO: 2354221 - DNA, 16 bp, Homo sapiens
aagagctagaaaaata

SEQ ID NO: 2354222 - DNA, 14 bp, Homo sapiens
aagagcttgctcca

SEQ ID NO: 2354223 - DNA, 19 bp, Homo sapiens
aagaggaattacgtgctct

SEQ ID NO: 2354224 - DNA, 21 bp, Homo sapiens
aagaggctctggacagcagaa

SEQ ID NO: 2354225 - DNA, 16 bp, Homo sapiens
aagaggctgaaagagg

SEQ ID NO: 2354226 - DNA, 18 bp, Homo sapiens
aagaggctgaaagaggcc

SEQ ID NO: 2354227 - DNA, 17 bp, Homo sapiens
aagaggctgcccctctc

SEQ ID NO: 2354228 - DNA, 18 bp, Homo sapiens
aagagggagaagcatgaa

SEQ ID NO: 2354229 - DNA, 16 bp, Homo sapiens
aagagggggtggaggg

SEQ ID NO: 2354230 - DNA, 17 bp, Homo sapiens
aagagggtttattttca

SEQ ID NO: 2354231 - DNA, 19 bp, Homo sapiens
aagagtccggatttctaac

SEQ ID NO: 2354232 - DNA, 15 bp, Homo sapiens
aagagtctgtctcaa

SEQ ID NO: 2354233 - DNA, 14 bp, Homo sapiens
aagagtgtagaagc

SEQ ID NO: 2354234 - DNA, 18 bp, Homo sapiens
aagagtgtagaagcattc

SEQ ID NO: 2354235 - DNA, 16 bp, Homo sapiens
aagagttcccttgaaa

SEQ ID NO: 2354236 - DNA, 20 bp, Homo sapiens
aagagttcccttgaaacttt

SEQ ID NO: 2354237 - DNA, 15 bp, Homo sapiens
aagatacaataaaac

SEQ ID NO: 2354238 - DNA, 16 bp, Homo sapiens
aagatacaataaaaca

SEQ ID NO: 2354239 - DNA, 18 bp, Homo sapiens
aagatagttgtaaagata

SEQ ID NO: 2354240 - DNA, 17 bp, Homo sapiens
aagatattgtatctcct

SEQ ID NO: 2354241 - DNA, 24 bp, Homo sapiens
aagatcactgtagtttagttctgt

SEQ ID NO: 2354242 - DNA, 23 bp, Homo sapiens
aagatcactttctcagttttcat

SEQ ID NO: 2354243 - DNA, 19 bp, Homo sapiens
aagatggacacgagccaca

SEQ ID NO: 2354244 - DNA, 17 bp, Homo sapiens
aagatggttaaacattt

SEQ ID NO: 2354245 - DNA, 17 bp, Homo sapiens
aagatgtctatgtagct

SEQ ID NO: 2354246 - DNA, 13 bp, Homo sapiens
aagatgtgaatta

SEQ ID NO: 2354247 - DNA, 21 bp, Homo sapiens
aagatgtgaattattgacact

SEQ ID NO: 2354248 - DNA, 15 bp, Homo sapiens
aagatgtgttcttat

SEQ ID NO: 2354249 - DNA, 19 bp, Homo sapiens
aagatgtttcattttactg

SEQ ID NO: 2354250 - DNA, 21 bp, Homo sapiens
aagattaataagatttttcaa

SEQ ID NO: 2354251 - DNA, 12 bp, Homo sapiens
aagattctaaag

SEQ ID NO: 2354252 - DNA, 18 bp, Homo sapiens
aagattctaaagctcaat

SEQ ID NO: 2354253 - DNA, 16 bp, Homo sapiens
aagattgctgaaattt

SEQ ID NO: 2354254 - DNA, 16 bp, Homo sapiens
aagatttcatatctaa

SEQ ID NO: 2354255 - DNA, 23 bp, Homo sapiens
aagatttcatatctaactttgta

SEQ ID NO: 2354256 - DNA, 21 bp, Homo sapiens
aagatttgatgggccacaact

SEQ ID NO: 2354257 - DNA, 13 bp, Homo sapiens
aagattttagaat

SEQ ID NO: 2354258 - DNA, 20 bp, Homo sapiens
aagattttcctcttgtgatt

SEQ ID NO: 2354259 - DNA, 17 bp, Homo sapiens
aagattttgaatgcttc

SEQ ID NO: 2354260 - DNA, 17 bp, Homo sapiens
aagatttttcaaaatcg

SEQ ID NO: 2354261 - DNA, 14 bp, Homo sapiens
aagatttttctcaa

SEQ ID NO: 2354262 - DNA, 14 bp, Homo sapiens
aagcaacatttgta

SEQ ID NO: 2354263 - DNA, 21 bp, Homo sapiens
aagcaacatttgtatggattt

SEQ ID NO: 2354264 - DNA, 22 bp, Homo sapiens
aagcaactcaagttataggaaa

SEQ ID NO: 2354265 - DNA, 15 bp, Homo sapiens
aagcaatccacctgc

SEQ ID NO: 2354266 - DNA, 20 bp, Homo sapiens
aagcaatccacctgccttgg

SEQ ID NO: 2354267 - DNA, 15 bp, Homo sapiens
aagcaatcctcctgc

SEQ ID NO: 2354268 - DNA, 19 bp, Homo sapiens
aagcacaaaaaatttaaga

SEQ ID NO: 2354269 - DNA, 19 bp, Homo sapiens
aagcacagagcctggcccc

SEQ ID NO: 2354270 - DNA, 21 bp, Homo sapiens
aagcacagagcctggccccag

SEQ ID NO: 2354271 - DNA, 23 bp, Homo sapiens
aagcactacaccttgccttgctg

SEQ ID NO: 2354272 - DNA, 23 bp, Homo sapiens
aagcactcctgcttaatcttcaa

SEQ ID NO: 2354273 - DNA, 12 bp, Homo sapiens
aagcactgagca

SEQ ID NO: 2354274 - DNA, 14 bp, Homo sapiens
aagcagaagtctgg

SEQ ID NO: 2354275 - DNA, 17 bp, Homo sapiens
aagcagaagtctggctt

SEQ ID NO: 2354276 - DNA, 15 bp, Homo sapiens
aagcagagttttcat

SEQ ID NO: 2354277 - DNA, 23 bp, Homo sapiens
aagcagataccttgcaaagcaac

SEQ ID NO: 2354278 - DNA, 20 bp, Homo sapiens
aagcagctggtcagtctttg

SEQ ID NO: 2354279 - DNA, 17 bp, Homo sapiens
aagcagggacacccccc

SEQ ID NO: 2354280 - DNA, 14 bp, Homo sapiens
aagcataaagctca

SEQ ID NO: 2354281 - DNA, 19 bp, Homo sapiens
aagcatggacatttagaag

SEQ ID NO: 2354282 - DNA, 14 bp, Homo sapiens
aagcattccttctt

SEQ ID NO: 2354283 - DNA, 17 bp, Homo sapiens
aagcattccttctttga

SEQ ID NO: 2354284 - DNA, 16 bp, Homo sapiens
aagcattctgagctgg

SEQ ID NO: 2354285 - DNA, 21 bp, Homo sapiens
aagcatttcatgaaaaagctg

SEQ ID NO: 2354286 - DNA, 12 bp, Homo sapiens
aagcatttccta

SEQ ID NO: 2354287 - DNA, 13 bp, Homo sapiens
aagcatttgtaca

SEQ ID NO: 2354288 - DNA, 12 bp, Homo sapiens
aagcattttgaa

SEQ ID NO: 2354289 - DNA, 23 bp, Homo sapiens
aagcatttttattatatttatgt

SEQ ID NO: 2354290 - DNA, 19 bp, Homo sapiens
aagcatttttcaatatatt

SEQ ID NO: 2354291 - DNA, 21 bp, Homo sapiens
aagccaaaagtccctccctgc

SEQ ID NO: 2354292 - DNA, 15 bp, Homo sapiens
aagccaaagaaaaat

SEQ ID NO: 2354293 - DNA, 13 bp, Homo sapiens
aagccacaggaag

SEQ ID NO: 2354294 - DNA, 20 bp, Homo sapiens
aagccagccaagctttaaat

SEQ ID NO: 2354295 - DNA, 22 bp, Homo sapiens
aagccagccaagctttaaatta

SEQ ID NO: 2354296 - DNA, 16 bp, Homo sapiens
aagccagctgccctat

SEQ ID NO: 2354297 - DNA, 17 bp, Homo sapiens
aagccagctttccctgc

SEQ ID NO: 2354298 - DNA, 23 bp, Homo sapiens
aagccagctttccctgcctctca

SEQ ID NO: 2354299 - DNA, 15 bp, Homo sapiens
aagccaggcctggct

SEQ ID NO: 2354300 - DNA, 19 bp, Homo sapiens
aagtaggtggcttgagcta

SEQ ID NO: 2354301 - DNA, 13 bp, Homo sapiens
aagtagtaaatca

SEQ ID NO: 2354302 - DNA, 20 bp, Homo sapiens
aagtataaaatagtatgaaa

SEQ ID NO: 2354303 - DNA, 22 bp, Homo sapiens
aagtataatgtttattaaatgc

SEQ ID NO: 2354304 - DNA, 14 bp, Homo sapiens
aagtatattaaaca

SEQ ID NO: 2354305 - DNA, 13 bp, Homo sapiens
aagtatcacactt

SEQ ID NO: 2354306 - DNA, 14 bp, Homo sapiens
aagtatcacttttc

SEQ ID NO: 2354307 - DNA, 15 bp, Homo sapiens
aagtatgaatctagt

SEQ ID NO: 2354308 - DNA, 22 bp, Homo sapiens
aagtatgcaatgcttcattatt

SEQ ID NO: 2354309 - DNA, 20 bp, Homo sapiens
aagtatgcattattaaattg

SEQ ID NO: 2354310 - DNA, 22 bp, Homo sapiens
aagtattgaaagccaacaactc

SEQ ID NO: 2354311 - DNA, 14 bp, Homo sapiens
aagtcaaaaaatta

SEQ ID NO: 2354312 - DNA, 16 bp, Homo sapiens
aagtcaccaaatagtg

SEQ ID NO: 2354313 - DNA, 17 bp, Homo sapiens
aagtcacttaactataa

SEQ ID NO: 2354314 - DNA, 12 bp, Homo sapiens
aagtcagaagtt

SEQ ID NO: 2354315 - DNA, 16 bp, Homo sapiens
aagtcagaatcagaag

SEQ ID NO: 2354316 - DNA, 20 bp, Homo sapiens
aagtcattgtcgctcagcaa

SEQ ID NO: 2354317 - DNA, 13 bp, Homo sapiens
aagtcctggcaca

SEQ ID NO: 2354318 - DNA, 15 bp, Homo sapiens
aagtcgggtcaaaaa

SEQ ID NO: 2354319 - DNA, 22 bp, Homo sapiens
aagtcgggtcaaaaataaaata

SEQ ID NO: 2354320 - DNA, 15 bp, Homo sapiens
aagtctgtctttcct

SEQ ID NO: 2354321 - DNA, 11 bp, Homo sapiens
aagtgaaatta

SEQ ID NO: 2354322 - DNA, 16 bp, Homo sapiens
aagtgaattgaagttt

SEQ ID NO: 2354323 - DNA, 21 bp, Homo sapiens
aagtgaattgaagtttcaagt

SEQ ID NO: 2354324 - DNA, 18 bp, Homo sapiens
aagtgacacattaatgat

SEQ ID NO: 2354325 - DNA, 14 bp, Homo sapiens
aagtgagcagaaca

SEQ ID NO: 2354326 - DNA, 15 bp, Homo sapiens
aagtgagcagaacag

SEQ ID NO: 2354327 - DNA, 15 bp, Homo sapiens
aagtgagcagtgttg

SEQ ID NO: 2354328 - DNA, 16 bp, Homo sapiens
aagtgaggcctgacat

SEQ ID NO: 2354329 - DNA, 12 bp, Homo sapiens
aagtgcagtcag

SEQ ID NO: 2354330 - DNA, 22 bp, Homo sapiens
aagtgcggggtaggggaagaag

SEQ ID NO: 2354331 - DNA, 15 bp, Homo sapiens
aagtgcgtgtgtaga

SEQ ID NO: 2354332 - DNA, 15 bp, Homo sapiens
aagtggactgtattt

SEQ ID NO: 2354333 - DNA, 20 bp, Homo sapiens
aagtggcgtgggagccagcc

SEQ ID NO: 2354334 - DNA, 15 bp, Homo sapiens
aagtggtctctgctg

SEQ ID NO: 2354335 - DNA, 12 bp, Homo sapiens
aagtgtaaaaaa

SEQ ID NO: 2354336 - DNA, 11 bp, Homo sapiens
aagtgtagctc

SEQ ID NO: 2354337 - DNA, 14 bp, Homo sapiens
aagtgtccttcttg

SEQ ID NO: 2354338 - DNA, 18 bp, Homo sapiens
aagtgtgccaaatcagtt

SEQ ID NO: 2354339 - DNA, 20 bp, Homo sapiens
aagtgttctcatgaagcagg

SEQ ID NO: 2354340 - DNA, 23 bp, Homo sapiens
aagtgttctcatgaagcaggagg

SEQ ID NO: 2354341 - DNA, 22 bp, Homo sapiens
aagttacacagaaatgctgctg

SEQ ID NO: 2354342 - DNA, 16 bp, Homo sapiens
aagttagtggaaatct

SEQ ID NO: 2354343 - DNA, 19 bp, Homo sapiens
aagttagtggaaatctgaa

SEQ ID NO: 2354344 - DNA, 23 bp, Homo sapiens
aagttagtggaaatctgaacatt

SEQ ID NO: 2354345 - DNA, 16 bp, Homo sapiens
aagttattaaaaatgt

SEQ ID NO: 2354346 - DNA, 21 bp, Homo sapiens
aagttattcttgtcattttga

SEQ ID NO: 2354347 - DNA, 10 bp, Homo sapiens
aagttatttt

SEQ ID NO: 2354348 - DNA, 18 bp, Homo sapiens
aagttattttctacagtg

SEQ ID NO: 2354349 - DNA, 18 bp, Homo sapiens
aagttatttttgtacatg

SEQ ID NO: 2354350 - DNA, 19 bp, Homo sapiens
aagttatttttgtacatgt

SEQ ID NO: 2354351 - DNA, 22 bp, Homo sapiens
aagttcttatgaggaggggagg

SEQ ID NO: 2354352 - DNA, 12 bp, Homo sapiens
aagttggaagga

SEQ ID NO: 2354353 - DNA, 18 bp, Homo sapiens
aagttgtgatctgttgta

SEQ ID NO: 2354354 - DNA, 21 bp, Homo sapiens
aagtttcaggtgacatgtgaa

SEQ ID NO: 2354355 - DNA, 13 bp, Homo sapiens
aagtttctcttct

SEQ ID NO: 2354356 - DNA, 19 bp, Homo sapiens
aagtttgtagtaaaagtgg

SEQ ID NO: 2354357 - DNA, 15 bp, Homo sapiens
aagttttaaagttca

SEQ ID NO: 2354358 - DNA, 16 bp, Homo sapiens
aagttttgaaaagcta

SEQ ID NO: 2354359 - DNA, 16 bp, Homo sapiens
aagttttgtaaaagaa

SEQ ID NO: 2354360 - DNA, 22 bp, Homo sapiens
aagttttgttgtacttaaatgg

SEQ ID NO: 2354361 - DNA, 15 bp, Homo sapiens
aagtttttgtttgga

SEQ ID NO: 2354362 - DNA, 13 bp, Homo sapiens
aagtttttttgct

SEQ ID NO: 2354363 - DNA, 23 bp, Homo sapiens
aagtttttttgctgctgcctctt

SEQ ID NO: 2354364 - DNA, 15 bp, Homo sapiens
aataaaaatatattt

SEQ ID NO: 2354365 - DNA, 14 bp, Homo sapiens
aataaaacacacct

SEQ ID NO: 2354366 - DNA, 20 bp, Homo sapiens
aataaaactgtttgacttct

SEQ ID NO: 2354367 - DNA, 16 bp, Homo sapiens
aataaaagaaaattac

SEQ ID NO: 2354368 - DNA, 16 bp, Homo sapiens
aataaaataattctaa

SEQ ID NO: 2354369 - DNA, 17 bp, Homo sapiens
aataaaataattctaaa

SEQ ID NO: 2354370 - DNA, 13 bp, Homo sapiens
aataaaatatata

SEQ ID NO: 2354371 - DNA, 22 bp, Homo sapiens
aataaaatatcataaagcattt

SEQ ID NO: 2354372 - DNA, 14 bp, Homo sapiens
aataaaatgaaaat

SEQ ID NO: 2354373 - DNA, 19 bp, Homo sapiens
aataaaatgtttcattatg

SEQ ID NO: 2354374 - DNA, 13 bp, Homo sapiens
aataaaattccta

SEQ ID NO: 2354375 - DNA, 15 bp, Homo sapiens
aataaagtataatgt

SEQ ID NO: 2354376 - DNA, 17 bp, Homo sapiens
aataaagtattttcttt

SEQ ID NO: 2354377 - DNA, 18 bp, Homo sapiens
aataaataaaaactaatt

SEQ ID NO: 2354378 - DNA, 11 bp, Homo sapiens
aataaatgaaa

SEQ ID NO: 2354379 - DNA, 20 bp, Homo sapiens
aataaatgaaacttggccag

SEQ ID NO: 2354380 - DNA, 21 bp, Homo sapiens
aataaatgaaacttggccagt

SEQ ID NO: 2354381 - DNA, 22 bp, Homo sapiens
aataaatgggtgtatataattt

SEQ ID NO: 2354382 - DNA, 19 bp, Homo sapiens
aataaatttaaacttacaa

SEQ ID NO: 2354383 - DNA, 14 bp, Homo sapiens
aataaattttctaa

SEQ ID NO: 2354384 - DNA, 13 bp, Homo sapiens
aataacattacct

SEQ ID NO: 2354385 - DNA, 18 bp, Homo sapiens
aataaccctttggttttt

SEQ ID NO: 2354386 - DNA, 15 bp, Homo sapiens
aataactgaatttgg

SEQ ID NO: 2354387 - DNA, 13 bp, Homo sapiens
aataactgtgtgg

SEQ ID NO: 2354388 - DNA, 17 bp, Homo sapiens
aataagacataacgttt

SEQ ID NO: 2354389 - DNA, 15 bp, Homo sapiens
aataagatggctgtg

SEQ ID NO: 2354390 - DNA, 19 bp, Homo sapiens
aataagtgacaaataagat

SEQ ID NO: 2354391 - DNA, 21 bp, Homo sapiens
aataagtgacaaataagatta

SEQ ID NO: 2354392 - DNA, 22 bp, Homo sapiens
aataagttcaaattcttctgaa

SEQ ID NO: 2354393 - DNA, 13 bp, Homo sapiens
aataatagactgt

SEQ ID NO: 2354394 - DNA, 12 bp, Homo sapiens
aataatgaagta

SEQ ID NO: 2354395 - DNA, 21 bp, Homo sapiens
aataatgctacaattttaaga

SEQ ID NO: 2354396 - DNA, 12 bp, Homo sapiens
aataatgctttt

SEQ ID NO: 2354397 - DNA, 19 bp, Homo sapiens
aataatgcttttctaatta

SEQ ID NO: 2354398 - DNA, 16 bp, Homo sapiens
aataattcatatctaa

SEQ ID NO: 2354399 - DNA, 10 bp, Homo sapiens
aataatttga

SEQ ID NO: 2354400 - DNA, 15 bp, Homo sapiens
aataatttgaatgta

SEQ ID NO: 2354401 - DNA, 22 bp, Homo sapiens
aataattttggaataatttcta

SEQ ID NO: 2354402 - DNA, 20 bp, Homo sapiens
aatacaagtaatattattac

SEQ ID NO: 2354403 - DNA, 15 bp, Homo sapiens
aatacacatttgcta

SEQ ID NO: 2354404 - DNA, 13 bp, Homo sapiens
aatacagacaaag

SEQ ID NO: 2354405 - DNA, 17 bp, Homo sapiens
aatacatgagaaagatg

SEQ ID NO: 2354406 - DNA, 12 bp, Homo sapiens
aatacatttgta

SEQ ID NO: 2354407 - DNA, 15 bp, Homo sapiens
aataccatttagtaa

SEQ ID NO: 2354408 - DNA, 18 bp, Homo sapiens
aataccatttagtaagaa

SEQ ID NO: 2354409 - DNA, 13 bp, Homo sapiens
aatacctctgtgt

SEQ ID NO: 2354410 - DNA, 14 bp, Homo sapiens
aatacctctgtgtg

SEQ ID NO: 2354411 - DNA, 16 bp, Homo sapiens
aatacctctgtgtgct

SEQ ID NO: 2354412 - DNA, 17 bp, Homo sapiens
aatactcttaaatttta

SEQ ID NO: 2354413 - DNA, 12 bp, Homo sapiens
aatacttccaga

SEQ ID NO: 2354414 - DNA, 23 bp, Homo sapiens
aatacttctttgttattataaca

SEQ ID NO: 2354415 - DNA, 16 bp, Homo sapiens
aatactttttaaatta

SEQ ID NO: 2354416 - DNA, 16 bp, Homo sapiens
aatgaggacttcaagc

SEQ ID NO: 2354417 - DNA, 15 bp, Homo sapiens
aatgaggtcagcatg

SEQ ID NO: 2354418 - DNA, 23 bp, Homo sapiens
aatgaggtgggaggtggaagaag

SEQ ID NO: 2354419 - DNA, 21 bp, Homo sapiens
aatgataaaataaataatttt

SEQ ID NO: 2354420 - DNA, 23 bp, Homo sapiens
aatgataaaataaataattttaa

SEQ ID NO: 2354421 - DNA, 19 bp, Homo sapiens
aatgataaactcagatctg

SEQ ID NO: 2354422 - DNA, 12 bp, Homo sapiens
aatgataatgct

SEQ ID NO: 2354423 - DNA, 23 bp, Homo sapiens
aatgataatgctaattttattat

SEQ ID NO: 2354424 - DNA, 22 bp, Homo sapiens
aatgatgattgaactggaataa

SEQ ID NO: 2354425 - DNA, 19 bp, Homo sapiens
aatgattaagggacatttc

SEQ ID NO: 2354426 - DNA, 23 bp, Homo sapiens
aatgattaagggacatttctata

SEQ ID NO: 2354427 - DNA, 14 bp, Homo sapiens
aatgcaataatttt

SEQ ID NO: 2354428 - DNA, 18 bp, Homo sapiens
aatgcatatcctgagcca

SEQ ID NO: 2354429 - DNA, 19 bp, Homo sapiens
aatgcatatcctgagccat

SEQ ID NO: 2354430 - DNA, 20 bp, Homo sapiens
aatgcatgtaaggtcttctt

SEQ ID NO: 2354431 - DNA, 11 bp, Homo sapiens
aatgccctctt

SEQ ID NO: 2354432 - DNA, 13 bp, Homo sapiens
aatgcccttcact

SEQ ID NO: 2354433 - DNA, 17 bp, Homo sapiens
aatgcctgctttttgga

SEQ ID NO: 2354434 - DNA, 19 bp, Homo sapiens
aatgcctgctttttggaaa

SEQ ID NO: 2354435 - DNA, 23 bp, Homo sapiens
aatgcctttgagacagtttctta

SEQ ID NO: 2354436 - DNA, 13 bp, Homo sapiens
aatgctaatttta

SEQ ID NO: 2354437 - DNA, 20 bp, Homo sapiens
aatgctacaattttaagagg

SEQ ID NO: 2354438 - DNA, 14 bp, Homo sapiens
aatgctatttgtgt

SEQ ID NO: 2354439 - DNA, 20 bp, Homo sapiens
aatgctccccacagcgtccc

SEQ ID NO: 2354440 - DNA, 14 bp, Homo sapiens
aatgctgtttctaa

SEQ ID NO: 2354441 - DNA, 24 bp, Homo sapiens
aatgctgtttctaagaaaatgtag

SEQ ID NO: 2354442 - DNA, 14 bp, Homo sapiens
aatgcttaaatttc

SEQ ID NO: 2354443 - DNA, 21 bp, Homo sapiens
aatgcttcctgacaatcaact

SEQ ID NO: 2354444 - DNA, 19 bp, Homo sapiens
aatgcttttctaattaata

SEQ ID NO: 2354445 - DNA, 20 bp, Homo sapiens
aatggaaaatgccatgaatt

SEQ ID NO: 2354446 - DNA, 18 bp, Homo sapiens
aatggaataaaaggcttg

SEQ ID NO: 2354447 - DNA, 15 bp, Homo sapiens
aatggaggaatatga

SEQ ID NO: 2354448 - DNA, 18 bp, Homo sapiens
aatggattggattattta

SEQ ID NO: 2354449 - DNA, 20 bp, Homo sapiens
aatggattggattatttaat

SEQ ID NO: 2354450 - DNA, 21 bp, Homo sapiens
aatggattggattatttaata

SEQ ID NO: 2354451 - DNA, 20 bp, Homo sapiens
aatggcatttagcacagtat

SEQ ID NO: 2354452 - DNA, 12 bp, Homo sapiens
aatggccatgca

SEQ ID NO: 2354453 - DNA, 18 bp, Homo sapiens
aatggccatgcaggaggt

SEQ ID NO: 2354454 - DNA, 15 bp, Homo sapiens
aatggccattttaaa

SEQ ID NO: 2354455 - DNA, 14 bp, Homo sapiens
aatggcgtctgctc

SEQ ID NO: 2354456 - DNA, 16 bp, Homo sapiens
aatggcgtctgctctg

SEQ ID NO: 2354457 - DNA, 23 bp, Homo sapiens
aatggcgtctgctctggtggctt

SEQ ID NO: 2354458 - DNA, 22 bp, Homo sapiens
aatggcttaagcaataaggaaa

SEQ ID NO: 2354459 - DNA, 12 bp, Homo sapiens
aatgggaagcag

SEQ ID NO: 2354460 - DNA, 12 bp, Homo sapiens
aatgggagctga

SEQ ID NO: 2354461 - DNA, 16 bp, Homo sapiens
aatgggagctgagcag

SEQ ID NO: 2354462 - DNA, 19 bp, Homo sapiens
aatgggctctccggggcca

SEQ ID NO: 2354463 - DNA, 13 bp, Homo sapiens
aatggtatgtaga

SEQ ID NO: 2354464 - DNA, 23 bp, Homo sapiens
aatggtcacgtttggtgcttctc

SEQ ID NO: 2354465 - DNA, 16 bp, Homo sapiens
aatggttaaattttac

SEQ ID NO: 2354466 - DNA, 17 bp, Homo sapiens
aatggttaaattttaca

SEQ ID NO: 2354467 - DNA, 22 bp, Homo sapiens
aatggttaaattttacatgaca

SEQ ID NO: 2354468 - DNA, 23 bp, Homo sapiens
aatggttaaattttacatgacag

SEQ ID NO: 2354469 - DNA, 23 bp, Homo sapiens
aatgtagcgactgtcaacagcgt

SEQ ID NO: 2354470 - DNA, 16 bp, Homo sapiens
aatgtataaatataca

SEQ ID NO: 2354471 - DNA, 15 bp, Homo sapiens
aatgtatgtgtggct

SEQ ID NO: 2354472 - DNA, 21 bp, Homo sapiens
aatgtatgtgtggctgtgggt

SEQ ID NO: 2354473 - DNA, 18 bp, Homo sapiens
aatgtattcctttaaaat

SEQ ID NO: 2354474 - DNA, 20 bp, Homo sapiens
aatgtattcctttaaaatat

SEQ ID NO: 2354475 - DNA, 17 bp, Homo sapiens
aatgtatttgatttata

SEQ ID NO: 2354476 - DNA, 12 bp, Homo sapiens
aatgtcagaaca

SEQ ID NO: 2354477 - DNA, 12 bp, Homo sapiens
aatgtctgctgg

SEQ ID NO: 2354478 - DNA, 13 bp, Homo sapiens
aatgtctgctggt

SEQ ID NO: 2354479 - DNA, 18 bp, Homo sapiens
aatgtctgtaataataga

SEQ ID NO: 2354480 - DNA, 15 bp, Homo sapiens
aatgtgaccctccaa

SEQ ID NO: 2354481 - DNA, 19 bp, Homo sapiens
aatgtgaccctccaaatgg

SEQ ID NO: 2354482 - DNA, 23 bp, Homo sapiens
aatgtgacttggattcaatttta

SEQ ID NO: 2354483 - DNA, 19 bp, Homo sapiens
aatgtgagatggttcccaa

SEQ ID NO: 2354484 - DNA, 21 bp, Homo sapiens
aatgtgatttataacgcacaa

SEQ ID NO: 2354485 - DNA, 17 bp, Homo sapiens
aatgtgcataatgataa

SEQ ID NO: 2354486 - DNA, 18 bp, Homo sapiens
aatgtgctatactgcata

SEQ ID NO: 2354487 - DNA, 21 bp, Homo sapiens
aatgtggaaggaaaatatttc

SEQ ID NO: 2354488 - DNA, 18 bp, Homo sapiens
aatgtggccatttcacca

SEQ ID NO: 2354489 - DNA, 13 bp, Homo sapiens
aatgtgtaagaac

SEQ ID NO: 2354490 - DNA, 22 bp, Homo sapiens
aatgtgtatttttcaaggcatt

SEQ ID NO: 2354491 - DNA, 22 bp, Homo sapiens
aatgtgtttcttgctgccatga

SEQ ID NO: 2354492 - DNA, 18 bp, Homo sapiens
aatgttaaagggatattt

SEQ ID NO: 2354493 - DNA, 22 bp, Homo sapiens
aatgttaaatttgtaagtttca

SEQ ID NO: 2354494 - DNA, 22 bp, Homo sapiens
aatgttaaggaaactcttatct

SEQ ID NO: 2354495 - DNA, 20 bp, Homo sapiens
aatgttagagtaatgaaatg

SEQ ID NO: 2354496 - DNA, 16 bp, Homo sapiens
aatgtttaatggtgaa

SEQ ID NO: 2354497 - DNA, 20 bp, Homo sapiens
aatgtttagcagatttaaga

SEQ ID NO: 2354498 - DNA, 17 bp, Homo sapiens
aatgtttatgagccaga

SEQ ID NO: 2354499 - DNA, 14 bp, Homo sapiens
aatgttttatgaca

SEQ ID NO: 2354500 - DNA, 21 bp, Homo sapiens
aatgttttatgacatttttct

SEQ ID NO: 2354501 - DNA, 23 bp, Homo sapiens
aatgttttcttcaacatgctcca

SEQ ID NO: 2354502 - DNA, 22 bp, Homo sapiens
aatgtttttaataaaagaaaat

SEQ ID NO: 2354503 - DNA, 16 bp, Homo sapiens
aatgtttttccctccc

SEQ ID NO: 2354504 - DNA, 17 bp, Homo sapiens
aattaaaaaaaaattgt

SEQ ID NO: 2354505 - DNA, 18 bp, Homo sapiens
aattaaaaaaaaattgta

SEQ ID NO: 2354506 - DNA, 16 bp, Homo sapiens
aattaagaaattccat

SEQ ID NO: 2354507 - DNA, 23 bp, Homo sapiens
aattaagcattttgaaacaaagt

SEQ ID NO: 2354508 - DNA, 23 bp, Homo sapiens
aattaatagccaaagatttcata

SEQ ID NO: 2354509 - DNA, 13 bp, Homo sapiens
aattaatttggag

SEQ ID NO: 2354510 - DNA, 15 bp, Homo sapiens
aattaccaacctgtt

SEQ ID NO: 2354511 - DNA, 18 bp, Homo sapiens
aattacctggatgttctt

SEQ ID NO: 2354512 - DNA, 14 bp, Homo sapiens
aattaccttctatt

SEQ ID NO: 2354513 - DNA, 20 bp, Homo sapiens
aattagtgtgacagtttcca

SEQ ID NO: 2354514 - DNA, 21 bp, Homo sapiens
aattagtgtgacagtttccaa

SEQ ID NO: 2354515 - DNA, 18 bp, Homo sapiens
aattagttccagtttctc

SEQ ID NO: 2354516 - DNA, 21 bp, Homo sapiens
aattatcattgtttgtccttt

SEQ ID NO: 2354517 - DNA, 11 bp, Homo sapiens
aattatgtgac

SEQ ID NO: 2354518 - DNA, 14 bp, Homo sapiens
aattattgacactg

SEQ ID NO: 2354519 - DNA, 19 bp, Homo sapiens
aattattgacactgaactt

SEQ ID NO: 2354520 - DNA, 16 bp, Homo sapiens
aattatttaattgtcc

SEQ ID NO: 2354521 - DNA, 14 bp, Homo sapiens
aattatttgattat

SEQ ID NO: 2354522 - DNA, 20 bp, Homo sapiens
aattatttgattatttaaga

SEQ ID NO: 2354523 - DNA, 14 bp, Homo sapiens
aattcaaaaagaac

SEQ ID NO: 2354524 - DNA, 15 bp, Homo sapiens
aattcaaaagtattg

SEQ ID NO: 2354525 - DNA, 14 bp, Homo sapiens
aattcaactttgta

SEQ ID NO: 2354526 - DNA, 15 bp, Homo sapiens
aattcataataaatt

SEQ ID NO: 2354527 - DNA, 19 bp, Homo sapiens
aattcatatctaaatagta

SEQ ID NO: 2354528 - DNA, 14 bp, Homo sapiens
aattctaacccaag

SEQ ID NO: 2354529 - DNA, 17 bp, Homo sapiens
aattctaacccaggtat

SEQ ID NO: 2354530 - DNA, 15 bp, Homo sapiens
acaatagtatacatt

SEQ ID NO: 2354531 - DNA, 23 bp, Homo sapiens
acaatcaactctaatagtgctta

SEQ ID NO: 2354532 - DNA, 22 bp, Homo sapiens
acaatccacgcttctccggatc

SEQ ID NO: 2354533 - DNA, 21 bp, Homo sapiens
acaatctatggcttatttcta

SEQ ID NO: 2354534 - DNA, 21 bp, Homo sapiens
acaatgatcaccgactgaaaa

SEQ ID NO: 2354535 - DNA, 11 bp, Homo sapiens
acaatgttaag

SEQ ID NO: 2354536 - DNA, 16 bp, Homo sapiens
acaattcagtaacaaa

SEQ ID NO: 2354537 - DNA, 15 bp, Homo sapiens
acaattggtaaaact

SEQ ID NO: 2354538 - DNA, 16 bp, Homo sapiens
acaattttttatcatg

SEQ ID NO: 2354539 - DNA, 22 bp, Homo sapiens
acaattttttatcatgcatgtc

SEQ ID NO: 2354540 - DNA, 23 bp, Homo sapiens
acaattttttttaattggccatg

SEQ ID NO: 2354541 - DNA, 16 bp, Homo sapiens
acacaaagcttctaaa

SEQ ID NO: 2354542 - DNA, 23 bp, Homo sapiens
acacaacgattatagtaactata

SEQ ID NO: 2354543 - DNA, 12 bp, Homo sapiens
acacacacacac

SEQ ID NO: 2354544 - DNA, 17 bp, Homo sapiens
acacacacacacacgat

SEQ ID NO: 2354545 - DNA, 13 bp, Homo sapiens
acacacacacacg

SEQ ID NO: 2354546 - DNA, 14 bp, Homo sapiens
acacacacacacga

SEQ ID NO: 2354547 - DNA, 14 bp, Homo sapiens
acacacacgatgca

SEQ ID NO: 2354548 - DNA, 13 bp, Homo sapiens
acacacagcagtg

SEQ ID NO: 2354549 - DNA, 14 bp, Homo sapiens
acacacgagcaaac

SEQ ID NO: 2354550 - DNA, 19 bp, Homo sapiens
acacacgagcaaacccaga

SEQ ID NO: 2354551 - DNA, 11 bp, Homo sapiens
acacacgatgc

SEQ ID NO: 2354552 - DNA, 13 bp, Homo sapiens
acacacgatgcat

SEQ ID NO: 2354553 - DNA, 20 bp, Homo sapiens
acacacgatgcatttaataa

SEQ ID NO: 2354554 - DNA, 22 bp, Homo sapiens
acacacgatgcatttaataaag

SEQ ID NO: 2354555 - DNA, 20 bp, Homo sapiens
acacagaaatgctgctggcc

SEQ ID NO: 2354556 - DNA, 21 bp, Homo sapiens
acacagaaatgctgctggcca

SEQ ID NO: 2354557 - DNA, 14 bp, Homo sapiens
acacagcatgtgta

SEQ ID NO: 2354558 - DNA, 15 bp, Homo sapiens
acacagcatgtgtat

SEQ ID NO: 2354559 - DNA, 20 bp, Homo sapiens
acacagcccctatagcactg

SEQ ID NO: 2354560 - DNA, 17 bp, Homo sapiens
acacagtgtctgttcag

SEQ ID NO: 2354561 - DNA, 15 bp, Homo sapiens
acacagttcctggga

SEQ ID NO: 2354562 - DNA, 20 bp, Homo sapiens
acacatagttctgtaataaa

SEQ ID NO: 2354563 - DNA, 13 bp, Homo sapiens
acacatcttaaaa

SEQ ID NO: 2354564 - DNA, 22 bp, Homo sapiens
acacattaatgataaactcaga

SEQ ID NO: 2354565 - DNA, 22 bp, Homo sapiens
acacattacaaagttaaaattg

SEQ ID NO: 2354566 - DNA, 23 bp, Homo sapiens
acacattacaaagttaaaattgt

SEQ ID NO: 2354567 - DNA, 20 bp, Homo sapiens
acacattgcagcttcaactt

SEQ ID NO: 2354568 - DNA, 19 bp, Homo sapiens
acacattggaatgccttgg

SEQ ID NO: 2354569 - DNA, 16 bp, Homo sapiens
acacatttgctactgt

SEQ ID NO: 2354570 - DNA, 20 bp, Homo sapiens
acacatttgctactgttgta

SEQ ID NO: 2354571 - DNA, 16 bp, Homo sapiens
acacattttttaggaa

SEQ ID NO: 2354572 - DNA, 19 bp, Homo sapiens
acacattttttaggaaatg

SEQ ID NO: 2354573 - DNA, 13 bp, Homo sapiens
acacatttttttg

SEQ ID NO: 2354574 - DNA, 17 bp, Homo sapiens
acaccactttcccacac

SEQ ID NO: 2354575 - DNA, 16 bp, Homo sapiens
acaccattaccaaaat

SEQ ID NO: 2354576 - DNA, 13 bp, Homo sapiens
acacccctgtgct

SEQ ID NO: 2354577 - DNA, 21 bp, Homo sapiens
acacccctgtgctcccctgcc

SEQ ID NO: 2354578 - DNA, 14 bp, Homo sapiens
acaccctccagaga

SEQ ID NO: 2354579 - DNA, 21 bp, Homo sapiens
acacccttctcccactctcct

SEQ ID NO: 2354580 - DNA, 21 bp, Homo sapiens
acacctactagtcaccagaga

SEQ ID NO: 2354581 - DNA, 18 bp, Homo sapiens
acacctattatcccagct

SEQ ID NO: 2354582 - DNA, 23 bp, Homo sapiens
acacctggctgaggttcctctgc

SEQ ID NO: 2354583 - DNA, 12 bp, Homo sapiens
acacgagccaca

SEQ ID NO: 2354584 - DNA, 13 bp, Homo sapiens
acacgagccacaa

SEQ ID NO: 2354585 - DNA, 21 bp, Homo sapiens
acacggatctgctgggctctg

SEQ ID NO: 2354586 - DNA, 16 bp, Homo sapiens
acactaacgaaatatc

SEQ ID NO: 2354587 - DNA, 19 bp, Homo sapiens
acactaactcaccagcccc

SEQ ID NO: 2354588 - DNA, 22 bp, Homo sapiens
acactaccaaacactcagtcca

SEQ ID NO: 2354589 - DNA, 17 bp, Homo sapiens
acactagcccaatgaaa

SEQ ID NO: 2354590 - DNA, 20 bp, Homo sapiens
acactagcccaatgaaatga

SEQ ID NO: 2354591 - DNA, 20 bp, Homo sapiens
acactccagggacacacagc

SEQ ID NO: 2354592 - DNA, 22 bp, Homo sapiens
acactcttagctatgttgacat

SEQ ID NO: 2354593 - DNA, 23 bp, Homo sapiens
acactgaaagttttgtaaaagaa

SEQ ID NO: 2354594 - DNA, 14 bp, Homo sapiens
acactgaatttttc

SEQ ID NO: 2354595 - DNA, 17 bp, Homo sapiens
acactgatggctcaaga

SEQ ID NO: 2354596 - DNA, 15 bp, Homo sapiens
acactgggtgcgtct

SEQ ID NO: 2354597 - DNA, 16 bp, Homo sapiens
acactggtaaatgtta

SEQ ID NO: 2354598 - DNA, 19 bp, Homo sapiens
acactgtgaactaatgaca

SEQ ID NO: 2354599 - DNA, 17 bp, Homo sapiens
acactgttgataaaaac

SEQ ID NO: 2354600 - DNA, 20 bp, Homo sapiens
acacttctcttaagtggtct

SEQ ID NO: 2354601 - DNA, 20 bp, Homo sapiens
acacttcttgaaacagcctg

SEQ ID NO: 2354602 - DNA, 22 bp, Homo sapiens
acactttaattaccaacctgtt

SEQ ID NO: 2354603 - DNA, 20 bp, Homo sapiens
acagaaagagactccgtctc

SEQ ID NO: 2354604 - DNA, 16 bp, Homo sapiens
acagaaatgctgctgg

SEQ ID NO: 2354605 - DNA, 16 bp, Homo sapiens
acagaacagcttcagg

SEQ ID NO: 2354606 - DNA, 22 bp, Homo sapiens
acagaagctcttactctttcct

SEQ ID NO: 2354607 - DNA, 15 bp, Homo sapiens
acagaatatttttat

SEQ ID NO: 2354608 - DNA, 23 bp, Homo sapiens
acagaatatttttatatttcctt

SEQ ID NO: 2354609 - DNA, 18 bp, Homo sapiens
acagaatcttgttttgaa

SEQ ID NO: 2354610 - DNA, 13 bp, Homo sapiens
acagaatttgaga

SEQ ID NO: 2354611 - DNA, 14 bp, Homo sapiens
acagaatttgagaa

SEQ ID NO: 2354612 - DNA, 21 bp, Homo sapiens
acagaatttgagaaccttgga

SEQ ID NO: 2354613 - DNA, 18 bp, Homo sapiens
acagacaaagcataatca

SEQ ID NO: 2354614 - DNA, 14 bp, Homo sapiens
acagagcctggccc

SEQ ID NO: 2354615 - DNA, 21 bp, Homo sapiens
acagaggaaagggctggctcc

SEQ ID NO: 2354616 - DNA, 15 bp, Homo sapiens
acagaggagtgcagc

SEQ ID NO: 2354617 - DNA, 19 bp, Homo sapiens
acagaggatgccttttctg

SEQ ID NO: 2354618 - DNA, 24 bp, Homo sapiens
acagaggtagtctcactgcttgaa

SEQ ID NO: 2354619 - DNA, 22 bp, Homo sapiens
acagaggtattaaaactaaatt

SEQ ID NO: 2354620 - DNA, 20 bp, Homo sapiens
acagataagcaagagagatg

SEQ ID NO: 2354621 - DNA, 14 bp, Homo sapiens
acagatcaagaaaa

SEQ ID NO: 2354622 - DNA, 15 bp, Homo sapiens
acagattctttcagt

SEQ ID NO: 2354623 - DNA, 22 bp, Homo sapiens
acagcagtgtgaatagcctggc

SEQ ID NO: 2354624 - DNA, 16 bp, Homo sapiens
acagcatcccttccca

SEQ ID NO: 2354625 - DNA, 13 bp, Homo sapiens
acagcatgtgtat

SEQ ID NO: 2354626 - DNA, 20 bp, Homo sapiens
acagcccaggatactggcac

SEQ ID NO: 2354627 - DNA, 14 bp, Homo sapiens
acagcctagggcag

SEQ ID NO: 2354628 - DNA, 15 bp, Homo sapiens
acagcctagggcaga

SEQ ID NO: 2354629 - DNA, 20 bp, Homo sapiens
acagcctgggtgacggtcct

SEQ ID NO: 2354630 - DNA, 16 bp, Homo sapiens
acagccttgtccccct

SEQ ID NO: 2354631 - DNA, 14 bp, Homo sapiens
acagcctttgaatg

SEQ ID NO: 2354632 - DNA, 16 bp, Homo sapiens
acagcctttgaatgta

SEQ ID NO: 2354633 - DNA, 21 bp, Homo sapiens
acagcctttgaatgtaaccaa

SEQ ID NO: 2354634 - DNA, 21 bp, Homo sapiens
acagccttttttcctgggcca

SEQ ID NO: 2354635 - DNA, 18 bp, Homo sapiens
acagcgagggcagctgct

SEQ ID NO: 2354636 - DNA, 19 bp, Homo sapiens
acagcgagggcagctgcta

SEQ ID NO: 2354637 - DNA, 15 bp, Homo sapiens
acagcgtccctggcg

SEQ ID NO: 2354638 - DNA, 17 bp, Homo sapiens
acagcgtccctggcgca

SEQ ID NO: 2354639 - DNA, 13 bp, Homo sapiens
acagctacaaact

SEQ ID NO: 2354640 - DNA, 14 bp, Homo sapiens
acagctaccaccct

SEQ ID NO: 2354641 - DNA, 19 bp, Homo sapiens
acagctgcaattccctgga

SEQ ID NO: 2354642 - DNA, 23 bp, Homo sapiens
acagctgcactgaggcagcgacc

SEQ ID NO: 2354643 - DNA, 18 bp, Homo sapiens
acagctgctgttctcagg

SEQ ID NO: 2354644 - DNA, 16 bp, Homo sapiens
acagctgtgtctgcca

SEQ ID NO: 2354645 - DNA, 15 bp, Homo sapiens
acagcttcaggttat

SEQ ID NO: 2354646 - DNA, 22 bp, Homo sapiens
acagcttcaggttatcgaaata

SEQ ID NO: 2354647 - DNA, 21 bp, Homo sapiens
acagcttcattttatttttga

SEQ ID NO: 2354648 - DNA, 16 bp, Homo sapiens
acagcttgagccgggc

SEQ ID NO: 2354649 - DNA, 17 bp, Homo sapiens
acagctttctgggatgt

SEQ ID NO: 2354650 - DNA, 20 bp, Homo sapiens
acagctttctgggatgtcac

SEQ ID NO: 2354651 - DNA, 21 bp, Homo sapiens
acagctttctgggatgtcaca

SEQ ID NO: 2354652 - DNA, 22 bp, Homo sapiens
acaggaaggaggggagagacag

SEQ ID NO: 2354653 - DNA, 18 bp, Homo sapiens
acaggagacaaaagagca

SEQ ID NO: 2354654 - DNA, 22 bp, Homo sapiens
acaggatctataggcagcttct

SEQ ID NO: 2354655 - DNA, 16 bp, Homo sapiens
acaggcagcccagcag

SEQ ID NO: 2354656 - DNA, 17 bp, Homo sapiens
acaggcagcccagcagt

SEQ ID NO: 2354657 - DNA, 17 bp, Homo sapiens
acaggcagcctcctttg

SEQ ID NO: 2354658 - DNA, 17 bp, Homo sapiens
acaggcctatttaacaa

SEQ ID NO: 2354659 - DNA, 18 bp, Homo sapiens
acagggtgggcttcctgc

SEQ ID NO: 2354660 - DNA, 16 bp, Homo sapiens
acagggttcaaaatgt

SEQ ID NO: 2354661 - DNA, 15 bp, Homo sapiens
acagtaagatatctc

SEQ ID NO: 2354662 - DNA, 18 bp, Homo sapiens
acagtactggttactttc

SEQ ID NO: 2354663 - DNA, 20 bp, Homo sapiens
acagtactggttactttcaa

SEQ ID NO: 2354664 - DNA, 13 bp, Homo sapiens
acagtagaactgt

SEQ ID NO: 2354665 - DNA, 16 bp, Homo sapiens
acagtatagatttttg

SEQ ID NO: 2354666 - DNA, 14 bp, Homo sapiens
acagtccaaccaga

SEQ ID NO: 2354667 - DNA, 17 bp, Homo sapiens
acagtccaaccagaaac

SEQ ID NO: 2354668 - DNA, 15 bp, Homo sapiens
acagtccttgctttg

SEQ ID NO: 2354669 - DNA, 23 bp, Homo sapiens
acagtgaagttttactgtctatt

SEQ ID NO: 2354670 - DNA, 19 bp, Homo sapiens
acagtgcagagccttctca

SEQ ID NO: 2354671 - DNA, 13 bp, Homo sapiens
acagtgcctcttc

SEQ ID NO: 2354672 - DNA, 20 bp, Homo sapiens
acagtggttttatactgaag

SEQ ID NO: 2354673 - DNA, 22 bp, Homo sapiens
acagtggttttatactgaagga

SEQ ID NO: 2354674 - DNA, 12 bp, Homo sapiens
acagtgtctgtt

SEQ ID NO: 2354675 - DNA, 21 bp, Homo sapiens
acagtgttgcatatgagcctg

SEQ ID NO: 2354676 - DNA, 21 bp, Homo sapiens
acagttcctgggaacatcaca

SEQ ID NO: 2354677 - DNA, 12 bp, Homo sapiens
acagttctttcc

SEQ ID NO: 2354678 - DNA, 22 bp, Homo sapiens
acagttctttcctctttctgct

SEQ ID NO: 2354679 - DNA, 12 bp, Homo sapiens
acagtttaacag

SEQ ID NO: 2354680 - DNA, 14 bp, Homo sapiens
acagtttcttagct

SEQ ID NO: 2354681 - DNA, 20 bp, Homo sapiens
acagtttcttagctttttaa

SEQ ID NO: 2354682 - DNA, 14 bp, Homo sapiens
acataaaagaaata

SEQ ID NO: 2354683 - DNA, 16 bp, Homo sapiens
acataaaggaaaagac

SEQ ID NO: 2354684 - DNA, 20 bp, Homo sapiens
acataaaggaaaagacacat

SEQ ID NO: 2354685 - DNA, 22 bp, Homo sapiens
acataaaggaaaagacacattt

SEQ ID NO: 2354686 - DNA, 15 bp, Homo sapiens
acataacgtttttcc

SEQ ID NO: 2354687 - DNA, 20 bp, Homo sapiens
acataacgtttttcctttaa

SEQ ID NO: 2354688 - DNA, 23 bp, Homo sapiens
acataagtaacttttaaaatttg

SEQ ID NO: 2354689 - DNA, 15 bp, Homo sapiens
acataataaagtatt

SEQ ID NO: 2354690 - DNA, 16 bp, Homo sapiens
acatacaagaaaatgt

SEQ ID NO: 2354691 - DNA, 18 bp, Homo sapiens
acatacaagaaaatgtat

SEQ ID NO: 2354692 - DNA, 22 bp, Homo sapiens
acatacacccaaacacttacac

SEQ ID NO: 2354693 - DNA, 19 bp, Homo sapiens
acatacgggctttaatagt

SEQ ID NO: 2354694 - DNA, 20 bp, Homo sapiens
acatagcatgcttcctttct

SEQ ID NO: 2354695 - DNA, 21 bp, Homo sapiens
acatagcatgcttcctttctc

SEQ ID NO: 2354696 - DNA, 22 bp, Homo sapiens
acatagcatgcttcctttctct

SEQ ID NO: 2354697 - DNA, 17 bp, Homo sapiens
acatagctctgaagtta

SEQ ID NO: 2354698 - DNA, 20 bp, Homo sapiens
acataggaagggatctgaga

SEQ ID NO: 2354699 - DNA, 18 bp, Homo sapiens
acataggccgagctgtgg

SEQ ID NO: 2354700 - DNA, 21 bp, Homo sapiens
acatagttctgtaataaaact

SEQ ID NO: 2354701 - DNA, 14 bp, Homo sapiens
acatatatttattg

SEQ ID NO: 2354702 - DNA, 13 bp, Homo sapiens
acatcaaaccttt

SEQ ID NO: 2354703 - DNA, 17 bp, Homo sapiens
acatcaaacctttgagt

SEQ ID NO: 2354704 - DNA, 20 bp, Homo sapiens
acatctcaataaagtgcttt

SEQ ID NO: 2354705 - DNA, 22 bp, Homo sapiens
acatctctggcccagaaagcct

SEQ ID NO: 2354706 - DNA, 15 bp, Homo sapiens
acatctgatatcagg

SEQ ID NO: 2354707 - DNA, 22 bp, Homo sapiens
acatctgatatcaggaaatatc

SEQ ID NO: 2354708 - DNA, 23 bp, Homo sapiens
acatctgccttaaaaccaaagag

SEQ ID NO: 2354709 - DNA, 14 bp, Homo sapiens
acatcttctttgga

SEQ ID NO: 2354710 - DNA, 13 bp, Homo sapiens
acatctttatccg

SEQ ID NO: 2354711 - DNA, 14 bp, Homo sapiens
acatcttttctaat

SEQ ID NO: 2354712 - DNA, 22 bp, Homo sapiens
acatcttttctaatcacagtgt

SEQ ID NO: 2354713 - DNA, 22 bp, Homo sapiens
acatgaaaaacacggcagctgt

SEQ ID NO: 2354714 - DNA, 21 bp, Homo sapiens
acatgaatcccacccacatgt

SEQ ID NO: 2354715 - DNA, 18 bp, Homo sapiens
acatgacagatattttat

SEQ ID NO: 2354716 - DNA, 21 bp, Homo sapiens
acatgacttccttatttctga

SEQ ID NO: 2354717 - DNA, 15 bp, Homo sapiens
acatgagatggagag

SEQ ID NO: 2354718 - DNA, 21 bp, Homo sapiens
acatgatttagggaagcaggg

SEQ ID NO: 2354719 - DNA, 22 bp, Homo sapiens
acatgatttagggaagcaggga

SEQ ID NO: 2354720 - DNA, 13 bp, Homo sapiens
acatgcaataaaa

SEQ ID NO: 2354721 - DNA, 14 bp, Homo sapiens
acatgcaataaaat

SEQ ID NO: 2354722 - DNA, 19 bp, Homo sapiens
acatgcaataaaatttaaa

SEQ ID NO: 2354723 - DNA, 13 bp, Homo sapiens
acatgcatataat

SEQ ID NO: 2354724 - DNA, 16 bp, Homo sapiens
acatgcatataatgaa

SEQ ID NO: 2354725 - DNA, 18 bp, Homo sapiens
acatgcatataatgaata

SEQ ID NO: 2354726 - DNA, 20 bp, Homo sapiens
acatgcctgcgcctgctgcc

SEQ ID NO: 2354727 - DNA, 22 bp, Homo sapiens
acatgcctgcgcctgctgcctg

SEQ ID NO: 2354728 - DNA, 17 bp, Homo sapiens
acatggcctatgcacat

SEQ ID NO: 2354729 - DNA, 20 bp, Homo sapiens
acatggcctatgcacatatg

SEQ ID NO: 2354730 - DNA, 20 bp, Homo sapiens
acatggcgccctgcctcctg

SEQ ID NO: 2354731 - DNA, 13 bp, Homo sapiens
acatggtgcctga

SEQ ID NO: 2354732 - DNA, 18 bp, Homo sapiens
acatggttgtgacctgag

SEQ ID NO: 2354733 - DNA, 19 bp, Homo sapiens
acatgtaataaaaagtata

SEQ ID NO: 2354734 - DNA, 20 bp, Homo sapiens
acatgtaataaaaagtatat

SEQ ID NO: 2354735 - DNA, 23 bp, Homo sapiens
acatgtaataaaaagtatatgtt

SEQ ID NO: 2354736 - DNA, 12 bp, Homo sapiens
acatgtgaaacc

SEQ ID NO: 2354737 - DNA, 17 bp, Homo sapiens
acatgtgaaaccttttt

SEQ ID NO: 2354738 - DNA, 14 bp, Homo sapiens
acatgtgacacata

SEQ ID NO: 2354739 - DNA, 15 bp, Homo sapiens
acatgtgacacatat

SEQ ID NO: 2354740 - DNA, 23 bp, Homo sapiens
acatgtgatacattttttaagct

SEQ ID NO: 2354741 - DNA, 20 bp, Homo sapiens
acatgtgtagcctgtgcatg

SEQ ID NO: 2354742 - DNA, 15 bp, Homo sapiens
acattaaatgcaata

SEQ ID NO: 2354743 - DNA, 17 bp, Homo sapiens
acattaaatgcaataat

SEQ ID NO: 2354744 - DNA, 21 bp, Homo sapiens
acattaaatgcaataatttta

SEQ ID NO: 2354745 - DNA, 19 bp, Homo sapiens
acattaaggaatttgatga

SEQ ID NO: 2354746 - DNA, 13 bp, Homo sapiens
acattaggctgtt

SEQ ID NO: 2354747 - DNA, 13 bp, Homo sapiens
acattcctttgaa

SEQ ID NO: 2354748 - DNA, 15 bp, Homo sapiens
acattcctttgaata

SEQ ID NO: 2354749 - DNA, 22 bp, Homo sapiens
acattcgaggtgtcaccctgca

SEQ ID NO: 2354750 - DNA, 23 bp, Homo sapiens
acattcgaggtgtcaccctgcag

SEQ ID NO: 2354751 - DNA, 23 bp, Homo sapiens
acattctggggaaacaacattta

SEQ ID NO: 2354752 - DNA, 18 bp, Homo sapiens
acattcttggtcacaaag

SEQ ID NO: 2354753 - DNA, 15 bp, Homo sapiens
acattgaaactgtat

SEQ ID NO: 2354754 - DNA, 16 bp, Homo sapiens
acattgaaactgtatt

SEQ ID NO: 2354755 - DNA, 20 bp, Homo sapiens
acattgaaactgtatttact

SEQ ID NO: 2354756 - DNA, 17 bp, Homo sapiens
acattggaatgccttgg

SEQ ID NO: 2354757 - DNA, 17 bp, Homo sapiens
acattgttcttattctg

SEQ ID NO: 2354758 - DNA, 23 bp, Homo sapiens
accccttctctcctccccaaatc

SEQ ID NO: 2354759 - DNA, 14 bp, Homo sapiens
accctatgggtcta

SEQ ID NO: 2354760 - DNA, 19 bp, Homo sapiens
accctattctatccatctc

SEQ ID NO: 2354761 - DNA, 22 bp, Homo sapiens
accctattctatccatctcctg

SEQ ID NO: 2354762 - DNA, 23 bp, Homo sapiens
accctattctatccatctcctgg

SEQ ID NO: 2354763 - DNA, 19 bp, Homo sapiens
accctcactggctctcctg

SEQ ID NO: 2354764 - DNA, 21 bp, Homo sapiens
accctcactggctctcctggc

SEQ ID NO: 2354765 - DNA, 20 bp, Homo sapiens
accctcagggagcctcccca

SEQ ID NO: 2354766 - DNA, 17 bp, Homo sapiens
accctcattgtgtttct

SEQ ID NO: 2354767 - DNA, 23 bp, Homo sapiens
accctcccagaaacatctctggc

SEQ ID NO: 2354768 - DNA, 11 bp, Homo sapiens
accctctccat

SEQ ID NO: 2354769 - DNA, 15 bp, Homo sapiens
accctctccatctcc

SEQ ID NO: 2354770 - DNA, 15 bp, Homo sapiens
accctcttcctactg

SEQ ID NO: 2354771 - DNA, 17 bp, Homo sapiens
accctcttcctgtgatc

SEQ ID NO: 2354772 - DNA, 20 bp, Homo sapiens
accctcttcctgtgatccac

SEQ ID NO: 2354773 - DNA, 16 bp, Homo sapiens
accctgacctggcccc

SEQ ID NO: 2354774 - DNA, 15 bp, Homo sapiens
accctgaggccctgg

SEQ ID NO: 2354775 - DNA, 20 bp, Homo sapiens
accctgaggccctgggctgg

SEQ ID NO: 2354776 - DNA, 14 bp, Homo sapiens
accctgattcttga

SEQ ID NO: 2354777 - DNA, 22 bp, Homo sapiens
accctgattcttgattcctggc

SEQ ID NO: 2354778 - DNA, 23 bp, Homo sapiens
accctgattcttgattcctggct

SEQ ID NO: 2354779 - DNA, 13 bp, Homo sapiens
accctgccacagc

SEQ ID NO: 2354780 - DNA, 16 bp, Homo sapiens
accctgccacagccag

SEQ ID NO: 2354781 - DNA, 14 bp, Homo sapiens
accctgcgggccag

SEQ ID NO: 2354782 - DNA, 16 bp, Homo sapiens
accctgcgggccaggg

SEQ ID NO: 2354783 - DNA, 21 bp, Homo sapiens
accctgctgaacacagtgtct

SEQ ID NO: 2354784 - DNA, 22 bp, Homo sapiens
accctgctgaacacagtgtctg

SEQ ID NO: 2354785 - DNA, 13 bp, Homo sapiens
accctggggcctg

SEQ ID NO: 2354786 - DNA, 14 bp, Homo sapiens
accctggggcctga

SEQ ID NO: 2354787 - DNA, 17 bp, Homo sapiens
accctgtctgtcccttt

SEQ ID NO: 2354788 - DNA, 14 bp, Homo sapiens
accctgttcctgct

SEQ ID NO: 2354789 - DNA, 21 bp, Homo sapiens
accctgttcctgctgctgtct

SEQ ID NO: 2354790 - DNA, 22 bp, Homo sapiens
acccttactggcttacctcctc

SEQ ID NO: 2354791 - DNA, 21 bp, Homo sapiens
acccttattgctgtcctggag

SEQ ID NO: 2354792 - DNA, 17 bp, Homo sapiens
acccttcatcttcctgt

SEQ ID NO: 2354793 - DNA, 18 bp, Homo sapiens
acccttcatcttcctgtg

SEQ ID NO: 2354794 - DNA, 14 bp, Homo sapiens
acccttctcccact

SEQ ID NO: 2354795 - DNA, 17 bp, Homo sapiens
acccttctcccactctc

SEQ ID NO: 2354796 - DNA, 20 bp, Homo sapiens
acccttctcccactctccta

SEQ ID NO: 2354797 - DNA, 18 bp, Homo sapiens
acccttgttggggagtgg

SEQ ID NO: 2354798 - DNA, 17 bp, Homo sapiens
accctttgggggttgaa

SEQ ID NO: 2354799 - DNA, 19 bp, Homo sapiens
accctttgtgtgctctcca

SEQ ID NO: 2354800 - DNA, 23 bp, Homo sapiens
acccttttaagtttaaaatgtgt

SEQ ID NO: 2354801 - DNA, 18 bp, Homo sapiens
accgagtagaaaatgtga

SEQ ID NO: 2354802 - DNA, 20 bp, Homo sapiens
accgagtagaaaatgtgacc

SEQ ID NO: 2354803 - DNA, 19 bp, Homo sapiens
accgcgggtgtgggaaagc

SEQ ID NO: 2354804 - DNA, 19 bp, Homo sapiens
accgcgtagagagccgggc

SEQ ID NO: 2354805 - DNA, 15 bp, Homo sapiens
accgggccctgggtt

SEQ ID NO: 2354806 - DNA, 16 bp, Homo sapiens
accggtccagctggcc

SEQ ID NO: 2354807 - DNA, 17 bp, Homo sapiens
accggtccagctggcct

SEQ ID NO: 2354808 - DNA, 18 bp, Homo sapiens
accggtccagctggcctg

SEQ ID NO: 2354809 - DNA, 23 bp, Homo sapiens
accggtccagctggcctggacag

SEQ ID NO: 2354810 - DNA, 11 bp, Homo sapiens
accgtgcctgg

SEQ ID NO: 2354811 - DNA, 12 bp, Homo sapiens
accgtgcctggc

SEQ ID NO: 2354812 - DNA, 15 bp, Homo sapiens
accgtggaggaggaa

SEQ ID NO: 2354813 - DNA, 18 bp, Homo sapiens
accgtggaggaggaaggc

SEQ ID NO: 2354814 - DNA, 16 bp, Homo sapiens
accgtggtatgtctgc

SEQ ID NO: 2354815 - DNA, 14 bp, Homo sapiens
accgtgtcaagctg

SEQ ID NO: 2354816 - DNA, 17 bp, Homo sapiens
accgtgtcaagctgctc

SEQ ID NO: 2354817 - DNA, 21 bp, Homo sapiens
acctaacacattaaatgtgga

SEQ ID NO: 2354818 - DNA, 11 bp, Homo sapiens
acctaatccaa

SEQ ID NO: 2354819 - DNA, 12 bp, Homo sapiens
acctaatgttta

SEQ ID NO: 2354820 - DNA, 19 bp, Homo sapiens
acctaatgtttatgagcca

SEQ ID NO: 2354821 - DNA, 15 bp, Homo sapiens
acctaattaatatat

SEQ ID NO: 2354822 - DNA, 16 bp, Homo sapiens
acctacacccctgtgc

SEQ ID NO: 2354823 - DNA, 22 bp, Homo sapiens
acctacatatgctgatctttta

SEQ ID NO: 2354824 - DNA, 21 bp, Homo sapiens
acctacatgctgaaaaatata

SEQ ID NO: 2354825 - DNA, 15 bp, Homo sapiens
acctacccatacacc

SEQ ID NO: 2354826 - DNA, 13 bp, Homo sapiens
acctacctcccac

SEQ ID NO: 2354827 - DNA, 18 bp, Homo sapiens
acctagctggctctgtga

SEQ ID NO: 2354828 - DNA, 15 bp, Homo sapiens
acctaggtctccagt

SEQ ID NO: 2354829 - DNA, 18 bp, Homo sapiens
acctagttaaagaaagga

SEQ ID NO: 2354830 - DNA, 14 bp, Homo sapiens
acctagttttccat

SEQ ID NO: 2354831 - DNA, 19 bp, Homo sapiens
acctatgatattttctgtg

SEQ ID NO: 2354832 - DNA, 15 bp, Homo sapiens
acctcaagggggact

SEQ ID NO: 2354833 - DNA, 14 bp, Homo sapiens
acctcaccttcctg

SEQ ID NO: 2354834 - DNA, 15 bp, Homo sapiens
acctcagggctccca

SEQ ID NO: 2354835 - DNA, 18 bp, Homo sapiens
acctcagggctgtcccag

SEQ ID NO: 2354836 - DNA, 22 bp, Homo sapiens
acctcagggctgtcccagcccc

SEQ ID NO: 2354837 - DNA, 23 bp, Homo sapiens
acctcagtgccttcctgtttttc

SEQ ID NO: 2354838 - DNA, 13 bp, Homo sapiens
acctcatgcccac

SEQ ID NO: 2354839 - DNA, 20 bp, Homo sapiens
acctcatgcccaccccctgc

SEQ ID NO: 2354840 - DNA, 21 bp, Homo sapiens
acctcatgcccaccccctgcc

SEQ ID NO: 2354841 - DNA, 23 bp, Homo sapiens
acctcatgcccaccccctgccct

SEQ ID NO: 2354842 - DNA, 15 bp, Homo sapiens
acctcatgcccagct

SEQ ID NO: 2354843 - DNA, 12 bp, Homo sapiens
acctccaagcat

SEQ ID NO: 2354844 - DNA, 17 bp, Homo sapiens
acctccaagcatttcat

SEQ ID NO: 2354845 - DNA, 13 bp, Homo sapiens
acctccagcctga

SEQ ID NO: 2354846 - DNA, 17 bp, Homo sapiens
acctccaggctccagca

SEQ ID NO: 2354847 - DNA, 18 bp, Homo sapiens
acctcctgacacccttct

SEQ ID NO: 2354848 - DNA, 13 bp, Homo sapiens
acctcctgctgtg

SEQ ID NO: 2354849 - DNA, 14 bp, Homo sapiens
acctcgctgagggc

SEQ ID NO: 2354850 - DNA, 15 bp, Homo sapiens
acctcggtgaccact

SEQ ID NO: 2354851 - DNA, 16 bp, Homo sapiens
acctctattttaatta

SEQ ID NO: 2354852 - DNA, 15 bp, Homo sapiens
acctctcaagctagt

SEQ ID NO: 2354853 - DNA, 20 bp, Homo sapiens
acctcttgtgcaaggtggcc

SEQ ID NO: 2354854 - DNA, 13 bp, Homo sapiens
acctctttgctca

SEQ ID NO: 2354855 - DNA, 21 bp, Homo sapiens
acctctttgctcaacagaaca

SEQ ID NO: 2354856 - DNA, 22 bp, Homo sapiens
acctcttttgcttgccaaagta

SEQ ID NO: 2354857 - DNA, 21 bp, Homo sapiens
acctctttttcctcctggaca

SEQ ID NO: 2354858 - DNA, 17 bp, Homo sapiens
acctgaccccattcctg

SEQ ID NO: 2354859 - DNA, 17 bp, Homo sapiens
acctgacccctgctcag

SEQ ID NO: 2354860 - DNA, 16 bp, Homo sapiens
acctgagaccctactg

SEQ ID NO: 2354861 - DNA, 18 bp, Homo sapiens
acctgagaccctactgaa

SEQ ID NO: 2354862 - DNA, 12 bp, Homo sapiens
acctgagctaaa

SEQ ID NO: 2354863 - DNA, 18 bp, Homo sapiens
acctgagctattttcctc

SEQ ID NO: 2354864 - DNA, 15 bp, Homo sapiens
acctgagtatttttt

SEQ ID NO: 2354865 - DNA, 21 bp, Homo sapiens
acctgagtcgtacagaaagct

SEQ ID NO: 2354866 - DNA, 17 bp, Homo sapiens
acctgattttttttcct

SEQ ID NO: 2354867 - DNA, 20 bp, Homo sapiens
acctgattttttttcctttt

SEQ ID NO: 2354868 - DNA, 15 bp, Homo sapiens
acctgcaagatggac

SEQ ID NO: 2354869 - DNA, 15 bp, Homo sapiens
acctgcacacaggac

SEQ ID NO: 2354870 - DNA, 19 bp, Homo sapiens
acctgcacacaggacagcg

SEQ ID NO: 2354871 - DNA, 17 bp, Homo sapiens
acctgcatctggggccc

SEQ ID NO: 2354872 - DNA, 15 bp, Homo sapiens
acctgccccagcact

SEQ ID NO: 2354873 - DNA, 16 bp, Homo sapiens
actccgcgccgatgcc

SEQ ID NO: 2354874 - DNA, 19 bp, Homo sapiens
actccgcgccgatgccacc

SEQ ID NO: 2354875 - DNA, 22 bp, Homo sapiens
actccgcgccgatgccaccggc

SEQ ID NO: 2354876 - DNA, 16 bp, Homo sapiens
actcctctgctgacct

SEQ ID NO: 2354877 - DNA, 14 bp, Homo sapiens
actcctctggcttt

SEQ ID NO: 2354878 - DNA, 21 bp, Homo sapiens
actcctctggctttcccagga

SEQ ID NO: 2354879 - DNA, 18 bp, Homo sapiens
actcctgacccctctcct

SEQ ID NO: 2354880 - DNA, 18 bp, Homo sapiens
actcctgggctcaagcaa

SEQ ID NO: 2354881 - DNA, 21 bp, Homo sapiens
actcctgtccctgtagctcag

SEQ ID NO: 2354882 - DNA, 22 bp, Homo sapiens
actcctgtccctgtagctcagt

SEQ ID NO: 2354883 - DNA, 15 bp, Homo sapiens
actccttatttggcg

SEQ ID NO: 2354884 - DNA, 14 bp, Homo sapiens
actccttcctggcc

SEQ ID NO: 2354885 - DNA, 15 bp, Homo sapiens
actcgtggctgtcaa

SEQ ID NO: 2354886 - DNA, 15 bp, Homo sapiens
actcgtgtgtttcta

SEQ ID NO: 2354887 - DNA, 21 bp, Homo sapiens
actctaatagtgcttaaaaat

SEQ ID NO: 2354888 - DNA, 21 bp, Homo sapiens
actctcaccatgatgtgaaga

SEQ ID NO: 2354889 - DNA, 19 bp, Homo sapiens
actctgcacatgtcttgta

SEQ ID NO: 2354890 - DNA, 15 bp, Homo sapiens
actctgcctttatga

SEQ ID NO: 2354891 - DNA, 16 bp, Homo sapiens
actctgcctttatgat

SEQ ID NO: 2354892 - DNA, 19 bp, Homo sapiens
actctgcctttatgatgct

SEQ ID NO: 2354893 - DNA, 16 bp, Homo sapiens
actctgcttgattttt

SEQ ID NO: 2354894 - DNA, 22 bp, Homo sapiens
actctggaatgtttttccctcc

SEQ ID NO: 2354895 - DNA, 23 bp, Homo sapiens
actctgggagtaatactttttaa

SEQ ID NO: 2354896 - DNA, 18 bp, Homo sapiens
actcttctttaagccata

SEQ ID NO: 2354897 - DNA, 15 bp, Homo sapiens
actcttttgctgtgc

SEQ ID NO: 2354898 - DNA, 15 bp, Homo sapiens
actctttttttgagt

SEQ ID NO: 2354899 - DNA, 22 bp, Homo sapiens
actctttttttgagtgacagct

SEQ ID NO: 2354900 - DNA, 18 bp, Homo sapiens
actgaaaatattgtttta

SEQ ID NO: 2354901 - DNA, 19 bp, Homo sapiens
actgaaaggttgcactcta

SEQ ID NO: 2354902 - DNA, 16 bp, Homo sapiens
actgaaagttttgtaa

SEQ ID NO: 2354903 - DNA, 23 bp, Homo sapiens
actgaaagttttgtaaaagaaat

SEQ ID NO: 2354904 - DNA, 17 bp, Homo sapiens
actgaaatgcctgcttt

SEQ ID NO: 2354905 - DNA, 20 bp, Homo sapiens
actgaaccactgcttctctt

SEQ ID NO: 2354906 - DNA, 21 bp, Homo sapiens
actgaaccactgcttctcttt

SEQ ID NO: 2354907 - DNA, 20 bp, Homo sapiens
actgaactacatgcataaac

SEQ ID NO: 2354908 - DNA, 18 bp, Homo sapiens
actgaaggaaaaacacaa

SEQ ID NO: 2354909 - DNA, 15 bp, Homo sapiens
actgaaggggtgcac

SEQ ID NO: 2354910 - DNA, 21 bp, Homo sapiens
actgaagtggctggtagaaaa

SEQ ID NO: 2354911 - DNA, 16 bp, Homo sapiens
actgaataatgctacc

SEQ ID NO: 2354912 - DNA, 18 bp, Homo sapiens
actgaatttttttgtaat

SEQ ID NO: 2354913 - DNA, 15 bp, Homo sapiens
actgacatttcttct

SEQ ID NO: 2354914 - DNA, 15 bp, Homo sapiens
actgagaatatacaa

SEQ ID NO: 2354915 - DNA, 21 bp, Homo sapiens
actgagaggacagagagaaat

SEQ ID NO: 2354916 - DNA, 21 bp, Homo sapiens
actgagcaccctctggattct

SEQ ID NO: 2354917 - DNA, 18 bp, Homo sapiens
actgagcaggctgtgggg

SEQ ID NO: 2354918 - DNA, 17 bp, Homo sapiens
actgagctcacatggga

SEQ ID NO: 2354919 - DNA, 15 bp, Homo sapiens
actgaggatattcag

SEQ ID NO: 2354920 - DNA, 16 bp, Homo sapiens
actgatatattttaca

SEQ ID NO: 2354921 - DNA, 22 bp, Homo sapiens
actgatggctcaagacaaggct

SEQ ID NO: 2354922 - DNA, 14 bp, Homo sapiens
actgatttcagtaa

SEQ ID NO: 2354923 - DNA, 17 bp, Homo sapiens
actgcaaagctttggct

SEQ ID NO: 2354924 - DNA, 13 bp, Homo sapiens
actgcactccagc

SEQ ID NO: 2354925 - DNA, 23 bp, Homo sapiens
actgcagcctcatactcctgggc

SEQ ID NO: 2354926 - DNA, 14 bp, Homo sapiens
actgcagtgtggag

SEQ ID NO: 2354927 - DNA, 12 bp, Homo sapiens
actgccagcagc

SEQ ID NO: 2354928 - DNA, 13 bp, Homo sapiens
actgccagcagca

SEQ ID NO: 2354929 - DNA, 16 bp, Homo sapiens
actgccagcagcagca

SEQ ID NO: 2354930 - DNA, 16 bp, Homo sapiens
actgccaggccagcct

SEQ ID NO: 2354931 - DNA, 19 bp, Homo sapiens
actgccaggccagcctccg

SEQ ID NO: 2354932 - DNA, 13 bp, Homo sapiens
actgccaggctgt

SEQ ID NO: 2354933 - DNA, 17 bp, Homo sapiens
actgccaggctgtttca

SEQ ID NO: 2354934 - DNA, 22 bp, Homo sapiens
actgccattttttgtctgtgat

SEQ ID NO: 2354935 - DNA, 19 bp, Homo sapiens
actgcccacatgggacctg

SEQ ID NO: 2354936 - DNA, 19 bp, Homo sapiens
actgccccacggagacaga

SEQ ID NO: 2354937 - DNA, 19 bp, Homo sapiens
actgccttgcctcctcagt

SEQ ID NO: 2354938 - DNA, 23 bp, Homo sapiens
actgcgcccttaactgcatccag

SEQ ID NO: 2354939 - DNA, 13 bp, Homo sapiens
actgctataaata

SEQ ID NO: 2354940 - DNA, 17 bp, Homo sapiens
actgctataaataggtt

SEQ ID NO: 2354941 - DNA, 18 bp, Homo sapiens
actgctcccacctcctga

SEQ ID NO: 2354942 - DNA, 16 bp, Homo sapiens
actgcttctcttttga

SEQ ID NO: 2354943 - DNA, 23 bp, Homo sapiens
actgcttgaactaggctgagcaa

SEQ ID NO: 2354944 - DNA, 23 bp, Homo sapiens
actgcttgattttaatacattga

SEQ ID NO: 2354945 - DNA, 20 bp, Homo sapiens
actggaaaggggagagcctg

SEQ ID NO: 2354946 - DNA, 16 bp, Homo sapiens
actggaggttgaagcc

SEQ ID NO: 2354947 - DNA, 19 bp, Homo sapiens
actggaggttgaagccaag

SEQ ID NO: 2354948 - DNA, 21 bp, Homo sapiens
actggcatggatatagtttta

SEQ ID NO: 2354949 - DNA, 23 bp, Homo sapiens
actggcatggatatagttttact

SEQ ID NO: 2354950 - DNA, 16 bp, Homo sapiens
actggccatggcctgc

SEQ ID NO: 2354951 - DNA, 21 bp, Homo sapiens
actggctcatgcctcagcccg

SEQ ID NO: 2354952 - DNA, 17 bp, Homo sapiens
actgggaacccctttcc

SEQ ID NO: 2354953 - DNA, 12 bp, Homo sapiens
actgggaagaag

SEQ ID NO: 2354954 - DNA, 12 bp, Homo sapiens
actgggaggctc

SEQ ID NO: 2354955 - DNA, 15 bp, Homo sapiens
actgggccccacatg

SEQ ID NO: 2354956 - DNA, 19 bp, Homo sapiens
actgggccccacatggctt

SEQ ID NO: 2354957 - DNA, 15 bp, Homo sapiens
actggggaaactggc

SEQ ID NO: 2354958 - DNA, 15 bp, Homo sapiens
actggggttgagggc

SEQ ID NO: 2354959 - DNA, 22 bp, Homo sapiens
actggtccaaaagattgctgaa

SEQ ID NO: 2354960 - DNA, 12 bp, Homo sapiens
actggtctctct

SEQ ID NO: 2354961 - DNA, 15 bp, Homo sapiens
actggtgaatataaa

SEQ ID NO: 2354962 - DNA, 15 bp, Homo sapiens
actggttttctgcca

SEQ ID NO: 2354963 - DNA, 22 bp, Homo sapiens
actgtaacttccaaataaataa

SEQ ID NO: 2354964 - DNA, 18 bp, Homo sapiens
actgtaatacttctttgt

SEQ ID NO: 2354965 - DNA, 20 bp, Homo sapiens
actgtagatatgtattcttt

SEQ ID NO: 2354966 - DNA, 14 bp, Homo sapiens
actgtagccacagc

SEQ ID NO: 2354967 - DNA, 15 bp, Homo sapiens
actgtagctttggaa

SEQ ID NO: 2354968 - DNA, 19 bp, Homo sapiens
actgtagcttttaggaata

SEQ ID NO: 2354969 - DNA, 18 bp, Homo sapiens
actgtagtttagttctgt

SEQ ID NO: 2354970 - DNA, 21 bp, Homo sapiens
actgtagtttagttctgttga

SEQ ID NO: 2354971 - DNA, 15 bp, Homo sapiens
actgtataaatagga

SEQ ID NO: 2354972 - DNA, 17 bp, Homo sapiens
actgtataaataggaga

SEQ ID NO: 2354973 - DNA, 13 bp, Homo sapiens
actgtatattttg

SEQ ID NO: 2354974 - DNA, 23 bp, Homo sapiens
actgtatattttgtagttaatat

SEQ ID NO: 2354975 - DNA, 15 bp, Homo sapiens
actgtatcattttct

SEQ ID NO: 2354976 - DNA, 22 bp, Homo sapiens
actgtatttcggctatgtctca

SEQ ID NO: 2354977 - DNA, 22 bp, Homo sapiens
actgtcacggggttccctccta

SEQ ID NO: 2354978 - DNA, 23 bp, Homo sapiens
actgtcagtgctagatttagcac

SEQ ID NO: 2354979 - DNA, 18 bp, Homo sapiens
actgtcagttctctggga

SEQ ID NO: 2354980 - DNA, 14 bp, Homo sapiens
actgtcctttcctt

SEQ ID NO: 2354981 - DNA, 20 bp, Homo sapiens
actgtctctcttctcagagt

SEQ ID NO: 2354982 - DNA, 12 bp, Homo sapiens
actgtctttcag

SEQ ID NO: 2354983 - DNA, 17 bp, Homo sapiens
actgtgagaacccagtt

SEQ ID NO: 2354984 - DNA, 18 bp, Homo sapiens
actgtggaggaaggattg

SEQ ID NO: 2354985 - DNA, 23 bp, Homo sapiens
actgtggaggaaggattgtaaaa

SEQ ID NO: 2354986 - DNA, 17 bp, Homo sapiens
actgtggccagtaaaat

SEQ ID NO: 2354987 - DNA, 23 bp, Homo sapiens
agaaatggcgtctgctctggtgg

SEQ ID NO: 2354988 - DNA, 19 bp, Homo sapiens
agaaatgtcatgattgccg

SEQ ID NO: 2354989 - DNA, 22 bp, Homo sapiens
agaaatgttgagtctgtactaa

SEQ ID NO: 2354990 - DNA, 23 bp, Homo sapiens
agaaattccatacttctctcaga

SEQ ID NO: 2354991 - DNA, 17 bp, Homo sapiens
agaaattttgtaagaag

SEQ ID NO: 2354992 - DNA, 16 bp, Homo sapiens
agaacacgttgccagg

SEQ ID NO: 2354993 - DNA, 14 bp, Homo sapiens
agaacagcttcagg

SEQ ID NO: 2354994 - DNA, 16 bp, Homo sapiens
agaacagcttcaggtt

SEQ ID NO: 2354995 - DNA, 16 bp, Homo sapiens
agaacatgtaaaatgt

SEQ ID NO: 2354996 - DNA, 16 bp, Homo sapiens
agaaccacacttgaaa

SEQ ID NO: 2354997 - DNA, 19 bp, Homo sapiens
agaaccacacttgaaacct

SEQ ID NO: 2354998 - DNA, 21 bp, Homo sapiens
agaaccacacttgaaaccttt

SEQ ID NO: 2354999 - DNA, 13 bp, Homo sapiens
agaacccaagtgc

SEQ ID NO: 2355000 - DNA, 15 bp, Homo sapiens
agaacccaagtgcct

SEQ ID NO: 2355001 - DNA, 17 bp, Homo sapiens
agaacccaagtgcctca

SEQ ID NO: 2355002 - DNA, 21 bp, Homo sapiens
agaacccagtgtttccacact

SEQ ID NO: 2355003 - DNA, 22 bp, Homo sapiens
agaacctatagcatcttctcat

SEQ ID NO: 2355004 - DNA, 22 bp, Homo sapiens
agaacctgagctattttcctct

SEQ ID NO: 2355005 - DNA, 23 bp, Homo sapiens
agaacctgagctattttcctctg

SEQ ID NO: 2355006 - DNA, 15 bp, Homo sapiens
agaaccttgtcccag

SEQ ID NO: 2355007 - DNA, 20 bp, Homo sapiens
agaaccttgtcccagccagt

SEQ ID NO: 2355008 - DNA, 23 bp, Homo sapiens
agaactattgtgctcagagacac

SEQ ID NO: 2355009 - DNA, 17 bp, Homo sapiens
agaactccaggccctcc

SEQ ID NO: 2355010 - DNA, 16 bp, Homo sapiens
agaactctctggaagc

SEQ ID NO: 2355011 - DNA, 12 bp, Homo sapiens
agaagaaagatg

SEQ ID NO: 2355012 - DNA, 16 bp, Homo sapiens
agaagaagttcatgtc

SEQ ID NO: 2355013 - DNA, 18 bp, Homo sapiens
agaagaatggctttcaat

SEQ ID NO: 2355014 - DNA, 19 bp, Homo sapiens
agaagacatactgcttgat

SEQ ID NO: 2355015 - DNA, 15 bp, Homo sapiens
agaagacatgaacca

SEQ ID NO: 2355016 - DNA, 15 bp, Homo sapiens
agaagactttaatta

SEQ ID NO: 2355017 - DNA, 15 bp, Homo sapiens
agaagatagttgtaa

SEQ ID NO: 2355018 - DNA, 19 bp, Homo sapiens
agaagcacagaatattttt

SEQ ID NO: 2355019 - DNA, 15 bp, Homo sapiens
agaagcattccttct

SEQ ID NO: 2355020 - DNA, 17 bp, Homo sapiens
agaagcattccttcttt

SEQ ID NO: 2355021 - DNA, 15 bp, Homo sapiens
agaagccaagggaaa

SEQ ID NO: 2355022 - DNA, 18 bp, Homo sapiens
agaagccaagggaaaggg

SEQ ID NO: 2355023 - DNA, 23 bp, Homo sapiens
agaagccatatatgaccagaagc

SEQ ID NO: 2355024 - DNA, 23 bp, Homo sapiens
agaagcctccaagcacagagcct

SEQ ID NO: 2355025 - DNA, 12 bp, Homo sapiens
agaagccttcag

SEQ ID NO: 2355026 - DNA, 14 bp, Homo sapiens
agaagccttcagct

SEQ ID NO: 2355027 - DNA, 18 bp, Homo sapiens
agaagccttcagctccag

SEQ ID NO: 2355028 - DNA, 19 bp, Homo sapiens
agaagccttcagctccagg

SEQ ID NO: 2355029 - DNA, 19 bp, Homo sapiens
agaagctctgaagaactct

SEQ ID NO: 2355030 - DNA, 11 bp, Homo sapiens
agaagctgcag

SEQ ID NO: 2355031 - DNA, 13 bp, Homo sapiens
agaagctgcaggc

SEQ ID NO: 2355032 - DNA, 15 bp, Homo sapiens
agaagctgcaggctt

SEQ ID NO: 2355033 - DNA, 19 bp, Homo sapiens
agaagctgttgtacattta

SEQ ID NO: 2355034 - DNA, 22 bp, Homo sapiens
agaagctgttgtacatttatga

SEQ ID NO: 2355035 - DNA, 17 bp, Homo sapiens
agaaggaaggcctgagc

SEQ ID NO: 2355036 - DNA, 13 bp, Homo sapiens
agaaggcaatatt

SEQ ID NO: 2355037 - DNA, 14 bp, Homo sapiens
agaaggcaatatta

SEQ ID NO: 2355038 - DNA, 16 bp, Homo sapiens
agaagggggtctctgt

SEQ ID NO: 2355039 - DNA, 18 bp, Homo sapiens
agaagggggtctctgtta

SEQ ID NO: 2355040 - DNA, 19 bp, Homo sapiens
agaagggggtctctgttaa

SEQ ID NO: 2355041 - DNA, 14 bp, Homo sapiens
agaagtaggaggaa

SEQ ID NO: 2355042 - DNA, 15 bp, Homo sapiens
agaagtaggaggaaa

SEQ ID NO: 2355043 - DNA, 22 bp, Homo sapiens
agaagtccaagcaacagccttt

SEQ ID NO: 2355044 - DNA, 22 bp, Homo sapiens
agaagtcttgaagttgggtgtt

SEQ ID NO: 2355045 - DNA, 18 bp, Homo sapiens
agaagtgagcagtgttgg

SEQ ID NO: 2355046 - DNA, 14 bp, Homo sapiens
agaagtggctgcca

SEQ ID NO: 2355047 - DNA, 23 bp, Homo sapiens
agaagttattttctacagtggtt

SEQ ID NO: 2355048 - DNA, 17 bp, Homo sapiens
agaagttcatgtccaaa

SEQ ID NO: 2355049 - DNA, 15 bp, Homo sapiens
agaataaaattccta

SEQ ID NO: 2355050 - DNA, 18 bp, Homo sapiens
agaataaaattcctatct

SEQ ID NO: 2355051 - DNA, 17 bp, Homo sapiens
agaataatcacgctttc

SEQ ID NO: 2355052 - DNA, 20 bp, Homo sapiens
agaataatcacgctttcctg

SEQ ID NO: 2355053 - DNA, 13 bp, Homo sapiens
agaatagactgga

SEQ ID NO: 2355054 - DNA, 17 bp, Homo sapiens
agaatatccatgaccta

SEQ ID NO: 2355055 - DNA, 21 bp, Homo sapiens
agaatatttactaactaaata

SEQ ID NO: 2355056 - DNA, 21 bp, Homo sapiens
agaatatttttatatttcctt

SEQ ID NO: 2355057 - DNA, 16 bp, Homo sapiens
agaatcagaagatagt

SEQ ID NO: 2355058 - DNA, 13 bp, Homo sapiens
agaatcttctggg

SEQ ID NO: 2355059 - DNA, 21 bp, Homo sapiens
agaatgactatataatttatt

SEQ ID NO: 2355060 - DNA, 22 bp, Homo sapiens
agaatgagtccttgatttcaaa

SEQ ID NO: 2355061 - DNA, 20 bp, Homo sapiens
agaatgatcaaggatctgga

SEQ ID NO: 2355062 - DNA, 17 bp, Homo sapiens
agaatgccatttctcac

SEQ ID NO: 2355063 - DNA, 12 bp, Homo sapiens
agaatgctcagg

SEQ ID NO: 2355064 - DNA, 16 bp, Homo sapiens
agaatggctttcaata

SEQ ID NO: 2355065 - DNA, 22 bp, Homo sapiens
agaatggctttcaatacccttt

SEQ ID NO: 2355066 - DNA, 23 bp, Homo sapiens
agaatggctttcaataccctttt

SEQ ID NO: 2355067 - DNA, 15 bp, Homo sapiens
agaatgttgtattca

SEQ ID NO: 2355068 - DNA, 16 bp, Homo sapiens
agaattggtaaaaaca

SEQ ID NO: 2355069 - DNA, 14 bp, Homo sapiens
agacaaaaagtata

SEQ ID NO: 2355070 - DNA, 23 bp, Homo sapiens
agacaaaatttgagaatacataa

SEQ ID NO: 2355071 - DNA, 20 bp, Homo sapiens
agacaaagccttaagcaaat

SEQ ID NO: 2355072 - DNA, 18 bp, Homo sapiens
agacaaatctcagaacct

SEQ ID NO: 2355073 - DNA, 18 bp, Homo sapiens
agacaaatggaggaatat

SEQ ID NO: 2355074 - DNA, 19 bp, Homo sapiens
agacaacaggtaaaacagg

SEQ ID NO: 2355075 - DNA, 16 bp, Homo sapiens
agacaacctttctgta

SEQ ID NO: 2355076 - DNA, 22 bp, Homo sapiens
agacaagtaatttcagtgtaaa

SEQ ID NO: 2355077 - DNA, 15 bp, Homo sapiens
agacaatgttttctt

SEQ ID NO: 2355078 - DNA, 17 bp, Homo sapiens
agacacattttttagga

SEQ ID NO: 2355079 - DNA, 20 bp, Homo sapiens
agacactaacgaaatatcaa

SEQ ID NO: 2355080 - DNA, 18 bp, Homo sapiens
agacactgttgataaaaa

SEQ ID NO: 2355081 - DNA, 19 bp, Homo sapiens
agacactgttgataaaaac

SEQ ID NO: 2355082 - DNA, 20 bp, Homo sapiens
agacagaggaaagggctggc

SEQ ID NO: 2355083 - DNA, 22 bp, Homo sapiens
agacagcccaggatactggcac

SEQ ID NO: 2355084 - DNA, 22 bp, Homo sapiens
agacaggggagttgtcaacttg

SEQ ID NO: 2355085 - DNA, 16 bp, Homo sapiens
agacagggtcttgctc

SEQ ID NO: 2355086 - DNA, 22 bp, Homo sapiens
agacagggtgggcttcctgccc

SEQ ID NO: 2355087 - DNA, 14 bp, Homo sapiens
agacagtgaatttg

SEQ ID NO: 2355088 - DNA, 14 bp, Homo sapiens
agacagtttcttag

SEQ ID NO: 2355089 - DNA, 18 bp, Homo sapiens
agacagtttcttagcttt

SEQ ID NO: 2355090 - DNA, 15 bp, Homo sapiens
agacataaaggaaaa

SEQ ID NO: 2355091 - DNA, 16 bp, Homo sapiens
agacataaaggaaaag

SEQ ID NO: 2355092 - DNA, 22 bp, Homo sapiens
agacatccaaatttttttttaa

SEQ ID NO: 2355093 - DNA, 15 bp, Homo sapiens
agacatggacctcca

SEQ ID NO: 2355094 - DNA, 17 bp, Homo sapiens
agacatggacctccagg

SEQ ID NO: 2355095 - DNA, 19 bp, Homo sapiens
agacattctcacataagcc

SEQ ID NO: 2355096 - DNA, 20 bp, Homo sapiens
agacattttaaaaaatggtc

SEQ ID NO: 2355097 - DNA, 14 bp, Homo sapiens
agacattttaagtt

SEQ ID NO: 2355098 - DNA, 21 bp, Homo sapiens
agaccacagggttcaaaatgt

SEQ ID NO: 2355099 - DNA, 12 bp, Homo sapiens
agaccactgtct

SEQ ID NO: 2355100 - DNA, 23 bp, Homo sapiens
agaccactgtctccacccacctt

SEQ ID NO: 2355101 - DNA, 19 bp, Homo sapiens
agaggcttgtttacctttc

SEQ ID NO: 2355102 - DNA, 21 bp, Homo sapiens
agagggaaggggcctacaccc

SEQ ID NO: 2355103 - DNA, 14 bp, Homo sapiens
agagggagaatcca

SEQ ID NO: 2355104 - DNA, 22 bp, Homo sapiens
agagggaggtcactggaaaggg

SEQ ID NO: 2355105 - DNA, 19 bp, Homo sapiens
agagggatttccctgcaga

SEQ ID NO: 2355106 - DNA, 12 bp, Homo sapiens
agagggcttcct

SEQ ID NO: 2355107 - DNA, 19 bp, Homo sapiens
agaggtagcgagctgctct

SEQ ID NO: 2355108 - DNA, 20 bp, Homo sapiens
agaggtagcgagctgctctg

SEQ ID NO: 2355109 - DNA, 16 bp, Homo sapiens
agaggtattaaaacta

SEQ ID NO: 2355110 - DNA, 17 bp, Homo sapiens
agaggtattaaaactaa

SEQ ID NO: 2355111 - DNA, 15 bp, Homo sapiens
agaggtcagcacaca

SEQ ID NO: 2355112 - DNA, 12 bp, Homo sapiens
agaggtggatgt

SEQ ID NO: 2355113 - DNA, 14 bp, Homo sapiens
agaggtggatgtta

SEQ ID NO: 2355114 - DNA, 20 bp, Homo sapiens
agaggtggatgttatgaaca

SEQ ID NO: 2355115 - DNA, 23 bp, Homo sapiens
agaggtggatgttatgaacagct

SEQ ID NO: 2355116 - DNA, 12 bp, Homo sapiens
agagtatttccc

SEQ ID NO: 2355117 - DNA, 22 bp, Homo sapiens
agagtcaactacacaaagcagg

SEQ ID NO: 2355118 - DNA, 16 bp, Homo sapiens
agagtcaccttttctg

SEQ ID NO: 2355119 - DNA, 18 bp, Homo sapiens
agagtcagctctctgccc

SEQ ID NO: 2355120 - DNA, 19 bp, Homo sapiens
agagtcagctctctgccct

SEQ ID NO: 2355121 - DNA, 16 bp, Homo sapiens
agagtccagtgctctg

SEQ ID NO: 2355122 - DNA, 17 bp, Homo sapiens
agagtccagtgctctgc

SEQ ID NO: 2355123 - DNA, 20 bp, Homo sapiens
agagtccagtgctctgcctc

SEQ ID NO: 2355124 - DNA, 13 bp, Homo sapiens
agagtctgggacc

SEQ ID NO: 2355125 - DNA, 18 bp, Homo sapiens
agagtctggtgaagctca

SEQ ID NO: 2355126 - DNA, 14 bp, Homo sapiens
agagtgaagggaag

SEQ ID NO: 2355127 - DNA, 13 bp, Homo sapiens
agagtggtggggg

SEQ ID NO: 2355128 - DNA, 13 bp, Homo sapiens
agagtgtagaagc

SEQ ID NO: 2355129 - DNA, 15 bp, Homo sapiens
agagtgtagaagcat

SEQ ID NO: 2355130 - DNA, 16 bp, Homo sapiens
agagtgtagaagcatt

SEQ ID NO: 2355131 - DNA, 13 bp, Homo sapiens
agagttaagaagc

SEQ ID NO: 2355132 - DNA, 20 bp, Homo sapiens
agagttaagaagctgttgta

SEQ ID NO: 2355133 - DNA, 18 bp, Homo sapiens
agataactctctttcctt

SEQ ID NO: 2355134 - DNA, 14 bp, Homo sapiens
agataatattgttt

SEQ ID NO: 2355135 - DNA, 17 bp, Homo sapiens
agataatattgtttggt

SEQ ID NO: 2355136 - DNA, 14 bp, Homo sapiens
agataatatttttg

SEQ ID NO: 2355137 - DNA, 21 bp, Homo sapiens
agataattgtttcattcatcc

SEQ ID NO: 2355138 - DNA, 22 bp, Homo sapiens
agataccttatcttacaatatt

SEQ ID NO: 2355139 - DNA, 23 bp, Homo sapiens
agatagaaaacagcccccactcc

SEQ ID NO: 2355140 - DNA, 21 bp, Homo sapiens
agatagtcttggaagctgttt

SEQ ID NO: 2355141 - DNA, 19 bp, Homo sapiens
agatagtgtaacttgctta

SEQ ID NO: 2355142 - DNA, 20 bp, Homo sapiens
agatatcctctccccctcct

SEQ ID NO: 2355143 - DNA, 15 bp, Homo sapiens
agatatctcaatgaa

SEQ ID NO: 2355144 - DNA, 20 bp, Homo sapiens
agatattgtatctcctttaa

SEQ ID NO: 2355145 - DNA, 21 bp, Homo sapiens
agatattgtgaagtacatatt

SEQ ID NO: 2355146 - DNA, 17 bp, Homo sapiens
agatatttttatcttta

SEQ ID NO: 2355147 - DNA, 19 bp, Homo sapiens
agatatttttatctttata

SEQ ID NO: 2355148 - DNA, 14 bp, Homo sapiens
agatcactgtagtt

SEQ ID NO: 2355149 - DNA, 22 bp, Homo sapiens
agatcactgtagtttagttctg

SEQ ID NO: 2355150 - DNA, 18 bp, Homo sapiens
agatcactttctcagttt

SEQ ID NO: 2355151 - DNA, 21 bp, Homo sapiens
agatcatccagaagttcctca

SEQ ID NO: 2355152 - DNA, 19 bp, Homo sapiens
agatccatttccattgctt

SEQ ID NO: 2355153 - DNA, 16 bp, Homo sapiens
agatcgagaccatcct

SEQ ID NO: 2355154 - DNA, 19 bp, Homo sapiens
agatcgtgctactgcactc

SEQ ID NO: 2355155 - DNA, 12 bp, Homo sapiens
agatctttcaga

SEQ ID NO: 2355156 - DNA, 16 bp, Homo sapiens
agatctttcagaaata

SEQ ID NO: 2355157 - DNA, 12 bp, Homo sapiens
agatctttctct

SEQ ID NO: 2355158 - DNA, 18 bp, Homo sapiens
agatctttttttaagtgt

SEQ ID NO: 2355159 - DNA, 18 bp, Homo sapiens
agatgaatggtctggcaa

SEQ ID NO: 2355160 - DNA, 13 bp, Homo sapiens
agatgagcccacc

SEQ ID NO: 2355161 - DNA, 18 bp, Homo sapiens
agatgaggagtaaaattc

SEQ ID NO: 2355162 - DNA, 20 bp, Homo sapiens
agatgatttcagttctagga

SEQ ID NO: 2355163 - DNA, 18 bp, Homo sapiens
agatgcagagagccattt

SEQ ID NO: 2355164 - DNA, 20 bp, Homo sapiens
agatgcagagagccattttg

SEQ ID NO: 2355165 - DNA, 23 bp, Homo sapiens
agatgccctgttggtttcacaga

SEQ ID NO: 2355166 - DNA, 18 bp, Homo sapiens
agatgctgttgtgaagct

SEQ ID NO: 2355167 - DNA, 21 bp, Homo sapiens
agatggctgtggcatttccaa

SEQ ID NO: 2355168 - DNA, 17 bp, Homo sapiens
agatgggggcagggctg

SEQ ID NO: 2355169 - DNA, 16 bp, Homo sapiens
agatgggtccaggggt

SEQ ID NO: 2355170 - DNA, 23 bp, Homo sapiens
agatgggtccaggggtctgtctg

SEQ ID NO: 2355171 - DNA, 21 bp, Homo sapiens
agatggtgtgggtgtcctgcc

SEQ ID NO: 2355172 - DNA, 22 bp, Homo sapiens
agatggtgtgggtgtcctgcct

SEQ ID NO: 2355173 - DNA, 18 bp, Homo sapiens
agatggttaaacattttc

SEQ ID NO: 2355174 - DNA, 18 bp, Homo sapiens
agatgtcttccctgggct

SEQ ID NO: 2355175 - DNA, 11 bp, Homo sapiens
agatgtgaatt

SEQ ID NO: 2355176 - DNA, 16 bp, Homo sapiens
agatgtgaattattga

SEQ ID NO: 2355177 - DNA, 23 bp, Homo sapiens
agatgtgagccaccgtgcctggc

SEQ ID NO: 2355178 - DNA, 18 bp, Homo sapiens
agatgtgagccttgtgca

SEQ ID NO: 2355179 - DNA, 16 bp, Homo sapiens
agatgtggctactgac

SEQ ID NO: 2355180 - DNA, 15 bp, Homo sapiens
agatgtgttcttatt

SEQ ID NO: 2355181 - DNA, 14 bp, Homo sapiens
agatgttcccccat

SEQ ID NO: 2355182 - DNA, 21 bp, Homo sapiens
agatgtttcattttactgtat

SEQ ID NO: 2355183 - DNA, 14 bp, Homo sapiens
agatgtttgcctca

SEQ ID NO: 2355184 - DNA, 16 bp, Homo sapiens
agattactttgtcccg

SEQ ID NO: 2355185 - DNA, 15 bp, Homo sapiens
agattattttttaaa

SEQ ID NO: 2355186 - DNA, 17 bp, Homo sapiens
agattctaaagctcaat

SEQ ID NO: 2355187 - DNA, 19 bp, Homo sapiens
agattctgcctctctggaa

SEQ ID NO: 2355188 - DNA, 23 bp, Homo sapiens
agattgacctggatggggcaggc

SEQ ID NO: 2355189 - DNA, 13 bp, Homo sapiens
agattgctgaaat

SEQ ID NO: 2355190 - DNA, 14 bp, Homo sapiens
agattgctgaaatt

SEQ ID NO: 2355191 - DNA, 14 bp, Homo sapiens
agatttccacagag

SEQ ID NO: 2355192 - DNA, 13 bp, Homo sapiens
agattttagaatt

SEQ ID NO: 2355193 - DNA, 14 bp, Homo sapiens
agattttatgttta

SEQ ID NO: 2355194 - DNA, 19 bp, Homo sapiens
agattttatgtttaaaatg

SEQ ID NO: 2355195 - DNA, 12 bp, Homo sapiens
agatttttcaaa

SEQ ID NO: 2355196 - DNA, 13 bp, Homo sapiens
agatttttctcaa

SEQ ID NO: 2355197 - DNA, 14 bp, Homo sapiens
agcaaaatctaaaa

SEQ ID NO: 2355198 - DNA, 13 bp, Homo sapiens
agcaaacccagag

SEQ ID NO: 2355199 - DNA, 18 bp, Homo sapiens
agcaaacccagaggtgga

SEQ ID NO: 2355200 - DNA, 19 bp, Homo sapiens
agcaaacccagaggtggat

SEQ ID NO: 2355201 - DNA, 23 bp, Homo sapiens
agcaaactaaccagcattcccta

SEQ ID NO: 2355202 - DNA, 21 bp, Homo sapiens
agcaacaatttatgaattgaa

SEQ ID NO: 2355203 - DNA, 19 bp, Homo sapiens
agcaacagcctttgaatgt

SEQ ID NO: 2355204 - DNA, 16 bp, Homo sapiens
agcaaccacatttaga

SEQ ID NO: 2355205 - DNA, 22 bp, Homo sapiens
agcaaccacatttagaaatgtt

SEQ ID NO: 2355206 - DNA, 21 bp, Homo sapiens
agcaactctccactccatatt

SEQ ID NO: 2355207 - DNA, 16 bp, Homo sapiens
agcaacttcttctcca

SEQ ID NO: 2355208 - DNA, 21 bp, Homo sapiens
agcaacttcttctccatccct

SEQ ID NO: 2355209 - DNA, 15 bp, Homo sapiens
agcaagagagatgtt

SEQ ID NO: 2355210 - DNA, 11 bp, Homo sapiens
agcaagccaga

SEQ ID NO: 2355211 - DNA, 15 bp, Homo sapiens
agcaatcctcctgcc

SEQ ID NO: 2355212 - DNA, 18 bp, Homo sapiens
agcaatcctcctgcctca

SEQ ID NO: 2355213 - DNA, 11 bp, Homo sapiens
agcacaaaatt

SEQ ID NO: 2355214 - DNA, 20 bp, Homo sapiens
agcacaaaattcaaagcatg

SEQ ID NO: 2355215 - DNA, 22 bp, Homo sapiens
agcacaaaattcaaagcatgga

SEQ ID NO: 2355216 - DNA, 18 bp, Homo sapiens
agcccagattcccctgtg

SEQ ID NO: 2355217 - DNA, 16 bp, Homo sapiens
agcccagcagtgtgga

SEQ ID NO: 2355218 - DNA, 19 bp, Homo sapiens
agcccagcccctactgctg

SEQ ID NO: 2355219 - DNA, 18 bp, Homo sapiens
agccccactgccagcagc

SEQ ID NO: 2355220 - DNA, 19 bp, Homo sapiens
agccccagcccagccccac

SEQ ID NO: 2355221 - DNA, 17 bp, Homo sapiens
agcccccaccctgttcc

SEQ ID NO: 2355222 - DNA, 14 bp, Homo sapiens
agccccctcttcct

SEQ ID NO: 2355223 - DNA, 15 bp, Homo sapiens
agccccctcttcctc

SEQ ID NO: 2355224 - DNA, 16 bp, Homo sapiens
agccccctcttcctcc

SEQ ID NO: 2355225 - DNA, 20 bp, Homo sapiens
agccccgcgaccatgtggcc

SEQ ID NO: 2355226 - DNA, 16 bp, Homo sapiens
agccccggcaagccac

SEQ ID NO: 2355227 - DNA, 17 bp, Homo sapiens
agccccggtggctgggc

SEQ ID NO: 2355228 - DNA, 15 bp, Homo sapiens
agcccctactgctgt

SEQ ID NO: 2355229 - DNA, 23 bp, Homo sapiens
agcccctatagcactgagctcac

SEQ ID NO: 2355230 - DNA, 13 bp, Homo sapiens
agcccctcttccc

SEQ ID NO: 2355231 - DNA, 16 bp, Homo sapiens
agcccctgggcccagt

SEQ ID NO: 2355232 - DNA, 12 bp, Homo sapiens
agcccctggggc

SEQ ID NO: 2355233 - DNA, 17 bp, Homo sapiens
agcccctggggcccagc

SEQ ID NO: 2355234 - DNA, 18 bp, Homo sapiens
agcccctggggcccagcc

SEQ ID NO: 2355235 - DNA, 20 bp, Homo sapiens
agcccctggggcccagcccc

SEQ ID NO: 2355236 - DNA, 22 bp, Homo sapiens
agcccctttgcctgtcaagttg

SEQ ID NO: 2355237 - DNA, 17 bp, Homo sapiens
agccctactccctgcag

SEQ ID NO: 2355238 - DNA, 23 bp, Homo sapiens
agccctcagttccttcatttcca

SEQ ID NO: 2355239 - DNA, 12 bp, Homo sapiens
agccctggctgt

SEQ ID NO: 2355240 - DNA, 14 bp, Homo sapiens
agcccttccctgag

SEQ ID NO: 2355241 - DNA, 16 bp, Homo sapiens
agcccttgcctcccca

SEQ ID NO: 2355242 - DNA, 23 bp, Homo sapiens
agcccttgcctccccatttccca

SEQ ID NO: 2355243 - DNA, 20 bp, Homo sapiens
agccgcggggaagctggctt

SEQ ID NO: 2355244 - DNA, 17 bp, Homo sapiens
agccgggcccctgggct

SEQ ID NO: 2355245 - DNA, 22 bp, Homo sapiens
agccgggggctggccttctcct

SEQ ID NO: 2355246 - DNA, 21 bp, Homo sapiens
agcctaaaacgaatggtcttt

SEQ ID NO: 2355247 - DNA, 12 bp, Homo sapiens
agcctaagggat

SEQ ID NO: 2355248 - DNA, 21 bp, Homo sapiens
agcctaagggatcctgcctgc

SEQ ID NO: 2355249 - DNA, 20 bp, Homo sapiens
agcctagacaacctttctgt

SEQ ID NO: 2355250 - DNA, 18 bp, Homo sapiens
agcctcagaaagggattg

SEQ ID NO: 2355251 - DNA, 16 bp, Homo sapiens
agcctcatactcctgg

SEQ ID NO: 2355252 - DNA, 19 bp, Homo sapiens
agcctcatactcctgggct

SEQ ID NO: 2355253 - DNA, 18 bp, Homo sapiens
agcctcatcccaggcagt

SEQ ID NO: 2355254 - DNA, 23 bp, Homo sapiens
agcctcatgggaagtcctggcac

SEQ ID NO: 2355255 - DNA, 22 bp, Homo sapiens
agcctccaagcacagagcctgg

SEQ ID NO: 2355256 - DNA, 12 bp, Homo sapiens
agcctccacagc

SEQ ID NO: 2355257 - DNA, 15 bp, Homo sapiens
agcctccacagcgag

SEQ ID NO: 2355258 - DNA, 23 bp, Homo sapiens
agcctccacagcgagggcagctg

SEQ ID NO: 2355259 - DNA, 17 bp, Homo sapiens
agcctccgagagggaga

SEQ ID NO: 2355260 - DNA, 18 bp, Homo sapiens
agcctccgagagggagag

SEQ ID NO: 2355261 - DNA, 19 bp, Homo sapiens
agcctcctctggacggcag

SEQ ID NO: 2355262 - DNA, 12 bp, Homo sapiens
agcctctctctc

SEQ ID NO: 2355263 - DNA, 16 bp, Homo sapiens
agcctctctctccctc

SEQ ID NO: 2355264 - DNA, 20 bp, Homo sapiens
agcctctctctccctccctc

SEQ ID NO: 2355265 - DNA, 17 bp, Homo sapiens
agcctctggacagccag

SEQ ID NO: 2355266 - DNA, 19 bp, Homo sapiens
agcctctggacagccagtg

SEQ ID NO: 2355267 - DNA, 23 bp, Homo sapiens
agcctctggacagccagtgacct

SEQ ID NO: 2355268 - DNA, 19 bp, Homo sapiens
agcctgccgccgtctctgt

SEQ ID NO: 2355269 - DNA, 23 bp, Homo sapiens
agcctggccaccagccatcctcc

SEQ ID NO: 2355270 - DNA, 12 bp, Homo sapiens
agcctggcccca

SEQ ID NO: 2355271 - DNA, 18 bp, Homo sapiens
agcctggccccaggcccc

SEQ ID NO: 2355272 - DNA, 22 bp, Homo sapiens
agcctggccccaggccccagac

SEQ ID NO: 2355273 - DNA, 17 bp, Homo sapiens
agcctggggctgaggct

SEQ ID NO: 2355274 - DNA, 11 bp, Homo sapiens
agcctgtcacc

SEQ ID NO: 2355275 - DNA, 13 bp, Homo sapiens
agcctgtcctggt

SEQ ID NO: 2355276 - DNA, 14 bp, Homo sapiens
agcctgtcctggta

SEQ ID NO: 2355277 - DNA, 22 bp, Homo sapiens
agcctgtcctggtacagcaggg

SEQ ID NO: 2355278 - DNA, 23 bp, Homo sapiens
agcctgtcctggtacagcagggt

SEQ ID NO: 2355279 - DNA, 15 bp, Homo sapiens
agcctgttgctgaag

SEQ ID NO: 2355280 - DNA, 14 bp, Homo sapiens
agccttaagcaaat

SEQ ID NO: 2355281 - DNA, 20 bp, Homo sapiens
agccttagctctcccaactc

SEQ ID NO: 2355282 - DNA, 22 bp, Homo sapiens
agccttcaaaactatagcttgc

SEQ ID NO: 2355283 - DNA, 18 bp, Homo sapiens
agccttctcagaagcaca

SEQ ID NO: 2355284 - DNA, 24 bp, Homo sapiens
agccttctccatatctccatggcc

SEQ ID NO: 2355285 - DNA, 16 bp, Homo sapiens
agccttctccctagct

SEQ ID NO: 2355286 - DNA, 17 bp, Homo sapiens
agccttgagccctggct

SEQ ID NO: 2355287 - DNA, 19 bp, Homo sapiens
agccttgagccctggctgt

SEQ ID NO: 2355288 - DNA, 20 bp, Homo sapiens
agccttggaaccagccccat

SEQ ID NO: 2355289 - DNA, 23 bp, Homo sapiens
agccttggaaccagccccatcag

SEQ ID NO: 2355290 - DNA, 16 bp, Homo sapiens
agcctttacctgtgaa

SEQ ID NO: 2355291 - DNA, 19 bp, Homo sapiens
agcctttgaatgtaaccaa

SEQ ID NO: 2355292 - DNA, 15 bp, Homo sapiens
agcgaaggaacctct

SEQ ID NO: 2355293 - DNA, 18 bp, Homo sapiens
agcgagctgctctgctat

SEQ ID NO: 2355294 - DNA, 17 bp, Homo sapiens
agcgagggcagctgcta

SEQ ID NO: 2355295 - DNA, 18 bp, Homo sapiens
agcgatctctcctggcct

SEQ ID NO: 2355296 - DNA, 17 bp, Homo sapiens
agcgccaggaagccaga

SEQ ID NO: 2355297 - DNA, 21 bp, Homo sapiens
agcgccaggaagccagagccc

SEQ ID NO: 2355298 - DNA, 20 bp, Homo sapiens
agcggcaaacctttccccct

SEQ ID NO: 2355299 - DNA, 14 bp, Homo sapiens
agcggctcccctct

SEQ ID NO: 2355300 - DNA, 17 bp, Homo sapiens
agcggctcccctctgct

SEQ ID NO: 2355301 - DNA, 14 bp, Homo sapiens
agcgtccctggcgc

SEQ ID NO: 2355302 - DNA, 17 bp, Homo sapiens
agcgttgttttgtggat

SEQ ID NO: 2355303 - DNA, 18 bp, Homo sapiens
agcgttgttttgtggata

SEQ ID NO: 2355304 - DNA, 18 bp, Homo sapiens
agcgttttgttgagcatg

SEQ ID NO: 2355305 - DNA, 17 bp, Homo sapiens
agctaaaccaaggactg

SEQ ID NO: 2355306 - DNA, 13 bp, Homo sapiens
agctactaatgat

SEQ ID NO: 2355307 - DNA, 18 bp, Homo sapiens
agctactaatgatgtttt

SEQ ID NO: 2355308 - DNA, 17 bp, Homo sapiens
agctacttgggaggctg

SEQ ID NO: 2355309 - DNA, 12 bp, Homo sapiens
agctagctgcca

SEQ ID NO: 2355310 - DNA, 15 bp, Homo sapiens
agctagctgccactt

SEQ ID NO: 2355311 - DNA, 17 bp, Homo sapiens
agctagctgccactttc

SEQ ID NO: 2355312 - DNA, 21 bp, Homo sapiens
agctataaaagcccatgctta

SEQ ID NO: 2355313 - DNA, 20 bp, Homo sapiens
agctatgagttgaaatgttc

SEQ ID NO: 2355314 - DNA, 13 bp, Homo sapiens
agctatggtgagg

SEQ ID NO: 2355315 - DNA, 22 bp, Homo sapiens
agctattagccaggatcatggt

SEQ ID NO: 2355316 - DNA, 19 bp, Homo sapiens
agctattggcaagttttaa

SEQ ID NO: 2355317 - DNA, 22 bp, Homo sapiens
agctatttaagtggactgtatt

SEQ ID NO: 2355318 - DNA, 14 bp, Homo sapiens
agctatttcatcta

SEQ ID NO: 2355319 - DNA, 12 bp, Homo sapiens
agctcaaatgaa

SEQ ID NO: 2355320 - DNA, 17 bp, Homo sapiens
agctcaaatgaaatgta

SEQ ID NO: 2355321 - DNA, 19 bp, Homo sapiens
agctcacatgggactggga

SEQ ID NO: 2355322 - DNA, 21 bp, Homo sapiens
agctcacatgggactgggata

SEQ ID NO: 2355323 - DNA, 23 bp, Homo sapiens
agctcacttctgggcttcatctg

SEQ ID NO: 2355324 - DNA, 15 bp, Homo sapiens
agctcaggaggcgcc

SEQ ID NO: 2355325 - DNA, 17 bp, Homo sapiens
agctcaggaggcgccct

SEQ ID NO: 2355326 - DNA, 13 bp, Homo sapiens
agctcaggtgcct

SEQ ID NO: 2355327 - DNA, 23 bp, Homo sapiens
agctcatagaattttgagtattc

SEQ ID NO: 2355328 - DNA, 16 bp, Homo sapiens
agctcatctgcaaaag

SEQ ID NO: 2355329 - DNA, 13 bp, Homo sapiens
agctcctcccctt

SEQ ID NO: 2355330 - DNA, 16 bp, Homo sapiens
agctcctgtcccctgc

SEQ ID NO: 2355331 - DNA, 18 bp, Homo sapiens
agctcctgtcccctgcta

SEQ ID NO: 2355332 - DNA, 24 bp, Homo sapiens
agctcctgtcccctgctacaccta

SEQ ID NO: 2355333 - DNA, 14 bp, Homo sapiens
agctctctctagaa

SEQ ID NO: 2355334 - DNA, 13 bp, Homo sapiens
agctctctgacgc

SEQ ID NO: 2355335 - DNA, 23 bp, Homo sapiens
agctctctgacgcttgtgacagt

SEQ ID NO: 2355336 - DNA, 22 bp, Homo sapiens
agctctgaagttaaaatgattt

SEQ ID NO: 2355337 - DNA, 19 bp, Homo sapiens
agctctgaatgctatttgt

SEQ ID NO: 2355338 - DNA, 19 bp, Homo sapiens
agctctggaggtgctgctc

SEQ ID NO: 2355339 - DNA, 18 bp, Homo sapiens
agctcttactctttccta

SEQ ID NO: 2355340 - DNA, 19 bp, Homo sapiens
agctcttactctttcctat

SEQ ID NO: 2355341 - DNA, 19 bp, Homo sapiens
agctgaaaattaaatttta

SEQ ID NO: 2355342 - DNA, 15 bp, Homo sapiens
agctgagcagcctct

SEQ ID NO: 2355343 - DNA, 18 bp, Homo sapiens
agctgagcagcctctgga

SEQ ID NO: 2355344 - DNA, 19 bp, Homo sapiens
agctgatattatttcttct

SEQ ID NO: 2355345 - DNA, 16 bp, Homo sapiens
agctgcaaaaataatc

SEQ ID NO: 2355346 - DNA, 18 bp, Homo sapiens
agctgcaaaaataatcat

SEQ ID NO: 2355347 - DNA, 16 bp, Homo sapiens
agctgcaaatctgatg

SEQ ID NO: 2355348 - DNA, 13 bp, Homo sapiens
agctgcactgtga

SEQ ID NO: 2355349 - DNA, 17 bp, Homo sapiens
agctgccctatgggcct

SEQ ID NO: 2355350 - DNA, 21 bp, Homo sapiens
agctgccctatgggcctgccg

SEQ ID NO: 2355351 - DNA, 13 bp, Homo sapiens
agctgcctaccta

SEQ ID NO: 2355352 - DNA, 17 bp, Homo sapiens
agctgccttccctagct

SEQ ID NO: 2355353 - DNA, 17 bp, Homo sapiens
agctgcgcttgcttttc

SEQ ID NO: 2355354 - DNA, 23 bp, Homo sapiens
agctgctatccccatctccctgc

SEQ ID NO: 2355355 - DNA, 19 bp, Homo sapiens
agctgctatttattttcct

SEQ ID NO: 2355356 - DNA, 22 bp, Homo sapiens
agctgctcattacagttctttc

SEQ ID NO: 2355357 - DNA, 17 bp, Homo sapiens
agctgctccctggcatt

SEQ ID NO: 2355358 - DNA, 15 bp, Homo sapiens
agctgctctgagcca

SEQ ID NO: 2355359 - DNA, 18 bp, Homo sapiens
agctgctctgagccacag

SEQ ID NO: 2355360 - DNA, 11 bp, Homo sapiens
agctgctctgc

SEQ ID NO: 2355361 - DNA, 12 bp, Homo sapiens
agctggagaaat

SEQ ID NO: 2355362 - DNA, 15 bp, Homo sapiens
agctggagcccccag

SEQ ID NO: 2355363 - DNA, 18 bp, Homo sapiens
agctggagcccccagcag

SEQ ID NO: 2355364 - DNA, 18 bp, Homo sapiens
agctggatagacttggga

SEQ ID NO: 2355365 - DNA, 22 bp, Homo sapiens
agctggctctgtgagggtgctg

SEQ ID NO: 2355366 - DNA, 20 bp, Homo sapiens
agctggctttgaaacctcag

SEQ ID NO: 2355367 - DNA, 15 bp, Homo sapiens
agctgggaaagcata

SEQ ID NO: 2355368 - DNA, 16 bp, Homo sapiens
agctggggccagaggc

SEQ ID NO: 2355369 - DNA, 17 bp, Homo sapiens
agctggggccagaggct

SEQ ID NO: 2355370 - DNA, 20 bp, Homo sapiens
agctggggccagaggctggg

SEQ ID NO: 2355371 - DNA, 19 bp, Homo sapiens
agctggtcagtctttgctc

SEQ ID NO: 2355372 - DNA, 15 bp, Homo sapiens
agctggtggacccag

SEQ ID NO: 2355373 - DNA, 17 bp, Homo sapiens
agctgtaaaaatgttac

SEQ ID NO: 2355374 - DNA, 16 bp, Homo sapiens
agctgtcactctgtgc

SEQ ID NO: 2355375 - DNA, 18 bp, Homo sapiens
agctgtcctttttcctct

SEQ ID NO: 2355376 - DNA, 21 bp, Homo sapiens
agctgtcctttttcctctcca

SEQ ID NO: 2355377 - DNA, 23 bp, Homo sapiens
agctgtggacaaaaaaaaaagaa

SEQ ID NO: 2355378 - DNA, 13 bp, Homo sapiens
agctgtgtctgcc

SEQ ID NO: 2355379 - DNA, 22 bp, Homo sapiens
agctgtgtctgccaaacacatt

SEQ ID NO: 2355380 - DNA, 11 bp, Homo sapiens
agctgtgttta

SEQ ID NO: 2355381 - DNA, 23 bp, Homo sapiens
agctgttgtacatttatgattta

SEQ ID NO: 2355382 - DNA, 16 bp, Homo sapiens
agctgttgtgagcttt

SEQ ID NO: 2355383 - DNA, 17 bp, Homo sapiens
agctgttgtgagctttg

SEQ ID NO: 2355384 - DNA, 14 bp, Homo sapiens
agcttaatgctaca

SEQ ID NO: 2355385 - DNA, 14 bp, Homo sapiens
agcttagatttccc

SEQ ID NO: 2355386 - DNA, 13 bp, Homo sapiens
agcttcaggttat

SEQ ID NO: 2355387 - DNA, 19 bp, Homo sapiens
agcttcagttgcttgtctt

SEQ ID NO: 2355388 - DNA, 23 bp, Homo sapiens
agcttcagttgcttgtcttctgg

SEQ ID NO: 2355389 - DNA, 12 bp, Homo sapiens
agcttccaaagc

SEQ ID NO: 2355390 - DNA, 13 bp, Homo sapiens
agcttccctccat

SEQ ID NO: 2355391 - DNA, 19 bp, Homo sapiens
agcttctgggagatttttt

SEQ ID NO: 2355392 - DNA, 16 bp, Homo sapiens
agcttcttgtttcctt

SEQ ID NO: 2355393 - DNA, 23 bp, Homo sapiens
agcttgggcagtgccccagggag

SEQ ID NO: 2355394 - DNA, 14 bp, Homo sapiens
agcttggggagagg

SEQ ID NO: 2355395 - DNA, 16 bp, Homo sapiens
agcttggggagaggga

SEQ ID NO: 2355396 - DNA, 17 bp, Homo sapiens
agctttaaattatgtga

SEQ ID NO: 2355397 - DNA, 12 bp, Homo sapiens
agctttccctgc

SEQ ID NO: 2355398 - DNA, 16 bp, Homo sapiens
agctttccctgcctct

SEQ ID NO: 2355399 - DNA, 18 bp, Homo sapiens
agctttctcaatgtcttc

SEQ ID NO: 2355400 - DNA, 21 bp, Homo sapiens
agctttctcaatgtcttccca

SEQ ID NO: 2355401 - DNA, 20 bp, Homo sapiens
agctttctgggatgtcacag

SEQ ID NO: 2355402 - DNA, 12 bp, Homo sapiens
agctttgaagta

SEQ ID NO: 2355403 - DNA, 18 bp, Homo sapiens
agctttggaagtttagct

SEQ ID NO: 2355404 - DNA, 22 bp, Homo sapiens
agctttggaagtttagctctga

SEQ ID NO: 2355405 - DNA, 23 bp, Homo sapiens
agctttggaagtttagctctgag

SEQ ID NO: 2355406 - DNA, 15 bp, Homo sapiens
agctttttaattgtt

SEQ ID NO: 2355407 - DNA, 21 bp, Homo sapiens
agctttttaattgttgtttct

SEQ ID NO: 2355408 - DNA, 14 bp, Homo sapiens
agctttttggaatc

SEQ ID NO: 2355409 - DNA, 14 bp, Homo sapiens
aggaaaagacacat

SEQ ID NO: 2355410 - DNA, 22 bp, Homo sapiens
aggaaaaggttgaataatatat

SEQ ID NO: 2355411 - DNA, 16 bp, Homo sapiens
aggaaaatatttcatt

SEQ ID NO: 2355412 - DNA, 20 bp, Homo sapiens
aggaaaatgtctgtaataat

SEQ ID NO: 2355413 - DNA, 14 bp, Homo sapiens
aggaaaattccatt

SEQ ID NO: 2355414 - DNA, 19 bp, Homo sapiens
aggaaaattccattagaga

SEQ ID NO: 2355415 - DNA, 23 bp, Homo sapiens
aggaaaccgagtagaaaatgtga

SEQ ID NO: 2355416 - DNA, 12 bp, Homo sapiens
aggaaactctta

SEQ ID NO: 2355417 - DNA, 15 bp, Homo sapiens
aggaaagtttcttca

SEQ ID NO: 2355418 - DNA, 22 bp, Homo sapiens
aggaaatatctgtgaaggactt

SEQ ID NO: 2355419 - DNA, 11 bp, Homo sapiens
aggaaatgtat

SEQ ID NO: 2355420 - DNA, 18 bp, Homo sapiens
aggaagaattcctgccat

SEQ ID NO: 2355421 - DNA, 18 bp, Homo sapiens
aggaagagccacctgcaa

SEQ ID NO: 2355422 - DNA, 20 bp, Homo sapiens
aggaagagccacctgcaaga

SEQ ID NO: 2355423 - DNA, 15 bp, Homo sapiens
aggaagcagatacct

SEQ ID NO: 2355424 - DNA, 18 bp, Homo sapiens
aggaaggattgtaaaaaa

SEQ ID NO: 2355425 - DNA, 14 bp, Homo sapiens
aggaaggccaaaat

SEQ ID NO: 2355426 - DNA, 14 bp, Homo sapiens
aggaaggcctgagc

SEQ ID NO: 2355427 - DNA, 14 bp, Homo sapiens
aggaaggcctttct

SEQ ID NO: 2355428 - DNA, 13 bp, Homo sapiens
aggaagggaagcg

SEQ ID NO: 2355429 - DNA, 16 bp, Homo sapiens
aggaagggatctgaga

SEQ ID NO: 2355430 - DNA, 17 bp, Homo sapiens
aggaagggatctgagaa

SEQ ID NO: 2355431 - DNA, 12 bp, Homo sapiens
aggaagtggggt

SEQ ID NO: 2355432 - DNA, 16 bp, Homo sapiens
aggaagtggggtctgg

SEQ ID NO: 2355433 - DNA, 20 bp, Homo sapiens
aggaagtggggtctggcctg

SEQ ID NO: 2355434 - DNA, 22 bp, Homo sapiens
aggaatatgacggaagaacata

SEQ ID NO: 2355435 - DNA, 18 bp, Homo sapiens
aggaatcctggcagccca

SEQ ID NO: 2355436 - DNA, 22 bp, Homo sapiens
aggaatttcacctgtaaacctg

SEQ ID NO: 2355437 - DNA, 18 bp, Homo sapiens
aggaatttgatgattttc

SEQ ID NO: 2355438 - DNA, 13 bp, Homo sapiens
aggacaaaataaa

SEQ ID NO: 2355439 - DNA, 14 bp, Homo sapiens
aggacagagagaaa

SEQ ID NO: 2355440 - DNA, 13 bp, Homo sapiens
aggacatgcaata

SEQ ID NO: 2355441 - DNA, 22 bp, Homo sapiens
aggacatgcaataaaatttaaa

SEQ ID NO: 2355442 - DNA, 22 bp, Homo sapiens
aggacgcacgctcgctgccatc

SEQ ID NO: 2355443 - DNA, 17 bp, Homo sapiens
aggacgcctgcaggaga

SEQ ID NO: 2355444 - DNA, 21 bp, Homo sapiens
aggactccattggatctgcaa

SEQ ID NO: 2355445 - DNA, 20 bp, Homo sapiens
aggcctttcttctgtgttaa

SEQ ID NO: 2355446 - DNA, 15 bp, Homo sapiens
aggcgaccaccgccc

SEQ ID NO: 2355447 - DNA, 22 bp, Homo sapiens
aggcgaccaccgcccctggccg

SEQ ID NO: 2355448 - DNA, 23 bp, Homo sapiens
aggcgagtctggggacctggcac

SEQ ID NO: 2355449 - DNA, 14 bp, Homo sapiens
aggcgcctggtgtg

SEQ ID NO: 2355450 - DNA, 19 bp, Homo sapiens
aggcgcgtctgccccaccc

SEQ ID NO: 2355451 - DNA, 20 bp, Homo sapiens
aggcgcgtctgccccaccct

SEQ ID NO: 2355452 - DNA, 15 bp, Homo sapiens
aggctagcttctgct

SEQ ID NO: 2355453 - DNA, 17 bp, Homo sapiens
aggctagcttctgcttt

SEQ ID NO: 2355454 - DNA, 15 bp, Homo sapiens
aggctattaaaaaag

SEQ ID NO: 2355455 - DNA, 18 bp, Homo sapiens
aggctattttctaaagac

SEQ ID NO: 2355456 - DNA, 16 bp, Homo sapiens
aggctcactgccaggc

SEQ ID NO: 2355457 - DNA, 21 bp, Homo sapiens
aggctcactgccaggccagcc

SEQ ID NO: 2355458 - DNA, 24 bp, Homo sapiens
aggctcactgccaggccagcctcc

SEQ ID NO: 2355459 - DNA, 20 bp, Homo sapiens
aggctcagtggtgggagaga

SEQ ID NO: 2355460 - DNA, 20 bp, Homo sapiens
aggctccagcacatccccct

SEQ ID NO: 2355461 - DNA, 12 bp, Homo sapiens
aggctctggaca

SEQ ID NO: 2355462 - DNA, 23 bp, Homo sapiens
aggctctggacagcagaagcctc

SEQ ID NO: 2355463 - DNA, 16 bp, Homo sapiens
aggctgaaagaggcca

SEQ ID NO: 2355464 - DNA, 18 bp, Homo sapiens
aggctgcacccctgggcc

SEQ ID NO: 2355465 - DNA, 15 bp, Homo sapiens
aggctgccagacatg

SEQ ID NO: 2355466 - DNA, 18 bp, Homo sapiens
aggctgccagacatggac

SEQ ID NO: 2355467 - DNA, 17 bp, Homo sapiens
aggctgcccctctcacc

SEQ ID NO: 2355468 - DNA, 19 bp, Homo sapiens
aggctgggagtccctacct

SEQ ID NO: 2355469 - DNA, 22 bp, Homo sapiens
aggctgggagtccctacctgct

SEQ ID NO: 2355470 - DNA, 20 bp, Homo sapiens
aggctggtggagaactctgg

SEQ ID NO: 2355471 - DNA, 20 bp, Homo sapiens
aggctgtaactgagagaaag

SEQ ID NO: 2355472 - DNA, 21 bp, Homo sapiens
aggctgtaactgagagaaaga

SEQ ID NO: 2355473 - DNA, 11 bp, Homo sapiens
aggctgtcccc

SEQ ID NO: 2355474 - DNA, 16 bp, Homo sapiens
aggcttaggtgccagg

SEQ ID NO: 2355475 - DNA, 15 bp, Homo sapiens
aggcttctccgccag

SEQ ID NO: 2355476 - DNA, 18 bp, Homo sapiens
aggcttctccgccagcct

SEQ ID NO: 2355477 - DNA, 17 bp, Homo sapiens
aggcttctgctggggcc

SEQ ID NO: 2355478 - DNA, 18 bp, Homo sapiens
aggcttctgctggggcct

SEQ ID NO: 2355479 - DNA, 19 bp, Homo sapiens
aggcttctgctggggcctg

SEQ ID NO: 2355480 - DNA, 16 bp, Homo sapiens
aggcttggggaaaatg

SEQ ID NO: 2355481 - DNA, 22 bp, Homo sapiens
aggcttggggaaaatggccatg

SEQ ID NO: 2355482 - DNA, 18 bp, Homo sapiens
aggctttgccatgggcct

SEQ ID NO: 2355483 - DNA, 21 bp, Homo sapiens
aggctttgccatgggcctgct

SEQ ID NO: 2355484 - DNA, 22 bp, Homo sapiens
agggaaaagataaagaccagaa

SEQ ID NO: 2355485 - DNA, 19 bp, Homo sapiens
agggaaaggggtgctttta

SEQ ID NO: 2355486 - DNA, 15 bp, Homo sapiens
agggaaagttttttt

SEQ ID NO: 2355487 - DNA, 13 bp, Homo sapiens
agggaactgggga

SEQ ID NO: 2355488 - DNA, 13 bp, Homo sapiens
agggaagaaaaag

SEQ ID NO: 2355489 - DNA, 15 bp, Homo sapiens
agggaagaactattg

SEQ ID NO: 2355490 - DNA, 19 bp, Homo sapiens
agggaagagacagcccagg

SEQ ID NO: 2355491 - DNA, 12 bp, Homo sapiens
agggaagcaggg

SEQ ID NO: 2355492 - DNA, 16 bp, Homo sapiens
agggaagcgtatatac

SEQ ID NO: 2355493 - DNA, 15 bp, Homo sapiens
agggaatccaagcct

SEQ ID NO: 2355494 - DNA, 16 bp, Homo sapiens
agggaatccaagcctc

SEQ ID NO: 2355495 - DNA, 22 bp, Homo sapiens
agggaatccaagcctccacagc

SEQ ID NO: 2355496 - DNA, 15 bp, Homo sapiens
agggaccctttgggg

SEQ ID NO: 2355497 - DNA, 17 bp, Homo sapiens
agggaccctttgggggt

SEQ ID NO: 2355498 - DNA, 16 bp, Homo sapiens
agggagaagaaaggtg

SEQ ID NO: 2355499 - DNA, 16 bp, Homo sapiens
agggagaatccaaggg

SEQ ID NO: 2355500 - DNA, 22 bp, Homo sapiens
agggagagagagagagagagga

SEQ ID NO: 2355501 - DNA, 13 bp, Homo sapiens
agggagagggagg

SEQ ID NO: 2355502 - DNA, 14 bp, Homo sapiens
agggagagggaggt

SEQ ID NO: 2355503 - DNA, 16 bp, Homo sapiens
agggagcaactctcca

SEQ ID NO: 2355504 - DNA, 22 bp, Homo sapiens
agggagcctccccatctgtcca

SEQ ID NO: 2355505 - DNA, 16 bp, Homo sapiens
agggaggaaggccttt

SEQ ID NO: 2355506 - DNA, 21 bp, Homo sapiens
agggaggaaggcctttcttct

SEQ ID NO: 2355507 - DNA, 22 bp, Homo sapiens
agggaggaaggcctttcttctg

SEQ ID NO: 2355508 - DNA, 21 bp, Homo sapiens
agggaggggaaaagcattttt

SEQ ID NO: 2355509 - DNA, 20 bp, Homo sapiens
agggaggtcactggaaaggg

SEQ ID NO: 2355510 - DNA, 21 bp, Homo sapiens
agggagtccagggtttctctg

SEQ ID NO: 2355511 - DNA, 16 bp, Homo sapiens
agggagttttgtctgt

SEQ ID NO: 2355512 - DNA, 17 bp, Homo sapiens
agggatgtttggaaaaa

SEQ ID NO: 2355513 - DNA, 22 bp, Homo sapiens
agggatttgcctcaccttgggg

SEQ ID NO: 2355514 - DNA, 13 bp, Homo sapiens
agggcaagaaatg

SEQ ID NO: 2355515 - DNA, 20 bp, Homo sapiens
agggcaagggttaaggcctg

SEQ ID NO: 2355516 - DNA, 21 bp, Homo sapiens
agggcaagggttaaggcctga

SEQ ID NO: 2355517 - DNA, 20 bp, Homo sapiens
agggcagactggggcatcct

SEQ ID NO: 2355518 - DNA, 13 bp, Homo sapiens
agggcagctgcta

SEQ ID NO: 2355519 - DNA, 14 bp, Homo sapiens
agggcaggcttggg

SEQ ID NO: 2355520 - DNA, 15 bp, Homo sapiens
agggcaggcttgggg

SEQ ID NO: 2355521 - DNA, 13 bp, Homo sapiens
agggcatcttgct

SEQ ID NO: 2355522 - DNA, 15 bp, Homo sapiens
agggccctgggcagg

SEQ ID NO: 2355523 - DNA, 11 bp, Homo sapiens
agggcctcctg

SEQ ID NO: 2355524 - DNA, 20 bp, Homo sapiens
agggcctcctgggggacctt

SEQ ID NO: 2355525 - DNA, 16 bp, Homo sapiens
agggcctgctggaggc

SEQ ID NO: 2355526 - DNA, 22 bp, Homo sapiens
agggcctgctggaggcctcagg

SEQ ID NO: 2355527 - DNA, 22 bp, Homo sapiens
agggcgttctaggtaggaagag

SEQ ID NO: 2355528 - DNA, 13 bp, Homo sapiens
agggctcccaggg

SEQ ID NO: 2355529 - DNA, 18 bp, Homo sapiens
agggctccctcctggagc

SEQ ID NO: 2355530 - DNA, 17 bp, Homo sapiens
agggctcgggagccatg

SEQ ID NO: 2355531 - DNA, 12 bp, Homo sapiens
agggctgcagtt

SEQ ID NO: 2355532 - DNA, 13 bp, Homo sapiens
agggctggctccc

SEQ ID NO: 2355533 - DNA, 17 bp, Homo sapiens
agggctggctcctgatc

SEQ ID NO: 2355534 - DNA, 15 bp, Homo sapiens
agggctgtcattgca

SEQ ID NO: 2355535 - DNA, 12 bp, Homo sapiens
agggctgtccca

SEQ ID NO: 2355536 - DNA, 12 bp, Homo sapiens
agggcttcctct

SEQ ID NO: 2355537 - DNA, 20 bp, Homo sapiens
agggcttcctctagaagcca

SEQ ID NO: 2355538 - DNA, 22 bp, Homo sapiens
agggcttcctctagaagccaag

SEQ ID NO: 2355539 - DNA, 14 bp, Homo sapiens
aggggagagacagg

SEQ ID NO: 2355540 - DNA, 17 bp, Homo sapiens
aggggagagacaggcag

SEQ ID NO: 2355541 - DNA, 15 bp, Homo sapiens
aggggagagcctgct

SEQ ID NO: 2355542 - DNA, 16 bp, Homo sapiens
aggggagagcctgctg

SEQ ID NO: 2355543 - DNA, 17 bp, Homo sapiens
aggggagggcaggcttg

SEQ ID NO: 2355544 - DNA, 12 bp, Homo sapiens
aggggagtagag

SEQ ID NO: 2355545 - DNA, 20 bp, Homo sapiens
aggggatctaaaaaaatgtt

SEQ ID NO: 2355546 - DNA, 20 bp, Homo sapiens
aggggatggttagtcacctg

SEQ ID NO: 2355547 - DNA, 14 bp, Homo sapiens
aggggcctgagtgg

SEQ ID NO: 2355548 - DNA, 13 bp, Homo sapiens
aggggcctgccct

SEQ ID NO: 2355549 - DNA, 24 bp, Homo sapiens
aggggctcttcatctgcctgcgct

SEQ ID NO: 2355550 - DNA, 18 bp, Homo sapiens
agggggctttctggggcc

SEQ ID NO: 2355551 - DNA, 13 bp, Homo sapiens
agggggtctctgt

SEQ ID NO: 2355552 - DNA, 15 bp, Homo sapiens
agggggtggaggggt

SEQ ID NO: 2355553 - DNA, 14 bp, Homo sapiens
aggggtctccctgg

SEQ ID NO: 2355554 - DNA, 18 bp, Homo sapiens
aggggtctccctggctcc

SEQ ID NO: 2355555 - DNA, 19 bp, Homo sapiens
aggggtctccctggctccc

SEQ ID NO: 2355556 - DNA, 19 bp, Homo sapiens
aggggtgggggtggaggct

SEQ ID NO: 2355557 - DNA, 18 bp, Homo sapiens
aggggtgtggcagtggtt

SEQ ID NO: 2355558 - DNA, 21 bp, Homo sapiens
aggggttcccttgagggctgc

SEQ ID NO: 2355559 - DNA, 13 bp, Homo sapiens
agggtctgggctg

SEQ ID NO: 2355560 - DNA, 16 bp, Homo sapiens
agtatgtgcatttaat

SEQ ID NO: 2355561 - DNA, 22 bp, Homo sapiens
agtatgtgctatacacacacac

SEQ ID NO: 2355562 - DNA, 17 bp, Homo sapiens
agtatgtgggggcttca

SEQ ID NO: 2355563 - DNA, 22 bp, Homo sapiens
agtatgtgggggcttcatctct

SEQ ID NO: 2355564 - DNA, 15 bp, Homo sapiens
agtattgaaagccaa

SEQ ID NO: 2355565 - DNA, 13 bp, Homo sapiens
agtattgacaata

SEQ ID NO: 2355566 - DNA, 21 bp, Homo sapiens
agtattgacaataagaaacag

SEQ ID NO: 2355567 - DNA, 15 bp, Homo sapiens
agtatttaacattct

SEQ ID NO: 2355568 - DNA, 17 bp, Homo sapiens
agtatttaacattcttg

SEQ ID NO: 2355569 - DNA, 13 bp, Homo sapiens
agtatttcccttc

SEQ ID NO: 2355570 - DNA, 18 bp, Homo sapiens
agtatttcccttccaaag

SEQ ID NO: 2355571 - DNA, 22 bp, Homo sapiens
agtattttgatctcgctaggta

SEQ ID NO: 2355572 - DNA, 23 bp, Homo sapiens
agtattttgtctaggagatgctt

SEQ ID NO: 2355573 - DNA, 15 bp, Homo sapiens
agtattttgtgtcct

SEQ ID NO: 2355574 - DNA, 13 bp, Homo sapiens
agtcaaaaaatta

SEQ ID NO: 2355575 - DNA, 21 bp, Homo sapiens
agtcaactacacaaagcaggc

SEQ ID NO: 2355576 - DNA, 23 bp, Homo sapiens
agtcacatggcctatgcacatat

SEQ ID NO: 2355577 - DNA, 20 bp, Homo sapiens
agtcaccaaatagtgtgaaa

SEQ ID NO: 2355578 - DNA, 18 bp, Homo sapiens
agtcacctgccccagcac

SEQ ID NO: 2355579 - DNA, 19 bp, Homo sapiens
agtcacctgccccagcact

SEQ ID NO: 2355580 - DNA, 20 bp, Homo sapiens
agtcaccttttctgtggctg

SEQ ID NO: 2355581 - DNA, 21 bp, Homo sapiens
agtcactggaggttgaagcca

SEQ ID NO: 2355582 - DNA, 14 bp, Homo sapiens
agtcacttaactat

SEQ ID NO: 2355583 - DNA, 14 bp, Homo sapiens
agtcagctctctgc

SEQ ID NO: 2355584 - DNA, 18 bp, Homo sapiens
agtcagctctctgccctg

SEQ ID NO: 2355585 - DNA, 19 bp, Homo sapiens
agtcagtaggactccttat

SEQ ID NO: 2355586 - DNA, 21 bp, Homo sapiens
agtcagttgctcaaaaagaaa

SEQ ID NO: 2355587 - DNA, 15 bp, Homo sapiens
agtcatcaaagcaga

SEQ ID NO: 2355588 - DNA, 11 bp, Homo sapiens
agtcatctccc

SEQ ID NO: 2355589 - DNA, 15 bp, Homo sapiens
agtcatctcccctcc

SEQ ID NO: 2355590 - DNA, 15 bp, Homo sapiens
agtcatctgtaagag

SEQ ID NO: 2355591 - DNA, 19 bp, Homo sapiens
agtcatctgtaagagcttg

SEQ ID NO: 2355592 - DNA, 23 bp, Homo sapiens
agtccaagcaacagcctttgaat

SEQ ID NO: 2355593 - DNA, 16 bp, Homo sapiens
agtccaaggccagtcc

SEQ ID NO: 2355594 - DNA, 17 bp, Homo sapiens
agtccaccctgcctgcc

SEQ ID NO: 2355595 - DNA, 17 bp, Homo sapiens
agtccagggtttctctg

SEQ ID NO: 2355596 - DNA, 18 bp, Homo sapiens
agtccagggtttctctgc

SEQ ID NO: 2355597 - DNA, 19 bp, Homo sapiens
agtccagggtttctctgca

SEQ ID NO: 2355598 - DNA, 18 bp, Homo sapiens
agtccagtgctctgcctc

SEQ ID NO: 2355599 - DNA, 14 bp, Homo sapiens
agtccattctccca

SEQ ID NO: 2355600 - DNA, 17 bp, Homo sapiens
agtccattctcccaggt

SEQ ID NO: 2355601 - DNA, 20 bp, Homo sapiens
agtccattttttaaaaatgt

SEQ ID NO: 2355602 - DNA, 20 bp, Homo sapiens
agtccccacccctgccccca

SEQ ID NO: 2355603 - DNA, 13 bp, Homo sapiens
agtcccctctctc

SEQ ID NO: 2355604 - DNA, 15 bp, Homo sapiens
agtcccctctctctg

SEQ ID NO: 2355605 - DNA, 17 bp, Homo sapiens
agtcccctctctctggg

SEQ ID NO: 2355606 - DNA, 23 bp, Homo sapiens
agtcccctgttgattatcttcag

SEQ ID NO: 2355607 - DNA, 10 bp, Homo sapiens
agtccctccc

SEQ ID NO: 2355608 - DNA, 18 bp, Homo sapiens
agtccggatttctaacag

SEQ ID NO: 2355609 - DNA, 14 bp, Homo sapiens
agtcctatttcagt

SEQ ID NO: 2355610 - DNA, 15 bp, Homo sapiens
agtcctgctacctcc

SEQ ID NO: 2355611 - DNA, 24 bp, Homo sapiens
agtcctgctacctcccttgccttt

SEQ ID NO: 2355612 - DNA, 23 bp, Homo sapiens
agtcctggaagccagctttccct

SEQ ID NO: 2355613 - DNA, 23 bp, Homo sapiens
agtcctggcacagtttttgtaaa

SEQ ID NO: 2355614 - DNA, 23 bp, Homo sapiens
agtccttgatttcaaagttttgt

SEQ ID NO: 2355615 - DNA, 19 bp, Homo sapiens
agtctcataggttaaaaaa

SEQ ID NO: 2355616 - DNA, 20 bp, Homo sapiens
agtctcatttgggctagact

SEQ ID NO: 2355617 - DNA, 23 bp, Homo sapiens
agtctgcccacgcagaggacgca

SEQ ID NO: 2355618 - DNA, 19 bp, Homo sapiens
agtctggctttgctctatt

SEQ ID NO: 2355619 - DNA, 17 bp, Homo sapiens
agtctgtactaaacagt

SEQ ID NO: 2355620 - DNA, 22 bp, Homo sapiens
agtctgtactaaacagtaagat

SEQ ID NO: 2355621 - DNA, 14 bp, Homo sapiens
agtctgtctcaaaa

SEQ ID NO: 2355622 - DNA, 16 bp, Homo sapiens
agtctgtctttcctga

SEQ ID NO: 2355623 - DNA, 21 bp, Homo sapiens
agtctgtctttcctgaaccat

SEQ ID NO: 2355624 - DNA, 15 bp, Homo sapiens
agtcttaataaaata

SEQ ID NO: 2355625 - DNA, 22 bp, Homo sapiens
agtcttaataaaataaactaga

SEQ ID NO: 2355626 - DNA, 15 bp, Homo sapiens
agtcttccaattaat

SEQ ID NO: 2355627 - DNA, 16 bp, Homo sapiens
agtcttcctgacactt

SEQ ID NO: 2355628 - DNA, 18 bp, Homo sapiens
agtcttcctgacacttta

SEQ ID NO: 2355629 - DNA, 19 bp, Homo sapiens
agtcttcctgacactttaa

SEQ ID NO: 2355630 - DNA, 15 bp, Homo sapiens
agtctttcatggctg

SEQ ID NO: 2355631 - DNA, 20 bp, Homo sapiens
agtctttgctcagtgtccag

SEQ ID NO: 2355632 - DNA, 13 bp, Homo sapiens
agtgaaaaaatgt

SEQ ID NO: 2355633 - DNA, 15 bp, Homo sapiens
agtgaaaaaatgtaa

SEQ ID NO: 2355634 - DNA, 15 bp, Homo sapiens
agtgaacattcccag

SEQ ID NO: 2355635 - DNA, 16 bp, Homo sapiens
agtgaactcctgccag

SEQ ID NO: 2355636 - DNA, 17 bp, Homo sapiens
agtgaactcctgccagg

SEQ ID NO: 2355637 - DNA, 18 bp, Homo sapiens
agtgaagtgaatctgatt

SEQ ID NO: 2355638 - DNA, 21 bp, Homo sapiens
agtgacaaataagattaataa

SEQ ID NO: 2355639 - DNA, 15 bp, Homo sapiens
agtgacagctttctg

SEQ ID NO: 2355640 - DNA, 15 bp, Homo sapiens
agtgagactgcccca

SEQ ID NO: 2355641 - DNA, 18 bp, Homo sapiens
agtgagatgtagaaagtt

SEQ ID NO: 2355642 - DNA, 17 bp, Homo sapiens
agtgagcctcctgtgcc

SEQ ID NO: 2355643 - DNA, 17 bp, Homo sapiens
agtgatagatgtagtct

SEQ ID NO: 2355644 - DNA, 14 bp, Homo sapiens
agtgatatggcaga

SEQ ID NO: 2355645 - DNA, 17 bp, Homo sapiens
agtgatatggcagaaga

SEQ ID NO: 2355646 - DNA, 15 bp, Homo sapiens
agtgatgacttgctg

SEQ ID NO: 2355647 - DNA, 23 bp, Homo sapiens
agtgattgagactcaaaaaaaca

SEQ ID NO: 2355648 - DNA, 17 bp, Homo sapiens
agtgcaatgcttgtaga

SEQ ID NO: 2355649 - DNA, 18 bp, Homo sapiens
agtgcaatgcttgtagaa

SEQ ID NO: 2355650 - DNA, 18 bp, Homo sapiens
agtgcagagccttctcag

SEQ ID NO: 2355651 - DNA, 16 bp, Homo sapiens
agtgcagccttctcca

SEQ ID NO: 2355652 - DNA, 14 bp, Homo sapiens
agtgcatttttgta

SEQ ID NO: 2355653 - DNA, 20 bp, Homo sapiens
agtgccccagggagtccagg

SEQ ID NO: 2355654 - DNA, 23 bp, Homo sapiens
agtgccctctcccaccctcttcc

SEQ ID NO: 2355655 - DNA, 14 bp, Homo sapiens
agtgcctattgata

SEQ ID NO: 2355656 - DNA, 16 bp, Homo sapiens
agtgcctcacctcgaa

SEQ ID NO: 2355657 - DNA, 12 bp, Homo sapiens
agtgcctggagt

SEQ ID NO: 2355658 - DNA, 21 bp, Homo sapiens
agtgcgggctgaggccagagt

SEQ ID NO: 2355659 - DNA, 23 bp, Homo sapiens
agtgcgggctgaggccagagtca

SEQ ID NO: 2355660 - DNA, 22 bp, Homo sapiens
agtgcgtgtgtagagttaagaa

SEQ ID NO: 2355661 - DNA, 16 bp, Homo sapiens
agtgctcaccagccct

SEQ ID NO: 2355662 - DNA, 17 bp, Homo sapiens
agtgctcaccagccctg

SEQ ID NO: 2355663 - DNA, 16 bp, Homo sapiens
agtgctctcagctggc

SEQ ID NO: 2355664 - DNA, 18 bp, Homo sapiens
agtgctctcagctggcag

SEQ ID NO: 2355665 - DNA, 15 bp, Homo sapiens
agtgctctgcctcag

SEQ ID NO: 2355666 - DNA, 13 bp, Homo sapiens
agtgctggaaggg

SEQ ID NO: 2355667 - DNA, 14 bp, Homo sapiens
agtgctggaaggga

SEQ ID NO: 2355668 - DNA, 19 bp, Homo sapiens
agtgcttaaaaatcattga

SEQ ID NO: 2355669 - DNA, 13 bp, Homo sapiens
agtgcttggaaca

SEQ ID NO: 2355670 - DNA, 22 bp, Homo sapiens
agtggaagtatgtatattaaaa

SEQ ID NO: 2355671 - DNA, 18 bp, Homo sapiens
agtggaccttgagaccac

SEQ ID NO: 2355672 - DNA, 15 bp, Homo sapiens
agtggactgtatttc

SEQ ID NO: 2355673 - DNA, 19 bp, Homo sapiens
agtggcgggtgatggccag

SEQ ID NO: 2355674 - DNA, 16 bp, Homo sapiens
agttttgtaaaagaaa

SEQ ID NO: 2355675 - DNA, 17 bp, Homo sapiens
agttttgtctgtctccc

SEQ ID NO: 2355676 - DNA, 13 bp, Homo sapiens
agttttgttgtac

SEQ ID NO: 2355677 - DNA, 16 bp, Homo sapiens
agtttttgtttggaga

SEQ ID NO: 2355678 - DNA, 18 bp, Homo sapiens
ataaaaagatcactttct

SEQ ID NO: 2355679 - DNA, 22 bp, Homo sapiens
ataaaaagatcactttctcagt

SEQ ID NO: 2355680 - DNA, 23 bp, Homo sapiens
ataaaaatactacaatagtttta

SEQ ID NO: 2355681 - DNA, 12 bp, Homo sapiens
ataaaaatatat

SEQ ID NO: 2355682 - DNA, 21 bp, Homo sapiens
ataaaacaaataaatatgaaa

SEQ ID NO: 2355683 - DNA, 14 bp, Homo sapiens
ataaaacagaatct

SEQ ID NO: 2355684 - DNA, 14 bp, Homo sapiens
ataaaaccaaagaa

SEQ ID NO: 2355685 - DNA, 13 bp, Homo sapiens
ataaaagaaaatt

SEQ ID NO: 2355686 - DNA, 14 bp, Homo sapiens
ataaaagaaaatta

SEQ ID NO: 2355687 - DNA, 20 bp, Homo sapiens
ataaaaggtggagtttctct

SEQ ID NO: 2355688 - DNA, 15 bp, Homo sapiens
ataaaataaataatt

SEQ ID NO: 2355689 - DNA, 15 bp, Homo sapiens
ataaaatagaataat

SEQ ID NO: 2355690 - DNA, 18 bp, Homo sapiens
ataaaatagtatgaaaat

SEQ ID NO: 2355691 - DNA, 17 bp, Homo sapiens
ataaaatatatcttata

SEQ ID NO: 2355692 - DNA, 14 bp, Homo sapiens
ataaaatatcataa

SEQ ID NO: 2355693 - DNA, 13 bp, Homo sapiens
ataaaatgaaaat

SEQ ID NO: 2355694 - DNA, 14 bp, Homo sapiens
ataaaatgtttcat

SEQ ID NO: 2355695 - DNA, 12 bp, Homo sapiens
ataaaatttaaa

SEQ ID NO: 2355696 - DNA, 13 bp, Homo sapiens
ataaaccaaaaac

SEQ ID NO: 2355697 - DNA, 17 bp, Homo sapiens
ataaaccaaaaacattt

SEQ ID NO: 2355698 - DNA, 15 bp, Homo sapiens
ataaaccactgtgcg

SEQ ID NO: 2355699 - DNA, 23 bp, Homo sapiens
ataaaccgtgtatttattacatt

SEQ ID NO: 2355700 - DNA, 22 bp, Homo sapiens
ataaacttaaagctactgtaga

SEQ ID NO: 2355701 - DNA, 21 bp, Homo sapiens
ataaagaaaagacattttaag

SEQ ID NO: 2355702 - DNA, 16 bp, Homo sapiens
ataaagatattgttca

SEQ ID NO: 2355703 - DNA, 22 bp, Homo sapiens
ataaagctcaaatgaaatgtat

SEQ ID NO: 2355704 - DNA, 14 bp, Homo sapiens
ataaaggataaaga

SEQ ID NO: 2355705 - DNA, 16 bp, Homo sapiens
ataaagtaaatacatg

SEQ ID NO: 2355706 - DNA, 18 bp, Homo sapiens
ataaagtaaatacatgca

SEQ ID NO: 2355707 - DNA, 17 bp, Homo sapiens
ataaagtacaaatgaag

SEQ ID NO: 2355708 - DNA, 20 bp, Homo sapiens
ataaagtacaaatgaagaaa

SEQ ID NO: 2355709 - DNA, 23 bp, Homo sapiens
ataaagtacaaatgaagaaagtc

SEQ ID NO: 2355710 - DNA, 15 bp, Homo sapiens
ataaagtattttctt

SEQ ID NO: 2355711 - DNA, 16 bp, Homo sapiens
ataaagtgctttaaaa

SEQ ID NO: 2355712 - DNA, 13 bp, Homo sapiens
ataaataatttta

SEQ ID NO: 2355713 - DNA, 23 bp, Homo sapiens
ataaatacgtgtcaaaaaagaat

SEQ ID NO: 2355714 - DNA, 13 bp, Homo sapiens
ataaatatgaaag

SEQ ID NO: 2355715 - DNA, 13 bp, Homo sapiens
ataaatatgcagt

SEQ ID NO: 2355716 - DNA, 19 bp, Homo sapiens
ataaatcattcttactaaa

SEQ ID NO: 2355717 - DNA, 18 bp, Homo sapiens
ataaatgatgattgaact

SEQ ID NO: 2355718 - DNA, 17 bp, Homo sapiens
ataaatgtataaatata

SEQ ID NO: 2355719 - DNA, 14 bp, Homo sapiens
ataaatgtgttggg

SEQ ID NO: 2355720 - DNA, 16 bp, Homo sapiens
ataaatgttgctctaa

SEQ ID NO: 2355721 - DNA, 20 bp, Homo sapiens
ataaattcaactttgtaaaa

SEQ ID NO: 2355722 - DNA, 15 bp, Homo sapiens
ataaattttctaaaa

SEQ ID NO: 2355723 - DNA, 17 bp, Homo sapiens
ataacaaggagatttct

SEQ ID NO: 2355724 - DNA, 13 bp, Homo sapiens
ataacaatgttaa

SEQ ID NO: 2355725 - DNA, 18 bp, Homo sapiens
ataacaatgttaaggaaa

SEQ ID NO: 2355726 - DNA, 20 bp, Homo sapiens
ataacagagtgatttgtaaa

SEQ ID NO: 2355727 - DNA, 19 bp, Homo sapiens
ataacagctgcaattccct

SEQ ID NO: 2355728 - DNA, 13 bp, Homo sapiens
ataacataaaagc

SEQ ID NO: 2355729 - DNA, 14 bp, Homo sapiens
ataacataaaagca

SEQ ID NO: 2355730 - DNA, 15 bp, Homo sapiens
ataacataaataaaa

SEQ ID NO: 2355731 - DNA, 17 bp, Homo sapiens
ataacataaataaaaat

SEQ ID NO: 2355732 - DNA, 23 bp, Homo sapiens
ataacatcgaaaagttattttgt

SEQ ID NO: 2355733 - DNA, 15 bp, Homo sapiens
ataacctagttaaag

SEQ ID NO: 2355734 - DNA, 15 bp, Homo sapiens
ataacgtttttcctt

SEQ ID NO: 2355735 - DNA, 20 bp, Homo sapiens
ataactctgtataatagaga

SEQ ID NO: 2355736 - DNA, 15 bp, Homo sapiens
ataactgaaaatgtg

SEQ ID NO: 2355737 - DNA, 15 bp, Homo sapiens
ataactgaatttgga

SEQ ID NO: 2355738 - DNA, 16 bp, Homo sapiens
ataactgtgtactgtt

SEQ ID NO: 2355739 - DNA, 13 bp, Homo sapiens
ataagaaacagtt

SEQ ID NO: 2355740 - DNA, 22 bp, Homo sapiens
ataagaaacagtttaacagaaa

SEQ ID NO: 2355741 - DNA, 18 bp, Homo sapiens
ataagaaagcctaaaatt

SEQ ID NO: 2355742 - DNA, 14 bp, Homo sapiens
ataagacataacgt

SEQ ID NO: 2355743 - DNA, 14 bp, Homo sapiens
ataagacatttgtt

SEQ ID NO: 2355744 - DNA, 14 bp, Homo sapiens
ataagatggctgtg

SEQ ID NO: 2355745 - DNA, 15 bp, Homo sapiens
ataagatttttcaaa

SEQ ID NO: 2355746 - DNA, 18 bp, Homo sapiens
ataagcaaattgcttttt

SEQ ID NO: 2355747 - DNA, 12 bp, Homo sapiens
ataagcaagaga

SEQ ID NO: 2355748 - DNA, 17 bp, Homo sapiens
ataagcaagagagatgt

SEQ ID NO: 2355749 - DNA, 20 bp, Homo sapiens
ataagctatgagttgaaatg

SEQ ID NO: 2355750 - DNA, 22 bp, Homo sapiens
ataagcttccattttaatttta

SEQ ID NO: 2355751 - DNA, 12 bp, Homo sapiens
ataaggaaattt

SEQ ID NO: 2355752 - DNA, 15 bp, Homo sapiens
ataagggaaaagata

SEQ ID NO: 2355753 - DNA, 13 bp, Homo sapiens
ataaggtgcctca

SEQ ID NO: 2355754 - DNA, 20 bp, Homo sapiens
ataagtaaatgtcttcatgt

SEQ ID NO: 2355755 - DNA, 21 bp, Homo sapiens
ataagtagtaaatcagaaagt

SEQ ID NO: 2355756 - DNA, 18 bp, Homo sapiens
ataagttatttttgtaca

SEQ ID NO: 2355757 - DNA, 18 bp, Homo sapiens
ataagttcccatttcctt

SEQ ID NO: 2355758 - DNA, 11 bp, Homo sapiens
ataataaaaat

SEQ ID NO: 2355759 - DNA, 19 bp, Homo sapiens
ataataaaaatatattttc

SEQ ID NO: 2355760 - DNA, 17 bp, Homo sapiens
ataataaagtattttct

SEQ ID NO: 2355761 - DNA, 20 bp, Homo sapiens
ataataagagaatgttccta

SEQ ID NO: 2355762 - DNA, 13 bp, Homo sapiens
ataatagactgta

SEQ ID NO: 2355763 - DNA, 17 bp, Homo sapiens
ataatagagataagtcc

SEQ ID NO: 2355764 - DNA, 14 bp, Homo sapiens
ataatatatattaa

SEQ ID NO: 2355765 - DNA, 14 bp, Homo sapiens
ataatatcaaataa

SEQ ID NO: 2355766 - DNA, 19 bp, Homo sapiens
ataatatcaaataaaatat

SEQ ID NO: 2355767 - DNA, 14 bp, Homo sapiens
ataatattgtttgg

SEQ ID NO: 2355768 - DNA, 22 bp, Homo sapiens
ataatatttttgtatttctcta

SEQ ID NO: 2355769 - DNA, 20 bp, Homo sapiens
ataatctgtttttacgtatg

SEQ ID NO: 2355770 - DNA, 15 bp, Homo sapiens
ataatcttctgcctt

SEQ ID NO: 2355771 - DNA, 22 bp, Homo sapiens
ataatgaaaataaaacacacct

SEQ ID NO: 2355772 - DNA, 14 bp, Homo sapiens
ataatgaataaatc

SEQ ID NO: 2355773 - DNA, 20 bp, Homo sapiens
ataatgagatgtgagccttg

SEQ ID NO: 2355774 - DNA, 17 bp, Homo sapiens
ataatgaggagtttatg

SEQ ID NO: 2355775 - DNA, 15 bp, Homo sapiens
ataatgataaaataa

SEQ ID NO: 2355776 - DNA, 22 bp, Homo sapiens
ataatgataaaataaataattt

SEQ ID NO: 2355777 - DNA, 15 bp, Homo sapiens
ataatgctacaattt

SEQ ID NO: 2355778 - DNA, 19 bp, Homo sapiens
ataatgtactgatttcagt

SEQ ID NO: 2355779 - DNA, 20 bp, Homo sapiens
ataatgtactgatttcagta

SEQ ID NO: 2355780 - DNA, 10 bp, Homo sapiens
ataatgttaa

SEQ ID NO: 2355781 - DNA, 16 bp, Homo sapiens
ataatgttaaatttgt

SEQ ID NO: 2355782 - DNA, 13 bp, Homo sapiens
ataattgtacaaa

SEQ ID NO: 2355783 - DNA, 21 bp, Homo sapiens
ataattgtacaaaattaagca

SEQ ID NO: 2355784 - DNA, 14 bp, Homo sapiens
ataatttgaatgta

SEQ ID NO: 2355785 - DNA, 19 bp, Homo sapiens
ataatttgaatgtatttga

SEQ ID NO: 2355786 - DNA, 20 bp, Homo sapiens
ataatttgaatgtatttgat

SEQ ID NO: 2355787 - DNA, 19 bp, Homo sapiens
atacaacacattgaaactg

SEQ ID NO: 2355788 - DNA, 23 bp, Homo sapiens
atacaacacattgaaactgtatt

SEQ ID NO: 2355789 - DNA, 15 bp, Homo sapiens
atacaactgcctggg

SEQ ID NO: 2355790 - DNA, 14 bp, Homo sapiens
atatcaggtgtata

SEQ ID NO: 2355791 - DNA, 22 bp, Homo sapiens
atatcaggtgtataaatgtaca

SEQ ID NO: 2355792 - DNA, 22 bp, Homo sapiens
atatcagttacagtggcagtat

SEQ ID NO: 2355793 - DNA, 14 bp, Homo sapiens
atatcataaagcat

SEQ ID NO: 2355794 - DNA, 13 bp, Homo sapiens
atatcatgcaaaa

SEQ ID NO: 2355795 - DNA, 14 bp, Homo sapiens
atatcctgagccat

SEQ ID NO: 2355796 - DNA, 15 bp, Homo sapiens
atatcctgagccatc

SEQ ID NO: 2355797 - DNA, 12 bp, Homo sapiens
atatctaacttt

SEQ ID NO: 2355798 - DNA, 13 bp, Homo sapiens
atatctaactttg

SEQ ID NO: 2355799 - DNA, 15 bp, Homo sapiens
atatctaactttgta

SEQ ID NO: 2355800 - DNA, 13 bp, Homo sapiens
atatctatttgaa

SEQ ID NO: 2355801 - DNA, 14 bp, Homo sapiens
atatgaaataagta

SEQ ID NO: 2355802 - DNA, 20 bp, Homo sapiens
atatgaacatattgttgaaa

SEQ ID NO: 2355803 - DNA, 14 bp, Homo sapiens
atatgaattgtaca

SEQ ID NO: 2355804 - DNA, 20 bp, Homo sapiens
atatgaccagaagccttgga

SEQ ID NO: 2355805 - DNA, 13 bp, Homo sapiens
atatgatgagcag

SEQ ID NO: 2355806 - DNA, 21 bp, Homo sapiens
atatgattaaattatcattgt

SEQ ID NO: 2355807 - DNA, 17 bp, Homo sapiens
atatgcaatatatgttc

SEQ ID NO: 2355808 - DNA, 18 bp, Homo sapiens
atatgcagaaatagacaa

SEQ ID NO: 2355809 - DNA, 20 bp, Homo sapiens
atatgcagtgatatggcaga

SEQ ID NO: 2355810 - DNA, 16 bp, Homo sapiens
atatgctgatctttta

SEQ ID NO: 2355811 - DNA, 16 bp, Homo sapiens
atatggaagaaagtaa

SEQ ID NO: 2355812 - DNA, 17 bp, Homo sapiens
atatggcagaagacacc

SEQ ID NO: 2355813 - DNA, 22 bp, Homo sapiens
atatgggttgcatttggtcaag

SEQ ID NO: 2355814 - DNA, 13 bp, Homo sapiens
atatgtaatttca

SEQ ID NO: 2355815 - DNA, 20 bp, Homo sapiens
atatgtaatttcaaaataca

SEQ ID NO: 2355816 - DNA, 23 bp, Homo sapiens
atatgtaatttcaaaatacattt

SEQ ID NO: 2355817 - DNA, 18 bp, Homo sapiens
atatgtattcttttctca

SEQ ID NO: 2355818 - DNA, 21 bp, Homo sapiens
atatgtgtgcctatttgtgtg

SEQ ID NO: 2355819 - DNA, 23 bp, Homo sapiens
atatgttcatatctatgggaaaa

SEQ ID NO: 2355820 - DNA, 22 bp, Homo sapiens
atattaaaattccaaattcatg

SEQ ID NO: 2355821 - DNA, 12 bp, Homo sapiens
atattaaacaaa

SEQ ID NO: 2355822 - DNA, 18 bp, Homo sapiens
atattaaacaaagtttca

SEQ ID NO: 2355823 - DNA, 18 bp, Homo sapiens
atattaagtgtgccaaat

SEQ ID NO: 2355824 - DNA, 12 bp, Homo sapiens
atattacaatga

SEQ ID NO: 2355825 - DNA, 15 bp, Homo sapiens
atattacaatgatca

SEQ ID NO: 2355826 - DNA, 16 bp, Homo sapiens
atattacaatgatcac

SEQ ID NO: 2355827 - DNA, 14 bp, Homo sapiens
atattactgacatt

SEQ ID NO: 2355828 - DNA, 12 bp, Homo sapiens
atattatagaaa

SEQ ID NO: 2355829 - DNA, 13 bp, Homo sapiens
atattatagaaaa

SEQ ID NO: 2355830 - DNA, 22 bp, Homo sapiens
atattatagaaaattatttgta

SEQ ID NO: 2355831 - DNA, 13 bp, Homo sapiens
atattatttcttc

SEQ ID NO: 2355832 - DNA, 17 bp, Homo sapiens
atattatttcttctctt

SEQ ID NO: 2355833 - DNA, 15 bp, Homo sapiens
atattcttcaaatgt

SEQ ID NO: 2355834 - DNA, 16 bp, Homo sapiens
atattgaaaattgaaa

SEQ ID NO: 2355835 - DNA, 20 bp, Homo sapiens
atattgaaaattgaaaagta

SEQ ID NO: 2355836 - DNA, 12 bp, Homo sapiens
atattgaacttt

SEQ ID NO: 2355837 - DNA, 15 bp, Homo sapiens
atattggttcttccc

SEQ ID NO: 2355838 - DNA, 16 bp, Homo sapiens
atattggttcttcccc

SEQ ID NO: 2355839 - DNA, 13 bp, Homo sapiens
atattgtgaagta

SEQ ID NO: 2355840 - DNA, 16 bp, Homo sapiens
atattgttttcctaca

SEQ ID NO: 2355841 - DNA, 21 bp, Homo sapiens
atatttcccatttgtgccaga

SEQ ID NO: 2355842 - DNA, 23 bp, Homo sapiens
atatttcctaaggcatgtggcct

SEQ ID NO: 2355843 - DNA, 13 bp, Homo sapiens
atatttgatttct

SEQ ID NO: 2355844 - DNA, 15 bp, Homo sapiens
atatttgatttctaa

SEQ ID NO: 2355845 - DNA, 16 bp, Homo sapiens
atatttgatttctaat

SEQ ID NO: 2355846 - DNA, 18 bp, Homo sapiens
atatttgatttctaattg

SEQ ID NO: 2355847 - DNA, 13 bp, Homo sapiens
atatttgcacatg

SEQ ID NO: 2355848 - DNA, 16 bp, Homo sapiens
atattttaacctgcat

SEQ ID NO: 2355849 - DNA, 19 bp, Homo sapiens
atattttcacactggtaaa

SEQ ID NO: 2355850 - DNA, 22 bp, Homo sapiens
atattttcacactggtaaatgt

SEQ ID NO: 2355851 - DNA, 20 bp, Homo sapiens
atattttcatcctataagct

SEQ ID NO: 2355852 - DNA, 21 bp, Homo sapiens
atattttgtagttaatataaa

SEQ ID NO: 2355853 - DNA, 22 bp, Homo sapiens
atattttgtagttaatataaat

SEQ ID NO: 2355854 - DNA, 13 bp, Homo sapiens
atattttgtgtga

SEQ ID NO: 2355855 - DNA, 20 bp, Homo sapiens
atatttttaaagaatgttag

SEQ ID NO: 2355856 - DNA, 19 bp, Homo sapiens
atatttttatatttccttt

SEQ ID NO: 2355857 - DNA, 20 bp, Homo sapiens
atatttttatatttccttta

SEQ ID NO: 2355858 - DNA, 21 bp, Homo sapiens
atatttttatatttcctttat

SEQ ID NO: 2355859 - DNA, 14 bp, Homo sapiens
atatttttatcttt

SEQ ID NO: 2355860 - DNA, 19 bp, Homo sapiens
atatttttctcaatgttta

SEQ ID NO: 2355861 - DNA, 15 bp, Homo sapiens
atcaaataagaaata

SEQ ID NO: 2355862 - DNA, 12 bp, Homo sapiens
atcaactctgaa

SEQ ID NO: 2355863 - DNA, 21 bp, Homo sapiens
atcaactctgaagctaattgt

SEQ ID NO: 2355864 - DNA, 11 bp, Homo sapiens
atcaactgaat

SEQ ID NO: 2355865 - DNA, 13 bp, Homo sapiens
atcaactgaatga

SEQ ID NO: 2355866 - DNA, 13 bp, Homo sapiens
atcaagagaaact

SEQ ID NO: 2355867 - DNA, 15 bp, Homo sapiens
atcaagagaaacttc

SEQ ID NO: 2355868 - DNA, 16 bp, Homo sapiens
atcaagagaaacttca

SEQ ID NO: 2355869 - DNA, 16 bp, Homo sapiens
atcaagggaagaacta

SEQ ID NO: 2355870 - DNA, 19 bp, Homo sapiens
atcaaggttataatttttt

SEQ ID NO: 2355871 - DNA, 15 bp, Homo sapiens
atcacaatgagaaaa

SEQ ID NO: 2355872 - DNA, 20 bp, Homo sapiens
atcacaatgagaaaaataaa

SEQ ID NO: 2355873 - DNA, 17 bp, Homo sapiens
atcacattaatctcaaa

SEQ ID NO: 2355874 - DNA, 18 bp, Homo sapiens
atcacattaatctcaaag

SEQ ID NO: 2355875 - DNA, 15 bp, Homo sapiens
atcaccatgtaagca

SEQ ID NO: 2355876 - DNA, 14 bp, Homo sapiens
atcaccgctgggtg

SEQ ID NO: 2355877 - DNA, 16 bp, Homo sapiens
atcaccgctgggtggt

SEQ ID NO: 2355878 - DNA, 14 bp, Homo sapiens
atcacgatttgcag

SEQ ID NO: 2355879 - DNA, 14 bp, Homo sapiens
atcactagtggcaa

SEQ ID NO: 2355880 - DNA, 16 bp, Homo sapiens
atcactagtggcaaat

SEQ ID NO: 2355881 - DNA, 12 bp, Homo sapiens
atcactgccaca

SEQ ID NO: 2355882 - DNA, 18 bp, Homo sapiens
atcactgccacactctcc

SEQ ID NO: 2355883 - DNA, 19 bp, Homo sapiens
atcactgccacactctcca

SEQ ID NO: 2355884 - DNA, 20 bp, Homo sapiens
atcactgccacactctccat

SEQ ID NO: 2355885 - DNA, 21 bp, Homo sapiens
atcactttctcagttttcata

SEQ ID NO: 2355886 - DNA, 18 bp, Homo sapiens
atcagaaagtaacaatct

SEQ ID NO: 2355887 - DNA, 22 bp, Homo sapiens
atcagaagtatatctgtacaga

SEQ ID NO: 2355888 - DNA, 17 bp, Homo sapiens
atcagacatacagctgc

SEQ ID NO: 2355889 - DNA, 12 bp, Homo sapiens
atcagatgcctg

SEQ ID NO: 2355890 - DNA, 16 bp, Homo sapiens
atcagatgcctgcttg

SEQ ID NO: 2355891 - DNA, 16 bp, Homo sapiens
atcagcattttagaaa

SEQ ID NO: 2355892 - DNA, 20 bp, Homo sapiens
atcagcctccgccattccaa

SEQ ID NO: 2355893 - DNA, 18 bp, Homo sapiens
atcagtaaatagtgtcat

SEQ ID NO: 2355894 - DNA, 20 bp, Homo sapiens
atcagtatcacgatttgcag

SEQ ID NO: 2355895 - DNA, 15 bp, Homo sapiens
atcagttacagtggc

SEQ ID NO: 2355896 - DNA, 15 bp, Homo sapiens
atcatacaaactctc

SEQ ID NO: 2355897 - DNA, 15 bp, Homo sapiens
atcatcaagagaatt

SEQ ID NO: 2355898 - DNA, 14 bp, Homo sapiens
atcatccagaagtt

SEQ ID NO: 2355899 - DNA, 19 bp, Homo sapiens
atcatgaaaggttaaaaaa

SEQ ID NO: 2355900 - DNA, 18 bp, Homo sapiens
atcatgaatgcttttagt

SEQ ID NO: 2355901 - DNA, 14 bp, Homo sapiens
atcatgaattttaa

SEQ ID NO: 2355902 - DNA, 17 bp, Homo sapiens
atcatgaattttaaagt

SEQ ID NO: 2355903 - DNA, 19 bp, Homo sapiens
atcatgaattttaaagtat

SEQ ID NO: 2355904 - DNA, 15 bp, Homo sapiens
atcatgagcctgctg

SEQ ID NO: 2355905 - DNA, 21 bp, Homo sapiens
atcatgagcctgctggaagcc

SEQ ID NO: 2355906 - DNA, 18 bp, Homo sapiens
atctgccttaaaaccaaa

SEQ ID NO: 2355907 - DNA, 19 bp, Homo sapiens
atctgccttaaaaccaaag

SEQ ID NO: 2355908 - DNA, 22 bp, Homo sapiens
atctgcggatctcagctttgag

SEQ ID NO: 2355909 - DNA, 21 bp, Homo sapiens
atctggctgcagttttgctat

SEQ ID NO: 2355910 - DNA, 13 bp, Homo sapiens
atctgtaaactgt

SEQ ID NO: 2355911 - DNA, 14 bp, Homo sapiens
atctgtaaactgtg

SEQ ID NO: 2355912 - DNA, 22 bp, Homo sapiens
atctgtaaactgtgtattccaa

SEQ ID NO: 2355913 - DNA, 15 bp, Homo sapiens
atctgtcccccttta

SEQ ID NO: 2355914 - DNA, 18 bp, Homo sapiens
atctgtccccctttagat

SEQ ID NO: 2355915 - DNA, 17 bp, Homo sapiens
atctgttagggccttgg

SEQ ID NO: 2355916 - DNA, 11 bp, Homo sapiens
atctgttgtaa

SEQ ID NO: 2355917 - DNA, 21 bp, Homo sapiens
atctgttttgtggtttggaat

SEQ ID NO: 2355918 - DNA, 22 bp, Homo sapiens
atcttaaaagtgtgtaaatgct

SEQ ID NO: 2355919 - DNA, 10 bp, Homo sapiens
atcttaaaat

SEQ ID NO: 2355920 - DNA, 13 bp, Homo sapiens
atcttaaaataat

SEQ ID NO: 2355921 - DNA, 17 bp, Homo sapiens
atcttaagtaccaatgg

SEQ ID NO: 2355922 - DNA, 15 bp, Homo sapiens
atcttcaaagccttc

SEQ ID NO: 2355923 - DNA, 18 bp, Homo sapiens
atcttcaaagccttctcc

SEQ ID NO: 2355924 - DNA, 14 bp, Homo sapiens
atcttcaatatgaa

SEQ ID NO: 2355925 - DNA, 14 bp, Homo sapiens
atcttcagcccagg

SEQ ID NO: 2355926 - DNA, 23 bp, Homo sapiens
atcttcagcccaggcttttgcta

SEQ ID NO: 2355927 - DNA, 18 bp, Homo sapiens
atcttcgggaccaggatt

SEQ ID NO: 2355928 - DNA, 21 bp, Homo sapiens
atcttctcattcccatgtgga

SEQ ID NO: 2355929 - DNA, 16 bp, Homo sapiens
atcttctgccttctca

SEQ ID NO: 2355930 - DNA, 19 bp, Homo sapiens
atcttctttggaaataaaa

SEQ ID NO: 2355931 - DNA, 12 bp, Homo sapiens
atcttgggtgta

SEQ ID NO: 2355932 - DNA, 15 bp, Homo sapiens
atcttgggtgtattc

SEQ ID NO: 2355933 - DNA, 13 bp, Homo sapiens
atctttattgaaa

SEQ ID NO: 2355934 - DNA, 15 bp, Homo sapiens
atctttattgaaatt

SEQ ID NO: 2355935 - DNA, 12 bp, Homo sapiens
atctttcagaaa

SEQ ID NO: 2355936 - DNA, 16 bp, Homo sapiens
atctttcagaaatata

SEQ ID NO: 2355937 - DNA, 22 bp, Homo sapiens
atctttcagaaatataacacat

SEQ ID NO: 2355938 - DNA, 12 bp, Homo sapiens
atctttctcttc

SEQ ID NO: 2355939 - DNA, 14 bp, Homo sapiens
atctttctcttccc

SEQ ID NO: 2355940 - DNA, 19 bp, Homo sapiens
atcttttctaatcacagtg

SEQ ID NO: 2355941 - DNA, 16 bp, Homo sapiens
atcttttgaagcatag

SEQ ID NO: 2355942 - DNA, 15 bp, Homo sapiens
atctttttttaagtg

SEQ ID NO: 2355943 - DNA, 16 bp, Homo sapiens
atctttttttaagtgt

SEQ ID NO: 2355944 - DNA, 19 bp, Homo sapiens
atgaaaaacacggcagctg

SEQ ID NO: 2355945 - DNA, 20 bp, Homo sapiens
atgaaaaacacggcagctgt

SEQ ID NO: 2355946 - DNA, 18 bp, Homo sapiens
atgaaaaattgctgactg

SEQ ID NO: 2355947 - DNA, 14 bp, Homo sapiens
atgaaaataaaaca

SEQ ID NO: 2355948 - DNA, 14 bp, Homo sapiens
atgaaaataccatt

SEQ ID NO: 2355949 - DNA, 24 bp, Homo sapiens
atgaaaataccatttagtaagaat

SEQ ID NO: 2355950 - DNA, 21 bp, Homo sapiens
atgaaaatgtattcctttaaa

SEQ ID NO: 2355951 - DNA, 19 bp, Homo sapiens
atgaaagtagattcatgaa

SEQ ID NO: 2355952 - DNA, 21 bp, Homo sapiens
atgaaagtagattcatgaaaa

SEQ ID NO: 2355953 - DNA, 16 bp, Homo sapiens
atgaaattcttcctaa

SEQ ID NO: 2355954 - DNA, 15 bp, Homo sapiens
atgaaatttaagcac

SEQ ID NO: 2355955 - DNA, 16 bp, Homo sapiens
atgaaatttaagcaca

SEQ ID NO: 2355956 - DNA, 13 bp, Homo sapiens
atgaacagctgtg

SEQ ID NO: 2355957 - DNA, 21 bp, Homo sapiens
atgaacagctgtgtctgccaa

SEQ ID NO: 2355958 - DNA, 21 bp, Homo sapiens
atgaacatattgttgaaaggt

SEQ ID NO: 2355959 - DNA, 19 bp, Homo sapiens
atgaagaaaatcacttagg

SEQ ID NO: 2355960 - DNA, 18 bp, Homo sapiens
atgaagaaagtcaaaaaa

SEQ ID NO: 2355961 - DNA, 15 bp, Homo sapiens
atgaagaactgagga

SEQ ID NO: 2355962 - DNA, 17 bp, Homo sapiens
atgaatccattggagaa

SEQ ID NO: 2355963 - DNA, 17 bp, Homo sapiens
atgaatgattaaattat

SEQ ID NO: 2355964 - DNA, 16 bp, Homo sapiens
atgaatgcttttagtg

SEQ ID NO: 2355965 - DNA, 22 bp, Homo sapiens
atgaatgtaaggatgagggaag

SEQ ID NO: 2355966 - DNA, 22 bp, Homo sapiens
atgaattgtacagaatatttct

SEQ ID NO: 2355967 - DNA, 22 bp, Homo sapiens
atgaattttaaagtatgcatta

SEQ ID NO: 2355968 - DNA, 14 bp, Homo sapiens
atgacaagtgactt

SEQ ID NO: 2355969 - DNA, 21 bp, Homo sapiens
atgacagaggctgcacccctg

SEQ ID NO: 2355970 - DNA, 16 bp, Homo sapiens
atgacagatattttat

SEQ ID NO: 2355971 - DNA, 18 bp, Homo sapiens
atgacctagttttccatg

SEQ ID NO: 2355972 - DNA, 19 bp, Homo sapiens
atgacggaagaacatagaa

SEQ ID NO: 2355973 - DNA, 21 bp, Homo sapiens
atgacggaagaacatagaact

SEQ ID NO: 2355974 - DNA, 19 bp, Homo sapiens
atgacggtaagtgttctca

SEQ ID NO: 2355975 - DNA, 20 bp, Homo sapiens
atgacggtaagtgttctcat

SEQ ID NO: 2355976 - DNA, 12 bp, Homo sapiens
atgactaaagag

SEQ ID NO: 2355977 - DNA, 13 bp, Homo sapiens
atgactaaagaga

SEQ ID NO: 2355978 - DNA, 16 bp, Homo sapiens
atgactaaagagagaa

SEQ ID NO: 2355979 - DNA, 23 bp, Homo sapiens
atgactaaagagagaatgtagat

SEQ ID NO: 2355980 - DNA, 15 bp, Homo sapiens
atgactaatgctttt

SEQ ID NO: 2355981 - DNA, 22 bp, Homo sapiens
atgactatataatttatttcca

SEQ ID NO: 2355982 - DNA, 22 bp, Homo sapiens
atgactatgcgtggctggaacc

SEQ ID NO: 2355983 - DNA, 17 bp, Homo sapiens
atgactgccttgcctcc

SEQ ID NO: 2355984 - DNA, 22 bp, Homo sapiens
atgacttccttatttctgaaca

SEQ ID NO: 2355985 - DNA, 15 bp, Homo sapiens
atgagaaaaataaat

SEQ ID NO: 2355986 - DNA, 13 bp, Homo sapiens
atgagaagccaag

SEQ ID NO: 2355987 - DNA, 18 bp, Homo sapiens
atgagagcccagaggtaa

SEQ ID NO: 2355988 - DNA, 20 bp, Homo sapiens
atgagattggttttcctgtg

SEQ ID NO: 2355989 - DNA, 14 bp, Homo sapiens
atgagccagacaaa

SEQ ID NO: 2355990 - DNA, 21 bp, Homo sapiens
atgagcccaccctgctgagat

SEQ ID NO: 2355991 - DNA, 14 bp, Homo sapiens
atgagcctgctgga

SEQ ID NO: 2355992 - DNA, 20 bp, Homo sapiens
atgagcctgctggaagccca

SEQ ID NO: 2355993 - DNA, 18 bp, Homo sapiens
atgagctatcctttcaaa

SEQ ID NO: 2355994 - DNA, 19 bp, Homo sapiens
atgagctctgaaatcttcc

SEQ ID NO: 2355995 - DNA, 22 bp, Homo sapiens
atgagctgctcattacagttct

SEQ ID NO: 2355996 - DNA, 15 bp, Homo sapiens
atgaggaaaattctt

SEQ ID NO: 2355997 - DNA, 13 bp, Homo sapiens
atgaggaggggag

SEQ ID NO: 2355998 - DNA, 23 bp, Homo sapiens
atgaggaggggagcgtctgggaa

SEQ ID NO: 2355999 - DNA, 17 bp, Homo sapiens
atgaggaggggagggta

SEQ ID NO: 2356000 - DNA, 21 bp, Homo sapiens
atgaggaggggcccccctgcc

SEQ ID NO: 2356001 - DNA, 12 bp, Homo sapiens
atgaggggagag

SEQ ID NO: 2356002 - DNA, 14 bp, Homo sapiens
atgaggggagagga

SEQ ID NO: 2356003 - DNA, 22 bp, Homo sapiens
atgaggtgggaggtggaagaag

SEQ ID NO: 2356004 - DNA, 19 bp, Homo sapiens
atgagtaaaaactagaagg

SEQ ID NO: 2356005 - DNA, 22 bp, Homo sapiens
atgagtagataatttcagggtg

SEQ ID NO: 2356006 - DNA, 15 bp, Homo sapiens
atgagttgaaatgtt

SEQ ID NO: 2356007 - DNA, 12 bp, Homo sapiens
atgataaaataa

SEQ ID NO: 2356008 - DNA, 16 bp, Homo sapiens
atgataaactcagatc

SEQ ID NO: 2356009 - DNA, 20 bp, Homo sapiens
atgataaactcagatctgat

SEQ ID NO: 2356010 - DNA, 16 bp, Homo sapiens
atgatcagacatacag

SEQ ID NO: 2356011 - DNA, 15 bp, Homo sapiens
atgatgctaagctga

SEQ ID NO: 2356012 - DNA, 16 bp, Homo sapiens
atgatgtatatccata

SEQ ID NO: 2356013 - DNA, 13 bp, Homo sapiens
atgatttaataaa

SEQ ID NO: 2356014 - DNA, 16 bp, Homo sapiens
atgatttaataaaata

SEQ ID NO: 2356015 - DNA, 18 bp, Homo sapiens
atgatttaataaaataat

SEQ ID NO: 2356016 - DNA, 19 bp, Homo sapiens
atgatttaataaaataatt

SEQ ID NO: 2356017 - DNA, 15 bp, Homo sapiens
atgatttccttcaat

SEQ ID NO: 2356018 - DNA, 15 bp, Homo sapiens
atgattttttgaaag

SEQ ID NO: 2356019 - DNA, 23 bp, Homo sapiens
atgattttttgaaagttaacatt

SEQ ID NO: 2356020 - DNA, 21 bp, Homo sapiens
atgatttttttttcatacact

SEQ ID NO: 2356021 - DNA, 17 bp, Homo sapiens
atggcatcttcaatatg

SEQ ID NO: 2356022 - DNA, 22 bp, Homo sapiens
atggcatttggtctcaggcagc

SEQ ID NO: 2356023 - DNA, 13 bp, Homo sapiens
atggccagcccct

SEQ ID NO: 2356024 - DNA, 14 bp, Homo sapiens
atggccagcccctg

SEQ ID NO: 2356025 - DNA, 15 bp, Homo sapiens
atggccatgcaggag

SEQ ID NO: 2356026 - DNA, 11 bp, Homo sapiens
atggccctgtc

SEQ ID NO: 2356027 - DNA, 17 bp, Homo sapiens
atggcctgcaaactggg

SEQ ID NO: 2356028 - DNA, 22 bp, Homo sapiens
atggcctgcaaactgggaaccc

SEQ ID NO: 2356029 - DNA, 23 bp, Homo sapiens
atggcctttccttccctctctga

SEQ ID NO: 2356030 - DNA, 14 bp, Homo sapiens
atggcgccctgcct

SEQ ID NO: 2356031 - DNA, 19 bp, Homo sapiens
atggcgccctgcctcctgg

SEQ ID NO: 2356032 - DNA, 15 bp, Homo sapiens
atggctgctgttgct

SEQ ID NO: 2356033 - DNA, 21 bp, Homo sapiens
atggctgtggcatttccaaac

SEQ ID NO: 2356034 - DNA, 22 bp, Homo sapiens
atggctgtgttggtgtggccca

SEQ ID NO: 2356035 - DNA, 14 bp, Homo sapiens
atggcttatttcta

SEQ ID NO: 2356036 - DNA, 22 bp, Homo sapiens
atggcttatttctatgacaaat

SEQ ID NO: 2356037 - DNA, 13 bp, Homo sapiens
atggcttgtctat

SEQ ID NO: 2356038 - DNA, 20 bp, Homo sapiens
atggcttgtctatactcctt

SEQ ID NO: 2356039 - DNA, 23 bp, Homo sapiens
atgggaacagtaaagaaagcaga

SEQ ID NO: 2356040 - DNA, 22 bp, Homo sapiens
atgggaagccatattcacacct

SEQ ID NO: 2356041 - DNA, 14 bp, Homo sapiens
atgggaagtcctgg

SEQ ID NO: 2356042 - DNA, 13 bp, Homo sapiens
atgggacctggcc

SEQ ID NO: 2356043 - DNA, 19 bp, Homo sapiens
atgggacctgtggctgtcg

SEQ ID NO: 2356044 - DNA, 14 bp, Homo sapiens
atgggaggaattca

SEQ ID NO: 2356045 - DNA, 20 bp, Homo sapiens
atgggagggggcttgaagcc

SEQ ID NO: 2356046 - DNA, 23 bp, Homo sapiens
atgggagggggcttgaagccaaa

SEQ ID NO: 2356047 - DNA, 16 bp, Homo sapiens
atggggagggagggag

SEQ ID NO: 2356048 - DNA, 17 bp, Homo sapiens
atggggcaggccacctg

SEQ ID NO: 2356049 - DNA, 23 bp, Homo sapiens
atggggcaggccacctggctctc

SEQ ID NO: 2356050 - DNA, 14 bp, Homo sapiens
atgggtcagagcta

SEQ ID NO: 2356051 - DNA, 12 bp, Homo sapiens
atgggtccaggg

SEQ ID NO: 2356052 - DNA, 16 bp, Homo sapiens
atgggtggacacggat

SEQ ID NO: 2356053 - DNA, 20 bp, Homo sapiens
atgggtgtatataattttat

SEQ ID NO: 2356054 - DNA, 13 bp, Homo sapiens
atggtaagagaaa

SEQ ID NO: 2356055 - DNA, 13 bp, Homo sapiens
atggtaataagca

SEQ ID NO: 2356056 - DNA, 20 bp, Homo sapiens
atggtaatctttacctgtat

SEQ ID NO: 2356057 - DNA, 18 bp, Homo sapiens
atggtaggggagggcagg

SEQ ID NO: 2356058 - DNA, 21 bp, Homo sapiens
atggtcacgtttggtgcttct

SEQ ID NO: 2356059 - DNA, 15 bp, Homo sapiens
atggtcctagacaaa

SEQ ID NO: 2356060 - DNA, 20 bp, Homo sapiens
atggtctggcaatattctgt

SEQ ID NO: 2356061 - DNA, 19 bp, Homo sapiens
atggtgaaaccccgtctct

SEQ ID NO: 2356062 - DNA, 18 bp, Homo sapiens
atggtgcctgagaggcag

SEQ ID NO: 2356063 - DNA, 16 bp, Homo sapiens
atggtgtaataagaca

SEQ ID NO: 2356064 - DNA, 22 bp, Homo sapiens
atggtgtaataagacataacgt

SEQ ID NO: 2356065 - DNA, 21 bp, Homo sapiens
atggtgtcccggtaccttcca

SEQ ID NO: 2356066 - DNA, 18 bp, Homo sapiens
atggtgtgaacccgggag

SEQ ID NO: 2356067 - DNA, 15 bp, Homo sapiens
atggtgtgtttgtaa

SEQ ID NO: 2356068 - DNA, 16 bp, Homo sapiens
atggtgtgtttgtaat

SEQ ID NO: 2356069 - DNA, 20 bp, Homo sapiens
atggttctccaagaaactga

SEQ ID NO: 2356070 - DNA, 12 bp, Homo sapiens
atgtaaaatgtt

SEQ ID NO: 2356071 - DNA, 17 bp, Homo sapiens
atgtaaactatttgtgg

SEQ ID NO: 2356072 - DNA, 21 bp, Homo sapiens
atgtaaagatatttttatctt

SEQ ID NO: 2356073 - DNA, 18 bp, Homo sapiens
atgtaaatagctaagata

SEQ ID NO: 2356074 - DNA, 20 bp, Homo sapiens
atgtaaatagctaagatata

SEQ ID NO: 2356075 - DNA, 16 bp, Homo sapiens
atgtaacaacaattat

SEQ ID NO: 2356076 - DNA, 23 bp, Homo sapiens
atgtaacacaggataaagttatt

SEQ ID NO: 2356077 - DNA, 17 bp, Homo sapiens
atgtaaccaatcctact

SEQ ID NO: 2356078 - DNA, 13 bp, Homo sapiens
atgtaagcatttg

SEQ ID NO: 2356079 - DNA, 15 bp, Homo sapiens
atgtaattatatata

SEQ ID NO: 2356080 - DNA, 12 bp, Homo sapiens
atgtaatttaaa

SEQ ID NO: 2356081 - DNA, 15 bp, Homo sapiens
atgtaatttaaatga

SEQ ID NO: 2356082 - DNA, 16 bp, Homo sapiens
atgtaatttcaaaata

SEQ ID NO: 2356083 - DNA, 23 bp, Homo sapiens
atgtaattttattttaaaatttc

SEQ ID NO: 2356084 - DNA, 20 bp, Homo sapiens
atgtacaaaaaaaaaaccct

SEQ ID NO: 2356085 - DNA, 13 bp, Homo sapiens
atgtacaaacatg

SEQ ID NO: 2356086 - DNA, 18 bp, Homo sapiens
atgtacagaggtcagcac

SEQ ID NO: 2356087 - DNA, 14 bp, Homo sapiens
atgtacagattctt

SEQ ID NO: 2356088 - DNA, 18 bp, Homo sapiens
atgtacagattctttcag

SEQ ID NO: 2356089 - DNA, 19 bp, Homo sapiens
atgtacattgtacccaata

SEQ ID NO: 2356090 - DNA, 18 bp, Homo sapiens
atgtagaggcttgtttac

SEQ ID NO: 2356091 - DNA, 14 bp, Homo sapiens
atgtataaatatac

SEQ ID NO: 2356092 - DNA, 14 bp, Homo sapiens
atgtatagtgtcta

SEQ ID NO: 2356093 - DNA, 21 bp, Homo sapiens
atgtatattaaaaaagagaca

SEQ ID NO: 2356094 - DNA, 16 bp, Homo sapiens
atgtatgtgtggctgt

SEQ ID NO: 2356095 - DNA, 15 bp, Homo sapiens
atgtattcctttaaa

SEQ ID NO: 2356096 - DNA, 18 bp, Homo sapiens
atgtattcctttaaaata

SEQ ID NO: 2356097 - DNA, 20 bp, Homo sapiens
atgtattcctttaaaatatt

SEQ ID NO: 2356098 - DNA, 12 bp, Homo sapiens
atgtatttgatt

SEQ ID NO: 2356099 - DNA, 11 bp, Homo sapiens
atgtcagcctt

SEQ ID NO: 2356100 - DNA, 14 bp, Homo sapiens
atgtcagccttgca

SEQ ID NO: 2356101 - DNA, 15 bp, Homo sapiens
atgtccaaagaggct

SEQ ID NO: 2356102 - DNA, 22 bp, Homo sapiens
atgtccaaagaggctgcccctc

SEQ ID NO: 2356103 - DNA, 13 bp, Homo sapiens
atgtccatacact

SEQ ID NO: 2356104 - DNA, 13 bp, Homo sapiens
atgtccctccaac

SEQ ID NO: 2356105 - DNA, 17 bp, Homo sapiens
atgtctcactttacttt

SEQ ID NO: 2356106 - DNA, 23 bp, Homo sapiens
atgtctcaggtttgttttgtgaa

SEQ ID NO: 2356107 - DNA, 15 bp, Homo sapiens
atgtctcatgtttta

SEQ ID NO: 2356108 - DNA, 13 bp, Homo sapiens
atgtctcctcccc

SEQ ID NO: 2356109 - DNA, 19 bp, Homo sapiens
atgtctgctggtatttcta

SEQ ID NO: 2356110 - DNA, 16 bp, Homo sapiens
atgtctgtagctcctc

SEQ ID NO: 2356111 - DNA, 14 bp, Homo sapiens
atgtcttcatgttg

SEQ ID NO: 2356112 - DNA, 19 bp, Homo sapiens
atgtcttcatgttgatgtg

SEQ ID NO: 2356113 - DNA, 13 bp, Homo sapiens
atgtcttccctgg

SEQ ID NO: 2356114 - DNA, 24 bp, Homo sapiens
atgtcttccctgggctgccaccag

SEQ ID NO: 2356115 - DNA, 15 bp, Homo sapiens
atgtcttctccctgg

SEQ ID NO: 2356116 - DNA, 20 bp, Homo sapiens
atgtcttggacactgtacaa

SEQ ID NO: 2356117 - DNA, 14 bp, Homo sapiens
atgtcttgtacatg

SEQ ID NO: 2356118 - DNA, 17 bp, Homo sapiens
atgtcttgtacatgtgt

SEQ ID NO: 2356119 - DNA, 22 bp, Homo sapiens
atgtcttgtacatgtgtagcct

SEQ ID NO: 2356120 - DNA, 16 bp, Homo sapiens
atgtcttgtatttaaa

SEQ ID NO: 2356121 - DNA, 15 bp, Homo sapiens
atgtctttttattaa

SEQ ID NO: 2356122 - DNA, 13 bp, Homo sapiens
atgtgaaaaatta

SEQ ID NO: 2356123 - DNA, 15 bp, Homo sapiens
atgtgaaaaattaac

SEQ ID NO: 2356124 - DNA, 18 bp, Homo sapiens
atgtgaaaaattaacttt

SEQ ID NO: 2356125 - DNA, 18 bp, Homo sapiens
atgtgaaaccttttttaa

SEQ ID NO: 2356126 - DNA, 19 bp, Homo sapiens
atgtgaaaccttttttaag

SEQ ID NO: 2356127 - DNA, 20 bp, Homo sapiens
atgtgaaaccttttttaaga

SEQ ID NO: 2356128 - DNA, 22 bp, Homo sapiens
atgtgaaaccttttttaagatt

SEQ ID NO: 2356129 - DNA, 16 bp, Homo sapiens
atgtgaatttttaagc

SEQ ID NO: 2356130 - DNA, 11 bp, Homo sapiens
atgtgacacat

SEQ ID NO: 2356131 - DNA, 18 bp, Homo sapiens
atgtgacattaacaaata

SEQ ID NO: 2356132 - DNA, 12 bp, Homo sapiens
atgtgaccctcc

SEQ ID NO: 2356133 - DNA, 14 bp, Homo sapiens
atgtgactaaagga

SEQ ID NO: 2356134 - DNA, 21 bp, Homo sapiens
atgtgacttggattcaatttt

SEQ ID NO: 2356135 - DNA, 18 bp, Homo sapiens
atgtgagatggttcccaa

SEQ ID NO: 2356136 - DNA, 19 bp, Homo sapiens
attatgagttttaagaagg

SEQ ID NO: 2356137 - DNA, 21 bp, Homo sapiens
attatgcacttttagaaatgc

SEQ ID NO: 2356138 - DNA, 16 bp, Homo sapiens
attattaataatgaag

SEQ ID NO: 2356139 - DNA, 20 bp, Homo sapiens
attattactttatgaacaat

SEQ ID NO: 2356140 - DNA, 12 bp, Homo sapiens
attattcaagaa

SEQ ID NO: 2356141 - DNA, 19 bp, Homo sapiens
attattcataatgtgagat

SEQ ID NO: 2356142 - DNA, 12 bp, Homo sapiens
attattgacact

SEQ ID NO: 2356143 - DNA, 13 bp, Homo sapiens
attattgacactg

SEQ ID NO: 2356144 - DNA, 15 bp, Homo sapiens
attattgacactgaa

SEQ ID NO: 2356145 - DNA, 12 bp, Homo sapiens
attatttcaaaa

SEQ ID NO: 2356146 - DNA, 17 bp, Homo sapiens
attatttcaaaatgata

SEQ ID NO: 2356147 - DNA, 14 bp, Homo sapiens
attatttcttctct

SEQ ID NO: 2356148 - DNA, 16 bp, Homo sapiens
attatttcttctctta

SEQ ID NO: 2356149 - DNA, 19 bp, Homo sapiens
attatttgattatttaaga

SEQ ID NO: 2356150 - DNA, 16 bp, Homo sapiens
attatttgctatggca

SEQ ID NO: 2356151 - DNA, 14 bp, Homo sapiens
attatttttataat

SEQ ID NO: 2356152 - DNA, 19 bp, Homo sapiens
attatttttttaaaatttt

SEQ ID NO: 2356153 - DNA, 21 bp, Homo sapiens
attatttttttaaaattttgt

SEQ ID NO: 2356154 - DNA, 22 bp, Homo sapiens
attatttttttaaaattttgta

SEQ ID NO: 2356155 - DNA, 21 bp, Homo sapiens
attcaaaagtattgaaagcca

SEQ ID NO: 2356156 - DNA, 17 bp, Homo sapiens
attcaatctgtaaactg

SEQ ID NO: 2356157 - DNA, 24 bp, Homo sapiens
attcaattagtggtcataaaatag

SEQ ID NO: 2356158 - DNA, 16 bp, Homo sapiens
attcacaataaaagct

SEQ ID NO: 2356159 - DNA, 13 bp, Homo sapiens
attcactggcccc

SEQ ID NO: 2356160 - DNA, 16 bp, Homo sapiens
attcacttccagagag

SEQ ID NO: 2356161 - DNA, 13 bp, Homo sapiens
attcagaaatgtt

SEQ ID NO: 2356162 - DNA, 15 bp, Homo sapiens
attcagtgagggtct

SEQ ID NO: 2356163 - DNA, 16 bp, Homo sapiens
attcagtgagggtctt

SEQ ID NO: 2356164 - DNA, 13 bp, Homo sapiens
attcagttttttt

SEQ ID NO: 2356165 - DNA, 19 bp, Homo sapiens
attcagtttttttccagtt

SEQ ID NO: 2356166 - DNA, 13 bp, Homo sapiens
attcataataaat

SEQ ID NO: 2356167 - DNA, 19 bp, Homo sapiens
attcataataaattttcta

SEQ ID NO: 2356168 - DNA, 20 bp, Homo sapiens
attcataataaattttctaa

SEQ ID NO: 2356169 - DNA, 13 bp, Homo sapiens
attcataatgtga

SEQ ID NO: 2356170 - DNA, 21 bp, Homo sapiens
attcatatctaaatagtattt

SEQ ID NO: 2356171 - DNA, 14 bp, Homo sapiens
attccaaaatatta

SEQ ID NO: 2356172 - DNA, 13 bp, Homo sapiens
attccaagaacta

SEQ ID NO: 2356173 - DNA, 22 bp, Homo sapiens
attccaagacatgtctgttcta

SEQ ID NO: 2356174 - DNA, 22 bp, Homo sapiens
attccaagggtatgggaagcca

SEQ ID NO: 2356175 - DNA, 16 bp, Homo sapiens
attccactacacctgg

SEQ ID NO: 2356176 - DNA, 17 bp, Homo sapiens
attccactacacctggc

SEQ ID NO: 2356177 - DNA, 19 bp, Homo sapiens
attccagatctttcagaaa

SEQ ID NO: 2356178 - DNA, 17 bp, Homo sapiens
attccagtacagtattc

SEQ ID NO: 2356179 - DNA, 16 bp, Homo sapiens
attccatacttctctc

SEQ ID NO: 2356180 - DNA, 18 bp, Homo sapiens
attccatgagctgctcat

SEQ ID NO: 2356181 - DNA, 21 bp, Homo sapiens
attccatgagctgctcattac

SEQ ID NO: 2356182 - DNA, 15 bp, Homo sapiens
attcccttctgggct

SEQ ID NO: 2356183 - DNA, 14 bp, Homo sapiens
attcctattaatgt

SEQ ID NO: 2356184 - DNA, 22 bp, Homo sapiens
attcctattaatgtctcacttt

SEQ ID NO: 2356185 - DNA, 22 bp, Homo sapiens
attcctgacctccgccatccac

SEQ ID NO: 2356186 - DNA, 19 bp, Homo sapiens
attcctgatcccatggcca

SEQ ID NO: 2356187 - DNA, 20 bp, Homo sapiens
attcctggcatgacactcta

SEQ ID NO: 2356188 - DNA, 21 bp, Homo sapiens
attcctggcatgacactctag

SEQ ID NO: 2356189 - DNA, 22 bp, Homo sapiens
attcctggctctaccctgtctg

SEQ ID NO: 2356190 - DNA, 20 bp, Homo sapiens
attccttagataccttgaaa

SEQ ID NO: 2356191 - DNA, 21 bp, Homo sapiens
attccttgcgcctcagccctc

SEQ ID NO: 2356192 - DNA, 12 bp, Homo sapiens
attcctttaaaa

SEQ ID NO: 2356193 - DNA, 14 bp, Homo sapiens
attcctttaaaata

SEQ ID NO: 2356194 - DNA, 14 bp, Homo sapiens
attcctttgcatat

SEQ ID NO: 2356195 - DNA, 21 bp, Homo sapiens
attcggaactgtcctttcctt

SEQ ID NO: 2356196 - DNA, 18 bp, Homo sapiens
attcgtatccagctcttt

SEQ ID NO: 2356197 - DNA, 21 bp, Homo sapiens
attcgtgattttcaagcagca

SEQ ID NO: 2356198 - DNA, 23 bp, Homo sapiens
attctagtgtccataaataaagt

SEQ ID NO: 2356199 - DNA, 15 bp, Homo sapiens
attctcaagacctga

SEQ ID NO: 2356200 - DNA, 12 bp, Homo sapiens
attctcactgct

SEQ ID NO: 2356201 - DNA, 20 bp, Homo sapiens
attctcccaggtaccagctg

SEQ ID NO: 2356202 - DNA, 12 bp, Homo sapiens
attctctcttta

SEQ ID NO: 2356203 - DNA, 23 bp, Homo sapiens
attctgattattgagttccagtt

SEQ ID NO: 2356204 - DNA, 23 bp, Homo sapiens
attctgcagaaaattaattgaaa

SEQ ID NO: 2356205 - DNA, 21 bp, Homo sapiens
attctgccgccccctcctgaa

SEQ ID NO: 2356206 - DNA, 19 bp, Homo sapiens
attctggaaacttttgtta

SEQ ID NO: 2356207 - DNA, 16 bp, Homo sapiens
attctggacctctggg

SEQ ID NO: 2356208 - DNA, 19 bp, Homo sapiens
attctggctttaagccttc

SEQ ID NO: 2356209 - DNA, 22 bp, Homo sapiens
attctggggaaacaacatttat

SEQ ID NO: 2356210 - DNA, 17 bp, Homo sapiens
attcttactaaaaagta

SEQ ID NO: 2356211 - DNA, 22 bp, Homo sapiens
attcttactaaaaagtataaaa

SEQ ID NO: 2356212 - DNA, 20 bp, Homo sapiens
attcttgttgctgtacaaaa

SEQ ID NO: 2356213 - DNA, 22 bp, Homo sapiens
attctttagagattataacaaa

SEQ ID NO: 2356214 - DNA, 17 bp, Homo sapiens
attctttcagttctttg

SEQ ID NO: 2356215 - DNA, 15 bp, Homo sapiens
attcttttaaatctc

SEQ ID NO: 2356216 - DNA, 19 bp, Homo sapiens
attcttttctcagtgttgg

SEQ ID NO: 2356217 - DNA, 13 bp, Homo sapiens
attgaaaaggaca

SEQ ID NO: 2356218 - DNA, 19 bp, Homo sapiens
attgaaaagtttttgtttg

SEQ ID NO: 2356219 - DNA, 23 bp, Homo sapiens
attgaaaagtttttgtttggaga

SEQ ID NO: 2356220 - DNA, 14 bp, Homo sapiens
attgaaactgtatt

SEQ ID NO: 2356221 - DNA, 18 bp, Homo sapiens
attgaaactgtatttact

SEQ ID NO: 2356222 - DNA, 20 bp, Homo sapiens
attgaaactgtatttacttg

SEQ ID NO: 2356223 - DNA, 13 bp, Homo sapiens
attgaaagccaac

SEQ ID NO: 2356224 - DNA, 17 bp, Homo sapiens
attgaacttttgtactg

SEQ ID NO: 2356225 - DNA, 23 bp, Homo sapiens
attgaacttttgtactgaatttt

SEQ ID NO: 2356226 - DNA, 16 bp, Homo sapiens
attgaagaatgttaga

SEQ ID NO: 2356227 - DNA, 19 bp, Homo sapiens
attgaagtattttgctgga

SEQ ID NO: 2356228 - DNA, 15 bp, Homo sapiens
attgaagtttcaagt

SEQ ID NO: 2356229 - DNA, 12 bp, Homo sapiens
attgacactgaa

SEQ ID NO: 2356230 - DNA, 13 bp, Homo sapiens
attgacagaagct

SEQ ID NO: 2356231 - DNA, 13 bp, Homo sapiens
attgaccattttt

SEQ ID NO: 2356232 - DNA, 22 bp, Homo sapiens
attgaccattttttaatttact

SEQ ID NO: 2356233 - DNA, 19 bp, Homo sapiens
attgactaactcaaataca

SEQ ID NO: 2356234 - DNA, 23 bp, Homo sapiens
attgactaactcaaatacacatt

SEQ ID NO: 2356235 - DNA, 21 bp, Homo sapiens
attgagattttccattaacta

SEQ ID NO: 2356236 - DNA, 15 bp, Homo sapiens
attgagtattgttta

SEQ ID NO: 2356237 - DNA, 14 bp, Homo sapiens
attgatccaggaga

SEQ ID NO: 2356238 - DNA, 19 bp, Homo sapiens
attgattgggaaaacattt

SEQ ID NO: 2356239 - DNA, 20 bp, Homo sapiens
attgattgggaaaacatttg

SEQ ID NO: 2356240 - DNA, 14 bp, Homo sapiens
attgcaacagactg

SEQ ID NO: 2356241 - DNA, 19 bp, Homo sapiens
attgcactagagaaaataa

SEQ ID NO: 2356242 - DNA, 19 bp, Homo sapiens
attgcatcactgtatcatt

SEQ ID NO: 2356243 - DNA, 14 bp, Homo sapiens
attgccagcaaata

SEQ ID NO: 2356244 - DNA, 16 bp, Homo sapiens
attgcctcccaggcaa

SEQ ID NO: 2356245 - DNA, 18 bp, Homo sapiens
attgcctctgaaaagtgt

SEQ ID NO: 2356246 - DNA, 19 bp, Homo sapiens
attgctcttagtcccaagc

SEQ ID NO: 2356247 - DNA, 12 bp, Homo sapiens
attgctgaaatt

SEQ ID NO: 2356248 - DNA, 13 bp, Homo sapiens
attgctgaaattt

SEQ ID NO: 2356249 - DNA, 16 bp, Homo sapiens
attgctgaaattttat

SEQ ID NO: 2356250 - DNA, 19 bp, Homo sapiens
atttgcaggattcccttct

SEQ ID NO: 2356251 - DNA, 22 bp, Homo sapiens
atttgcaggattcccttctggg

SEQ ID NO: 2356252 - DNA, 15 bp, Homo sapiens
atttgccatgggctt

SEQ ID NO: 2356253 - DNA, 11 bp, Homo sapiens
atttgcctcac

SEQ ID NO: 2356254 - DNA, 20 bp, Homo sapiens
atttgcctcaccttggggcc

SEQ ID NO: 2356255 - DNA, 19 bp, Homo sapiens
atttgctcataagtaaatg

SEQ ID NO: 2356256 - DNA, 21 bp, Homo sapiens
atttgctcataagtaaatgtc

SEQ ID NO: 2356257 - DNA, 16 bp, Homo sapiens
atttggaagagaggca

SEQ ID NO: 2356258 - DNA, 22 bp, Homo sapiens
atttggggctacttatattctg

SEQ ID NO: 2356259 - DNA, 14 bp, Homo sapiens
atttgggtgggagt

SEQ ID NO: 2356260 - DNA, 18 bp, Homo sapiens
atttggttatgttgataa

SEQ ID NO: 2356261 - DNA, 18 bp, Homo sapiens
atttgtaaggagctaaag

SEQ ID NO: 2356262 - DNA, 15 bp, Homo sapiens
atttgtaagtgtaaa

SEQ ID NO: 2356263 - DNA, 21 bp, Homo sapiens
atttgtaagtgtaaaaaatgt

SEQ ID NO: 2356264 - DNA, 14 bp, Homo sapiens
atttgtaagtttca

SEQ ID NO: 2356265 - DNA, 14 bp, Homo sapiens
atttgtacatcttc

SEQ ID NO: 2356266 - DNA, 21 bp, Homo sapiens
atttgtacatcttctttggaa

SEQ ID NO: 2356267 - DNA, 23 bp, Homo sapiens
atttgtatgaataatgaaaataa

SEQ ID NO: 2356268 - DNA, 16 bp, Homo sapiens
atttgtcttaaaaatt

SEQ ID NO: 2356269 - DNA, 20 bp, Homo sapiens
atttgtcttaaaaatttata

SEQ ID NO: 2356270 - DNA, 14 bp, Homo sapiens
atttgtgtaactga

SEQ ID NO: 2356271 - DNA, 16 bp, Homo sapiens
atttgtgtaactgaaa

SEQ ID NO: 2356272 - DNA, 18 bp, Homo sapiens
atttgtttgctgtacaga

SEQ ID NO: 2356273 - DNA, 22 bp, Homo sapiens
atttgtttgtctgtttttactc

SEQ ID NO: 2356274 - DNA, 16 bp, Homo sapiens
attttaaaatttcata

SEQ ID NO: 2356275 - DNA, 17 bp, Homo sapiens
attttaaagtatgcatt

SEQ ID NO: 2356276 - DNA, 22 bp, Homo sapiens
attttaaagtatgcattattaa

SEQ ID NO: 2356277 - DNA, 17 bp, Homo sapiens
attttaaagtgcaaaag

SEQ ID NO: 2356278 - DNA, 22 bp, Homo sapiens
attttaacctatgatattttct

SEQ ID NO: 2356279 - DNA, 17 bp, Homo sapiens
attttaacctgcataaa

SEQ ID NO: 2356280 - DNA, 20 bp, Homo sapiens
attttaacttaactgaaatg

SEQ ID NO: 2356281 - DNA, 15 bp, Homo sapiens
attttaagaagacat

SEQ ID NO: 2356282 - DNA, 17 bp, Homo sapiens
attttaagtttgtagta

SEQ ID NO: 2356283 - DNA, 10 bp, Homo sapiens
attttaatac

SEQ ID NO: 2356284 - DNA, 17 bp, Homo sapiens
attttaatacaagtaat

SEQ ID NO: 2356285 - DNA, 22 bp, Homo sapiens
attttacctagctaattattta

SEQ ID NO: 2356286 - DNA, 20 bp, Homo sapiens
attttagaaactacaaatat

SEQ ID NO: 2356287 - DNA, 13 bp, Homo sapiens
attttagaaatat

SEQ ID NO: 2356288 - DNA, 15 bp, Homo sapiens
attttagaaatattc

SEQ ID NO: 2356289 - DNA, 12 bp, Homo sapiens
attttatgttta

SEQ ID NO: 2356290 - DNA, 17 bp, Homo sapiens
attttatgtttaaaatg

SEQ ID NO: 2356291 - DNA, 21 bp, Homo sapiens
attttatgtttaaaatggcat

SEQ ID NO: 2356292 - DNA, 11 bp, Homo sapiens
attttattatg

SEQ ID NO: 2356293 - DNA, 17 bp, Homo sapiens
attttattcttatttca

SEQ ID NO: 2356294 - DNA, 22 bp, Homo sapiens
attttatttagacaagagatgg

SEQ ID NO: 2356295 - DNA, 24 bp, Homo sapiens
attttcaagaataatcacgctttc

SEQ ID NO: 2356296 - DNA, 15 bp, Homo sapiens
attttcaagattcta

SEQ ID NO: 2356297 - DNA, 18 bp, Homo sapiens
attttcaagattctaaag

SEQ ID NO: 2356298 - DNA, 22 bp, Homo sapiens
attttcacttttggcaatgact

SEQ ID NO: 2356299 - DNA, 13 bp, Homo sapiens
attttcagagccg

SEQ ID NO: 2356300 - DNA, 12 bp, Homo sapiens
attttcagtccc

SEQ ID NO: 2356301 - DNA, 23 bp, Homo sapiens
attttcagtcccctctctctggg

SEQ ID NO: 2356302 - DNA, 21 bp, Homo sapiens
attttcataatcagtaaatag

SEQ ID NO: 2356303 - DNA, 21 bp, Homo sapiens
attttcatgaaaataccattt

SEQ ID NO: 2356304 - DNA, 15 bp, Homo sapiens
attttccaggcttct

SEQ ID NO: 2356305 - DNA, 21 bp, Homo sapiens
attttccaggcttctgctggg

SEQ ID NO: 2356306 - DNA, 22 bp, Homo sapiens
attttcccactcattctgaatt

SEQ ID NO: 2356307 - DNA, 15 bp, Homo sapiens
attttcctctggccg

SEQ ID NO: 2356308 - DNA, 14 bp, Homo sapiens
attttcctcttgtg

SEQ ID NO: 2356309 - DNA, 15 bp, Homo sapiens
attttcctcttgtga

SEQ ID NO: 2356310 - DNA, 18 bp, Homo sapiens
attttcctggtgccaatt

SEQ ID NO: 2356311 - DNA, 23 bp, Homo sapiens
attttcctggtgccaatttcaag

SEQ ID NO: 2356312 - DNA, 15 bp, Homo sapiens
attttctaaaagctt

SEQ ID NO: 2356313 - DNA, 20 bp, Homo sapiens
attttctaaataaaaatatg

SEQ ID NO: 2356314 - DNA, 14 bp, Homo sapiens
attttctacagtgg

SEQ ID NO: 2356315 - DNA, 16 bp, Homo sapiens
attttctacgtttctt

SEQ ID NO: 2356316 - DNA, 17 bp, Homo sapiens
attttctacgtttcttt

SEQ ID NO: 2356317 - DNA, 15 bp, Homo sapiens
attttctcaatctcc

SEQ ID NO: 2356318 - DNA, 17 bp, Homo sapiens
attttctccttggtttg

SEQ ID NO: 2356319 - DNA, 21 bp, Homo sapiens
attttctgtgcctgaatattt

SEQ ID NO: 2356320 - DNA, 22 bp, Homo sapiens
attttgaaacaaagtactcttt

SEQ ID NO: 2356321 - DNA, 15 bp, Homo sapiens
attttgacataagta

SEQ ID NO: 2356322 - DNA, 19 bp, Homo sapiens
attttgaccatatagattt

SEQ ID NO: 2356323 - DNA, 16 bp, Homo sapiens
attttgagtattccat

SEQ ID NO: 2356324 - DNA, 22 bp, Homo sapiens
attttggaataatttctattaa

SEQ ID NO: 2356325 - DNA, 22 bp, Homo sapiens
attttggggggcagagaataaa

SEQ ID NO: 2356326 - DNA, 12 bp, Homo sapiens
attttgtaagaa

SEQ ID NO: 2356327 - DNA, 16 bp, Homo sapiens
attttgtaagaaggca

SEQ ID NO: 2356328 - DNA, 15 bp, Homo sapiens
attttgtatgttaaa

SEQ ID NO: 2356329 - DNA, 12 bp, Homo sapiens
attttgtgtaaa

SEQ ID NO: 2356330 - DNA, 20 bp, Homo sapiens
attttgtgtaaaaaaaccac

SEQ ID NO: 2356331 - DNA, 21 bp, Homo sapiens
attttgtgtcctccaggagct

SEQ ID NO: 2356332 - DNA, 18 bp, Homo sapiens
atttttaaagaatgttag

SEQ ID NO: 2356333 - DNA, 15 bp, Homo sapiens
atttttaattttatg

SEQ ID NO: 2356334 - DNA, 17 bp, Homo sapiens
atttttacctgtttaaa

SEQ ID NO: 2356335 - DNA, 12 bp, Homo sapiens
atttttataatt

SEQ ID NO: 2356336 - DNA, 21 bp, Homo sapiens
atttttataattgtacaaaat

SEQ ID NO: 2356337 - DNA, 19 bp, Homo sapiens
atttttatatcatgcaaaa

SEQ ID NO: 2356338 - DNA, 17 bp, Homo sapiens
atttttatatttccttt

SEQ ID NO: 2356339 - DNA, 16 bp, Homo sapiens
atttttattaaagcat

SEQ ID NO: 2356340 - DNA, 12 bp, Homo sapiens
atttttattata

SEQ ID NO: 2356341 - DNA, 18 bp, Homo sapiens
atttttattatatttatg

SEQ ID NO: 2356342 - DNA, 19 bp, Homo sapiens
atttttcaaatcattcctt

SEQ ID NO: 2356343 - DNA, 14 bp, Homo sapiens
atttttcaatatat

SEQ ID NO: 2356344 - DNA, 22 bp, Homo sapiens
atttttcttttattcttctttc

SEQ ID NO: 2356345 - DNA, 21 bp, Homo sapiens
atttttgcctcttccagtctt

SEQ ID NO: 2356346 - DNA, 14 bp, Homo sapiens
atttttgtaaagtt

SEQ ID NO: 2356347 - DNA, 17 bp, Homo sapiens
atttttgtaaagtttcc

SEQ ID NO: 2356348 - DNA, 13 bp, Homo sapiens
atttttgtacatg

SEQ ID NO: 2356349 - DNA, 20 bp, Homo sapiens
atttttgtgaaatgaaaaca

SEQ ID NO: 2356350 - DNA, 13 bp, Homo sapiens
attttttaaaaag

SEQ ID NO: 2356351 - DNA, 21 bp, Homo sapiens
attttttaagcttcagttgct

SEQ ID NO: 2356352 - DNA, 13 bp, Homo sapiens
attttttaggaaa

SEQ ID NO: 2356353 - DNA, 14 bp, Homo sapiens
attttttattaata

SEQ ID NO: 2356354 - DNA, 19 bp, Homo sapiens
attttttgaaaagcagaca

SEQ ID NO: 2356355 - DNA, 14 bp, Homo sapiens
attttttgaaagtt

SEQ ID NO: 2356356 - DNA, 19 bp, Homo sapiens
attttttgatgtcagcctt

SEQ ID NO: 2356357 - DNA, 14 bp, Homo sapiens
attttttgtctgtg

SEQ ID NO: 2356358 - DNA, 21 bp, Homo sapiens
attttttgtctgtgataacag

SEQ ID NO: 2356359 - DNA, 19 bp, Homo sapiens
atttttttgtaataagcaa

SEQ ID NO: 2356360 - DNA, 14 bp, Homo sapiens
atttttttttcata

SEQ ID NO: 2356361 - DNA, 16 bp, Homo sapiens
atttttttttcataca

SEQ ID NO: 2356362 - DNA, 20 bp, Homo sapiens
atttttttttcatacactta

SEQ ID NO: 2356363 - DNA, 15 bp, Homo sapiens
atttttttttctaag

SEQ ID NO: 2356364 - DNA, 21 bp, Homo sapiens
caaaaaaaaattttaaagacc

SEQ ID NO: 2356365 - DNA, 19 bp, Homo sapiens
caactttcacttcttccta

SEQ ID NO: 2356366 - DNA, 20 bp, Homo sapiens
caagaaagctcactgtagct

SEQ ID NO: 2356367 - DNA, 16 bp, Homo sapiens
caagaacactggacct

SEQ ID NO: 2356368 - DNA, 17 bp, Homo sapiens
caagaacccaagtgcct

SEQ ID NO: 2356369 - DNA, 19 bp, Homo sapiens
caagaacccaagtgcctca

SEQ ID NO: 2356370 - DNA, 20 bp, Homo sapiens
caagaataatcacgctttcc

SEQ ID NO: 2356371 - DNA, 22 bp, Homo sapiens
caagaataatcacgctttcctg

SEQ ID NO: 2356372 - DNA, 14 bp, Homo sapiens
caagaatgaaaaat

SEQ ID NO: 2356373 - DNA, 15 bp, Homo sapiens
caagacatgtctgtt

SEQ ID NO: 2356374 - DNA, 16 bp, Homo sapiens
caagaccgatcggcgg

SEQ ID NO: 2356375 - DNA, 22 bp, Homo sapiens
caagactctttatgatctggcc

SEQ ID NO: 2356376 - DNA, 22 bp, Homo sapiens
caagactgagccagcttagcaa

SEQ ID NO: 2356377 - DNA, 12 bp, Homo sapiens
caagagaaactt

SEQ ID NO: 2356378 - DNA, 15 bp, Homo sapiens
caagagagatgtttt

SEQ ID NO: 2356379 - DNA, 15 bp, Homo sapiens
caagaggcaagctga

SEQ ID NO: 2356380 - DNA, 17 bp, Homo sapiens
caagagtccggatttct

SEQ ID NO: 2356381 - DNA, 18 bp, Homo sapiens
caagagtccggatttcta

SEQ ID NO: 2356382 - DNA, 19 bp, Homo sapiens
caagagtccggatttctaa

SEQ ID NO: 2356383 - DNA, 18 bp, Homo sapiens
caagagtctgtctcaaaa

SEQ ID NO: 2356384 - DNA, 22 bp, Homo sapiens
caagagtgagatgtagaaagtt

SEQ ID NO: 2356385 - DNA, 19 bp, Homo sapiens
caagatgggggcagggctg

SEQ ID NO: 2356386 - DNA, 19 bp, Homo sapiens
caagatgtgaattattgac

SEQ ID NO: 2356387 - DNA, 22 bp, Homo sapiens
caagatgtgaattattgacact

SEQ ID NO: 2356388 - DNA, 20 bp, Homo sapiens
caagcaaaatctaaaatgtt

SEQ ID NO: 2356389 - DNA, 15 bp, Homo sapiens
caagcaacagccttt

SEQ ID NO: 2356390 - DNA, 22 bp, Homo sapiens
caagcaacatttgtatggattt

SEQ ID NO: 2356391 - DNA, 20 bp, Homo sapiens
caagcaatcctcctgcctca

SEQ ID NO: 2356392 - DNA, 22 bp, Homo sapiens
caagcaatcctcctgcctcagc

SEQ ID NO: 2356393 - DNA, 17 bp, Homo sapiens
caagcagcatcttctgg

SEQ ID NO: 2356394 - DNA, 17 bp, Homo sapiens
caagcatgcagctttgc

SEQ ID NO: 2356395 - DNA, 12 bp, Homo sapiens
caagcatttcat

SEQ ID NO: 2356396 - DNA, 22 bp, Homo sapiens
caagccagacctagcaggctgt

SEQ ID NO: 2356397 - DNA, 20 bp, Homo sapiens
caagccattttttgaggaga

SEQ ID NO: 2356398 - DNA, 18 bp, Homo sapiens
caagcctaagggatcctg

SEQ ID NO: 2356399 - DNA, 15 bp, Homo sapiens
caagcgggtggctct

SEQ ID NO: 2356400 - DNA, 20 bp, Homo sapiens
caagctgaaattttagaaat

SEQ ID NO: 2356401 - DNA, 15 bp, Homo sapiens
caagctgcactgtga

SEQ ID NO: 2356402 - DNA, 17 bp, Homo sapiens
caagctgcactgtgaac

SEQ ID NO: 2356403 - DNA, 21 bp, Homo sapiens
caagctgctctgagccacagt

SEQ ID NO: 2356404 - DNA, 12 bp, Homo sapiens
caagcttccctc

SEQ ID NO: 2356405 - DNA, 19 bp, Homo sapiens
caagcttccctccatcccc

SEQ ID NO: 2356406 - DNA, 13 bp, Homo sapiens
caagcttcttgct

SEQ ID NO: 2356407 - DNA, 15 bp, Homo sapiens
caagcttcttgctga

SEQ ID NO: 2356408 - DNA, 13 bp, Homo sapiens
caagctttaaatt

SEQ ID NO: 2356409 - DNA, 13 bp, Homo sapiens
caaggactgagca

SEQ ID NO: 2356410 - DNA, 20 bp, Homo sapiens
caaggactgagcaccctctg

SEQ ID NO: 2356411 - DNA, 16 bp, Homo sapiens
caaggagatttcttag

SEQ ID NO: 2356412 - DNA, 21 bp, Homo sapiens
caaggagatttcttagttcat

SEQ ID NO: 2356413 - DNA, 16 bp, Homo sapiens
caaggaggcccactgt

SEQ ID NO: 2356414 - DNA, 14 bp, Homo sapiens
caaggagtgtaaaa

SEQ ID NO: 2356415 - DNA, 22 bp, Homo sapiens
caaggagtgtaaaatgtatatt

SEQ ID NO: 2356416 - DNA, 18 bp, Homo sapiens
caaggatcggactctgcc

SEQ ID NO: 2356417 - DNA, 17 bp, Homo sapiens
caaggccagtccccatt

SEQ ID NO: 2356418 - DNA, 22 bp, Homo sapiens
caaggctgagacagtgaatttg

SEQ ID NO: 2356419 - DNA, 12 bp, Homo sapiens
caaggctgccag

SEQ ID NO: 2356420 - DNA, 16 bp, Homo sapiens
caaggctgccagacat

SEQ ID NO: 2356421 - DNA, 17 bp, Homo sapiens
caaggctgccagacatg

SEQ ID NO: 2356422 - DNA, 12 bp, Homo sapiens
caagggaaaggg

SEQ ID NO: 2356423 - DNA, 16 bp, Homo sapiens
caagggaaaggggtgc

SEQ ID NO: 2356424 - DNA, 21 bp, Homo sapiens
caagggaaaggggtgctttta

SEQ ID NO: 2356425 - DNA, 14 bp, Homo sapiens
caagggatttgagg

SEQ ID NO: 2356426 - DNA, 16 bp, Homo sapiens
caagggcataaagtaa

SEQ ID NO: 2356427 - DNA, 15 bp, Homo sapiens
caagggggactgtct

SEQ ID NO: 2356428 - DNA, 17 bp, Homo sapiens
caagggttaaggcctga

SEQ ID NO: 2356429 - DNA, 18 bp, Homo sapiens
caagggttaaggcctgaa

SEQ ID NO: 2356430 - DNA, 16 bp, Homo sapiens
caagggttgagagcca

SEQ ID NO: 2356431 - DNA, 12 bp, Homo sapiens
caaggtgctaac

SEQ ID NO: 2356432 - DNA, 14 bp, Homo sapiens
caaggtgctaacat

SEQ ID NO: 2356433 - DNA, 12 bp, Homo sapiens
caaggtggcaga

SEQ ID NO: 2356434 - DNA, 15 bp, Homo sapiens
caaggtggcagatgt

SEQ ID NO: 2356435 - DNA, 22 bp, Homo sapiens
caaggtggcagatgtcttccct

SEQ ID NO: 2356436 - DNA, 21 bp, Homo sapiens
caaggtggcctttgtgctgcg

SEQ ID NO: 2356437 - DNA, 17 bp, Homo sapiens
caaggttggagcccagg

SEQ ID NO: 2356438 - DNA, 21 bp, Homo sapiens
caaggttggagcccagggcat

SEQ ID NO: 2356439 - DNA, 22 bp, Homo sapiens
caagtaagaagacatgaaccaa

SEQ ID NO: 2356440 - DNA, 14 bp, Homo sapiens
caagtaatattatt

SEQ ID NO: 2356441 - DNA, 14 bp, Homo sapiens
caagtaatttcagt

SEQ ID NO: 2356442 - DNA, 20 bp, Homo sapiens
caagtacagcggctcccctc

SEQ ID NO: 2356443 - DNA, 17 bp, Homo sapiens
caagtcaacactcttct

SEQ ID NO: 2356444 - DNA, 17 bp, Homo sapiens
caagtcacttaactata

SEQ ID NO: 2356445 - DNA, 15 bp, Homo sapiens
caagtcagctccagc

SEQ ID NO: 2356446 - DNA, 19 bp, Homo sapiens
caagtccaacctgcctgtg

SEQ ID NO: 2356447 - DNA, 20 bp, Homo sapiens
caagtccaacctgcctgtgc

SEQ ID NO: 2356448 - DNA, 16 bp, Homo sapiens
caagtgccagggctgg

SEQ ID NO: 2356449 - DNA, 20 bp, Homo sapiens
caagtgccagggctgggccc

SEQ ID NO: 2356450 - DNA, 21 bp, Homo sapiens
caagtgctggagtctcctgag

SEQ ID NO: 2356451 - DNA, 16 bp, Homo sapiens
caagtgtgctaaaaat

SEQ ID NO: 2356452 - DNA, 23 bp, Homo sapiens
caagtgttcactgctccttgctg

SEQ ID NO: 2356453 - DNA, 19 bp, Homo sapiens
caagttataggaaaggaag

SEQ ID NO: 2356454 - DNA, 15 bp, Homo sapiens
caagttgctaataca

SEQ ID NO: 2356455 - DNA, 13 bp, Homo sapiens
caagttttaaagt

SEQ ID NO: 2356456 - DNA, 13 bp, Homo sapiens
caataaaaatgtt

SEQ ID NO: 2356457 - DNA, 15 bp, Homo sapiens
caataaaacaaataa

SEQ ID NO: 2356458 - DNA, 20 bp, Homo sapiens
caataaaatttaaaaaataa

SEQ ID NO: 2356459 - DNA, 15 bp, Homo sapiens
caataaagcactgag

SEQ ID NO: 2356460 - DNA, 17 bp, Homo sapiens
caataaagcactgagca

SEQ ID NO: 2356461 - DNA, 20 bp, Homo sapiens
caataaagtataatgtttat

SEQ ID NO: 2356462 - DNA, 15 bp, Homo sapiens
caataaatgtctgtt

SEQ ID NO: 2356463 - DNA, 16 bp, Homo sapiens
caataaatgtctgttg

SEQ ID NO: 2356464 - DNA, 13 bp, Homo sapiens
caataacagctgc

SEQ ID NO: 2356465 - DNA, 20 bp, Homo sapiens
caataagaaacagtttaaca

SEQ ID NO: 2356466 - DNA, 19 bp, Homo sapiens
caatacactagttgtttct

SEQ ID NO: 2356467 - DNA, 18 bp, Homo sapiens
caatagtatacattttat

SEQ ID NO: 2356468 - DNA, 20 bp, Homo sapiens
caatatattgaacttttgta

SEQ ID NO: 2356469 - DNA, 19 bp, Homo sapiens
caatatgaatctataagta

SEQ ID NO: 2356470 - DNA, 16 bp, Homo sapiens
caatattctgtaacta

SEQ ID NO: 2356471 - DNA, 17 bp, Homo sapiens
caatattgattgggaaa

SEQ ID NO: 2356472 - DNA, 15 bp, Homo sapiens
caatcacagtctcag

SEQ ID NO: 2356473 - DNA, 17 bp, Homo sapiens
caatccataactttagt

SEQ ID NO: 2356474 - DNA, 19 bp, Homo sapiens
caatcctaatttctcctcc

SEQ ID NO: 2356475 - DNA, 20 bp, Homo sapiens
caatcctactaataaaccag

SEQ ID NO: 2356476 - DNA, 16 bp, Homo sapiens
caatcctcctgcctca

SEQ ID NO: 2356477 - DNA, 17 bp, Homo sapiens
caatctctttttgtttg

SEQ ID NO: 2356478 - DNA, 16 bp, Homo sapiens
caatctgtaaactgtg

SEQ ID NO: 2356479 - DNA, 18 bp, Homo sapiens
caatctgtaaactgtgta

SEQ ID NO: 2356480 - DNA, 15 bp, Homo sapiens
cacccagacataaag

SEQ ID NO: 2356481 - DNA, 21 bp, Homo sapiens
cacccagacataaaggaaaag

SEQ ID NO: 2356482 - DNA, 23 bp, Homo sapiens
cacccagacataaaggaaaagac

SEQ ID NO: 2356483 - DNA, 15 bp, Homo sapiens
cacccagggctccct

SEQ ID NO: 2356484 - DNA, 16 bp, Homo sapiens
cacccagggctccctc

SEQ ID NO: 2356485 - DNA, 22 bp, Homo sapiens
cacccagggctccctcctggag

SEQ ID NO: 2356486 - DNA, 15 bp, Homo sapiens
cacccatttttcctt

SEQ ID NO: 2356487 - DNA, 16 bp, Homo sapiens
caccccaacctgctct

SEQ ID NO: 2356488 - DNA, 20 bp, Homo sapiens
caccccaacctgctctcctc

SEQ ID NO: 2356489 - DNA, 14 bp, Homo sapiens
caccccagccctcg

SEQ ID NO: 2356490 - DNA, 13 bp, Homo sapiens
caccccctgccct

SEQ ID NO: 2356491 - DNA, 17 bp, Homo sapiens
caccccggggaccctgt

SEQ ID NO: 2356492 - DNA, 18 bp, Homo sapiens
caccccggggaccctgtg

SEQ ID NO: 2356493 - DNA, 13 bp, Homo sapiens
cacccctgccccc

SEQ ID NO: 2356494 - DNA, 14 bp, Homo sapiens
cacccctgccccca

SEQ ID NO: 2356495 - DNA, 18 bp, Homo sapiens
cacccctgcccccagccc

SEQ ID NO: 2356496 - DNA, 19 bp, Homo sapiens
cacccctgcccccagcccc

SEQ ID NO: 2356497 - DNA, 18 bp, Homo sapiens
cacccctggaagagccca

SEQ ID NO: 2356498 - DNA, 14 bp, Homo sapiens
cacccctgggccag

SEQ ID NO: 2356499 - DNA, 22 bp, Homo sapiens
cacccctgggccagcggggctg

SEQ ID NO: 2356500 - DNA, 23 bp, Homo sapiens
cacccctgtgctcccctgccaca

SEQ ID NO: 2356501 - DNA, 18 bp, Homo sapiens
caccccttctctcctccc

SEQ ID NO: 2356502 - DNA, 21 bp, Homo sapiens
caccccttctctcctccccaa

SEQ ID NO: 2356503 - DNA, 13 bp, Homo sapiens
cacccgccctgtg

SEQ ID NO: 2356504 - DNA, 21 bp, Homo sapiens
cacccgtcttggggctcgccc

SEQ ID NO: 2356505 - DNA, 21 bp, Homo sapiens
caccctcactggctctcctgg

SEQ ID NO: 2356506 - DNA, 13 bp, Homo sapiens
caccctcagggag

SEQ ID NO: 2356507 - DNA, 17 bp, Homo sapiens
caccctccaccgagcca

SEQ ID NO: 2356508 - DNA, 11 bp, Homo sapiens
caccctcttcc

SEQ ID NO: 2356509 - DNA, 21 bp, Homo sapiens
caccctcttcctactggtctc

SEQ ID NO: 2356510 - DNA, 16 bp, Homo sapiens
caccctgcgggccagg

SEQ ID NO: 2356511 - DNA, 19 bp, Homo sapiens
caccctgcgggccagggtc

SEQ ID NO: 2356512 - DNA, 13 bp, Homo sapiens
caccctgctgaga

SEQ ID NO: 2356513 - DNA, 16 bp, Homo sapiens
caccctgttcctgctg

SEQ ID NO: 2356514 - DNA, 16 bp, Homo sapiens
cacccttctcccactc

SEQ ID NO: 2356515 - DNA, 17 bp, Homo sapiens
cacccttctcccactct

SEQ ID NO: 2356516 - DNA, 18 bp, Homo sapiens
cacccttctcccactctc

SEQ ID NO: 2356517 - DNA, 21 bp, Homo sapiens
cacccttctcccactctccta

SEQ ID NO: 2356518 - DNA, 14 bp, Homo sapiens
caccgcccctggcc

SEQ ID NO: 2356519 - DNA, 19 bp, Homo sapiens
caccgcgggtgtgggaaag

SEQ ID NO: 2356520 - DNA, 20 bp, Homo sapiens
caccggcctgtgggtctctg

SEQ ID NO: 2356521 - DNA, 15 bp, Homo sapiens
caccggtccagctgg

SEQ ID NO: 2356522 - DNA, 16 bp, Homo sapiens
caccggtccagctggc

SEQ ID NO: 2356523 - DNA, 13 bp, Homo sapiens
caccgtgcctggc

SEQ ID NO: 2356524 - DNA, 15 bp, Homo sapiens
caccgtgcctggcca

SEQ ID NO: 2356525 - DNA, 23 bp, Homo sapiens
caccgtgtcaagctgctctgagc

SEQ ID NO: 2356526 - DNA, 14 bp, Homo sapiens
cacctaatgtttat

SEQ ID NO: 2356527 - DNA, 14 bp, Homo sapiens
cacctacacccctg

SEQ ID NO: 2356528 - DNA, 15 bp, Homo sapiens
cacctattatcccag

SEQ ID NO: 2356529 - DNA, 18 bp, Homo sapiens
cacctattatcccagctg

SEQ ID NO: 2356530 - DNA, 19 bp, Homo sapiens
cacctattatcccagctgc

SEQ ID NO: 2356531 - DNA, 21 bp, Homo sapiens
cacctcaccaaggatcggact

SEQ ID NO: 2356532 - DNA, 16 bp, Homo sapiens
cacctcatgcccaccc

SEQ ID NO: 2356533 - DNA, 20 bp, Homo sapiens
cacctcatgcccaccccctg

SEQ ID NO: 2356534 - DNA, 17 bp, Homo sapiens
cacctccaagcatttca

SEQ ID NO: 2356535 - DNA, 21 bp, Homo sapiens
cacctgacttggctggggagg

SEQ ID NO: 2356536 - DNA, 11 bp, Homo sapiens
cacctgagacc

SEQ ID NO: 2356537 - DNA, 17 bp, Homo sapiens
cacctgcatctggggcc

SEQ ID NO: 2356538 - DNA, 13 bp, Homo sapiens
cacctgccccagc

SEQ ID NO: 2356539 - DNA, 17 bp, Homo sapiens
cacctgccttggcctcc

SEQ ID NO: 2356540 - DNA, 10 bp, Homo sapiens
cacctgctgg

SEQ ID NO: 2356541 - DNA, 13 bp, Homo sapiens
cacctgctggaaa

SEQ ID NO: 2356542 - DNA, 19 bp, Homo sapiens
cacctggctgaggttcctc

SEQ ID NO: 2356543 - DNA, 23 bp, Homo sapiens
cacctggctgaggttcctctgcc

SEQ ID NO: 2356544 - DNA, 16 bp, Homo sapiens
cacctgtaaacctgag

SEQ ID NO: 2356545 - DNA, 22 bp, Homo sapiens
cacctgtagtcccagctacttg

SEQ ID NO: 2356546 - DNA, 14 bp, Homo sapiens
cacctgttttctga

SEQ ID NO: 2356547 - DNA, 15 bp, Homo sapiens
cacctgttttctgaa

SEQ ID NO: 2356548 - DNA, 16 bp, Homo sapiens
cacctgttttctgaaa

SEQ ID NO: 2356549 - DNA, 20 bp, Homo sapiens
cacctgttttctgaaacaca

SEQ ID NO: 2356550 - DNA, 14 bp, Homo sapiens
caccttcagggctg

SEQ ID NO: 2356551 - DNA, 18 bp, Homo sapiens
caccttcagggctgagtt

SEQ ID NO: 2356552 - DNA, 18 bp, Homo sapiens
caccttgacgtttcttct

SEQ ID NO: 2356553 - DNA, 16 bp, Homo sapiens
caccttgccgagagag

SEQ ID NO: 2356554 - DNA, 13 bp, Homo sapiens
caccttgccttgc

SEQ ID NO: 2356555 - DNA, 16 bp, Homo sapiens
caccttggctgggaag

SEQ ID NO: 2356556 - DNA, 17 bp, Homo sapiens
caccttggggccttgat

SEQ ID NO: 2356557 - DNA, 14 bp, Homo sapiens
cacctttgggatca

SEQ ID NO: 2356558 - DNA, 20 bp, Homo sapiens
cacctttgggatcagcctcc

SEQ ID NO: 2356559 - DNA, 14 bp, Homo sapiens
caccttttctgtgg

SEQ ID NO: 2356560 - DNA, 17 bp, Homo sapiens
caccttttctgtggctg

SEQ ID NO: 2356561 - DNA, 21 bp, Homo sapiens
caccttttctgtggctggctc

SEQ ID NO: 2356562 - DNA, 17 bp, Homo sapiens
cacgagcaaacccagag

SEQ ID NO: 2356563 - DNA, 22 bp, Homo sapiens
cacgagcaaacccagaggtgga

SEQ ID NO: 2356564 - DNA, 12 bp, Homo sapiens
cacgagccacaa

SEQ ID NO: 2356565 - DNA, 14 bp, Homo sapiens
cacgagccacaagc

SEQ ID NO: 2356566 - DNA, 15 bp, Homo sapiens
cacgaggtcaggaga

SEQ ID NO: 2356567 - DNA, 21 bp, Homo sapiens
cacgatgcatttaataaagat

SEQ ID NO: 2356568 - DNA, 22 bp, Homo sapiens
cacgatgcatttaataaagatg

SEQ ID NO: 2356569 - DNA, 11 bp, Homo sapiens
cacgcaagtgc

SEQ ID NO: 2356570 - DNA, 13 bp, Homo sapiens
cacgcaagtgcca

SEQ ID NO: 2356571 - DNA, 16 bp, Homo sapiens
cacgccaacagccccc

SEQ ID NO: 2356572 - DNA, 16 bp, Homo sapiens
cacgctcgctgccatc

SEQ ID NO: 2356573 - DNA, 13 bp, Homo sapiens
cacggagacagag

SEQ ID NO: 2356574 - DNA, 12 bp, Homo sapiens
cacggcagctgt

SEQ ID NO: 2356575 - DNA, 18 bp, Homo sapiens
cacggggttccctcctag

SEQ ID NO: 2356576 - DNA, 22 bp, Homo sapiens
cacgggtggggaaaggaggtgg

SEQ ID NO: 2356577 - DNA, 14 bp, Homo sapiens
cacgggtggtcccc

SEQ ID NO: 2356578 - DNA, 14 bp, Homo sapiens
cacgtcatgggagg

SEQ ID NO: 2356579 - DNA, 20 bp, Homo sapiens
cacgttggggtgatttaatc

SEQ ID NO: 2356580 - DNA, 22 bp, Homo sapiens
cactaaaaatattgtttctgca

SEQ ID NO: 2356581 - DNA, 21 bp, Homo sapiens
cactacaagtcagctccagct

SEQ ID NO: 2356582 - DNA, 23 bp, Homo sapiens
cactacacctggctgaggttcct

SEQ ID NO: 2356583 - DNA, 14 bp, Homo sapiens
cactaccctgattc

SEQ ID NO: 2356584 - DNA, 17 bp, Homo sapiens
cactagggccttggaaa

SEQ ID NO: 2356585 - DNA, 21 bp, Homo sapiens
cactcagtgagcctcctgtgc

SEQ ID NO: 2356586 - DNA, 15 bp, Homo sapiens
cactccaagcccagc

SEQ ID NO: 2356587 - DNA, 17 bp, Homo sapiens
cactccacctccaccca

SEQ ID NO: 2356588 - DNA, 13 bp, Homo sapiens
cactccagcctgg

SEQ ID NO: 2356589 - DNA, 13 bp, Homo sapiens
cactccagggaca

SEQ ID NO: 2356590 - DNA, 21 bp, Homo sapiens
cactccagggacacacagcct

SEQ ID NO: 2356591 - DNA, 18 bp, Homo sapiens
cactccagtccactcctg

SEQ ID NO: 2356592 - DNA, 20 bp, Homo sapiens
cactccagttttctcctctg

SEQ ID NO: 2356593 - DNA, 14 bp, Homo sapiens
cactccccacatcc

SEQ ID NO: 2356594 - DNA, 14 bp, Homo sapiens
cactccctgggaca

SEQ ID NO: 2356595 - DNA, 20 bp, Homo sapiens
cagagaggcactcagtgagc

SEQ ID NO: 2356596 - DNA, 16 bp, Homo sapiens
cagagatttctcattg

SEQ ID NO: 2356597 - DNA, 16 bp, Homo sapiens
cagagccccaagcagg

SEQ ID NO: 2356598 - DNA, 19 bp, Homo sapiens
cagagccccaagcaggacg

SEQ ID NO: 2356599 - DNA, 18 bp, Homo sapiens
cagagccggcccgcctct

SEQ ID NO: 2356600 - DNA, 13 bp, Homo sapiens
cagagcctggccc

SEQ ID NO: 2356601 - DNA, 20 bp, Homo sapiens
cagagccttctcagaagcac

SEQ ID NO: 2356602 - DNA, 21 bp, Homo sapiens
cagagccttctcagaagcaca

SEQ ID NO: 2356603 - DNA, 15 bp, Homo sapiens
cagagcgcacaggga

SEQ ID NO: 2356604 - DNA, 15 bp, Homo sapiens
cagagcgccaggaag

SEQ ID NO: 2356605 - DNA, 16 bp, Homo sapiens
cagagcgccaggaagc

SEQ ID NO: 2356606 - DNA, 18 bp, Homo sapiens
cagagcgccaggaagcca

SEQ ID NO: 2356607 - DNA, 21 bp, Homo sapiens
cagagcgccaggaagccagag

SEQ ID NO: 2356608 - DNA, 20 bp, Homo sapiens
cagagctaaactccttcctg

SEQ ID NO: 2356609 - DNA, 21 bp, Homo sapiens
cagagctaaactccttcctgg

SEQ ID NO: 2356610 - DNA, 13 bp, Homo sapiens
cagagctgcctgc

SEQ ID NO: 2356611 - DNA, 18 bp, Homo sapiens
cagagctggagcccccag

SEQ ID NO: 2356612 - DNA, 18 bp, Homo sapiens
cagaggaaagggctggct

SEQ ID NO: 2356613 - DNA, 16 bp, Homo sapiens
cagaggaatcctggca

SEQ ID NO: 2356614 - DNA, 21 bp, Homo sapiens
cagaggaatcctggcagccca

SEQ ID NO: 2356615 - DNA, 22 bp, Homo sapiens
cagaggacgcacgctcgctgcc

SEQ ID NO: 2356616 - DNA, 16 bp, Homo sapiens
cagaggagtgcagcct

SEQ ID NO: 2356617 - DNA, 21 bp, Homo sapiens
cagaggatgccttttctgtga

SEQ ID NO: 2356618 - DNA, 22 bp, Homo sapiens
cagaggatgccttttctgtgat

SEQ ID NO: 2356619 - DNA, 13 bp, Homo sapiens
cagaggcaggctg

SEQ ID NO: 2356620 - DNA, 22 bp, Homo sapiens
cagaggctgcacccctgggcca

SEQ ID NO: 2356621 - DNA, 20 bp, Homo sapiens
cagagggtgtggctttccag

SEQ ID NO: 2356622 - DNA, 19 bp, Homo sapiens
cagaggtaacagaacagct

SEQ ID NO: 2356623 - DNA, 20 bp, Homo sapiens
cagaggtaacagaacagctt

SEQ ID NO: 2356624 - DNA, 13 bp, Homo sapiens
cagaggtggatgt

SEQ ID NO: 2356625 - DNA, 20 bp, Homo sapiens
cagaggtggatgttatgaac

SEQ ID NO: 2356626 - DNA, 22 bp, Homo sapiens
cagaggtggatgttatgaacag

SEQ ID NO: 2356627 - DNA, 21 bp, Homo sapiens
cagaggttttaatgtctgttt

SEQ ID NO: 2356628 - DNA, 12 bp, Homo sapiens
cagagtccagtg

SEQ ID NO: 2356629 - DNA, 18 bp, Homo sapiens
cagagtccagtgctctgc

SEQ ID NO: 2356630 - DNA, 21 bp, Homo sapiens
cagagtccagtgctctgcctc

SEQ ID NO: 2356631 - DNA, 20 bp, Homo sapiens
cagagtctggtgaagctcac

SEQ ID NO: 2356632 - DNA, 20 bp, Homo sapiens
cagagttgctgcaaacctga

SEQ ID NO: 2356633 - DNA, 14 bp, Homo sapiens
cagagttttcatta

SEQ ID NO: 2356634 - DNA, 19 bp, Homo sapiens
cagataactctctttcctt

SEQ ID NO: 2356635 - DNA, 22 bp, Homo sapiens
cagataactctctttccttgag

SEQ ID NO: 2356636 - DNA, 22 bp, Homo sapiens
cagataagcaagagagatgttt

SEQ ID NO: 2356637 - DNA, 22 bp, Homo sapiens
cagatagaaaacagcccccact

SEQ ID NO: 2356638 - DNA, 13 bp, Homo sapiens
cagatattttatc

SEQ ID NO: 2356639 - DNA, 15 bp, Homo sapiens
cagatcactgccaca

SEQ ID NO: 2356640 - DNA, 23 bp, Homo sapiens
cagatctgttttgtggtttggaa

SEQ ID NO: 2356641 - DNA, 14 bp, Homo sapiens
cagatcttggactc

SEQ ID NO: 2356642 - DNA, 13 bp, Homo sapiens
cagatctttctct

SEQ ID NO: 2356643 - DNA, 18 bp, Homo sapiens
cagatgcagagagccatt

SEQ ID NO: 2356644 - DNA, 20 bp, Homo sapiens
cagatgcagagagccatttt

SEQ ID NO: 2356645 - DNA, 18 bp, Homo sapiens
cagatgccaccctagcca

SEQ ID NO: 2356646 - DNA, 22 bp, Homo sapiens
cagatgctgttgtgaagctaat

SEQ ID NO: 2356647 - DNA, 22 bp, Homo sapiens
cagatgcttgcggcaaaaggaa

SEQ ID NO: 2356648 - DNA, 18 bp, Homo sapiens
cagatgtcttccctgggc

SEQ ID NO: 2356649 - DNA, 20 bp, Homo sapiens
cagatgtcttccctgggctg

SEQ ID NO: 2356650 - DNA, 16 bp, Homo sapiens
cagatgtgagccaccg

SEQ ID NO: 2356651 - DNA, 20 bp, Homo sapiens
cagatgtgctataatctgtt

SEQ ID NO: 2356652 - DNA, 12 bp, Homo sapiens
cagatgtggcta

SEQ ID NO: 2356653 - DNA, 19 bp, Homo sapiens
cagatgtggctactgacat

SEQ ID NO: 2356654 - DNA, 21 bp, Homo sapiens
cagattactgctttaatcaga

SEQ ID NO: 2356655 - DNA, 17 bp, Homo sapiens
cagattcccctgtgtca

SEQ ID NO: 2356656 - DNA, 12 bp, Homo sapiens
cagattctgatg

SEQ ID NO: 2356657 - DNA, 15 bp, Homo sapiens
cagattgctctgccc

SEQ ID NO: 2356658 - DNA, 14 bp, Homo sapiens
cagattgcttaaaa

SEQ ID NO: 2356659 - DNA, 20 bp, Homo sapiens
cagatttaagatatgtaaca

SEQ ID NO: 2356660 - DNA, 15 bp, Homo sapiens
cagatttccacagag

SEQ ID NO: 2356661 - DNA, 17 bp, Homo sapiens
cagatttctgaggaaat

SEQ ID NO: 2356662 - DNA, 23 bp, Homo sapiens
cagcaaactaaccagcattccct

SEQ ID NO: 2356663 - DNA, 20 bp, Homo sapiens
cagcaaactcttttcccact

SEQ ID NO: 2356664 - DNA, 13 bp, Homo sapiens
cagcaaataaata

SEQ ID NO: 2356665 - DNA, 14 bp, Homo sapiens
cagcaaataaatac

SEQ ID NO: 2356666 - DNA, 20 bp, Homo sapiens
cagcaacttcttctccatcc

SEQ ID NO: 2356667 - DNA, 23 bp, Homo sapiens
cagcaagtacagcggctcccctc

SEQ ID NO: 2356668 - DNA, 21 bp, Homo sapiens
cagcaataatatgtgagagga

SEQ ID NO: 2356669 - DNA, 17 bp, Homo sapiens
cagcaattcagacccct

SEQ ID NO: 2356670 - DNA, 12 bp, Homo sapiens
cagcaatttaga

SEQ ID NO: 2356671 - DNA, 12 bp, Homo sapiens
cagcacaggaat

SEQ ID NO: 2356672 - DNA, 14 bp, Homo sapiens
cagcaccacactgg

SEQ ID NO: 2356673 - DNA, 22 bp, Homo sapiens
cagcaccacactgggtgcgtct

SEQ ID NO: 2356674 - DNA, 16 bp, Homo sapiens
cagcactttgggaggc

SEQ ID NO: 2356675 - DNA, 17 bp, Homo sapiens
cagcagaacctgcacac

SEQ ID NO: 2356676 - DNA, 18 bp, Homo sapiens
cagcagaacctgcacaca

SEQ ID NO: 2356677 - DNA, 24 bp, Homo sapiens
cagcagaacctgcacacaggacag

SEQ ID NO: 2356678 - DNA, 20 bp, Homo sapiens
cagcagaagcctccaagcac

SEQ ID NO: 2356679 - DNA, 23 bp, Homo sapiens
cagcagaagcctccaagcacaga

SEQ ID NO: 2356680 - DNA, 13 bp, Homo sapiens
cagcagaggcagg

SEQ ID NO: 2356681 - DNA, 18 bp, Homo sapiens
cagcagcccaagcttccc

SEQ ID NO: 2356682 - DNA, 11 bp, Homo sapiens
cagcagctcat

SEQ ID NO: 2356683 - DNA, 15 bp, Homo sapiens
cagcagctcatagaa

SEQ ID NO: 2356684 - DNA, 23 bp, Homo sapiens
cagcagcttataatgggctctcc

SEQ ID NO: 2356685 - DNA, 20 bp, Homo sapiens
cagcagcttggggagaggga

SEQ ID NO: 2356686 - DNA, 18 bp, Homo sapiens
cagcaggtgattggacca

SEQ ID NO: 2356687 - DNA, 20 bp, Homo sapiens
cagcagtgtgaatagcctgg

SEQ ID NO: 2356688 - DNA, 21 bp, Homo sapiens
cagcagtgtgaatagcctggc

SEQ ID NO: 2356689 - DNA, 17 bp, Homo sapiens
cagcagtgtggagaccc

SEQ ID NO: 2356690 - DNA, 20 bp, Homo sapiens
cagcattctcaggcaccagt

SEQ ID NO: 2356691 - DNA, 21 bp, Homo sapiens
cagcattttagaaactacaaa

SEQ ID NO: 2356692 - DNA, 21 bp, Homo sapiens
cagcattttcacattttgcct

SEQ ID NO: 2356693 - DNA, 23 bp, Homo sapiens
cagccaagattttcctcttgtga

SEQ ID NO: 2356694 - DNA, 16 bp, Homo sapiens
cagccagaccagcagg

SEQ ID NO: 2356695 - DNA, 21 bp, Homo sapiens
cagccagaggagggcagaggg

SEQ ID NO: 2356696 - DNA, 23 bp, Homo sapiens
cagccatccagggggcaagagga

SEQ ID NO: 2356697 - DNA, 19 bp, Homo sapiens
cagccatctcatgagggga

SEQ ID NO: 2356698 - DNA, 23 bp, Homo sapiens
cagccatctcatgaggggagagg

SEQ ID NO: 2356699 - DNA, 17 bp, Homo sapiens
cagccatgccagctggc

SEQ ID NO: 2356700 - DNA, 12 bp, Homo sapiens
cagcccagagac

SEQ ID NO: 2356701 - DNA, 21 bp, Homo sapiens
cagcccagagactttgtagat

SEQ ID NO: 2356702 - DNA, 16 bp, Homo sapiens
cagccccactcctctg

SEQ ID NO: 2356703 - DNA, 16 bp, Homo sapiens
cagccccactgccagc

SEQ ID NO: 2356704 - DNA, 18 bp, Homo sapiens
cagccccactgccagcag

SEQ ID NO: 2356705 - DNA, 17 bp, Homo sapiens
cagccccatcagaacct

SEQ ID NO: 2356706 - DNA, 13 bp, Homo sapiens
cagcccccactcc

SEQ ID NO: 2356707 - DNA, 15 bp, Homo sapiens
cagcccccgccccag

SEQ ID NO: 2356708 - DNA, 18 bp, Homo sapiens
cagccccggtggctgggc

SEQ ID NO: 2356709 - DNA, 17 bp, Homo sapiens
cagcccctactgctgtg

SEQ ID NO: 2356710 - DNA, 21 bp, Homo sapiens
cagcccctatagcactgagct

SEQ ID NO: 2356711 - DNA, 20 bp, Homo sapiens
cagcccctggggcccagccc

SEQ ID NO: 2356712 - DNA, 13 bp, Homo sapiens
cagccctgcagcc

SEQ ID NO: 2356713 - DNA, 16 bp, Homo sapiens
cagcctactctccttg

SEQ ID NO: 2356714 - DNA, 18 bp, Homo sapiens
cagcctatagtaaatgtg

SEQ ID NO: 2356715 - DNA, 14 bp, Homo sapiens
cagcctcagactgg

SEQ ID NO: 2356716 - DNA, 21 bp, Homo sapiens
cagcctcatactcctgggctc

SEQ ID NO: 2356717 - DNA, 22 bp, Homo sapiens
cagcctcatactcctgggctca

SEQ ID NO: 2356718 - DNA, 17 bp, Homo sapiens
cagcctcatgactttat

SEQ ID NO: 2356719 - DNA, 17 bp, Homo sapiens
cagcctccgagagggag

SEQ ID NO: 2356720 - DNA, 14 bp, Homo sapiens
cagcctcctctgga

SEQ ID NO: 2356721 - DNA, 16 bp, Homo sapiens
cagcctcctttgtgtg

SEQ ID NO: 2356722 - DNA, 21 bp, Homo sapiens
cagcctcctttgtgtgtattc

SEQ ID NO: 2356723 - DNA, 22 bp, Homo sapiens
cagcctctcagtgccctccagc

SEQ ID NO: 2356724 - DNA, 17 bp, Homo sapiens
cagcctctggacagcca

SEQ ID NO: 2356725 - DNA, 18 bp, Homo sapiens
cagcctctggacagccag

SEQ ID NO: 2356726 - DNA, 19 bp, Homo sapiens
cagcctctggacagccagt

SEQ ID NO: 2356727 - DNA, 17 bp, Homo sapiens
cagcctgaacagaagct

SEQ ID NO: 2356728 - DNA, 14 bp, Homo sapiens
cagcctgggtgacg

SEQ ID NO: 2356729 - DNA, 18 bp, Homo sapiens
cagcctgtcctggtacag

SEQ ID NO: 2356730 - DNA, 14 bp, Homo sapiens
cagccttaatattt

SEQ ID NO: 2356731 - DNA, 21 bp, Homo sapiens
cagccttagctctcccaactc

SEQ ID NO: 2356732 - DNA, 16 bp, Homo sapiens
cagccttgagccctgg

SEQ ID NO: 2356733 - DNA, 18 bp, Homo sapiens
cagccttgagccctggct

SEQ ID NO: 2356734 - DNA, 16 bp, Homo sapiens
cagcctttgaatgtaa

SEQ ID NO: 2356735 - DNA, 20 bp, Homo sapiens
cagcgacctcaagtgtcctg

SEQ ID NO: 2356736 - DNA, 21 bp, Homo sapiens
cagcgacctcaagtgtcctga

SEQ ID NO: 2356737 - DNA, 16 bp, Homo sapiens
cagcgagggcagctgc

SEQ ID NO: 2356738 - DNA, 16 bp, Homo sapiens
cagcggctcccctctg

SEQ ID NO: 2356739 - DNA, 21 bp, Homo sapiens
cagcggctcccctctgcttct

SEQ ID NO: 2356740 - DNA, 17 bp, Homo sapiens
cagctactaatgatgtt

SEQ ID NO: 2356741 - DNA, 15 bp, Homo sapiens
cagctacttgggagg

SEQ ID NO: 2356742 - DNA, 22 bp, Homo sapiens
cagctcactttttcatagtcat

SEQ ID NO: 2356743 - DNA, 13 bp, Homo sapiens
cagctcatagaat

SEQ ID NO: 2356744 - DNA, 20 bp, Homo sapiens
cagctccagggaatccaagc

SEQ ID NO: 2356745 - DNA, 13 bp, Homo sapiens
cagctccctcctg

SEQ ID NO: 2356746 - DNA, 22 bp, Homo sapiens
cagctccctttctcaggagctt

SEQ ID NO: 2356747 - DNA, 13 bp, Homo sapiens
cagctctctgacg

SEQ ID NO: 2356748 - DNA, 15 bp, Homo sapiens
cagctctctgacgct

SEQ ID NO: 2356749 - DNA, 15 bp, Homo sapiens
cagctctctgccctg

SEQ ID NO: 2356750 - DNA, 17 bp, Homo sapiens
cagctctctgccctgtg

SEQ ID NO: 2356751 - DNA, 21 bp, Homo sapiens
cagctctctgccctgtgtact

SEQ ID NO: 2356752 - DNA, 19 bp, Homo sapiens
cagctctttccaaattaaa

SEQ ID NO: 2356753 - DNA, 21 bp, Homo sapiens
cagctgaggctgggggagagc

SEQ ID NO: 2356754 - DNA, 15 bp, Homo sapiens
cagctggcctggaca

SEQ ID NO: 2356755 - DNA, 16 bp, Homo sapiens
cagctggcctttgtaa

SEQ ID NO: 2356756 - DNA, 16 bp, Homo sapiens
cagctggggccagagg

SEQ ID NO: 2356757 - DNA, 21 bp, Homo sapiens
cagctggggccagaggctggg

SEQ ID NO: 2356758 - DNA, 19 bp, Homo sapiens
cagctggtcagtctttgct

SEQ ID NO: 2356759 - DNA, 22 bp, Homo sapiens
cagctggtcagtctttgctcag

SEQ ID NO: 2356760 - DNA, 18 bp, Homo sapiens
cagcttcaacttttctct

SEQ ID NO: 2356761 - DNA, 14 bp, Homo sapiens
cagcttccaaagcc

SEQ ID NO: 2356762 - DNA, 16 bp, Homo sapiens
cagcttccaaagccta

SEQ ID NO: 2356763 - DNA, 22 bp, Homo sapiens
cagcttgagccgggcccctggg

SEQ ID NO: 2356764 - DNA, 22 bp, Homo sapiens
cagcttggggccaccaaagctg

SEQ ID NO: 2356765 - DNA, 19 bp, Homo sapiens
cagctttccctgcctctca

SEQ ID NO: 2356766 - DNA, 16 bp, Homo sapiens
cagctttctgggatgt

SEQ ID NO: 2356767 - DNA, 21 bp, Homo sapiens
cagctttctgggatgtcacag

SEQ ID NO: 2356768 - DNA, 12 bp, Homo sapiens
cagctttgcaaa

SEQ ID NO: 2356769 - DNA, 19 bp, Homo sapiens
caggaaactccacatctgc

SEQ ID NO: 2356770 - DNA, 18 bp, Homo sapiens
caggaaagagcagtcaga

SEQ ID NO: 2356771 - DNA, 21 bp, Homo sapiens
caggaaagagcagtcagagtc

SEQ ID NO: 2356772 - DNA, 16 bp, Homo sapiens
caggaagccagagccc

SEQ ID NO: 2356773 - DNA, 14 bp, Homo sapiens
caggaagggaagcg

SEQ ID NO: 2356774 - DNA, 18 bp, Homo sapiens
caggaattctcaagacct

SEQ ID NO: 2356775 - DNA, 15 bp, Homo sapiens
caggacggctcctca

SEQ ID NO: 2356776 - DNA, 23 bp, Homo sapiens
caggacggctcctcagagcgcca

SEQ ID NO: 2356777 - DNA, 23 bp, Homo sapiens
caggactggtgaatataaatgat

SEQ ID NO: 2356778 - DNA, 15 bp, Homo sapiens
caggagagaagctgg

SEQ ID NO: 2356779 - DNA, 17 bp, Homo sapiens
caggagcaggcacgggt

SEQ ID NO: 2356780 - DNA, 13 bp, Homo sapiens
caggaggcgccct

SEQ ID NO: 2356781 - DNA, 21 bp, Homo sapiens
caggagttcaataaatgtctg

SEQ ID NO: 2356782 - DNA, 18 bp, Homo sapiens
caggatactggcacagag

SEQ ID NO: 2356783 - DNA, 19 bp, Homo sapiens
caggatactggcacagagg

SEQ ID NO: 2356784 - DNA, 15 bp, Homo sapiens
caggatcatggtgta

SEQ ID NO: 2356785 - DNA, 21 bp, Homo sapiens
caggatggcctttccttccct

SEQ ID NO: 2356786 - DNA, 22 bp, Homo sapiens
caggatggcctttccttccctc

SEQ ID NO: 2356787 - DNA, 18 bp, Homo sapiens
caggattacagtgtagct

SEQ ID NO: 2356788 - DNA, 15 bp, Homo sapiens
caggatttgcacaga

SEQ ID NO: 2356789 - DNA, 22 bp, Homo sapiens
caggatttgcacagaagcacat

SEQ ID NO: 2356790 - DNA, 15 bp, Homo sapiens
caggcacacacagcc

SEQ ID NO: 2356791 - DNA, 18 bp, Homo sapiens
caggcacacacagcccct

SEQ ID NO: 2356792 - DNA, 20 bp, Homo sapiens
caggcaccaggactagggct

SEQ ID NO: 2356793 - DNA, 18 bp, Homo sapiens
caggcaccagtccctgtc

SEQ ID NO: 2356794 - DNA, 14 bp, Homo sapiens
caggcaccctcagg

SEQ ID NO: 2356795 - DNA, 15 bp, Homo sapiens
caggcaccctcaggg

SEQ ID NO: 2356796 - DNA, 16 bp, Homo sapiens
caggcaccgagaatgt

SEQ ID NO: 2356797 - DNA, 14 bp, Homo sapiens
caggcacctcttcc

SEQ ID NO: 2356798 - DNA, 20 bp, Homo sapiens
caggcacgggtggtccccgt

SEQ ID NO: 2356799 - DNA, 17 bp, Homo sapiens
caggcagagctggagcc

SEQ ID NO: 2356800 - DNA, 22 bp, Homo sapiens
caggcagagctggagcccccag

SEQ ID NO: 2356801 - DNA, 22 bp, Homo sapiens
caggcagaggttttaatgtctg

SEQ ID NO: 2356802 - DNA, 12 bp, Homo sapiens
caggcagcacca

SEQ ID NO: 2356803 - DNA, 15 bp, Homo sapiens
caggcagcaccacac

SEQ ID NO: 2356804 - DNA, 18 bp, Homo sapiens
caggcagcaccacactgg

SEQ ID NO: 2356805 - DNA, 20 bp, Homo sapiens
caggcagcaccacactgggt

SEQ ID NO: 2356806 - DNA, 16 bp, Homo sapiens
caggcagcccagcagt

SEQ ID NO: 2356807 - DNA, 14 bp, Homo sapiens
caggcagcctcctt

SEQ ID NO: 2356808 - DNA, 16 bp, Homo sapiens
caggcagctccctcct

SEQ ID NO: 2356809 - DNA, 17 bp, Homo sapiens
caggcagctccctcctg

SEQ ID NO: 2356810 - DNA, 23 bp, Homo sapiens
caggcaggggtgggggtggaggc

SEQ ID NO: 2356811 - DNA, 18 bp, Homo sapiens
caggcatagaggcttctc

SEQ ID NO: 2356812 - DNA, 23 bp, Homo sapiens
caggcatagaggcttctccgcca

SEQ ID NO: 2356813 - DNA, 13 bp, Homo sapiens
caggccaccacag

SEQ ID NO: 2356814 - DNA, 12 bp, Homo sapiens
caggccagcctc

SEQ ID NO: 2356815 - DNA, 16 bp, Homo sapiens
caggccagcctccgag

SEQ ID NO: 2356816 - DNA, 23 bp, Homo sapiens
caggccagcctccgagagggaga

SEQ ID NO: 2356817 - DNA, 18 bp, Homo sapiens
caggccctgactcctctg

SEQ ID NO: 2356818 - DNA, 20 bp, Homo sapiens
caggccctgactcctctggc

SEQ ID NO: 2356819 - DNA, 13 bp, Homo sapiens
caggccggcccag

SEQ ID NO: 2356820 - DNA, 14 bp, Homo sapiens
caggccgtgccttg

SEQ ID NO: 2356821 - DNA, 17 bp, Homo sapiens
caggcctgcctcccact

SEQ ID NO: 2356822 - DNA, 15 bp, Homo sapiens
cagtgatatggcaga

SEQ ID NO: 2356823 - DNA, 16 bp, Homo sapiens
cagtgcagagccttct

SEQ ID NO: 2356824 - DNA, 21 bp, Homo sapiens
cagtgcatagttgtagacaaa

SEQ ID NO: 2356825 - DNA, 13 bp, Homo sapiens
cagtgccccaggg

SEQ ID NO: 2356826 - DNA, 14 bp, Homo sapiens
cagtgccctccagc

SEQ ID NO: 2356827 - DNA, 15 bp, Homo sapiens
cagtgcctattgata

SEQ ID NO: 2356828 - DNA, 14 bp, Homo sapiens
cagtgcctcttcca

SEQ ID NO: 2356829 - DNA, 15 bp, Homo sapiens
cagtgcctcttccag

SEQ ID NO: 2356830 - DNA, 18 bp, Homo sapiens
cagtgctcaccagccctg

SEQ ID NO: 2356831 - DNA, 22 bp, Homo sapiens
cagtgctcaccagccctgcagc

SEQ ID NO: 2356832 - DNA, 14 bp, Homo sapiens
cagtgctctcagct

SEQ ID NO: 2356833 - DNA, 14 bp, Homo sapiens
cagtgctctgcctc

SEQ ID NO: 2356834 - DNA, 21 bp, Homo sapiens
cagtggcgggtgatggccagc

SEQ ID NO: 2356835 - DNA, 20 bp, Homo sapiens
cagtggttttatactgaagg

SEQ ID NO: 2356836 - DNA, 21 bp, Homo sapiens
cagtggttttatactgaagga

SEQ ID NO: 2356837 - DNA, 15 bp, Homo sapiens
cagtgtaaagtgtgt

SEQ ID NO: 2356838 - DNA, 16 bp, Homo sapiens
cagtgtcatttctcat

SEQ ID NO: 2356839 - DNA, 22 bp, Homo sapiens
cagtgtccagcttccaaagcct

SEQ ID NO: 2356840 - DNA, 19 bp, Homo sapiens
cagtgtgaatagcctggcc

SEQ ID NO: 2356841 - DNA, 13 bp, Homo sapiens
cagtgtggagttc

SEQ ID NO: 2356842 - DNA, 22 bp, Homo sapiens
cagtgtggagttcaccttggaa

SEQ ID NO: 2356843 - DNA, 23 bp, Homo sapiens
cagtgtggagttcaccttggaag

SEQ ID NO: 2356844 - DNA, 20 bp, Homo sapiens
cagtgttgcatatgagcctg

SEQ ID NO: 2356845 - DNA, 16 bp, Homo sapiens
cagtgttggtatattt

SEQ ID NO: 2356846 - DNA, 23 bp, Homo sapiens
cagtgttgtgccccttcactcat

SEQ ID NO: 2356847 - DNA, 19 bp, Homo sapiens
cagttcatcaccatttcct

SEQ ID NO: 2356848 - DNA, 17 bp, Homo sapiens
cagttctactcaggctg

SEQ ID NO: 2356849 - DNA, 13 bp, Homo sapiens
cagttctttcctc

SEQ ID NO: 2356850 - DNA, 21 bp, Homo sapiens
cagttctttcctctttctgct

SEQ ID NO: 2356851 - DNA, 16 bp, Homo sapiens
cagttgatctgctctg

SEQ ID NO: 2356852 - DNA, 22 bp, Homo sapiens
cagttgcccgaaactaagccag

SEQ ID NO: 2356853 - DNA, 17 bp, Homo sapiens
cagttgctcaaaaagaa

SEQ ID NO: 2356854 - DNA, 13 bp, Homo sapiens
cagttgcttgtct

SEQ ID NO: 2356855 - DNA, 23 bp, Homo sapiens
cagttgtcttatgtgaaaaatta

SEQ ID NO: 2356856 - DNA, 14 bp, Homo sapiens
cagttgttatttag

SEQ ID NO: 2356857 - DNA, 13 bp, Homo sapiens
cagtttaacagaa

SEQ ID NO: 2356858 - DNA, 12 bp, Homo sapiens
cagtttccaaat

SEQ ID NO: 2356859 - DNA, 11 bp, Homo sapiens
cagtttctcct

SEQ ID NO: 2356860 - DNA, 15 bp, Homo sapiens
cagtttgttggaaag

SEQ ID NO: 2356861 - DNA, 12 bp, Homo sapiens
cagttttcataa

SEQ ID NO: 2356862 - DNA, 14 bp, Homo sapiens
cagttttctcctct

SEQ ID NO: 2356863 - DNA, 22 bp, Homo sapiens
cataaaaatctagcacactctt

SEQ ID NO: 2356864 - DNA, 16 bp, Homo sapiens
cataaaagaaataaac

SEQ ID NO: 2356865 - DNA, 15 bp, Homo sapiens
cataaacggttcctg

SEQ ID NO: 2356866 - DNA, 13 bp, Homo sapiens
cataaactaaaaa

SEQ ID NO: 2356867 - DNA, 15 bp, Homo sapiens
cataaaggaaaagac

SEQ ID NO: 2356868 - DNA, 15 bp, Homo sapiens
cataaatatgcagtg

SEQ ID NO: 2356869 - DNA, 16 bp, Homo sapiens
cataaattcaactttg

SEQ ID NO: 2356870 - DNA, 18 bp, Homo sapiens
cataaattcaactttgta

SEQ ID NO: 2356871 - DNA, 17 bp, Homo sapiens
cataacgtttttccttt

SEQ ID NO: 2356872 - DNA, 18 bp, Homo sapiens
cataacgtttttccttta

SEQ ID NO: 2356873 - DNA, 20 bp, Homo sapiens
cataacgtttttcctttaaa

SEQ ID NO: 2356874 - DNA, 21 bp, Homo sapiens
cataacgtttttcctttaaaa

SEQ ID NO: 2356875 - DNA, 11 bp, Homo sapiens
cataactgaaa

SEQ ID NO: 2356876 - DNA, 14 bp, Homo sapiens
cataactgaaaatg

SEQ ID NO: 2356877 - DNA, 19 bp, Homo sapiens
cataagcttccattttaat

SEQ ID NO: 2356878 - DNA, 13 bp, Homo sapiens
cataagtaaatgt

SEQ ID NO: 2356879 - DNA, 21 bp, Homo sapiens
cataagtaacttttaaaattt

SEQ ID NO: 2356880 - DNA, 23 bp, Homo sapiens
cataagtaacttttaaaatttgt

SEQ ID NO: 2356881 - DNA, 17 bp, Homo sapiens
cataataagctaaagag

SEQ ID NO: 2356882 - DNA, 13 bp, Homo sapiens
cataatcttctgc

SEQ ID NO: 2356883 - DNA, 15 bp, Homo sapiens
cataatcttctgcct

SEQ ID NO: 2356884 - DNA, 14 bp, Homo sapiens
cataatgagatgtg

SEQ ID NO: 2356885 - DNA, 22 bp, Homo sapiens
cataatgagatgtgagccttgt

SEQ ID NO: 2356886 - DNA, 23 bp, Homo sapiens
cataatgataaaataaataattt

SEQ ID NO: 2356887 - DNA, 20 bp, Homo sapiens
cataatttaaaaatatattt

SEQ ID NO: 2356888 - DNA, 16 bp, Homo sapiens
catacaagaaaatgta

SEQ ID NO: 2356889 - DNA, 23 bp, Homo sapiens
catacacttattggaactctgct

SEQ ID NO: 2356890 - DNA, 20 bp, Homo sapiens
catacactttgttgcaagat

SEQ ID NO: 2356891 - DNA, 19 bp, Homo sapiens
catacagaggatgcctttt

SEQ ID NO: 2356892 - DNA, 22 bp, Homo sapiens
catacagaggatgccttttctg

SEQ ID NO: 2356893 - DNA, 13 bp, Homo sapiens
catacataaaaga

SEQ ID NO: 2356894 - DNA, 20 bp, Homo sapiens
catacataaaagaaataaac

SEQ ID NO: 2356895 - DNA, 18 bp, Homo sapiens
catacccaaaccaggtgg

SEQ ID NO: 2356896 - DNA, 15 bp, Homo sapiens
cataccctgacctgg

SEQ ID NO: 2356897 - DNA, 16 bp, Homo sapiens
cataccctgacctggc

SEQ ID NO: 2356898 - DNA, 16 bp, Homo sapiens
catactcctgggctca

SEQ ID NO: 2356899 - DNA, 19 bp, Homo sapiens
catactccttgcttcctga

SEQ ID NO: 2356900 - DNA, 23 bp, Homo sapiens
catactgattgggaggtgcgtgt

SEQ ID NO: 2356901 - DNA, 14 bp, Homo sapiens
catacttctctcag

SEQ ID NO: 2356902 - DNA, 16 bp, Homo sapiens
catactttgtattttg

SEQ ID NO: 2356903 - DNA, 17 bp, Homo sapiens
catactttgtattttga

SEQ ID NO: 2356904 - DNA, 18 bp, Homo sapiens
catactttgtattttgat

SEQ ID NO: 2356905 - DNA, 22 bp, Homo sapiens
catactttttaaatgtaaagat

SEQ ID NO: 2356906 - DNA, 14 bp, Homo sapiens
catagacatgaaag

SEQ ID NO: 2356907 - DNA, 21 bp, Homo sapiens
catagaccctgaggccctggg

SEQ ID NO: 2356908 - DNA, 18 bp, Homo sapiens
catagacttgaataactc

SEQ ID NO: 2356909 - DNA, 22 bp, Homo sapiens
catagaggcttctccgccagcc

SEQ ID NO: 2356910 - DNA, 18 bp, Homo sapiens
catagcaaccagaggaag

SEQ ID NO: 2356911 - DNA, 12 bp, Homo sapiens
catagctcactg

SEQ ID NO: 2356912 - DNA, 18 bp, Homo sapiens
catagctcactgcagcct

SEQ ID NO: 2356913 - DNA, 21 bp, Homo sapiens
catagctgtacttcttgaata

SEQ ID NO: 2356914 - DNA, 19 bp, Homo sapiens
cataggccgagctgtggac

SEQ ID NO: 2356915 - DNA, 19 bp, Homo sapiens
cataggtctctttgctttc

SEQ ID NO: 2356916 - DNA, 22 bp, Homo sapiens
cataggtctctttgctttctgg

SEQ ID NO: 2356917 - DNA, 22 bp, Homo sapiens
catagtttctttattttgtgta

SEQ ID NO: 2356918 - DNA, 11 bp, Homo sapiens
catataagaca

SEQ ID NO: 2356919 - DNA, 18 bp, Homo sapiens
catataagacaaatattc

SEQ ID NO: 2356920 - DNA, 18 bp, Homo sapiens
catatagattttattatg

SEQ ID NO: 2356921 - DNA, 18 bp, Homo sapiens
catatagctcgagcaaaa

SEQ ID NO: 2356922 - DNA, 14 bp, Homo sapiens
catatatttattga

SEQ ID NO: 2356923 - DNA, 23 bp, Homo sapiens
catatcctgagccatcggtgaaa

SEQ ID NO: 2356924 - DNA, 16 bp, Homo sapiens
catatctatgggaaaa

SEQ ID NO: 2356925 - DNA, 21 bp, Homo sapiens
catatctccatggccctgtcc

SEQ ID NO: 2356926 - DNA, 17 bp, Homo sapiens
catatgcaccttgtgtc

SEQ ID NO: 2356927 - DNA, 20 bp, Homo sapiens
catatgcaccttgtgtctgt

SEQ ID NO: 2356928 - DNA, 23 bp, Homo sapiens
catatgctgatcttttaaaatca

SEQ ID NO: 2356929 - DNA, 17 bp, Homo sapiens
catatggactctgcaca

SEQ ID NO: 2356930 - DNA, 23 bp, Homo sapiens
catattaaaatctgatgtaacaa

SEQ ID NO: 2356931 - DNA, 17 bp, Homo sapiens
catattataaaggataa

SEQ ID NO: 2356932 - DNA, 14 bp, Homo sapiens
catattcacacctc

SEQ ID NO: 2356933 - DNA, 20 bp, Homo sapiens
catattgtgattctgccttt

SEQ ID NO: 2356934 - DNA, 16 bp, Homo sapiens
catatttaacaaaatt

SEQ ID NO: 2356935 - DNA, 15 bp, Homo sapiens
catatttgatttcta

SEQ ID NO: 2356936 - DNA, 23 bp, Homo sapiens
catggcatccctttttcataaat

SEQ ID NO: 2356937 - DNA, 18 bp, Homo sapiens
catggcatgcttaaattt

SEQ ID NO: 2356938 - DNA, 16 bp, Homo sapiens
catggccctgtcccag

SEQ ID NO: 2356939 - DNA, 19 bp, Homo sapiens
catggcctgcaaactggga

SEQ ID NO: 2356940 - DNA, 15 bp, Homo sapiens
catggcgccctgcct

SEQ ID NO: 2356941 - DNA, 18 bp, Homo sapiens
catggctaatttaacacc

SEQ ID NO: 2356942 - DNA, 12 bp, Homo sapiens
catggctgtgtt

SEQ ID NO: 2356943 - DNA, 18 bp, Homo sapiens
catgggaagtcctggcac

SEQ ID NO: 2356944 - DNA, 14 bp, Homo sapiens
catgggacctggcc

SEQ ID NO: 2356945 - DNA, 14 bp, Homo sapiens
catgggcctgctgc

SEQ ID NO: 2356946 - DNA, 14 bp, Homo sapiens
catgggcttcactg

SEQ ID NO: 2356947 - DNA, 16 bp, Homo sapiens
catgggcttcactgta

SEQ ID NO: 2356948 - DNA, 23 bp, Homo sapiens
catggtgaagtgcttggaacata

SEQ ID NO: 2356949 - DNA, 13 bp, Homo sapiens
catggtgcctgag

SEQ ID NO: 2356950 - DNA, 14 bp, Homo sapiens
catggtgcctgaga

SEQ ID NO: 2356951 - DNA, 16 bp, Homo sapiens
catggtgtaataagac

SEQ ID NO: 2356952 - DNA, 18 bp, Homo sapiens
catggtgtaataagacat

SEQ ID NO: 2356953 - DNA, 19 bp, Homo sapiens
catggtgtaataagacata

SEQ ID NO: 2356954 - DNA, 22 bp, Homo sapiens
catggtgtaataagacataacg

SEQ ID NO: 2356955 - DNA, 13 bp, Homo sapiens
catgtaaaatgtt

SEQ ID NO: 2356956 - DNA, 12 bp, Homo sapiens
catgtaataaaa

SEQ ID NO: 2356957 - DNA, 22 bp, Homo sapiens
catgtaataaaaagtatatgtt

SEQ ID NO: 2356958 - DNA, 15 bp, Homo sapiens
catgtatgaatgtaa

SEQ ID NO: 2356959 - DNA, 18 bp, Homo sapiens
catgtatgtcttggacac

SEQ ID NO: 2356960 - DNA, 21 bp, Homo sapiens
catgtatgtcttggacactgt

SEQ ID NO: 2356961 - DNA, 22 bp, Homo sapiens
catgtatgtcttggacactgta

SEQ ID NO: 2356962 - DNA, 15 bp, Homo sapiens
catgtatttgagcat

SEQ ID NO: 2356963 - DNA, 20 bp, Homo sapiens
catgtccaaagaggctgccc

SEQ ID NO: 2356964 - DNA, 19 bp, Homo sapiens
catgtccaagtccaacctg

SEQ ID NO: 2356965 - DNA, 22 bp, Homo sapiens
catgtccaagtccaacctgcct

SEQ ID NO: 2356966 - DNA, 22 bp, Homo sapiens
catgtccatacactttgttgca

SEQ ID NO: 2356967 - DNA, 18 bp, Homo sapiens
catgtcccctcccagagc

SEQ ID NO: 2356968 - DNA, 15 bp, Homo sapiens
catgtcttctccctg

SEQ ID NO: 2356969 - DNA, 14 bp, Homo sapiens
catgtgaaaccttt

SEQ ID NO: 2356970 - DNA, 21 bp, Homo sapiens
catgtgaaaccttttttaaga

SEQ ID NO: 2356971 - DNA, 13 bp, Homo sapiens
catgtgacacata

SEQ ID NO: 2356972 - DNA, 16 bp, Homo sapiens
catgtgatacattttt

SEQ ID NO: 2356973 - DNA, 17 bp, Homo sapiens
catgtgatggacactcc

SEQ ID NO: 2356974 - DNA, 23 bp, Homo sapiens
catgtgatgtgttgctctccatt

SEQ ID NO: 2356975 - DNA, 21 bp, Homo sapiens
catgtgggggaggagggagag

SEQ ID NO: 2356976 - DNA, 12 bp, Homo sapiens
catgttatgctg

SEQ ID NO: 2356977 - DNA, 12 bp, Homo sapiens
catgtttaatgg

SEQ ID NO: 2356978 - DNA, 20 bp, Homo sapiens
cattaaatgcaataatttta

SEQ ID NO: 2356979 - DNA, 15 bp, Homo sapiens
cattaacggtgctaa

SEQ ID NO: 2356980 - DNA, 19 bp, Homo sapiens
cattaactatttttttcaa

SEQ ID NO: 2356981 - DNA, 17 bp, Homo sapiens
cattaatctcaaagaga

SEQ ID NO: 2356982 - DNA, 17 bp, Homo sapiens
cattaatgcctgctttt

SEQ ID NO: 2356983 - DNA, 23 bp, Homo sapiens
cattaatgcctgctttttggaaa

SEQ ID NO: 2356984 - DNA, 16 bp, Homo sapiens
cattaatggcatatgg

SEQ ID NO: 2356985 - DNA, 22 bp, Homo sapiens
cattaatggcatatggtcctag

SEQ ID NO: 2356986 - DNA, 22 bp, Homo sapiens
cattacagttctttcctctttc

SEQ ID NO: 2356987 - DNA, 11 bp, Homo sapiens
cattaccaaaa

SEQ ID NO: 2356988 - DNA, 16 bp, Homo sapiens
cattacctccatccat

SEQ ID NO: 2356989 - DNA, 14 bp, Homo sapiens
cattatgattcttt

SEQ ID NO: 2356990 - DNA, 22 bp, Homo sapiens
cattatgcacttttagaaatgc

SEQ ID NO: 2356991 - DNA, 22 bp, Homo sapiens
cattcaattagtggtcataaaa

SEQ ID NO: 2356992 - DNA, 14 bp, Homo sapiens
cattcacttcataa

SEQ ID NO: 2356993 - DNA, 23 bp, Homo sapiens
cattcagaaatgttgagtctgta

SEQ ID NO: 2356994 - DNA, 13 bp, Homo sapiens
cattcatttttat

SEQ ID NO: 2356995 - DNA, 21 bp, Homo sapiens
cattccaagaactataaactt

SEQ ID NO: 2356996 - DNA, 18 bp, Homo sapiens
cattccaagtcaacactc

SEQ ID NO: 2356997 - DNA, 20 bp, Homo sapiens
cattccctacagcctagggc

SEQ ID NO: 2356998 - DNA, 23 bp, Homo sapiens
cattcctaacacagcatgtgtat

SEQ ID NO: 2356999 - DNA, 14 bp, Homo sapiens
cattccttctttga

SEQ ID NO: 2357000 - DNA, 19 bp, Homo sapiens
cattccttgcgcctcagcc

SEQ ID NO: 2357001 - DNA, 15 bp, Homo sapiens
cattctgaattaatt

SEQ ID NO: 2357002 - DNA, 20 bp, Homo sapiens
cattctgaattaattaattt

SEQ ID NO: 2357003 - DNA, 13 bp, Homo sapiens
cattctgagctgg

SEQ ID NO: 2357004 - DNA, 14 bp, Homo sapiens
cattctgctccttc

SEQ ID NO: 2357005 - DNA, 12 bp, Homo sapiens
cattcttactaa

SEQ ID NO: 2357006 - DNA, 22 bp, Homo sapiens
cattcttactaaaaagtataaa

SEQ ID NO: 2357007 - DNA, 13 bp, Homo sapiens
cattcttttaaat

SEQ ID NO: 2357008 - DNA, 11 bp, Homo sapiens
cattgaaagag

SEQ ID NO: 2357009 - DNA, 21 bp, Homo sapiens
cattgaagaatgttagagtaa

SEQ ID NO: 2357010 - DNA, 22 bp, Homo sapiens
cattgaagaatgttagagtaat

SEQ ID NO: 2357011 - DNA, 18 bp, Homo sapiens
cattgacttttataaagc

SEQ ID NO: 2357012 - DNA, 15 bp, Homo sapiens
cattgagtattgttt

SEQ ID NO: 2357013 - DNA, 18 bp, Homo sapiens
cattgagtattgtttaaa

SEQ ID NO: 2357014 - DNA, 16 bp, Homo sapiens
cattgattgtcagcta

SEQ ID NO: 2357015 - DNA, 19 bp, Homo sapiens
cattgcacataagcttcca

SEQ ID NO: 2357016 - DNA, 13 bp, Homo sapiens
cattgcagcttca

SEQ ID NO: 2357017 - DNA, 12 bp, Homo sapiens
cattgctgcctt

SEQ ID NO: 2357018 - DNA, 16 bp, Homo sapiens
cattgggcacagtcca

SEQ ID NO: 2357019 - DNA, 16 bp, Homo sapiens
cattggtaagattgca

SEQ ID NO: 2357020 - DNA, 23 bp, Homo sapiens
cattggtacacgtgtaacaagaa

SEQ ID NO: 2357021 - DNA, 20 bp, Homo sapiens
cattgtcctccttttcactt

SEQ ID NO: 2357022 - DNA, 16 bp, Homo sapiens
cattgttgtcaaggaa

SEQ ID NO: 2357023 - DNA, 14 bp, Homo sapiens
cattgtttgtcctt

SEQ ID NO: 2357024 - DNA, 17 bp, Homo sapiens
catttaaattttttggc

SEQ ID NO: 2357025 - DNA, 12 bp, Homo sapiens
catttaataaag

SEQ ID NO: 2357026 - DNA, 13 bp, Homo sapiens
catttagcacagt

SEQ ID NO: 2357027 - DNA, 18 bp, Homo sapiens
catttagcacagtattta

SEQ ID NO: 2357028 - DNA, 16 bp, Homo sapiens
catttatgatttaata

SEQ ID NO: 2357029 - DNA, 20 bp, Homo sapiens
catttatgatttaataaaat

SEQ ID NO: 2357030 - DNA, 21 bp, Homo sapiens
catttcatgaaaaagctgctt

SEQ ID NO: 2357031 - DNA, 23 bp, Homo sapiens
catttcatgaaaaagctgcttct

SEQ ID NO: 2357032 - DNA, 16 bp, Homo sapiens
catttccaccaggccg

SEQ ID NO: 2357033 - DNA, 21 bp, Homo sapiens
catttccatgtcccctcccag

SEQ ID NO: 2357034 - DNA, 15 bp, Homo sapiens
catttcccatctgca

SEQ ID NO: 2357035 - DNA, 13 bp, Homo sapiens
catttctgaggtg

SEQ ID NO: 2357036 - DNA, 12 bp, Homo sapiens
catttctgcctc

SEQ ID NO: 2357037 - DNA, 13 bp, Homo sapiens
catttctgcctcg

SEQ ID NO: 2357038 - DNA, 17 bp, Homo sapiens
catttgacacaaagctt

SEQ ID NO: 2357039 - DNA, 20 bp, Homo sapiens
catttgcaataacagctgca

SEQ ID NO: 2357040 - DNA, 17 bp, Homo sapiens
catttggggtaatactt

SEQ ID NO: 2357041 - DNA, 20 bp, Homo sapiens
catttgtaagtgtaaaaaat

SEQ ID NO: 2357042 - DNA, 14 bp, Homo sapiens
catttgtacatctt

SEQ ID NO: 2357043 - DNA, 12 bp, Homo sapiens
catttgtttgct

SEQ ID NO: 2357044 - DNA, 18 bp, Homo sapiens
cattttaaccctatttta

SEQ ID NO: 2357045 - DNA, 15 bp, Homo sapiens
cattttaattttaaa

SEQ ID NO: 2357046 - DNA, 14 bp, Homo sapiens
cattttactgtata

SEQ ID NO: 2357047 - DNA, 15 bp, Homo sapiens
cattttatcattaaa

SEQ ID NO: 2357048 - DNA, 20 bp, Homo sapiens
cattttatcattaaaaatta

SEQ ID NO: 2357049 - DNA, 21 bp, Homo sapiens
cattttattaagctttttgga

SEQ ID NO: 2357050 - DNA, 14 bp, Homo sapiens
cattttatttttga

SEQ ID NO: 2357051 - DNA, 15 bp, Homo sapiens
ccaccctgttcctgc

SEQ ID NO: 2357052 - DNA, 15 bp, Homo sapiens
ccaccgagccacgca

SEQ ID NO: 2357053 - DNA, 14 bp, Homo sapiens
ccaccgtgcctggc

SEQ ID NO: 2357054 - DNA, 15 bp, Homo sapiens
ccaccgtgcctggct

SEQ ID NO: 2357055 - DNA, 16 bp, Homo sapiens
ccaccgtggaggagga

SEQ ID NO: 2357056 - DNA, 19 bp, Homo sapiens
ccacctagaacactaactc

SEQ ID NO: 2357057 - DNA, 22 bp, Homo sapiens
ccacctcttgtgcaaggtggcc

SEQ ID NO: 2357058 - DNA, 23 bp, Homo sapiens
ccacctgccttggcctcccaaag

SEQ ID NO: 2357059 - DNA, 15 bp, Homo sapiens
ccacctggctctcac

SEQ ID NO: 2357060 - DNA, 22 bp, Homo sapiens
ccacctggctctcacctctagg

SEQ ID NO: 2357061 - DNA, 13 bp, Homo sapiens
ccaccttgccagg

SEQ ID NO: 2357062 - DNA, 16 bp, Homo sapiens
ccaccttgccagggca

SEQ ID NO: 2357063 - DNA, 20 bp, Homo sapiens
ccacctttgggatcagcctc

SEQ ID NO: 2357064 - DNA, 13 bp, Homo sapiens
ccacgcagaggac

SEQ ID NO: 2357065 - DNA, 13 bp, Homo sapiens
ccacgcagtgcct

SEQ ID NO: 2357066 - DNA, 14 bp, Homo sapiens
ccacggccaccact

SEQ ID NO: 2357067 - DNA, 16 bp, Homo sapiens
ccacggccaccactgc

SEQ ID NO: 2357068 - DNA, 16 bp, Homo sapiens
ccactacacctggctg

SEQ ID NO: 2357069 - DNA, 20 bp, Homo sapiens
ccactccagtccactcctga

SEQ ID NO: 2357070 - DNA, 22 bp, Homo sapiens
ccactcccctccactctctacc

SEQ ID NO: 2357071 - DNA, 18 bp, Homo sapiens
ccactcccttgctggccc

SEQ ID NO: 2357072 - DNA, 14 bp, Homo sapiens
ccactcctctgctg

SEQ ID NO: 2357073 - DNA, 22 bp, Homo sapiens
ccactcctctgctgacctgctg

SEQ ID NO: 2357074 - DNA, 13 bp, Homo sapiens
ccactctcctagg

SEQ ID NO: 2357075 - DNA, 14 bp, Homo sapiens
ccactctcctaggc

SEQ ID NO: 2357076 - DNA, 17 bp, Homo sapiens
ccactctctaccagata

SEQ ID NO: 2357077 - DNA, 20 bp, Homo sapiens
ccactcttctttaagccata

SEQ ID NO: 2357078 - DNA, 15 bp, Homo sapiens
ccactgacttgctgt

SEQ ID NO: 2357079 - DNA, 13 bp, Homo sapiens
ccactgcttctct

SEQ ID NO: 2357080 - DNA, 15 bp, Homo sapiens
ccactgtgctttcag

SEQ ID NO: 2357081 - DNA, 17 bp, Homo sapiens
ccactgttgagccccag

SEQ ID NO: 2357082 - DNA, 21 bp, Homo sapiens
ccactgttgagccccagtgct

SEQ ID NO: 2357083 - DNA, 21 bp, Homo sapiens
ccactgtttctcttgagctgg

SEQ ID NO: 2357084 - DNA, 17 bp, Homo sapiens
ccacttccagagccaga

SEQ ID NO: 2357085 - DNA, 15 bp, Homo sapiens
ccacttttttttccc

SEQ ID NO: 2357086 - DNA, 18 bp, Homo sapiens
ccagaaacacccctctgt

SEQ ID NO: 2357087 - DNA, 20 bp, Homo sapiens
ccagaaacacccctctgtct

SEQ ID NO: 2357088 - DNA, 16 bp, Homo sapiens
ccagaaagcctctctc

SEQ ID NO: 2357089 - DNA, 22 bp, Homo sapiens
ccagaaccacacttgaaacctt

SEQ ID NO: 2357090 - DNA, 13 bp, Homo sapiens
ccagacagggtgg

SEQ ID NO: 2357091 - DNA, 14 bp, Homo sapiens
ccagacatggacct

SEQ ID NO: 2357092 - DNA, 16 bp, Homo sapiens
ccagacatggacctcc

SEQ ID NO: 2357093 - DNA, 22 bp, Homo sapiens
ccagacctagcaggctgttcca

SEQ ID NO: 2357094 - DNA, 17 bp, Homo sapiens
ccagacgtcaggccctg

SEQ ID NO: 2357095 - DNA, 18 bp, Homo sapiens
ccagactctttttttgag

SEQ ID NO: 2357096 - DNA, 16 bp, Homo sapiens
ccagagactttgtaga

SEQ ID NO: 2357097 - DNA, 13 bp, Homo sapiens
ccagagaggcact

SEQ ID NO: 2357098 - DNA, 22 bp, Homo sapiens
ccagagcagatgcagagagcca

SEQ ID NO: 2357099 - DNA, 23 bp, Homo sapiens
ccagagcagatgcagagagccat

SEQ ID NO: 2357100 - DNA, 18 bp, Homo sapiens
ccagaggaagaaaatgag

SEQ ID NO: 2357101 - DNA, 18 bp, Homo sapiens
ccagaggaatcctggcag

SEQ ID NO: 2357102 - DNA, 19 bp, Homo sapiens
ccagaggaatcctggcagc

SEQ ID NO: 2357103 - DNA, 21 bp, Homo sapiens
ccagaggaatcctggcagccc

SEQ ID NO: 2357104 - DNA, 23 bp, Homo sapiens
ccagaggaatcctggcagcccag

SEQ ID NO: 2357105 - DNA, 15 bp, Homo sapiens
ccagaggagggcaga

SEQ ID NO: 2357106 - DNA, 19 bp, Homo sapiens
ccagaggagggcagaggga

SEQ ID NO: 2357107 - DNA, 13 bp, Homo sapiens
ccagaggctggga

SEQ ID NO: 2357108 - DNA, 18 bp, Homo sapiens
ccagaggtaacagaacag

SEQ ID NO: 2357109 - DNA, 17 bp, Homo sapiens
ccagaggttgtgcactg

SEQ ID NO: 2357110 - DNA, 21 bp, Homo sapiens
ccagagtcaccttttctgtgg

SEQ ID NO: 2357111 - DNA, 19 bp, Homo sapiens
ccagataactctctttcct

SEQ ID NO: 2357112 - DNA, 16 bp, Homo sapiens
ccagataactgaggag

SEQ ID NO: 2357113 - DNA, 16 bp, Homo sapiens
ccagatctttcagaaa

SEQ ID NO: 2357114 - DNA, 21 bp, Homo sapiens
ccagatctttcagaaatataa

SEQ ID NO: 2357115 - DNA, 14 bp, Homo sapiens
ccagatctttctct

SEQ ID NO: 2357116 - DNA, 18 bp, Homo sapiens
ccagatctttctcttccc

SEQ ID NO: 2357117 - DNA, 13 bp, Homo sapiens
ccagatgctgtca

SEQ ID NO: 2357118 - DNA, 21 bp, Homo sapiens
ccagatgtgtcccccccaggc

SEQ ID NO: 2357119 - DNA, 23 bp, Homo sapiens
ccagatgtgtcccccccaggcct

SEQ ID NO: 2357120 - DNA, 15 bp, Homo sapiens
ccagattctgatgca

SEQ ID NO: 2357121 - DNA, 15 bp, Homo sapiens
ccagattctgcctct

SEQ ID NO: 2357122 - DNA, 17 bp, Homo sapiens
ccagattctgcctctct

SEQ ID NO: 2357123 - DNA, 18 bp, Homo sapiens
ccagattctgcctctctg

SEQ ID NO: 2357124 - DNA, 23 bp, Homo sapiens
ccagattctgcctctctggaaag

SEQ ID NO: 2357125 - DNA, 17 bp, Homo sapiens
ccagattgctctgcccc

SEQ ID NO: 2357126 - DNA, 23 bp, Homo sapiens
ccagcaacattataatggccctg

SEQ ID NO: 2357127 - DNA, 23 bp, Homo sapiens
ccagcaacttcttctccatccct

SEQ ID NO: 2357128 - DNA, 21 bp, Homo sapiens
ccagcacatccccctctcctc

SEQ ID NO: 2357129 - DNA, 16 bp, Homo sapiens
ccagcactttgggagg

SEQ ID NO: 2357130 - DNA, 20 bp, Homo sapiens
ccagcactttgggaggccga

SEQ ID NO: 2357131 - DNA, 17 bp, Homo sapiens
ccagcagaggcaggctg

SEQ ID NO: 2357132 - DNA, 18 bp, Homo sapiens
ccagcagaggcaggctgg

SEQ ID NO: 2357133 - DNA, 21 bp, Homo sapiens
ccagcagaggcaggctgggac

SEQ ID NO: 2357134 - DNA, 15 bp, Homo sapiens
ccagcagcagcaggt

SEQ ID NO: 2357135 - DNA, 16 bp, Homo sapiens
ccagcattctcaggca

SEQ ID NO: 2357136 - DNA, 15 bp, Homo sapiens
ccagccacagagcaa

SEQ ID NO: 2357137 - DNA, 12 bp, Homo sapiens
ccagccaggcag

SEQ ID NO: 2357138 - DNA, 14 bp, Homo sapiens
ccagccatgccagc

SEQ ID NO: 2357139 - DNA, 15 bp, Homo sapiens
ccagccatgcctgag

SEQ ID NO: 2357140 - DNA, 23 bp, Homo sapiens
ccagcccagattcccctgtgtca

SEQ ID NO: 2357141 - DNA, 16 bp, Homo sapiens
ccagcccagccccact

SEQ ID NO: 2357142 - DNA, 14 bp, Homo sapiens
ccagcccatggaga

SEQ ID NO: 2357143 - DNA, 23 bp, Homo sapiens
ccagcccatggagattgacctgg

SEQ ID NO: 2357144 - DNA, 18 bp, Homo sapiens
ccagccccactcctctgc

SEQ ID NO: 2357145 - DNA, 21 bp, Homo sapiens
ccagccccactgccagcagca

SEQ ID NO: 2357146 - DNA, 23 bp, Homo sapiens
ccagccccactgccagcagcagc

SEQ ID NO: 2357147 - DNA, 17 bp, Homo sapiens
ccagcccccgccccaga

SEQ ID NO: 2357148 - DNA, 20 bp, Homo sapiens
ccagcccccgccccagagtg

SEQ ID NO: 2357149 - DNA, 15 bp, Homo sapiens
ccagcccctcttccc

SEQ ID NO: 2357150 - DNA, 14 bp, Homo sapiens
ccagcccctggggc

SEQ ID NO: 2357151 - DNA, 21 bp, Homo sapiens
ccagcccctggggcccagccc

SEQ ID NO: 2357152 - DNA, 13 bp, Homo sapiens
ccagccctgctgg

SEQ ID NO: 2357153 - DNA, 17 bp, Homo sapiens
ccagccctgctggggat

SEQ ID NO: 2357154 - DNA, 20 bp, Homo sapiens
ccagccctgctggggatccc

SEQ ID NO: 2357155 - DNA, 22 bp, Homo sapiens
ccagccctgctggggatccccg

SEQ ID NO: 2357156 - DNA, 16 bp, Homo sapiens
ccagcctcagactgga

SEQ ID NO: 2357157 - DNA, 12 bp, Homo sapiens
ccagcctcctct

SEQ ID NO: 2357158 - DNA, 13 bp, Homo sapiens
ccagcctcctctg

SEQ ID NO: 2357159 - DNA, 15 bp, Homo sapiens
ccagcctcctctgga

SEQ ID NO: 2357160 - DNA, 12 bp, Homo sapiens
ccagcctgggcc

SEQ ID NO: 2357161 - DNA, 21 bp, Homo sapiens
ccagcctggggctgaggctga

SEQ ID NO: 2357162 - DNA, 16 bp, Homo sapiens
ccagcctgtcctggta

SEQ ID NO: 2357163 - DNA, 18 bp, Homo sapiens
ccagccttgagccctggc

SEQ ID NO: 2357164 - DNA, 19 bp, Homo sapiens
ccagccttgagccctggct

SEQ ID NO: 2357165 - DNA, 20 bp, Homo sapiens
ccatcttcgggaccaggatt

SEQ ID NO: 2357166 - DNA, 18 bp, Homo sapiens
ccatgaagggaccctttg

SEQ ID NO: 2357167 - DNA, 14 bp, Homo sapiens
ccatgagctgctca

SEQ ID NO: 2357168 - DNA, 14 bp, Homo sapiens
ccatgatgtatatc

SEQ ID NO: 2357169 - DNA, 12 bp, Homo sapiens
ccatgcagacct

SEQ ID NO: 2357170 - DNA, 12 bp, Homo sapiens
ccatgcaggagg

SEQ ID NO: 2357171 - DNA, 13 bp, Homo sapiens
ccatgcaggaggt

SEQ ID NO: 2357172 - DNA, 14 bp, Homo sapiens
ccatgcaggaggtg

SEQ ID NO: 2357173 - DNA, 22 bp, Homo sapiens
ccatgccagattctgcctctct

SEQ ID NO: 2357174 - DNA, 20 bp, Homo sapiens
ccatgcgtgtttctgactct

SEQ ID NO: 2357175 - DNA, 19 bp, Homo sapiens
ccatggagattgacctgga

SEQ ID NO: 2357176 - DNA, 22 bp, Homo sapiens
ccatggatctgatctgtaccat

SEQ ID NO: 2357177 - DNA, 22 bp, Homo sapiens
ccatggcctgcaaactgggaac

SEQ ID NO: 2357178 - DNA, 12 bp, Homo sapiens
ccatgggcctgc

SEQ ID NO: 2357179 - DNA, 13 bp, Homo sapiens
ccatgggcctgct

SEQ ID NO: 2357180 - DNA, 15 bp, Homo sapiens
ccatgggcctgctgc

SEQ ID NO: 2357181 - DNA, 21 bp, Homo sapiens
ccatgggcctgctgcgtcaga

SEQ ID NO: 2357182 - DNA, 19 bp, Homo sapiens
ccatgggcttcactgtata

SEQ ID NO: 2357183 - DNA, 16 bp, Homo sapiens
ccatgggggcacttga

SEQ ID NO: 2357184 - DNA, 20 bp, Homo sapiens
ccatgggggcacttgagttt

SEQ ID NO: 2357185 - DNA, 15 bp, Homo sapiens
ccatggtgtcccggt

SEQ ID NO: 2357186 - DNA, 15 bp, Homo sapiens
ccatgtaagcactct

SEQ ID NO: 2357187 - DNA, 18 bp, Homo sapiens
ccatgtccaaagaggctg

SEQ ID NO: 2357188 - DNA, 16 bp, Homo sapiens
ccatgtcccctcccag

SEQ ID NO: 2357189 - DNA, 21 bp, Homo sapiens
ccatgtgatggacactccagg

SEQ ID NO: 2357190 - DNA, 22 bp, Homo sapiens
ccatgtgatggacactccaggg

SEQ ID NO: 2357191 - DNA, 21 bp, Homo sapiens
ccatgtggataactttacaga

SEQ ID NO: 2357192 - DNA, 14 bp, Homo sapiens
ccattaaagtcaga

SEQ ID NO: 2357193 - DNA, 19 bp, Homo sapiens
ccattaaagtcagaagttt

SEQ ID NO: 2357194 - DNA, 15 bp, Homo sapiens
ccattcatccttcca

SEQ ID NO: 2357195 - DNA, 19 bp, Homo sapiens
ccattcatccttccatcca

SEQ ID NO: 2357196 - DNA, 20 bp, Homo sapiens
ccattcatccttccatccat

SEQ ID NO: 2357197 - DNA, 21 bp, Homo sapiens
ccattcattaattagttccag

SEQ ID NO: 2357198 - DNA, 13 bp, Homo sapiens
ccattccaaaata

SEQ ID NO: 2357199 - DNA, 21 bp, Homo sapiens
ccattccttgcgcctcagccc

SEQ ID NO: 2357200 - DNA, 12 bp, Homo sapiens
ccattctcccag

SEQ ID NO: 2357201 - DNA, 14 bp, Homo sapiens
ccattctcccaggt

SEQ ID NO: 2357202 - DNA, 19 bp, Homo sapiens
ccattctgctccttcccca

SEQ ID NO: 2357203 - DNA, 21 bp, Homo sapiens
ccattgctcttagtcccaagc

SEQ ID NO: 2357204 - DNA, 14 bp, Homo sapiens
ccattgtcctcctt

SEQ ID NO: 2357205 - DNA, 18 bp, Homo sapiens
ccattgttgtcaaggaag

SEQ ID NO: 2357206 - DNA, 21 bp, Homo sapiens
ccattgttgtcaaggaagaag

SEQ ID NO: 2357207 - DNA, 15 bp, Homo sapiens
ccatttcccatctgc

SEQ ID NO: 2357208 - DNA, 17 bp, Homo sapiens
ccatttcccatctgcac

SEQ ID NO: 2357209 - DNA, 19 bp, Homo sapiens
ccatttctgaggtgcactg

SEQ ID NO: 2357210 - DNA, 12 bp, Homo sapiens
ccatttctgcct

SEQ ID NO: 2357211 - DNA, 20 bp, Homo sapiens
ccatttgcaataacagctgc

SEQ ID NO: 2357212 - DNA, 14 bp, Homo sapiens
ccatttgtcccaga

SEQ ID NO: 2357213 - DNA, 16 bp, Homo sapiens
ccatttgtgccagagg

SEQ ID NO: 2357214 - DNA, 14 bp, Homo sapiens
ccattttaatttta

SEQ ID NO: 2357215 - DNA, 13 bp, Homo sapiens
ccattttgtgaat

SEQ ID NO: 2357216 - DNA, 18 bp, Homo sapiens
ccattttttaatttactt

SEQ ID NO: 2357217 - DNA, 11 bp, Homo sapiens
cccaaaatata

SEQ ID NO: 2357218 - DNA, 19 bp, Homo sapiens
cccaaacccaagtgccttc

SEQ ID NO: 2357219 - DNA, 20 bp, Homo sapiens
cccaaaggacgcctgcagga

SEQ ID NO: 2357220 - DNA, 14 bp, Homo sapiens
cccaaatcaataca

SEQ ID NO: 2357221 - DNA, 22 bp, Homo sapiens
cccaacctcagggctcccaggg

SEQ ID NO: 2357222 - DNA, 14 bp, Homo sapiens
cccaaggctgccag

SEQ ID NO: 2357223 - DNA, 16 bp, Homo sapiens
cccaaggctgccagac

SEQ ID NO: 2357224 - DNA, 17 bp, Homo sapiens
cccaaggctgccagaca

SEQ ID NO: 2357225 - DNA, 17 bp, Homo sapiens
cccaatcggactgccaa

SEQ ID NO: 2357226 - DNA, 18 bp, Homo sapiens
cccaatcggactgccaaa

SEQ ID NO: 2357227 - DNA, 18 bp, Homo sapiens
cccacagcgtccctggcg

SEQ ID NO: 2357228 - DNA, 18 bp, Homo sapiens
cccacatgcctgcgcctg

SEQ ID NO: 2357229 - DNA, 19 bp, Homo sapiens
cccacatgtgacacatatg

SEQ ID NO: 2357230 - DNA, 19 bp, Homo sapiens
cccaccccaacctgctctc

SEQ ID NO: 2357231 - DNA, 22 bp, Homo sapiens
cccaccccaacctgctctcctc

SEQ ID NO: 2357232 - DNA, 13 bp, Homo sapiens
cccaccccctgcc

SEQ ID NO: 2357233 - DNA, 17 bp, Homo sapiens
cccaccccctgccctgc

SEQ ID NO: 2357234 - DNA, 18 bp, Homo sapiens
cccaccccctgccctgca

SEQ ID NO: 2357235 - DNA, 16 bp, Homo sapiens
cccacccctgccccca

SEQ ID NO: 2357236 - DNA, 21 bp, Homo sapiens
cccaccctcaaaccctgtggg

SEQ ID NO: 2357237 - DNA, 17 bp, Homo sapiens
cccaccctgcgggccag

SEQ ID NO: 2357238 - DNA, 19 bp, Homo sapiens
cccaccctgttcctgctgc

SEQ ID NO: 2357239 - DNA, 16 bp, Homo sapiens
cccaccggtccagctg

SEQ ID NO: 2357240 - DNA, 17 bp, Homo sapiens
cccaccggtccagctgg

SEQ ID NO: 2357241 - DNA, 18 bp, Homo sapiens
cccacctcttgtgcaagg

SEQ ID NO: 2357242 - DNA, 19 bp, Homo sapiens
cccacctgcatctggggcc

SEQ ID NO: 2357243 - DNA, 17 bp, Homo sapiens
cccacctgttttctgaa

SEQ ID NO: 2357244 - DNA, 18 bp, Homo sapiens
cccacggagacagaggaa

SEQ ID NO: 2357245 - DNA, 12 bp, Homo sapiens
cccactctccta

SEQ ID NO: 2357246 - DNA, 13 bp, Homo sapiens
cccactgccagca

SEQ ID NO: 2357247 - DNA, 15 bp, Homo sapiens
cccactgccagcagc

SEQ ID NO: 2357248 - DNA, 16 bp, Homo sapiens
cccactgccagcagca

SEQ ID NO: 2357249 - DNA, 17 bp, Homo sapiens
cccactgccagcagcag

SEQ ID NO: 2357250 - DNA, 21 bp, Homo sapiens
cccactgccagcagcagcagg

SEQ ID NO: 2357251 - DNA, 19 bp, Homo sapiens
cccagacataaaggaaaag

SEQ ID NO: 2357252 - DNA, 13 bp, Homo sapiens
cccagaccactgt

SEQ ID NO: 2357253 - DNA, 12 bp, Homo sapiens
cccagagaggca

SEQ ID NO: 2357254 - DNA, 13 bp, Homo sapiens
cccagagaggcac

SEQ ID NO: 2357255 - DNA, 15 bp, Homo sapiens
cccagagctgcctgc

SEQ ID NO: 2357256 - DNA, 20 bp, Homo sapiens
cccagagctggtggacccag

SEQ ID NO: 2357257 - DNA, 22 bp, Homo sapiens
cccagaggtaacagaacagctt

SEQ ID NO: 2357258 - DNA, 21 bp, Homo sapiens
cccagatgtgtcccccccagg

SEQ ID NO: 2357259 - DNA, 17 bp, Homo sapiens
cccagattcccctgtgt

SEQ ID NO: 2357260 - DNA, 15 bp, Homo sapiens
cccagcactttggga

SEQ ID NO: 2357261 - DNA, 13 bp, Homo sapiens
cccagcagaggca

SEQ ID NO: 2357262 - DNA, 14 bp, Homo sapiens
cccagcagaggcag

SEQ ID NO: 2357263 - DNA, 13 bp, Homo sapiens
cccagcattctca

SEQ ID NO: 2357264 - DNA, 19 bp, Homo sapiens
cccagcattctcaggcacc

SEQ ID NO: 2357265 - DNA, 18 bp, Homo sapiens
cccagccatgccagctgg

SEQ ID NO: 2357266 - DNA, 11 bp, Homo sapiens
cccagcccaga

SEQ ID NO: 2357267 - DNA, 21 bp, Homo sapiens
cccagcccagattcccctgtg

SEQ ID NO: 2357268 - DNA, 22 bp, Homo sapiens
cccagccccgccccgttgtgag

SEQ ID NO: 2357269 - DNA, 15 bp, Homo sapiens
cccagccctgctggg

SEQ ID NO: 2357270 - DNA, 12 bp, Homo sapiens
cccagcctgggc

SEQ ID NO: 2357271 - DNA, 15 bp, Homo sapiens
cccagcctgggccat

SEQ ID NO: 2357272 - DNA, 19 bp, Homo sapiens
cccagcctgtcctggtaca

SEQ ID NO: 2357273 - DNA, 20 bp, Homo sapiens
cccagcctgtcctggtacag

SEQ ID NO: 2357274 - DNA, 15 bp, Homo sapiens
cccagctacttggga

SEQ ID NO: 2357275 - DNA, 23 bp, Homo sapiens
cccagctacttgggaggctgagg

SEQ ID NO: 2357276 - DNA, 17 bp, Homo sapiens
cccaggatactggcaca

SEQ ID NO: 2357277 - DNA, 19 bp, Homo sapiens
cccaggatactggcacaga

SEQ ID NO: 2357278 - DNA, 21 bp, Homo sapiens
cccaggcatgaaattcttcct

SEQ ID NO: 2357279 - DNA, 15 bp, Homo sapiens
cccaggccggcccag

SEQ ID NO: 2357280 - DNA, 15 bp, Homo sapiens
cccggggaccctgtg

SEQ ID NO: 2357281 - DNA, 21 bp, Homo sapiens
cccgtgcatcccccctgctca

SEQ ID NO: 2357282 - DNA, 20 bp, Homo sapiens
ccctaaaagcactcctgctt

SEQ ID NO: 2357283 - DNA, 12 bp, Homo sapiens
ccctaagagact

SEQ ID NO: 2357284 - DNA, 17 bp, Homo sapiens
ccctactgctgtgaacc

SEQ ID NO: 2357285 - DNA, 14 bp, Homo sapiens
ccctatctcctgac

SEQ ID NO: 2357286 - DNA, 15 bp, Homo sapiens
ccctatctcctgaca

SEQ ID NO: 2357287 - DNA, 13 bp, Homo sapiens
ccctatgctgtgc

SEQ ID NO: 2357288 - DNA, 22 bp, Homo sapiens
ccctcacaacagtcacctcaca

SEQ ID NO: 2357289 - DNA, 15 bp, Homo sapiens
ccctcactccctctg

SEQ ID NO: 2357290 - DNA, 13 bp, Homo sapiens
ccctcatcctttt

SEQ ID NO: 2357291 - DNA, 20 bp, Homo sapiens
ccctccaaatggagaagctg

SEQ ID NO: 2357292 - DNA, 12 bp, Homo sapiens
ccctccaacaca

SEQ ID NO: 2357293 - DNA, 21 bp, Homo sapiens
ccctccacccatccagtggac

SEQ ID NO: 2357294 - DNA, 22 bp, Homo sapiens
ccctccattgggcacagtccag

SEQ ID NO: 2357295 - DNA, 20 bp, Homo sapiens
ccctcccaggactctgaccc

SEQ ID NO: 2357296 - DNA, 17 bp, Homo sapiens
ccctccccccagactct

SEQ ID NO: 2357297 - DNA, 16 bp, Homo sapiens
ccctcccctctcagaa

SEQ ID NO: 2357298 - DNA, 17 bp, Homo sapiens
ccctccctgcctgaggg

SEQ ID NO: 2357299 - DNA, 19 bp, Homo sapiens
ccctccggactggtgccct

SEQ ID NO: 2357300 - DNA, 19 bp, Homo sapiens
ccctcctagctctcccagt

SEQ ID NO: 2357301 - DNA, 21 bp, Homo sapiens
ccctcctcactcccacctgca

SEQ ID NO: 2357302 - DNA, 20 bp, Homo sapiens
ccctcctcccagggcctcct

SEQ ID NO: 2357303 - DNA, 22 bp, Homo sapiens
ccctcctgaaccgcacagctca

SEQ ID NO: 2357304 - DNA, 13 bp, Homo sapiens
ccctcctggagca

SEQ ID NO: 2357305 - DNA, 13 bp, Homo sapiens
ccctcctttccct

SEQ ID NO: 2357306 - DNA, 15 bp, Homo sapiens
ccctcctttccctta

SEQ ID NO: 2357307 - DNA, 22 bp, Homo sapiens
ccctcctttcccttattgcctc

SEQ ID NO: 2357308 - DNA, 11 bp, Homo sapiens
ccctctcagaa

SEQ ID NO: 2357309 - DNA, 17 bp, Homo sapiens
ccctctcccaccctctt

SEQ ID NO: 2357310 - DNA, 18 bp, Homo sapiens
ccctctcccaccctcttc

SEQ ID NO: 2357311 - DNA, 21 bp, Homo sapiens
ccctctgggcacgcctgctgg

SEQ ID NO: 2357312 - DNA, 19 bp, Homo sapiens
ccctcttcctactggtctc

SEQ ID NO: 2357313 - DNA, 11 bp, Homo sapiens
ccctcttcctc

SEQ ID NO: 2357314 - DNA, 16 bp, Homo sapiens
ccctcttcctccctgg

SEQ ID NO: 2357315 - DNA, 17 bp, Homo sapiens
ccctcttgcccatcctg

SEQ ID NO: 2357316 - DNA, 14 bp, Homo sapiens
ccctctttgctgca

SEQ ID NO: 2357317 - DNA, 19 bp, Homo sapiens
ccctgaacgttttcttctt

SEQ ID NO: 2357318 - DNA, 20 bp, Homo sapiens
ccctgaacgttttcttcttt

SEQ ID NO: 2357319 - DNA, 14 bp, Homo sapiens
ccctgacccaggga

SEQ ID NO: 2357320 - DNA, 12 bp, Homo sapiens
ccctgactcctc

SEQ ID NO: 2357321 - DNA, 18 bp, Homo sapiens
ccctgactcctctggctt

SEQ ID NO: 2357322 - DNA, 19 bp, Homo sapiens
ccctgactcctctggcttt

SEQ ID NO: 2357323 - DNA, 14 bp, Homo sapiens
ccctgaggccctgg

SEQ ID NO: 2357324 - DNA, 16 bp, Homo sapiens
ccctgaggccctgggc

SEQ ID NO: 2357325 - DNA, 21 bp, Homo sapiens
ccctgaggccctgggctgggt

SEQ ID NO: 2357326 - DNA, 20 bp, Homo sapiens
ccctgaggcggaggctgtgc

SEQ ID NO: 2357327 - DNA, 13 bp, Homo sapiens
ccctgattcttga

SEQ ID NO: 2357328 - DNA, 14 bp, Homo sapiens
ccctgcagacctca

SEQ ID NO: 2357329 - DNA, 19 bp, Homo sapiens
ccctgcagacctcaagcca

SEQ ID NO: 2357330 - DNA, 13 bp, Homo sapiens
ccctgcagagcta

SEQ ID NO: 2357331 - DNA, 16 bp, Homo sapiens
ccctgccacagccaga

SEQ ID NO: 2357332 - DNA, 18 bp, Homo sapiens
ccctgccacagccagagg

SEQ ID NO: 2357333 - DNA, 19 bp, Homo sapiens
ccctgccacagccagagga

SEQ ID NO: 2357334 - DNA, 22 bp, Homo sapiens
ccctgccaggagctttggacct

SEQ ID NO: 2357335 - DNA, 18 bp, Homo sapiens
ccctgcccccagccccgg

SEQ ID NO: 2357336 - DNA, 14 bp, Homo sapiens
ccctgccctgtggg

SEQ ID NO: 2357337 - DNA, 14 bp, Homo sapiens
ccctgcctcctgga

SEQ ID NO: 2357338 - DNA, 12 bp, Homo sapiens
ccctgctcagca

SEQ ID NO: 2357339 - DNA, 15 bp, Homo sapiens
ccctgcttccaggaa

SEQ ID NO: 2357340 - DNA, 16 bp, Homo sapiens
ccctggaagagcccag

SEQ ID NO: 2357341 - DNA, 23 bp, Homo sapiens
ccctggaatgagttgaggccact

SEQ ID NO: 2357342 - DNA, 10 bp, Homo sapiens
ccctggacag

SEQ ID NO: 2357343 - DNA, 14 bp, Homo sapiens
ccctggacaggcag

SEQ ID NO: 2357344 - DNA, 18 bp, Homo sapiens
ccctggagaagcaccagc

SEQ ID NO: 2357345 - DNA, 13 bp, Homo sapiens
ccctggagtcagg

SEQ ID NO: 2357346 - DNA, 11 bp, Homo sapiens
ccctggcccct

SEQ ID NO: 2357347 - DNA, 20 bp, Homo sapiens
ccctggccgcgctccgggct

SEQ ID NO: 2357348 - DNA, 16 bp, Homo sapiens
ccctggctccctcctc

SEQ ID NO: 2357349 - DNA, 21 bp, Homo sapiens
ccctgggccagcggggctgct

SEQ ID NO: 2357350 - DNA, 19 bp, Homo sapiens
ccctgggctgggtgctggg

SEQ ID NO: 2357351 - DNA, 20 bp, Homo sapiens
ccctgggctgggtgctggga

SEQ ID NO: 2357352 - DNA, 20 bp, Homo sapiens
ccctgggcttggcctgctgt

SEQ ID NO: 2357353 - DNA, 22 bp, Homo sapiens
ccctgggcttggcctgctgtga

SEQ ID NO: 2357354 - DNA, 21 bp, Homo sapiens
ccctggggcctgactgctcag

SEQ ID NO: 2357355 - DNA, 22 bp, Homo sapiens
ccctggttattgatgtggccct

SEQ ID NO: 2357356 - DNA, 15 bp, Homo sapiens
ccctgtagctcagtc

SEQ ID NO: 2357357 - DNA, 14 bp, Homo sapiens
ccctgtccaaaagc

SEQ ID NO: 2357358 - DNA, 21 bp, Homo sapiens
ccctgtccggaatgccaccca

SEQ ID NO: 2357359 - DNA, 21 bp, Homo sapiens
ccctgtgacatggtgcctgag

SEQ ID NO: 2357360 - DNA, 15 bp, Homo sapiens
ccctgtgctcccctg

SEQ ID NO: 2357361 - DNA, 18 bp, Homo sapiens
ccctgtggggcctgatgg

SEQ ID NO: 2357362 - DNA, 13 bp, Homo sapiens
ccctgttccctgg

SEQ ID NO: 2357363 - DNA, 13 bp, Homo sapiens
ccctgttcctgct

SEQ ID NO: 2357364 - DNA, 14 bp, Homo sapiens
ccctgttcctgctg

SEQ ID NO: 2357365 - DNA, 19 bp, Homo sapiens
cccttattgctgtcctgga

SEQ ID NO: 2357366 - DNA, 17 bp, Homo sapiens
cccttcaatgctgcagg

SEQ ID NO: 2357367 - DNA, 21 bp, Homo sapiens
cccttccctctgggcacgcct

SEQ ID NO: 2357368 - DNA, 13 bp, Homo sapiens
cccttccctgagt

SEQ ID NO: 2357369 - DNA, 14 bp, Homo sapiens
cccttccctgagtg

SEQ ID NO: 2357370 - DNA, 20 bp, Homo sapiens
cccttcctcttgtctgattt

SEQ ID NO: 2357371 - DNA, 22 bp, Homo sapiens
cccttccttttccctgcttcca

SEQ ID NO: 2357372 - DNA, 20 bp, Homo sapiens
cccttctcccactctcctag

SEQ ID NO: 2357373 - DNA, 19 bp, Homo sapiens
cccttgaatctgcagggag

SEQ ID NO: 2357374 - DNA, 18 bp, Homo sapiens
cccttgcacagctggaga

SEQ ID NO: 2357375 - DNA, 21 bp, Homo sapiens
cccttgcctttcgaggcctga

SEQ ID NO: 2357376 - DNA, 13 bp, Homo sapiens
cccttgctggccc

SEQ ID NO: 2357377 - DNA, 15 bp, Homo sapiens
cccttgctggcccca

SEQ ID NO: 2357378 - DNA, 13 bp, Homo sapiens
ccctttaccctct

SEQ ID NO: 2357379 - DNA, 17 bp, Homo sapiens
ccctttcccaccccaac

SEQ ID NO: 2357380 - DNA, 20 bp, Homo sapiens
ccctttcccaccccaacctg

SEQ ID NO: 2357381 - DNA, 23 bp, Homo sapiens
ccctttcccaccccaacctgctc

SEQ ID NO: 2357382 - DNA, 17 bp, Homo sapiens
ccctttctagaccaata

SEQ ID NO: 2357383 - DNA, 21 bp, Homo sapiens
ccctttggccccactttgaag

SEQ ID NO: 2357384 - DNA, 20 bp, Homo sapiens
ccctttggtttttttcttct

SEQ ID NO: 2357385 - DNA, 21 bp, Homo sapiens
ccctttttatgtgggatatag

SEQ ID NO: 2357386 - DNA, 23 bp, Homo sapiens
ccgaagggaattaaaaagaagat

SEQ ID NO: 2357387 - DNA, 13 bp, Homo sapiens
ccgacctggccgc

SEQ ID NO: 2357388 - DNA, 17 bp, Homo sapiens
ccgagaggccagttgat

SEQ ID NO: 2357389 - DNA, 18 bp, Homo sapiens
ccgaggggagggcaggat

SEQ ID NO: 2357390 - DNA, 13 bp, Homo sapiens
ccgatgccaccgg

SEQ ID NO: 2357391 - DNA, 19 bp, Homo sapiens
ccgatgccaccggcctgtg

SEQ ID NO: 2357392 - DNA, 13 bp, Homo sapiens
ccgcacagctcag

SEQ ID NO: 2357393 - DNA, 11 bp, Homo sapiens
ccgcagggcca

SEQ ID NO: 2357394 - DNA, 14 bp, Homo sapiens
ccgcagggccatgc

SEQ ID NO: 2357395 - DNA, 20 bp, Homo sapiens
ccgcagggccatgcagacct

SEQ ID NO: 2357396 - DNA, 19 bp, Homo sapiens
ccgccaccgcgggtgtggg

SEQ ID NO: 2357397 - DNA, 11 bp, Homo sapiens
ccgccagcctc

SEQ ID NO: 2357398 - DNA, 12 bp, Homo sapiens
ccgccagcctcc

SEQ ID NO: 2357399 - DNA, 14 bp, Homo sapiens
ccgccagcctcctc

SEQ ID NO: 2357400 - DNA, 17 bp, Homo sapiens
ccgccatggtgtcccgg

SEQ ID NO: 2357401 - DNA, 14 bp, Homo sapiens
ccgcccatgctgtc

SEQ ID NO: 2357402 - DNA, 18 bp, Homo sapiens
ccgccccagagtggccca

SEQ ID NO: 2357403 - DNA, 13 bp, Homo sapiens
ccgcccccagtcc

SEQ ID NO: 2357404 - DNA, 19 bp, Homo sapiens
ccgcccccagtccccaccc

SEQ ID NO: 2357405 - DNA, 14 bp, Homo sapiens
ccgcctctgcccgc

SEQ ID NO: 2357406 - DNA, 17 bp, Homo sapiens
ccgcctctgcccgcaga

SEQ ID NO: 2357407 - DNA, 13 bp, Homo sapiens
ccgcctggccagg

SEQ ID NO: 2357408 - DNA, 14 bp, Homo sapiens
ccgcctggccagga

SEQ ID NO: 2357409 - DNA, 16 bp, Homo sapiens
ccgcctggccaggagc

SEQ ID NO: 2357410 - DNA, 20 bp, Homo sapiens
ccgcctggccaggagcaggc

SEQ ID NO: 2357411 - DNA, 23 bp, Homo sapiens
ccgcctggccaggagcaggcacg

SEQ ID NO: 2357412 - DNA, 14 bp, Homo sapiens
ccgcctggcctggc

SEQ ID NO: 2357413 - DNA, 15 bp, Homo sapiens
ccgcgaccatgtggc

SEQ ID NO: 2357414 - DNA, 19 bp, Homo sapiens
ccgcggggaagctggcttt

SEQ ID NO: 2357415 - DNA, 15 bp, Homo sapiens
ccgctgccagccttg

SEQ ID NO: 2357416 - DNA, 14 bp, Homo sapiens
ccgctggcccttag

SEQ ID NO: 2357417 - DNA, 20 bp, Homo sapiens
ccgctgggtggttttttccc

SEQ ID NO: 2357418 - DNA, 14 bp, Homo sapiens
ccgcttctccccag

SEQ ID NO: 2357419 - DNA, 20 bp, Homo sapiens
ccgcttggagctattttcca

SEQ ID NO: 2357420 - DNA, 16 bp, Homo sapiens
ccggaatgccacccac

SEQ ID NO: 2357421 - DNA, 16 bp, Homo sapiens
ccggactggtgccctc

SEQ ID NO: 2357422 - DNA, 18 bp, Homo sapiens
ccggactggtgccctcct

SEQ ID NO: 2357423 - DNA, 11 bp, Homo sapiens
ccggatttcta

SEQ ID NO: 2357424 - DNA, 22 bp, Homo sapiens
ccggccccctccccccagactc

SEQ ID NO: 2357425 - DNA, 20 bp, Homo sapiens
ccggcctgtgggtctctgaa

SEQ ID NO: 2357426 - DNA, 17 bp, Homo sapiens
ccggcggctactctgga

SEQ ID NO: 2357427 - DNA, 23 bp, Homo sapiens
ccgggatattatagaaaattatt

SEQ ID NO: 2357428 - DNA, 15 bp, Homo sapiens
ccgggccagggctgc

SEQ ID NO: 2357429 - DNA, 19 bp, Homo sapiens
ccggggccttatcgggctc

SEQ ID NO: 2357430 - DNA, 14 bp, Homo sapiens
ccggtccagctggc

SEQ ID NO: 2357431 - DNA, 23 bp, Homo sapiens
ccgtccatatcagaactgtgcca

SEQ ID NO: 2357432 - DNA, 15 bp, Homo sapiens
ccgtgaaccagaggg

SEQ ID NO: 2357433 - DNA, 19 bp, Homo sapiens
ccgtgatttggaagagagg

SEQ ID NO: 2357434 - DNA, 22 bp, Homo sapiens
ccgtgcatcccccctgctcagc

SEQ ID NO: 2357435 - DNA, 15 bp, Homo sapiens
ccgtgcctggccaga

SEQ ID NO: 2357436 - DNA, 20 bp, Homo sapiens
ccgtggaggaggaaggcaag

SEQ ID NO: 2357437 - DNA, 22 bp, Homo sapiens
ccgtggaggaggaaggcaagag

SEQ ID NO: 2357438 - DNA, 23 bp, Homo sapiens
ccgtggctgttgacgcacctgtg

SEQ ID NO: 2357439 - DNA, 21 bp, Homo sapiens
ccgttccaccccaagagaact

SEQ ID NO: 2357440 - DNA, 15 bp, Homo sapiens
ccgttgtgagctgga

SEQ ID NO: 2357441 - DNA, 19 bp, Homo sapiens
cctaaaataacagtatgtg

SEQ ID NO: 2357442 - DNA, 16 bp, Homo sapiens
cctaaactttggcctt

SEQ ID NO: 2357443 - DNA, 23 bp, Homo sapiens
cctaaagagagtatttttataca

SEQ ID NO: 2357444 - DNA, 20 bp, Homo sapiens
cctaaagtatacaactgcct

SEQ ID NO: 2357445 - DNA, 18 bp, Homo sapiens
cctaagggatcctgcctg

SEQ ID NO: 2357446 - DNA, 19 bp, Homo sapiens
cctaatgtttatgagccag

SEQ ID NO: 2357447 - DNA, 15 bp, Homo sapiens
cctaatttctcctcc

SEQ ID NO: 2357448 - DNA, 16 bp, Homo sapiens
cctaatttctcctccc

SEQ ID NO: 2357449 - DNA, 17 bp, Homo sapiens
cctaatttctcctccct

SEQ ID NO: 2357450 - DNA, 20 bp, Homo sapiens
cctacatcccgggcctcagt

SEQ ID NO: 2357451 - DNA, 13 bp, Homo sapiens
cctacgtccaagg

SEQ ID NO: 2357452 - DNA, 23 bp, Homo sapiens
cctactcaagcgggtggctctgg

SEQ ID NO: 2357453 - DNA, 18 bp, Homo sapiens
cctactcacacttcagct

SEQ ID NO: 2357454 - DNA, 17 bp, Homo sapiens
cctactgaagtggctgg

SEQ ID NO: 2357455 - DNA, 12 bp, Homo sapiens
cctactgctgtg

SEQ ID NO: 2357456 - DNA, 15 bp, Homo sapiens
cctacttagggaaga

SEQ ID NO: 2357457 - DNA, 19 bp, Homo sapiens
cctacttagggaagaaaaa

SEQ ID NO: 2357458 - DNA, 14 bp, Homo sapiens
cctactttgacttt

SEQ ID NO: 2357459 - DNA, 15 bp, Homo sapiens
cctactttgactttt

SEQ ID NO: 2357460 - DNA, 15 bp, Homo sapiens
cctagcacagcagct

SEQ ID NO: 2357461 - DNA, 13 bp, Homo sapiens
cctagcaggctgt

SEQ ID NO: 2357462 - DNA, 16 bp, Homo sapiens
cctagcccttccctga

SEQ ID NO: 2357463 - DNA, 17 bp, Homo sapiens
cctagcccttccctgag

SEQ ID NO: 2357464 - DNA, 19 bp, Homo sapiens
cctagcccttccctgagtg

SEQ ID NO: 2357465 - DNA, 19 bp, Homo sapiens
cctagcgatctctcctggc

SEQ ID NO: 2357466 - DNA, 21 bp, Homo sapiens
cctagcgatctctcctggcct

SEQ ID NO: 2357467 - DNA, 22 bp, Homo sapiens
cctagcgatctctcctggccta

SEQ ID NO: 2357468 - DNA, 20 bp, Homo sapiens
cctagctcctccccttcctc

SEQ ID NO: 2357469 - DNA, 22 bp, Homo sapiens
cctagctctcccagtgaactcc

SEQ ID NO: 2357470 - DNA, 17 bp, Homo sapiens
cctagctggctctgtga

SEQ ID NO: 2357471 - DNA, 21 bp, Homo sapiens
cctagctttagaccctgggtg

SEQ ID NO: 2357472 - DNA, 22 bp, Homo sapiens
cctaggaaactcacactcccct

SEQ ID NO: 2357473 - DNA, 16 bp, Homo sapiens
cctagtttgtgagaaa

SEQ ID NO: 2357474 - DNA, 12 bp, Homo sapiens
cctagttttcca

SEQ ID NO: 2357475 - DNA, 15 bp, Homo sapiens
cctagttttccatgc

SEQ ID NO: 2357476 - DNA, 18 bp, Homo sapiens
cctatagcactgagctca

SEQ ID NO: 2357477 - DNA, 15 bp, Homo sapiens
cctatccctctccta

SEQ ID NO: 2357478 - DNA, 17 bp, Homo sapiens
cctatccgctgccagcc

SEQ ID NO: 2357479 - DNA, 18 bp, Homo sapiens
cctatccgctgccagcct

SEQ ID NO: 2357480 - DNA, 20 bp, Homo sapiens
cctatccttggagagcagct

SEQ ID NO: 2357481 - DNA, 22 bp, Homo sapiens
cctatccttggagagcagctgg

SEQ ID NO: 2357482 - DNA, 23 bp, Homo sapiens
cctatccttggagagcagctggc

SEQ ID NO: 2357483 - DNA, 16 bp, Homo sapiens
cctatctcctgacaga

SEQ ID NO: 2357484 - DNA, 20 bp, Homo sapiens
cctatgcacatatggactct

SEQ ID NO: 2357485 - DNA, 17 bp, Homo sapiens
cctatgccaagtccctg

SEQ ID NO: 2357486 - DNA, 20 bp, Homo sapiens
cctatgcttaataaaagaac

SEQ ID NO: 2357487 - DNA, 19 bp, Homo sapiens
cctatgggcctgccgggct

SEQ ID NO: 2357488 - DNA, 20 bp, Homo sapiens
cctattaatgtctcacttta

SEQ ID NO: 2357489 - DNA, 17 bp, Homo sapiens
cctattatcccagctgc

SEQ ID NO: 2357490 - DNA, 21 bp, Homo sapiens
cctattctatccatctcctgg

SEQ ID NO: 2357491 - DNA, 21 bp, Homo sapiens
cctattgtaatcgtgtgccat

SEQ ID NO: 2357492 - DNA, 17 bp, Homo sapiens
cctatttgccatgggct

SEQ ID NO: 2357493 - DNA, 17 bp, Homo sapiens
cctcaaattttttgact

SEQ ID NO: 2357494 - DNA, 21 bp, Homo sapiens
cctcaactcacctaatgttta

SEQ ID NO: 2357495 - DNA, 13 bp, Homo sapiens
cctcaactgaagg

SEQ ID NO: 2357496 - DNA, 15 bp, Homo sapiens
cctcaactgcctact

SEQ ID NO: 2357497 - DNA, 13 bp, Homo sapiens
cctcaagcaatcc

SEQ ID NO: 2357498 - DNA, 19 bp, Homo sapiens
cctcaagggggactgtctt

SEQ ID NO: 2357499 - DNA, 17 bp, Homo sapiens
cctcaagtgtcctgaaa

SEQ ID NO: 2357500 - DNA, 12 bp, Homo sapiens
cctcaccattcc

SEQ ID NO: 2357501 - DNA, 12 bp, Homo sapiens
cctcacctcatg

SEQ ID NO: 2357502 - DNA, 19 bp, Homo sapiens
cctcacctcatgcccaccc

SEQ ID NO: 2357503 - DNA, 23 bp, Homo sapiens
cctcacctcatgcccaccccctg

SEQ ID NO: 2357504 - DNA, 18 bp, Homo sapiens
cctcactccctctgcaga

SEQ ID NO: 2357505 - DNA, 22 bp, Homo sapiens
cctcactcgggtttctctgtgg

SEQ ID NO: 2357506 - DNA, 23 bp, Homo sapiens
cctcactcgggtttctctgtggc

SEQ ID NO: 2357507 - DNA, 17 bp, Homo sapiens
cctcactggctctcctg

SEQ ID NO: 2357508 - DNA, 11 bp, Homo sapiens
cctcagccctc

SEQ ID NO: 2357509 - DNA, 18 bp, Homo sapiens
cctctgggcacgcctgct

SEQ ID NO: 2357510 - DNA, 22 bp, Homo sapiens
cctctgggcacgcctgctggcc

SEQ ID NO: 2357511 - DNA, 23 bp, Homo sapiens
cctctgggcacgcctgctggccg

SEQ ID NO: 2357512 - DNA, 15 bp, Homo sapiens
cctcttccagtgaac

SEQ ID NO: 2357513 - DNA, 17 bp, Homo sapiens
cctcttccagtgaacat

SEQ ID NO: 2357514 - DNA, 16 bp, Homo sapiens
cctcttcctccctggg

SEQ ID NO: 2357515 - DNA, 21 bp, Homo sapiens
cctcttcctgtgatccaccca

SEQ ID NO: 2357516 - DNA, 23 bp, Homo sapiens
cctcttctactcacttttcccac

SEQ ID NO: 2357517 - DNA, 19 bp, Homo sapiens
cctcttctcgtgcctcccc

SEQ ID NO: 2357518 - DNA, 17 bp, Homo sapiens
cctcttgtaaagactgg

SEQ ID NO: 2357519 - DNA, 21 bp, Homo sapiens
cctcttgtgcaaggtggcctt

SEQ ID NO: 2357520 - DNA, 18 bp, Homo sapiens
cctctttctgctctgcca

SEQ ID NO: 2357521 - DNA, 24 bp, Homo sapiens
cctcttttgcttgccaaagtacag

SEQ ID NO: 2357522 - DNA, 14 bp, Homo sapiens
cctctttttcctcc

SEQ ID NO: 2357523 - DNA, 20 bp, Homo sapiens
cctgaaacgctcctttgtgt

SEQ ID NO: 2357524 - DNA, 21 bp, Homo sapiens
cctgaaagcccttctcaagac

SEQ ID NO: 2357525 - DNA, 22 bp, Homo sapiens
cctgaaccgcacagctcaggag

SEQ ID NO: 2357526 - DNA, 20 bp, Homo sapiens
cctgaacgttttcttctttc

SEQ ID NO: 2357527 - DNA, 16 bp, Homo sapiens
cctgaatcatgagcct

SEQ ID NO: 2357528 - DNA, 17 bp, Homo sapiens
cctgaatccaaactaat

SEQ ID NO: 2357529 - DNA, 13 bp, Homo sapiens
cctgacacccttc

SEQ ID NO: 2357530 - DNA, 23 bp, Homo sapiens
cctgacacccttctcccactctc

SEQ ID NO: 2357531 - DNA, 15 bp, Homo sapiens
cctgacactttaatt

SEQ ID NO: 2357532 - DNA, 15 bp, Homo sapiens
cctgacagaaggtgc

SEQ ID NO: 2357533 - DNA, 16 bp, Homo sapiens
cctgacagaaggtgcc

SEQ ID NO: 2357534 - DNA, 12 bp, Homo sapiens
cctgacccaggg

SEQ ID NO: 2357535 - DNA, 13 bp, Homo sapiens
cctgacccaggga

SEQ ID NO: 2357536 - DNA, 21 bp, Homo sapiens
cctgacccagggactctccaa

SEQ ID NO: 2357537 - DNA, 14 bp, Homo sapiens
cctgacccctgctc

SEQ ID NO: 2357538 - DNA, 16 bp, Homo sapiens
cctgacccctgctcag

SEQ ID NO: 2357539 - DNA, 14 bp, Homo sapiens
cctgacctggcccc

SEQ ID NO: 2357540 - DNA, 16 bp, Homo sapiens
cctgactcctctggct

SEQ ID NO: 2357541 - DNA, 17 bp, Homo sapiens
cctgactcctctggctt

SEQ ID NO: 2357542 - DNA, 19 bp, Homo sapiens
cctgactcctctggctttc

SEQ ID NO: 2357543 - DNA, 20 bp, Homo sapiens
cctgagaagaagtggctgcc

SEQ ID NO: 2357544 - DNA, 21 bp, Homo sapiens
cctgagaagaagtggctgcca

SEQ ID NO: 2357545 - DNA, 12 bp, Homo sapiens
cctgagaccaca

SEQ ID NO: 2357546 - DNA, 18 bp, Homo sapiens
cctgagaccctactgaag

SEQ ID NO: 2357547 - DNA, 17 bp, Homo sapiens
cctgagaggcaggcata

SEQ ID NO: 2357548 - DNA, 20 bp, Homo sapiens
cctgagcccctttgcctgtc

SEQ ID NO: 2357549 - DNA, 17 bp, Homo sapiens
cctgagccctactccct

SEQ ID NO: 2357550 - DNA, 20 bp, Homo sapiens
cctgagctattttcctctgg

SEQ ID NO: 2357551 - DNA, 22 bp, Homo sapiens
cctgaggccctgggctgggtgc

SEQ ID NO: 2357552 - DNA, 18 bp, Homo sapiens
cctgaggcctagactctg

SEQ ID NO: 2357553 - DNA, 17 bp, Homo sapiens
cctgaggcggaggctgt

SEQ ID NO: 2357554 - DNA, 20 bp, Homo sapiens
cctgaggcggaggctgtgct

SEQ ID NO: 2357555 - DNA, 21 bp, Homo sapiens
cctgaggcggaggctgtgctc

SEQ ID NO: 2357556 - DNA, 12 bp, Homo sapiens
cctgagtcagtg

SEQ ID NO: 2357557 - DNA, 22 bp, Homo sapiens
cctgagtcgtacagaaagctgc

SEQ ID NO: 2357558 - DNA, 14 bp, Homo sapiens
cctgagtgcgggct

SEQ ID NO: 2357559 - DNA, 17 bp, Homo sapiens
cctgagtgcgggctgag

SEQ ID NO: 2357560 - DNA, 21 bp, Homo sapiens
cctgagtgcgggctgaggcca

SEQ ID NO: 2357561 - DNA, 22 bp, Homo sapiens
cctgagtgcgggctgaggccag

SEQ ID NO: 2357562 - DNA, 23 bp, Homo sapiens
cctgagtgcgggctgaggccaga

SEQ ID NO: 2357563 - DNA, 12 bp, Homo sapiens
cctgcaaactgg

SEQ ID NO: 2357564 - DNA, 22 bp, Homo sapiens
cctgcaaactgggaaccccttt

SEQ ID NO: 2357565 - DNA, 13 bp, Homo sapiens
cctgcaagatgga

SEQ ID NO: 2357566 - DNA, 21 bp, Homo sapiens
cctgcacacagaatgctcagg

SEQ ID NO: 2357567 - DNA, 17 bp, Homo sapiens
cctgcacacaggacagc

SEQ ID NO: 2357568 - DNA, 18 bp, Homo sapiens
cctgcacacaggacagcg

SEQ ID NO: 2357569 - DNA, 20 bp, Homo sapiens
cctgcacggggcattcctgc

SEQ ID NO: 2357570 - DNA, 20 bp, Homo sapiens
cctgcagacctcaagccatc

SEQ ID NO: 2357571 - DNA, 21 bp, Homo sapiens
cctgcagatgccaccctagcc

SEQ ID NO: 2357572 - DNA, 23 bp, Homo sapiens
cctgcagcccaccagacgtcagg

SEQ ID NO: 2357573 - DNA, 18 bp, Homo sapiens
cctgcaggagagagcagc

SEQ ID NO: 2357574 - DNA, 20 bp, Homo sapiens
cctgcaggagagagcagcac

SEQ ID NO: 2357575 - DNA, 15 bp, Homo sapiens
cctgcaggcagagct

SEQ ID NO: 2357576 - DNA, 21 bp, Homo sapiens
cctgcaggcagagctggagcc

SEQ ID NO: 2357577 - DNA, 22 bp, Homo sapiens
cctgcaggcaggaacaaacagg

SEQ ID NO: 2357578 - DNA, 14 bp, Homo sapiens
cctgcatctggggc

SEQ ID NO: 2357579 - DNA, 13 bp, Homo sapiens
cctgcatttcctc

SEQ ID NO: 2357580 - DNA, 14 bp, Homo sapiens
cctgccacactgat

SEQ ID NO: 2357581 - DNA, 11 bp, Homo sapiens
cctgccacagc

SEQ ID NO: 2357582 - DNA, 13 bp, Homo sapiens
cctgccacagcca

SEQ ID NO: 2357583 - DNA, 14 bp, Homo sapiens
cctgccacagccag

SEQ ID NO: 2357584 - DNA, 16 bp, Homo sapiens
cctgccacagccagag

SEQ ID NO: 2357585 - DNA, 17 bp, Homo sapiens
cctgccacagccagagg

SEQ ID NO: 2357586 - DNA, 21 bp, Homo sapiens
cctgccaggagctttggacct

SEQ ID NO: 2357587 - DNA, 12 bp, Homo sapiens
cctgccaggcac

SEQ ID NO: 2357588 - DNA, 19 bp, Homo sapiens
cctgccaggcacacacagc

SEQ ID NO: 2357589 - DNA, 13 bp, Homo sapiens
cctgccaggcagg

SEQ ID NO: 2357590 - DNA, 13 bp, Homo sapiens
cctgcccccagcc

SEQ ID NO: 2357591 - DNA, 17 bp, Homo sapiens
cctgcccccagccccgg

SEQ ID NO: 2357592 - DNA, 13 bp, Homo sapiens
cctgccctcaagg

SEQ ID NO: 2357593 - DNA, 18 bp, Homo sapiens
cctgccctcactccctct

SEQ ID NO: 2357594 - DNA, 21 bp, Homo sapiens
cctgccctcactccctctgca

SEQ ID NO: 2357595 - DNA, 11 bp, Homo sapiens
cctgccctgca

SEQ ID NO: 2357596 - DNA, 13 bp, Homo sapiens
cctgccctgtcca

SEQ ID NO: 2357597 - DNA, 14 bp, Homo sapiens
cctgcccttccctc

SEQ ID NO: 2357598 - DNA, 18 bp, Homo sapiens
cctgcccttccctctggg

SEQ ID NO: 2357599 - DNA, 19 bp, Homo sapiens
cctgcccttccctctgggc

SEQ ID NO: 2357600 - DNA, 20 bp, Homo sapiens
cctgccgggctgagggcctg

SEQ ID NO: 2357601 - DNA, 13 bp, Homo sapiens
cctgcctgtctgc

SEQ ID NO: 2357602 - DNA, 13 bp, Homo sapiens
cctgcctgtgcat

SEQ ID NO: 2357603 - DNA, 23 bp, Homo sapiens
cctgccttggcctcccaaagtgc

SEQ ID NO: 2357604 - DNA, 16 bp, Homo sapiens
cctgcgccagtcctgc

SEQ ID NO: 2357605 - DNA, 15 bp, Homo sapiens
cctgcgcctgctgcc

SEQ ID NO: 2357606 - DNA, 17 bp, Homo sapiens
cctgcgctctctttgca

SEQ ID NO: 2357607 - DNA, 14 bp, Homo sapiens
cctgcgggccaggg

SEQ ID NO: 2357608 - DNA, 18 bp, Homo sapiens
cctgcgtcctcctcacct

SEQ ID NO: 2357609 - DNA, 19 bp, Homo sapiens
cctgcgtcctcctcacctc

SEQ ID NO: 2357610 - DNA, 14 bp, Homo sapiens
cctgctacacctat

SEQ ID NO: 2357611 - DNA, 21 bp, Homo sapiens
cctgctacacctattatccca

SEQ ID NO: 2357612 - DNA, 23 bp, Homo sapiens
cctgctacacctattatcccagc

SEQ ID NO: 2357613 - DNA, 23 bp, Homo sapiens
cctgctcagcaattcagacccct

SEQ ID NO: 2357614 - DNA, 20 bp, Homo sapiens
cctgctcattcctcacgccc

SEQ ID NO: 2357615 - DNA, 14 bp, Homo sapiens
cctgctgacctgtg

SEQ ID NO: 2357616 - DNA, 15 bp, Homo sapiens
cctgctgacctgtgc

SEQ ID NO: 2357617 - DNA, 23 bp, Homo sapiens
cctgctgagatctgctgtcctgt

SEQ ID NO: 2357618 - DNA, 17 bp, Homo sapiens
cctgctgcgtcagacca

SEQ ID NO: 2357619 - DNA, 23 bp, Homo sapiens
cctgctgcgtcagaccagtactg

SEQ ID NO: 2357620 - DNA, 12 bp, Homo sapiens
cctgctggaagc

SEQ ID NO: 2357621 - DNA, 15 bp, Homo sapiens
cctgctggaggcctc

SEQ ID NO: 2357622 - DNA, 16 bp, Homo sapiens
cctgctggaggcctca

SEQ ID NO: 2357623 - DNA, 22 bp, Homo sapiens
ccttaatttcctttttgacact

SEQ ID NO: 2357624 - DNA, 18 bp, Homo sapiens
ccttacatcttttctaat

SEQ ID NO: 2357625 - DNA, 17 bp, Homo sapiens
ccttactcttcttgaaa

SEQ ID NO: 2357626 - DNA, 18 bp, Homo sapiens
ccttactggcttacctcc

SEQ ID NO: 2357627 - DNA, 20 bp, Homo sapiens
ccttagaggtcctctggagc

SEQ ID NO: 2357628 - DNA, 21 bp, Homo sapiens
ccttattgcctcccaggcaag

SEQ ID NO: 2357629 - DNA, 19 bp, Homo sapiens
ccttattgctgtcctggag

SEQ ID NO: 2357630 - DNA, 20 bp, Homo sapiens
ccttcaaaactatagcttgc

SEQ ID NO: 2357631 - DNA, 13 bp, Homo sapiens
ccttcaatgctgc

SEQ ID NO: 2357632 - DNA, 14 bp, Homo sapiens
ccttcagcacagga

SEQ ID NO: 2357633 - DNA, 12 bp, Homo sapiens
ccttcagctcca

SEQ ID NO: 2357634 - DNA, 18 bp, Homo sapiens
ccttcagttatgattttt

SEQ ID NO: 2357635 - DNA, 15 bp, Homo sapiens
ccttcatcttcctgt

SEQ ID NO: 2357636 - DNA, 18 bp, Homo sapiens
ccttcatcttcctgtgtc

SEQ ID NO: 2357637 - DNA, 19 bp, Homo sapiens
ccttcatcttcctgtgtcc

SEQ ID NO: 2357638 - DNA, 17 bp, Homo sapiens
ccttcatttccaccagg

SEQ ID NO: 2357639 - DNA, 15 bp, Homo sapiens
ccttccactctggaa

SEQ ID NO: 2357640 - DNA, 13 bp, Homo sapiens
ccttccagatcac

SEQ ID NO: 2357641 - DNA, 20 bp, Homo sapiens
ccttccagggatttgcctca

SEQ ID NO: 2357642 - DNA, 23 bp, Homo sapiens
ccttccagggatttgcctcacct

SEQ ID NO: 2357643 - DNA, 19 bp, Homo sapiens
ccttccatacacagaggag

SEQ ID NO: 2357644 - DNA, 22 bp, Homo sapiens
ccttcccccaccggtccagctg

SEQ ID NO: 2357645 - DNA, 15 bp, Homo sapiens
ccttccctagcttta

SEQ ID NO: 2357646 - DNA, 15 bp, Homo sapiens
ccttccctctctgat

SEQ ID NO: 2357647 - DNA, 13 bp, Homo sapiens
ccttccctctggg

SEQ ID NO: 2357648 - DNA, 20 bp, Homo sapiens
ccttccctctgggcacgcct

SEQ ID NO: 2357649 - DNA, 16 bp, Homo sapiens
ccttccgcttggagct

SEQ ID NO: 2357650 - DNA, 15 bp, Homo sapiens
ccttccttttccctg

SEQ ID NO: 2357651 - DNA, 16 bp, Homo sapiens
ccttccttttccctgc

SEQ ID NO: 2357652 - DNA, 18 bp, Homo sapiens
ccttccttttccctgctt

SEQ ID NO: 2357653 - DNA, 18 bp, Homo sapiens
ccttctacaaggactcca

SEQ ID NO: 2357654 - DNA, 15 bp, Homo sapiens
ccttctattctagcc

SEQ ID NO: 2357655 - DNA, 15 bp, Homo sapiens
ccttctatttggggc

SEQ ID NO: 2357656 - DNA, 16 bp, Homo sapiens
ccttctatttggggct

SEQ ID NO: 2357657 - DNA, 22 bp, Homo sapiens
ccttctatttggggcttgatga

SEQ ID NO: 2357658 - DNA, 18 bp, Homo sapiens
ccttctcagaagcacaga

SEQ ID NO: 2357659 - DNA, 21 bp, Homo sapiens
ccttctgagctcctgtcccct

SEQ ID NO: 2357660 - DNA, 20 bp, Homo sapiens
ccttctttgataatgttaaa

SEQ ID NO: 2357661 - DNA, 13 bp, Homo sapiens
ccttgagccctgg

SEQ ID NO: 2357662 - DNA, 15 bp, Homo sapiens
ccttgagccctggct

SEQ ID NO: 2357663 - DNA, 17 bp, Homo sapiens
ccttgagccctggctgt

SEQ ID NO: 2357664 - DNA, 22 bp, Homo sapiens
ccttgagccctggctgttctgt

SEQ ID NO: 2357665 - DNA, 15 bp, Homo sapiens
ccttgagctgttgtg

SEQ ID NO: 2357666 - DNA, 16 bp, Homo sapiens
ccttgagggctgcagt

SEQ ID NO: 2357667 - DNA, 14 bp, Homo sapiens
ccttgatgactgcc

SEQ ID NO: 2357668 - DNA, 13 bp, Homo sapiens
ccttgatttcaaa

SEQ ID NO: 2357669 - DNA, 14 bp, Homo sapiens
ccttgcaaagcaac

SEQ ID NO: 2357670 - DNA, 21 bp, Homo sapiens
ccttgcaacctcaccttcctg

SEQ ID NO: 2357671 - DNA, 11 bp, Homo sapiens
ccttgcatcaa

SEQ ID NO: 2357672 - DNA, 13 bp, Homo sapiens
ccttgccagggca

SEQ ID NO: 2357673 - DNA, 20 bp, Homo sapiens
ccttgccccccgccctcatg

SEQ ID NO: 2357674 - DNA, 14 bp, Homo sapiens
ccttgcctcctcag

SEQ ID NO: 2357675 - DNA, 13 bp, Homo sapiens
ccttgcgcctcag

SEQ ID NO: 2357676 - DNA, 22 bp, Homo sapiens
ccttgctggccccagccctgct

SEQ ID NO: 2357677 - DNA, 12 bp, Homo sapiens
ccttgcttctgt

SEQ ID NO: 2357678 - DNA, 20 bp, Homo sapiens
ccttgcttctgtatttcctt

SEQ ID NO: 2357679 - DNA, 23 bp, Homo sapiens
ccttgctttggggggtgtgctga

SEQ ID NO: 2357680 - DNA, 17 bp, Homo sapiens
ccttggaaatgtctgct

SEQ ID NO: 2357681 - DNA, 18 bp, Homo sapiens
ccttggaaatgtctgctg

SEQ ID NO: 2357682 - DNA, 16 bp, Homo sapiens
ccttggaaccagcccc

SEQ ID NO: 2357683 - DNA, 17 bp, Homo sapiens
ccttggaaccagcccca

SEQ ID NO: 2357684 - DNA, 14 bp, Homo sapiens
ccttggagagcagc

SEQ ID NO: 2357685 - DNA, 22 bp, Homo sapiens
ccttggagagcagctggctctc

SEQ ID NO: 2357686 - DNA, 15 bp, Homo sapiens
ccttggattttcctg

SEQ ID NO: 2357687 - DNA, 17 bp, Homo sapiens
ccttggcctcccaaagt

SEQ ID NO: 2357688 - DNA, 14 bp, Homo sapiens
ccttgggctctgat

SEQ ID NO: 2357689 - DNA, 16 bp, Homo sapiens
ccttgggctctgatga

SEQ ID NO: 2357690 - DNA, 15 bp, Homo sapiens
ccttgggggctccca

SEQ ID NO: 2357691 - DNA, 12 bp, Homo sapiens
ccttgtggcttc

SEQ ID NO: 2357692 - DNA, 17 bp, Homo sapiens
ccttgttgtttcttgcc

SEQ ID NO: 2357693 - DNA, 21 bp, Homo sapiens
ccttgtttgagtttttcctcc

SEQ ID NO: 2357694 - DNA, 12 bp, Homo sapiens
cctttaaaatat

SEQ ID NO: 2357695 - DNA, 13 bp, Homo sapiens
cctttaccactgt

SEQ ID NO: 2357696 - DNA, 19 bp, Homo sapiens
cctttaccctctttgctgc

SEQ ID NO: 2357697 - DNA, 22 bp, Homo sapiens
cctttaccctctttgctgcaga

SEQ ID NO: 2357698 - DNA, 17 bp, Homo sapiens
cctttaggcagcctgcc

SEQ ID NO: 2357699 - DNA, 18 bp, Homo sapiens
cctttaggcagcctgccg

SEQ ID NO: 2357700 - DNA, 19 bp, Homo sapiens
cctttaggcagcctgccgc

SEQ ID NO: 2357701 - DNA, 22 bp, Homo sapiens
cctttatgatgctaagctgata

SEQ ID NO: 2357702 - DNA, 23 bp, Homo sapiens
cctttatgtgaatttttaagctg

SEQ ID NO: 2357703 - DNA, 22 bp, Homo sapiens
cctttcagtgcagtttcttttc

SEQ ID NO: 2357704 - DNA, 13 bp, Homo sapiens
cctttccttccct

SEQ ID NO: 2357705 - DNA, 14 bp, Homo sapiens
cctttctacaactg

SEQ ID NO: 2357706 - DNA, 13 bp, Homo sapiens
cctttctctcctg

SEQ ID NO: 2357707 - DNA, 12 bp, Homo sapiens
cctttcttctgt

SEQ ID NO: 2357708 - DNA, 22 bp, Homo sapiens
cctttcttttaatgatgccatg

SEQ ID NO: 2357709 - DNA, 12 bp, Homo sapiens
cctttgaatgta

SEQ ID NO: 2357710 - DNA, 13 bp, Homo sapiens
cctttgagacagt

SEQ ID NO: 2357711 - DNA, 15 bp, Homo sapiens
cctttgagacagttt

SEQ ID NO: 2357712 - DNA, 21 bp, Homo sapiens
cctttgagagacgccactccc

SEQ ID NO: 2357713 - DNA, 11 bp, Homo sapiens
cctttgggggt

SEQ ID NO: 2357714 - DNA, 16 bp, Homo sapiens
cctttgtaagtgcagg

SEQ ID NO: 2357715 - DNA, 21 bp, Homo sapiens
cctttgtgctgcgcctgcagg

SEQ ID NO: 2357716 - DNA, 20 bp, Homo sapiens
cctttgtgtgctctccattc

SEQ ID NO: 2357717 - DNA, 16 bp, Homo sapiens
cctttgtgtgtgtgtc

SEQ ID NO: 2357718 - DNA, 21 bp, Homo sapiens
cctttgtgtgtgtgtcagctg

SEQ ID NO: 2357719 - DNA, 19 bp, Homo sapiens
ccttttcactttattgcta

SEQ ID NO: 2357720 - DNA, 19 bp, Homo sapiens
ccttttccctgcttccagg

SEQ ID NO: 2357721 - DNA, 19 bp, Homo sapiens
ccttttttaagatttttct

SEQ ID NO: 2357722 - DNA, 23 bp, Homo sapiens
cgaaaggaggccctgttccctgg

SEQ ID NO: 2357723 - DNA, 18 bp, Homo sapiens
cgaaatagatatcctctc

SEQ ID NO: 2357724 - DNA, 18 bp, Homo sapiens
cgaagaccctcttgccca

SEQ ID NO: 2357725 - DNA, 20 bp, Homo sapiens
cgaatggtctttgctccaga

SEQ ID NO: 2357726 - DNA, 13 bp, Homo sapiens
cgactagcaggca

SEQ ID NO: 2357727 - DNA, 15 bp, Homo sapiens
cgagaccatcctggc

SEQ ID NO: 2357728 - DNA, 17 bp, Homo sapiens
cgagaccatcctggcta

SEQ ID NO: 2357729 - DNA, 11 bp, Homo sapiens
cgagaccccag

SEQ ID NO: 2357730 - DNA, 22 bp, Homo sapiens
cgagaccgggccctgggttcct

SEQ ID NO: 2357731 - DNA, 22 bp, Homo sapiens
cgagagaggcgcgtctgcccca

SEQ ID NO: 2357732 - DNA, 15 bp, Homo sapiens
cgagcaaacccagag

SEQ ID NO: 2357733 - DNA, 14 bp, Homo sapiens
cgagccacaagctg

SEQ ID NO: 2357734 - DNA, 14 bp, Homo sapiens
cgagctgctctgct

SEQ ID NO: 2357735 - DNA, 19 bp, Homo sapiens
cgaggtgtcaccctgcaga

SEQ ID NO: 2357736 - DNA, 23 bp, Homo sapiens
cgaggtgtcaccctgcagagcta

SEQ ID NO: 2357737 - DNA, 16 bp, Homo sapiens
cgagtagaaaatgtga

SEQ ID NO: 2357738 - DNA, 13 bp, Homo sapiens
cgtctctgtcccg

SEQ ID NO: 2357739 - DNA, 15 bp, Homo sapiens
cgtctgccccaccct

SEQ ID NO: 2357740 - DNA, 16 bp, Homo sapiens
cgtctgccccaccctc

SEQ ID NO: 2357741 - DNA, 22 bp, Homo sapiens
cgtcttggtgtaatttgaagat

SEQ ID NO: 2357742 - DNA, 19 bp, Homo sapiens
cgtgaaagtgcatttttgt

SEQ ID NO: 2357743 - DNA, 23 bp, Homo sapiens
cgtgaaagtgcatttttgtaaat

SEQ ID NO: 2357744 - DNA, 17 bp, Homo sapiens
cgtgaaagttgtgatct

SEQ ID NO: 2357745 - DNA, 15 bp, Homo sapiens
cgtgacccgacctgg

SEQ ID NO: 2357746 - DNA, 20 bp, Homo sapiens
cgtgatgtggaggaagagcc

SEQ ID NO: 2357747 - DNA, 21 bp, Homo sapiens
cgtgatgtggaggaagagcca

SEQ ID NO: 2357748 - DNA, 20 bp, Homo sapiens
cgtgatttggaagagaggca

SEQ ID NO: 2357749 - DNA, 20 bp, Homo sapiens
cgtgcatcccccctgctcag

SEQ ID NO: 2357750 - DNA, 15 bp, Homo sapiens
cgtgcctggccagat

SEQ ID NO: 2357751 - DNA, 15 bp, Homo sapiens
cgtgctactgcactc

SEQ ID NO: 2357752 - DNA, 17 bp, Homo sapiens
cgtgctactgcactcca

SEQ ID NO: 2357753 - DNA, 15 bp, Homo sapiens
cgtgctgggcggctg

SEQ ID NO: 2357754 - DNA, 19 bp, Homo sapiens
cgtgctgggcggctgtgct

SEQ ID NO: 2357755 - DNA, 22 bp, Homo sapiens
cgtggaatgcccttcactgtca

SEQ ID NO: 2357756 - DNA, 13 bp, Homo sapiens
cgtggactctgca

SEQ ID NO: 2357757 - DNA, 16 bp, Homo sapiens
cgtggactctgcacat

SEQ ID NO: 2357758 - DNA, 14 bp, Homo sapiens
cgtggcccaaggct

SEQ ID NO: 2357759 - DNA, 15 bp, Homo sapiens
cgtggtatgtctgcc

SEQ ID NO: 2357760 - DNA, 16 bp, Homo sapiens
cgtggtatgtctgcca

SEQ ID NO: 2357761 - DNA, 16 bp, Homo sapiens
cgtggtccctgaggat

SEQ ID NO: 2357762 - DNA, 19 bp, Homo sapiens
cgtggtttgcctgaggctg

SEQ ID NO: 2357763 - DNA, 15 bp, Homo sapiens
cgtgtcaagctgctc

SEQ ID NO: 2357764 - DNA, 23 bp, Homo sapiens
cgtgtgccatggatctgatctgt

SEQ ID NO: 2357765 - DNA, 12 bp, Homo sapiens
cgtgtgtagagt

SEQ ID NO: 2357766 - DNA, 18 bp, Homo sapiens
cgtgtgtagagttaagaa

SEQ ID NO: 2357767 - DNA, 13 bp, Homo sapiens
cgtgttcagcaga

SEQ ID NO: 2357768 - DNA, 14 bp, Homo sapiens
cgtgtttctgactc

SEQ ID NO: 2357769 - DNA, 18 bp, Homo sapiens
cgttctaggtaggaagag

SEQ ID NO: 2357770 - DNA, 12 bp, Homo sapiens
cgttgcccccat

SEQ ID NO: 2357771 - DNA, 15 bp, Homo sapiens
cgttgttttgtggat

SEQ ID NO: 2357772 - DNA, 16 bp, Homo sapiens
cgttgttttgtggata

SEQ ID NO: 2357773 - DNA, 15 bp, Homo sapiens
cgtttattttcaaga

SEQ ID NO: 2357774 - DNA, 21 bp, Homo sapiens
cgtttctttaaccttgtataa

SEQ ID NO: 2357775 - DNA, 18 bp, Homo sapiens
cgtttggtgcttctcaga

SEQ ID NO: 2357776 - DNA, 23 bp, Homo sapiens
cgttttcttctttccctggacag

SEQ ID NO: 2357777 - DNA, 21 bp, Homo sapiens
cgtttttgtattttcatgaaa

SEQ ID NO: 2357778 - DNA, 20 bp, Homo sapiens
ctaaaaaaccaacaatgtga

SEQ ID NO: 2357779 - DNA, 15 bp, Homo sapiens
ctaaaaagtataaaa

SEQ ID NO: 2357780 - DNA, 23 bp, Homo sapiens
ctaaaaatgagcttgattaaatc

SEQ ID NO: 2357781 - DNA, 18 bp, Homo sapiens
ctaaaacagcttcctgtt

SEQ ID NO: 2357782 - DNA, 22 bp, Homo sapiens
ctaaaacgaatggtctttgctc

SEQ ID NO: 2357783 - DNA, 13 bp, Homo sapiens
ctaaaatgtttta

SEQ ID NO: 2357784 - DNA, 17 bp, Homo sapiens
ctaaaatgttttatgac

SEQ ID NO: 2357785 - DNA, 16 bp, Homo sapiens
ctaaaccaaggactga

SEQ ID NO: 2357786 - DNA, 19 bp, Homo sapiens
ctaaaccaaggactgagca

SEQ ID NO: 2357787 - DNA, 14 bp, Homo sapiens
ctaaactccttcct

SEQ ID NO: 2357788 - DNA, 16 bp, Homo sapiens
ctaaactccttcctgg

SEQ ID NO: 2357789 - DNA, 17 bp, Homo sapiens
ctaaactccttcctggc

SEQ ID NO: 2357790 - DNA, 18 bp, Homo sapiens
ctaaagagagaatgtaga

SEQ ID NO: 2357791 - DNA, 19 bp, Homo sapiens
ctaaagagagaatgtagat

SEQ ID NO: 2357792 - DNA, 21 bp, Homo sapiens
ctaaagagcccttgcctcccc

SEQ ID NO: 2357793 - DNA, 21 bp, Homo sapiens
ctaaagcctaccctattctat

SEQ ID NO: 2357794 - DNA, 18 bp, Homo sapiens
ctaaaggcatccttgtct

SEQ ID NO: 2357795 - DNA, 23 bp, Homo sapiens
ctaaaggcatccttgtcttttga

SEQ ID NO: 2357796 - DNA, 21 bp, Homo sapiens
ctaaagtaaaaagggaattat

SEQ ID NO: 2357797 - DNA, 20 bp, Homo sapiens
ctaaagtgtattttcagagc

SEQ ID NO: 2357798 - DNA, 16 bp, Homo sapiens
ctaaataaagatattg

SEQ ID NO: 2357799 - DNA, 22 bp, Homo sapiens
ctaaatgcatatcctgagccat

SEQ ID NO: 2357800 - DNA, 17 bp, Homo sapiens
ctaaattttaaagccat

SEQ ID NO: 2357801 - DNA, 13 bp, Homo sapiens
ctaacaaaatgag

SEQ ID NO: 2357802 - DNA, 15 bp, Homo sapiens
ctaacaaaatgagat

SEQ ID NO: 2357803 - DNA, 16 bp, Homo sapiens
ctaacacattaaatgt

SEQ ID NO: 2357804 - DNA, 17 bp, Homo sapiens
ctaacagataagcaaga

SEQ ID NO: 2357805 - DNA, 18 bp, Homo sapiens
ctaacagtaactgccatt

SEQ ID NO: 2357806 - DNA, 17 bp, Homo sapiens
ctaacagtccttgcttt

SEQ ID NO: 2357807 - DNA, 20 bp, Homo sapiens
ctaacagtgaagttttactg

SEQ ID NO: 2357808 - DNA, 22 bp, Homo sapiens
ctaacatggtgaaaccccgtct

SEQ ID NO: 2357809 - DNA, 16 bp, Homo sapiens
ctaaccagcattccct

SEQ ID NO: 2357810 - DNA, 20 bp, Homo sapiens
ctaactcaaatacacatttg

SEQ ID NO: 2357811 - DNA, 12 bp, Homo sapiens
ctaactttgtaa

SEQ ID NO: 2357812 - DNA, 22 bp, Homo sapiens
ctaagactatatatataaatgt

SEQ ID NO: 2357813 - DNA, 11 bp, Homo sapiens
ctaagagaagt

SEQ ID NO: 2357814 - DNA, 22 bp, Homo sapiens
ctaagagaagttattttctaca

SEQ ID NO: 2357815 - DNA, 17 bp, Homo sapiens
ctaagatataatttaaa

SEQ ID NO: 2357816 - DNA, 20 bp, Homo sapiens
ctaagatataatttaaacgt

SEQ ID NO: 2357817 - DNA, 13 bp, Homo sapiens
ctaagccaggcct

SEQ ID NO: 2357818 - DNA, 11 bp, Homo sapiens
ctaagcctgtt

SEQ ID NO: 2357819 - DNA, 13 bp, Homo sapiens
ctaagcctgttgc

SEQ ID NO: 2357820 - DNA, 23 bp, Homo sapiens
ctaagcctgttgctgaagtcatt

SEQ ID NO: 2357821 - DNA, 23 bp, Homo sapiens
ctaagctgatattatttcttctc

SEQ ID NO: 2357822 - DNA, 19 bp, Homo sapiens
ctaagggaagatcactgta

SEQ ID NO: 2357823 - DNA, 17 bp, Homo sapiens
ctaagtgcttattacat

SEQ ID NO: 2357824 - DNA, 12 bp, Homo sapiens
ctaataaaccag

SEQ ID NO: 2357825 - DNA, 16 bp, Homo sapiens
ctaatacctctgtgtg

SEQ ID NO: 2357826 - DNA, 14 bp, Homo sapiens
ctaatatatgaaat

SEQ ID NO: 2357827 - DNA, 16 bp, Homo sapiens
ctaatcacagtgttgc

SEQ ID NO: 2357828 - DNA, 19 bp, Homo sapiens
ctaatcaccatgtaagcac

SEQ ID NO: 2357829 - DNA, 16 bp, Homo sapiens
ctaatgacaagtgact

SEQ ID NO: 2357830 - DNA, 13 bp, Homo sapiens
ctaatgagactga

SEQ ID NO: 2357831 - DNA, 12 bp, Homo sapiens
ctaatgatgttt

SEQ ID NO: 2357832 - DNA, 17 bp, Homo sapiens
ctaatgtcacaattatg

SEQ ID NO: 2357833 - DNA, 19 bp, Homo sapiens
ctaatgtcacaattatgtg

SEQ ID NO: 2357834 - DNA, 15 bp, Homo sapiens
ctaatgtttgaacaa

SEQ ID NO: 2357835 - DNA, 15 bp, Homo sapiens
ctaattaatatatta

SEQ ID NO: 2357836 - DNA, 18 bp, Homo sapiens
ctaattaatatattaaaa

SEQ ID NO: 2357837 - DNA, 23 bp, Homo sapiens
ctaattcaaatggcttaagcaat

SEQ ID NO: 2357838 - DNA, 18 bp, Homo sapiens
ctaattgtaagtgaaatt

SEQ ID NO: 2357839 - DNA, 21 bp, Homo sapiens
ctaattgtaagtgaaattaag

SEQ ID NO: 2357840 - DNA, 20 bp, Homo sapiens
ctaattgtactaatctgaga

SEQ ID NO: 2357841 - DNA, 16 bp, Homo sapiens
ctacaaacttttaaga

SEQ ID NO: 2357842 - DNA, 20 bp, Homo sapiens
ctacaaacttttaagatttc

SEQ ID NO: 2357843 - DNA, 22 bp, Homo sapiens
ctacaagccaaaagtccctccc

SEQ ID NO: 2357844 - DNA, 13 bp, Homo sapiens
ctacaattgtaaa

SEQ ID NO: 2357845 - DNA, 17 bp, Homo sapiens
ctacaattgtaaactag

SEQ ID NO: 2357846 - DNA, 22 bp, Homo sapiens
ctacacccctgtgctcccctgc

SEQ ID NO: 2357847 - DNA, 18 bp, Homo sapiens
ctacacctattatcccag

SEQ ID NO: 2357848 - DNA, 15 bp, Homo sapiens
ctacacctggctgag

SEQ ID NO: 2357849 - DNA, 15 bp, Homo sapiens
ctacaccttgccttg

SEQ ID NO: 2357850 - DNA, 21 bp, Homo sapiens
ctacaggggttagcctggact

SEQ ID NO: 2357851 - DNA, 22 bp, Homo sapiens
ctacaggtgcgcgccaccgtgc

SEQ ID NO: 2357852 - DNA, 16 bp, Homo sapiens
ctatttaacaagatgt

SEQ ID NO: 2357853 - DNA, 18 bp, Homo sapiens
ctatttaacattttacag

SEQ ID NO: 2357854 - DNA, 21 bp, Homo sapiens
ctatttaagtggactgtattt

SEQ ID NO: 2357855 - DNA, 21 bp, Homo sapiens
ctatttataatacagaatctt

SEQ ID NO: 2357856 - DNA, 18 bp, Homo sapiens
ctatttattttcctaaag

SEQ ID NO: 2357857 - DNA, 19 bp, Homo sapiens
ctatttattttcctaaaga

SEQ ID NO: 2357858 - DNA, 19 bp, Homo sapiens
ctatttcagtgttacctgt

SEQ ID NO: 2357859 - DNA, 21 bp, Homo sapiens
ctatttcagtgttacctgtgt

SEQ ID NO: 2357860 - DNA, 16 bp, Homo sapiens
ctatttgaataaatta

SEQ ID NO: 2357861 - DNA, 22 bp, Homo sapiens
ctatttgccatgggcttcactg

SEQ ID NO: 2357862 - DNA, 14 bp, Homo sapiens
ctattttaattact

SEQ ID NO: 2357863 - DNA, 13 bp, Homo sapiens
ctattttcataat

SEQ ID NO: 2357864 - DNA, 21 bp, Homo sapiens
ctattttcataatcagtaaat

SEQ ID NO: 2357865 - DNA, 19 bp, Homo sapiens
ctattttccaggcttctgc

SEQ ID NO: 2357866 - DNA, 23 bp, Homo sapiens
ctattttccaggcttctgctggg

SEQ ID NO: 2357867 - DNA, 19 bp, Homo sapiens
ctatttttaatgtttgtac

SEQ ID NO: 2357868 - DNA, 14 bp, Homo sapiens
ctatttttgactgt

SEQ ID NO: 2357869 - DNA, 14 bp, Homo sapiens
ctatttttgtaaag

SEQ ID NO: 2357870 - DNA, 18 bp, Homo sapiens
ctatttttttcaaagact

SEQ ID NO: 2357871 - DNA, 18 bp, Homo sapiens
ctcaaaataaagaagtat

SEQ ID NO: 2357872 - DNA, 14 bp, Homo sapiens
ctcaaaccctgtgg

SEQ ID NO: 2357873 - DNA, 22 bp, Homo sapiens
ctcaaactgaggaatttcacct

SEQ ID NO: 2357874 - DNA, 13 bp, Homo sapiens
ctcaaacttgtgg

SEQ ID NO: 2357875 - DNA, 16 bp, Homo sapiens
ctcaaacttgtggcct

SEQ ID NO: 2357876 - DNA, 16 bp, Homo sapiens
ctcaaagagattcgaa

SEQ ID NO: 2357877 - DNA, 15 bp, Homo sapiens
ctcaaaggagctttc

SEQ ID NO: 2357878 - DNA, 18 bp, Homo sapiens
ctcaaatacacatttgct

SEQ ID NO: 2357879 - DNA, 21 bp, Homo sapiens
ctcaaattttttgactttttt

SEQ ID NO: 2357880 - DNA, 16 bp, Homo sapiens
ctcaacccattgttgt

SEQ ID NO: 2357881 - DNA, 20 bp, Homo sapiens
ctcaacccattgttgtcaag

SEQ ID NO: 2357882 - DNA, 13 bp, Homo sapiens
ctcaactgaaggg

SEQ ID NO: 2357883 - DNA, 23 bp, Homo sapiens
ctcaactgaaggggtgcacccac

SEQ ID NO: 2357884 - DNA, 13 bp, Homo sapiens
ctcaactgcctac

SEQ ID NO: 2357885 - DNA, 15 bp, Homo sapiens
ctcaagacaaggctg

SEQ ID NO: 2357886 - DNA, 12 bp, Homo sapiens
ctcaagaccccc

SEQ ID NO: 2357887 - DNA, 15 bp, Homo sapiens
ctcaagatgggggca

SEQ ID NO: 2357888 - DNA, 21 bp, Homo sapiens
ctcaagatgggggcagggctg

SEQ ID NO: 2357889 - DNA, 21 bp, Homo sapiens
ctcaagcaatccacctgcctt

SEQ ID NO: 2357890 - DNA, 17 bp, Homo sapiens
ctcaagcaatcctcctg

SEQ ID NO: 2357891 - DNA, 18 bp, Homo sapiens
ctcaagcaatcctcctgc

SEQ ID NO: 2357892 - DNA, 20 bp, Homo sapiens
ctcaagcgggtggctctggg

SEQ ID NO: 2357893 - DNA, 17 bp, Homo sapiens
ctcaagctagtgtttct

SEQ ID NO: 2357894 - DNA, 23 bp, Homo sapiens
ctcaatcctaatttctcctccct

SEQ ID NO: 2357895 - DNA, 19 bp, Homo sapiens
ctcaatgaaccataaattc

SEQ ID NO: 2357896 - DNA, 14 bp, Homo sapiens
ctcacaggctgaga

SEQ ID NO: 2357897 - DNA, 21 bp, Homo sapiens
ctcacataagcccagttcatc

SEQ ID NO: 2357898 - DNA, 17 bp, Homo sapiens
ctcaccagccccactgc

SEQ ID NO: 2357899 - DNA, 15 bp, Homo sapiens
ctcaccagccctgca

SEQ ID NO: 2357900 - DNA, 20 bp, Homo sapiens
ctcaccattccaagtctcca

SEQ ID NO: 2357901 - DNA, 22 bp, Homo sapiens
ctcaccattccaagtctccacc

SEQ ID NO: 2357902 - DNA, 13 bp, Homo sapiens
ctcaccgcccatc

SEQ ID NO: 2357903 - DNA, 14 bp, Homo sapiens
ctcacctcatgccc

SEQ ID NO: 2357904 - DNA, 17 bp, Homo sapiens
ctcacctcatgcccacc

SEQ ID NO: 2357905 - DNA, 23 bp, Homo sapiens
ctcacctctaggtccccatactc

SEQ ID NO: 2357906 - DNA, 16 bp, Homo sapiens
ctcacgactcttcctg

SEQ ID NO: 2357907 - DNA, 17 bp, Homo sapiens
ctcacgactcttcctgc

SEQ ID NO: 2357908 - DNA, 19 bp, Homo sapiens
ctcacgcccttcaatgctg

SEQ ID NO: 2357909 - DNA, 21 bp, Homo sapiens
ctcacgcccttcaatgctgca

SEQ ID NO: 2357910 - DNA, 22 bp, Homo sapiens
ctcacgcccttcaatgctgcag

SEQ ID NO: 2357911 - DNA, 17 bp, Homo sapiens
ctcactccctctgcaga

SEQ ID NO: 2357912 - DNA, 12 bp, Homo sapiens
ctcactgccagg

SEQ ID NO: 2357913 - DNA, 15 bp, Homo sapiens
ctcactgccaggcca

SEQ ID NO: 2357914 - DNA, 18 bp, Homo sapiens
ctcactgccaggccagcc

SEQ ID NO: 2357915 - DNA, 21 bp, Homo sapiens
ctcactgccaggccagcctcc

SEQ ID NO: 2357916 - DNA, 21 bp, Homo sapiens
ctcactggctctcctggccct

SEQ ID NO: 2357917 - DNA, 14 bp, Homo sapiens
ctcacttattatta

SEQ ID NO: 2357918 - DNA, 17 bp, Homo sapiens
ctcagaaccttgtccca

SEQ ID NO: 2357919 - DNA, 15 bp, Homo sapiens
ctcagaagtccctgt

SEQ ID NO: 2357920 - DNA, 14 bp, Homo sapiens
ctcagacattccaa

SEQ ID NO: 2357921 - DNA, 15 bp, Homo sapiens
ctcagacgttgcctg

SEQ ID NO: 2357922 - DNA, 17 bp, Homo sapiens
ctcagacgttgcctgag

SEQ ID NO: 2357923 - DNA, 18 bp, Homo sapiens
ctcagacgttgcctgaga

SEQ ID NO: 2357924 - DNA, 17 bp, Homo sapiens
ctcagactgatttcttg

SEQ ID NO: 2357925 - DNA, 19 bp, Homo sapiens
ctcagagaaaaatgctccc

SEQ ID NO: 2357926 - DNA, 21 bp, Homo sapiens
ctcagagaaaaatgctcccca

SEQ ID NO: 2357927 - DNA, 22 bp, Homo sapiens
ctcagagcgccaggaagccaga

SEQ ID NO: 2357928 - DNA, 16 bp, Homo sapiens
ctcagagtggtggggg

SEQ ID NO: 2357929 - DNA, 12 bp, Homo sapiens
ctcagatctgat

SEQ ID NO: 2357930 - DNA, 17 bp, Homo sapiens
ctcagatttccacagag

SEQ ID NO: 2357931 - DNA, 12 bp, Homo sapiens
ctcagccctcag

SEQ ID NO: 2357932 - DNA, 12 bp, Homo sapiens
ctcagctttgag

SEQ ID NO: 2357933 - DNA, 21 bp, Homo sapiens
ctcagctttgagaagccttca

SEQ ID NO: 2357934 - DNA, 17 bp, Homo sapiens
ctcaggcagcaccacac

SEQ ID NO: 2357935 - DNA, 13 bp, Homo sapiens
ctcagggctccca

SEQ ID NO: 2357936 - DNA, 16 bp, Homo sapiens
ctcagggctcccaggg

SEQ ID NO: 2357937 - DNA, 20 bp, Homo sapiens
ctcagggctgtcccagcccc

SEQ ID NO: 2357938 - DNA, 21 bp, Homo sapiens
ctcagggctgtcccagccccg

SEQ ID NO: 2357939 - DNA, 14 bp, Homo sapiens
ctcagggtcactga

SEQ ID NO: 2357940 - DNA, 17 bp, Homo sapiens
ctcaggtcaactgacct

SEQ ID NO: 2357941 - DNA, 13 bp, Homo sapiens
ctcaggttccttt

SEQ ID NO: 2357942 - DNA, 12 bp, Homo sapiens
ctcagtaaacgg

SEQ ID NO: 2357943 - DNA, 21 bp, Homo sapiens
ctcagtaaacgggaacatgcc

SEQ ID NO: 2357944 - DNA, 22 bp, Homo sapiens
ctcagtagaaaaggatctaagg

SEQ ID NO: 2357945 - DNA, 23 bp, Homo sapiens
ctcagtatgtgggggcttcatct

SEQ ID NO: 2357946 - DNA, 14 bp, Homo sapiens
ctcagtcatgcata

SEQ ID NO: 2357947 - DNA, 22 bp, Homo sapiens
ctcagtcatgcataaatatgca

SEQ ID NO: 2357948 - DNA, 15 bp, Homo sapiens
ctcagtccactgttg

SEQ ID NO: 2357949 - DNA, 20 bp, Homo sapiens
ctcagtgagcctcctgtgcc

SEQ ID NO: 2357950 - DNA, 21 bp, Homo sapiens
ctcagtgagcctcctgtgcct

SEQ ID NO: 2357951 - DNA, 15 bp, Homo sapiens
ctcagtgtccagctt

SEQ ID NO: 2357952 - DNA, 13 bp, Homo sapiens
ctcagttccttca

SEQ ID NO: 2357953 - DNA, 18 bp, Homo sapiens
ctcagttctcttgctttc

SEQ ID NO: 2357954 - DNA, 14 bp, Homo sapiens
ctcagttttcataa

SEQ ID NO: 2357955 - DNA, 18 bp, Homo sapiens
ctcatagacactgatctg

SEQ ID NO: 2357956 - DNA, 21 bp, Homo sapiens
ctcatagtaataagatggctg

SEQ ID NO: 2357957 - DNA, 19 bp, Homo sapiens
ctcatattgtgattctgcc

SEQ ID NO: 2357958 - DNA, 13 bp, Homo sapiens
ctcatcaactgaa

SEQ ID NO: 2357959 - DNA, 16 bp, Homo sapiens
ctcatcaactgaatga

SEQ ID NO: 2357960 - DNA, 16 bp, Homo sapiens
ctcatgaagcaggagg

SEQ ID NO: 2357961 - DNA, 15 bp, Homo sapiens
ctcatgaggggagag

SEQ ID NO: 2357962 - DNA, 19 bp, Homo sapiens
ctcatgcaaatcaattact

SEQ ID NO: 2357963 - DNA, 16 bp, Homo sapiens
ctcatgcccaccccct

SEQ ID NO: 2357964 - DNA, 17 bp, Homo sapiens
ctcatgcccaccccctg

SEQ ID NO: 2357965 - DNA, 15 bp, Homo sapiens
ctcatgttgagccag

SEQ ID NO: 2357966 - DNA, 17 bp, Homo sapiens
ctcatgttgagccagtg

SEQ ID NO: 2357967 - DNA, 12 bp, Homo sapiens
ctcctagctctc

SEQ ID NO: 2357968 - DNA, 15 bp, Homo sapiens
ctcctatccttggag

SEQ ID NO: 2357969 - DNA, 16 bp, Homo sapiens
ctcctatgatctgagt

SEQ ID NO: 2357970 - DNA, 15 bp, Homo sapiens
ctcctattctataaa

SEQ ID NO: 2357971 - DNA, 19 bp, Homo sapiens
ctcctcacctcatgcccac

SEQ ID NO: 2357972 - DNA, 21 bp, Homo sapiens
ctcctcagagcgccaggaagc

SEQ ID NO: 2357973 - DNA, 17 bp, Homo sapiens
ctcctccaggcctgcct

SEQ ID NO: 2357974 - DNA, 21 bp, Homo sapiens
ctcctccaggcctgcctccca

SEQ ID NO: 2357975 - DNA, 24 bp, Homo sapiens
ctcctccagggaaggtggccacag

SEQ ID NO: 2357976 - DNA, 21 bp, Homo sapiens
ctcctcccagggcctcctggg

SEQ ID NO: 2357977 - DNA, 17 bp, Homo sapiens
ctcctccccttcctctt

SEQ ID NO: 2357978 - DNA, 19 bp, Homo sapiens
ctcctccttggtgcctggc

SEQ ID NO: 2357979 - DNA, 17 bp, Homo sapiens
ctcctcggttcaaggtc

SEQ ID NO: 2357980 - DNA, 13 bp, Homo sapiens
ctcctctgcctac

SEQ ID NO: 2357981 - DNA, 16 bp, Homo sapiens
ctcctctgctgacctg

SEQ ID NO: 2357982 - DNA, 14 bp, Homo sapiens
ctcctctgcttctt

SEQ ID NO: 2357983 - DNA, 14 bp, Homo sapiens
ctcctctggctttc

SEQ ID NO: 2357984 - DNA, 17 bp, Homo sapiens
ctcctctggctttccca

SEQ ID NO: 2357985 - DNA, 18 bp, Homo sapiens
ctcctgaaccgcacagct

SEQ ID NO: 2357986 - DNA, 16 bp, Homo sapiens
ctcctgacagaaggtg

SEQ ID NO: 2357987 - DNA, 19 bp, Homo sapiens
ctcctgacagaaggtgcca

SEQ ID NO: 2357988 - DNA, 14 bp, Homo sapiens
ctcctgcacacaga

SEQ ID NO: 2357989 - DNA, 15 bp, Homo sapiens
ctcctgccaggcaca

SEQ ID NO: 2357990 - DNA, 21 bp, Homo sapiens
ctcctgccaggcacacacagc

SEQ ID NO: 2357991 - DNA, 22 bp, Homo sapiens
ctcctgccaggcacacacagcc

SEQ ID NO: 2357992 - DNA, 23 bp, Homo sapiens
ctcctgccaggcacacacagccc

SEQ ID NO: 2357993 - DNA, 14 bp, Homo sapiens
ctcctgcctcagcc

SEQ ID NO: 2357994 - DNA, 23 bp, Homo sapiens
ctcctgctgtgcctcgcatccta

SEQ ID NO: 2357995 - DNA, 17 bp, Homo sapiens
ctcctggagcatcccag

SEQ ID NO: 2357996 - DNA, 19 bp, Homo sapiens
ctcctggagcatcccaggc

SEQ ID NO: 2357997 - DNA, 18 bp, Homo sapiens
ctcctggtgttctgcagt

SEQ ID NO: 2357998 - DNA, 15 bp, Homo sapiens
ctcctgtcccctgct

SEQ ID NO: 2357999 - DNA, 22 bp, Homo sapiens
ctcctgtgcctggccccagcct

SEQ ID NO: 2358000 - DNA, 22 bp, Homo sapiens
ctccttaaaaatgtatgttggt

SEQ ID NO: 2358001 - DNA, 18 bp, Homo sapiens
ctccttcctggcctgaga

SEQ ID NO: 2358002 - DNA, 13 bp, Homo sapiens
ctccttctgagct

SEQ ID NO: 2358003 - DNA, 19 bp, Homo sapiens
ctccttctgagctcctgtc

SEQ ID NO: 2358004 - DNA, 20 bp, Homo sapiens
ctccttctgagctcctgtcc

SEQ ID NO: 2358005 - DNA, 17 bp, Homo sapiens
ctccttggtttgctagt

SEQ ID NO: 2358006 - DNA, 22 bp, Homo sapiens
ctccttggtttgctagtatctt

SEQ ID NO: 2358007 - DNA, 10 bp, Homo sapiens
ctcctttcca

SEQ ID NO: 2358008 - DNA, 12 bp, Homo sapiens
ctcctttccctt

SEQ ID NO: 2358009 - DNA, 20 bp, Homo sapiens
ctccttttcactttattgct

SEQ ID NO: 2358010 - DNA, 20 bp, Homo sapiens
ctccttttcttcaccctccc

SEQ ID NO: 2358011 - DNA, 19 bp, Homo sapiens
ctcgcagcctctcagtgcc

SEQ ID NO: 2358012 - DNA, 15 bp, Homo sapiens
ctcgcatcctatgct

SEQ ID NO: 2358013 - DNA, 24 bp, Homo sapiens
ctcgccatgatcagacatacagct

SEQ ID NO: 2358014 - DNA, 14 bp, Homo sapiens
ctcgccccacccag

SEQ ID NO: 2358015 - DNA, 16 bp, Homo sapiens
ctcgcgctcagtaaac

SEQ ID NO: 2358016 - DNA, 19 bp, Homo sapiens
ctcgctgccatcaccgctg

SEQ ID NO: 2358017 - DNA, 22 bp, Homo sapiens
ctcggatggaccaacctgctct

SEQ ID NO: 2358018 - DNA, 23 bp, Homo sapiens
ctcggcagcccttccaaactctt

SEQ ID NO: 2358019 - DNA, 19 bp, Homo sapiens
ctcggggtaaaaagtggct

SEQ ID NO: 2358020 - DNA, 21 bp, Homo sapiens
ctcggttcaaggtcactgttt

SEQ ID NO: 2358021 - DNA, 15 bp, Homo sapiens
ctcgtcccatccagc

SEQ ID NO: 2358022 - DNA, 21 bp, Homo sapiens
ctcgtcccatccagctaccac

SEQ ID NO: 2358023 - DNA, 16 bp, Homo sapiens
ctcgtgcatccctgag

SEQ ID NO: 2358024 - DNA, 20 bp, Homo sapiens
ctcgtggtagaagccagtac

SEQ ID NO: 2358025 - DNA, 16 bp, Homo sapiens
ctctaatcagattgct

SEQ ID NO: 2358026 - DNA, 15 bp, Homo sapiens
ctctaccctgtctgt

SEQ ID NO: 2358027 - DNA, 19 bp, Homo sapiens
ctctaccttcctgtccctg

SEQ ID NO: 2358028 - DNA, 21 bp, Homo sapiens
ctctaccttcctgtccctgag

SEQ ID NO: 2358029 - DNA, 23 bp, Homo sapiens
ctctaccttcctgtccctgaggt

SEQ ID NO: 2358030 - DNA, 20 bp, Homo sapiens
ctctactaatgcctcttcat

SEQ ID NO: 2358031 - DNA, 18 bp, Homo sapiens
ctctagaagccaagggaa

SEQ ID NO: 2358032 - DNA, 19 bp, Homo sapiens
ctctagaagccaagggaaa

SEQ ID NO: 2358033 - DNA, 15 bp, Homo sapiens
ctctagggcagggaa

SEQ ID NO: 2358034 - DNA, 14 bp, Homo sapiens
ctctattaaaatgc

SEQ ID NO: 2358035 - DNA, 20 bp, Homo sapiens
ctctattttcataatcagta

SEQ ID NO: 2358036 - DNA, 12 bp, Homo sapiens
ctctcagaacat

SEQ ID NO: 2358037 - DNA, 19 bp, Homo sapiens
ctctcaggccaccacagag

SEQ ID NO: 2358038 - DNA, 20 bp, Homo sapiens
ctctcagtgccctccagccc

SEQ ID NO: 2358039 - DNA, 16 bp, Homo sapiens
ctctcatcaactgaat

SEQ ID NO: 2358040 - DNA, 17 bp, Homo sapiens
ctctccaaccactgtgc

SEQ ID NO: 2358041 - DNA, 20 bp, Homo sapiens
ctctccaaccactgtgccac

SEQ ID NO: 2358042 - DNA, 23 bp, Homo sapiens
ctctccaaccactgtgccactga

SEQ ID NO: 2358043 - DNA, 23 bp, Homo sapiens
ctctccacacagtgctcaaggcc

SEQ ID NO: 2358044 - DNA, 14 bp, Homo sapiens
ctctccagcctgac

SEQ ID NO: 2358045 - DNA, 15 bp, Homo sapiens
ctctccattctgctc

SEQ ID NO: 2358046 - DNA, 17 bp, Homo sapiens
ctctccattctgctcct

SEQ ID NO: 2358047 - DNA, 18 bp, Homo sapiens
ctctccattcttttaaat

SEQ ID NO: 2358048 - DNA, 21 bp, Homo sapiens
ctctcccaccctcttcctact

SEQ ID NO: 2358049 - DNA, 22 bp, Homo sapiens
ctctcccagtgaactcctgcca

SEQ ID NO: 2358050 - DNA, 16 bp, Homo sapiens
ctctccccctcctcca

SEQ ID NO: 2358051 - DNA, 23 bp, Homo sapiens
ctctccctccctctctcatgaga

SEQ ID NO: 2358052 - DNA, 18 bp, Homo sapiens
ctctcccttgggctctga

SEQ ID NO: 2358053 - DNA, 23 bp, Homo sapiens
ctctcccttgggctctgatgaaa

SEQ ID NO: 2358054 - DNA, 17 bp, Homo sapiens
ctctcctactcggctct

SEQ ID NO: 2358055 - DNA, 22 bp, Homo sapiens
ctctcctaggcattctggacct

SEQ ID NO: 2358056 - DNA, 12 bp, Homo sapiens
ctctcctcttct

SEQ ID NO: 2358057 - DNA, 12 bp, Homo sapiens
ctctcctggcct

SEQ ID NO: 2358058 - DNA, 13 bp, Homo sapiens
ctctcctggccta

SEQ ID NO: 2358059 - DNA, 14 bp, Homo sapiens
ctctctacagtctc

SEQ ID NO: 2358060 - DNA, 14 bp, Homo sapiens
ctctctatgcctct

SEQ ID NO: 2358061 - DNA, 14 bp, Homo sapiens
ctctctctccctcc

SEQ ID NO: 2358062 - DNA, 15 bp, Homo sapiens
ctctctctccctccc

SEQ ID NO: 2358063 - DNA, 16 bp, Homo sapiens
ctctctgatgtcccag

SEQ ID NO: 2358064 - DNA, 18 bp, Homo sapiens
ctctctgatgtcccagtg

SEQ ID NO: 2358065 - DNA, 12 bp, Homo sapiens
ctctctgccctg

SEQ ID NO: 2358066 - DNA, 14 bp, Homo sapiens
ctctctgccctgtg

SEQ ID NO: 2358067 - DNA, 15 bp, Homo sapiens
ctctctgccctgtgt

SEQ ID NO: 2358068 - DNA, 17 bp, Homo sapiens
ctctctggaaagaggct

SEQ ID NO: 2358069 - DNA, 19 bp, Homo sapiens
ctctctggaaagaggctct

SEQ ID NO: 2358070 - DNA, 22 bp, Homo sapiens
ctctctggaaagaggctctgga

SEQ ID NO: 2358071 - DNA, 21 bp, Homo sapiens
ctctctgggtcagaaccagag

SEQ ID NO: 2358072 - DNA, 19 bp, Homo sapiens
ctctctgtgggctggcagt

SEQ ID NO: 2358073 - DNA, 13 bp, Homo sapiens
ctctcttgccagc

SEQ ID NO: 2358074 - DNA, 12 bp, Homo sapiens
ctctgaagctaa

SEQ ID NO: 2358075 - DNA, 20 bp, Homo sapiens
ctctgaagctaattgtacta

SEQ ID NO: 2358076 - DNA, 18 bp, Homo sapiens
ctctgaatgctatttgtg

SEQ ID NO: 2358077 - DNA, 14 bp, Homo sapiens
ctctgacgcttgtg

SEQ ID NO: 2358078 - DNA, 22 bp, Homo sapiens
ctctgatctccataaacatgaa

SEQ ID NO: 2358079 - DNA, 14 bp, Homo sapiens
ctctgatgaaaaat

SEQ ID NO: 2358080 - DNA, 16 bp, Homo sapiens
ctctgatgtcccagtg

SEQ ID NO: 2358081 - DNA, 18 bp, Homo sapiens
ctgaatcatgagcctgct

SEQ ID NO: 2358082 - DNA, 19 bp, Homo sapiens
ctgaatccaaactaatcca

SEQ ID NO: 2358083 - DNA, 20 bp, Homo sapiens
ctgaatgctatttgtgtaac

SEQ ID NO: 2358084 - DNA, 16 bp, Homo sapiens
ctgaattaattaattt

SEQ ID NO: 2358085 - DNA, 13 bp, Homo sapiens
ctgaattgtgttt

SEQ ID NO: 2358086 - DNA, 12 bp, Homo sapiens
ctgaatttggag

SEQ ID NO: 2358087 - DNA, 15 bp, Homo sapiens
ctgaatttttttgta

SEQ ID NO: 2358088 - DNA, 17 bp, Homo sapiens
ctgaatttttttgtaat

SEQ ID NO: 2358089 - DNA, 21 bp, Homo sapiens
ctgacaacttagctcaggtgc

SEQ ID NO: 2358090 - DNA, 16 bp, Homo sapiens
ctgacagaaggtgcca

SEQ ID NO: 2358091 - DNA, 17 bp, Homo sapiens
ctgacagagctctgggt

SEQ ID NO: 2358092 - DNA, 20 bp, Homo sapiens
ctgacccagggactctccaa

SEQ ID NO: 2358093 - DNA, 13 bp, Homo sapiens
ctgacccctgctc

SEQ ID NO: 2358094 - DNA, 20 bp, Homo sapiens
ctgacctacctcaaagggca

SEQ ID NO: 2358095 - DNA, 22 bp, Homo sapiens
ctgacctacctcaaagggcagt

SEQ ID NO: 2358096 - DNA, 14 bp, Homo sapiens
ctgacctccgccat

SEQ ID NO: 2358097 - DNA, 17 bp, Homo sapiens
ctgacctccgccatcca

SEQ ID NO: 2358098 - DNA, 13 bp, Homo sapiens
ctgacctgctgac

SEQ ID NO: 2358099 - DNA, 17 bp, Homo sapiens
ctgacctggccccctca

SEQ ID NO: 2358100 - DNA, 13 bp, Homo sapiens
ctgacgcttgtga

SEQ ID NO: 2358101 - DNA, 21 bp, Homo sapiens
ctgacgcttgtgacagtgcct

SEQ ID NO: 2358102 - DNA, 20 bp, Homo sapiens
ctgactcctctggctttccc

SEQ ID NO: 2358103 - DNA, 21 bp, Homo sapiens
ctgactgaaagtagggggctt

SEQ ID NO: 2358104 - DNA, 14 bp, Homo sapiens
ctgactgctcagaa

SEQ ID NO: 2358105 - DNA, 18 bp, Homo sapiens
ctgactgtagctttggaa

SEQ ID NO: 2358106 - DNA, 15 bp, Homo sapiens
ctgacttgctgtgtg

SEQ ID NO: 2358107 - DNA, 23 bp, Homo sapiens
ctgagaacacgttgccaggggct

SEQ ID NO: 2358108 - DNA, 20 bp, Homo sapiens
ctgagaagaagtggctgcca

SEQ ID NO: 2358109 - DNA, 19 bp, Homo sapiens
ctgagaatatacaatgatc

SEQ ID NO: 2358110 - DNA, 16 bp, Homo sapiens
ctgagacagtgaattt

SEQ ID NO: 2358111 - DNA, 20 bp, Homo sapiens
ctgagaccctactgaagtgg

SEQ ID NO: 2358112 - DNA, 13 bp, Homo sapiens
ctgagacctgaag

SEQ ID NO: 2358113 - DNA, 20 bp, Homo sapiens
ctgagacctgggatttgaga

SEQ ID NO: 2358114 - DNA, 20 bp, Homo sapiens
ctgagaggacagagagaaat

SEQ ID NO: 2358115 - DNA, 19 bp, Homo sapiens
ctgagagtatttaggcaga

SEQ ID NO: 2358116 - DNA, 16 bp, Homo sapiens
ctgagatatgaacata

SEQ ID NO: 2358117 - DNA, 23 bp, Homo sapiens
ctgagattgtgtttgttcataat

SEQ ID NO: 2358118 - DNA, 15 bp, Homo sapiens
ctgagcagcctctgg

SEQ ID NO: 2358119 - DNA, 17 bp, Homo sapiens
ctgagcaggctgtgggg

SEQ ID NO: 2358120 - DNA, 13 bp, Homo sapiens
ctgagccacagtg

SEQ ID NO: 2358121 - DNA, 22 bp, Homo sapiens
ctgagccagcttagcaactgct

SEQ ID NO: 2358122 - DNA, 22 bp, Homo sapiens
ctgagcccctttgcctgtcaag

SEQ ID NO: 2358123 - DNA, 22 bp, Homo sapiens
ctgagccctactccctgcagat

SEQ ID NO: 2358124 - DNA, 17 bp, Homo sapiens
ctgagctattttcctct

SEQ ID NO: 2358125 - DNA, 20 bp, Homo sapiens
ctgagctattttcctctggc

SEQ ID NO: 2358126 - DNA, 15 bp, Homo sapiens
ctgagctcacatggg

SEQ ID NO: 2358127 - DNA, 22 bp, Homo sapiens
ctgagctcacatgggactggga

SEQ ID NO: 2358128 - DNA, 22 bp, Homo sapiens
ctgaggatattcagatgtatgt

SEQ ID NO: 2358129 - DNA, 19 bp, Homo sapiens
ctgaggatgggtcagagct

SEQ ID NO: 2358130 - DNA, 11 bp, Homo sapiens
ctgaggatgtt

SEQ ID NO: 2358131 - DNA, 13 bp, Homo sapiens
ctgaggcaggaga

SEQ ID NO: 2358132 - DNA, 15 bp, Homo sapiens
ctgaggccagagtca

SEQ ID NO: 2358133 - DNA, 17 bp, Homo sapiens
ctgaggccagagtcacc

SEQ ID NO: 2358134 - DNA, 13 bp, Homo sapiens
ctgaggcccagtg

SEQ ID NO: 2358135 - DNA, 15 bp, Homo sapiens
ctgaggcccagtgca

SEQ ID NO: 2358136 - DNA, 16 bp, Homo sapiens
ctgaggcccagtgcat

SEQ ID NO: 2358137 - DNA, 17 bp, Homo sapiens
ctgaggcccagtgcata

SEQ ID NO: 2358138 - DNA, 21 bp, Homo sapiens
ctgaggcggaggctgtgctcc

SEQ ID NO: 2358139 - DNA, 19 bp, Homo sapiens
ctgagggcagactggggca

SEQ ID NO: 2358140 - DNA, 15 bp, Homo sapiens
ctgagggcctgctgg

SEQ ID NO: 2358141 - DNA, 16 bp, Homo sapiens
ctgagggcctgctgga

SEQ ID NO: 2358142 - DNA, 19 bp, Homo sapiens
ctgagggcctgctggaggc

SEQ ID NO: 2358143 - DNA, 19 bp, Homo sapiens
ctgaggttaaacggtgccc

SEQ ID NO: 2358144 - DNA, 21 bp, Homo sapiens
ctgaggttaaacggtgcccat

SEQ ID NO: 2358145 - DNA, 22 bp, Homo sapiens
ctgaggttaaacggtgcccatc

SEQ ID NO: 2358146 - DNA, 14 bp, Homo sapiens
ctgaggttcctctg

SEQ ID NO: 2358147 - DNA, 15 bp, Homo sapiens
ctgaggttcctctgc

SEQ ID NO: 2358148 - DNA, 18 bp, Homo sapiens
ctgaggttcctctgcctg

SEQ ID NO: 2358149 - DNA, 23 bp, Homo sapiens
ctgaggttcctctgcctgccccg

SEQ ID NO: 2358150 - DNA, 19 bp, Homo sapiens
ctgagtcagagccatgtct

SEQ ID NO: 2358151 - DNA, 15 bp, Homo sapiens
ctgagtcagtgctct

SEQ ID NO: 2358152 - DNA, 21 bp, Homo sapiens
ctgagtcatctgttagggcct

SEQ ID NO: 2358153 - DNA, 19 bp, Homo sapiens
ctgagtcgtacagaaagct

SEQ ID NO: 2358154 - DNA, 22 bp, Homo sapiens
ctgagttctgggtttctagagg

SEQ ID NO: 2358155 - DNA, 16 bp, Homo sapiens
ctgatattatttcttc

SEQ ID NO: 2358156 - DNA, 17 bp, Homo sapiens
ctgatattatttcttct

SEQ ID NO: 2358157 - DNA, 17 bp, Homo sapiens
ctgatcccatggccagg

SEQ ID NO: 2358158 - DNA, 15 bp, Homo sapiens
ctgatctggctgcag

SEQ ID NO: 2358159 - DNA, 13 bp, Homo sapiens
ctgatcttttaaa

SEQ ID NO: 2358160 - DNA, 16 bp, Homo sapiens
ctgatgaagttgtaca

SEQ ID NO: 2358161 - DNA, 22 bp, Homo sapiens
ctgatgctgggcaatgaggcag

SEQ ID NO: 2358162 - DNA, 19 bp, Homo sapiens
ctgatggccttaatttcct

SEQ ID NO: 2358163 - DNA, 20 bp, Homo sapiens
ctgatggccttaatttcctt

SEQ ID NO: 2358164 - DNA, 14 bp, Homo sapiens
ctgatggctcaaga

SEQ ID NO: 2358165 - DNA, 21 bp, Homo sapiens
ctgatggtgtggcctgtggct

SEQ ID NO: 2358166 - DNA, 16 bp, Homo sapiens
ctgatgtaacaaggtg

SEQ ID NO: 2358167 - DNA, 14 bp, Homo sapiens
ctgatgtcccagtg

SEQ ID NO: 2358168 - DNA, 16 bp, Homo sapiens
ctgattataggatttt

SEQ ID NO: 2358169 - DNA, 20 bp, Homo sapiens
ctgattattgagttccagtt

SEQ ID NO: 2358170 - DNA, 21 bp, Homo sapiens
ctgattcttgattcctggctc

SEQ ID NO: 2358171 - DNA, 22 bp, Homo sapiens
ctgattcttgattcctggctct

SEQ ID NO: 2358172 - DNA, 15 bp, Homo sapiens
ctgatttactaacag

SEQ ID NO: 2358173 - DNA, 20 bp, Homo sapiens
ctgattttttttccttttaa

SEQ ID NO: 2358174 - DNA, 18 bp, Homo sapiens
ctgcaaacctgacccctg

SEQ ID NO: 2358175 - DNA, 16 bp, Homo sapiens
ctgcaaagctttggct

SEQ ID NO: 2358176 - DNA, 19 bp, Homo sapiens
ctgcaaatctgatggcctt

SEQ ID NO: 2358177 - DNA, 20 bp, Homo sapiens
ctgcaaatctgatggcctta

SEQ ID NO: 2358178 - DNA, 23 bp, Homo sapiens
ctgcaagatggacacgagccaca

SEQ ID NO: 2358179 - DNA, 20 bp, Homo sapiens
ctgcacacagaatgctcagg

SEQ ID NO: 2358180 - DNA, 15 bp, Homo sapiens
ctgcacacaggacag

SEQ ID NO: 2358181 - DNA, 18 bp, Homo sapiens
ctgcacacaggacagcgg

SEQ ID NO: 2358182 - DNA, 18 bp, Homo sapiens
ctgcacaccctccagaga

SEQ ID NO: 2358183 - DNA, 23 bp, Homo sapiens
ctgcacagagcaagtcctcactc

SEQ ID NO: 2358184 - DNA, 13 bp, Homo sapiens
ctgcacaggcaga

SEQ ID NO: 2358185 - DNA, 14 bp, Homo sapiens
ctgcacatgtcttg

SEQ ID NO: 2358186 - DNA, 21 bp, Homo sapiens
ctgcacatgtcttgtacatgt

SEQ ID NO: 2358187 - DNA, 15 bp, Homo sapiens
ctgcacccctgggcc

SEQ ID NO: 2358188 - DNA, 12 bp, Homo sapiens
ctgcacgtcatg

SEQ ID NO: 2358189 - DNA, 20 bp, Homo sapiens
ctgcactgtgaacctgggca

SEQ ID NO: 2358190 - DNA, 18 bp, Homo sapiens
ctgcagacctcaagccat

SEQ ID NO: 2358191 - DNA, 14 bp, Homo sapiens
ctgcagatgccacc

SEQ ID NO: 2358192 - DNA, 19 bp, Homo sapiens
ctgcagatgccaccctagc

SEQ ID NO: 2358193 - DNA, 21 bp, Homo sapiens
ctgcagatgccaccctagcca

SEQ ID NO: 2358194 - DNA, 21 bp, Homo sapiens
ctgcagatgtgcggagcggga

SEQ ID NO: 2358195 - DNA, 18 bp, Homo sapiens
ctgctgctgtctgggtgc

SEQ ID NO: 2358196 - DNA, 14 bp, Homo sapiens
ctgctggaaaccac

SEQ ID NO: 2358197 - DNA, 11 bp, Homo sapiens
ctgctggacat

SEQ ID NO: 2358198 - DNA, 18 bp, Homo sapiens
ctgctggaggcctcaggt

SEQ ID NO: 2358199 - DNA, 11 bp, Homo sapiens
ctgctggccat

SEQ ID NO: 2358200 - DNA, 22 bp, Homo sapiens
ctgctggccgacccactgaccc

SEQ ID NO: 2358201 - DNA, 15 bp, Homo sapiens
ctgctggggagacaa

SEQ ID NO: 2358202 - DNA, 16 bp, Homo sapiens
ctgctggggagacaaa

SEQ ID NO: 2358203 - DNA, 22 bp, Homo sapiens
ctgctggggatccccgcctggc

SEQ ID NO: 2358204 - DNA, 17 bp, Homo sapiens
ctgctggggcctgggac

SEQ ID NO: 2358205 - DNA, 18 bp, Homo sapiens
ctgctggggcctgggaca

SEQ ID NO: 2358206 - DNA, 14 bp, Homo sapiens
ctgctggtatttct

SEQ ID NO: 2358207 - DNA, 15 bp, Homo sapiens
ctgctgtccagtgcc

SEQ ID NO: 2358208 - DNA, 17 bp, Homo sapiens
ctgctgtccagtgccta

SEQ ID NO: 2358209 - DNA, 18 bp, Homo sapiens
ctgctgtccagtgcctac

SEQ ID NO: 2358210 - DNA, 13 bp, Homo sapiens
ctgctgtctgggt

SEQ ID NO: 2358211 - DNA, 15 bp, Homo sapiens
ctgctgtctgggtgc

SEQ ID NO: 2358212 - DNA, 21 bp, Homo sapiens
ctgctgtctgggtgctactgg

SEQ ID NO: 2358213 - DNA, 12 bp, Homo sapiens
ctgctgtcttgt

SEQ ID NO: 2358214 - DNA, 15 bp, Homo sapiens
ctgctgttctcagga

SEQ ID NO: 2358215 - DNA, 23 bp, Homo sapiens
ctgctgttctcaggacagcatcc

SEQ ID NO: 2358216 - DNA, 21 bp, Homo sapiens
ctgcttcccttactttgctga

SEQ ID NO: 2358217 - DNA, 16 bp, Homo sapiens
ctgcttctcatcccaa

SEQ ID NO: 2358218 - DNA, 16 bp, Homo sapiens
ctgcttttctgccctg

SEQ ID NO: 2358219 - DNA, 20 bp, Homo sapiens
ctgctttttggaaagtcaga

SEQ ID NO: 2358220 - DNA, 17 bp, Homo sapiens
ctggaaaggggagagcc

SEQ ID NO: 2358221 - DNA, 19 bp, Homo sapiens
ctggaaaggggagagcctg

SEQ ID NO: 2358222 - DNA, 11 bp, Homo sapiens
ctggaagagcc

SEQ ID NO: 2358223 - DNA, 14 bp, Homo sapiens
ctggaagagcccag

SEQ ID NO: 2358224 - DNA, 17 bp, Homo sapiens
ctggaagccagctttcc

SEQ ID NO: 2358225 - DNA, 22 bp, Homo sapiens
ctggaagcccagcccctactgc

SEQ ID NO: 2358226 - DNA, 22 bp, Homo sapiens
ctggaagggaggaaggcctttc

SEQ ID NO: 2358227 - DNA, 23 bp, Homo sapiens
ctggaagggaggaaggcctttct

SEQ ID NO: 2358228 - DNA, 17 bp, Homo sapiens
ctggaatctacaagcca

SEQ ID NO: 2358229 - DNA, 15 bp, Homo sapiens
ctggaattgtggcta

SEQ ID NO: 2358230 - DNA, 23 bp, Homo sapiens
ctggaattgtggctatcctgatt

SEQ ID NO: 2358231 - DNA, 19 bp, Homo sapiens
ctggaatttggacaagtgc

SEQ ID NO: 2358232 - DNA, 12 bp, Homo sapiens
ctggacagccag

SEQ ID NO: 2358233 - DNA, 13 bp, Homo sapiens
ctggacaggcagc

SEQ ID NO: 2358234 - DNA, 15 bp, Homo sapiens
ctggacaggcagcct

SEQ ID NO: 2358235 - DNA, 18 bp, Homo sapiens
ctggacagtatcccacat

SEQ ID NO: 2358236 - DNA, 22 bp, Homo sapiens
ctggacatgagatggagaggct

SEQ ID NO: 2358237 - DNA, 14 bp, Homo sapiens
ctggacctctgggt

SEQ ID NO: 2358238 - DNA, 13 bp, Homo sapiens
ctggacctgggaa

SEQ ID NO: 2358239 - DNA, 19 bp, Homo sapiens
ctggacctttgggttcttt

SEQ ID NO: 2358240 - DNA, 22 bp, Homo sapiens
ctggacctttgggttctttctg

SEQ ID NO: 2358241 - DNA, 13 bp, Homo sapiens
ctggacggcaggc

SEQ ID NO: 2358242 - DNA, 22 bp, Homo sapiens
ctggacggcaggctcactgcca

SEQ ID NO: 2358243 - DNA, 18 bp, Homo sapiens
ctggacttctacctgccc

SEQ ID NO: 2358244 - DNA, 19 bp, Homo sapiens
ctggacttctacctgccct

SEQ ID NO: 2358245 - DNA, 17 bp, Homo sapiens
ctggagcatcccaggcg

SEQ ID NO: 2358246 - DNA, 13 bp, Homo sapiens
ctggagcccccag

SEQ ID NO: 2358247 - DNA, 19 bp, Homo sapiens
ctggagcccccagcagagg

SEQ ID NO: 2358248 - DNA, 23 bp, Homo sapiens
ctggagcccccagcagaggcagg

SEQ ID NO: 2358249 - DNA, 22 bp, Homo sapiens
ctggagccctaaccccttccag

SEQ ID NO: 2358250 - DNA, 14 bp, Homo sapiens
ctggagctcatctg

SEQ ID NO: 2358251 - DNA, 21 bp, Homo sapiens
ctggagctcatctgcaaaagg

SEQ ID NO: 2358252 - DNA, 16 bp, Homo sapiens
ctggaggaagtggggt

SEQ ID NO: 2358253 - DNA, 16 bp, Homo sapiens
ctggaggagcagcagc

SEQ ID NO: 2358254 - DNA, 14 bp, Homo sapiens
ctggaggcctcagg

SEQ ID NO: 2358255 - DNA, 18 bp, Homo sapiens
ctggaggtgctgctctag

SEQ ID NO: 2358256 - DNA, 15 bp, Homo sapiens
ctggagtctcctgag

SEQ ID NO: 2358257 - DNA, 15 bp, Homo sapiens
ctggagtgcagtggc

SEQ ID NO: 2358258 - DNA, 17 bp, Homo sapiens
ctggatggaaagacaaa

SEQ ID NO: 2358259 - DNA, 12 bp, Homo sapiens
ctggcacagagg

SEQ ID NO: 2358260 - DNA, 13 bp, Homo sapiens
ctggcacagaggt

SEQ ID NO: 2358261 - DNA, 19 bp, Homo sapiens
ctggcacccaccgtggagg

SEQ ID NO: 2358262 - DNA, 12 bp, Homo sapiens
ctggcagcccag

SEQ ID NO: 2358263 - DNA, 13 bp, Homo sapiens
ctggcagcccaga

SEQ ID NO: 2358264 - DNA, 18 bp, Homo sapiens
ctggcaggtcaacctcgc

SEQ ID NO: 2358265 - DNA, 17 bp, Homo sapiens
ctggcatgacactctag

SEQ ID NO: 2358266 - DNA, 21 bp, Homo sapiens
ctggcatgacactctagtgac

SEQ ID NO: 2358267 - DNA, 16 bp, Homo sapiens
ctggccaaatagcaaa

SEQ ID NO: 2358268 - DNA, 11 bp, Homo sapiens
ctggccagatt

SEQ ID NO: 2358269 - DNA, 18 bp, Homo sapiens
ctggccagtccaccctgc

SEQ ID NO: 2358270 - DNA, 22 bp, Homo sapiens
ctggccatgaatctctgcctct

SEQ ID NO: 2358271 - DNA, 14 bp, Homo sapiens
ctggccatggcctg

SEQ ID NO: 2358272 - DNA, 20 bp, Homo sapiens
ctggccatggcctgcaaact

SEQ ID NO: 2358273 - DNA, 19 bp, Homo sapiens
ctggcccagaaagcctctc

SEQ ID NO: 2358274 - DNA, 12 bp, Homo sapiens
ctggccccagcc

SEQ ID NO: 2358275 - DNA, 17 bp, Homo sapiens
ctggccccagcctgggc

SEQ ID NO: 2358276 - DNA, 15 bp, Homo sapiens
ctggccccaggcccc

SEQ ID NO: 2358277 - DNA, 21 bp, Homo sapiens
ctggccccaggccccagacag

SEQ ID NO: 2358278 - DNA, 15 bp, Homo sapiens
ctggccccaggctgt

SEQ ID NO: 2358279 - DNA, 13 bp, Homo sapiens
ctggcccctctcc

SEQ ID NO: 2358280 - DNA, 24 bp, Homo sapiens
ctggcccctctcccttgggctctg

SEQ ID NO: 2358281 - DNA, 19 bp, Homo sapiens
ctggcccctgacccaggga

SEQ ID NO: 2358282 - DNA, 14 bp, Homo sapiens
ctggcccttagaga

SEQ ID NO: 2358283 - DNA, 15 bp, Homo sapiens
ctggccgacccactg

SEQ ID NO: 2358284 - DNA, 15 bp, Homo sapiens
ctggccgcagaggtg

SEQ ID NO: 2358285 - DNA, 20 bp, Homo sapiens
ctggccgcgctccgggcttt

SEQ ID NO: 2358286 - DNA, 18 bp, Homo sapiens
ctggccgcggagcctgca

SEQ ID NO: 2358287 - DNA, 19 bp, Homo sapiens
ctggccgcttctccccaga

SEQ ID NO: 2358288 - DNA, 19 bp, Homo sapiens
ctggcctatccgctgccag

SEQ ID NO: 2358289 - DNA, 17 bp, Homo sapiens
ctggcctctctagcaca

SEQ ID NO: 2358290 - DNA, 20 bp, Homo sapiens
ctggcctgagagtcagctct

SEQ ID NO: 2358291 - DNA, 13 bp, Homo sapiens
ctggcctggcaca

SEQ ID NO: 2358292 - DNA, 18 bp, Homo sapiens
ctggcctggcacacatca

SEQ ID NO: 2358293 - DNA, 13 bp, Homo sapiens
ctggccttctcct

SEQ ID NO: 2358294 - DNA, 14 bp, Homo sapiens
ctggcctttgtaag

SEQ ID NO: 2358295 - DNA, 19 bp, Homo sapiens
ctggcctttgtaagtgcag

SEQ ID NO: 2358296 - DNA, 13 bp, Homo sapiens
ctggcgcaggtgg

SEQ ID NO: 2358297 - DNA, 15 bp, Homo sapiens
ctggcggcgcagagg

SEQ ID NO: 2358298 - DNA, 22 bp, Homo sapiens
ctggctccctcctccaggcctg

SEQ ID NO: 2358299 - DNA, 22 bp, Homo sapiens
ctggctcggggtaaaaagtggc

SEQ ID NO: 2358300 - DNA, 15 bp, Homo sapiens
ctggctctaccctgt

SEQ ID NO: 2358301 - DNA, 19 bp, Homo sapiens
ctggctctaccctgtctgt

SEQ ID NO: 2358302 - DNA, 17 bp, Homo sapiens
ctggctctaccttcctg

SEQ ID NO: 2358303 - DNA, 14 bp, Homo sapiens
ctggctctcacctc

SEQ ID NO: 2358304 - DNA, 19 bp, Homo sapiens
ctggctctcacctctaggt

SEQ ID NO: 2358305 - DNA, 22 bp, Homo sapiens
ctggctctcacctctaggtccc

SEQ ID NO: 2358306 - DNA, 15 bp, Homo sapiens
ctggctctcctggcc

SEQ ID NO: 2358307 - DNA, 17 bp, Homo sapiens
ctggctgaggttcctct

SEQ ID NO: 2358308 - DNA, 19 bp, Homo sapiens
ctggctgaggttcctctgc

SEQ ID NO: 2358309 - DNA, 12 bp, Homo sapiens
ctggctgctgcc

SEQ ID NO: 2358310 - DNA, 13 bp, Homo sapiens
ctgtccctgtagc

SEQ ID NO: 2358311 - DNA, 17 bp, Homo sapiens
ctgtccctgtagctcag

SEQ ID NO: 2358312 - DNA, 15 bp, Homo sapiens
ctgtcccttttcttt

SEQ ID NO: 2358313 - DNA, 18 bp, Homo sapiens
ctgtccgcctctgcccgc

SEQ ID NO: 2358314 - DNA, 17 bp, Homo sapiens
ctgtcctttttcctctc

SEQ ID NO: 2358315 - DNA, 18 bp, Homo sapiens
ctgtcctttttcctctcc

SEQ ID NO: 2358316 - DNA, 20 bp, Homo sapiens
ctgtcctttttcctctccac

SEQ ID NO: 2358317 - DNA, 15 bp, Homo sapiens
ctgtcggtgggacct

SEQ ID NO: 2358318 - DNA, 15 bp, Homo sapiens
ctgtctaaagtgtat

SEQ ID NO: 2358319 - DNA, 14 bp, Homo sapiens
ctgtctacctggtc

SEQ ID NO: 2358320 - DNA, 18 bp, Homo sapiens
ctgtctaggactgcagtg

SEQ ID NO: 2358321 - DNA, 21 bp, Homo sapiens
ctgtctccctcccctctcaga

SEQ ID NO: 2358322 - DNA, 19 bp, Homo sapiens
ctgtctgccccagcccaga

SEQ ID NO: 2358323 - DNA, 16 bp, Homo sapiens
ctgtctgggtgctact

SEQ ID NO: 2358324 - DNA, 13 bp, Homo sapiens
ctgtctgtccctt

SEQ ID NO: 2358325 - DNA, 17 bp, Homo sapiens
ctgtctgtcccttttct

SEQ ID NO: 2358326 - DNA, 16 bp, Homo sapiens
ctgtctgttatgattt

SEQ ID NO: 2358327 - DNA, 16 bp, Homo sapiens
ctgtcttagactgcta

SEQ ID NO: 2358328 - DNA, 20 bp, Homo sapiens
ctgtgaagatctcactctgc

SEQ ID NO: 2358329 - DNA, 13 bp, Homo sapiens
ctgtgaagtgtta

SEQ ID NO: 2358330 - DNA, 20 bp, Homo sapiens
ctgtgacatggtgcctgaga

SEQ ID NO: 2358331 - DNA, 21 bp, Homo sapiens
ctgtgacatggtgcctgagag

SEQ ID NO: 2358332 - DNA, 24 bp, Homo sapiens
ctgtgacatggtgcctgagaggca

SEQ ID NO: 2358333 - DNA, 14 bp, Homo sapiens
ctgtgagggagggg

SEQ ID NO: 2358334 - DNA, 15 bp, Homo sapiens
ctgtgagggagggga

SEQ ID NO: 2358335 - DNA, 19 bp, Homo sapiens
ctgtgatccacccaaccct

SEQ ID NO: 2358336 - DNA, 14 bp, Homo sapiens
ctgtgatcttaaaa

SEQ ID NO: 2358337 - DNA, 18 bp, Homo sapiens
ctgtgatcttaaaataat

SEQ ID NO: 2358338 - DNA, 15 bp, Homo sapiens
ctgtgatgagctgat

SEQ ID NO: 2358339 - DNA, 16 bp, Homo sapiens
ctgtgatgagctgatc

SEQ ID NO: 2358340 - DNA, 18 bp, Homo sapiens
ctgtgatgagctgatctg

SEQ ID NO: 2358341 - DNA, 22 bp, Homo sapiens
ctgtgcacctaccccttggaaa

SEQ ID NO: 2358342 - DNA, 23 bp, Homo sapiens
ctgtgcacctaccccttggaaat

SEQ ID NO: 2358343 - DNA, 18 bp, Homo sapiens
ctgtgcagtcactggagg

SEQ ID NO: 2358344 - DNA, 14 bp, Homo sapiens
ctgtgcatgacctg

SEQ ID NO: 2358345 - DNA, 22 bp, Homo sapiens
ctgtgccaatacagacaaagca

SEQ ID NO: 2358346 - DNA, 15 bp, Homo sapiens
ctgtgcctgaatatt

SEQ ID NO: 2358347 - DNA, 14 bp, Homo sapiens
ctgtgcctggcccc

SEQ ID NO: 2358348 - DNA, 19 bp, Homo sapiens
ctgtgcctggccccagcct

SEQ ID NO: 2358349 - DNA, 21 bp, Homo sapiens
ctgtgcctggccccagcctgg

SEQ ID NO: 2358350 - DNA, 19 bp, Homo sapiens
ctgtgcgtcttggtgtaat

SEQ ID NO: 2358351 - DNA, 22 bp, Homo sapiens
ctgtgcgtcttggtgtaatttg

SEQ ID NO: 2358352 - DNA, 22 bp, Homo sapiens
ctgtgctccgccatggtgtccc

SEQ ID NO: 2358353 - DNA, 17 bp, Homo sapiens
ctgtgcttcctcctgcc

SEQ ID NO: 2358354 - DNA, 21 bp, Homo sapiens
ctgtgcttcggtaggcgacca

SEQ ID NO: 2358355 - DNA, 15 bp, Homo sapiens
ctgtgcttgaaggcc

SEQ ID NO: 2358356 - DNA, 18 bp, Homo sapiens
ctgtgcttgaaggccctg

SEQ ID NO: 2358357 - DNA, 20 bp, Homo sapiens
ctgtgcttgaaggccctgct

SEQ ID NO: 2358358 - DNA, 14 bp, Homo sapiens
ctgtggaggaagga

SEQ ID NO: 2358359 - DNA, 20 bp, Homo sapiens
ctgtggaggaaggattgtaa

SEQ ID NO: 2358360 - DNA, 18 bp, Homo sapiens
ctgtggctccaggccaaa

SEQ ID NO: 2358361 - DNA, 15 bp, Homo sapiens
ctgtgggcttcccca

SEQ ID NO: 2358362 - DNA, 17 bp, Homo sapiens
ctgtgggtctctgaagg

SEQ ID NO: 2358363 - DNA, 20 bp, Homo sapiens
ctgtgggtctctgaagggac

SEQ ID NO: 2358364 - DNA, 18 bp, Homo sapiens
ctgtgggtgttctttcct

SEQ ID NO: 2358365 - DNA, 19 bp, Homo sapiens
ctgtgggtgttctttcctg

SEQ ID NO: 2358366 - DNA, 16 bp, Homo sapiens
ctgtggttcctctgct

SEQ ID NO: 2358367 - DNA, 20 bp, Homo sapiens
ctgtgtacataactgaaaat

SEQ ID NO: 2358368 - DNA, 13 bp, Homo sapiens
ctgtgtactgttc

SEQ ID NO: 2358369 - DNA, 16 bp, Homo sapiens
ctgtgtacttcccggg

SEQ ID NO: 2358370 - DNA, 19 bp, Homo sapiens
ctgtgtctaggcaggcaag

SEQ ID NO: 2358371 - DNA, 23 bp, Homo sapiens
ctgtgttaattgcgtagaggcta

SEQ ID NO: 2358372 - DNA, 23 bp, Homo sapiens
ctgtgttgccacagtagaactgt

SEQ ID NO: 2358373 - DNA, 16 bp, Homo sapiens
ctgtgtttatatggaa

SEQ ID NO: 2358374 - DNA, 13 bp, Homo sapiens
ctgttaacatcta

SEQ ID NO: 2358375 - DNA, 14 bp, Homo sapiens
ctgttagggccttg

SEQ ID NO: 2358376 - DNA, 20 bp, Homo sapiens
ctgttatgatttccttcaat

SEQ ID NO: 2358377 - DNA, 19 bp, Homo sapiens
ctgttatgctgtgacacat

SEQ ID NO: 2358378 - DNA, 13 bp, Homo sapiens
ctgttatgggctt

SEQ ID NO: 2358379 - DNA, 15 bp, Homo sapiens
ctgttcactcactct

SEQ ID NO: 2358380 - DNA, 21 bp, Homo sapiens
ctgttccatgttctatttttg

SEQ ID NO: 2358381 - DNA, 12 bp, Homo sapiens
ctgttccctgga

SEQ ID NO: 2358382 - DNA, 21 bp, Homo sapiens
ctgttcctgctgctgtctggg

SEQ ID NO: 2358383 - DNA, 18 bp, Homo sapiens
ctgttgacgcacctgtgg

SEQ ID NO: 2358384 - DNA, 14 bp, Homo sapiens
ctgttgataaaaac

SEQ ID NO: 2358385 - DNA, 18 bp, Homo sapiens
ctgttgataaaaactcag

SEQ ID NO: 2358386 - DNA, 19 bp, Homo sapiens
ctgttgctttgaaaaatct

SEQ ID NO: 2358387 - DNA, 17 bp, Homo sapiens
ctgttgtaagaattctg

SEQ ID NO: 2358388 - DNA, 22 bp, Homo sapiens
ctgttgtaatatcagttacagt

SEQ ID NO: 2358389 - DNA, 18 bp, Homo sapiens
ctgttgtacatttatgat

SEQ ID NO: 2358390 - DNA, 19 bp, Homo sapiens
ctgttgtacatttatgatt

SEQ ID NO: 2358391 - DNA, 18 bp, Homo sapiens
ctgttgtgagctttgaag

SEQ ID NO: 2358392 - DNA, 21 bp, Homo sapiens
ctgtttaggttcccctgtcaa

SEQ ID NO: 2358393 - DNA, 16 bp, Homo sapiens
ctgtttctaagaaaat

SEQ ID NO: 2358394 - DNA, 16 bp, Homo sapiens
ctgtttctcttgagct

SEQ ID NO: 2358395 - DNA, 22 bp, Homo sapiens
ctgtttctcttgagctggcctc

SEQ ID NO: 2358396 - DNA, 14 bp, Homo sapiens
ctgtttgaaagtaa

SEQ ID NO: 2358397 - DNA, 16 bp, Homo sapiens
ctgtttgacttctcaa

SEQ ID NO: 2358398 - DNA, 21 bp, Homo sapiens
ctgtttgatataccaaattaa

SEQ ID NO: 2358399 - DNA, 13 bp, Homo sapiens
ctgtttgctgtgc

SEQ ID NO: 2358400 - DNA, 18 bp, Homo sapiens
ctgttttgtggtttggaa

SEQ ID NO: 2358401 - DNA, 14 bp, Homo sapiens
ctgtttttactctg

SEQ ID NO: 2358402 - DNA, 12 bp, Homo sapiens
ctgtttttcaca

SEQ ID NO: 2358403 - DNA, 12 bp, Homo sapiens
cttaaaaaggaa

SEQ ID NO: 2358404 - DNA, 20 bp, Homo sapiens
cttaaaaatcattgattgtc

SEQ ID NO: 2358405 - DNA, 12 bp, Homo sapiens
cttaaaaatgta

SEQ ID NO: 2358406 - DNA, 15 bp, Homo sapiens
cttaaaaccaaagag

SEQ ID NO: 2358407 - DNA, 12 bp, Homo sapiens
cttaaaagacag

SEQ ID NO: 2358408 - DNA, 22 bp, Homo sapiens
cttaaaagcatttttattatat

SEQ ID NO: 2358409 - DNA, 13 bp, Homo sapiens
cttaaaataattc

SEQ ID NO: 2358410 - DNA, 12 bp, Homo sapiens
cttaaatttcag

SEQ ID NO: 2358411 - DNA, 14 bp, Homo sapiens
cttaaatttcagaa

SEQ ID NO: 2358412 - DNA, 16 bp, Homo sapiens
cttaaatttcagaatt

SEQ ID NO: 2358413 - DNA, 13 bp, Homo sapiens
cttaaatttctta

SEQ ID NO: 2358414 - DNA, 18 bp, Homo sapiens
cttaaatttcttatgtga

SEQ ID NO: 2358415 - DNA, 19 bp, Homo sapiens
cttaaatttcttatgtgac

SEQ ID NO: 2358416 - DNA, 16 bp, Homo sapiens
cttaaattttaactaa

SEQ ID NO: 2358417 - DNA, 18 bp, Homo sapiens
cttaaattttaactaaat

SEQ ID NO: 2358418 - DNA, 21 bp, Homo sapiens
cttaagcaaattttgtattat

SEQ ID NO: 2358419 - DNA, 17 bp, Homo sapiens
cttaagctttggggaat

SEQ ID NO: 2358420 - DNA, 19 bp, Homo sapiens
cttaagtgagcagaacagg

SEQ ID NO: 2358421 - DNA, 20 bp, Homo sapiens
cttaagtgagcagaacaggt

SEQ ID NO: 2358422 - DNA, 19 bp, Homo sapiens
cttaataaaagaacatgct

SEQ ID NO: 2358423 - DNA, 20 bp, Homo sapiens
cttaataaaagaacatgctt

SEQ ID NO: 2358424 - DNA, 19 bp, Homo sapiens
cttaataactgtgtactgt

SEQ ID NO: 2358425 - DNA, 19 bp, Homo sapiens
cttctacctgccctcaagg

SEQ ID NO: 2358426 - DNA, 20 bp, Homo sapiens
cttctactcacttttcccac

SEQ ID NO: 2358427 - DNA, 20 bp, Homo sapiens
cttctaggcccattgtcctc

SEQ ID NO: 2358428 - DNA, 21 bp, Homo sapiens
cttctaggcccattgtcctcc

SEQ ID NO: 2358429 - DNA, 22 bp, Homo sapiens
cttctaggcccattgtcctcct

SEQ ID NO: 2358430 - DNA, 18 bp, Homo sapiens
cttctagtgatgatggtt

SEQ ID NO: 2358431 - DNA, 19 bp, Homo sapiens
cttctattaatcaagagaa

SEQ ID NO: 2358432 - DNA, 20 bp, Homo sapiens
cttctattctagcctgcatt

SEQ ID NO: 2358433 - DNA, 16 bp, Homo sapiens
cttctcagaagcacag

SEQ ID NO: 2358434 - DNA, 14 bp, Homo sapiens
cttctcagatttct

SEQ ID NO: 2358435 - DNA, 22 bp, Homo sapiens
cttctcagatttctgaggaaat

SEQ ID NO: 2358436 - DNA, 15 bp, Homo sapiens
cttctcccactctcc

SEQ ID NO: 2358437 - DNA, 17 bp, Homo sapiens
cttctcccactctccta

SEQ ID NO: 2358438 - DNA, 16 bp, Homo sapiens
cttctccctagctcct

SEQ ID NO: 2358439 - DNA, 18 bp, Homo sapiens
cttctccgccagcctcct

SEQ ID NO: 2358440 - DNA, 13 bp, Homo sapiens
cttctctcctccc

SEQ ID NO: 2358441 - DNA, 17 bp, Homo sapiens
cttctgaactcaaactg

SEQ ID NO: 2358442 - DNA, 18 bp, Homo sapiens
cttctgaactcaaactga

SEQ ID NO: 2358443 - DNA, 14 bp, Homo sapiens
cttctgagctcctg

SEQ ID NO: 2358444 - DNA, 15 bp, Homo sapiens
cttctgagctcctgt

SEQ ID NO: 2358445 - DNA, 22 bp, Homo sapiens
cttctgagctcctgtcccctgc

SEQ ID NO: 2358446 - DNA, 18 bp, Homo sapiens
cttctgcaacaagcatgc

SEQ ID NO: 2358447 - DNA, 19 bp, Homo sapiens
cttctgctggggcctggga

SEQ ID NO: 2358448 - DNA, 17 bp, Homo sapiens
cttctgcttttctgccc

SEQ ID NO: 2358449 - DNA, 21 bp, Homo sapiens
cttctgcttttctgccctggc

SEQ ID NO: 2358450 - DNA, 18 bp, Homo sapiens
cttctggaaactgtgaag

SEQ ID NO: 2358451 - DNA, 14 bp, Homo sapiens
cttctggggcaggc

SEQ ID NO: 2358452 - DNA, 16 bp, Homo sapiens
cttctggggcaggctg

SEQ ID NO: 2358453 - DNA, 21 bp, Homo sapiens
cttctggggcaggctgggcca

SEQ ID NO: 2358454 - DNA, 20 bp, Homo sapiens
cttctgtatttttttttcta

SEQ ID NO: 2358455 - DNA, 17 bp, Homo sapiens
cttctgtgatgagctga

SEQ ID NO: 2358456 - DNA, 17 bp, Homo sapiens
cttcttgaaacagcctg

SEQ ID NO: 2358457 - DNA, 19 bp, Homo sapiens
cttcttgaatataaaaaat

SEQ ID NO: 2358458 - DNA, 15 bp, Homo sapiens
cttcttgtgtcctga

SEQ ID NO: 2358459 - DNA, 15 bp, Homo sapiens
cttctttaagccata

SEQ ID NO: 2358460 - DNA, 13 bp, Homo sapiens
cttctttccctgg

SEQ ID NO: 2358461 - DNA, 17 bp, Homo sapiens
cttctttccctggacag

SEQ ID NO: 2358462 - DNA, 17 bp, Homo sapiens
cttctttgataatgtta

SEQ ID NO: 2358463 - DNA, 20 bp, Homo sapiens
cttctttggaaataaaagat

SEQ ID NO: 2358464 - DNA, 14 bp, Homo sapiens
cttgaaacagcctg

SEQ ID NO: 2358465 - DNA, 16 bp, Homo sapiens
cttgaaacagcctggg

SEQ ID NO: 2358466 - DNA, 18 bp, Homo sapiens
cttgaaactttgggaaaa

SEQ ID NO: 2358467 - DNA, 16 bp, Homo sapiens
cttgaaaggcaggaag

SEQ ID NO: 2358468 - DNA, 14 bp, Homo sapiens
cttgaaattttaac

SEQ ID NO: 2358469 - DNA, 17 bp, Homo sapiens
cttgaaattttaaccta

SEQ ID NO: 2358470 - DNA, 14 bp, Homo sapiens
cttgaagccaaaga

SEQ ID NO: 2358471 - DNA, 19 bp, Homo sapiens
cttgaagccaaagaaaaat

SEQ ID NO: 2358472 - DNA, 20 bp, Homo sapiens
cttgaatataaaaaatcatg

SEQ ID NO: 2358473 - DNA, 21 bp, Homo sapiens
cttgacgtttcttctttctag

SEQ ID NO: 2358474 - DNA, 16 bp, Homo sapiens
cttgagacaatgtttt

SEQ ID NO: 2358475 - DNA, 18 bp, Homo sapiens
cttgagccaggaggcctg

SEQ ID NO: 2358476 - DNA, 12 bp, Homo sapiens
cttgagccctgg

SEQ ID NO: 2358477 - DNA, 19 bp, Homo sapiens
cttgagccgggcccctggg

SEQ ID NO: 2358478 - DNA, 20 bp, Homo sapiens
cttgagccgggcccctgggc

SEQ ID NO: 2358479 - DNA, 23 bp, Homo sapiens
cttgagctagagataaaacagaa

SEQ ID NO: 2358480 - DNA, 20 bp, Homo sapiens
cttgagctgttgtgagcttt

SEQ ID NO: 2358481 - DNA, 18 bp, Homo sapiens
cttgataatatataaaca

SEQ ID NO: 2358482 - DNA, 17 bp, Homo sapiens
cttgatataaaaaatct

SEQ ID NO: 2358483 - DNA, 12 bp, Homo sapiens
cttgatgactgc

SEQ ID NO: 2358484 - DNA, 16 bp, Homo sapiens
cttgatgactgccttg

SEQ ID NO: 2358485 - DNA, 17 bp, Homo sapiens
cttgatgtttggggtct

SEQ ID NO: 2358486 - DNA, 16 bp, Homo sapiens
cttgattcctggctct

SEQ ID NO: 2358487 - DNA, 23 bp, Homo sapiens
cttgatttcaaagttttgttgta

SEQ ID NO: 2358488 - DNA, 16 bp, Homo sapiens
cttgcacagctggaga

SEQ ID NO: 2358489 - DNA, 19 bp, Homo sapiens
cttgcacagtcactgctct

SEQ ID NO: 2358490 - DNA, 22 bp, Homo sapiens
cttgcacttgttatattataat

SEQ ID NO: 2358491 - DNA, 20 bp, Homo sapiens
cttgcataataagctaaaga

SEQ ID NO: 2358492 - DNA, 21 bp, Homo sapiens
cttgcataataagctaaagag

SEQ ID NO: 2358493 - DNA, 22 bp, Homo sapiens
cttgcataataagctaaagagg

SEQ ID NO: 2358494 - DNA, 21 bp, Homo sapiens
cttgccaaagtacagaatttg

SEQ ID NO: 2358495 - DNA, 15 bp, Homo sapiens
cttgccagggcaggg

SEQ ID NO: 2358496 - DNA, 17 bp, Homo sapiens
cttgccagggcagggtc

SEQ ID NO: 2358497 - DNA, 17 bp, Homo sapiens
cttgccattccaaaata

SEQ ID NO: 2358498 - DNA, 12 bp, Homo sapiens
cttgcccatcct

SEQ ID NO: 2358499 - DNA, 16 bp, Homo sapiens
cttgcccatcctgact

SEQ ID NO: 2358500 - DNA, 20 bp, Homo sapiens
cttgccccccgccctcatgg

SEQ ID NO: 2358501 - DNA, 15 bp, Homo sapiens
cttgccgagagaggc

SEQ ID NO: 2358502 - DNA, 16 bp, Homo sapiens
cttgccgagagaggcg

SEQ ID NO: 2358503 - DNA, 20 bp, Homo sapiens
cttgcctccccatttcccat

SEQ ID NO: 2358504 - DNA, 15 bp, Homo sapiens
cttgcctcctcagta

SEQ ID NO: 2358505 - DNA, 15 bp, Homo sapiens
cttgcctctgcacac

SEQ ID NO: 2358506 - DNA, 24 bp, Homo sapiens
cttgcctctgcacaccctccagag

SEQ ID NO: 2358507 - DNA, 18 bp, Homo sapiens
cttgcctttcgaggcctg

SEQ ID NO: 2358508 - DNA, 19 bp, Homo sapiens
cttgcctttcgaggcctga

SEQ ID NO: 2358509 - DNA, 13 bp, Homo sapiens
cttgcgagtccaa

SEQ ID NO: 2358510 - DNA, 17 bp, Homo sapiens
cttgcggcaaaaggaaa

SEQ ID NO: 2358511 - DNA, 16 bp, Homo sapiens
cttgctccagattctg

SEQ ID NO: 2358512 - DNA, 20 bp, Homo sapiens
cttgctccagattctgatgc

SEQ ID NO: 2358513 - DNA, 12 bp, Homo sapiens
cttgctctgtcc

SEQ ID NO: 2358514 - DNA, 19 bp, Homo sapiens
cttgctctgtcccccaggc

SEQ ID NO: 2358515 - DNA, 16 bp, Homo sapiens
cttgctggccccagcc

SEQ ID NO: 2358516 - DNA, 22 bp, Homo sapiens
cttgctggctacgcctcttctg

SEQ ID NO: 2358517 - DNA, 20 bp, Homo sapiens
cttgctggtgcctgccacct

SEQ ID NO: 2358518 - DNA, 13 bp, Homo sapiens
cttgctgtccagg

SEQ ID NO: 2358519 - DNA, 16 bp, Homo sapiens
cttgctgtccaggcag

SEQ ID NO: 2358520 - DNA, 19 bp, Homo sapiens
cttgctgtttgtcctgaga

SEQ ID NO: 2358521 - DNA, 16 bp, Homo sapiens
cttgcttaaatttctt

SEQ ID NO: 2358522 - DNA, 23 bp, Homo sapiens
cttgcttaaatttcttatgtgac

SEQ ID NO: 2358523 - DNA, 21 bp, Homo sapiens
cttgctttggggggtgtgctg

SEQ ID NO: 2358524 - DNA, 18 bp, Homo sapiens
cttggaaatgtctgctgg

SEQ ID NO: 2358525 - DNA, 20 bp, Homo sapiens
cttggaaattcctgtactgt

SEQ ID NO: 2358526 - DNA, 15 bp, Homo sapiens
cttggaagctgtttg

SEQ ID NO: 2358527 - DNA, 16 bp, Homo sapiens
cttggaagctgtttgg

SEQ ID NO: 2358528 - DNA, 19 bp, Homo sapiens
cttggaagctgtttggaaa

SEQ ID NO: 2358529 - DNA, 21 bp, Homo sapiens
cttggaccactcctgtccctg

SEQ ID NO: 2358530 - DNA, 23 bp, Homo sapiens
cttggaccactcctgtccctgta

SEQ ID NO: 2358531 - DNA, 16 bp, Homo sapiens
cttggaccatgccaga

SEQ ID NO: 2358532 - DNA, 20 bp, Homo sapiens
cttggagagcagctggctct

SEQ ID NO: 2358533 - DNA, 19 bp, Homo sapiens
cttggagctattttccagg

SEQ ID NO: 2358534 - DNA, 15 bp, Homo sapiens
cttggcctcccaaag

SEQ ID NO: 2358535 - DNA, 12 bp, Homo sapiens
cttggcctgctg

SEQ ID NO: 2358536 - DNA, 13 bp, Homo sapiens
cttggcctgctgt

SEQ ID NO: 2358537 - DNA, 21 bp, Homo sapiens
cttggctgccctgtctggaac

SEQ ID NO: 2358538 - DNA, 13 bp, Homo sapiens
cttggctggggag

SEQ ID NO: 2358539 - DNA, 13 bp, Homo sapiens
cttggcttctgtg

SEQ ID NO: 2358540 - DNA, 17 bp, Homo sapiens
cttgggcagtgccccag

SEQ ID NO: 2358541 - DNA, 13 bp, Homo sapiens
cttggggccttga

SEQ ID NO: 2358542 - DNA, 18 bp, Homo sapiens
cttgggtgtattctctgt

SEQ ID NO: 2358543 - DNA, 19 bp, Homo sapiens
cttgggtgtattctctgta

SEQ ID NO: 2358544 - DNA, 23 bp, Homo sapiens
cttggtgattacctgaaagccct

SEQ ID NO: 2358545 - DNA, 12 bp, Homo sapiens
cttggtgtaatt

SEQ ID NO: 2358546 - DNA, 18 bp, Homo sapiens
cttggtgtaatttgaaga

SEQ ID NO: 2358547 - DNA, 14 bp, Homo sapiens
cttggttttatggt

SEQ ID NO: 2358548 - DNA, 14 bp, Homo sapiens
cttgtaaagactgg

SEQ ID NO: 2358549 - DNA, 15 bp, Homo sapiens
cttgtaaagactggt

SEQ ID NO: 2358550 - DNA, 23 bp, Homo sapiens
cttgtaaagactggttttctgcc

SEQ ID NO: 2358551 - DNA, 23 bp, Homo sapiens
cttgtacatgtgtagcctgtgca

SEQ ID NO: 2358552 - DNA, 22 bp, Homo sapiens
cttgtaggggaggggctccttt

SEQ ID NO: 2358553 - DNA, 12 bp, Homo sapiens
cttgtataatat

SEQ ID NO: 2358554 - DNA, 17 bp, Homo sapiens
cttgtatttaaaaacat

SEQ ID NO: 2358555 - DNA, 20 bp, Homo sapiens
cttgtatttaaaaacatttt

SEQ ID NO: 2358556 - DNA, 23 bp, Homo sapiens
cttgtcttctggtactttctgtt

SEQ ID NO: 2358557 - DNA, 13 bp, Homo sapiens
cttgtgacagtgc

SEQ ID NO: 2358558 - DNA, 20 bp, Homo sapiens
cttgtgacagtgcctcttcc

SEQ ID NO: 2358559 - DNA, 21 bp, Homo sapiens
cttgtgatttctttaaaagaa

SEQ ID NO: 2358560 - DNA, 23 bp, Homo sapiens
cttgtgatttctttaaaagaatg

SEQ ID NO: 2358561 - DNA, 12 bp, Homo sapiens
cttgtggggcct

SEQ ID NO: 2358562 - DNA, 16 bp, Homo sapiens
cttgtggggcctggga

SEQ ID NO: 2358563 - DNA, 14 bp, Homo sapiens
cttgtgggtccatg

SEQ ID NO: 2358564 - DNA, 16 bp, Homo sapiens
cttgtgggtccatgct

SEQ ID NO: 2358565 - DNA, 24 bp, Homo sapiens
cttgtgggtccatgctaacaaaga

SEQ ID NO: 2358566 - DNA, 14 bp, Homo sapiens
cttgtgtctgtaca

SEQ ID NO: 2358567 - DNA, 15 bp, Homo sapiens
cttgtgtctgtacac

SEQ ID NO: 2358568 - DNA, 15 bp, Homo sapiens
cttgtgttttaaaat

SEQ ID NO: 2358569 - DNA, 14 bp, Homo sapiens
cttgttatgttgta

SEQ ID NO: 2358570 - DNA, 22 bp, Homo sapiens
cttgttatgttgtaatattttg

SEQ ID NO: 2358571 - DNA, 15 bp, Homo sapiens
cttgttgtttttaag

SEQ ID NO: 2358572 - DNA, 21 bp, Homo sapiens
cttgttgtttttaagtcctgt

SEQ ID NO: 2358573 - DNA, 19 bp, Homo sapiens
cttgtttgagtttttcctc

SEQ ID NO: 2358574 - DNA, 20 bp, Homo sapiens
cttgtttgagtttttcctcc

SEQ ID NO: 2358575 - DNA, 22 bp, Homo sapiens
cttgtttggtttggtttgcttt

SEQ ID NO: 2358576 - DNA, 12 bp, Homo sapiens
ctttaaaagaat

SEQ ID NO: 2358577 - DNA, 15 bp, Homo sapiens
ctttaaaagaatgac

SEQ ID NO: 2358578 - DNA, 23 bp, Homo sapiens
ctttaaactatgttcctaacaaa

SEQ ID NO: 2358579 - DNA, 13 bp, Homo sapiens
ctttaaagttctt

SEQ ID NO: 2358580 - DNA, 18 bp, Homo sapiens
ctttaaccttgtataaat

SEQ ID NO: 2358581 - DNA, 17 bp, Homo sapiens
ctttaagccttcaaaac

SEQ ID NO: 2358582 - DNA, 20 bp, Homo sapiens
ctttaagccttcaaaactat

SEQ ID NO: 2358583 - DNA, 20 bp, Homo sapiens
ctttaataacaaggagattt

SEQ ID NO: 2358584 - DNA, 21 bp, Homo sapiens
ctttaatatactccttaaaaa

SEQ ID NO: 2358585 - DNA, 12 bp, Homo sapiens
ctttaattatat

SEQ ID NO: 2358586 - DNA, 19 bp, Homo sapiens
ctttacccacctagaacac

SEQ ID NO: 2358587 - DNA, 14 bp, Homo sapiens
ctttaccctctttg

SEQ ID NO: 2358588 - DNA, 17 bp, Homo sapiens
ctttaccctctttgctg

SEQ ID NO: 2358589 - DNA, 17 bp, Homo sapiens
ctttacctgtgaagtgt

SEQ ID NO: 2358590 - DNA, 22 bp, Homo sapiens
ctttacgcccatctcaggacac

SEQ ID NO: 2358591 - DNA, 20 bp, Homo sapiens
ctttactttcaagtaatatt

SEQ ID NO: 2358592 - DNA, 16 bp, Homo sapiens
ctttagaccctgggtg

SEQ ID NO: 2358593 - DNA, 23 bp, Homo sapiens
ctttagaccctgggtgggctctg

SEQ ID NO: 2358594 - DNA, 14 bp, Homo sapiens
ctttagtttttggt

SEQ ID NO: 2358595 - DNA, 12 bp, Homo sapiens
ctttatgtattc

SEQ ID NO: 2358596 - DNA, 14 bp, Homo sapiens
ctttatgtattctc

SEQ ID NO: 2358597 - DNA, 22 bp, Homo sapiens
ctttattgctatcgccctcctt

SEQ ID NO: 2358598 - DNA, 16 bp, Homo sapiens
ctttattggctgagat

SEQ ID NO: 2358599 - DNA, 14 bp, Homo sapiens
ctttcaaaatgaat

SEQ ID NO: 2358600 - DNA, 16 bp, Homo sapiens
ctttcaagtaatattg

SEQ ID NO: 2358601 - DNA, 15 bp, Homo sapiens
ctttcacttcttcct

SEQ ID NO: 2358602 - DNA, 17 bp, Homo sapiens
ctttcacttcttcctat

SEQ ID NO: 2358603 - DNA, 10 bp, Homo sapiens
ctttcagaaa

SEQ ID NO: 2358604 - DNA, 14 bp, Homo sapiens
ctttcagaaagctt

SEQ ID NO: 2358605 - DNA, 23 bp, Homo sapiens
ctttcagaaatataacacatttt

SEQ ID NO: 2358606 - DNA, 21 bp, Homo sapiens
ctttcagaagtgcccttcctg

SEQ ID NO: 2358607 - DNA, 19 bp, Homo sapiens
ctttcagatacatggttgt

SEQ ID NO: 2358608 - DNA, 17 bp, Homo sapiens
ctttcagtgcagtttct

SEQ ID NO: 2358609 - DNA, 21 bp, Homo sapiens
ctttcagtgcagtttcttttc

SEQ ID NO: 2358610 - DNA, 22 bp, Homo sapiens
ctttcagtgcagtttcttttca

SEQ ID NO: 2358611 - DNA, 13 bp, Homo sapiens
ctttccaaattaa

SEQ ID NO: 2358612 - DNA, 15 bp, Homo sapiens
ctttccaaattaaaa

SEQ ID NO: 2358613 - DNA, 18 bp, Homo sapiens
ctttccaggcaccctcag

SEQ ID NO: 2358614 - DNA, 23 bp, Homo sapiens
ctttccatccattacctccatcc

SEQ ID NO: 2358615 - DNA, 11 bp, Homo sapiens
ctttcccacac

SEQ ID NO: 2358616 - DNA, 14 bp, Homo sapiens
ctttcccacactgt

SEQ ID NO: 2358617 - DNA, 15 bp, Homo sapiens
ctttcccaccccaac

SEQ ID NO: 2358618 - DNA, 14 bp, Homo sapiens
ctttccctggacag

SEQ ID NO: 2358619 - DNA, 16 bp, Homo sapiens
ctttcccttattgcct

SEQ ID NO: 2358620 - DNA, 23 bp, Homo sapiens
ctttcccttattgcctcccaggc

SEQ ID NO: 2358621 - DNA, 15 bp, Homo sapiens
ctttcctcacatttg

SEQ ID NO: 2358622 - DNA, 23 bp, Homo sapiens
ctttcctctttctgctctgccat

SEQ ID NO: 2358623 - DNA, 17 bp, Homo sapiens
ctttcctgccctgtcca

SEQ ID NO: 2358624 - DNA, 10 bp, Homo sapiens
ctttcctgtc

SEQ ID NO: 2358625 - DNA, 12 bp, Homo sapiens
ctttccttccct

SEQ ID NO: 2358626 - DNA, 17 bp, Homo sapiens
ctttccttggctttatg

SEQ ID NO: 2358627 - DNA, 20 bp, Homo sapiens
ctttcgaggcctgaagccag

SEQ ID NO: 2358628 - DNA, 18 bp, Homo sapiens
ctttctagtggtctttgt

SEQ ID NO: 2358629 - DNA, 19 bp, Homo sapiens
ctttctagtggtctttgta

SEQ ID NO: 2358630 - DNA, 20 bp, Homo sapiens
ctttctagtggtctttgtaa

SEQ ID NO: 2358631 - DNA, 21 bp, Homo sapiens
ctttctagtggtctttgtaag

SEQ ID NO: 2358632 - DNA, 17 bp, Homo sapiens
ctttctcagttttcata

SEQ ID NO: 2358633 - DNA, 19 bp, Homo sapiens
ctttctccctcaactgaag

SEQ ID NO: 2358634 - DNA, 22 bp, Homo sapiens
ctttctccctcaactgaagggg

SEQ ID NO: 2358635 - DNA, 14 bp, Homo sapiens
ctttctctcctggc

SEQ ID NO: 2358636 - DNA, 15 bp, Homo sapiens
ctttctctcctggct

SEQ ID NO: 2358637 - DNA, 16 bp, Homo sapiens
ctttctctcctggctc

SEQ ID NO: 2358638 - DNA, 21 bp, Homo sapiens
ctttctctcctggctcggggt

SEQ ID NO: 2358639 - DNA, 14 bp, Homo sapiens
ctttctcttccctg

SEQ ID NO: 2358640 - DNA, 16 bp, Homo sapiens
ctttctcttccctgaa

SEQ ID NO: 2358641 - DNA, 24 bp, Homo sapiens
ctttctcttccctgaacgttttct

SEQ ID NO: 2358642 - DNA, 21 bp, Homo sapiens
ctttctcttttcccctttcct

SEQ ID NO: 2358643 - DNA, 22 bp, Homo sapiens
ctttctgccatctagccagccc

SEQ ID NO: 2358644 - DNA, 15 bp, Homo sapiens
ctttctgctctgcca

SEQ ID NO: 2358645 - DNA, 23 bp, Homo sapiens
ctttctggggggatatttcctaa

SEQ ID NO: 2358646 - DNA, 13 bp, Homo sapiens
ctttctgtagcct

SEQ ID NO: 2358647 - DNA, 14 bp, Homo sapiens
ctttctgtagccta

SEQ ID NO: 2358648 - DNA, 17 bp, Homo sapiens
ctttctttaaagttctt

SEQ ID NO: 2358649 - DNA, 19 bp, Homo sapiens
ctttcttttaatgatgcca

SEQ ID NO: 2358650 - DNA, 22 bp, Homo sapiens
ctttctttttcttttttgcttt

SEQ ID NO: 2358651 - DNA, 15 bp, Homo sapiens
ctttctttttttccc

SEQ ID NO: 2358652 - DNA, 19 bp, Homo sapiens
ctttgaaaagttggaagga

SEQ ID NO: 2358653 - DNA, 14 bp, Homo sapiens
ctttgaagggcaag

SEQ ID NO: 2358654 - DNA, 15 bp, Homo sapiens
gaaacaaagggtttt

SEQ ID NO: 2358655 - DNA, 18 bp, Homo sapiens
gaaacaaagggttttctt

SEQ ID NO: 2358656 - DNA, 21 bp, Homo sapiens
gaaacagttctcactgggaag

SEQ ID NO: 2358657 - DNA, 21 bp, Homo sapiens
gaaacagttgctgtgaacttt

SEQ ID NO: 2358658 - DNA, 16 bp, Homo sapiens
gaaacagtttaacaga

SEQ ID NO: 2358659 - DNA, 16 bp, Homo sapiens
gaaacatctcaataaa

SEQ ID NO: 2358660 - DNA, 20 bp, Homo sapiens
gaaacattttatcattaaaa

SEQ ID NO: 2358661 - DNA, 13 bp, Homo sapiens
gaaaccacacttc

SEQ ID NO: 2358662 - DNA, 17 bp, Homo sapiens
gaaaccacacttcttga

SEQ ID NO: 2358663 - DNA, 21 bp, Homo sapiens
gaaaccacacttcttgaaaca

SEQ ID NO: 2358664 - DNA, 14 bp, Homo sapiens
gaaaccttttttaa

SEQ ID NO: 2358665 - DNA, 22 bp, Homo sapiens
gaaaccttttttaagatttttc

SEQ ID NO: 2358666 - DNA, 13 bp, Homo sapiens
gaaactacaaata

SEQ ID NO: 2358667 - DNA, 19 bp, Homo sapiens
gaaactccacatctgcctt

SEQ ID NO: 2358668 - DNA, 13 bp, Homo sapiens
gaaactgaatgaa

SEQ ID NO: 2358669 - DNA, 14 bp, Homo sapiens
gaaactggccatgg

SEQ ID NO: 2358670 - DNA, 20 bp, Homo sapiens
gaaactggccatggcctgca

SEQ ID NO: 2358671 - DNA, 21 bp, Homo sapiens
gaaactggccatggcctgcaa

SEQ ID NO: 2358672 - DNA, 18 bp, Homo sapiens
gaaactggttgtaaaaga

SEQ ID NO: 2358673 - DNA, 14 bp, Homo sapiens
gaaacttggccagt

SEQ ID NO: 2358674 - DNA, 18 bp, Homo sapiens
gaaactttgatctctgct

SEQ ID NO: 2358675 - DNA, 13 bp, Homo sapiens
gaaagagagtacc

SEQ ID NO: 2358676 - DNA, 14 bp, Homo sapiens
gaaagcctctctct

SEQ ID NO: 2358677 - DNA, 17 bp, Homo sapiens
gaaagctcactgtagct

SEQ ID NO: 2358678 - DNA, 19 bp, Homo sapiens
gaaaggcaggaagggaagc

SEQ ID NO: 2358679 - DNA, 14 bp, Homo sapiens
gaaagggctggctc

SEQ ID NO: 2358680 - DNA, 18 bp, Homo sapiens
gaaaggggagagcctgct

SEQ ID NO: 2358681 - DNA, 21 bp, Homo sapiens
gaaagtcaaaaaattatttgc

SEQ ID NO: 2358682 - DNA, 14 bp, Homo sapiens
gaaagtgcattttt

SEQ ID NO: 2358683 - DNA, 18 bp, Homo sapiens
gaaagttttgtaaaagaa

SEQ ID NO: 2358684 - DNA, 20 bp, Homo sapiens
gaaagttttgtaaaagaaat

SEQ ID NO: 2358685 - DNA, 21 bp, Homo sapiens
gaaagttttgtaaaagaaatc

SEQ ID NO: 2358686 - DNA, 13 bp, Homo sapiens
gaaataaatgaaa

SEQ ID NO: 2358687 - DNA, 16 bp, Homo sapiens
gaaataaatgaaactt

SEQ ID NO: 2358688 - DNA, 16 bp, Homo sapiens
gaaataacaatgttaa

SEQ ID NO: 2358689 - DNA, 16 bp, Homo sapiens
gaaataatttgaatgt

SEQ ID NO: 2358690 - DNA, 13 bp, Homo sapiens
gaaatagacaaaa

SEQ ID NO: 2358691 - DNA, 18 bp, Homo sapiens
gaaatagatatcctctcc

SEQ ID NO: 2358692 - DNA, 23 bp, Homo sapiens
gaaatatcaaagtcattaaagac

SEQ ID NO: 2358693 - DNA, 20 bp, Homo sapiens
gaaatatctgtgaaggactt

SEQ ID NO: 2358694 - DNA, 19 bp, Homo sapiens
gaaatgaaaacatgtaata

SEQ ID NO: 2358695 - DNA, 13 bp, Homo sapiens
gaaatgctgctgg

SEQ ID NO: 2358696 - DNA, 15 bp, Homo sapiens
gaaatgctgctggcc

SEQ ID NO: 2358697 - DNA, 16 bp, Homo sapiens
gaaatgctgctggcca

SEQ ID NO: 2358698 - DNA, 17 bp, Homo sapiens
gaaatgctgctggccaa

SEQ ID NO: 2358699 - DNA, 15 bp, Homo sapiens
gaaatggaaagcaga

SEQ ID NO: 2358700 - DNA, 18 bp, Homo sapiens
gaaatggcgtctgctctg

SEQ ID NO: 2358701 - DNA, 22 bp, Homo sapiens
gaaatggcgtctgctctggtgg

SEQ ID NO: 2358702 - DNA, 16 bp, Homo sapiens
gaaatggtatgtagag

SEQ ID NO: 2358703 - DNA, 14 bp, Homo sapiens
gaaatgtctgctgg

SEQ ID NO: 2358704 - DNA, 19 bp, Homo sapiens
gaaattaacacaaaggaag

SEQ ID NO: 2358705 - DNA, 21 bp, Homo sapiens
gaaattccatacttctctcag

SEQ ID NO: 2358706 - DNA, 18 bp, Homo sapiens
gaaattgctttgtattgt

SEQ ID NO: 2358707 - DNA, 23 bp, Homo sapiens
gaaatttgggagagccatacata

SEQ ID NO: 2358708 - DNA, 14 bp, Homo sapiens
gaaattttagaaat

SEQ ID NO: 2358709 - DNA, 22 bp, Homo sapiens
gaaattttatatgcttactgat

SEQ ID NO: 2358710 - DNA, 14 bp, Homo sapiens
gaaattttgtaaga

SEQ ID NO: 2358711 - DNA, 15 bp, Homo sapiens
gaaattttgtaagaa

SEQ ID NO: 2358712 - DNA, 18 bp, Homo sapiens
gaacaagcttcagtaagt

SEQ ID NO: 2358713 - DNA, 15 bp, Homo sapiens
gaacacgattttcaa

SEQ ID NO: 2358714 - DNA, 19 bp, Homo sapiens
gaacagagtgcaacccagt

SEQ ID NO: 2358715 - DNA, 19 bp, Homo sapiens
gaacaggttcttaaaaagg

SEQ ID NO: 2358716 - DNA, 20 bp, Homo sapiens
gaacagtaaagaaagcagaa

SEQ ID NO: 2358717 - DNA, 22 bp, Homo sapiens
gaacatactgttcactcactct

SEQ ID NO: 2358718 - DNA, 15 bp, Homo sapiens
gaacatatgttgcaa

SEQ ID NO: 2358719 - DNA, 19 bp, Homo sapiens
gaacatctaacccactaga

SEQ ID NO: 2358720 - DNA, 24 bp, Homo sapiens
gaaccaacaacctcaactgcctac

SEQ ID NO: 2358721 - DNA, 16 bp, Homo sapiens
gaaccactgcttctct

SEQ ID NO: 2358722 - DNA, 21 bp, Homo sapiens
gaaccactgcttctcttttga

SEQ ID NO: 2358723 - DNA, 17 bp, Homo sapiens
gaaccctggggcctgac

SEQ ID NO: 2358724 - DNA, 20 bp, Homo sapiens
gaaccctggggcctgactgc

SEQ ID NO: 2358725 - DNA, 21 bp, Homo sapiens
gaaccgcacagctcaggaggc

SEQ ID NO: 2358726 - DNA, 20 bp, Homo sapiens
gaaccttggaccactcctgt

SEQ ID NO: 2358727 - DNA, 13 bp, Homo sapiens
gaacgtggtttgc

SEQ ID NO: 2358728 - DNA, 13 bp, Homo sapiens
gaacgttttcttc

SEQ ID NO: 2358729 - DNA, 14 bp, Homo sapiens
gaacgttttcttct

SEQ ID NO: 2358730 - DNA, 15 bp, Homo sapiens
gaacgttttcttctt

SEQ ID NO: 2358731 - DNA, 18 bp, Homo sapiens
gaacgttttcttctttcc

SEQ ID NO: 2358732 - DNA, 23 bp, Homo sapiens
gaacgttttcttctttccctgga

SEQ ID NO: 2358733 - DNA, 18 bp, Homo sapiens
gaactagccaaaccagga

SEQ ID NO: 2358734 - DNA, 17 bp, Homo sapiens
gaactccaggccctcct

SEQ ID NO: 2358735 - DNA, 12 bp, Homo sapiens
gaactcctgcca

SEQ ID NO: 2358736 - DNA, 17 bp, Homo sapiens
gaactcgcgctcagtaa

SEQ ID NO: 2358737 - DNA, 13 bp, Homo sapiens
gaactctggcttt

SEQ ID NO: 2358738 - DNA, 18 bp, Homo sapiens
gaactctgggctgccatg

SEQ ID NO: 2358739 - DNA, 19 bp, Homo sapiens
gaactgcaaagctttggct

SEQ ID NO: 2358740 - DNA, 20 bp, Homo sapiens
gaactgtagctgccatggct

SEQ ID NO: 2358741 - DNA, 14 bp, Homo sapiens
gaactgtgccacaa

SEQ ID NO: 2358742 - DNA, 16 bp, Homo sapiens
gaagaaataaatgaaa

SEQ ID NO: 2358743 - DNA, 13 bp, Homo sapiens
gaagaagaaatct

SEQ ID NO: 2358744 - DNA, 19 bp, Homo sapiens
gaagaagtgagcagtgttg

SEQ ID NO: 2358745 - DNA, 13 bp, Homo sapiens
gaagaagtggctg

SEQ ID NO: 2358746 - DNA, 18 bp, Homo sapiens
gaagaatggctttcaata

SEQ ID NO: 2358747 - DNA, 22 bp, Homo sapiens
gaagaattgaaaagtttttgtt

SEQ ID NO: 2358748 - DNA, 13 bp, Homo sapiens
gaagacaagcatt

SEQ ID NO: 2358749 - DNA, 14 bp, Homo sapiens
gaagacaccagagc

SEQ ID NO: 2358750 - DNA, 21 bp, Homo sapiens
gaagacaccagagcagatgca

SEQ ID NO: 2358751 - DNA, 15 bp, Homo sapiens
gaagaccctatctcc

SEQ ID NO: 2358752 - DNA, 17 bp, Homo sapiens
gaagaccctcttgccca

SEQ ID NO: 2358753 - DNA, 15 bp, Homo sapiens
gaagactcctagctg

SEQ ID NO: 2358754 - DNA, 19 bp, Homo sapiens
gaagactttaattatatat

SEQ ID NO: 2358755 - DNA, 17 bp, Homo sapiens
gaagagaggcacctgct

SEQ ID NO: 2358756 - DNA, 12 bp, Homo sapiens
gaagagccacct

SEQ ID NO: 2358757 - DNA, 20 bp, Homo sapiens
gaagagccacctgcaagatg

SEQ ID NO: 2358758 - DNA, 23 bp, Homo sapiens
gaagagccacctgcaagatggac

SEQ ID NO: 2358759 - DNA, 14 bp, Homo sapiens
gaagagcccagtct

SEQ ID NO: 2358760 - DNA, 21 bp, Homo sapiens
gaagagcgcagtgttttgcaa

SEQ ID NO: 2358761 - DNA, 20 bp, Homo sapiens
gaagagttcccttgaaactt

SEQ ID NO: 2358762 - DNA, 21 bp, Homo sapiens
gaagagttcccttgaaacttt

SEQ ID NO: 2358763 - DNA, 15 bp, Homo sapiens
gaagatgaatggtct

SEQ ID NO: 2358764 - DNA, 22 bp, Homo sapiens
gaagatgaatggtctggcaata

SEQ ID NO: 2358765 - DNA, 18 bp, Homo sapiens
gaagattattttttaaaa

SEQ ID NO: 2358766 - DNA, 22 bp, Homo sapiens
gaagcaagaggcaagctgaaat

SEQ ID NO: 2358767 - DNA, 23 bp, Homo sapiens
gaagcaagaggcaagctgaaatt

SEQ ID NO: 2358768 - DNA, 14 bp, Homo sapiens
gaagcaagccagac

SEQ ID NO: 2358769 - DNA, 13 bp, Homo sapiens
gacacagttcctg

SEQ ID NO: 2358770 - DNA, 15 bp, Homo sapiens
gacacagttcctggg

SEQ ID NO: 2358771 - DNA, 20 bp, Homo sapiens
gacacattttttaggaaatg

SEQ ID NO: 2358772 - DNA, 15 bp, Homo sapiens
gacaccagagcagat

SEQ ID NO: 2358773 - DNA, 23 bp, Homo sapiens
gacaccattaccaaaataataaa

SEQ ID NO: 2358774 - DNA, 15 bp, Homo sapiens
gacacccttctccca

SEQ ID NO: 2358775 - DNA, 18 bp, Homo sapiens
gacacgggtggggaaagg

SEQ ID NO: 2358776 - DNA, 15 bp, Homo sapiens
gacactccagggaca

SEQ ID NO: 2358777 - DNA, 14 bp, Homo sapiens
gacagaaggtgcca

SEQ ID NO: 2358778 - DNA, 17 bp, Homo sapiens
gacagaggaaagggctg

SEQ ID NO: 2358779 - DNA, 23 bp, Homo sapiens
gacagaggaaagggctggctccc

SEQ ID NO: 2358780 - DNA, 22 bp, Homo sapiens
gacagaggctgcacccctgggc

SEQ ID NO: 2358781 - DNA, 14 bp, Homo sapiens
gacagcagaagcct

SEQ ID NO: 2358782 - DNA, 16 bp, Homo sapiens
gacagcagaagcctcc

SEQ ID NO: 2358783 - DNA, 17 bp, Homo sapiens
gacagcatcccttccca

SEQ ID NO: 2358784 - DNA, 22 bp, Homo sapiens
gacagcccaggatactggcaca

SEQ ID NO: 2358785 - DNA, 18 bp, Homo sapiens
gacagcctgcagcaggaa

SEQ ID NO: 2358786 - DNA, 13 bp, Homo sapiens
gacagcgggaaaa

SEQ ID NO: 2358787 - DNA, 15 bp, Homo sapiens
gacagcgggaaaaat

SEQ ID NO: 2358788 - DNA, 13 bp, Homo sapiens
gacagctttctgg

SEQ ID NO: 2358789 - DNA, 10 bp, Homo sapiens
gacaggcagc

SEQ ID NO: 2358790 - DNA, 14 bp, Homo sapiens
gacaggcagcccag

SEQ ID NO: 2358791 - DNA, 15 bp, Homo sapiens
gacaggcagcccagc

SEQ ID NO: 2358792 - DNA, 14 bp, Homo sapiens
gacaggcagcctcc

SEQ ID NO: 2358793 - DNA, 17 bp, Homo sapiens
gacaggcagcctccttt

SEQ ID NO: 2358794 - DNA, 14 bp, Homo sapiens
gacagggtgggctt

SEQ ID NO: 2358795 - DNA, 20 bp, Homo sapiens
gacagggtgggcttcctgcc

SEQ ID NO: 2358796 - DNA, 15 bp, Homo sapiens
gacagtatcccacat

SEQ ID NO: 2358797 - DNA, 17 bp, Homo sapiens
gacagtgcctcttccag

SEQ ID NO: 2358798 - DNA, 20 bp, Homo sapiens
gacagtgcctcttccagtga

SEQ ID NO: 2358799 - DNA, 14 bp, Homo sapiens
gacagtttccaaat

SEQ ID NO: 2358800 - DNA, 21 bp, Homo sapiens
gacataacgtttttcctttaa

SEQ ID NO: 2358801 - DNA, 23 bp, Homo sapiens
gacataacgtttttcctttaaaa

SEQ ID NO: 2358802 - DNA, 12 bp, Homo sapiens
gacatgagatgg

SEQ ID NO: 2358803 - DNA, 19 bp, Homo sapiens
gacatgcaataaaatttaa

SEQ ID NO: 2358804 - DNA, 20 bp, Homo sapiens
gacatgcaataaaatttaaa

SEQ ID NO: 2358805 - DNA, 16 bp, Homo sapiens
gacatggtgcctgaga

SEQ ID NO: 2358806 - DNA, 22 bp, Homo sapiens
gacatggtgcctgagaggcagg

SEQ ID NO: 2358807 - DNA, 17 bp, Homo sapiens
gacatgtctgttctaca

SEQ ID NO: 2358808 - DNA, 19 bp, Homo sapiens
gacattaacaaataaaaaa

SEQ ID NO: 2358809 - DNA, 14 bp, Homo sapiens
gaccaacctgctct

SEQ ID NO: 2358810 - DNA, 16 bp, Homo sapiens
gaccaacctgctctgt

SEQ ID NO: 2358811 - DNA, 19 bp, Homo sapiens
gaccaccctcactggctct

SEQ ID NO: 2358812 - DNA, 16 bp, Homo sapiens
gaccactcctgtccct

SEQ ID NO: 2358813 - DNA, 20 bp, Homo sapiens
gaccactcctgtccctgtag

SEQ ID NO: 2358814 - DNA, 11 bp, Homo sapiens
gaccactgtct

SEQ ID NO: 2358815 - DNA, 15 bp, Homo sapiens
gaccagatctttctc

SEQ ID NO: 2358816 - DNA, 16 bp, Homo sapiens
gaccagatctttctct

SEQ ID NO: 2358817 - DNA, 17 bp, Homo sapiens
gaccagatctttctctt

SEQ ID NO: 2358818 - DNA, 23 bp, Homo sapiens
gaccagatctttctcttccctga

SEQ ID NO: 2358819 - DNA, 15 bp, Homo sapiens
gaccagattgctctg

SEQ ID NO: 2358820 - DNA, 16 bp, Homo sapiens
gaccagccagcagcag

SEQ ID NO: 2358821 - DNA, 14 bp, Homo sapiens
gaccatgccagatt

SEQ ID NO: 2358822 - DNA, 22 bp, Homo sapiens
gaccatgccagattctgcctct

SEQ ID NO: 2358823 - DNA, 12 bp, Homo sapiens
gaccatgtggcc

SEQ ID NO: 2358824 - DNA, 15 bp, Homo sapiens
gacccagggaacagc

SEQ ID NO: 2358825 - DNA, 16 bp, Homo sapiens
gacccagggactctcc

SEQ ID NO: 2358826 - DNA, 15 bp, Homo sapiens
gaccccagccatcca

SEQ ID NO: 2358827 - DNA, 15 bp, Homo sapiens
gacccgacctggccg

SEQ ID NO: 2358828 - DNA, 16 bp, Homo sapiens
gacccgacctggccgc

SEQ ID NO: 2358829 - DNA, 20 bp, Homo sapiens
gaccctactgaagtggctgg

SEQ ID NO: 2358830 - DNA, 14 bp, Homo sapiens
gaccctcttgccca

SEQ ID NO: 2358831 - DNA, 11 bp, Homo sapiens
gaccctgaggc

SEQ ID NO: 2358832 - DNA, 13 bp, Homo sapiens
gaccctgaggccc

SEQ ID NO: 2358833 - DNA, 17 bp, Homo sapiens
gaccctgaggccctggg

SEQ ID NO: 2358834 - DNA, 21 bp, Homo sapiens
gaccctgccacagccagagga

SEQ ID NO: 2358835 - DNA, 21 bp, Homo sapiens
gaccctgggtgggctctgtgc

SEQ ID NO: 2358836 - DNA, 22 bp, Homo sapiens
gaccctgtgacatggtgcctga

SEQ ID NO: 2358837 - DNA, 20 bp, Homo sapiens
gaccggcggaccccagccat

SEQ ID NO: 2358838 - DNA, 15 bp, Homo sapiens
gacctagcaggctgt

SEQ ID NO: 2358839 - DNA, 13 bp, Homo sapiens
gacctcaagccat

SEQ ID NO: 2358840 - DNA, 12 bp, Homo sapiens
gacctcatgccc

SEQ ID NO: 2358841 - DNA, 17 bp, Homo sapiens
gacctcatgcccagctc

SEQ ID NO: 2358842 - DNA, 19 bp, Homo sapiens
gacctccaggctccagcac

SEQ ID NO: 2358843 - DNA, 15 bp, Homo sapiens
gacctctgggttggg

SEQ ID NO: 2358844 - DNA, 18 bp, Homo sapiens
gacctgaccccattcctg

SEQ ID NO: 2358845 - DNA, 19 bp, Homo sapiens
gacctgaccccattcctga

SEQ ID NO: 2358846 - DNA, 20 bp, Homo sapiens
gacctgaccccattcctgat

SEQ ID NO: 2358847 - DNA, 16 bp, Homo sapiens
gacctgagacctgaag

SEQ ID NO: 2358848 - DNA, 15 bp, Homo sapiens
gacctgccaggcagg

SEQ ID NO: 2358849 - DNA, 18 bp, Homo sapiens
gacctgctgacctgtgca

SEQ ID NO: 2358850 - DNA, 19 bp, Homo sapiens
gacctgctgacctgtgcac

SEQ ID NO: 2358851 - DNA, 15 bp, Homo sapiens
gacctggccccaggc

SEQ ID NO: 2358852 - DNA, 16 bp, Homo sapiens
gacctggccccaggct

SEQ ID NO: 2358853 - DNA, 13 bp, Homo sapiens
gacctttgacctc

SEQ ID NO: 2358854 - DNA, 18 bp, Homo sapiens
gacctttgggttctttct

SEQ ID NO: 2358855 - DNA, 20 bp, Homo sapiens
gacctttgggttctttctgg

SEQ ID NO: 2358856 - DNA, 16 bp, Homo sapiens
gacgcacgctcgctgc

SEQ ID NO: 2358857 - DNA, 19 bp, Homo sapiens
gacgcacgctcgctgccat

SEQ ID NO: 2358858 - DNA, 20 bp, Homo sapiens
gacgcacgctcgctgccatc

SEQ ID NO: 2358859 - DNA, 22 bp, Homo sapiens
gacgccatgtgatggacactcc

SEQ ID NO: 2358860 - DNA, 18 bp, Homo sapiens
gacgcttgtgacagtgcc

SEQ ID NO: 2358861 - DNA, 12 bp, Homo sapiens
gacggaggggag

SEQ ID NO: 2358862 - DNA, 19 bp, Homo sapiens
gacggtcctttaggcagcc

SEQ ID NO: 2358863 - DNA, 20 bp, Homo sapiens
gacgtcaggccctgactcct

SEQ ID NO: 2358864 - DNA, 10 bp, Homo sapiens
gactaaagag

SEQ ID NO: 2358865 - DNA, 19 bp, Homo sapiens
gactaaaggatccagagag

SEQ ID NO: 2358866 - DNA, 20 bp, Homo sapiens
gactaaaggatccagagagc

SEQ ID NO: 2358867 - DNA, 22 bp, Homo sapiens
gactaaaggcatccttgtcttt

SEQ ID NO: 2358868 - DNA, 16 bp, Homo sapiens
gactagcaggcatgcc

SEQ ID NO: 2358869 - DNA, 16 bp, Homo sapiens
gactattcatggctac

SEQ ID NO: 2358870 - DNA, 19 bp, Homo sapiens
gactattctgtatctttca

SEQ ID NO: 2358871 - DNA, 14 bp, Homo sapiens
gactcctagctgtc

SEQ ID NO: 2358872 - DNA, 13 bp, Homo sapiens
gactcctctggct

SEQ ID NO: 2358873 - DNA, 15 bp, Homo sapiens
gactctgcacatgtc

SEQ ID NO: 2358874 - DNA, 20 bp, Homo sapiens
gactctgcacatgtcttgta

SEQ ID NO: 2358875 - DNA, 19 bp, Homo sapiens
gactctgtctacctggtct

SEQ ID NO: 2358876 - DNA, 12 bp, Homo sapiens
gactcttcctgc

SEQ ID NO: 2358877 - DNA, 13 bp, Homo sapiens
gactcttcctgca

SEQ ID NO: 2358878 - DNA, 20 bp, Homo sapiens
gactctttttttgagtgaca

SEQ ID NO: 2358879 - DNA, 15 bp, Homo sapiens
gactgaaaatattgt

SEQ ID NO: 2358880 - DNA, 15 bp, Homo sapiens
gactgaaagtagggg

SEQ ID NO: 2358881 - DNA, 14 bp, Homo sapiens
gactgactgagcag

SEQ ID NO: 2358882 - DNA, 20 bp, Homo sapiens
gactgcagtgtggagttcac

SEQ ID NO: 2358883 - DNA, 11 bp, Homo sapiens
gactgccaaat

SEQ ID NO: 2358884 - DNA, 14 bp, Homo sapiens
gactgcgttctgca

SEQ ID NO: 2358885 - DNA, 21 bp, Homo sapiens
gagcctcctgtgcctggcccc

SEQ ID NO: 2358886 - DNA, 23 bp, Homo sapiens
gagcctcctgtgcctggccccag

SEQ ID NO: 2358887 - DNA, 16 bp, Homo sapiens
gagcctgccctcactc

SEQ ID NO: 2358888 - DNA, 18 bp, Homo sapiens
gagcctgccctcactccc

SEQ ID NO: 2358889 - DNA, 15 bp, Homo sapiens
gagcctgctggcacc

SEQ ID NO: 2358890 - DNA, 12 bp, Homo sapiens
gagcctggcccc

SEQ ID NO: 2358891 - DNA, 14 bp, Homo sapiens
gagcctggccccag

SEQ ID NO: 2358892 - DNA, 15 bp, Homo sapiens
gagcctggccccagg

SEQ ID NO: 2358893 - DNA, 23 bp, Homo sapiens
gagcctggccccaggccccagac

SEQ ID NO: 2358894 - DNA, 17 bp, Homo sapiens
gagccttctcagaagca

SEQ ID NO: 2358895 - DNA, 21 bp, Homo sapiens
gagcgcacagggagtgcacat

SEQ ID NO: 2358896 - DNA, 19 bp, Homo sapiens
gagcgcagtgttttgcaag

SEQ ID NO: 2358897 - DNA, 12 bp, Homo sapiens
gagcgccacctc

SEQ ID NO: 2358898 - DNA, 14 bp, Homo sapiens
gagcgccaggaagc

SEQ ID NO: 2358899 - DNA, 16 bp, Homo sapiens
gagcgccaggaagcca

SEQ ID NO: 2358900 - DNA, 17 bp, Homo sapiens
gagcgccaggaagccag

SEQ ID NO: 2358901 - DNA, 19 bp, Homo sapiens
gagcgccaggaagccagag

SEQ ID NO: 2358902 - DNA, 21 bp, Homo sapiens
gagcgccaggaagccagagcc

SEQ ID NO: 2358903 - DNA, 18 bp, Homo sapiens
gagcggatgggcacacac

SEQ ID NO: 2358904 - DNA, 15 bp, Homo sapiens
gagctactctcttgc

SEQ ID NO: 2358905 - DNA, 20 bp, Homo sapiens
gagctactctcttgccagca

SEQ ID NO: 2358906 - DNA, 21 bp, Homo sapiens
gagctactctcttgccagcat

SEQ ID NO: 2358907 - DNA, 16 bp, Homo sapiens
gagctattcacctcag

SEQ ID NO: 2358908 - DNA, 15 bp, Homo sapiens
gagctattttcctct

SEQ ID NO: 2358909 - DNA, 17 bp, Homo sapiens
gagctcacatgggactg

SEQ ID NO: 2358910 - DNA, 15 bp, Homo sapiens
gagctcaccatggaa

SEQ ID NO: 2358911 - DNA, 19 bp, Homo sapiens
gagctctgaaatcttccca

SEQ ID NO: 2358912 - DNA, 14 bp, Homo sapiens
gagctgagcagcct

SEQ ID NO: 2358913 - DNA, 19 bp, Homo sapiens
gagctgagcagcctctgga

SEQ ID NO: 2358914 - DNA, 13 bp, Homo sapiens
gagctgccttccc

SEQ ID NO: 2358915 - DNA, 14 bp, Homo sapiens
gagctgccttccct

SEQ ID NO: 2358916 - DNA, 19 bp, Homo sapiens
gagctgccttccctagctt

SEQ ID NO: 2358917 - DNA, 13 bp, Homo sapiens
gagctggagcccc

SEQ ID NO: 2358918 - DNA, 18 bp, Homo sapiens
gagctggagcccccagca

SEQ ID NO: 2358919 - DNA, 22 bp, Homo sapiens
gagctggatagacttgggatgg

SEQ ID NO: 2358920 - DNA, 16 bp, Homo sapiens
gagctggcctctctag

SEQ ID NO: 2358921 - DNA, 18 bp, Homo sapiens
gagctgtaaaaatgttac

SEQ ID NO: 2358922 - DNA, 14 bp, Homo sapiens
gagctgttgtgagc

SEQ ID NO: 2358923 - DNA, 22 bp, Homo sapiens
gagcttaatgctacatgtgagt

SEQ ID NO: 2358924 - DNA, 15 bp, Homo sapiens
gagcttgctccagat

SEQ ID NO: 2358925 - DNA, 18 bp, Homo sapiens
gagcttgctccagattct

SEQ ID NO: 2358926 - DNA, 21 bp, Homo sapiens
gagcttgctccagattctgat

SEQ ID NO: 2358927 - DNA, 22 bp, Homo sapiens
gagcttgggcagtgccccaggg

SEQ ID NO: 2358928 - DNA, 14 bp, Homo sapiens
gagctttctcaatg

SEQ ID NO: 2358929 - DNA, 14 bp, Homo sapiens
gaggaaagggctgg

SEQ ID NO: 2358930 - DNA, 16 bp, Homo sapiens
gaggaagagccacctg

SEQ ID NO: 2358931 - DNA, 17 bp, Homo sapiens
gaggaagagccacctgc

SEQ ID NO: 2358932 - DNA, 23 bp, Homo sapiens
gaggaagagccacctgcaagatg

SEQ ID NO: 2358933 - DNA, 15 bp, Homo sapiens
gaggaaggattgtaa

SEQ ID NO: 2358934 - DNA, 16 bp, Homo sapiens
gaggaaggattgtaaa

SEQ ID NO: 2358935 - DNA, 23 bp, Homo sapiens
gaggaatatgacggaagaacata

SEQ ID NO: 2358936 - DNA, 14 bp, Homo sapiens
gaggaatgcaccac

SEQ ID NO: 2358937 - DNA, 15 bp, Homo sapiens
gaggaccagggccct

SEQ ID NO: 2358938 - DNA, 13 bp, Homo sapiens
gaggacgcacgct

SEQ ID NO: 2358939 - DNA, 22 bp, Homo sapiens
gaggacgcacgctcgctgccat

SEQ ID NO: 2358940 - DNA, 13 bp, Homo sapiens
gaggaggaaggca

SEQ ID NO: 2358941 - DNA, 14 bp, Homo sapiens
gaggagtaaaattc

SEQ ID NO: 2358942 - DNA, 17 bp, Homo sapiens
gaggataaagaaaagac

SEQ ID NO: 2358943 - DNA, 20 bp, Homo sapiens
gaggatagtagttaaataac

SEQ ID NO: 2358944 - DNA, 14 bp, Homo sapiens
gaggatgagagccc

SEQ ID NO: 2358945 - DNA, 15 bp, Homo sapiens
gaggatgagagccca

SEQ ID NO: 2358946 - DNA, 17 bp, Homo sapiens
gaggcactcagtgagcc

SEQ ID NO: 2358947 - DNA, 14 bp, Homo sapiens
gaggcaggctggga

SEQ ID NO: 2358948 - DNA, 16 bp, Homo sapiens
gaggcagggctctccc

SEQ ID NO: 2358949 - DNA, 21 bp, Homo sapiens
gaggcagtgatgacttgctgt

SEQ ID NO: 2358950 - DNA, 14 bp, Homo sapiens
gaggcccagcctgt

SEQ ID NO: 2358951 - DNA, 18 bp, Homo sapiens
gaggcccagcctgtcctg

SEQ ID NO: 2358952 - DNA, 17 bp, Homo sapiens
gaggccctgttccctgg

SEQ ID NO: 2358953 - DNA, 23 bp, Homo sapiens
gaggcccttgtcgtgggatggca

SEQ ID NO: 2358954 - DNA, 14 bp, Homo sapiens
gaggccgaggccat

SEQ ID NO: 2358955 - DNA, 15 bp, Homo sapiens
gaggcctagactctg

SEQ ID NO: 2358956 - DNA, 12 bp, Homo sapiens
gaggcctcaggt

SEQ ID NO: 2358957 - DNA, 20 bp, Homo sapiens
gaggcctcaggtgctgtcca

SEQ ID NO: 2358958 - DNA, 9 bp, Homo sapiens
gaggcctga

SEQ ID NO: 2358959 - DNA, 23 bp, Homo sapiens
gaggcctgaagccagctgcccta

SEQ ID NO: 2358960 - DNA, 15 bp, Homo sapiens
gaggccttgagaggc

SEQ ID NO: 2358961 - DNA, 23 bp, Homo sapiens
gaggctacaggggttagcctgga

SEQ ID NO: 2358962 - DNA, 23 bp, Homo sapiens
gaggctctggacagcagaagcct

SEQ ID NO: 2358963 - DNA, 16 bp, Homo sapiens
gaggctgagggacagg

SEQ ID NO: 2358964 - DNA, 21 bp, Homo sapiens
gaggctgcacccctgggccag

SEQ ID NO: 2358965 - DNA, 15 bp, Homo sapiens
gaggctgcccctctc

SEQ ID NO: 2358966 - DNA, 19 bp, Homo sapiens
gaggctgcccctctcacca

SEQ ID NO: 2358967 - DNA, 20 bp, Homo sapiens
gaggctgggggagagccgtg

SEQ ID NO: 2358968 - DNA, 21 bp, Homo sapiens
gaggctgtaactgagagaaag

SEQ ID NO: 2358969 - DNA, 14 bp, Homo sapiens
gaggctgtgctccg

SEQ ID NO: 2358970 - DNA, 15 bp, Homo sapiens
gaggcttctccgcca

SEQ ID NO: 2358971 - DNA, 21 bp, Homo sapiens
gaggcttctccgccagcctcc

SEQ ID NO: 2358972 - DNA, 22 bp, Homo sapiens
gaggcttctccgccagcctcct

SEQ ID NO: 2358973 - DNA, 23 bp, Homo sapiens
gaggcttctccgccagcctcctc

SEQ ID NO: 2358974 - DNA, 14 bp, Homo sapiens
gaggcttgaaggcc

SEQ ID NO: 2358975 - DNA, 15 bp, Homo sapiens
gaggcttgaaggcca

SEQ ID NO: 2358976 - DNA, 19 bp, Homo sapiens
gagggaagggtttctctat

SEQ ID NO: 2358977 - DNA, 22 bp, Homo sapiens
gagggagaatccaagggttgag

SEQ ID NO: 2358978 - DNA, 16 bp, Homo sapiens
gagggagagagagaga

SEQ ID NO: 2358979 - DNA, 16 bp, Homo sapiens
gagggagttttgtctg

SEQ ID NO: 2358980 - DNA, 21 bp, Homo sapiens
gagggatttccctgcagacct

SEQ ID NO: 2358981 - DNA, 16 bp, Homo sapiens
gagggcagtaccctcc

SEQ ID NO: 2358982 - DNA, 12 bp, Homo sapiens
gagggctgcagt

SEQ ID NO: 2358983 - DNA, 12 bp, Homo sapiens
gaggggagaagc

SEQ ID NO: 2358984 - DNA, 11 bp, Homo sapiens
gaggggagagg

SEQ ID NO: 2358985 - DNA, 17 bp, Homo sapiens
gaggggcccccctgccc

SEQ ID NO: 2358986 - DNA, 21 bp, Homo sapiens
gagggggcttgaagccaaaga

SEQ ID NO: 2358987 - DNA, 14 bp, Homo sapiens
gagggggtggaggg

SEQ ID NO: 2358988 - DNA, 18 bp, Homo sapiens
gaggggtgtggcagtggt

SEQ ID NO: 2358989 - DNA, 14 bp, Homo sapiens
gagggtgggggagg

SEQ ID NO: 2358990 - DNA, 15 bp, Homo sapiens
gagggtgggggaggg

SEQ ID NO: 2358991 - DNA, 15 bp, Homo sapiens
gaggtaacagaacag

SEQ ID NO: 2358992 - DNA, 16 bp, Homo sapiens
gaggtaacagaacagc

SEQ ID NO: 2358993 - DNA, 17 bp, Homo sapiens
gaggtaacagaacagct

SEQ ID NO: 2358994 - DNA, 14 bp, Homo sapiens
gaggtagcgagctg

SEQ ID NO: 2358995 - DNA, 19 bp, Homo sapiens
gaggtagcgagctgctctg

SEQ ID NO: 2358996 - DNA, 15 bp, Homo sapiens
gaggtcactggaaag

SEQ ID NO: 2358997 - DNA, 17 bp, Homo sapiens
gaggtcactggaaaggg

SEQ ID NO: 2358998 - DNA, 18 bp, Homo sapiens
gaggtcaggacggctcct

SEQ ID NO: 2358999 - DNA, 21 bp, Homo sapiens
gaggtcaggacggctcctcag

SEQ ID NO: 2359000 - DNA, 12 bp, Homo sapiens
gatcttaaaata

SEQ ID NO: 2359001 - DNA, 13 bp, Homo sapiens
gatctttctcttc

SEQ ID NO: 2359002 - DNA, 18 bp, Homo sapiens
gatctttctcttccctga

SEQ ID NO: 2359003 - DNA, 20 bp, Homo sapiens
gatgaaccagccggggcctt

SEQ ID NO: 2359004 - DNA, 18 bp, Homo sapiens
gatgaattgcattatttt

SEQ ID NO: 2359005 - DNA, 18 bp, Homo sapiens
gatgacagtgacacccag

SEQ ID NO: 2359006 - DNA, 13 bp, Homo sapiens
gatgactgccttg

SEQ ID NO: 2359007 - DNA, 22 bp, Homo sapiens
gatgactgccttgcctcctcag

SEQ ID NO: 2359008 - DNA, 15 bp, Homo sapiens
gatgagagcccagag

SEQ ID NO: 2359009 - DNA, 12 bp, Homo sapiens
gatgagcccacc

SEQ ID NO: 2359010 - DNA, 15 bp, Homo sapiens
gatgagcccaccctg

SEQ ID NO: 2359011 - DNA, 22 bp, Homo sapiens
gatgaggagtaaaattcagttt

SEQ ID NO: 2359012 - DNA, 19 bp, Homo sapiens
gatgaggtcagttgtgttt

SEQ ID NO: 2359013 - DNA, 19 bp, Homo sapiens
gatgattgacaacacccat

SEQ ID NO: 2359014 - DNA, 19 bp, Homo sapiens
gatgatttcagttctagga

SEQ ID NO: 2359015 - DNA, 22 bp, Homo sapiens
gatgatttcagttctaggaaaa

SEQ ID NO: 2359016 - DNA, 23 bp, Homo sapiens
gatgatttcagttctaggaaaat

SEQ ID NO: 2359017 - DNA, 23 bp, Homo sapiens
gatgcagagagccattttgtgaa

SEQ ID NO: 2359018 - DNA, 17 bp, Homo sapiens
gatgccaatttcctctc

SEQ ID NO: 2359019 - DNA, 12 bp, Homo sapiens
gatgccacccta

SEQ ID NO: 2359020 - DNA, 16 bp, Homo sapiens
gatgccaccctagcca

SEQ ID NO: 2359021 - DNA, 17 bp, Homo sapiens
gatgcccacatactgtc

SEQ ID NO: 2359022 - DNA, 17 bp, Homo sapiens
gatgctgggcaatgagg

SEQ ID NO: 2359023 - DNA, 16 bp, Homo sapiens
gatgctgttgtgaagc

SEQ ID NO: 2359024 - DNA, 16 bp, Homo sapiens
gatgcttctctccttg

SEQ ID NO: 2359025 - DNA, 17 bp, Homo sapiens
gatggaaaaggaagact

SEQ ID NO: 2359026 - DNA, 14 bp, Homo sapiens
gatggaatggaaaa

SEQ ID NO: 2359027 - DNA, 19 bp, Homo sapiens
gatggacacgagccacaag

SEQ ID NO: 2359028 - DNA, 18 bp, Homo sapiens
gatggaccaacctgctct

SEQ ID NO: 2359029 - DNA, 13 bp, Homo sapiens
gatggagaggctg

SEQ ID NO: 2359030 - DNA, 19 bp, Homo sapiens
gatggagttcttgtgccat

SEQ ID NO: 2359031 - DNA, 24 bp, Homo sapiens
gatggcatttggtctcaggcagca

SEQ ID NO: 2359032 - DNA, 14 bp, Homo sapiens
gatggccagcccct

SEQ ID NO: 2359033 - DNA, 22 bp, Homo sapiens
gatggccagcccctggggccca

SEQ ID NO: 2359034 - DNA, 16 bp, Homo sapiens
gatggcctttccttcc

SEQ ID NO: 2359035 - DNA, 21 bp, Homo sapiens
gatggcctttccttccctctc

SEQ ID NO: 2359036 - DNA, 17 bp, Homo sapiens
gatgggaacagtaaaga

SEQ ID NO: 2359037 - DNA, 23 bp, Homo sapiens
gatggggcaggccacctggctct

SEQ ID NO: 2359038 - DNA, 18 bp, Homo sapiens
gatggtaagagaaaagag

SEQ ID NO: 2359039 - DNA, 22 bp, Homo sapiens
gatggtaagagaaaagagagaa

SEQ ID NO: 2359040 - DNA, 18 bp, Homo sapiens
gatggtcggatctcacag

SEQ ID NO: 2359041 - DNA, 16 bp, Homo sapiens
gatggtgtggcctgtg

SEQ ID NO: 2359042 - DNA, 22 bp, Homo sapiens
gatgtacatagttatttttctc

SEQ ID NO: 2359043 - DNA, 13 bp, Homo sapiens
gatgtagaaagtt

SEQ ID NO: 2359044 - DNA, 20 bp, Homo sapiens
gatgtcacagtccaaccaga

SEQ ID NO: 2359045 - DNA, 14 bp, Homo sapiens
gatgtcagccttgc

SEQ ID NO: 2359046 - DNA, 18 bp, Homo sapiens
gatgtcccagtgctcacc

SEQ ID NO: 2359047 - DNA, 12 bp, Homo sapiens
gatgtcttccct

SEQ ID NO: 2359048 - DNA, 17 bp, Homo sapiens
gatgtcttccctgggct

SEQ ID NO: 2359049 - DNA, 19 bp, Homo sapiens
gatgtctttttattaaaat

SEQ ID NO: 2359050 - DNA, 22 bp, Homo sapiens
gatgtgaattattgacactgaa

SEQ ID NO: 2359051 - DNA, 21 bp, Homo sapiens
gatgtgagccaccgtgcctgg

SEQ ID NO: 2359052 - DNA, 13 bp, Homo sapiens
gatgtggaggaag

SEQ ID NO: 2359053 - DNA, 23 bp, Homo sapiens
gatgtggaggaagagccacctgc

SEQ ID NO: 2359054 - DNA, 15 bp, Homo sapiens
gatgttatgaacagc

SEQ ID NO: 2359055 - DNA, 23 bp, Homo sapiens
gatgttatgaacagctgtgtctg

SEQ ID NO: 2359056 - DNA, 23 bp, Homo sapiens
gatgtttggaaaaaactctgaag

SEQ ID NO: 2359057 - DNA, 20 bp, Homo sapiens
gattaaattatcattgtttg

SEQ ID NO: 2359058 - DNA, 20 bp, Homo sapiens
gattaataaaatatctattt

SEQ ID NO: 2359059 - DNA, 21 bp, Homo sapiens
gattaataagatttttcaaaa

SEQ ID NO: 2359060 - DNA, 14 bp, Homo sapiens
gattacctgaaagc

SEQ ID NO: 2359061 - DNA, 14 bp, Homo sapiens
gattatatgaagtt

SEQ ID NO: 2359062 - DNA, 18 bp, Homo sapiens
gattatcttcagcccagg

SEQ ID NO: 2359063 - DNA, 21 bp, Homo sapiens
gattatcttcagcccaggctt

SEQ ID NO: 2359064 - DNA, 12 bp, Homo sapiens
gattatttaata

SEQ ID NO: 2359065 - DNA, 16 bp, Homo sapiens
gattatttaataacat

SEQ ID NO: 2359066 - DNA, 22 bp, Homo sapiens
gattatttaataacattacctt

SEQ ID NO: 2359067 - DNA, 23 bp, Homo sapiens
gattatttaataacattacctta

SEQ ID NO: 2359068 - DNA, 19 bp, Homo sapiens
gattcaatctgtaaactgt

SEQ ID NO: 2359069 - DNA, 22 bp, Homo sapiens
gattcagggaaagtgggacagc

SEQ ID NO: 2359070 - DNA, 18 bp, Homo sapiens
gattcatgtagagagaca

SEQ ID NO: 2359071 - DNA, 17 bp, Homo sapiens
gattccactacacctgg

SEQ ID NO: 2359072 - DNA, 15 bp, Homo sapiens
gattcccctgtgtca

SEQ ID NO: 2359073 - DNA, 13 bp, Homo sapiens
gattcccttctgg

SEQ ID NO: 2359074 - DNA, 18 bp, Homo sapiens
gattcccttctgggcttc

SEQ ID NO: 2359075 - DNA, 13 bp, Homo sapiens
gattctaaagctc

SEQ ID NO: 2359076 - DNA, 16 bp, Homo sapiens
gattctcccaaagtac

SEQ ID NO: 2359077 - DNA, 12 bp, Homo sapiens
gattctgaatct

SEQ ID NO: 2359078 - DNA, 16 bp, Homo sapiens
gattctgcctctctgg

SEQ ID NO: 2359079 - DNA, 20 bp, Homo sapiens
gattctggctttaagccttc

SEQ ID NO: 2359080 - DNA, 15 bp, Homo sapiens
gattctggggctgtg

SEQ ID NO: 2359081 - DNA, 16 bp, Homo sapiens
gattcttgattcctgg

SEQ ID NO: 2359082 - DNA, 20 bp, Homo sapiens
gattctttcagttctttgga

SEQ ID NO: 2359083 - DNA, 21 bp, Homo sapiens
gattgaagtattttgctggaa

SEQ ID NO: 2359084 - DNA, 21 bp, Homo sapiens
gattgctttgcattactgtcc

SEQ ID NO: 2359085 - DNA, 13 bp, Homo sapiens
gattggattattt

SEQ ID NO: 2359086 - DNA, 22 bp, Homo sapiens
gattggattatttaataacatt

SEQ ID NO: 2359087 - DNA, 13 bp, Homo sapiens
gattgtaaaaaaa

SEQ ID NO: 2359088 - DNA, 20 bp, Homo sapiens
gattgtgtgactattcatgg

SEQ ID NO: 2359089 - DNA, 19 bp, Homo sapiens
gatttaaaggcagacagtt

SEQ ID NO: 2359090 - DNA, 15 bp, Homo sapiens
gatttaataaaataa

SEQ ID NO: 2359091 - DNA, 19 bp, Homo sapiens
gatttaataaaataattct

SEQ ID NO: 2359092 - DNA, 19 bp, Homo sapiens
gatttcagttctaggaaaa

SEQ ID NO: 2359093 - DNA, 11 bp, Homo sapiens
gatttccctgc

SEQ ID NO: 2359094 - DNA, 15 bp, Homo sapiens
gatttccctgcagac

SEQ ID NO: 2359095 - DNA, 18 bp, Homo sapiens
gatttccctgcagacctc

SEQ ID NO: 2359096 - DNA, 15 bp, Homo sapiens
gatttctaattgtaa

SEQ ID NO: 2359097 - DNA, 15 bp, Homo sapiens
gatttctcattgact

SEQ ID NO: 2359098 - DNA, 21 bp, Homo sapiens
gatttgaaaaatataaaatta

SEQ ID NO: 2359099 - DNA, 20 bp, Homo sapiens
gatttgcaggattcccttct

SEQ ID NO: 2359100 - DNA, 16 bp, Homo sapiens
gatttgtaaaacagtg

SEQ ID NO: 2359101 - DNA, 19 bp, Homo sapiens
gatttgtaacccactgaga

SEQ ID NO: 2359102 - DNA, 23 bp, Homo sapiens
gatttgtgaaacagttgctgtga

SEQ ID NO: 2359103 - DNA, 16 bp, Homo sapiens
gattttaatacattga

SEQ ID NO: 2359104 - DNA, 21 bp, Homo sapiens
gattttatgtttaaaatggca

SEQ ID NO: 2359105 - DNA, 18 bp, Homo sapiens
gattttattcttatttca

SEQ ID NO: 2359106 - DNA, 16 bp, Homo sapiens
gattttcatttcatga

SEQ ID NO: 2359107 - DNA, 18 bp, Homo sapiens
gattttccattaactatt

SEQ ID NO: 2359108 - DNA, 23 bp, Homo sapiens
gattttctattatggaaaactgt

SEQ ID NO: 2359109 - DNA, 13 bp, Homo sapiens
gattttttccctt

SEQ ID NO: 2359110 - DNA, 18 bp, Homo sapiens
gcaaaaaattctttagag

SEQ ID NO: 2359111 - DNA, 23 bp, Homo sapiens
gcaaaagagggtttattttcagt

SEQ ID NO: 2359112 - DNA, 11 bp, Homo sapiens
gcaaaaggaaa

SEQ ID NO: 2359113 - DNA, 20 bp, Homo sapiens
gcaaacccagaggtggatgt

SEQ ID NO: 2359114 - DNA, 18 bp, Homo sapiens
gcagcctctggacagcca

SEQ ID NO: 2359115 - DNA, 22 bp, Homo sapiens
gcagcctctggacagccagtga

SEQ ID NO: 2359116 - DNA, 16 bp, Homo sapiens
gcagctccctttctca

SEQ ID NO: 2359117 - DNA, 22 bp, Homo sapiens
gcagctccctttctcaggagct

SEQ ID NO: 2359118 - DNA, 23 bp, Homo sapiens
gcagcttataatgggctctccgg

SEQ ID NO: 2359119 - DNA, 16 bp, Homo sapiens
gcaggaacaaacaggg

SEQ ID NO: 2359120 - DNA, 14 bp, Homo sapiens
gcaggaagggaagc

SEQ ID NO: 2359121 - DNA, 19 bp, Homo sapiens
gcaggaatatatgtgtgcc

SEQ ID NO: 2359122 - DNA, 14 bp, Homo sapiens
gcaggatggccttt

SEQ ID NO: 2359123 - DNA, 17 bp, Homo sapiens
gcaggatggcctttcct

SEQ ID NO: 2359124 - DNA, 22 bp, Homo sapiens
gcaggatggcctttccttccct

SEQ ID NO: 2359125 - DNA, 20 bp, Homo sapiens
gcaggcacgggtggtccccg

SEQ ID NO: 2359126 - DNA, 13 bp, Homo sapiens
gcaggcagagctg

SEQ ID NO: 2359127 - DNA, 22 bp, Homo sapiens
gcaggccacctggctctcacct

SEQ ID NO: 2359128 - DNA, 15 bp, Homo sapiens
gcaggctcactgcca

SEQ ID NO: 2359129 - DNA, 19 bp, Homo sapiens
gcaggctcactgccaggcc

SEQ ID NO: 2359130 - DNA, 21 bp, Homo sapiens
gcaggctcactgccaggccag

SEQ ID NO: 2359131 - DNA, 17 bp, Homo sapiens
gcaggctggcctatgtg

SEQ ID NO: 2359132 - DNA, 13 bp, Homo sapiens
gcaggctgggcca

SEQ ID NO: 2359133 - DNA, 23 bp, Homo sapiens
gcaggctgggccatgtccaaaga

SEQ ID NO: 2359134 - DNA, 21 bp, Homo sapiens
gcaggctgtggggtggagcac

SEQ ID NO: 2359135 - DNA, 12 bp, Homo sapiens
gcaggctgttcc

SEQ ID NO: 2359136 - DNA, 13 bp, Homo sapiens
gcaggcttgggga

SEQ ID NO: 2359137 - DNA, 21 bp, Homo sapiens
gcaggcttggggaaaatggcc

SEQ ID NO: 2359138 - DNA, 15 bp, Homo sapiens
gcagggaattcctgg

SEQ ID NO: 2359139 - DNA, 18 bp, Homo sapiens
gcagggagcaactctcca

SEQ ID NO: 2359140 - DNA, 21 bp, Homo sapiens
gcagggccatgcagacctcat

SEQ ID NO: 2359141 - DNA, 16 bp, Homo sapiens
gcagggctctcccgtg

SEQ ID NO: 2359142 - DNA, 17 bp, Homo sapiens
gcaggggtgggggtgga

SEQ ID NO: 2359143 - DNA, 21 bp, Homo sapiens
gcaggggtgggggtggaggct

SEQ ID NO: 2359144 - DNA, 14 bp, Homo sapiens
gcagggtctgggct

SEQ ID NO: 2359145 - DNA, 15 bp, Homo sapiens
gcagggtctgggctg

SEQ ID NO: 2359146 - DNA, 13 bp, Homo sapiens
gcagggtcttgct

SEQ ID NO: 2359147 - DNA, 14 bp, Homo sapiens
gcagggtttctttt

SEQ ID NO: 2359148 - DNA, 21 bp, Homo sapiens
gcaggtgattggaccaggcca

SEQ ID NO: 2359149 - DNA, 17 bp, Homo sapiens
gcaggtgggctggactt

SEQ ID NO: 2359150 - DNA, 23 bp, Homo sapiens
gcagtaccctccattgggcacag

SEQ ID NO: 2359151 - DNA, 19 bp, Homo sapiens
gcagtcagagtccagtgct

SEQ ID NO: 2359152 - DNA, 18 bp, Homo sapiens
gcagtcctggaagccagc

SEQ ID NO: 2359153 - DNA, 15 bp, Homo sapiens
gcagtgccccaggga

SEQ ID NO: 2359154 - DNA, 14 bp, Homo sapiens
gcagtgtctccacc

SEQ ID NO: 2359155 - DNA, 20 bp, Homo sapiens
gcagtgtgaatagcctggcc

SEQ ID NO: 2359156 - DNA, 15 bp, Homo sapiens
gcagtttaacaaaat

SEQ ID NO: 2359157 - DNA, 21 bp, Homo sapiens
gcataaagctcaaatgaaatg

SEQ ID NO: 2359158 - DNA, 14 bp, Homo sapiens
gcataaatatgcag

SEQ ID NO: 2359159 - DNA, 15 bp, Homo sapiens
gcataatgataaaat

SEQ ID NO: 2359160 - DNA, 16 bp, Homo sapiens
gcataatttaaaaata

SEQ ID NO: 2359161 - DNA, 14 bp, Homo sapiens
gcatactttgtatt

SEQ ID NO: 2359162 - DNA, 23 bp, Homo sapiens
gcatagataatattgtttggtaa

SEQ ID NO: 2359163 - DNA, 20 bp, Homo sapiens
gcatagcagtatatgttaat

SEQ ID NO: 2359164 - DNA, 20 bp, Homo sapiens
gcataggtctctttgctttc

SEQ ID NO: 2359165 - DNA, 18 bp, Homo sapiens
gcatagttgtagacaaag

SEQ ID NO: 2359166 - DNA, 21 bp, Homo sapiens
gcatagttgtagacaaagtac

SEQ ID NO: 2359167 - DNA, 13 bp, Homo sapiens
gcatagtttcttt

SEQ ID NO: 2359168 - DNA, 16 bp, Homo sapiens
gcatatcctgagccat

SEQ ID NO: 2359169 - DNA, 16 bp, Homo sapiens
gcatattataaaggat

SEQ ID NO: 2359170 - DNA, 19 bp, Homo sapiens
gcatatttgcaaagtgtat

SEQ ID NO: 2359171 - DNA, 15 bp, Homo sapiens
gcatcagttctacgg

SEQ ID NO: 2359172 - DNA, 16 bp, Homo sapiens
gcatcccccctgctca

SEQ ID NO: 2359173 - DNA, 14 bp, Homo sapiens
gcatcccttcccac

SEQ ID NO: 2359174 - DNA, 17 bp, Homo sapiens
gcatcccttcccacatg

SEQ ID NO: 2359175 - DNA, 22 bp, Homo sapiens
gcatcccttcccacatgcctgc

SEQ ID NO: 2359176 - DNA, 22 bp, Homo sapiens
gcatccctttttcataaattat

SEQ ID NO: 2359177 - DNA, 13 bp, Homo sapiens
gcatccttgtctt

SEQ ID NO: 2359178 - DNA, 14 bp, Homo sapiens
gcatccttgtcttt

SEQ ID NO: 2359179 - DNA, 18 bp, Homo sapiens
gcatccttgtcttttgag

SEQ ID NO: 2359180 - DNA, 14 bp, Homo sapiens
gcatgaaataaaat

SEQ ID NO: 2359181 - DNA, 18 bp, Homo sapiens
gcatgaaataaaatatat

SEQ ID NO: 2359182 - DNA, 17 bp, Homo sapiens
gcatgcagctttgcaaa

SEQ ID NO: 2359183 - DNA, 22 bp, Homo sapiens
gcatgctgaatgccccctgctt

SEQ ID NO: 2359184 - DNA, 14 bp, Homo sapiens
gcatgcttcctttc

SEQ ID NO: 2359185 - DNA, 22 bp, Homo sapiens
gcatgcttcctttctctcctgg

SEQ ID NO: 2359186 - DNA, 22 bp, Homo sapiens
gcatggacatttagaagaaaga

SEQ ID NO: 2359187 - DNA, 20 bp, Homo sapiens
gcatgtagaggcttgtttac

SEQ ID NO: 2359188 - DNA, 15 bp, Homo sapiens
gcatgtatgaatgta

SEQ ID NO: 2359189 - DNA, 19 bp, Homo sapiens
gcatgtcctgtaaaggtta

SEQ ID NO: 2359190 - DNA, 16 bp, Homo sapiens
gcatgtggcctttatc

SEQ ID NO: 2359191 - DNA, 23 bp, Homo sapiens
gcatgtgggggaggagggagaga

SEQ ID NO: 2359192 - DNA, 12 bp, Homo sapiens
gcatgtgtattt

SEQ ID NO: 2359193 - DNA, 21 bp, Homo sapiens
gcatgtgtatttccagtgcaa

SEQ ID NO: 2359194 - DNA, 20 bp, Homo sapiens
gcatgttcacccttatagtc

SEQ ID NO: 2359195 - DNA, 23 bp, Homo sapiens
gcatgttcctccttttcttcacc

SEQ ID NO: 2359196 - DNA, 16 bp, Homo sapiens
gcattattttatatat

SEQ ID NO: 2359197 - DNA, 15 bp, Homo sapiens
gcattcatttttata

SEQ ID NO: 2359198 - DNA, 18 bp, Homo sapiens
gcattcatttttatagca

SEQ ID NO: 2359199 - DNA, 22 bp, Homo sapiens
gcattccagctgtcactctgtg

SEQ ID NO: 2359200 - DNA, 22 bp, Homo sapiens
gcattccctacagcctagggca

SEQ ID NO: 2359201 - DNA, 19 bp, Homo sapiens
gcattctggacctctgggt

SEQ ID NO: 2359202 - DNA, 22 bp, Homo sapiens
gcattgccacggaaacatacag

SEQ ID NO: 2359203 - DNA, 18 bp, Homo sapiens
gcatttaaaacagacact

SEQ ID NO: 2359204 - DNA, 20 bp, Homo sapiens
gcatttaataaagatgagtt

SEQ ID NO: 2359205 - DNA, 16 bp, Homo sapiens
gcatttggtctcaggc

SEQ ID NO: 2359206 - DNA, 18 bp, Homo sapiens
gcattttcctcctctgcc

SEQ ID NO: 2359207 - DNA, 18 bp, Homo sapiens
gccaaaagtccctccctg

SEQ ID NO: 2359208 - DNA, 17 bp, Homo sapiens
gccaaaatatttggaat

SEQ ID NO: 2359209 - DNA, 17 bp, Homo sapiens
gccaaagtacagaattt

SEQ ID NO: 2359210 - DNA, 15 bp, Homo sapiens
gccaagattttcctc

SEQ ID NO: 2359211 - DNA, 23 bp, Homo sapiens
gccaagattttcctcttgtgatt

SEQ ID NO: 2359212 - DNA, 12 bp, Homo sapiens
gccaagcctatc

SEQ ID NO: 2359213 - DNA, 16 bp, Homo sapiens
gccaagctttaaatta

SEQ ID NO: 2359214 - DNA, 15 bp, Homo sapiens
gccaaggacctgaga

SEQ ID NO: 2359215 - DNA, 22 bp, Homo sapiens
gccaagggaaaggggtgctttt

SEQ ID NO: 2359216 - DNA, 13 bp, Homo sapiens
gccaagtggggtg

SEQ ID NO: 2359217 - DNA, 18 bp, Homo sapiens
gccaagtggggtgctggg

SEQ ID NO: 2359218 - DNA, 20 bp, Homo sapiens
gccaagtggggtgctgggag

SEQ ID NO: 2359219 - DNA, 13 bp, Homo sapiens
gccaatttcctct

SEQ ID NO: 2359220 - DNA, 16 bp, Homo sapiens
gccaatttcctctcca

SEQ ID NO: 2359221 - DNA, 13 bp, Homo sapiens
gccacaagctgca

SEQ ID NO: 2359222 - DNA, 15 bp, Homo sapiens
gccacaagctgcact

SEQ ID NO: 2359223 - DNA, 19 bp, Homo sapiens
gccacaagctgcactgtga

SEQ ID NO: 2359224 - DNA, 20 bp, Homo sapiens
gccacaatgcagttctgagc

SEQ ID NO: 2359225 - DNA, 14 bp, Homo sapiens
gccacacccagggg

SEQ ID NO: 2359226 - DNA, 18 bp, Homo sapiens
gccacactctccatcacc

SEQ ID NO: 2359227 - DNA, 12 bp, Homo sapiens
gccacactgatg

SEQ ID NO: 2359228 - DNA, 20 bp, Homo sapiens
gcccagcctgtcctggtaca

SEQ ID NO: 2359229 - DNA, 15 bp, Homo sapiens
gcccaggatactggc

SEQ ID NO: 2359230 - DNA, 17 bp, Homo sapiens
gcccaggatactggcac

SEQ ID NO: 2359231 - DNA, 19 bp, Homo sapiens
gcccaggctggagtgcagt

SEQ ID NO: 2359232 - DNA, 18 bp, Homo sapiens
gcccagggcatcttgctg

SEQ ID NO: 2359233 - DNA, 15 bp, Homo sapiens
gcccatcctgactga

SEQ ID NO: 2359234 - DNA, 13 bp, Homo sapiens
gcccatggagatt

SEQ ID NO: 2359235 - DNA, 13 bp, Homo sapiens
gcccattgtcctc

SEQ ID NO: 2359236 - DNA, 15 bp, Homo sapiens
gcccattgtcctcct

SEQ ID NO: 2359237 - DNA, 21 bp, Homo sapiens
gcccattgtcctccttttcac

SEQ ID NO: 2359238 - DNA, 21 bp, Homo sapiens
gccccaatgtatgtgtggctg

SEQ ID NO: 2359239 - DNA, 16 bp, Homo sapiens
gccccactttgaaggg

SEQ ID NO: 2359240 - DNA, 15 bp, Homo sapiens
gccccagagtggccc

SEQ ID NO: 2359241 - DNA, 17 bp, Homo sapiens
gccccagagtggcccac

SEQ ID NO: 2359242 - DNA, 17 bp, Homo sapiens
gccccagcactcacacc

SEQ ID NO: 2359243 - DNA, 12 bp, Homo sapiens
gccccagcccag

SEQ ID NO: 2359244 - DNA, 14 bp, Homo sapiens
gccccagcccagat

SEQ ID NO: 2359245 - DNA, 19 bp, Homo sapiens
gccccagcccagccccact

SEQ ID NO: 2359246 - DNA, 22 bp, Homo sapiens
gccccagcccagccccactcct

SEQ ID NO: 2359247 - DNA, 14 bp, Homo sapiens
gccccagccctgct

SEQ ID NO: 2359248 - DNA, 18 bp, Homo sapiens
gccccagccctgctgggg

SEQ ID NO: 2359249 - DNA, 14 bp, Homo sapiens
gccccagcctgggc

SEQ ID NO: 2359250 - DNA, 19 bp, Homo sapiens
gccccaggccccagacagg

SEQ ID NO: 2359251 - DNA, 16 bp, Homo sapiens
gccccagtgctggaag

SEQ ID NO: 2359252 - DNA, 19 bp, Homo sapiens
gccccagtgctggaaggga

SEQ ID NO: 2359253 - DNA, 20 bp, Homo sapiens
gccccatcagaacctgagct

SEQ ID NO: 2359254 - DNA, 19 bp, Homo sapiens
gcccccaacctcagggctc

SEQ ID NO: 2359255 - DNA, 23 bp, Homo sapiens
gcccccaacctcagggctcccag

SEQ ID NO: 2359256 - DNA, 21 bp, Homo sapiens
gcccccaccccggggaccctg

SEQ ID NO: 2359257 - DNA, 11 bp, Homo sapiens
gcccccaccct

SEQ ID NO: 2359258 - DNA, 22 bp, Homo sapiens
gcccccaccctgttcctgctgc

SEQ ID NO: 2359259 - DNA, 20 bp, Homo sapiens
gcccccagccccggggtgag

SEQ ID NO: 2359260 - DNA, 21 bp, Homo sapiens
gcccccagccccggggtgagt

SEQ ID NO: 2359261 - DNA, 15 bp, Homo sapiens
gcccccagtccccac

SEQ ID NO: 2359262 - DNA, 23 bp, Homo sapiens
gccccccccttgaatctgcaggg

SEQ ID NO: 2359263 - DNA, 14 bp, Homo sapiens
gccccccgccctca

SEQ ID NO: 2359264 - DNA, 15 bp, Homo sapiens
gcccccgccccagag

SEQ ID NO: 2359265 - DNA, 22 bp, Homo sapiens
gcccccgccccagagtggccca

SEQ ID NO: 2359266 - DNA, 19 bp, Homo sapiens
gccccctccccccagactc

SEQ ID NO: 2359267 - DNA, 21 bp, Homo sapiens
gccccctcctgaaccgcacag

SEQ ID NO: 2359268 - DNA, 22 bp, Homo sapiens
gccccgcctgagtcagtgctct

SEQ ID NO: 2359269 - DNA, 22 bp, Homo sapiens
gccccggcaagccacaggaagg

SEQ ID NO: 2359270 - DNA, 19 bp, Homo sapiens
gccccggggtgagtccatt

SEQ ID NO: 2359271 - DNA, 18 bp, Homo sapiens
gccccgttgtgagctgga

SEQ ID NO: 2359272 - DNA, 18 bp, Homo sapiens
gcccctaccctggacttg

SEQ ID NO: 2359273 - DNA, 21 bp, Homo sapiens
gcccctatagcactgagctca

SEQ ID NO: 2359274 - DNA, 14 bp, Homo sapiens
gcccctctcaccaa

SEQ ID NO: 2359275 - DNA, 20 bp, Homo sapiens
gcccctctcccttgggctct

SEQ ID NO: 2359276 - DNA, 14 bp, Homo sapiens
gcccctcttcccca

SEQ ID NO: 2359277 - DNA, 23 bp, Homo sapiens
gcccctgacccagggactctcca

SEQ ID NO: 2359278 - DNA, 17 bp, Homo sapiens
gcccctggacctgggaa

SEQ ID NO: 2359279 - DNA, 15 bp, Homo sapiens
gccccttcactcatt

SEQ ID NO: 2359280 - DNA, 21 bp, Homo sapiens
gcccgaaactaagccaggcct

SEQ ID NO: 2359281 - DNA, 22 bp, Homo sapiens
gcccgaaactaagccaggcctg

SEQ ID NO: 2359282 - DNA, 13 bp, Homo sapiens
gcccgcagagccc

SEQ ID NO: 2359283 - DNA, 13 bp, Homo sapiens
gcccgcagggcca

SEQ ID NO: 2359284 - DNA, 22 bp, Homo sapiens
gcccgcagggccatgcagacct

SEQ ID NO: 2359285 - DNA, 16 bp, Homo sapiens
gcccggggtggccaca

SEQ ID NO: 2359286 - DNA, 16 bp, Homo sapiens
gccctactccctgcag

SEQ ID NO: 2359287 - DNA, 22 bp, Homo sapiens
gccctactccctgcagatgcca

SEQ ID NO: 2359288 - DNA, 13 bp, Homo sapiens
gccctatgggcct

SEQ ID NO: 2359289 - DNA, 21 bp, Homo sapiens
gccctatgggcctgccgggct

SEQ ID NO: 2359290 - DNA, 13 bp, Homo sapiens
gccctcaagggtg

SEQ ID NO: 2359291 - DNA, 23 bp, Homo sapiens
gccctcatgggtcctagcccttc

SEQ ID NO: 2359292 - DNA, 15 bp, Homo sapiens
gccctcctttccctt

SEQ ID NO: 2359293 - DNA, 20 bp, Homo sapiens
gccctctcccaccctcttcc

SEQ ID NO: 2359294 - DNA, 12 bp, Homo sapiens
gccctcttctcg

SEQ ID NO: 2359295 - DNA, 16 bp, Homo sapiens
gccctgactcctctgg

SEQ ID NO: 2359296 - DNA, 23 bp, Homo sapiens
gccctgaggcggaggctgtgctc

SEQ ID NO: 2359297 - DNA, 13 bp, Homo sapiens
gccctgcctcctg

SEQ ID NO: 2359298 - DNA, 18 bp, Homo sapiens
gccctgcctcctggagga

SEQ ID NO: 2359299 - DNA, 13 bp, Homo sapiens
gccctgctgggga

SEQ ID NO: 2359300 - DNA, 11 bp, Homo sapiens
gccctggctgc

SEQ ID NO: 2359301 - DNA, 15 bp, Homo sapiens
gccctggctgctgcc

SEQ ID NO: 2359302 - DNA, 17 bp, Homo sapiens
gccctggctgctgcccc

SEQ ID NO: 2359303 - DNA, 15 bp, Homo sapiens
gccctgggcagggca

SEQ ID NO: 2359304 - DNA, 22 bp, Homo sapiens
gccctgtccaaaagcgccctca

SEQ ID NO: 2359305 - DNA, 17 bp, Homo sapiens
gccctgtccaggtagaa

SEQ ID NO: 2359306 - DNA, 13 bp, Homo sapiens
gccctgtcccagg

SEQ ID NO: 2359307 - DNA, 13 bp, Homo sapiens
gccctgtctggaa

SEQ ID NO: 2359308 - DNA, 18 bp, Homo sapiens
gcccttcaatgctgcagg

SEQ ID NO: 2359309 - DNA, 19 bp, Homo sapiens
gcccttccctctgggcacg

SEQ ID NO: 2359310 - DNA, 22 bp, Homo sapiens
gcccttccctctgggcacgcct

SEQ ID NO: 2359311 - DNA, 20 bp, Homo sapiens
gcccttgcacagctggagaa

SEQ ID NO: 2359312 - DNA, 18 bp, Homo sapiens
gcccttgcttacctctca

SEQ ID NO: 2359313 - DNA, 13 bp, Homo sapiens
gccgagagaggcg

SEQ ID NO: 2359314 - DNA, 13 bp, Homo sapiens
gccgatgccaccg

SEQ ID NO: 2359315 - DNA, 18 bp, Homo sapiens
gccgccgtctctgtcccg

SEQ ID NO: 2359316 - DNA, 19 bp, Homo sapiens
gccgcggggaagctggctt

SEQ ID NO: 2359317 - DNA, 18 bp, Homo sapiens
gccgcttctccccagagc

SEQ ID NO: 2359318 - DNA, 23 bp, Homo sapiens
gccggaccgcgtagagagccggg

SEQ ID NO: 2359319 - DNA, 14 bp, Homo sapiens
gccggcccagatgt

SEQ ID NO: 2359320 - DNA, 12 bp, Homo sapiens
gccgggcccctg

SEQ ID NO: 2359321 - DNA, 14 bp, Homo sapiens
gccgggcgcggtgg

SEQ ID NO: 2359322 - DNA, 18 bp, Homo sapiens
gccgtggatggccgtgga

SEQ ID NO: 2359323 - DNA, 14 bp, Homo sapiens
gccgtggtccctga

SEQ ID NO: 2359324 - DNA, 23 bp, Homo sapiens
gcctaaaacgaatggtctttgct

SEQ ID NO: 2359325 - DNA, 12 bp, Homo sapiens
gcctacagccag

SEQ ID NO: 2359326 - DNA, 12 bp, Homo sapiens
gcctagcacagc

SEQ ID NO: 2359327 - DNA, 14 bp, Homo sapiens
gcctagcacagcag

SEQ ID NO: 2359328 - DNA, 15 bp, Homo sapiens
gcctagcacagcagc

SEQ ID NO: 2359329 - DNA, 20 bp, Homo sapiens
gcctatcaaaggaaatgaga

SEQ ID NO: 2359330 - DNA, 18 bp, Homo sapiens
gcctatccgctgccagcc

SEQ ID NO: 2359331 - DNA, 14 bp, Homo sapiens
gcctatgcacatat

SEQ ID NO: 2359332 - DNA, 20 bp, Homo sapiens
gcctatgcacatatggactc

SEQ ID NO: 2359333 - DNA, 22 bp, Homo sapiens
gcctatgcacatatggactctg

SEQ ID NO: 2359334 - DNA, 15 bp, Homo sapiens
gcctcaccttggggc

SEQ ID NO: 2359335 - DNA, 17 bp, Homo sapiens
gcctcagacgttgcctg

SEQ ID NO: 2359336 - DNA, 21 bp, Homo sapiens
gcctcagactggagggcaagg

SEQ ID NO: 2359337 - DNA, 23 bp, Homo sapiens
gcctcagccctcagttccttcat

SEQ ID NO: 2359338 - DNA, 12 bp, Homo sapiens
gcctcagtgccc

SEQ ID NO: 2359339 - DNA, 23 bp, Homo sapiens
gcctcagttaaatctcctgtgga

SEQ ID NO: 2359340 - DNA, 16 bp, Homo sapiens
gcctcagttttccttc

SEQ ID NO: 2359341 - DNA, 18 bp, Homo sapiens
gcctcagttttccttctg

SEQ ID NO: 2359342 - DNA, 18 bp, Homo sapiens
gcctcatgggaagtcctg

SEQ ID NO: 2359343 - DNA, 16 bp, Homo sapiens
gcggcaaaaggaaagc

SEQ ID NO: 2359344 - DNA, 18 bp, Homo sapiens
gcggcacgccaacagccc

SEQ ID NO: 2359345 - DNA, 13 bp, Homo sapiens
gcggcgcagaggg

SEQ ID NO: 2359346 - DNA, 14 bp, Homo sapiens
gcggctactctgga

SEQ ID NO: 2359347 - DNA, 20 bp, Homo sapiens
gcggctcccctctgcttctc

SEQ ID NO: 2359348 - DNA, 16 bp, Homo sapiens
gcgggccagggtcctg

SEQ ID NO: 2359349 - DNA, 15 bp, Homo sapiens
gcgggctgaggccag

SEQ ID NO: 2359350 - DNA, 17 bp, Homo sapiens
gcgggctgaggccagag

SEQ ID NO: 2359351 - DNA, 23 bp, Homo sapiens
gcggggatcagagcgcacaggga

SEQ ID NO: 2359352 - DNA, 18 bp, Homo sapiens
gcggtttcacgccccaca

SEQ ID NO: 2359353 - DNA, 16 bp, Homo sapiens
gcgtagcagagttaaa

SEQ ID NO: 2359354 - DNA, 22 bp, Homo sapiens
gcgtcagctgctccctggcatt

SEQ ID NO: 2359355 - DNA, 19 bp, Homo sapiens
gcgtgacccgacctggccg

SEQ ID NO: 2359356 - DNA, 15 bp, Homo sapiens
gcgtgccgtggcacc

SEQ ID NO: 2359357 - DNA, 14 bp, Homo sapiens
gcgtggactctgca

SEQ ID NO: 2359358 - DNA, 14 bp, Homo sapiens
gcgtggcccaaggc

SEQ ID NO: 2359359 - DNA, 20 bp, Homo sapiens
gcgtggcccaaggctggcag

SEQ ID NO: 2359360 - DNA, 16 bp, Homo sapiens
gcgtgggagccagcct

SEQ ID NO: 2359361 - DNA, 20 bp, Homo sapiens
gcgtgtgtagagttaagaag

SEQ ID NO: 2359362 - DNA, 17 bp, Homo sapiens
gcgttgttttgtggata

SEQ ID NO: 2359363 - DNA, 17 bp, Homo sapiens
gctaaactccttcctgg

SEQ ID NO: 2359364 - DNA, 22 bp, Homo sapiens
gctaaactccttcctggcctga

SEQ ID NO: 2359365 - DNA, 12 bp, Homo sapiens
gctaaataaatg

SEQ ID NO: 2359366 - DNA, 13 bp, Homo sapiens
gctaagatataat

SEQ ID NO: 2359367 - DNA, 12 bp, Homo sapiens
gctacgcctctt

SEQ ID NO: 2359368 - DNA, 16 bp, Homo sapiens
gctactggggaaactg

SEQ ID NO: 2359369 - DNA, 16 bp, Homo sapiens
gctacttgggaggctg

SEQ ID NO: 2359370 - DNA, 19 bp, Homo sapiens
gctagagataaaacagaat

SEQ ID NO: 2359371 - DNA, 13 bp, Homo sapiens
gctagctgccact

SEQ ID NO: 2359372 - DNA, 14 bp, Homo sapiens
gctagctgccactt

SEQ ID NO: 2359373 - DNA, 18 bp, Homo sapiens
gctagcttctgcttttct

SEQ ID NO: 2359374 - DNA, 22 bp, Homo sapiens
gctagtgtttctagctaaataa

SEQ ID NO: 2359375 - DNA, 14 bp, Homo sapiens
gctataaaagccca

SEQ ID NO: 2359376 - DNA, 14 bp, Homo sapiens
gctatacacacaca

SEQ ID NO: 2359377 - DNA, 14 bp, Homo sapiens
gctatatataaaac

SEQ ID NO: 2359378 - DNA, 19 bp, Homo sapiens
gctatccccatctccctgc

SEQ ID NO: 2359379 - DNA, 22 bp, Homo sapiens
gctatccccatctccctgcctg

SEQ ID NO: 2359380 - DNA, 15 bp, Homo sapiens
gctatcctttcaaac

SEQ ID NO: 2359381 - DNA, 15 bp, Homo sapiens
gctatgtcagtacta

SEQ ID NO: 2359382 - DNA, 16 bp, Homo sapiens
gctatgtctcatgttt

SEQ ID NO: 2359383 - DNA, 16 bp, Homo sapiens
gctattaaaaaagtct

SEQ ID NO: 2359384 - DNA, 20 bp, Homo sapiens
gctattcacctcagtagaaa

SEQ ID NO: 2359385 - DNA, 11 bp, Homo sapiens
gctatttaagt

SEQ ID NO: 2359386 - DNA, 22 bp, Homo sapiens
gctatttaagtggactgtattt

SEQ ID NO: 2359387 - DNA, 16 bp, Homo sapiens
gctatttattttccta

SEQ ID NO: 2359388 - DNA, 22 bp, Homo sapiens
gctatttattttcctaaagaga

SEQ ID NO: 2359389 - DNA, 14 bp, Homo sapiens
gctatttcatctat

SEQ ID NO: 2359390 - DNA, 16 bp, Homo sapiens
gctattttcctctggc

SEQ ID NO: 2359391 - DNA, 13 bp, Homo sapiens
gctatttttgtaa

SEQ ID NO: 2359392 - DNA, 20 bp, Homo sapiens
gctcaagcaatcctcctgcc

SEQ ID NO: 2359393 - DNA, 17 bp, Homo sapiens
gctcaattcaagtgaca

SEQ ID NO: 2359394 - DNA, 14 bp, Homo sapiens
gctcaccagccctg

SEQ ID NO: 2359395 - DNA, 15 bp, Homo sapiens
gctcaccgcccatca

SEQ ID NO: 2359396 - DNA, 16 bp, Homo sapiens
gctcaccgctggccct

SEQ ID NO: 2359397 - DNA, 21 bp, Homo sapiens
gctcaccgctggcccttagag

SEQ ID NO: 2359398 - DNA, 19 bp, Homo sapiens
gctcacgactcttcctgca

SEQ ID NO: 2359399 - DNA, 16 bp, Homo sapiens
gctcactgcagcctca

SEQ ID NO: 2359400 - DNA, 18 bp, Homo sapiens
gctcactgcagcctcata

SEQ ID NO: 2359401 - DNA, 14 bp, Homo sapiens
gctcactgccaggc

SEQ ID NO: 2359402 - DNA, 20 bp, Homo sapiens
gctcagaacttgctgctgtc

SEQ ID NO: 2359403 - DNA, 18 bp, Homo sapiens
gctcagcaattcagaccc

SEQ ID NO: 2359404 - DNA, 15 bp, Homo sapiens
gctcaggaggcgccc

SEQ ID NO: 2359405 - DNA, 22 bp, Homo sapiens
gctcagggtcactgaaccactg

SEQ ID NO: 2359406 - DNA, 14 bp, Homo sapiens
gctcaggtgcctta

SEQ ID NO: 2359407 - DNA, 18 bp, Homo sapiens
gctcagtaaacgggaaca

SEQ ID NO: 2359408 - DNA, 22 bp, Homo sapiens
gctcagtaaacgggaacatgcc

SEQ ID NO: 2359409 - DNA, 22 bp, Homo sapiens
gctcagtgtccagcttccaaag

SEQ ID NO: 2359410 - DNA, 19 bp, Homo sapiens
gctcattacagttctttcc

SEQ ID NO: 2359411 - DNA, 20 bp, Homo sapiens
gctcattacagttctttcct

SEQ ID NO: 2359412 - DNA, 23 bp, Homo sapiens
gctcattacagttctttcctctt

SEQ ID NO: 2359413 - DNA, 20 bp, Homo sapiens
gctccagataactctctttc

SEQ ID NO: 2359414 - DNA, 18 bp, Homo sapiens
gctccagattctgatgca

SEQ ID NO: 2359415 - DNA, 20 bp, Homo sapiens
gctccagggaatccaagcct

SEQ ID NO: 2359416 - DNA, 19 bp, Homo sapiens
gctccatatttgatttcta

SEQ ID NO: 2359417 - DNA, 20 bp, Homo sapiens
gctccatatttgatttctaa

SEQ ID NO: 2359418 - DNA, 21 bp, Homo sapiens
gctccatatttgatttctaat

SEQ ID NO: 2359419 - DNA, 15 bp, Homo sapiens
gctcccacctcctga

SEQ ID NO: 2359420 - DNA, 22 bp, Homo sapiens
gctcccacctcctgacaccctt

SEQ ID NO: 2359421 - DNA, 12 bp, Homo sapiens
gctcccagggca

SEQ ID NO: 2359422 - DNA, 16 bp, Homo sapiens
gctcccaggggtctcc

SEQ ID NO: 2359423 - DNA, 20 bp, Homo sapiens
gctcccaggggtctccctgg

SEQ ID NO: 2359424 - DNA, 22 bp, Homo sapiens
gctcccaggggtctccctggct

SEQ ID NO: 2359425 - DNA, 20 bp, Homo sapiens
gctccccctccccaggctgg

SEQ ID NO: 2359426 - DNA, 12 bp, Homo sapiens
gctcccctctgc

SEQ ID NO: 2359427 - DNA, 18 bp, Homo sapiens
gctcccctctgcttctca

SEQ ID NO: 2359428 - DNA, 17 bp, Homo sapiens
gctcccctgccacactg

SEQ ID NO: 2359429 - DNA, 20 bp, Homo sapiens
gctcccgagctactctcttg

SEQ ID NO: 2359430 - DNA, 14 bp, Homo sapiens
gctccctcccagga

SEQ ID NO: 2359431 - DNA, 19 bp, Homo sapiens
gctccctcctccaggcctg

SEQ ID NO: 2359432 - DNA, 19 bp, Homo sapiens
gctccctcctggagcatcc

SEQ ID NO: 2359433 - DNA, 11 bp, Homo sapiens
gctcctgcagc

SEQ ID NO: 2359434 - DNA, 17 bp, Homo sapiens
gctccttgctgcattga

SEQ ID NO: 2359435 - DNA, 13 bp, Homo sapiens
gctcctttgtgtg

SEQ ID NO: 2359436 - DNA, 19 bp, Homo sapiens
gctcgagcaaaattcaaaa

SEQ ID NO: 2359437 - DNA, 13 bp, Homo sapiens
gctcgcactgccc

SEQ ID NO: 2359438 - DNA, 13 bp, Homo sapiens
gctcgccccaccc

SEQ ID NO: 2359439 - DNA, 15 bp, Homo sapiens
gctcgctgccatcac

SEQ ID NO: 2359440 - DNA, 23 bp, Homo sapiens
gctctaaaaggtaatgtgtggat

SEQ ID NO: 2359441 - DNA, 18 bp, Homo sapiens
gctctaccctgtctgtcc

SEQ ID NO: 2359442 - DNA, 19 bp, Homo sapiens
gctctaccctgtctgtccc

SEQ ID NO: 2359443 - DNA, 15 bp, Homo sapiens
gctctaccttcctgt

SEQ ID NO: 2359444 - DNA, 21 bp, Homo sapiens
gctctaccttcctgtccctga

SEQ ID NO: 2359445 - DNA, 22 bp, Homo sapiens
gctctagggactgccaggctgt

SEQ ID NO: 2359446 - DNA, 22 bp, Homo sapiens
gctctattaagattggaaatgt

SEQ ID NO: 2359447 - DNA, 14 bp, Homo sapiens
gctctccattctgc

SEQ ID NO: 2359448 - DNA, 18 bp, Homo sapiens
gctctccattctgctcct

SEQ ID NO: 2359449 - DNA, 19 bp, Homo sapiens
gctctccattctgctcctt

SEQ ID NO: 2359450 - DNA, 13 bp, Homo sapiens
gctctcccagtga

SEQ ID NO: 2359451 - DNA, 17 bp, Homo sapiens
gctctcccatttcctga

SEQ ID NO: 2359452 - DNA, 21 bp, Homo sapiens
gctctccgccaatttctctca

SEQ ID NO: 2359453 - DNA, 23 bp, Homo sapiens
gctctcctcttctactcactttt

SEQ ID NO: 2359454 - DNA, 14 bp, Homo sapiens
gctctctctagaat

SEQ ID NO: 2359455 - DNA, 12 bp, Homo sapiens
gctctctgccct

SEQ ID NO: 2359456 - DNA, 15 bp, Homo sapiens
gctctgccatcttca

SEQ ID NO: 2359457 - DNA, 23 bp, Homo sapiens
gctctgccccaccttgccagggc

SEQ ID NO: 2359458 - DNA, 22 bp, Homo sapiens
gctctgcctcagacgttgcctg

SEQ ID NO: 2359459 - DNA, 20 bp, Homo sapiens
gctctggacagcagaagcct

SEQ ID NO: 2359460 - DNA, 19 bp, Homo sapiens
gctctggaggtgctgctct

SEQ ID NO: 2359461 - DNA, 22 bp, Homo sapiens
gctctggtggcttaagtgagca

SEQ ID NO: 2359462 - DNA, 23 bp, Homo sapiens
gctctgtgagccccacagccctg

SEQ ID NO: 2359463 - DNA, 15 bp, Homo sapiens
gctcttagtcccaag

SEQ ID NO: 2359464 - DNA, 15 bp, Homo sapiens
gctcttcatctgcct

SEQ ID NO: 2359465 - DNA, 16 bp, Homo sapiens
gctctttccaaattaa

SEQ ID NO: 2359466 - DNA, 20 bp, Homo sapiens
gctctttccaaattaaaaca

SEQ ID NO: 2359467 - DNA, 23 bp, Homo sapiens
gctctttccaaattaaaacaaat

SEQ ID NO: 2359468 - DNA, 12 bp, Homo sapiens
gctgaaaacaat

SEQ ID NO: 2359469 - DNA, 17 bp, Homo sapiens
gctgaaattttagaaat

SEQ ID NO: 2359470 - DNA, 19 bp, Homo sapiens
gctgaacacagtgtctgtt

SEQ ID NO: 2359471 - DNA, 22 bp, Homo sapiens
gctgaacacagtgtctgttcag

SEQ ID NO: 2359472 - DNA, 18 bp, Homo sapiens
gctgaatgccccctgctt

SEQ ID NO: 2359473 - DNA, 12 bp, Homo sapiens
gctgacctgctg

SEQ ID NO: 2359474 - DNA, 15 bp, Homo sapiens
gctgagactgtgctg

SEQ ID NO: 2359475 - DNA, 12 bp, Homo sapiens
gctgagcagcct

SEQ ID NO: 2359476 - DNA, 20 bp, Homo sapiens
gctgagcagcctctggacag

SEQ ID NO: 2359477 - DNA, 15 bp, Homo sapiens
gctgaggccagagtc

SEQ ID NO: 2359478 - DNA, 13 bp, Homo sapiens
gctgaggcccagt

SEQ ID NO: 2359479 - DNA, 17 bp, Homo sapiens
gctgaggcccagtgcat

SEQ ID NO: 2359480 - DNA, 15 bp, Homo sapiens
gctgaggctggggga

SEQ ID NO: 2359481 - DNA, 22 bp, Homo sapiens
gctgaggctgggggagagccgt

SEQ ID NO: 2359482 - DNA, 12 bp, Homo sapiens
gctgagggcctg

SEQ ID NO: 2359483 - DNA, 18 bp, Homo sapiens
gctgagggcctgctggag

SEQ ID NO: 2359484 - DNA, 14 bp, Homo sapiens
gctgagggtttgaa

SEQ ID NO: 2359485 - DNA, 18 bp, Homo sapiens
gctgaggttcctctgcct

SEQ ID NO: 2359486 - DNA, 21 bp, Homo sapiens
gctgaggttcctctgcctgcc

SEQ ID NO: 2359487 - DNA, 16 bp, Homo sapiens
gctgatattatttctt

SEQ ID NO: 2359488 - DNA, 13 bp, Homo sapiens
gctgatccccaac

SEQ ID NO: 2359489 - DNA, 15 bp, Homo sapiens
gctgcaattccctgg

SEQ ID NO: 2359490 - DNA, 12 bp, Homo sapiens
gctgcactgtga

SEQ ID NO: 2359491 - DNA, 14 bp, Homo sapiens
gctgcactgtgaac

SEQ ID NO: 2359492 - DNA, 15 bp, Homo sapiens
gctgcactgtgaacc

SEQ ID NO: 2359493 - DNA, 18 bp, Homo sapiens
gctgcagagatttctcat

SEQ ID NO: 2359494 - DNA, 17 bp, Homo sapiens
gctgcagttttgctatc

SEQ ID NO: 2359495 - DNA, 16 bp, Homo sapiens
gctgccaccagccccc

SEQ ID NO: 2359496 - DNA, 19 bp, Homo sapiens
gctgccagccttgagccct

SEQ ID NO: 2359497 - DNA, 17 bp, Homo sapiens
gctgccatcaccgctgg

SEQ ID NO: 2359498 - DNA, 21 bp, Homo sapiens
gctgccatcaccgctgggtgg

SEQ ID NO: 2359499 - DNA, 21 bp, Homo sapiens
gctgccatgtgaagagggaga

SEQ ID NO: 2359500 - DNA, 22 bp, Homo sapiens
gctgcccactgtttctcttgag

SEQ ID NO: 2359501 - DNA, 23 bp, Homo sapiens
gctgcccactgtttctcttgagc

SEQ ID NO: 2359502 - DNA, 15 bp, Homo sapiens
gctgcccccaccccg

SEQ ID NO: 2359503 - DNA, 20 bp, Homo sapiens
gctgcccccaccccggggac

SEQ ID NO: 2359504 - DNA, 14 bp, Homo sapiens
gctgcccctctcac

SEQ ID NO: 2359505 - DNA, 15 bp, Homo sapiens
gctgcccctctcacc

SEQ ID NO: 2359506 - DNA, 16 bp, Homo sapiens
gctgcccctctcacca

SEQ ID NO: 2359507 - DNA, 18 bp, Homo sapiens
gctgcccctctcaccaaa

SEQ ID NO: 2359508 - DNA, 17 bp, Homo sapiens
gctgccctatgggcctg

SEQ ID NO: 2359509 - DNA, 12 bp, Homo sapiens
gctgccttccct

SEQ ID NO: 2359510 - DNA, 15 bp, Homo sapiens
gctgccttccctagc

SEQ ID NO: 2359511 - DNA, 14 bp, Homo sapiens
gctgcgcctgcagg

SEQ ID NO: 2359512 - DNA, 17 bp, Homo sapiens
gctgcgcctgcaggcag

SEQ ID NO: 2359513 - DNA, 16 bp, Homo sapiens
gctgcgcttgcttttc

SEQ ID NO: 2359514 - DNA, 17 bp, Homo sapiens
gctgctcacccacctct

SEQ ID NO: 2359515 - DNA, 13 bp, Homo sapiens
gctgctccctggc

SEQ ID NO: 2359516 - DNA, 22 bp, Homo sapiens
gctgctggccaaatagcaaaga

SEQ ID NO: 2359517 - DNA, 15 bp, Homo sapiens
gctgctgtccagtgc

SEQ ID NO: 2359518 - DNA, 17 bp, Homo sapiens
gctgctgtccagtgcct

SEQ ID NO: 2359519 - DNA, 16 bp, Homo sapiens
gctgctgtctgggtgc

SEQ ID NO: 2359520 - DNA, 11 bp, Homo sapiens
gctgcttttct

SEQ ID NO: 2359521 - DNA, 23 bp, Homo sapiens
gctggaagaagtgagcagtgttg

SEQ ID NO: 2359522 - DNA, 12 bp, Homo sapiens
gctggaagccca

SEQ ID NO: 2359523 - DNA, 20 bp, Homo sapiens
gctggacttctacctgccct

SEQ ID NO: 2359524 - DNA, 15 bp, Homo sapiens
gctggagtaatcaga

SEQ ID NO: 2359525 - DNA, 19 bp, Homo sapiens
gctggatagacttgggatg

SEQ ID NO: 2359526 - DNA, 12 bp, Homo sapiens
gctggatggcac

SEQ ID NO: 2359527 - DNA, 20 bp, Homo sapiens
gctggatggcacctcaggct

SEQ ID NO: 2359528 - DNA, 16 bp, Homo sapiens
gctggcacccaccgtg

SEQ ID NO: 2359529 - DNA, 23 bp, Homo sapiens
gctggcacccaccgtggaggagg

SEQ ID NO: 2359530 - DNA, 19 bp, Homo sapiens
gctggccaaatagcaaaga

SEQ ID NO: 2359531 - DNA, 14 bp, Homo sapiens
gctggccccagccc

SEQ ID NO: 2359532 - DNA, 15 bp, Homo sapiens
gctggccccagccct

SEQ ID NO: 2359533 - DNA, 17 bp, Homo sapiens
gctggccccagccctgc

SEQ ID NO: 2359534 - DNA, 19 bp, Homo sapiens
gctggccccagccctgctg

SEQ ID NO: 2359535 - DNA, 14 bp, Homo sapiens
gctggcccttagag

SEQ ID NO: 2359536 - DNA, 15 bp, Homo sapiens
gctggcctctctagc

SEQ ID NO: 2359537 - DNA, 14 bp, Homo sapiens
gctggcctggacag

SEQ ID NO: 2359538 - DNA, 15 bp, Homo sapiens
gctggctacgcctct

SEQ ID NO: 2359539 - DNA, 17 bp, Homo sapiens
gctggctccccctcccc

SEQ ID NO: 2359540 - DNA, 19 bp, Homo sapiens
gctggctccccctccccag

SEQ ID NO: 2359541 - DNA, 22 bp, Homo sapiens
gctggctccccctccccaggct

SEQ ID NO: 2359542 - DNA, 14 bp, Homo sapiens
gctggctcctgatc

SEQ ID NO: 2359543 - DNA, 22 bp, Homo sapiens
gctggctctaccttcctgtccc

SEQ ID NO: 2359544 - DNA, 21 bp, Homo sapiens
gctggcttcattctcagactc

SEQ ID NO: 2359545 - DNA, 20 bp, Homo sapiens
gctggctttgaaacctcagg

SEQ ID NO: 2359546 - DNA, 16 bp, Homo sapiens
gctgggaggagggaga

SEQ ID NO: 2359547 - DNA, 17 bp, Homo sapiens
gctgggaggagggagag

SEQ ID NO: 2359548 - DNA, 21 bp, Homo sapiens
gctgggagtccctacctgctt

SEQ ID NO: 2359549 - DNA, 12 bp, Homo sapiens
gctggggaaggg

SEQ ID NO: 2359550 - DNA, 21 bp, Homo sapiens
gctggggaagggttttctttt

SEQ ID NO: 2359551 - DNA, 19 bp, Homo sapiens
gctggggccagaggctggg

SEQ ID NO: 2359552 - DNA, 12 bp, Homo sapiens
gctggggcctgg

SEQ ID NO: 2359553 - DNA, 15 bp, Homo sapiens
gctggggcctgggac

SEQ ID NO: 2359554 - DNA, 16 bp, Homo sapiens
gctggggcctgggaca

SEQ ID NO: 2359555 - DNA, 20 bp, Homo sapiens
gctggtagaaaaaggggcct

SEQ ID NO: 2359556 - DNA, 23 bp, Homo sapiens
gctggtcagtctttgctcagtgt

SEQ ID NO: 2359557 - DNA, 23 bp, Homo sapiens
gctgtaactcagacattccaagg

SEQ ID NO: 2359558 - DNA, 19 bp, Homo sapiens
gctgtaagcattctgagct

SEQ ID NO: 2359559 - DNA, 17 bp, Homo sapiens
gctgtacttcttgaata

SEQ ID NO: 2359560 - DNA, 14 bp, Homo sapiens
gctgtataagttat

SEQ ID NO: 2359561 - DNA, 15 bp, Homo sapiens
gctgtatgtgagctg

SEQ ID NO: 2359562 - DNA, 13 bp, Homo sapiens
gctgtccagtgcc

SEQ ID NO: 2359563 - DNA, 17 bp, Homo sapiens
gctgtccagtgcctaca

SEQ ID NO: 2359564 - DNA, 19 bp, Homo sapiens
gctgtccagtgcctacatc

SEQ ID NO: 2359565 - DNA, 11 bp, Homo sapiens
gctgtcccagc

SEQ ID NO: 2359566 - DNA, 23 bp, Homo sapiens
gctgtcctggaggggctggggac

SEQ ID NO: 2359567 - DNA, 17 bp, Homo sapiens
gctgtctgggtgctact

SEQ ID NO: 2359568 - DNA, 23 bp, Homo sapiens
gctgtcttgttgcggatggatgg

SEQ ID NO: 2359569 - DNA, 13 bp, Homo sapiens
gctgtgaaccctg

SEQ ID NO: 2359570 - DNA, 21 bp, Homo sapiens
gctgtgaaccctggggcctga

SEQ ID NO: 2359571 - DNA, 22 bp, Homo sapiens
gctgtgaaccctggggcctgac

SEQ ID NO: 2359572 - DNA, 23 bp, Homo sapiens
gctgtgaaccctggggcctgact

SEQ ID NO: 2359573 - DNA, 11 bp, Homo sapiens
ggaaagtcaga

SEQ ID NO: 2359574 - DNA, 14 bp, Homo sapiens
ggaaataatttgaa

SEQ ID NO: 2359575 - DNA, 17 bp, Homo sapiens
ggaaataatttgaatgt

SEQ ID NO: 2359576 - DNA, 18 bp, Homo sapiens
ggaaataatttgaatgta

SEQ ID NO: 2359577 - DNA, 18 bp, Homo sapiens
ggaaatagaaagaagcca

SEQ ID NO: 2359578 - DNA, 15 bp, Homo sapiens
ggaaatagcatgaca

SEQ ID NO: 2359579 - DNA, 14 bp, Homo sapiens
ggaaatatctgtga

SEQ ID NO: 2359580 - DNA, 16 bp, Homo sapiens
ggaaatgtctgctggt

SEQ ID NO: 2359581 - DNA, 22 bp, Homo sapiens
ggaacagtaaagaaagcagaat

SEQ ID NO: 2359582 - DNA, 12 bp, Homo sapiens
ggaaccagcccc

SEQ ID NO: 2359583 - DNA, 16 bp, Homo sapiens
ggaacccctttcccac

SEQ ID NO: 2359584 - DNA, 22 bp, Homo sapiens
ggaacttgcgagtccaaggcca

SEQ ID NO: 2359585 - DNA, 16 bp, Homo sapiens
ggaagaacatagaact

SEQ ID NO: 2359586 - DNA, 13 bp, Homo sapiens
ggaagaagggaga

SEQ ID NO: 2359587 - DNA, 14 bp, Homo sapiens
ggaagaagggagaa

SEQ ID NO: 2359588 - DNA, 13 bp, Homo sapiens
ggaagaatgaaag

SEQ ID NO: 2359589 - DNA, 12 bp, Homo sapiens
ggaagagaggca

SEQ ID NO: 2359590 - DNA, 18 bp, Homo sapiens
ggaagagaggcacctgct

SEQ ID NO: 2359591 - DNA, 19 bp, Homo sapiens
ggaagagaggcacctgctg

SEQ ID NO: 2359592 - DNA, 21 bp, Homo sapiens
ggaagagaggcacctgctgga

SEQ ID NO: 2359593 - DNA, 12 bp, Homo sapiens
ggaagagccacc

SEQ ID NO: 2359594 - DNA, 18 bp, Homo sapiens
ggaagagcccgcagggcc

SEQ ID NO: 2359595 - DNA, 22 bp, Homo sapiens
ggaagaggcatcgcctgcagga

SEQ ID NO: 2359596 - DNA, 11 bp, Homo sapiens
ggaagcaggga

SEQ ID NO: 2359597 - DNA, 11 bp, Homo sapiens
ggaagccagag

SEQ ID NO: 2359598 - DNA, 18 bp, Homo sapiens
ggaagccagagccccaag

SEQ ID NO: 2359599 - DNA, 22 bp, Homo sapiens
ggaagccccctcttcctccctg

SEQ ID NO: 2359600 - DNA, 13 bp, Homo sapiens
ggaagcccctggg

SEQ ID NO: 2359601 - DNA, 18 bp, Homo sapiens
ggaagcccctgggcccag

SEQ ID NO: 2359602 - DNA, 19 bp, Homo sapiens
ggaagcccctgggcccagt

SEQ ID NO: 2359603 - DNA, 15 bp, Homo sapiens
ggaaggatctgctga

SEQ ID NO: 2359604 - DNA, 17 bp, Homo sapiens
ggaaggatctgctgagg

SEQ ID NO: 2359605 - DNA, 16 bp, Homo sapiens
ggaaggattgtaaaaa

SEQ ID NO: 2359606 - DNA, 23 bp, Homo sapiens
ggaaggattgtaaaaaaaaatgc

SEQ ID NO: 2359607 - DNA, 14 bp, Homo sapiens
ggaaggcctgagcc

SEQ ID NO: 2359608 - DNA, 17 bp, Homo sapiens
ggaaggcctgagcccct

SEQ ID NO: 2359609 - DNA, 17 bp, Homo sapiens
ggaagggaaagtttttt

SEQ ID NO: 2359610 - DNA, 18 bp, Homo sapiens
ggaagtatgtatattaaa

SEQ ID NO: 2359611 - DNA, 17 bp, Homo sapiens
ggaataaaaggcttgaa

SEQ ID NO: 2359612 - DNA, 18 bp, Homo sapiens
ggaatatatgtgtgccta

SEQ ID NO: 2359613 - DNA, 20 bp, Homo sapiens
ggaatccaagcctccacagc

SEQ ID NO: 2359614 - DNA, 20 bp, Homo sapiens
ggaatgaaattaacacaaag

SEQ ID NO: 2359615 - DNA, 23 bp, Homo sapiens
ggaatgagccgcggggaagctgg

SEQ ID NO: 2359616 - DNA, 13 bp, Homo sapiens
ggaatgccttgga

SEQ ID NO: 2359617 - DNA, 21 bp, Homo sapiens
ggaatggaaggctttgccatg

SEQ ID NO: 2359618 - DNA, 23 bp, Homo sapiens
ggaatgtttttccctccccagaa

SEQ ID NO: 2359619 - DNA, 14 bp, Homo sapiens
ggaattaaaaagaa

SEQ ID NO: 2359620 - DNA, 16 bp, Homo sapiens
ggaattaaaaagaaga

SEQ ID NO: 2359621 - DNA, 13 bp, Homo sapiens
ggaattgtggcta

SEQ ID NO: 2359622 - DNA, 21 bp, Homo sapiens
ggaattgtggctatcctgatt

SEQ ID NO: 2359623 - DNA, 14 bp, Homo sapiens
ggacacagttcctg

SEQ ID NO: 2359624 - DNA, 18 bp, Homo sapiens
ggacacagttcctgggaa

SEQ ID NO: 2359625 - DNA, 21 bp, Homo sapiens
ggacacattggaatgccttgg

SEQ ID NO: 2359626 - DNA, 16 bp, Homo sapiens
ggacacgagccacaag

SEQ ID NO: 2359627 - DNA, 19 bp, Homo sapiens
ggacactcgtcaccccagc

SEQ ID NO: 2359628 - DNA, 18 bp, Homo sapiens
ggacagcatcccttccca

SEQ ID NO: 2359629 - DNA, 24 bp, Homo sapiens
ggacagcatcccttcccacatgcc

SEQ ID NO: 2359630 - DNA, 12 bp, Homo sapiens
ggacagctgtgt

SEQ ID NO: 2359631 - DNA, 13 bp, Homo sapiens
ggacaggatctat

SEQ ID NO: 2359632 - DNA, 11 bp, Homo sapiens
ggacagtggtg

SEQ ID NO: 2359633 - DNA, 22 bp, Homo sapiens
ggacatgagatggagaggctga

SEQ ID NO: 2359634 - DNA, 18 bp, Homo sapiens
ggacatgcaataaaattt

SEQ ID NO: 2359635 - DNA, 19 bp, Homo sapiens
ggacatgcaataaaattta

SEQ ID NO: 2359636 - DNA, 16 bp, Homo sapiens
ggaccactcctgtccc

SEQ ID NO: 2359637 - DNA, 22 bp, Homo sapiens
ggacccccgaggggagggcagg

SEQ ID NO: 2359638 - DNA, 16 bp, Homo sapiens
ggaccctgtgacatgg

SEQ ID NO: 2359639 - DNA, 23 bp, Homo sapiens
ggaccctgtgacatggtgcctga

SEQ ID NO: 2359640 - DNA, 21 bp, Homo sapiens
ggaccgcgtagagagccgggc

SEQ ID NO: 2359641 - DNA, 14 bp, Homo sapiens
ggacctgccaggca

SEQ ID NO: 2359642 - DNA, 12 bp, Homo sapiens
ggacctgtggct

SEQ ID NO: 2359643 - DNA, 23 bp, Homo sapiens
ggacgcacgctcgctgccatcac

SEQ ID NO: 2359644 - DNA, 13 bp, Homo sapiens
ggacggaccagca

SEQ ID NO: 2359645 - DNA, 14 bp, Homo sapiens
ggacggcggcagta

SEQ ID NO: 2359646 - DNA, 15 bp, Homo sapiens
ggacggttgtaagca

SEQ ID NO: 2359647 - DNA, 14 bp, Homo sapiens
ggactcatgaggag

SEQ ID NO: 2359648 - DNA, 24 bp, Homo sapiens
ggactcatttcattcctaacacag

SEQ ID NO: 2359649 - DNA, 19 bp, Homo sapiens
ggactccggggccccactg

SEQ ID NO: 2359650 - DNA, 13 bp, Homo sapiens
ggactctgcacat

SEQ ID NO: 2359651 - DNA, 15 bp, Homo sapiens
ggactctgcacatga

SEQ ID NO: 2359652 - DNA, 18 bp, Homo sapiens
ggactctgcccctggacc

SEQ ID NO: 2359653 - DNA, 11 bp, Homo sapiens
ggactgccaaa

SEQ ID NO: 2359654 - DNA, 21 bp, Homo sapiens
ggactggtgccctcctcactc

SEQ ID NO: 2359655 - DNA, 21 bp, Homo sapiens
ggactgtcacggggttccctc

SEQ ID NO: 2359656 - DNA, 20 bp, Homo sapiens
ggactgtctttcagatacat

SEQ ID NO: 2359657 - DNA, 14 bp, Homo sapiens
ggagaaatggcatc

SEQ ID NO: 2359658 - DNA, 15 bp, Homo sapiens
ggagaaatggcatca

SEQ ID NO: 2359659 - DNA, 11 bp, Homo sapiens
ggagaaccagg

SEQ ID NO: 2359660 - DNA, 14 bp, Homo sapiens
ggagaagagcgcag

SEQ ID NO: 2359661 - DNA, 16 bp, Homo sapiens
ggagaagcaccagcaa

SEQ ID NO: 2359662 - DNA, 18 bp, Homo sapiens
ggagaagcatgaaaaagc

SEQ ID NO: 2359663 - DNA, 12 bp, Homo sapiens
ggagaagctgca

SEQ ID NO: 2359664 - DNA, 21 bp, Homo sapiens
ggagaagtgggggcagcccag

SEQ ID NO: 2359665 - DNA, 17 bp, Homo sapiens
ggagaatatttactaac

SEQ ID NO: 2359666 - DNA, 16 bp, Homo sapiens
ggagacaaggtgctaa

SEQ ID NO: 2359667 - DNA, 16 bp, Homo sapiens
ggagaccctgccacag

SEQ ID NO: 2359668 - DNA, 12 bp, Homo sapiens
ggagacgccatg

SEQ ID NO: 2359669 - DNA, 14 bp, Homo sapiens
ggagagacaggcag

SEQ ID NO: 2359670 - DNA, 15 bp, Homo sapiens
ggagagacaggcagc

SEQ ID NO: 2359671 - DNA, 16 bp, Homo sapiens
ggagagacaggcagcc

SEQ ID NO: 2359672 - DNA, 20 bp, Homo sapiens
ggagagacaggcagcccagc

SEQ ID NO: 2359673 - DNA, 22 bp, Homo sapiens
ggagagatccctgcagaaccca

SEQ ID NO: 2359674 - DNA, 11 bp, Homo sapiens
ggagagcagct

SEQ ID NO: 2359675 - DNA, 14 bp, Homo sapiens
ggagagctctcctt

SEQ ID NO: 2359676 - DNA, 21 bp, Homo sapiens
ggagaggatgagagcccagag

SEQ ID NO: 2359677 - DNA, 15 bp, Homo sapiens
ggagatgcttctctc

SEQ ID NO: 2359678 - DNA, 13 bp, Homo sapiens
ggagatggagttc

SEQ ID NO: 2359679 - DNA, 15 bp, Homo sapiens
ggagattgacctgga

SEQ ID NO: 2359680 - DNA, 16 bp, Homo sapiens
ggagcaggcacgggtg

SEQ ID NO: 2359681 - DNA, 15 bp, Homo sapiens
ggagcccccagcaga

SEQ ID NO: 2359682 - DNA, 19 bp, Homo sapiens
ggagcccccagcagaggca

SEQ ID NO: 2359683 - DNA, 12 bp, Homo sapiens
ggagcctcccca

SEQ ID NO: 2359684 - DNA, 19 bp, Homo sapiens
ggagcctccccatctgtcc

SEQ ID NO: 2359685 - DNA, 20 bp, Homo sapiens
ggagcctccccatctgtcca

SEQ ID NO: 2359686 - DNA, 16 bp, Homo sapiens
ggagcgggaggcggtg

SEQ ID NO: 2359687 - DNA, 16 bp, Homo sapiens
ggagcgtctgggaact

SEQ ID NO: 2359688 - DNA, 18 bp, Homo sapiens
ggagctttctcaatgtct

SEQ ID NO: 2359689 - DNA, 17 bp, Homo sapiens
ggccagggcctctccaa

SEQ ID NO: 2359690 - DNA, 11 bp, Homo sapiens
ggccagggctg

SEQ ID NO: 2359691 - DNA, 21 bp, Homo sapiens
ggccagtccccatttctgcct

SEQ ID NO: 2359692 - DNA, 18 bp, Homo sapiens
ggccagttgatctgctct

SEQ ID NO: 2359693 - DNA, 17 bp, Homo sapiens
ggccataaacggttcct

SEQ ID NO: 2359694 - DNA, 18 bp, Homo sapiens
ggccatgaatctctgcct

SEQ ID NO: 2359695 - DNA, 22 bp, Homo sapiens
ggccatgaatctctgcctctcc

SEQ ID NO: 2359696 - DNA, 12 bp, Homo sapiens
ggccatgcagac

SEQ ID NO: 2359697 - DNA, 14 bp, Homo sapiens
ggccatggcctgca

SEQ ID NO: 2359698 - DNA, 15 bp, Homo sapiens
ggccatggcctgcaa

SEQ ID NO: 2359699 - DNA, 23 bp, Homo sapiens
ggccatgtccaaagaggctgccc

SEQ ID NO: 2359700 - DNA, 19 bp, Homo sapiens
ggccatgttatgctggtgg

SEQ ID NO: 2359701 - DNA, 22 bp, Homo sapiens
ggccatttgcaataacagctgc

SEQ ID NO: 2359702 - DNA, 23 bp, Homo sapiens
ggccatttgcaataacagctgca

SEQ ID NO: 2359703 - DNA, 16 bp, Homo sapiens
ggcccagaaagcctct

SEQ ID NO: 2359704 - DNA, 16 bp, Homo sapiens
ggcccagcctgtcctg

SEQ ID NO: 2359705 - DNA, 22 bp, Homo sapiens
ggcccagcctgtcctggtacag

SEQ ID NO: 2359706 - DNA, 18 bp, Homo sapiens
ggcccatagcagccagtt

SEQ ID NO: 2359707 - DNA, 17 bp, Homo sapiens
ggcccattgtcctcctt

SEQ ID NO: 2359708 - DNA, 14 bp, Homo sapiens
ggccccactggctg

SEQ ID NO: 2359709 - DNA, 17 bp, Homo sapiens
ggccccactttgaaggg

SEQ ID NO: 2359710 - DNA, 19 bp, Homo sapiens
ggccccactttgaagggca

SEQ ID NO: 2359711 - DNA, 17 bp, Homo sapiens
ggccccagacagggtgg

SEQ ID NO: 2359712 - DNA, 13 bp, Homo sapiens
ggccccagccctg

SEQ ID NO: 2359713 - DNA, 16 bp, Homo sapiens
ggccccagccctgctg

SEQ ID NO: 2359714 - DNA, 19 bp, Homo sapiens
ggccccaggccccagacag

SEQ ID NO: 2359715 - DNA, 16 bp, Homo sapiens
ggcccccctgccctgt

SEQ ID NO: 2359716 - DNA, 19 bp, Homo sapiens
ggccccctccccccagact

SEQ ID NO: 2359717 - DNA, 22 bp, Homo sapiens
ggcccctgggcttggcctgctg

SEQ ID NO: 2359718 - DNA, 23 bp, Homo sapiens
ggcccctgggcttggcctgctgt

SEQ ID NO: 2359719 - DNA, 21 bp, Homo sapiens
ggccccttccaaatgtccctc

SEQ ID NO: 2359720 - DNA, 16 bp, Homo sapiens
ggccctgactcctctg

SEQ ID NO: 2359721 - DNA, 15 bp, Homo sapiens
ggccctgggctgggt

SEQ ID NO: 2359722 - DNA, 18 bp, Homo sapiens
ggccctgtccaggtagaa

SEQ ID NO: 2359723 - DNA, 15 bp, Homo sapiens
ggccctgtcccaggc

SEQ ID NO: 2359724 - DNA, 19 bp, Homo sapiens
ggccctgtcccaggccggc

SEQ ID NO: 2359725 - DNA, 16 bp, Homo sapiens
ggccctgttccctgga

SEQ ID NO: 2359726 - DNA, 16 bp, Homo sapiens
ggccgcggagcctgca

SEQ ID NO: 2359727 - DNA, 16 bp, Homo sapiens
ggccgcttctccccag

SEQ ID NO: 2359728 - DNA, 19 bp, Homo sapiens
ggccgcttctccccagagc

SEQ ID NO: 2359729 - DNA, 21 bp, Homo sapiens
ggcctagcgatctctcctggc

SEQ ID NO: 2359730 - DNA, 14 bp, Homo sapiens
ggcctatgtggtct

SEQ ID NO: 2359731 - DNA, 20 bp, Homo sapiens
ggcctcaagcaatccacctg

SEQ ID NO: 2359732 - DNA, 16 bp, Homo sapiens
ggcctcaggtgctgtc

SEQ ID NO: 2359733 - DNA, 17 bp, Homo sapiens
ggcctcaggtgctgtcc

SEQ ID NO: 2359734 - DNA, 13 bp, Homo sapiens
ggcctcagtgccc

SEQ ID NO: 2359735 - DNA, 18 bp, Homo sapiens
ggcctcccaaagtgctga

SEQ ID NO: 2359736 - DNA, 14 bp, Homo sapiens
ggcctccttctgag

SEQ ID NO: 2359737 - DNA, 13 bp, Homo sapiens
ggcctctctagca

SEQ ID NO: 2359738 - DNA, 15 bp, Homo sapiens
ggcctgaagccagct

SEQ ID NO: 2359739 - DNA, 12 bp, Homo sapiens
ggcctgagcccc

SEQ ID NO: 2359740 - DNA, 14 bp, Homo sapiens
ggcctgcaaactgg

SEQ ID NO: 2359741 - DNA, 14 bp, Homo sapiens
ggcctgccgggctg

SEQ ID NO: 2359742 - DNA, 21 bp, Homo sapiens
ggcctgccgggctgagggcct

SEQ ID NO: 2359743 - DNA, 15 bp, Homo sapiens
ggcctgcctcccact

SEQ ID NO: 2359744 - DNA, 18 bp, Homo sapiens
ggcctgcgccagtcctgc

SEQ ID NO: 2359745 - DNA, 16 bp, Homo sapiens
ggcctgctggaggcct

SEQ ID NO: 2359746 - DNA, 20 bp, Homo sapiens
ggcctgctggaggcctcagg

SEQ ID NO: 2359747 - DNA, 13 bp, Homo sapiens
ggcctggctggag

SEQ ID NO: 2359748 - DNA, 22 bp, Homo sapiens
ggcctggctggaggagcagcag

SEQ ID NO: 2359749 - DNA, 22 bp, Homo sapiens
ggcctgggaaaccctctccatc

SEQ ID NO: 2359750 - DNA, 21 bp, Homo sapiens
ggcctgggacaactgctccca

SEQ ID NO: 2359751 - DNA, 11 bp, Homo sapiens
ggcctgggagg

SEQ ID NO: 2359752 - DNA, 23 bp, Homo sapiens
ggcctgttccccaaatggccatt

SEQ ID NO: 2359753 - DNA, 16 bp, Homo sapiens
ggccttaatttccttt

SEQ ID NO: 2359754 - DNA, 17 bp, Homo sapiens
ggccttacgatggcaat

SEQ ID NO: 2359755 - DNA, 21 bp, Homo sapiens
ggccttgtcctacgtccaagg

SEQ ID NO: 2359756 - DNA, 22 bp, Homo sapiens
ggccttgtcctacgtccaaggt

SEQ ID NO: 2359757 - DNA, 19 bp, Homo sapiens
ggcctttccttccctctct

SEQ ID NO: 2359758 - DNA, 20 bp, Homo sapiens
ggcctttccttccctctctg

SEQ ID NO: 2359759 - DNA, 18 bp, Homo sapiens
ggcctttgtgctgcgcct

SEQ ID NO: 2359760 - DNA, 17 bp, Homo sapiens
ggcgaatctcaaaatta

SEQ ID NO: 2359761 - DNA, 23 bp, Homo sapiens
ggcgagtctggggacctggcact

SEQ ID NO: 2359762 - DNA, 15 bp, Homo sapiens
ggcgcaggtgggctg

SEQ ID NO: 2359763 - DNA, 14 bp, Homo sapiens
ggcgccctgcctcc

SEQ ID NO: 2359764 - DNA, 16 bp, Homo sapiens
ggcgccctgcctcctg

SEQ ID NO: 2359765 - DNA, 20 bp, Homo sapiens
ggcgcgtctgccccaccctc

SEQ ID NO: 2359766 - DNA, 21 bp, Homo sapiens
ggcggaggctgtgctccgcca

SEQ ID NO: 2359767 - DNA, 16 bp, Homo sapiens
ggcggctactctggaa

SEQ ID NO: 2359768 - DNA, 20 bp, Homo sapiens
ggcgggtggatcacgaggtc

SEQ ID NO: 2359769 - DNA, 20 bp, Homo sapiens
ggcgggtggatcatgaggtc

SEQ ID NO: 2359770 - DNA, 23 bp, Homo sapiens
ggcgtcaccatccaccttccctt

SEQ ID NO: 2359771 - DNA, 15 bp, Homo sapiens
ggcgtctgctctggt

SEQ ID NO: 2359772 - DNA, 22 bp, Homo sapiens
ggcgttctaggtaggaagagcc

SEQ ID NO: 2359773 - DNA, 20 bp, Homo sapiens
ggctagcttctgcttttctg

SEQ ID NO: 2359774 - DNA, 20 bp, Homo sapiens
ggctattttctaaagacttg

SEQ ID NO: 2359775 - DNA, 21 bp, Homo sapiens
ggctcaagacaaggctggcaa

SEQ ID NO: 2359776 - DNA, 19 bp, Homo sapiens
ggctcactgccaggccagc

SEQ ID NO: 2359777 - DNA, 22 bp, Homo sapiens
ggctcccaggggtctccctggc

SEQ ID NO: 2359778 - DNA, 19 bp, Homo sapiens
ggctccccctccagccaga

SEQ ID NO: 2359779 - DNA, 15 bp, Homo sapiens
ggctccccctcccca

SEQ ID NO: 2359780 - DNA, 17 bp, Homo sapiens
ggctccccctccccagg

SEQ ID NO: 2359781 - DNA, 19 bp, Homo sapiens
ggctccccctccccaggct

SEQ ID NO: 2359782 - DNA, 20 bp, Homo sapiens
ggctccccctccccaggctg

SEQ ID NO: 2359783 - DNA, 14 bp, Homo sapiens
ggctcccctctgct

SEQ ID NO: 2359784 - DNA, 15 bp, Homo sapiens
ggctccctcctggag

SEQ ID NO: 2359785 - DNA, 16 bp, Homo sapiens
ggctccctcctggagc

SEQ ID NO: 2359786 - DNA, 14 bp, Homo sapiens
ggctcctcagagcg

SEQ ID NO: 2359787 - DNA, 22 bp, Homo sapiens
ggctcctcagagcgccaggaag

SEQ ID NO: 2359788 - DNA, 11 bp, Homo sapiens
ggctcctgatc

SEQ ID NO: 2359789 - DNA, 15 bp, Homo sapiens
ggctcgccccaccca

SEQ ID NO: 2359790 - DNA, 20 bp, Homo sapiens
ggctcgccccacccagggct

SEQ ID NO: 2359791 - DNA, 22 bp, Homo sapiens
ggctcgggagccatgtcatgtg

SEQ ID NO: 2359792 - DNA, 16 bp, Homo sapiens
ggctctaccttcctgt

SEQ ID NO: 2359793 - DNA, 22 bp, Homo sapiens
ggctctgcagtcctactcaagc

SEQ ID NO: 2359794 - DNA, 15 bp, Homo sapiens
ggctcttcatctgcc

SEQ ID NO: 2359795 - DNA, 15 bp, Homo sapiens
ggctgagctctctgt

SEQ ID NO: 2359796 - DNA, 13 bp, Homo sapiens
ggctgaggccaga

SEQ ID NO: 2359797 - DNA, 18 bp, Homo sapiens
ggctgagggcctgctgga

SEQ ID NO: 2359798 - DNA, 18 bp, Homo sapiens
ggctgaggttcctctgcc

SEQ ID NO: 2359799 - DNA, 17 bp, Homo sapiens
ggctgcagttctactca

SEQ ID NO: 2359800 - DNA, 18 bp, Homo sapiens
ggctgccagacatggacc

SEQ ID NO: 2359801 - DNA, 19 bp, Homo sapiens
ggctgcctgtgggcttccc

SEQ ID NO: 2359802 - DNA, 20 bp, Homo sapiens
ggctggacttctacctgccc

SEQ ID NO: 2359803 - DNA, 17 bp, Homo sapiens
ggggaagggttttcttt

SEQ ID NO: 2359804 - DNA, 13 bp, Homo sapiens
ggggacagctgtg

SEQ ID NO: 2359805 - DNA, 11 bp, Homo sapiens
ggggaccctgt

SEQ ID NO: 2359806 - DNA, 21 bp, Homo sapiens
ggggagagacaggcagcccag

SEQ ID NO: 2359807 - DNA, 23 bp, Homo sapiens
ggggagagacaggcagcccagca

SEQ ID NO: 2359808 - DNA, 11 bp, Homo sapiens
ggggaggacca

SEQ ID NO: 2359809 - DNA, 12 bp, Homo sapiens
ggggagggcagg

SEQ ID NO: 2359810 - DNA, 14 bp, Homo sapiens
ggggagtagagaag

SEQ ID NO: 2359811 - DNA, 14 bp, Homo sapiens
ggggcaggctgggc

SEQ ID NO: 2359812 - DNA, 15 bp, Homo sapiens
ggggcaggctgggcc

SEQ ID NO: 2359813 - DNA, 16 bp, Homo sapiens
ggggcaggctgggcca

SEQ ID NO: 2359814 - DNA, 18 bp, Homo sapiens
ggggccaccaaagctgcc

SEQ ID NO: 2359815 - DNA, 15 bp, Homo sapiens
ggggccagaggctgg

SEQ ID NO: 2359816 - DNA, 16 bp, Homo sapiens
ggggccagaggctggg

SEQ ID NO: 2359817 - DNA, 21 bp, Homo sapiens
ggggccatttgcaataacagc

SEQ ID NO: 2359818 - DNA, 21 bp, Homo sapiens
ggggccgggcgcggtggctca

SEQ ID NO: 2359819 - DNA, 17 bp, Homo sapiens
ggggccttatcgggctc

SEQ ID NO: 2359820 - DNA, 22 bp, Homo sapiens
ggggctgggtccaccctgtcct

SEQ ID NO: 2359821 - DNA, 21 bp, Homo sapiens
ggggcttcatctctttagaga

SEQ ID NO: 2359822 - DNA, 18 bp, Homo sapiens
gggggctagggagacgcc

SEQ ID NO: 2359823 - DNA, 22 bp, Homo sapiens
ggggtaaagtatcacttttctg

SEQ ID NO: 2359824 - DNA, 13 bp, Homo sapiens
ggggtctccctgg

SEQ ID NO: 2359825 - DNA, 21 bp, Homo sapiens
ggggtctccctggctccctcc

SEQ ID NO: 2359826 - DNA, 17 bp, Homo sapiens
ggggtggaggcttcctg

SEQ ID NO: 2359827 - DNA, 13 bp, Homo sapiens
ggggttccctcct

SEQ ID NO: 2359828 - DNA, 22 bp, Homo sapiens
ggggttccctcctagctctccc

SEQ ID NO: 2359829 - DNA, 22 bp, Homo sapiens
ggggttcccttgagggctgcag

SEQ ID NO: 2359830 - DNA, 21 bp, Homo sapiens
gggtcactgaaccactgcttc

SEQ ID NO: 2359831 - DNA, 17 bp, Homo sapiens
gggtcatattcatacct

SEQ ID NO: 2359832 - DNA, 20 bp, Homo sapiens
gggtcctagcccttccctga

SEQ ID NO: 2359833 - DNA, 13 bp, Homo sapiens
gggtctccctggc

SEQ ID NO: 2359834 - DNA, 17 bp, Homo sapiens
gggtctccctggctccc

SEQ ID NO: 2359835 - DNA, 12 bp, Homo sapiens
gggtctctgaag

SEQ ID NO: 2359836 - DNA, 22 bp, Homo sapiens
gggtcttgctctgtcccccagg

SEQ ID NO: 2359837 - DNA, 22 bp, Homo sapiens
gggtctttgtggtagcttatct

SEQ ID NO: 2359838 - DNA, 13 bp, Homo sapiens
gggtgcagcccaa

SEQ ID NO: 2359839 - DNA, 16 bp, Homo sapiens
gggtgctactggggaa

SEQ ID NO: 2359840 - DNA, 15 bp, Homo sapiens
gggtgctgggaggag

SEQ ID NO: 2359841 - DNA, 21 bp, Homo sapiens
gggtgcttttatagaggctag

SEQ ID NO: 2359842 - DNA, 22 bp, Homo sapiens
gggtgcttttatagaggctagc

SEQ ID NO: 2359843 - DNA, 16 bp, Homo sapiens
gggtggaggcttcctg

SEQ ID NO: 2359844 - DNA, 13 bp, Homo sapiens
gggtggggaaagg

SEQ ID NO: 2359845 - DNA, 11 bp, Homo sapiens
gggtgtgggtt

SEQ ID NO: 2359846 - DNA, 14 bp, Homo sapiens
gggtgttctttcct

SEQ ID NO: 2359847 - DNA, 15 bp, Homo sapiens
gggttttcttttctt

SEQ ID NO: 2359848 - DNA, 20 bp, Homo sapiens
ggtaaaaacagcagctcata

SEQ ID NO: 2359849 - DNA, 18 bp, Homo sapiens
ggtaaaaagtggctgcgg

SEQ ID NO: 2359850 - DNA, 18 bp, Homo sapiens
ggtaaaacagggccacat

SEQ ID NO: 2359851 - DNA, 19 bp, Homo sapiens
ggtaaaactcactgtgatc

SEQ ID NO: 2359852 - DNA, 20 bp, Homo sapiens
ggtaaatggttaaattttac

SEQ ID NO: 2359853 - DNA, 22 bp, Homo sapiens
ggtaaattgtcgggggagagag

SEQ ID NO: 2359854 - DNA, 15 bp, Homo sapiens
ggtaacagaacagct

SEQ ID NO: 2359855 - DNA, 21 bp, Homo sapiens
ggtaacagaacagcttcaggt

SEQ ID NO: 2359856 - DNA, 15 bp, Homo sapiens
ggtacatatatacca

SEQ ID NO: 2359857 - DNA, 19 bp, Homo sapiens
ggtacccctttctggctct

SEQ ID NO: 2359858 - DNA, 11 bp, Homo sapiens
ggtagaagcca

SEQ ID NO: 2359859 - DNA, 11 bp, Homo sapiens
ggtagcctatt

SEQ ID NO: 2359860 - DNA, 14 bp, Homo sapiens
ggtagcgagctgct

SEQ ID NO: 2359861 - DNA, 18 bp, Homo sapiens
ggtagctgggaaagcata

SEQ ID NO: 2359862 - DNA, 13 bp, Homo sapiens
ggtagtactggga

SEQ ID NO: 2359863 - DNA, 20 bp, Homo sapiens
ggtcaagattttgaatgctt

SEQ ID NO: 2359864 - DNA, 23 bp, Homo sapiens
ggtcaaggcagtagaactccagg

SEQ ID NO: 2359865 - DNA, 20 bp, Homo sapiens
ggtcaagtaagaagacatga

SEQ ID NO: 2359866 - DNA, 17 bp, Homo sapiens
ggtcacaaagctattta

SEQ ID NO: 2359867 - DNA, 18 bp, Homo sapiens
ggtcactgtttcctgggc

SEQ ID NO: 2359868 - DNA, 20 bp, Homo sapiens
ggtcaggacggctcctcaga

SEQ ID NO: 2359869 - DNA, 12 bp, Homo sapiens
ggtcataaaata

SEQ ID NO: 2359870 - DNA, 14 bp, Homo sapiens
ggtcatcagatgcc

SEQ ID NO: 2359871 - DNA, 21 bp, Homo sapiens
ggtcatcagatgcctgcttga

SEQ ID NO: 2359872 - DNA, 21 bp, Homo sapiens
ggtccatagagatgagcccac

SEQ ID NO: 2359873 - DNA, 23 bp, Homo sapiens
ggtcccagttttgttgccccaga

SEQ ID NO: 2359874 - DNA, 19 bp, Homo sapiens
ggtccctcaggttcctttt

SEQ ID NO: 2359875 - DNA, 15 bp, Homo sapiens
ggtcctagtaagaag

SEQ ID NO: 2359876 - DNA, 15 bp, Homo sapiens
ggtcctctggagccc

SEQ ID NO: 2359877 - DNA, 21 bp, Homo sapiens
ggtcctgtcgccaccacttcc

SEQ ID NO: 2359878 - DNA, 16 bp, Homo sapiens
ggtcctttaggcagcc

SEQ ID NO: 2359879 - DNA, 19 bp, Homo sapiens
ggtcctttaggcagcctgc

SEQ ID NO: 2359880 - DNA, 21 bp, Homo sapiens
ggtcctttaggcagcctgccg

SEQ ID NO: 2359881 - DNA, 14 bp, Homo sapiens
ggtctccctggctc

SEQ ID NO: 2359882 - DNA, 15 bp, Homo sapiens
ggtctccctggctcc

SEQ ID NO: 2359883 - DNA, 20 bp, Homo sapiens
ggtctctgaagggacccccc

SEQ ID NO: 2359884 - DNA, 13 bp, Homo sapiens
ggtctctgctggg

SEQ ID NO: 2359885 - DNA, 17 bp, Homo sapiens
ggtctctttgctttctg

SEQ ID NO: 2359886 - DNA, 21 bp, Homo sapiens
ggtctgggctgggcacctgac

SEQ ID NO: 2359887 - DNA, 15 bp, Homo sapiens
ggtctgtctgctttg

SEQ ID NO: 2359888 - DNA, 12 bp, Homo sapiens
ggtctttgtaag

SEQ ID NO: 2359889 - DNA, 14 bp, Homo sapiens
ggtctttgtaagag

SEQ ID NO: 2359890 - DNA, 15 bp, Homo sapiens
ggtgaactgcaaagc

SEQ ID NO: 2359891 - DNA, 17 bp, Homo sapiens
ggtgaactgcaaagctt

SEQ ID NO: 2359892 - DNA, 18 bp, Homo sapiens
ggtgaatatggtggaaaa

SEQ ID NO: 2359893 - DNA, 18 bp, Homo sapiens
ggtgagacccatggctgt

SEQ ID NO: 2359894 - DNA, 14 bp, Homo sapiens
ggtgaggcccagcc

SEQ ID NO: 2359895 - DNA, 18 bp, Homo sapiens
ggtgagtccattctccca

SEQ ID NO: 2359896 - DNA, 14 bp, Homo sapiens
ggtgataagggaaa

SEQ ID NO: 2359897 - DNA, 16 bp, Homo sapiens
ggtgatggccagcccc

SEQ ID NO: 2359898 - DNA, 22 bp, Homo sapiens
ggtgcaaggagtgtaaaatgta

SEQ ID NO: 2359899 - DNA, 16 bp, Homo sapiens
ggtgccactttaccca

SEQ ID NO: 2359900 - DNA, 22 bp, Homo sapiens
ggtgccatgaagggaccctttg

SEQ ID NO: 2359901 - DNA, 15 bp, Homo sapiens
ggtgcccatcctgcc

SEQ ID NO: 2359902 - DNA, 17 bp, Homo sapiens
ggtgcctcagttttcct

SEQ ID NO: 2359903 - DNA, 22 bp, Homo sapiens
ggtgcctcagttttccttctgt

SEQ ID NO: 2359904 - DNA, 18 bp, Homo sapiens
ggtgcctgagaggcaggc

SEQ ID NO: 2359905 - DNA, 21 bp, Homo sapiens
ggtgcgtgttcagcagaacct

SEQ ID NO: 2359906 - DNA, 14 bp, Homo sapiens
ggtgctactgggga

SEQ ID NO: 2359907 - DNA, 21 bp, Homo sapiens
ggtgctactggggaaactggc

SEQ ID NO: 2359908 - DNA, 19 bp, Homo sapiens
ggtgctgactggcttcagc

SEQ ID NO: 2359909 - DNA, 15 bp, Homo sapiens
ggtgctgggaggagg

SEQ ID NO: 2359910 - DNA, 19 bp, Homo sapiens
ggtgcttttatagaggcta

SEQ ID NO: 2359911 - DNA, 20 bp, Homo sapiens
ggtggaagggtagagaggcg

SEQ ID NO: 2359912 - DNA, 13 bp, Homo sapiens
ggtggacccaggg

SEQ ID NO: 2359913 - DNA, 15 bp, Homo sapiens
ggtggagtttctctg

SEQ ID NO: 2359914 - DNA, 13 bp, Homo sapiens
ggtggccacagcg

SEQ ID NO: 2359915 - DNA, 11 bp, Homo sapiens
ggtggctgggc

SEQ ID NO: 2359916 - DNA, 16 bp, Homo sapiens
ggtggcttgagctaga

SEQ ID NO: 2359917 - DNA, 22 bp, Homo sapiens
ggtgggattttttcccttttta

SEQ ID NO: 2359918 - DNA, 20 bp, Homo sapiens
gtactttatcatgaatgctt

SEQ ID NO: 2359919 - DNA, 22 bp, Homo sapiens
gtagaaaaaggggcctgagtgg

SEQ ID NO: 2359920 - DNA, 11 bp, Homo sapiens
gtagaagccag

SEQ ID NO: 2359921 - DNA, 15 bp, Homo sapiens
gtagacatttataac

SEQ ID NO: 2359922 - DNA, 14 bp, Homo sapiens
gtagagagccgggc

SEQ ID NO: 2359923 - DNA, 14 bp, Homo sapiens
gtagattcatgaaa

SEQ ID NO: 2359924 - DNA, 15 bp, Homo sapiens
gtagcagagttaaat

SEQ ID NO: 2359925 - DNA, 20 bp, Homo sapiens
gtagcatttaaaatggaaaa

SEQ ID NO: 2359926 - DNA, 12 bp, Homo sapiens
gtagccacagct

SEQ ID NO: 2359927 - DNA, 12 bp, Homo sapiens
gtagcctgtgca

SEQ ID NO: 2359928 - DNA, 10 bp, Homo sapiens
gtagctcagt

SEQ ID NO: 2359929 - DNA, 11 bp, Homo sapiens
gtagctcagtc

SEQ ID NO: 2359930 - DNA, 16 bp, Homo sapiens
gtagctgcaaaaataa

SEQ ID NO: 2359931 - DNA, 22 bp, Homo sapiens
gtagctgggaaagcataaagct

SEQ ID NO: 2359932 - DNA, 23 bp, Homo sapiens
gtaggaggaaacagttctcactg

SEQ ID NO: 2359933 - DNA, 18 bp, Homo sapiens
gtaggggagggcaggctt

SEQ ID NO: 2359934 - DNA, 20 bp, Homo sapiens
gtaggggagggcaggcttgg

SEQ ID NO: 2359935 - DNA, 22 bp, Homo sapiens
gtaggggagggcaggcttgggg

SEQ ID NO: 2359936 - DNA, 15 bp, Homo sapiens
gtaggggtgtgtgtg

SEQ ID NO: 2359937 - DNA, 19 bp, Homo sapiens
gtaggttccgtatctccct

SEQ ID NO: 2359938 - DNA, 23 bp, Homo sapiens
gtagtcccagctacttgggaggc

SEQ ID NO: 2359939 - DNA, 12 bp, Homo sapiens
gtagtccccaac

SEQ ID NO: 2359940 - DNA, 19 bp, Homo sapiens
gtagtctcactgcttgaac

SEQ ID NO: 2359941 - DNA, 14 bp, Homo sapiens
gtagttaaataact

SEQ ID NO: 2359942 - DNA, 15 bp, Homo sapiens
gtagttaaataactg

SEQ ID NO: 2359943 - DNA, 18 bp, Homo sapiens
gtagtttagttctgttga

SEQ ID NO: 2359944 - DNA, 18 bp, Homo sapiens
gtataaataggagaggat

SEQ ID NO: 2359945 - DNA, 14 bp, Homo sapiens
gtataaatgtacat

SEQ ID NO: 2359946 - DNA, 17 bp, Homo sapiens
gtataatagagataagt

SEQ ID NO: 2359947 - DNA, 15 bp, Homo sapiens
gtataatattgaaaa

SEQ ID NO: 2359948 - DNA, 18 bp, Homo sapiens
gtataatgtttattaaat

SEQ ID NO: 2359949 - DNA, 21 bp, Homo sapiens
gtatacttccttacttttaag

SEQ ID NO: 2359950 - DNA, 12 bp, Homo sapiens
gtatataatttt

SEQ ID NO: 2359951 - DNA, 15 bp, Homo sapiens
gtatatacttaagaa

SEQ ID NO: 2359952 - DNA, 13 bp, Homo sapiens
gtatattacaatg

SEQ ID NO: 2359953 - DNA, 18 bp, Homo sapiens
gtatattacaatgatcac

SEQ ID NO: 2359954 - DNA, 14 bp, Homo sapiens
gtatcacttttctg

SEQ ID NO: 2359955 - DNA, 16 bp, Homo sapiens
gtatcagctacaattg

SEQ ID NO: 2359956 - DNA, 21 bp, Homo sapiens
gtatccaaggaaacattttat

SEQ ID NO: 2359957 - DNA, 22 bp, Homo sapiens
gtatcttgggtgtattctctgt

SEQ ID NO: 2359958 - DNA, 17 bp, Homo sapiens
gtatgaataatgaaaat

SEQ ID NO: 2359959 - DNA, 20 bp, Homo sapiens
gtatgactaaagagagaatg

SEQ ID NO: 2359960 - DNA, 22 bp, Homo sapiens
gtatgtgagctgtaaaaatgtt

SEQ ID NO: 2359961 - DNA, 16 bp, Homo sapiens
gtatgtgcatttaatt

SEQ ID NO: 2359962 - DNA, 16 bp, Homo sapiens
gtatgtgggggcttca

SEQ ID NO: 2359963 - DNA, 14 bp, Homo sapiens
gtatgtgtggctgt

SEQ ID NO: 2359964 - DNA, 18 bp, Homo sapiens
gtattgacaataagaaac

SEQ ID NO: 2359965 - DNA, 18 bp, Homo sapiens
gtattgtttaaaatgtaa

SEQ ID NO: 2359966 - DNA, 15 bp, Homo sapiens
gtatttaaaaacatt

SEQ ID NO: 2359967 - DNA, 17 bp, Homo sapiens
gtatttaaaaacatttt

SEQ ID NO: 2359968 - DNA, 11 bp, Homo sapiens
gtatttaacat

SEQ ID NO: 2359969 - DNA, 22 bp, Homo sapiens
gtatttatgggtggatttatcc

SEQ ID NO: 2359970 - DNA, 11 bp, Homo sapiens
gtatttccctt

SEQ ID NO: 2359971 - DNA, 12 bp, Homo sapiens
gtatttcccttc

SEQ ID NO: 2359972 - DNA, 17 bp, Homo sapiens
gtatttcccttccaaag

SEQ ID NO: 2359973 - DNA, 16 bp, Homo sapiens
gtatttcggctatgtc

SEQ ID NO: 2359974 - DNA, 17 bp, Homo sapiens
gtattttaagaagacat

SEQ ID NO: 2359975 - DNA, 24 bp, Homo sapiens
gtattttgtgtcctccaggagctt

SEQ ID NO: 2359976 - DNA, 16 bp, Homo sapiens
gtatttttttttctaa

SEQ ID NO: 2359977 - DNA, 18 bp, Homo sapiens
gtatttttttttctaaga

SEQ ID NO: 2359978 - DNA, 19 bp, Homo sapiens
gtcaacactcttcttgagc

SEQ ID NO: 2359979 - DNA, 21 bp, Homo sapiens
gtcaacctcgcgcttgctggc

SEQ ID NO: 2359980 - DNA, 14 bp, Homo sapiens
gtcaactacacaaa

SEQ ID NO: 2359981 - DNA, 14 bp, Homo sapiens
gtcaagattttgaa

SEQ ID NO: 2359982 - DNA, 22 bp, Homo sapiens
gtcaagctgctctgagccacag

SEQ ID NO: 2359983 - DNA, 18 bp, Homo sapiens
gtcaatcacagtctcagt

SEQ ID NO: 2359984 - DNA, 17 bp, Homo sapiens
gtcaatgggacctgtgg

SEQ ID NO: 2359985 - DNA, 19 bp, Homo sapiens
gtcaatgggacctgtggct

SEQ ID NO: 2359986 - DNA, 16 bp, Homo sapiens
gtcacaaagctattta

SEQ ID NO: 2359987 - DNA, 19 bp, Homo sapiens
gtcacaaagctatttaagt

SEQ ID NO: 2359988 - DNA, 16 bp, Homo sapiens
gtcacactgtggccag

SEQ ID NO: 2359989 - DNA, 15 bp, Homo sapiens
gtcacatccatccct

SEQ ID NO: 2359990 - DNA, 21 bp, Homo sapiens
gtcacatggcctatgcacata

SEQ ID NO: 2359991 - DNA, 23 bp, Homo sapiens
gtcacatggcctatgcacatatg

SEQ ID NO: 2359992 - DNA, 22 bp, Homo sapiens
gtcaccaaatagtgtgaaatat

SEQ ID NO: 2359993 - DNA, 17 bp, Homo sapiens
gtcaccttttctgtggc

SEQ ID NO: 2359994 - DNA, 15 bp, Homo sapiens
gtcactgaaccactg

SEQ ID NO: 2359995 - DNA, 16 bp, Homo sapiens
gtcactgaaccactgc

SEQ ID NO: 2359996 - DNA, 17 bp, Homo sapiens
gtcactgaaccactgct

SEQ ID NO: 2359997 - DNA, 21 bp, Homo sapiens
gtcactgaaccactgcttctc

SEQ ID NO: 2359998 - DNA, 22 bp, Homo sapiens
gtcactgaaccactgcttctct

SEQ ID NO: 2359999 - DNA, 18 bp, Homo sapiens
gtcactggaggttgaagc

SEQ ID NO: 2360000 - DNA, 14 bp, Homo sapiens
gtcactgtttcctg

SEQ ID NO: 2360001 - DNA, 21 bp, Homo sapiens
gtcacttaactataaggtgcc

SEQ ID NO: 2360002 - DNA, 17 bp, Homo sapiens
gtcagagtccagtgctc

SEQ ID NO: 2360003 - DNA, 22 bp, Homo sapiens
gtcagagtccagtgctctgcct

SEQ ID NO: 2360004 - DNA, 17 bp, Homo sapiens
gtcagctactaatgatg

SEQ ID NO: 2360005 - DNA, 17 bp, Homo sapiens
gtcagctctctgccctg

SEQ ID NO: 2360006 - DNA, 21 bp, Homo sapiens
gtcagctctctgccctgtgta

SEQ ID NO: 2360007 - DNA, 12 bp, Homo sapiens
gtcagctgaggc

SEQ ID NO: 2360008 - DNA, 16 bp, Homo sapiens
gtcaggctgaaaacaa

SEQ ID NO: 2360009 - DNA, 15 bp, Homo sapiens
gtcagtctttgctca

SEQ ID NO: 2360010 - DNA, 17 bp, Homo sapiens
gtcagtctttgctcagt

SEQ ID NO: 2360011 - DNA, 18 bp, Homo sapiens
gtcagtctttgctcagtg

SEQ ID NO: 2360012 - DNA, 19 bp, Homo sapiens
gtcagttgtgttttttaag

SEQ ID NO: 2360013 - DNA, 21 bp, Homo sapiens
gtcatagactcctttgctaat

SEQ ID NO: 2360014 - DNA, 20 bp, Homo sapiens
gtcatattcataccttctga

SEQ ID NO: 2360015 - DNA, 19 bp, Homo sapiens
gtcatcaaagcagaagtct

SEQ ID NO: 2360016 - DNA, 21 bp, Homo sapiens
gtcatctgtaagagcttgctc

SEQ ID NO: 2360017 - DNA, 23 bp, Homo sapiens
gtcatctgtaagagcttgctcca

SEQ ID NO: 2360018 - DNA, 13 bp, Homo sapiens
gtcatgattgccg

SEQ ID NO: 2360019 - DNA, 14 bp, Homo sapiens
gtcatgcataaata

SEQ ID NO: 2360020 - DNA, 17 bp, Homo sapiens
gtcatgcataaatatgc

SEQ ID NO: 2360021 - DNA, 19 bp, Homo sapiens
gtcattgcacataagcttc

SEQ ID NO: 2360022 - DNA, 18 bp, Homo sapiens
gtccaaaagattgctgaa

SEQ ID NO: 2360023 - DNA, 16 bp, Homo sapiens
gtccaaagaggctgcc

SEQ ID NO: 2360024 - DNA, 17 bp, Homo sapiens
gtccaagcaacagcctt

SEQ ID NO: 2360025 - DNA, 21 bp, Homo sapiens
gtccaagcaacagcctttgaa

SEQ ID NO: 2360026 - DNA, 22 bp, Homo sapiens
gtccaagcaacagcctttgaat

SEQ ID NO: 2360027 - DNA, 16 bp, Homo sapiens
gtccaccctgcctgcc

SEQ ID NO: 2360028 - DNA, 19 bp, Homo sapiens
gtccacgcgtgccgtggca

SEQ ID NO: 2360029 - DNA, 15 bp, Homo sapiens
gtccagacccaagtc

SEQ ID NO: 2360030 - DNA, 12 bp, Homo sapiens
gtccagctggcc

SEQ ID NO: 2360031 - DNA, 13 bp, Homo sapiens
gtccagctggcct

SEQ ID NO: 2360032 - DNA, 18 bp, Homo sapiens
gtccagctggcctggaca

SEQ ID NO: 2360033 - DNA, 18 bp, Homo sapiens
gtgaattattgacactga

SEQ ID NO: 2360034 - DNA, 13 bp, Homo sapiens
gtgaatttttaag

SEQ ID NO: 2360035 - DNA, 16 bp, Homo sapiens
gtgacaaataagatta

SEQ ID NO: 2360036 - DNA, 14 bp, Homo sapiens
gtgacagagccatg

SEQ ID NO: 2360037 - DNA, 22 bp, Homo sapiens
gtgacatggtgcctgagaggca

SEQ ID NO: 2360038 - DNA, 24 bp, Homo sapiens
gtgacatggtgcctgagaggcagg

SEQ ID NO: 2360039 - DNA, 16 bp, Homo sapiens
gtgacatgtgaaacct

SEQ ID NO: 2360040 - DNA, 22 bp, Homo sapiens
gtgacatgtgaaacctttttta

SEQ ID NO: 2360041 - DNA, 23 bp, Homo sapiens
gtgacctgaggatttaagggatg

SEQ ID NO: 2360042 - DNA, 16 bp, Homo sapiens
gtgacctttgacctcg

SEQ ID NO: 2360043 - DNA, 24 bp, Homo sapiens
gtgacggtcctttaggcagcctgc

SEQ ID NO: 2360044 - DNA, 13 bp, Homo sapiens
gtgagcagaacag

SEQ ID NO: 2360045 - DNA, 16 bp, Homo sapiens
gtgagcagaacaggta

SEQ ID NO: 2360046 - DNA, 19 bp, Homo sapiens
gtgagccaccgtgcctggc

SEQ ID NO: 2360047 - DNA, 14 bp, Homo sapiens
gtgagccccacagc

SEQ ID NO: 2360048 - DNA, 17 bp, Homo sapiens
gtgagcctcctgtgcct

SEQ ID NO: 2360049 - DNA, 18 bp, Homo sapiens
gtgagcctcctgtgcctg

SEQ ID NO: 2360050 - DNA, 19 bp, Homo sapiens
gtgagcctcctgtgcctgg

SEQ ID NO: 2360051 - DNA, 20 bp, Homo sapiens
gtgagcctcctgtgcctggc

SEQ ID NO: 2360052 - DNA, 14 bp, Homo sapiens
gtgaggcccagcct

SEQ ID NO: 2360053 - DNA, 15 bp, Homo sapiens
gtgaggcccagcctg

SEQ ID NO: 2360054 - DNA, 16 bp, Homo sapiens
gtgaggcccagcctgt

SEQ ID NO: 2360055 - DNA, 23 bp, Homo sapiens
gtgaggcccagcctgtcctggta

SEQ ID NO: 2360056 - DNA, 13 bp, Homo sapiens
gtgagggagggga

SEQ ID NO: 2360057 - DNA, 21 bp, Homo sapiens
gtgagggaggggaaaagcatt

SEQ ID NO: 2360058 - DNA, 21 bp, Homo sapiens
gtgagtttgagctgccttccc

SEQ ID NO: 2360059 - DNA, 21 bp, Homo sapiens
gtgataagggaaaagataaag

SEQ ID NO: 2360060 - DNA, 16 bp, Homo sapiens
gtgatatggcagaaga

SEQ ID NO: 2360061 - DNA, 13 bp, Homo sapiens
gtgatctgggcat

SEQ ID NO: 2360062 - DNA, 22 bp, Homo sapiens
gtgatctgggcattttcctcct

SEQ ID NO: 2360063 - DNA, 14 bp, Homo sapiens
gtgatcttaaaata

SEQ ID NO: 2360064 - DNA, 16 bp, Homo sapiens
gtgatggccagcccct

SEQ ID NO: 2360065 - DNA, 19 bp, Homo sapiens
gtgattacctgaaagccct

SEQ ID NO: 2360066 - DNA, 14 bp, Homo sapiens
gtgattcaatctgt

SEQ ID NO: 2360067 - DNA, 22 bp, Homo sapiens
gtgattccactacacctggctg

SEQ ID NO: 2360068 - DNA, 23 bp, Homo sapiens
gtgattccactacacctggctga

SEQ ID NO: 2360069 - DNA, 13 bp, Homo sapiens
gtgattctgcctt

SEQ ID NO: 2360070 - DNA, 14 bp, Homo sapiens
gtgatttgaaaaat

SEQ ID NO: 2360071 - DNA, 22 bp, Homo sapiens
gtgatttgaaaaatataaaatt

SEQ ID NO: 2360072 - DNA, 14 bp, Homo sapiens
gtgatttgaattct

SEQ ID NO: 2360073 - DNA, 19 bp, Homo sapiens
gtgcaaaatatttgactat

SEQ ID NO: 2360074 - DNA, 23 bp, Homo sapiens
gtgcaatgcttgtagaagtagga

SEQ ID NO: 2360075 - DNA, 22 bp, Homo sapiens
gtgcaattgtaggggtgtgtgt

SEQ ID NO: 2360076 - DNA, 20 bp, Homo sapiens
gtgcacaccccactcccaca

SEQ ID NO: 2360077 - DNA, 13 bp, Homo sapiens
gtgcacatttctt

SEQ ID NO: 2360078 - DNA, 13 bp, Homo sapiens
gtgcacccacctg

SEQ ID NO: 2360079 - DNA, 14 bp, Homo sapiens
gtgcacccacctgt

SEQ ID NO: 2360080 - DNA, 15 bp, Homo sapiens
gtgcacccacctgtt

SEQ ID NO: 2360081 - DNA, 13 bp, Homo sapiens
gtgcactgggagg

SEQ ID NO: 2360082 - DNA, 20 bp, Homo sapiens
gtgcactgggaggctcccct

SEQ ID NO: 2360083 - DNA, 16 bp, Homo sapiens
gtgcagagccttctca

SEQ ID NO: 2360084 - DNA, 14 bp, Homo sapiens
gtgcagccttctcc

SEQ ID NO: 2360085 - DNA, 19 bp, Homo sapiens
gtgcataatgataaaataa

SEQ ID NO: 2360086 - DNA, 22 bp, Homo sapiens
gtgcatagttgtagacaaagta

SEQ ID NO: 2360087 - DNA, 14 bp, Homo sapiens
gtgccaatttcaag

SEQ ID NO: 2360088 - DNA, 20 bp, Homo sapiens
gtgccacccagtagcccaga

SEQ ID NO: 2360089 - DNA, 17 bp, Homo sapiens
gtgccactgacttgctg

SEQ ID NO: 2360090 - DNA, 17 bp, Homo sapiens
gtgccaggctgtaagca

SEQ ID NO: 2360091 - DNA, 23 bp, Homo sapiens
gtgccagggctgggccccttcca

SEQ ID NO: 2360092 - DNA, 14 bp, Homo sapiens
gtgccagttgggct

SEQ ID NO: 2360093 - DNA, 17 bp, Homo sapiens
gtgccatggatctgatc

SEQ ID NO: 2360094 - DNA, 12 bp, Homo sapiens
gtgccatgtctg

SEQ ID NO: 2360095 - DNA, 18 bp, Homo sapiens
gtgccccagggagtccag

SEQ ID NO: 2360096 - DNA, 13 bp, Homo sapiens
gtgccccatgtcc

SEQ ID NO: 2360097 - DNA, 21 bp, Homo sapiens
gtgccctctcccaccctcttc

SEQ ID NO: 2360098 - DNA, 13 bp, Homo sapiens
gtgccgtggcacc

SEQ ID NO: 2360099 - DNA, 19 bp, Homo sapiens
gtgcctatttgtgtggaca

SEQ ID NO: 2360100 - DNA, 16 bp, Homo sapiens
gtgcctcagttttcct

SEQ ID NO: 2360101 - DNA, 19 bp, Homo sapiens
gtgcctcagttttccttct

SEQ ID NO: 2360102 - DNA, 15 bp, Homo sapiens
gtgcctcgcatccta

SEQ ID NO: 2360103 - DNA, 21 bp, Homo sapiens
gtgcctcgcatcctatgctta

SEQ ID NO: 2360104 - DNA, 16 bp, Homo sapiens
gtgcctgagaggcagg

SEQ ID NO: 2360105 - DNA, 17 bp, Homo sapiens
gtgcctgagaggcaggc

SEQ ID NO: 2360106 - DNA, 18 bp, Homo sapiens
gtgcctgagaggcaggca

SEQ ID NO: 2360107 - DNA, 14 bp, Homo sapiens
gtgcctggccccag

SEQ ID NO: 2360108 - DNA, 17 bp, Homo sapiens
gtgcctggccccagcct

SEQ ID NO: 2360109 - DNA, 22 bp, Homo sapiens
gtgcctggccccagcctgggcc

SEQ ID NO: 2360110 - DNA, 12 bp, Homo sapiens
gtgcctggcctg

SEQ ID NO: 2360111 - DNA, 19 bp, Homo sapiens
gtgcctggcctggcacaca

SEQ ID NO: 2360112 - DNA, 19 bp, Homo sapiens
gtgccttacatcttttcta

SEQ ID NO: 2360113 - DNA, 15 bp, Homo sapiens
gtgcgtgtgtagagt

SEQ ID NO: 2360114 - DNA, 22 bp, Homo sapiens
gtgctataatctgtttttacgt

SEQ ID NO: 2360115 - DNA, 21 bp, Homo sapiens
gtgctatactgcatacttttt

SEQ ID NO: 2360116 - DNA, 20 bp, Homo sapiens
gtgctcaccagccctgcagc

SEQ ID NO: 2360117 - DNA, 18 bp, Homo sapiens
gtgctcacgactcttcct

SEQ ID NO: 2360118 - DNA, 17 bp, Homo sapiens
gtgctcccctgccacac

SEQ ID NO: 2360119 - DNA, 20 bp, Homo sapiens
gtgctcccctgccacactga

SEQ ID NO: 2360120 - DNA, 14 bp, Homo sapiens
gtgctcctccttgg

SEQ ID NO: 2360121 - DNA, 17 bp, Homo sapiens
gtgctctcagctggcag

SEQ ID NO: 2360122 - DNA, 13 bp, Homo sapiens
gtgctctccattc

SEQ ID NO: 2360123 - DNA, 22 bp, Homo sapiens
gtgctctccattctgctccttc

SEQ ID NO: 2360124 - DNA, 14 bp, Homo sapiens
gtgctctgcctcag

SEQ ID NO: 2360125 - DNA, 21 bp, Homo sapiens
gtgctgacaacttagctcagg

SEQ ID NO: 2360126 - DNA, 22 bp, Homo sapiens
gtgctgacaacttagctcaggt

SEQ ID NO: 2360127 - DNA, 20 bp, Homo sapiens
gtgctgcgcctgcaggcaga

SEQ ID NO: 2360128 - DNA, 17 bp, Homo sapiens
gtgctgctctagggcag

SEQ ID NO: 2360129 - DNA, 19 bp, Homo sapiens
gtgctgggaggagggagag

SEQ ID NO: 2360130 - DNA, 16 bp, Homo sapiens
gtgctgtgagggaggg

SEQ ID NO: 2360131 - DNA, 20 bp, Homo sapiens
gtgcttgaaggccctgctga

SEQ ID NO: 2360132 - DNA, 23 bp, Homo sapiens
gtgcttgctggtgcctgccacct

SEQ ID NO: 2360133 - DNA, 20 bp, Homo sapiens
gtggaaataatttgaatgta

SEQ ID NO: 2360134 - DNA, 17 bp, Homo sapiens
gtggaaggcagagaaat

SEQ ID NO: 2360135 - DNA, 21 bp, Homo sapiens
gtggacaggcgcctggtgtga

SEQ ID NO: 2360136 - DNA, 14 bp, Homo sapiens
gtggactctgcaca

SEQ ID NO: 2360137 - DNA, 13 bp, Homo sapiens
gtggactgtattt

SEQ ID NO: 2360138 - DNA, 17 bp, Homo sapiens
gtggagaaaattggaac

SEQ ID NO: 2360139 - DNA, 18 bp, Homo sapiens
gtggagaccctgccacag

SEQ ID NO: 2360140 - DNA, 22 bp, Homo sapiens
gtggagaccctgccacagccag

SEQ ID NO: 2360141 - DNA, 23 bp, Homo sapiens
gtggagaccctgccacagccaga

SEQ ID NO: 2360142 - DNA, 16 bp, Homo sapiens
gtggaggaagagccac

SEQ ID NO: 2360143 - DNA, 20 bp, Homo sapiens
gtggaggaagagccacctgc

SEQ ID NO: 2360144 - DNA, 21 bp, Homo sapiens
gtggaggaagagccacctgca

SEQ ID NO: 2360145 - DNA, 13 bp, Homo sapiens
gtggaggaaggat

SEQ ID NO: 2360146 - DNA, 20 bp, Homo sapiens
gtggaggaaggattgtaaaa

SEQ ID NO: 2360147 - DNA, 15 bp, Homo sapiens
gttcctctgcctgcc

SEQ ID NO: 2360148 - DNA, 23 bp, Homo sapiens
gttcctctgctcaccgcccatca

SEQ ID NO: 2360149 - DNA, 22 bp, Homo sapiens
gttcctgctgctgtctgggtgc

SEQ ID NO: 2360150 - DNA, 15 bp, Homo sapiens
gttcctggtgactcc

SEQ ID NO: 2360151 - DNA, 16 bp, Homo sapiens
gttcctggtgactcct

SEQ ID NO: 2360152 - DNA, 21 bp, Homo sapiens
gttcgaaatagatatcctctc

SEQ ID NO: 2360153 - DNA, 21 bp, Homo sapiens
gttctaattaagaaaactatt

SEQ ID NO: 2360154 - DNA, 13 bp, Homo sapiens
gttctactcaggc

SEQ ID NO: 2360155 - DNA, 13 bp, Homo sapiens
gttctaggaaaat

SEQ ID NO: 2360156 - DNA, 15 bp, Homo sapiens
gttctcactgggaag

SEQ ID NO: 2360157 - DNA, 19 bp, Homo sapiens
gttctcatgaagcaggagg

SEQ ID NO: 2360158 - DNA, 19 bp, Homo sapiens
gttctccaagaaactgaat

SEQ ID NO: 2360159 - DNA, 12 bp, Homo sapiens
gttctctttgga

SEQ ID NO: 2360160 - DNA, 13 bp, Homo sapiens
gttctgcagtcat

SEQ ID NO: 2360161 - DNA, 20 bp, Homo sapiens
gttcttatgaggaggggagg

SEQ ID NO: 2360162 - DNA, 17 bp, Homo sapiens
gttcttatttttataac

SEQ ID NO: 2360163 - DNA, 13 bp, Homo sapiens
gttctttcctgcc

SEQ ID NO: 2360164 - DNA, 17 bp, Homo sapiens
gttctttcctgccctgt

SEQ ID NO: 2360165 - DNA, 19 bp, Homo sapiens
gttctttcctgccctgtcc

SEQ ID NO: 2360166 - DNA, 12 bp, Homo sapiens
gttctttctggg

SEQ ID NO: 2360167 - DNA, 15 bp, Homo sapiens
gttgactgactgagc

SEQ ID NO: 2360168 - DNA, 19 bp, Homo sapiens
gttgagcatgacagcctgc

SEQ ID NO: 2360169 - DNA, 17 bp, Homo sapiens
gttgagccccagtgctg

SEQ ID NO: 2360170 - DNA, 19 bp, Homo sapiens
gttgagccccagtgctgga

SEQ ID NO: 2360171 - DNA, 20 bp, Homo sapiens
gttgaggccgaggataaaga

SEQ ID NO: 2360172 - DNA, 13 bp, Homo sapiens
gttgatctgctct

SEQ ID NO: 2360173 - DNA, 14 bp, Homo sapiens
gttgatctgctctg

SEQ ID NO: 2360174 - DNA, 17 bp, Homo sapiens
gttgcaaagagacattt

SEQ ID NO: 2360175 - DNA, 15 bp, Homo sapiens
gttgcaagatgtgaa

SEQ ID NO: 2360176 - DNA, 16 bp, Homo sapiens
gttgcatagcagtata

SEQ ID NO: 2360177 - DNA, 15 bp, Homo sapiens
gttgcccccatttct

SEQ ID NO: 2360178 - DNA, 19 bp, Homo sapiens
gttgcccctttctcttttc

SEQ ID NO: 2360179 - DNA, 20 bp, Homo sapiens
gttgcccgaaactaagccag

SEQ ID NO: 2360180 - DNA, 18 bp, Homo sapiens
gttgctgctgtccagtgc

SEQ ID NO: 2360181 - DNA, 20 bp, Homo sapiens
gttgctgctgtccagtgcct

SEQ ID NO: 2360182 - DNA, 14 bp, Homo sapiens
gttggaaggatctg

SEQ ID NO: 2360183 - DNA, 18 bp, Homo sapiens
gttggaaggatctgctga

SEQ ID NO: 2360184 - DNA, 19 bp, Homo sapiens
gttggaaggatctgctgag

SEQ ID NO: 2360185 - DNA, 23 bp, Homo sapiens
gttgggaatgaggaaaattctta

SEQ ID NO: 2360186 - DNA, 14 bp, Homo sapiens
gttgggcagccaga

SEQ ID NO: 2360187 - DNA, 19 bp, Homo sapiens
gttgggcagccagaccagc

SEQ ID NO: 2360188 - DNA, 14 bp, Homo sapiens
gttggtaaacagtt

SEQ ID NO: 2360189 - DNA, 18 bp, Homo sapiens
gttggtatattttatatt

SEQ ID NO: 2360190 - DNA, 15 bp, Homo sapiens
gttggttctgcacta

SEQ ID NO: 2360191 - DNA, 12 bp, Homo sapiens
gttgtaaagata

SEQ ID NO: 2360192 - DNA, 23 bp, Homo sapiens
gttgtaaagatattgtatctcct

SEQ ID NO: 2360193 - DNA, 15 bp, Homo sapiens
gttgtcaaggaagaa

SEQ ID NO: 2360194 - DNA, 20 bp, Homo sapiens
gttgtcaaggaagaagaaat

SEQ ID NO: 2360195 - DNA, 17 bp, Homo sapiens
gttgtgatctgttgtaa

SEQ ID NO: 2360196 - DNA, 16 bp, Homo sapiens
gttgtgttttttaaga

SEQ ID NO: 2360197 - DNA, 24 bp, Homo sapiens
gttgttccagggagcttctacctg

SEQ ID NO: 2360198 - DNA, 11 bp, Homo sapiens
gttgtttcttt

SEQ ID NO: 2360199 - DNA, 14 bp, Homo sapiens
gttgttttgtggat

SEQ ID NO: 2360200 - DNA, 19 bp, Homo sapiens
gttgtttttaagtcctgta

SEQ ID NO: 2360201 - DNA, 22 bp, Homo sapiens
gtttaaaataaaatgaaaattg

SEQ ID NO: 2360202 - DNA, 18 bp, Homo sapiens
gtttaatgggtatgctca

SEQ ID NO: 2360203 - DNA, 22 bp, Homo sapiens
gtttacatggcgccctgcctcc

SEQ ID NO: 2360204 - DNA, 21 bp, Homo sapiens
gtttacctggcttatttaata

SEQ ID NO: 2360205 - DNA, 13 bp, Homo sapiens
gtttacctttctc

SEQ ID NO: 2360206 - DNA, 12 bp, Homo sapiens
gtttagctctga

SEQ ID NO: 2360207 - DNA, 13 bp, Homo sapiens
gtttagctctgag

SEQ ID NO: 2360208 - DNA, 14 bp, Homo sapiens
gtttagctctgaga

SEQ ID NO: 2360209 - DNA, 18 bp, Homo sapiens
gtttagtggctcaacatt

SEQ ID NO: 2360210 - DNA, 14 bp, Homo sapiens
gtttataaacagaa

SEQ ID NO: 2360211 - DNA, 19 bp, Homo sapiens
gtttatatggaagaaagta

SEQ ID NO: 2360212 - DNA, 13 bp, Homo sapiens
gtttatgagccag

SEQ ID NO: 2360213 - DNA, 18 bp, Homo sapiens
gtttattaactactgaat

SEQ ID NO: 2360214 - DNA, 19 bp, Homo sapiens
gtttattttcaagaataat

SEQ ID NO: 2360215 - DNA, 22 bp, Homo sapiens
gtttcaaagtgatagaaaagtg

SEQ ID NO: 2360216 - DNA, 17 bp, Homo sapiens
gtttcaagttttaaagt

SEQ ID NO: 2360217 - DNA, 16 bp, Homo sapiens
gtttcaggtgacatgt

SEQ ID NO: 2360218 - DNA, 17 bp, Homo sapiens
gtttctattttttgaaa

SEQ ID NO: 2360219 - DNA, 17 bp, Homo sapiens
gtttctccttgaaatga

SEQ ID NO: 2360220 - DNA, 17 bp, Homo sapiens
gtttctgactctgagct

SEQ ID NO: 2360221 - DNA, 20 bp, Homo sapiens
gtttctgcattcatttttat

SEQ ID NO: 2360222 - DNA, 13 bp, Homo sapiens
gtttctgtcaagc

SEQ ID NO: 2360223 - DNA, 16 bp, Homo sapiens
gtttgaaagtaaaaac

SEQ ID NO: 2360224 - DNA, 13 bp, Homo sapiens
gtttgaatgtttt

SEQ ID NO: 2360225 - DNA, 15 bp, Homo sapiens
gtttgagctgccttc

SEQ ID NO: 2360226 - DNA, 18 bp, Homo sapiens
gtttgagctgccttccct

SEQ ID NO: 2360227 - DNA, 13 bp, Homo sapiens
gtttgctgtgaac

SEQ ID NO: 2360228 - DNA, 17 bp, Homo sapiens
gtttggaaaagtggcgt

SEQ ID NO: 2360229 - DNA, 16 bp, Homo sapiens
gtttggaatattaaaa

SEQ ID NO: 2360230 - DNA, 20 bp, Homo sapiens
gtttgtcctttttcactttg

SEQ ID NO: 2360231 - DNA, 13 bp, Homo sapiens
gtttgttggaaag

SEQ ID NO: 2360232 - DNA, 15 bp, Homo sapiens
gttttactgtctatt

SEQ ID NO: 2360233 - DNA, 18 bp, Homo sapiens
gttttacttttaaactgt

SEQ ID NO: 2360234 - DNA, 21 bp, Homo sapiens
gttttatactgaaggaaaaac

SEQ ID NO: 2360235 - DNA, 15 bp, Homo sapiens
gttttccttctgtta

SEQ ID NO: 2360236 - DNA, 15 bp, Homo sapiens
gttttctcctctgct

SEQ ID NO: 2360237 - DNA, 16 bp, Homo sapiens
gttttctgaaacacac

SEQ ID NO: 2360238 - DNA, 14 bp, Homo sapiens
gttttcttcgtgga

SEQ ID NO: 2360239 - DNA, 13 bp, Homo sapiens
gttttcttctttc

SEQ ID NO: 2360240 - DNA, 22 bp, Homo sapiens
gttttcttttttaaatgtttct

SEQ ID NO: 2360241 - DNA, 21 bp, Homo sapiens
gttttgaaaagctattagcca

SEQ ID NO: 2360242 - DNA, 14 bp, Homo sapiens
gttttgtaaaagaa

SEQ ID NO: 2360243 - DNA, 22 bp, Homo sapiens
gtttttaaataaagaacaattg

SEQ ID NO: 2360244 - DNA, 13 bp, Homo sapiens
gtttttagaacat

SEQ ID NO: 2360245 - DNA, 12 bp, Homo sapiens
gtttttcacatt

SEQ ID NO: 2360246 - DNA, 18 bp, Homo sapiens
gtttttgtaaagcccttg

SEQ ID NO: 2360247 - DNA, 18 bp, Homo sapiens
gttttttaagatagtgta

SEQ ID NO: 2360248 - DNA, 17 bp, Homo sapiens
taaaaaaaaatgccttt

SEQ ID NO: 2360249 - DNA, 22 bp, Homo sapiens
taaaaaaaccaccaaaaacaaa

SEQ ID NO: 2360250 - DNA, 15 bp, Homo sapiens
taaaaaaatttaagt

SEQ ID NO: 2360251 - DNA, 15 bp, Homo sapiens
taaaaacaactttca

SEQ ID NO: 2360252 - DNA, 12 bp, Homo sapiens
taaaaacatttt

SEQ ID NO: 2360253 - DNA, 22 bp, Homo sapiens
taaaaacattttttatacattt

SEQ ID NO: 2360254 - DNA, 18 bp, Homo sapiens
taaaaagattgaagtatt

SEQ ID NO: 2360255 - DNA, 13 bp, Homo sapiens
taaaaaggaacaa

SEQ ID NO: 2360256 - DNA, 16 bp, Homo sapiens
taaaaatatgtaattt

SEQ ID NO: 2360257 - DNA, 18 bp, Homo sapiens
taaaaatcttttgaagca

SEQ ID NO: 2360258 - DNA, 16 bp, Homo sapiens
taaaaatgagatttct

SEQ ID NO: 2360259 - DNA, 20 bp, Homo sapiens
taaaaattacctttaatttt

SEQ ID NO: 2360260 - DNA, 11 bp, Homo sapiens
taaaaatttat

SEQ ID NO: 2360261 - DNA, 12 bp, Homo sapiens
taaaaatttata

SEQ ID NO: 2360262 - DNA, 11 bp, Homo sapiens
taaaacaaata

SEQ ID NO: 2360263 - DNA, 12 bp, Homo sapiens
taaattttagaa

SEQ ID NO: 2360264 - DNA, 16 bp, Homo sapiens
taaatttttttcctta

SEQ ID NO: 2360265 - DNA, 22 bp, Homo sapiens
taacaaaagcacacaacgatta

SEQ ID NO: 2360266 - DNA, 14 bp, Homo sapiens
taacaacaattatt

SEQ ID NO: 2360267 - DNA, 16 bp, Homo sapiens
taacaagaaagtggtc

SEQ ID NO: 2360268 - DNA, 19 bp, Homo sapiens
taacaagatgtttcatttt

SEQ ID NO: 2360269 - DNA, 22 bp, Homo sapiens
taacaagatgtttcattttact

SEQ ID NO: 2360270 - DNA, 23 bp, Homo sapiens
taacaaggagatttcttagttca

SEQ ID NO: 2360271 - DNA, 21 bp, Homo sapiens
taacaatacatgagaaagatg

SEQ ID NO: 2360272 - DNA, 13 bp, Homo sapiens
taacaatgttaag

SEQ ID NO: 2360273 - DNA, 22 bp, Homo sapiens
taacaatgttaaggaaactctt

SEQ ID NO: 2360274 - DNA, 23 bp, Homo sapiens
taacacaggataaagttattctt

SEQ ID NO: 2360275 - DNA, 17 bp, Homo sapiens
taacacattaaatgtgg

SEQ ID NO: 2360276 - DNA, 12 bp, Homo sapiens
taacacattttt

SEQ ID NO: 2360277 - DNA, 19 bp, Homo sapiens
taacacatttttttgcatg

SEQ ID NO: 2360278 - DNA, 21 bp, Homo sapiens
taacagaaaaatgaaatttaa

SEQ ID NO: 2360279 - DNA, 12 bp, Homo sapiens
taacagaacagc

SEQ ID NO: 2360280 - DNA, 14 bp, Homo sapiens
taacagaacagctt

SEQ ID NO: 2360281 - DNA, 18 bp, Homo sapiens
taacagaacagcttcagg

SEQ ID NO: 2360282 - DNA, 23 bp, Homo sapiens
taacagagtgatttgtaaaacag

SEQ ID NO: 2360283 - DNA, 12 bp, Homo sapiens
taacagctgcaa

SEQ ID NO: 2360284 - DNA, 22 bp, Homo sapiens
taacagtaactgccattttttg

SEQ ID NO: 2360285 - DNA, 21 bp, Homo sapiens
taacagtatgtgggatattga

SEQ ID NO: 2360286 - DNA, 18 bp, Homo sapiens
taacatacaagaaaatgt

SEQ ID NO: 2360287 - DNA, 20 bp, Homo sapiens
taacatcgaaaagttatttt

SEQ ID NO: 2360288 - DNA, 23 bp, Homo sapiens
taacatgaaaaacacggcagctg

SEQ ID NO: 2360289 - DNA, 19 bp, Homo sapiens
taacattaccttactgtgg

SEQ ID NO: 2360290 - DNA, 17 bp, Homo sapiens
taacattttacagtaaa

SEQ ID NO: 2360291 - DNA, 18 bp, Homo sapiens
taacattttacagtaaat

SEQ ID NO: 2360292 - DNA, 16 bp, Homo sapiens
taaccagaattataca

SEQ ID NO: 2360293 - DNA, 21 bp, Homo sapiens
taacccattccagtacagtat

SEQ ID NO: 2360294 - DNA, 20 bp, Homo sapiens
taacccttcatcttcctgtg

SEQ ID NO: 2360295 - DNA, 17 bp, Homo sapiens
taaccctttgtgtgctc

SEQ ID NO: 2360296 - DNA, 17 bp, Homo sapiens
taacctagttaaagaaa

SEQ ID NO: 2360297 - DNA, 20 bp, Homo sapiens
taacctagttaaagaaagga

SEQ ID NO: 2360298 - DNA, 22 bp, Homo sapiens
taacctagttaaagaaaggaaa

SEQ ID NO: 2360299 - DNA, 14 bp, Homo sapiens
taacgcaaccaagt

SEQ ID NO: 2360300 - DNA, 19 bp, Homo sapiens
taacgtttttcctttaaaa

SEQ ID NO: 2360301 - DNA, 19 bp, Homo sapiens
taactaaattttaaagcca

SEQ ID NO: 2360302 - DNA, 19 bp, Homo sapiens
taactataaggtgcctcag

SEQ ID NO: 2360303 - DNA, 22 bp, Homo sapiens
taactcaaggataccttcttat

SEQ ID NO: 2360304 - DNA, 23 bp, Homo sapiens
taactcaaggataccttcttatt

SEQ ID NO: 2360305 - DNA, 17 bp, Homo sapiens
taactcagacattccaa

SEQ ID NO: 2360306 - DNA, 21 bp, Homo sapiens
taactcataatttttgcagaa

SEQ ID NO: 2360307 - DNA, 15 bp, Homo sapiens
taactctctttcctt

SEQ ID NO: 2360308 - DNA, 22 bp, Homo sapiens
taactctctttccttgagctgt

SEQ ID NO: 2360309 - DNA, 18 bp, Homo sapiens
taactctgtataatagag

SEQ ID NO: 2360310 - DNA, 20 bp, Homo sapiens
taactgaaaatgtgctatac

SEQ ID NO: 2360311 - DNA, 14 bp, Homo sapiens
taactgagagaaag

SEQ ID NO: 2360312 - DNA, 22 bp, Homo sapiens
taactgccattttttgtctgtg

SEQ ID NO: 2360313 - DNA, 21 bp, Homo sapiens
taactggccttacgatggcaa

SEQ ID NO: 2360314 - DNA, 22 bp, Homo sapiens
taactggccttacgatggcaat

SEQ ID NO: 2360315 - DNA, 21 bp, Homo sapiens
taactgtcaggctgaaaacaa

SEQ ID NO: 2360316 - DNA, 21 bp, Homo sapiens
taacttagactctagtattta

SEQ ID NO: 2360317 - DNA, 20 bp, Homo sapiens
taacttgcttaaatttctta

SEQ ID NO: 2360318 - DNA, 13 bp, Homo sapiens
taacttttccaag

SEQ ID NO: 2360319 - DNA, 22 bp, Homo sapiens
taacttttccaagcaaaatcta

SEQ ID NO: 2360320 - DNA, 22 bp, Homo sapiens
taacttttttgtggcaattagt

SEQ ID NO: 2360321 - DNA, 18 bp, Homo sapiens
taagaaacagtttaacag

SEQ ID NO: 2360322 - DNA, 19 bp, Homo sapiens
taagaaacatgatgtgaga

SEQ ID NO: 2360323 - DNA, 19 bp, Homo sapiens
taagaaagcctaaaattga

SEQ ID NO: 2360324 - DNA, 22 bp, Homo sapiens
taagaagaagttcatgtccaaa

SEQ ID NO: 2360325 - DNA, 21 bp, Homo sapiens
taagaagctgttgtacattta

SEQ ID NO: 2360326 - DNA, 13 bp, Homo sapiens
taagaattctgat

SEQ ID NO: 2360327 - DNA, 19 bp, Homo sapiens
taagaattctgattgattt

SEQ ID NO: 2360328 - DNA, 12 bp, Homo sapiens
taagacataacg

SEQ ID NO: 2360329 - DNA, 16 bp, Homo sapiens
taagacataacgtttt

SEQ ID NO: 2360330 - DNA, 15 bp, Homo sapiens
taagagaaaagagag

SEQ ID NO: 2360331 - DNA, 18 bp, Homo sapiens
taagagaaaagagagaaa

SEQ ID NO: 2360332 - DNA, 15 bp, Homo sapiens
taagagaatgttcct

SEQ ID NO: 2360333 - DNA, 14 bp, Homo sapiens
taagagattttatg

SEQ ID NO: 2360334 - DNA, 15 bp, Homo sapiens
taagagcagtcacaa

SEQ ID NO: 2360335 - DNA, 16 bp, Homo sapiens
taagagcttgctccag

SEQ ID NO: 2360336 - DNA, 14 bp, Homo sapiens
taagagtaaagcaa

SEQ ID NO: 2360337 - DNA, 13 bp, Homo sapiens
taagagtgtagaa

SEQ ID NO: 2360338 - DNA, 16 bp, Homo sapiens
taagagtgtagaagca

SEQ ID NO: 2360339 - DNA, 20 bp, Homo sapiens
taagatagtgtaacttgctt

SEQ ID NO: 2360340 - DNA, 17 bp, Homo sapiens
taagatgtgttcttatt

SEQ ID NO: 2360341 - DNA, 14 bp, Homo sapiens
taagattggaaatg

SEQ ID NO: 2360342 - DNA, 15 bp, Homo sapiens
taagatttttctcaa

SEQ ID NO: 2360343 - DNA, 16 bp, Homo sapiens
taagatttttctcaaa

SEQ ID NO: 2360344 - DNA, 22 bp, Homo sapiens
taagcaaaggggacagctgtgt

SEQ ID NO: 2360345 - DNA, 14 bp, Homo sapiens
taagcaaatgttaa

SEQ ID NO: 2360346 - DNA, 18 bp, Homo sapiens
taagcaaatgttaaaagt

SEQ ID NO: 2360347 - DNA, 12 bp, Homo sapiens
taagcagtatat

SEQ ID NO: 2360348 - DNA, 21 bp, Homo sapiens
taagcagtatattagtattat

SEQ ID NO: 2360349 - DNA, 16 bp, Homo sapiens
taagcattctgagctg

SEQ ID NO: 2360350 - DNA, 14 bp, Homo sapiens
taagcatttgtaca

SEQ ID NO: 2360351 - DNA, 19 bp, Homo sapiens
taagcattttgaaacaaag

SEQ ID NO: 2360352 - DNA, 20 bp, Homo sapiens
taagcattttgaaacaaagt

SEQ ID NO: 2360353 - DNA, 19 bp, Homo sapiens
taagccatagaccctgagg

SEQ ID NO: 2360354 - DNA, 20 bp, Homo sapiens
taagctatgagttgaaatgt

SEQ ID NO: 2360355 - DNA, 20 bp, Homo sapiens
taagctgatattatttcttc

SEQ ID NO: 2360356 - DNA, 23 bp, Homo sapiens
taagctgcaaatctgatggcctt

SEQ ID NO: 2360357 - DNA, 22 bp, Homo sapiens
taagctgtgtctgcccaatgaa

SEQ ID NO: 2360358 - DNA, 17 bp, Homo sapiens
taagcttcagttgcttg

SEQ ID NO: 2360359 - DNA, 13 bp, Homo sapiens
taagctttttgga

SEQ ID NO: 2360360 - DNA, 17 bp, Homo sapiens
taaggaaactcttatct

SEQ ID NO: 2360361 - DNA, 21 bp, Homo sapiens
taaggaatttgatgattttca

SEQ ID NO: 2360362 - DNA, 17 bp, Homo sapiens
taaggagctaaagctga

SEQ ID NO: 2360363 - DNA, 22 bp, Homo sapiens
taaggataaatcataaagtcag

SEQ ID NO: 2360364 - DNA, 15 bp, Homo sapiens
taaggccagggcctc

SEQ ID NO: 2360365 - DNA, 14 bp, Homo sapiens
taaggcctgaatca

SEQ ID NO: 2360366 - DNA, 21 bp, Homo sapiens
taaggcttaggtgccaggctg

SEQ ID NO: 2360367 - DNA, 16 bp, Homo sapiens
taagggccgccggacc

SEQ ID NO: 2360368 - DNA, 14 bp, Homo sapiens
taagtaaatgtctt

SEQ ID NO: 2360369 - DNA, 19 bp, Homo sapiens
taagtaaatgtcttcatgt

SEQ ID NO: 2360370 - DNA, 20 bp, Homo sapiens
taagtaaatgtcttcatgtt

SEQ ID NO: 2360371 - DNA, 18 bp, Homo sapiens
taagtaccaatgggaagc

SEQ ID NO: 2360372 - DNA, 21 bp, Homo sapiens
taagtaccaatgggaagcagg

SEQ ID NO: 2360373 - DNA, 22 bp, Homo sapiens
taagtgacaaataagattaata

SEQ ID NO: 2360374 - DNA, 17 bp, Homo sapiens
taagtgcgtgtgtagag

SEQ ID NO: 2360375 - DNA, 18 bp, Homo sapiens
taagtgcgtgtgtagagt

SEQ ID NO: 2360376 - DNA, 16 bp, Homo sapiens
tactaaaaatacaaaa

SEQ ID NO: 2360377 - DNA, 12 bp, Homo sapiens
tactaacagtaa

SEQ ID NO: 2360378 - DNA, 16 bp, Homo sapiens
tactaactaaatacca

SEQ ID NO: 2360379 - DNA, 18 bp, Homo sapiens
tactaagagtaaagcaac

SEQ ID NO: 2360380 - DNA, 16 bp, Homo sapiens
tactaataaaccagtt

SEQ ID NO: 2360381 - DNA, 16 bp, Homo sapiens
tactaatctgagattg

SEQ ID NO: 2360382 - DNA, 16 bp, Homo sapiens
tactaatgatgttttc

SEQ ID NO: 2360383 - DNA, 13 bp, Homo sapiens
tactacaatagtt

SEQ ID NO: 2360384 - DNA, 19 bp, Homo sapiens
tactcaagcgggtggctct

SEQ ID NO: 2360385 - DNA, 23 bp, Homo sapiens
tactcaggctggtggagaactct

SEQ ID NO: 2360386 - DNA, 19 bp, Homo sapiens
tactccctgcagatgccac

SEQ ID NO: 2360387 - DNA, 18 bp, Homo sapiens
tactccttaaaaatgtat

SEQ ID NO: 2360388 - DNA, 17 bp, Homo sapiens
tactccttgcttcctga

SEQ ID NO: 2360389 - DNA, 19 bp, Homo sapiens
tactccttgcttcctgatg

SEQ ID NO: 2360390 - DNA, 20 bp, Homo sapiens
tactctgggagtaatacttt

SEQ ID NO: 2360391 - DNA, 22 bp, Homo sapiens
tactgaactacatgcataaact

SEQ ID NO: 2360392 - DNA, 22 bp, Homo sapiens
tactgaagtggctggtagaaaa

SEQ ID NO: 2360393 - DNA, 15 bp, Homo sapiens
tactgaataatatca

SEQ ID NO: 2360394 - DNA, 18 bp, Homo sapiens
tactgaataatatcaaat

SEQ ID NO: 2360395 - DNA, 19 bp, Homo sapiens
tactgaataatatcaaata

SEQ ID NO: 2360396 - DNA, 19 bp, Homo sapiens
tactgaatgaagcagtatt

SEQ ID NO: 2360397 - DNA, 21 bp, Homo sapiens
tactgaatgaagcagtatttt

SEQ ID NO: 2360398 - DNA, 17 bp, Homo sapiens
tactgattgggaggtgc

SEQ ID NO: 2360399 - DNA, 18 bp, Homo sapiens
tactgatttcagtaagtc

SEQ ID NO: 2360400 - DNA, 19 bp, Homo sapiens
tactgatttcagtaagtct

SEQ ID NO: 2360401 - DNA, 17 bp, Homo sapiens
tactgcatactttttaa

SEQ ID NO: 2360402 - DNA, 17 bp, Homo sapiens
tactgctttaatcagaa

SEQ ID NO: 2360403 - DNA, 18 bp, Homo sapiens
tactggatttgttgttct

SEQ ID NO: 2360404 - DNA, 22 bp, Homo sapiens
tactggggaaactggccatggc

SEQ ID NO: 2360405 - DNA, 16 bp, Homo sapiens
tactggttactttcaa

SEQ ID NO: 2360406 - DNA, 17 bp, Homo sapiens
tactggttactttcaaa

SEQ ID NO: 2360407 - DNA, 21 bp, Homo sapiens
tactgtaatacttctttgtta

SEQ ID NO: 2360408 - DNA, 13 bp, Homo sapiens
tactgtagaaaca

SEQ ID NO: 2360409 - DNA, 18 bp, Homo sapiens
tactgtctattaatattc

SEQ ID NO: 2360410 - DNA, 19 bp, Homo sapiens
tactgtctattaatattca

SEQ ID NO: 2360411 - DNA, 18 bp, Homo sapiens
tactgtctgttatgattt

SEQ ID NO: 2360412 - DNA, 14 bp, Homo sapiens
tactgtggaggaag

SEQ ID NO: 2360413 - DNA, 22 bp, Homo sapiens
tactgtggaggaaggattgtaa

SEQ ID NO: 2360414 - DNA, 19 bp, Homo sapiens
tactgtgtctcatggattt

SEQ ID NO: 2360415 - DNA, 16 bp, Homo sapiens
tactgttgtaagaatt

SEQ ID NO: 2360416 - DNA, 18 bp, Homo sapiens
tacttaattgccagcaaa

SEQ ID NO: 2360417 - DNA, 16 bp, Homo sapiens
tacttagggaagaaaa

SEQ ID NO: 2360418 - DNA, 19 bp, Homo sapiens
tacttcccgggccagggct

SEQ ID NO: 2360419 - DNA, 20 bp, Homo sapiens
tacttcttgaatataaaaaa

SEQ ID NO: 2360420 - DNA, 19 bp, Homo sapiens
tacttctttgttattataa

SEQ ID NO: 2360421 - DNA, 12 bp, Homo sapiens
tacttgggaggc

SEQ ID NO: 2360422 - DNA, 17 bp, Homo sapiens
tacttgttatgttgtaa

SEQ ID NO: 2360423 - DNA, 15 bp, Homo sapiens
tactttaaattgtgg

SEQ ID NO: 2360424 - DNA, 16 bp, Homo sapiens
tactttaaattgtgga

SEQ ID NO: 2360425 - DNA, 17 bp, Homo sapiens
tactttaaattgtggat

SEQ ID NO: 2360426 - DNA, 18 bp, Homo sapiens
tactttcaaaatgaattt

SEQ ID NO: 2360427 - DNA, 17 bp, Homo sapiens
tactttcaagtaatatt

SEQ ID NO: 2360428 - DNA, 23 bp, Homo sapiens
tactttggtagctgggaaagcat

SEQ ID NO: 2360429 - DNA, 21 bp, Homo sapiens
tagaaaaaggggcctgagtgg

SEQ ID NO: 2360430 - DNA, 17 bp, Homo sapiens
tagaaaaataaaatgtt

SEQ ID NO: 2360431 - DNA, 18 bp, Homo sapiens
tagaaaagaactggaaac

SEQ ID NO: 2360432 - DNA, 15 bp, Homo sapiens
tagaaacaaagggtt

SEQ ID NO: 2360433 - DNA, 20 bp, Homo sapiens
tagaaacaaagggttttctt

SEQ ID NO: 2360434 - DNA, 13 bp, Homo sapiens
tagaaagaagcca

SEQ ID NO: 2360435 - DNA, 14 bp, Homo sapiens
tagaaattttgtaa

SEQ ID NO: 2360436 - DNA, 17 bp, Homo sapiens
tagaaattttgtaagaa

SEQ ID NO: 2360437 - DNA, 18 bp, Homo sapiens
tagaaattttgtaagaag

SEQ ID NO: 2360438 - DNA, 23 bp, Homo sapiens
tagaacaggttcttaaaaaggaa

SEQ ID NO: 2360439 - DNA, 16 bp, Homo sapiens
tagaacgttaaactat

SEQ ID NO: 2360440 - DNA, 16 bp, Homo sapiens
tagaactgtctgtgaa

SEQ ID NO: 2360441 - DNA, 16 bp, Homo sapiens
tagaagaaagatgttt

SEQ ID NO: 2360442 - DNA, 21 bp, Homo sapiens
tagaagcattccttctttgat

SEQ ID NO: 2360443 - DNA, 22 bp, Homo sapiens
tagaagcattccttctttgata

SEQ ID NO: 2360444 - DNA, 10 bp, Homo sapiens
tagaagccag

SEQ ID NO: 2360445 - DNA, 14 bp, Homo sapiens
tagaaggcttctct

SEQ ID NO: 2360446 - DNA, 16 bp, Homo sapiens
tagaagtctggaaaaa

SEQ ID NO: 2360447 - DNA, 15 bp, Homo sapiens
tagaatagcctgagg

SEQ ID NO: 2360448 - DNA, 16 bp, Homo sapiens
tagaatccgaagggaa

SEQ ID NO: 2360449 - DNA, 14 bp, Homo sapiens
tagacaaaaagtat

SEQ ID NO: 2360450 - DNA, 20 bp, Homo sapiens
tagacaaaaagtatattaaa

SEQ ID NO: 2360451 - DNA, 15 bp, Homo sapiens
tagacattctcacat

SEQ ID NO: 2360452 - DNA, 12 bp, Homo sapiens
tagaccaataaa

SEQ ID NO: 2360453 - DNA, 21 bp, Homo sapiens
tagactggatggaaagacaaa

SEQ ID NO: 2360454 - DNA, 18 bp, Homo sapiens
tagactgtttgctgatcc

SEQ ID NO: 2360455 - DNA, 22 bp, Homo sapiens
tagacttgggatggggagggag

SEQ ID NO: 2360456 - DNA, 18 bp, Homo sapiens
tagagaggtagcgagctg

SEQ ID NO: 2360457 - DNA, 13 bp, Homo sapiens
tagagccagcttg

SEQ ID NO: 2360458 - DNA, 21 bp, Homo sapiens
tagaggcttctccgccagcct

SEQ ID NO: 2360459 - DNA, 20 bp, Homo sapiens
tagaggtcctctggagccct

SEQ ID NO: 2360460 - DNA, 14 bp, Homo sapiens
tagagtaatgaaat

SEQ ID NO: 2360461 - DNA, 17 bp, Homo sapiens
tagagtaatgaaatgga

SEQ ID NO: 2360462 - DNA, 17 bp, Homo sapiens
tagagtgtagactgtgg

SEQ ID NO: 2360463 - DNA, 19 bp, Homo sapiens
tagagttaagaagctgttg

SEQ ID NO: 2360464 - DNA, 22 bp, Homo sapiens
tagatatgtattcttttctcag

SEQ ID NO: 2360465 - DNA, 20 bp, Homo sapiens
tagatcaaatagttgcatag

SEQ ID NO: 2360466 - DNA, 15 bp, Homo sapiens
tagatccatttccat

SEQ ID NO: 2360467 - DNA, 17 bp, Homo sapiens
tagatcctaagatgtgt

SEQ ID NO: 2360468 - DNA, 12 bp, Homo sapiens
tagatctccagc

SEQ ID NO: 2360469 - DNA, 13 bp, Homo sapiens
tagatctccagcg

SEQ ID NO: 2360470 - DNA, 13 bp, Homo sapiens
tagatctctgaag

SEQ ID NO: 2360471 - DNA, 22 bp, Homo sapiens
tagatgattttttgaaagttaa

SEQ ID NO: 2360472 - DNA, 17 bp, Homo sapiens
tagatggaatggaaaag

SEQ ID NO: 2360473 - DNA, 17 bp, Homo sapiens
tagattattcataatgt

SEQ ID NO: 2360474 - DNA, 21 bp, Homo sapiens
tagattattcataatgtgaga

SEQ ID NO: 2360475 - DNA, 17 bp, Homo sapiens
tagattcatgaaaatgt

SEQ ID NO: 2360476 - DNA, 22 bp, Homo sapiens
tagattgactaactcaaataca

SEQ ID NO: 2360477 - DNA, 15 bp, Homo sapiens
tagattgagaaatgt

SEQ ID NO: 2360478 - DNA, 19 bp, Homo sapiens
tagcaacaacaattggtaa

SEQ ID NO: 2360479 - DNA, 14 bp, Homo sapiens
tagcaatgcctgag

SEQ ID NO: 2360480 - DNA, 13 bp, Homo sapiens
tagcacagtattt

SEQ ID NO: 2360481 - DNA, 17 bp, Homo sapiens
tagcacagtatttaaca

SEQ ID NO: 2360482 - DNA, 16 bp, Homo sapiens
tagcagccagttcaaa

SEQ ID NO: 2360483 - DNA, 16 bp, Homo sapiens
tagcaggctgttccat

SEQ ID NO: 2360484 - DNA, 17 bp, Homo sapiens
tagcaggctgttccatg

SEQ ID NO: 2360485 - DNA, 15 bp, Homo sapiens
tagcatgaaataaaa

SEQ ID NO: 2360486 - DNA, 19 bp, Homo sapiens
tagcatgatggctgtagct

SEQ ID NO: 2360487 - DNA, 19 bp, Homo sapiens
tagcatgcttcctttctct

SEQ ID NO: 2360488 - DNA, 23 bp, Homo sapiens
tagcatgttcctccttttcttca

SEQ ID NO: 2360489 - DNA, 14 bp, Homo sapiens
tagcattctttgga

SEQ ID NO: 2360490 - DNA, 17 bp, Homo sapiens
tagcattctttggagtt

SEQ ID NO: 2360491 - DNA, 19 bp, Homo sapiens
tatgtagtatctatatgac

SEQ ID NO: 2360492 - DNA, 14 bp, Homo sapiens
tatgtctcatgttt

SEQ ID NO: 2360493 - DNA, 15 bp, Homo sapiens
tatgtctcatgtttt

SEQ ID NO: 2360494 - DNA, 21 bp, Homo sapiens
tatgtcttggacactgtacaa

SEQ ID NO: 2360495 - DNA, 23 bp, Homo sapiens
tatgtcttgtatttaaaaacatt

SEQ ID NO: 2360496 - DNA, 15 bp, Homo sapiens
tatgtgaaaaattaa

SEQ ID NO: 2360497 - DNA, 16 bp, Homo sapiens
tatgtgaaaaattaac

SEQ ID NO: 2360498 - DNA, 12 bp, Homo sapiens
tatgtgaatttt

SEQ ID NO: 2360499 - DNA, 21 bp, Homo sapiens
tatgtgggatattgaatgtta

SEQ ID NO: 2360500 - DNA, 19 bp, Homo sapiens
tatgtgggggcttcatctc

SEQ ID NO: 2360501 - DNA, 19 bp, Homo sapiens
tatgtgtggctgtgggtgt

SEQ ID NO: 2360502 - DNA, 19 bp, Homo sapiens
tatgttaagggaagaattc

SEQ ID NO: 2360503 - DNA, 19 bp, Homo sapiens
tatgttcctaacaaaatga

SEQ ID NO: 2360504 - DNA, 13 bp, Homo sapiens
tatgttgataaac

SEQ ID NO: 2360505 - DNA, 13 bp, Homo sapiens
tatgtttaaaata

SEQ ID NO: 2360506 - DNA, 15 bp, Homo sapiens
tattaaaaaacttca

SEQ ID NO: 2360507 - DNA, 16 bp, Homo sapiens
tattaaaatatttcag

SEQ ID NO: 2360508 - DNA, 14 bp, Homo sapiens
tattaaaattccaa

SEQ ID NO: 2360509 - DNA, 19 bp, Homo sapiens
tattaaaattccaaattca

SEQ ID NO: 2360510 - DNA, 13 bp, Homo sapiens
tattaaacaaagt

SEQ ID NO: 2360511 - DNA, 17 bp, Homo sapiens
tattaaacaaagtttca

SEQ ID NO: 2360512 - DNA, 19 bp, Homo sapiens
tattaaacaaagtttcaga

SEQ ID NO: 2360513 - DNA, 14 bp, Homo sapiens
tattaagtaaaatc

SEQ ID NO: 2360514 - DNA, 17 bp, Homo sapiens
tattaagtgtgccaaat

SEQ ID NO: 2360515 - DNA, 23 bp, Homo sapiens
tattaatatttgcacatgggatt

SEQ ID NO: 2360516 - DNA, 18 bp, Homo sapiens
tattaatcaagagaaact

SEQ ID NO: 2360517 - DNA, 20 bp, Homo sapiens
tattaatcatacaaactctc

SEQ ID NO: 2360518 - DNA, 17 bp, Homo sapiens
tattaatgttttcaaaa

SEQ ID NO: 2360519 - DNA, 19 bp, Homo sapiens
tattactgaataatatcaa

SEQ ID NO: 2360520 - DNA, 21 bp, Homo sapiens
tattactgaataatatcaaat

SEQ ID NO: 2360521 - DNA, 22 bp, Homo sapiens
tattactgaataatatcaaata

SEQ ID NO: 2360522 - DNA, 19 bp, Homo sapiens
tattagagtatttcccttc

SEQ ID NO: 2360523 - DNA, 22 bp, Homo sapiens
tattagatcaaatagttgcata

SEQ ID NO: 2360524 - DNA, 18 bp, Homo sapiens
tattaggtccattcatta

SEQ ID NO: 2360525 - DNA, 15 bp, Homo sapiens
tattaggttgtcacg

SEQ ID NO: 2360526 - DNA, 16 bp, Homo sapiens
tattataaaggataaa

SEQ ID NO: 2360527 - DNA, 20 bp, Homo sapiens
tattataaaggataaagaag

SEQ ID NO: 2360528 - DNA, 19 bp, Homo sapiens
tattataactctgtataat

SEQ ID NO: 2360529 - DNA, 21 bp, Homo sapiens
tattatacatgtgatacattt

SEQ ID NO: 2360530 - DNA, 12 bp, Homo sapiens
tattatagaaaa

SEQ ID NO: 2360531 - DNA, 13 bp, Homo sapiens
tattatatacata

SEQ ID NO: 2360532 - DNA, 13 bp, Homo sapiens
tattatcacatta

SEQ ID NO: 2360533 - DNA, 20 bp, Homo sapiens
tattatcttgttcaggaaaa

SEQ ID NO: 2360534 - DNA, 16 bp, Homo sapiens
tattatggaaaactgt

SEQ ID NO: 2360535 - DNA, 20 bp, Homo sapiens
tattatggaaaactgtgttg

SEQ ID NO: 2360536 - DNA, 17 bp, Homo sapiens
tattcaagaagatagtt

SEQ ID NO: 2360537 - DNA, 15 bp, Homo sapiens
tattcatggctacct

SEQ ID NO: 2360538 - DNA, 15 bp, Homo sapiens
tattcctttaaaata

SEQ ID NO: 2360539 - DNA, 17 bp, Homo sapiens
tattcctttaaaatatt

SEQ ID NO: 2360540 - DNA, 16 bp, Homo sapiens
tattctgcagaaaatt

SEQ ID NO: 2360541 - DNA, 15 bp, Homo sapiens
tattcttatttcatt

SEQ ID NO: 2360542 - DNA, 13 bp, Homo sapiens
tattcttctttct

SEQ ID NO: 2360543 - DNA, 18 bp, Homo sapiens
tattcttgtcattttgaa

SEQ ID NO: 2360544 - DNA, 13 bp, Homo sapiens
tattcttttctca

SEQ ID NO: 2360545 - DNA, 16 bp, Homo sapiens
tattcttttgtttcca

SEQ ID NO: 2360546 - DNA, 13 bp, Homo sapiens
tattgaaagccaa

SEQ ID NO: 2360547 - DNA, 22 bp, Homo sapiens
tattgacaataagaaacagttt

SEQ ID NO: 2360548 - DNA, 12 bp, Homo sapiens
tattgacactga

SEQ ID NO: 2360549 - DNA, 13 bp, Homo sapiens
tattgacactgaa

SEQ ID NO: 2360550 - DNA, 14 bp, Homo sapiens
tattgacactgaac

SEQ ID NO: 2360551 - DNA, 24 bp, Homo sapiens
tattgacactgaacttaataactg

SEQ ID NO: 2360552 - DNA, 20 bp, Homo sapiens
tattgacaggtcttttcaaa

SEQ ID NO: 2360553 - DNA, 23 bp, Homo sapiens
tattgacaggtcttttcaaataa

SEQ ID NO: 2360554 - DNA, 14 bp, Homo sapiens
tattgaccattttt

SEQ ID NO: 2360555 - DNA, 15 bp, Homo sapiens
tattgattgggaaaa

SEQ ID NO: 2360556 - DNA, 16 bp, Homo sapiens
tattgcaataaagtat

SEQ ID NO: 2360557 - DNA, 18 bp, Homo sapiens
tattgtaatcgtgtgcca

SEQ ID NO: 2360558 - DNA, 16 bp, Homo sapiens
tattgtatattacaat

SEQ ID NO: 2360559 - DNA, 19 bp, Homo sapiens
tattgtatattacaatgat

SEQ ID NO: 2360560 - DNA, 15 bp, Homo sapiens
tattgtatctccttt

SEQ ID NO: 2360561 - DNA, 17 bp, Homo sapiens
tattgtttaaaatgtaa

SEQ ID NO: 2360562 - DNA, 15 bp, Homo sapiens
tattgtttggtaaat

SEQ ID NO: 2360563 - DNA, 14 bp, Homo sapiens
tattgttttacaat

SEQ ID NO: 2360564 - DNA, 17 bp, Homo sapiens
tattgttttacaatagt

SEQ ID NO: 2360565 - DNA, 20 bp, Homo sapiens
tattgttttacaatagttct

SEQ ID NO: 2360566 - DNA, 21 bp, Homo sapiens
tatttaaatcctgaagagcat

SEQ ID NO: 2360567 - DNA, 18 bp, Homo sapiens
tatttaacaaaatttgaa

SEQ ID NO: 2360568 - DNA, 14 bp, Homo sapiens
tatttaacattctt

SEQ ID NO: 2360569 - DNA, 15 bp, Homo sapiens
tatttaacattcttg

SEQ ID NO: 2360570 - DNA, 14 bp, Homo sapiens
tatttaagactaaa

SEQ ID NO: 2360571 - DNA, 15 bp, Homo sapiens
tatttaagtggactg

SEQ ID NO: 2360572 - DNA, 20 bp, Homo sapiens
tatttaagtggactgtattt

SEQ ID NO: 2360573 - DNA, 15 bp, Homo sapiens
tatttaataacatta

SEQ ID NO: 2360574 - DNA, 15 bp, Homo sapiens
tatttaatatgctta

SEQ ID NO: 2360575 - DNA, 14 bp, Homo sapiens
tatttactaactaa

SEQ ID NO: 2360576 - DNA, 19 bp, Homo sapiens
tatttactaactaaatacc

SEQ ID NO: 2360577 - DNA, 21 bp, Homo sapiens
tatttactaactaaataccat

SEQ ID NO: 2360578 - DNA, 22 bp, Homo sapiens
tatttactttttcggtttcaaa

SEQ ID NO: 2360579 - DNA, 13 bp, Homo sapiens
tatttagacaaga

SEQ ID NO: 2360580 - DNA, 20 bp, Homo sapiens
tatttagacaagagatggga

SEQ ID NO: 2360581 - DNA, 16 bp, Homo sapiens
tatttataatacagaa

SEQ ID NO: 2360582 - DNA, 20 bp, Homo sapiens
tatttataatacagaatctt

SEQ ID NO: 2360583 - DNA, 13 bp, Homo sapiens
tatttatgttgtt

SEQ ID NO: 2360584 - DNA, 16 bp, Homo sapiens
tatttattttcctaaa

SEQ ID NO: 2360585 - DNA, 21 bp, Homo sapiens
tatttattttcctaaagagag

SEQ ID NO: 2360586 - DNA, 13 bp, Homo sapiens
tatttcaaaatga

SEQ ID NO: 2360587 - DNA, 20 bp, Homo sapiens
tatttcagtgttacctgtgt

SEQ ID NO: 2360588 - DNA, 18 bp, Homo sapiens
tatttcatttattttttg

SEQ ID NO: 2360589 - DNA, 19 bp, Homo sapiens
tatttccactaaaaatatt

SEQ ID NO: 2360590 - DNA, 12 bp, Homo sapiens
tatttcccttcc

SEQ ID NO: 2360591 - DNA, 15 bp, Homo sapiens
tatttcctaaggcat

SEQ ID NO: 2360592 - DNA, 11 bp, Homo sapiens
tatttccttta

SEQ ID NO: 2360593 - DNA, 16 bp, Homo sapiens
tatttcctttatgtga

SEQ ID NO: 2360594 - DNA, 20 bp, Homo sapiens
tatttctatgacaaattcaa

SEQ ID NO: 2360595 - DNA, 14 bp, Homo sapiens
tatttctgaaggta

SEQ ID NO: 2360596 - DNA, 21 bp, Homo sapiens
tatttctgaaggtagcattct

SEQ ID NO: 2360597 - DNA, 14 bp, Homo sapiens
tatttcttctctta

SEQ ID NO: 2360598 - DNA, 16 bp, Homo sapiens
tatttgatttctaatt

SEQ ID NO: 2360599 - DNA, 20 bp, Homo sapiens
tatttgcacatgggattgct

SEQ ID NO: 2360600 - DNA, 21 bp, Homo sapiens
tatttgctcataagtaaatgt

SEQ ID NO: 2360601 - DNA, 15 bp, Homo sapiens
tattttaaaatttca

SEQ ID NO: 2360602 - DNA, 14 bp, Homo sapiens
tattttacaatttt

SEQ ID NO: 2360603 - DNA, 20 bp, Homo sapiens
tattttatctattggcctgt

SEQ ID NO: 2360604 - DNA, 20 bp, Homo sapiens
tattttatttagacaagaga

SEQ ID NO: 2360605 - DNA, 22 bp, Homo sapiens
tattttcagtcccctctctctg

SEQ ID NO: 2360606 - DNA, 13 bp, Homo sapiens
tcagtgctctcag

SEQ ID NO: 2360607 - DNA, 20 bp, Homo sapiens
tcagtgctctcagctggcag

SEQ ID NO: 2360608 - DNA, 15 bp, Homo sapiens
tcagtgttacctgtg

SEQ ID NO: 2360609 - DNA, 16 bp, Homo sapiens
tcagtgttacctgtgt

SEQ ID NO: 2360610 - DNA, 18 bp, Homo sapiens
tcagtgttacctgtgtgc

SEQ ID NO: 2360611 - DNA, 14 bp, Homo sapiens
tcagttacagtggc

SEQ ID NO: 2360612 - DNA, 12 bp, Homo sapiens
tcagttccttca

SEQ ID NO: 2360613 - DNA, 15 bp, Homo sapiens
tcagttctaggaaaa

SEQ ID NO: 2360614 - DNA, 15 bp, Homo sapiens
tcagttctctgggaa

SEQ ID NO: 2360615 - DNA, 18 bp, Homo sapiens
tcagttgctcaaaaagaa

SEQ ID NO: 2360616 - DNA, 13 bp, Homo sapiens
tcagttgtgtttt

SEQ ID NO: 2360617 - DNA, 16 bp, Homo sapiens
tcagttttccttctgt

SEQ ID NO: 2360618 - DNA, 19 bp, Homo sapiens
tcagttttccttctgttaa

SEQ ID NO: 2360619 - DNA, 15 bp, Homo sapiens
tcagttttgtacata

SEQ ID NO: 2360620 - DNA, 14 bp, Homo sapiens
tcataagtaaatgt

SEQ ID NO: 2360621 - DNA, 18 bp, Homo sapiens
tcataataaaagtgaagt

SEQ ID NO: 2360622 - DNA, 16 bp, Homo sapiens
tcataatcagtaaata

SEQ ID NO: 2360623 - DNA, 12 bp, Homo sapiens
tcataatgtgag

SEQ ID NO: 2360624 - DNA, 23 bp, Homo sapiens
tcataatgtgagatggttcccaa

SEQ ID NO: 2360625 - DNA, 16 bp, Homo sapiens
tcatacaaactctcac

SEQ ID NO: 2360626 - DNA, 23 bp, Homo sapiens
tcataccttctgatgaagttgta

SEQ ID NO: 2360627 - DNA, 21 bp, Homo sapiens
tcatagctcactgcagcctca

SEQ ID NO: 2360628 - DNA, 15 bp, Homo sapiens
tcatatccttttgaa

SEQ ID NO: 2360629 - DNA, 21 bp, Homo sapiens
tcatattgtgattctgccttt

SEQ ID NO: 2360630 - DNA, 17 bp, Homo sapiens
tcatcaaagaacaaaca

SEQ ID NO: 2360631 - DNA, 13 bp, Homo sapiens
tcatcaactgaat

SEQ ID NO: 2360632 - DNA, 16 bp, Homo sapiens
tcatcatccagatgtg

SEQ ID NO: 2360633 - DNA, 13 bp, Homo sapiens
tcatctctttaga

SEQ ID NO: 2360634 - DNA, 16 bp, Homo sapiens
tcatcttcctgtgtcc

SEQ ID NO: 2360635 - DNA, 12 bp, Homo sapiens
tcatgaaaatac

SEQ ID NO: 2360636 - DNA, 14 bp, Homo sapiens
tcatgaaaatacca

SEQ ID NO: 2360637 - DNA, 19 bp, Homo sapiens
tcatgaaaatgtattcctt

SEQ ID NO: 2360638 - DNA, 15 bp, Homo sapiens
tcatgaatgctttta

SEQ ID NO: 2360639 - DNA, 21 bp, Homo sapiens
tcatgaatgcttttagtgtgt

SEQ ID NO: 2360640 - DNA, 12 bp, Homo sapiens
tcatgaatttta

SEQ ID NO: 2360641 - DNA, 21 bp, Homo sapiens
tcatgacataataaagtattt

SEQ ID NO: 2360642 - DNA, 13 bp, Homo sapiens
tcatgagcctgct

SEQ ID NO: 2360643 - DNA, 16 bp, Homo sapiens
tcatgagcctgctgga

SEQ ID NO: 2360644 - DNA, 14 bp, Homo sapiens
tcatgaggggagag

SEQ ID NO: 2360645 - DNA, 16 bp, Homo sapiens
tcatgatccaactaat

SEQ ID NO: 2360646 - DNA, 19 bp, Homo sapiens
tcatgcccaccccctgccc

SEQ ID NO: 2360647 - DNA, 15 bp, Homo sapiens
tcatgcccagctctc

SEQ ID NO: 2360648 - DNA, 16 bp, Homo sapiens
tcatgcggtgggtgct

SEQ ID NO: 2360649 - DNA, 16 bp, Homo sapiens
tcatggctgctgttgc

SEQ ID NO: 2360650 - DNA, 23 bp, Homo sapiens
tcatgggagggggcttgaagcca

SEQ ID NO: 2360651 - DNA, 14 bp, Homo sapiens
tcatgggtcctagc

SEQ ID NO: 2360652 - DNA, 21 bp, Homo sapiens
tcatgggtcctagcccttccc

SEQ ID NO: 2360653 - DNA, 16 bp, Homo sapiens
tcatggtgtaataaga

SEQ ID NO: 2360654 - DNA, 22 bp, Homo sapiens
tcatggtgtaataagacataac

SEQ ID NO: 2360655 - DNA, 15 bp, Homo sapiens
tcatgtcaatgacca

SEQ ID NO: 2360656 - DNA, 18 bp, Homo sapiens
tcatgtcacctacatatg

SEQ ID NO: 2360657 - DNA, 21 bp, Homo sapiens
tcatgtccaaacgtcctcttt

SEQ ID NO: 2360658 - DNA, 12 bp, Homo sapiens
tcatgttgatgt

SEQ ID NO: 2360659 - DNA, 22 bp, Homo sapiens
tcattaaaaattacctttaatt

SEQ ID NO: 2360660 - DNA, 15 bp, Homo sapiens
tcattaaagacagga

SEQ ID NO: 2360661 - DNA, 23 bp, Homo sapiens
tcattatgcacttttagaaatgc

SEQ ID NO: 2360662 - DNA, 16 bp, Homo sapiens
tcattattcaagaatg

SEQ ID NO: 2360663 - DNA, 18 bp, Homo sapiens
tcattattcaagaatgaa

SEQ ID NO: 2360664 - DNA, 23 bp, Homo sapiens
tcattcaatttaagtatatttgt

SEQ ID NO: 2360665 - DNA, 14 bp, Homo sapiens
tcattcagaaatgt

SEQ ID NO: 2360666 - DNA, 12 bp, Homo sapiens
tcattcatcctg

SEQ ID NO: 2360667 - DNA, 13 bp, Homo sapiens
tcattcatcctga

SEQ ID NO: 2360668 - DNA, 15 bp, Homo sapiens
tcattcccatgtgga

SEQ ID NO: 2360669 - DNA, 20 bp, Homo sapiens
tcattccttagataccttga

SEQ ID NO: 2360670 - DNA, 14 bp, Homo sapiens
tcattctgaattaa

SEQ ID NO: 2360671 - DNA, 15 bp, Homo sapiens
tcattcttactaaaa

SEQ ID NO: 2360672 - DNA, 12 bp, Homo sapiens
tcattgactttt

SEQ ID NO: 2360673 - DNA, 16 bp, Homo sapiens
tcattgacttttataa

SEQ ID NO: 2360674 - DNA, 21 bp, Homo sapiens
tcattgacttttataaagcat

SEQ ID NO: 2360675 - DNA, 17 bp, Homo sapiens
tcattgcacataagctt

SEQ ID NO: 2360676 - DNA, 19 bp, Homo sapiens
tcatttcagggtcttggct

SEQ ID NO: 2360677 - DNA, 15 bp, Homo sapiens
tcatttcatgaaaat

SEQ ID NO: 2360678 - DNA, 17 bp, Homo sapiens
tcattttactgtatatt

SEQ ID NO: 2360679 - DNA, 16 bp, Homo sapiens
tcattttcttttttaa

SEQ ID NO: 2360680 - DNA, 18 bp, Homo sapiens
tcattttgaccatataga

SEQ ID NO: 2360681 - DNA, 13 bp, Homo sapiens
tcatttttatagc

SEQ ID NO: 2360682 - DNA, 21 bp, Homo sapiens
tcatttttatagcaacaacaa

SEQ ID NO: 2360683 - DNA, 22 bp, Homo sapiens
tccaaaatgttggtcattttat

SEQ ID NO: 2360684 - DNA, 15 bp, Homo sapiens
tccaaacatccaaaa

SEQ ID NO: 2360685 - DNA, 13 bp, Homo sapiens
tccaaagaaagtt

SEQ ID NO: 2360686 - DNA, 17 bp, Homo sapiens
tccaaatataagacatt

SEQ ID NO: 2360687 - DNA, 19 bp, Homo sapiens
tccaaatggagaagctgca

SEQ ID NO: 2360688 - DNA, 20 bp, Homo sapiens
tccaaatggagaagctgcag

SEQ ID NO: 2360689 - DNA, 16 bp, Homo sapiens
tccaaatgtccctcca

SEQ ID NO: 2360690 - DNA, 16 bp, Homo sapiens
tccaaccactgtgcca

SEQ ID NO: 2360691 - DNA, 17 bp, Homo sapiens
tccaaccactgtgccac

SEQ ID NO: 2360692 - DNA, 18 bp, Homo sapiens
tccaaccactgtgccact

SEQ ID NO: 2360693 - DNA, 19 bp, Homo sapiens
tccaactaatgccttactc

SEQ ID NO: 2360694 - DNA, 17 bp, Homo sapiens
tccaagacatgtctgtt

SEQ ID NO: 2360695 - DNA, 19 bp, Homo sapiens
tccaagcaaaatctaaaat

SEQ ID NO: 2360696 - DNA, 16 bp, Homo sapiens
tccaagcaacagcctt

SEQ ID NO: 2360697 - DNA, 17 bp, Homo sapiens
tccaagcaacagccttt

SEQ ID NO: 2360698 - DNA, 21 bp, Homo sapiens
tccaagcaacagcctttgaat

SEQ ID NO: 2360699 - DNA, 15 bp, Homo sapiens
tccaagcatttcatg

SEQ ID NO: 2360700 - DNA, 21 bp, Homo sapiens
tccaagcatttcatgaaaaag

SEQ ID NO: 2360701 - DNA, 15 bp, Homo sapiens
tccaagcctccacag

SEQ ID NO: 2360702 - DNA, 17 bp, Homo sapiens
tccaagcctccacagcg

SEQ ID NO: 2360703 - DNA, 20 bp, Homo sapiens
tccaagcctccacagcgagg

SEQ ID NO: 2360704 - DNA, 21 bp, Homo sapiens
tccaagcctccacagcgaggg

SEQ ID NO: 2360705 - DNA, 20 bp, Homo sapiens
tccaaggaggggctgtaaaa

SEQ ID NO: 2360706 - DNA, 12 bp, Homo sapiens
tccaaggccagt

SEQ ID NO: 2360707 - DNA, 18 bp, Homo sapiens
tccaaggtggcagatgtc

SEQ ID NO: 2360708 - DNA, 17 bp, Homo sapiens
tccaagttgttcgggcc

SEQ ID NO: 2360709 - DNA, 15 bp, Homo sapiens
tccacccaaccctat

SEQ ID NO: 2360710 - DNA, 12 bp, Homo sapiens
tccacccactgt

SEQ ID NO: 2360711 - DNA, 19 bp, Homo sapiens
tccaccccaagagaactcg

SEQ ID NO: 2360712 - DNA, 13 bp, Homo sapiens
tccaccttccctt

SEQ ID NO: 2360713 - DNA, 17 bp, Homo sapiens
tccactaaaaatattgt

SEQ ID NO: 2360714 - DNA, 15 bp, Homo sapiens
tccactacacctggc

SEQ ID NO: 2360715 - DNA, 18 bp, Homo sapiens
tccactacacctggctga

SEQ ID NO: 2360716 - DNA, 15 bp, Homo sapiens
tccactcgtgtgttt

SEQ ID NO: 2360717 - DNA, 18 bp, Homo sapiens
tccactcgtgtgtttcta

SEQ ID NO: 2360718 - DNA, 19 bp, Homo sapiens
tccactgttgagccccagt

SEQ ID NO: 2360719 - DNA, 14 bp, Homo sapiens
tccagaagagccca

SEQ ID NO: 2360720 - DNA, 15 bp, Homo sapiens
tccagaagagcccat

SEQ ID NO: 2360721 - DNA, 17 bp, Homo sapiens
tccagatcactgccaca

SEQ ID NO: 2360722 - DNA, 18 bp, Homo sapiens
tcctctttagtttttggt

SEQ ID NO: 2360723 - DNA, 16 bp, Homo sapiens
tcctgaaacgctcctt

SEQ ID NO: 2360724 - DNA, 22 bp, Homo sapiens
tcctgaaccatgtggataactt

SEQ ID NO: 2360725 - DNA, 16 bp, Homo sapiens
tcctgaaccgcacagc

SEQ ID NO: 2360726 - DNA, 19 bp, Homo sapiens
tcctgaaccgcacagctca

SEQ ID NO: 2360727 - DNA, 20 bp, Homo sapiens
tcctgaaccgcacagctcag

SEQ ID NO: 2360728 - DNA, 13 bp, Homo sapiens
tcctgacacttta

SEQ ID NO: 2360729 - DNA, 14 bp, Homo sapiens
tcctgacagaaggt

SEQ ID NO: 2360730 - DNA, 15 bp, Homo sapiens
tcctgaccaagactg

SEQ ID NO: 2360731 - DNA, 20 bp, Homo sapiens
tcctgaccaagactgagcca

SEQ ID NO: 2360732 - DNA, 16 bp, Homo sapiens
tcctgacctccgccat

SEQ ID NO: 2360733 - DNA, 15 bp, Homo sapiens
tcctgagacctcaat

SEQ ID NO: 2360734 - DNA, 20 bp, Homo sapiens
tcctgatccactttggggga

SEQ ID NO: 2360735 - DNA, 15 bp, Homo sapiens
tcctgcacacagaat

SEQ ID NO: 2360736 - DNA, 12 bp, Homo sapiens
tcctgcagcccc

SEQ ID NO: 2360737 - DNA, 15 bp, Homo sapiens
tcctgcagggcttct

SEQ ID NO: 2360738 - DNA, 13 bp, Homo sapiens
tcctgccaggcac

SEQ ID NO: 2360739 - DNA, 21 bp, Homo sapiens
tcctgccaggcacacacagcc

SEQ ID NO: 2360740 - DNA, 12 bp, Homo sapiens
tcctgccatcct

SEQ ID NO: 2360741 - DNA, 16 bp, Homo sapiens
tcctgcccttccctct

SEQ ID NO: 2360742 - DNA, 22 bp, Homo sapiens
tcctgcccttccctctgggcac

SEQ ID NO: 2360743 - DNA, 14 bp, Homo sapiens
tcctgcctcagcct

SEQ ID NO: 2360744 - DNA, 17 bp, Homo sapiens
tcctgcctgtctgcccc

SEQ ID NO: 2360745 - DNA, 19 bp, Homo sapiens
tcctgcctgtctgccccag

SEQ ID NO: 2360746 - DNA, 13 bp, Homo sapiens
tcctgcgtcctcc

SEQ ID NO: 2360747 - DNA, 18 bp, Homo sapiens
tcctgcgtcctcctcacc

SEQ ID NO: 2360748 - DNA, 21 bp, Homo sapiens
tcctgcgtcctcctcacctca

SEQ ID NO: 2360749 - DNA, 18 bp, Homo sapiens
tcctgctgctgtctgggt

SEQ ID NO: 2360750 - DNA, 19 bp, Homo sapiens
tcctgctgctgtctgggtg

SEQ ID NO: 2360751 - DNA, 20 bp, Homo sapiens
tcctgctgctgtctgggtgc

SEQ ID NO: 2360752 - DNA, 18 bp, Homo sapiens
tcctggaagccagctttc

SEQ ID NO: 2360753 - DNA, 13 bp, Homo sapiens
tcctggaggacca

SEQ ID NO: 2360754 - DNA, 20 bp, Homo sapiens
tcctggcacagtttttgtaa

SEQ ID NO: 2360755 - DNA, 22 bp, Homo sapiens
tcctggcacagtttttgtaaag

SEQ ID NO: 2360756 - DNA, 11 bp, Homo sapiens
tcctggcagcc

SEQ ID NO: 2360757 - DNA, 16 bp, Homo sapiens
tcctggcagcccagag

SEQ ID NO: 2360758 - DNA, 19 bp, Homo sapiens
tcctggcagcccagagact

SEQ ID NO: 2360759 - DNA, 22 bp, Homo sapiens
tcctggcctatccgctgccagc

SEQ ID NO: 2360760 - DNA, 23 bp, Homo sapiens
tcctggctcggggtaaaaagtgg

SEQ ID NO: 2360761 - DNA, 19 bp, Homo sapiens
tcctggctctaccctgtct

SEQ ID NO: 2360762 - DNA, 14 bp, Homo sapiens
tcctgggggacctt

SEQ ID NO: 2360763 - DNA, 14 bp, Homo sapiens
tcctggtgactcct

SEQ ID NO: 2360764 - DNA, 24 bp, Homo sapiens
tcctggtgaggcccagcctgtcct

SEQ ID NO: 2360765 - DNA, 16 bp, Homo sapiens
tcctgtcccctgctac

SEQ ID NO: 2360766 - DNA, 15 bp, Homo sapiens
tcctgtccctgaggt

SEQ ID NO: 2360767 - DNA, 16 bp, Homo sapiens
tcctgtccctgtagct

SEQ ID NO: 2360768 - DNA, 21 bp, Homo sapiens
tcctgtcttatcctccaccgt

SEQ ID NO: 2360769 - DNA, 23 bp, Homo sapiens
tcctgtggaaggcagagaaatct

SEQ ID NO: 2360770 - DNA, 19 bp, Homo sapiens
tcctgtggcataaattgca

SEQ ID NO: 2360771 - DNA, 14 bp, Homo sapiens
tcctgtttttcaca

SEQ ID NO: 2360772 - DNA, 19 bp, Homo sapiens
tccttaaaaatgtatgttg

SEQ ID NO: 2360773 - DNA, 22 bp, Homo sapiens
tccttacaagttagaaaacata

SEQ ID NO: 2360774 - DNA, 18 bp, Homo sapiens
tccttcatttccaccagg

SEQ ID NO: 2360775 - DNA, 19 bp, Homo sapiens
tccttcatttccaccaggc

SEQ ID NO: 2360776 - DNA, 19 bp, Homo sapiens
tccttccctctctgatgtc

SEQ ID NO: 2360777 - DNA, 23 bp, Homo sapiens
tccttccgcttggagctattttc

SEQ ID NO: 2360778 - DNA, 17 bp, Homo sapiens
tccttcctggcctgaga

SEQ ID NO: 2360779 - DNA, 16 bp, Homo sapiens
tccttctgagctcctg

SEQ ID NO: 2360780 - DNA, 13 bp, Homo sapiens
tccttctttgata

SEQ ID NO: 2360781 - DNA, 16 bp, Homo sapiens
tccttgagtgtatgag

SEQ ID NO: 2360782 - DNA, 14 bp, Homo sapiens
tccttgatttcaaa

SEQ ID NO: 2360783 - DNA, 22 bp, Homo sapiens
tccttgatttcaaagttttgtt

SEQ ID NO: 2360784 - DNA, 21 bp, Homo sapiens
tccttgcaggtgggggttgct

SEQ ID NO: 2360785 - DNA, 18 bp, Homo sapiens
tccttgcgcctcagccct

SEQ ID NO: 2360786 - DNA, 23 bp, Homo sapiens
tccttgcgcctcagccctcagtt

SEQ ID NO: 2360787 - DNA, 20 bp, Homo sapiens
tccttggagagcagctggct

SEQ ID NO: 2360788 - DNA, 19 bp, Homo sapiens
tccttggtttgctagtatc

SEQ ID NO: 2360789 - DNA, 21 bp, Homo sapiens
tccttggtttgctagtatctt

SEQ ID NO: 2360790 - DNA, 23 bp, Homo sapiens
tccttgtgcaaaatatttgacta

SEQ ID NO: 2360791 - DNA, 16 bp, Homo sapiens
tcctttaaaaaaattt

SEQ ID NO: 2360792 - DNA, 21 bp, Homo sapiens
tcctttaaaaaaatttaagtg

SEQ ID NO: 2360793 - DNA, 17 bp, Homo sapiens
tcctttaggcagcctgc

SEQ ID NO: 2360794 - DNA, 20 bp, Homo sapiens
tcctttatgtgaatttttaa

SEQ ID NO: 2360795 - DNA, 22 bp, Homo sapiens
tcctttgtgtgtgtgtcagctg

SEQ ID NO: 2360796 - DNA, 21 bp, Homo sapiens
tcctttttcctctccacacag

SEQ ID NO: 2360797 - DNA, 14 bp, Homo sapiens
tcctttttgacact

SEQ ID NO: 2360798 - DNA, 16 bp, Homo sapiens
tcctttttgacactga

SEQ ID NO: 2360799 - DNA, 12 bp, Homo sapiens
tcgaaataacaa

SEQ ID NO: 2360800 - DNA, 14 bp, Homo sapiens
tcgaaataacaatg

SEQ ID NO: 2360801 - DNA, 18 bp, Homo sapiens
tcgagaccatcctggcta

SEQ ID NO: 2360802 - DNA, 17 bp, Homo sapiens
tcgaggtgtcaccctgc

SEQ ID NO: 2360803 - DNA, 23 bp, Homo sapiens
tcgaggtgtcaccctgcagagct

SEQ ID NO: 2360804 - DNA, 11 bp, Homo sapiens
tcgccccaccc

SEQ ID NO: 2360805 - DNA, 14 bp, Homo sapiens
tcgccccacccagg

SEQ ID NO: 2360806 - DNA, 17 bp, Homo sapiens
tcgccctcctttccctt

SEQ ID NO: 2360807 - DNA, 18 bp, Homo sapiens
tcgccctcctttccctta

SEQ ID NO: 2360808 - DNA, 14 bp, Homo sapiens
tcgcgctcagtaaa

SEQ ID NO: 2360809 - DNA, 17 bp, Homo sapiens
tcgctaatcagtcattt

SEQ ID NO: 2360810 - DNA, 14 bp, Homo sapiens
tcgctccctcccag

SEQ ID NO: 2360811 - DNA, 19 bp, Homo sapiens
tcgctgccatcaccgctgg

SEQ ID NO: 2360812 - DNA, 21 bp, Homo sapiens
tcgctgccatcaccgctgggt

SEQ ID NO: 2360813 - DNA, 18 bp, Homo sapiens
tcggaactgtcctttcct

SEQ ID NO: 2360814 - DNA, 12 bp, Homo sapiens
tcggactgccaa

SEQ ID NO: 2360815 - DNA, 16 bp, Homo sapiens
tcggagaagagcgcag

SEQ ID NO: 2360816 - DNA, 23 bp, Homo sapiens
tcggatagttgctatttttgtaa

SEQ ID NO: 2360817 - DNA, 20 bp, Homo sapiens
tcggatggaccaacctgctc

SEQ ID NO: 2360818 - DNA, 18 bp, Homo sapiens
tcggcgtggcccaaggct

SEQ ID NO: 2360819 - DNA, 19 bp, Homo sapiens
tcggggtaaaaagtggctg

SEQ ID NO: 2360820 - DNA, 18 bp, Homo sapiens
tcgtcaccccagccctcg

SEQ ID NO: 2360821 - DNA, 17 bp, Homo sapiens
tcgtcccatccagctac

SEQ ID NO: 2360822 - DNA, 11 bp, Homo sapiens
tcgtgatgtgg

SEQ ID NO: 2360823 - DNA, 15 bp, Homo sapiens
tcgtgatgtggagga

SEQ ID NO: 2360824 - DNA, 13 bp, Homo sapiens
tcgtggctgtcaa

SEQ ID NO: 2360825 - DNA, 15 bp, Homo sapiens
tctaaaaaaatgttt

SEQ ID NO: 2360826 - DNA, 14 bp, Homo sapiens
tctaaaatgtttta

SEQ ID NO: 2360827 - DNA, 19 bp, Homo sapiens
tctaaaatgttttatgaca

SEQ ID NO: 2360828 - DNA, 21 bp, Homo sapiens
tctaaaatgttttatgacatt

SEQ ID NO: 2360829 - DNA, 22 bp, Homo sapiens
tctaaaatgttttatgacattt

SEQ ID NO: 2360830 - DNA, 12 bp, Homo sapiens
tctaaagagcat

SEQ ID NO: 2360831 - DNA, 13 bp, Homo sapiens
tctaaagagcatc

SEQ ID NO: 2360832 - DNA, 14 bp, Homo sapiens
tctaaataaaaata

SEQ ID NO: 2360833 - DNA, 16 bp, Homo sapiens
tctaaataaaaatatg

SEQ ID NO: 2360834 - DNA, 21 bp, Homo sapiens
tctaaataaaaatatgtaatt

SEQ ID NO: 2360835 - DNA, 18 bp, Homo sapiens
tctaacagtccttgcttt

SEQ ID NO: 2360836 - DNA, 13 bp, Homo sapiens
tctaactcagcaa

SEQ ID NO: 2360837 - DNA, 23 bp, Homo sapiens
tctcctcccttccttttccctgc

SEQ ID NO: 2360838 - DNA, 17 bp, Homo sapiens
tctcctcctctgtcttt

SEQ ID NO: 2360839 - DNA, 16 bp, Homo sapiens
tctcctctcccccagg

SEQ ID NO: 2360840 - DNA, 13 bp, Homo sapiens
tctcctctgcttc

SEQ ID NO: 2360841 - DNA, 21 bp, Homo sapiens
tctcctggcctatccgctgcc

SEQ ID NO: 2360842 - DNA, 23 bp, Homo sapiens
tctcctggcctatccgctgccag

SEQ ID NO: 2360843 - DNA, 12 bp, Homo sapiens
tctccttaagct

SEQ ID NO: 2360844 - DNA, 16 bp, Homo sapiens
tctccttgagtgtatg

SEQ ID NO: 2360845 - DNA, 22 bp, Homo sapiens
tctccttgccccccgccctcat

SEQ ID NO: 2360846 - DNA, 18 bp, Homo sapiens
tctcggatagttgctatt

SEQ ID NO: 2360847 - DNA, 23 bp, Homo sapiens
tctcggatagttgctatttttgt

SEQ ID NO: 2360848 - DNA, 18 bp, Homo sapiens
tctctacagtctcgtctc

SEQ ID NO: 2360849 - DNA, 22 bp, Homo sapiens
tctctacagtctcgtctctttt

SEQ ID NO: 2360850 - DNA, 12 bp, Homo sapiens
tctctactgctt

SEQ ID NO: 2360851 - DNA, 13 bp, Homo sapiens
tctctattttcat

SEQ ID NO: 2360852 - DNA, 15 bp, Homo sapiens
tctctccctccctct

SEQ ID NO: 2360853 - DNA, 19 bp, Homo sapiens
tctctccctccctctctca

SEQ ID NO: 2360854 - DNA, 13 bp, Homo sapiens
tctctcctggcct

SEQ ID NO: 2360855 - DNA, 16 bp, Homo sapiens
tctctcctggcctatc

SEQ ID NO: 2360856 - DNA, 13 bp, Homo sapiens
tctctcctggctc

SEQ ID NO: 2360857 - DNA, 15 bp, Homo sapiens
tctctcttctcagag

SEQ ID NO: 2360858 - DNA, 15 bp, Homo sapiens
tctctctttcctcca

SEQ ID NO: 2360859 - DNA, 11 bp, Homo sapiens
tctctgaaggg

SEQ ID NO: 2360860 - DNA, 19 bp, Homo sapiens
tctctgacgcttgtgacag

SEQ ID NO: 2360861 - DNA, 20 bp, Homo sapiens
tctctggaagcccctgggcc

SEQ ID NO: 2360862 - DNA, 13 bp, Homo sapiens
tctctggcccaga

SEQ ID NO: 2360863 - DNA, 17 bp, Homo sapiens
tctctggcccagaaagc

SEQ ID NO: 2360864 - DNA, 13 bp, Homo sapiens
tctctgtaagtgt

SEQ ID NO: 2360865 - DNA, 21 bp, Homo sapiens
tctctgtaagtgtagctcaaa

SEQ ID NO: 2360866 - DNA, 18 bp, Homo sapiens
tctcttatcctctctctc

SEQ ID NO: 2360867 - DNA, 21 bp, Homo sapiens
tctcttcactaccctgattct

SEQ ID NO: 2360868 - DNA, 15 bp, Homo sapiens
tctcttccccagaga

SEQ ID NO: 2360869 - DNA, 15 bp, Homo sapiens
tctcttgagctggcc

SEQ ID NO: 2360870 - DNA, 21 bp, Homo sapiens
tctcttgccatttgtagcttt

SEQ ID NO: 2360871 - DNA, 16 bp, Homo sapiens
tctctttaaccctccc

SEQ ID NO: 2360872 - DNA, 15 bp, Homo sapiens
tctctttcctccacc

SEQ ID NO: 2360873 - DNA, 15 bp, Homo sapiens
tctctttccttgagc

SEQ ID NO: 2360874 - DNA, 18 bp, Homo sapiens
tctctttggaaatagcat

SEQ ID NO: 2360875 - DNA, 20 bp, Homo sapiens
tctcttttcccctttcctgt

SEQ ID NO: 2360876 - DNA, 14 bp, Homo sapiens
tctgaaacacacga

SEQ ID NO: 2360877 - DNA, 22 bp, Homo sapiens
tctgaaatcttcccatgcattc

SEQ ID NO: 2360878 - DNA, 12 bp, Homo sapiens
tctgaactcaaa

SEQ ID NO: 2360879 - DNA, 17 bp, Homo sapiens
tctgaactcaaactgag

SEQ ID NO: 2360880 - DNA, 19 bp, Homo sapiens
tctgaagaaggaaggcctg

SEQ ID NO: 2360881 - DNA, 23 bp, Homo sapiens
tctgaagaaggaaggcctgagcc

SEQ ID NO: 2360882 - DNA, 15 bp, Homo sapiens
tctgaaggagaggag

SEQ ID NO: 2360883 - DNA, 13 bp, Homo sapiens
tctgaagggaccc

SEQ ID NO: 2360884 - DNA, 19 bp, Homo sapiens
tctgaatctcaagatgggg

SEQ ID NO: 2360885 - DNA, 23 bp, Homo sapiens
tctgacctggcatctaattctga

SEQ ID NO: 2360886 - DNA, 20 bp, Homo sapiens
tctgacgcttgtgacagtgc

SEQ ID NO: 2360887 - DNA, 16 bp, Homo sapiens
tctgagaagctctgaa

SEQ ID NO: 2360888 - DNA, 12 bp, Homo sapiens
tctgagcacaga

SEQ ID NO: 2360889 - DNA, 15 bp, Homo sapiens
tctgagccacagtgg

SEQ ID NO: 2360890 - DNA, 12 bp, Homo sapiens
tctgagctgggc

SEQ ID NO: 2360891 - DNA, 19 bp, Homo sapiens
tctgaggtgcactgggagg

SEQ ID NO: 2360892 - DNA, 19 bp, Homo sapiens
tctgatactttagtacaat

SEQ ID NO: 2360893 - DNA, 21 bp, Homo sapiens
tctgatggccttaatttcctt

SEQ ID NO: 2360894 - DNA, 23 bp, Homo sapiens
tctgatggccttaatttcctttt

SEQ ID NO: 2360895 - DNA, 13 bp, Homo sapiens
tctgatgtcccag

SEQ ID NO: 2360896 - DNA, 19 bp, Homo sapiens
tctgattatgtaagcattt

SEQ ID NO: 2360897 - DNA, 16 bp, Homo sapiens
tctgattctagtgtgt

SEQ ID NO: 2360898 - DNA, 15 bp, Homo sapiens
tctgattctggcttt

SEQ ID NO: 2360899 - DNA, 19 bp, Homo sapiens
tctgattctggctttaagc

SEQ ID NO: 2360900 - DNA, 23 bp, Homo sapiens
tctgattctggctttaagccttc

SEQ ID NO: 2360901 - DNA, 22 bp, Homo sapiens
tctgatttgtaacccactgaga

SEQ ID NO: 2360902 - DNA, 12 bp, Homo sapiens
tctgcacatgaa

SEQ ID NO: 2360903 - DNA, 19 bp, Homo sapiens
tctgcacatgtcttgtaca

SEQ ID NO: 2360904 - DNA, 17 bp, Homo sapiens
tctgcagtcatctcccc

SEQ ID NO: 2360905 - DNA, 16 bp, Homo sapiens
tctgcattcattttta

SEQ ID NO: 2360906 - DNA, 23 bp, Homo sapiens
tctgcccacgcagaggacgcacg

SEQ ID NO: 2360907 - DNA, 19 bp, Homo sapiens
tctgcccctggacctggga

SEQ ID NO: 2360908 - DNA, 17 bp, Homo sapiens
tctgccctggctgctgc

SEQ ID NO: 2360909 - DNA, 16 bp, Homo sapiens
tctgccggtgctcgga

SEQ ID NO: 2360910 - DNA, 23 bp, Homo sapiens
tctgcctcagacgttgcctgaga

SEQ ID NO: 2360911 - DNA, 20 bp, Homo sapiens
tctgcctctcccaggctgtc

SEQ ID NO: 2360912 - DNA, 13 bp, Homo sapiens
tctgcctctctgg

SEQ ID NO: 2360913 - DNA, 17 bp, Homo sapiens
tctgccttaaaaccaaa

SEQ ID NO: 2360914 - DNA, 20 bp, Homo sapiens
tctgccttctcatgatccaa

SEQ ID NO: 2360915 - DNA, 21 bp, Homo sapiens
tctgctcaccgcccatcaggg

SEQ ID NO: 2360916 - DNA, 13 bp, Homo sapiens
tctgctctggtgg

SEQ ID NO: 2360917 - DNA, 15 bp, Homo sapiens
tctgctgacctgctg

SEQ ID NO: 2360918 - DNA, 16 bp, Homo sapiens
tctgctggggcctggg

SEQ ID NO: 2360919 - DNA, 16 bp, Homo sapiens
tctgctggtatttcta

SEQ ID NO: 2360920 - DNA, 16 bp, Homo sapiens
tctgcttctcatccca

SEQ ID NO: 2360921 - DNA, 15 bp, Homo sapiens
tctgcttttctgccc

SEQ ID NO: 2360922 - DNA, 15 bp, Homo sapiens
tctggaaagaggctc

SEQ ID NO: 2360923 - DNA, 21 bp, Homo sapiens
tctggaacatggactttcttg

SEQ ID NO: 2360924 - DNA, 17 bp, Homo sapiens
tctggaagcccctgggc

SEQ ID NO: 2360925 - DNA, 20 bp, Homo sapiens
tctggacagcagaagcctcc

SEQ ID NO: 2360926 - DNA, 13 bp, Homo sapiens
tctggacagccag

SEQ ID NO: 2360927 - DNA, 17 bp, Homo sapiens
tctggacagccagtgac

SEQ ID NO: 2360928 - DNA, 14 bp, Homo sapiens
tctggacctctggg

SEQ ID NO: 2360929 - DNA, 17 bp, Homo sapiens
tctggacggcaggctca

SEQ ID NO: 2360930 - DNA, 19 bp, Homo sapiens
tctggacggcaggctcact

SEQ ID NO: 2360931 - DNA, 21 bp, Homo sapiens
tctggacggcaggctcactgc

SEQ ID NO: 2360932 - DNA, 16 bp, Homo sapiens
tctggagccctaaccc

SEQ ID NO: 2360933 - DNA, 23 bp, Homo sapiens
tctggagccctaaccccttccag

SEQ ID NO: 2360934 - DNA, 15 bp, Homo sapiens
tctggcaacatcttt

SEQ ID NO: 2360935 - DNA, 16 bp, Homo sapiens
tctggcaacatcttta

SEQ ID NO: 2360936 - DNA, 14 bp, Homo sapiens
tctggctttaagcc

SEQ ID NO: 2360937 - DNA, 13 bp, Homo sapiens
tctggctttgctc

SEQ ID NO: 2360938 - DNA, 15 bp, Homo sapiens
tctgggatgtcacag

SEQ ID NO: 2360939 - DNA, 21 bp, Homo sapiens
tctgggcacgcctgctggccg

SEQ ID NO: 2360940 - DNA, 21 bp, Homo sapiens
tctgggcattttcctcctctg

SEQ ID NO: 2360941 - DNA, 17 bp, Homo sapiens
tctgggctgggcacctg

SEQ ID NO: 2360942 - DNA, 17 bp, Homo sapiens
tctggggcaggctgggc

SEQ ID NO: 2360943 - DNA, 21 bp, Homo sapiens
tctggggcaggctgggccatg

SEQ ID NO: 2360944 - DNA, 13 bp, Homo sapiens
tctggggctgtgt

SEQ ID NO: 2360945 - DNA, 19 bp, Homo sapiens
tctggggggatatttccta

SEQ ID NO: 2360946 - DNA, 18 bp, Homo sapiens
tctgggtgctactgggga

SEQ ID NO: 2360947 - DNA, 15 bp, Homo sapiens
tctggtactttctgt

SEQ ID NO: 2360948 - DNA, 20 bp, Homo sapiens
tctggtcaagggctgtcatt

SEQ ID NO: 2360949 - DNA, 20 bp, Homo sapiens
tctgtaagagcttgctccag

SEQ ID NO: 2360950 - DNA, 17 bp, Homo sapiens
tctgtacagatcaagaa

SEQ ID NO: 2360951 - DNA, 15 bp, Homo sapiens
tctgtataatagaga

SEQ ID NO: 2360952 - DNA, 22 bp, Homo sapiens
tctttgctccagataactctct

SEQ ID NO: 2360953 - DNA, 13 bp, Homo sapiens
tctttgctgcaga

SEQ ID NO: 2360954 - DNA, 18 bp, Homo sapiens
tctttggaaataaaagat

SEQ ID NO: 2360955 - DNA, 20 bp, Homo sapiens
tctttggaaataaaagataa

SEQ ID NO: 2360956 - DNA, 17 bp, Homo sapiens
tctttggaaatagcatg

SEQ ID NO: 2360957 - DNA, 23 bp, Homo sapiens
tctttgtaagagtgtagaagcat

SEQ ID NO: 2360958 - DNA, 14 bp, Homo sapiens
tctttgtaccaaaa

SEQ ID NO: 2360959 - DNA, 15 bp, Homo sapiens
tctttgttacaggca

SEQ ID NO: 2360960 - DNA, 13 bp, Homo sapiens
tcttttaccctgg

SEQ ID NO: 2360961 - DNA, 18 bp, Homo sapiens
tcttttaccctggcccct

SEQ ID NO: 2360962 - DNA, 21 bp, Homo sapiens
tcttttcagaagcaagccaga

SEQ ID NO: 2360963 - DNA, 22 bp, Homo sapiens
tcttttcagaagcaagccagac

SEQ ID NO: 2360964 - DNA, 12 bp, Homo sapiens
tcttttgaagca

SEQ ID NO: 2360965 - DNA, 19 bp, Homo sapiens
tcttttgtaataaactatt

SEQ ID NO: 2360966 - DNA, 13 bp, Homo sapiens
tctttttcctcct

SEQ ID NO: 2360967 - DNA, 16 bp, Homo sapiens
tcttttttaaatgttt

SEQ ID NO: 2360968 - DNA, 19 bp, Homo sapiens
tcttttttaaatgtttctt

SEQ ID NO: 2360969 - DNA, 23 bp, Homo sapiens
tcttttttaaccggtaagagttt

SEQ ID NO: 2360970 - DNA, 21 bp, Homo sapiens
tctttttttaagtgttctgtg

SEQ ID NO: 2360971 - DNA, 17 bp, Homo sapiens
tctttttttgagtgaca

SEQ ID NO: 2360972 - DNA, 20 bp, Homo sapiens
tctttttttttaagttctta

SEQ ID NO: 2360973 - DNA, 18 bp, Homo sapiens
tgaaaaacacggcagctg

SEQ ID NO: 2360974 - DNA, 22 bp, Homo sapiens
tgaaaaacacggcagctgtagc

SEQ ID NO: 2360975 - DNA, 22 bp, Homo sapiens
tgaaaaagctgcttcttattaa

SEQ ID NO: 2360976 - DNA, 13 bp, Homo sapiens
tgaaaaatataaa

SEQ ID NO: 2360977 - DNA, 19 bp, Homo sapiens
tgaaaaatataaaattatg

SEQ ID NO: 2360978 - DNA, 19 bp, Homo sapiens
tgaaaaatctcattatttc

SEQ ID NO: 2360979 - DNA, 11 bp, Homo sapiens
tgaaaaattaa

SEQ ID NO: 2360980 - DNA, 12 bp, Homo sapiens
tgaaaaattaac

SEQ ID NO: 2360981 - DNA, 14 bp, Homo sapiens
tgaaaacatgtaat

SEQ ID NO: 2360982 - DNA, 16 bp, Homo sapiens
tgaaaagaaggaaaga

SEQ ID NO: 2360983 - DNA, 18 bp, Homo sapiens
tgaaaagaccaagacttt

SEQ ID NO: 2360984 - DNA, 13 bp, Homo sapiens
tgaaaagctatta

SEQ ID NO: 2360985 - DNA, 20 bp, Homo sapiens
tgaaaagctattagccagga

SEQ ID NO: 2360986 - DNA, 18 bp, Homo sapiens
tgaaaagtgtgtatatat

SEQ ID NO: 2360987 - DNA, 15 bp, Homo sapiens
tgaaaagttggaagg

SEQ ID NO: 2360988 - DNA, 16 bp, Homo sapiens
tgaaaagttggaagga

SEQ ID NO: 2360989 - DNA, 20 bp, Homo sapiens
tgaaaataaaaagatcactt

SEQ ID NO: 2360990 - DNA, 21 bp, Homo sapiens
tgaaaatatagacattctcac

SEQ ID NO: 2360991 - DNA, 16 bp, Homo sapiens
tgaaaatattgtttta

SEQ ID NO: 2360992 - DNA, 20 bp, Homo sapiens
tgaaaatattgttttacaat

SEQ ID NO: 2360993 - DNA, 23 bp, Homo sapiens
tgaaaatattgttttacaatagt

SEQ ID NO: 2360994 - DNA, 23 bp, Homo sapiens
tgaaaatgtattcctttaaaata

SEQ ID NO: 2360995 - DNA, 20 bp, Homo sapiens
tgaaaatgtgctatactgca

SEQ ID NO: 2360996 - DNA, 20 bp, Homo sapiens
tgaaacaaagtactctttaa

SEQ ID NO: 2360997 - DNA, 13 bp, Homo sapiens
tgaaacacacgag

SEQ ID NO: 2360998 - DNA, 17 bp, Homo sapiens
tgaaacagcctgggtga

SEQ ID NO: 2360999 - DNA, 17 bp, Homo sapiens
tgaaacagttgctgtga

SEQ ID NO: 2361000 - DNA, 20 bp, Homo sapiens
tgaaaccaccgtgaaccaga

SEQ ID NO: 2361001 - DNA, 16 bp, Homo sapiens
tgaaaccttttttaag

SEQ ID NO: 2361002 - DNA, 17 bp, Homo sapiens
tgaaaccttttttaaga

SEQ ID NO: 2361003 - DNA, 17 bp, Homo sapiens
tgaaacctttttttatc

SEQ ID NO: 2361004 - DNA, 15 bp, Homo sapiens
tgaaactttgggaaa

SEQ ID NO: 2361005 - DNA, 21 bp, Homo sapiens
tgaaactttgggaaaacatgt

SEQ ID NO: 2361006 - DNA, 22 bp, Homo sapiens
tgaaactttgggaaaacatgtt

SEQ ID NO: 2361007 - DNA, 23 bp, Homo sapiens
tgaaactttgggaaaacatgtta

SEQ ID NO: 2361008 - DNA, 17 bp, Homo sapiens
tgaaagagtctgggacc

SEQ ID NO: 2361009 - DNA, 21 bp, Homo sapiens
tgaaagccaacaactctgcct

SEQ ID NO: 2361010 - DNA, 22 bp, Homo sapiens
tgaaagccaacaactctgcctt

SEQ ID NO: 2361011 - DNA, 23 bp, Homo sapiens
tgaaagccaacaactctgccttt

SEQ ID NO: 2361012 - DNA, 20 bp, Homo sapiens
tgaaaggcaggaagggaagc

SEQ ID NO: 2361013 - DNA, 16 bp, Homo sapiens
tgaaaggtaatttgag

SEQ ID NO: 2361014 - DNA, 15 bp, Homo sapiens
tgaaagttgtgatct

SEQ ID NO: 2361015 - DNA, 17 bp, Homo sapiens
tgaaagttttgtaaaag

SEQ ID NO: 2361016 - DNA, 16 bp, Homo sapiens
tgaaatattttctact

SEQ ID NO: 2361017 - DNA, 17 bp, Homo sapiens
tgaaatattttctactt

SEQ ID NO: 2361018 - DNA, 19 bp, Homo sapiens
tgaaatcttcccatgcatt

SEQ ID NO: 2361019 - DNA, 20 bp, Homo sapiens
tgaaatgaaaacatgtaata

SEQ ID NO: 2361020 - DNA, 18 bp, Homo sapiens
tgaaatgagtaaaaacta

SEQ ID NO: 2361021 - DNA, 21 bp, Homo sapiens
tgaaatgagtaaaaactagaa

SEQ ID NO: 2361022 - DNA, 19 bp, Homo sapiens
tgaaattaacacaaaggaa

SEQ ID NO: 2361023 - DNA, 19 bp, Homo sapiens
tgaaattaagcattttgaa

SEQ ID NO: 2361024 - DNA, 24 bp, Homo sapiens
tgaaattaagcattttgaaacaaa

SEQ ID NO: 2361025 - DNA, 13 bp, Homo sapiens
tgaaattctattt

SEQ ID NO: 2361026 - DNA, 13 bp, Homo sapiens
tgaaattcttcct

SEQ ID NO: 2361027 - DNA, 12 bp, Homo sapiens
tgaaatttaagc

SEQ ID NO: 2361028 - DNA, 13 bp, Homo sapiens
tgaaatttaagca

SEQ ID NO: 2361029 - DNA, 20 bp, Homo sapiens
tgaaattttaacctatgata

SEQ ID NO: 2361030 - DNA, 18 bp, Homo sapiens
tgaaattttagaaatatt

SEQ ID NO: 2361031 - DNA, 18 bp, Homo sapiens
tgaaattttatatgctta

SEQ ID NO: 2361032 - DNA, 22 bp, Homo sapiens
tgaaattttatatgcttactga

SEQ ID NO: 2361033 - DNA, 18 bp, Homo sapiens
tgaacaaagctcaaagta

SEQ ID NO: 2361034 - DNA, 21 bp, Homo sapiens
tgaacaattgtcgaaaagagt

SEQ ID NO: 2361035 - DNA, 20 bp, Homo sapiens
tgaacatgtttaatgggtat

SEQ ID NO: 2361036 - DNA, 15 bp, Homo sapiens
tgaaccttaatgtgg

SEQ ID NO: 2361037 - DNA, 17 bp, Homo sapiens
tgaacgttttcttcttt

SEQ ID NO: 2361038 - DNA, 18 bp, Homo sapiens
tgaacgttttcttctttc

SEQ ID NO: 2361039 - DNA, 15 bp, Homo sapiens
tgaactaatatatga

SEQ ID NO: 2361040 - DNA, 17 bp, Homo sapiens
tgaactacatgcataaa

SEQ ID NO: 2361041 - DNA, 17 bp, Homo sapiens
tgaactaggctgagcaa

SEQ ID NO: 2361042 - DNA, 16 bp, Homo sapiens
tgaactcaaactgagg

SEQ ID NO: 2361043 - DNA, 14 bp, Homo sapiens
tgaactgcaaagct

SEQ ID NO: 2361044 - DNA, 16 bp, Homo sapiens
tgaactgcaaagcttt

SEQ ID NO: 2361045 - DNA, 18 bp, Homo sapiens
tgaacttaataactgtgt

SEQ ID NO: 2361046 - DNA, 16 bp, Homo sapiens
tgaacttataatgatt

SEQ ID NO: 2361047 - DNA, 12 bp, Homo sapiens
tgaacttttgta

SEQ ID NO: 2361048 - DNA, 13 bp, Homo sapiens
tgaacttttgtac

SEQ ID NO: 2361049 - DNA, 14 bp, Homo sapiens
tgaacttttgtact

SEQ ID NO: 2361050 - DNA, 20 bp, Homo sapiens
tgaagaaagtcaaaaaatta

SEQ ID NO: 2361051 - DNA, 13 bp, Homo sapiens
tgaagaactgagg

SEQ ID NO: 2361052 - DNA, 21 bp, Homo sapiens
tgaagaccctatctcccacaa

SEQ ID NO: 2361053 - DNA, 21 bp, Homo sapiens
tgaagagacagagacaagtaa

SEQ ID NO: 2361054 - DNA, 17 bp, Homo sapiens
tgaagcagggtttcttt

SEQ ID NO: 2361055 - DNA, 21 bp, Homo sapiens
tgaagcagggtttcttttctt

SEQ ID NO: 2361056 - DNA, 17 bp, Homo sapiens
tgaagcatagataatat

SEQ ID NO: 2361057 - DNA, 14 bp, Homo sapiens
tgaagccaagtggg

SEQ ID NO: 2361058 - DNA, 21 bp, Homo sapiens
tgaagccaagtggggtgctgg

SEQ ID NO: 2361059 - DNA, 22 bp, Homo sapiens
tgaagccaagtggggtgctggg

SEQ ID NO: 2361060 - DNA, 16 bp, Homo sapiens
tgaagctcacttctgg

SEQ ID NO: 2361061 - DNA, 19 bp, Homo sapiens
tgaaggcaagagatgaatt

SEQ ID NO: 2361062 - DNA, 23 bp, Homo sapiens
tgaaggcaagagatgaattgcat

SEQ ID NO: 2361063 - DNA, 15 bp, Homo sapiens
tgaagggcaagaaat

SEQ ID NO: 2361064 - DNA, 19 bp, Homo sapiens
tgaagggcaagaaatggcg

SEQ ID NO: 2361065 - DNA, 21 bp, Homo sapiens
tgaagggggtaccttaagaga

SEQ ID NO: 2361066 - DNA, 17 bp, Homo sapiens
tgtaatttcaaaataca

SEQ ID NO: 2361067 - DNA, 17 bp, Homo sapiens
tgtaattttattttaaa

SEQ ID NO: 2361068 - DNA, 16 bp, Homo sapiens
tgtacaaaattaagca

SEQ ID NO: 2361069 - DNA, 19 bp, Homo sapiens
tgtacaaaattaagcaaat

SEQ ID NO: 2361070 - DNA, 16 bp, Homo sapiens
tgtacacgtgtcctgt

SEQ ID NO: 2361071 - DNA, 17 bp, Homo sapiens
tgtacacgtgtcctgta

SEQ ID NO: 2361072 - DNA, 14 bp, Homo sapiens
tgtacagattcttt

SEQ ID NO: 2361073 - DNA, 18 bp, Homo sapiens
tgtacagattctttcagt

SEQ ID NO: 2361074 - DNA, 19 bp, Homo sapiens
tgtacagattctttcagtt

SEQ ID NO: 2361075 - DNA, 22 bp, Homo sapiens
tgtacatagttatttttctctt

SEQ ID NO: 2361076 - DNA, 17 bp, Homo sapiens
tgtacatgtgtagcctg

SEQ ID NO: 2361077 - DNA, 21 bp, Homo sapiens
tgtacatgtgtagcctgtgca

SEQ ID NO: 2361078 - DNA, 15 bp, Homo sapiens
tgtaccaaaatttta

SEQ ID NO: 2361079 - DNA, 23 bp, Homo sapiens
tgtacgacacgggtggggaaagg

SEQ ID NO: 2361080 - DNA, 14 bp, Homo sapiens
tgtactaaacagta

SEQ ID NO: 2361081 - DNA, 18 bp, Homo sapiens
tgtactaatctgagattg

SEQ ID NO: 2361082 - DNA, 22 bp, Homo sapiens
tgtactaatctgagattgtgtt

SEQ ID NO: 2361083 - DNA, 15 bp, Homo sapiens
tgtactctacaaaat

SEQ ID NO: 2361084 - DNA, 17 bp, Homo sapiens
tgtactctacaaaatat

SEQ ID NO: 2361085 - DNA, 23 bp, Homo sapiens
tgtactgaatttttttgtaataa

SEQ ID NO: 2361086 - DNA, 21 bp, Homo sapiens
tgtacttcccgggccagggct

SEQ ID NO: 2361087 - DNA, 22 bp, Homo sapiens
tgtacttcccgggccagggctg

SEQ ID NO: 2361088 - DNA, 19 bp, Homo sapiens
tgtactttatcatgaatgc

SEQ ID NO: 2361089 - DNA, 20 bp, Homo sapiens
tgtactttatcatgaatgct

SEQ ID NO: 2361090 - DNA, 21 bp, Homo sapiens
tgtactttatcatgaatgctt

SEQ ID NO: 2361091 - DNA, 16 bp, Homo sapiens
tgtagacaaagtacat

SEQ ID NO: 2361092 - DNA, 14 bp, Homo sapiens
tgtagagttaagaa

SEQ ID NO: 2361093 - DNA, 15 bp, Homo sapiens
tgtagagttaagaag

SEQ ID NO: 2361094 - DNA, 16 bp, Homo sapiens
tgtagagttaagaagc

SEQ ID NO: 2361095 - DNA, 18 bp, Homo sapiens
tgtagagttaagaagctg

SEQ ID NO: 2361096 - DNA, 19 bp, Homo sapiens
tgtagatattgtgaagtac

SEQ ID NO: 2361097 - DNA, 22 bp, Homo sapiens
tgtagcatttaaaatggaaaat

SEQ ID NO: 2361098 - DNA, 13 bp, Homo sapiens
tgtagccacagct

SEQ ID NO: 2361099 - DNA, 24 bp, Homo sapiens
tgtagccacagctgctgttctcag

SEQ ID NO: 2361100 - DNA, 13 bp, Homo sapiens
tgtagcctgtgca

SEQ ID NO: 2361101 - DNA, 15 bp, Homo sapiens
tgtagcctgtgcatg

SEQ ID NO: 2361102 - DNA, 22 bp, Homo sapiens
tgtagctcaaataggtcatcat

SEQ ID NO: 2361103 - DNA, 13 bp, Homo sapiens
tgtagctcagtca

SEQ ID NO: 2361104 - DNA, 17 bp, Homo sapiens
tgtagctcagtcatcaa

SEQ ID NO: 2361105 - DNA, 23 bp, Homo sapiens
tgtagctctgaatgctatttgtg

SEQ ID NO: 2361106 - DNA, 22 bp, Homo sapiens
tgtaggaaccgtggtatgtctg

SEQ ID NO: 2361107 - DNA, 23 bp, Homo sapiens
tgtagtaaaagtggtctctgctg

SEQ ID NO: 2361108 - DNA, 18 bp, Homo sapiens
tgtagttaatataaatgt

SEQ ID NO: 2361109 - DNA, 15 bp, Homo sapiens
tgtagttgcgtggac

SEQ ID NO: 2361110 - DNA, 20 bp, Homo sapiens
tgtagttgcgtggactctgc

SEQ ID NO: 2361111 - DNA, 13 bp, Homo sapiens
tgtataaatatac

SEQ ID NO: 2361112 - DNA, 14 bp, Homo sapiens
tgtataaatataca

SEQ ID NO: 2361113 - DNA, 13 bp, Homo sapiens
tgtataagttatt

SEQ ID NO: 2361114 - DNA, 23 bp, Homo sapiens
tgtataagttatttttgtacatg

SEQ ID NO: 2361115 - DNA, 14 bp, Homo sapiens
tgtataatattgaa

SEQ ID NO: 2361116 - DNA, 13 bp, Homo sapiens
tgtatacagtgca

SEQ ID NO: 2361117 - DNA, 19 bp, Homo sapiens
tgtatagcatgaaataaaa

SEQ ID NO: 2361118 - DNA, 22 bp, Homo sapiens
tgtatatattttgtgtgaaatt

SEQ ID NO: 2361119 - DNA, 14 bp, Homo sapiens
tgtatattacaatg

SEQ ID NO: 2361120 - DNA, 15 bp, Homo sapiens
tgtatattacaatga

SEQ ID NO: 2361121 - DNA, 18 bp, Homo sapiens
tgtatatttttaaagaat

SEQ ID NO: 2361122 - DNA, 20 bp, Homo sapiens
tgtatatttttaaagaatgt

SEQ ID NO: 2361123 - DNA, 21 bp, Homo sapiens
tgtatatttttaaagaatgtt

SEQ ID NO: 2361124 - DNA, 18 bp, Homo sapiens
tgtatccaaggaaacatt

SEQ ID NO: 2361125 - DNA, 19 bp, Homo sapiens
tgtatctttgtaagagcaa

SEQ ID NO: 2361126 - DNA, 18 bp, Homo sapiens
tgtatgaataatgaaaat

SEQ ID NO: 2361127 - DNA, 12 bp, Homo sapiens
tgtatgtaaata

SEQ ID NO: 2361128 - DNA, 15 bp, Homo sapiens
tgtatgtgtgttttt

SEQ ID NO: 2361129 - DNA, 20 bp, Homo sapiens
tgtattagaagattttagaa

SEQ ID NO: 2361130 - DNA, 17 bp, Homo sapiens
tgtattcagaggcagtg

SEQ ID NO: 2361131 - DNA, 15 bp, Homo sapiens
tgtatttccagtgca

SEQ ID NO: 2361132 - DNA, 14 bp, Homo sapiens
tgtatttgatttat

SEQ ID NO: 2361133 - DNA, 18 bp, Homo sapiens
tgtattttatttagacaa

SEQ ID NO: 2361134 - DNA, 19 bp, Homo sapiens
tgtattttatttagacaag

SEQ ID NO: 2361135 - DNA, 14 bp, Homo sapiens
tgtattttgattat

SEQ ID NO: 2361136 - DNA, 21 bp, Homo sapiens
tgtatttttcaaggcatttat

SEQ ID NO: 2361137 - DNA, 19 bp, Homo sapiens
tgtcaagctgctctgagcc

SEQ ID NO: 2361138 - DNA, 14 bp, Homo sapiens
tgtcaaggaagaag

SEQ ID NO: 2361139 - DNA, 15 bp, Homo sapiens
tgtcaagttgtacat

SEQ ID NO: 2361140 - DNA, 17 bp, Homo sapiens
tgtcaatgagagcataa

SEQ ID NO: 2361141 - DNA, 23 bp, Homo sapiens
tgtcacaagtggtgtttattgca

SEQ ID NO: 2361142 - DNA, 19 bp, Homo sapiens
tgtcacagtccaaccagaa

SEQ ID NO: 2361143 - DNA, 22 bp, Homo sapiens
tgtcacagtccaaccagaaaca

SEQ ID NO: 2361144 - DNA, 18 bp, Homo sapiens
tgtcaccaccctgctcat

SEQ ID NO: 2361145 - DNA, 22 bp, Homo sapiens
tgtcaccaccctgctcatccac

SEQ ID NO: 2361146 - DNA, 18 bp, Homo sapiens
tgtcaccctgcagagcta

SEQ ID NO: 2361147 - DNA, 16 bp, Homo sapiens
tgtcactgcctgacat

SEQ ID NO: 2361148 - DNA, 11 bp, Homo sapiens
tgtcagccttg

SEQ ID NO: 2361149 - DNA, 13 bp, Homo sapiens
tgtcagccttgca

SEQ ID NO: 2361150 - DNA, 18 bp, Homo sapiens
tgtcagctactaatgatg

SEQ ID NO: 2361151 - DNA, 21 bp, Homo sapiens
tgtcagctactaatgatgttt

SEQ ID NO: 2361152 - DNA, 13 bp, Homo sapiens
tgtcagctgaggc

SEQ ID NO: 2361153 - DNA, 18 bp, Homo sapiens
tgtcaggctgaaaacaat

SEQ ID NO: 2361154 - DNA, 16 bp, Homo sapiens
tgtcataaggttttta

SEQ ID NO: 2361155 - DNA, 21 bp, Homo sapiens
tgtcattgcacataagcttcc

SEQ ID NO: 2361156 - DNA, 18 bp, Homo sapiens
tgtccaaaagcgccctca

SEQ ID NO: 2361157 - DNA, 11 bp, Homo sapiens
tgtccaaagag

SEQ ID NO: 2361158 - DNA, 21 bp, Homo sapiens
tgtccaaagaggctgcccctc

SEQ ID NO: 2361159 - DNA, 13 bp, Homo sapiens
tgtccagcttcca

SEQ ID NO: 2361160 - DNA, 17 bp, Homo sapiens
tgtccagcttccaaagc

SEQ ID NO: 2361161 - DNA, 15 bp, Homo sapiens
tgtccaggcagctcc

SEQ ID NO: 2361162 - DNA, 17 bp, Homo sapiens
tgtccaggcagctccct

SEQ ID NO: 2361163 - DNA, 22 bp, Homo sapiens
tgtccaggtagaaaagaaatgg

SEQ ID NO: 2361164 - DNA, 23 bp, Homo sapiens
tgtccaggtagaaaagaaatggt

SEQ ID NO: 2361165 - DNA, 17 bp, Homo sapiens
tgtccagtgcctacatc

SEQ ID NO: 2361166 - DNA, 13 bp, Homo sapiens
tgtccatacactt

SEQ ID NO: 2361167 - DNA, 23 bp, Homo sapiens
tgtcccaccatacgagcacctcc

SEQ ID NO: 2361168 - DNA, 22 bp, Homo sapiens
tgtcccagccccggcaagccac

SEQ ID NO: 2361169 - DNA, 17 bp, Homo sapiens
tgtcccaggccggccca

SEQ ID NO: 2361170 - DNA, 18 bp, Homo sapiens
tgtcccaggccggcccag

SEQ ID NO: 2361171 - DNA, 21 bp, Homo sapiens
tgtcccatcggagtgcggacc

SEQ ID NO: 2361172 - DNA, 24 bp, Homo sapiens
tgtccccaaaggacgcctgcagga

SEQ ID NO: 2361173 - DNA, 14 bp, Homo sapiens
tgtcccccaggctg

SEQ ID NO: 2361174 - DNA, 19 bp, Homo sapiens
tgtcccccccaggccttgt

SEQ ID NO: 2361175 - DNA, 21 bp, Homo sapiens
tgtccccctttagatctctga

SEQ ID NO: 2361176 - DNA, 17 bp, Homo sapiens
tgtcccggttcaccttg

SEQ ID NO: 2361177 - DNA, 16 bp, Homo sapiens
tgtccctccaacacag

SEQ ID NO: 2361178 - DNA, 13 bp, Homo sapiens
tgtccctgtagct

SEQ ID NO: 2361179 - DNA, 19 bp, Homo sapiens
tgtccctgtagctcagtca

SEQ ID NO: 2361180 - DNA, 18 bp, Homo sapiens
tgtgtctgccaaacacat

SEQ ID NO: 2361181 - DNA, 14 bp, Homo sapiens
tgtgtctgtacacg

SEQ ID NO: 2361182 - DNA, 14 bp, Homo sapiens
tgtgtgaaattgca

SEQ ID NO: 2361183 - DNA, 14 bp, Homo sapiens
tgtgtgattgaagg

SEQ ID NO: 2361184 - DNA, 11 bp, Homo sapiens
tgtgtggctgt

SEQ ID NO: 2361185 - DNA, 19 bp, Homo sapiens
tgtgtgtattcagaggcag

SEQ ID NO: 2361186 - DNA, 14 bp, Homo sapiens
tgtgtgtgtcagct

SEQ ID NO: 2361187 - DNA, 11 bp, Homo sapiens
tgtgtgtgtgt

SEQ ID NO: 2361188 - DNA, 12 bp, Homo sapiens
tgtgtgtgtgtg

SEQ ID NO: 2361189 - DNA, 16 bp, Homo sapiens
tgtgttcccatttcag

SEQ ID NO: 2361190 - DNA, 16 bp, Homo sapiens
tgtgttttcttcgtgg

SEQ ID NO: 2361191 - DNA, 23 bp, Homo sapiens
tgtgttttcttcgtggattgttt

SEQ ID NO: 2361192 - DNA, 15 bp, Homo sapiens
tgtgttttttaagat

SEQ ID NO: 2361193 - DNA, 12 bp, Homo sapiens
tgttaaagactt

SEQ ID NO: 2361194 - DNA, 12 bp, Homo sapiens
tgttaaagagaa

SEQ ID NO: 2361195 - DNA, 15 bp, Homo sapiens
tgttaaatttgtaag

SEQ ID NO: 2361196 - DNA, 17 bp, Homo sapiens
tgttaaatttgtaagtt

SEQ ID NO: 2361197 - DNA, 18 bp, Homo sapiens
tgttaaatttgtaagttt

SEQ ID NO: 2361198 - DNA, 20 bp, Homo sapiens
tgttaaggaaactcttatct

SEQ ID NO: 2361199 - DNA, 22 bp, Homo sapiens
tgttaaggaaactcttatctca

SEQ ID NO: 2361200 - DNA, 23 bp, Homo sapiens
tgttaaggaaactcttatctcag

SEQ ID NO: 2361201 - DNA, 20 bp, Homo sapiens
tgttaagggaagaattccag

SEQ ID NO: 2361202 - DNA, 23 bp, Homo sapiens
tgttacaggcaccgagaatgttg

SEQ ID NO: 2361203 - DNA, 15 bp, Homo sapiens
tgttaccattcacaa

SEQ ID NO: 2361204 - DNA, 21 bp, Homo sapiens
tgttagagaggtagcgagctg

SEQ ID NO: 2361205 - DNA, 13 bp, Homo sapiens
tgttagtaaagga

SEQ ID NO: 2361206 - DNA, 14 bp, Homo sapiens
tgttagtaaaggaa

SEQ ID NO: 2361207 - DNA, 19 bp, Homo sapiens
tgttatagaatagcctgag

SEQ ID NO: 2361208 - DNA, 12 bp, Homo sapiens
tgttatattata

SEQ ID NO: 2361209 - DNA, 13 bp, Homo sapiens
tgttatgaacagc

SEQ ID NO: 2361210 - DNA, 14 bp, Homo sapiens
tgttatgaacagct

SEQ ID NO: 2361211 - DNA, 16 bp, Homo sapiens
tgttatgaacagctgt

SEQ ID NO: 2361212 - DNA, 17 bp, Homo sapiens
tgttatgaacagctgtg

SEQ ID NO: 2361213 - DNA, 15 bp, Homo sapiens
tgttatgctgtgaca

SEQ ID NO: 2361214 - DNA, 18 bp, Homo sapiens
tgttcactcactctaaag

SEQ ID NO: 2361215 - DNA, 21 bp, Homo sapiens
tgttcagctctttccaaatta

SEQ ID NO: 2361216 - DNA, 21 bp, Homo sapiens
tgttcaggaaaaggttgaata

SEQ ID NO: 2361217 - DNA, 19 bp, Homo sapiens
tgttcatatctatgggaaa

SEQ ID NO: 2361218 - DNA, 20 bp, Homo sapiens
tgttcatcatccagatgtgg

SEQ ID NO: 2361219 - DNA, 13 bp, Homo sapiens
tgttcatttcatt

SEQ ID NO: 2361220 - DNA, 13 bp, Homo sapiens
tgttccctggagt

SEQ ID NO: 2361221 - DNA, 22 bp, Homo sapiens
tgttcctctagtagtatattta

SEQ ID NO: 2361222 - DNA, 12 bp, Homo sapiens
tgttcctgctgc

SEQ ID NO: 2361223 - DNA, 16 bp, Homo sapiens
tgttctcaggacagca

SEQ ID NO: 2361224 - DNA, 17 bp, Homo sapiens
tgttctcatgaagcagg

SEQ ID NO: 2361225 - DNA, 16 bp, Homo sapiens
tgttctccattttcaa

SEQ ID NO: 2361226 - DNA, 19 bp, Homo sapiens
tgttctgtggttcctctgc

SEQ ID NO: 2361227 - DNA, 17 bp, Homo sapiens
tgttctttcctgccctg

SEQ ID NO: 2361228 - DNA, 17 bp, Homo sapiens
tgttgacctgtgcacct

SEQ ID NO: 2361229 - DNA, 18 bp, Homo sapiens
tgttgagccccagtgctg

SEQ ID NO: 2361230 - DNA, 21 bp, Homo sapiens
tgttgataaaccaaaaacatt

SEQ ID NO: 2361231 - DNA, 16 bp, Homo sapiens
tgttgattatcttcag

SEQ ID NO: 2361232 - DNA, 22 bp, Homo sapiens
tgttgattatcttcagcccagg

SEQ ID NO: 2361233 - DNA, 18 bp, Homo sapiens
tgttgcaagatgtgaatt

SEQ ID NO: 2361234 - DNA, 18 bp, Homo sapiens
tgttgccaaagctggtct

SEQ ID NO: 2361235 - DNA, 13 bp, Homo sapiens
tgttggaaagtaa

SEQ ID NO: 2361236 - DNA, 14 bp, Homo sapiens
tgttggttcaaact

SEQ ID NO: 2361237 - DNA, 18 bp, Homo sapiens
tgttgtaagaattctgat

SEQ ID NO: 2361238 - DNA, 21 bp, Homo sapiens
tgttgtaatatcagttacagt

SEQ ID NO: 2361239 - DNA, 17 bp, Homo sapiens
tgttgtaatattttgct

SEQ ID NO: 2361240 - DNA, 13 bp, Homo sapiens
tgttgtacattta

SEQ ID NO: 2361241 - DNA, 14 bp, Homo sapiens
tgttgtacatttat

SEQ ID NO: 2361242 - DNA, 16 bp, Homo sapiens
tgttgtacatttatga

SEQ ID NO: 2361243 - DNA, 17 bp, Homo sapiens
tgttgtacatttatgat

SEQ ID NO: 2361244 - DNA, 15 bp, Homo sapiens
tgttgtatctttgta

SEQ ID NO: 2361245 - DNA, 12 bp, Homo sapiens
tgttgtcaagga

SEQ ID NO: 2361246 - DNA, 23 bp, Homo sapiens
tgttgttgaactaatatatgaaa

SEQ ID NO: 2361247 - DNA, 20 bp, Homo sapiens
tgttgtttataataaaaata

SEQ ID NO: 2361248 - DNA, 21 bp, Homo sapiens
tgttgtttataataaaaatat

SEQ ID NO: 2361249 - DNA, 18 bp, Homo sapiens
tgttgtttttaagtcctg

SEQ ID NO: 2361250 - DNA, 18 bp, Homo sapiens
tgtttaaaagaaatatat

SEQ ID NO: 2361251 - DNA, 12 bp, Homo sapiens
tgtttaaaataa

SEQ ID NO: 2361252 - DNA, 18 bp, Homo sapiens
tgtttaaaataaaatgaa

SEQ ID NO: 2361253 - DNA, 22 bp, Homo sapiens
tgtttaaaataaaatgaaaatt

SEQ ID NO: 2361254 - DNA, 21 bp, Homo sapiens
tgtttaaaatggcatttagca

SEQ ID NO: 2361255 - DNA, 22 bp, Homo sapiens
tgtttaaaatgtaatttaaatg

SEQ ID NO: 2361256 - DNA, 15 bp, Homo sapiens
tgtttaaataaaatt

SEQ ID NO: 2361257 - DNA, 20 bp, Homo sapiens
tgtttaatgggtatgctcag

SEQ ID NO: 2361258 - DNA, 23 bp, Homo sapiens
tgtttacatggcgccctgcctcc

SEQ ID NO: 2361259 - DNA, 14 bp, Homo sapiens
tgtttatgagccag

SEQ ID NO: 2361260 - DNA, 21 bp, Homo sapiens
tgtttatgagccagacaaatg

SEQ ID NO: 2361261 - DNA, 18 bp, Homo sapiens
tgtttatgttgtttataa

SEQ ID NO: 2361262 - DNA, 13 bp, Homo sapiens
tgtttatttacaa

SEQ ID NO: 2361263 - DNA, 15 bp, Homo sapiens
tgtttcattcatcct

SEQ ID NO: 2361264 - DNA, 20 bp, Homo sapiens
tgtttccagaattggtaaaa

SEQ ID NO: 2361265 - DNA, 22 bp, Homo sapiens
tgtttccagaattggtaaaaac

SEQ ID NO: 2361266 - DNA, 17 bp, Homo sapiens
tgtttctagctaaataa

SEQ ID NO: 2361267 - DNA, 18 bp, Homo sapiens
tgtttctagctaaataaa

SEQ ID NO: 2361268 - DNA, 19 bp, Homo sapiens
tgtttctgactctgagcta

SEQ ID NO: 2361269 - DNA, 14 bp, Homo sapiens
tgtttgaatgtttt

SEQ ID NO: 2361270 - DNA, 23 bp, Homo sapiens
tgtttgagtttttcctcccagtg

SEQ ID NO: 2361271 - DNA, 16 bp, Homo sapiens
tgtttgccaggacatg

SEQ ID NO: 2361272 - DNA, 19 bp, Homo sapiens
tgtttgccaggacatgcaa

SEQ ID NO: 2361273 - DNA, 12 bp, Homo sapiens
tgtttggaaaaa

SEQ ID NO: 2361274 - DNA, 16 bp, Homo sapiens
tgtttggaaaagacag

SEQ ID NO: 2361275 - DNA, 14 bp, Homo sapiens
tgtttggtaaatgt

SEQ ID NO: 2361276 - DNA, 15 bp, Homo sapiens
tgtttggtaaatgtt

SEQ ID NO: 2361277 - DNA, 14 bp, Homo sapiens
tgtttgtcctttat

SEQ ID NO: 2361278 - DNA, 17 bp, Homo sapiens
tgttttaaaataaggat

SEQ ID NO: 2361279 - DNA, 17 bp, Homo sapiens
tgttttacaatagttct

SEQ ID NO: 2361280 - DNA, 21 bp, Homo sapiens
tgttttacaatagttctgtgg

SEQ ID NO: 2361281 - DNA, 14 bp, Homo sapiens
tgttttatgacatt

SEQ ID NO: 2361282 - DNA, 12 bp, Homo sapiens
tgttttctgaaa

SEQ ID NO: 2361283 - DNA, 20 bp, Homo sapiens
tgttttgccaaagactgtaa

SEQ ID NO: 2361284 - DNA, 17 bp, Homo sapiens
tgttttggatggcttgt

SEQ ID NO: 2361285 - DNA, 13 bp, Homo sapiens
tgttttgtggata

SEQ ID NO: 2361286 - DNA, 18 bp, Homo sapiens
tgttttgtggataagaaa

SEQ ID NO: 2361287 - DNA, 17 bp, Homo sapiens
tgtttttaagtcctgta

SEQ ID NO: 2361288 - DNA, 13 bp, Homo sapiens
tgtttttcacatt

SEQ ID NO: 2361289 - DNA, 12 bp, Homo sapiens
tgttttttaaga

SEQ ID NO: 2361290 - DNA, 16 bp, Homo sapiens
tgttttttaagatagt

SEQ ID NO: 2361291 - DNA, 16 bp, Homo sapiens
ttaaaaaaatttaagt

SEQ ID NO: 2361292 - DNA, 14 bp, Homo sapiens
ttaaaaacatgaat

SEQ ID NO: 2361293 - DNA, 12 bp, Homo sapiens
ttaaaaaggaac

SEQ ID NO: 2361294 - DNA, 15 bp, Homo sapiens
ttaaaaatgtatgtt

SEQ ID NO: 2361295 - DNA, 19 bp, Homo sapiens
ttaaaacaaatatacattt

SEQ ID NO: 2361296 - DNA, 13 bp, Homo sapiens
ttcaaacaagtat

SEQ ID NO: 2361297 - DNA, 15 bp, Homo sapiens
ttcaaagactcaaat

SEQ ID NO: 2361298 - DNA, 16 bp, Homo sapiens
ttcaaagttttgttgt

SEQ ID NO: 2361299 - DNA, 18 bp, Homo sapiens
ttcaaatcattccttaga

SEQ ID NO: 2361300 - DNA, 18 bp, Homo sapiens
ttcaagagctagaaaaat

SEQ ID NO: 2361301 - DNA, 20 bp, Homo sapiens
ttcaagagctagaaaaataa

SEQ ID NO: 2361302 - DNA, 23 bp, Homo sapiens
ttcaagagctagaaaaataaaat

SEQ ID NO: 2361303 - DNA, 15 bp, Homo sapiens
ttcaagaggagcccc

SEQ ID NO: 2361304 - DNA, 22 bp, Homo sapiens
ttcaagaggagcccccaccctg

SEQ ID NO: 2361305 - DNA, 13 bp, Homo sapiens
ttcaagattctaa

SEQ ID NO: 2361306 - DNA, 16 bp, Homo sapiens
ttcaagcaaaacagtt

SEQ ID NO: 2361307 - DNA, 17 bp, Homo sapiens
ttcaaggaggcccactg

SEQ ID NO: 2361308 - DNA, 23 bp, Homo sapiens
ttcaaggaggcccactgtgtcta

SEQ ID NO: 2361309 - DNA, 11 bp, Homo sapiens
ttcaaggcatt

SEQ ID NO: 2361310 - DNA, 14 bp, Homo sapiens
ttcaaggcatttat

SEQ ID NO: 2361311 - DNA, 14 bp, Homo sapiens
ttcaagttttaaag

SEQ ID NO: 2361312 - DNA, 15 bp, Homo sapiens
ttcaagttttaaagt

SEQ ID NO: 2361313 - DNA, 19 bp, Homo sapiens
ttcaataaagcactgagca

SEQ ID NO: 2361314 - DNA, 17 bp, Homo sapiens
ttcaatatattgaactt

SEQ ID NO: 2361315 - DNA, 18 bp, Homo sapiens
ttcaatatattgaacttt

SEQ ID NO: 2361316 - DNA, 22 bp, Homo sapiens
ttcaatatgaatctataagtag

SEQ ID NO: 2361317 - DNA, 14 bp, Homo sapiens
ttcaatctgtaaac

SEQ ID NO: 2361318 - DNA, 13 bp, Homo sapiens
ttcaatgctgcag

SEQ ID NO: 2361319 - DNA, 18 bp, Homo sapiens
ttcaattagtggtcataa

SEQ ID NO: 2361320 - DNA, 20 bp, Homo sapiens
ttcacacctcacgctctgga

SEQ ID NO: 2361321 - DNA, 18 bp, Homo sapiens
ttcacactggtaaatgtt

SEQ ID NO: 2361322 - DNA, 19 bp, Homo sapiens
ttcacactggtaaatgtta

SEQ ID NO: 2361323 - DNA, 17 bp, Homo sapiens
ttcacaggtagcctatt

SEQ ID NO: 2361324 - DNA, 15 bp, Homo sapiens
ttcacagtagagcca

SEQ ID NO: 2361325 - DNA, 20 bp, Homo sapiens
ttcacagtagagccagcttg

SEQ ID NO: 2361326 - DNA, 16 bp, Homo sapiens
ttcacattaggctgtt

SEQ ID NO: 2361327 - DNA, 18 bp, Homo sapiens
ttcacattaggctgttgg

SEQ ID NO: 2361328 - DNA, 20 bp, Homo sapiens
ttcacatttgaaataaagta

SEQ ID NO: 2361329 - DNA, 15 bp, Homo sapiens
ttcaccttggaaggg

SEQ ID NO: 2361330 - DNA, 22 bp, Homo sapiens
ttcactggcccctactttgtgg

SEQ ID NO: 2361331 - DNA, 23 bp, Homo sapiens
ttcactgtataaataggagagga

SEQ ID NO: 2361332 - DNA, 13 bp, Homo sapiens
ttcacttcttcct

SEQ ID NO: 2361333 - DNA, 10 bp, Homo sapiens
ttcactttga

SEQ ID NO: 2361334 - DNA, 23 bp, Homo sapiens
ttcactttgaaaagttggaagga

SEQ ID NO: 2361335 - DNA, 15 bp, Homo sapiens
ttcagaaatataaca

SEQ ID NO: 2361336 - DNA, 20 bp, Homo sapiens
ttcagaaatataacacattt

SEQ ID NO: 2361337 - DNA, 17 bp, Homo sapiens
ttcagaagtcacacatt

SEQ ID NO: 2361338 - DNA, 17 bp, Homo sapiens
ttcagaccctgggtcag

SEQ ID NO: 2361339 - DNA, 19 bp, Homo sapiens
ttcagactgtgcaatactt

SEQ ID NO: 2361340 - DNA, 22 bp, Homo sapiens
ttcagaggataaatatcaatgg

SEQ ID NO: 2361341 - DNA, 13 bp, Homo sapiens
ttcagcagaacct

SEQ ID NO: 2361342 - DNA, 16 bp, Homo sapiens
ttcagctctttccaaa

SEQ ID NO: 2361343 - DNA, 19 bp, Homo sapiens
ttcagctctttccaaatta

SEQ ID NO: 2361344 - DNA, 20 bp, Homo sapiens
ttcagctctttccaaattaa

SEQ ID NO: 2361345 - DNA, 19 bp, Homo sapiens
ttcagctgggtcacatcca

SEQ ID NO: 2361346 - DNA, 20 bp, Homo sapiens
ttcagggctggctcctgatc

SEQ ID NO: 2361347 - DNA, 21 bp, Homo sapiens
ttcaggtgacatgtgaaacct

SEQ ID NO: 2361348 - DNA, 21 bp, Homo sapiens
ttcaggttatcgaaataacaa

SEQ ID NO: 2361349 - DNA, 23 bp, Homo sapiens
ttcagtaagtctcataggttaaa

SEQ ID NO: 2361350 - DNA, 20 bp, Homo sapiens
ttcataaattatttgattat

SEQ ID NO: 2361351 - DNA, 20 bp, Homo sapiens
ttcataagtattatgtctct

SEQ ID NO: 2361352 - DNA, 16 bp, Homo sapiens
ttcataataaaagtga

SEQ ID NO: 2361353 - DNA, 14 bp, Homo sapiens
ttcataatcagtaa

SEQ ID NO: 2361354 - DNA, 21 bp, Homo sapiens
ttcataatcagtaaatagtgt

SEQ ID NO: 2361355 - DNA, 14 bp, Homo sapiens
ttcataatgtgaga

SEQ ID NO: 2361356 - DNA, 20 bp, Homo sapiens
ttcatagtcattgtggttta

SEQ ID NO: 2361357 - DNA, 13 bp, Homo sapiens
ttcatcctataag

SEQ ID NO: 2361358 - DNA, 16 bp, Homo sapiens
ttcatccttccatcca

SEQ ID NO: 2361359 - DNA, 17 bp, Homo sapiens
ttcatccttccatccat

SEQ ID NO: 2361360 - DNA, 23 bp, Homo sapiens
ttcatctatttttggcagtctga

SEQ ID NO: 2361361 - DNA, 14 bp, Homo sapiens
ttcatgaaaatgta

SEQ ID NO: 2361362 - DNA, 23 bp, Homo sapiens
ttcatgacataataaagtatttt

SEQ ID NO: 2361363 - DNA, 21 bp, Homo sapiens
ttcatggcatgcttaaatttt

SEQ ID NO: 2361364 - DNA, 21 bp, Homo sapiens
ttcatggctgctgttgcttaa

SEQ ID NO: 2361365 - DNA, 22 bp, Homo sapiens
ttcatgtcccagaacttagcct

SEQ ID NO: 2361366 - DNA, 19 bp, Homo sapiens
ttcattattcaagaatgaa

SEQ ID NO: 2361367 - DNA, 23 bp, Homo sapiens
ttcattattcaagaatgaaaaat

SEQ ID NO: 2361368 - DNA, 18 bp, Homo sapiens
ttcatttcagggtcttgg

SEQ ID NO: 2361369 - DNA, 18 bp, Homo sapiens
ttcattttactgtatatt

SEQ ID NO: 2361370 - DNA, 22 bp, Homo sapiens
ttcattttgcactgaggatatt

SEQ ID NO: 2361371 - DNA, 14 bp, Homo sapiens
ttccaaaacaaaaa

SEQ ID NO: 2361372 - DNA, 14 bp, Homo sapiens
ttccaaaatattat

SEQ ID NO: 2361373 - DNA, 14 bp, Homo sapiens
ttccaaagaaagtt

SEQ ID NO: 2361374 - DNA, 14 bp, Homo sapiens
ttccaaataaataa

SEQ ID NO: 2361375 - DNA, 21 bp, Homo sapiens
ttccaagggtatgggaagcca

SEQ ID NO: 2361376 - DNA, 19 bp, Homo sapiens
ttccaagtcaacactcttc

SEQ ID NO: 2361377 - DNA, 15 bp, Homo sapiens
ttccaccccaagaga

SEQ ID NO: 2361378 - DNA, 15 bp, Homo sapiens
ttccagaacactctt

SEQ ID NO: 2361379 - DNA, 16 bp, Homo sapiens
ttccaggcaccctcag

SEQ ID NO: 2361380 - DNA, 21 bp, Homo sapiens
ttccaggcaccctcagggagc

SEQ ID NO: 2361381 - DNA, 15 bp, Homo sapiens
ttccaggcttctgct

SEQ ID NO: 2361382 - DNA, 17 bp, Homo sapiens
ttccaggcttctgctgg

SEQ ID NO: 2361383 - DNA, 18 bp, Homo sapiens
ttccagggatttgcctca

SEQ ID NO: 2361384 - DNA, 23 bp, Homo sapiens
ttccagggatttgcctcaccttg

SEQ ID NO: 2361385 - DNA, 20 bp, Homo sapiens
ttccagtcttcctgacactt

SEQ ID NO: 2361386 - DNA, 18 bp, Homo sapiens
ttccatacttctctcaga

SEQ ID NO: 2361387 - DNA, 10 bp, Homo sapiens
ttccatgagc

SEQ ID NO: 2361388 - DNA, 21 bp, Homo sapiens
ttccatgagttatcatgaatt

SEQ ID NO: 2361389 - DNA, 18 bp, Homo sapiens
ttccatgcgtgtttctga

SEQ ID NO: 2361390 - DNA, 14 bp, Homo sapiens
ttccattatgattc

SEQ ID NO: 2361391 - DNA, 18 bp, Homo sapiens
ttcccaatatcatgtgat

SEQ ID NO: 2361392 - DNA, 15 bp, Homo sapiens
ttcccacatgcctgc

SEQ ID NO: 2361393 - DNA, 20 bp, Homo sapiens
ttcccaccccaacctgctct

SEQ ID NO: 2361394 - DNA, 14 bp, Homo sapiens
ttcccactccaagc

SEQ ID NO: 2361395 - DNA, 17 bp, Homo sapiens
ttcccatttgtgccaga

SEQ ID NO: 2361396 - DNA, 20 bp, Homo sapiens
ttcccatttgtgccagagga

SEQ ID NO: 2361397 - DNA, 12 bp, Homo sapiens
ttccccagagag

SEQ ID NO: 2361398 - DNA, 18 bp, Homo sapiens
ttcccccaccggtccagc

SEQ ID NO: 2361399 - DNA, 22 bp, Homo sapiens
ttcccccaccggtccagctggc

SEQ ID NO: 2361400 - DNA, 23 bp, Homo sapiens
ttcccccaccggtccagctggcc

SEQ ID NO: 2361401 - DNA, 18 bp, Homo sapiens
ttcccgggccagggctgc

SEQ ID NO: 2361402 - DNA, 23 bp, Homo sapiens
ttccctccatccccctttaccct

SEQ ID NO: 2361403 - DNA, 17 bp, Homo sapiens
ttccctcctagctctcc

SEQ ID NO: 2361404 - DNA, 21 bp, Homo sapiens
ttccctcctagctctcccagt

SEQ ID NO: 2361405 - DNA, 20 bp, Homo sapiens
ttccctctctgatgtcccag

SEQ ID NO: 2361406 - DNA, 22 bp, Homo sapiens
ttccctctctgatgtcccagtg

SEQ ID NO: 2361407 - DNA, 20 bp, Homo sapiens
ttccctctgggcacgcctgc

SEQ ID NO: 2361408 - DNA, 22 bp, Homo sapiens
ttccctctgggcacgcctgctg

SEQ ID NO: 2361409 - DNA, 21 bp, Homo sapiens
ttccctgaacgttttcttctt

SEQ ID NO: 2361410 - DNA, 14 bp, Homo sapiens
ttctgtggctggct

SEQ ID NO: 2361411 - DNA, 24 bp, Homo sapiens
ttctgttaaaatggggataataat

SEQ ID NO: 2361412 - DNA, 19 bp, Homo sapiens
ttcttagctgtaacttaac

SEQ ID NO: 2361413 - DNA, 13 bp, Homo sapiens
ttcttatgtgaca

SEQ ID NO: 2361414 - DNA, 19 bp, Homo sapiens
ttcttatgtgacattaaca

SEQ ID NO: 2361415 - DNA, 15 bp, Homo sapiens
ttcttcctaatgtca

SEQ ID NO: 2361416 - DNA, 21 bp, Homo sapiens
ttcttctgattctagtgtgtg

SEQ ID NO: 2361417 - DNA, 13 bp, Homo sapiens
ttcttctgtattt

SEQ ID NO: 2361418 - DNA, 12 bp, Homo sapiens
ttcttctttccc

SEQ ID NO: 2361419 - DNA, 12 bp, Homo sapiens
ttcttctttcta

SEQ ID NO: 2361420 - DNA, 15 bp, Homo sapiens
ttcttgattcctggc

SEQ ID NO: 2361421 - DNA, 16 bp, Homo sapiens
ttcttgtcttttcaga

SEQ ID NO: 2361422 - DNA, 14 bp, Homo sapiens
ttcttgtttccttg

SEQ ID NO: 2361423 - DNA, 16 bp, Homo sapiens
ttctttaaaagaatga

SEQ ID NO: 2361424 - DNA, 18 bp, Homo sapiens
ttctttaaaagaatgact

SEQ ID NO: 2361425 - DNA, 21 bp, Homo sapiens
ttctttagagattataacaaa

SEQ ID NO: 2361426 - DNA, 12 bp, Homo sapiens
ttctttccctgg

SEQ ID NO: 2361427 - DNA, 15 bp, Homo sapiens
ttctttcctgccctg

SEQ ID NO: 2361428 - DNA, 18 bp, Homo sapiens
ttctttgaccagatcttt

SEQ ID NO: 2361429 - DNA, 16 bp, Homo sapiens
ttctttggagttaaaa

SEQ ID NO: 2361430 - DNA, 21 bp, Homo sapiens
ttctttggattctaaatacat

SEQ ID NO: 2361431 - DNA, 15 bp, Homo sapiens
ttctttgtgcctgag

SEQ ID NO: 2361432 - DNA, 21 bp, Homo sapiens
ttcttttcacattaggctgtt

SEQ ID NO: 2361433 - DNA, 17 bp, Homo sapiens
ttctttttttttaagtt

SEQ ID NO: 2361434 - DNA, 17 bp, Homo sapiens
ttgaaaaatataaaatt

SEQ ID NO: 2361435 - DNA, 17 bp, Homo sapiens
ttgaaaagcagacattt

SEQ ID NO: 2361436 - DNA, 14 bp, Homo sapiens
ttgaaacagcctgg

SEQ ID NO: 2361437 - DNA, 14 bp, Homo sapiens
ttgaaacctcaggg

SEQ ID NO: 2361438 - DNA, 12 bp, Homo sapiens
ttgaaactgtat

SEQ ID NO: 2361439 - DNA, 17 bp, Homo sapiens
ttgaaactgtatttact

SEQ ID NO: 2361440 - DNA, 20 bp, Homo sapiens
ttgaaactttgggaaaacat

SEQ ID NO: 2361441 - DNA, 22 bp, Homo sapiens
ttgaaaggcaggaagggaagcg

SEQ ID NO: 2361442 - DNA, 16 bp, Homo sapiens
ttgaaagtagagctag

SEQ ID NO: 2361443 - DNA, 13 bp, Homo sapiens
ttgaaatgagtaa

SEQ ID NO: 2361444 - DNA, 13 bp, Homo sapiens
ttgaaattctatt

SEQ ID NO: 2361445 - DNA, 18 bp, Homo sapiens
ttgaactaatatatgaaa

SEQ ID NO: 2361446 - DNA, 11 bp, Homo sapiens
ttgaagcatag

SEQ ID NO: 2361447 - DNA, 19 bp, Homo sapiens
ttgaagcatagataatatt

SEQ ID NO: 2361448 - DNA, 23 bp, Homo sapiens
ttgaagcatagataatattgttt

SEQ ID NO: 2361449 - DNA, 15 bp, Homo sapiens
ttgaaggccctgctg

SEQ ID NO: 2361450 - DNA, 20 bp, Homo sapiens
ttgaaggccctgctgagtca

SEQ ID NO: 2361451 - DNA, 22 bp, Homo sapiens
ttgaaggtgataagggaaaaga

SEQ ID NO: 2361452 - DNA, 19 bp, Homo sapiens
ttgaagttgggtgtttcca

SEQ ID NO: 2361453 - DNA, 19 bp, Homo sapiens
ttgaagtttcaagttttaa

SEQ ID NO: 2361454 - DNA, 17 bp, Homo sapiens
ttgaatataaaaaatca

SEQ ID NO: 2361455 - DNA, 16 bp, Homo sapiens
ttgaatgcttcctgac

SEQ ID NO: 2361456 - DNA, 11 bp, Homo sapiens
ttgaatgtaac

SEQ ID NO: 2361457 - DNA, 22 bp, Homo sapiens
ttgaatgttaaagggatatttt

SEQ ID NO: 2361458 - DNA, 22 bp, Homo sapiens
ttgacacaaagcttctaaagca

SEQ ID NO: 2361459 - DNA, 22 bp, Homo sapiens
ttgacaccacttagatttaaag

SEQ ID NO: 2361460 - DNA, 23 bp, Homo sapiens
ttgacactagcccaatgaaatga

SEQ ID NO: 2361461 - DNA, 17 bp, Homo sapiens
ttgacactgaaagtttt

SEQ ID NO: 2361462 - DNA, 22 bp, Homo sapiens
ttgacactgaacttaataactg

SEQ ID NO: 2361463 - DNA, 16 bp, Homo sapiens
ttgacatggaaatgaa

SEQ ID NO: 2361464 - DNA, 19 bp, Homo sapiens
ttgaccagatctttctctt

SEQ ID NO: 2361465 - DNA, 22 bp, Homo sapiens
ttgaccagatctttctcttccc

SEQ ID NO: 2361466 - DNA, 18 bp, Homo sapiens
ttgaccctgaaatatttt

SEQ ID NO: 2361467 - DNA, 22 bp, Homo sapiens
ttgacgtcactttttggccatg

SEQ ID NO: 2361468 - DNA, 20 bp, Homo sapiens
ttgacgtttcttctttctag

SEQ ID NO: 2361469 - DNA, 16 bp, Homo sapiens
ttgactgtagccacag

SEQ ID NO: 2361470 - DNA, 17 bp, Homo sapiens
ttgactgtagccacagc

SEQ ID NO: 2361471 - DNA, 22 bp, Homo sapiens
ttgactttacgcccatctcagg

SEQ ID NO: 2361472 - DNA, 18 bp, Homo sapiens
ttgacttttataaagcat

SEQ ID NO: 2361473 - DNA, 17 bp, Homo sapiens
ttgagacagtttcttag

SEQ ID NO: 2361474 - DNA, 22 bp, Homo sapiens
ttgagacagtttcttagctttt

SEQ ID NO: 2361475 - DNA, 19 bp, Homo sapiens
ttgagaggccctggggttc

SEQ ID NO: 2361476 - DNA, 15 bp, Homo sapiens
ttgagcatctgtccc

SEQ ID NO: 2361477 - DNA, 19 bp, Homo sapiens
ttgagcatgacagcctgca

SEQ ID NO: 2361478 - DNA, 15 bp, Homo sapiens
ttgagccctggctgt

SEQ ID NO: 2361479 - DNA, 11 bp, Homo sapiens
ttgagctgcct

SEQ ID NO: 2361480 - DNA, 13 bp, Homo sapiens
ttgagctgccttc

SEQ ID NO: 2361481 - DNA, 19 bp, Homo sapiens
ttgagctgccttccctagc

SEQ ID NO: 2361482 - DNA, 22 bp, Homo sapiens
ttgaggtcaagtaagaagacat

SEQ ID NO: 2361483 - DNA, 16 bp, Homo sapiens
ttgagtaatgtgacta

SEQ ID NO: 2361484 - DNA, 13 bp, Homo sapiens
ttgagtattgttt

SEQ ID NO: 2361485 - DNA, 15 bp, Homo sapiens
ttgagtattgtttaa

SEQ ID NO: 2361486 - DNA, 22 bp, Homo sapiens
ttgagtattgtttaaaatgtaa

SEQ ID NO: 2361487 - DNA, 17 bp, Homo sapiens
ttgagtttttcctccca

SEQ ID NO: 2361488 - DNA, 23 bp, Homo sapiens
ttgagtttttcctcccagtgaga

SEQ ID NO: 2361489 - DNA, 20 bp, Homo sapiens
ttgataaaccaaaaacattt

SEQ ID NO: 2361490 - DNA, 17 bp, Homo sapiens
ttgataatatatattaa

SEQ ID NO: 2361491 - DNA, 18 bp, Homo sapiens
ttgataatgttaaatttg

SEQ ID NO: 2361492 - DNA, 13 bp, Homo sapiens
ttgatataccaaa

SEQ ID NO: 2361493 - DNA, 19 bp, Homo sapiens
ttgatataccaaattaaaa

SEQ ID NO: 2361494 - DNA, 19 bp, Homo sapiens
ttgatccagaagagcccat

SEQ ID NO: 2361495 - DNA, 20 bp, Homo sapiens
ttgatccagaagagcccata

SEQ ID NO: 2361496 - DNA, 20 bp, Homo sapiens
ttgatgaaacgtcatgtgtt

SEQ ID NO: 2361497 - DNA, 21 bp, Homo sapiens
ttgatgactgccttgcctcct

SEQ ID NO: 2361498 - DNA, 20 bp, Homo sapiens
ttgatgattttcatttcatg

SEQ ID NO: 2361499 - DNA, 24 bp, Homo sapiens
ttgatgccttttttttcatgacat

SEQ ID NO: 2361500 - DNA, 19 bp, Homo sapiens
ttgatggagggtggaaata

SEQ ID NO: 2361501 - DNA, 16 bp, Homo sapiens
ttgatgtcagccttgc

SEQ ID NO: 2361502 - DNA, 18 bp, Homo sapiens
ttgatgtggccctggctg

SEQ ID NO: 2361503 - DNA, 17 bp, Homo sapiens
ttgattgggaaaacatt

SEQ ID NO: 2361504 - DNA, 19 bp, Homo sapiens
ttgattgggaaaacatttg

SEQ ID NO: 2361505 - DNA, 23 bp, Homo sapiens
ttgattttaatacattgatcagg

SEQ ID NO: 2361506 - DNA, 20 bp, Homo sapiens
ttgcaaagagacatttcaaa

SEQ ID NO: 2361507 - DNA, 22 bp, Homo sapiens
ttgcaaatgggagctgagcagc

SEQ ID NO: 2361508 - DNA, 16 bp, Homo sapiens
ttgcaagatgtgaatt

SEQ ID NO: 2361509 - DNA, 20 bp, Homo sapiens
ttgcaagatgtgaattattg

SEQ ID NO: 2361510 - DNA, 14 bp, Homo sapiens
ttgcaataacagct

SEQ ID NO: 2361511 - DNA, 17 bp, Homo sapiens
ttgcaataacagctgca

SEQ ID NO: 2361512 - DNA, 14 bp, Homo sapiens
ttgcacatgggatt

SEQ ID NO: 2361513 - DNA, 14 bp, Homo sapiens
ttgcagcttcaact

SEQ ID NO: 2361514 - DNA, 15 bp, Homo sapiens
ttgcataataagcta

SEQ ID NO: 2361515 - DNA, 20 bp, Homo sapiens
ttgcataataagctaaagag

SEQ ID NO: 2361516 - DNA, 16 bp, Homo sapiens
ttgcatactttgtatt

SEQ ID NO: 2361517 - DNA, 16 bp, Homo sapiens
ttgcatgcatgcaaat

SEQ ID NO: 2361518 - DNA, 15 bp, Homo sapiens
ttgcatttggtcaag

SEQ ID NO: 2361519 - DNA, 21 bp, Homo sapiens
ttgccaaagtacagaatttga

SEQ ID NO: 2361520 - DNA, 14 bp, Homo sapiens
ttgccatgggcctg

SEQ ID NO: 2361521 - DNA, 18 bp, Homo sapiens
ttgccatgggcctgctgc

SEQ ID NO: 2361522 - DNA, 16 bp, Homo sapiens
ttgcccatcctgactg

SEQ ID NO: 2361523 - DNA, 17 bp, Homo sapiens
ttgcctcttccagtctt

SEQ ID NO: 2361524 - DNA, 19 bp, Homo sapiens
tttcaaatagggtctaact

SEQ ID NO: 2361525 - DNA, 20 bp, Homo sapiens
tttcaaatagggtctaactc

SEQ ID NO: 2361526 - DNA, 23 bp, Homo sapiens
tttcaagaggagcccccaccctg

SEQ ID NO: 2361527 - DNA, 14 bp, Homo sapiens
tttcaagattctaa

SEQ ID NO: 2361528 - DNA, 17 bp, Homo sapiens
tttcaagattctaaagc

SEQ ID NO: 2361529 - DNA, 16 bp, Homo sapiens
tttcaagcaaaacagt

SEQ ID NO: 2361530 - DNA, 17 bp, Homo sapiens
tttcaagttttaaagtt

SEQ ID NO: 2361531 - DNA, 18 bp, Homo sapiens
tttcaagttttaaagttc

SEQ ID NO: 2361532 - DNA, 23 bp, Homo sapiens
tttcaatactcttaaattttata

SEQ ID NO: 2361533 - DNA, 16 bp, Homo sapiens
tttcacagataacata

SEQ ID NO: 2361534 - DNA, 20 bp, Homo sapiens
tttcacagcacttacaattt

SEQ ID NO: 2361535 - DNA, 13 bp, Homo sapiens
tttcacctgtaaa

SEQ ID NO: 2361536 - DNA, 14 bp, Homo sapiens
tttcacctgtaaac

SEQ ID NO: 2361537 - DNA, 17 bp, Homo sapiens
tttcacctgtaaacctg

SEQ ID NO: 2361538 - DNA, 18 bp, Homo sapiens
tttcacctgtaaacctga

SEQ ID NO: 2361539 - DNA, 16 bp, Homo sapiens
tttcaccttttcagga

SEQ ID NO: 2361540 - DNA, 13 bp, Homo sapiens
tttcacttcttcc

SEQ ID NO: 2361541 - DNA, 15 bp, Homo sapiens
tttcacttcttccta

SEQ ID NO: 2361542 - DNA, 13 bp, Homo sapiens
tttcactttgaaa

SEQ ID NO: 2361543 - DNA, 13 bp, Homo sapiens
tttcagaaatata

SEQ ID NO: 2361544 - DNA, 20 bp, Homo sapiens
tttcagaaatataacacatt

SEQ ID NO: 2361545 - DNA, 16 bp, Homo sapiens
tttcagaagcaagcca

SEQ ID NO: 2361546 - DNA, 22 bp, Homo sapiens
tttcagaagcaagccagaccta

SEQ ID NO: 2361547 - DNA, 21 bp, Homo sapiens
tttcagtcccctctctctggg

SEQ ID NO: 2361548 - DNA, 16 bp, Homo sapiens
tttcagtgttacctgt

SEQ ID NO: 2361549 - DNA, 17 bp, Homo sapiens
tttcagtgttacctgtg

SEQ ID NO: 2361550 - DNA, 14 bp, Homo sapiens
tttcagtttgttgg

SEQ ID NO: 2361551 - DNA, 15 bp, Homo sapiens
tttcataatcagtaa

SEQ ID NO: 2361552 - DNA, 15 bp, Homo sapiens
tttcatgaaaaagct

SEQ ID NO: 2361553 - DNA, 20 bp, Homo sapiens
tttcatgaaaaagctgcttc

SEQ ID NO: 2361554 - DNA, 14 bp, Homo sapiens
tttcatgaaaatac

SEQ ID NO: 2361555 - DNA, 17 bp, Homo sapiens
tttcatgaaaataccat

SEQ ID NO: 2361556 - DNA, 20 bp, Homo sapiens
tttcatgacataataaagta

SEQ ID NO: 2361557 - DNA, 22 bp, Homo sapiens
tttcatgacataataaagtatt

SEQ ID NO: 2361558 - DNA, 20 bp, Homo sapiens
tttcatggctgctgttgctt

SEQ ID NO: 2361559 - DNA, 16 bp, Homo sapiens
tttcattaaatccttt

SEQ ID NO: 2361560 - DNA, 12 bp, Homo sapiens
tttcattatgca

SEQ ID NO: 2361561 - DNA, 11 bp, Homo sapiens
tttcattgtgt

SEQ ID NO: 2361562 - DNA, 14 bp, Homo sapiens
tttccaaattaaaa

SEQ ID NO: 2361563 - DNA, 13 bp, Homo sapiens
tttccaaattgcc

SEQ ID NO: 2361564 - DNA, 16 bp, Homo sapiens
tttccaagcaaaatct

SEQ ID NO: 2361565 - DNA, 19 bp, Homo sapiens
tttccaagcaaaatctaaa

SEQ ID NO: 2361566 - DNA, 16 bp, Homo sapiens
tttccactaaaaatat

SEQ ID NO: 2361567 - DNA, 18 bp, Homo sapiens
tttccaggcaccctcagg

SEQ ID NO: 2361568 - DNA, 23 bp, Homo sapiens
tttccaggcttctgctggggcct

SEQ ID NO: 2361569 - DNA, 12 bp, Homo sapiens
tttccagtgcaa

SEQ ID NO: 2361570 - DNA, 17 bp, Homo sapiens
tttccagttcctctttt

SEQ ID NO: 2361571 - DNA, 15 bp, Homo sapiens
tttccattaactatt

SEQ ID NO: 2361572 - DNA, 16 bp, Homo sapiens
tttcccacactgtgaa

SEQ ID NO: 2361573 - DNA, 20 bp, Homo sapiens
tttcccacactgtgaactaa

SEQ ID NO: 2361574 - DNA, 13 bp, Homo sapiens
tttcccatctgca

SEQ ID NO: 2361575 - DNA, 21 bp, Homo sapiens
tttcccatttgtgccagagga

SEQ ID NO: 2361576 - DNA, 13 bp, Homo sapiens
tttcccctttcct

SEQ ID NO: 2361577 - DNA, 14 bp, Homo sapiens
tttcccctttcctg

SEQ ID NO: 2361578 - DNA, 15 bp, Homo sapiens
tttcccctttcctgt

SEQ ID NO: 2361579 - DNA, 16 bp, Homo sapiens
tttcccctttcctgtc

SEQ ID NO: 2361580 - DNA, 16 bp, Homo sapiens
tttccctgcagacctc

SEQ ID NO: 2361581 - DNA, 18 bp, Homo sapiens
tttccctgcagacctcaa

SEQ ID NO: 2361582 - DNA, 13 bp, Homo sapiens
tttcccttccaaa

SEQ ID NO: 2361583 - DNA, 13 bp, Homo sapiens
tttcctcctctgc

SEQ ID NO: 2361584 - DNA, 17 bp, Homo sapiens
tttcctctttctgctct

SEQ ID NO: 2361585 - DNA, 15 bp, Homo sapiens
tttcctgggccagaa

SEQ ID NO: 2361586 - DNA, 19 bp, Homo sapiens
tttcctggtgccaatttca

SEQ ID NO: 2361587 - DNA, 14 bp, Homo sapiens
tttccttctgttaa

SEQ ID NO: 2361588 - DNA, 13 bp, Homo sapiens
tttccttgtgcaa

SEQ ID NO: 2361589 - DNA, 21 bp, Homo sapiens
tttcctttaaaaaaatttaag

SEQ ID NO: 2361590 - DNA, 17 bp, Homo sapiens
tttcctttatgtgaatt

SEQ ID NO: 2361591 - DNA, 21 bp, Homo sapiens
tttcctttatgtgaattttta

SEQ ID NO: 2361592 - DNA, 17 bp, Homo sapiens
tttctaacagtccttgc

SEQ ID NO: 2361593 - DNA, 16 bp, Homo sapiens
tttctaagaaaatgta

SEQ ID NO: 2361594 - DNA, 18 bp, Homo sapiens
tttctacaactgattgca

SEQ ID NO: 2361595 - DNA, 20 bp, Homo sapiens
tttctagtggtctttgtaag

SEQ ID NO: 2361596 - DNA, 23 bp, Homo sapiens
tttctagtggtctttgtaagagt

SEQ ID NO: 2361597 - DNA, 15 bp, Homo sapiens
tttctcaaagttttg

SEQ ID NO: 2361598 - DNA, 20 bp, Homo sapiens
tttctcagaagtccctgttt

SEQ ID NO: 2361599 - DNA, 17 bp, Homo sapiens
tttctcctctgcttctt

SEQ ID NO: 2361600 - DNA, 13 bp, Homo sapiens
tttctccttgaaa

SEQ ID NO: 2361601 - DNA, 22 bp, Homo sapiens
tttctccttgaaatgagtaaaa

SEQ ID NO: 2361602 - DNA, 18 bp, Homo sapiens
tttctcttgagctggcct

SEQ ID NO: 2361603 - DNA, 20 bp, Homo sapiens
tttctcttttcccctttcct

SEQ ID NO: 2361604 - DNA, 13 bp, Homo sapiens
tttctgaaacaca

SEQ ID NO: 2361605 - DNA, 12 bp, Homo sapiens
tttctgccctgg

SEQ ID NO: 2361606 - DNA, 20 bp, Homo sapiens
tttctgccctggctgctgcc

SEQ ID NO: 2361607 - DNA, 19 bp, Homo sapiens
tttctgggatgtcacagtc

SEQ ID NO: 2361608 - DNA, 18 bp, Homo sapiens
tttctggggggatatttc

SEQ ID NO: 2361609 - DNA, 19 bp, Homo sapiens
tttcttagctttttaattg

SEQ ID NO: 2361610 - DNA, 20 bp, Homo sapiens
tttcttagctttttaattgt

SEQ ID NO: 2361611 - DNA, 23 bp, Homo sapiens
tttcttctgtatttttttttcta

SEQ ID NO: 2361612 - DNA, 12 bp, Homo sapiens
tttcttctttcc

SEQ ID NO: 2361613 - DNA, 19 bp, Homo sapiens
tttcttttttgctttcttg

SEQ ID NO: 2361614 - DNA, 12 bp, Homo sapiens
tttgaaaaatat

SEQ ID NO: 2361615 - DNA, 13 bp, Homo sapiens
tttgaaaagctat

SEQ ID NO: 2361616 - DNA, 17 bp, Homo sapiens
tttgaagatttaattac

SEQ ID NO: 2361617 - DNA, 17 bp, Homo sapiens
tttgaagggcaagaaat

SEQ ID NO: 2361618 - DNA, 18 bp, Homo sapiens
tttgaaggtagttgcaaa

SEQ ID NO: 2361619 - DNA, 19 bp, Homo sapiens
tttgaatatgtagtatcta

SEQ ID NO: 2361620 - DNA, 16 bp, Homo sapiens
tttgaatgtaaccaat

SEQ ID NO: 2361621 - DNA, 16 bp, Homo sapiens
tttgaattatcagcaa

SEQ ID NO: 2361622 - DNA, 13 bp, Homo sapiens
tttgacactgaaa

SEQ ID NO: 2361623 - DNA, 22 bp, Homo sapiens
tttgacactgaaagttttgtaa

SEQ ID NO: 2361624 - DNA, 16 bp, Homo sapiens
tttgacatggaaatga

SEQ ID NO: 2361625 - DNA, 21 bp, Homo sapiens
tttgaccagatctttctcttc

SEQ ID NO: 2361626 - DNA, 16 bp, Homo sapiens
tttgactattctgtat

SEQ ID NO: 2361627 - DNA, 15 bp, Homo sapiens
tttgagaatacataa

SEQ ID NO: 2361628 - DNA, 17 bp, Homo sapiens
tttgagacagtttctta

SEQ ID NO: 2361629 - DNA, 22 bp, Homo sapiens
tttgagagacgccactccctgg

SEQ ID NO: 2361630 - DNA, 17 bp, Homo sapiens
tttgagctgccttccct

SEQ ID NO: 2361631 - DNA, 23 bp, Homo sapiens
tttgaggtcaagtaagaagacat

SEQ ID NO: 2361632 - DNA, 21 bp, Homo sapiens
tttgagtttttcctcccagtg

SEQ ID NO: 2361633 - DNA, 12 bp, Homo sapiens
tttgataatgtt

SEQ ID NO: 2361634 - DNA, 19 bp, Homo sapiens
tttgataatgttaaatttg

SEQ ID NO: 2361635 - DNA, 16 bp, Homo sapiens
tttgatataccaaatt

SEQ ID NO: 2361636 - DNA, 20 bp, Homo sapiens
tttgatggagggtggaaata

SEQ ID NO: 2361637 - DNA, 14 bp, Homo sapiens
tttgatttctaatt

SEQ ID NO: 2361638 - DNA, 16 bp, Homo sapiens
tttgatttctaattgt

SEQ ID NO: 2361639 - DNA, 18 bp, Homo sapiens
tttgatttctaattgtaa

SEQ ID NO: 2361640 - DNA, 16 bp, Homo sapiens
tttgcaataacagctg

SEQ ID NO: 2361641 - DNA, 19 bp, Homo sapiens
tttgcaataacagctgcaa

SEQ ID NO: 2361642 - DNA, 18 bp, Homo sapiens
tttgcaggattcccttct

SEQ ID NO: 2361643 - DNA, 20 bp, Homo sapiens
tttgcaggattcccttctgg

SEQ ID NO: 2361644 - DNA, 13 bp, Homo sapiens
tttgcatgcatgc

SEQ ID NO: 2361645 - DNA, 17 bp, Homo sapiens
tttgcatttaaaacaga

SEQ ID NO: 2361646 - DNA, 23 bp, Homo sapiens
tttgcatttaaaacagacactgg

SEQ ID NO: 2361647 - DNA, 17 bp, Homo sapiens
tttgccaggacatgcaa

SEQ ID NO: 2361648 - DNA, 17 bp, Homo sapiens
tttgccattgtgaacca

SEQ ID NO: 2361649 - DNA, 18 bp, Homo sapiens
tttgcccagaaagaagat

SEQ ID NO: 2361650 - DNA, 16 bp, Homo sapiens
tttgcctaattcctgg

SEQ ID NO: 2361651 - DNA, 19 bp, Homo sapiens
tttgctgcactttttactt

SEQ ID NO: 2361652 - DNA, 15 bp, Homo sapiens
tttgctggaataagt

SEQ ID NO: 2361653 - DNA, 14 bp, Homo sapiens
tttgctgtgaacaa

SEQ ID NO: 2361654 - DNA, 16 bp, Homo sapiens
tttgcttgatccagaa

SEQ ID NO: 2361655 - DNA, 18 bp, Homo sapiens
tttggaaaaaactctgaa

SEQ ID NO: 2361656 - DNA, 17 bp, Homo sapiens
tttggaataatttctat

SEQ ID NO: 2361657 - DNA, 22 bp, Homo sapiens
tttggaggctggagtaatcaga

SEQ ID NO: 2361658 - DNA, 19 bp, Homo sapiens
tttggcaaacgctaaagag

SEQ ID NO: 2361659 - DNA, 16 bp, Homo sapiens
tttggccccactttga

SEQ ID NO: 2361660 - DNA, 16 bp, Homo sapiens
tttgggttctttctgg

SEQ ID NO: 2361661 - DNA, 14 bp, Homo sapiens
tttggtactaataa

SEQ ID NO: 2361662 - DNA, 21 bp, Homo sapiens
tttggtgcttctcagatttct

SEQ ID NO: 2361663 - DNA, 12 bp, Homo sapiens
tttgtaagagtg

SEQ ID NO: 2361664 - DNA, 21 bp, Homo sapiens
tttgtaagtttcaggtgacat

SEQ ID NO: 2361665 - DNA, 22 bp, Homo sapiens
tttgtactgaatttttttgtaa

SEQ ID NO: 2361666 - DNA, 20 bp, Homo sapiens
tttgtagctggggctttgat

SEQ ID NO: 2361667 - DNA, 16 bp, Homo sapiens
tttgtagtaaaagtgg

SEQ ID NO: 2361668 - DNA, 16 bp, Homo sapiens
tttgtatgttaaagag

SEQ ID NO: 2361669 - DNA, 22 bp, Homo sapiens
tttgtgagaaacatctcaataa

SEQ ID NO: 2361670 - DNA, 20 bp, Homo sapiens
tttgtgattcaatctgtaaa

SEQ ID NO: 2361671 - DNA, 18 bp, Homo sapiens
tttgtggataagaaaaat

SEQ ID NO: 2361672 - DNA, 18 bp, Homo sapiens
tttgtgtcctccaggagc

SEQ ID NO: 2361673 - DNA, 14 bp, Homo sapiens
tttgtgtgctctcc

SEQ ID NO: 2361674 - DNA, 15 bp, Homo sapiens
tttgttagggctgct

SEQ ID NO: 2361675 - DNA, 21 bp, Homo sapiens
ttttaaaaaagggagtttttg

SEQ ID NO: 2361676 - DNA, 21 bp, Homo sapiens
ttttaaaaaggtaaatggtta

SEQ ID NO: 2361677 - DNA, 18 bp, Homo sapiens
ttttaaaatagaaatttt

SEQ ID NO: 2361678 - DNA, 23 bp, Homo sapiens
ttttaaaatagaaattttgtaag

SEQ ID NO: 2361679 - DNA, 17 bp, Homo sapiens
ttttaaaattcaaaagt

SEQ ID NO: 2361680 - DNA, 22 bp, Homo sapiens
ttttaaacccaaaatatataca

SEQ ID NO: 2361681 - DNA, 20 bp, Homo sapiens
ttttaaactgtgtacataac

SEQ ID NO: 2361682 - DNA, 14 bp, Homo sapiens
ttttaaagtgcaaa

SEQ ID NO: 2361683 - DNA, 24 bp, Homo sapiens
ttttaactaaattttaaagccatt

SEQ ID NO: 2361684 - DNA, 19 bp, Homo sapiens
ttttaagatttttctcaaa

SEQ ID NO: 2361685 - DNA, 21 bp, Homo sapiens
ttttaagatttttctcaaagt

SEQ ID NO: 2361686 - DNA, 19 bp, Homo sapiens
ttttaagtttgactacata

SEQ ID NO: 2361687 - DNA, 18 bp, Homo sapiens
ttttaatattcttttgtt

SEQ ID NO: 2361688 - DNA, 21 bp, Homo sapiens
ttttaatattcttttgtttcc

SEQ ID NO: 2361689 - DNA, 18 bp, Homo sapiens
ttttaatttacttgtttt

SEQ ID NO: 2361690 - DNA, 20 bp, Homo sapiens
ttttacttttaaactgtgta

SEQ ID NO: 2361691 - DNA, 22 bp, Homo sapiens
ttttagaaatgcatatttgcca

SEQ ID NO: 2361692 - DNA, 11 bp, Homo sapiens
ttttaggaaat

SEQ ID NO: 2361693 - DNA, 18 bp, Homo sapiens
ttttagtgtgtgcataat

SEQ ID NO: 2361694 - DNA, 12 bp, Homo sapiens
ttttataaagca

SEQ ID NO: 2361695 - DNA, 18 bp, Homo sapiens
ttttataatgatgaactt

SEQ ID NO: 2361696 - DNA, 14 bp, Homo sapiens
ttttatacaaacct

SEQ ID NO: 2361697 - DNA, 13 bp, Homo sapiens
ttttatatgcttt

SEQ ID NO: 2361698 - DNA, 21 bp, Homo sapiens
ttttatatttcctttatgtga

SEQ ID NO: 2361699 - DNA, 22 bp, Homo sapiens
ttttatatttcctttatgtgaa

SEQ ID NO: 2361700 - DNA, 18 bp, Homo sapiens
ttttatcgtttttgttta

SEQ ID NO: 2361701 - DNA, 22 bp, Homo sapiens
ttttatggtggaaaagaactgt

SEQ ID NO: 2361702 - DNA, 17 bp, Homo sapiens
ttttatgtaattatata

SEQ ID NO: 2361703 - DNA, 22 bp, Homo sapiens
ttttattaaaatatttcaggtt

SEQ ID NO: 2361704 - DNA, 22 bp, Homo sapiens
ttttattaagctttttggaatc

SEQ ID NO: 2361705 - DNA, 15 bp, Homo sapiens
ttttatttgcatgtg

SEQ ID NO: 2361706 - DNA, 14 bp, Homo sapiens
ttttcaaaaaccag

SEQ ID NO: 2361707 - DNA, 21 bp, Homo sapiens
ttttcaaatcattccttagat

SEQ ID NO: 2361708 - DNA, 12 bp, Homo sapiens
ttttcaaggcat

SEQ ID NO: 2361709 - DNA, 12 bp, Homo sapiens
ttttcacatttt

SEQ ID NO: 2361710 - DNA, 18 bp, Homo sapiens
ttttcagcaaactctttt

SEQ ID NO: 2361711 - DNA, 22 bp, Homo sapiens
ttttcagggctggctcctgatc

SEQ ID NO: 2361712 - DNA, 20 bp, Homo sapiens
ttttcagtcccctctctctg

SEQ ID NO: 2361713 - DNA, 18 bp, Homo sapiens
ttttcatttcatgaaaat

SEQ ID NO: 2361714 - DNA, 17 bp, Homo sapiens
ttttccaggcttctgct

SEQ ID NO: 2361715 - DNA, 20 bp, Homo sapiens
ttttccaggcttctgctggg

SEQ ID NO: 2361716 - DNA, 17 bp, Homo sapiens
ttttcccactccaagcc

SEQ ID NO: 2361717 - DNA, 15 bp, Homo sapiens
ttttcccctttcctg

SEQ ID NO: 2361718 - DNA, 15 bp, Homo sapiens
ttttcccctttctgt

SEQ ID NO: 2361719 - DNA, 10 bp, Homo sapiens
ttttcccttt

SEQ ID NO: 2361720 - DNA, 17 bp, Homo sapiens
ttttccctttttatgtg

SEQ ID NO: 2361721 - DNA, 13 bp, Homo sapiens
ttttcctcctctg

SEQ ID NO: 2361722 - DNA, 14 bp, Homo sapiens
ttttcctcctctgc

SEQ ID NO: 2361723 - DNA, 12 bp, Homo sapiens
ttttcctttaaa

SEQ ID NO: 2361724 - DNA, 11 bp, Homo sapiens
ttttctaaaag

SEQ ID NO: 2361725 - DNA, 15 bp, Homo sapiens
ttttctcaaagtttt

SEQ ID NO: 2361726 - DNA, 19 bp, Homo sapiens
ttttctcaaagttttgaaa

SEQ ID NO: 2361727 - DNA, 20 bp, Homo sapiens
ttttctcaaagttttgaaaa

SEQ ID NO: 2361728 - DNA, 16 bp, Homo sapiens
ttttctcaatctcctc

SEQ ID NO: 2361729 - DNA, 13 bp, Homo sapiens
ttttctgccctgg

SEQ ID NO: 2361730 - DNA, 21 bp, Homo sapiens
ttttctggctgtgatcttaaa

SEQ ID NO: 2361731 - DNA, 14 bp, Homo sapiens
ttttctgtttctgt

SEQ ID NO: 2361732 - DNA, 19 bp, Homo sapiens
ttttcttccaacatgtgat

SEQ ID NO: 2361733 - DNA, 16 bp, Homo sapiens
ttttcttcttgggata

SEQ ID NO: 2361734 - DNA, 15 bp, Homo sapiens
ttttctttgaccaga

SEQ ID NO: 2361735 - DNA, 20 bp, Homo sapiens
ttttgaaaagcagacatttt

SEQ ID NO: 2361736 - DNA, 13 bp, Homo sapiens
ttttgaagcatag

SEQ ID NO: 2361737 - DNA, 18 bp, Homo sapiens
ttttgaatgcttcctgac

SEQ ID NO: 2361738 - DNA, 14 bp, Homo sapiens
ttttgacactgaaa

SEQ ID NO: 2361739 - DNA, 15 bp, Homo sapiens
ttttgatagttgtgt

SEQ ID NO: 2361740 - DNA, 22 bp, Homo sapiens
ttttgattattttttttttctt

SEQ ID NO: 2361741 - DNA, 21 bp, Homo sapiens
ttttgcactgaggatattcag

SEQ ID NO: 2361742 - DNA, 18 bp, Homo sapiens
ttttgcatttaaaacaga

SEQ ID NO: 2361743 - DNA, 17 bp, Homo sapiens
ttttggaaagtcagaat

SEQ ID NO: 2361744 - DNA, 15 bp, Homo sapiens
ttttggggagccaga

SEQ ID NO: 2361745 - DNA, 21 bp, Homo sapiens
ttttggggggcagagaataaa

SEQ ID NO: 2361746 - DNA, 15 bp, Homo sapiens
ttttgtaaaagaaat

SEQ ID NO: 2361747 - DNA, 16 bp, Homo sapiens
ttttgtaataagcaat

SEQ ID NO: 2361748 - DNA, 15 bp, Homo sapiens
ttttgtactgaattt

SEQ ID NO: 2361749 - DNA, 21 bp, Homo sapiens
ttttgtagctggggctttgat

SEQ ID NO: 2361750 - DNA, 14 bp, Homo sapiens
ttttgtatgttaaa

SEQ ID NO: 2361751 - DNA, 20 bp, Homo sapiens
ttttgtctaggagatgcttt

SEQ ID NO: 2361752 - DNA, 22 bp, Homo sapiens
ttttgtgaaatgaaaacatgta

SEQ ID NO: 2361753 - DNA, 11 bp, Homo sapiens
aaaaaaattta

SEQ ID NO: 2361754 - DNA, 12 bp, Homo sapiens
aaaaaagagaca

SEQ ID NO: 2361755 - DNA, 13 bp, Homo sapiens
aaaaaattcttta

SEQ ID NO: 2361756 - DNA, 11 bp, Homo sapiens
aaaaacatttt

SEQ ID NO: 2361757 - DNA, 15 bp, Homo sapiens
aaaaagagacatcca

SEQ ID NO: 2361758 - DNA, 14 bp, Homo sapiens
aaaaagatgtacag

SEQ ID NO: 2361759 - DNA, 18 bp, Homo sapiens
aaaaaggggcctgagtgg

SEQ ID NO: 2361760 - DNA, 14 bp, Homo sapiens
aaaaagtataaaat

SEQ ID NO: 2361761 - DNA, 22 bp, Homo sapiens
aaaaatataaaattatgagatt

SEQ ID NO: 2361762 - DNA, 16 bp, Homo sapiens
aaaaatataatgttga

SEQ ID NO: 2361763 - DNA, 11 bp, Homo sapiens
aaaaatatatt

SEQ ID NO: 2361764 - DNA, 20 bp, Homo sapiens
aaaaatcatgccagtatttt

SEQ ID NO: 2361765 - DNA, 9 bp, Homo sapiens
aaaaatctc

SEQ ID NO: 2361766 - DNA, 16 bp, Homo sapiens
aaaaatctcattattt

SEQ ID NO: 2361767 - DNA, 22 bp, Homo sapiens
aaaaatgagcttgattaaatca

SEQ ID NO: 2361768 - DNA, 12 bp, Homo sapiens
aaaaatgccttt

SEQ ID NO: 2361769 - DNA, 13 bp, Homo sapiens
aaaaatgcctttg

SEQ ID NO: 2361770 - DNA, 15 bp, Homo sapiens
aaaaatgcctttgag

SEQ ID NO: 2361771 - DNA, 19 bp, Homo sapiens
aaaaatgcctttgagacag

SEQ ID NO: 2361772 - DNA, 22 bp, Homo sapiens
aaaaatgcctttgagacagttt

SEQ ID NO: 2361773 - DNA, 15 bp, Homo sapiens
aaaaattgctgactg

SEQ ID NO: 2361774 - DNA, 11 bp, Homo sapiens
aaaaattgtta

SEQ ID NO: 2361775 - DNA, 12 bp, Homo sapiens
aaaaatttaaga

SEQ ID NO: 2361776 - DNA, 22 bp, Homo sapiens
aaaaatttatacaccagcaatt

SEQ ID NO: 2361777 - DNA, 15 bp, Homo sapiens
aaaacaaaaagatgt

SEQ ID NO: 2361778 - DNA, 16 bp, Homo sapiens
aaaacaaataaatatg

SEQ ID NO: 2361779 - DNA, 18 bp, Homo sapiens
aaaacaactttcacttct

SEQ ID NO: 2361780 - DNA, 21 bp, Homo sapiens
aaaacaactttcacttcttcc

SEQ ID NO: 2361781 - DNA, 15 bp, Homo sapiens
aaaacaagtctataa

SEQ ID NO: 2361782 - DNA, 19 bp, Homo sapiens
aaaacaagtctataatgtg

SEQ ID NO: 2361783 - DNA, 23 bp, Homo sapiens
aaaacaagttattaaaaatgtat

SEQ ID NO: 2361784 - DNA, 15 bp, Homo sapiens
aaaacacaagcaaaa

SEQ ID NO: 2361785 - DNA, 16 bp, Homo sapiens
aaaacacacctcgtgg

SEQ ID NO: 2361786 - DNA, 16 bp, Homo sapiens
aaaacagttctcagaa

SEQ ID NO: 2361787 - DNA, 17 bp, Homo sapiens
aaaacagttctcagaaa

SEQ ID NO: 2361788 - DNA, 17 bp, Homo sapiens
aaaacataatcttctgc

SEQ ID NO: 2361789 - DNA, 18 bp, Homo sapiens
aaaacataatcttctgcc

SEQ ID NO: 2361790 - DNA, 24 bp, Homo sapiens
aaaacataatcttctgccttctca

SEQ ID NO: 2361791 - DNA, 22 bp, Homo sapiens
aaaacatttgattaataaaata

SEQ ID NO: 2361792 - DNA, 12 bp, Homo sapiens
aaaacatttgct

SEQ ID NO: 2361793 - DNA, 13 bp, Homo sapiens
aaaacatttgctg

SEQ ID NO: 2361794 - DNA, 13 bp, Homo sapiens
aaaaccaaagagg

SEQ ID NO: 2361795 - DNA, 15 bp, Homo sapiens
aaaaccaaatgttta

SEQ ID NO: 2361796 - DNA, 11 bp, Homo sapiens
aaaagaaaatt

SEQ ID NO: 2361797 - DNA, 16 bp, Homo sapiens
aaaagaaatatatttt

SEQ ID NO: 2361798 - DNA, 14 bp, Homo sapiens
aaaagaaatcaata

SEQ ID NO: 2361799 - DNA, 21 bp, Homo sapiens
aaaagaaatcaatagttgaat

SEQ ID NO: 2361800 - DNA, 11 bp, Homo sapiens
aaaagaacatg

SEQ ID NO: 2361801 - DNA, 11 bp, Homo sapiens
aaaagaatgac

SEQ ID NO: 2361802 - DNA, 23 bp, Homo sapiens
aaaagaatgacgtttacatataa

SEQ ID NO: 2361803 - DNA, 14 bp, Homo sapiens
aaaagacattttaa

SEQ ID NO: 2361804 - DNA, 14 bp, Homo sapiens
aaaagaccaagact

SEQ ID NO: 2361805 - DNA, 21 bp, Homo sapiens
aaaagagcagtggtaagaata

SEQ ID NO: 2361806 - DNA, 21 bp, Homo sapiens
aaaagattgctgaaattttat

SEQ ID NO: 2361807 - DNA, 15 bp, Homo sapiens
aaaagcaatggttga

SEQ ID NO: 2361808 - DNA, 18 bp, Homo sapiens
aaaagcatttttattata

SEQ ID NO: 2361809 - DNA, 15 bp, Homo sapiens
aaaagctcttttaat

SEQ ID NO: 2361810 - DNA, 11 bp, Homo sapiens
aaaaggaaagc

SEQ ID NO: 2361811 - DNA, 14 bp, Homo sapiens
aaaaggaagactag

SEQ ID NO: 2361812 - DNA, 17 bp, Homo sapiens
aaaaggatgtataaatt

SEQ ID NO: 2361813 - DNA, 22 bp, Homo sapiens
aaaagggagaataaaattccta

SEQ ID NO: 2361814 - DNA, 13 bp, Homo sapiens
aacctgcacacag

SEQ ID NO: 2361815 - DNA, 13 bp, Homo sapiens
aacctgctctcct

SEQ ID NO: 2361816 - DNA, 14 bp, Homo sapiens
aacctgctctcctc

SEQ ID NO: 2361817 - DNA, 11 bp, Homo sapiens
aacctgcttgg

SEQ ID NO: 2361818 - DNA, 22 bp, Homo sapiens
aacctggaatctacaagccaaa

SEQ ID NO: 2361819 - DNA, 13 bp, Homo sapiens
aaccttaatgtgg

SEQ ID NO: 2361820 - DNA, 13 bp, Homo sapiens
aaccttgtataaa

SEQ ID NO: 2361821 - DNA, 16 bp, Homo sapiens
aaccttgtcccagcca

SEQ ID NO: 2361822 - DNA, 16 bp, Homo sapiens
aacgaaatatcaaagt

SEQ ID NO: 2361823 - DNA, 16 bp, Homo sapiens
aacgaagagttccctt

SEQ ID NO: 2361824 - DNA, 22 bp, Homo sapiens
aacgctaaagagcccttgcctc

SEQ ID NO: 2361825 - DNA, 17 bp, Homo sapiens
aacgggaacatgccccc

SEQ ID NO: 2361826 - DNA, 18 bp, Homo sapiens
aacggtgcccatcctgcc

SEQ ID NO: 2361827 - DNA, 20 bp, Homo sapiens
aacggtgctaaaaatgaaaa

SEQ ID NO: 2361828 - DNA, 21 bp, Homo sapiens
aacggttcctggtgactcctg

SEQ ID NO: 2361829 - DNA, 14 bp, Homo sapiens
aacgttttcttctt

SEQ ID NO: 2361830 - DNA, 18 bp, Homo sapiens
aactaaataccattcact

SEQ ID NO: 2361831 - DNA, 16 bp, Homo sapiens
aactaaattttaaagc

SEQ ID NO: 2361832 - DNA, 18 bp, Homo sapiens
aactaaattttaaagcca

SEQ ID NO: 2361833 - DNA, 15 bp, Homo sapiens
aactaaccagcattc

SEQ ID NO: 2361834 - DNA, 12 bp, Homo sapiens
aactaagccagg

SEQ ID NO: 2361835 - DNA, 13 bp, Homo sapiens
aactaatatatga

SEQ ID NO: 2361836 - DNA, 18 bp, Homo sapiens
aactaatgacaagtgact

SEQ ID NO: 2361837 - DNA, 12 bp, Homo sapiens
aactaatgcctt

SEQ ID NO: 2361838 - DNA, 15 bp, Homo sapiens
aactaatgccttact

SEQ ID NO: 2361839 - DNA, 14 bp, Homo sapiens
aactaatgtttgaa

SEQ ID NO: 2361840 - DNA, 18 bp, Homo sapiens
aactaatgtttgaacaaa

SEQ ID NO: 2361841 - DNA, 15 bp, Homo sapiens
aactacctgagctaa

SEQ ID NO: 2361842 - DNA, 19 bp, Homo sapiens
aactactgaatgaagcagt

SEQ ID NO: 2361843 - DNA, 21 bp, Homo sapiens
aactactgaatgaagcagtat

SEQ ID NO: 2361844 - DNA, 18 bp, Homo sapiens
aactagccaaaccaggac

SEQ ID NO: 2361845 - DNA, 21 bp, Homo sapiens
aactagccaaaccaggaccct

SEQ ID NO: 2361846 - DNA, 15 bp, Homo sapiens
aactagctgggacta

SEQ ID NO: 2361847 - DNA, 21 bp, Homo sapiens
aactagttactaaacatgtat

SEQ ID NO: 2361848 - DNA, 18 bp, Homo sapiens
aactataagatacaataa

SEQ ID NO: 2361849 - DNA, 15 bp, Homo sapiens
aactataaggtgcct

SEQ ID NO: 2361850 - DNA, 17 bp, Homo sapiens
aactataaggtgcctca

SEQ ID NO: 2361851 - DNA, 19 bp, Homo sapiens
aactataaggtgcctcagt

SEQ ID NO: 2361852 - DNA, 16 bp, Homo sapiens
aactatgttcctaaca

SEQ ID NO: 2361853 - DNA, 20 bp, Homo sapiens
aactattgggtgaatatggt

SEQ ID NO: 2361854 - DNA, 24 bp, Homo sapiens
aactattgtgctcagagacactgt

SEQ ID NO: 2361855 - DNA, 16 bp, Homo sapiens
aactatttttttcaaa

SEQ ID NO: 2361856 - DNA, 22 bp, Homo sapiens
aactcaaactgaggaatttcac

SEQ ID NO: 2361857 - DNA, 13 bp, Homo sapiens
aactcaaatacac

SEQ ID NO: 2361858 - DNA, 23 bp, Homo sapiens
aactcagagaaaaatgctcccca

SEQ ID NO: 2361859 - DNA, 21 bp, Homo sapiens
aactcagatctgatcaagagt

SEQ ID NO: 2361860 - DNA, 15 bp, Homo sapiens
aactcaggcaaagaa

SEQ ID NO: 2361861 - DNA, 17 bp, Homo sapiens
aactcatcctcttttaa

SEQ ID NO: 2361862 - DNA, 22 bp, Homo sapiens
aactctcaccatgatgtgaaga

SEQ ID NO: 2361863 - DNA, 20 bp, Homo sapiens
aactctctggaagcccctgg

SEQ ID NO: 2361864 - DNA, 23 bp, Homo sapiens
aactctgaagctaattgtactaa

SEQ ID NO: 2361865 - DNA, 15 bp, Homo sapiens
aactctggcttttgg

SEQ ID NO: 2361866 - DNA, 13 bp, Homo sapiens
aactcttatctca

SEQ ID NO: 2361867 - DNA, 16 bp, Homo sapiens
aactgaaatgcctgct

SEQ ID NO: 2361868 - DNA, 21 bp, Homo sapiens
aactgaaggggtgcacccacc

SEQ ID NO: 2361869 - DNA, 22 bp, Homo sapiens
aactgaatgaatccattggaga

SEQ ID NO: 2361870 - DNA, 23 bp, Homo sapiens
aactgaatgaatccattggagaa

SEQ ID NO: 2361871 - DNA, 14 bp, Homo sapiens
aactgaatttggag

SEQ ID NO: 2361872 - DNA, 16 bp, Homo sapiens
aactgcctactccaaa

SEQ ID NO: 2361873 - DNA, 20 bp, Homo sapiens
aactgcctactccaaaatgt

SEQ ID NO: 2361874 - DNA, 18 bp, Homo sapiens
aactgcctggggggcagg

SEQ ID NO: 2361875 - DNA, 18 bp, Homo sapiens
aactggccatggcctgca

SEQ ID NO: 2361876 - DNA, 18 bp, Homo sapiens
aactgggaacccctttcc

SEQ ID NO: 2361877 - DNA, 20 bp, Homo sapiens
aactgggaacccctttccca

SEQ ID NO: 2361878 - DNA, 18 bp, Homo sapiens
aactggggttgagggcca

SEQ ID NO: 2361879 - DNA, 21 bp, Homo sapiens
aactgtcaggctgaaaacaat

SEQ ID NO: 2361880 - DNA, 15 bp, Homo sapiens
aactgtcttcctcaa

SEQ ID NO: 2361881 - DNA, 21 bp, Homo sapiens
aactgtgtacataactgaaaa

SEQ ID NO: 2361882 - DNA, 23 bp, Homo sapiens
aactgtgtacataactgaaaatg

SEQ ID NO: 2361883 - DNA, 14 bp, Homo sapiens
aactgtgtactgtt

SEQ ID NO: 2361884 - DNA, 15 bp, Homo sapiens
aactgtgtgattaaa

SEQ ID NO: 2361885 - DNA, 21 bp, Homo sapiens
aacttaagcaaaggggacagc

SEQ ID NO: 2361886 - DNA, 20 bp, Homo sapiens
aacttagactctagtattta

SEQ ID NO: 2361887 - DNA, 14 bp, Homo sapiens
aacttcattggtaa

SEQ ID NO: 2361888 - DNA, 15 bp, Homo sapiens
aacttcccattaaaa

SEQ ID NO: 2361889 - DNA, 20 bp, Homo sapiens
aacttctgcaacaagcatgc

SEQ ID NO: 2361890 - DNA, 14 bp, Homo sapiens
aacttgctgctgtc

SEQ ID NO: 2361891 - DNA, 15 bp, Homo sapiens
aacttgcttaaattt

SEQ ID NO: 2361892 - DNA, 19 bp, Homo sapiens
aacttgcttaaatttctta

SEQ ID NO: 2361893 - DNA, 20 bp, Homo sapiens
aacttgcttaaatttcttat

SEQ ID NO: 2361894 - DNA, 21 bp, Homo sapiens
aacttgcttaaatttcttatg

SEQ ID NO: 2361895 - DNA, 16 bp, Homo sapiens
aacttggccagtttgt

SEQ ID NO: 2361896 - DNA, 12 bp, Homo sapiens
aacttgtggcct

SEQ ID NO: 2361897 - DNA, 15 bp, Homo sapiens
aactttggcctttgt

SEQ ID NO: 2361898 - DNA, 22 bp, Homo sapiens
aactttgggaaaacatgttaat

SEQ ID NO: 2361899 - DNA, 21 bp, Homo sapiens
aactttgtaaaaatcttttga

SEQ ID NO: 2361900 - DNA, 14 bp, Homo sapiens
aacttttctcttat

SEQ ID NO: 2361901 - DNA, 13 bp, Homo sapiens
aacttttgggagc

SEQ ID NO: 2361902 - DNA, 19 bp, Homo sapiens
aacttttgtactgaatttt

SEQ ID NO: 2361903 - DNA, 18 bp, Homo sapiens
aagaaaaaaaaaaaagcc

SEQ ID NO: 2361904 - DNA, 15 bp, Homo sapiens
aagaaaaaaagaaaa

SEQ ID NO: 2361905 - DNA, 14 bp, Homo sapiens
aagaaaaaagaaaa

SEQ ID NO: 2361906 - DNA, 12 bp, Homo sapiens
aagaaaaagcaa

SEQ ID NO: 2361907 - DNA, 13 bp, Homo sapiens
aagaaaaatctca

SEQ ID NO: 2361908 - DNA, 15 bp, Homo sapiens
aagaaaagacatttt

SEQ ID NO: 2361909 - DNA, 13 bp, Homo sapiens
aagaaaatcactt

SEQ ID NO: 2361910 - DNA, 16 bp, Homo sapiens
aagaaaatgaaatgca

SEQ ID NO: 2361911 - DNA, 16 bp, Homo sapiens
aagaaaattacaaaaa

SEQ ID NO: 2361912 - DNA, 14 bp, Homo sapiens
aagaaaattgagtt

SEQ ID NO: 2361913 - DNA, 13 bp, Homo sapiens
aagaaactgaatg

SEQ ID NO: 2361914 - DNA, 17 bp, Homo sapiens
aagaaagcctaaaattg

SEQ ID NO: 2361915 - DNA, 19 bp, Homo sapiens
aagaaataatgctacaatt

SEQ ID NO: 2361916 - DNA, 23 bp, Homo sapiens
aagaaatcatgtccatacacttt

SEQ ID NO: 2361917 - DNA, 13 bp, Homo sapiens
aagaaatggtatg

SEQ ID NO: 2361918 - DNA, 22 bp, Homo sapiens
aagaaattccatacttctctca

SEQ ID NO: 2361919 - DNA, 22 bp, Homo sapiens
aagaactataaacttaaagcta

SEQ ID NO: 2361920 - DNA, 11 bp, Homo sapiens
aagaagacata

SEQ ID NO: 2361921 - DNA, 12 bp, Homo sapiens
aagaagacatga

SEQ ID NO: 2361922 - DNA, 15 bp, Homo sapiens
aagaagagctatcag

SEQ ID NO: 2361923 - DNA, 16 bp, Homo sapiens
aagaagctgttgtaca

SEQ ID NO: 2361924 - DNA, 18 bp, Homo sapiens
aagaagctgttgtacatt

SEQ ID NO: 2361925 - DNA, 17 bp, Homo sapiens
aagaagggagaagaaag

SEQ ID NO: 2361926 - DNA, 12 bp, Homo sapiens
aagaagtcttga

SEQ ID NO: 2361927 - DNA, 16 bp, Homo sapiens
aagaataatcacgctt

SEQ ID NO: 2361928 - DNA, 15 bp, Homo sapiens
aagaatgaaaaatat

SEQ ID NO: 2361929 - DNA, 21 bp, Homo sapiens
aatagactgtaacttccaaat

SEQ ID NO: 2361930 - DNA, 17 bp, Homo sapiens
aatagctaagatataat

SEQ ID NO: 2361931 - DNA, 16 bp, Homo sapiens
aatagctacagtgcat

SEQ ID NO: 2361932 - DNA, 15 bp, Homo sapiens
aataggagaggatga

SEQ ID NO: 2361933 - DNA, 21 bp, Homo sapiens
aataggagtggtgatttgaaa

SEQ ID NO: 2361934 - DNA, 19 bp, Homo sapiens
aatagtcaccttcatgatt

SEQ ID NO: 2361935 - DNA, 15 bp, Homo sapiens
aatagttgaattagt

SEQ ID NO: 2361936 - DNA, 12 bp, Homo sapiens
aatataaaaaat

SEQ ID NO: 2361937 - DNA, 17 bp, Homo sapiens
aatataagacatttgtt

SEQ ID NO: 2361938 - DNA, 23 bp, Homo sapiens
aatataagacatttgtttgctgt

SEQ ID NO: 2361939 - DNA, 16 bp, Homo sapiens
aatatacattttctaa

SEQ ID NO: 2361940 - DNA, 17 bp, Homo sapiens
aatatacattttctaaa

SEQ ID NO: 2361941 - DNA, 21 bp, Homo sapiens
aatatacattttctaaataaa

SEQ ID NO: 2361942 - DNA, 21 bp, Homo sapiens
aatatatgccttgtataatat

SEQ ID NO: 2361943 - DNA, 13 bp, Homo sapiens
aatatattgaact

SEQ ID NO: 2361944 - DNA, 18 bp, Homo sapiens
aatatattgaacttttgt

SEQ ID NO: 2361945 - DNA, 21 bp, Homo sapiens
aatatatttataaggaaattt

SEQ ID NO: 2361946 - DNA, 18 bp, Homo sapiens
aatatcacactcgtcttt

SEQ ID NO: 2361947 - DNA, 14 bp, Homo sapiens
aatatcataaagca

SEQ ID NO: 2361948 - DNA, 13 bp, Homo sapiens
aatatcatgtgat

SEQ ID NO: 2361949 - DNA, 15 bp, Homo sapiens
aatatctatttgaat

SEQ ID NO: 2361950 - DNA, 21 bp, Homo sapiens
aatatctatttgaataaatta

SEQ ID NO: 2361951 - DNA, 13 bp, Homo sapiens
aatatgaatctat

SEQ ID NO: 2361952 - DNA, 17 bp, Homo sapiens
aatatgacggaagaaca

SEQ ID NO: 2361953 - DNA, 19 bp, Homo sapiens
aatatgacggaagaacata

SEQ ID NO: 2361954 - DNA, 20 bp, Homo sapiens
aatatgcctagtaacacata

SEQ ID NO: 2361955 - DNA, 23 bp, Homo sapiens
aatatgtaatttcaaaatacatt

SEQ ID NO: 2361956 - DNA, 13 bp, Homo sapiens
aatattaaaaaac

SEQ ID NO: 2361957 - DNA, 21 bp, Homo sapiens
aatattaaaaaacttcatgta

SEQ ID NO: 2361958 - DNA, 16 bp, Homo sapiens
aatattccagatcttt

SEQ ID NO: 2361959 - DNA, 13 bp, Homo sapiens
aatattcttttgt

SEQ ID NO: 2361960 - DNA, 16 bp, Homo sapiens
aatattcttttgtttc

SEQ ID NO: 2361961 - DNA, 17 bp, Homo sapiens
aatattcttttgtttcc

SEQ ID NO: 2361962 - DNA, 21 bp, Homo sapiens
aatattcttttgtttccatgg

SEQ ID NO: 2361963 - DNA, 15 bp, Homo sapiens
aatattgaaaattga

SEQ ID NO: 2361964 - DNA, 21 bp, Homo sapiens
aatattgaaaattgaaaagta

SEQ ID NO: 2361965 - DNA, 16 bp, Homo sapiens
aatattgattgggaaa

SEQ ID NO: 2361966 - DNA, 21 bp, Homo sapiens
aatattgattgggaaaacatt

SEQ ID NO: 2361967 - DNA, 23 bp, Homo sapiens
aatattgattgggaaaacatttg

SEQ ID NO: 2361968 - DNA, 23 bp, Homo sapiens
aatattgcttactggtgaggttg

SEQ ID NO: 2361969 - DNA, 15 bp, Homo sapiens
aatattggtatgtaa

SEQ ID NO: 2361970 - DNA, 21 bp, Homo sapiens
aatattggtgctatttaacat

SEQ ID NO: 2361971 - DNA, 12 bp, Homo sapiens
aatattgtttct

SEQ ID NO: 2361972 - DNA, 15 bp, Homo sapiens
aatattgtttctgca

SEQ ID NO: 2361973 - DNA, 21 bp, Homo sapiens
aatattgtttggtaaatgttt

SEQ ID NO: 2361974 - DNA, 17 bp, Homo sapiens
aatattgttttacaata

SEQ ID NO: 2361975 - DNA, 18 bp, Homo sapiens
aatattgttttacaatag

SEQ ID NO: 2361976 - DNA, 19 bp, Homo sapiens
aatatttactaactaaata

SEQ ID NO: 2361977 - DNA, 15 bp, Homo sapiens
aatatttactcatca

SEQ ID NO: 2361978 - DNA, 14 bp, Homo sapiens
aatatttctattga

SEQ ID NO: 2361979 - DNA, 18 bp, Homo sapiens
aatatttctattgaattc

SEQ ID NO: 2361980 - DNA, 18 bp, Homo sapiens
aatatttgactattctgt

SEQ ID NO: 2361981 - DNA, 20 bp, Homo sapiens
aatattttgctgctgaattt

SEQ ID NO: 2361982 - DNA, 18 bp, Homo sapiens
aatatttttatatttcct

SEQ ID NO: 2361983 - DNA, 20 bp, Homo sapiens
aatatttttatatttccttt

SEQ ID NO: 2361984 - DNA, 22 bp, Homo sapiens
aatatttttatatttcctttat

SEQ ID NO: 2361985 - DNA, 17 bp, Homo sapiens
aatatttttgtatttct

SEQ ID NO: 2361986 - DNA, 14 bp, Homo sapiens
aatcaagagaaact

SEQ ID NO: 2361987 - DNA, 10 bp, Homo sapiens
aatcaagagt

SEQ ID NO: 2361988 - DNA, 21 bp, Homo sapiens
aatcaatctgcagtttaacaa

SEQ ID NO: 2361989 - DNA, 20 bp, Homo sapiens
aatcaattactggtccaaaa

SEQ ID NO: 2361990 - DNA, 14 bp, Homo sapiens
aatcaccatgtaag

SEQ ID NO: 2361991 - DNA, 13 bp, Homo sapiens
aatcactgttgct

SEQ ID NO: 2361992 - DNA, 17 bp, Homo sapiens
aatcagaaagtaacaat

SEQ ID NO: 2361993 - DNA, 13 bp, Homo sapiens
aatcagagacaaa

SEQ ID NO: 2361994 - DNA, 14 bp, Homo sapiens
aatcagcatttagt

SEQ ID NO: 2361995 - DNA, 23 bp, Homo sapiens
aatcagcctcatgactttatagt

SEQ ID NO: 2361996 - DNA, 23 bp, Homo sapiens
aatcatcaagagaatttggggct

SEQ ID NO: 2361997 - DNA, 17 bp, Homo sapiens
aatcatgagcctgctgg

SEQ ID NO: 2361998 - DNA, 15 bp, Homo sapiens
aatcatgccagtatt

SEQ ID NO: 2361999 - DNA, 19 bp, Homo sapiens
aatcatgtccatacacttt

SEQ ID NO: 2362000 - DNA, 14 bp, Homo sapiens
aatcattcagaaat

SEQ ID NO: 2362001 - DNA, 17 bp, Homo sapiens
aatcattcttactaaaa

SEQ ID NO: 2362002 - DNA, 23 bp, Homo sapiens
aatccaagggttgagagccagtg

SEQ ID NO: 2362003 - DNA, 13 bp, Homo sapiens
aatccagttataa

SEQ ID NO: 2362004 - DNA, 16 bp, Homo sapiens
aatccagttataagaa

SEQ ID NO: 2362005 - DNA, 19 bp, Homo sapiens
aatcctaatttctcctccc

SEQ ID NO: 2362006 - DNA, 21 bp, Homo sapiens
aatcctaatttctcctccctt

SEQ ID NO: 2362007 - DNA, 19 bp, Homo sapiens
aatcctcctgcctcagcct

SEQ ID NO: 2362008 - DNA, 19 bp, Homo sapiens
aatcgctaatcagtcattt

SEQ ID NO: 2362009 - DNA, 14 bp, Homo sapiens
aatcggactgccaa

SEQ ID NO: 2362010 - DNA, 15 bp, Homo sapiens
aatcggactgccaaa

SEQ ID NO: 2362011 - DNA, 14 bp, Homo sapiens
aatctaaaatgtgt

SEQ ID NO: 2362012 - DNA, 19 bp, Homo sapiens
aatctaaaatgttttatga

SEQ ID NO: 2362013 - DNA, 12 bp, Homo sapiens
aatctcaaaatt

SEQ ID NO: 2362014 - DNA, 13 bp, Homo sapiens
aatctcaaaatta

SEQ ID NO: 2362015 - DNA, 14 bp, Homo sapiens
aatctcaaaattag

SEQ ID NO: 2362016 - DNA, 20 bp, Homo sapiens
aatctcattatttcaaaatg

SEQ ID NO: 2362017 - DNA, 21 bp, Homo sapiens
aatctcattatttcaaaatga

SEQ ID NO: 2362018 - DNA, 13 bp, Homo sapiens
aatctctgcctct

SEQ ID NO: 2362019 - DNA, 15 bp, Homo sapiens
aatctcttcattatt

SEQ ID NO: 2362020 - DNA, 23 bp, Homo sapiens
aatctgagattgtgtttgttcat

SEQ ID NO: 2362021 - DNA, 16 bp, Homo sapiens
aatctgatggccttaa

SEQ ID NO: 2362022 - DNA, 18 bp, Homo sapiens
aatctgatggccttaatt

SEQ ID NO: 2362023 - DNA, 22 bp, Homo sapiens
aatctgatggccttaatttcct

SEQ ID NO: 2362024 - DNA, 23 bp, Homo sapiens
aatctgcagggagcaactctcca

SEQ ID NO: 2362025 - DNA, 23 bp, Homo sapiens
aatcttaagtaccaatgggaagc

SEQ ID NO: 2362026 - DNA, 17 bp, Homo sapiens
aatcttcaaagccttct

SEQ ID NO: 2362027 - DNA, 17 bp, Homo sapiens
aatcttcccatgcattc

SEQ ID NO: 2362028 - DNA, 14 bp, Homo sapiens
aatcttccttttat

SEQ ID NO: 2362029 - DNA, 16 bp, Homo sapiens
aatcttgtttctgaaa

SEQ ID NO: 2362030 - DNA, 23 bp, Homo sapiens
aatcttgttttgaaaataaccta

SEQ ID NO: 2362031 - DNA, 15 bp, Homo sapiens
aatctttacctgtat

SEQ ID NO: 2362032 - DNA, 18 bp, Homo sapiens
aatctttacctgtataca

SEQ ID NO: 2362033 - DNA, 15 bp, Homo sapiens
aatcttttcttattt

SEQ ID NO: 2362034 - DNA, 13 bp, Homo sapiens
aatcttttgaagc

SEQ ID NO: 2362035 - DNA, 13 bp, Homo sapiens
aatgaaaaatata

SEQ ID NO: 2362036 - DNA, 16 bp, Homo sapiens
aatgaaaaatataatg

SEQ ID NO: 2362037 - DNA, 18 bp, Homo sapiens
aatgaaaaatataatgtt

SEQ ID NO: 2362038 - DNA, 21 bp, Homo sapiens
aatgaaaataaaacacacctc

SEQ ID NO: 2362039 - DNA, 14 bp, Homo sapiens
aatgaaaattgtat

SEQ ID NO: 2362040 - DNA, 14 bp, Homo sapiens
aatgaaatgtatgc

SEQ ID NO: 2362041 - DNA, 15 bp, Homo sapiens
aatgaaattaacaca

SEQ ID NO: 2362042 - DNA, 20 bp, Homo sapiens
aatgaaattaacacaaagga

SEQ ID NO: 2362043 - DNA, 22 bp, Homo sapiens
aatgaaattaacacaaaggaag

SEQ ID NO: 2362044 - DNA, 12 bp, Homo sapiens
acagtttcttag

SEQ ID NO: 2362045 - DNA, 17 bp, Homo sapiens
acagttttgctttagta

SEQ ID NO: 2362046 - DNA, 17 bp, Homo sapiens
acataaaagaaataaac

SEQ ID NO: 2362047 - DNA, 17 bp, Homo sapiens
acataaaggaaaagaca

SEQ ID NO: 2362048 - DNA, 18 bp, Homo sapiens
acataaaggaaaagacac

SEQ ID NO: 2362049 - DNA, 13 bp, Homo sapiens
acataaataaaaa

SEQ ID NO: 2362050 - DNA, 14 bp, Homo sapiens
acataacgtttttc

SEQ ID NO: 2362051 - DNA, 16 bp, Homo sapiens
acataacgtttttcct

SEQ ID NO: 2362052 - DNA, 22 bp, Homo sapiens
acataacgtttttcctttaaaa

SEQ ID NO: 2362053 - DNA, 20 bp, Homo sapiens
acataactgaaaatgtgcta

SEQ ID NO: 2362054 - DNA, 16 bp, Homo sapiens
acataagtaactttta

SEQ ID NO: 2362055 - DNA, 22 bp, Homo sapiens
acataccctgacctggccccct

SEQ ID NO: 2362056 - DNA, 14 bp, Homo sapiens
acatactgttcact

SEQ ID NO: 2362057 - DNA, 22 bp, Homo sapiens
acatagcaaataaaataaatga

SEQ ID NO: 2362058 - DNA, 13 bp, Homo sapiens
acataggaaggga

SEQ ID NO: 2362059 - DNA, 19 bp, Homo sapiens
acataggaagggatctgag

SEQ ID NO: 2362060 - DNA, 19 bp, Homo sapiens
acatagttatttttctctt

SEQ ID NO: 2362061 - DNA, 17 bp, Homo sapiens
acatagttctgtaataa

SEQ ID NO: 2362062 - DNA, 15 bp, Homo sapiens
acatatatttattga

SEQ ID NO: 2362063 - DNA, 20 bp, Homo sapiens
acatatgcaccttgtgtctg

SEQ ID NO: 2362064 - DNA, 24 bp, Homo sapiens
acatatgctgatcttttaaaatca

SEQ ID NO: 2362065 - DNA, 18 bp, Homo sapiens
acatattaggaaaatatg

SEQ ID NO: 2362066 - DNA, 13 bp, Homo sapiens
acatcaaataaga

SEQ ID NO: 2362067 - DNA, 22 bp, Homo sapiens
acatcaatgataatgctaattt

SEQ ID NO: 2362068 - DNA, 14 bp, Homo sapiens
acatcaggagttca

SEQ ID NO: 2362069 - DNA, 18 bp, Homo sapiens
acatccaactccagcaac

SEQ ID NO: 2362070 - DNA, 15 bp, Homo sapiens
acatccatccctcca

SEQ ID NO: 2362071 - DNA, 20 bp, Homo sapiens
acatcccagtttctcagaag

SEQ ID NO: 2362072 - DNA, 17 bp, Homo sapiens
acatcccgggcctcagt

SEQ ID NO: 2362073 - DNA, 19 bp, Homo sapiens
acatcccgggcctcagtgc

SEQ ID NO: 2362074 - DNA, 18 bp, Homo sapiens
acatctaataagtatata

SEQ ID NO: 2362075 - DNA, 18 bp, Homo sapiens
acatctctggcccagaaa

SEQ ID NO: 2362076 - DNA, 18 bp, Homo sapiens
acatctgacctggcatct

SEQ ID NO: 2362077 - DNA, 12 bp, Homo sapiens
acatctgatatc

SEQ ID NO: 2362078 - DNA, 11 bp, Homo sapiens
acatctgcctt

SEQ ID NO: 2362079 - DNA, 22 bp, Homo sapiens
acatctttattgaaattctatt

SEQ ID NO: 2362080 - DNA, 21 bp, Homo sapiens
acatcttttctaatcacagtg

SEQ ID NO: 2362081 - DNA, 20 bp, Homo sapiens
acatgaaaaacacggcagct

SEQ ID NO: 2362082 - DNA, 20 bp, Homo sapiens
acatgaatcccacccacatg

SEQ ID NO: 2362083 - DNA, 23 bp, Homo sapiens
acatgaatcccacccacatgtga

SEQ ID NO: 2362084 - DNA, 13 bp, Homo sapiens
acatgacagatat

SEQ ID NO: 2362085 - DNA, 17 bp, Homo sapiens
acatgacagatatttta

SEQ ID NO: 2362086 - DNA, 17 bp, Homo sapiens
acatgacattcttagct

SEQ ID NO: 2362087 - DNA, 15 bp, Homo sapiens
acatgagaaagatgt

SEQ ID NO: 2362088 - DNA, 15 bp, Homo sapiens
acatgcaataaaatt

SEQ ID NO: 2362089 - DNA, 20 bp, Homo sapiens
acatgcagtatttggttttc

SEQ ID NO: 2362090 - DNA, 22 bp, Homo sapiens
acatgccacatcaaacctttga

SEQ ID NO: 2362091 - DNA, 14 bp, Homo sapiens
acatgcctgcgcct

SEQ ID NO: 2362092 - DNA, 21 bp, Homo sapiens
acatggcccctccccctgcca

SEQ ID NO: 2362093 - DNA, 22 bp, Homo sapiens
acatggcccctccccctgccag

SEQ ID NO: 2362094 - DNA, 18 bp, Homo sapiens
acatggcctatgcacata

SEQ ID NO: 2362095 - DNA, 18 bp, Homo sapiens
acatggcgccctgcctcc

SEQ ID NO: 2362096 - DNA, 19 bp, Homo sapiens
acatggcgccctgcctcct

SEQ ID NO: 2362097 - DNA, 12 bp, Homo sapiens
acatgggacctg

SEQ ID NO: 2362098 - DNA, 13 bp, Homo sapiens
acatgggacctgg

SEQ ID NO: 2362099 - DNA, 16 bp, Homo sapiens
acatgggccgcaccat

SEQ ID NO: 2362100 - DNA, 16 bp, Homo sapiens
acatggtgcctgagag

SEQ ID NO: 2362101 - DNA, 20 bp, Homo sapiens
acatggtgcctgagaggcag

SEQ ID NO: 2362102 - DNA, 20 bp, Homo sapiens
acatggttgtgacctgagga

SEQ ID NO: 2362103 - DNA, 16 bp, Homo sapiens
acatgtaaaatgttta

SEQ ID NO: 2362104 - DNA, 17 bp, Homo sapiens
acatgtctgttctacat

SEQ ID NO: 2362105 - DNA, 13 bp, Homo sapiens
acatgtcttgtac

SEQ ID NO: 2362106 - DNA, 16 bp, Homo sapiens
acatgtcttgtacatg

SEQ ID NO: 2362107 - DNA, 14 bp, Homo sapiens
acatgtgaaacctt

SEQ ID NO: 2362108 - DNA, 20 bp, Homo sapiens
acatgttaatgacaatattc

SEQ ID NO: 2362109 - DNA, 22 bp, Homo sapiens
acatgttgtttgttttatttgg

SEQ ID NO: 2362110 - DNA, 19 bp, Homo sapiens
acattaaatgcaataattt

SEQ ID NO: 2362111 - DNA, 20 bp, Homo sapiens
acattaaatgcaataatttt

SEQ ID NO: 2362112 - DNA, 21 bp, Homo sapiens
acattaaatgtggaaggaaaa

SEQ ID NO: 2362113 - DNA, 14 bp, Homo sapiens
acattaacaaataa

SEQ ID NO: 2362114 - DNA, 15 bp, Homo sapiens
acattaatctcaaag

SEQ ID NO: 2362115 - DNA, 15 bp, Homo sapiens
acattaccttactgt

SEQ ID NO: 2362116 - DNA, 19 bp, Homo sapiens
acattaccttactgtggag

SEQ ID NO: 2362117 - DNA, 16 bp, Homo sapiens
acattcccagcccagc

SEQ ID NO: 2362118 - DNA, 18 bp, Homo sapiens
acattccctctaatttga

SEQ ID NO: 2362119 - DNA, 19 bp, Homo sapiens
acattccctctaatttgaa

SEQ ID NO: 2362120 - DNA, 16 bp, Homo sapiens
acattggaatgccttg

SEQ ID NO: 2362121 - DNA, 14 bp, Homo sapiens
acattgtacttaaa

SEQ ID NO: 2362122 - DNA, 13 bp, Homo sapiens
acatttagaaaag

SEQ ID NO: 2362123 - DNA, 17 bp, Homo sapiens
acatttagaaaagtgaa

SEQ ID NO: 2362124 - DNA, 15 bp, Homo sapiens
acatttagaaatgtt

SEQ ID NO: 2362125 - DNA, 21 bp, Homo sapiens
acatttagaaatgtttattga

SEQ ID NO: 2362126 - DNA, 18 bp, Homo sapiens
acatttagaagaaagatg

SEQ ID NO: 2362127 - DNA, 17 bp, Homo sapiens
acatttatgatttaata

SEQ ID NO: 2362128 - DNA, 20 bp, Homo sapiens
acatttatgatttaataaaa

SEQ ID NO: 2362129 - DNA, 22 bp, Homo sapiens
acatttatgatttaataaaata

SEQ ID NO: 2362130 - DNA, 13 bp, Homo sapiens
acatttccaaatg

SEQ ID NO: 2362131 - DNA, 19 bp, Homo sapiens
acatttcttctagtgatga

SEQ ID NO: 2362132 - DNA, 18 bp, Homo sapiens
acatttctttgcattcca

SEQ ID NO: 2362133 - DNA, 19 bp, Homo sapiens
acatttgaaataaagtaat

SEQ ID NO: 2362134 - DNA, 19 bp, Homo sapiens
acatttgattaataaaata

SEQ ID NO: 2362135 - DNA, 20 bp, Homo sapiens
acatttgattaataaaatat

SEQ ID NO: 2362136 - DNA, 24 bp, Homo sapiens
acatttgattaataaaatatctat

SEQ ID NO: 2362137 - DNA, 14 bp, Homo sapiens
acatttggagaggg

SEQ ID NO: 2362138 - DNA, 16 bp, Homo sapiens
acatttgtaagtgtaa

SEQ ID NO: 2362139 - DNA, 13 bp, Homo sapiens
acattttacagta

SEQ ID NO: 2362140 - DNA, 19 bp, Homo sapiens
acattttacagtaaatgtt

SEQ ID NO: 2362141 - DNA, 19 bp, Homo sapiens
acattttccttttcaaata

SEQ ID NO: 2362142 - DNA, 19 bp, Homo sapiens
acattttctaaataaaaat

SEQ ID NO: 2362143 - DNA, 13 bp, Homo sapiens
acattttgccttt

SEQ ID NO: 2362144 - DNA, 16 bp, Homo sapiens
acattttttaggaaat

SEQ ID NO: 2362145 - DNA, 18 bp, Homo sapiens
acatttttttgcatgcat

SEQ ID NO: 2362146 - DNA, 23 bp, Homo sapiens
acatttttttgcatgcatgcaaa

SEQ ID NO: 2362147 - DNA, 22 bp, Homo sapiens
accaaaaacatttgattaataa

SEQ ID NO: 2362148 - DNA, 13 bp, Homo sapiens
accaaaactgctc

SEQ ID NO: 2362149 - DNA, 15 bp, Homo sapiens
accaaaataataaaa

SEQ ID NO: 2362150 - DNA, 18 bp, Homo sapiens
accaaaattttaaaaaag

SEQ ID NO: 2362151 - DNA, 14 bp, Homo sapiens
accaaacactcagt

SEQ ID NO: 2362152 - DNA, 12 bp, Homo sapiens
accaaagctgcc

SEQ ID NO: 2362153 - DNA, 14 bp, Homo sapiens
accaaagctgccca

SEQ ID NO: 2362154 - DNA, 21 bp, Homo sapiens
accaaggatcggactctgccc

SEQ ID NO: 2362155 - DNA, 15 bp, Homo sapiens
accaatgggaagcag

SEQ ID NO: 2362156 - DNA, 16 bp, Homo sapiens
accacaaaccctgctg

SEQ ID NO: 2362157 - DNA, 21 bp, Homo sapiens
accacatagcatgcttccttt

SEQ ID NO: 2362158 - DNA, 22 bp, Homo sapiens
accacatagcatgcttcctttc

SEQ ID NO: 2362159 - DNA, 15 bp, Homo sapiens
actctgtataataga

SEQ ID NO: 2362160 - DNA, 18 bp, Homo sapiens
actctgtataatagagat

SEQ ID NO: 2362161 - DNA, 23 bp, Homo sapiens
actcttatctcagtcatgcataa

SEQ ID NO: 2362162 - DNA, 15 bp, Homo sapiens
actcttcttgaaatt

SEQ ID NO: 2362163 - DNA, 22 bp, Homo sapiens
actcttgcacagtcactgctct

SEQ ID NO: 2362164 - DNA, 23 bp, Homo sapiens
actctttttcagagcttctcaca

SEQ ID NO: 2362165 - DNA, 16 bp, Homo sapiens
actgaaaagaaggaaa

SEQ ID NO: 2362166 - DNA, 19 bp, Homo sapiens
actgaaaagaaggaaagat

SEQ ID NO: 2362167 - DNA, 18 bp, Homo sapiens
actgaaagttttgtaaaa

SEQ ID NO: 2362168 - DNA, 13 bp, Homo sapiens
actgaaccactgc

SEQ ID NO: 2362169 - DNA, 16 bp, Homo sapiens
actgaactacatgcat

SEQ ID NO: 2362170 - DNA, 20 bp, Homo sapiens
actgaaggaaaaacacaagc

SEQ ID NO: 2362171 - DNA, 22 bp, Homo sapiens
actgaaggaaaaacacaagcaa

SEQ ID NO: 2362172 - DNA, 23 bp, Homo sapiens
actgaaggaaaaacacaagcaaa

SEQ ID NO: 2362173 - DNA, 22 bp, Homo sapiens
actgaaggggtgcacccacctg

SEQ ID NO: 2362174 - DNA, 22 bp, Homo sapiens
actgaagtggctggtagaaaaa

SEQ ID NO: 2362175 - DNA, 22 bp, Homo sapiens
actgaataatatcaaataaaat

SEQ ID NO: 2362176 - DNA, 19 bp, Homo sapiens
actgaataatgctaccagg

SEQ ID NO: 2362177 - DNA, 12 bp, Homo sapiens
actgaatgaggt

SEQ ID NO: 2362178 - DNA, 20 bp, Homo sapiens
actgaatttttttgtaataa

SEQ ID NO: 2362179 - DNA, 14 bp, Homo sapiens
actgacctacctca

SEQ ID NO: 2362180 - DNA, 21 bp, Homo sapiens
actgacctgaccccattcctg

SEQ ID NO: 2362181 - DNA, 14 bp, Homo sapiens
actgagagaaagat

SEQ ID NO: 2362182 - DNA, 14 bp, Homo sapiens
actgagcaccctct

SEQ ID NO: 2362183 - DNA, 21 bp, Homo sapiens
actgagccagcttagcaactg

SEQ ID NO: 2362184 - DNA, 20 bp, Homo sapiens
actgaggcagcgacctcaag

SEQ ID NO: 2362185 - DNA, 13 bp, Homo sapiens
actgcagcctcat

SEQ ID NO: 2362186 - DNA, 17 bp, Homo sapiens
actgcatactttttaaa

SEQ ID NO: 2362187 - DNA, 18 bp, Homo sapiens
actgcatactttttaaat

SEQ ID NO: 2362188 - DNA, 20 bp, Homo sapiens
actgcatactttttaaatgt

SEQ ID NO: 2362189 - DNA, 15 bp, Homo sapiens
actgcatccagcctg

SEQ ID NO: 2362190 - DNA, 21 bp, Homo sapiens
actgccacactctccatcacc

SEQ ID NO: 2362191 - DNA, 14 bp, Homo sapiens
actgccagcagcag

SEQ ID NO: 2362192 - DNA, 18 bp, Homo sapiens
actgccagcagcagcagg

SEQ ID NO: 2362193 - DNA, 19 bp, Homo sapiens
actgccagcagcagcaggt

SEQ ID NO: 2362194 - DNA, 18 bp, Homo sapiens
actgccaggccagcctcc

SEQ ID NO: 2362195 - DNA, 23 bp, Homo sapiens
actgccaggccagcctccgagag

SEQ ID NO: 2362196 - DNA, 18 bp, Homo sapiens
actgccccacggagacag

SEQ ID NO: 2362197 - DNA, 20 bp, Homo sapiens
actgccttgcctcctcagta

SEQ ID NO: 2362198 - DNA, 16 bp, Homo sapiens
actgctggacatgaga

SEQ ID NO: 2362199 - DNA, 17 bp, Homo sapiens
actgctggacatgagat

SEQ ID NO: 2362200 - DNA, 13 bp, Homo sapiens
actgcttctcttt

SEQ ID NO: 2362201 - DNA, 21 bp, Homo sapiens
actgcttctcttttgaaagta

SEQ ID NO: 2362202 - DNA, 22 bp, Homo sapiens
actggacctttgggttctttct

SEQ ID NO: 2362203 - DNA, 16 bp, Homo sapiens
actggactccggggcc

SEQ ID NO: 2362204 - DNA, 15 bp, Homo sapiens
actggagctcatctg

SEQ ID NO: 2362205 - DNA, 14 bp, Homo sapiens
actggcacagaggt

SEQ ID NO: 2362206 - DNA, 21 bp, Homo sapiens
actggccatggcctgcaaact

SEQ ID NO: 2362207 - DNA, 18 bp, Homo sapiens
actggcccctgacccagg

SEQ ID NO: 2362208 - DNA, 19 bp, Homo sapiens
actggccttacgatggcaa

SEQ ID NO: 2362209 - DNA, 19 bp, Homo sapiens
actgggaacccctttccca

SEQ ID NO: 2362210 - DNA, 20 bp, Homo sapiens
actgggaacccctttcccac

SEQ ID NO: 2362211 - DNA, 16 bp, Homo sapiens
actgggaagaagcaag

SEQ ID NO: 2362212 - DNA, 18 bp, Homo sapiens
actgggacactgtcagtg

SEQ ID NO: 2362213 - DNA, 13 bp, Homo sapiens
actggtaaatgtt

SEQ ID NO: 2362214 - DNA, 14 bp, Homo sapiens
actggtattgttta

SEQ ID NO: 2362215 - DNA, 13 bp, Homo sapiens
actggtgccctcc

SEQ ID NO: 2362216 - DNA, 17 bp, Homo sapiens
actggttactttcaaaa

SEQ ID NO: 2362217 - DNA, 18 bp, Homo sapiens
actggttactttcaaaat

SEQ ID NO: 2362218 - DNA, 13 bp, Homo sapiens
actggttttctgc

SEQ ID NO: 2362219 - DNA, 19 bp, Homo sapiens
actggttttctgccaatga

SEQ ID NO: 2362220 - DNA, 13 bp, Homo sapiens
actgtaagggatt

SEQ ID NO: 2362221 - DNA, 18 bp, Homo sapiens
actgtagccacagctgct

SEQ ID NO: 2362222 - DNA, 17 bp, Homo sapiens
actgtagtttagttctg

SEQ ID NO: 2362223 - DNA, 19 bp, Homo sapiens
actgtagtttagttctgtt

SEQ ID NO: 2362224 - DNA, 23 bp, Homo sapiens
actgtagtttagttctgttgacc

SEQ ID NO: 2362225 - DNA, 12 bp, Homo sapiens
actgtataaata

SEQ ID NO: 2362226 - DNA, 13 bp, Homo sapiens
actgtataaatag

SEQ ID NO: 2362227 - DNA, 14 bp, Homo sapiens
actgtataaatagg

SEQ ID NO: 2362228 - DNA, 20 bp, Homo sapiens
actgtataaataggagagga

SEQ ID NO: 2362229 - DNA, 23 bp, Homo sapiens
actgtataaataggagaggatga

SEQ ID NO: 2362230 - DNA, 14 bp, Homo sapiens
actgtatcattttc

SEQ ID NO: 2362231 - DNA, 15 bp, Homo sapiens
actgtatttacttgt

SEQ ID NO: 2362232 - DNA, 20 bp, Homo sapiens
actgtatttacttgttatgt

SEQ ID NO: 2362233 - DNA, 20 bp, Homo sapiens
actgtcaggctgaaaacaat

SEQ ID NO: 2362234 - DNA, 17 bp, Homo sapiens
actgtcagtgctagatt

SEQ ID NO: 2362235 - DNA, 15 bp, Homo sapiens
actgtccgcctctgc

SEQ ID NO: 2362236 - DNA, 20 bp, Homo sapiens
actgtccgcctctgcccgca

SEQ ID NO: 2362237 - DNA, 22 bp, Homo sapiens
actgtccgcctctgcccgcaga

SEQ ID NO: 2362238 - DNA, 17 bp, Homo sapiens
actgtctattaatattc

SEQ ID NO: 2362239 - DNA, 22 bp, Homo sapiens
actgtgaacctgggcactccgc

SEQ ID NO: 2362240 - DNA, 22 bp, Homo sapiens
actgtgcgtcttggtgtaattt

SEQ ID NO: 2362241 - DNA, 22 bp, Homo sapiens
actgtggaggaaggattgtaaa

SEQ ID NO: 2362242 - DNA, 17 bp, Homo sapiens
actgtgtacataactga

SEQ ID NO: 2362243 - DNA, 21 bp, Homo sapiens
actgtgtattccaagacatgt

SEQ ID NO: 2362244 - DNA, 12 bp, Homo sapiens
actgtgttcctt

SEQ ID NO: 2362245 - DNA, 14 bp, Homo sapiens
actgtgttccttcc

SEQ ID NO: 2362246 - DNA, 17 bp, Homo sapiens
actgttgagccccagtg

SEQ ID NO: 2362247 - DNA, 20 bp, Homo sapiens
actgttgagccccagtgctg

SEQ ID NO: 2362248 - DNA, 12 bp, Homo sapiens
actgttgagtta

SEQ ID NO: 2362249 - DNA, 15 bp, Homo sapiens
actgttgataaaaac

SEQ ID NO: 2362250 - DNA, 15 bp, Homo sapiens
actgttgctttgaaa

SEQ ID NO: 2362251 - DNA, 14 bp, Homo sapiens
actgttgtaagaat

SEQ ID NO: 2362252 - DNA, 17 bp, Homo sapiens
actgtttcctgggcacg

SEQ ID NO: 2362253 - DNA, 22 bp, Homo sapiens
actgtttctcttgagctggcct

SEQ ID NO: 2362254 - DNA, 19 bp, Homo sapiens
acttaaatggtaataagca

SEQ ID NO: 2362255 - DNA, 17 bp, Homo sapiens
acttaataactgtgtac

SEQ ID NO: 2362256 - DNA, 19 bp, Homo sapiens
acttagactctagtattta

SEQ ID NO: 2362257 - DNA, 18 bp, Homo sapiens
acttagggaagaaaaagc

SEQ ID NO: 2362258 - DNA, 12 bp, Homo sapiens
acttattattaa

SEQ ID NO: 2362259 - DNA, 19 bp, Homo sapiens
acttattattaataatgaa

SEQ ID NO: 2362260 - DNA, 22 bp, Homo sapiens
acttattattaataatgaagta

SEQ ID NO: 2362261 - DNA, 17 bp, Homo sapiens
acttcacataggaaggg

SEQ ID NO: 2362262 - DNA, 23 bp, Homo sapiens
acttcatgtaattttattttaaa

SEQ ID NO: 2362263 - DNA, 15 bp, Homo sapiens
acttccaaagaaagt

SEQ ID NO: 2362264 - DNA, 18 bp, Homo sapiens
acttccaaagaaagttct

SEQ ID NO: 2362265 - DNA, 14 bp, Homo sapiens
acttccagagagga

SEQ ID NO: 2362266 - DNA, 20 bp, Homo sapiens
acttcccgggccagggctgc

SEQ ID NO: 2362267 - DNA, 17 bp, Homo sapiens
acttctaaatgcatatc

SEQ ID NO: 2362268 - DNA, 14 bp, Homo sapiens
acttctacctgccc

SEQ ID NO: 2362269 - DNA, 18 bp, Homo sapiens
acttctcttaagtggtct

SEQ ID NO: 2362270 - DNA, 16 bp, Homo sapiens
acttctgcaacaagca

SEQ ID NO: 2362271 - DNA, 13 bp, Homo sapiens
acttcttgaatat

SEQ ID NO: 2362272 - DNA, 23 bp, Homo sapiens
acttcttgaatataaaaaatcat

SEQ ID NO: 2362273 - DNA, 22 bp, Homo sapiens
agatctgttttgtggtttggaa

SEQ ID NO: 2362274 - DNA, 14 bp, Homo sapiens
agatctttcagaaa

SEQ ID NO: 2362275 - DNA, 13 bp, Homo sapiens
agatctttctctt

SEQ ID NO: 2362276 - DNA, 15 bp, Homo sapiens
agatctttctcttcc

SEQ ID NO: 2362277 - DNA, 18 bp, Homo sapiens
agatctttctcttccctg

SEQ ID NO: 2362278 - DNA, 19 bp, Homo sapiens
agatctttctcttccctga

SEQ ID NO: 2362279 - DNA, 17 bp, Homo sapiens
agatctttttttaagtg

SEQ ID NO: 2362280 - DNA, 21 bp, Homo sapiens
agatgagcaaccacatttaga

SEQ ID NO: 2362281 - DNA, 23 bp, Homo sapiens
agatgatttcagttctaggaaaa

SEQ ID NO: 2362282 - DNA, 20 bp, Homo sapiens
agatgattttttgaaagtta

SEQ ID NO: 2362283 - DNA, 13 bp, Homo sapiens
agatgcagagagc

SEQ ID NO: 2362284 - DNA, 17 bp, Homo sapiens
agatgcagagagccatt

SEQ ID NO: 2362285 - DNA, 15 bp, Homo sapiens
agatgccaccctagc

SEQ ID NO: 2362286 - DNA, 14 bp, Homo sapiens
agatgccccattcc

SEQ ID NO: 2362287 - DNA, 17 bp, Homo sapiens
agatgccccattccttg

SEQ ID NO: 2362288 - DNA, 20 bp, Homo sapiens
agatgctgatggagccttcc

SEQ ID NO: 2362289 - DNA, 19 bp, Homo sapiens
agatgcttctctccttgcc

SEQ ID NO: 2362290 - DNA, 20 bp, Homo sapiens
agatgcttctctccttgccc

SEQ ID NO: 2362291 - DNA, 22 bp, Homo sapiens
agatgcttgcggcaaaaggaaa

SEQ ID NO: 2362292 - DNA, 17 bp, Homo sapiens
agatggagaggctgagg

SEQ ID NO: 2362293 - DNA, 12 bp, Homo sapiens
agatggctgtgg

SEQ ID NO: 2362294 - DNA, 14 bp, Homo sapiens
agatggctgtggca

SEQ ID NO: 2362295 - DNA, 22 bp, Homo sapiens
agatgggggcagggctgtgctt

SEQ ID NO: 2362296 - DNA, 13 bp, Homo sapiens
agatgggtccagg

SEQ ID NO: 2362297 - DNA, 21 bp, Homo sapiens
agatgtagtcttgacgaatat

SEQ ID NO: 2362298 - DNA, 22 bp, Homo sapiens
agatgtcttccctgggctgcca

SEQ ID NO: 2362299 - DNA, 14 bp, Homo sapiens
agatgtgaattatt

SEQ ID NO: 2362300 - DNA, 18 bp, Homo sapiens
agatgtgaattattgaca

SEQ ID NO: 2362301 - DNA, 21 bp, Homo sapiens
agatgtgaattattgacactg

SEQ ID NO: 2362302 - DNA, 15 bp, Homo sapiens
agatgtgagccaccg

SEQ ID NO: 2362303 - DNA, 21 bp, Homo sapiens
agatgtgagccaccgtgcctg

SEQ ID NO: 2362304 - DNA, 20 bp, Homo sapiens
agatgtgtcccccccaggcc

SEQ ID NO: 2362305 - DNA, 16 bp, Homo sapiens
agattattcataatgt

SEQ ID NO: 2362306 - DNA, 17 bp, Homo sapiens
agattcatgaaaatgta

SEQ ID NO: 2362307 - DNA, 15 bp, Homo sapiens
agattcccctgtgtc

SEQ ID NO: 2362308 - DNA, 16 bp, Homo sapiens
agattcccctgtgtca

SEQ ID NO: 2362309 - DNA, 12 bp, Homo sapiens
agattctgcctc

SEQ ID NO: 2362310 - DNA, 16 bp, Homo sapiens
agattctgcctctctg

SEQ ID NO: 2362311 - DNA, 20 bp, Homo sapiens
agattctttcagttctttgg

SEQ ID NO: 2362312 - DNA, 17 bp, Homo sapiens
agattgactaactcaaa

SEQ ID NO: 2362313 - DNA, 19 bp, Homo sapiens
agattgactaactcaaata

SEQ ID NO: 2362314 - DNA, 13 bp, Homo sapiens
agattgagaaatg

SEQ ID NO: 2362315 - DNA, 14 bp, Homo sapiens
agattgagaaatgt

SEQ ID NO: 2362316 - DNA, 16 bp, Homo sapiens
agattgggatactgta

SEQ ID NO: 2362317 - DNA, 20 bp, Homo sapiens
agattgtgatcccttgagat

SEQ ID NO: 2362318 - DNA, 19 bp, Homo sapiens
agatttaaaggcagacagt

SEQ ID NO: 2362319 - DNA, 20 bp, Homo sapiens
agatttaaaggcagacagtt

SEQ ID NO: 2362320 - DNA, 23 bp, Homo sapiens
agatttaagtgaatacattaacg

SEQ ID NO: 2362321 - DNA, 16 bp, Homo sapiens
agatttactaaatcaa

SEQ ID NO: 2362322 - DNA, 23 bp, Homo sapiens
agatttcatatctaactttgtaa

SEQ ID NO: 2362323 - DNA, 14 bp, Homo sapiens
agatttctgaggaa

SEQ ID NO: 2362324 - DNA, 19 bp, Homo sapiens
agattttccattaactatt

SEQ ID NO: 2362325 - DNA, 21 bp, Homo sapiens
agattttccattaactatttt

SEQ ID NO: 2362326 - DNA, 14 bp, Homo sapiens
agattttgaatgct

SEQ ID NO: 2362327 - DNA, 13 bp, Homo sapiens
agatttttcaaaa

SEQ ID NO: 2362328 - DNA, 22 bp, Homo sapiens
agatttttctcaaagttttgaa

SEQ ID NO: 2362329 - DNA, 17 bp, Homo sapiens
agcaaaatctaaaatgt

SEQ ID NO: 2362330 - DNA, 17 bp, Homo sapiens
agcaaaggggacagctg

SEQ ID NO: 2362331 - DNA, 15 bp, Homo sapiens
agcaaataaatacgt

SEQ ID NO: 2362332 - DNA, 23 bp, Homo sapiens
agcaacaacaattggtaaaactc

SEQ ID NO: 2362333 - DNA, 21 bp, Homo sapiens
agcaactaatgtttgaacaaa

SEQ ID NO: 2362334 - DNA, 16 bp, Homo sapiens
agcaactgctggggag

SEQ ID NO: 2362335 - DNA, 14 bp, Homo sapiens
agcaagactgggcc

SEQ ID NO: 2362336 - DNA, 12 bp, Homo sapiens
agcaagagagat

SEQ ID NO: 2362337 - DNA, 22 bp, Homo sapiens
agcaagaggcaagctgaaattt

SEQ ID NO: 2362338 - DNA, 16 bp, Homo sapiens
agcaagcctgaattgg

SEQ ID NO: 2362339 - DNA, 19 bp, Homo sapiens
agcaaggtgagaaatcaca

SEQ ID NO: 2362340 - DNA, 20 bp, Homo sapiens
agcaagtacagcggctcccc

SEQ ID NO: 2362341 - DNA, 18 bp, Homo sapiens
agcaagtcctcactcttc

SEQ ID NO: 2362342 - DNA, 19 bp, Homo sapiens
agcaatcctcctgcctcag

SEQ ID NO: 2362343 - DNA, 23 bp, Homo sapiens
agcaatctcttcattattctctg

SEQ ID NO: 2362344 - DNA, 16 bp, Homo sapiens
agcaatctgaccctat

SEQ ID NO: 2362345 - DNA, 16 bp, Homo sapiens
agcaattcagacccct

SEQ ID NO: 2362346 - DNA, 16 bp, Homo sapiens
agcaatttagacaaag

SEQ ID NO: 2362347 - DNA, 12 bp, Homo sapiens
agcacaaaattc

SEQ ID NO: 2362348 - DNA, 14 bp, Homo sapiens
agcacaaaattcaa

SEQ ID NO: 2362349 - DNA, 15 bp, Homo sapiens
agcacaaaattcaaa

SEQ ID NO: 2362350 - DNA, 14 bp, Homo sapiens
agcacacattattt

SEQ ID NO: 2362351 - DNA, 14 bp, Homo sapiens
agcacagagcctgg

SEQ ID NO: 2362352 - DNA, 22 bp, Homo sapiens
agcacagagcctggccccaggc

SEQ ID NO: 2362353 - DNA, 19 bp, Homo sapiens
agcacaggaattctcaaga

SEQ ID NO: 2362354 - DNA, 23 bp, Homo sapiens
agcacaggaattctcaagacctg

SEQ ID NO: 2362355 - DNA, 14 bp, Homo sapiens
agcacagtatttaa

SEQ ID NO: 2362356 - DNA, 16 bp, Homo sapiens
agcacagtatttaaca

SEQ ID NO: 2362357 - DNA, 19 bp, Homo sapiens
agcacagtatttaacattc

SEQ ID NO: 2362358 - DNA, 22 bp, Homo sapiens
agcaccagcaattctctttctt

SEQ ID NO: 2362359 - DNA, 14 bp, Homo sapiens
agcaccttcagggc

SEQ ID NO: 2362360 - DNA, 16 bp, Homo sapiens
agcaccttcagggctg

SEQ ID NO: 2362361 - DNA, 17 bp, Homo sapiens
agcacggactgtcagtt

SEQ ID NO: 2362362 - DNA, 20 bp, Homo sapiens
agcactccgcatcacctcac

SEQ ID NO: 2362363 - DNA, 22 bp, Homo sapiens
agcactccgcatcacctcacca

SEQ ID NO: 2362364 - DNA, 17 bp, Homo sapiens
agcactgagcaagttga

SEQ ID NO: 2362365 - DNA, 17 bp, Homo sapiens
agcactttgggaggccg

SEQ ID NO: 2362366 - DNA, 20 bp, Homo sapiens
agcactttgggaggccgagg

SEQ ID NO: 2362367 - DNA, 21 bp, Homo sapiens
agcactttgggaggccgaggc

SEQ ID NO: 2362368 - DNA, 14 bp, Homo sapiens
agcagaacaggtag

SEQ ID NO: 2362369 - DNA, 15 bp, Homo sapiens
agcagaacaggtagt

SEQ ID NO: 2362370 - DNA, 19 bp, Homo sapiens
agcagaacctgcacacagg

SEQ ID NO: 2362371 - DNA, 24 bp, Homo sapiens
agcagaacctgcacacaggacagc

SEQ ID NO: 2362372 - DNA, 15 bp, Homo sapiens
agcagaagtctggct

SEQ ID NO: 2362373 - DNA, 22 bp, Homo sapiens
agcagacctaaagcaagcctga

SEQ ID NO: 2362374 - DNA, 23 bp, Homo sapiens
agcagacttctcggaattcataa

SEQ ID NO: 2362375 - DNA, 19 bp, Homo sapiens
agcagaggcaggctgggac

SEQ ID NO: 2362376 - DNA, 12 bp, Homo sapiens
agcagagttaaa

SEQ ID NO: 2362377 - DNA, 18 bp, Homo sapiens
agcagagttaaatctcaa

SEQ ID NO: 2362378 - DNA, 12 bp, Homo sapiens
agcagatgcaga

SEQ ID NO: 2362379 - DNA, 13 bp, Homo sapiens
agcagatgcagag

SEQ ID NO: 2362380 - DNA, 18 bp, Homo sapiens
agcagatgcagagagcca

SEQ ID NO: 2362381 - DNA, 21 bp, Homo sapiens
agcagatgctgttgtgaagct

SEQ ID NO: 2362382 - DNA, 21 bp, Homo sapiens
agcagcagcccaagcttccct

SEQ ID NO: 2362383 - DNA, 19 bp, Homo sapiens
agcagcagcttggggagag

SEQ ID NO: 2362384 - DNA, 14 bp, Homo sapiens
agcagcatcttctg

SEQ ID NO: 2362385 - DNA, 15 bp, Homo sapiens
agcagcatcttctgg

SEQ ID NO: 2362386 - DNA, 14 bp, Homo sapiens
agcagcctctggac

SEQ ID NO: 2362387 - DNA, 16 bp, Homo sapiens
agcctaagggatcctg

SEQ ID NO: 2362388 - DNA, 13 bp, Homo sapiens
agcctactctcct

SEQ ID NO: 2362389 - DNA, 14 bp, Homo sapiens
agcctactctcctt

SEQ ID NO: 2362390 - DNA, 17 bp, Homo sapiens
agcctatagtaaatgtg

SEQ ID NO: 2362391 - DNA, 17 bp, Homo sapiens
agcctcatactcctggg

SEQ ID NO: 2362392 - DNA, 22 bp, Homo sapiens
agcctccacagcgagggcagct

SEQ ID NO: 2362393 - DNA, 19 bp, Homo sapiens
agcctccccatctgtccag

SEQ ID NO: 2362394 - DNA, 22 bp, Homo sapiens
agcctccccatctgtccagctg

SEQ ID NO: 2362395 - DNA, 17 bp, Homo sapiens
agcctccctgaagacca

SEQ ID NO: 2362396 - DNA, 14 bp, Homo sapiens
agcctccgagaggg

SEQ ID NO: 2362397 - DNA, 12 bp, Homo sapiens
agcctcctctgg

SEQ ID NO: 2362398 - DNA, 13 bp, Homo sapiens
agcctcctctgga

SEQ ID NO: 2362399 - DNA, 18 bp, Homo sapiens
agcctcctctggacggca

SEQ ID NO: 2362400 - DNA, 15 bp, Homo sapiens
agcctcctgtgcctg

SEQ ID NO: 2362401 - DNA, 14 bp, Homo sapiens
agcctcctttgtgt

SEQ ID NO: 2362402 - DNA, 20 bp, Homo sapiens
agcctctcagtgccctccag

SEQ ID NO: 2362403 - DNA, 15 bp, Homo sapiens
agcctctctctccct

SEQ ID NO: 2362404 - DNA, 14 bp, Homo sapiens
agcctgcagcagga

SEQ ID NO: 2362405 - DNA, 15 bp, Homo sapiens
agcctgcattgagct

SEQ ID NO: 2362406 - DNA, 14 bp, Homo sapiens
agcctgctggaagc

SEQ ID NO: 2362407 - DNA, 21 bp, Homo sapiens
agcctggccaccagccatcct

SEQ ID NO: 2362408 - DNA, 21 bp, Homo sapiens
agcctggccccaggccccaga

SEQ ID NO: 2362409 - DNA, 12 bp, Homo sapiens
agcctgtcctgg

SEQ ID NO: 2362410 - DNA, 21 bp, Homo sapiens
agcctgtgcatgtatgtcttg

SEQ ID NO: 2362411 - DNA, 12 bp, Homo sapiens
agccttctccct

SEQ ID NO: 2362412 - DNA, 18 bp, Homo sapiens
agccttgcatcaagggct

SEQ ID NO: 2362413 - DNA, 19 bp, Homo sapiens
agccttggaaccagcccca

SEQ ID NO: 2362414 - DNA, 22 bp, Homo sapiens
agcctttaaatcatttttatat

SEQ ID NO: 2362415 - DNA, 18 bp, Homo sapiens
agcctttacctgtgaagt

SEQ ID NO: 2362416 - DNA, 20 bp, Homo sapiens
agcctttactgtttgatata

SEQ ID NO: 2362417 - DNA, 16 bp, Homo sapiens
agcctttgaatgtaac

SEQ ID NO: 2362418 - DNA, 22 bp, Homo sapiens
agcgaacttcacataggaaggg

SEQ ID NO: 2362419 - DNA, 17 bp, Homo sapiens
agcgaaggaacctctcg

SEQ ID NO: 2362420 - DNA, 14 bp, Homo sapiens
agcgagctgctctg

SEQ ID NO: 2362421 - DNA, 16 bp, Homo sapiens
agcgagctgctctgct

SEQ ID NO: 2362422 - DNA, 23 bp, Homo sapiens
agcgaggcacccttactggctta

SEQ ID NO: 2362423 - DNA, 14 bp, Homo sapiens
agcgagggcagctg

SEQ ID NO: 2362424 - DNA, 16 bp, Homo sapiens
agcgagggcagctgct

SEQ ID NO: 2362425 - DNA, 19 bp, Homo sapiens
agcgatctctccactgtgc

SEQ ID NO: 2362426 - DNA, 18 bp, Homo sapiens
agcgccaggaagccagag

SEQ ID NO: 2362427 - DNA, 19 bp, Homo sapiens
agcgccaggaagccagagc

SEQ ID NO: 2362428 - DNA, 17 bp, Homo sapiens
agcgcggacgtgctggg

SEQ ID NO: 2362429 - DNA, 19 bp, Homo sapiens
agcgctcatgttgagccag

SEQ ID NO: 2362430 - DNA, 13 bp, Homo sapiens
agcggggctgctc

SEQ ID NO: 2362431 - DNA, 21 bp, Homo sapiens
agcggtggataactagccaga

SEQ ID NO: 2362432 - DNA, 13 bp, Homo sapiens
agcgtccctggcg

SEQ ID NO: 2362433 - DNA, 12 bp, Homo sapiens
agcgtctgggaa

SEQ ID NO: 2362434 - DNA, 14 bp, Homo sapiens
agcgttgttttgtg

SEQ ID NO: 2362435 - DNA, 18 bp, Homo sapiens
agctaaaccaaggactga

SEQ ID NO: 2362436 - DNA, 18 bp, Homo sapiens
agctaaactccttcctgg

SEQ ID NO: 2362437 - DNA, 15 bp, Homo sapiens
agctaaagaggctga

SEQ ID NO: 2362438 - DNA, 21 bp, Homo sapiens
agctaaagaggctgaaagagg

SEQ ID NO: 2362439 - DNA, 11 bp, Homo sapiens
agctaaataaa

SEQ ID NO: 2362440 - DNA, 22 bp, Homo sapiens
agctaattgtactaatctgaga

SEQ ID NO: 2362441 - DNA, 13 bp, Homo sapiens
agctactctcttg

SEQ ID NO: 2362442 - DNA, 14 bp, Homo sapiens
agctagctgccact

SEQ ID NO: 2362443 - DNA, 15 bp, Homo sapiens
agctataaaagccca

SEQ ID NO: 2362444 - DNA, 19 bp, Homo sapiens
agctataaaagcccatgct

SEQ ID NO: 2362445 - DNA, 14 bp, Homo sapiens
agctatcctttcaa

SEQ ID NO: 2362446 - DNA, 20 bp, Homo sapiens
agctattagccaggatcatg

SEQ ID NO: 2362447 - DNA, 15 bp, Homo sapiens
agctattcacctcag

SEQ ID NO: 2362448 - DNA, 23 bp, Homo sapiens
agctatttaagtggactgtattt

SEQ ID NO: 2362449 - DNA, 17 bp, Homo sapiens
agctatttcatctattt

SEQ ID NO: 2362450 - DNA, 12 bp, Homo sapiens
agctattttcca

SEQ ID NO: 2362451 - DNA, 21 bp, Homo sapiens
agctattttccaggcttctgc

SEQ ID NO: 2362452 - DNA, 13 bp, Homo sapiens
agctcaatgcagt

SEQ ID NO: 2362453 - DNA, 16 bp, Homo sapiens
agctcaattcaagtga

SEQ ID NO: 2362454 - DNA, 17 bp, Homo sapiens
agctcacatgggactgg

SEQ ID NO: 2362455 - DNA, 12 bp, Homo sapiens
agctcaccatgg

SEQ ID NO: 2362456 - DNA, 15 bp, Homo sapiens
agctcaggtgcctta

SEQ ID NO: 2362457 - DNA, 22 bp, Homo sapiens
agctcagtcatcaaagcagaag

SEQ ID NO: 2362458 - DNA, 14 bp, Homo sapiens
agctccagctttct

SEQ ID NO: 2362459 - DNA, 21 bp, Homo sapiens
agctccagggaatccaagcct

SEQ ID NO: 2362460 - DNA, 22 bp, Homo sapiens
agctccctcctgcacacagaat

SEQ ID NO: 2362461 - DNA, 16 bp, Homo sapiens
agctcctcaactcacc

SEQ ID NO: 2362462 - DNA, 14 bp, Homo sapiens
agctcctgtcccct

SEQ ID NO: 2362463 - DNA, 18 bp, Homo sapiens
agctctctctagaatgag

SEQ ID NO: 2362464 - DNA, 21 bp, Homo sapiens
agctctctgacgcttgtgaca

SEQ ID NO: 2362465 - DNA, 22 bp, Homo sapiens
agctctctgacgcttgtgacag

SEQ ID NO: 2362466 - DNA, 13 bp, Homo sapiens
agctctctgccct

SEQ ID NO: 2362467 - DNA, 18 bp, Homo sapiens
agctctctgccctgtgta

SEQ ID NO: 2362468 - DNA, 20 bp, Homo sapiens
agctctgaagttaaaatgat

SEQ ID NO: 2362469 - DNA, 18 bp, Homo sapiens
agctctgaatgctatttg

SEQ ID NO: 2362470 - DNA, 21 bp, Homo sapiens
agctctggaggtgctgctcta

SEQ ID NO: 2362471 - DNA, 17 bp, Homo sapiens
agctcttactctttcct

SEQ ID NO: 2362472 - DNA, 22 bp, Homo sapiens
agctcttcctatccctctccta

SEQ ID NO: 2362473 - DNA, 21 bp, Homo sapiens
agctctttccaaattaaaaca

SEQ ID NO: 2362474 - DNA, 22 bp, Homo sapiens
agctctttccaaattaaaacaa

SEQ ID NO: 2362475 - DNA, 17 bp, Homo sapiens
agctgagcagcctctgg

SEQ ID NO: 2362476 - DNA, 21 bp, Homo sapiens
agctgatattatttcttctct

SEQ ID NO: 2362477 - DNA, 23 bp, Homo sapiens
agctgatattatttcttctctta

SEQ ID NO: 2362478 - DNA, 22 bp, Homo sapiens
agctgatctgcggatctcagct

SEQ ID NO: 2362479 - DNA, 15 bp, Homo sapiens
agctgcactgtgaac

SEQ ID NO: 2362480 - DNA, 19 bp, Homo sapiens
agctgcagagatttctcat

SEQ ID NO: 2362481 - DNA, 14 bp, Homo sapiens
agctgccaagagtg

SEQ ID NO: 2362482 - DNA, 14 bp, Homo sapiens
agctgccatggcta

SEQ ID NO: 2362483 - DNA, 24 bp, Homo sapiens
agctgcccactgtttctcttgagc

SEQ ID NO: 2362484 - DNA, 18 bp, Homo sapiens
agctgccctatgggcctg

SEQ ID NO: 2362485 - DNA, 19 bp, Homo sapiens
agctgccctatgggcctgc

SEQ ID NO: 2362486 - DNA, 15 bp, Homo sapiens
agctgcctggtatat

SEQ ID NO: 2362487 - DNA, 12 bp, Homo sapiens
agctgccttccc

SEQ ID NO: 2362488 - DNA, 14 bp, Homo sapiens
agctgccttcccta

SEQ ID NO: 2362489 - DNA, 19 bp, Homo sapiens
agctgccttccctagcttt

SEQ ID NO: 2362490 - DNA, 19 bp, Homo sapiens
agctgctcattacagttct

SEQ ID NO: 2362491 - DNA, 13 bp, Homo sapiens
agctgctctgcta

SEQ ID NO: 2362492 - DNA, 16 bp, Homo sapiens
agctggatagacttgg

SEQ ID NO: 2362493 - DNA, 20 bp, Homo sapiens
agctggatagacttgggatg

SEQ ID NO: 2362494 - DNA, 21 bp, Homo sapiens
agctggatagacttgggatgg

SEQ ID NO: 2362495 - DNA, 15 bp, Homo sapiens
agctggcctggacag

SEQ ID NO: 2362496 - DNA, 14 bp, Homo sapiens
agctggctctgtga

SEQ ID NO: 2362497 - DNA, 23 bp, Homo sapiens
agctggctttgaaacctcagggc

SEQ ID NO: 2362498 - DNA, 14 bp, Homo sapiens
agctgggaaagcat

SEQ ID NO: 2362499 - DNA, 18 bp, Homo sapiens
agctgggactacaggtgc

SEQ ID NO: 2362500 - DNA, 19 bp, Homo sapiens
agctggggccagaggctgg

SEQ ID NO: 2362501 - DNA, 22 bp, Homo sapiens
agctggggctttgatgttcctt

SEQ ID NO: 2362502 - DNA, 18 bp, Homo sapiens
agtctcagttctcttgct

SEQ ID NO: 2362503 - DNA, 20 bp, Homo sapiens
agtctcataggttaaaaaaa

SEQ ID NO: 2362504 - DNA, 17 bp, Homo sapiens
agtctcatttgggctag

SEQ ID NO: 2362505 - DNA, 20 bp, Homo sapiens
agtctgcccacgcagaggac

SEQ ID NO: 2362506 - DNA, 16 bp, Homo sapiens
agtctggggacctggc

SEQ ID NO: 2362507 - DNA, 19 bp, Homo sapiens
agtctggggacctggcact

SEQ ID NO: 2362508 - DNA, 15 bp, Homo sapiens
agtctggtgaagctc

SEQ ID NO: 2362509 - DNA, 22 bp, Homo sapiens
agtcttccaattaatgcttttt

SEQ ID NO: 2362510 - DNA, 17 bp, Homo sapiens
agtcttcctgacacttt

SEQ ID NO: 2362511 - DNA, 17 bp, Homo sapiens
agtctttcatggctgct

SEQ ID NO: 2362512 - DNA, 19 bp, Homo sapiens
agtctttgctcagtgtcca

SEQ ID NO: 2362513 - DNA, 16 bp, Homo sapiens
agtcttttttttcctg

SEQ ID NO: 2362514 - DNA, 22 bp, Homo sapiens
agtgaaaaatcttaagtaccaa

SEQ ID NO: 2362515 - DNA, 21 bp, Homo sapiens
agtgaactcctgccaggcaca

SEQ ID NO: 2362516 - DNA, 23 bp, Homo sapiens
agtgaagggaagagacagcccag

SEQ ID NO: 2362517 - DNA, 20 bp, Homo sapiens
agtgaatacattaacggtgc

SEQ ID NO: 2362518 - DNA, 23 bp, Homo sapiens
agtgaatacattaacggtgctaa

SEQ ID NO: 2362519 - DNA, 12 bp, Homo sapiens
agtgaattgaag

SEQ ID NO: 2362520 - DNA, 24 bp, Homo sapiens
agtgacaaataaattaggaccaag

SEQ ID NO: 2362521 - DNA, 17 bp, Homo sapiens
agtgacacattaatgat

SEQ ID NO: 2362522 - DNA, 16 bp, Homo sapiens
agtgacagctttctgg

SEQ ID NO: 2362523 - DNA, 15 bp, Homo sapiens
agtgacttcctggtg

SEQ ID NO: 2362524 - DNA, 11 bp, Homo sapiens
agtgagactgc

SEQ ID NO: 2362525 - DNA, 17 bp, Homo sapiens
agtgagatgtagaaagt

SEQ ID NO: 2362526 - DNA, 15 bp, Homo sapiens
agtgagcagaacagg

SEQ ID NO: 2362527 - DNA, 15 bp, Homo sapiens
agtgagccaaaatca

SEQ ID NO: 2362528 - DNA, 13 bp, Homo sapiens
agtgagcctcctg

SEQ ID NO: 2362529 - DNA, 18 bp, Homo sapiens
agtgagcctcctgtgcct

SEQ ID NO: 2362530 - DNA, 19 bp, Homo sapiens
agtgagcctcctgtgcctg

SEQ ID NO: 2362531 - DNA, 22 bp, Homo sapiens
agtgagcctcctgtgcctggcc

SEQ ID NO: 2362532 - DNA, 19 bp, Homo sapiens
agtgatatggcagaagaca

SEQ ID NO: 2362533 - DNA, 22 bp, Homo sapiens
agtgatatggcagaagacacca

SEQ ID NO: 2362534 - DNA, 21 bp, Homo sapiens
agtgcagagccttctcagaag

SEQ ID NO: 2362535 - DNA, 14 bp, Homo sapiens
agtgcagccttctc

SEQ ID NO: 2362536 - DNA, 22 bp, Homo sapiens
agtgcagtcagcagatgctgtt

SEQ ID NO: 2362537 - DNA, 21 bp, Homo sapiens
agtgcatagttgtagacaaag

SEQ ID NO: 2362538 - DNA, 17 bp, Homo sapiens
agtgcatttttgtaaat

SEQ ID NO: 2362539 - DNA, 17 bp, Homo sapiens
agtgcccacatttgatg

SEQ ID NO: 2362540 - DNA, 21 bp, Homo sapiens
agtgccccagggagtccaggg

SEQ ID NO: 2362541 - DNA, 22 bp, Homo sapiens
agtgccccagggagtccagggt

SEQ ID NO: 2362542 - DNA, 14 bp, Homo sapiens
agtgccctccagcc

SEQ ID NO: 2362543 - DNA, 15 bp, Homo sapiens
agtgccctccagccc

SEQ ID NO: 2362544 - DNA, 15 bp, Homo sapiens
agtgccctctcccac

SEQ ID NO: 2362545 - DNA, 19 bp, Homo sapiens
agtgccctctcccaccctc

SEQ ID NO: 2362546 - DNA, 20 bp, Homo sapiens
agtgcccttcctgctgcgca

SEQ ID NO: 2362547 - DNA, 22 bp, Homo sapiens
agtgcctacatcccgggcctca

SEQ ID NO: 2362548 - DNA, 13 bp, Homo sapiens
agtgcctcacctc

SEQ ID NO: 2362549 - DNA, 21 bp, Homo sapiens
agtgcctcacctcgaaaggag

SEQ ID NO: 2362550 - DNA, 19 bp, Homo sapiens
agtgcgggctgaggccaga

SEQ ID NO: 2362551 - DNA, 17 bp, Homo sapiens
agtgctagatttagcac

SEQ ID NO: 2362552 - DNA, 14 bp, Homo sapiens
agtgctcaaggcca

SEQ ID NO: 2362553 - DNA, 13 bp, Homo sapiens
agtgctctgcctc

SEQ ID NO: 2362554 - DNA, 22 bp, Homo sapiens
agtgctgttgggatatagtcaa

SEQ ID NO: 2362555 - DNA, 19 bp, Homo sapiens
agtggcgtgggagccagcc

SEQ ID NO: 2362556 - DNA, 14 bp, Homo sapiens
agtggctcaacatt

SEQ ID NO: 2362557 - DNA, 18 bp, Homo sapiens
agtggctgccacacccag

SEQ ID NO: 2362558 - DNA, 17 bp, Homo sapiens
agtgggggcagcccagg

SEQ ID NO: 2362559 - DNA, 16 bp, Homo sapiens
agtggggtgctgggag

SEQ ID NO: 2362560 - DNA, 15 bp, Homo sapiens
agtggtcataaaata

SEQ ID NO: 2362561 - DNA, 21 bp, Homo sapiens
agtggtcataaaatagaataa

SEQ ID NO: 2362562 - DNA, 12 bp, Homo sapiens
agtggtctctgc

SEQ ID NO: 2362563 - DNA, 13 bp, Homo sapiens
agtggtctctgct

SEQ ID NO: 2362564 - DNA, 13 bp, Homo sapiens
agtggtctttgta

SEQ ID NO: 2362565 - DNA, 17 bp, Homo sapiens
agtggtctttgtaagag

SEQ ID NO: 2362566 - DNA, 22 bp, Homo sapiens
agtggtgatttgaaaaatataa

SEQ ID NO: 2362567 - DNA, 14 bp, Homo sapiens
agtggtgggggaag

SEQ ID NO: 2362568 - DNA, 15 bp, Homo sapiens
agtggttgttttttc

SEQ ID NO: 2362569 - DNA, 20 bp, Homo sapiens
agtggttttatactgaagga

SEQ ID NO: 2362570 - DNA, 23 bp, Homo sapiens
agtggttttatactgaaggaaaa

SEQ ID NO: 2362571 - DNA, 20 bp, Homo sapiens
agtgtaacttgcttaaattt

SEQ ID NO: 2362572 - DNA, 22 bp, Homo sapiens
agtgtacaccactttcccacac

SEQ ID NO: 2362573 - DNA, 18 bp, Homo sapiens
agtgtacccatctttaat

SEQ ID NO: 2362574 - DNA, 22 bp, Homo sapiens
agtgtagaaaagaactggaaac

SEQ ID NO: 2362575 - DNA, 17 bp, Homo sapiens
agtgtagaagcattcct

SEQ ID NO: 2362576 - DNA, 20 bp, Homo sapiens
agtgtagaagcattccttct

SEQ ID NO: 2362577 - DNA, 20 bp, Homo sapiens
agtgtcatttctcatccaca

SEQ ID NO: 2362578 - DNA, 17 bp, Homo sapiens
agtgtccagcttccaaa

SEQ ID NO: 2362579 - DNA, 22 bp, Homo sapiens
agtgtccagcttccaaagccta

SEQ ID NO: 2362580 - DNA, 23 bp, Homo sapiens
agtgtctcaaaggagctttctca

SEQ ID NO: 2362581 - DNA, 13 bp, Homo sapiens
agtgtctccacct

SEQ ID NO: 2362582 - DNA, 21 bp, Homo sapiens
agtgtctggaattgtggctat

SEQ ID NO: 2362583 - DNA, 13 bp, Homo sapiens
agtgtctgttcag

SEQ ID NO: 2362584 - DNA, 16 bp, Homo sapiens
agtgtgaaatatatta

SEQ ID NO: 2362585 - DNA, 18 bp, Homo sapiens
agtgtgacagtttccaaa

SEQ ID NO: 2362586 - DNA, 19 bp, Homo sapiens
agtgtgatttgaattctgt

SEQ ID NO: 2362587 - DNA, 16 bp, Homo sapiens
agtgtgctaaaaatga

SEQ ID NO: 2362588 - DNA, 18 bp, Homo sapiens
agtgtgtatatattttgt

SEQ ID NO: 2362589 - DNA, 23 bp, Homo sapiens
agtgtgtatatattttgtgtgaa

SEQ ID NO: 2362590 - DNA, 15 bp, Homo sapiens
agtgttacctgtgtg

SEQ ID NO: 2362591 - DNA, 14 bp, Homo sapiens
agtgttcactgctc

SEQ ID NO: 2362592 - DNA, 22 bp, Homo sapiens
agtgttctcatgaagcaggagg

SEQ ID NO: 2362593 - DNA, 19 bp, Homo sapiens
agtgttctgtttgaaacta

SEQ ID NO: 2362594 - DNA, 18 bp, Homo sapiens
agtgttgcatatgagcct

SEQ ID NO: 2362595 - DNA, 20 bp, Homo sapiens
agtgttgtgccccttcactc

SEQ ID NO: 2362596 - DNA, 16 bp, Homo sapiens
agttaaagaaaggaaa

SEQ ID NO: 2362597 - DNA, 18 bp, Homo sapiens
agttaaagaaaggaaaag

SEQ ID NO: 2362598 - DNA, 19 bp, Homo sapiens
agttaaatctcctgtggag

SEQ ID NO: 2362599 - DNA, 22 bp, Homo sapiens
agttaagaagctgttgtacatt

SEQ ID NO: 2362600 - DNA, 13 bp, Homo sapiens
agttaatataaat

SEQ ID NO: 2362601 - DNA, 18 bp, Homo sapiens
agttaatcatcaagagaa

SEQ ID NO: 2362602 - DNA, 19 bp, Homo sapiens
agttaatcatcaagagaat

SEQ ID NO: 2362603 - DNA, 21 bp, Homo sapiens
agttaattggatgttcactgc

SEQ ID NO: 2362604 - DNA, 19 bp, Homo sapiens
agttacagtggcagtattg

SEQ ID NO: 2362605 - DNA, 22 bp, Homo sapiens
agttacagtggcagtattgaca

SEQ ID NO: 2362606 - DNA, 15 bp, Homo sapiens
agttactaaaattta

SEQ ID NO: 2362607 - DNA, 17 bp, Homo sapiens
agttactaaaatttaca

SEQ ID NO: 2362608 - DNA, 12 bp, Homo sapiens
agttacttgtga

SEQ ID NO: 2362609 - DNA, 15 bp, Homo sapiens
agttagctccataaa

SEQ ID NO: 2362610 - DNA, 14 bp, Homo sapiens
agttagtggaaatc

SEQ ID NO: 2362611 - DNA, 16 bp, Homo sapiens
agttagttaagttggg

SEQ ID NO: 2362612 - DNA, 15 bp, Homo sapiens
agttatcatgaattt

SEQ ID NO: 2362613 - DNA, 18 bp, Homo sapiens
agttatcatgaattttaa

SEQ ID NO: 2362614 - DNA, 20 bp, Homo sapiens
agttatgatttttttttcat

SEQ ID NO: 2362615 - DNA, 17 bp, Homo sapiens
agttatttttctctttg

SEQ ID NO: 2362616 - DNA, 20 bp, Homo sapiens
atttctaacagtccttgctt

SEQ ID NO: 2362617 - DNA, 23 bp, Homo sapiens
atttctaacagtccttgctttgg

SEQ ID NO: 2362618 - DNA, 16 bp, Homo sapiens
atttctaattgtaagt

SEQ ID NO: 2362619 - DNA, 13 bp, Homo sapiens
atttctatgacaa

SEQ ID NO: 2362620 - DNA, 16 bp, Homo sapiens
atttctatgacaaatt

SEQ ID NO: 2362621 - DNA, 15 bp, Homo sapiens
atttctattaatatc

SEQ ID NO: 2362622 - DNA, 23 bp, Homo sapiens
atttctctattttcataatcagt

SEQ ID NO: 2362623 - DNA, 20 bp, Homo sapiens
atttctttaaaagaatgact

SEQ ID NO: 2362624 - DNA, 22 bp, Homo sapiens
atttgaaataaagtaattttta

SEQ ID NO: 2362625 - DNA, 19 bp, Homo sapiens
atttgaagatttaattact

SEQ ID NO: 2362626 - DNA, 13 bp, Homo sapiens
atttgaataaatt

SEQ ID NO: 2362627 - DNA, 16 bp, Homo sapiens
atttgaataaattatg

SEQ ID NO: 2362628 - DNA, 22 bp, Homo sapiens
atttgacacaaagcttctaaag

SEQ ID NO: 2362629 - DNA, 17 bp, Homo sapiens
atttgactattctgtat

SEQ ID NO: 2362630 - DNA, 20 bp, Homo sapiens
atttgagaatacataaacaa

SEQ ID NO: 2362631 - DNA, 16 bp, Homo sapiens
atttgagcatatcagt

SEQ ID NO: 2362632 - DNA, 13 bp, Homo sapiens
atttgaggtcaag

SEQ ID NO: 2362633 - DNA, 16 bp, Homo sapiens
atttgatgattttcat

SEQ ID NO: 2362634 - DNA, 23 bp, Homo sapiens
atttgatgggccacaactgtctt

SEQ ID NO: 2362635 - DNA, 19 bp, Homo sapiens
atttgattaataaaatatc

SEQ ID NO: 2362636 - DNA, 21 bp, Homo sapiens
atttgattaataaaatatcta

SEQ ID NO: 2362637 - DNA, 20 bp, Homo sapiens
atttgatttctaattgtaag

SEQ ID NO: 2362638 - DNA, 23 bp, Homo sapiens
atttgcacagaagcacatgcacc

SEQ ID NO: 2362639 - DNA, 17 bp, Homo sapiens
atttgcctaattcctgg

SEQ ID NO: 2362640 - DNA, 12 bp, Homo sapiens
atttgcctcacc

SEQ ID NO: 2362641 - DNA, 14 bp, Homo sapiens
atttgcctcacctt

SEQ ID NO: 2362642 - DNA, 17 bp, Homo sapiens
atttgctactgttgtaa

SEQ ID NO: 2362643 - DNA, 18 bp, Homo sapiens
atttggatgattgtcata

SEQ ID NO: 2362644 - DNA, 15 bp, Homo sapiens
atttggggcttccaa

SEQ ID NO: 2362645 - DNA, 23 bp, Homo sapiens
atttggtcaagattttgaatgct

SEQ ID NO: 2362646 - DNA, 23 bp, Homo sapiens
atttggtctcaggcagcaccaca

SEQ ID NO: 2362647 - DNA, 11 bp, Homo sapiens
atttgtaaaac

SEQ ID NO: 2362648 - DNA, 23 bp, Homo sapiens
atttgtaacccactgagaggaca

SEQ ID NO: 2362649 - DNA, 15 bp, Homo sapiens
atttgtaagtttcag

SEQ ID NO: 2362650 - DNA, 18 bp, Homo sapiens
atttgtatgtcaaagctt

SEQ ID NO: 2362651 - DNA, 12 bp, Homo sapiens
atttgtcccaga

SEQ ID NO: 2362652 - DNA, 22 bp, Homo sapiens
atttgtgtgtttttagctgtga

SEQ ID NO: 2362653 - DNA, 14 bp, Homo sapiens
attttaaaaaaggg

SEQ ID NO: 2362654 - DNA, 16 bp, Homo sapiens
attttaaaaaatggtc

SEQ ID NO: 2362655 - DNA, 13 bp, Homo sapiens
attttaaaatttc

SEQ ID NO: 2362656 - DNA, 13 bp, Homo sapiens
attttaaagtatg

SEQ ID NO: 2362657 - DNA, 18 bp, Homo sapiens
attttaactaaattttaa

SEQ ID NO: 2362658 - DNA, 21 bp, Homo sapiens
attttaactaaattttaaagc

SEQ ID NO: 2362659 - DNA, 18 bp, Homo sapiens
attttaacttaactgaaa

SEQ ID NO: 2362660 - DNA, 19 bp, Homo sapiens
attttaacttaactgaaat

SEQ ID NO: 2362661 - DNA, 20 bp, Homo sapiens
attttaatgctgtttctaag

SEQ ID NO: 2362662 - DNA, 21 bp, Homo sapiens
attttaatgctgtttctaaga

SEQ ID NO: 2362663 - DNA, 13 bp, Homo sapiens
attttacagagcg

SEQ ID NO: 2362664 - DNA, 12 bp, Homo sapiens
attttacatgac

SEQ ID NO: 2362665 - DNA, 17 bp, Homo sapiens
attttacctagctaatt

SEQ ID NO: 2362666 - DNA, 19 bp, Homo sapiens
attttacctagctaattat

SEQ ID NO: 2362667 - DNA, 18 bp, Homo sapiens
attttagaaactacaaat

SEQ ID NO: 2362668 - DNA, 22 bp, Homo sapiens
attttataatgatgaacttata

SEQ ID NO: 2362669 - DNA, 12 bp, Homo sapiens
attttatcatta

SEQ ID NO: 2362670 - DNA, 13 bp, Homo sapiens
attttatcattaa

SEQ ID NO: 2362671 - DNA, 17 bp, Homo sapiens
attttatcattaaaaat

SEQ ID NO: 2362672 - DNA, 15 bp, Homo sapiens
attttatgagacagg

SEQ ID NO: 2362673 - DNA, 15 bp, Homo sapiens
attttatggtggaaa

SEQ ID NO: 2362674 - DNA, 22 bp, Homo sapiens
attttatgttaagggaagaatt

SEQ ID NO: 2362675 - DNA, 20 bp, Homo sapiens
attttcaagattctaaagct

SEQ ID NO: 2362676 - DNA, 23 bp, Homo sapiens
attttcaagattctaaagctcaa

SEQ ID NO: 2362677 - DNA, 17 bp, Homo sapiens
attttcacactggtaaa

SEQ ID NO: 2362678 - DNA, 17 bp, Homo sapiens
attttcagcaaactctt

SEQ ID NO: 2362679 - DNA, 20 bp, Homo sapiens
attttcagtcccctctctct

SEQ ID NO: 2362680 - DNA, 22 bp, Homo sapiens
attttcagtcccctctctctgg

SEQ ID NO: 2362681 - DNA, 17 bp, Homo sapiens
attttcatgaaaatacc

SEQ ID NO: 2362682 - DNA, 14 bp, Homo sapiens
attttcatttcatg

SEQ ID NO: 2362683 - DNA, 17 bp, Homo sapiens
attttccattaactatt

SEQ ID NO: 2362684 - DNA, 18 bp, Homo sapiens
attttcctcctctgccta

SEQ ID NO: 2362685 - DNA, 14 bp, Homo sapiens
attttccttttcaa

SEQ ID NO: 2362686 - DNA, 14 bp, Homo sapiens
attttctaaaagcc

SEQ ID NO: 2362687 - DNA, 21 bp, Homo sapiens
attttctaaaagctttcatgt

SEQ ID NO: 2362688 - DNA, 15 bp, Homo sapiens
attttctaaagactt

SEQ ID NO: 2362689 - DNA, 22 bp, Homo sapiens
attttctaaataaaaatatgta

SEQ ID NO: 2362690 - DNA, 16 bp, Homo sapiens
attttctgtgcctgaa

SEQ ID NO: 2362691 - DNA, 15 bp, Homo sapiens
attttgaaacaaagt

SEQ ID NO: 2362692 - DNA, 21 bp, Homo sapiens
attttgagtattccatgagct

SEQ ID NO: 2362693 - DNA, 22 bp, Homo sapiens
attttggcgaatctcaaaatta

SEQ ID NO: 2362694 - DNA, 20 bp, Homo sapiens
attttgtagttaatataaat

SEQ ID NO: 2362695 - DNA, 12 bp, Homo sapiens
attttgtgaatg

SEQ ID NO: 2362696 - DNA, 13 bp, Homo sapiens
attttgtgtaaaa

SEQ ID NO: 2362697 - DNA, 12 bp, Homo sapiens
attttgtgtcct

SEQ ID NO: 2362698 - DNA, 16 bp, Homo sapiens
atttttaaaacccatt

SEQ ID NO: 2362699 - DNA, 17 bp, Homo sapiens
atttttaaaacccattt

SEQ ID NO: 2362700 - DNA, 15 bp, Homo sapiens
atttttaaaggcatt

SEQ ID NO: 2362701 - DNA, 12 bp, Homo sapiens
atttttaagctg

SEQ ID NO: 2362702 - DNA, 18 bp, Homo sapiens
atttttataacatcttta

SEQ ID NO: 2362703 - DNA, 13 bp, Homo sapiens
atttttatagcaa

SEQ ID NO: 2362704 - DNA, 22 bp, Homo sapiens
atttttatatcatgcaaaatat

SEQ ID NO: 2362705 - DNA, 14 bp, Homo sapiens
atttttatatttcc

SEQ ID NO: 2362706 - DNA, 14 bp, Homo sapiens
atttttcaaggcat

SEQ ID NO: 2362707 - DNA, 22 bp, Homo sapiens
atttttcaatatattgaacttt

SEQ ID NO: 2362708 - DNA, 18 bp, Homo sapiens
atttttgacatggaaatg

SEQ ID NO: 2362709 - DNA, 19 bp, Homo sapiens
atttttggcagtctgaatt

SEQ ID NO: 2362710 - DNA, 13 bp, Homo sapiens
atttttgtaaatg

SEQ ID NO: 2362711 - DNA, 19 bp, Homo sapiens
atttttgtaaatgtgtaca

SEQ ID NO: 2362712 - DNA, 20 bp, Homo sapiens
attttttcagactgtgcaat

SEQ ID NO: 2362713 - DNA, 12 bp, Homo sapiens
attttttccctt

SEQ ID NO: 2362714 - DNA, 12 bp, Homo sapiens
attttttgactt

SEQ ID NO: 2362715 - DNA, 13 bp, Homo sapiens
attttttgtctgt

SEQ ID NO: 2362716 - DNA, 16 bp, Homo sapiens
attttttgtttgttta

SEQ ID NO: 2362717 - DNA, 17 bp, Homo sapiens
atttttttaaaattttg

SEQ ID NO: 2362718 - DNA, 22 bp, Homo sapiens
attttttttcaaacaagtatga

SEQ ID NO: 2362719 - DNA, 19 bp, Homo sapiens
atttttttttcatacactt

SEQ ID NO: 2362720 - DNA, 21 bp, Homo sapiens
atttttttttcatacacttat

SEQ ID NO: 2362721 - DNA, 22 bp, Homo sapiens
caaaaaaaaattttaaagaccc

SEQ ID NO: 2362722 - DNA, 19 bp, Homo sapiens
caaaaaaaatttagccggg

SEQ ID NO: 2362723 - DNA, 21 bp, Homo sapiens
caaaaaaaatttagccgggcg

SEQ ID NO: 2362724 - DNA, 15 bp, Homo sapiens
caaaaaaacaaaaaa

SEQ ID NO: 2362725 - DNA, 11 bp, Homo sapiens
caaaaaattat

SEQ ID NO: 2362726 - DNA, 14 bp, Homo sapiens
caaaaaattcttta

SEQ ID NO: 2362727 - DNA, 22 bp, Homo sapiens
caaaaacatttgattaataaaa

SEQ ID NO: 2362728 - DNA, 16 bp, Homo sapiens
caaaacaaaaagatgt

SEQ ID NO: 2362729 - DNA, 23 bp, Homo sapiens
caaaacccctaagagactgcgtt

SEQ ID NO: 2362730 - DNA, 16 bp, Homo sapiens
caaaacctgtattact

SEQ ID NO: 2362731 - DNA, 20 bp, Homo sapiens
caccagccccactgccagca

SEQ ID NO: 2362732 - DNA, 20 bp, Homo sapiens
caccagcccccgccccagag

SEQ ID NO: 2362733 - DNA, 22 bp, Homo sapiens
caccagcccccgccccagagtg

SEQ ID NO: 2362734 - DNA, 18 bp, Homo sapiens
caccaggccgtgccttgt

SEQ ID NO: 2362735 - DNA, 19 bp, Homo sapiens
caccaggccgtgccttgtt

SEQ ID NO: 2362736 - DNA, 15 bp, Homo sapiens
caccaggcgctgccc

SEQ ID NO: 2362737 - DNA, 14 bp, Homo sapiens
caccagtccctgtc

SEQ ID NO: 2362738 - DNA, 19 bp, Homo sapiens
caccatactccttgcttcc

SEQ ID NO: 2362739 - DNA, 15 bp, Homo sapiens
caccatatgaattgt

SEQ ID NO: 2362740 - DNA, 20 bp, Homo sapiens
caccatatgaattgtacaga

SEQ ID NO: 2362741 - DNA, 18 bp, Homo sapiens
caccatccaccttccctt

SEQ ID NO: 2362742 - DNA, 23 bp, Homo sapiens
cacccaaccctatctcctgacag

SEQ ID NO: 2362743 - DNA, 13 bp, Homo sapiens
cacccacatgtga

SEQ ID NO: 2362744 - DNA, 21 bp, Homo sapiens
cacccacatgtgacacatatg

SEQ ID NO: 2362745 - DNA, 16 bp, Homo sapiens
cacccaccgtggagga

SEQ ID NO: 2362746 - DNA, 15 bp, Homo sapiens
cacccacctcttgtg

SEQ ID NO: 2362747 - DNA, 14 bp, Homo sapiens
cacccacctgtttt

SEQ ID NO: 2362748 - DNA, 19 bp, Homo sapiens
cacccacctgttttctgaa

SEQ ID NO: 2362749 - DNA, 20 bp, Homo sapiens
cacccacctgttttctgaaa

SEQ ID NO: 2362750 - DNA, 22 bp, Homo sapiens
cacccacctgttttctgaaaca

SEQ ID NO: 2362751 - DNA, 14 bp, Homo sapiens
cacccactgtccgc

SEQ ID NO: 2362752 - DNA, 19 bp, Homo sapiens
cacccactgtccgcctctg

SEQ ID NO: 2362753 - DNA, 20 bp, Homo sapiens
cacccagacataaaggaaaa

SEQ ID NO: 2362754 - DNA, 12 bp, Homo sapiens
caccccaagaga

SEQ ID NO: 2362755 - DNA, 15 bp, Homo sapiens
caccccactcccaca

SEQ ID NO: 2362756 - DNA, 14 bp, Homo sapiens
caccccctgccctg

SEQ ID NO: 2362757 - DNA, 16 bp, Homo sapiens
caccccctgccctgca

SEQ ID NO: 2362758 - DNA, 17 bp, Homo sapiens
caccccctgccctgcac

SEQ ID NO: 2362759 - DNA, 19 bp, Homo sapiens
caccccggggaccctgtga

SEQ ID NO: 2362760 - DNA, 20 bp, Homo sapiens
cacccctggaagagcccagt

SEQ ID NO: 2362761 - DNA, 12 bp, Homo sapiens
cacccctgggcc

SEQ ID NO: 2362762 - DNA, 13 bp, Homo sapiens
cacccctgggcca

SEQ ID NO: 2362763 - DNA, 18 bp, Homo sapiens
caccctcaaaccctgtgg

SEQ ID NO: 2362764 - DNA, 18 bp, Homo sapiens
caccctcagggagcctcc

SEQ ID NO: 2362765 - DNA, 16 bp, Homo sapiens
caccctccagagacaa

SEQ ID NO: 2362766 - DNA, 16 bp, Homo sapiens
caccctcttcctactg

SEQ ID NO: 2362767 - DNA, 12 bp, Homo sapiens
caccctgcagag

SEQ ID NO: 2362768 - DNA, 13 bp, Homo sapiens
caccctgcagagc

SEQ ID NO: 2362769 - DNA, 15 bp, Homo sapiens
caccctgcgggccag

SEQ ID NO: 2362770 - DNA, 18 bp, Homo sapiens
caccctgtcctatgactt

SEQ ID NO: 2362771 - DNA, 15 bp, Homo sapiens
caccctgttcctgct

SEQ ID NO: 2362772 - DNA, 19 bp, Homo sapiens
cacccttctcccactctcc

SEQ ID NO: 2362773 - DNA, 15 bp, Homo sapiens
caccgcccctggccg

SEQ ID NO: 2362774 - DNA, 12 bp, Homo sapiens
caccgctggccc

SEQ ID NO: 2362775 - DNA, 13 bp, Homo sapiens
caccgctgggtgg

SEQ ID NO: 2362776 - DNA, 21 bp, Homo sapiens
caccggcctgtgggtctctga

SEQ ID NO: 2362777 - DNA, 17 bp, Homo sapiens
caccggtccagctggcc

SEQ ID NO: 2362778 - DNA, 18 bp, Homo sapiens
caccggtccagctggcct

SEQ ID NO: 2362779 - DNA, 18 bp, Homo sapiens
caccgtgcctggccagat

SEQ ID NO: 2362780 - DNA, 19 bp, Homo sapiens
caccgtgcctggccagatt

SEQ ID NO: 2362781 - DNA, 19 bp, Homo sapiens
caccgtgtcaagctgctct

SEQ ID NO: 2362782 - DNA, 21 bp, Homo sapiens
cacctaatgtttatgagccag

SEQ ID NO: 2362783 - DNA, 19 bp, Homo sapiens
cacctacacccctgtgctc

SEQ ID NO: 2362784 - DNA, 19 bp, Homo sapiens
cacctaccccttggaaatg

SEQ ID NO: 2362785 - DNA, 17 bp, Homo sapiens
cacctattatcccagct

SEQ ID NO: 2362786 - DNA, 21 bp, Homo sapiens
cacctattatcccagctgcct

SEQ ID NO: 2362787 - DNA, 15 bp, Homo sapiens
cacctcaagaccccc

SEQ ID NO: 2362788 - DNA, 14 bp, Homo sapiens
cacctcacgctctg

SEQ ID NO: 2362789 - DNA, 18 bp, Homo sapiens
cacctcatgcccaccccc

SEQ ID NO: 2362790 - DNA, 21 bp, Homo sapiens
cacctcatgcccaccccctgc

SEQ ID NO: 2362791 - DNA, 18 bp, Homo sapiens
cacctccaagcatttcat

SEQ ID NO: 2362792 - DNA, 22 bp, Homo sapiens
cacctccaagcatttcatgaaa

SEQ ID NO: 2362793 - DNA, 23 bp, Homo sapiens
cacctcttgtgcaaggtggcctt

SEQ ID NO: 2362794 - DNA, 12 bp, Homo sapiens
cacctctttaaa

SEQ ID NO: 2362795 - DNA, 22 bp, Homo sapiens
cacctctttaaaaactcactta

SEQ ID NO: 2362796 - DNA, 17 bp, Homo sapiens
cacctgacttggctggg

SEQ ID NO: 2362797 - DNA, 16 bp, Homo sapiens
cacctgagaccctact

SEQ ID NO: 2362798 - DNA, 18 bp, Homo sapiens
cacctgagaccctactga

SEQ ID NO: 2362799 - DNA, 11 bp, Homo sapiens
cacctgcaaga

SEQ ID NO: 2362800 - DNA, 16 bp, Homo sapiens
cacctgcatctggggc

SEQ ID NO: 2362801 - DNA, 17 bp, Homo sapiens
cacctggctctcacctc

SEQ ID NO: 2362802 - DNA, 19 bp, Homo sapiens
cacctggctctcacctcta

SEQ ID NO: 2362803 - DNA, 22 bp, Homo sapiens
cacctggctgaggttcctctgc

SEQ ID NO: 2362804 - DNA, 15 bp, Homo sapiens
cacctgtaaacctga

SEQ ID NO: 2362805 - DNA, 21 bp, Homo sapiens
cacctgttttctgaaacacac

SEQ ID NO: 2362806 - DNA, 16 bp, Homo sapiens
caccttcatgattata

SEQ ID NO: 2362807 - DNA, 20 bp, Homo sapiens
caccttcccttctacaagga

SEQ ID NO: 2362808 - DNA, 23 bp, Homo sapiens
caccttgacgtttcttctttcta

SEQ ID NO: 2362809 - DNA, 18 bp, Homo sapiens
caccttgccagggcaggg

SEQ ID NO: 2362810 - DNA, 17 bp, Homo sapiens
caccttgccgagagagg

SEQ ID NO: 2362811 - DNA, 19 bp, Homo sapiens
caccttgccgagagaggcg

SEQ ID NO: 2362812 - DNA, 15 bp, Homo sapiens
caccttggggccttg

SEQ ID NO: 2362813 - DNA, 17 bp, Homo sapiens
caccttgtgtctgtaca

SEQ ID NO: 2362814 - DNA, 17 bp, Homo sapiens
cacctttgggatcagcc

SEQ ID NO: 2362815 - DNA, 21 bp, Homo sapiens
cacgagcaaacccagaggtgg

SEQ ID NO: 2362816 - DNA, 16 bp, Homo sapiens
cacgagccacaagctg

SEQ ID NO: 2362817 - DNA, 21 bp, Homo sapiens
cacgagccacaagctgcactg

SEQ ID NO: 2362818 - DNA, 18 bp, Homo sapiens
cacgattttcaagattct

SEQ ID NO: 2362819 - DNA, 12 bp, Homo sapiens
cacgcagaggac

SEQ ID NO: 2362820 - DNA, 21 bp, Homo sapiens
cacgcccggggtggccacagc

SEQ ID NO: 2362821 - DNA, 12 bp, Homo sapiens
cacgctcgctgc

SEQ ID NO: 2362822 - DNA, 14 bp, Homo sapiens
cacgcttctccgga

SEQ ID NO: 2362823 - DNA, 19 bp, Homo sapiens
cacggagacagaggaaagg

SEQ ID NO: 2362824 - DNA, 19 bp, Homo sapiens
cacggaggatgatgccagt

SEQ ID NO: 2362825 - DNA, 19 bp, Homo sapiens
cacggatcacgatgtaaat

SEQ ID NO: 2362826 - DNA, 21 bp, Homo sapiens
cacggggttccctcctagctc

SEQ ID NO: 2362827 - DNA, 15 bp, Homo sapiens
cacgtgtcctgtagt

SEQ ID NO: 2362828 - DNA, 16 bp, Homo sapiens
cacgtgtcctgtagtt

SEQ ID NO: 2362829 - DNA, 14 bp, Homo sapiens
cacgttgccagggg

SEQ ID NO: 2362830 - DNA, 18 bp, Homo sapiens
cacgttggccggcggcta

SEQ ID NO: 2362831 - DNA, 17 bp, Homo sapiens
cacgttggggtgattta

SEQ ID NO: 2362832 - DNA, 15 bp, Homo sapiens
cactaaatcagagac

SEQ ID NO: 2362833 - DNA, 15 bp, Homo sapiens
cactaactcaccagc

SEQ ID NO: 2362834 - DNA, 15 bp, Homo sapiens
cactacacctggctg

SEQ ID NO: 2362835 - DNA, 16 bp, Homo sapiens
cactacaccttgcctt

SEQ ID NO: 2362836 - DNA, 21 bp, Homo sapiens
cactacaggaggaatgcacca

SEQ ID NO: 2362837 - DNA, 18 bp, Homo sapiens
cactaccctgattcttga

SEQ ID NO: 2362838 - DNA, 20 bp, Homo sapiens
cactaccctgattcttgatt

SEQ ID NO: 2362839 - DNA, 12 bp, Homo sapiens
cactagagaaaa

SEQ ID NO: 2362840 - DNA, 16 bp, Homo sapiens
cactagcccaatgaaa

SEQ ID NO: 2362841 - DNA, 18 bp, Homo sapiens
cactagggccttggaaat

SEQ ID NO: 2362842 - DNA, 15 bp, Homo sapiens
cactcagtccactgt

SEQ ID NO: 2362843 - DNA, 18 bp, Homo sapiens
cactcagtccactgttga

SEQ ID NO: 2362844 - DNA, 23 bp, Homo sapiens
cactcagtgagcctcctgtgcct

SEQ ID NO: 2362845 - DNA, 18 bp, Homo sapiens
cactcattctgaattaat

SEQ ID NO: 2362846 - DNA, 20 bp, Homo sapiens
caggagcttgggcagtgccc

SEQ ID NO: 2362847 - DNA, 13 bp, Homo sapiens
caggaggcccttg

SEQ ID NO: 2362848 - DNA, 21 bp, Homo sapiens
caggaggcccttgtcgtggga

SEQ ID NO: 2362849 - DNA, 17 bp, Homo sapiens
caggaggcgcccttggc

SEQ ID NO: 2362850 - DNA, 23 bp, Homo sapiens
caggataagaaagcctaaaattg

SEQ ID NO: 2362851 - DNA, 17 bp, Homo sapiens
caggatactggcacaga

SEQ ID NO: 2362852 - DNA, 19 bp, Homo sapiens
caggatattggttcttccc

SEQ ID NO: 2362853 - DNA, 22 bp, Homo sapiens
caggatattggttcttcccctc

SEQ ID NO: 2362854 - DNA, 23 bp, Homo sapiens
caggatcatggtgtaataagaca

SEQ ID NO: 2362855 - DNA, 10 bp, Homo sapiens
caggatctat

SEQ ID NO: 2362856 - DNA, 19 bp, Homo sapiens
caggatgctaaagatgatg

SEQ ID NO: 2362857 - DNA, 16 bp, Homo sapiens
caggatggcctttcct

SEQ ID NO: 2362858 - DNA, 18 bp, Homo sapiens
caggatggcctttccttc

SEQ ID NO: 2362859 - DNA, 14 bp, Homo sapiens
caggattcccttct

SEQ ID NO: 2362860 - DNA, 14 bp, Homo sapiens
caggatttgcacag

SEQ ID NO: 2362861 - DNA, 13 bp, Homo sapiens
caggcaagcagct

SEQ ID NO: 2362862 - DNA, 13 bp, Homo sapiens
caggcacacacag

SEQ ID NO: 2362863 - DNA, 18 bp, Homo sapiens
caggcaccctcagggagc

SEQ ID NO: 2362864 - DNA, 17 bp, Homo sapiens
caggcacgggtggtccc

SEQ ID NO: 2362865 - DNA, 18 bp, Homo sapiens
caggcacgggtggtcccc

SEQ ID NO: 2362866 - DNA, 13 bp, Homo sapiens
caggcagcaccac

SEQ ID NO: 2362867 - DNA, 13 bp, Homo sapiens
caggcagcccagc

SEQ ID NO: 2362868 - DNA, 14 bp, Homo sapiens
caggcagcccagca

SEQ ID NO: 2362869 - DNA, 20 bp, Homo sapiens
caggcagcccagcagtgtgg

SEQ ID NO: 2362870 - DNA, 15 bp, Homo sapiens
caggcagcctccttt

SEQ ID NO: 2362871 - DNA, 15 bp, Homo sapiens
caggcagctccctcc

SEQ ID NO: 2362872 - DNA, 17 bp, Homo sapiens
caggcaggggtgggggt

SEQ ID NO: 2362873 - DNA, 21 bp, Homo sapiens
caggcaggggtgggggtggag

SEQ ID NO: 2362874 - DNA, 22 bp, Homo sapiens
caggcaggggtgggggtggagg

SEQ ID NO: 2362875 - DNA, 17 bp, Homo sapiens
caggcatagaggcttct

SEQ ID NO: 2362876 - DNA, 17 bp, Homo sapiens
caggccacctggctctc

SEQ ID NO: 2362877 - DNA, 21 bp, Homo sapiens
caggccagcctccgagaggga

SEQ ID NO: 2362878 - DNA, 12 bp, Homo sapiens
caggccaggctc

SEQ ID NO: 2362879 - DNA, 16 bp, Homo sapiens
caggccctcctctccc

SEQ ID NO: 2362880 - DNA, 13 bp, Homo sapiens
caggccctgactc

SEQ ID NO: 2362881 - DNA, 19 bp, Homo sapiens
caggccctgactcctctgg

SEQ ID NO: 2362882 - DNA, 21 bp, Homo sapiens
caggccctgactcctctggct

SEQ ID NO: 2362883 - DNA, 22 bp, Homo sapiens
caggccctgactcctctggctt

SEQ ID NO: 2362884 - DNA, 16 bp, Homo sapiens
caggccggcccagatg

SEQ ID NO: 2362885 - DNA, 15 bp, Homo sapiens
caggcctatttaaca

SEQ ID NO: 2362886 - DNA, 16 bp, Homo sapiens
caggcctgcctcccac

SEQ ID NO: 2362887 - DNA, 21 bp, Homo sapiens
caggcctggctggaggagcag

SEQ ID NO: 2362888 - DNA, 11 bp, Homo sapiens
caggccttgtc

SEQ ID NO: 2362889 - DNA, 22 bp, Homo sapiens
caggctcactgccaggccagcc

SEQ ID NO: 2362890 - DNA, 15 bp, Homo sapiens
caggctggagacccc

SEQ ID NO: 2362891 - DNA, 20 bp, Homo sapiens
caggctgggacggaccagca

SEQ ID NO: 2362892 - DNA, 23 bp, Homo sapiens
caggctgggacggaccagcatct

SEQ ID NO: 2362893 - DNA, 13 bp, Homo sapiens
caggctgggccat

SEQ ID NO: 2362894 - DNA, 22 bp, Homo sapiens
caggctgggccatgtccaaaga

SEQ ID NO: 2362895 - DNA, 23 bp, Homo sapiens
caggctgggccatgtccaaagag

SEQ ID NO: 2362896 - DNA, 14 bp, Homo sapiens
caggctgtggggtg

SEQ ID NO: 2362897 - DNA, 15 bp, Homo sapiens
caggcttttgctaga

SEQ ID NO: 2362898 - DNA, 23 bp, Homo sapiens
cagggaatccaagcctccacagc

SEQ ID NO: 2362899 - DNA, 21 bp, Homo sapiens
cagggacttcaggatcaagtc

SEQ ID NO: 2362900 - DNA, 17 bp, Homo sapiens
cagggagcaactctcca

SEQ ID NO: 2362901 - DNA, 23 bp, Homo sapiens
cagggagcaactctccactccat

SEQ ID NO: 2362902 - DNA, 20 bp, Homo sapiens
cagggatttgcctcaccttg

SEQ ID NO: 2362903 - DNA, 13 bp, Homo sapiens
cagggcagggtct

SEQ ID NO: 2362904 - DNA, 15 bp, Homo sapiens
cagggcagggtctgg

SEQ ID NO: 2362905 - DNA, 16 bp, Homo sapiens
cagggcagggtctggg

SEQ ID NO: 2362906 - DNA, 18 bp, Homo sapiens
cagggcagggtctgggct

SEQ ID NO: 2362907 - DNA, 20 bp, Homo sapiens
cagggcatcttgctggctac

SEQ ID NO: 2362908 - DNA, 12 bp, Homo sapiens
cagggccatgca

SEQ ID NO: 2362909 - DNA, 17 bp, Homo sapiens
cagggccatgcagacct

SEQ ID NO: 2362910 - DNA, 18 bp, Homo sapiens
cagggccatgcagacctc

SEQ ID NO: 2362911 - DNA, 14 bp, Homo sapiens
cagggctccctcct

SEQ ID NO: 2362912 - DNA, 18 bp, Homo sapiens
cagggctccctcctggag

SEQ ID NO: 2362913 - DNA, 20 bp, Homo sapiens
cagggctccctcctggagca

SEQ ID NO: 2362914 - DNA, 21 bp, Homo sapiens
cagggctccctcctggagcat

SEQ ID NO: 2362915 - DNA, 12 bp, Homo sapiens
cagggctgtccc

SEQ ID NO: 2362916 - DNA, 14 bp, Homo sapiens
cagggctgtcccag

SEQ ID NO: 2362917 - DNA, 15 bp, Homo sapiens
cagggctgtcccagc

SEQ ID NO: 2362918 - DNA, 23 bp, Homo sapiens
cagggctgtgcttgaaggccctg

SEQ ID NO: 2362919 - DNA, 19 bp, Homo sapiens
caggggaaggccctgaggc

SEQ ID NO: 2362920 - DNA, 16 bp, Homo sapiens
caggggtctccctggc

SEQ ID NO: 2362921 - DNA, 17 bp, Homo sapiens
caggggtctccctggct

SEQ ID NO: 2362922 - DNA, 22 bp, Homo sapiens
caggggtctccctggctccctc

SEQ ID NO: 2362923 - DNA, 12 bp, Homo sapiens
caggggtggggg

SEQ ID NO: 2362924 - DNA, 18 bp, Homo sapiens
caggggttagcctggact

SEQ ID NO: 2362925 - DNA, 13 bp, Homo sapiens
cagggtctgggct

SEQ ID NO: 2362926 - DNA, 23 bp, Homo sapiens
cagggtctgggctgggcacctga

SEQ ID NO: 2362927 - DNA, 17 bp, Homo sapiens
cagggtgaactgcaaag

SEQ ID NO: 2362928 - DNA, 15 bp, Homo sapiens
cagggtgcagcccaa

SEQ ID NO: 2362929 - DNA, 23 bp, Homo sapiens
cagggtgcagcccaatctgccag

SEQ ID NO: 2362930 - DNA, 16 bp, Homo sapiens
cagggtgggcttcctg

SEQ ID NO: 2362931 - DNA, 23 bp, Homo sapiens
cagggttctcttagcaactcaga

SEQ ID NO: 2362932 - DNA, 14 bp, Homo sapiens
caggtaaaacaggg

SEQ ID NO: 2362933 - DNA, 23 bp, Homo sapiens
caggtaaaacagggccacataga

SEQ ID NO: 2362934 - DNA, 16 bp, Homo sapiens
caggtaccagctgcgc

SEQ ID NO: 2362935 - DNA, 19 bp, Homo sapiens
caggtaccagctgcgcttg

SEQ ID NO: 2362936 - DNA, 18 bp, Homo sapiens
caggtagaaaagaaatgg

SEQ ID NO: 2362937 - DNA, 22 bp, Homo sapiens
caggtcatcagatgcctgcttg

SEQ ID NO: 2362938 - DNA, 15 bp, Homo sapiens
caggtccagatgtgc

SEQ ID NO: 2362939 - DNA, 17 bp, Homo sapiens
caggtgacatgtgaaac

SEQ ID NO: 2362940 - DNA, 20 bp, Homo sapiens
caggtgattggaccaggcca

SEQ ID NO: 2362941 - DNA, 20 bp, Homo sapiens
caggtgcgcgccaccgtgcc

SEQ ID NO: 2362942 - DNA, 17 bp, Homo sapiens
caggtgggggttgctgt

SEQ ID NO: 2362943 - DNA, 20 bp, Homo sapiens
caggtggttgtcttattgca

SEQ ID NO: 2362944 - DNA, 20 bp, Homo sapiens
caggtgttctacactcatct

SEQ ID NO: 2362945 - DNA, 19 bp, Homo sapiens
caggttatcgaaataacaa

SEQ ID NO: 2362946 - DNA, 15 bp, Homo sapiens
caggttcctttttca

SEQ ID NO: 2362947 - DNA, 21 bp, Homo sapiens
cagtaaaatactattgcctca

SEQ ID NO: 2362948 - DNA, 21 bp, Homo sapiens
cagtaaacgggaacatgcccc

SEQ ID NO: 2362949 - DNA, 12 bp, Homo sapiens
cagtaaatgtta

SEQ ID NO: 2362950 - DNA, 14 bp, Homo sapiens
cagtaactgtcagg

SEQ ID NO: 2362951 - DNA, 18 bp, Homo sapiens
cagtacagtattctttta

SEQ ID NO: 2362952 - DNA, 17 bp, Homo sapiens
cagtacatttaaatttt

SEQ ID NO: 2362953 - DNA, 13 bp, Homo sapiens
cagtacctctcaa

SEQ ID NO: 2362954 - DNA, 14 bp, Homo sapiens
cagtagaactccag

SEQ ID NO: 2362955 - DNA, 16 bp, Homo sapiens
cagtagagccagcttg

SEQ ID NO: 2362956 - DNA, 14 bp, Homo sapiens
cagtatattagtat

SEQ ID NO: 2362957 - DNA, 12 bp, Homo sapiens
cagtatcccaca

SEQ ID NO: 2362958 - DNA, 13 bp, Homo sapiens
cagtatcccacat

SEQ ID NO: 2362959 - DNA, 19 bp, Homo sapiens
cagtatgtgggatattgaa

SEQ ID NO: 2362960 - DNA, 15 bp, Homo sapiens
cagtatgtgggggct

SEQ ID NO: 2362961 - DNA, 18 bp, Homo sapiens
cattaaggggaagaatga

SEQ ID NO: 2362962 - DNA, 19 bp, Homo sapiens
cattaaggggaagaatgaa

SEQ ID NO: 2362963 - DNA, 21 bp, Homo sapiens
cattaaggggaagaatgaaag

SEQ ID NO: 2362964 - DNA, 23 bp, Homo sapiens
cattaaggggaagaatgaaagct

SEQ ID NO: 2362965 - DNA, 15 bp, Homo sapiens
cattaagtggctttt

SEQ ID NO: 2362966 - DNA, 21 bp, Homo sapiens
cattaattagttccagtttct

SEQ ID NO: 2362967 - DNA, 22 bp, Homo sapiens
cattacaactgaccaagtttct

SEQ ID NO: 2362968 - DNA, 21 bp, Homo sapiens
cattacagaggtattaaaact

SEQ ID NO: 2362969 - DNA, 20 bp, Homo sapiens
cattaccaaaataataaaaa

SEQ ID NO: 2362970 - DNA, 15 bp, Homo sapiens
cattacctccatcca

SEQ ID NO: 2362971 - DNA, 17 bp, Homo sapiens
cattacctccatccatc

SEQ ID NO: 2362972 - DNA, 21 bp, Homo sapiens
cattacctccatccatccttc

SEQ ID NO: 2362973 - DNA, 23 bp, Homo sapiens
cattacctccatccatccttcca

SEQ ID NO: 2362974 - DNA, 15 bp, Homo sapiens
cattactgtcccctt

SEQ ID NO: 2362975 - DNA, 19 bp, Homo sapiens
cattaggctgttggttcaa

SEQ ID NO: 2362976 - DNA, 21 bp, Homo sapiens
cattatgcacttttagaaatg

SEQ ID NO: 2362977 - DNA, 16 bp, Homo sapiens
cattatgttagagagg

SEQ ID NO: 2362978 - DNA, 21 bp, Homo sapiens
cattattcaagaatgaaaaat

SEQ ID NO: 2362979 - DNA, 24 bp, Homo sapiens
cattattctctgctatatataaaa

SEQ ID NO: 2362980 - DNA, 11 bp, Homo sapiens
cattattcttc

SEQ ID NO: 2362981 - DNA, 15 bp, Homo sapiens
cattattcttcttta

SEQ ID NO: 2362982 - DNA, 13 bp, Homo sapiens
cattatttcaaaa

SEQ ID NO: 2362983 - DNA, 19 bp, Homo sapiens
cattatttcaaaatgatag

SEQ ID NO: 2362984 - DNA, 21 bp, Homo sapiens
cattcaattagtggtcataaa

SEQ ID NO: 2362985 - DNA, 15 bp, Homo sapiens
cattcacttcataat

SEQ ID NO: 2362986 - DNA, 12 bp, Homo sapiens
cattcagaaatg

SEQ ID NO: 2362987 - DNA, 12 bp, Homo sapiens
cattcatcctga

SEQ ID NO: 2362988 - DNA, 17 bp, Homo sapiens
cattccaagaactataa

SEQ ID NO: 2362989 - DNA, 21 bp, Homo sapiens
cattccagtacagtattcttt

SEQ ID NO: 2362990 - DNA, 22 bp, Homo sapiens
cattccagtacagtattctttt

SEQ ID NO: 2362991 - DNA, 21 bp, Homo sapiens
cattcctaacacagcatgtgt

SEQ ID NO: 2362992 - DNA, 16 bp, Homo sapiens
cattccttctttgata

SEQ ID NO: 2362993 - DNA, 23 bp, Homo sapiens
cattccttctttgataatgttaa

SEQ ID NO: 2362994 - DNA, 19 bp, Homo sapiens
cattcgtatccagctcttt

SEQ ID NO: 2362995 - DNA, 21 bp, Homo sapiens
cattcgttgtgttttttaaga

SEQ ID NO: 2362996 - DNA, 11 bp, Homo sapiens
cattctcacat

SEQ ID NO: 2362997 - DNA, 13 bp, Homo sapiens
cattctcactgct

SEQ ID NO: 2362998 - DNA, 15 bp, Homo sapiens
cattctcaggcacca

SEQ ID NO: 2362999 - DNA, 21 bp, Homo sapiens
cattctcccaggtaccagctg

SEQ ID NO: 2363000 - DNA, 23 bp, Homo sapiens
cattctcccaggtaccagctgcg

SEQ ID NO: 2363001 - DNA, 12 bp, Homo sapiens
cattctgaatta

SEQ ID NO: 2363002 - DNA, 23 bp, Homo sapiens
cattctgaattaattaatttgga

SEQ ID NO: 2363003 - DNA, 23 bp, Homo sapiens
cattctgccgccccctcctgaac

SEQ ID NO: 2363004 - DNA, 16 bp, Homo sapiens
cattctgctccttccc

SEQ ID NO: 2363005 - DNA, 23 bp, Homo sapiens
cattctggtcaagggctgtcatt

SEQ ID NO: 2363006 - DNA, 14 bp, Homo sapiens
cattgaaactgtat

SEQ ID NO: 2363007 - DNA, 16 bp, Homo sapiens
cattgaaactgtattt

SEQ ID NO: 2363008 - DNA, 19 bp, Homo sapiens
cattgagcttgcatgcttg

SEQ ID NO: 2363009 - DNA, 16 bp, Homo sapiens
cattgagtattgttta

SEQ ID NO: 2363010 - DNA, 22 bp, Homo sapiens
cattgagtattgtttaaaatgt

SEQ ID NO: 2363011 - DNA, 19 bp, Homo sapiens
cattgatccaggagataat

SEQ ID NO: 2363012 - DNA, 21 bp, Homo sapiens
cattgcacataagcttccatt

SEQ ID NO: 2363013 - DNA, 21 bp, Homo sapiens
cattgccacggaaacatacag

SEQ ID NO: 2363014 - DNA, 14 bp, Homo sapiens
cattggatctgcaa

SEQ ID NO: 2363015 - DNA, 14 bp, Homo sapiens
cattgtcctccttt

SEQ ID NO: 2363016 - DNA, 16 bp, Homo sapiens
cattgtcctccttttc

SEQ ID NO: 2363017 - DNA, 21 bp, Homo sapiens
cattgtcctccttttcacttt

SEQ ID NO: 2363018 - DNA, 11 bp, Homo sapiens
cattgtggttt

SEQ ID NO: 2363019 - DNA, 14 bp, Homo sapiens
cattgtgttttctt

SEQ ID NO: 2363020 - DNA, 20 bp, Homo sapiens
cattgtgttttcttcgtgga

SEQ ID NO: 2363021 - DNA, 19 bp, Homo sapiens
cattgttcttattctggca

SEQ ID NO: 2363022 - DNA, 20 bp, Homo sapiens
cattgttcttattctggcat

SEQ ID NO: 2363023 - DNA, 13 bp, Homo sapiens
cattgttgtcaag

SEQ ID NO: 2363024 - DNA, 15 bp, Homo sapiens
cattgtttgtccttt

SEQ ID NO: 2363025 - DNA, 12 bp, Homo sapiens
catttaaaaaaa

SEQ ID NO: 2363026 - DNA, 17 bp, Homo sapiens
catttaaaatggaaaat

SEQ ID NO: 2363027 - DNA, 18 bp, Homo sapiens
catttaaattttttggca

SEQ ID NO: 2363028 - DNA, 18 bp, Homo sapiens
catttaaatttttttcct

SEQ ID NO: 2363029 - DNA, 18 bp, Homo sapiens
catttaataaagatgagt

SEQ ID NO: 2363030 - DNA, 18 bp, Homo sapiens
catttagaaatgtttatt

SEQ ID NO: 2363031 - DNA, 21 bp, Homo sapiens
catttagcttttttattttaa

SEQ ID NO: 2363032 - DNA, 15 bp, Homo sapiens
catttagtaagaata

SEQ ID NO: 2363033 - DNA, 15 bp, Homo sapiens
catttatgatttaat

SEQ ID NO: 2363034 - DNA, 17 bp, Homo sapiens
catttatgatttaataa

SEQ ID NO: 2363035 - DNA, 23 bp, Homo sapiens
catttatgatttaataaaataat

SEQ ID NO: 2363036 - DNA, 19 bp, Homo sapiens
catttcagggtcttggctg

SEQ ID NO: 2363037 - DNA, 14 bp, Homo sapiens
catttcatgaaaaa

SEQ ID NO: 2363038 - DNA, 17 bp, Homo sapiens
catttcatgaaaaagct

SEQ ID NO: 2363039 - DNA, 17 bp, Homo sapiens
catttcatgaaaatgac

SEQ ID NO: 2363040 - DNA, 15 bp, Homo sapiens
catttcattcctaac

SEQ ID NO: 2363041 - DNA, 18 bp, Homo sapiens
catttcattcctaacaca

SEQ ID NO: 2363042 - DNA, 11 bp, Homo sapiens
catttccaaac

SEQ ID NO: 2363043 - DNA, 15 bp, Homo sapiens
catttccaaatgaac

SEQ ID NO: 2363044 - DNA, 14 bp, Homo sapiens
catttccattgctt

SEQ ID NO: 2363045 - DNA, 15 bp, Homo sapiens
catttccattgctta

SEQ ID NO: 2363046 - DNA, 20 bp, Homo sapiens
catttcctagctgttctaat

SEQ ID NO: 2363047 - DNA, 19 bp, Homo sapiens
catttcctgagaccacaga

SEQ ID NO: 2363048 - DNA, 18 bp, Homo sapiens
catttccttgtctaaaga

SEQ ID NO: 2363049 - DNA, 12 bp, Homo sapiens
catttctcatcc

SEQ ID NO: 2363050 - DNA, 14 bp, Homo sapiens
catttgaaataaag

SEQ ID NO: 2363051 - DNA, 21 bp, Homo sapiens
catttgaaataaagtaatttt

SEQ ID NO: 2363052 - DNA, 14 bp, Homo sapiens
catttgattaataa

SEQ ID NO: 2363053 - DNA, 16 bp, Homo sapiens
catttgcaataacagc

SEQ ID NO: 2363054 - DNA, 18 bp, Homo sapiens
catttgcaataacagctg

SEQ ID NO: 2363055 - DNA, 19 bp, Homo sapiens
catttgcctaattcctggc

SEQ ID NO: 2363056 - DNA, 15 bp, Homo sapiens
catttgctactgttg

SEQ ID NO: 2363057 - DNA, 18 bp, Homo sapiens
catttgctactgttgtaa

SEQ ID NO: 2363058 - DNA, 20 bp, Homo sapiens
catttggtcaagattttgaa

SEQ ID NO: 2363059 - DNA, 15 bp, Homo sapiens
catttggtctcaggc

SEQ ID NO: 2363060 - DNA, 16 bp, Homo sapiens
catttggtctcaggca

SEQ ID NO: 2363061 - DNA, 22 bp, Homo sapiens
catttgtaagtgtaaaaaatgt

SEQ ID NO: 2363062 - DNA, 16 bp, Homo sapiens
catttgtgccagagga

SEQ ID NO: 2363063 - DNA, 14 bp, Homo sapiens
cattttaattttaa

SEQ ID NO: 2363064 - DNA, 16 bp, Homo sapiens
cattttactgtatatt

SEQ ID NO: 2363065 - DNA, 22 bp, Homo sapiens
cattttattaagctttttggaa

SEQ ID NO: 2363066 - DNA, 17 bp, Homo sapiens
cattttccatatcctgg

SEQ ID NO: 2363067 - DNA, 19 bp, Homo sapiens
cattttccatatcctggtg

SEQ ID NO: 2363068 - DNA, 11 bp, Homo sapiens
cattttcctcc

SEQ ID NO: 2363069 - DNA, 17 bp, Homo sapiens
cattttcctcctctgcc

SEQ ID NO: 2363070 - DNA, 13 bp, Homo sapiens
cattttctaaata

SEQ ID NO: 2363071 - DNA, 18 bp, Homo sapiens
cattttgggatccttcag

SEQ ID NO: 2363072 - DNA, 18 bp, Homo sapiens
cattttgtgaatggattg

SEQ ID NO: 2363073 - DNA, 10 bp, Homo sapiens
catttttcaa

SEQ ID NO: 2363074 - DNA, 12 bp, Homo sapiens
catttttgtaaa

SEQ ID NO: 2363075 - DNA, 11 bp, Homo sapiens
ccaaaaacaaa

SEQ ID NO: 2363076 - DNA, 17 bp, Homo sapiens
ccaccctgttcctgctg

SEQ ID NO: 2363077 - DNA, 18 bp, Homo sapiens
ccaccctgttcctgctgc

SEQ ID NO: 2363078 - DNA, 17 bp, Homo sapiens
ccaccgcccctggccgc

SEQ ID NO: 2363079 - DNA, 14 bp, Homo sapiens
ccaccggcctgtgg

SEQ ID NO: 2363080 - DNA, 13 bp, Homo sapiens
ccaccgtgcctgg

SEQ ID NO: 2363081 - DNA, 16 bp, Homo sapiens
ccacctagaacactaa

SEQ ID NO: 2363082 - DNA, 16 bp, Homo sapiens
ccacctcaagaccccc

SEQ ID NO: 2363083 - DNA, 15 bp, Homo sapiens
ccacctccacccact

SEQ ID NO: 2363084 - DNA, 19 bp, Homo sapiens
ccacctcctgacacccttc

SEQ ID NO: 2363085 - DNA, 18 bp, Homo sapiens
ccacctgcatctggggcc

SEQ ID NO: 2363086 - DNA, 19 bp, Homo sapiens
ccacctggctctcacctct

SEQ ID NO: 2363087 - DNA, 16 bp, Homo sapiens
ccacctgttttctgaa

SEQ ID NO: 2363088 - DNA, 12 bp, Homo sapiens
ccaccttccctt

SEQ ID NO: 2363089 - DNA, 20 bp, Homo sapiens
ccaccttgacgtttcttctt

SEQ ID NO: 2363090 - DNA, 19 bp, Homo sapiens
ccacctttgggatcagcct

SEQ ID NO: 2363091 - DNA, 22 bp, Homo sapiens
ccacctttgggatcagcctccg

SEQ ID NO: 2363092 - DNA, 18 bp, Homo sapiens
ccacgcagtgcctggagt

SEQ ID NO: 2363093 - DNA, 19 bp, Homo sapiens
ccacgcccgactagcaggc

SEQ ID NO: 2363094 - DNA, 12 bp, Homo sapiens
ccactaaaaata

SEQ ID NO: 2363095 - DNA, 13 bp, Homo sapiens
ccactaaaaatat

SEQ ID NO: 2363096 - DNA, 14 bp, Homo sapiens
ccactacacctggc

SEQ ID NO: 2363097 - DNA, 21 bp, Homo sapiens
ccactccagttttctcctctg

SEQ ID NO: 2363098 - DNA, 14 bp, Homo sapiens
ccactccctgggac

SEQ ID NO: 2363099 - DNA, 20 bp, Homo sapiens
ccactcctgtccctgtagct

SEQ ID NO: 2363100 - DNA, 19 bp, Homo sapiens
ccactcttctttaagccat

SEQ ID NO: 2363101 - DNA, 17 bp, Homo sapiens
ccactgacttgctgtgt

SEQ ID NO: 2363102 - DNA, 15 bp, Homo sapiens
ccactgccagcagca

SEQ ID NO: 2363103 - DNA, 20 bp, Homo sapiens
ccactgccagcagcagcagg

SEQ ID NO: 2363104 - DNA, 23 bp, Homo sapiens
ccactgccagcagcagcaggtga

SEQ ID NO: 2363105 - DNA, 11 bp, Homo sapiens
ccactgctgga

SEQ ID NO: 2363106 - DNA, 14 bp, Homo sapiens
ccactgctggacat

SEQ ID NO: 2363107 - DNA, 15 bp, Homo sapiens
ccactggctggagga

SEQ ID NO: 2363108 - DNA, 22 bp, Homo sapiens
ccactgtccgcctctgcccgca

SEQ ID NO: 2363109 - DNA, 23 bp, Homo sapiens
ccactgtccgcctctgcccgcag

SEQ ID NO: 2363110 - DNA, 13 bp, Homo sapiens
ccactgtgttcct

SEQ ID NO: 2363111 - DNA, 22 bp, Homo sapiens
ccactgttgagccccagtgctg

SEQ ID NO: 2363112 - DNA, 17 bp, Homo sapiens
ccactgtttctcttgag

SEQ ID NO: 2363113 - DNA, 22 bp, Homo sapiens
ccactgtttctcttgagctggc

SEQ ID NO: 2363114 - DNA, 23 bp, Homo sapiens
ccactgtttctcttgagctggcc

SEQ ID NO: 2363115 - DNA, 13 bp, Homo sapiens
ccacttcactgcg

SEQ ID NO: 2363116 - DNA, 18 bp, Homo sapiens
ccactttacccacctaga

SEQ ID NO: 2363117 - DNA, 19 bp, Homo sapiens
ccactttcacgtggcctcc

SEQ ID NO: 2363118 - DNA, 13 bp, Homo sapiens
ccactttgaaggg

SEQ ID NO: 2363119 - DNA, 19 bp, Homo sapiens
ccactttgaagggcaagaa

SEQ ID NO: 2363120 - DNA, 19 bp, Homo sapiens
ccagaaacacccctctgtc

SEQ ID NO: 2363121 - DNA, 22 bp, Homo sapiens
ccagaaacatctctggcccaga

SEQ ID NO: 2363122 - DNA, 23 bp, Homo sapiens
ccagaaagcctctctctccctcc

SEQ ID NO: 2363123 - DNA, 13 bp, Homo sapiens
ccagaaagggtgc

SEQ ID NO: 2363124 - DNA, 14 bp, Homo sapiens
ccagaagccttgga

SEQ ID NO: 2363125 - DNA, 19 bp, Homo sapiens
ccagaagccttggaaccag

SEQ ID NO: 2363126 - DNA, 16 bp, Homo sapiens
ccagacataaaggaaa

SEQ ID NO: 2363127 - DNA, 15 bp, Homo sapiens
ccagacgtcaggccc

SEQ ID NO: 2363128 - DNA, 21 bp, Homo sapiens
ccagacgtcaggccctgactc

SEQ ID NO: 2363129 - DNA, 19 bp, Homo sapiens
ccagactaaaggatccaga

SEQ ID NO: 2363130 - DNA, 23 bp, Homo sapiens
ccagactaaaggatccagagagc

SEQ ID NO: 2363131 - DNA, 17 bp, Homo sapiens
ccagactctttttttga

SEQ ID NO: 2363132 - DNA, 19 bp, Homo sapiens
ccagagaggcactcagtga

SEQ ID NO: 2363133 - DNA, 15 bp, Homo sapiens
ccagagcagatgcag

SEQ ID NO: 2363134 - DNA, 17 bp, Homo sapiens
ccagagcagatgcagag

SEQ ID NO: 2363135 - DNA, 17 bp, Homo sapiens
ccagagccccaagcagg

SEQ ID NO: 2363136 - DNA, 14 bp, Homo sapiens
ccagagctgcctgc

SEQ ID NO: 2363137 - DNA, 17 bp, Homo sapiens
ccagaggaatcctggca

SEQ ID NO: 2363138 - DNA, 20 bp, Homo sapiens
ccagaggaatcctggcagcc

SEQ ID NO: 2363139 - DNA, 13 bp, Homo sapiens
ccagaggagggca

SEQ ID NO: 2363140 - DNA, 21 bp, Homo sapiens
ccagaggagggcagagggaga

SEQ ID NO: 2363141 - DNA, 17 bp, Homo sapiens
ccagagggtgtggcttt

SEQ ID NO: 2363142 - DNA, 20 bp, Homo sapiens
ccagagggtgtggctttcca

SEQ ID NO: 2363143 - DNA, 17 bp, Homo sapiens
ccagaggtaacagaaca

SEQ ID NO: 2363144 - DNA, 22 bp, Homo sapiens
ccagaggtaacagaacagcttc

SEQ ID NO: 2363145 - DNA, 15 bp, Homo sapiens
ccagatcactgccac

SEQ ID NO: 2363146 - DNA, 20 bp, Homo sapiens
ccagatcactgccacactct

SEQ ID NO: 2363147 - DNA, 15 bp, Homo sapiens
ccagatctttctctt

SEQ ID NO: 2363148 - DNA, 13 bp, Homo sapiens
ccagatgtggcta

SEQ ID NO: 2363149 - DNA, 15 bp, Homo sapiens
ccagattcccctgtg

SEQ ID NO: 2363150 - DNA, 13 bp, Homo sapiens
ccagattctgatg

SEQ ID NO: 2363151 - DNA, 14 bp, Homo sapiens
ccagattctgcctc

SEQ ID NO: 2363152 - DNA, 16 bp, Homo sapiens
ccagattctgcctctc

SEQ ID NO: 2363153 - DNA, 19 bp, Homo sapiens
ccagattctgcctctctgg

SEQ ID NO: 2363154 - DNA, 14 bp, Homo sapiens
ccagcaacttcttc

SEQ ID NO: 2363155 - DNA, 21 bp, Homo sapiens
ccagcaattctctttctttta

SEQ ID NO: 2363156 - DNA, 17 bp, Homo sapiens
ccagcactttgggaggc

SEQ ID NO: 2363157 - DNA, 22 bp, Homo sapiens
ccagcagaggcaggctgggacg

SEQ ID NO: 2363158 - DNA, 18 bp, Homo sapiens
ccagcagcagcaggtgat

SEQ ID NO: 2363159 - DNA, 18 bp, Homo sapiens
ccagcagtgtggagaccc

SEQ ID NO: 2363160 - DNA, 14 bp, Homo sapiens
ccagcattccctac

SEQ ID NO: 2363161 - DNA, 16 bp, Homo sapiens
ccagccatgccagctg

SEQ ID NO: 2363162 - DNA, 17 bp, Homo sapiens
ccagccatgccagctgg

SEQ ID NO: 2363163 - DNA, 19 bp, Homo sapiens
ccagccccactcctctgct

SEQ ID NO: 2363164 - DNA, 16 bp, Homo sapiens
ccagccccactgccag

SEQ ID NO: 2363165 - DNA, 17 bp, Homo sapiens
ccagccccactgccagc

SEQ ID NO: 2363166 - DNA, 18 bp, Homo sapiens
ccagccccactgccagca

SEQ ID NO: 2363167 - DNA, 19 bp, Homo sapiens
ccagccccactgccagcag

SEQ ID NO: 2363168 - DNA, 23 bp, Homo sapiens
ccagccccatcagaacctgagct

SEQ ID NO: 2363169 - DNA, 15 bp, Homo sapiens
ccagcccctactgct

SEQ ID NO: 2363170 - DNA, 14 bp, Homo sapiens
ccagccctgcagcc

SEQ ID NO: 2363171 - DNA, 19 bp, Homo sapiens
ccagccctgctggggatcc

SEQ ID NO: 2363172 - DNA, 13 bp, Homo sapiens
ccagccggggcct

SEQ ID NO: 2363173 - DNA, 11 bp, Homo sapiens
ccagcctccct

SEQ ID NO: 2363174 - DNA, 18 bp, Homo sapiens
ccagcctccgagagggag

SEQ ID NO: 2363175 - DNA, 21 bp, Homo sapiens
ccagcctccgagagggagaga

SEQ ID NO: 2363176 - DNA, 16 bp, Homo sapiens
ccagcctcctctggac

SEQ ID NO: 2363177 - DNA, 18 bp, Homo sapiens
ccagcctgaacagaagct

SEQ ID NO: 2363178 - DNA, 13 bp, Homo sapiens
ccagcctgggcca

SEQ ID NO: 2363179 - DNA, 18 bp, Homo sapiens
ccagcctgggccatctct

SEQ ID NO: 2363180 - DNA, 14 bp, Homo sapiens
ccagcctgtcctgg

SEQ ID NO: 2363181 - DNA, 20 bp, Homo sapiens
ccagccttgagccctggctg

SEQ ID NO: 2363182 - DNA, 13 bp, Homo sapiens
ccagctaccacca

SEQ ID NO: 2363183 - DNA, 16 bp, Homo sapiens
ccagctacttgggagg

SEQ ID NO: 2363184 - DNA, 20 bp, Homo sapiens
ccagctgccctatgggcctg

SEQ ID NO: 2363185 - DNA, 16 bp, Homo sapiens
ccagctggcctttgta

SEQ ID NO: 2363186 - DNA, 19 bp, Homo sapiens
ccagctgggccgggaccca

SEQ ID NO: 2363187 - DNA, 12 bp, Homo sapiens
ccagctggggcc

SEQ ID NO: 2363188 - DNA, 17 bp, Homo sapiens
ccagctggggccagagg

SEQ ID NO: 2363189 - DNA, 22 bp, Homo sapiens
ccagcttagcaactgctgggga

SEQ ID NO: 2363190 - DNA, 13 bp, Homo sapiens
ccagcttccaaag

SEQ ID NO: 2363191 - DNA, 19 bp, Homo sapiens
ccgcctgagtcagtgctct

SEQ ID NO: 2363192 - DNA, 22 bp, Homo sapiens
ccgcctgagtcagtgctctcag

SEQ ID NO: 2363193 - DNA, 15 bp, Homo sapiens
ccgcctggccaggag

SEQ ID NO: 2363194 - DNA, 18 bp, Homo sapiens
ccgcgaccatgtggccac

SEQ ID NO: 2363195 - DNA, 17 bp, Homo sapiens
ccgcgccgatgccaccg

SEQ ID NO: 2363196 - DNA, 21 bp, Homo sapiens
ccgcgctccgggctttcacgg

SEQ ID NO: 2363197 - DNA, 20 bp, Homo sapiens
ccgcggtaggtaagggccgc

SEQ ID NO: 2363198 - DNA, 13 bp, Homo sapiens
ccgcgtagagagc

SEQ ID NO: 2363199 - DNA, 13 bp, Homo sapiens
ccgctgccagcct

SEQ ID NO: 2363200 - DNA, 23 bp, Homo sapiens
ccgcttggagctattttccaggc

SEQ ID NO: 2363201 - DNA, 13 bp, Homo sapiens
ccggactggtgcc

SEQ ID NO: 2363202 - DNA, 22 bp, Homo sapiens
ccggagtgtctggaattgtggc

SEQ ID NO: 2363203 - DNA, 16 bp, Homo sapiens
ccggatctgagggaga

SEQ ID NO: 2363204 - DNA, 17 bp, Homo sapiens
ccggatttctaacagtc

SEQ ID NO: 2363205 - DNA, 12 bp, Homo sapiens
ccggcccagatg

SEQ ID NO: 2363206 - DNA, 14 bp, Homo sapiens
ccggcccagatgtg

SEQ ID NO: 2363207 - DNA, 23 bp, Homo sapiens
ccgggcccctgggcttggcctgc

SEQ ID NO: 2363208 - DNA, 14 bp, Homo sapiens
ccgggcgcggtggc

SEQ ID NO: 2363209 - DNA, 18 bp, Homo sapiens
ccgggctgagggcctgct

SEQ ID NO: 2363210 - DNA, 15 bp, Homo sapiens
ccggggaccctgtga

SEQ ID NO: 2363211 - DNA, 14 bp, Homo sapiens
ccggtggctgggca

SEQ ID NO: 2363212 - DNA, 16 bp, Homo sapiens
ccggtggctgggcaga

SEQ ID NO: 2363213 - DNA, 13 bp, Homo sapiens
ccgtatctccctg

SEQ ID NO: 2363214 - DNA, 17 bp, Homo sapiens
ccgtatctccctggaga

SEQ ID NO: 2363215 - DNA, 19 bp, Homo sapiens
ccgtctttcttttatactg

SEQ ID NO: 2363216 - DNA, 16 bp, Homo sapiens
ccgtgatttggaagag

SEQ ID NO: 2363217 - DNA, 19 bp, Homo sapiens
ccgtggactggctcatgcc

SEQ ID NO: 2363218 - DNA, 16 bp, Homo sapiens
ccgtggaggaggaagg

SEQ ID NO: 2363219 - DNA, 15 bp, Homo sapiens
ccgtggtatgtctgc

SEQ ID NO: 2363220 - DNA, 18 bp, Homo sapiens
ccgtggtatgtctgccat

SEQ ID NO: 2363221 - DNA, 13 bp, Homo sapiens
ccgtggtccctga

SEQ ID NO: 2363222 - DNA, 14 bp, Homo sapiens
ccgtggtccctgag

SEQ ID NO: 2363223 - DNA, 23 bp, Homo sapiens
ccgtgtcaagctgctctgagcca

SEQ ID NO: 2363224 - DNA, 16 bp, Homo sapiens
ccgtgtctgtctggca

SEQ ID NO: 2363225 - DNA, 19 bp, Homo sapiens
ccgtgtgtcccagatgctg

SEQ ID NO: 2363226 - DNA, 17 bp, Homo sapiens
ccgttccaccccaagag

SEQ ID NO: 2363227 - DNA, 22 bp, Homo sapiens
ccgttccaccccaagagaactc

SEQ ID NO: 2363228 - DNA, 23 bp, Homo sapiens
cctaaaataacagtatgtgggat

SEQ ID NO: 2363229 - DNA, 15 bp, Homo sapiens
cctaaccccttccag

SEQ ID NO: 2363230 - DNA, 18 bp, Homo sapiens
cctaaccccttccagatc

SEQ ID NO: 2363231 - DNA, 18 bp, Homo sapiens
cctaatgtttatgagcca

SEQ ID NO: 2363232 - DNA, 21 bp, Homo sapiens
cctaattcctggcatgacact

SEQ ID NO: 2363233 - DNA, 18 bp, Homo sapiens
cctaatttctcctccctt

SEQ ID NO: 2363234 - DNA, 19 bp, Homo sapiens
cctacagcctagggcagac

SEQ ID NO: 2363235 - DNA, 21 bp, Homo sapiens
cctacatatgctgatctttta

SEQ ID NO: 2363236 - DNA, 12 bp, Homo sapiens
cctactaataaa

SEQ ID NO: 2363237 - DNA, 16 bp, Homo sapiens
cctactaataaaccag

SEQ ID NO: 2363238 - DNA, 15 bp, Homo sapiens
cctactccctgcaga

SEQ ID NO: 2363239 - DNA, 18 bp, Homo sapiens
cctactcggctctgcagt

SEQ ID NO: 2363240 - DNA, 16 bp, Homo sapiens
cctactgaagtggctg

SEQ ID NO: 2363241 - DNA, 16 bp, Homo sapiens
cctactggtctctcta

SEQ ID NO: 2363242 - DNA, 17 bp, Homo sapiens
cctacttagggaagaaa

SEQ ID NO: 2363243 - DNA, 21 bp, Homo sapiens
cctagaacactaactcaccag

SEQ ID NO: 2363244 - DNA, 16 bp, Homo sapiens
cctagacaacctttct

SEQ ID NO: 2363245 - DNA, 18 bp, Homo sapiens
cctagacaacctttctgt

SEQ ID NO: 2363246 - DNA, 16 bp, Homo sapiens
cctagcacagcagctt

SEQ ID NO: 2363247 - DNA, 12 bp, Homo sapiens
cctagcccttcc

SEQ ID NO: 2363248 - DNA, 15 bp, Homo sapiens
cctagcccttccctg

SEQ ID NO: 2363249 - DNA, 18 bp, Homo sapiens
cctagcccttccctgagt

SEQ ID NO: 2363250 - DNA, 17 bp, Homo sapiens
cctagcgatctctcctg

SEQ ID NO: 2363251 - DNA, 15 bp, Homo sapiens
cctagctaattattt

SEQ ID NO: 2363252 - DNA, 13 bp, Homo sapiens
cctagctggctct

SEQ ID NO: 2363253 - DNA, 15 bp, Homo sapiens
cctagctggctctgt

SEQ ID NO: 2363254 - DNA, 13 bp, Homo sapiens
cctagctgtcctt

SEQ ID NO: 2363255 - DNA, 22 bp, Homo sapiens
cctagctgtcctttttcctctc

SEQ ID NO: 2363256 - DNA, 20 bp, Homo sapiens
cctagctttagaccctgggt

SEQ ID NO: 2363257 - DNA, 23 bp, Homo sapiens
cctagctttagaccctgggtggg

SEQ ID NO: 2363258 - DNA, 19 bp, Homo sapiens
cctagttaaagaaaggaaa

SEQ ID NO: 2363259 - DNA, 13 bp, Homo sapiens
cctagttttccat

SEQ ID NO: 2363260 - DNA, 17 bp, Homo sapiens
cctatagcactgagctc

SEQ ID NO: 2363261 - DNA, 20 bp, Homo sapiens
cctatcagagttgctgcaaa

SEQ ID NO: 2363262 - DNA, 15 bp, Homo sapiens
cctatccgctgccag

SEQ ID NO: 2363263 - DNA, 13 bp, Homo sapiens
cctatctcctgac

SEQ ID NO: 2363264 - DNA, 17 bp, Homo sapiens
cctatgcttaataaaag

SEQ ID NO: 2363265 - DNA, 16 bp, Homo sapiens
cctattatcccagctg

SEQ ID NO: 2363266 - DNA, 18 bp, Homo sapiens
cctattatcccagctgcc

SEQ ID NO: 2363267 - DNA, 19 bp, Homo sapiens
cctatttcagtgttacctg

SEQ ID NO: 2363268 - DNA, 23 bp, Homo sapiens
cctatttttttagattgagaaat

SEQ ID NO: 2363269 - DNA, 17 bp, Homo sapiens
cctcaaagggcagtttt

SEQ ID NO: 2363270 - DNA, 15 bp, Homo sapiens
cctcaaattttttga

SEQ ID NO: 2363271 - DNA, 16 bp, Homo sapiens
cctcaaattttttgac

SEQ ID NO: 2363272 - DNA, 14 bp, Homo sapiens
cctcaactgcctac

SEQ ID NO: 2363273 - DNA, 20 bp, Homo sapiens
cctcaagcaatccacctgcc

SEQ ID NO: 2363274 - DNA, 22 bp, Homo sapiens
cctcaagcaatccacctgcctt

SEQ ID NO: 2363275 - DNA, 15 bp, Homo sapiens
cctcaagtgtcctga

SEQ ID NO: 2363276 - DNA, 16 bp, Homo sapiens
cctcacctcatgccca

SEQ ID NO: 2363277 - DNA, 12 bp, Homo sapiens
cctcaccttcct

SEQ ID NO: 2363278 - DNA, 13 bp, Homo sapiens
cctcaccttcctg

SEQ ID NO: 2363279 - DNA, 16 bp, Homo sapiens
cctcaccttggggcct

SEQ ID NO: 2363280 - DNA, 20 bp, Homo sapiens
cctcaccttggggccttgat

SEQ ID NO: 2363281 - DNA, 15 bp, Homo sapiens
cctcacgcccttcaa

SEQ ID NO: 2363282 - DNA, 14 bp, Homo sapiens
cctcacgctctgga

SEQ ID NO: 2363283 - DNA, 16 bp, Homo sapiens
cctcacgctctggaca

SEQ ID NO: 2363284 - DNA, 13 bp, Homo sapiens
cctcactggctct

SEQ ID NO: 2363285 - DNA, 16 bp, Homo sapiens
cctcactggctctcct

SEQ ID NO: 2363286 - DNA, 23 bp, Homo sapiens
cctcagagcgccaggaagccaga

SEQ ID NO: 2363287 - DNA, 13 bp, Homo sapiens
cctcagccttcca

SEQ ID NO: 2363288 - DNA, 18 bp, Homo sapiens
cctcagggctgtcccagc

SEQ ID NO: 2363289 - DNA, 21 bp, Homo sapiens
cctcagggctgtcccagcccc

SEQ ID NO: 2363290 - DNA, 18 bp, Homo sapiens
cctcagtatgtgggggct

SEQ ID NO: 2363291 - DNA, 13 bp, Homo sapiens
cctcagtgcccca

SEQ ID NO: 2363292 - DNA, 15 bp, Homo sapiens
cctcagttccttcat

SEQ ID NO: 2363293 - DNA, 18 bp, Homo sapiens
cctcagttttccttctgt

SEQ ID NO: 2363294 - DNA, 22 bp, Homo sapiens
cctcatactcctgggctcaagc

SEQ ID NO: 2363295 - DNA, 20 bp, Homo sapiens
cctcatgcccaccccctgcc

SEQ ID NO: 2363296 - DNA, 22 bp, Homo sapiens
cctcatgcccaccccctgccct

SEQ ID NO: 2363297 - DNA, 23 bp, Homo sapiens
cctcatgcccaccccctgccctg

SEQ ID NO: 2363298 - DNA, 13 bp, Homo sapiens
cctcatgcccagc

SEQ ID NO: 2363299 - DNA, 19 bp, Homo sapiens
cctcatgcccagctctctg

SEQ ID NO: 2363300 - DNA, 23 bp, Homo sapiens
cctcatgggaagtcctggcacag

SEQ ID NO: 2363301 - DNA, 15 bp, Homo sapiens
cctcatgggtcctag

SEQ ID NO: 2363302 - DNA, 20 bp, Homo sapiens
cctccaaatggagaagctgc

SEQ ID NO: 2363303 - DNA, 21 bp, Homo sapiens
cctccaaatggagaagctgca

SEQ ID NO: 2363304 - DNA, 14 bp, Homo sapiens
cctccaagcacaga

SEQ ID NO: 2363305 - DNA, 17 bp, Homo sapiens
cctccaagcatttcatg

SEQ ID NO: 2363306 - DNA, 18 bp, Homo sapiens
cctgggacttccatgcct

SEQ ID NO: 2363307 - DNA, 13 bp, Homo sapiens
cctgggcactccg

SEQ ID NO: 2363308 - DNA, 21 bp, Homo sapiens
cctgggccagcggggctgctc

SEQ ID NO: 2363309 - DNA, 14 bp, Homo sapiens
cctgggctgccacc

SEQ ID NO: 2363310 - DNA, 17 bp, Homo sapiens
cctgggctgccaccagc

SEQ ID NO: 2363311 - DNA, 14 bp, Homo sapiens
cctgggcttggcct

SEQ ID NO: 2363312 - DNA, 15 bp, Homo sapiens
cctgggcttggcctg

SEQ ID NO: 2363313 - DNA, 21 bp, Homo sapiens
cctgggcttggcctgctgtga

SEQ ID NO: 2363314 - DNA, 17 bp, Homo sapiens
cctggggcccagcccct

SEQ ID NO: 2363315 - DNA, 17 bp, Homo sapiens
cctggggcctgactgct

SEQ ID NO: 2363316 - DNA, 13 bp, Homo sapiens
cctgggggacctt

SEQ ID NO: 2363317 - DNA, 13 bp, Homo sapiens
cctggggggcagg

SEQ ID NO: 2363318 - DNA, 14 bp, Homo sapiens
cctgggttgctgct

SEQ ID NO: 2363319 - DNA, 13 bp, Homo sapiens
cctggtgactcct

SEQ ID NO: 2363320 - DNA, 17 bp, Homo sapiens
cctggtgaggcccagcc

SEQ ID NO: 2363321 - DNA, 18 bp, Homo sapiens
cctggtgaggcccagcct

SEQ ID NO: 2363322 - DNA, 23 bp, Homo sapiens
cctggttattgatgtggccctgg

SEQ ID NO: 2363323 - DNA, 12 bp, Homo sapiens
cctgtaaacctg

SEQ ID NO: 2363324 - DNA, 13 bp, Homo sapiens
cctgtaaacctga

SEQ ID NO: 2363325 - DNA, 21 bp, Homo sapiens
cctgtagttgcgtggactctg

SEQ ID NO: 2363326 - DNA, 14 bp, Homo sapiens
cctgtatacagtgc

SEQ ID NO: 2363327 - DNA, 16 bp, Homo sapiens
cctgtatacagtgcag

SEQ ID NO: 2363328 - DNA, 16 bp, Homo sapiens
cctgtccaggtagaaa

SEQ ID NO: 2363329 - DNA, 16 bp, Homo sapiens
cctgtcccaggccggc

SEQ ID NO: 2363330 - DNA, 20 bp, Homo sapiens
cctgtcccaggccggcccag

SEQ ID NO: 2363331 - DNA, 14 bp, Homo sapiens
cctgtccctgaggt

SEQ ID NO: 2363332 - DNA, 19 bp, Homo sapiens
cctgtccctgtagctcagt

SEQ ID NO: 2363333 - DNA, 21 bp, Homo sapiens
cctgtccctgtagctcagtca

SEQ ID NO: 2363334 - DNA, 16 bp, Homo sapiens
cctgtcctggtacagc

SEQ ID NO: 2363335 - DNA, 20 bp, Homo sapiens
cctgtcctggtacagcaggg

SEQ ID NO: 2363336 - DNA, 21 bp, Homo sapiens
cctgtcctggtacagcagggt

SEQ ID NO: 2363337 - DNA, 13 bp, Homo sapiens
cctgtctctgccc

SEQ ID NO: 2363338 - DNA, 19 bp, Homo sapiens
cctgtctgccccagcccag

SEQ ID NO: 2363339 - DNA, 20 bp, Homo sapiens
cctgtctgccccagcccaga

SEQ ID NO: 2363340 - DNA, 18 bp, Homo sapiens
cctgtgacatggtgcctg

SEQ ID NO: 2363341 - DNA, 22 bp, Homo sapiens
cctgtgcacaccccactcccac

SEQ ID NO: 2363342 - DNA, 17 bp, Homo sapiens
cctgtgcatgtatgtct

SEQ ID NO: 2363343 - DNA, 18 bp, Homo sapiens
cctgtggcataaattgca

SEQ ID NO: 2363344 - DNA, 21 bp, Homo sapiens
cctgtggggcctgatggtgct

SEQ ID NO: 2363345 - DNA, 19 bp, Homo sapiens
cctgtgggtctctgaaggg

SEQ ID NO: 2363346 - DNA, 20 bp, Homo sapiens
cctgtgggtgttctttcctg

SEQ ID NO: 2363347 - DNA, 17 bp, Homo sapiens
cctgtgtgtgtcccctc

SEQ ID NO: 2363348 - DNA, 23 bp, Homo sapiens
cctgttagacgtcctccgtccat

SEQ ID NO: 2363349 - DNA, 17 bp, Homo sapiens
cctgtttaaataaaatt

SEQ ID NO: 2363350 - DNA, 15 bp, Homo sapiens
ccttaaaaccaaaga

SEQ ID NO: 2363351 - DNA, 17 bp, Homo sapiens
ccttaaaaccaaagagg

SEQ ID NO: 2363352 - DNA, 16 bp, Homo sapiens
ccttaactgcatccag

SEQ ID NO: 2363353 - DNA, 13 bp, Homo sapiens
ccttaattattgc

SEQ ID NO: 2363354 - DNA, 13 bp, Homo sapiens
ccttaatttcctt

SEQ ID NO: 2363355 - DNA, 18 bp, Homo sapiens
ccttaatttcctttttga

SEQ ID NO: 2363356 - DNA, 23 bp, Homo sapiens
ccttaatttcctttttgacactg

SEQ ID NO: 2363357 - DNA, 22 bp, Homo sapiens
ccttacaagttagaaaacataa

SEQ ID NO: 2363358 - DNA, 14 bp, Homo sapiens
ccttacctttttat

SEQ ID NO: 2363359 - DNA, 16 bp, Homo sapiens
ccttactcttcttgaa

SEQ ID NO: 2363360 - DNA, 13 bp, Homo sapiens
ccttactggctta

SEQ ID NO: 2363361 - DNA, 14 bp, Homo sapiens
ccttagagaccccg

SEQ ID NO: 2363362 - DNA, 17 bp, Homo sapiens
ccttagaggtcctctgg

SEQ ID NO: 2363363 - DNA, 19 bp, Homo sapiens
ccttagaggtcctctggag

SEQ ID NO: 2363364 - DNA, 20 bp, Homo sapiens
ccttaggggtaattggtaat

SEQ ID NO: 2363365 - DNA, 17 bp, Homo sapiens
ccttatagtctaagact

SEQ ID NO: 2363366 - DNA, 14 bp, Homo sapiens
ccttattgcctccc

SEQ ID NO: 2363367 - DNA, 16 bp, Homo sapiens
ccttcatcttcctgtg

SEQ ID NO: 2363368 - DNA, 20 bp, Homo sapiens
ccttcatcttcctgtgtcct

SEQ ID NO: 2363369 - DNA, 21 bp, Homo sapiens
ccttccaactagctgggacta

SEQ ID NO: 2363370 - DNA, 21 bp, Homo sapiens
ccttccagggatttgcctcac

SEQ ID NO: 2363371 - DNA, 23 bp, Homo sapiens
ccttccatccatctttccatcca

SEQ ID NO: 2363372 - DNA, 12 bp, Homo sapiens
ccttccctagct

SEQ ID NO: 2363373 - DNA, 11 bp, Homo sapiens
ccttccctctg

SEQ ID NO: 2363374 - DNA, 14 bp, Homo sapiens
ccttcctgtccctg

SEQ ID NO: 2363375 - DNA, 19 bp, Homo sapiens
ccttcctgtccctgaggtt

SEQ ID NO: 2363376 - DNA, 19 bp, Homo sapiens
ccttcctgtttttcacatt

SEQ ID NO: 2363377 - DNA, 13 bp, Homo sapiens
ccttccttttccc

SEQ ID NO: 2363378 - DNA, 23 bp, Homo sapiens
ccttccttttccctgcttccagg

SEQ ID NO: 2363379 - DNA, 15 bp, Homo sapiens
ccttctcagaagcac

SEQ ID NO: 2363380 - DNA, 20 bp, Homo sapiens
ccttctcccactctcctagg

SEQ ID NO: 2363381 - DNA, 17 bp, Homo sapiens
ccttctccctagctcct

SEQ ID NO: 2363382 - DNA, 20 bp, Homo sapiens
ccttctctacactcttgtaa

SEQ ID NO: 2363383 - DNA, 16 bp, Homo sapiens
ccttctctcctcccca

SEQ ID NO: 2363384 - DNA, 14 bp, Homo sapiens
ccttctgagctcct

SEQ ID NO: 2363385 - DNA, 22 bp, Homo sapiens
ccttctgagctcctgtcccctg

SEQ ID NO: 2363386 - DNA, 16 bp, Homo sapiens
ccttctggaaactgtg

SEQ ID NO: 2363387 - DNA, 13 bp, Homo sapiens
ccttctttgataa

SEQ ID NO: 2363388 - DNA, 18 bp, Homo sapiens
ccttctttgataatgtta

SEQ ID NO: 2363389 - DNA, 19 bp, Homo sapiens
ccttctttgataatgttaa

SEQ ID NO: 2363390 - DNA, 15 bp, Homo sapiens
ccttgaatctgcagg

SEQ ID NO: 2363391 - DNA, 19 bp, Homo sapiens
ccttgaatctgcagggagc

SEQ ID NO: 2363392 - DNA, 16 bp, Homo sapiens
ccttgagaccacaggg

SEQ ID NO: 2363393 - DNA, 13 bp, Homo sapiens
ccttgagggctgc

SEQ ID NO: 2363394 - DNA, 13 bp, Homo sapiens
ccttgatgactgc

SEQ ID NO: 2363395 - DNA, 17 bp, Homo sapiens
ccttgatgactgccttg

SEQ ID NO: 2363396 - DNA, 17 bp, Homo sapiens
ccttgcacagctggaga

SEQ ID NO: 2363397 - DNA, 19 bp, Homo sapiens
ccttgcacagctggagaaa

SEQ ID NO: 2363398 - DNA, 17 bp, Homo sapiens
ccttgccagggcagggt

SEQ ID NO: 2363399 - DNA, 22 bp, Homo sapiens
ccttgcctccccatttcccatc

SEQ ID NO: 2363400 - DNA, 15 bp, Homo sapiens
ccttgcctcctcagt

SEQ ID NO: 2363401 - DNA, 20 bp, Homo sapiens
ccttgcctttcgaggcctga

SEQ ID NO: 2363402 - DNA, 15 bp, Homo sapiens
ccttgcgcctcagcc

SEQ ID NO: 2363403 - DNA, 20 bp, Homo sapiens
ccttgcgcctcagccctcag

SEQ ID NO: 2363404 - DNA, 21 bp, Homo sapiens
ccttgcgcctcagccctcagt

SEQ ID NO: 2363405 - DNA, 12 bp, Homo sapiens
ccttgctacctc

SEQ ID NO: 2363406 - DNA, 17 bp, Homo sapiens
ccttgctacctcaaggg

SEQ ID NO: 2363407 - DNA, 15 bp, Homo sapiens
ccttgctggccccag

SEQ ID NO: 2363408 - DNA, 17 bp, Homo sapiens
ccttgctggccccagcc

SEQ ID NO: 2363409 - DNA, 21 bp, Homo sapiens
ccttgctggccccagccctgc

SEQ ID NO: 2363410 - DNA, 21 bp, Homo sapiens
ccttgctgtttgtcctgagat

SEQ ID NO: 2363411 - DNA, 11 bp, Homo sapiens
ccttggaaatg

SEQ ID NO: 2363412 - DNA, 22 bp, Homo sapiens
ccttggaaccagccccatcaga

SEQ ID NO: 2363413 - DNA, 11 bp, Homo sapiens
ccttggaaggg

SEQ ID NO: 2363414 - DNA, 22 bp, Homo sapiens
ccttggaccactcctgtccctg

SEQ ID NO: 2363415 - DNA, 23 bp, Homo sapiens
ccttggaccactcctgtccctgt

SEQ ID NO: 2363416 - DNA, 19 bp, Homo sapiens
ccttggagagcagctggct

SEQ ID NO: 2363417 - DNA, 21 bp, Homo sapiens
ccttggagagcagctggctct

SEQ ID NO: 2363418 - DNA, 17 bp, Homo sapiens
ccttggcttctgtgatg

SEQ ID NO: 2363419 - DNA, 15 bp, Homo sapiens
ccttgggctctgatg

SEQ ID NO: 2363420 - DNA, 14 bp, Homo sapiens
ccttgggtggcccc

SEQ ID NO: 2363421 - DNA, 20 bp, Homo sapiens
ctatgcttaataaaagaaca

SEQ ID NO: 2363422 - DNA, 22 bp, Homo sapiens
ctatgggaaaaatctaaaatgt

SEQ ID NO: 2363423 - DNA, 19 bp, Homo sapiens
ctatgggcctgccgggctg

SEQ ID NO: 2363424 - DNA, 23 bp, Homo sapiens
ctatgggcctgccgggctgaggg

SEQ ID NO: 2363425 - DNA, 14 bp, Homo sapiens
ctatggtgaggtgt

SEQ ID NO: 2363426 - DNA, 22 bp, Homo sapiens
ctatgtagctgaaaataaaatg

SEQ ID NO: 2363427 - DNA, 23 bp, Homo sapiens
ctattaatatcaactctgaagct

SEQ ID NO: 2363428 - DNA, 12 bp, Homo sapiens
ctattatcacat

SEQ ID NO: 2363429 - DNA, 16 bp, Homo sapiens
ctattatggaaaactg

SEQ ID NO: 2363430 - DNA, 19 bp, Homo sapiens
ctattatttttataattgt

SEQ ID NO: 2363431 - DNA, 21 bp, Homo sapiens
ctattcaagaagatagttgta

SEQ ID NO: 2363432 - DNA, 14 bp, Homo sapiens
ctattcatggctac

SEQ ID NO: 2363433 - DNA, 20 bp, Homo sapiens
ctattgtaatcgtgtgccat

SEQ ID NO: 2363434 - DNA, 21 bp, Homo sapiens
ctattgtaatcgtgtgccatg

SEQ ID NO: 2363435 - DNA, 17 bp, Homo sapiens
ctatttaacaagatgtt

SEQ ID NO: 2363436 - DNA, 13 bp, Homo sapiens
ctatttaacattt

SEQ ID NO: 2363437 - DNA, 16 bp, Homo sapiens
ctatttaacattttac

SEQ ID NO: 2363438 - DNA, 20 bp, Homo sapiens
ctatttaagtggactgtatt

SEQ ID NO: 2363439 - DNA, 16 bp, Homo sapiens
ctatttattttcctaa

SEQ ID NO: 2363440 - DNA, 16 bp, Homo sapiens
ctatttgcaccttaaa

SEQ ID NO: 2363441 - DNA, 20 bp, Homo sapiens
ctatttgtgtaactgaaagg

SEQ ID NO: 2363442 - DNA, 12 bp, Homo sapiens
ctattttcataa

SEQ ID NO: 2363443 - DNA, 15 bp, Homo sapiens
ctattttcctctggc

SEQ ID NO: 2363444 - DNA, 12 bp, Homo sapiens
ctatttttgtac

SEQ ID NO: 2363445 - DNA, 14 bp, Homo sapiens
ctatttttttcaaa

SEQ ID NO: 2363446 - DNA, 19 bp, Homo sapiens
ctcaaaaaaaaaaagaaaa

SEQ ID NO: 2363447 - DNA, 22 bp, Homo sapiens
ctcaaaaaaacaaaaaagactt

SEQ ID NO: 2363448 - DNA, 14 bp, Homo sapiens
ctcaaaaagaaatc

SEQ ID NO: 2363449 - DNA, 20 bp, Homo sapiens
ctcaaaagagaaaaacaaaa

SEQ ID NO: 2363450 - DNA, 16 bp, Homo sapiens
ctcaaaagttttttct

SEQ ID NO: 2363451 - DNA, 19 bp, Homo sapiens
ctcaaagtatgcaatgctt

SEQ ID NO: 2363452 - DNA, 14 bp, Homo sapiens
ctcaaagttttgaa

SEQ ID NO: 2363453 - DNA, 17 bp, Homo sapiens
ctcaaagttttgaaaag

SEQ ID NO: 2363454 - DNA, 19 bp, Homo sapiens
ctcaaagttttgaaaagct

SEQ ID NO: 2363455 - DNA, 21 bp, Homo sapiens
ctcaaagttttgaaaagctat

SEQ ID NO: 2363456 - DNA, 23 bp, Homo sapiens
ctcaaagttttgaaaagctatta

SEQ ID NO: 2363457 - DNA, 15 bp, Homo sapiens
ctcaaatacacattt

SEQ ID NO: 2363458 - DNA, 20 bp, Homo sapiens
ctcaaataggtcatcatgaa

SEQ ID NO: 2363459 - DNA, 22 bp, Homo sapiens
ctcaaatgcggggtgggggcag

SEQ ID NO: 2363460 - DNA, 13 bp, Homo sapiens
ctcaaattttttg

SEQ ID NO: 2363461 - DNA, 14 bp, Homo sapiens
ctcaagacaaggct

SEQ ID NO: 2363462 - DNA, 22 bp, Homo sapiens
ctcaagacccccatttgtccca

SEQ ID NO: 2363463 - DNA, 20 bp, Homo sapiens
ctcaagatgggggcagggct

SEQ ID NO: 2363464 - DNA, 23 bp, Homo sapiens
ctcaagcaatccacctgccttgg

SEQ ID NO: 2363465 - DNA, 16 bp, Homo sapiens
ctcaagcaatcctcct

SEQ ID NO: 2363466 - DNA, 20 bp, Homo sapiens
ctcaagcaatcctcctgcct

SEQ ID NO: 2363467 - DNA, 23 bp, Homo sapiens
ctcaagcaatcctcctgcctcag

SEQ ID NO: 2363468 - DNA, 19 bp, Homo sapiens
ctcaagctagtgtttctag

SEQ ID NO: 2363469 - DNA, 20 bp, Homo sapiens
ctcaatcctaatttctcctc

SEQ ID NO: 2363470 - DNA, 22 bp, Homo sapiens
ctcaatcctaatttctcctccc

SEQ ID NO: 2363471 - DNA, 18 bp, Homo sapiens
ctcacactcccctagggg

SEQ ID NO: 2363472 - DNA, 13 bp, Homo sapiens
ctcacatgggact

SEQ ID NO: 2363473 - DNA, 14 bp, Homo sapiens
ctcacatgggactg

SEQ ID NO: 2363474 - DNA, 19 bp, Homo sapiens
ctcacatgggactgggata

SEQ ID NO: 2363475 - DNA, 19 bp, Homo sapiens
ctcaccagccccactgcca

SEQ ID NO: 2363476 - DNA, 21 bp, Homo sapiens
ctcaccagccccactgccagc

SEQ ID NO: 2363477 - DNA, 23 bp, Homo sapiens
ctcaccagccccactgccagcag

SEQ ID NO: 2363478 - DNA, 17 bp, Homo sapiens
ctcaccagccctgcagc

SEQ ID NO: 2363479 - DNA, 19 bp, Homo sapiens
ctcaccatgatgtgaagag

SEQ ID NO: 2363480 - DNA, 16 bp, Homo sapiens
ctcaccgcccatcagg

SEQ ID NO: 2363481 - DNA, 16 bp, Homo sapiens
ctcaccgctggccctt

SEQ ID NO: 2363482 - DNA, 19 bp, Homo sapiens
ctcaccgctggcccttaga

SEQ ID NO: 2363483 - DNA, 15 bp, Homo sapiens
ctcacctcatgccca

SEQ ID NO: 2363484 - DNA, 22 bp, Homo sapiens
ctcacctctaggtccccatact

SEQ ID NO: 2363485 - DNA, 15 bp, Homo sapiens
ctcaccttggggcct

SEQ ID NO: 2363486 - DNA, 18 bp, Homo sapiens
ctcaccttggggccttga

SEQ ID NO: 2363487 - DNA, 21 bp, Homo sapiens
ctcacgcctgtaatcccagca

SEQ ID NO: 2363488 - DNA, 15 bp, Homo sapiens
ctcacgctctggaca

SEQ ID NO: 2363489 - DNA, 14 bp, Homo sapiens
ctcactattcttgg

SEQ ID NO: 2363490 - DNA, 19 bp, Homo sapiens
ctcactattcttggaccat

SEQ ID NO: 2363491 - DNA, 18 bp, Homo sapiens
ctcactccccacatccca

SEQ ID NO: 2363492 - DNA, 19 bp, Homo sapiens
ctcactgccaggccagcct

SEQ ID NO: 2363493 - DNA, 22 bp, Homo sapiens
ctcactgccaggccagcctccg

SEQ ID NO: 2363494 - DNA, 16 bp, Homo sapiens
ctcactgcttgaacta

SEQ ID NO: 2363495 - DNA, 15 bp, Homo sapiens
ctcactggctctcct

SEQ ID NO: 2363496 - DNA, 19 bp, Homo sapiens
ctcactggctctcctggcc

SEQ ID NO: 2363497 - DNA, 22 bp, Homo sapiens
ctcactgtgatcaatattttta

SEQ ID NO: 2363498 - DNA, 19 bp, Homo sapiens
ctcactttactttcaagta

SEQ ID NO: 2363499 - DNA, 16 bp, Homo sapiens
ctcacttttcccactc

SEQ ID NO: 2363500 - DNA, 21 bp, Homo sapiens
ctcacttttcccactccaagc

SEQ ID NO: 2363501 - DNA, 22 bp, Homo sapiens
ctcagaaagatttgatgggcca

SEQ ID NO: 2363502 - DNA, 14 bp, Homo sapiens
ctcagaaagggatt

SEQ ID NO: 2363503 - DNA, 14 bp, Homo sapiens
ctcagaacatactg

SEQ ID NO: 2363504 - DNA, 16 bp, Homo sapiens
ctcagaacatactgat

SEQ ID NO: 2363505 - DNA, 17 bp, Homo sapiens
ctcagaacatactgatt

SEQ ID NO: 2363506 - DNA, 14 bp, Homo sapiens
ctcagaacttgctg

SEQ ID NO: 2363507 - DNA, 17 bp, Homo sapiens
ctcagaacttgctgctg

SEQ ID NO: 2363508 - DNA, 19 bp, Homo sapiens
ctcagaacttgctgctgtc

SEQ ID NO: 2363509 - DNA, 20 bp, Homo sapiens
ctcagaacttgctgctgtct

SEQ ID NO: 2363510 - DNA, 23 bp, Homo sapiens
ctcagaacttgctgctgtcttgt

SEQ ID NO: 2363511 - DNA, 22 bp, Homo sapiens
ctcagacgttgcctgagaagaa

SEQ ID NO: 2363512 - DNA, 23 bp, Homo sapiens
ctcagagaaaaatgctccccaca

SEQ ID NO: 2363513 - DNA, 19 bp, Homo sapiens
ctcagagcgccaggaagcc

SEQ ID NO: 2363514 - DNA, 21 bp, Homo sapiens
ctcagagcggatgggcacaca

SEQ ID NO: 2363515 - DNA, 16 bp, Homo sapiens
ctcagatttctgagga

SEQ ID NO: 2363516 - DNA, 17 bp, Homo sapiens
ctcagcaattcagaccc

SEQ ID NO: 2363517 - DNA, 14 bp, Homo sapiens
ctcagctcaatgca

SEQ ID NO: 2363518 - DNA, 13 bp, Homo sapiens
ctcagctttgaga

SEQ ID NO: 2363519 - DNA, 16 bp, Homo sapiens
ctcaggagcctctgct

SEQ ID NO: 2363520 - DNA, 14 bp, Homo sapiens
ctcaggagcttggg

SEQ ID NO: 2363521 - DNA, 19 bp, Homo sapiens
ctcaggaggcgcccttggc

SEQ ID NO: 2363522 - DNA, 16 bp, Homo sapiens
ctcaggcagcaccaca

SEQ ID NO: 2363523 - DNA, 21 bp, Homo sapiens
ctcaggcagcaccacactggg

SEQ ID NO: 2363524 - DNA, 16 bp, Homo sapiens
ctcaggccaccacaga

SEQ ID NO: 2363525 - DNA, 18 bp, Homo sapiens
ctcaggccaccacagagg

SEQ ID NO: 2363526 - DNA, 19 bp, Homo sapiens
ctcagggctgtcccagccc

SEQ ID NO: 2363527 - DNA, 15 bp, Homo sapiens
ctcaggtagtactgg

SEQ ID NO: 2363528 - DNA, 13 bp, Homo sapiens
ctcaggtgcctta

SEQ ID NO: 2363529 - DNA, 20 bp, Homo sapiens
ctcagtaaacgggaacatgc

SEQ ID NO: 2363530 - DNA, 17 bp, Homo sapiens
ctcagtatgtgggggct

SEQ ID NO: 2363531 - DNA, 19 bp, Homo sapiens
ctcagtatgtgggggcttc

SEQ ID NO: 2363532 - DNA, 16 bp, Homo sapiens
ctcagtcatgcataaa

SEQ ID NO: 2363533 - DNA, 23 bp, Homo sapiens
ctcagtcatgcataaatatgcag

SEQ ID NO: 2363534 - DNA, 17 bp, Homo sapiens
ctcagtgagcctcctgt

SEQ ID NO: 2363535 - DNA, 14 bp, Homo sapiens
ctgaataatatcaa

SEQ ID NO: 2363536 - DNA, 14 bp, Homo sapiens
ctgaataatgctac

SEQ ID NO: 2363537 - DNA, 23 bp, Homo sapiens
ctgaataatgctaccaggatgct

SEQ ID NO: 2363538 - DNA, 21 bp, Homo sapiens
ctgaatcatgagcctgctgga

SEQ ID NO: 2363539 - DNA, 14 bp, Homo sapiens
ctgaatgaagcagt

SEQ ID NO: 2363540 - DNA, 13 bp, Homo sapiens
ctgaatgccccct

SEQ ID NO: 2363541 - DNA, 23 bp, Homo sapiens
ctgaatgctatttgtgtaactga

SEQ ID NO: 2363542 - DNA, 20 bp, Homo sapiens
ctgaatttggggctacttat

SEQ ID NO: 2363543 - DNA, 12 bp, Homo sapiens
ctgaatttttca

SEQ ID NO: 2363544 - DNA, 14 bp, Homo sapiens
ctgaatttttttgt

SEQ ID NO: 2363545 - DNA, 16 bp, Homo sapiens
ctgaatttttttgtaa

SEQ ID NO: 2363546 - DNA, 19 bp, Homo sapiens
ctgaatttttttgtaataa

SEQ ID NO: 2363547 - DNA, 19 bp, Homo sapiens
ctgacaaccattaaagtca

SEQ ID NO: 2363548 - DNA, 22 bp, Homo sapiens
ctgacaaccattaaagtcagaa

SEQ ID NO: 2363549 - DNA, 19 bp, Homo sapiens
ctgacaacttagctcaggt

SEQ ID NO: 2363550 - DNA, 22 bp, Homo sapiens
ctgaccaagactgagccagctt

SEQ ID NO: 2363551 - DNA, 14 bp, Homo sapiens
ctgaccaagtttct

SEQ ID NO: 2363552 - DNA, 22 bp, Homo sapiens
ctgaccatattgtgcttcacag

SEQ ID NO: 2363553 - DNA, 21 bp, Homo sapiens
ctgacccagggactctccaaa

SEQ ID NO: 2363554 - DNA, 16 bp, Homo sapiens
ctgaccccattcctga

SEQ ID NO: 2363555 - DNA, 22 bp, Homo sapiens
ctgaccctcctccactccacct

SEQ ID NO: 2363556 - DNA, 19 bp, Homo sapiens
ctgacctccgccatccacc

SEQ ID NO: 2363557 - DNA, 19 bp, Homo sapiens
ctgacctgctgacctgtgc

SEQ ID NO: 2363558 - DNA, 20 bp, Homo sapiens
ctgacctgctgacctgtgca

SEQ ID NO: 2363559 - DNA, 23 bp, Homo sapiens
ctgacctggcatctaattctgat

SEQ ID NO: 2363560 - DNA, 12 bp, Homo sapiens
ctgacctggccc

SEQ ID NO: 2363561 - DNA, 14 bp, Homo sapiens
ctgacctggccccc

SEQ ID NO: 2363562 - DNA, 20 bp, Homo sapiens
ctgacctggccccctcagtg

SEQ ID NO: 2363563 - DNA, 20 bp, Homo sapiens
ctgacgcttgtgacagtgcc

SEQ ID NO: 2363564 - DNA, 22 bp, Homo sapiens
ctgacgcttgtgacagtgcctc

SEQ ID NO: 2363565 - DNA, 14 bp, Homo sapiens
ctgactcctctggc

SEQ ID NO: 2363566 - DNA, 21 bp, Homo sapiens
ctgactgctcagaacttgctg

SEQ ID NO: 2363567 - DNA, 13 bp, Homo sapiens
ctgactgtagctt

SEQ ID NO: 2363568 - DNA, 16 bp, Homo sapiens
ctgacttgctgtgtga

SEQ ID NO: 2363569 - DNA, 21 bp, Homo sapiens
ctgacttggggagatggagtt

SEQ ID NO: 2363570 - DNA, 18 bp, Homo sapiens
ctgagaagaagtggctgc

SEQ ID NO: 2363571 - DNA, 13 bp, Homo sapiens
ctgagaagctctg

SEQ ID NO: 2363572 - DNA, 14 bp, Homo sapiens
ctgagaccctactg

SEQ ID NO: 2363573 - DNA, 14 bp, Homo sapiens
ctgagacctgggat

SEQ ID NO: 2363574 - DNA, 15 bp, Homo sapiens
ctgagactgtgctgt

SEQ ID NO: 2363575 - DNA, 13 bp, Homo sapiens
ctgagaggcaggc

SEQ ID NO: 2363576 - DNA, 14 bp, Homo sapiens
ctgagaggcaggca

SEQ ID NO: 2363577 - DNA, 17 bp, Homo sapiens
ctgagagtcagctctct

SEQ ID NO: 2363578 - DNA, 18 bp, Homo sapiens
ctgagagtcagctctctg

SEQ ID NO: 2363579 - DNA, 12 bp, Homo sapiens
ctgagatatgaa

SEQ ID NO: 2363580 - DNA, 21 bp, Homo sapiens
ctgagatatgaacatattgtt

SEQ ID NO: 2363581 - DNA, 19 bp, Homo sapiens
ctgagatcgtgctactgca

SEQ ID NO: 2363582 - DNA, 11 bp, Homo sapiens
ctgagcacaga

SEQ ID NO: 2363583 - DNA, 15 bp, Homo sapiens
ctgagcaccctctgg

SEQ ID NO: 2363584 - DNA, 17 bp, Homo sapiens
ctgagcaccctctggat

SEQ ID NO: 2363585 - DNA, 20 bp, Homo sapiens
ctgagcaccctctggattct

SEQ ID NO: 2363586 - DNA, 20 bp, Homo sapiens
ctgagcaccgtgtcaagctg

SEQ ID NO: 2363587 - DNA, 14 bp, Homo sapiens
ctgagcagcctctg

SEQ ID NO: 2363588 - DNA, 16 bp, Homo sapiens
ctgagcagcctctgga

SEQ ID NO: 2363589 - DNA, 18 bp, Homo sapiens
ctgagccctactccctgc

SEQ ID NO: 2363590 - DNA, 20 bp, Homo sapiens
ctgagccctactccctgcag

SEQ ID NO: 2363591 - DNA, 21 bp, Homo sapiens
ctgagccctactccctgcaga

SEQ ID NO: 2363592 - DNA, 13 bp, Homo sapiens
ctgaggaggggag

SEQ ID NO: 2363593 - DNA, 22 bp, Homo sapiens
ctgaggatttaagggatggaaa

SEQ ID NO: 2363594 - DNA, 13 bp, Homo sapiens
ctgaggccagagt

SEQ ID NO: 2363595 - DNA, 18 bp, Homo sapiens
ctgaggccagagtcacct

SEQ ID NO: 2363596 - DNA, 15 bp, Homo sapiens
ctgaggccctgggct

SEQ ID NO: 2363597 - DNA, 17 bp, Homo sapiens
ctgaggcctagactctg

SEQ ID NO: 2363598 - DNA, 16 bp, Homo sapiens
ctgaggcggaggctgt

SEQ ID NO: 2363599 - DNA, 20 bp, Homo sapiens
ctgaggcggaggctgtgctc

SEQ ID NO: 2363600 - DNA, 14 bp, Homo sapiens
ctgaggctgaggca

SEQ ID NO: 2363601 - DNA, 20 bp, Homo sapiens
ctgagggcagactggggcat

SEQ ID NO: 2363602 - DNA, 22 bp, Homo sapiens
ctgaggtcatcggcgtggccca

SEQ ID NO: 2363603 - DNA, 17 bp, Homo sapiens
ctgaggttcctctgcct

SEQ ID NO: 2363604 - DNA, 18 bp, Homo sapiens
ctgagtaatagtccatgg

SEQ ID NO: 2363605 - DNA, 17 bp, Homo sapiens
ctgagtattttttataa

SEQ ID NO: 2363606 - DNA, 18 bp, Homo sapiens
ctgagtcagagccatgtc

SEQ ID NO: 2363607 - DNA, 14 bp, Homo sapiens
ctgagtcagtgctc

SEQ ID NO: 2363608 - DNA, 19 bp, Homo sapiens
ctgagtcagtgctctcagc

SEQ ID NO: 2363609 - DNA, 21 bp, Homo sapiens
ctgagtcagtgctctcagctg

SEQ ID NO: 2363610 - DNA, 23 bp, Homo sapiens
ctgagtcagtgctctcagctggc

SEQ ID NO: 2363611 - DNA, 17 bp, Homo sapiens
ctgagtcatctgttagg

SEQ ID NO: 2363612 - DNA, 17 bp, Homo sapiens
ctgagtcgtacagaaag

SEQ ID NO: 2363613 - DNA, 23 bp, Homo sapiens
ctgagtcgtacagaaagctgcct

SEQ ID NO: 2363614 - DNA, 20 bp, Homo sapiens
ctgagtgagttattgggagt

SEQ ID NO: 2363615 - DNA, 20 bp, Homo sapiens
ctgagtgcgggctgaggcca

SEQ ID NO: 2363616 - DNA, 23 bp, Homo sapiens
ctgagttctgggtttctagaggt

SEQ ID NO: 2363617 - DNA, 23 bp, Homo sapiens
ctgatactttagtacaatttcaa

SEQ ID NO: 2363618 - DNA, 21 bp, Homo sapiens
ctgatattatttcttctctta

SEQ ID NO: 2363619 - DNA, 22 bp, Homo sapiens
ctgatcaagagtccggatttct

SEQ ID NO: 2363620 - DNA, 20 bp, Homo sapiens
ctgatcattacatggctgtg

SEQ ID NO: 2363621 - DNA, 16 bp, Homo sapiens
ctgatcccatggccag

SEQ ID NO: 2363622 - DNA, 19 bp, Homo sapiens
ctgatctgcggatctcagc

SEQ ID NO: 2363623 - DNA, 20 bp, Homo sapiens
ctgatctgcggatctcagct

SEQ ID NO: 2363624 - DNA, 22 bp, Homo sapiens
ctgatgaaaaattgctgactgt

SEQ ID NO: 2363625 - DNA, 15 bp, Homo sapiens
ctgatggagccttcc

SEQ ID NO: 2363626 - DNA, 13 bp, Homo sapiens
ctgatggctcaag

SEQ ID NO: 2363627 - DNA, 21 bp, Homo sapiens
ctgatggctcaagacaaggct

SEQ ID NO: 2363628 - DNA, 12 bp, Homo sapiens
ctgatgtcccag

SEQ ID NO: 2363629 - DNA, 17 bp, Homo sapiens
ctgatgtcccagtgctc

SEQ ID NO: 2363630 - DNA, 19 bp, Homo sapiens
ctgattctagtgtgtgttt

SEQ ID NO: 2363631 - DNA, 15 bp, Homo sapiens
ctgattctggcttta

SEQ ID NO: 2363632 - DNA, 22 bp, Homo sapiens
ctgattctggctttaagccttc

SEQ ID NO: 2363633 - DNA, 19 bp, Homo sapiens
ctgattgggaggtgcgtgt

SEQ ID NO: 2363634 - DNA, 23 bp, Homo sapiens
ctgatttgatgatacatttcatt

SEQ ID NO: 2363635 - DNA, 16 bp, Homo sapiens
ctgattttcttctttc

SEQ ID NO: 2363636 - DNA, 19 bp, Homo sapiens
ctgattttttttcctttta

SEQ ID NO: 2363637 - DNA, 12 bp, Homo sapiens
ctgcaaactggg

SEQ ID NO: 2363638 - DNA, 19 bp, Homo sapiens
ctgcaaagggaactgaaga

SEQ ID NO: 2363639 - DNA, 22 bp, Homo sapiens
ctgcaagaacactggacctttg

SEQ ID NO: 2363640 - DNA, 22 bp, Homo sapiens
ctgcaagatggacacgagccac

SEQ ID NO: 2363641 - DNA, 18 bp, Homo sapiens
ctgcacaataaaaatgtt

SEQ ID NO: 2363642 - DNA, 11 bp, Homo sapiens
ctgcacacagg

SEQ ID NO: 2363643 - DNA, 14 bp, Homo sapiens
ctgcacacaggaca

SEQ ID NO: 2363644 - DNA, 20 bp, Homo sapiens
ctgcacaccctccagagaca

SEQ ID NO: 2363645 - DNA, 21 bp, Homo sapiens
ctgcacagagcaagtcctcac

SEQ ID NO: 2363646 - DNA, 22 bp, Homo sapiens
ctgcacatgaatcccacccaca

SEQ ID NO: 2363647 - DNA, 23 bp, Homo sapiens
ctgcacatgtcttgtacatgtgt

SEQ ID NO: 2363648 - DNA, 13 bp, Homo sapiens
ctgcacccctggg

SEQ ID NO: 2363649 - DNA, 18 bp, Homo sapiens
ctggcctctctagcacaa

SEQ ID NO: 2363650 - DNA, 14 bp, Homo sapiens
ctggcctggcacac

SEQ ID NO: 2363651 - DNA, 16 bp, Homo sapiens
ctggcctggcacacat

SEQ ID NO: 2363652 - DNA, 14 bp, Homo sapiens
ctggccttctccta

SEQ ID NO: 2363653 - DNA, 15 bp, Homo sapiens
ctggcgagttctctt

SEQ ID NO: 2363654 - DNA, 22 bp, Homo sapiens
ctggcgagttctctttggaaat

SEQ ID NO: 2363655 - DNA, 14 bp, Homo sapiens
ctggcgcaggtggg

SEQ ID NO: 2363656 - DNA, 18 bp, Homo sapiens
ctggctccccctccccag

SEQ ID NO: 2363657 - DNA, 20 bp, Homo sapiens
ctggctccccctccccaggc

SEQ ID NO: 2363658 - DNA, 22 bp, Homo sapiens
ctggctccccctccccaggctg

SEQ ID NO: 2363659 - DNA, 24 bp, Homo sapiens
ctggctccccctccccaggctgga

SEQ ID NO: 2363660 - DNA, 18 bp, Homo sapiens
ctggctccctcctccagg

SEQ ID NO: 2363661 - DNA, 21 bp, Homo sapiens
ctggctccctcctccaggcct

SEQ ID NO: 2363662 - DNA, 23 bp, Homo sapiens
ctggctccctcctccaggcctgc

SEQ ID NO: 2363663 - DNA, 22 bp, Homo sapiens
ctggctctaccttcctgtccct

SEQ ID NO: 2363664 - DNA, 15 bp, Homo sapiens
ctggctctccacctt

SEQ ID NO: 2363665 - DNA, 20 bp, Homo sapiens
ctggctctcccatttcctga

SEQ ID NO: 2363666 - DNA, 13 bp, Homo sapiens
ctggctctcctgg

SEQ ID NO: 2363667 - DNA, 20 bp, Homo sapiens
ctggctgaggttcctctgcc

SEQ ID NO: 2363668 - DNA, 22 bp, Homo sapiens
ctggctgaggttcctctgcctg

SEQ ID NO: 2363669 - DNA, 13 bp, Homo sapiens
ctggctgctgccc

SEQ ID NO: 2363670 - DNA, 20 bp, Homo sapiens
ctggctggaggagcagcagc

SEQ ID NO: 2363671 - DNA, 23 bp, Homo sapiens
ctggctgttctgtggttcctctg

SEQ ID NO: 2363672 - DNA, 12 bp, Homo sapiens
ctggcttattta

SEQ ID NO: 2363673 - DNA, 17 bp, Homo sapiens
ctggctttaagccttca

SEQ ID NO: 2363674 - DNA, 14 bp, Homo sapiens
ctggctttcccagg

SEQ ID NO: 2363675 - DNA, 16 bp, Homo sapiens
ctggctttcccaggag

SEQ ID NO: 2363676 - DNA, 19 bp, Homo sapiens
ctggctttcccaggagatg

SEQ ID NO: 2363677 - DNA, 13 bp, Homo sapiens
ctggctttgctct

SEQ ID NO: 2363678 - DNA, 17 bp, Homo sapiens
ctgggaaaccctctcca

SEQ ID NO: 2363679 - DNA, 18 bp, Homo sapiens
ctgggaaaccctctccat

SEQ ID NO: 2363680 - DNA, 17 bp, Homo sapiens
ctgggaaagcataaagc

SEQ ID NO: 2363681 - DNA, 17 bp, Homo sapiens
ctgggaagaagcaaggg

SEQ ID NO: 2363682 - DNA, 18 bp, Homo sapiens
ctgggacaactgctccca

SEQ ID NO: 2363683 - DNA, 16 bp, Homo sapiens
ctgggacacagaccca

SEQ ID NO: 2363684 - DNA, 19 bp, Homo sapiens
ctgggacacagacccagga

SEQ ID NO: 2363685 - DNA, 22 bp, Homo sapiens
ctgggacaccattaccaaaata

SEQ ID NO: 2363686 - DNA, 13 bp, Homo sapiens
ctgggacccttgt

SEQ ID NO: 2363687 - DNA, 21 bp, Homo sapiens
ctgggacccttgttggggagt

SEQ ID NO: 2363688 - DNA, 23 bp, Homo sapiens
ctgggacccttgttggggagtgg

SEQ ID NO: 2363689 - DNA, 17 bp, Homo sapiens
ctgggacctgccaggca

SEQ ID NO: 2363690 - DNA, 19 bp, Homo sapiens
ctgggacggaccagcatct

SEQ ID NO: 2363691 - DNA, 16 bp, Homo sapiens
ctgggactacaggtgc

SEQ ID NO: 2363692 - DNA, 15 bp, Homo sapiens
ctgggaggagggaga

SEQ ID NO: 2363693 - DNA, 19 bp, Homo sapiens
ctgggaggagggagaggga

SEQ ID NO: 2363694 - DNA, 20 bp, Homo sapiens
ctgggaggagggagagggag

SEQ ID NO: 2363695 - DNA, 23 bp, Homo sapiens
ctgggaggagggagagggaggtc

SEQ ID NO: 2363696 - DNA, 15 bp, Homo sapiens
ctgggatgtcacagt

SEQ ID NO: 2363697 - DNA, 17 bp, Homo sapiens
ctgggatgtcacagtcc

SEQ ID NO: 2363698 - DNA, 17 bp, Homo sapiens
ctgggcaatgaggcaga

SEQ ID NO: 2363699 - DNA, 16 bp, Homo sapiens
ctgggcacgcctgctg

SEQ ID NO: 2363700 - DNA, 14 bp, Homo sapiens
ctgggcagggcagg

SEQ ID NO: 2363701 - DNA, 18 bp, Homo sapiens
ctgggcattttcctcctc

SEQ ID NO: 2363702 - DNA, 23 bp, Homo sapiens
ctgggcattttcctcctctgcct

SEQ ID NO: 2363703 - DNA, 17 bp, Homo sapiens
ctgggccagcggggctg

SEQ ID NO: 2363704 - DNA, 19 bp, Homo sapiens
ctgggccagcggggctgct

SEQ ID NO: 2363705 - DNA, 22 bp, Homo sapiens
ctgggccatgtccaaagaggct

SEQ ID NO: 2363706 - DNA, 19 bp, Homo sapiens
ctgggctgggcacctgact

SEQ ID NO: 2363707 - DNA, 15 bp, Homo sapiens
ctgggcttcatctgg

SEQ ID NO: 2363708 - DNA, 19 bp, Homo sapiens
ctgggcttcatctggcaac

SEQ ID NO: 2363709 - DNA, 19 bp, Homo sapiens
ctgggcttcattctggaaa

SEQ ID NO: 2363710 - DNA, 14 bp, Homo sapiens
ctgggcttggcctg

SEQ ID NO: 2363711 - DNA, 17 bp, Homo sapiens
ctgggcttggcctgctg

SEQ ID NO: 2363712 - DNA, 15 bp, Homo sapiens
ctggggagtgattac

SEQ ID NO: 2363713 - DNA, 14 bp, Homo sapiens
ctggggatccccgc

SEQ ID NO: 2363714 - DNA, 14 bp, Homo sapiens
ctggggccagaggc

SEQ ID NO: 2363715 - DNA, 18 bp, Homo sapiens
ctggggcctgactgctca

SEQ ID NO: 2363716 - DNA, 20 bp, Homo sapiens
ctggggcctgactgctcaga

SEQ ID NO: 2363717 - DNA, 20 bp, Homo sapiens
ctggggctgaggctgaggca

SEQ ID NO: 2363718 - DNA, 14 bp, Homo sapiens
ctggggctgtgtta

SEQ ID NO: 2363719 - DNA, 14 bp, Homo sapiens
ctggggttgagggc

SEQ ID NO: 2363720 - DNA, 17 bp, Homo sapiens
ctgggtgcgtctccagt

SEQ ID NO: 2363721 - DNA, 17 bp, Homo sapiens
ctgggtgctactgggga

SEQ ID NO: 2363722 - DNA, 18 bp, Homo sapiens
ctgggtgctactggggaa

SEQ ID NO: 2363723 - DNA, 20 bp, Homo sapiens
ctgggttgcgggacagagta

SEQ ID NO: 2363724 - DNA, 23 bp, Homo sapiens
ctgggttgctgctgtccagtgcc

SEQ ID NO: 2363725 - DNA, 17 bp, Homo sapiens
ctgggtttctagaggtc

SEQ ID NO: 2363726 - DNA, 14 bp, Homo sapiens
ctggtacagcaggg

SEQ ID NO: 2363727 - DNA, 19 bp, Homo sapiens
ctggtagcatgatggctgt

SEQ ID NO: 2363728 - DNA, 18 bp, Homo sapiens
ctggtatatccaaaagct

SEQ ID NO: 2363729 - DNA, 22 bp, Homo sapiens
ctggtccaaaagattgctgaaa

SEQ ID NO: 2363730 - DNA, 22 bp, Homo sapiens
ctggtctcaaacttgtggcctc

SEQ ID NO: 2363731 - DNA, 17 bp, Homo sapiens
ctggtctctctatgcct

SEQ ID NO: 2363732 - DNA, 24 bp, Homo sapiens
ctggtctctctatgcctctctaca

SEQ ID NO: 2363733 - DNA, 15 bp, Homo sapiens
ctggtgaagctcact

SEQ ID NO: 2363734 - DNA, 20 bp, Homo sapiens
ctggtgaggcccagcctgtc

SEQ ID NO: 2363735 - DNA, 15 bp, Homo sapiens
ctggtgccaatttca

SEQ ID NO: 2363736 - DNA, 18 bp, Homo sapiens
ctggtgccaatttcaagt

SEQ ID NO: 2363737 - DNA, 17 bp, Homo sapiens
ctggtggcttaagtgag

SEQ ID NO: 2363738 - DNA, 19 bp, Homo sapiens
ctggtggcttaagtgagca

SEQ ID NO: 2363739 - DNA, 15 bp, Homo sapiens
ctggtggtggcctgt

SEQ ID NO: 2363740 - DNA, 20 bp, Homo sapiens
ctggttattgatgtggccct

SEQ ID NO: 2363741 - DNA, 18 bp, Homo sapiens
ctggttcaaagtaaagca

SEQ ID NO: 2363742 - DNA, 17 bp, Homo sapiens
ctggttgggcagccaga

SEQ ID NO: 2363743 - DNA, 15 bp, Homo sapiens
ctggttgtaaaagag

SEQ ID NO: 2363744 - DNA, 15 bp, Homo sapiens
ctgtaaaaatgttac

SEQ ID NO: 2363745 - DNA, 18 bp, Homo sapiens
ctgtacacgtgtcctgta

SEQ ID NO: 2363746 - DNA, 16 bp, Homo sapiens
ctgtacagatcaagaa

SEQ ID NO: 2363747 - DNA, 19 bp, Homo sapiens
ctgtacagatcaagaaaaa

SEQ ID NO: 2363748 - DNA, 19 bp, Homo sapiens
ctgtagagtcctatttcag

SEQ ID NO: 2363749 - DNA, 18 bp, Homo sapiens
ctgtagatatgtattctt

SEQ ID NO: 2363750 - DNA, 18 bp, Homo sapiens
ctgtagccacagctgctg

SEQ ID NO: 2363751 - DNA, 21 bp, Homo sapiens
ctgtagcctaaaacgaatggt

SEQ ID NO: 2363752 - DNA, 12 bp, Homo sapiens
ctgtagctcagt

SEQ ID NO: 2363753 - DNA, 14 bp, Homo sapiens
ctgtagctcagtca

SEQ ID NO: 2363754 - DNA, 19 bp, Homo sapiens
ctgtagctctgaatgctat

SEQ ID NO: 2363755 - DNA, 19 bp, Homo sapiens
ctgtagtttagttctgttg

SEQ ID NO: 2363756 - DNA, 13 bp, Homo sapiens
ctgtataaatagg

SEQ ID NO: 2363757 - DNA, 14 bp, Homo sapiens
ctgtataaatagga

SEQ ID NO: 2363758 - DNA, 15 bp, Homo sapiens
ctgtataaataggag

SEQ ID NO: 2363759 - DNA, 23 bp, Homo sapiens
ctgtataagttatttttgtacat

SEQ ID NO: 2363760 - DNA, 21 bp, Homo sapiens
ctgtatgaaaaattggggagg

SEQ ID NO: 2363761 - DNA, 23 bp, Homo sapiens
ctgtatgtgagctgtaaaaatgt

SEQ ID NO: 2363762 - DNA, 20 bp, Homo sapiens
ctgtattactgaataatatc

SEQ ID NO: 2363763 - DNA, 14 bp, Homo sapiens
cttcctgtccctga

SEQ ID NO: 2363764 - DNA, 16 bp, Homo sapiens
cttcctgtgatccacc

SEQ ID NO: 2363765 - DNA, 16 bp, Homo sapiens
cttcctgtttttcaca

SEQ ID NO: 2363766 - DNA, 13 bp, Homo sapiens
cttcctttctctc

SEQ ID NO: 2363767 - DNA, 17 bp, Homo sapiens
cttccttttccctgctt

SEQ ID NO: 2363768 - DNA, 19 bp, Homo sapiens
cttccttttccctgcttcc

SEQ ID NO: 2363769 - DNA, 13 bp, Homo sapiens
cttcgctgaaatt

SEQ ID NO: 2363770 - DNA, 22 bp, Homo sapiens
cttcggagatgaggagtaaaat

SEQ ID NO: 2363771 - DNA, 12 bp, Homo sapiens
cttcgggaccag

SEQ ID NO: 2363772 - DNA, 14 bp, Homo sapiens
cttcgggaccagga

SEQ ID NO: 2363773 - DNA, 23 bp, Homo sapiens
cttctaagagcgaacttcacata

SEQ ID NO: 2363774 - DNA, 23 bp, Homo sapiens
cttctacaatacaacacattgaa

SEQ ID NO: 2363775 - DNA, 12 bp, Homo sapiens
cttctacctgcc

SEQ ID NO: 2363776 - DNA, 23 bp, Homo sapiens
cttctattaatcaagagaaactt

SEQ ID NO: 2363777 - DNA, 17 bp, Homo sapiens
cttctcagaagcacaga

SEQ ID NO: 2363778 - DNA, 14 bp, Homo sapiens
cttctcatgatcca

SEQ ID NO: 2363779 - DNA, 19 bp, Homo sapiens
cttctcattcccatgtgga

SEQ ID NO: 2363780 - DNA, 16 bp, Homo sapiens
cttctcccactctcct

SEQ ID NO: 2363781 - DNA, 20 bp, Homo sapiens
cttctcccactctcctaggc

SEQ ID NO: 2363782 - DNA, 18 bp, Homo sapiens
cttctccccagagctgcc

SEQ ID NO: 2363783 - DNA, 19 bp, Homo sapiens
cttctccccagagctgcct

SEQ ID NO: 2363784 - DNA, 16 bp, Homo sapiens
cttctccctggaatga

SEQ ID NO: 2363785 - DNA, 13 bp, Homo sapiens
cttctccgccagc

SEQ ID NO: 2363786 - DNA, 23 bp, Homo sapiens
cttctccgccagcctcctctgga

SEQ ID NO: 2363787 - DNA, 15 bp, Homo sapiens
cttctctcctcccca

SEQ ID NO: 2363788 - DNA, 13 bp, Homo sapiens
cttctctccttgc

SEQ ID NO: 2363789 - DNA, 15 bp, Homo sapiens
cttctctccttgccc

SEQ ID NO: 2363790 - DNA, 23 bp, Homo sapiens
cttctgagctcctgtcccctgct

SEQ ID NO: 2363791 - DNA, 14 bp, Homo sapiens
cttctgatacttta

SEQ ID NO: 2363792 - DNA, 14 bp, Homo sapiens
cttctgcttttctg

SEQ ID NO: 2363793 - DNA, 19 bp, Homo sapiens
cttctgcttttctgccctg

SEQ ID NO: 2363794 - DNA, 22 bp, Homo sapiens
cttctgcttttctgccctggct

SEQ ID NO: 2363795 - DNA, 23 bp, Homo sapiens
cttctgcttttctgccctggctg

SEQ ID NO: 2363796 - DNA, 21 bp, Homo sapiens
cttctgggcttcatctggcaa

SEQ ID NO: 2363797 - DNA, 22 bp, Homo sapiens
cttctgggcttcatctggcaac

SEQ ID NO: 2363798 - DNA, 20 bp, Homo sapiens
cttctgggcttcattctgga

SEQ ID NO: 2363799 - DNA, 15 bp, Homo sapiens
cttctggggcaggct

SEQ ID NO: 2363800 - DNA, 19 bp, Homo sapiens
cttctggggcaggctgggc

SEQ ID NO: 2363801 - DNA, 15 bp, Homo sapiens
cttctggtactttct

SEQ ID NO: 2363802 - DNA, 19 bp, Homo sapiens
cttctggtttaaacttgtt

SEQ ID NO: 2363803 - DNA, 14 bp, Homo sapiens
cttctgtgatgagc

SEQ ID NO: 2363804 - DNA, 13 bp, Homo sapiens
cttcttacatgca

SEQ ID NO: 2363805 - DNA, 14 bp, Homo sapiens
cttcttacatgcat

SEQ ID NO: 2363806 - DNA, 16 bp, Homo sapiens
cttcttgaatataaaa

SEQ ID NO: 2363807 - DNA, 16 bp, Homo sapiens
cttcttgtttccttgt

SEQ ID NO: 2363808 - DNA, 16 bp, Homo sapiens
cttctttccctggaca

SEQ ID NO: 2363809 - DNA, 22 bp, Homo sapiens
cttctttccctggacaggcagc

SEQ ID NO: 2363810 - DNA, 23 bp, Homo sapiens
cttctttccctggacaggcagcc

SEQ ID NO: 2363811 - DNA, 16 bp, Homo sapiens
cttctttctagagcag

SEQ ID NO: 2363812 - DNA, 18 bp, Homo sapiens
cttctttgcctccctcag

SEQ ID NO: 2363813 - DNA, 21 bp, Homo sapiens
cttctttggaaataaaagata

SEQ ID NO: 2363814 - DNA, 20 bp, Homo sapiens
cttctttgttattataacat

SEQ ID NO: 2363815 - DNA, 23 bp, Homo sapiens
cttgaaaggcaggaagggaagcg

SEQ ID NO: 2363816 - DNA, 15 bp, Homo sapiens
cttgaaatgagtaaa

SEQ ID NO: 2363817 - DNA, 15 bp, Homo sapiens
cttgaaattttaacc

SEQ ID NO: 2363818 - DNA, 16 bp, Homo sapiens
cttgaagccaaagaaa

SEQ ID NO: 2363819 - DNA, 15 bp, Homo sapiens
cttgaaggccctgct

SEQ ID NO: 2363820 - DNA, 16 bp, Homo sapiens
cttgaagttgggtgtt

SEQ ID NO: 2363821 - DNA, 14 bp, Homo sapiens
cttgaccctgaaat

SEQ ID NO: 2363822 - DNA, 23 bp, Homo sapiens
cttgaccctgaaatattttctac

SEQ ID NO: 2363823 - DNA, 15 bp, Homo sapiens
cttgacgtttcttct

SEQ ID NO: 2363824 - DNA, 13 bp, Homo sapiens
cttgagcagaccg

SEQ ID NO: 2363825 - DNA, 14 bp, Homo sapiens
cttgagccctggct

SEQ ID NO: 2363826 - DNA, 17 bp, Homo sapiens
cttgagccgggcccctg

SEQ ID NO: 2363827 - DNA, 12 bp, Homo sapiens
cttgagctggcc

SEQ ID NO: 2363828 - DNA, 12 bp, Homo sapiens
cttgagggctgc

SEQ ID NO: 2363829 - DNA, 13 bp, Homo sapiens
cttgagggctgca

SEQ ID NO: 2363830 - DNA, 16 bp, Homo sapiens
cttgatccagaagagc

SEQ ID NO: 2363831 - DNA, 17 bp, Homo sapiens
cttgatccagaagagcc

SEQ ID NO: 2363832 - DNA, 13 bp, Homo sapiens
cttgatgactgcc

SEQ ID NO: 2363833 - DNA, 13 bp, Homo sapiens
cttgattaaatca

SEQ ID NO: 2363834 - DNA, 13 bp, Homo sapiens
cttgattcctggc

SEQ ID NO: 2363835 - DNA, 14 bp, Homo sapiens
cttgattcctggct

SEQ ID NO: 2363836 - DNA, 15 bp, Homo sapiens
cttgattcctggctc

SEQ ID NO: 2363837 - DNA, 23 bp, Homo sapiens
cttgattcctggctctaccctgt

SEQ ID NO: 2363838 - DNA, 12 bp, Homo sapiens
cttgatttttgc

SEQ ID NO: 2363839 - DNA, 13 bp, Homo sapiens
cttgcaaagcaac

SEQ ID NO: 2363840 - DNA, 16 bp, Homo sapiens
cttgcaaatgggagct

SEQ ID NO: 2363841 - DNA, 17 bp, Homo sapiens
cttgcacagctggagaa

SEQ ID NO: 2363842 - DNA, 15 bp, Homo sapiens
cttgcacagtcactg

SEQ ID NO: 2363843 - DNA, 14 bp, Homo sapiens
cttgcagaactgta

SEQ ID NO: 2363844 - DNA, 20 bp, Homo sapiens
cttgccaaagtacagaattt

SEQ ID NO: 2363845 - DNA, 14 bp, Homo sapiens
cttgccagggcagg

SEQ ID NO: 2363846 - DNA, 18 bp, Homo sapiens
cttgccagggcagggtct

SEQ ID NO: 2363847 - DNA, 14 bp, Homo sapiens
cttgcccatcctga

SEQ ID NO: 2363848 - DNA, 13 bp, Homo sapiens
cttgccgagagag

SEQ ID NO: 2363849 - DNA, 23 bp, Homo sapiens
cttgccgagagaggcgcgtctgc

SEQ ID NO: 2363850 - DNA, 12 bp, Homo sapiens
cttgcctcccca

SEQ ID NO: 2363851 - DNA, 15 bp, Homo sapiens
cttgcgagtccaagg

SEQ ID NO: 2363852 - DNA, 16 bp, Homo sapiens
cttgcgagtccaaggc

SEQ ID NO: 2363853 - DNA, 12 bp, Homo sapiens
cttgctccagat

SEQ ID NO: 2363854 - DNA, 19 bp, Homo sapiens
cttgctccagattctgatg

SEQ ID NO: 2363855 - DNA, 22 bp, Homo sapiens
cttgctctgtcccccaggctgg

SEQ ID NO: 2363856 - DNA, 18 bp, Homo sapiens
cttgctctgttttgcttt

SEQ ID NO: 2363857 - DNA, 17 bp, Homo sapiens
cttgctgccatgatgta

SEQ ID NO: 2363858 - DNA, 14 bp, Homo sapiens
cttgctggccccag

SEQ ID NO: 2363859 - DNA, 18 bp, Homo sapiens
cttgctggccccagccct

SEQ ID NO: 2363860 - DNA, 20 bp, Homo sapiens
cttgctggccccagccctgc

SEQ ID NO: 2363861 - DNA, 21 bp, Homo sapiens
cttgctggccccagccctgct

SEQ ID NO: 2363862 - DNA, 22 bp, Homo sapiens
cttgctgtccaggcagctccct

SEQ ID NO: 2363863 - DNA, 22 bp, Homo sapiens
cttgcttaaatttcttatgtga

SEQ ID NO: 2363864 - DNA, 12 bp, Homo sapiens
cttgcttcctga

SEQ ID NO: 2363865 - DNA, 13 bp, Homo sapiens
cttgcttcctgat

SEQ ID NO: 2363866 - DNA, 18 bp, Homo sapiens
cttgcttctgtatttcct

SEQ ID NO: 2363867 - DNA, 20 bp, Homo sapiens
cttgctttaccttttcaggg

SEQ ID NO: 2363868 - DNA, 17 bp, Homo sapiens
cttggaaatagaaagaa

SEQ ID NO: 2363869 - DNA, 21 bp, Homo sapiens
cttggaaatagaaagaagcca

SEQ ID NO: 2363870 - DNA, 17 bp, Homo sapiens
cttggaaatgtctgctg

SEQ ID NO: 2363871 - DNA, 19 bp, Homo sapiens
cttggaaatgtctgctggt

SEQ ID NO: 2363872 - DNA, 19 bp, Homo sapiens
cttggaaattcctgtactg

SEQ ID NO: 2363873 - DNA, 15 bp, Homo sapiens
cttggaaccagcccc

SEQ ID NO: 2363874 - DNA, 16 bp, Homo sapiens
cttggaaccagcccca

SEQ ID NO: 2363875 - DNA, 12 bp, Homo sapiens
cttggaagggcg

SEQ ID NO: 2363876 - DNA, 21 bp, Homo sapiens
cttggaagggcgttctaggta

SEQ ID NO: 2363877 - DNA, 18 bp, Homo sapiens
cttggaccactcctgtcc

SEQ ID NO: 2363878 - DNA, 19 bp, Homo sapiens
cttggaccatgccagattc

SEQ ID NO: 2363879 - DNA, 16 bp, Homo sapiens
gacaaaaagtatatta

SEQ ID NO: 2363880 - DNA, 17 bp, Homo sapiens
gacaaaagtctgtcttt

SEQ ID NO: 2363881 - DNA, 16 bp, Homo sapiens
gacaaaatatttccca

SEQ ID NO: 2363882 - DNA, 16 bp, Homo sapiens
gacaacacccattttt

SEQ ID NO: 2363883 - DNA, 17 bp, Homo sapiens
gacaactgctcccacct

SEQ ID NO: 2363884 - DNA, 19 bp, Homo sapiens
gacaactgctcccacctcc

SEQ ID NO: 2363885 - DNA, 13 bp, Homo sapiens
gacaaggtgctaa

SEQ ID NO: 2363886 - DNA, 14 bp, Homo sapiens
gacaaggtgctaac

SEQ ID NO: 2363887 - DNA, 15 bp, Homo sapiens
gacaagtaatttcag

SEQ ID NO: 2363888 - DNA, 18 bp, Homo sapiens
gacaatgttttcttcaac

SEQ ID NO: 2363889 - DNA, 18 bp, Homo sapiens
gacacagacccaggaccc

SEQ ID NO: 2363890 - DNA, 14 bp, Homo sapiens
gacacagttcctgg

SEQ ID NO: 2363891 - DNA, 22 bp, Homo sapiens
gacacatatgcaccttgtgtct

SEQ ID NO: 2363892 - DNA, 23 bp, Homo sapiens
gacacattaatgataaactcaga

SEQ ID NO: 2363893 - DNA, 12 bp, Homo sapiens
gacaccagagca

SEQ ID NO: 2363894 - DNA, 19 bp, Homo sapiens
gacaccagagcagatgcag

SEQ ID NO: 2363895 - DNA, 10 bp, Homo sapiens
gacacccggc

SEQ ID NO: 2363896 - DNA, 23 bp, Homo sapiens
gacacccttctcccactctccta

SEQ ID NO: 2363897 - DNA, 18 bp, Homo sapiens
gacactagcccaatgaaa

SEQ ID NO: 2363898 - DNA, 12 bp, Homo sapiens
gacactggcatg

SEQ ID NO: 2363899 - DNA, 17 bp, Homo sapiens
gacactgttgataaaaa

SEQ ID NO: 2363900 - DNA, 13 bp, Homo sapiens
gacagagccatgg

SEQ ID NO: 2363901 - DNA, 22 bp, Homo sapiens
gacagaggaaagggctggctcc

SEQ ID NO: 2363902 - DNA, 20 bp, Homo sapiens
gacagcatcccttcccacat

SEQ ID NO: 2363903 - DNA, 20 bp, Homo sapiens
gacagcttgtaggggagggg

SEQ ID NO: 2363904 - DNA, 14 bp, Homo sapiens
gacagctttctggg

SEQ ID NO: 2363905 - DNA, 18 bp, Homo sapiens
gacagctttctgggatgt

SEQ ID NO: 2363906 - DNA, 23 bp, Homo sapiens
gacagctttctgggatgtcacag

SEQ ID NO: 2363907 - DNA, 18 bp, Homo sapiens
gacaggcagcccagcagt

SEQ ID NO: 2363908 - DNA, 18 bp, Homo sapiens
gacaggggagttgtcaac

SEQ ID NO: 2363909 - DNA, 20 bp, Homo sapiens
gacagggtcttgctctgtcc

SEQ ID NO: 2363910 - DNA, 15 bp, Homo sapiens
gacagggtgggcttc

SEQ ID NO: 2363911 - DNA, 16 bp, Homo sapiens
gacagggtgggcttcc

SEQ ID NO: 2363912 - DNA, 17 bp, Homo sapiens
gacagggtgggcttcct

SEQ ID NO: 2363913 - DNA, 21 bp, Homo sapiens
gacagggtgggcttcctgccc

SEQ ID NO: 2363914 - DNA, 22 bp, Homo sapiens
gacagggtgggcttcctgccct

SEQ ID NO: 2363915 - DNA, 18 bp, Homo sapiens
gacagtatcccacatcca

SEQ ID NO: 2363916 - DNA, 13 bp, Homo sapiens
gacagtgcctctt

SEQ ID NO: 2363917 - DNA, 13 bp, Homo sapiens
gacagtttccaaa

SEQ ID NO: 2363918 - DNA, 23 bp, Homo sapiens
gacagtttcttagctttttaatt

SEQ ID NO: 2363919 - DNA, 21 bp, Homo sapiens
gacataaaggaaaagacacat

SEQ ID NO: 2363920 - DNA, 16 bp, Homo sapiens
gacataacgtttttcc

SEQ ID NO: 2363921 - DNA, 20 bp, Homo sapiens
gacataataaagtattttct

SEQ ID NO: 2363922 - DNA, 22 bp, Homo sapiens
gacataataaagtattttcttt

SEQ ID NO: 2363923 - DNA, 14 bp, Homo sapiens
gacatatctacact

SEQ ID NO: 2363924 - DNA, 17 bp, Homo sapiens
gacatgcaataaaattt

SEQ ID NO: 2363925 - DNA, 18 bp, Homo sapiens
gacatggacctccaggct

SEQ ID NO: 2363926 - DNA, 17 bp, Homo sapiens
gacatggtgcctgagag

SEQ ID NO: 2363927 - DNA, 12 bp, Homo sapiens
gacatgtgaaac

SEQ ID NO: 2363928 - DNA, 18 bp, Homo sapiens
gacatgtgaaaccttttt

SEQ ID NO: 2363929 - DNA, 23 bp, Homo sapiens
gacatgtgaaaccttttttaaga

SEQ ID NO: 2363930 - DNA, 14 bp, Homo sapiens
gacattcctttgaa

SEQ ID NO: 2363931 - DNA, 14 bp, Homo sapiens
gacatttagaagaa

SEQ ID NO: 2363932 - DNA, 15 bp, Homo sapiens
gacatttagaagaaa

SEQ ID NO: 2363933 - DNA, 17 bp, Homo sapiens
gacatttgtttgctgta

SEQ ID NO: 2363934 - DNA, 23 bp, Homo sapiens
gacattttaagtttgtagtaaaa

SEQ ID NO: 2363935 - DNA, 13 bp, Homo sapiens
gaccaacctgctc

SEQ ID NO: 2363936 - DNA, 18 bp, Homo sapiens
gaccaacctgctctgtcc

SEQ ID NO: 2363937 - DNA, 12 bp, Homo sapiens
gaccaataaaga

SEQ ID NO: 2363938 - DNA, 21 bp, Homo sapiens
gaccacagggttcaaaatgtc

SEQ ID NO: 2363939 - DNA, 23 bp, Homo sapiens
gaccacagggttcaaaatgtctg

SEQ ID NO: 2363940 - DNA, 13 bp, Homo sapiens
gaccagaagcctt

SEQ ID NO: 2363941 - DNA, 19 bp, Homo sapiens
gaccagatctttctcttcc

SEQ ID NO: 2363942 - DNA, 18 bp, Homo sapiens
gaccagccagcagcagcc

SEQ ID NO: 2363943 - DNA, 16 bp, Homo sapiens
gaccagggccctgggc

SEQ ID NO: 2363944 - DNA, 20 bp, Homo sapiens
gaccagtactgggaaggagg

SEQ ID NO: 2363945 - DNA, 12 bp, Homo sapiens
gaccatcctggc

SEQ ID NO: 2363946 - DNA, 13 bp, Homo sapiens
gaccatcctggct

SEQ ID NO: 2363947 - DNA, 14 bp, Homo sapiens
gaccatcctggcta

SEQ ID NO: 2363948 - DNA, 13 bp, Homo sapiens
gaccatgccagat

SEQ ID NO: 2363949 - DNA, 15 bp, Homo sapiens
gaccatgccagattc

SEQ ID NO: 2363950 - DNA, 20 bp, Homo sapiens
gaccattttttaatttactt

SEQ ID NO: 2363951 - DNA, 17 bp, Homo sapiens
gacccagggaacagcca

SEQ ID NO: 2363952 - DNA, 19 bp, Homo sapiens
gacccagggaacagccact

SEQ ID NO: 2363953 - DNA, 20 bp, Homo sapiens
gacccagggaacagccactc

SEQ ID NO: 2363954 - DNA, 22 bp, Homo sapiens
gaccccagtcgtgatgtggagg

SEQ ID NO: 2363955 - DNA, 23 bp, Homo sapiens
gaccccagtcgtgatgtggagga

SEQ ID NO: 2363956 - DNA, 12 bp, Homo sapiens
gacccctttgag

SEQ ID NO: 2363957 - DNA, 18 bp, Homo sapiens
gacccggaggccgaggcc

SEQ ID NO: 2363958 - DNA, 19 bp, Homo sapiens
gaccctactgaagtggctg

SEQ ID NO: 2363959 - DNA, 18 bp, Homo sapiens
gaccctatgggtctagga

SEQ ID NO: 2363960 - DNA, 11 bp, Homo sapiens
gaccctccaaa

SEQ ID NO: 2363961 - DNA, 17 bp, Homo sapiens
gaccctcttgcccatcc

SEQ ID NO: 2363962 - DNA, 23 bp, Homo sapiens
gaccctgaggccctgggctgggt

SEQ ID NO: 2363963 - DNA, 15 bp, Homo sapiens
gaccctgccacagcc

SEQ ID NO: 2363964 - DNA, 18 bp, Homo sapiens
gaccctgccacagccaga

SEQ ID NO: 2363965 - DNA, 19 bp, Homo sapiens
gaccctgccacagccagag

SEQ ID NO: 2363966 - DNA, 20 bp, Homo sapiens
gaccctgccacagccagagg

SEQ ID NO: 2363967 - DNA, 22 bp, Homo sapiens
gaccctgccacagccagaggag

SEQ ID NO: 2363968 - DNA, 14 bp, Homo sapiens
gaccctgggcaagt

SEQ ID NO: 2363969 - DNA, 19 bp, Homo sapiens
gaccctgggtgggctctgt

SEQ ID NO: 2363970 - DNA, 22 bp, Homo sapiens
gaccctgggtgggctctgtgca

SEQ ID NO: 2363971 - DNA, 20 bp, Homo sapiens
gaccgcgtagagagccgggc

SEQ ID NO: 2363972 - DNA, 16 bp, Homo sapiens
gaccgggccctgggtt

SEQ ID NO: 2363973 - DNA, 20 bp, Homo sapiens
gacctacctcaaagggcagt

SEQ ID NO: 2363974 - DNA, 14 bp, Homo sapiens
gacctagcaggctg

SEQ ID NO: 2363975 - DNA, 20 bp, Homo sapiens
gacctatcccaaatgtggaa

SEQ ID NO: 2363976 - DNA, 16 bp, Homo sapiens
gacctcatgcccagct

SEQ ID NO: 2363977 - DNA, 22 bp, Homo sapiens
gacctgatcattacatggctgt

SEQ ID NO: 2363978 - DNA, 16 bp, Homo sapiens
gacctgccaggcaggg

SEQ ID NO: 2363979 - DNA, 19 bp, Homo sapiens
gacctgccaggcaggggtg

SEQ ID NO: 2363980 - DNA, 20 bp, Homo sapiens
gacctgccaggcaggggtgg

SEQ ID NO: 2363981 - DNA, 16 bp, Homo sapiens
gacctggcactgggag

SEQ ID NO: 2363982 - DNA, 19 bp, Homo sapiens
gacctttgggttctttctg

SEQ ID NO: 2363983 - DNA, 16 bp, Homo sapiens
gacgaaaaagaggcat

SEQ ID NO: 2363984 - DNA, 17 bp, Homo sapiens
gacgccactccctggga

SEQ ID NO: 2363985 - DNA, 18 bp, Homo sapiens
gacgccactccctgggac

SEQ ID NO: 2363986 - DNA, 20 bp, Homo sapiens
gacggcaggctcactgccag

SEQ ID NO: 2363987 - DNA, 15 bp, Homo sapiens
gacggctcctcagag

SEQ ID NO: 2363988 - DNA, 21 bp, Homo sapiens
gacggtaagtgttctcatgaa

SEQ ID NO: 2363989 - DNA, 21 bp, Homo sapiens
gacggtcctttaggcagcctg

SEQ ID NO: 2363990 - DNA, 14 bp, Homo sapiens
gacgtcaggccctg

SEQ ID NO: 2363991 - DNA, 19 bp, Homo sapiens
gacgtttataaacagaaat

SEQ ID NO: 2363992 - DNA, 23 bp, Homo sapiens
gacgtttataaacagaaatggaa

SEQ ID NO: 2363993 - DNA, 16 bp, Homo sapiens
gatccagagagcagct

SEQ ID NO: 2363994 - DNA, 22 bp, Homo sapiens
gatccccgcctggccaggagca

SEQ ID NO: 2363995 - DNA, 21 bp, Homo sapiens
gatccttagaggtcctctgga

SEQ ID NO: 2363996 - DNA, 22 bp, Homo sapiens
gatccttagaggtcctctggag

SEQ ID NO: 2363997 - DNA, 16 bp, Homo sapiens
gatcgagaccatcctg

SEQ ID NO: 2363998 - DNA, 17 bp, Homo sapiens
gatcgagaccatcctgg

SEQ ID NO: 2363999 - DNA, 19 bp, Homo sapiens
gatcgagaccatcctggct

SEQ ID NO: 2364000 - DNA, 17 bp, Homo sapiens
gatcggactctgcccct

SEQ ID NO: 2364001 - DNA, 22 bp, Homo sapiens
gatcgtgctactgcactccagc

SEQ ID NO: 2364002 - DNA, 17 bp, Homo sapiens
gatctaaaaaaatgttt

SEQ ID NO: 2364003 - DNA, 22 bp, Homo sapiens
gatctagttctcaatcactgct

SEQ ID NO: 2364004 - DNA, 16 bp, Homo sapiens
gatctataggcagctt

SEQ ID NO: 2364005 - DNA, 17 bp, Homo sapiens
gatctataggcagcttc

SEQ ID NO: 2364006 - DNA, 21 bp, Homo sapiens
gatctataggcagcttctaag

SEQ ID NO: 2364007 - DNA, 16 bp, Homo sapiens
gatctcacaggctgag

SEQ ID NO: 2364008 - DNA, 15 bp, Homo sapiens
gatctcactctgccc

SEQ ID NO: 2364009 - DNA, 21 bp, Homo sapiens
gatctcagctttgagaagcct

SEQ ID NO: 2364010 - DNA, 16 bp, Homo sapiens
gatctctcctggccta

SEQ ID NO: 2364011 - DNA, 11 bp, Homo sapiens
gatctctgctt

SEQ ID NO: 2364012 - DNA, 12 bp, Homo sapiens
gatctgagaaca

SEQ ID NO: 2364013 - DNA, 22 bp, Homo sapiens
gatctgagtcagagccatgtct

SEQ ID NO: 2364014 - DNA, 13 bp, Homo sapiens
gatctgatcaaga

SEQ ID NO: 2364015 - DNA, 13 bp, Homo sapiens
gatctggctgcag

SEQ ID NO: 2364016 - DNA, 18 bp, Homo sapiens
gatctgggcattttcctc

SEQ ID NO: 2364017 - DNA, 19 bp, Homo sapiens
gatctgggcattttcctcc

SEQ ID NO: 2364018 - DNA, 16 bp, Homo sapiens
gatctttcagaaatat

SEQ ID NO: 2364019 - DNA, 15 bp, Homo sapiens
gatctttctcttccc

SEQ ID NO: 2364020 - DNA, 17 bp, Homo sapiens
gatctttctcttccctg

SEQ ID NO: 2364021 - DNA, 19 bp, Homo sapiens
gatctttctcttccctgaa

SEQ ID NO: 2364022 - DNA, 18 bp, Homo sapiens
gatgaaaaattgctgact

SEQ ID NO: 2364023 - DNA, 20 bp, Homo sapiens
gatgaaaaattgctgactgt

SEQ ID NO: 2364024 - DNA, 12 bp, Homo sapiens
gatgaagaccct

SEQ ID NO: 2364025 - DNA, 15 bp, Homo sapiens
gatgaattgcattat

SEQ ID NO: 2364026 - DNA, 12 bp, Homo sapiens
gatgactgcctt

SEQ ID NO: 2364027 - DNA, 19 bp, Homo sapiens
gatgactgccttgcctcct

SEQ ID NO: 2364028 - DNA, 14 bp, Homo sapiens
gatgagagcccaga

SEQ ID NO: 2364029 - DNA, 21 bp, Homo sapiens
gatgagagcccagaggtaaca

SEQ ID NO: 2364030 - DNA, 15 bp, Homo sapiens
gatgagcgccacctc

SEQ ID NO: 2364031 - DNA, 15 bp, Homo sapiens
gatgcatttaataaa

SEQ ID NO: 2364032 - DNA, 17 bp, Homo sapiens
gatgcatttaataaaga

SEQ ID NO: 2364033 - DNA, 19 bp, Homo sapiens
gatgcatttaataaagatg

SEQ ID NO: 2364034 - DNA, 22 bp, Homo sapiens
gatgcatttaataaagatgagt

SEQ ID NO: 2364035 - DNA, 20 bp, Homo sapiens
gatgccaatttcctctccac

SEQ ID NO: 2364036 - DNA, 13 bp, Homo sapiens
gatgccaccggcc

SEQ ID NO: 2364037 - DNA, 23 bp, Homo sapiens
gatgcttgcggcaaaaggaaagc

SEQ ID NO: 2364038 - DNA, 18 bp, Homo sapiens
gatggaaaaactgaggct

SEQ ID NO: 2364039 - DNA, 16 bp, Homo sapiens
gatggaatggaaaagc

SEQ ID NO: 2364040 - DNA, 15 bp, Homo sapiens
gatggacacgagcca

SEQ ID NO: 2364041 - DNA, 18 bp, Homo sapiens
gatggacacgagccacaa

SEQ ID NO: 2364042 - DNA, 14 bp, Homo sapiens
gatggacactccag

SEQ ID NO: 2364043 - DNA, 19 bp, Homo sapiens
gatggaccaacctgctctg

SEQ ID NO: 2364044 - DNA, 17 bp, Homo sapiens
gatggagggtggaaata

SEQ ID NO: 2364045 - DNA, 18 bp, Homo sapiens
gatggagttcttgtgcca

SEQ ID NO: 2364046 - DNA, 22 bp, Homo sapiens
gatggcatttggtctcaggcag

SEQ ID NO: 2364047 - DNA, 13 bp, Homo sapiens
gatggccagcccc

SEQ ID NO: 2364048 - DNA, 16 bp, Homo sapiens
gatggccagcccctgg

SEQ ID NO: 2364049 - DNA, 18 bp, Homo sapiens
gatggccttaatttcctt

SEQ ID NO: 2364050 - DNA, 14 bp, Homo sapiens
gatggcctttcctt

SEQ ID NO: 2364051 - DNA, 17 bp, Homo sapiens
gatggcctttccttccc

SEQ ID NO: 2364052 - DNA, 18 bp, Homo sapiens
gatggcctttccttccct

SEQ ID NO: 2364053 - DNA, 20 bp, Homo sapiens
gatggcctttccttccctct

SEQ ID NO: 2364054 - DNA, 20 bp, Homo sapiens
gatggctgtggcatttccaa

SEQ ID NO: 2364055 - DNA, 14 bp, Homo sapiens
gatggtaagagaaa

SEQ ID NO: 2364056 - DNA, 18 bp, Homo sapiens
gatggtgtgggtgtcctg

SEQ ID NO: 2364057 - DNA, 14 bp, Homo sapiens
gatgtataaatttt

SEQ ID NO: 2364058 - DNA, 11 bp, Homo sapiens
gatgtcagcct

SEQ ID NO: 2364059 - DNA, 11 bp, Homo sapiens
gatgtcccagt

SEQ ID NO: 2364060 - DNA, 15 bp, Homo sapiens
gatgtcttccctggg

SEQ ID NO: 2364061 - DNA, 13 bp, Homo sapiens
gatgtgagccttg

SEQ ID NO: 2364062 - DNA, 21 bp, Homo sapiens
gatgtgcatttttgtgaaatg

SEQ ID NO: 2364063 - DNA, 23 bp, Homo sapiens
gatgtgcatttttgtgaaatgaa

SEQ ID NO: 2364064 - DNA, 19 bp, Homo sapiens
gatgtgctataatctgttt

SEQ ID NO: 2364065 - DNA, 14 bp, Homo sapiens
gatgtggaggaaga

SEQ ID NO: 2364066 - DNA, 21 bp, Homo sapiens
gatgtgtcccccccaggcctt

SEQ ID NO: 2364067 - DNA, 18 bp, Homo sapiens
gatgtgtgttctcagtga

SEQ ID NO: 2364068 - DNA, 14 bp, Homo sapiens
gatgtttggaaaaa

SEQ ID NO: 2364069 - DNA, 19 bp, Homo sapiens
gattaagggacatttctat

SEQ ID NO: 2364070 - DNA, 17 bp, Homo sapiens
gattacctgaaagccct

SEQ ID NO: 2364071 - DNA, 16 bp, Homo sapiens
gattatagtaactata

SEQ ID NO: 2364072 - DNA, 12 bp, Homo sapiens
gattatcttcag

SEQ ID NO: 2364073 - DNA, 17 bp, Homo sapiens
gattatcttcagcccag

SEQ ID NO: 2364074 - DNA, 21 bp, Homo sapiens
gattattgagttccagttgaa

SEQ ID NO: 2364075 - DNA, 13 bp, Homo sapiens
gattatttaataa

SEQ ID NO: 2364076 - DNA, 15 bp, Homo sapiens
gattatttaataaca

SEQ ID NO: 2364077 - DNA, 17 bp, Homo sapiens
gattatttaataacatt

SEQ ID NO: 2364078 - DNA, 18 bp, Homo sapiens
gattatttaataacatta

SEQ ID NO: 2364079 - DNA, 21 bp, Homo sapiens
gattatttaataacattacct

SEQ ID NO: 2364080 - DNA, 22 bp, Homo sapiens
gattcaatctgtaaactgtgta

SEQ ID NO: 2364081 - DNA, 14 bp, Homo sapiens
gattctaaatacat

SEQ ID NO: 2364082 - DNA, 14 bp, Homo sapiens
gattctgcctctct

SEQ ID NO: 2364083 - DNA, 17 bp, Homo sapiens
gattctgcctctctgga

SEQ ID NO: 2364084 - DNA, 19 bp, Homo sapiens
gattctttccattatgatt

SEQ ID NO: 2364085 - DNA, 19 bp, Homo sapiens
gattgaactggaataatat

SEQ ID NO: 2364086 - DNA, 23 bp, Homo sapiens
gattgaagtattttgctggaata

SEQ ID NO: 2364087 - DNA, 22 bp, Homo sapiens
gattgcatttttattaaagcat

SEQ ID NO: 2364088 - DNA, 15 bp, Homo sapiens
gattgcttaaaagca

SEQ ID NO: 2364089 - DNA, 18 bp, Homo sapiens
gattgcttaaaagcattt

SEQ ID NO: 2364090 - DNA, 21 bp, Homo sapiens
gattggattatttaataacat

SEQ ID NO: 2364091 - DNA, 17 bp, Homo sapiens
gatttaagatatgtaac

SEQ ID NO: 2364092 - DNA, 17 bp, Homo sapiens
gatttaagtgaatacat

SEQ ID NO: 2364093 - DNA, 14 bp, Homo sapiens
gatttaataaaata

SEQ ID NO: 2364094 - DNA, 23 bp, Homo sapiens
gatttaataaaataattctaaag

SEQ ID NO: 2364095 - DNA, 13 bp, Homo sapiens
gatttacataggc

SEQ ID NO: 2364096 - DNA, 15 bp, Homo sapiens
gatttactaacagta

SEQ ID NO: 2364097 - DNA, 16 bp, Homo sapiens
gatttagggaagcagg

SEQ ID NO: 2364098 - DNA, 15 bp, Homo sapiens
gatttccttcaatgt

SEQ ID NO: 2364099 - DNA, 22 bp, Homo sapiens
gatttctaattgtaagtgaaat

SEQ ID NO: 2364100 - DNA, 16 bp, Homo sapiens
gatttctcattgactt

SEQ ID NO: 2364101 - DNA, 22 bp, Homo sapiens
gatttctcattgacttttataa

SEQ ID NO: 2364102 - DNA, 22 bp, Homo sapiens
gatttcttttgtaataaactat

SEQ ID NO: 2364103 - DNA, 14 bp, Homo sapiens
gatttgaattctgt

SEQ ID NO: 2364104 - DNA, 15 bp, Homo sapiens
gattttaacttaact

SEQ ID NO: 2364105 - DNA, 20 bp, Homo sapiens
gattttaacttaactgaaat

SEQ ID NO: 2364106 - DNA, 17 bp, Homo sapiens
gattttacagagcgcac

SEQ ID NO: 2364107 - DNA, 23 bp, Homo sapiens
gattttatgtttaaaatggcatt

SEQ ID NO: 2364108 - DNA, 14 bp, Homo sapiens
gccattttgtgaat

SEQ ID NO: 2364109 - DNA, 16 bp, Homo sapiens
gcccacatgggacctg

SEQ ID NO: 2364110 - DNA, 17 bp, Homo sapiens
gcccacatgggacctgg

SEQ ID NO: 2364111 - DNA, 19 bp, Homo sapiens
gcccacatgggacctggcc

SEQ ID NO: 2364112 - DNA, 14 bp, Homo sapiens
gcccacatttgatg

SEQ ID NO: 2364113 - DNA, 21 bp, Homo sapiens
gcccaccagacgtcaggccct

SEQ ID NO: 2364114 - DNA, 14 bp, Homo sapiens
gcccacctgccggc

SEQ ID NO: 2364115 - DNA, 14 bp, Homo sapiens
gcccacgcagagga

SEQ ID NO: 2364116 - DNA, 21 bp, Homo sapiens
gcccacgcccgactagcaggc

SEQ ID NO: 2364117 - DNA, 18 bp, Homo sapiens
gcccagaggtaacagaac

SEQ ID NO: 2364118 - DNA, 20 bp, Homo sapiens
gcccagaggtaacagaacag

SEQ ID NO: 2364119 - DNA, 20 bp, Homo sapiens
gcccagattcccctgtgtca

SEQ ID NO: 2364120 - DNA, 18 bp, Homo sapiens
gcccagccccactcctct

SEQ ID NO: 2364121 - DNA, 18 bp, Homo sapiens
gcccagcccctactgctg

SEQ ID NO: 2364122 - DNA, 19 bp, Homo sapiens
gcccagcccctactgctgt

SEQ ID NO: 2364123 - DNA, 20 bp, Homo sapiens
gcccagcccctactgctgtg

SEQ ID NO: 2364124 - DNA, 16 bp, Homo sapiens
gcccagcccctgttta

SEQ ID NO: 2364125 - DNA, 12 bp, Homo sapiens
gcccagcctgtc

SEQ ID NO: 2364126 - DNA, 15 bp, Homo sapiens
gcccagctctctgac

SEQ ID NO: 2364127 - DNA, 20 bp, Homo sapiens
gcccaggatactggcacaga

SEQ ID NO: 2364128 - DNA, 23 bp, Homo sapiens
gcccaggatactggcacagaggt

SEQ ID NO: 2364129 - DNA, 14 bp, Homo sapiens
gcccagtctgttga

SEQ ID NO: 2364130 - DNA, 12 bp, Homo sapiens
gcccatgctgtc

SEQ ID NO: 2364131 - DNA, 22 bp, Homo sapiens
gcccatggagattgacctggat

SEQ ID NO: 2364132 - DNA, 22 bp, Homo sapiens
gccccaatgtatgtgtggctgt

SEQ ID NO: 2364133 - DNA, 19 bp, Homo sapiens
gccccacactttgtacaga

SEQ ID NO: 2364134 - DNA, 15 bp, Homo sapiens
gccccacccagggct

SEQ ID NO: 2364135 - DNA, 23 bp, Homo sapiens
gccccacccagggctccctcctg

SEQ ID NO: 2364136 - DNA, 15 bp, Homo sapiens
gccccaccttgccag

SEQ ID NO: 2364137 - DNA, 18 bp, Homo sapiens
gccccaccttgccagggc

SEQ ID NO: 2364138 - DNA, 19 bp, Homo sapiens
gccccaccttgccagggca

SEQ ID NO: 2364139 - DNA, 23 bp, Homo sapiens
gccccacggagacagaggaaagg

SEQ ID NO: 2364140 - DNA, 13 bp, Homo sapiens
gccccactcctct

SEQ ID NO: 2364141 - DNA, 12 bp, Homo sapiens
gccccactgcca

SEQ ID NO: 2364142 - DNA, 14 bp, Homo sapiens
gccccactgccagc

SEQ ID NO: 2364143 - DNA, 16 bp, Homo sapiens
gccccactgccagcag

SEQ ID NO: 2364144 - DNA, 20 bp, Homo sapiens
gccccactgccagcagcagc

SEQ ID NO: 2364145 - DNA, 14 bp, Homo sapiens
gccccactggctgg

SEQ ID NO: 2364146 - DNA, 18 bp, Homo sapiens
gccccactttgaagggca

SEQ ID NO: 2364147 - DNA, 19 bp, Homo sapiens
gccccactttgaagggcaa

SEQ ID NO: 2364148 - DNA, 12 bp, Homo sapiens
gccccagacagg

SEQ ID NO: 2364149 - DNA, 16 bp, Homo sapiens
gccccagacagggtgg

SEQ ID NO: 2364150 - DNA, 13 bp, Homo sapiens
gccccagcccaga

SEQ ID NO: 2364151 - DNA, 16 bp, Homo sapiens
gccccagccctgctgg

SEQ ID NO: 2364152 - DNA, 10 bp, Homo sapiens
gccccagcct

SEQ ID NO: 2364153 - DNA, 15 bp, Homo sapiens
gccccagcctgggcc

SEQ ID NO: 2364154 - DNA, 14 bp, Homo sapiens
gccccaggccccag

SEQ ID NO: 2364155 - DNA, 19 bp, Homo sapiens
gccccatcagaacctgagc

SEQ ID NO: 2364156 - DNA, 21 bp, Homo sapiens
gccccattccttgcgcctcag

SEQ ID NO: 2364157 - DNA, 17 bp, Homo sapiens
gcccccaacctcagggc

SEQ ID NO: 2364158 - DNA, 12 bp, Homo sapiens
gcccccaccctg

SEQ ID NO: 2364159 - DNA, 18 bp, Homo sapiens
gcccccaccctgttcctg

SEQ ID NO: 2364160 - DNA, 23 bp, Homo sapiens
gcccccaccctgttcctgctgct

SEQ ID NO: 2364161 - DNA, 17 bp, Homo sapiens
gcccccagcagaggcag

SEQ ID NO: 2364162 - DNA, 17 bp, Homo sapiens
gcccccagtccccaccc

SEQ ID NO: 2364163 - DNA, 20 bp, Homo sapiens
gcccccagtccccacccctg

SEQ ID NO: 2364164 - DNA, 22 bp, Homo sapiens
gcccccagtccccacccctgcc

SEQ ID NO: 2364165 - DNA, 14 bp, Homo sapiens
gccccccacctttg

SEQ ID NO: 2364166 - DNA, 23 bp, Homo sapiens
gccccccacctttgggatcagcc

SEQ ID NO: 2364167 - DNA, 15 bp, Homo sapiens
gccccccgccctcat

SEQ ID NO: 2364168 - DNA, 16 bp, Homo sapiens
gccccccgccctcatg

SEQ ID NO: 2364169 - DNA, 13 bp, Homo sapiens
gccccctcctgaa

SEQ ID NO: 2364170 - DNA, 15 bp, Homo sapiens
gccccctcctgaacc

SEQ ID NO: 2364171 - DNA, 21 bp, Homo sapiens
gccccgcccccagtccccacc

SEQ ID NO: 2364172 - DNA, 18 bp, Homo sapiens
gccccggtggctgggcag

SEQ ID NO: 2364173 - DNA, 21 bp, Homo sapiens
gccccgttgtgagctggatag

SEQ ID NO: 2364174 - DNA, 15 bp, Homo sapiens
gcccctaatctctgt

SEQ ID NO: 2364175 - DNA, 19 bp, Homo sapiens
gcccctaatctctgtagga

SEQ ID NO: 2364176 - DNA, 13 bp, Homo sapiens
gcccctactgctg

SEQ ID NO: 2364177 - DNA, 15 bp, Homo sapiens
gcccctactgctgtg

SEQ ID NO: 2364178 - DNA, 18 bp, Homo sapiens
gcccctatagcactgagc

SEQ ID NO: 2364179 - DNA, 19 bp, Homo sapiens
gcccctatagcactgagct

SEQ ID NO: 2364180 - DNA, 15 bp, Homo sapiens
gcccctgacccaggg

SEQ ID NO: 2364181 - DNA, 20 bp, Homo sapiens
gcccctgggcttggcctgct

SEQ ID NO: 2364182 - DNA, 16 bp, Homo sapiens
gcccctggggcccagc

SEQ ID NO: 2364183 - DNA, 18 bp, Homo sapiens
gcccctggggcccagccc

SEQ ID NO: 2364184 - DNA, 20 bp, Homo sapiens
gcccctggggcccagcccct

SEQ ID NO: 2364185 - DNA, 20 bp, Homo sapiens
gccccttcaaacctcatagc

SEQ ID NO: 2364186 - DNA, 17 bp, Homo sapiens
gcccgaaactaagccag

SEQ ID NO: 2364187 - DNA, 23 bp, Homo sapiens
gcccgtgtagtccccaaccgtgt

SEQ ID NO: 2364188 - DNA, 17 bp, Homo sapiens
gccctactccctgcaga

SEQ ID NO: 2364189 - DNA, 20 bp, Homo sapiens
gccctactccctgcagatgc

SEQ ID NO: 2364190 - DNA, 18 bp, Homo sapiens
gccctcactccctctgca

SEQ ID NO: 2364191 - DNA, 17 bp, Homo sapiens
gccctcagttccttcat

SEQ ID NO: 2364192 - DNA, 22 bp, Homo sapiens
gccctcccctccggactggtgc

SEQ ID NO: 2364193 - DNA, 23 bp, Homo sapiens
gccctcccctccggactggtgcc

SEQ ID NO: 2364194 - DNA, 22 bp, Homo sapiens
gccctcccctgcccctcacaac

SEQ ID NO: 2364195 - DNA, 16 bp, Homo sapiens
gccctctcccaccctc

SEQ ID NO: 2364196 - DNA, 20 bp, Homo sapiens
gccctgaggcctagactctg

SEQ ID NO: 2364197 - DNA, 16 bp, Homo sapiens
gccctgcctcctggag

SEQ ID NO: 2364198 - DNA, 19 bp, Homo sapiens
gccctgctgagtcatctgt

SEQ ID NO: 2364199 - DNA, 12 bp, Homo sapiens
gccctggctgct

SEQ ID NO: 2364200 - DNA, 15 bp, Homo sapiens
gccctgggctgggtg

SEQ ID NO: 2364201 - DNA, 15 bp, Homo sapiens
gccctgtagctctga

SEQ ID NO: 2364202 - DNA, 20 bp, Homo sapiens
gccctgtccaaaagcgccct

SEQ ID NO: 2364203 - DNA, 16 bp, Homo sapiens
gccctgtccaggtaga

SEQ ID NO: 2364204 - DNA, 13 bp, Homo sapiens
gccctgtgtactt

SEQ ID NO: 2364205 - DNA, 14 bp, Homo sapiens
gccctgttccctgg

SEQ ID NO: 2364206 - DNA, 15 bp, Homo sapiens
gcccttcaatgctgc

SEQ ID NO: 2364207 - DNA, 17 bp, Homo sapiens
gcccttcaatgctgcag

SEQ ID NO: 2364208 - DNA, 13 bp, Homo sapiens
gcccttccctctg

SEQ ID NO: 2364209 - DNA, 14 bp, Homo sapiens
gcccttccctctgg

SEQ ID NO: 2364210 - DNA, 14 bp, Homo sapiens
gcccttccctgagt

SEQ ID NO: 2364211 - DNA, 22 bp, Homo sapiens
gcccttccctgagtgcgggctg

SEQ ID NO: 2364212 - DNA, 18 bp, Homo sapiens
gcccttgtcgtgggatgg

SEQ ID NO: 2364213 - DNA, 12 bp, Homo sapiens
gccgatgccacc

SEQ ID NO: 2364214 - DNA, 16 bp, Homo sapiens
gccgatgccaccggcc

SEQ ID NO: 2364215 - DNA, 15 bp, Homo sapiens
gccgccccctcctga

SEQ ID NO: 2364216 - DNA, 19 bp, Homo sapiens
gccgcttctccccagagct

SEQ ID NO: 2364217 - DNA, 23 bp, Homo sapiens
gccgcttctccccagagctgcct

SEQ ID NO: 2364218 - DNA, 15 bp, Homo sapiens
gccggatctgaggga

SEQ ID NO: 2364219 - DNA, 17 bp, Homo sapiens
gccggatctgagggaga

SEQ ID NO: 2364220 - DNA, 12 bp, Homo sapiens
gccggcccagat

SEQ ID NO: 2364221 - DNA, 16 bp, Homo sapiens
gccggcccgcctctcc

SEQ ID NO: 2364222 - DNA, 16 bp, Homo sapiens
gccgggacccagggcc

SEQ ID NO: 2364223 - DNA, 19 bp, Homo sapiens
gctgccatcaccgctgggt

SEQ ID NO: 2364224 - DNA, 19 bp, Homo sapiens
gctgcccctaatctctgta

SEQ ID NO: 2364225 - DNA, 22 bp, Homo sapiens
gctgcccctaatctctgtagga

SEQ ID NO: 2364226 - DNA, 16 bp, Homo sapiens
gctgccctatgggcct

SEQ ID NO: 2364227 - DNA, 13 bp, Homo sapiens
gctgcctgctgag

SEQ ID NO: 2364228 - DNA, 13 bp, Homo sapiens
gctgccttcccta

SEQ ID NO: 2364229 - DNA, 21 bp, Homo sapiens
gctgcgcctgcaggcagagct

SEQ ID NO: 2364230 - DNA, 15 bp, Homo sapiens
gctgcggtgtttggc

SEQ ID NO: 2364231 - DNA, 21 bp, Homo sapiens
gctgcgtcagaccagtactgg

SEQ ID NO: 2364232 - DNA, 18 bp, Homo sapiens
gctgctatttattttcct

SEQ ID NO: 2364233 - DNA, 18 bp, Homo sapiens
gctgctcattacagttct

SEQ ID NO: 2364234 - DNA, 12 bp, Homo sapiens
gctgctctgcta

SEQ ID NO: 2364235 - DNA, 21 bp, Homo sapiens
gctgctggccaaatagcaaag

SEQ ID NO: 2364236 - DNA, 12 bp, Homo sapiens
gctgctggccat

SEQ ID NO: 2364237 - DNA, 16 bp, Homo sapiens
gctgctgtccagtgcc

SEQ ID NO: 2364238 - DNA, 21 bp, Homo sapiens
gctgctgtccagtgcctacat

SEQ ID NO: 2364239 - DNA, 24 bp, Homo sapiens
gctgctgtctgggtgctactgggg

SEQ ID NO: 2364240 - DNA, 14 bp, Homo sapiens
gctgctgtcttgtt

SEQ ID NO: 2364241 - DNA, 13 bp, Homo sapiens
gctgctgttctca

SEQ ID NO: 2364242 - DNA, 19 bp, Homo sapiens
gctgctgttctcaggacag

SEQ ID NO: 2364243 - DNA, 20 bp, Homo sapiens
gctgctgttctcaggacagc

SEQ ID NO: 2364244 - DNA, 15 bp, Homo sapiens
gctgcttttcttaag

SEQ ID NO: 2364245 - DNA, 22 bp, Homo sapiens
gctggaagcccagcccctactg

SEQ ID NO: 2364246 - DNA, 17 bp, Homo sapiens
gctggaagggaggaagg

SEQ ID NO: 2364247 - DNA, 19 bp, Homo sapiens
gctggacatgagatggaga

SEQ ID NO: 2364248 - DNA, 21 bp, Homo sapiens
gctggacatgagatggagagg

SEQ ID NO: 2364249 - DNA, 22 bp, Homo sapiens
gctggacttctacctgccctca

SEQ ID NO: 2364250 - DNA, 23 bp, Homo sapiens
gctggacttctacctgccctcaa

SEQ ID NO: 2364251 - DNA, 22 bp, Homo sapiens
gctggaggagcagcagcttggg

SEQ ID NO: 2364252 - DNA, 14 bp, Homo sapiens
gctggaggcctcag

SEQ ID NO: 2364253 - DNA, 16 bp, Homo sapiens
gctggagtctcctgag

SEQ ID NO: 2364254 - DNA, 14 bp, Homo sapiens
gctggatagacttg

SEQ ID NO: 2364255 - DNA, 16 bp, Homo sapiens
gctggatagacttggg

SEQ ID NO: 2364256 - DNA, 20 bp, Homo sapiens
gctggatagacttgggatgg

SEQ ID NO: 2364257 - DNA, 22 bp, Homo sapiens
gctggcaaaccctcccagaaac

SEQ ID NO: 2364258 - DNA, 21 bp, Homo sapiens
gctggcacccaccgtggagga

SEQ ID NO: 2364259 - DNA, 21 bp, Homo sapiens
gctggccatgaatctctgcct

SEQ ID NO: 2364260 - DNA, 12 bp, Homo sapiens
gctggccccagc

SEQ ID NO: 2364261 - DNA, 16 bp, Homo sapiens
gctggccccagccctg

SEQ ID NO: 2364262 - DNA, 21 bp, Homo sapiens
gctggccccagccctgctggg

SEQ ID NO: 2364263 - DNA, 18 bp, Homo sapiens
gctggcccttagagaccc

SEQ ID NO: 2364264 - DNA, 23 bp, Homo sapiens
gctggctccccctccccaggctg

SEQ ID NO: 2364265 - DNA, 13 bp, Homo sapiens
gctggctcctgat

SEQ ID NO: 2364266 - DNA, 21 bp, Homo sapiens
gctggctctaccttcctgtcc

SEQ ID NO: 2364267 - DNA, 18 bp, Homo sapiens
gctgggaggagggagagg

SEQ ID NO: 2364268 - DNA, 22 bp, Homo sapiens
gctgggaggagggagagggagg

SEQ ID NO: 2364269 - DNA, 15 bp, Homo sapiens
gctgggcacctgact

SEQ ID NO: 2364270 - DNA, 16 bp, Homo sapiens
gctgggcacctgactt

SEQ ID NO: 2364271 - DNA, 17 bp, Homo sapiens
gctgggctaggcatagg

SEQ ID NO: 2364272 - DNA, 20 bp, Homo sapiens
gctggggaagggttttcttt

SEQ ID NO: 2364273 - DNA, 23 bp, Homo sapiens
gctggggaagggttttcttttct

SEQ ID NO: 2364274 - DNA, 16 bp, Homo sapiens
gctggggccagaggct

SEQ ID NO: 2364275 - DNA, 13 bp, Homo sapiens
gctggggcctggg

SEQ ID NO: 2364276 - DNA, 14 bp, Homo sapiens
gctgggtccaccct

SEQ ID NO: 2364277 - DNA, 21 bp, Homo sapiens
gctgggtggttttttccccct

SEQ ID NO: 2364278 - DNA, 15 bp, Homo sapiens
gctggtatttctaat

SEQ ID NO: 2364279 - DNA, 24 bp, Homo sapiens
gctggtctcaaacttgtggcctca

SEQ ID NO: 2364280 - DNA, 21 bp, Homo sapiens
gctggtggagaactctggctt

SEQ ID NO: 2364281 - DNA, 18 bp, Homo sapiens
gctgtaactcagacattc

SEQ ID NO: 2364282 - DNA, 18 bp, Homo sapiens
gctgtacgacacgggtgg

SEQ ID NO: 2364283 - DNA, 20 bp, Homo sapiens
gctgtacttcttgaatataa

SEQ ID NO: 2364284 - DNA, 20 bp, Homo sapiens
gctgtcaccctccaccgagc

SEQ ID NO: 2364285 - DNA, 21 bp, Homo sapiens
gctgtcattgcacataagctt

SEQ ID NO: 2364286 - DNA, 12 bp, Homo sapiens
gctgtccaggca

SEQ ID NO: 2364287 - DNA, 15 bp, Homo sapiens
gctgtccaggcagct

SEQ ID NO: 2364288 - DNA, 22 bp, Homo sapiens
gctgtccaggcagctccctcct

SEQ ID NO: 2364289 - DNA, 15 bp, Homo sapiens
gctgtcctggagggg

SEQ ID NO: 2364290 - DNA, 22 bp, Homo sapiens
gctgtctgggtgctactgggga

SEQ ID NO: 2364291 - DNA, 14 bp, Homo sapiens
gctgtgagggaggg

SEQ ID NO: 2364292 - DNA, 15 bp, Homo sapiens
gctgtgatcttaaaa

SEQ ID NO: 2364293 - DNA, 19 bp, Homo sapiens
gctgtgcctcgcatcctat

SEQ ID NO: 2364294 - DNA, 19 bp, Homo sapiens
gctgtgcttgaaggccctg

SEQ ID NO: 2364295 - DNA, 16 bp, Homo sapiens
gctgtggggtggagca

SEQ ID NO: 2364296 - DNA, 19 bp, Homo sapiens
gctgtggggtggagcactg

SEQ ID NO: 2364297 - DNA, 16 bp, Homo sapiens
gctgtgggtgtgggtg

SEQ ID NO: 2364298 - DNA, 20 bp, Homo sapiens
gctgtggttcctaagcctgt

SEQ ID NO: 2364299 - DNA, 18 bp, Homo sapiens
gctgtgtgaccctgggca

SEQ ID NO: 2364300 - DNA, 22 bp, Homo sapiens
gctgtgtttatatggaagaaag

SEQ ID NO: 2364301 - DNA, 19 bp, Homo sapiens
gctgttgcttaaaccactt

SEQ ID NO: 2364302 - DNA, 13 bp, Homo sapiens
gctgttgggatat

SEQ ID NO: 2364303 - DNA, 15 bp, Homo sapiens
gctgttgtacattta

SEQ ID NO: 2364304 - DNA, 14 bp, Homo sapiens
gctgtttggaaaag

SEQ ID NO: 2364305 - DNA, 15 bp, Homo sapiens
gcttaaaaatcattg

SEQ ID NO: 2364306 - DNA, 14 bp, Homo sapiens
gcttaaatttcaga

SEQ ID NO: 2364307 - DNA, 15 bp, Homo sapiens
gcttaaatttcttat

SEQ ID NO: 2364308 - DNA, 21 bp, Homo sapiens
gcttaaatttcttatgtgaca

SEQ ID NO: 2364309 - DNA, 13 bp, Homo sapiens
gcttaaattttaa

SEQ ID NO: 2364310 - DNA, 14 bp, Homo sapiens
gcttaaattttaac

SEQ ID NO: 2364311 - DNA, 18 bp, Homo sapiens
gcttaagtgagcagaaca

SEQ ID NO: 2364312 - DNA, 12 bp, Homo sapiens
gcttaataccaa

SEQ ID NO: 2364313 - DNA, 22 bp, Homo sapiens
gcttaatcttcaaagccttctc

SEQ ID NO: 2364314 - DNA, 19 bp, Homo sapiens
gcttactaatgtgccccat

SEQ ID NO: 2364315 - DNA, 17 bp, Homo sapiens
gcttactgatatatttt

SEQ ID NO: 2364316 - DNA, 21 bp, Homo sapiens
gcttactgatatattttacaa

SEQ ID NO: 2364317 - DNA, 19 bp, Homo sapiens
gcttagaacgttaaactat

SEQ ID NO: 2364318 - DNA, 23 bp, Homo sapiens
gcttagaacgttaaactattaga

SEQ ID NO: 2364319 - DNA, 19 bp, Homo sapiens
gcttagagaggcttgaagg

SEQ ID NO: 2364320 - DNA, 18 bp, Homo sapiens
gcttagcaactgctgggg

SEQ ID NO: 2364321 - DNA, 18 bp, Homo sapiens
gcttataacctagttaaa

SEQ ID NO: 2364322 - DNA, 17 bp, Homo sapiens
gcttatttaatatgctt

SEQ ID NO: 2364323 - DNA, 12 bp, Homo sapiens
gcttcaggttat

SEQ ID NO: 2364324 - DNA, 17 bp, Homo sapiens
gcttcaggttatcgaaa

SEQ ID NO: 2364325 - DNA, 19 bp, Homo sapiens
gcttcaggttatcgaaata

SEQ ID NO: 2364326 - DNA, 20 bp, Homo sapiens
gcttcaggttatcgaaataa

SEQ ID NO: 2364327 - DNA, 21 bp, Homo sapiens
gcttcaggttatcgaaataac

SEQ ID NO: 2364328 - DNA, 15 bp, Homo sapiens
gcttcagttgcttgt

SEQ ID NO: 2364329 - DNA, 16 bp, Homo sapiens
gcttcatctctttaga

SEQ ID NO: 2364330 - DNA, 19 bp, Homo sapiens
gcttcatctctttagagaa

SEQ ID NO: 2364331 - DNA, 14 bp, Homo sapiens
gcttcatctggcaa

SEQ ID NO: 2364332 - DNA, 15 bp, Homo sapiens
gcttcattctcagac

SEQ ID NO: 2364333 - DNA, 23 bp, Homo sapiens
gcttcattttatttttgacgtca

SEQ ID NO: 2364334 - DNA, 12 bp, Homo sapiens
gcttccaaagcc

SEQ ID NO: 2364335 - DNA, 13 bp, Homo sapiens
gcttccaaagcct

SEQ ID NO: 2364336 - DNA, 15 bp, Homo sapiens
gcttccaaagcctag

SEQ ID NO: 2364337 - DNA, 19 bp, Homo sapiens
ggccataaacggttcctgg

SEQ ID NO: 2364338 - DNA, 22 bp, Homo sapiens
ggccataaacggttcctggtga

SEQ ID NO: 2364339 - DNA, 20 bp, Homo sapiens
ggccatgaatctctgcctct

SEQ ID NO: 2364340 - DNA, 13 bp, Homo sapiens
ggccatgcagacc

SEQ ID NO: 2364341 - DNA, 13 bp, Homo sapiens
ggccatgcaggag

SEQ ID NO: 2364342 - DNA, 18 bp, Homo sapiens
ggccatgcaggaggtgga

SEQ ID NO: 2364343 - DNA, 13 bp, Homo sapiens
ggccatgtccaaa

SEQ ID NO: 2364344 - DNA, 15 bp, Homo sapiens
ggccatgtccaaaga

SEQ ID NO: 2364345 - DNA, 16 bp, Homo sapiens
ggccatgtccaaagag

SEQ ID NO: 2364346 - DNA, 14 bp, Homo sapiens
ggccattctgccgc

SEQ ID NO: 2364347 - DNA, 20 bp, Homo sapiens
ggccattctgccgccccctc

SEQ ID NO: 2364348 - DNA, 23 bp, Homo sapiens
ggccatttcaccagtcactgcca

SEQ ID NO: 2364349 - DNA, 14 bp, Homo sapiens
ggccatttgcaata

SEQ ID NO: 2364350 - DNA, 21 bp, Homo sapiens
ggccatttgcaataacagctg

SEQ ID NO: 2364351 - DNA, 17 bp, Homo sapiens
ggcccagaaagcctctc

SEQ ID NO: 2364352 - DNA, 12 bp, Homo sapiens
ggcccagcctgt

SEQ ID NO: 2364353 - DNA, 15 bp, Homo sapiens
ggcccagcctgtcct

SEQ ID NO: 2364354 - DNA, 21 bp, Homo sapiens
ggcccattcagagctatggtg

SEQ ID NO: 2364355 - DNA, 13 bp, Homo sapiens
ggccccactggct

SEQ ID NO: 2364356 - DNA, 19 bp, Homo sapiens
ggccccactggctggagga

SEQ ID NO: 2364357 - DNA, 21 bp, Homo sapiens
ggccccagccctgctggggat

SEQ ID NO: 2364358 - DNA, 21 bp, Homo sapiens
ggcccccaacctcagggctcc

SEQ ID NO: 2364359 - DNA, 21 bp, Homo sapiens
ggccccctccccccagactct

SEQ ID NO: 2364360 - DNA, 13 bp, Homo sapiens
ggccccctctcct

SEQ ID NO: 2364361 - DNA, 20 bp, Homo sapiens
ggcccctgggcttggcctgc

SEQ ID NO: 2364362 - DNA, 19 bp, Homo sapiens
ggccctgactcctctggct

SEQ ID NO: 2364363 - DNA, 14 bp, Homo sapiens
ggccctgaggcgga

SEQ ID NO: 2364364 - DNA, 21 bp, Homo sapiens
ggccctgaggcggaggctgtg

SEQ ID NO: 2364365 - DNA, 23 bp, Homo sapiens
ggccctgaggcggaggctgtgct

SEQ ID NO: 2364366 - DNA, 20 bp, Homo sapiens
ggccctgctgagtcatctgt

SEQ ID NO: 2364367 - DNA, 13 bp, Homo sapiens
ggccctggctgcc

SEQ ID NO: 2364368 - DNA, 21 bp, Homo sapiens
ggccctgggctgggtgctggg

SEQ ID NO: 2364369 - DNA, 15 bp, Homo sapiens
ggccctgggttcctc

SEQ ID NO: 2364370 - DNA, 20 bp, Homo sapiens
ggccctgtccaggtagaaaa

SEQ ID NO: 2364371 - DNA, 11 bp, Homo sapiens
ggccctgtccc

SEQ ID NO: 2364372 - DNA, 12 bp, Homo sapiens
ggccctgtccca

SEQ ID NO: 2364373 - DNA, 14 bp, Homo sapiens
ggccctgtcccagg

SEQ ID NO: 2364374 - DNA, 14 bp, Homo sapiens
ggccgaggcgggtg

SEQ ID NO: 2364375 - DNA, 14 bp, Homo sapiens
ggccgtgccttgtt

SEQ ID NO: 2364376 - DNA, 19 bp, Homo sapiens
ggcctagcgatctctcctg

SEQ ID NO: 2364377 - DNA, 13 bp, Homo sapiens
ggcctcaggtgct

SEQ ID NO: 2364378 - DNA, 12 bp, Homo sapiens
ggcctcctgggg

SEQ ID NO: 2364379 - DNA, 17 bp, Homo sapiens
ggcctcctgggggacct

SEQ ID NO: 2364380 - DNA, 22 bp, Homo sapiens
ggcctccttctgagctcctgtc

SEQ ID NO: 2364381 - DNA, 19 bp, Homo sapiens
ggcctctccaaccactgtg

SEQ ID NO: 2364382 - DNA, 16 bp, Homo sapiens
ggcctgaagccagctg

SEQ ID NO: 2364383 - DNA, 17 bp, Homo sapiens
ggcctgaagccagctgc

SEQ ID NO: 2364384 - DNA, 19 bp, Homo sapiens
ggcctgaagccagctgccc

SEQ ID NO: 2364385 - DNA, 17 bp, Homo sapiens
ggcctgaatcatgagcc

SEQ ID NO: 2364386 - DNA, 18 bp, Homo sapiens
ggcctgagagtcagctct

SEQ ID NO: 2364387 - DNA, 21 bp, Homo sapiens
ggcctgagagtcagctctctg

SEQ ID NO: 2364388 - DNA, 22 bp, Homo sapiens
ggcctgagcccctttgcctgtc

SEQ ID NO: 2364389 - DNA, 16 bp, Homo sapiens
ggcctgcaaactggga

SEQ ID NO: 2364390 - DNA, 17 bp, Homo sapiens
ggcctgctggaggcctc

SEQ ID NO: 2364391 - DNA, 21 bp, Homo sapiens
ggcctgctggaggcctcaggt

SEQ ID NO: 2364392 - DNA, 15 bp, Homo sapiens
ggcctgtggctgtcg

SEQ ID NO: 2364393 - DNA, 21 bp, Homo sapiens
ggccttatcgggctccagcca

SEQ ID NO: 2364394 - DNA, 21 bp, Homo sapiens
ggcctttatctcaacggaagc

SEQ ID NO: 2364395 - DNA, 11 bp, Homo sapiens
ggcctttcctt

SEQ ID NO: 2364396 - DNA, 12 bp, Homo sapiens
ggcctttccttc

SEQ ID NO: 2364397 - DNA, 15 bp, Homo sapiens
ggcctttccttccct

SEQ ID NO: 2364398 - DNA, 12 bp, Homo sapiens
ggcctttcttct

SEQ ID NO: 2364399 - DNA, 15 bp, Homo sapiens
ggcctttcttctgtg

SEQ ID NO: 2364400 - DNA, 23 bp, Homo sapiens
ggcctttgtgctgcgcctgcagg

SEQ ID NO: 2364401 - DNA, 21 bp, Homo sapiens
ggcgaccaccgcccctggccg

SEQ ID NO: 2364402 - DNA, 14 bp, Homo sapiens
ggcgcaggtgggct

SEQ ID NO: 2364403 - DNA, 16 bp, Homo sapiens
ggcgcaggtgggctgg

SEQ ID NO: 2364404 - DNA, 23 bp, Homo sapiens
ggcgcatgcatgggaggaattca

SEQ ID NO: 2364405 - DNA, 20 bp, Homo sapiens
ggcgccctgcctcctggagg

SEQ ID NO: 2364406 - DNA, 18 bp, Homo sapiens
ggcgcccttggcttctgt

SEQ ID NO: 2364407 - DNA, 15 bp, Homo sapiens
ggcgcggagtgaacc

SEQ ID NO: 2364408 - DNA, 14 bp, Homo sapiens
ggcgcgtctgcccc

SEQ ID NO: 2364409 - DNA, 17 bp, Homo sapiens
ggcgcgtctgccccacc

SEQ ID NO: 2364410 - DNA, 21 bp, Homo sapiens
ggcgctgcccacctgccggcc

SEQ ID NO: 2364411 - DNA, 12 bp, Homo sapiens
ggcggaggctgt

SEQ ID NO: 2364412 - DNA, 20 bp, Homo sapiens
ggcgggtgatggccagcccc

SEQ ID NO: 2364413 - DNA, 18 bp, Homo sapiens
ggctattttctaaagact

SEQ ID NO: 2364414 - DNA, 19 bp, Homo sapiens
ggctcaagcaatcctcctg

SEQ ID NO: 2364415 - DNA, 13 bp, Homo sapiens
ggctcacgcctgt

SEQ ID NO: 2364416 - DNA, 14 bp, Homo sapiens
ggctcactgccagg

SEQ ID NO: 2364417 - DNA, 18 bp, Homo sapiens
ggctccagccatctcatg

SEQ ID NO: 2364418 - DNA, 21 bp, Homo sapiens
ggctcccaggggtctccctgg

SEQ ID NO: 2364419 - DNA, 23 bp, Homo sapiens
ggctcccaggggtctccctggct

SEQ ID NO: 2364420 - DNA, 21 bp, Homo sapiens
ggctccccctccagccagaga

SEQ ID NO: 2364421 - DNA, 22 bp, Homo sapiens
ggctccccctccccaggctgga

SEQ ID NO: 2364422 - DNA, 13 bp, Homo sapiens
ggctcccctctgc

SEQ ID NO: 2364423 - DNA, 12 bp, Homo sapiens
ggctcctttcca

SEQ ID NO: 2364424 - DNA, 14 bp, Homo sapiens
ggctcgcactgccc

SEQ ID NO: 2364425 - DNA, 15 bp, Homo sapiens
ggctcgcactgccca

SEQ ID NO: 2364426 - DNA, 18 bp, Homo sapiens
ggctcgccccacccaggg

SEQ ID NO: 2364427 - DNA, 20 bp, Homo sapiens
ggctctaccctgtctgtccc

SEQ ID NO: 2364428 - DNA, 12 bp, Homo sapiens
ggctctgcagtc

SEQ ID NO: 2364429 - DNA, 21 bp, Homo sapiens
ggctctggacagcagaagcct

SEQ ID NO: 2364430 - DNA, 16 bp, Homo sapiens
ggctcttcatctgcct

SEQ ID NO: 2364431 - DNA, 15 bp, Homo sapiens
ggctgaggcaggaga

SEQ ID NO: 2364432 - DNA, 23 bp, Homo sapiens
ggctgaggcaggagaatggtgtg

SEQ ID NO: 2364433 - DNA, 14 bp, Homo sapiens
ggctgaggccagag

SEQ ID NO: 2364434 - DNA, 15 bp, Homo sapiens
ggctgaggccagagt

SEQ ID NO: 2364435 - DNA, 15 bp, Homo sapiens
ggctgagggacagga

SEQ ID NO: 2364436 - DNA, 14 bp, Homo sapiens
ggctgagggcctgc

SEQ ID NO: 2364437 - DNA, 17 bp, Homo sapiens
ggctgagggcctgctgg

SEQ ID NO: 2364438 - DNA, 17 bp, Homo sapiens
ggctgaggttcctctgc

SEQ ID NO: 2364439 - DNA, 22 bp, Homo sapiens
ggctgaggttcctctgcctgcc

SEQ ID NO: 2364440 - DNA, 23 bp, Homo sapiens
ggctgatggtgtggcctgtggct

SEQ ID NO: 2364441 - DNA, 17 bp, Homo sapiens
ggctgcacccctgggcc

SEQ ID NO: 2364442 - DNA, 15 bp, Homo sapiens
ggctgccacacccag

SEQ ID NO: 2364443 - DNA, 18 bp, Homo sapiens
ggctgccacacccagggg

SEQ ID NO: 2364444 - DNA, 15 bp, Homo sapiens
ggctgcccctctcac

SEQ ID NO: 2364445 - DNA, 16 bp, Homo sapiens
ggctgccttctggcct

SEQ ID NO: 2364446 - DNA, 10 bp, Homo sapiens
ggctgctgcc

SEQ ID NO: 2364447 - DNA, 22 bp, Homo sapiens
ggctgcttttcttaagtgccca

SEQ ID NO: 2364448 - DNA, 17 bp, Homo sapiens
ggctggagtaatcagat

SEQ ID NO: 2364449 - DNA, 19 bp, Homo sapiens
ggctggatggcacctcagg

SEQ ID NO: 2364450 - DNA, 15 bp, Homo sapiens
ggctggctccccctc

SEQ ID NO: 2364451 - DNA, 21 bp, Homo sapiens
ggctggctccccctccccagg

SEQ ID NO: 2364452 - DNA, 13 bp, Homo sapiens
gggctgagggcct

SEQ ID NO: 2364453 - DNA, 18 bp, Homo sapiens
gggctgagggcctgctgg

SEQ ID NO: 2364454 - DNA, 18 bp, Homo sapiens
gggctgccaccagccccc

SEQ ID NO: 2364455 - DNA, 18 bp, Homo sapiens
gggctgccatgtgaagag

SEQ ID NO: 2364456 - DNA, 20 bp, Homo sapiens
gggctgctcacccacctctt

SEQ ID NO: 2364457 - DNA, 23 bp, Homo sapiens
gggctgtgcttgaaggccctgct

SEQ ID NO: 2364458 - DNA, 21 bp, Homo sapiens
gggcttcatctctttagagaa

SEQ ID NO: 2364459 - DNA, 15 bp, Homo sapiens
gggcttcctgccctt

SEQ ID NO: 2364460 - DNA, 19 bp, Homo sapiens
gggcttcctgcccttccct

SEQ ID NO: 2364461 - DNA, 15 bp, Homo sapiens
gggcttgaagccaaa

SEQ ID NO: 2364462 - DNA, 16 bp, Homo sapiens
gggcttgtggggcctg

SEQ ID NO: 2364463 - DNA, 23 bp, Homo sapiens
ggggaaaatggccatgcaggagg

SEQ ID NO: 2364464 - DNA, 15 bp, Homo sapiens
ggggaaggccctgag

SEQ ID NO: 2364465 - DNA, 14 bp, Homo sapiens
ggggaggagggggc

SEQ ID NO: 2364466 - DNA, 14 bp, Homo sapiens
ggggatatttccta

SEQ ID NO: 2364467 - DNA, 13 bp, Homo sapiens
ggggatccccgcc

SEQ ID NO: 2364468 - DNA, 23 bp, Homo sapiens
ggggatccccgcctggccaggag

SEQ ID NO: 2364469 - DNA, 15 bp, Homo sapiens
ggggcagagaataaa

SEQ ID NO: 2364470 - DNA, 20 bp, Homo sapiens
ggggcagatcttggactcat

SEQ ID NO: 2364471 - DNA, 12 bp, Homo sapiens
ggggcagggctg

SEQ ID NO: 2364472 - DNA, 19 bp, Homo sapiens
ggggcattgagtattgttt

SEQ ID NO: 2364473 - DNA, 19 bp, Homo sapiens
ggggccaccaaagctgccc

SEQ ID NO: 2364474 - DNA, 15 bp, Homo sapiens
ggggcccccctgccc

SEQ ID NO: 2364475 - DNA, 16 bp, Homo sapiens
ggggcctgggacttcc

SEQ ID NO: 2364476 - DNA, 20 bp, Homo sapiens
ggggctacttatattctgca

SEQ ID NO: 2364477 - DNA, 23 bp, Homo sapiens
ggggctcttcatctgcctgcgct

SEQ ID NO: 2364478 - DNA, 20 bp, Homo sapiens
gggggcatctcttccccaga

SEQ ID NO: 2364479 - DNA, 14 bp, Homo sapiens
ggggtggggagatg

SEQ ID NO: 2364480 - DNA, 18 bp, Homo sapiens
ggggttcctcaaattttt

SEQ ID NO: 2364481 - DNA, 15 bp, Homo sapiens
gggtaaaaagtggct

SEQ ID NO: 2364482 - DNA, 16 bp, Homo sapiens
gggtcctagcccttcc

SEQ ID NO: 2364483 - DNA, 21 bp, Homo sapiens
gggtcctagcccttccctgag

SEQ ID NO: 2364484 - DNA, 18 bp, Homo sapiens
gggtctccctggctccct

SEQ ID NO: 2364485 - DNA, 22 bp, Homo sapiens
gggtctccctggctccctcctc

SEQ ID NO: 2364486 - DNA, 12 bp, Homo sapiens
gggtctgggctg

SEQ ID NO: 2364487 - DNA, 14 bp, Homo sapiens
gggtctgggctggg

SEQ ID NO: 2364488 - DNA, 16 bp, Homo sapiens
gggtctgtctgctttg

SEQ ID NO: 2364489 - DNA, 18 bp, Homo sapiens
gggtcttgctctgtcccc

SEQ ID NO: 2364490 - DNA, 16 bp, Homo sapiens
gggtgaactgcaaagc

SEQ ID NO: 2364491 - DNA, 18 bp, Homo sapiens
gggtgatggccagcccct

SEQ ID NO: 2364492 - DNA, 20 bp, Homo sapiens
gggtgccccgcctgagtcag

SEQ ID NO: 2364493 - DNA, 19 bp, Homo sapiens
gggtgcgtctccagtcatc

SEQ ID NO: 2364494 - DNA, 20 bp, Homo sapiens
gggtgcttttatagaggcta

SEQ ID NO: 2364495 - DNA, 20 bp, Homo sapiens
gggtgggctgctggccatga

SEQ ID NO: 2364496 - DNA, 19 bp, Homo sapiens
gggtgggcttcctgccctt

SEQ ID NO: 2364497 - DNA, 17 bp, Homo sapiens
gggtgtcctgcctgtct

SEQ ID NO: 2364498 - DNA, 22 bp, Homo sapiens
gggtgtcctgcctgtctgcccc

SEQ ID NO: 2364499 - DNA, 21 bp, Homo sapiens
gggtgttctttcctgccctgt

SEQ ID NO: 2364500 - DNA, 22 bp, Homo sapiens
gggttaacccttcatcttcctg

SEQ ID NO: 2364501 - DNA, 14 bp, Homo sapiens
gggttaaggcctga

SEQ ID NO: 2364502 - DNA, 17 bp, Homo sapiens
gggttcctcaaattttt

SEQ ID NO: 2364503 - DNA, 12 bp, Homo sapiens
ggtaaatgtttc

SEQ ID NO: 2364504 - DNA, 13 bp, Homo sapiens
ggtaaatgtttct

SEQ ID NO: 2364505 - DNA, 19 bp, Homo sapiens
ggtaagaatagtagatgtg

SEQ ID NO: 2364506 - DNA, 23 bp, Homo sapiens
ggtaagattgcactgttctgatt

SEQ ID NO: 2364507 - DNA, 16 bp, Homo sapiens
ggtaagtgttctcatg

SEQ ID NO: 2364508 - DNA, 20 bp, Homo sapiens
ggtaatacttccagaagtgc

SEQ ID NO: 2364509 - DNA, 13 bp, Homo sapiens
ggtacagcagggt

SEQ ID NO: 2364510 - DNA, 18 bp, Homo sapiens
ggtactaataatcttgtt

SEQ ID NO: 2364511 - DNA, 14 bp, Homo sapiens
ggtaggggagggca

SEQ ID NO: 2364512 - DNA, 12 bp, Homo sapiens
ggtatcatatat

SEQ ID NO: 2364513 - DNA, 12 bp, Homo sapiens
ggtatgtctgcc

SEQ ID NO: 2364514 - DNA, 13 bp, Homo sapiens
ggtatgtctgcca

SEQ ID NO: 2364515 - DNA, 14 bp, Homo sapiens
ggtcacatccatcc

SEQ ID NO: 2364516 - DNA, 20 bp, Homo sapiens
ggtcacgtttggtgcttctc

SEQ ID NO: 2364517 - DNA, 23 bp, Homo sapiens
ggtcactgaaccactgcttctct

SEQ ID NO: 2364518 - DNA, 13 bp, Homo sapiens
ggtcactggaaag

SEQ ID NO: 2364519 - DNA, 21 bp, Homo sapiens
ggtcagcatgtctattcagct

SEQ ID NO: 2364520 - DNA, 19 bp, Homo sapiens
ggtcaggacggctcctcag

SEQ ID NO: 2364521 - DNA, 18 bp, Homo sapiens
ggtcagtctttgctcagt

SEQ ID NO: 2364522 - DNA, 23 bp, Homo sapiens
ggtcatattcataccttctgatg

SEQ ID NO: 2364523 - DNA, 15 bp, Homo sapiens
ggtcatcagatgcct

SEQ ID NO: 2364524 - DNA, 17 bp, Homo sapiens
ggtcatcatgaaaggtt

SEQ ID NO: 2364525 - DNA, 20 bp, Homo sapiens
ggtccagctggcctggacag

SEQ ID NO: 2364526 - DNA, 22 bp, Homo sapiens
ggtccccgttccaccccaagag

SEQ ID NO: 2364527 - DNA, 14 bp, Homo sapiens
ggtcctagcccttc

SEQ ID NO: 2364528 - DNA, 18 bp, Homo sapiens
ggtcctagcccttccctg

SEQ ID NO: 2364529 - DNA, 19 bp, Homo sapiens
ggtcctagcccttccctga

SEQ ID NO: 2364530 - DNA, 13 bp, Homo sapiens
ggtcctctggagc

SEQ ID NO: 2364531 - DNA, 11 bp, Homo sapiens
ggtctccctgg

SEQ ID NO: 2364532 - DNA, 13 bp, Homo sapiens
ggtctccctggct

SEQ ID NO: 2364533 - DNA, 12 bp, Homo sapiens
ggtctctgaagg

SEQ ID NO: 2364534 - DNA, 15 bp, Homo sapiens
ggtctctgaagggac

SEQ ID NO: 2364535 - DNA, 20 bp, Homo sapiens
ggtctctgctggggaagggt

SEQ ID NO: 2364536 - DNA, 12 bp, Homo sapiens
ggtctggcctgt

SEQ ID NO: 2364537 - DNA, 15 bp, Homo sapiens
ggtctggttgggcag

SEQ ID NO: 2364538 - DNA, 22 bp, Homo sapiens
ggtcttcttacatgcatttgag

SEQ ID NO: 2364539 - DNA, 16 bp, Homo sapiens
ggtcttcttgtgtcct

SEQ ID NO: 2364540 - DNA, 13 bp, Homo sapiens
ggtcttgctctgt

SEQ ID NO: 2364541 - DNA, 14 bp, Homo sapiens
ggtcttgctctgtc

SEQ ID NO: 2364542 - DNA, 15 bp, Homo sapiens
ggtcttgctctgtcc

SEQ ID NO: 2364543 - DNA, 20 bp, Homo sapiens
ggtcttgctctgtcccccag

SEQ ID NO: 2364544 - DNA, 18 bp, Homo sapiens
ggtctttaaaatattgtt

SEQ ID NO: 2364545 - DNA, 15 bp, Homo sapiens
ggtctttgctccaga

SEQ ID NO: 2364546 - DNA, 13 bp, Homo sapiens
ggtcttttcaaat

SEQ ID NO: 2364547 - DNA, 22 bp, Homo sapiens
ggtgaagtcgggtcaaaaataa

SEQ ID NO: 2364548 - DNA, 15 bp, Homo sapiens
ggtgacatgtgaaac

SEQ ID NO: 2364549 - DNA, 18 bp, Homo sapiens
ggtgacatgtgaaacctt

SEQ ID NO: 2364550 - DNA, 22 bp, Homo sapiens
ggtgacggtcctttaggcagcc

SEQ ID NO: 2364551 - DNA, 14 bp, Homo sapiens
ggtgagacagttgc

SEQ ID NO: 2364552 - DNA, 13 bp, Homo sapiens
ggtgaggcccagc

SEQ ID NO: 2364553 - DNA, 14 bp, Homo sapiens
ggtgagggtgcccc

SEQ ID NO: 2364554 - DNA, 16 bp, Homo sapiens
ggtgagggttggcgct

SEQ ID NO: 2364555 - DNA, 20 bp, Homo sapiens
ggtgagtttgagctgccttc

SEQ ID NO: 2364556 - DNA, 16 bp, Homo sapiens
ggtgattacctgaaag

SEQ ID NO: 2364557 - DNA, 16 bp, Homo sapiens
ggtgcacccacctgtt

SEQ ID NO: 2364558 - DNA, 13 bp, Homo sapiens
ggtgcactgggag

SEQ ID NO: 2364559 - DNA, 23 bp, Homo sapiens
ggtgccaatttcaagttccaagt

SEQ ID NO: 2364560 - DNA, 18 bp, Homo sapiens
ggtgccaggctgtaagca

SEQ ID NO: 2364561 - DNA, 14 bp, Homo sapiens
ggtgccagttgggc

SEQ ID NO: 2364562 - DNA, 18 bp, Homo sapiens
ggtgccatgtctgcagtg

SEQ ID NO: 2364563 - DNA, 22 bp, Homo sapiens
ggtgccccccacccctggaaga

SEQ ID NO: 2364564 - DNA, 15 bp, Homo sapiens
ggtgcctgagaggca

SEQ ID NO: 2364565 - DNA, 20 bp, Homo sapiens
ggtgccttacatcttttcta

SEQ ID NO: 2364566 - DNA, 17 bp, Homo sapiens
ggtgcgtctccagtcat

SEQ ID NO: 2364567 - DNA, 12 bp, Homo sapiens
gtccagtgccta

SEQ ID NO: 2364568 - DNA, 14 bp, Homo sapiens
gtccagtgcctaca

SEQ ID NO: 2364569 - DNA, 19 bp, Homo sapiens
gtccagtgctctgcctcag

SEQ ID NO: 2364570 - DNA, 15 bp, Homo sapiens
gtccatagagatgag

SEQ ID NO: 2364571 - DNA, 19 bp, Homo sapiens
gtccatagagatgagccca

SEQ ID NO: 2364572 - DNA, 20 bp, Homo sapiens
gtccatagagatgagcccac

SEQ ID NO: 2364573 - DNA, 21 bp, Homo sapiens
gtccatatcagaactgtgcca

SEQ ID NO: 2364574 - DNA, 19 bp, Homo sapiens
gtccatgctaacaaagaca

SEQ ID NO: 2364575 - DNA, 17 bp, Homo sapiens
gtcccaggccggcccag

SEQ ID NO: 2364576 - DNA, 23 bp, Homo sapiens
gtcccagtgctcaccagccctgc

SEQ ID NO: 2364577 - DNA, 15 bp, Homo sapiens
gtcccatccagctac

SEQ ID NO: 2364578 - DNA, 17 bp, Homo sapiens
gtcccatccagctacca

SEQ ID NO: 2364579 - DNA, 16 bp, Homo sapiens
gtccccacccctgccc

SEQ ID NO: 2364580 - DNA, 17 bp, Homo sapiens
gtccccacccctgcccc

SEQ ID NO: 2364581 - DNA, 16 bp, Homo sapiens
gtccccatttctgcct

SEQ ID NO: 2364582 - DNA, 17 bp, Homo sapiens
gtccccatttctgcctc

SEQ ID NO: 2364583 - DNA, 18 bp, Homo sapiens
gtccccatttctgcctcg

SEQ ID NO: 2364584 - DNA, 21 bp, Homo sapiens
gtcccccccaggccttgtcct

SEQ ID NO: 2364585 - DNA, 23 bp, Homo sapiens
gtcccgcttattctcctccctgt

SEQ ID NO: 2364586 - DNA, 14 bp, Homo sapiens
gtccctcaggttcc

SEQ ID NO: 2364587 - DNA, 11 bp, Homo sapiens
gtccctccctg

SEQ ID NO: 2364588 - DNA, 15 bp, Homo sapiens
gtccctccctgcctg

SEQ ID NO: 2364589 - DNA, 17 bp, Homo sapiens
gtccctccctgcctgag

SEQ ID NO: 2364590 - DNA, 18 bp, Homo sapiens
gtccctgtagctcagtca

SEQ ID NO: 2364591 - DNA, 20 bp, Homo sapiens
gtcctaagtgctaagtgctt

SEQ ID NO: 2364592 - DNA, 20 bp, Homo sapiens
gtcctacgtccaaggtggca

SEQ ID NO: 2364593 - DNA, 19 bp, Homo sapiens
gtcctagcccttccctgag

SEQ ID NO: 2364594 - DNA, 20 bp, Homo sapiens
gtcctagcccttccctgagt

SEQ ID NO: 2364595 - DNA, 14 bp, Homo sapiens
gtcctagtaagaag

SEQ ID NO: 2364596 - DNA, 16 bp, Homo sapiens
gtcctagttgttcagc

SEQ ID NO: 2364597 - DNA, 13 bp, Homo sapiens
gtcctctggagcc

SEQ ID NO: 2364598 - DNA, 12 bp, Homo sapiens
gtcctgcctgtc

SEQ ID NO: 2364599 - DNA, 14 bp, Homo sapiens
gtcctgcctgtctg

SEQ ID NO: 2364600 - DNA, 22 bp, Homo sapiens
gtcctggaatttggacaagtgc

SEQ ID NO: 2364601 - DNA, 13 bp, Homo sapiens
gtcctggaggggc

SEQ ID NO: 2364602 - DNA, 20 bp, Homo sapiens
gtcctggaggggctggggac

SEQ ID NO: 2364603 - DNA, 21 bp, Homo sapiens
gtcctggtacagcagggtctt

SEQ ID NO: 2364604 - DNA, 17 bp, Homo sapiens
gtcctgtttctgtcaag

SEQ ID NO: 2364605 - DNA, 17 bp, Homo sapiens
gtccttaggcctctgag

SEQ ID NO: 2364606 - DNA, 18 bp, Homo sapiens
gtccttaggcctctgaga

SEQ ID NO: 2364607 - DNA, 14 bp, Homo sapiens
gtccttgatttcaa

SEQ ID NO: 2364608 - DNA, 19 bp, Homo sapiens
gtccttgatttcaaagttt

SEQ ID NO: 2364609 - DNA, 14 bp, Homo sapiens
gtccttgctttggg

SEQ ID NO: 2364610 - DNA, 15 bp, Homo sapiens
gtcctttaggcagcc

SEQ ID NO: 2364611 - DNA, 16 bp, Homo sapiens
gtcctttttcctctcc

SEQ ID NO: 2364612 - DNA, 21 bp, Homo sapiens
gtctagactgtttgctgatcc

SEQ ID NO: 2364613 - DNA, 14 bp, Homo sapiens
gtctaggacacagt

SEQ ID NO: 2364614 - DNA, 17 bp, Homo sapiens
gtctattatcacattaa

SEQ ID NO: 2364615 - DNA, 21 bp, Homo sapiens
gtctcaaacttgtggcctcaa

SEQ ID NO: 2364616 - DNA, 14 bp, Homo sapiens
gtctcactgcttga

SEQ ID NO: 2364617 - DNA, 18 bp, Homo sapiens
gtctcactttactttcaa

SEQ ID NO: 2364618 - DNA, 19 bp, Homo sapiens
gtctcactttactttcaag

SEQ ID NO: 2364619 - DNA, 16 bp, Homo sapiens
gtctcaggcagcacca

SEQ ID NO: 2364620 - DNA, 19 bp, Homo sapiens
gtctcccatatgcagaaat

SEQ ID NO: 2364621 - DNA, 18 bp, Homo sapiens
gtctccctcccctctcag

SEQ ID NO: 2364622 - DNA, 20 bp, Homo sapiens
gtctccctcccctctcagaa

SEQ ID NO: 2364623 - DNA, 14 bp, Homo sapiens
gtctccctggctcc

SEQ ID NO: 2364624 - DNA, 14 bp, Homo sapiens
gtctcgtctctttt

SEQ ID NO: 2364625 - DNA, 20 bp, Homo sapiens
gtctcgttttgttgccaaag

SEQ ID NO: 2364626 - DNA, 23 bp, Homo sapiens
gtctcgttttgttgccaaagctg

SEQ ID NO: 2364627 - DNA, 19 bp, Homo sapiens
gtctctcttctcagagtgg

SEQ ID NO: 2364628 - DNA, 23 bp, Homo sapiens
gtctctgtcccggttcaccttgc

SEQ ID NO: 2364629 - DNA, 21 bp, Homo sapiens
gtctctgttaacatctagcct

SEQ ID NO: 2364630 - DNA, 14 bp, Homo sapiens
gtctcttctgagct

SEQ ID NO: 2364631 - DNA, 22 bp, Homo sapiens
gtctcttctgagctatttcatc

SEQ ID NO: 2364632 - DNA, 20 bp, Homo sapiens
gtctcttttaccctggcccc

SEQ ID NO: 2364633 - DNA, 22 bp, Homo sapiens
gtctcttttaccctggcccctc

SEQ ID NO: 2364634 - DNA, 18 bp, Homo sapiens
gtctgaagaaggaaggcc

SEQ ID NO: 2364635 - DNA, 17 bp, Homo sapiens
gtctgcccacgcagagg

SEQ ID NO: 2364636 - DNA, 18 bp, Homo sapiens
gtctgcccacgcagagga

SEQ ID NO: 2364637 - DNA, 19 bp, Homo sapiens
gtctgcccacgcagaggac

SEQ ID NO: 2364638 - DNA, 13 bp, Homo sapiens
gtctgccccaccc

SEQ ID NO: 2364639 - DNA, 14 bp, Homo sapiens
gtctgccccaccct

SEQ ID NO: 2364640 - DNA, 12 bp, Homo sapiens
gtctgccccagc

SEQ ID NO: 2364641 - DNA, 23 bp, Homo sapiens
gtctgccggacccggaggccgag

SEQ ID NO: 2364642 - DNA, 14 bp, Homo sapiens
gtctgctctggtgg

SEQ ID NO: 2364643 - DNA, 15 bp, Homo sapiens
gtctgggctgggcac

SEQ ID NO: 2364644 - DNA, 18 bp, Homo sapiens
gtctggttgggcagccag

SEQ ID NO: 2364645 - DNA, 20 bp, Homo sapiens
gtctgtacacgtgtcctgta

SEQ ID NO: 2364646 - DNA, 21 bp, Homo sapiens
gtctgtacacgtgtcctgtag

SEQ ID NO: 2364647 - DNA, 15 bp, Homo sapiens
gtctgtcccttttct

SEQ ID NO: 2364648 - DNA, 18 bp, Homo sapiens
gtctgtgaacagagagac

SEQ ID NO: 2364649 - DNA, 13 bp, Homo sapiens
gtctgtgataaca

SEQ ID NO: 2364650 - DNA, 16 bp, Homo sapiens
gtctgtgataacagag

SEQ ID NO: 2364651 - DNA, 14 bp, Homo sapiens
gtcttaaaaattta

SEQ ID NO: 2364652 - DNA, 18 bp, Homo sapiens
gtcttatgtgaaaaatta

SEQ ID NO: 2364653 - DNA, 11 bp, Homo sapiens
gtcttccctgg

SEQ ID NO: 2364654 - DNA, 18 bp, Homo sapiens
gtcttccctgggctgcca

SEQ ID NO: 2364655 - DNA, 16 bp, Homo sapiens
gtcttcttgtgtcctg

SEQ ID NO: 2364656 - DNA, 17 bp, Homo sapiens
gtcttcttgtgtcctga

SEQ ID NO: 2364657 - DNA, 19 bp, Homo sapiens
gtcttcttgtgtcctgatg

SEQ ID NO: 2364658 - DNA, 15 bp, Homo sapiens
gtcttggacactgta

SEQ ID NO: 2364659 - DNA, 15 bp, Homo sapiens
gtcttggatatatag

SEQ ID NO: 2364660 - DNA, 19 bp, Homo sapiens
gtcttgtatttaaaaacat

SEQ ID NO: 2364661 - DNA, 21 bp, Homo sapiens
gtctttccctttaccactgtg

SEQ ID NO: 2364662 - DNA, 15 bp, Homo sapiens
gtcttttcagaagca

SEQ ID NO: 2364663 - DNA, 13 bp, Homo sapiens
gtgaaaccttttt

SEQ ID NO: 2364664 - DNA, 21 bp, Homo sapiens
gtgaaaccttttttaagattt

SEQ ID NO: 2364665 - DNA, 22 bp, Homo sapiens
gtgaaaccttttttaagatttt

SEQ ID NO: 2364666 - DNA, 15 bp, Homo sapiens
gtgaaattaagcatt

SEQ ID NO: 2364667 - DNA, 15 bp, Homo sapiens
gtgaacattcccagc

SEQ ID NO: 2364668 - DNA, 14 bp, Homo sapiens
gtgaaccctggggc

SEQ ID NO: 2364669 - DNA, 18 bp, Homo sapiens
gtgaaccctggggcctga

SEQ ID NO: 2364670 - DNA, 15 bp, Homo sapiens
gtgaactgcaaagct

SEQ ID NO: 2364671 - DNA, 12 bp, Homo sapiens
gtgaagaaataa

SEQ ID NO: 2364672 - DNA, 19 bp, Homo sapiens
gtgaagatctcactctgcc

SEQ ID NO: 2364673 - DNA, 14 bp, Homo sapiens
gtgaagctaatgtc

SEQ ID NO: 2364674 - DNA, 14 bp, Homo sapiens
gtgaatataaatga

SEQ ID NO: 2364675 - DNA, 16 bp, Homo sapiens
gtgaattattgacact

SEQ ID NO: 2364676 - DNA, 11 bp, Homo sapiens
gtgaattttta

SEQ ID NO: 2364677 - DNA, 23 bp, Homo sapiens
gtgacacccagagggagtagaat

SEQ ID NO: 2364678 - DNA, 13 bp, Homo sapiens
gtgacagctttct

SEQ ID NO: 2364679 - DNA, 19 bp, Homo sapiens
gtgacagctttctgggatg

SEQ ID NO: 2364680 - DNA, 18 bp, Homo sapiens
gtgacagtgcctcttcca

SEQ ID NO: 2364681 - DNA, 16 bp, Homo sapiens
gtgacagtttccaaat

SEQ ID NO: 2364682 - DNA, 16 bp, Homo sapiens
gtttttaagtcctgta

SEQ ID NO: 2364683 - DNA, 19 bp, Homo sapiens
gtttttaataaaagaaaat

SEQ ID NO: 2364684 - DNA, 23 bp, Homo sapiens
gtttttagaacatgtaaaatgtt

SEQ ID NO: 2364685 - DNA, 13 bp, Homo sapiens
gtttttccctccc

SEQ ID NO: 2364686 - DNA, 15 bp, Homo sapiens
gtttttcctttaaaa

SEQ ID NO: 2364687 - DNA, 14 bp, Homo sapiens
gtttttgtttactg

SEQ ID NO: 2364688 - DNA, 15 bp, Homo sapiens
gtttttgtttggaga

SEQ ID NO: 2364689 - DNA, 19 bp, Homo sapiens
gtttttttcttctgtattt

SEQ ID NO: 2364690 - DNA, 17 bp, Homo sapiens
gtttttttgttattaaa

SEQ ID NO: 2364691 - DNA, 15 bp, Homo sapiens
taaaaaaaaaagtca

SEQ ID NO: 2364692 - DNA, 16 bp, Homo sapiens
taaaaaaaaatgcctt

SEQ ID NO: 2364693 - DNA, 15 bp, Homo sapiens
taaaaaaaaattgta

SEQ ID NO: 2364694 - DNA, 14 bp, Homo sapiens
taaaaaaatgtttt

SEQ ID NO: 2364695 - DNA, 19 bp, Homo sapiens
taaaaaaatgtttttagaa

SEQ ID NO: 2364696 - DNA, 13 bp, Homo sapiens
taaaaaagagaca

SEQ ID NO: 2364697 - DNA, 18 bp, Homo sapiens
taaaaaagctcttttaat

SEQ ID NO: 2364698 - DNA, 11 bp, Homo sapiens
taaaaaatgtc

SEQ ID NO: 2364699 - DNA, 12 bp, Homo sapiens
taaaaaatgtct

SEQ ID NO: 2364700 - DNA, 18 bp, Homo sapiens
taaaaacaactttcactt

SEQ ID NO: 2364701 - DNA, 17 bp, Homo sapiens
taaaaacagcagctcat

SEQ ID NO: 2364702 - DNA, 20 bp, Homo sapiens
taaaaagattgaagtatttt

SEQ ID NO: 2364703 - DNA, 16 bp, Homo sapiens
taaaaaggtaaatggt

SEQ ID NO: 2364704 - DNA, 13 bp, Homo sapiens
taaaaagtataaa

SEQ ID NO: 2364705 - DNA, 16 bp, Homo sapiens
taaaaagtatatgtta

SEQ ID NO: 2364706 - DNA, 12 bp, Homo sapiens
taaaaatgttac

SEQ ID NO: 2364707 - DNA, 22 bp, Homo sapiens
taaaaattacctttaattttaa

SEQ ID NO: 2364708 - DNA, 19 bp, Homo sapiens
taaaacaaatatacatttt

SEQ ID NO: 2364709 - DNA, 21 bp, Homo sapiens
taaaacaaatatacattttct

SEQ ID NO: 2364710 - DNA, 22 bp, Homo sapiens
taaaacaaatatacattttcta

SEQ ID NO: 2364711 - DNA, 19 bp, Homo sapiens
taaaacagaatcttctggg

SEQ ID NO: 2364712 - DNA, 15 bp, Homo sapiens
taaaacagacactgg

SEQ ID NO: 2364713 - DNA, 17 bp, Homo sapiens
taaaacagacactggca

SEQ ID NO: 2364714 - DNA, 18 bp, Homo sapiens
taaaacccgttgattact

SEQ ID NO: 2364715 - DNA, 15 bp, Homo sapiens
taaaaccctatacaa

SEQ ID NO: 2364716 - DNA, 23 bp, Homo sapiens
taaaacggtgctgtgagggaggg

SEQ ID NO: 2364717 - DNA, 23 bp, Homo sapiens
taaaacgttagttaatccctttg

SEQ ID NO: 2364718 - DNA, 16 bp, Homo sapiens
taaaactcactgtgat

SEQ ID NO: 2364719 - DNA, 19 bp, Homo sapiens
taaaagcatttttattata

SEQ ID NO: 2364720 - DNA, 22 bp, Homo sapiens
taaaagcatttttattatattt

SEQ ID NO: 2364721 - DNA, 16 bp, Homo sapiens
taaaagcccatgctta

SEQ ID NO: 2364722 - DNA, 15 bp, Homo sapiens
taaaaggatgtataa

SEQ ID NO: 2364723 - DNA, 16 bp, Homo sapiens
taaaaggatgtataaa

SEQ ID NO: 2364724 - DNA, 22 bp, Homo sapiens
taaaaggcccatagcagccagt

SEQ ID NO: 2364725 - DNA, 20 bp, Homo sapiens
taaaagtgaagtgaatctga

SEQ ID NO: 2364726 - DNA, 21 bp, Homo sapiens
taaaagtgaagtgaatctgat

SEQ ID NO: 2364727 - DNA, 18 bp, Homo sapiens
taaaagtggtctctgctg

SEQ ID NO: 2364728 - DNA, 20 bp, Homo sapiens
taaaagtgtgtaaatgctta

SEQ ID NO: 2364729 - DNA, 14 bp, Homo sapiens
taaaataaaatgaa

SEQ ID NO: 2364730 - DNA, 16 bp, Homo sapiens
taaaataaaatgaaaa

SEQ ID NO: 2364731 - DNA, 17 bp, Homo sapiens
taaaataaaatgaaaat

SEQ ID NO: 2364732 - DNA, 20 bp, Homo sapiens
taaaataaaatgaaaattgt

SEQ ID NO: 2364733 - DNA, 21 bp, Homo sapiens
taaaataaaatgaaaattgta

SEQ ID NO: 2364734 - DNA, 22 bp, Homo sapiens
taaaataattcatatctaaata

SEQ ID NO: 2364735 - DNA, 15 bp, Homo sapiens
taaaatactattgcc

SEQ ID NO: 2364736 - DNA, 19 bp, Homo sapiens
taaaatagaaattttgtaa

SEQ ID NO: 2364737 - DNA, 19 bp, Homo sapiens
taaaatagaataattcttt

SEQ ID NO: 2364738 - DNA, 19 bp, Homo sapiens
taaaatatcataaagcatt

SEQ ID NO: 2364739 - DNA, 14 bp, Homo sapiens
taaaatatctattt

SEQ ID NO: 2364740 - DNA, 17 bp, Homo sapiens
taaaatatctatttgaa

SEQ ID NO: 2364741 - DNA, 18 bp, Homo sapiens
taaaatattgttttccta

SEQ ID NO: 2364742 - DNA, 20 bp, Homo sapiens
taaaatattgttttcctaca

SEQ ID NO: 2364743 - DNA, 16 bp, Homo sapiens
taaaatgaaaattgta

SEQ ID NO: 2364744 - DNA, 13 bp, Homo sapiens
taaaatggaaaat

SEQ ID NO: 2364745 - DNA, 19 bp, Homo sapiens
taaaatggcatttagcaca

SEQ ID NO: 2364746 - DNA, 23 bp, Homo sapiens
taaaatggggataataatactga

SEQ ID NO: 2364747 - DNA, 15 bp, Homo sapiens
taaaatgtaatttaa

SEQ ID NO: 2364748 - DNA, 16 bp, Homo sapiens
taaaatgtaatttaaa

SEQ ID NO: 2364749 - DNA, 21 bp, Homo sapiens
taaaatgtaatttaaatgaaa

SEQ ID NO: 2364750 - DNA, 19 bp, Homo sapiens
taaaatgtatatttttaaa

SEQ ID NO: 2364751 - DNA, 20 bp, Homo sapiens
taaaatgtgtatttttcaag

SEQ ID NO: 2364752 - DNA, 22 bp, Homo sapiens
taaaattcagtttttttccagt

SEQ ID NO: 2364753 - DNA, 23 bp, Homo sapiens
taaaattgagtttgtagaacttt

SEQ ID NO: 2364754 - DNA, 19 bp, Homo sapiens
taaaattttgtatgttaaa

SEQ ID NO: 2364755 - DNA, 22 bp, Homo sapiens
taaaatttttatgtaattatat

SEQ ID NO: 2364756 - DNA, 23 bp, Homo sapiens
taaacaaagtttcagagtatatt

SEQ ID NO: 2364757 - DNA, 14 bp, Homo sapiens
taaacagaaatgga

SEQ ID NO: 2364758 - DNA, 17 bp, Homo sapiens
taaacagtaagatatct

SEQ ID NO: 2364759 - DNA, 22 bp, Homo sapiens
taaacatgaaaacacttgaaat

SEQ ID NO: 2364760 - DNA, 16 bp, Homo sapiens
taaaccaaaaacattt

SEQ ID NO: 2364761 - DNA, 17 bp, Homo sapiens
taaaccaaaaacatttg

SEQ ID NO: 2364762 - DNA, 15 bp, Homo sapiens
taaaccaaggactga

SEQ ID NO: 2364763 - DNA, 21 bp, Homo sapiens
taaaccagaacccagtgtttc

SEQ ID NO: 2364764 - DNA, 15 bp, Homo sapiens
taaacccaaaatata

SEQ ID NO: 2364765 - DNA, 16 bp, Homo sapiens
taaacccaaaatatat

SEQ ID NO: 2364766 - DNA, 16 bp, Homo sapiens
taaacggttcctggtg

SEQ ID NO: 2364767 - DNA, 17 bp, Homo sapiens
taaacggttcctggtga

SEQ ID NO: 2364768 - DNA, 17 bp, Homo sapiens
taaactaaaaactaaca

SEQ ID NO: 2364769 - DNA, 19 bp, Homo sapiens
taaactagcaatgcctgag

SEQ ID NO: 2364770 - DNA, 20 bp, Homo sapiens
taaactatgttcctaacaaa

SEQ ID NO: 2364771 - DNA, 23 bp, Homo sapiens
taaactatgttcctaacaaaatg

SEQ ID NO: 2364772 - DNA, 18 bp, Homo sapiens
taaactattagagtattt

SEQ ID NO: 2364773 - DNA, 22 bp, Homo sapiens
taaactattagagtatttccct

SEQ ID NO: 2364774 - DNA, 14 bp, Homo sapiens
taaactcagatctg

SEQ ID NO: 2364775 - DNA, 15 bp, Homo sapiens
taaactcagatctga

SEQ ID NO: 2364776 - DNA, 15 bp, Homo sapiens
taaactgtgtacata

SEQ ID NO: 2364777 - DNA, 15 bp, Homo sapiens
taaacttaaaattac

SEQ ID NO: 2364778 - DNA, 17 bp, Homo sapiens
taaacttaaagctactg

SEQ ID NO: 2364779 - DNA, 17 bp, Homo sapiens
taaacttccaaagaaag

SEQ ID NO: 2364780 - DNA, 17 bp, Homo sapiens
taaacttgtttgctgtg

SEQ ID NO: 2364781 - DNA, 14 bp, Homo sapiens
taaagaaagcagaa

SEQ ID NO: 2364782 - DNA, 15 bp, Homo sapiens
taaagaaaggaaaag

SEQ ID NO: 2364783 - DNA, 23 bp, Homo sapiens
taaagaaaggaaaagaaaacaaa

SEQ ID NO: 2364784 - DNA, 16 bp, Homo sapiens
taaagaccagaaattc

SEQ ID NO: 2364785 - DNA, 12 bp, Homo sapiens
taaagagaatga

SEQ ID NO: 2364786 - DNA, 20 bp, Homo sapiens
taaagagcatctgattcttg

SEQ ID NO: 2364787 - DNA, 15 bp, Homo sapiens
taaagagcccttgcc

SEQ ID NO: 2364788 - DNA, 16 bp, Homo sapiens
taaagagcccttgcct

SEQ ID NO: 2364789 - DNA, 19 bp, Homo sapiens
taaagagcccttgcctccc

SEQ ID NO: 2364790 - DNA, 22 bp, Homo sapiens
taaagatattgtatctccttta

SEQ ID NO: 2364791 - DNA, 24 bp, Homo sapiens
taaagatattgtatctcctttaat

SEQ ID NO: 2364792 - DNA, 22 bp, Homo sapiens
taaagatatttttatctttata

SEQ ID NO: 2364793 - DNA, 20 bp, Homo sapiens
taaagatctttttttaagtg

SEQ ID NO: 2364794 - DNA, 22 bp, Homo sapiens
taaagatctttttttaagtgtt

SEQ ID NO: 2364795 - DNA, 21 bp, Homo sapiens
taaagcatcaccactcatttt

SEQ ID NO: 2364796 - DNA, 16 bp, Homo sapiens
tagattttattatgtt

SEQ ID NO: 2364797 - DNA, 15 bp, Homo sapiens
tagcaactaatgttt

SEQ ID NO: 2364798 - DNA, 18 bp, Homo sapiens
tagcaactgctggggaga

SEQ ID NO: 2364799 - DNA, 12 bp, Homo sapiens
tagcacagcagc

SEQ ID NO: 2364800 - DNA, 17 bp, Homo sapiens
tagcaccttcagggctg

SEQ ID NO: 2364801 - DNA, 16 bp, Homo sapiens
tagcactgagctcaca

SEQ ID NO: 2364802 - DNA, 15 bp, Homo sapiens
tagcagatttaagat

SEQ ID NO: 2364803 - DNA, 15 bp, Homo sapiens
tagcaggctgttcca

SEQ ID NO: 2364804 - DNA, 16 bp, Homo sapiens
tagcatgaaataaaat

SEQ ID NO: 2364805 - DNA, 14 bp, Homo sapiens
tagcatgacaggct

SEQ ID NO: 2364806 - DNA, 16 bp, Homo sapiens
tagcatgcttcctttc

SEQ ID NO: 2364807 - DNA, 18 bp, Homo sapiens
tagcatgcttcctttctc

SEQ ID NO: 2364808 - DNA, 23 bp, Homo sapiens
tagcatgcttcctttctctcctg

SEQ ID NO: 2364809 - DNA, 17 bp, Homo sapiens
tagcatgtatgaatgta

SEQ ID NO: 2364810 - DNA, 15 bp, Homo sapiens
tagccaaagatttca

SEQ ID NO: 2364811 - DNA, 21 bp, Homo sapiens
tagccaatgtctcctcccctt

SEQ ID NO: 2364812 - DNA, 15 bp, Homo sapiens
tagccacagctgctg

SEQ ID NO: 2364813 - DNA, 20 bp, Homo sapiens
tagccagacaaaatttgaga

SEQ ID NO: 2364814 - DNA, 21 bp, Homo sapiens
tagccagacaaaatttgagaa

SEQ ID NO: 2364815 - DNA, 15 bp, Homo sapiens
tagccaggatcatgg

SEQ ID NO: 2364816 - DNA, 18 bp, Homo sapiens
tagccaggatcatggtgt

SEQ ID NO: 2364817 - DNA, 15 bp, Homo sapiens
tagcccttccctgag

SEQ ID NO: 2364818 - DNA, 24 bp, Homo sapiens
tagcctaaagtatacaactgcctg

SEQ ID NO: 2364819 - DNA, 18 bp, Homo sapiens
tagcctttacctgtgaag

SEQ ID NO: 2364820 - DNA, 20 bp, Homo sapiens
tagcgctggcttcattctca

SEQ ID NO: 2364821 - DNA, 19 bp, Homo sapiens
tagcgttgttttgtggata

SEQ ID NO: 2364822 - DNA, 19 bp, Homo sapiens
tagctaagatataatttaa

SEQ ID NO: 2364823 - DNA, 13 bp, Homo sapiens
tagctaattattt

SEQ ID NO: 2364824 - DNA, 17 bp, Homo sapiens
tagctcactgcagcctc

SEQ ID NO: 2364825 - DNA, 16 bp, Homo sapiens
tagctcaggtgcctta

SEQ ID NO: 2364826 - DNA, 19 bp, Homo sapiens
tagctcctccccttcctct

SEQ ID NO: 2364827 - DNA, 18 bp, Homo sapiens
tagctctgaatgctattt

SEQ ID NO: 2364828 - DNA, 22 bp, Homo sapiens
tagctgaagaattgaaaagttt

SEQ ID NO: 2364829 - DNA, 16 bp, Homo sapiens
tagctgggaaagcata

SEQ ID NO: 2364830 - DNA, 22 bp, Homo sapiens
tagctgtcctttttcctctcca

SEQ ID NO: 2364831 - DNA, 19 bp, Homo sapiens
tagctgttctaattaagaa

SEQ ID NO: 2364832 - DNA, 13 bp, Homo sapiens
tagcttctgcttt

SEQ ID NO: 2364833 - DNA, 14 bp, Homo sapiens
tagctttttaattg

SEQ ID NO: 2364834 - DNA, 15 bp, Homo sapiens
tagctttttaattgt

SEQ ID NO: 2364835 - DNA, 23 bp, Homo sapiens
taggaaatggctttgtgattcaa

SEQ ID NO: 2364836 - DNA, 22 bp, Homo sapiens
taggaaccgtggtatgtctgcc

SEQ ID NO: 2364837 - DNA, 20 bp, Homo sapiens
taggaagggatctgagaaca

SEQ ID NO: 2364838 - DNA, 17 bp, Homo sapiens
taggaatcattcagaaa

SEQ ID NO: 2364839 - DNA, 14 bp, Homo sapiens
taggaatctcttca

SEQ ID NO: 2364840 - DNA, 22 bp, Homo sapiens
taggaatctcttcactaccctg

SEQ ID NO: 2364841 - DNA, 14 bp, Homo sapiens
taggactgcagtgt

SEQ ID NO: 2364842 - DNA, 22 bp, Homo sapiens
taggagaggatgagagcccaga

SEQ ID NO: 2364843 - DNA, 24 bp, Homo sapiens
taggaggaaacagttctcactggg

SEQ ID NO: 2364844 - DNA, 22 bp, Homo sapiens
taggagttaacccctgcgctct

SEQ ID NO: 2364845 - DNA, 21 bp, Homo sapiens
taggatccagtgatccttaca

SEQ ID NO: 2364846 - DNA, 17 bp, Homo sapiens
taggccgagctgtggac

SEQ ID NO: 2364847 - DNA, 15 bp, Homo sapiens
tagggaactggggaa

SEQ ID NO: 2364848 - DNA, 15 bp, Homo sapiens
tagggaagcagggac

SEQ ID NO: 2364849 - DNA, 21 bp, Homo sapiens
tagggaatgagagttccttct

SEQ ID NO: 2364850 - DNA, 15 bp, Homo sapiens
tagggggctttctgg

SEQ ID NO: 2364851 - DNA, 15 bp, Homo sapiens
taggtgccaggctgt

SEQ ID NO: 2364852 - DNA, 15 bp, Homo sapiens
taggttcccctgtca

SEQ ID NO: 2364853 - DNA, 16 bp, Homo sapiens
tagtaaatcagaaagt

SEQ ID NO: 2364854 - DNA, 23 bp, Homo sapiens
tagtaacaatacatgagaaagat

SEQ ID NO: 2364855 - DNA, 17 bp, Homo sapiens
tagtaactataagatac

SEQ ID NO: 2364856 - DNA, 20 bp, Homo sapiens
tagtagttaaataactgtgt

SEQ ID NO: 2364857 - DNA, 14 bp, Homo sapiens
tagtagtttgggtg

SEQ ID NO: 2364858 - DNA, 19 bp, Homo sapiens
tagtatagaagtctggaaa

SEQ ID NO: 2364859 - DNA, 23 bp, Homo sapiens
tagtattatcttgttcaggaaaa

SEQ ID NO: 2364860 - DNA, 21 bp, Homo sapiens
tagtcacatggcctatgcaca

SEQ ID NO: 2364861 - DNA, 23 bp, Homo sapiens
tagtcacatggcctatgcacata

SEQ ID NO: 2364862 - DNA, 15 bp, Homo sapiens
tagtcaccagagact

SEQ ID NO: 2364863 - DNA, 20 bp, Homo sapiens
tagtcactggcatactgaga

SEQ ID NO: 2364864 - DNA, 20 bp, Homo sapiens
tagtcccatttttctcttgc

SEQ ID NO: 2364865 - DNA, 18 bp, Homo sapiens
tagtccctcatgcaaatc

SEQ ID NO: 2364866 - DNA, 19 bp, Homo sapiens
tagtctctgccctcataga

SEQ ID NO: 2364867 - DNA, 11 bp, Homo sapiens
tagtcttggaa

SEQ ID NO: 2364868 - DNA, 19 bp, Homo sapiens
tagtggtctttgtaagagt

SEQ ID NO: 2364869 - DNA, 20 bp, Homo sapiens
tagtgtccataaataaagtt

SEQ ID NO: 2364870 - DNA, 11 bp, Homo sapiens
tagtgtgaaat

SEQ ID NO: 2364871 - DNA, 20 bp, Homo sapiens
tagtgtgacagtttccaaat

SEQ ID NO: 2364872 - DNA, 17 bp, Homo sapiens
tagttaaagaaaggaaa

SEQ ID NO: 2364873 - DNA, 17 bp, Homo sapiens
tagttaaataactgtgt

SEQ ID NO: 2364874 - DNA, 14 bp, Homo sapiens
tagttaatataaat

SEQ ID NO: 2364875 - DNA, 17 bp, Homo sapiens
tagttaatataaatgtt

SEQ ID NO: 2364876 - DNA, 12 bp, Homo sapiens
tagttactaaaa

SEQ ID NO: 2364877 - DNA, 20 bp, Homo sapiens
tagttactaaaatttacaca

SEQ ID NO: 2364878 - DNA, 19 bp, Homo sapiens
tagttcaatatttgttact

SEQ ID NO: 2364879 - DNA, 18 bp, Homo sapiens
tagttccagtttctcctt

SEQ ID NO: 2364880 - DNA, 12 bp, Homo sapiens
tagttgaggccg

SEQ ID NO: 2364881 - DNA, 23 bp, Homo sapiens
tagttgaggccgaggataaagaa

SEQ ID NO: 2364882 - DNA, 21 bp, Homo sapiens
tagttgcaaagagacatttca

SEQ ID NO: 2364883 - DNA, 20 bp, Homo sapiens
tagttgcatagcagtatatg

SEQ ID NO: 2364884 - DNA, 22 bp, Homo sapiens
tagttgcgtggactctgcacat

SEQ ID NO: 2364885 - DNA, 21 bp, Homo sapiens
tagttgggatgccaatttcct

SEQ ID NO: 2364886 - DNA, 20 bp, Homo sapiens
tagttgtagacaaagtacat

SEQ ID NO: 2364887 - DNA, 15 bp, Homo sapiens
tagtttagttctgtt

SEQ ID NO: 2364888 - DNA, 17 bp, Homo sapiens
tagtttctttattttgt

SEQ ID NO: 2364889 - DNA, 14 bp, Homo sapiens
tagtttgtgagaaa

SEQ ID NO: 2364890 - DNA, 15 bp, Homo sapiens
tagtttgtgagaaac

SEQ ID NO: 2364891 - DNA, 11 bp, Homo sapiens
tagttttatgc

SEQ ID NO: 2364892 - DNA, 14 bp, Homo sapiens
tataaaaaatcttt

SEQ ID NO: 2364893 - DNA, 12 bp, Homo sapiens
tataaactcatt

SEQ ID NO: 2364894 - DNA, 17 bp, Homo sapiens
tataaatgatgattgaa

SEQ ID NO: 2364895 - DNA, 13 bp, Homo sapiens
tataaatgtacat

SEQ ID NO: 2364896 - DNA, 16 bp, Homo sapiens
tataaatgtataaata

SEQ ID NO: 2364897 - DNA, 20 bp, Homo sapiens
tataaatgtataaatataca

SEQ ID NO: 2364898 - DNA, 14 bp, Homo sapiens
tataacacattttt

SEQ ID NO: 2364899 - DNA, 22 bp, Homo sapiens
tataacacatttttttgcatgc

SEQ ID NO: 2364900 - DNA, 23 bp, Homo sapiens
tataacacatttttttgcatgca

SEQ ID NO: 2364901 - DNA, 15 bp, Homo sapiens
tataacataaaagca

SEQ ID NO: 2364902 - DNA, 17 bp, Homo sapiens
tataacctagttaaaga

SEQ ID NO: 2364903 - DNA, 20 bp, Homo sapiens
tataacctagttaaagaaag

SEQ ID NO: 2364904 - DNA, 22 bp, Homo sapiens
tataactcaaggataccttctt

SEQ ID NO: 2364905 - DNA, 15 bp, Homo sapiens
tataagacatttgtt

SEQ ID NO: 2364906 - DNA, 19 bp, Homo sapiens
tataagacatttgtttgct

SEQ ID NO: 2364907 - DNA, 15 bp, Homo sapiens
tataatgaataaatc

SEQ ID NO: 2364908 - DNA, 20 bp, Homo sapiens
tataatgtttattaaatgct

SEQ ID NO: 2364909 - DNA, 14 bp, Homo sapiens
tataattggaagtg

SEQ ID NO: 2364910 - DNA, 14 bp, Homo sapiens
tcagtcatcaaagc

SEQ ID NO: 2364911 - DNA, 14 bp, Homo sapiens
tcagtcatgcataa

SEQ ID NO: 2364912 - DNA, 15 bp, Homo sapiens
tcagtcatgcataaa

SEQ ID NO: 2364913 - DNA, 11 bp, Homo sapiens
tcagtcccctc

SEQ ID NO: 2364914 - DNA, 15 bp, Homo sapiens
tcagtctttgctcag

SEQ ID NO: 2364915 - DNA, 21 bp, Homo sapiens
tcagtgagcctcctgtgcctg

SEQ ID NO: 2364916 - DNA, 15 bp, Homo sapiens
tcagtgccctccagc

SEQ ID NO: 2364917 - DNA, 13 bp, Homo sapiens
tcagttacagtgg

SEQ ID NO: 2364918 - DNA, 16 bp, Homo sapiens
tcagttacccactcgg

SEQ ID NO: 2364919 - DNA, 16 bp, Homo sapiens
tcagttctaggaaaat

SEQ ID NO: 2364920 - DNA, 13 bp, Homo sapiens
tcagttgcttgtc

SEQ ID NO: 2364921 - DNA, 18 bp, Homo sapiens
tcagttgtgttttttaag

SEQ ID NO: 2364922 - DNA, 15 bp, Homo sapiens
tcagtttgttggaaa

SEQ ID NO: 2364923 - DNA, 16 bp, Homo sapiens
tcagtttgttggaaag

SEQ ID NO: 2364924 - DNA, 16 bp, Homo sapiens
tcataaaatagaataa

SEQ ID NO: 2364925 - DNA, 12 bp, Homo sapiens
tcataaactttt

SEQ ID NO: 2364926 - DNA, 22 bp, Homo sapiens
tcataaattatttgattattta

SEQ ID NO: 2364927 - DNA, 13 bp, Homo sapiens
tcataataaattt

SEQ ID NO: 2364928 - DNA, 14 bp, Homo sapiens
tcataataaatttt

SEQ ID NO: 2364929 - DNA, 14 bp, Homo sapiens
tcataatcagtaaa

SEQ ID NO: 2364930 - DNA, 18 bp, Homo sapiens
tcataatcagtaaatagt

SEQ ID NO: 2364931 - DNA, 20 bp, Homo sapiens
tcataatcagtaaatagtgt

SEQ ID NO: 2364932 - DNA, 14 bp, Homo sapiens
tcataatgtgagat

SEQ ID NO: 2364933 - DNA, 19 bp, Homo sapiens
tcataatttttgcagaaaa

SEQ ID NO: 2364934 - DNA, 15 bp, Homo sapiens
tcatacaaactctca

SEQ ID NO: 2364935 - DNA, 18 bp, Homo sapiens
tcatacaaactctcacca

SEQ ID NO: 2364936 - DNA, 23 bp, Homo sapiens
tcatagagttgattgtctagtga

SEQ ID NO: 2364937 - DNA, 18 bp, Homo sapiens
tcatagctcactgcagcc

SEQ ID NO: 2364938 - DNA, 22 bp, Homo sapiens
tcatagctcactgcagcctcat

SEQ ID NO: 2364939 - DNA, 20 bp, Homo sapiens
tcataggttaaaaaaaaaag

SEQ ID NO: 2364940 - DNA, 12 bp, Homo sapiens
tcatataagaca

SEQ ID NO: 2364941 - DNA, 17 bp, Homo sapiens
tcatatatatcacccag

SEQ ID NO: 2364942 - DNA, 14 bp, Homo sapiens
tcatatatcaagaa

SEQ ID NO: 2364943 - DNA, 14 bp, Homo sapiens
tcatatctaacttt

SEQ ID NO: 2364944 - DNA, 16 bp, Homo sapiens
tcatatctaactttgt

SEQ ID NO: 2364945 - DNA, 13 bp, Homo sapiens
tcatcaacaagat

SEQ ID NO: 2364946 - DNA, 13 bp, Homo sapiens
tcatcaagagaat

SEQ ID NO: 2364947 - DNA, 19 bp, Homo sapiens
tcatcaccatttcctcctt

SEQ ID NO: 2364948 - DNA, 13 bp, Homo sapiens
tcatcagatgcct

SEQ ID NO: 2364949 - DNA, 23 bp, Homo sapiens
tcatcccaacctctttttcctcc

SEQ ID NO: 2364950 - DNA, 15 bp, Homo sapiens
tcatccttccatcca

SEQ ID NO: 2364951 - DNA, 13 bp, Homo sapiens
tcatctgcctgcg

SEQ ID NO: 2364952 - DNA, 16 bp, Homo sapiens
tcatctgcctgcgctc

SEQ ID NO: 2364953 - DNA, 23 bp, Homo sapiens
tcatctggcaacatctttatccg

SEQ ID NO: 2364954 - DNA, 21 bp, Homo sapiens
tcatgaaaaagctgcttctta

SEQ ID NO: 2364955 - DNA, 17 bp, Homo sapiens
tcatgacataataaagt

SEQ ID NO: 2364956 - DNA, 19 bp, Homo sapiens
tcatgagcctgctggaagc

SEQ ID NO: 2364957 - DNA, 20 bp, Homo sapiens
tcatgaggaggggcccccct

SEQ ID NO: 2364958 - DNA, 22 bp, Homo sapiens
tcatgattatagcaactaatgt

SEQ ID NO: 2364959 - DNA, 13 bp, Homo sapiens
tcatgcaaaatat

SEQ ID NO: 2364960 - DNA, 15 bp, Homo sapiens
tcatgcataaatatg

SEQ ID NO: 2364961 - DNA, 20 bp, Homo sapiens
tcatgcataaatatgcagtg

SEQ ID NO: 2364962 - DNA, 20 bp, Homo sapiens
tcatgcccaccccctgccct

SEQ ID NO: 2364963 - DNA, 18 bp, Homo sapiens
tcatgcccagctctctga

SEQ ID NO: 2364964 - DNA, 19 bp, Homo sapiens
tcatgcggtgggtgctgcc

SEQ ID NO: 2364965 - DNA, 16 bp, Homo sapiens
tcatggctacctcaga

SEQ ID NO: 2364966 - DNA, 17 bp, Homo sapiens
tcatgggtcctagccct

SEQ ID NO: 2364967 - DNA, 13 bp, Homo sapiens
tcatggtgtaata

SEQ ID NO: 2364968 - DNA, 14 bp, Homo sapiens
tcatggtgtaataa

SEQ ID NO: 2364969 - DNA, 15 bp, Homo sapiens
tcatggtgtaataag

SEQ ID NO: 2364970 - DNA, 17 bp, Homo sapiens
tcatggtgtaataagac

SEQ ID NO: 2364971 - DNA, 19 bp, Homo sapiens
tcatggtgtaataagacat

SEQ ID NO: 2364972 - DNA, 15 bp, Homo sapiens
tcatgtatttgagca

SEQ ID NO: 2364973 - DNA, 15 bp, Homo sapiens
tcatgttttatatga

SEQ ID NO: 2364974 - DNA, 16 bp, Homo sapiens
tcattaaaaattacct

SEQ ID NO: 2364975 - DNA, 15 bp, Homo sapiens
tcattacagttcttt

SEQ ID NO: 2364976 - DNA, 17 bp, Homo sapiens
tcattacagttctttcc

SEQ ID NO: 2364977 - DNA, 19 bp, Homo sapiens
tcattacagttctttcctc

SEQ ID NO: 2364978 - DNA, 21 bp, Homo sapiens
tcattacagttctttcctctt

SEQ ID NO: 2364979 - DNA, 22 bp, Homo sapiens
tcattattcaagaatgaaaaat

SEQ ID NO: 2364980 - DNA, 17 bp, Homo sapiens
tcattattctctgctat

SEQ ID NO: 2364981 - DNA, 13 bp, Homo sapiens
tcattatttcaaa

SEQ ID NO: 2364982 - DNA, 13 bp, Homo sapiens
tcattcagaaatg

SEQ ID NO: 2364983 - DNA, 18 bp, Homo sapiens
tcattcctcacgcccttc

SEQ ID NO: 2364984 - DNA, 18 bp, Homo sapiens
tcattctccttgctctgt

SEQ ID NO: 2364985 - DNA, 13 bp, Homo sapiens
tcattctggaaac

SEQ ID NO: 2364986 - DNA, 20 bp, Homo sapiens
tcattctggaaacttttgtt

SEQ ID NO: 2364987 - DNA, 19 bp, Homo sapiens
tcattgtgttttcttcgtg

SEQ ID NO: 2364988 - DNA, 21 bp, Homo sapiens
tcattgtgttttcttcgtgga

SEQ ID NO: 2364989 - DNA, 20 bp, Homo sapiens
tcattgtttgtcctttatgt

SEQ ID NO: 2364990 - DNA, 17 bp, Homo sapiens
tcatttgacacaaagct

SEQ ID NO: 2364991 - DNA, 16 bp, Homo sapiens
tcatttgggctagact

SEQ ID NO: 2364992 - DNA, 17 bp, Homo sapiens
tcatttgtatgtcaaag

SEQ ID NO: 2364993 - DNA, 16 bp, Homo sapiens
tcatttttatagcaac

SEQ ID NO: 2364994 - DNA, 21 bp, Homo sapiens
tccaaaaaaagggaaggattt

SEQ ID NO: 2364995 - DNA, 17 bp, Homo sapiens
tccaaaaatgtgtaaga

SEQ ID NO: 2364996 - DNA, 21 bp, Homo sapiens
tccaaaaatgtgtaagaacaa

SEQ ID NO: 2364997 - DNA, 19 bp, Homo sapiens
tccaaaagattgctgaaat

SEQ ID NO: 2364998 - DNA, 13 bp, Homo sapiens
tccaaaagctttt

SEQ ID NO: 2364999 - DNA, 19 bp, Homo sapiens
tccaaactcttccctctct

SEQ ID NO: 2365000 - DNA, 13 bp, Homo sapiens
tccaaagaggctg

SEQ ID NO: 2365001 - DNA, 14 bp, Homo sapiens
tccaaagaggctgc

SEQ ID NO: 2365002 - DNA, 16 bp, Homo sapiens
tccaaagaggctgccc

SEQ ID NO: 2365003 - DNA, 18 bp, Homo sapiens
tccaaagaggctgcccct

SEQ ID NO: 2365004 - DNA, 21 bp, Homo sapiens
tccaaagagggatgtttggaa

SEQ ID NO: 2365005 - DNA, 23 bp, Homo sapiens
tccaaagcctagacaacctttct

SEQ ID NO: 2365006 - DNA, 22 bp, Homo sapiens
tccaaatataagacatttgttt

SEQ ID NO: 2365007 - DNA, 21 bp, Homo sapiens
tccaaatggagaagctgcagg

SEQ ID NO: 2365008 - DNA, 13 bp, Homo sapiens
tccaaatgtccct

SEQ ID NO: 2365009 - DNA, 17 bp, Homo sapiens
tccaaattaaaacaaat

SEQ ID NO: 2365010 - DNA, 19 bp, Homo sapiens
tccaacatatatttattga

SEQ ID NO: 2365011 - DNA, 15 bp, Homo sapiens
tccaacatgtgatgt

SEQ ID NO: 2365012 - DNA, 15 bp, Homo sapiens
tccaactaatgcctt

SEQ ID NO: 2365013 - DNA, 15 bp, Homo sapiens
tccaactagctggga

SEQ ID NO: 2365014 - DNA, 13 bp, Homo sapiens
tccaactccagca

SEQ ID NO: 2365015 - DNA, 21 bp, Homo sapiens
tccaagcaaaatctaaaatgt

SEQ ID NO: 2365016 - DNA, 17 bp, Homo sapiens
tccaagcacagagcctg

SEQ ID NO: 2365017 - DNA, 22 bp, Homo sapiens
tccaagcacagagcctggcccc

SEQ ID NO: 2365018 - DNA, 23 bp, Homo sapiens
tccaagcacagagcctggcccca

SEQ ID NO: 2365019 - DNA, 14 bp, Homo sapiens
tccaagcatttcat

SEQ ID NO: 2365020 - DNA, 17 bp, Homo sapiens
tccaagcatttcatgaa

SEQ ID NO: 2365021 - DNA, 19 bp, Homo sapiens
tccaagcccagcccatgga

SEQ ID NO: 2365022 - DNA, 21 bp, Homo sapiens
tccaagcccagcccatggaga

SEQ ID NO: 2365023 - DNA, 21 bp, Homo sapiens
tccaagggtatgggaagccat

SEQ ID NO: 2365024 - DNA, 22 bp, Homo sapiens
tccaagggtatgggaagccata

SEQ ID NO: 2365025 - DNA, 20 bp, Homo sapiens
tcctctttctgctctgccat

SEQ ID NO: 2365026 - DNA, 21 bp, Homo sapiens
tcctcttttgtgctgcttctc

SEQ ID NO: 2365027 - DNA, 14 bp, Homo sapiens
tcctgaaccatgtg

SEQ ID NO: 2365028 - DNA, 17 bp, Homo sapiens
tcctgaaccgcacagct

SEQ ID NO: 2365029 - DNA, 21 bp, Homo sapiens
tcctgaaccgcacagctcagg

SEQ ID NO: 2365030 - DNA, 23 bp, Homo sapiens
tcctgaaccgcacagctcaggag

SEQ ID NO: 2365031 - DNA, 22 bp, Homo sapiens
tcctgacacccttctcccactc

SEQ ID NO: 2365032 - DNA, 20 bp, Homo sapiens
tcctgacctccgccatccac

SEQ ID NO: 2365033 - DNA, 14 bp, Homo sapiens
tcctgagacctcaa

SEQ ID NO: 2365034 - DNA, 17 bp, Homo sapiens
tcctgcaaagggaactg

SEQ ID NO: 2365035 - DNA, 21 bp, Homo sapiens
tcctgcacacagaatgctcag

SEQ ID NO: 2365036 - DNA, 19 bp, Homo sapiens
tcctgcagggcttctcctc

SEQ ID NO: 2365037 - DNA, 14 bp, Homo sapiens
tcctgccctgtcca

SEQ ID NO: 2365038 - DNA, 14 bp, Homo sapiens
tcctgcccttccct

SEQ ID NO: 2365039 - DNA, 14 bp, Homo sapiens
tcctgcctgtctgc

SEQ ID NO: 2365040 - DNA, 15 bp, Homo sapiens
tcctgctcatattgt

SEQ ID NO: 2365041 - DNA, 16 bp, Homo sapiens
tcctgctcatattgtg

SEQ ID NO: 2365042 - DNA, 13 bp, Homo sapiens
tcctgctgctgtc

SEQ ID NO: 2365043 - DNA, 17 bp, Homo sapiens
tcctgctgctgtctggg

SEQ ID NO: 2365044 - DNA, 20 bp, Homo sapiens
tcctggaatttggacaagtg

SEQ ID NO: 2365045 - DNA, 16 bp, Homo sapiens
tcctggagcatcccag

SEQ ID NO: 2365046 - DNA, 15 bp, Homo sapiens
tcctggcagcccaga

SEQ ID NO: 2365047 - DNA, 14 bp, Homo sapiens
tcctggcctatccg

SEQ ID NO: 2365048 - DNA, 15 bp, Homo sapiens
tcctggtacagcagg

SEQ ID NO: 2365049 - DNA, 21 bp, Homo sapiens
tcctggtgaggcccagcctgt

SEQ ID NO: 2365050 - DNA, 22 bp, Homo sapiens
tcctgtagttgcgtggactctg

SEQ ID NO: 2365051 - DNA, 23 bp, Homo sapiens
tcctgtagttgcgtggactctgc

SEQ ID NO: 2365052 - DNA, 14 bp, Homo sapiens
tcctgtccctgagg

SEQ ID NO: 2365053 - DNA, 12 bp, Homo sapiens
tcctgtccctgt

SEQ ID NO: 2365054 - DNA, 13 bp, Homo sapiens
tcctgtccctgta

SEQ ID NO: 2365055 - DNA, 19 bp, Homo sapiens
tcctgtccctgtagctcag

SEQ ID NO: 2365056 - DNA, 22 bp, Homo sapiens
tcctgtccctgtagctcagtca

SEQ ID NO: 2365057 - DNA, 17 bp, Homo sapiens
tcctgtcccttgacctt

SEQ ID NO: 2365058 - DNA, 14 bp, Homo sapiens
tcctgtcttatcct

SEQ ID NO: 2365059 - DNA, 15 bp, Homo sapiens
tcctgtgcctggccc

SEQ ID NO: 2365060 - DNA, 20 bp, Homo sapiens
tcctgtgcctggccccagcc

SEQ ID NO: 2365061 - DNA, 18 bp, Homo sapiens
tccttaaaaatgtatgtt

SEQ ID NO: 2365062 - DNA, 17 bp, Homo sapiens
tccttaagctgcagaga

SEQ ID NO: 2365063 - DNA, 20 bp, Homo sapiens
tccttagaggtcctctggag

SEQ ID NO: 2365064 - DNA, 21 bp, Homo sapiens
tccttcatttccaccaggccg

SEQ ID NO: 2365065 - DNA, 24 bp, Homo sapiens
tccttccagtgtcatttctcatcc

SEQ ID NO: 2365066 - DNA, 14 bp, Homo sapiens
tccttccctctctg

SEQ ID NO: 2365067 - DNA, 23 bp, Homo sapiens
tccttccctctctgatgtcccag

SEQ ID NO: 2365068 - DNA, 15 bp, Homo sapiens
tccttcctggcctga

SEQ ID NO: 2365069 - DNA, 18 bp, Homo sapiens
tccttctgagctcctgtc

SEQ ID NO: 2365070 - DNA, 20 bp, Homo sapiens
tccttctttgataatgttaa

SEQ ID NO: 2365071 - DNA, 16 bp, Homo sapiens
tccttgccccccgccc

SEQ ID NO: 2365072 - DNA, 20 bp, Homo sapiens
tccttgccccccgccctcat

SEQ ID NO: 2365073 - DNA, 13 bp, Homo sapiens
tccttgcgcctca

SEQ ID NO: 2365074 - DNA, 14 bp, Homo sapiens
tccttgcttcctga

SEQ ID NO: 2365075 - DNA, 17 bp, Homo sapiens
tccttgcttcctgtctt

SEQ ID NO: 2365076 - DNA, 16 bp, Homo sapiens
tccttggagagcagct

SEQ ID NO: 2365077 - DNA, 19 bp, Homo sapiens
tccttggagagcagctggc

SEQ ID NO: 2365078 - DNA, 18 bp, Homo sapiens
tccttgggggctcccagg

SEQ ID NO: 2365079 - DNA, 19 bp, Homo sapiens
tccttggtcctagtaagaa

SEQ ID NO: 2365080 - DNA, 12 bp, Homo sapiens
tccttgtgcaaa

SEQ ID NO: 2365081 - DNA, 22 bp, Homo sapiens
tcctttaaaaaaatttaagtgc

SEQ ID NO: 2365082 - DNA, 13 bp, Homo sapiens
tcctttaaaatat

SEQ ID NO: 2365083 - DNA, 14 bp, Homo sapiens
tcctttaggcagcc

SEQ ID NO: 2365084 - DNA, 13 bp, Homo sapiens
tcctttatgtatt

SEQ ID NO: 2365085 - DNA, 23 bp, Homo sapiens
tcctttatgtgaatttttaagct

SEQ ID NO: 2365086 - DNA, 16 bp, Homo sapiens
tcctttctctcctggc

SEQ ID NO: 2365087 - DNA, 17 bp, Homo sapiens
tcctttgtgtgtgtgtc

SEQ ID NO: 2365088 - DNA, 13 bp, Homo sapiens
tccttttccctgc

SEQ ID NO: 2365089 - DNA, 12 bp, Homo sapiens
tcctttttcctc

SEQ ID NO: 2365090 - DNA, 17 bp, Homo sapiens
tcctttttgacactgaa

SEQ ID NO: 2365091 - DNA, 21 bp, Homo sapiens
tcgaaaagagtcttccaatta

SEQ ID NO: 2365092 - DNA, 20 bp, Homo sapiens
tcgaaataacaatgttaagg

SEQ ID NO: 2365093 - DNA, 21 bp, Homo sapiens
tcgaaatagatatcctctccc

SEQ ID NO: 2365094 - DNA, 22 bp, Homo sapiens
tcgaaatagatatcctctcccc

SEQ ID NO: 2365095 - DNA, 15 bp, Homo sapiens
tcgagaccatcctgg

SEQ ID NO: 2365096 - DNA, 19 bp, Homo sapiens
tcgagaccatcctggctaa

SEQ ID NO: 2365097 - DNA, 14 bp, Homo sapiens
tcgagcaaaattca

SEQ ID NO: 2365098 - DNA, 22 bp, Homo sapiens
tcgagcaaaattcaaaaagaac

SEQ ID NO: 2365099 - DNA, 10 bp, Homo sapiens
tcgaggcctg

SEQ ID NO: 2365100 - DNA, 12 bp, Homo sapiens
tcgaggcctgaa

SEQ ID NO: 2365101 - DNA, 15 bp, Homo sapiens
tcgaggcctgaagcc

SEQ ID NO: 2365102 - DNA, 13 bp, Homo sapiens
tcgcaccggagtg

SEQ ID NO: 2365103 - DNA, 21 bp, Homo sapiens
tcgccaggactggtgaatata

SEQ ID NO: 2365104 - DNA, 12 bp, Homo sapiens
tcgccccaccca

SEQ ID NO: 2365105 - DNA, 16 bp, Homo sapiens
tcgccggatctgaggg

SEQ ID NO: 2365106 - DNA, 17 bp, Homo sapiens
tcgctccctcccaggac

SEQ ID NO: 2365107 - DNA, 15 bp, Homo sapiens
tcgctcctgcagccc

SEQ ID NO: 2365108 - DNA, 22 bp, Homo sapiens
tcgctgagggcagactggggca

SEQ ID NO: 2365109 - DNA, 22 bp, Homo sapiens
tcgctgccatcaccgctgggtg

SEQ ID NO: 2365110 - DNA, 23 bp, Homo sapiens
tcgctgccatcaccgctgggtgg

SEQ ID NO: 2365111 - DNA, 19 bp, Homo sapiens
tcggaattcataataaatt

SEQ ID NO: 2365112 - DNA, 15 bp, Homo sapiens
tcggactctgcccct

SEQ ID NO: 2365113 - DNA, 14 bp, Homo sapiens
tcggactgccaaat

SEQ ID NO: 2365114 - DNA, 18 bp, Homo sapiens
tcggatagttgctatttt

SEQ ID NO: 2365115 - DNA, 16 bp, Homo sapiens
tcggatggaccaacct

SEQ ID NO: 2365116 - DNA, 23 bp, Homo sapiens
tcggatggaccaacctgctctgt

SEQ ID NO: 2365117 - DNA, 22 bp, Homo sapiens
tcggcgtggcccaaggctggca

SEQ ID NO: 2365118 - DNA, 16 bp, Homo sapiens
tcggggtaaaaagtgg

SEQ ID NO: 2365119 - DNA, 18 bp, Homo sapiens
tcgggtttctctgtggct

SEQ ID NO: 2365120 - DNA, 15 bp, Homo sapiens
tcgtacagaaagctg

SEQ ID NO: 2365121 - DNA, 22 bp, Homo sapiens
tcgtgctactgcactccagcct

SEQ ID NO: 2365122 - DNA, 16 bp, Homo sapiens
tcgtggtagaagccag

SEQ ID NO: 2365123 - DNA, 19 bp, Homo sapiens
tcgtttattttcaagaata

SEQ ID NO: 2365124 - DNA, 11 bp, Homo sapiens
tcgtttttgta

SEQ ID NO: 2365125 - DNA, 17 bp, Homo sapiens
tctaaaaggtaatgtgt

SEQ ID NO: 2365126 - DNA, 12 bp, Homo sapiens
tctaaaatgttt

SEQ ID NO: 2365127 - DNA, 18 bp, Homo sapiens
tctaaataaaaatatgta

SEQ ID NO: 2365128 - DNA, 22 bp, Homo sapiens
tctaaataaaaatatgtaattt

SEQ ID NO: 2365129 - DNA, 22 bp, Homo sapiens
tctaacagtgaagttttactgt

SEQ ID NO: 2365130 - DNA, 15 bp, Homo sapiens
tctaacccaagacat

SEQ ID NO: 2365131 - DNA, 12 bp, Homo sapiens
tctaactttgta

SEQ ID NO: 2365132 - DNA, 13 bp, Homo sapiens
tctaagaaaatgt

SEQ ID NO: 2365133 - DNA, 14 bp, Homo sapiens
tctaatacctctgt

SEQ ID NO: 2365134 - DNA, 13 bp, Homo sapiens
tctaattaagaaa

SEQ ID NO: 2365135 - DNA, 12 bp, Homo sapiens
tctaattgtaag

SEQ ID NO: 2365136 - DNA, 14 bp, Homo sapiens
tctaatttgaactg

SEQ ID NO: 2365137 - DNA, 13 bp, Homo sapiens
tctacaaggactc

SEQ ID NO: 2365138 - DNA, 14 bp, Homo sapiens
tctacaatctcttt

SEQ ID NO: 2365139 - DNA, 19 bp, Homo sapiens
tctacaatctctttttgtt

SEQ ID NO: 2365140 - DNA, 14 bp, Homo sapiens
tctttgtggtttct

SEQ ID NO: 2365141 - DNA, 19 bp, Homo sapiens
tctttgtggtttcttgttt

SEQ ID NO: 2365142 - DNA, 19 bp, Homo sapiens
tcttttattcttctttctt

SEQ ID NO: 2365143 - DNA, 13 bp, Homo sapiens
tcttttcacatta

SEQ ID NO: 2365144 - DNA, 17 bp, Homo sapiens
tcttttcccctttcctg

SEQ ID NO: 2365145 - DNA, 14 bp, Homo sapiens
tcttttgaagcata

SEQ ID NO: 2365146 - DNA, 13 bp, Homo sapiens
tcttttgctgtgc

SEQ ID NO: 2365147 - DNA, 20 bp, Homo sapiens
tcttttgcttgccaaagtac

SEQ ID NO: 2365148 - DNA, 13 bp, Homo sapiens
tcttttgtttcca

SEQ ID NO: 2365149 - DNA, 12 bp, Homo sapiens
tctttttcctcc

SEQ ID NO: 2365150 - DNA, 20 bp, Homo sapiens
tcttttttaaatgtttcttg

SEQ ID NO: 2365151 - DNA, 21 bp, Homo sapiens
tcttttttaaccggtaagagt

SEQ ID NO: 2365152 - DNA, 19 bp, Homo sapiens
tctttttttgagtgacagc

SEQ ID NO: 2365153 - DNA, 18 bp, Homo sapiens
tctttttttttaagttct

SEQ ID NO: 2365154 - DNA, 13 bp, Homo sapiens
tgaaaaaatgtaa

SEQ ID NO: 2365155 - DNA, 21 bp, Homo sapiens
tgaaaaagcagctaccaggtg

SEQ ID NO: 2365156 - DNA, 16 bp, Homo sapiens
tgaaaaagctgcttct

SEQ ID NO: 2365157 - DNA, 22 bp, Homo sapiens
tgaaaaatataaaattatgaga

SEQ ID NO: 2365158 - DNA, 12 bp, Homo sapiens
tgaaaaatatag

SEQ ID NO: 2365159 - DNA, 21 bp, Homo sapiens
tgaaaaatctcattatttctg

SEQ ID NO: 2365160 - DNA, 15 bp, Homo sapiens
tgaaaaatcttaagt

SEQ ID NO: 2365161 - DNA, 16 bp, Homo sapiens
tgaaaaattaactttt

SEQ ID NO: 2365162 - DNA, 16 bp, Homo sapiens
tgaaaaattgctgact

SEQ ID NO: 2365163 - DNA, 18 bp, Homo sapiens
tgaaaagatggtatcata

SEQ ID NO: 2365164 - DNA, 16 bp, Homo sapiens
tgaaaagcagacattt

SEQ ID NO: 2365165 - DNA, 17 bp, Homo sapiens
tgaaaagctattagcca

SEQ ID NO: 2365166 - DNA, 19 bp, Homo sapiens
tgaaaagctattagccagg

SEQ ID NO: 2365167 - DNA, 19 bp, Homo sapiens
tgaaaagtgtgtatatatt

SEQ ID NO: 2365168 - DNA, 21 bp, Homo sapiens
tgaaaataactgaatttggag

SEQ ID NO: 2365169 - DNA, 23 bp, Homo sapiens
tgaaaatatagacattctcacat

SEQ ID NO: 2365170 - DNA, 11 bp, Homo sapiens
tgaaaatggaa

SEQ ID NO: 2365171 - DNA, 21 bp, Homo sapiens
tgaaaatgtattcctttaaaa

SEQ ID NO: 2365172 - DNA, 22 bp, Homo sapiens
tgaaaattctaacccaagacat

SEQ ID NO: 2365173 - DNA, 17 bp, Homo sapiens
tgaaacaaagtactctt

SEQ ID NO: 2365174 - DNA, 15 bp, Homo sapiens
tgaaacacacgagca

SEQ ID NO: 2365175 - DNA, 21 bp, Homo sapiens
tgaaacacacgagcaaaccca

SEQ ID NO: 2365176 - DNA, 16 bp, Homo sapiens
tgaaacagttgctgtg

SEQ ID NO: 2365177 - DNA, 21 bp, Homo sapiens
tgaaaccaccgtgaaccagag

SEQ ID NO: 2365178 - DNA, 16 bp, Homo sapiens
tgaaacctcagggctg

SEQ ID NO: 2365179 - DNA, 18 bp, Homo sapiens
tgaaaccttttttaagat

SEQ ID NO: 2365180 - DNA, 18 bp, Homo sapiens
tgaaactcatagacactg

SEQ ID NO: 2365181 - DNA, 11 bp, Homo sapiens
tgaaactgtat

SEQ ID NO: 2365182 - DNA, 12 bp, Homo sapiens
tgaaactgtatt

SEQ ID NO: 2365183 - DNA, 14 bp, Homo sapiens
tgaaactgtattta

SEQ ID NO: 2365184 - DNA, 20 bp, Homo sapiens
tgaaactgtatttacttgtt

SEQ ID NO: 2365185 - DNA, 16 bp, Homo sapiens
tgaaactttgggaaaa

SEQ ID NO: 2365186 - DNA, 15 bp, Homo sapiens
tgaaagaaaattgag

SEQ ID NO: 2365187 - DNA, 17 bp, Homo sapiens
tgaaagaaaattgagtt

SEQ ID NO: 2365188 - DNA, 21 bp, Homo sapiens
tgaaagtagagctagctgcca

SEQ ID NO: 2365189 - DNA, 21 bp, Homo sapiens
tgaaagtagattcatgaaaat

SEQ ID NO: 2365190 - DNA, 15 bp, Homo sapiens
tgaaagtagggggct

SEQ ID NO: 2365191 - DNA, 14 bp, Homo sapiens
tgaaagtgcatttt

SEQ ID NO: 2365192 - DNA, 17 bp, Homo sapiens
tgaaagttgtgatctgt

SEQ ID NO: 2365193 - DNA, 22 bp, Homo sapiens
tgaaagttgtgatctgttgtaa

SEQ ID NO: 2365194 - DNA, 13 bp, Homo sapiens
tgaaagttttgta

SEQ ID NO: 2365195 - DNA, 22 bp, Homo sapiens
tgaaagttttgtaaaagaaatc

SEQ ID NO: 2365196 - DNA, 14 bp, Homo sapiens
tgaaataaaatata

SEQ ID NO: 2365197 - DNA, 12 bp, Homo sapiens
tgaaatacctat

SEQ ID NO: 2365198 - DNA, 18 bp, Homo sapiens
tgaaatcttcccatgcat

SEQ ID NO: 2365199 - DNA, 22 bp, Homo sapiens
tgaaatcttcccatgcattctg

SEQ ID NO: 2365200 - DNA, 13 bp, Homo sapiens
tgaaatgaaaaca

SEQ ID NO: 2365201 - DNA, 14 bp, Homo sapiens
tgaaatgaaaacat

SEQ ID NO: 2365202 - DNA, 19 bp, Homo sapiens
tgaaatgaaaacatgtaat

SEQ ID NO: 2365203 - DNA, 13 bp, Homo sapiens
tgaaattaacaca

SEQ ID NO: 2365204 - DNA, 16 bp, Homo sapiens
tgaaattgcatacttt

SEQ ID NO: 2365205 - DNA, 11 bp, Homo sapiens
tgaaatttaag

SEQ ID NO: 2365206 - DNA, 22 bp, Homo sapiens
tgaaattttaacctatgatatt

SEQ ID NO: 2365207 - DNA, 20 bp, Homo sapiens
tgaacaaagctcaaagtatg

SEQ ID NO: 2365208 - DNA, 17 bp, Homo sapiens
tgaacaagcttcagtaa

SEQ ID NO: 2365209 - DNA, 14 bp, Homo sapiens
tgaacacagtgtct

SEQ ID NO: 2365210 - DNA, 13 bp, Homo sapiens
tgaacagctgtgt

SEQ ID NO: 2365211 - DNA, 15 bp, Homo sapiens
tgaacagctgtgtct

SEQ ID NO: 2365212 - DNA, 20 bp, Homo sapiens
tgaacagtactggttacttt

SEQ ID NO: 2365213 - DNA, 17 bp, Homo sapiens
tgaacatattgttgaaa

SEQ ID NO: 2365214 - DNA, 13 bp, Homo sapiens
tgaacattcccag

SEQ ID NO: 2365215 - DNA, 17 bp, Homo sapiens
tgaacattcccagccca

SEQ ID NO: 2365216 - DNA, 12 bp, Homo sapiens
tgaaccactgct

SEQ ID NO: 2365217 - DNA, 15 bp, Homo sapiens
tgaaccactgcttct

SEQ ID NO: 2365218 - DNA, 20 bp, Homo sapiens
tgaaccagagggtgtggctt

SEQ ID NO: 2365219 - DNA, 22 bp, Homo sapiens
tgaaccagagggtgtggctttc

SEQ ID NO: 2365220 - DNA, 23 bp, Homo sapiens
tgaaccccccgcccatgctgtcc

SEQ ID NO: 2365221 - DNA, 16 bp, Homo sapiens
tgaacgttttcttctt

SEQ ID NO: 2365222 - DNA, 20 bp, Homo sapiens
tgaacgttttcttctttccc

SEQ ID NO: 2365223 - DNA, 22 bp, Homo sapiens
tgaacgttttcttctttccctg

SEQ ID NO: 2365224 - DNA, 14 bp, Homo sapiens
tgaactcaaactga

SEQ ID NO: 2365225 - DNA, 15 bp, Homo sapiens
tgaacttttgtactg

SEQ ID NO: 2365226 - DNA, 15 bp, Homo sapiens
tgaagaaaatcactt

SEQ ID NO: 2365227 - DNA, 21 bp, Homo sapiens
tgaagaaagtcaaaaaattat

SEQ ID NO: 2365228 - DNA, 13 bp, Homo sapiens
tgaagaattgaaa

SEQ ID NO: 2365229 - DNA, 16 bp, Homo sapiens
tgaagaccctatctcc

SEQ ID NO: 2365230 - DNA, 24 bp, Homo sapiens
tgaagacctccacattaagtggct

SEQ ID NO: 2365231 - DNA, 18 bp, Homo sapiens
tgaagagggagaagcatg

SEQ ID NO: 2365232 - DNA, 15 bp, Homo sapiens
tgaagagtttcacaa

SEQ ID NO: 2365233 - DNA, 16 bp, Homo sapiens
tgaagatgaaggggct

SEQ ID NO: 2365234 - DNA, 12 bp, Homo sapiens
tgaagcagaaat

SEQ ID NO: 2365235 - DNA, 15 bp, Homo sapiens
tgaagcaggaggccc

SEQ ID NO: 2365236 - DNA, 14 bp, Homo sapiens
tgaagcagtatttt

SEQ ID NO: 2365237 - DNA, 15 bp, Homo sapiens
tgaagcagtattttg

SEQ ID NO: 2365238 - DNA, 11 bp, Homo sapiens
tgaagccaaag

SEQ ID NO: 2365239 - DNA, 23 bp, Homo sapiens
tgaagccaagtggggtgctggga

SEQ ID NO: 2365240 - DNA, 21 bp, Homo sapiens
tgaaggaaaaacacaagcaaa

SEQ ID NO: 2365241 - DNA, 23 bp, Homo sapiens
tgaaggaaaaacacaagcaaaaa

SEQ ID NO: 2365242 - DNA, 13 bp, Homo sapiens
tgaagtacatatt

SEQ ID NO: 2365243 - DNA, 14 bp, Homo sapiens
tgaagtaggtggct

SEQ ID NO: 2365244 - DNA, 21 bp, Homo sapiens
tgaagttagtggaaatctgaa

SEQ ID NO: 2365245 - DNA, 14 bp, Homo sapiens
tgaagtttaaattc

SEQ ID NO: 2365246 - DNA, 16 bp, Homo sapiens
tgaagttttactgtct

SEQ ID NO: 2365247 - DNA, 14 bp, Homo sapiens
tgaataaagaatgc

SEQ ID NO: 2365248 - DNA, 23 bp, Homo sapiens
tgaataaagaatgccatttctca

SEQ ID NO: 2365249 - DNA, 22 bp, Homo sapiens
tgaataatgaaaataaaacaca

SEQ ID NO: 2365250 - DNA, 18 bp, Homo sapiens
tgaataatgctaccagga

SEQ ID NO: 2365251 - DNA, 14 bp, Homo sapiens
tgaataatggaaaa

SEQ ID NO: 2365252 - DNA, 23 bp, Homo sapiens
tgaatatgtagtatctatatgac

SEQ ID NO: 2365253 - DNA, 21 bp, Homo sapiens
tgaatatttgttatgtagata

SEQ ID NO: 2365254 - DNA, 21 bp, Homo sapiens
tgaatcactgttgctttgaaa

SEQ ID NO: 2365255 - DNA, 21 bp, Homo sapiens
tgcagtgtggagttcaccttg

SEQ ID NO: 2365256 - DNA, 14 bp, Homo sapiens
tgcagtttcttttc

SEQ ID NO: 2365257 - DNA, 18 bp, Homo sapiens
tgcataatgataaaataa

SEQ ID NO: 2365258 - DNA, 18 bp, Homo sapiens
tgcatactttttaaatgt

SEQ ID NO: 2365259 - DNA, 22 bp, Homo sapiens
tgcatactttttaaatgtaaag

SEQ ID NO: 2365260 - DNA, 17 bp, Homo sapiens
tgcatatcctgagccat

SEQ ID NO: 2365261 - DNA, 16 bp, Homo sapiens
tgcatattataaagga

SEQ ID NO: 2365262 - DNA, 23 bp, Homo sapiens
tgcatatttgccacaaaacctgt

SEQ ID NO: 2365263 - DNA, 21 bp, Homo sapiens
tgcatccagcctggggctgag

SEQ ID NO: 2365264 - DNA, 14 bp, Homo sapiens
tgcatccctgagac

SEQ ID NO: 2365265 - DNA, 18 bp, Homo sapiens
tgcatgaatcagatgtgt

SEQ ID NO: 2365266 - DNA, 22 bp, Homo sapiens
tgcatgcaaatgagctctgaaa

SEQ ID NO: 2365267 - DNA, 16 bp, Homo sapiens
tgcatgtatgtcttgg

SEQ ID NO: 2365268 - DNA, 17 bp, Homo sapiens
tgcattattaaattgta

SEQ ID NO: 2365269 - DNA, 14 bp, Homo sapiens
tgcattattttata

SEQ ID NO: 2365270 - DNA, 20 bp, Homo sapiens
tgcattattttatatatttt

SEQ ID NO: 2365271 - DNA, 15 bp, Homo sapiens
tgcattcatttttat

SEQ ID NO: 2365272 - DNA, 18 bp, Homo sapiens
tgcattcatttttatagc

SEQ ID NO: 2365273 - DNA, 21 bp, Homo sapiens
tgcattcgttgtgttttttaa

SEQ ID NO: 2365274 - DNA, 20 bp, Homo sapiens
tgcatttaaaacagacactg

SEQ ID NO: 2365275 - DNA, 13 bp, Homo sapiens
tgcatttaataaa

SEQ ID NO: 2365276 - DNA, 18 bp, Homo sapiens
tgcatttaataaagatga

SEQ ID NO: 2365277 - DNA, 16 bp, Homo sapiens
tgcatttggtcaagat

SEQ ID NO: 2365278 - DNA, 15 bp, Homo sapiens
tgcatttttattaaa

SEQ ID NO: 2365279 - DNA, 19 bp, Homo sapiens
tgcatttttattaaagcat

SEQ ID NO: 2365280 - DNA, 21 bp, Homo sapiens
tgcatttttattaaagcattt

SEQ ID NO: 2365281 - DNA, 14 bp, Homo sapiens
tgccaatttcctct

SEQ ID NO: 2365282 - DNA, 15 bp, Homo sapiens
tgccaatttcctctc

SEQ ID NO: 2365283 - DNA, 18 bp, Homo sapiens
tgccacaatgcagttctg

SEQ ID NO: 2365284 - DNA, 14 bp, Homo sapiens
tgccaccctagcca

SEQ ID NO: 2365285 - DNA, 15 bp, Homo sapiens
tgccaccggcctgtg

SEQ ID NO: 2365286 - DNA, 18 bp, Homo sapiens
tgccactgacttgctgtg

SEQ ID NO: 2365287 - DNA, 19 bp, Homo sapiens
tgccactgacttgctgtgt

SEQ ID NO: 2365288 - DNA, 21 bp, Homo sapiens
tgccagaggaatcctggcagc

SEQ ID NO: 2365289 - DNA, 19 bp, Homo sapiens
tgccagattctgcctctct

SEQ ID NO: 2365290 - DNA, 16 bp, Homo sapiens
tgccagcaaataaata

SEQ ID NO: 2365291 - DNA, 15 bp, Homo sapiens
tgccagcagcagcag

SEQ ID NO: 2365292 - DNA, 12 bp, Homo sapiens
tgccagctggcc

SEQ ID NO: 2365293 - DNA, 20 bp, Homo sapiens
tgccaggacatgcaataaaa

SEQ ID NO: 2365294 - DNA, 15 bp, Homo sapiens
tgccaggcaggggtg

SEQ ID NO: 2365295 - DNA, 17 bp, Homo sapiens
tgccaggcaggggtggg

SEQ ID NO: 2365296 - DNA, 18 bp, Homo sapiens
tgccaggcaggggtgggg

SEQ ID NO: 2365297 - DNA, 15 bp, Homo sapiens
tgccaggccagcctc

SEQ ID NO: 2365298 - DNA, 12 bp, Homo sapiens
tgccaggctgtt

SEQ ID NO: 2365299 - DNA, 15 bp, Homo sapiens
tgccagggcagggtc

SEQ ID NO: 2365300 - DNA, 22 bp, Homo sapiens
tgccagggcagggtctgggctg

SEQ ID NO: 2365301 - DNA, 18 bp, Homo sapiens
tgccagttacttgcttta

SEQ ID NO: 2365302 - DNA, 15 bp, Homo sapiens
tgccagttgggctcg

SEQ ID NO: 2365303 - DNA, 18 bp, Homo sapiens
tgccatattaaaatctga

SEQ ID NO: 2365304 - DNA, 16 bp, Homo sapiens
tgccatcaccgctggg

SEQ ID NO: 2365305 - DNA, 19 bp, Homo sapiens
tgccatcaccgctgggtgg

SEQ ID NO: 2365306 - DNA, 16 bp, Homo sapiens
tgccatctagccagcc

SEQ ID NO: 2365307 - DNA, 21 bp, Homo sapiens
tgccatggatctgatctgtac

SEQ ID NO: 2365308 - DNA, 15 bp, Homo sapiens
tgccatgttgcccct

SEQ ID NO: 2365309 - DNA, 16 bp, Homo sapiens
tgccatttctcacgcc

SEQ ID NO: 2365310 - DNA, 18 bp, Homo sapiens
tgccattttttgtctgtg

SEQ ID NO: 2365311 - DNA, 17 bp, Homo sapiens
tgcccacatgggacctg

SEQ ID NO: 2365312 - DNA, 18 bp, Homo sapiens
tgcccacatgggacctgg

SEQ ID NO: 2365313 - DNA, 13 bp, Homo sapiens
tgcccaccccctg

SEQ ID NO: 2365314 - DNA, 15 bp, Homo sapiens
tgcccaccccctgcc

SEQ ID NO: 2365315 - DNA, 16 bp, Homo sapiens
tgcccaccccctgccc

SEQ ID NO: 2365316 - DNA, 16 bp, Homo sapiens
tgcccacgcagaggac

SEQ ID NO: 2365317 - DNA, 20 bp, Homo sapiens
tgcccacgcagaggacgcac

SEQ ID NO: 2365318 - DNA, 13 bp, Homo sapiens
tgcccacttgtca

SEQ ID NO: 2365319 - DNA, 21 bp, Homo sapiens
tgcccagctctctgacgcttg

SEQ ID NO: 2365320 - DNA, 23 bp, Homo sapiens
tgcccaggcatgaaattcttcct

SEQ ID NO: 2365321 - DNA, 20 bp, Homo sapiens
tgcccatcctgccatcctca

SEQ ID NO: 2365322 - DNA, 20 bp, Homo sapiens
tgccccaccttgccagggca

SEQ ID NO: 2365323 - DNA, 21 bp, Homo sapiens
tgccccagggagtccagggtt

SEQ ID NO: 2365324 - DNA, 20 bp, Homo sapiens
tgccccattccttgcgcctc

SEQ ID NO: 2365325 - DNA, 23 bp, Homo sapiens
tgcccccaccccggggaccctgt

SEQ ID NO: 2365326 - DNA, 14 bp, Homo sapiens
tgcccccagccccg

SEQ ID NO: 2365327 - DNA, 20 bp, Homo sapiens
tgcccccagccccggggtga

SEQ ID NO: 2365328 - DNA, 15 bp, Homo sapiens
tgcccccatttctga

SEQ ID NO: 2365329 - DNA, 14 bp, Homo sapiens
tgccccctgcagac

SEQ ID NO: 2365330 - DNA, 22 bp, Homo sapiens
tgccccgcccccagtccccacc

SEQ ID NO: 2365331 - DNA, 17 bp, Homo sapiens
tgcccctaatctctgta

SEQ ID NO: 2365332 - DNA, 12 bp, Homo sapiens
tgcccctctcac

SEQ ID NO: 2365333 - DNA, 18 bp, Homo sapiens
tgcccctttctcttttcc

SEQ ID NO: 2365334 - DNA, 18 bp, Homo sapiens
tgcccgaaactaagccag

SEQ ID NO: 2365335 - DNA, 13 bp, Homo sapiens
tgcccgcagagcc

SEQ ID NO: 2365336 - DNA, 14 bp, Homo sapiens
tgcccgcagagccc

SEQ ID NO: 2365337 - DNA, 15 bp, Homo sapiens
tgccctctcccaccc

SEQ ID NO: 2365338 - DNA, 16 bp, Homo sapiens
tgccctctcccaccct

SEQ ID NO: 2365339 - DNA, 17 bp, Homo sapiens
tgccctctcccaccctc

SEQ ID NO: 2365340 - DNA, 20 bp, Homo sapiens
tgccctcttctcgtgcctcc

SEQ ID NO: 2365341 - DNA, 11 bp, Homo sapiens
tgccctggctg

SEQ ID NO: 2365342 - DNA, 14 bp, Homo sapiens
tgccctggctgctg

SEQ ID NO: 2365343 - DNA, 16 bp, Homo sapiens
tgccctggctgctgcc

SEQ ID NO: 2365344 - DNA, 18 bp, Homo sapiens
tgccctgttggtttcaca

SEQ ID NO: 2365345 - DNA, 15 bp, Homo sapiens
tgcccttcactgtca

SEQ ID NO: 2365346 - DNA, 16 bp, Homo sapiens
tgcccttccctctggg

SEQ ID NO: 2365347 - DNA, 23 bp, Homo sapiens
tgccgagagaggcgcgtctgccc

SEQ ID NO: 2365348 - DNA, 19 bp, Homo sapiens
tgccgccgtctctgtcccg

SEQ ID NO: 2365349 - DNA, 15 bp, Homo sapiens
tgccggtgagaccca

SEQ ID NO: 2365350 - DNA, 18 bp, Homo sapiens
tgcctaattcctggcatg

SEQ ID NO: 2365351 - DNA, 15 bp, Homo sapiens
tgcctacagccaggt

SEQ ID NO: 2365352 - DNA, 21 bp, Homo sapiens
tgcctacatcccgggcctcag

SEQ ID NO: 2365353 - DNA, 20 bp, Homo sapiens
tgcctacctaatgaggactt

SEQ ID NO: 2365354 - DNA, 16 bp, Homo sapiens
tgcctcacctcgaaag

SEQ ID NO: 2365355 - DNA, 11 bp, Homo sapiens
tgcctcagcct

SEQ ID NO: 2365356 - DNA, 21 bp, Homo sapiens
tgcctcagttttccttctgtt

SEQ ID NO: 2365357 - DNA, 23 bp, Homo sapiens
tgcctcagttttccttctgttaa

SEQ ID NO: 2365358 - DNA, 16 bp, Homo sapiens
tgcctcccacttcact

SEQ ID NO: 2365359 - DNA, 13 bp, Homo sapiens
tgcctcctcagta

SEQ ID NO: 2365360 - DNA, 12 bp, Homo sapiens
tgcctcctggag

SEQ ID NO: 2365361 - DNA, 19 bp, Homo sapiens
tgcctcgctcaccgctggc

SEQ ID NO: 2365362 - DNA, 23 bp, Homo sapiens
tgcctcttccagtcttcctgaca

SEQ ID NO: 2365363 - DNA, 12 bp, Homo sapiens
tgcctctttccc

SEQ ID NO: 2365364 - DNA, 21 bp, Homo sapiens
tgcctgagaagaagtggctgc

SEQ ID NO: 2365365 - DNA, 23 bp, Homo sapiens
tgcctgagaagaagtggctgcca

SEQ ID NO: 2365366 - DNA, 15 bp, Homo sapiens
tgcctgagaggcagg

SEQ ID NO: 2365367 - DNA, 18 bp, Homo sapiens
tgcctgagaggcaggcat

SEQ ID NO: 2365368 - DNA, 14 bp, Homo sapiens
tgcctgaggctgta

SEQ ID NO: 2365369 - DNA, 20 bp, Homo sapiens
tgcctgagtggcctgtagtc

SEQ ID NO: 2365370 - DNA, 15 bp, Homo sapiens
tggctccaggccaaa

SEQ ID NO: 2365371 - DNA, 18 bp, Homo sapiens
tggctccccctccccagg

SEQ ID NO: 2365372 - DNA, 23 bp, Homo sapiens
tggctccccctccccaggctgga

SEQ ID NO: 2365373 - DNA, 19 bp, Homo sapiens
tggctccctcctccaggcc

SEQ ID NO: 2365374 - DNA, 12 bp, Homo sapiens
tggctcctgatc

SEQ ID NO: 2365375 - DNA, 13 bp, Homo sapiens
tggctctaccctg

SEQ ID NO: 2365376 - DNA, 19 bp, Homo sapiens
tggctctaccctgtctgtc

SEQ ID NO: 2365377 - DNA, 20 bp, Homo sapiens
tggctctaccctgtctgtcc

SEQ ID NO: 2365378 - DNA, 19 bp, Homo sapiens
tggctctaccttcctgtcc

SEQ ID NO: 2365379 - DNA, 17 bp, Homo sapiens
tggctctcccatttcct

SEQ ID NO: 2365380 - DNA, 17 bp, Homo sapiens
tggctctcctggccctg

SEQ ID NO: 2365381 - DNA, 15 bp, Homo sapiens
tggctctgggatcct

SEQ ID NO: 2365382 - DNA, 19 bp, Homo sapiens
tggctgagatatgaacata

SEQ ID NO: 2365383 - DNA, 23 bp, Homo sapiens
tggctgaggttcctctgcctgcc

SEQ ID NO: 2365384 - DNA, 14 bp, Homo sapiens
tggctgccacaccc

SEQ ID NO: 2365385 - DNA, 21 bp, Homo sapiens
tggctgcggtgtttggcaatg

SEQ ID NO: 2365386 - DNA, 20 bp, Homo sapiens
tggctggctctaccttcctg

SEQ ID NO: 2365387 - DNA, 20 bp, Homo sapiens
tggctgggcagagctgcatc

SEQ ID NO: 2365388 - DNA, 20 bp, Homo sapiens
tggctgtggcatttccaaac

SEQ ID NO: 2365389 - DNA, 14 bp, Homo sapiens
tggcttctgtgatg

SEQ ID NO: 2365390 - DNA, 12 bp, Homo sapiens
tggcttgttcat

SEQ ID NO: 2365391 - DNA, 23 bp, Homo sapiens
tggctttaagccttcaaaactat

SEQ ID NO: 2365392 - DNA, 12 bp, Homo sapiens
tggctttccagg

SEQ ID NO: 2365393 - DNA, 22 bp, Homo sapiens
tggctttccaggcaccctcagg

SEQ ID NO: 2365394 - DNA, 14 bp, Homo sapiens
tggctttcccagga

SEQ ID NO: 2365395 - DNA, 19 bp, Homo sapiens
tggctttgaaacctcaggg

SEQ ID NO: 2365396 - DNA, 22 bp, Homo sapiens
tggctttgctctattaagattg

SEQ ID NO: 2365397 - DNA, 20 bp, Homo sapiens
tggctttgtgattcaatctg

SEQ ID NO: 2365398 - DNA, 15 bp, Homo sapiens
tgggaaagcataaag

SEQ ID NO: 2365399 - DNA, 22 bp, Homo sapiens
tgggaacagtaaagaaagcaga

SEQ ID NO: 2365400 - DNA, 23 bp, Homo sapiens
tgggaacagtaaagaaagcagaa

SEQ ID NO: 2365401 - DNA, 16 bp, Homo sapiens
tgggaactgaattgtg

SEQ ID NO: 2365402 - DNA, 18 bp, Homo sapiens
tgggaaggcgagtctggg

SEQ ID NO: 2365403 - DNA, 21 bp, Homo sapiens
tgggaaggcgagtctggggac

SEQ ID NO: 2365404 - DNA, 14 bp, Homo sapiens
tgggaatgaggtgg

SEQ ID NO: 2365405 - DNA, 17 bp, Homo sapiens
tgggaattgctggagga

SEQ ID NO: 2365406 - DNA, 14 bp, Homo sapiens
tgggacacagaccc

SEQ ID NO: 2365407 - DNA, 17 bp, Homo sapiens
tgggacacagacccagg

SEQ ID NO: 2365408 - DNA, 19 bp, Homo sapiens
tgggacctgccaggcaggg

SEQ ID NO: 2365409 - DNA, 18 bp, Homo sapiens
tgggacctgtggctgtcg

SEQ ID NO: 2365410 - DNA, 18 bp, Homo sapiens
tgggactcgtggctgtca

SEQ ID NO: 2365411 - DNA, 13 bp, Homo sapiens
tgggagccagcct

SEQ ID NO: 2365412 - DNA, 14 bp, Homo sapiens
tgggaggctcccct

SEQ ID NO: 2365413 - DNA, 15 bp, Homo sapiens
tgggaggctcccctt

SEQ ID NO: 2365414 - DNA, 14 bp, Homo sapiens
tgggaggctgaggc

SEQ ID NO: 2365415 - DNA, 23 bp, Homo sapiens
tgggagggggcttgaagccaaag

SEQ ID NO: 2365416 - DNA, 14 bp, Homo sapiens
tgggaggtgcgtgt

SEQ ID NO: 2365417 - DNA, 21 bp, Homo sapiens
tgggaggtgcgtgttcagcag

SEQ ID NO: 2365418 - DNA, 22 bp, Homo sapiens
tgggaggtgcgtgttcagcaga

SEQ ID NO: 2365419 - DNA, 23 bp, Homo sapiens
tgggaggtgcgtgttcagcagaa

SEQ ID NO: 2365420 - DNA, 19 bp, Homo sapiens
tgggaggtggaagaaggga

SEQ ID NO: 2365421 - DNA, 15 bp, Homo sapiens
tgggagtccctacct

SEQ ID NO: 2365422 - DNA, 18 bp, Homo sapiens
tgggagtgtgtctgctga

SEQ ID NO: 2365423 - DNA, 19 bp, Homo sapiens
tgggagtgtgtctgctgag

SEQ ID NO: 2365424 - DNA, 14 bp, Homo sapiens
tgggagttgtagtt

SEQ ID NO: 2365425 - DNA, 20 bp, Homo sapiens
tgggatgccaatttcctctc

SEQ ID NO: 2365426 - DNA, 23 bp, Homo sapiens
tgggatgccaatttcctctccac

SEQ ID NO: 2365427 - DNA, 21 bp, Homo sapiens
tgggatggtcggatctcacag

SEQ ID NO: 2365428 - DNA, 18 bp, Homo sapiens
tgggatgtcacagtccaa

SEQ ID NO: 2365429 - DNA, 13 bp, Homo sapiens
tgggcacagtcca

SEQ ID NO: 2365430 - DNA, 18 bp, Homo sapiens
tgggcacgcctgctggcc

SEQ ID NO: 2365431 - DNA, 15 bp, Homo sapiens
tgggcagattttcag

SEQ ID NO: 2365432 - DNA, 13 bp, Homo sapiens
tgggcagccagac

SEQ ID NO: 2365433 - DNA, 16 bp, Homo sapiens
tgggcattttcctcct

SEQ ID NO: 2365434 - DNA, 20 bp, Homo sapiens
tgggcattttcctcctctgc

SEQ ID NO: 2365435 - DNA, 18 bp, Homo sapiens
tgggccagccacagagca

SEQ ID NO: 2365436 - DNA, 14 bp, Homo sapiens
tgggccatgtccaa

SEQ ID NO: 2365437 - DNA, 17 bp, Homo sapiens
tgggccatgtccaaaga

SEQ ID NO: 2365438 - DNA, 19 bp, Homo sapiens
tgggcctgccgggctgagg

SEQ ID NO: 2365439 - DNA, 21 bp, Homo sapiens
tgggctcaagcaatcctcctg

SEQ ID NO: 2365440 - DNA, 22 bp, Homo sapiens
tgggctcaagcaatcctcctgc

SEQ ID NO: 2365441 - DNA, 14 bp, Homo sapiens
tgggctctccgggg

SEQ ID NO: 2365442 - DNA, 11 bp, Homo sapiens
tgggctctgat

SEQ ID NO: 2365443 - DNA, 14 bp, Homo sapiens
tgggctctgatgaa

SEQ ID NO: 2365444 - DNA, 15 bp, Homo sapiens
tgggctctgatgaaa

SEQ ID NO: 2365445 - DNA, 17 bp, Homo sapiens
tgggctctgtgcagtca

SEQ ID NO: 2365446 - DNA, 18 bp, Homo sapiens
tgggctctgtgcagtcac

SEQ ID NO: 2365447 - DNA, 17 bp, Homo sapiens
tgggctgccaccagccc

SEQ ID NO: 2365448 - DNA, 19 bp, Homo sapiens
tgggctgccaccagccccc

SEQ ID NO: 2365449 - DNA, 16 bp, Homo sapiens
tgggctgccatgtgaa

SEQ ID NO: 2365450 - DNA, 19 bp, Homo sapiens
tgggctgggtgctgggaag

SEQ ID NO: 2365451 - DNA, 20 bp, Homo sapiens
tgggcttcctgcccttccct

SEQ ID NO: 2365452 - DNA, 19 bp, Homo sapiens
tgggcttggcctgctgtga

SEQ ID NO: 2365453 - DNA, 19 bp, Homo sapiens
tgggcttgtggggcctggg

SEQ ID NO: 2365454 - DNA, 20 bp, Homo sapiens
tgggcttgtggggcctggga

SEQ ID NO: 2365455 - DNA, 16 bp, Homo sapiens
tggggaaactggccat

SEQ ID NO: 2365456 - DNA, 22 bp, Homo sapiens
tggggaagggttttcttttctt

SEQ ID NO: 2365457 - DNA, 20 bp, Homo sapiens
tggggagatgcttctctcct

SEQ ID NO: 2365458 - DNA, 23 bp, Homo sapiens
tggggagtgggtggcaggtgggg

SEQ ID NO: 2365459 - DNA, 15 bp, Homo sapiens
tggggataataatac

SEQ ID NO: 2365460 - DNA, 20 bp, Homo sapiens
tggggccaccaaagctgccc

SEQ ID NO: 2365461 - DNA, 18 bp, Homo sapiens
tggggccagaggctggga

SEQ ID NO: 2365462 - DNA, 15 bp, Homo sapiens
tggggccctgtccag

SEQ ID NO: 2365463 - DNA, 22 bp, Homo sapiens
tggggcctagcgatctctcctg

SEQ ID NO: 2365464 - DNA, 13 bp, Homo sapiens
tggggcctgactg

SEQ ID NO: 2365465 - DNA, 17 bp, Homo sapiens
tggggcctgactgctca

SEQ ID NO: 2365466 - DNA, 17 bp, Homo sapiens
tggggcctgaggtcatc

SEQ ID NO: 2365467 - DNA, 13 bp, Homo sapiens
tggggcctgggac

SEQ ID NO: 2365468 - DNA, 21 bp, Homo sapiens
tggggccttgatgactgcctt

SEQ ID NO: 2365469 - DNA, 20 bp, Homo sapiens
tggggctcgccccacccagg

SEQ ID NO: 2365470 - DNA, 21 bp, Homo sapiens
tggggctcgccccacccaggg

SEQ ID NO: 2365471 - DNA, 19 bp, Homo sapiens
tggggctgggtccaccctg

SEQ ID NO: 2365472 - DNA, 23 bp, Homo sapiens
tgggggaggagggagagagatgt

SEQ ID NO: 2365473 - DNA, 21 bp, Homo sapiens
tgggggtgggctgctggccat

SEQ ID NO: 2365474 - DNA, 15 bp, Homo sapiens
tggggtggagcactg

SEQ ID NO: 2365475 - DNA, 19 bp, Homo sapiens
tggggtggagcactggact

SEQ ID NO: 2365476 - DNA, 23 bp, Homo sapiens
tggggtggagcactggactccgg

SEQ ID NO: 2365477 - DNA, 17 bp, Homo sapiens
tgggtcaaaaaaaagaa

SEQ ID NO: 2365478 - DNA, 20 bp, Homo sapiens
tgggtccaggggtctgtctg

SEQ ID NO: 2365479 - DNA, 15 bp, Homo sapiens
tgggtcctagccctt

SEQ ID NO: 2365480 - DNA, 18 bp, Homo sapiens
tgggtcctagcccttccc

SEQ ID NO: 2365481 - DNA, 17 bp, Homo sapiens
tgggtgctactggggaa

SEQ ID NO: 2365482 - DNA, 21 bp, Homo sapiens
tgggtgggattttttcccttt

SEQ ID NO: 2365483 - DNA, 19 bp, Homo sapiens
tgggtgggctctgtgcagt

SEQ ID NO: 2365484 - DNA, 22 bp, Homo sapiens
tgttccttccagtgtcatttct

SEQ ID NO: 2365485 - DNA, 19 bp, Homo sapiens
tgttccttccgcttggagc

SEQ ID NO: 2365486 - DNA, 20 bp, Homo sapiens
tgttcggaaggggttcctca

SEQ ID NO: 2365487 - DNA, 21 bp, Homo sapiens
tgttcggaaggggttcctcaa

SEQ ID NO: 2365488 - DNA, 22 bp, Homo sapiens
tgttctagtaacaatacatgag

SEQ ID NO: 2365489 - DNA, 15 bp, Homo sapiens
tgttctcatgaagca

SEQ ID NO: 2365490 - DNA, 21 bp, Homo sapiens
tgttctcatgaagcaggaggc

SEQ ID NO: 2365491 - DNA, 20 bp, Homo sapiens
tgttctccattttcaagctg

SEQ ID NO: 2365492 - DNA, 15 bp, Homo sapiens
tgttctgattatgta

SEQ ID NO: 2365493 - DNA, 16 bp, Homo sapiens
tgttctgtttgaaact

SEQ ID NO: 2365494 - DNA, 23 bp, Homo sapiens
tgttgaactaatatatgaaataa

SEQ ID NO: 2365495 - DNA, 16 bp, Homo sapiens
tgttgacgcacctgtg

SEQ ID NO: 2365496 - DNA, 20 bp, Homo sapiens
tgttgagccccagtgctgga

SEQ ID NO: 2365497 - DNA, 16 bp, Homo sapiens
tgttgcaagatgtgaa

SEQ ID NO: 2365498 - DNA, 17 bp, Homo sapiens
tgttgccaaagctggtc

SEQ ID NO: 2365499 - DNA, 16 bp, Homo sapiens
tgttgcccctttctct

SEQ ID NO: 2365500 - DNA, 15 bp, Homo sapiens
tgttgctctccattc

SEQ ID NO: 2365501 - DNA, 19 bp, Homo sapiens
tgttgctgtacaaaagcaa

SEQ ID NO: 2365502 - DNA, 15 bp, Homo sapiens
tgttgtaatatcagt

SEQ ID NO: 2365503 - DNA, 17 bp, Homo sapiens
tgttgtaatatcagtta

SEQ ID NO: 2365504 - DNA, 15 bp, Homo sapiens
tgttgtaatattttg

SEQ ID NO: 2365505 - DNA, 22 bp, Homo sapiens
tgttgtaatattttgctgctga

SEQ ID NO: 2365506 - DNA, 20 bp, Homo sapiens
tgttgtacatttatgattta

SEQ ID NO: 2365507 - DNA, 19 bp, Homo sapiens
tgttgtcaaggatggtttt

SEQ ID NO: 2365508 - DNA, 18 bp, Homo sapiens
tgttgttctttcagaaag

SEQ ID NO: 2365509 - DNA, 19 bp, Homo sapiens
tgtttaaaataaaatgaaa

SEQ ID NO: 2365510 - DNA, 18 bp, Homo sapiens
tgtttaaaatggcattta

SEQ ID NO: 2365511 - DNA, 20 bp, Homo sapiens
tgtttaaaatggcatttagc

SEQ ID NO: 2365512 - DNA, 13 bp, Homo sapiens
tgtttaaaatgta

SEQ ID NO: 2365513 - DNA, 23 bp, Homo sapiens
tgtttaaataaaatttaatttca

SEQ ID NO: 2365514 - DNA, 17 bp, Homo sapiens
tgtttaatgggtatgct

SEQ ID NO: 2365515 - DNA, 21 bp, Homo sapiens
tgtttacatggcgccctgcct

SEQ ID NO: 2365516 - DNA, 16 bp, Homo sapiens
tgtttacctttctctc

SEQ ID NO: 2365517 - DNA, 14 bp, Homo sapiens
tgtttacgtttgat

SEQ ID NO: 2365518 - DNA, 16 bp, Homo sapiens
tgtttattaaatgctt

SEQ ID NO: 2365519 - DNA, 16 bp, Homo sapiens
tgtttattaactactg

SEQ ID NO: 2365520 - DNA, 22 bp, Homo sapiens
tgtttattgacaggtcttttca

SEQ ID NO: 2365521 - DNA, 15 bp, Homo sapiens
tgtttcattttactg

SEQ ID NO: 2365522 - DNA, 23 bp, Homo sapiens
tgtttcgcgggtaactggggttg

SEQ ID NO: 2365523 - DNA, 20 bp, Homo sapiens
tgtttctaccggagagagaa

SEQ ID NO: 2365524 - DNA, 18 bp, Homo sapiens
tgtttctcttgagctggc

SEQ ID NO: 2365525 - DNA, 12 bp, Homo sapiens
tgtttctgactc

SEQ ID NO: 2365526 - DNA, 22 bp, Homo sapiens
tgtttctgtcaagctggtgcta

SEQ ID NO: 2365527 - DNA, 13 bp, Homo sapiens
tgtttctttctag

SEQ ID NO: 2365528 - DNA, 15 bp, Homo sapiens
tgtttcttttgtttg

SEQ ID NO: 2365529 - DNA, 18 bp, Homo sapiens
tgtttcttttgtttggta

SEQ ID NO: 2365530 - DNA, 21 bp, Homo sapiens
tgtttcttttgtttggtaaat

SEQ ID NO: 2365531 - DNA, 14 bp, Homo sapiens
tgtttgctgtgaac

SEQ ID NO: 2365532 - DNA, 22 bp, Homo sapiens
tgtttggaaaaaactctgaagg

SEQ ID NO: 2365533 - DNA, 19 bp, Homo sapiens
tgtttggagacgtttataa

SEQ ID NO: 2365534 - DNA, 22 bp, Homo sapiens
tgtttggcgtagcagagttaaa

SEQ ID NO: 2365535 - DNA, 21 bp, Homo sapiens
tgtttgtcctttatgtattct

SEQ ID NO: 2365536 - DNA, 22 bp, Homo sapiens
tgttttacaatagttctgtggg

SEQ ID NO: 2365537 - DNA, 21 bp, Homo sapiens
tgttttagtgtttatgtttaa

SEQ ID NO: 2365538 - DNA, 22 bp, Homo sapiens
tgttttctgaaacacacgagca

SEQ ID NO: 2365539 - DNA, 13 bp, Homo sapiens
tgttttcttcaac

SEQ ID NO: 2365540 - DNA, 11 bp, Homo sapiens
tgttttgcaag

SEQ ID NO: 2365541 - DNA, 15 bp, Homo sapiens
tgttttgcaagtgct

SEQ ID NO: 2365542 - DNA, 18 bp, Homo sapiens
tgttttgcttttccatat

SEQ ID NO: 2365543 - DNA, 19 bp, Homo sapiens
tgtttttagaacatgtaaa

SEQ ID NO: 2365544 - DNA, 20 bp, Homo sapiens
tgttttttaagatagtgtaa

SEQ ID NO: 2365545 - DNA, 22 bp, Homo sapiens
tgttttttctttttttttaagt

SEQ ID NO: 2365546 - DNA, 19 bp, Homo sapiens
ttaaaaaaaaattgtatct

SEQ ID NO: 2365547 - DNA, 13 bp, Homo sapiens
ttaaaaaacttca

SEQ ID NO: 2365548 - DNA, 13 bp, Homo sapiens
ttaaaaaagagac

SEQ ID NO: 2365549 - DNA, 15 bp, Homo sapiens
ttaaaaaagagacat

SEQ ID NO: 2365550 - DNA, 13 bp, Homo sapiens
ttaaaaacatttt

SEQ ID NO: 2365551 - DNA, 21 bp, Homo sapiens
ttaaaaacattttttatacat

SEQ ID NO: 2365552 - DNA, 23 bp, Homo sapiens
ttaaaaacattttttatacattt

SEQ ID NO: 2365553 - DNA, 16 bp, Homo sapiens
ttaaaaactcacttac

SEQ ID NO: 2365554 - DNA, 17 bp, Homo sapiens
ttaaaaaggtaaatggt

SEQ ID NO: 2365555 - DNA, 20 bp, Homo sapiens
ttaaaaattacctttaattt

SEQ ID NO: 2365556 - DNA, 14 bp, Homo sapiens
ttaaaaattgttat

SEQ ID NO: 2365557 - DNA, 16 bp, Homo sapiens
ttaaaacaaatataca

SEQ ID NO: 2365558 - DNA, 16 bp, Homo sapiens
ttaaaactaaatttca

SEQ ID NO: 2365559 - DNA, 12 bp, Homo sapiens
ttaaaagaaata

SEQ ID NO: 2365560 - DNA, 12 bp, Homo sapiens
ttaaaagaatga

SEQ ID NO: 2365561 - DNA, 13 bp, Homo sapiens
ttaaaagaatgac

SEQ ID NO: 2365562 - DNA, 15 bp, Homo sapiens
ttaaaagaatgacta

SEQ ID NO: 2365563 - DNA, 17 bp, Homo sapiens
ttaaaataaaatgaaaa

SEQ ID NO: 2365564 - DNA, 20 bp, Homo sapiens
ttaaaataaaatgaaaattg

SEQ ID NO: 2365565 - DNA, 20 bp, Homo sapiens
ttaaaataattcatatctaa

SEQ ID NO: 2365566 - DNA, 17 bp, Homo sapiens
ttaaaatagaaattttg

SEQ ID NO: 2365567 - DNA, 18 bp, Homo sapiens
ttaaaatggcatttagca

SEQ ID NO: 2365568 - DNA, 13 bp, Homo sapiens
ttaaaatgtaatt

SEQ ID NO: 2365569 - DNA, 17 bp, Homo sapiens
ttaaaatgtaatttaaa

SEQ ID NO: 2365570 - DNA, 17 bp, Homo sapiens
ttaaaatgtttggatgg

SEQ ID NO: 2365571 - DNA, 13 bp, Homo sapiens
ttaaaatttcata

SEQ ID NO: 2365572 - DNA, 18 bp, Homo sapiens
ttaaaatttgtcttaaaa

SEQ ID NO: 2365573 - DNA, 16 bp, Homo sapiens
ttaaaattttgtatgt

SEQ ID NO: 2365574 - DNA, 20 bp, Homo sapiens
ttaaaattttgtatgttaaa

SEQ ID NO: 2365575 - DNA, 14 bp, Homo sapiens
ttaaacacattgtc

SEQ ID NO: 2365576 - DNA, 16 bp, Homo sapiens
ttaaactatgttccta

SEQ ID NO: 2365577 - DNA, 13 bp, Homo sapiens
ttaaagaatgtta

SEQ ID NO: 2365578 - DNA, 15 bp, Homo sapiens
ttaaagagaatgagt

SEQ ID NO: 2365579 - DNA, 19 bp, Homo sapiens
ttaaatacccatcttcatt

SEQ ID NO: 2365580 - DNA, 12 bp, Homo sapiens
ttaaatgaaaga

SEQ ID NO: 2365581 - DNA, 16 bp, Homo sapiens
ttaaatgcttcatttg

SEQ ID NO: 2365582 - DNA, 22 bp, Homo sapiens
ttaaattacctttacatatata

SEQ ID NO: 2365583 - DNA, 20 bp, Homo sapiens
ttaaattatcattgtttgtc

SEQ ID NO: 2365584 - DNA, 15 bp, Homo sapiens
ttaaatttaatacca

SEQ ID NO: 2365585 - DNA, 17 bp, Homo sapiens
ttaaatttcttatgtga

SEQ ID NO: 2365586 - DNA, 18 bp, Homo sapiens
ttaaatttcttatgtgac

SEQ ID NO: 2365587 - DNA, 21 bp, Homo sapiens
ttaaatttgtaagtttcaggt

SEQ ID NO: 2365588 - DNA, 14 bp, Homo sapiens
ttaaattttttggc

SEQ ID NO: 2365589 - DNA, 15 bp, Homo sapiens
ttaacccttcatctt

SEQ ID NO: 2365590 - DNA, 14 bp, Homo sapiens
ttaacctgcataaa

SEQ ID NO: 2365591 - DNA, 15 bp, Homo sapiens
ttaaccttgtataaa

SEQ ID NO: 2365592 - DNA, 13 bp, Homo sapiens
ttaacggtgctaa

SEQ ID NO: 2365593 - DNA, 20 bp, Homo sapiens
ttaactaaattttaaagcca

SEQ ID NO: 2365594 - DNA, 20 bp, Homo sapiens
ttaagaaattccatacttct

SEQ ID NO: 2365595 - DNA, 13 bp, Homo sapiens
ttaagaagctgtt

SEQ ID NO: 2365596 - DNA, 14 bp, Homo sapiens
ttaagaagctgttg

SEQ ID NO: 2365597 - DNA, 18 bp, Homo sapiens
ttaagagattttatgttt

SEQ ID NO: 2365598 - DNA, 13 bp, Homo sapiens
ttaagatggcaat

SEQ ID NO: 2365599 - DNA, 12 bp, Homo sapiens
ttgaaaagctat

SEQ ID NO: 2365600 - DNA, 14 bp, Homo sapiens
ttgaaaagctatta

SEQ ID NO: 2365601 - DNA, 21 bp, Homo sapiens
ttgaaaccaccgtgaaccaga

SEQ ID NO: 2365602 - DNA, 20 bp, Homo sapiens
ttgaaactgtatttacttgt

SEQ ID NO: 2365603 - DNA, 22 bp, Homo sapiens
ttgaaactttgggaaaacatgt

SEQ ID NO: 2365604 - DNA, 23 bp, Homo sapiens
ttgaaagccaacaactctgcctt

SEQ ID NO: 2365605 - DNA, 22 bp, Homo sapiens
ttgaaagtaaaaacctgcttgg

SEQ ID NO: 2365606 - DNA, 21 bp, Homo sapiens
ttgaaatgagtaaaaactaga

SEQ ID NO: 2365607 - DNA, 21 bp, Homo sapiens
ttgaaattctatttataatac

SEQ ID NO: 2365608 - DNA, 19 bp, Homo sapiens
ttgaacttttgtactgaat

SEQ ID NO: 2365609 - DNA, 14 bp, Homo sapiens
ttgaagagacagag

SEQ ID NO: 2365610 - DNA, 14 bp, Homo sapiens
ttgaagccaaagaa

SEQ ID NO: 2365611 - DNA, 15 bp, Homo sapiens
ttgaagccaaagaaa

SEQ ID NO: 2365612 - DNA, 20 bp, Homo sapiens
ttgaagccaagtggggtgct

SEQ ID NO: 2365613 - DNA, 16 bp, Homo sapiens
ttgaagccatctaaag

SEQ ID NO: 2365614 - DNA, 18 bp, Homo sapiens
ttgaagtattttgctgga

SEQ ID NO: 2365615 - DNA, 22 bp, Homo sapiens
ttgaagttagtggaaatctgaa

SEQ ID NO: 2365616 - DNA, 14 bp, Homo sapiens
ttgaataaatgtgt

SEQ ID NO: 2365617 - DNA, 13 bp, Homo sapiens
ttgaatataaaaa

SEQ ID NO: 2365618 - DNA, 14 bp, Homo sapiens
ttgaatgttaaagg

SEQ ID NO: 2365619 - DNA, 13 bp, Homo sapiens
ttgaattatcttg

SEQ ID NO: 2365620 - DNA, 18 bp, Homo sapiens
ttgaattatcttggttga

SEQ ID NO: 2365621 - DNA, 20 bp, Homo sapiens
ttgaattatcttggttgaaa

SEQ ID NO: 2365622 - DNA, 14 bp, Homo sapiens
ttgacaataagaaa

SEQ ID NO: 2365623 - DNA, 15 bp, Homo sapiens
ttgacaataagaaac

SEQ ID NO: 2365624 - DNA, 21 bp, Homo sapiens
ttgacaccacttagatttaaa

SEQ ID NO: 2365625 - DNA, 12 bp, Homo sapiens
ttgacactgaaa

SEQ ID NO: 2365626 - DNA, 14 bp, Homo sapiens
ttgacactgaactt

SEQ ID NO: 2365627 - DNA, 19 bp, Homo sapiens
ttgacaggtcttttcaaat

SEQ ID NO: 2365628 - DNA, 13 bp, Homo sapiens
ttgacatggaaat

SEQ ID NO: 2365629 - DNA, 15 bp, Homo sapiens
ttgaccagatctttc

SEQ ID NO: 2365630 - DNA, 22 bp, Homo sapiens
ttgacctggatggggcaggcca

SEQ ID NO: 2365631 - DNA, 23 bp, Homo sapiens
ttgactttacgcccatctcagga

SEQ ID NO: 2365632 - DNA, 21 bp, Homo sapiens
ttgacttttataaagcatgtt

SEQ ID NO: 2365633 - DNA, 19 bp, Homo sapiens
ttgagaagccttcagctcc

SEQ ID NO: 2365634 - DNA, 23 bp, Homo sapiens
ttgagaagccttcagctccaggg

SEQ ID NO: 2365635 - DNA, 12 bp, Homo sapiens
ttgagacagttt

SEQ ID NO: 2365636 - DNA, 17 bp, Homo sapiens
ttgagccccagtgctgg

SEQ ID NO: 2365637 - DNA, 13 bp, Homo sapiens
ttgagccctggct

SEQ ID NO: 2365638 - DNA, 12 bp, Homo sapiens
ttgagctgcctt

SEQ ID NO: 2365639 - DNA, 13 bp, Homo sapiens
ttgagctggcctc

SEQ ID NO: 2365640 - DNA, 20 bp, Homo sapiens
ttgagctgttgtgagctttg

SEQ ID NO: 2365641 - DNA, 15 bp, Homo sapiens
ttgagggctgcagtt

SEQ ID NO: 2365642 - DNA, 13 bp, Homo sapiens
ttgagtaatgtga

SEQ ID NO: 2365643 - DNA, 17 bp, Homo sapiens
ttgagtacctactgtgt

SEQ ID NO: 2365644 - DNA, 15 bp, Homo sapiens
ttgagtgtatgagta

SEQ ID NO: 2365645 - DNA, 15 bp, Homo sapiens
ttgagtttttcctcc

SEQ ID NO: 2365646 - DNA, 19 bp, Homo sapiens
ttgataaaccaaaaacatt

SEQ ID NO: 2365647 - DNA, 17 bp, Homo sapiens
ttgataatatataaaca

SEQ ID NO: 2365648 - DNA, 21 bp, Homo sapiens
ttgataatatatattaagtgt

SEQ ID NO: 2365649 - DNA, 13 bp, Homo sapiens
ttgataatgttaa

SEQ ID NO: 2365650 - DNA, 21 bp, Homo sapiens
ttgataatgttaaatttgtaa

SEQ ID NO: 2365651 - DNA, 13 bp, Homo sapiens
ttgatgactgcct

SEQ ID NO: 2365652 - DNA, 17 bp, Homo sapiens
ttgatgtcagccttgca

SEQ ID NO: 2365653 - DNA, 19 bp, Homo sapiens
ttgatgtggccctggctgc

SEQ ID NO: 2365654 - DNA, 14 bp, Homo sapiens
ttgatgttccttcc

SEQ ID NO: 2365655 - DNA, 20 bp, Homo sapiens
ttgattatcttcagcccagg

SEQ ID NO: 2365656 - DNA, 13 bp, Homo sapiens
ttgattcctggct

SEQ ID NO: 2365657 - DNA, 15 bp, Homo sapiens
ttgattgtcagctac

SEQ ID NO: 2365658 - DNA, 17 bp, Homo sapiens
ttgattgtcagctacta

SEQ ID NO: 2365659 - DNA, 20 bp, Homo sapiens
ttgatttcaaagttttgttg

SEQ ID NO: 2365660 - DNA, 14 bp, Homo sapiens
ttgattttaataca

SEQ ID NO: 2365661 - DNA, 21 bp, Homo sapiens
ttgcaacagactgttgagtta

SEQ ID NO: 2365662 - DNA, 18 bp, Homo sapiens
ttgcaacctcaccttcct

SEQ ID NO: 2365663 - DNA, 19 bp, Homo sapiens
ttgcaacctcaccttcctg

SEQ ID NO: 2365664 - DNA, 20 bp, Homo sapiens
ttgcaacctcaccttcctgt

SEQ ID NO: 2365665 - DNA, 19 bp, Homo sapiens
ttgcaagatgtgaattatt

SEQ ID NO: 2365666 - DNA, 14 bp, Homo sapiens
ttgcaagtgctgga

SEQ ID NO: 2365667 - DNA, 19 bp, Homo sapiens
ttgcaattaaacttccaaa

SEQ ID NO: 2365668 - DNA, 20 bp, Homo sapiens
ttgcacagctggagaaatgg

SEQ ID NO: 2365669 - DNA, 21 bp, Homo sapiens
ttgcacagtcactgctcttca

SEQ ID NO: 2365670 - DNA, 22 bp, Homo sapiens
ttgcaccatactccttgcttcc

SEQ ID NO: 2365671 - DNA, 14 bp, Homo sapiens
ttgcacctgagacc

SEQ ID NO: 2365672 - DNA, 14 bp, Homo sapiens
ttgcaggattccct

SEQ ID NO: 2365673 - DNA, 16 bp, Homo sapiens
ttgcagtgagctgaga

SEQ ID NO: 2365674 - DNA, 21 bp, Homo sapiens
ttgcataataagctaaagagg

SEQ ID NO: 2365675 - DNA, 19 bp, Homo sapiens
ttgcatattataaaggata

SEQ ID NO: 2365676 - DNA, 20 bp, Homo sapiens
ttgcatttaaaacagacact

SEQ ID NO: 2365677 - DNA, 11 bp, Homo sapiens
ttgccaaagct

SEQ ID NO: 2365678 - DNA, 16 bp, Homo sapiens
ttgccaggacatgcaa

SEQ ID NO: 2365679 - DNA, 17 bp, Homo sapiens
ttgccatgggcctgctg

SEQ ID NO: 2365680 - DNA, 13 bp, Homo sapiens
ttgcccatcctga

SEQ ID NO: 2365681 - DNA, 14 bp, Homo sapiens
ttgcccatcctgac

SEQ ID NO: 2365682 - DNA, 16 bp, Homo sapiens
ttgccccccgccctca

SEQ ID NO: 2365683 - DNA, 20 bp, Homo sapiens
ttgcccgaaactaagccagg

SEQ ID NO: 2365684 - DNA, 16 bp, Homo sapiens
ttgccctatgctgtgc

SEQ ID NO: 2365685 - DNA, 17 bp, Homo sapiens
ttgcctcatattgtcct

SEQ ID NO: 2365686 - DNA, 12 bp, Homo sapiens
ttgcctcccagg

SEQ ID NO: 2365687 - DNA, 20 bp, Homo sapiens
ttgcctccccatttcccatc

SEQ ID NO: 2365688 - DNA, 21 bp, Homo sapiens
ttgcctccccatttcccatct

SEQ ID NO: 2365689 - DNA, 14 bp, Homo sapiens
ttgcctcctcagta

SEQ ID NO: 2365690 - DNA, 16 bp, Homo sapiens
ttgccttgctgtttgt

SEQ ID NO: 2365691 - DNA, 18 bp, Homo sapiens
ttgcctttcgaggcctga

SEQ ID NO: 2365692 - DNA, 19 bp, Homo sapiens
ttgcgcctcagccctcagt

SEQ ID NO: 2365693 - DNA, 21 bp, Homo sapiens
ttgctaaaacagcttcctgtt

SEQ ID NO: 2365694 - DNA, 19 bp, Homo sapiens
ttgctactgttgtaagaat

SEQ ID NO: 2365695 - DNA, 22 bp, Homo sapiens
ttgctatggcaggataagaaag

SEQ ID NO: 2365696 - DNA, 15 bp, Homo sapiens
ttgctcagtgtccag

SEQ ID NO: 2365697 - DNA, 16 bp, Homo sapiens
ttgctcagtgtccagc

SEQ ID NO: 2365698 - DNA, 20 bp, Homo sapiens
ttgctcagtgtccagcttcc

SEQ ID NO: 2365699 - DNA, 16 bp, Homo sapiens
ttgctccgcctggcct

SEQ ID NO: 2365700 - DNA, 23 bp, Homo sapiens
ttgctctattaagattggaaatg

SEQ ID NO: 2365701 - DNA, 20 bp, Homo sapiens
ttgctctgtcccccaggctg

SEQ ID NO: 2365702 - DNA, 17 bp, Homo sapiens
ttgctcttagtcccaag

SEQ ID NO: 2365703 - DNA, 11 bp, Homo sapiens
ttgctgaaatt

SEQ ID NO: 2365704 - DNA, 21 bp, Homo sapiens
ttgctgactgtagctttggaa

SEQ ID NO: 2365705 - DNA, 21 bp, Homo sapiens
ttgctgcagagaaacttaagc

SEQ ID NO: 2365706 - DNA, 15 bp, Homo sapiens
ttgctgctgtccagt

SEQ ID NO: 2365707 - DNA, 22 bp, Homo sapiens
ttgctgctgtccagtgcctaca

SEQ ID NO: 2365708 - DNA, 13 bp, Homo sapiens
ttgctggccccag

SEQ ID NO: 2365709 - DNA, 17 bp, Homo sapiens
ttgctggccccagccct

SEQ ID NO: 2365710 - DNA, 13 bp, Homo sapiens
ttgctgtacaaaa

SEQ ID NO: 2365711 - DNA, 15 bp, Homo sapiens
ttgctgtccaggcag

SEQ ID NO: 2365712 - DNA, 20 bp, Homo sapiens
ttgctgtgtgaccctgggca

SEQ ID NO: 2365713 - DNA, 14 bp, Homo sapiens
ttgcttacctctca

SEQ ID NO: 2365714 - DNA, 13 bp, Homo sapiens
tttggccccactt

SEQ ID NO: 2365715 - DNA, 22 bp, Homo sapiens
tttggctgagacctgggatttg

SEQ ID NO: 2365716 - DNA, 16 bp, Homo sapiens
tttggggtctttgtgg

SEQ ID NO: 2365717 - DNA, 23 bp, Homo sapiens
tttgggtggggggcattgagtat

SEQ ID NO: 2365718 - DNA, 13 bp, Homo sapiens
tttggtaaatgtt

SEQ ID NO: 2365719 - DNA, 16 bp, Homo sapiens
tttggtaaatgtttct

SEQ ID NO: 2365720 - DNA, 23 bp, Homo sapiens
tttgtaaaaatcttttgaagcat

SEQ ID NO: 2365721 - DNA, 16 bp, Homo sapiens
tttgtaaagcccttgc

SEQ ID NO: 2365722 - DNA, 17 bp, Homo sapiens
tttgtaagagtgtagaa

SEQ ID NO: 2365723 - DNA, 19 bp, Homo sapiens
tttgtaagagtgtagaagc

SEQ ID NO: 2365724 - DNA, 21 bp, Homo sapiens
tttgtaagagtgtagaagcat

SEQ ID NO: 2365725 - DNA, 22 bp, Homo sapiens
tttgtaagagtgtagaagcatt

SEQ ID NO: 2365726 - DNA, 13 bp, Homo sapiens
tttgtaagtgtaa

SEQ ID NO: 2365727 - DNA, 20 bp, Homo sapiens
tttgtaagtgtaaaaaatgt

SEQ ID NO: 2365728 - DNA, 15 bp, Homo sapiens
tttgtactgaatttt

SEQ ID NO: 2365729 - DNA, 14 bp, Homo sapiens
tttgtagtaaaagt

SEQ ID NO: 2365730 - DNA, 17 bp, Homo sapiens
tttgtatttctctattt

SEQ ID NO: 2365731 - DNA, 14 bp, Homo sapiens
tttgtattttcatg

SEQ ID NO: 2365732 - DNA, 15 bp, Homo sapiens
tttgtattttcatga

SEQ ID NO: 2365733 - DNA, 23 bp, Homo sapiens
tttgtcaaaagttggtgttgaca

SEQ ID NO: 2365734 - DNA, 11 bp, Homo sapiens
tttgtcccaga

SEQ ID NO: 2365735 - DNA, 16 bp, Homo sapiens
tttgtcctttatgtat

SEQ ID NO: 2365736 - DNA, 22 bp, Homo sapiens
tttgtcctttttcactttgaaa

SEQ ID NO: 2365737 - DNA, 13 bp, Homo sapiens
tttgtctgtctcc

SEQ ID NO: 2365738 - DNA, 12 bp, Homo sapiens
tttgtcttaaaa

SEQ ID NO: 2365739 - DNA, 17 bp, Homo sapiens
tttgtgaatggattgga

SEQ ID NO: 2365740 - DNA, 19 bp, Homo sapiens
tttgtgaatggattggatt

SEQ ID NO: 2365741 - DNA, 13 bp, Homo sapiens
tttgtgccagagg

SEQ ID NO: 2365742 - DNA, 15 bp, Homo sapiens
tttgtggataagaaa

SEQ ID NO: 2365743 - DNA, 12 bp, Homo sapiens
tttgtgtcctcc

SEQ ID NO: 2365744 - DNA, 16 bp, Homo sapiens
tttgtgtgctctccat

SEQ ID NO: 2365745 - DNA, 19 bp, Homo sapiens
tttgttcataataaaagtg

SEQ ID NO: 2365746 - DNA, 18 bp, Homo sapiens
tttgttgcaagatgtgaa

SEQ ID NO: 2365747 - DNA, 19 bp, Homo sapiens
tttgttgcaagatgtgaat

SEQ ID NO: 2365748 - DNA, 19 bp, Homo sapiens
tttgttgttctttcagaaa

SEQ ID NO: 2365749 - DNA, 16 bp, Homo sapiens
ttttaaaaaatggtca

SEQ ID NO: 2365750 - DNA, 21 bp, Homo sapiens
ttttaaaaggatgtataaatt

SEQ ID NO: 2365751 - DNA, 17 bp, Homo sapiens
ttttaaaataaggattt

SEQ ID NO: 2365752 - DNA, 19 bp, Homo sapiens
ttttaaaggcattagagtc

SEQ ID NO: 2365753 - DNA, 22 bp, Homo sapiens
ttttaaccggtaagagtttcag

SEQ ID NO: 2365754 - DNA, 15 bp, Homo sapiens
ttttaagatagtgta

SEQ ID NO: 2365755 - DNA, 16 bp, Homo sapiens
ttttaagatagtgtaa

SEQ ID NO: 2365756 - DNA, 23 bp, Homo sapiens
ttttaagatagtgtaacttgctt

SEQ ID NO: 2365757 - DNA, 17 bp, Homo sapiens
ttttaagatttttctca

SEQ ID NO: 2365758 - DNA, 18 bp, Homo sapiens
ttttaagatttttctcaa

SEQ ID NO: 2365759 - DNA, 21 bp, Homo sapiens
ttttaagctgcaaatctgatg

SEQ ID NO: 2365760 - DNA, 13 bp, Homo sapiens
ttttaagttctta

SEQ ID NO: 2365761 - DNA, 15 bp, Homo sapiens
ttttaataaaagaaa

SEQ ID NO: 2365762 - DNA, 15 bp, Homo sapiens
ttttaatacattgat

SEQ ID NO: 2365763 - DNA, 20 bp, Homo sapiens
ttttaatattcttttgtttc

SEQ ID NO: 2365764 - DNA, 22 bp, Homo sapiens
ttttaatattcttttgtttcca

SEQ ID NO: 2365765 - DNA, 18 bp, Homo sapiens
ttttaatgctgtttctaa

SEQ ID NO: 2365766 - DNA, 13 bp, Homo sapiens
ttttaatggcatt

SEQ ID NO: 2365767 - DNA, 21 bp, Homo sapiens
ttttaattactgctataaata

SEQ ID NO: 2365768 - DNA, 17 bp, Homo sapiens
ttttacatgacagatat

SEQ ID NO: 2365769 - DNA, 23 bp, Homo sapiens
ttttactccaggttattgcaata

SEQ ID NO: 2365770 - DNA, 20 bp, Homo sapiens
ttttactctgggagtaatac

SEQ ID NO: 2365771 - DNA, 13 bp, Homo sapiens
ttttactgtctat

SEQ ID NO: 2365772 - DNA, 19 bp, Homo sapiens
ttttagaaactacaaatat

SEQ ID NO: 2365773 - DNA, 17 bp, Homo sapiens
ttttagaaatattcaca

SEQ ID NO: 2365774 - DNA, 14 bp, Homo sapiens
ttttagaaatgcat

SEQ ID NO: 2365775 - DNA, 12 bp, Homo sapiens
ttttaggaaatg

SEQ ID NO: 2365776 - DNA, 15 bp, Homo sapiens
ttttataaagcatgt

SEQ ID NO: 2365777 - DNA, 14 bp, Homo sapiens
ttttatatgattaa

SEQ ID NO: 2365778 - DNA, 19 bp, Homo sapiens
ttttatattactgacattt

SEQ ID NO: 2365779 - DNA, 16 bp, Homo sapiens
ttttatcatgcatgtc

SEQ ID NO: 2365780 - DNA, 23 bp, Homo sapiens
ttttatcgtttttgtattttcat

SEQ ID NO: 2365781 - DNA, 17 bp, Homo sapiens
ttttatggttacttctt

SEQ ID NO: 2365782 - DNA, 17 bp, Homo sapiens
ttttcaaaaggtattat

SEQ ID NO: 2365783 - DNA, 16 bp, Homo sapiens
ttttcaagaataatca

SEQ ID NO: 2365784 - DNA, 23 bp, Homo sapiens
ttttcaagcaaaacagttctcag

SEQ ID NO: 2365785 - DNA, 15 bp, Homo sapiens
ttttcaagcagcatc

SEQ ID NO: 2365786 - DNA, 14 bp, Homo sapiens
ttttcaaggcattt

SEQ ID NO: 2365787 - DNA, 14 bp, Homo sapiens
ttttcaatatattg

SEQ ID NO: 2365788 - DNA, 20 bp, Homo sapiens
ttttcaatatattgaacttt

SEQ ID NO: 2365789 - DNA, 22 bp, Homo sapiens
ttttcaatatattgaacttttg

SEQ ID NO: 2365790 - DNA, 23 bp, Homo sapiens
ttttcaatatattgaacttttgt

SEQ ID NO: 2365791 - DNA, 21 bp, Homo sapiens
ttttcacactggtaaatgtta

SEQ ID NO: 2365792 - DNA, 22 bp, Homo sapiens
ttttcagaagcaagccagacct

SEQ ID NO: 2365793 - DNA, 19 bp, Homo sapiens
ttttcagtcccctctctct

SEQ ID NO: 2365794 - DNA, 13 bp, Homo sapiens
ttttcatgaaaat

SEQ ID NO: 2365795 - DNA, 14 bp, Homo sapiens
ttttcattgtgttt

SEQ ID NO: 2365796 - DNA, 19 bp, Homo sapiens
ttttccaaaacaaaaagat

SEQ ID NO: 2365797 - DNA, 16 bp, Homo sapiens
ttttccatatcctggt

SEQ ID NO: 2365798 - DNA, 16 bp, Homo sapiens
ttttcccctttcctgt

SEQ ID NO: 2365799 - DNA, 17 bp, Homo sapiens
ttttcccctttcctgtc

SEQ ID NO: 2365800 - DNA, 14 bp, Homo sapiens
ttttccctccccag

SEQ ID NO: 2365801 - DNA, 21 bp, Homo sapiens
ttttcctacaggcctatttaa

SEQ ID NO: 2365802 - DNA, 15 bp, Homo sapiens
ttttcctcctctgcc

SEQ ID NO: 2365803 - DNA, 16 bp, Homo sapiens
ttttcctcctctgcct

SEQ ID NO: 2365804 - DNA, 17 bp, Homo sapiens
ttttcctcctctgccta

SEQ ID NO: 2365805 - DNA, 11 bp, Homo sapiens
ttttcctctgg

SEQ ID NO: 2365806 - DNA, 14 bp, Homo sapiens
ttttcctcttgtga

SEQ ID NO: 2365807 - DNA, 12 bp, Homo sapiens
ttttccttctgt

SEQ ID NO: 2365808 - DNA, 21 bp, Homo sapiens
ttttcctttaaaaaaatttaa

SEQ ID NO: 2365809 - DNA, 13 bp, Homo sapiens
ttttctaaaagct

SEQ ID NO: 2365810 - DNA, 17 bp, Homo sapiens
ttttctaaataaaaata

SEQ ID NO: 2365811 - DNA, 22 bp, Homo sapiens
ttttctaaataaaaatatgtaa

SEQ ID NO: 2365812 - DNA, 13 bp, Homo sapiens
ttttctaactttt

SEQ ID NO: 2365813 - DNA, 13 bp, Homo sapiens
ttttctaagagaa

SEQ ID NO: 2365814 - DNA, 14 bp, Homo sapiens
ttttctacagtggt

SEQ ID NO: 2365815 - DNA, 20 bp, Homo sapiens
ttttctctgcatttaaaaaa

SEQ ID NO: 2365816 - DNA, 12 bp, Homo sapiens
ttttctgccctg

SEQ ID NO: 2365817 - DNA, 15 bp, Homo sapiens
ttttctgccctggct

SEQ ID NO: 2365818 - DNA, 19 bp, Homo sapiens
ttttctttgaccagatctt

SEQ ID NO: 2365819 - DNA, 17 bp, Homo sapiens
ttttcttttttaaatgt

SEQ ID NO: 2365820 - DNA, 22 bp, Homo sapiens
ttttcttttttaaatgtttctt

SEQ ID NO: 2365821 - DNA, 15 bp, Homo sapiens
ttttgaaaagctatt

SEQ ID NO: 2365822 - DNA, 13 bp, Homo sapiens
ttttgaaacaaag

SEQ ID NO: 2365823 - DNA, 22 bp, Homo sapiens
ttttgaatgcttcctgacaatc

SEQ ID NO: 2365824 - DNA, 13 bp, Homo sapiens
ttttgagtattcc

SEQ ID NO: 2365825 - DNA, 13 bp, Homo sapiens
ttttgctagatgg

SEQ ID NO: 2365826 - DNA, 16 bp, Homo sapiens
ttttgctgctgaattt

SEQ ID NO: 2365827 - DNA, 13 bp, Homo sapiens
ttttgctggaata

SEQ ID NO: 2365828 - DNA, 19 bp, Homo sapiens
ttttggcaaacgctaaaga

SEQ ID NO: 2365829 - DNA, 15 bp, Homo sapiens
tttgctgtgaacaat

SEQ ID NO: 2365830 - DNA, 15 bp, Homo sapiens
tttgcttgatccaga

SEQ ID NO: 2365831 - DNA, 13 bp, Homo sapiens
tttgctttctggt

SEQ ID NO: 2365832 - DNA, 15 bp, Homo sapiens
tttgctttcttgtct

SEQ ID NO: 2365833 - DNA, 17 bp, Homo sapiens
tttggaaaaaactctga

SEQ ID NO: 2365834 - DNA, 19 bp, Homo sapiens
tttggaaaaaactctgaag

SEQ ID NO: 2365835 - DNA, 20 bp, Homo sapiens
tttggaaaagtggcgtggga

SEQ ID NO: 2365836 - DNA, 23 bp, Homo sapiens
tttggaagagaggcacctgctgg

SEQ ID NO: 2365837 - DNA, 19 bp, Homo sapiens
tttggaagtttagctctga

SEQ ID NO: 2365838 - DNA, 18 bp, Homo sapiens
tttggaataatttctatt

SEQ ID NO: 2365839 - DNA, 16 bp, Homo sapiens
tttggacctaatccaa

SEQ ID NO: 2365840 - DNA, 15 bp, Homo sapiens
tttggattctaaata

SEQ ID NO: 2365841 - DNA, 14 bp, Homo sapiens
tttgtaaaaatctt

SEQ ID NO: 2365842 - DNA, 15 bp, Homo sapiens
tttgtaaagtttccg

SEQ ID NO: 2365843 - DNA, 20 bp, Homo sapiens
tttgtaagaaggcaatatta

SEQ ID NO: 2365844 - DNA, 18 bp, Homo sapiens
tttgtaagagtgtagaag

SEQ ID NO: 2365845 - DNA, 23 bp, Homo sapiens
tttgtaagagtgtagaagcattc

SEQ ID NO: 2365846 - DNA, 23 bp, Homo sapiens
tttgtaataagcaatcaaggtta

SEQ ID NO: 2365847 - DNA, 22 bp, Homo sapiens
tttgtacagaccgagaggccag

SEQ ID NO: 2365848 - DNA, 12 bp, Homo sapiens
tttgtacatctt

SEQ ID NO: 2365849 - DNA, 11 bp, Homo sapiens
tttgtacatgt

SEQ ID NO: 2365850 - DNA, 20 bp, Homo sapiens
tttgtactttatcatgaatg

SEQ ID NO: 2365851 - DNA, 18 bp, Homo sapiens
tttgtagcgtacatcaat

SEQ ID NO: 2365852 - DNA, 23 bp, Homo sapiens
tttgtagtaaaagtggtctctgc

SEQ ID NO: 2365853 - DNA, 17 bp, Homo sapiens
tttgtagttaatataaa

SEQ ID NO: 2365854 - DNA, 12 bp, Homo sapiens
tttgtatgtgtg

SEQ ID NO: 2365855 - DNA, 14 bp, Homo sapiens
tttgtattgtatat

SEQ ID NO: 2365856 - DNA, 21 bp, Homo sapiens
tttgtattttcatgaaaatac

SEQ ID NO: 2365857 - DNA, 17 bp, Homo sapiens
tttgtcctttatgtatt

SEQ ID NO: 2365858 - DNA, 17 bp, Homo sapiens
tttgtcctttttcactt

SEQ ID NO: 2365859 - DNA, 17 bp, Homo sapiens
tttgtctgtttttactc

SEQ ID NO: 2365860 - DNA, 23 bp, Homo sapiens
tttgtgaatggattggattattt

SEQ ID NO: 2365861 - DNA, 15 bp, Homo sapiens
tttgtggtttggaat

SEQ ID NO: 2365862 - DNA, 16 bp, Homo sapiens
tttgtgtcctccagga

SEQ ID NO: 2365863 - DNA, 19 bp, Homo sapiens
tttgtgtcctccaggagct

SEQ ID NO: 2365864 - DNA, 16 bp, Homo sapiens
tttgttgcaagatgtg

SEQ ID NO: 2365865 - DNA, 17 bp, Homo sapiens
ttttaaaaaatggtcac

SEQ ID NO: 2365866 - DNA, 18 bp, Homo sapiens
ttttaaaaaggtaaatgg

SEQ ID NO: 2365867 - DNA, 19 bp, Homo sapiens
ttttaaaaattgttattta

SEQ ID NO: 2365868 - DNA, 16 bp, Homo sapiens
ttttaaaatagaaatt

SEQ ID NO: 2365869 - DNA, 21 bp, Homo sapiens
ttttaaaatagaaattttgta

SEQ ID NO: 2365870 - DNA, 17 bp, Homo sapiens
ttttaaaatttgtctta

SEQ ID NO: 2365871 - DNA, 17 bp, Homo sapiens
ttttaaacccaaaatat

SEQ ID NO: 2365872 - DNA, 13 bp, Homo sapiens
tttactaacagta

SEQ ID NO: 2365873 - DNA, 21 bp, Homo sapiens
tttactaacagtaactgccat

SEQ ID NO: 2365874 - DNA, 14 bp, Homo sapiens
tttactaactaaat

SEQ ID NO: 2365875 - DNA, 20 bp, Homo sapiens
tttacttctcgaattgaagc

SEQ ID NO: 2365876 - DNA, 11 bp, Homo sapiens
tttagaaatat

SEQ ID NO: 2365877 - DNA, 14 bp, Homo sapiens
tttagaaatgcata

SEQ ID NO: 2365878 - DNA, 15 bp, Homo sapiens
tttagaaatgcatat

SEQ ID NO: 2365879 - DNA, 15 bp, Homo sapiens
tttagatctctgaag

SEQ ID NO: 2365880 - DNA, 13 bp, Homo sapiens
tttagcacagtat

SEQ ID NO: 2365881 - DNA, 15 bp, Homo sapiens
tttagcacagtattt

SEQ ID NO: 2365882 - DNA, 17 bp, Homo sapiens
tttagcacagtatttaa

SEQ ID NO: 2365883 - DNA, 20 bp, Homo sapiens
tttagcacagtatttaacat

SEQ ID NO: 2365884 - DNA, 22 bp, Homo sapiens
tttagcatgttcctccttttct

SEQ ID NO: 2365885 - DNA, 12 bp, Homo sapiens
tttagctctgag

SEQ ID NO: 2365886 - DNA, 11 bp, Homo sapiens
tttaggcagcc

SEQ ID NO: 2365887 - DNA, 17 bp, Homo sapiens
tttagtggatggaatat

SEQ ID NO: 2365888 - DNA, 19 bp, Homo sapiens
tttataataaaaatatatt

SEQ ID NO: 2365889 - DNA, 13 bp, Homo sapiens
tttataataggaa

SEQ ID NO: 2365890 - DNA, 18 bp, Homo sapiens
tttatatcaggtgtataa

SEQ ID NO: 2365891 - DNA, 17 bp, Homo sapiens
tttatatcatgcaaaat

SEQ ID NO: 2365892 - DNA, 18 bp, Homo sapiens
tttatattactgacattt

SEQ ID NO: 2365893 - DNA, 23 bp, Homo sapiens
tttatattataactctgtataat

SEQ ID NO: 2365894 - DNA, 13 bp, Homo sapiens
tttatatttcctt

SEQ ID NO: 2365895 - DNA, 17 bp, Homo sapiens
tttatatttcctttatg

SEQ ID NO: 2365896 - DNA, 22 bp, Homo sapiens
tttatatttcctttatgtgaat

SEQ ID NO: 2365897 - DNA, 22 bp, Homo sapiens
tttatcatgcatgtcctgtaaa

SEQ ID NO: 2365898 - DNA, 23 bp, Homo sapiens
tttatcatgcatgtcctgtaaag

SEQ ID NO: 2365899 - DNA, 15 bp, Homo sapiens
tttatcattaaaaat

SEQ ID NO: 2365900 - DNA, 14 bp, Homo sapiens
tttatcgtttttgt

SEQ ID NO: 2365901 - DNA, 20 bp, Homo sapiens
tttatcttattttctcaatc

SEQ ID NO: 2365902 - DNA, 18 bp, Homo sapiens
tttatctttatatgaaga

SEQ ID NO: 2365903 - DNA, 13 bp, Homo sapiens
tttatgaacaatt

SEQ ID NO: 2365904 - DNA, 12 bp, Homo sapiens
tttatgagccag

SEQ ID NO: 2365905 - DNA, 15 bp, Homo sapiens
tttatgtaattatat

SEQ ID NO: 2365906 - DNA, 20 bp, Homo sapiens
tttatgtgaatttttaagct

SEQ ID NO: 2365907 - DNA, 20 bp, Homo sapiens
tttatgttaagggaagaatt

SEQ ID NO: 2365908 - DNA, 19 bp, Homo sapiens
tttatgtttaaaatggcat

SEQ ID NO: 2365909 - DNA, 14 bp, Homo sapiens
tttattaaaatatt

SEQ ID NO: 2365910 - DNA, 18 bp, Homo sapiens
tttattaaaatatttcag

SEQ ID NO: 2365911 - DNA, 19 bp, Homo sapiens
tttattaaaatatttcagg

SEQ ID NO: 2365912 - DNA, 18 bp, Homo sapiens
tttattaatgttttcaaa

SEQ ID NO: 2365913 - DNA, 18 bp, Homo sapiens
tttattgagattttccat

SEQ ID NO: 2365914 - DNA, 20 bp, Homo sapiens
tttattttaaaatttcatag

SEQ ID NO: 2365915 - DNA, 13 bp, Homo sapiens
tttattttgtgta

SEQ ID NO: 2365916 - DNA, 13 bp, Homo sapiens
tttcaaaaaccag

SEQ ID NO: 2365917 - DNA, 20 bp, Homo sapiens
tttcaaaaggtattatacat

SEQ ID NO: 2365918 - DNA, 19 bp, Homo sapiens
tttcaaaatacatttgtaa

SEQ ID NO: 2365919 - DNA, 21 bp, Homo sapiens
tttcaaagtgatagaaaagtg

SEQ ID NO: 2365920 - DNA, 20 bp, Homo sapiens
tttcaaagttttgttgtact

SEQ ID NO: 2365921 - DNA, 21 bp, Homo sapiens
tttcaaagttttgttgtactt

SEQ ID NO: 2365922 - DNA, 20 bp, Homo sapiens
tttcaaataatgcttttcta

SEQ ID NO: 2365923 - DNA, 20 bp, Homo sapiens
tttcaagcagcatcttctgg

SEQ ID NO: 2365924 - DNA, 18 bp, Homo sapiens
tttcaatatattgaactt

SEQ ID NO: 2365925 - DNA, 22 bp, Homo sapiens
tttcaatatattgaacttttgt

SEQ ID NO: 2365926 - DNA, 17 bp, Homo sapiens
tttcacagataacataa

SEQ ID NO: 2365927 - DNA, 18 bp, Homo sapiens
tttcacagataacataaa

SEQ ID NO: 2365928 - DNA, 18 bp, Homo sapiens
tttcacaggtagcctatt

SEQ ID NO: 2365929 - DNA, 14 bp, Homo sapiens
tttcacattttcct

SEQ ID NO: 2365930 - DNA, 21 bp, Homo sapiens
tttcaccttttcaggaaaata

SEQ ID NO: 2365931 - DNA, 14 bp, Homo sapiens
tttcacttcttcct

SEQ ID NO: 2365932 - DNA, 20 bp, Homo sapiens
tttcagactgtgcaatactt

SEQ ID NO: 2365933 - DNA, 12 bp, Homo sapiens
tttcaggaaaat

SEQ ID NO: 2365934 - DNA, 18 bp, Homo sapiens
tttcagggctggctcctg

SEQ ID NO: 2365935 - DNA, 20 bp, Homo sapiens
tttcagggtcttggctgcct

SEQ ID NO: 2365936 - DNA, 19 bp, Homo sapiens
tttcaggtgacatgtgaaa

SEQ ID NO: 2365937 - DNA, 13 bp, Homo sapiens
tttcagtcccctc

SEQ ID NO: 2365938 - DNA, 16 bp, Homo sapiens
tttcagtcccctctct

SEQ ID NO: 2365939 - DNA, 22 bp, Homo sapiens
tttcagttctttggattctaaa

SEQ ID NO: 2365940 - DNA, 18 bp, Homo sapiens
tttcatgtcccagaactt

SEQ ID NO: 2365941 - DNA, 15 bp, Homo sapiens
tttcattcatcctga

SEQ ID NO: 2365942 - DNA, 22 bp, Homo sapiens
tttcattggtacacgtgtaaca

SEQ ID NO: 2365943 - DNA, 16 bp, Homo sapiens
tttttaagatttttct

SEQ ID NO: 2365944 - DNA, 20 bp, Homo sapiens
tttttaagctgcaaatctga

SEQ ID NO: 2365945 - DNA, 20 bp, Homo sapiens
tttttaattgttgtttcttt

SEQ ID NO: 2365946 - DNA, 12 bp, Homo sapiens
tttttagaaagc

SEQ ID NO: 2365947 - DNA, 23 bp, Homo sapiens
tttttataacatctttattgaaa

SEQ ID NO: 2365948 - DNA, 23 bp, Homo sapiens
tttttataattgtacaaaattaa

SEQ ID NO: 2365949 - DNA, 18 bp, Homo sapiens
tttttatagcaacaacaa

SEQ ID NO: 2365950 - DNA, 23 bp, Homo sapiens
tttttattaaaatatttcaggtt

SEQ ID NO: 2365951 - DNA, 23 bp, Homo sapiens
tttttcaaggcatttattgccat

SEQ ID NO: 2365952 - DNA, 17 bp, Homo sapiens
tttttcaatatattgaa

SEQ ID NO: 2365953 - DNA, 19 bp, Homo sapiens
tttttcaatatattgaact

SEQ ID NO: 2365954 - DNA, 20 bp, Homo sapiens
tttttcaatatattgaactt

SEQ ID NO: 2365955 - DNA, 21 bp, Homo sapiens
tttttcatccattaccctcct

SEQ ID NO: 2365956 - DNA, 22 bp, Homo sapiens
tttttcatgacataataaagta

SEQ ID NO: 2365957 - DNA, 14 bp, Homo sapiens
tttttcattgtgtt

SEQ ID NO: 2365958 - DNA, 15 bp, Homo sapiens
tttttccctccccag

SEQ ID NO: 2365959 - DNA, 11 bp, Homo sapiens
tttttcccttt

SEQ ID NO: 2365960 - DNA, 13 bp, Homo sapiens
tttttcctcccag

SEQ ID NO: 2365961 - DNA, 13 bp, Homo sapiens
tttttcctctcca

SEQ ID NO: 2365962 - DNA, 11 bp, Homo sapiens
tttttccttta

SEQ ID NO: 2365963 - DNA, 20 bp, Homo sapiens
tttttgaaaagcagacattt

SEQ ID NO: 2365964 - DNA, 13 bp, Homo sapiens
tttttgacactga

SEQ ID NO: 2365965 - DNA, 19 bp, Homo sapiens
tttttgacactgaaagttt

SEQ ID NO: 2365966 - DNA, 16 bp, Homo sapiens
tttttgagtcaaagac

SEQ ID NO: 2365967 - DNA, 17 bp, Homo sapiens
tttttggaaagtcagaa

SEQ ID NO: 2365968 - DNA, 20 bp, Homo sapiens
tttttgtaaatgtgtacata

SEQ ID NO: 2365969 - DNA, 22 bp, Homo sapiens
tttttgtaataagcaatcaagg

SEQ ID NO: 2365970 - DNA, 11 bp, Homo sapiens
tttttgtacat

SEQ ID NO: 2365971 - DNA, 14 bp, Homo sapiens
tttttgtttggaga

SEQ ID NO: 2365972 - DNA, 17 bp, Homo sapiens
ttttttaagtgttctgt

SEQ ID NO: 2365973 - DNA, 18 bp, Homo sapiens
ttttttcagactgtgcaa

SEQ ID NO: 2365974 - DNA, 12 bp, Homo sapiens
ttttttctaaga

SEQ ID NO: 2365975 - DNA, 14 bp, Homo sapiens
ttttttgtctgtga

SEQ ID NO: 2365976 - DNA, 12 bp, Homo sapiens
ttttttgttatt

SEQ ID NO: 2365977 - DNA, 11 bp, Homo sapiens
tttttttcaaa

SEQ ID NO: 2365978 - DNA, 14 bp, Homo sapiens
tttttttctaagag

SEQ ID NO: 2365979 - DNA, 12 bp, Homo sapiens
tttttttctatt

SEQ ID NO: 2365980 - DNA, 13 bp, Homo sapiens
tttttttgtaata

SEQ ID NO: 2365981 - DNA, 13 bp, Homo sapiens
tttttttttgagg

SEQ ID NO: 2365982 - DNA, 12 bp, Homo sapiens
ttgtaaagtttc

SEQ ID NO: 2365983 - DNA, 19 bp, Homo sapiens
ttgtaagaaggcaatatta

SEQ ID NO: 2365984 - DNA, 24 bp, Homo sapiens
ttgtaagaaggcaatattaaccta

SEQ ID NO: 2365985 - DNA, 15 bp, Homo sapiens
ttgtaagagtgtaga

SEQ ID NO: 2365986 - DNA, 18 bp, Homo sapiens
ttgtaagtgtaaaaaatg

SEQ ID NO: 2365987 - DNA, 13 bp, Homo sapiens
ttgtaagtttcag

SEQ ID NO: 2365988 - DNA, 19 bp, Homo sapiens
ttgtaagtttcaggtgaca

SEQ ID NO: 2365989 - DNA, 22 bp, Homo sapiens
ttgtaagtttcaggtgacatgt

SEQ ID NO: 2365990 - DNA, 14 bp, Homo sapiens
ttgtaataaaatgt

SEQ ID NO: 2365991 - DNA, 16 bp, Homo sapiens
ttgtaatcgtgtgcca

SEQ ID NO: 2365992 - DNA, 18 bp, Homo sapiens
ttgtacaaaattaagcaa

SEQ ID NO: 2365993 - DNA, 13 bp, Homo sapiens
ttgtacatagcaa

SEQ ID NO: 2365994 - DNA, 17 bp, Homo sapiens
ttgtacatttatgattt

SEQ ID NO: 2365995 - DNA, 22 bp, Homo sapiens
ttgtactgaatttttttgtaat

SEQ ID NO: 2365996 - DNA, 13 bp, Homo sapiens
ttgtagaacttta

SEQ ID NO: 2365997 - DNA, 17 bp, Homo sapiens
ttgtagcatttaaaatg

SEQ ID NO: 2365998 - DNA, 23 bp, Homo sapiens
ttgtagcatttaaaatggaaaat

SEQ ID NO: 2365999 - DNA, 19 bp, Homo sapiens
ttgtagctggggctttgat

SEQ ID NO: 2366000 - DNA, 22 bp, Homo sapiens
ttgtatagcatgaaataaaata

SEQ ID NO: 2366001 - DNA, 17 bp, Homo sapiens
ttgtattttcatgaaaa

SEQ ID NO: 2366002 - DNA, 18 bp, Homo sapiens
ttgtattttcatgaaaat

SEQ ID NO: 2366003 - DNA, 17 bp, Homo sapiens
ttgtcaccagatctgat

SEQ ID NO: 2366004 - DNA, 11 bp, Homo sapiens
ttgtcccagac

SEQ ID NO: 2366005 - DNA, 15 bp, Homo sapiens
ttgtcctttatgtat

SEQ ID NO: 2366006 - DNA, 22 bp, Homo sapiens
ttgtcgaaaagagtcttccaat

SEQ ID NO: 2366007 - DNA, 16 bp, Homo sapiens
ttgtctgatttcttag

SEQ ID NO: 2366008 - DNA, 13 bp, Homo sapiens
ttgtcttaaaaat

SEQ ID NO: 2366009 - DNA, 18 bp, Homo sapiens
ttgtcttatgtgaaaaat

SEQ ID NO: 2366010 - DNA, 14 bp, Homo sapiens
ttgtcttttgagct

SEQ ID NO: 2366011 - DNA, 14 bp, Homo sapiens
ttgtgaagtacata

SEQ ID NO: 2366012 - DNA, 21 bp, Homo sapiens
ttgtgaatggattggattatt

SEQ ID NO: 2366013 - DNA, 16 bp, Homo sapiens
ttgtgacaagaataat

SEQ ID NO: 2366014 - DNA, 21 bp, Homo sapiens
ttgtgacagtgcctcttccag

SEQ ID NO: 2366015 - DNA, 21 bp, Homo sapiens
ttgtgagaaacatctcaataa

SEQ ID NO: 2366016 - DNA, 12 bp, Homo sapiens
ttgtgagctgga

SEQ ID NO: 2366017 - DNA, 18 bp, Homo sapiens
ttgtgatctgttgtaata

SEQ ID NO: 2366018 - DNA, 19 bp, Homo sapiens
ttgtgattcaatctgtaaa

SEQ ID NO: 2366019 - DNA, 12 bp, Homo sapiens
ttgtgcactgtt

SEQ ID NO: 2366020 - DNA, 21 bp, Homo sapiens
ttgtgcttcacagtagagcca

SEQ ID NO: 2366021 - DNA, 23 bp, Homo sapiens
ttgtggcctcaagcaatccacct

SEQ ID NO: 2366022 - DNA, 17 bp, Homo sapiens
ttgtggctatcctgatt

SEQ ID NO: 2366023 - DNA, 17 bp, Homo sapiens
ttgtggggcctgggagg

SEQ ID NO: 2366024 - DNA, 14 bp, Homo sapiens
ttgtggtttggaat

SEQ ID NO: 2366025 - DNA, 12 bp, Homo sapiens
ttgtgtaaaaaa

SEQ ID NO: 2366026 - DNA, 19 bp, Homo sapiens
ttgtgtcctccaggagctt

SEQ ID NO: 2366027 - DNA, 16 bp, Homo sapiens
ttgtgtgaaattgcat

SEQ ID NO: 2366028 - DNA, 13 bp, Homo sapiens
ttgtgtgctctcc

SEQ ID NO: 2366029 - DNA, 15 bp, Homo sapiens
ttgtgtgctctccat

SEQ ID NO: 2366030 - DNA, 22 bp, Homo sapiens
ttgtgttcagctctttccaaat

SEQ ID NO: 2366031 - DNA, 17 bp, Homo sapiens
ttgtgttttttaagata

SEQ ID NO: 2366032 - DNA, 13 bp, Homo sapiens
ttgttagggctgc

SEQ ID NO: 2366033 - DNA, 23 bp, Homo sapiens
ttgttagggctgcttttcttaag

SEQ ID NO: 2366034 - DNA, 18 bp, Homo sapiens
ttgttatgtagataacaa

SEQ ID NO: 2366035 - DNA, 17 bp, Homo sapiens
ttgttcatcatccagat

SEQ ID NO: 2366036 - DNA, 14 bp, Homo sapiens
ttgttctttcagaa

SEQ ID NO: 2366037 - DNA, 22 bp, Homo sapiens
ttgttgagcatgacagcctgca

SEQ ID NO: 2366038 - DNA, 16 bp, Homo sapiens
ttgttgcaagatgtga

SEQ ID NO: 2366039 - DNA, 14 bp, Homo sapiens
ttgttgcggatgga

SEQ ID NO: 2366040 - DNA, 14 bp, Homo sapiens
ttgttgtacttaaa

SEQ ID NO: 2366041 - DNA, 15 bp, Homo sapiens
ttgttgtttcttgcc

SEQ ID NO: 2366042 - DNA, 15 bp, Homo sapiens
ttgtttaaaatgtaa

SEQ ID NO: 2366043 - DNA, 22 bp, Homo sapiens
ttgtttgagtttttcctcccag

SEQ ID NO: 2366044 - DNA, 13 bp, Homo sapiens
ttgtttgccagga

SEQ ID NO: 2366045 - DNA, 12 bp, Homo sapiens
ttgtttggagac

SEQ ID NO: 2366046 - DNA, 13 bp, Homo sapiens
ttgttttacaata

SEQ ID NO: 2366047 - DNA, 17 bp, Homo sapiens
ttgttttggatggcttg

SEQ ID NO: 2366048 - DNA, 13 bp, Homo sapiens
ttgttttgtggat

SEQ ID NO: 2366049 - DNA, 16 bp, Homo sapiens
tttaaaaaatggtcac

SEQ ID NO: 2366050 - DNA, 19 bp, Homo sapiens
tttaaaaacattttttata

SEQ ID NO: 2366051 - DNA, 12 bp, Homo sapiens
tttaaaaattgt

SEQ ID NO: 2366052 - DNA, 14 bp, Homo sapiens
tgttctttcagaaa

SEQ ID NO: 2366053 - DNA, 15 bp, Homo sapiens
tgttctttcagaaag

SEQ ID NO: 2366054 - DNA, 15 bp, Homo sapiens
tgttctttcctcaca

SEQ ID NO: 2366055 - DNA, 14 bp, Homo sapiens
tgttctttcctgcc

SEQ ID NO: 2366056 - DNA, 22 bp, Homo sapiens
tgttctttcctgccctgtccaa

SEQ ID NO: 2366057 - DNA, 18 bp, Homo sapiens
tgttgacctgtgcaccta

SEQ ID NO: 2366058 - DNA, 20 bp, Homo sapiens
tgttgagcatgacagcctgc

SEQ ID NO: 2366059 - DNA, 17 bp, Homo sapiens
tgttgagccccagtgct

SEQ ID NO: 2366060 - DNA, 23 bp, Homo sapiens
tgttgagccccagtgctggaagg

SEQ ID NO: 2366061 - DNA, 14 bp, Homo sapiens
tgttgataatatat

SEQ ID NO: 2366062 - DNA, 15 bp, Homo sapiens
tgttgcaagatgtga

SEQ ID NO: 2366063 - DNA, 17 bp, Homo sapiens
tgttgcaagatgtgaat

SEQ ID NO: 2366064 - DNA, 19 bp, Homo sapiens
tgttgcaagatgtgaatta

SEQ ID NO: 2366065 - DNA, 23 bp, Homo sapiens
tgttgcaagatgtgaattattga

SEQ ID NO: 2366066 - DNA, 17 bp, Homo sapiens
tgttgcccctttctctt

SEQ ID NO: 2366067 - DNA, 20 bp, Homo sapiens
tgttgcccctttctcttttc

SEQ ID NO: 2366068 - DNA, 13 bp, Homo sapiens
tgttggagtgagg

SEQ ID NO: 2366069 - DNA, 14 bp, Homo sapiens
tgttggagtgagga

SEQ ID NO: 2366070 - DNA, 20 bp, Homo sapiens
tgttggggagtgggtggcag

SEQ ID NO: 2366071 - DNA, 14 bp, Homo sapiens
tgttggtcatttta

SEQ ID NO: 2366072 - DNA, 16 bp, Homo sapiens
tgttgtaagaattctg

SEQ ID NO: 2366073 - DNA, 15 bp, Homo sapiens
tgttgtacatttatg

SEQ ID NO: 2366074 - DNA, 18 bp, Homo sapiens
tgttgtacatttatgatt

SEQ ID NO: 2366075 - DNA, 22 bp, Homo sapiens
tgttgtacatttatgatttaat

SEQ ID NO: 2366076 - DNA, 23 bp, Homo sapiens
tgttgtacatttatgatttaata

SEQ ID NO: 2366077 - DNA, 15 bp, Homo sapiens
tgttgtacttaaatg

SEQ ID NO: 2366078 - DNA, 22 bp, Homo sapiens
tgttgtgaagctaatgtcacaa

SEQ ID NO: 2366079 - DNA, 13 bp, Homo sapiens
tgttgtgagcttt

SEQ ID NO: 2366080 - DNA, 16 bp, Homo sapiens
tgttgttctttcagaa

SEQ ID NO: 2366081 - DNA, 13 bp, Homo sapiens
tgttgtttctttc

SEQ ID NO: 2366082 - DNA, 15 bp, Homo sapiens
tgttgtttctttcta

SEQ ID NO: 2366083 - DNA, 15 bp, Homo sapiens
tgtttaaaataaaat

SEQ ID NO: 2366084 - DNA, 21 bp, Homo sapiens
tgtttaaaataaaatgaaaat

SEQ ID NO: 2366085 - DNA, 20 bp, Homo sapiens
tgtttaaaatgtaatttaaa

SEQ ID NO: 2366086 - DNA, 15 bp, Homo sapiens
tgtttacctttctct

SEQ ID NO: 2366087 - DNA, 23 bp, Homo sapiens
tgtttacctttctctctctaagg

SEQ ID NO: 2366088 - DNA, 16 bp, Homo sapiens
tgtttataataaaaat

SEQ ID NO: 2366089 - DNA, 17 bp, Homo sapiens
tgtttatatggaagaaa

SEQ ID NO: 2366090 - DNA, 16 bp, Homo sapiens
tgtttatgagccagac

SEQ ID NO: 2366091 - DNA, 14 bp, Homo sapiens
tgtttatttacaag

SEQ ID NO: 2366092 - DNA, 20 bp, Homo sapiens
tgtttattttctacgtttct

SEQ ID NO: 2366093 - DNA, 19 bp, Homo sapiens
tgtttcaagaggagccccc

SEQ ID NO: 2366094 - DNA, 22 bp, Homo sapiens
tgtttcaagaggagcccccacc

SEQ ID NO: 2366095 - DNA, 17 bp, Homo sapiens
tgtttcattcatcctga

SEQ ID NO: 2366096 - DNA, 20 bp, Homo sapiens
tgtttcctaggaggaaaatt

SEQ ID NO: 2366097 - DNA, 22 bp, Homo sapiens
tgtttctattttttgaaaagca

SEQ ID NO: 2366098 - DNA, 20 bp, Homo sapiens
tgtttctcttgagctggcct

SEQ ID NO: 2366099 - DNA, 13 bp, Homo sapiens
tgtttctgaaaag

SEQ ID NO: 2366100 - DNA, 13 bp, Homo sapiens
tgtttctgtcaag

SEQ ID NO: 2366101 - DNA, 19 bp, Homo sapiens
tgtttgagtttttcctccc

SEQ ID NO: 2366102 - DNA, 22 bp, Homo sapiens
tgtttgagtttttcctcccagt

SEQ ID NO: 2366103 - DNA, 13 bp, Homo sapiens
tgtttgccaggac

SEQ ID NO: 2366104 - DNA, 17 bp, Homo sapiens
tgtttgctgatccccaa

SEQ ID NO: 2366105 - DNA, 20 bp, Homo sapiens
tgtttggaaaaaactctgaa

SEQ ID NO: 2366106 - DNA, 17 bp, Homo sapiens
tgtttggaaaagacagt

SEQ ID NO: 2366107 - DNA, 12 bp, Homo sapiens
tgtttggtaaat

SEQ ID NO: 2366108 - DNA, 20 bp, Homo sapiens
tgtttgtacacaacaatcct

SEQ ID NO: 2366109 - DNA, 18 bp, Homo sapiens
tgtttgtcacaagtggtg

SEQ ID NO: 2366110 - DNA, 13 bp, Homo sapiens
tgttttacaatag

SEQ ID NO: 2366111 - DNA, 16 bp, Homo sapiens
tgttttatatgattaa

SEQ ID NO: 2366112 - DNA, 19 bp, Homo sapiens
ttacagaaatggactggag

SEQ ID NO: 2366113 - DNA, 15 bp, Homo sapiens
ttacagtggcagtat

SEQ ID NO: 2366114 - DNA, 16 bp, Homo sapiens
ttacagttctttcctc

SEQ ID NO: 2366115 - DNA, 18 bp, Homo sapiens
ttacatcttttctaatca

SEQ ID NO: 2366116 - DNA, 13 bp, Homo sapiens
ttacatgcatttg

SEQ ID NO: 2366117 - DNA, 14 bp, Homo sapiens
ttaccattcacaat

SEQ ID NO: 2366118 - DNA, 23 bp, Homo sapiens
ttacccatttgggtgggagtgtt

SEQ ID NO: 2366119 - DNA, 13 bp, Homo sapiens
ttaccccgggaga

SEQ ID NO: 2366120 - DNA, 13 bp, Homo sapiens
ttaccctggcccc

SEQ ID NO: 2366121 - DNA, 18 bp, Homo sapiens
ttaccctggcccctctcc

SEQ ID NO: 2366122 - DNA, 23 bp, Homo sapiens
ttacctactttgactttttgcat

SEQ ID NO: 2366123 - DNA, 21 bp, Homo sapiens
ttacctagctaattatttaat

SEQ ID NO: 2366124 - DNA, 21 bp, Homo sapiens
ttacctccatccatccttcca

SEQ ID NO: 2366125 - DNA, 19 bp, Homo sapiens
ttacctgtatacagtgcag

SEQ ID NO: 2366126 - DNA, 14 bp, Homo sapiens
ttacctttctctct

SEQ ID NO: 2366127 - DNA, 18 bp, Homo sapiens
ttaccttttcagggctgg

SEQ ID NO: 2366128 - DNA, 16 bp, Homo sapiens
ttactgaataatatca

SEQ ID NO: 2366129 - DNA, 14 bp, Homo sapiens
ttactgacatttct

SEQ ID NO: 2366130 - DNA, 23 bp, Homo sapiens
ttactgatatattttacaatttt

SEQ ID NO: 2366131 - DNA, 17 bp, Homo sapiens
ttactgctttaatcaga

SEQ ID NO: 2366132 - DNA, 17 bp, Homo sapiens
ttactggtccaaaagat

SEQ ID NO: 2366133 - DNA, 14 bp, Homo sapiens
ttactgtggaggaa

SEQ ID NO: 2366134 - DNA, 15 bp, Homo sapiens
ttacttttaaactgt

SEQ ID NO: 2366135 - DNA, 19 bp, Homo sapiens
ttagaaatattcacatctt

SEQ ID NO: 2366136 - DNA, 18 bp, Homo sapiens
ttagaaatgtttattgac

SEQ ID NO: 2366137 - DNA, 17 bp, Homo sapiens
ttagaaattaaatctgt

SEQ ID NO: 2366138 - DNA, 23 bp, Homo sapiens
ttagaagcactacaccttgcctt

SEQ ID NO: 2366139 - DNA, 21 bp, Homo sapiens
ttagagaggtagcgagctgct

SEQ ID NO: 2366140 - DNA, 17 bp, Homo sapiens
ttagagtatttcccttc

SEQ ID NO: 2366141 - DNA, 23 bp, Homo sapiens
ttagagtatttcccttccaaaga

SEQ ID NO: 2366142 - DNA, 13 bp, Homo sapiens
ttagattgagaaa

SEQ ID NO: 2366143 - DNA, 13 bp, Homo sapiens
ttagcacagtatt

SEQ ID NO: 2366144 - DNA, 21 bp, Homo sapiens
ttagcacagtatttaacattc

SEQ ID NO: 2366145 - DNA, 16 bp, Homo sapiens
ttagcattcataaact

SEQ ID NO: 2366146 - DNA, 17 bp, Homo sapiens
ttagccaggatcatggt

SEQ ID NO: 2366147 - DNA, 19 bp, Homo sapiens
ttagcggcaaacctttccc

SEQ ID NO: 2366148 - DNA, 11 bp, Homo sapiens
ttagctcaggt

SEQ ID NO: 2366149 - DNA, 18 bp, Homo sapiens
ttagctccataaagtaca

SEQ ID NO: 2366150 - DNA, 16 bp, Homo sapiens
ttagctttttaattgt

SEQ ID NO: 2366151 - DNA, 15 bp, Homo sapiens
ttaggaatctcttca

SEQ ID NO: 2366152 - DNA, 14 bp, Homo sapiens
ttagggaatgagag

SEQ ID NO: 2366153 - DNA, 14 bp, Homo sapiens
ttaggtgtctgtcc

SEQ ID NO: 2366154 - DNA, 15 bp, Homo sapiens
ttagtacaatttcaa

SEQ ID NO: 2366155 - DNA, 13 bp, Homo sapiens
ttagtattatctt

SEQ ID NO: 2366156 - DNA, 16 bp, Homo sapiens
ttagtggatggaatat

SEQ ID NO: 2366157 - DNA, 16 bp, Homo sapiens
ttagtggctcaacatt

SEQ ID NO: 2366158 - DNA, 22 bp, Homo sapiens
ttagtgtgacagtttccaaatt

SEQ ID NO: 2366159 - DNA, 15 bp, Homo sapiens
ttagttccagtttct

SEQ ID NO: 2366160 - DNA, 20 bp, Homo sapiens
ttagttccagtttctccttg

SEQ ID NO: 2366161 - DNA, 13 bp, Homo sapiens
ttagttctgttga

SEQ ID NO: 2366162 - DNA, 13 bp, Homo sapiens
ttataaagcatgt

SEQ ID NO: 2366163 - DNA, 20 bp, Homo sapiens
ttatacaaacctaccaaaat

SEQ ID NO: 2366164 - DNA, 16 bp, Homo sapiens
ttatacatttggttat

SEQ ID NO: 2366165 - DNA, 21 bp, Homo sapiens
ttatagaggctagcttctgct

SEQ ID NO: 2366166 - DNA, 16 bp, Homo sapiens
ttatagtcaatggctt

SEQ ID NO: 2366167 - DNA, 16 bp, Homo sapiens
ttatatcatgcaaaat

SEQ ID NO: 2366168 - DNA, 19 bp, Homo sapiens
ttatatgaagaaaatcact

SEQ ID NO: 2366169 - DNA, 12 bp, Homo sapiens
ttatatgaagtt

SEQ ID NO: 2366170 - DNA, 21 bp, Homo sapiens
tggaggaggaaggcaagaggg

SEQ ID NO: 2366171 - DNA, 24 bp, Homo sapiens
tggaggcctcaggtgctgtccatg

SEQ ID NO: 2366172 - DNA, 15 bp, Homo sapiens
tggaggcttcctgcg

SEQ ID NO: 2366173 - DNA, 17 bp, Homo sapiens
tggaggcttcctgcgtc

SEQ ID NO: 2366174 - DNA, 22 bp, Homo sapiens
tggaggcttttatggggccctg

SEQ ID NO: 2366175 - DNA, 14 bp, Homo sapiens
tggaggggtgtggc

SEQ ID NO: 2366176 - DNA, 19 bp, Homo sapiens
tggaggggtgtggcagtgg

SEQ ID NO: 2366177 - DNA, 17 bp, Homo sapiens
tggaggttgaagccaag

SEQ ID NO: 2366178 - DNA, 13 bp, Homo sapiens
tggagtctcctga

SEQ ID NO: 2366179 - DNA, 15 bp, Homo sapiens
tggagttaaaatgca

SEQ ID NO: 2366180 - DNA, 14 bp, Homo sapiens
tggagtttctctgt

SEQ ID NO: 2366181 - DNA, 15 bp, Homo sapiens
tggataactagccag

SEQ ID NO: 2366182 - DNA, 12 bp, Homo sapiens
tggataagaaaa

SEQ ID NO: 2366183 - DNA, 20 bp, Homo sapiens
tggataagaaaaatgcttga

SEQ ID NO: 2366184 - DNA, 18 bp, Homo sapiens
tggatagacttgggatgg

SEQ ID NO: 2366185 - DNA, 19 bp, Homo sapiens
tggatatataggctatttt

SEQ ID NO: 2366186 - DNA, 15 bp, Homo sapiens
tggatcactcaccat

SEQ ID NO: 2366187 - DNA, 17 bp, Homo sapiens
tggatgcgcagtgcctt

SEQ ID NO: 2366188 - DNA, 20 bp, Homo sapiens
tggatggaaggttggatgga

SEQ ID NO: 2366189 - DNA, 13 bp, Homo sapiens
tggatggggcagg

SEQ ID NO: 2366190 - DNA, 20 bp, Homo sapiens
tggatggggcaggccacctg

SEQ ID NO: 2366191 - DNA, 17 bp, Homo sapiens
tggatgggtggatggcc

SEQ ID NO: 2366192 - DNA, 22 bp, Homo sapiens
tggatggtttgttgttctgcct

SEQ ID NO: 2366193 - DNA, 21 bp, Homo sapiens
tggatgttatgaacagctgtg

SEQ ID NO: 2366194 - DNA, 16 bp, Homo sapiens
tggattatttaataac

SEQ ID NO: 2366195 - DNA, 20 bp, Homo sapiens
tggattatttaataacatta

SEQ ID NO: 2366196 - DNA, 20 bp, Homo sapiens
tggattggattatttaataa

SEQ ID NO: 2366197 - DNA, 21 bp, Homo sapiens
tggattggattatttaataac

SEQ ID NO: 2366198 - DNA, 11 bp, Homo sapiens
tggattgtttt

SEQ ID NO: 2366199 - DNA, 23 bp, Homo sapiens
tggatttaagagtattttaagaa

SEQ ID NO: 2366200 - DNA, 14 bp, Homo sapiens
tggatttcttttgt

SEQ ID NO: 2366201 - DNA, 16 bp, Homo sapiens
tggatttcttttgtaa

SEQ ID NO: 2366202 - DNA, 18 bp, Homo sapiens
tggatttggcactagcca

SEQ ID NO: 2366203 - DNA, 24 bp, Homo sapiens
tggcaaacgctaaagagcccttgc

SEQ ID NO: 2366204 - DNA, 19 bp, Homo sapiens
tggcaatgactcaaagtct

SEQ ID NO: 2366205 - DNA, 21 bp, Homo sapiens
tggcacccaccgtggaggagg

SEQ ID NO: 2366206 - DNA, 17 bp, Homo sapiens
tggcactgggaggcagg

SEQ ID NO: 2366207 - DNA, 22 bp, Homo sapiens
tggcagaagacaccagagcaga

SEQ ID NO: 2366208 - DNA, 16 bp, Homo sapiens
tggcagatgtcttccc

SEQ ID NO: 2366209 - DNA, 15 bp, Homo sapiens
tggcagtgcaatgct

SEQ ID NO: 2366210 - DNA, 23 bp, Homo sapiens
tggcagttaattggatgttcact

SEQ ID NO: 2366211 - DNA, 20 bp, Homo sapiens
tggcatgatcatagctcact

SEQ ID NO: 2366212 - DNA, 22 bp, Homo sapiens
tggcatgatcatagctcactgc

SEQ ID NO: 2366213 - DNA, 17 bp, Homo sapiens
tggcatgcttaaatttt

SEQ ID NO: 2366214 - DNA, 16 bp, Homo sapiens
tggcatttagcacagt

SEQ ID NO: 2366215 - DNA, 20 bp, Homo sapiens
tggcatttagcacagtattt

SEQ ID NO: 2366216 - DNA, 14 bp, Homo sapiens
tggcatttccaaac

SEQ ID NO: 2366217 - DNA, 16 bp, Homo sapiens
tggcatttctctttaa

SEQ ID NO: 2366218 - DNA, 23 bp, Homo sapiens
tggcatttctctttaaactatgt

SEQ ID NO: 2366219 - DNA, 17 bp, Homo sapiens
tggcatttggtctcagg

SEQ ID NO: 2366220 - DNA, 18 bp, Homo sapiens
tggcatttggtctcaggc

SEQ ID NO: 2366221 - DNA, 14 bp, Homo sapiens
tggccaagcctatc

SEQ ID NO: 2366222 - DNA, 23 bp, Homo sapiens
tggccacagcaagtacagcggct

SEQ ID NO: 2366223 - DNA, 20 bp, Homo sapiens
tggccacagcgccagcctca

SEQ ID NO: 2366224 - DNA, 21 bp, Homo sapiens
tggccagcccctggggcccag

SEQ ID NO: 2366225 - DNA, 19 bp, Homo sapiens
tggccaggtggttgtctta

SEQ ID NO: 2366226 - DNA, 22 bp, Homo sapiens
tggccagtaaaatactattgcc

SEQ ID NO: 2366227 - DNA, 21 bp, Homo sapiens
tggccatgaatctctgcctct

SEQ ID NO: 2366228 - DNA, 17 bp, Homo sapiens
tggccatgttatgctgg

SEQ ID NO: 2366229 - DNA, 19 bp, Homo sapiens
tggccatgttatgctggtg

SEQ ID NO: 2366230 - DNA, 12 bp, Homo sapiens
tggcccaaggct

SEQ ID NO: 2366231 - DNA, 23 bp, Homo sapiens
tggcccaaggctggcaggtcaac

SEQ ID NO: 2366232 - DNA, 14 bp, Homo sapiens
tggcccagaaagcc

SEQ ID NO: 2366233 - DNA, 21 bp, Homo sapiens
tggcccagaaagcctctctct

SEQ ID NO: 2366234 - DNA, 23 bp, Homo sapiens
tggcccagaaagcctctctctcc

SEQ ID NO: 2366235 - DNA, 16 bp, Homo sapiens
tggccccagccctgct

SEQ ID NO: 2366236 - DNA, 17 bp, Homo sapiens
tggccccagcctgggcc

SEQ ID NO: 2366237 - DNA, 22 bp, Homo sapiens
tggccctgggagaatcgctcct

SEQ ID NO: 2366238 - DNA, 13 bp, Homo sapiens
tggccctgtccca

SEQ ID NO: 2366239 - DNA, 15 bp, Homo sapiens
tggcctatccgctgc

SEQ ID NO: 2366240 - DNA, 18 bp, Homo sapiens
tggcctatccgctgccag

SEQ ID NO: 2366241 - DNA, 20 bp, Homo sapiens
tgctgaatgccccctgctta

SEQ ID NO: 2366242 - DNA, 14 bp, Homo sapiens
tgctgactgtagct

SEQ ID NO: 2366243 - DNA, 19 bp, Homo sapiens
tgctgagattgcagatgtg

SEQ ID NO: 2366244 - DNA, 18 bp, Homo sapiens
tgctgaggcccagtgcat

SEQ ID NO: 2366245 - DNA, 19 bp, Homo sapiens
tgctgatcagagttcctcc

SEQ ID NO: 2366246 - DNA, 20 bp, Homo sapiens
tgctgatcttttaaaatcat

SEQ ID NO: 2366247 - DNA, 20 bp, Homo sapiens
tgctgcaaacctgacccctg

SEQ ID NO: 2366248 - DNA, 16 bp, Homo sapiens
tgctgcaggatggact

SEQ ID NO: 2366249 - DNA, 21 bp, Homo sapiens
tgctgccatgacagaggctgc

SEQ ID NO: 2366250 - DNA, 20 bp, Homo sapiens
tgctgcccccaccccgggga

SEQ ID NO: 2366251 - DNA, 15 bp, Homo sapiens
tgctgccttgcttct

SEQ ID NO: 2366252 - DNA, 18 bp, Homo sapiens
tgctgcgcctgcaggcag

SEQ ID NO: 2366253 - DNA, 16 bp, Homo sapiens
tgctgctgtccagtgc

SEQ ID NO: 2366254 - DNA, 17 bp, Homo sapiens
tgctggaaaccacactt

SEQ ID NO: 2366255 - DNA, 15 bp, Homo sapiens
tgctggaagcccagc

SEQ ID NO: 2366256 - DNA, 17 bp, Homo sapiens
tgctggaataagttcaa

SEQ ID NO: 2366257 - DNA, 13 bp, Homo sapiens
tgctggaggcctc

SEQ ID NO: 2366258 - DNA, 18 bp, Homo sapiens
tgctggccccagccctgc

SEQ ID NO: 2366259 - DNA, 20 bp, Homo sapiens
tgctggccccagccctgctg

SEQ ID NO: 2366260 - DNA, 20 bp, Homo sapiens
tgctgggaggagggagaggg

SEQ ID NO: 2366261 - DNA, 17 bp, Homo sapiens
tgctggggcctgggaca

SEQ ID NO: 2366262 - DNA, 19 bp, Homo sapiens
tgctggggtcaaggcagta

SEQ ID NO: 2366263 - DNA, 14 bp, Homo sapiens
tgctggtatttcta

SEQ ID NO: 2366264 - DNA, 22 bp, Homo sapiens
tgctgtaactcagacattccaa

SEQ ID NO: 2366265 - DNA, 17 bp, Homo sapiens
tgctgtagcctattttt

SEQ ID NO: 2366266 - DNA, 22 bp, Homo sapiens
tgctgtatatggaattctttta

SEQ ID NO: 2366267 - DNA, 16 bp, Homo sapiens
tgctgtatgtgagctg

SEQ ID NO: 2366268 - DNA, 22 bp, Homo sapiens
tgctgtccaggcagctccctcc

SEQ ID NO: 2366269 - DNA, 13 bp, Homo sapiens
tgctgtccagtgc

SEQ ID NO: 2366270 - DNA, 15 bp, Homo sapiens
tgctgtccagtgcct

SEQ ID NO: 2366271 - DNA, 16 bp, Homo sapiens
tgctgtccagtgccta

SEQ ID NO: 2366272 - DNA, 17 bp, Homo sapiens
tgctgtccagtgcctac

SEQ ID NO: 2366273 - DNA, 22 bp, Homo sapiens
tgctgtcctgtttctgtcaagc

SEQ ID NO: 2366274 - DNA, 15 bp, Homo sapiens
tgctgtctgggtgct

SEQ ID NO: 2366275 - DNA, 20 bp, Homo sapiens
tgctgtgtgaccctgggcaa

SEQ ID NO: 2366276 - DNA, 15 bp, Homo sapiens
tgtaaatgtgtacat

SEQ ID NO: 2366277 - DNA, 16 bp, Homo sapiens
tgtaaccaatcctact

SEQ ID NO: 2366278 - DNA, 13 bp, Homo sapiens
tgtaactcagaca

SEQ ID NO: 2366279 - DNA, 15 bp, Homo sapiens
tgtaacttccaaata

SEQ ID NO: 2366280 - DNA, 20 bp, Homo sapiens
tgtaacttccaaataaataa

SEQ ID NO: 2366281 - DNA, 16 bp, Homo sapiens
tgtaacttgcttaaat

SEQ ID NO: 2366282 - DNA, 21 bp, Homo sapiens
tgtaagaacaactacctgagc

SEQ ID NO: 2366283 - DNA, 15 bp, Homo sapiens
tgtaagagcttgctc

SEQ ID NO: 2366284 - DNA, 15 bp, Homo sapiens
tgtaagagtgtagaa

SEQ ID NO: 2366285 - DNA, 19 bp, Homo sapiens
tgtaagagtgtagaagcat

SEQ ID NO: 2366286 - DNA, 16 bp, Homo sapiens
tgtaagtgaaattaag

SEQ ID NO: 2366287 - DNA, 16 bp, Homo sapiens
tgtaagtgtagctcaa

SEQ ID NO: 2366288 - DNA, 15 bp, Homo sapiens
tgtaagtttcaggtg

SEQ ID NO: 2366289 - DNA, 19 bp, Homo sapiens
tgtaagtttcaggtgacat

SEQ ID NO: 2366290 - DNA, 19 bp, Homo sapiens
tgtaatacttctttgttat

SEQ ID NO: 2366291 - DNA, 17 bp, Homo sapiens
tgtaatatcagttacag

SEQ ID NO: 2366292 - DNA, 21 bp, Homo sapiens
tgtaatatcagttacagtggc

SEQ ID NO: 2366293 - DNA, 23 bp, Homo sapiens
tgtaatatcagttacagtggcag

SEQ ID NO: 2366294 - DNA, 12 bp, Homo sapiens
tgtaattatata

SEQ ID NO: 2366295 - DNA, 21 bp, Homo sapiens
tgtaattatatatactatatt

SEQ ID NO: 2366296 - DNA, 14 bp, Homo sapiens
tgtaattattttcc

SEQ ID NO: 2366297 - DNA, 15 bp, Homo sapiens
tgtaatttaaatgaa

SEQ ID NO: 2366298 - DNA, 13 bp, Homo sapiens
tgtaatttcaaaa

SEQ ID NO: 2366299 - DNA, 11 bp, Homo sapiens
tgtacaaaagc

SEQ ID NO: 2366300 - DNA, 13 bp, Homo sapiens
tgtacaaaagcaa

SEQ ID NO: 2366301 - DNA, 15 bp, Homo sapiens
tgtacaaaagcaatg

SEQ ID NO: 2366302 - DNA, 24 bp, Homo sapiens
tgtacaaaattaagcaaatgttaa

SEQ ID NO: 2366303 - DNA, 13 bp, Homo sapiens
tgtacaaacatgt

SEQ ID NO: 2366304 - DNA, 14 bp, Homo sapiens
tgtacaaacatgtt

SEQ ID NO: 2366305 - DNA, 22 bp, Homo sapiens
tgtacagaacacatttctctga

SEQ ID NO: 2366306 - DNA, 23 bp, Homo sapiens
tgtacagaatatttctattgaat

SEQ ID NO: 2366307 - DNA, 17 bp, Homo sapiens
tgtacagaccgagaggc

SEQ ID NO: 2366308 - DNA, 13 bp, Homo sapiens
tgtacataactga

SEQ ID NO: 2366309 - DNA, 14 bp, Homo sapiens
tgtacataactgaa

SEQ ID NO: 2366310 - DNA, 17 bp, Homo sapiens
tgtacataactgaaaat

SEQ ID NO: 2366311 - DNA, 21 bp, Homo sapiens
tgtacatgttcgggtgtgggt

SEQ ID NO: 2366312 - DNA, 21 bp, Homo sapiens
tgtacatttatgatttaataa

SEQ ID NO: 2366313 - DNA, 13 bp, Homo sapiens
tgtaccaaaattt

SEQ ID NO: 2366314 - DNA, 17 bp, Homo sapiens
tgtaccaaaattttaaa

SEQ ID NO: 2366315 - DNA, 16 bp, Homo sapiens
tgtactaatctgagat

SEQ ID NO: 2366316 - DNA, 22 bp, Homo sapiens
tgtacttaaatggtaataagca

SEQ ID NO: 2366317 - DNA, 18 bp, Homo sapiens
tgtacttcccgggccagg

SEQ ID NO: 2366318 - DNA, 16 bp, Homo sapiens
tgtagaagcattcctt

SEQ ID NO: 2366319 - DNA, 22 bp, Homo sapiens
tgtagaagcattccttctttga

SEQ ID NO: 2366320 - DNA, 19 bp, Homo sapiens
tgtagacaaagtacattct

SEQ ID NO: 2366321 - DNA, 17 bp, Homo sapiens
tgtagagtgtagactgt

SEQ ID NO: 2366322 - DNA, 17 bp, Homo sapiens
tgtagagttaagaagct

SEQ ID NO: 2366323 - DNA, 21 bp, Homo sapiens
tgtagagttaagaagctgttg

SEQ ID NO: 2366324 - DNA, 18 bp, Homo sapiens
tgtagatatgtattcttt

SEQ ID NO: 2366325 - DNA, 16 bp, Homo sapiens
tgtagccacagctgct

SEQ ID NO: 2366326 - DNA, 23 bp, Homo sapiens
tgtagccacagctgctgttctca

SEQ ID NO: 2366327 - DNA, 16 bp, Homo sapiens
tgtagcctgtgcatgt

SEQ ID NO: 2366328 - DNA, 22 bp, Homo sapiens
tgtagcctgtgcatgtatgtct

SEQ ID NO: 2366329 - DNA, 11 bp, Homo sapiens
tgtagctcagt

SEQ ID NO: 2366330 - DNA, 23 bp, Homo sapiens
tgtagctttggaagtttagctct

SEQ ID NO: 2366331 - DNA, 21 bp, Homo sapiens
tgtaggggaggggctcctttc

SEQ ID NO: 2366332 - DNA, 22 bp, Homo sapiens
tgtaggggaggggctcctttcc

SEQ ID NO: 2366333 - DNA, 23 bp, Homo sapiens
tgtaggggaggggctcctttcca

SEQ ID NO: 2366334 - DNA, 14 bp, Homo sapiens
tgtaggtaagactg

SEQ ID NO: 2366335 - DNA, 14 bp, Homo sapiens
tgtagtaaaagtgg

SEQ ID NO: 2366336 - DNA, 17 bp, Homo sapiens
tgtagtaaaagtggtct

SEQ ID NO: 2366337 - DNA, 21 bp, Homo sapiens
tgtagttgcgtggactctgca

SEQ ID NO: 2366338 - DNA, 19 bp, Homo sapiens
tgtataaatatacagtata

SEQ ID NO: 2366339 - DNA, 18 bp, Homo sapiens
tgtataaatgtacatttc

SEQ ID NO: 2366340 - DNA, 20 bp, Homo sapiens
tgtataatattgaaaattga

SEQ ID NO: 2366341 - DNA, 21 bp, Homo sapiens
tgtataatattgaaaattgaa

SEQ ID NO: 2366342 - DNA, 22 bp, Homo sapiens
tgtataatattgaaaattgaaa

SEQ ID NO: 2366343 - DNA, 16 bp, Homo sapiens
tgtatacagtgcagag

SEQ ID NO: 2366344 - DNA, 19 bp, Homo sapiens
tgtatattacaatgatcac

SEQ ID NO: 2366345 - DNA, 15 bp, Homo sapiens
tgtatgactaaagag

SEQ ID NO: 2366346 - DNA, 16 bp, Homo sapiens
tgtatgactaaagaga

SEQ ID NO: 2366347 - DNA, 21 bp, Homo sapiens
tgtatgactaaagagagaatg

SEQ ID NO: 2366348 - DNA, 15 bp, Homo sapiens
tgtatgtcaaagctt

SEQ ID NO: 2366349 - DNA, 17 bp, Homo sapiens
tgtatgtcaaagctttg

SEQ ID NO: 2366350 - DNA, 19 bp, Homo sapiens
tgtatgtcttggacactgt

SEQ ID NO: 2366351 - DNA, 16 bp, Homo sapiens
tgtatgtgtggctgtg

SEQ ID NO: 2366352 - DNA, 17 bp, Homo sapiens
tgtatgtgtggctgtgg

SEQ ID NO: 2366353 - DNA, 19 bp, Homo sapiens
tgtatgtgtggctgtgggt

SEQ ID NO: 2366354 - DNA, 22 bp, Homo sapiens
tgtatgttaaagagaatgagtc

SEQ ID NO: 2366355 - DNA, 14 bp, Homo sapiens
tgtattaagccaat

SEQ ID NO: 2366356 - DNA, 17 bp, Homo sapiens
tgtattcagtgagggtc

SEQ ID NO: 2366357 - DNA, 13 bp, Homo sapiens
tgtattccaagac

SEQ ID NO: 2366358 - DNA, 15 bp, Homo sapiens
tgtattccaagacat

SEQ ID NO: 2366359 - DNA, 20 bp, Homo sapiens
tgtattccaagacatgtctg

SEQ ID NO: 2366360 - DNA, 14 bp, Homo sapiens
tgtatttaaaaaca

SEQ ID NO: 2366361 - DNA, 15 bp, Homo sapiens
tgtatttaaaaacat

SEQ ID NO: 2366362 - DNA, 17 bp, Homo sapiens
tgtatttaaaaacattt

SEQ ID NO: 2366363 - DNA, 11 bp, Homo sapiens
tgtatttcctt

SEQ ID NO: 2366364 - DNA, 22 bp, Homo sapiens
tgtatttctctattttcataat

SEQ ID NO: 2366365 - DNA, 23 bp, Homo sapiens
tgtattttatcttattttctcaa

SEQ ID NO: 2366366 - DNA, 14 bp, Homo sapiens
tgtattttcagagc

SEQ ID NO: 2366367 - DNA, 16 bp, Homo sapiens
tgtattttcatgaaaa

SEQ ID NO: 2366368 - DNA, 13 bp, Homo sapiens
tgtcaaagctttg

SEQ ID NO: 2366369 - DNA, 15 bp, Homo sapiens
tgtcaagctgctctg

SEQ ID NO: 2366370 - DNA, 20 bp, Homo sapiens
tgtcacagtccaaccagaaa

SEQ ID NO: 2366371 - DNA, 21 bp, Homo sapiens
tgtcaccctccaccgagccac

SEQ ID NO: 2366372 - DNA, 18 bp, Homo sapiens
tgtcacggggttccctcc

SEQ ID NO: 2366373 - DNA, 21 bp, Homo sapiens
tgtcagaacagagtgcaaccc

SEQ ID NO: 2366374 - DNA, 19 bp, Homo sapiens
tgtcagctactaatgatgt

SEQ ID NO: 2366375 - DNA, 19 bp, Homo sapiens
tgtcagctgaggctggggg

SEQ ID NO: 2366376 - DNA, 16 bp, Homo sapiens
tgtcagttttgtacat

SEQ ID NO: 2366377 - DNA, 21 bp, Homo sapiens
tgtcatataaactcatttatc

SEQ ID NO: 2366378 - DNA, 17 bp, Homo sapiens
tgtcattgcacataagc

SEQ ID NO: 2366379 - DNA, 17 bp, Homo sapiens
tgtcattttgaactgta

SEQ ID NO: 2366380 - DNA, 17 bp, Homo sapiens
tgtccaaagaggctgcc

SEQ ID NO: 2366381 - DNA, 19 bp, Homo sapiens
tgtccaaagaggctgcccc

SEQ ID NO: 2366382 - DNA, 23 bp, Homo sapiens
tgtccacgcgtgccgtggcacca

SEQ ID NO: 2366383 - DNA, 14 bp, Homo sapiens
tgtccagctggggc

SEQ ID NO: 2366384 - DNA, 18 bp, Homo sapiens
tgtccagcttccaaagcc

SEQ ID NO: 2366385 - DNA, 20 bp, Homo sapiens
tgtccaggcagctccctcct

SEQ ID NO: 2366386 - DNA, 18 bp, Homo sapiens
tgtcccagccagtgagga

SEQ ID NO: 2366387 - DNA, 13 bp, Homo sapiens
tgtcccaggccgg

SEQ ID NO: 2366388 - DNA, 13 bp, Homo sapiens
tgtcccccaggct

SEQ ID NO: 2366389 - DNA, 16 bp, Homo sapiens
tgtcccccaggctgga

SEQ ID NO: 2366390 - DNA, 18 bp, Homo sapiens
tgctgttgtgaagctaat

SEQ ID NO: 2366391 - DNA, 21 bp, Homo sapiens
tgcttaaaccacttaaacgaa

SEQ ID NO: 2366392 - DNA, 13 bp, Homo sapiens
tgcttaaatttct

SEQ ID NO: 2366393 - DNA, 15 bp, Homo sapiens
tgcttaaatttctta

SEQ ID NO: 2366394 - DNA, 16 bp, Homo sapiens
tgcttaaatttcttat

SEQ ID NO: 2366395 - DNA, 15 bp, Homo sapiens
tgcttaataaaagaa

SEQ ID NO: 2366396 - DNA, 18 bp, Homo sapiens
tgcttaataaaagaacat

SEQ ID NO: 2366397 - DNA, 21 bp, Homo sapiens
tgcttaatcttcaaagccttc

SEQ ID NO: 2366398 - DNA, 19 bp, Homo sapiens
tgcttataacctagttaaa

SEQ ID NO: 2366399 - DNA, 12 bp, Homo sapiens
tgcttcattatt

SEQ ID NO: 2366400 - DNA, 16 bp, Homo sapiens
tgcttccaggaaactc

SEQ ID NO: 2366401 - DNA, 14 bp, Homo sapiens
tgcttcctgatgct

SEQ ID NO: 2366402 - DNA, 13 bp, Homo sapiens
tgcttcctttctc

SEQ ID NO: 2366403 - DNA, 18 bp, Homo sapiens
tgcttcctttctctcctg

SEQ ID NO: 2366404 - DNA, 21 bp, Homo sapiens
tgcttctcagatttctgagga

SEQ ID NO: 2366405 - DNA, 11 bp, Homo sapiens
tgcttctcttt

SEQ ID NO: 2366406 - DNA, 16 bp, Homo sapiens
tgcttgaaggccctgc

SEQ ID NO: 2366407 - DNA, 15 bp, Homo sapiens
tgcttgatccagaag

SEQ ID NO: 2366408 - DNA, 22 bp, Homo sapiens
tgcttgatccagaagagcccat

SEQ ID NO: 2366409 - DNA, 21 bp, Homo sapiens
tgcttgcggcaaaaggaaagc

SEQ ID NO: 2366410 - DNA, 22 bp, Homo sapiens
tgcttggaacatactgttcact

SEQ ID NO: 2366411 - DNA, 13 bp, Homo sapiens
tgcttgtagaagt

SEQ ID NO: 2366412 - DNA, 20 bp, Homo sapiens
tgcttgtcttctggtacttt

SEQ ID NO: 2366413 - DNA, 22 bp, Homo sapiens
tgcttgtcttctggtactttct

SEQ ID NO: 2366414 - DNA, 21 bp, Homo sapiens
tgctttaccttttcagggctg

SEQ ID NO: 2366415 - DNA, 15 bp, Homo sapiens
tgctttattaatgtt

SEQ ID NO: 2366416 - DNA, 16 bp, Homo sapiens
tgctttctctctagta

SEQ ID NO: 2366417 - DNA, 13 bp, Homo sapiens
tgctttcttgtct

SEQ ID NO: 2366418 - DNA, 14 bp, Homo sapiens
tgctttgaaaaatc

SEQ ID NO: 2366419 - DNA, 17 bp, Homo sapiens
tgctttgaaaaatctca

SEQ ID NO: 2366420 - DNA, 22 bp, Homo sapiens
tgctttggggggtgtgctgaca

SEQ ID NO: 2366421 - DNA, 17 bp, Homo sapiens
tgcttttctgtatttta

SEQ ID NO: 2366422 - DNA, 16 bp, Homo sapiens
tgctttttagaaagca

SEQ ID NO: 2366423 - DNA, 14 bp, Homo sapiens
tgctttttcttgtt

SEQ ID NO: 2366424 - DNA, 13 bp, Homo sapiens
tggaaaaaactct

SEQ ID NO: 2366425 - DNA, 15 bp, Homo sapiens
tggaaaactgtgttg

SEQ ID NO: 2366426 - DNA, 18 bp, Homo sapiens
tggaaaaggaagactaga

SEQ ID NO: 2366427 - DNA, 18 bp, Homo sapiens
tggaaaatgccatgaatt

SEQ ID NO: 2366428 - DNA, 19 bp, Homo sapiens
tggaaaccacacttcttga

SEQ ID NO: 2366429 - DNA, 21 bp, Homo sapiens
tggaaaccacacttcttgaaa

SEQ ID NO: 2366430 - DNA, 14 bp, Homo sapiens
tggaaagaggctct

SEQ ID NO: 2366431 - DNA, 19 bp, Homo sapiens
tggaaagcagagttttcat

SEQ ID NO: 2366432 - DNA, 13 bp, Homo sapiens
tggaaaggggaga

SEQ ID NO: 2366433 - DNA, 15 bp, Homo sapiens
tggaaaggggagagc

SEQ ID NO: 2366434 - DNA, 19 bp, Homo sapiens
tggaaaggggagagcctgc

SEQ ID NO: 2366435 - DNA, 23 bp, Homo sapiens
tggaaaggggagagcctgctggc

SEQ ID NO: 2366436 - DNA, 13 bp, Homo sapiens
tggaaagtcagaa

SEQ ID NO: 2366437 - DNA, 16 bp, Homo sapiens
tggaaatagcatgaca

SEQ ID NO: 2366438 - DNA, 16 bp, Homo sapiens
tggaaatgtctgctgg

SEQ ID NO: 2366439 - DNA, 13 bp, Homo sapiens
tggaaattcctgt

SEQ ID NO: 2366440 - DNA, 17 bp, Homo sapiens
tggaacatactgttcac

SEQ ID NO: 2366441 - DNA, 19 bp, Homo sapiens
tggaaccacattgaagaat

SEQ ID NO: 2366442 - DNA, 14 bp, Homo sapiens
tggaaccagcccca

SEQ ID NO: 2366443 - DNA, 13 bp, Homo sapiens
tggaagaagggag

SEQ ID NO: 2366444 - DNA, 17 bp, Homo sapiens
tggaagaagggagaaga

SEQ ID NO: 2366445 - DNA, 21 bp, Homo sapiens
tggaagaagggagaagaaagg

SEQ ID NO: 2366446 - DNA, 14 bp, Homo sapiens
tggaagagaggcac

SEQ ID NO: 2366447 - DNA, 23 bp, Homo sapiens
tggaagagaggcacctgctggaa

SEQ ID NO: 2366448 - DNA, 16 bp, Homo sapiens
tggaagcccctgggcc

SEQ ID NO: 2366449 - DNA, 19 bp, Homo sapiens
tggaagctgtttggaaaag

SEQ ID NO: 2366450 - DNA, 15 bp, Homo sapiens
tggaaggatctgctg

SEQ ID NO: 2366451 - DNA, 16 bp, Homo sapiens
tggaaggcagagaaat

SEQ ID NO: 2366452 - DNA, 17 bp, Homo sapiens
tggaaggcagagaaatc

SEQ ID NO: 2366453 - DNA, 18 bp, Homo sapiens
tggaaggcagagaaatct

SEQ ID NO: 2366454 - DNA, 20 bp, Homo sapiens
tggaaggcagagaaatctaa

SEQ ID NO: 2366455 - DNA, 14 bp, Homo sapiens
tggaaggctttgcc

SEQ ID NO: 2366456 - DNA, 20 bp, Homo sapiens
tggaagggaggaaggccttt

SEQ ID NO: 2366457 - DNA, 15 bp, Homo sapiens
tggaataatttctat

SEQ ID NO: 2366458 - DNA, 12 bp, Homo sapiens
tggaatattaaa

SEQ ID NO: 2366459 - DNA, 13 bp, Homo sapiens
tggaatattaaaa

SEQ ID NO: 2366460 - DNA, 21 bp, Homo sapiens
tggaatggaaaagcaacttca

SEQ ID NO: 2366461 - DNA, 13 bp, Homo sapiens
tggaattgtggct

SEQ ID NO: 2366462 - DNA, 16 bp, Homo sapiens
tggacaaaaaaaaaag

SEQ ID NO: 2366463 - DNA, 17 bp, Homo sapiens
tggacaaaaaaaaaaga

SEQ ID NO: 2366464 - DNA, 16 bp, Homo sapiens
tggacacattggaatg

SEQ ID NO: 2366465 - DNA, 14 bp, Homo sapiens
tggacacgagccac

SEQ ID NO: 2366466 - DNA, 23 bp, Homo sapiens
tggacacgagccacaagctgcac

SEQ ID NO: 2366467 - DNA, 21 bp, Homo sapiens
acctttgggatcagcctccgc

SEQ ID NO: 2366468 - DNA, 11 bp, Homo sapiens
accttttcagg

SEQ ID NO: 2366469 - DNA, 13 bp, Homo sapiens
accttttcaggaa

SEQ ID NO: 2366470 - DNA, 16 bp, Homo sapiens
accttttcaggaaaat

SEQ ID NO: 2366471 - DNA, 22 bp, Homo sapiens
accttttcaggaaaataactta

SEQ ID NO: 2366472 - DNA, 15 bp, Homo sapiens
accttttctgtggct

SEQ ID NO: 2366473 - DNA, 16 bp, Homo sapiens
accttttctgtggctg

SEQ ID NO: 2366474 - DNA, 20 bp, Homo sapiens
accttttttaagatttttct

SEQ ID NO: 2366475 - DNA, 17 bp, Homo sapiens
acgaaatatcaaagtca

SEQ ID NO: 2366476 - DNA, 21 bp, Homo sapiens
acgaatgaaaataactgaatt

SEQ ID NO: 2366477 - DNA, 18 bp, Homo sapiens
acgagccacaagctgcac

SEQ ID NO: 2366478 - DNA, 22 bp, Homo sapiens
acgagccacaagctgcactgtg

SEQ ID NO: 2366479 - DNA, 15 bp, Homo sapiens
acgaggaaccgaaaa

SEQ ID NO: 2366480 - DNA, 17 bp, Homo sapiens
acgatggcaattggcat

SEQ ID NO: 2366481 - DNA, 16 bp, Homo sapiens
acgcacgctcgctgcc

SEQ ID NO: 2366482 - DNA, 21 bp, Homo sapiens
acgcacgctcgctgccatcac

SEQ ID NO: 2366483 - DNA, 15 bp, Homo sapiens
acgcagaactaccag

SEQ ID NO: 2366484 - DNA, 14 bp, Homo sapiens
acgccaacagcccc

SEQ ID NO: 2366485 - DNA, 18 bp, Homo sapiens
acgcctcttctgtccctg

SEQ ID NO: 2366486 - DNA, 23 bp, Homo sapiens
acgcctcttctgtccctgttaga

SEQ ID NO: 2366487 - DNA, 18 bp, Homo sapiens
acgctaaagagcccttgc

SEQ ID NO: 2366488 - DNA, 21 bp, Homo sapiens
acgctaaagagcccttgcctc

SEQ ID NO: 2366489 - DNA, 21 bp, Homo sapiens
acgctcctttgtgtgtgtgtc

SEQ ID NO: 2366490 - DNA, 12 bp, Homo sapiens
acgctctggaca

SEQ ID NO: 2366491 - DNA, 15 bp, Homo sapiens
acgcttgtgacagtg

SEQ ID NO: 2366492 - DNA, 18 bp, Homo sapiens
acgctttcctgaatccaa

SEQ ID NO: 2366493 - DNA, 18 bp, Homo sapiens
acggcaggctcactgcca

SEQ ID NO: 2366494 - DNA, 16 bp, Homo sapiens
acggccaccactgcag

SEQ ID NO: 2366495 - DNA, 13 bp, Homo sapiens
acggctcctcaga

SEQ ID NO: 2366496 - DNA, 14 bp, Homo sapiens
acggctcctcagag

SEQ ID NO: 2366497 - DNA, 18 bp, Homo sapiens
acggctcctcagagcgcc

SEQ ID NO: 2366498 - DNA, 22 bp, Homo sapiens
acggctcctcagagcgccagga

SEQ ID NO: 2366499 - DNA, 20 bp, Homo sapiens
acggtcctttaggcagcctg

SEQ ID NO: 2366500 - DNA, 11 bp, Homo sapiens
acggttcctgg

SEQ ID NO: 2366501 - DNA, 19 bp, Homo sapiens
acggttcctggtgactcct

SEQ ID NO: 2366502 - DNA, 19 bp, Homo sapiens
acgtcactttttggccatg

SEQ ID NO: 2366503 - DNA, 15 bp, Homo sapiens
tgcattattaaattg

SEQ ID NO: 2366504 - DNA, 20 bp, Homo sapiens
tgcattcatttttatagcaa

SEQ ID NO: 2366505 - DNA, 17 bp, Homo sapiens
tgcatttaaaacagaca

SEQ ID NO: 2366506 - DNA, 22 bp, Homo sapiens
tgcatttaaaacagacactggc

SEQ ID NO: 2366507 - DNA, 14 bp, Homo sapiens
tgcatttaataaag

SEQ ID NO: 2366508 - DNA, 14 bp, Homo sapiens
tgcatttttgtaaa

SEQ ID NO: 2366509 - DNA, 15 bp, Homo sapiens
tgcatttttgtaaat

SEQ ID NO: 2366510 - DNA, 14 bp, Homo sapiens
tgcatttttgtgaa

SEQ ID NO: 2366511 - DNA, 17 bp, Homo sapiens
tgcatttttgtgaaatg

SEQ ID NO: 2366512 - DNA, 19 bp, Homo sapiens
tgcatttttgtgaaatgaa

SEQ ID NO: 2366513 - DNA, 11 bp, Homo sapiens
tgccaaagtac

SEQ ID NO: 2366514 - DNA, 19 bp, Homo sapiens
tgccaaagtacagaatttg

SEQ ID NO: 2366515 - DNA, 23 bp, Homo sapiens
tgccacaatgcagttctgagcac

SEQ ID NO: 2366516 - DNA, 22 bp, Homo sapiens
tgccacactgatggctcaagac

SEQ ID NO: 2366517 - DNA, 14 bp, Homo sapiens
tgccacagccagag

SEQ ID NO: 2366518 - DNA, 15 bp, Homo sapiens
tgccacagccagagg

SEQ ID NO: 2366519 - DNA, 17 bp, Homo sapiens
tgccacagtagaactgt

SEQ ID NO: 2366520 - DNA, 22 bp, Homo sapiens
tgccacagtagaactgtctgtg

SEQ ID NO: 2366521 - DNA, 22 bp, Homo sapiens
tgccacatcaaacctttgagta

SEQ ID NO: 2366522 - DNA, 19 bp, Homo sapiens
tgccactaaactacattgt

SEQ ID NO: 2366523 - DNA, 21 bp, Homo sapiens
tgccactttacccacctagaa

SEQ ID NO: 2366524 - DNA, 20 bp, Homo sapiens
tgccactttcacgtggcctc

SEQ ID NO: 2366525 - DNA, 22 bp, Homo sapiens
tgccagaggaatcctggcagcc

SEQ ID NO: 2366526 - DNA, 17 bp, Homo sapiens
tgccagcaaataaatac

SEQ ID NO: 2366527 - DNA, 16 bp, Homo sapiens
tgccagcagcagcagg

SEQ ID NO: 2366528 - DNA, 21 bp, Homo sapiens
tgccagccccctaaaagcact

SEQ ID NO: 2366529 - DNA, 22 bp, Homo sapiens
tgccagccccctaaaagcactc

SEQ ID NO: 2366530 - DNA, 17 bp, Homo sapiens
tgccagccttgagccct

SEQ ID NO: 2366531 - DNA, 21 bp, Homo sapiens
tgccagccttgagccctggct

SEQ ID NO: 2366532 - DNA, 22 bp, Homo sapiens
tgcctgcccctaccctggactt

SEQ ID NO: 2366533 - DNA, 19 bp, Homo sapiens
tgcctgcgcctgctgcctg

SEQ ID NO: 2366534 - DNA, 15 bp, Homo sapiens
tgcctgctgagatga

SEQ ID NO: 2366535 - DNA, 15 bp, Homo sapiens
tgcctgctttttgga

SEQ ID NO: 2366536 - DNA, 20 bp, Homo sapiens
tgcctggagacaaggtgcta

SEQ ID NO: 2366537 - DNA, 22 bp, Homo sapiens
tgcctggagttgactgactgag

SEQ ID NO: 2366538 - DNA, 11 bp, Homo sapiens
tgcctggcccc

SEQ ID NO: 2366539 - DNA, 21 bp, Homo sapiens
tgcctgggaaggcgagtctgg

SEQ ID NO: 2366540 - DNA, 12 bp, Homo sapiens
tgcctgtcaagt

SEQ ID NO: 2366541 - DNA, 13 bp, Homo sapiens
tgcctgtctgccc

SEQ ID NO: 2366542 - DNA, 14 bp, Homo sapiens
tgcctgtctgcccc

SEQ ID NO: 2366543 - DNA, 15 bp, Homo sapiens
tgcctgtgcatgacc

SEQ ID NO: 2366544 - DNA, 15 bp, Homo sapiens
tgccttaaaaccaaa

SEQ ID NO: 2366545 - DNA, 22 bp, Homo sapiens
tgccttaaaaccaaagagggct

SEQ ID NO: 2366546 - DNA, 17 bp, Homo sapiens
tgccttacatcttttct

SEQ ID NO: 2366547 - DNA, 19 bp, Homo sapiens
tgccttacatcttttctaa

SEQ ID NO: 2366548 - DNA, 14 bp, Homo sapiens
tgccttccctagct

SEQ ID NO: 2366549 - DNA, 17 bp, Homo sapiens
tgccttccctagcttta

SEQ ID NO: 2366550 - DNA, 15 bp, Homo sapiens
tgccttcctgttttt

SEQ ID NO: 2366551 - DNA, 19 bp, Homo sapiens
tgccttcctgtttttcaca

SEQ ID NO: 2366552 - DNA, 12 bp, Homo sapiens
tgccttgcctcc

SEQ ID NO: 2366553 - DNA, 13 bp, Homo sapiens
tgccttgcctcct

SEQ ID NO: 2366554 - DNA, 15 bp, Homo sapiens
tgccttgcctcctca

SEQ ID NO: 2366555 - DNA, 22 bp, Homo sapiens
tgccttgctgtttgtcctgaga

SEQ ID NO: 2366556 - DNA, 21 bp, Homo sapiens
tgccttgcttctgtatttcct

SEQ ID NO: 2366557 - DNA, 12 bp, Homo sapiens
tgccttggcctc

SEQ ID NO: 2366558 - DNA, 19 bp, Homo sapiens
tgccttggcctcccaaagt

SEQ ID NO: 2366559 - DNA, 16 bp, Homo sapiens
tgccttgtataatatt

SEQ ID NO: 2366560 - DNA, 17 bp, Homo sapiens
tgccttgtttgagtttt

SEQ ID NO: 2366561 - DNA, 16 bp, Homo sapiens
tgcctttatgatgcta

SEQ ID NO: 2366562 - DNA, 15 bp, Homo sapiens
tgcctttgagacagt

SEQ ID NO: 2366563 - DNA, 13 bp, Homo sapiens
aaaaaaaaagtca

SEQ ID NO: 2366564 - DNA, 11 bp, Homo sapiens
aaaaaaaccac

SEQ ID NO: 2366565 - DNA, 18 bp, Homo sapiens
aaaaacacggcagctgta

SEQ ID NO: 2366566 - DNA, 14 bp, Homo sapiens
aaaaacagcagctc

SEQ ID NO: 2366567 - DNA, 20 bp, Homo sapiens
aaaaagacttgagacaatgt

SEQ ID NO: 2366568 - DNA, 21 bp, Homo sapiens
aaaaagcagctaccaggtgtt

SEQ ID NO: 2366569 - DNA, 13 bp, Homo sapiens
aaaaagtggctgc

SEQ ID NO: 2366570 - DNA, 12 bp, Homo sapiens
aaaaatctcatt

SEQ ID NO: 2366571 - DNA, 14 bp, Homo sapiens
aaaaatctcattat

SEQ ID NO: 2366572 - DNA, 23 bp, Homo sapiens
aaaaatctcattatttcaaaatg

SEQ ID NO: 2366573 - DNA, 20 bp, Homo sapiens
aaaaatctcattatttctgg

SEQ ID NO: 2366574 - DNA, 18 bp, Homo sapiens
aaaaatgcctttgagaca

SEQ ID NO: 2366575 - DNA, 21 bp, Homo sapiens
aaaaatgcctttgagacagtt

SEQ ID NO: 2366576 - DNA, 19 bp, Homo sapiens
aaaaattacctttaatttt

SEQ ID NO: 2366577 - DNA, 10 bp, Homo sapiens
aaaacaaaaa

SEQ ID NO: 2366578 - DNA, 15 bp, Homo sapiens
aaaacaaaaacagaa

SEQ ID NO: 2366579 - DNA, 11 bp, Homo sapiens
aaaacaaaaag

SEQ ID NO: 2366580 - DNA, 17 bp, Homo sapiens
aaaacaaatatacattt

SEQ ID NO: 2366581 - DNA, 17 bp, Homo sapiens
aaaacagacactggcat

SEQ ID NO: 2366582 - DNA, 14 bp, Homo sapiens
aaaacagcccccac

SEQ ID NO: 2366583 - DNA, 15 bp, Homo sapiens
aaaacagttctcaga

SEQ ID NO: 2366584 - DNA, 22 bp, Homo sapiens
aaaaccaaagagggcttcctct

SEQ ID NO: 2366585 - DNA, 16 bp, Homo sapiens
aaaaccaacaatgtga

SEQ ID NO: 2366586 - DNA, 14 bp, Homo sapiens
aaaactaaatttca

SEQ ID NO: 2366587 - DNA, 18 bp, Homo sapiens
aaaactcaggcaaagaaa

SEQ ID NO: 2366588 - DNA, 23 bp, Homo sapiens
aaaactcaggcaaagaaaatgaa

SEQ ID NO: 2366589 - DNA, 22 bp, Homo sapiens
aaaactgctcctcctcctgtat

SEQ ID NO: 2366590 - DNA, 12 bp, Homo sapiens
aaaactgtgttg

SEQ ID NO: 2366591 - DNA, 14 bp, Homo sapiens
aaaagaaatatatt

SEQ ID NO: 2366592 - DNA, 16 bp, Homo sapiens
aaaagaactaaatatg

SEQ ID NO: 2366593 - DNA, 14 bp, Homo sapiens
aaaagaaggaaaga

SEQ ID NO: 2366594 - DNA, 16 bp, Homo sapiens
aaaagaccaagacttt

SEQ ID NO: 2366595 - DNA, 17 bp, Homo sapiens
aaaagagtcttccaatt

SEQ ID NO: 2366596 - DNA, 18 bp, Homo sapiens
aaaagattgctgaaattt

SEQ ID NO: 2366597 - DNA, 14 bp, Homo sapiens
aaaagcaacttcat

SEQ ID NO: 2366598 - DNA, 13 bp, Homo sapiens
aaaagcagacatt

SEQ ID NO: 2366599 - DNA, 21 bp, Homo sapiens
aaaagcatttttcaatatatt

SEQ ID NO: 2366600 - DNA, 18 bp, Homo sapiens
aaaagcccatgcttaaat

SEQ ID NO: 2366601 - DNA, 20 bp, Homo sapiens
aaaagctattagccaggatc

SEQ ID NO: 2366602 - DNA, 21 bp, Homo sapiens
aaaagctattagccaggatca

SEQ ID NO: 2366603 - DNA, 14 bp, Homo sapiens
aaaagctttttatt

SEQ ID NO: 2366604 - DNA, 13 bp, Homo sapiens
aaaaggaaagctg

SEQ ID NO: 2366605 - DNA, 16 bp, Homo sapiens
aaaaggaacaaataaa

SEQ ID NO: 2366606 - DNA, 15 bp, Homo sapiens
aaaaggcgcatctaa

SEQ ID NO: 2366607 - DNA, 20 bp, Homo sapiens
aaaaggcgcatctaacgcgt

SEQ ID NO: 2366608 - DNA, 13 bp, Homo sapiens
aaaagggagaata

SEQ ID NO: 2366609 - DNA, 13 bp, Homo sapiens
aaaaggttgaata

SEQ ID NO: 2366610 - DNA, 22 bp, Homo sapiens
aaaagtaatgacttagaaactg

SEQ ID NO: 2366611 - DNA, 13 bp, Homo sapiens
aaaagtatatgtt

SEQ ID NO: 2366612 - DNA, 14 bp, Homo sapiens
aaaagtatatgtta

SEQ ID NO: 2366613 - DNA, 15 bp, Homo sapiens
aaaagtatatgttag

SEQ ID NO: 2366614 - DNA, 17 bp, Homo sapiens
aaaagtatattaaacaa

SEQ ID NO: 2366615 - DNA, 16 bp, Homo sapiens
aaaagtccctccctgc

SEQ ID NO: 2366616 - DNA, 21 bp, Homo sapiens
aaaagtgtgtatatattttgt

SEQ ID NO: 2366617 - DNA, 13 bp, Homo sapiens
aaaagttggaagg

SEQ ID NO: 2366618 - DNA, 20 bp, Homo sapiens
aaaagttggaaggatctgct

SEQ ID NO: 2366619 - DNA, 14 bp, Homo sapiens
aaaataaaacacac

SEQ ID NO: 2366620 - DNA, 12 bp, Homo sapiens
aaaataaataat

SEQ ID NO: 2366621 - DNA, 16 bp, Homo sapiens
aaaataaataatttta

SEQ ID NO: 2366622 - DNA, 13 bp, Homo sapiens
aaaataacagtat

SEQ ID NO: 2366623 - DNA, 13 bp, Homo sapiens
aaaataattctaa

SEQ ID NO: 2366624 - DNA, 17 bp, Homo sapiens
aaaatacaaaaaaatta

SEQ ID NO: 2366625 - DNA, 17 bp, Homo sapiens
aaaatagaaaaagtgga

SEQ ID NO: 2366626 - DNA, 21 bp, Homo sapiens
aaaatagaaattttgtaagaa

SEQ ID NO: 2366627 - DNA, 20 bp, Homo sapiens
aaaatatgggttgcatttgg

SEQ ID NO: 2366628 - DNA, 16 bp, Homo sapiens
aaaatatgtaatttca

SEQ ID NO: 2366629 - DNA, 16 bp, Homo sapiens
aaaatattgtttctgc

SEQ ID NO: 2366630 - DNA, 14 bp, Homo sapiens
aaaatatttggaat

SEQ ID NO: 2366631 - DNA, 10 bp, Homo sapiens
aaaatcaaga

SEQ ID NO: 2366632 - DNA, 12 bp, Homo sapiens
aaaatcaagagt

SEQ ID NO: 2366633 - DNA, 16 bp, Homo sapiens
aaaatcaagagtgaga

SEQ ID NO: 2366634 - DNA, 24 bp, Homo sapiens
aaaatcaagagtgagatgtagaaa

SEQ ID NO: 2366635 - DNA, 20 bp, Homo sapiens
aaaatcactttcataatctt

SEQ ID NO: 2366636 - DNA, 21 bp, Homo sapiens
aaaatccccttcgctgaaatt

SEQ ID NO: 2366637 - DNA, 15 bp, Homo sapiens
aaaatctaaaatgtg

SEQ ID NO: 2366638 - DNA, 14 bp, Homo sapiens
aaaatctcattatt

SEQ ID NO: 2366639 - DNA, 23 bp, Homo sapiens
aaaatctcattatttcaaaatga

SEQ ID NO: 2366640 - DNA, 17 bp, Homo sapiens
aaaatctcattatttct

SEQ ID NO: 2366641 - DNA, 16 bp, Homo sapiens
aaaatcttttgaagca

SEQ ID NO: 2366642 - DNA, 15 bp, Homo sapiens
aaaatgaaaattgta

SEQ ID NO: 2366643 - DNA, 14 bp, Homo sapiens
aaaatgaaatgcat

SEQ ID NO: 2366644 - DNA, 18 bp, Homo sapiens
aaaatgaaatgcatattt

SEQ ID NO: 2366645 - DNA, 17 bp, Homo sapiens
aaaatgaaatttaagca

SEQ ID NO: 2366646 - DNA, 20 bp, Homo sapiens
aaaatgaaatttaagcacaa

SEQ ID NO: 2366647 - DNA, 14 bp, Homo sapiens
aaaatgagatttct

SEQ ID NO: 2366648 - DNA, 15 bp, Homo sapiens
aaaatgagatttctt

SEQ ID NO: 2366649 - DNA, 17 bp, Homo sapiens
aaaatgagatttcttat

SEQ ID NO: 2366650 - DNA, 19 bp, Homo sapiens
aaaatgagatttcttattt

SEQ ID NO: 2366651 - DNA, 16 bp, Homo sapiens
aaaatgagcttgatta

SEQ ID NO: 2366652 - DNA, 16 bp, Homo sapiens
aaaatgatagacatat

SEQ ID NO: 2366653 - DNA, 15 bp, Homo sapiens
aaaatgcctttgaga

SEQ ID NO: 2366654 - DNA, 17 bp, Homo sapiens
aaaatgcctttgagaca

SEQ ID NO: 2366655 - DNA, 22 bp, Homo sapiens
aaaatggaggccattgtgtgag

SEQ ID NO: 2366656 - DNA, 16 bp, Homo sapiens
aaaatgttttatgaca

SEQ ID NO: 2366657 - DNA, 14 bp, Homo sapiens
aaaattaaatttta

SEQ ID NO: 2366658 - DNA, 19 bp, Homo sapiens
aaaattacctttaatttta

SEQ ID NO: 2366659 - DNA, 16 bp, Homo sapiens
aaaattagttgggcat

SEQ ID NO: 2366660 - DNA, 15 bp, Homo sapiens
aaaattatttgctat

SEQ ID NO: 2366661 - DNA, 17 bp, Homo sapiens
aaaattatttgctatgg

SEQ ID NO: 2366662 - DNA, 15 bp, Homo sapiens
aaaattcaaagcatg

SEQ ID NO: 2366663 - DNA, 21 bp, Homo sapiens
aaaattcaaagcatggacatt

SEQ ID NO: 2366664 - DNA, 17 bp, Homo sapiens
aaaattccaaattcatg

SEQ ID NO: 2366665 - DNA, 15 bp, Homo sapiens
aaaattcctatctca

SEQ ID NO: 2366666 - DNA, 17 bp, Homo sapiens
aaaattctttagagatt

SEQ ID NO: 2366667 - DNA, 18 bp, Homo sapiens
aaaatttaagtgcgtgtg

SEQ ID NO: 2366668 - DNA, 23 bp, Homo sapiens
aaaatttaagtgcgtgtgtagag

SEQ ID NO: 2366669 - DNA, 15 bp, Homo sapiens
aaaatttacacatct

SEQ ID NO: 2366670 - DNA, 20 bp, Homo sapiens
aaaatttacacatcttaaaa

SEQ ID NO: 2366671 - DNA, 12 bp, Homo sapiens
aaaatttataca

SEQ ID NO: 2366672 - DNA, 20 bp, Homo sapiens
aaaatttatacaccagcaat

SEQ ID NO: 2366673 - DNA, 19 bp, Homo sapiens
aaaatttttatgtaattat

SEQ ID NO: 2366674 - DNA, 19 bp, Homo sapiens
aaacaaagtttcagagtat

SEQ ID NO: 2366675 - DNA, 23 bp, Homo sapiens
aaacaaagtttcagagtatattg

SEQ ID NO: 2366676 - DNA, 12 bp, Homo sapiens
aaacaacattta

SEQ ID NO: 2366677 - DNA, 13 bp, Homo sapiens
aaacaactttcac

SEQ ID NO: 2366678 - DNA, 12 bp, Homo sapiens
aaacaagtatga

SEQ ID NO: 2366679 - DNA, 15 bp, Homo sapiens
aaacagggctgcctt

SEQ ID NO: 2366680 - DNA, 16 bp, Homo sapiens
aaacagttctcactgg

SEQ ID NO: 2366681 - DNA, 13 bp, Homo sapiens
aaacagtttaaca

SEQ ID NO: 2366682 - DNA, 17 bp, Homo sapiens
aaacatgtatgtaaata

SEQ ID NO: 2366683 - DNA, 17 bp, Homo sapiens
aaaccaaaaacatttga

SEQ ID NO: 2366684 - DNA, 14 bp, Homo sapiens
aaaccaaggactga

SEQ ID NO: 2366685 - DNA, 22 bp, Homo sapiens
aaaccacttaaacgaagagttc

SEQ ID NO: 2366686 - DNA, 11 bp, Homo sapiens
aaaccagaacc

SEQ ID NO: 2366687 - DNA, 13 bp, Homo sapiens
aaacccaaaatat

SEQ ID NO: 2366688 - DNA, 21 bp, Homo sapiens
aaaccctcccagaaacatctc

SEQ ID NO: 2366689 - DNA, 15 bp, Homo sapiens
aaaccctgctgaaca

SEQ ID NO: 2366690 - DNA, 21 bp, Homo sapiens
aaaccctgtggggcctgatgg

SEQ ID NO: 2366691 - DNA, 20 bp, Homo sapiens
aaaccgagtagaaaatgtga

SEQ ID NO: 2366692 - DNA, 11 bp, Homo sapiens
aaacctcaggg

SEQ ID NO: 2366693 - DNA, 19 bp, Homo sapiens
aaacctcagggctgtccca

SEQ ID NO: 2366694 - DNA, 13 bp, Homo sapiens
aaacctgaatggt

SEQ ID NO: 2366695 - DNA, 17 bp, Homo sapiens
aaacgggaacatgcccc

SEQ ID NO: 2366696 - DNA, 20 bp, Homo sapiens
aaacgggaacatgccccctg

SEQ ID NO: 2366697 - DNA, 16 bp, Homo sapiens
aaacggtgcccatcct

SEQ ID NO: 2366698 - DNA, 15 bp, Homo sapiens
aaactaacagataag

SEQ ID NO: 2366699 - DNA, 14 bp, Homo sapiens
aaactatgttccta

SEQ ID NO: 2366700 - DNA, 22 bp, Homo sapiens
aaactattagagtatttccctt

SEQ ID NO: 2366701 - DNA, 13 bp, Homo sapiens
aaactcactgtga

SEQ ID NO: 2366702 - DNA, 20 bp, Homo sapiens
aaactccttcctggcctgag

SEQ ID NO: 2366703 - DNA, 16 bp, Homo sapiens
aaactctgaaggagag

SEQ ID NO: 2366704 - DNA, 22 bp, Homo sapiens
aaactcttatctcagtcatgca

SEQ ID NO: 2366705 - DNA, 18 bp, Homo sapiens
aaactgggaacccctttc

SEQ ID NO: 2366706 - DNA, 21 bp, Homo sapiens
aaactggttgtaaaagagaaa

SEQ ID NO: 2366707 - DNA, 12 bp, Homo sapiens
aaactgtattta

SEQ ID NO: 2366708 - DNA, 18 bp, Homo sapiens
aaactgtatttacttgtt

SEQ ID NO: 2366709 - DNA, 21 bp, Homo sapiens
aaactgtgtacataactgaaa

SEQ ID NO: 2366710 - DNA, 15 bp, Homo sapiens
aaactgtgttgccac

SEQ ID NO: 2366711 - DNA, 21 bp, Homo sapiens
aaacttcatgtaattttattt

SEQ ID NO: 2366712 - DNA, 17 bp, Homo sapiens
aaactttgggaaaacat

SEQ ID NO: 2366713 - DNA, 20 bp, Homo sapiens
aaacttttaagatttctcta

SEQ ID NO: 2366714 - DNA, 22 bp, Homo sapiens
aaagaaaaaaaaaaaagccagc

SEQ ID NO: 2366715 - DNA, 14 bp, Homo sapiens
aaagaaaacaaaaa

SEQ ID NO: 2366716 - DNA, 13 bp, Homo sapiens
aaagaaaatgaaa

SEQ ID NO: 2366717 - DNA, 13 bp, Homo sapiens
aaagaacatgctt

SEQ ID NO: 2366718 - DNA, 16 bp, Homo sapiens
aaagaactaaatatgc

SEQ ID NO: 2366719 - DNA, 15 bp, Homo sapiens
aaagaatctgtattc

SEQ ID NO: 2366720 - DNA, 13 bp, Homo sapiens
aaagaatgactat

SEQ ID NO: 2366721 - DNA, 12 bp, Homo sapiens
aaagaatgttag

SEQ ID NO: 2366722 - DNA, 19 bp, Homo sapiens
aaagacagctagattttgc

SEQ ID NO: 2366723 - DNA, 13 bp, Homo sapiens
aaagacattttaa

SEQ ID NO: 2366724 - DNA, 14 bp, Homo sapiens
aaagaccagaaatt

SEQ ID NO: 2366725 - DNA, 22 bp, Homo sapiens
aaagaccctcctattctataaa

SEQ ID NO: 2366726 - DNA, 20 bp, Homo sapiens
aaagactcaaattttgtacc

SEQ ID NO: 2366727 - DNA, 13 bp, Homo sapiens
aaagacttaaagg

SEQ ID NO: 2366728 - DNA, 14 bp, Homo sapiens
aaagagaatgagtc

SEQ ID NO: 2366729 - DNA, 20 bp, Homo sapiens
aaagagaatgagtccttgat

SEQ ID NO: 2366730 - DNA, 18 bp, Homo sapiens
aaagagagaaacactgaa

SEQ ID NO: 2366731 - DNA, 14 bp, Homo sapiens
aaagagcagtcaga

SEQ ID NO: 2366732 - DNA, 20 bp, Homo sapiens
aaagaggctgaaagaggcca

SEQ ID NO: 2366733 - DNA, 14 bp, Homo sapiens
aaagaggctgcccc

SEQ ID NO: 2366734 - DNA, 20 bp, Homo sapiens
aaagaggctgcccctctcac

SEQ ID NO: 2366735 - DNA, 15 bp, Homo sapiens
aaagagggcttcctc

SEQ ID NO: 2366736 - DNA, 18 bp, Homo sapiens
aaagatctttttttaagt

SEQ ID NO: 2366737 - DNA, 12 bp, Homo sapiens
aaagatgagttg

SEQ ID NO: 2366738 - DNA, 23 bp, Homo sapiens
aaagatggtgtgggtgtcctgcc

SEQ ID NO: 2366739 - DNA, 22 bp, Homo sapiens
aaagatggttgtagcatttaaa

SEQ ID NO: 2366740 - DNA, 21 bp, Homo sapiens
aaagattgctgaaattttata

SEQ ID NO: 2366741 - DNA, 18 bp, Homo sapiens
aaagcaccactgttctgt

SEQ ID NO: 2366742 - DNA, 21 bp, Homo sapiens
aaagcataaagctcaaatgaa

SEQ ID NO: 2366743 - DNA, 22 bp, Homo sapiens
aaagcataaagctcaaatgaaa

SEQ ID NO: 2366744 - DNA, 20 bp, Homo sapiens
aaagcatcaccactcatttt

SEQ ID NO: 2366745 - DNA, 22 bp, Homo sapiens
aaagcatcaccactcattttga

SEQ ID NO: 2366746 - DNA, 15 bp, Homo sapiens
aaagcatggacattt

SEQ ID NO: 2366747 - DNA, 13 bp, Homo sapiens
aaagcatttccta

SEQ ID NO: 2366748 - DNA, 11 bp, Homo sapiens
aaagcattttt

SEQ ID NO: 2366749 - DNA, 20 bp, Homo sapiens
aaagcatttttattatattt

SEQ ID NO: 2366750 - DNA, 20 bp, Homo sapiens
aaagcctagacaacctttct

SEQ ID NO: 2366751 - DNA, 22 bp, Homo sapiens
aaagcctagacaacctttctgt

SEQ ID NO: 2366752 - DNA, 15 bp, Homo sapiens
aaagcctcagaaagg

SEQ ID NO: 2366753 - DNA, 16 bp, Homo sapiens
aaagcctcagaaaggg

SEQ ID NO: 2366754 - DNA, 13 bp, Homo sapiens
aaagcctctctct

SEQ ID NO: 2366755 - DNA, 16 bp, Homo sapiens
aaagccttaagcaaat

SEQ ID NO: 2366756 - DNA, 21 bp, Homo sapiens
aaatgtacatttccaaatgaa

SEQ ID NO: 2366757 - DNA, 13 bp, Homo sapiens
aaatgtataaata

SEQ ID NO: 2366758 - DNA, 22 bp, Homo sapiens
aaatgtattagaagattttaga

SEQ ID NO: 2366759 - DNA, 13 bp, Homo sapiens
aaatgtcatgatt

SEQ ID NO: 2366760 - DNA, 11 bp, Homo sapiens
aaatgtccctc

SEQ ID NO: 2366761 - DNA, 13 bp, Homo sapiens
aaatgtccctcca

SEQ ID NO: 2366762 - DNA, 13 bp, Homo sapiens
aaatgtctgctgg

SEQ ID NO: 2366763 - DNA, 14 bp, Homo sapiens
aaatgtctgctggt

SEQ ID NO: 2366764 - DNA, 21 bp, Homo sapiens
aaatgtctgctggtatttcta

SEQ ID NO: 2366765 - DNA, 18 bp, Homo sapiens
aaatgtctgtaataatag

SEQ ID NO: 2366766 - DNA, 19 bp, Homo sapiens
aaatgtgtatttttcaagg

SEQ ID NO: 2366767 - DNA, 14 bp, Homo sapiens
aaatgttaaaagtt

SEQ ID NO: 2366768 - DNA, 16 bp, Homo sapiens
aaatgttaaaagtttt

SEQ ID NO: 2366769 - DNA, 19 bp, Homo sapiens
aaatgttaaaagttttata

SEQ ID NO: 2366770 - DNA, 13 bp, Homo sapiens
aaatgttacgtga

SEQ ID NO: 2366771 - DNA, 20 bp, Homo sapiens
aaatgttacgtgaagaaata

SEQ ID NO: 2366772 - DNA, 17 bp, Homo sapiens
aaatgttacttctgata

SEQ ID NO: 2366773 - DNA, 21 bp, Homo sapiens
aaatgttacttctgatacttt

SEQ ID NO: 2366774 - DNA, 13 bp, Homo sapiens
aaatgttctgtca

SEQ ID NO: 2366775 - DNA, 17 bp, Homo sapiens
aaatgttggtcatttta

SEQ ID NO: 2366776 - DNA, 19 bp, Homo sapiens
aaatgttggtcattttatg

SEQ ID NO: 2366777 - DNA, 12 bp, Homo sapiens
aaatgtttcatt

SEQ ID NO: 2366778 - DNA, 18 bp, Homo sapiens
aaatgtttcttttaaaga

SEQ ID NO: 2366779 - DNA, 21 bp, Homo sapiens
aaatgtttttaataaaagaaa

SEQ ID NO: 2366780 - DNA, 22 bp, Homo sapiens
aaattaaaaaaaaattgtatct

SEQ ID NO: 2366781 - DNA, 16 bp, Homo sapiens
aaattaaattttagat

SEQ ID NO: 2366782 - DNA, 19 bp, Homo sapiens
aaattaacacaaaggaagt

SEQ ID NO: 2366783 - DNA, 20 bp, Homo sapiens
aaattacctttacatatata

SEQ ID NO: 2366784 - DNA, 19 bp, Homo sapiens
aaattagatcctaagatgt

SEQ ID NO: 2366785 - DNA, 20 bp, Homo sapiens
aaattagatcctaagatgtg

SEQ ID NO: 2366786 - DNA, 20 bp, Homo sapiens
aaattatcattgtttgtcct

SEQ ID NO: 2366787 - DNA, 22 bp, Homo sapiens
aaattatgaagctcatatcctt

SEQ ID NO: 2366788 - DNA, 21 bp, Homo sapiens
aaattcaaagcatggacattt

SEQ ID NO: 2366789 - DNA, 20 bp, Homo sapiens
aaattcaactttgtaaaaat

SEQ ID NO: 2366790 - DNA, 18 bp, Homo sapiens
aaattcaagagctagaaa

SEQ ID NO: 2366791 - DNA, 11 bp, Homo sapiens
aaattctttag

SEQ ID NO: 2366792 - DNA, 14 bp, Homo sapiens
aaattgcatacttt

SEQ ID NO: 2366793 - DNA, 18 bp, Homo sapiens
aaattgctttgtattgta

SEQ ID NO: 2366794 - DNA, 19 bp, Homo sapiens
aaattgtcgggggagagag

SEQ ID NO: 2366795 - DNA, 14 bp, Homo sapiens
aaattgtggatgaa

SEQ ID NO: 2366796 - DNA, 21 bp, Homo sapiens
aaattgtggatgaagacccta

SEQ ID NO: 2366797 - DNA, 12 bp, Homo sapiens
aaatttaagcac

SEQ ID NO: 2366798 - DNA, 13 bp, Homo sapiens
aaatttaagcaca

SEQ ID NO: 2366799 - DNA, 21 bp, Homo sapiens
aaatttaagtgcgtgtgtaga

SEQ ID NO: 2366800 - DNA, 21 bp, Homo sapiens
aaatttaataccagatacctt

SEQ ID NO: 2366801 - DNA, 11 bp, Homo sapiens
aaatttcttat

SEQ ID NO: 2366802 - DNA, 17 bp, Homo sapiens
aaatttcttatgtgaca

SEQ ID NO: 2366803 - DNA, 15 bp, Homo sapiens
aaatttgtaagtttc

SEQ ID NO: 2366804 - DNA, 20 bp, Homo sapiens
aaatttgtaagtttcaggtg

SEQ ID NO: 2366805 - DNA, 13 bp, Homo sapiens
aaattttctcctt

SEQ ID NO: 2366806 - DNA, 17 bp, Homo sapiens
aaattttttattttaat

SEQ ID NO: 2366807 - DNA, 19 bp, Homo sapiens
aaatttttttttaaagcag

SEQ ID NO: 2366808 - DNA, 19 bp, Homo sapiens
aacaaaaacagaatttgag

SEQ ID NO: 2366809 - DNA, 12 bp, Homo sapiens
aacaaaaaccaa

SEQ ID NO: 2366810 - DNA, 14 bp, Homo sapiens
aacaaaatttgaat

SEQ ID NO: 2366811 - DNA, 15 bp, Homo sapiens
aacaaagtactcttt

SEQ ID NO: 2366812 - DNA, 19 bp, Homo sapiens
aacaaatttttcaaatcat

SEQ ID NO: 2366813 - DNA, 13 bp, Homo sapiens
aacaacaattggt

SEQ ID NO: 2366814 - DNA, 14 bp, Homo sapiens
aacaacaattggta

SEQ ID NO: 2366815 - DNA, 19 bp, Homo sapiens
aacaacaattggtaaaact

SEQ ID NO: 2366816 - DNA, 13 bp, Homo sapiens
aacaactctgcct

SEQ ID NO: 2366817 - DNA, 15 bp, Homo sapiens
aacaagaaagtggtc

SEQ ID NO: 2366818 - DNA, 18 bp, Homo sapiens
aacaagatgtttcatttt

SEQ ID NO: 2366819 - DNA, 19 bp, Homo sapiens
aacaagatgtttcatttta

SEQ ID NO: 2366820 - DNA, 14 bp, Homo sapiens
aacaagcttcagta

SEQ ID NO: 2366821 - DNA, 13 bp, Homo sapiens
aacaataaaaaca

SEQ ID NO: 2366822 - DNA, 16 bp, Homo sapiens
aacaatggagtattct

SEQ ID NO: 2366823 - DNA, 18 bp, Homo sapiens
aacaatgttaaggaaact

SEQ ID NO: 2366824 - DNA, 23 bp, Homo sapiens
aacaattggtaaaactcactgtg

SEQ ID NO: 2366825 - DNA, 24 bp, Homo sapiens
aacaattggtaaaactcactgtga

SEQ ID NO: 2366826 - DNA, 14 bp, Homo sapiens
aacacaaaggaagt

SEQ ID NO: 2366827 - DNA, 16 bp, Homo sapiens
aacacagcatgtgtat

SEQ ID NO: 2366828 - DNA, 17 bp, Homo sapiens
aacacaggataaagtta

SEQ ID NO: 2366829 - DNA, 15 bp, Homo sapiens
aacacagtgtctgtt

SEQ ID NO: 2366830 - DNA, 22 bp, Homo sapiens
aacacagtgtctgttcagcaaa

SEQ ID NO: 2366831 - DNA, 19 bp, Homo sapiens
aacacattgaaactgtatt

SEQ ID NO: 2366832 - DNA, 21 bp, Homo sapiens
aacacccatttttccttttgc

SEQ ID NO: 2366833 - DNA, 13 bp, Homo sapiens
aacacccctctgt

SEQ ID NO: 2366834 - DNA, 15 bp, Homo sapiens
aacacccctctgtct

SEQ ID NO: 2366835 - DNA, 17 bp, Homo sapiens
aacacgattttcaagat

SEQ ID NO: 2366836 - DNA, 18 bp, Homo sapiens
aacacggcagctgtagct

SEQ ID NO: 2366837 - DNA, 14 bp, Homo sapiens
aacacgttgccagg

SEQ ID NO: 2366838 - DNA, 12 bp, Homo sapiens
aacactcagtcc

SEQ ID NO: 2366839 - DNA, 17 bp, Homo sapiens
aacagactgttgagtta

SEQ ID NO: 2366840 - DNA, 17 bp, Homo sapiens
aacagagtgaaaaatct

SEQ ID NO: 2366841 - DNA, 19 bp, Homo sapiens
aacagataagcaagagaga

SEQ ID NO: 2366842 - DNA, 13 bp, Homo sapiens
aacagcagctcat

SEQ ID NO: 2366843 - DNA, 14 bp, Homo sapiens
aacagcagctcata

SEQ ID NO: 2366844 - DNA, 14 bp, Homo sapiens
aacagcctttgaat

SEQ ID NO: 2366845 - DNA, 19 bp, Homo sapiens
aacagctacaaacttttaa

SEQ ID NO: 2366846 - DNA, 11 bp, Homo sapiens
aacagctgcaa

SEQ ID NO: 2366847 - DNA, 19 bp, Homo sapiens
aacagctgcaattccctgg

SEQ ID NO: 2366848 - DNA, 18 bp, Homo sapiens
aacttgcttaaatttctt

SEQ ID NO: 2366849 - DNA, 16 bp, Homo sapiens
aacttgtttgctgtga

SEQ ID NO: 2366850 - DNA, 20 bp, Homo sapiens
aacttgtttgctgtgaacaa

SEQ ID NO: 2366851 - DNA, 16 bp, Homo sapiens
aactttcacttcttcc

SEQ ID NO: 2366852 - DNA, 12 bp, Homo sapiens
aactttgatctc

SEQ ID NO: 2366853 - DNA, 16 bp, Homo sapiens
aactttgggaaaacat

SEQ ID NO: 2366854 - DNA, 18 bp, Homo sapiens
aactttgtaaaaatcttt

SEQ ID NO: 2366855 - DNA, 20 bp, Homo sapiens
aacttttccaagcaaaatct

SEQ ID NO: 2366856 - DNA, 21 bp, Homo sapiens
aacttttccaagcaaaatcta

SEQ ID NO: 2366857 - DNA, 11 bp, Homo sapiens
aacttttgtac

SEQ ID NO: 2366858 - DNA, 17 bp, Homo sapiens
aacttttgtactgaatt

SEQ ID NO: 2366859 - DNA, 18 bp, Homo sapiens
aacttttgtactgaattt

SEQ ID NO: 2366860 - DNA, 16 bp, Homo sapiens
aacttttttgtggcaa

SEQ ID NO: 2366861 - DNA, 21 bp, Homo sapiens
aacttttttgtggcaattagt

SEQ ID NO: 2366862 - DNA, 18 bp, Homo sapiens
aagaaaaaagaaaaatct

SEQ ID NO: 2366863 - DNA, 21 bp, Homo sapiens
aagaaaaatctcattatttca

SEQ ID NO: 2366864 - DNA, 23 bp, Homo sapiens
aagaaaaatctcattatttcaaa

SEQ ID NO: 2366865 - DNA, 17 bp, Homo sapiens
aagaaacagtttaacag

SEQ ID NO: 2366866 - DNA, 14 bp, Homo sapiens
aagaaagatgtttg

SEQ ID NO: 2366867 - DNA, 16 bp, Homo sapiens
aagaaatcatgtccat

SEQ ID NO: 2366868 - DNA, 11 bp, Homo sapiens
aagaaatggcg

SEQ ID NO: 2366869 - DNA, 18 bp, Homo sapiens
aagaaatggtatgtagag

SEQ ID NO: 2366870 - DNA, 12 bp, Homo sapiens
aagaacatagaa

SEQ ID NO: 2366871 - DNA, 19 bp, Homo sapiens
aagaactataaacttaaag

SEQ ID NO: 2366872 - DNA, 20 bp, Homo sapiens
aagaactataaacttaaagc

SEQ ID NO: 2366873 - DNA, 14 bp, Homo sapiens
aagaactctctgga

SEQ ID NO: 2366874 - DNA, 13 bp, Homo sapiens
aagaactggaaac

SEQ ID NO: 2366875 - DNA, 17 bp, Homo sapiens
aagaagatagttgtaaa

SEQ ID NO: 2366876 - DNA, 14 bp, Homo sapiens
aagaagctgttgta

SEQ ID NO: 2366877 - DNA, 22 bp, Homo sapiens
aagaagctgttgtacatttatg

SEQ ID NO: 2366878 - DNA, 23 bp, Homo sapiens
aagaagctgttgtacatttatga

SEQ ID NO: 2366879 - DNA, 18 bp, Homo sapiens
aagaaggaaggcctgagc

SEQ ID NO: 2366880 - DNA, 21 bp, Homo sapiens
aagaaggaaggcctgagcccc

SEQ ID NO: 2366881 - DNA, 17 bp, Homo sapiens
aagaaggatgatgtctt

SEQ ID NO: 2366882 - DNA, 14 bp, Homo sapiens
aagaaggcaatatt

SEQ ID NO: 2366883 - DNA, 14 bp, Homo sapiens
aagaagggagaaga

SEQ ID NO: 2366884 - DNA, 16 bp, Homo sapiens
aagaataattttggaa

SEQ ID NO: 2366885 - DNA, 14 bp, Homo sapiens
aagaatgaaaaata

SEQ ID NO: 2366886 - DNA, 22 bp, Homo sapiens
aagaatgaaaaatataatgttg

SEQ ID NO: 2366887 - DNA, 16 bp, Homo sapiens
aagaatgttagagtaa

SEQ ID NO: 2366888 - DNA, 21 bp, Homo sapiens
aagaatgttagagtaatgaaa

SEQ ID NO: 2366889 - DNA, 18 bp, Homo sapiens
aagaatgttagtaaagga

SEQ ID NO: 2366890 - DNA, 20 bp, Homo sapiens
aagacaaatattcctttgca

SEQ ID NO: 2366891 - DNA, 21 bp, Homo sapiens
aagacaccagagcagatgcag

SEQ ID NO: 2366892 - DNA, 14 bp, Homo sapiens
aagacaggagacaa

SEQ ID NO: 2366893 - DNA, 14 bp, Homo sapiens
aagacataacgttt

SEQ ID NO: 2366894 - DNA, 18 bp, Homo sapiens
aagacataacgtttttcc

SEQ ID NO: 2366895 - DNA, 16 bp, Homo sapiens
aagacatttgtttgct

SEQ ID NO: 2366896 - DNA, 21 bp, Homo sapiens
aagaccaagacttttgtctga

SEQ ID NO: 2366897 - DNA, 14 bp, Homo sapiens
aagaccagaaattc

SEQ ID NO: 2366898 - DNA, 15 bp, Homo sapiens
aagacctgagtattt

SEQ ID NO: 2366899 - DNA, 16 bp, Homo sapiens
aagacctgagtatttt

SEQ ID NO: 2366900 - DNA, 21 bp, Homo sapiens
aagactatatatataaatgta

SEQ ID NO: 2366901 - DNA, 22 bp, Homo sapiens
aagactatatatataaatgtat

SEQ ID NO: 2366902 - DNA, 14 bp, Homo sapiens
aagactcaaatttt

SEQ ID NO: 2366903 - DNA, 18 bp, Homo sapiens
aagactcggcttttaatg

SEQ ID NO: 2366904 - DNA, 17 bp, Homo sapiens
aagactgggccccacat

SEQ ID NO: 2366905 - DNA, 16 bp, Homo sapiens
aagactggttttctgc

SEQ ID NO: 2366906 - DNA, 15 bp, Homo sapiens
aagacttgagacaat

SEQ ID NO: 2366907 - DNA, 17 bp, Homo sapiens
aagacttgagacaatgt

SEQ ID NO: 2366908 - DNA, 15 bp, Homo sapiens
aagagaaaagagaga

SEQ ID NO: 2366909 - DNA, 20 bp, Homo sapiens
aagagaaactatctatttgc

SEQ ID NO: 2366910 - DNA, 20 bp, Homo sapiens
aagagaactcgcgctcagta

SEQ ID NO: 2366911 - DNA, 21 bp, Homo sapiens
aagagaagttattttctacag

SEQ ID NO: 2366912 - DNA, 15 bp, Homo sapiens
aagagaatgttccta

SEQ ID NO: 2366913 - DNA, 15 bp, Homo sapiens
aagagacatttcaaa

SEQ ID NO: 2366914 - DNA, 18 bp, Homo sapiens
aagagacatttcaaaact

SEQ ID NO: 2366915 - DNA, 12 bp, Homo sapiens
aagagagaatgt

SEQ ID NO: 2366916 - DNA, 19 bp, Homo sapiens
aagagaggcacctgctgga

SEQ ID NO: 2366917 - DNA, 21 bp, Homo sapiens
aagagattcgaatgacggtaa

SEQ ID NO: 2366918 - DNA, 23 bp, Homo sapiens
aagagattttatgtttaaaatgg

SEQ ID NO: 2366919 - DNA, 18 bp, Homo sapiens
aagagcagtggtaagaat

SEQ ID NO: 2366920 - DNA, 11 bp, Homo sapiens
aagagccacct

SEQ ID NO: 2366921 - DNA, 13 bp, Homo sapiens
aagagccacctgc

SEQ ID NO: 2366922 - DNA, 16 bp, Homo sapiens
aagagccacctgcaag

SEQ ID NO: 2366923 - DNA, 19 bp, Homo sapiens
aagagccacctgcaagatg

SEQ ID NO: 2366924 - DNA, 14 bp, Homo sapiens
aagagcccagtctg

SEQ ID NO: 2366925 - DNA, 22 bp, Homo sapiens
aagagcccgcagggccatgcag

SEQ ID NO: 2366926 - DNA, 21 bp, Homo sapiens
aagagcgatacacaaagcttt

SEQ ID NO: 2366927 - DNA, 20 bp, Homo sapiens
aagagctagaaaaataaaat

SEQ ID NO: 2366928 - DNA, 22 bp, Homo sapiens
aagagctagaaaaataaaatgt

SEQ ID NO: 2366929 - DNA, 14 bp, Homo sapiens
aagagcttaagaac

SEQ ID NO: 2366930 - DNA, 20 bp, Homo sapiens
aataaaaatatattttcaac

SEQ ID NO: 2366931 - DNA, 14 bp, Homo sapiens
aataaaaatgttta

SEQ ID NO: 2366932 - DNA, 15 bp, Homo sapiens
aataaaaatgtttaa

SEQ ID NO: 2366933 - DNA, 20 bp, Homo sapiens
aataaaacaaataaatatga

SEQ ID NO: 2366934 - DNA, 15 bp, Homo sapiens
aataaaacacacctc

SEQ ID NO: 2366935 - DNA, 13 bp, Homo sapiens
aataaaagaaaat

SEQ ID NO: 2366936 - DNA, 13 bp, Homo sapiens
aataaaagaacat

SEQ ID NO: 2366937 - DNA, 16 bp, Homo sapiens
aataaaagataaaaga

SEQ ID NO: 2366938 - DNA, 22 bp, Homo sapiens
aataaaagtgaagtgaatctga

SEQ ID NO: 2366939 - DNA, 14 bp, Homo sapiens
aataaaatatatat

SEQ ID NO: 2366940 - DNA, 20 bp, Homo sapiens
aataaaatatatcttataaa

SEQ ID NO: 2366941 - DNA, 18 bp, Homo sapiens
aataaaattcctatctca

SEQ ID NO: 2366942 - DNA, 17 bp, Homo sapiens
aataaagaatgccattt

SEQ ID NO: 2366943 - DNA, 15 bp, Homo sapiens
aataaagatgagttg

SEQ ID NO: 2366944 - DNA, 15 bp, Homo sapiens
aataaagcactgagc

SEQ ID NO: 2366945 - DNA, 13 bp, Homo sapiens
aataaagtatttt

SEQ ID NO: 2366946 - DNA, 14 bp, Homo sapiens
aataaataatttta

SEQ ID NO: 2366947 - DNA, 16 bp, Homo sapiens
aataaatgccctcttc

SEQ ID NO: 2366948 - DNA, 15 bp, Homo sapiens
aataaattttctaaa

SEQ ID NO: 2366949 - DNA, 14 bp, Homo sapiens
aataacagctgcaa

SEQ ID NO: 2366950 - DNA, 14 bp, Homo sapiens
aataacattacctt

SEQ ID NO: 2366951 - DNA, 16 bp, Homo sapiens
aataaccgcttggttt

SEQ ID NO: 2366952 - DNA, 20 bp, Homo sapiens
aataaccgcttggtttgcaa

SEQ ID NO: 2366953 - DNA, 13 bp, Homo sapiens
aataactgaattt

SEQ ID NO: 2366954 - DNA, 16 bp, Homo sapiens
aataactgtgtactgt

SEQ ID NO: 2366955 - DNA, 13 bp, Homo sapiens
aataagctaaaga

SEQ ID NO: 2366956 - DNA, 14 bp, Homo sapiens
aataagctaaagag

SEQ ID NO: 2366957 - DNA, 18 bp, Homo sapiens
aataagtgacaaataaga

SEQ ID NO: 2366958 - DNA, 18 bp, Homo sapiens
aataagtgccctctccca

SEQ ID NO: 2366959 - DNA, 15 bp, Homo sapiens
aataagttcccattt

SEQ ID NO: 2366960 - DNA, 18 bp, Homo sapiens
aataataaaaccaaagaa

SEQ ID NO: 2366961 - DNA, 14 bp, Homo sapiens
aataatatcaaata

SEQ ID NO: 2366962 - DNA, 20 bp, Homo sapiens
aataatcacgctttcctgaa

SEQ ID NO: 2366963 - DNA, 18 bp, Homo sapiens
aataatgaagtagaagtt

SEQ ID NO: 2366964 - DNA, 15 bp, Homo sapiens
aataatgcttttcta

SEQ ID NO: 2366965 - DNA, 18 bp, Homo sapiens
aataatgcttttctaatt

SEQ ID NO: 2366966 - DNA, 23 bp, Homo sapiens
aataatgcttttctaattaatag

SEQ ID NO: 2366967 - DNA, 12 bp, Homo sapiens
aataatttctat

SEQ ID NO: 2366968 - DNA, 17 bp, Homo sapiens
aataattttaatattct

SEQ ID NO: 2366969 - DNA, 18 bp, Homo sapiens
aatacagtcattccaaga

SEQ ID NO: 2366970 - DNA, 15 bp, Homo sapiens
aatacctctgtgtgc

SEQ ID NO: 2366971 - DNA, 19 bp, Homo sapiens
aatacgtgtcaaaaaagaa

SEQ ID NO: 2366972 - DNA, 11 bp, Homo sapiens
aatactgacct

SEQ ID NO: 2366973 - DNA, 20 bp, Homo sapiens
aatactttttaaattacctt

SEQ ID NO: 2366974 - DNA, 17 bp, Homo sapiens
aatagaaattttgtaag

SEQ ID NO: 2366975 - DNA, 18 bp, Homo sapiens
aatagaaattttgtaaga

SEQ ID NO: 2366976 - DNA, 13 bp, Homo sapiens
aatagaataattc

SEQ ID NO: 2366977 - DNA, 14 bp, Homo sapiens
aatagagataagtc

SEQ ID NO: 2366978 - DNA, 19 bp, Homo sapiens
aatagcatgacaggctgtt

SEQ ID NO: 2366979 - DNA, 12 bp, Homo sapiens
aatagcctggcc

SEQ ID NO: 2366980 - DNA, 14 bp, Homo sapiens
aatagcctggccac

SEQ ID NO: 2366981 - DNA, 19 bp, Homo sapiens
aataggaatcattcagaaa

SEQ ID NO: 2366982 - DNA, 23 bp, Homo sapiens
aataggagaggatgagagcccag

SEQ ID NO: 2366983 - DNA, 21 bp, Homo sapiens
aataggctattaaaaaagtct

SEQ ID NO: 2366984 - DNA, 21 bp, Homo sapiens
aatagggctgagctctctgtg

SEQ ID NO: 2366985 - DNA, 22 bp, Homo sapiens
aatagtagatgtggcctttgaa

SEQ ID NO: 2366986 - DNA, 14 bp, Homo sapiens
aatagtatgaaaat

SEQ ID NO: 2366987 - DNA, 15 bp, Homo sapiens
aatagtctatatttt

SEQ ID NO: 2366988 - DNA, 15 bp, Homo sapiens
aatagtgtgaaatat

SEQ ID NO: 2366989 - DNA, 12 bp, Homo sapiens
aatagttgaatt

SEQ ID NO: 2366990 - DNA, 13 bp, Homo sapiens
aatagttttatgc

SEQ ID NO: 2366991 - DNA, 20 bp, Homo sapiens
aatataaaaaatcatgccag

SEQ ID NO: 2366992 - DNA, 12 bp, Homo sapiens
aatataaaatta

SEQ ID NO: 2366993 - DNA, 11 bp, Homo sapiens
aatataaatga

SEQ ID NO: 2366994 - DNA, 13 bp, Homo sapiens
aatataaatgttg

SEQ ID NO: 2366995 - DNA, 15 bp, Homo sapiens
aatataacacatttt

SEQ ID NO: 2366996 - DNA, 14 bp, Homo sapiens
aatataagacattt

SEQ ID NO: 2366997 - DNA, 15 bp, Homo sapiens
aatatacattttcta

SEQ ID NO: 2366998 - DNA, 19 bp, Homo sapiens
aatatacattttctaaata

SEQ ID NO: 2366999 - DNA, 15 bp, Homo sapiens
aattgtaagtgaaat

SEQ ID NO: 2367000 - DNA, 18 bp, Homo sapiens
aattgtaagtgaaattaa

SEQ ID NO: 2367001 - DNA, 20 bp, Homo sapiens
aattgtacaaaattaagcaa

SEQ ID NO: 2367002 - DNA, 18 bp, Homo sapiens
aattgtactaatctgaga

SEQ ID NO: 2367003 - DNA, 18 bp, Homo sapiens
aattgtcgaaaagagtct

SEQ ID NO: 2367004 - DNA, 23 bp, Homo sapiens
aattgtcgaaaagagtcttccaa

SEQ ID NO: 2367005 - DNA, 17 bp, Homo sapiens
aattgtcgggggagaga

SEQ ID NO: 2367006 - DNA, 11 bp, Homo sapiens
aattgtggatg

SEQ ID NO: 2367007 - DNA, 12 bp, Homo sapiens
aattgttgtttc

SEQ ID NO: 2367008 - DNA, 18 bp, Homo sapiens
aattgttgtttctttcta

SEQ ID NO: 2367009 - DNA, 21 bp, Homo sapiens
aattgttgtttctttctagtg

SEQ ID NO: 2367010 - DNA, 23 bp, Homo sapiens
aattgttgtttctttctagtggt

SEQ ID NO: 2367011 - DNA, 20 bp, Homo sapiens
aatttaagcacaaaaaattt

SEQ ID NO: 2367012 - DNA, 14 bp, Homo sapiens
aatttaagtgcgtg

SEQ ID NO: 2367013 - DNA, 20 bp, Homo sapiens
aatttaagtgcgtgtgtaga

SEQ ID NO: 2367014 - DNA, 14 bp, Homo sapiens
aatttacacatctt

SEQ ID NO: 2367015 - DNA, 17 bp, Homo sapiens
aatttacacatcttaaa

SEQ ID NO: 2367016 - DNA, 18 bp, Homo sapiens
aatttacacatcttaaaa

SEQ ID NO: 2367017 - DNA, 13 bp, Homo sapiens
aatttacttgttt

SEQ ID NO: 2367018 - DNA, 14 bp, Homo sapiens
aatttatttccact

SEQ ID NO: 2367019 - DNA, 21 bp, Homo sapiens
aatttatttccactaaaaata

SEQ ID NO: 2367020 - DNA, 11 bp, Homo sapiens
aatttcaaaat

SEQ ID NO: 2367021 - DNA, 12 bp, Homo sapiens
aatttcagggtg

SEQ ID NO: 2367022 - DNA, 18 bp, Homo sapiens
aatttcatagctgtactt

SEQ ID NO: 2367023 - DNA, 14 bp, Homo sapiens
aatttcctttttga

SEQ ID NO: 2367024 - DNA, 15 bp, Homo sapiens
aatttcctttttgac

SEQ ID NO: 2367025 - DNA, 17 bp, Homo sapiens
aatttcctttttgacac

SEQ ID NO: 2367026 - DNA, 19 bp, Homo sapiens
aatttcctttttgacactg

SEQ ID NO: 2367027 - DNA, 20 bp, Homo sapiens
aatttcctttttgacactga

SEQ ID NO: 2367028 - DNA, 20 bp, Homo sapiens
aatttctcctcccttccttt

SEQ ID NO: 2367029 - DNA, 19 bp, Homo sapiens
aatttctctcagatttcca

SEQ ID NO: 2367030 - DNA, 20 bp, Homo sapiens
aatttcttatgtgacattaa

SEQ ID NO: 2367031 - DNA, 18 bp, Homo sapiens
aatttgagagaaatatga

SEQ ID NO: 2367032 - DNA, 20 bp, Homo sapiens
aatttgagagaaatatgaag

SEQ ID NO: 2367033 - DNA, 19 bp, Homo sapiens
aatttggagcacaaaattc

SEQ ID NO: 2367034 - DNA, 20 bp, Homo sapiens
aatttggagcacaaaattca

SEQ ID NO: 2367035 - DNA, 19 bp, Homo sapiens
aatttggggctacttatat

SEQ ID NO: 2367036 - DNA, 16 bp, Homo sapiens
aatttgtaagtttcag

SEQ ID NO: 2367037 - DNA, 13 bp, Homo sapiens
aatttgtcttaaa

SEQ ID NO: 2367038 - DNA, 17 bp, Homo sapiens
aatttgttttagccatt

SEQ ID NO: 2367039 - DNA, 20 bp, Homo sapiens
aattttaatattcttttgtt

SEQ ID NO: 2367040 - DNA, 14 bp, Homo sapiens
aattttaatgctgt

SEQ ID NO: 2367041 - DNA, 22 bp, Homo sapiens
aattttaatgctgtttctaaga

SEQ ID NO: 2367042 - DNA, 21 bp, Homo sapiens
aattttagaaaacacccaata

SEQ ID NO: 2367043 - DNA, 16 bp, Homo sapiens
aattttagaaatattc

SEQ ID NO: 2367044 - DNA, 16 bp, Homo sapiens
aattttctaaaagctt

SEQ ID NO: 2367045 - DNA, 13 bp, Homo sapiens
aattttggaataa

SEQ ID NO: 2367046 - DNA, 20 bp, Homo sapiens
aattttggaataatttctat

SEQ ID NO: 2367047 - DNA, 11 bp, Homo sapiens
aatttttaagc

SEQ ID NO: 2367048 - DNA, 20 bp, Homo sapiens
aattttttatcatgcatgtc

SEQ ID NO: 2367049 - DNA, 21 bp, Homo sapiens
aattttttgatgtcagccttg

SEQ ID NO: 2367050 - DNA, 20 bp, Homo sapiens
acaaaaacagaatttgagaa

SEQ ID NO: 2367051 - DNA, 20 bp, Homo sapiens
acaaaaaccaaatgtttatt

SEQ ID NO: 2367052 - DNA, 11 bp, Homo sapiens
acaaaagcaat

SEQ ID NO: 2367053 - DNA, 15 bp, Homo sapiens
acaaaagtctgtctt

SEQ ID NO: 2367054 - DNA, 21 bp, Homo sapiens
acaaaagtctgtctttcctga

SEQ ID NO: 2367055 - DNA, 13 bp, Homo sapiens
acaaaatttgaga

SEQ ID NO: 2367056 - DNA, 20 bp, Homo sapiens
acaaacagggctgccttctg

SEQ ID NO: 2367057 - DNA, 20 bp, Homo sapiens
acagtggttgttttttcatt

SEQ ID NO: 2367058 - DNA, 18 bp, Homo sapiens
acagtggttttatactga

SEQ ID NO: 2367059 - DNA, 21 bp, Homo sapiens
acagtgtctgttcagcaaact

SEQ ID NO: 2367060 - DNA, 13 bp, Homo sapiens
acagttcctggga

SEQ ID NO: 2367061 - DNA, 15 bp, Homo sapiens
acagttctttcctct

SEQ ID NO: 2367062 - DNA, 13 bp, Homo sapiens
acagtttccaaat

SEQ ID NO: 2367063 - DNA, 16 bp, Homo sapiens
acagtttcttagcttt

SEQ ID NO: 2367064 - DNA, 15 bp, Homo sapiens
acataaaagaaataa

SEQ ID NO: 2367065 - DNA, 14 bp, Homo sapiens
acataaaggaaaag

SEQ ID NO: 2367066 - DNA, 18 bp, Homo sapiens
acataacgtttttccttt

SEQ ID NO: 2367067 - DNA, 21 bp, Homo sapiens
acataacgtttttcctttaaa

SEQ ID NO: 2367068 - DNA, 12 bp, Homo sapiens
acataactgaaa

SEQ ID NO: 2367069 - DNA, 15 bp, Homo sapiens
acataagcttccatt

SEQ ID NO: 2367070 - DNA, 17 bp, Homo sapiens
acataagtaacttttaa

SEQ ID NO: 2367071 - DNA, 14 bp, Homo sapiens
acataataaagtat

SEQ ID NO: 2367072 - DNA, 23 bp, Homo sapiens
acatacagaggatgccttttctg

SEQ ID NO: 2367073 - DNA, 13 bp, Homo sapiens
acatactgcttga

SEQ ID NO: 2367074 - DNA, 20 bp, Homo sapiens
acatactgcttgattttaat

SEQ ID NO: 2367075 - DNA, 16 bp, Homo sapiens
acatagcatgcttcct

SEQ ID NO: 2367076 - DNA, 21 bp, Homo sapiens
acataggaagggatctgagaa

SEQ ID NO: 2367077 - DNA, 20 bp, Homo sapiens
acataggccgagctgtggac

SEQ ID NO: 2367078 - DNA, 15 bp, Homo sapiens
acatataccaaaaac

SEQ ID NO: 2367079 - DNA, 23 bp, Homo sapiens
acatatctacacttcgcaccgga

SEQ ID NO: 2367080 - DNA, 17 bp, Homo sapiens
acatatgcaccttgtgt

SEQ ID NO: 2367081 - DNA, 18 bp, Homo sapiens
acatatgcaccttgtgtc

SEQ ID NO: 2367082 - DNA, 19 bp, Homo sapiens
acatatgcaccttgtgtct

SEQ ID NO: 2367083 - DNA, 23 bp, Homo sapiens
acatatgctgatcttttaaaatc

SEQ ID NO: 2367084 - DNA, 18 bp, Homo sapiens
acatcaaataagaaataa

SEQ ID NO: 2367085 - DNA, 16 bp, Homo sapiens
acatccaactccagca

SEQ ID NO: 2367086 - DNA, 19 bp, Homo sapiens
acatccaactccagcaact

SEQ ID NO: 2367087 - DNA, 15 bp, Homo sapiens
acatcccgggcctca

SEQ ID NO: 2367088 - DNA, 18 bp, Homo sapiens
acatcccgggcctcagtg

SEQ ID NO: 2367089 - DNA, 12 bp, Homo sapiens
acatctgcctta

SEQ ID NO: 2367090 - DNA, 13 bp, Homo sapiens
acatcttctttgg

SEQ ID NO: 2367091 - DNA, 15 bp, Homo sapiens
acatcttctttggaa

SEQ ID NO: 2367092 - DNA, 16 bp, Homo sapiens
acatctttattgaaat

SEQ ID NO: 2367093 - DNA, 18 bp, Homo sapiens
acatctttattgaaattc

SEQ ID NO: 2367094 - DNA, 19 bp, Homo sapiens
acatctttattgaaattct

SEQ ID NO: 2367095 - DNA, 19 bp, Homo sapiens
acatgacttccttatttct

SEQ ID NO: 2367096 - DNA, 22 bp, Homo sapiens
acatgacttccttatttctgaa

SEQ ID NO: 2367097 - DNA, 23 bp, Homo sapiens
acatgacttccttatttctgaac

SEQ ID NO: 2367098 - DNA, 12 bp, Homo sapiens
acatgagaaaga

SEQ ID NO: 2367099 - DNA, 18 bp, Homo sapiens
acatgagatggagaggct

SEQ ID NO: 2367100 - DNA, 19 bp, Homo sapiens
acatgagatggagaggctg

SEQ ID NO: 2367101 - DNA, 14 bp, Homo sapiens
acatgatgtgagat

SEQ ID NO: 2367102 - DNA, 16 bp, Homo sapiens
acatgcaataaaattt

SEQ ID NO: 2367103 - DNA, 12 bp, Homo sapiens
acatgcatttga

SEQ ID NO: 2367104 - DNA, 21 bp, Homo sapiens
acatgcatttgaggtcaagta

SEQ ID NO: 2367105 - DNA, 15 bp, Homo sapiens
acatgcctgcgcctg

SEQ ID NO: 2367106 - DNA, 17 bp, Homo sapiens
acatgcctgcgcctgct

SEQ ID NO: 2367107 - DNA, 14 bp, Homo sapiens
acatggacctccag

SEQ ID NO: 2367108 - DNA, 17 bp, Homo sapiens
acatggacctccaggct

SEQ ID NO: 2367109 - DNA, 19 bp, Homo sapiens
acatggacctccaggctcc

SEQ ID NO: 2367110 - DNA, 17 bp, Homo sapiens
acatggtctgtcaatga

SEQ ID NO: 2367111 - DNA, 23 bp, Homo sapiens
acatggtgcctgagaggcaggca

SEQ ID NO: 2367112 - DNA, 17 bp, Homo sapiens
acatgtaataaaaagta

SEQ ID NO: 2367113 - DNA, 13 bp, Homo sapiens
acatgtatgtaaa

SEQ ID NO: 2367114 - DNA, 18 bp, Homo sapiens
acatgtatgtaaatagct

SEQ ID NO: 2367115 - DNA, 22 bp, Homo sapiens
acatgtcttgtacatgtgtagc

SEQ ID NO: 2367116 - DNA, 13 bp, Homo sapiens
acatgtgaaacct

SEQ ID NO: 2367117 - DNA, 23 bp, Homo sapiens
acatgtgaaaccttttttaagat

SEQ ID NO: 2367118 - DNA, 12 bp, Homo sapiens
acatgtgacaca

SEQ ID NO: 2367119 - DNA, 14 bp, Homo sapiens
acatgtgatacatt

SEQ ID NO: 2367120 - DNA, 17 bp, Homo sapiens
acatgtgtagcctgtgc

SEQ ID NO: 2367121 - DNA, 18 bp, Homo sapiens
acatgtgtagcctgtgca

SEQ ID NO: 2367122 - DNA, 16 bp, Homo sapiens
acatgttaatgacaat

SEQ ID NO: 2367123 - DNA, 23 bp, Homo sapiens
acattaaatgcaataattttact

SEQ ID NO: 2367124 - DNA, 14 bp, Homo sapiens
acattaacggtgct

SEQ ID NO: 2367125 - DNA, 13 bp, Homo sapiens
tcccatttcagct

SEQ ID NO: 2367126 - DNA, 16 bp, Homo sapiens
tcccatttgtgccaga

SEQ ID NO: 2367127 - DNA, 18 bp, Homo sapiens
tccccaaaggacgcctgc

SEQ ID NO: 2367128 - DNA, 18 bp, Homo sapiens
tccccaaatcaatacact

SEQ ID NO: 2367129 - DNA, 20 bp, Homo sapiens
tccccacagcgtccctggcg

SEQ ID NO: 2367130 - DNA, 13 bp, Homo sapiens
tccccacccctgc

SEQ ID NO: 2367131 - DNA, 14 bp, Homo sapiens
tccccacccctgcc

SEQ ID NO: 2367132 - DNA, 18 bp, Homo sapiens
tccccacccctgccccca

SEQ ID NO: 2367133 - DNA, 22 bp, Homo sapiens
tccccacccctgcccccagccc

SEQ ID NO: 2367134 - DNA, 16 bp, Homo sapiens
tccccaggctggagac

SEQ ID NO: 2367135 - DNA, 20 bp, Homo sapiens
tccccaggctggagaccccc

SEQ ID NO: 2367136 - DNA, 23 bp, Homo sapiens
tccccatactcctatgatctgag

SEQ ID NO: 2367137 - DNA, 15 bp, Homo sapiens
tccccatctccctgc

SEQ ID NO: 2367138 - DNA, 20 bp, Homo sapiens
tccccatctccctgcctggc

SEQ ID NO: 2367139 - DNA, 15 bp, Homo sapiens
tccccatctgtccag

SEQ ID NO: 2367140 - DNA, 15 bp, Homo sapiens
tccccatttcccatc

SEQ ID NO: 2367141 - DNA, 17 bp, Homo sapiens
tccccatttcccatctg

SEQ ID NO: 2367142 - DNA, 21 bp, Homo sapiens
tcccccaccggtccagctggc

SEQ ID NO: 2367143 - DNA, 22 bp, Homo sapiens
tcccccagccatgccagctggc

SEQ ID NO: 2367144 - DNA, 12 bp, Homo sapiens
tccccccagact

SEQ ID NO: 2367145 - DNA, 13 bp, Homo sapiens
tccccccagactc

SEQ ID NO: 2367146 - DNA, 20 bp, Homo sapiens
tccccctcctccagggaagg

SEQ ID NO: 2367147 - DNA, 19 bp, Homo sapiens
tcccctccggactggtgcc

SEQ ID NO: 2367148 - DNA, 20 bp, Homo sapiens
tcccctccggactggtgccc

SEQ ID NO: 2367149 - DNA, 17 bp, Homo sapiens
tcccctcgtcccatcca

SEQ ID NO: 2367150 - DNA, 13 bp, Homo sapiens
tcccctctcagaa

SEQ ID NO: 2367151 - DNA, 11 bp, Homo sapiens
tcccctctctc

SEQ ID NO: 2367152 - DNA, 13 bp, Homo sapiens
tcccctctctctg

SEQ ID NO: 2367153 - DNA, 14 bp, Homo sapiens
tcccctctctctgg

SEQ ID NO: 2367154 - DNA, 12 bp, Homo sapiens
tcccctgccaca

SEQ ID NO: 2367155 - DNA, 12 bp, Homo sapiens
tcccctgtgtca

SEQ ID NO: 2367156 - DNA, 20 bp, Homo sapiens
tcccctgttgattatcttca

SEQ ID NO: 2367157 - DNA, 22 bp, Homo sapiens
tcccctgttgattatcttcagc

SEQ ID NO: 2367158 - DNA, 16 bp, Homo sapiens
tcccgggccagggctg

SEQ ID NO: 2367159 - DNA, 21 bp, Homo sapiens
tcccgggccagggctgcccct

SEQ ID NO: 2367160 - DNA, 16 bp, Homo sapiens
tcccggttcaccttgc

SEQ ID NO: 2367161 - DNA, 19 bp, Homo sapiens
tcccgtacaaacttggaca

SEQ ID NO: 2367162 - DNA, 19 bp, Homo sapiens
tccctaaactttggccttt

SEQ ID NO: 2367163 - DNA, 22 bp, Homo sapiens
tccctagctttagaccctgggt

SEQ ID NO: 2367164 - DNA, 17 bp, Homo sapiens
tccctccaacacagatc

SEQ ID NO: 2367165 - DNA, 13 bp, Homo sapiens
tccctccatcccc

SEQ ID NO: 2367166 - DNA, 20 bp, Homo sapiens
tccctccattcatccttcca

SEQ ID NO: 2367167 - DNA, 13 bp, Homo sapiens
tccctcccaggac

SEQ ID NO: 2367168 - DNA, 16 bp, Homo sapiens
tccctcccctctcaga

SEQ ID NO: 2367169 - DNA, 12 bp, Homo sapiens
tccctcctagct

SEQ ID NO: 2367170 - DNA, 16 bp, Homo sapiens
tccctcctagctctcc

SEQ ID NO: 2367171 - DNA, 18 bp, Homo sapiens
tccctcctggagcatccc

SEQ ID NO: 2367172 - DNA, 15 bp, Homo sapiens
tccctctctcatgag

SEQ ID NO: 2367173 - DNA, 20 bp, Homo sapiens
tccctctgcagaatcccttt

SEQ ID NO: 2367174 - DNA, 17 bp, Homo sapiens
tccctctgggcacgcct

SEQ ID NO: 2367175 - DNA, 23 bp, Homo sapiens
tccctctgggcacgcctgctggc

SEQ ID NO: 2367176 - DNA, 22 bp, Homo sapiens
tccctgaggttaaacggtgccc

SEQ ID NO: 2367177 - DNA, 15 bp, Homo sapiens
tccctgcagacctca

SEQ ID NO: 2367178 - DNA, 19 bp, Homo sapiens
tccctgcagacctcaagcc

SEQ ID NO: 2367179 - DNA, 17 bp, Homo sapiens
tccctgcctctcatcaa

SEQ ID NO: 2367180 - DNA, 15 bp, Homo sapiens
tccctgcctggcccc

SEQ ID NO: 2367181 - DNA, 12 bp, Homo sapiens
tccctgcttcca

SEQ ID NO: 2367182 - DNA, 14 bp, Homo sapiens
tccctggaaaagga

SEQ ID NO: 2367183 - DNA, 20 bp, Homo sapiens
tccctggaaaaggagcttca

SEQ ID NO: 2367184 - DNA, 17 bp, Homo sapiens
tccctggacaggcagcc

SEQ ID NO: 2367185 - DNA, 19 bp, Homo sapiens
tccctggacaggcagcctc

SEQ ID NO: 2367186 - DNA, 23 bp, Homo sapiens
tccctggacaggcagcctccttt

SEQ ID NO: 2367187 - DNA, 19 bp, Homo sapiens
tccctggagaagcaccagc

SEQ ID NO: 2367188 - DNA, 22 bp, Homo sapiens
tccctggccgcttctccccaga

SEQ ID NO: 2367189 - DNA, 17 bp, Homo sapiens
tccctggctccctcctc

SEQ ID NO: 2367190 - DNA, 22 bp, Homo sapiens
tccctgggacacagacccagga

SEQ ID NO: 2367191 - DNA, 22 bp, Homo sapiens
tccctgggctgccaccagcccc

SEQ ID NO: 2367192 - DNA, 17 bp, Homo sapiens
tccctgtagctcagtca

SEQ ID NO: 2367193 - DNA, 15 bp, Homo sapiens
tcccttactttgctg

SEQ ID NO: 2367194 - DNA, 13 bp, Homo sapiens
tcccttccaaaga

SEQ ID NO: 2367195 - DNA, 17 bp, Homo sapiens
tcccttctacaaggact

SEQ ID NO: 2367196 - DNA, 14 bp, Homo sapiens
tcccttgaccttaa

SEQ ID NO: 2367197 - DNA, 15 bp, Homo sapiens
tcccttgagggctgc

SEQ ID NO: 2367198 - DNA, 19 bp, Homo sapiens
tcccttgagggctgcagtt

SEQ ID NO: 2367199 - DNA, 13 bp, Homo sapiens
tcccttgggctct

SEQ ID NO: 2367200 - DNA, 14 bp, Homo sapiens
tcccttgggctctg

SEQ ID NO: 2367201 - DNA, 17 bp, Homo sapiens
tcccttgggctctgatg

SEQ ID NO: 2367202 - DNA, 21 bp, Homo sapiens
tcccttgggctctgatgaaaa

SEQ ID NO: 2367203 - DNA, 22 bp, Homo sapiens
tccctttgtctgtcaatcacag

SEQ ID NO: 2367204 - DNA, 14 bp, Homo sapiens
tccctttttttgtt

SEQ ID NO: 2367205 - DNA, 16 bp, Homo sapiens
tccgcagtgtctccac

SEQ ID NO: 2367206 - DNA, 14 bp, Homo sapiens
tccgccactccagt

SEQ ID NO: 2367207 - DNA, 11 bp, Homo sapiens
tccgccagcct

SEQ ID NO: 2367208 - DNA, 20 bp, Homo sapiens
tccgccatggtgtcccggta

SEQ ID NO: 2367209 - DNA, 14 bp, Homo sapiens
tccgctgccagcct

SEQ ID NO: 2367210 - DNA, 19 bp, Homo sapiens
tccgctgccagccttgagc

SEQ ID NO: 2367211 - DNA, 20 bp, Homo sapiens
tccgcttggagctattttcc

SEQ ID NO: 2367212 - DNA, 20 bp, Homo sapiens
tccgtatctccctggagaag

SEQ ID NO: 2367213 - DNA, 17 bp, Homo sapiens
tccgtgtgtcccagatg

SEQ ID NO: 2367214 - DNA, 13 bp, Homo sapiens
tcctaagcctgtt

SEQ ID NO: 2367215 - DNA, 13 bp, Homo sapiens
tcctaatcgctaa

SEQ ID NO: 2367216 - DNA, 16 bp, Homo sapiens
tcctaatttctcctcc

SEQ ID NO: 2367217 - DNA, 19 bp, Homo sapiens
tcctacacttgagagaaaa

SEQ ID NO: 2367218 - DNA, 18 bp, Homo sapiens
tcctactaataaaccagt

SEQ ID NO: 2367219 - DNA, 19 bp, Homo sapiens
tcctactggtctctctatg

SEQ ID NO: 2367220 - DNA, 12 bp, Homo sapiens
tcctacttacaa

SEQ ID NO: 2367221 - DNA, 19 bp, Homo sapiens
tcctacttagggaagaaaa

SEQ ID NO: 2367222 - DNA, 16 bp, Homo sapiens
tcctagcccttccctg

SEQ ID NO: 2367223 - DNA, 13 bp, Homo sapiens
tcctagctgttct

SEQ ID NO: 2367224 - DNA, 17 bp, Homo sapiens
tcctaggaggaaaattc

SEQ ID NO: 2367225 - DNA, 23 bp, Homo sapiens
tcctaggcattctggacctctgg

SEQ ID NO: 2367226 - DNA, 14 bp, Homo sapiens
tcctagtaagaaga

SEQ ID NO: 2367227 - DNA, 20 bp, Homo sapiens
tcctataatataataaatat

SEQ ID NO: 2367228 - DNA, 19 bp, Homo sapiens
tcctatccttggagagcag

SEQ ID NO: 2367229 - DNA, 22 bp, Homo sapiens
tcctatgcttaataaaagaaca

SEQ ID NO: 2367230 - DNA, 23 bp, Homo sapiens
tcctcaactcacctaatgtttat

SEQ ID NO: 2367231 - DNA, 17 bp, Homo sapiens
tcctcagagcgccagga

SEQ ID NO: 2367232 - DNA, 18 bp, Homo sapiens
tcctcagagcgccaggaa

SEQ ID NO: 2367233 - DNA, 19 bp, Homo sapiens
tcctccaggagcttcttgt

SEQ ID NO: 2367234 - DNA, 19 bp, Homo sapiens
tcctccaggcctgcctccc

SEQ ID NO: 2367235 - DNA, 23 bp, Homo sapiens
tcctccagggaaggtggccacag

SEQ ID NO: 2367236 - DNA, 22 bp, Homo sapiens
tcctcccagggcctcctggggg

SEQ ID NO: 2367237 - DNA, 22 bp, Homo sapiens
tcctcccagtgagactgcccca

SEQ ID NO: 2367238 - DNA, 14 bp, Homo sapiens
tcctccctgggggc

SEQ ID NO: 2367239 - DNA, 13 bp, Homo sapiens
tcctcccttcctt

SEQ ID NO: 2367240 - DNA, 17 bp, Homo sapiens
tcctcccttccttttcc

SEQ ID NO: 2367241 - DNA, 21 bp, Homo sapiens
tcctcccttccttttccctgc

SEQ ID NO: 2367242 - DNA, 11 bp, Homo sapiens
tccaaccactg

SEQ ID NO: 2367243 - DNA, 12 bp, Homo sapiens
tccaaccactgt

SEQ ID NO: 2367244 - DNA, 14 bp, Homo sapiens
tccaactccagcaa

SEQ ID NO: 2367245 - DNA, 20 bp, Homo sapiens
tccaagacatgtctgttcta

SEQ ID NO: 2367246 - DNA, 22 bp, Homo sapiens
tccaagacatgtctgttctaca

SEQ ID NO: 2367247 - DNA, 18 bp, Homo sapiens
tccaagcaacagcctttg

SEQ ID NO: 2367248 - DNA, 14 bp, Homo sapiens
tccaagcacagagc

SEQ ID NO: 2367249 - DNA, 21 bp, Homo sapiens
tccaagcacagagcctggccc

SEQ ID NO: 2367250 - DNA, 12 bp, Homo sapiens
tccaagcatttc

SEQ ID NO: 2367251 - DNA, 20 bp, Homo sapiens
tccaagcatttcatgaaaaa

SEQ ID NO: 2367252 - DNA, 14 bp, Homo sapiens
tccaagcctccaca

SEQ ID NO: 2367253 - DNA, 16 bp, Homo sapiens
tccaagcctccacagc

SEQ ID NO: 2367254 - DNA, 16 bp, Homo sapiens
tccaaggccagtcccc

SEQ ID NO: 2367255 - DNA, 20 bp, Homo sapiens
tccaagggtatgggaagcca

SEQ ID NO: 2367256 - DNA, 15 bp, Homo sapiens
tccaagtcaacactc

SEQ ID NO: 2367257 - DNA, 22 bp, Homo sapiens
tccaagtcaacactcttcttga

SEQ ID NO: 2367258 - DNA, 16 bp, Homo sapiens
tccaagtccaacctgc

SEQ ID NO: 2367259 - DNA, 20 bp, Homo sapiens
tccaagtccaacctgcctgt

SEQ ID NO: 2367260 - DNA, 16 bp, Homo sapiens
tccacacccgtgagaa

SEQ ID NO: 2367261 - DNA, 21 bp, Homo sapiens
tccacagcgagggcagctgct

SEQ ID NO: 2367262 - DNA, 19 bp, Homo sapiens
tccacagtgttgtgcccct

SEQ ID NO: 2367263 - DNA, 19 bp, Homo sapiens
tccacccaaccctatctcc

SEQ ID NO: 2367264 - DNA, 20 bp, Homo sapiens
tccacccataataagagaat

SEQ ID NO: 2367265 - DNA, 17 bp, Homo sapiens
tccacccatccagtgga

SEQ ID NO: 2367266 - DNA, 21 bp, Homo sapiens
tccacccctttctagaccaat

SEQ ID NO: 2367267 - DNA, 14 bp, Homo sapiens
tccaccctgcctgc

SEQ ID NO: 2367268 - DNA, 14 bp, Homo sapiens
tccacctgccttgg

SEQ ID NO: 2367269 - DNA, 20 bp, Homo sapiens
tccacctgccttggcctccc

SEQ ID NO: 2367270 - DNA, 21 bp, Homo sapiens
tccacctgccttggcctccca

SEQ ID NO: 2367271 - DNA, 15 bp, Homo sapiens
tccacgcgtgccgtg

SEQ ID NO: 2367272 - DNA, 16 bp, Homo sapiens
tccactccatatttat

SEQ ID NO: 2367273 - DNA, 23 bp, Homo sapiens
tccactccatatttatttaaaca

SEQ ID NO: 2367274 - DNA, 14 bp, Homo sapiens
tccactgctggaca

SEQ ID NO: 2367275 - DNA, 13 bp, Homo sapiens
tccagaacactct

SEQ ID NO: 2367276 - DNA, 19 bp, Homo sapiens
tccagaaccacacttgaaa

SEQ ID NO: 2367277 - DNA, 15 bp, Homo sapiens
tccagagacaacagg

SEQ ID NO: 2367278 - DNA, 16 bp, Homo sapiens
tccagagacaacaggt

SEQ ID NO: 2367279 - DNA, 16 bp, Homo sapiens
tccagataactctctt

SEQ ID NO: 2367280 - DNA, 17 bp, Homo sapiens
tccagataactctcttt

SEQ ID NO: 2367281 - DNA, 19 bp, Homo sapiens
tccagataactctctttcc

SEQ ID NO: 2367282 - DNA, 21 bp, Homo sapiens
tccagataactctctttcctt

SEQ ID NO: 2367283 - DNA, 16 bp, Homo sapiens
tccagatcactgccac

SEQ ID NO: 2367284 - DNA, 17 bp, Homo sapiens
tccagatctttcagaaa

SEQ ID NO: 2367285 - DNA, 13 bp, Homo sapiens
tccagatgtggct

SEQ ID NO: 2367286 - DNA, 21 bp, Homo sapiens
tccagatgtggctactgacat

SEQ ID NO: 2367287 - DNA, 16 bp, Homo sapiens
tccagattctgatgca

SEQ ID NO: 2367288 - DNA, 21 bp, Homo sapiens
tccagcacatccccctctcct

SEQ ID NO: 2367289 - DNA, 12 bp, Homo sapiens
tccagcagttgt

SEQ ID NO: 2367290 - DNA, 22 bp, Homo sapiens
tccagcgatctctccactgtgc

SEQ ID NO: 2367291 - DNA, 13 bp, Homo sapiens
tccagctggggcc

SEQ ID NO: 2367292 - DNA, 17 bp, Homo sapiens
tccagctggggccagag

SEQ ID NO: 2367293 - DNA, 21 bp, Homo sapiens
tccagctggggccagaggctg

SEQ ID NO: 2367294 - DNA, 14 bp, Homo sapiens
tccagcttccaaag

SEQ ID NO: 2367295 - DNA, 11 bp, Homo sapiens
tccaggaaaga

SEQ ID NO: 2367296 - DNA, 15 bp, Homo sapiens
tccaggaaagagcag

SEQ ID NO: 2367297 - DNA, 16 bp, Homo sapiens
tccaggaataggcatt

SEQ ID NO: 2367298 - DNA, 21 bp, Homo sapiens
tccaggagataattgtttcat

SEQ ID NO: 2367299 - DNA, 13 bp, Homo sapiens
tccaggcaccagg

SEQ ID NO: 2367300 - DNA, 20 bp, Homo sapiens
tccaggcaccctcagggagc

SEQ ID NO: 2367301 - DNA, 14 bp, Homo sapiens
tccaggcctgcctc

SEQ ID NO: 2367302 - DNA, 17 bp, Homo sapiens
tccaggcctgcctccca

SEQ ID NO: 2367303 - DNA, 20 bp, Homo sapiens
tccagggaaggtggccacag

SEQ ID NO: 2367304 - DNA, 22 bp, Homo sapiens
tccagggaaggtggccacagca

SEQ ID NO: 2367305 - DNA, 20 bp, Homo sapiens
tccagggaatccaagcctcc

SEQ ID NO: 2367306 - DNA, 18 bp, Homo sapiens
tccagggatttgcctcac

SEQ ID NO: 2367307 - DNA, 18 bp, Homo sapiens
tccagtcatctgtaagag

SEQ ID NO: 2367308 - DNA, 15 bp, Homo sapiens
tccagtcttcctgac

SEQ ID NO: 2367309 - DNA, 19 bp, Homo sapiens
tccagtcttcctgacactt

SEQ ID NO: 2367310 - DNA, 15 bp, Homo sapiens
tccagtgaacattcc

SEQ ID NO: 2367311 - DNA, 18 bp, Homo sapiens
tccagtttctccttgaaa

SEQ ID NO: 2367312 - DNA, 16 bp, Homo sapiens
tccataaagtacaaat

SEQ ID NO: 2367313 - DNA, 24 bp, Homo sapiens
tccataaagtacaaatgaagaaag

SEQ ID NO: 2367314 - DNA, 15 bp, Homo sapiens
tccatacacagagga

SEQ ID NO: 2367315 - DNA, 14 bp, Homo sapiens
tccatatcctggtg

SEQ ID NO: 2367316 - DNA, 16 bp, Homo sapiens
tccatatttgatttct

SEQ ID NO: 2367317 - DNA, 19 bp, Homo sapiens
tccatatttgatttctaat

SEQ ID NO: 2367318 - DNA, 18 bp, Homo sapiens
tccatccctccattcatc

SEQ ID NO: 2367319 - DNA, 12 bp, Homo sapiens
tccatccctcta

SEQ ID NO: 2367320 - DNA, 23 bp, Homo sapiens
tccatccctctaatgagactgac

SEQ ID NO: 2367321 - DNA, 18 bp, Homo sapiens
tccatccttccaacatat

SEQ ID NO: 2367322 - DNA, 15 bp, Homo sapiens
tccatctcccaaggc

SEQ ID NO: 2367323 - DNA, 21 bp, Homo sapiens
tccatctcccaaggctgccag

SEQ ID NO: 2367324 - DNA, 22 bp, Homo sapiens
tccatgagttatcatgaatttt

SEQ ID NO: 2367325 - DNA, 17 bp, Homo sapiens
tccatggccctgtccca

SEQ ID NO: 2367326 - DNA, 18 bp, Homo sapiens
tccatgtcccctcccaga

SEQ ID NO: 2367327 - DNA, 14 bp, Homo sapiens
tccattacctccat

SEQ ID NO: 2367328 - DNA, 16 bp, Homo sapiens
tccattcatccttcca

SEQ ID NO: 2367329 - DNA, 23 bp, Homo sapiens
tccattcattaattagttccagt

SEQ ID NO: 2367330 - DNA, 19 bp, Homo sapiens
tccattggatctgcaagaa

SEQ ID NO: 2367331 - DNA, 20 bp, Homo sapiens
tccattgggcacagtccaga

SEQ ID NO: 2367332 - DNA, 11 bp, Homo sapiens
tcccaaagtgc

SEQ ID NO: 2367333 - DNA, 13 bp, Homo sapiens
tcccaagctaggc

SEQ ID NO: 2367334 - DNA, 20 bp, Homo sapiens
tcccaaggttggagcccagg

SEQ ID NO: 2367335 - DNA, 21 bp, Homo sapiens
tcccaaggttggagcccaggg

SEQ ID NO: 2367336 - DNA, 16 bp, Homo sapiens
tcccacactgtgaact

SEQ ID NO: 2367337 - DNA, 20 bp, Homo sapiens
tcccacatccaactccagca

SEQ ID NO: 2367338 - DNA, 19 bp, Homo sapiens
tcccacatgggcccaggcc

SEQ ID NO: 2367339 - DNA, 12 bp, Homo sapiens
tcccaccctctt

SEQ ID NO: 2367340 - DNA, 22 bp, Homo sapiens
tcccaccctgcgggccagggtc

SEQ ID NO: 2367341 - DNA, 21 bp, Homo sapiens
tcccacctcctgacacccttc

SEQ ID NO: 2367342 - DNA, 22 bp, Homo sapiens
tcccactccaagcccagcccat

SEQ ID NO: 2367343 - DNA, 13 bp, Homo sapiens
tcccactctccta

SEQ ID NO: 2367344 - DNA, 19 bp, Homo sapiens
tcccagaaacatctctggc

SEQ ID NO: 2367345 - DNA, 19 bp, Homo sapiens
tcccagagctggtggaccc

SEQ ID NO: 2367346 - DNA, 22 bp, Homo sapiens
tcccagagctggtggacccagg

SEQ ID NO: 2367347 - DNA, 15 bp, Homo sapiens
tcccagatgctgtca

SEQ ID NO: 2367348 - DNA, 18 bp, Homo sapiens
tcccagcactttgggagg

SEQ ID NO: 2367349 - DNA, 22 bp, Homo sapiens
tcccagccccggcaagccacag

SEQ ID NO: 2367350 - DNA, 19 bp, Homo sapiens
tcccaggagatgggtccag

SEQ ID NO: 2367351 - DNA, 18 bp, Homo sapiens
tcccaggggtctccctgg

SEQ ID NO: 2367352 - DNA, 19 bp, Homo sapiens
tcccaggggtctccctggc

SEQ ID NO: 2367353 - DNA, 16 bp, Homo sapiens
tcccaggtaccagctg

SEQ ID NO: 2367354 - DNA, 19 bp, Homo sapiens
tcccaggtaccagctgcgc

SEQ ID NO: 2367355 - DNA, 22 bp, Homo sapiens
tcccagtgctcaccagccctgc

SEQ ID NO: 2367356 - DNA, 17 bp, Homo sapiens
tcccatccagctaccac

SEQ ID NO: 2367357 - DNA, 13 bp, Homo sapiens
tcccatctgcacc

SEQ ID NO: 2367358 - DNA, 18 bp, Homo sapiens
tcctcctcacctcatgcc

SEQ ID NO: 2367359 - DNA, 11 bp, Homo sapiens
tcctcctctgc

SEQ ID NO: 2367360 - DNA, 14 bp, Homo sapiens
tcctcctctgccta

SEQ ID NO: 2367361 - DNA, 15 bp, Homo sapiens
tcctcctctgcctac

SEQ ID NO: 2367362 - DNA, 13 bp, Homo sapiens
tcctcctgcctca

SEQ ID NO: 2367363 - DNA, 17 bp, Homo sapiens
tcctcctgcctcagcct

SEQ ID NO: 2367364 - DNA, 16 bp, Homo sapiens
tcctcctgtattcctg

SEQ ID NO: 2367365 - DNA, 19 bp, Homo sapiens
tcctccttggtgcctggcc

SEQ ID NO: 2367366 - DNA, 16 bp, Homo sapiens
tcctctagaagccaag

SEQ ID NO: 2367367 - DNA, 13 bp, Homo sapiens
tcctctccactgc

SEQ ID NO: 2367368 - DNA, 14 bp, Homo sapiens
tcctctccactgct

SEQ ID NO: 2367369 - DNA, 15 bp, Homo sapiens
tcctctccactgctg

SEQ ID NO: 2367370 - DNA, 20 bp, Homo sapiens
tcctctccccctcctccagg

SEQ ID NO: 2367371 - DNA, 22 bp, Homo sapiens
tcctctccccctcctccaggga

SEQ ID NO: 2367372 - DNA, 16 bp, Homo sapiens
tcctctctctcttcta

SEQ ID NO: 2367373 - DNA, 13 bp, Homo sapiens
tcctctgcaagct

SEQ ID NO: 2367374 - DNA, 14 bp, Homo sapiens
tcctctgcctacag

SEQ ID NO: 2367375 - DNA, 18 bp, Homo sapiens
tcctctgcctacagccag

SEQ ID NO: 2367376 - DNA, 11 bp, Homo sapiens
tcctctgcctg

SEQ ID NO: 2367377 - DNA, 15 bp, Homo sapiens
tcctctggacggcag

SEQ ID NO: 2367378 - DNA, 24 bp, Homo sapiens
tcctctggacggcaggctcactgc

SEQ ID NO: 2367379 - DNA, 14 bp, Homo sapiens
tcctctggctttcc

SEQ ID NO: 2367380 - DNA, 17 bp, Homo sapiens
tcctctggctttcccag

SEQ ID NO: 2367381 - DNA, 13 bp, Homo sapiens
tcctcttgtccta

SEQ ID NO: 2367382 - DNA, 14 bp, Homo sapiens
tcctctttctgctc

SEQ ID NO: 2367383 - DNA, 15 bp, Homo sapiens
tcctctttctgctct

SEQ ID NO: 2367384 - DNA, 22 bp, Homo sapiens
tcctctttctgctctgccatct

SEQ ID NO: 2367385 - DNA, 17 bp, Homo sapiens
tcctgaaacgctccttt

SEQ ID NO: 2367386 - DNA, 18 bp, Homo sapiens
tcctgaaccgcacagctc

SEQ ID NO: 2367387 - DNA, 22 bp, Homo sapiens
tcctgaatccaaactaatccat

SEQ ID NO: 2367388 - DNA, 19 bp, Homo sapiens
tcctgacacccttctccca

SEQ ID NO: 2367389 - DNA, 21 bp, Homo sapiens
tcctgacacccttctcccact

SEQ ID NO: 2367390 - DNA, 15 bp, Homo sapiens
tcctgacagaaggtg

SEQ ID NO: 2367391 - DNA, 16 bp, Homo sapiens
tcctgacagaaggtgc

SEQ ID NO: 2367392 - DNA, 17 bp, Homo sapiens
tcctgacagaaggtgcc

SEQ ID NO: 2367393 - DNA, 17 bp, Homo sapiens
tcctgaccaagactgag

SEQ ID NO: 2367394 - DNA, 16 bp, Homo sapiens
tcctgacccctctcct

SEQ ID NO: 2367395 - DNA, 18 bp, Homo sapiens
tcctgacccctctcctca

SEQ ID NO: 2367396 - DNA, 15 bp, Homo sapiens
tcctgacctccgcca

SEQ ID NO: 2367397 - DNA, 20 bp, Homo sapiens
tcctgactgaaagtaggggg

SEQ ID NO: 2367398 - DNA, 22 bp, Homo sapiens
tcctgcacacagaatgctcagg

SEQ ID NO: 2367399 - DNA, 23 bp, Homo sapiens
tcctgcacacagaatgctcaggg

SEQ ID NO: 2367400 - DNA, 17 bp, Homo sapiens
tcctgcaggcaggaaca

SEQ ID NO: 2367401 - DNA, 22 bp, Homo sapiens
tcctgcaggcaggaacaaacag

SEQ ID NO: 2367402 - DNA, 15 bp, Homo sapiens
tcctgcccttccctc

SEQ ID NO: 2367403 - DNA, 18 bp, Homo sapiens
tcctgcccttccctctgg

SEQ ID NO: 2367404 - DNA, 18 bp, Homo sapiens
tcctgcctcagccttcca

SEQ ID NO: 2367405 - DNA, 21 bp, Homo sapiens
tcctgcgaccttgcaacctca

SEQ ID NO: 2367406 - DNA, 15 bp, Homo sapiens
tcctgcgtcctcctc

SEQ ID NO: 2367407 - DNA, 14 bp, Homo sapiens
tcctgctgctgtct

SEQ ID NO: 2367408 - DNA, 20 bp, Homo sapiens
tcctggaagccagctttccc

SEQ ID NO: 2367409 - DNA, 18 bp, Homo sapiens
tcctggagcatcccaggc

SEQ ID NO: 2367410 - DNA, 19 bp, Homo sapiens
tcctggagcatcccaggcg

SEQ ID NO: 2367411 - DNA, 19 bp, Homo sapiens
tcctggaggggctggggac

SEQ ID NO: 2367412 - DNA, 17 bp, Homo sapiens
tcctggcagcccagaga

SEQ ID NO: 2367413 - DNA, 18 bp, Homo sapiens
tcctggcctatccgctgc

SEQ ID NO: 2367414 - DNA, 17 bp, Homo sapiens
tcctggcctgagagtca

SEQ ID NO: 2367415 - DNA, 21 bp, Homo sapiens
tcctggctcggggtaaaaagt

SEQ ID NO: 2367416 - DNA, 20 bp, Homo sapiens
tcctggctctaccctgtctg

SEQ ID NO: 2367417 - DNA, 23 bp, Homo sapiens
tcctggctctaccctgtctgtcc

SEQ ID NO: 2367418 - DNA, 23 bp, Homo sapiens
tcctgggggcctgggttgggggc

SEQ ID NO: 2367419 - DNA, 23 bp, Homo sapiens
tcctggtacagcagggtcttgct

SEQ ID NO: 2367420 - DNA, 17 bp, Homo sapiens
tcctggtgaggcccagc

SEQ ID NO: 2367421 - DNA, 18 bp, Homo sapiens
tcctggtgaggcccagcc

SEQ ID NO: 2367422 - DNA, 22 bp, Homo sapiens
tcctggtgaggcccagcctgtc

SEQ ID NO: 2367423 - DNA, 21 bp, Homo sapiens
tcctgtagttgcgtggactct

SEQ ID NO: 2367424 - DNA, 10 bp, Homo sapiens
tcctgtccca

SEQ ID NO: 2367425 - DNA, 17 bp, Homo sapiens
tcctgtcccctgctaca

SEQ ID NO: 2367426 - DNA, 12 bp, Homo sapiens
tcctgtccctga

SEQ ID NO: 2367427 - DNA, 21 bp, Homo sapiens
tcctgtgatccacccaaccct

SEQ ID NO: 2367428 - DNA, 21 bp, Homo sapiens
tcctgtggaaggcagagaaat

SEQ ID NO: 2367429 - DNA, 20 bp, Homo sapiens
tcctgtgggtgttctttcct

SEQ ID NO: 2367430 - DNA, 21 bp, Homo sapiens
tcctgtgggtgttctttcctg

SEQ ID NO: 2367431 - DNA, 12 bp, Homo sapiens
tcctgtgtcctg

SEQ ID NO: 2367432 - DNA, 20 bp, Homo sapiens
tccttacctttttatttgca

SEQ ID NO: 2367433 - DNA, 15 bp, Homo sapiens
tccttacttttaagg

SEQ ID NO: 2367434 - DNA, 24 bp, Homo sapiens
tccttcatttccaccaggccgtgc

SEQ ID NO: 2367435 - DNA, 15 bp, Homo sapiens
tccttccctctctga

SEQ ID NO: 2367436 - DNA, 17 bp, Homo sapiens
tccttccctctctgatg

SEQ ID NO: 2367437 - DNA, 16 bp, Homo sapiens
tccttccgcttggagc

SEQ ID NO: 2367438 - DNA, 13 bp, Homo sapiens
tccttcctggcct

SEQ ID NO: 2367439 - DNA, 14 bp, Homo sapiens
tccttcctggcctg

SEQ ID NO: 2367440 - DNA, 15 bp, Homo sapiens
tccttctattctagc

SEQ ID NO: 2367441 - DNA, 19 bp, Homo sapiens
tccttctttgataatgtta

SEQ ID NO: 2367442 - DNA, 22 bp, Homo sapiens
tccttctttgataatgttaaat

SEQ ID NO: 2367443 - DNA, 19 bp, Homo sapiens
tccttgcgcctcagccctc

SEQ ID NO: 2367444 - DNA, 14 bp, Homo sapiens
tccttggagagcag

SEQ ID NO: 2367445 - DNA, 18 bp, Homo sapiens
tccttggagagcagctgg

SEQ ID NO: 2367446 - DNA, 18 bp, Homo sapiens
tccttggattttcctgaa

SEQ ID NO: 2367447 - DNA, 22 bp, Homo sapiens
tccttggattttcctgaaagtg

SEQ ID NO: 2367448 - DNA, 19 bp, Homo sapiens
tccttgtcttttgagctat

SEQ ID NO: 2367449 - DNA, 20 bp, Homo sapiens
tcctttaatatactccttaa

SEQ ID NO: 2367450 - DNA, 15 bp, Homo sapiens
tcctttacctttcag

SEQ ID NO: 2367451 - DNA, 17 bp, Homo sapiens
tcctttacctttcagtg

SEQ ID NO: 2367452 - DNA, 16 bp, Homo sapiens
tcctttaggcagcctg

SEQ ID NO: 2367453 - DNA, 13 bp, Homo sapiens
tcctttatgtgaa

SEQ ID NO: 2367454 - DNA, 14 bp, Homo sapiens
tcctttatgtgaat

SEQ ID NO: 2367455 - DNA, 16 bp, Homo sapiens
tcctttatgtgaattt

SEQ ID NO: 2367456 - DNA, 17 bp, Homo sapiens
tcctttatgtgaatttt

SEQ ID NO: 2367457 - DNA, 18 bp, Homo sapiens
tcctttgtgtgtgtgtca

SEQ ID NO: 2367458 - DNA, 17 bp, Homo sapiens
tccttttaattttcctg

SEQ ID NO: 2367459 - DNA, 15 bp, Homo sapiens
tccttttccctgctt

SEQ ID NO: 2367460 - DNA, 16 bp, Homo sapiens
tcctttttcctctcca

SEQ ID NO: 2367461 - DNA, 16 bp, Homo sapiens
tcgaaataacaatgtt

SEQ ID NO: 2367462 - DNA, 19 bp, Homo sapiens
tcgaaataacaatgttaag

SEQ ID NO: 2367463 - DNA, 11 bp, Homo sapiens
tcgaggcctga

SEQ ID NO: 2367464 - DNA, 20 bp, Homo sapiens
tcgaggcctgaagccagctg

SEQ ID NO: 2367465 - DNA, 22 bp, Homo sapiens
tcgcactacatctgatatcagg

SEQ ID NO: 2367466 - DNA, 22 bp, Homo sapiens
tcgccaggactggtgaatataa

SEQ ID NO: 2367467 - DNA, 12 bp, Homo sapiens
tcgccctccttt

SEQ ID NO: 2367468 - DNA, 17 bp, Homo sapiens
tcgccggatctgaggga

SEQ ID NO: 2367469 - DNA, 15 bp, Homo sapiens
tcgcgctcagtaaac

SEQ ID NO: 2367470 - DNA, 21 bp, Homo sapiens
tcgctcaccgctggcccttag

SEQ ID NO: 2367471 - DNA, 17 bp, Homo sapiens
tcgctgaaattgcttat

SEQ ID NO: 2367472 - DNA, 20 bp, Homo sapiens
tcgctgccatcaccgctggg

SEQ ID NO: 2367473 - DNA, 19 bp, Homo sapiens
tcgctttattggctgagat

SEQ ID NO: 2367474 - DNA, 21 bp, Homo sapiens
cttacaatattgattgggaaa

SEQ ID NO: 2367475 - DNA, 14 bp, Homo sapiens
cttacatgcatttg

SEQ ID NO: 2367476 - DNA, 15 bp, Homo sapiens
cttactaaaaagtat

SEQ ID NO: 2367477 - DNA, 21 bp, Homo sapiens
cttactaaaaagtataaaata

SEQ ID NO: 2367478 - DNA, 14 bp, Homo sapiens
cttactctttccta

SEQ ID NO: 2367479 - DNA, 23 bp, Homo sapiens
cttactctttcctatttcagtgt

SEQ ID NO: 2367480 - DNA, 19 bp, Homo sapiens
cttactgatatattttaca

SEQ ID NO: 2367481 - DNA, 20 bp, Homo sapiens
cttacttggtgagggtgccc

SEQ ID NO: 2367482 - DNA, 13 bp, Homo sapiens
cttactttgctga

SEQ ID NO: 2367483 - DNA, 21 bp, Homo sapiens
cttacttttaaggataaatca

SEQ ID NO: 2367484 - DNA, 11 bp, Homo sapiens
cttagaaactg

SEQ ID NO: 2367485 - DNA, 12 bp, Homo sapiens
cttcttctccat

SEQ ID NO: 2367486 - DNA, 22 bp, Homo sapiens
cttcttgaaattttaacctatg

SEQ ID NO: 2367487 - DNA, 15 bp, Homo sapiens
cttcttgagcagacc

SEQ ID NO: 2367488 - DNA, 11 bp, Homo sapiens
cttcttgggat

SEQ ID NO: 2367489 - DNA, 18 bp, Homo sapiens
cttcttgtgtcctgatga

SEQ ID NO: 2367490 - DNA, 15 bp, Homo sapiens
cttcttgtttccttg

SEQ ID NO: 2367491 - DNA, 15 bp, Homo sapiens
cttctttccctggac

SEQ ID NO: 2367492 - DNA, 17 bp, Homo sapiens
cttctttctagagcagt

SEQ ID NO: 2367493 - DNA, 14 bp, Homo sapiens
cttctttgataatg

SEQ ID NO: 2367494 - DNA, 15 bp, Homo sapiens
cttctttgcctccct

SEQ ID NO: 2367495 - DNA, 15 bp, Homo sapiens
cttctttgtgcctga

SEQ ID NO: 2367496 - DNA, 17 bp, Homo sapiens
cttgaaacagcctgggt

SEQ ID NO: 2367497 - DNA, 20 bp, Homo sapiens
cttgaaatgagtaaaaacta

SEQ ID NO: 2367498 - DNA, 22 bp, Homo sapiens
cttgaaatgagtaaaaactaga

SEQ ID NO: 2367499 - DNA, 13 bp, Homo sapiens
cttgaaattttaa

SEQ ID NO: 2367500 - DNA, 16 bp, Homo sapiens
cttgaaattttaacct

SEQ ID NO: 2367501 - DNA, 17 bp, Homo sapiens
cttgaaggccctgctga

SEQ ID NO: 2367502 - DNA, 13 bp, Homo sapiens
cttgaatataaaa

SEQ ID NO: 2367503 - DNA, 15 bp, Homo sapiens
cttgaatataaaaaa

SEQ ID NO: 2367504 - DNA, 16 bp, Homo sapiens
cttgaatataaaaaat

SEQ ID NO: 2367505 - DNA, 14 bp, Homo sapiens
cttgacgaatattg

SEQ ID NO: 2367506 - DNA, 17 bp, Homo sapiens
cttgacgaatattgctt

SEQ ID NO: 2367507 - DNA, 12 bp, Homo sapiens
cttgagacaatg

SEQ ID NO: 2367508 - DNA, 21 bp, Homo sapiens
cttgagacaatgttttcttca

SEQ ID NO: 2367509 - DNA, 13 bp, Homo sapiens
cttgagctggcct

SEQ ID NO: 2367510 - DNA, 23 bp, Homo sapiens
cttgagctggcctctctagcaca

SEQ ID NO: 2367511 - DNA, 14 bp, Homo sapiens
cttgagggctgcag

SEQ ID NO: 2367512 - DNA, 23 bp, Homo sapiens
cttgagggctgcagttctactca

SEQ ID NO: 2367513 - DNA, 12 bp, Homo sapiens
cttgataatata

SEQ ID NO: 2367514 - DNA, 14 bp, Homo sapiens
cttgatgactgcct

SEQ ID NO: 2367515 - DNA, 15 bp, Homo sapiens
cttgatgactgcctt

SEQ ID NO: 2367516 - DNA, 21 bp, Homo sapiens
cttgatgactgccttgcctcc

SEQ ID NO: 2367517 - DNA, 19 bp, Homo sapiens
cttgatttcaaagttttgt

SEQ ID NO: 2367518 - DNA, 21 bp, Homo sapiens
cttgcaacctcaccttcctgt

SEQ ID NO: 2367519 - DNA, 18 bp, Homo sapiens
cttgcacagctggagaaa

SEQ ID NO: 2367520 - DNA, 17 bp, Homo sapiens
cttgccatcagtgaaaa

SEQ ID NO: 2367521 - DNA, 14 bp, Homo sapiens
cttgcctccccatt

SEQ ID NO: 2367522 - DNA, 14 bp, Homo sapiens
cttgcctcctcagt

SEQ ID NO: 2367523 - DNA, 20 bp, Homo sapiens
cttgcctttcgaggcctgaa

SEQ ID NO: 2367524 - DNA, 19 bp, Homo sapiens
cttgcgcctcagccctcag

SEQ ID NO: 2367525 - DNA, 20 bp, Homo sapiens
cttgcgcctcagccctcagt

SEQ ID NO: 2367526 - DNA, 16 bp, Homo sapiens
cttgctacctcaaggg

SEQ ID NO: 2367527 - DNA, 17 bp, Homo sapiens
cttgctccagattctga

SEQ ID NO: 2367528 - DNA, 21 bp, Homo sapiens
cttgctccagattctgatgca

SEQ ID NO: 2367529 - DNA, 13 bp, Homo sapiens
cttgctctgtccc

SEQ ID NO: 2367530 - DNA, 14 bp, Homo sapiens
cttgctctgtcccc

SEQ ID NO: 2367531 - DNA, 20 bp, Homo sapiens
cttgctctgtcccccaggct

SEQ ID NO: 2367532 - DNA, 22 bp, Homo sapiens
cttgctgatcagagttcctcct

SEQ ID NO: 2367533 - DNA, 19 bp, Homo sapiens
cttgctgccatgatgtata

SEQ ID NO: 2367534 - DNA, 12 bp, Homo sapiens
cttgctgctgtc

SEQ ID NO: 2367535 - DNA, 15 bp, Homo sapiens
cttgctggccccagc

SEQ ID NO: 2367536 - DNA, 22 bp, Homo sapiens
cttgctggccccagccctgctg

SEQ ID NO: 2367537 - DNA, 19 bp, Homo sapiens
cttgctgtaactcagacat

SEQ ID NO: 2367538 - DNA, 14 bp, Homo sapiens
cttgctgtccaggc

SEQ ID NO: 2367539 - DNA, 18 bp, Homo sapiens
cttgctgtccaggcagct

SEQ ID NO: 2367540 - DNA, 19 bp, Homo sapiens
cttgctgtgtgaccctggg

SEQ ID NO: 2367541 - DNA, 13 bp, Homo sapiens
cttgcttaaattt

SEQ ID NO: 2367542 - DNA, 17 bp, Homo sapiens
cttgcttaaatttctta

SEQ ID NO: 2367543 - DNA, 19 bp, Homo sapiens
cttgcttctgtatttcctt

SEQ ID NO: 2367544 - DNA, 17 bp, Homo sapiens
cttgctttaccttttca

SEQ ID NO: 2367545 - DNA, 22 bp, Homo sapiens
cttgctttggggggtgtgctga

SEQ ID NO: 2367546 - DNA, 20 bp, Homo sapiens
cttggaaatagaaagaagcc

SEQ ID NO: 2367547 - DNA, 23 bp, Homo sapiens
cttggaaatagaaagaagccata

SEQ ID NO: 2367548 - DNA, 24 bp, Homo sapiens
cttggaaatgtctgctggtatttc

SEQ ID NO: 2367549 - DNA, 16 bp, Homo sapiens
cttggaaattcctgta

SEQ ID NO: 2367550 - DNA, 13 bp, Homo sapiens
cttggacactgta

SEQ ID NO: 2367551 - DNA, 14 bp, Homo sapiens
cttggaccactcct

SEQ ID NO: 2367552 - DNA, 16 bp, Homo sapiens
cttggaccactcctgt

SEQ ID NO: 2367553 - DNA, 22 bp, Homo sapiens
cttggaccactcctgtccctgt

SEQ ID NO: 2367554 - DNA, 15 bp, Homo sapiens
cttggagagcagctg

SEQ ID NO: 2367555 - DNA, 22 bp, Homo sapiens
cttggatatataggctattttc

SEQ ID NO: 2367556 - DNA, 22 bp, Homo sapiens
cttggatgtcactgcctgacat

SEQ ID NO: 2367557 - DNA, 15 bp, Homo sapiens
cttggattttcctga

SEQ ID NO: 2367558 - DNA, 16 bp, Homo sapiens
cttggattttcctgaa

SEQ ID NO: 2367559 - DNA, 16 bp, Homo sapiens
cttggcctgctgtgat

SEQ ID NO: 2367560 - DNA, 14 bp, Homo sapiens
cttggctgccctgt

SEQ ID NO: 2367561 - DNA, 16 bp, Homo sapiens
cttggctggggaggac

SEQ ID NO: 2367562 - DNA, 19 bp, Homo sapiens
cttggctggggaggaccag

SEQ ID NO: 2367563 - DNA, 17 bp, Homo sapiens
cttggcttctgtgatga

SEQ ID NO: 2367564 - DNA, 18 bp, Homo sapiens
cttgggaagactcctagc

SEQ ID NO: 2367565 - DNA, 16 bp, Homo sapiens
cttgggctctgatgaa

SEQ ID NO: 2367566 - DNA, 18 bp, Homo sapiens
cttgggctctgatgaaaa

SEQ ID NO: 2367567 - DNA, 23 bp, Homo sapiens
cttggggccaccaaagctgccca

SEQ ID NO: 2367568 - DNA, 20 bp, Homo sapiens
cttggggctcgccccaccca

SEQ ID NO: 2367569 - DNA, 22 bp, Homo sapiens
cttggggctcgccccacccagg

SEQ ID NO: 2367570 - DNA, 18 bp, Homo sapiens
cttggtagattattcata

SEQ ID NO: 2367571 - DNA, 22 bp, Homo sapiens
cttggtcacaaagctatttaag

SEQ ID NO: 2367572 - DNA, 22 bp, Homo sapiens
cttggttcaataaagcactgag

SEQ ID NO: 2367573 - DNA, 20 bp, Homo sapiens
cttgtacatgtgtagcctgt

SEQ ID NO: 2367574 - DNA, 18 bp, Homo sapiens
cttgtattctgaggatgt

SEQ ID NO: 2367575 - DNA, 22 bp, Homo sapiens
cttgtcatagactcctttgcta

SEQ ID NO: 2367576 - DNA, 13 bp, Homo sapiens
cttgtcattttga

SEQ ID NO: 2367577 - DNA, 18 bp, Homo sapiens
cttgtcctacgtccaagg

SEQ ID NO: 2367578 - DNA, 15 bp, Homo sapiens
cttgtcgtgggatgg

SEQ ID NO: 2367579 - DNA, 18 bp, Homo sapiens
cttgtcttttcagaagca

SEQ ID NO: 2367580 - DNA, 22 bp, Homo sapiens
cttgtgatttctttaaaagaat

SEQ ID NO: 2367581 - DNA, 19 bp, Homo sapiens
cttgtgcaaggtggccttt

SEQ ID NO: 2367582 - DNA, 12 bp, Homo sapiens
cttgtgtcctga

SEQ ID NO: 2367583 - DNA, 10 bp, Homo sapiens
cttgtgtctg

SEQ ID NO: 2367584 - DNA, 12 bp, Homo sapiens
cttgtgtctgta

SEQ ID NO: 2367585 - DNA, 23 bp, Homo sapiens
cttgttatgttgtaatattttgc

SEQ ID NO: 2367586 - DNA, 14 bp, Homo sapiens
cttgttcaggaaaa

SEQ ID NO: 2367587 - DNA, 18 bp, Homo sapiens
cttgttgtttttaagtcc

SEQ ID NO: 2367588 - DNA, 19 bp, Homo sapiens
cttgtttacctttctctct

SEQ ID NO: 2367589 - DNA, 22 bp, Homo sapiens
cttgtttacctttctctctcta

SEQ ID NO: 2367590 - DNA, 21 bp, Homo sapiens
cttgtttgagtttttcctccc

SEQ ID NO: 2367591 - DNA, 17 bp, Homo sapiens
cttgttttggatggctt

SEQ ID NO: 2367592 - DNA, 17 bp, Homo sapiens
ctttaaaaaaatttaag

SEQ ID NO: 2367593 - DNA, 18 bp, Homo sapiens
ctttaaaaaaatttaagt

SEQ ID NO: 2367594 - DNA, 20 bp, Homo sapiens
tgaaggggtgcacccacctg

SEQ ID NO: 2367595 - DNA, 18 bp, Homo sapiens
tgaaggtgataagggaaa

SEQ ID NO: 2367596 - DNA, 15 bp, Homo sapiens
tgaagtagaagttac

SEQ ID NO: 2367597 - DNA, 21 bp, Homo sapiens
tgaagtcattgtcgctcagca

SEQ ID NO: 2367598 - DNA, 20 bp, Homo sapiens
tgaagtcgggtcaaaaataa

SEQ ID NO: 2367599 - DNA, 16 bp, Homo sapiens
tgaagtggctggtaga

SEQ ID NO: 2367600 - DNA, 16 bp, Homo sapiens
tgaagttagtggaaat

SEQ ID NO: 2367601 - DNA, 18 bp, Homo sapiens
tgaagttgggtgtttcca

SEQ ID NO: 2367602 - DNA, 20 bp, Homo sapiens
tgaagttgggtgtttccaga

SEQ ID NO: 2367603 - DNA, 22 bp, Homo sapiens
tgaagtttcaagttttaaagtt

SEQ ID NO: 2367604 - DNA, 17 bp, Homo sapiens
tgaagttttactgtcta

SEQ ID NO: 2367605 - DNA, 22 bp, Homo sapiens
tgaagtttttttgctgctgcct

SEQ ID NO: 2367606 - DNA, 16 bp, Homo sapiens
tgaataaagaatgcca

SEQ ID NO: 2367607 - DNA, 13 bp, Homo sapiens
tgaataaatgtgt

SEQ ID NO: 2367608 - DNA, 13 bp, Homo sapiens
tgaataactcttt

SEQ ID NO: 2367609 - DNA, 16 bp, Homo sapiens
tgaataatatcaaata

SEQ ID NO: 2367610 - DNA, 19 bp, Homo sapiens
tgaataatggaaaatgcca

SEQ ID NO: 2367611 - DNA, 13 bp, Homo sapiens
tgaatacattaac

SEQ ID NO: 2367612 - DNA, 23 bp, Homo sapiens
tgaatacattaacggtgctaaaa

SEQ ID NO: 2367613 - DNA, 14 bp, Homo sapiens
tgaatagcctggcc

SEQ ID NO: 2367614 - DNA, 13 bp, Homo sapiens
tgaatataaaaaa

SEQ ID NO: 2367615 - DNA, 15 bp, Homo sapiens
tgaatccaaactaat

SEQ ID NO: 2367616 - DNA, 20 bp, Homo sapiens
tgaatcccacccacatgtga

SEQ ID NO: 2367617 - DNA, 15 bp, Homo sapiens
tgaatctctgcctct

SEQ ID NO: 2367618 - DNA, 12 bp, Homo sapiens
tgaatgctattt

SEQ ID NO: 2367619 - DNA, 14 bp, Homo sapiens
tgaatgctcctaat

SEQ ID NO: 2367620 - DNA, 15 bp, Homo sapiens
tgaatggattggatt

SEQ ID NO: 2367621 - DNA, 17 bp, Homo sapiens
tgaatggattggattat

SEQ ID NO: 2367622 - DNA, 21 bp, Homo sapiens
tgaatgttaaagggatatttt

SEQ ID NO: 2367623 - DNA, 16 bp, Homo sapiens
tgaattattgacactg

SEQ ID NO: 2367624 - DNA, 17 bp, Homo sapiens
tgaattattgacactga

SEQ ID NO: 2367625 - DNA, 16 bp, Homo sapiens
tgaattgaagtttcaa

SEQ ID NO: 2367626 - DNA, 17 bp, Homo sapiens
tgaattggctatgcagt

SEQ ID NO: 2367627 - DNA, 13 bp, Homo sapiens
tgaattttaaagt

SEQ ID NO: 2367628 - DNA, 16 bp, Homo sapiens
tgaattttaaagtatg

SEQ ID NO: 2367629 - DNA, 17 bp, Homo sapiens
tgaattttctaaaagct

SEQ ID NO: 2367630 - DNA, 15 bp, Homo sapiens
tgaatttttttgtaa

SEQ ID NO: 2367631 - DNA, 22 bp, Homo sapiens
tgacaaataagattaataagat

SEQ ID NO: 2367632 - DNA, 19 bp, Homo sapiens
tgacaaccattaaagtcag

SEQ ID NO: 2367633 - DNA, 21 bp, Homo sapiens
tgacaaccattaaagtcagaa

SEQ ID NO: 2367634 - DNA, 17 bp, Homo sapiens
tgacaacttagctcagg

SEQ ID NO: 2367635 - DNA, 18 bp, Homo sapiens
tgacaacttagctcaggt

SEQ ID NO: 2367636 - DNA, 16 bp, Homo sapiens
tgacaataagaaacag

SEQ ID NO: 2367637 - DNA, 24 bp, Homo sapiens
tgacaatattccagatctttcaga

SEQ ID NO: 2367638 - DNA, 15 bp, Homo sapiens
tgacaatcaactcta

SEQ ID NO: 2367639 - DNA, 18 bp, Homo sapiens
tgacaatcaactctaata

SEQ ID NO: 2367640 - DNA, 16 bp, Homo sapiens
tgacacaaagcttcta

SEQ ID NO: 2367641 - DNA, 16 bp, Homo sapiens
tgacacaactgtgtga

SEQ ID NO: 2367642 - DNA, 22 bp, Homo sapiens
tgacacaactgtgtgattaaaa

SEQ ID NO: 2367643 - DNA, 19 bp, Homo sapiens
tgacacattaatgataaac

SEQ ID NO: 2367644 - DNA, 23 bp, Homo sapiens
tgacacccttctcccactctcct

SEQ ID NO: 2367645 - DNA, 19 bp, Homo sapiens
tgacactctagtgacttcc

SEQ ID NO: 2367646 - DNA, 10 bp, Homo sapiens
tgacactgaa

SEQ ID NO: 2367647 - DNA, 20 bp, Homo sapiens
tgacactgaaagttttgtaa

SEQ ID NO: 2367648 - DNA, 22 bp, Homo sapiens
tgacactgaacttaataactgt

SEQ ID NO: 2367649 - DNA, 13 bp, Homo sapiens
tgacagagccatg

SEQ ID NO: 2367650 - DNA, 13 bp, Homo sapiens
tgacagaggctgc

SEQ ID NO: 2367651 - DNA, 14 bp, Homo sapiens
tgacagcctgcagc

SEQ ID NO: 2367652 - DNA, 17 bp, Homo sapiens
tgacagctttctgggat

SEQ ID NO: 2367653 - DNA, 20 bp, Homo sapiens
tgacagctttctgggatgtc

SEQ ID NO: 2367654 - DNA, 21 bp, Homo sapiens
tgacagtgacacccagaggga

SEQ ID NO: 2367655 - DNA, 15 bp, Homo sapiens
tgacagtttccaaat

SEQ ID NO: 2367656 - DNA, 17 bp, Homo sapiens
tgacataataaagtatt

SEQ ID NO: 2367657 - DNA, 15 bp, Homo sapiens
tgacatggaaatgaa

SEQ ID NO: 2367658 - DNA, 14 bp, Homo sapiens
tgacattaacaaat

SEQ ID NO: 2367659 - DNA, 23 bp, Homo sapiens
tgaccactcttctttaagccata

SEQ ID NO: 2367660 - DNA, 13 bp, Homo sapiens
tgaccagaagcct

SEQ ID NO: 2367661 - DNA, 15 bp, Homo sapiens
tgaccagaagccttg

SEQ ID NO: 2367662 - DNA, 15 bp, Homo sapiens
tgaccagatctttct

SEQ ID NO: 2367663 - DNA, 16 bp, Homo sapiens
tgaccagatctttctc

SEQ ID NO: 2367664 - DNA, 17 bp, Homo sapiens
tgaccagatctttctct

SEQ ID NO: 2367665 - DNA, 19 bp, Homo sapiens
tgaccagatctttctcttc

SEQ ID NO: 2367666 - DNA, 20 bp, Homo sapiens
tgaccagatctttctcttcc

SEQ ID NO: 2367667 - DNA, 21 bp, Homo sapiens
tgaccatatagattttattat

SEQ ID NO: 2367668 - DNA, 12 bp, Homo sapiens
tgaccatttttt

SEQ ID NO: 2367669 - DNA, 22 bp, Homo sapiens
tgaccccagcattctcaggcac

SEQ ID NO: 2367670 - DNA, 16 bp, Homo sapiens
tgaccccattcctgat

SEQ ID NO: 2367671 - DNA, 17 bp, Homo sapiens
tgacctccgccatccac

SEQ ID NO: 2367672 - DNA, 22 bp, Homo sapiens
tgacctggcatctaattctgat

SEQ ID NO: 2367673 - DNA, 14 bp, Homo sapiens
tgacctttgacctc

SEQ ID NO: 2367674 - DNA, 15 bp, Homo sapiens
tgacgcttgtgacag

SEQ ID NO: 2367675 - DNA, 18 bp, Homo sapiens
tgacgcttgtgacagtgc

SEQ ID NO: 2367676 - DNA, 14 bp, Homo sapiens
tgacggaagaacat

SEQ ID NO: 2367677 - DNA, 20 bp, Homo sapiens
tgacggtcctttaggcagcc

SEQ ID NO: 2367678 - DNA, 21 bp, Homo sapiens
tgacggtcctttaggcagcct

SEQ ID NO: 2367679 - DNA, 22 bp, Homo sapiens
tgacggtcctttaggcagcctg

SEQ ID NO: 2367680 - DNA, 15 bp, Homo sapiens
tgactaactcaaata

SEQ ID NO: 2367681 - DNA, 20 bp, Homo sapiens
tgactaactcaaatacacat

SEQ ID NO: 2367682 - DNA, 23 bp, Homo sapiens
tgactaactcaaatacacatttg

SEQ ID NO: 2367683 - DNA, 18 bp, Homo sapiens
tgactattctgtatcttt

SEQ ID NO: 2367684 - DNA, 14 bp, Homo sapiens
tgactcctctggct

SEQ ID NO: 2367685 - DNA, 20 bp, Homo sapiens
tgactcctctggctttccca

SEQ ID NO: 2367686 - DNA, 16 bp, Homo sapiens
tgactgagcaggctgt

SEQ ID NO: 2367687 - DNA, 23 bp, Homo sapiens
tgactgcctatgccaagtccctg

SEQ ID NO: 2367688 - DNA, 20 bp, Homo sapiens
tgactgccttgcctcctcag

SEQ ID NO: 2367689 - DNA, 22 bp, Homo sapiens
tgactgctcagaacttgctgct

SEQ ID NO: 2367690 - DNA, 17 bp, Homo sapiens
tgactgtagctttggaa

SEQ ID NO: 2367691 - DNA, 14 bp, Homo sapiens
tgacttagaaactg

SEQ ID NO: 2367692 - DNA, 13 bp, Homo sapiens
tgacttatttgct

SEQ ID NO: 2367693 - DNA, 15 bp, Homo sapiens
tgacttctcaagtaa

SEQ ID NO: 2367694 - DNA, 14 bp, Homo sapiens
tgacttgctgtcca

SEQ ID NO: 2367695 - DNA, 20 bp, Homo sapiens
tgacttgctgtccaggcagc

SEQ ID NO: 2367696 - DNA, 22 bp, Homo sapiens
tgacttgctgtgtgaccctggg

SEQ ID NO: 2367697 - DNA, 18 bp, Homo sapiens
tgactttacgcccatctc

SEQ ID NO: 2367698 - DNA, 13 bp, Homo sapiens
tgactttcttttt

SEQ ID NO: 2367699 - DNA, 17 bp, Homo sapiens
tgacttttataaagcat

SEQ ID NO: 2367700 - DNA, 14 bp, Homo sapiens
tgactttttgcatt

SEQ ID NO: 2367701 - DNA, 19 bp, Homo sapiens
tgactttttttgtatgtgt

SEQ ID NO: 2367702 - DNA, 13 bp, Homo sapiens
tgagaaaaataaa

SEQ ID NO: 2367703 - DNA, 21 bp, Homo sapiens
tgagaaactttgatctctgct

SEQ ID NO: 2367704 - DNA, 22 bp, Homo sapiens
tgagaaatcacaatgagaaaaa

SEQ ID NO: 2367705 - DNA, 14 bp, Homo sapiens
tgagaaatcctgga

SEQ ID NO: 2367706 - DNA, 17 bp, Homo sapiens
tgagaagaagtggctgc

SEQ ID NO: 2367707 - DNA, 19 bp, Homo sapiens
tgagaagccttcagctcca

SEQ ID NO: 2367708 - DNA, 22 bp, Homo sapiens
tgagaaggttactgagtgagtt

SEQ ID NO: 2367709 - DNA, 14 bp, Homo sapiens
tgcaggcagagctg

SEQ ID NO: 2367710 - DNA, 15 bp, Homo sapiens
tgcaggcagagctgg

SEQ ID NO: 2367711 - DNA, 22 bp, Homo sapiens
tgcaggcagagctggagccccc

SEQ ID NO: 2367712 - DNA, 15 bp, Homo sapiens
tgcagggcttctcct

SEQ ID NO: 2367713 - DNA, 23 bp, Homo sapiens
tgcaggtgggggttgctgtataa

SEQ ID NO: 2367714 - DNA, 14 bp, Homo sapiens
tgcagtcactggag

SEQ ID NO: 2367715 - DNA, 14 bp, Homo sapiens
tgcagtcagcagat

SEQ ID NO: 2367716 - DNA, 17 bp, Homo sapiens
tgcagtgatatggcaga

SEQ ID NO: 2367717 - DNA, 23 bp, Homo sapiens
tgcagtgatatggcagaagacac

SEQ ID NO: 2367718 - DNA, 15 bp, Homo sapiens
tgcagtgtggagttc

SEQ ID NO: 2367719 - DNA, 15 bp, Homo sapiens
tgcagtttcttttca

SEQ ID NO: 2367720 - DNA, 14 bp, Homo sapiens
tgcagttttccagg

SEQ ID NO: 2367721 - DNA, 14 bp, Homo sapiens
tgcataaatatgca

SEQ ID NO: 2367722 - DNA, 15 bp, Homo sapiens
tgcataaatatgcag

SEQ ID NO: 2367723 - DNA, 19 bp, Homo sapiens
tgcataaatatgcagtgat

SEQ ID NO: 2367724 - DNA, 22 bp, Homo sapiens
tgcataataagctaaagaggct

SEQ ID NO: 2367725 - DNA, 17 bp, Homo sapiens
tgcataatagctacagt

SEQ ID NO: 2367726 - DNA, 22 bp, Homo sapiens
tgcatacggctatattggttta

SEQ ID NO: 2367727 - DNA, 20 bp, Homo sapiens
tgcatactttgtattttgat

SEQ ID NO: 2367728 - DNA, 18 bp, Homo sapiens
tgcatagttgtagacaaa

SEQ ID NO: 2367729 - DNA, 14 bp, Homo sapiens
tgcatagtttcttt

SEQ ID NO: 2367730 - DNA, 18 bp, Homo sapiens
tgcatagtttctttattt

SEQ ID NO: 2367731 - DNA, 16 bp, Homo sapiens
tgcatataatgaataa

SEQ ID NO: 2367732 - DNA, 14 bp, Homo sapiens
tgcatatgagcctg

SEQ ID NO: 2367733 - DNA, 14 bp, Homo sapiens
tgcatatgcaatgt

SEQ ID NO: 2367734 - DNA, 20 bp, Homo sapiens
tgcatattataaaggataaa

SEQ ID NO: 2367735 - DNA, 16 bp, Homo sapiens
tgcatcatccttgcag

SEQ ID NO: 2367736 - DNA, 18 bp, Homo sapiens
tgcatcccccctgctcag

SEQ ID NO: 2367737 - DNA, 21 bp, Homo sapiens
tgcatgtagaggcttgtttac

SEQ ID NO: 2367738 - DNA, 13 bp, Homo sapiens
tgcatgtatgtct

SEQ ID NO: 2367739 - DNA, 14 bp, Homo sapiens
tgcattattaaatt

SEQ ID NO: 2367740 - DNA, 11 bp, Homo sapiens
tgcattcattt

SEQ ID NO: 2367741 - DNA, 14 bp, Homo sapiens
tgcattcattttta

SEQ ID NO: 2367742 - DNA, 18 bp, Homo sapiens
tgcattccagctgtcact

SEQ ID NO: 2367743 - DNA, 18 bp, Homo sapiens
tgcattcgttgtgttttt

SEQ ID NO: 2367744 - DNA, 12 bp, Homo sapiens
tgcatttaataa

SEQ ID NO: 2367745 - DNA, 20 bp, Homo sapiens
tgcatttaataaagatgagt

SEQ ID NO: 2367746 - DNA, 20 bp, Homo sapiens
tgcatttcctcgcagcctct

SEQ ID NO: 2367747 - DNA, 13 bp, Homo sapiens
tgcatttgaggtc

SEQ ID NO: 2367748 - DNA, 22 bp, Homo sapiens
tgccaaagtacagaatttgaat

SEQ ID NO: 2367749 - DNA, 14 bp, Homo sapiens
tgccaaatcagttt

SEQ ID NO: 2367750 - DNA, 19 bp, Homo sapiens
tgccaaattctccggtttg

SEQ ID NO: 2367751 - DNA, 12 bp, Homo sapiens
tgccaatttcct

SEQ ID NO: 2367752 - DNA, 12 bp, Homo sapiens
tgccacacccag

SEQ ID NO: 2367753 - DNA, 14 bp, Homo sapiens
tgccacactctcca

SEQ ID NO: 2367754 - DNA, 18 bp, Homo sapiens
tgccacactctccatcac

SEQ ID NO: 2367755 - DNA, 15 bp, Homo sapiens
tgccacactgatggc

SEQ ID NO: 2367756 - DNA, 13 bp, Homo sapiens
tgccacagccaga

SEQ ID NO: 2367757 - DNA, 13 bp, Homo sapiens
tgccaccagcccc

SEQ ID NO: 2367758 - DNA, 23 bp, Homo sapiens
tgccaccagcccccgccccagag

SEQ ID NO: 2367759 - DNA, 22 bp, Homo sapiens
tgccaccggcctgtgggtctct

SEQ ID NO: 2367760 - DNA, 17 bp, Homo sapiens
tgccactgacttgctgt

SEQ ID NO: 2367761 - DNA, 19 bp, Homo sapiens
tgccagacatggacctcca

SEQ ID NO: 2367762 - DNA, 20 bp, Homo sapiens
tgccagaggaatcctggcag

SEQ ID NO: 2367763 - DNA, 23 bp, Homo sapiens
tgccagaggaatcctggcagccc

SEQ ID NO: 2367764 - DNA, 17 bp, Homo sapiens
tgccagattctgcctct

SEQ ID NO: 2367765 - DNA, 21 bp, Homo sapiens
tgccagattctgcctctctgg

SEQ ID NO: 2367766 - DNA, 12 bp, Homo sapiens
tgccagcaaata

SEQ ID NO: 2367767 - DNA, 15 bp, Homo sapiens
tgccagcaaataaat

SEQ ID NO: 2367768 - DNA, 10 bp, Homo sapiens
tgccagcagc

SEQ ID NO: 2367769 - DNA, 14 bp, Homo sapiens
tgccagcagcagca

SEQ ID NO: 2367770 - DNA, 19 bp, Homo sapiens
tgccagccccctaaaagca

SEQ ID NO: 2367771 - DNA, 19 bp, Homo sapiens
tgccagccttgagccctgg

SEQ ID NO: 2367772 - DNA, 15 bp, Homo sapiens
tgccagctggccttt

SEQ ID NO: 2367773 - DNA, 16 bp, Homo sapiens
tgccagctggcctttg

SEQ ID NO: 2367774 - DNA, 14 bp, Homo sapiens
tgccaggccagcct

SEQ ID NO: 2367775 - DNA, 16 bp, Homo sapiens
tgccaggccagcctcc

SEQ ID NO: 2367776 - DNA, 17 bp, Homo sapiens
tgccaggccagcctccg

SEQ ID NO: 2367777 - DNA, 16 bp, Homo sapiens
tgccaggctgtaagca

SEQ ID NO: 2367778 - DNA, 16 bp, Homo sapiens
tgccagggcagggtct

SEQ ID NO: 2367779 - DNA, 18 bp, Homo sapiens
tgccagggcagggtctgg

SEQ ID NO: 2367780 - DNA, 19 bp, Homo sapiens
tgccagggcagggtctggg

SEQ ID NO: 2367781 - DNA, 21 bp, Homo sapiens
tgccagggcagggtctgggct

SEQ ID NO: 2367782 - DNA, 17 bp, Homo sapiens
tgccaggggcttgagaa

SEQ ID NO: 2367783 - DNA, 18 bp, Homo sapiens
tgccagtatttttaaagg

SEQ ID NO: 2367784 - DNA, 21 bp, Homo sapiens
tgccagttgggctcgcactgc

SEQ ID NO: 2367785 - DNA, 16 bp, Homo sapiens
tgccatagtcacatgg

SEQ ID NO: 2367786 - DNA, 17 bp, Homo sapiens
tgccatagtcacatggc

SEQ ID NO: 2367787 - DNA, 17 bp, Homo sapiens
tgccatcaccgctgggt

SEQ ID NO: 2367788 - DNA, 17 bp, Homo sapiens
tgccatctagccagccc

SEQ ID NO: 2367789 - DNA, 18 bp, Homo sapiens
tgccatctagccagcccc

SEQ ID NO: 2367790 - DNA, 12 bp, Homo sapiens
tgccatcttcag

SEQ ID NO: 2367791 - DNA, 20 bp, Homo sapiens
tgccatgaagggaccctttg

SEQ ID NO: 2367792 - DNA, 15 bp, Homo sapiens
tgccatgatgtatat

SEQ ID NO: 2367793 - DNA, 17 bp, Homo sapiens
tgccatggatctgatct

SEQ ID NO: 2367794 - DNA, 18 bp, Homo sapiens
tgccatggatctgatctg

SEQ ID NO: 2367795 - DNA, 24 bp, Homo sapiens
tgccatggatctgatctgtaccat

SEQ ID NO: 2367796 - DNA, 17 bp, Homo sapiens
tgccatgggcctgctgc

SEQ ID NO: 2367797 - DNA, 18 bp, Homo sapiens
tgccatgggcttcactgt

SEQ ID NO: 2367798 - DNA, 20 bp, Homo sapiens
tgccatgggcttcactgtat

SEQ ID NO: 2367799 - DNA, 23 bp, Homo sapiens
tgccatgggcttcactgtataaa

SEQ ID NO: 2367800 - DNA, 15 bp, Homo sapiens
tgccatgtgaagagg

SEQ ID NO: 2367801 - DNA, 16 bp, Homo sapiens
tgccatgtgaagaggg

SEQ ID NO: 2367802 - DNA, 20 bp, Homo sapiens
tgcccaatgaataatggaaa

SEQ ID NO: 2367803 - DNA, 14 bp, Homo sapiens
tgcccaccccctgc

SEQ ID NO: 2367804 - DNA, 16 bp, Homo sapiens
tgcccagctctctgac

SEQ ID NO: 2367805 - DNA, 22 bp, Homo sapiens
tgcccaggcatgaaattcttcc

SEQ ID NO: 2367806 - DNA, 15 bp, Homo sapiens
tgcccagtacattta

SEQ ID NO: 2367807 - DNA, 15 bp, Homo sapiens
tgcccatcctgactg

SEQ ID NO: 2367808 - DNA, 13 bp, Homo sapiens
tgcccatcctgcc

SEQ ID NO: 2367809 - DNA, 13 bp, Homo sapiens
tgccccagcccag

SEQ ID NO: 2367810 - DNA, 17 bp, Homo sapiens
tgccccagggagtccag

SEQ ID NO: 2367811 - DNA, 18 bp, Homo sapiens
tgccccagggagtccagg

SEQ ID NO: 2367812 - DNA, 19 bp, Homo sapiens
tgccccagggagtccaggg

SEQ ID NO: 2367813 - DNA, 15 bp, Homo sapiens
tgccccattccttgc

SEQ ID NO: 2367814 - DNA, 22 bp, Homo sapiens
tgccccattccttgcgcctcag

SEQ ID NO: 2367815 - DNA, 13 bp, Homo sapiens
tgccccctgctta

SEQ ID NO: 2367816 - DNA, 19 bp, Homo sapiens
tgccccgggatattataga

SEQ ID NO: 2367817 - DNA, 18 bp, Homo sapiens
tgcccctaatctctgtag

SEQ ID NO: 2367818 - DNA, 17 bp, Homo sapiens
tgcccctaccctggact

SEQ ID NO: 2367819 - DNA, 14 bp, Homo sapiens
tgcccctcccccag

SEQ ID NO: 2367820 - DNA, 16 bp, Homo sapiens
tgcccctcccccagcc

SEQ ID NO: 2367821 - DNA, 17 bp, Homo sapiens
tgcccctggacctggga

SEQ ID NO: 2367822 - DNA, 23 bp, Homo sapiens
tgcccgaaactaagccaggcctg

SEQ ID NO: 2367823 - DNA, 19 bp, Homo sapiens
tgcccgcagagcccacgcc

SEQ ID NO: 2367824 - DNA, 20 bp, Homo sapiens
tggaattgtggctatcctga

SEQ ID NO: 2367825 - DNA, 22 bp, Homo sapiens
tggaattgtggctatcctgatt

SEQ ID NO: 2367826 - DNA, 22 bp, Homo sapiens
tggacaaaaaaaaaagaagcag

SEQ ID NO: 2367827 - DNA, 22 bp, Homo sapiens
tggacacattggaatgccttgg

SEQ ID NO: 2367828 - DNA, 17 bp, Homo sapiens
tggacacgagccacaag

SEQ ID NO: 2367829 - DNA, 20 bp, Homo sapiens
tggacacgagccacaagctg

SEQ ID NO: 2367830 - DNA, 22 bp, Homo sapiens
tggacacgagccacaagctgca

SEQ ID NO: 2367831 - DNA, 13 bp, Homo sapiens
tggacactccagg

SEQ ID NO: 2367832 - DNA, 14 bp, Homo sapiens
tggacactccaggg

SEQ ID NO: 2367833 - DNA, 18 bp, Homo sapiens
tggacactccagggacac

SEQ ID NO: 2367834 - DNA, 14 bp, Homo sapiens
tggacactgtacaa

SEQ ID NO: 2367835 - DNA, 12 bp, Homo sapiens
tggacagcagaa

SEQ ID NO: 2367836 - DNA, 14 bp, Homo sapiens
tggacagccagtga

SEQ ID NO: 2367837 - DNA, 12 bp, Homo sapiens
tggacaggcagc

SEQ ID NO: 2367838 - DNA, 17 bp, Homo sapiens
tggaccaacctgctctg

SEQ ID NO: 2367839 - DNA, 19 bp, Homo sapiens
tggaccactcctgtccctg

SEQ ID NO: 2367840 - DNA, 16 bp, Homo sapiens
tggaccatgccagatt

SEQ ID NO: 2367841 - DNA, 23 bp, Homo sapiens
tggaccatgccagattctgcctc

SEQ ID NO: 2367842 - DNA, 16 bp, Homo sapiens
tggaccttgagaccac

SEQ ID NO: 2367843 - DNA, 20 bp, Homo sapiens
tggacctttgggttctttct

SEQ ID NO: 2367844 - DNA, 13 bp, Homo sapiens
tggacggcaggct

SEQ ID NO: 2367845 - DNA, 17 bp, Homo sapiens
tggactctgcacatgtc

SEQ ID NO: 2367846 - DNA, 19 bp, Homo sapiens
tggagaaaattggaactct

SEQ ID NO: 2367847 - DNA, 11 bp, Homo sapiens
tggagaaatgg

SEQ ID NO: 2367848 - DNA, 16 bp, Homo sapiens
tggagaagaatggctt

SEQ ID NO: 2367849 - DNA, 17 bp, Homo sapiens
tggagaagaatggcttt

SEQ ID NO: 2367850 - DNA, 11 bp, Homo sapiens
tggagaagcac

SEQ ID NO: 2367851 - DNA, 15 bp, Homo sapiens
tggagaagctgcagg

SEQ ID NO: 2367852 - DNA, 14 bp, Homo sapiens
tggagacaaggtgc

SEQ ID NO: 2367853 - DNA, 18 bp, Homo sapiens
tggagacaaggtgctaac

SEQ ID NO: 2367854 - DNA, 18 bp, Homo sapiens
tggagaccctgccacagc

SEQ ID NO: 2367855 - DNA, 19 bp, Homo sapiens
tggagaccctgccacagcc

SEQ ID NO: 2367856 - DNA, 21 bp, Homo sapiens
tggagaccctgccacagccag

SEQ ID NO: 2367857 - DNA, 23 bp, Homo sapiens
tggagaccctgccacagccagag

SEQ ID NO: 2367858 - DNA, 13 bp, Homo sapiens
tggagagcagctg

SEQ ID NO: 2367859 - DNA, 21 bp, Homo sapiens
tggagcactggactccggggc

SEQ ID NO: 2367860 - DNA, 16 bp, Homo sapiens
tggagcccccagcaga

SEQ ID NO: 2367861 - DNA, 17 bp, Homo sapiens
tggagcccccagcagag

SEQ ID NO: 2367862 - DNA, 19 bp, Homo sapiens
tggaggaagagccacctgc

SEQ ID NO: 2367863 - DNA, 18 bp, Homo sapiens
tggaggaaggattgtaaa

SEQ ID NO: 2367864 - DNA, 23 bp, Homo sapiens
tggaggaccagattgctctgccc

SEQ ID NO: 2367865 - DNA, 15 bp, Homo sapiens
tggaggaggaaggca

SEQ ID NO: 2367866 - DNA, 16 bp, Homo sapiens
tggaggaggaaggcaa

SEQ ID NO: 2367867 - DNA, 17 bp, Homo sapiens
tggaggaggaaggcaag

SEQ ID NO: 2367868 - DNA, 23 bp, Homo sapiens
tggaggatttcctacccccgtcc

SEQ ID NO: 2367869 - DNA, 13 bp, Homo sapiens
tggaggcttcctg

SEQ ID NO: 2367870 - DNA, 16 bp, Homo sapiens
tggaggcttcctgcgt

SEQ ID NO: 2367871 - DNA, 22 bp, Homo sapiens
tggaggcttcctgcgtcctcct

SEQ ID NO: 2367872 - DNA, 13 bp, Homo sapiens
tggagggagggaa

SEQ ID NO: 2367873 - DNA, 17 bp, Homo sapiens
tggaggggtgtggcagt

SEQ ID NO: 2367874 - DNA, 16 bp, Homo sapiens
tggaggtgctgctcta

SEQ ID NO: 2367875 - DNA, 13 bp, Homo sapiens
tggaggtgggcaa

SEQ ID NO: 2367876 - DNA, 18 bp, Homo sapiens
tggaggttgaagccaagt

SEQ ID NO: 2367877 - DNA, 22 bp, Homo sapiens
tggaggttgaagccaagtgggg

SEQ ID NO: 2367878 - DNA, 16 bp, Homo sapiens
tggagttcttgtgcca

SEQ ID NO: 2367879 - DNA, 13 bp, Homo sapiens
tggagtttctctg

SEQ ID NO: 2367880 - DNA, 16 bp, Homo sapiens
tggataactagccaga

SEQ ID NO: 2367881 - DNA, 22 bp, Homo sapiens
tggatagacttgggatggggag

SEQ ID NO: 2367882 - DNA, 17 bp, Homo sapiens
tggatatagttttactt

SEQ ID NO: 2367883 - DNA, 17 bp, Homo sapiens
tggatggaatatcagaa

SEQ ID NO: 2367884 - DNA, 16 bp, Homo sapiens
tggatggcacctcagg

SEQ ID NO: 2367885 - DNA, 12 bp, Homo sapiens
tggatggtttgt

SEQ ID NO: 2367886 - DNA, 16 bp, Homo sapiens
tggatgttatgaacag

SEQ ID NO: 2367887 - DNA, 17 bp, Homo sapiens
tggatgttatgaacagc

SEQ ID NO: 2367888 - DNA, 18 bp, Homo sapiens
tggatgttatgaacagct

SEQ ID NO: 2367889 - DNA, 19 bp, Homo sapiens
tggatgttatgaacagctg

SEQ ID NO: 2367890 - DNA, 13 bp, Homo sapiens
tggattatttaat

SEQ ID NO: 2367891 - DNA, 23 bp, Homo sapiens
tggattatttaataacattacct

SEQ ID NO: 2367892 - DNA, 15 bp, Homo sapiens
tggattctaaataca

SEQ ID NO: 2367893 - DNA, 16 bp, Homo sapiens
tggattgcctctgaaa

SEQ ID NO: 2367894 - DNA, 15 bp, Homo sapiens
tggattggattattt

SEQ ID NO: 2367895 - DNA, 23 bp, Homo sapiens
tggattggattatttaataacat

SEQ ID NO: 2367896 - DNA, 16 bp, Homo sapiens
tggcaaaccctcccag

SEQ ID NO: 2367897 - DNA, 17 bp, Homo sapiens
tggcaaaccctcccaga

SEQ ID NO: 2367898 - DNA, 19 bp, Homo sapiens
tggcaatattctgtaacta

SEQ ID NO: 2367899 - DNA, 22 bp, Homo sapiens
tggcacccaccgtggaggagga

SEQ ID NO: 2367900 - DNA, 15 bp, Homo sapiens
tggcactagaatgca

SEQ ID NO: 2367901 - DNA, 14 bp, Homo sapiens
tggcactcgctgta

SEQ ID NO: 2367902 - DNA, 13 bp, Homo sapiens
tggcagaagacac

SEQ ID NO: 2367903 - DNA, 18 bp, Homo sapiens
tggcagaagacaccagag

SEQ ID NO: 2367904 - DNA, 20 bp, Homo sapiens
tggcagaagacaccagagca

SEQ ID NO: 2367905 - DNA, 22 bp, Homo sapiens
tggcagatgtcttccctgggct

SEQ ID NO: 2367906 - DNA, 12 bp, Homo sapiens
tggcagcccaga

SEQ ID NO: 2367907 - DNA, 15 bp, Homo sapiens
tggcaggtgggggtg

SEQ ID NO: 2367908 - DNA, 16 bp, Homo sapiens
tggcagtctgaatttt

SEQ ID NO: 2367909 - DNA, 20 bp, Homo sapiens
tggcatatatgtgatctggg

SEQ ID NO: 2367910 - DNA, 15 bp, Homo sapiens
tggcatatggtccta

SEQ ID NO: 2367911 - DNA, 18 bp, Homo sapiens
tggcatgcttaaatttta

SEQ ID NO: 2367912 - DNA, 15 bp, Homo sapiens
tggcatttagcacag

SEQ ID NO: 2367913 - DNA, 19 bp, Homo sapiens
tggcatttagcacagtatt

SEQ ID NO: 2367914 - DNA, 18 bp, Homo sapiens
tggcatttctctttaaac

SEQ ID NO: 2367915 - DNA, 20 bp, Homo sapiens
tggcatttggtctcaggcag

SEQ ID NO: 2367916 - DNA, 22 bp, Homo sapiens
tggcatttggtctcaggcagca

SEQ ID NO: 2367917 - DNA, 23 bp, Homo sapiens
tggccagcccctggggcccagcc

SEQ ID NO: 2367918 - DNA, 11 bp, Homo sapiens
tggccaggagc

SEQ ID NO: 2367919 - DNA, 16 bp, Homo sapiens
tggccatactgtgtcc

SEQ ID NO: 2367920 - DNA, 15 bp, Homo sapiens
tggccatgcaggagg

SEQ ID NO: 2367921 - DNA, 18 bp, Homo sapiens
tggccatgcaggaggtgg

SEQ ID NO: 2367922 - DNA, 14 bp, Homo sapiens
tggccatggcctgc

SEQ ID NO: 2367923 - DNA, 16 bp, Homo sapiens
tggcccaaggctggca

SEQ ID NO: 2367924 - DNA, 17 bp, Homo sapiens
tggcccaaggctggcag

SEQ ID NO: 2367925 - DNA, 18 bp, Homo sapiens
tggcccaaggctggcagg

SEQ ID NO: 2367926 - DNA, 16 bp, Homo sapiens
tggccccactttgaag

SEQ ID NO: 2367927 - DNA, 18 bp, Homo sapiens
tggccccagccctgctgg

SEQ ID NO: 2367928 - DNA, 13 bp, Homo sapiens
tggccccagcctg

SEQ ID NO: 2367929 - DNA, 15 bp, Homo sapiens
tggccccagcctggg

SEQ ID NO: 2367930 - DNA, 23 bp, Homo sapiens
tggcccctactttgtggcaatct

SEQ ID NO: 2367931 - DNA, 19 bp, Homo sapiens
tggcccttgcttacctctc

SEQ ID NO: 2367932 - DNA, 17 bp, Homo sapiens
tggccgcggagcctgca

SEQ ID NO: 2367933 - DNA, 22 bp, Homo sapiens
tggccgcttctccccagagctg

SEQ ID NO: 2367934 - DNA, 17 bp, Homo sapiens
tggcctatgcacatatg

SEQ ID NO: 2367935 - DNA, 13 bp, Homo sapiens
tggcctctctagc

SEQ ID NO: 2367936 - DNA, 19 bp, Homo sapiens
tggcctgcaaactgggaac

SEQ ID NO: 2367937 - DNA, 20 bp, Homo sapiens
tggcctgcaaactgggaacc

SEQ ID NO: 2367938 - DNA, 12 bp, Homo sapiens
tggcctgctgtg

SEQ ID NO: 2367939 - DNA, 11 bp, Homo sapiens
aaaaaaatgcc

SEQ ID NO: 2367940 - DNA, 11 bp, Homo sapiens
aaaaaagaaaa

SEQ ID NO: 2367941 - DNA, 16 bp, Homo sapiens
aaaaaagtcaccaaat

SEQ ID NO: 2367942 - DNA, 20 bp, Homo sapiens
aaaaacattttttatacatt

SEQ ID NO: 2367943 - DNA, 9 bp, Homo sapiens
aaaaagaaa

SEQ ID NO: 2367944 - DNA, 18 bp, Homo sapiens
aaaaagaaaaatctcatt

SEQ ID NO: 2367945 - DNA, 20 bp, Homo sapiens
aaaaagaaaaatctcattat

SEQ ID NO: 2367946 - DNA, 19 bp, Homo sapiens
aaaaagaactaaatatgca

SEQ ID NO: 2367947 - DNA, 12 bp, Homo sapiens
aaaaagagacat

SEQ ID NO: 2367948 - DNA, 13 bp, Homo sapiens
aaaaagcagctac

SEQ ID NO: 2367949 - DNA, 16 bp, Homo sapiens
aaaaagggagtttttg

SEQ ID NO: 2367950 - DNA, 14 bp, Homo sapiens
aaaaaggtaaatgg

SEQ ID NO: 2367951 - DNA, 23 bp, Homo sapiens
aaaaagtaatgacttagaaactg

SEQ ID NO: 2367952 - DNA, 12 bp, Homo sapiens
aaaaagtgtctc

SEQ ID NO: 2367953 - DNA, 14 bp, Homo sapiens
aaaaagtgtctcaa

SEQ ID NO: 2367954 - DNA, 16 bp, Homo sapiens
aaaaagtgtctcaaag

SEQ ID NO: 2367955 - DNA, 15 bp, Homo sapiens
aaaaataaaatgttt

SEQ ID NO: 2367956 - DNA, 14 bp, Homo sapiens
aaaaatataatgtt

SEQ ID NO: 2367957 - DNA, 14 bp, Homo sapiens
aaaaatatgtaatt

SEQ ID NO: 2367958 - DNA, 23 bp, Homo sapiens
aaaaatattgtttctgcattcat

SEQ ID NO: 2367959 - DNA, 21 bp, Homo sapiens
aaaaatcatgccagtattttt

SEQ ID NO: 2367960 - DNA, 17 bp, Homo sapiens
aaaaatgaaatttaagc

SEQ ID NO: 2367961 - DNA, 19 bp, Homo sapiens
aaaaatgaaatttaagcac

SEQ ID NO: 2367962 - DNA, 15 bp, Homo sapiens
aaaaatgagatttct

SEQ ID NO: 2367963 - DNA, 16 bp, Homo sapiens
aaaaatgagatttctt

SEQ ID NO: 2367964 - DNA, 20 bp, Homo sapiens
aaaaatgcctttgagacagt

SEQ ID NO: 2367965 - DNA, 24 bp, Homo sapiens
aaaaatgcctttgagacagtttct

SEQ ID NO: 2367966 - DNA, 12 bp, Homo sapiens
aaacatctctgg

SEQ ID NO: 2367967 - DNA, 21 bp, Homo sapiens
aaacatgttaatgacaatatt

SEQ ID NO: 2367968 - DNA, 16 bp, Homo sapiens
aaacatttgattaata

SEQ ID NO: 2367969 - DNA, 23 bp, Homo sapiens
aaacatttgattaataaaatatc

SEQ ID NO: 2367970 - DNA, 16 bp, Homo sapiens
aaacattttttataca

SEQ ID NO: 2367971 - DNA, 13 bp, Homo sapiens
aaaccaaaaacat

SEQ ID NO: 2367972 - DNA, 16 bp, Homo sapiens
aaaccaaagaaacata

SEQ ID NO: 2367973 - DNA, 17 bp, Homo sapiens
aaaccaccaaaaacaaa

SEQ ID NO: 2367974 - DNA, 15 bp, Homo sapiens
aaaccactagaaagt

SEQ ID NO: 2367975 - DNA, 13 bp, Homo sapiens
aaaccagccaggc

SEQ ID NO: 2367976 - DNA, 15 bp, Homo sapiens
aaaccagccaggcag

SEQ ID NO: 2367977 - DNA, 16 bp, Homo sapiens
aaaccaggaccctgtc

SEQ ID NO: 2367978 - DNA, 15 bp, Homo sapiens
aaaccattgctctta

SEQ ID NO: 2367979 - DNA, 16 bp, Homo sapiens
aaacccaaaatatata

SEQ ID NO: 2367980 - DNA, 13 bp, Homo sapiens
aaacccagaggtg

SEQ ID NO: 2367981 - DNA, 11 bp, Homo sapiens
aaacctaggtc

SEQ ID NO: 2367982 - DNA, 20 bp, Homo sapiens
aaacctcagggctgtcccag

SEQ ID NO: 2367983 - DNA, 18 bp, Homo sapiens
aaacctgacccctgctca

SEQ ID NO: 2367984 - DNA, 22 bp, Homo sapiens
aaacctgtattactgaataata

SEQ ID NO: 2367985 - DNA, 18 bp, Homo sapiens
aaaccttttttaagattt

SEQ ID NO: 2367986 - DNA, 22 bp, Homo sapiens
aaaccttttttaagatttttct

SEQ ID NO: 2367987 - DNA, 22 bp, Homo sapiens
aaacgctaaagagcccttgcct

SEQ ID NO: 2367988 - DNA, 19 bp, Homo sapiens
aaacgggaacatgccccct

SEQ ID NO: 2367989 - DNA, 17 bp, Homo sapiens
aaacgggatacaggaga

SEQ ID NO: 2367990 - DNA, 22 bp, Homo sapiens
aaacggttcctggtgactcctg

SEQ ID NO: 2367991 - DNA, 20 bp, Homo sapiens
aaactaacagataagcaaga

SEQ ID NO: 2367992 - DNA, 21 bp, Homo sapiens
aaactaacagctacaaacttt

SEQ ID NO: 2367993 - DNA, 12 bp, Homo sapiens
aaactacaaata

SEQ ID NO: 2367994 - DNA, 21 bp, Homo sapiens
aaactactgaatgaagcagta

SEQ ID NO: 2367995 - DNA, 22 bp, Homo sapiens
aaactcactgtgatcaatattt

SEQ ID NO: 2367996 - DNA, 14 bp, Homo sapiens
aaactcagatctga

SEQ ID NO: 2367997 - DNA, 17 bp, Homo sapiens
aaactccacatctgcct

SEQ ID NO: 2367998 - DNA, 18 bp, Homo sapiens
aaactccacatctgcctt

SEQ ID NO: 2367999 - DNA, 13 bp, Homo sapiens
aaactcttatctc

SEQ ID NO: 2368000 - DNA, 13 bp, Homo sapiens
aaactcttttccc

SEQ ID NO: 2368001 - DNA, 14 bp, Homo sapiens
aaactgaatgaatc

SEQ ID NO: 2368002 - DNA, 22 bp, Homo sapiens
aaactgcttcccttactttgct

SEQ ID NO: 2368003 - DNA, 18 bp, Homo sapiens
aaactggccatggcctgc

SEQ ID NO: 2368004 - DNA, 20 bp, Homo sapiens
aaactgtgtacataactgaa

SEQ ID NO: 2368005 - DNA, 19 bp, Homo sapiens
aaactgtttgacttctcaa

SEQ ID NO: 2368006 - DNA, 17 bp, Homo sapiens
aaacttccaaagaaagt

SEQ ID NO: 2368007 - DNA, 18 bp, Homo sapiens
aaacttccaaagaaagtt

SEQ ID NO: 2368008 - DNA, 19 bp, Homo sapiens
aaacttgtttgctgtgaac

SEQ ID NO: 2368009 - DNA, 19 bp, Homo sapiens
aaactttgatctctgctta

SEQ ID NO: 2368010 - DNA, 19 bp, Homo sapiens
aaagaaaacaaaaaacgaa

SEQ ID NO: 2368011 - DNA, 14 bp, Homo sapiens
aaagaactgtactg

SEQ ID NO: 2368012 - DNA, 18 bp, Homo sapiens
aaagaatgccatttctca

SEQ ID NO: 2368013 - DNA, 23 bp, Homo sapiens
aaagacattttaagtttgtagta

SEQ ID NO: 2368014 - DNA, 12 bp, Homo sapiens
aaagagaatgag

SEQ ID NO: 2368015 - DNA, 12 bp, Homo sapiens
aaagagacattt

SEQ ID NO: 2368016 - DNA, 15 bp, Homo sapiens
aaagagacatttcaa

SEQ ID NO: 2368017 - DNA, 16 bp, Homo sapiens
aaagagacatttcaaa

SEQ ID NO: 2368018 - DNA, 13 bp, Homo sapiens
aaagagagaatgt

SEQ ID NO: 2368019 - DNA, 18 bp, Homo sapiens
aaagagagaatgtagata

SEQ ID NO: 2368020 - DNA, 13 bp, Homo sapiens
aaagagattcgaa

SEQ ID NO: 2368021 - DNA, 14 bp, Homo sapiens
aaagagattcgaat

SEQ ID NO: 2368022 - DNA, 18 bp, Homo sapiens
aaagaggctgcccctctc

SEQ ID NO: 2368023 - DNA, 19 bp, Homo sapiens
aaagagggcttcctctaga

SEQ ID NO: 2368024 - DNA, 14 bp, Homo sapiens
aaagagtcttccaa

SEQ ID NO: 2368025 - DNA, 13 bp, Homo sapiens
aaagatattgtat

SEQ ID NO: 2368026 - DNA, 18 bp, Homo sapiens
aaagatattgtatctcct

SEQ ID NO: 2368027 - DNA, 16 bp, Homo sapiens
aaagatctttttttaa

SEQ ID NO: 2368028 - DNA, 20 bp, Homo sapiens
aaagatctttttttaagtgt

SEQ ID NO: 2368029 - DNA, 11 bp, Homo sapiens
aaagatgagtt

SEQ ID NO: 2368030 - DNA, 20 bp, Homo sapiens
aaagatggtatcatatattt

SEQ ID NO: 2368031 - DNA, 12 bp, Homo sapiens
aaagatttcata

SEQ ID NO: 2368032 - DNA, 18 bp, Homo sapiens
aaagatttcatatctaac

SEQ ID NO: 2368033 - DNA, 11 bp, Homo sapiens
aaagcaagtgt

SEQ ID NO: 2368034 - DNA, 19 bp, Homo sapiens
aaagcaagtgttcactgct

SEQ ID NO: 2368035 - DNA, 22 bp, Homo sapiens
aaagcaggcttgcccagtacat

SEQ ID NO: 2368036 - DNA, 19 bp, Homo sapiens
aaagcatcaccactcattt

SEQ ID NO: 2368037 - DNA, 18 bp, Homo sapiens
aaagcatggacatttaga

SEQ ID NO: 2368038 - DNA, 17 bp, Homo sapiens
aaagccattctgattat

SEQ ID NO: 2368039 - DNA, 18 bp, Homo sapiens
aaagcctagacaaccttt

SEQ ID NO: 2368040 - DNA, 19 bp, Homo sapiens
aaagcctctctctccctcc

SEQ ID NO: 2368041 - DNA, 15 bp, Homo sapiens
aaagctattagccag

SEQ ID NO: 2368042 - DNA, 17 bp, Homo sapiens
aaagctattagccagga

SEQ ID NO: 2368043 - DNA, 23 bp, Homo sapiens
aaagctattagccaggatcatgg

SEQ ID NO: 2368044 - DNA, 19 bp, Homo sapiens
aaagctcaaatgaaatgta

SEQ ID NO: 2368045 - DNA, 21 bp, Homo sapiens
aaagctcttcctaatcgctaa

SEQ ID NO: 2368046 - DNA, 22 bp, Homo sapiens
aaagctgaaaattaaattttag

SEQ ID NO: 2368047 - DNA, 22 bp, Homo sapiens
aaagctgcccactgtttctctt

SEQ ID NO: 2368048 - DNA, 14 bp, Homo sapiens
aaagctgtgtttat

SEQ ID NO: 2368049 - DNA, 18 bp, Homo sapiens
aaagctttcttttctaac

SEQ ID NO: 2368050 - DNA, 20 bp, Homo sapiens
aaagctttggctgagacctg

SEQ ID NO: 2368051 - DNA, 19 bp, Homo sapiens
aaagctttttattcctcct

SEQ ID NO: 2368052 - DNA, 12 bp, Homo sapiens
aaaggaaaagac

SEQ ID NO: 2368053 - DNA, 16 bp, Homo sapiens
aaaggaaaatgtctgt

SEQ ID NO: 2368054 - DNA, 15 bp, Homo sapiens
aaaggaaagctgtgt

SEQ ID NO: 2368055 - DNA, 15 bp, Homo sapiens
aaaggaagcactctg

SEQ ID NO: 2368056 - DNA, 15 bp, Homo sapiens
aaaggacgcctgcag

SEQ ID NO: 2368057 - DNA, 15 bp, Homo sapiens
aaaggagctttctca

SEQ ID NO: 2368058 - DNA, 22 bp, Homo sapiens
aaaggagctttctcaatgtctt

SEQ ID NO: 2368059 - DNA, 22 bp, Homo sapiens
aaaggaggccctgttccctgga

SEQ ID NO: 2368060 - DNA, 18 bp, Homo sapiens
aaaggatgtataaatttt

SEQ ID NO: 2368061 - DNA, 19 bp, Homo sapiens
aaaggcaggaagggaagcg

SEQ ID NO: 2368062 - DNA, 18 bp, Homo sapiens
aaaggcagtattttgtgt

SEQ ID NO: 2368063 - DNA, 21 bp, Homo sapiens
aaaggcatccttgtcttttga

SEQ ID NO: 2368064 - DNA, 15 bp, Homo sapiens
aaaggcattagagtc

SEQ ID NO: 2368065 - DNA, 21 bp, Homo sapiens
aaaggcctcttgtaaagactg

SEQ ID NO: 2368066 - DNA, 23 bp, Homo sapiens
aaagggctggctccccctcccca

SEQ ID NO: 2368067 - DNA, 15 bp, Homo sapiens
aaaggggtgctttta

SEQ ID NO: 2368068 - DNA, 13 bp, Homo sapiens
aaagggttttctt

SEQ ID NO: 2368069 - DNA, 20 bp, Homo sapiens
aaaggtgtgcttcctgctgt

SEQ ID NO: 2368070 - DNA, 17 bp, Homo sapiens
aaaggttgaataatata

SEQ ID NO: 2368071 - DNA, 19 bp, Homo sapiens
aaaggttgaataatatatg

SEQ ID NO: 2368072 - DNA, 14 bp, Homo sapiens
aaaggtttaaagtt

SEQ ID NO: 2368073 - DNA, 20 bp, Homo sapiens
aaagtaaaaagggaattatg

SEQ ID NO: 2368074 - DNA, 18 bp, Homo sapiens
aaagtaaatacatgcata

SEQ ID NO: 2368075 - DNA, 14 bp, Homo sapiens
aaagtaacaatcta

SEQ ID NO: 2368076 - DNA, 15 bp, Homo sapiens
aaagtaacaatctat

SEQ ID NO: 2368077 - DNA, 13 bp, Homo sapiens
aaagtaattttta

SEQ ID NO: 2368078 - DNA, 14 bp, Homo sapiens
aaagtacagaattt

SEQ ID NO: 2368079 - DNA, 21 bp, Homo sapiens
aaagtacagaatttgaattat

SEQ ID NO: 2368080 - DNA, 20 bp, Homo sapiens
aaagtagagctagctgccac

SEQ ID NO: 2368081 - DNA, 12 bp, Homo sapiens
aaccgcacagct

SEQ ID NO: 2368082 - DNA, 14 bp, Homo sapiens
aaccgcacagctca

SEQ ID NO: 2368083 - DNA, 15 bp, Homo sapiens
aaccgcacagctcag

SEQ ID NO: 2368084 - DNA, 16 bp, Homo sapiens
aaccgtggtatgtctg

SEQ ID NO: 2368085 - DNA, 22 bp, Homo sapiens
aacctagttaaagaaaggaaaa

SEQ ID NO: 2368086 - DNA, 16 bp, Homo sapiens
aacctcaactgcctac

SEQ ID NO: 2368087 - DNA, 17 bp, Homo sapiens
aacctcagggctcccag

SEQ ID NO: 2368088 - DNA, 19 bp, Homo sapiens
aacctcagggctgtcccag

SEQ ID NO: 2368089 - DNA, 19 bp, Homo sapiens
aacctctcgccatgatcag

SEQ ID NO: 2368090 - DNA, 22 bp, Homo sapiens
aacctctcgccatgatcagaca

SEQ ID NO: 2368091 - DNA, 17 bp, Homo sapiens
aacctctttttcctcct

SEQ ID NO: 2368092 - DNA, 19 bp, Homo sapiens
aacctctttttcctcctgg

SEQ ID NO: 2368093 - DNA, 20 bp, Homo sapiens
aacctgagtcgtacagaaag

SEQ ID NO: 2368094 - DNA, 20 bp, Homo sapiens
aacctgcacacaggacagcg

SEQ ID NO: 2368095 - DNA, 19 bp, Homo sapiens
aacctgcctgtgcatgacc

SEQ ID NO: 2368096 - DNA, 24 bp, Homo sapiens
aacctgttacctactttgactttt

SEQ ID NO: 2368097 - DNA, 13 bp, Homo sapiens
aaccttgtcccag

SEQ ID NO: 2368098 - DNA, 21 bp, Homo sapiens
aacctttgagtagatccattt

SEQ ID NO: 2368099 - DNA, 17 bp, Homo sapiens
aaccttttttaagattt

SEQ ID NO: 2368100 - DNA, 14 bp, Homo sapiens
aacgattatagtaa

SEQ ID NO: 2368101 - DNA, 17 bp, Homo sapiens
aacgctaaagagccctt

SEQ ID NO: 2368102 - DNA, 21 bp, Homo sapiens
aacgctaaagagcccttgcct

SEQ ID NO: 2368103 - DNA, 14 bp, Homo sapiens
aacgctcctttgtg

SEQ ID NO: 2368104 - DNA, 16 bp, Homo sapiens
aacgctcctttgtgtg

SEQ ID NO: 2368105 - DNA, 14 bp, Homo sapiens
aacggttcctggtg

SEQ ID NO: 2368106 - DNA, 19 bp, Homo sapiens
aacgtcctctttagttttt

SEQ ID NO: 2368107 - DNA, 11 bp, Homo sapiens
aacgttttctt

SEQ ID NO: 2368108 - DNA, 17 bp, Homo sapiens
aacgttttcttctttcc

SEQ ID NO: 2368109 - DNA, 19 bp, Homo sapiens
aacgttttcttctttccct

SEQ ID NO: 2368110 - DNA, 23 bp, Homo sapiens
aacgtttttcctttaaaaaaatt

SEQ ID NO: 2368111 - DNA, 22 bp, Homo sapiens
aactaaatatgcaatatatgtt

SEQ ID NO: 2368112 - DNA, 13 bp, Homo sapiens
aactaaatttcac

SEQ ID NO: 2368113 - DNA, 23 bp, Homo sapiens
aactaacagctacaaacttttaa

SEQ ID NO: 2368114 - DNA, 13 bp, Homo sapiens
aactaccaggtgg

SEQ ID NO: 2368115 - DNA, 12 bp, Homo sapiens
aactactgaata

SEQ ID NO: 2368116 - DNA, 23 bp, Homo sapiens
aactactgaatgaagcagtattt

SEQ ID NO: 2368117 - DNA, 18 bp, Homo sapiens
aactagccagacaaaatt

SEQ ID NO: 2368118 - DNA, 22 bp, Homo sapiens
aactattagagtatttcccttc

SEQ ID NO: 2368119 - DNA, 22 bp, Homo sapiens
aactattgtgctcagagacact

SEQ ID NO: 2368120 - DNA, 15 bp, Homo sapiens
aactatttttttcaa

SEQ ID NO: 2368121 - DNA, 19 bp, Homo sapiens
aactcagatctgatcaaga

SEQ ID NO: 2368122 - DNA, 14 bp, Homo sapiens
aactcaggcaaaga

SEQ ID NO: 2368123 - DNA, 17 bp, Homo sapiens
aactccacatctgcctt

SEQ ID NO: 2368124 - DNA, 13 bp, Homo sapiens
aactccagcaact

SEQ ID NO: 2368125 - DNA, 20 bp, Homo sapiens
aactccttcctggcctgaga

SEQ ID NO: 2368126 - DNA, 15 bp, Homo sapiens
aactctaatagtgct

SEQ ID NO: 2368127 - DNA, 12 bp, Homo sapiens
aactctccactc

SEQ ID NO: 2368128 - DNA, 15 bp, Homo sapiens
aactctccactccat

SEQ ID NO: 2368129 - DNA, 15 bp, Homo sapiens
aactctgcatgtaga

SEQ ID NO: 2368130 - DNA, 21 bp, Homo sapiens
aactctgcctttatgatgcta

SEQ ID NO: 2368131 - DNA, 22 bp, Homo sapiens
aactctgcctttatgatgctaa

SEQ ID NO: 2368132 - DNA, 16 bp, Homo sapiens
aactctgtataataga

SEQ ID NO: 2368133 - DNA, 14 bp, Homo sapiens
aactcttatctcag

SEQ ID NO: 2368134 - DNA, 12 bp, Homo sapiens
aactgaaaatgt

SEQ ID NO: 2368135 - DNA, 20 bp, Homo sapiens
aactgaagacctccacatta

SEQ ID NO: 2368136 - DNA, 17 bp, Homo sapiens
aactgaaggggtgcacc

SEQ ID NO: 2368137 - DNA, 19 bp, Homo sapiens
aactgaaggggtgcaccca

SEQ ID NO: 2368138 - DNA, 23 bp, Homo sapiens
aactgaaggggtgcacccacctg

SEQ ID NO: 2368139 - DNA, 12 bp, Homo sapiens
aactgaatgaat

SEQ ID NO: 2368140 - DNA, 13 bp, Homo sapiens
aactgaattgtgt

SEQ ID NO: 2368141 - DNA, 22 bp, Homo sapiens
aactgacctgaccccattcctg

SEQ ID NO: 2368142 - DNA, 13 bp, Homo sapiens
aactgagagaaag

SEQ ID NO: 2368143 - DNA, 13 bp, Homo sapiens
aactgcaaagctt

SEQ ID NO: 2368144 - DNA, 14 bp, Homo sapiens
aactgcaaagcttt

SEQ ID NO: 2368145 - DNA, 22 bp, Homo sapiens
aactgcaaagctttggctgaga

SEQ ID NO: 2368146 - DNA, 17 bp, Homo sapiens
aactgctcccacctcct

SEQ ID NO: 2368147 - DNA, 22 bp, Homo sapiens
aactgcttcccttactttgctg

SEQ ID NO: 2368148 - DNA, 13 bp, Homo sapiens
aactggaataata

SEQ ID NO: 2368149 - DNA, 21 bp, Homo sapiens
aactgggaacccctttcccac

SEQ ID NO: 2368150 - DNA, 22 bp, Homo sapiens
aactgggaacccctttcccacc

SEQ ID NO: 2368151 - DNA, 14 bp, Homo sapiens
aactggtattgttt

SEQ ID NO: 2368152 - DNA, 15 bp, Homo sapiens
aactgtactgtctgt

SEQ ID NO: 2368153 - DNA, 16 bp, Homo sapiens
aactgtatttacttgt

SEQ ID NO: 2368154 - DNA, 19 bp, Homo sapiens
aactgtccgtaagcagtat

SEQ ID NO: 2368155 - DNA, 21 bp, Homo sapiens
aactgtccgtaagcagtatat

SEQ ID NO: 2368156 - DNA, 15 bp, Homo sapiens
aactgtgccacaatg

SEQ ID NO: 2368157 - DNA, 19 bp, Homo sapiens
aactgtttgacttctcaag

SEQ ID NO: 2368158 - DNA, 13 bp, Homo sapiens
aacttataatgat

SEQ ID NO: 2368159 - DNA, 16 bp, Homo sapiens
aacttataatgattaa

SEQ ID NO: 2368160 - DNA, 21 bp, Homo sapiens
aacttcatttgacacaaagct

SEQ ID NO: 2368161 - DNA, 13 bp, Homo sapiens
aacttccaaagaa

SEQ ID NO: 2368162 - DNA, 14 bp, Homo sapiens
aacttccaaagaaa

SEQ ID NO: 2368163 - DNA, 17 bp, Homo sapiens
aacttccaaagaaagtt

SEQ ID NO: 2368164 - DNA, 16 bp, Homo sapiens
aacttccaaataaata

SEQ ID NO: 2368165 - DNA, 16 bp, Homo sapiens
aacttgctgctgtctt

SEQ ID NO: 2368166 - DNA, 17 bp, Homo sapiens
aacttgtttgctgtgaa

SEQ ID NO: 2368167 - DNA, 17 bp, Homo sapiens
aactttcacttcttcct

SEQ ID NO: 2368168 - DNA, 17 bp, Homo sapiens
aactttgatctctgctt

SEQ ID NO: 2368169 - DNA, 12 bp, Homo sapiens
aactttgggaaa

SEQ ID NO: 2368170 - DNA, 14 bp, Homo sapiens
aactttgtaaaaat

SEQ ID NO: 2368171 - DNA, 17 bp, Homo sapiens
aacttttaaaatttgtc

SEQ ID NO: 2368172 - DNA, 13 bp, Homo sapiens
aacttttctcttt

SEQ ID NO: 2368173 - DNA, 15 bp, Homo sapiens
aagaaaaaaaaaaga

SEQ ID NO: 2368174 - DNA, 14 bp, Homo sapiens
aagaaaaatctcat

SEQ ID NO: 2368175 - DNA, 16 bp, Homo sapiens
aagaaagttctacagt

SEQ ID NO: 2368176 - DNA, 13 bp, Homo sapiens
aagaaataaatga

SEQ ID NO: 2368177 - DNA, 14 bp, Homo sapiens
aagaaataaatgaa

SEQ ID NO: 2368178 - DNA, 23 bp, Homo sapiens
aagaaataaatgaaacttggcca

SEQ ID NO: 2368179 - DNA, 20 bp, Homo sapiens
aagaaatggcgtctgctctg

SEQ ID NO: 2368180 - DNA, 21 bp, Homo sapiens
aagaaatggcgtctgctctgg

SEQ ID NO: 2368181 - DNA, 14 bp, Homo sapiens
aagaaatggtatgt

SEQ ID NO: 2368182 - DNA, 17 bp, Homo sapiens
aagaaatggtatgtaga

SEQ ID NO: 2368183 - DNA, 16 bp, Homo sapiens
aagaacatagaactct

SEQ ID NO: 2368184 - DNA, 13 bp, Homo sapiens
aagaagaagttca

SEQ ID NO: 2368185 - DNA, 20 bp, Homo sapiens
aagaagagctatcaggagaa

SEQ ID NO: 2368186 - DNA, 19 bp, Homo sapiens
aagaagctgttgtacattt

SEQ ID NO: 2368187 - DNA, 13 bp, Homo sapiens
aagaaggaaggcc

SEQ ID NO: 2368188 - DNA, 17 bp, Homo sapiens
aagaagttcatgtccaa

SEQ ID NO: 2368189 - DNA, 17 bp, Homo sapiens
aagaatgaaagctgttc

SEQ ID NO: 2368190 - DNA, 17 bp, Homo sapiens
aagaatgccatttctca

SEQ ID NO: 2368191 - DNA, 19 bp, Homo sapiens
aagaattctgattgatttg

SEQ ID NO: 2368192 - DNA, 20 bp, Homo sapiens
aagaattctgattgatttga

SEQ ID NO: 2368193 - DNA, 14 bp, Homo sapiens
aagacaccagagca

SEQ ID NO: 2368194 - DNA, 16 bp, Homo sapiens
aagacaccagagcaga

SEQ ID NO: 2368195 - DNA, 20 bp, Homo sapiens
aagacaccagagcagatgca

SEQ ID NO: 2368196 - DNA, 23 bp, Homo sapiens
aagccatagaccctgaggccctg

SEQ ID NO: 2368197 - DNA, 17 bp, Homo sapiens
aagccccctcttcctcc

SEQ ID NO: 2368198 - DNA, 13 bp, Homo sapiens
aagcctaaaattg

SEQ ID NO: 2368199 - DNA, 21 bp, Homo sapiens
aagcctagacaacctttctgt

SEQ ID NO: 2368200 - DNA, 23 bp, Homo sapiens
aagcctagacaacctttctgtag

SEQ ID NO: 2368201 - DNA, 21 bp, Homo sapiens
aagcctatcaaaggaaatgag

SEQ ID NO: 2368202 - DNA, 23 bp, Homo sapiens
aagcctccacagcgagggcagct

SEQ ID NO: 2368203 - DNA, 12 bp, Homo sapiens
aagcctctctct

SEQ ID NO: 2368204 - DNA, 13 bp, Homo sapiens
aagccttcaaaac

SEQ ID NO: 2368205 - DNA, 18 bp, Homo sapiens
aagccttggaaccagccc

SEQ ID NO: 2368206 - DNA, 11 bp, Homo sapiens
aagctaaagag

SEQ ID NO: 2368207 - DNA, 14 bp, Homo sapiens
aagctactgtagaa

SEQ ID NO: 2368208 - DNA, 17 bp, Homo sapiens
aagctactgtagaaaca

SEQ ID NO: 2368209 - DNA, 16 bp, Homo sapiens
aagctataaaagccca

SEQ ID NO: 2368210 - DNA, 13 bp, Homo sapiens
aagctatgagttg

SEQ ID NO: 2368211 - DNA, 22 bp, Homo sapiens
aagctcaaagtatgcaatgctt

SEQ ID NO: 2368212 - DNA, 19 bp, Homo sapiens
aagctcaaatgaaatgtat

SEQ ID NO: 2368213 - DNA, 14 bp, Homo sapiens
aagctcacttctgg

SEQ ID NO: 2368214 - DNA, 23 bp, Homo sapiens
aagctgagttaggtgtctgtcct

SEQ ID NO: 2368215 - DNA, 22 bp, Homo sapiens
aagctgatattatttcttctct

SEQ ID NO: 2368216 - DNA, 23 bp, Homo sapiens
aagctgatattatttcttctctt

SEQ ID NO: 2368217 - DNA, 13 bp, Homo sapiens
aagctgcactgtg

SEQ ID NO: 2368218 - DNA, 19 bp, Homo sapiens
aagctgctctgagccacag

SEQ ID NO: 2368219 - DNA, 20 bp, Homo sapiens
aagctgctctgagccacagt

SEQ ID NO: 2368220 - DNA, 13 bp, Homo sapiens
aagctgttgtaca

SEQ ID NO: 2368221 - DNA, 17 bp, Homo sapiens
aagctgttgtacattta

SEQ ID NO: 2368222 - DNA, 20 bp, Homo sapiens
aagctgttgtacatttatga

SEQ ID NO: 2368223 - DNA, 21 bp, Homo sapiens
aagctgttgtacatttatgat

SEQ ID NO: 2368224 - DNA, 21 bp, Homo sapiens
aagctgtttggaaaagacagt

SEQ ID NO: 2368225 - DNA, 14 bp, Homo sapiens
aagcttaaatagga

SEQ ID NO: 2368226 - DNA, 18 bp, Homo sapiens
aagcttaaataggaaagt

SEQ ID NO: 2368227 - DNA, 22 bp, Homo sapiens
aagcttaaataggaaagtttct

SEQ ID NO: 2368228 - DNA, 13 bp, Homo sapiens
aagcttctaaagc

SEQ ID NO: 2368229 - DNA, 17 bp, Homo sapiens
aagcttggttctgtgaa

SEQ ID NO: 2368230 - DNA, 21 bp, Homo sapiens
aagcttggttctgtgaacaag

SEQ ID NO: 2368231 - DNA, 14 bp, Homo sapiens
aagctttaaattat

SEQ ID NO: 2368232 - DNA, 19 bp, Homo sapiens
aagctttgaatactaaatt

SEQ ID NO: 2368233 - DNA, 16 bp, Homo sapiens
aaggaaaaacacaagc

SEQ ID NO: 2368234 - DNA, 13 bp, Homo sapiens
aaggaaactctta

SEQ ID NO: 2368235 - DNA, 13 bp, Homo sapiens
aaggaaattttac

SEQ ID NO: 2368236 - DNA, 13 bp, Homo sapiens
aaggaagactaga

SEQ ID NO: 2368237 - DNA, 20 bp, Homo sapiens
aaggactgagcaccctctgg

SEQ ID NO: 2368238 - DNA, 14 bp, Homo sapiens
aaggacttggtgat

SEQ ID NO: 2368239 - DNA, 19 bp, Homo sapiens
aaggagagagcaaagggtg

SEQ ID NO: 2368240 - DNA, 14 bp, Homo sapiens
aaggagatttctta

SEQ ID NO: 2368241 - DNA, 13 bp, Homo sapiens
aaggagctttctc

SEQ ID NO: 2368242 - DNA, 16 bp, Homo sapiens
aaggagctttctcaat

SEQ ID NO: 2368243 - DNA, 14 bp, Homo sapiens
aaggaggcccactg

SEQ ID NO: 2368244 - DNA, 20 bp, Homo sapiens
aaggaggccctgttccctgg

SEQ ID NO: 2368245 - DNA, 17 bp, Homo sapiens
aaggagtgtaaaatgta

SEQ ID NO: 2368246 - DNA, 12 bp, Homo sapiens
aaggataaagaa

SEQ ID NO: 2368247 - DNA, 13 bp, Homo sapiens
aaggatccagaga

SEQ ID NO: 2368248 - DNA, 17 bp, Homo sapiens
aaggatcggactctgcc

SEQ ID NO: 2368249 - DNA, 24 bp, Homo sapiens
aaggatctgctgaggcccagtgca

SEQ ID NO: 2368250 - DNA, 19 bp, Homo sapiens
aaggatgatgtctttttat

SEQ ID NO: 2368251 - DNA, 10 bp, Homo sapiens
aaggatgtgt

SEQ ID NO: 2368252 - DNA, 13 bp, Homo sapiens
aaggattgtaaaa

SEQ ID NO: 2368253 - DNA, 15 bp, Homo sapiens
aaggcagagaaatct

SEQ ID NO: 2368254 - DNA, 20 bp, Homo sapiens
aaggcatccttgtcttttga

SEQ ID NO: 2368255 - DNA, 21 bp, Homo sapiens
aaggcatgtggcctttatctc

SEQ ID NO: 2368256 - DNA, 22 bp, Homo sapiens
aaggcatgtggcctttatctca

SEQ ID NO: 2368257 - DNA, 16 bp, Homo sapiens
aaggccaaaatcaaga

SEQ ID NO: 2368258 - DNA, 11 bp, Homo sapiens
aaggccagggc

SEQ ID NO: 2368259 - DNA, 13 bp, Homo sapiens
aaggcctcttgta

SEQ ID NO: 2368260 - DNA, 13 bp, Homo sapiens
aaggcctgaatca

SEQ ID NO: 2368261 - DNA, 11 bp, Homo sapiens
aaggcctgagc

SEQ ID NO: 2368262 - DNA, 13 bp, Homo sapiens
aaggcctttcttc

SEQ ID NO: 2368263 - DNA, 14 bp, Homo sapiens
aaggcctttcttct

SEQ ID NO: 2368264 - DNA, 16 bp, Homo sapiens
aaggcttgaagctgtg

SEQ ID NO: 2368265 - DNA, 20 bp, Homo sapiens
aaggctttgccatgggcctg

SEQ ID NO: 2368266 - DNA, 17 bp, Homo sapiens
aagggaactgaagacct

SEQ ID NO: 2368267 - DNA, 16 bp, Homo sapiens
aagggaagatttatgt

SEQ ID NO: 2368268 - DNA, 13 bp, Homo sapiens
aagggaccccccc

SEQ ID NO: 2368269 - DNA, 16 bp, Homo sapiens
aagggaggaaggcctt

SEQ ID NO: 2368270 - DNA, 15 bp, Homo sapiens
aagggagtttttgat

SEQ ID NO: 2368271 - DNA, 13 bp, Homo sapiens
aagggatcctgcc

SEQ ID NO: 2368272 - DNA, 16 bp, Homo sapiens
aagggatcctgcctgc

SEQ ID NO: 2368273 - DNA, 15 bp, Homo sapiens
aagggatggaaaagg

SEQ ID NO: 2368274 - DNA, 20 bp, Homo sapiens
aagggatggaaaaggaagac

SEQ ID NO: 2368275 - DNA, 21 bp, Homo sapiens
aagggatggaaaaggaagact

SEQ ID NO: 2368276 - DNA, 15 bp, Homo sapiens
aagggcaagaaatgg

SEQ ID NO: 2368277 - DNA, 12 bp, Homo sapiens
aagggctggctc

SEQ ID NO: 2368278 - DNA, 23 bp, Homo sapiens
aagggctggctccccctccccag

SEQ ID NO: 2368279 - DNA, 15 bp, Homo sapiens
aaggggagagcctgc

SEQ ID NO: 2368280 - DNA, 18 bp, Homo sapiens
aaggggagagcctgctgg

SEQ ID NO: 2368281 - DNA, 14 bp, Homo sapiens
aaggggtgctttta

SEQ ID NO: 2368282 - DNA, 18 bp, Homo sapiens
aagggtatgggaagccat

SEQ ID NO: 2368283 - DNA, 14 bp, Homo sapiens
aagggtttctctat

SEQ ID NO: 2368284 - DNA, 12 bp, Homo sapiens
aaggtaaatggt

SEQ ID NO: 2368285 - DNA, 21 bp, Homo sapiens
aaggtaaatggttaaatttta

SEQ ID NO: 2368286 - DNA, 13 bp, Homo sapiens
aaggtaatgtgtg

SEQ ID NO: 2368287 - DNA, 14 bp, Homo sapiens
aaggtcactgtttc

SEQ ID NO: 2368288 - DNA, 18 bp, Homo sapiens
aaggtcactgtttcctgg

SEQ ID NO: 2368289 - DNA, 20 bp, Homo sapiens
aaggtcttcttgtgtcctga

SEQ ID NO: 2368290 - DNA, 17 bp, Homo sapiens
aaggtgagaaatcacaa

SEQ ID NO: 2368291 - DNA, 22 bp, Homo sapiens
aaggtgagtttgagctgccttc

SEQ ID NO: 2368292 - DNA, 13 bp, Homo sapiens
aaggtgatgttgt

SEQ ID NO: 2368293 - DNA, 17 bp, Homo sapiens
aaggtggagtttctctg

SEQ ID NO: 2368294 - DNA, 18 bp, Homo sapiens
aaggtggagtttctctgt

SEQ ID NO: 2368295 - DNA, 14 bp, Homo sapiens
aaggtggccacagc

SEQ ID NO: 2368296 - DNA, 15 bp, Homo sapiens
aaggtggccacagca

SEQ ID NO: 2368297 - DNA, 18 bp, Homo sapiens
aagtaaatacatgcatat

SEQ ID NO: 2368298 - DNA, 20 bp, Homo sapiens
aagtaaggtgcttggagttt

SEQ ID NO: 2368299 - DNA, 13 bp, Homo sapiens
aagtaatattatt

SEQ ID NO: 2368300 - DNA, 17 bp, Homo sapiens
aagtaatgacttagaaa

SEQ ID NO: 2368301 - DNA, 19 bp, Homo sapiens
aagtaatgacttagaaact

SEQ ID NO: 2368302 - DNA, 13 bp, Homo sapiens
aagtaatttcagt

SEQ ID NO: 2368303 - DNA, 23 bp, Homo sapiens
aagtaatttcagtgtaaagtgtg

SEQ ID NO: 2368304 - DNA, 13 bp, Homo sapiens
aagtacaaatgaa

SEQ ID NO: 2368305 - DNA, 22 bp, Homo sapiens
aagtacagcggctcccctctgc

SEQ ID NO: 2368306 - DNA, 20 bp, Homo sapiens
aagtacatattaggaaaata

SEQ ID NO: 2368307 - DNA, 17 bp, Homo sapiens
aagtaccaatgggaagc

SEQ ID NO: 2368308 - DNA, 24 bp, Homo sapiens
aagtactctttaacatacaagaaa

SEQ ID NO: 2368309 - DNA, 22 bp, Homo sapiens
aagtacttgtcatagactcctt

SEQ ID NO: 2368310 - DNA, 21 bp, Homo sapiens
aagtagattcatgaaaatgta

SEQ ID NO: 2368311 - DNA, 18 bp, Homo sapiens
aagtaggaggaaacagtt

SEQ ID NO: 2368312 - DNA, 19 bp, Homo sapiens
aatagaaattttgtaagaa

SEQ ID NO: 2368313 - DNA, 17 bp, Homo sapiens
aatagacaaaaagtata

SEQ ID NO: 2368314 - DNA, 17 bp, Homo sapiens
aatagccaaagatttca

SEQ ID NO: 2368315 - DNA, 23 bp, Homo sapiens
aataggaatcattcagaaatgtt

SEQ ID NO: 2368316 - DNA, 13 bp, Homo sapiens
aataggagaggat

SEQ ID NO: 2368317 - DNA, 15 bp, Homo sapiens
aataggatgaggttt

SEQ ID NO: 2368318 - DNA, 13 bp, Homo sapiens
aatagtagatgtg

SEQ ID NO: 2368319 - DNA, 16 bp, Homo sapiens
aatagtatacatttta

SEQ ID NO: 2368320 - DNA, 19 bp, Homo sapiens
aatagtatacattttataa

SEQ ID NO: 2368321 - DNA, 15 bp, Homo sapiens
aatagtatagaagtc

SEQ ID NO: 2368322 - DNA, 17 bp, Homo sapiens
aatagtatgaaaatgga

SEQ ID NO: 2368323 - DNA, 18 bp, Homo sapiens
aatagtatgaaaatggaa

SEQ ID NO: 2368324 - DNA, 21 bp, Homo sapiens
aatagtcaccttcatgattat

SEQ ID NO: 2368325 - DNA, 16 bp, Homo sapiens
aatagtgtgaaatata

SEQ ID NO: 2368326 - DNA, 15 bp, Homo sapiens
aatataaaattatga

SEQ ID NO: 2368327 - DNA, 16 bp, Homo sapiens
aatataagacatttgt

SEQ ID NO: 2368328 - DNA, 22 bp, Homo sapiens
aatatactccttaaaaatgtat

SEQ ID NO: 2368329 - DNA, 19 bp, Homo sapiens
aatatagctttcataacat

SEQ ID NO: 2368330 - DNA, 13 bp, Homo sapiens
aatatatattaag

SEQ ID NO: 2368331 - DNA, 23 bp, Homo sapiens
aatatatattaagtgtgccaaat

SEQ ID NO: 2368332 - DNA, 18 bp, Homo sapiens
aatatattacttaactgt

SEQ ID NO: 2368333 - DNA, 23 bp, Homo sapiens
aatatattgaacttttgtactga

SEQ ID NO: 2368334 - DNA, 21 bp, Homo sapiens
aatatattttttgttattatt

SEQ ID NO: 2368335 - DNA, 21 bp, Homo sapiens
aatatcaaagtcattaaagac

SEQ ID NO: 2368336 - DNA, 13 bp, Homo sapiens
aatatcataaagc

SEQ ID NO: 2368337 - DNA, 18 bp, Homo sapiens
aatatcataaagcatttt

SEQ ID NO: 2368338 - DNA, 22 bp, Homo sapiens
aatatctatttgaataaattat

SEQ ID NO: 2368339 - DNA, 17 bp, Homo sapiens
aatatctgtgaaggact

SEQ ID NO: 2368340 - DNA, 14 bp, Homo sapiens
aatatgaatctata

SEQ ID NO: 2368341 - DNA, 22 bp, Homo sapiens
aatatgcagtgatatggcagaa

SEQ ID NO: 2368342 - DNA, 17 bp, Homo sapiens
aatatgcttataaccta

SEQ ID NO: 2368343 - DNA, 15 bp, Homo sapiens
aatatgtttaaaata

SEQ ID NO: 2368344 - DNA, 19 bp, Homo sapiens
aatattcatggatggctca

SEQ ID NO: 2368345 - DNA, 14 bp, Homo sapiens
aatattctgtaact

SEQ ID NO: 2368346 - DNA, 16 bp, Homo sapiens
aatattgaaaattgaa

SEQ ID NO: 2368347 - DNA, 22 bp, Homo sapiens
aatattgattgggaaaacattt

SEQ ID NO: 2368348 - DNA, 14 bp, Homo sapiens
aatattgtttctgc

SEQ ID NO: 2368349 - DNA, 23 bp, Homo sapiens
aatattgtttctgcattcatttt

SEQ ID NO: 2368350 - DNA, 20 bp, Homo sapiens
aatattgtttggtaaatgtt

SEQ ID NO: 2368351 - DNA, 23 bp, Homo sapiens
aatattgtttggtaaatgtttct

SEQ ID NO: 2368352 - DNA, 20 bp, Homo sapiens
aatatttactaactaaatac

SEQ ID NO: 2368353 - DNA, 13 bp, Homo sapiens
aatatttctattg

SEQ ID NO: 2368354 - DNA, 14 bp, Homo sapiens
aatatttgcacatg

SEQ ID NO: 2368355 - DNA, 23 bp, Homo sapiens
aatatttgcacatgggattgcta

SEQ ID NO: 2368356 - DNA, 16 bp, Homo sapiens
aatattttctacttta

SEQ ID NO: 2368357 - DNA, 23 bp, Homo sapiens
aatatttttatatcatgcaaaat

SEQ ID NO: 2368358 - DNA, 21 bp, Homo sapiens
aatatttttatatttccttta

SEQ ID NO: 2368359 - DNA, 21 bp, Homo sapiens
aatcaaatgaatgattaaatt

SEQ ID NO: 2368360 - DNA, 22 bp, Homo sapiens
aatcaaatgaatgattaaatta

SEQ ID NO: 2368361 - DNA, 23 bp, Homo sapiens
aatcaaatgaatgattaaattat

SEQ ID NO: 2368362 - DNA, 14 bp, Homo sapiens
aatcaactctaata

SEQ ID NO: 2368363 - DNA, 10 bp, Homo sapiens
aatcaagaga

SEQ ID NO: 2368364 - DNA, 13 bp, Homo sapiens
aatcaagagaaac

SEQ ID NO: 2368365 - DNA, 17 bp, Homo sapiens
aatcaaggttataattt

SEQ ID NO: 2368366 - DNA, 18 bp, Homo sapiens
aatcaaggttataatttt

SEQ ID NO: 2368367 - DNA, 20 bp, Homo sapiens
aatcaatacactagttgttt

SEQ ID NO: 2368368 - DNA, 16 bp, Homo sapiens
aatcaatataatctga

SEQ ID NO: 2368369 - DNA, 16 bp, Homo sapiens
aatcacgctttcctga

SEQ ID NO: 2368370 - DNA, 19 bp, Homo sapiens
aatcactgttgctttgaaa

SEQ ID NO: 2368371 - DNA, 17 bp, Homo sapiens
aatcagattgcttaaaa

SEQ ID NO: 2368372 - DNA, 18 bp, Homo sapiens
aatcagattgcttaaaag

SEQ ID NO: 2368373 - DNA, 21 bp, Homo sapiens
aatcagcctcatgactttata

SEQ ID NO: 2368374 - DNA, 15 bp, Homo sapiens
aatcatcaagagaat

SEQ ID NO: 2368375 - DNA, 21 bp, Homo sapiens
aatcatcaagagaatttgggg

SEQ ID NO: 2368376 - DNA, 16 bp, Homo sapiens
aatcatgagcctgctg

SEQ ID NO: 2368377 - DNA, 17 bp, Homo sapiens
aatcatgccagtatttt

SEQ ID NO: 2368378 - DNA, 22 bp, Homo sapiens
aatcatgtccatacactttgtt

SEQ ID NO: 2368379 - DNA, 18 bp, Homo sapiens
aatcattcttactaaaaa

SEQ ID NO: 2368380 - DNA, 18 bp, Homo sapiens
aatccaagcctccacagc

SEQ ID NO: 2368381 - DNA, 22 bp, Homo sapiens
aatccaagcctccacagcgagg

SEQ ID NO: 2368382 - DNA, 16 bp, Homo sapiens
aatcctcctgcctcag

SEQ ID NO: 2368383 - DNA, 19 bp, Homo sapiens
aatccttctattctagcct

SEQ ID NO: 2368384 - DNA, 11 bp, Homo sapiens
aatcggactgc

SEQ ID NO: 2368385 - DNA, 13 bp, Homo sapiens
aatcggactgcca

SEQ ID NO: 2368386 - DNA, 13 bp, Homo sapiens
aatcgtgtgccat

SEQ ID NO: 2368387 - DNA, 18 bp, Homo sapiens
aatctatggcttatttct

SEQ ID NO: 2368388 - DNA, 19 bp, Homo sapiens
aatctatggcttatttcta

SEQ ID NO: 2368389 - DNA, 20 bp, Homo sapiens
aatctatggcttatttctat

SEQ ID NO: 2368390 - DNA, 16 bp, Homo sapiens
aatctcaaataggcta

SEQ ID NO: 2368391 - DNA, 21 bp, Homo sapiens
aatctcagaaccttgtcccag

SEQ ID NO: 2368392 - DNA, 16 bp, Homo sapiens
aatctcattatttcaa

SEQ ID NO: 2368393 - DNA, 20 bp, Homo sapiens
aatctcgcactacatctgat

SEQ ID NO: 2368394 - DNA, 14 bp, Homo sapiens
aatctctgtaggaa

SEQ ID NO: 2368395 - DNA, 19 bp, Homo sapiens
aatctcttcactaccctga

SEQ ID NO: 2368396 - DNA, 18 bp, Homo sapiens
aatctctttttgtttgcc

SEQ ID NO: 2368397 - DNA, 14 bp, Homo sapiens
aatctgatggcctt

SEQ ID NO: 2368398 - DNA, 15 bp, Homo sapiens
aatctgatggcctta

SEQ ID NO: 2368399 - DNA, 19 bp, Homo sapiens
aatctgatggccttaattt

SEQ ID NO: 2368400 - DNA, 14 bp, Homo sapiens
aatctgtaaactgt

SEQ ID NO: 2368401 - DNA, 16 bp, Homo sapiens
aatctgtaaactgtgt

SEQ ID NO: 2368402 - DNA, 13 bp, Homo sapiens
aatcttgttttga

SEQ ID NO: 2368403 - DNA, 14 bp, Homo sapiens
aatcttgttttgaa

SEQ ID NO: 2368404 - DNA, 14 bp, Homo sapiens
aatcttttcttatt

SEQ ID NO: 2368405 - DNA, 22 bp, Homo sapiens
aatgaaaataaaacacacctcg

SEQ ID NO: 2368406 - DNA, 17 bp, Homo sapiens
aatgaaaattgtattat

SEQ ID NO: 2368407 - DNA, 19 bp, Homo sapiens
aatgaaagaaaattgagtt

SEQ ID NO: 2368408 - DNA, 14 bp, Homo sapiens
aatgaagaaagtca

SEQ ID NO: 2368409 - DNA, 23 bp, Homo sapiens
aatgaagaaagtcaaaaaattat

SEQ ID NO: 2368410 - DNA, 21 bp, Homo sapiens
aatgaataatggaaaatgcca

SEQ ID NO: 2368411 - DNA, 15 bp, Homo sapiens
aatgaatgattaaat

SEQ ID NO: 2368412 - DNA, 20 bp, Homo sapiens
aatgaatgattaaattatga

SEQ ID NO: 2368413 - DNA, 18 bp, Homo sapiens
aatgacaagtgacttatt

SEQ ID NO: 2368414 - DNA, 12 bp, Homo sapiens
aatgacaatatt

SEQ ID NO: 2368415 - DNA, 19 bp, Homo sapiens
aatgaccattcaattagtg

SEQ ID NO: 2368416 - DNA, 22 bp, Homo sapiens
aatgacggtaagtgttctcatg

SEQ ID NO: 2368417 - DNA, 23 bp, Homo sapiens
aatgactatataatttatttcca

SEQ ID NO: 2368418 - DNA, 15 bp, Homo sapiens
aatgactcaaagtct

SEQ ID NO: 2368419 - DNA, 16 bp, Homo sapiens
aatgactcaaagtctg

SEQ ID NO: 2368420 - DNA, 13 bp, Homo sapiens
aatgacttagaaa

SEQ ID NO: 2368421 - DNA, 16 bp, Homo sapiens
aatgacttagaaactg

SEQ ID NO: 2368422 - DNA, 14 bp, Homo sapiens
aatgagaaaaataa

SEQ ID NO: 2368423 - DNA, 12 bp, Homo sapiens
aatgagagcata

SEQ ID NO: 2368424 - DNA, 16 bp, Homo sapiens
aatgagccattttttg

SEQ ID NO: 2368425 - DNA, 19 bp, Homo sapiens
aatgagcttgattaaatca

SEQ ID NO: 2368426 - DNA, 22 bp, Homo sapiens
aattctcaagacctgagtattt

SEQ ID NO: 2368427 - DNA, 12 bp, Homo sapiens
aattctctttct

SEQ ID NO: 2368428 - DNA, 17 bp, Homo sapiens
aattctgtgatattttc

SEQ ID NO: 2368429 - DNA, 23 bp, Homo sapiens
aattcttaaaaggcccatagcag

SEQ ID NO: 2368430 - DNA, 15 bp, Homo sapiens
aattcttttctgagg

SEQ ID NO: 2368431 - DNA, 16 bp, Homo sapiens
aattgaaatacctatt

SEQ ID NO: 2368432 - DNA, 15 bp, Homo sapiens
aattgacattccttt

SEQ ID NO: 2368433 - DNA, 18 bp, Homo sapiens
aattgagttgcacttatt

SEQ ID NO: 2368434 - DNA, 16 bp, Homo sapiens
aattgcatactttgta

SEQ ID NO: 2368435 - DNA, 13 bp, Homo sapiens
aattgccagcaaa

SEQ ID NO: 2368436 - DNA, 14 bp, Homo sapiens
aattgccagcaaat

SEQ ID NO: 2368437 - DNA, 19 bp, Homo sapiens
aattgccagcaaataaata

SEQ ID NO: 2368438 - DNA, 23 bp, Homo sapiens
aattgctctttcacaggtagcct

SEQ ID NO: 2368439 - DNA, 19 bp, Homo sapiens
aattgctgactgtagcttt

SEQ ID NO: 2368440 - DNA, 18 bp, Homo sapiens
aattgtacaaaattaagc

SEQ ID NO: 2368441 - DNA, 14 bp, Homo sapiens
aattgtagggcttt

SEQ ID NO: 2368442 - DNA, 11 bp, Homo sapiens
aattgtggcta

SEQ ID NO: 2368443 - DNA, 18 bp, Homo sapiens
aattgtggctatcctgat

SEQ ID NO: 2368444 - DNA, 15 bp, Homo sapiens
aattgttgtttcttt

SEQ ID NO: 2368445 - DNA, 19 bp, Homo sapiens
aattgttgtttctttctag

SEQ ID NO: 2368446 - DNA, 12 bp, Homo sapiens
aatttaaatgaa

SEQ ID NO: 2368447 - DNA, 20 bp, Homo sapiens
aatttaataccagatacctt

SEQ ID NO: 2368448 - DNA, 15 bp, Homo sapiens
aatttacacatctta

SEQ ID NO: 2368449 - DNA, 18 bp, Homo sapiens
aatttagtggatggaata

SEQ ID NO: 2368450 - DNA, 20 bp, Homo sapiens
aatttatatcaggtgtataa

SEQ ID NO: 2368451 - DNA, 23 bp, Homo sapiens
aatttatgaattgaattatcttg

SEQ ID NO: 2368452 - DNA, 15 bp, Homo sapiens
aatttcaaaatacat

SEQ ID NO: 2368453 - DNA, 22 bp, Homo sapiens
aatttcaaaatacatttgtaag

SEQ ID NO: 2368454 - DNA, 16 bp, Homo sapiens
aatttcacctgtaaac

SEQ ID NO: 2368455 - DNA, 19 bp, Homo sapiens
aatttcagtgtaaagtgtg

SEQ ID NO: 2368456 - DNA, 21 bp, Homo sapiens
aatttcatagctgtacttctt

SEQ ID NO: 2368457 - DNA, 14 bp, Homo sapiens
aatttcctctccac

SEQ ID NO: 2368458 - DNA, 17 bp, Homo sapiens
aatttcctctccactgc

SEQ ID NO: 2368459 - DNA, 14 bp, Homo sapiens
aatttcttatgtga

SEQ ID NO: 2368460 - DNA, 15 bp, Homo sapiens
aatttcttatgtgac

SEQ ID NO: 2368461 - DNA, 18 bp, Homo sapiens
aatttcttatgtgacatt

SEQ ID NO: 2368462 - DNA, 22 bp, Homo sapiens
aatttgaattatcagcaaagaa

SEQ ID NO: 2368463 - DNA, 21 bp, Homo sapiens
aatttggagcacaaaattcaa

SEQ ID NO: 2368464 - DNA, 22 bp, Homo sapiens
aatttggaggctggagtaatca

SEQ ID NO: 2368465 - DNA, 13 bp, Homo sapiens
aatttgtaagttt

SEQ ID NO: 2368466 - DNA, 14 bp, Homo sapiens
aatttgtaagtttc

SEQ ID NO: 2368467 - DNA, 23 bp, Homo sapiens
aatttgtaagtttcaggtgacat

SEQ ID NO: 2368468 - DNA, 14 bp, Homo sapiens
aatttgtgtgtttt

SEQ ID NO: 2368469 - DNA, 23 bp, Homo sapiens
aattttaaaaaagggagtttttg

SEQ ID NO: 2368470 - DNA, 12 bp, Homo sapiens
aattttaaagcc

SEQ ID NO: 2368471 - DNA, 15 bp, Homo sapiens
aattttaaagccatt

SEQ ID NO: 2368472 - DNA, 12 bp, Homo sapiens
aattttaaagta

SEQ ID NO: 2368473 - DNA, 16 bp, Homo sapiens
aattttaaagtatgca

SEQ ID NO: 2368474 - DNA, 18 bp, Homo sapiens
aattttaaagtatgcatt

SEQ ID NO: 2368475 - DNA, 21 bp, Homo sapiens
aattttaaggcatatttaaca

SEQ ID NO: 2368476 - DNA, 19 bp, Homo sapiens
aattttaatattcttttgt

SEQ ID NO: 2368477 - DNA, 16 bp, Homo sapiens
aattttacatgacaga

SEQ ID NO: 2368478 - DNA, 15 bp, Homo sapiens
aattttagaaatatt

SEQ ID NO: 2368479 - DNA, 13 bp, Homo sapiens
aattttattatag

SEQ ID NO: 2368480 - DNA, 21 bp, Homo sapiens
aattttcacttttggcaatga

SEQ ID NO: 2368481 - DNA, 19 bp, Homo sapiens
aattttcattttgcactga

SEQ ID NO: 2368482 - DNA, 15 bp, Homo sapiens
aattttctaaaagct

SEQ ID NO: 2368483 - DNA, 20 bp, Homo sapiens
aattttgtatgttaaagaga

SEQ ID NO: 2368484 - DNA, 17 bp, Homo sapiens
aatttttaagctgcaaa

SEQ ID NO: 2368485 - DNA, 13 bp, Homo sapiens
aattttttgactt

SEQ ID NO: 2368486 - DNA, 19 bp, Homo sapiens
aattttttgatgtcagcct

SEQ ID NO: 2368487 - DNA, 15 bp, Homo sapiens
aatttttttgtaata

SEQ ID NO: 2368488 - DNA, 16 bp, Homo sapiens
aatttttttgtaataa

SEQ ID NO: 2368489 - DNA, 19 bp, Homo sapiens
aattttttttaaaatagaa

SEQ ID NO: 2368490 - DNA, 20 bp, Homo sapiens
aattttttttaaaatagaaa

SEQ ID NO: 2368491 - DNA, 17 bp, Homo sapiens
acaaaaaacgaatgaaa

SEQ ID NO: 2368492 - DNA, 18 bp, Homo sapiens
acaaaaacagaatttgag

SEQ ID NO: 2368493 - DNA, 18 bp, Homo sapiens
acaaaaaccaaatgttta

SEQ ID NO: 2368494 - DNA, 13 bp, Homo sapiens
acaaaattcaaag

SEQ ID NO: 2368495 - DNA, 22 bp, Homo sapiens
acaaacatctaataagtatata

SEQ ID NO: 2368496 - DNA, 23 bp, Homo sapiens
acaaaccctgctgaacacagtgt

SEQ ID NO: 2368497 - DNA, 21 bp, Homo sapiens
acaaacctaccaaaatggaat

SEQ ID NO: 2368498 - DNA, 19 bp, Homo sapiens
acaaactcatcctctttta

SEQ ID NO: 2368499 - DNA, 22 bp, Homo sapiens
acaaactgcttcccttactttg

SEQ ID NO: 2368500 - DNA, 17 bp, Homo sapiens
acaaagacaaaagtctg

SEQ ID NO: 2368501 - DNA, 19 bp, Homo sapiens
acaaagccttaagcaaatt

SEQ ID NO: 2368502 - DNA, 17 bp, Homo sapiens
acaaagctatttaagtg

SEQ ID NO: 2368503 - DNA, 15 bp, Homo sapiens
acaaagcttctaaag

SEQ ID NO: 2368504 - DNA, 19 bp, Homo sapiens
acaaagctttcttttctaa

SEQ ID NO: 2368505 - DNA, 18 bp, Homo sapiens
acaaagtactctttaaca

SEQ ID NO: 2368506 - DNA, 16 bp, Homo sapiens
acaaataagattaata

SEQ ID NO: 2368507 - DNA, 17 bp, Homo sapiens
acaaataagattaataa

SEQ ID NO: 2368508 - DNA, 19 bp, Homo sapiens
acaaatattcactggcccc

SEQ ID NO: 2368509 - DNA, 12 bp, Homo sapiens
acaaatctcaga

SEQ ID NO: 2368510 - DNA, 21 bp, Homo sapiens
acaaatgtggccaagcctatc

SEQ ID NO: 2368511 - DNA, 22 bp, Homo sapiens
acaaattcaagagctagaaaaa

SEQ ID NO: 2368512 - DNA, 23 bp, Homo sapiens
acaaatttttcaaatcattcctt

SEQ ID NO: 2368513 - DNA, 16 bp, Homo sapiens
acaacacattgaaact

SEQ ID NO: 2368514 - DNA, 19 bp, Homo sapiens
acaacaccagcaacattat

SEQ ID NO: 2368515 - DNA, 13 bp, Homo sapiens
acaacacccattt

SEQ ID NO: 2368516 - DNA, 22 bp, Homo sapiens
acaacagagtgaaaaatcttaa

SEQ ID NO: 2368517 - DNA, 17 bp, Homo sapiens
acaacatttatatgtag

SEQ ID NO: 2368518 - DNA, 12 bp, Homo sapiens
acaactctgcct

SEQ ID NO: 2368519 - DNA, 16 bp, Homo sapiens
acaactctgcctttat

SEQ ID NO: 2368520 - DNA, 18 bp, Homo sapiens
acaactctgcctttatga

SEQ ID NO: 2368521 - DNA, 16 bp, Homo sapiens
acaacttagctcaggt

SEQ ID NO: 2368522 - DNA, 21 bp, Homo sapiens
acaacttagctcaggtgcctt

SEQ ID NO: 2368523 - DNA, 12 bp, Homo sapiens
acaagaaaatgt

SEQ ID NO: 2368524 - DNA, 15 bp, Homo sapiens
acaagaaagtggtct

SEQ ID NO: 2368525 - DNA, 15 bp, Homo sapiens
acaagaaggaacaat

SEQ ID NO: 2368526 - DNA, 17 bp, Homo sapiens
acaagatgtttcatttt

SEQ ID NO: 2368527 - DNA, 18 bp, Homo sapiens
acaagatttccttgtgca

SEQ ID NO: 2368528 - DNA, 20 bp, Homo sapiens
acaagatttccttgtgcaaa

SEQ ID NO: 2368529 - DNA, 13 bp, Homo sapiens
acaagctgcactg

SEQ ID NO: 2368530 - DNA, 14 bp, Homo sapiens
acaagctgcactgt

SEQ ID NO: 2368531 - DNA, 17 bp, Homo sapiens
acaagctgcactgtgaa

SEQ ID NO: 2368532 - DNA, 18 bp, Homo sapiens
acaagctgcactgtgaac

SEQ ID NO: 2368533 - DNA, 14 bp, Homo sapiens
acaaggagatttct

SEQ ID NO: 2368534 - DNA, 12 bp, Homo sapiens
acaaggtgctaa

SEQ ID NO: 2368535 - DNA, 16 bp, Homo sapiens
acaagtaatattatta

SEQ ID NO: 2368536 - DNA, 17 bp, Homo sapiens
acaagtggtgtttattg

SEQ ID NO: 2368537 - DNA, 14 bp, Homo sapiens
acaataaaaatgtt

SEQ ID NO: 2368538 - DNA, 17 bp, Homo sapiens
acaataagaaacagttt

SEQ ID NO: 2368539 - DNA, 21 bp, Homo sapiens
acaataagaaacagtttaaca

SEQ ID NO: 2368540 - DNA, 22 bp, Homo sapiens
acaataagaaacagtttaacag

SEQ ID NO: 2368541 - DNA, 16 bp, Homo sapiens
acatttagaaaagtga

SEQ ID NO: 2368542 - DNA, 20 bp, Homo sapiens
acatttagaaaagtgaattg

SEQ ID NO: 2368543 - DNA, 22 bp, Homo sapiens
acatttagaaaagtgaattgaa

SEQ ID NO: 2368544 - DNA, 15 bp, Homo sapiens
acatttagaagaaag

SEQ ID NO: 2368545 - DNA, 15 bp, Homo sapiens
acatttatgatttaa

SEQ ID NO: 2368546 - DNA, 11 bp, Homo sapiens
acatttcaaaa

SEQ ID NO: 2368547 - DNA, 16 bp, Homo sapiens
acatttccaaatgaac

SEQ ID NO: 2368548 - DNA, 12 bp, Homo sapiens
acatttctctga

SEQ ID NO: 2368549 - DNA, 17 bp, Homo sapiens
acatttgctactgttgt

SEQ ID NO: 2368550 - DNA, 21 bp, Homo sapiens
acatttgtaagtgtaaaaaat

SEQ ID NO: 2368551 - DNA, 14 bp, Homo sapiens
acattttacagtaa

SEQ ID NO: 2368552 - DNA, 12 bp, Homo sapiens
acattttccttt

SEQ ID NO: 2368553 - DNA, 17 bp, Homo sapiens
acattttttaagcttca

SEQ ID NO: 2368554 - DNA, 20 bp, Homo sapiens
acattttttaggaaatgttt

SEQ ID NO: 2368555 - DNA, 14 bp, Homo sapiens
acattttttataca

SEQ ID NO: 2368556 - DNA, 13 bp, Homo sapiens
accaaaaacaagt

SEQ ID NO: 2368557 - DNA, 14 bp, Homo sapiens
accaaaaacatttg

SEQ ID NO: 2368558 - DNA, 16 bp, Homo sapiens
accaaaaacatttgat

SEQ ID NO: 2368559 - DNA, 19 bp, Homo sapiens
accaaagctgcccactgtt

SEQ ID NO: 2368560 - DNA, 15 bp, Homo sapiens
accaaggactgagca

SEQ ID NO: 2368561 - DNA, 21 bp, Homo sapiens
accaaggctgagacagtgaat

SEQ ID NO: 2368562 - DNA, 23 bp, Homo sapiens
accaaggctgagacagtgaattt

SEQ ID NO: 2368563 - DNA, 19 bp, Homo sapiens
accaatcctactaataaac

SEQ ID NO: 2368564 - DNA, 13 bp, Homo sapiens
accaatgggaagc

SEQ ID NO: 2368565 - DNA, 14 bp, Homo sapiens
accaatgggaagca

SEQ ID NO: 2368566 - DNA, 17 bp, Homo sapiens
accacaaaccctgctga

SEQ ID NO: 2368567 - DNA, 22 bp, Homo sapiens
accacagggttcaaaatgtctg

SEQ ID NO: 2368568 - DNA, 19 bp, Homo sapiens
accacatagcatgcttcct

SEQ ID NO: 2368569 - DNA, 15 bp, Homo sapiens
accaccaaaaacaaa

SEQ ID NO: 2368570 - DNA, 22 bp, Homo sapiens
accaccacggccaccactgcag

SEQ ID NO: 2368571 - DNA, 14 bp, Homo sapiens
accaccctgctcat

SEQ ID NO: 2368572 - DNA, 14 bp, Homo sapiens
accaccggccccct

SEQ ID NO: 2368573 - DNA, 18 bp, Homo sapiens
accacggccaccactgca

SEQ ID NO: 2368574 - DNA, 16 bp, Homo sapiens
accactcctgtccctg

SEQ ID NO: 2368575 - DNA, 18 bp, Homo sapiens
accactcctgtccctgta

SEQ ID NO: 2368576 - DNA, 21 bp, Homo sapiens
accactcctgtccctgtagct

SEQ ID NO: 2368577 - DNA, 22 bp, Homo sapiens
accactcctgtccctgtagctc

SEQ ID NO: 2368578 - DNA, 14 bp, Homo sapiens
accactcgtgcatc

SEQ ID NO: 2368579 - DNA, 21 bp, Homo sapiens
accactcgtgcatccctgaga

SEQ ID NO: 2368580 - DNA, 23 bp, Homo sapiens
accactcttctttaagccataga

SEQ ID NO: 2368581 - DNA, 15 bp, Homo sapiens
accactgcttctctt

SEQ ID NO: 2368582 - DNA, 23 bp, Homo sapiens
accactgtctccacccaccttga

SEQ ID NO: 2368583 - DNA, 23 bp, Homo sapiens
accactgttctgttcatttccta

SEQ ID NO: 2368584 - DNA, 15 bp, Homo sapiens
accacttccagagcc

SEQ ID NO: 2368585 - DNA, 15 bp, Homo sapiens
accagaaacacccct

SEQ ID NO: 2368586 - DNA, 21 bp, Homo sapiens
accagaaacacccctctgtct

SEQ ID NO: 2368587 - DNA, 17 bp, Homo sapiens
accagacgtcaggccct

SEQ ID NO: 2368588 - DNA, 23 bp, Homo sapiens
accagacgtcaggccctgactcc

SEQ ID NO: 2368589 - DNA, 12 bp, Homo sapiens
accagagcagat

SEQ ID NO: 2368590 - DNA, 16 bp, Homo sapiens
accagagggtgtggct

SEQ ID NO: 2368591 - DNA, 14 bp, Homo sapiens
accagatctttctc

SEQ ID NO: 2368592 - DNA, 14 bp, Homo sapiens
accagcaacattat

SEQ ID NO: 2368593 - DNA, 23 bp, Homo sapiens
accagcaattctctttcttttac

SEQ ID NO: 2368594 - DNA, 15 bp, Homo sapiens
accagcattccctac

SEQ ID NO: 2368595 - DNA, 23 bp, Homo sapiens
accagcattccctacagcctagg

SEQ ID NO: 2368596 - DNA, 17 bp, Homo sapiens
accagccatcctccctc

SEQ ID NO: 2368597 - DNA, 19 bp, Homo sapiens
accagcccccgccccagag

SEQ ID NO: 2368598 - DNA, 21 bp, Homo sapiens
accagcccccgccccagagtg

SEQ ID NO: 2368599 - DNA, 17 bp, Homo sapiens
accaggccgtgccttgt

SEQ ID NO: 2368600 - DNA, 17 bp, Homo sapiens
accaggtccagatgtgc

SEQ ID NO: 2368601 - DNA, 18 bp, Homo sapiens
accagtgggaattgctgg

SEQ ID NO: 2368602 - DNA, 22 bp, Homo sapiens
accataaattcaactttgtaaa

SEQ ID NO: 2368603 - DNA, 19 bp, Homo sapiens
accataatgagatgtgagc

SEQ ID NO: 2368604 - DNA, 18 bp, Homo sapiens
accatactccttgcttcc

SEQ ID NO: 2368605 - DNA, 12 bp, Homo sapiens
accatcctggct

SEQ ID NO: 2368606 - DNA, 13 bp, Homo sapiens
accatcctggcta

SEQ ID NO: 2368607 - DNA, 17 bp, Homo sapiens
accatgaccctacataa

SEQ ID NO: 2368608 - DNA, 20 bp, Homo sapiens
accatgccagattctgcctc

SEQ ID NO: 2368609 - DNA, 18 bp, Homo sapiens
accatgtgagctcttcct

SEQ ID NO: 2368610 - DNA, 13 bp, Homo sapiens
accattaaagtca

SEQ ID NO: 2368611 - DNA, 14 bp, Homo sapiens
accattaccaaaat

SEQ ID NO: 2368612 - DNA, 14 bp, Homo sapiens
accattcaattagt

SEQ ID NO: 2368613 - DNA, 19 bp, Homo sapiens
accattcacaataaaagct

SEQ ID NO: 2368614 - DNA, 18 bp, Homo sapiens
accattgatttaatgtaa

SEQ ID NO: 2368615 - DNA, 21 bp, Homo sapiens
accattgctcttagtcccaag

SEQ ID NO: 2368616 - DNA, 17 bp, Homo sapiens
accattttttaatttac

SEQ ID NO: 2368617 - DNA, 14 bp, Homo sapiens
acccaaaatatata

SEQ ID NO: 2368618 - DNA, 18 bp, Homo sapiens
acccaaccctatctcctg

SEQ ID NO: 2368619 - DNA, 16 bp, Homo sapiens
acccacctgttttctg

SEQ ID NO: 2368620 - DNA, 19 bp, Homo sapiens
acccacctgttttctgaaa

SEQ ID NO: 2368621 - DNA, 15 bp, Homo sapiens
acccactcggtccca

SEQ ID NO: 2368622 - DNA, 17 bp, Homo sapiens
acccactgcatgcagaa

SEQ ID NO: 2368623 - DNA, 17 bp, Homo sapiens
acccactgtccgcctct

SEQ ID NO: 2368624 - DNA, 19 bp, Homo sapiens
acccactgtccgcctctgc

SEQ ID NO: 2368625 - DNA, 19 bp, Homo sapiens
acccagacataaaggaaaa

SEQ ID NO: 2368626 - DNA, 20 bp, Homo sapiens
acccagacataaaggaaaag

SEQ ID NO: 2368627 - DNA, 13 bp, Homo sapiens
acccagaggtgga

SEQ ID NO: 2368628 - DNA, 17 bp, Homo sapiens
acccagggactctccaa

SEQ ID NO: 2368629 - DNA, 18 bp, Homo sapiens
acccagggactctccaaa

SEQ ID NO: 2368630 - DNA, 21 bp, Homo sapiens
acccagggctccctcctggag

SEQ ID NO: 2368631 - DNA, 18 bp, Homo sapiens
acccaggggaaggccctg

SEQ ID NO: 2368632 - DNA, 15 bp, Homo sapiens
acccagtagcccaga

SEQ ID NO: 2368633 - DNA, 14 bp, Homo sapiens
acccatacaccccc

SEQ ID NO: 2368634 - DNA, 17 bp, Homo sapiens
acccatcagaaaaagca

SEQ ID NO: 2368635 - DNA, 23 bp, Homo sapiens
acccatcagaaaaagcatactgc

SEQ ID NO: 2368636 - DNA, 21 bp, Homo sapiens
acccattaaggggaagaatga

SEQ ID NO: 2368637 - DNA, 17 bp, Homo sapiens
acccattgttgtcaagg

SEQ ID NO: 2368638 - DNA, 18 bp, Homo sapiens
acccattgttgtcaagga

SEQ ID NO: 2368639 - DNA, 13 bp, Homo sapiens
accccaacctgct

SEQ ID NO: 2368640 - DNA, 18 bp, Homo sapiens
accccaacctgctctcct

SEQ ID NO: 2368641 - DNA, 13 bp, Homo sapiens
accccactcccac

SEQ ID NO: 2368642 - DNA, 14 bp, Homo sapiens
accccattcctgat

SEQ ID NO: 2368643 - DNA, 18 bp, Homo sapiens
acccccccccaatcggac

SEQ ID NO: 2368644 - DNA, 19 bp, Homo sapiens
acccccgtcctcttcgaga

SEQ ID NO: 2368645 - DNA, 20 bp, Homo sapiens
accccctcttctgagcacag

SEQ ID NO: 2368646 - DNA, 21 bp, Homo sapiens
accccctcttctgagcacaga

SEQ ID NO: 2368647 - DNA, 13 bp, Homo sapiens
accccctgccctg

SEQ ID NO: 2368648 - DNA, 15 bp, Homo sapiens
accccggggaccctg

SEQ ID NO: 2368649 - DNA, 17 bp, Homo sapiens
accccggggaccctgtg

SEQ ID NO: 2368650 - DNA, 10 bp, Homo sapiens
acccctgccc

SEQ ID NO: 2368651 - DNA, 12 bp, Homo sapiens
acccctgccccc

SEQ ID NO: 2368652 - DNA, 12 bp, Homo sapiens
acccctggaaga

SEQ ID NO: 2368653 - DNA, 19 bp, Homo sapiens
acccctggaagagcccagt

SEQ ID NO: 2368654 - DNA, 22 bp, Homo sapiens
acccctgtgctcccctgccaca

SEQ ID NO: 2368655 - DNA, 20 bp, Homo sapiens
accccttccagatcactgcc

SEQ ID NO: 2368656 - DNA, 14 bp, Homo sapiens
acctgccctcaagg

SEQ ID NO: 2368657 - DNA, 15 bp, Homo sapiens
acctgccctcaaggg

SEQ ID NO: 2368658 - DNA, 17 bp, Homo sapiens
acctgccctcaagggtg

SEQ ID NO: 2368659 - DNA, 17 bp, Homo sapiens
acctgctctcctcttct

SEQ ID NO: 2368660 - DNA, 18 bp, Homo sapiens
acctgctgacctgtgcac

SEQ ID NO: 2368661 - DNA, 16 bp, Homo sapiens
acctggctctcacctc

SEQ ID NO: 2368662 - DNA, 19 bp, Homo sapiens
acctggctgaggttcctct

SEQ ID NO: 2368663 - DNA, 23 bp, Homo sapiens
acctggctgaggttcctctgcct

SEQ ID NO: 2368664 - DNA, 23 bp, Homo sapiens
acctgggcactccgcgccgatgc

SEQ ID NO: 2368665 - DNA, 17 bp, Homo sapiens
acctgttacctactttg

SEQ ID NO: 2368666 - DNA, 13 bp, Homo sapiens
acctgttttctga

SEQ ID NO: 2368667 - DNA, 14 bp, Homo sapiens
acctgttttctgaa

SEQ ID NO: 2368668 - DNA, 21 bp, Homo sapiens
accttactgtggaggaaggat

SEQ ID NO: 2368669 - DNA, 15 bp, Homo sapiens
accttcctgtccctg

SEQ ID NO: 2368670 - DNA, 24 bp, Homo sapiens
accttcctgtgggtgttctttcct

SEQ ID NO: 2368671 - DNA, 11 bp, Homo sapiens
accttggaagg

SEQ ID NO: 2368672 - DNA, 22 bp, Homo sapiens
accttggggccttgatgactgc

SEQ ID NO: 2368673 - DNA, 19 bp, Homo sapiens
accttgtataaattattca

SEQ ID NO: 2368674 - DNA, 12 bp, Homo sapiens
accttgtgtctg

SEQ ID NO: 2368675 - DNA, 15 bp, Homo sapiens
accttgtgtctgtac

SEQ ID NO: 2368676 - DNA, 20 bp, Homo sapiens
acctttgagtagatccattt

SEQ ID NO: 2368677 - DNA, 19 bp, Homo sapiens
acctttgggttctttctgg

SEQ ID NO: 2368678 - DNA, 15 bp, Homo sapiens
accttttcagggctg

SEQ ID NO: 2368679 - DNA, 20 bp, Homo sapiens
accttttctgtggctggctc

SEQ ID NO: 2368680 - DNA, 15 bp, Homo sapiens
accttttttaagatt

SEQ ID NO: 2368681 - DNA, 24 bp, Homo sapiens
acctttttttatcgtttttgtatt

SEQ ID NO: 2368682 - DNA, 13 bp, Homo sapiens
acgactcttcctg

SEQ ID NO: 2368683 - DNA, 16 bp, Homo sapiens
acgactcttcctgcaa

SEQ ID NO: 2368684 - DNA, 12 bp, Homo sapiens
acgagccacaag

SEQ ID NO: 2368685 - DNA, 17 bp, Homo sapiens
acgagccacaagctgca

SEQ ID NO: 2368686 - DNA, 19 bp, Homo sapiens
acgagccacaagctgcact

SEQ ID NO: 2368687 - DNA, 14 bp, Homo sapiens
acgatgcatttaat

SEQ ID NO: 2368688 - DNA, 11 bp, Homo sapiens
acgattctccc

SEQ ID NO: 2368689 - DNA, 22 bp, Homo sapiens
acgatttgcaggattcccttct

SEQ ID NO: 2368690 - DNA, 17 bp, Homo sapiens
acgcagtgcctggagtt

SEQ ID NO: 2368691 - DNA, 18 bp, Homo sapiens
acgcccttcaatgctgca

SEQ ID NO: 2368692 - DNA, 22 bp, Homo sapiens
acgcctgcaggagagagcagca

SEQ ID NO: 2368693 - DNA, 16 bp, Homo sapiens
acgcgtgccgtggcac

SEQ ID NO: 2368694 - DNA, 14 bp, Homo sapiens
acgctcgctgccat

SEQ ID NO: 2368695 - DNA, 13 bp, Homo sapiens
acgcttctccgga

SEQ ID NO: 2368696 - DNA, 17 bp, Homo sapiens
acgcttgtgacagtgcc

SEQ ID NO: 2368697 - DNA, 16 bp, Homo sapiens
acggaaacatacagag

SEQ ID NO: 2368698 - DNA, 20 bp, Homo sapiens
acggaagccccctcttcctc

SEQ ID NO: 2368699 - DNA, 20 bp, Homo sapiens
acggcaggctcactgccagg

SEQ ID NO: 2368700 - DNA, 22 bp, Homo sapiens
acggcaggctcactgccaggcc

SEQ ID NO: 2368701 - DNA, 12 bp, Homo sapiens
acggctcctcag

SEQ ID NO: 2368702 - DNA, 13 bp, Homo sapiens
acgggtggtcccc

SEQ ID NO: 2368703 - DNA, 14 bp, Homo sapiens
acgggtggtccccg

SEQ ID NO: 2368704 - DNA, 14 bp, Homo sapiens
acggtaagtgttct

SEQ ID NO: 2368705 - DNA, 12 bp, Homo sapiens
acggttcctggt

SEQ ID NO: 2368706 - DNA, 12 bp, Homo sapiens
acgtcatgtatt

SEQ ID NO: 2368707 - DNA, 18 bp, Homo sapiens
acgtccgtgtgtcccaga

SEQ ID NO: 2368708 - DNA, 14 bp, Homo sapiens
acgtgaagaaataa

SEQ ID NO: 2368709 - DNA, 18 bp, Homo sapiens
acgtggcctccgcagtgt

SEQ ID NO: 2368710 - DNA, 21 bp, Homo sapiens
acgttgccaggggcttgagaa

SEQ ID NO: 2368711 - DNA, 14 bp, Homo sapiens
acgtttataaacag

SEQ ID NO: 2368712 - DNA, 10 bp, Homo sapiens
acgtttcttt

SEQ ID NO: 2368713 - DNA, 12 bp, Homo sapiens
acgttttcttct

SEQ ID NO: 2368714 - DNA, 13 bp, Homo sapiens
acgttttcttctt

SEQ ID NO: 2368715 - DNA, 16 bp, Homo sapiens
acgttttcttctttcc

SEQ ID NO: 2368716 - DNA, 19 bp, Homo sapiens
acgttttcttctttccctg

SEQ ID NO: 2368717 - DNA, 17 bp, Homo sapiens
actaaaaagtataaaat

SEQ ID NO: 2368718 - DNA, 13 bp, Homo sapiens
actaaaaatattg

SEQ ID NO: 2368719 - DNA, 21 bp, Homo sapiens
actaaaaatattgtttctgca

SEQ ID NO: 2368720 - DNA, 18 bp, Homo sapiens
actaaaacttgaggcaga

SEQ ID NO: 2368721 - DNA, 13 bp, Homo sapiens
actaaacatgtat

SEQ ID NO: 2368722 - DNA, 16 bp, Homo sapiens
actaaacatgtatgta

SEQ ID NO: 2368723 - DNA, 12 bp, Homo sapiens
actaaagagaga

SEQ ID NO: 2368724 - DNA, 20 bp, Homo sapiens
actaaattcgtgattttcaa

SEQ ID NO: 2368725 - DNA, 13 bp, Homo sapiens
actaaattttaaa

SEQ ID NO: 2368726 - DNA, 14 bp, Homo sapiens
actaacagtaactg

SEQ ID NO: 2368727 - DNA, 15 bp, Homo sapiens
actaacagtaactgc

SEQ ID NO: 2368728 - DNA, 22 bp, Homo sapiens
actaacgaaatatcaaagtcat

SEQ ID NO: 2368729 - DNA, 17 bp, Homo sapiens
actaagccaggcctggc

SEQ ID NO: 2368730 - DNA, 20 bp, Homo sapiens
actaagtttacttctcgaat

SEQ ID NO: 2368731 - DNA, 14 bp, Homo sapiens
actaataaaccagt

SEQ ID NO: 2368732 - DNA, 15 bp, Homo sapiens
actaataaaccagtt

SEQ ID NO: 2368733 - DNA, 21 bp, Homo sapiens
actaatgacaagtgacttatt

SEQ ID NO: 2368734 - DNA, 19 bp, Homo sapiens
actaatgccttactcttct

SEQ ID NO: 2368735 - DNA, 23 bp, Homo sapiens
actaatgccttactcttcttgaa

SEQ ID NO: 2368736 - DNA, 17 bp, Homo sapiens
actaatgctttttagaa

SEQ ID NO: 2368737 - DNA, 19 bp, Homo sapiens
actaatgtttgaacaaagc

SEQ ID NO: 2368738 - DNA, 21 bp, Homo sapiens
actacaccttgccttgctgtt

SEQ ID NO: 2368739 - DNA, 18 bp, Homo sapiens
actacatctgatatcagg

SEQ ID NO: 2368740 - DNA, 21 bp, Homo sapiens
actacatgcataaactaaaaa

SEQ ID NO: 2368741 - DNA, 19 bp, Homo sapiens
actacccatagacatgaaa

SEQ ID NO: 2368742 - DNA, 16 bp, Homo sapiens
actactgaataatgct

SEQ ID NO: 2368743 - DNA, 11 bp, Homo sapiens
actagcaggca

SEQ ID NO: 2368744 - DNA, 14 bp, Homo sapiens
actaggctgagcaa

SEQ ID NO: 2368745 - DNA, 21 bp, Homo sapiens
actatataatttatttccact

SEQ ID NO: 2368746 - DNA, 22 bp, Homo sapiens
actatggtgctgccttgcttct

SEQ ID NO: 2368747 - DNA, 10 bp, Homo sapiens
actatggtgt

SEQ ID NO: 2368748 - DNA, 21 bp, Homo sapiens
actatgttcctaacaaaatga

SEQ ID NO: 2368749 - DNA, 23 bp, Homo sapiens
actattgtgctcagagacactgt

SEQ ID NO: 2368750 - DNA, 21 bp, Homo sapiens
actcaaactgaggaatttcac

SEQ ID NO: 2368751 - DNA, 23 bp, Homo sapiens
actcaaactgaggaatttcacct

SEQ ID NO: 2368752 - DNA, 15 bp, Homo sapiens
actcaaatacacatt

SEQ ID NO: 2368753 - DNA, 14 bp, Homo sapiens
actcaaattttggc

SEQ ID NO: 2368754 - DNA, 13 bp, Homo sapiens
actcaaattttgt

SEQ ID NO: 2368755 - DNA, 20 bp, Homo sapiens
actcaccagccccactgcca

SEQ ID NO: 2368756 - DNA, 16 bp, Homo sapiens
actcacctaatgttta

SEQ ID NO: 2368757 - DNA, 23 bp, Homo sapiens
actcacctaatgtttatgagcca

SEQ ID NO: 2368758 - DNA, 15 bp, Homo sapiens
actcacttttcccac

SEQ ID NO: 2368759 - DNA, 19 bp, Homo sapiens
actcagatctgatcaagag

SEQ ID NO: 2368760 - DNA, 18 bp, Homo sapiens
actcatagacactgatct

SEQ ID NO: 2368761 - DNA, 16 bp, Homo sapiens
actcatcctcttttaa

SEQ ID NO: 2368762 - DNA, 22 bp, Homo sapiens
actcatcttagtgcctgagagt

SEQ ID NO: 2368763 - DNA, 14 bp, Homo sapiens
actcatgaggaggg

SEQ ID NO: 2368764 - DNA, 18 bp, Homo sapiens
actcatttatctcctctt

SEQ ID NO: 2368765 - DNA, 13 bp, Homo sapiens
actccaaaatgtt

SEQ ID NO: 2368766 - DNA, 17 bp, Homo sapiens
actccaagcccagccca

SEQ ID NO: 2368767 - DNA, 18 bp, Homo sapiens
actccaagcccagcccat

SEQ ID NO: 2368768 - DNA, 19 bp, Homo sapiens
actccagggacacacagcc

SEQ ID NO: 2368769 - DNA, 18 bp, Homo sapiens
actccatatttatttaaa

SEQ ID NO: 2368770 - DNA, 17 bp, Homo sapiens
actccctgcagatgcca

SEQ ID NO: 2368771 - DNA, 17 bp, Homo sapiens
actgtggttttgactta

SEQ ID NO: 2368772 - DNA, 16 bp, Homo sapiens
actgtgtattccaaga

SEQ ID NO: 2368773 - DNA, 14 bp, Homo sapiens
actgtgttgccaca

SEQ ID NO: 2368774 - DNA, 20 bp, Homo sapiens
actgttgctttgaaaaatct

SEQ ID NO: 2368775 - DNA, 22 bp, Homo sapiens
actgttgctttgaaaaatctca

SEQ ID NO: 2368776 - DNA, 13 bp, Homo sapiens
actgtttcctggg

SEQ ID NO: 2368777 - DNA, 17 bp, Homo sapiens
actgtttctcttgagct

SEQ ID NO: 2368778 - DNA, 21 bp, Homo sapiens
actgtttctcttgagctggcc

SEQ ID NO: 2368779 - DNA, 23 bp, Homo sapiens
actgtttctcttgagctggcctc

SEQ ID NO: 2368780 - DNA, 20 bp, Homo sapiens
actgtttgctgatccccaac

SEQ ID NO: 2368781 - DNA, 21 bp, Homo sapiens
acttaactgtccgtaagcagt

SEQ ID NO: 2368782 - DNA, 14 bp, Homo sapiens
acttaagaaagcaa

SEQ ID NO: 2368783 - DNA, 17 bp, Homo sapiens
acttaagaaagcaaaac

SEQ ID NO: 2368784 - DNA, 17 bp, Homo sapiens
acttaagaatacacagg

SEQ ID NO: 2368785 - DNA, 19 bp, Homo sapiens
acttaattgccagcaaata

SEQ ID NO: 2368786 - DNA, 20 bp, Homo sapiens
acttagcctttacctgtgaa

SEQ ID NO: 2368787 - DNA, 15 bp, Homo sapiens
acttattgaccattt

SEQ ID NO: 2368788 - DNA, 23 bp, Homo sapiens
acttatttgctcataagtaaatg

SEQ ID NO: 2368789 - DNA, 12 bp, Homo sapiens
acttccaccttg

SEQ ID NO: 2368790 - DNA, 14 bp, Homo sapiens
acttccatgcctta

SEQ ID NO: 2368791 - DNA, 16 bp, Homo sapiens
acttctacctgccctc

SEQ ID NO: 2368792 - DNA, 17 bp, Homo sapiens
acttctacctgccctca

SEQ ID NO: 2368793 - DNA, 13 bp, Homo sapiens
acttctcaagtaa

SEQ ID NO: 2368794 - DNA, 19 bp, Homo sapiens
acttctcgaattgaagcaa

SEQ ID NO: 2368795 - DNA, 24 bp, Homo sapiens
acttctgcaacaagcatgcagctt

SEQ ID NO: 2368796 - DNA, 17 bp, Homo sapiens
acttctgggcttcatct

SEQ ID NO: 2368797 - DNA, 19 bp, Homo sapiens
acttctgggcttcatctgg

SEQ ID NO: 2368798 - DNA, 22 bp, Homo sapiens
acttctgggcttcatctggcaa

SEQ ID NO: 2368799 - DNA, 14 bp, Homo sapiens
acttcttctccatc

SEQ ID NO: 2368800 - DNA, 17 bp, Homo sapiens
acttcttctccatccct

SEQ ID NO: 2368801 - DNA, 18 bp, Homo sapiens
acttcttgaaacagcctg

SEQ ID NO: 2368802 - DNA, 18 bp, Homo sapiens
acttgaggcagagtcttc

SEQ ID NO: 2368803 - DNA, 21 bp, Homo sapiens
acttgcgagtccaaggccagt

SEQ ID NO: 2368804 - DNA, 14 bp, Homo sapiens
acttgctgtccagg

SEQ ID NO: 2368805 - DNA, 16 bp, Homo sapiens
acttgctgtccaggca

SEQ ID NO: 2368806 - DNA, 17 bp, Homo sapiens
acttgctgtccaggcag

SEQ ID NO: 2368807 - DNA, 21 bp, Homo sapiens
acttgctgtgtgaccctgggc

SEQ ID NO: 2368808 - DNA, 18 bp, Homo sapiens
acttgcttaaatttctta

SEQ ID NO: 2368809 - DNA, 22 bp, Homo sapiens
acttgctttaccttttcagggc

SEQ ID NO: 2368810 - DNA, 15 bp, Homo sapiens
acttggattcaattt

SEQ ID NO: 2368811 - DNA, 18 bp, Homo sapiens
acttggattcaattttaa

SEQ ID NO: 2368812 - DNA, 13 bp, Homo sapiens
acttggttttatg

SEQ ID NO: 2368813 - DNA, 13 bp, Homo sapiens
acttgtggcctca

SEQ ID NO: 2368814 - DNA, 11 bp, Homo sapiens
acttgtgtctg

SEQ ID NO: 2368815 - DNA, 16 bp, Homo sapiens
acttgttatgttgtaa

SEQ ID NO: 2368816 - DNA, 18 bp, Homo sapiens
acttgttttggatggctt

SEQ ID NO: 2368817 - DNA, 13 bp, Homo sapiens
actttaattatat

SEQ ID NO: 2368818 - DNA, 13 bp, Homo sapiens
actttactttcaa

SEQ ID NO: 2368819 - DNA, 18 bp, Homo sapiens
actttatcatgaatgctt

SEQ ID NO: 2368820 - DNA, 17 bp, Homo sapiens
actttattaagtaaaat

SEQ ID NO: 2368821 - DNA, 22 bp, Homo sapiens
actttattgctatcgccctcct

SEQ ID NO: 2368822 - DNA, 11 bp, Homo sapiens
actttcaaaat

SEQ ID NO: 2368823 - DNA, 16 bp, Homo sapiens
actttcaaaatgaatt

SEQ ID NO: 2368824 - DNA, 11 bp, Homo sapiens
actttcacttc

SEQ ID NO: 2368825 - DNA, 16 bp, Homo sapiens
actttcccacactgtg

SEQ ID NO: 2368826 - DNA, 18 bp, Homo sapiens
actttctcagttttcata

SEQ ID NO: 2368827 - DNA, 14 bp, Homo sapiens
actttgaagggcaa

SEQ ID NO: 2368828 - DNA, 15 bp, Homo sapiens
actttgactttttgc

SEQ ID NO: 2368829 - DNA, 21 bp, Homo sapiens
actttgactttttgcatttaa

SEQ ID NO: 2368830 - DNA, 21 bp, Homo sapiens
actttgggaggccgaggcggg

SEQ ID NO: 2368831 - DNA, 23 bp, Homo sapiens
actttggtagctgggaaagcata

SEQ ID NO: 2368832 - DNA, 13 bp, Homo sapiens
actttgtcccgct

SEQ ID NO: 2368833 - DNA, 18 bp, Homo sapiens
actttgtgttcatttcat

SEQ ID NO: 2368834 - DNA, 15 bp, Homo sapiens
actttgttgcaagat

SEQ ID NO: 2368835 - DNA, 21 bp, Homo sapiens
actttgttgcaagatgtgaat

SEQ ID NO: 2368836 - DNA, 22 bp, Homo sapiens
actttgttgcaagatgtgaatt

SEQ ID NO: 2368837 - DNA, 14 bp, Homo sapiens
acttttaaactgtg

SEQ ID NO: 2368838 - DNA, 15 bp, Homo sapiens
acttttaaactgtgt

SEQ ID NO: 2368839 - DNA, 17 bp, Homo sapiens
acttttaaactgtgtac

SEQ ID NO: 2368840 - DNA, 20 bp, Homo sapiens
acttttaaactgtgtacata

SEQ ID NO: 2368841 - DNA, 19 bp, Homo sapiens
acttttaaggataaatcat

SEQ ID NO: 2368842 - DNA, 20 bp, Homo sapiens
acttttaaggataaatcata

SEQ ID NO: 2368843 - DNA, 19 bp, Homo sapiens
acttttccaagcaaaatct

SEQ ID NO: 2368844 - DNA, 14 bp, Homo sapiens
acttttcccactcc

SEQ ID NO: 2368845 - DNA, 16 bp, Homo sapiens
acttttcttaaacctt

SEQ ID NO: 2368846 - DNA, 13 bp, Homo sapiens
acttttgaaaaga

SEQ ID NO: 2368847 - DNA, 17 bp, Homo sapiens
acttttgtactgaattt

SEQ ID NO: 2368848 - DNA, 20 bp, Homo sapiens
acttttgttagggctgcttt

SEQ ID NO: 2368849 - DNA, 16 bp, Homo sapiens
actttttttgtatgtg

SEQ ID NO: 2368850 - DNA, 23 bp, Homo sapiens
agaaaaaaaagtgtctcaaagga

SEQ ID NO: 2368851 - DNA, 17 bp, Homo sapiens
agaaaaaagaaaaatct

SEQ ID NO: 2368852 - DNA, 19 bp, Homo sapiens
agaaaaaagaaaaatctca

SEQ ID NO: 2368853 - DNA, 16 bp, Homo sapiens
agaaaaataaaatgtt

SEQ ID NO: 2368854 - DNA, 21 bp, Homo sapiens
agaaaagaaatggtatgtaga

SEQ ID NO: 2368855 - DNA, 12 bp, Homo sapiens
agaaaagtgaat

SEQ ID NO: 2368856 - DNA, 15 bp, Homo sapiens
agaaaagtgaattga

SEQ ID NO: 2368857 - DNA, 16 bp, Homo sapiens
agaaaataaattccaa

SEQ ID NO: 2368858 - DNA, 13 bp, Homo sapiens
agaaacaaacatc

SEQ ID NO: 2368859 - DNA, 21 bp, Homo sapiens
agaaacaaagggttttctttt

SEQ ID NO: 2368860 - DNA, 15 bp, Homo sapiens
agaaacactgaaaag

SEQ ID NO: 2368861 - DNA, 17 bp, Homo sapiens
agaaacactgaaaagaa

SEQ ID NO: 2368862 - DNA, 15 bp, Homo sapiens
agaaacatctctggc

SEQ ID NO: 2368863 - DNA, 20 bp, Homo sapiens
agaaacatctctggcccaga

SEQ ID NO: 2368864 - DNA, 14 bp, Homo sapiens
agaaactacaaata

SEQ ID NO: 2368865 - DNA, 17 bp, Homo sapiens
agaaactacaaatatag

SEQ ID NO: 2368866 - DNA, 19 bp, Homo sapiens
agaaactttgatctctgct

SEQ ID NO: 2368867 - DNA, 14 bp, Homo sapiens
agaaagaagccata

SEQ ID NO: 2368868 - DNA, 16 bp, Homo sapiens
agaaagatttgatggg

SEQ ID NO: 2368869 - DNA, 19 bp, Homo sapiens
agaaagatttgatgggcca

SEQ ID NO: 2368870 - DNA, 18 bp, Homo sapiens
agaaagcctaaaattgag

SEQ ID NO: 2368871 - DNA, 19 bp, Homo sapiens
agaaagcctctctctccct

SEQ ID NO: 2368872 - DNA, 21 bp, Homo sapiens
agaaagggtgccagttgggct

SEQ ID NO: 2368873 - DNA, 22 bp, Homo sapiens
agaaaggtgagtttgagctgcc

SEQ ID NO: 2368874 - DNA, 23 bp, Homo sapiens
agaaaggtgagtttgagctgcct

SEQ ID NO: 2368875 - DNA, 13 bp, Homo sapiens
agaaataaaccaa

SEQ ID NO: 2368876 - DNA, 14 bp, Homo sapiens
agaaataaaccaaa

SEQ ID NO: 2368877 - DNA, 17 bp, Homo sapiens
agaaataaatgaaactt

SEQ ID NO: 2368878 - DNA, 19 bp, Homo sapiens
agaaataagtgccctctcc

SEQ ID NO: 2368879 - DNA, 19 bp, Homo sapiens
agaaataatgctacaattt

SEQ ID NO: 2368880 - DNA, 17 bp, Homo sapiens
agaaatagacaaaaagt

SEQ ID NO: 2368881 - DNA, 16 bp, Homo sapiens
agaaatataacacatt

SEQ ID NO: 2368882 - DNA, 13 bp, Homo sapiens
agaaatgcatatt

SEQ ID NO: 2368883 - DNA, 14 bp, Homo sapiens
agaaatgctgctgg

SEQ ID NO: 2368884 - DNA, 15 bp, Homo sapiens
agaaatgctgctggc

SEQ ID NO: 2368885 - DNA, 22 bp, Homo sapiens
agaaatggcgtctgctctggtg

SEQ ID NO: 2368886 - DNA, 12 bp, Homo sapiens
agaccagaaatt

SEQ ID NO: 2368887 - DNA, 13 bp, Homo sapiens
agaccagtactgg

SEQ ID NO: 2368888 - DNA, 19 bp, Homo sapiens
agacccccatttgtcccag

SEQ ID NO: 2368889 - DNA, 13 bp, Homo sapiens
agacccctttgag

SEQ ID NO: 2368890 - DNA, 14 bp, Homo sapiens
agaccctcttgccc

SEQ ID NO: 2368891 - DNA, 17 bp, Homo sapiens
agaccctgccacagcca

SEQ ID NO: 2368892 - DNA, 19 bp, Homo sapiens
agaccctgccacagccaga

SEQ ID NO: 2368893 - DNA, 19 bp, Homo sapiens
agaccctgggtgggctctg

SEQ ID NO: 2368894 - DNA, 22 bp, Homo sapiens
agaccctgggtgggctctgtgc

SEQ ID NO: 2368895 - DNA, 21 bp, Homo sapiens
agacccttattgctgtcctgg

SEQ ID NO: 2368896 - DNA, 22 bp, Homo sapiens
agacccttattgctgtcctgga

SEQ ID NO: 2368897 - DNA, 15 bp, Homo sapiens
agaccgagaggccag

SEQ ID NO: 2368898 - DNA, 15 bp, Homo sapiens
agaccgatcggcggc

SEQ ID NO: 2368899 - DNA, 17 bp, Homo sapiens
agaccgggccctgggtt

SEQ ID NO: 2368900 - DNA, 19 bp, Homo sapiens
agaccgtgatttggaagag

SEQ ID NO: 2368901 - DNA, 18 bp, Homo sapiens
agacctgggatttgagat

SEQ ID NO: 2368902 - DNA, 16 bp, Homo sapiens
agacggaggggagtag

SEQ ID NO: 2368903 - DNA, 15 bp, Homo sapiens
agacgttgcctgaga

SEQ ID NO: 2368904 - DNA, 15 bp, Homo sapiens
agactaaaggatcca

SEQ ID NO: 2368905 - DNA, 21 bp, Homo sapiens
agactatatatataaatgtat

SEQ ID NO: 2368906 - DNA, 21 bp, Homo sapiens
agactctttttttgagtgaca

SEQ ID NO: 2368907 - DNA, 23 bp, Homo sapiens
agactctttttttgagtgacagc

SEQ ID NO: 2368908 - DNA, 21 bp, Homo sapiens
agactgccccacggagacaga

SEQ ID NO: 2368909 - DNA, 22 bp, Homo sapiens
agactgccccacggagacagag

SEQ ID NO: 2368910 - DNA, 17 bp, Homo sapiens
agactgcgttctgcaag

SEQ ID NO: 2368911 - DNA, 14 bp, Homo sapiens
agactggttttctg

SEQ ID NO: 2368912 - DNA, 15 bp, Homo sapiens
agactggttttctgc

SEQ ID NO: 2368913 - DNA, 13 bp, Homo sapiens
agactgtgcaata

SEQ ID NO: 2368914 - DNA, 14 bp, Homo sapiens
agactgtgcaatac

SEQ ID NO: 2368915 - DNA, 14 bp, Homo sapiens
agactgttgagtta

SEQ ID NO: 2368916 - DNA, 18 bp, Homo sapiens
agactgtttgaatgtttt

SEQ ID NO: 2368917 - DNA, 18 bp, Homo sapiens
agacttgagacaatgttt

SEQ ID NO: 2368918 - DNA, 20 bp, Homo sapiens
agacttgggatggggaggga

SEQ ID NO: 2368919 - DNA, 17 bp, Homo sapiens
agagaaaataaattcca

SEQ ID NO: 2368920 - DNA, 14 bp, Homo sapiens
agagaatgtatttg

SEQ ID NO: 2368921 - DNA, 21 bp, Homo sapiens
agagaatgttcctactcacac

SEQ ID NO: 2368922 - DNA, 16 bp, Homo sapiens
agagaattgaaatgag

SEQ ID NO: 2368923 - DNA, 20 bp, Homo sapiens
agagacaagtaatttcagtg

SEQ ID NO: 2368924 - DNA, 20 bp, Homo sapiens
agagacactgttgataaaaa

SEQ ID NO: 2368925 - DNA, 16 bp, Homo sapiens
agagacagaggatgtg

SEQ ID NO: 2368926 - DNA, 20 bp, Homo sapiens
agagacaggcagcccagcag

SEQ ID NO: 2368927 - DNA, 12 bp, Homo sapiens
agagacatttca

SEQ ID NO: 2368928 - DNA, 18 bp, Homo sapiens
agagacgccactccctgg

SEQ ID NO: 2368929 - DNA, 18 bp, Homo sapiens
agagactgcgttctgcaa

SEQ ID NO: 2368930 - DNA, 19 bp, Homo sapiens
agagactgtttgaatgttt

SEQ ID NO: 2368931 - DNA, 15 bp, Homo sapiens
agagagagagagagg

SEQ ID NO: 2368932 - DNA, 15 bp, Homo sapiens
agagagagaggacag

SEQ ID NO: 2368933 - DNA, 20 bp, Homo sapiens
agagaggcgcgtctgcccca

SEQ ID NO: 2368934 - DNA, 20 bp, Homo sapiens
agagatccctgcagaaccca

SEQ ID NO: 2368935 - DNA, 19 bp, Homo sapiens
agagatgggaatgaggtgg

SEQ ID NO: 2368936 - DNA, 20 bp, Homo sapiens
agagcaaaagcctcagaaag

SEQ ID NO: 2368937 - DNA, 19 bp, Homo sapiens
agagcaagtcctcactctt

SEQ ID NO: 2368938 - DNA, 15 bp, Homo sapiens
agagcagatgcagag

SEQ ID NO: 2368939 - DNA, 19 bp, Homo sapiens
agagcagatgcagagagcc

SEQ ID NO: 2368940 - DNA, 22 bp, Homo sapiens
agagcagctccctttctcagga

SEQ ID NO: 2368941 - DNA, 11 bp, Homo sapiens
agagcagctgg

SEQ ID NO: 2368942 - DNA, 21 bp, Homo sapiens
agagcagttggccaagcagaa

SEQ ID NO: 2368943 - DNA, 18 bp, Homo sapiens
agagcataatttaaaaat

SEQ ID NO: 2368944 - DNA, 23 bp, Homo sapiens
agagcataatttaaaaatatatt

SEQ ID NO: 2368945 - DNA, 18 bp, Homo sapiens
agagccacctgcaagatg

SEQ ID NO: 2368946 - DNA, 19 bp, Homo sapiens
agagccacctgcaagatgg

SEQ ID NO: 2368947 - DNA, 13 bp, Homo sapiens
agagccagcttgg

SEQ ID NO: 2368948 - DNA, 13 bp, Homo sapiens
agagccatacata

SEQ ID NO: 2368949 - DNA, 20 bp, Homo sapiens
agagccatacataaaagaaa

SEQ ID NO: 2368950 - DNA, 17 bp, Homo sapiens
agagccattttgtgaat

SEQ ID NO: 2368951 - DNA, 20 bp, Homo sapiens
agagcccagaggtaacagaa

SEQ ID NO: 2368952 - DNA, 22 bp, Homo sapiens
agagcccagaggtaacagaaca

SEQ ID NO: 2368953 - DNA, 16 bp, Homo sapiens
agagccccaagcagga

SEQ ID NO: 2368954 - DNA, 18 bp, Homo sapiens
agagccctgaggcctaga

SEQ ID NO: 2368955 - DNA, 22 bp, Homo sapiens
agagccctgaggcctagactct

SEQ ID NO: 2368956 - DNA, 19 bp, Homo sapiens
agagccggcccgcctctcc

SEQ ID NO: 2368957 - DNA, 21 bp, Homo sapiens
agagccggcccgcctctcctc

SEQ ID NO: 2368958 - DNA, 21 bp, Homo sapiens
agagccgtggtccctgaggat

SEQ ID NO: 2368959 - DNA, 13 bp, Homo sapiens
agagcctgctggc

SEQ ID NO: 2368960 - DNA, 15 bp, Homo sapiens
agagcctggccccag

SEQ ID NO: 2368961 - DNA, 16 bp, Homo sapiens
agagcctggccccagg

SEQ ID NO: 2368962 - DNA, 16 bp, Homo sapiens
agagccttctcagaag

SEQ ID NO: 2368963 - DNA, 18 bp, Homo sapiens
agagccttctcagaagca

SEQ ID NO: 2368964 - DNA, 13 bp, Homo sapiens
agagcgccaggaa

SEQ ID NO: 2368965 - DNA, 18 bp, Homo sapiens
agagcgccaggaagccag

SEQ ID NO: 2368966 - DNA, 20 bp, Homo sapiens
agagcgccaggaagccagag

SEQ ID NO: 2368967 - DNA, 17 bp, Homo sapiens
agagctagaaaaataaa

SEQ ID NO: 2368968 - DNA, 20 bp, Homo sapiens
agagctagaaaaataaaatg

SEQ ID NO: 2368969 - DNA, 16 bp, Homo sapiens
agagctagctgccact

SEQ ID NO: 2368970 - DNA, 23 bp, Homo sapiens
agagctagctgccactttcacgt

SEQ ID NO: 2368971 - DNA, 15 bp, Homo sapiens
agagctggagccccc

SEQ ID NO: 2368972 - DNA, 13 bp, Homo sapiens
agagcttgctcca

SEQ ID NO: 2368973 - DNA, 22 bp, Homo sapiens
agagcttgctccagattctgat

SEQ ID NO: 2368974 - DNA, 18 bp, Homo sapiens
agaggaaagggctggctc

SEQ ID NO: 2368975 - DNA, 18 bp, Homo sapiens
agaggaattacgtgctct

SEQ ID NO: 2368976 - DNA, 21 bp, Homo sapiens
agaggacctatcccaaatgtg

SEQ ID NO: 2368977 - DNA, 21 bp, Homo sapiens
agaggacgcacgctcgctgcc

SEQ ID NO: 2368978 - DNA, 23 bp, Homo sapiens
agaggacgcacgctcgctgccat

SEQ ID NO: 2368979 - DNA, 23 bp, Homo sapiens
agaggagcccccaccctgttcct

SEQ ID NO: 2368980 - DNA, 19 bp, Homo sapiens
agaggagtgcagccttctc

SEQ ID NO: 2368981 - DNA, 14 bp, Homo sapiens
agaggatgagagcc

SEQ ID NO: 2368982 - DNA, 17 bp, Homo sapiens
agaggatgagagcccag

SEQ ID NO: 2368983 - DNA, 18 bp, Homo sapiens
agaggatgagagcccaga

SEQ ID NO: 2368984 - DNA, 20 bp, Homo sapiens
agaggatgccttttctgtga

SEQ ID NO: 2368985 - DNA, 18 bp, Homo sapiens
agaggcaagctgaaattt

SEQ ID NO: 2368986 - DNA, 13 bp, Homo sapiens
agaggcacctgct

SEQ ID NO: 2368987 - DNA, 16 bp, Homo sapiens
agaggcacctgctgga

SEQ ID NO: 2368988 - DNA, 21 bp, Homo sapiens
agaggcactcagtgagcctcc

SEQ ID NO: 2368989 - DNA, 23 bp, Homo sapiens
agaggcactcagtgagcctcctg

SEQ ID NO: 2368990 - DNA, 18 bp, Homo sapiens
agaggcagtgatgacttg

SEQ ID NO: 2368991 - DNA, 14 bp, Homo sapiens
agaggccagttgat

SEQ ID NO: 2368992 - DNA, 16 bp, Homo sapiens
agaggcgcgtctgccc

SEQ ID NO: 2368993 - DNA, 18 bp, Homo sapiens
agaggcgcgtctgcccca

SEQ ID NO: 2368994 - DNA, 19 bp, Homo sapiens
agaggctagcttctgcttt

SEQ ID NO: 2368995 - DNA, 15 bp, Homo sapiens
agaggctctggacag

SEQ ID NO: 2368996 - DNA, 13 bp, Homo sapiens
agaggctgaaaga

SEQ ID NO: 2368997 - DNA, 23 bp, Homo sapiens
agaggctgcacccctgggccagc

SEQ ID NO: 2368998 - DNA, 20 bp, Homo sapiens
agaggcttctccgccagcct

SEQ ID NO: 2368999 - DNA, 22 bp, Homo sapiens
agaggcttctccgccagcctcc

SEQ ID NO: 2369000 - DNA, 19 bp, Homo sapiens
agcacaatttgcactaaat

SEQ ID NO: 2369001 - DNA, 14 bp, Homo sapiens
agcacagaatattt

SEQ ID NO: 2369002 - DNA, 12 bp, Homo sapiens
agcacagagcct

SEQ ID NO: 2369003 - DNA, 16 bp, Homo sapiens
agcacagagcctggcc

SEQ ID NO: 2369004 - DNA, 20 bp, Homo sapiens
agcacagagcctggccccag

SEQ ID NO: 2369005 - DNA, 17 bp, Homo sapiens
agcacaggaattctcaa

SEQ ID NO: 2369006 - DNA, 15 bp, Homo sapiens
agcacagtatttaac

SEQ ID NO: 2369007 - DNA, 16 bp, Homo sapiens
agcacagtattttgat

SEQ ID NO: 2369008 - DNA, 14 bp, Homo sapiens
agcaccacactggg

SEQ ID NO: 2369009 - DNA, 19 bp, Homo sapiens
agcaccgtgtcaagctgct

SEQ ID NO: 2369010 - DNA, 22 bp, Homo sapiens
agcaccgtgtcaagctgctctg

SEQ ID NO: 2369011 - DNA, 20 bp, Homo sapiens
agcacctccagcctgaacag

SEQ ID NO: 2369012 - DNA, 18 bp, Homo sapiens
agcaccttcagggctgag

SEQ ID NO: 2369013 - DNA, 22 bp, Homo sapiens
agcaccttcagggctgagttct

SEQ ID NO: 2369014 - DNA, 12 bp, Homo sapiens
agcactgagcaa

SEQ ID NO: 2369015 - DNA, 22 bp, Homo sapiens
agcacttgcaaccgtctgttat

SEQ ID NO: 2369016 - DNA, 22 bp, Homo sapiens
agcagaacaggtagtattacac

SEQ ID NO: 2369017 - DNA, 20 bp, Homo sapiens
agcagacctaaagcaagcct

SEQ ID NO: 2369018 - DNA, 22 bp, Homo sapiens
agcagacttctcggaattcata

SEQ ID NO: 2369019 - DNA, 15 bp, Homo sapiens
agcagaggcaggctg

SEQ ID NO: 2369020 - DNA, 17 bp, Homo sapiens
agcagaggcaggctggg

SEQ ID NO: 2369021 - DNA, 13 bp, Homo sapiens
agcagagttttca

SEQ ID NO: 2369022 - DNA, 15 bp, Homo sapiens
agcagagttttcatt

SEQ ID NO: 2369023 - DNA, 18 bp, Homo sapiens
agcagatctgttttgtgg

SEQ ID NO: 2369024 - DNA, 23 bp, Homo sapiens
agcagcactccgcatcacctcac

SEQ ID NO: 2369025 - DNA, 12 bp, Homo sapiens
agcagcagcagg

SEQ ID NO: 2369026 - DNA, 16 bp, Homo sapiens
agcagcagcaggtgat

SEQ ID NO: 2369027 - DNA, 19 bp, Homo sapiens
agcagcccaagcttccctc

SEQ ID NO: 2369028 - DNA, 13 bp, Homo sapiens
agcagcctctgga

SEQ ID NO: 2369029 - DNA, 15 bp, Homo sapiens
agcagctccctttct

SEQ ID NO: 2369030 - DNA, 22 bp, Homo sapiens
agcagctccctttctcaggagc

SEQ ID NO: 2369031 - DNA, 22 bp, Homo sapiens
agcagctggtcagtctttgctc

SEQ ID NO: 2369032 - DNA, 22 bp, Homo sapiens
agcagcttataatgggctctcc

SEQ ID NO: 2369033 - DNA, 21 bp, Homo sapiens
agcaggaatatatgtgtgcct

SEQ ID NO: 2369034 - DNA, 20 bp, Homo sapiens
agcaggcacgggtggtcccc

SEQ ID NO: 2369035 - DNA, 14 bp, Homo sapiens
agcagggacacccc

SEQ ID NO: 2369036 - DNA, 20 bp, Homo sapiens
agcaggtgattggaccaggc

SEQ ID NO: 2369037 - DNA, 20 bp, Homo sapiens
agcagtatatgttaatttgt

SEQ ID NO: 2369038 - DNA, 23 bp, Homo sapiens
agcagtgtgaatagcctggccac

SEQ ID NO: 2369039 - DNA, 20 bp, Homo sapiens
agcagtgtggagaccctgcc

SEQ ID NO: 2369040 - DNA, 13 bp, Homo sapiens
agcagttgttcca

SEQ ID NO: 2369041 - DNA, 13 bp, Homo sapiens
agcataaagctca

SEQ ID NO: 2369042 - DNA, 18 bp, Homo sapiens
agcataaagctcaaatga

SEQ ID NO: 2369043 - DNA, 23 bp, Homo sapiens
agcataaagctcaaatgaaatgt

SEQ ID NO: 2369044 - DNA, 20 bp, Homo sapiens
agcatcaccactcattttga

SEQ ID NO: 2369045 - DNA, 13 bp, Homo sapiens
agcatcccttccc

SEQ ID NO: 2369046 - DNA, 20 bp, Homo sapiens
agcatcccttcccacatgcc

SEQ ID NO: 2369047 - DNA, 19 bp, Homo sapiens
agcatgaaataaaatatat

SEQ ID NO: 2369048 - DNA, 15 bp, Homo sapiens
agcatgacagcctgc

SEQ ID NO: 2369049 - DNA, 20 bp, Homo sapiens
agcatgacagcctgcagcag

SEQ ID NO: 2369050 - DNA, 19 bp, Homo sapiens
agcatgcttcctttctctc

SEQ ID NO: 2369051 - DNA, 23 bp, Homo sapiens
agcatgcttcctttctctcctgg

SEQ ID NO: 2369052 - DNA, 14 bp, Homo sapiens
agcatggacattta

SEQ ID NO: 2369053 - DNA, 14 bp, Homo sapiens
agcatggtgtcagt

SEQ ID NO: 2369054 - DNA, 17 bp, Homo sapiens
agcatgtctattcagct

SEQ ID NO: 2369055 - DNA, 19 bp, Homo sapiens
agcatgtctattcagcttc

SEQ ID NO: 2369056 - DNA, 22 bp, Homo sapiens
agcattccctacagcctagggc

SEQ ID NO: 2369057 - DNA, 19 bp, Homo sapiens
agcattccttctttgataa

SEQ ID NO: 2369058 - DNA, 22 bp, Homo sapiens
agcattccttctttgataatgt

SEQ ID NO: 2369059 - DNA, 18 bp, Homo sapiens
agcattctgagctgggct

SEQ ID NO: 2369060 - DNA, 24 bp, Homo sapiens
agcattctttggagttaaaatgca

SEQ ID NO: 2369061 - DNA, 11 bp, Homo sapiens
agcatttcatg

SEQ ID NO: 2369062 - DNA, 20 bp, Homo sapiens
agcattttagaaactacaaa

SEQ ID NO: 2369063 - DNA, 20 bp, Homo sapiens
agcattttgggatccttcag

SEQ ID NO: 2369064 - DNA, 12 bp, Homo sapiens
agcatttttcaa

SEQ ID NO: 2369065 - DNA, 20 bp, Homo sapiens
agcatttttcaatatattga

SEQ ID NO: 2369066 - DNA, 23 bp, Homo sapiens
agccaaaagtccctccctgcctg

SEQ ID NO: 2369067 - DNA, 12 bp, Homo sapiens
agccaaaatcat

SEQ ID NO: 2369068 - DNA, 12 bp, Homo sapiens
agccaaagaaaa

SEQ ID NO: 2369069 - DNA, 18 bp, Homo sapiens
agccaacaactctgcctt

SEQ ID NO: 2369070 - DNA, 19 bp, Homo sapiens
agccaacaactctgccttt

SEQ ID NO: 2369071 - DNA, 14 bp, Homo sapiens
agccaagggaaagg

SEQ ID NO: 2369072 - DNA, 19 bp, Homo sapiens
agccaatatttactcatca

SEQ ID NO: 2369073 - DNA, 19 bp, Homo sapiens
agccacaagctgcactgtg

SEQ ID NO: 2369074 - DNA, 22 bp, Homo sapiens
agccacaagctgcactgtgaac

SEQ ID NO: 2369075 - DNA, 18 bp, Homo sapiens
agccacagctgctgttct

SEQ ID NO: 2369076 - DNA, 19 bp, Homo sapiens
agccacagctgctgttctc

SEQ ID NO: 2369077 - DNA, 16 bp, Homo sapiens
agccaccgtgcctggc

SEQ ID NO: 2369078 - DNA, 18 bp, Homo sapiens
agccaccgtgcctggcca

SEQ ID NO: 2369079 - DNA, 22 bp, Homo sapiens
agccaccgtgcctggccagatt

SEQ ID NO: 2369080 - DNA, 19 bp, Homo sapiens
agccacctgcaagatggac

SEQ ID NO: 2369081 - DNA, 17 bp, Homo sapiens
agccacgcagtgcctgg

SEQ ID NO: 2369082 - DNA, 18 bp, Homo sapiens
agccacgcagtgcctgga

SEQ ID NO: 2369083 - DNA, 13 bp, Homo sapiens
agccagaaagggt

SEQ ID NO: 2369084 - DNA, 20 bp, Homo sapiens
agccagacaaaatttgagaa

SEQ ID NO: 2369085 - DNA, 12 bp, Homo sapiens
agccagagcccc

SEQ ID NO: 2369086 - DNA, 18 bp, Homo sapiens
agccagcagcagcccaag

SEQ ID NO: 2369087 - DNA, 17 bp, Homo sapiens
agccagcccctcttccc

SEQ ID NO: 2369088 - DNA, 14 bp, Homo sapiens
agccagctgcccta

SEQ ID NO: 2369089 - DNA, 16 bp, Homo sapiens
agccagctttccctgc

SEQ ID NO: 2369090 - DNA, 22 bp, Homo sapiens
agccagctttccctgcctctca

SEQ ID NO: 2369091 - DNA, 14 bp, Homo sapiens
agccaggaggcctg

SEQ ID NO: 2369092 - DNA, 19 bp, Homo sapiens
agccaggaggcctgctagg

SEQ ID NO: 2369093 - DNA, 23 bp, Homo sapiens
agccaggatcatggtgtaataag

SEQ ID NO: 2369094 - DNA, 21 bp, Homo sapiens
agccaggcctggctggaggag

SEQ ID NO: 2369095 - DNA, 23 bp, Homo sapiens
agccagtggcgggtgatggccag

SEQ ID NO: 2369096 - DNA, 21 bp, Homo sapiens
agccagtgggccagccacaga

SEQ ID NO: 2369097 - DNA, 18 bp, Homo sapiens
agccatacataaaagaaa

SEQ ID NO: 2369098 - DNA, 10 bp, Homo sapiens
agccatagtg

SEQ ID NO: 2369099 - DNA, 20 bp, Homo sapiens
agccatatatgaccagaagc

SEQ ID NO: 2369100 - DNA, 21 bp, Homo sapiens
agccatatatgaccagaagcc

SEQ ID NO: 2369101 - DNA, 14 bp, Homo sapiens
agccatcctccctc

SEQ ID NO: 2369102 - DNA, 16 bp, Homo sapiens
agccatcctccctcca

SEQ ID NO: 2369103 - DNA, 22 bp, Homo sapiens
agccatcctccctccacctcaa

SEQ ID NO: 2369104 - DNA, 17 bp, Homo sapiens
agccatgccagctggcc

SEQ ID NO: 2369105 - DNA, 17 bp, Homo sapiens
agccatgtcttctccct

SEQ ID NO: 2369106 - DNA, 15 bp, Homo sapiens
agccattttgtgaat

SEQ ID NO: 2369107 - DNA, 17 bp, Homo sapiens
agccattttgtgaatgg

SEQ ID NO: 2369108 - DNA, 19 bp, Homo sapiens
agccattttgtgaatggat

SEQ ID NO: 2369109 - DNA, 20 bp, Homo sapiens
agcccagagactttgtagat

SEQ ID NO: 2369110 - DNA, 13 bp, Homo sapiens
agcccagaggtaa

SEQ ID NO: 2369111 - DNA, 15 bp, Homo sapiens
agcccagaggtaaca

SEQ ID NO: 2369112 - DNA, 16 bp, Homo sapiens
agcccagaggtaacag

SEQ ID NO: 2369113 - DNA, 21 bp, Homo sapiens
agcccagaggtaacagaacag

SEQ ID NO: 2369114 - DNA, 19 bp, Homo sapiens
aggactgagcaccctctgg

SEQ ID NO: 2369115 - DNA, 13 bp, Homo sapiens
aggagaggatgag

SEQ ID NO: 2369116 - DNA, 15 bp, Homo sapiens
aggagaggatgagag

SEQ ID NO: 2369117 - DNA, 17 bp, Homo sapiens
aggagaggatgagagcc

SEQ ID NO: 2369118 - DNA, 18 bp, Homo sapiens
aggagaggatgagagccc

SEQ ID NO: 2369119 - DNA, 20 bp, Homo sapiens
aggagaggatgagagcccag

SEQ ID NO: 2369120 - DNA, 16 bp, Homo sapiens
aggagatgggtccagg

SEQ ID NO: 2369121 - DNA, 14 bp, Homo sapiens
aggagatttcttag

SEQ ID NO: 2369122 - DNA, 22 bp, Homo sapiens
aggagcaaggtgagaaatcaca

SEQ ID NO: 2369123 - DNA, 14 bp, Homo sapiens
aggagcagcagctt

SEQ ID NO: 2369124 - DNA, 22 bp, Homo sapiens
aggagcttgggcagtgccccag

SEQ ID NO: 2369125 - DNA, 17 bp, Homo sapiens
aggaggaaaattccatt

SEQ ID NO: 2369126 - DNA, 22 bp, Homo sapiens
aggaggaaaattccattagaga

SEQ ID NO: 2369127 - DNA, 16 bp, Homo sapiens
aggaggaaacagttct

SEQ ID NO: 2369128 - DNA, 17 bp, Homo sapiens
aggaggaaggcaagagg

SEQ ID NO: 2369129 - DNA, 13 bp, Homo sapiens
aggaggcccactg

SEQ ID NO: 2369130 - DNA, 20 bp, Homo sapiens
aggaggcccttgtcgtggga

SEQ ID NO: 2369131 - DNA, 20 bp, Homo sapiens
aggaggcgcccttggcttct

SEQ ID NO: 2369132 - DNA, 14 bp, Homo sapiens
aggagggcagaggg

SEQ ID NO: 2369133 - DNA, 19 bp, Homo sapiens
aggaggggagagacaggca

SEQ ID NO: 2369134 - DNA, 21 bp, Homo sapiens
aggaggggagagacaggcagc

SEQ ID NO: 2369135 - DNA, 19 bp, Homo sapiens
aggaggggcccccctgccc

SEQ ID NO: 2369136 - DNA, 19 bp, Homo sapiens
aggagggggccgggcgcgg

SEQ ID NO: 2369137 - DNA, 18 bp, Homo sapiens
aggaggtccttaggcctc

SEQ ID NO: 2369138 - DNA, 14 bp, Homo sapiens
aggagtaaaattca

SEQ ID NO: 2369139 - DNA, 13 bp, Homo sapiens
aggataagaaagc

SEQ ID NO: 2369140 - DNA, 22 bp, Homo sapiens
aggataagaaagcctaaaattg

SEQ ID NO: 2369141 - DNA, 22 bp, Homo sapiens
aggatattttggggggcagaga

SEQ ID NO: 2369142 - DNA, 22 bp, Homo sapiens
aggatcatggtgtaataagaca

SEQ ID NO: 2369143 - DNA, 21 bp, Homo sapiens
aggatccagagagcagctccc

SEQ ID NO: 2369144 - DNA, 17 bp, Homo sapiens
aggatcggactctgccc

SEQ ID NO: 2369145 - DNA, 23 bp, Homo sapiens
aggatctataggcagcttctaag

SEQ ID NO: 2369146 - DNA, 17 bp, Homo sapiens
aggatctctaaagagca

SEQ ID NO: 2369147 - DNA, 12 bp, Homo sapiens
aggatctgctga

SEQ ID NO: 2369148 - DNA, 18 bp, Homo sapiens
aggatctgctgaggccca

SEQ ID NO: 2369149 - DNA, 21 bp, Homo sapiens
aggatctgctgaggcccagtg

SEQ ID NO: 2369150 - DNA, 13 bp, Homo sapiens
aggatgagagccc

SEQ ID NO: 2369151 - DNA, 18 bp, Homo sapiens
aggatgagagcccagagg

SEQ ID NO: 2369152 - DNA, 19 bp, Homo sapiens
aggatgagagcccagaggt

SEQ ID NO: 2369153 - DNA, 14 bp, Homo sapiens
aggatgagggaagc

SEQ ID NO: 2369154 - DNA, 23 bp, Homo sapiens
aggatgatgtctttttattaaaa

SEQ ID NO: 2369155 - DNA, 15 bp, Homo sapiens
aggatgccttttctg

SEQ ID NO: 2369156 - DNA, 20 bp, Homo sapiens
aggatggcctttccttccct

SEQ ID NO: 2369157 - DNA, 21 bp, Homo sapiens
aggatggcctttccttccctc

SEQ ID NO: 2369158 - DNA, 17 bp, Homo sapiens
aggatgggtcagagcta

SEQ ID NO: 2369159 - DNA, 14 bp, Homo sapiens
aggattatcagtat

SEQ ID NO: 2369160 - DNA, 12 bp, Homo sapiens
aggattcccttc

SEQ ID NO: 2369161 - DNA, 16 bp, Homo sapiens
aggattcccttctggg

SEQ ID NO: 2369162 - DNA, 17 bp, Homo sapiens
aggcaagagggggtgga

SEQ ID NO: 2369163 - DNA, 21 bp, Homo sapiens
aggcaagagggggtggagggg

SEQ ID NO: 2369164 - DNA, 21 bp, Homo sapiens
aggcaagctgaaattttagaa

SEQ ID NO: 2369165 - DNA, 16 bp, Homo sapiens
aggcaccagtccctgt

SEQ ID NO: 2369166 - DNA, 13 bp, Homo sapiens
aggcaccctcagg

SEQ ID NO: 2369167 - DNA, 14 bp, Homo sapiens
aggcaccctcaggg

SEQ ID NO: 2369168 - DNA, 17 bp, Homo sapiens
aggcaccctcagggagc

SEQ ID NO: 2369169 - DNA, 16 bp, Homo sapiens
aggcaccgagaatgtt

SEQ ID NO: 2369170 - DNA, 18 bp, Homo sapiens
aggcaccgagaatgttgt

SEQ ID NO: 2369171 - DNA, 13 bp, Homo sapiens
aggcacctgctgg

SEQ ID NO: 2369172 - DNA, 14 bp, Homo sapiens
aggcacctgctgga

SEQ ID NO: 2369173 - DNA, 17 bp, Homo sapiens
aggcacgggtggtcccc

SEQ ID NO: 2369174 - DNA, 15 bp, Homo sapiens
aggcactcagtgagc

SEQ ID NO: 2369175 - DNA, 20 bp, Homo sapiens
aggcactcagtgagcctcct

SEQ ID NO: 2369176 - DNA, 22 bp, Homo sapiens
aggcactcagtgagcctcctgt

SEQ ID NO: 2369177 - DNA, 20 bp, Homo sapiens
aggcagagctggagccccca

SEQ ID NO: 2369178 - DNA, 15 bp, Homo sapiens
aggcagaggttttaa

SEQ ID NO: 2369179 - DNA, 15 bp, Homo sapiens
aggcagagtcttctt

SEQ ID NO: 2369180 - DNA, 16 bp, Homo sapiens
aggcagatagcactgg

SEQ ID NO: 2369181 - DNA, 18 bp, Homo sapiens
aggcagatgtttgcctca

SEQ ID NO: 2369182 - DNA, 15 bp, Homo sapiens
aggcagattgaaaag

SEQ ID NO: 2369183 - DNA, 16 bp, Homo sapiens
aggcagattgaaaagg

SEQ ID NO: 2369184 - DNA, 23 bp, Homo sapiens
aggcagcaccacactgggtgcgt

SEQ ID NO: 2369185 - DNA, 13 bp, Homo sapiens
aggcagcctcctt

SEQ ID NO: 2369186 - DNA, 13 bp, Homo sapiens
aggcagcttctaa

SEQ ID NO: 2369187 - DNA, 17 bp, Homo sapiens
aggcaggctgggacgga

SEQ ID NO: 2369188 - DNA, 23 bp, Homo sapiens
aggcaggctgggacggaccagca

SEQ ID NO: 2369189 - DNA, 16 bp, Homo sapiens
aggcaggggtgggggt

SEQ ID NO: 2369190 - DNA, 20 bp, Homo sapiens
aggcaggggtgggggtggag

SEQ ID NO: 2369191 - DNA, 19 bp, Homo sapiens
aggcagtaataaaaagatt

SEQ ID NO: 2369192 - DNA, 18 bp, Homo sapiens
aggcataggtctctttgc

SEQ ID NO: 2369193 - DNA, 21 bp, Homo sapiens
aggcatccatagtgcactagc

SEQ ID NO: 2369194 - DNA, 15 bp, Homo sapiens
aggcatccttgtctt

SEQ ID NO: 2369195 - DNA, 17 bp, Homo sapiens
aggcatccttgtctttt

SEQ ID NO: 2369196 - DNA, 22 bp, Homo sapiens
aggcatccttgtcttttgagct

SEQ ID NO: 2369197 - DNA, 17 bp, Homo sapiens
aggccaaaatcaagagt

SEQ ID NO: 2369198 - DNA, 20 bp, Homo sapiens
aggccactgtgttccttccg

SEQ ID NO: 2369199 - DNA, 21 bp, Homo sapiens
aggccagagtcaccttttctg

SEQ ID NO: 2369200 - DNA, 12 bp, Homo sapiens
aggccagggcct

SEQ ID NO: 2369201 - DNA, 22 bp, Homo sapiens
aggccagtccccatttctgcct

SEQ ID NO: 2369202 - DNA, 14 bp, Homo sapiens
aggccatgtgcata

SEQ ID NO: 2369203 - DNA, 20 bp, Homo sapiens
aggccatgtgcatagtttct

SEQ ID NO: 2369204 - DNA, 16 bp, Homo sapiens
aggccattctgccgcc

SEQ ID NO: 2369205 - DNA, 13 bp, Homo sapiens
aggcccagcctgt

SEQ ID NO: 2369206 - DNA, 13 bp, Homo sapiens
aggcccatagcag

SEQ ID NO: 2369207 - DNA, 23 bp, Homo sapiens
aggcccattgtcctccttttcac

SEQ ID NO: 2369208 - DNA, 15 bp, Homo sapiens
aggccctgactcctc

SEQ ID NO: 2369209 - DNA, 16 bp, Homo sapiens
aggccctgactcctct

SEQ ID NO: 2369210 - DNA, 17 bp, Homo sapiens
aggccctgactcctctg

SEQ ID NO: 2369211 - DNA, 16 bp, Homo sapiens
aggccctgctgagtca

SEQ ID NO: 2369212 - DNA, 12 bp, Homo sapiens
aggccctgggct

SEQ ID NO: 2369213 - DNA, 14 bp, Homo sapiens
aggccctgttccct

SEQ ID NO: 2369214 - DNA, 16 bp, Homo sapiens
aggccgagctgtggac

SEQ ID NO: 2369215 - DNA, 20 bp, Homo sapiens
aggccgaggataaagaaaag

SEQ ID NO: 2369216 - DNA, 12 bp, Homo sapiens
aggccggcccag

SEQ ID NO: 2369217 - DNA, 22 bp, Homo sapiens
aggccgtggactggctcatgcc

SEQ ID NO: 2369218 - DNA, 17 bp, Homo sapiens
aggcctagactctgtct

SEQ ID NO: 2369219 - DNA, 21 bp, Homo sapiens
aggcctagactctgtctacct

SEQ ID NO: 2369220 - DNA, 15 bp, Homo sapiens
aggcctatttaacaa

SEQ ID NO: 2369221 - DNA, 14 bp, Homo sapiens
aggcctcaggtgct

SEQ ID NO: 2369222 - DNA, 21 bp, Homo sapiens
aggcctcaggtgctgtccatg

SEQ ID NO: 2369223 - DNA, 13 bp, Homo sapiens
aggcctgaagcca

SEQ ID NO: 2369224 - DNA, 22 bp, Homo sapiens
aggcctgcctcccacttcactg

SEQ ID NO: 2369225 - DNA, 21 bp, Homo sapiens
aggccttgggtggccccctct

SEQ ID NO: 2369226 - DNA, 11 bp, Homo sapiens
aggcctttctt

SEQ ID NO: 2369227 - DNA, 13 bp, Homo sapiens
aggcctttcttct

SEQ ID NO: 2369228 - DNA, 18 bp, Homo sapiens
aggcctttcttctgtgtt

SEQ ID NO: 2369229 - DNA, 20 bp, Homo sapiens
agggtgcagttttccaggaa

SEQ ID NO: 2369230 - DNA, 17 bp, Homo sapiens
agggtgggcttcctgcc

SEQ ID NO: 2369231 - DNA, 18 bp, Homo sapiens
agggtgggcttcctgccc

SEQ ID NO: 2369232 - DNA, 15 bp, Homo sapiens
agggttaaggcctga

SEQ ID NO: 2369233 - DNA, 14 bp, Homo sapiens
agggttcaaaatgt

SEQ ID NO: 2369234 - DNA, 18 bp, Homo sapiens
agggttcaaaatgtctgt

SEQ ID NO: 2369235 - DNA, 14 bp, Homo sapiens
agggttgagagcca

SEQ ID NO: 2369236 - DNA, 14 bp, Homo sapiens
agggtttctctatt

SEQ ID NO: 2369237 - DNA, 15 bp, Homo sapiens
agggttttcttttct

SEQ ID NO: 2369238 - DNA, 14 bp, Homo sapiens
aggtaaaacagggc

SEQ ID NO: 2369239 - DNA, 21 bp, Homo sapiens
aggtaaatggttaaattttac

SEQ ID NO: 2369240 - DNA, 23 bp, Homo sapiens
aggtaaatggttaaattttacat

SEQ ID NO: 2369241 - DNA, 13 bp, Homo sapiens
aggtaacagaaca

SEQ ID NO: 2369242 - DNA, 18 bp, Homo sapiens
aggtaacagaacagcttc

SEQ ID NO: 2369243 - DNA, 19 bp, Homo sapiens
aggtaacagaacagcttca

SEQ ID NO: 2369244 - DNA, 16 bp, Homo sapiens
aggtaagggccgccgg

SEQ ID NO: 2369245 - DNA, 12 bp, Homo sapiens
aggtaatttttc

SEQ ID NO: 2369246 - DNA, 17 bp, Homo sapiens
aggtacccctttctggc

SEQ ID NO: 2369247 - DNA, 17 bp, Homo sapiens
aggtagcgagctgctct

SEQ ID NO: 2369248 - DNA, 13 bp, Homo sapiens
aggtaggaagagc

SEQ ID NO: 2369249 - DNA, 15 bp, Homo sapiens
aggtagtctcactgc

SEQ ID NO: 2369250 - DNA, 17 bp, Homo sapiens
aggtatactttagtaga

SEQ ID NO: 2369251 - DNA, 15 bp, Homo sapiens
aggtatctagagctt

SEQ ID NO: 2369252 - DNA, 22 bp, Homo sapiens
aggtcaagtaagaagacatgaa

SEQ ID NO: 2369253 - DNA, 16 bp, Homo sapiens
aggtcactggaaaggg

SEQ ID NO: 2369254 - DNA, 21 bp, Homo sapiens
aggtcactggaaaggggagag

SEQ ID NO: 2369255 - DNA, 15 bp, Homo sapiens
aggtcagcatgtcta

SEQ ID NO: 2369256 - DNA, 17 bp, Homo sapiens
aggtcaggacggctcct

SEQ ID NO: 2369257 - DNA, 23 bp, Homo sapiens
aggtcaggacggctcctcagagc

SEQ ID NO: 2369258 - DNA, 21 bp, Homo sapiens
aggtcatcagatgcctgcttg

SEQ ID NO: 2369259 - DNA, 18 bp, Homo sapiens
aggtccattcattaatta

SEQ ID NO: 2369260 - DNA, 20 bp, Homo sapiens
aggtccttaggcctctgaga

SEQ ID NO: 2369261 - DNA, 12 bp, Homo sapiens
aggtcttttcaa

SEQ ID NO: 2369262 - DNA, 15 bp, Homo sapiens
aggtgacatgtgaaa

SEQ ID NO: 2369263 - DNA, 20 bp, Homo sapiens
aggtgacatgtgaaaccttt

SEQ ID NO: 2369264 - DNA, 21 bp, Homo sapiens
aggtgagtttgagctgccttc

SEQ ID NO: 2369265 - DNA, 21 bp, Homo sapiens
aggtgataagggaaaagataa

SEQ ID NO: 2369266 - DNA, 22 bp, Homo sapiens
aggtgcactgggaggctcccct

SEQ ID NO: 2369267 - DNA, 23 bp, Homo sapiens
aggtgcactgggaggctcccctt

SEQ ID NO: 2369268 - DNA, 22 bp, Homo sapiens
aggtgcctcagttttccttctg

SEQ ID NO: 2369269 - DNA, 23 bp, Homo sapiens
aggtgcctcagttttccttctgt

SEQ ID NO: 2369270 - DNA, 22 bp, Homo sapiens
aggtgccttacatcttttctaa

SEQ ID NO: 2369271 - DNA, 20 bp, Homo sapiens
aggtgcgcgccaccgtgcct

SEQ ID NO: 2369272 - DNA, 22 bp, Homo sapiens
aggtgcgcgccaccgtgcctgg

SEQ ID NO: 2369273 - DNA, 13 bp, Homo sapiens
aggtgctgctcta

SEQ ID NO: 2369274 - DNA, 17 bp, Homo sapiens
aggtggagaaaattgga

SEQ ID NO: 2369275 - DNA, 14 bp, Homo sapiens
aggtggagggaggg

SEQ ID NO: 2369276 - DNA, 17 bp, Homo sapiens
aggtggagtttctctgt

SEQ ID NO: 2369277 - DNA, 22 bp, Homo sapiens
aggtggatgttatgaacagctg

SEQ ID NO: 2369278 - DNA, 23 bp, Homo sapiens
aggtggcagatgtcttccctggg

SEQ ID NO: 2369279 - DNA, 14 bp, Homo sapiens
aggtggcctttgtg

SEQ ID NO: 2369280 - DNA, 20 bp, Homo sapiens
aggtggcctttgtgctgcgc

SEQ ID NO: 2369281 - DNA, 15 bp, Homo sapiens
aggtgggccttgcta

SEQ ID NO: 2369282 - DNA, 21 bp, Homo sapiens
aggtgggccttgctacctcaa

SEQ ID NO: 2369283 - DNA, 19 bp, Homo sapiens
aggtggttgtcttattgca

SEQ ID NO: 2369284 - DNA, 20 bp, Homo sapiens
aggtgtataaatgtacattt

SEQ ID NO: 2369285 - DNA, 18 bp, Homo sapiens
aggtgtcaccctgcagag

SEQ ID NO: 2369286 - DNA, 20 bp, Homo sapiens
aggtgtcaccctgcagagct

SEQ ID NO: 2369287 - DNA, 17 bp, Homo sapiens
aggtgttctacactcat

SEQ ID NO: 2369288 - DNA, 14 bp, Homo sapiens
aggttataattttt

SEQ ID NO: 2369289 - DNA, 14 bp, Homo sapiens
aggttcccctgtca

SEQ ID NO: 2369290 - DNA, 23 bp, Homo sapiens
aggttccgtatctccctggagaa

SEQ ID NO: 2369291 - DNA, 12 bp, Homo sapiens
aggttcctctgc

SEQ ID NO: 2369292 - DNA, 13 bp, Homo sapiens
aggttcctctgcc

SEQ ID NO: 2369293 - DNA, 14 bp, Homo sapiens
aggttcctctgcct

SEQ ID NO: 2369294 - DNA, 16 bp, Homo sapiens
aggttcctctgcctgc

SEQ ID NO: 2369295 - DNA, 18 bp, Homo sapiens
aggttcctctgcctgccc

SEQ ID NO: 2369296 - DNA, 16 bp, Homo sapiens
aggttcctttttcaaa

SEQ ID NO: 2369297 - DNA, 12 bp, Homo sapiens
aggttgaagcca

SEQ ID NO: 2369298 - DNA, 13 bp, Homo sapiens
aggttgaagccaa

SEQ ID NO: 2369299 - DNA, 16 bp, Homo sapiens
aggttgaggaatatca

SEQ ID NO: 2369300 - DNA, 15 bp, Homo sapiens
aggttggagcccagg

SEQ ID NO: 2369301 - DNA, 15 bp, Homo sapiens
aggttttgtttttag

SEQ ID NO: 2369302 - DNA, 14 bp, Homo sapiens
agtaaaattcagtt

SEQ ID NO: 2369303 - DNA, 19 bp, Homo sapiens
agtaaacgggaacatgccc

SEQ ID NO: 2369304 - DNA, 21 bp, Homo sapiens
agtaaacgggaacatgccccc

SEQ ID NO: 2369305 - DNA, 23 bp, Homo sapiens
agtaaacgggaacatgccccctg

SEQ ID NO: 2369306 - DNA, 20 bp, Homo sapiens
agtaaatccaggctttatgt

SEQ ID NO: 2369307 - DNA, 13 bp, Homo sapiens
agtaaatgtcttc

SEQ ID NO: 2369308 - DNA, 20 bp, Homo sapiens
agtaaatgtgattcacctct

SEQ ID NO: 2369309 - DNA, 16 bp, Homo sapiens
agtaaatgttacttct

SEQ ID NO: 2369310 - DNA, 21 bp, Homo sapiens
agtaacaatacatgagaaaga

SEQ ID NO: 2369311 - DNA, 17 bp, Homo sapiens
agtaacaatctatggct

SEQ ID NO: 2369312 - DNA, 19 bp, Homo sapiens
agtaacatgacttccttat

SEQ ID NO: 2369313 - DNA, 23 bp, Homo sapiens
agtaacatgacttccttatttct

SEQ ID NO: 2369314 - DNA, 19 bp, Homo sapiens
agtaacccccttaaattta

SEQ ID NO: 2369315 - DNA, 17 bp, Homo sapiens
agtaactgtcaggctga

SEQ ID NO: 2369316 - DNA, 23 bp, Homo sapiens
agtaactgtcaggctgaaaacaa

SEQ ID NO: 2369317 - DNA, 16 bp, Homo sapiens
agtaagaagacatgaa

SEQ ID NO: 2369318 - DNA, 17 bp, Homo sapiens
agtaagcagatgggaac

SEQ ID NO: 2369319 - DNA, 16 bp, Homo sapiens
agtaagttatctttga

SEQ ID NO: 2369320 - DNA, 20 bp, Homo sapiens
agtaagttatctttgaatat

SEQ ID NO: 2369321 - DNA, 13 bp, Homo sapiens
agtaatattatta

SEQ ID NO: 2369322 - DNA, 17 bp, Homo sapiens
agtacagaatttgaatt

SEQ ID NO: 2369323 - DNA, 21 bp, Homo sapiens
agtacagcggctcccctctgc

SEQ ID NO: 2369324 - DNA, 18 bp, Homo sapiens
agtacatattaggaaaat

SEQ ID NO: 2369325 - DNA, 13 bp, Homo sapiens
agtacatttaaat

SEQ ID NO: 2369326 - DNA, 16 bp, Homo sapiens
agtacatttaaatttt

SEQ ID NO: 2369327 - DNA, 19 bp, Homo sapiens
agtacatttaaattttttg

SEQ ID NO: 2369328 - DNA, 16 bp, Homo sapiens
agtaccaatgggaagc

SEQ ID NO: 2369329 - DNA, 17 bp, Homo sapiens
agtaccaatgggaagca

SEQ ID NO: 2369330 - DNA, 21 bp, Homo sapiens
agtacctagctggctctgtga

SEQ ID NO: 2369331 - DNA, 23 bp, Homo sapiens
agtaccttgaactcttagtgatt

SEQ ID NO: 2369332 - DNA, 14 bp, Homo sapiens
agtagaaaatgtga

SEQ ID NO: 2369333 - DNA, 14 bp, Homo sapiens
agtagacatttata

SEQ ID NO: 2369334 - DNA, 15 bp, Homo sapiens
agtagagccagcttg

SEQ ID NO: 2369335 - DNA, 18 bp, Homo sapiens
agtagattcatgaaaatg

SEQ ID NO: 2369336 - DNA, 13 bp, Homo sapiens
agtagttaaataa

SEQ ID NO: 2369337 - DNA, 18 bp, Homo sapiens
agtatagaagtctggaaa

SEQ ID NO: 2369338 - DNA, 22 bp, Homo sapiens
agtatattgttgaagagacaga

SEQ ID NO: 2369339 - DNA, 23 bp, Homo sapiens
agtatatttaattttgacataag

SEQ ID NO: 2369340 - DNA, 16 bp, Homo sapiens
agtatcagctacaatt

SEQ ID NO: 2369341 - DNA, 16 bp, Homo sapiens
agtatgcattattaaa

SEQ ID NO: 2369342 - DNA, 13 bp, Homo sapiens
agtatgtatgtgt

SEQ ID NO: 2369343 - DNA, 20 bp, Homo sapiens
agtggcgggtgatggccagc

SEQ ID NO: 2369344 - DNA, 14 bp, Homo sapiens
agtggctgccacac

SEQ ID NO: 2369345 - DNA, 12 bp, Homo sapiens
agtggctgcggt

SEQ ID NO: 2369346 - DNA, 15 bp, Homo sapiens
agtgggatgaaccag

SEQ ID NO: 2369347 - DNA, 14 bp, Homo sapiens
agtggggtgctggg

SEQ ID NO: 2369348 - DNA, 16 bp, Homo sapiens
agtggtctctgctggg

SEQ ID NO: 2369349 - DNA, 15 bp, Homo sapiens
agtggtctttgtaag

SEQ ID NO: 2369350 - DNA, 18 bp, Homo sapiens
agtggtctttgtaagagt

SEQ ID NO: 2369351 - DNA, 21 bp, Homo sapiens
agtggtctttgtaagagtgta

SEQ ID NO: 2369352 - DNA, 22 bp, Homo sapiens
agtggtctttgtaagagtgtag

SEQ ID NO: 2369353 - DNA, 15 bp, Homo sapiens
agtggtgatttgaaa

SEQ ID NO: 2369354 - DNA, 17 bp, Homo sapiens
agtggttttatactgaa

SEQ ID NO: 2369355 - DNA, 15 bp, Homo sapiens
agtgtaaaatgtata

SEQ ID NO: 2369356 - DNA, 16 bp, Homo sapiens
agtgtaacttgcttaa

SEQ ID NO: 2369357 - DNA, 22 bp, Homo sapiens
agtgtacccatctttaatttat

SEQ ID NO: 2369358 - DNA, 13 bp, Homo sapiens
agtgtagaagcat

SEQ ID NO: 2369359 - DNA, 18 bp, Homo sapiens
agtgtagaagcattcctt

SEQ ID NO: 2369360 - DNA, 19 bp, Homo sapiens
agtgtagaagcattccttc

SEQ ID NO: 2369361 - DNA, 20 bp, Homo sapiens
agtgtcatataaactcattt

SEQ ID NO: 2369362 - DNA, 14 bp, Homo sapiens
agtgtccagcttcc

SEQ ID NO: 2369363 - DNA, 16 bp, Homo sapiens
agtgtctggaattgtg

SEQ ID NO: 2369364 - DNA, 17 bp, Homo sapiens
agtgtctggaattgtgg

SEQ ID NO: 2369365 - DNA, 14 bp, Homo sapiens
agtgtgaaatatat

SEQ ID NO: 2369366 - DNA, 16 bp, Homo sapiens
agtgtgaatagcctgg

SEQ ID NO: 2369367 - DNA, 17 bp, Homo sapiens
agtgtgaatagcctggc

SEQ ID NO: 2369368 - DNA, 18 bp, Homo sapiens
agtgtgccaaatcagttt

SEQ ID NO: 2369369 - DNA, 21 bp, Homo sapiens
agtgtggagaccctgccacag

SEQ ID NO: 2369370 - DNA, 16 bp, Homo sapiens
agtgtgtctgctgagt

SEQ ID NO: 2369371 - DNA, 19 bp, Homo sapiens
agtgtgtgcataatagcta

SEQ ID NO: 2369372 - DNA, 23 bp, Homo sapiens
agtgttctcatgaagcaggaggc

SEQ ID NO: 2369373 - DNA, 13 bp, Homo sapiens
agtgttctgtggc

SEQ ID NO: 2369374 - DNA, 14 bp, Homo sapiens
agtgttgtgcccct

SEQ ID NO: 2369375 - DNA, 22 bp, Homo sapiens
agtgttgtgccccttcactcat

SEQ ID NO: 2369376 - DNA, 21 bp, Homo sapiens
agtgtttcgcgggtaactggg

SEQ ID NO: 2369377 - DNA, 14 bp, Homo sapiens
agtgtttctagcta

SEQ ID NO: 2369378 - DNA, 13 bp, Homo sapiens
agtgttttgcaag

SEQ ID NO: 2369379 - DNA, 12 bp, Homo sapiens
agttaaatctca

SEQ ID NO: 2369380 - DNA, 14 bp, Homo sapiens
agttaaatctcaaa

SEQ ID NO: 2369381 - DNA, 15 bp, Homo sapiens
agttaagaagctgtt

SEQ ID NO: 2369382 - DNA, 18 bp, Homo sapiens
agttaagaagctgttgta

SEQ ID NO: 2369383 - DNA, 15 bp, Homo sapiens
agttaatataaatgt

SEQ ID NO: 2369384 - DNA, 16 bp, Homo sapiens
agttaatataaatgtt

SEQ ID NO: 2369385 - DNA, 14 bp, Homo sapiens
agttactaaaattt

SEQ ID NO: 2369386 - DNA, 19 bp, Homo sapiens
agttactaaaatttacaca

SEQ ID NO: 2369387 - DNA, 23 bp, Homo sapiens
agttagctccataaagtacaaat

SEQ ID NO: 2369388 - DNA, 12 bp, Homo sapiens
agttataagaag

SEQ ID NO: 2369389 - DNA, 20 bp, Homo sapiens
agttatcatgaattttaaag

SEQ ID NO: 2369390 - DNA, 22 bp, Homo sapiens
agttatcatgaattttaaagta

SEQ ID NO: 2369391 - DNA, 15 bp, Homo sapiens
agttatggtgccgaa

SEQ ID NO: 2369392 - DNA, 14 bp, Homo sapiens
agttattttctaca

SEQ ID NO: 2369393 - DNA, 23 bp, Homo sapiens
agttattttctacagtggtttta

SEQ ID NO: 2369394 - DNA, 15 bp, Homo sapiens
agttatttttgtaca

SEQ ID NO: 2369395 - DNA, 17 bp, Homo sapiens
agttatttttgtacatg

SEQ ID NO: 2369396 - DNA, 18 bp, Homo sapiens
agttatttttgtacatgt

SEQ ID NO: 2369397 - DNA, 12 bp, Homo sapiens
agttcaaaaaca

SEQ ID NO: 2369398 - DNA, 18 bp, Homo sapiens
agttcaataaatgtctgt

SEQ ID NO: 2369399 - DNA, 19 bp, Homo sapiens
agttcaataaatgtctgtt

SEQ ID NO: 2369400 - DNA, 18 bp, Homo sapiens
agttcaccttggaagggc

SEQ ID NO: 2369401 - DNA, 19 bp, Homo sapiens
agttcatcaccatttcctc

SEQ ID NO: 2369402 - DNA, 18 bp, Homo sapiens
agttcatcgattttctat

SEQ ID NO: 2369403 - DNA, 13 bp, Homo sapiens
agttccagtttct

SEQ ID NO: 2369404 - DNA, 19 bp, Homo sapiens
agttctaacagtgaagttt

SEQ ID NO: 2369405 - DNA, 23 bp, Homo sapiens
agttctaacagtgaagttttact

SEQ ID NO: 2369406 - DNA, 15 bp, Homo sapiens
agttctaggaaaata

SEQ ID NO: 2369407 - DNA, 17 bp, Homo sapiens
agttctcaatcactgct

SEQ ID NO: 2369408 - DNA, 13 bp, Homo sapiens
agttctcactggg

SEQ ID NO: 2369409 - DNA, 14 bp, Homo sapiens
agttctcttgcttt

SEQ ID NO: 2369410 - DNA, 15 bp, Homo sapiens
agttctcttgctttc

SEQ ID NO: 2369411 - DNA, 15 bp, Homo sapiens
agttctctttggaaa

SEQ ID NO: 2369412 - DNA, 14 bp, Homo sapiens
agttctgtaataaa

SEQ ID NO: 2369413 - DNA, 20 bp, Homo sapiens
agttcttatgaggaggggag

SEQ ID NO: 2369414 - DNA, 21 bp, Homo sapiens
agttcttatgaggaggggagg

SEQ ID NO: 2369415 - DNA, 12 bp, Homo sapiens
agttctttcctc

SEQ ID NO: 2369416 - DNA, 15 bp, Homo sapiens
agttctttcctcttt

SEQ ID NO: 2369417 - DNA, 22 bp, Homo sapiens
agttgaagttagtggaaatctg

SEQ ID NO: 2369418 - DNA, 13 bp, Homo sapiens
agttgaggccact

SEQ ID NO: 2369419 - DNA, 14 bp, Homo sapiens
agttgatctgctct

SEQ ID NO: 2369420 - DNA, 23 bp, Homo sapiens
agttgcattttaaccctatttta

SEQ ID NO: 2369421 - DNA, 20 bp, Homo sapiens
agttgcgtggactctgcaca

SEQ ID NO: 2369422 - DNA, 16 bp, Homo sapiens
agttgctgtgaacttt

SEQ ID NO: 2369423 - DNA, 18 bp, Homo sapiens
agttggaaggatctgctg

SEQ ID NO: 2369424 - DNA, 21 bp, Homo sapiens
agttgggatgccaatttcctc

SEQ ID NO: 2369425 - DNA, 15 bp, Homo sapiens
agttgggtgtctcct

SEQ ID NO: 2369426 - DNA, 21 bp, Homo sapiens
agttgtaaaatagaaaaagtg

SEQ ID NO: 2369427 - DNA, 14 bp, Homo sapiens
agttgtagacaaag

SEQ ID NO: 2369428 - DNA, 23 bp, Homo sapiens
agttgtagacaaagtacattctg

SEQ ID NO: 2369429 - DNA, 13 bp, Homo sapiens
agttgtcttatgt

SEQ ID NO: 2369430 - DNA, 18 bp, Homo sapiens
agttgtgatctgttgtaa

SEQ ID NO: 2369431 - DNA, 14 bp, Homo sapiens
agttgtgcttgagc

SEQ ID NO: 2369432 - DNA, 18 bp, Homo sapiens
agttgtgtgtatgtgtgt

SEQ ID NO: 2369433 - DNA, 21 bp, Homo sapiens
agttgttcgggccaaggacct

SEQ ID NO: 2369434 - DNA, 23 bp, Homo sapiens
agttgttcgggccaaggacctga

SEQ ID NO: 2369435 - DNA, 13 bp, Homo sapiens
agtttaaattcta

SEQ ID NO: 2369436 - DNA, 14 bp, Homo sapiens
agtttagctctgag

SEQ ID NO: 2369437 - DNA, 18 bp, Homo sapiens
agtttcaagttttaaagt

SEQ ID NO: 2369438 - DNA, 20 bp, Homo sapiens
agtttcacaaatccttcaaa

SEQ ID NO: 2369439 - DNA, 20 bp, Homo sapiens
agtttcacagcacttacaat

SEQ ID NO: 2369440 - DNA, 22 bp, Homo sapiens
agtttcacagcacttacaattt

SEQ ID NO: 2369441 - DNA, 11 bp, Homo sapiens
agtttcaggtg

SEQ ID NO: 2369442 - DNA, 16 bp, Homo sapiens
agtttcaggtgacatg

SEQ ID NO: 2369443 - DNA, 18 bp, Homo sapiens
agtttcaggtgacatgtg

SEQ ID NO: 2369444 - DNA, 15 bp, Homo sapiens
agtttctcagaagtc

SEQ ID NO: 2369445 - DNA, 11 bp, Homo sapiens
agtttctctgt

SEQ ID NO: 2369446 - DNA, 17 bp, Homo sapiens
agtttcttagcttttta

SEQ ID NO: 2369447 - DNA, 16 bp, Homo sapiens
agtttgactacatagt

SEQ ID NO: 2369448 - DNA, 18 bp, Homo sapiens
agtttgtagaactttatt

SEQ ID NO: 2369449 - DNA, 18 bp, Homo sapiens
agtttgtagtaaaagtgg

SEQ ID NO: 2369450 - DNA, 13 bp, Homo sapiens
agtttgtgagaaa

SEQ ID NO: 2369451 - DNA, 14 bp, Homo sapiens
agtttgtgagaaac

SEQ ID NO: 2369452 - DNA, 21 bp, Homo sapiens
agttttaaacccaaaatatat

SEQ ID NO: 2369453 - DNA, 22 bp, Homo sapiens
agttttaagaaggtgcttagct

SEQ ID NO: 2369454 - DNA, 14 bp, Homo sapiens
agttttatatgctt

SEQ ID NO: 2369455 - DNA, 15 bp, Homo sapiens
agttttatatgcttt

SEQ ID NO: 2369456 - DNA, 16 bp, Homo sapiens
agttttatatgcttta

SEQ ID NO: 2369457 - DNA, 19 bp, Homo sapiens
agttttgctttagtacaat

SEQ ID NO: 2369458 - DNA, 23 bp, Homo sapiens
atacacatagttctgtaataaaa

SEQ ID NO: 2369459 - DNA, 15 bp, Homo sapiens
atacactttgttgca

SEQ ID NO: 2369460 - DNA, 23 bp, Homo sapiens
atacagaggatgccttttctgtg

SEQ ID NO: 2369461 - DNA, 13 bp, Homo sapiens
atacagtcattcc

SEQ ID NO: 2369462 - DNA, 16 bp, Homo sapiens
atacataaaagaaata

SEQ ID NO: 2369463 - DNA, 13 bp, Homo sapiens
atacatgagaaag

SEQ ID NO: 2369464 - DNA, 17 bp, Homo sapiens
atacatgccacatcaaa

SEQ ID NO: 2369465 - DNA, 21 bp, Homo sapiens
atacatgccacatcaaacctt

SEQ ID NO: 2369466 - DNA, 14 bp, Homo sapiens
atacatggttgtga

SEQ ID NO: 2369467 - DNA, 20 bp, Homo sapiens
atacatggttgtgacctgag

SEQ ID NO: 2369468 - DNA, 16 bp, Homo sapiens
atacatgtgatacatt

SEQ ID NO: 2369469 - DNA, 12 bp, Homo sapiens
atacatttgtaa

SEQ ID NO: 2369470 - DNA, 23 bp, Homo sapiens
atacatttgtaagtgtaaaaaat

SEQ ID NO: 2369471 - DNA, 13 bp, Homo sapiens
atacattttataa

SEQ ID NO: 2369472 - DNA, 18 bp, Homo sapiens
atacattttataatgatg

SEQ ID NO: 2369473 - DNA, 16 bp, Homo sapiens
atacattttttaagct

SEQ ID NO: 2369474 - DNA, 13 bp, Homo sapiens
ataccacatcaaa

SEQ ID NO: 2369475 - DNA, 18 bp, Homo sapiens
ataccatttagtaagaat

SEQ ID NO: 2369476 - DNA, 13 bp, Homo sapiens
atacctctgtgtg

SEQ ID NO: 2369477 - DNA, 20 bp, Homo sapiens
atacctgattttttttcctt

SEQ ID NO: 2369478 - DNA, 17 bp, Homo sapiens
ataccttgaaaggcagg

SEQ ID NO: 2369479 - DNA, 23 bp, Homo sapiens
atacgctaataagtgacaaataa

SEQ ID NO: 2369480 - DNA, 20 bp, Homo sapiens
atacgtccgtgtgtcccaga

SEQ ID NO: 2369481 - DNA, 12 bp, Homo sapiens
atactacaatag

SEQ ID NO: 2369482 - DNA, 19 bp, Homo sapiens
atactccttgcttcctgat

SEQ ID NO: 2369483 - DNA, 14 bp, Homo sapiens
atactgaaggaaaa

SEQ ID NO: 2369484 - DNA, 18 bp, Homo sapiens
atactgagaatatacaat

SEQ ID NO: 2369485 - DNA, 19 bp, Homo sapiens
atacttctttgttattata

SEQ ID NO: 2369486 - DNA, 22 bp, Homo sapiens
atacttctttgttattataaca

SEQ ID NO: 2369487 - DNA, 18 bp, Homo sapiens
atactttagtagacattt

SEQ ID NO: 2369488 - DNA, 17 bp, Homo sapiens
atactttgtattttgat

SEQ ID NO: 2369489 - DNA, 19 bp, Homo sapiens
atactttttaaatgtaaag

SEQ ID NO: 2369490 - DNA, 15 bp, Homo sapiens
atagaaagaagccat

SEQ ID NO: 2369491 - DNA, 17 bp, Homo sapiens
atagaaattttgtaaga

SEQ ID NO: 2369492 - DNA, 17 bp, Homo sapiens
atagaagtctggaaaaa

SEQ ID NO: 2369493 - DNA, 19 bp, Homo sapiens
atagaataattcttttctg

SEQ ID NO: 2369494 - DNA, 23 bp, Homo sapiens
atagaatagcctgaggtcccctc

SEQ ID NO: 2369495 - DNA, 13 bp, Homo sapiens
atagacatgaaag

SEQ ID NO: 2369496 - DNA, 15 bp, Homo sapiens
atagacattctcaca

SEQ ID NO: 2369497 - DNA, 19 bp, Homo sapiens
atagacgagttgatttcct

SEQ ID NO: 2369498 - DNA, 14 bp, Homo sapiens
atagacttgggatg

SEQ ID NO: 2369499 - DNA, 15 bp, Homo sapiens
atagagatgagccca

SEQ ID NO: 2369500 - DNA, 18 bp, Homo sapiens
atagaggcttctccgcca

SEQ ID NO: 2369501 - DNA, 23 bp, Homo sapiens
atagaggcttctccgccagcctc

SEQ ID NO: 2369502 - DNA, 15 bp, Homo sapiens
atagataatattgtt

SEQ ID NO: 2369503 - DNA, 16 bp, Homo sapiens
atagataatattgttt

SEQ ID NO: 2369504 - DNA, 16 bp, Homo sapiens
atagatatcctctccc

SEQ ID NO: 2369505 - DNA, 15 bp, Homo sapiens
atagatgtagtcttg

SEQ ID NO: 2369506 - DNA, 17 bp, Homo sapiens
atagcaactaatgtttg

SEQ ID NO: 2369507 - DNA, 23 bp, Homo sapiens
atagcaactaatgtttgaacaaa

SEQ ID NO: 2369508 - DNA, 17 bp, Homo sapiens
atagcagccagttcaaa

SEQ ID NO: 2369509 - DNA, 15 bp, Homo sapiens
atagcatgcttcctt

SEQ ID NO: 2369510 - DNA, 16 bp, Homo sapiens
atagcatgcttccttt

SEQ ID NO: 2369511 - DNA, 19 bp, Homo sapiens
atagcatgcttcctttctc

SEQ ID NO: 2369512 - DNA, 15 bp, Homo sapiens
atagccctatttatc

SEQ ID NO: 2369513 - DNA, 18 bp, Homo sapiens
atagcctggccaccagcc

SEQ ID NO: 2369514 - DNA, 18 bp, Homo sapiens
atagctctgaagttaaaa

SEQ ID NO: 2369515 - DNA, 19 bp, Homo sapiens
ataggaagggatctgagaa

SEQ ID NO: 2369516 - DNA, 21 bp, Homo sapiens
ataggaatgtccaccatgaac

SEQ ID NO: 2369517 - DNA, 21 bp, Homo sapiens
ataggagtggtgatttgaaaa

SEQ ID NO: 2369518 - DNA, 17 bp, Homo sapiens
ataggctattttctaaa

SEQ ID NO: 2369519 - DNA, 20 bp, Homo sapiens
ataggctattttctaaagac

SEQ ID NO: 2369520 - DNA, 22 bp, Homo sapiens
atagggaaaattctaacccagg

SEQ ID NO: 2369521 - DNA, 18 bp, Homo sapiens
atagggagaatatttact

SEQ ID NO: 2369522 - DNA, 15 bp, Homo sapiens
ataggtaatttttca

SEQ ID NO: 2369523 - DNA, 15 bp, Homo sapiens
ataggtcatcatgaa

SEQ ID NO: 2369524 - DNA, 21 bp, Homo sapiens
atagtaactataagatacaat

SEQ ID NO: 2369525 - DNA, 19 bp, Homo sapiens
atagtaataagatggctgt

SEQ ID NO: 2369526 - DNA, 22 bp, Homo sapiens
atagtagatgtggcctttgaat

SEQ ID NO: 2369527 - DNA, 18 bp, Homo sapiens
atagtagttaaataactg

SEQ ID NO: 2369528 - DNA, 23 bp, Homo sapiens
atagtctaagactatatatataa

SEQ ID NO: 2369529 - DNA, 17 bp, Homo sapiens
atagtgcttaaaaatca

SEQ ID NO: 2369530 - DNA, 18 bp, Homo sapiens
atagtgtcatataaactc

SEQ ID NO: 2369531 - DNA, 21 bp, Homo sapiens
atagtgtcatataaactcatt

SEQ ID NO: 2369532 - DNA, 20 bp, Homo sapiens
atagtgtctattatcacatt

SEQ ID NO: 2369533 - DNA, 14 bp, Homo sapiens
atagtgtgaaatat

SEQ ID NO: 2369534 - DNA, 15 bp, Homo sapiens
atagtgtgaaatata

SEQ ID NO: 2369535 - DNA, 21 bp, Homo sapiens
atagttgaattagtgagtata

SEQ ID NO: 2369536 - DNA, 18 bp, Homo sapiens
atagttgcatagcagtat

SEQ ID NO: 2369537 - DNA, 21 bp, Homo sapiens
atagttgcatagcagtatatg

SEQ ID NO: 2369538 - DNA, 18 bp, Homo sapiens
atagttgtagacaaagta

SEQ ID NO: 2369539 - DNA, 22 bp, Homo sapiens
atagtttctttattttgtgtaa

SEQ ID NO: 2369540 - DNA, 15 bp, Homo sapiens
atagttttactttta

SEQ ID NO: 2369541 - DNA, 14 bp, Homo sapiens
atataacacatttt

SEQ ID NO: 2369542 - DNA, 15 bp, Homo sapiens
atataacacattttt

SEQ ID NO: 2369543 - DNA, 22 bp, Homo sapiens
atataatttatttccactaaaa

SEQ ID NO: 2369544 - DNA, 12 bp, Homo sapiens
atataattttat

SEQ ID NO: 2369545 - DNA, 13 bp, Homo sapiens
atataattttatg

SEQ ID NO: 2369546 - DNA, 13 bp, Homo sapiens
atatacattttct

SEQ ID NO: 2369547 - DNA, 16 bp, Homo sapiens
atatacattttctaaa

SEQ ID NO: 2369548 - DNA, 14 bp, Homo sapiens
atataccaaattaa

SEQ ID NO: 2369549 - DNA, 14 bp, Homo sapiens
atatactccttaaa

SEQ ID NO: 2369550 - DNA, 17 bp, Homo sapiens
atatacttaagaataca

SEQ ID NO: 2369551 - DNA, 19 bp, Homo sapiens
atatacttaagaatacaca

SEQ ID NO: 2369552 - DNA, 18 bp, Homo sapiens
atatagacattctcacat

SEQ ID NO: 2369553 - DNA, 15 bp, Homo sapiens
atatagcctttaaat

SEQ ID NO: 2369554 - DNA, 18 bp, Homo sapiens
atatagtcaacttattct

SEQ ID NO: 2369555 - DNA, 12 bp, Homo sapiens
atatagttttac

SEQ ID NO: 2369556 - DNA, 13 bp, Homo sapiens
atatagttttact

SEQ ID NO: 2369557 - DNA, 16 bp, Homo sapiens
atatagttttactttt

SEQ ID NO: 2369558 - DNA, 19 bp, Homo sapiens
atatataaacaataaaaac

SEQ ID NO: 2369559 - DNA, 14 bp, Homo sapiens
atatataaatgtat

SEQ ID NO: 2369560 - DNA, 14 bp, Homo sapiens
atatatacattgct

SEQ ID NO: 2369561 - DNA, 20 bp, Homo sapiens
atatataggctattttctaa

SEQ ID NO: 2369562 - DNA, 14 bp, Homo sapiens
atatatattaagtg

SEQ ID NO: 2369563 - DNA, 17 bp, Homo sapiens
atatatcacccagacat

SEQ ID NO: 2369564 - DNA, 22 bp, Homo sapiens
atatattgaacttttgtactga

SEQ ID NO: 2369565 - DNA, 20 bp, Homo sapiens
atatattttcatcctataag

SEQ ID NO: 2369566 - DNA, 14 bp, Homo sapiens
atatcaaataaaat

SEQ ID NO: 2369567 - DNA, 18 bp, Homo sapiens
atatcaactctgaagcta

SEQ ID NO: 2369568 - DNA, 16 bp, Homo sapiens
atatcacccagacata

SEQ ID NO: 2369569 - DNA, 19 bp, Homo sapiens
atatcacccagacataaag

SEQ ID NO: 2369570 - DNA, 20 bp, Homo sapiens
atatcacccagacataaagg

SEQ ID NO: 2369571 - DNA, 22 bp, Homo sapiens
atatcacccagacataaaggaa

SEQ ID NO: 2369572 - DNA, 20 bp, Homo sapiens
atatcaggaaatatctgtga

SEQ ID NO: 2369573 - DNA, 12 bp, Homo sapiens
atcatgcaaaat

SEQ ID NO: 2369574 - DNA, 21 bp, Homo sapiens
atcatgcatgtcctgtaaagg

SEQ ID NO: 2369575 - DNA, 14 bp, Homo sapiens
atcatggtgtaata

SEQ ID NO: 2369576 - DNA, 17 bp, Homo sapiens
atcatggtgtaataaga

SEQ ID NO: 2369577 - DNA, 20 bp, Homo sapiens
atcatggtgtaataagacat

SEQ ID NO: 2369578 - DNA, 20 bp, Homo sapiens
atcattaaaaattaccttta

SEQ ID NO: 2369579 - DNA, 14 bp, Homo sapiens
atcattcagaaatg

SEQ ID NO: 2369580 - DNA, 18 bp, Homo sapiens
atcattgattgtcagcta

SEQ ID NO: 2369581 - DNA, 22 bp, Homo sapiens
atccaaatttttttttaaagca

SEQ ID NO: 2369582 - DNA, 15 bp, Homo sapiens
atccaagcctccaca

SEQ ID NO: 2369583 - DNA, 18 bp, Homo sapiens
atccaagcctccacagcg

SEQ ID NO: 2369584 - DNA, 19 bp, Homo sapiens
atccaagcctccacagcga

SEQ ID NO: 2369585 - DNA, 17 bp, Homo sapiens
atccaagggttgagagc

SEQ ID NO: 2369586 - DNA, 14 bp, Homo sapiens
atccacaagccatt

SEQ ID NO: 2369587 - DNA, 17 bp, Homo sapiens
atccacctgccttggcc

SEQ ID NO: 2369588 - DNA, 15 bp, Homo sapiens
atccagatgtggcta

SEQ ID NO: 2369589 - DNA, 23 bp, Homo sapiens
atccagatgtggctactgacata

SEQ ID NO: 2369590 - DNA, 22 bp, Homo sapiens
atccagctctttattacatagc

SEQ ID NO: 2369591 - DNA, 20 bp, Homo sapiens
atccaggagataattgtttc

SEQ ID NO: 2369592 - DNA, 15 bp, Homo sapiens
atccaggcaccagga

SEQ ID NO: 2369593 - DNA, 16 bp, Homo sapiens
atccaggcaccaggac

SEQ ID NO: 2369594 - DNA, 20 bp, Homo sapiens
atccatctcctggtgttctg

SEQ ID NO: 2369595 - DNA, 18 bp, Homo sapiens
atccattacctccatcca

SEQ ID NO: 2369596 - DNA, 13 bp, Homo sapiens
atcccacatccaa

SEQ ID NO: 2369597 - DNA, 15 bp, Homo sapiens
atcccacccacatgt

SEQ ID NO: 2369598 - DNA, 17 bp, Homo sapiens
atcccatcattttccat

SEQ ID NO: 2369599 - DNA, 16 bp, Homo sapiens
atccccatctccctgc

SEQ ID NO: 2369600 - DNA, 14 bp, Homo sapiens
atccccgcctggcc

SEQ ID NO: 2369601 - DNA, 18 bp, Homo sapiens
atccccgcctggccagga

SEQ ID NO: 2369602 - DNA, 20 bp, Homo sapiens
atccccgcctggccaggagc

SEQ ID NO: 2369603 - DNA, 13 bp, Homo sapiens
atcccgggcctca

SEQ ID NO: 2369604 - DNA, 11 bp, Homo sapiens
atccctgcaga

SEQ ID NO: 2369605 - DNA, 22 bp, Homo sapiens
atccctttgtctgtcaatcaca

SEQ ID NO: 2369606 - DNA, 23 bp, Homo sapiens
atccctttgtctgtcaatcacag

SEQ ID NO: 2369607 - DNA, 22 bp, Homo sapiens
atccgagtgtgatttgaattct

SEQ ID NO: 2369608 - DNA, 20 bp, Homo sapiens
atccgctgccagccttgagc

SEQ ID NO: 2369609 - DNA, 18 bp, Homo sapiens
atcctaagatgtgttctt

SEQ ID NO: 2369610 - DNA, 20 bp, Homo sapiens
atcctaatttctcctccctt

SEQ ID NO: 2369611 - DNA, 18 bp, Homo sapiens
atcctactaataaaccag

SEQ ID NO: 2369612 - DNA, 14 bp, Homo sapiens
atcctatgcttaat

SEQ ID NO: 2369613 - DNA, 20 bp, Homo sapiens
atcctcaaacgacagaggag

SEQ ID NO: 2369614 - DNA, 12 bp, Homo sapiens
atcctccctcca

SEQ ID NO: 2369615 - DNA, 14 bp, Homo sapiens
atcctcctgcctca

SEQ ID NO: 2369616 - DNA, 10 bp, Homo sapiens
atcctctctc

SEQ ID NO: 2369617 - DNA, 12 bp, Homo sapiens
atcctctctctc

SEQ ID NO: 2369618 - DNA, 22 bp, Homo sapiens
atcctcttttaatggcatttct

SEQ ID NO: 2369619 - DNA, 23 bp, Homo sapiens
atcctcttttaatggcatttctc

SEQ ID NO: 2369620 - DNA, 20 bp, Homo sapiens
atcctgcagggcttctcctc

SEQ ID NO: 2369621 - DNA, 12 bp, Homo sapiens
atcctgcctgcc

SEQ ID NO: 2369622 - DNA, 12 bp, Homo sapiens
atcctggcagcc

SEQ ID NO: 2369623 - DNA, 15 bp, Homo sapiens
atcctggcagcccag

SEQ ID NO: 2369624 - DNA, 18 bp, Homo sapiens
atcctggcagcccagaga

SEQ ID NO: 2369625 - DNA, 24 bp, Homo sapiens
atcctggcagcccagagactttgt

SEQ ID NO: 2369626 - DNA, 19 bp, Homo sapiens
atcctggttaccactcttt

SEQ ID NO: 2369627 - DNA, 15 bp, Homo sapiens
atccttcagcacagg

SEQ ID NO: 2369628 - DNA, 16 bp, Homo sapiens
atccttggagagcagc

SEQ ID NO: 2369629 - DNA, 17 bp, Homo sapiens
atccttggagagcagct

SEQ ID NO: 2369630 - DNA, 18 bp, Homo sapiens
atccttggagagcagctg

SEQ ID NO: 2369631 - DNA, 20 bp, Homo sapiens
atccttggagagcagctggc

SEQ ID NO: 2369632 - DNA, 15 bp, Homo sapiens
atccttgtcttttga

SEQ ID NO: 2369633 - DNA, 13 bp, Homo sapiens
atcgaaataacaa

SEQ ID NO: 2369634 - DNA, 18 bp, Homo sapiens
atcgaaataacaatgtta

SEQ ID NO: 2369635 - DNA, 22 bp, Homo sapiens
atcgaaataacaatgttaagga

SEQ ID NO: 2369636 - DNA, 23 bp, Homo sapiens
atcgaaataacaatgttaaggaa

SEQ ID NO: 2369637 - DNA, 18 bp, Homo sapiens
atcgatgagcgccacctc

SEQ ID NO: 2369638 - DNA, 13 bp, Homo sapiens
atcgccctccttt

SEQ ID NO: 2369639 - DNA, 18 bp, Homo sapiens
atcgccctcctttccctt

SEQ ID NO: 2369640 - DNA, 15 bp, Homo sapiens
atcggaaagctcttc

SEQ ID NO: 2369641 - DNA, 14 bp, Homo sapiens
atcggactgccaaa

SEQ ID NO: 2369642 - DNA, 14 bp, Homo sapiens
atcgtttttgtatt

SEQ ID NO: 2369643 - DNA, 14 bp, Homo sapiens
atctaaaaaaatgt

SEQ ID NO: 2369644 - DNA, 13 bp, Homo sapiens
atctaaaatgtgt

SEQ ID NO: 2369645 - DNA, 12 bp, Homo sapiens
atctaaaatgtt

SEQ ID NO: 2369646 - DNA, 13 bp, Homo sapiens
atctaaaatgttt

SEQ ID NO: 2369647 - DNA, 19 bp, Homo sapiens
atctaagggaagatcactg

SEQ ID NO: 2369648 - DNA, 20 bp, Homo sapiens
atctaagggaagatcactgt

SEQ ID NO: 2369649 - DNA, 22 bp, Homo sapiens
atctaatacctctgtgtgctcc

SEQ ID NO: 2369650 - DNA, 13 bp, Homo sapiens
atctaattctgat

SEQ ID NO: 2369651 - DNA, 14 bp, Homo sapiens
atctacaatctctt

SEQ ID NO: 2369652 - DNA, 16 bp, Homo sapiens
atctacatctccttca

SEQ ID NO: 2369653 - DNA, 21 bp, Homo sapiens
atctagccagcccctcttccc

SEQ ID NO: 2369654 - DNA, 12 bp, Homo sapiens
atctcaaaatta

SEQ ID NO: 2369655 - DNA, 20 bp, Homo sapiens
atctcaaataggctattaaa

SEQ ID NO: 2369656 - DNA, 19 bp, Homo sapiens
atctcaataaagtgcttta

SEQ ID NO: 2369657 - DNA, 22 bp, Homo sapiens
atctcaataaagtgctttaaaa

SEQ ID NO: 2369658 - DNA, 13 bp, Homo sapiens
atctcacaggctg

SEQ ID NO: 2369659 - DNA, 13 bp, Homo sapiens
atctcagctttga

SEQ ID NO: 2369660 - DNA, 15 bp, Homo sapiens
atctcagtcatgcat

SEQ ID NO: 2369661 - DNA, 15 bp, Homo sapiens
atctcatctatctca

SEQ ID NO: 2369662 - DNA, 18 bp, Homo sapiens
atctcatgaggggagagg

SEQ ID NO: 2369663 - DNA, 15 bp, Homo sapiens
atctcattatttctg

SEQ ID NO: 2369664 - DNA, 16 bp, Homo sapiens
atctccataaacatga

SEQ ID NO: 2369665 - DNA, 22 bp, Homo sapiens
atctccatggccctgtcccagg

SEQ ID NO: 2369666 - DNA, 20 bp, Homo sapiens
atctcccaaggctgccagac

SEQ ID NO: 2369667 - DNA, 22 bp, Homo sapiens
atctcccaaggctgccagacat

SEQ ID NO: 2369668 - DNA, 13 bp, Homo sapiens
atctccctgcctg

SEQ ID NO: 2369669 - DNA, 15 bp, Homo sapiens
atctccctgcctggc

SEQ ID NO: 2369670 - DNA, 13 bp, Homo sapiens
atctcctggtgtt

SEQ ID NO: 2369671 - DNA, 17 bp, Homo sapiens
atctcgctccctcccag

SEQ ID NO: 2369672 - DNA, 19 bp, Homo sapiens
atctcgctccctcccagga

SEQ ID NO: 2369673 - DNA, 12 bp, Homo sapiens
atctctcctggc

SEQ ID NO: 2369674 - DNA, 19 bp, Homo sapiens
atctctgaagccacaaata

SEQ ID NO: 2369675 - DNA, 12 bp, Homo sapiens
atctctgcctct

SEQ ID NO: 2369676 - DNA, 17 bp, Homo sapiens
atctcttcactaccctg

SEQ ID NO: 2369677 - DNA, 17 bp, Homo sapiens
atctcttccccagagag

SEQ ID NO: 2369678 - DNA, 18 bp, Homo sapiens
atctcttccccagagagg

SEQ ID NO: 2369679 - DNA, 11 bp, Homo sapiens
atctctttaga

SEQ ID NO: 2369680 - DNA, 13 bp, Homo sapiens
atctctttagaga

SEQ ID NO: 2369681 - DNA, 14 bp, Homo sapiens
atctctttagagaa

SEQ ID NO: 2369682 - DNA, 15 bp, Homo sapiens
atctctttttgtttg

SEQ ID NO: 2369683 - DNA, 21 bp, Homo sapiens
atctgagattgtgtttgttca

SEQ ID NO: 2369684 - DNA, 22 bp, Homo sapiens
atctgagattgtgtttgttcat

SEQ ID NO: 2369685 - DNA, 15 bp, Homo sapiens
atctgatctgtacca

SEQ ID NO: 2369686 - DNA, 14 bp, Homo sapiens
atctgattgcactg

SEQ ID NO: 2369687 - DNA, 20 bp, Homo sapiens
atctgcaccccttctctcct

SEQ ID NO: 2369688 - DNA, 21 bp, Homo sapiens
atctgcaccccttctctcctc

SEQ ID NO: 2369689 - DNA, 17 bp, Homo sapiens
atgcaaaatatgtttaa

SEQ ID NO: 2369690 - DNA, 14 bp, Homo sapiens
atgcaaatgagctc

SEQ ID NO: 2369691 - DNA, 21 bp, Homo sapiens
atgcaaatgagctctgaaatc

SEQ ID NO: 2369692 - DNA, 23 bp, Homo sapiens
atgcaaatgagctctgaaatctt

SEQ ID NO: 2369693 - DNA, 14 bp, Homo sapiens
atgcaataaaattt

SEQ ID NO: 2369694 - DNA, 18 bp, Homo sapiens
atgcaataaaatttaaaa

SEQ ID NO: 2369695 - DNA, 12 bp, Homo sapiens
atgcaataattt

SEQ ID NO: 2369696 - DNA, 14 bp, Homo sapiens
atgcaataatttta

SEQ ID NO: 2369697 - DNA, 15 bp, Homo sapiens
atgcacttttagaaa

SEQ ID NO: 2369698 - DNA, 16 bp, Homo sapiens
atgcagaaacttggat

SEQ ID NO: 2369699 - DNA, 18 bp, Homo sapiens
atgcagaaatagacaaaa

SEQ ID NO: 2369700 - DNA, 20 bp, Homo sapiens
atgcagaaatagacaaaaag

SEQ ID NO: 2369701 - DNA, 21 bp, Homo sapiens
atgcagacctcatgcccagct

SEQ ID NO: 2369702 - DNA, 23 bp, Homo sapiens
atgcagacctcatgcccagctct

SEQ ID NO: 2369703 - DNA, 13 bp, Homo sapiens
atgcagagagcca

SEQ ID NO: 2369704 - DNA, 15 bp, Homo sapiens
atgcagctttgcaaa

SEQ ID NO: 2369705 - DNA, 22 bp, Homo sapiens
atgcaggaggtggagaaaattg

SEQ ID NO: 2369706 - DNA, 21 bp, Homo sapiens
atgcagtgatatggcagaaga

SEQ ID NO: 2369707 - DNA, 23 bp, Homo sapiens
atgcagtgatatggcagaagaca

SEQ ID NO: 2369708 - DNA, 22 bp, Homo sapiens
atgcagttagctgaagaattga

SEQ ID NO: 2369709 - DNA, 15 bp, Homo sapiens
atgcataaactaaaa

SEQ ID NO: 2369710 - DNA, 17 bp, Homo sapiens
atgcataaatatgcagt

SEQ ID NO: 2369711 - DNA, 15 bp, Homo sapiens
atgcatataatgaat

SEQ ID NO: 2369712 - DNA, 17 bp, Homo sapiens
atgcatatcctgagcca

SEQ ID NO: 2369713 - DNA, 16 bp, Homo sapiens
atgcatgcaaatgagc

SEQ ID NO: 2369714 - DNA, 19 bp, Homo sapiens
atgcatgggaggaattcat

SEQ ID NO: 2369715 - DNA, 17 bp, Homo sapiens
atgcatgtcctgtaaag

SEQ ID NO: 2369716 - DNA, 23 bp, Homo sapiens
atgcattcacatttagaaaagtg

SEQ ID NO: 2369717 - DNA, 13 bp, Homo sapiens
atgcatttaataa

SEQ ID NO: 2369718 - DNA, 17 bp, Homo sapiens
atgcatttaataaagat

SEQ ID NO: 2369719 - DNA, 19 bp, Homo sapiens
atgcatttaataaagatga

SEQ ID NO: 2369720 - DNA, 23 bp, Homo sapiens
atgcatttgaggtcaagtaagaa

SEQ ID NO: 2369721 - DNA, 17 bp, Homo sapiens
atgccagattctgcctc

SEQ ID NO: 2369722 - DNA, 21 bp, Homo sapiens
atgccagattctgcctctctg

SEQ ID NO: 2369723 - DNA, 20 bp, Homo sapiens
atgccagtatttttaaaggc

SEQ ID NO: 2369724 - DNA, 22 bp, Homo sapiens
atgccagtatttttaaaggcat

SEQ ID NO: 2369725 - DNA, 14 bp, Homo sapiens
atgccatttctcac

SEQ ID NO: 2369726 - DNA, 12 bp, Homo sapiens
atgcccagctct

SEQ ID NO: 2369727 - DNA, 15 bp, Homo sapiens
atgcccagctctctg

SEQ ID NO: 2369728 - DNA, 16 bp, Homo sapiens
atgcccagctctctga

SEQ ID NO: 2369729 - DNA, 14 bp, Homo sapiens
atgcctcctgccct

SEQ ID NO: 2369730 - DNA, 16 bp, Homo sapiens
atgcctgcgcctgctg

SEQ ID NO: 2369731 - DNA, 23 bp, Homo sapiens
atgcctgcgcctgctgcctgctg

SEQ ID NO: 2369732 - DNA, 16 bp, Homo sapiens
atgcctgcttgataat

SEQ ID NO: 2369733 - DNA, 16 bp, Homo sapiens
atgccttactcttctt

SEQ ID NO: 2369734 - DNA, 18 bp, Homo sapiens
atgccttactcttcttga

SEQ ID NO: 2369735 - DNA, 19 bp, Homo sapiens
atgcctttgagacagtttc

SEQ ID NO: 2369736 - DNA, 22 bp, Homo sapiens
atgcctttgagacagtttctta

SEQ ID NO: 2369737 - DNA, 15 bp, Homo sapiens
atgccttttctgtga

SEQ ID NO: 2369738 - DNA, 15 bp, Homo sapiens
atgcggtgggtgctg

SEQ ID NO: 2369739 - DNA, 22 bp, Homo sapiens
atgcgtgagatgggtgtacaaa

SEQ ID NO: 2369740 - DNA, 16 bp, Homo sapiens
atgcgtgtttctgact

SEQ ID NO: 2369741 - DNA, 17 bp, Homo sapiens
atgcgtgtttctgactc

SEQ ID NO: 2369742 - DNA, 20 bp, Homo sapiens
atgctaaagatgatgatgtt

SEQ ID NO: 2369743 - DNA, 23 bp, Homo sapiens
atgctaacaaagacaaaagtctg

SEQ ID NO: 2369744 - DNA, 23 bp, Homo sapiens
atgctaagctgatattatttctt

SEQ ID NO: 2369745 - DNA, 16 bp, Homo sapiens
atgctaattcaatgcc

SEQ ID NO: 2369746 - DNA, 14 bp, Homo sapiens
atgctaattttatt

SEQ ID NO: 2369747 - DNA, 16 bp, Homo sapiens
atgctaccaggatgct

SEQ ID NO: 2369748 - DNA, 15 bp, Homo sapiens
atgctatgcaaaaaa

SEQ ID NO: 2369749 - DNA, 17 bp, Homo sapiens
atgctcagggtcactga

SEQ ID NO: 2369750 - DNA, 18 bp, Homo sapiens
atgctcagggtcactgaa

SEQ ID NO: 2369751 - DNA, 19 bp, Homo sapiens
atgctcagggtcactgaac

SEQ ID NO: 2369752 - DNA, 21 bp, Homo sapiens
atgctcagggtcactgaacca

SEQ ID NO: 2369753 - DNA, 12 bp, Homo sapiens
atgctccccaca

SEQ ID NO: 2369754 - DNA, 14 bp, Homo sapiens
atgctccccacagc

SEQ ID NO: 2369755 - DNA, 15 bp, Homo sapiens
atgctgatcttttaa

SEQ ID NO: 2369756 - DNA, 17 bp, Homo sapiens
atgctgatcttttaaaa

SEQ ID NO: 2369757 - DNA, 12 bp, Homo sapiens
atgctgctggcc

SEQ ID NO: 2369758 - DNA, 14 bp, Homo sapiens
atgctgctggccaa

SEQ ID NO: 2369759 - DNA, 21 bp, Homo sapiens
atgctggcggcgcagagggaa

SEQ ID NO: 2369760 - DNA, 18 bp, Homo sapiens
atgctgtgctccatattt

SEQ ID NO: 2369761 - DNA, 15 bp, Homo sapiens
atgctgtttctaaga

SEQ ID NO: 2369762 - DNA, 13 bp, Homo sapiens
atgcttaaatttt

SEQ ID NO: 2369763 - DNA, 15 bp, Homo sapiens
atgcttaataaaaga

SEQ ID NO: 2369764 - DNA, 19 bp, Homo sapiens
atgcttaataaaagaacat

SEQ ID NO: 2369765 - DNA, 20 bp, Homo sapiens
atgcttaataaaagaacatg

SEQ ID NO: 2369766 - DNA, 13 bp, Homo sapiens
atgcttactgata

SEQ ID NO: 2369767 - DNA, 22 bp, Homo sapiens
atgcttactgatatattttaca

SEQ ID NO: 2369768 - DNA, 20 bp, Homo sapiens
atgcttcattattcaagaat

SEQ ID NO: 2369769 - DNA, 21 bp, Homo sapiens
atgcttcatttgtatgtcaaa

SEQ ID NO: 2369770 - DNA, 16 bp, Homo sapiens
atgcttcctgacaatc

SEQ ID NO: 2369771 - DNA, 13 bp, Homo sapiens
atgcttcctttct

SEQ ID NO: 2369772 - DNA, 20 bp, Homo sapiens
atgcttcctttctctcctgg

SEQ ID NO: 2369773 - DNA, 22 bp, Homo sapiens
atgcttcctttctctcctggct

SEQ ID NO: 2369774 - DNA, 23 bp, Homo sapiens
atgcttcctttctctcctggctc

SEQ ID NO: 2369775 - DNA, 12 bp, Homo sapiens
atgcttgggaag

SEQ ID NO: 2369776 - DNA, 18 bp, Homo sapiens
atgcttgggaagactcct

SEQ ID NO: 2369777 - DNA, 23 bp, Homo sapiens
atgcttgggaagactcctagctg

SEQ ID NO: 2369778 - DNA, 20 bp, Homo sapiens
atgctttctctctagtagtt

SEQ ID NO: 2369779 - DNA, 20 bp, Homo sapiens
atggaaaaggaagactagag

SEQ ID NO: 2369780 - DNA, 18 bp, Homo sapiens
atggaaaagtgtccttct

SEQ ID NO: 2369781 - DNA, 15 bp, Homo sapiens
atggaaagacaaact

SEQ ID NO: 2369782 - DNA, 23 bp, Homo sapiens
atggaaagcagagttttcattaa

SEQ ID NO: 2369783 - DNA, 13 bp, Homo sapiens
atggaaaggatgg

SEQ ID NO: 2369784 - DNA, 12 bp, Homo sapiens
atggaagaaagt

SEQ ID NO: 2369785 - DNA, 13 bp, Homo sapiens
atggaagaaagta

SEQ ID NO: 2369786 - DNA, 14 bp, Homo sapiens
atggaatatcagaa

SEQ ID NO: 2369787 - DNA, 15 bp, Homo sapiens
atggacacgagccac

SEQ ID NO: 2369788 - DNA, 16 bp, Homo sapiens
atggacacgagccaca

SEQ ID NO: 2369789 - DNA, 17 bp, Homo sapiens
atggacacgagccacaa

SEQ ID NO: 2369790 - DNA, 17 bp, Homo sapiens
atggacatttagaagaa

SEQ ID NO: 2369791 - DNA, 18 bp, Homo sapiens
atggaccaacctgctctg

SEQ ID NO: 2369792 - DNA, 22 bp, Homo sapiens
atggaccaacctgctctgtccc

SEQ ID NO: 2369793 - DNA, 14 bp, Homo sapiens
atggactggcccct

SEQ ID NO: 2369794 - DNA, 14 bp, Homo sapiens
atggagaagctgca

SEQ ID NO: 2369795 - DNA, 15 bp, Homo sapiens
atggagaagctgcag

SEQ ID NO: 2369796 - DNA, 21 bp, Homo sapiens
atggaggatctctaaagagca

SEQ ID NO: 2369797 - DNA, 15 bp, Homo sapiens
atggagttcttgtgc

SEQ ID NO: 2369798 - DNA, 22 bp, Homo sapiens
atggattggattatttaataac

SEQ ID NO: 2369799 - DNA, 16 bp, Homo sapiens
atggcagaagacacca

SEQ ID NO: 2369800 - DNA, 24 bp, Homo sapiens
atggcagaagacaccagagcagat

SEQ ID NO: 2369801 - DNA, 15 bp, Homo sapiens
atggcatcttcaata

SEQ ID NO: 2369802 - DNA, 16 bp, Homo sapiens
atggcatcttcaatat

SEQ ID NO: 2369803 - DNA, 17 bp, Homo sapiens
atgtgagccaccgtgcc

SEQ ID NO: 2369804 - DNA, 21 bp, Homo sapiens
atgtgatacattttttaagct

SEQ ID NO: 2369805 - DNA, 18 bp, Homo sapiens
atgtgatggacactccag

SEQ ID NO: 2369806 - DNA, 17 bp, Homo sapiens
atgtgctatacacacac

SEQ ID NO: 2369807 - DNA, 19 bp, Homo sapiens
atgtgctatacacacacac

SEQ ID NO: 2369808 - DNA, 20 bp, Homo sapiens
atgtggcaaactgaagctgc

SEQ ID NO: 2369809 - DNA, 14 bp, Homo sapiens
atgtgggggcttca

SEQ ID NO: 2369810 - DNA, 19 bp, Homo sapiens
atgtgggggcttcatctct

SEQ ID NO: 2369811 - DNA, 15 bp, Homo sapiens
atgtgtagcctgtgc

SEQ ID NO: 2369812 - DNA, 21 bp, Homo sapiens
atgtgtatttttcaaggcatt

SEQ ID NO: 2369813 - DNA, 18 bp, Homo sapiens
atgtgtcccccccaggcc

SEQ ID NO: 2369814 - DNA, 23 bp, Homo sapiens
atgtgtcccccccaggccttgtc

SEQ ID NO: 2369815 - DNA, 13 bp, Homo sapiens
atgtgtgtctcac

SEQ ID NO: 2369816 - DNA, 15 bp, Homo sapiens
atgtgtttcttgctg

SEQ ID NO: 2369817 - DNA, 16 bp, Homo sapiens
atgttaaagagaatga

SEQ ID NO: 2369818 - DNA, 18 bp, Homo sapiens
atgttaaagagaatgagt

SEQ ID NO: 2369819 - DNA, 22 bp, Homo sapiens
atgttaaagagaatgagtcctt

SEQ ID NO: 2369820 - DNA, 17 bp, Homo sapiens
atgttaaatttgtaagt

SEQ ID NO: 2369821 - DNA, 18 bp, Homo sapiens
atgttaaatttgtaagtt

SEQ ID NO: 2369822 - DNA, 17 bp, Homo sapiens
atgttaaggaaactctt

SEQ ID NO: 2369823 - DNA, 14 bp, Homo sapiens
atgttacttctgat

SEQ ID NO: 2369824 - DNA, 13 bp, Homo sapiens
atgttatgaacag

SEQ ID NO: 2369825 - DNA, 20 bp, Homo sapiens
atgttatgaacagctgtgtc

SEQ ID NO: 2369826 - DNA, 22 bp, Homo sapiens
atgttatgaacagctgtgtctg

SEQ ID NO: 2369827 - DNA, 13 bp, Homo sapiens
atgttatgctggt

SEQ ID NO: 2369828 - DNA, 13 bp, Homo sapiens
atgttcatatcta

SEQ ID NO: 2369829 - DNA, 17 bp, Homo sapiens
atgttcctaacaaaatg

SEQ ID NO: 2369830 - DNA, 12 bp, Homo sapiens
atgttgggaaag

SEQ ID NO: 2369831 - DNA, 12 bp, Homo sapiens
atgttgtaatat

SEQ ID NO: 2369832 - DNA, 18 bp, Homo sapiens
atgttgtttataataaaa

SEQ ID NO: 2369833 - DNA, 20 bp, Homo sapiens
atgttgtttataataaaaat

SEQ ID NO: 2369834 - DNA, 19 bp, Homo sapiens
atgtttaaaagaaatatat

SEQ ID NO: 2369835 - DNA, 20 bp, Homo sapiens
atgtttaaaagaaatatatt

SEQ ID NO: 2369836 - DNA, 12 bp, Homo sapiens
atgtttaaaata

SEQ ID NO: 2369837 - DNA, 15 bp, Homo sapiens
atgtttaaaataaaa

SEQ ID NO: 2369838 - DNA, 18 bp, Homo sapiens
atgtttaaaataaaatga

SEQ ID NO: 2369839 - DNA, 15 bp, Homo sapiens
atgtttaaaatggca

SEQ ID NO: 2369840 - DNA, 16 bp, Homo sapiens
atgtttaaaatggcat

SEQ ID NO: 2369841 - DNA, 14 bp, Homo sapiens
atgtttatgagcca

SEQ ID NO: 2369842 - DNA, 15 bp, Homo sapiens
atgtttatgagccag

SEQ ID NO: 2369843 - DNA, 13 bp, Homo sapiens
atgtttcattatg

SEQ ID NO: 2369844 - DNA, 16 bp, Homo sapiens
atgtttcttttaaaga

SEQ ID NO: 2369845 - DNA, 21 bp, Homo sapiens
atgtttcttttgtttggtaaa

SEQ ID NO: 2369846 - DNA, 16 bp, Homo sapiens
atgtttgcctcataat

SEQ ID NO: 2369847 - DNA, 16 bp, Homo sapiens
atgttttatatgatta

SEQ ID NO: 2369848 - DNA, 20 bp, Homo sapiens
atgtttttccctccccagaa

SEQ ID NO: 2369849 - DNA, 17 bp, Homo sapiens
attaaaaaaaaattgta

SEQ ID NO: 2369850 - DNA, 16 bp, Homo sapiens
attaaaaaagagacat

SEQ ID NO: 2369851 - DNA, 14 bp, Homo sapiens
attaaaacaaatat

SEQ ID NO: 2369852 - DNA, 21 bp, Homo sapiens
attaaaatacagctgcactga

SEQ ID NO: 2369853 - DNA, 12 bp, Homo sapiens
attaaaatattt

SEQ ID NO: 2369854 - DNA, 14 bp, Homo sapiens
attaaaatatttca

SEQ ID NO: 2369855 - DNA, 13 bp, Homo sapiens
attaaacaaagtt

SEQ ID NO: 2369856 - DNA, 21 bp, Homo sapiens
attaaacttccaaagaaagtt

SEQ ID NO: 2369857 - DNA, 16 bp, Homo sapiens
attaaagtcagaagtt

SEQ ID NO: 2369858 - DNA, 13 bp, Homo sapiens
attaaataaaatt

SEQ ID NO: 2369859 - DNA, 16 bp, Homo sapiens
attaaatgcttcattt

SEQ ID NO: 2369860 - DNA, 18 bp, Homo sapiens
attaaattatcattgttt

SEQ ID NO: 2369861 - DNA, 19 bp, Homo sapiens
attaaattatcattgtttg

SEQ ID NO: 2369862 - DNA, 12 bp, Homo sapiens
attaaattatga

SEQ ID NO: 2369863 - DNA, 15 bp, Homo sapiens
attaacggtgctaaa

SEQ ID NO: 2369864 - DNA, 17 bp, Homo sapiens
attaactactgaataat

SEQ ID NO: 2369865 - DNA, 20 bp, Homo sapiens
attaactactgaataatgct

SEQ ID NO: 2369866 - DNA, 21 bp, Homo sapiens
attaactactgaataatgcta

SEQ ID NO: 2369867 - DNA, 19 bp, Homo sapiens
attaactatttttttcaaa

SEQ ID NO: 2369868 - DNA, 14 bp, Homo sapiens
attaagaaaactat

SEQ ID NO: 2369869 - DNA, 16 bp, Homo sapiens
attaagaaaactatta

SEQ ID NO: 2369870 - DNA, 14 bp, Homo sapiens
attaagatgagcaa

SEQ ID NO: 2369871 - DNA, 22 bp, Homo sapiens
attaagggacatttctataaaa

SEQ ID NO: 2369872 - DNA, 18 bp, Homo sapiens
attaaggggaagaatgaa

SEQ ID NO: 2369873 - DNA, 18 bp, Homo sapiens
attaagtggctttttaac

SEQ ID NO: 2369874 - DNA, 12 bp, Homo sapiens
attaataaaata

SEQ ID NO: 2369875 - DNA, 19 bp, Homo sapiens
attaataagatttttcaaa

SEQ ID NO: 2369876 - DNA, 20 bp, Homo sapiens
attaatagccaaagatttca

SEQ ID NO: 2369877 - DNA, 12 bp, Homo sapiens
attaatatatta

SEQ ID NO: 2369878 - DNA, 18 bp, Homo sapiens
attaatatcaactctgaa

SEQ ID NO: 2369879 - DNA, 21 bp, Homo sapiens
attaatcaagagaaacttcaa

SEQ ID NO: 2369880 - DNA, 20 bp, Homo sapiens
attaatcatacaaactctca

SEQ ID NO: 2369881 - DNA, 21 bp, Homo sapiens
attaatcatacaaactctcac

SEQ ID NO: 2369882 - DNA, 22 bp, Homo sapiens
attaatgcctgctttttggaaa

SEQ ID NO: 2369883 - DNA, 22 bp, Homo sapiens
attaatgtctcactttactttc

SEQ ID NO: 2369884 - DNA, 23 bp, Homo sapiens
attaatgtctcactttactttca

SEQ ID NO: 2369885 - DNA, 16 bp, Homo sapiens
attaattagttccagt

SEQ ID NO: 2369886 - DNA, 13 bp, Homo sapiens
attacaaagttaa

SEQ ID NO: 2369887 - DNA, 15 bp, Homo sapiens
attacaaagttaaaa

SEQ ID NO: 2369888 - DNA, 23 bp, Homo sapiens
attacaaagttaaaattgttatc

SEQ ID NO: 2369889 - DNA, 18 bp, Homo sapiens
attacaactgaccaagtt

SEQ ID NO: 2369890 - DNA, 15 bp, Homo sapiens
attacagttctttcc

SEQ ID NO: 2369891 - DNA, 19 bp, Homo sapiens
attacagttctttcctctt

SEQ ID NO: 2369892 - DNA, 21 bp, Homo sapiens
attacctggagaagaatggct

SEQ ID NO: 2369893 - DNA, 19 bp, Homo sapiens
attacctttaattttaatg

SEQ ID NO: 2369894 - DNA, 15 bp, Homo sapiens
attacctttacatat

SEQ ID NO: 2369895 - DNA, 18 bp, Homo sapiens
attactgctttaatcaga

SEQ ID NO: 2369896 - DNA, 12 bp, Homo sapiens
attactgtcccc

SEQ ID NO: 2369897 - DNA, 14 bp, Homo sapiens
attactttatgaac

SEQ ID NO: 2369898 - DNA, 18 bp, Homo sapiens
attagagtatttcccttc

SEQ ID NO: 2369899 - DNA, 13 bp, Homo sapiens
attagataatatt

SEQ ID NO: 2369900 - DNA, 11 bp, Homo sapiens
attaggctgtt

SEQ ID NO: 2369901 - DNA, 12 bp, Homo sapiens
attaggctgttg

SEQ ID NO: 2369902 - DNA, 21 bp, Homo sapiens
attagtaacattcatgttcta

SEQ ID NO: 2369903 - DNA, 20 bp, Homo sapiens
attagtggtcataaaataga

SEQ ID NO: 2369904 - DNA, 22 bp, Homo sapiens
attagtgtgacagtttccaaat

SEQ ID NO: 2369905 - DNA, 20 bp, Homo sapiens
attagttccagtttctcctt

SEQ ID NO: 2369906 - DNA, 18 bp, Homo sapiens
attataaaggataaagaa

SEQ ID NO: 2369907 - DNA, 14 bp, Homo sapiens
attataacataaaa

SEQ ID NO: 2369908 - DNA, 17 bp, Homo sapiens
attataacataaaagca

SEQ ID NO: 2369909 - DNA, 19 bp, Homo sapiens
attatagcaactaatgttt

SEQ ID NO: 2369910 - DNA, 15 bp, Homo sapiens
attatagtaactata

SEQ ID NO: 2369911 - DNA, 23 bp, Homo sapiens
attatcacattaatctcaaagag

SEQ ID NO: 2369912 - DNA, 13 bp, Homo sapiens
attatcagcaaag

SEQ ID NO: 2369913 - DNA, 15 bp, Homo sapiens
attatcagcaaagaa

SEQ ID NO: 2369914 - DNA, 17 bp, Homo sapiens
attatcattgtttgtcc

SEQ ID NO: 2369915 - DNA, 16 bp, Homo sapiens
attatcttcagcccag

SEQ ID NO: 2369916 - DNA, 18 bp, Homo sapiens
attatcttgttcaggaaa

SEQ ID NO: 2369917 - DNA, 16 bp, Homo sapiens
attatgaagctcatat

SEQ ID NO: 2369918 - DNA, 13 bp, Homo sapiens
attgcttaaaagc

SEQ ID NO: 2369919 - DNA, 19 bp, Homo sapiens
attgcttattatgtaggta

SEQ ID NO: 2369920 - DNA, 21 bp, Homo sapiens
attgcttttttccaaaacaaa

SEQ ID NO: 2369921 - DNA, 13 bp, Homo sapiens
attggaccaggcc

SEQ ID NO: 2369922 - DNA, 15 bp, Homo sapiens
attggaccaggccat

SEQ ID NO: 2369923 - DNA, 19 bp, Homo sapiens
attggattatttaataaca

SEQ ID NO: 2369924 - DNA, 12 bp, Homo sapiens
attggggaggag

SEQ ID NO: 2369925 - DNA, 19 bp, Homo sapiens
attggtaaaaacagcagct

SEQ ID NO: 2369926 - DNA, 14 bp, Homo sapiens
attggttcttcccc

SEQ ID NO: 2369927 - DNA, 21 bp, Homo sapiens
attggttcttcccctcatagt

SEQ ID NO: 2369928 - DNA, 17 bp, Homo sapiens
attgtaaaaaaaaatgc

SEQ ID NO: 2369929 - DNA, 20 bp, Homo sapiens
attgtaaaaaaaaatgcctt

SEQ ID NO: 2369930 - DNA, 23 bp, Homo sapiens
attgtaaaaaaaaatgcctttga

SEQ ID NO: 2369931 - DNA, 17 bp, Homo sapiens
attgtaagtgaaattaa

SEQ ID NO: 2369932 - DNA, 19 bp, Homo sapiens
attgtaatcgtgtgccatg

SEQ ID NO: 2369933 - DNA, 15 bp, Homo sapiens
attgtacaaaattaa

SEQ ID NO: 2369934 - DNA, 22 bp, Homo sapiens
attgtacaaaattaagcaaatg

SEQ ID NO: 2369935 - DNA, 18 bp, Homo sapiens
attgtatattacaatgat

SEQ ID NO: 2369936 - DNA, 19 bp, Homo sapiens
attgtcagctactaatgat

SEQ ID NO: 2369937 - DNA, 18 bp, Homo sapiens
attgtctttggtgctttt

SEQ ID NO: 2369938 - DNA, 18 bp, Homo sapiens
attgtgacagagccatgg

SEQ ID NO: 2369939 - DNA, 17 bp, Homo sapiens
attgtggctatcctgat

SEQ ID NO: 2369940 - DNA, 15 bp, Homo sapiens
attgtgttcccattt

SEQ ID NO: 2369941 - DNA, 18 bp, Homo sapiens
attgttcttattctggca

SEQ ID NO: 2369942 - DNA, 19 bp, Homo sapiens
attgttgtttctttctagt

SEQ ID NO: 2369943 - DNA, 20 bp, Homo sapiens
attgttgtttctttctagtg

SEQ ID NO: 2369944 - DNA, 17 bp, Homo sapiens
attgtttaaaatgtaat

SEQ ID NO: 2369945 - DNA, 17 bp, Homo sapiens
attgtttctgcattcat

SEQ ID NO: 2369946 - DNA, 17 bp, Homo sapiens
attgttttacaatagtt

SEQ ID NO: 2369947 - DNA, 19 bp, Homo sapiens
attgttttacaatagttct

SEQ ID NO: 2369948 - DNA, 14 bp, Homo sapiens
atttaaaaacattt

SEQ ID NO: 2369949 - DNA, 15 bp, Homo sapiens
atttaaaacagacac

SEQ ID NO: 2369950 - DNA, 16 bp, Homo sapiens
atttaaaacagacact

SEQ ID NO: 2369951 - DNA, 13 bp, Homo sapiens
atttaaatgaaag

SEQ ID NO: 2369952 - DNA, 17 bp, Homo sapiens
atttaaatttttttcct

SEQ ID NO: 2369953 - DNA, 16 bp, Homo sapiens
atttaacattcttggt

SEQ ID NO: 2369954 - DNA, 19 bp, Homo sapiens
atttaacattttacagtaa

SEQ ID NO: 2369955 - DNA, 21 bp, Homo sapiens
atttaacattttacagtaaat

SEQ ID NO: 2369956 - DNA, 12 bp, Homo sapiens
atttaagcacaa

SEQ ID NO: 2369957 - DNA, 19 bp, Homo sapiens
atttaagtgcgtgtgtaga

SEQ ID NO: 2369958 - DNA, 21 bp, Homo sapiens
atttaagtgcgtgtgtagagt

SEQ ID NO: 2369959 - DNA, 22 bp, Homo sapiens
atttaagtgcgtgtgtagagtt

SEQ ID NO: 2369960 - DNA, 21 bp, Homo sapiens
atttaataaaataattctaaa

SEQ ID NO: 2369961 - DNA, 14 bp, Homo sapiens
atttaataaagatg

SEQ ID NO: 2369962 - DNA, 16 bp, Homo sapiens
atttaataaagatgag

SEQ ID NO: 2369963 - DNA, 17 bp, Homo sapiens
atttaataaagatgagt

SEQ ID NO: 2369964 - DNA, 15 bp, Homo sapiens
atttaataacattac

SEQ ID NO: 2369965 - DNA, 19 bp, Homo sapiens
atttaataccagatacctt

SEQ ID NO: 2369966 - DNA, 20 bp, Homo sapiens
atttaccctttggccccact

SEQ ID NO: 2369967 - DNA, 13 bp, Homo sapiens
atttactaacagt

SEQ ID NO: 2369968 - DNA, 18 bp, Homo sapiens
atttactaacagtaactg

SEQ ID NO: 2369969 - DNA, 19 bp, Homo sapiens
atttactaacagtaactgc

SEQ ID NO: 2369970 - DNA, 12 bp, Homo sapiens
atttacttgttt

SEQ ID NO: 2369971 - DNA, 15 bp, Homo sapiens
atttacttgttttgg

SEQ ID NO: 2369972 - DNA, 14 bp, Homo sapiens
atttagaaatgttt

SEQ ID NO: 2369973 - DNA, 17 bp, Homo sapiens
atttagggaagcaggga

SEQ ID NO: 2369974 - DNA, 23 bp, Homo sapiens
atttagggaagcagggacacccc

SEQ ID NO: 2369975 - DNA, 21 bp, Homo sapiens
atttatacaccagcaatttag

SEQ ID NO: 2369976 - DNA, 22 bp, Homo sapiens
atttatacaccagcaatttaga

SEQ ID NO: 2369977 - DNA, 23 bp, Homo sapiens
atttatgaattgaattatcttgg

SEQ ID NO: 2369978 - DNA, 16 bp, Homo sapiens
atttatgggtggattt

SEQ ID NO: 2369979 - DNA, 18 bp, Homo sapiens
atttatgtagatgtgcat

SEQ ID NO: 2369980 - DNA, 20 bp, Homo sapiens
atttatgtagatgtgcattt

SEQ ID NO: 2369981 - DNA, 15 bp, Homo sapiens
atttatgtgtatatg

SEQ ID NO: 2369982 - DNA, 16 bp, Homo sapiens
atttatgtgtatatgg

SEQ ID NO: 2369983 - DNA, 21 bp, Homo sapiens
atttatgttgttgaactaata

SEQ ID NO: 2369984 - DNA, 12 bp, Homo sapiens
atttattgccat

SEQ ID NO: 2369985 - DNA, 14 bp, Homo sapiens
atttatttatgtgt

SEQ ID NO: 2369986 - DNA, 20 bp, Homo sapiens
atttatttccactaaaaata

SEQ ID NO: 2369987 - DNA, 15 bp, Homo sapiens
atttattttcctaaa

SEQ ID NO: 2369988 - DNA, 22 bp, Homo sapiens
atttcaagttccaagttgctaa

SEQ ID NO: 2369989 - DNA, 16 bp, Homo sapiens
atttcacctgtaaacc

SEQ ID NO: 2369990 - DNA, 21 bp, Homo sapiens
atttcagtgttacctgtgtgc

SEQ ID NO: 2369991 - DNA, 17 bp, Homo sapiens
atttcagttctaggaaa

SEQ ID NO: 2369992 - DNA, 20 bp, Homo sapiens
atttcatatctaactttgta

SEQ ID NO: 2369993 - DNA, 18 bp, Homo sapiens
atttccaccaggccgtgc

SEQ ID NO: 2369994 - DNA, 21 bp, Homo sapiens
atttccactaaaaatattgtt

SEQ ID NO: 2369995 - DNA, 15 bp, Homo sapiens
atttcccatctgcac

SEQ ID NO: 2369996 - DNA, 15 bp, Homo sapiens
atttcccttccaaag

SEQ ID NO: 2369997 - DNA, 16 bp, Homo sapiens
atttcccttccaaaga

SEQ ID NO: 2369998 - DNA, 16 bp, Homo sapiens
atttcctctccactgc

SEQ ID NO: 2369999 - DNA, 20 bp, Homo sapiens
atttcctctccactgctgga

SEQ ID NO: 2370000 - DNA, 19 bp, Homo sapiens
atttccttgtctaaagatc

SEQ ID NO: 2370001 - DNA, 13 bp, Homo sapiens
atttcctttatgt

SEQ ID NO: 2370002 - DNA, 14 bp, Homo sapiens
atttcctttatgtg

SEQ ID NO: 2370003 - DNA, 21 bp, Homo sapiens
atttcctttatgtgaattttt

SEQ ID NO: 2370004 - DNA, 19 bp, Homo sapiens
atttcctttttgacactga

SEQ ID NO: 2370005 - DNA, 19 bp, Homo sapiens
atttctaacagtccttgct

SEQ ID NO: 2370006 - DNA, 21 bp, Homo sapiens
atttctaacagtccttgcttt

SEQ ID NO: 2370007 - DNA, 13 bp, Homo sapiens
atttctaattgta

SEQ ID NO: 2370008 - DNA, 14 bp, Homo sapiens
atttctagaaacaa

SEQ ID NO: 2370009 - DNA, 15 bp, Homo sapiens
atttctcattgactt

SEQ ID NO: 2370010 - DNA, 17 bp, Homo sapiens
atttctcattgactttt

SEQ ID NO: 2370011 - DNA, 14 bp, Homo sapiens
atttcttatgtgac

SEQ ID NO: 2370012 - DNA, 17 bp, Homo sapiens
atttcttatgtgacatt

SEQ ID NO: 2370013 - DNA, 21 bp, Homo sapiens
atttcttctcttatcctctct

SEQ ID NO: 2370014 - DNA, 21 bp, Homo sapiens
atttcttttgtaataaactat

SEQ ID NO: 2370015 - DNA, 15 bp, Homo sapiens
atttgaaaaatataa

SEQ ID NO: 2370016 - DNA, 14 bp, Homo sapiens
atttgaataaatta

SEQ ID NO: 2370017 - DNA, 15 bp, Homo sapiens
atttgaataaattat

SEQ ID NO: 2370018 - DNA, 17 bp, Homo sapiens
atttgaataaattatga

SEQ ID NO: 2370019 - DNA, 20 bp, Homo sapiens
atttgaataaattatgagct

SEQ ID NO: 2370020 - DNA, 19 bp, Homo sapiens
atttgacacaaagcttcta

SEQ ID NO: 2370021 - DNA, 18 bp, Homo sapiens
atttgagaatacataaac

SEQ ID NO: 2370022 - DNA, 17 bp, Homo sapiens
atttgagagaaatatga

SEQ ID NO: 2370023 - DNA, 22 bp, Homo sapiens
atttgaggtcaagtaagaagac

SEQ ID NO: 2370024 - DNA, 13 bp, Homo sapiens
atttgattaataa

SEQ ID NO: 2370025 - DNA, 14 bp, Homo sapiens
atttgattaataaa

SEQ ID NO: 2370026 - DNA, 16 bp, Homo sapiens
atttgattaataaaat

SEQ ID NO: 2370027 - DNA, 18 bp, Homo sapiens
atttgattaataaaatat

SEQ ID NO: 2370028 - DNA, 18 bp, Homo sapiens
atttgattgggatgaatg

SEQ ID NO: 2370029 - DNA, 13 bp, Homo sapiens
atttgatttctaa

SEQ ID NO: 2370030 - DNA, 21 bp, Homo sapiens
atttgatttctaattgtaagt

SEQ ID NO: 2370031 - DNA, 16 bp, Homo sapiens
atttgcaataacagct

SEQ ID NO: 2370032 - DNA, 18 bp, Homo sapiens
atttgcaccttaaaagac

SEQ ID NO: 2370033 - DNA, 18 bp, Homo sapiens
caaaaaaacaagttatta

SEQ ID NO: 2370034 - DNA, 18 bp, Homo sapiens
caaaaaattctttagaga

SEQ ID NO: 2370035 - DNA, 10 bp, Homo sapiens
caaaaacaaa

SEQ ID NO: 2370036 - DNA, 18 bp, Homo sapiens
caaaaacagaatttgaga

SEQ ID NO: 2370037 - DNA, 14 bp, Homo sapiens
caaaaaccagccag

SEQ ID NO: 2370038 - DNA, 20 bp, Homo sapiens
caaaagattgctgaaatttt

SEQ ID NO: 2370039 - DNA, 22 bp, Homo sapiens
caaaagattgctgaaattttat

SEQ ID NO: 2370040 - DNA, 15 bp, Homo sapiens
caaaagcgccctcac

SEQ ID NO: 2370041 - DNA, 20 bp, Homo sapiens
caaaaggaaagctgtgttta

SEQ ID NO: 2370042 - DNA, 16 bp, Homo sapiens
caaaagtccctccctg

SEQ ID NO: 2370043 - DNA, 16 bp, Homo sapiens
caaaagtctgtctttc

SEQ ID NO: 2370044 - DNA, 19 bp, Homo sapiens
caaaagtctgtctttcctg

SEQ ID NO: 2370045 - DNA, 22 bp, Homo sapiens
caaaatacattattcttcttta

SEQ ID NO: 2370046 - DNA, 19 bp, Homo sapiens
caaaatgaatttttattga

SEQ ID NO: 2370047 - DNA, 18 bp, Homo sapiens
caaaatgttggtcatttt

SEQ ID NO: 2370048 - DNA, 20 bp, Homo sapiens
caaaattcaaaaagaactaa

SEQ ID NO: 2370049 - DNA, 17 bp, Homo sapiens
caaaattcaaagcatgg

SEQ ID NO: 2370050 - DNA, 14 bp, Homo sapiens
caaaccattgctct

SEQ ID NO: 2370051 - DNA, 13 bp, Homo sapiens
caaaccctgtggg

SEQ ID NO: 2370052 - DNA, 23 bp, Homo sapiens
caaaccctgtggggcctgatggt

SEQ ID NO: 2370053 - DNA, 17 bp, Homo sapiens
caaacctaccaaaatgg

SEQ ID NO: 2370054 - DNA, 14 bp, Homo sapiens
caaacctttgagta

SEQ ID NO: 2370055 - DNA, 13 bp, Homo sapiens
caaacgctaaaga

SEQ ID NO: 2370056 - DNA, 23 bp, Homo sapiens
caaactgggaacccctttcccac

SEQ ID NO: 2370057 - DNA, 16 bp, Homo sapiens
caaacttttaagattt

SEQ ID NO: 2370058 - DNA, 16 bp, Homo sapiens
caaagaaaatgaaatg

SEQ ID NO: 2370059 - DNA, 14 bp, Homo sapiens
caaagacaaaagtc

SEQ ID NO: 2370060 - DNA, 15 bp, Homo sapiens
caaagagacatttca

SEQ ID NO: 2370061 - DNA, 18 bp, Homo sapiens
caaagagacatttcaaaa

SEQ ID NO: 2370062 - DNA, 15 bp, Homo sapiens
caaagaggctgcccc

SEQ ID NO: 2370063 - DNA, 21 bp, Homo sapiens
caaagaggctgcccctctcac

SEQ ID NO: 2370064 - DNA, 15 bp, Homo sapiens
caaagagggatgttt

SEQ ID NO: 2370065 - DNA, 15 bp, Homo sapiens
caaagctatttaagt

SEQ ID NO: 2370066 - DNA, 22 bp, Homo sapiens
caaagctatttaagtggactgt

SEQ ID NO: 2370067 - DNA, 14 bp, Homo sapiens
caaagctgcccact

SEQ ID NO: 2370068 - DNA, 15 bp, Homo sapiens
caaagctgcccactg

SEQ ID NO: 2370069 - DNA, 20 bp, Homo sapiens
caaagctgcccactgtttct

SEQ ID NO: 2370070 - DNA, 22 bp, Homo sapiens
caaaggagctttctcaatgtct

SEQ ID NO: 2370071 - DNA, 18 bp, Homo sapiens
caaaggggacagctgtgt

SEQ ID NO: 2370072 - DNA, 23 bp, Homo sapiens
caaagtacttgtcatagactcct

SEQ ID NO: 2370073 - DNA, 17 bp, Homo sapiens
caaagtatgcaatgctt

SEQ ID NO: 2370074 - DNA, 20 bp, Homo sapiens
caaagtgatagaaaagtgtg

SEQ ID NO: 2370075 - DNA, 21 bp, Homo sapiens
caaagtgatagaaaagtgtgg

SEQ ID NO: 2370076 - DNA, 22 bp, Homo sapiens
caaagtgtattaggaagtgttt

SEQ ID NO: 2370077 - DNA, 20 bp, Homo sapiens
caaagtttcagagtatattg

SEQ ID NO: 2370078 - DNA, 13 bp, Homo sapiens
caaagttttgaaa

SEQ ID NO: 2370079 - DNA, 14 bp, Homo sapiens
caaagttttgaaaa

SEQ ID NO: 2370080 - DNA, 19 bp, Homo sapiens
caaagttttgaaaagctat

SEQ ID NO: 2370081 - DNA, 20 bp, Homo sapiens
caaagttttgaaaagctatt

SEQ ID NO: 2370082 - DNA, 12 bp, Homo sapiens
caaataaaatat

SEQ ID NO: 2370083 - DNA, 16 bp, Homo sapiens
caaataaaatatcata

SEQ ID NO: 2370084 - DNA, 14 bp, Homo sapiens
caaataagaaataa

SEQ ID NO: 2370085 - DNA, 19 bp, Homo sapiens
caaataatgcttttctaat

SEQ ID NO: 2370086 - DNA, 14 bp, Homo sapiens
caaatacacatttg

SEQ ID NO: 2370087 - DNA, 17 bp, Homo sapiens
caaatacacatttgcta

SEQ ID NO: 2370088 - DNA, 19 bp, Homo sapiens
caaatataagacatttgtt

SEQ ID NO: 2370089 - DNA, 19 bp, Homo sapiens
caaatatacattttctaaa

SEQ ID NO: 2370090 - DNA, 15 bp, Homo sapiens
caaatcattccttag

SEQ ID NO: 2370091 - DNA, 14 bp, Homo sapiens
caaatccttcaaaa

SEQ ID NO: 2370092 - DNA, 16 bp, Homo sapiens
caaatctcagaacctt

SEQ ID NO: 2370093 - DNA, 16 bp, Homo sapiens
caaatctgatggcctt

SEQ ID NO: 2370094 - DNA, 18 bp, Homo sapiens
caaatggagaagctgcag

SEQ ID NO: 2370095 - DNA, 19 bp, Homo sapiens
caaatggccattttaaaat

SEQ ID NO: 2370096 - DNA, 20 bp, Homo sapiens
caaatgtggccaagcctatc

SEQ ID NO: 2370097 - DNA, 13 bp, Homo sapiens
caaattaaaaaaa

SEQ ID NO: 2370098 - DNA, 19 bp, Homo sapiens
caaattaaaaaaaaattgt

SEQ ID NO: 2370099 - DNA, 15 bp, Homo sapiens
caaattcttctgaac

SEQ ID NO: 2370100 - DNA, 20 bp, Homo sapiens
caaattgccctatgctgtgc

SEQ ID NO: 2370101 - DNA, 20 bp, Homo sapiens
caaattgcttttttccaaaa

SEQ ID NO: 2370102 - DNA, 22 bp, Homo sapiens
caaattgcttttttccaaaaca

SEQ ID NO: 2370103 - DNA, 21 bp, Homo sapiens
caaattttgtaccaagtaaat

SEQ ID NO: 2370104 - DNA, 21 bp, Homo sapiens
caaatttttcaaatcattcct

SEQ ID NO: 2370105 - DNA, 15 bp, Homo sapiens
caacaacaattggta

SEQ ID NO: 2370106 - DNA, 21 bp, Homo sapiens
caacaactctgcctttatgat

SEQ ID NO: 2370107 - DNA, 15 bp, Homo sapiens
caacaattggtaaaa

SEQ ID NO: 2370108 - DNA, 14 bp, Homo sapiens
caacaatttatgaa

SEQ ID NO: 2370109 - DNA, 17 bp, Homo sapiens
caacacattgaaactgt

SEQ ID NO: 2370110 - DNA, 18 bp, Homo sapiens
caacacattgaaactgta

SEQ ID NO: 2370111 - DNA, 13 bp, Homo sapiens
caacagaacatat

SEQ ID NO: 2370112 - DNA, 17 bp, Homo sapiens
caacagactgttgagtt

SEQ ID NO: 2370113 - DNA, 18 bp, Homo sapiens
caacagactgttgagtta

SEQ ID NO: 2370114 - DNA, 16 bp, Homo sapiens
caacagcctttgaatg

SEQ ID NO: 2370115 - DNA, 23 bp, Homo sapiens
caacaggtaaaacagggccacat

SEQ ID NO: 2370116 - DNA, 19 bp, Homo sapiens
caacatgctccaaatataa

SEQ ID NO: 2370117 - DNA, 20 bp, Homo sapiens
caacattaaggaatttgatg

SEQ ID NO: 2370118 - DNA, 20 bp, Homo sapiens
caaccagaggaagaaaatga

SEQ ID NO: 2370119 - DNA, 22 bp, Homo sapiens
caaccctatctcctgacagaag

SEQ ID NO: 2370120 - DNA, 18 bp, Homo sapiens
caacctcaactgcctact

SEQ ID NO: 2370121 - DNA, 15 bp, Homo sapiens
caacctcaccttcct

SEQ ID NO: 2370122 - DNA, 16 bp, Homo sapiens
caacctcaccttcctg

SEQ ID NO: 2370123 - DNA, 19 bp, Homo sapiens
caacctcaccttcctgtgg

SEQ ID NO: 2370124 - DNA, 19 bp, Homo sapiens
caacctcagggctcccagg

SEQ ID NO: 2370125 - DNA, 20 bp, Homo sapiens
caacctcagggctcccaggg

SEQ ID NO: 2370126 - DNA, 16 bp, Homo sapiens
caacctcgctgagggc

SEQ ID NO: 2370127 - DNA, 16 bp, Homo sapiens
caacctctttttcctc

SEQ ID NO: 2370128 - DNA, 15 bp, Homo sapiens
caacctgctctcctc

SEQ ID NO: 2370129 - DNA, 14 bp, Homo sapiens
caacctgctctgtc

SEQ ID NO: 2370130 - DNA, 23 bp, Homo sapiens
caacctgttacctactttgactt

SEQ ID NO: 2370131 - DNA, 15 bp, Homo sapiens
caactagctgggact

SEQ ID NO: 2370132 - DNA, 20 bp, Homo sapiens
caactccagcaacttcttct

SEQ ID NO: 2370133 - DNA, 22 bp, Homo sapiens
caactccagcaacttcttctcc

SEQ ID NO: 2370134 - DNA, 15 bp, Homo sapiens
caactccaggaaaga

SEQ ID NO: 2370135 - DNA, 14 bp, Homo sapiens
caactcgctttagg

SEQ ID NO: 2370136 - DNA, 13 bp, Homo sapiens
caactctccactc

SEQ ID NO: 2370137 - DNA, 13 bp, Homo sapiens
caactctgccttt

SEQ ID NO: 2370138 - DNA, 23 bp, Homo sapiens
caactgaaggggtgcacccacct

SEQ ID NO: 2370139 - DNA, 18 bp, Homo sapiens
caactgaatgaggtcagc

SEQ ID NO: 2370140 - DNA, 12 bp, Homo sapiens
caactgattgca

SEQ ID NO: 2370141 - DNA, 14 bp, Homo sapiens
caactgcctactcc

SEQ ID NO: 2370142 - DNA, 15 bp, Homo sapiens
caactgcctactcca

SEQ ID NO: 2370143 - DNA, 19 bp, Homo sapiens
caactgctcccacctcctg

SEQ ID NO: 2370144 - DNA, 20 bp, Homo sapiens
caactgtctctcttctcaga

SEQ ID NO: 2370145 - DNA, 13 bp, Homo sapiens
caacttagctcag

SEQ ID NO: 2370146 - DNA, 20 bp, Homo sapiens
caacttagctcaggtgcctt

SEQ ID NO: 2370147 - DNA, 15 bp, Homo sapiens
caacttcatttgaca

SEQ ID NO: 2370148 - DNA, 12 bp, Homo sapiens
caatctgtgggc

SEQ ID NO: 2370149 - DNA, 11 bp, Homo sapiens
caatgaaatga

SEQ ID NO: 2370150 - DNA, 21 bp, Homo sapiens
caatgaaatgaattaaagtgg

SEQ ID NO: 2370151 - DNA, 19 bp, Homo sapiens
caatgaaccataaattcaa

SEQ ID NO: 2370152 - DNA, 19 bp, Homo sapiens
caatgctgcaggatggact

SEQ ID NO: 2370153 - DNA, 13 bp, Homo sapiens
caatgggaagcag

SEQ ID NO: 2370154 - DNA, 18 bp, Homo sapiens
caatgtatgtgtggctgt

SEQ ID NO: 2370155 - DNA, 24 bp, Homo sapiens
caatgttaaggaaactcttatctc

SEQ ID NO: 2370156 - DNA, 22 bp, Homo sapiens
caatgtttagcagatttaagat

SEQ ID NO: 2370157 - DNA, 22 bp, Homo sapiens
caatgtttcaagaggagccccc

SEQ ID NO: 2370158 - DNA, 18 bp, Homo sapiens
caattagtggtcataaaa

SEQ ID NO: 2370159 - DNA, 14 bp, Homo sapiens
caattatgtgcaaa

SEQ ID NO: 2370160 - DNA, 20 bp, Homo sapiens
caattggcatcattctcctt

SEQ ID NO: 2370161 - DNA, 21 bp, Homo sapiens
caattgtcgaaaagagtcttc

SEQ ID NO: 2370162 - DNA, 11 bp, Homo sapiens
caatttcaagt

SEQ ID NO: 2370163 - DNA, 16 bp, Homo sapiens
caatttcctctccact

SEQ ID NO: 2370164 - DNA, 21 bp, Homo sapiens
caattttttatcatgcatgtc

SEQ ID NO: 2370165 - DNA, 18 bp, Homo sapiens
cacaaagctatttaagtg

SEQ ID NO: 2370166 - DNA, 20 bp, Homo sapiens
cacaaagcttctaaagcagg

SEQ ID NO: 2370167 - DNA, 19 bp, Homo sapiens
cacaacccaagcaacattt

SEQ ID NO: 2370168 - DNA, 19 bp, Homo sapiens
cacaactgtgtgattaaaa

SEQ ID NO: 2370169 - DNA, 20 bp, Homo sapiens
cacaacttcccattaaaaat

SEQ ID NO: 2370170 - DNA, 23 bp, Homo sapiens
cacaagccattttttgaggagag

SEQ ID NO: 2370171 - DNA, 11 bp, Homo sapiens
cacaagctgca

SEQ ID NO: 2370172 - DNA, 18 bp, Homo sapiens
cacaagctgcactgtgaa

SEQ ID NO: 2370173 - DNA, 14 bp, Homo sapiens
cacaatgagaaaaa

SEQ ID NO: 2370174 - DNA, 17 bp, Homo sapiens
cacaatgagaaaaataa

SEQ ID NO: 2370175 - DNA, 13 bp, Homo sapiens
cacaatttgcact

SEQ ID NO: 2370176 - DNA, 12 bp, Homo sapiens
cacacacacaca

SEQ ID NO: 2370177 - DNA, 15 bp, Homo sapiens
cacacacacacgatg

SEQ ID NO: 2370178 - DNA, 11 bp, Homo sapiens
cacacacacga

SEQ ID NO: 2370179 - DNA, 13 bp, Homo sapiens
cacacacgatgca

SEQ ID NO: 2370180 - DNA, 22 bp, Homo sapiens
cacacagacccctcgcaactgt

SEQ ID NO: 2370181 - DNA, 18 bp, Homo sapiens
cacacagtgctcaaggcc

SEQ ID NO: 2370182 - DNA, 13 bp, Homo sapiens
cacacatcaggag

SEQ ID NO: 2370183 - DNA, 12 bp, Homo sapiens
cacacctcgtgg

SEQ ID NO: 2370184 - DNA, 19 bp, Homo sapiens
cacacgagcaaacccagag

SEQ ID NO: 2370185 - DNA, 19 bp, Homo sapiens
cacacgatgcatttaataa

SEQ ID NO: 2370186 - DNA, 20 bp, Homo sapiens
cacacgatgcatttaataaa

SEQ ID NO: 2370187 - DNA, 22 bp, Homo sapiens
cacacgatgcatttaataaaga

SEQ ID NO: 2370188 - DNA, 24 bp, Homo sapiens
cacacgatgcatttaataaagatg

SEQ ID NO: 2370189 - DNA, 20 bp, Homo sapiens
cacactgggtgcgtctccag

SEQ ID NO: 2370190 - DNA, 21 bp, Homo sapiens
cacacttcttgaaacagcctg

SEQ ID NO: 2370191 - DNA, 14 bp, Homo sapiens
cacagaaatgctgc

SEQ ID NO: 2370192 - DNA, 16 bp, Homo sapiens
cacagaaatgctgctg

SEQ ID NO: 2370193 - DNA, 20 bp, Homo sapiens
cacagaaatgctgctggcca

SEQ ID NO: 2370194 - DNA, 22 bp, Homo sapiens
cacagacactaacgaaatatca

SEQ ID NO: 2370195 - DNA, 20 bp, Homo sapiens
cacagagactgtttgaatgt

SEQ ID NO: 2370196 - DNA, 23 bp, Homo sapiens
cacagagcaagagataagtcttt

SEQ ID NO: 2370197 - DNA, 19 bp, Homo sapiens
cacagagcaagtcctcact

SEQ ID NO: 2370198 - DNA, 14 bp, Homo sapiens
cacagataacataa

SEQ ID NO: 2370199 - DNA, 20 bp, Homo sapiens
cacagcaagtacagcggctc

SEQ ID NO: 2370200 - DNA, 23 bp, Homo sapiens
cacagcagcttataatgggctct

SEQ ID NO: 2370201 - DNA, 13 bp, Homo sapiens
cacagcatgtgta

SEQ ID NO: 2370202 - DNA, 13 bp, Homo sapiens
cacagccagagga

SEQ ID NO: 2370203 - DNA, 16 bp, Homo sapiens
cacagccagaggaggg

SEQ ID NO: 2370204 - DNA, 19 bp, Homo sapiens
cacagccagaggagggcag

SEQ ID NO: 2370205 - DNA, 15 bp, Homo sapiens
cacagcgagggcagc

SEQ ID NO: 2370206 - DNA, 14 bp, Homo sapiens
cacagcgtccctgg

SEQ ID NO: 2370207 - DNA, 19 bp, Homo sapiens
cacagcgtccctggcgcag

SEQ ID NO: 2370208 - DNA, 22 bp, Homo sapiens
cacagcgtccctggcgcaggtg

SEQ ID NO: 2370209 - DNA, 18 bp, Homo sapiens
cacagctgctgttctcag

SEQ ID NO: 2370210 - DNA, 13 bp, Homo sapiens
cacagctggagaa

SEQ ID NO: 2370211 - DNA, 23 bp, Homo sapiens
cacaggaaggaggggagagacag

SEQ ID NO: 2370212 - DNA, 16 bp, Homo sapiens
cacaggataaagttat

SEQ ID NO: 2370213 - DNA, 20 bp, Homo sapiens
cacagtagaactgtctgtga

SEQ ID NO: 2370214 - DNA, 15 bp, Homo sapiens
cacagtagagccagc

SEQ ID NO: 2370215 - DNA, 17 bp, Homo sapiens
cacagtagagccagctt

SEQ ID NO: 2370216 - DNA, 13 bp, Homo sapiens
cacagtatttaac

SEQ ID NO: 2370217 - DNA, 15 bp, Homo sapiens
cacagtatttaacat

SEQ ID NO: 2370218 - DNA, 15 bp, Homo sapiens
cacagtcactgctct

SEQ ID NO: 2370219 - DNA, 14 bp, Homo sapiens
cacagtccagaccc

SEQ ID NO: 2370220 - DNA, 19 bp, Homo sapiens
cacagtctcagttctcttg

SEQ ID NO: 2370221 - DNA, 16 bp, Homo sapiens
cacagtgtctgttcag

SEQ ID NO: 2370222 - DNA, 18 bp, Homo sapiens
cacataccctgacctggc

SEQ ID NO: 2370223 - DNA, 22 bp, Homo sapiens
cacatagcatgcttcctttctc

SEQ ID NO: 2370224 - DNA, 21 bp, Homo sapiens
cacataggaagggatctgaga

SEQ ID NO: 2370225 - DNA, 22 bp, Homo sapiens
cacatagttctgtaataaaact

SEQ ID NO: 2370226 - DNA, 15 bp, Homo sapiens
cacatatccaggcac

SEQ ID NO: 2370227 - DNA, 19 bp, Homo sapiens
cacatatgcaccttgtgtc

SEQ ID NO: 2370228 - DNA, 20 bp, Homo sapiens
cacatatgcaccttgtgtct

SEQ ID NO: 2370229 - DNA, 21 bp, Homo sapiens
cacatatgcaccttgtgtctg

SEQ ID NO: 2370230 - DNA, 18 bp, Homo sapiens
cacatcaaataagaaata

SEQ ID NO: 2370231 - DNA, 12 bp, Homo sapiens
cacatcttaaaa

SEQ ID NO: 2370232 - DNA, 15 bp, Homo sapiens
cacatgggacctggc

SEQ ID NO: 2370233 - DNA, 15 bp, Homo sapiens
cacatgtcttgtaca

SEQ ID NO: 2370234 - DNA, 22 bp, Homo sapiens
cacatgtgagcatgtcacttcc

SEQ ID NO: 2370235 - DNA, 17 bp, Homo sapiens
cacattaagtggctttt

SEQ ID NO: 2370236 - DNA, 15 bp, Homo sapiens
cacattaatctcaaa

SEQ ID NO: 2370237 - DNA, 16 bp, Homo sapiens
cacattaatctcaaag

SEQ ID NO: 2370238 - DNA, 15 bp, Homo sapiens
cacattccctggccg

SEQ ID NO: 2370239 - DNA, 13 bp, Homo sapiens
cacattttcttta

SEQ ID NO: 2370240 - DNA, 21 bp, Homo sapiens
cacattttgcctttctcgtgg

SEQ ID NO: 2370241 - DNA, 15 bp, Homo sapiens
caccacactgggtgc

SEQ ID NO: 2370242 - DNA, 14 bp, Homo sapiens
caccactaaaaaac

SEQ ID NO: 2370243 - DNA, 12 bp, Homo sapiens
caccactgcagc

SEQ ID NO: 2370244 - DNA, 18 bp, Homo sapiens
caccactgttctgttcat

SEQ ID NO: 2370245 - DNA, 18 bp, Homo sapiens
caccacttccagagccag

SEQ ID NO: 2370246 - DNA, 12 bp, Homo sapiens
caccagagcaga

SEQ ID NO: 2370247 - DNA, 19 bp, Homo sapiens
caccagagcagatgcagag

SEQ ID NO: 2370248 - DNA, 16 bp, Homo sapiens
caccagccatcctccc

SEQ ID NO: 2370249 - DNA, 14 bp, Homo sapiens
caccagccccactg

SEQ ID NO: 2370250 - DNA, 18 bp, Homo sapiens
caccagccccactgccag

SEQ ID NO: 2370251 - DNA, 22 bp, Homo sapiens
caccagccccactgccagcagc

SEQ ID NO: 2370252 - DNA, 23 bp, Homo sapiens
caccagccccactgccagcagca

SEQ ID NO: 2370253 - DNA, 16 bp, Homo sapiens
caccagccctgcagcc

SEQ ID NO: 2370254 - DNA, 18 bp, Homo sapiens
caccataatgagatgtga

SEQ ID NO: 2370255 - DNA, 22 bp, Homo sapiens
caccataatgagatgtgagcct

SEQ ID NO: 2370256 - DNA, 13 bp, Homo sapiens
caccatatgaatt

SEQ ID NO: 2370257 - DNA, 18 bp, Homo sapiens
caccatatgaattgtaca

SEQ ID NO: 2370258 - DNA, 17 bp, Homo sapiens
caccatgtgagctcttc

SEQ ID NO: 2370259 - DNA, 20 bp, Homo sapiens
caccattccaagtctccacc

SEQ ID NO: 2370260 - DNA, 12 bp, Homo sapiens
cacccacatgtg

SEQ ID NO: 2370261 - DNA, 19 bp, Homo sapiens
cacccacatgtgacacata

SEQ ID NO: 2370262 - DNA, 13 bp, Homo sapiens
cacccaccgtgga

SEQ ID NO: 2370263 - DNA, 14 bp, Homo sapiens
cactcccttgctgg

SEQ ID NO: 2370264 - DNA, 17 bp, Homo sapiens
cactcccttgctggccc

SEQ ID NO: 2370265 - DNA, 19 bp, Homo sapiens
cactcccttgctggcccca

SEQ ID NO: 2370266 - DNA, 20 bp, Homo sapiens
cactcccttgctggccccag

SEQ ID NO: 2370267 - DNA, 18 bp, Homo sapiens
cactcctctgctgacctg

SEQ ID NO: 2370268 - DNA, 14 bp, Homo sapiens
cactcctgtccctg

SEQ ID NO: 2370269 - DNA, 23 bp, Homo sapiens
cactcctgtccctgtagctcagt

SEQ ID NO: 2370270 - DNA, 20 bp, Homo sapiens
cactcggtcccagttttgtt

SEQ ID NO: 2370271 - DNA, 11 bp, Homo sapiens
cactctgcccc

SEQ ID NO: 2370272 - DNA, 15 bp, Homo sapiens
cactcttctcttgag

SEQ ID NO: 2370273 - DNA, 18 bp, Homo sapiens
cactgaaagttttgtaaa

SEQ ID NO: 2370274 - DNA, 13 bp, Homo sapiens
cactgacttgctg

SEQ ID NO: 2370275 - DNA, 21 bp, Homo sapiens
cactgagctcacatgggactg

SEQ ID NO: 2370276 - DNA, 20 bp, Homo sapiens
cactgaggcagcgacctcaa

SEQ ID NO: 2370277 - DNA, 16 bp, Homo sapiens
cactgatggctcaaga

SEQ ID NO: 2370278 - DNA, 19 bp, Homo sapiens
cactgcagcctcatactcc

SEQ ID NO: 2370279 - DNA, 20 bp, Homo sapiens
cactgccagcagcagcaggt

SEQ ID NO: 2370280 - DNA, 21 bp, Homo sapiens
cactgccagcagcagcaggtg

SEQ ID NO: 2370281 - DNA, 13 bp, Homo sapiens
cactgccaggcca

SEQ ID NO: 2370282 - DNA, 14 bp, Homo sapiens
cactgccaggccag

SEQ ID NO: 2370283 - DNA, 18 bp, Homo sapiens
cactgccaggccagcctc

SEQ ID NO: 2370284 - DNA, 19 bp, Homo sapiens
cactgccaggccagcctcc

SEQ ID NO: 2370285 - DNA, 19 bp, Homo sapiens
cactgcccacatgggacct

SEQ ID NO: 2370286 - DNA, 14 bp, Homo sapiens
cactgcctgacatt

SEQ ID NO: 2370287 - DNA, 22 bp, Homo sapiens
cactgcgaagaccctcttgccc

SEQ ID NO: 2370288 - DNA, 13 bp, Homo sapiens
cactgctccttgc

SEQ ID NO: 2370289 - DNA, 17 bp, Homo sapiens
cactgcttgaactaggc

SEQ ID NO: 2370290 - DNA, 19 bp, Homo sapiens
cactggaaaggggagagcc

SEQ ID NO: 2370291 - DNA, 21 bp, Homo sapiens
cactggctctcctggccctgg

SEQ ID NO: 2370292 - DNA, 21 bp, Homo sapiens
cactgtagtttagttctgttg

SEQ ID NO: 2370293 - DNA, 21 bp, Homo sapiens
cactgtataaataggagagga

SEQ ID NO: 2370294 - DNA, 21 bp, Homo sapiens
cactgtcaccaccctgctcat

SEQ ID NO: 2370295 - DNA, 20 bp, Homo sapiens
cactgtgaacctgggcactc

SEQ ID NO: 2370296 - DNA, 22 bp, Homo sapiens
cactgtgcgtcttggtgtaatt

SEQ ID NO: 2370297 - DNA, 14 bp, Homo sapiens
cactgtgctttcag

SEQ ID NO: 2370298 - DNA, 14 bp, Homo sapiens
cactgtggttttga

SEQ ID NO: 2370299 - DNA, 15 bp, Homo sapiens
cactgtgttccttcc

SEQ ID NO: 2370300 - DNA, 17 bp, Homo sapiens
cactgttgagccccagt

SEQ ID NO: 2370301 - DNA, 19 bp, Homo sapiens
cactgttgagccccagtgc

SEQ ID NO: 2370302 - DNA, 20 bp, Homo sapiens
cactgttgagccccagtgct

SEQ ID NO: 2370303 - DNA, 23 bp, Homo sapiens
cactgttgagccccagtgctgga

SEQ ID NO: 2370304 - DNA, 14 bp, Homo sapiens
cactgttgataaaa

SEQ ID NO: 2370305 - DNA, 16 bp, Homo sapiens
cactgttgataaaaac

SEQ ID NO: 2370306 - DNA, 17 bp, Homo sapiens
cactgttgataaaaact

SEQ ID NO: 2370307 - DNA, 17 bp, Homo sapiens
cactgtttctcttgagc

SEQ ID NO: 2370308 - DNA, 13 bp, Homo sapiens
cacttacaatttt

SEQ ID NO: 2370309 - DNA, 16 bp, Homo sapiens
cacttattgaatatat

SEQ ID NO: 2370310 - DNA, 18 bp, Homo sapiens
cacttccctgcttaaatt

SEQ ID NO: 2370311 - DNA, 15 bp, Homo sapiens
cacttcttcctattg

SEQ ID NO: 2370312 - DNA, 18 bp, Homo sapiens
cacttcttgaaacagcct

SEQ ID NO: 2370313 - DNA, 20 bp, Homo sapiens
cacttcttgaaacagcctgg

SEQ ID NO: 2370314 - DNA, 20 bp, Homo sapiens
cactttaattaccaacctgt

SEQ ID NO: 2370315 - DNA, 17 bp, Homo sapiens
cactttacccacctaga

SEQ ID NO: 2370316 - DNA, 13 bp, Homo sapiens
cactttattgcta

SEQ ID NO: 2370317 - DNA, 12 bp, Homo sapiens
cactttcacgtg

SEQ ID NO: 2370318 - DNA, 15 bp, Homo sapiens
cactttcataatctt

SEQ ID NO: 2370319 - DNA, 18 bp, Homo sapiens
cactttcccacactgtga

SEQ ID NO: 2370320 - DNA, 17 bp, Homo sapiens
cactttgaaaagttgga

SEQ ID NO: 2370321 - DNA, 14 bp, Homo sapiens
cactttgttgcaag

SEQ ID NO: 2370322 - DNA, 15 bp, Homo sapiens
cactttgttgcaaga

SEQ ID NO: 2370323 - DNA, 17 bp, Homo sapiens
cacttttagaaatgcat

SEQ ID NO: 2370324 - DNA, 13 bp, Homo sapiens
cacttttcccact

SEQ ID NO: 2370325 - DNA, 12 bp, Homo sapiens
cacttttctggg

SEQ ID NO: 2370326 - DNA, 14 bp, Homo sapiens
cagaaaaaaaagtg

SEQ ID NO: 2370327 - DNA, 22 bp, Homo sapiens
cagaaaaaaaagtgtctcaaag

SEQ ID NO: 2370328 - DNA, 21 bp, Homo sapiens
cagaaaaatgaaatttaagca

SEQ ID NO: 2370329 - DNA, 17 bp, Homo sapiens
cagaaacacccctctgt

SEQ ID NO: 2370330 - DNA, 23 bp, Homo sapiens
cagaaacacccctctgtctagga

SEQ ID NO: 2370331 - DNA, 15 bp, Homo sapiens
cagaaagctgcctgg

SEQ ID NO: 2370332 - DNA, 22 bp, Homo sapiens
cagaaagggtgccagttgggct

SEQ ID NO: 2370333 - DNA, 16 bp, Homo sapiens
cagaaatagacaaaaa

SEQ ID NO: 2370334 - DNA, 20 bp, Homo sapiens
cagaaatataacacattttt

SEQ ID NO: 2370335 - DNA, 15 bp, Homo sapiens
cagaaatgctgctgg

SEQ ID NO: 2370336 - DNA, 15 bp, Homo sapiens
cagaaatggaaagca

SEQ ID NO: 2370337 - DNA, 17 bp, Homo sapiens
cagaaatggaaagcaga

SEQ ID NO: 2370338 - DNA, 22 bp, Homo sapiens
cagaaatgttgagtctgtacta

SEQ ID NO: 2370339 - DNA, 12 bp, Homo sapiens
cagaacactctt

SEQ ID NO: 2370340 - DNA, 15 bp, Homo sapiens
cagaacatactgatt

SEQ ID NO: 2370341 - DNA, 17 bp, Homo sapiens
cagaacctcaattgaca

SEQ ID NO: 2370342 - DNA, 14 bp, Homo sapiens
cagaacctgagcta

SEQ ID NO: 2370343 - DNA, 22 bp, Homo sapiens
cagaacctgagctattttcctc

SEQ ID NO: 2370344 - DNA, 19 bp, Homo sapiens
cagaacctgcacacaggac

SEQ ID NO: 2370345 - DNA, 14 bp, Homo sapiens
cagaacttgctgct

SEQ ID NO: 2370346 - DNA, 16 bp, Homo sapiens
cagaagacaccagagc

SEQ ID NO: 2370347 - DNA, 16 bp, Homo sapiens
cagaagcctccaagca

SEQ ID NO: 2370348 - DNA, 21 bp, Homo sapiens
cagaagccttggaaccagccc

SEQ ID NO: 2370349 - DNA, 20 bp, Homo sapiens
cagaagctcttactctttcc

SEQ ID NO: 2370350 - DNA, 21 bp, Homo sapiens
cagaagctcttactctttcct

SEQ ID NO: 2370351 - DNA, 19 bp, Homo sapiens
cagaagtctggctttgctc

SEQ ID NO: 2370352 - DNA, 21 bp, Homo sapiens
cagaagtgcccttcctgctgc

SEQ ID NO: 2370353 - DNA, 13 bp, Homo sapiens
cagaatatttcta

SEQ ID NO: 2370354 - DNA, 17 bp, Homo sapiens
cagaatatttctattga

SEQ ID NO: 2370355 - DNA, 21 bp, Homo sapiens
cagaatatttttatatttcct

SEQ ID NO: 2370356 - DNA, 23 bp, Homo sapiens
cagaatatttttatatttccttt

SEQ ID NO: 2370357 - DNA, 15 bp, Homo sapiens
cagaatttgaattat

SEQ ID NO: 2370358 - DNA, 11 bp, Homo sapiens
cagaatttgag

SEQ ID NO: 2370359 - DNA, 13 bp, Homo sapiens
cagaatttgagaa

SEQ ID NO: 2370360 - DNA, 16 bp, Homo sapiens
cagacaaaatttgaga

SEQ ID NO: 2370361 - DNA, 18 bp, Homo sapiens
cagacaaaatttgagaat

SEQ ID NO: 2370362 - DNA, 15 bp, Homo sapiens
cagacataaaggaaa

SEQ ID NO: 2370363 - DNA, 22 bp, Homo sapiens
cagacataaaggaaaagacaca

SEQ ID NO: 2370364 - DNA, 17 bp, Homo sapiens
cagacatacagctgcct

SEQ ID NO: 2370365 - DNA, 22 bp, Homo sapiens
cagacccctttgagagacgcca

SEQ ID NO: 2370366 - DNA, 13 bp, Homo sapiens
cagacctcatgcc

SEQ ID NO: 2370367 - DNA, 22 bp, Homo sapiens
cagactggggcatcctgtgcca

SEQ ID NO: 2370368 - DNA, 18 bp, Homo sapiens
cagactgtgcaatactta

SEQ ID NO: 2370369 - DNA, 22 bp, Homo sapiens
cagactttgtgttcatttcatt

SEQ ID NO: 2370370 - DNA, 20 bp, Homo sapiens
cagagaaacttaagcaaagg

SEQ ID NO: 2370371 - DNA, 15 bp, Homo sapiens
cagagacaagtaatt

SEQ ID NO: 2370372 - DNA, 22 bp, Homo sapiens
cagagacactgttgataaaaac

SEQ ID NO: 2370373 - DNA, 23 bp, Homo sapiens
cagagacactgttgataaaaact

SEQ ID NO: 2370374 - DNA, 15 bp, Homo sapiens
cagagacagaggatg

SEQ ID NO: 2370375 - DNA, 14 bp, Homo sapiens
cagagactttgtag

SEQ ID NO: 2370376 - DNA, 15 bp, Homo sapiens
cagagagccattttg

SEQ ID NO: 2370377 - DNA, 18 bp, Homo sapiens
cagagagccattttgtga

SEQ ID NO: 2370378 - DNA, 23 bp, Homo sapiens
caggcgctgcccacctgccggcc

SEQ ID NO: 2370379 - DNA, 23 bp, Homo sapiens
caggcggtttcacgccccacact

SEQ ID NO: 2370380 - DNA, 15 bp, Homo sapiens
caggctcactgccag

SEQ ID NO: 2370381 - DNA, 14 bp, Homo sapiens
caggctccagcaca

SEQ ID NO: 2370382 - DNA, 15 bp, Homo sapiens
caggctccagcacat

SEQ ID NO: 2370383 - DNA, 16 bp, Homo sapiens
caggctccagcacatc

SEQ ID NO: 2370384 - DNA, 14 bp, Homo sapiens
caggctgaaaacaa

SEQ ID NO: 2370385 - DNA, 14 bp, Homo sapiens
caggctgagaactc

SEQ ID NO: 2370386 - DNA, 14 bp, Homo sapiens
caggctgggacgga

SEQ ID NO: 2370387 - DNA, 10 bp, Homo sapiens
caggctgggc

SEQ ID NO: 2370388 - DNA, 18 bp, Homo sapiens
caggctgggccatgtcca

SEQ ID NO: 2370389 - DNA, 20 bp, Homo sapiens
caggctgggccatgtccaaa

SEQ ID NO: 2370390 - DNA, 15 bp, Homo sapiens
caggctgtaagcatt

SEQ ID NO: 2370391 - DNA, 22 bp, Homo sapiens
caggctgtaagcattctgagct

SEQ ID NO: 2370392 - DNA, 23 bp, Homo sapiens
caggctgtaagcattctgagctg

SEQ ID NO: 2370393 - DNA, 14 bp, Homo sapiens
caggctgttccatg

SEQ ID NO: 2370394 - DNA, 15 bp, Homo sapiens
caggctgtttcagcc

SEQ ID NO: 2370395 - DNA, 17 bp, Homo sapiens
caggcttctgctggggc

SEQ ID NO: 2370396 - DNA, 11 bp, Homo sapiens
caggcttgggg

SEQ ID NO: 2370397 - DNA, 13 bp, Homo sapiens
caggcttggggaa

SEQ ID NO: 2370398 - DNA, 20 bp, Homo sapiens
caggcttggggaaaatggcc

SEQ ID NO: 2370399 - DNA, 22 bp, Homo sapiens
caggctttatgtacaaacatgt

SEQ ID NO: 2370400 - DNA, 18 bp, Homo sapiens
cagggaaggtggccacag

SEQ ID NO: 2370401 - DNA, 19 bp, Homo sapiens
cagggaaggtggccacagc

SEQ ID NO: 2370402 - DNA, 22 bp, Homo sapiens
cagggaaggtggccacagcaag

SEQ ID NO: 2370403 - DNA, 23 bp, Homo sapiens
cagggagtccagggtttctctgc

SEQ ID NO: 2370404 - DNA, 19 bp, Homo sapiens
cagggatttgcctcacctt

SEQ ID NO: 2370405 - DNA, 20 bp, Homo sapiens
cagggcaagggttaaggcct

SEQ ID NO: 2370406 - DNA, 12 bp, Homo sapiens
cagggcagggtc

SEQ ID NO: 2370407 - DNA, 15 bp, Homo sapiens
cagggcatcttgctg

SEQ ID NO: 2370408 - DNA, 19 bp, Homo sapiens
cagggcatcttgctggcta

SEQ ID NO: 2370409 - DNA, 14 bp, Homo sapiens
cagggccatgcaga

SEQ ID NO: 2370410 - DNA, 15 bp, Homo sapiens
cagggccatgcagac

SEQ ID NO: 2370411 - DNA, 22 bp, Homo sapiens
cagggccatgcagacctcatgc

SEQ ID NO: 2370412 - DNA, 13 bp, Homo sapiens
cagggccctgggc

SEQ ID NO: 2370413 - DNA, 15 bp, Homo sapiens
cagggccctgggcag

SEQ ID NO: 2370414 - DNA, 17 bp, Homo sapiens
cagggccctgggcaggg

SEQ ID NO: 2370415 - DNA, 21 bp, Homo sapiens
cagggcctcctgggggacctt

SEQ ID NO: 2370416 - DNA, 20 bp, Homo sapiens
cagggcctctccaaccactg

SEQ ID NO: 2370417 - DNA, 12 bp, Homo sapiens
cagggctcccag

SEQ ID NO: 2370418 - DNA, 14 bp, Homo sapiens
cagggctcccaggg

SEQ ID NO: 2370419 - DNA, 21 bp, Homo sapiens
cagggctcccaggggtctccc

SEQ ID NO: 2370420 - DNA, 13 bp, Homo sapiens
cagggctgtgctt

SEQ ID NO: 2370421 - DNA, 17 bp, Homo sapiens
cagggcttctcctcctc

SEQ ID NO: 2370422 - DNA, 17 bp, Homo sapiens
caggggaaggccctgag

SEQ ID NO: 2370423 - DNA, 18 bp, Homo sapiens
caggggaaggccctgagg

SEQ ID NO: 2370424 - DNA, 18 bp, Homo sapiens
caggggctggtgggacag

SEQ ID NO: 2370425 - DNA, 20 bp, Homo sapiens
caggggctggtgggacagtg

SEQ ID NO: 2370426 - DNA, 15 bp, Homo sapiens
caggggcttgagaag

SEQ ID NO: 2370427 - DNA, 17 bp, Homo sapiens
caggggcttgagaaggt

SEQ ID NO: 2370428 - DNA, 15 bp, Homo sapiens
cagggggcaagagga

SEQ ID NO: 2370429 - DNA, 14 bp, Homo sapiens
caggggtctgtctg

SEQ ID NO: 2370430 - DNA, 21 bp, Homo sapiens
cagggtcactgaaccactgct

SEQ ID NO: 2370431 - DNA, 22 bp, Homo sapiens
cagggtcttggctgcctgtggg

SEQ ID NO: 2370432 - DNA, 18 bp, Homo sapiens
cagggtgggcttcctgcc

SEQ ID NO: 2370433 - DNA, 20 bp, Homo sapiens
cagggtgggcttcctgccct

SEQ ID NO: 2370434 - DNA, 16 bp, Homo sapiens
cagggtgggcttgtgg

SEQ ID NO: 2370435 - DNA, 22 bp, Homo sapiens
cagggtgtgaacatgttctcca

SEQ ID NO: 2370436 - DNA, 19 bp, Homo sapiens
cagggttaggaatctcttc

SEQ ID NO: 2370437 - DNA, 20 bp, Homo sapiens
cagggttaggaatctcttca

SEQ ID NO: 2370438 - DNA, 19 bp, Homo sapiens
cagggtttctctgcagatg

SEQ ID NO: 2370439 - DNA, 15 bp, Homo sapiens
caggtaaaacagggc

SEQ ID NO: 2370440 - DNA, 20 bp, Homo sapiens
caggtagtattacaccaccg

SEQ ID NO: 2370441 - DNA, 22 bp, Homo sapiens
caggtagtattacaccaccggc

SEQ ID NO: 2370442 - DNA, 15 bp, Homo sapiens
caggtatccaaaaat

SEQ ID NO: 2370443 - DNA, 14 bp, Homo sapiens
caggtcatcagatg

SEQ ID NO: 2370444 - DNA, 15 bp, Homo sapiens
caggtcttttcaaat

SEQ ID NO: 2370445 - DNA, 12 bp, Homo sapiens
caggtgacatgt

SEQ ID NO: 2370446 - DNA, 18 bp, Homo sapiens
caggtgacatgtgaaacc

SEQ ID NO: 2370447 - DNA, 21 bp, Homo sapiens
caggtgacatgtgaaaccttt

SEQ ID NO: 2370448 - DNA, 16 bp, Homo sapiens
caggtggcaaagtact

SEQ ID NO: 2370449 - DNA, 15 bp, Homo sapiens
caggtggcctggagg

SEQ ID NO: 2370450 - DNA, 18 bp, Homo sapiens
caggtgggggtgggctgc

SEQ ID NO: 2370451 - DNA, 21 bp, Homo sapiens
caggtgggggttgctgtataa

SEQ ID NO: 2370452 - DNA, 14 bp, Homo sapiens
caggttcctttttc

SEQ ID NO: 2370453 - DNA, 23 bp, Homo sapiens
cagtaaacgggaacatgccccct

SEQ ID NO: 2370454 - DNA, 23 bp, Homo sapiens
cagtaaatagtgtcatataaact

SEQ ID NO: 2370455 - DNA, 18 bp, Homo sapiens
cagtaacccccttaaatt

SEQ ID NO: 2370456 - DNA, 14 bp, Homo sapiens
cagtaactgccatt

SEQ ID NO: 2370457 - DNA, 20 bp, Homo sapiens
cagtaagatatctcaatgaa

SEQ ID NO: 2370458 - DNA, 21 bp, Homo sapiens
cagtacagagaaattctgtgg

SEQ ID NO: 2370459 - DNA, 15 bp, Homo sapiens
cagtacatttaaatt

SEQ ID NO: 2370460 - DNA, 22 bp, Homo sapiens
cagtacatttaaattttttggc

SEQ ID NO: 2370461 - DNA, 16 bp, Homo sapiens
cagtacctctcaagct

SEQ ID NO: 2370462 - DNA, 22 bp, Homo sapiens
cagtactattcaggtaacacta

SEQ ID NO: 2370463 - DNA, 20 bp, Homo sapiens
cagtactggttactttcaaa

SEQ ID NO: 2370464 - DNA, 21 bp, Homo sapiens
cagtactggttactttcaaaa

SEQ ID NO: 2370465 - DNA, 23 bp, Homo sapiens
cagtactggttactttcaaaatg

SEQ ID NO: 2370466 - DNA, 14 bp, Homo sapiens
cagtagaactgtct

SEQ ID NO: 2370467 - DNA, 23 bp, Homo sapiens
cagtatatgttaatttgtgtgtt

SEQ ID NO: 2370468 - DNA, 16 bp, Homo sapiens
cagtatattagtatta

SEQ ID NO: 2370469 - DNA, 14 bp, Homo sapiens
cagtatcccacatc

SEQ ID NO: 2370470 - DNA, 15 bp, Homo sapiens
cagtatgtgggatat

SEQ ID NO: 2370471 - DNA, 20 bp, Homo sapiens
cagtatgtgggggcttcatc

SEQ ID NO: 2370472 - DNA, 19 bp, Homo sapiens
cagtcacaacagagtgaaa

SEQ ID NO: 2370473 - DNA, 14 bp, Homo sapiens
cagtcacctcacaa

SEQ ID NO: 2370474 - DNA, 23 bp, Homo sapiens
cagtcactggaggttgaagccaa

SEQ ID NO: 2370475 - DNA, 21 bp, Homo sapiens
cagtcagagtccagtgctctg

SEQ ID NO: 2370476 - DNA, 19 bp, Homo sapiens
cagtcatctcccctcctgg

SEQ ID NO: 2370477 - DNA, 14 bp, Homo sapiens
cagtccccacccct

SEQ ID NO: 2370478 - DNA, 16 bp, Homo sapiens
cagtccccacccctgc

SEQ ID NO: 2370479 - DNA, 17 bp, Homo sapiens
cagtccccacccctgcc

SEQ ID NO: 2370480 - DNA, 18 bp, Homo sapiens
cagtccccacccctgccc

SEQ ID NO: 2370481 - DNA, 21 bp, Homo sapiens
cagtcctactcaagcgggtgg

SEQ ID NO: 2370482 - DNA, 17 bp, Homo sapiens
cagtcctggaagccagc

SEQ ID NO: 2370483 - DNA, 15 bp, Homo sapiens
cagtccttgctttgg

SEQ ID NO: 2370484 - DNA, 13 bp, Homo sapiens
cagtctcgtctct

SEQ ID NO: 2370485 - DNA, 20 bp, Homo sapiens
cagtctgcccacgcagagga

SEQ ID NO: 2370486 - DNA, 18 bp, Homo sapiens
cagtcttcctgacacttt

SEQ ID NO: 2370487 - DNA, 14 bp, Homo sapiens
cagtctttgctcag

SEQ ID NO: 2370488 - DNA, 13 bp, Homo sapiens
cagtgacacccag

SEQ ID NO: 2370489 - DNA, 15 bp, Homo sapiens
cagtgagcctcctgt

SEQ ID NO: 2370490 - DNA, 16 bp, Homo sapiens
cagtgagcctcctgtg

SEQ ID NO: 2370491 - DNA, 16 bp, Homo sapiens
cagtgagggtcttctt

SEQ ID NO: 2370492 - DNA, 18 bp, Homo sapiens
catcaaagcagaagtctg

SEQ ID NO: 2370493 - DNA, 12 bp, Homo sapiens
catcaagagaat

SEQ ID NO: 2370494 - DNA, 15 bp, Homo sapiens
catcaccgctgggtg

SEQ ID NO: 2370495 - DNA, 16 bp, Homo sapiens
catcactagtggcaaa

SEQ ID NO: 2370496 - DNA, 17 bp, Homo sapiens
catcagaacctgagcta

SEQ ID NO: 2370497 - DNA, 16 bp, Homo sapiens
catcagatgcctgctt

SEQ ID NO: 2370498 - DNA, 20 bp, Homo sapiens
catcattttccatatcctgg

SEQ ID NO: 2370499 - DNA, 14 bp, Homo sapiens
catccaactccagc

SEQ ID NO: 2370500 - DNA, 14 bp, Homo sapiens
catccaccttccct

SEQ ID NO: 2370501 - DNA, 16 bp, Homo sapiens
catccaccttcccttc

SEQ ID NO: 2370502 - DNA, 17 bp, Homo sapiens
catccaccttcccttct

SEQ ID NO: 2370503 - DNA, 14 bp, Homo sapiens
catccagatgtggc

SEQ ID NO: 2370504 - DNA, 15 bp, Homo sapiens
catccatagtgcact

SEQ ID NO: 2370505 - DNA, 17 bp, Homo sapiens
catccatccctccattc

SEQ ID NO: 2370506 - DNA, 14 bp, Homo sapiens
catccatccttcca

SEQ ID NO: 2370507 - DNA, 16 bp, Homo sapiens
catcccgggcctcagt

SEQ ID NO: 2370508 - DNA, 17 bp, Homo sapiens
catcccgggcctcagtg

SEQ ID NO: 2370509 - DNA, 22 bp, Homo sapiens
catcctcaaacgacagaggagc

SEQ ID NO: 2370510 - DNA, 13 bp, Homo sapiens
catcctccctcca

SEQ ID NO: 2370511 - DNA, 19 bp, Homo sapiens
catcctccctccacctcaa

SEQ ID NO: 2370512 - DNA, 21 bp, Homo sapiens
catcctccctccacctcaaga

SEQ ID NO: 2370513 - DNA, 23 bp, Homo sapiens
catcctcttttaatggcatttct

SEQ ID NO: 2370514 - DNA, 18 bp, Homo sapiens
catcctgaccaagactga

SEQ ID NO: 2370515 - DNA, 21 bp, Homo sapiens
catcctgcagggcttctcctc

SEQ ID NO: 2370516 - DNA, 15 bp, Homo sapiens
catccttccatccat

SEQ ID NO: 2370517 - DNA, 15 bp, Homo sapiens
catcggcgtggccca

SEQ ID NO: 2370518 - DNA, 21 bp, Homo sapiens
catcggtgaaactaacagata

SEQ ID NO: 2370519 - DNA, 15 bp, Homo sapiens
catcgttgcccccat

SEQ ID NO: 2370520 - DNA, 13 bp, Homo sapiens
catctaattctga

SEQ ID NO: 2370521 - DNA, 17 bp, Homo sapiens
catctagccagcccctc

SEQ ID NO: 2370522 - DNA, 21 bp, Homo sapiens
catctagccagcccctcttcc

SEQ ID NO: 2370523 - DNA, 22 bp, Homo sapiens
catctaggagcaaggtgagaaa

SEQ ID NO: 2370524 - DNA, 16 bp, Homo sapiens
catctatctcaatcct

SEQ ID NO: 2370525 - DNA, 20 bp, Homo sapiens
catctcaggacacttccgta

SEQ ID NO: 2370526 - DNA, 13 bp, Homo sapiens
catctcccaaggc

SEQ ID NO: 2370527 - DNA, 14 bp, Homo sapiens
catctcccaaggct

SEQ ID NO: 2370528 - DNA, 15 bp, Homo sapiens
catctccctgcctgg

SEQ ID NO: 2370529 - DNA, 21 bp, Homo sapiens
catctccctgcctggccccca

SEQ ID NO: 2370530 - DNA, 19 bp, Homo sapiens
catctcgctccctcccagg

SEQ ID NO: 2370531 - DNA, 12 bp, Homo sapiens
catctcttcccc

SEQ ID NO: 2370532 - DNA, 15 bp, Homo sapiens
catctcttccccaga

SEQ ID NO: 2370533 - DNA, 16 bp, Homo sapiens
catctcttccccagag

SEQ ID NO: 2370534 - DNA, 17 bp, Homo sapiens
catctcttccccagaga

SEQ ID NO: 2370535 - DNA, 14 bp, Homo sapiens
catctctttagaga

SEQ ID NO: 2370536 - DNA, 22 bp, Homo sapiens
catctgatatcaggaaatatct

SEQ ID NO: 2370537 - DNA, 22 bp, Homo sapiens
catctgcaaaaggcctcttgta

SEQ ID NO: 2370538 - DNA, 17 bp, Homo sapiens
catctgcaccccttctc

SEQ ID NO: 2370539 - DNA, 23 bp, Homo sapiens
catctgcaccccttctctcctcc

SEQ ID NO: 2370540 - DNA, 17 bp, Homo sapiens
catctgcctgcgctctc

SEQ ID NO: 2370541 - DNA, 20 bp, Homo sapiens
catctggcaacatctttatc

SEQ ID NO: 2370542 - DNA, 14 bp, Homo sapiens
catctgtccagctg

SEQ ID NO: 2370543 - DNA, 12 bp, Homo sapiens
catctgtccccc

SEQ ID NO: 2370544 - DNA, 15 bp, Homo sapiens
catcttcaatatgaa

SEQ ID NO: 2370545 - DNA, 19 bp, Homo sapiens
catcttcaatatgaatcta

SEQ ID NO: 2370546 - DNA, 11 bp, Homo sapiens
catcttcagga

SEQ ID NO: 2370547 - DNA, 14 bp, Homo sapiens
catcttcctgtgtc

SEQ ID NO: 2370548 - DNA, 16 bp, Homo sapiens
catcttcctgtgtcct

SEQ ID NO: 2370549 - DNA, 17 bp, Homo sapiens
catcttcctgtgtcctg

SEQ ID NO: 2370550 - DNA, 18 bp, Homo sapiens
catcttctcattcccatg

SEQ ID NO: 2370551 - DNA, 15 bp, Homo sapiens
catctttaatttata

SEQ ID NO: 2370552 - DNA, 21 bp, Homo sapiens
catctttattgaaattctatt

SEQ ID NO: 2370553 - DNA, 13 bp, Homo sapiens
catcttttctaat

SEQ ID NO: 2370554 - DNA, 19 bp, Homo sapiens
catgaaaaacacggcagct

SEQ ID NO: 2370555 - DNA, 12 bp, Homo sapiens
catgaaaaagca

SEQ ID NO: 2370556 - DNA, 19 bp, Homo sapiens
catgaaaaagcagctacca

SEQ ID NO: 2370557 - DNA, 13 bp, Homo sapiens
catgaaaatgtat

SEQ ID NO: 2370558 - DNA, 23 bp, Homo sapiens
catgaaaatgtattcctttaaaa

SEQ ID NO: 2370559 - DNA, 18 bp, Homo sapiens
catgaaataaaatatatc

SEQ ID NO: 2370560 - DNA, 19 bp, Homo sapiens
catgaaattcttcctaatg

SEQ ID NO: 2370561 - DNA, 14 bp, Homo sapiens
catgaagcaggagg

SEQ ID NO: 2370562 - DNA, 22 bp, Homo sapiens
catgaagggaccctttgggggt

SEQ ID NO: 2370563 - DNA, 16 bp, Homo sapiens
catgaattttaaagta

SEQ ID NO: 2370564 - DNA, 17 bp, Homo sapiens
catgaattttaaagtat

SEQ ID NO: 2370565 - DNA, 14 bp, Homo sapiens
catgacagaggctg

SEQ ID NO: 2370566 - DNA, 15 bp, Homo sapiens
catgacttccttatt

SEQ ID NO: 2370567 - DNA, 22 bp, Homo sapiens
catgacttccttatttctgaac

SEQ ID NO: 2370568 - DNA, 22 bp, Homo sapiens
catgagatggagaggctgaggg

SEQ ID NO: 2370569 - DNA, 12 bp, Homo sapiens
catgagcctgct

SEQ ID NO: 2370570 - DNA, 19 bp, Homo sapiens
catgagctgctcattacag

SEQ ID NO: 2370571 - DNA, 23 bp, Homo sapiens
catgagctgctcattacagttct

SEQ ID NO: 2370572 - DNA, 13 bp, Homo sapiens
catgaggaggggc

SEQ ID NO: 2370573 - DNA, 21 bp, Homo sapiens
catgaggaggggcccccctgc

SEQ ID NO: 2370574 - DNA, 13 bp, Homo sapiens
catgaggagggtg

SEQ ID NO: 2370575 - DNA, 20 bp, Homo sapiens
catgaggagggtgggggagg

SEQ ID NO: 2370576 - DNA, 13 bp, Homo sapiens
catgaggggagag

SEQ ID NO: 2370577 - DNA, 14 bp, Homo sapiens
catgaggggagagg

SEQ ID NO: 2370578 - DNA, 23 bp, Homo sapiens
catgatcagacatacagctgcct

SEQ ID NO: 2370579 - DNA, 12 bp, Homo sapiens
catgatgtatat

SEQ ID NO: 2370580 - DNA, 14 bp, Homo sapiens
catgattatagcaa

SEQ ID NO: 2370581 - DNA, 18 bp, Homo sapiens
catgatttagggaagcag

SEQ ID NO: 2370582 - DNA, 16 bp, Homo sapiens
catgcaaatgagctct

SEQ ID NO: 2370583 - DNA, 12 bp, Homo sapiens
catgcaggaggt

SEQ ID NO: 2370584 - DNA, 14 bp, Homo sapiens
catgcaggaggtgg

SEQ ID NO: 2370585 - DNA, 16 bp, Homo sapiens
catgcataaatatgca

SEQ ID NO: 2370586 - DNA, 17 bp, Homo sapiens
catgcataaatatgcag

SEQ ID NO: 2370587 - DNA, 21 bp, Homo sapiens
catgcatataatgaataaatc

SEQ ID NO: 2370588 - DNA, 17 bp, Homo sapiens
catgcatgtcctgtaaa

SEQ ID NO: 2370589 - DNA, 18 bp, Homo sapiens
catgcatgtcctgtaaag

SEQ ID NO: 2370590 - DNA, 18 bp, Homo sapiens
catgccagattctgcctc

SEQ ID NO: 2370591 - DNA, 22 bp, Homo sapiens
catgccagattctgcctctctg

SEQ ID NO: 2370592 - DNA, 14 bp, Homo sapiens
catgccagtatttt

SEQ ID NO: 2370593 - DNA, 15 bp, Homo sapiens
catgcccaccccctg

SEQ ID NO: 2370594 - DNA, 16 bp, Homo sapiens
catgcccaccccctgc

SEQ ID NO: 2370595 - DNA, 19 bp, Homo sapiens
catgcccaccccctgccct

SEQ ID NO: 2370596 - DNA, 22 bp, Homo sapiens
catgcccaccccctgccctgca

SEQ ID NO: 2370597 - DNA, 23 bp, Homo sapiens
catgcccaccccctgccctgcac

SEQ ID NO: 2370598 - DNA, 12 bp, Homo sapiens
catgcctgcgcc

SEQ ID NO: 2370599 - DNA, 20 bp, Homo sapiens
catgcctgcgcctgctgcct

SEQ ID NO: 2370600 - DNA, 15 bp, Homo sapiens
catgctgaaaaatat

SEQ ID NO: 2370601 - DNA, 17 bp, Homo sapiens
catgctgaaaaatatag

SEQ ID NO: 2370602 - DNA, 21 bp, Homo sapiens
catgctgaatgccccctgctt

SEQ ID NO: 2370603 - DNA, 15 bp, Homo sapiens
catgctgtccggcct

SEQ ID NO: 2370604 - DNA, 22 bp, Homo sapiens
catgcttaaataaaaattatgt

SEQ ID NO: 2370605 - DNA, 13 bp, Homo sapiens
catgcttaaattt

SEQ ID NO: 2370606 - DNA, 20 bp, Homo sapiens
catgcttcctttctctcctg

SEQ ID NO: 2370607 - DNA, 15 bp, Homo sapiens
cattttcctcctctg

SEQ ID NO: 2370608 - DNA, 15 bp, Homo sapiens
cattttcgtttttaa

SEQ ID NO: 2370609 - DNA, 11 bp, Homo sapiens
cattttctaaa

SEQ ID NO: 2370610 - DNA, 23 bp, Homo sapiens
cattttctaaataaaaatatgta

SEQ ID NO: 2370611 - DNA, 14 bp, Homo sapiens
cattttgaaacaaa

SEQ ID NO: 2370612 - DNA, 13 bp, Homo sapiens
cattttgcctttc

SEQ ID NO: 2370613 - DNA, 13 bp, Homo sapiens
cattttgtgaatg

SEQ ID NO: 2370614 - DNA, 15 bp, Homo sapiens
cattttgtgaatgga

SEQ ID NO: 2370615 - DNA, 12 bp, Homo sapiens
catttttatagc

SEQ ID NO: 2370616 - DNA, 23 bp, Homo sapiens
catttttattaaagcatttccta

SEQ ID NO: 2370617 - DNA, 21 bp, Homo sapiens
cattttttaatttacttgttt

SEQ ID NO: 2370618 - DNA, 14 bp, Homo sapiens
cattttttaggaaa

SEQ ID NO: 2370619 - DNA, 22 bp, Homo sapiens
cattttttgagtctccttcata

SEQ ID NO: 2370620 - DNA, 14 bp, Homo sapiens
cattttttgtctgt

SEQ ID NO: 2370621 - DNA, 21 bp, Homo sapiens
ccaaaaacatttgattaataa

SEQ ID NO: 2370622 - DNA, 23 bp, Homo sapiens
ccaaaaacatttgattaataaaa

SEQ ID NO: 2370623 - DNA, 19 bp, Homo sapiens
ccaaaaatgtgtaagaaca

SEQ ID NO: 2370624 - DNA, 22 bp, Homo sapiens
ccaaaagattgctgaaatttta

SEQ ID NO: 2370625 - DNA, 22 bp, Homo sapiens
ccaaaagcgccctcactattct

SEQ ID NO: 2370626 - DNA, 15 bp, Homo sapiens
ccaaaagctttttat

SEQ ID NO: 2370627 - DNA, 14 bp, Homo sapiens
ccaaaatcaagagt

SEQ ID NO: 2370628 - DNA, 15 bp, Homo sapiens
ccaaaattttaaaaa

SEQ ID NO: 2370629 - DNA, 15 bp, Homo sapiens
ccaaacactcagtcc

SEQ ID NO: 2370630 - DNA, 16 bp, Homo sapiens
ccaaaccaggaccctg

SEQ ID NO: 2370631 - DNA, 12 bp, Homo sapiens
ccaaaccataaa

SEQ ID NO: 2370632 - DNA, 17 bp, Homo sapiens
ccaaagaggctgcccct

SEQ ID NO: 2370633 - DNA, 16 bp, Homo sapiens
ccaaagagggcttcct

SEQ ID NO: 2370634 - DNA, 18 bp, Homo sapiens
ccaaagctgcccactgtt

SEQ ID NO: 2370635 - DNA, 20 bp, Homo sapiens
ccaaagctgcccactgtttc

SEQ ID NO: 2370636 - DNA, 21 bp, Homo sapiens
ccaaagctgcccactgtttct

SEQ ID NO: 2370637 - DNA, 14 bp, Homo sapiens
ccaaaggaaaatgt

SEQ ID NO: 2370638 - DNA, 12 bp, Homo sapiens
ccaaagtacctt

SEQ ID NO: 2370639 - DNA, 19 bp, Homo sapiens
ccaaatagtgtgaaatata

SEQ ID NO: 2370640 - DNA, 16 bp, Homo sapiens
ccaaatccacaagcca

SEQ ID NO: 2370641 - DNA, 17 bp, Homo sapiens
ccaaatccacaagccat

SEQ ID NO: 2370642 - DNA, 18 bp, Homo sapiens
ccaaatggccattttaaa

SEQ ID NO: 2370643 - DNA, 15 bp, Homo sapiens
ccaacaactctgcct

SEQ ID NO: 2370644 - DNA, 16 bp, Homo sapiens
ccaacagcccccccct

SEQ ID NO: 2370645 - DNA, 22 bp, Homo sapiens
ccaacatatatttattgagtac

SEQ ID NO: 2370646 - DNA, 18 bp, Homo sapiens
ccaacctcagggctccca

SEQ ID NO: 2370647 - DNA, 22 bp, Homo sapiens
ccaacctcagggctcccagggg

SEQ ID NO: 2370648 - DNA, 12 bp, Homo sapiens
ccaacctgctct

SEQ ID NO: 2370649 - DNA, 13 bp, Homo sapiens
ccaacctgctctc

SEQ ID NO: 2370650 - DNA, 17 bp, Homo sapiens
ccaacctgctctcctct

SEQ ID NO: 2370651 - DNA, 18 bp, Homo sapiens
ccaacctgctctcctctt

SEQ ID NO: 2370652 - DNA, 15 bp, Homo sapiens
ccaactagctgggac

SEQ ID NO: 2370653 - DNA, 21 bp, Homo sapiens
ccaactccagcaacttcttct

SEQ ID NO: 2370654 - DNA, 20 bp, Homo sapiens
ccaactccaggaaagagcag

SEQ ID NO: 2370655 - DNA, 12 bp, Homo sapiens
ccaagaaactga

SEQ ID NO: 2370656 - DNA, 21 bp, Homo sapiens
ccaagaaagctcactgtagct

SEQ ID NO: 2370657 - DNA, 20 bp, Homo sapiens
ccaagattttcctcttgtga

SEQ ID NO: 2370658 - DNA, 22 bp, Homo sapiens
ccaagattttcctcttgtgatt

SEQ ID NO: 2370659 - DNA, 14 bp, Homo sapiens
ccaagcacagagcc

SEQ ID NO: 2370660 - DNA, 17 bp, Homo sapiens
ccaagcacagagcctgg

SEQ ID NO: 2370661 - DNA, 20 bp, Homo sapiens
ccaagcaggacgaaaaagag

SEQ ID NO: 2370662 - DNA, 13 bp, Homo sapiens
ccaagcatttcat

SEQ ID NO: 2370663 - DNA, 22 bp, Homo sapiens
ccaagcatttcatgaaaaagct

SEQ ID NO: 2370664 - DNA, 11 bp, Homo sapiens
ccaagcctatc

SEQ ID NO: 2370665 - DNA, 14 bp, Homo sapiens
ccaagcctccacag

SEQ ID NO: 2370666 - DNA, 15 bp, Homo sapiens
ccaagcctccacagc

SEQ ID NO: 2370667 - DNA, 19 bp, Homo sapiens
ccaagcctccacagcgagg

SEQ ID NO: 2370668 - DNA, 22 bp, Homo sapiens
ccaagggaaaggggtgctttta

SEQ ID NO: 2370669 - DNA, 19 bp, Homo sapiens
ccaagggtatgggaagcca

SEQ ID NO: 2370670 - DNA, 15 bp, Homo sapiens
ccaagggttgagagc

SEQ ID NO: 2370671 - DNA, 20 bp, Homo sapiens
ccaaggttggagcccagggc

SEQ ID NO: 2370672 - DNA, 22 bp, Homo sapiens
ccaaggttggagcccagggcat

SEQ ID NO: 2370673 - DNA, 17 bp, Homo sapiens
ccaagtcaacactcttc

SEQ ID NO: 2370674 - DNA, 19 bp, Homo sapiens
ccaagtcaacactcttctt

SEQ ID NO: 2370675 - DNA, 23 bp, Homo sapiens
ccaagtcaacactcttcttgagc

SEQ ID NO: 2370676 - DNA, 22 bp, Homo sapiens
ccaagtccaacctgcctgtgca

SEQ ID NO: 2370677 - DNA, 15 bp, Homo sapiens
ccaagtccctggaaa

SEQ ID NO: 2370678 - DNA, 20 bp, Homo sapiens
ccaagttgtgcttgagccag

SEQ ID NO: 2370679 - DNA, 22 bp, Homo sapiens
ccaataataaatgccctcttct

SEQ ID NO: 2370680 - DNA, 23 bp, Homo sapiens
ccaataataaatgccctcttctc

SEQ ID NO: 2370681 - DNA, 15 bp, Homo sapiens
ccaatatcatgtgat

SEQ ID NO: 2370682 - DNA, 21 bp, Homo sapiens
ccaatcctactaataaaccag

SEQ ID NO: 2370683 - DNA, 18 bp, Homo sapiens
ccaatgaattattatata

SEQ ID NO: 2370684 - DNA, 13 bp, Homo sapiens
ccaatgggaagca

SEQ ID NO: 2370685 - DNA, 17 bp, Homo sapiens
ccaatgtatgtgtggct

SEQ ID NO: 2370686 - DNA, 11 bp, Homo sapiens
ccaatttcctc

SEQ ID NO: 2370687 - DNA, 17 bp, Homo sapiens
ccacaagctgcactgtg

SEQ ID NO: 2370688 - DNA, 20 bp, Homo sapiens
ccacaagctgcactgtgaac

SEQ ID NO: 2370689 - DNA, 16 bp, Homo sapiens
ccacaatgcagttctg

SEQ ID NO: 2370690 - DNA, 20 bp, Homo sapiens
ccacacagtgctcaaggcca

SEQ ID NO: 2370691 - DNA, 15 bp, Homo sapiens
ccacactcccaaggt

SEQ ID NO: 2370692 - DNA, 17 bp, Homo sapiens
ccacacttgaaaccttt

SEQ ID NO: 2370693 - DNA, 20 bp, Homo sapiens
ccacagagactgtttgaatg

SEQ ID NO: 2370694 - DNA, 12 bp, Homo sapiens
ccacagagcaaa

SEQ ID NO: 2370695 - DNA, 21 bp, Homo sapiens
ccacagcaagtacagcggctc

SEQ ID NO: 2370696 - DNA, 15 bp, Homo sapiens
ccacagccagaggag

SEQ ID NO: 2370697 - DNA, 17 bp, Homo sapiens
ccacagcgagggcagct

SEQ ID NO: 2370698 - DNA, 17 bp, Homo sapiens
ccacagcgtccctggcg

SEQ ID NO: 2370699 - DNA, 22 bp, Homo sapiens
ccacagggttcaaaatgtctgt

SEQ ID NO: 2370700 - DNA, 19 bp, Homo sapiens
ccacagtgttgtgcccctt

SEQ ID NO: 2370701 - DNA, 13 bp, Homo sapiens
ccacatagcatgc

SEQ ID NO: 2370702 - DNA, 22 bp, Homo sapiens
ccacatagcatgcttcctttct

SEQ ID NO: 2370703 - DNA, 14 bp, Homo sapiens
ccacatcaaacctt

SEQ ID NO: 2370704 - DNA, 18 bp, Homo sapiens
ccacatccaactccagca

SEQ ID NO: 2370705 - DNA, 18 bp, Homo sapiens
ccacatcttccatttcca

SEQ ID NO: 2370706 - DNA, 21 bp, Homo sapiens
ccacatgcctgcgcctgctgc

SEQ ID NO: 2370707 - DNA, 22 bp, Homo sapiens
ccacatgcctgcgcctgctgcc

SEQ ID NO: 2370708 - DNA, 12 bp, Homo sapiens
ccaccaaagctg

SEQ ID NO: 2370709 - DNA, 16 bp, Homo sapiens
ccaccaaagctgccca

SEQ ID NO: 2370710 - DNA, 19 bp, Homo sapiens
ccaccaaagctgcccactg

SEQ ID NO: 2370711 - DNA, 15 bp, Homo sapiens
ccaccactaaaaaac

SEQ ID NO: 2370712 - DNA, 12 bp, Homo sapiens
ccaccagccatc

SEQ ID NO: 2370713 - DNA, 17 bp, Homo sapiens
ccaccatatgaattgta

SEQ ID NO: 2370714 - DNA, 20 bp, Homo sapiens
ccaccatatgaattgtacag

SEQ ID NO: 2370715 - DNA, 13 bp, Homo sapiens
ccacccaacccta

SEQ ID NO: 2370716 - DNA, 17 bp, Homo sapiens
ccaccccctgccctgca

SEQ ID NO: 2370717 - DNA, 19 bp, Homo sapiens
ccaccccggggaccctgtg

SEQ ID NO: 2370718 - DNA, 22 bp, Homo sapiens
ccacccctgcccccagccccgg

SEQ ID NO: 2370719 - DNA, 21 bp, Homo sapiens
ccacccctggaagagcccagt

SEQ ID NO: 2370720 - DNA, 19 bp, Homo sapiens
ccaccctcactggctctcc

SEQ ID NO: 2370721 - DNA, 13 bp, Homo sapiens
ccaccctgctcat

SEQ ID NO: 2370722 - DNA, 20 bp, Homo sapiens
ccagcgatctctccactgtg

SEQ ID NO: 2370723 - DNA, 23 bp, Homo sapiens
ccagcgtcagctgctccctggca

SEQ ID NO: 2370724 - DNA, 19 bp, Homo sapiens
ccagctacttgggaggctg

SEQ ID NO: 2370725 - DNA, 20 bp, Homo sapiens
ccagctacttgggaggctga

SEQ ID NO: 2370726 - DNA, 15 bp, Homo sapiens
ccagctctttattac

SEQ ID NO: 2370727 - DNA, 16 bp, Homo sapiens
ccagctgcgcttgctt

SEQ ID NO: 2370728 - DNA, 18 bp, Homo sapiens
ccagctgcgcttgctttt

SEQ ID NO: 2370729 - DNA, 13 bp, Homo sapiens
ccagctggccttt

SEQ ID NO: 2370730 - DNA, 20 bp, Homo sapiens
ccagctggggccagaggctg

SEQ ID NO: 2370731 - DNA, 21 bp, Homo sapiens
ccagctggggccagaggctgg

SEQ ID NO: 2370732 - DNA, 14 bp, Homo sapiens
ccagcttggggcca

SEQ ID NO: 2370733 - DNA, 22 bp, Homo sapiens
ccagcttggggccaccaaagct

SEQ ID NO: 2370734 - DNA, 15 bp, Homo sapiens
ccaggaagccagagc

SEQ ID NO: 2370735 - DNA, 23 bp, Homo sapiens
ccaggaaggccaaaatcaagagt

SEQ ID NO: 2370736 - DNA, 22 bp, Homo sapiens
ccaggactctgaccccagcatt

SEQ ID NO: 2370737 - DNA, 13 bp, Homo sapiens
ccaggagataatt

SEQ ID NO: 2370738 - DNA, 12 bp, Homo sapiens
ccaggagatggg

SEQ ID NO: 2370739 - DNA, 21 bp, Homo sapiens
ccaggagatgggtccaggggt

SEQ ID NO: 2370740 - DNA, 15 bp, Homo sapiens
ccaggagcaggcacg

SEQ ID NO: 2370741 - DNA, 21 bp, Homo sapiens
ccaggagcttcttgtttcctt

SEQ ID NO: 2370742 - DNA, 15 bp, Homo sapiens
ccaggatactggcac

SEQ ID NO: 2370743 - DNA, 15 bp, Homo sapiens
ccaggatcatggtgt

SEQ ID NO: 2370744 - DNA, 17 bp, Homo sapiens
ccaggatcatggtgtaa

SEQ ID NO: 2370745 - DNA, 23 bp, Homo sapiens
ccaggatcatggtgtaataagac

SEQ ID NO: 2370746 - DNA, 19 bp, Homo sapiens
ccaggcacacacagcccct

SEQ ID NO: 2370747 - DNA, 17 bp, Homo sapiens
ccaggcaccaggactag

SEQ ID NO: 2370748 - DNA, 17 bp, Homo sapiens
ccaggcaccctcaggga

SEQ ID NO: 2370749 - DNA, 16 bp, Homo sapiens
ccaggccagcctccga

SEQ ID NO: 2370750 - DNA, 14 bp, Homo sapiens
ccaggccggcccag

SEQ ID NO: 2370751 - DNA, 16 bp, Homo sapiens
ccaggccggcccagat

SEQ ID NO: 2370752 - DNA, 16 bp, Homo sapiens
ccaggcctgcctccca

SEQ ID NO: 2370753 - DNA, 12 bp, Homo sapiens
ccaggcctggct

SEQ ID NO: 2370754 - DNA, 15 bp, Homo sapiens
ccaggcgggcggcac

SEQ ID NO: 2370755 - DNA, 18 bp, Homo sapiens
ccaggcggtttcacgccc

SEQ ID NO: 2370756 - DNA, 13 bp, Homo sapiens
ccaggctccagca

SEQ ID NO: 2370757 - DNA, 15 bp, Homo sapiens
ccaggctccagcaca

SEQ ID NO: 2370758 - DNA, 22 bp, Homo sapiens
ccaggctccagcacatccccct

SEQ ID NO: 2370759 - DNA, 12 bp, Homo sapiens
ccaggctggaga

SEQ ID NO: 2370760 - DNA, 15 bp, Homo sapiens
ccaggcttctgctgg

SEQ ID NO: 2370761 - DNA, 15 bp, Homo sapiens
ccagggaatccaagc

SEQ ID NO: 2370762 - DNA, 17 bp, Homo sapiens
ccagggaatccaagcct

SEQ ID NO: 2370763 - DNA, 18 bp, Homo sapiens
ccagggaatccaagcctc

SEQ ID NO: 2370764 - DNA, 16 bp, Homo sapiens
ccagggacacacagcc

SEQ ID NO: 2370765 - DNA, 17 bp, Homo sapiens
ccagggagtccagggtt

SEQ ID NO: 2370766 - DNA, 16 bp, Homo sapiens
ccagggcagggtctgg

SEQ ID NO: 2370767 - DNA, 19 bp, Homo sapiens
ccagggcatcttgctggct

SEQ ID NO: 2370768 - DNA, 13 bp, Homo sapiens
ccagggccctcgg

SEQ ID NO: 2370769 - DNA, 14 bp, Homo sapiens
ccagggccctgggc

SEQ ID NO: 2370770 - DNA, 15 bp, Homo sapiens
ccagggccctgggca

SEQ ID NO: 2370771 - DNA, 17 bp, Homo sapiens
ccagggccctgggcagg

SEQ ID NO: 2370772 - DNA, 21 bp, Homo sapiens
ccagggctccctcctggagca

SEQ ID NO: 2370773 - DNA, 15 bp, Homo sapiens
ccaggggaaggccct

SEQ ID NO: 2370774 - DNA, 21 bp, Homo sapiens
ccaggggctggtgggacagtg

SEQ ID NO: 2370775 - DNA, 14 bp, Homo sapiens
ccaggggtctccct

SEQ ID NO: 2370776 - DNA, 16 bp, Homo sapiens
ccaggggtctccctgg

SEQ ID NO: 2370777 - DNA, 18 bp, Homo sapiens
ccaggggtctccctggct

SEQ ID NO: 2370778 - DNA, 19 bp, Homo sapiens
ccaggtaccagctgcgctt

SEQ ID NO: 2370779 - DNA, 22 bp, Homo sapiens
ccagtaaaatactattgcctca

SEQ ID NO: 2370780 - DNA, 22 bp, Homo sapiens
ccagtacagagaaattctgtgg

SEQ ID NO: 2370781 - DNA, 19 bp, Homo sapiens
ccagtacagtattctttta

SEQ ID NO: 2370782 - DNA, 15 bp, Homo sapiens
ccagtcacactgtgg

SEQ ID NO: 2370783 - DNA, 16 bp, Homo sapiens
ccagtcatctgtaaga

SEQ ID NO: 2370784 - DNA, 18 bp, Homo sapiens
ccagtccccacccctgcc

SEQ ID NO: 2370785 - DNA, 12 bp, Homo sapiens
ccagtcctgcta

SEQ ID NO: 2370786 - DNA, 20 bp, Homo sapiens
ccagtcgtcatcagatgctt

SEQ ID NO: 2370787 - DNA, 15 bp, Homo sapiens
ccagtgaaaaaatgt

SEQ ID NO: 2370788 - DNA, 15 bp, Homo sapiens
ccagtgaacattccc

SEQ ID NO: 2370789 - DNA, 17 bp, Homo sapiens
ccagtgaacattcccag

SEQ ID NO: 2370790 - DNA, 18 bp, Homo sapiens
ccagtgaacattcccagc

SEQ ID NO: 2370791 - DNA, 22 bp, Homo sapiens
ccagtgaacattcccagcccag

SEQ ID NO: 2370792 - DNA, 15 bp, Homo sapiens
ccagtgcatatgcaa

SEQ ID NO: 2370793 - DNA, 19 bp, Homo sapiens
ccagtgcatatgcaatgta

SEQ ID NO: 2370794 - DNA, 13 bp, Homo sapiens
ccagtgctggaag

SEQ ID NO: 2370795 - DNA, 22 bp, Homo sapiens
ccagtggcgggtgatggccagc

SEQ ID NO: 2370796 - DNA, 19 bp, Homo sapiens
ccagtgggccagccacaga

SEQ ID NO: 2370797 - DNA, 12 bp, Homo sapiens
ccagtgtttcca

SEQ ID NO: 2370798 - DNA, 19 bp, Homo sapiens
ccagttcatcaccatttcc

SEQ ID NO: 2370799 - DNA, 19 bp, Homo sapiens
ccagttgatctgctctgtt

SEQ ID NO: 2370800 - DNA, 15 bp, Homo sapiens
ccagtttctcagaag

SEQ ID NO: 2370801 - DNA, 20 bp, Homo sapiens
ccataaacggttcctggtga

SEQ ID NO: 2370802 - DNA, 22 bp, Homo sapiens
ccataaacggttcctggtgact

SEQ ID NO: 2370803 - DNA, 22 bp, Homo sapiens
ccataataagagaatgttccta

SEQ ID NO: 2370804 - DNA, 15 bp, Homo sapiens
ccatacacagaggag

SEQ ID NO: 2370805 - DNA, 20 bp, Homo sapiens
ccatacactttgttgcaaga

SEQ ID NO: 2370806 - DNA, 19 bp, Homo sapiens
ccatacataaaagaaataa

SEQ ID NO: 2370807 - DNA, 19 bp, Homo sapiens
ccatactccttgcttcctg

SEQ ID NO: 2370808 - DNA, 13 bp, Homo sapiens
ccatacttctctc

SEQ ID NO: 2370809 - DNA, 16 bp, Homo sapiens
ccatagacatgaaagg

SEQ ID NO: 2370810 - DNA, 16 bp, Homo sapiens
ccatagaccctgaggc

SEQ ID NO: 2370811 - DNA, 15 bp, Homo sapiens
ccatagtcacatggc

SEQ ID NO: 2370812 - DNA, 19 bp, Homo sapiens
ccatatcagaactgtgcca

SEQ ID NO: 2370813 - DNA, 18 bp, Homo sapiens
ccatatctccatggccct

SEQ ID NO: 2370814 - DNA, 19 bp, Homo sapiens
ccatatctccatggccctg

SEQ ID NO: 2370815 - DNA, 12 bp, Homo sapiens
ccatatgaattg

SEQ ID NO: 2370816 - DNA, 17 bp, Homo sapiens
ccatatgaattgtacag

SEQ ID NO: 2370817 - DNA, 13 bp, Homo sapiens
ccatcaccctctt

SEQ ID NO: 2370818 - DNA, 16 bp, Homo sapiens
ccatcaccctcttcct

SEQ ID NO: 2370819 - DNA, 14 bp, Homo sapiens
ccatcaccgctggg

SEQ ID NO: 2370820 - DNA, 17 bp, Homo sapiens
ccatcaccgctgggtgg

SEQ ID NO: 2370821 - DNA, 17 bp, Homo sapiens
ccatcagaacctgagct

SEQ ID NO: 2370822 - DNA, 23 bp, Homo sapiens
ccatcatgcggtgggtgctgcca

SEQ ID NO: 2370823 - DNA, 22 bp, Homo sapiens
ccatcattttccatatcctggt

SEQ ID NO: 2370824 - DNA, 18 bp, Homo sapiens
ccatcctcaaacgacaga

SEQ ID NO: 2370825 - DNA, 12 bp, Homo sapiens
ccatcctgactg

SEQ ID NO: 2370826 - DNA, 13 bp, Homo sapiens
ccatcctgactga

SEQ ID NO: 2370827 - DNA, 19 bp, Homo sapiens
ccatcctgggacggcggca

SEQ ID NO: 2370828 - DNA, 23 bp, Homo sapiens
ccatctagccagcccctcttccc

SEQ ID NO: 2370829 - DNA, 21 bp, Homo sapiens
ccatctcaggacacttccgta

SEQ ID NO: 2370830 - DNA, 14 bp, Homo sapiens
ccatctcccaaggc

SEQ ID NO: 2370831 - DNA, 17 bp, Homo sapiens
ccatctcccaaggctgc

SEQ ID NO: 2370832 - DNA, 13 bp, Homo sapiens
ccatctccctgcc

SEQ ID NO: 2370833 - DNA, 18 bp, Homo sapiens
ccatctcgctccctccca

SEQ ID NO: 2370834 - DNA, 20 bp, Homo sapiens
ccatctgcaccccttctctc

SEQ ID NO: 2370835 - DNA, 22 bp, Homo sapiens
ccatctgcaccccttctctcct

SEQ ID NO: 2370836 - DNA, 20 bp, Homo sapiens
ccatctgtccagctggggcc

SEQ ID NO: 2370837 - DNA, 16 bp, Homo sapiens
cccaggccggcccaga

SEQ ID NO: 2370838 - DNA, 18 bp, Homo sapiens
cccaggctggagtgcagt

SEQ ID NO: 2370839 - DNA, 19 bp, Homo sapiens
cccaggctggagtgcagtg

SEQ ID NO: 2370840 - DNA, 20 bp, Homo sapiens
cccaggctggagtgcagtgg

SEQ ID NO: 2370841 - DNA, 12 bp, Homo sapiens
cccaggctgtca

SEQ ID NO: 2370842 - DNA, 15 bp, Homo sapiens
cccagggagtccagg

SEQ ID NO: 2370843 - DNA, 16 bp, Homo sapiens
cccagggagtccaggg

SEQ ID NO: 2370844 - DNA, 16 bp, Homo sapiens
cccagggcctcctggg

SEQ ID NO: 2370845 - DNA, 19 bp, Homo sapiens
cccagggctccctcctgga

SEQ ID NO: 2370846 - DNA, 22 bp, Homo sapiens
cccagggctccctcctggagca

SEQ ID NO: 2370847 - DNA, 14 bp, Homo sapiens
cccaggggtctccc

SEQ ID NO: 2370848 - DNA, 21 bp, Homo sapiens
cccaggggtctccctggctcc

SEQ ID NO: 2370849 - DNA, 15 bp, Homo sapiens
cccaggtaccagctg

SEQ ID NO: 2370850 - DNA, 13 bp, Homo sapiens
cccagtccccacc

SEQ ID NO: 2370851 - DNA, 17 bp, Homo sapiens
cccagtgaactcctgcc

SEQ ID NO: 2370852 - DNA, 18 bp, Homo sapiens
cccagtgaactcctgcca

SEQ ID NO: 2370853 - DNA, 20 bp, Homo sapiens
cccagtgaactcctgccagg

SEQ ID NO: 2370854 - DNA, 14 bp, Homo sapiens
cccagtgctcacca

SEQ ID NO: 2370855 - DNA, 17 bp, Homo sapiens
cccagtgctcaccagcc

SEQ ID NO: 2370856 - DNA, 18 bp, Homo sapiens
cccagtgctcaccagccc

SEQ ID NO: 2370857 - DNA, 19 bp, Homo sapiens
cccagttttgttgccccag

SEQ ID NO: 2370858 - DNA, 20 bp, Homo sapiens
cccatagcagccagttcaaa

SEQ ID NO: 2370859 - DNA, 15 bp, Homo sapiens
cccatccagctacca

SEQ ID NO: 2370860 - DNA, 15 bp, Homo sapiens
cccatcctgccatcc

SEQ ID NO: 2370861 - DNA, 19 bp, Homo sapiens
cccatcgtctcggccttca

SEQ ID NO: 2370862 - DNA, 12 bp, Homo sapiens
cccatctccctg

SEQ ID NO: 2370863 - DNA, 13 bp, Homo sapiens
cccatctgtccag

SEQ ID NO: 2370864 - DNA, 17 bp, Homo sapiens
cccatcttcgggaccag

SEQ ID NO: 2370865 - DNA, 22 bp, Homo sapiens
cccattccttgcgcctcagccc

SEQ ID NO: 2370866 - DNA, 12 bp, Homo sapiens
cccattgtcctc

SEQ ID NO: 2370867 - DNA, 23 bp, Homo sapiens
cccattgtcctccttttcacttt

SEQ ID NO: 2370868 - DNA, 13 bp, Homo sapiens
cccatttcagctg

SEQ ID NO: 2370869 - DNA, 17 bp, Homo sapiens
cccatttcccatctgca

SEQ ID NO: 2370870 - DNA, 14 bp, Homo sapiens
cccatttctgcctc

SEQ ID NO: 2370871 - DNA, 17 bp, Homo sapiens
cccatttctgcctcgct

SEQ ID NO: 2370872 - DNA, 23 bp, Homo sapiens
cccatttctgcctcgctcaccgc

SEQ ID NO: 2370873 - DNA, 13 bp, Homo sapiens
cccatttgtccca

SEQ ID NO: 2370874 - DNA, 15 bp, Homo sapiens
ccccaaaggacgcct

SEQ ID NO: 2370875 - DNA, 22 bp, Homo sapiens
ccccaaaggacgcctgcaggag

SEQ ID NO: 2370876 - DNA, 14 bp, Homo sapiens
ccccaacctgctct

SEQ ID NO: 2370877 - DNA, 21 bp, Homo sapiens
ccccaacctgctctcctcttc

SEQ ID NO: 2370878 - DNA, 18 bp, Homo sapiens
ccccacagccctgctcat

SEQ ID NO: 2370879 - DNA, 23 bp, Homo sapiens
ccccacccctgcccccagccccg

SEQ ID NO: 2370880 - DNA, 14 bp, Homo sapiens
ccccaccctgttcc

SEQ ID NO: 2370881 - DNA, 17 bp, Homo sapiens
ccccaccctgttcctgc

SEQ ID NO: 2370882 - DNA, 19 bp, Homo sapiens
ccccaccctgttcctgctg

SEQ ID NO: 2370883 - DNA, 22 bp, Homo sapiens
ccccaccggtccagctggcctg

SEQ ID NO: 2370884 - DNA, 12 bp, Homo sapiens
ccccactcctct

SEQ ID NO: 2370885 - DNA, 18 bp, Homo sapiens
ccccagagaggcactcag

SEQ ID NO: 2370886 - DNA, 20 bp, Homo sapiens
ccccagcagaggcaggctgg

SEQ ID NO: 2370887 - DNA, 17 bp, Homo sapiens
ccccagccatccagggg

SEQ ID NO: 2370888 - DNA, 20 bp, Homo sapiens
ccccagccatgccagctggc

SEQ ID NO: 2370889 - DNA, 22 bp, Homo sapiens
ccccagccatgccagctggcct

SEQ ID NO: 2370890 - DNA, 23 bp, Homo sapiens
ccccagccatgccagctggcctt

SEQ ID NO: 2370891 - DNA, 23 bp, Homo sapiens
ccccagccccggtggctgggcag

SEQ ID NO: 2370892 - DNA, 17 bp, Homo sapiens
ccccagccctgctgggg

SEQ ID NO: 2370893 - DNA, 14 bp, Homo sapiens
ccccagcctgggcc

SEQ ID NO: 2370894 - DNA, 18 bp, Homo sapiens
ccccaggccccagacagg

SEQ ID NO: 2370895 - DNA, 13 bp, Homo sapiens
ccccaggccttgt

SEQ ID NO: 2370896 - DNA, 11 bp, Homo sapiens
ccccaggctgg

SEQ ID NO: 2370897 - DNA, 15 bp, Homo sapiens
ccccatactcctatg

SEQ ID NO: 2370898 - DNA, 19 bp, Homo sapiens
ccccatcagaacctgagct

SEQ ID NO: 2370899 - DNA, 22 bp, Homo sapiens
ccccatcgttgcccccatttct

SEQ ID NO: 2370900 - DNA, 19 bp, Homo sapiens
ccccatcttcgggaccagg

SEQ ID NO: 2370901 - DNA, 19 bp, Homo sapiens
ccccattcctgatcccatg

SEQ ID NO: 2370902 - DNA, 13 bp, Homo sapiens
ccccattccttgc

SEQ ID NO: 2370903 - DNA, 19 bp, Homo sapiens
ccccatttcccatctgcac

SEQ ID NO: 2370904 - DNA, 20 bp, Homo sapiens
ccccatttcccatctgcacc

SEQ ID NO: 2370905 - DNA, 22 bp, Homo sapiens
ccccatttcccatctgcacccc

SEQ ID NO: 2370906 - DNA, 14 bp, Homo sapiens
ccccatttctgcct

SEQ ID NO: 2370907 - DNA, 19 bp, Homo sapiens
ccccatttctgcctcgctc

SEQ ID NO: 2370908 - DNA, 16 bp, Homo sapiens
ccccatttgtcccaga

SEQ ID NO: 2370909 - DNA, 19 bp, Homo sapiens
cccccaatcggactgccaa

SEQ ID NO: 2370910 - DNA, 20 bp, Homo sapiens
cccccaccccggggaccctg

SEQ ID NO: 2370911 - DNA, 19 bp, Homo sapiens
cccccaccggtccagctgg

SEQ ID NO: 2370912 - DNA, 20 bp, Homo sapiens
cccccaccggtccagctggc

SEQ ID NO: 2370913 - DNA, 19 bp, Homo sapiens
cccccagccatgccagctg

SEQ ID NO: 2370914 - DNA, 20 bp, Homo sapiens
cccccaggctggagtgcagt

SEQ ID NO: 2370915 - DNA, 20 bp, Homo sapiens
cccccagtccccacccctgc

SEQ ID NO: 2370916 - DNA, 13 bp, Homo sapiens
cccccgccccaga

SEQ ID NO: 2370917 - DNA, 24 bp, Homo sapiens
ccccctctccttctcctagctctg

SEQ ID NO: 2370918 - DNA, 13 bp, Homo sapiens
ccccgcccatgct

SEQ ID NO: 2370919 - DNA, 13 bp, Homo sapiens
ccccgcctgagtc

SEQ ID NO: 2370920 - DNA, 17 bp, Homo sapiens
ccccgcctggccaggag

SEQ ID NO: 2370921 - DNA, 13 bp, Homo sapiens
ccccggcaagcca

SEQ ID NO: 2370922 - DNA, 22 bp, Homo sapiens
ccccggcaagccacaggaagga

SEQ ID NO: 2370923 - DNA, 17 bp, Homo sapiens
ccccgggatattataga

SEQ ID NO: 2370924 - DNA, 22 bp, Homo sapiens
ccccggggtgagtccattctcc

SEQ ID NO: 2370925 - DNA, 12 bp, Homo sapiens
cccctcccagag

SEQ ID NO: 2370926 - DNA, 14 bp, Homo sapiens
cccctcccccagcc

SEQ ID NO: 2370927 - DNA, 18 bp, Homo sapiens
cccctccggactggtgcc

SEQ ID NO: 2370928 - DNA, 15 bp, Homo sapiens
cccctctcccttggg

SEQ ID NO: 2370929 - DNA, 14 bp, Homo sapiens
cccctcttctgagc

SEQ ID NO: 2370930 - DNA, 22 bp, Homo sapiens
cccctgacccagggactctcca

SEQ ID NO: 2370931 - DNA, 16 bp, Homo sapiens
cccctgccacactgat

SEQ ID NO: 2370932 - DNA, 12 bp, Homo sapiens
cccctgccccca

SEQ ID NO: 2370933 - DNA, 15 bp, Homo sapiens
cccctgccctgtggg

SEQ ID NO: 2370934 - DNA, 23 bp, Homo sapiens
cccctggccgcgctccgggcttt

SEQ ID NO: 2370935 - DNA, 19 bp, Homo sapiens
ccccttcctcttgtctgat

SEQ ID NO: 2370936 - DNA, 14 bp, Homo sapiens
ccccttctctcctc

SEQ ID NO: 2370937 - DNA, 15 bp, Homo sapiens
ccccttctctcctcc

SEQ ID NO: 2370938 - DNA, 18 bp, Homo sapiens
ccccttgaatctgcaggg

SEQ ID NO: 2370939 - DNA, 22 bp, Homo sapiens
ccccttggaaatgtctgctggt

SEQ ID NO: 2370940 - DNA, 20 bp, Homo sapiens
cccctttagatctctgaagc

SEQ ID NO: 2370941 - DNA, 22 bp, Homo sapiens
cccgagctactctcttgccagc

SEQ ID NO: 2370942 - DNA, 23 bp, Homo sapiens
cccgagctactctcttgccagca

SEQ ID NO: 2370943 - DNA, 17 bp, Homo sapiens
cccgaggggagggcagg

SEQ ID NO: 2370944 - DNA, 16 bp, Homo sapiens
cccgcagggccatgca

SEQ ID NO: 2370945 - DNA, 20 bp, Homo sapiens
cccgccccgttgtgagctgg

SEQ ID NO: 2370946 - DNA, 21 bp, Homo sapiens
cccgccccgttgtgagctgga

SEQ ID NO: 2370947 - DNA, 23 bp, Homo sapiens
cccgcctgagtcagtgctctcag

SEQ ID NO: 2370948 - DNA, 14 bp, Homo sapiens
cccgcctggccagg

SEQ ID NO: 2370949 - DNA, 21 bp, Homo sapiens
cccgcctggccaggagcaggc

SEQ ID NO: 2370950 - DNA, 18 bp, Homo sapiens
cccggatgtgtgtctcac

SEQ ID NO: 2370951 - DNA, 13 bp, Homo sapiens
cctcagccctcag

SEQ ID NO: 2370952 - DNA, 15 bp, Homo sapiens
cctcagggagcctcc

SEQ ID NO: 2370953 - DNA, 16 bp, Homo sapiens
cctcagggagcctccc

SEQ ID NO: 2370954 - DNA, 14 bp, Homo sapiens
cctcagggctccca

SEQ ID NO: 2370955 - DNA, 18 bp, Homo sapiens
cctcagggctcccagggg

SEQ ID NO: 2370956 - DNA, 16 bp, Homo sapiens
cctcagggctgtccca

SEQ ID NO: 2370957 - DNA, 19 bp, Homo sapiens
cctcaggtagtactgggaa

SEQ ID NO: 2370958 - DNA, 14 bp, Homo sapiens
cctcaggttccttt

SEQ ID NO: 2370959 - DNA, 23 bp, Homo sapiens
cctcagttaaatctcctgtggag

SEQ ID NO: 2370960 - DNA, 14 bp, Homo sapiens
cctcagttttcctt

SEQ ID NO: 2370961 - DNA, 16 bp, Homo sapiens
cctcagttttccttct

SEQ ID NO: 2370962 - DNA, 17 bp, Homo sapiens
cctcagttttccttctg

SEQ ID NO: 2370963 - DNA, 19 bp, Homo sapiens
cctcagttttccttctgtt

SEQ ID NO: 2370964 - DNA, 14 bp, Homo sapiens
cctcatactcctgg

SEQ ID NO: 2370965 - DNA, 17 bp, Homo sapiens
cctcatactcctgggct

SEQ ID NO: 2370966 - DNA, 20 bp, Homo sapiens
cctcatgcccagctctctga

SEQ ID NO: 2370967 - DNA, 13 bp, Homo sapiens
cctcatgggtcct

SEQ ID NO: 2370968 - DNA, 22 bp, Homo sapiens
cctccaaatggagaagctgcag

SEQ ID NO: 2370969 - DNA, 13 bp, Homo sapiens
cctccaagcacag

SEQ ID NO: 2370970 - DNA, 18 bp, Homo sapiens
cctccaagcacagagcct

SEQ ID NO: 2370971 - DNA, 21 bp, Homo sapiens
cctccaagcacagagcctggc

SEQ ID NO: 2370972 - DNA, 20 bp, Homo sapiens
cctccaaggaggggctgtaa

SEQ ID NO: 2370973 - DNA, 21 bp, Homo sapiens
cctccaaggaggggctgtaaa

SEQ ID NO: 2370974 - DNA, 15 bp, Homo sapiens
cctccacagcgaggg

SEQ ID NO: 2370975 - DNA, 22 bp, Homo sapiens
cctccacagcgagggcagctgc

SEQ ID NO: 2370976 - DNA, 23 bp, Homo sapiens
cctccacagcgagggcagctgct

SEQ ID NO: 2370977 - DNA, 19 bp, Homo sapiens
cctccacctcaagaccccc

SEQ ID NO: 2370978 - DNA, 19 bp, Homo sapiens
cctccaggagcttcttgtt

SEQ ID NO: 2370979 - DNA, 18 bp, Homo sapiens
cctccaggcctgcctccc

SEQ ID NO: 2370980 - DNA, 12 bp, Homo sapiens
cctccaggctcc

SEQ ID NO: 2370981 - DNA, 14 bp, Homo sapiens
cctccaggctccag

SEQ ID NO: 2370982 - DNA, 22 bp, Homo sapiens
cctccagggaaggtggccacag

SEQ ID NO: 2370983 - DNA, 16 bp, Homo sapiens
cctccatccatccttc

SEQ ID NO: 2370984 - DNA, 15 bp, Homo sapiens
cctcccacactccca

SEQ ID NO: 2370985 - DNA, 19 bp, Homo sapiens
cctcccacactcccaaggt

SEQ ID NO: 2370986 - DNA, 16 bp, Homo sapiens
cctcccacttcactgc

SEQ ID NO: 2370987 - DNA, 21 bp, Homo sapiens
cctcccagaaacatctctggc

SEQ ID NO: 2370988 - DNA, 19 bp, Homo sapiens
cctcccaggcaagcagctg

SEQ ID NO: 2370989 - DNA, 16 bp, Homo sapiens
cctcccagggcctcct

SEQ ID NO: 2370990 - DNA, 17 bp, Homo sapiens
cctcccagggcctcctg

SEQ ID NO: 2370991 - DNA, 16 bp, Homo sapiens
cctcccagtgagactg

SEQ ID NO: 2370992 - DNA, 13 bp, Homo sapiens
cctccccagaatc

SEQ ID NO: 2370993 - DNA, 22 bp, Homo sapiens
cctccccaggctggagaccccc

SEQ ID NO: 2370994 - DNA, 18 bp, Homo sapiens
cctccccatctgtccagc

SEQ ID NO: 2370995 - DNA, 14 bp, Homo sapiens
cctccccatttccc

SEQ ID NO: 2370996 - DNA, 20 bp, Homo sapiens
cctccccatttcccatctgc

SEQ ID NO: 2370997 - DNA, 23 bp, Homo sapiens
cctcccccagccatgccagctgg

SEQ ID NO: 2370998 - DNA, 13 bp, Homo sapiens
cctccccctgcca

SEQ ID NO: 2370999 - DNA, 22 bp, Homo sapiens
cctccctctctcatgagaagcc

SEQ ID NO: 2371000 - DNA, 21 bp, Homo sapiens
cctccctgggggccccaggat

SEQ ID NO: 2371001 - DNA, 21 bp, Homo sapiens
cctcccttccttttccctgct

SEQ ID NO: 2371002 - DNA, 19 bp, Homo sapiens
cctccgagagggagagaga

SEQ ID NO: 2371003 - DNA, 14 bp, Homo sapiens
cctccgcagtgtct

SEQ ID NO: 2371004 - DNA, 14 bp, Homo sapiens
cctccgccatccac

SEQ ID NO: 2371005 - DNA, 15 bp, Homo sapiens
cctccgccatccacc

SEQ ID NO: 2371006 - DNA, 13 bp, Homo sapiens
cctccggactggt

SEQ ID NO: 2371007 - DNA, 16 bp, Homo sapiens
cctcctagctctccca

SEQ ID NO: 2371008 - DNA, 17 bp, Homo sapiens
cctcctagctctcccag

SEQ ID NO: 2371009 - DNA, 23 bp, Homo sapiens
cctcctatccttggagagcagct

SEQ ID NO: 2371010 - DNA, 14 bp, Homo sapiens
cctcctcacctcat

SEQ ID NO: 2371011 - DNA, 15 bp, Homo sapiens
cctcctccaggcctg

SEQ ID NO: 2371012 - DNA, 13 bp, Homo sapiens
cctcctctgccta

SEQ ID NO: 2371013 - DNA, 21 bp, Homo sapiens
cctcctctgcctacagccagg

SEQ ID NO: 2371014 - DNA, 21 bp, Homo sapiens
cctcctctggacggcaggctc

SEQ ID NO: 2371015 - DNA, 22 bp, Homo sapiens
cctcctctggacggcaggctca

SEQ ID NO: 2371016 - DNA, 19 bp, Homo sapiens
cctcctgacacccttctcc

SEQ ID NO: 2371017 - DNA, 16 bp, Homo sapiens
cctcctgcctcagcct

SEQ ID NO: 2371018 - DNA, 16 bp, Homo sapiens
cctcctggaggaccag

SEQ ID NO: 2371019 - DNA, 12 bp, Homo sapiens
cctcctgtgcct

SEQ ID NO: 2371020 - DNA, 14 bp, Homo sapiens
cctcctgtgcctgg

SEQ ID NO: 2371021 - DNA, 21 bp, Homo sapiens
cctccttctgagctcctgtcc

SEQ ID NO: 2371022 - DNA, 17 bp, Homo sapiens
cctccttggtgcctggc

SEQ ID NO: 2371023 - DNA, 12 bp, Homo sapiens
cctcctttccct

SEQ ID NO: 2371024 - DNA, 18 bp, Homo sapiens
cctcgtgaaagtgcattt

SEQ ID NO: 2371025 - DNA, 15 bp, Homo sapiens
cctctaatgagactg

SEQ ID NO: 2371026 - DNA, 20 bp, Homo sapiens
cctctcaagctagtgtttct

SEQ ID NO: 2371027 - DNA, 14 bp, Homo sapiens
cctctcagaacata

SEQ ID NO: 2371028 - DNA, 20 bp, Homo sapiens
cctctccaaccactgtgcca

SEQ ID NO: 2371029 - DNA, 23 bp, Homo sapiens
cctctccaaccactgtgccactg

SEQ ID NO: 2371030 - DNA, 17 bp, Homo sapiens
cctctccacacagtgct

SEQ ID NO: 2371031 - DNA, 18 bp, Homo sapiens
cctctccacacagtgctc

SEQ ID NO: 2371032 - DNA, 23 bp, Homo sapiens
cctctccacacagtgctcaaggc

SEQ ID NO: 2371033 - DNA, 15 bp, Homo sapiens
cctctccatctccca

SEQ ID NO: 2371034 - DNA, 17 bp, Homo sapiens
cctctccatctcccaag

SEQ ID NO: 2371035 - DNA, 21 bp, Homo sapiens
cctctccatctcccaaggctg

SEQ ID NO: 2371036 - DNA, 18 bp, Homo sapiens
cctctcccaccctcttcc

SEQ ID NO: 2371037 - DNA, 19 bp, Homo sapiens
cctctcccaccctcttcct

SEQ ID NO: 2371038 - DNA, 12 bp, Homo sapiens
cctctcccaggc

SEQ ID NO: 2371039 - DNA, 20 bp, Homo sapiens
cctctcctactcggctctgc

SEQ ID NO: 2371040 - DNA, 18 bp, Homo sapiens
cctctcctcggttcaagg

SEQ ID NO: 2371041 - DNA, 16 bp, Homo sapiens
cctctcctctccccca

SEQ ID NO: 2371042 - DNA, 17 bp, Homo sapiens
cctctcctctcccccag

SEQ ID NO: 2371043 - DNA, 15 bp, Homo sapiens
cctctctctcttcta

SEQ ID NO: 2371044 - DNA, 18 bp, Homo sapiens
cctctctctcttctaggc

SEQ ID NO: 2371045 - DNA, 12 bp, Homo sapiens
cctctctctggg

SEQ ID NO: 2371046 - DNA, 20 bp, Homo sapiens
cctctctctttcctccaccc

SEQ ID NO: 2371047 - DNA, 20 bp, Homo sapiens
cctctgagaagctctgaaga

SEQ ID NO: 2371048 - DNA, 19 bp, Homo sapiens
cctctgcaagcttcttgct

SEQ ID NO: 2371049 - DNA, 21 bp, Homo sapiens
cctctgcaagcttcttgctga

SEQ ID NO: 2371050 - DNA, 16 bp, Homo sapiens
cctctgcagaatccct

SEQ ID NO: 2371051 - DNA, 20 bp, Homo sapiens
cctctgcccctcccccagcc

SEQ ID NO: 2371052 - DNA, 16 bp, Homo sapiens
cctctgcccgcagagc

SEQ ID NO: 2371053 - DNA, 17 bp, Homo sapiens
cctctgcccgcagagcc

SEQ ID NO: 2371054 - DNA, 15 bp, Homo sapiens
cctctgcccttcctg

SEQ ID NO: 2371055 - DNA, 15 bp, Homo sapiens
cctctgcctacagcc

SEQ ID NO: 2371056 - DNA, 21 bp, Homo sapiens
cctctgcctgccccgccccca

SEQ ID NO: 2371057 - DNA, 13 bp, Homo sapiens
cctctgctcaccg

SEQ ID NO: 2371058 - DNA, 18 bp, Homo sapiens
cctctgctcaccgcccat

SEQ ID NO: 2371059 - DNA, 20 bp, Homo sapiens
cctctgctcaccgcccatca

SEQ ID NO: 2371060 - DNA, 21 bp, Homo sapiens
cctctgctcaccgcccatcag

SEQ ID NO: 2371061 - DNA, 22 bp, Homo sapiens
cctctggacggcaggctcactg

SEQ ID NO: 2371062 - DNA, 23 bp, Homo sapiens
cctctggacggcaggctcactgc

SEQ ID NO: 2371063 - DNA, 17 bp, Homo sapiens
cctctggccgcagaggt

SEQ ID NO: 2371064 - DNA, 15 bp, Homo sapiens
cctctggctttccca

SEQ ID NO: 2371065 - DNA, 23 bp, Homo sapiens
cctgctggggatccccgcctggc

SEQ ID NO: 2371066 - DNA, 22 bp, Homo sapiens
cctgcttaatcttcaaagcctt

SEQ ID NO: 2371067 - DNA, 18 bp, Homo sapiens
cctgcttgataatatata

SEQ ID NO: 2371068 - DNA, 20 bp, Homo sapiens
cctgctttttggaaagtcag

SEQ ID NO: 2371069 - DNA, 14 bp, Homo sapiens
cctggaagagccca

SEQ ID NO: 2371070 - DNA, 17 bp, Homo sapiens
cctggaagccagctttc

SEQ ID NO: 2371071 - DNA, 20 bp, Homo sapiens
cctggaatgagttgaggcca

SEQ ID NO: 2371072 - DNA, 15 bp, Homo sapiens
cctggacaggcagcc

SEQ ID NO: 2371073 - DNA, 16 bp, Homo sapiens
cctggacttgcctctg

SEQ ID NO: 2371074 - DNA, 19 bp, Homo sapiens
cctggagaagaatggcttt

SEQ ID NO: 2371075 - DNA, 18 bp, Homo sapiens
cctggagacaaggtgcta

SEQ ID NO: 2371076 - DNA, 19 bp, Homo sapiens
cctggagacaaggtgctaa

SEQ ID NO: 2371077 - DNA, 13 bp, Homo sapiens
cctggaggaccag

SEQ ID NO: 2371078 - DNA, 19 bp, Homo sapiens
cctggaggggctggggact

SEQ ID NO: 2371079 - DNA, 14 bp, Homo sapiens
cctggaggtgggca

SEQ ID NO: 2371080 - DNA, 22 bp, Homo sapiens
cctggagttgactgactgagca

SEQ ID NO: 2371081 - DNA, 12 bp, Homo sapiens
cctggcacacat

SEQ ID NO: 2371082 - DNA, 21 bp, Homo sapiens
cctggcacacatcaggagttc

SEQ ID NO: 2371083 - DNA, 19 bp, Homo sapiens
cctggcactgggaggcagg

SEQ ID NO: 2371084 - DNA, 22 bp, Homo sapiens
cctggcactgggaggcagggct

SEQ ID NO: 2371085 - DNA, 14 bp, Homo sapiens
cctggcagcccaga

SEQ ID NO: 2371086 - DNA, 16 bp, Homo sapiens
cctggccaccagccat

SEQ ID NO: 2371087 - DNA, 19 bp, Homo sapiens
cctggccaccagccatcct

SEQ ID NO: 2371088 - DNA, 21 bp, Homo sapiens
cctggccaccagccatcctcc

SEQ ID NO: 2371089 - DNA, 11 bp, Homo sapiens
cctggccagga

SEQ ID NO: 2371090 - DNA, 14 bp, Homo sapiens
cctggccaggagca

SEQ ID NO: 2371091 - DNA, 16 bp, Homo sapiens
cctggccaggagcagg

SEQ ID NO: 2371092 - DNA, 18 bp, Homo sapiens
cctggccccagcctgggc

SEQ ID NO: 2371093 - DNA, 19 bp, Homo sapiens
cctggccccagcctgggcc

SEQ ID NO: 2371094 - DNA, 18 bp, Homo sapiens
cctggccccaggccccag

SEQ ID NO: 2371095 - DNA, 22 bp, Homo sapiens
cctggcccccaacctcagggct

SEQ ID NO: 2371096 - DNA, 23 bp, Homo sapiens
cctggcccccaacctcagggctc

SEQ ID NO: 2371097 - DNA, 15 bp, Homo sapiens
cctggcccctctccc

SEQ ID NO: 2371098 - DNA, 20 bp, Homo sapiens
cctggcccctctcccttggg

SEQ ID NO: 2371099 - DNA, 17 bp, Homo sapiens
cctggccgcgctccggg

SEQ ID NO: 2371100 - DNA, 19 bp, Homo sapiens
cctggccgcttctccccag

SEQ ID NO: 2371101 - DNA, 21 bp, Homo sapiens
cctggcctatccgctgccagc

SEQ ID NO: 2371102 - DNA, 13 bp, Homo sapiens
cctggcctgagag

SEQ ID NO: 2371103 - DNA, 12 bp, Homo sapiens
cctggcctggca

SEQ ID NO: 2371104 - DNA, 16 bp, Homo sapiens
cctggcctggcacaca

SEQ ID NO: 2371105 - DNA, 15 bp, Homo sapiens
cctggcgcaggtggg

SEQ ID NO: 2371106 - DNA, 12 bp, Homo sapiens
cctggctccctc

SEQ ID NO: 2371107 - DNA, 22 bp, Homo sapiens
cctggctccctcctccaggcct

SEQ ID NO: 2371108 - DNA, 13 bp, Homo sapiens
cctggctctcacc

SEQ ID NO: 2371109 - DNA, 14 bp, Homo sapiens
cctggctctcacct

SEQ ID NO: 2371110 - DNA, 17 bp, Homo sapiens
cctggctctcacctcta

SEQ ID NO: 2371111 - DNA, 19 bp, Homo sapiens
cctggctctcacctctagg

SEQ ID NO: 2371112 - DNA, 21 bp, Homo sapiens
cctggctctcacctctaggtc

SEQ ID NO: 2371113 - DNA, 15 bp, Homo sapiens
cctggctgccggcac

SEQ ID NO: 2371114 - DNA, 13 bp, Homo sapiens
cctggctgctgcc

SEQ ID NO: 2371115 - DNA, 20 bp, Homo sapiens
cctggctgctgcccccaccc

SEQ ID NO: 2371116 - DNA, 13 bp, Homo sapiens
cctggctggagga

SEQ ID NO: 2371117 - DNA, 21 bp, Homo sapiens
cctggctgttctgtggttcct

SEQ ID NO: 2371118 - DNA, 19 bp, Homo sapiens
cctgggacaactgctccca

SEQ ID NO: 2371119 - DNA, 18 bp, Homo sapiens
cctgggacacagacccag

SEQ ID NO: 2371120 - DNA, 20 bp, Homo sapiens
cctgggacacagacccagga

SEQ ID NO: 2371121 - DNA, 23 bp, Homo sapiens
cctgggacacagacccaggaccc

SEQ ID NO: 2371122 - DNA, 14 bp, Homo sapiens
cctgggatttgaga

SEQ ID NO: 2371123 - DNA, 12 bp, Homo sapiens
cctgggctgcca

SEQ ID NO: 2371124 - DNA, 16 bp, Homo sapiens
cctgggcttggcctgc

SEQ ID NO: 2371125 - DNA, 18 bp, Homo sapiens
cctgggcttggcctgctg

SEQ ID NO: 2371126 - DNA, 13 bp, Homo sapiens
cctggggcccagc

SEQ ID NO: 2371127 - DNA, 19 bp, Homo sapiens
cctggggcccagcccctgt

SEQ ID NO: 2371128 - DNA, 14 bp, Homo sapiens
cctggggcctgact

SEQ ID NO: 2371129 - DNA, 16 bp, Homo sapiens
cctggggcctgactgc

SEQ ID NO: 2371130 - DNA, 16 bp, Homo sapiens
cctgggtgggctctgt

SEQ ID NO: 2371131 - DNA, 14 bp, Homo sapiens
cctggtacagcagg

SEQ ID NO: 2371132 - DNA, 20 bp, Homo sapiens
cctggtatatccaaaagctt

SEQ ID NO: 2371133 - DNA, 22 bp, Homo sapiens
cctggtctggttgggcagccag

SEQ ID NO: 2371134 - DNA, 14 bp, Homo sapiens
cctggtgactcctg

SEQ ID NO: 2371135 - DNA, 20 bp, Homo sapiens
cctggtgaggcccagcctgt

SEQ ID NO: 2371136 - DNA, 22 bp, Homo sapiens
cctggtgccccccacccctgga

SEQ ID NO: 2371137 - DNA, 15 bp, Homo sapiens
cctgtaatcccagca

SEQ ID NO: 2371138 - DNA, 23 bp, Homo sapiens
cctgtagttgcgtggactctgca

SEQ ID NO: 2371139 - DNA, 18 bp, Homo sapiens
cctgtatacagtgcagag

SEQ ID NO: 2371140 - DNA, 21 bp, Homo sapiens
cctgtatacagtgcagagcct

SEQ ID NO: 2371141 - DNA, 19 bp, Homo sapiens
cctgtattcctgacctccg

SEQ ID NO: 2371142 - DNA, 23 bp, Homo sapiens
cctgtattcctgacctccgccat

SEQ ID NO: 2371143 - DNA, 22 bp, Homo sapiens
cctgtccaaaagcgccctcact

SEQ ID NO: 2371144 - DNA, 14 bp, Homo sapiens
cctgtccaggtaga

SEQ ID NO: 2371145 - DNA, 17 bp, Homo sapiens
cctgtccaggtagaaaa

SEQ ID NO: 2371146 - DNA, 19 bp, Homo sapiens
cctgtccaggtagaaaaga

SEQ ID NO: 2371147 - DNA, 14 bp, Homo sapiens
cctgtcccaggccg

SEQ ID NO: 2371148 - DNA, 21 bp, Homo sapiens
cctgtcccaggccggcccaga

SEQ ID NO: 2371149 - DNA, 13 bp, Homo sapiens
cctgtcccctgct

SEQ ID NO: 2371150 - DNA, 17 bp, Homo sapiens
cctgtgacatggtgcct

SEQ ID NO: 2371151 - DNA, 21 bp, Homo sapiens
cctgtgacatggtgcctgaga

SEQ ID NO: 2371152 - DNA, 22 bp, Homo sapiens
cctgtgacatggtgcctgagag

SEQ ID NO: 2371153 - DNA, 23 bp, Homo sapiens
cctgtgacatggtgcctgagagg

SEQ ID NO: 2371154 - DNA, 20 bp, Homo sapiens
cctgtgcatgtatgtcttgg

SEQ ID NO: 2371155 - DNA, 14 bp, Homo sapiens
cctgtgcctggccc

SEQ ID NO: 2371156 - DNA, 19 bp, Homo sapiens
cctgtgctcccctgccaca

SEQ ID NO: 2371157 - DNA, 20 bp, Homo sapiens
cctgtggaaggcagagaaat

SEQ ID NO: 2371158 - DNA, 12 bp, Homo sapiens
cctgtgggcttc

SEQ ID NO: 2371159 - DNA, 23 bp, Homo sapiens
cctgtggggtcaacccttctgga

SEQ ID NO: 2371160 - DNA, 18 bp, Homo sapiens
cctgtgggtctctgaagg

SEQ ID NO: 2371161 - DNA, 22 bp, Homo sapiens
cctgtgggtgttctttcctgcc

SEQ ID NO: 2371162 - DNA, 23 bp, Homo sapiens
cctgtgggtgttctttcctgccc

SEQ ID NO: 2371163 - DNA, 17 bp, Homo sapiens
cctgttacctactttga

SEQ ID NO: 2371164 - DNA, 11 bp, Homo sapiens
cctgttccctg

SEQ ID NO: 2371165 - DNA, 12 bp, Homo sapiens
cctgttccctgg

SEQ ID NO: 2371166 - DNA, 13 bp, Homo sapiens
cctgttccctgga

SEQ ID NO: 2371167 - DNA, 15 bp, Homo sapiens
cctgttcctgctgct

SEQ ID NO: 2371168 - DNA, 19 bp, Homo sapiens
cctgtttaaataaaattta

SEQ ID NO: 2371169 - DNA, 17 bp, Homo sapiens
cctgtttattccaaatg

SEQ ID NO: 2371170 - DNA, 14 bp, Homo sapiens
cctgtttgaaagta

SEQ ID NO: 2371171 - DNA, 12 bp, Homo sapiens
cctgttttctga

SEQ ID NO: 2371172 - DNA, 13 bp, Homo sapiens
cctgttttctgaa

SEQ ID NO: 2371173 - DNA, 14 bp, Homo sapiens
cctgttttctgaaa

SEQ ID NO: 2371174 - DNA, 19 bp, Homo sapiens
cctgttttctgaaacacac

SEQ ID NO: 2371175 - DNA, 13 bp, Homo sapiens
cctgtttttcaca

SEQ ID NO: 2371176 - DNA, 13 bp, Homo sapiens
ccttaaatttaat

SEQ ID NO: 2371177 - DNA, 12 bp, Homo sapiens
ccttaagcaaat

SEQ ID NO: 2371178 - DNA, 13 bp, Homo sapiens
ccttaagcaaatt

SEQ ID NO: 2371179 - DNA, 19 bp, Homo sapiens
ccttaatttcctttttgac

SEQ ID NO: 2371180 - DNA, 19 bp, Homo sapiens
cgatgagcgccacctcttt

SEQ ID NO: 2371181 - DNA, 13 bp, Homo sapiens
cgatgccaccggc

SEQ ID NO: 2371182 - DNA, 14 bp, Homo sapiens
cgatgccaccggcc

SEQ ID NO: 2371183 - DNA, 17 bp, Homo sapiens
cgcaaccaagtgtgcta

SEQ ID NO: 2371184 - DNA, 12 bp, Homo sapiens
cgcagagcccac

SEQ ID NO: 2371185 - DNA, 13 bp, Homo sapiens
cgcagaggacgca

SEQ ID NO: 2371186 - DNA, 23 bp, Homo sapiens
cgcagcctctcagtgccctccag

SEQ ID NO: 2371187 - DNA, 16 bp, Homo sapiens
cgcagtgcctggagtt

SEQ ID NO: 2371188 - DNA, 16 bp, Homo sapiens
cgcagtgtctccacct

SEQ ID NO: 2371189 - DNA, 16 bp, Homo sapiens
cgcagtgttttgcaag

SEQ ID NO: 2371190 - DNA, 24 bp, Homo sapiens
cgcattgccacggaaacatacaga

SEQ ID NO: 2371191 - DNA, 16 bp, Homo sapiens
cgccaatttctctcag

SEQ ID NO: 2371192 - DNA, 23 bp, Homo sapiens
cgccaccgcgggtgtgggaaagc

SEQ ID NO: 2371193 - DNA, 17 bp, Homo sapiens
cgccagcctcctctgga

SEQ ID NO: 2371194 - DNA, 21 bp, Homo sapiens
cgccagcctcctctggacggc

SEQ ID NO: 2371195 - DNA, 16 bp, Homo sapiens
cgccaggaagccagag

SEQ ID NO: 2371196 - DNA, 17 bp, Homo sapiens
cgccaggaagccagagc

SEQ ID NO: 2371197 - DNA, 15 bp, Homo sapiens
cgcccctccacccat

SEQ ID NO: 2371198 - DNA, 17 bp, Homo sapiens
cgccctcctttccctta

SEQ ID NO: 2371199 - DNA, 14 bp, Homo sapiens
cgccctgcctcctg

SEQ ID NO: 2371200 - DNA, 16 bp, Homo sapiens
cgcccttcaatgctgc

SEQ ID NO: 2371201 - DNA, 11 bp, Homo sapiens
cgcccttggct

SEQ ID NO: 2371202 - DNA, 20 bp, Homo sapiens
cgcccttggcttctgtgatg

SEQ ID NO: 2371203 - DNA, 13 bp, Homo sapiens
cgccgccaccgcg

SEQ ID NO: 2371204 - DNA, 16 bp, Homo sapiens
cgcctcagccctcagt

SEQ ID NO: 2371205 - DNA, 19 bp, Homo sapiens
cgcctctgcccgcagagcc

SEQ ID NO: 2371206 - DNA, 20 bp, Homo sapiens
cgcctctgcccgcagagccc

SEQ ID NO: 2371207 - DNA, 13 bp, Homo sapiens
cgcctgcaggcag

SEQ ID NO: 2371208 - DNA, 14 bp, Homo sapiens
cgcctgcaggcaga

SEQ ID NO: 2371209 - DNA, 14 bp, Homo sapiens
cgcctgctgcctgc

SEQ ID NO: 2371210 - DNA, 18 bp, Homo sapiens
cgcctgctgcctgctgag

SEQ ID NO: 2371211 - DNA, 22 bp, Homo sapiens
cgcctgctggccgacccactga

SEQ ID NO: 2371212 - DNA, 13 bp, Homo sapiens
cgcctggccagga

SEQ ID NO: 2371213 - DNA, 14 bp, Homo sapiens
cgcctggccaggag

SEQ ID NO: 2371214 - DNA, 16 bp, Homo sapiens
cgcctggccaggagca

SEQ ID NO: 2371215 - DNA, 16 bp, Homo sapiens
cgcgaccatgtggcca

SEQ ID NO: 2371216 - DNA, 12 bp, Homo sapiens
cgcgtagagagc

SEQ ID NO: 2371217 - DNA, 15 bp, Homo sapiens
cgctaaagagccctt

SEQ ID NO: 2371218 - DNA, 15 bp, Homo sapiens
cgctcagtaaacggg

SEQ ID NO: 2371219 - DNA, 14 bp, Homo sapiens
cgctcctgcagccc

SEQ ID NO: 2371220 - DNA, 20 bp, Homo sapiens
cgctcctttgtgtgtgtgtc

SEQ ID NO: 2371221 - DNA, 14 bp, Homo sapiens
cgctcgctgccatc

SEQ ID NO: 2371222 - DNA, 17 bp, Homo sapiens
cgctgagactgtgctgt

SEQ ID NO: 2371223 - DNA, 21 bp, Homo sapiens
cgctgccagccttgagccctg

SEQ ID NO: 2371224 - DNA, 13 bp, Homo sapiens
cgcttgtgacagt

SEQ ID NO: 2371225 - DNA, 15 bp, Homo sapiens
cgcttgtgacagtgc

SEQ ID NO: 2371226 - DNA, 19 bp, Homo sapiens
cgcttgtgacagtgcctct

SEQ ID NO: 2371227 - DNA, 22 bp, Homo sapiens
cggaaacatacagaggatgcct

SEQ ID NO: 2371228 - DNA, 21 bp, Homo sapiens
cggaccaccctcactggctct

SEQ ID NO: 2371229 - DNA, 21 bp, Homo sapiens
cggaccagcatctggaagatg

SEQ ID NO: 2371230 - DNA, 15 bp, Homo sapiens
cggaccccagccatc

SEQ ID NO: 2371231 - DNA, 18 bp, Homo sapiens
cggaccgcgtagagagcc

SEQ ID NO: 2371232 - DNA, 19 bp, Homo sapiens
cggacgttggttctgcact

SEQ ID NO: 2371233 - DNA, 16 bp, Homo sapiens
cggactggtgccctcc

SEQ ID NO: 2371234 - DNA, 16 bp, Homo sapiens
cggagaagagcgcagt

SEQ ID NO: 2371235 - DNA, 17 bp, Homo sapiens
cggagaagagcgcagtg

SEQ ID NO: 2371236 - DNA, 22 bp, Homo sapiens
cggagcagggagagctcaccat

SEQ ID NO: 2371237 - DNA, 21 bp, Homo sapiens
cggaggctgtgctccgccatg

SEQ ID NO: 2371238 - DNA, 14 bp, Homo sapiens
cggaggggagtaga

SEQ ID NO: 2371239 - DNA, 23 bp, Homo sapiens
cggagtgcggaccaccctcactg

SEQ ID NO: 2371240 - DNA, 17 bp, Homo sapiens
cggatagttgctatttt

SEQ ID NO: 2371241 - DNA, 15 bp, Homo sapiens
cggatcatcaacaag

SEQ ID NO: 2371242 - DNA, 11 bp, Homo sapiens
cggatttctaa

SEQ ID NO: 2371243 - DNA, 10 bp, Homo sapiens
cggcagctgt

SEQ ID NO: 2371244 - DNA, 14 bp, Homo sapiens
cggcagctgtagct

SEQ ID NO: 2371245 - DNA, 23 bp, Homo sapiens
cggcaggctcactgccaggccag

SEQ ID NO: 2371246 - DNA, 18 bp, Homo sapiens
cggcccagatgtgtcccc

SEQ ID NO: 2371247 - DNA, 14 bp, Homo sapiens
cggcccgcctctcc

SEQ ID NO: 2371248 - DNA, 12 bp, Homo sapiens
cggcctgtgggt

SEQ ID NO: 2371249 - DNA, 18 bp, Homo sapiens
cggcctgtgggtctctga

SEQ ID NO: 2371250 - DNA, 16 bp, Homo sapiens
cggcgtggcccaaggc

SEQ ID NO: 2371251 - DNA, 18 bp, Homo sapiens
cggctatgtctcatgttt

SEQ ID NO: 2371252 - DNA, 14 bp, Homo sapiens
cggctcccctctgc

SEQ ID NO: 2371253 - DNA, 15 bp, Homo sapiens
cggctcccctctgct

SEQ ID NO: 2371254 - DNA, 19 bp, Homo sapiens
cggctcccctctgcttctc

SEQ ID NO: 2371255 - DNA, 14 bp, Homo sapiens
cggctcctcagagc

SEQ ID NO: 2371256 - DNA, 16 bp, Homo sapiens
cggctcctcagagcgc

SEQ ID NO: 2371257 - DNA, 22 bp, Homo sapiens
cgggacccagggccctcggtgg

SEQ ID NO: 2371258 - DNA, 22 bp, Homo sapiens
cgggatacaggagagaagctgg

SEQ ID NO: 2371259 - DNA, 13 bp, Homo sapiens
cgggccagggctg

SEQ ID NO: 2371260 - DNA, 12 bp, Homo sapiens
cgggccagggtc

SEQ ID NO: 2371261 - DNA, 14 bp, Homo sapiens
cgggcgcggtggct

SEQ ID NO: 2371262 - DNA, 16 bp, Homo sapiens
cgggcgcggtggctca

SEQ ID NO: 2371263 - DNA, 14 bp, Homo sapiens
cgggctccagccat

SEQ ID NO: 2371264 - DNA, 18 bp, Homo sapiens
cgggctccagccatctca

SEQ ID NO: 2371265 - DNA, 16 bp, Homo sapiens
cgggctgaggccagag

SEQ ID NO: 2371266 - DNA, 14 bp, Homo sapiens
cgggctgagggcct

SEQ ID NO: 2371267 - DNA, 20 bp, Homo sapiens
cgggctttaatagtcacctt

SEQ ID NO: 2371268 - DNA, 16 bp, Homo sapiens
cggggaagctggcttt

SEQ ID NO: 2371269 - DNA, 14 bp, Homo sapiens
cggggaccctgtga

SEQ ID NO: 2371270 - DNA, 21 bp, Homo sapiens
cggggccttatcgggctccag

SEQ ID NO: 2371271 - DNA, 13 bp, Homo sapiens
cgggggagagagt

SEQ ID NO: 2371272 - DNA, 18 bp, Homo sapiens
cggggtaaaaagtggctg

SEQ ID NO: 2371273 - DNA, 19 bp, Homo sapiens
cggggtaaaaagtggctgc

SEQ ID NO: 2371274 - DNA, 16 bp, Homo sapiens
cggggtgggggcagca

SEQ ID NO: 2371275 - DNA, 21 bp, Homo sapiens
cgggtccatagagatgagccc

SEQ ID NO: 2371276 - DNA, 22 bp, Homo sapiens
cgggtccatagagatgagccca

SEQ ID NO: 2371277 - DNA, 14 bp, Homo sapiens
cgggtggggaaagg

SEQ ID NO: 2371278 - DNA, 13 bp, Homo sapiens
cggtaagtgttct

SEQ ID NO: 2371279 - DNA, 18 bp, Homo sapiens
cggtaggcgaccaccgcc

SEQ ID NO: 2371280 - DNA, 11 bp, Homo sapiens
cggtccagctg

SEQ ID NO: 2371281 - DNA, 14 bp, Homo sapiens
cggtccagctggcc

SEQ ID NO: 2371282 - DNA, 16 bp, Homo sapiens
cggtccagctggcctg

SEQ ID NO: 2371283 - DNA, 21 bp, Homo sapiens
cggtcccagttttgttgcccc

SEQ ID NO: 2371284 - DNA, 22 bp, Homo sapiens
cggtcctttaggcagcctgccg

SEQ ID NO: 2371285 - DNA, 19 bp, Homo sapiens
cggtgccatgtctgcagtg

SEQ ID NO: 2371286 - DNA, 20 bp, Homo sapiens
cggtggctcacgcctgtaat

SEQ ID NO: 2371287 - DNA, 13 bp, Homo sapiens
cggtggctgggca

SEQ ID NO: 2371288 - DNA, 16 bp, Homo sapiens
cggtgggactcgtggc

SEQ ID NO: 2371289 - DNA, 20 bp, Homo sapiens
cggttcaaggtcactgtttc

SEQ ID NO: 2371290 - DNA, 14 bp, Homo sapiens
cggttcctggtgac

SEQ ID NO: 2371291 - DNA, 19 bp, Homo sapiens
cggttcctggtgactcctg

SEQ ID NO: 2371292 - DNA, 12 bp, Homo sapiens
cgtaaggatgtg

SEQ ID NO: 2371293 - DNA, 16 bp, Homo sapiens
cgtatctccctggaga

SEQ ID NO: 2371294 - DNA, 18 bp, Homo sapiens
cgtcctccgtccatatca

SEQ ID NO: 2371295 - DNA, 21 bp, Homo sapiens
cgtcggggaggctcctgcctg

SEQ ID NO: 2371296 - DNA, 14 bp, Homo sapiens
ctacagtggtttta

SEQ ID NO: 2371297 - DNA, 16 bp, Homo sapiens
ctacatgcataaacta

SEQ ID NO: 2371298 - DNA, 18 bp, Homo sapiens
ctaccaaacactcagtcc

SEQ ID NO: 2371299 - DNA, 18 bp, Homo sapiens
ctaccagataactgagga

SEQ ID NO: 2371300 - DNA, 14 bp, Homo sapiens
ctaccctgattctt

SEQ ID NO: 2371301 - DNA, 15 bp, Homo sapiens
ctacctcccttgcct

SEQ ID NO: 2371302 - DNA, 14 bp, Homo sapiens
ctacctgagctaaa

SEQ ID NO: 2371303 - DNA, 19 bp, Homo sapiens
ctaccttccactctggaac

SEQ ID NO: 2371304 - DNA, 12 bp, Homo sapiens
ctaccttcctgt

SEQ ID NO: 2371305 - DNA, 14 bp, Homo sapiens
ctaccttcctgtcc

SEQ ID NO: 2371306 - DNA, 16 bp, Homo sapiens
ctaccttcctgtccct

SEQ ID NO: 2371307 - DNA, 13 bp, Homo sapiens
ctacgtccaaggt

SEQ ID NO: 2371308 - DNA, 12 bp, Homo sapiens
ctactaataaac

SEQ ID NO: 2371309 - DNA, 21 bp, Homo sapiens
ctactcacttttcccactcca

SEQ ID NO: 2371310 - DNA, 14 bp, Homo sapiens
ctactccctgcaga

SEQ ID NO: 2371311 - DNA, 17 bp, Homo sapiens
ctactccctgcagatgc

SEQ ID NO: 2371312 - DNA, 18 bp, Homo sapiens
ctactctcttgccagcat

SEQ ID NO: 2371313 - DNA, 17 bp, Homo sapiens
ctactgcactccagcct

SEQ ID NO: 2371314 - DNA, 20 bp, Homo sapiens
ctactggtctctctatgcct

SEQ ID NO: 2371315 - DNA, 15 bp, Homo sapiens
ctacttagggaagaa

SEQ ID NO: 2371316 - DNA, 22 bp, Homo sapiens
ctacttagggaagaaaaagcaa

SEQ ID NO: 2371317 - DNA, 13 bp, Homo sapiens
ctacttgggaggc

SEQ ID NO: 2371318 - DNA, 16 bp, Homo sapiens
ctacttgggaggctga

SEQ ID NO: 2371319 - DNA, 19 bp, Homo sapiens
ctactttaaattgtggatg

SEQ ID NO: 2371320 - DNA, 17 bp, Homo sapiens
ctactttgtggcaatct

SEQ ID NO: 2371321 - DNA, 17 bp, Homo sapiens
ctagaaaaataaaatgt

SEQ ID NO: 2371322 - DNA, 16 bp, Homo sapiens
ctagaacactaactca

SEQ ID NO: 2371323 - DNA, 22 bp, Homo sapiens
ctagaaggcttctctccacagt

SEQ ID NO: 2371324 - DNA, 16 bp, Homo sapiens
ctagacaacctttctg

SEQ ID NO: 2371325 - DNA, 19 bp, Homo sapiens
ctagacaacctttctgtag

SEQ ID NO: 2371326 - DNA, 19 bp, Homo sapiens
ctagactagcaatctcttc

SEQ ID NO: 2371327 - DNA, 20 bp, Homo sapiens
ctagagaaaataaattccaa

SEQ ID NO: 2371328 - DNA, 14 bp, Homo sapiens
ctagatgatttttt

SEQ ID NO: 2371329 - DNA, 20 bp, Homo sapiens
ctagatgattttttgaaagt

SEQ ID NO: 2371330 - DNA, 12 bp, Homo sapiens
ctagatttatta

SEQ ID NO: 2371331 - DNA, 23 bp, Homo sapiens
ctagcacactcttctcttgagca

SEQ ID NO: 2371332 - DNA, 15 bp, Homo sapiens
ctagcacagcagctt

SEQ ID NO: 2371333 - DNA, 15 bp, Homo sapiens
ctagcaggcatgccg

SEQ ID NO: 2371334 - DNA, 15 bp, Homo sapiens
ctagcaggctgttcc

SEQ ID NO: 2371335 - DNA, 16 bp, Homo sapiens
ctagcaggctgttcca

SEQ ID NO: 2371336 - DNA, 19 bp, Homo sapiens
ctagcaggctgttccatgt

SEQ ID NO: 2371337 - DNA, 15 bp, Homo sapiens
ctagcattttcttga

SEQ ID NO: 2371338 - DNA, 20 bp, Homo sapiens
ctagccaaaccaggaccctg

SEQ ID NO: 2371339 - DNA, 12 bp, Homo sapiens
ctagccagacaa

SEQ ID NO: 2371340 - DNA, 19 bp, Homo sapiens
ctagcgatctctcctggcc

SEQ ID NO: 2371341 - DNA, 14 bp, Homo sapiens
ctagctaattattt

SEQ ID NO: 2371342 - DNA, 15 bp, Homo sapiens
ctagctctcccagtg

SEQ ID NO: 2371343 - DNA, 23 bp, Homo sapiens
ctagctctggaggtgctgctcta

SEQ ID NO: 2371344 - DNA, 16 bp, Homo sapiens
ctagctgccactttca

SEQ ID NO: 2371345 - DNA, 14 bp, Homo sapiens
ctagctggctctgt

SEQ ID NO: 2371346 - DNA, 21 bp, Homo sapiens
ctagctgttctaattaagaaa

SEQ ID NO: 2371347 - DNA, 14 bp, Homo sapiens
ctagcttctgcttt

SEQ ID NO: 2371348 - DNA, 18 bp, Homo sapiens
ctagctttagaccctggg

SEQ ID NO: 2371349 - DNA, 19 bp, Homo sapiens
ctagctttagaccctgggt

SEQ ID NO: 2371350 - DNA, 20 bp, Homo sapiens
ctaggagcaaggtgagaaat

SEQ ID NO: 2371351 - DNA, 21 bp, Homo sapiens
ctaggcattctggacctctgg

SEQ ID NO: 2371352 - DNA, 23 bp, Homo sapiens
ctaggcccattgtcctccttttc

SEQ ID NO: 2371353 - DNA, 16 bp, Homo sapiens
ctagggccttggaaat

SEQ ID NO: 2371354 - DNA, 19 bp, Homo sapiens
ctagggttaggaggtcctt

SEQ ID NO: 2371355 - DNA, 14 bp, Homo sapiens
ctaggtaggaagag

SEQ ID NO: 2371356 - DNA, 15 bp, Homo sapiens
ctaggtaggaagagc

SEQ ID NO: 2371357 - DNA, 21 bp, Homo sapiens
ctaggtccccatactcctatg

SEQ ID NO: 2371358 - DNA, 22 bp, Homo sapiens
ctagtaacaatacatgagaaag

SEQ ID NO: 2371359 - DNA, 13 bp, Homo sapiens
ctagtaagaagac

SEQ ID NO: 2371360 - DNA, 22 bp, Homo sapiens
ctagtagttagaaattaaatct

SEQ ID NO: 2371361 - DNA, 14 bp, Homo sapiens
ctagtcaccagaga

SEQ ID NO: 2371362 - DNA, 18 bp, Homo sapiens
ctagtgacttcctggtga

SEQ ID NO: 2371363 - DNA, 18 bp, Homo sapiens
ctagtggtctttgtaaga

SEQ ID NO: 2371364 - DNA, 19 bp, Homo sapiens
ctagtgtccataaataaag

SEQ ID NO: 2371365 - DNA, 12 bp, Homo sapiens
ctataaatgaaa

SEQ ID NO: 2371366 - DNA, 22 bp, Homo sapiens
ctataagcttaaataggaaagt

SEQ ID NO: 2371367 - DNA, 14 bp, Homo sapiens
ctataatctgtttt

SEQ ID NO: 2371368 - DNA, 14 bp, Homo sapiens
ctatacacacacac

SEQ ID NO: 2371369 - DNA, 16 bp, Homo sapiens
ctatagcactgagctc

SEQ ID NO: 2371370 - DNA, 15 bp, Homo sapiens
ctatagcttgcagaa

SEQ ID NO: 2371371 - DNA, 19 bp, Homo sapiens
ctataggcagcttctaaga

SEQ ID NO: 2371372 - DNA, 15 bp, Homo sapiens
ctatatataaaacgg

SEQ ID NO: 2371373 - DNA, 19 bp, Homo sapiens
ctatatataaaacggtgct

SEQ ID NO: 2371374 - DNA, 18 bp, Homo sapiens
ctatatatataaatgtat

SEQ ID NO: 2371375 - DNA, 17 bp, Homo sapiens
ctatattagatcaaata

SEQ ID NO: 2371376 - DNA, 16 bp, Homo sapiens
ctatccatctcctggt

SEQ ID NO: 2371377 - DNA, 19 bp, Homo sapiens
ctatccccatctccctgcc

SEQ ID NO: 2371378 - DNA, 14 bp, Homo sapiens
ctatccgctgccag

SEQ ID NO: 2371379 - DNA, 22 bp, Homo sapiens
ctatccgctgccagccttgagc

SEQ ID NO: 2371380 - DNA, 20 bp, Homo sapiens
ctatccttggagagcagctg

SEQ ID NO: 2371381 - DNA, 18 bp, Homo sapiens
ctatcgccctcctttccc

SEQ ID NO: 2371382 - DNA, 20 bp, Homo sapiens
ctatcgccctcctttccctt

SEQ ID NO: 2371383 - DNA, 21 bp, Homo sapiens
ctatcgccctcctttccctta

SEQ ID NO: 2371384 - DNA, 21 bp, Homo sapiens
ctatctcatctatctcaatcc

SEQ ID NO: 2371385 - DNA, 14 bp, Homo sapiens
ctatctcctgacag

SEQ ID NO: 2371386 - DNA, 17 bp, Homo sapiens
ctatgacaaattcaaga

SEQ ID NO: 2371387 - DNA, 23 bp, Homo sapiens
ctatgatattttctgtgcctgaa

SEQ ID NO: 2371388 - DNA, 19 bp, Homo sapiens
ctatgcaaaaaattcttta

SEQ ID NO: 2371389 - DNA, 12 bp, Homo sapiens
ctatgcacatat

SEQ ID NO: 2371390 - DNA, 18 bp, Homo sapiens
ctatgcttaataaaagaa

SEQ ID NO: 2371391 - DNA, 21 bp, Homo sapiens
ctatgcttaataaaagaacat

SEQ ID NO: 2371392 - DNA, 22 bp, Homo sapiens
ctatgcttaataaaagaacatg

SEQ ID NO: 2371393 - DNA, 19 bp, Homo sapiens
ctatgggaaaaatctaaaa

SEQ ID NO: 2371394 - DNA, 21 bp, Homo sapiens
ctattaatatcaactctgaag

SEQ ID NO: 2371395 - DNA, 13 bp, Homo sapiens
ctattaatcaaga

SEQ ID NO: 2371396 - DNA, 15 bp, Homo sapiens
ctattaatcaagaga

SEQ ID NO: 2371397 - DNA, 18 bp, Homo sapiens
ctattaatcaagagaaac

SEQ ID NO: 2371398 - DNA, 16 bp, Homo sapiens
ctattagagtatttcc

SEQ ID NO: 2371399 - DNA, 19 bp, Homo sapiens
ctattagagtatttccctt

SEQ ID NO: 2371400 - DNA, 22 bp, Homo sapiens
ctattagccaggatcatggtgt

SEQ ID NO: 2371401 - DNA, 18 bp, Homo sapiens
ctattatcccagctgcct

SEQ ID NO: 2371402 - DNA, 19 bp, Homo sapiens
ctattatcccagctgccta

SEQ ID NO: 2371403 - DNA, 15 bp, Homo sapiens
ctattatggaaaact

SEQ ID NO: 2371404 - DNA, 18 bp, Homo sapiens
ctattatggaaaactgtg

SEQ ID NO: 2371405 - DNA, 23 bp, Homo sapiens
ctattcaagaggaaatgtcacag

SEQ ID NO: 2371406 - DNA, 23 bp, Homo sapiens
ctattcagcttcgtttattttca

SEQ ID NO: 2371407 - DNA, 13 bp, Homo sapiens
ctattcatggcta

SEQ ID NO: 2371408 - DNA, 17 bp, Homo sapiens
ctattctagcctgcatt

SEQ ID NO: 2371409 - DNA, 22 bp, Homo sapiens
ctattcttggaccatgccagat

SEQ ID NO: 2371410 - DNA, 19 bp, Homo sapiens
ctattgtgacagagccatg

SEQ ID NO: 2371411 - DNA, 20 bp, Homo sapiens
ctcatgttgagccagtgggc

SEQ ID NO: 2371412 - DNA, 17 bp, Homo sapiens
ctcatgttttatatgat

SEQ ID NO: 2371413 - DNA, 21 bp, Homo sapiens
ctcatgttttatatgattaaa

SEQ ID NO: 2371414 - DNA, 19 bp, Homo sapiens
ctcattacagttctttcct

SEQ ID NO: 2371415 - DNA, 12 bp, Homo sapiens
ctcattatttct

SEQ ID NO: 2371416 - DNA, 12 bp, Homo sapiens
ctcattgacttt

SEQ ID NO: 2371417 - DNA, 21 bp, Homo sapiens
ctcattgacttttataaagca

SEQ ID NO: 2371418 - DNA, 21 bp, Homo sapiens
ctccaaatggagaagctgcag

SEQ ID NO: 2371419 - DNA, 12 bp, Homo sapiens
ctccaaccactg

SEQ ID NO: 2371420 - DNA, 18 bp, Homo sapiens
ctccaaccactgtgccac

SEQ ID NO: 2371421 - DNA, 18 bp, Homo sapiens
ctccaagaaactgaatga

SEQ ID NO: 2371422 - DNA, 13 bp, Homo sapiens
ctccaagcacaga

SEQ ID NO: 2371423 - DNA, 17 bp, Homo sapiens
ctccaagcacagagcct

SEQ ID NO: 2371424 - DNA, 20 bp, Homo sapiens
ctccaagcacagagcctggc

SEQ ID NO: 2371425 - DNA, 22 bp, Homo sapiens
ctccaagcatttcatgaaaaag

SEQ ID NO: 2371426 - DNA, 17 bp, Homo sapiens
ctccaagcccagcccat

SEQ ID NO: 2371427 - DNA, 21 bp, Homo sapiens
ctccaaggaggggctgtaaaa

SEQ ID NO: 2371428 - DNA, 21 bp, Homo sapiens
ctccacagcgagggcagctgc

SEQ ID NO: 2371429 - DNA, 14 bp, Homo sapiens
ctccacagtgttgt

SEQ ID NO: 2371430 - DNA, 18 bp, Homo sapiens
ctccacctacacccctgt

SEQ ID NO: 2371431 - DNA, 19 bp, Homo sapiens
ctccagataactctctttc

SEQ ID NO: 2371432 - DNA, 17 bp, Homo sapiens
ctccagattctgatgca

SEQ ID NO: 2371433 - DNA, 19 bp, Homo sapiens
ctccagattctgatgcata

SEQ ID NO: 2371434 - DNA, 13 bp, Homo sapiens
ctccagccagaga

SEQ ID NO: 2371435 - DNA, 16 bp, Homo sapiens
ctccagccccgcgacc

SEQ ID NO: 2371436 - DNA, 13 bp, Homo sapiens
ctccagcctgggg

SEQ ID NO: 2371437 - DNA, 16 bp, Homo sapiens
ctccagcctgggggac

SEQ ID NO: 2371438 - DNA, 19 bp, Homo sapiens
ctccagcgtcagctgctcc

SEQ ID NO: 2371439 - DNA, 12 bp, Homo sapiens
ctccaggaaaga

SEQ ID NO: 2371440 - DNA, 16 bp, Homo sapiens
ctccaggaaagagcag

SEQ ID NO: 2371441 - DNA, 13 bp, Homo sapiens
ctccaggcctgcc

SEQ ID NO: 2371442 - DNA, 14 bp, Homo sapiens
ctccaggcctgcct

SEQ ID NO: 2371443 - DNA, 13 bp, Homo sapiens
ctccaggctccag

SEQ ID NO: 2371444 - DNA, 16 bp, Homo sapiens
ctccaggctccagcac

SEQ ID NO: 2371445 - DNA, 19 bp, Homo sapiens
ctccaggctccagcacatc

SEQ ID NO: 2371446 - DNA, 22 bp, Homo sapiens
ctccagggaaggtggccacagc

SEQ ID NO: 2371447 - DNA, 14 bp, Homo sapiens
ctccagggacacac

SEQ ID NO: 2371448 - DNA, 19 bp, Homo sapiens
ctccagggacacacagcct

SEQ ID NO: 2371449 - DNA, 23 bp, Homo sapiens
ctccagttttctcctctgcttct

SEQ ID NO: 2371450 - DNA, 19 bp, Homo sapiens
ctccatatttgatttctaa

SEQ ID NO: 2371451 - DNA, 20 bp, Homo sapiens
ctccatatttgatttctaat

SEQ ID NO: 2371452 - DNA, 13 bp, Homo sapiens
ctccatccatcct

SEQ ID NO: 2371453 - DNA, 12 bp, Homo sapiens
ctccatccctct

SEQ ID NO: 2371454 - DNA, 15 bp, Homo sapiens
ctccatctcccaagg

SEQ ID NO: 2371455 - DNA, 16 bp, Homo sapiens
ctccatctcccaaggc

SEQ ID NO: 2371456 - DNA, 21 bp, Homo sapiens
ctccatggccctgtcccaggc

SEQ ID NO: 2371457 - DNA, 13 bp, Homo sapiens
ctccattcatcct

SEQ ID NO: 2371458 - DNA, 14 bp, Homo sapiens
ctccattctgctcc

SEQ ID NO: 2371459 - DNA, 16 bp, Homo sapiens
ctccattttcaagctg

SEQ ID NO: 2371460 - DNA, 14 bp, Homo sapiens
ctcccaaggctgcc

SEQ ID NO: 2371461 - DNA, 15 bp, Homo sapiens
ctcccaaggctgcca

SEQ ID NO: 2371462 - DNA, 21 bp, Homo sapiens
ctcccaaggctgccagacatg

SEQ ID NO: 2371463 - DNA, 18 bp, Homo sapiens
ctcccaaggttggagccc

SEQ ID NO: 2371464 - DNA, 15 bp, Homo sapiens
ctcccacactcccaa

SEQ ID NO: 2371465 - DNA, 22 bp, Homo sapiens
ctcccacatgggcccaggcctc

SEQ ID NO: 2371466 - DNA, 14 bp, Homo sapiens
ctcccaccctcttc

SEQ ID NO: 2371467 - DNA, 20 bp, Homo sapiens
ctcccaccctcttcctactg

SEQ ID NO: 2371468 - DNA, 21 bp, Homo sapiens
ctcccacctcctgacaccctt

SEQ ID NO: 2371469 - DNA, 21 bp, Homo sapiens
ctcccactctcctaggcattc

SEQ ID NO: 2371470 - DNA, 16 bp, Homo sapiens
ctcccagaaacatctc

SEQ ID NO: 2371471 - DNA, 20 bp, Homo sapiens
ctcccagaaacatctctggc

SEQ ID NO: 2371472 - DNA, 21 bp, Homo sapiens
ctcccaggactctgaccccag

SEQ ID NO: 2371473 - DNA, 11 bp, Homo sapiens
ctcccaggcaa

SEQ ID NO: 2371474 - DNA, 13 bp, Homo sapiens
ctcccaggggtct

SEQ ID NO: 2371475 - DNA, 21 bp, Homo sapiens
ctcccaggtaccagctgcgct

SEQ ID NO: 2371476 - DNA, 22 bp, Homo sapiens
ctcccaggtaccagctgcgctt

SEQ ID NO: 2371477 - DNA, 22 bp, Homo sapiens
ctcccatgggggcacttgagtt

SEQ ID NO: 2371478 - DNA, 10 bp, Homo sapiens
ctccccagaa

SEQ ID NO: 2371479 - DNA, 16 bp, Homo sapiens
ctccccaggctggaga

SEQ ID NO: 2371480 - DNA, 17 bp, Homo sapiens
ctccccatttcccatct

SEQ ID NO: 2371481 - DNA, 15 bp, Homo sapiens
ctccccccagactct

SEQ ID NO: 2371482 - DNA, 15 bp, Homo sapiens
ctccccctccccagg

SEQ ID NO: 2371483 - DNA, 11 bp, Homo sapiens
ctccccctgcc

SEQ ID NO: 2371484 - DNA, 13 bp, Homo sapiens
ctcccctctcaga

SEQ ID NO: 2371485 - DNA, 19 bp, Homo sapiens
ctcccctctgcttctcatc

SEQ ID NO: 2371486 - DNA, 20 bp, Homo sapiens
ctcccgtacaaacttggaca

SEQ ID NO: 2371487 - DNA, 20 bp, Homo sapiens
ctccctaaactttggccttt

SEQ ID NO: 2371488 - DNA, 15 bp, Homo sapiens
ctccctccacctcaa

SEQ ID NO: 2371489 - DNA, 17 bp, Homo sapiens
ctccctcccctctcaga

SEQ ID NO: 2371490 - DNA, 18 bp, Homo sapiens
ctccctcccctctcagaa

SEQ ID NO: 2371491 - DNA, 14 bp, Homo sapiens
ctccctcctgcaca

SEQ ID NO: 2371492 - DNA, 19 bp, Homo sapiens
ctccctcctggagcatccc

SEQ ID NO: 2371493 - DNA, 22 bp, Homo sapiens
ctccctcctggagcatcccagg

SEQ ID NO: 2371494 - DNA, 17 bp, Homo sapiens
ctccctctctcatgaga

SEQ ID NO: 2371495 - DNA, 14 bp, Homo sapiens
ctccctgcctgagg

SEQ ID NO: 2371496 - DNA, 13 bp, Homo sapiens
ctccctgcctggc

SEQ ID NO: 2371497 - DNA, 16 bp, Homo sapiens
ctccctgcctggcccc

SEQ ID NO: 2371498 - DNA, 20 bp, Homo sapiens
ctccctggagaagcaccagc

SEQ ID NO: 2371499 - DNA, 22 bp, Homo sapiens
ctccctgggacacagacccagg

SEQ ID NO: 2371500 - DNA, 19 bp, Homo sapiens
ctccctgttatctgctaga

SEQ ID NO: 2371501 - DNA, 19 bp, Homo sapiens
ctcccttccttttccctgc

SEQ ID NO: 2371502 - DNA, 12 bp, Homo sapiens
ctcccttgctgg

SEQ ID NO: 2371503 - DNA, 17 bp, Homo sapiens
ctcccttgctggcccca

SEQ ID NO: 2371504 - DNA, 22 bp, Homo sapiens
ctcccttgctggccccagccct

SEQ ID NO: 2371505 - DNA, 23 bp, Homo sapiens
ctcccttgctggccccagccctg

SEQ ID NO: 2371506 - DNA, 17 bp, Homo sapiens
ctcccttgggctctgat

SEQ ID NO: 2371507 - DNA, 20 bp, Homo sapiens
ctcccttgggctctgatgaa

SEQ ID NO: 2371508 - DNA, 21 bp, Homo sapiens
ctcccttgggctctgatgaaa

SEQ ID NO: 2371509 - DNA, 14 bp, Homo sapiens
ctccctttctcagg

SEQ ID NO: 2371510 - DNA, 17 bp, Homo sapiens
ctccctttctcaggagc

SEQ ID NO: 2371511 - DNA, 14 bp, Homo sapiens
ctccgagagggaga

SEQ ID NO: 2371512 - DNA, 14 bp, Homo sapiens
ctccgcagtgtctc

SEQ ID NO: 2371513 - DNA, 20 bp, Homo sapiens
ctccgcagtgtctccaccta

SEQ ID NO: 2371514 - DNA, 20 bp, Homo sapiens
ctccgcatcacctcaccaag

SEQ ID NO: 2371515 - DNA, 21 bp, Homo sapiens
ctccgcatcacctcaccaagg

SEQ ID NO: 2371516 - DNA, 18 bp, Homo sapiens
ctccgccaatttctctca

SEQ ID NO: 2371517 - DNA, 12 bp, Homo sapiens
ctccgccagcct

SEQ ID NO: 2371518 - DNA, 20 bp, Homo sapiens
ctccgccagcctcctctgga

SEQ ID NO: 2371519 - DNA, 21 bp, Homo sapiens
ctccgccagcctcctctggac

SEQ ID NO: 2371520 - DNA, 14 bp, Homo sapiens
ctccgccattccaa

SEQ ID NO: 2371521 - DNA, 16 bp, Homo sapiens
ctccgcctggcctggc

SEQ ID NO: 2371522 - DNA, 19 bp, Homo sapiens
ctccgcgccgatgccaccg

SEQ ID NO: 2371523 - DNA, 14 bp, Homo sapiens
ctccggactggtgc

SEQ ID NO: 2371524 - DNA, 19 bp, Homo sapiens
ctccggggccatttgcaat

SEQ ID NO: 2371525 - DNA, 20 bp, Homo sapiens
ctcctacttagggaagaaaa

SEQ ID NO: 2371526 - DNA, 14 bp, Homo sapiens
ctctgcacatgtct

SEQ ID NO: 2371527 - DNA, 15 bp, Homo sapiens
ctctgcacatgtctt

SEQ ID NO: 2371528 - DNA, 20 bp, Homo sapiens
ctctgcagtcctactcaagc

SEQ ID NO: 2371529 - DNA, 17 bp, Homo sapiens
ctctgcatttaaaaaaa

SEQ ID NO: 2371530 - DNA, 16 bp, Homo sapiens
ctctgccccaccttgc

SEQ ID NO: 2371531 - DNA, 22 bp, Homo sapiens
ctctgccccaccttgccagggc

SEQ ID NO: 2371532 - DNA, 11 bp, Homo sapiens
ctctgcccctg

SEQ ID NO: 2371533 - DNA, 16 bp, Homo sapiens
ctctgcccctggacct

SEQ ID NO: 2371534 - DNA, 12 bp, Homo sapiens
ctctgcctcaga

SEQ ID NO: 2371535 - DNA, 16 bp, Homo sapiens
ctctgcctctcccagg

SEQ ID NO: 2371536 - DNA, 12 bp, Homo sapiens
ctctgcctgccc

SEQ ID NO: 2371537 - DNA, 13 bp, Homo sapiens
ctctgcctgcccc

SEQ ID NO: 2371538 - DNA, 15 bp, Homo sapiens
ctctgcctgccccgc

SEQ ID NO: 2371539 - DNA, 21 bp, Homo sapiens
ctctgctcaccgcccatcagg

SEQ ID NO: 2371540 - DNA, 13 bp, Homo sapiens
ctctgctgacctg

SEQ ID NO: 2371541 - DNA, 17 bp, Homo sapiens
ctctgctgacctgctga

SEQ ID NO: 2371542 - DNA, 22 bp, Homo sapiens
ctctgctggggaagggttttct

SEQ ID NO: 2371543 - DNA, 22 bp, Homo sapiens
ctctgcttactaatgtgcccca

SEQ ID NO: 2371544 - DNA, 16 bp, Homo sapiens
ctctgcttctcatccc

SEQ ID NO: 2371545 - DNA, 22 bp, Homo sapiens
ctctggaaagaggctctggaca

SEQ ID NO: 2371546 - DNA, 23 bp, Homo sapiens
ctctggacatgatttagggaagc

SEQ ID NO: 2371547 - DNA, 15 bp, Homo sapiens
ctctggacggcaggc

SEQ ID NO: 2371548 - DNA, 16 bp, Homo sapiens
ctctggacggcaggct

SEQ ID NO: 2371549 - DNA, 23 bp, Homo sapiens
ctctggacggcaggctcactgcc

SEQ ID NO: 2371550 - DNA, 13 bp, Homo sapiens
ctctggagcccta

SEQ ID NO: 2371551 - DNA, 19 bp, Homo sapiens
ctctggcccagaaagcctc

SEQ ID NO: 2371552 - DNA, 15 bp, Homo sapiens
ctctggctttcccag

SEQ ID NO: 2371553 - DNA, 22 bp, Homo sapiens
ctctggctttcccaggagatgg

SEQ ID NO: 2371554 - DNA, 16 bp, Homo sapiens
ctctgggatcctgggg

SEQ ID NO: 2371555 - DNA, 17 bp, Homo sapiens
ctctgggcacgcctgct

SEQ ID NO: 2371556 - DNA, 17 bp, Homo sapiens
ctctgggctgccatgtg

SEQ ID NO: 2371557 - DNA, 19 bp, Homo sapiens
ctctggtagcatgatggct

SEQ ID NO: 2371558 - DNA, 23 bp, Homo sapiens
ctctggtggcttaagtgagcaga

SEQ ID NO: 2371559 - DNA, 13 bp, Homo sapiens
ctctgtctaggac

SEQ ID NO: 2371560 - DNA, 17 bp, Homo sapiens
ctctgtgagccccacag

SEQ ID NO: 2371561 - DNA, 22 bp, Homo sapiens
ctctgtgagccccacagccctg

SEQ ID NO: 2371562 - DNA, 20 bp, Homo sapiens
ctctgtgcagtcactggagg

SEQ ID NO: 2371563 - DNA, 13 bp, Homo sapiens
ctctgtgtgctcc

SEQ ID NO: 2371564 - DNA, 11 bp, Homo sapiens
ctctgttaaca

SEQ ID NO: 2371565 - DNA, 15 bp, Homo sapiens
ctctgttaacatcta

SEQ ID NO: 2371566 - DNA, 19 bp, Homo sapiens
ctctgttgtttggttcagg

SEQ ID NO: 2371567 - DNA, 21 bp, Homo sapiens
ctctgttgtttggttcaggga

SEQ ID NO: 2371568 - DNA, 16 bp, Homo sapiens
ctcttagtcccaagct

SEQ ID NO: 2371569 - DNA, 18 bp, Homo sapiens
ctcttagtctaggtcctt

SEQ ID NO: 2371570 - DNA, 17 bp, Homo sapiens
ctcttatcctctctctc

SEQ ID NO: 2371571 - DNA, 16 bp, Homo sapiens
ctcttcactaccctga

SEQ ID NO: 2371572 - DNA, 21 bp, Homo sapiens
ctcttcactaccctgattctt

SEQ ID NO: 2371573 - DNA, 14 bp, Homo sapiens
ctcttcatctgcct

SEQ ID NO: 2371574 - DNA, 23 bp, Homo sapiens
ctcttcatggcatcttcaatatg

SEQ ID NO: 2371575 - DNA, 19 bp, Homo sapiens
ctcttccagtcttcctgac

SEQ ID NO: 2371576 - DNA, 23 bp, Homo sapiens
ctcttccagtcttcctgacactt

SEQ ID NO: 2371577 - DNA, 22 bp, Homo sapiens
ctcttccagtgaacattcccag

SEQ ID NO: 2371578 - DNA, 17 bp, Homo sapiens
ctcttcctaatcgctaa

SEQ ID NO: 2371579 - DNA, 16 bp, Homo sapiens
ctcttcctactggtct

SEQ ID NO: 2371580 - DNA, 18 bp, Homo sapiens
ctcttcctactggtctct

SEQ ID NO: 2371581 - DNA, 14 bp, Homo sapiens
ctcttctactcact

SEQ ID NO: 2371582 - DNA, 22 bp, Homo sapiens
ctcttctaggcccattgtcctc

SEQ ID NO: 2371583 - DNA, 12 bp, Homo sapiens
ctcttctgagct

SEQ ID NO: 2371584 - DNA, 15 bp, Homo sapiens
ctcttctgagctatt

SEQ ID NO: 2371585 - DNA, 18 bp, Homo sapiens
ctcttctgagctatttca

SEQ ID NO: 2371586 - DNA, 23 bp, Homo sapiens
ctcttctgagctatttcatctat

SEQ ID NO: 2371587 - DNA, 15 bp, Homo sapiens
ctcttcttgaaattt

SEQ ID NO: 2371588 - DNA, 17 bp, Homo sapiens
ctcttctttaagccata

SEQ ID NO: 2371589 - DNA, 16 bp, Homo sapiens
ctcttgagctggcctc

SEQ ID NO: 2371590 - DNA, 22 bp, Homo sapiens
ctcttgagctggcctctctagc

SEQ ID NO: 2371591 - DNA, 21 bp, Homo sapiens
ctcttgcacagtcactgctct

SEQ ID NO: 2371592 - DNA, 21 bp, Homo sapiens
ctcttgccatttgtagctttg

SEQ ID NO: 2371593 - DNA, 14 bp, Homo sapiens
ctcttgcccatcct

SEQ ID NO: 2371594 - DNA, 16 bp, Homo sapiens
ctcttgcccatcctga

SEQ ID NO: 2371595 - DNA, 15 bp, Homo sapiens
ctcttgtaaagactg

SEQ ID NO: 2371596 - DNA, 12 bp, Homo sapiens
ctcttgtgattt

SEQ ID NO: 2371597 - DNA, 14 bp, Homo sapiens
ctcttgtgatttct

SEQ ID NO: 2371598 - DNA, 19 bp, Homo sapiens
ctcttgtgcaaggtggcct

SEQ ID NO: 2371599 - DNA, 17 bp, Homo sapiens
ctctttaaaaactcact

SEQ ID NO: 2371600 - DNA, 17 bp, Homo sapiens
ctctttatgatctggcc

SEQ ID NO: 2371601 - DNA, 16 bp, Homo sapiens
ctctttccaaattaaa

SEQ ID NO: 2371602 - DNA, 19 bp, Homo sapiens
ctctttcctatttcagtgt

SEQ ID NO: 2371603 - DNA, 20 bp, Homo sapiens
ctctttcctatttcagtgtt

SEQ ID NO: 2371604 - DNA, 13 bp, Homo sapiens
ctctttcctccac

SEQ ID NO: 2371605 - DNA, 15 bp, Homo sapiens
ctctttccttgagct

SEQ ID NO: 2371606 - DNA, 13 bp, Homo sapiens
ctctttctgctct

SEQ ID NO: 2371607 - DNA, 14 bp, Homo sapiens
ctctttctgctctg

SEQ ID NO: 2371608 - DNA, 15 bp, Homo sapiens
ctctttctgctctgc

SEQ ID NO: 2371609 - DNA, 17 bp, Homo sapiens
ctctttgctgcagagaa

SEQ ID NO: 2371610 - DNA, 18 bp, Homo sapiens
ctcttttcccctttcctg

SEQ ID NO: 2371611 - DNA, 19 bp, Homo sapiens
ctcttttcccctttcctgt

SEQ ID NO: 2371612 - DNA, 14 bp, Homo sapiens
ctcttttgctgtgc

SEQ ID NO: 2371613 - DNA, 13 bp, Homo sapiens
ctctttttcctcc

SEQ ID NO: 2371614 - DNA, 13 bp, Homo sapiens
ctctttttttgag

SEQ ID NO: 2371615 - DNA, 16 bp, Homo sapiens
ctgaaaagaaggaaag

SEQ ID NO: 2371616 - DNA, 20 bp, Homo sapiens
ctgaaacgctcctttgtgtg

SEQ ID NO: 2371617 - DNA, 14 bp, Homo sapiens
ctgaaagaggccaa

SEQ ID NO: 2371618 - DNA, 22 bp, Homo sapiens
ctgaaagttttgtaaaagaaat

SEQ ID NO: 2371619 - DNA, 23 bp, Homo sapiens
ctgaaagttttgtaaaagaaatc

SEQ ID NO: 2371620 - DNA, 13 bp, Homo sapiens
ctgaaattttata

SEQ ID NO: 2371621 - DNA, 13 bp, Homo sapiens
ctgaacacagtgt

SEQ ID NO: 2371622 - DNA, 11 bp, Homo sapiens
ctgaaccactg

SEQ ID NO: 2371623 - DNA, 14 bp, Homo sapiens
ctgaaccactgctt

SEQ ID NO: 2371624 - DNA, 20 bp, Homo sapiens
ctgaaccactgcttctcttt

SEQ ID NO: 2371625 - DNA, 22 bp, Homo sapiens
ctgaaccactgcttctcttttg

SEQ ID NO: 2371626 - DNA, 17 bp, Homo sapiens
ctgaaccgcacagctca

SEQ ID NO: 2371627 - DNA, 16 bp, Homo sapiens
ctgaacgttttcttct

SEQ ID NO: 2371628 - DNA, 18 bp, Homo sapiens
ctgaactcaaactgagga

SEQ ID NO: 2371629 - DNA, 13 bp, Homo sapiens
ctgaagaattgaa

SEQ ID NO: 2371630 - DNA, 14 bp, Homo sapiens
ctgaaggaaaaaca

SEQ ID NO: 2371631 - DNA, 18 bp, Homo sapiens
ctgaaggaaaaacacaag

SEQ ID NO: 2371632 - DNA, 22 bp, Homo sapiens
ctgaaggaaaaacacaagcaaa

SEQ ID NO: 2371633 - DNA, 12 bp, Homo sapiens
ctgaaggagagg

SEQ ID NO: 2371634 - DNA, 18 bp, Homo sapiens
ctgaaggggtgcacccac

SEQ ID NO: 2371635 - DNA, 21 bp, Homo sapiens
ctgaagggttgactttaccca

SEQ ID NO: 2371636 - DNA, 20 bp, Homo sapiens
ctgaagtggctggtagaaaa

SEQ ID NO: 2371637 - DNA, 17 bp, Homo sapiens
ctgaagtttttttgctg

SEQ ID NO: 2371638 - DNA, 17 bp, Homo sapiens
ctgaataatgctaccag

SEQ ID NO: 2371639 - DNA, 19 bp, Homo sapiens
ctgaataatgctaccagga

SEQ ID NO: 2371640 - DNA, 13 bp, Homo sapiens
ctgaatcatgagc

SEQ ID NO: 2371641 - DNA, 21 bp, Homo sapiens
ctgcagcccaccagacgtcag

SEQ ID NO: 2371642 - DNA, 15 bp, Homo sapiens
ctgcagcctcatact

SEQ ID NO: 2371643 - DNA, 20 bp, Homo sapiens
ctgcagcctcatactcctgg

SEQ ID NO: 2371644 - DNA, 17 bp, Homo sapiens
ctgcaggagagagcagc

SEQ ID NO: 2371645 - DNA, 15 bp, Homo sapiens
ctgcaggatggactg

SEQ ID NO: 2371646 - DNA, 14 bp, Homo sapiens
ctgcaggcagagct

SEQ ID NO: 2371647 - DNA, 22 bp, Homo sapiens
ctgcaggcaggaacaaacaggg

SEQ ID NO: 2371648 - DNA, 15 bp, Homo sapiens
ctgcaggctttgcca

SEQ ID NO: 2371649 - DNA, 20 bp, Homo sapiens
ctgcagggagcaactctcca

SEQ ID NO: 2371650 - DNA, 18 bp, Homo sapiens
ctgcagtcctactcaagc

SEQ ID NO: 2371651 - DNA, 22 bp, Homo sapiens
ctgcagtcctactcaagcgggt

SEQ ID NO: 2371652 - DNA, 14 bp, Homo sapiens
ctgcagtgtgcccc

SEQ ID NO: 2371653 - DNA, 14 bp, Homo sapiens
ctgcatacttttta

SEQ ID NO: 2371654 - DNA, 18 bp, Homo sapiens
ctgcatcttggttatttc

SEQ ID NO: 2371655 - DNA, 23 bp, Homo sapiens
ctgcattgagcttgcatgcttgc

SEQ ID NO: 2371656 - DNA, 12 bp, Homo sapiens
ctgccactctgc

SEQ ID NO: 2371657 - DNA, 16 bp, Homo sapiens
ctgccagacatggacc

SEQ ID NO: 2371658 - DNA, 15 bp, Homo sapiens
ctgccagacttaaaa

SEQ ID NO: 2371659 - DNA, 13 bp, Homo sapiens
ctgccagccttga

SEQ ID NO: 2371660 - DNA, 15 bp, Homo sapiens
ctgccagccttgagc

SEQ ID NO: 2371661 - DNA, 21 bp, Homo sapiens
ctgccagccttgagccctggc

SEQ ID NO: 2371662 - DNA, 16 bp, Homo sapiens
ctgccaggcacacaca

SEQ ID NO: 2371663 - DNA, 12 bp, Homo sapiens
ctgccaggcagg

SEQ ID NO: 2371664 - DNA, 15 bp, Homo sapiens
ctgccaggcaggggt

SEQ ID NO: 2371665 - DNA, 18 bp, Homo sapiens
ctgccaggccagcctccg

SEQ ID NO: 2371666 - DNA, 20 bp, Homo sapiens
ctgccaggccagcctccgag

SEQ ID NO: 2371667 - DNA, 22 bp, Homo sapiens
ctgccaggccagcctccgagag

SEQ ID NO: 2371668 - DNA, 17 bp, Homo sapiens
ctgccatcaccgctggg

SEQ ID NO: 2371669 - DNA, 17 bp, Homo sapiens
ctgccatctagccagcc

SEQ ID NO: 2371670 - DNA, 20 bp, Homo sapiens
ctgccatctagccagcccct

SEQ ID NO: 2371671 - DNA, 17 bp, Homo sapiens
ctgccatgacagaggct

SEQ ID NO: 2371672 - DNA, 23 bp, Homo sapiens
ctgccatgacagaggctgcaccc

SEQ ID NO: 2371673 - DNA, 22 bp, Homo sapiens
ctgccatgttgcccctttctct

SEQ ID NO: 2371674 - DNA, 22 bp, Homo sapiens
ctgccattacagaggtattaaa

SEQ ID NO: 2371675 - DNA, 19 bp, Homo sapiens
ctgccattttttgtctgtg

SEQ ID NO: 2371676 - DNA, 19 bp, Homo sapiens
ctgcccacatgggacctgg

SEQ ID NO: 2371677 - DNA, 12 bp, Homo sapiens
ctgcccacctgc

SEQ ID NO: 2371678 - DNA, 18 bp, Homo sapiens
ctgcccacgcagaggacg

SEQ ID NO: 2371679 - DNA, 20 bp, Homo sapiens
ctgcccacgcagaggacgca

SEQ ID NO: 2371680 - DNA, 13 bp, Homo sapiens
ctgcccactgttt

SEQ ID NO: 2371681 - DNA, 11 bp, Homo sapiens
ctgccccaccc

SEQ ID NO: 2371682 - DNA, 12 bp, Homo sapiens
ctgccccaccct

SEQ ID NO: 2371683 - DNA, 15 bp, Homo sapiens
ctgccccagcccaga

SEQ ID NO: 2371684 - DNA, 16 bp, Homo sapiens
ctgccccagcccagat

SEQ ID NO: 2371685 - DNA, 18 bp, Homo sapiens
ctgccccgcccccagtcc

SEQ ID NO: 2371686 - DNA, 13 bp, Homo sapiens
ctgcccctctcac

SEQ ID NO: 2371687 - DNA, 20 bp, Homo sapiens
ctgccctatgggcctgccgg

SEQ ID NO: 2371688 - DNA, 21 bp, Homo sapiens
ctgccctatgggcctgccggg

SEQ ID NO: 2371689 - DNA, 13 bp, Homo sapiens
ctgccctcactcc

SEQ ID NO: 2371690 - DNA, 19 bp, Homo sapiens
ctgccctcactccctctgc

SEQ ID NO: 2371691 - DNA, 22 bp, Homo sapiens
ctgccctcccctccggactggt

SEQ ID NO: 2371692 - DNA, 17 bp, Homo sapiens
ctgccctggctgctgcc

SEQ ID NO: 2371693 - DNA, 13 bp, Homo sapiens
ctgccctgtctgg

SEQ ID NO: 2371694 - DNA, 11 bp, Homo sapiens
ctgcccttccc

SEQ ID NO: 2371695 - DNA, 13 bp, Homo sapiens
ctgcccttccctc

SEQ ID NO: 2371696 - DNA, 14 bp, Homo sapiens
ctgcccttccctct

SEQ ID NO: 2371697 - DNA, 15 bp, Homo sapiens
ctgccgggctgaggg

SEQ ID NO: 2371698 - DNA, 22 bp, Homo sapiens
ctgccgggctgagggcctgctg

SEQ ID NO: 2371699 - DNA, 23 bp, Homo sapiens
ctgccgggctgagggcctgctgg

SEQ ID NO: 2371700 - DNA, 13 bp, Homo sapiens
ctgcctacagcca

SEQ ID NO: 2371701 - DNA, 23 bp, Homo sapiens
ctgcctagattcagggaaagtgg

SEQ ID NO: 2371702 - DNA, 18 bp, Homo sapiens
ctgcctcagacgttgcct

SEQ ID NO: 2371703 - DNA, 19 bp, Homo sapiens
ctgcctcagacgttgcctg

SEQ ID NO: 2371704 - DNA, 15 bp, Homo sapiens
ctgcctcagccttcc

SEQ ID NO: 2371705 - DNA, 16 bp, Homo sapiens
ctgcctcagccttcca

SEQ ID NO: 2371706 - DNA, 14 bp, Homo sapiens
ctgcctcccacttc

SEQ ID NO: 2371707 - DNA, 23 bp, Homo sapiens
ctgcctcgctcaccgctggccct

SEQ ID NO: 2371708 - DNA, 19 bp, Homo sapiens
ctgcctctttccctaggaa

SEQ ID NO: 2371709 - DNA, 11 bp, Homo sapiens
ctgcctgaggg

SEQ ID NO: 2371710 - DNA, 15 bp, Homo sapiens
ctgcctgagggcagt

SEQ ID NO: 2371711 - DNA, 22 bp, Homo sapiens
ctgcctggagacaaggtgctaa

SEQ ID NO: 2371712 - DNA, 11 bp, Homo sapiens
ctgcctgtctg

SEQ ID NO: 2371713 - DNA, 18 bp, Homo sapiens
ctgcctgtctgccccagc

SEQ ID NO: 2371714 - DNA, 13 bp, Homo sapiens
ctgcctgtgcatg

SEQ ID NO: 2371715 - DNA, 15 bp, Homo sapiens
ctgcctgtgggcttc

SEQ ID NO: 2371716 - DNA, 17 bp, Homo sapiens
ctgccttaaacacacat

SEQ ID NO: 2371717 - DNA, 11 bp, Homo sapiens
ctgccttccct

SEQ ID NO: 2371718 - DNA, 16 bp, Homo sapiens
ctgccttggcctccca

SEQ ID NO: 2371719 - DNA, 19 bp, Homo sapiens
ctgcctttatgatgctaag

SEQ ID NO: 2371720 - DNA, 22 bp, Homo sapiens
ctgcgaccttgcaacctcacct

SEQ ID NO: 2371721 - DNA, 16 bp, Homo sapiens
ctgcgccagtcctgct

SEQ ID NO: 2371722 - DNA, 20 bp, Homo sapiens
ctgcgccagtcctgctacct

SEQ ID NO: 2371723 - DNA, 13 bp, Homo sapiens
ctgcgcctgcagg

SEQ ID NO: 2371724 - DNA, 17 bp, Homo sapiens
ctgcgctctctttgcaa

SEQ ID NO: 2371725 - DNA, 15 bp, Homo sapiens
ctgcggatctcagct

SEQ ID NO: 2371726 - DNA, 16 bp, Homo sapiens
ctgcgggccagggtcc

SEQ ID NO: 2371727 - DNA, 19 bp, Homo sapiens
ctgcgggccagggtcctgt

SEQ ID NO: 2371728 - DNA, 13 bp, Homo sapiens
ctgcgtcctcctc

SEQ ID NO: 2371729 - DNA, 17 bp, Homo sapiens
ctgcgtcctcctcacct

SEQ ID NO: 2371730 - DNA, 17 bp, Homo sapiens
ctgctagctttctcctt

SEQ ID NO: 2371731 - DNA, 18 bp, Homo sapiens
ctgctatatataaaacgg

SEQ ID NO: 2371732 - DNA, 20 bp, Homo sapiens
ctgctatccccatctccctg

SEQ ID NO: 2371733 - DNA, 21 bp, Homo sapiens
ctgctatttattttcctaaag

SEQ ID NO: 2371734 - DNA, 16 bp, Homo sapiens
ctgctcacccacctct

SEQ ID NO: 2371735 - DNA, 18 bp, Homo sapiens
ctgctcacccacctcttg

SEQ ID NO: 2371736 - DNA, 19 bp, Homo sapiens
ctgctcaccgcccatcagg

SEQ ID NO: 2371737 - DNA, 17 bp, Homo sapiens
ctgctcagaacttgctg

SEQ ID NO: 2371738 - DNA, 18 bp, Homo sapiens
ctgctcagaacttgctgc

SEQ ID NO: 2371739 - DNA, 22 bp, Homo sapiens
ctgctcagcaattcagacccct

SEQ ID NO: 2371740 - DNA, 19 bp, Homo sapiens
ctgctcatattgtgattct

SEQ ID NO: 2371741 - DNA, 15 bp, Homo sapiens
ctgctccctggcatt

SEQ ID NO: 2371742 - DNA, 12 bp, Homo sapiens
ctgctccttgct

SEQ ID NO: 2371743 - DNA, 11 bp, Homo sapiens
ctgctctcctc

SEQ ID NO: 2371744 - DNA, 13 bp, Homo sapiens
ctgctctgagcca

SEQ ID NO: 2371745 - DNA, 16 bp, Homo sapiens
ctgctctgagccacag

SEQ ID NO: 2371746 - DNA, 11 bp, Homo sapiens
ctgctctgcca

SEQ ID NO: 2371747 - DNA, 11 bp, Homo sapiens
ctgctctgcta

SEQ ID NO: 2371748 - DNA, 21 bp, Homo sapiens
ctgctctgtgagccccacagc

SEQ ID NO: 2371749 - DNA, 18 bp, Homo sapiens
ctgctgaacacagtgtct

SEQ ID NO: 2371750 - DNA, 19 bp, Homo sapiens
ctgctgaacacagtgtctg

SEQ ID NO: 2371751 - DNA, 20 bp, Homo sapiens
ctgctgaacacagtgtctgt

SEQ ID NO: 2371752 - DNA, 21 bp, Homo sapiens
ctgctgacctgctgacctgtg

SEQ ID NO: 2371753 - DNA, 15 bp, Homo sapiens
ctgctgacctgtgca

SEQ ID NO: 2371754 - DNA, 14 bp, Homo sapiens
ctgctgaggcccag

SEQ ID NO: 2371755 - DNA, 15 bp, Homo sapiens
ctgctgaggcccagt

SEQ ID NO: 2371756 - DNA, 14 bp, Homo sapiens
ctggctgctgcccc

SEQ ID NO: 2371757 - DNA, 15 bp, Homo sapiens
ctggctgctgccccc

SEQ ID NO: 2371758 - DNA, 16 bp, Homo sapiens
ctggctttaagccttc

SEQ ID NO: 2371759 - DNA, 15 bp, Homo sapiens
ctggctttcccagga

SEQ ID NO: 2371760 - DNA, 19 bp, Homo sapiens
ctggctttgaaacctcagg

SEQ ID NO: 2371761 - DNA, 14 bp, Homo sapiens
ctgggaaaccctct

SEQ ID NO: 2371762 - DNA, 19 bp, Homo sapiens
ctgggaaaccctctccatc

SEQ ID NO: 2371763 - DNA, 17 bp, Homo sapiens
ctgggaacccctttccc

SEQ ID NO: 2371764 - DNA, 19 bp, Homo sapiens
ctgggaacttgcgagtcca

SEQ ID NO: 2371765 - DNA, 19 bp, Homo sapiens
ctgggacctgccaggcagg

SEQ ID NO: 2371766 - DNA, 20 bp, Homo sapiens
ctgggacctgccaggcaggg

SEQ ID NO: 2371767 - DNA, 19 bp, Homo sapiens
ctgggacttccatgcctta

SEQ ID NO: 2371768 - DNA, 16 bp, Homo sapiens
ctgggaggcagggctc

SEQ ID NO: 2371769 - DNA, 16 bp, Homo sapiens
ctgggaggctcccctt

SEQ ID NO: 2371770 - DNA, 18 bp, Homo sapiens
ctgggatgtcacagtcca

SEQ ID NO: 2371771 - DNA, 21 bp, Homo sapiens
ctgggcaatgaggcagatagc

SEQ ID NO: 2371772 - DNA, 15 bp, Homo sapiens
ctgggcacctgactt

SEQ ID NO: 2371773 - DNA, 23 bp, Homo sapiens
ctgggcagggcagggcagcctgt

SEQ ID NO: 2371774 - DNA, 20 bp, Homo sapiens
ctgggcattttcctcctctg

SEQ ID NO: 2371775 - DNA, 19 bp, Homo sapiens
ctgggccccacatggctta

SEQ ID NO: 2371776 - DNA, 20 bp, Homo sapiens
ctgggccgggacccagggcc

SEQ ID NO: 2371777 - DNA, 18 bp, Homo sapiens
ctgggctgggtgctggga

SEQ ID NO: 2371778 - DNA, 15 bp, Homo sapiens
ctgggctgtgggcaa

SEQ ID NO: 2371779 - DNA, 13 bp, Homo sapiens
ctgggcttggcct

SEQ ID NO: 2371780 - DNA, 16 bp, Homo sapiens
ctgggcttggcctgct

SEQ ID NO: 2371781 - DNA, 20 bp, Homo sapiens
ctgggcttggcctgctgtga

SEQ ID NO: 2371782 - DNA, 19 bp, Homo sapiens
ctggggaaactggccatgg

SEQ ID NO: 2371783 - DNA, 22 bp, Homo sapiens
ctggggaaactggccatggcct

SEQ ID NO: 2371784 - DNA, 14 bp, Homo sapiens
ctggggacctggca

SEQ ID NO: 2371785 - DNA, 13 bp, Homo sapiens
ctggggacttgtg

SEQ ID NO: 2371786 - DNA, 18 bp, Homo sapiens
ctggggacttgtgtctgc

SEQ ID NO: 2371787 - DNA, 20 bp, Homo sapiens
ctggggatccccgcctggcc

SEQ ID NO: 2371788 - DNA, 22 bp, Homo sapiens
ctggggatccccgcctggccag

SEQ ID NO: 2371789 - DNA, 23 bp, Homo sapiens
ctggggatccccgcctggccagg

SEQ ID NO: 2371790 - DNA, 19 bp, Homo sapiens
ctggggcaggctgggccat

SEQ ID NO: 2371791 - DNA, 18 bp, Homo sapiens
ctggggcatcctgtgcca

SEQ ID NO: 2371792 - DNA, 12 bp, Homo sapiens
ctggggccagag

SEQ ID NO: 2371793 - DNA, 15 bp, Homo sapiens
ctggggccagaggct

SEQ ID NO: 2371794 - DNA, 17 bp, Homo sapiens
ctggggccagaggctgg

SEQ ID NO: 2371795 - DNA, 19 bp, Homo sapiens
ctggggccagaggctggga

SEQ ID NO: 2371796 - DNA, 23 bp, Homo sapiens
ctggggcctagcgatctctcctg

SEQ ID NO: 2371797 - DNA, 12 bp, Homo sapiens
ctgggggacctt

SEQ ID NO: 2371798 - DNA, 16 bp, Homo sapiens
ctgggtagtcccctgt

SEQ ID NO: 2371799 - DNA, 16 bp, Homo sapiens
ctgggtgcgtctccag

SEQ ID NO: 2371800 - DNA, 14 bp, Homo sapiens
ctgggtgctactgg

SEQ ID NO: 2371801 - DNA, 21 bp, Homo sapiens
ctgggtgctactggggaaact

SEQ ID NO: 2371802 - DNA, 13 bp, Homo sapiens
ctgggtgctggga

SEQ ID NO: 2371803 - DNA, 16 bp, Homo sapiens
ctgggttgcgggacag

SEQ ID NO: 2371804 - DNA, 20 bp, Homo sapiens
ctgggttgctgctgtccagt

SEQ ID NO: 2371805 - DNA, 14 bp, Homo sapiens
ctgggttgggatca

SEQ ID NO: 2371806 - DNA, 13 bp, Homo sapiens
ctgggttgggggc

SEQ ID NO: 2371807 - DNA, 23 bp, Homo sapiens
ctggtacagcagggtcttgctgt

SEQ ID NO: 2371808 - DNA, 19 bp, Homo sapiens
ctggtagaaaaaggggcct

SEQ ID NO: 2371809 - DNA, 14 bp, Homo sapiens
ctggtatttctaat

SEQ ID NO: 2371810 - DNA, 16 bp, Homo sapiens
ctggtcagtctttgct

SEQ ID NO: 2371811 - DNA, 23 bp, Homo sapiens
ctggtctcaaacttgtggcctca

SEQ ID NO: 2371812 - DNA, 20 bp, Homo sapiens
ctggtgaagctcacttctgg

SEQ ID NO: 2371813 - DNA, 21 bp, Homo sapiens
ctggtgccccccacccctgga

SEQ ID NO: 2371814 - DNA, 13 bp, Homo sapiens
ctggtgctactgt

SEQ ID NO: 2371815 - DNA, 21 bp, Homo sapiens
ctggtggagaactctggcttt

SEQ ID NO: 2371816 - DNA, 21 bp, Homo sapiens
ctggtggcttaagtgagcaga

SEQ ID NO: 2371817 - DNA, 18 bp, Homo sapiens
ctggtgggacagtggtga

SEQ ID NO: 2371818 - DNA, 18 bp, Homo sapiens
ctggtggttaaggccagg

SEQ ID NO: 2371819 - DNA, 21 bp, Homo sapiens
ctggtggttaaggccagggcc

SEQ ID NO: 2371820 - DNA, 18 bp, Homo sapiens
ctggttactttcaaaatg

SEQ ID NO: 2371821 - DNA, 21 bp, Homo sapiens
ctggttggctcccgcggtgcc

SEQ ID NO: 2371822 - DNA, 13 bp, Homo sapiens
ctggttgggcagc

SEQ ID NO: 2371823 - DNA, 17 bp, Homo sapiens
ctggtttgtggggcaca

SEQ ID NO: 2371824 - DNA, 13 bp, Homo sapiens
ctgtaaactgtgt

SEQ ID NO: 2371825 - DNA, 14 bp, Homo sapiens
ctgtaaactgtgta

SEQ ID NO: 2371826 - DNA, 14 bp, Homo sapiens
ctgtaaacttaaaa

SEQ ID NO: 2371827 - DNA, 15 bp, Homo sapiens
ctgtaactcagacat

SEQ ID NO: 2371828 - DNA, 19 bp, Homo sapiens
ctgtaactcagacattcca

SEQ ID NO: 2371829 - DNA, 17 bp, Homo sapiens
ctgtaactgagagaaag

SEQ ID NO: 2371830 - DNA, 17 bp, Homo sapiens
ctgtaagagcttgctcc

SEQ ID NO: 2371831 - DNA, 22 bp, Homo sapiens
ctgtaagcattctgagctgggc

SEQ ID NO: 2371832 - DNA, 15 bp, Homo sapiens
ctgtacaaaagcaat

SEQ ID NO: 2371833 - DNA, 17 bp, Homo sapiens
ctgtactgtgtctcatg

SEQ ID NO: 2371834 - DNA, 16 bp, Homo sapiens
ctgtacttcttgaata

SEQ ID NO: 2371835 - DNA, 13 bp, Homo sapiens
ctgtagccacagc

SEQ ID NO: 2371836 - DNA, 21 bp, Homo sapiens
ctgtagcctatttttttagat

SEQ ID NO: 2371837 - DNA, 16 bp, Homo sapiens
ctgtagctcagtcatc

SEQ ID NO: 2371838 - DNA, 22 bp, Homo sapiens
ctgtagctcagtcatcaaagca

SEQ ID NO: 2371839 - DNA, 14 bp, Homo sapiens
ctgtagctgccatg

SEQ ID NO: 2371840 - DNA, 16 bp, Homo sapiens
ctgtagcttttaggaa

SEQ ID NO: 2371841 - DNA, 14 bp, Homo sapiens
ctgtagtcccagct

SEQ ID NO: 2371842 - DNA, 21 bp, Homo sapiens
ctgtataaataggagaggatg

SEQ ID NO: 2371843 - DNA, 15 bp, Homo sapiens
ctgtataagttattt

SEQ ID NO: 2371844 - DNA, 22 bp, Homo sapiens
ctgtatacagtgcagagccttc

SEQ ID NO: 2371845 - DNA, 15 bp, Homo sapiens
ctgtatattttgtag

SEQ ID NO: 2371846 - DNA, 20 bp, Homo sapiens
ctgtatgaaaaattggggag

SEQ ID NO: 2371847 - DNA, 16 bp, Homo sapiens
ctgtatgtgagctgta

SEQ ID NO: 2371848 - DNA, 19 bp, Homo sapiens
ctgtatgtgagctgtaaaa

SEQ ID NO: 2371849 - DNA, 23 bp, Homo sapiens
ctgtattactgaataatatcaaa

SEQ ID NO: 2371850 - DNA, 21 bp, Homo sapiens
ctgtatttacttgttatgttg

SEQ ID NO: 2371851 - DNA, 12 bp, Homo sapiens
ctgtatttcctt

SEQ ID NO: 2371852 - DNA, 21 bp, Homo sapiens
ctgtattttatttagacaaga

SEQ ID NO: 2371853 - DNA, 12 bp, Homo sapiens
ctgtcaaatgtg

SEQ ID NO: 2371854 - DNA, 13 bp, Homo sapiens
ctgtcaatcacag

SEQ ID NO: 2371855 - DNA, 19 bp, Homo sapiens
ctgtcaatgggacctgtgg

SEQ ID NO: 2371856 - DNA, 21 bp, Homo sapiens
ctgtcacggggttccctccta

SEQ ID NO: 2371857 - DNA, 16 bp, Homo sapiens
ctgtcaggctgaaaac

SEQ ID NO: 2371858 - DNA, 13 bp, Homo sapiens
ctgtcattagtct

SEQ ID NO: 2371859 - DNA, 15 bp, Homo sapiens
ctgtcattatttcct

SEQ ID NO: 2371860 - DNA, 20 bp, Homo sapiens
ctgtccaaaagcgccctcac

SEQ ID NO: 2371861 - DNA, 21 bp, Homo sapiens
ctgtccaaaagcgccctcact

SEQ ID NO: 2371862 - DNA, 15 bp, Homo sapiens
ctgtccagctggggc

SEQ ID NO: 2371863 - DNA, 20 bp, Homo sapiens
ctgtccagctggggccagag

SEQ ID NO: 2371864 - DNA, 19 bp, Homo sapiens
ctgtccaggcagctccctc

SEQ ID NO: 2371865 - DNA, 12 bp, Homo sapiens
ctgtccagtgcc

SEQ ID NO: 2371866 - DNA, 21 bp, Homo sapiens
ctgtcccaggccggcccagat

SEQ ID NO: 2371867 - DNA, 15 bp, Homo sapiens
ctgtcccccaggctg

SEQ ID NO: 2371868 - DNA, 17 bp, Homo sapiens
ctgtcccccaggctgga

SEQ ID NO: 2371869 - DNA, 21 bp, Homo sapiens
ctgtcccctgctacacctatt

SEQ ID NO: 2371870 - DNA, 12 bp, Homo sapiens
ctgtccctgagg

SEQ ID NO: 2371871 - DNA, 17 bp, Homo sapiens
cttaattgccagcaaat

SEQ ID NO: 2371872 - DNA, 18 bp, Homo sapiens
cttaattgccagcaaata

SEQ ID NO: 2371873 - DNA, 21 bp, Homo sapiens
cttacaacccagggtgtgaac

SEQ ID NO: 2371874 - DNA, 13 bp, Homo sapiens
cttacctttttat

SEQ ID NO: 2371875 - DNA, 20 bp, Homo sapiens
cttacctttttatttgcatg

SEQ ID NO: 2371876 - DNA, 19 bp, Homo sapiens
cttactcttcttgaaattt

SEQ ID NO: 2371877 - DNA, 15 bp, Homo sapiens
cttactctttcctat

SEQ ID NO: 2371878 - DNA, 12 bp, Homo sapiens
cttactgatata

SEQ ID NO: 2371879 - DNA, 16 bp, Homo sapiens
cttactgtggaggaag

SEQ ID NO: 2371880 - DNA, 18 bp, Homo sapiens
cttactgtggaggaagga

SEQ ID NO: 2371881 - DNA, 18 bp, Homo sapiens
cttagactctagtattta

SEQ ID NO: 2371882 - DNA, 20 bp, Homo sapiens
cttagagattgcatttttat

SEQ ID NO: 2371883 - DNA, 16 bp, Homo sapiens
cttagattcttaattc

SEQ ID NO: 2371884 - DNA, 15 bp, Homo sapiens
cttagctcaggtgcc

SEQ ID NO: 2371885 - DNA, 16 bp, Homo sapiens
cttagctttttaattg

SEQ ID NO: 2371886 - DNA, 15 bp, Homo sapiens
cttagggaagaaaaa

SEQ ID NO: 2371887 - DNA, 16 bp, Homo sapiens
cttagggaagaaaaag

SEQ ID NO: 2371888 - DNA, 19 bp, Homo sapiens
cttagggaagaaaaagcaa

SEQ ID NO: 2371889 - DNA, 15 bp, Homo sapiens
cttaggggaaggaga

SEQ ID NO: 2371890 - DNA, 22 bp, Homo sapiens
cttaggtgagacagttgcccga

SEQ ID NO: 2371891 - DNA, 17 bp, Homo sapiens
cttaggtgccaggctgt

SEQ ID NO: 2371892 - DNA, 15 bp, Homo sapiens
cttagtctaggtcct

SEQ ID NO: 2371893 - DNA, 18 bp, Homo sapiens
cttataaagtggaagtat

SEQ ID NO: 2371894 - DNA, 20 bp, Homo sapiens
cttataaagtggaagtatgt

SEQ ID NO: 2371895 - DNA, 22 bp, Homo sapiens
cttataacctagttaaagaaag

SEQ ID NO: 2371896 - DNA, 15 bp, Homo sapiens
cttataactgtctgt

SEQ ID NO: 2371897 - DNA, 16 bp, Homo sapiens
cttatagtctaagact

SEQ ID NO: 2371898 - DNA, 21 bp, Homo sapiens
cttatagtctaagactatata

SEQ ID NO: 2371899 - DNA, 13 bp, Homo sapiens
cttatattctgca

SEQ ID NO: 2371900 - DNA, 13 bp, Homo sapiens
cttatcctctctc

SEQ ID NO: 2371901 - DNA, 19 bp, Homo sapiens
cttatcctctctctcttct

SEQ ID NO: 2371902 - DNA, 21 bp, Homo sapiens
cttatctcagtcatgcataaa

SEQ ID NO: 2371903 - DNA, 20 bp, Homo sapiens
cttatcttacaatattgatt

SEQ ID NO: 2371904 - DNA, 14 bp, Homo sapiens
cttatgaggagggg

SEQ ID NO: 2371905 - DNA, 16 bp, Homo sapiens
cttatgtgaaaaatta

SEQ ID NO: 2371906 - DNA, 17 bp, Homo sapiens
cttatgtgaaaaattaa

SEQ ID NO: 2371907 - DNA, 13 bp, Homo sapiens
cttatgtgacatt

SEQ ID NO: 2371908 - DNA, 16 bp, Homo sapiens
cttattacattttatt

SEQ ID NO: 2371909 - DNA, 13 bp, Homo sapiens
cttattgaatata

SEQ ID NO: 2371910 - DNA, 16 bp, Homo sapiens
cttattgaccattttt

SEQ ID NO: 2371911 - DNA, 16 bp, Homo sapiens
cttattgcctcccagg

SEQ ID NO: 2371912 - DNA, 22 bp, Homo sapiens
cttatttaatcttttcttattt

SEQ ID NO: 2371913 - DNA, 14 bp, Homo sapiens
cttatttctgaaca

SEQ ID NO: 2371914 - DNA, 23 bp, Homo sapiens
cttatttttataacatctttatt

SEQ ID NO: 2371915 - DNA, 16 bp, Homo sapiens
cttcaacttttctctt

SEQ ID NO: 2371916 - DNA, 18 bp, Homo sapiens
cttcaatatgaatctata

SEQ ID NO: 2371917 - DNA, 14 bp, Homo sapiens
cttcaatgctgcag

SEQ ID NO: 2371918 - DNA, 19 bp, Homo sapiens
cttcaatggaatacagtca

SEQ ID NO: 2371919 - DNA, 14 bp, Homo sapiens
cttcacacagacac

SEQ ID NO: 2371920 - DNA, 19 bp, Homo sapiens
cttcacacagacccctcgc

SEQ ID NO: 2371921 - DNA, 18 bp, Homo sapiens
cttcacagtagagccagc

SEQ ID NO: 2371922 - DNA, 19 bp, Homo sapiens
cttcacagtagagccagct

SEQ ID NO: 2371923 - DNA, 22 bp, Homo sapiens
cttcacagtagagccagcttgg

SEQ ID NO: 2371924 - DNA, 23 bp, Homo sapiens
cttcactaccctgattcttgatt

SEQ ID NO: 2371925 - DNA, 17 bp, Homo sapiens
cttcactcaaattttgg

SEQ ID NO: 2371926 - DNA, 13 bp, Homo sapiens
cttcactgtataa

SEQ ID NO: 2371927 - DNA, 17 bp, Homo sapiens
cttcactgtataaatag

SEQ ID NO: 2371928 - DNA, 12 bp, Homo sapiens
cttcactgtcac

SEQ ID NO: 2371929 - DNA, 15 bp, Homo sapiens
cttcagcccaggctt

SEQ ID NO: 2371930 - DNA, 15 bp, Homo sapiens
cttcagctccaggga

SEQ ID NO: 2371931 - DNA, 23 bp, Homo sapiens
cttcagctccagggaatccaagc

SEQ ID NO: 2371932 - DNA, 23 bp, Homo sapiens
cttcagggctgagttctgggttt

SEQ ID NO: 2371933 - DNA, 21 bp, Homo sapiens
cttcagggtaaactagcaatg

SEQ ID NO: 2371934 - DNA, 20 bp, Homo sapiens
cttcaggttatcgaaataac

SEQ ID NO: 2371935 - DNA, 22 bp, Homo sapiens
cttcaggttatcgaaataacaa

SEQ ID NO: 2371936 - DNA, 15 bp, Homo sapiens
cttcatctctttaga

SEQ ID NO: 2371937 - DNA, 16 bp, Homo sapiens
cttcatcttcctgtgt

SEQ ID NO: 2371938 - DNA, 20 bp, Homo sapiens
cttcatcttcctgtgtcctg

SEQ ID NO: 2371939 - DNA, 23 bp, Homo sapiens
cttcatggcatcttcaatatgaa

SEQ ID NO: 2371940 - DNA, 14 bp, Homo sapiens
cttcatgttgatgt

SEQ ID NO: 2371941 - DNA, 18 bp, Homo sapiens
cttcattctggaaacttt

SEQ ID NO: 2371942 - DNA, 20 bp, Homo sapiens
cttcatttccaccaggccgt

SEQ ID NO: 2371943 - DNA, 20 bp, Homo sapiens
cttccaacatatatttattg

SEQ ID NO: 2371944 - DNA, 15 bp, Homo sapiens
cttccactctggaac

SEQ ID NO: 2371945 - DNA, 13 bp, Homo sapiens
cttccagatcact

SEQ ID NO: 2371946 - DNA, 17 bp, Homo sapiens
cttccagatcactgcca

SEQ ID NO: 2371947 - DNA, 20 bp, Homo sapiens
cttccagatcactgccacac

SEQ ID NO: 2371948 - DNA, 17 bp, Homo sapiens
cttccaggaaactccac

SEQ ID NO: 2371949 - DNA, 21 bp, Homo sapiens
cttccagtcttcctgacactt

SEQ ID NO: 2371950 - DNA, 22 bp, Homo sapiens
cttccagtcttcctgacacttt

SEQ ID NO: 2371951 - DNA, 16 bp, Homo sapiens
cttccattttaatttt

SEQ ID NO: 2371952 - DNA, 13 bp, Homo sapiens
cttcccatgcatt

SEQ ID NO: 2371953 - DNA, 14 bp, Homo sapiens
cttcccattaaaaa

SEQ ID NO: 2371954 - DNA, 23 bp, Homo sapiens
cttcccccaccggtccagctggc

SEQ ID NO: 2371955 - DNA, 18 bp, Homo sapiens
cttcccgggccagggctg

SEQ ID NO: 2371956 - DNA, 21 bp, Homo sapiens
cttccctagctttagaccctg

SEQ ID NO: 2371957 - DNA, 13 bp, Homo sapiens
cttccctctctga

SEQ ID NO: 2371958 - DNA, 21 bp, Homo sapiens
cttccctctctgatgtcccag

SEQ ID NO: 2371959 - DNA, 23 bp, Homo sapiens
cttccctctctgatgtcccagtg

SEQ ID NO: 2371960 - DNA, 22 bp, Homo sapiens
cttccctgaacgttttcttctt

SEQ ID NO: 2371961 - DNA, 18 bp, Homo sapiens
cttccctgggctgccacc

SEQ ID NO: 2371962 - DNA, 23 bp, Homo sapiens
cttccgcttggagctattttcca

SEQ ID NO: 2371963 - DNA, 22 bp, Homo sapiens
cttcctcaaaataaagaagtat

SEQ ID NO: 2371964 - DNA, 18 bp, Homo sapiens
cttcctctagaagccaag

SEQ ID NO: 2371965 - DNA, 14 bp, Homo sapiens
cttcctcttgtctg

SEQ ID NO: 2371966 - DNA, 16 bp, Homo sapiens
cttcctcttgtctgat

SEQ ID NO: 2371967 - DNA, 17 bp, Homo sapiens
cttcctgacactttaat

SEQ ID NO: 2371968 - DNA, 20 bp, Homo sapiens
cttcctgcaggcaggaacaa

SEQ ID NO: 2371969 - DNA, 10 bp, Homo sapiens
cttcctgccc

SEQ ID NO: 2371970 - DNA, 15 bp, Homo sapiens
cttcctgcccttccc

SEQ ID NO: 2371971 - DNA, 19 bp, Homo sapiens
cttcctgcccttccctctg

SEQ ID NO: 2371972 - DNA, 20 bp, Homo sapiens
cttcctgcccttccctctgg

SEQ ID NO: 2371973 - DNA, 19 bp, Homo sapiens
cttcctggtgaggcccagc

SEQ ID NO: 2371974 - DNA, 22 bp, Homo sapiens
cttcctggtgaggcccagcctg

SEQ ID NO: 2371975 - DNA, 24 bp, Homo sapiens
cttcctggtgaggcccagcctgtc

SEQ ID NO: 2371976 - DNA, 15 bp, Homo sapiens
cttcctgtccctgag

SEQ ID NO: 2371977 - DNA, 18 bp, Homo sapiens
cttcctgtttttcacatt

SEQ ID NO: 2371978 - DNA, 23 bp, Homo sapiens
cttcctgtttttcacattttcct

SEQ ID NO: 2371979 - DNA, 12 bp, Homo sapiens
cttcctttctct

SEQ ID NO: 2371980 - DNA, 18 bp, Homo sapiens
cttcctttctctcctggc

SEQ ID NO: 2371981 - DNA, 14 bp, Homo sapiens
cttccttttccctg

SEQ ID NO: 2371982 - DNA, 15 bp, Homo sapiens
cttcgtttattttca

SEQ ID NO: 2371983 - DNA, 16 bp, Homo sapiens
cttcgtttattttcaa

SEQ ID NO: 2371984 - DNA, 14 bp, Homo sapiens
cttctacctgccct

SEQ ID NO: 2371985 - DNA, 16 bp, Homo sapiens
ctttgaataaatgtgt

SEQ ID NO: 2371986 - DNA, 23 bp, Homo sapiens
ctttgaatatgtagtatctatat

SEQ ID NO: 2371987 - DNA, 23 bp, Homo sapiens
ctttgacaattgggagctgccaa

SEQ ID NO: 2371988 - DNA, 19 bp, Homo sapiens
ctttgaccagatctttctc

SEQ ID NO: 2371989 - DNA, 15 bp, Homo sapiens
ctttgactttttgca

SEQ ID NO: 2371990 - DNA, 15 bp, Homo sapiens
ctttgagacagtttc

SEQ ID NO: 2371991 - DNA, 21 bp, Homo sapiens
ctttgagtaccaaatccacaa

SEQ ID NO: 2371992 - DNA, 13 bp, Homo sapiens
ctttgataatgtt

SEQ ID NO: 2371993 - DNA, 16 bp, Homo sapiens
ctttgataatgttaaa

SEQ ID NO: 2371994 - DNA, 14 bp, Homo sapiens
ctttgcacctgaga

SEQ ID NO: 2371995 - DNA, 22 bp, Homo sapiens
ctttgcacgtgctgtttgctgt

SEQ ID NO: 2371996 - DNA, 20 bp, Homo sapiens
ctttgccatgggcctgctgc

SEQ ID NO: 2371997 - DNA, 23 bp, Homo sapiens
ctttgctctattaagattggaaa

SEQ ID NO: 2371998 - DNA, 16 bp, Homo sapiens
ctttggaaataaaaga

SEQ ID NO: 2371999 - DNA, 20 bp, Homo sapiens
ctttggaagtttagctctga

SEQ ID NO: 2372000 - DNA, 21 bp, Homo sapiens
ctttggaagtttagctctgag

SEQ ID NO: 2372001 - DNA, 20 bp, Homo sapiens
ctttggattctaaatacatg

SEQ ID NO: 2372002 - DNA, 21 bp, Homo sapiens
ctttggccccactttgaaggg

SEQ ID NO: 2372003 - DNA, 22 bp, Homo sapiens
ctttggctgagacctgggattt

SEQ ID NO: 2372004 - DNA, 14 bp, Homo sapiens
ctttgggaaaacat

SEQ ID NO: 2372005 - DNA, 21 bp, Homo sapiens
ctttgggaaaacatgttaatg

SEQ ID NO: 2372006 - DNA, 11 bp, Homo sapiens
ctttggttttt

SEQ ID NO: 2372007 - DNA, 17 bp, Homo sapiens
ctttggtttttttcttc

SEQ ID NO: 2372008 - DNA, 16 bp, Homo sapiens
ctttgtaaaaatcttt

SEQ ID NO: 2372009 - DNA, 17 bp, Homo sapiens
ctttgtaagagtgtaga

SEQ ID NO: 2372010 - DNA, 20 bp, Homo sapiens
ctttgtaagagtgtagaagc

SEQ ID NO: 2372011 - DNA, 23 bp, Homo sapiens
ctttgtaagagtgtagaagcatt

SEQ ID NO: 2372012 - DNA, 22 bp, Homo sapiens
ctttgtacagaccgagaggcca

SEQ ID NO: 2372013 - DNA, 18 bp, Homo sapiens
ctttgtattttgattatt

SEQ ID NO: 2372014 - DNA, 23 bp, Homo sapiens
ctttgtgattcaatctgtaaact

SEQ ID NO: 2372015 - DNA, 17 bp, Homo sapiens
ctttgtgtgctctccat

SEQ ID NO: 2372016 - DNA, 20 bp, Homo sapiens
ctttgtgtgtgtgtcagctg

SEQ ID NO: 2372017 - DNA, 14 bp, Homo sapiens
ctttgtgttcattt

SEQ ID NO: 2372018 - DNA, 17 bp, Homo sapiens
ctttgtgttcatttcat

SEQ ID NO: 2372019 - DNA, 15 bp, Homo sapiens
ctttgttacaggcac

SEQ ID NO: 2372020 - DNA, 19 bp, Homo sapiens
ctttgttgcaagatgtgaa

SEQ ID NO: 2372021 - DNA, 17 bp, Homo sapiens
cttttaaaattcaaaag

SEQ ID NO: 2372022 - DNA, 23 bp, Homo sapiens
cttttaaaatttgtcttaaaaat

SEQ ID NO: 2372023 - DNA, 12 bp, Homo sapiens
cttttaaactgt

SEQ ID NO: 2372024 - DNA, 13 bp, Homo sapiens
cttttaaactgtg

SEQ ID NO: 2372025 - DNA, 14 bp, Homo sapiens
cttttaagatttct

SEQ ID NO: 2372026 - DNA, 14 bp, Homo sapiens
cttttaaggataaa

SEQ ID NO: 2372027 - DNA, 15 bp, Homo sapiens
cttttaatggcattt

SEQ ID NO: 2372028 - DNA, 16 bp, Homo sapiens
cttttaccctggcccc

SEQ ID NO: 2372029 - DNA, 19 bp, Homo sapiens
cttttaccctggcccctct

SEQ ID NO: 2372030 - DNA, 22 bp, Homo sapiens
cttttaccctggcccctctccc

SEQ ID NO: 2372031 - DNA, 23 bp, Homo sapiens
cttttaccctggcccctctccct

SEQ ID NO: 2372032 - DNA, 14 bp, Homo sapiens
cttttagaaatgca

SEQ ID NO: 2372033 - DNA, 15 bp, Homo sapiens
cttttagaaatgcat

SEQ ID NO: 2372034 - DNA, 13 bp, Homo sapiens
cttttataaagca

SEQ ID NO: 2372035 - DNA, 16 bp, Homo sapiens
cttttataaagcatgt

SEQ ID NO: 2372036 - DNA, 14 bp, Homo sapiens
cttttcaggaaaat

SEQ ID NO: 2372037 - DNA, 13 bp, Homo sapiens
cttttcccactcc

SEQ ID NO: 2372038 - DNA, 17 bp, Homo sapiens
cttttcccactccaagc

SEQ ID NO: 2372039 - DNA, 18 bp, Homo sapiens
cttttcccactgtttaag

SEQ ID NO: 2372040 - DNA, 17 bp, Homo sapiens
cttttcccctttcctgt

SEQ ID NO: 2372041 - DNA, 13 bp, Homo sapiens
cttttctaattaa

SEQ ID NO: 2372042 - DNA, 16 bp, Homo sapiens
cttttctaattaatag

SEQ ID NO: 2372043 - DNA, 14 bp, Homo sapiens
cttttctgccctgg

SEQ ID NO: 2372044 - DNA, 17 bp, Homo sapiens
cttttctgtggctggct

SEQ ID NO: 2372045 - DNA, 16 bp, Homo sapiens
cttttcttaaaccttc

SEQ ID NO: 2372046 - DNA, 11 bp, Homo sapiens
cttttcttatt

SEQ ID NO: 2372047 - DNA, 17 bp, Homo sapiens
cttttcttatttttgta

SEQ ID NO: 2372048 - DNA, 16 bp, Homo sapiens
cttttgctagatggaa

SEQ ID NO: 2372049 - DNA, 23 bp, Homo sapiens
cttttggagaaccagggctcttc

SEQ ID NO: 2372050 - DNA, 18 bp, Homo sapiens
cttttgttagggctgctt

SEQ ID NO: 2372051 - DNA, 15 bp, Homo sapiens
cttttgtttggtaaa

SEQ ID NO: 2372052 - DNA, 18 bp, Homo sapiens
cttttgtttggtaaatgt

SEQ ID NO: 2372053 - DNA, 21 bp, Homo sapiens
ctttttaaaaattgttattta

SEQ ID NO: 2372054 - DNA, 14 bp, Homo sapiens
ctttttaattgttg

SEQ ID NO: 2372055 - DNA, 23 bp, Homo sapiens
ctttttaattgttgtttctttct

SEQ ID NO: 2372056 - DNA, 13 bp, Homo sapiens
ctttttattaaaa

SEQ ID NO: 2372057 - DNA, 13 bp, Homo sapiens
ctttttatttgca

SEQ ID NO: 2372058 - DNA, 15 bp, Homo sapiens
ctttttatttgcatg

SEQ ID NO: 2372059 - DNA, 15 bp, Homo sapiens
ctttttcactttgaa

SEQ ID NO: 2372060 - DNA, 16 bp, Homo sapiens
ctttttcactttgaaa

SEQ ID NO: 2372061 - DNA, 12 bp, Homo sapiens
ctttttcctcct

SEQ ID NO: 2372062 - DNA, 14 bp, Homo sapiens
ctttttgacactga

SEQ ID NO: 2372063 - DNA, 15 bp, Homo sapiens
ctttttgacactgaa

SEQ ID NO: 2372064 - DNA, 11 bp, Homo sapiens
ctttttggaat

SEQ ID NO: 2372065 - DNA, 14 bp, Homo sapiens
ctttttttaagtgt

SEQ ID NO: 2372066 - DNA, 20 bp, Homo sapiens
ctttttttgagtgacagctt

SEQ ID NO: 2372067 - DNA, 17 bp, Homo sapiens
gaaaaaaaagtgtctca

SEQ ID NO: 2372068 - DNA, 20 bp, Homo sapiens
gaaaaaaaagtgtctcaaag

SEQ ID NO: 2372069 - DNA, 23 bp, Homo sapiens
gaaaaaaacaaaaacagaatttg

SEQ ID NO: 2372070 - DNA, 17 bp, Homo sapiens
gaaaaaaagggagaata

SEQ ID NO: 2372071 - DNA, 15 bp, Homo sapiens
gaaaaacacaagcaa

SEQ ID NO: 2372072 - DNA, 17 bp, Homo sapiens
gaaaaacacggcagctg

SEQ ID NO: 2372073 - DNA, 18 bp, Homo sapiens
gaaaaacacggcagctgt

SEQ ID NO: 2372074 - DNA, 12 bp, Homo sapiens
gaaaaataaatg

SEQ ID NO: 2372075 - DNA, 12 bp, Homo sapiens
gaaaaatataaa

SEQ ID NO: 2372076 - DNA, 17 bp, Homo sapiens
gaaaaatataaaattat

SEQ ID NO: 2372077 - DNA, 16 bp, Homo sapiens
gaaaaatctaaaatgt

SEQ ID NO: 2372078 - DNA, 18 bp, Homo sapiens
gaaaaatctaaaatgtgt

SEQ ID NO: 2372079 - DNA, 22 bp, Homo sapiens
gaaaaatctcattatttcaaaa

SEQ ID NO: 2372080 - DNA, 18 bp, Homo sapiens
gaaaaatgaaatttaagc

SEQ ID NO: 2372081 - DNA, 16 bp, Homo sapiens
gaaaaatgctccccac

SEQ ID NO: 2372082 - DNA, 17 bp, Homo sapiens
gaaaaatgctccccaca

SEQ ID NO: 2372083 - DNA, 15 bp, Homo sapiens
gaaaaattaactttt

SEQ ID NO: 2372084 - DNA, 21 bp, Homo sapiens
gaaaaattgctgactgtagct

SEQ ID NO: 2372085 - DNA, 22 bp, Homo sapiens
gaaaaattgctgactgtagctt

SEQ ID NO: 2372086 - DNA, 20 bp, Homo sapiens
gaaaacaatggagtattctc

SEQ ID NO: 2372087 - DNA, 16 bp, Homo sapiens
gaaaacatgttaatga

SEQ ID NO: 2372088 - DNA, 12 bp, Homo sapiens
gaaaactgtgtt

SEQ ID NO: 2372089 - DNA, 13 bp, Homo sapiens
gaaaactgtgttg

SEQ ID NO: 2372090 - DNA, 14 bp, Homo sapiens
gaaaagctattagc

SEQ ID NO: 2372091 - DNA, 22 bp, Homo sapiens
gaaaagctattagccaggatca

SEQ ID NO: 2372092 - DNA, 13 bp, Homo sapiens
gaaaaggttgaat

SEQ ID NO: 2372093 - DNA, 19 bp, Homo sapiens
gaaaaggttgaataatata

SEQ ID NO: 2372094 - DNA, 14 bp, Homo sapiens
gaaaagttggaagg

SEQ ID NO: 2372095 - DNA, 16 bp, Homo sapiens
gaaaataaaacacacc

SEQ ID NO: 2372096 - DNA, 13 bp, Homo sapiens
gaaaataactgaa

SEQ ID NO: 2372097 - DNA, 17 bp, Homo sapiens
gaaaattatttgtatga

SEQ ID NO: 2372098 - DNA, 16 bp, Homo sapiens
gaaaattcttaaaagg

SEQ ID NO: 2372099 - DNA, 12 bp, Homo sapiens
gaaaattgagtt

SEQ ID NO: 2372100 - DNA, 15 bp, Homo sapiens
gaagcacagaatatt

SEQ ID NO: 2372101 - DNA, 20 bp, Homo sapiens
gaagcactacaccttgcctt

SEQ ID NO: 2372102 - DNA, 20 bp, Homo sapiens
gaagcagggaattcctgggg

SEQ ID NO: 2372103 - DNA, 13 bp, Homo sapiens
gaagcagtatttt

SEQ ID NO: 2372104 - DNA, 18 bp, Homo sapiens
gaagcattccttctttga

SEQ ID NO: 2372105 - DNA, 14 bp, Homo sapiens
gaagccaaagaaaa

SEQ ID NO: 2372106 - DNA, 15 bp, Homo sapiens
gaagccaagggaaag

SEQ ID NO: 2372107 - DNA, 21 bp, Homo sapiens
gaagccaagggaaaggggtgc

SEQ ID NO: 2372108 - DNA, 13 bp, Homo sapiens
gaagccagagccc

SEQ ID NO: 2372109 - DNA, 22 bp, Homo sapiens
gaagccagagccccaagcagga

SEQ ID NO: 2372110 - DNA, 13 bp, Homo sapiens
gaagccagctgcc

SEQ ID NO: 2372111 - DNA, 15 bp, Homo sapiens
gaagccagctgccct

SEQ ID NO: 2372112 - DNA, 22 bp, Homo sapiens
gaagccagctttccctgcctct

SEQ ID NO: 2372113 - DNA, 23 bp, Homo sapiens
gaagccatatatgaccagaagcc

SEQ ID NO: 2372114 - DNA, 20 bp, Homo sapiens
gaagccatattcacacctca

SEQ ID NO: 2372115 - DNA, 18 bp, Homo sapiens
gaagcccctgggcccagt

SEQ ID NO: 2372116 - DNA, 17 bp, Homo sapiens
gaagcctccaagcacag

SEQ ID NO: 2372117 - DNA, 19 bp, Homo sapiens
gaagccttggaaccagccc

SEQ ID NO: 2372118 - DNA, 16 bp, Homo sapiens
gaagctaatgtcacaa

SEQ ID NO: 2372119 - DNA, 20 bp, Homo sapiens
gaagctcatatccttttgaa

SEQ ID NO: 2372120 - DNA, 23 bp, Homo sapiens
gaagctggctttgaaacctcagg

SEQ ID NO: 2372121 - DNA, 12 bp, Homo sapiens
gaaggacttgac

SEQ ID NO: 2372122 - DNA, 17 bp, Homo sapiens
gaaggagaagtaagagg

SEQ ID NO: 2372123 - DNA, 20 bp, Homo sapiens
gaaggaggggagagacaggc

SEQ ID NO: 2372124 - DNA, 22 bp, Homo sapiens
gaaggaggggagagacaggcag

SEQ ID NO: 2372125 - DNA, 14 bp, Homo sapiens
gaaggatctgctga

SEQ ID NO: 2372126 - DNA, 15 bp, Homo sapiens
gaaggatctgctgag

SEQ ID NO: 2372127 - DNA, 13 bp, Homo sapiens
gaaggattgtaaa

SEQ ID NO: 2372128 - DNA, 14 bp, Homo sapiens
gaaggcagagaaat

SEQ ID NO: 2372129 - DNA, 18 bp, Homo sapiens
gaaggcagagaaatctaa

SEQ ID NO: 2372130 - DNA, 14 bp, Homo sapiens
gaaggccctgaggc

SEQ ID NO: 2372131 - DNA, 16 bp, Homo sapiens
gaaggcctttcttctg

SEQ ID NO: 2372132 - DNA, 20 bp, Homo sapiens
gaaggcctttcttctgtgtt

SEQ ID NO: 2372133 - DNA, 18 bp, Homo sapiens
gaaggcgagtctggggac

SEQ ID NO: 2372134 - DNA, 23 bp, Homo sapiens
gaaggctttgccatgggcctgct

SEQ ID NO: 2372135 - DNA, 14 bp, Homo sapiens
gaagggaaagtttt

SEQ ID NO: 2372136 - DNA, 23 bp, Homo sapiens
gaagggaagcgtatatacttaag

SEQ ID NO: 2372137 - DNA, 16 bp, Homo sapiens
gaagggcgttctaggt

SEQ ID NO: 2372138 - DNA, 14 bp, Homo sapiens
gaaggggttcctca

SEQ ID NO: 2372139 - DNA, 13 bp, Homo sapiens
gaagggtttctct

SEQ ID NO: 2372140 - DNA, 17 bp, Homo sapiens
gaaggtgataagggaaa

SEQ ID NO: 2372141 - DNA, 19 bp, Homo sapiens
gaaggtgataagggaaaag

SEQ ID NO: 2372142 - DNA, 19 bp, Homo sapiens
gaagtattttgctggaata

SEQ ID NO: 2372143 - DNA, 16 bp, Homo sapiens
gaagtcattgtcgctc

SEQ ID NO: 2372144 - DNA, 16 bp, Homo sapiens
gaagtctggctttgct

SEQ ID NO: 2372145 - DNA, 18 bp, Homo sapiens
gaagtctggctttgctct

SEQ ID NO: 2372146 - DNA, 16 bp, Homo sapiens
gaagtgcccttcctgc

SEQ ID NO: 2372147 - DNA, 13 bp, Homo sapiens
gaagtgcttggaa

SEQ ID NO: 2372148 - DNA, 19 bp, Homo sapiens
gaagtgcttggaacatact

SEQ ID NO: 2372149 - DNA, 20 bp, Homo sapiens
gaagtggctggtagaaaaag

SEQ ID NO: 2372150 - DNA, 23 bp, Homo sapiens
gaagttacacagaaatgctgctg

SEQ ID NO: 2372151 - DNA, 17 bp, Homo sapiens
gaagtttagctctgaga

SEQ ID NO: 2372152 - DNA, 21 bp, Homo sapiens
gaagtttcaagttttaaagtt

SEQ ID NO: 2372153 - DNA, 19 bp, Homo sapiens
gaataaaattcctatctca

SEQ ID NO: 2372154 - DNA, 15 bp, Homo sapiens
gaataatgaaaataa

SEQ ID NO: 2372155 - DNA, 18 bp, Homo sapiens
gaatacgcagaactacca

SEQ ID NO: 2372156 - DNA, 20 bp, Homo sapiens
gaatacgctaataagtgaca

SEQ ID NO: 2372157 - DNA, 13 bp, Homo sapiens
gaatagcctggcc

SEQ ID NO: 2372158 - DNA, 15 bp, Homo sapiens
gaatatatgtgtgcc

SEQ ID NO: 2372159 - DNA, 21 bp, Homo sapiens
gaatatcagaagtatatctgt

SEQ ID NO: 2372160 - DNA, 17 bp, Homo sapiens
gaatatggtggaaaata

SEQ ID NO: 2372161 - DNA, 19 bp, Homo sapiens
gaatatgtagtatctatat

SEQ ID NO: 2372162 - DNA, 22 bp, Homo sapiens
gaatatttgttatgtagataac

SEQ ID NO: 2372163 - DNA, 21 bp, Homo sapiens
gaatatttttatatttccttt

SEQ ID NO: 2372164 - DNA, 20 bp, Homo sapiens
gaatcactgttgctttgaaa

SEQ ID NO: 2372165 - DNA, 19 bp, Homo sapiens
gaatcatgagcctgctgga

SEQ ID NO: 2372166 - DNA, 18 bp, Homo sapiens
gaatcattcagaaatgtt

SEQ ID NO: 2372167 - DNA, 15 bp, Homo sapiens
gaatccaagattggt

SEQ ID NO: 2372168 - DNA, 15 bp, Homo sapiens
gaatccaagcctcca

SEQ ID NO: 2372169 - DNA, 20 bp, Homo sapiens
gaatccaagcctccacagcg

SEQ ID NO: 2372170 - DNA, 22 bp, Homo sapiens
gaatccaagggttgagagccag

SEQ ID NO: 2372171 - DNA, 12 bp, Homo sapiens
gaatcctggcag

SEQ ID NO: 2372172 - DNA, 14 bp, Homo sapiens
gaatctctgcctct

SEQ ID NO: 2372173 - DNA, 15 bp, Homo sapiens
gaatctcttcactac

SEQ ID NO: 2372174 - DNA, 17 bp, Homo sapiens
gaatctgcagggagcaa

SEQ ID NO: 2372175 - DNA, 20 bp, Homo sapiens
gaatcttgttttgaaaataa

SEQ ID NO: 2372176 - DNA, 20 bp, Homo sapiens
gaatgaaaataactgaattt

SEQ ID NO: 2372177 - DNA, 16 bp, Homo sapiens
gaatgaaattaacaca

SEQ ID NO: 2372178 - DNA, 14 bp, Homo sapiens
gaatgacagccttt

SEQ ID NO: 2372179 - DNA, 22 bp, Homo sapiens
gaatgcaccacggcagctctcc

SEQ ID NO: 2372180 - DNA, 16 bp, Homo sapiens
gaatgccatttctcac

SEQ ID NO: 2372181 - DNA, 22 bp, Homo sapiens
gaatgccttggaaatagaaaga

SEQ ID NO: 2372182 - DNA, 21 bp, Homo sapiens
gaatgcttttagtgtgtgcat

SEQ ID NO: 2372183 - DNA, 20 bp, Homo sapiens
gaatggattggattatttaa

SEQ ID NO: 2372184 - DNA, 15 bp, Homo sapiens
gaatggtctttgctc

SEQ ID NO: 2372185 - DNA, 13 bp, Homo sapiens
gaatgtaaccaat

SEQ ID NO: 2372186 - DNA, 18 bp, Homo sapiens
gaatgtttttccctcccc

SEQ ID NO: 2372187 - DNA, 16 bp, Homo sapiens
gaattaaaaagaagat

SEQ ID NO: 2372188 - DNA, 17 bp, Homo sapiens
gaattaattaatttgga

SEQ ID NO: 2372189 - DNA, 16 bp, Homo sapiens
gaattatcagcaaaga

SEQ ID NO: 2372190 - DNA, 17 bp, Homo sapiens
gaattatcagcaaagaa

SEQ ID NO: 2372191 - DNA, 18 bp, Homo sapiens
gaattatcagcaaagaaa

SEQ ID NO: 2372192 - DNA, 22 bp, Homo sapiens
gaattgaaaagtttttgtttgg

SEQ ID NO: 2372193 - DNA, 12 bp, Homo sapiens
gaattgtggcta

SEQ ID NO: 2372194 - DNA, 18 bp, Homo sapiens
gaatttcaaaccattgct

SEQ ID NO: 2372195 - DNA, 19 bp, Homo sapiens
gaatttggggcttccaagt

SEQ ID NO: 2372196 - DNA, 12 bp, Homo sapiens
gaattttaaagt

SEQ ID NO: 2372197 - DNA, 15 bp, Homo sapiens
gaattttaaagtatg

SEQ ID NO: 2372198 - DNA, 15 bp, Homo sapiens
gaattttctaaaagc

SEQ ID NO: 2372199 - DNA, 20 bp, Homo sapiens
gaattttgagtattccatga

SEQ ID NO: 2372200 - DNA, 14 bp, Homo sapiens
gacaaaagtctgtc

SEQ ID NO: 2372201 - DNA, 22 bp, Homo sapiens
gacaaaatttgagaatacataa

SEQ ID NO: 2372202 - DNA, 20 bp, Homo sapiens
gacaaagccttaagcaaatt

SEQ ID NO: 2372203 - DNA, 11 bp, Homo sapiens
gacaaatattc

SEQ ID NO: 2372204 - DNA, 18 bp, Homo sapiens
gacaaatctcagaacctt

SEQ ID NO: 2372205 - DNA, 19 bp, Homo sapiens
gacaaccattaaagtcaga

SEQ ID NO: 2372206 - DNA, 13 bp, Homo sapiens
gacaacctttctg

SEQ ID NO: 2372207 - DNA, 14 bp, Homo sapiens
gacaacctttctgt

SEQ ID NO: 2372208 - DNA, 22 bp, Homo sapiens
gacaagagttggggacagaact

SEQ ID NO: 2372209 - DNA, 13 bp, Homo sapiens
gacaataagaaac

SEQ ID NO: 2372210 - DNA, 17 bp, Homo sapiens
gacaataagaaacagtt

SEQ ID NO: 2372211 - DNA, 18 bp, Homo sapiens
gacaataagaaacagttt

SEQ ID NO: 2372212 - DNA, 21 bp, Homo sapiens
gacaataagaaacagtttaac

SEQ ID NO: 2372213 - DNA, 15 bp, Homo sapiens
gacaatactggggtt

SEQ ID NO: 2372214 - DNA, 17 bp, Homo sapiens
gacaatcaactctaata

SEQ ID NO: 2372215 - DNA, 22 bp, Homo sapiens
gactggcccctgacccagggac

SEQ ID NO: 2372216 - DNA, 15 bp, Homo sapiens
gactggttttctgcc

SEQ ID NO: 2372217 - DNA, 14 bp, Homo sapiens
gactgtagccacag

SEQ ID NO: 2372218 - DNA, 17 bp, Homo sapiens
gactgtagccacagctg

SEQ ID NO: 2372219 - DNA, 21 bp, Homo sapiens
gactgtagccacagctgctgt

SEQ ID NO: 2372220 - DNA, 13 bp, Homo sapiens
gactgttgagtta

SEQ ID NO: 2372221 - DNA, 22 bp, Homo sapiens
gacttaactttaacttttgaaa

SEQ ID NO: 2372222 - DNA, 13 bp, Homo sapiens
gacttagaaactg

SEQ ID NO: 2372223 - DNA, 13 bp, Homo sapiens
gacttagagctgg

SEQ ID NO: 2372224 - DNA, 15 bp, Homo sapiens
gacttccatgcctta

SEQ ID NO: 2372225 - DNA, 15 bp, Homo sapiens
gacttctacctgccc

SEQ ID NO: 2372226 - DNA, 18 bp, Homo sapiens
gacttgagacaatgtttt

SEQ ID NO: 2372227 - DNA, 21 bp, Homo sapiens
gacttgctgtgtgaccctggg

SEQ ID NO: 2372228 - DNA, 22 bp, Homo sapiens
gacttgctgtgtgaccctgggc

SEQ ID NO: 2372229 - DNA, 21 bp, Homo sapiens
gacttggtgattacctgaaag

SEQ ID NO: 2372230 - DNA, 21 bp, Homo sapiens
gactttatctaatacctctgt

SEQ ID NO: 2372231 - DNA, 18 bp, Homo sapiens
gactttcttgcatgaatc

SEQ ID NO: 2372232 - DNA, 23 bp, Homo sapiens
gactttctttttgtagctggggc

SEQ ID NO: 2372233 - DNA, 14 bp, Homo sapiens
gactttgagctgag

SEQ ID NO: 2372234 - DNA, 19 bp, Homo sapiens
gactttgtgttcatttcat

SEQ ID NO: 2372235 - DNA, 20 bp, Homo sapiens
gactttgtgttcatttcatt

SEQ ID NO: 2372236 - DNA, 16 bp, Homo sapiens
gactttttgcatttaa

SEQ ID NO: 2372237 - DNA, 18 bp, Homo sapiens
gagaaaaatgctccccac

SEQ ID NO: 2372238 - DNA, 22 bp, Homo sapiens
gagaaaattggaactctactca

SEQ ID NO: 2372239 - DNA, 23 bp, Homo sapiens
gagaaatgtgtagctgcaaaaat

SEQ ID NO: 2372240 - DNA, 20 bp, Homo sapiens
gagaagaaaggtgagtttga

SEQ ID NO: 2372241 - DNA, 13 bp, Homo sapiens
gagaagccttcag

SEQ ID NO: 2372242 - DNA, 17 bp, Homo sapiens
gagaagggggtctctgt

SEQ ID NO: 2372243 - DNA, 19 bp, Homo sapiens
gagaagggggtctctgtta

SEQ ID NO: 2372244 - DNA, 13 bp, Homo sapiens
gagaatacataaa

SEQ ID NO: 2372245 - DNA, 20 bp, Homo sapiens
gagacactgttgataaaaac

SEQ ID NO: 2372246 - DNA, 18 bp, Homo sapiens
gagacagggtcttgctct

SEQ ID NO: 2372247 - DNA, 15 bp, Homo sapiens
gagacagttgcccga

SEQ ID NO: 2372248 - DNA, 21 bp, Homo sapiens
gagacagtttcttagcttttt

SEQ ID NO: 2372249 - DNA, 20 bp, Homo sapiens
gagaccctgccacagccaga

SEQ ID NO: 2372250 - DNA, 16 bp, Homo sapiens
gagacgccactccctg

SEQ ID NO: 2372251 - DNA, 20 bp, Homo sapiens
gagacgccactccctgggac

SEQ ID NO: 2372252 - DNA, 21 bp, Homo sapiens
gagacgccactccctgggaca

SEQ ID NO: 2372253 - DNA, 18 bp, Homo sapiens
gagactcaaaaaaacaaa

SEQ ID NO: 2372254 - DNA, 11 bp, Homo sapiens
gagactgcccc

SEQ ID NO: 2372255 - DNA, 12 bp, Homo sapiens
gagagagaggac

SEQ ID NO: 2372256 - DNA, 13 bp, Homo sapiens
gagagagaggaca

SEQ ID NO: 2372257 - DNA, 10 bp, Homo sapiens
gagagcagct

SEQ ID NO: 2372258 - DNA, 20 bp, Homo sapiens
gagagcagctccctttctca

SEQ ID NO: 2372259 - DNA, 21 bp, Homo sapiens
gagagcagctccctttctcag

SEQ ID NO: 2372260 - DNA, 22 bp, Homo sapiens
gagagcagctccctttctcagg

SEQ ID NO: 2372261 - DNA, 14 bp, Homo sapiens
gagagcagctggct

SEQ ID NO: 2372262 - DNA, 12 bp, Homo sapiens
gagagcataatt

SEQ ID NO: 2372263 - DNA, 16 bp, Homo sapiens
gagagcataatttaaa

SEQ ID NO: 2372264 - DNA, 16 bp, Homo sapiens
gagagccatacataaa

SEQ ID NO: 2372265 - DNA, 19 bp, Homo sapiens
gagagccctgaggcctaga

SEQ ID NO: 2372266 - DNA, 12 bp, Homo sapiens
gagagcctgctg

SEQ ID NO: 2372267 - DNA, 15 bp, Homo sapiens
gagaggacagcttga

SEQ ID NO: 2372268 - DNA, 18 bp, Homo sapiens
gagaggacagcttgagcc

SEQ ID NO: 2372269 - DNA, 14 bp, Homo sapiens
gagaggatgagagc

SEQ ID NO: 2372270 - DNA, 16 bp, Homo sapiens
gagaggatgagagccc

SEQ ID NO: 2372271 - DNA, 21 bp, Homo sapiens
gagaggatgagagcccagagg

SEQ ID NO: 2372272 - DNA, 18 bp, Homo sapiens
gagaggcactcagtgagc

SEQ ID NO: 2372273 - DNA, 11 bp, Homo sapiens
gagaggcaggc

SEQ ID NO: 2372274 - DNA, 21 bp, Homo sapiens
gagaggcaggcatagaggctt

SEQ ID NO: 2372275 - DNA, 14 bp, Homo sapiens
gagaggccagttga

SEQ ID NO: 2372276 - DNA, 10 bp, Homo sapiens
gagagggaga

SEQ ID NO: 2372277 - DNA, 17 bp, Homo sapiens
gagagggatttccctgc

SEQ ID NO: 2372278 - DNA, 23 bp, Homo sapiens
gagagggatttccctgcagacct

SEQ ID NO: 2372279 - DNA, 23 bp, Homo sapiens
gagagggggcctgggacttccat

SEQ ID NO: 2372280 - DNA, 16 bp, Homo sapiens
gagagtaccatgctgg

SEQ ID NO: 2372281 - DNA, 17 bp, Homo sapiens
gagagtaccatgctggc

SEQ ID NO: 2372282 - DNA, 21 bp, Homo sapiens
gagagtcagctctctgccctg

SEQ ID NO: 2372283 - DNA, 23 bp, Homo sapiens
gagataaaaggtggagtttctct

SEQ ID NO: 2372284 - DNA, 20 bp, Homo sapiens
gagatccctgcagaacccac

SEQ ID NO: 2372285 - DNA, 22 bp, Homo sapiens
gagatcgagaccatcctggcta

SEQ ID NO: 2372286 - DNA, 21 bp, Homo sapiens
gagatcgtgctactgcactcc

SEQ ID NO: 2372287 - DNA, 13 bp, Homo sapiens
gagatgagcccac

SEQ ID NO: 2372288 - DNA, 14 bp, Homo sapiens
gagatgaggagggg

SEQ ID NO: 2372289 - DNA, 21 bp, Homo sapiens
gagatgggaatgaggtgggag

SEQ ID NO: 2372290 - DNA, 14 bp, Homo sapiens
gagatttcttattt

SEQ ID NO: 2372291 - DNA, 14 bp, Homo sapiens
gagcaaaattcaaa

SEQ ID NO: 2372292 - DNA, 13 bp, Homo sapiens
gagcaaacccaga

SEQ ID NO: 2372293 - DNA, 13 bp, Homo sapiens
gagcaactctcca

SEQ ID NO: 2372294 - DNA, 22 bp, Homo sapiens
gagcacaaaattcaaagcatgg

SEQ ID NO: 2372295 - DNA, 23 bp, Homo sapiens
gagcaccgtgtcaagctgctctg

SEQ ID NO: 2372296 - DNA, 16 bp, Homo sapiens
gagcagaacaggtagt

SEQ ID NO: 2372297 - DNA, 18 bp, Homo sapiens
gagcagatgcagagagcc

SEQ ID NO: 2372298 - DNA, 15 bp, Homo sapiens
gagcagcagcttggg

SEQ ID NO: 2372299 - DNA, 14 bp, Homo sapiens
gagcagcctctgga

SEQ ID NO: 2372300 - DNA, 12 bp, Homo sapiens
gagcagctccct

SEQ ID NO: 2372301 - DNA, 15 bp, Homo sapiens
gagcagctggctctc

SEQ ID NO: 2372302 - DNA, 19 bp, Homo sapiens
gagcagctggctctccacc

SEQ ID NO: 2372303 - DNA, 12 bp, Homo sapiens
gagcagtcacaa

SEQ ID NO: 2372304 - DNA, 17 bp, Homo sapiens
gagcataatttaaaaat

SEQ ID NO: 2372305 - DNA, 20 bp, Homo sapiens
gagcataatttaaaaatata

SEQ ID NO: 2372306 - DNA, 16 bp, Homo sapiens
gagccaccgtgcctgg

SEQ ID NO: 2372307 - DNA, 19 bp, Homo sapiens
gagccacctgcaagatgga

SEQ ID NO: 2372308 - DNA, 19 bp, Homo sapiens
gagccacgcagtgcctgga

SEQ ID NO: 2372309 - DNA, 22 bp, Homo sapiens
gagccatcggtgaaactaacag

SEQ ID NO: 2372310 - DNA, 22 bp, Homo sapiens
gagccatggtgtgtttgtaata

SEQ ID NO: 2372311 - DNA, 18 bp, Homo sapiens
gagccatgtcttctccct

SEQ ID NO: 2372312 - DNA, 21 bp, Homo sapiens
gagccattttgtgaatggatt

SEQ ID NO: 2372313 - DNA, 12 bp, Homo sapiens
gagcccaccctg

SEQ ID NO: 2372314 - DNA, 21 bp, Homo sapiens
gagcccacgcccgactagcag

SEQ ID NO: 2372315 - DNA, 18 bp, Homo sapiens
gagccccagtgctggaag

SEQ ID NO: 2372316 - DNA, 18 bp, Homo sapiens
gagcccccagcagaggca

SEQ ID NO: 2372317 - DNA, 20 bp, Homo sapiens
gagcccctttgcctgtcaag

SEQ ID NO: 2372318 - DNA, 21 bp, Homo sapiens
gagcccctttgcctgtcaagt

SEQ ID NO: 2372319 - DNA, 14 bp, Homo sapiens
gagcccgcagggcc

SEQ ID NO: 2372320 - DNA, 19 bp, Homo sapiens
gagcccgcagggccatgca

SEQ ID NO: 2372321 - DNA, 16 bp, Homo sapiens
gagccctaaccccttc

SEQ ID NO: 2372322 - DNA, 18 bp, Homo sapiens
gagccctaaccccttcca

SEQ ID NO: 2372323 - DNA, 17 bp, Homo sapiens
gagccctactccctgca

SEQ ID NO: 2372324 - DNA, 19 bp, Homo sapiens
gagccctactccctgcaga

SEQ ID NO: 2372325 - DNA, 17 bp, Homo sapiens
gagccctgaggcctaga

SEQ ID NO: 2372326 - DNA, 15 bp, Homo sapiens
gagcccttgcctccc

SEQ ID NO: 2372327 - DNA, 15 bp, Homo sapiens
gagccgggccccgga

SEQ ID NO: 2372328 - DNA, 15 bp, Homo sapiens
gagccgggcccctgg

SEQ ID NO: 2372329 - DNA, 20 bp, Homo sapiens
gagcctccccatctgtccag

SEQ ID NO: 2372330 - DNA, 14 bp, Homo sapiens
gaggtcctctggag

SEQ ID NO: 2372331 - DNA, 16 bp, Homo sapiens
gaggtcctctggagcc

SEQ ID NO: 2372332 - DNA, 15 bp, Homo sapiens
gaggtgcaaggagtg

SEQ ID NO: 2372333 - DNA, 14 bp, Homo sapiens
gaggtgcactggga

SEQ ID NO: 2372334 - DNA, 21 bp, Homo sapiens
gaggtgccacccagtagccca

SEQ ID NO: 2372335 - DNA, 20 bp, Homo sapiens
gaggtgcgtgttcagcagaa

SEQ ID NO: 2372336 - DNA, 13 bp, Homo sapiens
gaggtggaagaag

SEQ ID NO: 2372337 - DNA, 15 bp, Homo sapiens
gaggtggaagaaggg

SEQ ID NO: 2372338 - DNA, 16 bp, Homo sapiens
gaggtggaagaaggga

SEQ ID NO: 2372339 - DNA, 17 bp, Homo sapiens
gaggtggaagaagggag

SEQ ID NO: 2372340 - DNA, 15 bp, Homo sapiens
gaggtggagaaaatt

SEQ ID NO: 2372341 - DNA, 15 bp, Homo sapiens
gaggtgggaggtgga

SEQ ID NO: 2372342 - DNA, 22 bp, Homo sapiens
gaggtgtcaccctgcagagcta

SEQ ID NO: 2372343 - DNA, 16 bp, Homo sapiens
gaggttcctctgcctg

SEQ ID NO: 2372344 - DNA, 15 bp, Homo sapiens
gaggttgcagtgagc

SEQ ID NO: 2372345 - DNA, 12 bp, Homo sapiens
gagtaaagcaac

SEQ ID NO: 2372346 - DNA, 20 bp, Homo sapiens
gagtattgtttaaaatgtaa

SEQ ID NO: 2372347 - DNA, 20 bp, Homo sapiens
gagtatttaggcagattgaa

SEQ ID NO: 2372348 - DNA, 14 bp, Homo sapiens
gagtatttcccttc

SEQ ID NO: 2372349 - DNA, 12 bp, Homo sapiens
gagtattttaag

SEQ ID NO: 2372350 - DNA, 14 bp, Homo sapiens
gagtcaccttttct

SEQ ID NO: 2372351 - DNA, 14 bp, Homo sapiens
gagtcagctctctg

SEQ ID NO: 2372352 - DNA, 17 bp, Homo sapiens
gagtcagctctctgccc

SEQ ID NO: 2372353 - DNA, 14 bp, Homo sapiens
gagtcatggctaat

SEQ ID NO: 2372354 - DNA, 19 bp, Homo sapiens
gagtccagggtttctctgc

SEQ ID NO: 2372355 - DNA, 18 bp, Homo sapiens
gagtccagtgctctgcct

SEQ ID NO: 2372356 - DNA, 16 bp, Homo sapiens
gagtccattctcccag

SEQ ID NO: 2372357 - DNA, 18 bp, Homo sapiens
gagtccattctcccaggt

SEQ ID NO: 2372358 - DNA, 16 bp, Homo sapiens
gagtccggatttctaa

SEQ ID NO: 2372359 - DNA, 17 bp, Homo sapiens
gagtccggatttctaac

SEQ ID NO: 2372360 - DNA, 17 bp, Homo sapiens
gagtctcatttgggcta

SEQ ID NO: 2372361 - DNA, 21 bp, Homo sapiens
gagtctggggacctggcactg

SEQ ID NO: 2372362 - DNA, 20 bp, Homo sapiens
gagtgatttgtaaaacagtg

SEQ ID NO: 2372363 - DNA, 16 bp, Homo sapiens
gagtgcagccttctcc

SEQ ID NO: 2372364 - DNA, 11 bp, Homo sapiens
gagtggcccac

SEQ ID NO: 2372365 - DNA, 16 bp, Homo sapiens
gagtggcctgtagtcc

SEQ ID NO: 2372366 - DNA, 14 bp, Homo sapiens
gagtgggtgggatg

SEQ ID NO: 2372367 - DNA, 13 bp, Homo sapiens
gagtgtacaagta

SEQ ID NO: 2372368 - DNA, 15 bp, Homo sapiens
gagtgtagaagcatt

SEQ ID NO: 2372369 - DNA, 20 bp, Homo sapiens
gagtgtagaagcattccttc

SEQ ID NO: 2372370 - DNA, 14 bp, Homo sapiens
gagtgtgtctgctg

SEQ ID NO: 2372371 - DNA, 13 bp, Homo sapiens
gagttaaaatgca

SEQ ID NO: 2372372 - DNA, 21 bp, Homo sapiens
gagttaagaagctgttgtaca

SEQ ID NO: 2372373 - DNA, 20 bp, Homo sapiens
gagttcaccttggaagggcg

SEQ ID NO: 2372374 - DNA, 18 bp, Homo sapiens
gagttgctgcaaacctga

SEQ ID NO: 2372375 - DNA, 12 bp, Homo sapiens
gagtttctctgt

SEQ ID NO: 2372376 - DNA, 17 bp, Homo sapiens
gagtttgagctgccttc

SEQ ID NO: 2372377 - DNA, 12 bp, Homo sapiens
gagtttttcctc

SEQ ID NO: 2372378 - DNA, 13 bp, Homo sapiens
gagtttttcctcc

SEQ ID NO: 2372379 - DNA, 14 bp, Homo sapiens
gagtttttcctccc

SEQ ID NO: 2372380 - DNA, 20 bp, Homo sapiens
gataaaacagaatcttctgg

SEQ ID NO: 2372381 - DNA, 22 bp, Homo sapiens
gataaaaggtggagtttctctg

SEQ ID NO: 2372382 - DNA, 18 bp, Homo sapiens
gataaagaccagaaattc

SEQ ID NO: 2372383 - DNA, 14 bp, Homo sapiens
gataacataaataa

SEQ ID NO: 2372384 - DNA, 15 bp, Homo sapiens
gataactagccagac

SEQ ID NO: 2372385 - DNA, 16 bp, Homo sapiens
gataactttacagaaa

SEQ ID NO: 2372386 - DNA, 19 bp, Homo sapiens
gataactttacagaaatgg

SEQ ID NO: 2372387 - DNA, 12 bp, Homo sapiens
gataatatataa

SEQ ID NO: 2372388 - DNA, 17 bp, Homo sapiens
gataatatataaacaat

SEQ ID NO: 2372389 - DNA, 12 bp, Homo sapiens
gataatgttaaa

SEQ ID NO: 2372390 - DNA, 13 bp, Homo sapiens
gataatgttaaat

SEQ ID NO: 2372391 - DNA, 15 bp, Homo sapiens
gataatttcagggtg

SEQ ID NO: 2372392 - DNA, 15 bp, Homo sapiens
gatacaataaaacaa

SEQ ID NO: 2372393 - DNA, 19 bp, Homo sapiens
gatacaggagagaagctgg

SEQ ID NO: 2372394 - DNA, 18 bp, Homo sapiens
gataccttcttatttaat

SEQ ID NO: 2372395 - DNA, 20 bp, Homo sapiens
gataccttcttatttaatct

SEQ ID NO: 2372396 - DNA, 13 bp, Homo sapiens
gatactggcacag

SEQ ID NO: 2372397 - DNA, 16 bp, Homo sapiens
gatactggcacagagg

SEQ ID NO: 2372398 - DNA, 19 bp, Homo sapiens
gatacttcccacaccacaa

SEQ ID NO: 2372399 - DNA, 20 bp, Homo sapiens
gatactttagtacaatttca

SEQ ID NO: 2372400 - DNA, 21 bp, Homo sapiens
gatagacgagttgatttcctc

SEQ ID NO: 2372401 - DNA, 16 bp, Homo sapiens
gatataccaaattaaa

SEQ ID NO: 2372402 - DNA, 21 bp, Homo sapiens
gatatagttttacttttaaac

SEQ ID NO: 2372403 - DNA, 24 bp, Homo sapiens
gatatagttttacttttaaactgt

SEQ ID NO: 2372404 - DNA, 14 bp, Homo sapiens
gatatattttacaa

SEQ ID NO: 2372405 - DNA, 14 bp, Homo sapiens
gatatcctctcccc

SEQ ID NO: 2372406 - DNA, 14 bp, Homo sapiens
gatatggcagaaga

SEQ ID NO: 2372407 - DNA, 20 bp, Homo sapiens
gatatgtattcttttctcag

SEQ ID NO: 2372408 - DNA, 13 bp, Homo sapiens
gatattatttctt

SEQ ID NO: 2372409 - DNA, 15 bp, Homo sapiens
gatattgtatctcct

SEQ ID NO: 2372410 - DNA, 16 bp, Homo sapiens
gatattgtgaagtaca

SEQ ID NO: 2372411 - DNA, 20 bp, Homo sapiens
gatcaagaaaaaaagggaga

SEQ ID NO: 2372412 - DNA, 23 bp, Homo sapiens
gatcaccgactgaaaatattgtt

SEQ ID NO: 2372413 - DNA, 15 bp, Homo sapiens
gatcactgccacact

SEQ ID NO: 2372414 - DNA, 16 bp, Homo sapiens
gatcactgccacactc

SEQ ID NO: 2372415 - DNA, 19 bp, Homo sapiens
gatcagacatacagctgcc

SEQ ID NO: 2372416 - DNA, 20 bp, Homo sapiens
gatcagacatacagctgcct

SEQ ID NO: 2372417 - DNA, 16 bp, Homo sapiens
gatcagagttcctcct

SEQ ID NO: 2372418 - DNA, 11 bp, Homo sapiens
gatcagcctcc

SEQ ID NO: 2372419 - DNA, 15 bp, Homo sapiens
gatcatagctcactg

SEQ ID NO: 2372420 - DNA, 20 bp, Homo sapiens
gatcatagctcactgcagcc

SEQ ID NO: 2372421 - DNA, 22 bp, Homo sapiens
gatcatagctcactgcagcctc

SEQ ID NO: 2372422 - DNA, 21 bp, Homo sapiens
gatcatcaacaagatttcctt

SEQ ID NO: 2372423 - DNA, 15 bp, Homo sapiens
gatcatggtgtaata

SEQ ID NO: 2372424 - DNA, 20 bp, Homo sapiens
gatcatggtgtaataagaca

SEQ ID NO: 2372425 - DNA, 22 bp, Homo sapiens
gatcattacatggctgtggttc

SEQ ID NO: 2372426 - DNA, 13 bp, Homo sapiens
gatccagaagagc

SEQ ID NO: 2372427 - DNA, 16 bp, Homo sapiens
gatccagaagagccca

SEQ ID NO: 2372428 - DNA, 14 bp, Homo sapiens
gatccagagagcag

SEQ ID NO: 2372429 - DNA, 19 bp, Homo sapiens
gatccagagagcagctccc

SEQ ID NO: 2372430 - DNA, 14 bp, Homo sapiens
gatccccgcctggc

SEQ ID NO: 2372431 - DNA, 17 bp, Homo sapiens
gatccccgcctggccag

SEQ ID NO: 2372432 - DNA, 20 bp, Homo sapiens
gatcctggttaccactcttt

SEQ ID NO: 2372433 - DNA, 15 bp, Homo sapiens
gatccttcagcacag

SEQ ID NO: 2372434 - DNA, 15 bp, Homo sapiens
gatcggactctgccc

SEQ ID NO: 2372435 - DNA, 19 bp, Homo sapiens
gatcggactctgcccctgg

SEQ ID NO: 2372436 - DNA, 22 bp, Homo sapiens
gatcggccatcaagggaagaac

SEQ ID NO: 2372437 - DNA, 18 bp, Homo sapiens
gatctaaaaaaatgtttt

SEQ ID NO: 2372438 - DNA, 16 bp, Homo sapiens
gatctcagctttgaga

SEQ ID NO: 2372439 - DNA, 14 bp, Homo sapiens
gatctctcctggcc

SEQ ID NO: 2372440 - DNA, 12 bp, Homo sapiens
gatctctgctta

SEQ ID NO: 2372441 - DNA, 21 bp, Homo sapiens
gatctgagaacacgttgccag

SEQ ID NO: 2372442 - DNA, 19 bp, Homo sapiens
gatctgcggatctcagctt

SEQ ID NO: 2372443 - DNA, 16 bp, Homo sapiens
gatctgctctgtttta

SEQ ID NO: 2372444 - DNA, 23 bp, Homo sapiens
gatctgggcattttcctcctctg

SEQ ID NO: 2372445 - DNA, 17 bp, Homo sapiens
gatctgttgtaatatca

SEQ ID NO: 2372446 - DNA, 22 bp, Homo sapiens
gcaaacccagaggtggatgtta

SEQ ID NO: 2372447 - DNA, 23 bp, Homo sapiens
gcaaaccctcccagaaacatctc

SEQ ID NO: 2372448 - DNA, 14 bp, Homo sapiens
gcaaacgctaaaga

SEQ ID NO: 2372449 - DNA, 22 bp, Homo sapiens
gcaaactaaccagcattcccta

SEQ ID NO: 2372450 - DNA, 22 bp, Homo sapiens
gcaaactgggaacccctttccc

SEQ ID NO: 2372451 - DNA, 14 bp, Homo sapiens
gcaaagagacattt

SEQ ID NO: 2372452 - DNA, 20 bp, Homo sapiens
gcaaagctttggctgagacc

SEQ ID NO: 2372453 - DNA, 13 bp, Homo sapiens
gcaaaggggacag

SEQ ID NO: 2372454 - DNA, 14 bp, Homo sapiens
gcaaaggggacagc

SEQ ID NO: 2372455 - DNA, 19 bp, Homo sapiens
gcaaaggggacagctgtgt

SEQ ID NO: 2372456 - DNA, 21 bp, Homo sapiens
gcaaatgggagctgagcagcc

SEQ ID NO: 2372457 - DNA, 23 bp, Homo sapiens
gcaaatgttaaaagttttatatg

SEQ ID NO: 2372458 - DNA, 20 bp, Homo sapiens
gcaaatgttgggaaagtatt

SEQ ID NO: 2372459 - DNA, 17 bp, Homo sapiens
gcaaattttgtattatt

SEQ ID NO: 2372460 - DNA, 21 bp, Homo sapiens
gcaacaacaattggtaaaact

SEQ ID NO: 2372461 - DNA, 15 bp, Homo sapiens
gcaacagcctttgaa

SEQ ID NO: 2372462 - DNA, 12 bp, Homo sapiens
gcaacctcacct

SEQ ID NO: 2372463 - DNA, 19 bp, Homo sapiens
gcaactaatgtttgaacaa

SEQ ID NO: 2372464 - DNA, 20 bp, Homo sapiens
gcaactaatgtttgaacaaa

SEQ ID NO: 2372465 - DNA, 20 bp, Homo sapiens
gcaactcaagttataggaaa

SEQ ID NO: 2372466 - DNA, 21 bp, Homo sapiens
gcaagaaatggcgtctgctct

SEQ ID NO: 2372467 - DNA, 22 bp, Homo sapiens
gcaagaaatggcgtctgctctg

SEQ ID NO: 2372468 - DNA, 18 bp, Homo sapiens
gcaagaggcaagctgaaa

SEQ ID NO: 2372469 - DNA, 20 bp, Homo sapiens
gcaagagggggtggaggggt

SEQ ID NO: 2372470 - DNA, 22 bp, Homo sapiens
gcaagagggggtggaggggtgt

SEQ ID NO: 2372471 - DNA, 23 bp, Homo sapiens
gcaagagggggtggaggggtgtg

SEQ ID NO: 2372472 - DNA, 21 bp, Homo sapiens
gcaagatggacacgagccaca

SEQ ID NO: 2372473 - DNA, 14 bp, Homo sapiens
gcaagatgtgaatt

SEQ ID NO: 2372474 - DNA, 15 bp, Homo sapiens
gcaagatgtgaatta

SEQ ID NO: 2372475 - DNA, 19 bp, Homo sapiens
gcaagcagctggtcagtct

SEQ ID NO: 2372476 - DNA, 17 bp, Homo sapiens
gcaagccacaggaagga

SEQ ID NO: 2372477 - DNA, 19 bp, Homo sapiens
gcaagccacaggaaggagg

SEQ ID NO: 2372478 - DNA, 11 bp, Homo sapiens
gcaagccagac

SEQ ID NO: 2372479 - DNA, 19 bp, Homo sapiens
gcaagcctaagggatcctg

SEQ ID NO: 2372480 - DNA, 14 bp, Homo sapiens
gcaagctgaaattt

SEQ ID NO: 2372481 - DNA, 22 bp, Homo sapiens
gcaaggggttcccttgagggct

SEQ ID NO: 2372482 - DNA, 17 bp, Homo sapiens
gcaagtgttcactgctc

SEQ ID NO: 2372483 - DNA, 12 bp, Homo sapiens
gcaataaaattt

SEQ ID NO: 2372484 - DNA, 13 bp, Homo sapiens
gcaataaaattta

SEQ ID NO: 2372485 - DNA, 13 bp, Homo sapiens
gcaataaagtata

SEQ ID NO: 2372486 - DNA, 22 bp, Homo sapiens
gcaatctgaccctatgggtcta

SEQ ID NO: 2372487 - DNA, 19 bp, Homo sapiens
gcacaaaaaatttaagaga

SEQ ID NO: 2372488 - DNA, 17 bp, Homo sapiens
gcacaataaaaatgttt

SEQ ID NO: 2372489 - DNA, 15 bp, Homo sapiens
gcacacacagcccct

SEQ ID NO: 2372490 - DNA, 17 bp, Homo sapiens
gcacagaagcacatgca

SEQ ID NO: 2372491 - DNA, 13 bp, Homo sapiens
gcacagagcaagt

SEQ ID NO: 2372492 - DNA, 11 bp, Homo sapiens
gcacagagcct

SEQ ID NO: 2372493 - DNA, 14 bp, Homo sapiens
gcacagagcctggc

SEQ ID NO: 2372494 - DNA, 15 bp, Homo sapiens
gcacagagcctggcc

SEQ ID NO: 2372495 - DNA, 15 bp, Homo sapiens
gcacagctcaggagg

SEQ ID NO: 2372496 - DNA, 23 bp, Homo sapiens
gcacagtttttgtaaagcccttg

SEQ ID NO: 2372497 - DNA, 20 bp, Homo sapiens
gcacatgtcttgtacatgtg

SEQ ID NO: 2372498 - DNA, 20 bp, Homo sapiens
gcaccatactccttgcttcc

SEQ ID NO: 2372499 - DNA, 23 bp, Homo sapiens
gcaccatactccttgcttcctga

SEQ ID NO: 2372500 - DNA, 18 bp, Homo sapiens
gcacccaccgtggaggag

SEQ ID NO: 2372501 - DNA, 19 bp, Homo sapiens
gcacccaccgtggaggagg

SEQ ID NO: 2372502 - DNA, 22 bp, Homo sapiens
gcacccacctgttttctgaaac

SEQ ID NO: 2372503 - DNA, 14 bp, Homo sapiens
gcacccctgggcca

SEQ ID NO: 2372504 - DNA, 12 bp, Homo sapiens
gcaccccttctc

SEQ ID NO: 2372505 - DNA, 13 bp, Homo sapiens
gcaccccttctct

SEQ ID NO: 2372506 - DNA, 18 bp, Homo sapiens
gcaccccttctctcctcc

SEQ ID NO: 2372507 - DNA, 20 bp, Homo sapiens
gcaccgtgtcaagctgctct

SEQ ID NO: 2372508 - DNA, 21 bp, Homo sapiens
gcaccgtgtcaagctgctctg

SEQ ID NO: 2372509 - DNA, 15 bp, Homo sapiens
gcacctccagcctga

SEQ ID NO: 2372510 - DNA, 16 bp, Homo sapiens
gcacctgacttggctg

SEQ ID NO: 2372511 - DNA, 11 bp, Homo sapiens
gcacctgctgg

SEQ ID NO: 2372512 - DNA, 23 bp, Homo sapiens
gcacctgctggaaaccacacttc

SEQ ID NO: 2372513 - DNA, 16 bp, Homo sapiens
gcaccttcagggctga

SEQ ID NO: 2372514 - DNA, 22 bp, Homo sapiens
gcaccttgtgtctgtacacgtg

SEQ ID NO: 2372515 - DNA, 13 bp, Homo sapiens
gcacgcctgctgg

SEQ ID NO: 2372516 - DNA, 14 bp, Homo sapiens
gcacgctcgctgcc

SEQ ID NO: 2372517 - DNA, 16 bp, Homo sapiens
gcacgctcgctgccat

SEQ ID NO: 2372518 - DNA, 13 bp, Homo sapiens
gcacgggtggtcc

SEQ ID NO: 2372519 - DNA, 14 bp, Homo sapiens
gcactccagcctgg

SEQ ID NO: 2372520 - DNA, 18 bp, Homo sapiens
gcactccgcgccgatgcc

SEQ ID NO: 2372521 - DNA, 23 bp, Homo sapiens
gcactccgcgccgatgccaccgg

SEQ ID NO: 2372522 - DNA, 19 bp, Homo sapiens
gcactgagctcacatggga

SEQ ID NO: 2372523 - DNA, 23 bp, Homo sapiens
gcactgagctcacatgggactgg

SEQ ID NO: 2372524 - DNA, 21 bp, Homo sapiens
gcactgcccacatgggacctg

SEQ ID NO: 2372525 - DNA, 15 bp, Homo sapiens
gcactggcgaggaga

SEQ ID NO: 2372526 - DNA, 16 bp, Homo sapiens
gcactggcgaggagag

SEQ ID NO: 2372527 - DNA, 11 bp, Homo sapiens
gcactgggagg

SEQ ID NO: 2372528 - DNA, 19 bp, Homo sapiens
gcacttattgaccattttt

SEQ ID NO: 2372529 - DNA, 22 bp, Homo sapiens
gcactttgggaggccgaggcgg

SEQ ID NO: 2372530 - DNA, 16 bp, Homo sapiens
gcagaaacttggatgt

SEQ ID NO: 2372531 - DNA, 23 bp, Homo sapiens
gcagaacaggtagtattacacca

SEQ ID NO: 2372532 - DNA, 15 bp, Homo sapiens
gcagaacctgcacac

SEQ ID NO: 2372533 - DNA, 18 bp, Homo sapiens
gcagaagacaccagagca

SEQ ID NO: 2372534 - DNA, 21 bp, Homo sapiens
gcagaagtctggctttgctct

SEQ ID NO: 2372535 - DNA, 23 bp, Homo sapiens
gcagaagtctggctttgctctat

SEQ ID NO: 2372536 - DNA, 17 bp, Homo sapiens
gcagacattttaaaaaa

SEQ ID NO: 2372537 - DNA, 17 bp, Homo sapiens
gcagacctcaagccatc

SEQ ID NO: 2372538 - DNA, 21 bp, Homo sapiens
gcagagaaacttaagcaaagg

SEQ ID NO: 2372539 - DNA, 21 bp, Homo sapiens
gcagagagccattttgtgaat

SEQ ID NO: 2372540 - DNA, 19 bp, Homo sapiens
gcagagccttctcagaagc

SEQ ID NO: 2372541 - DNA, 19 bp, Homo sapiens
gcagagctggagcccccag

SEQ ID NO: 2372542 - DNA, 13 bp, Homo sapiens
gcagaggacgcac

SEQ ID NO: 2372543 - DNA, 15 bp, Homo sapiens
gcagaggcaggctgg

SEQ ID NO: 2372544 - DNA, 17 bp, Homo sapiens
gcagaggcaggctggga

SEQ ID NO: 2372545 - DNA, 16 bp, Homo sapiens
gcagagggagaatcca

SEQ ID NO: 2372546 - DNA, 18 bp, Homo sapiens
gcagatgcagagagccat

SEQ ID NO: 2372547 - DNA, 14 bp, Homo sapiens
gcagatgccaccct

SEQ ID NO: 2372548 - DNA, 18 bp, Homo sapiens
gcagatgtcttccctggg

SEQ ID NO: 2372549 - DNA, 19 bp, Homo sapiens
gcagatgtcttccctgggc

SEQ ID NO: 2372550 - DNA, 23 bp, Homo sapiens
gcagatgtgagccaccgtgcctg

SEQ ID NO: 2372551 - DNA, 17 bp, Homo sapiens
gcagattgaaaaggaca

SEQ ID NO: 2372552 - DNA, 15 bp, Homo sapiens
gcagcacaggagggc

SEQ ID NO: 2372553 - DNA, 16 bp, Homo sapiens
gcagcaccacactggg

SEQ ID NO: 2372554 - DNA, 20 bp, Homo sapiens
gcagcagcccaagcttccct

SEQ ID NO: 2372555 - DNA, 12 bp, Homo sapiens
gcagcatcttct

SEQ ID NO: 2372556 - DNA, 15 bp, Homo sapiens
gcagcccaccagacg

SEQ ID NO: 2372557 - DNA, 18 bp, Homo sapiens
gcagcccagcagtgtgga

SEQ ID NO: 2372558 - DNA, 15 bp, Homo sapiens
gcagcccaggcggtt

SEQ ID NO: 2372559 - DNA, 20 bp, Homo sapiens
gcagcctctcagtgccctcc

SEQ ID NO: 2372560 - DNA, 13 bp, Homo sapiens
gccacactgatgg

SEQ ID NO: 2372561 - DNA, 12 bp, Homo sapiens
gccacagccaga

SEQ ID NO: 2372562 - DNA, 14 bp, Homo sapiens
gccacagccagagg

SEQ ID NO: 2372563 - DNA, 16 bp, Homo sapiens
gccacagcgccagcct

SEQ ID NO: 2372564 - DNA, 16 bp, Homo sapiens
gccacagctgctgttc

SEQ ID NO: 2372565 - DNA, 17 bp, Homo sapiens
gccacagctgctgttct

SEQ ID NO: 2372566 - DNA, 20 bp, Homo sapiens
gccacagtgggatgaaccag

SEQ ID NO: 2372567 - DNA, 14 bp, Homo sapiens
gccaccaaagctgc

SEQ ID NO: 2372568 - DNA, 13 bp, Homo sapiens
gccaccacagagg

SEQ ID NO: 2372569 - DNA, 20 bp, Homo sapiens
gccaccacttccagagccag

SEQ ID NO: 2372570 - DNA, 12 bp, Homo sapiens
gccaccagcccc

SEQ ID NO: 2372571 - DNA, 22 bp, Homo sapiens
gccaccagcccccgccccagag

SEQ ID NO: 2372572 - DNA, 12 bp, Homo sapiens
gccaccctagcc

SEQ ID NO: 2372573 - DNA, 23 bp, Homo sapiens
gccaccggcctgtgggtctctga

SEQ ID NO: 2372574 - DNA, 14 bp, Homo sapiens
gccaccgtgcctgg

SEQ ID NO: 2372575 - DNA, 17 bp, Homo sapiens
gccaccgtgcctggcca

SEQ ID NO: 2372576 - DNA, 18 bp, Homo sapiens
gccaccgtgcctggccag

SEQ ID NO: 2372577 - DNA, 19 bp, Homo sapiens
gccaccgtgcctggccaga

SEQ ID NO: 2372578 - DNA, 17 bp, Homo sapiens
gccacctctttaaaaac

SEQ ID NO: 2372579 - DNA, 20 bp, Homo sapiens
gccacctggctctcacctct

SEQ ID NO: 2372580 - DNA, 18 bp, Homo sapiens
gccactgacttgctgtgt

SEQ ID NO: 2372581 - DNA, 20 bp, Homo sapiens
gccactgacttgctgtgtga

SEQ ID NO: 2372582 - DNA, 15 bp, Homo sapiens
gccactgtgttcctt

SEQ ID NO: 2372583 - DNA, 16 bp, Homo sapiens
gccactgtgttccttc

SEQ ID NO: 2372584 - DNA, 22 bp, Homo sapiens
gccactttacccacctagaaca

SEQ ID NO: 2372585 - DNA, 16 bp, Homo sapiens
gccagagccccaagca

SEQ ID NO: 2372586 - DNA, 17 bp, Homo sapiens
gccagagccccaagcag

SEQ ID NO: 2372587 - DNA, 19 bp, Homo sapiens
gccagaggaatcctggcag

SEQ ID NO: 2372588 - DNA, 13 bp, Homo sapiens
gccagaggctggg

SEQ ID NO: 2372589 - DNA, 13 bp, Homo sapiens
gccagagtcacct

SEQ ID NO: 2372590 - DNA, 14 bp, Homo sapiens
gccagatgccctgt

SEQ ID NO: 2372591 - DNA, 15 bp, Homo sapiens
gccagattctgcctc

SEQ ID NO: 2372592 - DNA, 11 bp, Homo sapiens
gccagcaaata

SEQ ID NO: 2372593 - DNA, 13 bp, Homo sapiens
gccagcagcagca

SEQ ID NO: 2372594 - DNA, 15 bp, Homo sapiens
gccagcagcagcagg

SEQ ID NO: 2372595 - DNA, 16 bp, Homo sapiens
gccagcagcagcaggt

SEQ ID NO: 2372596 - DNA, 22 bp, Homo sapiens
gccagccaagctttaaattatg

SEQ ID NO: 2372597 - DNA, 16 bp, Homo sapiens
gccagcccctggggcc

SEQ ID NO: 2372598 - DNA, 18 bp, Homo sapiens
gccagcctccgagaggga

SEQ ID NO: 2372599 - DNA, 21 bp, Homo sapiens
gccagcctccgagagggagag

SEQ ID NO: 2372600 - DNA, 14 bp, Homo sapiens
gccagcctcctctg

SEQ ID NO: 2372601 - DNA, 17 bp, Homo sapiens
gccagccttgagccctg

SEQ ID NO: 2372602 - DNA, 19 bp, Homo sapiens
gccagccttgagccctggc

SEQ ID NO: 2372603 - DNA, 16 bp, Homo sapiens
gccagcggggctgctc

SEQ ID NO: 2372604 - DNA, 15 bp, Homo sapiens
gccagctgccctatg

SEQ ID NO: 2372605 - DNA, 20 bp, Homo sapiens
gccagctgccctatgggcct

SEQ ID NO: 2372606 - DNA, 22 bp, Homo sapiens
gccagctgccctatgggcctgc

SEQ ID NO: 2372607 - DNA, 13 bp, Homo sapiens
gccagctggcctt

SEQ ID NO: 2372608 - DNA, 16 bp, Homo sapiens
gccagctggcctttgt

SEQ ID NO: 2372609 - DNA, 22 bp, Homo sapiens
gccagcttggggccaccaaagc

SEQ ID NO: 2372610 - DNA, 17 bp, Homo sapiens
gccaggaagccagagcc

SEQ ID NO: 2372611 - DNA, 20 bp, Homo sapiens
gccaggaagccagagcccca

SEQ ID NO: 2372612 - DNA, 19 bp, Homo sapiens
gccaggatcatggtgtaat

SEQ ID NO: 2372613 - DNA, 24 bp, Homo sapiens
gccaggatcatggtgtaataagac

SEQ ID NO: 2372614 - DNA, 20 bp, Homo sapiens
gccaggcacacacagcccct

SEQ ID NO: 2372615 - DNA, 10 bp, Homo sapiens
gccaggcaga

SEQ ID NO: 2372616 - DNA, 17 bp, Homo sapiens
gccaggcaggggtgggg

SEQ ID NO: 2372617 - DNA, 14 bp, Homo sapiens
gccaggccagcctc

SEQ ID NO: 2372618 - DNA, 13 bp, Homo sapiens
gccaggcctggct

SEQ ID NO: 2372619 - DNA, 14 bp, Homo sapiens
gccagggcagggtc

SEQ ID NO: 2372620 - DNA, 18 bp, Homo sapiens
gccaggggcttgagaagg

SEQ ID NO: 2372621 - DNA, 22 bp, Homo sapiens
gccaggtggttgtcttattgca

SEQ ID NO: 2372622 - DNA, 23 bp, Homo sapiens
gccagtaaaatactattgcctca

SEQ ID NO: 2372623 - DNA, 23 bp, Homo sapiens
gccagtacagagaaattctgtgg

SEQ ID NO: 2372624 - DNA, 16 bp, Homo sapiens
gccagtaggagaaatc

SEQ ID NO: 2372625 - DNA, 17 bp, Homo sapiens
gccagtatttttaaagg

SEQ ID NO: 2372626 - DNA, 21 bp, Homo sapiens
gccagtccccatttctgcctc

SEQ ID NO: 2372627 - DNA, 23 bp, Homo sapiens
gccagtgacctttgacctcggtg

SEQ ID NO: 2372628 - DNA, 15 bp, Homo sapiens
gccagttgatctgct

SEQ ID NO: 2372629 - DNA, 17 bp, Homo sapiens
gccagttgatctgctct

SEQ ID NO: 2372630 - DNA, 22 bp, Homo sapiens
gccagttgatctgctctgtttt

SEQ ID NO: 2372631 - DNA, 22 bp, Homo sapiens
gccataaacggttcctggtgac

SEQ ID NO: 2372632 - DNA, 23 bp, Homo sapiens
gccataaacggttcctggtgact

SEQ ID NO: 2372633 - DNA, 17 bp, Homo sapiens
gccatagaccctgaggc

SEQ ID NO: 2372634 - DNA, 19 bp, Homo sapiens
gccatagaccctgaggccc

SEQ ID NO: 2372635 - DNA, 14 bp, Homo sapiens
gccatcaccgctgg

SEQ ID NO: 2372636 - DNA, 23 bp, Homo sapiens
gccatcatgcggtgggtgctgcc

SEQ ID NO: 2372637 - DNA, 21 bp, Homo sapiens
gccatcctcaaacgacagagg

SEQ ID NO: 2372638 - DNA, 13 bp, Homo sapiens
gccatcctccctc

SEQ ID NO: 2372639 - DNA, 14 bp, Homo sapiens
gccatctaaagtaa

SEQ ID NO: 2372640 - DNA, 23 bp, Homo sapiens
gccatctagccagcccctcttcc

SEQ ID NO: 2372641 - DNA, 18 bp, Homo sapiens
gccatctcatgaggggag

SEQ ID NO: 2372642 - DNA, 11 bp, Homo sapiens
gccatcttcag

SEQ ID NO: 2372643 - DNA, 16 bp, Homo sapiens
gccatgacagaggctg

SEQ ID NO: 2372644 - DNA, 18 bp, Homo sapiens
gccatgacagaggctgca

SEQ ID NO: 2372645 - DNA, 20 bp, Homo sapiens
gccatgcagacctcatgccc

SEQ ID NO: 2372646 - DNA, 22 bp, Homo sapiens
gccatgcagacctcatgcccag

SEQ ID NO: 2372647 - DNA, 23 bp, Homo sapiens
gccatgcagacctcatgcccagc

SEQ ID NO: 2372648 - DNA, 13 bp, Homo sapiens
gccatgcaggagg

SEQ ID NO: 2372649 - DNA, 14 bp, Homo sapiens
gccatgtccaaaga

SEQ ID NO: 2372650 - DNA, 15 bp, Homo sapiens
gccatgtccaaagag

SEQ ID NO: 2372651 - DNA, 19 bp, Homo sapiens
gccatgtcgccaaaaatac

SEQ ID NO: 2372652 - DNA, 21 bp, Homo sapiens
gccatgtcttctccctggaat

SEQ ID NO: 2372653 - DNA, 15 bp, Homo sapiens
gccatgtgaagaggg

SEQ ID NO: 2372654 - DNA, 21 bp, Homo sapiens
gccattcacttcataatccag

SEQ ID NO: 2372655 - DNA, 15 bp, Homo sapiens
gccattctgattatt

SEQ ID NO: 2372656 - DNA, 22 bp, Homo sapiens
gccatttgcaataacagctgca

SEQ ID NO: 2372657 - DNA, 14 bp, Homo sapiens
gccattttaaaatg

SEQ ID NO: 2372658 - DNA, 18 bp, Homo sapiens
gccattttgtgaatggat

SEQ ID NO: 2372659 - DNA, 17 bp, Homo sapiens
gccattttttgaggaga

SEQ ID NO: 2372660 - DNA, 14 bp, Homo sapiens
gcccaagcttccct

SEQ ID NO: 2372661 - DNA, 20 bp, Homo sapiens
gcccaagcttccctccatcc

SEQ ID NO: 2372662 - DNA, 14 bp, Homo sapiens
gcccaatgaattat

SEQ ID NO: 2372663 - DNA, 14 bp, Homo sapiens
gcccaccagacgtc

SEQ ID NO: 2372664 - DNA, 16 bp, Homo sapiens
gcccaccatctgtttg

SEQ ID NO: 2372665 - DNA, 19 bp, Homo sapiens
gcccaccccctgccctgca

SEQ ID NO: 2372666 - DNA, 15 bp, Homo sapiens
gcccacctgccggcc

SEQ ID NO: 2372667 - DNA, 15 bp, Homo sapiens
gcccacgcagaggac

SEQ ID NO: 2372668 - DNA, 19 bp, Homo sapiens
gcccacgcagaggacgcac

SEQ ID NO: 2372669 - DNA, 20 bp, Homo sapiens
gcccagaaagcctctctctc

SEQ ID NO: 2372670 - DNA, 22 bp, Homo sapiens
gcccagaggtaacagaacagct

SEQ ID NO: 2372671 - DNA, 12 bp, Homo sapiens
gcccagagtgag

SEQ ID NO: 2372672 - DNA, 16 bp, Homo sapiens
gcccagcccatggaga

SEQ ID NO: 2372673 - DNA, 17 bp, Homo sapiens
gcccagccccactcctc

SEQ ID NO: 2372674 - DNA, 21 bp, Homo sapiens
gcccagcccctactgctgtga

SEQ ID NO: 2372675 - DNA, 15 bp, Homo sapiens
gcctccaagcacaga

SEQ ID NO: 2372676 - DNA, 12 bp, Homo sapiens
gcctccacagcg

SEQ ID NO: 2372677 - DNA, 22 bp, Homo sapiens
gcctccacagcgagggcagctg

SEQ ID NO: 2372678 - DNA, 15 bp, Homo sapiens
gcctcccaggcaagc

SEQ ID NO: 2372679 - DNA, 13 bp, Homo sapiens
gcctccccatctg

SEQ ID NO: 2372680 - DNA, 22 bp, Homo sapiens
gcctccccatttcccatctgca

SEQ ID NO: 2372681 - DNA, 15 bp, Homo sapiens
gcctccgagagggag

SEQ ID NO: 2372682 - DNA, 17 bp, Homo sapiens
gcctccgcagtgtctcc

SEQ ID NO: 2372683 - DNA, 16 bp, Homo sapiens
gcctcctggaggacca

SEQ ID NO: 2372684 - DNA, 13 bp, Homo sapiens
gcctcctgtgcct

SEQ ID NO: 2372685 - DNA, 16 bp, Homo sapiens
gcctcctgtgcctggc

SEQ ID NO: 2372686 - DNA, 21 bp, Homo sapiens
gcctcctgtgcctggccccag

SEQ ID NO: 2372687 - DNA, 12 bp, Homo sapiens
gcctccttctga

SEQ ID NO: 2372688 - DNA, 19 bp, Homo sapiens
gcctctcagtgccctccag

SEQ ID NO: 2372689 - DNA, 19 bp, Homo sapiens
gcctctcatcaactgaatg

SEQ ID NO: 2372690 - DNA, 16 bp, Homo sapiens
gcctctccaaccactg

SEQ ID NO: 2372691 - DNA, 15 bp, Homo sapiens
gcctctcccaggctg

SEQ ID NO: 2372692 - DNA, 14 bp, Homo sapiens
gcctctctacagtc

SEQ ID NO: 2372693 - DNA, 14 bp, Homo sapiens
gcctctctctccct

SEQ ID NO: 2372694 - DNA, 14 bp, Homo sapiens
gcctctgcccgcag

SEQ ID NO: 2372695 - DNA, 22 bp, Homo sapiens
gcctctgcccgcagagcccacg

SEQ ID NO: 2372696 - DNA, 20 bp, Homo sapiens
gcctctggacagccagtgac

SEQ ID NO: 2372697 - DNA, 21 bp, Homo sapiens
gcctcttccagtcttcctgac

SEQ ID NO: 2372698 - DNA, 14 bp, Homo sapiens
gcctcttccagtga

SEQ ID NO: 2372699 - DNA, 16 bp, Homo sapiens
gcctcttctgtccctg

SEQ ID NO: 2372700 - DNA, 16 bp, Homo sapiens
gcctcttgtaaagact

SEQ ID NO: 2372701 - DNA, 12 bp, Homo sapiens
gcctctttccct

SEQ ID NO: 2372702 - DNA, 15 bp, Homo sapiens
gcctgaacagaagct

SEQ ID NO: 2372703 - DNA, 15 bp, Homo sapiens
gcctgaagccagctg

SEQ ID NO: 2372704 - DNA, 19 bp, Homo sapiens
gcctgaatcatgagcctgc

SEQ ID NO: 2372705 - DNA, 20 bp, Homo sapiens
gcctgacatggttgtcatca

SEQ ID NO: 2372706 - DNA, 14 bp, Homo sapiens
gcctgactgctcag

SEQ ID NO: 2372707 - DNA, 19 bp, Homo sapiens
gcctgagaagaagtggctg

SEQ ID NO: 2372708 - DNA, 13 bp, Homo sapiens
gcctgagaggcag

SEQ ID NO: 2372709 - DNA, 15 bp, Homo sapiens
gcctgagaggcaggc

SEQ ID NO: 2372710 - DNA, 20 bp, Homo sapiens
gcctgagaggcaggcataga

SEQ ID NO: 2372711 - DNA, 19 bp, Homo sapiens
gcctgaggtcatcggcgtg

SEQ ID NO: 2372712 - DNA, 15 bp, Homo sapiens
gcctgagtcagtgct

SEQ ID NO: 2372713 - DNA, 17 bp, Homo sapiens
gcctgagtcagtgctct

SEQ ID NO: 2372714 - DNA, 23 bp, Homo sapiens
gcctgagtcagtgctctcagctg

SEQ ID NO: 2372715 - DNA, 16 bp, Homo sapiens
gcctgcaggagagagc

SEQ ID NO: 2372716 - DNA, 15 bp, Homo sapiens
gcctgcaggcagagc

SEQ ID NO: 2372717 - DNA, 21 bp, Homo sapiens
gcctgcaggcagagctggagc

SEQ ID NO: 2372718 - DNA, 21 bp, Homo sapiens
gcctgcatttcctcgcagcct

SEQ ID NO: 2372719 - DNA, 14 bp, Homo sapiens
gcctgccctcactc

SEQ ID NO: 2372720 - DNA, 17 bp, Homo sapiens
gcctgccgggctgaggg

SEQ ID NO: 2372721 - DNA, 13 bp, Homo sapiens
gcctgcgcctgct

SEQ ID NO: 2372722 - DNA, 18 bp, Homo sapiens
gcctgcgcctgctgcctg

SEQ ID NO: 2372723 - DNA, 21 bp, Homo sapiens
gcctgctctgtgagccccaca

SEQ ID NO: 2372724 - DNA, 17 bp, Homo sapiens
gcctgctgcctgctgag

SEQ ID NO: 2372725 - DNA, 23 bp, Homo sapiens
gcctgctggaggcctcaggtgct

SEQ ID NO: 2372726 - DNA, 22 bp, Homo sapiens
gcctgctgtgattccactacac

SEQ ID NO: 2372727 - DNA, 22 bp, Homo sapiens
gcctggacagtatcccacatcc

SEQ ID NO: 2372728 - DNA, 18 bp, Homo sapiens
gcctggccatactgtgtc

SEQ ID NO: 2372729 - DNA, 15 bp, Homo sapiens
gcctggccccagcct

SEQ ID NO: 2372730 - DNA, 18 bp, Homo sapiens
gcctggccccagcctggg

SEQ ID NO: 2372731 - DNA, 17 bp, Homo sapiens
gcctggccccaggcccc

SEQ ID NO: 2372732 - DNA, 17 bp, Homo sapiens
gcctggctggaggagca

SEQ ID NO: 2372733 - DNA, 16 bp, Homo sapiens
gcctgggacaactgct

SEQ ID NO: 2372734 - DNA, 20 bp, Homo sapiens
gcctggtatatccaaaagct

SEQ ID NO: 2372735 - DNA, 21 bp, Homo sapiens
gcctggtgtgaggaggacaaa

SEQ ID NO: 2372736 - DNA, 21 bp, Homo sapiens
gcctgtagtccatctccagca

SEQ ID NO: 2372737 - DNA, 20 bp, Homo sapiens
gcctgtcctggtacagcagg

SEQ ID NO: 2372738 - DNA, 21 bp, Homo sapiens
gcctgtcctggtacagcaggg

SEQ ID NO: 2372739 - DNA, 14 bp, Homo sapiens
gcctgtgggtctct

SEQ ID NO: 2372740 - DNA, 17 bp, Homo sapiens
gcctgtgggtctctgaa

SEQ ID NO: 2372741 - DNA, 14 bp, Homo sapiens
gccttaaaaccaaa

SEQ ID NO: 2372742 - DNA, 17 bp, Homo sapiens
gccttaaaaccaaagag

SEQ ID NO: 2372743 - DNA, 17 bp, Homo sapiens
gccttaatttccttttt

SEQ ID NO: 2372744 - DNA, 19 bp, Homo sapiens
gccttaatttcctttttga

SEQ ID NO: 2372745 - DNA, 21 bp, Homo sapiens
gccttaatttcctttttgaca

SEQ ID NO: 2372746 - DNA, 23 bp, Homo sapiens
gccttaatttcctttttgacact

SEQ ID NO: 2372747 - DNA, 14 bp, Homo sapiens
gccttcagctccag

SEQ ID NO: 2372748 - DNA, 23 bp, Homo sapiens
gccttccaactagctgggactac

SEQ ID NO: 2372749 - DNA, 21 bp, Homo sapiens
gccttcccaagttgtgcttga

SEQ ID NO: 2372750 - DNA, 19 bp, Homo sapiens
gccttcctgtttttcacat

SEQ ID NO: 2372751 - DNA, 19 bp, Homo sapiens
gccttggaaatagaaagaa

SEQ ID NO: 2372752 - DNA, 13 bp, Homo sapiens
gccttggaaccag

SEQ ID NO: 2372753 - DNA, 17 bp, Homo sapiens
gccttggcctcccaaag

SEQ ID NO: 2372754 - DNA, 21 bp, Homo sapiens
gccttgtataatattgaaaat

SEQ ID NO: 2372755 - DNA, 22 bp, Homo sapiens
gccttgtcctacgtccaaggtg

SEQ ID NO: 2372756 - DNA, 23 bp, Homo sapiens
gcctttctcgtggtagaagccag

SEQ ID NO: 2372757 - DNA, 14 bp, Homo sapiens
gcctttcttctgtg

SEQ ID NO: 2372758 - DNA, 17 bp, Homo sapiens
gcctttgaatgtaacca

SEQ ID NO: 2372759 - DNA, 14 bp, Homo sapiens
gcctttgagacagt

SEQ ID NO: 2372760 - DNA, 23 bp, Homo sapiens
gcctttgagacagtttcttagct

SEQ ID NO: 2372761 - DNA, 12 bp, Homo sapiens
gcgaccaccgcc

SEQ ID NO: 2372762 - DNA, 17 bp, Homo sapiens
gcgaccatgtggccaca

SEQ ID NO: 2372763 - DNA, 14 bp, Homo sapiens
gcgagggcagctgc

SEQ ID NO: 2372764 - DNA, 17 bp, Homo sapiens
gcgagggcagctgctat

SEQ ID NO: 2372765 - DNA, 17 bp, Homo sapiens
gcgatctctccactgtg

SEQ ID NO: 2372766 - DNA, 18 bp, Homo sapiens
gcgatctctccactgtgc

SEQ ID NO: 2372767 - DNA, 14 bp, Homo sapiens
gcgcagtgccttgc

SEQ ID NO: 2372768 - DNA, 20 bp, Homo sapiens
gcgcatcaatgtattttatc

SEQ ID NO: 2372769 - DNA, 14 bp, Homo sapiens
gcgccaccgtgcct

SEQ ID NO: 2372770 - DNA, 16 bp, Homo sapiens
gcgccaggaagccaga

SEQ ID NO: 2372771 - DNA, 18 bp, Homo sapiens
gcgccaggaagccagagc

SEQ ID NO: 2372772 - DNA, 20 bp, Homo sapiens
gcgccaggaagccagagccc

SEQ ID NO: 2372773 - DNA, 21 bp, Homo sapiens
gcgccaggaagccagagcccc

SEQ ID NO: 2372774 - DNA, 13 bp, Homo sapiens
gcgccgatgccac

SEQ ID NO: 2372775 - DNA, 17 bp, Homo sapiens
gcgccgatgccaccggc

SEQ ID NO: 2372776 - DNA, 12 bp, Homo sapiens
gcgcctcagccc

SEQ ID NO: 2372777 - DNA, 14 bp, Homo sapiens
gcgcctcagccctc

SEQ ID NO: 2372778 - DNA, 21 bp, Homo sapiens
gcgcctcgccggatctgaggg

SEQ ID NO: 2372779 - DNA, 17 bp, Homo sapiens
gcgcctgctgcctgctg

SEQ ID NO: 2372780 - DNA, 22 bp, Homo sapiens
gcgcctgctgcctgctgagatg

SEQ ID NO: 2372781 - DNA, 13 bp, Homo sapiens
gcgcggtggctca

SEQ ID NO: 2372782 - DNA, 13 bp, Homo sapiens
gcgcgtctgcccc

SEQ ID NO: 2372783 - DNA, 12 bp, Homo sapiens
gcgctcagtaaa

SEQ ID NO: 2372784 - DNA, 18 bp, Homo sapiens
gcgctcatgttgagccag

SEQ ID NO: 2372785 - DNA, 19 bp, Homo sapiens
gcgctgcccacctgccggc

SEQ ID NO: 2372786 - DNA, 15 bp, Homo sapiens
gcgcttgctggccag

SEQ ID NO: 2372787 - DNA, 15 bp, Homo sapiens
gcggaggctgtgctc

SEQ ID NO: 2372788 - DNA, 15 bp, Homo sapiens
gcggatggatggaag

SEQ ID NO: 2372789 - DNA, 21 bp, Homo sapiens
gcggatggatggaaggttgga

SEQ ID NO: 2372790 - DNA, 13 bp, Homo sapiens
gctgtgagggagg

SEQ ID NO: 2372791 - DNA, 15 bp, Homo sapiens
gctgtgagggagggg

SEQ ID NO: 2372792 - DNA, 23 bp, Homo sapiens
gctgtgagggaggggaaaagcat

SEQ ID NO: 2372793 - DNA, 18 bp, Homo sapiens
gctgtgctccatatttga

SEQ ID NO: 2372794 - DNA, 18 bp, Homo sapiens
gctgtggcatttccaaac

SEQ ID NO: 2372795 - DNA, 14 bp, Homo sapiens
gctgtgtctgccaa

SEQ ID NO: 2372796 - DNA, 21 bp, Homo sapiens
gctgtgtctgcccaatgaata

SEQ ID NO: 2372797 - DNA, 13 bp, Homo sapiens
gctgttctcagga

SEQ ID NO: 2372798 - DNA, 16 bp, Homo sapiens
gctgttctcaggacag

SEQ ID NO: 2372799 - DNA, 21 bp, Homo sapiens
gctgttctgtggttcctctgc

SEQ ID NO: 2372800 - DNA, 12 bp, Homo sapiens
gctgttgtacat

SEQ ID NO: 2372801 - DNA, 13 bp, Homo sapiens
gctgttgtacatt

SEQ ID NO: 2372802 - DNA, 14 bp, Homo sapiens
gctgttgtacattt

SEQ ID NO: 2372803 - DNA, 16 bp, Homo sapiens
gctgttgtacatttat

SEQ ID NO: 2372804 - DNA, 21 bp, Homo sapiens
gctgttgtgaagctaatgtca

SEQ ID NO: 2372805 - DNA, 23 bp, Homo sapiens
gcttaaaggcagtattttgtgtc

SEQ ID NO: 2372806 - DNA, 13 bp, Homo sapiens
gcttaaatttctt

SEQ ID NO: 2372807 - DNA, 16 bp, Homo sapiens
gcttaaatttcttatg

SEQ ID NO: 2372808 - DNA, 19 bp, Homo sapiens
gcttaagtgagcagaacag

SEQ ID NO: 2372809 - DNA, 20 bp, Homo sapiens
gcttaagtgagcagaacagg

SEQ ID NO: 2372810 - DNA, 16 bp, Homo sapiens
gcttaataaaagaaca

SEQ ID NO: 2372811 - DNA, 22 bp, Homo sapiens
gcttagcattttgcatgtttta

SEQ ID NO: 2372812 - DNA, 15 bp, Homo sapiens
gcttattacatttta

SEQ ID NO: 2372813 - DNA, 19 bp, Homo sapiens
gcttcacagtagagccagc

SEQ ID NO: 2372814 - DNA, 15 bp, Homo sapiens
gcttcactgtataaa

SEQ ID NO: 2372815 - DNA, 17 bp, Homo sapiens
gcttcactgtataaata

SEQ ID NO: 2372816 - DNA, 22 bp, Homo sapiens
gcttcaggttatcgaaataaca

SEQ ID NO: 2372817 - DNA, 15 bp, Homo sapiens
gcttcatctctttag

SEQ ID NO: 2372818 - DNA, 18 bp, Homo sapiens
gcttcatctctttagaga

SEQ ID NO: 2372819 - DNA, 15 bp, Homo sapiens
gcttcattctggaaa

SEQ ID NO: 2372820 - DNA, 23 bp, Homo sapiens
gcttcattctggaaacttttgtt

SEQ ID NO: 2372821 - DNA, 19 bp, Homo sapiens
gcttccaaagcctagacaa

SEQ ID NO: 2372822 - DNA, 17 bp, Homo sapiens
gcttccctccatccccc

SEQ ID NO: 2372823 - DNA, 15 bp, Homo sapiens
gcttcctctagaagc

SEQ ID NO: 2372824 - DNA, 17 bp, Homo sapiens
gcttcctctagaagcca

SEQ ID NO: 2372825 - DNA, 11 bp, Homo sapiens
gcttcctgccc

SEQ ID NO: 2372826 - DNA, 21 bp, Homo sapiens
gcttcctgcccttccctctgg

SEQ ID NO: 2372827 - DNA, 20 bp, Homo sapiens
gcttcctgcgtcctcctcac

SEQ ID NO: 2372828 - DNA, 14 bp, Homo sapiens
gcttcctgttactg

SEQ ID NO: 2372829 - DNA, 17 bp, Homo sapiens
gcttcctttctctcctg

SEQ ID NO: 2372830 - DNA, 18 bp, Homo sapiens
gcttcctttctctcctgg

SEQ ID NO: 2372831 - DNA, 19 bp, Homo sapiens
gcttcctttctctcctggc

SEQ ID NO: 2372832 - DNA, 12 bp, Homo sapiens
gcttctaaagca

SEQ ID NO: 2372833 - DNA, 21 bp, Homo sapiens
gcttctcagatttctgaggaa

SEQ ID NO: 2372834 - DNA, 14 bp, Homo sapiens
gcttctccgccagc

SEQ ID NO: 2372835 - DNA, 17 bp, Homo sapiens
gcttctccgccagcctc

SEQ ID NO: 2372836 - DNA, 19 bp, Homo sapiens
gcttctccgccagcctcct

SEQ ID NO: 2372837 - DNA, 23 bp, Homo sapiens
gcttctccgccagcctcctctgg

SEQ ID NO: 2372838 - DNA, 24 bp, Homo sapiens
gcttctccgccagcctcctctgga

SEQ ID NO: 2372839 - DNA, 18 bp, Homo sapiens
gcttctctccacagtgtt

SEQ ID NO: 2372840 - DNA, 17 bp, Homo sapiens
gcttctcttttgaaagt

SEQ ID NO: 2372841 - DNA, 16 bp, Homo sapiens
gcttctgctggggcct

SEQ ID NO: 2372842 - DNA, 22 bp, Homo sapiens
gcttctgctggggcctgggaca

SEQ ID NO: 2372843 - DNA, 15 bp, Homo sapiens
gcttctgcttttctg

SEQ ID NO: 2372844 - DNA, 19 bp, Homo sapiens
gcttctgcttttctgccct

SEQ ID NO: 2372845 - DNA, 21 bp, Homo sapiens
gcttcttcctatttgccatgg

SEQ ID NO: 2372846 - DNA, 19 bp, Homo sapiens
gcttgaactaggctgagca

SEQ ID NO: 2372847 - DNA, 11 bp, Homo sapiens
gcttgaagcca

SEQ ID NO: 2372848 - DNA, 12 bp, Homo sapiens
gcttgaagccaa

SEQ ID NO: 2372849 - DNA, 14 bp, Homo sapiens
gcttgaagccaaag

SEQ ID NO: 2372850 - DNA, 20 bp, Homo sapiens
gcttgaagccaaagaaaaat

SEQ ID NO: 2372851 - DNA, 13 bp, Homo sapiens
gcttgaaggccag

SEQ ID NO: 2372852 - DNA, 15 bp, Homo sapiens
gcttgaccctgaaat

SEQ ID NO: 2372853 - DNA, 15 bp, Homo sapiens
gcttgagccaggagg

SEQ ID NO: 2372854 - DNA, 18 bp, Homo sapiens
gcttgagccgggcccctg

SEQ ID NO: 2372855 - DNA, 21 bp, Homo sapiens
gcttgagccgggcccctgggc

SEQ ID NO: 2372856 - DNA, 18 bp, Homo sapiens
gcttgataatatataaac

SEQ ID NO: 2372857 - DNA, 20 bp, Homo sapiens
gcttgataatatataaacaa

SEQ ID NO: 2372858 - DNA, 21 bp, Homo sapiens
gcttgatccagaagagcccat

SEQ ID NO: 2372859 - DNA, 13 bp, Homo sapiens
gcttgattttaat

SEQ ID NO: 2372860 - DNA, 23 bp, Homo sapiens
gcttgcataataagctaaagagg

SEQ ID NO: 2372861 - DNA, 22 bp, Homo sapiens
gcttgccaaagtacagaatttg

SEQ ID NO: 2372862 - DNA, 22 bp, Homo sapiens
gcttgcccagtacatttaaatt

SEQ ID NO: 2372863 - DNA, 21 bp, Homo sapiens
gcttgctccagattctgatgc

SEQ ID NO: 2372864 - DNA, 11 bp, Homo sapiens
gcttgctggcc

SEQ ID NO: 2372865 - DNA, 13 bp, Homo sapiens
gcttggcctgctg

SEQ ID NO: 2372866 - DNA, 14 bp, Homo sapiens
gcttggcctgctgt

SEQ ID NO: 2372867 - DNA, 21 bp, Homo sapiens
gcttgggcagtgccccaggga

SEQ ID NO: 2372868 - DNA, 22 bp, Homo sapiens
gcttggggccaccaaagctgcc

SEQ ID NO: 2372869 - DNA, 13 bp, Homo sapiens
gcttggtctgttt

SEQ ID NO: 2372870 - DNA, 15 bp, Homo sapiens
gcttggtctgtttga

SEQ ID NO: 2372871 - DNA, 22 bp, Homo sapiens
gcttgtagaagtaggaggaaac

SEQ ID NO: 2372872 - DNA, 16 bp, Homo sapiens
gcttgtgacagtgcct

SEQ ID NO: 2372873 - DNA, 19 bp, Homo sapiens
gcttgtggggcctgggagg

SEQ ID NO: 2372874 - DNA, 15 bp, Homo sapiens
gctttagaccctggg

SEQ ID NO: 2372875 - DNA, 21 bp, Homo sapiens
gctttagtacaatagtataca

SEQ ID NO: 2372876 - DNA, 20 bp, Homo sapiens
gctttcacggaaactcccga

SEQ ID NO: 2372877 - DNA, 15 bp, Homo sapiens
gctttcagaagtgcc

SEQ ID NO: 2372878 - DNA, 12 bp, Homo sapiens
gctttcccagga

SEQ ID NO: 2372879 - DNA, 12 bp, Homo sapiens
gctttctcaatg

SEQ ID NO: 2372880 - DNA, 15 bp, Homo sapiens
gctttctgccatcta

SEQ ID NO: 2372881 - DNA, 19 bp, Homo sapiens
gctttctgggatgtcacag

SEQ ID NO: 2372882 - DNA, 14 bp, Homo sapiens
gctttctggggcct

SEQ ID NO: 2372883 - DNA, 18 bp, Homo sapiens
gctttgaaaaatctcatt

SEQ ID NO: 2372884 - DNA, 16 bp, Homo sapiens
gctttgaataaatgtg

SEQ ID NO: 2372885 - DNA, 17 bp, Homo sapiens
gctttgaataaatgtgt

SEQ ID NO: 2372886 - DNA, 20 bp, Homo sapiens
gctttgactctataagcaaa

SEQ ID NO: 2372887 - DNA, 15 bp, Homo sapiens
gctttgatgttcctt

SEQ ID NO: 2372888 - DNA, 21 bp, Homo sapiens
gctttgatgttccttccagtg

SEQ ID NO: 2372889 - DNA, 22 bp, Homo sapiens
gcttttatagaggctagcttct

SEQ ID NO: 2372890 - DNA, 22 bp, Homo sapiens
gcttttctgccctggctgctgc

SEQ ID NO: 2372891 - DNA, 15 bp, Homo sapiens
gcttttgctagatgg

SEQ ID NO: 2372892 - DNA, 21 bp, Homo sapiens
gctttttaattgttgtttctt

SEQ ID NO: 2372893 - DNA, 19 bp, Homo sapiens
gctttttattcctcctgct

SEQ ID NO: 2372894 - DNA, 12 bp, Homo sapiens
gctttttggaat

SEQ ID NO: 2372895 - DNA, 13 bp, Homo sapiens
ggaaaaacacaag

SEQ ID NO: 2372896 - DNA, 13 bp, Homo sapiens
ggaaaagacacat

SEQ ID NO: 2372897 - DNA, 16 bp, Homo sapiens
ggaaaagcaacttcat

SEQ ID NO: 2372898 - DNA, 15 bp, Homo sapiens
ggaaaaggttgaata

SEQ ID NO: 2372899 - DNA, 18 bp, Homo sapiens
ggaaacatacagaggatg

SEQ ID NO: 2372900 - DNA, 18 bp, Homo sapiens
ggaaactcacactcccct

SEQ ID NO: 2372901 - DNA, 20 bp, Homo sapiens
ggaaactccacatctgcctt

SEQ ID NO: 2372902 - DNA, 17 bp, Homo sapiens
ggaaactggccatggcc

SEQ ID NO: 2372903 - DNA, 12 bp, Homo sapiens
ggaaaggggaga

SEQ ID NO: 2372904 - DNA, 21 bp, Homo sapiens
ggaaaggggagagcctgctgg

SEQ ID NO: 2372905 - DNA, 22 bp, Homo sapiens
ggaggaaacagttctcactggg

SEQ ID NO: 2372906 - DNA, 14 bp, Homo sapiens
ggaggaagagccac

SEQ ID NO: 2372907 - DNA, 19 bp, Homo sapiens
ggaggaagagccacctgca

SEQ ID NO: 2372908 - DNA, 11 bp, Homo sapiens
ggaggaaggat

SEQ ID NO: 2372909 - DNA, 13 bp, Homo sapiens
ggaggaaggattg

SEQ ID NO: 2372910 - DNA, 14 bp, Homo sapiens
ggaggaaggcaaga

SEQ ID NO: 2372911 - DNA, 22 bp, Homo sapiens
ggaggaccagggccctgggcag

SEQ ID NO: 2372912 - DNA, 14 bp, Homo sapiens
ggaggagcagcagc

SEQ ID NO: 2372913 - DNA, 15 bp, Homo sapiens
ggaggagcagcagct

SEQ ID NO: 2372914 - DNA, 17 bp, Homo sapiens
ggaggccattgtgtgag

SEQ ID NO: 2372915 - DNA, 18 bp, Homo sapiens
ggaggccctgttccctgg

SEQ ID NO: 2372916 - DNA, 21 bp, Homo sapiens
ggaggcccttgtcgtgggatg

SEQ ID NO: 2372917 - DNA, 17 bp, Homo sapiens
ggaggcctcaggtgctg

SEQ ID NO: 2372918 - DNA, 19 bp, Homo sapiens
ggaggcctcaggtgctgtc

SEQ ID NO: 2372919 - DNA, 13 bp, Homo sapiens
ggagggagaggga

SEQ ID NO: 2372920 - DNA, 20 bp, Homo sapiens
ggaggggagagacaggcagc

SEQ ID NO: 2372921 - DNA, 16 bp, Homo sapiens
ggagggggcttgaagc

SEQ ID NO: 2372922 - DNA, 20 bp, Homo sapiens
ggagggtaaataaaccactg

SEQ ID NO: 2372923 - DNA, 20 bp, Homo sapiens
ggagggttccgccactccag

SEQ ID NO: 2372924 - DNA, 17 bp, Homo sapiens
ggaggtcactggaaagg

SEQ ID NO: 2372925 - DNA, 21 bp, Homo sapiens
ggaggtcactggaaaggggag

SEQ ID NO: 2372926 - DNA, 21 bp, Homo sapiens
ggaggtgggcaaagggaagta

SEQ ID NO: 2372927 - DNA, 16 bp, Homo sapiens
ggaggttgaagccaag

SEQ ID NO: 2372928 - DNA, 14 bp, Homo sapiens
ggaggttgcagtga

SEQ ID NO: 2372929 - DNA, 16 bp, Homo sapiens
ggagtattgaatggtg

SEQ ID NO: 2372930 - DNA, 19 bp, Homo sapiens
ggagtccagggtttctctg

SEQ ID NO: 2372931 - DNA, 15 bp, Homo sapiens
ggagtgcagccttct

SEQ ID NO: 2372932 - DNA, 18 bp, Homo sapiens
ggagtgcagccttctcca

SEQ ID NO: 2372933 - DNA, 22 bp, Homo sapiens
ggagtgcggaccaccctcactg

SEQ ID NO: 2372934 - DNA, 15 bp, Homo sapiens
ggagttcaccttgga

SEQ ID NO: 2372935 - DNA, 13 bp, Homo sapiens
ggagtttctctgt

SEQ ID NO: 2372936 - DNA, 18 bp, Homo sapiens
ggagttttgtctgtctcc

SEQ ID NO: 2372937 - DNA, 18 bp, Homo sapiens
ggataaatcataaagtca

SEQ ID NO: 2372938 - DNA, 20 bp, Homo sapiens
ggataactttacagaaatgg

SEQ ID NO: 2372939 - DNA, 15 bp, Homo sapiens
ggatactggcacaga

SEQ ID NO: 2372940 - DNA, 14 bp, Homo sapiens
ggatagacttggga

SEQ ID NO: 2372941 - DNA, 23 bp, Homo sapiens
ggatagtagttaaataactgtgt

SEQ ID NO: 2372942 - DNA, 20 bp, Homo sapiens
ggatatagttttacttttaa

SEQ ID NO: 2372943 - DNA, 19 bp, Homo sapiens
ggatatataggctattttc

SEQ ID NO: 2372944 - DNA, 9 bp, Homo sapiens
ggatattat

SEQ ID NO: 2372945 - DNA, 16 bp, Homo sapiens
ggatattatagaaaat

SEQ ID NO: 2372946 - DNA, 18 bp, Homo sapiens
ggatcaggggtaggaatg

SEQ ID NO: 2372947 - DNA, 21 bp, Homo sapiens
ggatccccgcctggccaggag

SEQ ID NO: 2372948 - DNA, 18 bp, Homo sapiens
ggatccttcagcacagga

SEQ ID NO: 2372949 - DNA, 15 bp, Homo sapiens
ggatctataggcagc

SEQ ID NO: 2372950 - DNA, 16 bp, Homo sapiens
ggatctataggcagct

SEQ ID NO: 2372951 - DNA, 11 bp, Homo sapiens
ggatctcacag

SEQ ID NO: 2372952 - DNA, 17 bp, Homo sapiens
ggatctcacaggctgag

SEQ ID NO: 2372953 - DNA, 16 bp, Homo sapiens
ggatctcagctttgag

SEQ ID NO: 2372954 - DNA, 17 bp, Homo sapiens
ggatctcagctttgaga

SEQ ID NO: 2372955 - DNA, 15 bp, Homo sapiens
ggatctgatctgtac

SEQ ID NO: 2372956 - DNA, 14 bp, Homo sapiens
ggatctgctgaggc

SEQ ID NO: 2372957 - DNA, 17 bp, Homo sapiens
ggatctgctgggctctg

SEQ ID NO: 2372958 - DNA, 14 bp, Homo sapiens
ggatgagagcccag

SEQ ID NO: 2372959 - DNA, 15 bp, Homo sapiens
ggatgagagcccaga

SEQ ID NO: 2372960 - DNA, 18 bp, Homo sapiens
ggatgagagcccagaggt

SEQ ID NO: 2372961 - DNA, 18 bp, Homo sapiens
ggatgagggaagcgaagg

SEQ ID NO: 2372962 - DNA, 23 bp, Homo sapiens
ggatgatgtctttttattaaaat

SEQ ID NO: 2372963 - DNA, 16 bp, Homo sapiens
ggatgccttttctgtg

SEQ ID NO: 2372964 - DNA, 19 bp, Homo sapiens
ggatgctaaagatgatgat

SEQ ID NO: 2372965 - DNA, 20 bp, Homo sapiens
ggatggaccaacctgctctg

SEQ ID NO: 2372966 - DNA, 17 bp, Homo sapiens
ggatggcatttggtctc

SEQ ID NO: 2372967 - DNA, 14 bp, Homo sapiens
ggatggcttgtcta

SEQ ID NO: 2372968 - DNA, 15 bp, Homo sapiens
ggatgggtcagagct

SEQ ID NO: 2372969 - DNA, 17 bp, Homo sapiens
ggattatttaataacat

SEQ ID NO: 2372970 - DNA, 22 bp, Homo sapiens
ggattggattatttaataacat

SEQ ID NO: 2372971 - DNA, 23 bp, Homo sapiens
ggattgtaaaaaaaaatgccttt

SEQ ID NO: 2372972 - DNA, 10 bp, Homo sapiens
ggattgtttt

SEQ ID NO: 2372973 - DNA, 14 bp, Homo sapiens
ggcaaacctttccc

SEQ ID NO: 2372974 - DNA, 21 bp, Homo sapiens
ggcaaagtacttgtcatagac

SEQ ID NO: 2372975 - DNA, 18 bp, Homo sapiens
ggcaagccacaggaagga

SEQ ID NO: 2372976 - DNA, 14 bp, Homo sapiens
ggcaccagtccctg

SEQ ID NO: 2372977 - DNA, 12 bp, Homo sapiens
ggcaccctcagg

SEQ ID NO: 2372978 - DNA, 16 bp, Homo sapiens
ggcaccctcagggagc

SEQ ID NO: 2372979 - DNA, 21 bp, Homo sapiens
ggcaccctcagggagcctccc

SEQ ID NO: 2372980 - DNA, 22 bp, Homo sapiens
ggcaccctcagggagcctcccc

SEQ ID NO: 2372981 - DNA, 13 bp, Homo sapiens
ggcacctgctgga

SEQ ID NO: 2372982 - DNA, 15 bp, Homo sapiens
ggcacgggtggtccc

SEQ ID NO: 2372983 - DNA, 16 bp, Homo sapiens
ggcactagccaaagcg

SEQ ID NO: 2372984 - DNA, 20 bp, Homo sapiens
ggcactcagtgagcctcctg

SEQ ID NO: 2372985 - DNA, 17 bp, Homo sapiens
ggcactgggaggcaggg

SEQ ID NO: 2372986 - DNA, 19 bp, Homo sapiens
ggcactgggaggcagggct

SEQ ID NO: 2372987 - DNA, 15 bp, Homo sapiens
ggcagaagacaccag

SEQ ID NO: 2372988 - DNA, 20 bp, Homo sapiens
ggcagaagacaccagagcag

SEQ ID NO: 2372989 - DNA, 22 bp, Homo sapiens
ggcagaagacaccagagcagat

SEQ ID NO: 2372990 - DNA, 17 bp, Homo sapiens
ggcagcaccacactggg

SEQ ID NO: 2372991 - DNA, 11 bp, Homo sapiens
ggcagcccagg

SEQ ID NO: 2372992 - DNA, 22 bp, Homo sapiens
ggcagctgctatttattttcct

SEQ ID NO: 2372993 - DNA, 17 bp, Homo sapiens
ggcaggaagggaagcgt

SEQ ID NO: 2372994 - DNA, 19 bp, Homo sapiens
ggcaggatggcctttcctt

SEQ ID NO: 2372995 - DNA, 19 bp, Homo sapiens
ggcaggccacctggctctc

SEQ ID NO: 2372996 - DNA, 15 bp, Homo sapiens
ggcaggctgggccat

SEQ ID NO: 2372997 - DNA, 17 bp, Homo sapiens
ggcaggcttggggaaaa

SEQ ID NO: 2372998 - DNA, 16 bp, Homo sapiens
ggcagggctgtgcttg

SEQ ID NO: 2372999 - DNA, 21 bp, Homo sapiens
ggcagtagaactccaggccct

SEQ ID NO: 2373000 - DNA, 20 bp, Homo sapiens
ggcagtgatgacttgctgtc

SEQ ID NO: 2373001 - DNA, 23 bp, Homo sapiens
ggcagtgatgacttgctgtccag

SEQ ID NO: 2373002 - DNA, 20 bp, Homo sapiens
ggcataggtctctttgcttt

SEQ ID NO: 2373003 - DNA, 22 bp, Homo sapiens
ggcatatttaacaaaatttgaa

SEQ ID NO: 2373004 - DNA, 22 bp, Homo sapiens
ggcatccctttttcataaatta

SEQ ID NO: 2373005 - DNA, 20 bp, Homo sapiens
ggcatctcttccccagagag

SEQ ID NO: 2373006 - DNA, 21 bp, Homo sapiens
ggcatgacactctagtgactt

SEQ ID NO: 2373007 - DNA, 20 bp, Homo sapiens
ggcattctggacctctgggt

SEQ ID NO: 2373008 - DNA, 19 bp, Homo sapiens
ggcattgagtattgtttaa

SEQ ID NO: 2373009 - DNA, 13 bp, Homo sapiens
ggcatttccaaac

SEQ ID NO: 2373010 - DNA, 13 bp, Homo sapiens
ggcattttcctcc

SEQ ID NO: 2373011 - DNA, 14 bp, Homo sapiens
ggccaaaatcaaga

SEQ ID NO: 2373012 - DNA, 20 bp, Homo sapiens
ggccaagcagaaaaaaaagt

SEQ ID NO: 2373013 - DNA, 17 bp, Homo sapiens
ggccaccaaagctgccc

SEQ ID NO: 2373014 - DNA, 13 bp, Homo sapiens
ggccaccactgca

SEQ ID NO: 2373015 - DNA, 16 bp, Homo sapiens
ggccagcctccgagag

SEQ ID NO: 2373016 - DNA, 19 bp, Homo sapiens
ggccagcctccgagaggga

SEQ ID NO: 2373017 - DNA, 16 bp, Homo sapiens
ggccagcggggctgct

SEQ ID NO: 2373018 - DNA, 19 bp, Homo sapiens
ggccagcggggctgctcac

SEQ ID NO: 2373019 - DNA, 15 bp, Homo sapiens
ggccagggcctctcc

SEQ ID NO: 2373020 - DNA, 13 bp, Homo sapiens
ggctggagacccc

SEQ ID NO: 2373021 - DNA, 17 bp, Homo sapiens
ggctggagtgcagtggc

SEQ ID NO: 2373022 - DNA, 21 bp, Homo sapiens
ggctggcaaaccctcccagaa

SEQ ID NO: 2373023 - DNA, 22 bp, Homo sapiens
ggctggctctaccttcctgtcc

SEQ ID NO: 2373024 - DNA, 11 bp, Homo sapiens
ggctgggccat

SEQ ID NO: 2373025 - DNA, 23 bp, Homo sapiens
ggctggggaggaccagggccctg

SEQ ID NO: 2373026 - DNA, 16 bp, Homo sapiens
ggctgggggagagccg

SEQ ID NO: 2373027 - DNA, 19 bp, Homo sapiens
ggctgggggagagccgtgg

SEQ ID NO: 2373028 - DNA, 12 bp, Homo sapiens
ggctgggtgctg

SEQ ID NO: 2373029 - DNA, 13 bp, Homo sapiens
ggctgggtgctgg

SEQ ID NO: 2373030 - DNA, 21 bp, Homo sapiens
ggctggtagaaaaaggggcct

SEQ ID NO: 2373031 - DNA, 20 bp, Homo sapiens
ggctgtaactgagagaaaga

SEQ ID NO: 2373032 - DNA, 23 bp, Homo sapiens
ggctgtcaatgggacctgtggct

SEQ ID NO: 2373033 - DNA, 12 bp, Homo sapiens
ggctgtggttcc

SEQ ID NO: 2373034 - DNA, 14 bp, Homo sapiens
ggctgtgttggtgt

SEQ ID NO: 2373035 - DNA, 16 bp, Homo sapiens
ggcttaggtgccaggc

SEQ ID NO: 2373036 - DNA, 17 bp, Homo sapiens
ggcttaggtgccaggct

SEQ ID NO: 2373037 - DNA, 19 bp, Homo sapiens
ggcttcactgtataaatag

SEQ ID NO: 2373038 - DNA, 12 bp, Homo sapiens
ggcttcatctct

SEQ ID NO: 2373039 - DNA, 20 bp, Homo sapiens
ggcttcatctctttagagaa

SEQ ID NO: 2373040 - DNA, 22 bp, Homo sapiens
ggcttcctgcccttccctctgg

SEQ ID NO: 2373041 - DNA, 16 bp, Homo sapiens
ggcttctccgccagcc

SEQ ID NO: 2373042 - DNA, 18 bp, Homo sapiens
ggcttctccgccagcctc

SEQ ID NO: 2373043 - DNA, 14 bp, Homo sapiens
ggcttctcctcctc

SEQ ID NO: 2373044 - DNA, 15 bp, Homo sapiens
ggcttctctccacag

SEQ ID NO: 2373045 - DNA, 12 bp, Homo sapiens
ggcttctgctgg

SEQ ID NO: 2373046 - DNA, 19 bp, Homo sapiens
ggcttctgctggggcctgg

SEQ ID NO: 2373047 - DNA, 13 bp, Homo sapiens
ggcttgaagccaa

SEQ ID NO: 2373048 - DNA, 16 bp, Homo sapiens
ggcttgaagccaaaga

SEQ ID NO: 2373049 - DNA, 13 bp, Homo sapiens
ggcttgaagctgt

SEQ ID NO: 2373050 - DNA, 14 bp, Homo sapiens
ggcttgaaggccag

SEQ ID NO: 2373051 - DNA, 15 bp, Homo sapiens
ggcttgaaggccagc

SEQ ID NO: 2373052 - DNA, 16 bp, Homo sapiens
ggcttgagctagagat

SEQ ID NO: 2373053 - DNA, 14 bp, Homo sapiens
ggcttgtggggcct

SEQ ID NO: 2373054 - DNA, 19 bp, Homo sapiens
ggcttgttcatcatccaga

SEQ ID NO: 2373055 - DNA, 14 bp, Homo sapiens
ggctttcccaggag

SEQ ID NO: 2373056 - DNA, 18 bp, Homo sapiens
ggctttgccatgggcctg

SEQ ID NO: 2373057 - DNA, 20 bp, Homo sapiens
gggaaaatggccatgcagga

SEQ ID NO: 2373058 - DNA, 23 bp, Homo sapiens
gggaacagtaaagaaagcagaat

SEQ ID NO: 2373059 - DNA, 14 bp, Homo sapiens
gggaacatgccccc

SEQ ID NO: 2373060 - DNA, 19 bp, Homo sapiens
gggaacttgcgagtccaag

SEQ ID NO: 2373061 - DNA, 12 bp, Homo sapiens
gggaagaaaaag

SEQ ID NO: 2373062 - DNA, 22 bp, Homo sapiens
gggaagactcctagctgtcctt

SEQ ID NO: 2373063 - DNA, 13 bp, Homo sapiens
gggaaggatttaa

SEQ ID NO: 2373064 - DNA, 14 bp, Homo sapiens
gggaaggccctgag

SEQ ID NO: 2373065 - DNA, 14 bp, Homo sapiens
gggaagtaacagac

SEQ ID NO: 2373066 - DNA, 18 bp, Homo sapiens
gggaatccaagcctccac

SEQ ID NO: 2373067 - DNA, 17 bp, Homo sapiens
gggaattaaaaagaaga

SEQ ID NO: 2373068 - DNA, 13 bp, Homo sapiens
gggacacacagcc

SEQ ID NO: 2373069 - DNA, 21 bp, Homo sapiens
gggactgtctttcagatacat

SEQ ID NO: 2373070 - DNA, 14 bp, Homo sapiens
gggacttgtgtctg

SEQ ID NO: 2373071 - DNA, 23 bp, Homo sapiens
gggagagagagagagagaggaca

SEQ ID NO: 2373072 - DNA, 16 bp, Homo sapiens
gggagagcctgctggc

SEQ ID NO: 2373073 - DNA, 17 bp, Homo sapiens
gggagagggaggtcact

SEQ ID NO: 2373074 - DNA, 16 bp, Homo sapiens
gggagcgtctgggaac

SEQ ID NO: 2373075 - DNA, 13 bp, Homo sapiens
gggagctgagcag

SEQ ID NO: 2373076 - DNA, 19 bp, Homo sapiens
gggagctgagcagcctctg

SEQ ID NO: 2373077 - DNA, 22 bp, Homo sapiens
gggaggaaggcctttcttctgt

SEQ ID NO: 2373078 - DNA, 15 bp, Homo sapiens
gggaggccgaggcgg

SEQ ID NO: 2373079 - DNA, 19 bp, Homo sapiens
gggagggcaggatggcctt

SEQ ID NO: 2373080 - DNA, 15 bp, Homo sapiens
gggaggtcactggaa

SEQ ID NO: 2373081 - DNA, 23 bp, Homo sapiens
gggaggtggaagaagggagaaga

SEQ ID NO: 2373082 - DNA, 20 bp, Homo sapiens
gggagtccctacctgcttca

SEQ ID NO: 2373083 - DNA, 20 bp, Homo sapiens
gggagtcttaataaaataaa

SEQ ID NO: 2373084 - DNA, 15 bp, Homo sapiens
gggatgccaatttcc

SEQ ID NO: 2373085 - DNA, 22 bp, Homo sapiens
gggatggcatttggtctcaggc

SEQ ID NO: 2373086 - DNA, 20 bp, Homo sapiens
gggatggtcggatctcacag

SEQ ID NO: 2373087 - DNA, 16 bp, Homo sapiens
gggattttttcccttt

SEQ ID NO: 2373088 - DNA, 13 bp, Homo sapiens
gggcaagaggaat

SEQ ID NO: 2373089 - DNA, 22 bp, Homo sapiens
gggcacctgacttggctgggga

SEQ ID NO: 2373090 - DNA, 16 bp, Homo sapiens
gggcacgcactgggtt

SEQ ID NO: 2373091 - DNA, 18 bp, Homo sapiens
gggcactccgcgccgatg

SEQ ID NO: 2373092 - DNA, 20 bp, Homo sapiens
gggcagatcttggactcatg

SEQ ID NO: 2373093 - DNA, 12 bp, Homo sapiens
gggcagggctgt

SEQ ID NO: 2373094 - DNA, 23 bp, Homo sapiens
gggcagggttaggaatctcttca

SEQ ID NO: 2373095 - DNA, 17 bp, Homo sapiens
gggcatctcttccccag

SEQ ID NO: 2373096 - DNA, 18 bp, Homo sapiens
gggcatctcttccccaga

SEQ ID NO: 2373097 - DNA, 17 bp, Homo sapiens
gggcattttcctcctct

SEQ ID NO: 2373098 - DNA, 20 bp, Homo sapiens
gggcattttcctcctctgcc

SEQ ID NO: 2373099 - DNA, 14 bp, Homo sapiens
gggccaaggacctg

SEQ ID NO: 2373100 - DNA, 16 bp, Homo sapiens
gggccaaggacctgag

SEQ ID NO: 2373101 - DNA, 14 bp, Homo sapiens
gggccaccaaagct

SEQ ID NO: 2373102 - DNA, 19 bp, Homo sapiens
gggccagaggctgggagtc

SEQ ID NO: 2373103 - DNA, 12 bp, Homo sapiens
gggccagggctg

SEQ ID NO: 2373104 - DNA, 16 bp, Homo sapiens
gggccagggtcctgtc

SEQ ID NO: 2373105 - DNA, 23 bp, Homo sapiens
gggccatctcttaggtgagacag

SEQ ID NO: 2373106 - DNA, 16 bp, Homo sapiens
gggccatgtccaaaga

SEQ ID NO: 2373107 - DNA, 13 bp, Homo sapiens
gggcccccctgcc

SEQ ID NO: 2373108 - DNA, 16 bp, Homo sapiens
gggccgcaccataatg

SEQ ID NO: 2373109 - DNA, 20 bp, Homo sapiens
gggcctagcgatctctcctg

SEQ ID NO: 2373110 - DNA, 13 bp, Homo sapiens
gggcctcctgggg

SEQ ID NO: 2373111 - DNA, 19 bp, Homo sapiens
gggcctgcgccagtcctgc

SEQ ID NO: 2373112 - DNA, 20 bp, Homo sapiens
gggcctgctgcgtcagacca

SEQ ID NO: 2373113 - DNA, 21 bp, Homo sapiens
gggcctgggacttccatgcct

SEQ ID NO: 2373114 - DNA, 12 bp, Homo sapiens
gggcctgggagg

SEQ ID NO: 2373115 - DNA, 16 bp, Homo sapiens
gggccttgatgactgc

SEQ ID NO: 2373116 - DNA, 18 bp, Homo sapiens
gggccttgatgactgcct

SEQ ID NO: 2373117 - DNA, 23 bp, Homo sapiens
gggccttgctacctcaaggggga

SEQ ID NO: 2373118 - DNA, 16 bp, Homo sapiens
gggcgcggtggctcac

SEQ ID NO: 2373119 - DNA, 14 bp, Homo sapiens
gggctagggagacg

SEQ ID NO: 2373120 - DNA, 11 bp, Homo sapiens
gggctcccagg

SEQ ID NO: 2373121 - DNA, 15 bp, Homo sapiens
gggctccctcctgga

SEQ ID NO: 2373122 - DNA, 21 bp, Homo sapiens
gggctccctcctggagcatcc

SEQ ID NO: 2373123 - DNA, 18 bp, Homo sapiens
gggctcgccccacccagg

SEQ ID NO: 2373124 - DNA, 10 bp, Homo sapiens
gggctctgat

SEQ ID NO: 2373125 - DNA, 14 bp, Homo sapiens
gggctgagggcctg

SEQ ID NO: 2373126 - DNA, 16 bp, Homo sapiens
gggctgagggcctgct

SEQ ID NO: 2373127 - DNA, 17 bp, Homo sapiens
gggctgccaccagcccc

SEQ ID NO: 2373128 - DNA, 13 bp, Homo sapiens
gggctgggtgctg

SEQ ID NO: 2373129 - DNA, 14 bp, Homo sapiens
gggctgggtgctgg

SEQ ID NO: 2373130 - DNA, 15 bp, Homo sapiens
gggctggtgggacag

SEQ ID NO: 2373131 - DNA, 16 bp, Homo sapiens
gggcttcactgtataa

SEQ ID NO: 2373132 - DNA, 17 bp, Homo sapiens
gggcttcatctctttag

SEQ ID NO: 2373133 - DNA, 22 bp, Homo sapiens
gggcttcctgcccttccctctg

SEQ ID NO: 2373134 - DNA, 21 bp, Homo sapiens
gggcttctcctcctctgtctt

SEQ ID NO: 2373135 - DNA, 13 bp, Homo sapiens
gggcttggcctgc

SEQ ID NO: 2373136 - DNA, 21 bp, Homo sapiens
ggtgggcccagaccactgtct

SEQ ID NO: 2373137 - DNA, 13 bp, Homo sapiens
ggtgggctctgtg

SEQ ID NO: 2373138 - DNA, 16 bp, Homo sapiens
ggtggttaaggccagg

SEQ ID NO: 2373139 - DNA, 15 bp, Homo sapiens
ggtgtaataagacat

SEQ ID NO: 2373140 - DNA, 15 bp, Homo sapiens
ggtgtatataatttt

SEQ ID NO: 2373141 - DNA, 17 bp, Homo sapiens
ggtgtcaccctgcagag

SEQ ID NO: 2373142 - DNA, 19 bp, Homo sapiens
ggtgtcaccctgcagagct

SEQ ID NO: 2373143 - DNA, 20 bp, Homo sapiens
ggtgtcaccctgcagagcta

SEQ ID NO: 2373144 - DNA, 18 bp, Homo sapiens
ggtgtcctgcctgtctgc

SEQ ID NO: 2373145 - DNA, 15 bp, Homo sapiens
ggtgtgaacatgttc

SEQ ID NO: 2373146 - DNA, 15 bp, Homo sapiens
ggtgtgggtgtcctg

SEQ ID NO: 2373147 - DNA, 16 bp, Homo sapiens
ggttaaaaaaaaaagt

SEQ ID NO: 2373148 - DNA, 22 bp, Homo sapiens
ggttaacccttcatcttcctgt

SEQ ID NO: 2373149 - DNA, 17 bp, Homo sapiens
ggttacttcttctctta

SEQ ID NO: 2373150 - DNA, 14 bp, Homo sapiens
ggttactttcaaaa

SEQ ID NO: 2373151 - DNA, 18 bp, Homo sapiens
ggttagattcaaggcccc

SEQ ID NO: 2373152 - DNA, 23 bp, Homo sapiens
ggttatcgaaataacaatgttaa

SEQ ID NO: 2373153 - DNA, 15 bp, Homo sapiens
ggttcaagccttcca

SEQ ID NO: 2373154 - DNA, 19 bp, Homo sapiens
ggttcctcaaattttttga

SEQ ID NO: 2373155 - DNA, 17 bp, Homo sapiens
ggttcctggtgactcct

SEQ ID NO: 2373156 - DNA, 13 bp, Homo sapiens
ggttcttcccctc

SEQ ID NO: 2373157 - DNA, 21 bp, Homo sapiens
ggttcttgcaaatgggagctg

SEQ ID NO: 2373158 - DNA, 15 bp, Homo sapiens
ggttgactttaccca

SEQ ID NO: 2373159 - DNA, 18 bp, Homo sapiens
ggttgctccgcctggcct

SEQ ID NO: 2373160 - DNA, 11 bp, Homo sapiens
ggttggagccc

SEQ ID NO: 2373161 - DNA, 13 bp, Homo sapiens
ggttggctcccgc

SEQ ID NO: 2373162 - DNA, 14 bp, Homo sapiens
ggttgtcttattgc

SEQ ID NO: 2373163 - DNA, 14 bp, Homo sapiens
ggtttaaagtttga

SEQ ID NO: 2373164 - DNA, 20 bp, Homo sapiens
ggtttattttcagtcccctc

SEQ ID NO: 2373165 - DNA, 20 bp, Homo sapiens
ggtttctctattaaaatgca

SEQ ID NO: 2373166 - DNA, 15 bp, Homo sapiens
ggtttctctgtggct

SEQ ID NO: 2373167 - DNA, 16 bp, Homo sapiens
ggtttggaatattaaa

SEQ ID NO: 2373168 - DNA, 23 bp, Homo sapiens
ggttttatggttacttcttctct

SEQ ID NO: 2373169 - DNA, 21 bp, Homo sapiens
ggttttggcaaacgctaaaga

SEQ ID NO: 2373170 - DNA, 19 bp, Homo sapiens
gtaaaaaaaaatgcctttg

SEQ ID NO: 2373171 - DNA, 13 bp, Homo sapiens
gtaaaaaaaccac

SEQ ID NO: 2373172 - DNA, 23 bp, Homo sapiens
gtaaaaaaaccaccaaaaacaaa

SEQ ID NO: 2373173 - DNA, 23 bp, Homo sapiens
gtaaaaaatgtctcatgtcaatg

SEQ ID NO: 2373174 - DNA, 17 bp, Homo sapiens
gtaaaaactagaaggct

SEQ ID NO: 2373175 - DNA, 14 bp, Homo sapiens
gtaaaagaaatcat

SEQ ID NO: 2373176 - DNA, 20 bp, Homo sapiens
gtaaaagaaatcatgtccat

SEQ ID NO: 2373177 - DNA, 21 bp, Homo sapiens
gtaaaagtggtctctgctggg

SEQ ID NO: 2373178 - DNA, 23 bp, Homo sapiens
gtaaagtttccgtgcgtggcact

SEQ ID NO: 2373179 - DNA, 14 bp, Homo sapiens
gtaaataaaccact

SEQ ID NO: 2373180 - DNA, 17 bp, Homo sapiens
gtaaataggaatcattc

SEQ ID NO: 2373181 - DNA, 21 bp, Homo sapiens
gtaaataggaatcattcagaa

SEQ ID NO: 2373182 - DNA, 16 bp, Homo sapiens
gtaaatcagaaagtaa

SEQ ID NO: 2373183 - DNA, 24 bp, Homo sapiens
gtaaatgtgtttcttgctgccatg

SEQ ID NO: 2373184 - DNA, 13 bp, Homo sapiens
gtaaatgtttctt

SEQ ID NO: 2373185 - DNA, 18 bp, Homo sapiens
gtaacaaaggtttaaagt

SEQ ID NO: 2373186 - DNA, 18 bp, Homo sapiens
gtaacaagaaagtggtct

SEQ ID NO: 2373187 - DNA, 17 bp, Homo sapiens
gtaacaatacatgagaa

SEQ ID NO: 2373188 - DNA, 20 bp, Homo sapiens
gtaacactagggccttggaa

SEQ ID NO: 2373189 - DNA, 21 bp, Homo sapiens
gtaaccaatcctactaataaa

SEQ ID NO: 2373190 - DNA, 16 bp, Homo sapiens
gtaactataagataca

SEQ ID NO: 2373191 - DNA, 19 bp, Homo sapiens
gtaactattgggtgaatat

SEQ ID NO: 2373192 - DNA, 14 bp, Homo sapiens
gtaactcagacatt

SEQ ID NO: 2373193 - DNA, 14 bp, Homo sapiens
gtaactgagagaaa

SEQ ID NO: 2373194 - DNA, 23 bp, Homo sapiens
gtaactgtcaggctgaaaacaat

SEQ ID NO: 2373195 - DNA, 19 bp, Homo sapiens
gtaacttccaaataaataa

SEQ ID NO: 2373196 - DNA, 13 bp, Homo sapiens
gtaacttttaaaa

SEQ ID NO: 2373197 - DNA, 15 bp, Homo sapiens
gtaagaagacatgaa

SEQ ID NO: 2373198 - DNA, 16 bp, Homo sapiens
gtaagagcaaaagcct

SEQ ID NO: 2373199 - DNA, 18 bp, Homo sapiens
gtaagagtgtagaagcat

SEQ ID NO: 2373200 - DNA, 22 bp, Homo sapiens
gtaagagtgtagaagcattcct

SEQ ID NO: 2373201 - DNA, 22 bp, Homo sapiens
gtaagatatctcaatgaaccat

SEQ ID NO: 2373202 - DNA, 19 bp, Homo sapiens
gtaagattgcactgttctg

SEQ ID NO: 2373203 - DNA, 17 bp, Homo sapiens
gtaaggtgcttggagtt

SEQ ID NO: 2373204 - DNA, 15 bp, Homo sapiens
gtaagtgaaattaag

SEQ ID NO: 2373205 - DNA, 17 bp, Homo sapiens
gtaagtggagtcctgga

SEQ ID NO: 2373206 - DNA, 22 bp, Homo sapiens
gtaagtgttctcatgaagcagg

SEQ ID NO: 2373207 - DNA, 13 bp, Homo sapiens
gtaagtttcaggt

SEQ ID NO: 2373208 - DNA, 22 bp, Homo sapiens
gtaagtttcaggtgacatgtga

SEQ ID NO: 2373209 - DNA, 13 bp, Homo sapiens
gtaataagacata

SEQ ID NO: 2373210 - DNA, 14 bp, Homo sapiens
gtaataagacataa

SEQ ID NO: 2373211 - DNA, 19 bp, Homo sapiens
gtaataagacataacgttt

SEQ ID NO: 2373212 - DNA, 23 bp, Homo sapiens
gtaataagacataacgtttttcc

SEQ ID NO: 2373213 - DNA, 20 bp, Homo sapiens
gtaataagatggctgtggca

SEQ ID NO: 2373214 - DNA, 13 bp, Homo sapiens
gtaataagcactg

SEQ ID NO: 2373215 - DNA, 20 bp, Homo sapiens
gtaataagcactgtaaactt

SEQ ID NO: 2373216 - DNA, 21 bp, Homo sapiens
gtaataagcactgtaaacttc

SEQ ID NO: 2373217 - DNA, 13 bp, Homo sapiens
gtaataatagact

SEQ ID NO: 2373218 - DNA, 17 bp, Homo sapiens
gtaatatcagttacagt

SEQ ID NO: 2373219 - DNA, 20 bp, Homo sapiens
gtaatattattactttatga

SEQ ID NO: 2373220 - DNA, 17 bp, Homo sapiens
gtaatctttacctgtat

SEQ ID NO: 2373221 - DNA, 18 bp, Homo sapiens
gtaatgacttagaaactg

SEQ ID NO: 2373222 - DNA, 17 bp, Homo sapiens
gtaattacctggagaag

SEQ ID NO: 2373223 - DNA, 23 bp, Homo sapiens
gtaatttgagagaaatatgaaga

SEQ ID NO: 2373224 - DNA, 20 bp, Homo sapiens
gtaattttattttaaaattt

SEQ ID NO: 2373225 - DNA, 17 bp, Homo sapiens
gtacaaatgaagaaagt

SEQ ID NO: 2373226 - DNA, 17 bp, Homo sapiens
gtacagaatttgaatta

SEQ ID NO: 2373227 - DNA, 20 bp, Homo sapiens
gtacagaccgagaggccagt

SEQ ID NO: 2373228 - DNA, 21 bp, Homo sapiens
gtacagaccgagaggccagtt

SEQ ID NO: 2373229 - DNA, 12 bp, Homo sapiens
gtacagatcaag

SEQ ID NO: 2373230 - DNA, 16 bp, Homo sapiens
gtacagatcaagaaaa

SEQ ID NO: 2373231 - DNA, 12 bp, Homo sapiens
gtacagcagggt

SEQ ID NO: 2373232 - DNA, 21 bp, Homo sapiens
gtacagcggctcccctctgct

SEQ ID NO: 2373233 - DNA, 23 bp, Homo sapiens
gtacagcggctcccctctgcttc

SEQ ID NO: 2373234 - DNA, 21 bp, Homo sapiens
gtacatagttatttttctctt

SEQ ID NO: 2373235 - DNA, 14 bp, Homo sapiens
gtacatatatacca

SEQ ID NO: 2373236 - DNA, 13 bp, Homo sapiens
gtacatcttcttt

SEQ ID NO: 2373237 - DNA, 16 bp, Homo sapiens
gtacatcttctttgga

SEQ ID NO: 2373238 - DNA, 20 bp, Homo sapiens
gtacatcttctttggaaata

SEQ ID NO: 2373239 - DNA, 14 bp, Homo sapiens
gtacatttaaattt

SEQ ID NO: 2373240 - DNA, 18 bp, Homo sapiens
gtacatttatgatttaat

SEQ ID NO: 2373241 - DNA, 20 bp, Homo sapiens
gtacatttatgatttaataa

SEQ ID NO: 2373242 - DNA, 16 bp, Homo sapiens
gtaccaatgggaagca

SEQ ID NO: 2373243 - DNA, 16 bp, Homo sapiens
gtaccagctgcgcttg

SEQ ID NO: 2373244 - DNA, 12 bp, Homo sapiens
gtactgaatttt

SEQ ID NO: 2373245 - DNA, 22 bp, Homo sapiens
gtactgaatttttttgtaataa

SEQ ID NO: 2373246 - DNA, 14 bp, Homo sapiens
gtactgatttcagt

SEQ ID NO: 2373247 - DNA, 19 bp, Homo sapiens
gtactgtctgttatgattt

SEQ ID NO: 2373248 - DNA, 23 bp, Homo sapiens
gtacttaaatggtaataagcact

SEQ ID NO: 2373249 - DNA, 23 bp, Homo sapiens
gtacttaggcttggctgccctgt

SEQ ID NO: 2373250 - DNA, 20 bp, Homo sapiens
gtccagctggggccagaggc

SEQ ID NO: 2373251 - DNA, 15 bp, Homo sapiens
gtccagcttccaaag

SEQ ID NO: 2373252 - DNA, 17 bp, Homo sapiens
gtccagcttccaaagcc

SEQ ID NO: 2373253 - DNA, 19 bp, Homo sapiens
gtccaggcagctccctcct

SEQ ID NO: 2373254 - DNA, 18 bp, Homo sapiens
gtccaggggtctgtctgc

SEQ ID NO: 2373255 - DNA, 16 bp, Homo sapiens
gtccagggtttctctg

SEQ ID NO: 2373256 - DNA, 17 bp, Homo sapiens
gtccagggtttctctgc

SEQ ID NO: 2373257 - DNA, 13 bp, Homo sapiens
gtccaggtagaaa

SEQ ID NO: 2373258 - DNA, 11 bp, Homo sapiens
gtccagtgcct

SEQ ID NO: 2373259 - DNA, 16 bp, Homo sapiens
gtccagtgctctgcct

SEQ ID NO: 2373260 - DNA, 15 bp, Homo sapiens
gtccattctcccagg

SEQ ID NO: 2373261 - DNA, 13 bp, Homo sapiens
gtcccagatgctg

SEQ ID NO: 2373262 - DNA, 22 bp, Homo sapiens
gtcccagccccggcaagccaca

SEQ ID NO: 2373263 - DNA, 14 bp, Homo sapiens
gtccccacccctgc

SEQ ID NO: 2373264 - DNA, 16 bp, Homo sapiens
gtccccatactcctat

SEQ ID NO: 2373265 - DNA, 17 bp, Homo sapiens
gtccccatactcctatg

SEQ ID NO: 2373266 - DNA, 12 bp, Homo sapiens
gtccccatttct

SEQ ID NO: 2373267 - DNA, 13 bp, Homo sapiens
gtcccccaggctg

SEQ ID NO: 2373268 - DNA, 22 bp, Homo sapiens
gtccccctcctcccagggcctc

SEQ ID NO: 2373269 - DNA, 18 bp, Homo sapiens
gtcccctgctacacctat

SEQ ID NO: 2373270 - DNA, 12 bp, Homo sapiens
gtcccctgttga

SEQ ID NO: 2373271 - DNA, 21 bp, Homo sapiens
gtcccctgttgattatcttca

SEQ ID NO: 2373272 - DNA, 17 bp, Homo sapiens
gtcccggttcaccttgc

SEQ ID NO: 2373273 - DNA, 16 bp, Homo sapiens
gtccctacctgcttca

SEQ ID NO: 2373274 - DNA, 13 bp, Homo sapiens
gtccctccctgcc

SEQ ID NO: 2373275 - DNA, 16 bp, Homo sapiens
gtccctccctgcctga

SEQ ID NO: 2373276 - DNA, 17 bp, Homo sapiens
gtccctggcgcaggtgg

SEQ ID NO: 2373277 - DNA, 15 bp, Homo sapiens
gtccctgtagctcag

SEQ ID NO: 2373278 - DNA, 12 bp, Homo sapiens
gtccctgttaga

SEQ ID NO: 2373279 - DNA, 15 bp, Homo sapiens
gtcccttttctttga

SEQ ID NO: 2373280 - DNA, 15 bp, Homo sapiens
gtccgtgaaagttgt

SEQ ID NO: 2373281 - DNA, 16 bp, Homo sapiens
gtcctacgtccaaggt

SEQ ID NO: 2373282 - DNA, 24 bp, Homo sapiens
gtcctacgtccaaggtggcagatg

SEQ ID NO: 2373283 - DNA, 15 bp, Homo sapiens
gtcctagcccttccc

SEQ ID NO: 2373284 - DNA, 16 bp, Homo sapiens
gtcctagcccttccct

SEQ ID NO: 2373285 - DNA, 17 bp, Homo sapiens
gtcctagtaagaagaca

SEQ ID NO: 2373286 - DNA, 13 bp, Homo sapiens
gtcctcctcacct

SEQ ID NO: 2373287 - DNA, 21 bp, Homo sapiens
gtcctcctcacctcatgccca

SEQ ID NO: 2373288 - DNA, 15 bp, Homo sapiens
gtcctgcctgtctgc

SEQ ID NO: 2373289 - DNA, 16 bp, Homo sapiens
gtcctgcctgtctgcc

SEQ ID NO: 2373290 - DNA, 18 bp, Homo sapiens
gtcctgcctgtctgcccc

SEQ ID NO: 2373291 - DNA, 21 bp, Homo sapiens
gtcctgcctgtctgccccagc

SEQ ID NO: 2373292 - DNA, 16 bp, Homo sapiens
gtcctggaatttggac

SEQ ID NO: 2373293 - DNA, 16 bp, Homo sapiens
gtcctggtacagcagg

SEQ ID NO: 2373294 - DNA, 18 bp, Homo sapiens
gtcctggtacagcagggt

SEQ ID NO: 2373295 - DNA, 23 bp, Homo sapiens
gtcctgtagttgcgtggactctg

SEQ ID NO: 2373296 - DNA, 16 bp, Homo sapiens
gtccttgatttcaaag

SEQ ID NO: 2373297 - DNA, 18 bp, Homo sapiens
gtcctttaggcagcctgc

SEQ ID NO: 2373298 - DNA, 13 bp, Homo sapiens
gtcctttatgtat

SEQ ID NO: 2373299 - DNA, 17 bp, Homo sapiens
gtcctttatgtattctc

SEQ ID NO: 2373300 - DNA, 17 bp, Homo sapiens
gtcgtcatcagatgctt

SEQ ID NO: 2373301 - DNA, 17 bp, Homo sapiens
gtcgtgatgtggaggaa

SEQ ID NO: 2373302 - DNA, 21 bp, Homo sapiens
gtctacaaactgaacactgca

SEQ ID NO: 2373303 - DNA, 20 bp, Homo sapiens
gtctaggactgcagtgtgga

SEQ ID NO: 2373304 - DNA, 15 bp, Homo sapiens
gtctcactgcttgaa

SEQ ID NO: 2373305 - DNA, 12 bp, Homo sapiens
gtctcaggcagc

SEQ ID NO: 2373306 - DNA, 23 bp, Homo sapiens
gtctcaggcagcaccacactggg

SEQ ID NO: 2373307 - DNA, 20 bp, Homo sapiens
gtctcaggtttgttttgtga

SEQ ID NO: 2373308 - DNA, 18 bp, Homo sapiens
gtctcataggttaaaaaa

SEQ ID NO: 2373309 - DNA, 13 bp, Homo sapiens
gtctcatgtttta

SEQ ID NO: 2373310 - DNA, 15 bp, Homo sapiens
gtctcatttgggcta

SEQ ID NO: 2373311 - DNA, 16 bp, Homo sapiens
gtctccctcccctctc

SEQ ID NO: 2373312 - DNA, 12 bp, Homo sapiens
gtctccctggct

SEQ ID NO: 2373313 - DNA, 16 bp, Homo sapiens
gtctcctccccttccc

SEQ ID NO: 2373314 - DNA, 15 bp, Homo sapiens
gtctcggccttcaca

SEQ ID NO: 2373315 - DNA, 16 bp, Homo sapiens
gtctctactaaaaata

SEQ ID NO: 2373316 - DNA, 18 bp, Homo sapiens
gtctctctatgcctctct

SEQ ID NO: 2373317 - DNA, 18 bp, Homo sapiens
gtctctcttctcagagtg

SEQ ID NO: 2373318 - DNA, 11 bp, Homo sapiens
gtctctgctgg

SEQ ID NO: 2373319 - DNA, 21 bp, Homo sapiens
gtctctttgctttctggtggt

SEQ ID NO: 2373320 - DNA, 18 bp, Homo sapiens
gtctcttttaccctggcc

SEQ ID NO: 2373321 - DNA, 21 bp, Homo sapiens
gtctcttttaccctggcccct

SEQ ID NO: 2373322 - DNA, 13 bp, Homo sapiens
gtctgatttctta

SEQ ID NO: 2373323 - DNA, 13 bp, Homo sapiens
gtctgccaaacac

SEQ ID NO: 2373324 - DNA, 14 bp, Homo sapiens
gtctgccaaacaca

SEQ ID NO: 2373325 - DNA, 20 bp, Homo sapiens
gtctgcccacgcagaggacg

SEQ ID NO: 2373326 - DNA, 12 bp, Homo sapiens
gtctgctctggt

SEQ ID NO: 2373327 - DNA, 18 bp, Homo sapiens
gtctgctggtatttctaa

SEQ ID NO: 2373328 - DNA, 23 bp, Homo sapiens
gtctggaaaaaaacaaaaacaga

SEQ ID NO: 2373329 - DNA, 15 bp, Homo sapiens
gtctggctttgctct

SEQ ID NO: 2373330 - DNA, 23 bp, Homo sapiens
gtctgggaacttgcgagtccaag

SEQ ID NO: 2373331 - DNA, 14 bp, Homo sapiens
gtctgtacacgtgt

SEQ ID NO: 2373332 - DNA, 19 bp, Homo sapiens
gtctgtacacgtgtcctgt

SEQ ID NO: 2373333 - DNA, 21 bp, Homo sapiens
gtctgtcaatcacagtctcag

SEQ ID NO: 2373334 - DNA, 21 bp, Homo sapiens
gtctgtcccttttctttgacc

SEQ ID NO: 2373335 - DNA, 20 bp, Homo sapiens
gtctgtctttcctgaaccat

SEQ ID NO: 2373336 - DNA, 15 bp, Homo sapiens
gtctgttcagcaaac

SEQ ID NO: 2373337 - DNA, 16 bp, Homo sapiens
gtctgtttttactctg

SEQ ID NO: 2373338 - DNA, 20 bp, Homo sapiens
gtcttatgtgaaaaattaac

SEQ ID NO: 2373339 - DNA, 22 bp, Homo sapiens
gtcttatgtgaaaaattaactt

SEQ ID NO: 2373340 - DNA, 12 bp, Homo sapiens
gtcttccctggg

SEQ ID NO: 2373341 - DNA, 14 bp, Homo sapiens
gtcttccctgggct

SEQ ID NO: 2373342 - DNA, 14 bp, Homo sapiens
gtcttcctgacact

SEQ ID NO: 2373343 - DNA, 15 bp, Homo sapiens
gtcttctccctggaa

SEQ ID NO: 2373344 - DNA, 15 bp, Homo sapiens
gtcttcttgtgtcct

SEQ ID NO: 2373345 - DNA, 22 bp, Homo sapiens
gtcttggaagctgtttggaaaa

SEQ ID NO: 2373346 - DNA, 18 bp, Homo sapiens
gtcttggacactgtacaa

SEQ ID NO: 2373347 - DNA, 13 bp, Homo sapiens
gtctttgctcagt

SEQ ID NO: 2373348 - DNA, 13 bp, Homo sapiens
gtctttgtaagag

SEQ ID NO: 2373349 - DNA, 14 bp, Homo sapiens
gtctttgtaagagt

SEQ ID NO: 2373350 - DNA, 23 bp, Homo sapiens
gtcttttgagctattcacctcag

SEQ ID NO: 2373351 - DNA, 20 bp, Homo sapiens
gtgaaaaatcttaagtacca

SEQ ID NO: 2373352 - DNA, 18 bp, Homo sapiens
gtgaaacagttgctgtga

SEQ ID NO: 2373353 - DNA, 19 bp, Homo sapiens
gtgaaaccttttttaagat

SEQ ID NO: 2373354 - DNA, 19 bp, Homo sapiens
gtgaaactaacagataagc

SEQ ID NO: 2373355 - DNA, 17 bp, Homo sapiens
gtgaacagagagaccct

SEQ ID NO: 2373356 - DNA, 19 bp, Homo sapiens
gtgaaccctggggcctgac

SEQ ID NO: 2373357 - DNA, 14 bp, Homo sapiens
gtgaactcctgcca

SEQ ID NO: 2373358 - DNA, 16 bp, Homo sapiens
gtgaagaaataaatga

SEQ ID NO: 2373359 - DNA, 20 bp, Homo sapiens
gtgaagaaataaatgaaact

SEQ ID NO: 2373360 - DNA, 16 bp, Homo sapiens
gtgaagagtttcacaa

SEQ ID NO: 2373361 - DNA, 15 bp, Homo sapiens
gtgaagtgaatctga

SEQ ID NO: 2373362 - DNA, 16 bp, Homo sapiens
gtgaagtgaatctgat

SEQ ID NO: 2373363 - DNA, 14 bp, Homo sapiens
gtgaatagcctggc

SEQ ID NO: 2373364 - DNA, 15 bp, Homo sapiens
gtgaatggattggat

SEQ ID NO: 2373365 - DNA, 14 bp, Homo sapiens
gtgaattattgaca

SEQ ID NO: 2373366 - DNA, 19 bp, Homo sapiens
gtggaggaggaaggcaaga

SEQ ID NO: 2373367 - DNA, 13 bp, Homo sapiens
gtggaggcttcct

SEQ ID NO: 2373368 - DNA, 16 bp, Homo sapiens
gtggaggggtgtggca

SEQ ID NO: 2373369 - DNA, 13 bp, Homo sapiens
gtggataagaaaa

SEQ ID NO: 2373370 - DNA, 16 bp, Homo sapiens
gtggatgttatgaaca

SEQ ID NO: 2373371 - DNA, 22 bp, Homo sapiens
gtggccacaatccacgcttctc

SEQ ID NO: 2373372 - DNA, 21 bp, Homo sapiens
gtggccacagcgccagcctca

SEQ ID NO: 2373373 - DNA, 19 bp, Homo sapiens
gtggccatgttatgctggt

SEQ ID NO: 2373374 - DNA, 19 bp, Homo sapiens
gtggcccaaggctggcagg

SEQ ID NO: 2373375 - DNA, 22 bp, Homo sapiens
gtggcctcagctcaatgcagtt

SEQ ID NO: 2373376 - DNA, 18 bp, Homo sapiens
gtggcgtgggagccagcc

SEQ ID NO: 2373377 - DNA, 22 bp, Homo sapiens
gtggctgatggtgtggcctgtg

SEQ ID NO: 2373378 - DNA, 16 bp, Homo sapiens
gtggctggctctacct

SEQ ID NO: 2373379 - DNA, 12 bp, Homo sapiens
gtggctgggcag

SEQ ID NO: 2373380 - DNA, 20 bp, Homo sapiens
gtggcttaagtgagcagaac

SEQ ID NO: 2373381 - DNA, 22 bp, Homo sapiens
gtggcttaagtgagcagaacag

SEQ ID NO: 2373382 - DNA, 14 bp, Homo sapiens
gtgggacagtggtg

SEQ ID NO: 2373383 - DNA, 16 bp, Homo sapiens
gtgggagtgtgtctgc

SEQ ID NO: 2373384 - DNA, 17 bp, Homo sapiens
gtgggattttttccctt

SEQ ID NO: 2373385 - DNA, 16 bp, Homo sapiens
gtgggctacatgctgg

SEQ ID NO: 2373386 - DNA, 19 bp, Homo sapiens
gtgggctacatgctggggt

SEQ ID NO: 2373387 - DNA, 18 bp, Homo sapiens
gtgggctctgtgcagtca

SEQ ID NO: 2373388 - DNA, 21 bp, Homo sapiens
gtgggcttcctgcccttccct

SEQ ID NO: 2373389 - DNA, 23 bp, Homo sapiens
gtgggcttcctgcccttccctct

SEQ ID NO: 2373390 - DNA, 22 bp, Homo sapiens
gtggggccataaacggttcctg

SEQ ID NO: 2373391 - DNA, 23 bp, Homo sapiens
gtggggccataaacggttcctgg

SEQ ID NO: 2373392 - DNA, 15 bp, Homo sapiens
gtgggggcagcccag

SEQ ID NO: 2373393 - DNA, 13 bp, Homo sapiens
gtgggtgctgcca

SEQ ID NO: 2373394 - DNA, 18 bp, Homo sapiens
gtgggtgtcctgcctgtc

SEQ ID NO: 2373395 - DNA, 17 bp, Homo sapiens
gtgggtgttctttcctg

SEQ ID NO: 2373396 - DNA, 20 bp, Homo sapiens
gtgggtgttctttcctgccc

SEQ ID NO: 2373397 - DNA, 15 bp, Homo sapiens
gtggtggaagggtag

SEQ ID NO: 2373398 - DNA, 13 bp, Homo sapiens
gtggttcctctgc

SEQ ID NO: 2373399 - DNA, 14 bp, Homo sapiens
gtgtaaaaaatgtc

SEQ ID NO: 2373400 - DNA, 13 bp, Homo sapiens
gtgtaaaatgtat

SEQ ID NO: 2373401 - DNA, 14 bp, Homo sapiens
gtgtaataagacat

SEQ ID NO: 2373402 - DNA, 14 bp, Homo sapiens
gtgtagaagcattc

SEQ ID NO: 2373403 - DNA, 17 bp, Homo sapiens
gtgtagaagcattcctt

SEQ ID NO: 2373404 - DNA, 15 bp, Homo sapiens
gtgtagagttaagaa

SEQ ID NO: 2373405 - DNA, 14 bp, Homo sapiens
gtgtagcctgtgca

SEQ ID NO: 2373406 - DNA, 23 bp, Homo sapiens
gtgtagctgcaaaaataatcatg

SEQ ID NO: 2373407 - DNA, 12 bp, Homo sapiens
gtgtataaatgt

SEQ ID NO: 2373408 - DNA, 14 bp, Homo sapiens
gtgtatataatttt

SEQ ID NO: 2373409 - DNA, 15 bp, Homo sapiens
gtgtatgactaaaga

SEQ ID NO: 2373410 - DNA, 14 bp, Homo sapiens
gtgtattctctgta

SEQ ID NO: 2373411 - DNA, 15 bp, Homo sapiens
gtgtatttattacat

SEQ ID NO: 2373412 - DNA, 16 bp, Homo sapiens
gtgtcaagctgctctg

SEQ ID NO: 2373413 - DNA, 15 bp, Homo sapiens
gtgtcaccctgcaga

SEQ ID NO: 2373414 - DNA, 14 bp, Homo sapiens
gtgtcagctgaggc

SEQ ID NO: 2373415 - DNA, 18 bp, Homo sapiens
gtgtcagctgaggctggg

SEQ ID NO: 2373416 - DNA, 19 bp, Homo sapiens
gtgtccataaataaagttt

SEQ ID NO: 2373417 - DNA, 19 bp, Homo sapiens
gtgtctcaaaggagctttc

SEQ ID NO: 2373418 - DNA, 20 bp, Homo sapiens
gtgtctgccaaacacattta

SEQ ID NO: 2373419 - DNA, 12 bp, Homo sapiens
gtgtctgtacac

SEQ ID NO: 2373420 - DNA, 13 bp, Homo sapiens
gtgtctgtacacg

SEQ ID NO: 2373421 - DNA, 16 bp, Homo sapiens
gtgtctgtacacgtgt

SEQ ID NO: 2373422 - DNA, 21 bp, Homo sapiens
gtgtctgtacacgtgtcctgt

SEQ ID NO: 2373423 - DNA, 18 bp, Homo sapiens
gtgtgacatttggagagg

SEQ ID NO: 2373424 - DNA, 19 bp, Homo sapiens
gtgtgacatttggagaggg

SEQ ID NO: 2373425 - DNA, 23 bp, Homo sapiens
gtgtgctctccattctgctcctt

SEQ ID NO: 2373426 - DNA, 19 bp, Homo sapiens
gtgtggagttcaccttgga

SEQ ID NO: 2373427 - DNA, 22 bp, Homo sapiens
gtgtggagttcaccttggaagg

SEQ ID NO: 2373428 - DNA, 12 bp, Homo sapiens
gtgtggcagtgg

SEQ ID NO: 2373429 - DNA, 14 bp, Homo sapiens
gtgtggcagtggtt

SEQ ID NO: 2373430 - DNA, 12 bp, Homo sapiens
gtgtggctttcc

SEQ ID NO: 2373431 - DNA, 20 bp, Homo sapiens
gtgtgtagagttaagaagct

SEQ ID NO: 2373432 - DNA, 16 bp, Homo sapiens
gtgtgtcagctgaggc

SEQ ID NO: 2373433 - DNA, 16 bp, Homo sapiens
gtgttcagcagaacct

SEQ ID NO: 2373434 - DNA, 18 bp, Homo sapiens
gtgttcagctctttccaa

SEQ ID NO: 2373435 - DNA, 21 bp, Homo sapiens
gtgttcccatttcagctgatc

SEQ ID NO: 2373436 - DNA, 18 bp, Homo sapiens
gtgttctcatgaagcagg

SEQ ID NO: 2373437 - DNA, 21 bp, Homo sapiens
gtgttctcatgaagcaggagg

SEQ ID NO: 2373438 - DNA, 18 bp, Homo sapiens
gtgttctgtttgaaacta

SEQ ID NO: 2373439 - DNA, 15 bp, Homo sapiens
gtgttctttcctgcc

SEQ ID NO: 2373440 - DNA, 20 bp, Homo sapiens
gtgttctttcctgccctgtc

SEQ ID NO: 2373441 - DNA, 21 bp, Homo sapiens
gtgtttcctaggaggaaaatt

SEQ ID NO: 2373442 - DNA, 19 bp, Homo sapiens
gtgtttcgcgggtaactgg

SEQ ID NO: 2373443 - DNA, 16 bp, Homo sapiens
gtgtttggcaatgcta

SEQ ID NO: 2373444 - DNA, 16 bp, Homo sapiens
gtgttttgcaagtgct

SEQ ID NO: 2373445 - DNA, 17 bp, Homo sapiens
gtgtttttagctgtgac

SEQ ID NO: 2373446 - DNA, 15 bp, Homo sapiens
gtgttttttaagata

SEQ ID NO: 2373447 - DNA, 21 bp, Homo sapiens
gtgttttttaagatagtgtaa

SEQ ID NO: 2373448 - DNA, 23 bp, Homo sapiens
gttaaacggtgcccatcctgcca

SEQ ID NO: 2373449 - DNA, 19 bp, Homo sapiens
gttaaactattagagtatt

SEQ ID NO: 2373450 - DNA, 21 bp, Homo sapiens
gttaaagggatatttttttct

SEQ ID NO: 2373451 - DNA, 23 bp, Homo sapiens
gttaacatctagcctaaagtata

SEQ ID NO: 2373452 - DNA, 15 bp, Homo sapiens
gttaagaagctgttg

SEQ ID NO: 2373453 - DNA, 20 bp, Homo sapiens
gttaagaagctgttgtacat

SEQ ID NO: 2373454 - DNA, 16 bp, Homo sapiens
gttaaggaaactctta

SEQ ID NO: 2373455 - DNA, 21 bp, Homo sapiens
gttaaggaaactcttatctca

SEQ ID NO: 2373456 - DNA, 21 bp, Homo sapiens
gttaagtatcagctacaattg

SEQ ID NO: 2373457 - DNA, 13 bp, Homo sapiens
gttaataccagct

SEQ ID NO: 2373458 - DNA, 22 bp, Homo sapiens
gttacaggcaccgagaatgttg

SEQ ID NO: 2373459 - DNA, 13 bp, Homo sapiens
gttacctactttg

SEQ ID NO: 2373460 - DNA, 23 bp, Homo sapiens
gttacctctattttaattactgc

SEQ ID NO: 2373461 - DNA, 14 bp, Homo sapiens
gttacctgtgtgct

SEQ ID NO: 2373462 - DNA, 22 bp, Homo sapiens
gttactggatttgttgttcttt

SEQ ID NO: 2373463 - DNA, 14 bp, Homo sapiens
gttacttcttctct

SEQ ID NO: 2373464 - DNA, 15 bp, Homo sapiens
gttacttcttctctt

SEQ ID NO: 2373465 - DNA, 20 bp, Homo sapiens
gttagggctgcttttcttaa

SEQ ID NO: 2373466 - DNA, 16 bp, Homo sapiens
gttagtaaaggaacca

SEQ ID NO: 2373467 - DNA, 17 bp, Homo sapiens
gttatcaaaatagtcta

SEQ ID NO: 2373468 - DNA, 19 bp, Homo sapiens
gttatcatgaattttaaag

SEQ ID NO: 2373469 - DNA, 20 bp, Homo sapiens
gttatcatgaattttaaagt

SEQ ID NO: 2373470 - DNA, 11 bp, Homo sapiens
gttatgaaaat

SEQ ID NO: 2373471 - DNA, 12 bp, Homo sapiens
gttatgaacagc

SEQ ID NO: 2373472 - DNA, 20 bp, Homo sapiens
gttatgatttccttcaatgt

SEQ ID NO: 2373473 - DNA, 13 bp, Homo sapiens
gttatgctgtgac

SEQ ID NO: 2373474 - DNA, 12 bp, Homo sapiens
gttatgttgtaa

SEQ ID NO: 2373475 - DNA, 12 bp, Homo sapiens
gttattttctac

SEQ ID NO: 2373476 - DNA, 21 bp, Homo sapiens
gttcaaggtcactgtttcctg

SEQ ID NO: 2373477 - DNA, 14 bp, Homo sapiens
gttcaccttggaag

SEQ ID NO: 2373478 - DNA, 15 bp, Homo sapiens
gttcaccttggaagg

SEQ ID NO: 2373479 - DNA, 17 bp, Homo sapiens
gttccctcctagctctc

SEQ ID NO: 2373480 - DNA, 18 bp, Homo sapiens
gttccctcctagctctcc

SEQ ID NO: 2373481 - DNA, 15 bp, Homo sapiens
taaaacaaataaata

SEQ ID NO: 2373482 - DNA, 17 bp, Homo sapiens
taaaacaaataaatatg

SEQ ID NO: 2373483 - DNA, 19 bp, Homo sapiens
taaaacagacactggcatg

SEQ ID NO: 2373484 - DNA, 13 bp, Homo sapiens
taaaaccaaagag

SEQ ID NO: 2373485 - DNA, 17 bp, Homo sapiens
taaaactaaatttcact

SEQ ID NO: 2373486 - DNA, 14 bp, Homo sapiens
taaaagaaataaac

SEQ ID NO: 2373487 - DNA, 15 bp, Homo sapiens
taaaagaacatgctt

SEQ ID NO: 2373488 - DNA, 18 bp, Homo sapiens
taaaagaacatgcttgaa

SEQ ID NO: 2373489 - DNA, 18 bp, Homo sapiens
taaaaggcttgaagctgt

SEQ ID NO: 2373490 - DNA, 15 bp, Homo sapiens
taaaaggtaatgtgt

SEQ ID NO: 2373491 - DNA, 17 bp, Homo sapiens
taaaagtggtctctgct

SEQ ID NO: 2373492 - DNA, 19 bp, Homo sapiens
taaaagtggtctctgctgg

SEQ ID NO: 2373493 - DNA, 17 bp, Homo sapiens
taaaagttttatatgct

SEQ ID NO: 2373494 - DNA, 19 bp, Homo sapiens
taaaataaaatgaaaattg

SEQ ID NO: 2373495 - DNA, 13 bp, Homo sapiens
taaaataaataat

SEQ ID NO: 2373496 - DNA, 14 bp, Homo sapiens
taaaataattcata

SEQ ID NO: 2373497 - DNA, 17 bp, Homo sapiens
taaaataattcatatct

SEQ ID NO: 2373498 - DNA, 15 bp, Homo sapiens
taaaataattctaaa

SEQ ID NO: 2373499 - DNA, 17 bp, Homo sapiens
taaaataattctaaagg

SEQ ID NO: 2373500 - DNA, 14 bp, Homo sapiens
taaaatagaaaaag

SEQ ID NO: 2373501 - DNA, 16 bp, Homo sapiens
taaaatagtatgaaaa

SEQ ID NO: 2373502 - DNA, 18 bp, Homo sapiens
taaaatatctatttgaat

SEQ ID NO: 2373503 - DNA, 22 bp, Homo sapiens
taaaatatctatttgaataaat

SEQ ID NO: 2373504 - DNA, 23 bp, Homo sapiens
taaaatattgttgaacacttgaa

SEQ ID NO: 2373505 - DNA, 15 bp, Homo sapiens
taaaatgaaaattgt

SEQ ID NO: 2373506 - DNA, 22 bp, Homo sapiens
taaaatggaaaattttctcctt

SEQ ID NO: 2373507 - DNA, 10 bp, Homo sapiens
taaaatgtaa

SEQ ID NO: 2373508 - DNA, 19 bp, Homo sapiens
taaaatgtaatttaaatga

SEQ ID NO: 2373509 - DNA, 13 bp, Homo sapiens
taaaatgtatatt

SEQ ID NO: 2373510 - DNA, 20 bp, Homo sapiens
taaaatgtatatttttaaag

SEQ ID NO: 2373511 - DNA, 12 bp, Homo sapiens
taaaatgtttca

SEQ ID NO: 2373512 - DNA, 22 bp, Homo sapiens
taaaatgtttcattatgcactt

SEQ ID NO: 2373513 - DNA, 21 bp, Homo sapiens
taaaatgtttggatggtttgt

SEQ ID NO: 2373514 - DNA, 15 bp, Homo sapiens
taaaattatgagatt

SEQ ID NO: 2373515 - DNA, 22 bp, Homo sapiens
taaaattatgagattggttttc

SEQ ID NO: 2373516 - DNA, 17 bp, Homo sapiens
taaaattccaaattcat

SEQ ID NO: 2373517 - DNA, 16 bp, Homo sapiens
taaaattgttatcaaa

SEQ ID NO: 2373518 - DNA, 15 bp, Homo sapiens
taaaatttaatttca

SEQ ID NO: 2373519 - DNA, 16 bp, Homo sapiens
taaaatttgtcttaaa

SEQ ID NO: 2373520 - DNA, 20 bp, Homo sapiens
taaaatttttatgtaattat

SEQ ID NO: 2373521 - DNA, 12 bp, Homo sapiens
taaacagaaatg

SEQ ID NO: 2373522 - DNA, 14 bp, Homo sapiens
taaacatgtatgta

SEQ ID NO: 2373523 - DNA, 14 bp, Homo sapiens
taaacccaaaatat

SEQ ID NO: 2373524 - DNA, 21 bp, Homo sapiens
taaacctaggacttccgagct

SEQ ID NO: 2373525 - DNA, 22 bp, Homo sapiens
taaacggttcctggtgactcct

SEQ ID NO: 2373526 - DNA, 21 bp, Homo sapiens
taaacgtgatttttaaattaa

SEQ ID NO: 2373527 - DNA, 20 bp, Homo sapiens
taaactccttcctggcctga

SEQ ID NO: 2373528 - DNA, 14 bp, Homo sapiens
taaacttaaagcta

SEQ ID NO: 2373529 - DNA, 15 bp, Homo sapiens
taaacttacaaactt

SEQ ID NO: 2373530 - DNA, 15 bp, Homo sapiens
taaacttccaaagaa

SEQ ID NO: 2373531 - DNA, 23 bp, Homo sapiens
taaacttctgcaacaagcatgca

SEQ ID NO: 2373532 - DNA, 15 bp, Homo sapiens
taaagacaggagaca

SEQ ID NO: 2373533 - DNA, 12 bp, Homo sapiens
taaagagagaat

SEQ ID NO: 2373534 - DNA, 21 bp, Homo sapiens
taaagagcccttgcctcccca

SEQ ID NO: 2373535 - DNA, 17 bp, Homo sapiens
taaagaggctgaaagag

SEQ ID NO: 2373536 - DNA, 20 bp, Homo sapiens
taaagaggctgaaagaggcc

SEQ ID NO: 2373537 - DNA, 17 bp, Homo sapiens
taaagatattgtatctc

SEQ ID NO: 2373538 - DNA, 18 bp, Homo sapiens
taaagatattgtatctcc

SEQ ID NO: 2373539 - DNA, 19 bp, Homo sapiens
taaagatattgtatctcct

SEQ ID NO: 2373540 - DNA, 21 bp, Homo sapiens
taaagatatttttatctttat

SEQ ID NO: 2373541 - DNA, 16 bp, Homo sapiens
taaagattattttttg

SEQ ID NO: 2373542 - DNA, 13 bp, Homo sapiens
taaagcatttcct

SEQ ID NO: 2373543 - DNA, 16 bp, Homo sapiens
taaagcccttgcacag

SEQ ID NO: 2373544 - DNA, 16 bp, Homo sapiens
taaagctactgtagaa

SEQ ID NO: 2373545 - DNA, 14 bp, Homo sapiens
taaagctcaaatga

SEQ ID NO: 2373546 - DNA, 15 bp, Homo sapiens
taaagctcaaatgaa

SEQ ID NO: 2373547 - DNA, 18 bp, Homo sapiens
taaagctcaaatgaaatg

SEQ ID NO: 2373548 - DNA, 17 bp, Homo sapiens
taaaggcatccttgtct

SEQ ID NO: 2373549 - DNA, 21 bp, Homo sapiens
taaagtaaaaagggaattatg

SEQ ID NO: 2373550 - DNA, 15 bp, Homo sapiens
taaagtataatgttt

SEQ ID NO: 2373551 - DNA, 18 bp, Homo sapiens
taaagtatcacttttctg

SEQ ID NO: 2373552 - DNA, 21 bp, Homo sapiens
taaagtatgcattattaaatt

SEQ ID NO: 2373553 - DNA, 13 bp, Homo sapiens
taaagtgtgtgat

SEQ ID NO: 2373554 - DNA, 21 bp, Homo sapiens
taaagttattcttgtcatttt

SEQ ID NO: 2373555 - DNA, 15 bp, Homo sapiens
taaataaaaatatgt

SEQ ID NO: 2373556 - DNA, 17 bp, Homo sapiens
taaataaaaatatgtaa

SEQ ID NO: 2373557 - DNA, 14 bp, Homo sapiens
taaataaaaattat

SEQ ID NO: 2373558 - DNA, 17 bp, Homo sapiens
taaataaaaattatgtc

SEQ ID NO: 2373559 - DNA, 16 bp, Homo sapiens
taaataaatgggtgta

SEQ ID NO: 2373560 - DNA, 20 bp, Homo sapiens
taaataaatgggtgtatata

SEQ ID NO: 2373561 - DNA, 14 bp, Homo sapiens
taaataactgtgtg

SEQ ID NO: 2373562 - DNA, 14 bp, Homo sapiens
taaataattttaat

SEQ ID NO: 2373563 - DNA, 20 bp, Homo sapiens
taaatacatgcatataatga

SEQ ID NO: 2373564 - DNA, 23 bp, Homo sapiens
taaatagtgtcatataaactcat

SEQ ID NO: 2373565 - DNA, 17 bp, Homo sapiens
taaatatttatgtagat

SEQ ID NO: 2373566 - DNA, 21 bp, Homo sapiens
taaatcagaaagtaacaatct

SEQ ID NO: 2373567 - DNA, 15 bp, Homo sapiens
taaatcataaagtca

SEQ ID NO: 2373568 - DNA, 16 bp, Homo sapiens
taaatcataaagtcag

SEQ ID NO: 2373569 - DNA, 17 bp, Homo sapiens
taaatcataaagtcagt

SEQ ID NO: 2373570 - DNA, 14 bp, Homo sapiens
taaatcctgaagag

SEQ ID NO: 2373571 - DNA, 18 bp, Homo sapiens
taaatcctgaagagcatt

SEQ ID NO: 2373572 - DNA, 22 bp, Homo sapiens
taaatctcgcactacatctgat

SEQ ID NO: 2373573 - DNA, 22 bp, Homo sapiens
taaatgaaagaaaattgagttg

SEQ ID NO: 2373574 - DNA, 17 bp, Homo sapiens
taaatgaaattgatttg

SEQ ID NO: 2373575 - DNA, 15 bp, Homo sapiens
taaatgcaataattt

SEQ ID NO: 2373576 - DNA, 10 bp, Homo sapiens
taaatgcata

SEQ ID NO: 2373577 - DNA, 21 bp, Homo sapiens
taaatgcatatcctgagccat

SEQ ID NO: 2373578 - DNA, 15 bp, Homo sapiens
taaatgcttaaattt

SEQ ID NO: 2373579 - DNA, 17 bp, Homo sapiens
taaatgcttaaatttca

SEQ ID NO: 2373580 - DNA, 19 bp, Homo sapiens
taaatgcttaaatttcaga

SEQ ID NO: 2373581 - DNA, 19 bp, Homo sapiens
taaatggaaacaccactgc

SEQ ID NO: 2373582 - DNA, 23 bp, Homo sapiens
taaatgggtgtatataattttat

SEQ ID NO: 2373583 - DNA, 20 bp, Homo sapiens
taaatggttaaattttacat

SEQ ID NO: 2373584 - DNA, 19 bp, Homo sapiens
taaatgttaaataagtgcg

SEQ ID NO: 2373585 - DNA, 16 bp, Homo sapiens
taaatgttacttctga

SEQ ID NO: 2373586 - DNA, 17 bp, Homo sapiens
taaattatcattgtttg

SEQ ID NO: 2373587 - DNA, 23 bp, Homo sapiens
taaattatgagctatcctttcaa

SEQ ID NO: 2373588 - DNA, 21 bp, Homo sapiens
taaattatgtgaccataatgt

SEQ ID NO: 2373589 - DNA, 10 bp, Homo sapiens
taaattattt

SEQ ID NO: 2373590 - DNA, 15 bp, Homo sapiens
taaattcaactttgt

SEQ ID NO: 2373591 - DNA, 20 bp, Homo sapiens
taaattctagtgtccataaa

SEQ ID NO: 2373592 - DNA, 19 bp, Homo sapiens
taaattgcatcactgtatc

SEQ ID NO: 2373593 - DNA, 18 bp, Homo sapiens
taaatttgtaagtttcag

SEQ ID NO: 2373594 - DNA, 19 bp, Homo sapiens
taaatttgtaagtttcagg

SEQ ID NO: 2373595 - DNA, 12 bp, Homo sapiens
taaattttaaag

SEQ ID NO: 2373596 - DNA, 19 bp, Homo sapiens
tacaacacattgaaactgt

SEQ ID NO: 2373597 - DNA, 18 bp, Homo sapiens
tacaagaaaatgtatcca

SEQ ID NO: 2373598 - DNA, 19 bp, Homo sapiens
tacaagggaagatttatgt

SEQ ID NO: 2373599 - DNA, 23 bp, Homo sapiens
tacaataaaacaaataaatatga

SEQ ID NO: 2373600 - DNA, 19 bp, Homo sapiens
tacaatagtatacatttta

SEQ ID NO: 2373601 - DNA, 15 bp, Homo sapiens
tacaatattgattgg

SEQ ID NO: 2373602 - DNA, 13 bp, Homo sapiens
tacaattttaaga

SEQ ID NO: 2373603 - DNA, 15 bp, Homo sapiens
tacacagaaatgctg

SEQ ID NO: 2373604 - DNA, 19 bp, Homo sapiens
tacacagaaatgctgctgg

SEQ ID NO: 2373605 - DNA, 22 bp, Homo sapiens
tacacagaaatgctgctggcca

SEQ ID NO: 2373606 - DNA, 23 bp, Homo sapiens
tacacagaaatgctgctggccaa

SEQ ID NO: 2373607 - DNA, 20 bp, Homo sapiens
tacacagaggagtgcagcct

SEQ ID NO: 2373608 - DNA, 22 bp, Homo sapiens
tacacatagttctgtaataaaa

SEQ ID NO: 2373609 - DNA, 13 bp, Homo sapiens
tacacatttgcta

SEQ ID NO: 2373610 - DNA, 22 bp, Homo sapiens
tacaccactttcccacactgtg

SEQ ID NO: 2373611 - DNA, 22 bp, Homo sapiens
tacaccccctcttctgagcaca

SEQ ID NO: 2373612 - DNA, 16 bp, Homo sapiens
tacacccctgtgctcc

SEQ ID NO: 2373613 - DNA, 23 bp, Homo sapiens
tacacccctgtgctcccctgcca

SEQ ID NO: 2373614 - DNA, 18 bp, Homo sapiens
tacacctattatcccagc

SEQ ID NO: 2373615 - DNA, 13 bp, Homo sapiens
tacacgtgtcctg

SEQ ID NO: 2373616 - DNA, 22 bp, Homo sapiens
tacactaccaaacactcagtcc

SEQ ID NO: 2373617 - DNA, 23 bp, Homo sapiens
tacactaccaaacactcagtcca

SEQ ID NO: 2373618 - DNA, 15 bp, Homo sapiens
tacactttgttgcaa

SEQ ID NO: 2373619 - DNA, 18 bp, Homo sapiens
tacactttgttgcaagat

SEQ ID NO: 2373620 - DNA, 13 bp, Homo sapiens
tacagaaagctgc

SEQ ID NO: 2373621 - DNA, 21 bp, Homo sapiens
tacagaatatttctattgaat

SEQ ID NO: 2373622 - DNA, 18 bp, Homo sapiens
tacagaatcttgttttga

SEQ ID NO: 2373623 - DNA, 18 bp, Homo sapiens
tacagaccgagaggccag

SEQ ID NO: 2373624 - DNA, 19 bp, Homo sapiens
tacagaccgagaggccagt

SEQ ID NO: 2373625 - DNA, 20 bp, Homo sapiens
tacagagaaattctgtggtg

SEQ ID NO: 2373626 - DNA, 18 bp, Homo sapiens
tacagaggatgccttttc

SEQ ID NO: 2373627 - DNA, 23 bp, Homo sapiens
tacagaggatgccttttctgtga

SEQ ID NO: 2373628 - DNA, 19 bp, Homo sapiens
tacagcaacaatttatgaa

SEQ ID NO: 2373629 - DNA, 20 bp, Homo sapiens
tacagcaacaatttatgaat

SEQ ID NO: 2373630 - DNA, 21 bp, Homo sapiens
tacagcagggtcttgctgtaa

SEQ ID NO: 2373631 - DNA, 16 bp, Homo sapiens
tacagcggctcccctc

SEQ ID NO: 2373632 - DNA, 21 bp, Homo sapiens
tacagtaaatgttacttctga

SEQ ID NO: 2373633 - DNA, 17 bp, Homo sapiens
tacagtctcgtctcttt

SEQ ID NO: 2373634 - DNA, 16 bp, Homo sapiens
tacagtgattcatgta

SEQ ID NO: 2373635 - DNA, 17 bp, Homo sapiens
tacagtggcagtattga

SEQ ID NO: 2373636 - DNA, 22 bp, Homo sapiens
tacagtggttttatactgaagg

SEQ ID NO: 2373637 - DNA, 22 bp, Homo sapiens
tacagttctttcctctttctgc

SEQ ID NO: 2373638 - DNA, 23 bp, Homo sapiens
tacagttctttcctctttctgct

SEQ ID NO: 2373639 - DNA, 17 bp, Homo sapiens
tacatatatacattgct

SEQ ID NO: 2373640 - DNA, 18 bp, Homo sapiens
tacatattaggaaaatat

SEQ ID NO: 2373641 - DNA, 19 bp, Homo sapiens
tacatcccgggcctcagtg

SEQ ID NO: 2373642 - DNA, 16 bp, Homo sapiens
tacatcttctttggaa

SEQ ID NO: 2373643 - DNA, 13 bp, Homo sapiens
tacatcttttcta

SEQ ID NO: 2373644 - DNA, 15 bp, Homo sapiens
tacatcttttctaat

SEQ ID NO: 2373645 - DNA, 16 bp, Homo sapiens
tacatcttttctaatc

SEQ ID NO: 2373646 - DNA, 20 bp, Homo sapiens
tacatgcatataatgaataa

SEQ ID NO: 2373647 - DNA, 14 bp, Homo sapiens
tacatgcatttgag

SEQ ID NO: 2373648 - DNA, 17 bp, Homo sapiens
tacatgctgaaaaatat

SEQ ID NO: 2373649 - DNA, 17 bp, Homo sapiens
tacatggcgccctgcct

SEQ ID NO: 2373650 - DNA, 19 bp, Homo sapiens
tacatggcgccctgcctcc

SEQ ID NO: 2373651 - DNA, 16 bp, Homo sapiens
tacatgtgatacattt

SEQ ID NO: 2373652 - DNA, 17 bp, Homo sapiens
tacatgtgatacatttt

SEQ ID NO: 2373653 - DNA, 19 bp, Homo sapiens
tacatgtgtagcctgtgca

SEQ ID NO: 2373654 - DNA, 15 bp, Homo sapiens
tacattaacggtgct

SEQ ID NO: 2373655 - DNA, 16 bp, Homo sapiens
tacattaacggtgcta

SEQ ID NO: 2373656 - DNA, 18 bp, Homo sapiens
tacattaacggtgctaaa

SEQ ID NO: 2373657 - DNA, 19 bp, Homo sapiens
tacattaacggtgctaaaa

SEQ ID NO: 2373658 - DNA, 15 bp, Homo sapiens
tacattgtattctgt

SEQ ID NO: 2373659 - DNA, 16 bp, Homo sapiens
tacatttatgatttaa

SEQ ID NO: 2373660 - DNA, 17 bp, Homo sapiens
tacatttatgatttaat

SEQ ID NO: 2373661 - DNA, 18 bp, Homo sapiens
tacatttatgatttaata

SEQ ID NO: 2373662 - DNA, 19 bp, Homo sapiens
tacatttggttatgttgat

SEQ ID NO: 2373663 - DNA, 17 bp, Homo sapiens
tacattttataatgatg

SEQ ID NO: 2373664 - DNA, 15 bp, Homo sapiens
tacattttctaaata

SEQ ID NO: 2373665 - DNA, 23 bp, Homo sapiens
tacattttctaaataaaaatatg

SEQ ID NO: 2373666 - DNA, 20 bp, Homo sapiens
taccaaaaacaagtctataa

SEQ ID NO: 2373667 - DNA, 11 bp, Homo sapiens
taccaaaataa

SEQ ID NO: 2373668 - DNA, 13 bp, Homo sapiens
taccaaaatttta

SEQ ID NO: 2373669 - DNA, 14 bp, Homo sapiens
taccaaaattttaa

SEQ ID NO: 2373670 - DNA, 13 bp, Homo sapiens
taccaaacactca

SEQ ID NO: 2373671 - DNA, 15 bp, Homo sapiens
taccaaacactcagt

SEQ ID NO: 2373672 - DNA, 13 bp, Homo sapiens
taccaaattaaaa

SEQ ID NO: 2373673 - DNA, 14 bp, Homo sapiens
taccaatgggaagc

SEQ ID NO: 2373674 - DNA, 19 bp, Homo sapiens
taccacaaaccctgctgaa

SEQ ID NO: 2373675 - DNA, 20 bp, Homo sapiens
taccacaaaccctgctgaac

SEQ ID NO: 2373676 - DNA, 22 bp, Homo sapiens
taccacaaaccctgctgaacac

SEQ ID NO: 2373677 - DNA, 22 bp, Homo sapiens
taccagctgcgcttgcttttct

SEQ ID NO: 2373678 - DNA, 18 bp, Homo sapiens
taccagtgaaaaaatgta

SEQ ID NO: 2373679 - DNA, 17 bp, Homo sapiens
taccattcacaataaaa

SEQ ID NO: 2373680 - DNA, 20 bp, Homo sapiens
tacccaataggtaatttttc

SEQ ID NO: 2373681 - DNA, 12 bp, Homo sapiens
tacccacctaga

SEQ ID NO: 2373682 - DNA, 17 bp, Homo sapiens
tacccactcggtcccag

SEQ ID NO: 2373683 - DNA, 23 bp, Homo sapiens
tacccatacaccccctcttctga

SEQ ID NO: 2373684 - DNA, 23 bp, Homo sapiens
taccccttggaaatgtctgctgg

SEQ ID NO: 2373685 - DNA, 19 bp, Homo sapiens
taccctggcccctctccct

SEQ ID NO: 2373686 - DNA, 16 bp, Homo sapiens
taccctgtctgtccct

SEQ ID NO: 2373687 - DNA, 17 bp, Homo sapiens
taccctgtctgtccctt

SEQ ID NO: 2373688 - DNA, 18 bp, Homo sapiens
taccggagagagaatgta

SEQ ID NO: 2373689 - DNA, 18 bp, Homo sapiens
taccggattctctcttta

SEQ ID NO: 2373690 - DNA, 21 bp, Homo sapiens
tacctactttgactttttgca

SEQ ID NO: 2373691 - DNA, 17 bp, Homo sapiens
tacctagctaattattt

SEQ ID NO: 2373692 - DNA, 15 bp, Homo sapiens
tacctagctggctct

SEQ ID NO: 2373693 - DNA, 21 bp, Homo sapiens
tacctccatccatccttccaa

SEQ ID NO: 2373694 - DNA, 15 bp, Homo sapiens
tacctcccacactcc

SEQ ID NO: 2373695 - DNA, 21 bp, Homo sapiens
tacctctattttaattactgc

SEQ ID NO: 2373696 - DNA, 14 bp, Homo sapiens
tacctgaaagccct

SEQ ID NO: 2373697 - DNA, 18 bp, Homo sapiens
tacctgattttttttcct

SEQ ID NO: 2373698 - DNA, 19 bp, Homo sapiens
tacctggatgttcttttta

SEQ ID NO: 2373699 - DNA, 12 bp, Homo sapiens
tacctgtataca

SEQ ID NO: 2373700 - DNA, 22 bp, Homo sapiens
taccttactgtggaggaaggat

SEQ ID NO: 2373701 - DNA, 20 bp, Homo sapiens
taccttcctgtccctgaggt

SEQ ID NO: 2373702 - DNA, 16 bp, Homo sapiens
taccttgcaaagcaac

SEQ ID NO: 2373703 - DNA, 18 bp, Homo sapiens
tacctttctctctctaag

SEQ ID NO: 2373704 - DNA, 18 bp, Homo sapiens
taccttttttttttcttg

SEQ ID NO: 2373705 - DNA, 18 bp, Homo sapiens
tacgcctcttctgtccct

SEQ ID NO: 2373706 - DNA, 19 bp, Homo sapiens
tacggatcatcaacaagat

SEQ ID NO: 2373707 - DNA, 18 bp, Homo sapiens
tacgtgctctgtgggtct

SEQ ID NO: 2373708 - DNA, 23 bp, Homo sapiens
tacgtttctttaaccttgtataa

SEQ ID NO: 2373709 - DNA, 15 bp, Homo sapiens
tactaaaaagtataa

SEQ ID NO: 2373710 - DNA, 19 bp, Homo sapiens
tatataaaacggtgctgtg

SEQ ID NO: 2373711 - DNA, 13 bp, Homo sapiens
tatataaatgtat

SEQ ID NO: 2373712 - DNA, 14 bp, Homo sapiens
tatatcatgcaaaa

SEQ ID NO: 2373713 - DNA, 19 bp, Homo sapiens
tatatgaagaaaatcactt

SEQ ID NO: 2373714 - DNA, 22 bp, Homo sapiens
tatatgatgagcagacttctcg

SEQ ID NO: 2373715 - DNA, 17 bp, Homo sapiens
tatatgcttactgatat

SEQ ID NO: 2373716 - DNA, 21 bp, Homo sapiens
tatatgcttactgatatattt

SEQ ID NO: 2373717 - DNA, 17 bp, Homo sapiens
tatatggttctccaaga

SEQ ID NO: 2373718 - DNA, 22 bp, Homo sapiens
tatattaaaattccaaattcat

SEQ ID NO: 2373719 - DNA, 13 bp, Homo sapiens
tatattaaacaaa

SEQ ID NO: 2373720 - DNA, 22 bp, Homo sapiens
tatattaaacaaagtttcagag

SEQ ID NO: 2373721 - DNA, 13 bp, Homo sapiens
tatattacaatga

SEQ ID NO: 2373722 - DNA, 18 bp, Homo sapiens
tatattataattggaagt

SEQ ID NO: 2373723 - DNA, 14 bp, Homo sapiens
tatatttcctttat

SEQ ID NO: 2373724 - DNA, 22 bp, Homo sapiens
tatatttcctttatgtgaattt

SEQ ID NO: 2373725 - DNA, 22 bp, Homo sapiens
tatattttaacctgcataaaaa

SEQ ID NO: 2373726 - DNA, 16 bp, Homo sapiens
tatattttacaatttt

SEQ ID NO: 2373727 - DNA, 16 bp, Homo sapiens
tatattttgtgtgaaa

SEQ ID NO: 2373728 - DNA, 15 bp, Homo sapiens
tatatttttaaagaa

SEQ ID NO: 2373729 - DNA, 16 bp, Homo sapiens
tatatttttaaagaat

SEQ ID NO: 2373730 - DNA, 12 bp, Homo sapiens
tatcaaagtcat

SEQ ID NO: 2373731 - DNA, 18 bp, Homo sapiens
tatcaaagtcattaaaga

SEQ ID NO: 2373732 - DNA, 14 bp, Homo sapiens
tatcaaataaaata

SEQ ID NO: 2373733 - DNA, 22 bp, Homo sapiens
tatcacattaatctcaaagaga

SEQ ID NO: 2373734 - DNA, 18 bp, Homo sapiens
tatcagaagtatatctgt

SEQ ID NO: 2373735 - DNA, 21 bp, Homo sapiens
tatcagtaacccccttaaatt

SEQ ID NO: 2373736 - DNA, 16 bp, Homo sapiens
tatcagttacagtggc

SEQ ID NO: 2373737 - DNA, 17 bp, Homo sapiens
tatcagttacagtggca

SEQ ID NO: 2373738 - DNA, 15 bp, Homo sapiens
tatcatatatttaat

SEQ ID NO: 2373739 - DNA, 11 bp, Homo sapiens
tatcatgaatg

SEQ ID NO: 2373740 - DNA, 16 bp, Homo sapiens
tatcatgaattttaaa

SEQ ID NO: 2373741 - DNA, 18 bp, Homo sapiens
tatcatgaattttaaagt

SEQ ID NO: 2373742 - DNA, 14 bp, Homo sapiens
tatcatgcaaaata

SEQ ID NO: 2373743 - DNA, 16 bp, Homo sapiens
tatcattaaaaattac

SEQ ID NO: 2373744 - DNA, 22 bp, Homo sapiens
tatccagctctttattacatag

SEQ ID NO: 2373745 - DNA, 18 bp, Homo sapiens
tatccaggcaccaggact

SEQ ID NO: 2373746 - DNA, 13 bp, Homo sapiens
tatcccaaatgtg

SEQ ID NO: 2373747 - DNA, 16 bp, Homo sapiens
tatcccacatccaact

SEQ ID NO: 2373748 - DNA, 14 bp, Homo sapiens
tatccgctgccagc

SEQ ID NO: 2373749 - DNA, 17 bp, Homo sapiens
tatcctgcgaccttgca

SEQ ID NO: 2373750 - DNA, 23 bp, Homo sapiens
tatccttgggggctcccagggca

SEQ ID NO: 2373751 - DNA, 14 bp, Homo sapiens
tatcgaaataacaa

SEQ ID NO: 2373752 - DNA, 18 bp, Homo sapiens
tatcgaaataacaatgtt

SEQ ID NO: 2373753 - DNA, 21 bp, Homo sapiens
tatcgaaataacaatgttaag

SEQ ID NO: 2373754 - DNA, 14 bp, Homo sapiens
tatcgccctccttt

SEQ ID NO: 2373755 - DNA, 16 bp, Homo sapiens
tatcgccctcctttcc

SEQ ID NO: 2373756 - DNA, 20 bp, Homo sapiens
tatcgccctcctttccctta

SEQ ID NO: 2373757 - DNA, 13 bp, Homo sapiens
tatctaactttgt

SEQ ID NO: 2373758 - DNA, 18 bp, Homo sapiens
tatctatttgaataaatt

SEQ ID NO: 2373759 - DNA, 22 bp, Homo sapiens
tatctcaatgaaccataaattc

SEQ ID NO: 2373760 - DNA, 18 bp, Homo sapiens
tatctcagtcatgcataa

SEQ ID NO: 2373761 - DNA, 17 bp, Homo sapiens
tatctccatggccctgt

SEQ ID NO: 2373762 - DNA, 18 bp, Homo sapiens
tatctccctggagaagca

SEQ ID NO: 2373763 - DNA, 21 bp, Homo sapiens
tatctcctgacagaaggtgcc

SEQ ID NO: 2373764 - DNA, 12 bp, Homo sapiens
tatcttgggtgt

SEQ ID NO: 2373765 - DNA, 23 bp, Homo sapiens
tatcttgggtgtattctctgtaa

SEQ ID NO: 2373766 - DNA, 19 bp, Homo sapiens
tatgaaaaattggggagga

SEQ ID NO: 2373767 - DNA, 21 bp, Homo sapiens
tatgaaaatatagacattctc

SEQ ID NO: 2373768 - DNA, 14 bp, Homo sapiens
tatgaaaatggaaa

SEQ ID NO: 2373769 - DNA, 13 bp, Homo sapiens
tatgaaagtagat

SEQ ID NO: 2373770 - DNA, 17 bp, Homo sapiens
tatgaacatattgttga

SEQ ID NO: 2373771 - DNA, 14 bp, Homo sapiens
tatgaagaactgag

SEQ ID NO: 2373772 - DNA, 16 bp, Homo sapiens
tatgaagaactgagga

SEQ ID NO: 2373773 - DNA, 17 bp, Homo sapiens
tatgaataaagaatgcc

SEQ ID NO: 2373774 - DNA, 15 bp, Homo sapiens
tatgaattgtacaga

SEQ ID NO: 2373775 - DNA, 22 bp, Homo sapiens
tatgaattgtacagaatatttc

SEQ ID NO: 2373776 - DNA, 16 bp, Homo sapiens
tatgacggaagaacat

SEQ ID NO: 2373777 - DNA, 13 bp, Homo sapiens
tatgactaaagag

SEQ ID NO: 2373778 - DNA, 20 bp, Homo sapiens
tatgactaaagagagaatgt

SEQ ID NO: 2373779 - DNA, 21 bp, Homo sapiens
tatgactaaagagagaatgta

SEQ ID NO: 2373780 - DNA, 20 bp, Homo sapiens
tatgagattggttttcctgt

SEQ ID NO: 2373781 - DNA, 21 bp, Homo sapiens
tatgagattggttttcctgtg

SEQ ID NO: 2373782 - DNA, 19 bp, Homo sapiens
tatgagccagacaaatgga

SEQ ID NO: 2373783 - DNA, 15 bp, Homo sapiens
tatgagcctgccctc

SEQ ID NO: 2373784 - DNA, 18 bp, Homo sapiens
tatgagctatcctttcaa

SEQ ID NO: 2373785 - DNA, 19 bp, Homo sapiens
tatgagctatcctttcaaa

SEQ ID NO: 2373786 - DNA, 15 bp, Homo sapiens
tatgatattttctgt

SEQ ID NO: 2373787 - DNA, 12 bp, Homo sapiens
tatgatgctaag

SEQ ID NO: 2373788 - DNA, 16 bp, Homo sapiens
tatgattaaattatca

SEQ ID NO: 2373789 - DNA, 22 bp, Homo sapiens
tatgattaaattatcattgttt

SEQ ID NO: 2373790 - DNA, 14 bp, Homo sapiens
tatgatttccttca

SEQ ID NO: 2373791 - DNA, 19 bp, Homo sapiens
tatgatttttttttcatac

SEQ ID NO: 2373792 - DNA, 15 bp, Homo sapiens
tatgcaatgcttcat

SEQ ID NO: 2373793 - DNA, 13 bp, Homo sapiens
tatgcacatatgg

SEQ ID NO: 2373794 - DNA, 22 bp, Homo sapiens
tatgcaccttgtgtctgtacac

SEQ ID NO: 2373795 - DNA, 12 bp, Homo sapiens
tatgcactttta

SEQ ID NO: 2373796 - DNA, 22 bp, Homo sapiens
tatgcagtgatatggcagaaga

SEQ ID NO: 2373797 - DNA, 18 bp, Homo sapiens
tatgcatcatttcaggag

SEQ ID NO: 2373798 - DNA, 23 bp, Homo sapiens
tatgcattcacatttagaaaagt

SEQ ID NO: 2373799 - DNA, 14 bp, Homo sapiens
tatgccttgtataa

SEQ ID NO: 2373800 - DNA, 17 bp, Homo sapiens
tatgctgatcttttaaa

SEQ ID NO: 2373801 - DNA, 21 bp, Homo sapiens
tatgctgatcttttaaaatca

SEQ ID NO: 2373802 - DNA, 15 bp, Homo sapiens
tatgctggtggttaa

SEQ ID NO: 2373803 - DNA, 15 bp, Homo sapiens
tatgcttactgatat

SEQ ID NO: 2373804 - DNA, 13 bp, Homo sapiens
tatggaaaactgt

SEQ ID NO: 2373805 - DNA, 13 bp, Homo sapiens
tatggaagaaagt

SEQ ID NO: 2373806 - DNA, 16 bp, Homo sapiens
tatggactctgcacat

SEQ ID NO: 2373807 - DNA, 15 bp, Homo sapiens
tatggcagaagacac

SEQ ID NO: 2373808 - DNA, 23 bp, Homo sapiens
tatggcagaagacaccagagcag

SEQ ID NO: 2373809 - DNA, 17 bp, Homo sapiens
tatggcaggataagaaa

SEQ ID NO: 2373810 - DNA, 23 bp, Homo sapiens
tatggcttatttctatgacaaat

SEQ ID NO: 2373811 - DNA, 13 bp, Homo sapiens
tatgggaagccat

SEQ ID NO: 2373812 - DNA, 22 bp, Homo sapiens
tatggttctccaagaaactgaa

SEQ ID NO: 2373813 - DNA, 16 bp, Homo sapiens
tatgtaacaacaatta

SEQ ID NO: 2373814 - DNA, 19 bp, Homo sapiens
tatgtaacaacaattattt

SEQ ID NO: 2373815 - DNA, 23 bp, Homo sapiens
tatgtaacaacaattatttgaag

SEQ ID NO: 2373816 - DNA, 16 bp, Homo sapiens
tatgtaagcatttgta

SEQ ID NO: 2373817 - DNA, 14 bp, Homo sapiens
tatgtaatttcaaa

SEQ ID NO: 2373818 - DNA, 15 bp, Homo sapiens
tatgtaatttcaaaa

SEQ ID NO: 2373819 - DNA, 16 bp, Homo sapiens
tatgtaatttcaaaat

SEQ ID NO: 2373820 - DNA, 15 bp, Homo sapiens
tatgtacaaacatgt

SEQ ID NO: 2373821 - DNA, 16 bp, Homo sapiens
tatgtacaaacatgtt

SEQ ID NO: 2373822 - DNA, 14 bp, Homo sapiens
tatgtagataacaa

SEQ ID NO: 2373823 - DNA, 17 bp, Homo sapiens
tatgtagatgtgcattt

SEQ ID NO: 2373824 - DNA, 17 bp, Homo sapiens
tatgtaggtaagactgt

SEQ ID NO: 2373825 - DNA, 13 bp, Homo sapiens
tcaccattcccag

SEQ ID NO: 2373826 - DNA, 15 bp, Homo sapiens
tcacccagacataaa

SEQ ID NO: 2373827 - DNA, 12 bp, Homo sapiens
tcaccctgcaga

SEQ ID NO: 2373828 - DNA, 22 bp, Homo sapiens
tcacccttatagtctaagacta

SEQ ID NO: 2373829 - DNA, 15 bp, Homo sapiens
tcaccgcccatcagg

SEQ ID NO: 2373830 - DNA, 14 bp, Homo sapiens
tcaccgctgggtgg

SEQ ID NO: 2373831 - DNA, 16 bp, Homo sapiens
tcacctcagtagaaaa

SEQ ID NO: 2373832 - DNA, 14 bp, Homo sapiens
tcacctgccccagc

SEQ ID NO: 2373833 - DNA, 15 bp, Homo sapiens
tcaccttcctgtggg

SEQ ID NO: 2373834 - DNA, 19 bp, Homo sapiens
tcaccttgccgagagaggc

SEQ ID NO: 2373835 - DNA, 15 bp, Homo sapiens
tcaccttttcaggaa

SEQ ID NO: 2373836 - DNA, 17 bp, Homo sapiens
tcaccttttctgtggct

SEQ ID NO: 2373837 - DNA, 13 bp, Homo sapiens
tcacgactcttcc

SEQ ID NO: 2373838 - DNA, 13 bp, Homo sapiens
tcacgatttgcag

SEQ ID NO: 2373839 - DNA, 21 bp, Homo sapiens
tcacgatttgcaggattccct

SEQ ID NO: 2373840 - DNA, 23 bp, Homo sapiens
tcacgatttgcaggattcccttc

SEQ ID NO: 2373841 - DNA, 20 bp, Homo sapiens
tcacgcccttcaatgctgca

SEQ ID NO: 2373842 - DNA, 15 bp, Homo sapiens
tcacgctctggacat

SEQ ID NO: 2373843 - DNA, 16 bp, Homo sapiens
tcacgctttcctgaat

SEQ ID NO: 2373844 - DNA, 19 bp, Homo sapiens
tcactaccctgattcttga

SEQ ID NO: 2373845 - DNA, 20 bp, Homo sapiens
tcactaccctgattcttgat

SEQ ID NO: 2373846 - DNA, 19 bp, Homo sapiens
tcactcccacctgcatctg

SEQ ID NO: 2373847 - DNA, 20 bp, Homo sapiens
tcactccctctgcagaatcc

SEQ ID NO: 2373848 - DNA, 20 bp, Homo sapiens
tcactcgggtttctctgtgg

SEQ ID NO: 2373849 - DNA, 22 bp, Homo sapiens
tcactgaaccactgcttctctt

SEQ ID NO: 2373850 - DNA, 20 bp, Homo sapiens
tcactgccacactctccatc

SEQ ID NO: 2373851 - DNA, 20 bp, Homo sapiens
tcactgccaggccagcctcc

SEQ ID NO: 2373852 - DNA, 13 bp, Homo sapiens
tcactgcctgaca

SEQ ID NO: 2373853 - DNA, 19 bp, Homo sapiens
tcactgcttgaactaggct

SEQ ID NO: 2373854 - DNA, 15 bp, Homo sapiens
tcactggaaagggga

SEQ ID NO: 2373855 - DNA, 17 bp, Homo sapiens
tcactggaaaggggaga

SEQ ID NO: 2373856 - DNA, 18 bp, Homo sapiens
tcactggaaaggggagag

SEQ ID NO: 2373857 - DNA, 20 bp, Homo sapiens
tcactggcatactgagaata

SEQ ID NO: 2373858 - DNA, 23 bp, Homo sapiens
tcactgtagtttagttctgttga

SEQ ID NO: 2373859 - DNA, 17 bp, Homo sapiens
tcactgtataaatagga

SEQ ID NO: 2373860 - DNA, 19 bp, Homo sapiens
tcactgtataaataggaga

SEQ ID NO: 2373861 - DNA, 17 bp, Homo sapiens
tcactgttgctttgaaa

SEQ ID NO: 2373862 - DNA, 16 bp, Homo sapiens
tcacttcataatccag

SEQ ID NO: 2373863 - DNA, 16 bp, Homo sapiens
tcacttccagagagga

SEQ ID NO: 2373864 - DNA, 13 bp, Homo sapiens
tcacttgtgtttt

SEQ ID NO: 2373865 - DNA, 14 bp, Homo sapiens
tcacttttcccact

SEQ ID NO: 2373866 - DNA, 20 bp, Homo sapiens
tcacttttggcaatgactca

SEQ ID NO: 2373867 - DNA, 18 bp, Homo sapiens
tcagaacttgctgctgtc

SEQ ID NO: 2373868 - DNA, 13 bp, Homo sapiens
tcagaagatagtc

SEQ ID NO: 2373869 - DNA, 20 bp, Homo sapiens
tcagaagatagtcttggaag

SEQ ID NO: 2373870 - DNA, 14 bp, Homo sapiens
tcagaagcaagcca

SEQ ID NO: 2373871 - DNA, 17 bp, Homo sapiens
tcagaagcaagccagac

SEQ ID NO: 2373872 - DNA, 18 bp, Homo sapiens
tcagacatacagctgcct

SEQ ID NO: 2373873 - DNA, 21 bp, Homo sapiens
tcagacatacagctgcctacc

SEQ ID NO: 2373874 - DNA, 22 bp, Homo sapiens
tcagacatacagctgcctacct

SEQ ID NO: 2373875 - DNA, 23 bp, Homo sapiens
tcagacccctttgagagacgcca

SEQ ID NO: 2373876 - DNA, 14 bp, Homo sapiens
tcagactgtgcaat

SEQ ID NO: 2373877 - DNA, 16 bp, Homo sapiens
tcagactgtgcaatac

SEQ ID NO: 2373878 - DNA, 22 bp, Homo sapiens
tcagagcgccaggaagccagag

SEQ ID NO: 2373879 - DNA, 22 bp, Homo sapiens
tcagagctaaactccttcctgg

SEQ ID NO: 2373880 - DNA, 22 bp, Homo sapiens
tcagagtatattgttgaagaga

SEQ ID NO: 2373881 - DNA, 12 bp, Homo sapiens
tcagagtccagt

SEQ ID NO: 2373882 - DNA, 13 bp, Homo sapiens
tcagagtccagtg

SEQ ID NO: 2373883 - DNA, 23 bp, Homo sapiens
tcagatagaaaacagcccccact

SEQ ID NO: 2373884 - DNA, 19 bp, Homo sapiens
tcagatgcttgcggcaaaa

SEQ ID NO: 2373885 - DNA, 22 bp, Homo sapiens
tcagattgcttaaaagcatttt

SEQ ID NO: 2373886 - DNA, 15 bp, Homo sapiens
tcagatttctgagga

SEQ ID NO: 2373887 - DNA, 16 bp, Homo sapiens
tcagatttctgaggaa

SEQ ID NO: 2373888 - DNA, 15 bp, Homo sapiens
tcagcaaactctttt

SEQ ID NO: 2373889 - DNA, 13 bp, Homo sapiens
tcagcaaagaaaa

SEQ ID NO: 2373890 - DNA, 15 bp, Homo sapiens
tcagcaaagaaaaaa

SEQ ID NO: 2373891 - DNA, 16 bp, Homo sapiens
tcagcaactcgcttta

SEQ ID NO: 2373892 - DNA, 17 bp, Homo sapiens
tcagcaatagggtgcag

SEQ ID NO: 2373893 - DNA, 14 bp, Homo sapiens
tcagcacaggaatt

SEQ ID NO: 2373894 - DNA, 22 bp, Homo sapiens
tcagcagaacctgcacacagga

SEQ ID NO: 2373895 - DNA, 19 bp, Homo sapiens
tcagcatgtctattcagct

SEQ ID NO: 2373896 - DNA, 21 bp, Homo sapiens
tcagcattttagaaactacaa

SEQ ID NO: 2373897 - DNA, 13 bp, Homo sapiens
tcagccctcagtt

SEQ ID NO: 2373898 - DNA, 19 bp, Homo sapiens
tcagccctcagttccttca

SEQ ID NO: 2373899 - DNA, 17 bp, Homo sapiens
tcagctacaattgtaaa

SEQ ID NO: 2373900 - DNA, 19 bp, Homo sapiens
tcagctacaattgtaaact

SEQ ID NO: 2373901 - DNA, 20 bp, Homo sapiens
tcagctactaatgatgtttt

SEQ ID NO: 2373902 - DNA, 15 bp, Homo sapiens
tcagctctctgccct

SEQ ID NO: 2373903 - DNA, 19 bp, Homo sapiens
tcagctgctccctggcatt

SEQ ID NO: 2373904 - DNA, 21 bp, Homo sapiens
tcagctttctttaaagttctt

SEQ ID NO: 2373905 - DNA, 15 bp, Homo sapiens
tcagctttgagaagc

SEQ ID NO: 2373906 - DNA, 16 bp, Homo sapiens
tcaggacggctcctca

SEQ ID NO: 2373907 - DNA, 18 bp, Homo sapiens
tcaggacggctcctcaga

SEQ ID NO: 2373908 - DNA, 18 bp, Homo sapiens
tcaggatattggttcttc

SEQ ID NO: 2373909 - DNA, 18 bp, Homo sapiens
tcagggctggctcctgat

SEQ ID NO: 2373910 - DNA, 14 bp, Homo sapiens
tcagggctgtccca

SEQ ID NO: 2373911 - DNA, 15 bp, Homo sapiens
tcagggctgtcccag

SEQ ID NO: 2373912 - DNA, 16 bp, Homo sapiens
tcagggctgtcccagc

SEQ ID NO: 2373913 - DNA, 17 bp, Homo sapiens
tcagggtaaataggaat

SEQ ID NO: 2373914 - DNA, 20 bp, Homo sapiens
tcagggtgaactgcaaagct

SEQ ID NO: 2373915 - DNA, 22 bp, Homo sapiens
tcagggtgcagcccaatctgcc

SEQ ID NO: 2373916 - DNA, 14 bp, Homo sapiens
tcaggtagtactgg

SEQ ID NO: 2373917 - DNA, 21 bp, Homo sapiens
tcaggtgacatgtgaaacctt

SEQ ID NO: 2373918 - DNA, 18 bp, Homo sapiens
tcaggtgccttacatctt

SEQ ID NO: 2373919 - DNA, 18 bp, Homo sapiens
tcaggttatcgaaataac

SEQ ID NO: 2373920 - DNA, 23 bp, Homo sapiens
tcaggttatcgaaataacaatgt

SEQ ID NO: 2373921 - DNA, 15 bp, Homo sapiens
tcaggtttgttttgt

SEQ ID NO: 2373922 - DNA, 22 bp, Homo sapiens
tcagtaaacgggaacatgcccc

SEQ ID NO: 2373923 - DNA, 20 bp, Homo sapiens
tcagtaacaaaggtttaaag

SEQ ID NO: 2373924 - DNA, 21 bp, Homo sapiens
tcagtaacccccttaaattta

SEQ ID NO: 2373925 - DNA, 23 bp, Homo sapiens
tcagtaacccccttaaatttaat

SEQ ID NO: 2373926 - DNA, 23 bp, Homo sapiens
tcagtaagttatctttgaatatg

SEQ ID NO: 2373927 - DNA, 23 bp, Homo sapiens
tcagtatgtgggggcttcatctc

SEQ ID NO: 2373928 - DNA, 21 bp, Homo sapiens
tcagtcatcaaagcagaagtc

SEQ ID NO: 2373929 - DNA, 16 bp, Homo sapiens
tcagtcatgcataaat

SEQ ID NO: 2373930 - DNA, 14 bp, Homo sapiens
tcagtcatgtgtaa

SEQ ID NO: 2373931 - DNA, 12 bp, Homo sapiens
tcagtccactgt

SEQ ID NO: 2373932 - DNA, 14 bp, Homo sapiens
tcagtcccctctct

SEQ ID NO: 2373933 - DNA, 18 bp, Homo sapiens
tcagtcccctctctctgg

SEQ ID NO: 2373934 - DNA, 16 bp, Homo sapiens
tcagtctacaaactga

SEQ ID NO: 2373935 - DNA, 12 bp, Homo sapiens
tcagtctttgct

SEQ ID NO: 2373936 - DNA, 17 bp, Homo sapiens
tcagtctttgctcagtg

SEQ ID NO: 2373937 - DNA, 18 bp, Homo sapiens
tcagtctttgctcagtgt

SEQ ID NO: 2373938 - DNA, 20 bp, Homo sapiens
tcagtgagcctcctgtgcct

SEQ ID NO: 2373939 - DNA, 16 bp, Homo sapiens
tcccctctcagaacat

SEQ ID NO: 2373940 - DNA, 15 bp, Homo sapiens
tccccttcccttttt

SEQ ID NO: 2373941 - DNA, 15 bp, Homo sapiens
tcccgggccagggct

SEQ ID NO: 2373942 - DNA, 16 bp, Homo sapiens
tcccggtaccttccat

SEQ ID NO: 2373943 - DNA, 20 bp, Homo sapiens
tcccgtgcatcccccctgct

SEQ ID NO: 2373944 - DNA, 20 bp, Homo sapiens
tccctagctttagaccctgg

SEQ ID NO: 2373945 - DNA, 15 bp, Homo sapiens
tccctccaacacaga

SEQ ID NO: 2373946 - DNA, 13 bp, Homo sapiens
tccctccacctca

SEQ ID NO: 2373947 - DNA, 16 bp, Homo sapiens
tccctccattcatcct

SEQ ID NO: 2373948 - DNA, 18 bp, Homo sapiens
tccctccattcatccttc

SEQ ID NO: 2373949 - DNA, 15 bp, Homo sapiens
tccctccctctctca

SEQ ID NO: 2373950 - DNA, 21 bp, Homo sapiens
tccctcctccaggcctgcctc

SEQ ID NO: 2373951 - DNA, 16 bp, Homo sapiens
tccctcctgcacacag

SEQ ID NO: 2373952 - DNA, 13 bp, Homo sapiens
tccctcctggagc

SEQ ID NO: 2373953 - DNA, 16 bp, Homo sapiens
tccctctaatgagact

SEQ ID NO: 2373954 - DNA, 17 bp, Homo sapiens
tccctctaatgagactg

SEQ ID NO: 2373955 - DNA, 14 bp, Homo sapiens
tccctctcctaact

SEQ ID NO: 2373956 - DNA, 15 bp, Homo sapiens
tccctctctcactcc

SEQ ID NO: 2373957 - DNA, 12 bp, Homo sapiens
tccctctctgat

SEQ ID NO: 2373958 - DNA, 14 bp, Homo sapiens
tccctgaggatggg

SEQ ID NO: 2373959 - DNA, 20 bp, Homo sapiens
tccctgcagacctcaagcca

SEQ ID NO: 2373960 - DNA, 22 bp, Homo sapiens
tccctgcagacctcaagccatc

SEQ ID NO: 2373961 - DNA, 22 bp, Homo sapiens
tccctgcagatgccaccctagc

SEQ ID NO: 2373962 - DNA, 23 bp, Homo sapiens
tccctgcctctcatcaactgaat

SEQ ID NO: 2373963 - DNA, 13 bp, Homo sapiens
tccctgcctgagg

SEQ ID NO: 2373964 - DNA, 12 bp, Homo sapiens
tccctgcctggc

SEQ ID NO: 2373965 - DNA, 18 bp, Homo sapiens
tccctgcttccaggaaac

SEQ ID NO: 2373966 - DNA, 22 bp, Homo sapiens
tccctggacaggcagcctcctt

SEQ ID NO: 2373967 - DNA, 15 bp, Homo sapiens
tccctggagaagcac

SEQ ID NO: 2373968 - DNA, 14 bp, Homo sapiens
tccctggagtcagg

SEQ ID NO: 2373969 - DNA, 21 bp, Homo sapiens
tccctggccgcttctccccag

SEQ ID NO: 2373970 - DNA, 11 bp, Homo sapiens
tccctggcgca

SEQ ID NO: 2373971 - DNA, 23 bp, Homo sapiens
tccctgggacacagacccaggac

SEQ ID NO: 2373972 - DNA, 15 bp, Homo sapiens
tccctgggggcccca

SEQ ID NO: 2373973 - DNA, 14 bp, Homo sapiens
tccctgtagctcag

SEQ ID NO: 2373974 - DNA, 15 bp, Homo sapiens
tccctgtagctcagt

SEQ ID NO: 2373975 - DNA, 20 bp, Homo sapiens
tcccttaaggggtatcatgt

SEQ ID NO: 2373976 - DNA, 13 bp, Homo sapiens
tcccttcccacat

SEQ ID NO: 2373977 - DNA, 16 bp, Homo sapiens
tcccttcccacatgcc

SEQ ID NO: 2373978 - DNA, 17 bp, Homo sapiens
tcccttcccacatgcct

SEQ ID NO: 2373979 - DNA, 20 bp, Homo sapiens
tcccttcccacatgcctgcg

SEQ ID NO: 2373980 - DNA, 17 bp, Homo sapiens
tcccttccttttccctg

SEQ ID NO: 2373981 - DNA, 20 bp, Homo sapiens
tcccttctacaaggactcca

SEQ ID NO: 2373982 - DNA, 17 bp, Homo sapiens
tcccttctgagtctcca

SEQ ID NO: 2373983 - DNA, 17 bp, Homo sapiens
tcccttgagggctgcag

SEQ ID NO: 2373984 - DNA, 17 bp, Homo sapiens
tccctttgcccagaaag

SEQ ID NO: 2373985 - DNA, 15 bp, Homo sapiens
tccctttttatgtgg

SEQ ID NO: 2373986 - DNA, 15 bp, Homo sapiens
tccgagagggagaga

SEQ ID NO: 2373987 - DNA, 23 bp, Homo sapiens
tccgagtgtgatttgaattctgt

SEQ ID NO: 2373988 - DNA, 15 bp, Homo sapiens
tccgcatcacctcac

SEQ ID NO: 2373989 - DNA, 20 bp, Homo sapiens
tccgccagcctcctctggac

SEQ ID NO: 2373990 - DNA, 15 bp, Homo sapiens
tccgccatggtgtcc

SEQ ID NO: 2373991 - DNA, 16 bp, Homo sapiens
tccgcgccgatgccac

SEQ ID NO: 2373992 - DNA, 17 bp, Homo sapiens
tccggaatgccacccac

SEQ ID NO: 2373993 - DNA, 12 bp, Homo sapiens
tccggactggtg

SEQ ID NO: 2373994 - DNA, 14 bp, Homo sapiens
tccggactggtgcc

SEQ ID NO: 2373995 - DNA, 13 bp, Homo sapiens
tccggatttctaa

SEQ ID NO: 2373996 - DNA, 21 bp, Homo sapiens
tccggatttctaacagtcctt

SEQ ID NO: 2373997 - DNA, 13 bp, Homo sapiens
tccgtgaaagttg

SEQ ID NO: 2373998 - DNA, 19 bp, Homo sapiens
tccgtgaaagttgtgatct

SEQ ID NO: 2373999 - DNA, 16 bp, Homo sapiens
tccgtgtgtcccagat

SEQ ID NO: 2374000 - DNA, 12 bp, Homo sapiens
tcctaaggcatg

SEQ ID NO: 2374001 - DNA, 19 bp, Homo sapiens
tcctaatttctcctccctt

SEQ ID NO: 2374002 - DNA, 17 bp, Homo sapiens
tcctactaataaaccag

SEQ ID NO: 2374003 - DNA, 17 bp, Homo sapiens
tcctactggtctctcta

SEQ ID NO: 2374004 - DNA, 20 bp, Homo sapiens
tcctacttagggaagaaaaa

SEQ ID NO: 2374005 - DNA, 23 bp, Homo sapiens
tcctacttagggaagaaaaagca

SEQ ID NO: 2374006 - DNA, 20 bp, Homo sapiens
tcctagcccttccctgagtg

SEQ ID NO: 2374007 - DNA, 13 bp, Homo sapiens
tcctagctctccc

SEQ ID NO: 2374008 - DNA, 15 bp, Homo sapiens
tcctagctgtccttt

SEQ ID NO: 2374009 - DNA, 21 bp, Homo sapiens
tcctaggtcatgcctcctccc

SEQ ID NO: 2374010 - DNA, 13 bp, Homo sapiens
tcctagtaagaag

SEQ ID NO: 2374011 - DNA, 14 bp, Homo sapiens
tcctatgcttaata

SEQ ID NO: 2374012 - DNA, 17 bp, Homo sapiens
tcctatgcttaataaaa

SEQ ID NO: 2374013 - DNA, 18 bp, Homo sapiens
tcctattctataaaactc

SEQ ID NO: 2374014 - DNA, 18 bp, Homo sapiens
tcctatttgccatgggct

SEQ ID NO: 2374015 - DNA, 16 bp, Homo sapiens
tcctcacctcatgccc

SEQ ID NO: 2374016 - DNA, 21 bp, Homo sapiens
tcctcagagcgccaggaagcc

SEQ ID NO: 2374017 - DNA, 22 bp, Homo sapiens
tcctcagagcgccaggaagcca

SEQ ID NO: 2374018 - DNA, 16 bp, Homo sapiens
tcctcagtatgtgggg

SEQ ID NO: 2374019 - DNA, 22 bp, Homo sapiens
tcctcagtatgtgggggcttca

SEQ ID NO: 2374020 - DNA, 22 bp, Homo sapiens
tcctcatggcagcctactctcc

SEQ ID NO: 2374021 - DNA, 13 bp, Homo sapiens
tcctccactccac

SEQ ID NO: 2374022 - DNA, 17 bp, Homo sapiens
tcctccaggagcttctt

SEQ ID NO: 2374023 - DNA, 17 bp, Homo sapiens
tcctccaggcctgcctc

SEQ ID NO: 2374024 - DNA, 23 bp, Homo sapiens
tcctcccagtgagactgccccac

SEQ ID NO: 2374025 - DNA, 16 bp, Homo sapiens
tcctccccaaatcaat

SEQ ID NO: 2374026 - DNA, 20 bp, Homo sapiens
tcctccctgttatctgctag

SEQ ID NO: 2374027 - DNA, 19 bp, Homo sapiens
tcctcccttccttttccct

SEQ ID NO: 2374028 - DNA, 22 bp, Homo sapiens
tcctcccttccttttccctgct

SEQ ID NO: 2374029 - DNA, 12 bp, Homo sapiens
tcctcctctgcc

SEQ ID NO: 2374030 - DNA, 20 bp, Homo sapiens
tcctcctgcctcagccttcc

SEQ ID NO: 2374031 - DNA, 12 bp, Homo sapiens
tcctcctgctca

SEQ ID NO: 2374032 - DNA, 16 bp, Homo sapiens
tcctccttttcacttt

SEQ ID NO: 2374033 - DNA, 22 bp, Homo sapiens
tcctccttttcttcaccctccc

SEQ ID NO: 2374034 - DNA, 14 bp, Homo sapiens
tcctcgcagcctct

SEQ ID NO: 2374035 - DNA, 17 bp, Homo sapiens
tcctctagaagccaagg

SEQ ID NO: 2374036 - DNA, 19 bp, Homo sapiens
tcctctagaagccaaggga

SEQ ID NO: 2374037 - DNA, 22 bp, Homo sapiens
tcctctagaagccaagggaaag

SEQ ID NO: 2374038 - DNA, 17 bp, Homo sapiens
tcctctccactgctgga

SEQ ID NO: 2374039 - DNA, 20 bp, Homo sapiens
tcctctccactgctggacat

SEQ ID NO: 2374040 - DNA, 19 bp, Homo sapiens
tcctctccccctcctccag

SEQ ID NO: 2374041 - DNA, 19 bp, Homo sapiens
tcctctctctttcctccac

SEQ ID NO: 2374042 - DNA, 16 bp, Homo sapiens
tcctctgcctacagcc

SEQ ID NO: 2374043 - DNA, 19 bp, Homo sapiens
tcctctgcctacagccagg

SEQ ID NO: 2374044 - DNA, 14 bp, Homo sapiens
tcctctgcctgccc

SEQ ID NO: 2374045 - DNA, 21 bp, Homo sapiens
tcctctgctgacctgctgacc

SEQ ID NO: 2374046 - DNA, 18 bp, Homo sapiens
tcctctggacggcaggct

SEQ ID NO: 2374047 - DNA, 22 bp, Homo sapiens
tcctctggacggcaggctcact

SEQ ID NO: 2374048 - DNA, 13 bp, Homo sapiens
tcctctggccgca

SEQ ID NO: 2374049 - DNA, 12 bp, Homo sapiens
tcctctggcttt

SEQ ID NO: 2374050 - DNA, 15 bp, Homo sapiens
tcctctggctttccc

SEQ ID NO: 2374051 - DNA, 19 bp, Homo sapiens
tcctctggctttcccagga

SEQ ID NO: 2374052 - DNA, 19 bp, Homo sapiens
tcctcttgtcctacaatga

SEQ ID NO: 2374053 - DNA, 20 bp, Homo sapiens
tcctcttgtgatttctttaa

SEQ ID NO: 2374054 - DNA, 16 bp, Homo sapiens
tctgtataatagagat

SEQ ID NO: 2374055 - DNA, 15 bp, Homo sapiens
tctgtcccccaggct

SEQ ID NO: 2374056 - DNA, 15 bp, Homo sapiens
tctgtccctgttaga

SEQ ID NO: 2374057 - DNA, 17 bp, Homo sapiens
tctgtcccttttctttg

SEQ ID NO: 2374058 - DNA, 14 bp, Homo sapiens
tctgtctaggactg

SEQ ID NO: 2374059 - DNA, 23 bp, Homo sapiens
tctgtctaggactgcagtgtgga

SEQ ID NO: 2374060 - DNA, 21 bp, Homo sapiens
tctgtctttcctgaaccatgt

SEQ ID NO: 2374061 - DNA, 19 bp, Homo sapiens
tctgtcttttggagaacca

SEQ ID NO: 2374062 - DNA, 19 bp, Homo sapiens
tctgtgaacaagcttcagt

SEQ ID NO: 2374063 - DNA, 17 bp, Homo sapiens
tctgtgagccccacagc

SEQ ID NO: 2374064 - DNA, 14 bp, Homo sapiens
tctgtgataacaga

SEQ ID NO: 2374065 - DNA, 17 bp, Homo sapiens
tctgtgatgagctgatc

SEQ ID NO: 2374066 - DNA, 16 bp, Homo sapiens
tctgtgattgggtggg

SEQ ID NO: 2374067 - DNA, 15 bp, Homo sapiens
tctgtgcctgaatat

SEQ ID NO: 2374068 - DNA, 21 bp, Homo sapiens
tctgtggatcagcattttaga

SEQ ID NO: 2374069 - DNA, 17 bp, Homo sapiens
tctgtggctgatttact

SEQ ID NO: 2374070 - DNA, 13 bp, Homo sapiens
tctgtggctggct

SEQ ID NO: 2374071 - DNA, 20 bp, Homo sapiens
tctgtgggctacatgctggg

SEQ ID NO: 2374072 - DNA, 11 bp, Homo sapiens
tctgtggtggg

SEQ ID NO: 2374073 - DNA, 15 bp, Homo sapiens
tctgttatgggcttt

SEQ ID NO: 2374074 - DNA, 21 bp, Homo sapiens
tctgttatgggcttttgggga

SEQ ID NO: 2374075 - DNA, 20 bp, Homo sapiens
tctgttctacatagatgctt

SEQ ID NO: 2374076 - DNA, 13 bp, Homo sapiens
tctgttgacctgt

SEQ ID NO: 2374077 - DNA, 17 bp, Homo sapiens
tctgttgacctgtgcac

SEQ ID NO: 2374078 - DNA, 20 bp, Homo sapiens
tctgttgtttggttcaggga

SEQ ID NO: 2374079 - DNA, 20 bp, Homo sapiens
tctgtttattaactactgaa

SEQ ID NO: 2374080 - DNA, 12 bp, Homo sapiens
tcttaaaaattt

SEQ ID NO: 2374081 - DNA, 19 bp, Homo sapiens
tcttaaaaatttatacacc

SEQ ID NO: 2374082 - DNA, 16 bp, Homo sapiens
tcttaaaccttcagtt

SEQ ID NO: 2374083 - DNA, 21 bp, Homo sapiens
tcttaagtaccaatgggaagc

SEQ ID NO: 2374084 - DNA, 22 bp, Homo sapiens
tcttaagtaccaatgggaagca

SEQ ID NO: 2374085 - DNA, 22 bp, Homo sapiens
tcttaagtgcccacatttgatg

SEQ ID NO: 2374086 - DNA, 13 bp, Homo sapiens
tcttactctttcc

SEQ ID NO: 2374087 - DNA, 16 bp, Homo sapiens
tcttactctttcctat

SEQ ID NO: 2374088 - DNA, 16 bp, Homo sapiens
tcttagctttttaatt

SEQ ID NO: 2374089 - DNA, 18 bp, Homo sapiens
tcttagctttttaattgt

SEQ ID NO: 2374090 - DNA, 17 bp, Homo sapiens
tcttagtctaggtcctt

SEQ ID NO: 2374091 - DNA, 16 bp, Homo sapiens
tcttatcctccaccgt

SEQ ID NO: 2374092 - DNA, 15 bp, Homo sapiens
tcttatcctctctct

SEQ ID NO: 2374093 - DNA, 19 bp, Homo sapiens
tcttatcctctctctcttc

SEQ ID NO: 2374094 - DNA, 22 bp, Homo sapiens
tcttatctcagtcatgcataaa

SEQ ID NO: 2374095 - DNA, 22 bp, Homo sapiens
tcttattaatcatacaaactct

SEQ ID NO: 2374096 - DNA, 17 bp, Homo sapiens
tcttcaaagccttctcc

SEQ ID NO: 2374097 - DNA, 18 bp, Homo sapiens
tcttcaatggaatacagt

SEQ ID NO: 2374098 - DNA, 16 bp, Homo sapiens
tcttcaccctcccctt

SEQ ID NO: 2374099 - DNA, 17 bp, Homo sapiens
tcttcagcccaggcttt

SEQ ID NO: 2374100 - DNA, 21 bp, Homo sapiens
tcttcatggcatcttcaatat

SEQ ID NO: 2374101 - DNA, 17 bp, Homo sapiens
tcttcattattctctgc

SEQ ID NO: 2374102 - DNA, 17 bp, Homo sapiens
tcttccaacatgtgatg

SEQ ID NO: 2374103 - DNA, 17 bp, Homo sapiens
tcttcccatgcattctg

SEQ ID NO: 2374104 - DNA, 14 bp, Homo sapiens
tcttccccagagag

SEQ ID NO: 2374105 - DNA, 11 bp, Homo sapiens
tcttccctggg

SEQ ID NO: 2374106 - DNA, 23 bp, Homo sapiens
tcttcctcaaaataaagaagtat

SEQ ID NO: 2374107 - DNA, 16 bp, Homo sapiens
tcttcgtggattgttt

SEQ ID NO: 2374108 - DNA, 22 bp, Homo sapiens
tcttcgtggattgttttttctg

SEQ ID NO: 2374109 - DNA, 21 bp, Homo sapiens
tcttctaggcccattgtcctc

SEQ ID NO: 2374110 - DNA, 19 bp, Homo sapiens
tcttctagtgatgatggtt

SEQ ID NO: 2374111 - DNA, 14 bp, Homo sapiens
tcttctcagagtgg

SEQ ID NO: 2374112 - DNA, 19 bp, Homo sapiens
tcttctgagctatttcatc

SEQ ID NO: 2374113 - DNA, 20 bp, Homo sapiens
tcttctggggcaggctgggc

SEQ ID NO: 2374114 - DNA, 21 bp, Homo sapiens
tcttctggggcaggctgggcc

SEQ ID NO: 2374115 - DNA, 22 bp, Homo sapiens
tcttctggggcaggctgggcca

SEQ ID NO: 2374116 - DNA, 21 bp, Homo sapiens
tcttctgggtagtcccctgtt

SEQ ID NO: 2374117 - DNA, 22 bp, Homo sapiens
tcttctggtactttctgttatg

SEQ ID NO: 2374118 - DNA, 22 bp, Homo sapiens
tcttctgtatttttttttctaa

SEQ ID NO: 2374119 - DNA, 13 bp, Homo sapiens
tcttctgtccctg

SEQ ID NO: 2374120 - DNA, 15 bp, Homo sapiens
tcttctgtgttaatt

SEQ ID NO: 2374121 - DNA, 15 bp, Homo sapiens
tcttcttacatgcat

SEQ ID NO: 2374122 - DNA, 12 bp, Homo sapiens
tcttctttccct

SEQ ID NO: 2374123 - DNA, 15 bp, Homo sapiens
tcttctttccctgga

SEQ ID NO: 2374124 - DNA, 22 bp, Homo sapiens
tcttctttccctggacaggcag

SEQ ID NO: 2374125 - DNA, 12 bp, Homo sapiens
tcttctttggaa

SEQ ID NO: 2374126 - DNA, 16 bp, Homo sapiens
tcttgaaacagcctgg

SEQ ID NO: 2374127 - DNA, 15 bp, Homo sapiens
tcttgaatataaaaa

SEQ ID NO: 2374128 - DNA, 19 bp, Homo sapiens
tcttgacgaatattgctta

SEQ ID NO: 2374129 - DNA, 12 bp, Homo sapiens
tcttgagcagac

SEQ ID NO: 2374130 - DNA, 17 bp, Homo sapiens
tcttgagctggcctctc

SEQ ID NO: 2374131 - DNA, 20 bp, Homo sapiens
tcttgcacagtcactgctct

SEQ ID NO: 2374132 - DNA, 21 bp, Homo sapiens
tcttgccagcattttcacatt

SEQ ID NO: 2374133 - DNA, 13 bp, Homo sapiens
tcttgcccatcct

SEQ ID NO: 2374134 - DNA, 20 bp, Homo sapiens
tcttggaccatgccagattc

SEQ ID NO: 2374135 - DNA, 18 bp, Homo sapiens
tcttgggtgtattctctg

SEQ ID NO: 2374136 - DNA, 19 bp, Homo sapiens
tcttggttgaaaataaaaa

SEQ ID NO: 2374137 - DNA, 17 bp, Homo sapiens
tcttgtacatgtgtagc

SEQ ID NO: 2374138 - DNA, 19 bp, Homo sapiens
tcttgtatttaaaaacatt

SEQ ID NO: 2374139 - DNA, 15 bp, Homo sapiens
tcttgttcaggaaaa

SEQ ID NO: 2374140 - DNA, 18 bp, Homo sapiens
tcttgttgctgtacaaaa

SEQ ID NO: 2374141 - DNA, 15 bp, Homo sapiens
tcttgtttccttgtt

SEQ ID NO: 2374142 - DNA, 16 bp, Homo sapiens
tcttgttttgaaaata

SEQ ID NO: 2374143 - DNA, 18 bp, Homo sapiens
tctttaaaaactcactta

SEQ ID NO: 2374144 - DNA, 17 bp, Homo sapiens
tctttaaaagaatgact

SEQ ID NO: 2374145 - DNA, 13 bp, Homo sapiens
tctttaagccata

SEQ ID NO: 2374146 - DNA, 13 bp, Homo sapiens
tctttaataacaa

SEQ ID NO: 2374147 - DNA, 24 bp, Homo sapiens
tctttaataacaaggagatttctt

SEQ ID NO: 2374148 - DNA, 19 bp, Homo sapiens
tctttacctgtatacagtg

SEQ ID NO: 2374149 - DNA, 12 bp, Homo sapiens
tctttagagatt

SEQ ID NO: 2374150 - DNA, 15 bp, Homo sapiens
tctttagcgctggct

SEQ ID NO: 2374151 - DNA, 15 bp, Homo sapiens
tctttatatgaagaa

SEQ ID NO: 2374152 - DNA, 15 bp, Homo sapiens
tctttattgaaattc

SEQ ID NO: 2374153 - DNA, 16 bp, Homo sapiens
tctttattttgtgtaa

SEQ ID NO: 2374154 - DNA, 13 bp, Homo sapiens
tctttccctggac

SEQ ID NO: 2374155 - DNA, 15 bp, Homo sapiens
tctttccctggacag

SEQ ID NO: 2374156 - DNA, 19 bp, Homo sapiens
tctttccctttaccactgt

SEQ ID NO: 2374157 - DNA, 21 bp, Homo sapiens
tctttccctttaccactgtgg

SEQ ID NO: 2374158 - DNA, 16 bp, Homo sapiens
tctttcctatttcagt

SEQ ID NO: 2374159 - DNA, 14 bp, Homo sapiens
tctttcctccaccc

SEQ ID NO: 2374160 - DNA, 15 bp, Homo sapiens
tctttcctccaccca

SEQ ID NO: 2374161 - DNA, 17 bp, Homo sapiens
tctttctagtggtcttt

SEQ ID NO: 2374162 - DNA, 21 bp, Homo sapiens
tctttctagtggtctttgtaa

SEQ ID NO: 2374163 - DNA, 22 bp, Homo sapiens
tctttctagtggtctttgtaag

SEQ ID NO: 2374164 - DNA, 20 bp, Homo sapiens
tctttctgctctgccatctt

SEQ ID NO: 2374165 - DNA, 16 bp, Homo sapiens
tctttgaccagatctt

SEQ ID NO: 2374166 - DNA, 19 bp, Homo sapiens
tctttgaccagatctttct

SEQ ID NO: 2374167 - DNA, 13 bp, Homo sapiens
tctttgataatgt

SEQ ID NO: 2374168 - DNA, 16 bp, Homo sapiens
tctttgataatgttaa

SEQ ID NO: 2374169 - DNA, 15 bp, Homo sapiens
tgtcccttttctttg

SEQ ID NO: 2374170 - DNA, 13 bp, Homo sapiens
tgtccgcctctgc

SEQ ID NO: 2374171 - DNA, 15 bp, Homo sapiens
tgtcctacgtccaag

SEQ ID NO: 2374172 - DNA, 15 bp, Homo sapiens
tgtcctccaggagct

SEQ ID NO: 2374173 - DNA, 16 bp, Homo sapiens
tgtcctccaggagctt

SEQ ID NO: 2374174 - DNA, 14 bp, Homo sapiens
tgtcctccttttca

SEQ ID NO: 2374175 - DNA, 10 bp, Homo sapiens
tgtcctgcct

SEQ ID NO: 2374176 - DNA, 15 bp, Homo sapiens
tgtcctgtaaaggtt

SEQ ID NO: 2374177 - DNA, 21 bp, Homo sapiens
tgtcctttggtactatggtgt

SEQ ID NO: 2374178 - DNA, 22 bp, Homo sapiens
tgtctaattaataaattttcca

SEQ ID NO: 2374179 - DNA, 14 bp, Homo sapiens
tgtctattcagctt

SEQ ID NO: 2374180 - DNA, 22 bp, Homo sapiens
tgtctcaaaggagctttctcaa

SEQ ID NO: 2374181 - DNA, 18 bp, Homo sapiens
tgtctccacccaccttga

SEQ ID NO: 2374182 - DNA, 13 bp, Homo sapiens
tgtctcttctgag

SEQ ID NO: 2374183 - DNA, 16 bp, Homo sapiens
tgtctcttctgagcta

SEQ ID NO: 2374184 - DNA, 16 bp, Homo sapiens
tgtctgccaaacacat

SEQ ID NO: 2374185 - DNA, 23 bp, Homo sapiens
tgtctggaacatggactttcttg

SEQ ID NO: 2374186 - DNA, 20 bp, Homo sapiens
tgtctgggtgctactgggga

SEQ ID NO: 2374187 - DNA, 20 bp, Homo sapiens
tgtctgtacacgtgtcctgt

SEQ ID NO: 2374188 - DNA, 17 bp, Homo sapiens
tgtctgtcaatcacagt

SEQ ID NO: 2374189 - DNA, 19 bp, Homo sapiens
tgtctgtgaacagagagac

SEQ ID NO: 2374190 - DNA, 13 bp, Homo sapiens
tgtctgttctaca

SEQ ID NO: 2374191 - DNA, 21 bp, Homo sapiens
tgtctgttctacatagatgct

SEQ ID NO: 2374192 - DNA, 17 bp, Homo sapiens
tgtcttaaaaatttata

SEQ ID NO: 2374193 - DNA, 15 bp, Homo sapiens
tgtcttcatgttgat

SEQ ID NO: 2374194 - DNA, 16 bp, Homo sapiens
tgtcttccctgggctg

SEQ ID NO: 2374195 - DNA, 16 bp, Homo sapiens
tgtcttgtacatgtgt

SEQ ID NO: 2374196 - DNA, 20 bp, Homo sapiens
tgtcttgtacatgtgtagcc

SEQ ID NO: 2374197 - DNA, 19 bp, Homo sapiens
tgtcttgtatttaaaaaca

SEQ ID NO: 2374198 - DNA, 20 bp, Homo sapiens
tgtctttcagatacatggtt

SEQ ID NO: 2374199 - DNA, 22 bp, Homo sapiens
tgtctttcctgaaccatgtgga

SEQ ID NO: 2374200 - DNA, 21 bp, Homo sapiens
tgtcttttcagaagcaagcca

SEQ ID NO: 2374201 - DNA, 23 bp, Homo sapiens
tgtcttttcagaagcaagccaga

SEQ ID NO: 2374202 - DNA, 13 bp, Homo sapiens
tgtgaaaaattaa

SEQ ID NO: 2374203 - DNA, 17 bp, Homo sapiens
tgtgaaaaattaacttt

SEQ ID NO: 2374204 - DNA, 21 bp, Homo sapiens
tgtgaaacagttgctgtgaac

SEQ ID NO: 2374205 - DNA, 14 bp, Homo sapiens
tgtgaaatgaaaac

SEQ ID NO: 2374206 - DNA, 23 bp, Homo sapiens
tgtgaaccctggggcctgactgc

SEQ ID NO: 2374207 - DNA, 19 bp, Homo sapiens
tgtgaacctgggcactccg

SEQ ID NO: 2374208 - DNA, 18 bp, Homo sapiens
tgtgaatagcctggccac

SEQ ID NO: 2374209 - DNA, 16 bp, Homo sapiens
tgtgaatggattggat

SEQ ID NO: 2374210 - DNA, 19 bp, Homo sapiens
tgtgaatggattggattat

SEQ ID NO: 2374211 - DNA, 22 bp, Homo sapiens
tgtgaatggattggattattta

SEQ ID NO: 2374212 - DNA, 16 bp, Homo sapiens
tgtgaattattgacac

SEQ ID NO: 2374213 - DNA, 21 bp, Homo sapiens
tgtgaattattgacactgaac

SEQ ID NO: 2374214 - DNA, 14 bp, Homo sapiens
tgtgaatttttaag

SEQ ID NO: 2374215 - DNA, 16 bp, Homo sapiens
tgtgaatttttaagct

SEQ ID NO: 2374216 - DNA, 14 bp, Homo sapiens
tgtgacaagaataa

SEQ ID NO: 2374217 - DNA, 17 bp, Homo sapiens
tgtgacacatatgcacc

SEQ ID NO: 2374218 - DNA, 15 bp, Homo sapiens
tgtgacagtgcctct

SEQ ID NO: 2374219 - DNA, 22 bp, Homo sapiens
tgtgacatggtgcctgagaggc

SEQ ID NO: 2374220 - DNA, 21 bp, Homo sapiens
tgtgagccaccgtgcctggcc

SEQ ID NO: 2374221 - DNA, 11 bp, Homo sapiens
tgtgagctgga

SEQ ID NO: 2374222 - DNA, 22 bp, Homo sapiens
tgtgagctggatagacttggga

SEQ ID NO: 2374223 - DNA, 18 bp, Homo sapiens
tgtgagctgtaaaaatgt

SEQ ID NO: 2374224 - DNA, 14 bp, Homo sapiens
tgtgagggagggga

SEQ ID NO: 2374225 - DNA, 13 bp, Homo sapiens
tgtgatgagctga

SEQ ID NO: 2374226 - DNA, 20 bp, Homo sapiens
tgtgattcaatctgtaaact

SEQ ID NO: 2374227 - DNA, 22 bp, Homo sapiens
tgtgattcaatctgtaaactgt

SEQ ID NO: 2374228 - DNA, 22 bp, Homo sapiens
tgtgatttctttaaaagaatga

SEQ ID NO: 2374229 - DNA, 15 bp, Homo sapiens
tgtgcaatacttaga

SEQ ID NO: 2374230 - DNA, 17 bp, Homo sapiens
tgtgcagtcactggagg

SEQ ID NO: 2374231 - DNA, 23 bp, Homo sapiens
tgtgcatgtatgtcttggacact

SEQ ID NO: 2374232 - DNA, 21 bp, Homo sapiens
tgtgcatttttgtgaaatgaa

SEQ ID NO: 2374233 - DNA, 22 bp, Homo sapiens
tgtgcatttttgtgaaatgaaa

SEQ ID NO: 2374234 - DNA, 23 bp, Homo sapiens
tgtgccagaggaatcctggcagc

SEQ ID NO: 2374235 - DNA, 16 bp, Homo sapiens
tgtgccatagtcacat

SEQ ID NO: 2374236 - DNA, 18 bp, Homo sapiens
tgtgccatagtcacatgg

SEQ ID NO: 2374237 - DNA, 19 bp, Homo sapiens
tgtgccatggatctgatct

SEQ ID NO: 2374238 - DNA, 20 bp, Homo sapiens
tgtgccccttcactcatttt

SEQ ID NO: 2374239 - DNA, 16 bp, Homo sapiens
tgtgcctcgcatccta

SEQ ID NO: 2374240 - DNA, 21 bp, Homo sapiens
tgtgcctcgcatcctatgctt

SEQ ID NO: 2374241 - DNA, 17 bp, Homo sapiens
tgtgcctggccccagcc

SEQ ID NO: 2374242 - DNA, 21 bp, Homo sapiens
tgtgcggagcgggaggcggtg

SEQ ID NO: 2374243 - DNA, 18 bp, Homo sapiens
tgtgctatactgcatact

SEQ ID NO: 2374244 - DNA, 21 bp, Homo sapiens
tgtgctctccattctgctcct

SEQ ID NO: 2374245 - DNA, 23 bp, Homo sapiens
tgtgctgacaacttagctcaggt

SEQ ID NO: 2374246 - DNA, 22 bp, Homo sapiens
tgtgcttgaaggccctgctgag

SEQ ID NO: 2374247 - DNA, 20 bp, Homo sapiens
tgtggagaccctgccacagc

SEQ ID NO: 2374248 - DNA, 15 bp, Homo sapiens
tgtggaggaagagcc

SEQ ID NO: 2374249 - DNA, 18 bp, Homo sapiens
tgtggaggaagagccacc

SEQ ID NO: 2374250 - DNA, 19 bp, Homo sapiens
tgtggaggaagagccacct

SEQ ID NO: 2374251 - DNA, 12 bp, Homo sapiens
tgtggaggaagg

SEQ ID NO: 2374252 - DNA, 14 bp, Homo sapiens
tgtggaggaaggat

SEQ ID NO: 2374253 - DNA, 19 bp, Homo sapiens
tgtggatcaaccatcgctt

SEQ ID NO: 2374254 - DNA, 11 bp, Homo sapiens
tgtggcagtgg

SEQ ID NO: 2374255 - DNA, 16 bp, Homo sapiens
tgtggcagtggttttg

SEQ ID NO: 2374256 - DNA, 23 bp, Homo sapiens
tgtggcataaattgcatcactgt

SEQ ID NO: 2374257 - DNA, 16 bp, Homo sapiens
tgtggcatttccaaac

SEQ ID NO: 2374258 - DNA, 22 bp, Homo sapiens
tgtggcctggttcaaagtaaag

SEQ ID NO: 2374259 - DNA, 22 bp, Homo sapiens
tgtggctccaggccaaagtgcc

SEQ ID NO: 2374260 - DNA, 13 bp, Homo sapiens
tgtggctggctct

SEQ ID NO: 2374261 - DNA, 16 bp, Homo sapiens
tgtgggggcttcatct

SEQ ID NO: 2374262 - DNA, 21 bp, Homo sapiens
tgtggggtggagcactggact

SEQ ID NO: 2374263 - DNA, 13 bp, Homo sapiens
tgtgggtctctga

SEQ ID NO: 2374264 - DNA, 20 bp, Homo sapiens
tgtgggtgggagtgtgtctg

SEQ ID NO: 2374265 - DNA, 23 bp, Homo sapiens
tgtgggtgggagtgtgtctgctg

SEQ ID NO: 2374266 - DNA, 21 bp, Homo sapiens
tgtgggtgtcctgcctgtctg

SEQ ID NO: 2374267 - DNA, 23 bp, Homo sapiens
tgtgggtgtcctgcctgtctgcc

SEQ ID NO: 2374268 - DNA, 22 bp, Homo sapiens
tgtgggtgttctttcctgccct

SEQ ID NO: 2374269 - DNA, 21 bp, Homo sapiens
tgtggttcctaagcctgttgc

SEQ ID NO: 2374270 - DNA, 23 bp, Homo sapiens
tgtggttcctaagcctgttgctg

SEQ ID NO: 2374271 - DNA, 17 bp, Homo sapiens
tgtggttcctctgctca

SEQ ID NO: 2374272 - DNA, 11 bp, Homo sapiens
tgtggttttga

SEQ ID NO: 2374273 - DNA, 16 bp, Homo sapiens
tgtgtagagttaagaa

SEQ ID NO: 2374274 - DNA, 19 bp, Homo sapiens
tgtgtagagttaagaagct

SEQ ID NO: 2374275 - DNA, 18 bp, Homo sapiens
tgtgtagctgcaaaaata

SEQ ID NO: 2374276 - DNA, 23 bp, Homo sapiens
tgtgtcagcattcctattaatgt

SEQ ID NO: 2374277 - DNA, 14 bp, Homo sapiens
tgtgtcagctgagg

SEQ ID NO: 2374278 - DNA, 16 bp, Homo sapiens
tgtgtcccagatgctg

SEQ ID NO: 2374279 - DNA, 22 bp, Homo sapiens
tgtgtcccccccaggccttgtc

SEQ ID NO: 2374280 - DNA, 23 bp, Homo sapiens
tgtgtccgtgaaagttgtgatct

SEQ ID NO: 2374281 - DNA, 15 bp, Homo sapiens
tgtgtctgccaaaca

SEQ ID NO: 2374282 - DNA, 18 bp, Homo sapiens
ttacctttttatttgcat

SEQ ID NO: 2374283 - DNA, 20 bp, Homo sapiens
ttacctttttatttgcatgt

SEQ ID NO: 2374284 - DNA, 19 bp, Homo sapiens
ttaccttttttttttcttg

SEQ ID NO: 2374285 - DNA, 18 bp, Homo sapiens
ttacgtgaagaaataaat

SEQ ID NO: 2374286 - DNA, 15 bp, Homo sapiens
ttactaaaaagtata

SEQ ID NO: 2374287 - DNA, 15 bp, Homo sapiens
ttactaaaatttaca

SEQ ID NO: 2374288 - DNA, 14 bp, Homo sapiens
ttactataaatgaa

SEQ ID NO: 2374289 - DNA, 22 bp, Homo sapiens
ttactgaataatatcaaataaa

SEQ ID NO: 2374290 - DNA, 22 bp, Homo sapiens
ttactggtgaggttgaggaata

SEQ ID NO: 2374291 - DNA, 19 bp, Homo sapiens
ttactgtccccttgatata

SEQ ID NO: 2374292 - DNA, 20 bp, Homo sapiens
ttactgtggaggaaggattg

SEQ ID NO: 2374293 - DNA, 23 bp, Homo sapiens
ttactgtggaggaaggattgtaa

SEQ ID NO: 2374294 - DNA, 19 bp, Homo sapiens
ttacttaattgccagcaaa

SEQ ID NO: 2374295 - DNA, 13 bp, Homo sapiens
ttacttcttctct

SEQ ID NO: 2374296 - DNA, 17 bp, Homo sapiens
ttactttcaagtaatat

SEQ ID NO: 2374297 - DNA, 18 bp, Homo sapiens
ttagaacgttaaactatt

SEQ ID NO: 2374298 - DNA, 22 bp, Homo sapiens
ttagacaaagccttaagcaaat

SEQ ID NO: 2374299 - DNA, 20 bp, Homo sapiens
ttagagaggtagcgagctgc

SEQ ID NO: 2374300 - DNA, 19 bp, Homo sapiens
ttagattgagaaatgtgta

SEQ ID NO: 2374301 - DNA, 21 bp, Homo sapiens
ttagcaactgctggggagaca

SEQ ID NO: 2374302 - DNA, 14 bp, Homo sapiens
ttagcacagtattt

SEQ ID NO: 2374303 - DNA, 15 bp, Homo sapiens
ttagcacagtattta

SEQ ID NO: 2374304 - DNA, 17 bp, Homo sapiens
ttagcacagtatttaac

SEQ ID NO: 2374305 - DNA, 19 bp, Homo sapiens
ttagcacagtatttaacat

SEQ ID NO: 2374306 - DNA, 15 bp, Homo sapiens
ttagcagacctaaag

SEQ ID NO: 2374307 - DNA, 20 bp, Homo sapiens
ttagcatgttcctccttttc

SEQ ID NO: 2374308 - DNA, 23 bp, Homo sapiens
ttagccaggatcatggtgtaata

SEQ ID NO: 2374309 - DNA, 19 bp, Homo sapiens
ttagcgttgttttgtggat

SEQ ID NO: 2374310 - DNA, 16 bp, Homo sapiens
ttagctgaagaattga

SEQ ID NO: 2374311 - DNA, 19 bp, Homo sapiens
ttaggaatctcttcactac

SEQ ID NO: 2374312 - DNA, 20 bp, Homo sapiens
ttaggactaaggaactaaaa

SEQ ID NO: 2374313 - DNA, 22 bp, Homo sapiens
ttaggactaaggaactaaaact

SEQ ID NO: 2374314 - DNA, 15 bp, Homo sapiens
ttaggcagattgaaa

SEQ ID NO: 2374315 - DNA, 13 bp, Homo sapiens
ttaggcagcctgc

SEQ ID NO: 2374316 - DNA, 14 bp, Homo sapiens
ttaggcctctgaga

SEQ ID NO: 2374317 - DNA, 15 bp, Homo sapiens
ttaggctgttggttc

SEQ ID NO: 2374318 - DNA, 19 bp, Homo sapiens
ttaggcttggctgccctgt

SEQ ID NO: 2374319 - DNA, 17 bp, Homo sapiens
ttagggctgcttttctt

SEQ ID NO: 2374320 - DNA, 19 bp, Homo sapiens
ttaggggaaggagaagtaa

SEQ ID NO: 2374321 - DNA, 12 bp, Homo sapiens
ttagtacaatag

SEQ ID NO: 2374322 - DNA, 19 bp, Homo sapiens
ttagtacaatagtatacat

SEQ ID NO: 2374323 - DNA, 21 bp, Homo sapiens
ttagtacaatagtatacattt

SEQ ID NO: 2374324 - DNA, 22 bp, Homo sapiens
ttagtacaatagtatacatttt

SEQ ID NO: 2374325 - DNA, 14 bp, Homo sapiens
ttagtgatagatgt

SEQ ID NO: 2374326 - DNA, 20 bp, Homo sapiens
ttagtggctcaacattgtgt

SEQ ID NO: 2374327 - DNA, 23 bp, Homo sapiens
ttagtggctcaacattgtgttcc

SEQ ID NO: 2374328 - DNA, 19 bp, Homo sapiens
ttagtggtcataaaataga

SEQ ID NO: 2374329 - DNA, 19 bp, Homo sapiens
ttagtgtgacagtttccaa

SEQ ID NO: 2374330 - DNA, 20 bp, Homo sapiens
ttagtgtgacagtttccaaa

SEQ ID NO: 2374331 - DNA, 21 bp, Homo sapiens
ttagtgtgacagtttccaaat

SEQ ID NO: 2374332 - DNA, 22 bp, Homo sapiens
ttagttctgttgacctgtgcac

SEQ ID NO: 2374333 - DNA, 18 bp, Homo sapiens
ttagtttttggttgggaa

SEQ ID NO: 2374334 - DNA, 19 bp, Homo sapiens
ttagtttttggttgggaat

SEQ ID NO: 2374335 - DNA, 22 bp, Homo sapiens
ttataatgattaagggacattt

SEQ ID NO: 2374336 - DNA, 19 bp, Homo sapiens
ttataatggccctgtagct

SEQ ID NO: 2374337 - DNA, 20 bp, Homo sapiens
ttataattttttttaaaata

SEQ ID NO: 2374338 - DNA, 12 bp, Homo sapiens
ttatacatttgg

SEQ ID NO: 2374339 - DNA, 24 bp, Homo sapiens
ttatactgggacaccattaccaaa

SEQ ID NO: 2374340 - DNA, 11 bp, Homo sapiens
ttatagaaaat

SEQ ID NO: 2374341 - DNA, 12 bp, Homo sapiens
ttatagaaaatt

SEQ ID NO: 2374342 - DNA, 18 bp, Homo sapiens
ttatagcaactaatgttt

SEQ ID NO: 2374343 - DNA, 19 bp, Homo sapiens
ttatagcaactaatgtttg

SEQ ID NO: 2374344 - DNA, 15 bp, Homo sapiens
ttatagtaactataa

SEQ ID NO: 2374345 - DNA, 14 bp, Homo sapiens
ttatatcatgcaaa

SEQ ID NO: 2374346 - DNA, 21 bp, Homo sapiens
ttatatgattaaattatcatt

SEQ ID NO: 2374347 - DNA, 13 bp, Homo sapiens
ttatatgcttact

SEQ ID NO: 2374348 - DNA, 20 bp, Homo sapiens
ttatatgctttattaatgtt

SEQ ID NO: 2374349 - DNA, 16 bp, Homo sapiens
ttatattctgcagaaa

SEQ ID NO: 2374350 - DNA, 22 bp, Homo sapiens
ttatatttcctttatgtgaatt

SEQ ID NO: 2374351 - DNA, 18 bp, Homo sapiens
ttatcatgaattttaaag

SEQ ID NO: 2374352 - DNA, 15 bp, Homo sapiens
ttatcattaaaaatt

SEQ ID NO: 2374353 - DNA, 18 bp, Homo sapiens
ttatcctctctctcttct

SEQ ID NO: 2374354 - DNA, 14 bp, Homo sapiens
ttatcgaaataaca

SEQ ID NO: 2374355 - DNA, 15 bp, Homo sapiens
ttatcgtttttgtat

SEQ ID NO: 2374356 - DNA, 20 bp, Homo sapiens
ttatctcagtcatgcataaa

SEQ ID NO: 2374357 - DNA, 15 bp, Homo sapiens
ttatcttacaatatt

SEQ ID NO: 2374358 - DNA, 12 bp, Homo sapiens
ttatctttatat

SEQ ID NO: 2374359 - DNA, 11 bp, Homo sapiens
ttatgaacagc

SEQ ID NO: 2374360 - DNA, 19 bp, Homo sapiens
ttatgacatttttctggct

SEQ ID NO: 2374361 - DNA, 13 bp, Homo sapiens
ttatgatgctaag

SEQ ID NO: 2374362 - DNA, 17 bp, Homo sapiens
ttatgatgctaagctga

SEQ ID NO: 2374363 - DNA, 20 bp, Homo sapiens
ttatgatttaataaaataat

SEQ ID NO: 2374364 - DNA, 16 bp, Homo sapiens
ttatgatttccttcaa

SEQ ID NO: 2374365 - DNA, 19 bp, Homo sapiens
ttatgcacttttagaaatg

SEQ ID NO: 2374366 - DNA, 20 bp, Homo sapiens
ttatgcacttttagaaatgc

SEQ ID NO: 2374367 - DNA, 22 bp, Homo sapiens
ttatgcacttttagaaatgcat

SEQ ID NO: 2374368 - DNA, 18 bp, Homo sapiens
ttatggggccctgtccag

SEQ ID NO: 2374369 - DNA, 14 bp, Homo sapiens
ttatgtacaaacat

SEQ ID NO: 2374370 - DNA, 23 bp, Homo sapiens
ttatgtcttgtatttaaaaacat

SEQ ID NO: 2374371 - DNA, 19 bp, Homo sapiens
ttatgtgaatttttaagct

SEQ ID NO: 2374372 - DNA, 13 bp, Homo sapiens
ttatgttagttta

SEQ ID NO: 2374373 - DNA, 13 bp, Homo sapiens
ttatgttgtaata

SEQ ID NO: 2374374 - DNA, 19 bp, Homo sapiens
ttattaagctttttggaat

SEQ ID NO: 2374375 - DNA, 17 bp, Homo sapiens
ttattaataatgaagta

SEQ ID NO: 2374376 - DNA, 13 bp, Homo sapiens
ttattattaataa

SEQ ID NO: 2374377 - DNA, 17 bp, Homo sapiens
ttattcataatgtgaga

SEQ ID NO: 2374378 - DNA, 20 bp, Homo sapiens
ttattcctcctgctcatatt

SEQ ID NO: 2374379 - DNA, 11 bp, Homo sapiens
ttattgacact

SEQ ID NO: 2374380 - DNA, 12 bp, Homo sapiens
ttattgacactg

SEQ ID NO: 2374381 - DNA, 13 bp, Homo sapiens
ttattgaccattt

SEQ ID NO: 2374382 - DNA, 14 bp, Homo sapiens
ttattggctgagat

SEQ ID NO: 2374383 - DNA, 16 bp, Homo sapiens
ttattggctgagatat

SEQ ID NO: 2374384 - DNA, 10 bp, Homo sapiens
ttatttaata

SEQ ID NO: 2374385 - DNA, 13 bp, Homo sapiens
ttatttcaaaatg

SEQ ID NO: 2374386 - DNA, 12 bp, Homo sapiens
ttatttctatga

SEQ ID NO: 2374387 - DNA, 21 bp, Homo sapiens
ttatttgaagatttaattact

SEQ ID NO: 2374388 - DNA, 13 bp, Homo sapiens
ttatttgcatgtg

SEQ ID NO: 2374389 - DNA, 19 bp, Homo sapiens
ttattttctacgtttcttt

SEQ ID NO: 2374390 - DNA, 14 bp, Homo sapiens
ttatttttataatt

SEQ ID NO: 2374391 - DNA, 15 bp, Homo sapiens
ttattttttaaaaag

SEQ ID NO: 2374392 - DNA, 18 bp, Homo sapiens
ttattttttaaaaaggta

SEQ ID NO: 2374393 - DNA, 16 bp, Homo sapiens
ttcaaaaagaactaaa

SEQ ID NO: 2374394 - DNA, 21 bp, Homo sapiens
ttcaaaaggtattatacatgt

SEQ ID NO: 2374395 - DNA, 16 bp, Homo sapiens
ttcaaaataaaaagta

SEQ ID NO: 2374396 - DNA, 14 bp, Homo sapiens
ttcaaaatgtctgt

SEQ ID NO: 2374397 - DNA, 15 bp, Homo sapiens
ttgcctgaggctgta

SEQ ID NO: 2374398 - DNA, 12 bp, Homo sapiens
ttgcctgtcaag

SEQ ID NO: 2374399 - DNA, 13 bp, Homo sapiens
ttgcctgtcaagt

SEQ ID NO: 2374400 - DNA, 14 bp, Homo sapiens
ttgcgggacagagt

SEQ ID NO: 2374401 - DNA, 18 bp, Homo sapiens
ttgcgtagaggctacagg

SEQ ID NO: 2374402 - DNA, 15 bp, Homo sapiens
ttgcgtggactctgc

SEQ ID NO: 2374403 - DNA, 21 bp, Homo sapiens
ttgctatcgccctcctttccc

SEQ ID NO: 2374404 - DNA, 23 bp, Homo sapiens
ttgctcagtgtccagcttccaaa

SEQ ID NO: 2374405 - DNA, 16 bp, Homo sapiens
ttgctcataagtaaat

SEQ ID NO: 2374406 - DNA, 22 bp, Homo sapiens
ttgctccagataactctctttc

SEQ ID NO: 2374407 - DNA, 14 bp, Homo sapiens
ttgctctacaatga

SEQ ID NO: 2374408 - DNA, 16 bp, Homo sapiens
ttgctctgtcccccag

SEQ ID NO: 2374409 - DNA, 16 bp, Homo sapiens
ttgctgaaattttata

SEQ ID NO: 2374410 - DNA, 18 bp, Homo sapiens
ttgctgatccccaacctg

SEQ ID NO: 2374411 - DNA, 15 bp, Homo sapiens
ttgctgctgcctctt

SEQ ID NO: 2374412 - DNA, 17 bp, Homo sapiens
ttgctgctgtccagtgc

SEQ ID NO: 2374413 - DNA, 12 bp, Homo sapiens
ttgctgctgtct

SEQ ID NO: 2374414 - DNA, 21 bp, Homo sapiens
ttgctggaataagttcaaatt

SEQ ID NO: 2374415 - DNA, 23 bp, Homo sapiens
ttgctggccccagccctgctggg

SEQ ID NO: 2374416 - DNA, 17 bp, Homo sapiens
ttgctgtacaaaagcaa

SEQ ID NO: 2374417 - DNA, 19 bp, Homo sapiens
ttgctgtccaggcagctcc

SEQ ID NO: 2374418 - DNA, 18 bp, Homo sapiens
ttgctgtgtgaccctggg

SEQ ID NO: 2374419 - DNA, 13 bp, Homo sapiens
ttgcttaaaagca

SEQ ID NO: 2374420 - DNA, 14 bp, Homo sapiens
ttgcttaaatttct

SEQ ID NO: 2374421 - DNA, 17 bp, Homo sapiens
ttgcttctgtatttcct

SEQ ID NO: 2374422 - DNA, 18 bp, Homo sapiens
ttgcttctgtatttcctt

SEQ ID NO: 2374423 - DNA, 17 bp, Homo sapiens
ttgcttgatccagaaga

SEQ ID NO: 2374424 - DNA, 16 bp, Homo sapiens
ttgctttaccttttca

SEQ ID NO: 2374425 - DNA, 15 bp, Homo sapiens
ttggaaaaaactctg

SEQ ID NO: 2374426 - DNA, 12 bp, Homo sapiens
ttggaaagtcag

SEQ ID NO: 2374427 - DNA, 15 bp, Homo sapiens
ttggaaataaaagat

SEQ ID NO: 2374428 - DNA, 18 bp, Homo sapiens
ttggaaatagaaagaagc

SEQ ID NO: 2374429 - DNA, 18 bp, Homo sapiens
ttggaaattcctgtactg

SEQ ID NO: 2374430 - DNA, 16 bp, Homo sapiens
ttggaagagaggcacc

SEQ ID NO: 2374431 - DNA, 21 bp, Homo sapiens
ttggaagagaggcacctgctg

SEQ ID NO: 2374432 - DNA, 21 bp, Homo sapiens
ttggaagctgtttggaaaaga

SEQ ID NO: 2374433 - DNA, 17 bp, Homo sapiens
ttggaaggatctgctga

SEQ ID NO: 2374434 - DNA, 17 bp, Homo sapiens
ttggaagtttagctctg

SEQ ID NO: 2374435 - DNA, 17 bp, Homo sapiens
ttggaatattaaaaaac

SEQ ID NO: 2374436 - DNA, 17 bp, Homo sapiens
ttggacctaatccaagc

SEQ ID NO: 2374437 - DNA, 13 bp, Homo sapiens
ttggagagcagct

SEQ ID NO: 2374438 - DNA, 15 bp, Homo sapiens
ttggagagcagctgg

SEQ ID NO: 2374439 - DNA, 14 bp, Homo sapiens
ttggattatttaat

SEQ ID NO: 2374440 - DNA, 15 bp, Homo sapiens
ttggattatttaata

SEQ ID NO: 2374441 - DNA, 19 bp, Homo sapiens
ttggattatttaataacat

SEQ ID NO: 2374442 - DNA, 21 bp, Homo sapiens
ttggattatttaataacatta

SEQ ID NO: 2374443 - DNA, 21 bp, Homo sapiens
ttggcaatgactcaaagtctg

SEQ ID NO: 2374444 - DNA, 16 bp, Homo sapiens
ttggccccactttgaa

SEQ ID NO: 2374445 - DNA, 20 bp, Homo sapiens
ttggccccactttgaagggc

SEQ ID NO: 2374446 - DNA, 13 bp, Homo sapiens
ttggcctgctgtg

SEQ ID NO: 2374447 - DNA, 14 bp, Homo sapiens
ttggcctgctgtga

SEQ ID NO: 2374448 - DNA, 22 bp, Homo sapiens
ttggcgtagcagagttaaatct

SEQ ID NO: 2374449 - DNA, 11 bp, Homo sapiens
ttggcttctgt

SEQ ID NO: 2374450 - DNA, 22 bp, Homo sapiens
ttggcttctgtgatgagctgat

SEQ ID NO: 2374451 - DNA, 17 bp, Homo sapiens
ttgggaaaacatttgct

SEQ ID NO: 2374452 - DNA, 23 bp, Homo sapiens
ttgggaatgaggaaaattcttaa

SEQ ID NO: 2374453 - DNA, 21 bp, Homo sapiens
ttgggagagccatacataaaa

SEQ ID NO: 2374454 - DNA, 12 bp, Homo sapiens
ttgggctctgat

SEQ ID NO: 2374455 - DNA, 14 bp, Homo sapiens
ttgggctctgatga

SEQ ID NO: 2374456 - DNA, 21 bp, Homo sapiens
ttggggccaccaaagctgccc

SEQ ID NO: 2374457 - DNA, 22 bp, Homo sapiens
ttggggtccctcaggttccttt

SEQ ID NO: 2374458 - DNA, 21 bp, Homo sapiens
ttgggtgggattttttccctt

SEQ ID NO: 2374459 - DNA, 21 bp, Homo sapiens
ttgggttaaaagatggttgta

SEQ ID NO: 2374460 - DNA, 21 bp, Homo sapiens
ttggtaaaaacagcagctcat

SEQ ID NO: 2374461 - DNA, 19 bp, Homo sapiens
ttggtaaaactcactgtga

SEQ ID NO: 2374462 - DNA, 12 bp, Homo sapiens
ttggtatatttt

SEQ ID NO: 2374463 - DNA, 22 bp, Homo sapiens
ttggtcacaaagctatttaagt

SEQ ID NO: 2374464 - DNA, 21 bp, Homo sapiens
ttggtctcccatatgcagaaa

SEQ ID NO: 2374465 - DNA, 15 bp, Homo sapiens
ttggtgtaatttgaa

SEQ ID NO: 2374466 - DNA, 13 bp, Homo sapiens
ttggttttatggt

SEQ ID NO: 2374467 - DNA, 17 bp, Homo sapiens
ttggttttcctgtggca

SEQ ID NO: 2374468 - DNA, 16 bp, Homo sapiens
ttgtaaaaaaaaatgc

SEQ ID NO: 2374469 - DNA, 22 bp, Homo sapiens
ttgtaaaaaaaaatgcctttga

SEQ ID NO: 2374470 - DNA, 15 bp, Homo sapiens
ttgtaaaacagtggt

SEQ ID NO: 2374471 - DNA, 13 bp, Homo sapiens
ttgtaaaagaaat

SEQ ID NO: 2374472 - DNA, 15 bp, Homo sapiens
ttgtaaaagaaatca

SEQ ID NO: 2374473 - DNA, 21 bp, Homo sapiens
ttgtaaagatattgtatctcc

SEQ ID NO: 2374474 - DNA, 14 bp, Homo sapiens
ttgtaacccactga

SEQ ID NO: 2374475 - DNA, 19 bp, Homo sapiens
ttgtaagagtgtagaagca

SEQ ID NO: 2374476 - DNA, 20 bp, Homo sapiens
ttgtaagtgtaaaaaatgtc

SEQ ID NO: 2374477 - DNA, 18 bp, Homo sapiens
ttgtaagtttcaggtgac

SEQ ID NO: 2374478 - DNA, 13 bp, Homo sapiens
ttgtaataagcaa

SEQ ID NO: 2374479 - DNA, 13 bp, Homo sapiens
ttgtaatatcagt

SEQ ID NO: 2374480 - DNA, 14 bp, Homo sapiens
ttgtaatatcagtt

SEQ ID NO: 2374481 - DNA, 19 bp, Homo sapiens
ttgtaatatcagttacagt

SEQ ID NO: 2374482 - DNA, 15 bp, Homo sapiens
ttgtaatattttgct

SEQ ID NO: 2374483 - DNA, 17 bp, Homo sapiens
ttgtacagaatatttct

SEQ ID NO: 2374484 - DNA, 20 bp, Homo sapiens
ttgtacatgtgtagcctgtg

SEQ ID NO: 2374485 - DNA, 20 bp, Homo sapiens
ttgtacatttatgatttaat

SEQ ID NO: 2374486 - DNA, 18 bp, Homo sapiens
ttgtaccaaaattttaaa

SEQ ID NO: 2374487 - DNA, 22 bp, Homo sapiens
ttgtactaatctgagattgtgt

SEQ ID NO: 2374488 - DNA, 15 bp, Homo sapiens
ttgtactctacaaaa

SEQ ID NO: 2374489 - DNA, 15 bp, Homo sapiens
ttgtacttaaatggt

SEQ ID NO: 2374490 - DNA, 19 bp, Homo sapiens
ttgtactttatcatgaatg

SEQ ID NO: 2374491 - DNA, 18 bp, Homo sapiens
ttgtagagtgtagactgt

SEQ ID NO: 2374492 - DNA, 22 bp, Homo sapiens
ttgtagcatttaaaatggaaaa

SEQ ID NO: 2374493 - DNA, 18 bp, Homo sapiens
ttgtagctggggctttga

SEQ ID NO: 2374494 - DNA, 16 bp, Homo sapiens
ttgtagtaaaagtggt

SEQ ID NO: 2374495 - DNA, 22 bp, Homo sapiens
ttgtagtaaaagtggtctctgc

SEQ ID NO: 2374496 - DNA, 15 bp, Homo sapiens
ttgtagttaatataa

SEQ ID NO: 2374497 - DNA, 20 bp, Homo sapiens
ttgtatagcatgaaataaaa

SEQ ID NO: 2374498 - DNA, 15 bp, Homo sapiens
ttgtatattacaatg

SEQ ID NO: 2374499 - DNA, 15 bp, Homo sapiens
ttgtatctcctttaa

SEQ ID NO: 2374500 - DNA, 17 bp, Homo sapiens
ttgtatttaaaaacatt

SEQ ID NO: 2374501 - DNA, 12 bp, Homo sapiens
ttgtcagctact

SEQ ID NO: 2374502 - DNA, 17 bp, Homo sapiens
ttgtcctacgtccaagg

SEQ ID NO: 2374503 - DNA, 19 bp, Homo sapiens
ttgtcctccttttcacttt

SEQ ID NO: 2374504 - DNA, 16 bp, Homo sapiens
ttgtcctttatgtatt

SEQ ID NO: 2374505 - DNA, 21 bp, Homo sapiens
ttgtcctttttcactttgaaa

SEQ ID NO: 2374506 - DNA, 14 bp, Homo sapiens
ttgtctaaagatct

SEQ ID NO: 2374507 - DNA, 20 bp, Homo sapiens
ttgtctaggagatgctttct

SEQ ID NO: 2374508 - DNA, 21 bp, Homo sapiens
ttgtctgtctccctcccctct

SEQ ID NO: 2374509 - DNA, 16 bp, Homo sapiens
ttgtctgtgataacag

SEQ ID NO: 2374510 - DNA, 21 bp, Homo sapiens
ttgtcttatgtgaaaaattaa

SEQ ID NO: 2374511 - DNA, 13 bp, Homo sapiens
ttgtcttattgca

SEQ ID NO: 2374512 - DNA, 19 bp, Homo sapiens
ttttgtgaatggattggat

SEQ ID NO: 2374513 - DNA, 23 bp, Homo sapiens
ttttgtgaatggattggattatt

SEQ ID NO: 2374514 - DNA, 11 bp, Homo sapiens
ttttgtgtcct

SEQ ID NO: 2374515 - DNA, 20 bp, Homo sapiens
ttttgtgtcctccaggagct

SEQ ID NO: 2374516 - DNA, 15 bp, Homo sapiens
ttttgtgtgaaattg

SEQ ID NO: 2374517 - DNA, 16 bp, Homo sapiens
ttttgttgccccagaa

SEQ ID NO: 2374518 - DNA, 14 bp, Homo sapiens
ttttgtttccatgg

SEQ ID NO: 2374519 - DNA, 15 bp, Homo sapiens
ttttgtttggtaaat

SEQ ID NO: 2374520 - DNA, 23 bp, Homo sapiens
tttttaaaatagaaattttgtaa

SEQ ID NO: 2374521 - DNA, 14 bp, Homo sapiens
tttttaaatgtttc

SEQ ID NO: 2374522 - DNA, 14 bp, Homo sapiens
tttttaaattaaat

SEQ ID NO: 2374523 - DNA, 15 bp, Homo sapiens
tttttaagatagtgt

SEQ ID NO: 2374524 - DNA, 20 bp, Homo sapiens
tttttaagatagtgtaactt

SEQ ID NO: 2374525 - DNA, 21 bp, Homo sapiens
tttttagaacatgtaaaatgt

SEQ ID NO: 2374526 - DNA, 18 bp, Homo sapiens
tttttataattgtacaaa

SEQ ID NO: 2374527 - DNA, 15 bp, Homo sapiens
tttttatatttcctt

SEQ ID NO: 2374528 - DNA, 14 bp, Homo sapiens
tttttatctttata

SEQ ID NO: 2374529 - DNA, 17 bp, Homo sapiens
tttttatgtaattatat

SEQ ID NO: 2374530 - DNA, 11 bp, Homo sapiens
tttttcaaaat

SEQ ID NO: 2374531 - DNA, 21 bp, Homo sapiens
tttttcatgacataataaagt

SEQ ID NO: 2374532 - DNA, 18 bp, Homo sapiens
tttttcattgtgttttct

SEQ ID NO: 2374533 - DNA, 16 bp, Homo sapiens
tttttctaagagaagt

SEQ ID NO: 2374534 - DNA, 22 bp, Homo sapiens
tttttctggctgtgatcttaaa

SEQ ID NO: 2374535 - DNA, 16 bp, Homo sapiens
tttttcttctgtattt

SEQ ID NO: 2374536 - DNA, 12 bp, Homo sapiens
tttttgacactg

SEQ ID NO: 2374537 - DNA, 12 bp, Homo sapiens
tttttgactttt

SEQ ID NO: 2374538 - DNA, 20 bp, Homo sapiens
tttttgactttttttgtatg

SEQ ID NO: 2374539 - DNA, 23 bp, Homo sapiens
tttttgactttttttgtatgtgt

SEQ ID NO: 2374540 - DNA, 17 bp, Homo sapiens
tttttgcatttaaaaca

SEQ ID NO: 2374541 - DNA, 15 bp, Homo sapiens
tttttggaaagtcag

SEQ ID NO: 2374542 - DNA, 14 bp, Homo sapiens
tttttggttgggaa

SEQ ID NO: 2374543 - DNA, 16 bp, Homo sapiens
tttttgtaaatgtgta

SEQ ID NO: 2374544 - DNA, 12 bp, Homo sapiens
tttttgtaataa

SEQ ID NO: 2374545 - DNA, 12 bp, Homo sapiens
tttttgtacatg

SEQ ID NO: 2374546 - DNA, 14 bp, Homo sapiens
tttttgtatgtgtg

SEQ ID NO: 2374547 - DNA, 15 bp, Homo sapiens
ttttttaagcttcag

SEQ ID NO: 2374548 - DNA, 12 bp, Homo sapiens
ttttttaggaaa

SEQ ID NO: 2374549 - DNA, 13 bp, Homo sapiens
ttttttgtaataa

SEQ ID NO: 2374550 - DNA, 15 bp, Homo sapiens
aaagaccaagacttt

SEQ ID NO: 2374551 - DNA, 14 bp, Homo sapiens
aaagactcaaattt

SEQ ID NO: 2374552 - DNA, 15 bp, Homo sapiens
aaagactggttttct

SEQ ID NO: 2374553 - DNA, 16 bp, Homo sapiens
aaagactggttttctg

SEQ ID NO: 2374554 - DNA, 17 bp, Homo sapiens
aaagactggttttctgc

SEQ ID NO: 2374555 - DNA, 17 bp, Homo sapiens
aaagacttgagacaatg

SEQ ID NO: 2374556 - DNA, 23 bp, Homo sapiens
aaagacttgagacaatgttttct

SEQ ID NO: 2374557 - DNA, 16 bp, Homo sapiens
aaagaggctgaaagag

SEQ ID NO: 2374558 - DNA, 22 bp, Homo sapiens
aaagaggctgcccctctcacca

SEQ ID NO: 2374559 - DNA, 21 bp, Homo sapiens
aaagagttgggtgtctcctta

SEQ ID NO: 2374560 - DNA, 15 bp, Homo sapiens
aaagataaagaccag

SEQ ID NO: 2374561 - DNA, 20 bp, Homo sapiens
aaagatgccccattccttgc

SEQ ID NO: 2374562 - DNA, 17 bp, Homo sapiens
aaagatggttaaacatt

SEQ ID NO: 2374563 - DNA, 19 bp, Homo sapiens
aaagatggttaaacatttt

SEQ ID NO: 2374564 - DNA, 20 bp, Homo sapiens
aaagatggttaaacattttc

SEQ ID NO: 2374565 - DNA, 19 bp, Homo sapiens
aaagattctggggctgtgt

SEQ ID NO: 2374566 - DNA, 23 bp, Homo sapiens
aaagattgaagtattttgctgga

SEQ ID NO: 2374567 - DNA, 19 bp, Homo sapiens
aaagattgctgaaatttta

SEQ ID NO: 2374568 - DNA, 15 bp, Homo sapiens
aaagatttcatatct

SEQ ID NO: 2374569 - DNA, 16 bp, Homo sapiens
aaagatttcatatcta

SEQ ID NO: 2374570 - DNA, 14 bp, Homo sapiens
aaagcagaagtctg

SEQ ID NO: 2374571 - DNA, 18 bp, Homo sapiens
aaagcagaagtctggctt

SEQ ID NO: 2374572 - DNA, 13 bp, Homo sapiens
aaagcataaagct

SEQ ID NO: 2374573 - DNA, 13 bp, Homo sapiens
aaagcatttttca

SEQ ID NO: 2374574 - DNA, 16 bp, Homo sapiens
aaagcatttttcaata

SEQ ID NO: 2374575 - DNA, 14 bp, Homo sapiens
aaagcctaaaattg

SEQ ID NO: 2374576 - DNA, 17 bp, Homo sapiens
aaagcctaccctattct

SEQ ID NO: 2374577 - DNA, 12 bp, Homo sapiens
aaagctactgta

SEQ ID NO: 2374578 - DNA, 18 bp, Homo sapiens
aaagctattagccaggat

SEQ ID NO: 2374579 - DNA, 19 bp, Homo sapiens
aaagctattagccaggatc

SEQ ID NO: 2374580 - DNA, 15 bp, Homo sapiens
aaagctatttaagtg

SEQ ID NO: 2374581 - DNA, 18 bp, Homo sapiens
aaagctcaaatgaaatgt

SEQ ID NO: 2374582 - DNA, 12 bp, Homo sapiens
aaagcttctaaa

SEQ ID NO: 2374583 - DNA, 13 bp, Homo sapiens
aaaggaaaagaaa

SEQ ID NO: 2374584 - DNA, 17 bp, Homo sapiens
aaaggaagcagatacct

SEQ ID NO: 2374585 - DNA, 22 bp, Homo sapiens
aaaggacaccttttaactcacc

SEQ ID NO: 2374586 - DNA, 21 bp, Homo sapiens
aaaggagctttctcaatgtct

SEQ ID NO: 2374587 - DNA, 13 bp, Homo sapiens
aaaggataaagaa

SEQ ID NO: 2374588 - DNA, 22 bp, Homo sapiens
aaaggataaagaaggatgatgt

SEQ ID NO: 2374589 - DNA, 21 bp, Homo sapiens
aaaggatagtaagcatagaaa

SEQ ID NO: 2374590 - DNA, 24 bp, Homo sapiens
aaaggatctaagggaagatcactg

SEQ ID NO: 2374591 - DNA, 20 bp, Homo sapiens
aaaggcaggaagggaagcgt

SEQ ID NO: 2374592 - DNA, 16 bp, Homo sapiens
aaaggcagtattttgt

SEQ ID NO: 2374593 - DNA, 16 bp, Homo sapiens
aaaggcttgaagctgt

SEQ ID NO: 2374594 - DNA, 17 bp, Homo sapiens
aaaggcttgaagctgtg

SEQ ID NO: 2374595 - DNA, 24 bp, Homo sapiens
aaagggaagtaacagacacacgat

SEQ ID NO: 2374596 - DNA, 15 bp, Homo sapiens
aaagggcagttttga

SEQ ID NO: 2374597 - DNA, 14 bp, Homo sapiens
aaaggggagagcct

SEQ ID NO: 2374598 - DNA, 23 bp, Homo sapiens
aaaggtaaatggttaaattttac

SEQ ID NO: 2374599 - DNA, 20 bp, Homo sapiens
aaaggtattatacatgtgat

SEQ ID NO: 2374600 - DNA, 21 bp, Homo sapiens
aaaggtgagtttgagctgcct

SEQ ID NO: 2374601 - DNA, 23 bp, Homo sapiens
aaaggtgagtttgagctgccttc

SEQ ID NO: 2374602 - DNA, 18 bp, Homo sapiens
aaaggtggagtttctctg

SEQ ID NO: 2374603 - DNA, 19 bp, Homo sapiens
aaaggtggagtttctctgt

SEQ ID NO: 2374604 - DNA, 21 bp, Homo sapiens
aaagtaatgacttagaaactg

SEQ ID NO: 2374605 - DNA, 15 bp, Homo sapiens
aaagtacaaatgaag

SEQ ID NO: 2374606 - DNA, 15 bp, Homo sapiens
aaagtacagaatttg

SEQ ID NO: 2374607 - DNA, 15 bp, Homo sapiens
aaagtagattcatga

SEQ ID NO: 2374608 - DNA, 12 bp, Homo sapiens
aaagtagggggc

SEQ ID NO: 2374609 - DNA, 13 bp, Homo sapiens
aaagtataatgtt

SEQ ID NO: 2374610 - DNA, 14 bp, Homo sapiens
aaagtataatgttt

SEQ ID NO: 2374611 - DNA, 16 bp, Homo sapiens
aaagtataatgtttat

SEQ ID NO: 2374612 - DNA, 20 bp, Homo sapiens
aaagtatgcattattaaatt

SEQ ID NO: 2374613 - DNA, 18 bp, Homo sapiens
aaagtattgaaagccaac

SEQ ID NO: 2374614 - DNA, 14 bp, Homo sapiens
aaagtattttcttt

SEQ ID NO: 2374615 - DNA, 23 bp, Homo sapiens
aaagtcaaaaaattatttgctat

SEQ ID NO: 2374616 - DNA, 15 bp, Homo sapiens
aaagtcagaagtttt

SEQ ID NO: 2374617 - DNA, 23 bp, Homo sapiens
aaagtcagttgctcaaaaagaaa

SEQ ID NO: 2374618 - DNA, 16 bp, Homo sapiens
aaagtcattaaagaca

SEQ ID NO: 2374619 - DNA, 17 bp, Homo sapiens
aaagtcattaaagacag

SEQ ID NO: 2374620 - DNA, 19 bp, Homo sapiens
aaagtccctccctgcctga

SEQ ID NO: 2374621 - DNA, 23 bp, Homo sapiens
aaagtctgctctcatataagaca

SEQ ID NO: 2374622 - DNA, 18 bp, Homo sapiens
aaagtctgtctttcctga

SEQ ID NO: 2374623 - DNA, 14 bp, Homo sapiens
aaagtgcatttttg

SEQ ID NO: 2374624 - DNA, 21 bp, Homo sapiens
aaagtggcgtgggagccagcc

SEQ ID NO: 2374625 - DNA, 14 bp, Homo sapiens
aaagtggtctctgc

SEQ ID NO: 2374626 - DNA, 18 bp, Homo sapiens
aaagtggtctctgctggg

SEQ ID NO: 2374627 - DNA, 23 bp, Homo sapiens
aaagtgtgtatatattttgtgtg

SEQ ID NO: 2374628 - DNA, 20 bp, Homo sapiens
aaagttattcttgtcatttt

SEQ ID NO: 2374629 - DNA, 10 bp, Homo sapiens
aaagtttccg

SEQ ID NO: 2374630 - DNA, 19 bp, Homo sapiens
aaagttttgaaaagctatt

SEQ ID NO: 2374631 - DNA, 14 bp, Homo sapiens
aaagttttgttgta

SEQ ID NO: 2374632 - DNA, 14 bp, Homo sapiens
aaagtttttgtttg

SEQ ID NO: 2374633 - DNA, 21 bp, Homo sapiens
aaataaaaaagctcttttaat

SEQ ID NO: 2374634 - DNA, 15 bp, Homo sapiens
aaataaaaactaatt

SEQ ID NO: 2374635 - DNA, 17 bp, Homo sapiens
aaataaaacacacctcg

SEQ ID NO: 2374636 - DNA, 18 bp, Homo sapiens
aaataaaacacacctcgt

SEQ ID NO: 2374637 - DNA, 14 bp, Homo sapiens
aaataaaatgaaaa

SEQ ID NO: 2374638 - DNA, 20 bp, Homo sapiens
aaataaaatgtttcattatg

SEQ ID NO: 2374639 - DNA, 13 bp, Homo sapiens
aaataaaattttt

SEQ ID NO: 2374640 - DNA, 11 bp, Homo sapiens
aaataaataat

SEQ ID NO: 2374641 - DNA, 11 bp, Homo sapiens
aaataaatgaa

SEQ ID NO: 2374642 - DNA, 19 bp, Homo sapiens
aaataacaatgttaaggaa

SEQ ID NO: 2374643 - DNA, 12 bp, Homo sapiens
aaataacagtat

SEQ ID NO: 2374644 - DNA, 18 bp, Homo sapiens
aaataactgaatttggag

SEQ ID NO: 2374645 - DNA, 14 bp, Homo sapiens
aaataagaaataat

SEQ ID NO: 2374646 - DNA, 20 bp, Homo sapiens
aaataatgctacaattttaa

SEQ ID NO: 2374647 - DNA, 17 bp, Homo sapiens
aaataatgcttttctaa

SEQ ID NO: 2374648 - DNA, 23 bp, Homo sapiens
aaataatttgaatgtatttgatt

SEQ ID NO: 2374649 - DNA, 12 bp, Homo sapiens
aaataattttaa

SEQ ID NO: 2374650 - DNA, 13 bp, Homo sapiens
aaatacacatttg

SEQ ID NO: 2374651 - DNA, 15 bp, Homo sapiens
aaatacacatttgct

SEQ ID NO: 2374652 - DNA, 23 bp, Homo sapiens
aaatacatgccacatcaaacctt

SEQ ID NO: 2374653 - DNA, 14 bp, Homo sapiens
aaatacatttgtaa

SEQ ID NO: 2374654 - DNA, 12 bp, Homo sapiens
aaataccattta

SEQ ID NO: 2374655 - DNA, 22 bp, Homo sapiens
aaataccatttagtaagaatac

SEQ ID NO: 2374656 - DNA, 17 bp, Homo sapiens
aaatactacaatagttt

SEQ ID NO: 2374657 - DNA, 12 bp, Homo sapiens
aaatagaaattt

SEQ ID NO: 2374658 - DNA, 13 bp, Homo sapiens
aaatagaataatt

SEQ ID NO: 2374659 - DNA, 18 bp, Homo sapiens
aaatagaataattctttt

SEQ ID NO: 2374660 - DNA, 20 bp, Homo sapiens
aaataggaatcattcagaaa

SEQ ID NO: 2374661 - DNA, 14 bp, Homo sapiens
aaataggagaggat

SEQ ID NO: 2374662 - DNA, 23 bp, Homo sapiens
aaataggagaggatgagagccca

SEQ ID NO: 2374663 - DNA, 19 bp, Homo sapiens
aaataggctattaaaaaag

SEQ ID NO: 2374664 - DNA, 13 bp, Homo sapiens
aaatagtgtgaaa

SEQ ID NO: 2374665 - DNA, 13 bp, Homo sapiens
aagaatgaaagct

SEQ ID NO: 2374666 - DNA, 16 bp, Homo sapiens
aagaatgactatataa

SEQ ID NO: 2374667 - DNA, 18 bp, Homo sapiens
aagaatgactatataatt

SEQ ID NO: 2374668 - DNA, 15 bp, Homo sapiens
aagaatgccatttct

SEQ ID NO: 2374669 - DNA, 22 bp, Homo sapiens
aagaatgccatttctcacgccc

SEQ ID NO: 2374670 - DNA, 15 bp, Homo sapiens
aagaatgttagagta

SEQ ID NO: 2374671 - DNA, 15 bp, Homo sapiens
aagaattgaaaagtt

SEQ ID NO: 2374672 - DNA, 14 bp, Homo sapiens
aagacaaaagtctg

SEQ ID NO: 2374673 - DNA, 16 bp, Homo sapiens
aagacaaaagtctgtc

SEQ ID NO: 2374674 - DNA, 22 bp, Homo sapiens
aagacaaaagtctgtctttcct

SEQ ID NO: 2374675 - DNA, 12 bp, Homo sapiens
aagacaaggctg

SEQ ID NO: 2374676 - DNA, 21 bp, Homo sapiens
aagacacattttttaggaaat

SEQ ID NO: 2374677 - DNA, 18 bp, Homo sapiens
aagacaggagacaaaaga

SEQ ID NO: 2374678 - DNA, 20 bp, Homo sapiens
aagacataacgtttttcctt

SEQ ID NO: 2374679 - DNA, 12 bp, Homo sapiens
aagacatgtctg

SEQ ID NO: 2374680 - DNA, 13 bp, Homo sapiens
aagacatgtctgt

SEQ ID NO: 2374681 - DNA, 16 bp, Homo sapiens
aagacatgtctgttct

SEQ ID NO: 2374682 - DNA, 15 bp, Homo sapiens
aagaccctcccatgg

SEQ ID NO: 2374683 - DNA, 20 bp, Homo sapiens
aagactagaggcttgcataa

SEQ ID NO: 2374684 - DNA, 14 bp, Homo sapiens
aagactcctagctg

SEQ ID NO: 2374685 - DNA, 21 bp, Homo sapiens
aagactcggcttttaatgtac

SEQ ID NO: 2374686 - DNA, 13 bp, Homo sapiens
aagactgggcccc

SEQ ID NO: 2374687 - DNA, 23 bp, Homo sapiens
aagactgggccccacatggctta

SEQ ID NO: 2374688 - DNA, 20 bp, Homo sapiens
aagactggttttctgccaat

SEQ ID NO: 2374689 - DNA, 24 bp, Homo sapiens
aagacttaaagggcccaatgaatt

SEQ ID NO: 2374690 - DNA, 13 bp, Homo sapiens
aagacttgagaca

SEQ ID NO: 2374691 - DNA, 21 bp, Homo sapiens
aagacttgagacaatgttttc

SEQ ID NO: 2374692 - DNA, 22 bp, Homo sapiens
aagacttgagacaatgttttct

SEQ ID NO: 2374693 - DNA, 11 bp, Homo sapiens
aagagaaactt

SEQ ID NO: 2374694 - DNA, 14 bp, Homo sapiens
aagagaagttattt

SEQ ID NO: 2374695 - DNA, 16 bp, Homo sapiens
aagagaatgagtcctt

SEQ ID NO: 2374696 - DNA, 22 bp, Homo sapiens
aagagacagagacaagtaattt

SEQ ID NO: 2374697 - DNA, 16 bp, Homo sapiens
aagagacagcccagga

SEQ ID NO: 2374698 - DNA, 17 bp, Homo sapiens
aagagagtaccatgctg

SEQ ID NO: 2374699 - DNA, 22 bp, Homo sapiens
aagagagtatttttatacaaac

SEQ ID NO: 2374700 - DNA, 18 bp, Homo sapiens
aagagattttatgtttaa

SEQ ID NO: 2374701 - DNA, 15 bp, Homo sapiens
aagagcttgctccag

SEQ ID NO: 2374702 - DNA, 20 bp, Homo sapiens
aagagcttgctccagattct

SEQ ID NO: 2374703 - DNA, 15 bp, Homo sapiens
aagaggccaatgccc

SEQ ID NO: 2374704 - DNA, 23 bp, Homo sapiens
aagaggctgcccctctcaccaaa

SEQ ID NO: 2374705 - DNA, 17 bp, Homo sapiens
aagagtccggatttcta

SEQ ID NO: 2374706 - DNA, 14 bp, Homo sapiens
aagagtctgggacc

SEQ ID NO: 2374707 - DNA, 13 bp, Homo sapiens
aagagtgtagaag

SEQ ID NO: 2374708 - DNA, 15 bp, Homo sapiens
aagagtgtagaagca

SEQ ID NO: 2374709 - DNA, 13 bp, Homo sapiens
aagagttttggga

SEQ ID NO: 2374710 - DNA, 18 bp, Homo sapiens
aagataaagaccagaaat

SEQ ID NO: 2374711 - DNA, 20 bp, Homo sapiens
aagatagtcttggaagctgt

SEQ ID NO: 2374712 - DNA, 14 bp, Homo sapiens
aagatagtgtaact

SEQ ID NO: 2374713 - DNA, 23 bp, Homo sapiens
aagatagttgtaaagatattgta

SEQ ID NO: 2374714 - DNA, 17 bp, Homo sapiens
aagatatttttatcttt

SEQ ID NO: 2374715 - DNA, 15 bp, Homo sapiens
aagatcactttctca

SEQ ID NO: 2374716 - DNA, 21 bp, Homo sapiens
aagatctcactctgccccccc

SEQ ID NO: 2374717 - DNA, 18 bp, Homo sapiens
aagatctttttttaagtg

SEQ ID NO: 2374718 - DNA, 22 bp, Homo sapiens
aagatctttttttaagtgttct

SEQ ID NO: 2374719 - DNA, 22 bp, Homo sapiens
aagatgaatggtctggcaatat

SEQ ID NO: 2374720 - DNA, 21 bp, Homo sapiens
aagatggctgtggcatttcca

SEQ ID NO: 2374721 - DNA, 18 bp, Homo sapiens
aagatgggggcagggctg

SEQ ID NO: 2374722 - DNA, 18 bp, Homo sapiens
aagatggtatcatatatt

SEQ ID NO: 2374723 - DNA, 23 bp, Homo sapiens
aagatgtctcaggtttgttttgt

SEQ ID NO: 2374724 - DNA, 18 bp, Homo sapiens
aagatgtgttcttatttt

SEQ ID NO: 2374725 - DNA, 13 bp, Homo sapiens
aagattatatgaa

SEQ ID NO: 2374726 - DNA, 18 bp, Homo sapiens
aagattattttttaaaaa

SEQ ID NO: 2374727 - DNA, 13 bp, Homo sapiens
aagattctaaagc

SEQ ID NO: 2374728 - DNA, 13 bp, Homo sapiens
aagattggaaatg

SEQ ID NO: 2374729 - DNA, 23 bp, Homo sapiens
aagattggtctcccatatgcaga

SEQ ID NO: 2374730 - DNA, 12 bp, Homo sapiens
aagatttatgtt

SEQ ID NO: 2374731 - DNA, 16 bp, Homo sapiens
aagatttccttgtgca

SEQ ID NO: 2374732 - DNA, 15 bp, Homo sapiens
aagatttctctaata

SEQ ID NO: 2374733 - DNA, 15 bp, Homo sapiens
aagattttgaatgct

SEQ ID NO: 2374734 - DNA, 21 bp, Homo sapiens
aagattttgaatgcttcctga

SEQ ID NO: 2374735 - DNA, 14 bp, Homo sapiens
aagatttttcaaaa

SEQ ID NO: 2374736 - DNA, 20 bp, Homo sapiens
aagatttttctcaaagtttt

SEQ ID NO: 2374737 - DNA, 15 bp, Homo sapiens
aagcaaaatctaaaa

SEQ ID NO: 2374738 - DNA, 20 bp, Homo sapiens
aagcaaaatctaaaatgttt

SEQ ID NO: 2374739 - DNA, 19 bp, Homo sapiens
aagcaaatgttaaaagttt

SEQ ID NO: 2374740 - DNA, 19 bp, Homo sapiens
aagcaacagcctttgaatg

SEQ ID NO: 2374741 - DNA, 20 bp, Homo sapiens
aagcaacagcctttgaatgt

SEQ ID NO: 2374742 - DNA, 16 bp, Homo sapiens
aagcaacttcatttga

SEQ ID NO: 2374743 - DNA, 17 bp, Homo sapiens
aagcaacttcatttgac

SEQ ID NO: 2374744 - DNA, 17 bp, Homo sapiens
aagcaagagagatgttt

SEQ ID NO: 2374745 - DNA, 16 bp, Homo sapiens
aagcaatccacctgcc

SEQ ID NO: 2374746 - DNA, 18 bp, Homo sapiens
aagcaatccacctgcctt

SEQ ID NO: 2374747 - DNA, 14 bp, Homo sapiens
aagcaatcctcctg

SEQ ID NO: 2374748 - DNA, 16 bp, Homo sapiens
aagcaatcctcctgcc

SEQ ID NO: 2374749 - DNA, 17 bp, Homo sapiens
aagcacagagcctggcc

SEQ ID NO: 2374750 - DNA, 18 bp, Homo sapiens
aagcactttgggattctt

SEQ ID NO: 2374751 - DNA, 16 bp, Homo sapiens
aagcagacattttaaa

SEQ ID NO: 2374752 - DNA, 15 bp, Homo sapiens
aagcaggaggccctt

SEQ ID NO: 2374753 - DNA, 21 bp, Homo sapiens
aagcaggcttgcccagtacat

SEQ ID NO: 2374754 - DNA, 22 bp, Homo sapiens
aagcagggacaccccccgcccc

SEQ ID NO: 2374755 - DNA, 13 bp, Homo sapiens
aagcagtattttg

SEQ ID NO: 2374756 - DNA, 20 bp, Homo sapiens
aagcatagataatattgttt

SEQ ID NO: 2374757 - DNA, 18 bp, Homo sapiens
aagcattccttctttgat

SEQ ID NO: 2374758 - DNA, 21 bp, Homo sapiens
aagcattccttctttgataat

SEQ ID NO: 2374759 - DNA, 11 bp, Homo sapiens
aagcatttcat

SEQ ID NO: 2374760 - DNA, 19 bp, Homo sapiens
aagcatttcatgaaaaagc

SEQ ID NO: 2374761 - DNA, 18 bp, Homo sapiens
aagcattttgggatcctt

SEQ ID NO: 2374762 - DNA, 22 bp, Homo sapiens
aagcattttgggatccttcagc

SEQ ID NO: 2374763 - DNA, 11 bp, Homo sapiens
aagccaaagaa

SEQ ID NO: 2374764 - DNA, 16 bp, Homo sapiens
aagccaacaactctgc

SEQ ID NO: 2374765 - DNA, 20 bp, Homo sapiens
aagccaacaactctgccttt

SEQ ID NO: 2374766 - DNA, 14 bp, Homo sapiens
aagccaagggaaag

SEQ ID NO: 2374767 - DNA, 19 bp, Homo sapiens
aagccagacctagcaggct

SEQ ID NO: 2374768 - DNA, 20 bp, Homo sapiens
aagccagacctagcaggctg

SEQ ID NO: 2374769 - DNA, 15 bp, Homo sapiens
aagccagctgcccta

SEQ ID NO: 2374770 - DNA, 15 bp, Homo sapiens
aagccagctttccct

SEQ ID NO: 2374771 - DNA, 17 bp, Homo sapiens
aagccaggcctggctgg

SEQ ID NO: 2374772 - DNA, 17 bp, Homo sapiens
aagccatagaccctgag

SEQ ID NO: 2374773 - DNA, 22 bp, Homo sapiens
aagccatatatgaccagaagcc

SEQ ID NO: 2374774 - DNA, 20 bp, Homo sapiens
aagccattttttgaggagag

SEQ ID NO: 2374775 - DNA, 22 bp, Homo sapiens
aagcctaagggatcctgcctgc

SEQ ID NO: 2374776 - DNA, 20 bp, Homo sapiens
aagcctagacaacctttctg

SEQ ID NO: 2374777 - DNA, 18 bp, Homo sapiens
aagcctccaagcacagag

SEQ ID NO: 2374778 - DNA, 15 bp, Homo sapiens
aagcctccacagcga

SEQ ID NO: 2374779 - DNA, 14 bp, Homo sapiens
aagcctctctctcc

SEQ ID NO: 2374780 - DNA, 11 bp, Homo sapiens
aattcttaaaa

SEQ ID NO: 2374781 - DNA, 14 bp, Homo sapiens
aattgaaaagtaca

SEQ ID NO: 2374782 - DNA, 16 bp, Homo sapiens
aattgaagtttcaagt

SEQ ID NO: 2374783 - DNA, 20 bp, Homo sapiens
aattgaagtttcaagtttta

SEQ ID NO: 2374784 - DNA, 22 bp, Homo sapiens
aattgcatactttgtattttga

SEQ ID NO: 2374785 - DNA, 17 bp, Homo sapiens
aattgccctatgctgtg

SEQ ID NO: 2374786 - DNA, 17 bp, Homo sapiens
aattgctgactgtagct

SEQ ID NO: 2374787 - DNA, 23 bp, Homo sapiens
aattggtaaaaacagcagctcat

SEQ ID NO: 2374788 - DNA, 19 bp, Homo sapiens
aattgtaagtgaaattaag

SEQ ID NO: 2374789 - DNA, 13 bp, Homo sapiens
aattgttgtttct

SEQ ID NO: 2374790 - DNA, 20 bp, Homo sapiens
aattgttgtttctttctagt

SEQ ID NO: 2374791 - DNA, 14 bp, Homo sapiens
aatttaaaaaataa

SEQ ID NO: 2374792 - DNA, 18 bp, Homo sapiens
aatttaaaaaataaataa

SEQ ID NO: 2374793 - DNA, 14 bp, Homo sapiens
aatttaaaaatata

SEQ ID NO: 2374794 - DNA, 15 bp, Homo sapiens
aatttaaaaatatat

SEQ ID NO: 2374795 - DNA, 17 bp, Homo sapiens
aatttaaaaatatattt

SEQ ID NO: 2374796 - DNA, 22 bp, Homo sapiens
aatttaaatgaaagaaaattga

SEQ ID NO: 2374797 - DNA, 15 bp, Homo sapiens
aatttaagcacaaaa

SEQ ID NO: 2374798 - DNA, 23 bp, Homo sapiens
aatttaagtgcgtgtgtagagtt

SEQ ID NO: 2374799 - DNA, 19 bp, Homo sapiens
aatttagacaaagccttaa

SEQ ID NO: 2374800 - DNA, 19 bp, Homo sapiens
aatttatacaccagcaatt

SEQ ID NO: 2374801 - DNA, 21 bp, Homo sapiens
aatttatgaattgaattatct

SEQ ID NO: 2374802 - DNA, 20 bp, Homo sapiens
aatttatttccactaaaaat

SEQ ID NO: 2374803 - DNA, 16 bp, Homo sapiens
aatttcaaaatacatt

SEQ ID NO: 2374804 - DNA, 19 bp, Homo sapiens
aatttcacctgtaaacctg

SEQ ID NO: 2374805 - DNA, 20 bp, Homo sapiens
aatttcacctgtaaacctga

SEQ ID NO: 2374806 - DNA, 13 bp, Homo sapiens
aatttcagtgtaa

SEQ ID NO: 2374807 - DNA, 20 bp, Homo sapiens
aatttcatagctgtacttct

SEQ ID NO: 2374808 - DNA, 18 bp, Homo sapiens
aatttcctctccactgct

SEQ ID NO: 2374809 - DNA, 21 bp, Homo sapiens
aatttcctctccactgctgga

SEQ ID NO: 2374810 - DNA, 18 bp, Homo sapiens
aatttcctttttgacact

SEQ ID NO: 2374811 - DNA, 21 bp, Homo sapiens
aatttcctttttgacactgaa

SEQ ID NO: 2374812 - DNA, 22 bp, Homo sapiens
aatttcctttttgacactgaaa

SEQ ID NO: 2374813 - DNA, 12 bp, Homo sapiens
aatttctcctcc

SEQ ID NO: 2374814 - DNA, 18 bp, Homo sapiens
aatttctctcagatttcc

SEQ ID NO: 2374815 - DNA, 16 bp, Homo sapiens
aatttcttatgtgaca

SEQ ID NO: 2374816 - DNA, 14 bp, Homo sapiens
aatttgaagtaatg

SEQ ID NO: 2374817 - DNA, 21 bp, Homo sapiens
aatttgagaatacataaacaa

SEQ ID NO: 2374818 - DNA, 20 bp, Homo sapiens
aatttgcactaaatcagaga

SEQ ID NO: 2374819 - DNA, 18 bp, Homo sapiens
aatttgtaagtttcaggt

SEQ ID NO: 2374820 - DNA, 16 bp, Homo sapiens
aatttgttttagccat

SEQ ID NO: 2374821 - DNA, 12 bp, Homo sapiens
aattttaaaaaa

SEQ ID NO: 2374822 - DNA, 13 bp, Homo sapiens
aattttaaagcca

SEQ ID NO: 2374823 - DNA, 14 bp, Homo sapiens
aattttaaagtatg

SEQ ID NO: 2374824 - DNA, 16 bp, Homo sapiens
aattttaaagtgcaaa

SEQ ID NO: 2374825 - DNA, 23 bp, Homo sapiens
aattttacaagggcataaagtaa

SEQ ID NO: 2374826 - DNA, 13 bp, Homo sapiens
aattttagaaata

SEQ ID NO: 2374827 - DNA, 17 bp, Homo sapiens
aattttagaaatattca

SEQ ID NO: 2374828 - DNA, 15 bp, Homo sapiens
aattttatatgtaag

SEQ ID NO: 2374829 - DNA, 22 bp, Homo sapiens
aattttattttaaaatttcata

SEQ ID NO: 2374830 - DNA, 18 bp, Homo sapiens
aattttcacttttggcaa

SEQ ID NO: 2374831 - DNA, 21 bp, Homo sapiens
aattttctaaaagctttcatg

SEQ ID NO: 2374832 - DNA, 13 bp, Homo sapiens
aattttctccttg

SEQ ID NO: 2374833 - DNA, 23 bp, Homo sapiens
aattttctccttggtttgctagt

SEQ ID NO: 2374834 - DNA, 19 bp, Homo sapiens
aattttggaataatttcta

SEQ ID NO: 2374835 - DNA, 12 bp, Homo sapiens
aattttgtaaga

SEQ ID NO: 2374836 - DNA, 18 bp, Homo sapiens
aattttttatcatgcatg

SEQ ID NO: 2374837 - DNA, 17 bp, Homo sapiens
aattttttattttaata

SEQ ID NO: 2374838 - DNA, 20 bp, Homo sapiens
aattttttggcacttgccat

SEQ ID NO: 2374839 - DNA, 21 bp, Homo sapiens
acaaaaaagacttgagacaat

SEQ ID NO: 2374840 - DNA, 11 bp, Homo sapiens
acaaaaaccaa

SEQ ID NO: 2374841 - DNA, 18 bp, Homo sapiens
acaaaattcaaagcatgg

SEQ ID NO: 2374842 - DNA, 12 bp, Homo sapiens
acaaaatttgag

SEQ ID NO: 2374843 - DNA, 14 bp, Homo sapiens
acaaaatttgagaa

SEQ ID NO: 2374844 - DNA, 18 bp, Homo sapiens
acaaacctaccaaaatgg

SEQ ID NO: 2374845 - DNA, 21 bp, Homo sapiens
acaaacttttaagatttctct

SEQ ID NO: 2374846 - DNA, 16 bp, Homo sapiens
acaaagctatttaagt

SEQ ID NO: 2374847 - DNA, 17 bp, Homo sapiens
acaaagcttctaaagca

SEQ ID NO: 2374848 - DNA, 15 bp, Homo sapiens
acaaagctttctttt

SEQ ID NO: 2374849 - DNA, 18 bp, Homo sapiens
acaaagtttcagagtata

SEQ ID NO: 2374850 - DNA, 20 bp, Homo sapiens
acaaagtttcagagtatatt

SEQ ID NO: 2374851 - DNA, 22 bp, Homo sapiens
acaaagtttcagagtatattgt

SEQ ID NO: 2374852 - DNA, 13 bp, Homo sapiens
acaaataaatatg

SEQ ID NO: 2374853 - DNA, 13 bp, Homo sapiens
acaaataatttag

SEQ ID NO: 2374854 - DNA, 21 bp, Homo sapiens
acaaatgaagaaagtcaaaaa

SEQ ID NO: 2374855 - DNA, 16 bp, Homo sapiens
acaaatgtggccaagc

SEQ ID NO: 2374856 - DNA, 15 bp, Homo sapiens
acaaatttttcaaat

SEQ ID NO: 2374857 - DNA, 19 bp, Homo sapiens
acaacaattggtaaaactc

SEQ ID NO: 2374858 - DNA, 16 bp, Homo sapiens
acaacaggtaaaacag

SEQ ID NO: 2374859 - DNA, 15 bp, Homo sapiens
acaacagtcacctca

SEQ ID NO: 2374860 - DNA, 16 bp, Homo sapiens
acaacctcaactgcct

SEQ ID NO: 2374861 - DNA, 14 bp, Homo sapiens
acaacgattatagt

SEQ ID NO: 2374862 - DNA, 19 bp, Homo sapiens
acaactttcacttcttcct

SEQ ID NO: 2374863 - DNA, 17 bp, Homo sapiens
acaagaataattttgga

SEQ ID NO: 2374864 - DNA, 21 bp, Homo sapiens
acaagccaaaagtccctccct

SEQ ID NO: 2374865 - DNA, 19 bp, Homo sapiens
acaagctgcactgtgaacc

SEQ ID NO: 2374866 - DNA, 15 bp, Homo sapiens
acaaggagatttctt

SEQ ID NO: 2374867 - DNA, 19 bp, Homo sapiens
acaaggtgctaacatagat

SEQ ID NO: 2374868 - DNA, 18 bp, Homo sapiens
acaataaaaacaactttc

SEQ ID NO: 2374869 - DNA, 21 bp, Homo sapiens
acaataaaaacaactttcact

SEQ ID NO: 2374870 - DNA, 16 bp, Homo sapiens
acaatagtatacattt

SEQ ID NO: 2374871 - DNA, 18 bp, Homo sapiens
acaatagtatacatttta

SEQ ID NO: 2374872 - DNA, 19 bp, Homo sapiens
acaatccacgcttctccgg

SEQ ID NO: 2374873 - DNA, 19 bp, Homo sapiens
acaatctctttttgtttgc

SEQ ID NO: 2374874 - DNA, 20 bp, Homo sapiens
acaatgagaaaaataaatgg

SEQ ID NO: 2374875 - DNA, 22 bp, Homo sapiens
acaatgcagttctgagcaccgt

SEQ ID NO: 2374876 - DNA, 15 bp, Homo sapiens
acaatggagtattct

SEQ ID NO: 2374877 - DNA, 14 bp, Homo sapiens
acaatgttaaggaa

SEQ ID NO: 2374878 - DNA, 22 bp, Homo sapiens
acaatgttaaggaaactcttat

SEQ ID NO: 2374879 - DNA, 12 bp, Homo sapiens
acaatgttttct

SEQ ID NO: 2374880 - DNA, 18 bp, Homo sapiens
acaattatgtgcaaaggt

SEQ ID NO: 2374881 - DNA, 22 bp, Homo sapiens
acaattatttgaagatttaatt

SEQ ID NO: 2374882 - DNA, 13 bp, Homo sapiens
acaattcagaggc

SEQ ID NO: 2374883 - DNA, 23 bp, Homo sapiens
acaattggtaaaactcactgtga

SEQ ID NO: 2374884 - DNA, 11 bp, Homo sapiens
acaatttcaac

SEQ ID NO: 2374885 - DNA, 13 bp, Homo sapiens
acacaaaggaagt

SEQ ID NO: 2374886 - DNA, 9 bp, Homo sapiens
acacacaca

SEQ ID NO: 2374887 - DNA, 14 bp, Homo sapiens
acacacacacgatg

SEQ ID NO: 2374888 - DNA, 16 bp, Homo sapiens
acacacacacgatgca

SEQ ID NO: 2374889 - DNA, 16 bp, Homo sapiens
acacacacgatgcatt

SEQ ID NO: 2374890 - DNA, 20 bp, Homo sapiens
acacacgagcaaacccagag

SEQ ID NO: 2374891 - DNA, 17 bp, Homo sapiens
acacagaaatgctgctg

SEQ ID NO: 2374892 - DNA, 18 bp, Homo sapiens
acacagaaatgctgctgg

SEQ ID NO: 2374893 - DNA, 20 bp, Homo sapiens
acacagtgtctgttcagcaa

SEQ ID NO: 2374894 - DNA, 15 bp, Homo sapiens
acacatcttaaaagt

SEQ ID NO: 2374895 - DNA, 17 bp, Homo sapiens
acgctaaagagcccttg

SEQ ID NO: 2374896 - DNA, 12 bp, Homo sapiens
acgctcgctgcc

SEQ ID NO: 2374897 - DNA, 16 bp, Homo sapiens
acgcttgtgacagtgc

SEQ ID NO: 2374898 - DNA, 18 bp, Homo sapiens
acgcttgtgacagtgcct

SEQ ID NO: 2374899 - DNA, 18 bp, Homo sapiens
acggaagccccctcttcc

SEQ ID NO: 2374900 - DNA, 18 bp, Homo sapiens
acggaggggagtagagaa

SEQ ID NO: 2374901 - DNA, 14 bp, Homo sapiens
acggatctgctggg

SEQ ID NO: 2374902 - DNA, 11 bp, Homo sapiens
acggcagctgt

SEQ ID NO: 2374903 - DNA, 13 bp, Homo sapiens
acggccaccactg

SEQ ID NO: 2374904 - DNA, 18 bp, Homo sapiens
acggtaagtgttctcatg

SEQ ID NO: 2374905 - DNA, 18 bp, Homo sapiens
acggtcctttaggcagcc

SEQ ID NO: 2374906 - DNA, 18 bp, Homo sapiens
acggtgcccatcctgcca

SEQ ID NO: 2374907 - DNA, 18 bp, Homo sapiens
acggtgctgtgagggagg

SEQ ID NO: 2374908 - DNA, 19 bp, Homo sapiens
acggtgctgtgagggaggg

SEQ ID NO: 2374909 - DNA, 13 bp, Homo sapiens
acggttcctggtg

SEQ ID NO: 2374910 - DNA, 15 bp, Homo sapiens
acgtcaggccctgac

SEQ ID NO: 2374911 - DNA, 23 bp, Homo sapiens
acgtcaggccctgactcctctgg

SEQ ID NO: 2374912 - DNA, 18 bp, Homo sapiens
acgtgctctgtgggtctc

SEQ ID NO: 2374913 - DNA, 16 bp, Homo sapiens
acgtttataaacagaa

SEQ ID NO: 2374914 - DNA, 18 bp, Homo sapiens
acgtttcttctttctaga

SEQ ID NO: 2374915 - DNA, 12 bp, Homo sapiens
acgtttctttaa

SEQ ID NO: 2374916 - DNA, 21 bp, Homo sapiens
acgtttctttaaccttgtata

SEQ ID NO: 2374917 - DNA, 15 bp, Homo sapiens
acgtttgatacaaca

SEQ ID NO: 2374918 - DNA, 22 bp, Homo sapiens
acgttttcttctttccctggac

SEQ ID NO: 2374919 - DNA, 13 bp, Homo sapiens
acgtttttccttt

SEQ ID NO: 2374920 - DNA, 19 bp, Homo sapiens
actaaaaaaccaacaatgt

SEQ ID NO: 2374921 - DNA, 21 bp, Homo sapiens
actaaaaagtataaaatagta

SEQ ID NO: 2374922 - DNA, 15 bp, Homo sapiens
actaaaaatattgtt

SEQ ID NO: 2374923 - DNA, 20 bp, Homo sapiens
actaaactacattgttctta

SEQ ID NO: 2374924 - DNA, 23 bp, Homo sapiens
actaaaggaaaaaactttgactt

SEQ ID NO: 2374925 - DNA, 12 bp, Homo sapiens
actaaatatgca

SEQ ID NO: 2374926 - DNA, 19 bp, Homo sapiens
actaaatcagagacaaaat

SEQ ID NO: 2374927 - DNA, 16 bp, Homo sapiens
actaacagataagcaa

SEQ ID NO: 2374928 - DNA, 15 bp, Homo sapiens
actaagccaggcctg

SEQ ID NO: 2374929 - DNA, 16 bp, Homo sapiens
actaagccaggcctgg

SEQ ID NO: 2374930 - DNA, 13 bp, Homo sapiens
actaataaaccag

SEQ ID NO: 2374931 - DNA, 14 bp, Homo sapiens
actaatatatgaaa

SEQ ID NO: 2374932 - DNA, 17 bp, Homo sapiens
actaatatatgaaataa

SEQ ID NO: 2374933 - DNA, 21 bp, Homo sapiens
actaatatatgaaataagtaa

SEQ ID NO: 2374934 - DNA, 23 bp, Homo sapiens
actaatgctttttagaaagcatt

SEQ ID NO: 2374935 - DNA, 14 bp, Homo sapiens
actacacctggctg

SEQ ID NO: 2374936 - DNA, 14 bp, Homo sapiens
actacatctgatat

SEQ ID NO: 2374937 - DNA, 16 bp, Homo sapiens
actacatctgatatca

SEQ ID NO: 2374938 - DNA, 16 bp, Homo sapiens
actaccaaacactcag

SEQ ID NO: 2374939 - DNA, 15 bp, Homo sapiens
actacccatagacat

SEQ ID NO: 2374940 - DNA, 21 bp, Homo sapiens
actaccttccactctggaacc

SEQ ID NO: 2374941 - DNA, 14 bp, Homo sapiens
actactagattgac

SEQ ID NO: 2374942 - DNA, 14 bp, Homo sapiens
actactctctgttt

SEQ ID NO: 2374943 - DNA, 21 bp, Homo sapiens
actactgaataatgctaccag

SEQ ID NO: 2374944 - DNA, 21 bp, Homo sapiens
actagaaggcttctctccaca

SEQ ID NO: 2374945 - DNA, 23 bp, Homo sapiens
actagcaatctcttcattattct

SEQ ID NO: 2374946 - DNA, 15 bp, Homo sapiens
actagcccaatgaaa

SEQ ID NO: 2374947 - DNA, 23 bp, Homo sapiens
actaggctgagcaatctgaccct

SEQ ID NO: 2374948 - DNA, 22 bp, Homo sapiens
actataaatgaaattgatttgt

SEQ ID NO: 2374949 - DNA, 14 bp, Homo sapiens
actataagatacaa

SEQ ID NO: 2374950 - DNA, 18 bp, Homo sapiens
actataagatacaataaa

SEQ ID NO: 2374951 - DNA, 19 bp, Homo sapiens
actatattagtatgtatgt

SEQ ID NO: 2374952 - DNA, 23 bp, Homo sapiens
actatatttttctcaatgtttag

SEQ ID NO: 2374953 - DNA, 13 bp, Homo sapiens
actatgttcctaa

SEQ ID NO: 2374954 - DNA, 17 bp, Homo sapiens
actatgttcctaacaaa

SEQ ID NO: 2374955 - DNA, 14 bp, Homo sapiens
actattcatggcta

SEQ ID NO: 2374956 - DNA, 16 bp, Homo sapiens
actatttttttcaaag

SEQ ID NO: 2374957 - DNA, 19 bp, Homo sapiens
actcaaatacacatttgct

SEQ ID NO: 2374958 - DNA, 23 bp, Homo sapiens
actcaaattttggcgaatctcaa

SEQ ID NO: 2374959 - DNA, 19 bp, Homo sapiens
actcaacccattgttgtca

SEQ ID NO: 2374960 - DNA, 14 bp, Homo sapiens
actcaccagcccca

SEQ ID NO: 2374961 - DNA, 23 bp, Homo sapiens
actcaccagccccactgccagca

SEQ ID NO: 2374962 - DNA, 20 bp, Homo sapiens
actcacctaatgtttatgag

SEQ ID NO: 2374963 - DNA, 19 bp, Homo sapiens
actcactaagtttacttct

SEQ ID NO: 2374964 - DNA, 18 bp, Homo sapiens
actcactgtgatcaatat

SEQ ID NO: 2374965 - DNA, 14 bp, Homo sapiens
actcacttttccca

SEQ ID NO: 2374966 - DNA, 17 bp, Homo sapiens
actcacttttcccactc

SEQ ID NO: 2374967 - DNA, 15 bp, Homo sapiens
actcagacattccaa

SEQ ID NO: 2374968 - DNA, 19 bp, Homo sapiens
actcagtccactgttgagc

SEQ ID NO: 2374969 - DNA, 14 bp, Homo sapiens
actcatcctctttt

SEQ ID NO: 2374970 - DNA, 19 bp, Homo sapiens
actcattctgaattaatta

SEQ ID NO: 2374971 - DNA, 20 bp, Homo sapiens
actccagcaacttcttctcc

SEQ ID NO: 2374972 - DNA, 18 bp, Homo sapiens
actccaggaaagagcagt

SEQ ID NO: 2374973 - DNA, 22 bp, Homo sapiens
actccaggaaagagcagtcaga

SEQ ID NO: 2374974 - DNA, 18 bp, Homo sapiens
actccagttttctcctct

SEQ ID NO: 2374975 - DNA, 12 bp, Homo sapiens
actccctctgca

SEQ ID NO: 2374976 - DNA, 22 bp, Homo sapiens
actccctctgcagaatcccttt

SEQ ID NO: 2374977 - DNA, 17 bp, Homo sapiens
actcccttgctggcccc

SEQ ID NO: 2374978 - DNA, 18 bp, Homo sapiens
actcccttgctggcccca

SEQ ID NO: 2374979 - DNA, 22 bp, Homo sapiens
actcccttgctggccccagccc

SEQ ID NO: 2374980 - DNA, 15 bp, Homo sapiens
actccgcatcacctc

SEQ ID NO: 2374981 - DNA, 17 bp, Homo sapiens
actccgcatcacctcac

SEQ ID NO: 2374982 - DNA, 18 bp, Homo sapiens
actccgcgccgatgccac

SEQ ID NO: 2374983 - DNA, 16 bp, Homo sapiens
actcctagctgtcctt

SEQ ID NO: 2374984 - DNA, 23 bp, Homo sapiens
actcctagctgtcctttttcctc

SEQ ID NO: 2374985 - DNA, 16 bp, Homo sapiens
actcctatgatctgag

SEQ ID NO: 2374986 - DNA, 21 bp, Homo sapiens
actcctgacccctctcctcaa

SEQ ID NO: 2374987 - DNA, 15 bp, Homo sapiens
actcctgggctcaag

SEQ ID NO: 2374988 - DNA, 20 bp, Homo sapiens
actccttaaaaatgtatgtt

SEQ ID NO: 2374989 - DNA, 22 bp, Homo sapiens
actccttatttggcgtgacccg

SEQ ID NO: 2374990 - DNA, 16 bp, Homo sapiens
actccttgcttcctga

SEQ ID NO: 2374991 - DNA, 19 bp, Homo sapiens
actcctttgctaatgctat

SEQ ID NO: 2374992 - DNA, 20 bp, Homo sapiens
actcgggtttctctgtggct

SEQ ID NO: 2374993 - DNA, 17 bp, Homo sapiens
actcgtcaccccagccc

SEQ ID NO: 2374994 - DNA, 14 bp, Homo sapiens
actctaatagtgct

SEQ ID NO: 2374995 - DNA, 18 bp, Homo sapiens
actctagtgacttcctgg

SEQ ID NO: 2374996 - DNA, 12 bp, Homo sapiens
actctcaccatg

SEQ ID NO: 2374997 - DNA, 14 bp, Homo sapiens
actctctaccagat

SEQ ID NO: 2374998 - DNA, 23 bp, Homo sapiens
actctctgttttagtgtttatgt

SEQ ID NO: 2374999 - DNA, 17 bp, Homo sapiens
actctctttccttgagc

SEQ ID NO: 2375000 - DNA, 15 bp, Homo sapiens
actctgaagctaatt

SEQ ID NO: 2375001 - DNA, 23 bp, Homo sapiens
actctgatggttcttcacctcct

SEQ ID NO: 2375002 - DNA, 11 bp, Homo sapiens
actctgcacat

SEQ ID NO: 2375003 - DNA, 22 bp, Homo sapiens
actctgcacatgtcttgtacat

SEQ ID NO: 2375004 - DNA, 20 bp, Homo sapiens
actctgcatgtagaggcttg

SEQ ID NO: 2375005 - DNA, 21 bp, Homo sapiens
actctgcctttatgatgctaa

SEQ ID NO: 2375006 - DNA, 15 bp, Homo sapiens
actctgcttgatttt

SEQ ID NO: 2375007 - DNA, 22 bp, Homo sapiens
actctggaaccttattccagca

SEQ ID NO: 2375008 - DNA, 17 bp, Homo sapiens
actctggcttttggaag

SEQ ID NO: 2375009 - DNA, 14 bp, Homo sapiens
agaagatagttgta

SEQ ID NO: 2375010 - DNA, 16 bp, Homo sapiens
agaagatagttgtaaa

SEQ ID NO: 2375011 - DNA, 18 bp, Homo sapiens
agaagatagttgtaaaga

SEQ ID NO: 2375012 - DNA, 15 bp, Homo sapiens
agaagcaccagcaat

SEQ ID NO: 2375013 - DNA, 16 bp, Homo sapiens
agaagcatgaaaaagc

SEQ ID NO: 2375014 - DNA, 13 bp, Homo sapiens
agaagcattcctt

SEQ ID NO: 2375015 - DNA, 14 bp, Homo sapiens
agaagcattccttc

SEQ ID NO: 2375016 - DNA, 20 bp, Homo sapiens
agaagcattccttctttgat

SEQ ID NO: 2375017 - DNA, 22 bp, Homo sapiens
agaagccaatctacaatctctt

SEQ ID NO: 2375018 - DNA, 13 bp, Homo sapiens
agaagccttcagc

SEQ ID NO: 2375019 - DNA, 17 bp, Homo sapiens
agaagccttcagctcca

SEQ ID NO: 2375020 - DNA, 20 bp, Homo sapiens
agaagctcttactctttcct

SEQ ID NO: 2375021 - DNA, 16 bp, Homo sapiens
agaagctgttgtacat

SEQ ID NO: 2375022 - DNA, 20 bp, Homo sapiens
agaagctgttgtacatttat

SEQ ID NO: 2375023 - DNA, 21 bp, Homo sapiens
agaagctgttgtacatttatg

SEQ ID NO: 2375024 - DNA, 15 bp, Homo sapiens
agaaggaaagatggt

SEQ ID NO: 2375025 - DNA, 19 bp, Homo sapiens
agaaggaaagatggttaaa

SEQ ID NO: 2375026 - DNA, 13 bp, Homo sapiens
agaaggatgatgt

SEQ ID NO: 2375027 - DNA, 22 bp, Homo sapiens
agaaggcttctctccacagtgt

SEQ ID NO: 2375028 - DNA, 14 bp, Homo sapiens
agaagggagaagaa

SEQ ID NO: 2375029 - DNA, 15 bp, Homo sapiens
agaagggagaagaaa

SEQ ID NO: 2375030 - DNA, 15 bp, Homo sapiens
agaaggtgcttagct

SEQ ID NO: 2375031 - DNA, 21 bp, Homo sapiens
agaagtaagaggctacctctt

SEQ ID NO: 2375032 - DNA, 22 bp, Homo sapiens
agaagtaggaggaaacagttct

SEQ ID NO: 2375033 - DNA, 14 bp, Homo sapiens
agaagtcttgaagt

SEQ ID NO: 2375034 - DNA, 14 bp, Homo sapiens
agaagtgagcaaaa

SEQ ID NO: 2375035 - DNA, 18 bp, Homo sapiens
agaagtgagcaaaaaaga

SEQ ID NO: 2375036 - DNA, 17 bp, Homo sapiens
agaagtgcccttcctgc

SEQ ID NO: 2375037 - DNA, 20 bp, Homo sapiens
agaagtgggggcagcccagg

SEQ ID NO: 2375038 - DNA, 15 bp, Homo sapiens
agaatacataaacaa

SEQ ID NO: 2375039 - DNA, 18 bp, Homo sapiens
agaataccacatcaaata

SEQ ID NO: 2375040 - DNA, 17 bp, Homo sapiens
agaatatttctattgaa

SEQ ID NO: 2375041 - DNA, 22 bp, Homo sapiens
agaatatttttatatttccttt

SEQ ID NO: 2375042 - DNA, 16 bp, Homo sapiens
agaatgaaagctgttc

SEQ ID NO: 2375043 - DNA, 16 bp, Homo sapiens
agaatgtatttgctga

SEQ ID NO: 2375044 - DNA, 15 bp, Homo sapiens
agaatgttagagtaa

SEQ ID NO: 2375045 - DNA, 17 bp, Homo sapiens
agaatgttagtaaagga

SEQ ID NO: 2375046 - DNA, 15 bp, Homo sapiens
agaattctgattgat

SEQ ID NO: 2375047 - DNA, 19 bp, Homo sapiens
agaattgaaaagtttttgt

SEQ ID NO: 2375048 - DNA, 20 bp, Homo sapiens
agaatttgagaaccttggac

SEQ ID NO: 2375049 - DNA, 18 bp, Homo sapiens
agaattttgagtattcca

SEQ ID NO: 2375050 - DNA, 22 bp, Homo sapiens
agaattttgagtattccatgag

SEQ ID NO: 2375051 - DNA, 12 bp, Homo sapiens
agacaaaaagta

SEQ ID NO: 2375052 - DNA, 23 bp, Homo sapiens
agacaaaaagtatattaaacaaa

SEQ ID NO: 2375053 - DNA, 22 bp, Homo sapiens
agacaaaagtctgtctttcctg

SEQ ID NO: 2375054 - DNA, 15 bp, Homo sapiens
agacaaaatttgaga

SEQ ID NO: 2375055 - DNA, 15 bp, Homo sapiens
agacaacctttctgt

SEQ ID NO: 2375056 - DNA, 15 bp, Homo sapiens
agacaagagatggga

SEQ ID NO: 2375057 - DNA, 12 bp, Homo sapiens
agacaaggtgct

SEQ ID NO: 2375058 - DNA, 14 bp, Homo sapiens
agacaaggtgctaa

SEQ ID NO: 2375059 - DNA, 15 bp, Homo sapiens
agacaagtaatttca

SEQ ID NO: 2375060 - DNA, 14 bp, Homo sapiens
agacaatgttttct

SEQ ID NO: 2375061 - DNA, 18 bp, Homo sapiens
agacactgatctggctgc

SEQ ID NO: 2375062 - DNA, 14 bp, Homo sapiens
agacagagacaagt

SEQ ID NO: 2375063 - DNA, 18 bp, Homo sapiens
agacagaggaaagggctg

SEQ ID NO: 2375064 - DNA, 17 bp, Homo sapiens
agacagcccaggatact

SEQ ID NO: 2375065 - DNA, 23 bp, Homo sapiens
agacagcccaggatactggcaca

SEQ ID NO: 2375066 - DNA, 18 bp, Homo sapiens
agacagggtcttgctctg

SEQ ID NO: 2375067 - DNA, 15 bp, Homo sapiens
agacagtttcttagc

SEQ ID NO: 2375068 - DNA, 14 bp, Homo sapiens
agacataaaggaaa

SEQ ID NO: 2375069 - DNA, 23 bp, Homo sapiens
agacataaaggaaaagacacatt

SEQ ID NO: 2375070 - DNA, 14 bp, Homo sapiens
agacataacgtttt

SEQ ID NO: 2375071 - DNA, 14 bp, Homo sapiens
agacatataccaaa

SEQ ID NO: 2375072 - DNA, 18 bp, Homo sapiens
agacatgtctgttctaca

SEQ ID NO: 2375073 - DNA, 15 bp, Homo sapiens
agacattctcacata

SEQ ID NO: 2375074 - DNA, 19 bp, Homo sapiens
agacattttaaaaaatggt

SEQ ID NO: 2375075 - DNA, 11 bp, Homo sapiens
agaccaataaa

SEQ ID NO: 2375076 - DNA, 17 bp, Homo sapiens
agaccagtactgggaag

SEQ ID NO: 2375077 - DNA, 19 bp, Homo sapiens
agaccctactgaagtggct

SEQ ID NO: 2375078 - DNA, 22 bp, Homo sapiens
agaccctactgaagtggctggt

SEQ ID NO: 2375079 - DNA, 18 bp, Homo sapiens
agaccctcttgcccatcc

SEQ ID NO: 2375080 - DNA, 18 bp, Homo sapiens
agaccctgaggccctggg

SEQ ID NO: 2375081 - DNA, 20 bp, Homo sapiens
agaccctgaggccctgggct

SEQ ID NO: 2375082 - DNA, 15 bp, Homo sapiens
agaccctgccacagc

SEQ ID NO: 2375083 - DNA, 22 bp, Homo sapiens
agaccctgccacagccagagga

SEQ ID NO: 2375084 - DNA, 24 bp, Homo sapiens
agaccctgccacagccagaggagg

SEQ ID NO: 2375085 - DNA, 14 bp, Homo sapiens
agaccgagaggcca

SEQ ID NO: 2375086 - DNA, 18 bp, Homo sapiens
agacctcagtgccttcct

SEQ ID NO: 2375087 - DNA, 20 bp, Homo sapiens
agacctcagtgccttcctgt

SEQ ID NO: 2375088 - DNA, 23 bp, Homo sapiens
agacctcatgcccagctctctga

SEQ ID NO: 2375089 - DNA, 14 bp, Homo sapiens
agacctgagtattt

SEQ ID NO: 2375090 - DNA, 15 bp, Homo sapiens
agacctgagtatttt

SEQ ID NO: 2375091 - DNA, 19 bp, Homo sapiens
agactaaaggatccagaga

SEQ ID NO: 2375092 - DNA, 20 bp, Homo sapiens
agactaaaggatccagagag

SEQ ID NO: 2375093 - DNA, 17 bp, Homo sapiens
agactagcaatctcttc

SEQ ID NO: 2375094 - DNA, 23 bp, Homo sapiens
agactagcaatctcttcattatt

SEQ ID NO: 2375095 - DNA, 19 bp, Homo sapiens
agactatatatataaatgt

SEQ ID NO: 2375096 - DNA, 14 bp, Homo sapiens
agactcaaaaaaac

SEQ ID NO: 2375097 - DNA, 14 bp, Homo sapiens
agactcaaattttg

SEQ ID NO: 2375098 - DNA, 22 bp, Homo sapiens
agactcctagctgtcctttttc

SEQ ID NO: 2375099 - DNA, 15 bp, Homo sapiens
agactctagtattta

SEQ ID NO: 2375100 - DNA, 20 bp, Homo sapiens
agactgaactgcagggttca

SEQ ID NO: 2375101 - DNA, 23 bp, Homo sapiens
agactgccccacggagacagagg

SEQ ID NO: 2375102 - DNA, 17 bp, Homo sapiens
agactgggccccacatg

SEQ ID NO: 2375103 - DNA, 19 bp, Homo sapiens
agactgtgcaatacttaga

SEQ ID NO: 2375104 - DNA, 19 bp, Homo sapiens
agactgtgctgttgttctc

SEQ ID NO: 2375105 - DNA, 14 bp, Homo sapiens
agactgtttgaatg

SEQ ID NO: 2375106 - DNA, 19 bp, Homo sapiens
agacttctcggaattcata

SEQ ID NO: 2375107 - DNA, 21 bp, Homo sapiens
agacttgtatagcatgaaata

SEQ ID NO: 2375108 - DNA, 16 bp, Homo sapiens
agagaaacttcaaagt

SEQ ID NO: 2375109 - DNA, 14 bp, Homo sapiens
agagaaatatgaag

SEQ ID NO: 2375110 - DNA, 15 bp, Homo sapiens
agagaatgttcctac

SEQ ID NO: 2375111 - DNA, 14 bp, Homo sapiens
agagacaagtaatt

SEQ ID NO: 2375112 - DNA, 15 bp, Homo sapiens
agagacagcccagga

SEQ ID NO: 2375113 - DNA, 18 bp, Homo sapiens
agagacagcccaggatac

SEQ ID NO: 2375114 - DNA, 15 bp, Homo sapiens
agagactgcgttctg

SEQ ID NO: 2375115 - DNA, 17 bp, Homo sapiens
agagactgcgttctgca

SEQ ID NO: 2375116 - DNA, 22 bp, Homo sapiens
agagactgcgttctgcaagcat

SEQ ID NO: 2375117 - DNA, 20 bp, Homo sapiens
agagagcagctccctttctc

SEQ ID NO: 2375118 - DNA, 23 bp, Homo sapiens
agagagcagctccctttctcagg

SEQ ID NO: 2375119 - DNA, 15 bp, Homo sapiens
agagagccattttgt

SEQ ID NO: 2375120 - DNA, 17 bp, Homo sapiens
agagagccattttgtga

SEQ ID NO: 2375121 - DNA, 18 bp, Homo sapiens
agagagccattttgtgaa

SEQ ID NO: 2375122 - DNA, 13 bp, Homo sapiens
agagaggacagct

SEQ ID NO: 2375123 - DNA, 17 bp, Homo sapiens
agagaggcacctgctgg

SEQ ID NO: 2375124 - DNA, 18 bp, Homo sapiens
agctggtcagtctttgct

SEQ ID NO: 2375125 - DNA, 21 bp, Homo sapiens
agctggtcagtctttgctcag

SEQ ID NO: 2375126 - DNA, 23 bp, Homo sapiens
agctggtcagtctttgctcagtg

SEQ ID NO: 2375127 - DNA, 16 bp, Homo sapiens
agctgtaaaaatgtta

SEQ ID NO: 2375128 - DNA, 16 bp, Homo sapiens
agctgtagctcccgag

SEQ ID NO: 2375129 - DNA, 16 bp, Homo sapiens
agctgtcctttttcct

SEQ ID NO: 2375130 - DNA, 14 bp, Homo sapiens
agctgtgtctgcca

SEQ ID NO: 2375131 - DNA, 21 bp, Homo sapiens
agctgtgtctgccaaacacat

SEQ ID NO: 2375132 - DNA, 16 bp, Homo sapiens
agctgttaccattcac

SEQ ID NO: 2375133 - DNA, 15 bp, Homo sapiens
agctgttgtacattt

SEQ ID NO: 2375134 - DNA, 18 bp, Homo sapiens
agctgttgtacatttatg

SEQ ID NO: 2375135 - DNA, 20 bp, Homo sapiens
agctgttgtacatttatgat

SEQ ID NO: 2375136 - DNA, 13 bp, Homo sapiens
agctgtttggaaa

SEQ ID NO: 2375137 - DNA, 16 bp, Homo sapiens
agctgtttggaaaaga

SEQ ID NO: 2375138 - DNA, 15 bp, Homo sapiens
agcttcaacttttct

SEQ ID NO: 2375139 - DNA, 11 bp, Homo sapiens
agcttcaggtt

SEQ ID NO: 2375140 - DNA, 22 bp, Homo sapiens
agcttcagtaagttatctttga

SEQ ID NO: 2375141 - DNA, 14 bp, Homo sapiens
agcttccaaagcct

SEQ ID NO: 2375142 - DNA, 19 bp, Homo sapiens
agcttccaaagcctagaca

SEQ ID NO: 2375143 - DNA, 20 bp, Homo sapiens
agcttcgtttattttcaaga

SEQ ID NO: 2375144 - DNA, 12 bp, Homo sapiens
agcttctgcttt

SEQ ID NO: 2375145 - DNA, 17 bp, Homo sapiens
agcttctgcttttctgc

SEQ ID NO: 2375146 - DNA, 20 bp, Homo sapiens
agcttctgcttttctgccct

SEQ ID NO: 2375147 - DNA, 23 bp, Homo sapiens
agcttgagccgggcccctgggct

SEQ ID NO: 2375148 - DNA, 12 bp, Homo sapiens
agcttgggcagt

SEQ ID NO: 2375149 - DNA, 19 bp, Homo sapiens
agcttgggcagtgccccag

SEQ ID NO: 2375150 - DNA, 20 bp, Homo sapiens
agcttggggccaccaaagct

SEQ ID NO: 2375151 - DNA, 21 bp, Homo sapiens
agcttggggccaccaaagctg

SEQ ID NO: 2375152 - DNA, 22 bp, Homo sapiens
agcttggggccaccaaagctgc

SEQ ID NO: 2375153 - DNA, 13 bp, Homo sapiens
agctttagaccct

SEQ ID NO: 2375154 - DNA, 17 bp, Homo sapiens
agctttagaccctgggt

SEQ ID NO: 2375155 - DNA, 19 bp, Homo sapiens
agctttgagaagccttcag

SEQ ID NO: 2375156 - DNA, 18 bp, Homo sapiens
agctttggacctaatcca

SEQ ID NO: 2375157 - DNA, 22 bp, Homo sapiens
agctttggctgagacctgggat

SEQ ID NO: 2375158 - DNA, 14 bp, Homo sapiens
agctttttaattgt

SEQ ID NO: 2375159 - DNA, 18 bp, Homo sapiens
agcttttttattttaata

SEQ ID NO: 2375160 - DNA, 17 bp, Homo sapiens
aggaaaaacacaagcaa

SEQ ID NO: 2375161 - DNA, 19 bp, Homo sapiens
aggaaaaacacaagcaaaa

SEQ ID NO: 2375162 - DNA, 17 bp, Homo sapiens
aggaaaaggttgaataa

SEQ ID NO: 2375163 - DNA, 23 bp, Homo sapiens
aggaaaatgtctgtaataataga

SEQ ID NO: 2375164 - DNA, 12 bp, Homo sapiens
aggaaaattcca

SEQ ID NO: 2375165 - DNA, 16 bp, Homo sapiens
aggaaaattcttaaaa

SEQ ID NO: 2375166 - DNA, 19 bp, Homo sapiens
aggaaacagttctcactgg

SEQ ID NO: 2375167 - DNA, 17 bp, Homo sapiens
aggaaactcttatctca

SEQ ID NO: 2375168 - DNA, 22 bp, Homo sapiens
aggaaactcttatctcagtcat

SEQ ID NO: 2375169 - DNA, 13 bp, Homo sapiens
aggaaagggctgg

SEQ ID NO: 2375170 - DNA, 21 bp, Homo sapiens
aggaaataagagcagtcacaa

SEQ ID NO: 2375171 - DNA, 17 bp, Homo sapiens
aggaacacgattttcaa

SEQ ID NO: 2375172 - DNA, 20 bp, Homo sapiens
aggaaccgtggtatgtctgc

SEQ ID NO: 2375173 - DNA, 23 bp, Homo sapiens
aggaaccgtggtatgtctgccat

SEQ ID NO: 2375174 - DNA, 20 bp, Homo sapiens
aggaagaagaaatctttctc

SEQ ID NO: 2375175 - DNA, 13 bp, Homo sapiens
aggaagagccacc

SEQ ID NO: 2375176 - DNA, 14 bp, Homo sapiens
aggaagagccacct

SEQ ID NO: 2375177 - DNA, 16 bp, Homo sapiens
aggaagagccacctgc

SEQ ID NO: 2375178 - DNA, 21 bp, Homo sapiens
aggaagagccacctgcaagat

SEQ ID NO: 2375179 - DNA, 20 bp, Homo sapiens
aggaaggaggggagagacag

SEQ ID NO: 2375180 - DNA, 19 bp, Homo sapiens
aggaaggccaaaatcaaga

SEQ ID NO: 2375181 - DNA, 21 bp, Homo sapiens
aggaaggccaaaatcaagagt

SEQ ID NO: 2375182 - DNA, 17 bp, Homo sapiens
aggaaggcctttcttct

SEQ ID NO: 2375183 - DNA, 18 bp, Homo sapiens
aggaaggcctttcttctg

SEQ ID NO: 2375184 - DNA, 20 bp, Homo sapiens
aggaaggcctttcttctgtg

SEQ ID NO: 2375185 - DNA, 21 bp, Homo sapiens
aggaaggcctttcttctgtgt

SEQ ID NO: 2375186 - DNA, 14 bp, Homo sapiens
aggaagggaagcgt

SEQ ID NO: 2375187 - DNA, 15 bp, Homo sapiens
aggaatcctggcagc

SEQ ID NO: 2375188 - DNA, 19 bp, Homo sapiens
aggaatcctggcagcccag

SEQ ID NO: 2375189 - DNA, 20 bp, Homo sapiens
aggaatcctggcagcccaga

SEQ ID NO: 2375190 - DNA, 15 bp, Homo sapiens
aggaatctcttcact

SEQ ID NO: 2375191 - DNA, 23 bp, Homo sapiens
aggaatctcttcactaccctgat

SEQ ID NO: 2375192 - DNA, 16 bp, Homo sapiens
aggacaatactggggt

SEQ ID NO: 2375193 - DNA, 21 bp, Homo sapiens
aggacacagttcctgggaaca

SEQ ID NO: 2375194 - DNA, 20 bp, Homo sapiens
aggaccagattgctctgccc

SEQ ID NO: 2375195 - DNA, 22 bp, Homo sapiens
aggacccccgaggggagggcag

SEQ ID NO: 2375196 - DNA, 23 bp, Homo sapiens
aggacccccgaggggagggcagg

SEQ ID NO: 2375197 - DNA, 21 bp, Homo sapiens
aggacctatcccaaatgtgga

SEQ ID NO: 2375198 - DNA, 16 bp, Homo sapiens
aggacctgagacctga

SEQ ID NO: 2375199 - DNA, 18 bp, Homo sapiens
aggacgcacgctcgctgc

SEQ ID NO: 2375200 - DNA, 22 bp, Homo sapiens
aggacgcctgcaggagagagca

SEQ ID NO: 2375201 - DNA, 20 bp, Homo sapiens
aggacggttgtaagcagttg

SEQ ID NO: 2375202 - DNA, 22 bp, Homo sapiens
aggacgtggatgaccctcccct

SEQ ID NO: 2375203 - DNA, 20 bp, Homo sapiens
aggactgagcaccctctgga

SEQ ID NO: 2375204 - DNA, 16 bp, Homo sapiens
aggactggtgaatata

SEQ ID NO: 2375205 - DNA, 22 bp, Homo sapiens
aggactggtgaatataaatgat

SEQ ID NO: 2375206 - DNA, 23 bp, Homo sapiens
aggacttggtgattacctgaaag

SEQ ID NO: 2375207 - DNA, 20 bp, Homo sapiens
aggagaatggtgtgaacccg

SEQ ID NO: 2375208 - DNA, 13 bp, Homo sapiens
aggagacaaaaga

SEQ ID NO: 2375209 - DNA, 19 bp, Homo sapiens
aggagaggatgagagccca

SEQ ID NO: 2375210 - DNA, 21 bp, Homo sapiens
aggagaggatgagagcccaga

SEQ ID NO: 2375211 - DNA, 23 bp, Homo sapiens
aggagaggatgagagcccagagg

SEQ ID NO: 2375212 - DNA, 23 bp, Homo sapiens
aggagatcgagaccatcctggct

SEQ ID NO: 2375213 - DNA, 13 bp, Homo sapiens
aggagatgctttc

SEQ ID NO: 2375214 - DNA, 12 bp, Homo sapiens
aggagatttctt

SEQ ID NO: 2375215 - DNA, 15 bp, Homo sapiens
aggagatttcttagt

SEQ ID NO: 2375216 - DNA, 16 bp, Homo sapiens
aggagcaggcacgggt

SEQ ID NO: 2375217 - DNA, 22 bp, Homo sapiens
aggagcccccaccctgttcctg

SEQ ID NO: 2375218 - DNA, 19 bp, Homo sapiens
aggagcttcttgtttcctt

SEQ ID NO: 2375219 - DNA, 20 bp, Homo sapiens
aggagcttcttgtttccttg

SEQ ID NO: 2375220 - DNA, 15 bp, Homo sapiens
aggagctttctcaat

SEQ ID NO: 2375221 - DNA, 16 bp, Homo sapiens
aggagctttctcaatg

SEQ ID NO: 2375222 - DNA, 14 bp, Homo sapiens
aggaggaaaattcc

SEQ ID NO: 2375223 - DNA, 13 bp, Homo sapiens
aggaggaaacagt

SEQ ID NO: 2375224 - DNA, 19 bp, Homo sapiens
aggaggccctgttccctgg

SEQ ID NO: 2375225 - DNA, 13 bp, Homo sapiens
aggagggagaggg

SEQ ID NO: 2375226 - DNA, 22 bp, Homo sapiens
aggagggcagagggagaatcca

SEQ ID NO: 2375227 - DNA, 19 bp, Homo sapiens
aggaggggagcgtctggga

SEQ ID NO: 2375228 - DNA, 14 bp, Homo sapiens
aggaggggagggta

SEQ ID NO: 2375229 - DNA, 14 bp, Homo sapiens
aggaggtggagaaa

SEQ ID NO: 2375230 - DNA, 20 bp, Homo sapiens
aggaggtggagaaaattgga

SEQ ID NO: 2375231 - DNA, 21 bp, Homo sapiens
aggagtaaaattcagtttttt

SEQ ID NO: 2375232 - DNA, 17 bp, Homo sapiens
aggagtgcagccttctc

SEQ ID NO: 2375233 - DNA, 17 bp, Homo sapiens
aggagtggtgatttgaa

SEQ ID NO: 2375234 - DNA, 23 bp, Homo sapiens
aggatagaagtatacctgatttt

SEQ ID NO: 2375235 - DNA, 20 bp, Homo sapiens
aggatagtagttaaataact

SEQ ID NO: 2375236 - DNA, 19 bp, Homo sapiens
aggatattcagatgtatgt

SEQ ID NO: 2375237 - DNA, 20 bp, Homo sapiens
aggttcctctgcctgccccg

SEQ ID NO: 2375238 - DNA, 15 bp, Homo sapiens
aggttcttcagaagt

SEQ ID NO: 2375239 - DNA, 15 bp, Homo sapiens
aggttgaagccaagt

SEQ ID NO: 2375240 - DNA, 16 bp, Homo sapiens
aggttgcagtgagctg

SEQ ID NO: 2375241 - DNA, 16 bp, Homo sapiens
aggttggagcccaggg

SEQ ID NO: 2375242 - DNA, 17 bp, Homo sapiens
aggttttaatgtctgtt

SEQ ID NO: 2375243 - DNA, 14 bp, Homo sapiens
agtaaaaacctgct

SEQ ID NO: 2375244 - DNA, 19 bp, Homo sapiens
agtaaaagtggtctctgct

SEQ ID NO: 2375245 - DNA, 20 bp, Homo sapiens
agtaaaatactattgcctca

SEQ ID NO: 2375246 - DNA, 18 bp, Homo sapiens
agtaaaattcagtttttt

SEQ ID NO: 2375247 - DNA, 14 bp, Homo sapiens
agtaaacgggaaca

SEQ ID NO: 2375248 - DNA, 16 bp, Homo sapiens
agtaaacgggaacatg

SEQ ID NO: 2375249 - DNA, 16 bp, Homo sapiens
agtaaagaaagcagaa

SEQ ID NO: 2375250 - DNA, 22 bp, Homo sapiens
agtaaaggaaataagagcagtc

SEQ ID NO: 2375251 - DNA, 21 bp, Homo sapiens
agtaaatcagaaagtaacaat

SEQ ID NO: 2375252 - DNA, 24 bp, Homo sapiens
agtaaatcagaaagtaacaatcta

SEQ ID NO: 2375253 - DNA, 19 bp, Homo sapiens
agtaaatgtgtttcttgct

SEQ ID NO: 2375254 - DNA, 18 bp, Homo sapiens
agtaacattcatgttcta

SEQ ID NO: 2375255 - DNA, 18 bp, Homo sapiens
agtaactgccattttttg

SEQ ID NO: 2375256 - DNA, 19 bp, Homo sapiens
agtaacttttaaaatttgt

SEQ ID NO: 2375257 - DNA, 14 bp, Homo sapiens
agtaagaagacatg

SEQ ID NO: 2375258 - DNA, 15 bp, Homo sapiens
agtaagaagacatga

SEQ ID NO: 2375259 - DNA, 21 bp, Homo sapiens
agtaagaataccacatcaaat

SEQ ID NO: 2375260 - DNA, 23 bp, Homo sapiens
agtaagaataccacatcaaataa

SEQ ID NO: 2375261 - DNA, 15 bp, Homo sapiens
agtaatactttttaa

SEQ ID NO: 2375262 - DNA, 17 bp, Homo sapiens
agtaatactttttaaat

SEQ ID NO: 2375263 - DNA, 20 bp, Homo sapiens
agtaatcagattactgcttt

SEQ ID NO: 2375264 - DNA, 22 bp, Homo sapiens
agtaatcagattactgctttaa

SEQ ID NO: 2375265 - DNA, 19 bp, Homo sapiens
agtaatgtgactaaaggaa

SEQ ID NO: 2375266 - DNA, 13 bp, Homo sapiens
agtaatttcagtg

SEQ ID NO: 2375267 - DNA, 22 bp, Homo sapiens
agtaatttcagtgtaaagtgtg

SEQ ID NO: 2375268 - DNA, 15 bp, Homo sapiens
agtacaaatgaagaa

SEQ ID NO: 2375269 - DNA, 12 bp, Homo sapiens
agtacagaattt

SEQ ID NO: 2375270 - DNA, 16 bp, Homo sapiens
agtacagaatttgaat

SEQ ID NO: 2375271 - DNA, 14 bp, Homo sapiens
agtacagcggctcc

SEQ ID NO: 2375272 - DNA, 16 bp, Homo sapiens
agtacagtattctttt

SEQ ID NO: 2375273 - DNA, 21 bp, Homo sapiens
agtacagtattcttttaaaat

SEQ ID NO: 2375274 - DNA, 19 bp, Homo sapiens
agtaccaatgggaagcagg

SEQ ID NO: 2375275 - DNA, 14 bp, Homo sapiens
agtaccttgaactc

SEQ ID NO: 2375276 - DNA, 15 bp, Homo sapiens
agtactctttaacat

SEQ ID NO: 2375277 - DNA, 17 bp, Homo sapiens
agtactggttactttca

SEQ ID NO: 2375278 - DNA, 18 bp, Homo sapiens
agtagaaaatgtgaccct

SEQ ID NO: 2375279 - DNA, 22 bp, Homo sapiens
agtagaaaatgtgaccctccaa

SEQ ID NO: 2375280 - DNA, 11 bp, Homo sapiens
agtagaactgt

SEQ ID NO: 2375281 - DNA, 20 bp, Homo sapiens
agtagataatttcagggtgc

SEQ ID NO: 2375282 - DNA, 23 bp, Homo sapiens
agtagatctatattagatcaaat

SEQ ID NO: 2375283 - DNA, 20 bp, Homo sapiens
agtagatgtggcctttgaat

SEQ ID NO: 2375284 - DNA, 15 bp, Homo sapiens
agtagattcatgaaa

SEQ ID NO: 2375285 - DNA, 17 bp, Homo sapiens
agtaggtgatattcatt

SEQ ID NO: 2375286 - DNA, 22 bp, Homo sapiens
agtaggtggcttgagctagaga

SEQ ID NO: 2375287 - DNA, 16 bp, Homo sapiens
agtagtatatttaatt

SEQ ID NO: 2375288 - DNA, 15 bp, Homo sapiens
agtagttaaataact

SEQ ID NO: 2375289 - DNA, 13 bp, Homo sapiens
agtataaaatagt

SEQ ID NO: 2375290 - DNA, 15 bp, Homo sapiens
agtatacctgatttt

SEQ ID NO: 2375291 - DNA, 14 bp, Homo sapiens
agtatattgttgaa

SEQ ID NO: 2375292 - DNA, 20 bp, Homo sapiens
agtatattgttgaagagaca

SEQ ID NO: 2375293 - DNA, 13 bp, Homo sapiens
agtatatttaatt

SEQ ID NO: 2375294 - DNA, 14 bp, Homo sapiens
agtatcacttttct

SEQ ID NO: 2375295 - DNA, 19 bp, Homo sapiens
agtatcagctacaattgta

SEQ ID NO: 2375296 - DNA, 12 bp, Homo sapiens
agtatcccacat

SEQ ID NO: 2375297 - DNA, 18 bp, Homo sapiens
agtatcccacatccaact

SEQ ID NO: 2375298 - DNA, 18 bp, Homo sapiens
agtatctttaaaattttt

SEQ ID NO: 2375299 - DNA, 19 bp, Homo sapiens
agtatgcattattaaattg

SEQ ID NO: 2375300 - DNA, 17 bp, Homo sapiens
agtatgcttaagctttg

SEQ ID NO: 2375301 - DNA, 19 bp, Homo sapiens
agtatggtaggggagggca

SEQ ID NO: 2375302 - DNA, 20 bp, Homo sapiens
agtatgtatattaaaaaaga

SEQ ID NO: 2375303 - DNA, 23 bp, Homo sapiens
agtatgtatattaaaaaagagac

SEQ ID NO: 2375304 - DNA, 23 bp, Homo sapiens
agtatgtgggcagattttcagca

SEQ ID NO: 2375305 - DNA, 16 bp, Homo sapiens
agtatgtgggggcttc

SEQ ID NO: 2375306 - DNA, 23 bp, Homo sapiens
agtatgtgggggcttcatctctt

SEQ ID NO: 2375307 - DNA, 23 bp, Homo sapiens
agtattatcttgttcaggaaaag

SEQ ID NO: 2375308 - DNA, 16 bp, Homo sapiens
agtattgtttaaaatg

SEQ ID NO: 2375309 - DNA, 13 bp, Homo sapiens
agtatttatgggt

SEQ ID NO: 2375310 - DNA, 14 bp, Homo sapiens
agtatttttaaagg

SEQ ID NO: 2375311 - DNA, 15 bp, Homo sapiens
agtcaacactcttct

SEQ ID NO: 2375312 - DNA, 16 bp, Homo sapiens
agtcaaggattcttct

SEQ ID NO: 2375313 - DNA, 16 bp, Homo sapiens
agtcacaacagagtga

SEQ ID NO: 2375314 - DNA, 18 bp, Homo sapiens
agtcacaacagagtgaaa

SEQ ID NO: 2375315 - DNA, 18 bp, Homo sapiens
agtcacacattacaaagt

SEQ ID NO: 2375316 - DNA, 21 bp, Homo sapiens
agtcaccaaatagtgtgaaat

SEQ ID NO: 2375317 - DNA, 22 bp, Homo sapiens
agtcaccttttctgtggctggc

SEQ ID NO: 2375318 - DNA, 22 bp, Homo sapiens
agtcactggcatactgagaata

SEQ ID NO: 2375319 - DNA, 23 bp, Homo sapiens
agtcacttaactataaggtgcct

SEQ ID NO: 2375320 - DNA, 23 bp, Homo sapiens
agtcagagccatgtcttctccct

SEQ ID NO: 2375321 - DNA, 14 bp, Homo sapiens
agtcagagtccagt

SEQ ID NO: 2375322 - DNA, 15 bp, Homo sapiens
agtcagagtccagtg

SEQ ID NO: 2375323 - DNA, 18 bp, Homo sapiens
agtcagagtccagtgctc

SEQ ID NO: 2375324 - DNA, 20 bp, Homo sapiens
agtcagagtccagtgctctg

SEQ ID NO: 2375325 - DNA, 13 bp, Homo sapiens
agtcagctctctg

SEQ ID NO: 2375326 - DNA, 23 bp, Homo sapiens
agtcagtgctctcagctggcagt

SEQ ID NO: 2375327 - DNA, 20 bp, Homo sapiens
agtcatatatatcacccaga

SEQ ID NO: 2375328 - DNA, 19 bp, Homo sapiens
agtcatctcccctcctggc

SEQ ID NO: 2375329 - DNA, 14 bp, Homo sapiens
agtcatgcataaat

SEQ ID NO: 2375330 - DNA, 14 bp, Homo sapiens
agtcattaaagaca

SEQ ID NO: 2375331 - DNA, 16 bp, Homo sapiens
agtccaaccagaaaca

SEQ ID NO: 2375332 - DNA, 12 bp, Homo sapiens
agtccaacctgc

SEQ ID NO: 2375333 - DNA, 15 bp, Homo sapiens
agtccaacctgcctg

SEQ ID NO: 2375334 - DNA, 14 bp, Homo sapiens
agtccaccctgcct

SEQ ID NO: 2375335 - DNA, 13 bp, Homo sapiens
agtccactgttga

SEQ ID NO: 2375336 - DNA, 11 bp, Homo sapiens
agtccagaccc

SEQ ID NO: 2375337 - DNA, 17 bp, Homo sapiens
agtccagtgctctgcct

SEQ ID NO: 2375338 - DNA, 18 bp, Homo sapiens
agtcccatttttctcttg

SEQ ID NO: 2375339 - DNA, 11 bp, Homo sapiens
agtccccaccc

SEQ ID NO: 2375340 - DNA, 13 bp, Homo sapiens
agtccccacccct

SEQ ID NO: 2375341 - DNA, 16 bp, Homo sapiens
agtccccacccctgcc

SEQ ID NO: 2375342 - DNA, 18 bp, Homo sapiens
agtccccatttctgcctc

SEQ ID NO: 2375343 - DNA, 12 bp, Homo sapiens
agtccctggaaa

SEQ ID NO: 2375344 - DNA, 13 bp, Homo sapiens
agtcctatttcag

SEQ ID NO: 2375345 - DNA, 18 bp, Homo sapiens
agtcctcactcttcaagg

SEQ ID NO: 2375346 - DNA, 22 bp, Homo sapiens
agtcctgctacctcccttgcct

SEQ ID NO: 2375347 - DNA, 14 bp, Homo sapiens
agtcctggaagcca

SEQ ID NO: 2375348 - DNA, 13 bp, Homo sapiens
agtcgtgatgtgg

SEQ ID NO: 2375349 - DNA, 18 bp, Homo sapiens
agtctaaggccatggcat

SEQ ID NO: 2375350 - DNA, 19 bp, Homo sapiens
agtctatatggttctccaa

SEQ ID NO: 2375351 - DNA, 21 bp, Homo sapiens
agtctatatggttctccaaga

SEQ ID NO: 2375352 - DNA, 20 bp, Homo sapiens
caaaacctgtattactgaat

SEQ ID NO: 2375353 - DNA, 18 bp, Homo sapiens
caaaactcactaagttta

SEQ ID NO: 2375354 - DNA, 12 bp, Homo sapiens
caaaactgctcc

SEQ ID NO: 2375355 - DNA, 23 bp, Homo sapiens
caaaactttaggccctgccccag

SEQ ID NO: 2375356 - DNA, 19 bp, Homo sapiens
caaaagattgctgaaattt

SEQ ID NO: 2375357 - DNA, 19 bp, Homo sapiens
caaaagcctcagaaaggga

SEQ ID NO: 2375358 - DNA, 13 bp, Homo sapiens
caaaagcttttta

SEQ ID NO: 2375359 - DNA, 11 bp, Homo sapiens
caaaaggaaag

SEQ ID NO: 2375360 - DNA, 16 bp, Homo sapiens
caaaaggaaagctgtg

SEQ ID NO: 2375361 - DNA, 16 bp, Homo sapiens
caaaaggcctcttgta

SEQ ID NO: 2375362 - DNA, 22 bp, Homo sapiens
caaaaggcctcttgtaaagact

SEQ ID NO: 2375363 - DNA, 23 bp, Homo sapiens
caaaaggcctcttgtaaagactg

SEQ ID NO: 2375364 - DNA, 15 bp, Homo sapiens
caaaagtccctccct

SEQ ID NO: 2375365 - DNA, 21 bp, Homo sapiens
caaaagtccctccctgcctga

SEQ ID NO: 2375366 - DNA, 22 bp, Homo sapiens
caaaagtccctccctgcctgag

SEQ ID NO: 2375367 - DNA, 17 bp, Homo sapiens
caaaataataaaaatca

SEQ ID NO: 2375368 - DNA, 16 bp, Homo sapiens
caaaatacatttgtaa

SEQ ID NO: 2375369 - DNA, 18 bp, Homo sapiens
caaaatacatttgtaagt

SEQ ID NO: 2375370 - DNA, 15 bp, Homo sapiens
caaaatatatacaca

SEQ ID NO: 2375371 - DNA, 16 bp, Homo sapiens
caaaatatgtttaaaa

SEQ ID NO: 2375372 - DNA, 15 bp, Homo sapiens
caaaatatttcccat

SEQ ID NO: 2375373 - DNA, 17 bp, Homo sapiens
caaaatctaaaatgttt

SEQ ID NO: 2375374 - DNA, 22 bp, Homo sapiens
caaaatctaaaatgttttatga

SEQ ID NO: 2375375 - DNA, 17 bp, Homo sapiens
caaaatggaataaaagg

SEQ ID NO: 2375376 - DNA, 13 bp, Homo sapiens
caaaatgtctgta

SEQ ID NO: 2375377 - DNA, 22 bp, Homo sapiens
caaaatgtctgtagctcctcaa

SEQ ID NO: 2375378 - DNA, 17 bp, Homo sapiens
caaaatgttggtcattt

SEQ ID NO: 2375379 - DNA, 23 bp, Homo sapiens
caaaattagatcctaagatgtgt

SEQ ID NO: 2375380 - DNA, 13 bp, Homo sapiens
caaaatttgagaa

SEQ ID NO: 2375381 - DNA, 12 bp, Homo sapiens
caaaattttaaa

SEQ ID NO: 2375382 - DNA, 19 bp, Homo sapiens
caaacacatttaccctttg

SEQ ID NO: 2375383 - DNA, 20 bp, Homo sapiens
caaacatgttgtttgtttta

SEQ ID NO: 2375384 - DNA, 16 bp, Homo sapiens
caaacccagaggtgga

SEQ ID NO: 2375385 - DNA, 21 bp, Homo sapiens
caaacccagaggtggatgtta

SEQ ID NO: 2375386 - DNA, 15 bp, Homo sapiens
caaacctaccaaaat

SEQ ID NO: 2375387 - DNA, 19 bp, Homo sapiens
caaacctgacccctgctca

SEQ ID NO: 2375388 - DNA, 21 bp, Homo sapiens
caaacctttcccccttagcac

SEQ ID NO: 2375389 - DNA, 23 bp, Homo sapiens
caaacgctaaagagcccttgcct

SEQ ID NO: 2375390 - DNA, 20 bp, Homo sapiens
caaactgggaacccctttcc

SEQ ID NO: 2375391 - DNA, 16 bp, Homo sapiens
caaacttgtggcctca

SEQ ID NO: 2375392 - DNA, 18 bp, Homo sapiens
caaacttgtggcctcaag

SEQ ID NO: 2375393 - DNA, 23 bp, Homo sapiens
caaacttgtggcctcaagcaatc

SEQ ID NO: 2375394 - DNA, 18 bp, Homo sapiens
caaagaaaatgaaatgca

SEQ ID NO: 2375395 - DNA, 16 bp, Homo sapiens
caaagactcaaatttt

SEQ ID NO: 2375396 - DNA, 13 bp, Homo sapiens
caaagagacattt

SEQ ID NO: 2375397 - DNA, 14 bp, Homo sapiens
caaagagattcgaa

SEQ ID NO: 2375398 - DNA, 12 bp, Homo sapiens
caaagaggctgc

SEQ ID NO: 2375399 - DNA, 13 bp, Homo sapiens
caaagaggctgcc

SEQ ID NO: 2375400 - DNA, 14 bp, Homo sapiens
caaagagggcttcc

SEQ ID NO: 2375401 - DNA, 22 bp, Homo sapiens
caaagagggcttcctctagaag

SEQ ID NO: 2375402 - DNA, 16 bp, Homo sapiens
caaagatttcatatct

SEQ ID NO: 2375403 - DNA, 21 bp, Homo sapiens
caaagccttaagcaaattttg

SEQ ID NO: 2375404 - DNA, 17 bp, Homo sapiens
caaaggaaaatgtctgt

SEQ ID NO: 2375405 - DNA, 17 bp, Homo sapiens
caaaggagctttctcaa

SEQ ID NO: 2375406 - DNA, 13 bp, Homo sapiens
caaagggcagttt

SEQ ID NO: 2375407 - DNA, 16 bp, Homo sapiens
caaagtacagaatttg

SEQ ID NO: 2375408 - DNA, 12 bp, Homo sapiens
caaagtcattaa

SEQ ID NO: 2375409 - DNA, 16 bp, Homo sapiens
caaagtcattaaagac

SEQ ID NO: 2375410 - DNA, 15 bp, Homo sapiens
caaagtgatagaaaa

SEQ ID NO: 2375411 - DNA, 17 bp, Homo sapiens
caaagttaaaattgtta

SEQ ID NO: 2375412 - DNA, 17 bp, Homo sapiens
caaagtttcagagtata

SEQ ID NO: 2375413 - DNA, 17 bp, Homo sapiens
caaagttttgaaaagct

SEQ ID NO: 2375414 - DNA, 18 bp, Homo sapiens
caaagttttgaaaagcta

SEQ ID NO: 2375415 - DNA, 15 bp, Homo sapiens
caaataaaatatcat

SEQ ID NO: 2375416 - DNA, 16 bp, Homo sapiens
caaatacacatttgct

SEQ ID NO: 2375417 - DNA, 22 bp, Homo sapiens
caaatactgcttagcattttgc

SEQ ID NO: 2375418 - DNA, 13 bp, Homo sapiens
caaatagcaaaga

SEQ ID NO: 2375419 - DNA, 18 bp, Homo sapiens
caaataggatgcttggga

SEQ ID NO: 2375420 - DNA, 23 bp, Homo sapiens
caaataggctattaaaaaagtct

SEQ ID NO: 2375421 - DNA, 12 bp, Homo sapiens
caaatagtgtga

SEQ ID NO: 2375422 - DNA, 15 bp, Homo sapiens
caaatagtgtgaaat

SEQ ID NO: 2375423 - DNA, 21 bp, Homo sapiens
caaatagtgtgaaatatatta

SEQ ID NO: 2375424 - DNA, 23 bp, Homo sapiens
caaatatacattttctaaataaa

SEQ ID NO: 2375425 - DNA, 17 bp, Homo sapiens
caaatcaaatgaatgat

SEQ ID NO: 2375426 - DNA, 17 bp, Homo sapiens
caaatcaatacactagt

SEQ ID NO: 2375427 - DNA, 16 bp, Homo sapiens
caaatcaattactggt

SEQ ID NO: 2375428 - DNA, 15 bp, Homo sapiens
caaatccacaagcca

SEQ ID NO: 2375429 - DNA, 12 bp, Homo sapiens
caaatgaagaaa

SEQ ID NO: 2375430 - DNA, 15 bp, Homo sapiens
caaatgaagaaagtc

SEQ ID NO: 2375431 - DNA, 16 bp, Homo sapiens
caaatgaagaaagtca

SEQ ID NO: 2375432 - DNA, 20 bp, Homo sapiens
caaatgaatgattaaattat

SEQ ID NO: 2375433 - DNA, 16 bp, Homo sapiens
caaatgagctctgaaa

SEQ ID NO: 2375434 - DNA, 19 bp, Homo sapiens
caaatggagaagctgcagg

SEQ ID NO: 2375435 - DNA, 15 bp, Homo sapiens
caaatgtggccaagc

SEQ ID NO: 2375436 - DNA, 21 bp, Homo sapiens
caaattaaaaaaaaattgtat

SEQ ID NO: 2375437 - DNA, 15 bp, Homo sapiens
caaattaaaacaaat

SEQ ID NO: 2375438 - DNA, 22 bp, Homo sapiens
caaattaaaacaaatatacatt

SEQ ID NO: 2375439 - DNA, 23 bp, Homo sapiens
caaattaaaacaaatatacattt

SEQ ID NO: 2375440 - DNA, 14 bp, Homo sapiens
caaattcttctgaa

SEQ ID NO: 2375441 - DNA, 21 bp, Homo sapiens
caaattttggcgaatctcaaa

SEQ ID NO: 2375442 - DNA, 19 bp, Homo sapiens
caacaacctcaactgccta

SEQ ID NO: 2375443 - DNA, 13 bp, Homo sapiens
caacaagatttcc

SEQ ID NO: 2375444 - DNA, 14 bp, Homo sapiens
caacaattggtaaa

SEQ ID NO: 2375445 - DNA, 18 bp, Homo sapiens
caacaatttatgaattga

SEQ ID NO: 2375446 - DNA, 20 bp, Homo sapiens
caacacattgaaactgtatt

SEQ ID NO: 2375447 - DNA, 14 bp, Homo sapiens
caacactcttcttg

SEQ ID NO: 2375448 - DNA, 20 bp, Homo sapiens
caacactcttcttgagcaga

SEQ ID NO: 2375449 - DNA, 14 bp, Homo sapiens
caacatatagttga

SEQ ID NO: 2375450 - DNA, 14 bp, Homo sapiens
caacatatatttat

SEQ ID NO: 2375451 - DNA, 21 bp, Homo sapiens
caacatatatttattgagtac

SEQ ID NO: 2375452 - DNA, 14 bp, Homo sapiens
caaccactgtgcca

SEQ ID NO: 2375453 - DNA, 15 bp, Homo sapiens
caaccactgtgccac

SEQ ID NO: 2375454 - DNA, 17 bp, Homo sapiens
caaccactgtgccactg

SEQ ID NO: 2375455 - DNA, 18 bp, Homo sapiens
caaccagaaacacccctc

SEQ ID NO: 2375456 - DNA, 16 bp, Homo sapiens
caaccaggcacctctt

SEQ ID NO: 2375457 - DNA, 21 bp, Homo sapiens
caacccagtcacactgtggcc

SEQ ID NO: 2375458 - DNA, 18 bp, Homo sapiens
caaccccaaacccaagtg

SEQ ID NO: 2375459 - DNA, 20 bp, Homo sapiens
caaccctatctcctgacaga

SEQ ID NO: 2375460 - DNA, 20 bp, Homo sapiens
caacctcaccttcctgtggg

SEQ ID NO: 2375461 - DNA, 17 bp, Homo sapiens
caacctcagggctccca

SEQ ID NO: 2375462 - DNA, 23 bp, Homo sapiens
caacctctttttcctcctggaca

SEQ ID NO: 2375463 - DNA, 14 bp, Homo sapiens
caacctgcctgtgc

SEQ ID NO: 2375464 - DNA, 16 bp, Homo sapiens
caacctgcctgtgcat

SEQ ID NO: 2375465 - DNA, 18 bp, Homo sapiens
caacctgcctgtgcatga

SEQ ID NO: 2375466 - DNA, 17 bp, Homo sapiens
caacctgctctcctctt

SEQ ID NO: 2375467 - DNA, 22 bp, Homo sapiens
cactcatttttttttgaggaga

SEQ ID NO: 2375468 - DNA, 22 bp, Homo sapiens
cactccacataaggggtttagt

SEQ ID NO: 2375469 - DNA, 17 bp, Homo sapiens
cactcccacatgggccc

SEQ ID NO: 2375470 - DNA, 18 bp, Homo sapiens
cactcccacctgcatctg

SEQ ID NO: 2375471 - DNA, 11 bp, Homo sapiens
cactccctggg

SEQ ID NO: 2375472 - DNA, 18 bp, Homo sapiens
cactcccttgctggcccc

SEQ ID NO: 2375473 - DNA, 22 bp, Homo sapiens
cactcccttgctggccccagcc

SEQ ID NO: 2375474 - DNA, 20 bp, Homo sapiens
cactccgcgccgatgccacc

SEQ ID NO: 2375475 - DNA, 21 bp, Homo sapiens
cactccgcgccgatgccaccg

SEQ ID NO: 2375476 - DNA, 14 bp, Homo sapiens
cactcctctgctga

SEQ ID NO: 2375477 - DNA, 21 bp, Homo sapiens
cactcctctgctgacctgctg

SEQ ID NO: 2375478 - DNA, 13 bp, Homo sapiens
cactcctgacccc

SEQ ID NO: 2375479 - DNA, 22 bp, Homo sapiens
cactcctgacccctctcctcaa

SEQ ID NO: 2375480 - DNA, 21 bp, Homo sapiens
cactcctgcttaatcttcaaa

SEQ ID NO: 2375481 - DNA, 22 bp, Homo sapiens
cactcctgtccctgtagctcag

SEQ ID NO: 2375482 - DNA, 22 bp, Homo sapiens
cactcggatggaccaacctgct

SEQ ID NO: 2375483 - DNA, 21 bp, Homo sapiens
cactcgggtttctctgtggct

SEQ ID NO: 2375484 - DNA, 13 bp, Homo sapiens
cactctccatcac

SEQ ID NO: 2375485 - DNA, 17 bp, Homo sapiens
cactgaaagttttgtaa

SEQ ID NO: 2375486 - DNA, 21 bp, Homo sapiens
cactgaaagttttgtaaaaga

SEQ ID NO: 2375487 - DNA, 18 bp, Homo sapiens
cactgacttgctgtgtga

SEQ ID NO: 2375488 - DNA, 22 bp, Homo sapiens
cactgagaggacagagagaaat

SEQ ID NO: 2375489 - DNA, 14 bp, Homo sapiens
cactgatggctcaa

SEQ ID NO: 2375490 - DNA, 20 bp, Homo sapiens
cactgatggctcaagacaag

SEQ ID NO: 2375491 - DNA, 13 bp, Homo sapiens
cactgcagcctca

SEQ ID NO: 2375492 - DNA, 21 bp, Homo sapiens
cactgcagcctcatactcctg

SEQ ID NO: 2375493 - DNA, 22 bp, Homo sapiens
cactgcatgcagaaacttggat

SEQ ID NO: 2375494 - DNA, 12 bp, Homo sapiens
cactgccagcag

SEQ ID NO: 2375495 - DNA, 21 bp, Homo sapiens
cactgccaggccagcctccga

SEQ ID NO: 2375496 - DNA, 20 bp, Homo sapiens
cactgcgaagaccctcttgc

SEQ ID NO: 2375497 - DNA, 19 bp, Homo sapiens
cactgcttctcttttgaaa

SEQ ID NO: 2375498 - DNA, 12 bp, Homo sapiens
cactggaaaggg

SEQ ID NO: 2375499 - DNA, 15 bp, Homo sapiens
cactggaaaggggag

SEQ ID NO: 2375500 - DNA, 22 bp, Homo sapiens
cactggaaaggggagagcctgc

SEQ ID NO: 2375501 - DNA, 23 bp, Homo sapiens
cactggactccggggccccactg

SEQ ID NO: 2375502 - DNA, 20 bp, Homo sapiens
cactggaggttgaagccaag

SEQ ID NO: 2375503 - DNA, 18 bp, Homo sapiens
cactgggaagaagcaagg

SEQ ID NO: 2375504 - DNA, 17 bp, Homo sapiens
cactgggaggcagggct

SEQ ID NO: 2375505 - DNA, 21 bp, Homo sapiens
cactgggaggcagggctctcc

SEQ ID NO: 2375506 - DNA, 18 bp, Homo sapiens
cactgggaggctcccctt

SEQ ID NO: 2375507 - DNA, 19 bp, Homo sapiens
cactgggtgcgtctccagt

SEQ ID NO: 2375508 - DNA, 13 bp, Homo sapiens
cactgtataaata

SEQ ID NO: 2375509 - DNA, 14 bp, Homo sapiens
cactgtataaatag

SEQ ID NO: 2375510 - DNA, 15 bp, Homo sapiens
cactgtataaatagg

SEQ ID NO: 2375511 - DNA, 18 bp, Homo sapiens
cactgtataaataggaga

SEQ ID NO: 2375512 - DNA, 16 bp, Homo sapiens
cactgtccgcctctgc

SEQ ID NO: 2375513 - DNA, 19 bp, Homo sapiens
cactgtgcgtcttggtgta

SEQ ID NO: 2375514 - DNA, 23 bp, Homo sapiens
cactgtggccagtaaaatactat

SEQ ID NO: 2375515 - DNA, 21 bp, Homo sapiens
cactgttgagccccagtgctg

SEQ ID NO: 2375516 - DNA, 16 bp, Homo sapiens
cactgttgctttgaaa

SEQ ID NO: 2375517 - DNA, 18 bp, Homo sapiens
cactgtttctcttgagct

SEQ ID NO: 2375518 - DNA, 20 bp, Homo sapiens
cactgtttctcttgagctgg

SEQ ID NO: 2375519 - DNA, 21 bp, Homo sapiens
cacttaaacgaagagttccct

SEQ ID NO: 2375520 - DNA, 20 bp, Homo sapiens
cacttaactataaggtgcct

SEQ ID NO: 2375521 - DNA, 12 bp, Homo sapiens
cacttattatta

SEQ ID NO: 2375522 - DNA, 22 bp, Homo sapiens
cacttattggaactctgcttga

SEQ ID NO: 2375523 - DNA, 14 bp, Homo sapiens
cacttcataatcca

SEQ ID NO: 2375524 - DNA, 21 bp, Homo sapiens
cacttcttgaaacagcctggg

SEQ ID NO: 2375525 - DNA, 14 bp, Homo sapiens
cacttgaaaccttt

SEQ ID NO: 2375526 - DNA, 21 bp, Homo sapiens
cacttgaaacctttttttatc

SEQ ID NO: 2375527 - DNA, 13 bp, Homo sapiens
cacttgagagaaa

SEQ ID NO: 2375528 - DNA, 11 bp, Homo sapiens
cacttgagttt

SEQ ID NO: 2375529 - DNA, 20 bp, Homo sapiens
cacttgccattccaaaatat

SEQ ID NO: 2375530 - DNA, 22 bp, Homo sapiens
cactttacccacctagaacact

SEQ ID NO: 2375531 - DNA, 21 bp, Homo sapiens
cactttactttcaagtaatat

SEQ ID NO: 2375532 - DNA, 17 bp, Homo sapiens
cactttcccacactgtg

SEQ ID NO: 2375533 - DNA, 21 bp, Homo sapiens
cactttgaaaagttggaagga

SEQ ID NO: 2375534 - DNA, 13 bp, Homo sapiens
cactttgggaggc

SEQ ID NO: 2375535 - DNA, 12 bp, Homo sapiens
cactttggggga

SEQ ID NO: 2375536 - DNA, 15 bp, Homo sapiens
cacttttagaaatgc

SEQ ID NO: 2375537 - DNA, 18 bp, Homo sapiens
cagaaaaatgaaatttaa

SEQ ID NO: 2375538 - DNA, 16 bp, Homo sapiens
cagaaacacccctctg

SEQ ID NO: 2375539 - DNA, 13 bp, Homo sapiens
cagaaacatctct

SEQ ID NO: 2375540 - DNA, 15 bp, Homo sapiens
cagaaacatctctgg

SEQ ID NO: 2375541 - DNA, 19 bp, Homo sapiens
cagaaagcctctctctccc

SEQ ID NO: 2375542 - DNA, 13 bp, Homo sapiens
cagaaagggtgcc

SEQ ID NO: 2375543 - DNA, 21 bp, Homo sapiens
cagaaatagacaaaaagtata

SEQ ID NO: 2375544 - DNA, 19 bp, Homo sapiens
cagaaatgctgctggccaa

SEQ ID NO: 2375545 - DNA, 15 bp, Homo sapiens
cagaacagcttcagg

SEQ ID NO: 2375546 - DNA, 24 bp, Homo sapiens
cagaacagcttcaggttatcgaaa

SEQ ID NO: 2375547 - DNA, 16 bp, Homo sapiens
cagaacatatgttgca

SEQ ID NO: 2375548 - DNA, 21 bp, Homo sapiens
cagaaccacacttgaaacctt

SEQ ID NO: 2375549 - DNA, 22 bp, Homo sapiens
cagaaccacacttgaaaccttt

SEQ ID NO: 2375550 - DNA, 15 bp, Homo sapiens
cagaaccagagggca

SEQ ID NO: 2375551 - DNA, 13 bp, Homo sapiens
cagaacctgcaca

SEQ ID NO: 2375552 - DNA, 15 bp, Homo sapiens
cagaaccttgtccca

SEQ ID NO: 2375553 - DNA, 22 bp, Homo sapiens
cagaacgtggtttgcctgaggc

SEQ ID NO: 2375554 - DNA, 16 bp, Homo sapiens
cagaactaccaggtgg

SEQ ID NO: 2375555 - DNA, 17 bp, Homo sapiens
cagaacttgctgctgtc

SEQ ID NO: 2375556 - DNA, 18 bp, Homo sapiens
cagaacttgctgctgtct

SEQ ID NO: 2375557 - DNA, 14 bp, Homo sapiens
cagaagacaccaga

SEQ ID NO: 2375558 - DNA, 15 bp, Homo sapiens
cagaagacaccagag

SEQ ID NO: 2375559 - DNA, 19 bp, Homo sapiens
cagaagacaccagagcaga

SEQ ID NO: 2375560 - DNA, 21 bp, Homo sapiens
cagaagacaccagagcagatg

SEQ ID NO: 2375561 - DNA, 20 bp, Homo sapiens
cagaagcctccaagcacaga

SEQ ID NO: 2375562 - DNA, 22 bp, Homo sapiens
cagaagctcttactctttccta

SEQ ID NO: 2375563 - DNA, 16 bp, Homo sapiens
cagaagcttctgccca

SEQ ID NO: 2375564 - DNA, 18 bp, Homo sapiens
cagaagtgcccttcctgc

SEQ ID NO: 2375565 - DNA, 20 bp, Homo sapiens
cagaagtgcccttcctgctg

SEQ ID NO: 2375566 - DNA, 13 bp, Homo sapiens
cagaatattttta

SEQ ID NO: 2375567 - DNA, 22 bp, Homo sapiens
cagaatatttttatatttcctt

SEQ ID NO: 2375568 - DNA, 14 bp, Homo sapiens
cagaatcttctggg

SEQ ID NO: 2375569 - DNA, 17 bp, Homo sapiens
cagaatcttgttttgaa

SEQ ID NO: 2375570 - DNA, 19 bp, Homo sapiens
cagaatcttgttttgaaaa

SEQ ID NO: 2375571 - DNA, 12 bp, Homo sapiens
cagaatgctcag

SEQ ID NO: 2375572 - DNA, 12 bp, Homo sapiens
cagaatttgaga

SEQ ID NO: 2375573 - DNA, 17 bp, Homo sapiens
cagacataaaggaaaag

SEQ ID NO: 2375574 - DNA, 19 bp, Homo sapiens
cagacataaaggaaaagac

SEQ ID NO: 2375575 - DNA, 21 bp, Homo sapiens
cagacatacagctgcctacct

SEQ ID NO: 2375576 - DNA, 13 bp, Homo sapiens
cagacattttaaa

SEQ ID NO: 2375577 - DNA, 13 bp, Homo sapiens
cagaccactgtct

SEQ ID NO: 2375578 - DNA, 19 bp, Homo sapiens
cagacccaggacccccgag

SEQ ID NO: 2375579 - DNA, 21 bp, Homo sapiens
cagacctaaagcaagcctgaa

SEQ ID NO: 2375580 - DNA, 17 bp, Homo sapiens
cagacctagcaggctgt

SEQ ID NO: 2375581 - DNA, 18 bp, Homo sapiens
cataccctgacctggccc

SEQ ID NO: 2375582 - DNA, 16 bp, Homo sapiens
catactccttgcttcc

SEQ ID NO: 2375583 - DNA, 16 bp, Homo sapiens
catacttctctcagat

SEQ ID NO: 2375584 - DNA, 13 bp, Homo sapiens
catagaattttga

SEQ ID NO: 2375585 - DNA, 13 bp, Homo sapiens
catagacatgaaa

SEQ ID NO: 2375586 - DNA, 15 bp, Homo sapiens
catagaccctgaggc

SEQ ID NO: 2375587 - DNA, 14 bp, Homo sapiens
catagagatgagcc

SEQ ID NO: 2375588 - DNA, 15 bp, Homo sapiens
catagagatgagccc

SEQ ID NO: 2375589 - DNA, 20 bp, Homo sapiens
catagagatgagcccaccct

SEQ ID NO: 2375590 - DNA, 12 bp, Homo sapiens
catagaggcttc

SEQ ID NO: 2375591 - DNA, 19 bp, Homo sapiens
catagaggcttctccgcca

SEQ ID NO: 2375592 - DNA, 23 bp, Homo sapiens
catagaggcttctccgccagcct

SEQ ID NO: 2375593 - DNA, 17 bp, Homo sapiens
catagataatattgttt

SEQ ID NO: 2375594 - DNA, 24 bp, Homo sapiens
catagataatattgtttggtaaat

SEQ ID NO: 2375595 - DNA, 14 bp, Homo sapiens
catagcagatctgt

SEQ ID NO: 2375596 - DNA, 17 bp, Homo sapiens
catagcagatctgtttt

SEQ ID NO: 2375597 - DNA, 15 bp, Homo sapiens
catagcatgcttcct

SEQ ID NO: 2375598 - DNA, 23 bp, Homo sapiens
catagcatgcttcctttctctcc

SEQ ID NO: 2375599 - DNA, 16 bp, Homo sapiens
catagctgtacttctt

SEQ ID NO: 2375600 - DNA, 19 bp, Homo sapiens
cataggaagggatctgaga

SEQ ID NO: 2375601 - DNA, 22 bp, Homo sapiens
cataggttaaaaaaaaaagtca

SEQ ID NO: 2375602 - DNA, 13 bp, Homo sapiens
catagttctgtaa

SEQ ID NO: 2375603 - DNA, 20 bp, Homo sapiens
catagttgtagacaaagtac

SEQ ID NO: 2375604 - DNA, 16 bp, Homo sapiens
catagtttctttattt

SEQ ID NO: 2375605 - DNA, 14 bp, Homo sapiens
catataatgaataa

SEQ ID NO: 2375606 - DNA, 16 bp, Homo sapiens
catataatgaataaat

SEQ ID NO: 2375607 - DNA, 22 bp, Homo sapiens
catataccaaaaacaagtctat

SEQ ID NO: 2375608 - DNA, 15 bp, Homo sapiens
catatagattttatt

SEQ ID NO: 2375609 - DNA, 18 bp, Homo sapiens
catatatgaccagaagcc

SEQ ID NO: 2375610 - DNA, 19 bp, Homo sapiens
catatatgaccagaagcct

SEQ ID NO: 2375611 - DNA, 13 bp, Homo sapiens
catatatttattg

SEQ ID NO: 2375612 - DNA, 15 bp, Homo sapiens
catatctaactttgt

SEQ ID NO: 2375613 - DNA, 16 bp, Homo sapiens
catatctaactttgta

SEQ ID NO: 2375614 - DNA, 18 bp, Homo sapiens
catatctccatggccctg

SEQ ID NO: 2375615 - DNA, 15 bp, Homo sapiens
catatgaattgtaca

SEQ ID NO: 2375616 - DNA, 16 bp, Homo sapiens
catatgaattgtacag

SEQ ID NO: 2375617 - DNA, 16 bp, Homo sapiens
catatgcaccttgtgt

SEQ ID NO: 2375618 - DNA, 13 bp, Homo sapiens
catatgcagaaat

SEQ ID NO: 2375619 - DNA, 12 bp, Homo sapiens
catatgttgcaa

SEQ ID NO: 2375620 - DNA, 14 bp, Homo sapiens
catattaggaaaat

SEQ ID NO: 2375621 - DNA, 21 bp, Homo sapiens
catattgtgcttcacagtaga

SEQ ID NO: 2375622 - DNA, 16 bp, Homo sapiens
catattgttgaaaggt

SEQ ID NO: 2375623 - DNA, 22 bp, Homo sapiens
catatttaacaaaatttgaata

SEQ ID NO: 2375624 - DNA, 16 bp, Homo sapiens
catatttgatttctaa

SEQ ID NO: 2375625 - DNA, 18 bp, Homo sapiens
catatttgatttctaatt

SEQ ID NO: 2375626 - DNA, 23 bp, Homo sapiens
catatttgatttctaattgtaag

SEQ ID NO: 2375627 - DNA, 17 bp, Homo sapiens
catcaaacctttgagta

SEQ ID NO: 2375628 - DNA, 13 bp, Homo sapiens
catcaaataagaa

SEQ ID NO: 2375629 - DNA, 10 bp, Homo sapiens
catcaactga

SEQ ID NO: 2375630 - DNA, 16 bp, Homo sapiens
catcaccactcatttt

SEQ ID NO: 2375631 - DNA, 14 bp, Homo sapiens
catcaccatttcct

SEQ ID NO: 2375632 - DNA, 13 bp, Homo sapiens
catcaccgctggg

SEQ ID NO: 2375633 - DNA, 11 bp, Homo sapiens
catcacctcac

SEQ ID NO: 2375634 - DNA, 23 bp, Homo sapiens
catcacctcaccaaggatcggac

SEQ ID NO: 2375635 - DNA, 15 bp, Homo sapiens
catcactagtggcaa

SEQ ID NO: 2375636 - DNA, 11 bp, Homo sapiens
catcagatgcc

SEQ ID NO: 2375637 - DNA, 18 bp, Homo sapiens
catcagatgcctgcttga

SEQ ID NO: 2375638 - DNA, 14 bp, Homo sapiens
catcattataagct

SEQ ID NO: 2375639 - DNA, 22 bp, Homo sapiens
catcattttccatatcctggtg

SEQ ID NO: 2375640 - DNA, 17 bp, Homo sapiens
catccaactccagcaac

SEQ ID NO: 2375641 - DNA, 20 bp, Homo sapiens
catccacataccctgacctg

SEQ ID NO: 2375642 - DNA, 13 bp, Homo sapiens
catccagatgtgg

SEQ ID NO: 2375643 - DNA, 15 bp, Homo sapiens
catccagatgtggct

SEQ ID NO: 2375644 - DNA, 13 bp, Homo sapiens
catccagggggca

SEQ ID NO: 2375645 - DNA, 17 bp, Homo sapiens
catccagtggactctgg

SEQ ID NO: 2375646 - DNA, 20 bp, Homo sapiens
catccatagtgcactagcat

SEQ ID NO: 2375647 - DNA, 20 bp, Homo sapiens
catccatccctccattcatc

SEQ ID NO: 2375648 - DNA, 20 bp, Homo sapiens
catcccaaccaggcacctct

SEQ ID NO: 2375649 - DNA, 16 bp, Homo sapiens
catcccccctgctcag

SEQ ID NO: 2375650 - DNA, 17 bp, Homo sapiens
catcccccctgctcagc

SEQ ID NO: 2375651 - DNA, 23 bp, Homo sapiens
catccccctctcctctcccccag

SEQ ID NO: 2375652 - DNA, 12 bp, Homo sapiens
catcccttccca

SEQ ID NO: 2375653 - DNA, 17 bp, Homo sapiens
catcccttcccacatgc

SEQ ID NO: 2375654 - DNA, 11 bp, Homo sapiens
catcctataag

SEQ ID NO: 2375655 - DNA, 20 bp, Homo sapiens
catcctccctccacctcaag

SEQ ID NO: 2375656 - DNA, 12 bp, Homo sapiens
catcctgaccaa

SEQ ID NO: 2375657 - DNA, 17 bp, Homo sapiens
catcctgccatcctcaa

SEQ ID NO: 2375658 - DNA, 23 bp, Homo sapiens
catccttagatgggacgcataat

SEQ ID NO: 2375659 - DNA, 16 bp, Homo sapiens
catccttccaacatat

SEQ ID NO: 2375660 - DNA, 16 bp, Homo sapiens
catccttccatccatc

SEQ ID NO: 2375661 - DNA, 13 bp, Homo sapiens
catccttgtcttt

SEQ ID NO: 2375662 - DNA, 16 bp, Homo sapiens
catccttgtcttttga

SEQ ID NO: 2375663 - DNA, 22 bp, Homo sapiens
catcggtgaaactaacagataa

SEQ ID NO: 2375664 - DNA, 12 bp, Homo sapiens
catctagccagc

SEQ ID NO: 2375665 - DNA, 13 bp, Homo sapiens
catctatctagtt

SEQ ID NO: 2375666 - DNA, 15 bp, Homo sapiens
catctatctcaatcc

SEQ ID NO: 2375667 - DNA, 16 bp, Homo sapiens
catctcaaaaaaacaa

SEQ ID NO: 2375668 - DNA, 19 bp, Homo sapiens
catctcatgaggggagagg

SEQ ID NO: 2375669 - DNA, 23 bp, Homo sapiens
catctcatgaggggagaggagac

SEQ ID NO: 2375670 - DNA, 16 bp, Homo sapiens
catctcccaaggctgc

SEQ ID NO: 2375671 - DNA, 18 bp, Homo sapiens
catctcccaaggctgcca

SEQ ID NO: 2375672 - DNA, 16 bp, Homo sapiens
catctcccctcctggc

SEQ ID NO: 2375673 - DNA, 13 bp, Homo sapiens
catctccctgcct

SEQ ID NO: 2375674 - DNA, 14 bp, Homo sapiens
catctccctgcctg

SEQ ID NO: 2375675 - DNA, 18 bp, Homo sapiens
catctccctgcctggccc

SEQ ID NO: 2375676 - DNA, 17 bp, Homo sapiens
catctcgctccctccca

SEQ ID NO: 2375677 - DNA, 21 bp, Homo sapiens
catctcgctccctcccaggac

SEQ ID NO: 2375678 - DNA, 23 bp, Homo sapiens
catctctacaggcacccatcaga

SEQ ID NO: 2375679 - DNA, 15 bp, Homo sapiens
catctctggcccaga

SEQ ID NO: 2375680 - DNA, 20 bp, Homo sapiens
catctcttaggtgagacagt

SEQ ID NO: 2375681 - DNA, 18 bp, Homo sapiens
catctcttccccagagag

SEQ ID NO: 2375682 - DNA, 15 bp, Homo sapiens
catctctttagagaa

SEQ ID NO: 2375683 - DNA, 20 bp, Homo sapiens
catctgccttaaaaccaaag

SEQ ID NO: 2375684 - DNA, 21 bp, Homo sapiens
catctggggcccatactggtt

SEQ ID NO: 2375685 - DNA, 14 bp, Homo sapiens
catctgtaagagct

SEQ ID NO: 2375686 - DNA, 16 bp, Homo sapiens
catctgtaagagcttg

SEQ ID NO: 2375687 - DNA, 19 bp, Homo sapiens
catctgtaagagcttgctc

SEQ ID NO: 2375688 - DNA, 23 bp, Homo sapiens
catctgtaagagcttgctccaga

SEQ ID NO: 2375689 - DNA, 12 bp, Homo sapiens
catctgtccagc

SEQ ID NO: 2375690 - DNA, 13 bp, Homo sapiens
catctgtccccct

SEQ ID NO: 2375691 - DNA, 16 bp, Homo sapiens
catctgttagggcctt

SEQ ID NO: 2375692 - DNA, 14 bp, Homo sapiens
catcttagtgcctg

SEQ ID NO: 2375693 - DNA, 16 bp, Homo sapiens
catcttcaatatgaat

SEQ ID NO: 2375694 - DNA, 21 bp, Homo sapiens
catcttcacttctaaatgcat

SEQ ID NO: 2375695 - DNA, 9 bp, Homo sapiens
catcttcag

SEQ ID NO: 2375696 - DNA, 15 bp, Homo sapiens
catcttcgggaccag

SEQ ID NO: 2375697 - DNA, 18 bp, Homo sapiens
ccagcttccaaagcctag

SEQ ID NO: 2375698 - DNA, 16 bp, Homo sapiens
ccagcttggggccacc

SEQ ID NO: 2375699 - DNA, 19 bp, Homo sapiens
ccagcttggggccaccaaa

SEQ ID NO: 2375700 - DNA, 21 bp, Homo sapiens
ccagcttggggccaccaaagc

SEQ ID NO: 2375701 - DNA, 14 bp, Homo sapiens
ccagctttccctgc

SEQ ID NO: 2375702 - DNA, 18 bp, Homo sapiens
ccagctttccctgcctct

SEQ ID NO: 2375703 - DNA, 20 bp, Homo sapiens
ccaggaaactccacatctgc

SEQ ID NO: 2375704 - DNA, 21 bp, Homo sapiens
ccaggaaactccacatctgcc

SEQ ID NO: 2375705 - DNA, 22 bp, Homo sapiens
ccaggaaactccacatctgcct

SEQ ID NO: 2375706 - DNA, 16 bp, Homo sapiens
ccaggaaagagcagtc

SEQ ID NO: 2375707 - DNA, 17 bp, Homo sapiens
ccaggaagccagagccc

SEQ ID NO: 2375708 - DNA, 18 bp, Homo sapiens
ccaggaagccagagcccc

SEQ ID NO: 2375709 - DNA, 23 bp, Homo sapiens
ccaggacatgcaataaaatttaa

SEQ ID NO: 2375710 - DNA, 20 bp, Homo sapiens
ccaggacccccgaggggagg

SEQ ID NO: 2375711 - DNA, 17 bp, Homo sapiens
ccaggagatgggtccag

SEQ ID NO: 2375712 - DNA, 16 bp, Homo sapiens
ccaggagcaggcacgg

SEQ ID NO: 2375713 - DNA, 22 bp, Homo sapiens
ccaggagcttcttgtttccttg

SEQ ID NO: 2375714 - DNA, 20 bp, Homo sapiens
ccaggatactggcacagagg

SEQ ID NO: 2375715 - DNA, 20 bp, Homo sapiens
ccaggatcatggtgtaataa

SEQ ID NO: 2375716 - DNA, 15 bp, Homo sapiens
ccaggcaagcagctg

SEQ ID NO: 2375717 - DNA, 20 bp, Homo sapiens
ccaggcaagcagctggtcag

SEQ ID NO: 2375718 - DNA, 16 bp, Homo sapiens
ccaggcacacacagcc

SEQ ID NO: 2375719 - DNA, 17 bp, Homo sapiens
ccaggcacacacagccc

SEQ ID NO: 2375720 - DNA, 15 bp, Homo sapiens
ccaggcaccctcagg

SEQ ID NO: 2375721 - DNA, 19 bp, Homo sapiens
ccaggcaccctcagggagc

SEQ ID NO: 2375722 - DNA, 14 bp, Homo sapiens
ccaggcagctccct

SEQ ID NO: 2375723 - DNA, 19 bp, Homo sapiens
ccaggcagctccctcctgc

SEQ ID NO: 2375724 - DNA, 23 bp, Homo sapiens
ccaggcagctccctcctgcacac

SEQ ID NO: 2375725 - DNA, 21 bp, Homo sapiens
ccaggcaggggtgggggtgga

SEQ ID NO: 2375726 - DNA, 22 bp, Homo sapiens
ccaggcaggggtgggggtggag

SEQ ID NO: 2375727 - DNA, 12 bp, Homo sapiens
ccaggccagcct

SEQ ID NO: 2375728 - DNA, 13 bp, Homo sapiens
ccaggccagcctc

SEQ ID NO: 2375729 - DNA, 20 bp, Homo sapiens
ccaggccagcctccgagagg

SEQ ID NO: 2375730 - DNA, 23 bp, Homo sapiens
ccaggccagcctccgagagggag

SEQ ID NO: 2375731 - DNA, 18 bp, Homo sapiens
ccaggccctcctctccca

SEQ ID NO: 2375732 - DNA, 22 bp, Homo sapiens
ccaggccggcccagatgtgtcc

SEQ ID NO: 2375733 - DNA, 13 bp, Homo sapiens
ccaggcctgcctc

SEQ ID NO: 2375734 - DNA, 16 bp, Homo sapiens
ccaggctccagcacat

SEQ ID NO: 2375735 - DNA, 15 bp, Homo sapiens
ccaggctggagaccc

SEQ ID NO: 2375736 - DNA, 18 bp, Homo sapiens
ccaggctggagtgcagtg

SEQ ID NO: 2375737 - DNA, 21 bp, Homo sapiens
ccaggctggagtgcagtggca

SEQ ID NO: 2375738 - DNA, 22 bp, Homo sapiens
ccaggctgtaagcattctgagc

SEQ ID NO: 2375739 - DNA, 18 bp, Homo sapiens
ccaggcttctgctggggc

SEQ ID NO: 2375740 - DNA, 20 bp, Homo sapiens
ccaggcttctgctggggcct

SEQ ID NO: 2375741 - DNA, 13 bp, Homo sapiens
ccaggcttttgct

SEQ ID NO: 2375742 - DNA, 21 bp, Homo sapiens
ccagggaatccaagcctccac

SEQ ID NO: 2375743 - DNA, 19 bp, Homo sapiens
ccagggacacacagcctag

SEQ ID NO: 2375744 - DNA, 14 bp, Homo sapiens
ccagggaccggcgg

SEQ ID NO: 2375745 - DNA, 23 bp, Homo sapiens
ccagggagtccagggtttctctg

SEQ ID NO: 2375746 - DNA, 17 bp, Homo sapiens
ccagggatttgcctcac

SEQ ID NO: 2375747 - DNA, 21 bp, Homo sapiens
ccagggcaagggttaaggcct

SEQ ID NO: 2375748 - DNA, 23 bp, Homo sapiens
ccagggcaagggttaaggcctga

SEQ ID NO: 2375749 - DNA, 13 bp, Homo sapiens
ccagggcagggtc

SEQ ID NO: 2375750 - DNA, 21 bp, Homo sapiens
ccagggcatcttgctggctac

SEQ ID NO: 2375751 - DNA, 12 bp, Homo sapiens
ccagggcctctc

SEQ ID NO: 2375752 - DNA, 17 bp, Homo sapiens
ccagggctccctcctgg

SEQ ID NO: 2375753 - DNA, 14 bp, Homo sapiens
ccagggctgcccct

SEQ ID NO: 2375754 - DNA, 18 bp, Homo sapiens
ccaggggaaggccctgag

SEQ ID NO: 2375755 - DNA, 19 bp, Homo sapiens
ccaggtatccaaaaatgtg

SEQ ID NO: 2375756 - DNA, 17 bp, Homo sapiens
ccaggtggcaaagtact

SEQ ID NO: 2375757 - DNA, 13 bp, Homo sapiens
ccaggtgggagcg

SEQ ID NO: 2375758 - DNA, 13 bp, Homo sapiens
ccagtactgggaa

SEQ ID NO: 2375759 - DNA, 18 bp, Homo sapiens
ccagtccaccctgcctgc

SEQ ID NO: 2375760 - DNA, 19 bp, Homo sapiens
ccagtccccatttctgcct

SEQ ID NO: 2375761 - DNA, 20 bp, Homo sapiens
ccagtccccatttctgcctc

SEQ ID NO: 2375762 - DNA, 18 bp, Homo sapiens
ccagtccctgtccggaat

SEQ ID NO: 2375763 - DNA, 15 bp, Homo sapiens
ccagtcctgctacct

SEQ ID NO: 2375764 - DNA, 21 bp, Homo sapiens
ccagtgaacattcccagccca

SEQ ID NO: 2375765 - DNA, 15 bp, Homo sapiens
ccagtgaactcctgc

SEQ ID NO: 2375766 - DNA, 17 bp, Homo sapiens
ccagtgaactcctgcca

SEQ ID NO: 2375767 - DNA, 21 bp, Homo sapiens
ccagtgagactgccccacgga

SEQ ID NO: 2375768 - DNA, 16 bp, Homo sapiens
ccagtgaggatgacag

SEQ ID NO: 2375769 - DNA, 17 bp, Homo sapiens
ccagtgaggatgacagt

SEQ ID NO: 2375770 - DNA, 18 bp, Homo sapiens
ccagtgaggatgacagtg

SEQ ID NO: 2375771 - DNA, 15 bp, Homo sapiens
ccagtgctctgcctc

SEQ ID NO: 2375772 - DNA, 14 bp, Homo sapiens
ccagtggattccca

SEQ ID NO: 2375773 - DNA, 12 bp, Homo sapiens
ccagttcaaaaa

SEQ ID NO: 2375774 - DNA, 16 bp, Homo sapiens
ccagttcctcttttgt

SEQ ID NO: 2375775 - DNA, 17 bp, Homo sapiens
ccagttgatctgctctg

SEQ ID NO: 2375776 - DNA, 13 bp, Homo sapiens
ccagttgggctcg

SEQ ID NO: 2375777 - DNA, 21 bp, Homo sapiens
ccagttgggctcgcactgccc

SEQ ID NO: 2375778 - DNA, 18 bp, Homo sapiens
ccataaacggttcctggt

SEQ ID NO: 2375779 - DNA, 22 bp, Homo sapiens
ccataatgagatgtgagccttg

SEQ ID NO: 2375780 - DNA, 12 bp, Homo sapiens
ccatacacagag

SEQ ID NO: 2375781 - DNA, 14 bp, Homo sapiens
ccatacaccccctc

SEQ ID NO: 2375782 - DNA, 19 bp, Homo sapiens
ccatacaccccctcttctg

SEQ ID NO: 2375783 - DNA, 21 bp, Homo sapiens
ccatactccttgcttcctgat

SEQ ID NO: 2375784 - DNA, 14 bp, Homo sapiens
ccatacttctctca

SEQ ID NO: 2375785 - DNA, 17 bp, Homo sapiens
ccatagagatgagccca

SEQ ID NO: 2375786 - DNA, 18 bp, Homo sapiens
ccatagtcttaactggtc

SEQ ID NO: 2375787 - DNA, 14 bp, Homo sapiens
ccatatgaattgta

SEQ ID NO: 2375788 - DNA, 16 bp, Homo sapiens
ccatatgcagaaatag

SEQ ID NO: 2375789 - DNA, 16 bp, Homo sapiens
ccatcaccgctgggtg

SEQ ID NO: 2375790 - DNA, 19 bp, Homo sapiens
ccatcaccgctgggtggtt

SEQ ID NO: 2375791 - DNA, 18 bp, Homo sapiens
ccatcagaacctgagcta

SEQ ID NO: 2375792 - DNA, 16 bp, Homo sapiens
ccatccagtggactct

SEQ ID NO: 2375793 - DNA, 14 bp, Homo sapiens
ccatcctccctcca

SEQ ID NO: 2375794 - DNA, 11 bp, Homo sapiens
ccatcctgcca

SEQ ID NO: 2375795 - DNA, 12 bp, Homo sapiens
ccatcctggcta

SEQ ID NO: 2375796 - DNA, 20 bp, Homo sapiens
ccatctcccaaggctgccag

SEQ ID NO: 2375797 - DNA, 14 bp, Homo sapiens
ccatctccctgcct

SEQ ID NO: 2375798 - DNA, 17 bp, Homo sapiens
ccatctccctgcctggc

SEQ ID NO: 2375799 - DNA, 22 bp, Homo sapiens
ccatctcgctccctcccaggac

SEQ ID NO: 2375800 - DNA, 12 bp, Homo sapiens
ccatctgcaccc

SEQ ID NO: 2375801 - DNA, 17 bp, Homo sapiens
ccatctgcaccccttct

SEQ ID NO: 2375802 - DNA, 15 bp, Homo sapiens
ccatctgtccagctg

SEQ ID NO: 2375803 - DNA, 15 bp, Homo sapiens
ccatctttccatcca

SEQ ID NO: 2375804 - DNA, 22 bp, Homo sapiens
ccatgaacttgatacgtccgtg

SEQ ID NO: 2375805 - DNA, 18 bp, Homo sapiens
ccatgaatctctgcctct

SEQ ID NO: 2375806 - DNA, 17 bp, Homo sapiens
ccatgacagaggctgca

SEQ ID NO: 2375807 - DNA, 20 bp, Homo sapiens
ccatgacagaggctgcaccc

SEQ ID NO: 2375808 - DNA, 24 bp, Homo sapiens
ccatgatcagacatacagctgcct

SEQ ID NO: 2375809 - DNA, 16 bp, Homo sapiens
ccatgcaggaggtgga

SEQ ID NO: 2375810 - DNA, 14 bp, Homo sapiens
ccatgccagctggc

SEQ ID NO: 2375811 - DNA, 15 bp, Homo sapiens
ccctccattgggcac

SEQ ID NO: 2375812 - DNA, 15 bp, Homo sapiens
ccctcccaccctgcg

SEQ ID NO: 2375813 - DNA, 14 bp, Homo sapiens
ccctcccaggactc

SEQ ID NO: 2375814 - DNA, 11 bp, Homo sapiens
ccctcccatgg

SEQ ID NO: 2375815 - DNA, 11 bp, Homo sapiens
ccctccccaga

SEQ ID NO: 2375816 - DNA, 12 bp, Homo sapiens
ccctccccagaa

SEQ ID NO: 2375817 - DNA, 22 bp, Homo sapiens
ccctccccttcgtgtttccccc

SEQ ID NO: 2375818 - DNA, 20 bp, Homo sapiens
ccctccctgcctgagggcag

SEQ ID NO: 2375819 - DNA, 18 bp, Homo sapiens
ccctccggactggtgccc

SEQ ID NO: 2375820 - DNA, 21 bp, Homo sapiens
ccctcctagctctcccagtga

SEQ ID NO: 2375821 - DNA, 16 bp, Homo sapiens
ccctcctccactccac

SEQ ID NO: 2375822 - DNA, 15 bp, Homo sapiens
ccctcctccaggcct

SEQ ID NO: 2375823 - DNA, 23 bp, Homo sapiens
ccctcctgaaccgcacagctcag

SEQ ID NO: 2375824 - DNA, 20 bp, Homo sapiens
ccctcctgcacacagaatgc

SEQ ID NO: 2375825 - DNA, 18 bp, Homo sapiens
ccctcctttcccttattg

SEQ ID NO: 2375826 - DNA, 16 bp, Homo sapiens
ccctcgtcccatccag

SEQ ID NO: 2375827 - DNA, 14 bp, Homo sapiens
ccctctcagaacat

SEQ ID NO: 2375828 - DNA, 12 bp, Homo sapiens
ccctctcccacc

SEQ ID NO: 2375829 - DNA, 22 bp, Homo sapiens
ccctctcccttgggctctgatg

SEQ ID NO: 2375830 - DNA, 19 bp, Homo sapiens
ccctctcctctcccccagg

SEQ ID NO: 2375831 - DNA, 23 bp, Homo sapiens
ccctctgggcacgcctgctggcc

SEQ ID NO: 2375832 - DNA, 14 bp, Homo sapiens
ccctcttcctgtga

SEQ ID NO: 2375833 - DNA, 13 bp, Homo sapiens
ccctcttgcccat

SEQ ID NO: 2375834 - DNA, 22 bp, Homo sapiens
ccctcttgcccatcctgactga

SEQ ID NO: 2375835 - DNA, 21 bp, Homo sapiens
ccctgaaatattttctacttt

SEQ ID NO: 2375836 - DNA, 15 bp, Homo sapiens
ccctgactcctctgg

SEQ ID NO: 2375837 - DNA, 23 bp, Homo sapiens
ccctgactcctctggctttccca

SEQ ID NO: 2375838 - DNA, 12 bp, Homo sapiens
ccctgaggccta

SEQ ID NO: 2375839 - DNA, 19 bp, Homo sapiens
ccctgaggcctagactctg

SEQ ID NO: 2375840 - DNA, 22 bp, Homo sapiens
ccctgaggcggaggctgtgctc

SEQ ID NO: 2375841 - DNA, 23 bp, Homo sapiens
ccctgaggcggaggctgtgctcc

SEQ ID NO: 2375842 - DNA, 23 bp, Homo sapiens
ccctgagtgcgggctgaggccag

SEQ ID NO: 2375843 - DNA, 14 bp, Homo sapiens
ccctgcacgtcatg

SEQ ID NO: 2375844 - DNA, 14 bp, Homo sapiens
ccctgcagaaccca

SEQ ID NO: 2375845 - DNA, 13 bp, Homo sapiens
ccctgcagacctc

SEQ ID NO: 2375846 - DNA, 17 bp, Homo sapiens
ccctgcagacctcaagc

SEQ ID NO: 2375847 - DNA, 18 bp, Homo sapiens
ccctgcagacctcaagcc

SEQ ID NO: 2375848 - DNA, 21 bp, Homo sapiens
ccctgcagacctcaagccatc

SEQ ID NO: 2375849 - DNA, 20 bp, Homo sapiens
ccctgcagatgccaccctag

SEQ ID NO: 2375850 - DNA, 12 bp, Homo sapiens
ccctgcagccca

SEQ ID NO: 2375851 - DNA, 13 bp, Homo sapiens
ccctgcagcccac

SEQ ID NO: 2375852 - DNA, 10 bp, Homo sapiens
ccctgccaca

SEQ ID NO: 2375853 - DNA, 20 bp, Homo sapiens
ccctgccacagccagaggag

SEQ ID NO: 2375854 - DNA, 13 bp, Homo sapiens
ccctgccctgcac

SEQ ID NO: 2375855 - DNA, 12 bp, Homo sapiens
ccctgcctctca

SEQ ID NO: 2375856 - DNA, 13 bp, Homo sapiens
ccctgcctgaggg

SEQ ID NO: 2375857 - DNA, 16 bp, Homo sapiens
ccctgcgctctctttg

SEQ ID NO: 2375858 - DNA, 22 bp, Homo sapiens
ccctgcgctctctttgcaactg

SEQ ID NO: 2375859 - DNA, 13 bp, Homo sapiens
ccctgcgggccag

SEQ ID NO: 2375860 - DNA, 15 bp, Homo sapiens
ccctgcgggccaggg

SEQ ID NO: 2375861 - DNA, 16 bp, Homo sapiens
ccctgctcagtaaagc

SEQ ID NO: 2375862 - DNA, 15 bp, Homo sapiens
ccctgctcatccact

SEQ ID NO: 2375863 - DNA, 17 bp, Homo sapiens
ccctggaagagcccagt

SEQ ID NO: 2375864 - DNA, 18 bp, Homo sapiens
ccctggaagagcccagtc

SEQ ID NO: 2375865 - DNA, 15 bp, Homo sapiens
ccctggacaggcagc

SEQ ID NO: 2375866 - DNA, 17 bp, Homo sapiens
ccctggacttgcctctg

SEQ ID NO: 2375867 - DNA, 14 bp, Homo sapiens
ccctggagaagcac

SEQ ID NO: 2375868 - DNA, 14 bp, Homo sapiens
ccctggagtcaggg

SEQ ID NO: 2375869 - DNA, 21 bp, Homo sapiens
ccctggatagacgagttgatt

SEQ ID NO: 2375870 - DNA, 17 bp, Homo sapiens
ccctggcccctctccct

SEQ ID NO: 2375871 - DNA, 18 bp, Homo sapiens
ccctggcccctctccctt

SEQ ID NO: 2375872 - DNA, 20 bp, Homo sapiens
ccctggccgcttctccccag

SEQ ID NO: 2375873 - DNA, 12 bp, Homo sapiens
ccctggctccct

SEQ ID NO: 2375874 - DNA, 15 bp, Homo sapiens
ccctggctccctcct

SEQ ID NO: 2375875 - DNA, 18 bp, Homo sapiens
ccctggctccctcctcca

SEQ ID NO: 2375876 - DNA, 14 bp, Homo sapiens
ccctggctgctgcc

SEQ ID NO: 2375877 - DNA, 18 bp, Homo sapiens
ccctggctgctgccccca

SEQ ID NO: 2375878 - DNA, 18 bp, Homo sapiens
ccctgggacacagaccca

SEQ ID NO: 2375879 - DNA, 22 bp, Homo sapiens
ccctgggagaatcgctcctgca

SEQ ID NO: 2375880 - DNA, 12 bp, Homo sapiens
ccctgggcaggg

SEQ ID NO: 2375881 - DNA, 21 bp, Homo sapiens
ccctgggctgccaccagcccc

SEQ ID NO: 2375882 - DNA, 17 bp, Homo sapiens
ccctgggcttggcctgc

SEQ ID NO: 2375883 - DNA, 19 bp, Homo sapiens
ccctgggcttggcctgctg

SEQ ID NO: 2375884 - DNA, 21 bp, Homo sapiens
ccctgggcttggcctgctgtg

SEQ ID NO: 2375885 - DNA, 20 bp, Homo sapiens
ccctggggcctgactgctca

SEQ ID NO: 2375886 - DNA, 20 bp, Homo sapiens
ccctgggtgggctctgtgca

SEQ ID NO: 2375887 - DNA, 13 bp, Homo sapiens
ccctgtcccaggc

SEQ ID NO: 2375888 - DNA, 15 bp, Homo sapiens
ccctgtcccaggccg

SEQ ID NO: 2375889 - DNA, 21 bp, Homo sapiens
ccctgtcccaggccggcccag

SEQ ID NO: 2375890 - DNA, 22 bp, Homo sapiens
ccctgtccggaatgccacccac

SEQ ID NO: 2375891 - DNA, 14 bp, Homo sapiens
ccctgtctgtccct

SEQ ID NO: 2375892 - DNA, 16 bp, Homo sapiens
ccctgtgtgtgtcccc

SEQ ID NO: 2375893 - DNA, 21 bp, Homo sapiens
cccttactggcttacctcctc

SEQ ID NO: 2375894 - DNA, 19 bp, Homo sapiens
cccttagcaccttcagggc

SEQ ID NO: 2375895 - DNA, 20 bp, Homo sapiens
cccttcatcttcctgtgtcc

SEQ ID NO: 2375896 - DNA, 18 bp, Homo sapiens
cccttccaaatgtccctc

SEQ ID NO: 2375897 - DNA, 13 bp, Homo sapiens
cccttccagatca

SEQ ID NO: 2375898 - DNA, 22 bp, Homo sapiens
cccttcctgctgcgcagttctc

SEQ ID NO: 2375899 - DNA, 17 bp, Homo sapiens
cccttccttttccctgc

SEQ ID NO: 2375900 - DNA, 15 bp, Homo sapiens
cccttctacaaggac

SEQ ID NO: 2375901 - DNA, 18 bp, Homo sapiens
cccttgaaactttgggaa

SEQ ID NO: 2375902 - DNA, 16 bp, Homo sapiens
cccttgaatctgcagg

SEQ ID NO: 2375903 - DNA, 12 bp, Homo sapiens
cccttgcctccc

SEQ ID NO: 2375904 - DNA, 13 bp, Homo sapiens
cccttgcctcccc

SEQ ID NO: 2375905 - DNA, 20 bp, Homo sapiens
cccttgcctttcgaggcctg

SEQ ID NO: 2375906 - DNA, 16 bp, Homo sapiens
cccttgctggccccag

SEQ ID NO: 2375907 - DNA, 20 bp, Homo sapiens
cccttgctggccccagccct

SEQ ID NO: 2375908 - DNA, 16 bp, Homo sapiens
cccttggcttctgtga

SEQ ID NO: 2375909 - DNA, 16 bp, Homo sapiens
cccttgggctctgatg

SEQ ID NO: 2375910 - DNA, 12 bp, Homo sapiens
ccctttcctgtc

SEQ ID NO: 2375911 - DNA, 14 bp, Homo sapiens
ccctttcctgtccc

SEQ ID NO: 2375912 - DNA, 23 bp, Homo sapiens
ccctttgtctgtcaatcacagtc

SEQ ID NO: 2375913 - DNA, 23 bp, Homo sapiens
ccctttgtgtgctctccattctg

SEQ ID NO: 2375914 - DNA, 15 bp, Homo sapiens
ccgactagcaggcat

SEQ ID NO: 2375915 - DNA, 13 bp, Homo sapiens
ccgagagaggcgc

SEQ ID NO: 2375916 - DNA, 13 bp, Homo sapiens
ccgagagggagag

SEQ ID NO: 2375917 - DNA, 23 bp, Homo sapiens
ccgagccacgcagtgcctggagt

SEQ ID NO: 2375918 - DNA, 21 bp, Homo sapiens
ccgagctactctcttgccagc

SEQ ID NO: 2375919 - DNA, 18 bp, Homo sapiens
ccgagtagaaaatgtgac

SEQ ID NO: 2375920 - DNA, 21 bp, Homo sapiens
ccgagtagaaaatgtgaccct

SEQ ID NO: 2375921 - DNA, 18 bp, Homo sapiens
ccgcacagctcaggaggc

SEQ ID NO: 2375922 - DNA, 15 bp, Homo sapiens
ccgccagcctcctct

SEQ ID NO: 2375923 - DNA, 18 bp, Homo sapiens
ccgccagcctcctctgga

SEQ ID NO: 2375924 - DNA, 12 bp, Homo sapiens
ccgccccagagt

SEQ ID NO: 2375925 - DNA, 23 bp, Homo sapiens
ccgcccctggccgcgctccgggc

SEQ ID NO: 2375926 - DNA, 13 bp, Homo sapiens
ccttgtcgtggga

SEQ ID NO: 2375927 - DNA, 15 bp, Homo sapiens
ccttgtctaaagatc

SEQ ID NO: 2375928 - DNA, 23 bp, Homo sapiens
ccttgtttgagtttttcctccca

SEQ ID NO: 2375929 - DNA, 20 bp, Homo sapiens
cctttaaaaaaatttaagtg

SEQ ID NO: 2375930 - DNA, 14 bp, Homo sapiens
cctttaaaatattg

SEQ ID NO: 2375931 - DNA, 21 bp, Homo sapiens
cctttaccctctttgctgcag

SEQ ID NO: 2375932 - DNA, 17 bp, Homo sapiens
cctttagatctctgaag

SEQ ID NO: 2375933 - DNA, 12 bp, Homo sapiens
cctttccttccc

SEQ ID NO: 2375934 - DNA, 18 bp, Homo sapiens
cctttcgaggcctgaagc

SEQ ID NO: 2375935 - DNA, 22 bp, Homo sapiens
cctttctcgtggtagaagccag

SEQ ID NO: 2375936 - DNA, 14 bp, Homo sapiens
cctttctggctctc

SEQ ID NO: 2375937 - DNA, 14 bp, Homo sapiens
cctttctgtagcct

SEQ ID NO: 2375938 - DNA, 16 bp, Homo sapiens
cctttcttctgtgtta

SEQ ID NO: 2375939 - DNA, 13 bp, Homo sapiens
cctttgaatgtaa

SEQ ID NO: 2375940 - DNA, 17 bp, Homo sapiens
cctttgagacagtttct

SEQ ID NO: 2375941 - DNA, 16 bp, Homo sapiens
cctttgcccagaaaga

SEQ ID NO: 2375942 - DNA, 20 bp, Homo sapiens
cctttgtctgtcaatcacag

SEQ ID NO: 2375943 - DNA, 12 bp, Homo sapiens
cctttgtgctgc

SEQ ID NO: 2375944 - DNA, 14 bp, Homo sapiens
cctttgtgtgctct

SEQ ID NO: 2375945 - DNA, 18 bp, Homo sapiens
ccttttcagggctggctc

SEQ ID NO: 2375946 - DNA, 19 bp, Homo sapiens
ccttttctgtggctggctc

SEQ ID NO: 2375947 - DNA, 15 bp, Homo sapiens
cctttttcctctcca

SEQ ID NO: 2375948 - DNA, 13 bp, Homo sapiens
cctttttgacact

SEQ ID NO: 2375949 - DNA, 20 bp, Homo sapiens
ccttttttaagatttttctc

SEQ ID NO: 2375950 - DNA, 16 bp, Homo sapiens
ccttttttttttcttg

SEQ ID NO: 2375951 - DNA, 15 bp, Homo sapiens
cgaaaagagtcttcc

SEQ ID NO: 2375952 - DNA, 14 bp, Homo sapiens
cgaaactaagccag

SEQ ID NO: 2375953 - DNA, 15 bp, Homo sapiens
cgaaactaagccagg

SEQ ID NO: 2375954 - DNA, 16 bp, Homo sapiens
cgaaataacaatgtta

SEQ ID NO: 2375955 - DNA, 20 bp, Homo sapiens
cgaaataacaatgttaagga

SEQ ID NO: 2375956 - DNA, 15 bp, Homo sapiens
cgaaatatcaaagtc

SEQ ID NO: 2375957 - DNA, 18 bp, Homo sapiens
cgaaggaacctctcgcca

SEQ ID NO: 2375958 - DNA, 15 bp, Homo sapiens
cgaatctcaaaatta

SEQ ID NO: 2375959 - DNA, 14 bp, Homo sapiens
cgaatggtctttgc

SEQ ID NO: 2375960 - DNA, 17 bp, Homo sapiens
cgaatggtctttgctcc

SEQ ID NO: 2375961 - DNA, 19 bp, Homo sapiens
cgaatggtctttgctccag

SEQ ID NO: 2375962 - DNA, 18 bp, Homo sapiens
cgacctcaagtgtcctga

SEQ ID NO: 2375963 - DNA, 19 bp, Homo sapiens
cgaccttgcaacctcacct

SEQ ID NO: 2375964 - DNA, 17 bp, Homo sapiens
cgactgaaaatattgtt

SEQ ID NO: 2375965 - DNA, 15 bp, Homo sapiens
cgagaggccagttga

SEQ ID NO: 2375966 - DNA, 23 bp, Homo sapiens
cgagcaaacccagaggtggatgt

SEQ ID NO: 2375967 - DNA, 21 bp, Homo sapiens
cgagccacaagctgcactgtg

SEQ ID NO: 2375968 - DNA, 22 bp, Homo sapiens
cgagccacaagctgcactgtga

SEQ ID NO: 2375969 - DNA, 17 bp, Homo sapiens
cgagccacgcagtgcct

SEQ ID NO: 2375970 - DNA, 21 bp, Homo sapiens
cgagctactctcttgccagca

SEQ ID NO: 2375971 - DNA, 22 bp, Homo sapiens
cgagctactctcttgccagcat

SEQ ID NO: 2375972 - DNA, 11 bp, Homo sapiens
cgaggcctgaa

SEQ ID NO: 2375973 - DNA, 13 bp, Homo sapiens
cgagggcagctgc

SEQ ID NO: 2375974 - DNA, 12 bp, Homo sapiens
cgaggggagggc

SEQ ID NO: 2375975 - DNA, 14 bp, Homo sapiens
cgaggggagggcag

SEQ ID NO: 2375976 - DNA, 14 bp, Homo sapiens
cgaggtcaggagat

SEQ ID NO: 2375977 - DNA, 16 bp, Homo sapiens
cgaggtgtcaccctgc

SEQ ID NO: 2375978 - DNA, 20 bp, Homo sapiens
cgagtagaaaatgtgaccct

SEQ ID NO: 2375979 - DNA, 13 bp, Homo sapiens
cgagtccaaggcc

SEQ ID NO: 2375980 - DNA, 13 bp, Homo sapiens
cgagtctggggac

SEQ ID NO: 2375981 - DNA, 13 bp, Homo sapiens
cgatctctcctgg

SEQ ID NO: 2375982 - DNA, 10 bp, Homo sapiens
cgatgcattt

SEQ ID NO: 2375983 - DNA, 14 bp, Homo sapiens
cgatgcatttaata

SEQ ID NO: 2375984 - DNA, 15 bp, Homo sapiens
cgatgcatttaataa

SEQ ID NO: 2375985 - DNA, 16 bp, Homo sapiens
cgatgcatttaataaa

SEQ ID NO: 2375986 - DNA, 20 bp, Homo sapiens
cgatttgcaggattcccttc

SEQ ID NO: 2375987 - DNA, 23 bp, Homo sapiens
cgatttgcaggattcccttctgg

SEQ ID NO: 2375988 - DNA, 17 bp, Homo sapiens
cgattttcaagattcta

SEQ ID NO: 2375989 - DNA, 20 bp, Homo sapiens
cgattttcaagattctaaag

SEQ ID NO: 2375990 - DNA, 21 bp, Homo sapiens
cgcaccggagtgtctggaatt

SEQ ID NO: 2375991 - DNA, 18 bp, Homo sapiens
cgcactgcccacatggga

SEQ ID NO: 2375992 - DNA, 14 bp, Homo sapiens
cgcagggccatgca

SEQ ID NO: 2375993 - DNA, 16 bp, Homo sapiens
cgcagggccatgcaga

SEQ ID NO: 2375994 - DNA, 14 bp, Homo sapiens
cgcaggtgggctgg

SEQ ID NO: 2375995 - DNA, 14 bp, Homo sapiens
cgccaacagccccc

SEQ ID NO: 2375996 - DNA, 14 bp, Homo sapiens
cgccactccctggg

SEQ ID NO: 2375997 - DNA, 13 bp, Homo sapiens
cgccagcctcctc

SEQ ID NO: 2375998 - DNA, 18 bp, Homo sapiens
cgccagcctcctctggac

SEQ ID NO: 2375999 - DNA, 23 bp, Homo sapiens
cgccagcctcctctggacggcag

SEQ ID NO: 2376000 - DNA, 14 bp, Homo sapiens
cgccaggaagccag

SEQ ID NO: 2376001 - DNA, 18 bp, Homo sapiens
cgccaggaagccagagcc

SEQ ID NO: 2376002 - DNA, 21 bp, Homo sapiens
cgccaggaagccagagcccca

SEQ ID NO: 2376003 - DNA, 23 bp, Homo sapiens
cgccatgtgatggacactccagg

SEQ ID NO: 2376004 - DNA, 13 bp, Homo sapiens
cgcccatgctgtc

SEQ ID NO: 2376005 - DNA, 16 bp, Homo sapiens
cgccccagagtggccc

SEQ ID NO: 2376006 - DNA, 18 bp, Homo sapiens
cgcccccagtccccaccc

SEQ ID NO: 2376007 - DNA, 22 bp, Homo sapiens
cgcccccagtccccacccctgc

SEQ ID NO: 2376008 - DNA, 19 bp, Homo sapiens
cgccccgttgtgagctgga

SEQ ID NO: 2376009 - DNA, 17 bp, Homo sapiens
cgcccgactagcaggca

SEQ ID NO: 2376010 - DNA, 19 bp, Homo sapiens
cgcccgactagcaggcatg

SEQ ID NO: 2376011 - DNA, 11 bp, Homo sapiens
cgccctccttt

SEQ ID NO: 2376012 - DNA, 15 bp, Homo sapiens
cgcctctcctcggtt

SEQ ID NO: 2376013 - DNA, 15 bp, Homo sapiens
cgcctgagtcagtgc

SEQ ID NO: 2376014 - DNA, 17 bp, Homo sapiens
cgcctgagtcagtgctc

SEQ ID NO: 2376015 - DNA, 21 bp, Homo sapiens
cgcctgagtcagtgctctcag

SEQ ID NO: 2376016 - DNA, 18 bp, Homo sapiens
cgcctgcaggagagagca

SEQ ID NO: 2376017 - DNA, 18 bp, Homo sapiens
cgcctggccaggagcagg

SEQ ID NO: 2376018 - DNA, 14 bp, Homo sapiens
cgcgccgatgccac

SEQ ID NO: 2376019 - DNA, 18 bp, Homo sapiens
cgcgccgatgccaccggc

SEQ ID NO: 2376020 - DNA, 13 bp, Homo sapiens
cgcgtagagagcc

SEQ ID NO: 2376021 - DNA, 13 bp, Homo sapiens
cgcgtctgcccca

SEQ ID NO: 2376022 - DNA, 17 bp, Homo sapiens
cgcgtgccgtggcacca

SEQ ID NO: 2376023 - DNA, 15 bp, Homo sapiens
cgctcaccgctggcc

SEQ ID NO: 2376024 - DNA, 22 bp, Homo sapiens
cgctcaccgctggcccttagag

SEQ ID NO: 2376025 - DNA, 23 bp, Homo sapiens
cgctcaccgctggcccttagaga

SEQ ID NO: 2376026 - DNA, 12 bp, Homo sapiens
cgctctggacat

SEQ ID NO: 2376027 - DNA, 23 bp, Homo sapiens
cgctgccagccttgagccctggc

SEQ ID NO: 2376028 - DNA, 18 bp, Homo sapiens
cgctgccatcaccgctgg

SEQ ID NO: 2376029 - DNA, 19 bp, Homo sapiens
cgctgccatcaccgctggg

SEQ ID NO: 2376030 - DNA, 18 bp, Homo sapiens
cgctgcccacctgccggc

SEQ ID NO: 2376031 - DNA, 19 bp, Homo sapiens
cgctgcccacctgccggcc

SEQ ID NO: 2376032 - DNA, 22 bp, Homo sapiens
cgctgggtggttttttccccct

SEQ ID NO: 2376033 - DNA, 13 bp, Homo sapiens
cgcttctccccag

SEQ ID NO: 2376034 - DNA, 16 bp, Homo sapiens
cgcttctccccagagc

SEQ ID NO: 2376035 - DNA, 14 bp, Homo sapiens
cgctttcctgaatc

SEQ ID NO: 2376036 - DNA, 17 bp, Homo sapiens
cggaaggggttcctcaa

SEQ ID NO: 2376037 - DNA, 20 bp, Homo sapiens
cggacccggaggccgaggcc

SEQ ID NO: 2376038 - DNA, 17 bp, Homo sapiens
cggaccgcgtagagagc

SEQ ID NO: 2376039 - DNA, 14 bp, Homo sapiens
cggactctgcccct

SEQ ID NO: 2376040 - DNA, 12 bp, Homo sapiens
cggactgccaaa

SEQ ID NO: 2376041 - DNA, 13 bp, Homo sapiens
cggactgccaaat

SEQ ID NO: 2376042 - DNA, 14 bp, Homo sapiens
ctctctcaaaagag

SEQ ID NO: 2376043 - DNA, 12 bp, Homo sapiens
ctctctctgggt

SEQ ID NO: 2376044 - DNA, 21 bp, Homo sapiens
ctctctgatgtcccagtgctc

SEQ ID NO: 2376045 - DNA, 13 bp, Homo sapiens
ctctctgccctgt

SEQ ID NO: 2376046 - DNA, 20 bp, Homo sapiens
ctctctggaagcccctgggc

SEQ ID NO: 2376047 - DNA, 19 bp, Homo sapiens
ctctcttctcagagtggtg

SEQ ID NO: 2376048 - DNA, 14 bp, Homo sapiens
ctctcttgccagca

SEQ ID NO: 2376049 - DNA, 17 bp, Homo sapiens
ctctctttaaccctccc

SEQ ID NO: 2376050 - DNA, 17 bp, Homo sapiens
ctctctttcctccaccc

SEQ ID NO: 2376051 - DNA, 19 bp, Homo sapiens
ctctctttcctccacccat

SEQ ID NO: 2376052 - DNA, 23 bp, Homo sapiens
ctctgaaatcttcccatgcattc

SEQ ID NO: 2376053 - DNA, 19 bp, Homo sapiens
ctctgaagctaattgtact

SEQ ID NO: 2376054 - DNA, 20 bp, Homo sapiens
ctctgaccccagcattctca

SEQ ID NO: 2376055 - DNA, 15 bp, Homo sapiens
ctctgacgcttgtga

SEQ ID NO: 2376056 - DNA, 20 bp, Homo sapiens
ctctgacgcttgtgacagtg

SEQ ID NO: 2376057 - DNA, 23 bp, Homo sapiens
ctctgacgcttgtgacagtgcct

SEQ ID NO: 2376058 - DNA, 15 bp, Homo sapiens
ctctgagtaaccctt

SEQ ID NO: 2376059 - DNA, 22 bp, Homo sapiens
ctctgatggttcttcacctcct

SEQ ID NO: 2376060 - DNA, 19 bp, Homo sapiens
ctctgcaagcttcttgctg

SEQ ID NO: 2376061 - DNA, 16 bp, Homo sapiens
ctctgccatcttcagg

SEQ ID NO: 2376062 - DNA, 20 bp, Homo sapiens
ctctgccccaccttgccagg

SEQ ID NO: 2376063 - DNA, 21 bp, Homo sapiens
ctctgccccaccttgccaggg

SEQ ID NO: 2376064 - DNA, 14 bp, Homo sapiens
ctctgccctgtgta

SEQ ID NO: 2376065 - DNA, 17 bp, Homo sapiens
ctctgcctacagccagg

SEQ ID NO: 2376066 - DNA, 22 bp, Homo sapiens
ctctgcctcagacgttgcctga

SEQ ID NO: 2376067 - DNA, 21 bp, Homo sapiens
ctctgcctctcccaggctgtc

SEQ ID NO: 2376068 - DNA, 11 bp, Homo sapiens
ctctgcctgcc

SEQ ID NO: 2376069 - DNA, 23 bp, Homo sapiens
ctctgcctttatgatgctaagct

SEQ ID NO: 2376070 - DNA, 23 bp, Homo sapiens
ctctgctatatataaaacggtgc

SEQ ID NO: 2376071 - DNA, 22 bp, Homo sapiens
ctctgctcaccgcccatcaggg

SEQ ID NO: 2376072 - DNA, 14 bp, Homo sapiens
ctctggacagcaga

SEQ ID NO: 2376073 - DNA, 21 bp, Homo sapiens
ctctggacagcagaagcctcc

SEQ ID NO: 2376074 - DNA, 13 bp, Homo sapiens
ctctggacagcca

SEQ ID NO: 2376075 - DNA, 12 bp, Homo sapiens
ctctggcccaga

SEQ ID NO: 2376076 - DNA, 15 bp, Homo sapiens
ctctggcccagaaag

SEQ ID NO: 2376077 - DNA, 21 bp, Homo sapiens
ctctggcccagaaagcctctc

SEQ ID NO: 2376078 - DNA, 23 bp, Homo sapiens
ctctggcccagaaagcctctctc

SEQ ID NO: 2376079 - DNA, 14 bp, Homo sapiens
ctctggctttccca

SEQ ID NO: 2376080 - DNA, 16 bp, Homo sapiens
ctctggctttcccagg

SEQ ID NO: 2376081 - DNA, 18 bp, Homo sapiens
ctctgggagtaatacttt

SEQ ID NO: 2376082 - DNA, 22 bp, Homo sapiens
ctctgggcacgcctgctggccg

SEQ ID NO: 2376083 - DNA, 18 bp, Homo sapiens
ctctgtcccccaggctgg

SEQ ID NO: 2376084 - DNA, 21 bp, Homo sapiens
ctctgtcccggttcaccttgc

SEQ ID NO: 2376085 - DNA, 20 bp, Homo sapiens
ctctgtctacctggtctggt

SEQ ID NO: 2376086 - DNA, 20 bp, Homo sapiens
ctctgtctaggactgcagtg

SEQ ID NO: 2376087 - DNA, 23 bp, Homo sapiens
ctctgtctaggactgcagtgtgg

SEQ ID NO: 2376088 - DNA, 18 bp, Homo sapiens
ctctgtgagccccacagc

SEQ ID NO: 2376089 - DNA, 22 bp, Homo sapiens
ctcttaaggattaatattcttc

SEQ ID NO: 2376090 - DNA, 21 bp, Homo sapiens
ctcttaagtggtctagtcaag

SEQ ID NO: 2376091 - DNA, 14 bp, Homo sapiens
ctcttactctttcc

SEQ ID NO: 2376092 - DNA, 16 bp, Homo sapiens
ctcttactctttccta

SEQ ID NO: 2376093 - DNA, 13 bp, Homo sapiens
ctcttagctatgt

SEQ ID NO: 2376094 - DNA, 14 bp, Homo sapiens
ctcttagtcccaag

SEQ ID NO: 2376095 - DNA, 22 bp, Homo sapiens
ctcttatcctctctctcttcta

SEQ ID NO: 2376096 - DNA, 21 bp, Homo sapiens
ctcttatctcagtcatgcata

SEQ ID NO: 2376097 - DNA, 22 bp, Homo sapiens
ctcttatctcagtcatgcataa

SEQ ID NO: 2376098 - DNA, 23 bp, Homo sapiens
ctcttatctcagtcatgcataaa

SEQ ID NO: 2376099 - DNA, 20 bp, Homo sapiens
ctcttcaaggaggcccactg

SEQ ID NO: 2376100 - DNA, 17 bp, Homo sapiens
ctcttcactaccctgat

SEQ ID NO: 2376101 - DNA, 13 bp, Homo sapiens
ctcttcatctgcc

SEQ ID NO: 2376102 - DNA, 19 bp, Homo sapiens
ctcttcatggcatcttcaa

SEQ ID NO: 2376103 - DNA, 18 bp, Homo sapiens
ctcttcattattctctgc

SEQ ID NO: 2376104 - DNA, 14 bp, Homo sapiens
ctcttccccagaga

SEQ ID NO: 2376105 - DNA, 15 bp, Homo sapiens
ctcttccccagagag

SEQ ID NO: 2376106 - DNA, 16 bp, Homo sapiens
ctcttccccagagagg

SEQ ID NO: 2376107 - DNA, 19 bp, Homo sapiens
ctcttccccagagaggcac

SEQ ID NO: 2376108 - DNA, 15 bp, Homo sapiens
ctcttccctgaacgt

SEQ ID NO: 2376109 - DNA, 20 bp, Homo sapiens
ctcttccctgaacgttttct

SEQ ID NO: 2376110 - DNA, 21 bp, Homo sapiens
ctcttccctgaacgttttctt

SEQ ID NO: 2376111 - DNA, 20 bp, Homo sapiens
ctcttcctatccctctccta

SEQ ID NO: 2376112 - DNA, 13 bp, Homo sapiens
ctcttcctgtgat

SEQ ID NO: 2376113 - DNA, 21 bp, Homo sapiens
ctcttctacaatacaacacat

SEQ ID NO: 2376114 - DNA, 22 bp, Homo sapiens
ctcttctactcacttttcccac

SEQ ID NO: 2376115 - DNA, 21 bp, Homo sapiens
ctcttctggggcaggctgggc

SEQ ID NO: 2376116 - DNA, 20 bp, Homo sapiens
ctcttcttgaaattttaacc

SEQ ID NO: 2376117 - DNA, 18 bp, Homo sapiens
ctcttctttaagccatag

SEQ ID NO: 2376118 - DNA, 13 bp, Homo sapiens
ctcttgagctggc

SEQ ID NO: 2376119 - DNA, 15 bp, Homo sapiens
ctcttgagctggcct

SEQ ID NO: 2376120 - DNA, 20 bp, Homo sapiens
ctcttgcacagtcactgctc

SEQ ID NO: 2376121 - DNA, 20 bp, Homo sapiens
ctcttgcccatcctgactga

SEQ ID NO: 2376122 - DNA, 16 bp, Homo sapiens
ctcttgtaaagactgg

SEQ ID NO: 2376123 - DNA, 18 bp, Homo sapiens
ctctttaaaaactcactt

SEQ ID NO: 2376124 - DNA, 20 bp, Homo sapiens
ctctttaaactatgttccta

SEQ ID NO: 2376125 - DNA, 17 bp, Homo sapiens
ctctttctgctctgcca

SEQ ID NO: 2376126 - DNA, 13 bp, Homo sapiens
ctctttgctgcag

SEQ ID NO: 2376127 - DNA, 16 bp, Homo sapiens
ctctttgctttctggt

SEQ ID NO: 2376128 - DNA, 20 bp, Homo sapiens
ctcttttaccctggcccctc

SEQ ID NO: 2376129 - DNA, 20 bp, Homo sapiens
ctcttttcccctttcctgtc

SEQ ID NO: 2376130 - DNA, 21 bp, Homo sapiens
ctcttttcccctttcctgtcc

SEQ ID NO: 2376131 - DNA, 14 bp, Homo sapiens
ctcttttgaaagta

SEQ ID NO: 2376132 - DNA, 21 bp, Homo sapiens
ctcttttgcttgccaaagtac

SEQ ID NO: 2376133 - DNA, 13 bp, Homo sapiens
ctctttttgtttg

SEQ ID NO: 2376134 - DNA, 12 bp, Homo sapiens
ctgaaaagaagg

SEQ ID NO: 2376135 - DNA, 17 bp, Homo sapiens
ctgaaaatattgtttta

SEQ ID NO: 2376136 - DNA, 20 bp, Homo sapiens
ctgaaaatattgttttacaa

SEQ ID NO: 2376137 - DNA, 13 bp, Homo sapiens
ctgaaaatgtgct

SEQ ID NO: 2376138 - DNA, 16 bp, Homo sapiens
ctgaaagtagggggct

SEQ ID NO: 2376139 - DNA, 15 bp, Homo sapiens
ctgaaagttttgtaa

SEQ ID NO: 2376140 - DNA, 17 bp, Homo sapiens
ctgaaagttttgtaaaa

SEQ ID NO: 2376141 - DNA, 16 bp, Homo sapiens
ctgaaatattttctac

SEQ ID NO: 2376142 - DNA, 13 bp, Homo sapiens
ctgaaattttaga

SEQ ID NO: 2376143 - DNA, 22 bp, Homo sapiens
ctgaaattttagaaatattcac

SEQ ID NO: 2376144 - DNA, 22 bp, Homo sapiens
ctgaaattttatatgcttactg

SEQ ID NO: 2376145 - DNA, 17 bp, Homo sapiens
ctgaacacagtgtctgt

SEQ ID NO: 2376146 - DNA, 13 bp, Homo sapiens
ctgaacagaagct

SEQ ID NO: 2376147 - DNA, 19 bp, Homo sapiens
ctgaaccactgcttctctt

SEQ ID NO: 2376148 - DNA, 12 bp, Homo sapiens
ctgaaccatgtg

SEQ ID NO: 2376149 - DNA, 15 bp, Homo sapiens
ctgaaccgcacagct

SEQ ID NO: 2376150 - DNA, 21 bp, Homo sapiens
ctgaacgttttcttctttccc

SEQ ID NO: 2376151 - DNA, 20 bp, Homo sapiens
ctgaacttaataactgtgta

SEQ ID NO: 2376152 - DNA, 16 bp, Homo sapiens
ctgaagacctccacat

SEQ ID NO: 2376153 - DNA, 17 bp, Homo sapiens
ctgaaggaaaaacacaa

SEQ ID NO: 2376154 - DNA, 14 bp, Homo sapiens
ctgaagggaccccc

SEQ ID NO: 2376155 - DNA, 22 bp, Homo sapiens
ctgaagtcattgtcgctcagca

SEQ ID NO: 2376156 - DNA, 21 bp, Homo sapiens
ctgtattactgaataatatca

SEQ ID NO: 2376157 - DNA, 20 bp, Homo sapiens
ctgtatttacttgttatgtt

SEQ ID NO: 2376158 - DNA, 23 bp, Homo sapiens
ctgtattttatttagacaagaga

SEQ ID NO: 2376159 - DNA, 21 bp, Homo sapiens
ctgtatttttttttctaagag

SEQ ID NO: 2376160 - DNA, 22 bp, Homo sapiens
ctgtatttttttttctaagaga

SEQ ID NO: 2376161 - DNA, 13 bp, Homo sapiens
ctgtcaagctggt

SEQ ID NO: 2376162 - DNA, 14 bp, Homo sapiens
ctgtcaatcacagt

SEQ ID NO: 2376163 - DNA, 22 bp, Homo sapiens
ctgtcacggggttccctcctag

SEQ ID NO: 2376164 - DNA, 19 bp, Homo sapiens
ctgtcaggctgaaaacaat

SEQ ID NO: 2376165 - DNA, 19 bp, Homo sapiens
ctgtcagttctaacctcct

SEQ ID NO: 2376166 - DNA, 13 bp, Homo sapiens
ctgtccagctggg

SEQ ID NO: 2376167 - DNA, 14 bp, Homo sapiens
ctgtccaggcagct

SEQ ID NO: 2376168 - DNA, 18 bp, Homo sapiens
ctgtccaggcagctccct

SEQ ID NO: 2376169 - DNA, 15 bp, Homo sapiens
ctgtccaggtagaaa

SEQ ID NO: 2376170 - DNA, 12 bp, Homo sapiens
ctgtcccaggcc

SEQ ID NO: 2376171 - DNA, 18 bp, Homo sapiens
ctgtcccaggccggccca

SEQ ID NO: 2376172 - DNA, 13 bp, Homo sapiens
ctgtcccccaggc

SEQ ID NO: 2376173 - DNA, 16 bp, Homo sapiens
ctgtcccccaggctgg

SEQ ID NO: 2376174 - DNA, 23 bp, Homo sapiens
ctgtccccctcctcccagggcct

SEQ ID NO: 2376175 - DNA, 15 bp, Homo sapiens
ctgtcccctgctaca

SEQ ID NO: 2376176 - DNA, 18 bp, Homo sapiens
ctgtcccggttcaccttg

SEQ ID NO: 2376177 - DNA, 19 bp, Homo sapiens
ctgtccctgtagctcagtc

SEQ ID NO: 2376178 - DNA, 19 bp, Homo sapiens
ctgtccgcctctgcccgca

SEQ ID NO: 2376179 - DNA, 14 bp, Homo sapiens
ctgtcctggtacag

SEQ ID NO: 2376180 - DNA, 20 bp, Homo sapiens
ctgtcctggtacagcagggt

SEQ ID NO: 2376181 - DNA, 19 bp, Homo sapiens
ctgtcctttttcctctcca

SEQ ID NO: 2376182 - DNA, 20 bp, Homo sapiens
ctgtcgccaccacttccaga

SEQ ID NO: 2376183 - DNA, 15 bp, Homo sapiens
ctgtctaggactgca

SEQ ID NO: 2376184 - DNA, 21 bp, Homo sapiens
ctgtctaggactgcagtgtgg

SEQ ID NO: 2376185 - DNA, 19 bp, Homo sapiens
ctgtctgggtgctactggg

SEQ ID NO: 2376186 - DNA, 21 bp, Homo sapiens
ctgtctgggtgctactgggga

SEQ ID NO: 2376187 - DNA, 22 bp, Homo sapiens
ctgtctgggtgctactggggaa

SEQ ID NO: 2376188 - DNA, 23 bp, Homo sapiens
ctgtctgggtgctactggggaaa

SEQ ID NO: 2376189 - DNA, 21 bp, Homo sapiens
ctgtctgtcccttttctttga

SEQ ID NO: 2376190 - DNA, 16 bp, Homo sapiens
ctgtcttatcctccac

SEQ ID NO: 2376191 - DNA, 20 bp, Homo sapiens
ctgtcttcctcaaaataaag

SEQ ID NO: 2376192 - DNA, 18 bp, Homo sapiens
ctgtctttcctgaaccat

SEQ ID NO: 2376193 - DNA, 21 bp, Homo sapiens
ctgtgaacaagcttcagtaag

SEQ ID NO: 2376194 - DNA, 19 bp, Homo sapiens
ctgtgaaccctggggcctg

SEQ ID NO: 2376195 - DNA, 21 bp, Homo sapiens
ctgtgaagatctcactctgcc

SEQ ID NO: 2376196 - DNA, 22 bp, Homo sapiens
ctgtgagccccacagccctgct

SEQ ID NO: 2376197 - DNA, 22 bp, Homo sapiens
ctgtgagggaggggaaaagcat

SEQ ID NO: 2376198 - DNA, 13 bp, Homo sapiens
ctgtgataacaga

SEQ ID NO: 2376199 - DNA, 14 bp, Homo sapiens
ctgtgataacagag

SEQ ID NO: 2376200 - DNA, 17 bp, Homo sapiens
ctgtgataacagagtga

SEQ ID NO: 2376201 - DNA, 20 bp, Homo sapiens
ctgtgatcaatatttttata

SEQ ID NO: 2376202 - DNA, 17 bp, Homo sapiens
ctgtgatcttaaaataa

SEQ ID NO: 2376203 - DNA, 22 bp, Homo sapiens
ctgtgattgggtgggatttttt

SEQ ID NO: 2376204 - DNA, 15 bp, Homo sapiens
ctgtgcaatacttag

SEQ ID NO: 2376205 - DNA, 21 bp, Homo sapiens
ctgtgcacaccccactcccac

SEQ ID NO: 2376206 - DNA, 16 bp, Homo sapiens
ctgtgcagtcactgga

SEQ ID NO: 2376207 - DNA, 17 bp, Homo sapiens
ctgtgcatgtatgtctt

SEQ ID NO: 2376208 - DNA, 16 bp, Homo sapiens
ctgtgcctggccccag

SEQ ID NO: 2376209 - DNA, 23 bp, Homo sapiens
ctgtgctccatatttgatttcta

SEQ ID NO: 2376210 - DNA, 23 bp, Homo sapiens
ctgtgctcccctgccacactgat

SEQ ID NO: 2376211 - DNA, 19 bp, Homo sapiens
ctgtggaaggcagagaaat

SEQ ID NO: 2376212 - DNA, 22 bp, Homo sapiens
ctgtggaggaaggattgtaaaa

SEQ ID NO: 2376213 - DNA, 14 bp, Homo sapiens
ctgtggcataaatt

SEQ ID NO: 2376214 - DNA, 13 bp, Homo sapiens
ctgtggcatttcc

SEQ ID NO: 2376215 - DNA, 14 bp, Homo sapiens
ctgtggcatttcca

SEQ ID NO: 2376216 - DNA, 12 bp, Homo sapiens
ctgtggctgatt

SEQ ID NO: 2376217 - DNA, 22 bp, Homo sapiens
ctgtggctgatttactaacagt

SEQ ID NO: 2376218 - DNA, 13 bp, Homo sapiens
ctgtggctggctc

SEQ ID NO: 2376219 - DNA, 23 bp, Homo sapiens
ctgtggctggctctaccttcctg

SEQ ID NO: 2376220 - DNA, 23 bp, Homo sapiens
ctgtgggctacatgctggggtca

SEQ ID NO: 2376221 - DNA, 13 bp, Homo sapiens
ctgtggggtggag

SEQ ID NO: 2376222 - DNA, 14 bp, Homo sapiens
ctgtgggtctctga

SEQ ID NO: 2376223 - DNA, 11 bp, Homo sapiens
ctgtgggtgtg

SEQ ID NO: 2376224 - DNA, 19 bp, Homo sapiens
ctgtgtacataactgaaaa

SEQ ID NO: 2376225 - DNA, 22 bp, Homo sapiens
ctgtgtacataactgaaaatgt

SEQ ID NO: 2376226 - DNA, 11 bp, Homo sapiens
ctgtgtactgt

SEQ ID NO: 2376227 - DNA, 23 bp, Homo sapiens
ctgtgtcctgaaacgctcctttg

SEQ ID NO: 2376228 - DNA, 18 bp, Homo sapiens
ctgtgtctgccaaacaca

SEQ ID NO: 2376229 - DNA, 22 bp, Homo sapiens
ctgtgtctgcccaatgaataat

SEQ ID NO: 2376230 - DNA, 19 bp, Homo sapiens
ctgtgtgaccctgggcaag

SEQ ID NO: 2376231 - DNA, 18 bp, Homo sapiens
ctgtgtgctcctccttgg

SEQ ID NO: 2376232 - DNA, 23 bp, Homo sapiens
ctgtgtgctcctccttggtgcct

SEQ ID NO: 2376233 - DNA, 17 bp, Homo sapiens
ctgtgtggcagttaatt

SEQ ID NO: 2376234 - DNA, 17 bp, Homo sapiens
ctgtgtgtgtcccctca

SEQ ID NO: 2376235 - DNA, 15 bp, Homo sapiens
ctgtgttaattgcgt

SEQ ID NO: 2376236 - DNA, 13 bp, Homo sapiens
ctgtgttccttcc

SEQ ID NO: 2376237 - DNA, 21 bp, Homo sapiens
ctgtgttccttccgcttggag

SEQ ID NO: 2376238 - DNA, 22 bp, Homo sapiens
ctgtgttgccacagtagaactg

SEQ ID NO: 2376239 - DNA, 14 bp, Homo sapiens
ctgttatgctgtga

SEQ ID NO: 2376240 - DNA, 13 bp, Homo sapiens
ctgttcagcaaac

SEQ ID NO: 2376241 - DNA, 11 bp, Homo sapiens
ctgttccctgg

SEQ ID NO: 2376242 - DNA, 21 bp, Homo sapiens
ctgttccctggagtcagggtg

SEQ ID NO: 2376243 - DNA, 13 bp, Homo sapiens
ctgttcctgctgc

SEQ ID NO: 2376244 - DNA, 17 bp, Homo sapiens
ctgttcctgctgctgtc

SEQ ID NO: 2376245 - DNA, 22 bp, Homo sapiens
ctgttcggaaggggttcctcaa

SEQ ID NO: 2376246 - DNA, 23 bp, Homo sapiens
ctgttcggaaggggttcctcaaa

SEQ ID NO: 2376247 - DNA, 15 bp, Homo sapiens
ctgttctaattaaga

SEQ ID NO: 2376248 - DNA, 20 bp, Homo sapiens
ctgttctacatagatgctta

SEQ ID NO: 2376249 - DNA, 19 bp, Homo sapiens
ctgttctcaggacagcatc

SEQ ID NO: 2376250 - DNA, 15 bp, Homo sapiens
ctgttggttcaaact

SEQ ID NO: 2376251 - DNA, 16 bp, Homo sapiens
ctgttgtaatatcagt

SEQ ID NO: 2376252 - DNA, 14 bp, Homo sapiens
ctgttgtacattta

SEQ ID NO: 2376253 - DNA, 22 bp, Homo sapiens
ctgttgtacatttatgatttaa

SEQ ID NO: 2376254 - DNA, 15 bp, Homo sapiens
ctgtttactggttct

SEQ ID NO: 2376255 - DNA, 18 bp, Homo sapiens
ctgtttaggttcccctgt

SEQ ID NO: 2376256 - DNA, 20 bp, Homo sapiens
ctgtttaggttcccctgtca

SEQ ID NO: 2376257 - DNA, 12 bp, Homo sapiens
ctgtttctaaga

SEQ ID NO: 2376258 - DNA, 14 bp, Homo sapiens
ctgtttctaagaaa

SEQ ID NO: 2376259 - DNA, 15 bp, Homo sapiens
ctgtttctaagaaaa

SEQ ID NO: 2376260 - DNA, 15 bp, Homo sapiens
ctgtttctcttgagc

SEQ ID NO: 2376261 - DNA, 21 bp, Homo sapiens
ctgtttctgtcaagctggtgc

SEQ ID NO: 2376262 - DNA, 22 bp, Homo sapiens
ctgtttgaaagtaaaaacctgc

SEQ ID NO: 2376263 - DNA, 18 bp, Homo sapiens
ctgtttgatataccaaat

SEQ ID NO: 2376264 - DNA, 23 bp, Homo sapiens
ctgtttgatataccaaattaaaa

SEQ ID NO: 2376265 - DNA, 21 bp, Homo sapiens
ctgtttgctgatccccaacct

SEQ ID NO: 2376266 - DNA, 21 bp, Homo sapiens
ctgttttagtgtttatgttta

SEQ ID NO: 2376267 - DNA, 12 bp, Homo sapiens
ctgttttctgaa

SEQ ID NO: 2376268 - DNA, 14 bp, Homo sapiens
cttaaaaatttata

SEQ ID NO: 2376269 - DNA, 22 bp, Homo sapiens
cttaaacctcctgctgtgcctc

SEQ ID NO: 2376270 - DNA, 17 bp, Homo sapiens
ctttcttctgtgttaat

SEQ ID NO: 2376271 - DNA, 14 bp, Homo sapiens
ctttcttttaatga

SEQ ID NO: 2376272 - DNA, 22 bp, Homo sapiens
ctttctttttgtagctggggct

SEQ ID NO: 2376273 - DNA, 13 bp, Homo sapiens
ctttgaaaagttg

SEQ ID NO: 2376274 - DNA, 17 bp, Homo sapiens
ctttgaaaagttggaag

SEQ ID NO: 2376275 - DNA, 18 bp, Homo sapiens
ctttgaaaagttggaagg

SEQ ID NO: 2376276 - DNA, 15 bp, Homo sapiens
ctttgaaacctcagg

SEQ ID NO: 2376277 - DNA, 18 bp, Homo sapiens
ctttgacaattgggagct

SEQ ID NO: 2376278 - DNA, 22 bp, Homo sapiens
ctttgacaattgggagctgcca

SEQ ID NO: 2376279 - DNA, 19 bp, Homo sapiens
ctttgactctataagcaaa

SEQ ID NO: 2376280 - DNA, 14 bp, Homo sapiens
ctttgactttttgc

SEQ ID NO: 2376281 - DNA, 17 bp, Homo sapiens
ctttgagacagtttctt

SEQ ID NO: 2376282 - DNA, 13 bp, Homo sapiens
ctttgagtaccaa

SEQ ID NO: 2376283 - DNA, 23 bp, Homo sapiens
ctttgagtagatccatttccatt

SEQ ID NO: 2376284 - DNA, 14 bp, Homo sapiens
ctttgataatgtta

SEQ ID NO: 2376285 - DNA, 21 bp, Homo sapiens
ctttgataatgttaaatttgt

SEQ ID NO: 2376286 - DNA, 22 bp, Homo sapiens
ctttgataatgttaaatttgta

SEQ ID NO: 2376287 - DNA, 15 bp, Homo sapiens
ctttgatctctgctt

SEQ ID NO: 2376288 - DNA, 14 bp, Homo sapiens
ctttgcacgtgctg

SEQ ID NO: 2376289 - DNA, 13 bp, Homo sapiens
ctttgcatattat

SEQ ID NO: 2376290 - DNA, 23 bp, Homo sapiens
ctttgcatattataaaggataaa

SEQ ID NO: 2376291 - DNA, 15 bp, Homo sapiens
ctttgcccagaaaga

SEQ ID NO: 2376292 - DNA, 16 bp, Homo sapiens
ctttgcccaggcatga

SEQ ID NO: 2376293 - DNA, 13 bp, Homo sapiens
ctttgctccagat

SEQ ID NO: 2376294 - DNA, 14 bp, Homo sapiens
ctttgctctattaa

SEQ ID NO: 2376295 - DNA, 12 bp, Homo sapiens
ctttgctgcaga

SEQ ID NO: 2376296 - DNA, 15 bp, Homo sapiens
ctttgctgcagagaa

SEQ ID NO: 2376297 - DNA, 18 bp, Homo sapiens
ctttggattctaaataca

SEQ ID NO: 2376298 - DNA, 21 bp, Homo sapiens
ctttggattctaaatacatgc

SEQ ID NO: 2376299 - DNA, 19 bp, Homo sapiens
ctttggccccactttgaag

SEQ ID NO: 2376300 - DNA, 20 bp, Homo sapiens
ctttgggaggccgaggcggg

SEQ ID NO: 2376301 - DNA, 21 bp, Homo sapiens
ctttggggaatttttttttaa

SEQ ID NO: 2376302 - DNA, 18 bp, Homo sapiens
ctttggggggtgtgctga

SEQ ID NO: 2376303 - DNA, 23 bp, Homo sapiens
ctttggtttttttcttctgtatt

SEQ ID NO: 2376304 - DNA, 15 bp, Homo sapiens
ctttgtaagagcaaa

SEQ ID NO: 2376305 - DNA, 22 bp, Homo sapiens
ctttgtaagagtgtagaagcat

SEQ ID NO: 2376306 - DNA, 13 bp, Homo sapiens
ctttgtattttga

SEQ ID NO: 2376307 - DNA, 18 bp, Homo sapiens
ctttgtggtttcttgttt

SEQ ID NO: 2376308 - DNA, 15 bp, Homo sapiens
ctttgtgtgtattca

SEQ ID NO: 2376309 - DNA, 15 bp, Homo sapiens
ctttgtgttcatttc

SEQ ID NO: 2376310 - DNA, 15 bp, Homo sapiens
cttttaaactgtgta

SEQ ID NO: 2376311 - DNA, 18 bp, Homo sapiens
cttttaaagaccctccta

SEQ ID NO: 2376312 - DNA, 18 bp, Homo sapiens
cttttaaggataaatcat

SEQ ID NO: 2376313 - DNA, 23 bp, Homo sapiens
cttttaatggcatttctctttaa

SEQ ID NO: 2376314 - DNA, 14 bp, Homo sapiens
cttttaattttcct

SEQ ID NO: 2376315 - DNA, 21 bp, Homo sapiens
cttttaccctggcccctctcc

SEQ ID NO: 2376316 - DNA, 17 bp, Homo sapiens
cttttagaaatgcatat

SEQ ID NO: 2376317 - DNA, 20 bp, Homo sapiens
cttttatggggccctgtcca

SEQ ID NO: 2376318 - DNA, 19 bp, Homo sapiens
cttttcacattaggctgtt

SEQ ID NO: 2376319 - DNA, 19 bp, Homo sapiens
cttttcactttattgctat

SEQ ID NO: 2376320 - DNA, 20 bp, Homo sapiens
cttttcagaagcaagccaga

SEQ ID NO: 2376321 - DNA, 21 bp, Homo sapiens
cttttcagaagcaagccagac

SEQ ID NO: 2376322 - DNA, 13 bp, Homo sapiens
cttttcagggctg

SEQ ID NO: 2376323 - DNA, 17 bp, Homo sapiens
cttttcagggctggctc

SEQ ID NO: 2376324 - DNA, 22 bp, Homo sapiens
cttttcccctttcctgtcccac

SEQ ID NO: 2376325 - DNA, 18 bp, Homo sapiens
cttttccctgcttccagg

SEQ ID NO: 2376326 - DNA, 13 bp, Homo sapiens
cttttctgccctg

SEQ ID NO: 2376327 - DNA, 17 bp, Homo sapiens
cttttctgccctggctg

SEQ ID NO: 2376328 - DNA, 13 bp, Homo sapiens
cttttctgtgatt

SEQ ID NO: 2376329 - DNA, 16 bp, Homo sapiens
cttttctttgaccaga

SEQ ID NO: 2376330 - DNA, 23 bp, Homo sapiens
cttttctttgaccagatctttct

SEQ ID NO: 2376331 - DNA, 22 bp, Homo sapiens
cttttctttttttctttaataa

SEQ ID NO: 2376332 - DNA, 17 bp, Homo sapiens
cttttgaaaagaccaag

SEQ ID NO: 2376333 - DNA, 14 bp, Homo sapiens
cttttgaaagtaga

SEQ ID NO: 2376334 - DNA, 18 bp, Homo sapiens
cttttgaaagtagagcta

SEQ ID NO: 2376335 - DNA, 21 bp, Homo sapiens
cttttgaagcatagataatat

SEQ ID NO: 2376336 - DNA, 17 bp, Homo sapiens
cttttgcttgatccaga

SEQ ID NO: 2376337 - DNA, 23 bp, Homo sapiens
cttttggcaatgactcaaagtct

SEQ ID NO: 2376338 - DNA, 12 bp, Homo sapiens
cttttgtaataa

SEQ ID NO: 2376339 - DNA, 12 bp, Homo sapiens
cttttgtactga

SEQ ID NO: 2376340 - DNA, 14 bp, Homo sapiens
cttttgtttggtaa

SEQ ID NO: 2376341 - DNA, 16 bp, Homo sapiens
cttttgtttggtaaat

SEQ ID NO: 2376342 - DNA, 15 bp, Homo sapiens
ctttttaattgttgt

SEQ ID NO: 2376343 - DNA, 17 bp, Homo sapiens
ctttttaccagtgaaaa

SEQ ID NO: 2376344 - DNA, 16 bp, Homo sapiens
ctttttagaaagcatt

SEQ ID NO: 2376345 - DNA, 21 bp, Homo sapiens
ctttttcaaaaaccagccagg

SEQ ID NO: 2376346 - DNA, 13 bp, Homo sapiens
ctttttgacactg

SEQ ID NO: 2376347 - DNA, 18 bp, Homo sapiens
ctttttggaatctttgta

SEQ ID NO: 2376348 - DNA, 16 bp, Homo sapiens
cttttttaaatgtttc

SEQ ID NO: 2376349 - DNA, 15 bp, Homo sapiens
cttttttgctttctt

SEQ ID NO: 2376350 - DNA, 22 bp, Homo sapiens
ctttttttaagtgttctgtggc

SEQ ID NO: 2376351 - DNA, 22 bp, Homo sapiens
ctttttttctctgcatttaaaa

SEQ ID NO: 2376352 - DNA, 16 bp, Homo sapiens
ctttttttgtatgtgt

SEQ ID NO: 2376353 - DNA, 17 bp, Homo sapiens
ctttttttgtatgtgtg

SEQ ID NO: 2376354 - DNA, 14 bp, Homo sapiens
ctttttttttaagt

SEQ ID NO: 2376355 - DNA, 23 bp, Homo sapiens
gaaaaacacggcagctgtagctc

SEQ ID NO: 2376356 - DNA, 14 bp, Homo sapiens
gaaaaagatgtaca

SEQ ID NO: 2376357 - DNA, 17 bp, Homo sapiens
gaaaaagctgcttctta

SEQ ID NO: 2376358 - DNA, 16 bp, Homo sapiens
gaaaaataaaatgttt

SEQ ID NO: 2376359 - DNA, 18 bp, Homo sapiens
gaaaaatctcattatttc

SEQ ID NO: 2376360 - DNA, 21 bp, Homo sapiens
gaaaaatctcattatttcaaa

SEQ ID NO: 2376361 - DNA, 11 bp, Homo sapiens
gaaaaattaac

SEQ ID NO: 2376362 - DNA, 16 bp, Homo sapiens
gaaaaattggggagga

SEQ ID NO: 2376363 - DNA, 19 bp, Homo sapiens
gaaaaattggggaggaggg

SEQ ID NO: 2376364 - DNA, 20 bp, Homo sapiens
gaaaactattaagatgagca

SEQ ID NO: 2376365 - DNA, 12 bp, Homo sapiens
gaaaagaaatgg

SEQ ID NO: 2376366 - DNA, 14 bp, Homo sapiens
gaaaagacatttta

SEQ ID NO: 2376367 - DNA, 21 bp, Homo sapiens
gaaaagatggtatcatatatt

SEQ ID NO: 2376368 - DNA, 16 bp, Homo sapiens
gaaaagcatttttcaa

SEQ ID NO: 2376369 - DNA, 11 bp, Homo sapiens
gaaaagctatt

SEQ ID NO: 2376370 - DNA, 14 bp, Homo sapiens
gaaaaggatctaag

SEQ ID NO: 2376371 - DNA, 16 bp, Homo sapiens
gaaaaggttgaataat

SEQ ID NO: 2376372 - DNA, 16 bp, Homo sapiens
gaaaagtgaattgaag

SEQ ID NO: 2376373 - DNA, 20 bp, Homo sapiens
gaaaagttggaaggatctgc

SEQ ID NO: 2376374 - DNA, 13 bp, Homo sapiens
gaaaataaaacac

SEQ ID NO: 2376375 - DNA, 15 bp, Homo sapiens
gaaaataaaacacac

SEQ ID NO: 2376376 - DNA, 18 bp, Homo sapiens
gaaaataactgaatttgg

SEQ ID NO: 2376377 - DNA, 22 bp, Homo sapiens
gaaaatattgttttacaatagt

SEQ ID NO: 2376378 - DNA, 20 bp, Homo sapiens
gaaaatgagccattttttga

SEQ ID NO: 2376379 - DNA, 18 bp, Homo sapiens
gaaaatggccatgcagga

SEQ ID NO: 2376380 - DNA, 22 bp, Homo sapiens
gaaaatggccatgcaggaggtg

SEQ ID NO: 2376381 - DNA, 22 bp, Homo sapiens
gaaaatgtctgtaataatagac

SEQ ID NO: 2376382 - DNA, 21 bp, Homo sapiens
gaaaattctaacccaagacat

SEQ ID NO: 2376383 - DNA, 12 bp, Homo sapiens
gaaaattttctc

SEQ ID NO: 2376384 - DNA, 14 bp, Homo sapiens
gaaaattttctcct

SEQ ID NO: 2376385 - DNA, 14 bp, Homo sapiens
gactaaattcgtga

SEQ ID NO: 2376386 - DNA, 16 bp, Homo sapiens
gactaaggaactaaaa

SEQ ID NO: 2376387 - DNA, 13 bp, Homo sapiens
gactaatgctttt

SEQ ID NO: 2376388 - DNA, 12 bp, Homo sapiens
gactagcaggca

SEQ ID NO: 2376389 - DNA, 16 bp, Homo sapiens
gactatataatttatt

SEQ ID NO: 2376390 - DNA, 18 bp, Homo sapiens
gactcatgaggaggggcc

SEQ ID NO: 2376391 - DNA, 22 bp, Homo sapiens
gactcatgaggaggggcccccc

SEQ ID NO: 2376392 - DNA, 16 bp, Homo sapiens
gactctttttttgagt

SEQ ID NO: 2376393 - DNA, 17 bp, Homo sapiens
gactgagcaccctctgg

SEQ ID NO: 2376394 - DNA, 18 bp, Homo sapiens
gactgagcaccctctgga

SEQ ID NO: 2376395 - DNA, 17 bp, Homo sapiens
gactgccttgcctcctc

SEQ ID NO: 2376396 - DNA, 15 bp, Homo sapiens
gactgcgttctgcaa

SEQ ID NO: 2376397 - DNA, 16 bp, Homo sapiens
gactgcgttctgcaag

SEQ ID NO: 2376398 - DNA, 19 bp, Homo sapiens
gactgctcagaacttgctg

SEQ ID NO: 2376399 - DNA, 15 bp, Homo sapiens
gactgggccccacat

SEQ ID NO: 2376400 - DNA, 17 bp, Homo sapiens
gactggtgaatataaat

SEQ ID NO: 2376401 - DNA, 10 bp, Homo sapiens
gactggtgcc

SEQ ID NO: 2376402 - DNA, 16 bp, Homo sapiens
gactggtgccctcctc

SEQ ID NO: 2376403 - DNA, 15 bp, Homo sapiens
gactgtagccacagc

SEQ ID NO: 2376404 - DNA, 19 bp, Homo sapiens
gactgtagccacagctgct

SEQ ID NO: 2376405 - DNA, 20 bp, Homo sapiens
gactgtagccacagctgctg

SEQ ID NO: 2376406 - DNA, 23 bp, Homo sapiens
gactgtcacggggttccctccta

SEQ ID NO: 2376407 - DNA, 16 bp, Homo sapiens
gacttaaaaaaaccat

SEQ ID NO: 2376408 - DNA, 15 bp, Homo sapiens
gacttaactttaact

SEQ ID NO: 2376409 - DNA, 18 bp, Homo sapiens
gacttaagaaagcaaaac

SEQ ID NO: 2376410 - DNA, 14 bp, Homo sapiens
gacttccttatttc

SEQ ID NO: 2376411 - DNA, 14 bp, Homo sapiens
gacttgctgtccag

SEQ ID NO: 2376412 - DNA, 12 bp, Homo sapiens
gacttgggatgg

SEQ ID NO: 2376413 - DNA, 23 bp, Homo sapiens
gacttgtatagcatgaaataaaa

SEQ ID NO: 2376414 - DNA, 15 bp, Homo sapiens
gactttgtagatcct

SEQ ID NO: 2376415 - DNA, 13 bp, Homo sapiens
gactttttttgta

SEQ ID NO: 2376416 - DNA, 18 bp, Homo sapiens
gagaaacttaagcaaagg

SEQ ID NO: 2376417 - DNA, 14 bp, Homo sapiens
gagaaacttcaaag

SEQ ID NO: 2376418 - DNA, 18 bp, Homo sapiens
gagaaataagtgccctct

SEQ ID NO: 2376419 - DNA, 14 bp, Homo sapiens
gagaagccttcagc

SEQ ID NO: 2376420 - DNA, 18 bp, Homo sapiens
gagaagccttcagctcca

SEQ ID NO: 2376421 - DNA, 20 bp, Homo sapiens
gagaagtgggggcagcccag

SEQ ID NO: 2376422 - DNA, 20 bp, Homo sapiens
gagaataaaattcctatctc

SEQ ID NO: 2376423 - DNA, 22 bp, Homo sapiens
gagaatatttactaactaaata

SEQ ID NO: 2376424 - DNA, 23 bp, Homo sapiens
gagaatggtgtgaacccgggagc

SEQ ID NO: 2376425 - DNA, 15 bp, Homo sapiens
gagacaaggtgctaa

SEQ ID NO: 2376426 - DNA, 16 bp, Homo sapiens
gagacaatgttttctt

SEQ ID NO: 2376427 - DNA, 16 bp, Homo sapiens
gagacactgttgataa

SEQ ID NO: 2376428 - DNA, 15 bp, Homo sapiens
gagacagaggaaagg

SEQ ID NO: 2376429 - DNA, 12 bp, Homo sapiens
gagacaggcagc

SEQ ID NO: 2376430 - DNA, 16 bp, Homo sapiens
gagacaggcagcccag

SEQ ID NO: 2376431 - DNA, 19 bp, Homo sapiens
gagacaggcagcccagcag

SEQ ID NO: 2376432 - DNA, 16 bp, Homo sapiens
gagacagtgaatttgg

SEQ ID NO: 2376433 - DNA, 13 bp, Homo sapiens
gagacatttcaaa

SEQ ID NO: 2376434 - DNA, 14 bp, Homo sapiens
gagacatttcaaaa

SEQ ID NO: 2376435 - DNA, 15 bp, Homo sapiens
gagaccctgccacag

SEQ ID NO: 2376436 - DNA, 21 bp, Homo sapiens
gagaccctgccacagccagag

SEQ ID NO: 2376437 - DNA, 20 bp, Homo sapiens
gagaccgggccctgggttcc

SEQ ID NO: 2376438 - DNA, 21 bp, Homo sapiens
gagagaaataagtgccctctc

SEQ ID NO: 2376439 - DNA, 21 bp, Homo sapiens
gagagacgccactccctggga

SEQ ID NO: 2376440 - DNA, 14 bp, Homo sapiens
gagagagagagaga

SEQ ID NO: 2376441 - DNA, 13 bp, Homo sapiens
gagagcagctggc

SEQ ID NO: 2376442 - DNA, 17 bp, Homo sapiens
gagagccattttgtgaa

SEQ ID NO: 2376443 - DNA, 14 bp, Homo sapiens
gagagcccagaggt

SEQ ID NO: 2376444 - DNA, 17 bp, Homo sapiens
gagagccgtggtccctg

SEQ ID NO: 2376445 - DNA, 21 bp, Homo sapiens
gagagccgtggtccctgagga

SEQ ID NO: 2376446 - DNA, 18 bp, Homo sapiens
gagagctcaccatggaat

SEQ ID NO: 2376447 - DNA, 17 bp, Homo sapiens
gagaggagacggagggg

SEQ ID NO: 2376448 - DNA, 16 bp, Homo sapiens
gagaggcacctgctgg

SEQ ID NO: 2376449 - DNA, 13 bp, Homo sapiens
gagaggcactcag

SEQ ID NO: 2376450 - DNA, 12 bp, Homo sapiens
gagaggcaggca

SEQ ID NO: 2376451 - DNA, 19 bp, Homo sapiens
gagaggcgcgtctgcccca

SEQ ID NO: 2376452 - DNA, 23 bp, Homo sapiens
gagagggaggtcactggaaaggg

SEQ ID NO: 2376453 - DNA, 19 bp, Homo sapiens
gagagggggcctgggactt

SEQ ID NO: 2376454 - DNA, 11 bp, Homo sapiens
gagagtaccat

SEQ ID NO: 2376455 - DNA, 14 bp, Homo sapiens
gagagtaccatgct

SEQ ID NO: 2376456 - DNA, 23 bp, Homo sapiens
gagagtcagctctctgccctgtg

SEQ ID NO: 2376457 - DNA, 22 bp, Homo sapiens
gagataaaacagaatcttctgg

SEQ ID NO: 2376458 - DNA, 23 bp, Homo sapiens
gagataaaacagaatcttctggg

SEQ ID NO: 2376459 - DNA, 23 bp, Homo sapiens
gagataccacaaaccctgctgaa

SEQ ID NO: 2376460 - DNA, 16 bp, Homo sapiens
gagatgaggagtaaaa

SEQ ID NO: 2376461 - DNA, 20 bp, Homo sapiens
gagatgaggagtaaaattca

SEQ ID NO: 2376462 - DNA, 13 bp, Homo sapiens
gagatgcttctct

SEQ ID NO: 2376463 - DNA, 14 bp, Homo sapiens
gagatgcttctctc

SEQ ID NO: 2376464 - DNA, 20 bp, Homo sapiens
gagatgcttctctccttgcc

SEQ ID NO: 2376465 - DNA, 20 bp, Homo sapiens
gagatgggaatgaggtggga

SEQ ID NO: 2376466 - DNA, 15 bp, Homo sapiens
gagatgtgagccttg

SEQ ID NO: 2376467 - DNA, 16 bp, Homo sapiens
gagatgtgagccttgt

SEQ ID NO: 2376468 - DNA, 14 bp, Homo sapiens
gagattgacctgga

SEQ ID NO: 2376469 - DNA, 12 bp, Homo sapiens
gagatttcttag

SEQ ID NO: 2376470 - DNA, 13 bp, Homo sapiens
gagcaaaattcaa

SEQ ID NO: 2376471 - DNA, 19 bp, Homo sapiens
gagcaaacccagaggtgga

SEQ ID NO: 2376472 - DNA, 18 bp, Homo sapiens
gagcaactctccactcca

SEQ ID NO: 2376473 - DNA, 19 bp, Homo sapiens
gagcaactctccactccat

SEQ ID NO: 2376474 - DNA, 18 bp, Homo sapiens
gagcaccgtgtcaagctg

SEQ ID NO: 2376475 - DNA, 21 bp, Homo sapiens
gagcaccgtgtcaagctgctc

SEQ ID NO: 2376476 - DNA, 13 bp, Homo sapiens
gagcactggactc

SEQ ID NO: 2376477 - DNA, 19 bp, Homo sapiens
gagcactggactccggggc

SEQ ID NO: 2376478 - DNA, 12 bp, Homo sapiens
gagcagaacagg

SEQ ID NO: 2376479 - DNA, 16 bp, Homo sapiens
gagcagatgcagagag

SEQ ID NO: 2376480 - DNA, 16 bp, Homo sapiens
gagcagcagcttgggg

SEQ ID NO: 2376481 - DNA, 24 bp, Homo sapiens
gagcagcctctggacagccagtga

SEQ ID NO: 2376482 - DNA, 18 bp, Homo sapiens
gagcagctccctttctca

SEQ ID NO: 2376483 - DNA, 11 bp, Homo sapiens
gagcagctggc

SEQ ID NO: 2376484 - DNA, 16 bp, Homo sapiens
gagcagctggctctcc

SEQ ID NO: 2376485 - DNA, 17 bp, Homo sapiens
gagcagctggctctcca

SEQ ID NO: 2376486 - DNA, 16 bp, Homo sapiens
gagcaggctgtggggt

SEQ ID NO: 2376487 - DNA, 18 bp, Homo sapiens
gagcagggagagctcacc

SEQ ID NO: 2376488 - DNA, 16 bp, Homo sapiens
gagcagtcagagtcca

SEQ ID NO: 2376489 - DNA, 17 bp, Homo sapiens
gagcatgacagcctgca

SEQ ID NO: 2376490 - DNA, 13 bp, Homo sapiens
gagccacaagctg

SEQ ID NO: 2376491 - DNA, 17 bp, Homo sapiens
gagccacaagctgcact

SEQ ID NO: 2376492 - DNA, 18 bp, Homo sapiens
gagccacaagctgcactg

SEQ ID NO: 2376493 - DNA, 20 bp, Homo sapiens
gagccacaagctgcactgtg

SEQ ID NO: 2376494 - DNA, 21 bp, Homo sapiens
gagccacaagctgcactgtga

SEQ ID NO: 2376495 - DNA, 20 bp, Homo sapiens
gagccaccgtgcctggccag

SEQ ID NO: 2376496 - DNA, 13 bp, Homo sapiens
gagccacctgcaa

SEQ ID NO: 2376497 - DNA, 18 bp, Homo sapiens
gagccacctgcaagatgg

SEQ ID NO: 2376498 - DNA, 20 bp, Homo sapiens
gagccacctgcaagatggac

SEQ ID NO: 2376499 - DNA, 22 bp, Homo sapiens
gagccacgcagtgcctggagtt

SEQ ID NO: 2376500 - DNA, 15 bp, Homo sapiens
gattttcatttcatg

SEQ ID NO: 2376501 - DNA, 12 bp, Homo sapiens
gatttttctcaa

SEQ ID NO: 2376502 - DNA, 13 bp, Homo sapiens
gatttttgcctct

SEQ ID NO: 2376503 - DNA, 20 bp, Homo sapiens
gattttttccctttttatgt

SEQ ID NO: 2376504 - DNA, 15 bp, Homo sapiens
gatttttttttcata

SEQ ID NO: 2376505 - DNA, 15 bp, Homo sapiens
gcaaaaaattcttta

SEQ ID NO: 2376506 - DNA, 16 bp, Homo sapiens
gcaaaagcctcagaaa

SEQ ID NO: 2376507 - DNA, 18 bp, Homo sapiens
gcaaaatctaaaatgttt

SEQ ID NO: 2376508 - DNA, 13 bp, Homo sapiens
gcaaacctttccc

SEQ ID NO: 2376509 - DNA, 20 bp, Homo sapiens
gcaaactgggaacccctttc

SEQ ID NO: 2376510 - DNA, 23 bp, Homo sapiens
gcaaagaaaaaaaaaaaagccag

SEQ ID NO: 2376511 - DNA, 17 bp, Homo sapiens
gcaaagagacatttcaa

SEQ ID NO: 2376512 - DNA, 17 bp, Homo sapiens
gcaaagctttggctgag

SEQ ID NO: 2376513 - DNA, 12 bp, Homo sapiens
gcaaatgggagc

SEQ ID NO: 2376514 - DNA, 20 bp, Homo sapiens
gcaaatgggagctgagcagc

SEQ ID NO: 2376515 - DNA, 12 bp, Homo sapiens
gcaaatgttaaa

SEQ ID NO: 2376516 - DNA, 19 bp, Homo sapiens
gcaaatgttgggaaagtat

SEQ ID NO: 2376517 - DNA, 15 bp, Homo sapiens
gcaacaacaattggt

SEQ ID NO: 2376518 - DNA, 14 bp, Homo sapiens
gcaacaatttatga

SEQ ID NO: 2376519 - DNA, 19 bp, Homo sapiens
gcaacagcctttgaatgta

SEQ ID NO: 2376520 - DNA, 23 bp, Homo sapiens
gcaacagcctttgaatgtaacca

SEQ ID NO: 2376521 - DNA, 13 bp, Homo sapiens
gcaaccagaggaa

SEQ ID NO: 2376522 - DNA, 14 bp, Homo sapiens
gcaaccagaggaag

SEQ ID NO: 2376523 - DNA, 23 bp, Homo sapiens
gcaaccgtctgttatgctgtgac

SEQ ID NO: 2376524 - DNA, 18 bp, Homo sapiens
gcaacctcaccttcctgt

SEQ ID NO: 2376525 - DNA, 22 bp, Homo sapiens
gcaacctcaccttcctgtgggt

SEQ ID NO: 2376526 - DNA, 23 bp, Homo sapiens
gcaacttcatttgacacaaagct

SEQ ID NO: 2376527 - DNA, 14 bp, Homo sapiens
gcaacttcttctcc

SEQ ID NO: 2376528 - DNA, 17 bp, Homo sapiens
gcaagaaatggcgtctg

SEQ ID NO: 2376529 - DNA, 17 bp, Homo sapiens
gcaagaccctcccatgg

SEQ ID NO: 2376530 - DNA, 20 bp, Homo sapiens
gcaagactgggccccacatg

SEQ ID NO: 2376531 - DNA, 14 bp, Homo sapiens
gcaagagagatgtt

SEQ ID NO: 2376532 - DNA, 21 bp, Homo sapiens
gcaagatgtgaattattgaca

SEQ ID NO: 2376533 - DNA, 16 bp, Homo sapiens
gcaagcagctggtcag

SEQ ID NO: 2376534 - DNA, 15 bp, Homo sapiens
gcaagccacaggaag

SEQ ID NO: 2376535 - DNA, 15 bp, Homo sapiens
gcaagcttcttgctg

SEQ ID NO: 2376536 - DNA, 16 bp, Homo sapiens
gcaagcttcttgctga

SEQ ID NO: 2376537 - DNA, 12 bp, Homo sapiens
gcaagtgctgga

SEQ ID NO: 2376538 - DNA, 21 bp, Homo sapiens
gcaagtgctggagtctcctga

SEQ ID NO: 2376539 - DNA, 13 bp, Homo sapiens
gcaagtgttcact

SEQ ID NO: 2376540 - DNA, 16 bp, Homo sapiens
gcaataacagctgcaa

SEQ ID NO: 2376541 - DNA, 12 bp, Homo sapiens
gcaataaggaaa

SEQ ID NO: 2376542 - DNA, 21 bp, Homo sapiens
gcaataaggaaatgtatattc

SEQ ID NO: 2376543 - DNA, 15 bp, Homo sapiens
gcaatccacctgcct

SEQ ID NO: 2376544 - DNA, 20 bp, Homo sapiens
gcaatccacctgccttggcc

SEQ ID NO: 2376545 - DNA, 15 bp, Homo sapiens
gcaatcctcctgcct

SEQ ID NO: 2376546 - DNA, 21 bp, Homo sapiens
gcaatcctcctgcctcagcct

SEQ ID NO: 2376547 - DNA, 23 bp, Homo sapiens
gcaatctcttcattattctctgc

SEQ ID NO: 2376548 - DNA, 14 bp, Homo sapiens
gcaatgtatagtgt

SEQ ID NO: 2376549 - DNA, 16 bp, Homo sapiens
gcaatgtggcaaactg

SEQ ID NO: 2376550 - DNA, 21 bp, Homo sapiens
gcaattaaacttccaaagaaa

SEQ ID NO: 2376551 - DNA, 22 bp, Homo sapiens
gcaattaaacttccaaagaaag

SEQ ID NO: 2376552 - DNA, 19 bp, Homo sapiens
gcaattctctttcttttac

SEQ ID NO: 2376553 - DNA, 14 bp, Homo sapiens
gcaatttagacaaa

SEQ ID NO: 2376554 - DNA, 18 bp, Homo sapiens
gcacacaacgattatagt

SEQ ID NO: 2376555 - DNA, 18 bp, Homo sapiens
gcacacagaatgctcagg

SEQ ID NO: 2376556 - DNA, 19 bp, Homo sapiens
gcacacagaatgctcaggg

SEQ ID NO: 2376557 - DNA, 12 bp, Homo sapiens
gcacagctcagg

SEQ ID NO: 2376558 - DNA, 17 bp, Homo sapiens
gcacagggagtgcacat

SEQ ID NO: 2376559 - DNA, 16 bp, Homo sapiens
gcacagtcactgctct

SEQ ID NO: 2376560 - DNA, 12 bp, Homo sapiens
gcacagtccaga

SEQ ID NO: 2376561 - DNA, 13 bp, Homo sapiens
gcacatatggact

SEQ ID NO: 2376562 - DNA, 17 bp, Homo sapiens
gcacatgcacctaccca

SEQ ID NO: 2376563 - DNA, 13 bp, Homo sapiens
gcacatgtcttgt

SEQ ID NO: 2376564 - DNA, 13 bp, Homo sapiens
gcaccacactggg

SEQ ID NO: 2376565 - DNA, 15 bp, Homo sapiens
gcaccacactgggtg

SEQ ID NO: 2376566 - DNA, 23 bp, Homo sapiens
gcaccacactgggtgcgtctcca

SEQ ID NO: 2376567 - DNA, 18 bp, Homo sapiens
gcaccagcaattctcttt

SEQ ID NO: 2376568 - DNA, 18 bp, Homo sapiens
gcaccaggcgctgcccac

SEQ ID NO: 2376569 - DNA, 13 bp, Homo sapiens
gcacccacctgtt

SEQ ID NO: 2376570 - DNA, 18 bp, Homo sapiens
gcacccacctgttttctg

SEQ ID NO: 2376571 - DNA, 18 bp, Homo sapiens
gcacccctgggccagcgg

SEQ ID NO: 2376572 - DNA, 17 bp, Homo sapiens
gcaccccttctctcctc

SEQ ID NO: 2376573 - DNA, 19 bp, Homo sapiens
gcaccctcagggagcctcc

SEQ ID NO: 2376574 - DNA, 20 bp, Homo sapiens
gcacctaccccttggaaatg

SEQ ID NO: 2376575 - DNA, 12 bp, Homo sapiens
gcacctgagacc

SEQ ID NO: 2376576 - DNA, 15 bp, Homo sapiens
gcacctgctggaaac

SEQ ID NO: 2376577 - DNA, 16 bp, Homo sapiens
gcacctgtagtcccag

SEQ ID NO: 2376578 - DNA, 14 bp, Homo sapiens
gcacgcctgctggc

SEQ ID NO: 2376579 - DNA, 15 bp, Homo sapiens
gcacgcctgctggcc

SEQ ID NO: 2376580 - DNA, 16 bp, Homo sapiens
gcacgcctgctggccg

SEQ ID NO: 2376581 - DNA, 17 bp, Homo sapiens
gcacgctcgctgccatc

SEQ ID NO: 2376582 - DNA, 14 bp, Homo sapiens
gcacgggtggtccc

SEQ ID NO: 2376583 - DNA, 17 bp, Homo sapiens
gcactaaatcagagaca

SEQ ID NO: 2376584 - DNA, 15 bp, Homo sapiens
gcactacaggaggaa

SEQ ID NO: 2376585 - DNA, 16 bp, Homo sapiens
gcactacaggaggaat

SEQ ID NO: 2376586 - DNA, 22 bp, Homo sapiens
gcactacatctgatatcaggaa

SEQ ID NO: 2376587 - DNA, 19 bp, Homo sapiens
gcactagagaaaataaatt

SEQ ID NO: 2376588 - DNA, 16 bp, Homo sapiens
gcactcagtgagcctc

SEQ ID NO: 2376589 - DNA, 17 bp, Homo sapiens
gcactccagcctggggg

SEQ ID NO: 2376590 - DNA, 17 bp, Homo sapiens
gcactctgtatatttga

SEQ ID NO: 2376591 - DNA, 16 bp, Homo sapiens
gcactgagctcacatg

SEQ ID NO: 2376592 - DNA, 19 bp, Homo sapiens
gcactgcccacatgggacc

SEQ ID NO: 2376593 - DNA, 20 bp, Homo sapiens
gcactgcccacatgggacct

SEQ ID NO: 2376594 - DNA, 11 bp, Homo sapiens
gcactggactc

SEQ ID NO: 2376595 - DNA, 17 bp, Homo sapiens
gcactggactccggggc

SEQ ID NO: 2376596 - DNA, 18 bp, Homo sapiens
gcactgggaggctcccct

SEQ ID NO: 2376597 - DNA, 20 bp, Homo sapiens
gcactgggaggctccccttc

SEQ ID NO: 2376598 - DNA, 23 bp, Homo sapiens
gcacttattgaccattttttaat

SEQ ID NO: 2376599 - DNA, 12 bp, Homo sapiens
gcacttgagttt

SEQ ID NO: 2376600 - DNA, 19 bp, Homo sapiens
gcagaacccaccaaccaga

SEQ ID NO: 2376601 - DNA, 16 bp, Homo sapiens
gcagaagacaccagag

SEQ ID NO: 2376602 - DNA, 20 bp, Homo sapiens
gcagaagacaccagagcaga

SEQ ID NO: 2376603 - DNA, 15 bp, Homo sapiens
gcagaagtctggctt

SEQ ID NO: 2376604 - DNA, 19 bp, Homo sapiens
gcagaagtctggctttgct

SEQ ID NO: 2376605 - DNA, 17 bp, Homo sapiens
gcagaccgtgatttgga

SEQ ID NO: 2376606 - DNA, 20 bp, Homo sapiens
gcagagaaacttaagcaaag

SEQ ID NO: 2376607 - DNA, 14 bp, Homo sapiens
gcagagccttctca

SEQ ID NO: 2376608 - DNA, 20 bp, Homo sapiens
gcagaggttttaatgtctgt

SEQ ID NO: 2376609 - DNA, 21 bp, Homo sapiens
gcagaggttttaatgtctgtt

SEQ ID NO: 2376610 - DNA, 14 bp, Homo sapiens
gcagagttttcatt

SEQ ID NO: 2376611 - DNA, 19 bp, Homo sapiens
gcagagttttcattaaatc

SEQ ID NO: 2376612 - DNA, 15 bp, Homo sapiens
gcagatgcagagagc

SEQ ID NO: 2376613 - DNA, 21 bp, Homo sapiens
gcagatgctgttgtgaagcta

SEQ ID NO: 2376614 - DNA, 22 bp, Homo sapiens
gcagatgtgagccaccgtgcct

SEQ ID NO: 2376615 - DNA, 17 bp, Homo sapiens
gccgggcccctgggctt

SEQ ID NO: 2376616 - DNA, 19 bp, Homo sapiens
gccgggcccctgggcttgg

SEQ ID NO: 2376617 - DNA, 16 bp, Homo sapiens
gccgggcgcggtggct

SEQ ID NO: 2376618 - DNA, 18 bp, Homo sapiens
gccgggcgcggtggctca

SEQ ID NO: 2376619 - DNA, 18 bp, Homo sapiens
gccgggctgagggcctgc

SEQ ID NO: 2376620 - DNA, 15 bp, Homo sapiens
gccgtggtccctgag

SEQ ID NO: 2376621 - DNA, 22 bp, Homo sapiens
gcctaaagtatacaactgcctg

SEQ ID NO: 2376622 - DNA, 15 bp, Homo sapiens
gcctaattcctggca

SEQ ID NO: 2376623 - DNA, 19 bp, Homo sapiens
gcctacatcccgggcctca

SEQ ID NO: 2376624 - DNA, 17 bp, Homo sapiens
gcctactccaaaatgtt

SEQ ID NO: 2376625 - DNA, 13 bp, Homo sapiens
gcctagactctgt

SEQ ID NO: 2376626 - DNA, 16 bp, Homo sapiens
gcctagcacagcagct

SEQ ID NO: 2376627 - DNA, 20 bp, Homo sapiens
gcctagcgatctctcctggc

SEQ ID NO: 2376628 - DNA, 21 bp, Homo sapiens
gcctagcgatctctcctggcc

SEQ ID NO: 2376629 - DNA, 13 bp, Homo sapiens
gcctatttgtgtg

SEQ ID NO: 2376630 - DNA, 23 bp, Homo sapiens
gcctatttttttagattgagaaa

SEQ ID NO: 2376631 - DNA, 13 bp, Homo sapiens
gcctcaccttggg

SEQ ID NO: 2376632 - DNA, 16 bp, Homo sapiens
gcctcagaaagggatt

SEQ ID NO: 2376633 - DNA, 19 bp, Homo sapiens
gcctcagacgttgcctgag

SEQ ID NO: 2376634 - DNA, 12 bp, Homo sapiens
gcctcagactgg

SEQ ID NO: 2376635 - DNA, 12 bp, Homo sapiens
gcctcagccctc

SEQ ID NO: 2376636 - DNA, 17 bp, Homo sapiens
gcctcagccctcagttc

SEQ ID NO: 2376637 - DNA, 13 bp, Homo sapiens
gcctcagccttcc

SEQ ID NO: 2376638 - DNA, 22 bp, Homo sapiens
gcctcagccttccaactagctg

SEQ ID NO: 2376639 - DNA, 15 bp, Homo sapiens
gcctcaggtgctgtc

SEQ ID NO: 2376640 - DNA, 15 bp, Homo sapiens
gcctcagtgccccat

SEQ ID NO: 2376641 - DNA, 15 bp, Homo sapiens
gcctcagttttcctt

SEQ ID NO: 2376642 - DNA, 20 bp, Homo sapiens
gcctcagttttccttctgtt

SEQ ID NO: 2376643 - DNA, 19 bp, Homo sapiens
gcctcatactcctgggctc

SEQ ID NO: 2376644 - DNA, 21 bp, Homo sapiens
gcctcatgggaagtcctggca

SEQ ID NO: 2376645 - DNA, 16 bp, Homo sapiens
gcctccaagcacagag

SEQ ID NO: 2376646 - DNA, 22 bp, Homo sapiens
gcctccaaggaggggctgtaaa

SEQ ID NO: 2376647 - DNA, 13 bp, Homo sapiens
gcctcccaaagtg

SEQ ID NO: 2376648 - DNA, 13 bp, Homo sapiens
gcctcccaggcaa

SEQ ID NO: 2376649 - DNA, 19 bp, Homo sapiens
gcctccccatctgtccagc

SEQ ID NO: 2376650 - DNA, 20 bp, Homo sapiens
gcctccccatctgtccagct

SEQ ID NO: 2376651 - DNA, 19 bp, Homo sapiens
gcctccccatttcccatct

SEQ ID NO: 2376652 - DNA, 23 bp, Homo sapiens
gcctccccatttcccatctgcac

SEQ ID NO: 2376653 - DNA, 17 bp, Homo sapiens
gcctcctctggacggca

SEQ ID NO: 2376654 - DNA, 20 bp, Homo sapiens
gcctcctctggacggcaggc

SEQ ID NO: 2376655 - DNA, 17 bp, Homo sapiens
gcctcctggaggaccag

SEQ ID NO: 2376656 - DNA, 18 bp, Homo sapiens
gcctcctggaggaccaga

SEQ ID NO: 2376657 - DNA, 21 bp, Homo sapiens
gcctcctggaggaccagattg

SEQ ID NO: 2376658 - DNA, 21 bp, Homo sapiens
gcctcctgggggacctttgta

SEQ ID NO: 2376659 - DNA, 15 bp, Homo sapiens
gcctcctgtgcctgg

SEQ ID NO: 2376660 - DNA, 20 bp, Homo sapiens
gcctcctgtgcctggcccca

SEQ ID NO: 2376661 - DNA, 15 bp, Homo sapiens
gcctcgctcaccgct

SEQ ID NO: 2376662 - DNA, 22 bp, Homo sapiens
gcctcgctcaccgctggccctt

SEQ ID NO: 2376663 - DNA, 22 bp, Homo sapiens
gcctctcagtgccctccagccc

SEQ ID NO: 2376664 - DNA, 17 bp, Homo sapiens
gcctctctggaaagagg

SEQ ID NO: 2376665 - DNA, 23 bp, Homo sapiens
gcctctctggaaagaggctctgg

SEQ ID NO: 2376666 - DNA, 16 bp, Homo sapiens
gcctctgaaaagtgtg

SEQ ID NO: 2376667 - DNA, 21 bp, Homo sapiens
gcctctgcacaccctccagag

SEQ ID NO: 2376668 - DNA, 13 bp, Homo sapiens
gcctctgcccgca

SEQ ID NO: 2376669 - DNA, 16 bp, Homo sapiens
gcctctgcccgcagag

SEQ ID NO: 2376670 - DNA, 22 bp, Homo sapiens
gcctctggacagccagtgacct

SEQ ID NO: 2376671 - DNA, 21 bp, Homo sapiens
gcctgaatcatgagcctgctg

SEQ ID NO: 2376672 - DNA, 13 bp, Homo sapiens
gcctgactgctca

SEQ ID NO: 2376673 - DNA, 15 bp, Homo sapiens
gcctgactgctcaga

SEQ ID NO: 2376674 - DNA, 17 bp, Homo sapiens
gcctgagaagaagtggc

SEQ ID NO: 2376675 - DNA, 22 bp, Homo sapiens
gcctgagccctactccctgcag

SEQ ID NO: 2376676 - DNA, 13 bp, Homo sapiens
gcctgaggctgta

SEQ ID NO: 2376677 - DNA, 20 bp, Homo sapiens
gcctgagtcagtgctctcag

SEQ ID NO: 2376678 - DNA, 14 bp, Homo sapiens
gcctgcaaactggg

SEQ ID NO: 2376679 - DNA, 23 bp, Homo sapiens
gcctgcaaactgggaaccccttt

SEQ ID NO: 2376680 - DNA, 16 bp, Homo sapiens
gcctgcacaataaaaa

SEQ ID NO: 2376681 - DNA, 14 bp, Homo sapiens
gcctgcaggagaga

SEQ ID NO: 2376682 - DNA, 18 bp, Homo sapiens
gcctgcaggagagagcag

SEQ ID NO: 2376683 - DNA, 22 bp, Homo sapiens
gcctgcaggagagagcagcact

SEQ ID NO: 2376684 - DNA, 13 bp, Homo sapiens
gcctgcaggcaga

SEQ ID NO: 2376685 - DNA, 14 bp, Homo sapiens
gcctgcaggcagag

SEQ ID NO: 2376686 - DNA, 19 bp, Homo sapiens
gcctgcaggcagagctgga

SEQ ID NO: 2376687 - DNA, 13 bp, Homo sapiens
gcctgccaccttc

SEQ ID NO: 2376688 - DNA, 20 bp, Homo sapiens
gcctgccccgcccccagtcc

SEQ ID NO: 2376689 - DNA, 21 bp, Homo sapiens
gcctgccccgcccccagtccc

SEQ ID NO: 2376690 - DNA, 22 bp, Homo sapiens
gcctgccctcactccctctgca

SEQ ID NO: 2376691 - DNA, 21 bp, Homo sapiens
gcctgccgccgtctctgtccc

SEQ ID NO: 2376692 - DNA, 14 bp, Homo sapiens
gcctgccgggctga

SEQ ID NO: 2376693 - DNA, 17 bp, Homo sapiens
gcctgctgcgtcagacc

SEQ ID NO: 2376694 - DNA, 19 bp, Homo sapiens
gcctgctggaagcccagcc

SEQ ID NO: 2376695 - DNA, 13 bp, Homo sapiens
gcctgctggaggc

SEQ ID NO: 2376696 - DNA, 15 bp, Homo sapiens
gcctgctggaggcct

SEQ ID NO: 2376697 - DNA, 18 bp, Homo sapiens
gcctgctggaggcctcag

SEQ ID NO: 2376698 - DNA, 10 bp, Homo sapiens
gcctgctggc

SEQ ID NO: 2376699 - DNA, 13 bp, Homo sapiens
gcctgctggcacc

SEQ ID NO: 2376700 - DNA, 22 bp, Homo sapiens
gcctgctggcacccaccgtgga

SEQ ID NO: 2376701 - DNA, 20 bp, Homo sapiens
gcctgctggccgacccactg

SEQ ID NO: 2376702 - DNA, 16 bp, Homo sapiens
gcctgctttttggaaa

SEQ ID NO: 2376703 - DNA, 21 bp, Homo sapiens
gcctgctttttggaaagtcag

SEQ ID NO: 2376704 - DNA, 21 bp, Homo sapiens
gcctggacagtatcccacatc

SEQ ID NO: 2376705 - DNA, 20 bp, Homo sapiens
gcctggagacaaggtgctaa

SEQ ID NO: 2376706 - DNA, 13 bp, Homo sapiens
gcctggcacacat

SEQ ID NO: 2376707 - DNA, 14 bp, Homo sapiens
gcctggccaggagc

SEQ ID NO: 2376708 - DNA, 19 bp, Homo sapiens
gcctggccccagcctgggc

SEQ ID NO: 2376709 - DNA, 20 bp, Homo sapiens
gcctggccccagcctgggcc

SEQ ID NO: 2376710 - DNA, 14 bp, Homo sapiens
gcctggccccaggc

SEQ ID NO: 2376711 - DNA, 18 bp, Homo sapiens
gcctggccccaggcccca

SEQ ID NO: 2376712 - DNA, 22 bp, Homo sapiens
gcctggccccaggccccagaca

SEQ ID NO: 2376713 - DNA, 23 bp, Homo sapiens
gcctggccccaggccccagacag

SEQ ID NO: 2376714 - DNA, 20 bp, Homo sapiens
gcctggcccccaacctcagg

SEQ ID NO: 2376715 - DNA, 22 bp, Homo sapiens
gcctggcccccaacctcagggc

SEQ ID NO: 2376716 - DNA, 13 bp, Homo sapiens
gcctggcctggca

SEQ ID NO: 2376717 - DNA, 23 bp, Homo sapiens
gcctggctggaggagcagcagct

SEQ ID NO: 2376718 - DNA, 18 bp, Homo sapiens
gcctgggaaaccctctcc

SEQ ID NO: 2376719 - DNA, 19 bp, Homo sapiens
gcctgggacaactgctccc

SEQ ID NO: 2376720 - DNA, 22 bp, Homo sapiens
gcctggggctgaggctgaggca

SEQ ID NO: 2376721 - DNA, 15 bp, Homo sapiens
gcctgggttgggggc

SEQ ID NO: 2376722 - DNA, 13 bp, Homo sapiens
gcctgtctgcccc

SEQ ID NO: 2376723 - DNA, 15 bp, Homo sapiens
gcctgtctgccccag

SEQ ID NO: 2376724 - DNA, 18 bp, Homo sapiens
gcctgtgggtctctgaag

SEQ ID NO: 2376725 - DNA, 19 bp, Homo sapiens
gcctgtgggtctctgaagg

SEQ ID NO: 2376726 - DNA, 20 bp, Homo sapiens
gccttaaacctacctcccac

SEQ ID NO: 2376727 - DNA, 22 bp, Homo sapiens
gccttcaaaactatagcttgca

SEQ ID NO: 2376728 - DNA, 20 bp, Homo sapiens
gccttccaactagctgggac

SEQ ID NO: 2376729 - DNA, 19 bp, Homo sapiens
gcttccaggaaactccaca

SEQ ID NO: 2376730 - DNA, 19 bp, Homo sapiens
gcttccattttaattttaa

SEQ ID NO: 2376731 - DNA, 15 bp, Homo sapiens
gcttccctccatccc

SEQ ID NO: 2376732 - DNA, 15 bp, Homo sapiens
gcttcccttactttg

SEQ ID NO: 2376733 - DNA, 20 bp, Homo sapiens
gcttcctctagaagccaagg

SEQ ID NO: 2376734 - DNA, 22 bp, Homo sapiens
gcttcctctagaagccaaggga

SEQ ID NO: 2376735 - DNA, 23 bp, Homo sapiens
gcttcctctagaagccaagggaa

SEQ ID NO: 2376736 - DNA, 17 bp, Homo sapiens
gcttcctgcccttccct

SEQ ID NO: 2376737 - DNA, 19 bp, Homo sapiens
gcttcctgcccttccctct

SEQ ID NO: 2376738 - DNA, 14 bp, Homo sapiens
gcttcgtttatttt

SEQ ID NO: 2376739 - DNA, 19 bp, Homo sapiens
gcttctccccagagctgcc

SEQ ID NO: 2376740 - DNA, 20 bp, Homo sapiens
gcttctccccagagctgcct

SEQ ID NO: 2376741 - DNA, 21 bp, Homo sapiens
gcttctccccagagctgcctg

SEQ ID NO: 2376742 - DNA, 16 bp, Homo sapiens
gcttctctccacagtg

SEQ ID NO: 2376743 - DNA, 13 bp, Homo sapiens
gcttctcttttga

SEQ ID NO: 2376744 - DNA, 15 bp, Homo sapiens
gcttctgctggggcc

SEQ ID NO: 2376745 - DNA, 21 bp, Homo sapiens
gcttctgctggggcctgggac

SEQ ID NO: 2376746 - DNA, 14 bp, Homo sapiens
gcttctgcttttct

SEQ ID NO: 2376747 - DNA, 16 bp, Homo sapiens
gcttctgcttttctgc

SEQ ID NO: 2376748 - DNA, 16 bp, Homo sapiens
gcttctgtatttcctt

SEQ ID NO: 2376749 - DNA, 17 bp, Homo sapiens
gcttctgtgatgagctg

SEQ ID NO: 2376750 - DNA, 19 bp, Homo sapiens
gcttctgtgatgagctgat

SEQ ID NO: 2376751 - DNA, 16 bp, Homo sapiens
gcttcttgtttccttg

SEQ ID NO: 2376752 - DNA, 15 bp, Homo sapiens
gcttgaagccaaaga

SEQ ID NO: 2376753 - DNA, 16 bp, Homo sapiens
gcttgaagccaaagaa

SEQ ID NO: 2376754 - DNA, 16 bp, Homo sapiens
gcttgaaggccctgct

SEQ ID NO: 2376755 - DNA, 20 bp, Homo sapiens
gcttgaaggccctgctgagt

SEQ ID NO: 2376756 - DNA, 13 bp, Homo sapiens
gcttgaccctgaa

SEQ ID NO: 2376757 - DNA, 22 bp, Homo sapiens
gcttgagaaggttactgagtga

SEQ ID NO: 2376758 - DNA, 21 bp, Homo sapiens
gcttgagagccctgaggccta

SEQ ID NO: 2376759 - DNA, 12 bp, Homo sapiens
gcttgagccggg

SEQ ID NO: 2376760 - DNA, 17 bp, Homo sapiens
gcttgagccgggcccct

SEQ ID NO: 2376761 - DNA, 22 bp, Homo sapiens
gcttgagccgggcccctgggct

SEQ ID NO: 2376762 - DNA, 14 bp, Homo sapiens
gcttgagctagaga

SEQ ID NO: 2376763 - DNA, 15 bp, Homo sapiens
gcttgatccagaaga

SEQ ID NO: 2376764 - DNA, 13 bp, Homo sapiens
gcttgattaaatc

SEQ ID NO: 2376765 - DNA, 14 bp, Homo sapiens
gcttgatttttgcc

SEQ ID NO: 2376766 - DNA, 11 bp, Homo sapiens
gcttgcagaac

SEQ ID NO: 2376767 - DNA, 23 bp, Homo sapiens
gcttgcccagtacatttaaattt

SEQ ID NO: 2376768 - DNA, 18 bp, Homo sapiens
gcttgcggcaaaaggaaa

SEQ ID NO: 2376769 - DNA, 12 bp, Homo sapiens
gcttgctccaga

SEQ ID NO: 2376770 - DNA, 20 bp, Homo sapiens
gcttgctccagattctgatg

SEQ ID NO: 2376771 - DNA, 12 bp, Homo sapiens
gcttgcttttct

SEQ ID NO: 2376772 - DNA, 15 bp, Homo sapiens
gcttggcctgctgtg

SEQ ID NO: 2376773 - DNA, 15 bp, Homo sapiens
gcttgggcagtgccc

SEQ ID NO: 2376774 - DNA, 22 bp, Homo sapiens
gcttgtaggggaggggctcctt

SEQ ID NO: 2376775 - DNA, 20 bp, Homo sapiens
gcttgtctatactccttccc

SEQ ID NO: 2376776 - DNA, 12 bp, Homo sapiens
gcttgtgacagt

SEQ ID NO: 2376777 - DNA, 18 bp, Homo sapiens
gcttgtggggcctgggag

SEQ ID NO: 2376778 - DNA, 18 bp, Homo sapiens
gcttgttcatcatccaga

SEQ ID NO: 2376779 - DNA, 22 bp, Homo sapiens
gcttgttgtttttaagtcctgt

SEQ ID NO: 2376780 - DNA, 16 bp, Homo sapiens
gcttgtttacctttct

SEQ ID NO: 2376781 - DNA, 18 bp, Homo sapiens
gcttgtttacctttctct

SEQ ID NO: 2376782 - DNA, 13 bp, Homo sapiens
gctttaatcagaa

SEQ ID NO: 2376783 - DNA, 17 bp, Homo sapiens
gctttaccttttcaggg

SEQ ID NO: 2376784 - DNA, 20 bp, Homo sapiens
gctttaccttttcagggctg

SEQ ID NO: 2376785 - DNA, 14 bp, Homo sapiens
gctttcacattgta

SEQ ID NO: 2376786 - DNA, 23 bp, Homo sapiens
gctttccaggcaccctcagggag

SEQ ID NO: 2376787 - DNA, 11 bp, Homo sapiens
gctttcctgaa

SEQ ID NO: 2376788 - DNA, 12 bp, Homo sapiens
gctttcctgaat

SEQ ID NO: 2376789 - DNA, 22 bp, Homo sapiens
gctttcctgaatccaaactaat

SEQ ID NO: 2376790 - DNA, 21 bp, Homo sapiens
gctttctgggatgtcacagtc

SEQ ID NO: 2376791 - DNA, 23 bp, Homo sapiens
gctttctggggcctagcgatctc

SEQ ID NO: 2376792 - DNA, 22 bp, Homo sapiens
gctttgagaagccttcagctcc

SEQ ID NO: 2376793 - DNA, 16 bp, Homo sapiens
gctttgccattgtgaa

SEQ ID NO: 2376794 - DNA, 21 bp, Homo sapiens
gctttggaagtttagctctga

SEQ ID NO: 2376795 - DNA, 17 bp, Homo sapiens
gctttggacctaatcca

SEQ ID NO: 2376796 - DNA, 15 bp, Homo sapiens
gctttggctgagacc

SEQ ID NO: 2376797 - DNA, 21 bp, Homo sapiens
gctttggggggtgtgctgaca

SEQ ID NO: 2376798 - DNA, 20 bp, Homo sapiens
gctttggttaagggctccct

SEQ ID NO: 2376799 - DNA, 23 bp, Homo sapiens
gctttggttaagggctccctaaa

SEQ ID NO: 2376800 - DNA, 17 bp, Homo sapiens
gcttttctgccctggct

SEQ ID NO: 2376801 - DNA, 18 bp, Homo sapiens
gcttttctgccctggctg

SEQ ID NO: 2376802 - DNA, 14 bp, Homo sapiens
gcttttctgtattt

SEQ ID NO: 2376803 - DNA, 13 bp, Homo sapiens
gcttttgctagat

SEQ ID NO: 2376804 - DNA, 12 bp, Homo sapiens
gctttttggaaa

SEQ ID NO: 2376805 - DNA, 13 bp, Homo sapiens
gctttttggaatc

SEQ ID NO: 2376806 - DNA, 15 bp, Homo sapiens
gcttttttattttaa

SEQ ID NO: 2376807 - DNA, 16 bp, Homo sapiens
ggaaaaaactctgaag

SEQ ID NO: 2376808 - DNA, 22 bp, Homo sapiens
ggaaaaaactctgaaggagagg

SEQ ID NO: 2376809 - DNA, 13 bp, Homo sapiens
ggaaaacatttgc

SEQ ID NO: 2376810 - DNA, 14 bp, Homo sapiens
ggaaaacatttgct

SEQ ID NO: 2376811 - DNA, 13 bp, Homo sapiens
ggaaaactgtgtt

SEQ ID NO: 2376812 - DNA, 22 bp, Homo sapiens
ggaaaagataaagaccagaaat

SEQ ID NO: 2376813 - DNA, 22 bp, Homo sapiens
ggaaaagcaacttcatttgaca

SEQ ID NO: 2376814 - DNA, 20 bp, Homo sapiens
ggaaaaggttgaataatata

SEQ ID NO: 2376815 - DNA, 21 bp, Homo sapiens
ggaaaatggccatgcaggagg

SEQ ID NO: 2376816 - DNA, 20 bp, Homo sapiens
ggaaaccctctccatctccc

SEQ ID NO: 2376817 - DNA, 22 bp, Homo sapiens
ggaaaccgagtagaaaatgtga

SEQ ID NO: 2376818 - DNA, 21 bp, Homo sapiens
ggaaactccacatctgcctta

SEQ ID NO: 2376819 - DNA, 20 bp, Homo sapiens
ggaaagggctggctccccct

SEQ ID NO: 2376820 - DNA, 13 bp, Homo sapiens
ggaaaggggagag

SEQ ID NO: 2376821 - DNA, 14 bp, Homo sapiens
ggaaaggggagagc

SEQ ID NO: 2376822 - DNA, 20 bp, Homo sapiens
ggaaataaaagataaaagag

SEQ ID NO: 2376823 - DNA, 20 bp, Homo sapiens
ggaaatagaaagaagccata

SEQ ID NO: 2376824 - DNA, 15 bp, Homo sapiens
ggaaatatctgtgaa

SEQ ID NO: 2376825 - DNA, 18 bp, Homo sapiens
ggaaatgtcacagaagca

SEQ ID NO: 2376826 - DNA, 14 bp, Homo sapiens
ggaaatgtctgctg

SEQ ID NO: 2376827 - DNA, 15 bp, Homo sapiens
ggaaatgtctgctgg

SEQ ID NO: 2376828 - DNA, 14 bp, Homo sapiens
ggaacatgccccct

SEQ ID NO: 2376829 - DNA, 22 bp, Homo sapiens
ggaaccagccccatcagaacct

SEQ ID NO: 2376830 - DNA, 14 bp, Homo sapiens
ggaacccctttccc

SEQ ID NO: 2376831 - DNA, 17 bp, Homo sapiens
ggaacccctttcccacc

SEQ ID NO: 2376832 - DNA, 21 bp, Homo sapiens
ggaaccgtggtatgtctgcca

SEQ ID NO: 2376833 - DNA, 15 bp, Homo sapiens
ggaactgaattgtgt

SEQ ID NO: 2376834 - DNA, 23 bp, Homo sapiens
ggaacttgcgagtccaaggccag

SEQ ID NO: 2376835 - DNA, 11 bp, Homo sapiens
ggaagaaaaag

SEQ ID NO: 2376836 - DNA, 14 bp, Homo sapiens
ggaagaaaaagcaa

SEQ ID NO: 2376837 - DNA, 19 bp, Homo sapiens
ggaagaagcaagggcaaga

SEQ ID NO: 2376838 - DNA, 17 bp, Homo sapiens
ggaagagaggcacctgc

SEQ ID NO: 2376839 - DNA, 13 bp, Homo sapiens
ggaagagccacct

SEQ ID NO: 2376840 - DNA, 16 bp, Homo sapiens
ggaagagccacctgca

SEQ ID NO: 2376841 - DNA, 14 bp, Homo sapiens
ggaagccagagccc

SEQ ID NO: 2376842 - DNA, 23 bp, Homo sapiens
ggaagccagagccccaagcagga

SEQ ID NO: 2376843 - DNA, 23 bp, Homo sapiens
ggaagcccagcccctactgctgt

SEQ ID NO: 2376844 - DNA, 15 bp, Homo sapiens
ggctggctcctgatc

SEQ ID NO: 2376845 - DNA, 15 bp, Homo sapiens
ggctgggagtcccta

SEQ ID NO: 2376846 - DNA, 21 bp, Homo sapiens
ggctgggccatgtccaaagag

SEQ ID NO: 2376847 - DNA, 15 bp, Homo sapiens
ggctggggaggacca

SEQ ID NO: 2376848 - DNA, 18 bp, Homo sapiens
ggctggggaggaccaggg

SEQ ID NO: 2376849 - DNA, 18 bp, Homo sapiens
ggctgggggagagccgtg

SEQ ID NO: 2376850 - DNA, 13 bp, Homo sapiens
ggctgggtccacc

SEQ ID NO: 2376851 - DNA, 15 bp, Homo sapiens
ggctgggtgctggga

SEQ ID NO: 2376852 - DNA, 22 bp, Homo sapiens
ggctggtggagaactctggctt

SEQ ID NO: 2376853 - DNA, 21 bp, Homo sapiens
ggctgtaagcattctgagctg

SEQ ID NO: 2376854 - DNA, 21 bp, Homo sapiens
ggctgtccccctcctcccagg

SEQ ID NO: 2376855 - DNA, 17 bp, Homo sapiens
ggctgtgcttgaaggcc

SEQ ID NO: 2376856 - DNA, 19 bp, Homo sapiens
ggctgtgcttgaaggccct

SEQ ID NO: 2376857 - DNA, 21 bp, Homo sapiens
ggctgtgcttgaaggccctgc

SEQ ID NO: 2376858 - DNA, 19 bp, Homo sapiens
ggctgtggcatttccaaac

SEQ ID NO: 2376859 - DNA, 20 bp, Homo sapiens
ggctgtggggtggagcactg

SEQ ID NO: 2376860 - DNA, 16 bp, Homo sapiens
ggctgtgttatgaaaa

SEQ ID NO: 2376861 - DNA, 13 bp, Homo sapiens
ggctgttccatgt

SEQ ID NO: 2376862 - DNA, 21 bp, Homo sapiens
ggcttaagtgagcagaacagg

SEQ ID NO: 2376863 - DNA, 19 bp, Homo sapiens
ggcttatttctatgacaaa

SEQ ID NO: 2376864 - DNA, 18 bp, Homo sapiens
ggcttcactgtataaata

SEQ ID NO: 2376865 - DNA, 21 bp, Homo sapiens
ggcttcactgtataaatagga

SEQ ID NO: 2376866 - DNA, 16 bp, Homo sapiens
ggcttcatctctttag

SEQ ID NO: 2376867 - DNA, 12 bp, Homo sapiens
ggcttcctgccc

SEQ ID NO: 2376868 - DNA, 19 bp, Homo sapiens
ggcttcctgcgtcctcctc

SEQ ID NO: 2376869 - DNA, 20 bp, Homo sapiens
ggcttcctgcgtcctcctca

SEQ ID NO: 2376870 - DNA, 17 bp, Homo sapiens
ggcttctccgccagcct

SEQ ID NO: 2376871 - DNA, 16 bp, Homo sapiens
ggcttctcctcctctg

SEQ ID NO: 2376872 - DNA, 21 bp, Homo sapiens
ggcttctgctggggcctggga

SEQ ID NO: 2376873 - DNA, 21 bp, Homo sapiens
ggcttctgtgatgagctgatc

SEQ ID NO: 2376874 - DNA, 12 bp, Homo sapiens
ggcttgaagcca

SEQ ID NO: 2376875 - DNA, 20 bp, Homo sapiens
ggcttgaagccaaagaaaaa

SEQ ID NO: 2376876 - DNA, 14 bp, Homo sapiens
ggcttgaagctgtg

SEQ ID NO: 2376877 - DNA, 13 bp, Homo sapiens
ggcttggcctgct

SEQ ID NO: 2376878 - DNA, 16 bp, Homo sapiens
ggcttgtggggcctgg

SEQ ID NO: 2376879 - DNA, 18 bp, Homo sapiens
ggcttgtggggcctggga

SEQ ID NO: 2376880 - DNA, 14 bp, Homo sapiens
ggctttctggggcc

SEQ ID NO: 2376881 - DNA, 21 bp, Homo sapiens
gggaaactggccatggcctgc

SEQ ID NO: 2376882 - DNA, 13 bp, Homo sapiens
gggaacagccact

SEQ ID NO: 2376883 - DNA, 14 bp, Homo sapiens
gggaacccctttcc

SEQ ID NO: 2376884 - DNA, 17 bp, Homo sapiens
gggaacccctttcccac

SEQ ID NO: 2376885 - DNA, 13 bp, Homo sapiens
gggaagctggctt

SEQ ID NO: 2376886 - DNA, 14 bp, Homo sapiens
gggaagctggcttt

SEQ ID NO: 2376887 - DNA, 16 bp, Homo sapiens
gggaaggccctgaggc

SEQ ID NO: 2376888 - DNA, 16 bp, Homo sapiens
gggaaggcgagtctgg

SEQ ID NO: 2376889 - DNA, 22 bp, Homo sapiens
gggaattaaaaagaagatgaat

SEQ ID NO: 2376890 - DNA, 13 bp, Homo sapiens
gggacaagggatt

SEQ ID NO: 2376891 - DNA, 22 bp, Homo sapiens
gggacagagtagccaggttctg

SEQ ID NO: 2376892 - DNA, 20 bp, Homo sapiens
gggacaggatctataggcag

SEQ ID NO: 2376893 - DNA, 13 bp, Homo sapiens
gggaccccccccc

SEQ ID NO: 2376894 - DNA, 18 bp, Homo sapiens
gggacctgccaggcaggg

SEQ ID NO: 2376895 - DNA, 17 bp, Homo sapiens
gggactgccaggctgtt

SEQ ID NO: 2376896 - DNA, 15 bp, Homo sapiens
gggacttgtgtctgc

SEQ ID NO: 2376897 - DNA, 22 bp, Homo sapiens
gggagaagaaaggtgagtttga

SEQ ID NO: 2376898 - DNA, 18 bp, Homo sapiens
gggagaagtgggggcagc

SEQ ID NO: 2376899 - DNA, 22 bp, Homo sapiens
gggagagagagagagagaggac

SEQ ID NO: 2376900 - DNA, 13 bp, Homo sapiens
gggagagcctgct

SEQ ID NO: 2376901 - DNA, 19 bp, Homo sapiens
gggagatggagttcttgtg

SEQ ID NO: 2376902 - DNA, 11 bp, Homo sapiens
gggagcctccc

SEQ ID NO: 2376903 - DNA, 14 bp, Homo sapiens
gggagcctccccat

SEQ ID NO: 2376904 - DNA, 18 bp, Homo sapiens
gggaggaccagggccctg

SEQ ID NO: 2376905 - DNA, 14 bp, Homo sapiens
gggaggagggagag

SEQ ID NO: 2376906 - DNA, 18 bp, Homo sapiens
gggaggagggagagggag

SEQ ID NO: 2376907 - DNA, 16 bp, Homo sapiens
gggagggcaggatggc

SEQ ID NO: 2376908 - DNA, 14 bp, Homo sapiens
gggaggggctcctt

SEQ ID NO: 2376909 - DNA, 15 bp, Homo sapiens
gggaggggctccttt

SEQ ID NO: 2376910 - DNA, 20 bp, Homo sapiens
gggagtccagggtttctctg

SEQ ID NO: 2376911 - DNA, 19 bp, Homo sapiens
gggatacagatctcagggc

SEQ ID NO: 2376912 - DNA, 18 bp, Homo sapiens
gggatcaggggtaggaat

SEQ ID NO: 2376913 - DNA, 17 bp, Homo sapiens
gggatccccgcctggcc

SEQ ID NO: 2376914 - DNA, 20 bp, Homo sapiens
gggatccccgcctggccagg

SEQ ID NO: 2376915 - DNA, 22 bp, Homo sapiens
gggatccccgcctggccaggag

SEQ ID NO: 2376916 - DNA, 14 bp, Homo sapiens
gggatcctgcctgc

SEQ ID NO: 2376917 - DNA, 18 bp, Homo sapiens
gggatctaaaaaaatgtt

SEQ ID NO: 2376918 - DNA, 12 bp, Homo sapiens
gggatctgagaa

SEQ ID NO: 2376919 - DNA, 15 bp, Homo sapiens
gggatttgcctcacc

SEQ ID NO: 2376920 - DNA, 14 bp, Homo sapiens
gggcacagtccaga

SEQ ID NO: 2376921 - DNA, 23 bp, Homo sapiens
gggcactccgcgccgatgccacc

SEQ ID NO: 2376922 - DNA, 22 bp, Homo sapiens
gggcagatcttggactcatgag

SEQ ID NO: 2376923 - DNA, 15 bp, Homo sapiens
gggcagcacaggagg

SEQ ID NO: 2376924 - DNA, 12 bp, Homo sapiens
gggcagctgcta

SEQ ID NO: 2376925 - DNA, 12 bp, Homo sapiens
gggcaggctggg

SEQ ID NO: 2376926 - DNA, 11 bp, Homo sapiens
gggcagggctg

SEQ ID NO: 2376927 - DNA, 17 bp, Homo sapiens
gggcagggtctgggctg

SEQ ID NO: 2376928 - DNA, 14 bp, Homo sapiens
gggcagtgccccag

SEQ ID NO: 2376929 - DNA, 15 bp, Homo sapiens
gggcagtgccccagg

SEQ ID NO: 2376930 - DNA, 20 bp, Homo sapiens
gggcatctcttccccagaga

SEQ ID NO: 2376931 - DNA, 13 bp, Homo sapiens
gggccaaggacct

SEQ ID NO: 2376932 - DNA, 15 bp, Homo sapiens
gggccaaggacctga

SEQ ID NO: 2376933 - DNA, 16 bp, Homo sapiens
gggccaccaaagctgc

SEQ ID NO: 2376934 - DNA, 19 bp, Homo sapiens
gggccaccaaagctgccca

SEQ ID NO: 2376935 - DNA, 13 bp, Homo sapiens
gggccagggctgc

SEQ ID NO: 2376936 - DNA, 22 bp, Homo sapiens
gggccataaacggttcctggtg

SEQ ID NO: 2376937 - DNA, 14 bp, Homo sapiens
gggccatttgcaat

SEQ ID NO: 2376938 - DNA, 12 bp, Homo sapiens
gggcccagcccc

SEQ ID NO: 2376939 - DNA, 15 bp, Homo sapiens
gggcccccctgccct

SEQ ID NO: 2376940 - DNA, 14 bp, Homo sapiens
gggcccctgggctt

SEQ ID NO: 2376941 - DNA, 23 bp, Homo sapiens
gggcccctgggcttggcctgctg

SEQ ID NO: 2376942 - DNA, 22 bp, Homo sapiens
gggccccttccaaatgtccctc

SEQ ID NO: 2376943 - DNA, 12 bp, Homo sapiens
gggccctgggca

SEQ ID NO: 2376944 - DNA, 16 bp, Homo sapiens
gggccctgggcagggc

SEQ ID NO: 2376945 - DNA, 23 bp, Homo sapiens
gggcctagcgatctctcctggcc

SEQ ID NO: 2376946 - DNA, 11 bp, Homo sapiens
gggcctcagtg

SEQ ID NO: 2376947 - DNA, 15 bp, Homo sapiens
gggcctcctggggga

SEQ ID NO: 2376948 - DNA, 18 bp, Homo sapiens
gggcctcctgggggacct

SEQ ID NO: 2376949 - DNA, 14 bp, Homo sapiens
gggcctgccgggct

SEQ ID NO: 2376950 - DNA, 15 bp, Homo sapiens
gggcctgccgggctg

SEQ ID NO: 2376951 - DNA, 21 bp, Homo sapiens
gggcctgccgggctgagggcc

SEQ ID NO: 2376952 - DNA, 11 bp, Homo sapiens
gggcctgctgc

SEQ ID NO: 2376953 - DNA, 23 bp, Homo sapiens
gggccttatcgggctccagccat

SEQ ID NO: 2376954 - DNA, 21 bp, Homo sapiens
gggctcaagcaatcctcctgc

SEQ ID NO: 2376955 - DNA, 13 bp, Homo sapiens
gggctcccagggc

SEQ ID NO: 2376956 - DNA, 14 bp, Homo sapiens
gggctcccaggggt

SEQ ID NO: 2376957 - DNA, 22 bp, Homo sapiens
gggctccctaaactttggcctt

SEQ ID NO: 2376958 - DNA, 15 bp, Homo sapiens
gggctgaggccagag

SEQ ID NO: 2376959 - DNA, 18 bp, Homo sapiens
gggctgaggccagagtca

SEQ ID NO: 2376960 - DNA, 15 bp, Homo sapiens
gtgacatggtgcctg

SEQ ID NO: 2376961 - DNA, 23 bp, Homo sapiens
gtgacatggtgcctgagaggcag

SEQ ID NO: 2376962 - DNA, 17 bp, Homo sapiens
gtgacatgtgaaacctt

SEQ ID NO: 2376963 - DNA, 16 bp, Homo sapiens
gtgacccgacctggcc

SEQ ID NO: 2376964 - DNA, 12 bp, Homo sapiens
gtgaccctccaa

SEQ ID NO: 2376965 - DNA, 20 bp, Homo sapiens
gtgacggtcctttaggcagc

SEQ ID NO: 2376966 - DNA, 21 bp, Homo sapiens
gtgacggtcctttaggcagcc

SEQ ID NO: 2376967 - DNA, 23 bp, Homo sapiens
gtgacttatttgctcataagtaa

SEQ ID NO: 2376968 - DNA, 15 bp, Homo sapiens
gtgacttcctggtga

SEQ ID NO: 2376969 - DNA, 12 bp, Homo sapiens
gtgagcagaaca

SEQ ID NO: 2376970 - DNA, 16 bp, Homo sapiens
gtgagccaaaatcatg

SEQ ID NO: 2376971 - DNA, 13 bp, Homo sapiens
gtgagcctcctgt

SEQ ID NO: 2376972 - DNA, 15 bp, Homo sapiens
gtgagcctcctgtgc

SEQ ID NO: 2376973 - DNA, 21 bp, Homo sapiens
gtgagcctcctgtgcctggcc

SEQ ID NO: 2376974 - DNA, 20 bp, Homo sapiens
gtgagctggatagacttggg

SEQ ID NO: 2376975 - DNA, 23 bp, Homo sapiens
gtgagctggatagacttgggatg

SEQ ID NO: 2376976 - DNA, 23 bp, Homo sapiens
gtgagggtgccccgcctgagtca

SEQ ID NO: 2376977 - DNA, 15 bp, Homo sapiens
gtgagtccattctcc

SEQ ID NO: 2376978 - DNA, 17 bp, Homo sapiens
gtgagtttgagctgcct

SEQ ID NO: 2376979 - DNA, 15 bp, Homo sapiens
gtgatacatttttta

SEQ ID NO: 2376980 - DNA, 17 bp, Homo sapiens
gtgatcaatatttttat

SEQ ID NO: 2376981 - DNA, 20 bp, Homo sapiens
gtgatcaatatttttatatc

SEQ ID NO: 2376982 - DNA, 23 bp, Homo sapiens
gtgatccacccaaccctatctcc

SEQ ID NO: 2376983 - DNA, 21 bp, Homo sapiens
gtgatctgttgtaatatcagt

SEQ ID NO: 2376984 - DNA, 15 bp, Homo sapiens
gtgatcttaaaataa

SEQ ID NO: 2376985 - DNA, 12 bp, Homo sapiens
gtgatgagctga

SEQ ID NO: 2376986 - DNA, 10 bp, Homo sapiens
gtgatgtgga

SEQ ID NO: 2376987 - DNA, 15 bp, Homo sapiens
gtgatgtggaggaag

SEQ ID NO: 2376988 - DNA, 17 bp, Homo sapiens
gtgattaccccgggaga

SEQ ID NO: 2376989 - DNA, 16 bp, Homo sapiens
gtgattcaatctgtaa

SEQ ID NO: 2376990 - DNA, 21 bp, Homo sapiens
gtgattcaatctgtaaactgt

SEQ ID NO: 2376991 - DNA, 17 bp, Homo sapiens
gtgatttgaaaaatata

SEQ ID NO: 2376992 - DNA, 17 bp, Homo sapiens
gtgattttcaagcagca

SEQ ID NO: 2376993 - DNA, 16 bp, Homo sapiens
gtgcaaaggtgtgctt

SEQ ID NO: 2376994 - DNA, 19 bp, Homo sapiens
gtgcaacctcgctgagggc

SEQ ID NO: 2376995 - DNA, 17 bp, Homo sapiens
gtgcaaggtggcctttg

SEQ ID NO: 2376996 - DNA, 21 bp, Homo sapiens
gtgcaatacttagagaaccta

SEQ ID NO: 2376997 - DNA, 15 bp, Homo sapiens
gtgcactgggaggct

SEQ ID NO: 2376998 - DNA, 14 bp, Homo sapiens
gtgcagtttctttt

SEQ ID NO: 2376999 - DNA, 20 bp, Homo sapiens
gtgcatagttgtagacaaag

SEQ ID NO: 2377000 - DNA, 15 bp, Homo sapiens
gtgcatagtttcttt

SEQ ID NO: 2377001 - DNA, 14 bp, Homo sapiens
gtgcatcccccctg

SEQ ID NO: 2377002 - DNA, 15 bp, Homo sapiens
gtgcatttttgtaaa

SEQ ID NO: 2377003 - DNA, 16 bp, Homo sapiens
gtgcatttttgtgaaa

SEQ ID NO: 2377004 - DNA, 21 bp, Homo sapiens
gtgccaatttcaagttccaag

SEQ ID NO: 2377005 - DNA, 14 bp, Homo sapiens
gtgccactgacttg

SEQ ID NO: 2377006 - DNA, 22 bp, Homo sapiens
gtgccactgacttgctgtgtga

SEQ ID NO: 2377007 - DNA, 20 bp, Homo sapiens
gtgccagaggaatcctggca

SEQ ID NO: 2377008 - DNA, 23 bp, Homo sapiens
gtgccagttgggctcgcactgcc

SEQ ID NO: 2377009 - DNA, 16 bp, Homo sapiens
gtgcccacatttgatg

SEQ ID NO: 2377010 - DNA, 12 bp, Homo sapiens
gtgccccaggga

SEQ ID NO: 2377011 - DNA, 12 bp, Homo sapiens
gtgccccttcac

SEQ ID NO: 2377012 - DNA, 15 bp, Homo sapiens
gtgccctctcccacc

SEQ ID NO: 2377013 - DNA, 20 bp, Homo sapiens
gtgccctctcccaccctctt

SEQ ID NO: 2377014 - DNA, 22 bp, Homo sapiens
gtgccctctcccaccctcttcc

SEQ ID NO: 2377015 - DNA, 20 bp, Homo sapiens
gtgcccttcctgctgcgcag

SEQ ID NO: 2377016 - DNA, 14 bp, Homo sapiens
gtgccgtggcacca

SEQ ID NO: 2377017 - DNA, 21 bp, Homo sapiens
gtgcctggagttgactgactg

SEQ ID NO: 2377018 - DNA, 20 bp, Homo sapiens
gtgcctggccccagcctggg

SEQ ID NO: 2377019 - DNA, 23 bp, Homo sapiens
gtgccttcctgtttttcacattt

SEQ ID NO: 2377020 - DNA, 17 bp, Homo sapiens
gtgcgggctgaggccag

SEQ ID NO: 2377021 - DNA, 15 bp, Homo sapiens
gtgcgtaaggatgtg

SEQ ID NO: 2377022 - DNA, 16 bp, Homo sapiens
gtgcgtctccagtcat

SEQ ID NO: 2377023 - DNA, 13 bp, Homo sapiens
gtgcgtgtgtaga

SEQ ID NO: 2377024 - DNA, 19 bp, Homo sapiens
gtgcgtgttcagcagaacc

SEQ ID NO: 2377025 - DNA, 13 bp, Homo sapiens
gtgctaagtgctt

SEQ ID NO: 2377026 - DNA, 11 bp, Homo sapiens
gtgctactggg

SEQ ID NO: 2377027 - DNA, 13 bp, Homo sapiens
gtgctactgggga

SEQ ID NO: 2377028 - DNA, 23 bp, Homo sapiens
gtgctataatctgtttttacgta

SEQ ID NO: 2377029 - DNA, 17 bp, Homo sapiens
gtgctatttaacatttt

SEQ ID NO: 2377030 - DNA, 13 bp, Homo sapiens
gtgctcaaggcca

SEQ ID NO: 2377031 - DNA, 22 bp, Homo sapiens
gtgctccatatttgatttctaa

SEQ ID NO: 2377032 - DNA, 14 bp, Homo sapiens
gtgctcccctgcca

SEQ ID NO: 2377033 - DNA, 16 bp, Homo sapiens
gtgctcccctgccaca

SEQ ID NO: 2377034 - DNA, 13 bp, Homo sapiens
gtgctctgcctca

SEQ ID NO: 2377035 - DNA, 20 bp, Homo sapiens
gtgctgacaacttagctcag

SEQ ID NO: 2377036 - DNA, 17 bp, Homo sapiens
gtgctggagtctcctga

SEQ ID NO: 2377037 - DNA, 14 bp, Homo sapiens
gtgctgggaaggga

SEQ ID NO: 2377038 - DNA, 18 bp, Homo sapiens
gtgctgggaagggagggt

SEQ ID NO: 2377039 - DNA, 18 bp, Homo sapiens
gtgctgggaggagggaga

SEQ ID NO: 2377040 - DNA, 23 bp, Homo sapiens
gtgctgggaggagggagagggag

SEQ ID NO: 2377041 - DNA, 18 bp, Homo sapiens
gtgctgggcggctgtgct

SEQ ID NO: 2377042 - DNA, 14 bp, Homo sapiens
gtgctgtgagggag

SEQ ID NO: 2377043 - DNA, 22 bp, Homo sapiens
gtgcttcacagtagagccagct

SEQ ID NO: 2377044 - DNA, 15 bp, Homo sapiens
gtgcttcctgctgta

SEQ ID NO: 2377045 - DNA, 13 bp, Homo sapiens
gtgcttgaaggcc

SEQ ID NO: 2377046 - DNA, 18 bp, Homo sapiens
gtgcttttatagaggcta

SEQ ID NO: 2377047 - DNA, 16 bp, Homo sapiens
gtggaagaagggagaa

SEQ ID NO: 2377048 - DNA, 20 bp, Homo sapiens
gtggaagaagggagaagaaa

SEQ ID NO: 2377049 - DNA, 13 bp, Homo sapiens
gtggactggctca

SEQ ID NO: 2377050 - DNA, 14 bp, Homo sapiens
gtggactgtatttc

SEQ ID NO: 2377051 - DNA, 15 bp, Homo sapiens
gtggagaccctgcca

SEQ ID NO: 2377052 - DNA, 15 bp, Homo sapiens
gtggagcactggact

SEQ ID NO: 2377053 - DNA, 16 bp, Homo sapiens
gtggaggaaggattgt

SEQ ID NO: 2377054 - DNA, 17 bp, Homo sapiens
gtggaggaggaaggcaa

SEQ ID NO: 2377055 - DNA, 12 bp, Homo sapiens
gtggagggaggg

SEQ ID NO: 2377056 - DNA, 23 bp, Homo sapiens
gtggaggggtgtggcagtggttt

SEQ ID NO: 2377057 - DNA, 20 bp, Homo sapiens
gtggagttcaccttggaagg

SEQ ID NO: 2377058 - DNA, 22 bp, Homo sapiens
gtggatcacgaggtcaggagat

SEQ ID NO: 2377059 - DNA, 14 bp, Homo sapiens
gtggattgtttttt

SEQ ID NO: 2377060 - DNA, 16 bp, Homo sapiens
gtggcaatctgtgggc

SEQ ID NO: 2377061 - DNA, 19 bp, Homo sapiens
gtggcaccaggcgctgccc

SEQ ID NO: 2377062 - DNA, 18 bp, Homo sapiens
gtggcagatgtcttccct

SEQ ID NO: 2377063 - DNA, 19 bp, Homo sapiens
gtggcagatgtcttccctg

SEQ ID NO: 2377064 - DNA, 15 bp, Homo sapiens
gtggcatttccaaac

SEQ ID NO: 2377065 - DNA, 19 bp, Homo sapiens
gtggccacagcaagtacag

SEQ ID NO: 2377066 - DNA, 16 bp, Homo sapiens
gtggccacagcgccag

SEQ ID NO: 2377067 - DNA, 20 bp, Homo sapiens
gtggctctgggatcctgggg

SEQ ID NO: 2377068 - DNA, 18 bp, Homo sapiens
gtggctgccacacccagg

SEQ ID NO: 2377069 - DNA, 19 bp, Homo sapiens
gtggctgccacacccaggg

SEQ ID NO: 2377070 - DNA, 22 bp, Homo sapiens
gtggctggaaccacattgaaga

SEQ ID NO: 2377071 - DNA, 12 bp, Homo sapiens
gtggctggctct

SEQ ID NO: 2377072 - DNA, 15 bp, Homo sapiens
gtggctggctctacc

SEQ ID NO: 2377073 - DNA, 11 bp, Homo sapiens
gtggctgggca

SEQ ID NO: 2377074 - DNA, 21 bp, Homo sapiens
gtggctgttgacgcacctgtg

SEQ ID NO: 2377075 - DNA, 20 bp, Homo sapiens
taatgcttttctaattaata

SEQ ID NO: 2377076 - DNA, 14 bp, Homo sapiens
taatggcatttctc

SEQ ID NO: 2377077 - DNA, 15 bp, Homo sapiens
taatggcatttctct

SEQ ID NO: 2377078 - DNA, 21 bp, Homo sapiens
taatgtgacttggattcaatt

SEQ ID NO: 2377079 - DNA, 19 bp, Homo sapiens
taatgtgagtagttactaa

SEQ ID NO: 2377080 - DNA, 19 bp, Homo sapiens
taatgtgccccatgtccaa

SEQ ID NO: 2377081 - DNA, 15 bp, Homo sapiens
taatgtgtggattgc

SEQ ID NO: 2377082 - DNA, 13 bp, Homo sapiens
taatgttaaattt

SEQ ID NO: 2377083 - DNA, 22 bp, Homo sapiens
taatgttaaatttgtaagtttc

SEQ ID NO: 2377084 - DNA, 16 bp, Homo sapiens
taattaagaaaactat

SEQ ID NO: 2377085 - DNA, 22 bp, Homo sapiens
taattaagaaaactattaagat

SEQ ID NO: 2377086 - DNA, 14 bp, Homo sapiens
taattatatatact

SEQ ID NO: 2377087 - DNA, 22 bp, Homo sapiens
taattattgcactagagaaaat

SEQ ID NO: 2377088 - DNA, 15 bp, Homo sapiens
taattcaaatggctt

SEQ ID NO: 2377089 - DNA, 22 bp, Homo sapiens
taattcaaatggcttaagcaat

SEQ ID NO: 2377090 - DNA, 19 bp, Homo sapiens
taattcatatctaaatagt

SEQ ID NO: 2377091 - DNA, 20 bp, Homo sapiens
taattccacaggtcatcaga

SEQ ID NO: 2377092 - DNA, 15 bp, Homo sapiens
taattcctggcatga

SEQ ID NO: 2377093 - DNA, 12 bp, Homo sapiens
taattctaaagg

SEQ ID NO: 2377094 - DNA, 16 bp, Homo sapiens
taattgtaagtgaaat

SEQ ID NO: 2377095 - DNA, 14 bp, Homo sapiens
taattgttgtttct

SEQ ID NO: 2377096 - DNA, 16 bp, Homo sapiens
taatttaaatgaaaga

SEQ ID NO: 2377097 - DNA, 12 bp, Homo sapiens
taatttaacacc

SEQ ID NO: 2377098 - DNA, 16 bp, Homo sapiens
taatttacttgttttg

SEQ ID NO: 2377099 - DNA, 12 bp, Homo sapiens
taatttcaaaat

SEQ ID NO: 2377100 - DNA, 13 bp, Homo sapiens
taatttccttttt

SEQ ID NO: 2377101 - DNA, 20 bp, Homo sapiens
taatttctagaaacaaacat

SEQ ID NO: 2377102 - DNA, 13 bp, Homo sapiens
taatttctcctcc

SEQ ID NO: 2377103 - DNA, 19 bp, Homo sapiens
taatttctcctcccttcct

SEQ ID NO: 2377104 - DNA, 21 bp, Homo sapiens
taatttggagcacaaaattca

SEQ ID NO: 2377105 - DNA, 23 bp, Homo sapiens
taatttggagcacaaaattcaaa

SEQ ID NO: 2377106 - DNA, 14 bp, Homo sapiens
taattttaaagtgc

SEQ ID NO: 2377107 - DNA, 20 bp, Homo sapiens
taattttttttaaaatagaa

SEQ ID NO: 2377108 - DNA, 14 bp, Homo sapiens
tacaaacatgttgt

SEQ ID NO: 2377109 - DNA, 23 bp, Homo sapiens
tacaaactcatcctcttttaatg

SEQ ID NO: 2377110 - DNA, 12 bp, Homo sapiens
tacaaactctca

SEQ ID NO: 2377111 - DNA, 16 bp, Homo sapiens
tacaaacttttaagat

SEQ ID NO: 2377112 - DNA, 19 bp, Homo sapiens
tacaaacttttaagatttc

SEQ ID NO: 2377113 - DNA, 20 bp, Homo sapiens
tacaacacattgaaactgta

SEQ ID NO: 2377114 - DNA, 22 bp, Homo sapiens
tacaacacattgaaactgtatt

SEQ ID NO: 2377115 - DNA, 19 bp, Homo sapiens
tacaagggcataaagtaaa

SEQ ID NO: 2377116 - DNA, 17 bp, Homo sapiens
tacaagtaatattatta

SEQ ID NO: 2377117 - DNA, 18 bp, Homo sapiens
tacaagtcagctccagct

SEQ ID NO: 2377118 - DNA, 13 bp, Homo sapiens
tacaataaaacaa

SEQ ID NO: 2377119 - DNA, 20 bp, Homo sapiens
tacaataaaacaaataaata

SEQ ID NO: 2377120 - DNA, 23 bp, Homo sapiens
tacaatacaacacattgaaactg

SEQ ID NO: 2377121 - DNA, 14 bp, Homo sapiens
tacaatattgattg

SEQ ID NO: 2377122 - DNA, 17 bp, Homo sapiens
tacaattttttatcatg

SEQ ID NO: 2377123 - DNA, 16 bp, Homo sapiens
tacacacacacacaca

SEQ ID NO: 2377124 - DNA, 18 bp, Homo sapiens
tacacagaaatgctgctg

SEQ ID NO: 2377125 - DNA, 18 bp, Homo sapiens
tacacatagttctgtaat

SEQ ID NO: 2377126 - DNA, 17 bp, Homo sapiens
tacacatttgctactgt

SEQ ID NO: 2377127 - DNA, 21 bp, Homo sapiens
tacacatttgctactgttgta

SEQ ID NO: 2377128 - DNA, 21 bp, Homo sapiens
tacaccagcaatttagacaaa

SEQ ID NO: 2377129 - DNA, 20 bp, Homo sapiens
tacaccccctcttctgagca

SEQ ID NO: 2377130 - DNA, 23 bp, Homo sapiens
tacacctggctgaggttcctctg

SEQ ID NO: 2377131 - DNA, 14 bp, Homo sapiens
tacaccttgccttg

SEQ ID NO: 2377132 - DNA, 21 bp, Homo sapiens
tacacgaccatttgataggga

SEQ ID NO: 2377133 - DNA, 14 bp, Homo sapiens
tacactttgttgca

SEQ ID NO: 2377134 - DNA, 22 bp, Homo sapiens
tacactttgttgcaagatgtga

SEQ ID NO: 2377135 - DNA, 22 bp, Homo sapiens
tacagaggatgccttttctgtg

SEQ ID NO: 2377136 - DNA, 18 bp, Homo sapiens
tacagcctatagtaaatg

SEQ ID NO: 2377137 - DNA, 20 bp, Homo sapiens
tacagccttaatattttcct

SEQ ID NO: 2377138 - DNA, 20 bp, Homo sapiens
tacagcggctcccctctgct

SEQ ID NO: 2377139 - DNA, 16 bp, Homo sapiens
tacagctgcctaccta

SEQ ID NO: 2377140 - DNA, 20 bp, Homo sapiens
tacaggcaccgagaatgttg

SEQ ID NO: 2377141 - DNA, 17 bp, Homo sapiens
tacaggggttagcctgg

SEQ ID NO: 2377142 - DNA, 20 bp, Homo sapiens
tacagtcattccaagaacta

SEQ ID NO: 2377143 - DNA, 16 bp, Homo sapiens
tacagtggcagtattg

SEQ ID NO: 2377144 - DNA, 11 bp, Homo sapiens
tacagtggttt

SEQ ID NO: 2377145 - DNA, 14 bp, Homo sapiens
tacagttctttcct

SEQ ID NO: 2377146 - DNA, 15 bp, Homo sapiens
tacagttctttcctc

SEQ ID NO: 2377147 - DNA, 13 bp, Homo sapiens
tacataaaagaaa

SEQ ID NO: 2377148 - DNA, 17 bp, Homo sapiens
tacataaaagaaataaa

SEQ ID NO: 2377149 - DNA, 11 bp, Homo sapiens
tacataaacaa

SEQ ID NO: 2377150 - DNA, 17 bp, Homo sapiens
tacataactgaaaatgt

SEQ ID NO: 2377151 - DNA, 17 bp, Homo sapiens
tacatagctctgaagtt

SEQ ID NO: 2377152 - DNA, 18 bp, Homo sapiens
tacatatgctgatctttt

SEQ ID NO: 2377153 - DNA, 23 bp, Homo sapiens
tacatattaggaaaatatgggtt

SEQ ID NO: 2377154 - DNA, 18 bp, Homo sapiens
tacatcaatgataatgct

SEQ ID NO: 2377155 - DNA, 13 bp, Homo sapiens
tacatctgatatc

SEQ ID NO: 2377156 - DNA, 16 bp, Homo sapiens
tacatctgatatcagg

SEQ ID NO: 2377157 - DNA, 23 bp, Homo sapiens
tacatcttttctaatcacagtgt

SEQ ID NO: 2377158 - DNA, 15 bp, Homo sapiens
tacatgagaaagatg

SEQ ID NO: 2377159 - DNA, 16 bp, Homo sapiens
tacatgcataaactaa

SEQ ID NO: 2377160 - DNA, 14 bp, Homo sapiens
tacatgcatataat

SEQ ID NO: 2377161 - DNA, 22 bp, Homo sapiens
tacatgctgaaaaatatagcct

SEQ ID NO: 2377162 - DNA, 16 bp, Homo sapiens
tacatggttgtgacct

SEQ ID NO: 2377163 - DNA, 15 bp, Homo sapiens
tacatgtgatacatt

SEQ ID NO: 2377164 - DNA, 19 bp, Homo sapiens
tacatgtgatacatttttt

SEQ ID NO: 2377165 - DNA, 16 bp, Homo sapiens
tacatgtgtagcctgt

SEQ ID NO: 2377166 - DNA, 17 bp, Homo sapiens
tacattaacggtgctaa

SEQ ID NO: 2377167 - DNA, 20 bp, Homo sapiens
tacatttatgatttaataaa

SEQ ID NO: 2377168 - DNA, 17 bp, Homo sapiens
tacatttccaaatgaac

SEQ ID NO: 2377169 - DNA, 23 bp, Homo sapiens
tacattttattaagctttttgga

SEQ ID NO: 2377170 - DNA, 17 bp, Homo sapiens
taccacaaaccctgctg

SEQ ID NO: 2377171 - DNA, 21 bp, Homo sapiens
taccagctgcgcttgcttttc

SEQ ID NO: 2377172 - DNA, 15 bp, Homo sapiens
taccaggatgctaaa

SEQ ID NO: 2377173 - DNA, 15 bp, Homo sapiens
tacccacctagaaca

SEQ ID NO: 2377174 - DNA, 18 bp, Homo sapiens
tacccatagacatgaaag

SEQ ID NO: 2377175 - DNA, 13 bp, Homo sapiens
taccctgacctgg

SEQ ID NO: 2377176 - DNA, 20 bp, Homo sapiens
taccctgacctggccccctc

SEQ ID NO: 2377177 - DNA, 22 bp, Homo sapiens
taccctgacctggccccctcag

SEQ ID NO: 2377178 - DNA, 13 bp, Homo sapiens
taccctggcccct

SEQ ID NO: 2377179 - DNA, 21 bp, Homo sapiens
tacctacatgctgaaaaatat

SEQ ID NO: 2377180 - DNA, 14 bp, Homo sapiens
tacctactgtgtgc

SEQ ID NO: 2377181 - DNA, 13 bp, Homo sapiens
tacctactttgac

SEQ ID NO: 2377182 - DNA, 22 bp, Homo sapiens
tacctattcaagaagatagttg

SEQ ID NO: 2377183 - DNA, 16 bp, Homo sapiens
tacctcaaagggcagt

SEQ ID NO: 2377184 - DNA, 19 bp, Homo sapiens
tacctcaaagggcagtttt

SEQ ID NO: 2377185 - DNA, 20 bp, Homo sapiens
tacctcccacactcccaagg

SEQ ID NO: 2377186 - DNA, 12 bp, Homo sapiens
tacctctgtgtg

SEQ ID NO: 2377187 - DNA, 13 bp, Homo sapiens
tacctgacctaaa

SEQ ID NO: 2377188 - DNA, 21 bp, Homo sapiens
tacctgacctaaattagataa

SEQ ID NO: 2377189 - DNA, 15 bp, Homo sapiens
tacctggagaagaat

SEQ ID NO: 2377190 - DNA, 23 bp, Homo sapiens
tcaccagccccactgccagcagc

SEQ ID NO: 2377191 - DNA, 24 bp, Homo sapiens
tcaccagccccactgccagcagca

SEQ ID NO: 2377192 - DNA, 15 bp, Homo sapiens
tcaccagccctgcag

SEQ ID NO: 2377193 - DNA, 20 bp, Homo sapiens
tcaccagccctgcagcccac

SEQ ID NO: 2377194 - DNA, 14 bp, Homo sapiens
tcaccatccacctt

SEQ ID NO: 2377195 - DNA, 18 bp, Homo sapiens
tcaccatgtgagctcttc

SEQ ID NO: 2377196 - DNA, 19 bp, Homo sapiens
tcacccagacataaaggaa

SEQ ID NO: 2377197 - DNA, 20 bp, Homo sapiens
tcacccagacataaaggaaa

SEQ ID NO: 2377198 - DNA, 22 bp, Homo sapiens
tcacccagacataaaggaaaag

SEQ ID NO: 2377199 - DNA, 13 bp, Homo sapiens
tcaccctgcagag

SEQ ID NO: 2377200 - DNA, 22 bp, Homo sapiens
tcaccgactgaaaatattgttt

SEQ ID NO: 2377201 - DNA, 20 bp, Homo sapiens
tcaccgcccatcagggttct

SEQ ID NO: 2377202 - DNA, 13 bp, Homo sapiens
tcaccgctgggtg

SEQ ID NO: 2377203 - DNA, 17 bp, Homo sapiens
tcaccgctgggtggttt

SEQ ID NO: 2377204 - DNA, 22 bp, Homo sapiens
tcacctaatgtttatgagccag

SEQ ID NO: 2377205 - DNA, 13 bp, Homo sapiens
tcacctcatgccc

SEQ ID NO: 2377206 - DNA, 21 bp, Homo sapiens
tcacctgccccagcactcaca

SEQ ID NO: 2377207 - DNA, 19 bp, Homo sapiens
tcacctgtaaacctgagtc

SEQ ID NO: 2377208 - DNA, 13 bp, Homo sapiens
tcaccttcctgtg

SEQ ID NO: 2377209 - DNA, 14 bp, Homo sapiens
tcaccttcctgtgg

SEQ ID NO: 2377210 - DNA, 20 bp, Homo sapiens
tcaccttgccgagagaggcg

SEQ ID NO: 2377211 - DNA, 16 bp, Homo sapiens
tcaccttggaagggcg

SEQ ID NO: 2377212 - DNA, 17 bp, Homo sapiens
tcaccttttcaggaaaa

SEQ ID NO: 2377213 - DNA, 18 bp, Homo sapiens
tcaccttttctgtggctg

SEQ ID NO: 2377214 - DNA, 22 bp, Homo sapiens
tcaccttttctgtggctggctc

SEQ ID NO: 2377215 - DNA, 13 bp, Homo sapiens
tcacgtggcctcc

SEQ ID NO: 2377216 - DNA, 21 bp, Homo sapiens
tcacgtggcctccgcagtgtc

SEQ ID NO: 2377217 - DNA, 17 bp, Homo sapiens
tcacgtttggtgcttct

SEQ ID NO: 2377218 - DNA, 21 bp, Homo sapiens
tcacgtttggtgcttctcaga

SEQ ID NO: 2377219 - DNA, 19 bp, Homo sapiens
tcactacaagtcagctcca

SEQ ID NO: 2377220 - DNA, 14 bp, Homo sapiens
tcactccctctgca

SEQ ID NO: 2377221 - DNA, 15 bp, Homo sapiens
tcactccctctgcag

SEQ ID NO: 2377222 - DNA, 18 bp, Homo sapiens
tcactgaaccactgcttc

SEQ ID NO: 2377223 - DNA, 21 bp, Homo sapiens
tcactgaaccactgcttctct

SEQ ID NO: 2377224 - DNA, 14 bp, Homo sapiens
tcactgcagcctca

SEQ ID NO: 2377225 - DNA, 19 bp, Homo sapiens
tcactgccaggccagcctc

SEQ ID NO: 2377226 - DNA, 18 bp, Homo sapiens
tcactgcgaagaccctct

SEQ ID NO: 2377227 - DNA, 17 bp, Homo sapiens
tcactgctcccccgtgt

SEQ ID NO: 2377228 - DNA, 15 bp, Homo sapiens
tcactgctccttgct

SEQ ID NO: 2377229 - DNA, 16 bp, Homo sapiens
tcactgctccttgctg

SEQ ID NO: 2377230 - DNA, 14 bp, Homo sapiens
tcactgggaagaag

SEQ ID NO: 2377231 - DNA, 15 bp, Homo sapiens
tcactgtataaatag

SEQ ID NO: 2377232 - DNA, 23 bp, Homo sapiens
tcactgtataaataggagaggat

SEQ ID NO: 2377233 - DNA, 12 bp, Homo sapiens
tcactgtgatca

SEQ ID NO: 2377234 - DNA, 14 bp, Homo sapiens
tcactgtttcctgg

SEQ ID NO: 2377235 - DNA, 22 bp, Homo sapiens
tcacttaactataaggtgcctc

SEQ ID NO: 2377236 - DNA, 21 bp, Homo sapiens
tcacttaggaaatggctttgt

SEQ ID NO: 2377237 - DNA, 13 bp, Homo sapiens
tcacttctaaatg

SEQ ID NO: 2377238 - DNA, 14 bp, Homo sapiens
tcactttactttca

SEQ ID NO: 2377239 - DNA, 16 bp, Homo sapiens
tcactttactttcaag

SEQ ID NO: 2377240 - DNA, 13 bp, Homo sapiens
tcactttattgct

SEQ ID NO: 2377241 - DNA, 15 bp, Homo sapiens
tcacttttcccactc

SEQ ID NO: 2377242 - DNA, 19 bp, Homo sapiens
tcagaaagtaacaatctat

SEQ ID NO: 2377243 - DNA, 20 bp, Homo sapiens
tcagaaatataacacatttt

SEQ ID NO: 2377244 - DNA, 10 bp, Homo sapiens
tcagaacata

SEQ ID NO: 2377245 - DNA, 20 bp, Homo sapiens
tcagaacatactgattggga

SEQ ID NO: 2377246 - DNA, 20 bp, Homo sapiens
tcagaaccagagggcatgct

SEQ ID NO: 2377247 - DNA, 21 bp, Homo sapiens
tcagaaccagagggcatgctg

SEQ ID NO: 2377248 - DNA, 14 bp, Homo sapiens
tcagaacctgagct

SEQ ID NO: 2377249 - DNA, 19 bp, Homo sapiens
tcagaaccttgtcccagcc

SEQ ID NO: 2377250 - DNA, 16 bp, Homo sapiens
tcagaagcaagccaga

SEQ ID NO: 2377251 - DNA, 19 bp, Homo sapiens
tcagaagcaagccagacct

SEQ ID NO: 2377252 - DNA, 16 bp, Homo sapiens
tcagaagtatatctgt

SEQ ID NO: 2377253 - DNA, 17 bp, Homo sapiens
tcagaagtatatctgta

SEQ ID NO: 2377254 - DNA, 16 bp, Homo sapiens
tcagaagtccctgttt

SEQ ID NO: 2377255 - DNA, 15 bp, Homo sapiens
tcagaatcagaagat

SEQ ID NO: 2377256 - DNA, 21 bp, Homo sapiens
tcagactgtgcaatacttaga

SEQ ID NO: 2377257 - DNA, 12 bp, Homo sapiens
tcagagacactg

SEQ ID NO: 2377258 - DNA, 20 bp, Homo sapiens
tcagagcgccaggaagccag

SEQ ID NO: 2377259 - DNA, 22 bp, Homo sapiens
tcagagcggatgggcacacaca

SEQ ID NO: 2377260 - DNA, 20 bp, Homo sapiens
tcagagctatggtgcttgct

SEQ ID NO: 2377261 - DNA, 13 bp, Homo sapiens
tcagaggcagtga

SEQ ID NO: 2377262 - DNA, 20 bp, Homo sapiens
tcagagtccagtgctctgcc

SEQ ID NO: 2377263 - DNA, 21 bp, Homo sapiens
tcagagtccagtgctctgcct

SEQ ID NO: 2377264 - DNA, 13 bp, Homo sapiens
tcagatctgatca

SEQ ID NO: 2377265 - DNA, 13 bp, Homo sapiens
tcagatgcctgct

SEQ ID NO: 2377266 - DNA, 22 bp, Homo sapiens
tcagatgcttgcggcaaaagga

SEQ ID NO: 2377267 - DNA, 17 bp, Homo sapiens
tcagatgtgtgttctca

SEQ ID NO: 2377268 - DNA, 20 bp, Homo sapiens
tcagattgcttaaaagcatt

SEQ ID NO: 2377269 - DNA, 21 bp, Homo sapiens
tcagattgcttaaaagcattt

SEQ ID NO: 2377270 - DNA, 17 bp, Homo sapiens
tcagcaataatatgtga

SEQ ID NO: 2377271 - DNA, 18 bp, Homo sapiens
tcagcaatagggtgcagt

SEQ ID NO: 2377272 - DNA, 19 bp, Homo sapiens
tcagcacaggaattctcaa

SEQ ID NO: 2377273 - DNA, 21 bp, Homo sapiens
tcagcacaggaattctcaaga

SEQ ID NO: 2377274 - DNA, 19 bp, Homo sapiens
tcagcagaacctgcacaca

SEQ ID NO: 2377275 - DNA, 20 bp, Homo sapiens
tcagcagaacctgcacacag

SEQ ID NO: 2377276 - DNA, 16 bp, Homo sapiens
tcagcatgtctattca

SEQ ID NO: 2377277 - DNA, 22 bp, Homo sapiens
tcagccttccaactagctggga

SEQ ID NO: 2377278 - DNA, 16 bp, Homo sapiens
tcagctcaatgcagtt

SEQ ID NO: 2377279 - DNA, 14 bp, Homo sapiens
tcagctctctgccc

SEQ ID NO: 2377280 - DNA, 21 bp, Homo sapiens
tcagctctctgccctgtgtac

SEQ ID NO: 2377281 - DNA, 15 bp, Homo sapiens
tcagctctttccaaa

SEQ ID NO: 2377282 - DNA, 22 bp, Homo sapiens
tcagctttgagaagccttcagc

SEQ ID NO: 2377283 - DNA, 19 bp, Homo sapiens
tcaggacggctcctcagag

SEQ ID NO: 2377284 - DNA, 14 bp, Homo sapiens
tcaggagcttgggc

SEQ ID NO: 2377285 - DNA, 23 bp, Homo sapiens
tcaggagcttgggcagtgcccca

SEQ ID NO: 2377286 - DNA, 14 bp, Homo sapiens
tcaggaggcgccct

SEQ ID NO: 2377287 - DNA, 22 bp, Homo sapiens
tcaggatattggttcttcccct

SEQ ID NO: 2377288 - DNA, 15 bp, Homo sapiens
tcaggcagcaccaca

SEQ ID NO: 2377289 - DNA, 20 bp, Homo sapiens
tcaggcagcaccacactggg

SEQ ID NO: 2377290 - DNA, 22 bp, Homo sapiens
tcaggcagcaccacactgggtg

SEQ ID NO: 2377291 - DNA, 23 bp, Homo sapiens
tcaggcagcaccacactgggtgc

SEQ ID NO: 2377292 - DNA, 19 bp, Homo sapiens
tcaggccctgactcctctg

SEQ ID NO: 2377293 - DNA, 22 bp, Homo sapiens
tcaggccctgactcctctggct

SEQ ID NO: 2377294 - DNA, 14 bp, Homo sapiens
tcagggctcccagg

SEQ ID NO: 2377295 - DNA, 13 bp, Homo sapiens
tcagggctgtccc

SEQ ID NO: 2377296 - DNA, 17 bp, Homo sapiens
tcagggctgtcccagcc

SEQ ID NO: 2377297 - DNA, 20 bp, Homo sapiens
tcagggctgtcccagccccg

SEQ ID NO: 2377298 - DNA, 19 bp, Homo sapiens
tcagggtgaactgcaaagc

SEQ ID NO: 2377299 - DNA, 22 bp, Homo sapiens
tcaggtgccttacatcttttct

SEQ ID NO: 2377300 - DNA, 16 bp, Homo sapiens
tcaggtgtataaatgt

SEQ ID NO: 2377301 - DNA, 14 bp, Homo sapiens
tcagtaaatagtgt

SEQ ID NO: 2377302 - DNA, 15 bp, Homo sapiens
tcagtaactgtcagg

SEQ ID NO: 2377303 - DNA, 19 bp, Homo sapiens
tcagtatgtgggggcttca

SEQ ID NO: 2377304 - DNA, 12 bp, Homo sapiens
tctacagtggtt

SEQ ID NO: 2377305 - DNA, 12 bp, Homo sapiens
tctacctgccct

SEQ ID NO: 2377306 - DNA, 12 bp, Homo sapiens
tctaccttcctg

SEQ ID NO: 2377307 - DNA, 21 bp, Homo sapiens
tctactcacttttcccactcc

SEQ ID NO: 2377308 - DNA, 19 bp, Homo sapiens
tctactttaaattgtggat

SEQ ID NO: 2377309 - DNA, 20 bp, Homo sapiens
tctactttaaattgtggatg

SEQ ID NO: 2377310 - DNA, 14 bp, Homo sapiens
tctagaaacaaaca

SEQ ID NO: 2377311 - DNA, 21 bp, Homo sapiens
tctagaagccaagggaaaggg

SEQ ID NO: 2377312 - DNA, 21 bp, Homo sapiens
tctagagcttaatgctacatg

SEQ ID NO: 2377313 - DNA, 22 bp, Homo sapiens
tctagcacaatttgcactaaat

SEQ ID NO: 2377314 - DNA, 14 bp, Homo sapiens
tctagctaaataaa

SEQ ID NO: 2377315 - DNA, 14 bp, Homo sapiens
tctaggactgcagt

SEQ ID NO: 2377316 - DNA, 16 bp, Homo sapiens
tctaggactgcagtgt

SEQ ID NO: 2377317 - DNA, 15 bp, Homo sapiens
tctaggagatgcttt

SEQ ID NO: 2377318 - DNA, 14 bp, Homo sapiens
tctaggtaggaaga

SEQ ID NO: 2377319 - DNA, 17 bp, Homo sapiens
tctaggtccccatactc

SEQ ID NO: 2377320 - DNA, 15 bp, Homo sapiens
tctagtagttagaaa

SEQ ID NO: 2377321 - DNA, 12 bp, Homo sapiens
tctagtgatgat

SEQ ID NO: 2377322 - DNA, 15 bp, Homo sapiens
tctagtggtctttgt

SEQ ID NO: 2377323 - DNA, 18 bp, Homo sapiens
tctagtggtctttgtaag

SEQ ID NO: 2377324 - DNA, 22 bp, Homo sapiens
tctagtggtctttgtaagagtg

SEQ ID NO: 2377325 - DNA, 23 bp, Homo sapiens
tctagtggtctttgtaagagtgt

SEQ ID NO: 2377326 - DNA, 18 bp, Homo sapiens
tctataaaaatactacaa

SEQ ID NO: 2377327 - DNA, 21 bp, Homo sapiens
tctataagcaaattgcttttt

SEQ ID NO: 2377328 - DNA, 19 bp, Homo sapiens
tctataagtagtaaatcag

SEQ ID NO: 2377329 - DNA, 21 bp, Homo sapiens
tctataagtagtaaatcagaa

SEQ ID NO: 2377330 - DNA, 13 bp, Homo sapiens
tctataggcagct

SEQ ID NO: 2377331 - DNA, 19 bp, Homo sapiens
tctataggcagcttctaag

SEQ ID NO: 2377332 - DNA, 20 bp, Homo sapiens
tctataggcagcttctaaga

SEQ ID NO: 2377333 - DNA, 19 bp, Homo sapiens
tctatatggttctccaaga

SEQ ID NO: 2377334 - DNA, 17 bp, Homo sapiens
tctatccatctcctggt

SEQ ID NO: 2377335 - DNA, 19 bp, Homo sapiens
tctattaagattggaaatg

SEQ ID NO: 2377336 - DNA, 15 bp, Homo sapiens
tctattatggaaaac

SEQ ID NO: 2377337 - DNA, 20 bp, Homo sapiens
tctattatggaaaactgtgt

SEQ ID NO: 2377338 - DNA, 16 bp, Homo sapiens
tctattatttttataa

SEQ ID NO: 2377339 - DNA, 17 bp, Homo sapiens
tctatttgaataaatta

SEQ ID NO: 2377340 - DNA, 15 bp, Homo sapiens
tctcaaacttgtggc

SEQ ID NO: 2377341 - DNA, 18 bp, Homo sapiens
tctcaaacttgtggcctc

SEQ ID NO: 2377342 - DNA, 19 bp, Homo sapiens
tctcaaacttgtggcctca

SEQ ID NO: 2377343 - DNA, 17 bp, Homo sapiens
tctcaaagagattcgaa

SEQ ID NO: 2377344 - DNA, 14 bp, Homo sapiens
tctcaaaggagctt

SEQ ID NO: 2377345 - DNA, 21 bp, Homo sapiens
tctcaaaggagctttctcaat

SEQ ID NO: 2377346 - DNA, 18 bp, Homo sapiens
tctcaaagttttgaaaag

SEQ ID NO: 2377347 - DNA, 23 bp, Homo sapiens
tctcaaagttttgaaaagctatt

SEQ ID NO: 2377348 - DNA, 16 bp, Homo sapiens
tctcaagacctgagta

SEQ ID NO: 2377349 - DNA, 18 bp, Homo sapiens
tctcaagacctgagtatt

SEQ ID NO: 2377350 - DNA, 21 bp, Homo sapiens
tctcaagatgggggcagggct

SEQ ID NO: 2377351 - DNA, 22 bp, Homo sapiens
tctcaagctatgatcagaagac

SEQ ID NO: 2377352 - DNA, 19 bp, Homo sapiens
tctcacaggctgagaactc

SEQ ID NO: 2377353 - DNA, 14 bp, Homo sapiens
tctcacctctaggt

SEQ ID NO: 2377354 - DNA, 23 bp, Homo sapiens
tctcactctgcccccccccccca

SEQ ID NO: 2377355 - DNA, 18 bp, Homo sapiens
tctcactgcttgaactag

SEQ ID NO: 2377356 - DNA, 14 bp, Homo sapiens
tctcagaaatgtca

SEQ ID NO: 2377357 - DNA, 11 bp, Homo sapiens
tctcagaacat

SEQ ID NO: 2377358 - DNA, 20 bp, Homo sapiens
tctcagaaccttgtcccagc

SEQ ID NO: 2377359 - DNA, 17 bp, Homo sapiens
tctcagatttctgagga

SEQ ID NO: 2377360 - DNA, 16 bp, Homo sapiens
tctcaggacagcatcc

SEQ ID NO: 2377361 - DNA, 16 bp, Homo sapiens
tctcaggagcttgggc

SEQ ID NO: 2377362 - DNA, 19 bp, Homo sapiens
tctcaggcagcaccacact

SEQ ID NO: 2377363 - DNA, 22 bp, Homo sapiens
tctcaggcagcaccacactggg

SEQ ID NO: 2377364 - DNA, 16 bp, Homo sapiens
tctcagtgccctccag

SEQ ID NO: 2377365 - DNA, 23 bp, Homo sapiens
tctcagttctcttgctttcacat

SEQ ID NO: 2377366 - DNA, 17 bp, Homo sapiens
tctcatcaactgaatga

SEQ ID NO: 2377367 - DNA, 16 bp, Homo sapiens
tctcatgaagcaggag

SEQ ID NO: 2377368 - DNA, 16 bp, Homo sapiens
tctcatgagaagccaa

SEQ ID NO: 2377369 - DNA, 22 bp, Homo sapiens
tctcatgaggggagaggagacg

SEQ ID NO: 2377370 - DNA, 17 bp, Homo sapiens
tctcattcccatgtgga

SEQ ID NO: 2377371 - DNA, 18 bp, Homo sapiens
tctcattcccatgtggaa

SEQ ID NO: 2377372 - DNA, 22 bp, Homo sapiens
tctcattgacttttataaagca

SEQ ID NO: 2377373 - DNA, 16 bp, Homo sapiens
tctcatttgggctaga

SEQ ID NO: 2377374 - DNA, 12 bp, Homo sapiens
tctccacagtgt

SEQ ID NO: 2377375 - DNA, 14 bp, Homo sapiens
tctccactgctgga

SEQ ID NO: 2377376 - DNA, 17 bp, Homo sapiens
tctccactgctggacat

SEQ ID NO: 2377377 - DNA, 18 bp, Homo sapiens
tctccactgtgctttcag

SEQ ID NO: 2377378 - DNA, 19 bp, Homo sapiens
tctccagtcatctgtaaga

SEQ ID NO: 2377379 - DNA, 21 bp, Homo sapiens
tctccataaacatgaaaacac

SEQ ID NO: 2377380 - DNA, 20 bp, Homo sapiens
tctccatcaccctcttcctg

SEQ ID NO: 2377381 - DNA, 18 bp, Homo sapiens
tctccatggccctgtccc

SEQ ID NO: 2377382 - DNA, 20 bp, Homo sapiens
tctccatggccctgtcccag

SEQ ID NO: 2377383 - DNA, 15 bp, Homo sapiens
tctccattctgctcc

SEQ ID NO: 2377384 - DNA, 16 bp, Homo sapiens
tctccattctgctcct

SEQ ID NO: 2377385 - DNA, 17 bp, Homo sapiens
tctccattcttttaaat

SEQ ID NO: 2377386 - DNA, 15 bp, Homo sapiens
tctcccaaggctgcc

SEQ ID NO: 2377387 - DNA, 18 bp, Homo sapiens
tctcccaaggctgccaga

SEQ ID NO: 2377388 - DNA, 15 bp, Homo sapiens
tctcccaggctgtcc

SEQ ID NO: 2377389 - DNA, 17 bp, Homo sapiens
tctcccaggtaccagct

SEQ ID NO: 2377390 - DNA, 18 bp, Homo sapiens
tctcccaggtaccagctg

SEQ ID NO: 2377391 - DNA, 22 bp, Homo sapiens
tctcccagtgaactcctgccag

SEQ ID NO: 2377392 - DNA, 15 bp, Homo sapiens
tctccccctcctcca

SEQ ID NO: 2377393 - DNA, 20 bp, Homo sapiens
tctccccctcctccagggaa

SEQ ID NO: 2377394 - DNA, 18 bp, Homo sapiens
tctccctcccctctcaga

SEQ ID NO: 2377395 - DNA, 17 bp, Homo sapiens
tctccctccctctctca

SEQ ID NO: 2377396 - DNA, 12 bp, Homo sapiens
tctccctgcctg

SEQ ID NO: 2377397 - DNA, 15 bp, Homo sapiens
tctccctgcctggcc

SEQ ID NO: 2377398 - DNA, 17 bp, Homo sapiens
tctccctggagaagcac

SEQ ID NO: 2377399 - DNA, 15 bp, Homo sapiens
tctccctggctccct

SEQ ID NO: 2377400 - DNA, 17 bp, Homo sapiens
tctcccttgggctctga

SEQ ID NO: 2377401 - DNA, 22 bp, Homo sapiens
tctcccttgggctctgatgaaa

SEQ ID NO: 2377402 - DNA, 21 bp, Homo sapiens
tctcctacttagggaagaaaa

SEQ ID NO: 2377403 - DNA, 21 bp, Homo sapiens
tctcctaggcattctggacct

SEQ ID NO: 2377404 - DNA, 13 bp, Homo sapiens
tctcctccctgtt

SEQ ID NO: 2377405 - DNA, 23 bp, Homo sapiens
tctcctccctgttatctgctaga

SEQ ID NO: 2377406 - DNA, 13 bp, Homo sapiens
tctcctcccttcc

SEQ ID NO: 2377407 - DNA, 19 bp, Homo sapiens
tctcctctctctttcctcc

SEQ ID NO: 2377408 - DNA, 20 bp, Homo sapiens
tctcctctctctttcctcca

SEQ ID NO: 2377409 - DNA, 22 bp, Homo sapiens
tctcctctgcttctttgcctcc

SEQ ID NO: 2377410 - DNA, 15 bp, Homo sapiens
tctcctgacagaagg

SEQ ID NO: 2377411 - DNA, 12 bp, Homo sapiens
tctcctgtggag

SEQ ID NO: 2377412 - DNA, 14 bp, Homo sapiens
tctccttgctctgt

SEQ ID NO: 2377413 - DNA, 14 bp, Homo sapiens
tctcgcacacctct

SEQ ID NO: 2377414 - DNA, 15 bp, Homo sapiens
tctcgctccctccca

SEQ ID NO: 2377415 - DNA, 20 bp, Homo sapiens
tctcgtggtagaagccagta

SEQ ID NO: 2377416 - DNA, 17 bp, Homo sapiens
tctctaaggtttacaat

SEQ ID NO: 2377417 - DNA, 13 bp, Homo sapiens
tctctaccagata

SEQ ID NO: 2377418 - DNA, 15 bp, Homo sapiens
tctctactaaaaata

SEQ ID NO: 2377419 - DNA, 16 bp, Homo sapiens
tgaatccaaactaatc

SEQ ID NO: 2377420 - DNA, 22 bp, Homo sapiens
tgaatctataagtagtaaatca

SEQ ID NO: 2377421 - DNA, 21 bp, Homo sapiens
tgaatctctgcctctcccagg

SEQ ID NO: 2377422 - DNA, 13 bp, Homo sapiens
tgaatctgcaggg

SEQ ID NO: 2377423 - DNA, 16 bp, Homo sapiens
tgaatgaagcagtatt

SEQ ID NO: 2377424 - DNA, 22 bp, Homo sapiens
tgaatgaggtcagcatgtctat

SEQ ID NO: 2377425 - DNA, 15 bp, Homo sapiens
tgaatgattaaatta

SEQ ID NO: 2377426 - DNA, 22 bp, Homo sapiens
tgaatgctatttgtgtaactga

SEQ ID NO: 2377427 - DNA, 14 bp, Homo sapiens
tgaatgcttttagt

SEQ ID NO: 2377428 - DNA, 22 bp, Homo sapiens
tgaatggattggattatttaat

SEQ ID NO: 2377429 - DNA, 23 bp, Homo sapiens
tgaatggattggattatttaata

SEQ ID NO: 2377430 - DNA, 14 bp, Homo sapiens
tgaatgtatttgat

SEQ ID NO: 2377431 - DNA, 20 bp, Homo sapiens
tgaatgtatttgatttataa

SEQ ID NO: 2377432 - DNA, 19 bp, Homo sapiens
tgaattaattaatttggag

SEQ ID NO: 2377433 - DNA, 17 bp, Homo sapiens
tgaattacctggatgtt

SEQ ID NO: 2377434 - DNA, 15 bp, Homo sapiens
tgaattagtgagtat

SEQ ID NO: 2377435 - DNA, 17 bp, Homo sapiens
tgaattatcagcaaaga

SEQ ID NO: 2377436 - DNA, 19 bp, Homo sapiens
tgaattatcagcaaagaaa

SEQ ID NO: 2377437 - DNA, 20 bp, Homo sapiens
tgaattatcagcaaagaaaa

SEQ ID NO: 2377438 - DNA, 13 bp, Homo sapiens
tgaattattgaca

SEQ ID NO: 2377439 - DNA, 15 bp, Homo sapiens
tgaattattgacact

SEQ ID NO: 2377440 - DNA, 18 bp, Homo sapiens
tgaattattgacactgaa

SEQ ID NO: 2377441 - DNA, 23 bp, Homo sapiens
tgaattcggaactgtcctttcct

SEQ ID NO: 2377442 - DNA, 12 bp, Homo sapiens
tgaattgtacag

SEQ ID NO: 2377443 - DNA, 11 bp, Homo sapiens
tgaattttcta

SEQ ID NO: 2377444 - DNA, 22 bp, Homo sapiens
tgaatttttaaaacccatttaa

SEQ ID NO: 2377445 - DNA, 16 bp, Homo sapiens
tgaatttttttgtaat

SEQ ID NO: 2377446 - DNA, 19 bp, Homo sapiens
tgacaaataagattaataa

SEQ ID NO: 2377447 - DNA, 17 bp, Homo sapiens
tgacaaccattaaagtc

SEQ ID NO: 2377448 - DNA, 16 bp, Homo sapiens
tgacaatattccagat

SEQ ID NO: 2377449 - DNA, 15 bp, Homo sapiens
tgacaattcagaggc

SEQ ID NO: 2377450 - DNA, 14 bp, Homo sapiens
tgacaattgggagc

SEQ ID NO: 2377451 - DNA, 19 bp, Homo sapiens
tgacacaaagcttctaaag

SEQ ID NO: 2377452 - DNA, 22 bp, Homo sapiens
tgacacatggcccctccccctg

SEQ ID NO: 2377453 - DNA, 14 bp, Homo sapiens
tgacacccttctcc

SEQ ID NO: 2377454 - DNA, 19 bp, Homo sapiens
tgacacccttctcccactc

SEQ ID NO: 2377455 - DNA, 20 bp, Homo sapiens
tgacacccttctcccactct

SEQ ID NO: 2377456 - DNA, 21 bp, Homo sapiens
tgacactagcccaatgaaatg

SEQ ID NO: 2377457 - DNA, 22 bp, Homo sapiens
tgacactctagtgacttcctgg

SEQ ID NO: 2377458 - DNA, 12 bp, Homo sapiens
tgacactgaaag

SEQ ID NO: 2377459 - DNA, 22 bp, Homo sapiens
tgacactttaattaccaacctg

SEQ ID NO: 2377460 - DNA, 15 bp, Homo sapiens
tgacagaaggtgcca

SEQ ID NO: 2377461 - DNA, 14 bp, Homo sapiens
tgacagagccatgg

SEQ ID NO: 2377462 - DNA, 20 bp, Homo sapiens
tgacagaggctgcacccctg

SEQ ID NO: 2377463 - DNA, 15 bp, Homo sapiens
tgacagcctgcagca

SEQ ID NO: 2377464 - DNA, 14 bp, Homo sapiens
tgacagctttctgg

SEQ ID NO: 2377465 - DNA, 16 bp, Homo sapiens
tgacagctttctggga

SEQ ID NO: 2377466 - DNA, 16 bp, Homo sapiens
tgacaggtcttttcaa

SEQ ID NO: 2377467 - DNA, 14 bp, Homo sapiens
tgacagtgcctctt

SEQ ID NO: 2377468 - DNA, 18 bp, Homo sapiens
tgacagtgcctcttccag

SEQ ID NO: 2377469 - DNA, 16 bp, Homo sapiens
tgacagtttccaaatt

SEQ ID NO: 2377470 - DNA, 16 bp, Homo sapiens
tgacataataaagtat

SEQ ID NO: 2377471 - DNA, 16 bp, Homo sapiens
tgacatggaaatgaag

SEQ ID NO: 2377472 - DNA, 16 bp, Homo sapiens
tgacatggtgcctgag

SEQ ID NO: 2377473 - DNA, 17 bp, Homo sapiens
tgacatggtgcctgaga

SEQ ID NO: 2377474 - DNA, 19 bp, Homo sapiens
tgacatgtgaaaccttttt

SEQ ID NO: 2377475 - DNA, 14 bp, Homo sapiens
tgacattcttagct

SEQ ID NO: 2377476 - DNA, 22 bp, Homo sapiens
tgacatttcttctagtgatgat

SEQ ID NO: 2377477 - DNA, 22 bp, Homo sapiens
tgaccaagactgagccagctta

SEQ ID NO: 2377478 - DNA, 11 bp, Homo sapiens
tgaccagaagc

SEQ ID NO: 2377479 - DNA, 18 bp, Homo sapiens
tgaccagatctttctctt

SEQ ID NO: 2377480 - DNA, 18 bp, Homo sapiens
tgacccagggactctcca

SEQ ID NO: 2377481 - DNA, 16 bp, Homo sapiens
tgacccctctcctcaa

SEQ ID NO: 2377482 - DNA, 13 bp, Homo sapiens
tgacccctgctca

SEQ ID NO: 2377483 - DNA, 11 bp, Homo sapiens
tgaccctccaa

SEQ ID NO: 2377484 - DNA, 13 bp, Homo sapiens
tgaccctccaaat

SEQ ID NO: 2377485 - DNA, 17 bp, Homo sapiens
tgacctagttttccatg

SEQ ID NO: 2377486 - DNA, 20 bp, Homo sapiens
tgacctgaccccattcctga

SEQ ID NO: 2377487 - DNA, 21 bp, Homo sapiens
tgacgatgatgtacagattct

SEQ ID NO: 2377488 - DNA, 18 bp, Homo sapiens
tgacggaagaacatagaa

SEQ ID NO: 2377489 - DNA, 14 bp, Homo sapiens
tgacgtttcttctt

SEQ ID NO: 2377490 - DNA, 18 bp, Homo sapiens
tgactaaattcgtgattt

SEQ ID NO: 2377491 - DNA, 19 bp, Homo sapiens
tgactaaattcgtgatttt

SEQ ID NO: 2377492 - DNA, 21 bp, Homo sapiens
tgactaactcaaatacacatt

SEQ ID NO: 2377493 - DNA, 14 bp, Homo sapiens
tgactaatgctttt

SEQ ID NO: 2377494 - DNA, 23 bp, Homo sapiens
tgactaatgctttttagaaagca

SEQ ID NO: 2377495 - DNA, 20 bp, Homo sapiens
tgactatgcgtggctggaac

SEQ ID NO: 2377496 - DNA, 13 bp, Homo sapiens
tgactattctgta

SEQ ID NO: 2377497 - DNA, 16 bp, Homo sapiens
tgactctataagcaaa

SEQ ID NO: 2377498 - DNA, 21 bp, Homo sapiens
tgactctataagcaaattgct

SEQ ID NO: 2377499 - DNA, 14 bp, Homo sapiens
tgactgccttgcct

SEQ ID NO: 2377500 - DNA, 17 bp, Homo sapiens
tgactggcttcagcaag

SEQ ID NO: 2377501 - DNA, 16 bp, Homo sapiens
tgactgtagccacagc

SEQ ID NO: 2377502 - DNA, 16 bp, Homo sapiens
tgacttatttgctcat

SEQ ID NO: 2377503 - DNA, 17 bp, Homo sapiens
tgacttcctggtgaggc

SEQ ID NO: 2377504 - DNA, 19 bp, Homo sapiens
tgacttccttatttctgaa

SEQ ID NO: 2377505 - DNA, 15 bp, Homo sapiens
tgacttgctgtccag

SEQ ID NO: 2377506 - DNA, 16 bp, Homo sapiens
tgacttgctgtccagg

SEQ ID NO: 2377507 - DNA, 19 bp, Homo sapiens
tgacttgctgtccaggcag

SEQ ID NO: 2377508 - DNA, 15 bp, Homo sapiens
tgacttgctgtgtga

SEQ ID NO: 2377509 - DNA, 18 bp, Homo sapiens
tgacttttataaagcatg

SEQ ID NO: 2377510 - DNA, 15 bp, Homo sapiens
tgactttttttgtat

SEQ ID NO: 2377511 - DNA, 15 bp, Homo sapiens
tgagaaaaataaatg

SEQ ID NO: 2377512 - DNA, 19 bp, Homo sapiens
tgagaaatcacaatgagaa

SEQ ID NO: 2377513 - DNA, 14 bp, Homo sapiens
tgagaagccttcag

SEQ ID NO: 2377514 - DNA, 12 bp, Homo sapiens
tgagaagctctg

SEQ ID NO: 2377515 - DNA, 19 bp, Homo sapiens
tgagaaggttactgagtga

SEQ ID NO: 2377516 - DNA, 12 bp, Homo sapiens
tgagacaatgtt

SEQ ID NO: 2377517 - DNA, 16 bp, Homo sapiens
tgagacagtgaatttg

SEQ ID NO: 2377518 - DNA, 17 bp, Homo sapiens
tgagacagtgaatttgg

SEQ ID NO: 2377519 - DNA, 19 bp, Homo sapiens
tgagacagtttcttagctt

SEQ ID NO: 2377520 - DNA, 21 bp, Homo sapiens
tgagacagtttcttagctttt

SEQ ID NO: 2377521 - DNA, 21 bp, Homo sapiens
tgagaccacagagagagggga

SEQ ID NO: 2377522 - DNA, 15 bp, Homo sapiens
tgagaccctactgaa

SEQ ID NO: 2377523 - DNA, 18 bp, Homo sapiens
tgagacctgggatttgag

SEQ ID NO: 2377524 - DNA, 19 bp, Homo sapiens
tgagactcaaaaaaacaaa

SEQ ID NO: 2377525 - DNA, 16 bp, Homo sapiens
tgagagcccagaggta

SEQ ID NO: 2377526 - DNA, 12 bp, Homo sapiens
tgagaggcaggc

SEQ ID NO: 2377527 - DNA, 13 bp, Homo sapiens
tgagaggcaggca

SEQ ID NO: 2377528 - DNA, 23 bp, Homo sapiens
tgagagtatttaggcagattgaa

SEQ ID NO: 2377529 - DNA, 17 bp, Homo sapiens
tgagagttccttctcac

SEQ ID NO: 2377530 - DNA, 22 bp, Homo sapiens
tgagagttccttctcacttaga

SEQ ID NO: 2377531 - DNA, 18 bp, Homo sapiens
tgagataccacaaaccct

SEQ ID NO: 2377532 - DNA, 17 bp, Homo sapiens
tgagatggagaggctga

SEQ ID NO: 2377533 - DNA, 16 bp, Homo sapiens
tgagatgtagaaagtt

SEQ ID NO: 2377534 - DNA, 14 bp, Homo sapiens
tgcctgcgcctgct

SEQ ID NO: 2377535 - DNA, 20 bp, Homo sapiens
tgcctgctctgtgagcccca

SEQ ID NO: 2377536 - DNA, 14 bp, Homo sapiens
tgcctgcttgataa

SEQ ID NO: 2377537 - DNA, 13 bp, Homo sapiens
tgcctgctttgaa

SEQ ID NO: 2377538 - DNA, 16 bp, Homo sapiens
tgcctgctttttggaa

SEQ ID NO: 2377539 - DNA, 17 bp, Homo sapiens
tgcctgctttttggaaa

SEQ ID NO: 2377540 - DNA, 19 bp, Homo sapiens
tgcctggagacaaggtgct

SEQ ID NO: 2377541 - DNA, 13 bp, Homo sapiens
tgcctggccagat

SEQ ID NO: 2377542 - DNA, 14 bp, Homo sapiens
tgcctggccagatt

SEQ ID NO: 2377543 - DNA, 14 bp, Homo sapiens
tgcctggccccagc

SEQ ID NO: 2377544 - DNA, 17 bp, Homo sapiens
tgcctggcctggcacac

SEQ ID NO: 2377545 - DNA, 20 bp, Homo sapiens
tgcctggcctggcacacatc

SEQ ID NO: 2377546 - DNA, 22 bp, Homo sapiens
tgcctggcctggcacacatcag

SEQ ID NO: 2377547 - DNA, 20 bp, Homo sapiens
tgcctggtatatccaaaagc

SEQ ID NO: 2377548 - DNA, 23 bp, Homo sapiens
tgcctggtatatccaaaagcttt

SEQ ID NO: 2377549 - DNA, 15 bp, Homo sapiens
tgcctgtctgcccca

SEQ ID NO: 2377550 - DNA, 22 bp, Homo sapiens
tgcctgttatggatatagtatc

SEQ ID NO: 2377551 - DNA, 20 bp, Homo sapiens
tgccttaaaaccaaagaggg

SEQ ID NO: 2377552 - DNA, 17 bp, Homo sapiens
tgccttaaacctacctc

SEQ ID NO: 2377553 - DNA, 18 bp, Homo sapiens
tgccttaaacctacctcc

SEQ ID NO: 2377554 - DNA, 20 bp, Homo sapiens
tgccttacatcttttctaat

SEQ ID NO: 2377555 - DNA, 19 bp, Homo sapiens
tgccttactcttcttgaaa

SEQ ID NO: 2377556 - DNA, 17 bp, Homo sapiens
tgccttgcctcctcagt

SEQ ID NO: 2377557 - DNA, 23 bp, Homo sapiens
tgccttggaaatagaaagaagcc

SEQ ID NO: 2377558 - DNA, 18 bp, Homo sapiens
tgccttggcctcccaaag

SEQ ID NO: 2377559 - DNA, 22 bp, Homo sapiens
tgcctttatgatgctaagctga

SEQ ID NO: 2377560 - DNA, 13 bp, Homo sapiens
tgcctttgagaca

SEQ ID NO: 2377561 - DNA, 19 bp, Homo sapiens
tgcctttgagacagtttct

SEQ ID NO: 2377562 - DNA, 21 bp, Homo sapiens
tgcctttgagacagtttctta

SEQ ID NO: 2377563 - DNA, 23 bp, Homo sapiens
tgcctttgagacagtttcttagc

SEQ ID NO: 2377564 - DNA, 21 bp, Homo sapiens
tgccttttctgtgattgggtg

SEQ ID NO: 2377565 - DNA, 20 bp, Homo sapiens
tgcgaagaccctcttgccca

SEQ ID NO: 2377566 - DNA, 13 bp, Homo sapiens
tgcgcctcagccc

SEQ ID NO: 2377567 - DNA, 12 bp, Homo sapiens
tgcgcctgcagg

SEQ ID NO: 2377568 - DNA, 20 bp, Homo sapiens
tgcgcctgcaggcagagctg

SEQ ID NO: 2377569 - DNA, 21 bp, Homo sapiens
tgcgcgccaccgtgcctggct

SEQ ID NO: 2377570 - DNA, 14 bp, Homo sapiens
tgcgggacagagta

SEQ ID NO: 2377571 - DNA, 12 bp, Homo sapiens
tgcgggccaggg

SEQ ID NO: 2377572 - DNA, 18 bp, Homo sapiens
tgcgggctgaggccagag

SEQ ID NO: 2377573 - DNA, 17 bp, Homo sapiens
tgcgtaaggatgtgtga

SEQ ID NO: 2377574 - DNA, 16 bp, Homo sapiens
tgcgtcctcctcacct

SEQ ID NO: 2377575 - DNA, 19 bp, Homo sapiens
tgcgtcctcctcacctcat

SEQ ID NO: 2377576 - DNA, 13 bp, Homo sapiens
tgcgtctccagtc

SEQ ID NO: 2377577 - DNA, 15 bp, Homo sapiens
tgcgtctccagtcat

SEQ ID NO: 2377578 - DNA, 17 bp, Homo sapiens
tgcgtctccagtcatct

SEQ ID NO: 2377579 - DNA, 15 bp, Homo sapiens
tgcgtcttggtgtaa

SEQ ID NO: 2377580 - DNA, 22 bp, Homo sapiens
tgcgtcttggtgtaatttgaag

SEQ ID NO: 2377581 - DNA, 20 bp, Homo sapiens
tgcgtggaatgcccttcact

SEQ ID NO: 2377582 - DNA, 20 bp, Homo sapiens
tgcgtgttcagcagaacctg

SEQ ID NO: 2377583 - DNA, 23 bp, Homo sapiens
tgctaaaaatgagcttgattaaa

SEQ ID NO: 2377584 - DNA, 22 bp, Homo sapiens
tgctaacaaagacaaaagtctg

SEQ ID NO: 2377585 - DNA, 23 bp, Homo sapiens
tgctaagctgatattatttcttc

SEQ ID NO: 2377586 - DNA, 16 bp, Homo sapiens
tgctaattttattata

SEQ ID NO: 2377587 - DNA, 21 bp, Homo sapiens
tgctaattttattatagtaat

SEQ ID NO: 2377588 - DNA, 18 bp, Homo sapiens
tgctacctcccttgcctt

SEQ ID NO: 2377589 - DNA, 15 bp, Homo sapiens
tgctactgcactcca

SEQ ID NO: 2377590 - DNA, 18 bp, Homo sapiens
tgctactgcactccagcc

SEQ ID NO: 2377591 - DNA, 21 bp, Homo sapiens
tgctactgcactccagcctgg

SEQ ID NO: 2377592 - DNA, 13 bp, Homo sapiens
tgctactggggaa

SEQ ID NO: 2377593 - DNA, 23 bp, Homo sapiens
tgctactgttgtaagaattctga

SEQ ID NO: 2377594 - DNA, 21 bp, Homo sapiens
tgctataatctgtttttacgt

SEQ ID NO: 2377595 - DNA, 13 bp, Homo sapiens
tgctatactgcat

SEQ ID NO: 2377596 - DNA, 21 bp, Homo sapiens
tgctatatataaaacggtgct

SEQ ID NO: 2377597 - DNA, 22 bp, Homo sapiens
tgctatgcaaaaaattctttag

SEQ ID NO: 2377598 - DNA, 14 bp, Homo sapiens
tgctatttaacatt

SEQ ID NO: 2377599 - DNA, 22 bp, Homo sapiens
tgctatttaacattttacagta

SEQ ID NO: 2377600 - DNA, 16 bp, Homo sapiens
tgctatttattttcct

SEQ ID NO: 2377601 - DNA, 18 bp, Homo sapiens
tgctatttgtgtaactga

SEQ ID NO: 2377602 - DNA, 16 bp, Homo sapiens
tgctatttttgtaaag

SEQ ID NO: 2377603 - DNA, 16 bp, Homo sapiens
tgctcaaggccagctt

SEQ ID NO: 2377604 - DNA, 20 bp, Homo sapiens
tgctcaccagccctgcagcc

SEQ ID NO: 2377605 - DNA, 19 bp, Homo sapiens
tgctcacgactcttcctgc

SEQ ID NO: 2377606 - DNA, 16 bp, Homo sapiens
tgctcagggtcactga

SEQ ID NO: 2377607 - DNA, 18 bp, Homo sapiens
tgctcagtgtccagcttc

SEQ ID NO: 2377608 - DNA, 20 bp, Homo sapiens
tgctcagtgtccagcttcca

SEQ ID NO: 2377609 - DNA, 17 bp, Homo sapiens
tgctcataagtaaatgt

SEQ ID NO: 2377610 - DNA, 19 bp, Homo sapiens
tgctcataagtaaatgtct

SEQ ID NO: 2377611 - DNA, 21 bp, Homo sapiens
tgctcataagtaaatgtcttc

SEQ ID NO: 2377612 - DNA, 16 bp, Homo sapiens
tgctcattacagttct

SEQ ID NO: 2377613 - DNA, 21 bp, Homo sapiens
tgctcattacagttctttcct

SEQ ID NO: 2377614 - DNA, 22 bp, Homo sapiens
tgctcattacagttctttcctc

SEQ ID NO: 2377615 - DNA, 13 bp, Homo sapiens
tgctccccacagc

SEQ ID NO: 2377616 - DNA, 15 bp, Homo sapiens
tgctcccctgccaca

SEQ ID NO: 2377617 - DNA, 23 bp, Homo sapiens
tgctcccctgccacactgatggc

SEQ ID NO: 2377618 - DNA, 18 bp, Homo sapiens
tgctccgcctggcctggc

SEQ ID NO: 2377619 - DNA, 13 bp, Homo sapiens
tgctccttcccca

SEQ ID NO: 2377620 - DNA, 15 bp, Homo sapiens
tgctccttccccatc

SEQ ID NO: 2377621 - DNA, 19 bp, Homo sapiens
tgctcggagaagagcgcag

SEQ ID NO: 2377622 - DNA, 21 bp, Homo sapiens
tgctctccattctgctccttc

SEQ ID NO: 2377623 - DNA, 11 bp, Homo sapiens
tgctctcctct

SEQ ID NO: 2377624 - DNA, 16 bp, Homo sapiens
tgctctgccatcttca

SEQ ID NO: 2377625 - DNA, 17 bp, Homo sapiens
tgctctgccatcttcag

SEQ ID NO: 2377626 - DNA, 22 bp, Homo sapiens
tgctctggtggcttaagtgagc

SEQ ID NO: 2377627 - DNA, 16 bp, Homo sapiens
tgctctgtgagcccca

SEQ ID NO: 2377628 - DNA, 15 bp, Homo sapiens
tgctcttagtcccaa

SEQ ID NO: 2377629 - DNA, 16 bp, Homo sapiens
tgctgaaaaatatagc

SEQ ID NO: 2377630 - DNA, 19 bp, Homo sapiens
tgctgaacacagtgtctgt

SEQ ID NO: 2377631 - DNA, 15 bp, Homo sapiens
tgctgaatgccccct

SEQ ID NO: 2377632 - DNA, 15 bp, Homo sapiens
tgctgaggcccagtg

SEQ ID NO: 2377633 - DNA, 14 bp, Homo sapiens
tgctgatccccaac

SEQ ID NO: 2377634 - DNA, 19 bp, Homo sapiens
tgctgatcttttaaaatca

SEQ ID NO: 2377635 - DNA, 16 bp, Homo sapiens
tgctgatggagccttc

SEQ ID NO: 2377636 - DNA, 23 bp, Homo sapiens
tgctgcaaaatacattattcttc

SEQ ID NO: 2377637 - DNA, 14 bp, Homo sapiens
tgctgcaaacctga

SEQ ID NO: 2377638 - DNA, 16 bp, Homo sapiens
tgctgccatgatgtat

SEQ ID NO: 2377639 - DNA, 14 bp, Homo sapiens
tgctgcccccaccc

SEQ ID NO: 2377640 - DNA, 15 bp, Homo sapiens
tgctgcccccacccc

SEQ ID NO: 2377641 - DNA, 22 bp, Homo sapiens
tgctgcccccaccccggggacc

SEQ ID NO: 2377642 - DNA, 15 bp, Homo sapiens
tgctgcgtcagacca

SEQ ID NO: 2377643 - DNA, 17 bp, Homo sapiens
tgctgctgcctctttcc

SEQ ID NO: 2377644 - DNA, 21 bp, Homo sapiens
tgctgctggccaaatagcaaa

SEQ ID NO: 2377645 - DNA, 17 bp, Homo sapiens
tgctgctgtctgggtgc

SEQ ID NO: 2377646 - DNA, 12 bp, Homo sapiens
tgctgctgtctt

SEQ ID NO: 2377647 - DNA, 16 bp, Homo sapiens
tgctggaaaccacact

SEQ ID NO: 2377648 - DNA, 16 bp, Homo sapiens
tgggtgtattctctgt

SEQ ID NO: 2377649 - DNA, 17 bp, Homo sapiens
tgggtgtcctgcctgtc

SEQ ID NO: 2377650 - DNA, 22 bp, Homo sapiens
tgggtgtgagaatgatcaagga

SEQ ID NO: 2377651 - DNA, 15 bp, Homo sapiens
tgggtgtttccagaa

SEQ ID NO: 2377652 - DNA, 18 bp, Homo sapiens
tgggttgtgcacatttct

SEQ ID NO: 2377653 - DNA, 15 bp, Homo sapiens
tggtaaatgtttctt

SEQ ID NO: 2377654 - DNA, 13 bp, Homo sapiens
tggtaagagaaaa

SEQ ID NO: 2377655 - DNA, 21 bp, Homo sapiens
tggtaatcccctaaaataaca

SEQ ID NO: 2377656 - DNA, 22 bp, Homo sapiens
tggtaatctttacctgtataca

SEQ ID NO: 2377657 - DNA, 14 bp, Homo sapiens
tggtacagcagggt

SEQ ID NO: 2377658 - DNA, 20 bp, Homo sapiens
tggtacagcagggtcttgct

SEQ ID NO: 2377659 - DNA, 15 bp, Homo sapiens
tggtcataaaataga

SEQ ID NO: 2377660 - DNA, 21 bp, Homo sapiens
tggtccaaaagattgctgaaa

SEQ ID NO: 2377661 - DNA, 22 bp, Homo sapiens
tggtcggatctcacaggctgag

SEQ ID NO: 2377662 - DNA, 23 bp, Homo sapiens
tggtctcccatatgcagaaatag

SEQ ID NO: 2377663 - DNA, 15 bp, Homo sapiens
tggtctcccttctct

SEQ ID NO: 2377664 - DNA, 21 bp, Homo sapiens
tggtctctctatgcctctcta

SEQ ID NO: 2377665 - DNA, 13 bp, Homo sapiens
tggtctctgctgg

SEQ ID NO: 2377666 - DNA, 14 bp, Homo sapiens
tggtctctgctggg

SEQ ID NO: 2377667 - DNA, 15 bp, Homo sapiens
tggtctttgtaagag

SEQ ID NO: 2377668 - DNA, 21 bp, Homo sapiens
tggtctttgtaagagtgtaga

SEQ ID NO: 2377669 - DNA, 22 bp, Homo sapiens
tggtctttgtaagagtgtagaa

SEQ ID NO: 2377670 - DNA, 14 bp, Homo sapiens
tggtgaactatatt

SEQ ID NO: 2377671 - DNA, 15 bp, Homo sapiens
tggtgaagtgcttgg

SEQ ID NO: 2377672 - DNA, 18 bp, Homo sapiens
tggtgaggcccagcctgt

SEQ ID NO: 2377673 - DNA, 23 bp, Homo sapiens
tggtgaggcccagcctgtcctgg

SEQ ID NO: 2377674 - DNA, 15 bp, Homo sapiens
tggtgcctgagaggc

SEQ ID NO: 2377675 - DNA, 18 bp, Homo sapiens
tggtgcctgagaggcagg

SEQ ID NO: 2377676 - DNA, 14 bp, Homo sapiens
tggtgcctgccacc

SEQ ID NO: 2377677 - DNA, 14 bp, Homo sapiens
tggtgcctggcctg

SEQ ID NO: 2377678 - DNA, 23 bp, Homo sapiens
tggtgcctggcctggcacacatc

SEQ ID NO: 2377679 - DNA, 18 bp, Homo sapiens
tggtggttaaggccaggg

SEQ ID NO: 2377680 - DNA, 20 bp, Homo sapiens
tggtggttaaggccagggcc

SEQ ID NO: 2377681 - DNA, 17 bp, Homo sapiens
tggtgtaatttgaagat

SEQ ID NO: 2377682 - DNA, 17 bp, Homo sapiens
tggtgtgaacccgggag

SEQ ID NO: 2377683 - DNA, 16 bp, Homo sapiens
tggtgtgggtgtcctg

SEQ ID NO: 2377684 - DNA, 17 bp, Homo sapiens
tggttaagggctcccta

SEQ ID NO: 2377685 - DNA, 16 bp, Homo sapiens
tggttaccactctttt

SEQ ID NO: 2377686 - DNA, 23 bp, Homo sapiens
tggttacctgacctaaattagat

SEQ ID NO: 2377687 - DNA, 22 bp, Homo sapiens
tggttcccaatatcatgtgatt

SEQ ID NO: 2377688 - DNA, 17 bp, Homo sapiens
tggttcctaagcctgtt

SEQ ID NO: 2377689 - DNA, 13 bp, Homo sapiens
tggttcctctgct

SEQ ID NO: 2377690 - DNA, 19 bp, Homo sapiens
tggttctccaagaaactga

SEQ ID NO: 2377691 - DNA, 14 bp, Homo sapiens
tggttcttcccctc

SEQ ID NO: 2377692 - DNA, 16 bp, Homo sapiens
tggttgaaaataaaaa

SEQ ID NO: 2377693 - DNA, 16 bp, Homo sapiens
tggttgggaatgagga

SEQ ID NO: 2377694 - DNA, 22 bp, Homo sapiens
tggtttgcaacctctttgctca

SEQ ID NO: 2377695 - DNA, 19 bp, Homo sapiens
tggtttgcctgaggctgta

SEQ ID NO: 2377696 - DNA, 23 bp, Homo sapiens
tggttttatactgaaggaaaaac

SEQ ID NO: 2377697 - DNA, 13 bp, Homo sapiens
tggttttctgcca

SEQ ID NO: 2377698 - DNA, 21 bp, Homo sapiens
tggttttctgccaatgaccaa

SEQ ID NO: 2377699 - DNA, 23 bp, Homo sapiens
tgtaaaaaaaccaccaaaaacaa

SEQ ID NO: 2377700 - DNA, 12 bp, Homo sapiens
tgtaaaacagtg

SEQ ID NO: 2377701 - DNA, 13 bp, Homo sapiens
tgtaaaagaaatc

SEQ ID NO: 2377702 - DNA, 14 bp, Homo sapiens
tgtaaaagagaaac

SEQ ID NO: 2377703 - DNA, 19 bp, Homo sapiens
tgtaaactgtgtattccaa

SEQ ID NO: 2377704 - DNA, 18 bp, Homo sapiens
tgtaaagatattgtatct

SEQ ID NO: 2377705 - DNA, 16 bp, Homo sapiens
tgtaaattatttatgt

SEQ ID NO: 2377706 - DNA, 16 bp, Homo sapiens
tgtaacaacaattatt

SEQ ID NO: 2377707 - DNA, 20 bp, Homo sapiens
tgtaacaagaaagtggtctg

SEQ ID NO: 2377708 - DNA, 16 bp, Homo sapiens
tgtaacacaggataaa

SEQ ID NO: 2377709 - DNA, 16 bp, Homo sapiens
tgtaactgagagaaag

SEQ ID NO: 2377710 - DNA, 17 bp, Homo sapiens
tgtaacttccaaataaa

SEQ ID NO: 2377711 - DNA, 19 bp, Homo sapiens
tgtaacttccaaataaata

SEQ ID NO: 2377712 - DNA, 21 bp, Homo sapiens
tgtaacttccaaataaataat

SEQ ID NO: 2377713 - DNA, 22 bp, Homo sapiens
tgtaacttgcttaaatttctta

SEQ ID NO: 2377714 - DNA, 14 bp, Homo sapiens
tgtaagaaggcaat

SEQ ID NO: 2377715 - DNA, 17 bp, Homo sapiens
tgtaagaattctgattg

SEQ ID NO: 2377716 - DNA, 19 bp, Homo sapiens
tgtaagagcttgctccaga

SEQ ID NO: 2377717 - DNA, 17 bp, Homo sapiens
tgtaagcactctggatg

SEQ ID NO: 2377718 - DNA, 20 bp, Homo sapiens
tgtaagcatttgtacatctt

SEQ ID NO: 2377719 - DNA, 15 bp, Homo sapiens
tgtaagtgtaaaaaa

SEQ ID NO: 2377720 - DNA, 16 bp, Homo sapiens
tgtaagtttcaggtga

SEQ ID NO: 2377721 - DNA, 23 bp, Homo sapiens
tgtaagtttcaggtgacatgtga

SEQ ID NO: 2377722 - DNA, 12 bp, Homo sapiens
tgtaataagaca

SEQ ID NO: 2377723 - DNA, 14 bp, Homo sapiens
tgtaataagacata

SEQ ID NO: 2377724 - DNA, 21 bp, Homo sapiens
tgtaataataaaaccaaagaa

SEQ ID NO: 2377725 - DNA, 14 bp, Homo sapiens
tgtaataatagact

SEQ ID NO: 2377726 - DNA, 23 bp, Homo sapiens
tgtaatacttctttgttattata

SEQ ID NO: 2377727 - DNA, 20 bp, Homo sapiens
tgtaatagggaaaattctaa

SEQ ID NO: 2377728 - DNA, 13 bp, Homo sapiens
tgtaatatcagtt

SEQ ID NO: 2377729 - DNA, 21 bp, Homo sapiens
tgtaatcccagcactttggga

SEQ ID NO: 2377730 - DNA, 17 bp, Homo sapiens
tgtaatcgtgtgccatg

SEQ ID NO: 2377731 - DNA, 18 bp, Homo sapiens
tgtaatttcaaaatacat

SEQ ID NO: 2377732 - DNA, 20 bp, Homo sapiens
tgtaattttattttaaaatt

SEQ ID NO: 2377733 - DNA, 23 bp, Homo sapiens
tgtaattttattttaaaatttca

SEQ ID NO: 2377734 - DNA, 13 bp, Homo sapiens
tgtacaaaattaa

SEQ ID NO: 2377735 - DNA, 14 bp, Homo sapiens
tgtacaaactcatc

SEQ ID NO: 2377736 - DNA, 22 bp, Homo sapiens
tgtacaacaccagcaacattat

SEQ ID NO: 2377737 - DNA, 20 bp, Homo sapiens
tgtacaccactttcccacac

SEQ ID NO: 2377738 - DNA, 15 bp, Homo sapiens
tgtacagatcaagaa

SEQ ID NO: 2377739 - DNA, 19 bp, Homo sapiens
tgtacataactgaaaatgt

SEQ ID NO: 2377740 - DNA, 11 bp, Homo sapiens
tgtacatgtgt

SEQ ID NO: 2377741 - DNA, 20 bp, Homo sapiens
tgtacatgtgtagcctgtgc

SEQ ID NO: 2377742 - DNA, 20 bp, Homo sapiens
tgtacatttatgatttaata

SEQ ID NO: 2377743 - DNA, 18 bp, Homo sapiens
tgtacctacagctaagct

SEQ ID NO: 2377744 - DNA, 20 bp, Homo sapiens
tgtactaaacagtaagatat

SEQ ID NO: 2377745 - DNA, 14 bp, Homo sapiens
tgtactgaattttt

SEQ ID NO: 2377746 - DNA, 20 bp, Homo sapiens
tgtactgaatttttttgtaa

SEQ ID NO: 2377747 - DNA, 16 bp, Homo sapiens
tgtactgtctgttatg

SEQ ID NO: 2377748 - DNA, 15 bp, Homo sapiens
tgtacttaaatggta

SEQ ID NO: 2377749 - DNA, 16 bp, Homo sapiens
tgtacttcttgaatat

SEQ ID NO: 2377750 - DNA, 20 bp, Homo sapiens
tgtagaaaagaactggaaac

SEQ ID NO: 2377751 - DNA, 19 bp, Homo sapiens
tgtagaaacaaagggtttt

SEQ ID NO: 2377752 - DNA, 13 bp, Homo sapiens
tgtagaagcattc

SEQ ID NO: 2377753 - DNA, 12 bp, Homo sapiens
tgtagagttaag

SEQ ID NO: 2377754 - DNA, 21 bp, Homo sapiens
tgtagatattgtgaagtacat

SEQ ID NO: 2377755 - DNA, 22 bp, Homo sapiens
tgtagatattgtgaagtacata

SEQ ID NO: 2377756 - DNA, 14 bp, Homo sapiens
tgtagcctgtgcat

SEQ ID NO: 2377757 - DNA, 20 bp, Homo sapiens
tgtagcctgtgcatgtatgt

SEQ ID NO: 2377758 - DNA, 22 bp, Homo sapiens
tgtagctcagtcatcaaagcag

SEQ ID NO: 2377759 - DNA, 23 bp, Homo sapiens
tgtagctcccgagctactctctt

SEQ ID NO: 2377760 - DNA, 23 bp, Homo sapiens
tgtagtcccagctacttgggagg

SEQ ID NO: 2377761 - DNA, 18 bp, Homo sapiens
tgtagtcttgacgaatat

SEQ ID NO: 2377762 - DNA, 17 bp, Homo sapiens
ttcagttgcttgtcttc

SEQ ID NO: 2377763 - DNA, 14 bp, Homo sapiens
ttcataaattattt

SEQ ID NO: 2377764 - DNA, 18 bp, Homo sapiens
ttcataatcagtaaatag

SEQ ID NO: 2377765 - DNA, 18 bp, Homo sapiens
ttcatagctgtacttctt

SEQ ID NO: 2377766 - DNA, 15 bp, Homo sapiens
ttcatatctaacttt

SEQ ID NO: 2377767 - DNA, 16 bp, Homo sapiens
ttcatctctttagaga

SEQ ID NO: 2377768 - DNA, 15 bp, Homo sapiens
ttcatcttcctgtgt

SEQ ID NO: 2377769 - DNA, 17 bp, Homo sapiens
ttcatcttcctgtgtcc

SEQ ID NO: 2377770 - DNA, 22 bp, Homo sapiens
ttcatgaaaaagctgcttctta

SEQ ID NO: 2377771 - DNA, 17 bp, Homo sapiens
ttcatgaaaataccatt

SEQ ID NO: 2377772 - DNA, 21 bp, Homo sapiens
ttcatggcatcttcaatatga

SEQ ID NO: 2377773 - DNA, 19 bp, Homo sapiens
ttcatggctacctcagaaa

SEQ ID NO: 2377774 - DNA, 19 bp, Homo sapiens
ttcatggctgctgttgctt

SEQ ID NO: 2377775 - DNA, 16 bp, Homo sapiens
ttcatgtcccagaact

SEQ ID NO: 2377776 - DNA, 22 bp, Homo sapiens
ttcattatgcacttttagaaat

SEQ ID NO: 2377777 - DNA, 13 bp, Homo sapiens
ttcattattctct

SEQ ID NO: 2377778 - DNA, 15 bp, Homo sapiens
ttcattattctctgc

SEQ ID NO: 2377779 - DNA, 16 bp, Homo sapiens
ttcattgcaattaaac

SEQ ID NO: 2377780 - DNA, 16 bp, Homo sapiens
ttccaaacatccaaaa

SEQ ID NO: 2377781 - DNA, 12 bp, Homo sapiens
ttccaaagaaag

SEQ ID NO: 2377782 - DNA, 19 bp, Homo sapiens
ttccaaattaaaacaaata

SEQ ID NO: 2377783 - DNA, 16 bp, Homo sapiens
ttccaagacatgtctg

SEQ ID NO: 2377784 - DNA, 19 bp, Homo sapiens
ttccaagcaaaatctaaaa

SEQ ID NO: 2377785 - DNA, 23 bp, Homo sapiens
ttccaagggtatgggaagccata

SEQ ID NO: 2377786 - DNA, 18 bp, Homo sapiens
ttccaccccaagagaact

SEQ ID NO: 2377787 - DNA, 18 bp, Homo sapiens
ttccactaaaaatattgt

SEQ ID NO: 2377788 - DNA, 17 bp, Homo sapiens
ttccactacacctggct

SEQ ID NO: 2377789 - DNA, 18 bp, Homo sapiens
ttccagatcactgccaca

SEQ ID NO: 2377790 - DNA, 20 bp, Homo sapiens
ttccagctgtcactctgtgc

SEQ ID NO: 2377791 - DNA, 21 bp, Homo sapiens
ttccagtacagtattctttta

SEQ ID NO: 2377792 - DNA, 13 bp, Homo sapiens
ttccagtttctcc

SEQ ID NO: 2377793 - DNA, 17 bp, Homo sapiens
ttccagtttctccttga

SEQ ID NO: 2377794 - DNA, 15 bp, Homo sapiens
ttccatacttctctc

SEQ ID NO: 2377795 - DNA, 15 bp, Homo sapiens
ttccatatcctggtg

SEQ ID NO: 2377796 - DNA, 22 bp, Homo sapiens
ttccatccatctttccatccat

SEQ ID NO: 2377797 - DNA, 21 bp, Homo sapiens
ttccatccattacctccatcc

SEQ ID NO: 2377798 - DNA, 15 bp, Homo sapiens
ttccatgagctgctc

SEQ ID NO: 2377799 - DNA, 13 bp, Homo sapiens
ttccattgcttat

SEQ ID NO: 2377800 - DNA, 21 bp, Homo sapiens
ttcccaggagatgggtccagg

SEQ ID NO: 2377801 - DNA, 13 bp, Homo sapiens
ttcccctgtgtca

SEQ ID NO: 2377802 - DNA, 19 bp, Homo sapiens
ttcccctttcctgtcccac

SEQ ID NO: 2377803 - DNA, 19 bp, Homo sapiens
ttccctacagcctagggca

SEQ ID NO: 2377804 - DNA, 20 bp, Homo sapiens
ttccctacagcctagggcag

SEQ ID NO: 2377805 - DNA, 14 bp, Homo sapiens
ttccctctctcact

SEQ ID NO: 2377806 - DNA, 18 bp, Homo sapiens
ttccctgaacgttttctt

SEQ ID NO: 2377807 - DNA, 16 bp, Homo sapiens
ttccctgcagacctca

SEQ ID NO: 2377808 - DNA, 23 bp, Homo sapiens
ttccctgcagacctcaagccatc

SEQ ID NO: 2377809 - DNA, 14 bp, Homo sapiens
ttccctgcttccag

SEQ ID NO: 2377810 - DNA, 16 bp, Homo sapiens
ttccctgcttccagga

SEQ ID NO: 2377811 - DNA, 13 bp, Homo sapiens
ttccctgggctgc

SEQ ID NO: 2377812 - DNA, 14 bp, Homo sapiens
ttcccttattgcct

SEQ ID NO: 2377813 - DNA, 15 bp, Homo sapiens
ttcccttattgcctc

SEQ ID NO: 2377814 - DNA, 11 bp, Homo sapiens
ttcccttccaa

SEQ ID NO: 2377815 - DNA, 15 bp, Homo sapiens
ttccgtatctccctg

SEQ ID NO: 2377816 - DNA, 14 bp, Homo sapiens
ttcctaacaaaatg

SEQ ID NO: 2377817 - DNA, 19 bp, Homo sapiens
ttcctaacacagcatgtgt

SEQ ID NO: 2377818 - DNA, 20 bp, Homo sapiens
ttcctaagcctgttgctgaa

SEQ ID NO: 2377819 - DNA, 17 bp, Homo sapiens
ttcctactcacacttca

SEQ ID NO: 2377820 - DNA, 15 bp, Homo sapiens
ttcctactggtctct

SEQ ID NO: 2377821 - DNA, 22 bp, Homo sapiens
ttcctaggaggaaaattccatt

SEQ ID NO: 2377822 - DNA, 13 bp, Homo sapiens
ttcctattgtaat

SEQ ID NO: 2377823 - DNA, 22 bp, Homo sapiens
ttcctatttcagtgttacctgt

SEQ ID NO: 2377824 - DNA, 18 bp, Homo sapiens
ttcctatttgccatgggc

SEQ ID NO: 2377825 - DNA, 20 bp, Homo sapiens
ttcctatttgccatgggctt

SEQ ID NO: 2377826 - DNA, 22 bp, Homo sapiens
ttcctatttgccatgggcttca

SEQ ID NO: 2377827 - DNA, 20 bp, Homo sapiens
ttcctcaaaataaagaagta

SEQ ID NO: 2377828 - DNA, 20 bp, Homo sapiens
ttcctcaaattttttgactt

SEQ ID NO: 2377829 - DNA, 19 bp, Homo sapiens
ttcctccctgggggcccca

SEQ ID NO: 2377830 - DNA, 15 bp, Homo sapiens
ttcctcctttacctt

SEQ ID NO: 2377831 - DNA, 17 bp, Homo sapiens
ttcctctagaagccaag

SEQ ID NO: 2377832 - DNA, 12 bp, Homo sapiens
ttcctctccact

SEQ ID NO: 2377833 - DNA, 13 bp, Homo sapiens
ttcctctccactg

SEQ ID NO: 2377834 - DNA, 15 bp, Homo sapiens
ttcctctggccgcag

SEQ ID NO: 2377835 - DNA, 21 bp, Homo sapiens
ttcctctttctgctctgccat

SEQ ID NO: 2377836 - DNA, 14 bp, Homo sapiens
ttcctgaaccatgt

SEQ ID NO: 2377837 - DNA, 18 bp, Homo sapiens
ttcctgaatccaaactaa

SEQ ID NO: 2377838 - DNA, 15 bp, Homo sapiens
ttcctgcaaagggaa

SEQ ID NO: 2377839 - DNA, 21 bp, Homo sapiens
ttcctgcaggcaggaacaaac

SEQ ID NO: 2377840 - DNA, 15 bp, Homo sapiens
ttcctgcgtcctcct

SEQ ID NO: 2377841 - DNA, 20 bp, Homo sapiens
ttcctgctgctgtctgggtg

SEQ ID NO: 2377842 - DNA, 12 bp, Homo sapiens
ttcctggctcta

SEQ ID NO: 2377843 - DNA, 18 bp, Homo sapiens
ttcctggctctaccctgt

SEQ ID NO: 2377844 - DNA, 12 bp, Homo sapiens
ttcctggtgagg

SEQ ID NO: 2377845 - DNA, 19 bp, Homo sapiens
ttcctggtgaggcccagcc

SEQ ID NO: 2377846 - DNA, 19 bp, Homo sapiens
ttcctggtgccaatttcaa

SEQ ID NO: 2377847 - DNA, 11 bp, Homo sapiens
ttcctgtccca

SEQ ID NO: 2377848 - DNA, 21 bp, Homo sapiens
ttcctgtgggtgttctttcct

SEQ ID NO: 2377849 - DNA, 11 bp, Homo sapiens
ttcctgtgtcc

SEQ ID NO: 2377850 - DNA, 14 bp, Homo sapiens
ttcctgtgtcctga

SEQ ID NO: 2377851 - DNA, 21 bp, Homo sapiens
ttcctgttactgagatgtctt

SEQ ID NO: 2377852 - DNA, 13 bp, Homo sapiens
ttccttctttgat

SEQ ID NO: 2377853 - DNA, 15 bp, Homo sapiens
ttccttgcgcctcag

SEQ ID NO: 2377854 - DNA, 23 bp, Homo sapiens
ttccttggtcctagtaagaagac

SEQ ID NO: 2377855 - DNA, 13 bp, Homo sapiens
ttccttgtgcaaa

SEQ ID NO: 2377856 - DNA, 14 bp, Homo sapiens
ttcctttatgtgaa

SEQ ID NO: 2377857 - DNA, 19 bp, Homo sapiens
ttcctttatgtgaattttt

SEQ ID NO: 2377858 - DNA, 15 bp, Homo sapiens
ttcctttctctcctg

SEQ ID NO: 2377859 - DNA, 18 bp, Homo sapiens
ttcctttctctcctggct

SEQ ID NO: 2377860 - DNA, 14 bp, Homo sapiens
ttcctttgcatatt

SEQ ID NO: 2377861 - DNA, 12 bp, Homo sapiens
ttccttttaatt

SEQ ID NO: 2377862 - DNA, 14 bp, Homo sapiens
ttccttttccctgc

SEQ ID NO: 2377863 - DNA, 21 bp, Homo sapiens
ttcctttttcaaaaaccagcc

SEQ ID NO: 2377864 - DNA, 23 bp, Homo sapiens
ttcgaatgacggtaagtgttctc

SEQ ID NO: 2377865 - DNA, 15 bp, Homo sapiens
ttcgaggcctgaagc

SEQ ID NO: 2377866 - DNA, 20 bp, Homo sapiens
ttcgaggcctgaagccagct

SEQ ID NO: 2377867 - DNA, 16 bp, Homo sapiens
ttcgaggtgtcaccct

SEQ ID NO: 2377868 - DNA, 22 bp, Homo sapiens
ttcgcgggtaactggggttgag

SEQ ID NO: 2377869 - DNA, 19 bp, Homo sapiens
ttcggaactgtcctttcct

SEQ ID NO: 2377870 - DNA, 16 bp, Homo sapiens
ttcggtttcaaagtga

SEQ ID NO: 2377871 - DNA, 15 bp, Homo sapiens
ttcgtttattttcaa

SEQ ID NO: 2377872 - DNA, 14 bp, Homo sapiens
ttctaagaaaatgt

SEQ ID NO: 2377873 - DNA, 16 bp, Homo sapiens
ttctaagaaaatgtag

SEQ ID NO: 2377874 - DNA, 12 bp, Homo sapiens
ttctaagagaag

SEQ ID NO: 2377875 - DNA, 15 bp, Homo sapiens
ttctaatcacagtgt

SEQ ID NO: 2377876 - DNA, 16 bp, Homo sapiens
ttctaatcacagtgtt

SEQ ID NO: 2377877 - DNA, 13 bp, Homo sapiens
ttctaattaatag

SEQ ID NO: 2377878 - DNA, 14 bp, Homo sapiens
ttctaattgtaagt

SEQ ID NO: 2377879 - DNA, 13 bp, Homo sapiens
ttctacaaggact

SEQ ID NO: 2377880 - DNA, 15 bp, Homo sapiens
ttctacatagatgct

SEQ ID NO: 2377881 - DNA, 23 bp, Homo sapiens
ttctaccggagagagaatgtatt

SEQ ID NO: 2377882 - DNA, 13 bp, Homo sapiens
ttctacctgccct

SEQ ID NO: 2377883 - DNA, 19 bp, Homo sapiens
ttctacggatcatcaacaa

SEQ ID NO: 2377884 - DNA, 22 bp, Homo sapiens
ttctacggatcatcaacaagat

SEQ ID NO: 2377885 - DNA, 13 bp, Homo sapiens
ttctacgtttctt

SEQ ID NO: 2377886 - DNA, 14 bp, Homo sapiens
ttctacgtttcttt

SEQ ID NO: 2377887 - DNA, 20 bp, Homo sapiens
ttctactcacttttcccact

SEQ ID NO: 2377888 - DNA, 21 bp, Homo sapiens
ttctactcacttttcccactc

SEQ ID NO: 2377889 - DNA, 21 bp, Homo sapiens
ttctagaaacaaacatctaat

SEQ ID NO: 2377890 - DNA, 12 bp, Homo sapiens
ttctaggaaaat

SEQ ID NO: 2377891 - DNA, 23 bp, Homo sapiens
ttctagtgatgatggttcacgtt

SEQ ID NO: 2377892 - DNA, 15 bp, Homo sapiens
ttctagtggtctttg

SEQ ID NO: 2377893 - DNA, 21 bp, Homo sapiens
ttctagtggtctttgtaagag

SEQ ID NO: 2377894 - DNA, 22 bp, Homo sapiens
ttctagtggtctttgtaagagt

SEQ ID NO: 2377895 - DNA, 11 bp, Homo sapiens
ttctagtgtcc

SEQ ID NO: 2377896 - DNA, 16 bp, Homo sapiens
ttctagtgtccataaa

SEQ ID NO: 2377897 - DNA, 14 bp, Homo sapiens
ttctatgacaaatt

SEQ ID NO: 2377898 - DNA, 18 bp, Homo sapiens
ttctatgacaaattcaag

SEQ ID NO: 2377899 - DNA, 19 bp, Homo sapiens
ttctattatttttataatt

SEQ ID NO: 2377900 - DNA, 14 bp, Homo sapiens
ttctattgaattcg

SEQ ID NO: 2377901 - DNA, 18 bp, Homo sapiens
ttctcaaagttttgaaaa

SEQ ID NO: 2377902 - DNA, 21 bp, Homo sapiens
ttctcaaagttttgaaaagct

SEQ ID NO: 2377903 - DNA, 14 bp, Homo sapiens
ttctcaagtaacat

SEQ ID NO: 2377904 - DNA, 19 bp, Homo sapiens
ttctcaatcactgctcccc

SEQ ID NO: 2377905 - DNA, 14 bp, Homo sapiens
ttctcagttttcat

SEQ ID NO: 2377906 - DNA, 16 bp, Homo sapiens
ttctcccactctccta

SEQ ID NO: 2377907 - DNA, 19 bp, Homo sapiens
ttctccgccagcctcctct

SEQ ID NO: 2377908 - DNA, 20 bp, Homo sapiens
ttctcctcccttccttttcc

SEQ ID NO: 2377909 - DNA, 12 bp, Homo sapiens
ttctctaatatt

SEQ ID NO: 2377910 - DNA, 21 bp, Homo sapiens
ttctctcagatttccacagag

SEQ ID NO: 2377911 - DNA, 22 bp, Homo sapiens
ttctctccacagtgttgtgccc

SEQ ID NO: 2377912 - DNA, 14 bp, Homo sapiens
ttctctccttgccc

SEQ ID NO: 2377913 - DNA, 19 bp, Homo sapiens
ttctctgtaagtgtagctc

SEQ ID NO: 2377914 - DNA, 22 bp, Homo sapiens
ttctctgttgtttggttcaggg

SEQ ID NO: 2377915 - DNA, 21 bp, Homo sapiens
ttctcttgagcagttagcaga

SEQ ID NO: 2377916 - DNA, 15 bp, Homo sapiens
ttctcttgagctggc

SEQ ID NO: 2377917 - DNA, 18 bp, Homo sapiens
ttctcttgagctggcctc

SEQ ID NO: 2377918 - DNA, 20 bp, Homo sapiens
ttctcttgagctggcctctc

SEQ ID NO: 2377919 - DNA, 14 bp, Homo sapiens
ttctcttttgaaag

SEQ ID NO: 2377920 - DNA, 15 bp, Homo sapiens
ttctgaaacacacga

SEQ ID NO: 2377921 - DNA, 16 bp, Homo sapiens
ttctgaactcaaactg

SEQ ID NO: 2377922 - DNA, 17 bp, Homo sapiens
ttctgaactcaaactga

SEQ ID NO: 2377923 - DNA, 15 bp, Homo sapiens
ttctgactctgagct

SEQ ID NO: 2377924 - DNA, 19 bp, Homo sapiens
ttctgagctcctgtcccct

SEQ ID NO: 2377925 - DNA, 13 bp, Homo sapiens
ttctgagctgggc

SEQ ID NO: 2377926 - DNA, 19 bp, Homo sapiens
ttctgcagtcatctcccct

SEQ ID NO: 2377927 - DNA, 21 bp, Homo sapiens
ttctgcattcatttttatagc

SEQ ID NO: 2377928 - DNA, 21 bp, Homo sapiens
ttctgccatctagccagcccc

SEQ ID NO: 2377929 - DNA, 13 bp, Homo sapiens
ttctgccctggct

SEQ ID NO: 2377930 - DNA, 18 bp, Homo sapiens
ttctgccctggctgctgc

SEQ ID NO: 2377931 - DNA, 16 bp, Homo sapiens
ttctgctctgccatct

SEQ ID NO: 2377932 - DNA, 13 bp, Homo sapiens
ttctgcttttctg

SEQ ID NO: 2377933 - DNA, 17 bp, Homo sapiens
ttctgcttttctgccct

SEQ ID NO: 2377934 - DNA, 16 bp, Homo sapiens
ttctggacctctgggt

SEQ ID NO: 2377935 - DNA, 18 bp, Homo sapiens
ttctggacctgggcatga

SEQ ID NO: 2377936 - DNA, 18 bp, Homo sapiens
ttctggctttaagccttc

SEQ ID NO: 2377937 - DNA, 16 bp, Homo sapiens
ttctgggatgtcacag

SEQ ID NO: 2377938 - DNA, 16 bp, Homo sapiens
ttctggggctgtgtta

SEQ ID NO: 2377939 - DNA, 22 bp, Homo sapiens
ttctggtcaagggctgtcattg

SEQ ID NO: 2377940 - DNA, 17 bp, Homo sapiens
ttctggtttaaacttgt

SEQ ID NO: 2377941 - DNA, 13 bp, Homo sapiens
ttctgtatttcct

SEQ ID NO: 2377942 - DNA, 14 bp, Homo sapiens
ttctgtatttcctt

SEQ ID NO: 2377943 - DNA, 20 bp, Homo sapiens
ttctgtatttttttttctaa

SEQ ID NO: 2377944 - DNA, 22 bp, Homo sapiens
ttctgtatttttttttctaaga

SEQ ID NO: 2377945 - DNA, 18 bp, Homo sapiens
ttctgtgatgagctgatc

SEQ ID NO: 2377946 - DNA, 15 bp, Homo sapiens
ttctgtgcctgaata

SEQ ID NO: 2377947 - DNA, 18 bp, Homo sapiens
ttctgtggctgatttact

SEQ ID NO: 2377948 - DNA, 17 bp, Homo sapiens
ttctgtggttcctctgc

SEQ ID NO: 2377949 - DNA, 20 bp, Homo sapiens
ttctgtggttcctctgctca

SEQ ID NO: 2377950 - DNA, 14 bp, Homo sapiens
ttctgttaaaatgg

SEQ ID NO: 2377951 - DNA, 16 bp, Homo sapiens
ttctgttcatttccta

SEQ ID NO: 2377952 - DNA, 14 bp, Homo sapiens
ttctgtttaatttt

SEQ ID NO: 2377953 - DNA, 19 bp, Homo sapiens
ttctgtttaattttcactt

SEQ ID NO: 2377954 - DNA, 14 bp, Homo sapiens
ttcttaaaaaggaa

SEQ ID NO: 2377955 - DNA, 21 bp, Homo sapiens
ttcttaaaaggcccatagcag

SEQ ID NO: 2377956 - DNA, 19 bp, Homo sapiens
ttcttaattcatgaggagg

SEQ ID NO: 2377957 - DNA, 14 bp, Homo sapiens
ttcttacatgcatt

SEQ ID NO: 2377958 - DNA, 15 bp, Homo sapiens
ttcttactaaaaagt

SEQ ID NO: 2377959 - DNA, 20 bp, Homo sapiens
ttcttactaaaaagtataaa

SEQ ID NO: 2377960 - DNA, 15 bp, Homo sapiens
ttcttagctttttaa

SEQ ID NO: 2377961 - DNA, 22 bp, Homo sapiens
ttcttagttcatatatcaagaa

SEQ ID NO: 2377962 - DNA, 24 bp, Homo sapiens
ttcttagttcatatatcaagaagt

SEQ ID NO: 2377963 - DNA, 20 bp, Homo sapiens
ttcttatgtgacattaacaa

SEQ ID NO: 2377964 - DNA, 17 bp, Homo sapiens
ttcttatttttgtactt

SEQ ID NO: 2377965 - DNA, 18 bp, Homo sapiens
ttcttcactcaaattttg

SEQ ID NO: 2377966 - DNA, 16 bp, Homo sapiens
ttcttctcttatcctc

SEQ ID NO: 2377967 - DNA, 17 bp, Homo sapiens
ttcttgaatataaaaaa

SEQ ID NO: 2377968 - DNA, 18 bp, Homo sapiens
ttcttgcctgaactcctg

SEQ ID NO: 2377969 - DNA, 21 bp, Homo sapiens
ttcttgctgccatgatgtata

SEQ ID NO: 2377970 - DNA, 15 bp, Homo sapiens
ttcttgtttccttgt

SEQ ID NO: 2377971 - DNA, 16 bp, Homo sapiens
ttcttgtttccttgtt

SEQ ID NO: 2377972 - DNA, 13 bp, Homo sapiens
ttctttaaaagaa

SEQ ID NO: 2377973 - DNA, 12 bp, Homo sapiens
ttctttcagaaa

SEQ ID NO: 2377974 - DNA, 19 bp, Homo sapiens
ttctttcagttctttggat

SEQ ID NO: 2377975 - DNA, 20 bp, Homo sapiens
ttctttccattatgattctt

SEQ ID NO: 2377976 - DNA, 13 bp, Homo sapiens
ttctttcctgccc

SEQ ID NO: 2377977 - DNA, 18 bp, Homo sapiens
ttctttctagtggtcttt

SEQ ID NO: 2377978 - DNA, 22 bp, Homo sapiens
ttctttctagtggtctttgtaa

SEQ ID NO: 2377979 - DNA, 17 bp, Homo sapiens
ttctttgataatgttaa

SEQ ID NO: 2377980 - DNA, 16 bp, Homo sapiens
ttctttgttacaggca

SEQ ID NO: 2377981 - DNA, 13 bp, Homo sapiens
ttcttttcacatt

SEQ ID NO: 2377982 - DNA, 14 bp, Homo sapiens
ttcttttctcagtg

SEQ ID NO: 2377983 - DNA, 20 bp, Homo sapiens
ttcttttcttcactcaaatt

SEQ ID NO: 2377984 - DNA, 13 bp, Homo sapiens
ttcttttgtttgg

SEQ ID NO: 2377985 - DNA, 23 bp, Homo sapiens
ttctttttgtagctggggctttg

SEQ ID NO: 2377986 - DNA, 18 bp, Homo sapiens
ttcttttttaaatgtttc

SEQ ID NO: 2377987 - DNA, 19 bp, Homo sapiens
ttcttttttaaatgtttct

SEQ ID NO: 2377988 - DNA, 20 bp, Homo sapiens
ttcttttttaaatgtttctt

SEQ ID NO: 2377989 - DNA, 21 bp, Homo sapiens
ttctttttttttaagttctta

SEQ ID NO: 2377990 - DNA, 20 bp, Homo sapiens
ttgaaaaatctcattatttc

SEQ ID NO: 2377991 - DNA, 19 bp, Homo sapiens
ttgaaaagaccaagacttt

SEQ ID NO: 2377992 - DNA, 14 bp, Homo sapiens
tttcataatcagta

SEQ ID NO: 2377993 - DNA, 14 bp, Homo sapiens
tttcatacacttat

SEQ ID NO: 2377994 - DNA, 18 bp, Homo sapiens
tttcatatctaactttgt

SEQ ID NO: 2377995 - DNA, 19 bp, Homo sapiens
tttcatgaaaataccattt

SEQ ID NO: 2377996 - DNA, 13 bp, Homo sapiens
tttcattttactg

SEQ ID NO: 2377997 - DNA, 13 bp, Homo sapiens
tttccaaatgaac

SEQ ID NO: 2377998 - DNA, 19 bp, Homo sapiens
tttccaccaggccgtgcct

SEQ ID NO: 2377999 - DNA, 18 bp, Homo sapiens
tttccaggcttctgctgg

SEQ ID NO: 2378000 - DNA, 19 bp, Homo sapiens
tttccaggcttctgctggg

SEQ ID NO: 2378001 - DNA, 19 bp, Homo sapiens
tttccatgcgtgtttctga

SEQ ID NO: 2378002 - DNA, 22 bp, Homo sapiens
tttcccaccccaacctgctctc

SEQ ID NO: 2378003 - DNA, 16 bp, Homo sapiens
tttcccactccaagcc

SEQ ID NO: 2378004 - DNA, 22 bp, Homo sapiens
tttcccatttgtgccagaggaa

SEQ ID NO: 2378005 - DNA, 13 bp, Homo sapiens
tttccctccccag

SEQ ID NO: 2378006 - DNA, 16 bp, Homo sapiens
tttccctgcctctcat

SEQ ID NO: 2378007 - DNA, 14 bp, Homo sapiens
tttcctaaggcatg

SEQ ID NO: 2378008 - DNA, 12 bp, Homo sapiens
tttcctccaccc

SEQ ID NO: 2378009 - DNA, 16 bp, Homo sapiens
tttcctctccactgct

SEQ ID NO: 2378010 - DNA, 13 bp, Homo sapiens
tttcctgaaagtg

SEQ ID NO: 2378011 - DNA, 18 bp, Homo sapiens
tttcctgaaccatgtgga

SEQ ID NO: 2378012 - DNA, 20 bp, Homo sapiens
tttcctgagaccacagagag

SEQ ID NO: 2378013 - DNA, 15 bp, Homo sapiens
tttcctgccctgtcc

SEQ ID NO: 2378014 - DNA, 16 bp, Homo sapiens
tttcctgccctgtcca

SEQ ID NO: 2378015 - DNA, 22 bp, Homo sapiens
tttcctttaaaaaaatttaagt

SEQ ID NO: 2378016 - DNA, 23 bp, Homo sapiens
tttcctttaaaaaaatttaagtg

SEQ ID NO: 2378017 - DNA, 14 bp, Homo sapiens
tttcctttatgtga

SEQ ID NO: 2378018 - DNA, 16 bp, Homo sapiens
tttcctttttgacact

SEQ ID NO: 2378019 - DNA, 19 bp, Homo sapiens
tttcctttttgacactgaa

SEQ ID NO: 2378020 - DNA, 21 bp, Homo sapiens
tttctaaataaaaatatgtaa

SEQ ID NO: 2378021 - DNA, 11 bp, Homo sapiens
tttctaacttt

SEQ ID NO: 2378022 - DNA, 12 bp, Homo sapiens
tttctaactttt

SEQ ID NO: 2378023 - DNA, 14 bp, Homo sapiens
tttctaagaaaatg

SEQ ID NO: 2378024 - DNA, 13 bp, Homo sapiens
tttctaagagaag

SEQ ID NO: 2378025 - DNA, 16 bp, Homo sapiens
tttctaagagaagtta

SEQ ID NO: 2378026 - DNA, 14 bp, Homo sapiens
tttctactttaaat

SEQ ID NO: 2378027 - DNA, 14 bp, Homo sapiens
tttctagtggtctt

SEQ ID NO: 2378028 - DNA, 14 bp, Homo sapiens
tttctatgacaaat

SEQ ID NO: 2378029 - DNA, 21 bp, Homo sapiens
tttctattaatatcaactctg

SEQ ID NO: 2378030 - DNA, 22 bp, Homo sapiens
tttctattaatatcaactctga

SEQ ID NO: 2378031 - DNA, 20 bp, Homo sapiens
tttctattatggaaaactgt

SEQ ID NO: 2378032 - DNA, 14 bp, Homo sapiens
tttctcaaagtttt

SEQ ID NO: 2378033 - DNA, 18 bp, Homo sapiens
tttctcaaagttttgaaa

SEQ ID NO: 2378034 - DNA, 22 bp, Homo sapiens
tttctcaaagttttgaaaagct

SEQ ID NO: 2378035 - DNA, 13 bp, Homo sapiens
tttctcaatgtct

SEQ ID NO: 2378036 - DNA, 16 bp, Homo sapiens
tttctcagttttcata

SEQ ID NO: 2378037 - DNA, 20 bp, Homo sapiens
tttctcatccacataccctg

SEQ ID NO: 2378038 - DNA, 16 bp, Homo sapiens
tttctctattaaaatg

SEQ ID NO: 2378039 - DNA, 13 bp, Homo sapiens
tttctctcctggc

SEQ ID NO: 2378040 - DNA, 15 bp, Homo sapiens
tttctctcctggctc

SEQ ID NO: 2378041 - DNA, 14 bp, Homo sapiens
tttctcttccctga

SEQ ID NO: 2378042 - DNA, 15 bp, Homo sapiens
tttctcttgagctgg

SEQ ID NO: 2378043 - DNA, 21 bp, Homo sapiens
tttctcttttcccctttcctg

SEQ ID NO: 2378044 - DNA, 13 bp, Homo sapiens
tttctgccctggc

SEQ ID NO: 2378045 - DNA, 15 bp, Homo sapiens
tttctgctctgccat

SEQ ID NO: 2378046 - DNA, 19 bp, Homo sapiens
tttctggctgtgatcttaa

SEQ ID NO: 2378047 - DNA, 18 bp, Homo sapiens
tttcttaaaccttcagtt

SEQ ID NO: 2378048 - DNA, 12 bp, Homo sapiens
tttcttagcttt

SEQ ID NO: 2378049 - DNA, 13 bp, Homo sapiens
tttcttagctttt

SEQ ID NO: 2378050 - DNA, 16 bp, Homo sapiens
tttcttagctttttaa

SEQ ID NO: 2378051 - DNA, 15 bp, Homo sapiens
tttcttatgtgacat

SEQ ID NO: 2378052 - DNA, 16 bp, Homo sapiens
tttcttatgtgacatt

SEQ ID NO: 2378053 - DNA, 18 bp, Homo sapiens
tttcttctttccctggac

SEQ ID NO: 2378054 - DNA, 23 bp, Homo sapiens
tttctttaaccttgtataaatta

SEQ ID NO: 2378055 - DNA, 13 bp, Homo sapiens
tttctttctagtg

SEQ ID NO: 2378056 - DNA, 22 bp, Homo sapiens
tttctttgaccagatctttctc

SEQ ID NO: 2378057 - DNA, 23 bp, Homo sapiens
tttctttgaccagatctttctct

SEQ ID NO: 2378058 - DNA, 16 bp, Homo sapiens
tttcttttctaacttt

SEQ ID NO: 2378059 - DNA, 20 bp, Homo sapiens
tttcttttttaaatgtttct

SEQ ID NO: 2378060 - DNA, 17 bp, Homo sapiens
tttctttttttttaagt

SEQ ID NO: 2378061 - DNA, 18 bp, Homo sapiens
tttgaaaagaccaagact

SEQ ID NO: 2378062 - DNA, 18 bp, Homo sapiens
tttgaaaagcagacattt

SEQ ID NO: 2378063 - DNA, 18 bp, Homo sapiens
tttgaaaagctattagcc

SEQ ID NO: 2378064 - DNA, 13 bp, Homo sapiens
tttgaataaatgt

SEQ ID NO: 2378065 - DNA, 21 bp, Homo sapiens
tttgaatgtatttgatttata

SEQ ID NO: 2378066 - DNA, 16 bp, Homo sapiens
tttgaattctgtgata

SEQ ID NO: 2378067 - DNA, 16 bp, Homo sapiens
tttgacacaaagcttc

SEQ ID NO: 2378068 - DNA, 18 bp, Homo sapiens
tttgacactgaaagtttt

SEQ ID NO: 2378069 - DNA, 19 bp, Homo sapiens
tttgaccagatctttctct

SEQ ID NO: 2378070 - DNA, 15 bp, Homo sapiens
tttgacttaagaaag

SEQ ID NO: 2378071 - DNA, 22 bp, Homo sapiens
tttgactttttttgtatgtgtg

SEQ ID NO: 2378072 - DNA, 21 bp, Homo sapiens
tttgagagaaatatgaagaac

SEQ ID NO: 2378073 - DNA, 14 bp, Homo sapiens
tttgagctgccttc

SEQ ID NO: 2378074 - DNA, 15 bp, Homo sapiens
tttgaggagagtgaa

SEQ ID NO: 2378075 - DNA, 20 bp, Homo sapiens
tttgaggtcaagtaagaaga

SEQ ID NO: 2378076 - DNA, 23 bp, Homo sapiens
tttgataatgttaaatttgtaag

SEQ ID NO: 2378077 - DNA, 19 bp, Homo sapiens
tttgatagggaactgggga

SEQ ID NO: 2378078 - DNA, 22 bp, Homo sapiens
tttgatgattttcatttcatga

SEQ ID NO: 2378079 - DNA, 12 bp, Homo sapiens
tttgattaataa

SEQ ID NO: 2378080 - DNA, 17 bp, Homo sapiens
tttgattaataaaatat

SEQ ID NO: 2378081 - DNA, 18 bp, Homo sapiens
tttgcaaagtgtattagg

SEQ ID NO: 2378082 - DNA, 19 bp, Homo sapiens
tttgcaacctctttgctca

SEQ ID NO: 2378083 - DNA, 14 bp, Homo sapiens
tttgcaagtgctgg

SEQ ID NO: 2378084 - DNA, 17 bp, Homo sapiens
tttgcaataacagctgc

SEQ ID NO: 2378085 - DNA, 21 bp, Homo sapiens
tttgcactaaatcagagacaa

SEQ ID NO: 2378086 - DNA, 18 bp, Homo sapiens
tttgcactgaggatattc

SEQ ID NO: 2378087 - DNA, 16 bp, Homo sapiens
tttgcaggattccctt

SEQ ID NO: 2378088 - DNA, 21 bp, Homo sapiens
tttgcaggattcccttctggg

SEQ ID NO: 2378089 - DNA, 20 bp, Homo sapiens
tttgcatgcatgcaaatgag

SEQ ID NO: 2378090 - DNA, 21 bp, Homo sapiens
tttgcatttaaaacagacact

SEQ ID NO: 2378091 - DNA, 14 bp, Homo sapiens
tttgccatgggctt

SEQ ID NO: 2378092 - DNA, 20 bp, Homo sapiens
tttgccatgggcttcactgt

SEQ ID NO: 2378093 - DNA, 14 bp, Homo sapiens
tttgccattgtgaa

SEQ ID NO: 2378094 - DNA, 23 bp, Homo sapiens
tttgccccgggatattatagaaa

SEQ ID NO: 2378095 - DNA, 17 bp, Homo sapiens
tttgcctcaccttgggg

SEQ ID NO: 2378096 - DNA, 16 bp, Homo sapiens
tttgctatctgggctg

SEQ ID NO: 2378097 - DNA, 14 bp, Homo sapiens
tttgctcagtgtcc

SEQ ID NO: 2378098 - DNA, 15 bp, Homo sapiens
tttgctcataagtaa

SEQ ID NO: 2378099 - DNA, 21 bp, Homo sapiens
tttgctcataagtaaatgtct

SEQ ID NO: 2378100 - DNA, 23 bp, Homo sapiens
tttgctctattaagattggaaat

SEQ ID NO: 2378101 - DNA, 23 bp, Homo sapiens
tttgctgacaaccattaaagtca

SEQ ID NO: 2378102 - DNA, 10 bp, Homo sapiens
tttggaaata

SEQ ID NO: 2378103 - DNA, 20 bp, Homo sapiens
tttggaataatttctattaa

SEQ ID NO: 2378104 - DNA, 15 bp, Homo sapiens
tttggaatattaaaa

SEQ ID NO: 2378105 - DNA, 20 bp, Homo sapiens
tttggagcacaaaattcaaa

SEQ ID NO: 2378106 - DNA, 14 bp, Homo sapiens
tttggatggtttgt

SEQ ID NO: 2378107 - DNA, 18 bp, Homo sapiens
aaaaactcaaccaaatgg

SEQ ID NO: 2378108 - DNA, 22 bp, Homo sapiens
aaaaactcaaccaaatggtaca

SEQ ID NO: 2378109 - DNA, 17 bp, Homo sapiens
aaaaagataccttaaaa

SEQ ID NO: 2378110 - DNA, 20 bp, Homo sapiens
aaaaagtattgccaaacatt

SEQ ID NO: 2378111 - DNA, 21 bp, Homo sapiens
aaaaagtattgccaaacatta

SEQ ID NO: 2378112 - DNA, 15 bp, Homo sapiens
aaaaagtcttttaaa

SEQ ID NO: 2378113 - DNA, 21 bp, Homo sapiens
aaaaagttgtatgatctgtgc

SEQ ID NO: 2378114 - DNA, 23 bp, Homo sapiens
aaaaagttgtatgatctgtgcct

SEQ ID NO: 2378115 - DNA, 16 bp, Homo sapiens
aaaaatatgtgaagga

SEQ ID NO: 2378116 - DNA, 13 bp, Homo sapiens
aaaacagaaattg

SEQ ID NO: 2378117 - DNA, 16 bp, Homo sapiens
aaaacagaaattggta

SEQ ID NO: 2378118 - DNA, 14 bp, Homo sapiens
aaaactacttagca

SEQ ID NO: 2378119 - DNA, 21 bp, Homo sapiens
aaaactgtactttgattcaca

SEQ ID NO: 2378120 - DNA, 22 bp, Homo sapiens
aaaactgtactttgattcacat

SEQ ID NO: 2378121 - DNA, 17 bp, Homo sapiens
aaaagataccttaaaat

SEQ ID NO: 2378122 - DNA, 21 bp, Homo sapiens
aaaagataccttaaaatttga

SEQ ID NO: 2378123 - DNA, 18 bp, Homo sapiens
aaaagtcttttaaaaagt

SEQ ID NO: 2378124 - DNA, 12 bp, Homo sapiens
aaaatatgcact

SEQ ID NO: 2378125 - DNA, 14 bp, Homo sapiens
aaaatatgcactaa

SEQ ID NO: 2378126 - DNA, 15 bp, Homo sapiens
aaaatattaatacag

SEQ ID NO: 2378127 - DNA, 13 bp, Homo sapiens
aaaatctgaagat

SEQ ID NO: 2378128 - DNA, 18 bp, Homo sapiens
aaaatctgaagattgttt

SEQ ID NO: 2378129 - DNA, 22 bp, Homo sapiens
aaaatctgaagattgtttatct

SEQ ID NO: 2378130 - DNA, 21 bp, Homo sapiens
aaaatcttattaaagtttcaa

SEQ ID NO: 2378131 - DNA, 19 bp, Homo sapiens
aaaatggcaacaaactgca

SEQ ID NO: 2378132 - DNA, 13 bp, Homo sapiens
aaaatgtaactgt

SEQ ID NO: 2378133 - DNA, 18 bp, Homo sapiens
aaacaagcatataaaatg

SEQ ID NO: 2378134 - DNA, 19 bp, Homo sapiens
aaacactaaatgttaaaga

SEQ ID NO: 2378135 - DNA, 14 bp, Homo sapiens
aaacattaatgttg

SEQ ID NO: 2378136 - DNA, 14 bp, Homo sapiens
aaacattagtactt

SEQ ID NO: 2378137 - DNA, 21 bp, Homo sapiens
aaacattagtactttatagaa

SEQ ID NO: 2378138 - DNA, 14 bp, Homo sapiens
aaaccctgtcaaac

SEQ ID NO: 2378139 - DNA, 15 bp, Homo sapiens
aaaccctgtcaaaca

SEQ ID NO: 2378140 - DNA, 18 bp, Homo sapiens
aaaccctgtcaaacatta

SEQ ID NO: 2378141 - DNA, 22 bp, Homo sapiens
aaactcaaccaaatggtacaaa

SEQ ID NO: 2378142 - DNA, 21 bp, Homo sapiens
aaactgcacatgatttcacaa

SEQ ID NO: 2378143 - DNA, 15 bp, Homo sapiens
aaactgtactttgat

SEQ ID NO: 2378144 - DNA, 22 bp, Homo sapiens
aaactgtactttgattcacatg

SEQ ID NO: 2378145 - DNA, 15 bp, Homo sapiens
aaagaaatctataga

SEQ ID NO: 2378146 - DNA, 18 bp, Homo sapiens
aaagaaatctatagaaag

SEQ ID NO: 2378147 - DNA, 21 bp, Homo sapiens
aaagaaatctatagaaagtgt

SEQ ID NO: 2378148 - DNA, 23 bp, Homo sapiens
aaagaaatctatagaaagtgttc

SEQ ID NO: 2378149 - DNA, 20 bp, Homo sapiens
aaagaactatcttcatctga

SEQ ID NO: 2378150 - DNA, 14 bp, Homo sapiens
aaagacaaatagta

SEQ ID NO: 2378151 - DNA, 18 bp, Homo sapiens
aaagataccttaaaattt

SEQ ID NO: 2378152 - DNA, 12 bp, Homo sapiens
aaagatgtagca

SEQ ID NO: 2378153 - DNA, 16 bp, Homo sapiens
aaaggaagatgttctg

SEQ ID NO: 2378154 - DNA, 17 bp, Homo sapiens
aaaggaagatgttctgt

SEQ ID NO: 2378155 - DNA, 13 bp, Homo sapiens
aaaggctgtattc

SEQ ID NO: 2378156 - DNA, 18 bp, Homo sapiens
aaaggctgtattcagcaa

SEQ ID NO: 2378157 - DNA, 16 bp, Homo sapiens
aaagtacaggtacttt

SEQ ID NO: 2378158 - DNA, 18 bp, Homo sapiens
aaagtattgccaaacatt

SEQ ID NO: 2378159 - DNA, 22 bp, Homo sapiens
aaagtcatgatgtttttaaaat

SEQ ID NO: 2378160 - DNA, 20 bp, Homo sapiens
aaagtcttttaaaaagtatt

SEQ ID NO: 2378161 - DNA, 17 bp, Homo sapiens
aaagtgttctgttacaa

SEQ ID NO: 2378162 - DNA, 18 bp, Homo sapiens
aaagtgttctgttacaaa

SEQ ID NO: 2378163 - DNA, 19 bp, Homo sapiens
aaagtgttctgttacaaaa

SEQ ID NO: 2378164 - DNA, 17 bp, Homo sapiens
aaagttgggcagagaaa

SEQ ID NO: 2378165 - DNA, 21 bp, Homo sapiens
aaagttgggcagagaaataca

SEQ ID NO: 2378166 - DNA, 22 bp, Homo sapiens
aaagtttgatcttcctctgcta

SEQ ID NO: 2378167 - DNA, 20 bp, Homo sapiens
aaataacaacttttttttct

SEQ ID NO: 2378168 - DNA, 20 bp, Homo sapiens
aaatactgtagataattaac

SEQ ID NO: 2378169 - DNA, 21 bp, Homo sapiens
aaatatatggtctaatgttta

SEQ ID NO: 2378170 - DNA, 21 bp, Homo sapiens
aaatatgcactaagtctcttt

SEQ ID NO: 2378171 - DNA, 12 bp, Homo sapiens
aaatatgtgaag

SEQ ID NO: 2378172 - DNA, 12 bp, Homo sapiens
aaatattaaaaa

SEQ ID NO: 2378173 - DNA, 14 bp, Homo sapiens
aaatattaaaaagt

SEQ ID NO: 2378174 - DNA, 19 bp, Homo sapiens
aaatctatagaaagtgttc

SEQ ID NO: 2378175 - DNA, 22 bp, Homo sapiens
aaatctatagaaagtgttctgt

SEQ ID NO: 2378176 - DNA, 16 bp, Homo sapiens
aaatctgaagattgtt

SEQ ID NO: 2378177 - DNA, 18 bp, Homo sapiens
aaatctgaagattgttta

SEQ ID NO: 2378178 - DNA, 19 bp, Homo sapiens
aaatctgaagattgtttat

SEQ ID NO: 2378179 - DNA, 19 bp, Homo sapiens
aaatcttattaaagtttca

SEQ ID NO: 2378180 - DNA, 22 bp, Homo sapiens
aaatcttattaaagtttcaaaa

SEQ ID NO: 2378181 - DNA, 18 bp, Homo sapiens
aaatgaacacaaattatg

SEQ ID NO: 2378182 - DNA, 17 bp, Homo sapiens
aaatgattgcttttaaa

SEQ ID NO: 2378183 - DNA, 20 bp, Homo sapiens
aaatgattgcttttaaaatt

SEQ ID NO: 2378184 - DNA, 14 bp, Homo sapiens
aaatggagttggag

SEQ ID NO: 2378185 - DNA, 22 bp, Homo sapiens
aaatggagttggagttcattca

SEQ ID NO: 2378186 - DNA, 15 bp, Homo sapiens
aaatggcaacaaact

SEQ ID NO: 2378187 - DNA, 22 bp, Homo sapiens
aaatgtgaattactaacttcta

SEQ ID NO: 2378188 - DNA, 22 bp, Homo sapiens
aaatgtgtgtgatgtgacattt

SEQ ID NO: 2378189 - DNA, 15 bp, Homo sapiens
aaatgttaaagatgt

SEQ ID NO: 2378190 - DNA, 21 bp, Homo sapiens
aaatgttaaagatgtagcaaa

SEQ ID NO: 2378191 - DNA, 22 bp, Homo sapiens
aaatgttttgtaaactttgaaa

SEQ ID NO: 2378192 - DNA, 21 bp, Homo sapiens
aaattatgctaagaatttttt

SEQ ID NO: 2378193 - DNA, 12 bp, Homo sapiens
aaattgatgttg

SEQ ID NO: 2378194 - DNA, 13 bp, Homo sapiens
aaattgatgttga

SEQ ID NO: 2378195 - DNA, 15 bp, Homo sapiens
aaattgatgttgatg

SEQ ID NO: 2378196 - DNA, 16 bp, Homo sapiens
aaattggtaccttgca

SEQ ID NO: 2378197 - DNA, 15 bp, Homo sapiens
aaatttattgaggaa

SEQ ID NO: 2378198 - DNA, 13 bp, Homo sapiens
aaatttgaaacat

SEQ ID NO: 2378199 - DNA, 14 bp, Homo sapiens
aaatttgaaacatt

SEQ ID NO: 2378200 - DNA, 19 bp, Homo sapiens
aaatttttcatattttaat

SEQ ID NO: 2378201 - DNA, 18 bp, Homo sapiens
aacaattttcagatttgc

SEQ ID NO: 2378202 - DNA, 23 bp, Homo sapiens
aacaattttcagatttgcacaaa

SEQ ID NO: 2378203 - DNA, 16 bp, Homo sapiens
aacactaaatgttaaa

SEQ ID NO: 2378204 - DNA, 12 bp, Homo sapiens
aacagaaattgg

SEQ ID NO: 2378205 - DNA, 14 bp, Homo sapiens
aacagaaattggta

SEQ ID NO: 2378206 - DNA, 15 bp, Homo sapiens
aacagaaattggtac

SEQ ID NO: 2378207 - DNA, 16 bp, Homo sapiens
aacagattggatttta

SEQ ID NO: 2378208 - DNA, 21 bp, Homo sapiens
aacatcaggttaggcagtata

SEQ ID NO: 2378209 - DNA, 19 bp, Homo sapiens
aacattaatgttgatttct

SEQ ID NO: 2378210 - DNA, 18 bp, Homo sapiens
aacattcatgctcattgc

SEQ ID NO: 2378211 - DNA, 24 bp, Homo sapiens
aacattggaagcaggttaaatgtt

SEQ ID NO: 2378212 - DNA, 22 bp, Homo sapiens
aaccacagtgtaccattaaaat

SEQ ID NO: 2378213 - DNA, 23 bp, Homo sapiens
aaccacagtgtaccattaaaata

SEQ ID NO: 2378214 - DNA, 19 bp, Homo sapiens
aaccctgtcaaacattagt

SEQ ID NO: 2378215 - DNA, 20 bp, Homo sapiens
aacgtgtatgtttttcagtt

SEQ ID NO: 2378216 - DNA, 17 bp, Homo sapiens
aactcaaccaaatggta

SEQ ID NO: 2378217 - DNA, 17 bp, Homo sapiens
aactgcacatgatttca

SEQ ID NO: 2378218 - DNA, 23 bp, Homo sapiens
aactgctcttgggcaatattctc

SEQ ID NO: 2378219 - DNA, 22 bp, Homo sapiens
aactgtactttgattcacatgt

SEQ ID NO: 2378220 - DNA, 14 bp, Homo sapiens
aactgttaccattg

SEQ ID NO: 2378221 - DNA, 17 bp, Homo sapiens
aactgttaccattggaa

SEQ ID NO: 2378222 - DNA, 18 bp, Homo sapiens
aactgttaccattggaaa

SEQ ID NO: 2378223 - DNA, 13 bp, Homo sapiens
aacttctaaaact

SEQ ID NO: 2378224 - DNA, 12 bp, Homo sapiens
aacttgcttaaa

SEQ ID NO: 2378225 - DNA, 14 bp, Homo sapiens
aacttgcttaaatg

SEQ ID NO: 2378226 - DNA, 19 bp, Homo sapiens
aacttgcttaaatgtgaat

SEQ ID NO: 2378227 - DNA, 11 bp, Homo sapiens
aactttgaaat

SEQ ID NO: 2378228 - DNA, 20 bp, Homo sapiens
aactttgttaggccaaagac

SEQ ID NO: 2378229 - DNA, 14 bp, Homo sapiens
aagaaacattggaa

SEQ ID NO: 2378230 - DNA, 14 bp, Homo sapiens
aagaacttgtttaa

SEQ ID NO: 2378231 - DNA, 15 bp, Homo sapiens
aagaacttgtttaat

SEQ ID NO: 2378232 - DNA, 22 bp, Homo sapiens
aagaataggacttgtttttgtt

SEQ ID NO: 2378233 - DNA, 14 bp, Homo sapiens
aagacatgtttaaa

SEQ ID NO: 2378234 - DNA, 17 bp, Homo sapiens
aagataagttggaaaca

SEQ ID NO: 2378235 - DNA, 20 bp, Homo sapiens
aagataagttggaaacacta

SEQ ID NO: 2378236 - DNA, 14 bp, Homo sapiens
aagataccttaaaa

SEQ ID NO: 2378237 - DNA, 15 bp, Homo sapiens
aagataccttaaaat

SEQ ID NO: 2378238 - DNA, 16 bp, Homo sapiens
aagataccttaaaatt

SEQ ID NO: 2378239 - DNA, 23 bp, Homo sapiens
aagataccttaaaatttgaaaca

SEQ ID NO: 2378240 - DNA, 19 bp, Homo sapiens
aagatcggttaacaaataa

SEQ ID NO: 2378241 - DNA, 20 bp, Homo sapiens
aagatcggttaacaaataac

SEQ ID NO: 2378242 - DNA, 21 bp, Homo sapiens
aagatcggttaacaaataaca

SEQ ID NO: 2378243 - DNA, 13 bp, Homo sapiens
aagatgtagcaaa

SEQ ID NO: 2378244 - DNA, 12 bp, Homo sapiens
aagatgttatat

SEQ ID NO: 2378245 - DNA, 16 bp, Homo sapiens
aagatgttatattttt

SEQ ID NO: 2378246 - DNA, 13 bp, Homo sapiens
aagcaacaatttt

SEQ ID NO: 2378247 - DNA, 17 bp, Homo sapiens
aagcaacaattttcaga

SEQ ID NO: 2378248 - DNA, 18 bp, Homo sapiens
aagcaacaattttcagat

SEQ ID NO: 2378249 - DNA, 14 bp, Homo sapiens
aagcaggttaaatg

SEQ ID NO: 2378250 - DNA, 15 bp, Homo sapiens
aagcaggttaaatgt

SEQ ID NO: 2378251 - DNA, 16 bp, Homo sapiens
aagcaggttaaatgtt

SEQ ID NO: 2378252 - DNA, 18 bp, Homo sapiens
aagcaggttaaatgtttt

SEQ ID NO: 2378253 - DNA, 21 bp, Homo sapiens
aagcaggttaaatgttttgta

SEQ ID NO: 2378254 - DNA, 12 bp, Homo sapiens
aagcagtttcaa

SEQ ID NO: 2378255 - DNA, 13 bp, Homo sapiens
aagcatataaaat

SEQ ID NO: 2378256 - DNA, 15 bp, Homo sapiens
aagcatataaaatgg

SEQ ID NO: 2378257 - DNA, 17 bp, Homo sapiens
aagcatataaaatggca

SEQ ID NO: 2378258 - DNA, 14 bp, Homo sapiens
aagcgaaaaactca

SEQ ID NO: 2378259 - DNA, 23 bp, Homo sapiens
aagctaggaaaagaaatctatag

SEQ ID NO: 2378260 - DNA, 21 bp, Homo sapiens
aaggaccttcactctaagatg

SEQ ID NO: 2378261 - DNA, 17 bp, Homo sapiens
aaggtagaatgaccttg

SEQ ID NO: 2378262 - DNA, 18 bp, Homo sapiens
aagtattgccaaacatta

SEQ ID NO: 2378263 - DNA, 12 bp, Homo sapiens
aagtcttttaaa

SEQ ID NO: 2378264 - DNA, 17 bp, Homo sapiens
aagtcttttaaaaagta

SEQ ID NO: 2378265 - DNA, 19 bp, Homo sapiens
aagtcttttaaaaagtatt

SEQ ID NO: 2378266 - DNA, 20 bp, Homo sapiens
aagtcttttaaaaagtattg

SEQ ID NO: 2378267 - DNA, 22 bp, Homo sapiens
aagtgttctgttacaaaatgta

SEQ ID NO: 2378268 - DNA, 17 bp, Homo sapiens
aagttagcctttatcta

SEQ ID NO: 2378269 - DNA, 21 bp, Homo sapiens
aagttagcctttatctaccaa

SEQ ID NO: 2378270 - DNA, 16 bp, Homo sapiens
aagttagtaggatatg

SEQ ID NO: 2378271 - DNA, 19 bp, Homo sapiens
aagttagtaggatatgcct

SEQ ID NO: 2378272 - DNA, 14 bp, Homo sapiens
aagttatatttcct

SEQ ID NO: 2378273 - DNA, 22 bp, Homo sapiens
aagttatatttcctataccatt

SEQ ID NO: 2378274 - DNA, 23 bp, Homo sapiens
aagttatatttcctataccattt

SEQ ID NO: 2378275 - DNA, 22 bp, Homo sapiens
aagttctgcctctgatgtattt

SEQ ID NO: 2378276 - DNA, 15 bp, Homo sapiens
aagttggaaacacta

SEQ ID NO: 2378277 - DNA, 20 bp, Homo sapiens
aagttggaaacactaaatgt

SEQ ID NO: 2378278 - DNA, 20 bp, Homo sapiens
aagtttgataaatagtgtta

SEQ ID NO: 2378279 - DNA, 21 bp, Homo sapiens
aagtttgataaatagtgttat

SEQ ID NO: 2378280 - DNA, 11 bp, Homo sapiens
aagttttgtga

SEQ ID NO: 2378281 - DNA, 14 bp, Homo sapiens
aagttttgtgaaat

SEQ ID NO: 2378282 - DNA, 18 bp, Homo sapiens
aagttttgtgaaattttt

SEQ ID NO: 2378283 - DNA, 20 bp, Homo sapiens
aagttttgtgaaatttttca

SEQ ID NO: 2378284 - DNA, 17 bp, Homo sapiens
aataaagcgaaaaactc

SEQ ID NO: 2378285 - DNA, 19 bp, Homo sapiens
aataaagtttgatcttcct

SEQ ID NO: 2378286 - DNA, 14 bp, Homo sapiens
aataatcctgcaaa

SEQ ID NO: 2378287 - DNA, 21 bp, Homo sapiens
aatagtaggcaagatggcaca

SEQ ID NO: 2378288 - DNA, 23 bp, Homo sapiens
aatagtgttattgagagagatgt

SEQ ID NO: 2378289 - DNA, 13 bp, Homo sapiens
aatatatagcatt

SEQ ID NO: 2378290 - DNA, 18 bp, Homo sapiens
aatatatggtctaatgtt

SEQ ID NO: 2378291 - DNA, 16 bp, Homo sapiens
aatatattttgtatgc

SEQ ID NO: 2378292 - DNA, 18 bp, Homo sapiens
aatatattttgtatgcaa

SEQ ID NO: 2378293 - DNA, 20 bp, Homo sapiens
aatatattttgtatgcaagc

SEQ ID NO: 2378294 - DNA, 17 bp, Homo sapiens
aatatgcactaagtctc

SEQ ID NO: 2378295 - DNA, 22 bp, Homo sapiens
aatatgcactaagtctcttttt

SEQ ID NO: 2378296 - DNA, 11 bp, Homo sapiens
aatatgtgaag

SEQ ID NO: 2378297 - DNA, 21 bp, Homo sapiens
aatatgtgaaggaccttcact

SEQ ID NO: 2378298 - DNA, 22 bp, Homo sapiens
cataattctgaagttatatttc

SEQ ID NO: 2378299 - DNA, 15 bp, Homo sapiens
catattacaatattt

SEQ ID NO: 2378300 - DNA, 17 bp, Homo sapiens
catattacaatatttgt

SEQ ID NO: 2378301 - DNA, 12 bp, Homo sapiens
catattagaaaa

SEQ ID NO: 2378302 - DNA, 13 bp, Homo sapiens
catattagaaaac

SEQ ID NO: 2378303 - DNA, 15 bp, Homo sapiens
catattagaaaactt

SEQ ID NO: 2378304 - DNA, 23 bp, Homo sapiens
catattagcgacaacagattgga

SEQ ID NO: 2378305 - DNA, 15 bp, Homo sapiens
catattttaatttca

SEQ ID NO: 2378306 - DNA, 23 bp, Homo sapiens
catcaggttaggcagtataaaga

SEQ ID NO: 2378307 - DNA, 21 bp, Homo sapiens
catgaaatgctatgtcatttc

SEQ ID NO: 2378308 - DNA, 22 bp, Homo sapiens
catgatgtttttaaaatcttat

SEQ ID NO: 2378309 - DNA, 14 bp, Homo sapiens
catgatttcacaaa

SEQ ID NO: 2378310 - DNA, 17 bp, Homo sapiens
catgatttcacaaatat

SEQ ID NO: 2378311 - DNA, 17 bp, Homo sapiens
catgctttccatatttt

SEQ ID NO: 2378312 - DNA, 18 bp, Homo sapiens
catgtcctgtgtcagttt

SEQ ID NO: 2378313 - DNA, 22 bp, Homo sapiens
catgttttcaaatggagttgga

SEQ ID NO: 2378314 - DNA, 14 bp, Homo sapiens
cattaatgttgatt

SEQ ID NO: 2378315 - DNA, 17 bp, Homo sapiens
cattaatgttgatttct

SEQ ID NO: 2378316 - DNA, 20 bp, Homo sapiens
cattaatgttgatttctagt

SEQ ID NO: 2378317 - DNA, 22 bp, Homo sapiens
cattagcaaaaaaagttgtatg

SEQ ID NO: 2378318 - DNA, 20 bp, Homo sapiens
cattagtactttatagaaga

SEQ ID NO: 2378319 - DNA, 22 bp, Homo sapiens
cattagtactttatagaagaat

SEQ ID NO: 2378320 - DNA, 13 bp, Homo sapiens
cattctcagtttt

SEQ ID NO: 2378321 - DNA, 19 bp, Homo sapiens
cattctcagtttttcttaa

SEQ ID NO: 2378322 - DNA, 17 bp, Homo sapiens
cattgcttttaaaacta

SEQ ID NO: 2378323 - DNA, 13 bp, Homo sapiens
cattggaaatttc

SEQ ID NO: 2378324 - DNA, 16 bp, Homo sapiens
cattggaaatttcacg

SEQ ID NO: 2378325 - DNA, 16 bp, Homo sapiens
catttatggtaatcat

SEQ ID NO: 2378326 - DNA, 14 bp, Homo sapiens
catttgtcattttc

SEQ ID NO: 2378327 - DNA, 15 bp, Homo sapiens
catttgtcattttca

SEQ ID NO: 2378328 - DNA, 17 bp, Homo sapiens
cattttcattagcaaaa

SEQ ID NO: 2378329 - DNA, 21 bp, Homo sapiens
cattttgtttttaatgcagaa

SEQ ID NO: 2378330 - DNA, 12 bp, Homo sapiens
ccaaacattaat

SEQ ID NO: 2378331 - DNA, 14 bp, Homo sapiens
ccaaatggtacaaa

SEQ ID NO: 2378332 - DNA, 19 bp, Homo sapiens
ccaactttcaagaacttgt

SEQ ID NO: 2378333 - DNA, 12 bp, Homo sapiens
ccaagttttgtg

SEQ ID NO: 2378334 - DNA, 17 bp, Homo sapiens
ccaagttttgtgaaatt

SEQ ID NO: 2378335 - DNA, 12 bp, Homo sapiens
ccacttttccag

SEQ ID NO: 2378336 - DNA, 15 bp, Homo sapiens
ccagtacattctcag

SEQ ID NO: 2378337 - DNA, 19 bp, Homo sapiens
ccagtacattctcagtttt

SEQ ID NO: 2378338 - DNA, 11 bp, Homo sapiens
ccatgtatgca

SEQ ID NO: 2378339 - DNA, 13 bp, Homo sapiens
ccattttcctgca

SEQ ID NO: 2378340 - DNA, 16 bp, Homo sapiens
cccactggttagatgt

SEQ ID NO: 2378341 - DNA, 11 bp, Homo sapiens
ccctgaaatgt

SEQ ID NO: 2378342 - DNA, 20 bp, Homo sapiens
ccgtaaaaactgaagttctg

SEQ ID NO: 2378343 - DNA, 17 bp, Homo sapiens
cctgaaatgtgtgtgat

SEQ ID NO: 2378344 - DNA, 19 bp, Homo sapiens
cctgaaatgtgtgtgatgt

SEQ ID NO: 2378345 - DNA, 22 bp, Homo sapiens
cctgcaaagtacaggtactttg

SEQ ID NO: 2378346 - DNA, 13 bp, Homo sapiens
cctgtcaaacatt

SEQ ID NO: 2378347 - DNA, 14 bp, Homo sapiens
cctgtcaaacatta

SEQ ID NO: 2378348 - DNA, 17 bp, Homo sapiens
ccttaaaatttgaaaca

SEQ ID NO: 2378349 - DNA, 17 bp, Homo sapiens
ccttgcacacatcatct

SEQ ID NO: 2378350 - DNA, 16 bp, Homo sapiens
ccttgtaatgtaactg

SEQ ID NO: 2378351 - DNA, 20 bp, Homo sapiens
cctttatctaccaactttca

SEQ ID NO: 2378352 - DNA, 22 bp, Homo sapiens
ccttttttatatcttggcaggt

SEQ ID NO: 2378353 - DNA, 16 bp, Homo sapiens
cgaaagttagtaggat

SEQ ID NO: 2378354 - DNA, 17 bp, Homo sapiens
cgacaacagattggatt

SEQ ID NO: 2378355 - DNA, 16 bp, Homo sapiens
ctaaaactgtactttg

SEQ ID NO: 2378356 - DNA, 17 bp, Homo sapiens
ctaaaactgtactttga

SEQ ID NO: 2378357 - DNA, 14 bp, Homo sapiens
ctaaacgtgtatgt

SEQ ID NO: 2378358 - DNA, 22 bp, Homo sapiens
ctaaacgtgtatgtttttcagt

SEQ ID NO: 2378359 - DNA, 16 bp, Homo sapiens
ctaaattgatgttgat

SEQ ID NO: 2378360 - DNA, 17 bp, Homo sapiens
ctaaattgatgttgatg

SEQ ID NO: 2378361 - DNA, 13 bp, Homo sapiens
ctaacttctaaaa

SEQ ID NO: 2378362 - DNA, 14 bp, Homo sapiens
ctaacttgcttaaa

SEQ ID NO: 2378363 - DNA, 17 bp, Homo sapiens
ctaagatcggttaacaa

SEQ ID NO: 2378364 - DNA, 18 bp, Homo sapiens
ctaagatcggttaacaaa

SEQ ID NO: 2378365 - DNA, 13 bp, Homo sapiens
ctaagatgttata

SEQ ID NO: 2378366 - DNA, 18 bp, Homo sapiens
ctaatgtttaagcagaat

SEQ ID NO: 2378367 - DNA, 20 bp, Homo sapiens
ctaatgtttaagcagaattg

SEQ ID NO: 2378368 - DNA, 22 bp, Homo sapiens
ctaatgtttaagcagaattgga

SEQ ID NO: 2378369 - DNA, 14 bp, Homo sapiens
ctaggaacaaatct

SEQ ID NO: 2378370 - DNA, 17 bp, Homo sapiens
ctagttagcatacacat

SEQ ID NO: 2378371 - DNA, 12 bp, Homo sapiens
ctagttatttat

SEQ ID NO: 2378372 - DNA, 13 bp, Homo sapiens
ctagttatttatt

SEQ ID NO: 2378373 - DNA, 16 bp, Homo sapiens
ctagttatttattctg

SEQ ID NO: 2378374 - DNA, 19 bp, Homo sapiens
ctagttatttattctggga

SEQ ID NO: 2378375 - DNA, 20 bp, Homo sapiens
ctagttatttattctgggaa

SEQ ID NO: 2378376 - DNA, 13 bp, Homo sapiens
ctatagaaagtgt

SEQ ID NO: 2378377 - DNA, 20 bp, Homo sapiens
ctatagaaagtgttctgtta

SEQ ID NO: 2378378 - DNA, 14 bp, Homo sapiens
ctatgtcatttcat

SEQ ID NO: 2378379 - DNA, 16 bp, Homo sapiens
ctatgtcatttcatgt

SEQ ID NO: 2378380 - DNA, 15 bp, Homo sapiens
ctctaagatgttata

SEQ ID NO: 2378381 - DNA, 18 bp, Homo sapiens
ctctaagatgttatattt

SEQ ID NO: 2378382 - DNA, 16 bp, Homo sapiens
ctctgtacatattagc

SEQ ID NO: 2378383 - DNA, 22 bp, Homo sapiens
ctcttgggcaatattctctgta

SEQ ID NO: 2378384 - DNA, 19 bp, Homo sapiens
ctgaaatgtgtgtgatgtg

SEQ ID NO: 2378385 - DNA, 15 bp, Homo sapiens
ctgaagattgtttat

SEQ ID NO: 2378386 - DNA, 17 bp, Homo sapiens
ctgaagttatatttcct

SEQ ID NO: 2378387 - DNA, 20 bp, Homo sapiens
ctgaagttatatttcctata

SEQ ID NO: 2378388 - DNA, 23 bp, Homo sapiens
ctgaagttctgcctctgatgtat

SEQ ID NO: 2378389 - DNA, 13 bp, Homo sapiens
ctgaagtttgata

SEQ ID NO: 2378390 - DNA, 22 bp, Homo sapiens
ctgaagtttgataaatagtgtt

SEQ ID NO: 2378391 - DNA, 14 bp, Homo sapiens
ctgaatctgtacag

SEQ ID NO: 2378392 - DNA, 20 bp, Homo sapiens
ctgagagaggctaaaatgtt

SEQ ID NO: 2378393 - DNA, 21 bp, Homo sapiens
ctgagagaggctaaaatgttt

SEQ ID NO: 2378394 - DNA, 23 bp, Homo sapiens
ctgagagaggctaaaatgttttc

SEQ ID NO: 2378395 - DNA, 21 bp, Homo sapiens
ctgcaaagtacaggtactttg

SEQ ID NO: 2378396 - DNA, 22 bp, Homo sapiens
ctgcaaagtacaggtactttgt

SEQ ID NO: 2378397 - DNA, 18 bp, Homo sapiens
ctgcattgggtgatcatt

SEQ ID NO: 2378398 - DNA, 18 bp, Homo sapiens
ctgctaaattgatgttga

SEQ ID NO: 2378399 - DNA, 20 bp, Homo sapiens
ctgggaatgtatagtatttg

SEQ ID NO: 2378400 - DNA, 23 bp, Homo sapiens
ctgggaatgtatagtatttgaaa

SEQ ID NO: 2378401 - DNA, 22 bp, Homo sapiens
ctgtacagagccgtaaaaactg

SEQ ID NO: 2378402 - DNA, 19 bp, Homo sapiens
ctgtactttgattcacatg

SEQ ID NO: 2378403 - DNA, 16 bp, Homo sapiens
ctgtagataattaacc

SEQ ID NO: 2378404 - DNA, 21 bp, Homo sapiens
ctgtatagacaggagaagaaa

SEQ ID NO: 2378405 - DNA, 12 bp, Homo sapiens
ctgtattcagca

SEQ ID NO: 2378406 - DNA, 15 bp, Homo sapiens
ctgtcaaacattagt

SEQ ID NO: 2378407 - DNA, 20 bp, Homo sapiens
ctgtcaaacattagtacttt

SEQ ID NO: 2378408 - DNA, 19 bp, Homo sapiens
ctgtgtcagtttatgtttt

SEQ ID NO: 2378409 - DNA, 17 bp, Homo sapiens
ctgttacaaaatgtaac

SEQ ID NO: 2378410 - DNA, 16 bp, Homo sapiens
ctgttaccattggaaa

SEQ ID NO: 2378411 - DNA, 11 bp, Homo sapiens
cttaaaaagta

SEQ ID NO: 2378412 - DNA, 18 bp, Homo sapiens
cttaaaagaggaaaatga

SEQ ID NO: 2378413 - DNA, 18 bp, Homo sapiens
cttctaaaactgtacttt

SEQ ID NO: 2378414 - DNA, 19 bp, Homo sapiens
cttctaaaactgtactttg

SEQ ID NO: 2378415 - DNA, 21 bp, Homo sapiens
cttctaaaactgtactttgat

SEQ ID NO: 2378416 - DNA, 21 bp, Homo sapiens
cttctattttccttaatcaaa

SEQ ID NO: 2378417 - DNA, 16 bp, Homo sapiens
cttctgttttcaatct

SEQ ID NO: 2378418 - DNA, 19 bp, Homo sapiens
cttctgttttcaatctcgt

SEQ ID NO: 2378419 - DNA, 18 bp, Homo sapiens
cttgcacacatcatctgt

SEQ ID NO: 2378420 - DNA, 19 bp, Homo sapiens
cttgcacacatcatctgta

SEQ ID NO: 2378421 - DNA, 16 bp, Homo sapiens
cttgcttaaatgtgaa

SEQ ID NO: 2378422 - DNA, 22 bp, Homo sapiens
cttgcttaaatgtgaattacta

SEQ ID NO: 2378423 - DNA, 15 bp, Homo sapiens
cttgtaatgtaactg

SEQ ID NO: 2378424 - DNA, 20 bp, Homo sapiens
cttgtaatgtaactgctctt

SEQ ID NO: 2378425 - DNA, 23 bp, Homo sapiens
cttgtttttgtttttgttttgtt

SEQ ID NO: 2378426 - DNA, 23 bp, Homo sapiens
ctttgaaatatatggtctaatgt

SEQ ID NO: 2378427 - DNA, 11 bp, Homo sapiens
ctttgaatttt

SEQ ID NO: 2378428 - DNA, 18 bp, Homo sapiens
ctttgaattttcatttta

SEQ ID NO: 2378429 - DNA, 19 bp, Homo sapiens
ctttgaattttcattttac

SEQ ID NO: 2378430 - DNA, 20 bp, Homo sapiens
ctttgaattttcattttaca

SEQ ID NO: 2378431 - DNA, 15 bp, Homo sapiens
ctttgattcacatgt

SEQ ID NO: 2378432 - DNA, 20 bp, Homo sapiens
ctttgattcacatgttttca

SEQ ID NO: 2378433 - DNA, 21 bp, Homo sapiens
ctttgtctaagaaacattgga

SEQ ID NO: 2378434 - DNA, 14 bp, Homo sapiens
cttttaaaaagtat

SEQ ID NO: 2378435 - DNA, 15 bp, Homo sapiens
cttttaaaaagtatt

SEQ ID NO: 2378436 - DNA, 14 bp, Homo sapiens
cttttttatatctt

SEQ ID NO: 2378437 - DNA, 15 bp, Homo sapiens
cttttttttttaagt

SEQ ID NO: 2378438 - DNA, 13 bp, Homo sapiens
gaaaacagaaatt

SEQ ID NO: 2378439 - DNA, 13 bp, Homo sapiens
gaaaactttgtta

SEQ ID NO: 2378440 - DNA, 24 bp, Homo sapiens
gaaaagaaatctatagaaagtgtt

SEQ ID NO: 2378441 - DNA, 17 bp, Homo sapiens
gaaaagactaagatcgg

SEQ ID NO: 2378442 - DNA, 16 bp, Homo sapiens
gaaacactaaatgtta

SEQ ID NO: 2378443 - DNA, 23 bp, Homo sapiens
gaaacactaaatgttaaagatgt

SEQ ID NO: 2378444 - DNA, 16 bp, Homo sapiens
gaaacattgcttttaa

SEQ ID NO: 2378445 - DNA, 13 bp, Homo sapiens
gaaacattggaag

SEQ ID NO: 2378446 - DNA, 20 bp, Homo sapiens
gaaagaactatcttcatctg

SEQ ID NO: 2378447 - DNA, 15 bp, Homo sapiens
gaaagtgttctgtta

SEQ ID NO: 2378448 - DNA, 18 bp, Homo sapiens
gaaagtgttctgttacaa

SEQ ID NO: 2378449 - DNA, 21 bp, Homo sapiens
gaaagtgttctgttacaaaat

SEQ ID NO: 2378450 - DNA, 18 bp, Homo sapiens
gaaatgctatgtcatttc

SEQ ID NO: 2378451 - DNA, 19 bp, Homo sapiens
gaaatgctatgtcatttca

SEQ ID NO: 2378452 - DNA, 20 bp, Homo sapiens
gaaatgctatgtcatttcat

SEQ ID NO: 2378453 - DNA, 16 bp, Homo sapiens
gaaatgtgtgtgatgt

SEQ ID NO: 2378454 - DNA, 20 bp, Homo sapiens
gaaatgtgtgtgatgtgaca

SEQ ID NO: 2378455 - DNA, 21 bp, Homo sapiens
gaaatgtgtgtgatgtgacat

SEQ ID NO: 2378456 - DNA, 16 bp, Homo sapiens
gaaattggtaccttgc

SEQ ID NO: 2378457 - DNA, 21 bp, Homo sapiens
gaaattggtaccttgcacaca

SEQ ID NO: 2378458 - DNA, 14 bp, Homo sapiens
gaaatttaatacat

SEQ ID NO: 2378459 - DNA, 19 bp, Homo sapiens
gaaatttaatacatttata

SEQ ID NO: 2378460 - DNA, 22 bp, Homo sapiens
gaaatttattgaggaaaaatat

SEQ ID NO: 2378461 - DNA, 20 bp, Homo sapiens
gaaatttcacgtcataggaa

SEQ ID NO: 2378462 - DNA, 15 bp, Homo sapiens
gaaatttttcatatt

SEQ ID NO: 2378463 - DNA, 19 bp, Homo sapiens
gaaatttttcatattttaa

SEQ ID NO: 2378464 - DNA, 16 bp, Homo sapiens
gaactatcttcatctg

SEQ ID NO: 2378465 - DNA, 14 bp, Homo sapiens
gaacttgtttaata

SEQ ID NO: 2378466 - DNA, 20 bp, Homo sapiens
gaagaatgcatgctttccat

SEQ ID NO: 2378467 - DNA, 14 bp, Homo sapiens
gaagatgttctgta

SEQ ID NO: 2378468 - DNA, 17 bp, Homo sapiens
gaagcaggttaaatgtt

SEQ ID NO: 2378469 - DNA, 18 bp, Homo sapiens
gaagcaggttaaatgttt

SEQ ID NO: 2378470 - DNA, 14 bp, Homo sapiens
gaagctttttaaaa

SEQ ID NO: 2378471 - DNA, 16 bp, Homo sapiens
gaaggaccttcactct

SEQ ID NO: 2378472 - DNA, 24 bp, Homo sapiens
gaaggaccttcactctaagatgtt

SEQ ID NO: 2378473 - DNA, 17 bp, Homo sapiens
gaagtcttcatgaaatg

SEQ ID NO: 2378474 - DNA, 18 bp, Homo sapiens
gaagtcttcatgaaatgc

SEQ ID NO: 2378475 - DNA, 21 bp, Homo sapiens
gaagttatatttcctatacca

SEQ ID NO: 2378476 - DNA, 18 bp, Homo sapiens
gaataggacttgtttttg

SEQ ID NO: 2378477 - DNA, 18 bp, Homo sapiens
gaatgaccttgtaatgta

SEQ ID NO: 2378478 - DNA, 21 bp, Homo sapiens
gaatgaccttgtaatgtaact

SEQ ID NO: 2378479 - DNA, 22 bp, Homo sapiens
gaatgtatagtatttgaaaaca

SEQ ID NO: 2378480 - DNA, 23 bp, Homo sapiens
gaattacaattactccttttatt

SEQ ID NO: 2378481 - DNA, 14 bp, Homo sapiens
gaattactaacttc

SEQ ID NO: 2378482 - DNA, 16 bp, Homo sapiens
gaattactaacttcta

SEQ ID NO: 2378483 - DNA, 12 bp, Homo sapiens
gaattttcattt

SEQ ID NO: 2378484 - DNA, 14 bp, Homo sapiens
gacaaatagtaggc

SEQ ID NO: 2378485 - DNA, 15 bp, Homo sapiens
gacaaatagtaggca

SEQ ID NO: 2378486 - DNA, 15 bp, Homo sapiens
gacatttgtcatttt

SEQ ID NO: 2378487 - DNA, 16 bp, Homo sapiens
gacatttgtcattttc

SEQ ID NO: 2378488 - DNA, 20 bp, Homo sapiens
gacatttgtcattttcatta

SEQ ID NO: 2378489 - DNA, 11 bp, Homo sapiens
gaccattttcc

SEQ ID NO: 2378490 - DNA, 14 bp, Homo sapiens
gaccctgaaatgtg

SEQ ID NO: 2378491 - DNA, 15 bp, Homo sapiens
gaccttgtaatgtaa

SEQ ID NO: 2378492 - DNA, 16 bp, Homo sapiens
gaccttgtaatgtaac

SEQ ID NO: 2378493 - DNA, 20 bp, Homo sapiens
gaccttgtaatgtaactgct

SEQ ID NO: 2378494 - DNA, 14 bp, Homo sapiens
gacttctgttttca

SEQ ID NO: 2378495 - DNA, 18 bp, Homo sapiens
gagagatgtgtaattttt

SEQ ID NO: 2378496 - DNA, 22 bp, Homo sapiens
gagataggaaggtcatttccat

SEQ ID NO: 2378497 - DNA, 17 bp, Homo sapiens
gaggaaaaatatgtgaa

SEQ ID NO: 2378498 - DNA, 14 bp, Homo sapiens
gaggctaaaatgtt

SEQ ID NO: 2378499 - DNA, 18 bp, Homo sapiens
gaggctaaaatgttttca

SEQ ID NO: 2378500 - DNA, 13 bp, Homo sapiens
gataagttggaaa

SEQ ID NO: 2378501 - DNA, 17 bp, Homo sapiens
gataagttggaaacact

SEQ ID NO: 2378502 - DNA, 18 bp, Homo sapiens
gataagttggaaacacta

SEQ ID NO: 2378503 - DNA, 17 bp, Homo sapiens
gataggaaggtcatttc

SEQ ID NO: 2378504 - DNA, 21 bp, Homo sapiens
gataggaaggtcatttccatg

SEQ ID NO: 2378505 - DNA, 23 bp, Homo sapiens
gataggaaggtcatttccatgta

SEQ ID NO: 2378506 - DNA, 16 bp, Homo sapiens
gatatgcctgctcttt

SEQ ID NO: 2378507 - DNA, 18 bp, Homo sapiens
gatatgcctgctctttgg

SEQ ID NO: 2378508 - DNA, 21 bp, Homo sapiens
gatattctttgttaatttgga

SEQ ID NO: 2378509 - DNA, 18 bp, Homo sapiens
gatcttcctctgctaaat

SEQ ID NO: 2378510 - DNA, 16 bp, Homo sapiens
gatgtattttgtgagt

SEQ ID NO: 2378511 - DNA, 21 bp, Homo sapiens
gatgtattttgtgagtttgtt

SEQ ID NO: 2378512 - DNA, 13 bp, Homo sapiens
gatgtgtaatttt

SEQ ID NO: 2378513 - DNA, 17 bp, Homo sapiens
gatgtgtaatttttctg

SEQ ID NO: 2378514 - DNA, 16 bp, Homo sapiens
gattcacatgttttca

SEQ ID NO: 2378515 - DNA, 19 bp, Homo sapiens
gattcacatgttttcaaat

SEQ ID NO: 2378516 - DNA, 20 bp, Homo sapiens
gattcacatgttttcaaatg

SEQ ID NO: 2378517 - DNA, 17 bp, Homo sapiens
aatattaaaaagtcttt

SEQ ID NO: 2378518 - DNA, 17 bp, Homo sapiens
aatattatatttggatg

SEQ ID NO: 2378519 - DNA, 19 bp, Homo sapiens
aatattccttatttaagac

SEQ ID NO: 2378520 - DNA, 15 bp, Homo sapiens
aatattctctgtaca

SEQ ID NO: 2378521 - DNA, 18 bp, Homo sapiens
aatattctctgtacatat

SEQ ID NO: 2378522 - DNA, 17 bp, Homo sapiens
aatatttgtgtgctaaa

SEQ ID NO: 2378523 - DNA, 21 bp, Homo sapiens
aatatttgtgtgctaaacgtg

SEQ ID NO: 2378524 - DNA, 24 bp, Homo sapiens
aatcagtttctgaaatgtaagcat

SEQ ID NO: 2378525 - DNA, 19 bp, Homo sapiens
aatccttacaaatgattgc

SEQ ID NO: 2378526 - DNA, 20 bp, Homo sapiens
aatctcgtatagaagtcttc

SEQ ID NO: 2378527 - DNA, 14 bp, Homo sapiens
aatctgaagattgt

SEQ ID NO: 2378528 - DNA, 21 bp, Homo sapiens
aatctgaagattgtttatcta

SEQ ID NO: 2378529 - DNA, 14 bp, Homo sapiens
aatcttattaaagt

SEQ ID NO: 2378530 - DNA, 18 bp, Homo sapiens
aatcttattaaagtttca

SEQ ID NO: 2378531 - DNA, 21 bp, Homo sapiens
aatcttattaaagtttcaaaa

SEQ ID NO: 2378532 - DNA, 14 bp, Homo sapiens
aatgaacacaaatt

SEQ ID NO: 2378533 - DNA, 20 bp, Homo sapiens
aatgaacacaaattatgcta

SEQ ID NO: 2378534 - DNA, 13 bp, Homo sapiens
aatgaattcatgg

SEQ ID NO: 2378535 - DNA, 16 bp, Homo sapiens
aatgattgcttttaaa

SEQ ID NO: 2378536 - DNA, 20 bp, Homo sapiens
aatgcatgctttccatattt

SEQ ID NO: 2378537 - DNA, 15 bp, Homo sapiens
aatgctatgtcattt

SEQ ID NO: 2378538 - DNA, 19 bp, Homo sapiens
aatggagttggagttcatt

SEQ ID NO: 2378539 - DNA, 16 bp, Homo sapiens
aatgtaactgctcttg

SEQ ID NO: 2378540 - DNA, 20 bp, Homo sapiens
aatgtaactgttaccattgg

SEQ ID NO: 2378541 - DNA, 22 bp, Homo sapiens
aatgtaactgttaccattggaa

SEQ ID NO: 2378542 - DNA, 17 bp, Homo sapiens
aatgtgaattactaact

SEQ ID NO: 2378543 - DNA, 21 bp, Homo sapiens
aatgtgtgtgatgtgacattt

SEQ ID NO: 2378544 - DNA, 21 bp, Homo sapiens
aatgttaaagatgtagcaaac

SEQ ID NO: 2378545 - DNA, 12 bp, Homo sapiens
aatgttgatttc

SEQ ID NO: 2378546 - DNA, 16 bp, Homo sapiens
aatgttgatttctagt

SEQ ID NO: 2378547 - DNA, 18 bp, Homo sapiens
aatgttgatttctagtta

SEQ ID NO: 2378548 - DNA, 23 bp, Homo sapiens
aatgttgatttctagttatttat

SEQ ID NO: 2378549 - DNA, 13 bp, Homo sapiens
tattaaagtttca

SEQ ID NO: 2378550 - DNA, 18 bp, Homo sapiens
tattaaagtttcaaaaat

SEQ ID NO: 2378551 - DNA, 13 bp, Homo sapiens
tattaatacagat

SEQ ID NO: 2378552 - DNA, 16 bp, Homo sapiens
tattactagttagcat

SEQ ID NO: 2378553 - DNA, 20 bp, Homo sapiens
tattagcgacaacagattgg

SEQ ID NO: 2378554 - DNA, 21 bp, Homo sapiens
tattagcgacaacagattgga

SEQ ID NO: 2378555 - DNA, 14 bp, Homo sapiens
tattatatttggat

SEQ ID NO: 2378556 - DNA, 15 bp, Homo sapiens
tattatatttggatg

SEQ ID NO: 2378557 - DNA, 16 bp, Homo sapiens
tattatatttggatgc

SEQ ID NO: 2378558 - DNA, 23 bp, Homo sapiens
tattccatattagaaaactttgt

SEQ ID NO: 2378559 - DNA, 14 bp, Homo sapiens
tattctctgtacat

SEQ ID NO: 2378560 - DNA, 21 bp, Homo sapiens
tattctgggaatgtatagtat

SEQ ID NO: 2378561 - DNA, 15 bp, Homo sapiens
tattctttgttaatt

SEQ ID NO: 2378562 - DNA, 22 bp, Homo sapiens
tattgagagagatgtgtaattt

SEQ ID NO: 2378563 - DNA, 22 bp, Homo sapiens
tattgaggaaaaatatgtgaag

SEQ ID NO: 2378564 - DNA, 15 bp, Homo sapiens
tattgccaaacatta

SEQ ID NO: 2378565 - DNA, 18 bp, Homo sapiens
tattgccaaacattaatg

SEQ ID NO: 2378566 - DNA, 18 bp, Homo sapiens
tattgtgcctatattaaa

SEQ ID NO: 2378567 - DNA, 18 bp, Homo sapiens
tatttattttaatgtatt

SEQ ID NO: 2378568 - DNA, 17 bp, Homo sapiens
tatttcctataccattt

SEQ ID NO: 2378569 - DNA, 18 bp, Homo sapiens
tatttgaaaacagaaatt

SEQ ID NO: 2378570 - DNA, 18 bp, Homo sapiens
tatttgtgtgctaaacgt

SEQ ID NO: 2378571 - DNA, 13 bp, Homo sapiens
tattttaatttca

SEQ ID NO: 2378572 - DNA, 15 bp, Homo sapiens
tattttaatttcaag

SEQ ID NO: 2378573 - DNA, 12 bp, Homo sapiens
tatttttttcct

SEQ ID NO: 2378574 - DNA, 19 bp, Homo sapiens
tatttttttccttacataa

SEQ ID NO: 2378575 - DNA, 13 bp, Homo sapiens
tcaaaaatctgaa

SEQ ID NO: 2378576 - DNA, 16 bp, Homo sapiens
tcaaaaatctgaagat

SEQ ID NO: 2378577 - DNA, 16 bp, Homo sapiens
tcaaacattagtactt

SEQ ID NO: 2378578 - DNA, 17 bp, Homo sapiens
tcaaactttctgccttc

SEQ ID NO: 2378579 - DNA, 16 bp, Homo sapiens
tcaaagtcatgatgtt

SEQ ID NO: 2378580 - DNA, 21 bp, Homo sapiens
tcaaagtcatgatgtttttaa

SEQ ID NO: 2378581 - DNA, 15 bp, Homo sapiens
tcaaattaatacaat

SEQ ID NO: 2378582 - DNA, 13 bp, Homo sapiens
tcaaccaaatggt

SEQ ID NO: 2378583 - DNA, 17 bp, Homo sapiens
tcaaccaaatggtacaa

SEQ ID NO: 2378584 - DNA, 14 bp, Homo sapiens
tcaagaacttgttt

SEQ ID NO: 2378585 - DNA, 15 bp, Homo sapiens
tcaagaacttgttta

SEQ ID NO: 2378586 - DNA, 20 bp, Homo sapiens
tcaatctcgtatagaagtct

SEQ ID NO: 2378587 - DNA, 22 bp, Homo sapiens
tcaatctcgtatagaagtcttc

SEQ ID NO: 2378588 - DNA, 16 bp, Homo sapiens
tcacgtcataggaagt

SEQ ID NO: 2378589 - DNA, 16 bp, Homo sapiens
tcactctaagatgtta

SEQ ID NO: 2378590 - DNA, 14 bp, Homo sapiens
tcagatttgcacaa

SEQ ID NO: 2378591 - DNA, 19 bp, Homo sapiens
tcagatttgcacaaaaaga

SEQ ID NO: 2378592 - DNA, 24 bp, Homo sapiens
tcagcaaggcgctaacttgcttaa

SEQ ID NO: 2378593 - DNA, 20 bp, Homo sapiens
tcagggaagataagttggaa

SEQ ID NO: 2378594 - DNA, 16 bp, Homo sapiens
tcagttcaaagtcatg

SEQ ID NO: 2378595 - DNA, 22 bp, Homo sapiens
tcagttcaaagtcatgatgttt

SEQ ID NO: 2378596 - DNA, 14 bp, Homo sapiens
tcagtttatgtttt

SEQ ID NO: 2378597 - DNA, 16 bp, Homo sapiens
tcagtttatgttttgg

SEQ ID NO: 2378598 - DNA, 15 bp, Homo sapiens
tcagtttttcttaat

SEQ ID NO: 2378599 - DNA, 13 bp, Homo sapiens
tcatattagactt

SEQ ID NO: 2378600 - DNA, 20 bp, Homo sapiens
tcatgaaatgctatgtcatt

SEQ ID NO: 2378601 - DNA, 19 bp, Homo sapiens
tcatgatgtttttaaaatc

SEQ ID NO: 2378602 - DNA, 16 bp, Homo sapiens
tcatgtcctgtgtcag

SEQ ID NO: 2378603 - DNA, 18 bp, Homo sapiens
tcatgtcctgtgtcagtt

SEQ ID NO: 2378604 - DNA, 20 bp, Homo sapiens
tcatgtcctgtgtcagttta

SEQ ID NO: 2378605 - DNA, 20 bp, Homo sapiens
tcattcatattacaatattt

SEQ ID NO: 2378606 - DNA, 22 bp, Homo sapiens
tcattcatattacaatatttgt

SEQ ID NO: 2378607 - DNA, 17 bp, Homo sapiens
tcattttcattagcaaa

SEQ ID NO: 2378608 - DNA, 13 bp, Homo sapiens
tcattttctcttt

SEQ ID NO: 2378609 - DNA, 14 bp, Homo sapiens
tccatattattgtg

SEQ ID NO: 2378610 - DNA, 13 bp, Homo sapiens
tcctataccattt

SEQ ID NO: 2378611 - DNA, 18 bp, Homo sapiens
tcctggactactttcatt

SEQ ID NO: 2378612 - DNA, 14 bp, Homo sapiens
tcctgtgtcagttt

SEQ ID NO: 2378613 - DNA, 15 bp, Homo sapiens
tccttacaaatgatt

SEQ ID NO: 2378614 - DNA, 15 bp, Homo sapiens
tccttacataaacat

SEQ ID NO: 2378615 - DNA, 20 bp, Homo sapiens
tcgaaagttagtaggatatg

SEQ ID NO: 2378616 - DNA, 15 bp, Homo sapiens
tcggttaacaaataa

SEQ ID NO: 2378617 - DNA, 22 bp, Homo sapiens
tcgtatagaagtcttcatgaaa

SEQ ID NO: 2378618 - DNA, 15 bp, Homo sapiens
tctaaaactgtactt

SEQ ID NO: 2378619 - DNA, 22 bp, Homo sapiens
tctaaaactgtactttgattca

SEQ ID NO: 2378620 - DNA, 17 bp, Homo sapiens
tctaagaaacattggaa

SEQ ID NO: 2378621 - DNA, 16 bp, Homo sapiens
tctaagatgttatatt

SEQ ID NO: 2378622 - DNA, 22 bp, Homo sapiens
tctaagatgttatatttttctt

SEQ ID NO: 2378623 - DNA, 23 bp, Homo sapiens
tctaagatgttatatttttctta

SEQ ID NO: 2378624 - DNA, 21 bp, Homo sapiens
tctatagaaagtgttctgtta

SEQ ID NO: 2378625 - DNA, 22 bp, Homo sapiens
tctatagaaagtgttctgttac

SEQ ID NO: 2378626 - DNA, 23 bp, Homo sapiens
tctatagaaagtgttctgttaca

SEQ ID NO: 2378627 - DNA, 13 bp, Homo sapiens
tctcagtttttct

SEQ ID NO: 2378628 - DNA, 21 bp, Homo sapiens
tctcagtttttcttaatatat

SEQ ID NO: 2378629 - DNA, 18 bp, Homo sapiens
tctgaagattgtttatct

SEQ ID NO: 2378630 - DNA, 22 bp, Homo sapiens
tctgagagaggctaaaatgttt

SEQ ID NO: 2378631 - DNA, 23 bp, Homo sapiens
tctgagagaggctaaaatgtttt

SEQ ID NO: 2378632 - DNA, 15 bp, Homo sapiens
tctgatgtattttgt

SEQ ID NO: 2378633 - DNA, 19 bp, Homo sapiens
tctgctaaattgatgttga

SEQ ID NO: 2378634 - DNA, 14 bp, Homo sapiens
tctgggaatgtata

SEQ ID NO: 2378635 - DNA, 17 bp, Homo sapiens
tctgggaatgtatagta

SEQ ID NO: 2378636 - DNA, 23 bp, Homo sapiens
tctgtacagagccgtaaaaactg

SEQ ID NO: 2378637 - DNA, 20 bp, Homo sapiens
tctgtgccttttttatatct

SEQ ID NO: 2378638 - DNA, 14 bp, Homo sapiens
tctgttacaaaatg

SEQ ID NO: 2378639 - DNA, 16 bp, Homo sapiens
tctgttacaaaatgta

SEQ ID NO: 2378640 - DNA, 17 bp, Homo sapiens
tctgttacaaaatgtaa

SEQ ID NO: 2378641 - DNA, 19 bp, Homo sapiens
tctgttacaaaatgtaact

SEQ ID NO: 2378642 - DNA, 20 bp, Homo sapiens
tctgttacaaaatgtaactg

SEQ ID NO: 2378643 - DNA, 22 bp, Homo sapiens
tctgttttcaatctcgtataga

SEQ ID NO: 2378644 - DNA, 13 bp, Homo sapiens
tcttaaaaagtaa

SEQ ID NO: 2378645 - DNA, 14 bp, Homo sapiens
tcttattaaagttt

SEQ ID NO: 2378646 - DNA, 14 bp, Homo sapiens
tcttattccatatt

SEQ ID NO: 2378647 - DNA, 16 bp, Homo sapiens
tcttcatgaaatgcta

SEQ ID NO: 2378648 - DNA, 21 bp, Homo sapiens
tcttgggcaatattctctgta

SEQ ID NO: 2378649 - DNA, 15 bp, Homo sapiens
tctttgaattttcat

SEQ ID NO: 2378650 - DNA, 13 bp, Homo sapiens
tcttttaaaaagt

SEQ ID NO: 2378651 - DNA, 18 bp, Homo sapiens
tcttttgttttttgaagt

SEQ ID NO: 2378652 - DNA, 14 bp, Homo sapiens
tgaaaacagaaatt

SEQ ID NO: 2378653 - DNA, 17 bp, Homo sapiens
tgaaaacagaaattggt

SEQ ID NO: 2378654 - DNA, 19 bp, Homo sapiens
tgaaacattgcttttaaaa

SEQ ID NO: 2378655 - DNA, 23 bp, Homo sapiens
tgaaatactttactttttctcat

SEQ ID NO: 2378656 - DNA, 22 bp, Homo sapiens
tgaaatatatggtctaatgttt

SEQ ID NO: 2378657 - DNA, 13 bp, Homo sapiens
tgaaatgaacaca

SEQ ID NO: 2378658 - DNA, 18 bp, Homo sapiens
tgaaatgctatgtcattt

SEQ ID NO: 2378659 - DNA, 14 bp, Homo sapiens
tgaaatgtgtgtga

SEQ ID NO: 2378660 - DNA, 19 bp, Homo sapiens
tgaaatgtgtgtgatgtga

SEQ ID NO: 2378661 - DNA, 21 bp, Homo sapiens
tgaaatgtgtgtgatgtgaca

SEQ ID NO: 2378662 - DNA, 20 bp, Homo sapiens
tttcagattccaagtgtatt

SEQ ID NO: 2378663 - DNA, 22 bp, Homo sapiens
tttcatattttaatttcaagct

SEQ ID NO: 2378664 - DNA, 22 bp, Homo sapiens
tttcatgtcctgtgtcagttta

SEQ ID NO: 2378665 - DNA, 13 bp, Homo sapiens
tttcattagcaaa

SEQ ID NO: 2378666 - DNA, 12 bp, Homo sapiens
tttccagtattt

SEQ ID NO: 2378667 - DNA, 16 bp, Homo sapiens
tttccagtattttagt

SEQ ID NO: 2378668 - DNA, 19 bp, Homo sapiens
acatcatctgtaagctgtt

SEQ ID NO: 2378669 - DNA, 20 bp, Homo sapiens
acatcatctgtaagctgttt

SEQ ID NO: 2378670 - DNA, 12 bp, Homo sapiens
acatgatttcac

SEQ ID NO: 2378671 - DNA, 15 bp, Homo sapiens
acatgatttcacaaa

SEQ ID NO: 2378672 - DNA, 22 bp, Homo sapiens
acatgatttcacaaatattaaa

SEQ ID NO: 2378673 - DNA, 17 bp, Homo sapiens
acatgtttaaattcacc

SEQ ID NO: 2378674 - DNA, 15 bp, Homo sapiens
acatgttttcaaatg

SEQ ID NO: 2378675 - DNA, 13 bp, Homo sapiens
acattaatgttga

SEQ ID NO: 2378676 - DNA, 17 bp, Homo sapiens
acattaatgttgatttc

SEQ ID NO: 2378677 - DNA, 22 bp, Homo sapiens
acattaatgttgatttctagtt

SEQ ID NO: 2378678 - DNA, 15 bp, Homo sapiens
acattgcttttaaaa

SEQ ID NO: 2378679 - DNA, 23 bp, Homo sapiens
acatttgtttggttatagtgcaa

SEQ ID NO: 2378680 - DNA, 15 bp, Homo sapiens
accaactgtcactgt

SEQ ID NO: 2378681 - DNA, 14 bp, Homo sapiens
accaactttcaaga

SEQ ID NO: 2378682 - DNA, 15 bp, Homo sapiens
accaattttaactta

SEQ ID NO: 2378683 - DNA, 17 bp, Homo sapiens
accagtacattctcagt

SEQ ID NO: 2378684 - DNA, 20 bp, Homo sapiens
accattaaaatatgcactaa

SEQ ID NO: 2378685 - DNA, 14 bp, Homo sapiens
accattggaaattt

SEQ ID NO: 2378686 - DNA, 15 bp, Homo sapiens
accattttcctgcat

SEQ ID NO: 2378687 - DNA, 14 bp, Homo sapiens
accctactcctcca

SEQ ID NO: 2378688 - DNA, 12 bp, Homo sapiens
accctgaaatgt

SEQ ID NO: 2378689 - DNA, 13 bp, Homo sapiens
accctgaaatgtg

SEQ ID NO: 2378690 - DNA, 17 bp, Homo sapiens
accttaaaatttgaaac

SEQ ID NO: 2378691 - DNA, 19 bp, Homo sapiens
accttcactctaagatgtt

SEQ ID NO: 2378692 - DNA, 22 bp, Homo sapiens
accttcactctaagatgttata

SEQ ID NO: 2378693 - DNA, 22 bp, Homo sapiens
accttgcacacatcatctgtaa

SEQ ID NO: 2378694 - DNA, 22 bp, Homo sapiens
accttgtaatgtaactgctctt

SEQ ID NO: 2378695 - DNA, 22 bp, Homo sapiens
acgtcataggaagttagccttt

SEQ ID NO: 2378696 - DNA, 11 bp, Homo sapiens
acgtgtatgtt

SEQ ID NO: 2378697 - DNA, 16 bp, Homo sapiens
acgtgtatgtttttca

SEQ ID NO: 2378698 - DNA, 23 bp, Homo sapiens
acgtgtatgtttttcagttcaaa

SEQ ID NO: 2378699 - DNA, 14 bp, Homo sapiens
actaaatttgtaaa

SEQ ID NO: 2378700 - DNA, 17 bp, Homo sapiens
actaacttctaaaactg

SEQ ID NO: 2378701 - DNA, 18 bp, Homo sapiens
actaacttctaaaactgt

SEQ ID NO: 2378702 - DNA, 17 bp, Homo sapiens
actaagatcggttaaca

SEQ ID NO: 2378703 - DNA, 15 bp, Homo sapiens
actaagtctcttttt

SEQ ID NO: 2378704 - DNA, 19 bp, Homo sapiens
actaagtctcttttttaca

SEQ ID NO: 2378705 - DNA, 22 bp, Homo sapiens
actaagtctcttttttacaaag

SEQ ID NO: 2378706 - DNA, 23 bp, Homo sapiens
actaagtctcttttttacaaagg

SEQ ID NO: 2378707 - DNA, 21 bp, Homo sapiens
actaattcaattcatgtaaca

SEQ ID NO: 2378708 - DNA, 21 bp, Homo sapiens
actcaaccaaatggtacaaaa

SEQ ID NO: 2378709 - DNA, 18 bp, Homo sapiens
actgaagtttgataaata

SEQ ID NO: 2378710 - DNA, 19 bp, Homo sapiens
actgaagtttgataaatag

SEQ ID NO: 2378711 - DNA, 21 bp, Homo sapiens
actgaagtttgataaatagtg

SEQ ID NO: 2378712 - DNA, 19 bp, Homo sapiens
actgcacatgatttcacaa

SEQ ID NO: 2378713 - DNA, 22 bp, Homo sapiens
actgcacatgatttcacaaata

SEQ ID NO: 2378714 - DNA, 23 bp, Homo sapiens
actgcacatgatttcacaaatat

SEQ ID NO: 2378715 - DNA, 13 bp, Homo sapiens
actgtactttgat

SEQ ID NO: 2378716 - DNA, 16 bp, Homo sapiens
actgtactttgattca

SEQ ID NO: 2378717 - DNA, 17 bp, Homo sapiens
actgttaccattggaaa

SEQ ID NO: 2378718 - DNA, 18 bp, Homo sapiens
actgttaccattggaaat

SEQ ID NO: 2378719 - DNA, 19 bp, Homo sapiens
actgttaccattggaaatt

SEQ ID NO: 2378720 - DNA, 21 bp, Homo sapiens
actgttaccattggaaatttc

SEQ ID NO: 2378721 - DNA, 19 bp, Homo sapiens
acttcagggcagattttag

SEQ ID NO: 2378722 - DNA, 19 bp, Homo sapiens
acttctaaaactgtacttt

SEQ ID NO: 2378723 - DNA, 14 bp, Homo sapiens
acttctgttttcaa

SEQ ID NO: 2378724 - DNA, 17 bp, Homo sapiens
actttatagaagaatgc

SEQ ID NO: 2378725 - DNA, 19 bp, Homo sapiens
actttcaagaacttgttta

SEQ ID NO: 2378726 - DNA, 18 bp, Homo sapiens
actttgattcacatgttt

SEQ ID NO: 2378727 - DNA, 23 bp, Homo sapiens
actttgattcacatgttttcaaa

SEQ ID NO: 2378728 - DNA, 19 bp, Homo sapiens
actttgtctaagaaacatt

SEQ ID NO: 2378729 - DNA, 14 bp, Homo sapiens
agaaaactttgtta

SEQ ID NO: 2378730 - DNA, 13 bp, Homo sapiens
agaaacattggaa

SEQ ID NO: 2378731 - DNA, 14 bp, Homo sapiens
agaaagaactatct

SEQ ID NO: 2378732 - DNA, 16 bp, Homo sapiens
agaaagtgttctgtta

SEQ ID NO: 2378733 - DNA, 20 bp, Homo sapiens
agaaatctatagaaagtgtt

SEQ ID NO: 2378734 - DNA, 16 bp, Homo sapiens
agaaattggtaccttg

SEQ ID NO: 2378735 - DNA, 18 bp, Homo sapiens
agaaattggtaccttgca

SEQ ID NO: 2378736 - DNA, 21 bp, Homo sapiens
agaaattggtaccttgcacac

SEQ ID NO: 2378737 - DNA, 13 bp, Homo sapiens
agaactatcttca

SEQ ID NO: 2378738 - DNA, 13 bp, Homo sapiens
agaagaaagaact

SEQ ID NO: 2378739 - DNA, 15 bp, Homo sapiens
agaagaaagaactat

SEQ ID NO: 2378740 - DNA, 22 bp, Homo sapiens
agaagaatgcatgctttccata

SEQ ID NO: 2378741 - DNA, 18 bp, Homo sapiens
agaagtcttcatgaaatg

SEQ ID NO: 2378742 - DNA, 16 bp, Homo sapiens
agaataggacttgttt

SEQ ID NO: 2378743 - DNA, 12 bp, Homo sapiens
agaatgaccttg

SEQ ID NO: 2378744 - DNA, 17 bp, Homo sapiens
agaatgaccttgtaatg

SEQ ID NO: 2378745 - DNA, 21 bp, Homo sapiens
agaatgaccttgtaatgtaac

SEQ ID NO: 2378746 - DNA, 22 bp, Homo sapiens
agaatgaccttgtaatgtaact

SEQ ID NO: 2378747 - DNA, 23 bp, Homo sapiens
agaatgcatgctttccatatttt

SEQ ID NO: 2378748 - DNA, 14 bp, Homo sapiens
agaattttttattt

SEQ ID NO: 2378749 - DNA, 21 bp, Homo sapiens
agaattttttctttgtattta

SEQ ID NO: 2378750 - DNA, 12 bp, Homo sapiens
agacaaatagta

SEQ ID NO: 2378751 - DNA, 15 bp, Homo sapiens
agactgtgtctgtat

SEQ ID NO: 2378752 - DNA, 20 bp, Homo sapiens
agagataggaaggtcatttc

SEQ ID NO: 2378753 - DNA, 13 bp, Homo sapiens
agagatgtgtaat

SEQ ID NO: 2378754 - DNA, 19 bp, Homo sapiens
agagatgtgtaatttttct

SEQ ID NO: 2378755 - DNA, 19 bp, Homo sapiens
agagccgtaaaaactgaag

SEQ ID NO: 2378756 - DNA, 15 bp, Homo sapiens
agaggctaaaatgtt

SEQ ID NO: 2378757 - DNA, 20 bp, Homo sapiens
agataagttggaaacactaa

SEQ ID NO: 2378758 - DNA, 22 bp, Homo sapiens
agataagttggaaacactaaat

SEQ ID NO: 2378759 - DNA, 15 bp, Homo sapiens
agatcggttaacaaa

SEQ ID NO: 2378760 - DNA, 17 bp, Homo sapiens
agatcggttaacaaata

SEQ ID NO: 2378761 - DNA, 17 bp, Homo sapiens
agatgaagattcatgtt

SEQ ID NO: 2378762 - DNA, 21 bp, Homo sapiens
agatgtagcaaaccctgtcaa

SEQ ID NO: 2378763 - DNA, 17 bp, Homo sapiens
agatgtgtaatttttct

SEQ ID NO: 2378764 - DNA, 19 bp, Homo sapiens
agatgttatatttttctta

SEQ ID NO: 2378765 - DNA, 18 bp, Homo sapiens
agattgtttatctagatg

SEQ ID NO: 2378766 - DNA, 19 bp, Homo sapiens
agattgtttatctagatgt

SEQ ID NO: 2378767 - DNA, 15 bp, Homo sapiens
agattttagttttat

SEQ ID NO: 2378768 - DNA, 18 bp, Homo sapiens
agcaaaaaaagttgtatg

SEQ ID NO: 2378769 - DNA, 17 bp, Homo sapiens
agcaaaccctgtcaaac

SEQ ID NO: 2378770 - DNA, 15 bp, Homo sapiens
agcaacaattttcag

SEQ ID NO: 2378771 - DNA, 17 bp, Homo sapiens
agcaacaattttcagat

SEQ ID NO: 2378772 - DNA, 19 bp, Homo sapiens
agcacttcagggcagattt

SEQ ID NO: 2378773 - DNA, 17 bp, Homo sapiens
agcagaattggaaaaga

SEQ ID NO: 2378774 - DNA, 19 bp, Homo sapiens
agcagaattggaaaagact

SEQ ID NO: 2378775 - DNA, 14 bp, Homo sapiens
agcaggttaaatgt

SEQ ID NO: 2378776 - DNA, 15 bp, Homo sapiens
agcaggttaaatgtt

SEQ ID NO: 2378777 - DNA, 18 bp, Homo sapiens
agcaggttaaatgttttg

SEQ ID NO: 2378778 - DNA, 20 bp, Homo sapiens
agcaggttaaatgttttgta

SEQ ID NO: 2378779 - DNA, 21 bp, Homo sapiens
agcagtgatattctttgttaa

SEQ ID NO: 2378780 - DNA, 23 bp, Homo sapiens
agcagtgatattctttgttaatt

SEQ ID NO: 2378781 - DNA, 18 bp, Homo sapiens
caagttttgtgaaatttt

SEQ ID NO: 2378782 - DNA, 19 bp, Homo sapiens
caagttttgtgaaattttt

SEQ ID NO: 2378783 - DNA, 13 bp, Homo sapiens
caataaagtttga

SEQ ID NO: 2378784 - DNA, 20 bp, Homo sapiens
caataaagtttgatcttcct

SEQ ID NO: 2378785 - DNA, 21 bp, Homo sapiens
caataaagtttgatcttcctc

SEQ ID NO: 2378786 - DNA, 23 bp, Homo sapiens
caataaagtttgatcttcctctg

SEQ ID NO: 2378787 - DNA, 13 bp, Homo sapiens
caatatattttgt

SEQ ID NO: 2378788 - DNA, 14 bp, Homo sapiens
caatatattttgta

SEQ ID NO: 2378789 - DNA, 12 bp, Homo sapiens
caatattctctg

SEQ ID NO: 2378790 - DNA, 17 bp, Homo sapiens
caatattctctgtacat

SEQ ID NO: 2378791 - DNA, 18 bp, Homo sapiens
caatattctctgtacata

SEQ ID NO: 2378792 - DNA, 11 bp, Homo sapiens
caatccttaca

SEQ ID NO: 2378793 - DNA, 17 bp, Homo sapiens
caatccttacaaatgat

SEQ ID NO: 2378794 - DNA, 20 bp, Homo sapiens
caatccttacaaatgattgc

SEQ ID NO: 2378795 - DNA, 14 bp, Homo sapiens
caattttcagattt

SEQ ID NO: 2378796 - DNA, 17 bp, Homo sapiens
cacaaatattaaaaagt

SEQ ID NO: 2378797 - DNA, 20 bp, Homo sapiens
cacaaattatgctaagaatt

SEQ ID NO: 2378798 - DNA, 15 bp, Homo sapiens
cacacatcatctgta

SEQ ID NO: 2378799 - DNA, 21 bp, Homo sapiens
cacacatcatctgtaagctgt

SEQ ID NO: 2378800 - DNA, 17 bp, Homo sapiens
cacagggcatgaaatga

SEQ ID NO: 2378801 - DNA, 17 bp, Homo sapiens
cacagtgtaccattaaa

SEQ ID NO: 2378802 - DNA, 18 bp, Homo sapiens
cacagtgtaccattaaaa

SEQ ID NO: 2378803 - DNA, 22 bp, Homo sapiens
cacagtgtaccattaaaatatg

SEQ ID NO: 2378804 - DNA, 14 bp, Homo sapiens
cacatgatttcaca

SEQ ID NO: 2378805 - DNA, 16 bp, Homo sapiens
cacatgatttcacaaa

SEQ ID NO: 2378806 - DNA, 17 bp, Homo sapiens
cacatgatttcacaaat

SEQ ID NO: 2378807 - DNA, 20 bp, Homo sapiens
cacatgatttcacaaatatt

SEQ ID NO: 2378808 - DNA, 13 bp, Homo sapiens
cacatgttttcaa

SEQ ID NO: 2378809 - DNA, 14 bp, Homo sapiens
cacatgttttcaaa

SEQ ID NO: 2378810 - DNA, 18 bp, Homo sapiens
cacatgttttcaaatgga

SEQ ID NO: 2378811 - DNA, 20 bp, Homo sapiens
cactaaatgttaaagatgta

SEQ ID NO: 2378812 - DNA, 16 bp, Homo sapiens
cactaagtctcttttt

SEQ ID NO: 2378813 - DNA, 22 bp, Homo sapiens
cactaagtctcttttttacaaa

SEQ ID NO: 2378814 - DNA, 22 bp, Homo sapiens
cactgaagtttgataaatagtg

SEQ ID NO: 2378815 - DNA, 20 bp, Homo sapiens
cactgaatctgtacagagcc

SEQ ID NO: 2378816 - DNA, 19 bp, Homo sapiens
cacttcagggcagatttta

SEQ ID NO: 2378817 - DNA, 11 bp, Homo sapiens
cacttttccag

SEQ ID NO: 2378818 - DNA, 17 bp, Homo sapiens
cacttttccagtatttt

SEQ ID NO: 2378819 - DNA, 23 bp, Homo sapiens
cagaaattggtaccttgcacaca

SEQ ID NO: 2378820 - DNA, 17 bp, Homo sapiens
cagaattggaaaagact

SEQ ID NO: 2378821 - DNA, 23 bp, Homo sapiens
cagagccgtaaaaactgaagttc

SEQ ID NO: 2378822 - DNA, 23 bp, Homo sapiens
cagattggattttatgttgacat

SEQ ID NO: 2378823 - DNA, 14 bp, Homo sapiens
cagatttgcacaaa

SEQ ID NO: 2378824 - DNA, 17 bp, Homo sapiens
cagattttagttttatt

SEQ ID NO: 2378825 - DNA, 22 bp, Homo sapiens
cagattttagttttattttcta

SEQ ID NO: 2378826 - DNA, 18 bp, Homo sapiens
cagcatacataactgaag

SEQ ID NO: 2378827 - DNA, 17 bp, Homo sapiens
cagctaggaacaaatct

SEQ ID NO: 2378828 - DNA, 18 bp, Homo sapiens
cagctaggaacaaatctt

SEQ ID NO: 2378829 - DNA, 12 bp, Homo sapiens
caggagaagaaa

SEQ ID NO: 2378830 - DNA, 19 bp, Homo sapiens
cagggaagataagttggaa

SEQ ID NO: 2378831 - DNA, 22 bp, Homo sapiens
cagggcagattttagttttatt

SEQ ID NO: 2378832 - DNA, 23 bp, Homo sapiens
caggtactttgtctaagaaacat

SEQ ID NO: 2378833 - DNA, 13 bp, Homo sapiens
caggtaggaatat

SEQ ID NO: 2378834 - DNA, 15 bp, Homo sapiens
caggtaggaatatta

SEQ ID NO: 2378835 - DNA, 16 bp, Homo sapiens
caggttaaatgttttg

SEQ ID NO: 2378836 - DNA, 22 bp, Homo sapiens
caggttaggcagtataaagaat

SEQ ID NO: 2378837 - DNA, 21 bp, Homo sapiens
cagtacattctcagtttttct

SEQ ID NO: 2378838 - DNA, 22 bp, Homo sapiens
cagtgatattctttgttaattt

SEQ ID NO: 2378839 - DNA, 18 bp, Homo sapiens
cagtgtaccattaaaata

SEQ ID NO: 2378840 - DNA, 21 bp, Homo sapiens
cagtgtaccattaaaatatgc

SEQ ID NO: 2378841 - DNA, 15 bp, Homo sapiens
cagttcaaagtcatg

SEQ ID NO: 2378842 - DNA, 19 bp, Homo sapiens
cagtttatgttttggtcca

SEQ ID NO: 2378843 - DNA, 20 bp, Homo sapiens
cagtttcaataaagtttgat

SEQ ID NO: 2378844 - DNA, 13 bp, Homo sapiens
cagtttttcttaa

SEQ ID NO: 2378845 - DNA, 11 bp, Homo sapiens
cataaacatca

SEQ ID NO: 2378846 - DNA, 17 bp, Homo sapiens
cataagcaacaattttc

SEQ ID NO: 2378847 - DNA, 17 bp, Homo sapiens
cataattctgaagttat

SEQ ID NO: 2378848 - DNA, 17 bp, Homo sapiens
catacaaacaagcatat

SEQ ID NO: 2378849 - DNA, 17 bp, Homo sapiens
cataggaagttagcctt

SEQ ID NO: 2378850 - DNA, 22 bp, Homo sapiens
catattacaatatttgtgtgct

SEQ ID NO: 2378851 - DNA, 17 bp, Homo sapiens
catattagaaaactttg

SEQ ID NO: 2378852 - DNA, 20 bp, Homo sapiens
catattagaaaactttgtta

SEQ ID NO: 2378853 - DNA, 18 bp, Homo sapiens
catattagacttctgttt

SEQ ID NO: 2378854 - DNA, 21 bp, Homo sapiens
catattagacttctgttttca

SEQ ID NO: 2378855 - DNA, 22 bp, Homo sapiens
catatttttttccttacataaa

SEQ ID NO: 2378856 - DNA, 15 bp, Homo sapiens
catctgtaagctgtt

SEQ ID NO: 2378857 - DNA, 13 bp, Homo sapiens
catgaaatgaaca

SEQ ID NO: 2378858 - DNA, 19 bp, Homo sapiens
catgaaatgaacacaaatt

SEQ ID NO: 2378859 - DNA, 18 bp, Homo sapiens
catgatgtttttaaaatc

SEQ ID NO: 2378860 - DNA, 19 bp, Homo sapiens
catgatgtttttaaaatct

SEQ ID NO: 2378861 - DNA, 20 bp, Homo sapiens
catgatgtttttaaaatctt

SEQ ID NO: 2378862 - DNA, 15 bp, Homo sapiens
catgtcctgtgtcag

SEQ ID NO: 2378863 - DNA, 16 bp, Homo sapiens
catgttttcaaatgga

SEQ ID NO: 2378864 - DNA, 18 bp, Homo sapiens
cattaaaatatgcactaa

SEQ ID NO: 2378865 - DNA, 16 bp, Homo sapiens
cattagcaaaaaaagt

SEQ ID NO: 2378866 - DNA, 18 bp, Homo sapiens
cattagcaaaaaaagttg

SEQ ID NO: 2378867 - DNA, 19 bp, Homo sapiens
cattagcaaaaaaagttgt

SEQ ID NO: 2378868 - DNA, 20 bp, Homo sapiens
cattagcaaaaaaagttgta

SEQ ID NO: 2378869 - DNA, 14 bp, Homo sapiens
cattagtactttat

SEQ ID NO: 2378870 - DNA, 18 bp, Homo sapiens
cattcatattacaatatt

SEQ ID NO: 2378871 - DNA, 18 bp, Homo sapiens
cattctcagtttttctta

SEQ ID NO: 2378872 - DNA, 20 bp, Homo sapiens
cattctcagtttttcttaat

SEQ ID NO: 2378873 - DNA, 21 bp, Homo sapiens
cattgcttttaaaactactta

SEQ ID NO: 2378874 - DNA, 14 bp, Homo sapiens
cattggaaatttca

SEQ ID NO: 2378875 - DNA, 21 bp, Homo sapiens
cattggaagcaggttaaatgt

SEQ ID NO: 2378876 - DNA, 22 bp, Homo sapiens
cattggaagcaggttaaatgtt

SEQ ID NO: 2378877 - DNA, 23 bp, Homo sapiens
cattggaagcaggttaaatgttt

SEQ ID NO: 2378878 - DNA, 19 bp, Homo sapiens
catttatggtaatcatatt

SEQ ID NO: 2378879 - DNA, 20 bp, Homo sapiens
catttatggtaatcatatta

SEQ ID NO: 2378880 - DNA, 22 bp, Homo sapiens
catttatggtaatcatattaga

SEQ ID NO: 2378881 - DNA, 16 bp, Homo sapiens
catttcatgtcctgtg

SEQ ID NO: 2378882 - DNA, 15 bp, Homo sapiens
catttccatgtatgc

SEQ ID NO: 2378883 - DNA, 17 bp, Homo sapiens
catttccatgtatgcat

SEQ ID NO: 2378884 - DNA, 16 bp, Homo sapiens
catttccgtaattctt

SEQ ID NO: 2378885 - DNA, 19 bp, Homo sapiens
catttccgtaattcttatt

SEQ ID NO: 2378886 - DNA, 12 bp, Homo sapiens
catttgtcattt

SEQ ID NO: 2378887 - DNA, 18 bp, Homo sapiens
catttgtttggttatagt

SEQ ID NO: 2378888 - DNA, 12 bp, Homo sapiens
cattttctcttt

SEQ ID NO: 2378889 - DNA, 22 bp, Homo sapiens
ccaaacattaatgttgatttct

SEQ ID NO: 2378890 - DNA, 20 bp, Homo sapiens
ccaaggtagaatgaccttgt

SEQ ID NO: 2378891 - DNA, 16 bp, Homo sapiens
ccaagttttgtgaaat

SEQ ID NO: 2378892 - DNA, 22 bp, Homo sapiens
ccatattagaaaactttgttag

SEQ ID NO: 2378893 - DNA, 24 bp, Homo sapiens
gtgttattgagagagatgtgtaat

SEQ ID NO: 2378894 - DNA, 16 bp, Homo sapiens
gttaaagatgtagcaa

SEQ ID NO: 2378895 - DNA, 11 bp, Homo sapiens
gttaaatgttt

SEQ ID NO: 2378896 - DNA, 13 bp, Homo sapiens
gttaaatgttttg

SEQ ID NO: 2378897 - DNA, 14 bp, Homo sapiens
gttaatatggctga

SEQ ID NO: 2378898 - DNA, 14 bp, Homo sapiens
gttaccattggaaa

SEQ ID NO: 2378899 - DNA, 21 bp, Homo sapiens
gttaccattggaaatttcacg

SEQ ID NO: 2378900 - DNA, 18 bp, Homo sapiens
gttagcatacacatttta

SEQ ID NO: 2378901 - DNA, 14 bp, Homo sapiens
gttagtagaggaaa

SEQ ID NO: 2378902 - DNA, 16 bp, Homo sapiens
gttatagtgcaatata

SEQ ID NO: 2378903 - DNA, 17 bp, Homo sapiens
gttatagtgcaatatat

SEQ ID NO: 2378904 - DNA, 23 bp, Homo sapiens
gttatatttttcttaaaaagtaa

SEQ ID NO: 2378905 - DNA, 21 bp, Homo sapiens
gttattgagagagatgtgtaa

SEQ ID NO: 2378906 - DNA, 19 bp, Homo sapiens
gttcagggaagataagttg

SEQ ID NO: 2378907 - DNA, 14 bp, Homo sapiens
gttcattcatatta

SEQ ID NO: 2378908 - DNA, 17 bp, Homo sapiens
gttcattcatattacaa

SEQ ID NO: 2378909 - DNA, 20 bp, Homo sapiens
gttctgcctctgatgtattt

SEQ ID NO: 2378910 - DNA, 13 bp, Homo sapiens
gttctttctcttt

SEQ ID NO: 2378911 - DNA, 12 bp, Homo sapiens
gttgacatttgt

SEQ ID NO: 2378912 - DNA, 12 bp, Homo sapiens
gttgagtgctta

SEQ ID NO: 2378913 - DNA, 16 bp, Homo sapiens
gttgatttctagttat

SEQ ID NO: 2378914 - DNA, 13 bp, Homo sapiens
gttgcactgaagt

SEQ ID NO: 2378915 - DNA, 16 bp, Homo sapiens
gttgcactgaagtttg

SEQ ID NO: 2378916 - DNA, 22 bp, Homo sapiens
gttggaaacactaaatgttaaa

SEQ ID NO: 2378917 - DNA, 23 bp, Homo sapiens
gttggaaacactaaatgttaaag

SEQ ID NO: 2378918 - DNA, 12 bp, Homo sapiens
gtttaagcagaa

SEQ ID NO: 2378919 - DNA, 18 bp, Homo sapiens
gtttaagcagaattggaa

SEQ ID NO: 2378920 - DNA, 19 bp, Homo sapiens
gtttaagcagaattggaaa

SEQ ID NO: 2378921 - DNA, 15 bp, Homo sapiens
gtttatctagatgta

SEQ ID NO: 2378922 - DNA, 18 bp, Homo sapiens
gtttatctagatgtaaat

SEQ ID NO: 2378923 - DNA, 15 bp, Homo sapiens
gtttattctgtttca

SEQ ID NO: 2378924 - DNA, 18 bp, Homo sapiens
gtttcaataaagtttgat

SEQ ID NO: 2378925 - DNA, 19 bp, Homo sapiens
gtttctttgaattttcatt

SEQ ID NO: 2378926 - DNA, 21 bp, Homo sapiens
gttttaaaatactgtagataa

SEQ ID NO: 2378927 - DNA, 20 bp, Homo sapiens
gttttgtgaaatttttcata

SEQ ID NO: 2378928 - DNA, 10 bp, Homo sapiens
gttttgttgc

SEQ ID NO: 2378929 - DNA, 18 bp, Homo sapiens
gttttgttgcactgaagt

SEQ ID NO: 2378930 - DNA, 19 bp, Homo sapiens
gttttgttgcactgaagtt

SEQ ID NO: 2378931 - DNA, 20 bp, Homo sapiens
gtttttaaaatcttattaaa

SEQ ID NO: 2378932 - DNA, 20 bp, Homo sapiens
gtttttcagttcaaagtcat

SEQ ID NO: 2378933 - DNA, 17 bp, Homo sapiens
gttttttgaagtgttgg

SEQ ID NO: 2378934 - DNA, 16 bp, Homo sapiens
taaaaaattagtttgt

SEQ ID NO: 2378935 - DNA, 16 bp, Homo sapiens
taaaaactgaagttct

SEQ ID NO: 2378936 - DNA, 21 bp, Homo sapiens
taaaaagtattgccaaacatt

SEQ ID NO: 2378937 - DNA, 21 bp, Homo sapiens
taaaaataaaccagatcaaat

SEQ ID NO: 2378938 - DNA, 13 bp, Homo sapiens
taaaactgtactt

SEQ ID NO: 2378939 - DNA, 14 bp, Homo sapiens
taaaactgtacttt

SEQ ID NO: 2378940 - DNA, 17 bp, Homo sapiens
taaaactgtactttgat

SEQ ID NO: 2378941 - DNA, 14 bp, Homo sapiens
taaaatactgtaga

SEQ ID NO: 2378942 - DNA, 16 bp, Homo sapiens
taaaatactgtagata

SEQ ID NO: 2378943 - DNA, 23 bp, Homo sapiens
taaaatatgcactaagtctcttt

SEQ ID NO: 2378944 - DNA, 18 bp, Homo sapiens
taaaatattaatacagat

SEQ ID NO: 2378945 - DNA, 14 bp, Homo sapiens
taaaatcttattaa

SEQ ID NO: 2378946 - DNA, 17 bp, Homo sapiens
taaaatcttattaaagt

SEQ ID NO: 2378947 - DNA, 18 bp, Homo sapiens
taaaatcttattaaagtt

SEQ ID NO: 2378948 - DNA, 22 bp, Homo sapiens
taaaatcttattaaagtttcaa

SEQ ID NO: 2378949 - DNA, 14 bp, Homo sapiens
taaaatgttttcag

SEQ ID NO: 2378950 - DNA, 16 bp, Homo sapiens
taaaatgttttcagct

SEQ ID NO: 2378951 - DNA, 21 bp, Homo sapiens
taaaatgttttcagctaggaa

SEQ ID NO: 2378952 - DNA, 15 bp, Homo sapiens
taaaatttgaaacat

SEQ ID NO: 2378953 - DNA, 17 bp, Homo sapiens
taaaatttgaaacattg

SEQ ID NO: 2378954 - DNA, 20 bp, Homo sapiens
taaacatcaggttaggcagt

SEQ ID NO: 2378955 - DNA, 20 bp, Homo sapiens
taaacgtgtatgtttttcag

SEQ ID NO: 2378956 - DNA, 13 bp, Homo sapiens
taaactttgaaat

SEQ ID NO: 2378957 - DNA, 16 bp, Homo sapiens
taaactttgaaatata

SEQ ID NO: 2378958 - DNA, 16 bp, Homo sapiens
taaagaagaaagcttt

SEQ ID NO: 2378959 - DNA, 15 bp, Homo sapiens
taaaggtatacaaat

SEQ ID NO: 2378960 - DNA, 13 bp, Homo sapiens
taaagtaaatgaa

SEQ ID NO: 2378961 - DNA, 19 bp, Homo sapiens
taaagtactgagcagtgat

SEQ ID NO: 2378962 - DNA, 19 bp, Homo sapiens
taaagtttcaaaaatctga

SEQ ID NO: 2378963 - DNA, 19 bp, Homo sapiens
taaataaggccatgtctga

SEQ ID NO: 2378964 - DNA, 15 bp, Homo sapiens
taaatagtgttattg

SEQ ID NO: 2378965 - DNA, 16 bp, Homo sapiens
taaatgttaaagatgt

SEQ ID NO: 2378966 - DNA, 18 bp, Homo sapiens
taaatgttttgtaaactt

SEQ ID NO: 2378967 - DNA, 19 bp, Homo sapiens
taaatgttttgtaaacttt

SEQ ID NO: 2378968 - DNA, 22 bp, Homo sapiens
taaatgttttgtaaactttgaa

SEQ ID NO: 2378969 - DNA, 23 bp, Homo sapiens
taaatgttttgtaaactttgaaa

SEQ ID NO: 2378970 - DNA, 13 bp, Homo sapiens
taaattgatgttg

SEQ ID NO: 2378971 - DNA, 18 bp, Homo sapiens
taaattgatgttgatgca

SEQ ID NO: 2378972 - DNA, 18 bp, Homo sapiens
taacaaataacaactttt

SEQ ID NO: 2378973 - DNA, 20 bp, Homo sapiens
taacaacttttttttctttt

SEQ ID NO: 2378974 - DNA, 21 bp, Homo sapiens
taaccaaggtagaatgacctt

SEQ ID NO: 2378975 - DNA, 19 bp, Homo sapiens
taactgctcttgggcaata

SEQ ID NO: 2378976 - DNA, 11 bp, Homo sapiens
taactgttacc

SEQ ID NO: 2378977 - DNA, 15 bp, Homo sapiens
taactgttaccattg

SEQ ID NO: 2378978 - DNA, 15 bp, Homo sapiens
taacttctaaaactg

SEQ ID NO: 2378979 - DNA, 17 bp, Homo sapiens
taacttctaaaactgta

SEQ ID NO: 2378980 - DNA, 13 bp, Homo sapiens
taacttgcttaaa

SEQ ID NO: 2378981 - DNA, 14 bp, Homo sapiens
taacttgcttaaat

SEQ ID NO: 2378982 - DNA, 15 bp, Homo sapiens
taacttgcttaaatg

SEQ ID NO: 2378983 - DNA, 12 bp, Homo sapiens
taagaaacattg

SEQ ID NO: 2378984 - DNA, 16 bp, Homo sapiens
taagaaacattggaag

SEQ ID NO: 2378985 - DNA, 21 bp, Homo sapiens
taagaaacattggaagcaggt

SEQ ID NO: 2378986 - DNA, 15 bp, Homo sapiens
taagaatgactgatg

SEQ ID NO: 2378987 - DNA, 23 bp, Homo sapiens
taagaattttttattttttggta

SEQ ID NO: 2378988 - DNA, 13 bp, Homo sapiens
taagacatgttta

SEQ ID NO: 2378989 - DNA, 19 bp, Homo sapiens
taagatcggttaacaaata

SEQ ID NO: 2378990 - DNA, 21 bp, Homo sapiens
taagatgttatatttttctta

SEQ ID NO: 2378991 - DNA, 13 bp, Homo sapiens
taagcaacaattt

SEQ ID NO: 2378992 - DNA, 16 bp, Homo sapiens
taagcaacaattttca

SEQ ID NO: 2378993 - DNA, 18 bp, Homo sapiens
taagctgtttggttttaa

SEQ ID NO: 2378994 - DNA, 22 bp, Homo sapiens
taagctgtttggttttaaaata

SEQ ID NO: 2378995 - DNA, 18 bp, Homo sapiens
taagtctcttttttacaa

SEQ ID NO: 2378996 - DNA, 20 bp, Homo sapiens
taagtctcttttttacaaag

SEQ ID NO: 2378997 - DNA, 12 bp, Homo sapiens
taagtgaaattt

SEQ ID NO: 2378998 - DNA, 20 bp, Homo sapiens
taataaagcgaaaaactcaa

SEQ ID NO: 2378999 - DNA, 15 bp, Homo sapiens
taatacaatcagaag

SEQ ID NO: 2379000 - DNA, 16 bp, Homo sapiens
taatgtttaagcagaa

SEQ ID NO: 2379001 - DNA, 20 bp, Homo sapiens
taattctgaagttatatttc

SEQ ID NO: 2379002 - DNA, 23 bp, Homo sapiens
taattctgaagttatatttccta

SEQ ID NO: 2379003 - DNA, 14 bp, Homo sapiens
taattcttattcca

SEQ ID NO: 2379004 - DNA, 17 bp, Homo sapiens
taattcttattccatat

SEQ ID NO: 2379005 - DNA, 11 bp, Homo sapiens
taatttcaagc

SEQ ID NO: 2379006 - DNA, 15 bp, Homo sapiens
taatttttctgtata

SEQ ID NO: 2379007 - DNA, 14 bp, Homo sapiens
tgtgtgtgatgtga

SEQ ID NO: 2379008 - DNA, 18 bp, Homo sapiens
tgtgtgtgatgtgacatt

SEQ ID NO: 2379009 - DNA, 13 bp, Homo sapiens
tgttaaagatgta

SEQ ID NO: 2379010 - DNA, 20 bp, Homo sapiens
tgttaattgttcaaactttc

SEQ ID NO: 2379011 - DNA, 22 bp, Homo sapiens
tgttaatttggaccattttcct

SEQ ID NO: 2379012 - DNA, 14 bp, Homo sapiens
tgttatatttttct

SEQ ID NO: 2379013 - DNA, 18 bp, Homo sapiens
tgttatatttttcttaaa

SEQ ID NO: 2379014 - DNA, 15 bp, Homo sapiens
tgttctgttacaaaa

SEQ ID NO: 2379015 - DNA, 15 bp, Homo sapiens
tgttgacatttgttt

SEQ ID NO: 2379016 - DNA, 20 bp, Homo sapiens
tgttgatgcaatccttacaa

SEQ ID NO: 2379017 - DNA, 23 bp, Homo sapiens
tgttgatgcaatccttacaaatg

SEQ ID NO: 2379018 - DNA, 11 bp, Homo sapiens
tgttgatttct

SEQ ID NO: 2379019 - DNA, 16 bp, Homo sapiens
tgttgatttctagtta

SEQ ID NO: 2379020 - DNA, 20 bp, Homo sapiens
tgttgatttctagttattta

SEQ ID NO: 2379021 - DNA, 13 bp, Homo sapiens
tgttgcactgaag

SEQ ID NO: 2379022 - DNA, 16 bp, Homo sapiens
tgttggaattttaagt

SEQ ID NO: 2379023 - DNA, 13 bp, Homo sapiens
tgtttaagcagaa

SEQ ID NO: 2379024 - DNA, 14 bp, Homo sapiens
tgtttaagcagaat

SEQ ID NO: 2379025 - DNA, 19 bp, Homo sapiens
tgtttaagcagaattggaa

SEQ ID NO: 2379026 - DNA, 22 bp, Homo sapiens
tgtttatctagatgtaaatttt

SEQ ID NO: 2379027 - DNA, 16 bp, Homo sapiens
tgtttctttgaatttt

SEQ ID NO: 2379028 - DNA, 14 bp, Homo sapiens
tgtttggttatagt

SEQ ID NO: 2379029 - DNA, 18 bp, Homo sapiens
tgtttggttatagtgcaa

SEQ ID NO: 2379030 - DNA, 21 bp, Homo sapiens
tgtttggttttaaaatactgt

SEQ ID NO: 2379031 - DNA, 13 bp, Homo sapiens
tgttttcaaatgg

SEQ ID NO: 2379032 - DNA, 14 bp, Homo sapiens
tgttttgttgcact

SEQ ID NO: 2379033 - DNA, 20 bp, Homo sapiens
tgttttgttgcactgaagtt

SEQ ID NO: 2379034 - DNA, 17 bp, Homo sapiens
tgtttttaaaatcttat

SEQ ID NO: 2379035 - DNA, 21 bp, Homo sapiens
tgtttttaaaatcttattaaa

SEQ ID NO: 2379036 - DNA, 13 bp, Homo sapiens
tgtttttcagttc

SEQ ID NO: 2379037 - DNA, 15 bp, Homo sapiens
tgtttttcagttcaa

SEQ ID NO: 2379038 - DNA, 9 bp, Homo sapiens
tgttttttg

SEQ ID NO: 2379039 - DNA, 20 bp, Homo sapiens
ttaaaaagtattgccaaaca

SEQ ID NO: 2379040 - DNA, 22 bp, Homo sapiens
ttaaaaagtattgccaaacatt

SEQ ID NO: 2379041 - DNA, 17 bp, Homo sapiens
ttaaaatactgtagata

SEQ ID NO: 2379042 - DNA, 16 bp, Homo sapiens
ttaaaatatgcactaa

SEQ ID NO: 2379043 - DNA, 19 bp, Homo sapiens
ttaaaatatgcactaagtc

SEQ ID NO: 2379044 - DNA, 16 bp, Homo sapiens
ttaaaatcttattaaa

SEQ ID NO: 2379045 - DNA, 14 bp, Homo sapiens
ttaaaatttgaaac

SEQ ID NO: 2379046 - DNA, 12 bp, Homo sapiens
ttaaaattttaa

SEQ ID NO: 2379047 - DNA, 11 bp, Homo sapiens
ttaaagatgta

SEQ ID NO: 2379048 - DNA, 16 bp, Homo sapiens
ttaaagatgtagcaaa

SEQ ID NO: 2379049 - DNA, 19 bp, Homo sapiens
ttaaagtttcaaaaatctg

SEQ ID NO: 2379050 - DNA, 18 bp, Homo sapiens
ttaaatgtgaattactaa

SEQ ID NO: 2379051 - DNA, 21 bp, Homo sapiens
ttaaatgtgaattactaactt

SEQ ID NO: 2379052 - DNA, 15 bp, Homo sapiens
ttaaatgttttgtaa

SEQ ID NO: 2379053 - DNA, 15 bp, Homo sapiens
ttaagaattgaagat

SEQ ID NO: 2379054 - DNA, 13 bp, Homo sapiens
ttaagtgaaattt

SEQ ID NO: 2379055 - DNA, 14 bp, Homo sapiens
ttaagtgaaattta

SEQ ID NO: 2379056 - DNA, 18 bp, Homo sapiens
ttaatcagtttctgaaat

SEQ ID NO: 2379057 - DNA, 17 bp, Homo sapiens
ttaatgttgatttctag

SEQ ID NO: 2379058 - DNA, 12 bp, Homo sapiens
ttacaaaatgta

SEQ ID NO: 2379059 - DNA, 15 bp, Homo sapiens
ttacaaaatgtaact

SEQ ID NO: 2379060 - DNA, 17 bp, Homo sapiens
ttacaaaatgtaactgt

SEQ ID NO: 2379061 - DNA, 18 bp, Homo sapiens
ttacaaaatgtaactgtt

SEQ ID NO: 2379062 - DNA, 17 bp, Homo sapiens
ttacaaatgattgcttt

SEQ ID NO: 2379063 - DNA, 20 bp, Homo sapiens
ttacaaatgattgcttttaa

SEQ ID NO: 2379064 - DNA, 16 bp, Homo sapiens
ttacaatatttgtgtg

SEQ ID NO: 2379065 - DNA, 18 bp, Homo sapiens
ttacaatatttgtgtgct

SEQ ID NO: 2379066 - DNA, 22 bp, Homo sapiens
ttacaatatttgtgtgctaaac

SEQ ID NO: 2379067 - DNA, 13 bp, Homo sapiens
ttacagttacttt

SEQ ID NO: 2379068 - DNA, 16 bp, Homo sapiens
ttacagttacttttcc

SEQ ID NO: 2379069 - DNA, 18 bp, Homo sapiens
ttacagttacttttcctt

SEQ ID NO: 2379070 - DNA, 18 bp, Homo sapiens
ttacataaacatcaggtt

SEQ ID NO: 2379071 - DNA, 14 bp, Homo sapiens
ttacatgactattg

SEQ ID NO: 2379072 - DNA, 15 bp, Homo sapiens
ttactaacttctaaa

SEQ ID NO: 2379073 - DNA, 17 bp, Homo sapiens
ttactaacttctaaaac

SEQ ID NO: 2379074 - DNA, 14 bp, Homo sapiens
ttagaaaactttgt

SEQ ID NO: 2379075 - DNA, 15 bp, Homo sapiens
ttagaaaactttgtt

SEQ ID NO: 2379076 - DNA, 16 bp, Homo sapiens
ttagaaaactttgtta

SEQ ID NO: 2379077 - DNA, 14 bp, Homo sapiens
ttagacttctgttt

SEQ ID NO: 2379078 - DNA, 22 bp, Homo sapiens
ttagagctttttttttttaatt

SEQ ID NO: 2379079 - DNA, 17 bp, Homo sapiens
ttagccagtgttttcca

SEQ ID NO: 2379080 - DNA, 20 bp, Homo sapiens
ttaggcagtataaagaatag

SEQ ID NO: 2379081 - DNA, 17 bp, Homo sapiens
ttagtactttatagaag

SEQ ID NO: 2379082 - DNA, 21 bp, Homo sapiens
ttagtggaccctgaaatgtgt

SEQ ID NO: 2379083 - DNA, 19 bp, Homo sapiens
ttatagaagaatgcatgct

SEQ ID NO: 2379084 - DNA, 22 bp, Homo sapiens
ttatagaagaatgcatgctttc

SEQ ID NO: 2379085 - DNA, 17 bp, Homo sapiens
ttatagtgcaatatatt

SEQ ID NO: 2379086 - DNA, 14 bp, Homo sapiens
ttatagttgaagat

SEQ ID NO: 2379087 - DNA, 22 bp, Homo sapiens
ttatatttggatgcagagttca

SEQ ID NO: 2379088 - DNA, 15 bp, Homo sapiens
ttatatttttcttaa

SEQ ID NO: 2379089 - DNA, 21 bp, Homo sapiens
ttatatttttcttaaaaagta

SEQ ID NO: 2379090 - DNA, 17 bp, Homo sapiens
ttatctaccaactttca

SEQ ID NO: 2379091 - DNA, 14 bp, Homo sapiens
ttatctagatgtaa

SEQ ID NO: 2379092 - DNA, 16 bp, Homo sapiens
ttatctagatgtaaat

SEQ ID NO: 2379093 - DNA, 20 bp, Homo sapiens
ttatgctaagaattttttat

SEQ ID NO: 2379094 - DNA, 18 bp, Homo sapiens
ttatggtaatcatattag

SEQ ID NO: 2379095 - DNA, 17 bp, Homo sapiens
ttatgttgacatttgtt

SEQ ID NO: 2379096 - DNA, 20 bp, Homo sapiens
ttattctgggaatgtatagt

SEQ ID NO: 2379097 - DNA, 22 bp, Homo sapiens
ttattgagagagatgtgtaatt

SEQ ID NO: 2379098 - DNA, 22 bp, Homo sapiens
ttatttattctgggaatgtata

SEQ ID NO: 2379099 - DNA, 12 bp, Homo sapiens
ttattttctaaa

SEQ ID NO: 2379100 - DNA, 21 bp, Homo sapiens
ttattttggagagataggaag

SEQ ID NO: 2379101 - DNA, 21 bp, Homo sapiens
ttcaaaaatctgaagattgtt

SEQ ID NO: 2379102 - DNA, 22 bp, Homo sapiens
ttcaaaaatctgaagattgttt

SEQ ID NO: 2379103 - DNA, 14 bp, Homo sapiens
ttcaagcttatttt

SEQ ID NO: 2379104 - DNA, 19 bp, Homo sapiens
ttcaagcttattttggaga

SEQ ID NO: 2379105 - DNA, 19 bp, Homo sapiens
ttcaataaagtttgatctt

SEQ ID NO: 2379106 - DNA, 22 bp, Homo sapiens
ttcaatctcgtatagaagtctt

SEQ ID NO: 2379107 - DNA, 20 bp, Homo sapiens
ttcacaaatattaaaaagtc

SEQ ID NO: 2379108 - DNA, 18 bp, Homo sapiens
ttcacatgttttcaaatg

SEQ ID NO: 2379109 - DNA, 23 bp, Homo sapiens
ttcaccagtacattctcagtttt

SEQ ID NO: 2379110 - DNA, 18 bp, Homo sapiens
ttcactctaagatgttat

SEQ ID NO: 2379111 - DNA, 16 bp, Homo sapiens
ttcagatttgcacaaa

SEQ ID NO: 2379112 - DNA, 18 bp, Homo sapiens
ttcagggaagataagttg

SEQ ID NO: 2379113 - DNA, 16 bp, Homo sapiens
ttcagggcagatttta

SEQ ID NO: 2379114 - DNA, 18 bp, Homo sapiens
ttcatattttaatttcaa

SEQ ID NO: 2379115 - DNA, 12 bp, Homo sapiens
ttcatgaaatgc

SEQ ID NO: 2379116 - DNA, 13 bp, Homo sapiens
ttcatgaaatgct

SEQ ID NO: 2379117 - DNA, 15 bp, Homo sapiens
ttcatgaaatgctat

SEQ ID NO: 2379118 - DNA, 20 bp, Homo sapiens
ttcatgaaatgctatgtcat

SEQ ID NO: 2379119 - DNA, 22 bp, Homo sapiens
ttcatgaaatgctatgtcattt

SEQ ID NO: 2379120 - DNA, 12 bp, Homo sapiens
aaaaaaagttgt

SEQ ID NO: 2379121 - DNA, 12 bp, Homo sapiens
aaaaaagttgta

SEQ ID NO: 2379122 - DNA, 13 bp, Homo sapiens
aaaaactgaagtt

SEQ ID NO: 2379123 - DNA, 12 bp, Homo sapiens
aaaaagtattgc

SEQ ID NO: 2379124 - DNA, 14 bp, Homo sapiens
aaaaatctgaagat

SEQ ID NO: 2379125 - DNA, 17 bp, Homo sapiens
aaaaatctgaagattgt

SEQ ID NO: 2379126 - DNA, 20 bp, Homo sapiens
aaaaatctgaagattgttta

SEQ ID NO: 2379127 - DNA, 21 bp, Homo sapiens
aaaaatctgaagattgtttat

SEQ ID NO: 2379128 - DNA, 17 bp, Homo sapiens
aaaactacttagcactt

SEQ ID NO: 2379129 - DNA, 20 bp, Homo sapiens
aaaactgtactttgattcac

SEQ ID NO: 2379130 - DNA, 12 bp, Homo sapiens
aaaagaaatcta

SEQ ID NO: 2379131 - DNA, 22 bp, Homo sapiens
aaaagaaatctatagaaagtgt

SEQ ID NO: 2379132 - DNA, 17 bp, Homo sapiens
aaaagactaagatcggt

SEQ ID NO: 2379133 - DNA, 16 bp, Homo sapiens
aaaagtattgccaaac

SEQ ID NO: 2379134 - DNA, 18 bp, Homo sapiens
aaaagttgtatgatctgt

SEQ ID NO: 2379135 - DNA, 15 bp, Homo sapiens
aaaatactgtagata

SEQ ID NO: 2379136 - DNA, 12 bp, Homo sapiens
aaaatatgtgaa

SEQ ID NO: 2379137 - DNA, 18 bp, Homo sapiens
aaaatatgtgaaggacct

SEQ ID NO: 2379138 - DNA, 16 bp, Homo sapiens
aaaatctgaagattgt

SEQ ID NO: 2379139 - DNA, 23 bp, Homo sapiens
aaaatcttattaaagtttcaaaa

SEQ ID NO: 2379140 - DNA, 15 bp, Homo sapiens
aaaatgtaactgtta

SEQ ID NO: 2379141 - DNA, 12 bp, Homo sapiens
aaaatgttttca

SEQ ID NO: 2379142 - DNA, 14 bp, Homo sapiens
aaaatgttttcagc

SEQ ID NO: 2379143 - DNA, 12 bp, Homo sapiens
aaaatttgaaac

SEQ ID NO: 2379144 - DNA, 13 bp, Homo sapiens
aaaatttgaaaca

SEQ ID NO: 2379145 - DNA, 19 bp, Homo sapiens
aaaatttgaaacattgctt

SEQ ID NO: 2379146 - DNA, 13 bp, Homo sapiens
aaaattttaagct

SEQ ID NO: 2379147 - DNA, 12 bp, Homo sapiens
aaacaagcatat

SEQ ID NO: 2379148 - DNA, 15 bp, Homo sapiens
aaacaagcatataaa

SEQ ID NO: 2379149 - DNA, 14 bp, Homo sapiens
aaacactaaatgtt

SEQ ID NO: 2379150 - DNA, 16 bp, Homo sapiens
aaacactaaatgttaa

SEQ ID NO: 2379151 - DNA, 20 bp, Homo sapiens
aaacactaaatgttaaagat

SEQ ID NO: 2379152 - DNA, 22 bp, Homo sapiens
aaacactaaatgttaaagatgt

SEQ ID NO: 2379153 - DNA, 16 bp, Homo sapiens
aaacattaatgttgat

SEQ ID NO: 2379154 - DNA, 24 bp, Homo sapiens
aaacattaatgttgatttctagtt

SEQ ID NO: 2379155 - DNA, 16 bp, Homo sapiens
aaacattgcttttaaa

SEQ ID NO: 2379156 - DNA, 13 bp, Homo sapiens
aaacattggaagc

SEQ ID NO: 2379157 - DNA, 17 bp, Homo sapiens
aaacattggaagcaggt

SEQ ID NO: 2379158 - DNA, 17 bp, Homo sapiens
aaaccctgtcaaacatt

SEQ ID NO: 2379159 - DNA, 18 bp, Homo sapiens
aaacgtgtatgtttttca

SEQ ID NO: 2379160 - DNA, 20 bp, Homo sapiens
aaacgtgtatgtttttcagt

SEQ ID NO: 2379161 - DNA, 22 bp, Homo sapiens
aaactgcacatgatttcacaaa

SEQ ID NO: 2379162 - DNA, 12 bp, Homo sapiens
aaactgtacttt

SEQ ID NO: 2379163 - DNA, 13 bp, Homo sapiens
aaactttgaaata

SEQ ID NO: 2379164 - DNA, 19 bp, Homo sapiens
aaagaataggacttgtttt

SEQ ID NO: 2379165 - DNA, 13 bp, Homo sapiens
aaagactaagatc

SEQ ID NO: 2379166 - DNA, 19 bp, Homo sapiens
aaagataccttaaaatttg

SEQ ID NO: 2379167 - DNA, 21 bp, Homo sapiens
aaagataccttaaaatttgaa

SEQ ID NO: 2379168 - DNA, 15 bp, Homo sapiens
aaagatgtagcaaac

SEQ ID NO: 2379169 - DNA, 14 bp, Homo sapiens
aaaggctgtattca

SEQ ID NO: 2379170 - DNA, 20 bp, Homo sapiens
aaaggtaagaaagctgatag

SEQ ID NO: 2379171 - DNA, 20 bp, Homo sapiens
aaagtacaggtactttgtct

SEQ ID NO: 2379172 - DNA, 22 bp, Homo sapiens
aaagtacaggtactttgtctaa

SEQ ID NO: 2379173 - DNA, 21 bp, Homo sapiens
aaagtactgagcagtgatatt

SEQ ID NO: 2379174 - DNA, 14 bp, Homo sapiens
aaagtattgccaaa

SEQ ID NO: 2379175 - DNA, 17 bp, Homo sapiens
aaagtcatgatgttttt

SEQ ID NO: 2379176 - DNA, 13 bp, Homo sapiens
aaagtcttttaaa

SEQ ID NO: 2379177 - DNA, 14 bp, Homo sapiens
aaagtcttttaaaa

SEQ ID NO: 2379178 - DNA, 20 bp, Homo sapiens
aaagtgttctgttacaaaat

SEQ ID NO: 2379179 - DNA, 17 bp, Homo sapiens
aaagttgtatgatctgt

SEQ ID NO: 2379180 - DNA, 14 bp, Homo sapiens
aaataactgatttt

SEQ ID NO: 2379181 - DNA, 14 bp, Homo sapiens
aaatactgtagata

SEQ ID NO: 2379182 - DNA, 15 bp, Homo sapiens
aaatactgtagataa

SEQ ID NO: 2379183 - DNA, 16 bp, Homo sapiens
aaatactgtagataat

SEQ ID NO: 2379184 - DNA, 22 bp, Homo sapiens
aaatatatggtctaatgtttaa

SEQ ID NO: 2379185 - DNA, 13 bp, Homo sapiens
aaatatgcactaa

SEQ ID NO: 2379186 - DNA, 16 bp, Homo sapiens
aaatatgcactaagtc

SEQ ID NO: 2379187 - DNA, 15 bp, Homo sapiens
aaatatgtgaaggac

SEQ ID NO: 2379188 - DNA, 14 bp, Homo sapiens
aaatctatagaaag

SEQ ID NO: 2379189 - DNA, 23 bp, Homo sapiens
aaatctgaagattgtttatctag

SEQ ID NO: 2379190 - DNA, 13 bp, Homo sapiens
aaatgaacacaaa

SEQ ID NO: 2379191 - DNA, 16 bp, Homo sapiens
aaatgaacacaaatta

SEQ ID NO: 2379192 - DNA, 23 bp, Homo sapiens
aaatgattgcttttaaaatttta

SEQ ID NO: 2379193 - DNA, 19 bp, Homo sapiens
aaatgctatgtcatttcat

SEQ ID NO: 2379194 - DNA, 20 bp, Homo sapiens
aaatgctatgtcatttcatg

SEQ ID NO: 2379195 - DNA, 23 bp, Homo sapiens
aaatggagttggagttcattcat

SEQ ID NO: 2379196 - DNA, 11 bp, Homo sapiens
aaatgtaactg

SEQ ID NO: 2379197 - DNA, 17 bp, Homo sapiens
agtcttttttttttaag

SEQ ID NO: 2379198 - DNA, 18 bp, Homo sapiens
agtcttttttttttaagt

SEQ ID NO: 2379199 - DNA, 13 bp, Homo sapiens
agtgaaatttatt

SEQ ID NO: 2379200 - DNA, 19 bp, Homo sapiens
agtgatattctttgttaat

SEQ ID NO: 2379201 - DNA, 21 bp, Homo sapiens
agtggaccctgaaatgtgtgt

SEQ ID NO: 2379202 - DNA, 18 bp, Homo sapiens
agtgtaccattaaaatat

SEQ ID NO: 2379203 - DNA, 16 bp, Homo sapiens
agtgttctgttacaaa

SEQ ID NO: 2379204 - DNA, 21 bp, Homo sapiens
agtgttctgttacaaaatgta

SEQ ID NO: 2379205 - DNA, 23 bp, Homo sapiens
agtgttctgttacaaaatgtaac

SEQ ID NO: 2379206 - DNA, 22 bp, Homo sapiens
agtgttggggtttggttttgtt

SEQ ID NO: 2379207 - DNA, 21 bp, Homo sapiens
agttacttttccttgcataca

SEQ ID NO: 2379208 - DNA, 14 bp, Homo sapiens
agttatatttccta

SEQ ID NO: 2379209 - DNA, 22 bp, Homo sapiens
agttcaaagtcatgatgttttt

SEQ ID NO: 2379210 - DNA, 22 bp, Homo sapiens
agttcagggaagataagttgga

SEQ ID NO: 2379211 - DNA, 16 bp, Homo sapiens
agttcattcatattac

SEQ ID NO: 2379212 - DNA, 23 bp, Homo sapiens
agttcattcatattacaatattt

SEQ ID NO: 2379213 - DNA, 13 bp, Homo sapiens
agttggaaacact

SEQ ID NO: 2379214 - DNA, 23 bp, Homo sapiens
agttggaaacactaaatgttaaa

SEQ ID NO: 2379215 - DNA, 23 bp, Homo sapiens
agttggagttcattcatattaca

SEQ ID NO: 2379216 - DNA, 14 bp, Homo sapiens
agtttcaaaaatct

SEQ ID NO: 2379217 - DNA, 18 bp, Homo sapiens
agtttcaaaaatctgaag

SEQ ID NO: 2379218 - DNA, 16 bp, Homo sapiens
agtttgataaatagtg

SEQ ID NO: 2379219 - DNA, 19 bp, Homo sapiens
agtttgataaatagtgtta

SEQ ID NO: 2379220 - DNA, 22 bp, Homo sapiens
agtttgatcttcctctgctaaa

SEQ ID NO: 2379221 - DNA, 12 bp, Homo sapiens
agttttgtgaaa

SEQ ID NO: 2379222 - DNA, 14 bp, Homo sapiens
agttttgtgaaatt

SEQ ID NO: 2379223 - DNA, 21 bp, Homo sapiens
agttttgtgaaatttttcata

SEQ ID NO: 2379224 - DNA, 19 bp, Homo sapiens
ataaagaataggacttgtt

SEQ ID NO: 2379225 - DNA, 12 bp, Homo sapiens
ataaagtttgat

SEQ ID NO: 2379226 - DNA, 15 bp, Homo sapiens
ataaagtttgatctt

SEQ ID NO: 2379227 - DNA, 22 bp, Homo sapiens
ataaagtttgatcttcctctgc

SEQ ID NO: 2379228 - DNA, 17 bp, Homo sapiens
ataacacagtttgtact

SEQ ID NO: 2379229 - DNA, 17 bp, Homo sapiens
ataagcaacaattttca

SEQ ID NO: 2379230 - DNA, 18 bp, Homo sapiens
ataagttggaaacactaa

SEQ ID NO: 2379231 - DNA, 22 bp, Homo sapiens
ataagttggaaacactaaatgt

SEQ ID NO: 2379232 - DNA, 15 bp, Homo sapiens
ataataaatgtattt

SEQ ID NO: 2379233 - DNA, 12 bp, Homo sapiens
ataatgaagccc

SEQ ID NO: 2379234 - DNA, 21 bp, Homo sapiens
ataattaaccaaggtagaatg

SEQ ID NO: 2379235 - DNA, 22 bp, Homo sapiens
ataattctgaagttatatttcc

SEQ ID NO: 2379236 - DNA, 17 bp, Homo sapiens
atacataactgaagcat

SEQ ID NO: 2379237 - DNA, 13 bp, Homo sapiens
ataccatttccgt

SEQ ID NO: 2379238 - DNA, 13 bp, Homo sapiens
ataccttaaaatt

SEQ ID NO: 2379239 - DNA, 16 bp, Homo sapiens
ataccttaaaatttga

SEQ ID NO: 2379240 - DNA, 21 bp, Homo sapiens
ataccttaaaatttgaaacat

SEQ ID NO: 2379241 - DNA, 22 bp, Homo sapiens
ataccttaaaatttgaaacatt

SEQ ID NO: 2379242 - DNA, 17 bp, Homo sapiens
atagaaagtgttctgtt

SEQ ID NO: 2379243 - DNA, 12 bp, Homo sapiens
atagaagaatgc

SEQ ID NO: 2379244 - DNA, 19 bp, Homo sapiens
atagaagtcttcatgaaat

SEQ ID NO: 2379245 - DNA, 16 bp, Homo sapiens
atagcatttatggtaa

SEQ ID NO: 2379246 - DNA, 17 bp, Homo sapiens
atagcatttatggtaat

SEQ ID NO: 2379247 - DNA, 21 bp, Homo sapiens
ataggaagttagcctttatct

SEQ ID NO: 2379248 - DNA, 12 bp, Homo sapiens
atagtgcaatat

SEQ ID NO: 2379249 - DNA, 15 bp, Homo sapiens
atagtgcaatatatt

SEQ ID NO: 2379250 - DNA, 12 bp, Homo sapiens
atataacacagt

SEQ ID NO: 2379251 - DNA, 13 bp, Homo sapiens
atataacacagtt

SEQ ID NO: 2379252 - DNA, 20 bp, Homo sapiens
atatatggtctaatgtttaa

SEQ ID NO: 2379253 - DNA, 14 bp, Homo sapiens
atatattttgtatg

SEQ ID NO: 2379254 - DNA, 19 bp, Homo sapiens
atatattttgtatgcaagc

SEQ ID NO: 2379255 - DNA, 19 bp, Homo sapiens
atatgcactaagtctcttt

SEQ ID NO: 2379256 - DNA, 15 bp, Homo sapiens
atatgcctgctcttt

SEQ ID NO: 2379257 - DNA, 16 bp, Homo sapiens
atatggtctaatgttt

SEQ ID NO: 2379258 - DNA, 12 bp, Homo sapiens
atattaaaaagt

SEQ ID NO: 2379259 - DNA, 20 bp, Homo sapiens
atattaaaaagtcttttaaa

SEQ ID NO: 2379260 - DNA, 21 bp, Homo sapiens
atattagacttctgttttcaa

SEQ ID NO: 2379261 - DNA, 19 bp, Homo sapiens
atattagcgacaacagatt

SEQ ID NO: 2379262 - DNA, 22 bp, Homo sapiens
atattatatttggatgcagagt

SEQ ID NO: 2379263 - DNA, 22 bp, Homo sapiens
atattccttatttaagacatgt

SEQ ID NO: 2379264 - DNA, 22 bp, Homo sapiens
atattctaaaatataacacagt

SEQ ID NO: 2379265 - DNA, 16 bp, Homo sapiens
atattctctgtacata

SEQ ID NO: 2379266 - DNA, 19 bp, Homo sapiens
atattctctgtacatatta

SEQ ID NO: 2379267 - DNA, 20 bp, Homo sapiens
atattctttgttaatttgga

SEQ ID NO: 2379268 - DNA, 22 bp, Homo sapiens
atatttgtgtgctaaacgtgta

SEQ ID NO: 2379269 - DNA, 16 bp, Homo sapiens
atattttaaaaataaa

SEQ ID NO: 2379270 - DNA, 15 bp, Homo sapiens
atatttttttcctta

SEQ ID NO: 2379271 - DNA, 18 bp, Homo sapiens
atatttttttccttacat

SEQ ID NO: 2379272 - DNA, 14 bp, Homo sapiens
atccttacaaatga

SEQ ID NO: 2379273 - DNA, 16 bp, Homo sapiens
atcggttaacaaataa

SEQ ID NO: 2379274 - DNA, 15 bp, Homo sapiens
atctaccaactttca

SEQ ID NO: 2379275 - DNA, 13 bp, Homo sapiens
atctagatgtaaa

SEQ ID NO: 2379276 - DNA, 19 bp, Homo sapiens
atctcgtatagaagtcttc

SEQ ID NO: 2379277 - DNA, 14 bp, Homo sapiens
atctgaagattgtt

SEQ ID NO: 2379278 - DNA, 15 bp, Homo sapiens
atctgaagattgttt

SEQ ID NO: 2379279 - DNA, 18 bp, Homo sapiens
atctggagtctttgataa

SEQ ID NO: 2379280 - DNA, 14 bp, Homo sapiens
atctgtaagctgtt

SEQ ID NO: 2379281 - DNA, 19 bp, Homo sapiens
atcttattaaagtttcaaa

SEQ ID NO: 2379282 - DNA, 16 bp, Homo sapiens
atcttcctctgctaaa

SEQ ID NO: 2379283 - DNA, 18 bp, Homo sapiens
atcttggcaggtaggaat

SEQ ID NO: 2379284 - DNA, 14 bp, Homo sapiens
atgaaatgaacaca

SEQ ID NO: 2379285 - DNA, 14 bp, Homo sapiens
atgaacacaaatta

SEQ ID NO: 2379286 - DNA, 17 bp, Homo sapiens
atgaccaattttaactt

SEQ ID NO: 2379287 - DNA, 18 bp, Homo sapiens
atgaccttgtaatgtaac

SEQ ID NO: 2379288 - DNA, 19 bp, Homo sapiens
atgatgtttttaaaatctt

SEQ ID NO: 2379289 - DNA, 13 bp, Homo sapiens
atgatttcacaaa

SEQ ID NO: 2379290 - DNA, 16 bp, Homo sapiens
atgatttcacaaatat

SEQ ID NO: 2379291 - DNA, 22 bp, Homo sapiens
atgatttcacaaatattaaaaa

SEQ ID NO: 2379292 - DNA, 13 bp, Homo sapiens
atgcaagcagttt

SEQ ID NO: 2379293 - DNA, 15 bp, Homo sapiens
atgcaagcagtttca

SEQ ID NO: 2379294 - DNA, 22 bp, Homo sapiens
atgcaagcagtttcaataaagt

SEQ ID NO: 2379295 - DNA, 23 bp, Homo sapiens
atgcaagcagtttcaataaagtt

SEQ ID NO: 2379296 - DNA, 21 bp, Homo sapiens
atgcaatccttacaaatgatt

SEQ ID NO: 2379297 - DNA, 24 bp, Homo sapiens
atgcagaaaaggaagatgttctgt

SEQ ID NO: 2379298 - DNA, 23 bp, Homo sapiens
atgcataataatcctgcaaagta

SEQ ID NO: 2379299 - DNA, 16 bp, Homo sapiens
atgcatgctttccata

SEQ ID NO: 2379300 - DNA, 21 bp, Homo sapiens
atgcatgctttccatattttt

SEQ ID NO: 2379301 - DNA, 16 bp, Homo sapiens
atgctttccatatttt

SEQ ID NO: 2379302 - DNA, 18 bp, Homo sapiens
atggagttggagttcatt

SEQ ID NO: 2379303 - DNA, 23 bp, Homo sapiens
atggagttggagttcattcatat

SEQ ID NO: 2379304 - DNA, 13 bp, Homo sapiens
atgtaactgttac

SEQ ID NO: 2379305 - DNA, 14 bp, Homo sapiens
atgtaactgttacc

SEQ ID NO: 2379306 - DNA, 18 bp, Homo sapiens
atgtaactgttaccattg

SEQ ID NO: 2379307 - DNA, 21 bp, Homo sapiens
atgtaactgttaccattggaa

SEQ ID NO: 2379308 - DNA, 20 bp, Homo sapiens
atgtagcaaaccctgtcaaa

SEQ ID NO: 2379309 - DNA, 19 bp, Homo sapiens
catattagaaaactttgtt

SEQ ID NO: 2379310 - DNA, 22 bp, Homo sapiens
catattagacttctgttttcaa

SEQ ID NO: 2379311 - DNA, 19 bp, Homo sapiens
catattagcgacaacagat

SEQ ID NO: 2379312 - DNA, 20 bp, Homo sapiens
catctgagagaggctaaaat

SEQ ID NO: 2379313 - DNA, 20 bp, Homo sapiens
catgaaatgaacacaaatta

SEQ ID NO: 2379314 - DNA, 17 bp, Homo sapiens
catgatgtttttaaaat

SEQ ID NO: 2379315 - DNA, 12 bp, Homo sapiens
catgatttcaca

SEQ ID NO: 2379316 - DNA, 18 bp, Homo sapiens
catgatttcacaaatatt

SEQ ID NO: 2379317 - DNA, 22 bp, Homo sapiens
catgatttcacaaatattaaaa

SEQ ID NO: 2379318 - DNA, 16 bp, Homo sapiens
catgctttccatattt

SEQ ID NO: 2379319 - DNA, 15 bp, Homo sapiens
catgtaacactgttg

SEQ ID NO: 2379320 - DNA, 14 bp, Homo sapiens
catgtcctgtgtca

SEQ ID NO: 2379321 - DNA, 13 bp, Homo sapiens
catgttttcaaat

SEQ ID NO: 2379322 - DNA, 20 bp, Homo sapiens
catgttttcaaatggagttg

SEQ ID NO: 2379323 - DNA, 13 bp, Homo sapiens
cattaatgttgat

SEQ ID NO: 2379324 - DNA, 16 bp, Homo sapiens
cattaatgttgatttc

SEQ ID NO: 2379325 - DNA, 17 bp, Homo sapiens
cattcatattacaatat

SEQ ID NO: 2379326 - DNA, 19 bp, Homo sapiens
cattcatattacaatattt

SEQ ID NO: 2379327 - DNA, 15 bp, Homo sapiens
cattctcagtttttc

SEQ ID NO: 2379328 - DNA, 14 bp, Homo sapiens
cattgtgattattg

SEQ ID NO: 2379329 - DNA, 12 bp, Homo sapiens
catttccatgta

SEQ ID NO: 2379330 - DNA, 17 bp, Homo sapiens
catttgtcattttcatt

SEQ ID NO: 2379331 - DNA, 18 bp, Homo sapiens
catttgtcattttcatta

SEQ ID NO: 2379332 - DNA, 22 bp, Homo sapiens
cattttacagttacttttcctt

SEQ ID NO: 2379333 - DNA, 15 bp, Homo sapiens
ccaaacattaatgtt

SEQ ID NO: 2379334 - DNA, 18 bp, Homo sapiens
ccaaacattaatgttgat

SEQ ID NO: 2379335 - DNA, 21 bp, Homo sapiens
ccaaacattaatgttgatttc

SEQ ID NO: 2379336 - DNA, 14 bp, Homo sapiens
ccaaagacaaatag

SEQ ID NO: 2379337 - DNA, 15 bp, Homo sapiens
ccaaagacaaatagt

SEQ ID NO: 2379338 - DNA, 16 bp, Homo sapiens
ccaactttcaagaact

SEQ ID NO: 2379339 - DNA, 21 bp, Homo sapiens
ccaattttaacttagagcttt

SEQ ID NO: 2379340 - DNA, 21 bp, Homo sapiens
ccacagtgtaccattaaaata

SEQ ID NO: 2379341 - DNA, 17 bp, Homo sapiens
ccacttttccagtattt

SEQ ID NO: 2379342 - DNA, 19 bp, Homo sapiens
ccatattagaaaactttgt

SEQ ID NO: 2379343 - DNA, 15 bp, Homo sapiens
ccatatttttttcct

SEQ ID NO: 2379344 - DNA, 16 bp, Homo sapiens
ccatatttttttcctt

SEQ ID NO: 2379345 - DNA, 18 bp, Homo sapiens
ccattaaaatatgcacta

SEQ ID NO: 2379346 - DNA, 11 bp, Homo sapiens
ccattggaaat

SEQ ID NO: 2379347 - DNA, 13 bp, Homo sapiens
cccaaatttaatt

SEQ ID NO: 2379348 - DNA, 17 bp, Homo sapiens
cccaagttttgtgaaat

SEQ ID NO: 2379349 - DNA, 23 bp, Homo sapiens
ccctcattaaaatattgaaatct

SEQ ID NO: 2379350 - DNA, 15 bp, Homo sapiens
ccctgtcaaacatta

SEQ ID NO: 2379351 - DNA, 12 bp, Homo sapiens
ccgtaaaaactg

SEQ ID NO: 2379352 - DNA, 23 bp, Homo sapiens
cctataccatttccgtaattctt

SEQ ID NO: 2379353 - DNA, 18 bp, Homo sapiens
ccttaaaatttgaaacat

SEQ ID NO: 2379354 - DNA, 17 bp, Homo sapiens
ccttacaaatgattgct

SEQ ID NO: 2379355 - DNA, 21 bp, Homo sapiens
ccttacaaatgattgctttta

SEQ ID NO: 2379356 - DNA, 24 bp, Homo sapiens
ccttgcacacatcatctgtaagct

SEQ ID NO: 2379357 - DNA, 14 bp, Homo sapiens
ccttggctgtatgt

SEQ ID NO: 2379358 - DNA, 15 bp, Homo sapiens
ccttgtaatgtaact

SEQ ID NO: 2379359 - DNA, 18 bp, Homo sapiens
ccttgtaatgtaactgct

SEQ ID NO: 2379360 - DNA, 20 bp, Homo sapiens
cgacaacagattggatttta

SEQ ID NO: 2379361 - DNA, 18 bp, Homo sapiens
cgctaacttgcttaaatg

SEQ ID NO: 2379362 - DNA, 22 bp, Homo sapiens
cgctaacttgcttaaatgtgaa

SEQ ID NO: 2379363 - DNA, 19 bp, Homo sapiens
cggttaacaaataacaact

SEQ ID NO: 2379364 - DNA, 17 bp, Homo sapiens
cgtaaaaactgaagttc

SEQ ID NO: 2379365 - DNA, 23 bp, Homo sapiens
cgtaattcttattccatattaga

SEQ ID NO: 2379366 - DNA, 14 bp, Homo sapiens
cgtatagaagtctt

SEQ ID NO: 2379367 - DNA, 18 bp, Homo sapiens
ctaaaactgtactttgat

SEQ ID NO: 2379368 - DNA, 22 bp, Homo sapiens
ctaaaactgtactttgattcac

SEQ ID NO: 2379369 - DNA, 13 bp, Homo sapiens
ctaaaatgttttc

SEQ ID NO: 2379370 - DNA, 17 bp, Homo sapiens
ctaaaatgttttcagct

SEQ ID NO: 2379371 - DNA, 19 bp, Homo sapiens
ctaaacgtgtatgtttttc

SEQ ID NO: 2379372 - DNA, 22 bp, Homo sapiens
ctaaagtactgagcagtgatat

SEQ ID NO: 2379373 - DNA, 23 bp, Homo sapiens
ctaaagtactgagcagtgatatt

SEQ ID NO: 2379374 - DNA, 17 bp, Homo sapiens
ctaaatgttaaagatgt

SEQ ID NO: 2379375 - DNA, 16 bp, Homo sapiens
ctaacttctaaaactg

SEQ ID NO: 2379376 - DNA, 18 bp, Homo sapiens
ctaacttctaaaactgta

SEQ ID NO: 2379377 - DNA, 17 bp, Homo sapiens
ctaacttgcttaaatgt

SEQ ID NO: 2379378 - DNA, 19 bp, Homo sapiens
ctaacttgcttaaatgtga

SEQ ID NO: 2379379 - DNA, 14 bp, Homo sapiens
ctaagaaacattgg

SEQ ID NO: 2379380 - DNA, 22 bp, Homo sapiens
ctaagaaacattggaagcaggt

SEQ ID NO: 2379381 - DNA, 17 bp, Homo sapiens
ctaagaattttttattt

SEQ ID NO: 2379382 - DNA, 21 bp, Homo sapiens
ctaagatcggttaacaaataa

SEQ ID NO: 2379383 - DNA, 20 bp, Homo sapiens
ctaagtctcttttttacaaa

SEQ ID NO: 2379384 - DNA, 17 bp, Homo sapiens
ctaatgtttaagcagaa

SEQ ID NO: 2379385 - DNA, 14 bp, Homo sapiens
ctaccaactttcaa

SEQ ID NO: 2379386 - DNA, 19 bp, Homo sapiens
ctacttagcacttcagggc

SEQ ID NO: 2379387 - DNA, 19 bp, Homo sapiens
ctaggaaaagaaatctata

SEQ ID NO: 2379388 - DNA, 21 bp, Homo sapiens
ctagtaggggtaccactgaat

SEQ ID NO: 2379389 - DNA, 18 bp, Homo sapiens
ctagtgttctttctcttt

SEQ ID NO: 2379390 - DNA, 21 bp, Homo sapiens
ctataccatttccgtaattct

SEQ ID NO: 2379391 - DNA, 15 bp, Homo sapiens
ctatagaaagtgttc

SEQ ID NO: 2379392 - DNA, 17 bp, Homo sapiens
ctatagaaagtgttctg

SEQ ID NO: 2379393 - DNA, 13 bp, Homo sapiens
ctatgcaaataaa

SEQ ID NO: 2379394 - DNA, 13 bp, Homo sapiens
ctatgtcatttca

SEQ ID NO: 2379395 - DNA, 18 bp, Homo sapiens
ctattttccttaatcaaa

SEQ ID NO: 2379396 - DNA, 14 bp, Homo sapiens
ctcaaccaaatggt

SEQ ID NO: 2379397 - DNA, 18 bp, Homo sapiens
ctcacaaatgaaacctga

SEQ ID NO: 2379398 - DNA, 12 bp, Homo sapiens
ctcagtttttct

SEQ ID NO: 2379399 - DNA, 14 bp, Homo sapiens
ctcagtttttctta

SEQ ID NO: 2379400 - DNA, 12 bp, Homo sapiens
ctctaagatgtt

SEQ ID NO: 2379401 - DNA, 19 bp, Homo sapiens
ctctaagatgttatatttt

SEQ ID NO: 2379402 - DNA, 23 bp, Homo sapiens
ctctaagatgttatatttttctt

SEQ ID NO: 2379403 - DNA, 13 bp, Homo sapiens
ctctgatgtattt

SEQ ID NO: 2379404 - DNA, 17 bp, Homo sapiens
ctctgctaaattgatgt

SEQ ID NO: 2379405 - DNA, 18 bp, Homo sapiens
ctctgtacatattagcga

SEQ ID NO: 2379406 - DNA, 20 bp, Homo sapiens
ctcttaaaagaggaaaatga

SEQ ID NO: 2379407 - DNA, 15 bp, Homo sapiens
ctcttgggcaatatt

SEQ ID NO: 2379408 - DNA, 20 bp, Homo sapiens
ctcttgggcaatattctctg

SEQ ID NO: 2379409 - DNA, 11 bp, Homo sapiens
ctgaaatgtgt

SEQ ID NO: 2379410 - DNA, 13 bp, Homo sapiens
ctgaaatgtgtgt

SEQ ID NO: 2379411 - DNA, 17 bp, Homo sapiens
ctgaaatgtgtgtgatg

SEQ ID NO: 2379412 - DNA, 22 bp, Homo sapiens
ctgaaatgtgtgtgatgtgaca

SEQ ID NO: 2379413 - DNA, 16 bp, Homo sapiens
ctgaagattgtttatc

SEQ ID NO: 2379414 - DNA, 12 bp, Homo sapiens
ctgaatctgtac

SEQ ID NO: 2379415 - DNA, 19 bp, Homo sapiens
ctgagagaggctaaaatgt

SEQ ID NO: 2379416 - DNA, 17 bp, Homo sapiens
ctgatgaccaattttaa

SEQ ID NO: 2379417 - DNA, 15 bp, Homo sapiens
ctgcacatgatttca

SEQ ID NO: 2379418 - DNA, 21 bp, Homo sapiens
ctgcacatgatttcacaaata

SEQ ID NO: 2379419 - DNA, 22 bp, Homo sapiens
ctgcataattctgaagttatat

SEQ ID NO: 2379420 - DNA, 23 bp, Homo sapiens
ctgcataattctgaagttatatt

SEQ ID NO: 2379421 - DNA, 14 bp, Homo sapiens
ctgctaaattgatg

SEQ ID NO: 2379422 - DNA, 17 bp, Homo sapiens
taagcagaattggaaaa

SEQ ID NO: 2379423 - DNA, 13 bp, Homo sapiens
taagctaggaaaa

SEQ ID NO: 2379424 - DNA, 20 bp, Homo sapiens
taagctaggaaaagaaatct

SEQ ID NO: 2379425 - DNA, 21 bp, Homo sapiens
taagctgtttggttttaaaat

SEQ ID NO: 2379426 - DNA, 16 bp, Homo sapiens
taaggagatataatat

SEQ ID NO: 2379427 - DNA, 13 bp, Homo sapiens
taagtgaaattta

SEQ ID NO: 2379428 - DNA, 12 bp, Homo sapiens
taagttggaaac

SEQ ID NO: 2379429 - DNA, 13 bp, Homo sapiens
taagttggaaaca

SEQ ID NO: 2379430 - DNA, 15 bp, Homo sapiens
taagttggaaacact

SEQ ID NO: 2379431 - DNA, 17 bp, Homo sapiens
taagttggaaacactaa

SEQ ID NO: 2379432 - DNA, 18 bp, Homo sapiens
taagttggaaacactaaa

SEQ ID NO: 2379433 - DNA, 21 bp, Homo sapiens
taagttggaaacactaaatgt

SEQ ID NO: 2379434 - DNA, 14 bp, Homo sapiens
taatatagcctgta

SEQ ID NO: 2379435 - DNA, 12 bp, Homo sapiens
taatcatattag

SEQ ID NO: 2379436 - DNA, 14 bp, Homo sapiens
taatcatattagac

SEQ ID NO: 2379437 - DNA, 21 bp, Homo sapiens
taatgtaactgctcttgggca

SEQ ID NO: 2379438 - DNA, 18 bp, Homo sapiens
taatgttgatttctagtt

SEQ ID NO: 2379439 - DNA, 16 bp, Homo sapiens
taattctgaagttata

SEQ ID NO: 2379440 - DNA, 19 bp, Homo sapiens
taattcttattccatatta

SEQ ID NO: 2379441 - DNA, 20 bp, Homo sapiens
taatttggaccattttcctg

SEQ ID NO: 2379442 - DNA, 19 bp, Homo sapiens
taattttgatatattcaaa

SEQ ID NO: 2379443 - DNA, 20 bp, Homo sapiens
taattttgatatattcaaag

SEQ ID NO: 2379444 - DNA, 11 bp, Homo sapiens
taattttgtct

SEQ ID NO: 2379445 - DNA, 12 bp, Homo sapiens
taatttttctgt

SEQ ID NO: 2379446 - DNA, 20 bp, Homo sapiens
tacaaaaccacagtgtacca

SEQ ID NO: 2379447 - DNA, 23 bp, Homo sapiens
tacaaaaccacagtgtaccatta

SEQ ID NO: 2379448 - DNA, 18 bp, Homo sapiens
tacaaaatgtaactgtta

SEQ ID NO: 2379449 - DNA, 14 bp, Homo sapiens
tacaaacaagcata

SEQ ID NO: 2379450 - DNA, 15 bp, Homo sapiens
tacaaacaagcatat

SEQ ID NO: 2379451 - DNA, 17 bp, Homo sapiens
tacaaacaagcatataa

SEQ ID NO: 2379452 - DNA, 20 bp, Homo sapiens
tacagatctgtttattctgt

SEQ ID NO: 2379453 - DNA, 15 bp, Homo sapiens
tacagttacttttcc

SEQ ID NO: 2379454 - DNA, 21 bp, Homo sapiens
tacatattagcgacaacagat

SEQ ID NO: 2379455 - DNA, 15 bp, Homo sapiens
tacattctcagtttt

SEQ ID NO: 2379456 - DNA, 13 bp, Homo sapiens
taccaactttcaa

SEQ ID NO: 2379457 - DNA, 15 bp, Homo sapiens
taccactgaatctgt

SEQ ID NO: 2379458 - DNA, 20 bp, Homo sapiens
taccactgaatctgtacaga

SEQ ID NO: 2379459 - DNA, 15 bp, Homo sapiens
taccattaaaatatg

SEQ ID NO: 2379460 - DNA, 17 bp, Homo sapiens
taccattaaaatatgca

SEQ ID NO: 2379461 - DNA, 20 bp, Homo sapiens
taccatttccgtaattctta

SEQ ID NO: 2379462 - DNA, 12 bp, Homo sapiens
taccttaaaatt

SEQ ID NO: 2379463 - DNA, 23 bp, Homo sapiens
taccttgcacacatcatctgtaa

SEQ ID NO: 2379464 - DNA, 17 bp, Homo sapiens
tactaacttctaaaact

SEQ ID NO: 2379465 - DNA, 19 bp, Homo sapiens
tactagttagcatacacat

SEQ ID NO: 2379466 - DNA, 15 bp, Homo sapiens
tactgagcagtgata

SEQ ID NO: 2379467 - DNA, 18 bp, Homo sapiens
tactttatagaagaatgc

SEQ ID NO: 2379468 - DNA, 20 bp, Homo sapiens
tactttgattcacatgtttt

SEQ ID NO: 2379469 - DNA, 21 bp, Homo sapiens
tactttgtctaagaaacattg

SEQ ID NO: 2379470 - DNA, 15 bp, Homo sapiens
tacttttccttgcat

SEQ ID NO: 2379471 - DNA, 20 bp, Homo sapiens
tagaaagtgttctgttacaa

SEQ ID NO: 2379472 - DNA, 21 bp, Homo sapiens
tagaaagtgttctgttacaaa

SEQ ID NO: 2379473 - DNA, 15 bp, Homo sapiens
tagaagtcttcatga

SEQ ID NO: 2379474 - DNA, 24 bp, Homo sapiens
tagaagtcttcatgaaatgctatg

SEQ ID NO: 2379475 - DNA, 16 bp, Homo sapiens
tagaatgaccttgtaa

SEQ ID NO: 2379476 - DNA, 18 bp, Homo sapiens
tagacaggagaagaaaga

SEQ ID NO: 2379477 - DNA, 19 bp, Homo sapiens
tagacaggagaagaaagaa

SEQ ID NO: 2379478 - DNA, 16 bp, Homo sapiens
tagacttctgttttca

SEQ ID NO: 2379479 - DNA, 17 bp, Homo sapiens
tagacttctgttttcaa

SEQ ID NO: 2379480 - DNA, 14 bp, Homo sapiens
tagataaaattgaa

SEQ ID NO: 2379481 - DNA, 14 bp, Homo sapiens
tagatgtaaatttt

SEQ ID NO: 2379482 - DNA, 13 bp, Homo sapiens
tagcaaaaaaagt

SEQ ID NO: 2379483 - DNA, 20 bp, Homo sapiens
tagcaaaaaaagttgtatga

SEQ ID NO: 2379484 - DNA, 23 bp, Homo sapiens
tagcaaaaaaagttgtatgatct

SEQ ID NO: 2379485 - DNA, 17 bp, Homo sapiens
tagcaaaccctgtcaaa

SEQ ID NO: 2379486 - DNA, 14 bp, Homo sapiens
tagcatacacattt

SEQ ID NO: 2379487 - DNA, 16 bp, Homo sapiens
tagcatacacatttta

SEQ ID NO: 2379488 - DNA, 19 bp, Homo sapiens
tagcgacaacagattggat

SEQ ID NO: 2379489 - DNA, 13 bp, Homo sapiens
taggaacaaatct

SEQ ID NO: 2379490 - DNA, 14 bp, Homo sapiens
taggaacaaatctt

SEQ ID NO: 2379491 - DNA, 18 bp, Homo sapiens
taggaaggtcatttccat

SEQ ID NO: 2379492 - DNA, 23 bp, Homo sapiens
taggaatattatatttggatgca

SEQ ID NO: 2379493 - DNA, 17 bp, Homo sapiens
taggcaagatggcacag

SEQ ID NO: 2379494 - DNA, 16 bp, Homo sapiens
taggcagtataaagaa

SEQ ID NO: 2379495 - DNA, 18 bp, Homo sapiens
taggccaaagacaaatag

SEQ ID NO: 2379496 - DNA, 19 bp, Homo sapiens
taggccaaagacaaatagt

SEQ ID NO: 2379497 - DNA, 15 bp, Homo sapiens
tagtactttatagaa

SEQ ID NO: 2379498 - DNA, 17 bp, Homo sapiens
tagtaggggtaccactg

SEQ ID NO: 2379499 - DNA, 20 bp, Homo sapiens
tagtaggggtaccactgaat

SEQ ID NO: 2379500 - DNA, 12 bp, Homo sapiens
tagtatttgaaa

SEQ ID NO: 2379501 - DNA, 17 bp, Homo sapiens
tagtgcaatatattttg

SEQ ID NO: 2379502 - DNA, 23 bp, Homo sapiens
tagtgcaatatattttgtatgca

SEQ ID NO: 2379503 - DNA, 20 bp, Homo sapiens
tagtggaccctgaaatgtgt

SEQ ID NO: 2379504 - DNA, 14 bp, Homo sapiens
tagttaagaattga

SEQ ID NO: 2379505 - DNA, 17 bp, Homo sapiens
tagttttattttctaaa

SEQ ID NO: 2379506 - DNA, 20 bp, Homo sapiens
tataaaatggcaacaaactg

SEQ ID NO: 2379507 - DNA, 22 bp, Homo sapiens
tataaaatggcaacaaactgca

SEQ ID NO: 2379508 - DNA, 11 bp, Homo sapiens
tatagaaagtg

SEQ ID NO: 2379509 - DNA, 20 bp, Homo sapiens
tatagaaagtgttctgttac

SEQ ID NO: 2379510 - DNA, 13 bp, Homo sapiens
tatagaagaatgc

SEQ ID NO: 2379511 - DNA, 18 bp, Homo sapiens
tatagaagaatgcatgct

SEQ ID NO: 2379512 - DNA, 16 bp, Homo sapiens
tatagaagtcttcatg

SEQ ID NO: 2379513 - DNA, 18 bp, Homo sapiens
tatagacaggagaagaaa

SEQ ID NO: 2379514 - DNA, 21 bp, Homo sapiens
tatagacaggagaagaaagaa

SEQ ID NO: 2379515 - DNA, 14 bp, Homo sapiens
tatagtatttgaaa

SEQ ID NO: 2379516 - DNA, 22 bp, Homo sapiens
tatagtatttgaaaacagaaat

SEQ ID NO: 2379517 - DNA, 15 bp, Homo sapiens
tatatagcatttatg

SEQ ID NO: 2379518 - DNA, 15 bp, Homo sapiens
tatattttgtatgca

SEQ ID NO: 2379519 - DNA, 17 bp, Homo sapiens
tatatttttcttaaaaa

SEQ ID NO: 2379520 - DNA, 16 bp, Homo sapiens
tatctaccaactttca

SEQ ID NO: 2379521 - DNA, 17 bp, Homo sapiens
tatctagatgtaaattt

SEQ ID NO: 2379522 - DNA, 23 bp, Homo sapiens
tatgcaagcagtttcaataaagt

SEQ ID NO: 2379523 - DNA, 14 bp, Homo sapiens
tatggtaatcatat

SEQ ID NO: 2379524 - DNA, 17 bp, Homo sapiens
tatggtctaatgtttaa

SEQ ID NO: 2379525 - DNA, 13 bp, Homo sapiens
tatgtcatttcat

SEQ ID NO: 2379526 - DNA, 16 bp, Homo sapiens
tatgttgacatttgtt

SEQ ID NO: 2379527 - DNA, 11 bp, Homo sapiens
tatgtttttca

SEQ ID NO: 2379528 - DNA, 14 bp, Homo sapiens
tatgtttttcagtt

SEQ ID NO: 2379529 - DNA, 15 bp, Homo sapiens
tatgtttttcagttc

SEQ ID NO: 2379530 - DNA, 18 bp, Homo sapiens
tatgtttttcagttcaaa

SEQ ID NO: 2379531 - DNA, 12 bp, Homo sapiens
tattaaaaagtc

SEQ ID NO: 2379532 - DNA, 19 bp, Homo sapiens
tattaaaaagtcttttaaa

SEQ ID NO: 2379533 - DNA, 16 bp, Homo sapiens
tattaaagtttcaaaa

SEQ ID NO: 2379534 - DNA, 15 bp, Homo sapiens
tattacaatatttgt

SEQ ID NO: 2379535 - DNA, 19 bp, Homo sapiens
tattacaatatttgtgtgc

SEQ ID NO: 2379536 - DNA, 19 bp, Homo sapiens
ttaagctaggaaaagaaat

SEQ ID NO: 2379537 - DNA, 15 bp, Homo sapiens
ttaagtgaaatttat

SEQ ID NO: 2379538 - DNA, 22 bp, Homo sapiens
ttaatgtattgttctcatgtaa

SEQ ID NO: 2379539 - DNA, 14 bp, Homo sapiens
ttaatgttgatttc

SEQ ID NO: 2379540 - DNA, 21 bp, Homo sapiens
ttaatttggaccattttcctg

SEQ ID NO: 2379541 - DNA, 16 bp, Homo sapiens
ttacaaaatgtaactg

SEQ ID NO: 2379542 - DNA, 13 bp, Homo sapiens
ttacaatatttgt

SEQ ID NO: 2379543 - DNA, 14 bp, Homo sapiens
ttacataaacatca

SEQ ID NO: 2379544 - DNA, 18 bp, Homo sapiens
ttacatagctcaaatatt

SEQ ID NO: 2379545 - DNA, 13 bp, Homo sapiens
ttaccattggaaa

SEQ ID NO: 2379546 - DNA, 11 bp, Homo sapiens
ttactaacttc

SEQ ID NO: 2379547 - DNA, 19 bp, Homo sapiens
ttactaacttctaaaactg

SEQ ID NO: 2379548 - DNA, 19 bp, Homo sapiens
ttacttttccttgcataca

SEQ ID NO: 2379549 - DNA, 13 bp, Homo sapiens
ttagaaaactttg

SEQ ID NO: 2379550 - DNA, 19 bp, Homo sapiens
ttagacttctgttttcaat

SEQ ID NO: 2379551 - DNA, 16 bp, Homo sapiens
ttagcaaaaaaagttg

SEQ ID NO: 2379552 - DNA, 15 bp, Homo sapiens
ttaggccaaagacaa

SEQ ID NO: 2379553 - DNA, 13 bp, Homo sapiens
ttagtactttata

SEQ ID NO: 2379554 - DNA, 16 bp, Homo sapiens
ttagtactttatagaa

SEQ ID NO: 2379555 - DNA, 16 bp, Homo sapiens
ttagtaggatatgcct

SEQ ID NO: 2379556 - DNA, 19 bp, Homo sapiens
ttagtaggatatgcctgct

SEQ ID NO: 2379557 - DNA, 19 bp, Homo sapiens
ttagtggaccctgaaatgt

SEQ ID NO: 2379558 - DNA, 12 bp, Homo sapiens
ttatagaagaat

SEQ ID NO: 2379559 - DNA, 15 bp, Homo sapiens
ttatagaagaatgca

SEQ ID NO: 2379560 - DNA, 17 bp, Homo sapiens
ttatagaagaatgcatg

SEQ ID NO: 2379561 - DNA, 13 bp, Homo sapiens
ttatagtgcaata

SEQ ID NO: 2379562 - DNA, 19 bp, Homo sapiens
ttatagtgcaatatatttt

SEQ ID NO: 2379563 - DNA, 22 bp, Homo sapiens
ttatagtgcaatatattttgta

SEQ ID NO: 2379564 - DNA, 20 bp, Homo sapiens
ttatatttggatgcagagtt

SEQ ID NO: 2379565 - DNA, 14 bp, Homo sapiens
ttatatttttctta

SEQ ID NO: 2379566 - DNA, 17 bp, Homo sapiens
ttatatttttcttaaaa

SEQ ID NO: 2379567 - DNA, 20 bp, Homo sapiens
ttatatttttcttaaaaagt

SEQ ID NO: 2379568 - DNA, 14 bp, Homo sapiens
ttatctaccaactt

SEQ ID NO: 2379569 - DNA, 15 bp, Homo sapiens
ttatctagatgtaaa

SEQ ID NO: 2379570 - DNA, 10 bp, Homo sapiens
ttatgctaag

SEQ ID NO: 2379571 - DNA, 16 bp, Homo sapiens
ttatgctaagaatttt

SEQ ID NO: 2379572 - DNA, 14 bp, Homo sapiens
ttattaaagtttca

SEQ ID NO: 2379573 - DNA, 15 bp, Homo sapiens
ttattaaagtttcaa

SEQ ID NO: 2379574 - DNA, 19 bp, Homo sapiens
ttattaaagtttcaaaaat

SEQ ID NO: 2379575 - DNA, 12 bp, Homo sapiens
ttattccatatt

SEQ ID NO: 2379576 - DNA, 17 bp, Homo sapiens
ttattccatattagaaa

SEQ ID NO: 2379577 - DNA, 20 bp, Homo sapiens
ttattccatattagaaaact

SEQ ID NO: 2379578 - DNA, 19 bp, Homo sapiens
ttattctgggaatgtatag

SEQ ID NO: 2379579 - DNA, 13 bp, Homo sapiens
ttattctgtttca

SEQ ID NO: 2379580 - DNA, 18 bp, Homo sapiens
ttattgagagagatgtgt

SEQ ID NO: 2379581 - DNA, 14 bp, Homo sapiens
ttcaaaaatctgaa

SEQ ID NO: 2379582 - DNA, 16 bp, Homo sapiens
ttcaaaaatctgaaga

SEQ ID NO: 2379583 - DNA, 18 bp, Homo sapiens
ttcaaaaatctgaagatt

SEQ ID NO: 2379584 - DNA, 17 bp, Homo sapiens
ttcaaagtcatgatgtt

SEQ ID NO: 2379585 - DNA, 15 bp, Homo sapiens
ttcaagaacttgttt

SEQ ID NO: 2379586 - DNA, 20 bp, Homo sapiens
ttcaagcttattttggagag

SEQ ID NO: 2379587 - DNA, 14 bp, Homo sapiens
ttcaataaagtttg

SEQ ID NO: 2379588 - DNA, 16 bp, Homo sapiens
ttcaataaagtttgat

SEQ ID NO: 2379589 - DNA, 14 bp, Homo sapiens
ttcacaaatattaa

SEQ ID NO: 2379590 - DNA, 19 bp, Homo sapiens
ttcacaaatattaaaaagt

SEQ ID NO: 2379591 - DNA, 22 bp, Homo sapiens
ttcacaaatattaaaaagtctt

SEQ ID NO: 2379592 - DNA, 16 bp, Homo sapiens
ttcacatgttttcaaa

SEQ ID NO: 2379593 - DNA, 20 bp, Homo sapiens
ttcacatgttttcaaatgga

SEQ ID NO: 2379594 - DNA, 15 bp, Homo sapiens
ttcagatttgcacaa

SEQ ID NO: 2379595 - DNA, 19 bp, Homo sapiens
ttcagatttgcacaaaaag

SEQ ID NO: 2379596 - DNA, 21 bp, Homo sapiens
ttcagcaaggcgctaacttgc

SEQ ID NO: 2379597 - DNA, 22 bp, Homo sapiens
ttcagctaggaacaaatcttcc

SEQ ID NO: 2379598 - DNA, 20 bp, Homo sapiens
ttcagggaagataagttgga

SEQ ID NO: 2379599 - DNA, 23 bp, Homo sapiens
ttcagggcagattttagttttat

SEQ ID NO: 2379600 - DNA, 16 bp, Homo sapiens
ttcagttcaaagtcat

SEQ ID NO: 2379601 - DNA, 13 bp, Homo sapiens
ttcatattacaat

SEQ ID NO: 2379602 - DNA, 22 bp, Homo sapiens
ttcatattttaatttcaagctt

SEQ ID NO: 2379603 - DNA, 21 bp, Homo sapiens
ttcatgaaatgctatgtcatt

SEQ ID NO: 2379604 - DNA, 20 bp, Homo sapiens
ttcatgtcctgtgtcagttt

SEQ ID NO: 2379605 - DNA, 22 bp, Homo sapiens
ttcatgtcctgtgtcagtttat

SEQ ID NO: 2379606 - DNA, 12 bp, Homo sapiens
ttcattcatatt

SEQ ID NO: 2379607 - DNA, 19 bp, Homo sapiens
ttcattttacagttacttt

SEQ ID NO: 2379608 - DNA, 12 bp, Homo sapiens
ttccagtatttt

SEQ ID NO: 2379609 - DNA, 18 bp, Homo sapiens
ttcctataccatttccgt

SEQ ID NO: 2379610 - DNA, 16 bp, Homo sapiens
ttcctctgctaaattg

SEQ ID NO: 2379611 - DNA, 17 bp, Homo sapiens
ttcctctgctaaattga

SEQ ID NO: 2379612 - DNA, 23 bp, Homo sapiens
ttccttatttaagacatgtttaa

SEQ ID NO: 2379613 - DNA, 17 bp, Homo sapiens
ttccttgcatacaaaca

SEQ ID NO: 2379614 - DNA, 13 bp, Homo sapiens
ttctaaaactgta

SEQ ID NO: 2379615 - DNA, 16 bp, Homo sapiens
ttctaaaactgtactt

SEQ ID NO: 2379616 - DNA, 18 bp, Homo sapiens
ttctaaaactgtactttg

SEQ ID NO: 2379617 - DNA, 19 bp, Homo sapiens
ttctaaaactgtactttga

SEQ ID NO: 2379618 - DNA, 16 bp, Homo sapiens
ttctaaaatataacac

SEQ ID NO: 2379619 - DNA, 13 bp, Homo sapiens
ttctatgcaaata

SEQ ID NO: 2379620 - DNA, 15 bp, Homo sapiens
ttctcagtttttctt

SEQ ID NO: 2379621 - DNA, 12 bp, Homo sapiens
ttctctgtacat

SEQ ID NO: 2379622 - DNA, 15 bp, Homo sapiens
ttctgaagttatatt

SEQ ID NO: 2379623 - DNA, 16 bp, Homo sapiens
ttctgcctctgatgta

SEQ ID NO: 2379624 - DNA, 22 bp, Homo sapiens
ttctgcctctgatgtattttgt

SEQ ID NO: 2379625 - DNA, 18 bp, Homo sapiens
ttctgtatagacaggaga

SEQ ID NO: 2379626 - DNA, 23 bp, Homo sapiens
ttctgtatagacaggagaagaaa

SEQ ID NO: 2379627 - DNA, 15 bp, Homo sapiens
ttctgttacaaaatg

SEQ ID NO: 2379628 - DNA, 13 bp, Homo sapiens
ttcttaaaaagta

SEQ ID NO: 2379629 - DNA, 14 bp, Homo sapiens
ttcttaaaaagtaa

SEQ ID NO: 2379630 - DNA, 15 bp, Homo sapiens
ttctttgaattttca

SEQ ID NO: 2379631 - DNA, 15 bp, Homo sapiens
ttgaaaacagaaatt

SEQ ID NO: 2379632 - DNA, 19 bp, Homo sapiens
ttgaaacattgcttttaaa

SEQ ID NO: 2379633 - DNA, 20 bp, Homo sapiens
ttgaaatatatggtctaatg

SEQ ID NO: 2379634 - DNA, 22 bp, Homo sapiens
ttgaaatatatggtctaatgtt

SEQ ID NO: 2379635 - DNA, 23 bp, Homo sapiens
ttgaaatatatggtctaatgttt

SEQ ID NO: 2379636 - DNA, 21 bp, Homo sapiens
ttgagagagatgtgtaatttt

SEQ ID NO: 2379637 - DNA, 22 bp, Homo sapiens
ttgagagagatgtgtaattttt

SEQ ID NO: 2379638 - DNA, 23 bp, Homo sapiens
ttgagagagatgtgtaatttttc

SEQ ID NO: 2379639 - DNA, 13 bp, Homo sapiens
ttgataaatagtg

SEQ ID NO: 2379640 - DNA, 16 bp, Homo sapiens
ttgatgttgatgcaat

SEQ ID NO: 2379641 - DNA, 22 bp, Homo sapiens
ttgatttctagttatttattct

SEQ ID NO: 2379642 - DNA, 22 bp, Homo sapiens
ttgcacaaaaagataccttaaa

SEQ ID NO: 2379643 - DNA, 15 bp, Homo sapiens
ttgcacacatcatct

SEQ ID NO: 2379644 - DNA, 17 bp, Homo sapiens
ttgcacacatcatctgt

SEQ ID NO: 2379645 - DNA, 18 bp, Homo sapiens
ttgcacacatcatctgta

SEQ ID NO: 2379646 - DNA, 19 bp, Homo sapiens
ttgcacacatcatctgtaa

SEQ ID NO: 2379647 - DNA, 20 bp, Homo sapiens
ttgcacacatcatctgtaag

SEQ ID NO: 2379648 - DNA, 11 bp, Homo sapiens
ttgcactgaag

SEQ ID NO: 2379649 - DNA, 16 bp, Homo sapiens
atttccgtaattctta

SEQ ID NO: 2379650 - DNA, 18 bp, Homo sapiens
atttccgtaattcttatt

SEQ ID NO: 2379651 - DNA, 17 bp, Homo sapiens
atttgaaaacagaaatt

SEQ ID NO: 2379652 - DNA, 20 bp, Homo sapiens
atttgaaaacagaaattggt

SEQ ID NO: 2379653 - DNA, 19 bp, Homo sapiens
atttgaaacattgctttta

SEQ ID NO: 2379654 - DNA, 18 bp, Homo sapiens
atttgcacaaaaagatac

SEQ ID NO: 2379655 - DNA, 17 bp, Homo sapiens
atttggaccattttcct

SEQ ID NO: 2379656 - DNA, 17 bp, Homo sapiens
atttgtcattttcatta

SEQ ID NO: 2379657 - DNA, 21 bp, Homo sapiens
atttgtcattttcattagcaa

SEQ ID NO: 2379658 - DNA, 18 bp, Homo sapiens
attttaatttcaagctta

SEQ ID NO: 2379659 - DNA, 21 bp, Homo sapiens
attttagtggaccctgaaatg

SEQ ID NO: 2379660 - DNA, 21 bp, Homo sapiens
attttagttttattttctaaa

SEQ ID NO: 2379661 - DNA, 14 bp, Homo sapiens
attttatgttgaca

SEQ ID NO: 2379662 - DNA, 22 bp, Homo sapiens
attttatgttgacatttgtttg

SEQ ID NO: 2379663 - DNA, 20 bp, Homo sapiens
attttcagatttgcacaaaa

SEQ ID NO: 2379664 - DNA, 13 bp, Homo sapiens
attttcattagca

SEQ ID NO: 2379665 - DNA, 15 bp, Homo sapiens
attttctaaagtact

SEQ ID NO: 2379666 - DNA, 20 bp, Homo sapiens
attttgtatgcaagcagttt

SEQ ID NO: 2379667 - DNA, 12 bp, Homo sapiens
atttttcatatt

SEQ ID NO: 2379668 - DNA, 20 bp, Homo sapiens
atttttcttaaaaagtaact

SEQ ID NO: 2379669 - DNA, 16 bp, Homo sapiens
atttttcttgtttcct

SEQ ID NO: 2379670 - DNA, 22 bp, Homo sapiens
aatgtttaagcagaattggaaa

SEQ ID NO: 2379671 - DNA, 14 bp, Homo sapiens
aatgttttcagcta

SEQ ID NO: 2379672 - DNA, 13 bp, Homo sapiens
aatgttttgtaaa

SEQ ID NO: 2379673 - DNA, 15 bp, Homo sapiens
aatgttttgtaaact

SEQ ID NO: 2379674 - DNA, 20 bp, Homo sapiens
aatgttttgtaaactttgaa

SEQ ID NO: 2379675 - DNA, 20 bp, Homo sapiens
aattaaccaaggtagaatga

SEQ ID NO: 2379676 - DNA, 13 bp, Homo sapiens
aattactaacttc

SEQ ID NO: 2379677 - DNA, 18 bp, Homo sapiens
aattatctgccttataca

SEQ ID NO: 2379678 - DNA, 15 bp, Homo sapiens
aattctgaagttata

SEQ ID NO: 2379679 - DNA, 22 bp, Homo sapiens
aattcttattccatattagaaa

SEQ ID NO: 2379680 - DNA, 13 bp, Homo sapiens
aattgaagctttt

SEQ ID NO: 2379681 - DNA, 19 bp, Homo sapiens
aatttattgaggaaaaata

SEQ ID NO: 2379682 - DNA, 15 bp, Homo sapiens
aatttcaagcttatt

SEQ ID NO: 2379683 - DNA, 10 bp, Homo sapiens
aattttcatt

SEQ ID NO: 2379684 - DNA, 12 bp, Homo sapiens
aattttcatttt

SEQ ID NO: 2379685 - DNA, 21 bp, Homo sapiens
aatttttctgtatagacagga

SEQ ID NO: 2379686 - DNA, 20 bp, Homo sapiens
acaaaaagataccttaaaat

SEQ ID NO: 2379687 - DNA, 14 bp, Homo sapiens
acaaaatgtaactg

SEQ ID NO: 2379688 - DNA, 20 bp, Homo sapiens
acaaaatgtaactgttacca

SEQ ID NO: 2379689 - DNA, 20 bp, Homo sapiens
acaaactgcacatgatttca

SEQ ID NO: 2379690 - DNA, 15 bp, Homo sapiens
acaaataacaacttt

SEQ ID NO: 2379691 - DNA, 22 bp, Homo sapiens
acaaataacaacttttttttct

SEQ ID NO: 2379692 - DNA, 18 bp, Homo sapiens
acaaatattaaaaagtct

SEQ ID NO: 2379693 - DNA, 20 bp, Homo sapiens
acaacttttttttctttttt

SEQ ID NO: 2379694 - DNA, 12 bp, Homo sapiens
acaatatttgtg

SEQ ID NO: 2379695 - DNA, 14 bp, Homo sapiens
acaatatttgtgtg

SEQ ID NO: 2379696 - DNA, 19 bp, Homo sapiens
acaatatttgtgtgctaaa

SEQ ID NO: 2379697 - DNA, 21 bp, Homo sapiens
acaattttcagatttgcacaa

SEQ ID NO: 2379698 - DNA, 16 bp, Homo sapiens
acacaaattatgctaa

SEQ ID NO: 2379699 - DNA, 21 bp, Homo sapiens
acacaaattatgctaagaatt

SEQ ID NO: 2379700 - DNA, 15 bp, Homo sapiens
acacatcatctgtaa

SEQ ID NO: 2379701 - DNA, 18 bp, Homo sapiens
acactaaatgttaaagat

SEQ ID NO: 2379702 - DNA, 20 bp, Homo sapiens
acagaaattggtaccttgca

SEQ ID NO: 2379703 - DNA, 23 bp, Homo sapiens
acagaaattggtaccttgcacac

SEQ ID NO: 2379704 - DNA, 15 bp, Homo sapiens
acagattggatttta

SEQ ID NO: 2379705 - DNA, 14 bp, Homo sapiens
acagccattttgtt

SEQ ID NO: 2379706 - DNA, 17 bp, Homo sapiens
acaggagaagaaagaac

SEQ ID NO: 2379707 - DNA, 18 bp, Homo sapiens
acagtgtaccattaaaat

SEQ ID NO: 2379708 - DNA, 14 bp, Homo sapiens
acagttacttttcc

SEQ ID NO: 2379709 - DNA, 16 bp, Homo sapiens
acagttacttttcctt

SEQ ID NO: 2379710 - DNA, 20 bp, Homo sapiens
acagttacttttccttgcat

SEQ ID NO: 2379711 - DNA, 23 bp, Homo sapiens
acagttacttttccttgcataca

SEQ ID NO: 2379712 - DNA, 12 bp, Homo sapiens
acataaacatca

SEQ ID NO: 2379713 - DNA, 17 bp, Homo sapiens
acatgatttcacaaata

SEQ ID NO: 2379714 - DNA, 11 bp, Homo sapiens
acatgttttca

SEQ ID NO: 2379715 - DNA, 23 bp, Homo sapiens
acattaactaattcaattcatgt

SEQ ID NO: 2379716 - DNA, 14 bp, Homo sapiens
acattaatgttgat

SEQ ID NO: 2379717 - DNA, 18 bp, Homo sapiens
acattaatgttgatttct

SEQ ID NO: 2379718 - DNA, 23 bp, Homo sapiens
acattaatgttgatttctagtta

SEQ ID NO: 2379719 - DNA, 22 bp, Homo sapiens
acattagtactttatagaagaa

SEQ ID NO: 2379720 - DNA, 13 bp, Homo sapiens
acattctcagttt

SEQ ID NO: 2379721 - DNA, 14 bp, Homo sapiens
acattctcagtttt

SEQ ID NO: 2379722 - DNA, 15 bp, Homo sapiens
acattctcagttttt

SEQ ID NO: 2379723 - DNA, 15 bp, Homo sapiens
acattggaagcaggt

SEQ ID NO: 2379724 - DNA, 22 bp, Homo sapiens
acattggaagcaggttaaatgt

SEQ ID NO: 2379725 - DNA, 13 bp, Homo sapiens
acattgtgattat

SEQ ID NO: 2379726 - DNA, 23 bp, Homo sapiens
acatttgtcattttcattagcaa

SEQ ID NO: 2379727 - DNA, 13 bp, Homo sapiens
accaaatggtaca

SEQ ID NO: 2379728 - DNA, 20 bp, Homo sapiens
accaactgtgatgtcactga

SEQ ID NO: 2379729 - DNA, 13 bp, Homo sapiens
accaactttcaag

SEQ ID NO: 2379730 - DNA, 20 bp, Homo sapiens
accaactttcaagaacttgt

SEQ ID NO: 2379731 - DNA, 23 bp, Homo sapiens
accaaggtagaatgaccttgtaa

SEQ ID NO: 2379732 - DNA, 14 bp, Homo sapiens
accactgaatctgt

SEQ ID NO: 2379733 - DNA, 14 bp, Homo sapiens
accattaaaatatg

SEQ ID NO: 2379734 - DNA, 15 bp, Homo sapiens
accattggaaatttc

SEQ ID NO: 2379735 - DNA, 15 bp, Homo sapiens
acccaagctccaacc

SEQ ID NO: 2379736 - DNA, 12 bp, Homo sapiens
accttaaaattt

SEQ ID NO: 2379737 - DNA, 15 bp, Homo sapiens
accttaaaatttgaa

SEQ ID NO: 2379738 - DNA, 21 bp, Homo sapiens
accttaaaatttgaaacattg

SEQ ID NO: 2379739 - DNA, 14 bp, Homo sapiens
accttcactctaag

SEQ ID NO: 2379740 - DNA, 21 bp, Homo sapiens
accttcactctaagatgttat

SEQ ID NO: 2379741 - DNA, 14 bp, Homo sapiens
accttgcacacatc

SEQ ID NO: 2379742 - DNA, 14 bp, Homo sapiens
accttgtaatgtaa

SEQ ID NO: 2379743 - DNA, 16 bp, Homo sapiens
accttgtaatgtaact

SEQ ID NO: 2379744 - DNA, 15 bp, Homo sapiens
actaaatgttaaaga

SEQ ID NO: 2379745 - DNA, 18 bp, Homo sapiens
actaaatgttaaagatgt

SEQ ID NO: 2379746 - DNA, 19 bp, Homo sapiens
actaaatgttaaagatgta

SEQ ID NO: 2379747 - DNA, 13 bp, Homo sapiens
actaacttctaaa

SEQ ID NO: 2379748 - DNA, 19 bp, Homo sapiens
actaacttctaaaactgta

SEQ ID NO: 2379749 - DNA, 19 bp, Homo sapiens
actaagatcggttaacaaa

SEQ ID NO: 2379750 - DNA, 20 bp, Homo sapiens
actaagtctcttttttacaa

SEQ ID NO: 2379751 - DNA, 13 bp, Homo sapiens
actatcttcatct

SEQ ID NO: 2379752 - DNA, 15 bp, Homo sapiens
actcaaccaaatggt

SEQ ID NO: 2379753 - DNA, 14 bp, Homo sapiens
actctaagatgtta

SEQ ID NO: 2379754 - DNA, 13 bp, Homo sapiens
actgaatctgtac

SEQ ID NO: 2379755 - DNA, 21 bp, Homo sapiens
actgatgttgtgttagttaag

SEQ ID NO: 2379756 - DNA, 17 bp, Homo sapiens
actgcacatgatttcac

SEQ ID NO: 2379757 - DNA, 22 bp, Homo sapiens
actgtactttgattcacatgtt

SEQ ID NO: 2379758 - DNA, 13 bp, Homo sapiens
actgttaccattg

SEQ ID NO: 2379759 - DNA, 17 bp, Homo sapiens
acttaattgaagctttt

SEQ ID NO: 2379760 - DNA, 22 bp, Homo sapiens
acttagagctttttttttttaa

SEQ ID NO: 2379761 - DNA, 16 bp, Homo sapiens
acttcagggcagattt

SEQ ID NO: 2379762 - DNA, 17 bp, Homo sapiens
acttcagggcagatttt

SEQ ID NO: 2379763 - DNA, 14 bp, Homo sapiens
acttctaaaactgt

SEQ ID NO: 2379764 - DNA, 15 bp, Homo sapiens
acttctaaaactgta

SEQ ID NO: 2379765 - DNA, 16 bp, Homo sapiens
acttctgttttcaatc

SEQ ID NO: 2379766 - DNA, 17 bp, Homo sapiens
acttgcttaaatgtgaa

SEQ ID NO: 2379767 - DNA, 18 bp, Homo sapiens
acttgcttaaatgtgaat

SEQ ID NO: 2379768 - DNA, 13 bp, Homo sapiens
acttgtttaataa

SEQ ID NO: 2379769 - DNA, 23 bp, Homo sapiens
acttgtttttgtttttgttttgt

SEQ ID NO: 2379770 - DNA, 16 bp, Homo sapiens
actttcaagaacttgt

SEQ ID NO: 2379771 - DNA, 19 bp, Homo sapiens
actttgattcacatgtttt

SEQ ID NO: 2379772 - DNA, 20 bp, Homo sapiens
actttgtctaagaaacattg

SEQ ID NO: 2379773 - DNA, 14 bp, Homo sapiens
acttttccagtatt

SEQ ID NO: 2379774 - DNA, 15 bp, Homo sapiens
acttttccagtattt

SEQ ID NO: 2379775 - DNA, 18 bp, Homo sapiens
acttttccagtattttag

SEQ ID NO: 2379776 - DNA, 19 bp, Homo sapiens
acttttccagtattttagt

SEQ ID NO: 2379777 - DNA, 14 bp, Homo sapiens
acttttccttgcat

SEQ ID NO: 2379778 - DNA, 12 bp, Homo sapiens
agaaaactttgt

SEQ ID NO: 2379779 - DNA, 20 bp, Homo sapiens
agaaaactttgttaggccaa

SEQ ID NO: 2379780 - DNA, 14 bp, Homo sapiens
agaaacattggaag

SEQ ID NO: 2379781 - DNA, 16 bp, Homo sapiens
agaaacattggaagca

SEQ ID NO: 2379782 - DNA, 14 bp, Homo sapiens
agaaagtgttctgt

SEQ ID NO: 2379783 - DNA, 18 bp, Homo sapiens
agaaagtgttctgttaca

SEQ ID NO: 2379784 - DNA, 15 bp, Homo sapiens
tgtaccattaaaata

SEQ ID NO: 2379785 - DNA, 23 bp, Homo sapiens
tgtaccattaaaatatgcactaa

SEQ ID NO: 2379786 - DNA, 15 bp, Homo sapiens
tgtagcaaaccctgt

SEQ ID NO: 2379787 - DNA, 16 bp, Homo sapiens
taagttggaaacacta

SEQ ID NO: 2379788 - DNA, 23 bp, Homo sapiens
taagttggaaacactaaatgtta

SEQ ID NO: 2379789 - DNA, 17 bp, Homo sapiens
taataaagcgaaaaact

SEQ ID NO: 2379790 - DNA, 19 bp, Homo sapiens
ttcacatgttttcaaatgg

SEQ ID NO: 2379791 - DNA, 19 bp, Homo sapiens
ttcacgtcataggaagtta

SEQ ID NO: 2379792 - DNA, 17 bp, Homo sapiens
ttcactctaagatgtta

SEQ ID NO: 2379793 - DNA, 22 bp, Homo sapiens
ttcactctaagatgttatattt

SEQ ID NO: 2379794 - DNA, 17 bp, Homo sapiens
ttcagatttgcacaaaa

SEQ ID NO: 2379795 - DNA, 18 bp, Homo sapiens
ttcagatttgcacaaaaa

SEQ ID NO: 2379796 - DNA, 14 bp, Homo sapiens
ttcagctaggaaca

SEQ ID NO: 2379797 - DNA, 21 bp, Homo sapiens
ttcagggaagataagttggaa

SEQ ID NO: 2379798 - DNA, 18 bp, Homo sapiens
ttcagggcagattttagt

SEQ ID NO: 2379799 - DNA, 20 bp, Homo sapiens
ttcagggcagattttagttt

SEQ ID NO: 2379800 - DNA, 13 bp, Homo sapiens
ttcagttcaaagt

SEQ ID NO: 2379801 - DNA, 17 bp, Homo sapiens
ttcagttcaaagtcatg

SEQ ID NO: 2379802 - DNA, 22 bp, Homo sapiens
ttcagttcaaagtcatgatgtt

SEQ ID NO: 2379803 - DNA, 15 bp, Homo sapiens
ttcatattacaatat

SEQ ID NO: 2379804 - DNA, 16 bp, Homo sapiens
ttcatattacaatatt

SEQ ID NO: 2379805 - DNA, 19 bp, Homo sapiens
ttcatatttaatatatgtg

SEQ ID NO: 2379806 - DNA, 20 bp, Homo sapiens
ttcatattttaatttcaagc

SEQ ID NO: 2379807 - DNA, 20 bp, Homo sapiens
ttcatctgagagaggctaaa

SEQ ID NO: 2379808 - DNA, 17 bp, Homo sapiens
ttcatgtcctgtgtcag

SEQ ID NO: 2379809 - DNA, 21 bp, Homo sapiens
ttcattagcaaaaaaagttgt

SEQ ID NO: 2379810 - DNA, 13 bp, Homo sapiens
ttcattcatatta

SEQ ID NO: 2379811 - DNA, 14 bp, Homo sapiens
ttcattcatattac

SEQ ID NO: 2379812 - DNA, 18 bp, Homo sapiens
ttccatatttttttcctt

SEQ ID NO: 2379813 - DNA, 23 bp, Homo sapiens
ttccatatttttttccttacata

SEQ ID NO: 2379814 - DNA, 17 bp, Homo sapiens
ttccttacataaacatc

SEQ ID NO: 2379815 - DNA, 18 bp, Homo sapiens
ttctcagtttttcttaat

SEQ ID NO: 2379816 - DNA, 15 bp, Homo sapiens
ttctcatgtaagaat

SEQ ID NO: 2379817 - DNA, 20 bp, Homo sapiens
ttctgaagttatatttccta

SEQ ID NO: 2379818 - DNA, 14 bp, Homo sapiens
ttctgttacaaaat

SEQ ID NO: 2379819 - DNA, 16 bp, Homo sapiens
ttctgttacaaaatgt

SEQ ID NO: 2379820 - DNA, 17 bp, Homo sapiens
ttctgttacaaaatgta

SEQ ID NO: 2379821 - DNA, 22 bp, Homo sapiens
ttctgttacaaaatgtaactgt

SEQ ID NO: 2379822 - DNA, 13 bp, Homo sapiens
ttctgttttcaat

SEQ ID NO: 2379823 - DNA, 18 bp, Homo sapiens
ttcttaatatatagcatt

SEQ ID NO: 2379824 - DNA, 12 bp, Homo sapiens
ttgaaacattgc

SEQ ID NO: 2379825 - DNA, 14 bp, Homo sapiens
ttgaaacattgctt

SEQ ID NO: 2379826 - DNA, 14 bp, Homo sapiens
ttgaattttcattt

SEQ ID NO: 2379827 - DNA, 17 bp, Homo sapiens
ttgaattttcattttac

SEQ ID NO: 2379828 - DNA, 23 bp, Homo sapiens
ttgaattttcattttacagttac

SEQ ID NO: 2379829 - DNA, 13 bp, Homo sapiens
ttgagagagatgt

SEQ ID NO: 2379830 - DNA, 15 bp, Homo sapiens
ttgagagagatgtgt

SEQ ID NO: 2379831 - DNA, 18 bp, Homo sapiens
ttgagagagatgtgtaat

SEQ ID NO: 2379832 - DNA, 15 bp, Homo sapiens
ttgaggaaaaatatg

SEQ ID NO: 2379833 - DNA, 20 bp, Homo sapiens
ttgaggaaaaatatgtgaag

SEQ ID NO: 2379834 - DNA, 11 bp, Homo sapiens
ttgagtctttt

SEQ ID NO: 2379835 - DNA, 15 bp, Homo sapiens
ttgataaatagtgtt

SEQ ID NO: 2379836 - DNA, 17 bp, Homo sapiens
ttgatcttcctctgcta

SEQ ID NO: 2379837 - DNA, 19 bp, Homo sapiens
ttgatcttcctctgctaaa

SEQ ID NO: 2379838 - DNA, 18 bp, Homo sapiens
ttgattcacatgttttca

SEQ ID NO: 2379839 - DNA, 20 bp, Homo sapiens
ttgattcacatgttttcaaa

SEQ ID NO: 2379840 - DNA, 23 bp, Homo sapiens
ttgcacaaaaagataccttaaaa

SEQ ID NO: 2379841 - DNA, 12 bp, Homo sapiens
ttgcactgaagt

SEQ ID NO: 2379842 - DNA, 14 bp, Homo sapiens
ttgcatacaaacaa

SEQ ID NO: 2379843 - DNA, 19 bp, Homo sapiens
ttgccaaacattaatgttg

SEQ ID NO: 2379844 - DNA, 21 bp, Homo sapiens
ttgccaaacattaatgttgat

SEQ ID NO: 2379845 - DNA, 14 bp, Homo sapiens
ttgcttaaatgtga

SEQ ID NO: 2379846 - DNA, 14 bp, Homo sapiens
ttgcttttaaaact

SEQ ID NO: 2379847 - DNA, 13 bp, Homo sapiens
ttgcttttaaaat

SEQ ID NO: 2379848 - DNA, 15 bp, Homo sapiens
ttgcttttaaaattt

SEQ ID NO: 2379849 - DNA, 17 bp, Homo sapiens
ttggaaacactaaatgt

SEQ ID NO: 2379850 - DNA, 20 bp, Homo sapiens
ttggaaacactaaatgttaa

SEQ ID NO: 2379851 - DNA, 18 bp, Homo sapiens
ttggattttatgttgaca

SEQ ID NO: 2379852 - DNA, 21 bp, Homo sapiens
ttggccataagcaacaatttt

SEQ ID NO: 2379853 - DNA, 16 bp, Homo sapiens
ttggtaccttgcacac

SEQ ID NO: 2379854 - DNA, 14 bp, Homo sapiens
ttggtccacttttc

SEQ ID NO: 2379855 - DNA, 13 bp, Homo sapiens
ttgtaaactttga

SEQ ID NO: 2379856 - DNA, 21 bp, Homo sapiens
ttgtaaactttgaaatatatg

SEQ ID NO: 2379857 - DNA, 19 bp, Homo sapiens
ttgtatgatctgtgccttt

SEQ ID NO: 2379858 - DNA, 20 bp, Homo sapiens
ttgtcattttcattagcaaa

SEQ ID NO: 2379859 - DNA, 17 bp, Homo sapiens
ttgtctaagaaacattg

SEQ ID NO: 2379860 - DNA, 18 bp, Homo sapiens
ttgtctcctataatacca

SEQ ID NO: 2379861 - DNA, 17 bp, Homo sapiens
ttgtgaaatttttcata

SEQ ID NO: 2379862 - DNA, 21 bp, Homo sapiens
ttgttaggccaaagacaaata

SEQ ID NO: 2379863 - DNA, 21 bp, Homo sapiens
ttgttcaaactttctgccttc

SEQ ID NO: 2379864 - DNA, 15 bp, Homo sapiens
ttgttgcactgaagt

SEQ ID NO: 2379865 - DNA, 17 bp, Homo sapiens
ttgttgcactgaagttt

SEQ ID NO: 2379866 - DNA, 20 bp, Homo sapiens
ttgttgcactgaagtttgat

SEQ ID NO: 2379867 - DNA, 17 bp, Homo sapiens
ttgtttatctagatgta

SEQ ID NO: 2379868 - DNA, 21 bp, Homo sapiens
ttgtttggttatagtgcaata

SEQ ID NO: 2379869 - DNA, 12 bp, Homo sapiens
ttgttttttgaa

SEQ ID NO: 2379870 - DNA, 14 bp, Homo sapiens
ttgttttttgaagt

SEQ ID NO: 2379871 - DNA, 13 bp, Homo sapiens
tttaaaaagtatt

SEQ ID NO: 2379872 - DNA, 16 bp, Homo sapiens
tttaaaaagtattgcc

SEQ ID NO: 2379873 - DNA, 12 bp, Homo sapiens
tttaaaatactg

SEQ ID NO: 2379874 - DNA, 22 bp, Homo sapiens
tttaaaatcttattaaagtttc

SEQ ID NO: 2379875 - DNA, 14 bp, Homo sapiens
tttaaaattttaag

SEQ ID NO: 2379876 - DNA, 18 bp, Homo sapiens
tttaagcagaattggaaa

SEQ ID NO: 2379877 - DNA, 19 bp, Homo sapiens
tttaagcagaattggaaaa

SEQ ID NO: 2379878 - DNA, 20 bp, Homo sapiens
tttaagctaggaaaagaaat

SEQ ID NO: 2379879 - DNA, 13 bp, Homo sapiens
tttaagtgaaatt

SEQ ID NO: 2379880 - DNA, 13 bp, Homo sapiens
tttaatacattta

SEQ ID NO: 2379881 - DNA, 20 bp, Homo sapiens
tttaatttcaagcttatttt

SEQ ID NO: 2379882 - DNA, 19 bp, Homo sapiens
tttacagttacttttcctt

SEQ ID NO: 2379883 - DNA, 21 bp, Homo sapiens
tttacagttacttttccttgc

SEQ ID NO: 2379884 - DNA, 21 bp, Homo sapiens
tttagataaaattgaagtact

SEQ ID NO: 2379885 - DNA, 18 bp, Homo sapiens
tttaggactgaaaatact

SEQ ID NO: 2379886 - DNA, 20 bp, Homo sapiens
tttagtggaccctgaaatgt

SEQ ID NO: 2379887 - DNA, 21 bp, Homo sapiens
tttagtggaccctgaaatgtg

SEQ ID NO: 2379888 - DNA, 13 bp, Homo sapiens
tttagttttattt

SEQ ID NO: 2379889 - DNA, 20 bp, Homo sapiens
tttatctagatgtaaatttt

SEQ ID NO: 2379890 - DNA, 22 bp, Homo sapiens
tttatgttgacatttgtttggt

SEQ ID NO: 2379891 - DNA, 13 bp, Homo sapiens
tttatgttttggt

SEQ ID NO: 2379892 - DNA, 20 bp, Homo sapiens
tttattgaggaaaaatatgt

SEQ ID NO: 2379893 - DNA, 13 bp, Homo sapiens
tttcaaaaatctg

SEQ ID NO: 2379894 - DNA, 19 bp, Homo sapiens
tttcaaaaatctgaagatt

SEQ ID NO: 2379895 - DNA, 24 bp, Homo sapiens
tttcaaaaatctgaagattgttta

SEQ ID NO: 2379896 - DNA, 21 bp, Homo sapiens
tttcaataaagtttgatcttc

SEQ ID NO: 2379897 - DNA, 23 bp, Homo sapiens
tttcaatctcgtatagaagtctt

SEQ ID NO: 2379898 - DNA, 13 bp, Homo sapiens
tttcacaaatatt

SEQ ID NO: 2379899 - DNA, 14 bp, Homo sapiens
aaaaagtcttttaa

SEQ ID NO: 2379900 - DNA, 23 bp, Homo sapiens
aaaaatatgtgaaggaccttcac

SEQ ID NO: 2379901 - DNA, 13 bp, Homo sapiens
aaaaatctgaaga

SEQ ID NO: 2379902 - DNA, 19 bp, Homo sapiens
aaaactcaaccaaatggta

SEQ ID NO: 2379903 - DNA, 19 bp, Homo sapiens
aaaactgtactttgattca

SEQ ID NO: 2379904 - DNA, 22 bp, Homo sapiens
aaaagataccttaaaatttgaa

SEQ ID NO: 2379905 - DNA, 14 bp, Homo sapiens
aaaagtattgccaa

SEQ ID NO: 2379906 - DNA, 15 bp, Homo sapiens
aaaagttgtatgatc

SEQ ID NO: 2379907 - DNA, 16 bp, Homo sapiens
aaaagttgtatgatct

SEQ ID NO: 2379908 - DNA, 12 bp, Homo sapiens
aaaatcttatta

SEQ ID NO: 2379909 - DNA, 18 bp, Homo sapiens
aaaatcttattaaagttt

SEQ ID NO: 2379910 - DNA, 16 bp, Homo sapiens
aaaatgtaactgttac

SEQ ID NO: 2379911 - DNA, 14 bp, Homo sapiens
aaaatttgaaacat

SEQ ID NO: 2379912 - DNA, 21 bp, Homo sapiens
aaaatttgaaacattgctttt

SEQ ID NO: 2379913 - DNA, 12 bp, Homo sapiens
agtgtaccatta

SEQ ID NO: 2379914 - DNA, 21 bp, Homo sapiens
agtgtaccattaaaatatgca

SEQ ID NO: 2379915 - DNA, 15 bp, Homo sapiens
agtgttctgttacaa

SEQ ID NO: 2379916 - DNA, 16 bp, Homo sapiens
agtgttctttctcttt

SEQ ID NO: 2379917 - DNA, 16 bp, Homo sapiens
agttaagaattgaaga

SEQ ID NO: 2379918 - DNA, 20 bp, Homo sapiens
agttacttttccttgcatac

SEQ ID NO: 2379919 - DNA, 23 bp, Homo sapiens
agttacttttccttgcatacaaa

SEQ ID NO: 2379920 - DNA, 23 bp, Homo sapiens
agttagcctttatctaccaactt

SEQ ID NO: 2379921 - DNA, 19 bp, Homo sapiens
agttcagggaagataagtt

SEQ ID NO: 2379922 - DNA, 21 bp, Homo sapiens
agttggaaacactaaatgtta

SEQ ID NO: 2379923 - DNA, 22 bp, Homo sapiens
agttggaaacactaaatgttaa

SEQ ID NO: 2379924 - DNA, 21 bp, Homo sapiens
agttggagttcattcatatta

SEQ ID NO: 2379925 - DNA, 15 bp, Homo sapiens
agttgtatgatctgt

SEQ ID NO: 2379926 - DNA, 17 bp, Homo sapiens
agttgtatgatctgtgc

SEQ ID NO: 2379927 - DNA, 14 bp, Homo sapiens
agtttatgttttgg

SEQ ID NO: 2379928 - DNA, 16 bp, Homo sapiens
agtttatgttttggtc

SEQ ID NO: 2379929 - DNA, 22 bp, Homo sapiens
agtttcaaaaatctgaagattg

SEQ ID NO: 2379930 - DNA, 23 bp, Homo sapiens
agtttcaaaaatctgaagattgt

SEQ ID NO: 2379931 - DNA, 15 bp, Homo sapiens
agtttcaataaagtt

SEQ ID NO: 2379932 - DNA, 19 bp, Homo sapiens
atgtttttcagttcaaagt

SEQ ID NO: 2379933 - DNA, 12 bp, Homo sapiens
attaaaaagtct

SEQ ID NO: 2379934 - DNA, 12 bp, Homo sapiens
attaaaatatgc

SEQ ID NO: 2379935 - DNA, 13 bp, Homo sapiens
attaaaatatgca

SEQ ID NO: 2379936 - DNA, 14 bp, Homo sapiens
attaaaatatgcac

SEQ ID NO: 2379937 - DNA, 23 bp, Homo sapiens
attaaaatatgcactaagtctct

SEQ ID NO: 2379938 - DNA, 20 bp, Homo sapiens
attaaagtttcaaaaatctg

SEQ ID NO: 2379939 - DNA, 21 bp, Homo sapiens
attaaagtttcaaaaatctga

SEQ ID NO: 2379940 - DNA, 15 bp, Homo sapiens
attaaccaaggtaga

SEQ ID NO: 2379941 - DNA, 15 bp, Homo sapiens
attaatgttgatttc

SEQ ID NO: 2379942 - DNA, 17 bp, Homo sapiens
attaatgttgatttcta

SEQ ID NO: 2379943 - DNA, 17 bp, Homo sapiens
attagaaaactttgtta

SEQ ID NO: 2379944 - DNA, 18 bp, Homo sapiens
attagaaaactttgttag

SEQ ID NO: 2379945 - DNA, 18 bp, Homo sapiens
attagcaaaaaaagttgt

SEQ ID NO: 2379946 - DNA, 22 bp, Homo sapiens
attagcaaaaaaagttgtatga

SEQ ID NO: 2379947 - DNA, 12 bp, Homo sapiens
attatatttgga

SEQ ID NO: 2379948 - DNA, 11 bp, Homo sapiens
attatgctaag

SEQ ID NO: 2379949 - DNA, 13 bp, Homo sapiens
attatgctaagaa

SEQ ID NO: 2379950 - DNA, 15 bp, Homo sapiens
attcacatgttttca

SEQ ID NO: 2379951 - DNA, 18 bp, Homo sapiens
attcacatgttttcaaat

SEQ ID NO: 2379952 - DNA, 21 bp, Homo sapiens
attcacatgttttcaaatgga

SEQ ID NO: 2379953 - DNA, 13 bp, Homo sapiens
attcatattacaa

SEQ ID NO: 2379954 - DNA, 14 bp, Homo sapiens
attcatattacaat

SEQ ID NO: 2379955 - DNA, 21 bp, Homo sapiens
attccatattagaaaactttg

SEQ ID NO: 2379956 - DNA, 12 bp, Homo sapiens
attccttattta

SEQ ID NO: 2379957 - DNA, 14 bp, Homo sapiens
attctctgtacata

SEQ ID NO: 2379958 - DNA, 18 bp, Homo sapiens
attctgaagttatatttc

SEQ ID NO: 2379959 - DNA, 15 bp, Homo sapiens
attctgggaatgtat

SEQ ID NO: 2379960 - DNA, 17 bp, Homo sapiens
attctgggaatgtatag

SEQ ID NO: 2379961 - DNA, 22 bp, Homo sapiens
attcttattccatattagaaaa

SEQ ID NO: 2379962 - DNA, 23 bp, Homo sapiens
attcttattccatattagaaaac

SEQ ID NO: 2379963 - DNA, 18 bp, Homo sapiens
attgaagctttttaaaaa

SEQ ID NO: 2379964 - DNA, 17 bp, Homo sapiens
attgagagagatgtgta

SEQ ID NO: 2379965 - DNA, 21 bp, Homo sapiens
attgagatctttttgtctcct

SEQ ID NO: 2379966 - DNA, 15 bp, Homo sapiens
attgagattattaaa

SEQ ID NO: 2379967 - DNA, 16 bp, Homo sapiens
attgagattattaaaa

SEQ ID NO: 2379968 - DNA, 21 bp, Homo sapiens
attgaggaaaaatatgtgaag

SEQ ID NO: 2379969 - DNA, 13 bp, Homo sapiens
attgatgttgatg

SEQ ID NO: 2379970 - DNA, 18 bp, Homo sapiens
attgatgttgatgcaatc

SEQ ID NO: 2379971 - DNA, 19 bp, Homo sapiens
attgccaaacattaatgtt

SEQ ID NO: 2379972 - DNA, 16 bp, Homo sapiens
attgcttttaaaacta

SEQ ID NO: 2379973 - DNA, 16 bp, Homo sapiens
attgcttttaaaattt

SEQ ID NO: 2379974 - DNA, 19 bp, Homo sapiens
attgcttttaaaattttaa

SEQ ID NO: 2379975 - DNA, 21 bp, Homo sapiens
attgcttttaaaattttaagc

SEQ ID NO: 2379976 - DNA, 15 bp, Homo sapiens
attggaaatttcacg

SEQ ID NO: 2379977 - DNA, 13 bp, Homo sapiens
atttaatacattt

SEQ ID NO: 2379978 - DNA, 20 bp, Homo sapiens
atttattctgggaatgtata

SEQ ID NO: 2379979 - DNA, 18 bp, Homo sapiens
atttattgaggaaaaata

SEQ ID NO: 2379980 - DNA, 21 bp, Homo sapiens
atttcaagcttattttggaga

SEQ ID NO: 2379981 - DNA, 22 bp, Homo sapiens
atttcaagcttattttggagag

SEQ ID NO: 2379982 - DNA, 14 bp, Homo sapiens
atttcacaaatatt

SEQ ID NO: 2379983 - DNA, 18 bp, Homo sapiens
atttcacgtcataggaag

SEQ ID NO: 2379984 - DNA, 18 bp, Homo sapiens
atttccatgtatgcataa

SEQ ID NO: 2379985 - DNA, 15 bp, Homo sapiens
atttctagttattta

SEQ ID NO: 2379986 - DNA, 20 bp, Homo sapiens
atttgtgtgctaaacgtgta

SEQ ID NO: 2379987 - DNA, 21 bp, Homo sapiens
atttgtttggttatagtgcaa

SEQ ID NO: 2379988 - DNA, 17 bp, Homo sapiens
attttaagctaggaaaa

SEQ ID NO: 2379989 - DNA, 22 bp, Homo sapiens
attttaagctaggaaaagaaat

SEQ ID NO: 2379990 - DNA, 23 bp, Homo sapiens
attttaagctaggaaaagaaatc

SEQ ID NO: 2379991 - DNA, 22 bp, Homo sapiens
attttagtggaccctgaaatgt

SEQ ID NO: 2379992 - DNA, 20 bp, Homo sapiens
attttagttttattttctaa

SEQ ID NO: 2379993 - DNA, 18 bp, Homo sapiens
attttatgttgacatttg

SEQ ID NO: 2379994 - DNA, 13 bp, Homo sapiens
attttcagatttg

SEQ ID NO: 2379995 - DNA, 14 bp, Homo sapiens
attttcagatttgc

SEQ ID NO: 2379996 - DNA, 15 bp, Homo sapiens
attttcagatttgca

SEQ ID NO: 2379997 - DNA, 19 bp, Homo sapiens
attttcagatttgcacaaa

SEQ ID NO: 2379998 - DNA, 16 bp, Homo sapiens
attttcattagcaaaa

SEQ ID NO: 2379999 - DNA, 17 bp, Homo sapiens
attttcattttacagtt

SEQ ID NO: 2380000 - DNA, 20 bp, Homo sapiens
attttggagagataggaagg

SEQ ID NO: 2380001 - DNA, 23 bp, Homo sapiens
attttgtatgcaagcagtttcaa

SEQ ID NO: 2380002 - DNA, 15 bp, Homo sapiens
attttgtgagtttgt

SEQ ID NO: 2380003 - DNA, 19 bp, Homo sapiens
attttgtgagtttgtttct

SEQ ID NO: 2380004 - DNA, 19 bp, Homo sapiens
atttttttccttacataaa

SEQ ID NO: 2380005 - DNA, 21 bp, Homo sapiens
atttttttccttacataaaca

SEQ ID NO: 2380006 - DNA, 22 bp, Homo sapiens
atttttttccttacataaacat

SEQ ID NO: 2380007 - DNA, 15 bp, Homo sapiens
caaaaaaagttgtat

SEQ ID NO: 2380008 - DNA, 18 bp, Homo sapiens
caaaaagataccttaaaa

SEQ ID NO: 2380009 - DNA, 20 bp, Homo sapiens
caaaaatctgaagattgttt

SEQ ID NO: 2380010 - DNA, 21 bp, Homo sapiens
caaaaatctgaagattgttta

SEQ ID NO: 2380011 - DNA, 12 bp, Homo sapiens
caaaatgtaact

SEQ ID NO: 2380012 - DNA, 18 bp, Homo sapiens
caaacaagcatataaaat

SEQ ID NO: 2380013 - DNA, 17 bp, Homo sapiens
caaacattagtacttta

SEQ ID NO: 2380014 - DNA, 13 bp, Homo sapiens
caaaccctgtcaa

SEQ ID NO: 2380015 - DNA, 14 bp, Homo sapiens
caaactgcacatga

SEQ ID NO: 2380016 - DNA, 21 bp, Homo sapiens
caaactgcacatgatttcaca

SEQ ID NO: 2380017 - DNA, 14 bp, Homo sapiens
caaagacaaatagt

SEQ ID NO: 2380018 - DNA, 16 bp, Homo sapiens
caaagacaaatagtag

SEQ ID NO: 2380019 - DNA, 20 bp, Homo sapiens
caaagtacaggtactttgtc

SEQ ID NO: 2380020 - DNA, 15 bp, Homo sapiens
caaagtcatgatgtt

SEQ ID NO: 2380021 - DNA, 16 bp, Homo sapiens
caaataacaacttttt

SEQ ID NO: 2380022 - DNA, 22 bp, Homo sapiens
caaatcttcctggtcgaaagtt

SEQ ID NO: 2380023 - DNA, 21 bp, Homo sapiens
caaatgattgcttttaaaatt

SEQ ID NO: 2380024 - DNA, 13 bp, Homo sapiens
caaatggtacaaa

SEQ ID NO: 2380025 - DNA, 14 bp, Homo sapiens
caaattaatacaat

SEQ ID NO: 2380026 - DNA, 19 bp, Homo sapiens
caaattaatacaatcagaa

SEQ ID NO: 2380027 - DNA, 18 bp, Homo sapiens
caacaattttcagatttg

SEQ ID NO: 2380028 - DNA, 19 bp, Homo sapiens
caacaattttcagatttgc

SEQ ID NO: 2380029 - DNA, 23 bp, Homo sapiens
caacaattttcagatttgcacaa

SEQ ID NO: 2380030 - DNA, 15 bp, Homo sapiens
caacagattggattt

SEQ ID NO: 2380031 - DNA, 13 bp, Homo sapiens
aattttcatttta

SEQ ID NO: 2380032 - DNA, 16 bp, Homo sapiens
aattttcattttacag

SEQ ID NO: 2380033 - DNA, 19 bp, Homo sapiens
aattttcattttacagtta

SEQ ID NO: 2380034 - DNA, 21 bp, Homo sapiens
aattttgtctgccccaagttt

SEQ ID NO: 2380035 - DNA, 22 bp, Homo sapiens
aattttgtctgccccaagtttt

SEQ ID NO: 2380036 - DNA, 13 bp, Homo sapiens
aatttttctgtat

SEQ ID NO: 2380037 - DNA, 18 bp, Homo sapiens
aatttttctgtatagaca

SEQ ID NO: 2380038 - DNA, 12 bp, Homo sapiens
acaaaatgtaac

SEQ ID NO: 2380039 - DNA, 23 bp, Homo sapiens
acaaaatgtaactgttaccattg

SEQ ID NO: 2380040 - DNA, 14 bp, Homo sapiens
acaaacaagcatat

SEQ ID NO: 2380041 - DNA, 19 bp, Homo sapiens
acaaactgcacatgatttc

SEQ ID NO: 2380042 - DNA, 23 bp, Homo sapiens
acaaactgcacatgatttcacaa

SEQ ID NO: 2380043 - DNA, 20 bp, Homo sapiens
acaaaggctgtattcagcaa

SEQ ID NO: 2380044 - DNA, 23 bp, Homo sapiens
acaaataacaacttttttttctt

SEQ ID NO: 2380045 - DNA, 19 bp, Homo sapiens
acaaatagtaggcaagatg

SEQ ID NO: 2380046 - DNA, 21 bp, Homo sapiens
acaaatagtaggcaagatggc

SEQ ID NO: 2380047 - DNA, 22 bp, Homo sapiens
acaaatagtaggcaagatggca

SEQ ID NO: 2380048 - DNA, 16 bp, Homo sapiens
acaaatgattgctttt

SEQ ID NO: 2380049 - DNA, 19 bp, Homo sapiens
acaaatgattgcttttaaa

SEQ ID NO: 2380050 - DNA, 21 bp, Homo sapiens
acaaatgattgcttttaaaat

SEQ ID NO: 2380051 - DNA, 18 bp, Homo sapiens
acaaattatgctaagaat

SEQ ID NO: 2380052 - DNA, 13 bp, Homo sapiens
acaacagattgga

SEQ ID NO: 2380053 - DNA, 15 bp, Homo sapiens
acaagcatataaaat

SEQ ID NO: 2380054 - DNA, 17 bp, Homo sapiens
acaattttcagatttgc

SEQ ID NO: 2380055 - DNA, 20 bp, Homo sapiens
acaattttcagatttgcaca

SEQ ID NO: 2380056 - DNA, 13 bp, Homo sapiens
acactaaatgtta

SEQ ID NO: 2380057 - DNA, 15 bp, Homo sapiens
acactaaatgttaaa

SEQ ID NO: 2380058 - DNA, 20 bp, Homo sapiens
acactaaatgttaaagatgt

SEQ ID NO: 2380059 - DNA, 21 bp, Homo sapiens
acactaaatgttaaagatgta

SEQ ID NO: 2380060 - DNA, 11 bp, Homo sapiens
acactccaacg

SEQ ID NO: 2380061 - DNA, 17 bp, Homo sapiens
acagacctgagatgaag

SEQ ID NO: 2380062 - DNA, 17 bp, Homo sapiens
acagagccgtaaaaact

SEQ ID NO: 2380063 - DNA, 16 bp, Homo sapiens
acagggcatgaaatga

SEQ ID NO: 2380064 - DNA, 19 bp, Homo sapiens
acaggtttttttggattta

SEQ ID NO: 2380065 - DNA, 13 bp, Homo sapiens
acagttacttttc

SEQ ID NO: 2380066 - DNA, 15 bp, Homo sapiens
acagttacttttcct

SEQ ID NO: 2380067 - DNA, 11 bp, Homo sapiens
acataaacatc

SEQ ID NO: 2380068 - DNA, 20 bp, Homo sapiens
acatattagcgacaacagat

SEQ ID NO: 2380069 - DNA, 14 bp, Homo sapiens
acatcatctgtaag

SEQ ID NO: 2380070 - DNA, 13 bp, Homo sapiens
acatgatttcaca

SEQ ID NO: 2380071 - DNA, 14 bp, Homo sapiens
acatgatttcacaa

SEQ ID NO: 2380072 - DNA, 18 bp, Homo sapiens
acatgatttcacaaatat

SEQ ID NO: 2380073 - DNA, 20 bp, Homo sapiens
acatgatttcacaaatatta

SEQ ID NO: 2380074 - DNA, 12 bp, Homo sapiens
acatgttttcaa

SEQ ID NO: 2380075 - DNA, 13 bp, Homo sapiens
acatgttttcaaa

SEQ ID NO: 2380076 - DNA, 17 bp, Homo sapiens
acatgttttcaaatgga

SEQ ID NO: 2380077 - DNA, 21 bp, Homo sapiens
acattaatgttgatttctagt

SEQ ID NO: 2380078 - DNA, 17 bp, Homo sapiens
acattctcagtttttct

SEQ ID NO: 2380079 - DNA, 12 bp, Homo sapiens
acattggaagca

SEQ ID NO: 2380080 - DNA, 21 bp, Homo sapiens
acattggaagcaggttaaatg

SEQ ID NO: 2380081 - DNA, 23 bp, Homo sapiens
acattggaagcaggttaaatgtt

SEQ ID NO: 2380082 - DNA, 18 bp, Homo sapiens
acattgtgattattgaag

SEQ ID NO: 2380083 - DNA, 17 bp, Homo sapiens
acatttgtcattttcat

SEQ ID NO: 2380084 - DNA, 15 bp, Homo sapiens
accaaatggtacaaa

SEQ ID NO: 2380085 - DNA, 12 bp, Homo sapiens
accaactttcaa

SEQ ID NO: 2380086 - DNA, 20 bp, Homo sapiens
accaaggtagaatgaccttg

SEQ ID NO: 2380087 - DNA, 21 bp, Homo sapiens
accacagtgtaccattaaaat

SEQ ID NO: 2380088 - DNA, 19 bp, Homo sapiens
accatttccgtaattctta

SEQ ID NO: 2380089 - DNA, 12 bp, Homo sapiens
accattttcctg

SEQ ID NO: 2380090 - DNA, 11 bp, Homo sapiens
accctgaaatg

SEQ ID NO: 2380091 - DNA, 14 bp, Homo sapiens
accctgaaatgtgt

SEQ ID NO: 2380092 - DNA, 15 bp, Homo sapiens
accctgaaatgtgtg

SEQ ID NO: 2380093 - DNA, 16 bp, Homo sapiens
accctgtcaaacatta

SEQ ID NO: 2380094 - DNA, 13 bp, Homo sapiens
accttaaaatttg

SEQ ID NO: 2380095 - DNA, 20 bp, Homo sapiens
accttaaaatttgaaacatt

SEQ ID NO: 2380096 - DNA, 18 bp, Homo sapiens
accttcactctaagatgt

SEQ ID NO: 2380097 - DNA, 20 bp, Homo sapiens
accttcactctaagatgtta

SEQ ID NO: 2380098 - DNA, 15 bp, Homo sapiens
accttgtaatgtaac

SEQ ID NO: 2380099 - DNA, 17 bp, Homo sapiens
accttgtaatgtaactg

SEQ ID NO: 2380100 - DNA, 13 bp, Homo sapiens
acgtgtatgtttt

SEQ ID NO: 2380101 - DNA, 16 bp, Homo sapiens
actaacttctaaaact

SEQ ID NO: 2380102 - DNA, 20 bp, Homo sapiens
actaagatcggttaacaaat

SEQ ID NO: 2380103 - DNA, 22 bp, Homo sapiens
actaagatcggttaacaaataa

SEQ ID NO: 2380104 - DNA, 18 bp, Homo sapiens
actaagtctcttttttac

SEQ ID NO: 2380105 - DNA, 21 bp, Homo sapiens
actaagtctcttttttacaaa

SEQ ID NO: 2380106 - DNA, 14 bp, Homo sapiens
actacttagcactt

SEQ ID NO: 2380107 - DNA, 19 bp, Homo sapiens
actattgtttatttttaat

SEQ ID NO: 2380108 - DNA, 13 bp, Homo sapiens
actctaagatgtt

SEQ ID NO: 2380109 - DNA, 19 bp, Homo sapiens
actctaagatgttatattt

SEQ ID NO: 2380110 - DNA, 21 bp, Homo sapiens
actgaagttctgcctctgatg

SEQ ID NO: 2380111 - DNA, 22 bp, Homo sapiens
actgaagtttgataaatagtgt

SEQ ID NO: 2380112 - DNA, 23 bp, Homo sapiens
actgaagtttgataaatagtgtt

SEQ ID NO: 2380113 - DNA, 14 bp, Homo sapiens
actgaatctgtaca

SEQ ID NO: 2380114 - DNA, 15 bp, Homo sapiens
actgaatctgtacag

SEQ ID NO: 2380115 - DNA, 13 bp, Homo sapiens
actgattttttaa

SEQ ID NO: 2380116 - DNA, 15 bp, Homo sapiens
actgcacatgatttc

SEQ ID NO: 2380117 - DNA, 16 bp, Homo sapiens
actgcacatgatttca

SEQ ID NO: 2380118 - DNA, 19 bp, Homo sapiens
actgctcttgggcaatatt

SEQ ID NO: 2380119 - DNA, 17 bp, Homo sapiens
gaaatttttcatatttt

SEQ ID NO: 2380120 - DNA, 14 bp, Homo sapiens
gaacaaatcttcct

SEQ ID NO: 2380121 - DNA, 13 bp, Homo sapiens
gaacgttctcttt

SEQ ID NO: 2380122 - DNA, 13 bp, Homo sapiens
gaactatcttcat

SEQ ID NO: 2380123 - DNA, 16 bp, Homo sapiens
gaagataggtttagca

SEQ ID NO: 2380124 - DNA, 13 bp, Homo sapiens
gaagattgtttat

SEQ ID NO: 2380125 - DNA, 15 bp, Homo sapiens
gaagcaggttaaatg

SEQ ID NO: 2380126 - DNA, 21 bp, Homo sapiens
gaagctttttaaaaattgtaa

SEQ ID NO: 2380127 - DNA, 18 bp, Homo sapiens
gaagttagcctttatcta

SEQ ID NO: 2380128 - DNA, 21 bp, Homo sapiens
gaagttagcctttatctacca

SEQ ID NO: 2380129 - DNA, 13 bp, Homo sapiens
gaagttatatttc

SEQ ID NO: 2380130 - DNA, 13 bp, Homo sapiens
gaagttcatgaat

SEQ ID NO: 2380131 - DNA, 18 bp, Homo sapiens
gaagttctgcctctgatg

SEQ ID NO: 2380132 - DNA, 20 bp, Homo sapiens
gaagtttgataaatagtgtt

SEQ ID NO: 2380133 - DNA, 19 bp, Homo sapiens
gaataggacttgtttttgt

SEQ ID NO: 2380134 - DNA, 18 bp, Homo sapiens
gaatgcatgctttccata

SEQ ID NO: 2380135 - DNA, 18 bp, Homo sapiens
gaattactaacttctaaa

SEQ ID NO: 2380136 - DNA, 23 bp, Homo sapiens
gaattactaacttctaaaactgt

SEQ ID NO: 2380137 - DNA, 11 bp, Homo sapiens
gaattttcatt

SEQ ID NO: 2380138 - DNA, 16 bp, Homo sapiens
gaattttcattttaca

SEQ ID NO: 2380139 - DNA, 16 bp, Homo sapiens
gaattttttctttgta

SEQ ID NO: 2380140 - DNA, 17 bp, Homo sapiens
gacatttgtcattttca

SEQ ID NO: 2380141 - DNA, 13 bp, Homo sapiens
gaccaattttaac

SEQ ID NO: 2380142 - DNA, 13 bp, Homo sapiens
gaccattttcctg

SEQ ID NO: 2380143 - DNA, 19 bp, Homo sapiens
gaccattttcctgcattgg

SEQ ID NO: 2380144 - DNA, 13 bp, Homo sapiens
gaccctgaaatgt

SEQ ID NO: 2380145 - DNA, 18 bp, Homo sapiens
gaccttgtaatgtaactg

SEQ ID NO: 2380146 - DNA, 22 bp, Homo sapiens
gactaagatcggttaacaaata

SEQ ID NO: 2380147 - DNA, 18 bp, Homo sapiens
gacttctgttttcaatct

SEQ ID NO: 2380148 - DNA, 23 bp, Homo sapiens
gacttctgttttcaatctcgtat

SEQ ID NO: 2380149 - DNA, 20 bp, Homo sapiens
gagagaggctaaaatgtttt

SEQ ID NO: 2380150 - DNA, 19 bp, Homo sapiens
gagagatgtgtaatttttc

SEQ ID NO: 2380151 - DNA, 16 bp, Homo sapiens
gagaggctaaaatgtt

SEQ ID NO: 2380152 - DNA, 22 bp, Homo sapiens
gagaggctaaaatgttttcagc

SEQ ID NO: 2380153 - DNA, 21 bp, Homo sapiens
gagataggaaggtcatttcca

SEQ ID NO: 2380154 - DNA, 14 bp, Homo sapiens
gaggaaaaatatgt

SEQ ID NO: 2380155 - DNA, 13 bp, Homo sapiens
gagggtgaagcct

SEQ ID NO: 2380156 - DNA, 18 bp, Homo sapiens
gagtgcttactctttgta

SEQ ID NO: 2380157 - DNA, 12 bp, Homo sapiens
gagtttgtttct

SEQ ID NO: 2380158 - DNA, 17 bp, Homo sapiens
gataaatagtgttattg

SEQ ID NO: 2380159 - DNA, 22 bp, Homo sapiens
gataagttggaaacactaaatg

SEQ ID NO: 2380160 - DNA, 14 bp, Homo sapiens
gataattaaccaag

SEQ ID NO: 2380161 - DNA, 23 bp, Homo sapiens
gataattaaccaaggtagaatga

SEQ ID NO: 2380162 - DNA, 18 bp, Homo sapiens
gataggaaggtcatttcc

SEQ ID NO: 2380163 - DNA, 18 bp, Homo sapiens
gatattctttgttaattt

SEQ ID NO: 2380164 - DNA, 16 bp, Homo sapiens
gatcggttaacaaata

SEQ ID NO: 2380165 - DNA, 17 bp, Homo sapiens
gatcggttaacaaataa

SEQ ID NO: 2380166 - DNA, 19 bp, Homo sapiens
gatgcaatccttacaaatg

SEQ ID NO: 2380167 - DNA, 20 bp, Homo sapiens
gatgcaatccttacaaatga

SEQ ID NO: 2380168 - DNA, 17 bp, Homo sapiens
gatgtgacatttgtcat

SEQ ID NO: 2380169 - DNA, 20 bp, Homo sapiens
gatgttatatttttcttaaa

SEQ ID NO: 2380170 - DNA, 13 bp, Homo sapiens
gatgtttttaaaa

SEQ ID NO: 2380171 - DNA, 17 bp, Homo sapiens
gatgtttttaaaatctt

SEQ ID NO: 2380172 - DNA, 22 bp, Homo sapiens
gattcatgtttagccagtgttt

SEQ ID NO: 2380173 - DNA, 14 bp, Homo sapiens
gattttatgttgac

SEQ ID NO: 2380174 - DNA, 19 bp, Homo sapiens
gcaaagtacaggtactttg

SEQ ID NO: 2380175 - DNA, 15 bp, Homo sapiens
gcaacaaactgcaca

SEQ ID NO: 2380176 - DNA, 21 bp, Homo sapiens
gcaacaaactgcacatgattt

SEQ ID NO: 2380177 - DNA, 16 bp, Homo sapiens
gcaacaattttcagat

SEQ ID NO: 2380178 - DNA, 15 bp, Homo sapiens
gcaagcagtttcaat

SEQ ID NO: 2380179 - DNA, 18 bp, Homo sapiens
gcaaggcgctaacttgct

SEQ ID NO: 2380180 - DNA, 20 bp, Homo sapiens
gcaaggcgctaacttgctta

SEQ ID NO: 2380181 - DNA, 14 bp, Homo sapiens
gcaatatattttgt

SEQ ID NO: 2380182 - DNA, 18 bp, Homo sapiens
gcaatatattttgtatgc

SEQ ID NO: 2380183 - DNA, 21 bp, Homo sapiens
gcaatattctctgtacatatt

SEQ ID NO: 2380184 - DNA, 15 bp, Homo sapiens
gcacacatcatctgt

SEQ ID NO: 2380185 - DNA, 17 bp, Homo sapiens
gcacacatcatctgtaa

SEQ ID NO: 2380186 - DNA, 23 bp, Homo sapiens
gcacagggcatgaaatgaacaca

SEQ ID NO: 2380187 - DNA, 19 bp, Homo sapiens
gcactaagtctctttttta

SEQ ID NO: 2380188 - DNA, 15 bp, Homo sapiens
gcagtaaagaagaaa

SEQ ID NO: 2380189 - DNA, 18 bp, Homo sapiens
gcagtgatattctttgtt

SEQ ID NO: 2380190 - DNA, 12 bp, Homo sapiens
gcagtttcaata

SEQ ID NO: 2380191 - DNA, 17 bp, Homo sapiens
gcataataatcctgcaa

SEQ ID NO: 2380192 - DNA, 23 bp, Homo sapiens
gcataattctgaagttatatttc

SEQ ID NO: 2380193 - DNA, 18 bp, Homo sapiens
gcatacaaacaagcatat

SEQ ID NO: 2380194 - DNA, 16 bp, Homo sapiens
gcattgggtgatcatt

SEQ ID NO: 2380195 - DNA, 19 bp, Homo sapiens
gccaaacattaatgttgat

SEQ ID NO: 2380196 - DNA, 22 bp, Homo sapiens
gccaaacattaatgttgatttc

SEQ ID NO: 2380197 - DNA, 20 bp, Homo sapiens
gccataagcaacaattttca

SEQ ID NO: 2380198 - DNA, 23 bp, Homo sapiens
gccataagcaacaattttcagat

SEQ ID NO: 2380199 - DNA, 21 bp, Homo sapiens
gccccaagttttgtgaaattt

SEQ ID NO: 2380200 - DNA, 23 bp, Homo sapiens
gcgaaaaactcaaccaaatggta

SEQ ID NO: 2380201 - DNA, 14 bp, Homo sapiens
gctaaaatgttttc

SEQ ID NO: 2380202 - DNA, 17 bp, Homo sapiens
gctaaaatgttttcagc

SEQ ID NO: 2380203 - DNA, 23 bp, Homo sapiens
gctaaacgtgtatgtttttcagt

SEQ ID NO: 2380204 - DNA, 20 bp, Homo sapiens
gctaaattgatgttgatgca

SEQ ID NO: 2380205 - DNA, 19 bp, Homo sapiens
gctagtgttctttctcttt

SEQ ID NO: 2380206 - DNA, 14 bp, Homo sapiens
gctcaaatattgaa

SEQ ID NO: 2380207 - DNA, 23 bp, Homo sapiens
gctcttgggcaatattctctgta

SEQ ID NO: 2380208 - DNA, 14 bp, Homo sapiens
gcttaaatgtgaat

SEQ ID NO: 2380209 - DNA, 23 bp, Homo sapiens
gcttaaatgtgaattactaactt

SEQ ID NO: 2380210 - DNA, 21 bp, Homo sapiens
gctttccatatttttttcctt

SEQ ID NO: 2380211 - DNA, 16 bp, Homo sapiens
gcttttaaaattttaa

SEQ ID NO: 2380212 - DNA, 13 bp, Homo sapiens
ggaaaagaaatct

SEQ ID NO: 2380213 - DNA, 21 bp, Homo sapiens
ggaaacactaaatgttaaaga

SEQ ID NO: 2380214 - DNA, 13 bp, Homo sapiens
ggaacaaatcttc

SEQ ID NO: 2380215 - DNA, 15 bp, Homo sapiens
ggaacaaatcttcct

SEQ ID NO: 2380216 - DNA, 18 bp, Homo sapiens
ggaagataagttggaaac

SEQ ID NO: 2380217 - DNA, 22 bp, Homo sapiens
ggaagcaggttaaatgttttgt

SEQ ID NO: 2380218 - DNA, 19 bp, Homo sapiens
ggaatattatatttggatg

SEQ ID NO: 2380219 - DNA, 16 bp, Homo sapiens
ggaatgtatagtattt

SEQ ID NO: 2380220 - DNA, 23 bp, Homo sapiens
ggaatgtatagtatttgaaaaca

SEQ ID NO: 2380221 - DNA, 19 bp, Homo sapiens
ggagaagaaagaactatct

SEQ ID NO: 2380222 - DNA, 20 bp, Homo sapiens
ggagttcattcatattacaa

SEQ ID NO: 2380223 - DNA, 15 bp, Homo sapiens
ggattttatgttgac

SEQ ID NO: 2380224 - DNA, 15 bp, Homo sapiens
ggcaatattctctgt

SEQ ID NO: 2380225 - DNA, 16 bp, Homo sapiens
ggcacagggcatgaaa

SEQ ID NO: 2380226 - DNA, 15 bp, Homo sapiens
ggccaaagacaaata

SEQ ID NO: 2380227 - DNA, 18 bp, Homo sapiens
ggctaaaatgttttcagc

SEQ ID NO: 2380228 - DNA, 16 bp, Homo sapiens
ggggaacgttctcttt

SEQ ID NO: 2380229 - DNA, 21 bp, Homo sapiens
caagcagtttcaataaagttt

SEQ ID NO: 2380230 - DNA, 15 bp, Homo sapiens
caaggcgctaacttg

SEQ ID NO: 2380231 - DNA, 18 bp, Homo sapiens
caaggtagaatgaccttg

SEQ ID NO: 2380232 - DNA, 20 bp, Homo sapiens
caaggtagaatgaccttgta

SEQ ID NO: 2380233 - DNA, 22 bp, Homo sapiens
caagttttgtgaaatttttcat

SEQ ID NO: 2380234 - DNA, 15 bp, Homo sapiens
caatatattttgtat

SEQ ID NO: 2380235 - DNA, 22 bp, Homo sapiens
caatatattttgtatgcaagca

SEQ ID NO: 2380236 - DNA, 22 bp, Homo sapiens
caatatttgtgtgctaaacgtg

SEQ ID NO: 2380237 - DNA, 12 bp, Homo sapiens
caatccttacaa

SEQ ID NO: 2380238 - DNA, 14 bp, Homo sapiens
caatccttacaaat

SEQ ID NO: 2380239 - DNA, 12 bp, Homo sapiens
caattttcagat

SEQ ID NO: 2380240 - DNA, 13 bp, Homo sapiens
cacaaatattaaa

SEQ ID NO: 2380241 - DNA, 14 bp, Homo sapiens
cacatcatctgtaa

SEQ ID NO: 2380242 - DNA, 13 bp, Homo sapiens
caccagtacattc

SEQ ID NO: 2380243 - DNA, 22 bp, Homo sapiens
caccagtacattctcagttttt

SEQ ID NO: 2380244 - DNA, 12 bp, Homo sapiens
cactaaatgtta

SEQ ID NO: 2380245 - DNA, 19 bp, Homo sapiens
cactaaatgttaaagatgt

SEQ ID NO: 2380246 - DNA, 23 bp, Homo sapiens
cactaaatgttaaagatgtagca

SEQ ID NO: 2380247 - DNA, 18 bp, Homo sapiens
cactctaagatgttatat

SEQ ID NO: 2380248 - DNA, 19 bp, Homo sapiens
cactctaagatgttatatt

SEQ ID NO: 2380249 - DNA, 17 bp, Homo sapiens
cacttcagggcagattt

SEQ ID NO: 2380250 - DNA, 18 bp, Homo sapiens
cacttcagggcagatttt

SEQ ID NO: 2380251 - DNA, 22 bp, Homo sapiens
cacttcagggcagattttagtt

SEQ ID NO: 2380252 - DNA, 11 bp, Homo sapiens
cagaaattggt

SEQ ID NO: 2380253 - DNA, 15 bp, Homo sapiens
cagaaattggtacct

SEQ ID NO: 2380254 - DNA, 17 bp, Homo sapiens
cagaaattggtaccttg

SEQ ID NO: 2380255 - DNA, 21 bp, Homo sapiens
cagaaattggtaccttgcaca

SEQ ID NO: 2380256 - DNA, 13 bp, Homo sapiens
cagaattggaaaa

SEQ ID NO: 2380257 - DNA, 14 bp, Homo sapiens
cagaattggaaaag

SEQ ID NO: 2380258 - DNA, 20 bp, Homo sapiens
cagagccgtaaaaactgaag

SEQ ID NO: 2380259 - DNA, 17 bp, Homo sapiens
cagatttgcacaaaaag

SEQ ID NO: 2380260 - DNA, 13 bp, Homo sapiens
cagattttagttt

SEQ ID NO: 2380261 - DNA, 19 bp, Homo sapiens
cagctaggaacaaatcttc

SEQ ID NO: 2380262 - DNA, 23 bp, Homo sapiens
caggtaggaatattatatttgga

SEQ ID NO: 2380263 - DNA, 23 bp, Homo sapiens
caggttaggcagtataaagaata

SEQ ID NO: 2380264 - DNA, 19 bp, Homo sapiens
cagtacattctcagttttt

SEQ ID NO: 2380265 - DNA, 17 bp, Homo sapiens
cagtataaagaatagga

SEQ ID NO: 2380266 - DNA, 13 bp, Homo sapiens
cagtattttagtg

SEQ ID NO: 2380267 - DNA, 15 bp, Homo sapiens
cagtgatattctttg

SEQ ID NO: 2380268 - DNA, 15 bp, Homo sapiens
cagttacttttcctt

SEQ ID NO: 2380269 - DNA, 14 bp, Homo sapiens
cagtttatgttttg

SEQ ID NO: 2380270 - DNA, 12 bp, Homo sapiens
cagtttcaataa

SEQ ID NO: 2380271 - DNA, 18 bp, Homo sapiens
cagtttcaataaagtttg

SEQ ID NO: 2380272 - DNA, 19 bp, Homo sapiens
cagtttttcttaatatata

SEQ ID NO: 2380273 - DNA, 15 bp, Homo sapiens
cataagcaacaattt

SEQ ID NO: 2380274 - DNA, 21 bp, Homo sapiens
cataagcaacaattttcagat

SEQ ID NO: 2380275 - DNA, 21 bp, Homo sapiens
catacaaacaagcatataaaa

SEQ ID NO: 2380276 - DNA, 20 bp, Homo sapiens
cataggaagttagcctttat

SEQ ID NO: 2380277 - DNA, 17 bp, Homo sapiens
catataaaatggcaaca

SEQ ID NO: 2380278 - DNA, 18 bp, Homo sapiens
catataaaatggcaacaa

SEQ ID NO: 2380279 - DNA, 18 bp, Homo sapiens
catattagaaaactttgt

SEQ ID NO: 2380280 - DNA, 20 bp, Homo sapiens
catattagcgacaacagatt

SEQ ID NO: 2380281 - DNA, 14 bp, Homo sapiens
catattttaatttc

SEQ ID NO: 2380282 - DNA, 16 bp, Homo sapiens
catattttaatttcaa

SEQ ID NO: 2380283 - DNA, 23 bp, Homo sapiens
catattttaatttcaagcttatt

SEQ ID NO: 2380284 - DNA, 15 bp, Homo sapiens
catatttttttcctt

SEQ ID NO: 2380285 - DNA, 18 bp, Homo sapiens
catatttttttccttaca

SEQ ID NO: 2380286 - DNA, 13 bp, Homo sapiens
catcatctgtaag

SEQ ID NO: 2380287 - DNA, 19 bp, Homo sapiens
catcatctgtaagctgttt

SEQ ID NO: 2380288 - DNA, 22 bp, Homo sapiens
catctgagagaggctaaaatgt

SEQ ID NO: 2380289 - DNA, 23 bp, Homo sapiens
catctgagagaggctaaaatgtt

SEQ ID NO: 2380290 - DNA, 15 bp, Homo sapiens
catgaaatgaacaca

SEQ ID NO: 2380291 - DNA, 19 bp, Homo sapiens
catgaaatgctatgtcatt

SEQ ID NO: 2380292 - DNA, 21 bp, Homo sapiens
catgatgtttttaaaatctta

SEQ ID NO: 2380293 - DNA, 15 bp, Homo sapiens
catgatttcacaaat

SEQ ID NO: 2380294 - DNA, 16 bp, Homo sapiens
catgatttcacaaata

SEQ ID NO: 2380295 - DNA, 19 bp, Homo sapiens
catgatttcacaaatatta

SEQ ID NO: 2380296 - DNA, 19 bp, Homo sapiens
catgtaagaatgactgatg

SEQ ID NO: 2380297 - DNA, 19 bp, Homo sapiens
catgtcctgtgtcagttta

SEQ ID NO: 2380298 - DNA, 20 bp, Homo sapiens
catgtcctgtgtcagtttat

SEQ ID NO: 2380299 - DNA, 16 bp, Homo sapiens
cattaaaatatgcact

SEQ ID NO: 2380300 - DNA, 16 bp, Homo sapiens
cattacatgactattg

SEQ ID NO: 2380301 - DNA, 17 bp, Homo sapiens
cattagcaaaaaaagtt

SEQ ID NO: 2380302 - DNA, 15 bp, Homo sapiens
cattagtactttata

SEQ ID NO: 2380303 - DNA, 19 bp, Homo sapiens
cattggaaatttcacgtca

SEQ ID NO: 2380304 - DNA, 14 bp, Homo sapiens
catttccatgtatg

SEQ ID NO: 2380305 - DNA, 16 bp, Homo sapiens
catttccatgtatgca

SEQ ID NO: 2380306 - DNA, 22 bp, Homo sapiens
catttccgtaattcttattcca

SEQ ID NO: 2380307 - DNA, 20 bp, Homo sapiens
catttgtcattttcattagc

SEQ ID NO: 2380308 - DNA, 19 bp, Homo sapiens
cattttacagttacttttc

SEQ ID NO: 2380309 - DNA, 15 bp, Homo sapiens
cattttcattagcaa

SEQ ID NO: 2380310 - DNA, 13 bp, Homo sapiens
ccaaagacaaata

SEQ ID NO: 2380311 - DNA, 16 bp, Homo sapiens
ccaaagacaaatagta

SEQ ID NO: 2380312 - DNA, 22 bp, Homo sapiens
ccaactttcaagaacttgttta

SEQ ID NO: 2380313 - DNA, 22 bp, Homo sapiens
ccaagttttgtgaaatttttca

SEQ ID NO: 2380314 - DNA, 16 bp, Homo sapiens
ccactgaatctgtaca

SEQ ID NO: 2380315 - DNA, 17 bp, Homo sapiens
ccagtacattctcagtt

SEQ ID NO: 2380316 - DNA, 22 bp, Homo sapiens
ccagtacattctcagtttttct

SEQ ID NO: 2380317 - DNA, 19 bp, Homo sapiens
ccataagcaacaattttca

SEQ ID NO: 2380318 - DNA, 20 bp, Homo sapiens
ccataagcaacaattttcag

SEQ ID NO: 2380319 - DNA, 20 bp, Homo sapiens
ccatattagaaaactttgtt

SEQ ID NO: 2380320 - DNA, 15 bp, Homo sapiens
ccatgtatgcataat

SEQ ID NO: 2380321 - DNA, 11 bp, Homo sapiens
ccattttcctg

SEQ ID NO: 2380322 - DNA, 19 bp, Homo sapiens
cccaagttttgtgaaattt

SEQ ID NO: 2380323 - DNA, 21 bp, Homo sapiens
cccaagttttgtgaaattttt

SEQ ID NO: 2380324 - DNA, 17 bp, Homo sapiens
cccacttggttagatga

SEQ ID NO: 2380325 - DNA, 16 bp, Homo sapiens
ccgtaaaaactgaagt

SEQ ID NO: 2380326 - DNA, 12 bp, Homo sapiens
cctataccattt

SEQ ID NO: 2380327 - DNA, 21 bp, Homo sapiens
cctctgatgtattttgtgagt

SEQ ID NO: 2380328 - DNA, 14 bp, Homo sapiens
cctctgctaaattg

SEQ ID NO: 2380329 - DNA, 12 bp, Homo sapiens
cctgaaatgtgt

SEQ ID NO: 2380330 - DNA, 15 bp, Homo sapiens
cctgctctttggcct

SEQ ID NO: 2380331 - DNA, 16 bp, Homo sapiens
cctgtcaaacattagt

SEQ ID NO: 2380332 - DNA, 22 bp, Homo sapiens
cctgtcaaacattagtacttta

SEQ ID NO: 2380333 - DNA, 17 bp, Homo sapiens
cctgtgtcagtttatgt

SEQ ID NO: 2380334 - DNA, 22 bp, Homo sapiens
cctgtgtcagtttatgttttgg

SEQ ID NO: 2380335 - DNA, 15 bp, Homo sapiens
ccttaaaatttgaaa

SEQ ID NO: 2380336 - DNA, 16 bp, Homo sapiens
ccttaaaatttgaaac

SEQ ID NO: 2380337 - DNA, 23 bp, Homo sapiens
ccttacaaatgattgcttttaaa

SEQ ID NO: 2380338 - DNA, 15 bp, Homo sapiens
ccttttttatatctt

SEQ ID NO: 2380339 - DNA, 22 bp, Homo sapiens
ttcaccagtacattctcagttt

SEQ ID NO: 2380340 - DNA, 16 bp, Homo sapiens
ttcactctaagatgtt

SEQ ID NO: 2380341 - DNA, 23 bp, Homo sapiens
ttcagcatacataactgaagcat

SEQ ID NO: 2380342 - DNA, 20 bp, Homo sapiens
ttcagctaggaacaaatctt

SEQ ID NO: 2380343 - DNA, 19 bp, Homo sapiens
ttcagggaagataagttgg

SEQ ID NO: 2380344 - DNA, 23 bp, Homo sapiens
ttcagggaagataagttggaaac

SEQ ID NO: 2380345 - DNA, 17 bp, Homo sapiens
ttcatattttaatttca

SEQ ID NO: 2380346 - DNA, 19 bp, Homo sapiens
ttcatgtcctgtgtcagtt

SEQ ID NO: 2380347 - DNA, 21 bp, Homo sapiens
ttcatgtcctgtgtcagttta

SEQ ID NO: 2380348 - DNA, 20 bp, Homo sapiens
ttcattagcaaaaaaagttg

SEQ ID NO: 2380349 - DNA, 18 bp, Homo sapiens
ttcattcatattacaata

SEQ ID NO: 2380350 - DNA, 11 bp, Homo sapiens
ttccagtattt

SEQ ID NO: 2380351 - DNA, 16 bp, Homo sapiens
ttccatattagaaaac

SEQ ID NO: 2380352 - DNA, 17 bp, Homo sapiens
ttccatattagaaaact

SEQ ID NO: 2380353 - DNA, 21 bp, Homo sapiens
ttccatattagaaaactttgt

SEQ ID NO: 2380354 - DNA, 14 bp, Homo sapiens
ttccatgtatgcat

SEQ ID NO: 2380355 - DNA, 19 bp, Homo sapiens
ttccgtcaaaattggattt

SEQ ID NO: 2380356 - DNA, 14 bp, Homo sapiens
ttcctctgctaaat

SEQ ID NO: 2380357 - DNA, 19 bp, Homo sapiens
ttcctctgctaaattgatg

SEQ ID NO: 2380358 - DNA, 12 bp, Homo sapiens
ttctaaaactgt

SEQ ID NO: 2380359 - DNA, 20 bp, Homo sapiens
ttctaaaactgtactttgat

SEQ ID NO: 2380360 - DNA, 17 bp, Homo sapiens
ttctagttatttattct

SEQ ID NO: 2380361 - DNA, 14 bp, Homo sapiens
ttctcagtttttct

SEQ ID NO: 2380362 - DNA, 19 bp, Homo sapiens
ttctcagtttttcttaata

SEQ ID NO: 2380363 - DNA, 18 bp, Homo sapiens
ttctctgtacatattagc

SEQ ID NO: 2380364 - DNA, 13 bp, Homo sapiens
ttctgaagttata

SEQ ID NO: 2380365 - DNA, 17 bp, Homo sapiens
ttctgaagttatatttc

SEQ ID NO: 2380366 - DNA, 22 bp, Homo sapiens
ttctgaagttatatttcctata

SEQ ID NO: 2380367 - DNA, 15 bp, Homo sapiens
ttctgcctctgatgt

SEQ ID NO: 2380368 - DNA, 16 bp, Homo sapiens
ttctttgaattttcat

SEQ ID NO: 2380369 - DNA, 17 bp, Homo sapiens
ttctttgaattttcatt

SEQ ID NO: 2380370 - DNA, 23 bp, Homo sapiens
ttctttgttaatttggaccattt

SEQ ID NO: 2380371 - DNA, 22 bp, Homo sapiens
ttcttttgttttttgaagtgtt

SEQ ID NO: 2380372 - DNA, 11 bp, Homo sapiens
ttgaaacattg

SEQ ID NO: 2380373 - DNA, 18 bp, Homo sapiens
ttgaaacattgcttttaa

SEQ ID NO: 2380374 - DNA, 11 bp, Homo sapiens
ttgaattttca

SEQ ID NO: 2380375 - DNA, 12 bp, Homo sapiens
ttgaattttcat

SEQ ID NO: 2380376 - DNA, 13 bp, Homo sapiens
ttgaattttcatt

SEQ ID NO: 2380377 - DNA, 17 bp, Homo sapiens
ttgaggaaaaatatgtg

SEQ ID NO: 2380378 - DNA, 21 bp, Homo sapiens
ttgagtcttttttttttaagt

SEQ ID NO: 2380379 - DNA, 20 bp, Homo sapiens
ttgatccccacactgcctta

SEQ ID NO: 2380380 - DNA, 14 bp, Homo sapiens
ttgatgttgatgca

SEQ ID NO: 2380381 - DNA, 15 bp, Homo sapiens
ttgatgttgatgcaa

SEQ ID NO: 2380382 - DNA, 13 bp, Homo sapiens
ttgattcacatgt

SEQ ID NO: 2380383 - DNA, 14 bp, Homo sapiens
ttgattcacatgtt

SEQ ID NO: 2380384 - DNA, 19 bp, Homo sapiens
ttgattcacatgttttcaa

SEQ ID NO: 2380385 - DNA, 13 bp, Homo sapiens
ttgcatacaaaca

SEQ ID NO: 2380386 - DNA, 20 bp, Homo sapiens
ttgcatacaaacaagcatat

SEQ ID NO: 2380387 - DNA, 13 bp, Homo sapiens
ttgccaaacatta

SEQ ID NO: 2380388 - DNA, 15 bp, Homo sapiens
ttgccaaacattaat

SEQ ID NO: 2380389 - DNA, 20 bp, Homo sapiens
ttgccaaacattaatgttga

SEQ ID NO: 2380390 - DNA, 24 bp, Homo sapiens
ttgccaaacattaatgttgatttc

SEQ ID NO: 2380391 - DNA, 13 bp, Homo sapiens
ttgcttaaatgtg

SEQ ID NO: 2380392 - DNA, 15 bp, Homo sapiens
ttgcttaaatgtgaa

SEQ ID NO: 2380393 - DNA, 17 bp, Homo sapiens
ttgcttttaaaactact

SEQ ID NO: 2380394 - DNA, 14 bp, Homo sapiens
ttggaaacactaaa

SEQ ID NO: 2380395 - DNA, 15 bp, Homo sapiens
ttggaaacactaaat

SEQ ID NO: 2380396 - DNA, 18 bp, Homo sapiens
ttggaagcaggttaaatg

SEQ ID NO: 2380397 - DNA, 19 bp, Homo sapiens
ttggaagcaggttaaatgt

SEQ ID NO: 2380398 - DNA, 21 bp, Homo sapiens
ttggaagcaggttaaatgttt

SEQ ID NO: 2380399 - DNA, 14 bp, Homo sapiens
ttggagttcattca

SEQ ID NO: 2380400 - DNA, 16 bp, Homo sapiens
ttggagttcattcata

SEQ ID NO: 2380401 - DNA, 18 bp, Homo sapiens
ttggagttcattcatatt

SEQ ID NO: 2380402 - DNA, 13 bp, Homo sapiens
ttggattttatgt

SEQ ID NO: 2380403 - DNA, 17 bp, Homo sapiens
ttggattttatgttgac

SEQ ID NO: 2380404 - DNA, 20 bp, Homo sapiens
ttggattttatgttgacatt

SEQ ID NO: 2380405 - DNA, 19 bp, Homo sapiens
ttggcaggtaggaatatta

SEQ ID NO: 2380406 - DNA, 20 bp, Homo sapiens
ttggcaggtaggaatattat

SEQ ID NO: 2380407 - DNA, 13 bp, Homo sapiens
ttggtaccttgca

SEQ ID NO: 2380408 - DNA, 17 bp, Homo sapiens
ttggtaccttgcacaca

SEQ ID NO: 2380409 - DNA, 18 bp, Homo sapiens
ttggtgagttgtgccttt

SEQ ID NO: 2380410 - DNA, 20 bp, Homo sapiens
ttggttatagtgcaatatat

SEQ ID NO: 2380411 - DNA, 16 bp, Homo sapiens
ttggttttaaaatact

SEQ ID NO: 2380412 - DNA, 19 bp, Homo sapiens
ttgtatgcaagcagtttca

SEQ ID NO: 2380413 - DNA, 24 bp, Homo sapiens
ttgtatgcaagcagtttcaataaa

SEQ ID NO: 2380414 - DNA, 14 bp, Homo sapiens
ttgtcattttcatt

SEQ ID NO: 2380415 - DNA, 21 bp, Homo sapiens
ttgtccaattgtataactttg

SEQ ID NO: 2380416 - DNA, 16 bp, Homo sapiens
ttgtctaagaaacatt

SEQ ID NO: 2380417 - DNA, 18 bp, Homo sapiens
ttgtctaagaaacattgg

SEQ ID NO: 2380418 - DNA, 18 bp, Homo sapiens
ttgtctgccccaagtttt

SEQ ID NO: 2380419 - DNA, 21 bp, Homo sapiens
ttgtctgccccaagttttgtg

SEQ ID NO: 2380420 - DNA, 21 bp, Homo sapiens
ttgtgagtttgtttctttgaa

SEQ ID NO: 2380421 - DNA, 22 bp, Homo sapiens
ttgtgagtttgtttctttgaat

SEQ ID NO: 2380422 - DNA, 22 bp, Homo sapiens
ttgtgcctatattaaaggtata

SEQ ID NO: 2380423 - DNA, 23 bp, Homo sapiens
ttgttgatccccacactgcctta

SEQ ID NO: 2380424 - DNA, 19 bp, Homo sapiens
ttgtttatctagatgtaaa

SEQ ID NO: 2380425 - DNA, 20 bp, Homo sapiens
ttgtttctttgaattttcat

SEQ ID NO: 2380426 - DNA, 18 bp, Homo sapiens
ttgtttggttatagtgca

SEQ ID NO: 2380427 - DNA, 14 bp, Homo sapiens
ttgttttgttgcac

SEQ ID NO: 2380428 - DNA, 13 bp, Homo sapiens
tttaaaactactt

SEQ ID NO: 2380429 - DNA, 16 bp, Homo sapiens
tttaaaactacttagc

SEQ ID NO: 2380430 - DNA, 15 bp, Homo sapiens
tttaaaatactgtag

SEQ ID NO: 2380431 - DNA, 21 bp, Homo sapiens
tttaaaatcttattaaagttt

SEQ ID NO: 2380432 - DNA, 15 bp, Homo sapiens
tttaagcagaattgg

SEQ ID NO: 2380433 - DNA, 23 bp, Homo sapiens
tttaagctaggaaaagaaatcta

SEQ ID NO: 2380434 - DNA, 19 bp, Homo sapiens
tttaataaagcgaaaaact

SEQ ID NO: 2380435 - DNA, 13 bp, Homo sapiens
tttaatttcaagc

SEQ ID NO: 2380436 - DNA, 15 bp, Homo sapiens
tttaggactgaaaat

SEQ ID NO: 2380437 - DNA, 22 bp, Homo sapiens
tttagtggaccctgaaatgtgt

SEQ ID NO: 2380438 - DNA, 15 bp, Homo sapiens
tttatctagatgtaa

SEQ ID NO: 2380439 - DNA, 16 bp, Homo sapiens
tttatctagatgtaaa

SEQ ID NO: 2380440 - DNA, 17 bp, Homo sapiens
tttatctagatgtaaat

SEQ ID NO: 2380441 - DNA, 13 bp, Homo sapiens
tttatgttgacat

SEQ ID NO: 2380442 - DNA, 15 bp, Homo sapiens
tttatgttgacattt

SEQ ID NO: 2380443 - DNA, 18 bp, Homo sapiens
tttatgttgacatttgtt

SEQ ID NO: 2380444 - DNA, 20 bp, Homo sapiens
tttatgttttggtccacttt

SEQ ID NO: 2380445 - DNA, 23 bp, Homo sapiens
tttattactagttagcatacaca

SEQ ID NO: 2380446 - DNA, 18 bp, Homo sapiens
tttattgaggaaaaatat

SEQ ID NO: 2380447 - DNA, 16 bp, Homo sapiens
tttcaagaacttgttt

SEQ ID NO: 2380448 - DNA, 14 bp, Homo sapiens
tttcaataaagttt

SEQ ID NO: 2380449 - DNA, 15 bp, Homo sapiens
tttcaataaagtttg

SEQ ID NO: 2380450 - DNA, 21 bp, Homo sapiens
tttcacgtcataggaagttag

SEQ ID NO: 2380451 - DNA, 19 bp, Homo sapiens
tttcagatttgcacaaaaa

SEQ ID NO: 2380452 - DNA, 22 bp, Homo sapiens
tttcagctaggaacaaatcttc

SEQ ID NO: 2380453 - DNA, 12 bp, Homo sapiens
tgtcattttcat

SEQ ID NO: 2380454 - DNA, 14 bp, Homo sapiens
tgtcattttcatta

SEQ ID NO: 2380455 - DNA, 17 bp, Homo sapiens
tgtcctgtgtcagttta

SEQ ID NO: 2380456 - DNA, 18 bp, Homo sapiens
tgtcctgtgtcagtttat

SEQ ID NO: 2380457 - DNA, 16 bp, Homo sapiens
tgtgaaggaccttcac

SEQ ID NO: 2380458 - DNA, 18 bp, Homo sapiens
tgtgaaggaccttcactc

SEQ ID NO: 2380459 - DNA, 17 bp, Homo sapiens
tgtgaattactaacttc

SEQ ID NO: 2380460 - DNA, 19 bp, Homo sapiens
tgtgaattactaacttcta

SEQ ID NO: 2380461 - DNA, 19 bp, Homo sapiens
tgtgacatttgtcattttc

SEQ ID NO: 2380462 - DNA, 20 bp, Homo sapiens
tgtgacatttgtcattttca

SEQ ID NO: 2380463 - DNA, 19 bp, Homo sapiens
tgtgagtttgtttctttga

SEQ ID NO: 2380464 - DNA, 15 bp, Homo sapiens
tgtgatgtgacattt

SEQ ID NO: 2380465 - DNA, 16 bp, Homo sapiens
tgtgatgtgacatttg

SEQ ID NO: 2380466 - DNA, 14 bp, Homo sapiens
tgtgccttttttat

SEQ ID NO: 2380467 - DNA, 12 bp, Homo sapiens
tgtgtaattttt

SEQ ID NO: 2380468 - DNA, 17 bp, Homo sapiens
tgtgtaatttttctgta

SEQ ID NO: 2380469 - DNA, 19 bp, Homo sapiens
tgtgtaatttttctgtata

SEQ ID NO: 2380470 - DNA, 19 bp, Homo sapiens
tgtgtcagtttatgttttg

SEQ ID NO: 2380471 - DNA, 15 bp, Homo sapiens
tgtgtgatgtgacat

SEQ ID NO: 2380472 - DNA, 16 bp, Homo sapiens
tgtgttctagtcattg

SEQ ID NO: 2380473 - DNA, 14 bp, Homo sapiens
tgttaaagatgtag

SEQ ID NO: 2380474 - DNA, 18 bp, Homo sapiens
tgttaaagatgtagcaaa

SEQ ID NO: 2380475 - DNA, 19 bp, Homo sapiens
tgttacaaaatgtaactgt

SEQ ID NO: 2380476 - DNA, 21 bp, Homo sapiens
tgttacaaaatgtaactgtta

SEQ ID NO: 2380477 - DNA, 17 bp, Homo sapiens
tgttaccattggaaatt

SEQ ID NO: 2380478 - DNA, 16 bp, Homo sapiens
tgttctcatgtaagaa

SEQ ID NO: 2380479 - DNA, 14 bp, Homo sapiens
tgttctgttacaaa

SEQ ID NO: 2380480 - DNA, 22 bp, Homo sapiens
tgttctgttacaaaatgtaact

SEQ ID NO: 2380481 - DNA, 23 bp, Homo sapiens
tgttctgttacaaaatgtaactg

SEQ ID NO: 2380482 - DNA, 13 bp, Homo sapiens
tgttgagtgctta

SEQ ID NO: 2380483 - DNA, 22 bp, Homo sapiens
tgttgatgcaatccttacaaat

SEQ ID NO: 2380484 - DNA, 19 bp, Homo sapiens
tgttgatttctagttattt

SEQ ID NO: 2380485 - DNA, 22 bp, Homo sapiens
tgttgcactgaagtttgataaa

SEQ ID NO: 2380486 - DNA, 20 bp, Homo sapiens
tgtttagccagtgttttcca

SEQ ID NO: 2380487 - DNA, 16 bp, Homo sapiens
tgtttatctagatgta

SEQ ID NO: 2380488 - DNA, 12 bp, Homo sapiens
tgtttctttgaa

SEQ ID NO: 2380489 - DNA, 16 bp, Homo sapiens
tgtttggttttaaaat

SEQ ID NO: 2380490 - DNA, 14 bp, Homo sapiens
tgttttcaaatgga

SEQ ID NO: 2380491 - DNA, 13 bp, Homo sapiens
tgttttgtaaact

SEQ ID NO: 2380492 - DNA, 15 bp, Homo sapiens
tgttttgtaaacttt

SEQ ID NO: 2380493 - DNA, 18 bp, Homo sapiens
tgttttgtaaactttgaa

SEQ ID NO: 2380494 - DNA, 18 bp, Homo sapiens
tgttttgttgcactgaag

SEQ ID NO: 2380495 - DNA, 19 bp, Homo sapiens
tgtttttcagttcaaagtc

SEQ ID NO: 2380496 - DNA, 16 bp, Homo sapiens
tgttttttgaagtgtt

SEQ ID NO: 2380497 - DNA, 16 bp, Homo sapiens
ttaaaaagtcttttaa

SEQ ID NO: 2380498 - DNA, 16 bp, Homo sapiens
ttaaaactacttagca

SEQ ID NO: 2380499 - DNA, 11 bp, Homo sapiens
ttaaaatactg

SEQ ID NO: 2380500 - DNA, 16 bp, Homo sapiens
ttaaaatactgtagat

SEQ ID NO: 2380501 - DNA, 18 bp, Homo sapiens
ttaaaatactgtagataa

SEQ ID NO: 2380502 - DNA, 14 bp, Homo sapiens
ttaaaatatgcact

SEQ ID NO: 2380503 - DNA, 13 bp, Homo sapiens
ttaaaatttgaaa

SEQ ID NO: 2380504 - DNA, 21 bp, Homo sapiens
ttaaaattttaagctaggaaa

SEQ ID NO: 2380505 - DNA, 15 bp, Homo sapiens
ttaaaggtatacaaa

SEQ ID NO: 2380506 - DNA, 14 bp, Homo sapiens
ttaaagtttcaaaa

SEQ ID NO: 2380507 - DNA, 16 bp, Homo sapiens
ttaaagtttcaaaaat

SEQ ID NO: 2380508 - DNA, 18 bp, Homo sapiens
ttaaagtttcaaaaatct

SEQ ID NO: 2380509 - DNA, 21 bp, Homo sapiens
ttaaagtttcaaaaatctgaa

SEQ ID NO: 2380510 - DNA, 21 bp, Homo sapiens
ttaaatgttttgtaaactttg

SEQ ID NO: 2380511 - DNA, 23 bp, Homo sapiens
ttaaatgttttgtaaactttgaa

SEQ ID NO: 2380512 - DNA, 16 bp, Homo sapiens
ttaagaattgaagata

SEQ ID NO: 2380513 - DNA, 15 bp, Homo sapiens
ttaagcagaattgga

SEQ ID NO: 2380514 - DNA, 22 bp, Homo sapiens
ttaagctaggaaaagaaatcta

SEQ ID NO: 2380515 - DNA, 12 bp, Homo sapiens
ttaagtgaaatt

SEQ ID NO: 2380516 - DNA, 20 bp, Homo sapiens
ttaataaagcgaaaaactca

SEQ ID NO: 2380517 - DNA, 15 bp, Homo sapiens
ttaatgttgatttct

SEQ ID NO: 2380518 - DNA, 21 bp, Homo sapiens
ttaatgttgatttctagttat

SEQ ID NO: 2380519 - DNA, 12 bp, Homo sapiens
ttaattctcttt

SEQ ID NO: 2380520 - DNA, 18 bp, Homo sapiens
ttaatttggaccattttc

SEQ ID NO: 2380521 - DNA, 18 bp, Homo sapiens
ttacaaaggctgtattca

SEQ ID NO: 2380522 - DNA, 12 bp, Homo sapiens
ttacaaatgatt

SEQ ID NO: 2380523 - DNA, 14 bp, Homo sapiens
ttacaactgagttg

SEQ ID NO: 2380524 - DNA, 14 bp, Homo sapiens
ttacagttactttt

SEQ ID NO: 2380525 - DNA, 15 bp, Homo sapiens
ttaccattggaaatt

SEQ ID NO: 2380526 - DNA, 18 bp, Homo sapiens
ttaccattggaaatttca

SEQ ID NO: 2380527 - DNA, 19 bp, Homo sapiens
ttactagttagcatacaca

SEQ ID NO: 2380528 - DNA, 20 bp, Homo sapiens
ttacttttccttgcatacaa

SEQ ID NO: 2380529 - DNA, 15 bp, Homo sapiens
ttagacttctgtttt

SEQ ID NO: 2380530 - DNA, 17 bp, Homo sapiens
ttagacttctgttttca

SEQ ID NO: 2380531 - DNA, 15 bp, Homo sapiens
ttagcgacaacagat

SEQ ID NO: 2380532 - DNA, 16 bp, Homo sapiens
ttagcgacaacagatt

SEQ ID NO: 2380533 - DNA, 22 bp, Homo sapiens
ttaggactgaaaatactcctga

SEQ ID NO: 2380534 - DNA, 18 bp, Homo sapiens
ttaggcagtataaagaat

SEQ ID NO: 2380535 - DNA, 19 bp, Homo sapiens
ttaggccaaagacaaatag

SEQ ID NO: 2380536 - DNA, 19 bp, Homo sapiens
ttagtactttatagaagaa

SEQ ID NO: 2380537 - DNA, 22 bp, Homo sapiens
ttagtaggatatgcctgctctt

SEQ ID NO: 2380538 - DNA, 16 bp, Homo sapiens
ttagtggaccctgaaa

SEQ ID NO: 2380539 - DNA, 17 bp, Homo sapiens
ttagttttattttctaa

SEQ ID NO: 2380540 - DNA, 15 bp, Homo sapiens
ttatagtgcaatata

SEQ ID NO: 2380541 - DNA, 15 bp, Homo sapiens
ttatatttggatgca

SEQ ID NO: 2380542 - DNA, 16 bp, Homo sapiens
ttatatttttcttaaa

SEQ ID NO: 2380543 - DNA, 20 bp, Homo sapiens
ttatctaccaactttcaaga

SEQ ID NO: 2380544 - DNA, 19 bp, Homo sapiens
ttatctagatgtaaatttt

SEQ ID NO: 2380545 - DNA, 16 bp, Homo sapiens
ttatggtaatcatatt

SEQ ID NO: 2380546 - DNA, 13 bp, Homo sapiens
ttatgttgacatt

SEQ ID NO: 2380547 - DNA, 15 bp, Homo sapiens
ttatgttgacatttg

SEQ ID NO: 2380548 - DNA, 16 bp, Homo sapiens
ttatgttgacatttgt

SEQ ID NO: 2380549 - DNA, 20 bp, Homo sapiens
ttatgttttggtccactttt

SEQ ID NO: 2380550 - DNA, 23 bp, Homo sapiens
ttatgttttggtccacttttcca

SEQ ID NO: 2380551 - DNA, 17 bp, Homo sapiens
ttattaaagtttcaaaa

SEQ ID NO: 2380552 - DNA, 19 bp, Homo sapiens
ttattccatattagaaaac

SEQ ID NO: 2380553 - DNA, 23 bp, Homo sapiens
ttattccatattagaaaactttg

SEQ ID NO: 2380554 - DNA, 19 bp, Homo sapiens
ttattgagagagatgtgta

SEQ ID NO: 2380555 - DNA, 20 bp, Homo sapiens
ttattgagagagatgtgtaa

SEQ ID NO: 2380556 - DNA, 19 bp, Homo sapiens
ttattgaggaaaaatatgt

SEQ ID NO: 2380557 - DNA, 21 bp, Homo sapiens
ttattgaggaaaaatatgtga

SEQ ID NO: 2380558 - DNA, 22 bp, Homo sapiens
ttattgaggaaaaatatgtgaa

SEQ ID NO: 2380559 - DNA, 23 bp, Homo sapiens
ttattgaggaaaaatatgtgaag

SEQ ID NO: 2380560 - DNA, 12 bp, Homo sapiens
ttatttattctg

SEQ ID NO: 2380561 - DNA, 14 bp, Homo sapiens
ttattttctaaagt

SEQ ID NO: 2380562 - DNA, 18 bp, Homo sapiens
ttcaaagtcatgatgttt

SEQ ID NO: 2380563 - DNA, 15 bp, Homo sapiens
ttcaataaagtttga

SEQ ID NO: 2380564 - DNA, 18 bp, Homo sapiens
ttcaataaagtttgatct

SEQ ID NO: 2380565 - DNA, 21 bp, Homo sapiens
ttcaataaagtttgatcttcc

SEQ ID NO: 2380566 - DNA, 15 bp, Homo sapiens
ttcacaaatattaaa

SEQ ID NO: 2380567 - DNA, 17 bp, Homo sapiens
ttcacatgttttcaaat

SEQ ID NO: 2380568 - DNA, 21 bp, Homo sapiens
aatgaccttgtaatgtaactg

SEQ ID NO: 2380569 - DNA, 22 bp, Homo sapiens
aatgaccttgtaatgtaactgc

SEQ ID NO: 2380570 - DNA, 20 bp, Homo sapiens
aatgattgcttttaaaattt

SEQ ID NO: 2380571 - DNA, 18 bp, Homo sapiens
aatgcatgctttccatat

SEQ ID NO: 2380572 - DNA, 21 bp, Homo sapiens
aatgctatgtcatttcatgtc

SEQ ID NO: 2380573 - DNA, 14 bp, Homo sapiens
aatggcaacaaact

SEQ ID NO: 2380574 - DNA, 17 bp, Homo sapiens
aatggcaacaaactgca

SEQ ID NO: 2380575 - DNA, 20 bp, Homo sapiens
aatggcaacaaactgcacat

SEQ ID NO: 2380576 - DNA, 13 bp, Homo sapiens
aatgtaactgtta

SEQ ID NO: 2380577 - DNA, 23 bp, Homo sapiens
aatgtaactgttaccattggaaa

SEQ ID NO: 2380578 - DNA, 18 bp, Homo sapiens
aatgtatagtatttgaaa

SEQ ID NO: 2380579 - DNA, 13 bp, Homo sapiens
aatgttaaagatg

SEQ ID NO: 2380580 - DNA, 15 bp, Homo sapiens
aatgttaaagatgta

SEQ ID NO: 2380581 - DNA, 15 bp, Homo sapiens
aatgttgatttctag

SEQ ID NO: 2380582 - DNA, 20 bp, Homo sapiens
aatgttgatttctagttatt

SEQ ID NO: 2380583 - DNA, 14 bp, Homo sapiens
aatgttttgtaaac

SEQ ID NO: 2380584 - DNA, 18 bp, Homo sapiens
aatgttttgtaaactttg

SEQ ID NO: 2380585 - DNA, 19 bp, Homo sapiens
aatgttttgtaaactttga

SEQ ID NO: 2380586 - DNA, 23 bp, Homo sapiens
aattactaacttctaaaactgta

SEQ ID NO: 2380587 - DNA, 22 bp, Homo sapiens
aattagtttgttatagttgaag

SEQ ID NO: 2380588 - DNA, 15 bp, Homo sapiens
aattcaattcatgta

SEQ ID NO: 2380589 - DNA, 16 bp, Homo sapiens
aattcaattcatgtaa

SEQ ID NO: 2380590 - DNA, 16 bp, Homo sapiens
aattcattttctcttt

SEQ ID NO: 2380591 - DNA, 18 bp, Homo sapiens
aattctgaagttatattt

SEQ ID NO: 2380592 - DNA, 19 bp, Homo sapiens
aattctgaagttatatttc

SEQ ID NO: 2380593 - DNA, 21 bp, Homo sapiens
aattctgaagttatatttcct

SEQ ID NO: 2380594 - DNA, 18 bp, Homo sapiens
aattcttattccatatta

SEQ ID NO: 2380595 - DNA, 14 bp, Homo sapiens
aattgatgttgatg

SEQ ID NO: 2380596 - DNA, 17 bp, Homo sapiens
aattgatgttgatgcaa

SEQ ID NO: 2380597 - DNA, 23 bp, Homo sapiens
aatttattgaggaaaaatatgtg

SEQ ID NO: 2380598 - DNA, 17 bp, Homo sapiens
aatttcaagcttatttt

SEQ ID NO: 2380599 - DNA, 22 bp, Homo sapiens
aatttcaagcttattttggaga

SEQ ID NO: 2380600 - DNA, 21 bp, Homo sapiens
aatttcacgtcataggaagtt

SEQ ID NO: 2380601 - DNA, 13 bp, Homo sapiens
aatttgaaacatt

SEQ ID NO: 2380602 - DNA, 15 bp, Homo sapiens
aatttgaaacattgc

SEQ ID NO: 2380603 - DNA, 21 bp, Homo sapiens
aatttgaaacattgcttttaa

SEQ ID NO: 2380604 - DNA, 17 bp, Homo sapiens
aattttcagatttgcac

SEQ ID NO: 2380605 - DNA, 18 bp, Homo sapiens
aattttcagatttgcaca

SEQ ID NO: 2380606 - DNA, 14 bp, Homo sapiens
aatttttctgtata

SEQ ID NO: 2380607 - DNA, 22 bp, Homo sapiens
acaaaaccacagtgtaccatta

SEQ ID NO: 2380608 - DNA, 13 bp, Homo sapiens
acaaaatgtaact

SEQ ID NO: 2380609 - DNA, 16 bp, Homo sapiens
acaaaggctgtattca

SEQ ID NO: 2380610 - DNA, 14 bp, Homo sapiens
acaaataacaactt

SEQ ID NO: 2380611 - DNA, 16 bp, Homo sapiens
acaaatattaaaaagt

SEQ ID NO: 2380612 - DNA, 20 bp, Homo sapiens
acaaatattaaaaagtcttt

SEQ ID NO: 2380613 - DNA, 15 bp, Homo sapiens
acaaatgattgcttt

SEQ ID NO: 2380614 - DNA, 18 bp, Homo sapiens
acaaatgattgcttttaa

SEQ ID NO: 2380615 - DNA, 21 bp, Homo sapiens
acaaattatgctaagaatttt

SEQ ID NO: 2380616 - DNA, 22 bp, Homo sapiens
acaacagattggattttatgtt

SEQ ID NO: 2380617 - DNA, 23 bp, Homo sapiens
acaacagattggattttatgttg

SEQ ID NO: 2380618 - DNA, 16 bp, Homo sapiens
acaacaggaaatgaaa

SEQ ID NO: 2380619 - DNA, 17 bp, Homo sapiens
acaagcatataaaatgg

SEQ ID NO: 2380620 - DNA, 18 bp, Homo sapiens
acaatatttgtgtgctaa

SEQ ID NO: 2380621 - DNA, 13 bp, Homo sapiens
acaattttcagat

SEQ ID NO: 2380622 - DNA, 15 bp, Homo sapiens
acaattttcagattt

SEQ ID NO: 2380623 - DNA, 19 bp, Homo sapiens
acaattttcagatttgcac

SEQ ID NO: 2380624 - DNA, 14 bp, Homo sapiens
acacatcatctgta

SEQ ID NO: 2380625 - DNA, 12 bp, Homo sapiens
acactaaatgtt

SEQ ID NO: 2380626 - DNA, 19 bp, Homo sapiens
acactaaatgttaaagatg

SEQ ID NO: 2380627 - DNA, 21 bp, Homo sapiens
acagaaattggtaccttgcac

SEQ ID NO: 2380628 - DNA, 13 bp, Homo sapiens
acagattggattt

SEQ ID NO: 2380629 - DNA, 21 bp, Homo sapiens
acagattggattttatgttga

SEQ ID NO: 2380630 - DNA, 23 bp, Homo sapiens
acagattggattttatgttgaca

SEQ ID NO: 2380631 - DNA, 20 bp, Homo sapiens
acagccattttgtttttaat

SEQ ID NO: 2380632 - DNA, 15 bp, Homo sapiens
acaggtactttgtct

SEQ ID NO: 2380633 - DNA, 20 bp, Homo sapiens
acagtgtaccattaaaatat

SEQ ID NO: 2380634 - DNA, 23 bp, Homo sapiens
acagtgtaccattaaaatatgca

SEQ ID NO: 2380635 - DNA, 18 bp, Homo sapiens
acatcatctgtaagctgt

SEQ ID NO: 2380636 - DNA, 19 bp, Homo sapiens
acatgatttcacaaatatt

SEQ ID NO: 2380637 - DNA, 21 bp, Homo sapiens
acatgatttcacaaatattaa

SEQ ID NO: 2380638 - DNA, 14 bp, Homo sapiens
acatgttttcaaat

SEQ ID NO: 2380639 - DNA, 16 bp, Homo sapiens
acatgttttcaaatgg

SEQ ID NO: 2380640 - DNA, 15 bp, Homo sapiens
acattaatgttgatt

SEQ ID NO: 2380641 - DNA, 16 bp, Homo sapiens
acattagtactttata

SEQ ID NO: 2380642 - DNA, 18 bp, Homo sapiens
acattagtactttataga

SEQ ID NO: 2380643 - DNA, 19 bp, Homo sapiens
acattagtactttatagaa

SEQ ID NO: 2380644 - DNA, 23 bp, Homo sapiens
acattagtactttatagaagaat

SEQ ID NO: 2380645 - DNA, 19 bp, Homo sapiens
acattctcagtttttctta

SEQ ID NO: 2380646 - DNA, 14 bp, Homo sapiens
acattgcttttaaa

SEQ ID NO: 2380647 - DNA, 17 bp, Homo sapiens
acattgcttttaaaact

SEQ ID NO: 2380648 - DNA, 18 bp, Homo sapiens
acattgcttttaaaacta

SEQ ID NO: 2380649 - DNA, 20 bp, Homo sapiens
acattggaagcaggttaaat

SEQ ID NO: 2380650 - DNA, 11 bp, Homo sapiens
acatttgtcat

SEQ ID NO: 2380651 - DNA, 14 bp, Homo sapiens
acatttgtcatttt

SEQ ID NO: 2380652 - DNA, 16 bp, Homo sapiens
acatttgtcattttca

SEQ ID NO: 2380653 - DNA, 18 bp, Homo sapiens
acatttgtcattttcatt

SEQ ID NO: 2380654 - DNA, 19 bp, Homo sapiens
acatttgtcattttcatta

SEQ ID NO: 2380655 - DNA, 22 bp, Homo sapiens
acatttgtcattttcattagca

SEQ ID NO: 2380656 - DNA, 18 bp, Homo sapiens
accaaactggatcactgg

SEQ ID NO: 2380657 - DNA, 15 bp, Homo sapiens
accaactttcaagaa

SEQ ID NO: 2380658 - DNA, 22 bp, Homo sapiens
accacagtgtaccattaaaata

SEQ ID NO: 2380659 - DNA, 23 bp, Homo sapiens
accagcgcactgatggtcactgg

SEQ ID NO: 2380660 - DNA, 18 bp, Homo sapiens
accagtacattctcagtt

SEQ ID NO: 2380661 - DNA, 16 bp, Homo sapiens
accatacagatctgtt

SEQ ID NO: 2380662 - DNA, 19 bp, Homo sapiens
accattaaaatatgcacta

SEQ ID NO: 2380663 - DNA, 13 bp, Homo sapiens
accattggaaatt

SEQ ID NO: 2380664 - DNA, 18 bp, Homo sapiens
accattggaaatttcacg

SEQ ID NO: 2380665 - DNA, 19 bp, Homo sapiens
accattggaaatttcacgt

SEQ ID NO: 2380666 - DNA, 20 bp, Homo sapiens
accattggaaatttcacgtc

SEQ ID NO: 2380667 - DNA, 14 bp, Homo sapiens
accattttcctgca

SEQ ID NO: 2380668 - DNA, 15 bp, Homo sapiens
acccaccatacagat

SEQ ID NO: 2380669 - DNA, 15 bp, Homo sapiens
accctgtcaaacatt

SEQ ID NO: 2380670 - DNA, 18 bp, Homo sapiens
accctgtcaaacattagt

SEQ ID NO: 2380671 - DNA, 14 bp, Homo sapiens
accttaaaatttga

SEQ ID NO: 2380672 - DNA, 16 bp, Homo sapiens
accttgcacacatcat

SEQ ID NO: 2380673 - DNA, 19 bp, Homo sapiens
acgtgtatgtttttcagtt

SEQ ID NO: 2380674 - DNA, 11 bp, Homo sapiens
actaaatgtta

SEQ ID NO: 2380675 - DNA, 12 bp, Homo sapiens
actaaatgttaa

SEQ ID NO: 2380676 - DNA, 13 bp, Homo sapiens
actaaatgttaaa

SEQ ID NO: 2380677 - DNA, 14 bp, Homo sapiens
actaaatgttaaag

SEQ ID NO: 2380678 - DNA, 22 bp, Homo sapiens
actaacttctaaaactgtactt

SEQ ID NO: 2380679 - DNA, 21 bp, Homo sapiens
actaagatcggttaacaaata

SEQ ID NO: 2380680 - DNA, 16 bp, Homo sapiens
actcaaccaaatggta

SEQ ID NO: 2380681 - DNA, 14 bp, Homo sapiens
atgtatagtatttg

SEQ ID NO: 2380682 - DNA, 17 bp, Homo sapiens
atgtattttgtgagttt

SEQ ID NO: 2380683 - DNA, 20 bp, Homo sapiens
atgtattttgtgagtttgtt

SEQ ID NO: 2380684 - DNA, 13 bp, Homo sapiens
atgtcatttcatg

SEQ ID NO: 2380685 - DNA, 14 bp, Homo sapiens
atgtcatttcatgt

SEQ ID NO: 2380686 - DNA, 18 bp, Homo sapiens
atgtcctgtgtcagttta

SEQ ID NO: 2380687 - DNA, 20 bp, Homo sapiens
atgtcctgtgtcagtttatg

SEQ ID NO: 2380688 - DNA, 21 bp, Homo sapiens
atgtcctgtgtcagtttatgt

SEQ ID NO: 2380689 - DNA, 18 bp, Homo sapiens
atgtgacatttgtcattt

SEQ ID NO: 2380690 - DNA, 19 bp, Homo sapiens
atgtgacatttgtcatttt

SEQ ID NO: 2380691 - DNA, 22 bp, Homo sapiens
atgtgacatttgtcattttcat

SEQ ID NO: 2380692 - DNA, 19 bp, Homo sapiens
atgtgtaatttttctgtat

SEQ ID NO: 2380693 - DNA, 15 bp, Homo sapiens
atgttaaagatgtag

SEQ ID NO: 2380694 - DNA, 18 bp, Homo sapiens
atgttaaagatgtagcaa

SEQ ID NO: 2380695 - DNA, 20 bp, Homo sapiens
atgttaaagatgtagcaaac

SEQ ID NO: 2380696 - DNA, 14 bp, Homo sapiens
atgttgacatttgt

SEQ ID NO: 2380697 - DNA, 12 bp, Homo sapiens
atgttgatttct

SEQ ID NO: 2380698 - DNA, 13 bp, Homo sapiens
atgttgatttcta

SEQ ID NO: 2380699 - DNA, 14 bp, Homo sapiens
atgtttaagcagaa

SEQ ID NO: 2380700 - DNA, 21 bp, Homo sapiens
atgtttaagcagaattggaaa

SEQ ID NO: 2380701 - DNA, 15 bp, Homo sapiens
atgtttagataaaat

SEQ ID NO: 2380702 - DNA, 18 bp, Homo sapiens
atgtttagataaaattga

SEQ ID NO: 2380703 - DNA, 12 bp, Homo sapiens
atgttttcaaat

SEQ ID NO: 2380704 - DNA, 13 bp, Homo sapiens
atgttttcaaatg

SEQ ID NO: 2380705 - DNA, 23 bp, Homo sapiens
atgttttggtccacttttccagt

SEQ ID NO: 2380706 - DNA, 16 bp, Homo sapiens
atgttttgtaaacttt

SEQ ID NO: 2380707 - DNA, 17 bp, Homo sapiens
atgttttgtaaactttg

SEQ ID NO: 2380708 - DNA, 20 bp, Homo sapiens
atgttttgtaaactttgaaa

SEQ ID NO: 2380709 - DNA, 13 bp, Homo sapiens
atgtttttaaaat

SEQ ID NO: 2380710 - DNA, 17 bp, Homo sapiens
atgtttttaaaatctta

SEQ ID NO: 2380711 - DNA, 23 bp, Homo sapiens
atgtttttaaaatcttattaaag

SEQ ID NO: 2380712 - DNA, 13 bp, Homo sapiens
atgtttttcagtt

SEQ ID NO: 2380713 - DNA, 13 bp, Homo sapiens
attaaaaagtctt

SEQ ID NO: 2380714 - DNA, 18 bp, Homo sapiens
attaaaatatgcactaag

SEQ ID NO: 2380715 - DNA, 16 bp, Homo sapiens
attaaaggtatacaaa

SEQ ID NO: 2380716 - DNA, 14 bp, Homo sapiens
attaaagtttcaaa

SEQ ID NO: 2380717 - DNA, 16 bp, Homo sapiens
attaaagtttcaaaaa

SEQ ID NO: 2380718 - DNA, 18 bp, Homo sapiens
attaaagtttcaaaaatc

SEQ ID NO: 2380719 - DNA, 12 bp, Homo sapiens
attaatgttgat

SEQ ID NO: 2380720 - DNA, 14 bp, Homo sapiens
attaatgttgattt

SEQ ID NO: 2380721 - DNA, 16 bp, Homo sapiens
attaatgttgatttct

SEQ ID NO: 2380722 - DNA, 13 bp, Homo sapiens
attacaatatttg

SEQ ID NO: 2380723 - DNA, 14 bp, Homo sapiens
attacaatatttgt

SEQ ID NO: 2380724 - DNA, 15 bp, Homo sapiens
attactaacttctaa

SEQ ID NO: 2380725 - DNA, 15 bp, Homo sapiens
attagacttctgttt

SEQ ID NO: 2380726 - DNA, 20 bp, Homo sapiens
attagacttctgttttcaat

SEQ ID NO: 2380727 - DNA, 14 bp, Homo sapiens
attagcaaaaaaag

SEQ ID NO: 2380728 - DNA, 20 bp, Homo sapiens
attagcaaaaaaagttgtat

SEQ ID NO: 2380729 - DNA, 21 bp, Homo sapiens
attagcaaaaaaagttgtatg

SEQ ID NO: 2380730 - DNA, 20 bp, Homo sapiens
attagcgacaacagattgga

SEQ ID NO: 2380731 - DNA, 13 bp, Homo sapiens
attagtactttat

SEQ ID NO: 2380732 - DNA, 15 bp, Homo sapiens
attagtactttatag

SEQ ID NO: 2380733 - DNA, 21 bp, Homo sapiens
attagtactttatagaagaat

SEQ ID NO: 2380734 - DNA, 12 bp, Homo sapiens
attatctgcctt

SEQ ID NO: 2380735 - DNA, 16 bp, Homo sapiens
attatgctaagaattt

SEQ ID NO: 2380736 - DNA, 17 bp, Homo sapiens
attcacatgttttcaaa

SEQ ID NO: 2380737 - DNA, 21 bp, Homo sapiens
attcagcaaggcgctaacttg

SEQ ID NO: 2380738 - DNA, 19 bp, Homo sapiens
attcatattacaatatttg

SEQ ID NO: 2380739 - DNA, 20 bp, Homo sapiens
attcatattacaatatttgt

SEQ ID NO: 2380740 - DNA, 15 bp, Homo sapiens
attccatattagaaa

SEQ ID NO: 2380741 - DNA, 23 bp, Homo sapiens
attcctatcttattgttcgttta

SEQ ID NO: 2380742 - DNA, 15 bp, Homo sapiens
attccttatttaaga

SEQ ID NO: 2380743 - DNA, 18 bp, Homo sapiens
attctcagtttttcttaa

SEQ ID NO: 2380744 - DNA, 11 bp, Homo sapiens
attctctgtac

SEQ ID NO: 2380745 - DNA, 12 bp, Homo sapiens
attctgaagtta

SEQ ID NO: 2380746 - DNA, 15 bp, Homo sapiens
attctgaagttatat

SEQ ID NO: 2380747 - DNA, 22 bp, Homo sapiens
attctgggaatgtatagtattt

SEQ ID NO: 2380748 - DNA, 15 bp, Homo sapiens
attgaggaaaaatat

SEQ ID NO: 2380749 - DNA, 14 bp, Homo sapiens
attgccaaacatta

SEQ ID NO: 2380750 - DNA, 13 bp, Homo sapiens
attgcttttaaaa

SEQ ID NO: 2380751 - DNA, 18 bp, Homo sapiens
attgcttttaaaactact

SEQ ID NO: 2380752 - DNA, 12 bp, Homo sapiens
attggaagcagg

SEQ ID NO: 2380753 - DNA, 17 bp, Homo sapiens
attggattttatgttga

SEQ ID NO: 2380754 - DNA, 21 bp, Homo sapiens
attggattttatgttgacatt

SEQ ID NO: 2380755 - DNA, 17 bp, Homo sapiens
attggtaccttgcacac

SEQ ID NO: 2380756 - DNA, 18 bp, Homo sapiens
attggtaccttgcacaca

SEQ ID NO: 2380757 - DNA, 17 bp, Homo sapiens
attgtttatctagatgt

SEQ ID NO: 2380758 - DNA, 19 bp, Homo sapiens
attgtttatctagatgtaa

SEQ ID NO: 2380759 - DNA, 21 bp, Homo sapiens
attgtttatctagatgtaaat

SEQ ID NO: 2380760 - DNA, 19 bp, Homo sapiens
atttatggtaatcatatta

SEQ ID NO: 2380761 - DNA, 18 bp, Homo sapiens
atttattctgggaatgta

SEQ ID NO: 2380762 - DNA, 15 bp, Homo sapiens
atttattgaggaaaa

SEQ ID NO: 2380763 - DNA, 16 bp, Homo sapiens
atttattttaatgtat

SEQ ID NO: 2380764 - DNA, 23 bp, Homo sapiens
atttcacaaatattaaaaagtct

SEQ ID NO: 2380765 - DNA, 21 bp, Homo sapiens
atttcatgtcctgtgtcagtt

SEQ ID NO: 2380766 - DNA, 14 bp, Homo sapiens
atttccatgtatgc

SEQ ID NO: 2380767 - DNA, 15 bp, Homo sapiens
atttccatgtatgca

SEQ ID NO: 2380768 - DNA, 14 bp, Homo sapiens
atttccgtaattct

SEQ ID NO: 2380769 - DNA, 17 bp, Homo sapiens
atttctagttatttatt

SEQ ID NO: 2380770 - DNA, 13 bp, Homo sapiens
atttgaaacattg

SEQ ID NO: 2380771 - DNA, 18 bp, Homo sapiens
atttggaccattttcctg

SEQ ID NO: 2380772 - DNA, 14 bp, Homo sapiens
atttggatgcagag

SEQ ID NO: 2380773 - DNA, 15 bp, Homo sapiens
atttgtcattttcat

SEQ ID NO: 2380774 - DNA, 15 bp, Homo sapiens
atttgtgtgctaaac

SEQ ID NO: 2380775 - DNA, 14 bp, Homo sapiens
attttaatgtattg

SEQ ID NO: 2380776 - DNA, 19 bp, Homo sapiens
attttaatttcaagcttat

SEQ ID NO: 2380777 - DNA, 20 bp, Homo sapiens
attttagtggaccctgaaat

SEQ ID NO: 2380778 - DNA, 23 bp, Homo sapiens
attttagtggaccctgaaatgtg

SEQ ID NO: 2380779 - DNA, 14 bp, Homo sapiens
attttagttttatt

SEQ ID NO: 2380780 - DNA, 22 bp, Homo sapiens
attttagttttattttctaaag

SEQ ID NO: 2380781 - DNA, 13 bp, Homo sapiens
attttatgttgac

SEQ ID NO: 2380782 - DNA, 15 bp, Homo sapiens
attttatgttgacat

SEQ ID NO: 2380783 - DNA, 17 bp, Homo sapiens
attttatgttgacattt

SEQ ID NO: 2380784 - DNA, 19 bp, Homo sapiens
attttatgttgacatttgt

SEQ ID NO: 2380785 - DNA, 16 bp, Homo sapiens
attttcagatttgcac

SEQ ID NO: 2380786 - DNA, 17 bp, Homo sapiens
attttcagatttgcaca

SEQ ID NO: 2380787 - DNA, 18 bp, Homo sapiens
attttcagatttgcacaa

SEQ ID NO: 2380788 - DNA, 15 bp, Homo sapiens
attttcattagcaaa

SEQ ID NO: 2380789 - DNA, 22 bp, Homo sapiens
attttcattagcaaaaaaagtt

SEQ ID NO: 2380790 - DNA, 14 bp, Homo sapiens
attttcattttaca

SEQ ID NO: 2380791 - DNA, 16 bp, Homo sapiens
attttctaaagtactg

SEQ ID NO: 2380792 - DNA, 20 bp, Homo sapiens
attttctaaagtactgagca

SEQ ID NO: 2380793 - DNA, 17 bp, Homo sapiens
attttggagagatagga

SEQ ID NO: 2380794 - DNA, 18 bp, Homo sapiens
attttggagagataggaa

SEQ ID NO: 2380795 - DNA, 19 bp, Homo sapiens
attttggagagataggaag

SEQ ID NO: 2380796 - DNA, 13 bp, Homo sapiens
attttgtatgcaa

SEQ ID NO: 2380797 - DNA, 20 bp, Homo sapiens
attttgtctgccccaagttt

SEQ ID NO: 2380798 - DNA, 23 bp, Homo sapiens
attttgtgagtttgtttctttga

SEQ ID NO: 2380799 - DNA, 12 bp, Homo sapiens
atttttttcctt

SEQ ID NO: 2380800 - DNA, 13 bp, Homo sapiens
caaaaaaagttgt

SEQ ID NO: 2380801 - DNA, 14 bp, Homo sapiens
caaaaaaagttgta

SEQ ID NO: 2380802 - DNA, 20 bp, Homo sapiens
caaaaagataccttaaaatt

SEQ ID NO: 2380803 - DNA, 13 bp, Homo sapiens
caaaatgtaactg

SEQ ID NO: 2380804 - DNA, 14 bp, Homo sapiens
caaaatgtaactgt

SEQ ID NO: 2380805 - DNA, 19 bp, Homo sapiens
caaaatgtaactgttacca

SEQ ID NO: 2380806 - DNA, 20 bp, Homo sapiens
caaacattaatgttgatttc

SEQ ID NO: 2380807 - DNA, 22 bp, Homo sapiens
caaacattaatgttgatttcta

SEQ ID NO: 2380808 - DNA, 16 bp, Homo sapiens
caaacattagtacttt

SEQ ID NO: 2380809 - DNA, 18 bp, Homo sapiens
caaacattagtactttat

SEQ ID NO: 2380810 - DNA, 19 bp, Homo sapiens
caaacattagtactttata

SEQ ID NO: 2380811 - DNA, 17 bp, Homo sapiens
caaaccctgtcaaacat

SEQ ID NO: 2380812 - DNA, 21 bp, Homo sapiens
caaaccctgtcaaacattagt

SEQ ID NO: 2380813 - DNA, 18 bp, Homo sapiens
caaactgcacatgatttc

SEQ ID NO: 2380814 - DNA, 15 bp, Homo sapiens
caaagacaaatagta

SEQ ID NO: 2380815 - DNA, 18 bp, Homo sapiens
caaaggctgtattcagca

SEQ ID NO: 2380816 - DNA, 19 bp, Homo sapiens
caaaggctgtattcagcaa

SEQ ID NO: 2380817 - DNA, 19 bp, Homo sapiens
caaagtacaggtactttgt

SEQ ID NO: 2380818 - DNA, 21 bp, Homo sapiens
caaagtacaggtactttgtct

SEQ ID NO: 2380819 - DNA, 17 bp, Homo sapiens
caaagtcatgatgtttt

SEQ ID NO: 2380820 - DNA, 18 bp, Homo sapiens
caaagtcatgatgttttt

SEQ ID NO: 2380821 - DNA, 13 bp, Homo sapiens
caaataacaactt

SEQ ID NO: 2380822 - DNA, 14 bp, Homo sapiens
caaataacaacttt

SEQ ID NO: 2380823 - DNA, 13 bp, Homo sapiens
caaatattaaaaa

SEQ ID NO: 2380824 - DNA, 19 bp, Homo sapiens
caaatattaaaaagtcttt

SEQ ID NO: 2380825 - DNA, 23 bp, Homo sapiens
caaatattaaaaagtcttttaaa

SEQ ID NO: 2380826 - DNA, 12 bp, Homo sapiens
caaatgattgct

SEQ ID NO: 2380827 - DNA, 14 bp, Homo sapiens
caaatgattgcttt

SEQ ID NO: 2380828 - DNA, 18 bp, Homo sapiens
caaatgattgcttttaaa

SEQ ID NO: 2380829 - DNA, 22 bp, Homo sapiens
caaatgattgcttttaaaattt

SEQ ID NO: 2380830 - DNA, 24 bp, Homo sapiens
caaatggtacaaaaccacagtgta

SEQ ID NO: 2380831 - DNA, 20 bp, Homo sapiens
caaattatgctaagaatttt

SEQ ID NO: 2380832 - DNA, 21 bp, Homo sapiens
caaattatgctaagaattttt

SEQ ID NO: 2380833 - DNA, 16 bp, Homo sapiens
caacaaactgcacatg

SEQ ID NO: 2380834 - DNA, 17 bp, Homo sapiens
caacaaactgcacatga

SEQ ID NO: 2380835 - DNA, 21 bp, Homo sapiens
caacagattggattttatgtt

SEQ ID NO: 2380836 - DNA, 12 bp, Homo sapiens
caaccaaatggt

SEQ ID NO: 2380837 - DNA, 17 bp, Homo sapiens
caagaacttgtttaata

SEQ ID NO: 2380838 - DNA, 23 bp, Homo sapiens
caagatggcacagggcatgaaat

SEQ ID NO: 2380839 - DNA, 11 bp, Homo sapiens
caagttttgtg

SEQ ID NO: 2380840 - DNA, 16 bp, Homo sapiens
caagttttgtgaaatt

SEQ ID NO: 2380841 - DNA, 20 bp, Homo sapiens
caagttttgtgaaatttttc

SEQ ID NO: 2380842 - DNA, 18 bp, Homo sapiens
caataaagtttgatcttc

SEQ ID NO: 2380843 - DNA, 16 bp, Homo sapiens
caatatattttgtatg

SEQ ID NO: 2380844 - DNA, 15 bp, Homo sapiens
caatattctctgtac

SEQ ID NO: 2380845 - DNA, 19 bp, Homo sapiens
caatattctctgtacatat

SEQ ID NO: 2380846 - DNA, 22 bp, Homo sapiens
caatattctctgtacatattag

SEQ ID NO: 2380847 - DNA, 19 bp, Homo sapiens
caatatttgtgtgctaaac

SEQ ID NO: 2380848 - DNA, 13 bp, Homo sapiens
caatccttacaaa

SEQ ID NO: 2380849 - DNA, 21 bp, Homo sapiens
caatctcgtatagaagtcttc

SEQ ID NO: 2380850 - DNA, 22 bp, Homo sapiens
caatctcgtatagaagtcttca

SEQ ID NO: 2380851 - DNA, 22 bp, Homo sapiens
caattttaacttagagcttttt

SEQ ID NO: 2380852 - DNA, 16 bp, Homo sapiens
caattttcagatttgc

SEQ ID NO: 2380853 - DNA, 19 bp, Homo sapiens
caattttcagatttgcaca

SEQ ID NO: 2380854 - DNA, 22 bp, Homo sapiens
cacaaaaagataccttaaaatt

SEQ ID NO: 2380855 - DNA, 14 bp, Homo sapiens
cacaaatattaaaa

SEQ ID NO: 2380856 - DNA, 15 bp, Homo sapiens
cacagtgtaccatta

SEQ ID NO: 2380857 - DNA, 19 bp, Homo sapiens
cacagtgtaccattaaaat

SEQ ID NO: 2380858 - DNA, 12 bp, Homo sapiens
cacatgatttca

SEQ ID NO: 2380859 - DNA, 18 bp, Homo sapiens
cacatgatttcacaaata

SEQ ID NO: 2380860 - DNA, 12 bp, Homo sapiens
cacatgttttca

SEQ ID NO: 2380861 - DNA, 16 bp, Homo sapiens
cacatgttttcaaatg

SEQ ID NO: 2380862 - DNA, 21 bp, Homo sapiens
caccagtacattctcagtttt

SEQ ID NO: 2380863 - DNA, 11 bp, Homo sapiens
cactaaatgtt

SEQ ID NO: 2380864 - DNA, 13 bp, Homo sapiens
cactaaatgttaa

SEQ ID NO: 2380865 - DNA, 14 bp, Homo sapiens
cactaaatgttaaa

SEQ ID NO: 2380866 - DNA, 21 bp, Homo sapiens
cactgaagtttgataaatagt

SEQ ID NO: 2380867 - DNA, 15 bp, Homo sapiens
cactgaatctgtaca

SEQ ID NO: 2380868 - DNA, 16 bp, Homo sapiens
cactgaatctgtacag

SEQ ID NO: 2380869 - DNA, 19 bp, Homo sapiens
cagaaattggtaccttgca

SEQ ID NO: 2380870 - DNA, 21 bp, Homo sapiens
cagattggattttatgttgac

SEQ ID NO: 2380871 - DNA, 13 bp, Homo sapiens
cagatttgcacaa

SEQ ID NO: 2380872 - DNA, 15 bp, Homo sapiens
cagattttagtttta

SEQ ID NO: 2380873 - DNA, 19 bp, Homo sapiens
cagcaaggcgctaacttgc

SEQ ID NO: 2380874 - DNA, 20 bp, Homo sapiens
cagcaaggcgctaacttgct

SEQ ID NO: 2380875 - DNA, 23 bp, Homo sapiens
cagctctgggaaatttaatacat

SEQ ID NO: 2380876 - DNA, 16 bp, Homo sapiens
caggagaagaaagaac

SEQ ID NO: 2380877 - DNA, 19 bp, Homo sapiens
caggagaagaaagaactat

SEQ ID NO: 2380878 - DNA, 14 bp, Homo sapiens
cagggcatgaaatg

SEQ ID NO: 2380879 - DNA, 15 bp, Homo sapiens
cagggcatgaaatga

SEQ ID NO: 2380880 - DNA, 23 bp, Homo sapiens
cagggcatgaaatgaacacaaat

SEQ ID NO: 2380881 - DNA, 12 bp, Homo sapiens
caggtactttgt

SEQ ID NO: 2380882 - DNA, 20 bp, Homo sapiens
caggtaggaatattatattt

SEQ ID NO: 2380883 - DNA, 13 bp, Homo sapiens
caggttaaatgtt

SEQ ID NO: 2380884 - DNA, 15 bp, Homo sapiens
caggttaaatgtttt

SEQ ID NO: 2380885 - DNA, 13 bp, Homo sapiens
cagtataaagaat

SEQ ID NO: 2380886 - DNA, 18 bp, Homo sapiens
cagtataaagaataggac

SEQ ID NO: 2380887 - DNA, 15 bp, Homo sapiens
cagtattttagtgga

SEQ ID NO: 2380888 - DNA, 12 bp, Homo sapiens
cagtgatattct

SEQ ID NO: 2380889 - DNA, 14 bp, Homo sapiens
cagtgatattcttt

SEQ ID NO: 2380890 - DNA, 15 bp, Homo sapiens
cagtgtaccattaaa

SEQ ID NO: 2380891 - DNA, 17 bp, Homo sapiens
cagtgtaccattaaaat

SEQ ID NO: 2380892 - DNA, 14 bp, Homo sapiens
cagttacttttcct

SEQ ID NO: 2380893 - DNA, 16 bp, Homo sapiens
cagttacttttccttg

SEQ ID NO: 2380894 - DNA, 19 bp, Homo sapiens
cagttacttttccttgcat

SEQ ID NO: 2380895 - DNA, 13 bp, Homo sapiens
cagttcaaagtca

SEQ ID NO: 2380896 - DNA, 22 bp, Homo sapiens
cagttcaaagtcatgatgtttt

SEQ ID NO: 2380897 - DNA, 24 bp, Homo sapiens
cagtttaattttgatatattcaaa

SEQ ID NO: 2380898 - DNA, 13 bp, Homo sapiens
cagtttcaataaa

SEQ ID NO: 2380899 - DNA, 16 bp, Homo sapiens
cagtttcaataaagtt

SEQ ID NO: 2380900 - DNA, 15 bp, Homo sapiens
cagtttttcttaata

SEQ ID NO: 2380901 - DNA, 16 bp, Homo sapiens
cagtttttcttaatat

SEQ ID NO: 2380902 - DNA, 22 bp, Homo sapiens
cataaacatcaggttaggcagt

SEQ ID NO: 2380903 - DNA, 18 bp, Homo sapiens
cataataatcctgcaaag

SEQ ID NO: 2380904 - DNA, 21 bp, Homo sapiens
catataaaatggcaacaaact

SEQ ID NO: 2380905 - DNA, 16 bp, Homo sapiens
catattacaatatttg

SEQ ID NO: 2380906 - DNA, 19 bp, Homo sapiens
catattacaatatttgtgt

SEQ ID NO: 2380907 - DNA, 16 bp, Homo sapiens
catattagaaaacttt

SEQ ID NO: 2380908 - DNA, 22 bp, Homo sapiens
gataggaaggtcatttccatgt

SEQ ID NO: 2380909 - DNA, 17 bp, Homo sapiens
gatattctaaaatataa

SEQ ID NO: 2380910 - DNA, 22 bp, Homo sapiens
gatctgtgccttttttatatct

SEQ ID NO: 2380911 - DNA, 22 bp, Homo sapiens
gatggcacagggcatgaaatga

SEQ ID NO: 2380912 - DNA, 12 bp, Homo sapiens
gatgtaaatttt

SEQ ID NO: 2380913 - DNA, 21 bp, Homo sapiens
gatgtagcaaaccctgtcaaa

SEQ ID NO: 2380914 - DNA, 15 bp, Homo sapiens
gatgtattttgtgag

SEQ ID NO: 2380915 - DNA, 14 bp, Homo sapiens
gatgtgacatttgt

SEQ ID NO: 2380916 - DNA, 19 bp, Homo sapiens
gatgtgtaatttttctgta

SEQ ID NO: 2380917 - DNA, 20 bp, Homo sapiens
gatgtgtaatttttctgtat

SEQ ID NO: 2380918 - DNA, 16 bp, Homo sapiens
gatgttatatttttct

SEQ ID NO: 2380919 - DNA, 14 bp, Homo sapiens
gatgttgatgcaat

SEQ ID NO: 2380920 - DNA, 21 bp, Homo sapiens
gatgttgtgttagttaagaat

SEQ ID NO: 2380921 - DNA, 15 bp, Homo sapiens
gatgtttttaaaatc

SEQ ID NO: 2380922 - DNA, 16 bp, Homo sapiens
gatgtttttaaaatct

SEQ ID NO: 2380923 - DNA, 13 bp, Homo sapiens
gattcacatgttt

SEQ ID NO: 2380924 - DNA, 20 bp, Homo sapiens
gattgattcagctaagcaaa

SEQ ID NO: 2380925 - DNA, 13 bp, Homo sapiens
gattgcttttaaa

SEQ ID NO: 2380926 - DNA, 19 bp, Homo sapiens
gattggattttatgttgac

SEQ ID NO: 2380927 - DNA, 15 bp, Homo sapiens
gatttcacaaatatt

SEQ ID NO: 2380928 - DNA, 18 bp, Homo sapiens
gattttatgttgacattt

SEQ ID NO: 2380929 - DNA, 20 bp, Homo sapiens
gattttatgttgacatttgt

SEQ ID NO: 2380930 - DNA, 17 bp, Homo sapiens
gcaaaaaaagttgtatg

SEQ ID NO: 2380931 - DNA, 19 bp, Homo sapiens
gcaaaaaaagttgtatgat

SEQ ID NO: 2380932 - DNA, 15 bp, Homo sapiens
gcaaaccctgtcaaa

SEQ ID NO: 2380933 - DNA, 14 bp, Homo sapiens
gcaacaaactgcac

SEQ ID NO: 2380934 - DNA, 22 bp, Homo sapiens
gcaacaaactgcacatgatttc

SEQ ID NO: 2380935 - DNA, 14 bp, Homo sapiens
gcaacaattttcag

SEQ ID NO: 2380936 - DNA, 22 bp, Homo sapiens
gcaagcagtttcaataaagttt

SEQ ID NO: 2380937 - DNA, 21 bp, Homo sapiens
gcaagggggaatattttaaaa

SEQ ID NO: 2380938 - DNA, 17 bp, Homo sapiens
gcaatatattttgtatg

SEQ ID NO: 2380939 - DNA, 20 bp, Homo sapiens
gcaatatattttgtatgcaa

SEQ ID NO: 2380940 - DNA, 14 bp, Homo sapiens
gcaatattctctgt

SEQ ID NO: 2380941 - DNA, 23 bp, Homo sapiens
gcacaaaaagataccttaaaatt

SEQ ID NO: 2380942 - DNA, 16 bp, Homo sapiens
gcacacatcatctgta

SEQ ID NO: 2380943 - DNA, 20 bp, Homo sapiens
gcacacatcatctgtaagct

SEQ ID NO: 2380944 - DNA, 19 bp, Homo sapiens
gcacatgatttcacaaata

SEQ ID NO: 2380945 - DNA, 22 bp, Homo sapiens
gcacatgatttcacaaatatta

SEQ ID NO: 2380946 - DNA, 13 bp, Homo sapiens
gcagaattggaaa

SEQ ID NO: 2380947 - DNA, 14 bp, Homo sapiens
gcagaattggaaaa

SEQ ID NO: 2380948 - DNA, 20 bp, Homo sapiens
gcagaattggaaaagactaa

SEQ ID NO: 2380949 - DNA, 14 bp, Homo sapiens
gcagagttcaggga

SEQ ID NO: 2380950 - DNA, 16 bp, Homo sapiens
gcaggtaggaatatta

SEQ ID NO: 2380951 - DNA, 20 bp, Homo sapiens
gcaggtaggaatattatatt

SEQ ID NO: 2380952 - DNA, 15 bp, Homo sapiens
gcaggttaaatgttt

SEQ ID NO: 2380953 - DNA, 18 bp, Homo sapiens
gcaggttaaatgttttgt

SEQ ID NO: 2380954 - DNA, 19 bp, Homo sapiens
gcaggttaaatgttttgta

SEQ ID NO: 2380955 - DNA, 19 bp, Homo sapiens
gcatgaaatgaacacaaat

SEQ ID NO: 2380956 - DNA, 23 bp, Homo sapiens
gcatttatggtaatcatattaga

SEQ ID NO: 2380957 - DNA, 11 bp, Homo sapiens
gccaaacatta

SEQ ID NO: 2380958 - DNA, 12 bp, Homo sapiens
gccaaagacaaa

SEQ ID NO: 2380959 - DNA, 21 bp, Homo sapiens
gcctttatctaccaactttca

SEQ ID NO: 2380960 - DNA, 15 bp, Homo sapiens
gcgctaacttgctta

SEQ ID NO: 2380961 - DNA, 12 bp, Homo sapiens
gctaaaatgttt

SEQ ID NO: 2380962 - DNA, 16 bp, Homo sapiens
gctaaaatgttttcag

SEQ ID NO: 2380963 - DNA, 18 bp, Homo sapiens
gctaaacgtgtatgtttt

SEQ ID NO: 2380964 - DNA, 18 bp, Homo sapiens
gctaacttgcttaaatgt

SEQ ID NO: 2380965 - DNA, 19 bp, Homo sapiens
gctaacttgcttaaatgtg

SEQ ID NO: 2380966 - DNA, 20 bp, Homo sapiens
gctaacttgcttaaatgtga

SEQ ID NO: 2380967 - DNA, 22 bp, Homo sapiens
gctaacttgcttaaatgtgaat

SEQ ID NO: 2380968 - DNA, 16 bp, Homo sapiens
gctaggaatgaaatct

SEQ ID NO: 2380969 - DNA, 12 bp, Homo sapiens
gctatgtcattt

SEQ ID NO: 2380970 - DNA, 17 bp, Homo sapiens
gcttaaatgtgaattac

SEQ ID NO: 2380971 - DNA, 14 bp, Homo sapiens
gctttccatatttt

SEQ ID NO: 2380972 - DNA, 20 bp, Homo sapiens
gctttttttttttaattttg

SEQ ID NO: 2380973 - DNA, 22 bp, Homo sapiens
ggaaaaagtattaattctcttt

SEQ ID NO: 2380974 - DNA, 12 bp, Homo sapiens
ggaaaaatatgt

SEQ ID NO: 2380975 - DNA, 17 bp, Homo sapiens
ggaaacactaaatgtta

SEQ ID NO: 2380976 - DNA, 19 bp, Homo sapiens
ggaaacactaaatgttaaa

SEQ ID NO: 2380977 - DNA, 12 bp, Homo sapiens
ggaaatttcacg

SEQ ID NO: 2380978 - DNA, 16 bp, Homo sapiens
ggaccctgaaatgtgt

SEQ ID NO: 2380979 - DNA, 22 bp, Homo sapiens
ggaccttcactctaagatgtta

SEQ ID NO: 2380980 - DNA, 19 bp, Homo sapiens
ggcaatattctctgtacat

SEQ ID NO: 2380981 - DNA, 20 bp, Homo sapiens
ggcaatattctctgtacata

SEQ ID NO: 2380982 - DNA, 19 bp, Homo sapiens
ggcatgaaatgaacacaaa

SEQ ID NO: 2380983 - DNA, 23 bp, Homo sapiens
ggcgctaacttgcttaaatgtga

SEQ ID NO: 2380984 - DNA, 20 bp, Homo sapiens
gggcaatattctctgtacat

SEQ ID NO: 2380985 - DNA, 21 bp, Homo sapiens
ggtacaggtttttttggattt

SEQ ID NO: 2380986 - DNA, 20 bp, Homo sapiens
ggtaccactgaatctgtaca

SEQ ID NO: 2380987 - DNA, 20 bp, Homo sapiens
ggtagaatgaccttgtaatg

SEQ ID NO: 2380988 - DNA, 21 bp, Homo sapiens
ggtcatttccatgtatgcata

SEQ ID NO: 2380989 - DNA, 13 bp, Homo sapiens
ggtctaatgttta

SEQ ID NO: 2380990 - DNA, 17 bp, Homo sapiens
ggttctatgcaaataaa

SEQ ID NO: 2380991 - DNA, 19 bp, Homo sapiens
ggtttggttttgttttttg

SEQ ID NO: 2380992 - DNA, 12 bp, Homo sapiens
ggttttaaaata

SEQ ID NO: 2380993 - DNA, 22 bp, Homo sapiens
gtaaaaactgaagttctgcctc

SEQ ID NO: 2380994 - DNA, 14 bp, Homo sapiens
gtaaactttgaaat

SEQ ID NO: 2380995 - DNA, 18 bp, Homo sapiens
gtaaagaagaaagctttt

SEQ ID NO: 2380996 - DNA, 14 bp, Homo sapiens
gtaaatgaaagcta

SEQ ID NO: 2380997 - DNA, 15 bp, Homo sapiens
gtaatcatattagac

SEQ ID NO: 2380998 - DNA, 19 bp, Homo sapiens
gtaccactgaatctgtaca

SEQ ID NO: 2380999 - DNA, 17 bp, Homo sapiens
gtaccattaaaatatgc

SEQ ID NO: 2381000 - DNA, 23 bp, Homo sapiens
gtaccttgcacacatcatctgta

SEQ ID NO: 2381001 - DNA, 20 bp, Homo sapiens
gtactttgattcacatgttt

SEQ ID NO: 2381002 - DNA, 23 bp, Homo sapiens
gtactttgattcacatgttttca

SEQ ID NO: 2381003 - DNA, 23 bp, Homo sapiens
gtagaatgaccttgtaatgtaac

SEQ ID NO: 2381004 - DNA, 20 bp, Homo sapiens
gtagcaaaccctgtcaaaca

SEQ ID NO: 2381005 - DNA, 16 bp, Homo sapiens
gtagctaacttttatt

SEQ ID NO: 2381006 - DNA, 17 bp, Homo sapiens
gtaggaatattatattt

SEQ ID NO: 2381007 - DNA, 14 bp, Homo sapiens
gtaggatatgcctg

SEQ ID NO: 2381008 - DNA, 18 bp, Homo sapiens
gtaggggtaccactgaat

SEQ ID NO: 2381009 - DNA, 21 bp, Homo sapiens
gtataaagaataggacttgtt

SEQ ID NO: 2381010 - DNA, 22 bp, Homo sapiens
gtataaagaataggacttgttt

SEQ ID NO: 2381011 - DNA, 13 bp, Homo sapiens
gtatacaaataaa

SEQ ID NO: 2381012 - DNA, 15 bp, Homo sapiens
gtatagtatttgaaa

SEQ ID NO: 2381013 - DNA, 17 bp, Homo sapiens
gtatagtatttgaaaac

SEQ ID NO: 2381014 - DNA, 18 bp, Homo sapiens
gtatagtatttgaaaaca

SEQ ID NO: 2381015 - DNA, 21 bp, Homo sapiens
gtatagtatttgaaaacagaa

SEQ ID NO: 2381016 - DNA, 18 bp, Homo sapiens
gtatgcaagcagtttcaa

SEQ ID NO: 2381017 - DNA, 18 bp, Homo sapiens
gtatgtttttcagttcaa

SEQ ID NO: 2381018 - DNA, 21 bp, Homo sapiens
gtatgtttttcagttcaaagt

SEQ ID NO: 2381019 - DNA, 16 bp, Homo sapiens
gtattgccaaacatta

SEQ ID NO: 2381020 - DNA, 22 bp, Homo sapiens
tattactagttagcatacacat

SEQ ID NO: 2381021 - DNA, 14 bp, Homo sapiens
tattagaaaacttt

SEQ ID NO: 2381022 - DNA, 20 bp, Homo sapiens
tattagacttctgttttcaa

SEQ ID NO: 2381023 - DNA, 17 bp, Homo sapiens
tattatatttggatgca

SEQ ID NO: 2381024 - DNA, 23 bp, Homo sapiens
tattcagcaaggcgctaacttgc

SEQ ID NO: 2381025 - DNA, 14 bp, Homo sapiens
tattccatattaga

SEQ ID NO: 2381026 - DNA, 19 bp, Homo sapiens
tattccatattagaaaact

SEQ ID NO: 2381027 - DNA, 13 bp, Homo sapiens
tattctctgtaca

SEQ ID NO: 2381028 - DNA, 16 bp, Homo sapiens
tattctctgtacatat

SEQ ID NO: 2381029 - DNA, 18 bp, Homo sapiens
tattctctgtacatatta

SEQ ID NO: 2381030 - DNA, 16 bp, Homo sapiens
tattctgggaatgtat

SEQ ID NO: 2381031 - DNA, 17 bp, Homo sapiens
tattctttgttaatttg

SEQ ID NO: 2381032 - DNA, 19 bp, Homo sapiens
tattctttgttaatttgga

SEQ ID NO: 2381033 - DNA, 19 bp, Homo sapiens
tattgagagagatgtgtaa

SEQ ID NO: 2381034 - DNA, 19 bp, Homo sapiens
tattgaggaaaaatatgtg

SEQ ID NO: 2381035 - DNA, 14 bp, Homo sapiens
tattgccaaacatt

SEQ ID NO: 2381036 - DNA, 19 bp, Homo sapiens
tattgccaaacattaatgt

SEQ ID NO: 2381037 - DNA, 22 bp, Homo sapiens
tattgccaaacattaatgttga

SEQ ID NO: 2381038 - DNA, 22 bp, Homo sapiens
tattggccataagcaacaattt

SEQ ID NO: 2381039 - DNA, 14 bp, Homo sapiens
tatttgaaaacaga

SEQ ID NO: 2381040 - DNA, 22 bp, Homo sapiens
tatttgaaaacagaaattggta

SEQ ID NO: 2381041 - DNA, 15 bp, Homo sapiens
tatttgtgtgctaaa

SEQ ID NO: 2381042 - DNA, 16 bp, Homo sapiens
tattttaatttcaagc

SEQ ID NO: 2381043 - DNA, 21 bp, Homo sapiens
tattttagtggaccctgaaat

SEQ ID NO: 2381044 - DNA, 22 bp, Homo sapiens
tattttagtggaccctgaaatg

SEQ ID NO: 2381045 - DNA, 18 bp, Homo sapiens
tattttccttaatcaaac

SEQ ID NO: 2381046 - DNA, 12 bp, Homo sapiens
tattttgtatgc

SEQ ID NO: 2381047 - DNA, 13 bp, Homo sapiens
tattttgtatgca

SEQ ID NO: 2381048 - DNA, 13 bp, Homo sapiens
tatttttcttaaa

SEQ ID NO: 2381049 - DNA, 14 bp, Homo sapiens
tcaaaaatctgaag

SEQ ID NO: 2381050 - DNA, 15 bp, Homo sapiens
tcaaaaatctgaaga

SEQ ID NO: 2381051 - DNA, 17 bp, Homo sapiens
tcaaaaatctgaagatt

SEQ ID NO: 2381052 - DNA, 18 bp, Homo sapiens
tcaaaaatctgaagattg

SEQ ID NO: 2381053 - DNA, 20 bp, Homo sapiens
tcaaaagagcactttaataa

SEQ ID NO: 2381054 - DNA, 16 bp, Homo sapiens
tcaagaacttgtttaa

SEQ ID NO: 2381055 - DNA, 13 bp, Homo sapiens
tcaataaagtttg

SEQ ID NO: 2381056 - DNA, 24 bp, Homo sapiens
tcaatctcgtatagaagtcttcat

SEQ ID NO: 2381057 - DNA, 13 bp, Homo sapiens
tcaattcatgtaa

SEQ ID NO: 2381058 - DNA, 12 bp, Homo sapiens
tcacatgttttc

SEQ ID NO: 2381059 - DNA, 15 bp, Homo sapiens
tcacatgttttcaaa

SEQ ID NO: 2381060 - DNA, 17 bp, Homo sapiens
tcacatgttttcaaatg

SEQ ID NO: 2381061 - DNA, 15 bp, Homo sapiens
tcaccagtacattct

SEQ ID NO: 2381062 - DNA, 17 bp, Homo sapiens
tcaccagtacattctca

SEQ ID NO: 2381063 - DNA, 19 bp, Homo sapiens
tcaccagtacattctcagt

SEQ ID NO: 2381064 - DNA, 14 bp, Homo sapiens
tcacgtcataggaa

SEQ ID NO: 2381065 - DNA, 17 bp, Homo sapiens
tcacgtcataggaagtt

SEQ ID NO: 2381066 - DNA, 15 bp, Homo sapiens
tcactctaagatgtt

SEQ ID NO: 2381067 - DNA, 17 bp, Homo sapiens
tcactctaagatgttat

SEQ ID NO: 2381068 - DNA, 21 bp, Homo sapiens
tcactctaagatgttatattt

SEQ ID NO: 2381069 - DNA, 16 bp, Homo sapiens
tcagatttgcacaaaa

SEQ ID NO: 2381070 - DNA, 13 bp, Homo sapiens
tcagcatacataa

SEQ ID NO: 2381071 - DNA, 16 bp, Homo sapiens
tcagctaggaacaaat

SEQ ID NO: 2381072 - DNA, 20 bp, Homo sapiens
tcagctaggaacaaatcttc

SEQ ID NO: 2381073 - DNA, 21 bp, Homo sapiens
tcagctaggaacaaatcttcc

SEQ ID NO: 2381074 - DNA, 23 bp, Homo sapiens
tcagctaggaacaaatcttcctg

SEQ ID NO: 2381075 - DNA, 16 bp, Homo sapiens
tcagggaagataagtt

SEQ ID NO: 2381076 - DNA, 19 bp, Homo sapiens
tcaggttaggcagtataaa

SEQ ID NO: 2381077 - DNA, 23 bp, Homo sapiens
tcaggttaggcagtataaagaat

SEQ ID NO: 2381078 - DNA, 12 bp, Homo sapiens
tcagttcaaagt

SEQ ID NO: 2381079 - DNA, 16 bp, Homo sapiens
tcataggaagttagcc

SEQ ID NO: 2381080 - DNA, 13 bp, Homo sapiens
tcatattacaata

SEQ ID NO: 2381081 - DNA, 15 bp, Homo sapiens
tcatattacaatatt

SEQ ID NO: 2381082 - DNA, 20 bp, Homo sapiens
tcatattagacttctgtttt

SEQ ID NO: 2381083 - DNA, 22 bp, Homo sapiens
tcatattagacttctgttttca

SEQ ID NO: 2381084 - DNA, 17 bp, Homo sapiens
tcatattttaatttcaa

SEQ ID NO: 2381085 - DNA, 21 bp, Homo sapiens
tcatattttaatttcaagctt

SEQ ID NO: 2381086 - DNA, 23 bp, Homo sapiens
tcatctgagagaggctaaaatgt

SEQ ID NO: 2381087 - DNA, 16 bp, Homo sapiens
tcatctgtaagctgtt

SEQ ID NO: 2381088 - DNA, 16 bp, Homo sapiens
tcattagcaaaaaaag

SEQ ID NO: 2381089 - DNA, 17 bp, Homo sapiens
tcattagcaaaaaaagt

SEQ ID NO: 2381090 - DNA, 20 bp, Homo sapiens
tcattagcaaaaaaagttgt

SEQ ID NO: 2381091 - DNA, 22 bp, Homo sapiens
tcattagcaaaaaaagttgtat

SEQ ID NO: 2381092 - DNA, 22 bp, Homo sapiens
tcattcaccagtacattctcag

SEQ ID NO: 2381093 - DNA, 12 bp, Homo sapiens
tcattcatatta

SEQ ID NO: 2381094 - DNA, 15 bp, Homo sapiens
tcattcatattacaa

SEQ ID NO: 2381095 - DNA, 19 bp, Homo sapiens
tcattcatattacaatatt

SEQ ID NO: 2381096 - DNA, 15 bp, Homo sapiens
tcatttcatgtcctg

SEQ ID NO: 2381097 - DNA, 16 bp, Homo sapiens
tcatttccatgtatgc

SEQ ID NO: 2381098 - DNA, 17 bp, Homo sapiens
tcatttccatgtatgca

SEQ ID NO: 2381099 - DNA, 21 bp, Homo sapiens
tcatttccatgtatgcataat

SEQ ID NO: 2381100 - DNA, 14 bp, Homo sapiens
tcattttacagtta

SEQ ID NO: 2381101 - DNA, 22 bp, Homo sapiens
tccaacgaggctaagttaatgc

SEQ ID NO: 2381102 - DNA, 18 bp, Homo sapiens
tccacttttccagtattt

SEQ ID NO: 2381103 - DNA, 14 bp, Homo sapiens
tccagtattttagt

SEQ ID NO: 2381104 - DNA, 13 bp, Homo sapiens
tccatattagaaa

SEQ ID NO: 2381105 - DNA, 15 bp, Homo sapiens
tccatattagaaaac

SEQ ID NO: 2381106 - DNA, 17 bp, Homo sapiens
tccatattagaaaactt

SEQ ID NO: 2381107 - DNA, 15 bp, Homo sapiens
tccatgtatgcataa

SEQ ID NO: 2381108 - DNA, 20 bp, Homo sapiens
tcctataccatttccgtaat

SEQ ID NO: 2381109 - DNA, 19 bp, Homo sapiens
tcctctgctaaattgatgt

SEQ ID NO: 2381110 - DNA, 14 bp, Homo sapiens
tcctggtcgaaagt

SEQ ID NO: 2381111 - DNA, 18 bp, Homo sapiens
tccttacaaatgattgct

SEQ ID NO: 2381112 - DNA, 13 bp, Homo sapiens
tccttatttaaga

SEQ ID NO: 2381113 - DNA, 12 bp, Homo sapiens
tctaaaactgta

SEQ ID NO: 2381114 - DNA, 18 bp, Homo sapiens
tctaagaaacattggaag

SEQ ID NO: 2381115 - DNA, 23 bp, Homo sapiens
tctaagaaacattggaagcaggt

SEQ ID NO: 2381116 - DNA, 12 bp, Homo sapiens
tctaagatgtta

SEQ ID NO: 2381117 - DNA, 12 bp, Homo sapiens
tctaatgtttaa

SEQ ID NO: 2381118 - DNA, 18 bp, Homo sapiens
tctaccaactttcaagaa

SEQ ID NO: 2381119 - DNA, 11 bp, Homo sapiens
tctagatgtaa

SEQ ID NO: 2381120 - DNA, 16 bp, Homo sapiens
tctagatgtaaatttt

SEQ ID NO: 2381121 - DNA, 16 bp, Homo sapiens
tctagttatttattct

SEQ ID NO: 2381122 - DNA, 15 bp, Homo sapiens
tctatagaaagtgtt

SEQ ID NO: 2381123 - DNA, 24 bp, Homo sapiens
tctatagaaagtgttctgttacaa

SEQ ID NO: 2381124 - DNA, 14 bp, Homo sapiens
tctatgcaaataaa

SEQ ID NO: 2381125 - DNA, 12 bp, Homo sapiens
tctcagtttttc

SEQ ID NO: 2381126 - DNA, 15 bp, Homo sapiens
tctcagtttttctta

SEQ ID NO: 2381127 - DNA, 22 bp, Homo sapiens
tctcagtttttcttaatatata

SEQ ID NO: 2381128 - DNA, 24 bp, Homo sapiens
tctcgtatagaagtcttcatgaaa

SEQ ID NO: 2381129 - DNA, 14 bp, Homo sapiens
tctctgtacatatt

SEQ ID NO: 2381130 - DNA, 17 bp, Homo sapiens
tctgaagttatatttcc

SEQ ID NO: 2381131 - DNA, 18 bp, Homo sapiens
tctgaagttatatttcct

SEQ ID NO: 2381132 - DNA, 21 bp, Homo sapiens
tctgagagaggctaaaatgtt

SEQ ID NO: 2381133 - DNA, 13 bp, Homo sapiens
tggtaccttgcac

SEQ ID NO: 2381134 - DNA, 14 bp, Homo sapiens
tggtaccttgcaca

SEQ ID NO: 2381135 - DNA, 15 bp, Homo sapiens
tggtaccttgcacac

SEQ ID NO: 2381136 - DNA, 20 bp, Homo sapiens
tggtagtggttgtatctgtg

SEQ ID NO: 2381137 - DNA, 15 bp, Homo sapiens
tggtccacttttcca

SEQ ID NO: 2381138 - DNA, 20 bp, Homo sapiens
tggtcgaaagttagtaggat

SEQ ID NO: 2381139 - DNA, 15 bp, Homo sapiens
tggtctaatgtttaa

SEQ ID NO: 2381140 - DNA, 19 bp, Homo sapiens
tggtctaatgtttaagcag

SEQ ID NO: 2381141 - DNA, 18 bp, Homo sapiens
tggttatagtgcaatata

SEQ ID NO: 2381142 - DNA, 19 bp, Homo sapiens
tggttatagtgcaatatat

SEQ ID NO: 2381143 - DNA, 22 bp, Homo sapiens
tggttatagtgcaatatatttt

SEQ ID NO: 2381144 - DNA, 14 bp, Homo sapiens
tggttttaaaatac

SEQ ID NO: 2381145 - DNA, 23 bp, Homo sapiens
tgtaactgctcttgggcaatatt

SEQ ID NO: 2381146 - DNA, 21 bp, Homo sapiens
tgtaactgttaccattggaaa

SEQ ID NO: 2381147 - DNA, 23 bp, Homo sapiens
tgtaagcctcgtaggatgtatgt

SEQ ID NO: 2381148 - DNA, 23 bp, Homo sapiens
tgtaagctgtttggttttaaaat

SEQ ID NO: 2381149 - DNA, 15 bp, Homo sapiens
tgtaatttttctgta

SEQ ID NO: 2381150 - DNA, 17 bp, Homo sapiens
tgtaatttttctgtata

SEQ ID NO: 2381151 - DNA, 19 bp, Homo sapiens
tgtaatttttctgtataga

SEQ ID NO: 2381152 - DNA, 20 bp, Homo sapiens
tgtaatttttctgtatagac

SEQ ID NO: 2381153 - DNA, 21 bp, Homo sapiens
tgtacagagccgtaaaaactg

SEQ ID NO: 2381154 - DNA, 22 bp, Homo sapiens
tgtacagagccgtaaaaactga

SEQ ID NO: 2381155 - DNA, 17 bp, Homo sapiens
tgtaccattaaaatatg

SEQ ID NO: 2381156 - DNA, 18 bp, Homo sapiens
tgtacccaccatacagat

SEQ ID NO: 2381157 - DNA, 17 bp, Homo sapiens
tgtactttgattcacat

SEQ ID NO: 2381158 - DNA, 19 bp, Homo sapiens
tgtactttgattcacatgt

SEQ ID NO: 2381159 - DNA, 19 bp, Homo sapiens
tgtagcaaaccctgtcaaa

SEQ ID NO: 2381160 - DNA, 23 bp, Homo sapiens
tgtagcaaaccctgtcaaacatt

SEQ ID NO: 2381161 - DNA, 15 bp, Homo sapiens
tgtatagtatttgaa

SEQ ID NO: 2381162 - DNA, 21 bp, Homo sapiens
tgtatagtatttgaaaacaga

SEQ ID NO: 2381163 - DNA, 16 bp, Homo sapiens
tgtatgcaagcagttt

SEQ ID NO: 2381164 - DNA, 17 bp, Homo sapiens
tgtatgcataataatcc

SEQ ID NO: 2381165 - DNA, 22 bp, Homo sapiens
tgtatgcataataatcctgcaa

SEQ ID NO: 2381166 - DNA, 18 bp, Homo sapiens
tgtatgtttttcagttca

SEQ ID NO: 2381167 - DNA, 21 bp, Homo sapiens
tgtatgtttttcagttcaaag

SEQ ID NO: 2381168 - DNA, 16 bp, Homo sapiens
tgtcagtttatgtttt

SEQ ID NO: 2381169 - DNA, 22 bp, Homo sapiens
tgtcagtttatgttttggtcca

SEQ ID NO: 2381170 - DNA, 13 bp, Homo sapiens
tgtcattttcatt

SEQ ID NO: 2381171 - DNA, 21 bp, Homo sapiens
tgtcctgtgtcagtttatgtt

SEQ ID NO: 2381172 - DNA, 19 bp, Homo sapiens
tgtctaagaaacattggaa

SEQ ID NO: 2381173 - DNA, 16 bp, Homo sapiens
tgtctgccccaagttt

SEQ ID NO: 2381174 - DNA, 16 bp, Homo sapiens
tgtgaaacagtatcat

SEQ ID NO: 2381175 - DNA, 17 bp, Homo sapiens
tgtgaaatttttcatat

SEQ ID NO: 2381176 - DNA, 19 bp, Homo sapiens
tgtgaaatttttcatattt

SEQ ID NO: 2381177 - DNA, 20 bp, Homo sapiens
tgtgaaatttttcatatttt

SEQ ID NO: 2381178 - DNA, 15 bp, Homo sapiens
tgtgaattactaact

SEQ ID NO: 2381179 - DNA, 10 bp, Homo sapiens
tgtgacattt

SEQ ID NO: 2381180 - DNA, 15 bp, Homo sapiens
tgtgacatttgtcat

SEQ ID NO: 2381181 - DNA, 21 bp, Homo sapiens
tgtgacatttgtcattttcat

SEQ ID NO: 2381182 - DNA, 22 bp, Homo sapiens
tgtgacatttgtcattttcatt

SEQ ID NO: 2381183 - DNA, 18 bp, Homo sapiens
tgtgatgtgacatttgtc

SEQ ID NO: 2381184 - DNA, 20 bp, Homo sapiens
tgtgccttttttatatcttg

SEQ ID NO: 2381185 - DNA, 22 bp, Homo sapiens
tgtgctaaacgtgtatgttttt

SEQ ID NO: 2381186 - DNA, 14 bp, Homo sapiens
tgtgtaatttttct

SEQ ID NO: 2381187 - DNA, 18 bp, Homo sapiens
tgtgtcagtttatgtttt

SEQ ID NO: 2381188 - DNA, 14 bp, Homo sapiens
tgtgtgatgtgaca

SEQ ID NO: 2381189 - DNA, 17 bp, Homo sapiens
tgtgtgatgtgacattt

SEQ ID NO: 2381190 - DNA, 19 bp, Homo sapiens
tgtgtgatgtgacatttgt

SEQ ID NO: 2381191 - DNA, 17 bp, Homo sapiens
tgtgtgctaaacgtgta

SEQ ID NO: 2381192 - DNA, 13 bp, Homo sapiens
tgtgtgtgatgtg

SEQ ID NO: 2381193 - DNA, 22 bp, Homo sapiens
tgtgttagttaagaattgaaga

SEQ ID NO: 2381194 - DNA, 14 bp, Homo sapiens
tgttacaaaatgta

SEQ ID NO: 2381195 - DNA, 16 bp, Homo sapiens
tgttacaaaatgtaac

SEQ ID NO: 2381196 - DNA, 16 bp, Homo sapiens
tgttaccattggaaat

SEQ ID NO: 2381197 - DNA, 18 bp, Homo sapiens
tgttaccattggaaattt

SEQ ID NO: 2381198 - DNA, 23 bp, Homo sapiens
tgttaccattggaaatttcacgt

SEQ ID NO: 2381199 - DNA, 19 bp, Homo sapiens
tgttaggccaaagacaaat

SEQ ID NO: 2381200 - DNA, 21 bp, Homo sapiens
tgttaggccaaagacaaatag

SEQ ID NO: 2381201 - DNA, 16 bp, Homo sapiens
tgttatatttttctta

SEQ ID NO: 2381202 - DNA, 13 bp, Homo sapiens
tgttctgttacaa

SEQ ID NO: 2381203 - DNA, 16 bp, Homo sapiens
tgttctgttacaaaat

SEQ ID NO: 2381204 - DNA, 18 bp, Homo sapiens
tgttctgttacaaaatgt

SEQ ID NO: 2381205 - DNA, 19 bp, Homo sapiens
tgttctgttacaaaatgta

SEQ ID NO: 2381206 - DNA, 14 bp, Homo sapiens
tgttgatttctagt

SEQ ID NO: 2381207 - DNA, 18 bp, Homo sapiens
tgttgatttctagttatt

SEQ ID NO: 2381208 - DNA, 15 bp, Homo sapiens
tgttgcactgaagtt

SEQ ID NO: 2381209 - DNA, 23 bp, Homo sapiens
tgttgcactgaagtttgataaat

SEQ ID NO: 2381210 - DNA, 18 bp, Homo sapiens
tgtttaagcagaattgga

SEQ ID NO: 2381211 - DNA, 17 bp, Homo sapiens
tgtttatctagatgtaa

SEQ ID NO: 2381212 - DNA, 19 bp, Homo sapiens
tgtttctttgaattttcat

SEQ ID NO: 2381213 - DNA, 22 bp, Homo sapiens
tgtttggttttaaaatactgta

SEQ ID NO: 2381214 - DNA, 22 bp, Homo sapiens
tgttttcaatctcgtatagaag

SEQ ID NO: 2381215 - DNA, 17 bp, Homo sapiens
tgttttgtaaactttga

SEQ ID NO: 2381216 - DNA, 20 bp, Homo sapiens
tgttttgtaaactttgaaat

SEQ ID NO: 2381217 - DNA, 15 bp, Homo sapiens
tgtttttaaaatctt

SEQ ID NO: 2381218 - DNA, 19 bp, Homo sapiens
tgtttttaaaatcttatta

SEQ ID NO: 2381219 - DNA, 12 bp, Homo sapiens
tgtttttcagtt

SEQ ID NO: 2381220 - DNA, 14 bp, Homo sapiens
tgtttttcagttca

SEQ ID NO: 2381221 - DNA, 17 bp, Homo sapiens
tgtttttcagttcaaag

SEQ ID NO: 2381222 - DNA, 13 bp, Homo sapiens
tgttttttgaagt

SEQ ID NO: 2381223 - DNA, 17 bp, Homo sapiens
tgttttttgagtctttt

SEQ ID NO: 2381224 - DNA, 21 bp, Homo sapiens
ttaaaaagtattgccaaacat

SEQ ID NO: 2381225 - DNA, 13 bp, Homo sapiens
ttaaaatactgta

SEQ ID NO: 2381226 - DNA, 15 bp, Homo sapiens
ttaaaatatgcacta

SEQ ID NO: 2381227 - DNA, 13 bp, Homo sapiens
ttaaaatcttatt

SEQ ID NO: 2381228 - DNA, 19 bp, Homo sapiens
ttaaaatcttattaaagtt

SEQ ID NO: 2381229 - DNA, 20 bp, Homo sapiens
ttaaaatcttattaaagttt

SEQ ID NO: 2381230 - DNA, 15 bp, Homo sapiens
ttaaaatttgaaaca

SEQ ID NO: 2381231 - DNA, 18 bp, Homo sapiens
ttaaaatttgaaacattg

SEQ ID NO: 2381232 - DNA, 15 bp, Homo sapiens
ttaaagatgtagcaa

SEQ ID NO: 2381233 - DNA, 21 bp, Homo sapiens
ttaaagatgtagcaaaccctg

SEQ ID NO: 2381234 - DNA, 12 bp, Homo sapiens
ttaaagtttcaa

SEQ ID NO: 2381235 - DNA, 13 bp, Homo sapiens
ttaaagtttcaaa

SEQ ID NO: 2381236 - DNA, 20 bp, Homo sapiens
ttaaagtttcaaaaatctga

SEQ ID NO: 2381237 - DNA, 12 bp, Homo sapiens
ttaaatgtgaat

SEQ ID NO: 2381238 - DNA, 22 bp, Homo sapiens
ttaaatgtgaattactaacttc

SEQ ID NO: 2381239 - DNA, 18 bp, Homo sapiens
ttaaatgttttgtaaact

SEQ ID NO: 2381240 - DNA, 19 bp, Homo sapiens
ttaaatgttttgtaaactt

SEQ ID NO: 2381241 - DNA, 20 bp, Homo sapiens
ttaaatgttttgtaaacttt

SEQ ID NO: 2381242 - DNA, 11 bp, Homo sapiens
ttaacaaataa

SEQ ID NO: 2381243 - DNA, 17 bp, Homo sapiens
ttaagcagaattggaaa

SEQ ID NO: 2381244 - DNA, 18 bp, Homo sapiens
ttaagcagaattggaaaa

SEQ ID NO: 2381245 - DNA, 22 bp, Homo sapiens
ttaagcagaattggaaaagact

SEQ ID NO: 2381246 - DNA, 20 bp, Homo sapiens
ttttagtggaccctgaaatg

SEQ ID NO: 2381247 - DNA, 13 bp, Homo sapiens
ttttatgttgaca

SEQ ID NO: 2381248 - DNA, 24 bp, Homo sapiens
ttttcaatctcgtatagaagtctt

SEQ ID NO: 2381249 - DNA, 14 bp, Homo sapiens
ttttcagatttgca

SEQ ID NO: 2381250 - DNA, 19 bp, Homo sapiens
ttttcagctaggaacaaat

SEQ ID NO: 2381251 - DNA, 21 bp, Homo sapiens
ttttcagctaggaacaaatct

SEQ ID NO: 2381252 - DNA, 22 bp, Homo sapiens
ttttcagctaggaacaaatctt

SEQ ID NO: 2381253 - DNA, 23 bp, Homo sapiens
ttttcagttcaaagtcatgatgt

SEQ ID NO: 2381254 - DNA, 16 bp, Homo sapiens
ttttcatattttaatt

SEQ ID NO: 2381255 - DNA, 19 bp, Homo sapiens
ttttcatattttaatttca

SEQ ID NO: 2381256 - DNA, 12 bp, Homo sapiens
ttttccttacat

SEQ ID NO: 2381257 - DNA, 20 bp, Homo sapiens
ttttggtccacttttccagt

SEQ ID NO: 2381258 - DNA, 21 bp, Homo sapiens
ttttggtccacttttccagta

SEQ ID NO: 2381259 - DNA, 14 bp, Homo sapiens
ttttgtaaactttg

SEQ ID NO: 2381260 - DNA, 17 bp, Homo sapiens
ttttgtaaactttgaaa

SEQ ID NO: 2381261 - DNA, 23 bp, Homo sapiens
ttttgtatgcaagcagtttcaat

SEQ ID NO: 2381262 - DNA, 13 bp, Homo sapiens
ttttgtgaaattt

SEQ ID NO: 2381263 - DNA, 22 bp, Homo sapiens
ttttgtgaaatttttcatattt

SEQ ID NO: 2381264 - DNA, 11 bp, Homo sapiens
ttttgttgcac

SEQ ID NO: 2381265 - DNA, 21 bp, Homo sapiens
ttttgttgcactgaagtttga

SEQ ID NO: 2381266 - DNA, 13 bp, Homo sapiens
tttttaaaatctt

SEQ ID NO: 2381267 - DNA, 14 bp, Homo sapiens
tttttaagtgaaat

SEQ ID NO: 2381268 - DNA, 13 bp, Homo sapiens
tttttcagttcaa

SEQ ID NO: 2381269 - DNA, 14 bp, Homo sapiens
tttttcagttcaaa

SEQ ID NO: 2381270 - DNA, 16 bp, Homo sapiens
tttttcagttcaaagt

SEQ ID NO: 2381271 - DNA, 20 bp, Homo sapiens
tttttccttacataaacatc

SEQ ID NO: 2381272 - DNA, 11 bp, Homo sapiens
tttttctgtat

SEQ ID NO: 2381273 - DNA, 15 bp, Homo sapiens
tttttcttaaaaagt

SEQ ID NO: 2381274 - DNA, 21 bp, Homo sapiens
tttttcttaatatatagcatt

SEQ ID NO: 2381275 - DNA, 14 bp, Homo sapiens
ttttttccttacat

SEQ ID NO: 2381276 - DNA, 23 bp, Homo sapiens
aagtgttctgttacaaaatgtaa

SEQ ID NO: 2381277 - DNA, 16 bp, Homo sapiens
aagttctgcctctgat

SEQ ID NO: 2381278 - DNA, 19 bp, Homo sapiens
aagttggaaacactaaatg

SEQ ID NO: 2381279 - DNA, 21 bp, Homo sapiens
aagttgtactccaatggctga

SEQ ID NO: 2381280 - DNA, 16 bp, Homo sapiens
aagtttcaaaaatctg

SEQ ID NO: 2381281 - DNA, 17 bp, Homo sapiens
aagtttgataaatagtg

SEQ ID NO: 2381282 - DNA, 15 bp, Homo sapiens
aagtttgatcttcct

SEQ ID NO: 2381283 - DNA, 23 bp, Homo sapiens
aagtttgatcttcctctgctaaa

SEQ ID NO: 2381284 - DNA, 12 bp, Homo sapiens
aagttttgtgaa

SEQ ID NO: 2381285 - DNA, 13 bp, Homo sapiens
aagttttgtgaaa

SEQ ID NO: 2381286 - DNA, 17 bp, Homo sapiens
aataaaccagatcaaat

SEQ ID NO: 2381287 - DNA, 12 bp, Homo sapiens
aataaagtttga

SEQ ID NO: 2381288 - DNA, 15 bp, Homo sapiens
aataaagtttgatct

SEQ ID NO: 2381289 - DNA, 19 bp, Homo sapiens
aataatcctgcaaagtaca

SEQ ID NO: 2381290 - DNA, 13 bp, Homo sapiens
aatacaatcagaa

SEQ ID NO: 2381291 - DNA, 14 bp, Homo sapiens
aataggacttgttt

SEQ ID NO: 2381292 - DNA, 20 bp, Homo sapiens
aatatatggtctaatgttta

SEQ ID NO: 2381293 - DNA, 14 bp, Homo sapiens
aatatattttgtat

SEQ ID NO: 2381294 - DNA, 17 bp, Homo sapiens
aatatattttgtatgca

SEQ ID NO: 2381295 - DNA, 20 bp, Homo sapiens
aatatgcactaagtctcttt

SEQ ID NO: 2381296 - DNA, 20 bp, Homo sapiens
aatattaaaaagtcttttaa

SEQ ID NO: 2381297 - DNA, 21 bp, Homo sapiens
aatattaaaaagtcttttaaa

SEQ ID NO: 2381298 - DNA, 13 bp, Homo sapiens
aatattatatttg

SEQ ID NO: 2381299 - DNA, 19 bp, Homo sapiens
aatattatatttggatgca

SEQ ID NO: 2381300 - DNA, 15 bp, Homo sapiens
aatctgaagattgtt

SEQ ID NO: 2381301 - DNA, 17 bp, Homo sapiens
aatctgaagattgttta

SEQ ID NO: 2381302 - DNA, 15 bp, Homo sapiens
aatcttattaaagtt

SEQ ID NO: 2381303 - DNA, 17 bp, Homo sapiens
aatcttattaaagtttc

SEQ ID NO: 2381304 - DNA, 15 bp, Homo sapiens
aatgattgcttttaa

SEQ ID NO: 2381305 - DNA, 19 bp, Homo sapiens
aatgattgcttttaaaatt

SEQ ID NO: 2381306 - DNA, 22 bp, Homo sapiens
aatgattgcttttaaaatttta

SEQ ID NO: 2381307 - DNA, 13 bp, Homo sapiens
aatgcatgctttc

SEQ ID NO: 2381308 - DNA, 16 bp, Homo sapiens
aatgcatgctttccat

SEQ ID NO: 2381309 - DNA, 16 bp, Homo sapiens
aatgctatgtcatttc

SEQ ID NO: 2381310 - DNA, 17 bp, Homo sapiens
aatgctatgtcatttca

SEQ ID NO: 2381311 - DNA, 18 bp, Homo sapiens
aatgctatgtcatttcat

SEQ ID NO: 2381312 - DNA, 13 bp, Homo sapiens
aatggagttggag

SEQ ID NO: 2381313 - DNA, 11 bp, Homo sapiens
aatgtaactgc

SEQ ID NO: 2381314 - DNA, 12 bp, Homo sapiens
aatgtaactgtt

SEQ ID NO: 2381315 - DNA, 14 bp, Homo sapiens
aatgtatagtattt

SEQ ID NO: 2381316 - DNA, 15 bp, Homo sapiens
aatgtatagtatttg

SEQ ID NO: 2381317 - DNA, 16 bp, Homo sapiens
aatgtatagtatttga

SEQ ID NO: 2381318 - DNA, 17 bp, Homo sapiens
aatgtatagtatttgaa

SEQ ID NO: 2381319 - DNA, 21 bp, Homo sapiens
aatgtatagtatttgaaaaca

SEQ ID NO: 2381320 - DNA, 20 bp, Homo sapiens
aatgtattgttctcatgtaa

SEQ ID NO: 2381321 - DNA, 23 bp, Homo sapiens
aatgtgtgtgatgtgacatttgt

SEQ ID NO: 2381322 - DNA, 19 bp, Homo sapiens
aatgttaaagatgtagcaa

SEQ ID NO: 2381323 - DNA, 20 bp, Homo sapiens
aatgttaaagatgtagcaaa

SEQ ID NO: 2381324 - DNA, 17 bp, Homo sapiens
aatgttgatttctagtt

SEQ ID NO: 2381325 - DNA, 21 bp, Homo sapiens
aatgttgatttctagttattt

SEQ ID NO: 2381326 - DNA, 22 bp, Homo sapiens
aatgttgatttctagttattta

SEQ ID NO: 2381327 - DNA, 21 bp, Homo sapiens
aatgtttaagcagaattggaa

SEQ ID NO: 2381328 - DNA, 17 bp, Homo sapiens
aatgttttgtaaacttt

SEQ ID NO: 2381329 - DNA, 23 bp, Homo sapiens
aatgttttgtaaactttgaaata

SEQ ID NO: 2381330 - DNA, 12 bp, Homo sapiens
aattaatacaat

SEQ ID NO: 2381331 - DNA, 14 bp, Homo sapiens
aattactaacttct

SEQ ID NO: 2381332 - DNA, 17 bp, Homo sapiens
aattactaacttctaaa

SEQ ID NO: 2381333 - DNA, 18 bp, Homo sapiens
aattactaacttctaaaa

SEQ ID NO: 2381334 - DNA, 20 bp, Homo sapiens
aattactaacttctaaaact

SEQ ID NO: 2381335 - DNA, 21 bp, Homo sapiens
aattactaacttctaaaactg

SEQ ID NO: 2381336 - DNA, 19 bp, Homo sapiens
aattatctgccttatacat

SEQ ID NO: 2381337 - DNA, 16 bp, Homo sapiens
aattatgctaagaatt

SEQ ID NO: 2381338 - DNA, 18 bp, Homo sapiens
aattatgctaagaatttt

SEQ ID NO: 2381339 - DNA, 17 bp, Homo sapiens
aattcatgtaacactgt

SEQ ID NO: 2381340 - DNA, 19 bp, Homo sapiens
aattcttattccatattag

SEQ ID NO: 2381341 - DNA, 23 bp, Homo sapiens
aattcttattccatattagaaaa

SEQ ID NO: 2381342 - DNA, 18 bp, Homo sapiens
aattgaagctttttaaaa

SEQ ID NO: 2381343 - DNA, 19 bp, Homo sapiens
aattgacttctattttcct

SEQ ID NO: 2381344 - DNA, 20 bp, Homo sapiens
aattggatttgtaattaaat

SEQ ID NO: 2381345 - DNA, 15 bp, Homo sapiens
aattggtaccttgca

SEQ ID NO: 2381346 - DNA, 22 bp, Homo sapiens
aatttattgaggaaaaatatgt

SEQ ID NO: 2381347 - DNA, 13 bp, Homo sapiens
aatttcaagctta

SEQ ID NO: 2381348 - DNA, 12 bp, Homo sapiens
aatttgaaacat

SEQ ID NO: 2381349 - DNA, 14 bp, Homo sapiens
aatttgaaacattg

SEQ ID NO: 2381350 - DNA, 14 bp, Homo sapiens
aatttgagcttgtg

SEQ ID NO: 2381351 - DNA, 19 bp, Homo sapiens
aatttggaccattttcctg

SEQ ID NO: 2381352 - DNA, 23 bp, Homo sapiens
aattttaagctaggaaaagaaat

SEQ ID NO: 2381353 - DNA, 13 bp, Homo sapiens
aattttcagattt

SEQ ID NO: 2381354 - DNA, 14 bp, Homo sapiens
aattttcagatttg

SEQ ID NO: 2381355 - DNA, 20 bp, Homo sapiens
aattttcagatttgcacaaa

SEQ ID NO: 2381356 - DNA, 15 bp, Homo sapiens
aattttcattttaca

SEQ ID NO: 2381357 - DNA, 13 bp, Homo sapiens
aatttttcatatt

SEQ ID NO: 2381358 - DNA, 14 bp, Homo sapiens
aatttttcatattt

SEQ ID NO: 2381359 - DNA, 12 bp, Homo sapiens
aatttttctgta

SEQ ID NO: 2381360 - DNA, 15 bp, Homo sapiens
acaaaaccacagtgt

SEQ ID NO: 2381361 - DNA, 16 bp, Homo sapiens
acaaaatgtaactgtt

SEQ ID NO: 2381362 - DNA, 17 bp, Homo sapiens
acaaaatgtaactgtta

SEQ ID NO: 2381363 - DNA, 14 bp, Homo sapiens
acaaactgcacatg

SEQ ID NO: 2381364 - DNA, 16 bp, Homo sapiens
acaaactgcacatgat

SEQ ID NO: 2381365 - DNA, 21 bp, Homo sapiens
acaaactgcacatgatttcac

SEQ ID NO: 2381366 - DNA, 19 bp, Homo sapiens
acaaaggctgtattcagca

SEQ ID NO: 2381367 - DNA, 17 bp, Homo sapiens
acaaatagtaggcaaga

SEQ ID NO: 2381368 - DNA, 23 bp, Homo sapiens
acaaatagtaggcaagatggcac

SEQ ID NO: 2381369 - DNA, 12 bp, Homo sapiens
acaaatattaaa

SEQ ID NO: 2381370 - DNA, 18 bp, Homo sapiens
acaacagattggatttta

SEQ ID NO: 2381371 - DNA, 20 bp, Homo sapiens
acaacagattggattttatg

SEQ ID NO: 2381372 - DNA, 15 bp, Homo sapiens
acaacttttttttct

SEQ ID NO: 2381373 - DNA, 18 bp, Homo sapiens
acaacttttttttctttt

SEQ ID NO: 2381374 - DNA, 19 bp, Homo sapiens
acaagcatataaaatggca

SEQ ID NO: 2381375 - DNA, 14 bp, Homo sapiens
acaattttcagatt

SEQ ID NO: 2381376 - DNA, 16 bp, Homo sapiens
acaattttcagatttg

SEQ ID NO: 2381377 - DNA, 18 bp, Homo sapiens
acaattttcagatttgca

SEQ ID NO: 2381378 - DNA, 22 bp, Homo sapiens
acaattttcagatttgcacaaa

SEQ ID NO: 2381379 - DNA, 22 bp, Homo sapiens
acacaaattatgctaagaattt

SEQ ID NO: 2381380 - DNA, 16 bp, Homo sapiens
acacatcatctgtaag

SEQ ID NO: 2381381 - DNA, 20 bp, Homo sapiens
acagacctgagatgaagatt

SEQ ID NO: 2381382 - DNA, 17 bp, Homo sapiens
acagattggattttatg

SEQ ID NO: 2381383 - DNA, 22 bp, Homo sapiens
acagattggattttatgttgac

SEQ ID NO: 2381384 - DNA, 14 bp, Homo sapiens
acaggtactttgtc

SEQ ID NO: 2381385 - DNA, 19 bp, Homo sapiens
acagtgtaccattaaaata

SEQ ID NO: 2381386 - DNA, 12 bp, Homo sapiens
acagttactttt

SEQ ID NO: 2381387 - DNA, 20 bp, Homo sapiens
acatcaggttaggcagtata

SEQ ID NO: 2381388 - DNA, 13 bp, Homo sapiens
acatcatctgtaa

SEQ ID NO: 2381389 - DNA, 23 bp, Homo sapiens
attaaaaagtcttttaaaaagta

SEQ ID NO: 2381390 - DNA, 20 bp, Homo sapiens
attaaaatatgcactaagtc

SEQ ID NO: 2381391 - DNA, 12 bp, Homo sapiens
attaaagtttca

SEQ ID NO: 2381392 - DNA, 15 bp, Homo sapiens
attaaagtttcaaaa

SEQ ID NO: 2381393 - DNA, 23 bp, Homo sapiens
attaaagtttcaaaaatctgaag

SEQ ID NO: 2381394 - DNA, 14 bp, Homo sapiens
attaattctctttc

SEQ ID NO: 2381395 - DNA, 12 bp, Homo sapiens
attactaacttc

SEQ ID NO: 2381396 - DNA, 21 bp, Homo sapiens
attactaacttctaaaactgt

SEQ ID NO: 2381397 - DNA, 22 bp, Homo sapiens
attactaacttctaaaactgta

SEQ ID NO: 2381398 - DNA, 22 bp, Homo sapiens
attactagttagcatacacatt

SEQ ID NO: 2381399 - DNA, 14 bp, Homo sapiens
attagacttctgtt

SEQ ID NO: 2381400 - DNA, 16 bp, Homo sapiens
attagacttctgtttt

SEQ ID NO: 2381401 - DNA, 19 bp, Homo sapiens
attagacttctgttttcaa

SEQ ID NO: 2381402 - DNA, 17 bp, Homo sapiens
attagcaaaaaaagttg

SEQ ID NO: 2381403 - DNA, 15 bp, Homo sapiens
attatatttggatgc

SEQ ID NO: 2381404 - DNA, 17 bp, Homo sapiens
attatatttggatgcag

SEQ ID NO: 2381405 - DNA, 19 bp, Homo sapiens
attcacatgttttcaaatg

SEQ ID NO: 2381406 - DNA, 20 bp, Homo sapiens
attcagcaaggcgctaactt

SEQ ID NO: 2381407 - DNA, 15 bp, Homo sapiens
attcatattacaata

SEQ ID NO: 2381408 - DNA, 17 bp, Homo sapiens
attcatattacaatatt

SEQ ID NO: 2381409 - DNA, 18 bp, Homo sapiens
attcatattacaatattt

SEQ ID NO: 2381410 - DNA, 15 bp, Homo sapiens
attcattttctcttt

SEQ ID NO: 2381411 - DNA, 16 bp, Homo sapiens
attcattttctcttta

SEQ ID NO: 2381412 - DNA, 18 bp, Homo sapiens
attccaagtgtatttaaa

SEQ ID NO: 2381413 - DNA, 20 bp, Homo sapiens
attccatattagaaaacttt

SEQ ID NO: 2381414 - DNA, 22 bp, Homo sapiens
attccatattagaaaactttgt

SEQ ID NO: 2381415 - DNA, 20 bp, Homo sapiens
attccttatttaagacatgt

SEQ ID NO: 2381416 - DNA, 13 bp, Homo sapiens
attctcagttttt

SEQ ID NO: 2381417 - DNA, 14 bp, Homo sapiens
attctcagtttttc

SEQ ID NO: 2381418 - DNA, 14 bp, Homo sapiens
attctgaagttata

SEQ ID NO: 2381419 - DNA, 22 bp, Homo sapiens
attctgaagttatatttcctat

SEQ ID NO: 2381420 - DNA, 13 bp, Homo sapiens
attcttattccat

SEQ ID NO: 2381421 - DNA, 17 bp, Homo sapiens
attctttgttaatttgg

SEQ ID NO: 2381422 - DNA, 19 bp, Homo sapiens
attgagagagatgtgtaat

SEQ ID NO: 2381423 - DNA, 20 bp, Homo sapiens
attgagagagatgtgtaatt

SEQ ID NO: 2381424 - DNA, 17 bp, Homo sapiens
attgaggaaaaatatgt

SEQ ID NO: 2381425 - DNA, 14 bp, Homo sapiens
attgatgttgatgc

SEQ ID NO: 2381426 - DNA, 22 bp, Homo sapiens
attgccaaacattaatgttgat

SEQ ID NO: 2381427 - DNA, 12 bp, Homo sapiens
attgcttttaaa

SEQ ID NO: 2381428 - DNA, 15 bp, Homo sapiens
attgcttttaaaact

SEQ ID NO: 2381429 - DNA, 17 bp, Homo sapiens
attgcttttaaaatttt

SEQ ID NO: 2381430 - DNA, 14 bp, Homo sapiens
attggaaatttcac

SEQ ID NO: 2381431 - DNA, 19 bp, Homo sapiens
attggaagcaggttaaatg

SEQ ID NO: 2381432 - DNA, 20 bp, Homo sapiens
attggaagcaggttaaatgt

SEQ ID NO: 2381433 - DNA, 21 bp, Homo sapiens
attggaagcaggttaaatgtt

SEQ ID NO: 2381434 - DNA, 13 bp, Homo sapiens
attggattttatg

SEQ ID NO: 2381435 - DNA, 22 bp, Homo sapiens
attggattttatgttgacattt

SEQ ID NO: 2381436 - DNA, 17 bp, Homo sapiens
attgtaaagtaaatgaa

SEQ ID NO: 2381437 - DNA, 22 bp, Homo sapiens
attgtttatctagatgtaaatt

SEQ ID NO: 2381438 - DNA, 19 bp, Homo sapiens
atttattctgggaatgtat

SEQ ID NO: 2381439 - DNA, 17 bp, Homo sapiens
atttattgaggaaaaat

SEQ ID NO: 2381440 - DNA, 21 bp, Homo sapiens
atttattgaggaaaaatatgt

SEQ ID NO: 2381441 - DNA, 12 bp, Homo sapiens
atttcaagctta

SEQ ID NO: 2381442 - DNA, 13 bp, Homo sapiens
atttcacaaatat

SEQ ID NO: 2381443 - DNA, 20 bp, Homo sapiens
atttcacaaatattaaaaag

SEQ ID NO: 2381444 - DNA, 19 bp, Homo sapiens
atttcacgtcataggaagt

SEQ ID NO: 2381445 - DNA, 22 bp, Homo sapiens
atttcatgtcctgtgtcagttt

SEQ ID NO: 2381446 - DNA, 17 bp, Homo sapiens
atttccatgtatgcata

SEQ ID NO: 2381447 - DNA, 15 bp, Homo sapiens
atttcctataccatt

SEQ ID NO: 2381448 - DNA, 16 bp, Homo sapiens
atttctagttatttat

SEQ ID NO: 2381449 - DNA, 18 bp, Homo sapiens
atttctagttatttattc

SEQ ID NO: 2381450 - DNA, 19 bp, Homo sapiens
atttgaaaacagaaattgg

SEQ ID NO: 2381451 - DNA, 17 bp, Homo sapiens
atttgaaacattgcttt

SEQ ID NO: 2381452 - DNA, 20 bp, Homo sapiens
atttgaaacattgcttttaa

SEQ ID NO: 2381453 - DNA, 14 bp, Homo sapiens
atttggaccatttt

SEQ ID NO: 2381454 - DNA, 21 bp, Homo sapiens
atttgtaaatattctatgagt

SEQ ID NO: 2381455 - DNA, 14 bp, Homo sapiens
atttgtcattttca

SEQ ID NO: 2381456 - DNA, 14 bp, Homo sapiens
atttgtgtgctaaa

SEQ ID NO: 2381457 - DNA, 23 bp, Homo sapiens
atttgtttggttatagtgcaata

SEQ ID NO: 2381458 - DNA, 13 bp, Homo sapiens
attttaacttaga

SEQ ID NO: 2381459 - DNA, 16 bp, Homo sapiens
attttaagctaggaaa

SEQ ID NO: 2381460 - DNA, 19 bp, Homo sapiens
attttaagctaggaaaaga

SEQ ID NO: 2381461 - DNA, 20 bp, Homo sapiens
attttaagctaggaaaagaa

SEQ ID NO: 2381462 - DNA, 13 bp, Homo sapiens
attttaatttcaa

SEQ ID NO: 2381463 - DNA, 20 bp, Homo sapiens
attttatgttgacatttgtt

SEQ ID NO: 2381464 - DNA, 12 bp, Homo sapiens
attttcagattt

SEQ ID NO: 2381465 - DNA, 14 bp, Homo sapiens
attttcattagcaa

SEQ ID NO: 2381466 - DNA, 17 bp, Homo sapiens
attttcattagcaaaaa

SEQ ID NO: 2381467 - DNA, 17 bp, Homo sapiens
attttccttaatcaaac

SEQ ID NO: 2381468 - DNA, 22 bp, Homo sapiens
attttgggaaattatctgcctt

SEQ ID NO: 2381469 - DNA, 12 bp, Homo sapiens
attttgtatgca

SEQ ID NO: 2381470 - DNA, 18 bp, Homo sapiens
attttgtgagtttgtttc

SEQ ID NO: 2381471 - DNA, 12 bp, Homo sapiens
caaaaaaagttg

SEQ ID NO: 2381472 - DNA, 16 bp, Homo sapiens
caaaaaaagttgtatg

SEQ ID NO: 2381473 - DNA, 18 bp, Homo sapiens
caaaaaaagttgtatgat

SEQ ID NO: 2381474 - DNA, 22 bp, Homo sapiens
caaaaaaagttgtatgatctgt

SEQ ID NO: 2381475 - DNA, 22 bp, Homo sapiens
caaaaagataccttaaaatttg

SEQ ID NO: 2381476 - DNA, 23 bp, Homo sapiens
caaaaagataccttaaaatttga

SEQ ID NO: 2381477 - DNA, 17 bp, Homo sapiens
caaaaatctgaagattg

SEQ ID NO: 2381478 - DNA, 16 bp, Homo sapiens
caaaatgtaactgtta

SEQ ID NO: 2381479 - DNA, 16 bp, Homo sapiens
caaacaagcatataaa

SEQ ID NO: 2381480 - DNA, 20 bp, Homo sapiens
caaacaagcatataaaatgg

SEQ ID NO: 2381481 - DNA, 21 bp, Homo sapiens
caaacattaatgttgatttct

SEQ ID NO: 2381482 - DNA, 23 bp, Homo sapiens
caaagacaaatagtaggcaagat

SEQ ID NO: 2381483 - DNA, 17 bp, Homo sapiens
caaagtacaggtacttt

SEQ ID NO: 2381484 - DNA, 19 bp, Homo sapiens
caaagtcatgatgttttta

SEQ ID NO: 2381485 - DNA, 22 bp, Homo sapiens
caaataaaaaaataactgattt

SEQ ID NO: 2381486 - DNA, 23 bp, Homo sapiens
caaatagtaggcaagatggcaca

SEQ ID NO: 2381487 - DNA, 15 bp, Homo sapiens
caaatgattgctttt

SEQ ID NO: 2381488 - DNA, 19 bp, Homo sapiens
caaatgattgcttttaaaa

SEQ ID NO: 2381489 - DNA, 23 bp, Homo sapiens
caaatgattgcttttaaaatttt

SEQ ID NO: 2381490 - DNA, 19 bp, Homo sapiens
caaatggagttggagttca

SEQ ID NO: 2381491 - DNA, 22 bp, Homo sapiens
caacaaactgcacatgatttca

SEQ ID NO: 2381492 - DNA, 17 bp, Homo sapiens
caactttcaagaacttg

SEQ ID NO: 2381493 - DNA, 15 bp, Homo sapiens
caacttttttttctt

SEQ ID NO: 2381494 - DNA, 16 bp, Homo sapiens
caagatggcacagggc

SEQ ID NO: 2381495 - DNA, 20 bp, Homo sapiens
caagatggcacagggcatga

SEQ ID NO: 2381496 - DNA, 14 bp, Homo sapiens
caagcagtttcaat

SEQ ID NO: 2381497 - DNA, 22 bp, Homo sapiens
caagcagtttcaataaagtttg

SEQ ID NO: 2381498 - DNA, 15 bp, Homo sapiens
caagtgtatttaaaa

SEQ ID NO: 2381499 - DNA, 13 bp, Homo sapiens
caagttttgtgaa

SEQ ID NO: 2381500 - DNA, 14 bp, Homo sapiens
caagttttgtgaaa

SEQ ID NO: 2381501 - DNA, 17 bp, Homo sapiens
caagttttgtgaaattt

SEQ ID NO: 2381502 - DNA, 18 bp, Homo sapiens
gcatgaaatgaacacaaa

SEQ ID NO: 2381503 - DNA, 21 bp, Homo sapiens
gcatgctgtattatgaaatcg

SEQ ID NO: 2381504 - DNA, 19 bp, Homo sapiens
gcatgtgaaacagtatcat

SEQ ID NO: 2381505 - DNA, 18 bp, Homo sapiens
gcatttatggtaatcata

SEQ ID NO: 2381506 - DNA, 20 bp, Homo sapiens
gcatttatggtaatcatatt

SEQ ID NO: 2381507 - DNA, 12 bp, Homo sapiens
gccaaacattaa

SEQ ID NO: 2381508 - DNA, 24 bp, Homo sapiens
gccaaacattaatgttgatttcta

SEQ ID NO: 2381509 - DNA, 14 bp, Homo sapiens
gccaaagacaaata

SEQ ID NO: 2381510 - DNA, 15 bp, Homo sapiens
gccaaagacaaatag

SEQ ID NO: 2381511 - DNA, 22 bp, Homo sapiens
gcctcgtaggatgtatgttgga

SEQ ID NO: 2381512 - DNA, 19 bp, Homo sapiens
gcctgatgaccaattttaa

SEQ ID NO: 2381513 - DNA, 22 bp, Homo sapiens
gcctttatctaccaactttcaa

SEQ ID NO: 2381514 - DNA, 13 bp, Homo sapiens
gcgacaacagatt

SEQ ID NO: 2381515 - DNA, 20 bp, Homo sapiens
gcgctaacttgcttaaatgt

SEQ ID NO: 2381516 - DNA, 13 bp, Homo sapiens
gctaaaatgtttt

SEQ ID NO: 2381517 - DNA, 15 bp, Homo sapiens
gctaaaatgttttca

SEQ ID NO: 2381518 - DNA, 18 bp, Homo sapiens
gctaaattgatgttgatg

SEQ ID NO: 2381519 - DNA, 21 bp, Homo sapiens
gctaaattgatgttgatgcaa

SEQ ID NO: 2381520 - DNA, 23 bp, Homo sapiens
gctaaattgatgttgatgcaatc

SEQ ID NO: 2381521 - DNA, 14 bp, Homo sapiens
gctaggaacaaatc

SEQ ID NO: 2381522 - DNA, 17 bp, Homo sapiens
gctatgtcatttcatgt

SEQ ID NO: 2381523 - DNA, 16 bp, Homo sapiens
gctgtttggttttaaa

SEQ ID NO: 2381524 - DNA, 12 bp, Homo sapiens
gcttaaatgtga

SEQ ID NO: 2381525 - DNA, 20 bp, Homo sapiens
gcttgtgttctagtcattgt

SEQ ID NO: 2381526 - DNA, 13 bp, Homo sapiens
gcttgttaattgt

SEQ ID NO: 2381527 - DNA, 14 bp, Homo sapiens
gcttttaaaactac

SEQ ID NO: 2381528 - DNA, 20 bp, Homo sapiens
gcttttaaaactacttagca

SEQ ID NO: 2381529 - DNA, 14 bp, Homo sapiens
gcttttaaaatttt

SEQ ID NO: 2381530 - DNA, 13 bp, Homo sapiens
ggaaaaatatgtg

SEQ ID NO: 2381531 - DNA, 16 bp, Homo sapiens
ggaaaaatatgtgaag

SEQ ID NO: 2381532 - DNA, 14 bp, Homo sapiens
ggaaaagaaatcta

SEQ ID NO: 2381533 - DNA, 15 bp, Homo sapiens
ggaatattatatttg

SEQ ID NO: 2381534 - DNA, 16 bp, Homo sapiens
ggaccattttcctgca

SEQ ID NO: 2381535 - DNA, 16 bp, Homo sapiens
ggcaacaaactgcaca

SEQ ID NO: 2381536 - DNA, 18 bp, Homo sapiens
ggcaatattctctgtaca

SEQ ID NO: 2381537 - DNA, 17 bp, Homo sapiens
ggcatgaaatgaacaca

SEQ ID NO: 2381538 - DNA, 16 bp, Homo sapiens
ggccaaagacaaatag

SEQ ID NO: 2381539 - DNA, 23 bp, Homo sapiens
ggccataagcaacaattttcaga

SEQ ID NO: 2381540 - DNA, 12 bp, Homo sapiens
ggcgctaacttg

SEQ ID NO: 2381541 - DNA, 15 bp, Homo sapiens
gggaacgttctcttt

SEQ ID NO: 2381542 - DNA, 16 bp, Homo sapiens
gggcaatattctctgt

SEQ ID NO: 2381543 - DNA, 23 bp, Homo sapiens
gggcaatattctctgtacatatt

SEQ ID NO: 2381544 - DNA, 15 bp, Homo sapiens
ggtaatcatattaga

SEQ ID NO: 2381545 - DNA, 14 bp, Homo sapiens
ggtatacaaataaa

SEQ ID NO: 2381546 - DNA, 20 bp, Homo sapiens
ggtcatttccatgtatgcat

SEQ ID NO: 2381547 - DNA, 13 bp, Homo sapiens
ggttaaatgtttt

SEQ ID NO: 2381548 - DNA, 13 bp, Homo sapiens
ggttaacaaataa

SEQ ID NO: 2381549 - DNA, 21 bp, Homo sapiens
ggttaacaaataacaactttt

SEQ ID NO: 2381550 - DNA, 15 bp, Homo sapiens
gtaaaaactgaagtt

SEQ ID NO: 2381551 - DNA, 16 bp, Homo sapiens
gtaaactttgaaatat

SEQ ID NO: 2381552 - DNA, 21 bp, Homo sapiens
gtaactgttaccattggaaat

SEQ ID NO: 2381553 - DNA, 22 bp, Homo sapiens
gtaagctgtttggttttaaaat

SEQ ID NO: 2381554 - DNA, 15 bp, Homo sapiens
gtaattaaattgtaa

SEQ ID NO: 2381555 - DNA, 13 bp, Homo sapiens
gtaatttttctgt

SEQ ID NO: 2381556 - DNA, 15 bp, Homo sapiens
gtaatttttctgtat

SEQ ID NO: 2381557 - DNA, 16 bp, Homo sapiens
gtaatttttctgtata

SEQ ID NO: 2381558 - DNA, 21 bp, Homo sapiens
gtaatttttctgtatagacag

SEQ ID NO: 2381559 - DNA, 14 bp, Homo sapiens
gtacaggtactttg

SEQ ID NO: 2381560 - DNA, 16 bp, Homo sapiens
gtaccattaaaatatg

SEQ ID NO: 2381561 - DNA, 22 bp, Homo sapiens
gtactttatagaagaatgcatg

SEQ ID NO: 2381562 - DNA, 15 bp, Homo sapiens
gtactttgattcaca

SEQ ID NO: 2381563 - DNA, 17 bp, Homo sapiens
gtactttgattcacatg

SEQ ID NO: 2381564 - DNA, 21 bp, Homo sapiens
gtactttgattcacatgtttt

SEQ ID NO: 2381565 - DNA, 18 bp, Homo sapiens
gtagaatgaccttgtaat

SEQ ID NO: 2381566 - DNA, 20 bp, Homo sapiens
gtagaatgaccttgtaatgt

SEQ ID NO: 2381567 - DNA, 22 bp, Homo sapiens
gtagaatgaccttgtaatgtaa

SEQ ID NO: 2381568 - DNA, 20 bp, Homo sapiens
gtagaggggtgctttgcctg

SEQ ID NO: 2381569 - DNA, 16 bp, Homo sapiens
gtaggaatattatatt

SEQ ID NO: 2381570 - DNA, 21 bp, Homo sapiens
gtaggaatattatatttggat

SEQ ID NO: 2381571 - DNA, 18 bp, Homo sapiens
gtaggcaagatggcacag

SEQ ID NO: 2381572 - DNA, 18 bp, Homo sapiens
gtatagaagtcttcatga

SEQ ID NO: 2381573 - DNA, 23 bp, Homo sapiens
gtatagaagtcttcatgaaatgc

SEQ ID NO: 2381574 - DNA, 15 bp, Homo sapiens
gtatgcaagcagttt

SEQ ID NO: 2381575 - DNA, 23 bp, Homo sapiens
gtatgcaagcagtttcaataaag

SEQ ID NO: 2381576 - DNA, 18 bp, Homo sapiens
gtatgtctgacagtcttt

SEQ ID NO: 2381577 - DNA, 20 bp, Homo sapiens
gtatgtttttcagttcaaag

SEQ ID NO: 2381578 - DNA, 19 bp, Homo sapiens
gtattgttctcatgtaaga

SEQ ID NO: 2381579 - DNA, 15 bp, Homo sapiens
gtatttgaaaacaga

SEQ ID NO: 2381580 - DNA, 19 bp, Homo sapiens
gtatttgaaaacagaaatt

SEQ ID NO: 2381581 - DNA, 19 bp, Homo sapiens
gtatttttaattaactttg

SEQ ID NO: 2381582 - DNA, 11 bp, Homo sapiens
gtcaaacatta

SEQ ID NO: 2381583 - DNA, 19 bp, Homo sapiens
gtcaaacattagtacttta

SEQ ID NO: 2381584 - DNA, 16 bp, Homo sapiens
gtcataggaagttagc

SEQ ID NO: 2381585 - DNA, 13 bp, Homo sapiens
gtcatgatgtttt

SEQ ID NO: 2381586 - DNA, 11 bp, Homo sapiens
gtcatttccat

SEQ ID NO: 2381587 - DNA, 13 bp, Homo sapiens
gtcattttcatta

SEQ ID NO: 2381588 - DNA, 12 bp, Homo sapiens
gtccacttttcc

SEQ ID NO: 2381589 - DNA, 18 bp, Homo sapiens
gtccacttttccagtatt

SEQ ID NO: 2381590 - DNA, 21 bp, Homo sapiens
gtccacttttccagtatttta

SEQ ID NO: 2381591 - DNA, 22 bp, Homo sapiens
gtccacttttccagtattttag

SEQ ID NO: 2381592 - DNA, 16 bp, Homo sapiens
gtcctgtgtcagttta

SEQ ID NO: 2381593 - DNA, 22 bp, Homo sapiens
gtcctgtgtcagtttatgtttt

SEQ ID NO: 2381594 - DNA, 17 bp, Homo sapiens
gtctaatgtttaagcag

SEQ ID NO: 2381595 - DNA, 19 bp, Homo sapiens
gtctgccccaagttttgtg

SEQ ID NO: 2381596 - DNA, 22 bp, Homo sapiens
gtctgccccaagttttgtgaaa

SEQ ID NO: 2381597 - DNA, 13 bp, Homo sapiens
gtcttcatgaaat

SEQ ID NO: 2381598 - DNA, 23 bp, Homo sapiens
gtcttcatgaaatgctatgtcat

SEQ ID NO: 2381599 - DNA, 21 bp, Homo sapiens
gtcttttttttttaagtgaaa

SEQ ID NO: 2381600 - DNA, 12 bp, Homo sapiens
gtgaaatttttc

SEQ ID NO: 2381601 - DNA, 18 bp, Homo sapiens
gtgaaatttttcatattt

SEQ ID NO: 2381602 - DNA, 21 bp, Homo sapiens
gtgaaggaccttcactctaag

SEQ ID NO: 2381603 - DNA, 13 bp, Homo sapiens
gtgagtttgtttc

SEQ ID NO: 2381604 - DNA, 15 bp, Homo sapiens
gtgagtttgtttctt

SEQ ID NO: 2381605 - DNA, 22 bp, Homo sapiens
gtgagtttgtttctttgaattt

SEQ ID NO: 2381606 - DNA, 18 bp, Homo sapiens
gtgatgtgacatttgtca

SEQ ID NO: 2381607 - DNA, 14 bp, Homo sapiens
gtgcaatatatttt

SEQ ID NO: 2381608 - DNA, 23 bp, Homo sapiens
gtgcaatatattttgtatgcaag

SEQ ID NO: 2381609 - DNA, 17 bp, Homo sapiens
gtgctaaacgtgtatgt

SEQ ID NO: 2381610 - DNA, 16 bp, Homo sapiens
gtgcttactctttgta

SEQ ID NO: 2381611 - DNA, 16 bp, Homo sapiens
gtggaccctgaaatgt

SEQ ID NO: 2381612 - DNA, 23 bp, Homo sapiens
gtggaccctgaaatgtgtgtgat

SEQ ID NO: 2381613 - DNA, 13 bp, Homo sapiens
gtgtatgtttttc

SEQ ID NO: 2381614 - DNA, 15 bp, Homo sapiens
gtgtatgtttttcag

SEQ ID NO: 2381615 - DNA, 14 bp, Homo sapiens
tgaatctgtacaga

SEQ ID NO: 2381616 - DNA, 21 bp, Homo sapiens
tgaattactaacttctaaaac

SEQ ID NO: 2381617 - DNA, 12 bp, Homo sapiens
tgaattttcatt

SEQ ID NO: 2381618 - DNA, 14 bp, Homo sapiens
tgaattttcatttt

SEQ ID NO: 2381619 - DNA, 18 bp, Homo sapiens
tgaattttcattttacag

SEQ ID NO: 2381620 - DNA, 19 bp, Homo sapiens
tgaattttcattttacagt

SEQ ID NO: 2381621 - DNA, 13 bp, Homo sapiens
tgacatttgtcat

SEQ ID NO: 2381622 - DNA, 14 bp, Homo sapiens
tgacatttgtcatt

SEQ ID NO: 2381623 - DNA, 15 bp, Homo sapiens
tgacatttgtttggt

SEQ ID NO: 2381624 - DNA, 16 bp, Homo sapiens
tgaccttgtaatgtaa

SEQ ID NO: 2381625 - DNA, 14 bp, Homo sapiens
tgagagagatgtgt

SEQ ID NO: 2381626 - DNA, 14 bp, Homo sapiens
tgagcagtgatatt

SEQ ID NO: 2381627 - DNA, 20 bp, Homo sapiens
tgagcagtgatattctttgt

SEQ ID NO: 2381628 - DNA, 23 bp, Homo sapiens
tgagcagtgatattctttgttaa

SEQ ID NO: 2381629 - DNA, 15 bp, Homo sapiens
tgaggaaaaatatgt

SEQ ID NO: 2381630 - DNA, 16 bp, Homo sapiens
tgaggaaaaatatgtg

SEQ ID NO: 2381631 - DNA, 19 bp, Homo sapiens
tgaggaaaaatatgtgaag

SEQ ID NO: 2381632 - DNA, 20 bp, Homo sapiens
tgagtcttttttttttaagt

SEQ ID NO: 2381633 - DNA, 13 bp, Homo sapiens
tgagtttgtttct

SEQ ID NO: 2381634 - DNA, 19 bp, Homo sapiens
tgataaatagtgttattga

SEQ ID NO: 2381635 - DNA, 18 bp, Homo sapiens
tgatattctttgttaatt

SEQ ID NO: 2381636 - DNA, 14 bp, Homo sapiens
tgatctgtgccttt

SEQ ID NO: 2381637 - DNA, 23 bp, Homo sapiens
tgatctgtgccttttttatatct

SEQ ID NO: 2381638 - DNA, 18 bp, Homo sapiens
tgatgcaatccttacaaa

SEQ ID NO: 2381639 - DNA, 23 bp, Homo sapiens
tgatgcaatccttacaaatgatt

SEQ ID NO: 2381640 - DNA, 12 bp, Homo sapiens
tgatgtgacatt

SEQ ID NO: 2381641 - DNA, 16 bp, Homo sapiens
tgatgtgacatttgtc

SEQ ID NO: 2381642 - DNA, 21 bp, Homo sapiens
tgatgtttttaaaatcttatt

SEQ ID NO: 2381643 - DNA, 18 bp, Homo sapiens
tgattcacatgttttcaa

SEQ ID NO: 2381644 - DNA, 20 bp, Homo sapiens
tgattcacatgttttcaaat

SEQ ID NO: 2381645 - DNA, 18 bp, Homo sapiens
tgattcagctaagcaaag

SEQ ID NO: 2381646 - DNA, 17 bp, Homo sapiens
tgattgcttttaaaatt

SEQ ID NO: 2381647 - DNA, 19 bp, Homo sapiens
tgatttcacaaatattaaa

SEQ ID NO: 2381648 - DNA, 23 bp, Homo sapiens
tgatttctagttatttattctgg

SEQ ID NO: 2381649 - DNA, 13 bp, Homo sapiens
tgattttttaaga

SEQ ID NO: 2381650 - DNA, 15 bp, Homo sapiens
tgcaatatattttgt

SEQ ID NO: 2381651 - DNA, 18 bp, Homo sapiens
tgcaatatattttgtatg

SEQ ID NO: 2381652 - DNA, 17 bp, Homo sapiens
tgcacacatcatctgta

SEQ ID NO: 2381653 - DNA, 20 bp, Homo sapiens
tgcacatgatttcacaaata

SEQ ID NO: 2381654 - DNA, 24 bp, Homo sapiens
tgcagagttcagggaagataagtt

SEQ ID NO: 2381655 - DNA, 11 bp, Homo sapiens
tgcataataat

SEQ ID NO: 2381656 - DNA, 12 bp, Homo sapiens
tgcatacaaaca

SEQ ID NO: 2381657 - DNA, 20 bp, Homo sapiens
tgcatacaaacaagcatata

SEQ ID NO: 2381658 - DNA, 12 bp, Homo sapiens
tgccaaacatta

SEQ ID NO: 2381659 - DNA, 19 bp, Homo sapiens
tgccaaacattaatgttga

SEQ ID NO: 2381660 - DNA, 17 bp, Homo sapiens
tgcctctgatgtatttt

SEQ ID NO: 2381661 - DNA, 19 bp, Homo sapiens
tgcctctgatgtattttgt

SEQ ID NO: 2381662 - DNA, 11 bp, Homo sapiens
tgcctgctctt

SEQ ID NO: 2381663 - DNA, 14 bp, Homo sapiens
tgccttaaggtata

SEQ ID NO: 2381664 - DNA, 15 bp, Homo sapiens
tgctaaacgtgtatg

SEQ ID NO: 2381665 - DNA, 17 bp, Homo sapiens
tgctaaacgtgtatgtt

SEQ ID NO: 2381666 - DNA, 15 bp, Homo sapiens
tgctaaattgatgtt

SEQ ID NO: 2381667 - DNA, 16 bp, Homo sapiens
tgctaagaatttttta

SEQ ID NO: 2381668 - DNA, 16 bp, Homo sapiens
tgctatgtcatttcat

SEQ ID NO: 2381669 - DNA, 18 bp, Homo sapiens
tgctatgtcatttcatgt

SEQ ID NO: 2381670 - DNA, 19 bp, Homo sapiens
tgctatgtcatttcatgtc

SEQ ID NO: 2381671 - DNA, 15 bp, Homo sapiens
tgctcttgggcaata

SEQ ID NO: 2381672 - DNA, 17 bp, Homo sapiens
tgctcttgggcaatatt

SEQ ID NO: 2381673 - DNA, 19 bp, Homo sapiens
tgctcttgggcaatattct

SEQ ID NO: 2381674 - DNA, 21 bp, Homo sapiens
tgctcttgggcaatattctct

SEQ ID NO: 2381675 - DNA, 23 bp, Homo sapiens
tgcttaaatgtgaattactaact

SEQ ID NO: 2381676 - DNA, 15 bp, Homo sapiens
tgctttccatatttt

SEQ ID NO: 2381677 - DNA, 18 bp, Homo sapiens
tggaaacactaaatgtta

SEQ ID NO: 2381678 - DNA, 20 bp, Homo sapiens
tggaaacactaaatgttaaa

SEQ ID NO: 2381679 - DNA, 22 bp, Homo sapiens
tggaaacactaaatgttaaaga

SEQ ID NO: 2381680 - DNA, 18 bp, Homo sapiens
tggaagcaggttaaatgt

SEQ ID NO: 2381681 - DNA, 21 bp, Homo sapiens
tggaagcaggttaaatgtttt

SEQ ID NO: 2381682 - DNA, 20 bp, Homo sapiens
tggaattttaagtctttcct

SEQ ID NO: 2381683 - DNA, 16 bp, Homo sapiens
tggaccctgaaatgtg

SEQ ID NO: 2381684 - DNA, 17 bp, Homo sapiens
tggaccctgaaatgtgt

SEQ ID NO: 2381685 - DNA, 14 bp, Homo sapiens
tggcaacaaactgc

SEQ ID NO: 2381686 - DNA, 17 bp, Homo sapiens
tggcaacaaactgcaca

SEQ ID NO: 2381687 - DNA, 18 bp, Homo sapiens
tggcaacaaactgcacat

SEQ ID NO: 2381688 - DNA, 20 bp, Homo sapiens
tggcacagggcatgaaatga

SEQ ID NO: 2381689 - DNA, 20 bp, Homo sapiens
tggcaggtaggaatattata

SEQ ID NO: 2381690 - DNA, 21 bp, Homo sapiens
tggcctgatgaccaattttaa

SEQ ID NO: 2381691 - DNA, 19 bp, Homo sapiens
tgggaaattatctgcctta

SEQ ID NO: 2381692 - DNA, 14 bp, Homo sapiens
tgggaatgtatagt

SEQ ID NO: 2381693 - DNA, 22 bp, Homo sapiens
tgggaatgtatagtatttgaaa

SEQ ID NO: 2381694 - DNA, 23 bp, Homo sapiens
tgggtacaggtttttttggattt

SEQ ID NO: 2381695 - DNA, 16 bp, Homo sapiens
tggtaccttgcacaca

SEQ ID NO: 2381696 - DNA, 16 bp, Homo sapiens
tggtccacttttccag

SEQ ID NO: 2381697 - DNA, 21 bp, Homo sapiens
tggttatagtgcaatatattt

SEQ ID NO: 2381698 - DNA, 14 bp, Homo sapiens
tggttgtatctgtg

SEQ ID NO: 2381699 - DNA, 13 bp, Homo sapiens
tggttttaaaata

SEQ ID NO: 2381700 - DNA, 12 bp, Homo sapiens
tgtaaactttga

SEQ ID NO: 2381701 - DNA, 13 bp, Homo sapiens
tgtaaactttgaa

SEQ ID NO: 2381702 - DNA, 15 bp, Homo sapiens
tgtaaactttgaaat

SEQ ID NO: 2381703 - DNA, 17 bp, Homo sapiens
tgtaaactttgaaatat

SEQ ID NO: 2381704 - DNA, 16 bp, Homo sapiens
tgtaagaatgactgat

SEQ ID NO: 2381705 - DNA, 15 bp, Homo sapiens
tgtaatgtaactgct

SEQ ID NO: 2381706 - DNA, 19 bp, Homo sapiens
tgtaccattaaaatatgca

SEQ ID NO: 2381707 - DNA, 21 bp, Homo sapiens
tgtagcaaaccctgtcaaaca

SEQ ID NO: 2381708 - DNA, 20 bp, Homo sapiens
tgtagctattggtctgtcct

SEQ ID NO: 2381709 - DNA, 19 bp, Homo sapiens
tgtatagtatttgaaaaca

SEQ ID NO: 2381710 - DNA, 17 bp, Homo sapiens
tgtatgatctgtgcctt

SEQ ID NO: 2381711 - DNA, 18 bp, Homo sapiens
tgtatgcaagcagtttca

SEQ ID NO: 2381712 - DNA, 18 bp, Homo sapiens
tgtattgttctcatgtaa

SEQ ID NO: 2381713 - DNA, 14 bp, Homo sapiens
tgtcagtttatgtt

SEQ ID NO: 2381714 - DNA, 22 bp, Homo sapiens
tgtcatttcatgtcctgtgtca

SEQ ID NO: 2381715 - DNA, 19 bp, Homo sapiens
tgtcctgtgtcagtttatg

SEQ ID NO: 2381716 - DNA, 15 bp, Homo sapiens
tgtctaagaaacatt

SEQ ID NO: 2381717 - DNA, 15 bp, Homo sapiens
tgtctgacagtcttt

SEQ ID NO: 2381718 - DNA, 15 bp, Homo sapiens
tgtctgagtttggta

SEQ ID NO: 2381719 - DNA, 13 bp, Homo sapiens
tgtgaattactaa

SEQ ID NO: 2381720 - DNA, 16 bp, Homo sapiens
tgtgaattactaactt

SEQ ID NO: 2381721 - DNA, 20 bp, Homo sapiens
tgtgaattactaacttctaa

SEQ ID NO: 2381722 - DNA, 17 bp, Homo sapiens
tgtgagtttgtttcttt

SEQ ID NO: 2381723 - DNA, 21 bp, Homo sapiens
tgtgagtttgtttctttgaat

SEQ ID NO: 2381724 - DNA, 15 bp, Homo sapiens
tgtgctaaacgtgta

SEQ ID NO: 2381725 - DNA, 13 bp, Homo sapiens
tgtgtcagtttat

SEQ ID NO: 2381726 - DNA, 15 bp, Homo sapiens
tgtgtcagtttatgt

SEQ ID NO: 2381727 - DNA, 20 bp, Homo sapiens
tgtgtcagtttatgttttgg

SEQ ID NO: 2381728 - DNA, 20 bp, Homo sapiens
tttgatcttcctctgctaaa

SEQ ID NO: 2381729 - DNA, 22 bp, Homo sapiens
tttgatcttcctctgctaaatt

SEQ ID NO: 2381730 - DNA, 19 bp, Homo sapiens
tttgattcacatgttttca

SEQ ID NO: 2381731 - DNA, 20 bp, Homo sapiens
tttgattcacatgttttcaa

SEQ ID NO: 2381732 - DNA, 13 bp, Homo sapiens
tttggttatagtg

SEQ ID NO: 2381733 - DNA, 23 bp, Homo sapiens
tttggttttaaaatactgtagat

SEQ ID NO: 2381734 - DNA, 21 bp, Homo sapiens
tttgtatgcaagcagtttcaa

SEQ ID NO: 2381735 - DNA, 23 bp, Homo sapiens
tttgtatgcaagcagtttcaata

SEQ ID NO: 2381736 - DNA, 16 bp, Homo sapiens
tttgtcattttcatta

SEQ ID NO: 2381737 - DNA, 21 bp, Homo sapiens
tttgtctgccccaagttttgt

SEQ ID NO: 2381738 - DNA, 20 bp, Homo sapiens
tttgttaatttggaccattt

SEQ ID NO: 2381739 - DNA, 22 bp, Homo sapiens
tttgttgcactgaagtttgata

SEQ ID NO: 2381740 - DNA, 19 bp, Homo sapiens
tttgttttttgaagtgttg

SEQ ID NO: 2381741 - DNA, 11 bp, Homo sapiens
ttttaaaaagt

SEQ ID NO: 2381742 - DNA, 18 bp, Homo sapiens
ttttaaaaagtattgcca

SEQ ID NO: 2381743 - DNA, 20 bp, Homo sapiens
ttttaaaaagtattgccaaa

SEQ ID NO: 2381744 - DNA, 14 bp, Homo sapiens
ttttaaaactactt

SEQ ID NO: 2381745 - DNA, 18 bp, Homo sapiens
ttttaaaactacttagca

SEQ ID NO: 2381746 - DNA, 12 bp, Homo sapiens
ttttaaaatact

SEQ ID NO: 2381747 - DNA, 15 bp, Homo sapiens
ttttaaaatcttatt

SEQ ID NO: 2381748 - DNA, 17 bp, Homo sapiens
ttttaacttagagcttt

SEQ ID NO: 2381749 - DNA, 18 bp, Homo sapiens
ttttaacttagagctttt

SEQ ID NO: 2381750 - DNA, 15 bp, Homo sapiens
ttttaagtgaaattt

SEQ ID NO: 2381751 - DNA, 19 bp, Homo sapiens
ttttaattaactttggatt

SEQ ID NO: 2381752 - DNA, 19 bp, Homo sapiens
ttttaatttcaagcttatt

SEQ ID NO: 2381753 - DNA, 23 bp, Homo sapiens
ttttacaaaggctgtattcagca

SEQ ID NO: 2381754 - DNA, 18 bp, Homo sapiens
ttttatgttgacatttgt

SEQ ID NO: 2381755 - DNA, 18 bp, Homo sapiens
ttttcaaatggagttgga

SEQ ID NO: 2381756 - DNA, 23 bp, Homo sapiens
ttttcagctaggaacaaatcttc

SEQ ID NO: 2381757 - DNA, 22 bp, Homo sapiens
ttttcatattttaatttcaagc

SEQ ID NO: 2381758 - DNA, 20 bp, Homo sapiens
ttttcattagcaaaaaaagt

SEQ ID NO: 2381759 - DNA, 13 bp, Homo sapiens
ttttcattttaca

SEQ ID NO: 2381760 - DNA, 14 bp, Homo sapiens
ttttccagtatttt

SEQ ID NO: 2381761 - DNA, 14 bp, Homo sapiens
ttttccttacataa

SEQ ID NO: 2381762 - DNA, 19 bp, Homo sapiens
ttttccttacataaacatc

SEQ ID NO: 2381763 - DNA, 12 bp, Homo sapiens
ttttcttaaaaa

SEQ ID NO: 2381764 - DNA, 23 bp, Homo sapiens
ttttgagtcttttttttttaagt

SEQ ID NO: 2381765 - DNA, 15 bp, Homo sapiens
ttttgtaaactttga

SEQ ID NO: 2381766 - DNA, 12 bp, Homo sapiens
ttttgtgaaatt

SEQ ID NO: 2381767 - DNA, 17 bp, Homo sapiens
ttttgtgaaatttttca

SEQ ID NO: 2381768 - DNA, 20 bp, Homo sapiens
ttttgtgaaatttttcatat

SEQ ID NO: 2381769 - DNA, 14 bp, Homo sapiens
ttttgtgagtttgt

SEQ ID NO: 2381770 - DNA, 23 bp, Homo sapiens
ttttgtgagtttgtttctttgaa

SEQ ID NO: 2381771 - DNA, 13 bp, Homo sapiens
ttttgttgcactg

SEQ ID NO: 2381772 - DNA, 15 bp, Homo sapiens
ttttgttgcactgaa

SEQ ID NO: 2381773 - DNA, 18 bp, Homo sapiens
ttttgttgcactgaagtt

SEQ ID NO: 2381774 - DNA, 19 bp, Homo sapiens
tttttaaaatcttattaaa

SEQ ID NO: 2381775 - DNA, 16 bp, Homo sapiens
tttttaagtgaaattt

SEQ ID NO: 2381776 - DNA, 18 bp, Homo sapiens
tttttctttgtatttatt

SEQ ID NO: 2381777 - DNA, 18 bp, Homo sapiens
tttttgttttgttgcact

SEQ ID NO: 2381778 - DNA, 13 bp, Homo sapiens
ttttttacaaagg

SEQ ID NO: 2381779 - DNA, 17 bp, Homo sapiens
atgtgaattactaactt

SEQ ID NO: 2381780 - DNA, 20 bp, Homo sapiens
atgtgaattactaacttcta

SEQ ID NO: 2381781 - DNA, 21 bp, Homo sapiens
atgtgaattactaacttctaa

SEQ ID NO: 2381782 - DNA, 11 bp, Homo sapiens
atgtgacattt

SEQ ID NO: 2381783 - DNA, 13 bp, Homo sapiens
atgtgtgtgatgt

SEQ ID NO: 2381784 - DNA, 18 bp, Homo sapiens
atgtgtgtgatgtgacat

SEQ ID NO: 2381785 - DNA, 22 bp, Homo sapiens
atgttgatgcaatccttacaaa

SEQ ID NO: 2381786 - DNA, 15 bp, Homo sapiens
atgttgatttctagt

SEQ ID NO: 2381787 - DNA, 21 bp, Homo sapiens
atgttggaattttaagtcttt

SEQ ID NO: 2381788 - DNA, 20 bp, Homo sapiens
atgtttaagcagaattggaa

SEQ ID NO: 2381789 - DNA, 22 bp, Homo sapiens
atgtttaagcagaattggaaaa

SEQ ID NO: 2381790 - DNA, 17 bp, Homo sapiens
atgttttggtccacttt

SEQ ID NO: 2381791 - DNA, 21 bp, Homo sapiens
atgttttgtaaactttgaaat

SEQ ID NO: 2381792 - DNA, 14 bp, Homo sapiens
atgtttttaaaatc

SEQ ID NO: 2381793 - DNA, 16 bp, Homo sapiens
atgtttttaaaatctt

SEQ ID NO: 2381794 - DNA, 12 bp, Homo sapiens
aaaattttaagc

SEQ ID NO: 2381795 - DNA, 20 bp, Homo sapiens
aaacaagcatataaaatggc

SEQ ID NO: 2381796 - DNA, 13 bp, Homo sapiens
aaacactaaatgt

SEQ ID NO: 2381797 - DNA, 15 bp, Homo sapiens
aaacactaaatgtta

SEQ ID NO: 2381798 - DNA, 21 bp, Homo sapiens
aaacactaaatgttaaagatg

SEQ ID NO: 2381799 - DNA, 14 bp, Homo sapiens
aaacagaaattggt

SEQ ID NO: 2381800 - DNA, 15 bp, Homo sapiens
aaacattaatgttga

SEQ ID NO: 2381801 - DNA, 19 bp, Homo sapiens
aaacattaatgttgatttc

SEQ ID NO: 2381802 - DNA, 20 bp, Homo sapiens
aaacattaatgttgatttct

SEQ ID NO: 2381803 - DNA, 22 bp, Homo sapiens
aaacattaatgttgatttctag

SEQ ID NO: 2381804 - DNA, 24 bp, Homo sapiens
aaacattagtactttatagaagaa

SEQ ID NO: 2381805 - DNA, 19 bp, Homo sapiens
aaacattggaagcaggtta

SEQ ID NO: 2381806 - DNA, 16 bp, Homo sapiens
aaaccctgtcaaacat

SEQ ID NO: 2381807 - DNA, 18 bp, Homo sapiens
aaactcaaccaaatggta

SEQ ID NO: 2381808 - DNA, 20 bp, Homo sapiens
aaactcaaccaaatggtaca

SEQ ID NO: 2381809 - DNA, 12 bp, Homo sapiens
aaactgcacatg

SEQ ID NO: 2381810 - DNA, 18 bp, Homo sapiens
aaactgcacatgatttca

SEQ ID NO: 2381811 - DNA, 20 bp, Homo sapiens
aaactgcacatgatttcaca

SEQ ID NO: 2381812 - DNA, 14 bp, Homo sapiens
aaactgtactttga

SEQ ID NO: 2381813 - DNA, 18 bp, Homo sapiens
aaactgtactttgattca

SEQ ID NO: 2381814 - DNA, 12 bp, Homo sapiens
aaactttgaaat

SEQ ID NO: 2381815 - DNA, 22 bp, Homo sapiens
aaagaaatctatagaaagtgtt

SEQ ID NO: 2381816 - DNA, 16 bp, Homo sapiens
aaagaactatcttcat

SEQ ID NO: 2381817 - DNA, 18 bp, Homo sapiens
aaagaactatcttcatct

SEQ ID NO: 2381818 - DNA, 12 bp, Homo sapiens
aaagacaaatag

SEQ ID NO: 2381819 - DNA, 18 bp, Homo sapiens
aaagacaaatagtaggca

SEQ ID NO: 2381820 - DNA, 17 bp, Homo sapiens
aaagataccttaaaatt

SEQ ID NO: 2381821 - DNA, 20 bp, Homo sapiens
aaagataccttaaaatttga

SEQ ID NO: 2381822 - DNA, 22 bp, Homo sapiens
aaagataccttaaaatttgaaa

SEQ ID NO: 2381823 - DNA, 14 bp, Homo sapiens
aaagatgtagcaaa

SEQ ID NO: 2381824 - DNA, 15 bp, Homo sapiens
aaaggattgattcag

SEQ ID NO: 2381825 - DNA, 20 bp, Homo sapiens
aaaggctgtattcagcaagg

SEQ ID NO: 2381826 - DNA, 18 bp, Homo sapiens
aaagtacaggtactttgt

SEQ ID NO: 2381827 - DNA, 13 bp, Homo sapiens
aaagtattgccaa

SEQ ID NO: 2381828 - DNA, 15 bp, Homo sapiens
aaagtattgccaaac

SEQ ID NO: 2381829 - DNA, 15 bp, Homo sapiens
aaagtcatgatgttt

SEQ ID NO: 2381830 - DNA, 16 bp, Homo sapiens
aaagtcatgatgtttt

SEQ ID NO: 2381831 - DNA, 18 bp, Homo sapiens
aaagtcatgatgttttta

SEQ ID NO: 2381832 - DNA, 21 bp, Homo sapiens
aaagtcatgatgtttttaaaa

SEQ ID NO: 2381833 - DNA, 16 bp, Homo sapiens
aaagtcttttaaaaag

SEQ ID NO: 2381834 - DNA, 16 bp, Homo sapiens
aaagtgttctgttaca

SEQ ID NO: 2381835 - DNA, 12 bp, Homo sapiens
aaagtttcaaaa

SEQ ID NO: 2381836 - DNA, 18 bp, Homo sapiens
aaagtttcaaaaatctga

SEQ ID NO: 2381837 - DNA, 19 bp, Homo sapiens
aaagtttcaaaaatctgaa

SEQ ID NO: 2381838 - DNA, 20 bp, Homo sapiens
aaagtttcaaaaatctgaag

SEQ ID NO: 2381839 - DNA, 21 bp, Homo sapiens
aaagtttcaaaaatctgaaga

SEQ ID NO: 2381840 - DNA, 13 bp, Homo sapiens
aaagtttgatctt

SEQ ID NO: 2381841 - DNA, 14 bp, Homo sapiens
aaagtttgatcttc

SEQ ID NO: 2381842 - DNA, 24 bp, Homo sapiens
aaagtttgatcttcctctgctaaa

SEQ ID NO: 2381843 - DNA, 11 bp, Homo sapiens
aaatactgtag

SEQ ID NO: 2381844 - DNA, 17 bp, Homo sapiens
aaatactgtagataatt

SEQ ID NO: 2381845 - DNA, 23 bp, Homo sapiens
aaatagtaggcaagatggcacag

SEQ ID NO: 2381846 - DNA, 16 bp, Homo sapiens
aaatataacacagttt

SEQ ID NO: 2381847 - DNA, 17 bp, Homo sapiens
aaatattaaaaagtctt

SEQ ID NO: 2381848 - DNA, 22 bp, Homo sapiens
aaatattaaaaagtcttttaaa

SEQ ID NO: 2381849 - DNA, 15 bp, Homo sapiens
aaatctgaagattgt

SEQ ID NO: 2381850 - DNA, 17 bp, Homo sapiens
aaatctgaagattgttt

SEQ ID NO: 2381851 - DNA, 20 bp, Homo sapiens
aaatctgaagattgtttatc

SEQ ID NO: 2381852 - DNA, 21 bp, Homo sapiens
aaatctgaagattgtttatct

SEQ ID NO: 2381853 - DNA, 14 bp, Homo sapiens
aaatcttattaaag

SEQ ID NO: 2381854 - DNA, 16 bp, Homo sapiens
aaatcttattaaagtt

SEQ ID NO: 2381855 - DNA, 21 bp, Homo sapiens
aaatcttattaaagtttcaaa

SEQ ID NO: 2381856 - DNA, 22 bp, Homo sapiens
aaatgattgcttttaaaatttt

SEQ ID NO: 2381857 - DNA, 17 bp, Homo sapiens
aaatgctatgtcatttc

SEQ ID NO: 2381858 - DNA, 22 bp, Homo sapiens
aaatgctatgtcatttcatgtc

SEQ ID NO: 2381859 - DNA, 20 bp, Homo sapiens
aaatggcaacaaactgcaca

SEQ ID NO: 2381860 - DNA, 14 bp, Homo sapiens
aaatgtaactgtta

SEQ ID NO: 2381861 - DNA, 15 bp, Homo sapiens
aaatgtgaattacta

SEQ ID NO: 2381862 - DNA, 23 bp, Homo sapiens
aaatgtgaattactaacttctaa

SEQ ID NO: 2381863 - DNA, 19 bp, Homo sapiens
aaatgtgtgtgatgtgaca

SEQ ID NO: 2381864 - DNA, 20 bp, Homo sapiens
aaatgtgtgtgatgtgacat

SEQ ID NO: 2381865 - DNA, 12 bp, Homo sapiens
aaatgttaaaga

SEQ ID NO: 2381866 - DNA, 16 bp, Homo sapiens
aaatgttaaagatgta

SEQ ID NO: 2381867 - DNA, 11 bp, Homo sapiens
aaatgttttca

SEQ ID NO: 2381868 - DNA, 12 bp, Homo sapiens
aatgtgaattac

SEQ ID NO: 2381869 - DNA, 16 bp, Homo sapiens
aatgtgtgtgatgtga

SEQ ID NO: 2381870 - DNA, 14 bp, Homo sapiens
aatgttaaagatgt

SEQ ID NO: 2381871 - DNA, 16 bp, Homo sapiens
aatgttaaagatgtag

SEQ ID NO: 2381872 - DNA, 13 bp, Homo sapiens
aatgttgatttct

SEQ ID NO: 2381873 - DNA, 14 bp, Homo sapiens
aatgttgatttcta

SEQ ID NO: 2381874 - DNA, 15 bp, Homo sapiens
aatgtttaagcagaa

SEQ ID NO: 2381875 - DNA, 20 bp, Homo sapiens
aatgtttaagcagaattgga

SEQ ID NO: 2381876 - DNA, 21 bp, Homo sapiens
aatgttttgtaaactttgaaa

SEQ ID NO: 2381877 - DNA, 22 bp, Homo sapiens
aatgttttgtaaactttgaaat

SEQ ID NO: 2381878 - DNA, 15 bp, Homo sapiens
aattactaacttcta

SEQ ID NO: 2381879 - DNA, 16 bp, Homo sapiens
aattactaacttctaa

SEQ ID NO: 2381880 - DNA, 22 bp, Homo sapiens
aattatgctaagaattttttat

SEQ ID NO: 2381881 - DNA, 18 bp, Homo sapiens
aattcaattcatgtaaca

SEQ ID NO: 2381882 - DNA, 14 bp, Homo sapiens
aattctgaagttat

SEQ ID NO: 2381883 - DNA, 21 bp, Homo sapiens
aattgaagtacttaattgaag

SEQ ID NO: 2381884 - DNA, 12 bp, Homo sapiens
aattgatgttga

SEQ ID NO: 2381885 - DNA, 13 bp, Homo sapiens
aattgatgttgat

SEQ ID NO: 2381886 - DNA, 15 bp, Homo sapiens
aattgatgttgatgc

SEQ ID NO: 2381887 - DNA, 16 bp, Homo sapiens
aattgatgttgatgca

SEQ ID NO: 2381888 - DNA, 15 bp, Homo sapiens
aattggaaaagacta

SEQ ID NO: 2381889 - DNA, 19 bp, Homo sapiens
aattggaaaagactaagat

SEQ ID NO: 2381890 - DNA, 20 bp, Homo sapiens
aattgtaaagtaaatgaaag

SEQ ID NO: 2381891 - DNA, 21 bp, Homo sapiens
aatttattgaggaaaaatatg

SEQ ID NO: 2381892 - DNA, 20 bp, Homo sapiens
aatttcaagcttattttgga

SEQ ID NO: 2381893 - DNA, 22 bp, Homo sapiens
aatttcacgtcataggaagtta

SEQ ID NO: 2381894 - DNA, 18 bp, Homo sapiens
aattttaagctaggaaaa

SEQ ID NO: 2381895 - DNA, 19 bp, Homo sapiens
agaaattggtaccttgcac

SEQ ID NO: 2381896 - DNA, 12 bp, Homo sapiens
agaacttgttta

SEQ ID NO: 2381897 - DNA, 17 bp, Homo sapiens
agaacttgtttaataaa

SEQ ID NO: 2381898 - DNA, 13 bp, Homo sapiens
agaagtcttcatg

SEQ ID NO: 2381899 - DNA, 17 bp, Homo sapiens
agaataggacttgtttt

SEQ ID NO: 2381900 - DNA, 21 bp, Homo sapiens
agaataggacttgtttttgtt

SEQ ID NO: 2381901 - DNA, 13 bp, Homo sapiens
agaatgaccttgt

SEQ ID NO: 2381902 - DNA, 23 bp, Homo sapiens
agaatgaccttgtaatgtaactg

SEQ ID NO: 2381903 - DNA, 13 bp, Homo sapiens
agaattgaagata

SEQ ID NO: 2381904 - DNA, 17 bp, Homo sapiens
agacaaatagtaggcaa

SEQ ID NO: 2381905 - DNA, 18 bp, Homo sapiens
agacctgagatgaagatt

SEQ ID NO: 2381906 - DNA, 15 bp, Homo sapiens
agacttctgttttca

SEQ ID NO: 2381907 - DNA, 17 bp, Homo sapiens
agacttctgttttcaat

SEQ ID NO: 2381908 - DNA, 18 bp, Homo sapiens
agagaggctaaaatgttt

SEQ ID NO: 2381909 - DNA, 19 bp, Homo sapiens
agagaggctaaaatgtttt

SEQ ID NO: 2381910 - DNA, 22 bp, Homo sapiens
agagataggaaggtcatttcca

SEQ ID NO: 2381911 - DNA, 23 bp, Homo sapiens
agagataggaaggtcatttccat

SEQ ID NO: 2381912 - DNA, 14 bp, Homo sapiens
agagatgtgtaatt

SEQ ID NO: 2381913 - DNA, 14 bp, Homo sapiens
agagccgtaaaaac

SEQ ID NO: 2381914 - DNA, 17 bp, Homo sapiens
agagccgtaaaaactga

SEQ ID NO: 2381915 - DNA, 16 bp, Homo sapiens
agagttcagggaagat

SEQ ID NO: 2381916 - DNA, 15 bp, Homo sapiens
agataagttggaaac

SEQ ID NO: 2381917 - DNA, 18 bp, Homo sapiens
agataagttggaaacact

SEQ ID NO: 2381918 - DNA, 19 bp, Homo sapiens
agataagttggaaacacta

SEQ ID NO: 2381919 - DNA, 20 bp, Homo sapiens
agataccttaaaatttgaaa

SEQ ID NO: 2381920 - DNA, 21 bp, Homo sapiens
agataggaaggtcatttccat

SEQ ID NO: 2381921 - DNA, 14 bp, Homo sapiens
agatcggttaacaa

SEQ ID NO: 2381922 - DNA, 16 bp, Homo sapiens
agatgaagattcatgt

SEQ ID NO: 2381923 - DNA, 22 bp, Homo sapiens
agatggcacagggcatgaaatg

SEQ ID NO: 2381924 - DNA, 21 bp, Homo sapiens
agatgtgtaatttttctgtat

SEQ ID NO: 2381925 - DNA, 21 bp, Homo sapiens
agatgttatatttttcttaaa

SEQ ID NO: 2381926 - DNA, 18 bp, Homo sapiens
agattccaagtgtattta

SEQ ID NO: 2381927 - DNA, 17 bp, Homo sapiens
agattggattttatgtt

SEQ ID NO: 2381928 - DNA, 23 bp, Homo sapiens
agattggattttatgttgacatt

SEQ ID NO: 2381929 - DNA, 14 bp, Homo sapiens
agattgtttatcta

SEQ ID NO: 2381930 - DNA, 16 bp, Homo sapiens
agcaaaccctgtcaaa

SEQ ID NO: 2381931 - DNA, 14 bp, Homo sapiens
agcaacaattttca

SEQ ID NO: 2381932 - DNA, 16 bp, Homo sapiens
agcaggttaaatgttt

SEQ ID NO: 2381933 - DNA, 20 bp, Homo sapiens
agcagtttcaataaagtttg

SEQ ID NO: 2381934 - DNA, 23 bp, Homo sapiens
agcatataaaatggcaacaaact

SEQ ID NO: 2381935 - DNA, 17 bp, Homo sapiens
agcatttatggtaatca

SEQ ID NO: 2381936 - DNA, 23 bp, Homo sapiens
agcctcgtaggatgtatgttgga

SEQ ID NO: 2381937 - DNA, 17 bp, Homo sapiens
agcgacaacagattgga

SEQ ID NO: 2381938 - DNA, 17 bp, Homo sapiens
agctaggaaaagaaatc

SEQ ID NO: 2381939 - DNA, 15 bp, Homo sapiens
agctaggaacaaatc

SEQ ID NO: 2381940 - DNA, 23 bp, Homo sapiens
agctaggaacaaatcttcctggt

SEQ ID NO: 2381941 - DNA, 20 bp, Homo sapiens
agctgtttggttttaaaata

SEQ ID NO: 2381942 - DNA, 12 bp, Homo sapiens
aggaaaagaaat

SEQ ID NO: 2381943 - DNA, 14 bp, Homo sapiens
aggaaaagaaatct

SEQ ID NO: 2381944 - DNA, 17 bp, Homo sapiens
aggaaaagaaatctata

SEQ ID NO: 2381945 - DNA, 15 bp, Homo sapiens
aggaacaaatcttcc

SEQ ID NO: 2381946 - DNA, 17 bp, Homo sapiens
aggaatattatatttgg

SEQ ID NO: 2381947 - DNA, 16 bp, Homo sapiens
aggcaagatggcacag

SEQ ID NO: 2381948 - DNA, 13 bp, Homo sapiens
aggccaaagacaa

SEQ ID NO: 2381949 - DNA, 19 bp, Homo sapiens
aggccaaagacaaatagta

SEQ ID NO: 2381950 - DNA, 23 bp, Homo sapiens
aggcgctaacttgcttaaatgtg

SEQ ID NO: 2381951 - DNA, 14 bp, Homo sapiens
aggctaaaatgttt

SEQ ID NO: 2381952 - DNA, 19 bp, Homo sapiens
aggctaaaatgttttcagc

SEQ ID NO: 2381953 - DNA, 16 bp, Homo sapiens
aggctgtattcagcaa

SEQ ID NO: 2381954 - DNA, 20 bp, Homo sapiens
agggactaaatttgtaaaaa

SEQ ID NO: 2381955 - DNA, 14 bp, Homo sapiens
agggcatgaaatga

SEQ ID NO: 2381956 - DNA, 16 bp, Homo sapiens
agggggaatattttaa

SEQ ID NO: 2381957 - DNA, 16 bp, Homo sapiens
aggggtaccactgaat

SEQ ID NO: 2381958 - DNA, 16 bp, Homo sapiens
aggtactttgtctaag

SEQ ID NO: 2381959 - DNA, 17 bp, Homo sapiens
aggtagaatgaccttgt

SEQ ID NO: 2381960 - DNA, 21 bp, Homo sapiens
aggtagaatgaccttgtaatg

SEQ ID NO: 2381961 - DNA, 18 bp, Homo sapiens
aggtcatttccatgtatg

SEQ ID NO: 2381962 - DNA, 21 bp, Homo sapiens
aggttaggcagtataaagaat

SEQ ID NO: 2381963 - DNA, 19 bp, Homo sapiens
agtaaagaagaaagctttt

SEQ ID NO: 2381964 - DNA, 20 bp, Homo sapiens
agtacaggtactttgtctaa

SEQ ID NO: 2381965 - DNA, 20 bp, Homo sapiens
agtacattctcagtttttct

SEQ ID NO: 2381966 - DNA, 19 bp, Homo sapiens
agtactgagcagtgatatt

SEQ ID NO: 2381967 - DNA, 16 bp, Homo sapiens
agtactttatagaaga

SEQ ID NO: 2381968 - DNA, 17 bp, Homo sapiens
agtactttatagaagaa

SEQ ID NO: 2381969 - DNA, 20 bp, Homo sapiens
agtaggatatgcctgctctt

SEQ ID NO: 2381970 - DNA, 22 bp, Homo sapiens
agtaggatatgcctgctctttg

SEQ ID NO: 2381971 - DNA, 14 bp, Homo sapiens
agtataaagaatag

SEQ ID NO: 2381972 - DNA, 15 bp, Homo sapiens
agtattgccaaacat

SEQ ID NO: 2381973 - DNA, 22 bp, Homo sapiens
agtatttgaaaacagaaattgg

SEQ ID NO: 2381974 - DNA, 18 bp, Homo sapiens
agtcatgatgtttttaaa

SEQ ID NO: 2381975 - DNA, 20 bp, Homo sapiens
agtctcttttttacaaaggc

SEQ ID NO: 2381976 - DNA, 16 bp, Homo sapiens
agtcttcatgaaatgc

SEQ ID NO: 2381977 - DNA, 13 bp, Homo sapiens
agtcttttaaaaa

SEQ ID NO: 2381978 - DNA, 19 bp, Homo sapiens
agtcttttaaaaagtattg

SEQ ID NO: 2381979 - DNA, 12 bp, Homo sapiens
agtgatattctt

SEQ ID NO: 2381980 - DNA, 20 bp, Homo sapiens
agtgatattctttgttaatt

SEQ ID NO: 2381981 - DNA, 15 bp, Homo sapiens
agtgcaatatatttt

SEQ ID NO: 2381982 - DNA, 21 bp, Homo sapiens
agtgcaatatattttgtatgc

SEQ ID NO: 2381983 - DNA, 19 bp, Homo sapiens
agtgcttactctttgtacc

SEQ ID NO: 2381984 - DNA, 17 bp, Homo sapiens
agtggaccctgaaatgt

SEQ ID NO: 2381985 - DNA, 18 bp, Homo sapiens
agtggaccctgaaatgtg

SEQ ID NO: 2381986 - DNA, 19 bp, Homo sapiens
aaatgttttgtaaactttg

SEQ ID NO: 2381987 - DNA, 23 bp, Homo sapiens
aaatgttttgtaaactttgaaat

SEQ ID NO: 2381988 - DNA, 19 bp, Homo sapiens
aaatttattgaggaaaaat

SEQ ID NO: 2381989 - DNA, 23 bp, Homo sapiens
aaatttattgaggaaaaatatgt

SEQ ID NO: 2381990 - DNA, 15 bp, Homo sapiens
aaatttgaaacattg

SEQ ID NO: 2381991 - DNA, 16 bp, Homo sapiens
aaatttgaaacattgc

SEQ ID NO: 2381992 - DNA, 20 bp, Homo sapiens
aaatttgaaacattgctttt

SEQ ID NO: 2381993 - DNA, 16 bp, Homo sapiens
aaattttaagctagga

SEQ ID NO: 2381994 - DNA, 12 bp, Homo sapiens
aaatttttcata

SEQ ID NO: 2381995 - DNA, 13 bp, Homo sapiens
aaatttttcatat

SEQ ID NO: 2381996 - DNA, 17 bp, Homo sapiens
aaatttttcatatttta

SEQ ID NO: 2381997 - DNA, 15 bp, Homo sapiens
aacaacttttttttc

SEQ ID NO: 2381998 - DNA, 16 bp, Homo sapiens
aacaattttcagattt

SEQ ID NO: 2381999 - DNA, 20 bp, Homo sapiens
aacaattttcagatttgcac

SEQ ID NO: 2382000 - DNA, 15 bp, Homo sapiens
aacactaaatgttaa

SEQ ID NO: 2382001 - DNA, 18 bp, Homo sapiens
aacactaaatgttaaaga

SEQ ID NO: 2382002 - DNA, 22 bp, Homo sapiens
aacactaaatgttaaagatgta

SEQ ID NO: 2382003 - DNA, 22 bp, Homo sapiens
aacagaaattggtaccttgcac

SEQ ID NO: 2382004 - DNA, 17 bp, Homo sapiens
aacagattggattttat

SEQ ID NO: 2382005 - DNA, 22 bp, Homo sapiens
aacatcaggttaggcagtataa

SEQ ID NO: 2382006 - DNA, 15 bp, Homo sapiens
aacattagtacttta

SEQ ID NO: 2382007 - DNA, 14 bp, Homo sapiens
aacattgcttttaa

SEQ ID NO: 2382008 - DNA, 15 bp, Homo sapiens
aacattgcttttaaa

SEQ ID NO: 2382009 - DNA, 20 bp, Homo sapiens
aaccaaggtagaatgacctt

SEQ ID NO: 2382010 - DNA, 23 bp, Homo sapiens
aaccaaggtagaatgaccttgta

SEQ ID NO: 2382011 - DNA, 18 bp, Homo sapiens
aaccacagtgtaccatta

SEQ ID NO: 2382012 - DNA, 21 bp, Homo sapiens
aaccacagtgtaccattaaaa

SEQ ID NO: 2382013 - DNA, 14 bp, Homo sapiens
aacgtgtatgtttt

SEQ ID NO: 2382014 - DNA, 23 bp, Homo sapiens
aactcaaccaaatggtacaaaac

SEQ ID NO: 2382015 - DNA, 19 bp, Homo sapiens
aactgcacatgatttcaca

SEQ ID NO: 2382016 - DNA, 22 bp, Homo sapiens
aactgctcttgggcaatattct

SEQ ID NO: 2382017 - DNA, 19 bp, Homo sapiens
aactgttaccattggaaat

SEQ ID NO: 2382018 - DNA, 14 bp, Homo sapiens
tttcagttcaaagt

SEQ ID NO: 2382019 - DNA, 21 bp, Homo sapiens
tttcatgtcctgtgtcagttt

SEQ ID NO: 2382020 - DNA, 14 bp, Homo sapiens
tttcattagcaaaa

SEQ ID NO: 2382021 - DNA, 15 bp, Homo sapiens
tttcattagcaaaaa

SEQ ID NO: 2382022 - DNA, 21 bp, Homo sapiens
tttcattttacagttactttt

SEQ ID NO: 2382023 - DNA, 21 bp, Homo sapiens
tttccatatttttttccttac

SEQ ID NO: 2382024 - DNA, 22 bp, Homo sapiens
tttccatatttttttccttaca

SEQ ID NO: 2382025 - DNA, 17 bp, Homo sapiens
tttccttacataaacat

SEQ ID NO: 2382026 - DNA, 13 bp, Homo sapiens
tttcttaatatat

SEQ ID NO: 2382027 - DNA, 20 bp, Homo sapiens
tttcttttgttttttgaagt

SEQ ID NO: 2382028 - DNA, 12 bp, Homo sapiens
tttgaaacattg

SEQ ID NO: 2382029 - DNA, 15 bp, Homo sapiens
tttgaaacattgctt

SEQ ID NO: 2382030 - DNA, 17 bp, Homo sapiens
tttgaattttcatttta

SEQ ID NO: 2382031 - DNA, 20 bp, Homo sapiens
tttgaattttcattttacag

SEQ ID NO: 2382032 - DNA, 23 bp, Homo sapiens
tttgaattttcattttacagtta

SEQ ID NO: 2382033 - DNA, 12 bp, Homo sapiens
tttgattcacat

SEQ ID NO: 2382034 - DNA, 14 bp, Homo sapiens
tttgattcacatgt

SEQ ID NO: 2382035 - DNA, 16 bp, Homo sapiens
tttgattcacatgttt

SEQ ID NO: 2382036 - DNA, 21 bp, Homo sapiens
tttgattcacatgttttcaaa

SEQ ID NO: 2382037 - DNA, 12 bp, Homo sapiens
tttgcacaaaaa

SEQ ID NO: 2382038 - DNA, 17 bp, Homo sapiens
tttgcacaaaaagatac

SEQ ID NO: 2382039 - DNA, 22 bp, Homo sapiens
tttggcctgatgaccaatttta

SEQ ID NO: 2382040 - DNA, 22 bp, Homo sapiens
tttggttttaaaatactgtaga

SEQ ID NO: 2382041 - DNA, 15 bp, Homo sapiens
tttgtaaactttgaa

SEQ ID NO: 2382042 - DNA, 16 bp, Homo sapiens
tttgtaaactttgaaa

SEQ ID NO: 2382043 - DNA, 19 bp, Homo sapiens
tttgtaaactttgaaatat

SEQ ID NO: 2382044 - DNA, 14 bp, Homo sapiens
tttgtcattttcat

SEQ ID NO: 2382045 - DNA, 16 bp, Homo sapiens
tttgtctaagaaacat

SEQ ID NO: 2382046 - DNA, 19 bp, Homo sapiens
tttgtctgccccaagtttt

SEQ ID NO: 2382047 - DNA, 15 bp, Homo sapiens
tttgtgagtttgttt

SEQ ID NO: 2382048 - DNA, 18 bp, Homo sapiens
tttgtgtgctaaacgtgt

SEQ ID NO: 2382049 - DNA, 10 bp, Homo sapiens
tttgttgcac

SEQ ID NO: 2382050 - DNA, 18 bp, Homo sapiens
tttgttgcactgaagttt

SEQ ID NO: 2382051 - DNA, 16 bp, Homo sapiens
tttgttttttgaagtg

SEQ ID NO: 2382052 - DNA, 17 bp, Homo sapiens
tttgttttttgaagtgt

SEQ ID NO: 2382053 - DNA, 18 bp, Homo sapiens
tttgttttttgagtcttt

SEQ ID NO: 2382054 - DNA, 21 bp, Homo sapiens
ttttaaaaagtattgccaaac

SEQ ID NO: 2382055 - DNA, 15 bp, Homo sapiens
ttttaaaactactta

SEQ ID NO: 2382056 - DNA, 13 bp, Homo sapiens
ttttaaaatctta

SEQ ID NO: 2382057 - DNA, 22 bp, Homo sapiens
ttttaaaatcttattaaagttt

SEQ ID NO: 2382058 - DNA, 13 bp, Homo sapiens
ttttaattttgtc

SEQ ID NO: 2382059 - DNA, 16 bp, Homo sapiens
ttttaattttgtctgc

SEQ ID NO: 2382060 - DNA, 21 bp, Homo sapiens
ttttagtggaccctgaaatgt

SEQ ID NO: 2382061 - DNA, 23 bp, Homo sapiens
ttttagtggaccctgaaatgtgt

SEQ ID NO: 2382062 - DNA, 15 bp, Homo sapiens
ttttatgttgacatt

SEQ ID NO: 2382063 - DNA, 23 bp, Homo sapiens
ttttatgttgacatttgtttggt

SEQ ID NO: 2382064 - DNA, 12 bp, Homo sapiens
ttttattttcca

SEQ ID NO: 2382065 - DNA, 16 bp, Homo sapiens
ttttattttctaaagt

SEQ ID NO: 2382066 - DNA, 20 bp, Homo sapiens
ttttcaatctcgtatagaag

SEQ ID NO: 2382067 - DNA, 15 bp, Homo sapiens
ttttcagatttgcac

SEQ ID NO: 2382068 - DNA, 17 bp, Homo sapiens
ttttcagatttgcacaa

SEQ ID NO: 2382069 - DNA, 24 bp, Homo sapiens
ttttcagttcaaagtcatgatgtt

SEQ ID NO: 2382070 - DNA, 15 bp, Homo sapiens
ttttcatattttaat

SEQ ID NO: 2382071 - DNA, 23 bp, Homo sapiens
ttttcattagcaaaaaaagttgt

SEQ ID NO: 2382072 - DNA, 13 bp, Homo sapiens
ttttccttgcata

SEQ ID NO: 2382073 - DNA, 14 bp, Homo sapiens
ttttccttgcatac

SEQ ID NO: 2382074 - DNA, 12 bp, Homo sapiens
ttttctaaagta

SEQ ID NO: 2382075 - DNA, 14 bp, Homo sapiens
ttttcttaaaaagt

SEQ ID NO: 2382076 - DNA, 20 bp, Homo sapiens
ttttcttttgttttttgaag

SEQ ID NO: 2382077 - DNA, 19 bp, Homo sapiens
ttttgtaaactttgaaata

SEQ ID NO: 2382078 - DNA, 12 bp, Homo sapiens
ttttgttgcact

SEQ ID NO: 2382079 - DNA, 14 bp, Homo sapiens
tttttaaaatctta

SEQ ID NO: 2382080 - DNA, 14 bp, Homo sapiens
tttttatatcttgg

SEQ ID NO: 2382081 - DNA, 12 bp, Homo sapiens
tttttcatattt

SEQ ID NO: 2382082 - DNA, 16 bp, Homo sapiens
tttttggatttagctt

SEQ ID NO: 2382083 - DNA, 12 bp, Homo sapiens
tttttttaagtg

SEQ ID NO: 2382084 - DNA, 20 bp, Homo sapiens
cttaaaatttgaaacattgc

SEQ ID NO: 2382085 - DNA, 23 bp, Homo sapiens
cttaaaatttgaaacattgcttt

SEQ ID NO: 2382086 - DNA, 16 bp, Homo sapiens
cttacaaatgattgct

SEQ ID NO: 2382087 - DNA, 19 bp, Homo sapiens
cttattaaagtttcaaaaa

SEQ ID NO: 2382088 - DNA, 20 bp, Homo sapiens
cttattaaagtttcaaaaat

SEQ ID NO: 2382089 - DNA, 22 bp, Homo sapiens
cttattaaagtttcaaaaatct

SEQ ID NO: 2382090 - DNA, 16 bp, Homo sapiens
cttcagggcagatttt

SEQ ID NO: 2382091 - DNA, 17 bp, Homo sapiens
cttcatgaaatgctatg

SEQ ID NO: 2382092 - DNA, 23 bp, Homo sapiens
cttcatgaaatgctatgtcattt

SEQ ID NO: 2382093 - DNA, 16 bp, Homo sapiens
cttcctctgctaaatt

SEQ ID NO: 2382094 - DNA, 22 bp, Homo sapiens
gattcacatgttttcaaatgga

SEQ ID NO: 2382095 - DNA, 19 bp, Homo sapiens
gattgattcagctaagcaa

SEQ ID NO: 2382096 - DNA, 22 bp, Homo sapiens
gattggattttatgttgacatt

SEQ ID NO: 2382097 - DNA, 14 bp, Homo sapiens
gatttcacaaatat

SEQ ID NO: 2382098 - DNA, 19 bp, Homo sapiens
gatttcacaaatattaaaa

SEQ ID NO: 2382099 - DNA, 15 bp, Homo sapiens
gatttctagttattt

SEQ ID NO: 2382100 - DNA, 13 bp, Homo sapiens
gattttatgttga

SEQ ID NO: 2382101 - DNA, 18 bp, Homo sapiens
gcaaaaaaagttgtatga

SEQ ID NO: 2382102 - DNA, 19 bp, Homo sapiens
gcaaaccctgtcaaacatt

SEQ ID NO: 2382103 - DNA, 16 bp, Homo sapiens
taataatcctgcaaag

SEQ ID NO: 2382104 - DNA, 22 bp, Homo sapiens
taatcatattagacttctgttt

SEQ ID NO: 2382105 - DNA, 13 bp, Homo sapiens
taatgttgatttc

SEQ ID NO: 2382106 - DNA, 14 bp, Homo sapiens
taatgttgatttct

SEQ ID NO: 2382107 - DNA, 17 bp, Homo sapiens
taatgttgatttctagt

SEQ ID NO: 2382108 - DNA, 17 bp, Homo sapiens
taattcaattcatgtaa

SEQ ID NO: 2382109 - DNA, 19 bp, Homo sapiens
taattctgaagttatattt

SEQ ID NO: 2382110 - DNA, 15 bp, Homo sapiens
taattcttattccat

SEQ ID NO: 2382111 - DNA, 16 bp, Homo sapiens
taattcttattccata

SEQ ID NO: 2382112 - DNA, 13 bp, Homo sapiens
taattgaagcttt

SEQ ID NO: 2382113 - DNA, 19 bp, Homo sapiens
taatttcaagcttattttg

SEQ ID NO: 2382114 - DNA, 17 bp, Homo sapiens
taatttggaccattttc

SEQ ID NO: 2382115 - DNA, 19 bp, Homo sapiens
taatttggaccattttcct

SEQ ID NO: 2382116 - DNA, 14 bp, Homo sapiens
taatttttctgtat

SEQ ID NO: 2382117 - DNA, 14 bp, Homo sapiens
tacaaaatgtaact

SEQ ID NO: 2382118 - DNA, 18 bp, Homo sapiens
tacaaacaagcatataaa

SEQ ID NO: 2382119 - DNA, 20 bp, Homo sapiens
tacaaacaagcatataaaat

SEQ ID NO: 2382120 - DNA, 17 bp, Homo sapiens
tacaatcagaaggtttc

SEQ ID NO: 2382121 - DNA, 20 bp, Homo sapiens
tacagagccgtaaaaactga

SEQ ID NO: 2382122 - DNA, 15 bp, Homo sapiens
tacaggtactttgtc

SEQ ID NO: 2382123 - DNA, 20 bp, Homo sapiens
tacaggtactttgtctaaga

SEQ ID NO: 2382124 - DNA, 13 bp, Homo sapiens
tacataaacatca

SEQ ID NO: 2382125 - DNA, 17 bp, Homo sapiens
tacattctcagtttttc

SEQ ID NO: 2382126 - DNA, 20 bp, Homo sapiens
tacattctcagtttttctta

SEQ ID NO: 2382127 - DNA, 15 bp, Homo sapiens
taccaactttcaaga

SEQ ID NO: 2382128 - DNA, 16 bp, Homo sapiens
taccactgaatctgta

SEQ ID NO: 2382129 - DNA, 18 bp, Homo sapiens
taccactgaatctgtaca

SEQ ID NO: 2382130 - DNA, 15 bp, Homo sapiens
taccactttagatga

SEQ ID NO: 2382131 - DNA, 13 bp, Homo sapiens
taccattaaaata

SEQ ID NO: 2382132 - DNA, 21 bp, Homo sapiens
taccattaaaatatgcactaa

SEQ ID NO: 2382133 - DNA, 13 bp, Homo sapiens
taccattggaaat

SEQ ID NO: 2382134 - DNA, 20 bp, Homo sapiens
taccattggaaatttcacgt

SEQ ID NO: 2382135 - DNA, 15 bp, Homo sapiens
taccttaaaatttga

SEQ ID NO: 2382136 - DNA, 21 bp, Homo sapiens
taccttaaaatttgaaacatt

SEQ ID NO: 2382137 - DNA, 22 bp, Homo sapiens
taccttaaaatttgaaacattg

SEQ ID NO: 2382138 - DNA, 21 bp, Homo sapiens
taccttgcacacatcatctgt

SEQ ID NO: 2382139 - DNA, 21 bp, Homo sapiens
tactgagcagtgatattcttt

SEQ ID NO: 2382140 - DNA, 14 bp, Homo sapiens
tactttatagaaga

SEQ ID NO: 2382141 - DNA, 19 bp, Homo sapiens
tactttatagaagaatgca

SEQ ID NO: 2382142 - DNA, 14 bp, Homo sapiens
tactttgattcaca

SEQ ID NO: 2382143 - DNA, 15 bp, Homo sapiens
tactttgattcacat

SEQ ID NO: 2382144 - DNA, 21 bp, Homo sapiens
tactttgattcacatgttttc

SEQ ID NO: 2382145 - DNA, 19 bp, Homo sapiens
tactttgtctaagaaacat

SEQ ID NO: 2382146 - DNA, 22 bp, Homo sapiens
tacttttccttgcatacaaaca

SEQ ID NO: 2382147 - DNA, 14 bp, Homo sapiens
tagaaaactttgtt

SEQ ID NO: 2382148 - DNA, 14 bp, Homo sapiens
tagaagaatgcatg

SEQ ID NO: 2382149 - DNA, 16 bp, Homo sapiens
tagaagaatgcatgct

SEQ ID NO: 2382150 - DNA, 18 bp, Homo sapiens
tagaagtcttcatgaaat

SEQ ID NO: 2382151 - DNA, 22 bp, Homo sapiens
tagaagtcttcatgaaatgcta

SEQ ID NO: 2382152 - DNA, 20 bp, Homo sapiens
tagaatgaccttgtaatgta

SEQ ID NO: 2382153 - DNA, 15 bp, Homo sapiens
tagacaggagaagaa

SEQ ID NO: 2382154 - DNA, 15 bp, Homo sapiens
tagacttctgttttc

SEQ ID NO: 2382155 - DNA, 18 bp, Homo sapiens
tagacttctgttttcaat

SEQ ID NO: 2382156 - DNA, 14 bp, Homo sapiens
tagcaaaaaaagtt

SEQ ID NO: 2382157 - DNA, 21 bp, Homo sapiens
tagcaaaaaaagttgtatgat

SEQ ID NO: 2382158 - DNA, 22 bp, Homo sapiens
tagcaaaccctgtcaaacatta

SEQ ID NO: 2382159 - DNA, 21 bp, Homo sapiens
tagcacttcagggcagatttt

SEQ ID NO: 2382160 - DNA, 17 bp, Homo sapiens
tagccagtgttttccag

SEQ ID NO: 2382161 - DNA, 22 bp, Homo sapiens
tagctcaaatattgaatgttta

SEQ ID NO: 2382162 - DNA, 15 bp, Homo sapiens
taggaaaagaaatct

SEQ ID NO: 2382163 - DNA, 22 bp, Homo sapiens
taggaaaagaaatctatagaaa

SEQ ID NO: 2382164 - DNA, 18 bp, Homo sapiens
taggaatattatatttgg

SEQ ID NO: 2382165 - DNA, 17 bp, Homo sapiens
taggacttgtttttgtt

SEQ ID NO: 2382166 - DNA, 15 bp, Homo sapiens
taggccaaagacaaa

SEQ ID NO: 2382167 - DNA, 16 bp, Homo sapiens
taggggtaccactgaa

SEQ ID NO: 2382168 - DNA, 17 bp, Homo sapiens
taggggtaccactgaat

SEQ ID NO: 2382169 - DNA, 16 bp, Homo sapiens
tagtactttatagaag

SEQ ID NO: 2382170 - DNA, 18 bp, Homo sapiens
tagtactttatagaagaa

SEQ ID NO: 2382171 - DNA, 21 bp, Homo sapiens
tagtactttatagaagaatgc

SEQ ID NO: 2382172 - DNA, 14 bp, Homo sapiens
tagtaggatatgcc

SEQ ID NO: 2382173 - DNA, 13 bp, Homo sapiens
tagtaggcaagat

SEQ ID NO: 2382174 - DNA, 14 bp, Homo sapiens
tagtatttgaaaac

SEQ ID NO: 2382175 - DNA, 16 bp, Homo sapiens
tagtgcaatatatttt

SEQ ID NO: 2382176 - DNA, 18 bp, Homo sapiens
tagtgcaatatattttgt

SEQ ID NO: 2382177 - DNA, 17 bp, Homo sapiens
tagtggaccctgaaatg

SEQ ID NO: 2382178 - DNA, 15 bp, Homo sapiens
tagttttattttcta

SEQ ID NO: 2382179 - DNA, 23 bp, Homo sapiens
tagttttattttctaaagtactg

SEQ ID NO: 2382180 - DNA, 17 bp, Homo sapiens
tataaagaataggactt

SEQ ID NO: 2382181 - DNA, 21 bp, Homo sapiens
tataaagaataggacttgttt

SEQ ID NO: 2382182 - DNA, 13 bp, Homo sapiens
tataccatttccg

SEQ ID NO: 2382183 - DNA, 14 bp, Homo sapiens
tatagaaagtgttc

SEQ ID NO: 2382184 - DNA, 23 bp, Homo sapiens
tatagaaagtgttctgttacaaa

SEQ ID NO: 2382185 - DNA, 20 bp, Homo sapiens
tatagaagaatgcatgcttt

SEQ ID NO: 2382186 - DNA, 19 bp, Homo sapiens
tatagaagtcttcatgaaa

SEQ ID NO: 2382187 - DNA, 13 bp, Homo sapiens
tatagtatttgaa

SEQ ID NO: 2382188 - DNA, 14 bp, Homo sapiens
tatagtgcaatata

SEQ ID NO: 2382189 - DNA, 15 bp, Homo sapiens
tatagtgcaatatat

SEQ ID NO: 2382190 - DNA, 19 bp, Homo sapiens
tatagtgcaatatattttg

SEQ ID NO: 2382191 - DNA, 18 bp, Homo sapiens
tatatagcatttatggta

SEQ ID NO: 2382192 - DNA, 21 bp, Homo sapiens
tatatcttggcaggtaggaat

SEQ ID NO: 2382193 - DNA, 17 bp, Homo sapiens
tatatggtctaatgttt

SEQ ID NO: 2382194 - DNA, 22 bp, Homo sapiens
tatattaaaggtatacaaataa

SEQ ID NO: 2382195 - DNA, 21 bp, Homo sapiens
tatatttcctataccatttcc

SEQ ID NO: 2382196 - DNA, 16 bp, Homo sapiens
tatattttgtatgcaa

SEQ ID NO: 2382197 - DNA, 17 bp, Homo sapiens
tatattttgtatgcaag

SEQ ID NO: 2382198 - DNA, 18 bp, Homo sapiens
tatatttttcttaaaaag

SEQ ID NO: 2382199 - DNA, 17 bp, Homo sapiens
tatctaccaactttcaa

SEQ ID NO: 2382200 - DNA, 18 bp, Homo sapiens
tatctaccaactttcaag

SEQ ID NO: 2382201 - DNA, 15 bp, Homo sapiens
tatctagatgtaaat

SEQ ID NO: 2382202 - DNA, 17 bp, Homo sapiens
tatctgccttatacatt

SEQ ID NO: 2382203 - DNA, 16 bp, Homo sapiens
tatgcaagcagtttca

SEQ ID NO: 2382204 - DNA, 17 bp, Homo sapiens
tatgcaagcagtttcaa

SEQ ID NO: 2382205 - DNA, 18 bp, Homo sapiens
tatgcaagcagtttcaat

SEQ ID NO: 2382206 - DNA, 24 bp, Homo sapiens
tatgcataataatcctgcaaagta

SEQ ID NO: 2382207 - DNA, 14 bp, Homo sapiens
tatgcctgctcttt

SEQ ID NO: 2382208 - DNA, 16 bp, Homo sapiens
tatggtaatcatatta

SEQ ID NO: 2382209 - DNA, 18 bp, Homo sapiens
tatggtaatcatattaga

SEQ ID NO: 2382210 - DNA, 12 bp, Homo sapiens
tatgtcatttca

SEQ ID NO: 2382211 - DNA, 16 bp, Homo sapiens
tatgtcatttcatgtc

SEQ ID NO: 2382212 - DNA, 13 bp, Homo sapiens
tatgttgacattt

SEQ ID NO: 2382213 - DNA, 12 bp, Homo sapiens
tatgttttggtc

SEQ ID NO: 2382214 - DNA, 17 bp, Homo sapiens
tattaaaaagtctttta

SEQ ID NO: 2382215 - DNA, 22 bp, Homo sapiens
tgaaatgtgtgtgatgtgacat

SEQ ID NO: 2382216 - DNA, 22 bp, Homo sapiens
tgtagcaaaccctgtcaaacat

SEQ ID NO: 2382217 - DNA, 20 bp, Homo sapiens
tgtatagtatttgaaaacag

SEQ ID NO: 2382218 - DNA, 16 bp, Homo sapiens
tgtatgatctgtgcct

SEQ ID NO: 2382219 - DNA, 19 bp, Homo sapiens
tgtatgcaagcagtttcaa

SEQ ID NO: 2382220 - DNA, 12 bp, Homo sapiens
tgtatgcataat

SEQ ID NO: 2382221 - DNA, 16 bp, Homo sapiens
tgtatgtttttcagtt

SEQ ID NO: 2382222 - DNA, 20 bp, Homo sapiens
tgtatgtttttcagttcaaa

SEQ ID NO: 2382223 - DNA, 22 bp, Homo sapiens
tgtatgtttttcagttcaaagt

SEQ ID NO: 2382224 - DNA, 22 bp, Homo sapiens
tgtattttgtgagtttgtttct

SEQ ID NO: 2382225 - DNA, 18 bp, Homo sapiens
tgtcatttcatgtcctgt

SEQ ID NO: 2382226 - DNA, 19 bp, Homo sapiens
tgtcattttcattagcaaa

SEQ ID NO: 2382227 - DNA, 20 bp, Homo sapiens
tgtcattttcattagcaaaa

SEQ ID NO: 2382228 - DNA, 16 bp, Homo sapiens
tgtcctgtgtcagttt

SEQ ID NO: 2382229 - DNA, 14 bp, Homo sapiens
tgtctaagaaacat

SEQ ID NO: 2382230 - DNA, 16 bp, Homo sapiens
tgtctaagaaacattg

SEQ ID NO: 2382231 - DNA, 17 bp, Homo sapiens
tgtctgccccaagtttt

SEQ ID NO: 2382232 - DNA, 22 bp, Homo sapiens
tgtctgccccaagttttgtgaa

SEQ ID NO: 2382233 - DNA, 15 bp, Homo sapiens
tgtgaaatttttcat

SEQ ID NO: 2382234 - DNA, 13 bp, Homo sapiens
tgtgaaggacctt

SEQ ID NO: 2382235 - DNA, 18 bp, Homo sapiens
tgtgacatttgtcatttt

SEQ ID NO: 2382236 - DNA, 17 bp, Homo sapiens
tgtgatgtgacatttgt

SEQ ID NO: 2382237 - DNA, 19 bp, Homo sapiens
tgtgatgtgacatttgtca

SEQ ID NO: 2382238 - DNA, 21 bp, Homo sapiens
tgtgctaaacgtgtatgtttt

SEQ ID NO: 2382239 - DNA, 15 bp, Homo sapiens
tgtgtaatttttctg

SEQ ID NO: 2382240 - DNA, 15 bp, Homo sapiens
tgtgtgtgatgtgac

SEQ ID NO: 2382241 - DNA, 19 bp, Homo sapiens
tgttaaagatgtagcaaac

SEQ ID NO: 2382242 - DNA, 15 bp, Homo sapiens
tgttaatttggacca

SEQ ID NO: 2382243 - DNA, 15 bp, Homo sapiens
tgttacaaaatgtaa

SEQ ID NO: 2382244 - DNA, 17 bp, Homo sapiens
tgttacaaaatgtaact

SEQ ID NO: 2382245 - DNA, 18 bp, Homo sapiens
tgttacaaaatgtaactg

SEQ ID NO: 2382246 - DNA, 23 bp, Homo sapiens
tgttacaaaatgtaactgttacc

SEQ ID NO: 2382247 - DNA, 20 bp, Homo sapiens
tgttattgagagagatgtgt

SEQ ID NO: 2382248 - DNA, 21 bp, Homo sapiens
tgttcaaactttctgccttct

SEQ ID NO: 2382249 - DNA, 21 bp, Homo sapiens
tgttgatgcaatccttacaaa

SEQ ID NO: 2382250 - DNA, 15 bp, Homo sapiens
tgttgatttctagtt

SEQ ID NO: 2382251 - DNA, 19 bp, Homo sapiens
tgttgcactgaagtttgat

SEQ ID NO: 2382252 - DNA, 17 bp, Homo sapiens
tgtttaataaagcgaaa

SEQ ID NO: 2382253 - DNA, 18 bp, Homo sapiens
tgtttatctagatgtaaa

SEQ ID NO: 2382254 - DNA, 20 bp, Homo sapiens
tgtttatctagatgtaaatt

SEQ ID NO: 2382255 - DNA, 16 bp, Homo sapiens
tgtttattctgtttca

SEQ ID NO: 2382256 - DNA, 16 bp, Homo sapiens
tgtttcattaactgtg

SEQ ID NO: 2382257 - DNA, 13 bp, Homo sapiens
tgtttctttgaat

SEQ ID NO: 2382258 - DNA, 18 bp, Homo sapiens
tgtttctttgaattttca

SEQ ID NO: 2382259 - DNA, 23 bp, Homo sapiens
tgtttctttgaattttcatttta

SEQ ID NO: 2382260 - DNA, 14 bp, Homo sapiens
tgttttccagcctt

SEQ ID NO: 2382261 - DNA, 16 bp, Homo sapiens
tgttttgtaaactttg

SEQ ID NO: 2382262 - DNA, 19 bp, Homo sapiens
tgttttgtaaactttgaaa

SEQ ID NO: 2382263 - DNA, 21 bp, Homo sapiens
tgttttgtaaactttgaaata

SEQ ID NO: 2382264 - DNA, 22 bp, Homo sapiens
tgttttgtaaactttgaaatat

SEQ ID NO: 2382265 - DNA, 22 bp, Homo sapiens
tgttttgttgcactgaagtttg

SEQ ID NO: 2382266 - DNA, 16 bp, Homo sapiens
tgtttttaaaatctta

SEQ ID NO: 2382267 - DNA, 14 bp, Homo sapiens
tgtttttgttttgt

SEQ ID NO: 2382268 - DNA, 18 bp, Homo sapiens
tgtttttgttttgttgca

SEQ ID NO: 2382269 - DNA, 15 bp, Homo sapiens
tgttttttgaagtgt

SEQ ID NO: 2382270 - DNA, 12 bp, Homo sapiens
ttaaaaagtatt

SEQ ID NO: 2382271 - DNA, 23 bp, Homo sapiens
ttaaaaagtattgccaaacatta

SEQ ID NO: 2382272 - DNA, 17 bp, Homo sapiens
ttaaaaagtcttttaaa

SEQ ID NO: 2382273 - DNA, 23 bp, Homo sapiens
ttaaaaagtcttttaaaaagtat

SEQ ID NO: 2382274 - DNA, 12 bp, Homo sapiens
ttaaaatactgt

SEQ ID NO: 2382275 - DNA, 20 bp, Homo sapiens
ttaaaatactgtagataatt

SEQ ID NO: 2382276 - DNA, 12 bp, Homo sapiens
ttaaaatattaa

SEQ ID NO: 2382277 - DNA, 15 bp, Homo sapiens
ttaaaatcttattaa

SEQ ID NO: 2382278 - DNA, 17 bp, Homo sapiens
ttaaaatttgaaacatt

SEQ ID NO: 2382279 - DNA, 11 bp, Homo sapiens
ttaaatgtgaa

SEQ ID NO: 2382280 - DNA, 16 bp, Homo sapiens
ttaaatgtgaattact

SEQ ID NO: 2382281 - DNA, 11 bp, Homo sapiens
ttaaatgtttt

SEQ ID NO: 2382282 - DNA, 12 bp, Homo sapiens
ttaaatgttttg

SEQ ID NO: 2382283 - DNA, 14 bp, Homo sapiens
ttaaatgttttgta

SEQ ID NO: 2382284 - DNA, 17 bp, Homo sapiens
ttaacaaataacaactt

SEQ ID NO: 2382285 - DNA, 18 bp, Homo sapiens
ttaagactgtgtctgtat

SEQ ID NO: 2382286 - DNA, 15 bp, Homo sapiens
ttaattgaagctttt

SEQ ID NO: 2382287 - DNA, 14 bp, Homo sapiens
ttaatttcaagctt

SEQ ID NO: 2382288 - DNA, 13 bp, Homo sapiens
ttaatttggacca

SEQ ID NO: 2382289 - DNA, 19 bp, Homo sapiens
ttaatttggaccattttcc

SEQ ID NO: 2382290 - DNA, 12 bp, Homo sapiens
ttaattttgtct

SEQ ID NO: 2382291 - DNA, 23 bp, Homo sapiens
ttaattttgtctgccccaagttt

SEQ ID NO: 2382292 - DNA, 13 bp, Homo sapiens
ttacaaaatgtaa

SEQ ID NO: 2382293 - DNA, 19 bp, Homo sapiens
ttacaaaatgtaactgtta

SEQ ID NO: 2382294 - DNA, 14 bp, Homo sapiens
ttacaaatgattgc

SEQ ID NO: 2382295 - DNA, 19 bp, Homo sapiens
ttacaaatgattgctttta

SEQ ID NO: 2382296 - DNA, 21 bp, Homo sapiens
ttacaaatgattgcttttaaa

SEQ ID NO: 2382297 - DNA, 23 bp, Homo sapiens
ttacaaatgattgcttttaaaat

SEQ ID NO: 2382298 - DNA, 15 bp, Homo sapiens
ttacaatatttgtgt

SEQ ID NO: 2382299 - DNA, 19 bp, Homo sapiens
ttacagttacttttccttg

SEQ ID NO: 2382300 - DNA, 16 bp, Homo sapiens
ttaccattggaaattt

SEQ ID NO: 2382301 - DNA, 20 bp, Homo sapiens
ttactaacttctaaaactgt

SEQ ID NO: 2382302 - DNA, 21 bp, Homo sapiens
ttactaacttctaaaactgta

SEQ ID NO: 2382303 - DNA, 18 bp, Homo sapiens
ttagacttctgttttcaa

SEQ ID NO: 2382304 - DNA, 14 bp, Homo sapiens
ttagcaaaaaaagt

SEQ ID NO: 2382305 - DNA, 21 bp, Homo sapiens
ttagcacttcagggcagattt

SEQ ID NO: 2382306 - DNA, 23 bp, Homo sapiens
ttagcgacaacagattggatttt

SEQ ID NO: 2382307 - DNA, 18 bp, Homo sapiens
ttaggccaaagacaaata

SEQ ID NO: 2382308 - DNA, 12 bp, Homo sapiens
ttagtactttat

SEQ ID NO: 2382309 - DNA, 21 bp, Homo sapiens
ttagtactttatagaagaatg

SEQ ID NO: 2382310 - DNA, 22 bp, Homo sapiens
ttataactgaaatactttactt

SEQ ID NO: 2382311 - DNA, 14 bp, Homo sapiens
ttatagtgcaatat

SEQ ID NO: 2382312 - DNA, 15 bp, Homo sapiens
ttatagttgaagatt

SEQ ID NO: 2382313 - DNA, 18 bp, Homo sapiens
ttatctaccaactttcaa

SEQ ID NO: 2382314 - DNA, 17 bp, Homo sapiens
ttatctagatgtaaatt

SEQ ID NO: 2382315 - DNA, 18 bp, Homo sapiens
ttatctagatgtaaattt

SEQ ID NO: 2382316 - DNA, 15 bp, Homo sapiens
ttatgctaagaattt

SEQ ID NO: 2382317 - DNA, 10 bp, Homo sapiens
ttatgttgac

SEQ ID NO: 2382318 - DNA, 14 bp, Homo sapiens
ttatgttgacattt

SEQ ID NO: 2382319 - DNA, 18 bp, Homo sapiens
ttatgttttggtccactt

SEQ ID NO: 2382320 - DNA, 12 bp, Homo sapiens
ttcaaaaatctg

SEQ ID NO: 2382321 - DNA, 19 bp, Homo sapiens
ttcaaagtcatgatgtttt

SEQ ID NO: 2382322 - DNA, 21 bp, Homo sapiens
ttcaaagtcatgatgttttta

SEQ ID NO: 2382323 - DNA, 17 bp, Homo sapiens
ttcaaatggagttggag

SEQ ID NO: 2382324 - DNA, 14 bp, Homo sapiens
ttcaagaacttgtt

SEQ ID NO: 2382325 - DNA, 13 bp, Homo sapiens
ttcaataaagttt

SEQ ID NO: 2382326 - DNA, 23 bp, Homo sapiens
ttcaatctcgtatagaagtcttc

SEQ ID NO: 2382327 - DNA, 18 bp, Homo sapiens
aaatgtaactgttaccat

SEQ ID NO: 2382328 - DNA, 16 bp, Homo sapiens
aaatgtgaattactaa

SEQ ID NO: 2382329 - DNA, 15 bp, Homo sapiens
aaatgtgtgtgatgt

SEQ ID NO: 2382330 - DNA, 18 bp, Homo sapiens
aaatgtgtgtgatgtgac

SEQ ID NO: 2382331 - DNA, 15 bp, Homo sapiens
aaatgttttcagcta

SEQ ID NO: 2382332 - DNA, 13 bp, Homo sapiens
aaatgttttgtaa

SEQ ID NO: 2382333 - DNA, 14 bp, Homo sapiens
aaatgttttgtaaa

SEQ ID NO: 2382334 - DNA, 20 bp, Homo sapiens
aaatgttttgtaaactttga

SEQ ID NO: 2382335 - DNA, 21 bp, Homo sapiens
aaatgttttgtaaactttgaa

SEQ ID NO: 2382336 - DNA, 17 bp, Homo sapiens
aaattatgctaagaatt

SEQ ID NO: 2382337 - DNA, 18 bp, Homo sapiens
aaattggtaccttgcaca

SEQ ID NO: 2382338 - DNA, 20 bp, Homo sapiens
aaattggtaccttgcacaca

SEQ ID NO: 2382339 - DNA, 23 bp, Homo sapiens
aaatttgaaacattgcttttaaa

SEQ ID NO: 2382340 - DNA, 15 bp, Homo sapiens
aaatttttcatattt

SEQ ID NO: 2382341 - DNA, 21 bp, Homo sapiens
aacaaactgcacatgatttca

SEQ ID NO: 2382342 - DNA, 24 bp, Homo sapiens
aacaaactgcacatgatttcacaa

SEQ ID NO: 2382343 - DNA, 14 bp, Homo sapiens
aacaaatcttcctg

SEQ ID NO: 2382344 - DNA, 16 bp, Homo sapiens
aacaagcatataaaat

SEQ ID NO: 2382345 - DNA, 17 bp, Homo sapiens
aacaagcatataaaatg

SEQ ID NO: 2382346 - DNA, 14 bp, Homo sapiens
aacaattttcagat

SEQ ID NO: 2382347 - DNA, 19 bp, Homo sapiens
aacaattttcagatttgca

SEQ ID NO: 2382348 - DNA, 14 bp, Homo sapiens
aacactaaatgtta

SEQ ID NO: 2382349 - DNA, 14 bp, Homo sapiens
aacattaatgttga

SEQ ID NO: 2382350 - DNA, 17 bp, Homo sapiens
aacattaatgttgattt

SEQ ID NO: 2382351 - DNA, 20 bp, Homo sapiens
aacattaatgttgatttcta

SEQ ID NO: 2382352 - DNA, 16 bp, Homo sapiens
aacattagtactttat

SEQ ID NO: 2382353 - DNA, 17 bp, Homo sapiens
aacattgcttttaaaac

SEQ ID NO: 2382354 - DNA, 19 bp, Homo sapiens
aacattgcttttaaaacta

SEQ ID NO: 2382355 - DNA, 22 bp, Homo sapiens
aacattggaagcaggttaaatg

SEQ ID NO: 2382356 - DNA, 22 bp, Homo sapiens
aaccaaggtagaatgaccttgt

SEQ ID NO: 2382357 - DNA, 17 bp, Homo sapiens
aaccacagtgtaccatt

SEQ ID NO: 2382358 - DNA, 23 bp, Homo sapiens
aaccagctctgggaaatttaata

SEQ ID NO: 2382359 - DNA, 13 bp, Homo sapiens
aactgaagttctg

SEQ ID NO: 2382360 - DNA, 16 bp, Homo sapiens
aactgcacatgatttc

SEQ ID NO: 2382361 - DNA, 19 bp, Homo sapiens
aactgctcttgggcaatat

SEQ ID NO: 2382362 - DNA, 13 bp, Homo sapiens
aactgtactttga

SEQ ID NO: 2382363 - DNA, 15 bp, Homo sapiens
aactgtactttgatt

SEQ ID NO: 2382364 - DNA, 23 bp, Homo sapiens
aactgttaccattggaaatttca

SEQ ID NO: 2382365 - DNA, 16 bp, Homo sapiens
aacttgcttaaatgtg

SEQ ID NO: 2382366 - DNA, 20 bp, Homo sapiens
aacttgcttaaatgtgaatt

SEQ ID NO: 2382367 - DNA, 16 bp, Homo sapiens
aacttgtttaataaag

SEQ ID NO: 2382368 - DNA, 16 bp, Homo sapiens
aacttttttttctttt

SEQ ID NO: 2382369 - DNA, 17 bp, Homo sapiens
aagaaacattggaagca

SEQ ID NO: 2382370 - DNA, 12 bp, Homo sapiens
aagaaagctttt

SEQ ID NO: 2382371 - DNA, 20 bp, Homo sapiens
aagaaatctatagaaagtgt

SEQ ID NO: 2382372 - DNA, 16 bp, Homo sapiens
aagaactatcttcatc

SEQ ID NO: 2382373 - DNA, 19 bp, Homo sapiens
aagaataggacttgttttt

SEQ ID NO: 2382374 - DNA, 21 bp, Homo sapiens
aagaataggacttgtttttgt

SEQ ID NO: 2382375 - DNA, 15 bp, Homo sapiens
aagaatgcatgcttt

SEQ ID NO: 2382376 - DNA, 12 bp, Homo sapiens
aagaattgaaga

SEQ ID NO: 2382377 - DNA, 14 bp, Homo sapiens
aagaattttttatt

SEQ ID NO: 2382378 - DNA, 22 bp, Homo sapiens
aagataagttggaaacactaaa

SEQ ID NO: 2382379 - DNA, 18 bp, Homo sapiens
aagatcggttaacaaata

SEQ ID NO: 2382380 - DNA, 23 bp, Homo sapiens
aagatgtagcaaaccctgtcaaa

SEQ ID NO: 2382381 - DNA, 16 bp, Homo sapiens
aagattaacttttcct

SEQ ID NO: 2382382 - DNA, 15 bp, Homo sapiens
aagattgtttatcta

SEQ ID NO: 2382383 - DNA, 20 bp, Homo sapiens
aagcaacaattttcagattt

SEQ ID NO: 2382384 - DNA, 22 bp, Homo sapiens
aagcaacaattttcagatttgc

SEQ ID NO: 2382385 - DNA, 15 bp, Homo sapiens
aagcagaattggaaa

SEQ ID NO: 2382386 - DNA, 21 bp, Homo sapiens
aagcagaattggaaaagacta

SEQ ID NO: 2382387 - DNA, 17 bp, Homo sapiens
aagcaggttaaatgttt

SEQ ID NO: 2382388 - DNA, 14 bp, Homo sapiens
aagcagtttcaata

SEQ ID NO: 2382389 - DNA, 22 bp, Homo sapiens
aagcagtttcaataaagtttga

SEQ ID NO: 2382390 - DNA, 20 bp, Homo sapiens
aagctgtttggttttaaaat

SEQ ID NO: 2382391 - DNA, 20 bp, Homo sapiens
aaggaccttcactctaagat

SEQ ID NO: 2382392 - DNA, 22 bp, Homo sapiens
aaggaccttcactctaagatgt

SEQ ID NO: 2382393 - DNA, 23 bp, Homo sapiens
aaggaccttcactctaagatgtt

SEQ ID NO: 2382394 - DNA, 24 bp, Homo sapiens
aaggaccttcactctaagatgtta

SEQ ID NO: 2382395 - DNA, 19 bp, Homo sapiens
aaggtagaatgaccttgta

SEQ ID NO: 2382396 - DNA, 22 bp, Homo sapiens
aaggtagaatgaccttgtaatg

SEQ ID NO: 2382397 - DNA, 16 bp, Homo sapiens
aagtactgagcagtga

SEQ ID NO: 2382398 - DNA, 19 bp, Homo sapiens
aagtcatgatgtttttaaa

SEQ ID NO: 2382399 - DNA, 22 bp, Homo sapiens
aagtcatgatgtttttaaaatc

SEQ ID NO: 2382400 - DNA, 23 bp, Homo sapiens
aagtcatgatgtttttaaaatct

SEQ ID NO: 2382401 - DNA, 16 bp, Homo sapiens
aagtctcttttttaca

SEQ ID NO: 2382402 - DNA, 22 bp, Homo sapiens
aagtcttcatgaaatgctatgt

SEQ ID NO: 2382403 - DNA, 10 bp, Homo sapiens
aagtgaaatt

SEQ ID NO: 2382404 - DNA, 11 bp, Homo sapiens
aagtgaaattt

SEQ ID NO: 2382405 - DNA, 12 bp, Homo sapiens
aagtgaaattta

SEQ ID NO: 2382406 - DNA, 20 bp, Homo sapiens
aagtgaaatttattgaggaa

SEQ ID NO: 2382407 - DNA, 16 bp, Homo sapiens
aagtgttctgttacaa

SEQ ID NO: 2382408 - DNA, 19 bp, Homo sapiens
aagtgttctgttacaaaat

SEQ ID NO: 2382409 - DNA, 16 bp, Homo sapiens
aagttagcctttatct

SEQ ID NO: 2382410 - DNA, 15 bp, Homo sapiens
aagttagtaggatat

SEQ ID NO: 2382411 - DNA, 15 bp, Homo sapiens
aagttctgcctctga

SEQ ID NO: 2382412 - DNA, 17 bp, Homo sapiens
aagttctgcctctgatg

SEQ ID NO: 2382413 - DNA, 22 bp, Homo sapiens
aagttggaaacactaaatgtta

SEQ ID NO: 2382414 - DNA, 21 bp, Homo sapiens
aagtttcaaaaatctgaagat

SEQ ID NO: 2382415 - DNA, 12 bp, Homo sapiens
aagtttgatctt

SEQ ID NO: 2382416 - DNA, 16 bp, Homo sapiens
aagttttgtgaaattt

SEQ ID NO: 2382417 - DNA, 14 bp, Homo sapiens
aataatctcattgg

SEQ ID NO: 2382418 - DNA, 15 bp, Homo sapiens
aataggacttgtttt

SEQ ID NO: 2382419 - DNA, 13 bp, Homo sapiens
aatagtaggcaag

SEQ ID NO: 2382420 - DNA, 22 bp, Homo sapiens
aatagtgttattgagagagatg

SEQ ID NO: 2382421 - DNA, 14 bp, Homo sapiens
aatatatagcattt

SEQ ID NO: 2382422 - DNA, 17 bp, Homo sapiens
aatatatggtctaatgt

SEQ ID NO: 2382423 - DNA, 13 bp, Homo sapiens
aatatattttgta

SEQ ID NO: 2382424 - DNA, 19 bp, Homo sapiens
aatatgtgaaggaccttca

SEQ ID NO: 2382425 - DNA, 16 bp, Homo sapiens
aatattaaaaagtctt

SEQ ID NO: 2382426 - DNA, 15 bp, Homo sapiens
aatattaatacagat

SEQ ID NO: 2382427 - DNA, 17 bp, Homo sapiens
aatattctctgtacata

SEQ ID NO: 2382428 - DNA, 21 bp, Homo sapiens
aatattctctgtacatattag

SEQ ID NO: 2382429 - DNA, 14 bp, Homo sapiens
aatctatagaaagt

SEQ ID NO: 2382430 - DNA, 17 bp, Homo sapiens
aatctatagaaagtgtt

SEQ ID NO: 2382431 - DNA, 19 bp, Homo sapiens
aatctcgtatagaagtctt

SEQ ID NO: 2382432 - DNA, 18 bp, Homo sapiens
aatctgaagattgtttat

SEQ ID NO: 2382433 - DNA, 13 bp, Homo sapiens
aatcttattaaag

SEQ ID NO: 2382434 - DNA, 21 bp, Homo sapiens
aatcttcctggtcgaaagtta

SEQ ID NO: 2382435 - DNA, 21 bp, Homo sapiens
aatcttggaacacctggcatg

SEQ ID NO: 2382436 - DNA, 13 bp, Homo sapiens
aatgaccttgtaa

SEQ ID NO: 2382437 - DNA, 14 bp, Homo sapiens
aatgaccttgtaat

SEQ ID NO: 2382438 - DNA, 16 bp, Homo sapiens
aatgaccttgtaatgt

SEQ ID NO: 2382439 - DNA, 19 bp, Homo sapiens
aatgaccttgtaatgtaac

SEQ ID NO: 2382440 - DNA, 18 bp, Homo sapiens
actcaagttgtctcttta

SEQ ID NO: 2382441 - DNA, 23 bp, Homo sapiens
actcactggggaacgttctcttt

SEQ ID NO: 2382442 - DNA, 22 bp, Homo sapiens
actcctagtaggggtaccactg

SEQ ID NO: 2382443 - DNA, 22 bp, Homo sapiens
actcctggactactttcattga

SEQ ID NO: 2382444 - DNA, 16 bp, Homo sapiens
actgaagcatgtgaaa

SEQ ID NO: 2382445 - DNA, 12 bp, Homo sapiens
actgaagtttga

SEQ ID NO: 2382446 - DNA, 15 bp, Homo sapiens
actgaagtttgataa

SEQ ID NO: 2382447 - DNA, 16 bp, Homo sapiens
actgagcagtgatatt

SEQ ID NO: 2382448 - DNA, 18 bp, Homo sapiens
actgcacatgatttcaca

SEQ ID NO: 2382449 - DNA, 20 bp, Homo sapiens
actgcacatgatttcacaaa

SEQ ID NO: 2382450 - DNA, 21 bp, Homo sapiens
actgcacatgatttcacaaat

SEQ ID NO: 2382451 - DNA, 23 bp, Homo sapiens
actgtactttgattcacatgttt

SEQ ID NO: 2382452 - DNA, 20 bp, Homo sapiens
acttaattgaagctttttaa

SEQ ID NO: 2382453 - DNA, 23 bp, Homo sapiens
acttagagctttttttttttaat

SEQ ID NO: 2382454 - DNA, 22 bp, Homo sapiens
acttagcacttcagggcagatt

SEQ ID NO: 2382455 - DNA, 18 bp, Homo sapiens
acttcagggcagatttta

SEQ ID NO: 2382456 - DNA, 20 bp, Homo sapiens
acttcagggcagattttagt

SEQ ID NO: 2382457 - DNA, 21 bp, Homo sapiens
acttcagggcagattttagtt

SEQ ID NO: 2382458 - DNA, 16 bp, Homo sapiens
acttctaaaactgtac

SEQ ID NO: 2382459 - DNA, 21 bp, Homo sapiens
acttctaaaactgtactttga

SEQ ID NO: 2382460 - DNA, 22 bp, Homo sapiens
acttctaaaactgtactttgat

SEQ ID NO: 2382461 - DNA, 22 bp, Homo sapiens
acttctattttccttaatcaaa

SEQ ID NO: 2382462 - DNA, 23 bp, Homo sapiens
acttctgttttcaatctcgtata

SEQ ID NO: 2382463 - DNA, 14 bp, Homo sapiens
acttgcttaaatgt

SEQ ID NO: 2382464 - DNA, 16 bp, Homo sapiens
acttgcttaaatgtga

SEQ ID NO: 2382465 - DNA, 12 bp, Homo sapiens
actttctgcctt

SEQ ID NO: 2382466 - DNA, 17 bp, Homo sapiens
actttgattcacatgtt

SEQ ID NO: 2382467 - DNA, 16 bp, Homo sapiens
actttgtctaagaaac

SEQ ID NO: 2382468 - DNA, 16 bp, Homo sapiens
acttttccagtatttt

SEQ ID NO: 2382469 - DNA, 18 bp, Homo sapiens
acttttccttgcatacaa

SEQ ID NO: 2382470 - DNA, 23 bp, Homo sapiens
agaaagtgttctgttacaaaatg

SEQ ID NO: 2382471 - DNA, 14 bp, Homo sapiens
agaaattggtacct

SEQ ID NO: 2382472 - DNA, 20 bp, Homo sapiens
agaaattggtaccttgcaca

SEQ ID NO: 2382473 - DNA, 22 bp, Homo sapiens
agaaattggtaccttgcacaca

SEQ ID NO: 2382474 - DNA, 17 bp, Homo sapiens
agaactatcttcatctg

SEQ ID NO: 2382475 - DNA, 19 bp, Homo sapiens
agaactatcttcatctgag

SEQ ID NO: 2382476 - DNA, 15 bp, Homo sapiens
agaagaatgcatgct

SEQ ID NO: 2382477 - DNA, 19 bp, Homo sapiens
agaagtcttcatgaaatgc

SEQ ID NO: 2382478 - DNA, 14 bp, Homo sapiens
agaatgaccttgta

SEQ ID NO: 2382479 - DNA, 15 bp, Homo sapiens
agaatgaccttgtaa

SEQ ID NO: 2382480 - DNA, 16 bp, Homo sapiens
agaatgaccttgtaat

SEQ ID NO: 2382481 - DNA, 16 bp, Homo sapiens
agaatgcatgctttcc

SEQ ID NO: 2382482 - DNA, 18 bp, Homo sapiens
agacaggagaagaaagaa

SEQ ID NO: 2382483 - DNA, 24 bp, Homo sapiens
agacctgagatgaagattcatgtt

SEQ ID NO: 2382484 - DNA, 21 bp, Homo sapiens
agactaagatcggttaacaaa

SEQ ID NO: 2382485 - DNA, 22 bp, Homo sapiens
agactaagatcggttaacaaat

SEQ ID NO: 2382486 - DNA, 14 bp, Homo sapiens
agagagatgtgtaa

SEQ ID NO: 2382487 - DNA, 19 bp, Homo sapiens
agagagatgtgtaattttt

SEQ ID NO: 2382488 - DNA, 17 bp, Homo sapiens
agagaggctaaaatgtt

SEQ ID NO: 2382489 - DNA, 18 bp, Homo sapiens
agagatgtgtaatttttc

SEQ ID NO: 2382490 - DNA, 14 bp, Homo sapiens
agaggctaaaatgt

SEQ ID NO: 2382491 - DNA, 18 bp, Homo sapiens
agagttcagggaagataa

SEQ ID NO: 2382492 - DNA, 14 bp, Homo sapiens
agataagttggaaa

SEQ ID NO: 2382493 - DNA, 21 bp, Homo sapiens
agataagttggaaacactaaa

SEQ ID NO: 2382494 - DNA, 20 bp, Homo sapiens
agataggaaggtcatttcca

SEQ ID NO: 2382495 - DNA, 18 bp, Homo sapiens
agatcggttaacaaataa

SEQ ID NO: 2382496 - DNA, 14 bp, Homo sapiens
agatctttttgtct

SEQ ID NO: 2382497 - DNA, 16 bp, Homo sapiens
agatggcacagggcat

SEQ ID NO: 2382498 - DNA, 23 bp, Homo sapiens
agatggcacagggcatgaaatga

SEQ ID NO: 2382499 - DNA, 22 bp, Homo sapiens
agatgtagcaaaccctgtcaaa

SEQ ID NO: 2382500 - DNA, 16 bp, Homo sapiens
agatgtgtaatttttc

SEQ ID NO: 2382501 - DNA, 17 bp, Homo sapiens
agatgttatatttttct

SEQ ID NO: 2382502 - DNA, 16 bp, Homo sapiens
agatgttctgtagcaa

SEQ ID NO: 2382503 - DNA, 22 bp, Homo sapiens
agattggattttatgttgacat

SEQ ID NO: 2382504 - DNA, 14 bp, Homo sapiens
agatttgcacaaaa

SEQ ID NO: 2382505 - DNA, 15 bp, Homo sapiens
agatttgcacaaaaa

SEQ ID NO: 2382506 - DNA, 13 bp, Homo sapiens
agattttagtttt

SEQ ID NO: 2382507 - DNA, 23 bp, Homo sapiens
agattttagttttattttctaaa

SEQ ID NO: 2382508 - DNA, 15 bp, Homo sapiens
agcaaaaaaagttgt

SEQ ID NO: 2382509 - DNA, 20 bp, Homo sapiens
agcaaaaaaagttgtatgat

SEQ ID NO: 2382510 - DNA, 20 bp, Homo sapiens
agcaaaccctgtcaaacatt

SEQ ID NO: 2382511 - DNA, 21 bp, Homo sapiens
agcaaagttgggcagagaaat

SEQ ID NO: 2382512 - DNA, 14 bp, Homo sapiens
agcagaattggaaa

SEQ ID NO: 2382513 - DNA, 12 bp, Homo sapiens
agcagtttcaat

SEQ ID NO: 2382514 - DNA, 15 bp, Homo sapiens
agcagtttcaataaa

SEQ ID NO: 2382515 - DNA, 21 bp, Homo sapiens
agcagtttcaataaagtttga

SEQ ID NO: 2382516 - DNA, 12 bp, Homo sapiens
agcatttgatat

SEQ ID NO: 2382517 - DNA, 16 bp, Homo sapiens
agctaggaacaaatct

SEQ ID NO: 2382518 - DNA, 14 bp, Homo sapiens
aggaaggtcatttc

SEQ ID NO: 2382519 - DNA, 16 bp, Homo sapiens
aggaaggtcatttcca

SEQ ID NO: 2382520 - DNA, 20 bp, Homo sapiens
aggaatattatatttggatg

SEQ ID NO: 2382521 - DNA, 14 bp, Homo sapiens
aggatatgcctgct

SEQ ID NO: 2382522 - DNA, 12 bp, Homo sapiens
aggctaaaatgt

SEQ ID NO: 2382523 - DNA, 15 bp, Homo sapiens
aggctaaaatgtttt

SEQ ID NO: 2382524 - DNA, 23 bp, Homo sapiens
aggcttatgggttaataaatgaa

SEQ ID NO: 2382525 - DNA, 21 bp, Homo sapiens
agggaagataagttggaaaca

SEQ ID NO: 2382526 - DNA, 17 bp, Homo sapiens
agggactaaatttgtaa

SEQ ID NO: 2382527 - DNA, 16 bp, Homo sapiens
agggcagattttagtt

SEQ ID NO: 2382528 - DNA, 19 bp, Homo sapiens
aggggtaccactgaatctg

SEQ ID NO: 2382529 - DNA, 15 bp, Homo sapiens
aggtatattatagaa

SEQ ID NO: 2382530 - DNA, 17 bp, Homo sapiens
aggttaaatgttttgta

SEQ ID NO: 2382531 - DNA, 18 bp, Homo sapiens
aggttaaatgttttgtaa

SEQ ID NO: 2382532 - DNA, 23 bp, Homo sapiens
aggttaggcagtataaagaatag

SEQ ID NO: 2382533 - DNA, 16 bp, Homo sapiens
agtacaggtactttgt

SEQ ID NO: 2382534 - DNA, 17 bp, Homo sapiens
agtacaggtactttgtc

SEQ ID NO: 2382535 - DNA, 13 bp, Homo sapiens
agtacattctcag

SEQ ID NO: 2382536 - DNA, 23 bp, Homo sapiens
agtactgagcagtgatattcttt

SEQ ID NO: 2382537 - DNA, 18 bp, Homo sapiens
agtactttatagaagaat

SEQ ID NO: 2382538 - DNA, 20 bp, Homo sapiens
agtaggggtaccactgaatc

SEQ ID NO: 2382539 - DNA, 16 bp, Homo sapiens
agtattaattctcttt

SEQ ID NO: 2382540 - DNA, 16 bp, Homo sapiens
agtattgccaaacatt

SEQ ID NO: 2382541 - DNA, 22 bp, Homo sapiens
agtattgccaaacattaatgtt

SEQ ID NO: 2382542 - DNA, 13 bp, Homo sapiens
agtatttgaaaac

SEQ ID NO: 2382543 - DNA, 21 bp, Homo sapiens
agtatttgaaaacagaaattg

SEQ ID NO: 2382544 - DNA, 12 bp, Homo sapiens
agtattttagtg

SEQ ID NO: 2382545 - DNA, 21 bp, Homo sapiens
agtattttagtggaccctgaa

SEQ ID NO: 2382546 - DNA, 17 bp, Homo sapiens
agtcatgatgtttttaa

SEQ ID NO: 2382547 - DNA, 22 bp, Homo sapiens
agtcatgatgtttttaaaatct

SEQ ID NO: 2382548 - DNA, 21 bp, Homo sapiens
agtctcttttttacaaaggct

SEQ ID NO: 2382549 - DNA, 14 bp, Homo sapiens
agtcttcatgaaat

SEQ ID NO: 2382550 - DNA, 15 bp, Homo sapiens
agtcttcatgaaatg

SEQ ID NO: 2382551 - DNA, 11 bp, Homo sapiens
agtcttttaaa

SEQ ID NO: 2382552 - DNA, 15 bp, Homo sapiens
ctgctcttgggcaat

SEQ ID NO: 2382553 - DNA, 14 bp, Homo sapiens
ctgggaatgtatag

SEQ ID NO: 2382554 - DNA, 19 bp, Homo sapiens
ctggtgtttcagcatacat

SEQ ID NO: 2382555 - DNA, 12 bp, Homo sapiens
ctgtactttgat

SEQ ID NO: 2382556 - DNA, 15 bp, Homo sapiens
ctgtactttgattca

SEQ ID NO: 2382557 - DNA, 24 bp, Homo sapiens
ctgtactttgattcacatgttttc

SEQ ID NO: 2382558 - DNA, 17 bp, Homo sapiens
ctgtagataattaacca

SEQ ID NO: 2382559 - DNA, 12 bp, Homo sapiens
ctgtcaaacatt

SEQ ID NO: 2382560 - DNA, 23 bp, Homo sapiens
ctgtcaaacattagtactttata

SEQ ID NO: 2382561 - DNA, 20 bp, Homo sapiens
ctgtgtcagtttatgttttg

SEQ ID NO: 2382562 - DNA, 11 bp, Homo sapiens
ctgttacaaaa

SEQ ID NO: 2382563 - DNA, 15 bp, Homo sapiens
ctgttacaaaatgta

SEQ ID NO: 2382564 - DNA, 18 bp, Homo sapiens
ctgttacaaaatgtaact

SEQ ID NO: 2382565 - DNA, 19 bp, Homo sapiens
ctgttacaaaatgtaactg

SEQ ID NO: 2382566 - DNA, 22 bp, Homo sapiens
ctgttaccattggaaatttcac

SEQ ID NO: 2382567 - DNA, 17 bp, Homo sapiens
ctgtttggttttaaaat

SEQ ID NO: 2382568 - DNA, 21 bp, Homo sapiens
ctgtttggttttaaaatactg

SEQ ID NO: 2382569 - DNA, 13 bp, Homo sapiens
cttaaaatttgaa

SEQ ID NO: 2382570 - DNA, 15 bp, Homo sapiens
cttaaaatttgaaac

SEQ ID NO: 2382571 - DNA, 13 bp, Homo sapiens
cttaaatgtgaat

SEQ ID NO: 2382572 - DNA, 16 bp, Homo sapiens
cttaaatgtgaattac

SEQ ID NO: 2382573 - DNA, 17 bp, Homo sapiens
cttaaatgtgaattact

SEQ ID NO: 2382574 - DNA, 19 bp, Homo sapiens
cttaaatgtgaattactaa

SEQ ID NO: 2382575 - DNA, 20 bp, Homo sapiens
cttaatatatagcatttatg

SEQ ID NO: 2382576 - DNA, 18 bp, Homo sapiens
cttacaaatgattgcttt

SEQ ID NO: 2382577 - DNA, 20 bp, Homo sapiens
cttacaaatgattgctttta

SEQ ID NO: 2382578 - DNA, 21 bp, Homo sapiens
cttacaaatgattgcttttaa

SEQ ID NO: 2382579 - DNA, 22 bp, Homo sapiens
cttacaaatgattgcttttaaa

SEQ ID NO: 2382580 - DNA, 19 bp, Homo sapiens
cttacataaacatcaggtt

SEQ ID NO: 2382581 - DNA, 20 bp, Homo sapiens
cttacatagctcaaatattg

SEQ ID NO: 2382582 - DNA, 13 bp, Homo sapiens
cttattaaagttt

SEQ ID NO: 2382583 - DNA, 23 bp, Homo sapiens
cttattaaagtttcaaaaatctg

SEQ ID NO: 2382584 - DNA, 17 bp, Homo sapiens
cttcactctaagatgtt

SEQ ID NO: 2382585 - DNA, 17 bp, Homo sapiens
cttcagggcagatttta

SEQ ID NO: 2382586 - DNA, 22 bp, Homo sapiens
cttcagggcagattttagtttt

SEQ ID NO: 2382587 - DNA, 12 bp, Homo sapiens
cttcatgaaatg

SEQ ID NO: 2382588 - DNA, 14 bp, Homo sapiens
cttcatgaaatgct

SEQ ID NO: 2382589 - DNA, 14 bp, Homo sapiens
cttcctctgctaaa

SEQ ID NO: 2382590 - DNA, 13 bp, Homo sapiens
cttctgttttcaa

SEQ ID NO: 2382591 - DNA, 13 bp, Homo sapiens
cttcttgaaatcc

SEQ ID NO: 2382592 - DNA, 14 bp, Homo sapiens
cttgcacacatcat

SEQ ID NO: 2382593 - DNA, 13 bp, Homo sapiens
cttgcttaaatgt

SEQ ID NO: 2382594 - DNA, 22 bp, Homo sapiens
cttgggcaatattctctgtaca

SEQ ID NO: 2382595 - DNA, 20 bp, Homo sapiens
ctttatctaccaactttcaa

SEQ ID NO: 2382596 - DNA, 16 bp, Homo sapiens
ctttcaagaacttgtt

SEQ ID NO: 2382597 - DNA, 17 bp, Homo sapiens
ctttcaagaacttgttt

SEQ ID NO: 2382598 - DNA, 13 bp, Homo sapiens
ctttgaattttca

SEQ ID NO: 2382599 - DNA, 15 bp, Homo sapiens
ctttgaattttcatt

SEQ ID NO: 2382600 - DNA, 21 bp, Homo sapiens
ctttgaattttcattttacag

SEQ ID NO: 2382601 - DNA, 17 bp, Homo sapiens
ctttgattcacatgttt

SEQ ID NO: 2382602 - DNA, 17 bp, Homo sapiens
ctttgtctaagaaacat

SEQ ID NO: 2382603 - DNA, 19 bp, Homo sapiens
ctttgtctaagaaacattg

SEQ ID NO: 2382604 - DNA, 20 bp, Homo sapiens
ctttgtctaagaaacattgg

SEQ ID NO: 2382605 - DNA, 15 bp, Homo sapiens
ctttgttaatttgga

SEQ ID NO: 2382606 - DNA, 14 bp, Homo sapiens
cttttccagtattt

SEQ ID NO: 2382607 - DNA, 18 bp, Homo sapiens
cttttgttttttgaagtg

SEQ ID NO: 2382608 - DNA, 12 bp, Homo sapiens
gaaaaatatgtg

SEQ ID NO: 2382609 - DNA, 15 bp, Homo sapiens
gaaaaatatgtgaag

SEQ ID NO: 2382610 - DNA, 16 bp, Homo sapiens
gaaaaatatgtgaagg

SEQ ID NO: 2382611 - DNA, 20 bp, Homo sapiens
gaaaacagaaattggtacct

SEQ ID NO: 2382612 - DNA, 13 bp, Homo sapiens
gaaaagaaatcta

SEQ ID NO: 2382613 - DNA, 22 bp, Homo sapiens
gaaaagaaatctatagaaagtg

SEQ ID NO: 2382614 - DNA, 15 bp, Homo sapiens
gaaacactaaatgtt

SEQ ID NO: 2382615 - DNA, 18 bp, Homo sapiens
gaaacactaaatgttaaa

SEQ ID NO: 2382616 - DNA, 19 bp, Homo sapiens
gaaacactaaatgttaaag

SEQ ID NO: 2382617 - DNA, 20 bp, Homo sapiens
gaaacagttttattttccat

SEQ ID NO: 2382618 - DNA, 16 bp, Homo sapiens
gaaagaactatcttca

SEQ ID NO: 2382619 - DNA, 13 bp, Homo sapiens
gaaagtgttctgt

SEQ ID NO: 2382620 - DNA, 17 bp, Homo sapiens
gaaagtgttctgttaca

SEQ ID NO: 2382621 - DNA, 19 bp, Homo sapiens
gaaagtgttctgttacaaa

SEQ ID NO: 2382622 - DNA, 22 bp, Homo sapiens
gaaatatatggtctaatgttta

SEQ ID NO: 2382623 - DNA, 23 bp, Homo sapiens
gaaatatatggtctaatgtttaa

SEQ ID NO: 2382624 - DNA, 14 bp, Homo sapiens
gaaatctatagaaa

SEQ ID NO: 2382625 - DNA, 15 bp, Homo sapiens
gaaatgaacacaaat

SEQ ID NO: 2382626 - DNA, 17 bp, Homo sapiens
gaaatgctatgtcattt

SEQ ID NO: 2382627 - DNA, 21 bp, Homo sapiens
gaaatgctatgtcatttcatg

SEQ ID NO: 2382628 - DNA, 22 bp, Homo sapiens
gaaatgctatgtcatttcatgt

SEQ ID NO: 2382629 - DNA, 13 bp, Homo sapiens
gaaatgtgtgtga

SEQ ID NO: 2382630 - DNA, 19 bp, Homo sapiens
gaaatgtgtgtgatgtgac

SEQ ID NO: 2382631 - DNA, 14 bp, Homo sapiens
gaaattatctgcct

SEQ ID NO: 2382632 - DNA, 20 bp, Homo sapiens
gaaattggtaccttgcacac

SEQ ID NO: 2382633 - DNA, 13 bp, Homo sapiens
gaacaaatcttcc

SEQ ID NO: 2382634 - DNA, 14 bp, Homo sapiens
gaactatcttcatc

SEQ ID NO: 2382635 - DNA, 20 bp, Homo sapiens
gaagaaagaactatcttcat

SEQ ID NO: 2382636 - DNA, 14 bp, Homo sapiens
gaagaatgcatgct

SEQ ID NO: 2382637 - DNA, 15 bp, Homo sapiens
gaagattcatgttta

SEQ ID NO: 2382638 - DNA, 16 bp, Homo sapiens
gaagcaggttaaatgt

SEQ ID NO: 2382639 - DNA, 14 bp, Homo sapiens
gaaggtcatttcca

SEQ ID NO: 2382640 - DNA, 16 bp, Homo sapiens
gaagtttgataaatag

SEQ ID NO: 2382641 - DNA, 13 bp, Homo sapiens
gaatattatattt

SEQ ID NO: 2382642 - DNA, 19 bp, Homo sapiens
gaatattatatttggatgc

SEQ ID NO: 2382643 - DNA, 24 bp, Homo sapiens
gaatattatatttggatgcagagt

SEQ ID NO: 2382644 - DNA, 16 bp, Homo sapiens
gaatgaccttgtaatg

SEQ ID NO: 2382645 - DNA, 19 bp, Homo sapiens
gaatgaccttgtaatgtaa

SEQ ID NO: 2382646 - DNA, 14 bp, Homo sapiens
gaattttcatttta

SEQ ID NO: 2382647 - DNA, 17 bp, Homo sapiens
gacaaatagtaggcaag

SEQ ID NO: 2382648 - DNA, 13 bp, Homo sapiens
gacatttgtttgg

SEQ ID NO: 2382649 - DNA, 14 bp, Homo sapiens
gacctgagatgaag

SEQ ID NO: 2382650 - DNA, 19 bp, Homo sapiens
gaccttcactctaagatgt

SEQ ID NO: 2382651 - DNA, 20 bp, Homo sapiens
gaccttcactctaagatgtt

SEQ ID NO: 2382652 - DNA, 23 bp, Homo sapiens
gactaagatcggttaacaaataa

SEQ ID NO: 2382653 - DNA, 16 bp, Homo sapiens
gacttctgttttcaat

SEQ ID NO: 2382654 - DNA, 17 bp, Homo sapiens
gacttctgttttcaatc

SEQ ID NO: 2382655 - DNA, 15 bp, Homo sapiens
gagagagatgtgtaa

SEQ ID NO: 2382656 - DNA, 19 bp, Homo sapiens
gagagaggctaaaatgttt

SEQ ID NO: 2382657 - DNA, 21 bp, Homo sapiens
gagaggctaaaatgttttcag

SEQ ID NO: 2382658 - DNA, 17 bp, Homo sapiens
gagatgtgtaatttttc

SEQ ID NO: 2382659 - DNA, 20 bp, Homo sapiens
gagcagtgatattctttgtt

SEQ ID NO: 2382660 - DNA, 15 bp, Homo sapiens
gagttcattcatatt

SEQ ID NO: 2382661 - DNA, 16 bp, Homo sapiens
gagttcattcatatta

SEQ ID NO: 2382662 - DNA, 14 bp, Homo sapiens
gagtttgtttcttt

SEQ ID NO: 2382663 - DNA, 19 bp, Homo sapiens
gataagttggaaacactaa

SEQ ID NO: 2382664 - DNA, 14 bp, Homo sapiens
gataccttaaaatt

SEQ ID NO: 2382665 - DNA, 17 bp, Homo sapiens
gataccttaaaatttga

SEQ ID NO: 2382666 - DNA, 23 bp, Homo sapiens
gtattgccaaacattaatgttga

SEQ ID NO: 2382667 - DNA, 24 bp, Homo sapiens
gtattgccaaacattaatgttgat

SEQ ID NO: 2382668 - DNA, 13 bp, Homo sapiens
gtatttattttaa

SEQ ID NO: 2382669 - DNA, 16 bp, Homo sapiens
gtatttgaaaacagaa

SEQ ID NO: 2382670 - DNA, 23 bp, Homo sapiens
gtattttagtggaccctgaaatg

SEQ ID NO: 2382671 - DNA, 15 bp, Homo sapiens
gtcataggaagttag

SEQ ID NO: 2382672 - DNA, 20 bp, Homo sapiens
gtcatgatgtttttaaaatc

SEQ ID NO: 2382673 - DNA, 22 bp, Homo sapiens
gtcatgatgtttttaaaatctt

SEQ ID NO: 2382674 - DNA, 18 bp, Homo sapiens
gtcatttccatgtatgca

SEQ ID NO: 2382675 - DNA, 22 bp, Homo sapiens
gtcatttccatgtatgcataat

SEQ ID NO: 2382676 - DNA, 15 bp, Homo sapiens
gtccacttttccagt

SEQ ID NO: 2382677 - DNA, 19 bp, Homo sapiens
gtccacttttccagtattt

SEQ ID NO: 2382678 - DNA, 14 bp, Homo sapiens
gtctaagaaacatt

SEQ ID NO: 2382679 - DNA, 19 bp, Homo sapiens
gtctaagaaacattggaag

SEQ ID NO: 2382680 - DNA, 15 bp, Homo sapiens
gtctaatgtttaagc

SEQ ID NO: 2382681 - DNA, 16 bp, Homo sapiens
gtctcttttttacaaa

SEQ ID NO: 2382682 - DNA, 18 bp, Homo sapiens
gtctcttttttacaaagg

SEQ ID NO: 2382683 - DNA, 15 bp, Homo sapiens
gtcttcatgaaatgc

SEQ ID NO: 2382684 - DNA, 15 bp, Homo sapiens
gtcttttaaaaagta

SEQ ID NO: 2382685 - DNA, 17 bp, Homo sapiens
gtcttttaaaaagtatt

SEQ ID NO: 2382686 - DNA, 19 bp, Homo sapiens
gtgaattactaacttctaa

SEQ ID NO: 2382687 - DNA, 17 bp, Homo sapiens
gtgacatttgtcatttt

SEQ ID NO: 2382688 - DNA, 19 bp, Homo sapiens
gtgacatttgtcattttca

SEQ ID NO: 2382689 - DNA, 14 bp, Homo sapiens
gtgactattgttta

SEQ ID NO: 2382690 - DNA, 17 bp, Homo sapiens
gtgagtttgtttctttg

SEQ ID NO: 2382691 - DNA, 23 bp, Homo sapiens
gtgatattctttgttaatttgga

SEQ ID NO: 2382692 - DNA, 19 bp, Homo sapiens
gtgtcagtttatgttttgg

SEQ ID NO: 2382693 - DNA, 22 bp, Homo sapiens
gtgtgctaaacgtgtatgtttt

SEQ ID NO: 2382694 - DNA, 15 bp, Homo sapiens
gtgtgtgatgtgaca

SEQ ID NO: 2382695 - DNA, 13 bp, Homo sapiens
gtgttctgttaca

SEQ ID NO: 2382696 - DNA, 18 bp, Homo sapiens
gttaaatgttttgtaaac

SEQ ID NO: 2382697 - DNA, 23 bp, Homo sapiens
gttaaatgttttgtaaactttga

SEQ ID NO: 2382698 - DNA, 12 bp, Homo sapiens
gttaatttggac

SEQ ID NO: 2382699 - DNA, 13 bp, Homo sapiens
gttacaaaatgta

SEQ ID NO: 2382700 - DNA, 21 bp, Homo sapiens
gttacaaaatgtaactgttac

SEQ ID NO: 2382701 - DNA, 19 bp, Homo sapiens
gttaccattggaaatttca

SEQ ID NO: 2382702 - DNA, 14 bp, Homo sapiens
gttacttttccttg

SEQ ID NO: 2382703 - DNA, 14 bp, Homo sapiens
gttaggcagtataa

SEQ ID NO: 2382704 - DNA, 15 bp, Homo sapiens
gttatagtgcaatat

SEQ ID NO: 2382705 - DNA, 18 bp, Homo sapiens
gttcaaagtcatgatgtt

SEQ ID NO: 2382706 - DNA, 19 bp, Homo sapiens
gttcaaagtcatgatgttt

SEQ ID NO: 2382707 - DNA, 23 bp, Homo sapiens
gttcagggaagataagttggaaa

SEQ ID NO: 2382708 - DNA, 16 bp, Homo sapiens
gttcattcatattaca

SEQ ID NO: 2382709 - DNA, 18 bp, Homo sapiens
gttctgttacaaaatgta

SEQ ID NO: 2382710 - DNA, 20 bp, Homo sapiens
gttctgttacaaaatgtaac

SEQ ID NO: 2382711 - DNA, 12 bp, Homo sapiens
gttgatgcaatc

SEQ ID NO: 2382712 - DNA, 24 bp, Homo sapiens
gttgatgcaatccttacaaatgat

SEQ ID NO: 2382713 - DNA, 15 bp, Homo sapiens
gttgcactgaagttt

SEQ ID NO: 2382714 - DNA, 15 bp, Homo sapiens
gttggaaacactaaa

SEQ ID NO: 2382715 - DNA, 20 bp, Homo sapiens
gttggaaacactaaatgtta

SEQ ID NO: 2382716 - DNA, 22 bp, Homo sapiens
gtttaataaagcgaaaaactca

SEQ ID NO: 2382717 - DNA, 17 bp, Homo sapiens
gtttatctagatgtaaa

SEQ ID NO: 2382718 - DNA, 13 bp, Homo sapiens
gtttcaaaaatct

SEQ ID NO: 2382719 - DNA, 16 bp, Homo sapiens
gtttcaaaaatctgaa

SEQ ID NO: 2382720 - DNA, 12 bp, Homo sapiens
gtttcaataaag

SEQ ID NO: 2382721 - DNA, 17 bp, Homo sapiens
gtttctttgaattttca

SEQ ID NO: 2382722 - DNA, 13 bp, Homo sapiens
gtttgatcttcct

SEQ ID NO: 2382723 - DNA, 16 bp, Homo sapiens
gtttggttttaaaata

SEQ ID NO: 2382724 - DNA, 17 bp, Homo sapiens
gtttggttttaaaatac

SEQ ID NO: 2382725 - DNA, 16 bp, Homo sapiens
gtttgtttctttgaat

SEQ ID NO: 2382726 - DNA, 18 bp, Homo sapiens
gttttaaaatactgtaga

SEQ ID NO: 2382727 - DNA, 20 bp, Homo sapiens
gttttattttctaaagtact

SEQ ID NO: 2382728 - DNA, 14 bp, Homo sapiens
gttttcaaatggag

SEQ ID NO: 2382729 - DNA, 18 bp, Homo sapiens
gttttgtaaactttgaaa

SEQ ID NO: 2382730 - DNA, 13 bp, Homo sapiens
gttttgttttttg

SEQ ID NO: 2382731 - DNA, 16 bp, Homo sapiens
gttttgttttttgagt

SEQ ID NO: 2382732 - DNA, 15 bp, Homo sapiens
gtttttaaaatctta

SEQ ID NO: 2382733 - DNA, 16 bp, Homo sapiens
gtttttcttaatatat

SEQ ID NO: 2382734 - DNA, 9 bp, Homo sapiens
gttttttga

SEQ ID NO: 2382735 - DNA, 14 bp, Homo sapiens
taaaaactgaagtt

SEQ ID NO: 2382736 - DNA, 15 bp, Homo sapiens
taaaaactgaagttc

SEQ ID NO: 2382737 - DNA, 13 bp, Homo sapiens
taaaaagtattgc

SEQ ID NO: 2382738 - DNA, 20 bp, Homo sapiens
taaaaagtattgccaaacat

SEQ ID NO: 2382739 - DNA, 16 bp, Homo sapiens
taaaactgtactttga

SEQ ID NO: 2382740 - DNA, 19 bp, Homo sapiens
taaaactgtactttgattc

SEQ ID NO: 2382741 - DNA, 20 bp, Homo sapiens
taaaactgtactttgattca

SEQ ID NO: 2382742 - DNA, 12 bp, Homo sapiens
taaaatactgta

SEQ ID NO: 2382743 - DNA, 19 bp, Homo sapiens
taaaatatgcactaagtct

SEQ ID NO: 2382744 - DNA, 21 bp, Homo sapiens
taaaatcttattaaagtttca

SEQ ID NO: 2382745 - DNA, 16 bp, Homo sapiens
taaaatggcaacaaac

SEQ ID NO: 2382746 - DNA, 22 bp, Homo sapiens
taaaatggcaacaaactgcaca

SEQ ID NO: 2382747 - DNA, 12 bp, Homo sapiens
taaaatgttttc

SEQ ID NO: 2382748 - DNA, 14 bp, Homo sapiens
taaaatttgaaaca

SEQ ID NO: 2382749 - DNA, 21 bp, Homo sapiens
taaaatttgaaacattgcttt

SEQ ID NO: 2382750 - DNA, 21 bp, Homo sapiens
taaacatcaggttaggcagta

SEQ ID NO: 2382751 - DNA, 23 bp, Homo sapiens
taaacgtgtatgtttttcagttc

SEQ ID NO: 2382752 - DNA, 15 bp, Homo sapiens
taaactttgaaatat

SEQ ID NO: 2382753 - DNA, 15 bp, Homo sapiens
taaagaataggactt

SEQ ID NO: 2382754 - DNA, 17 bp, Homo sapiens
taaagcgaaaaactcaa

SEQ ID NO: 2382755 - DNA, 18 bp, Homo sapiens
taaatattccttatttaa

SEQ ID NO: 2382756 - DNA, 13 bp, Homo sapiens
taaatgaattcat

SEQ ID NO: 2382757 - DNA, 11 bp, Homo sapiens
taaatgtgaat

SEQ ID NO: 2382758 - DNA, 15 bp, Homo sapiens
taaatgtgaattact

SEQ ID NO: 2382759 - DNA, 14 bp, Homo sapiens
taaatgttaaagat

SEQ ID NO: 2382760 - DNA, 21 bp, Homo sapiens
taaatgttaaagatgtagcaa

SEQ ID NO: 2382761 - DNA, 11 bp, Homo sapiens
taaatgttttg

SEQ ID NO: 2382762 - DNA, 14 bp, Homo sapiens
taaattgatgttga

SEQ ID NO: 2382763 - DNA, 20 bp, Homo sapiens
taaattgatgttgatgcaat

SEQ ID NO: 2382764 - DNA, 21 bp, Homo sapiens
taactcctagtaggggtacca

SEQ ID NO: 2382765 - DNA, 12 bp, Homo sapiens
taactgctcttg

SEQ ID NO: 2382766 - DNA, 13 bp, Homo sapiens
taactgttaccat

SEQ ID NO: 2382767 - DNA, 19 bp, Homo sapiens
taactgttaccattggaaa

SEQ ID NO: 2382768 - DNA, 17 bp, Homo sapiens
taacttagagctttttt

SEQ ID NO: 2382769 - DNA, 18 bp, Homo sapiens
taacttctaaaactgtac

SEQ ID NO: 2382770 - DNA, 20 bp, Homo sapiens
taacttctaaaactgtactt

SEQ ID NO: 2382771 - DNA, 23 bp, Homo sapiens
taacttctaaaactgtactttga

SEQ ID NO: 2382772 - DNA, 20 bp, Homo sapiens
taacttgcttaaatgtgaat

SEQ ID NO: 2382773 - DNA, 13 bp, Homo sapiens
taagaaacattgg

SEQ ID NO: 2382774 - DNA, 15 bp, Homo sapiens
taagaaacattggaa

SEQ ID NO: 2382775 - DNA, 12 bp, Homo sapiens
taagaattgaag

SEQ ID NO: 2382776 - DNA, 15 bp, Homo sapiens
taagactgtgtctgt

SEQ ID NO: 2382777 - DNA, 19 bp, Homo sapiens
taagactgtgtctgtattg

SEQ ID NO: 2382778 - DNA, 16 bp, Homo sapiens
taagatcggttaacaa

SEQ ID NO: 2382779 - DNA, 14 bp, Homo sapiens
taagatgttatatt

SEQ ID NO: 2382780 - DNA, 16 bp, Homo sapiens
tctgccccaagttttg

SEQ ID NO: 2382781 - DNA, 14 bp, Homo sapiens
tctgccttatacat

SEQ ID NO: 2382782 - DNA, 22 bp, Homo sapiens
tctgtaagctgtttggttttaa

SEQ ID NO: 2382783 - DNA, 12 bp, Homo sapiens
tctgtacatatt

SEQ ID NO: 2382784 - DNA, 23 bp, Homo sapiens
tctgtatagacaggagaagaaag

SEQ ID NO: 2382785 - DNA, 12 bp, Homo sapiens
tcttaaaaagta

SEQ ID NO: 2382786 - DNA, 15 bp, Homo sapiens
tcttattaaagtttc

SEQ ID NO: 2382787 - DNA, 16 bp, Homo sapiens
tcttattaaagtttca

SEQ ID NO: 2382788 - DNA, 17 bp, Homo sapiens
tcttattaaagtttcaa

SEQ ID NO: 2382789 - DNA, 20 bp, Homo sapiens
tcttattaaagtttcaaaaa

SEQ ID NO: 2382790 - DNA, 21 bp, Homo sapiens
tcttattaaagtttcaaaaat

SEQ ID NO: 2382791 - DNA, 19 bp, Homo sapiens
tcttattccatattagaaa

SEQ ID NO: 2382792 - DNA, 17 bp, Homo sapiens
tcttattgttcgtttaa

SEQ ID NO: 2382793 - DNA, 13 bp, Homo sapiens
tcttcatgaaatg

SEQ ID NO: 2382794 - DNA, 18 bp, Homo sapiens
tcttctagcatatctttc

SEQ ID NO: 2382795 - DNA, 17 bp, Homo sapiens
tcttgggcaatattctc

SEQ ID NO: 2382796 - DNA, 24 bp, Homo sapiens
tcttgggcaatattctctgtacat

SEQ ID NO: 2382797 - DNA, 17 bp, Homo sapiens
tcttttaaaaagtattg

SEQ ID NO: 2382798 - DNA, 13 bp, Homo sapiens
tcttttttacaaa

SEQ ID NO: 2382799 - DNA, 19 bp, Homo sapiens
tcttttttttttaagtgaa

SEQ ID NO: 2382800 - DNA, 18 bp, Homo sapiens
tgaaaacagaaattggta

SEQ ID NO: 2382801 - DNA, 21 bp, Homo sapiens
tgaaaacagaaattggtacct

SEQ ID NO: 2382802 - DNA, 21 bp, Homo sapiens
tgaaacattgcttttaaaact

SEQ ID NO: 2382803 - DNA, 20 bp, Homo sapiens
tgaaatgctatgtcatttca

SEQ ID NO: 2382804 - DNA, 22 bp, Homo sapiens
tgaaatgctatgtcatttcatg

SEQ ID NO: 2382805 - DNA, 12 bp, Homo sapiens
tgaaatgtgtgt

SEQ ID NO: 2382806 - DNA, 20 bp, Homo sapiens
tgaaatgtgtgtgatgtgac

SEQ ID NO: 2382807 - DNA, 15 bp, Homo sapiens
tgaaatttattgagg

SEQ ID NO: 2382808 - DNA, 17 bp, Homo sapiens
tgaaatttattgaggaa

SEQ ID NO: 2382809 - DNA, 16 bp, Homo sapiens
tgaaatttttcatatt

SEQ ID NO: 2382810 - DNA, 21 bp, Homo sapiens
tgaaatttttcatattttaat

SEQ ID NO: 2382811 - DNA, 12 bp, Homo sapiens
tgaacacaaatt

SEQ ID NO: 2382812 - DNA, 17 bp, Homo sapiens
tgaagataggtttagca

SEQ ID NO: 2382813 - DNA, 24 bp, Homo sapiens
tgaagattgtttatctagatgtaa

SEQ ID NO: 2382814 - DNA, 10 bp, Homo sapiens
tgaagtgttg

SEQ ID NO: 2382815 - DNA, 12 bp, Homo sapiens
tgaagttatatt

SEQ ID NO: 2382816 - DNA, 21 bp, Homo sapiens
tgaagttctgcctctgatgta

SEQ ID NO: 2382817 - DNA, 14 bp, Homo sapiens
tgaagtttgataaa

SEQ ID NO: 2382818 - DNA, 15 bp, Homo sapiens
tgaagtttgataaat

SEQ ID NO: 2382819 - DNA, 16 bp, Homo sapiens
tgaattactaacttct

SEQ ID NO: 2382820 - DNA, 18 bp, Homo sapiens
tgaattactaacttctaa

SEQ ID NO: 2382821 - DNA, 20 bp, Homo sapiens
tgaattactaacttctaaaa

SEQ ID NO: 2382822 - DNA, 11 bp, Homo sapiens
tgaattttcat

SEQ ID NO: 2382823 - DNA, 17 bp, Homo sapiens
tgaattttcattttaca

SEQ ID NO: 2382824 - DNA, 22 bp, Homo sapiens
tgacatttgtttggttatagtg

SEQ ID NO: 2382825 - DNA, 18 bp, Homo sapiens
tgaccttgtaatgtaact

SEQ ID NO: 2382826 - DNA, 19 bp, Homo sapiens
tgagagaggctaaaatgtt

SEQ ID NO: 2382827 - DNA, 21 bp, Homo sapiens
tgagagaggctaaaatgtttt

SEQ ID NO: 2382828 - DNA, 13 bp, Homo sapiens
tgagatgaagatt

SEQ ID NO: 2382829 - DNA, 22 bp, Homo sapiens
tgagcagtgatattctttgtta

SEQ ID NO: 2382830 - DNA, 12 bp, Homo sapiens
tgagtctttttt

SEQ ID NO: 2382831 - DNA, 22 bp, Homo sapiens
tgagtcttttttttttaagtga

SEQ ID NO: 2382832 - DNA, 19 bp, Homo sapiens
tgagtttgtttctttgaat

SEQ ID NO: 2382833 - DNA, 15 bp, Homo sapiens
tgataataaatgtat

SEQ ID NO: 2382834 - DNA, 18 bp, Homo sapiens
tgatcttcctctgctaaa

SEQ ID NO: 2382835 - DNA, 18 bp, Homo sapiens
tgatgaccaattttaact

SEQ ID NO: 2382836 - DNA, 14 bp, Homo sapiens
tgatgtgacatttg

SEQ ID NO: 2382837 - DNA, 14 bp, Homo sapiens
tgatgttgatgcaa

SEQ ID NO: 2382838 - DNA, 15 bp, Homo sapiens
tgatgtttttaaaat

SEQ ID NO: 2382839 - DNA, 14 bp, Homo sapiens
tgattcacatgttt

SEQ ID NO: 2382840 - DNA, 15 bp, Homo sapiens
tgattcacatgtttt

SEQ ID NO: 2382841 - DNA, 16 bp, Homo sapiens
tgattcacatgttttc

SEQ ID NO: 2382842 - DNA, 19 bp, Homo sapiens
tgattcacatgttttcaaa

SEQ ID NO: 2382843 - DNA, 14 bp, Homo sapiens
tgattgcttttaaa

SEQ ID NO: 2382844 - DNA, 16 bp, Homo sapiens
tgattgcttttaaaat

SEQ ID NO: 2382845 - DNA, 19 bp, Homo sapiens
tgattgcttttaaaatttt

SEQ ID NO: 2382846 - DNA, 20 bp, Homo sapiens
tgatttcacaaatattaaaa

SEQ ID NO: 2382847 - DNA, 17 bp, Homo sapiens
tgcaaagtacaggtact

SEQ ID NO: 2382848 - DNA, 17 bp, Homo sapiens
tgcaagcagtttcaata

SEQ ID NO: 2382849 - DNA, 21 bp, Homo sapiens
tgcaatatattttgtatgcaa

SEQ ID NO: 2382850 - DNA, 12 bp, Homo sapiens
tgcaatccttac

SEQ ID NO: 2382851 - DNA, 21 bp, Homo sapiens
tgcacacatcatctgtaagct

SEQ ID NO: 2382852 - DNA, 15 bp, Homo sapiens
tgcacatgatttcac

SEQ ID NO: 2382853 - DNA, 16 bp, Homo sapiens
tgcactgaagtttgat

SEQ ID NO: 2382854 - DNA, 19 bp, Homo sapiens
tgcataattctgaagttat

SEQ ID NO: 2382855 - DNA, 13 bp, Homo sapiens
tgcatacaaacaa

SEQ ID NO: 2382856 - DNA, 22 bp, Homo sapiens
tgcatacaaacaagcatataaa

SEQ ID NO: 2382857 - DNA, 14 bp, Homo sapiens
tgcatgctttccat

SEQ ID NO: 2382858 - DNA, 18 bp, Homo sapiens
tgcatgctttccatattt

SEQ ID NO: 2382859 - DNA, 22 bp, Homo sapiens
tgccccaagttttgtgaaattt

SEQ ID NO: 2382860 - DNA, 12 bp, Homo sapiens
tgcctgctcttt

SEQ ID NO: 2382861 - DNA, 21 bp, Homo sapiens
tgccttaaggtatattataga

SEQ ID NO: 2382862 - DNA, 19 bp, Homo sapiens
tgctaaacgtgtatgtttt

SEQ ID NO: 2382863 - DNA, 22 bp, Homo sapiens
tgctaaacgtgtatgtttttca

SEQ ID NO: 2382864 - DNA, 23 bp, Homo sapiens
tgctaaacgtgtatgtttttcag

SEQ ID NO: 2382865 - DNA, 16 bp, Homo sapiens
tgctaaattgatgttg

SEQ ID NO: 2382866 - DNA, 20 bp, Homo sapiens
tgctaagaattttttatttt

SEQ ID NO: 2382867 - DNA, 15 bp, Homo sapiens
tgctatgtcatttca

SEQ ID NO: 2382868 - DNA, 23 bp, Homo sapiens
tgctctttggcctgatgaccaat

SEQ ID NO: 2382869 - DNA, 23 bp, Homo sapiens
tgctgtagtgttgtctttgataa

SEQ ID NO: 2382870 - DNA, 13 bp, Homo sapiens
tgcttaaatgtga

SEQ ID NO: 2382871 - DNA, 14 bp, Homo sapiens
tgcttaaatgtgaa

SEQ ID NO: 2382872 - DNA, 16 bp, Homo sapiens
tgcttaaatgtgaatt

SEQ ID NO: 2382873 - DNA, 20 bp, Homo sapiens
tgcttaaatgtgaattacta

SEQ ID NO: 2382874 - DNA, 14 bp, Homo sapiens
tgctttccatattt

SEQ ID NO: 2382875 - DNA, 21 bp, Homo sapiens
tgctttccatatttttttcct

SEQ ID NO: 2382876 - DNA, 10 bp, Homo sapiens
tgcttttaaa

SEQ ID NO: 2382877 - DNA, 17 bp, Homo sapiens
tgcttttaaaattttaa

SEQ ID NO: 2382878 - DNA, 19 bp, Homo sapiens
tgcttttaaaattttaagc

SEQ ID NO: 2382879 - DNA, 17 bp, Homo sapiens
tggaaacactaaatgtt

SEQ ID NO: 2382880 - DNA, 19 bp, Homo sapiens
tggaaacactaaatgttaa

SEQ ID NO: 2382881 - DNA, 18 bp, Homo sapiens
tggagttcattcatatta

SEQ ID NO: 2382882 - DNA, 20 bp, Homo sapiens
tggagttcattcatattaca

SEQ ID NO: 2382883 - DNA, 11 bp, Homo sapiens
tggagttggag

SEQ ID NO: 2382884 - DNA, 16 bp, Homo sapiens
tggagttggagttcat

SEQ ID NO: 2382885 - DNA, 15 bp, Homo sapiens
tggcaacaaactgca

SEQ ID NO: 2382886 - DNA, 22 bp, Homo sapiens
tggccataagcaacaattttca

SEQ ID NO: 2382887 - DNA, 15 bp, Homo sapiens
tggctgtatgtctga

SEQ ID NO: 2382888 - DNA, 17 bp, Homo sapiens
tgggcaatattctctgt

SEQ ID NO: 2382889 - DNA, 20 bp, Homo sapiens
tgggcaatattctctgtaca

SEQ ID NO: 2382890 - DNA, 21 bp, Homo sapiens
tgggcaatattctctgtacat

SEQ ID NO: 2382891 - DNA, 18 bp, Homo sapiens
tgggtagaggggtgcttt

SEQ ID NO: 2382892 - DNA, 14 bp, Homo sapiens
tggtaatcatatta

SEQ ID NO: 2382893 - DNA, 13 bp, Homo sapiens
ttgcactgaagtt

SEQ ID NO: 2382894 - DNA, 16 bp, Homo sapiens
ttgcactgaagtttga

SEQ ID NO: 2382895 - DNA, 16 bp, Homo sapiens
ttgctgtcaaggaaga

SEQ ID NO: 2382896 - DNA, 17 bp, Homo sapiens
ttgcttaaatgtgaatt

SEQ ID NO: 2382897 - DNA, 24 bp, Homo sapiens
ttgcttaaatgtgaattactaact

SEQ ID NO: 2382898 - DNA, 18 bp, Homo sapiens
ttgcttttaaaattttaa

SEQ ID NO: 2382899 - DNA, 19 bp, Homo sapiens
ttggaaacactaaatgtta

SEQ ID NO: 2382900 - DNA, 20 bp, Homo sapiens
ttggaagcaggttaaatgtt

SEQ ID NO: 2382901 - DNA, 19 bp, Homo sapiens
ttggagttcattcatatta

SEQ ID NO: 2382902 - DNA, 21 bp, Homo sapiens
ttggagttcattcatattaca

SEQ ID NO: 2382903 - DNA, 24 bp, Homo sapiens
ttggattttatgttgacatttgtt

SEQ ID NO: 2382904 - DNA, 20 bp, Homo sapiens
ttgggaaattatctgcctta

SEQ ID NO: 2382905 - DNA, 19 bp, Homo sapiens
ttgggcaatattctctgta

SEQ ID NO: 2382906 - DNA, 21 bp, Homo sapiens
ttgggcaatattctctgtaca

SEQ ID NO: 2382907 - DNA, 17 bp, Homo sapiens
ttggtccacttttccag

SEQ ID NO: 2382908 - DNA, 23 bp, Homo sapiens
ttggttatagtgcaatatatttt

SEQ ID NO: 2382909 - DNA, 13 bp, Homo sapiens
ttggttttaaaat

SEQ ID NO: 2382910 - DNA, 12 bp, Homo sapiens
ttgtaaactttg

SEQ ID NO: 2382911 - DNA, 14 bp, Homo sapiens
ttgtaaactttgaa

SEQ ID NO: 2382912 - DNA, 15 bp, Homo sapiens
ttgtaaactttgaaa

SEQ ID NO: 2382913 - DNA, 17 bp, Homo sapiens
ttgtaaactttgaaata

SEQ ID NO: 2382914 - DNA, 18 bp, Homo sapiens
ttgtaaactttgaaatat

SEQ ID NO: 2382915 - DNA, 20 bp, Homo sapiens
ttgtaatgtaactgctcttg

SEQ ID NO: 2382916 - DNA, 13 bp, Homo sapiens
ttgtatgatctgt

SEQ ID NO: 2382917 - DNA, 20 bp, Homo sapiens
ttgtatgcaagcagtttcaa

SEQ ID NO: 2382918 - DNA, 22 bp, Homo sapiens
ttgtatgcaagcagtttcaata

SEQ ID NO: 2382919 - DNA, 13 bp, Homo sapiens
ttgtcattttcat

SEQ ID NO: 2382920 - DNA, 14 bp, Homo sapiens
ttgtgaaatttttc

SEQ ID NO: 2382921 - DNA, 15 bp, Homo sapiens
ttgtgaaatttttca

SEQ ID NO: 2382922 - DNA, 19 bp, Homo sapiens
ttgtgaaatttttcatatt

SEQ ID NO: 2382923 - DNA, 23 bp, Homo sapiens
ttgtgaaatttttcatattttaa

SEQ ID NO: 2382924 - DNA, 14 bp, Homo sapiens
ttgtgagtttgttt

SEQ ID NO: 2382925 - DNA, 16 bp, Homo sapiens
ttgtgagtttgtttct

SEQ ID NO: 2382926 - DNA, 21 bp, Homo sapiens
ttgtgtgctaaacgtgtatgt

SEQ ID NO: 2382927 - DNA, 22 bp, Homo sapiens
ttgttaggccaaagacaaatag

SEQ ID NO: 2382928 - DNA, 22 bp, Homo sapiens
ttgttgatccccacactgcctt

SEQ ID NO: 2382929 - DNA, 14 bp, Homo sapiens
ttgttgcactgaag

SEQ ID NO: 2382930 - DNA, 16 bp, Homo sapiens
ttgttttttgaagtgt

SEQ ID NO: 2382931 - DNA, 17 bp, Homo sapiens
ttgttttttgaagtgtt

SEQ ID NO: 2382932 - DNA, 20 bp, Homo sapiens
tttaaaaagtattgccaaac

SEQ ID NO: 2382933 - DNA, 16 bp, Homo sapiens
tttaaaatactgtaga

SEQ ID NO: 2382934 - DNA, 18 bp, Homo sapiens
tttaaaatactgtagata

SEQ ID NO: 2382935 - DNA, 16 bp, Homo sapiens
tttaaaatcttattaa

SEQ ID NO: 2382936 - DNA, 17 bp, Homo sapiens
tttaagcagaattggaa

SEQ ID NO: 2382937 - DNA, 14 bp, Homo sapiens
tttaagtgaaattt

SEQ ID NO: 2382938 - DNA, 21 bp, Homo sapiens
tttaataaagcgaaaaactca

SEQ ID NO: 2382939 - DNA, 20 bp, Homo sapiens
tttaatgcagaaaaggaaga

SEQ ID NO: 2382940 - DNA, 23 bp, Homo sapiens
tttaatttcaagcttattttgga

SEQ ID NO: 2382941 - DNA, 15 bp, Homo sapiens
tttacagttactttt

SEQ ID NO: 2382942 - DNA, 17 bp, Homo sapiens
tttagttttattttcta

SEQ ID NO: 2382943 - DNA, 14 bp, Homo sapiens
tttatatcttggca

SEQ ID NO: 2382944 - DNA, 14 bp, Homo sapiens
tttatatttggatg

SEQ ID NO: 2382945 - DNA, 21 bp, Homo sapiens
tttatctaccaactttcaaga

SEQ ID NO: 2382946 - DNA, 18 bp, Homo sapiens
tttatggtaatcatatta

SEQ ID NO: 2382947 - DNA, 13 bp, Homo sapiens
tttattttttggt

SEQ ID NO: 2382948 - DNA, 18 bp, Homo sapiens
tttcaagcttattttgga

SEQ ID NO: 2382949 - DNA, 13 bp, Homo sapiens
tttcaataaagtt

SEQ ID NO: 2382950 - DNA, 13 bp, Homo sapiens
tttcaatctcgta

SEQ ID NO: 2382951 - DNA, 19 bp, Homo sapiens
tttcaatctcgtatagaag

SEQ ID NO: 2382952 - DNA, 12 bp, Homo sapiens
tttcacaaatat

SEQ ID NO: 2382953 - DNA, 16 bp, Homo sapiens
tttcacaaatattaaa

SEQ ID NO: 2382954 - DNA, 22 bp, Homo sapiens
tttcacaaatattaaaaagtct

SEQ ID NO: 2382955 - DNA, 15 bp, Homo sapiens
tttcagatttgcaca

SEQ ID NO: 2382956 - DNA, 17 bp, Homo sapiens
tttcagatttgcacaaa

SEQ ID NO: 2382957 - DNA, 15 bp, Homo sapiens
tttcagcatacataa

SEQ ID NO: 2382958 - DNA, 15 bp, Homo sapiens
tttcagctaggaaca

SEQ ID NO: 2382959 - DNA, 21 bp, Homo sapiens
tttcagctaggaacaaatctt

SEQ ID NO: 2382960 - DNA, 17 bp, Homo sapiens
tttcagttcaaagtcat

SEQ ID NO: 2382961 - DNA, 17 bp, Homo sapiens
tttcatgtcctgtgtca

SEQ ID NO: 2382962 - DNA, 12 bp, Homo sapiens
tttcattagcaa

SEQ ID NO: 2382963 - DNA, 16 bp, Homo sapiens
tttcattagcaaaaaa

SEQ ID NO: 2382964 - DNA, 19 bp, Homo sapiens
tttcattagcaaaaaaagt

SEQ ID NO: 2382965 - DNA, 21 bp, Homo sapiens
tttcattagcaaaaaaagttg

SEQ ID NO: 2382966 - DNA, 23 bp, Homo sapiens
tttcattagcaaaaaaagttgta

SEQ ID NO: 2382967 - DNA, 15 bp, Homo sapiens
tttccagtattttag

SEQ ID NO: 2382968 - DNA, 19 bp, Homo sapiens
tttccatatttttttcctt

SEQ ID NO: 2382969 - DNA, 14 bp, Homo sapiens
tttccatgtatgca

SEQ ID NO: 2382970 - DNA, 15 bp, Homo sapiens
tttccatgtatgcat

SEQ ID NO: 2382971 - DNA, 20 bp, Homo sapiens
tttccatgtatgcataataa

SEQ ID NO: 2382972 - DNA, 14 bp, Homo sapiens
tttcctataccatt

SEQ ID NO: 2382973 - DNA, 18 bp, Homo sapiens
tttccttacataaacatc

SEQ ID NO: 2382974 - DNA, 16 bp, Homo sapiens
tttccttgcatacaaa

SEQ ID NO: 2382975 - DNA, 14 bp, Homo sapiens
tttctgtatagaca

SEQ ID NO: 2382976 - DNA, 20 bp, Homo sapiens
tttcttaatatatagcattt

SEQ ID NO: 2382977 - DNA, 16 bp, Homo sapiens
tttctttgaattttca

SEQ ID NO: 2382978 - DNA, 21 bp, Homo sapiens
tttcttttgttttttgaagtg

SEQ ID NO: 2382979 - DNA, 16 bp, Homo sapiens
tttgaaaacagaaatt

SEQ ID NO: 2382980 - DNA, 13 bp, Homo sapiens
tttgaaacattgc

SEQ ID NO: 2382981 - DNA, 23 bp, Homo sapiens
tttgaaacattgcttttaaaact

SEQ ID NO: 2382982 - DNA, 12 bp, Homo sapiens
tttgagtctttt

SEQ ID NO: 2382983 - DNA, 22 bp, Homo sapiens
tttgagtcttttttttttaagt

SEQ ID NO: 2382984 - DNA, 18 bp, Homo sapiens
tttgatcttcctctgcta

SEQ ID NO: 2382985 - DNA, 18 bp, Homo sapiens
tttggtccacttttccag

SEQ ID NO: 2382986 - DNA, 18 bp, Homo sapiens
tttggttatagtgcaata

SEQ ID NO: 2382987 - DNA, 21 bp, Homo sapiens
tttggttatagtgcaatatat

SEQ ID NO: 2382988 - DNA, 12 bp, Homo sapiens
tttggttttgtt

SEQ ID NO: 2382989 - DNA, 15 bp, Homo sapiens
tttgtcattttcatt

SEQ ID NO: 2382990 - DNA, 13 bp, Homo sapiens
tttgtctaagaaa

SEQ ID NO: 2382991 - DNA, 20 bp, Homo sapiens
tttgtctaagaaacattgga

SEQ ID NO: 2382992 - DNA, 12 bp, Homo sapiens
tttgtgaaattt

SEQ ID NO: 2382993 - DNA, 20 bp, Homo sapiens
tttgtgaaatttttcatatt

SEQ ID NO: 2382994 - DNA, 21 bp, Homo sapiens
tttgtgaaatttttcatattt

SEQ ID NO: 2382995 - DNA, 16 bp, Homo sapiens
tttgtgagtttgtttc

SEQ ID NO: 2382996 - DNA, 15 bp, Homo sapiens
tttgttatagttgaa

SEQ ID NO: 2382997 - DNA, 17 bp, Homo sapiens
tttgttgcactgaagtt

SEQ ID NO: 2382998 - DNA, 23 bp, Homo sapiens
tttgttgcactgaagtttgataa

SEQ ID NO: 2382999 - DNA, 16 bp, Homo sapiens
tttgttttttgagtct

SEQ ID NO: 2383000 - DNA, 19 bp, Homo sapiens
tttgttttttgagtctttt

SEQ ID NO: 2383001 - DNA, 14 bp, Homo sapiens
ttttaaaaagtatt

SEQ ID NO: 2383002 - DNA, 20 bp, Homo sapiens
ttttaaaactacttagcact

SEQ ID NO: 2383003 - DNA, 15 bp, Homo sapiens
ttttaaaaggattga

SEQ ID NO: 2383004 - DNA, 12 bp, Homo sapiens
ttttaaaatctt

SEQ ID NO: 2383005 - DNA, 16 bp, Homo sapiens
ttttaagtgaaattta

SEQ ID NO: 2383006 - DNA, 21 bp, Homo sapiens
aaatgctatgtcatttcatgt

SEQ ID NO: 2383007 - DNA, 18 bp, Homo sapiens
aaatggcaacaaactgca

SEQ ID NO: 2383008 - DNA, 23 bp, Homo sapiens
aaatgtgtgtgatgtgacatttg

SEQ ID NO: 2383009 - DNA, 14 bp, Homo sapiens
aaatgttttcagct

SEQ ID NO: 2383010 - DNA, 18 bp, Homo sapiens
aaatgttttcagctagga

SEQ ID NO: 2383011 - DNA, 16 bp, Homo sapiens
aaatgttttgtaaact

SEQ ID NO: 2383012 - DNA, 23 bp, Homo sapiens
aaattagtttgttatagttgaag

SEQ ID NO: 2383013 - DNA, 14 bp, Homo sapiens
aaattgatgttgat

SEQ ID NO: 2383014 - DNA, 18 bp, Homo sapiens
aaattgatgttgatgcaa

SEQ ID NO: 2383015 - DNA, 12 bp, Homo sapiens
aaattggatttg

SEQ ID NO: 2383016 - DNA, 16 bp, Homo sapiens
aaatttattgaggaaa

SEQ ID NO: 2383017 - DNA, 20 bp, Homo sapiens
aaatttattgaggaaaaata

SEQ ID NO: 2383018 - DNA, 14 bp, Homo sapiens
aaatttttcatatt

SEQ ID NO: 2383019 - DNA, 16 bp, Homo sapiens
aaatttttcatatttt

SEQ ID NO: 2383020 - DNA, 14 bp, Homo sapiens
aacaaactgcacat

SEQ ID NO: 2383021 - DNA, 22 bp, Homo sapiens
aacaaactgcacatgatttcac

SEQ ID NO: 2383022 - DNA, 13 bp, Homo sapiens
aacaaatcttcct

SEQ ID NO: 2383023 - DNA, 17 bp, Homo sapiens
aacaattttcagatttg

SEQ ID NO: 2383024 - DNA, 21 bp, Homo sapiens
aacaattttcagatttgcaca

SEQ ID NO: 2383025 - DNA, 22 bp, Homo sapiens
aacaattttcagatttgcacaa

SEQ ID NO: 2383026 - DNA, 21 bp, Homo sapiens
aacacaaattatgctaagaat

SEQ ID NO: 2383027 - DNA, 13 bp, Homo sapiens
aacactaaatgtt

SEQ ID NO: 2383028 - DNA, 19 bp, Homo sapiens
aacactaaatgttaaagat

SEQ ID NO: 2383029 - DNA, 21 bp, Homo sapiens
aacactaaatgttaaagatgt

SEQ ID NO: 2383030 - DNA, 13 bp, Homo sapiens
aacagaaattggt

SEQ ID NO: 2383031 - DNA, 18 bp, Homo sapiens
aacagattggattttatg

SEQ ID NO: 2383032 - DNA, 23 bp, Homo sapiens
aacagattggattttatgttgac

SEQ ID NO: 2383033 - DNA, 24 bp, Homo sapiens
aacagattggattttatgttgaca

SEQ ID NO: 2383034 - DNA, 12 bp, Homo sapiens
aacattaatgtt

SEQ ID NO: 2383035 - DNA, 15 bp, Homo sapiens
aacattaatgttgat

SEQ ID NO: 2383036 - DNA, 17 bp, Homo sapiens
aacattagtactttata

SEQ ID NO: 2383037 - DNA, 24 bp, Homo sapiens
aacattagtactttatagaagaat

SEQ ID NO: 2383038 - DNA, 12 bp, Homo sapiens
aacattggaagc

SEQ ID NO: 2383039 - DNA, 16 bp, Homo sapiens
aacattggaagcaggt

SEQ ID NO: 2383040 - DNA, 23 bp, Homo sapiens
aacattggaagcaggttaaatgt

SEQ ID NO: 2383041 - DNA, 17 bp, Homo sapiens
aaccctgtcaaacatta

SEQ ID NO: 2383042 - DNA, 23 bp, Homo sapiens
aaccctgtcaaacattagtactt

SEQ ID NO: 2383043 - DNA, 22 bp, Homo sapiens
aacgtgtatgtttttcagttca

SEQ ID NO: 2383044 - DNA, 13 bp, Homo sapiens
aactatcttcatc

SEQ ID NO: 2383045 - DNA, 19 bp, Homo sapiens
aactcaaccaaatggtaca

SEQ ID NO: 2383046 - DNA, 16 bp, Homo sapiens
aactgattttttaaga

SEQ ID NO: 2383047 - DNA, 18 bp, Homo sapiens
aactgcacatgatttcac

SEQ ID NO: 2383048 - DNA, 20 bp, Homo sapiens
aactgcacatgatttcacaa

SEQ ID NO: 2383049 - DNA, 21 bp, Homo sapiens
aactgcacatgatttcacaaa

SEQ ID NO: 2383050 - DNA, 23 bp, Homo sapiens
aactgcacatgatttcacaaata

SEQ ID NO: 2383051 - DNA, 20 bp, Homo sapiens
aactgctcttgggcaatatt

SEQ ID NO: 2383052 - DNA, 17 bp, Homo sapiens
aactgtactttgattca

SEQ ID NO: 2383053 - DNA, 18 bp, Homo sapiens
aactgtactttgattcac

SEQ ID NO: 2383054 - DNA, 19 bp, Homo sapiens
aactgtactttgattcaca

SEQ ID NO: 2383055 - DNA, 20 bp, Homo sapiens
aactgtactttgattcacat

SEQ ID NO: 2383056 - DNA, 15 bp, Homo sapiens
aacttagagcttttt

SEQ ID NO: 2383057 - DNA, 15 bp, Homo sapiens
aacttctaaaactgt

SEQ ID NO: 2383058 - DNA, 16 bp, Homo sapiens
aacttctaaaactgta

SEQ ID NO: 2383059 - DNA, 23 bp, Homo sapiens
aacttctaaaactgtactttgat

SEQ ID NO: 2383060 - DNA, 15 bp, Homo sapiens
aacttgcttaaatgt

SEQ ID NO: 2383061 - DNA, 17 bp, Homo sapiens
aacttgcttaaatgtga

SEQ ID NO: 2383062 - DNA, 18 bp, Homo sapiens
aacttgcttaaatgtgaa

SEQ ID NO: 2383063 - DNA, 21 bp, Homo sapiens
aacttgcttaaatgtgaatta

SEQ ID NO: 2383064 - DNA, 19 bp, Homo sapiens
aactttcaagaacttgttt

SEQ ID NO: 2383065 - DNA, 21 bp, Homo sapiens
aactttcaagaacttgtttaa

SEQ ID NO: 2383066 - DNA, 18 bp, Homo sapiens
aacttttttttctttttt

SEQ ID NO: 2383067 - DNA, 11 bp, Homo sapiens
aagaaacattg

SEQ ID NO: 2383068 - DNA, 16 bp, Homo sapiens
aagaaagcttttaaaa

SEQ ID NO: 2383069 - DNA, 14 bp, Homo sapiens
aagaaatctataga

SEQ ID NO: 2383070 - DNA, 18 bp, Homo sapiens
aagaacttgtttaataaa

SEQ ID NO: 2383071 - DNA, 13 bp, Homo sapiens
aagaataggactt

SEQ ID NO: 2383072 - DNA, 17 bp, Homo sapiens
aagaataggacttgttt

SEQ ID NO: 2383073 - DNA, 20 bp, Homo sapiens
aagaatgcatgctttccata

SEQ ID NO: 2383074 - DNA, 16 bp, Homo sapiens
aagaattttttatttt

SEQ ID NO: 2383075 - DNA, 13 bp, Homo sapiens
aagacaaatagta

SEQ ID NO: 2383076 - DNA, 16 bp, Homo sapiens
aagataagttggaaac

SEQ ID NO: 2383077 - DNA, 17 bp, Homo sapiens
aagataccttaaaattt

SEQ ID NO: 2383078 - DNA, 18 bp, Homo sapiens
aagataccttaaaatttg

SEQ ID NO: 2383079 - DNA, 19 bp, Homo sapiens
aagataccttaaaatttga

SEQ ID NO: 2383080 - DNA, 20 bp, Homo sapiens
aagataccttaaaatttgaa

SEQ ID NO: 2383081 - DNA, 21 bp, Homo sapiens
aagataccttaaaatttgaaa

SEQ ID NO: 2383082 - DNA, 14 bp, Homo sapiens
aagatgttatattt

SEQ ID NO: 2383083 - DNA, 22 bp, Homo sapiens
aagatgttatatttttcttaaa

SEQ ID NO: 2383084 - DNA, 19 bp, Homo sapiens
aagattgtttatctagatg

SEQ ID NO: 2383085 - DNA, 22 bp, Homo sapiens
aagattgtttatctagatgtaa

SEQ ID NO: 2383086 - DNA, 19 bp, Homo sapiens
aagcagaattggaaaagac

SEQ ID NO: 2383087 - DNA, 20 bp, Homo sapiens
aagcaggttaaatgttttgt

SEQ ID NO: 2383088 - DNA, 20 bp, Homo sapiens
aagcagtttcaataaagttt

SEQ ID NO: 2383089 - DNA, 14 bp, Homo sapiens
aagcatataaaatg

SEQ ID NO: 2383090 - DNA, 16 bp, Homo sapiens
aagcatataaaatggc

SEQ ID NO: 2383091 - DNA, 19 bp, Homo sapiens
aagctaggaaaagaaatct

SEQ ID NO: 2383092 - DNA, 19 bp, Homo sapiens
aagctgtttggttttaaaa

SEQ ID NO: 2383093 - DNA, 21 bp, Homo sapiens
aagctgtttggttttaaaata

SEQ ID NO: 2383094 - DNA, 16 bp, Homo sapiens
aagcttattttggaga

SEQ ID NO: 2383095 - DNA, 18 bp, Homo sapiens
aaggcgctaacttgctta

SEQ ID NO: 2383096 - DNA, 12 bp, Homo sapiens
aaggctgtattc

SEQ ID NO: 2383097 - DNA, 17 bp, Homo sapiens
aaggctgtattcagcaa

SEQ ID NO: 2383098 - DNA, 19 bp, Homo sapiens
aagggggaatattttaaaa

SEQ ID NO: 2383099 - DNA, 13 bp, Homo sapiens
aaggtagaatgac

SEQ ID NO: 2383100 - DNA, 20 bp, Homo sapiens
aaggtagaatgaccttgtaa

SEQ ID NO: 2383101 - DNA, 14 bp, Homo sapiens
aaggtcatttccat

SEQ ID NO: 2383102 - DNA, 20 bp, Homo sapiens
aaggtcatttccatgtatgc

SEQ ID NO: 2383103 - DNA, 18 bp, Homo sapiens
aagtacaggtactttgtc

SEQ ID NO: 2383104 - DNA, 23 bp, Homo sapiens
aagtactgagcagtgatattctt

SEQ ID NO: 2383105 - DNA, 17 bp, Homo sapiens
aagtattaattctcttt

SEQ ID NO: 2383106 - DNA, 13 bp, Homo sapiens
aagtattgccaaa

SEQ ID NO: 2383107 - DNA, 18 bp, Homo sapiens
aagtcatgatgtttttaa

SEQ ID NO: 2383108 - DNA, 21 bp, Homo sapiens
aagtcatgatgtttttaaaat

SEQ ID NO: 2383109 - DNA, 14 bp, Homo sapiens
aagtctctttttta

SEQ ID NO: 2383110 - DNA, 15 bp, Homo sapiens
aagtctcttttttac

SEQ ID NO: 2383111 - DNA, 18 bp, Homo sapiens
aagtctcttttttacaaa

SEQ ID NO: 2383112 - DNA, 13 bp, Homo sapiens
aagtcttcatgaa

SEQ ID NO: 2383113 - DNA, 16 bp, Homo sapiens
aagtcttcatgaaatg

SEQ ID NO: 2383114 - DNA, 18 bp, Homo sapiens
aagtcttcatgaaatgct

SEQ ID NO: 2383115 - DNA, 19 bp, Homo sapiens
aagtcttcatgaaatgcta

SEQ ID NO: 2383116 - DNA, 15 bp, Homo sapiens
aagtgaaatttattg

SEQ ID NO: 2383117 - DNA, 20 bp, Homo sapiens
aagtgttctgttacaaaatg

SEQ ID NO: 2383118 - DNA, 18 bp, Homo sapiens
atatatggtctaatgttt

SEQ ID NO: 2383119 - DNA, 16 bp, Homo sapiens
atatattttgtatgca

SEQ ID NO: 2383120 - DNA, 23 bp, Homo sapiens
atatattttgtatgcaagcagtt

SEQ ID NO: 2383121 - DNA, 21 bp, Homo sapiens
atatcttggcaggtaggaata

SEQ ID NO: 2383122 - DNA, 23 bp, Homo sapiens
atatgcactaagtctctttttta

SEQ ID NO: 2383123 - DNA, 14 bp, Homo sapiens
atatgcctgctctt

SEQ ID NO: 2383124 - DNA, 14 bp, Homo sapiens
atatggtctaatgt

SEQ ID NO: 2383125 - DNA, 17 bp, Homo sapiens
atatggtctaatgttta

SEQ ID NO: 2383126 - DNA, 22 bp, Homo sapiens
atatgtgaaggaccttcactct

SEQ ID NO: 2383127 - DNA, 13 bp, Homo sapiens
atattaaaaagtc

SEQ ID NO: 2383128 - DNA, 16 bp, Homo sapiens
atattaaaaagtcttt

SEQ ID NO: 2383129 - DNA, 17 bp, Homo sapiens
atattaaaaagtctttt

SEQ ID NO: 2383130 - DNA, 19 bp, Homo sapiens
atattaaaaagtcttttaa

SEQ ID NO: 2383131 - DNA, 19 bp, Homo sapiens
atattaaaggtatacaaat

SEQ ID NO: 2383132 - DNA, 14 bp, Homo sapiens
atattaatacagat

SEQ ID NO: 2383133 - DNA, 15 bp, Homo sapiens
atattagacttctgt

SEQ ID NO: 2383134 - DNA, 16 bp, Homo sapiens
atattagacttctgtt

SEQ ID NO: 2383135 - DNA, 20 bp, Homo sapiens
atattagacttctgttttca

SEQ ID NO: 2383136 - DNA, 22 bp, Homo sapiens
atattagacttctgttttcaat

SEQ ID NO: 2383137 - DNA, 22 bp, Homo sapiens
atattagcgacaacagattgga

SEQ ID NO: 2383138 - DNA, 13 bp, Homo sapiens
atattatatttgg

SEQ ID NO: 2383139 - DNA, 14 bp, Homo sapiens
atattatatttgga

SEQ ID NO: 2383140 - DNA, 15 bp, Homo sapiens
atattatatttggat

SEQ ID NO: 2383141 - DNA, 16 bp, Homo sapiens
atattatatttggatg

SEQ ID NO: 2383142 - DNA, 12 bp, Homo sapiens
atattctctgta

SEQ ID NO: 2383143 - DNA, 13 bp, Homo sapiens
atattctctgtac

SEQ ID NO: 2383144 - DNA, 14 bp, Homo sapiens
atattctctgtaca

SEQ ID NO: 2383145 - DNA, 15 bp, Homo sapiens
atattctctgtacat

SEQ ID NO: 2383146 - DNA, 22 bp, Homo sapiens
atatttcctataccatttccgt

SEQ ID NO: 2383147 - DNA, 20 bp, Homo sapiens
atatttggatgcagagttca

SEQ ID NO: 2383148 - DNA, 16 bp, Homo sapiens
atatttgtgtgctaaa

SEQ ID NO: 2383149 - DNA, 16 bp, Homo sapiens
atattttaatttcaag

SEQ ID NO: 2383150 - DNA, 17 bp, Homo sapiens
atattttgtatgcaagc

SEQ ID NO: 2383151 - DNA, 14 bp, Homo sapiens
atatttttcttaaa

SEQ ID NO: 2383152 - DNA, 19 bp, Homo sapiens
atatttttttccttacata

SEQ ID NO: 2383153 - DNA, 21 bp, Homo sapiens
atatttttttccttacataaa

SEQ ID NO: 2383154 - DNA, 22 bp, Homo sapiens
atatttttttccttacataaac

SEQ ID NO: 2383155 - DNA, 17 bp, Homo sapiens
atcatctgtaagctgtt

SEQ ID NO: 2383156 - DNA, 12 bp, Homo sapiens
atccttacaaat

SEQ ID NO: 2383157 - DNA, 16 bp, Homo sapiens
atccttacaaatgatt

SEQ ID NO: 2383158 - DNA, 17 bp, Homo sapiens
atccttacaaatgattg

SEQ ID NO: 2383159 - DNA, 21 bp, Homo sapiens
atccttacaaatgattgcttt

SEQ ID NO: 2383160 - DNA, 23 bp, Homo sapiens
atcggttaacaaataacaacttt

SEQ ID NO: 2383161 - DNA, 19 bp, Homo sapiens
atctaccaactttcaagaa

SEQ ID NO: 2383162 - DNA, 14 bp, Homo sapiens
atctagatgtaaat

SEQ ID NO: 2383163 - DNA, 15 bp, Homo sapiens
atctagatgtaaatt

SEQ ID NO: 2383164 - DNA, 14 bp, Homo sapiens
atctatagaaagtg

SEQ ID NO: 2383165 - DNA, 22 bp, Homo sapiens
atctatagaaagtgttctgtta

SEQ ID NO: 2383166 - DNA, 23 bp, Homo sapiens
atctatagaaagtgttctgttac

SEQ ID NO: 2383167 - DNA, 15 bp, Homo sapiens
atctcgtatagaagt

SEQ ID NO: 2383168 - DNA, 16 bp, Homo sapiens
atctgaagattgttta

SEQ ID NO: 2383169 - DNA, 20 bp, Homo sapiens
atctgaagattgtttatcta

SEQ ID NO: 2383170 - DNA, 23 bp, Homo sapiens
atctgagagaggctaaaatgttt

SEQ ID NO: 2383171 - DNA, 14 bp, Homo sapiens
atctgccttataca

SEQ ID NO: 2383172 - DNA, 12 bp, Homo sapiens
atctgtaagctg

SEQ ID NO: 2383173 - DNA, 23 bp, Homo sapiens
atctgtgccttttttatatcttg

SEQ ID NO: 2383174 - DNA, 22 bp, Homo sapiens
atcttattaaagtttcaaaaat

SEQ ID NO: 2383175 - DNA, 23 bp, Homo sapiens
atcttattaaagtttcaaaaatc

SEQ ID NO: 2383176 - DNA, 15 bp, Homo sapiens
atcttcctctgctaa

SEQ ID NO: 2383177 - DNA, 20 bp, Homo sapiens
atcttcctctgctaaattga

SEQ ID NO: 2383178 - DNA, 19 bp, Homo sapiens
atcttcctggtcgaaagtt

SEQ ID NO: 2383179 - DNA, 23 bp, Homo sapiens
atcttcctggtcgaaagttagta

SEQ ID NO: 2383180 - DNA, 20 bp, Homo sapiens
atcttggcaggtaggaatat

SEQ ID NO: 2383181 - DNA, 22 bp, Homo sapiens
atgaaatgctatgtcatttcat

SEQ ID NO: 2383182 - DNA, 23 bp, Homo sapiens
atgaaatgctatgtcatttcatg

SEQ ID NO: 2383183 - DNA, 19 bp, Homo sapiens
atgaccttgtaatgtaact

SEQ ID NO: 2383184 - DNA, 13 bp, Homo sapiens
atgatgtttttaa

SEQ ID NO: 2383185 - DNA, 17 bp, Homo sapiens
atgatgtttttaaaatc

SEQ ID NO: 2383186 - DNA, 18 bp, Homo sapiens
atgatgtttttaaaatct

SEQ ID NO: 2383187 - DNA, 13 bp, Homo sapiens
atgattgctttta

SEQ ID NO: 2383188 - DNA, 17 bp, Homo sapiens
atgattgcttttaaaat

SEQ ID NO: 2383189 - DNA, 14 bp, Homo sapiens
atgatttcacaaat

SEQ ID NO: 2383190 - DNA, 23 bp, Homo sapiens
atgatttcacaaatattaaaaag

SEQ ID NO: 2383191 - DNA, 15 bp, Homo sapiens
atgcaatccttacaa

SEQ ID NO: 2383192 - DNA, 16 bp, Homo sapiens
atgcaatccttacaaa

SEQ ID NO: 2383193 - DNA, 19 bp, Homo sapiens
atgcaatccttacaaatga

SEQ ID NO: 2383194 - DNA, 20 bp, Homo sapiens
atgcagaaaaggaagatgtt

SEQ ID NO: 2383195 - DNA, 20 bp, Homo sapiens
atgcagagttcagggaagat

SEQ ID NO: 2383196 - DNA, 21 bp, Homo sapiens
atgcataataatcctgcaaag

SEQ ID NO: 2383197 - DNA, 20 bp, Homo sapiens
atgcatgctttccatatttt

SEQ ID NO: 2383198 - DNA, 13 bp, Homo sapiens
atgctaagaattt

SEQ ID NO: 2383199 - DNA, 16 bp, Homo sapiens
atgctaagaatttttt

SEQ ID NO: 2383200 - DNA, 17 bp, Homo sapiens
atgctatgtcatttcat

SEQ ID NO: 2383201 - DNA, 22 bp, Homo sapiens
atgctttccatatttttttcct

SEQ ID NO: 2383202 - DNA, 22 bp, Homo sapiens
atggcaacaaactgcacatgat

SEQ ID NO: 2383203 - DNA, 21 bp, Homo sapiens
atggcacagggcatgaaatga

SEQ ID NO: 2383204 - DNA, 17 bp, Homo sapiens
atggtcaatatttgtaa

SEQ ID NO: 2383205 - DNA, 12 bp, Homo sapiens
atgtaacactgt

SEQ ID NO: 2383206 - DNA, 15 bp, Homo sapiens
atgtaactgctcttg

SEQ ID NO: 2383207 - DNA, 22 bp, Homo sapiens
atgtaactgttaccattggaaa

SEQ ID NO: 2383208 - DNA, 20 bp, Homo sapiens
atgtatagtatttgaaaaca

SEQ ID NO: 2383209 - DNA, 21 bp, Homo sapiens
atgtatttaggactgaaaata

SEQ ID NO: 2383210 - DNA, 12 bp, Homo sapiens
atgtattttgtg

SEQ ID NO: 2383211 - DNA, 16 bp, Homo sapiens
atgtattttgtgagtt

SEQ ID NO: 2383212 - DNA, 13 bp, Homo sapiens
atgtcctgtgtca

SEQ ID NO: 2383213 - DNA, 13 bp, Homo sapiens
atgtgaattacta

SEQ ID NO: 2383214 - DNA, 22 bp, Homo sapiens
atgtgaattactaacttctaaa

SEQ ID NO: 2383215 - DNA, 14 bp, Homo sapiens
atgtgacatttgtc

SEQ ID NO: 2383216 - DNA, 15 bp, Homo sapiens
atgtgacatttgtca

SEQ ID NO: 2383217 - DNA, 20 bp, Homo sapiens
atgtgtaatttttctgtata

SEQ ID NO: 2383218 - DNA, 20 bp, Homo sapiens
atgtgtgtgatgtgacattt

SEQ ID NO: 2383219 - DNA, 13 bp, Homo sapiens
atgttaaagatgt

SEQ ID NO: 2383220 - DNA, 17 bp, Homo sapiens
atgttaaagatgtagca

SEQ ID NO: 2383221 - DNA, 14 bp, Homo sapiens
atgttatatttttc

SEQ ID NO: 2383222 - DNA, 20 bp, Homo sapiens
atgttatatttttcttaaaa

SEQ ID NO: 2383223 - DNA, 13 bp, Homo sapiens
atgttgacatttg

SEQ ID NO: 2383224 - DNA, 14 bp, Homo sapiens
atgttgatgcaatc

SEQ ID NO: 2383225 - DNA, 15 bp, Homo sapiens
atgttttcaaatgga

SEQ ID NO: 2383226 - DNA, 19 bp, Homo sapiens
atgttttcagctaggaaca

SEQ ID NO: 2383227 - DNA, 22 bp, Homo sapiens
atgttttggtccacttttccag

SEQ ID NO: 2383228 - DNA, 15 bp, Homo sapiens
atgttttgtaaactt

SEQ ID NO: 2383229 - DNA, 18 bp, Homo sapiens
atgttttgtaaactttga

SEQ ID NO: 2383230 - DNA, 15 bp, Homo sapiens
atgtttttaaaatct

SEQ ID NO: 2383231 - DNA, 17 bp, Homo sapiens
ccatatttttttcctta

SEQ ID NO: 2383232 - DNA, 22 bp, Homo sapiens
ccatatttttttccttacataa

SEQ ID NO: 2383233 - DNA, 14 bp, Homo sapiens
ccattggaaatttc

SEQ ID NO: 2383234 - DNA, 15 bp, Homo sapiens
ccattggaaatttca

SEQ ID NO: 2383235 - DNA, 13 bp, Homo sapiens
ccctgaaatgtgt

SEQ ID NO: 2383236 - DNA, 17 bp, Homo sapiens
cctctgatgtattttgt

SEQ ID NO: 2383237 - DNA, 12 bp, Homo sapiens
cctctgctaaat

SEQ ID NO: 2383238 - DNA, 22 bp, Homo sapiens
cctctgctaaattgatgttgat

SEQ ID NO: 2383239 - DNA, 18 bp, Homo sapiens
cctgaaatgtgtgtgatg

SEQ ID NO: 2383240 - DNA, 20 bp, Homo sapiens
cctgagatgaagattcatgt

SEQ ID NO: 2383241 - DNA, 23 bp, Homo sapiens
cctgcaaagtacaggtactttgt

SEQ ID NO: 2383242 - DNA, 15 bp, Homo sapiens
ccttgcatacaaaca

SEQ ID NO: 2383243 - DNA, 21 bp, Homo sapiens
ccttgtaatgtaactgctctt

SEQ ID NO: 2383244 - DNA, 22 bp, Homo sapiens
cctttggttctatgcaaataaa

SEQ ID NO: 2383245 - DNA, 19 bp, Homo sapiens
cgctaacttgcttaaatgt

SEQ ID NO: 2383246 - DNA, 20 bp, Homo sapiens
cgctaacttgcttaaatgtg

SEQ ID NO: 2383247 - DNA, 21 bp, Homo sapiens
cgctaacttgcttaaatgtga

SEQ ID NO: 2383248 - DNA, 16 bp, Homo sapiens
cgtaaaaactgaagtt

SEQ ID NO: 2383249 - DNA, 16 bp, Homo sapiens
cgtatagaagtcttca

SEQ ID NO: 2383250 - DNA, 20 bp, Homo sapiens
ctaaacgtgtatgtttttca

SEQ ID NO: 2383251 - DNA, 21 bp, Homo sapiens
ctaaacgtgtatgtttttcag

SEQ ID NO: 2383252 - DNA, 14 bp, Homo sapiens
ctaaatgttaaaga

SEQ ID NO: 2383253 - DNA, 15 bp, Homo sapiens
ctaaatgttaaagat

SEQ ID NO: 2383254 - DNA, 19 bp, Homo sapiens
ctaaatgttaaagatgtag

SEQ ID NO: 2383255 - DNA, 14 bp, Homo sapiens
ctaaattgatgttg

SEQ ID NO: 2383256 - DNA, 17 bp, Homo sapiens
ctaacttctaaaactgt

SEQ ID NO: 2383257 - DNA, 16 bp, Homo sapiens
ctaacttgcttaaatg

SEQ ID NO: 2383258 - DNA, 12 bp, Homo sapiens
ctaagaaacatt

SEQ ID NO: 2383259 - DNA, 13 bp, Homo sapiens
ctaagaaacattg

SEQ ID NO: 2383260 - DNA, 14 bp, Homo sapiens
ctaagatgttatat

SEQ ID NO: 2383261 - DNA, 19 bp, Homo sapiens
ctaagatgttatatttttc

SEQ ID NO: 2383262 - DNA, 20 bp, Homo sapiens
ctaagatgttatatttttct

SEQ ID NO: 2383263 - DNA, 19 bp, Homo sapiens
ctaaggagatataatatag

SEQ ID NO: 2383264 - DNA, 17 bp, Homo sapiens
ctaagtctcttttttac

SEQ ID NO: 2383265 - DNA, 16 bp, Homo sapiens
ctaatgtttaagcaga

SEQ ID NO: 2383266 - DNA, 23 bp, Homo sapiens
ctaccaactttcaagaacttgtt

SEQ ID NO: 2383267 - DNA, 14 bp, Homo sapiens
ctaggaaaagaaat

SEQ ID NO: 2383268 - DNA, 20 bp, Homo sapiens
ctagtaggggtaccactgaa

SEQ ID NO: 2383269 - DNA, 14 bp, Homo sapiens
ctatagaaagtgtt

SEQ ID NO: 2383270 - DNA, 19 bp, Homo sapiens
ctatagaaagtgttctgtt

SEQ ID NO: 2383271 - DNA, 21 bp, Homo sapiens
ctatattaaaggtatacaaat

SEQ ID NO: 2383272 - DNA, 19 bp, Homo sapiens
ctattggggaactcattgt

SEQ ID NO: 2383273 - DNA, 21 bp, Homo sapiens
ctcaaatattgaatgtttaaa

SEQ ID NO: 2383274 - DNA, 16 bp, Homo sapiens
ctcgtatagaagtctt

SEQ ID NO: 2383275 - DNA, 13 bp, Homo sapiens
ctctgctaaattg

SEQ ID NO: 2383276 - DNA, 15 bp, Homo sapiens
ctcttttttacaaag

SEQ ID NO: 2383277 - DNA, 16 bp, Homo sapiens
ctgaaatgtgtgtgat

SEQ ID NO: 2383278 - DNA, 18 bp, Homo sapiens
ctgaaatgtgtgtgatgt

SEQ ID NO: 2383279 - DNA, 14 bp, Homo sapiens
ctgaagattgttta

SEQ ID NO: 2383280 - DNA, 19 bp, Homo sapiens
ctgaagttctgcctctgat

SEQ ID NO: 2383281 - DNA, 20 bp, Homo sapiens
ctgaagttctgcctctgatg

SEQ ID NO: 2383282 - DNA, 22 bp, Homo sapiens
ctgagcagtgatattctttgtt

SEQ ID NO: 2383283 - DNA, 14 bp, Homo sapiens
ctgataataaatgt

SEQ ID NO: 2383284 - DNA, 17 bp, Homo sapiens
ctgatgtattttgtgag

SEQ ID NO: 2383285 - DNA, 16 bp, Homo sapiens
ctgcacatgatttcac

SEQ ID NO: 2383286 - DNA, 15 bp, Homo sapiens
ctgcactctcattgt

SEQ ID NO: 2383287 - DNA, 15 bp, Homo sapiens
ctgccccaagttttg

SEQ ID NO: 2383288 - DNA, 19 bp, Homo sapiens
ctgctaaattgatgttgat

SEQ ID NO: 2383289 - DNA, 19 bp, Homo sapiens
ctgctcttgggcaatattc

SEQ ID NO: 2383290 - DNA, 13 bp, Homo sapiens
ctgggaaatttaa

SEQ ID NO: 2383291 - DNA, 21 bp, Homo sapiens
ctgtacagagccgtaaaaact

SEQ ID NO: 2383292 - DNA, 21 bp, Homo sapiens
ctgtcaaacattagtacttta

SEQ ID NO: 2383293 - DNA, 22 bp, Homo sapiens
ctgtcaaacattagtactttat

SEQ ID NO: 2383294 - DNA, 15 bp, Homo sapiens
ctgtgtcagtttatg

SEQ ID NO: 2383295 - DNA, 16 bp, Homo sapiens
ctgtgtcagtttatgt

SEQ ID NO: 2383296 - DNA, 19 bp, Homo sapiens
ctgttaccattggaaattt

SEQ ID NO: 2383297 - DNA, 21 bp, Homo sapiens
ctgttaccattggaaatttca

SEQ ID NO: 2383298 - DNA, 14 bp, Homo sapiens
cttaaaatttgaaa

SEQ ID NO: 2383299 - DNA, 19 bp, Homo sapiens
cttaaaatttgaaacattg

SEQ ID NO: 2383300 - DNA, 12 bp, Homo sapiens
cttaaatgtgaa

SEQ ID NO: 2383301 - DNA, 17 bp, Homo sapiens
cttacataaacatcagg

SEQ ID NO: 2383302 - DNA, 22 bp, Homo sapiens
cttacatagctcaaatattgaa

SEQ ID NO: 2383303 - DNA, 14 bp, Homo sapiens
cttattaaagtttc

SEQ ID NO: 2383304 - DNA, 15 bp, Homo sapiens
cttattaaagtttca

SEQ ID NO: 2383305 - DNA, 18 bp, Homo sapiens
cttattaaagtttcaaaa

SEQ ID NO: 2383306 - DNA, 20 bp, Homo sapiens
cttatttaagacatgtttaa

SEQ ID NO: 2383307 - DNA, 18 bp, Homo sapiens
cttattttggagagatag

SEQ ID NO: 2383308 - DNA, 17 bp, Homo sapiens
cttcctggtcgaaagtt

SEQ ID NO: 2383309 - DNA, 14 bp, Homo sapiens
cttctaaaactgta

SEQ ID NO: 2383310 - DNA, 23 bp, Homo sapiens
cttgcacacatcatctgtaagct

SEQ ID NO: 2383311 - DNA, 14 bp, Homo sapiens
cttgcatacaaaca

SEQ ID NO: 2383312 - DNA, 15 bp, Homo sapiens
cttgcatacaaacaa

SEQ ID NO: 2383313 - DNA, 20 bp, Homo sapiens
cttgcatacaaacaagcata

SEQ ID NO: 2383314 - DNA, 14 bp, Homo sapiens
cttgcttaaatgtg

SEQ ID NO: 2383315 - DNA, 19 bp, Homo sapiens
cttgggcaatattctctgt

SEQ ID NO: 2383316 - DNA, 14 bp, Homo sapiens
cttgtaatgtaact

SEQ ID NO: 2383317 - DNA, 19 bp, Homo sapiens
cttgtacccaccatacaga

SEQ ID NO: 2383318 - DNA, 17 bp, Homo sapiens
cttgtttttgtttttgt

SEQ ID NO: 2383319 - DNA, 19 bp, Homo sapiens
ctttatctaccaactttca

SEQ ID NO: 2383320 - DNA, 22 bp, Homo sapiens
ctttatctaccaactttcaaga

SEQ ID NO: 2383321 - DNA, 14 bp, Homo sapiens
ctttgaattttcat

SEQ ID NO: 2383322 - DNA, 21 bp, Homo sapiens
ctttgattcacatgttttcaa

SEQ ID NO: 2383323 - DNA, 22 bp, Homo sapiens
ctttgattcacatgttttcaaa

SEQ ID NO: 2383324 - DNA, 18 bp, Homo sapiens
ctttgtctaagaaacatt

SEQ ID NO: 2383325 - DNA, 16 bp, Homo sapiens
cttttaaaaagtattg

SEQ ID NO: 2383326 - DNA, 14 bp, Homo sapiens
cttttaaaactact

SEQ ID NO: 2383327 - DNA, 15 bp, Homo sapiens
cttttccttgcatac

SEQ ID NO: 2383328 - DNA, 19 bp, Homo sapiens
cttttgttttttgaagtgt

SEQ ID NO: 2383329 - DNA, 21 bp, Homo sapiens
cttttgttttttgaagtgttg

SEQ ID NO: 2383330 - DNA, 13 bp, Homo sapiens
cttttttacaaag

SEQ ID NO: 2383331 - DNA, 21 bp, Homo sapiens
cttttttttttaagtgaaatt

SEQ ID NO: 2383332 - DNA, 13 bp, Homo sapiens
gaaaaatatgtga

SEQ ID NO: 2383333 - DNA, 14 bp, Homo sapiens
gaaaaatatgtgaa

SEQ ID NO: 2383334 - DNA, 14 bp, Homo sapiens
gaaaacagaaattg

SEQ ID NO: 2383335 - DNA, 15 bp, Homo sapiens
gaaaacagaaattgg

SEQ ID NO: 2383336 - DNA, 11 bp, Homo sapiens
gaaaactttgt

SEQ ID NO: 2383337 - DNA, 16 bp, Homo sapiens
gaaaactttgttaggc

SEQ ID NO: 2383338 - DNA, 18 bp, Homo sapiens
gaaaactttgttaggcca

SEQ ID NO: 2383339 - DNA, 21 bp, Homo sapiens
gaaaagaaatctatagaaagt

SEQ ID NO: 2383340 - DNA, 23 bp, Homo sapiens
gaaaagaaatctatagaaagtgt

SEQ ID NO: 2383341 - DNA, 13 bp, Homo sapiens
gaaacattgcttt

SEQ ID NO: 2383342 - DNA, 17 bp, Homo sapiens
gaaacattgcttttaaa

SEQ ID NO: 2383343 - DNA, 17 bp, Homo sapiens
gaaagaactatcttcat

SEQ ID NO: 2383344 - DNA, 21 bp, Homo sapiens
tacaaaaccacagtgtaccat

SEQ ID NO: 2383345 - DNA, 12 bp, Homo sapiens
tacaaaatgtaa

SEQ ID NO: 2383346 - DNA, 23 bp, Homo sapiens
tacaaaatgtaactgttaccatt

SEQ ID NO: 2383347 - DNA, 18 bp, Homo sapiens
tacaaatgattgctttta

SEQ ID NO: 2383348 - DNA, 21 bp, Homo sapiens
tacaaatgattgcttttaaaa

SEQ ID NO: 2383349 - DNA, 24 bp, Homo sapiens
tacaatcagaaggtttcgaaatgt

SEQ ID NO: 2383350 - DNA, 14 bp, Homo sapiens
tacagatctgttta

SEQ ID NO: 2383351 - DNA, 14 bp, Homo sapiens
tacagttacttttc

SEQ ID NO: 2383352 - DNA, 12 bp, Homo sapiens
tacataaacatc

SEQ ID NO: 2383353 - DNA, 14 bp, Homo sapiens
taccaactttcaag

SEQ ID NO: 2383354 - DNA, 11 bp, Homo sapiens
taccactgaat

SEQ ID NO: 2383355 - DNA, 19 bp, Homo sapiens
taccactgaatctgtacag

SEQ ID NO: 2383356 - DNA, 14 bp, Homo sapiens
taccattaaaatat

SEQ ID NO: 2383357 - DNA, 19 bp, Homo sapiens
taccattggaaatttcacg

SEQ ID NO: 2383358 - DNA, 22 bp, Homo sapiens
taccatttccgtaattcttatt

SEQ ID NO: 2383359 - DNA, 16 bp, Homo sapiens
taccttaaaatttgaa

SEQ ID NO: 2383360 - DNA, 18 bp, Homo sapiens
taccttaaaatttgaaac

SEQ ID NO: 2383361 - DNA, 18 bp, Homo sapiens
tactaacttctaaaactg

SEQ ID NO: 2383362 - DNA, 13 bp, Homo sapiens
tactttatagaag

SEQ ID NO: 2383363 - DNA, 12 bp, Homo sapiens
tactttgattca

SEQ ID NO: 2383364 - DNA, 17 bp, Homo sapiens
tactttgattcacatgt

SEQ ID NO: 2383365 - DNA, 11 bp, Homo sapiens
tacttttcctt

SEQ ID NO: 2383366 - DNA, 21 bp, Homo sapiens
tacttttccttgcatacaaac

SEQ ID NO: 2383367 - DNA, 13 bp, Homo sapiens
tagaaaactttgt

SEQ ID NO: 2383368 - DNA, 16 bp, Homo sapiens
tagaaagtgttctgtt

SEQ ID NO: 2383369 - DNA, 22 bp, Homo sapiens
tagaagaatgcatgctttccat

SEQ ID NO: 2383370 - DNA, 20 bp, Homo sapiens
tagaagtcttcatgaaatgc

SEQ ID NO: 2383371 - DNA, 21 bp, Homo sapiens
tagaagtcttcatgaaatgct

SEQ ID NO: 2383372 - DNA, 15 bp, Homo sapiens
tagaatgaccttgta

SEQ ID NO: 2383373 - DNA, 17 bp, Homo sapiens
tagaatgaccttgtaat

SEQ ID NO: 2383374 - DNA, 19 bp, Homo sapiens
tagaatgaccttgtaatgt

SEQ ID NO: 2383375 - DNA, 13 bp, Homo sapiens
tagatgtaaattt

SEQ ID NO: 2383376 - DNA, 19 bp, Homo sapiens
tagcaaaccctgtcaaaca

SEQ ID NO: 2383377 - DNA, 20 bp, Homo sapiens
tagcaaaccctgtcaaacat

SEQ ID NO: 2383378 - DNA, 21 bp, Homo sapiens
tagcaaaccctgtcaaacatt

SEQ ID NO: 2383379 - DNA, 22 bp, Homo sapiens
tagcatttatggtaatcatatt

SEQ ID NO: 2383380 - DNA, 20 bp, Homo sapiens
tagcgacaacagattggatt

SEQ ID NO: 2383381 - DNA, 16 bp, Homo sapiens
taggaaaagaaatcta

SEQ ID NO: 2383382 - DNA, 21 bp, Homo sapiens
taggaaaagaaatctatagaa

SEQ ID NO: 2383383 - DNA, 14 bp, Homo sapiens
taggaaggtcattt

SEQ ID NO: 2383384 - DNA, 23 bp, Homo sapiens
taggaaggtcatttccatgtatg

SEQ ID NO: 2383385 - DNA, 13 bp, Homo sapiens
taggaatattata

SEQ ID NO: 2383386 - DNA, 14 bp, Homo sapiens
taggaatattatat

SEQ ID NO: 2383387 - DNA, 15 bp, Homo sapiens
taggaatattatatt

SEQ ID NO: 2383388 - DNA, 17 bp, Homo sapiens
taggatatgcctgctct

SEQ ID NO: 2383389 - DNA, 21 bp, Homo sapiens
taggatatgcctgctctttgg

SEQ ID NO: 2383390 - DNA, 19 bp, Homo sapiens
taggcaagatggcacaggg

SEQ ID NO: 2383391 - DNA, 13 bp, Homo sapiens
tagtactttatag

SEQ ID NO: 2383392 - DNA, 14 bp, Homo sapiens
tagtgcaatatatt

SEQ ID NO: 2383393 - DNA, 15 bp, Homo sapiens
tagtgcaatatattt

SEQ ID NO: 2383394 - DNA, 19 bp, Homo sapiens
tagtgcaatatattttgta

SEQ ID NO: 2383395 - DNA, 15 bp, Homo sapiens
tagtggaccctgaaa

SEQ ID NO: 2383396 - DNA, 19 bp, Homo sapiens
tagtggaccctgaaatgtg

SEQ ID NO: 2383397 - DNA, 21 bp, Homo sapiens
tagtggaccctgaaatgtgtg

SEQ ID NO: 2383398 - DNA, 19 bp, Homo sapiens
tagttttattttctaaagt

SEQ ID NO: 2383399 - DNA, 16 bp, Homo sapiens
tataaaatggcaacaa

SEQ ID NO: 2383400 - DNA, 12 bp, Homo sapiens
tataaagaatag

SEQ ID NO: 2383401 - DNA, 17 bp, Homo sapiens
tataccatttccgtaat

SEQ ID NO: 2383402 - DNA, 22 bp, Homo sapiens
tatagaaagtgttctgttacaa

SEQ ID NO: 2383403 - DNA, 13 bp, Homo sapiens
tatagaagtcttc

SEQ ID NO: 2383404 - DNA, 21 bp, Homo sapiens
tatagaagtcttcatgaaatg

SEQ ID NO: 2383405 - DNA, 23 bp, Homo sapiens
tatagaagtcttcatgaaatgct

SEQ ID NO: 2383406 - DNA, 11 bp, Homo sapiens
tatagtatttg

SEQ ID NO: 2383407 - DNA, 15 bp, Homo sapiens
tatagtatttgaaaa

SEQ ID NO: 2383408 - DNA, 20 bp, Homo sapiens
tatattaaaggtatacaaat

SEQ ID NO: 2383409 - DNA, 18 bp, Homo sapiens
tatatttcctataccatt

SEQ ID NO: 2383410 - DNA, 21 bp, Homo sapiens
tatattttgtatgcaagcagt

SEQ ID NO: 2383411 - DNA, 15 bp, Homo sapiens
tatatttttcttaaa

SEQ ID NO: 2383412 - DNA, 20 bp, Homo sapiens
tatatttttcttaaaaagta

SEQ ID NO: 2383413 - DNA, 15 bp, Homo sapiens
tatctaatttggatt

SEQ ID NO: 2383414 - DNA, 19 bp, Homo sapiens
tatctaccaactttcaaga

SEQ ID NO: 2383415 - DNA, 13 bp, Homo sapiens
tatctagatgtaa

SEQ ID NO: 2383416 - DNA, 10 bp, Homo sapiens
tatcttcatc

SEQ ID NO: 2383417 - DNA, 13 bp, Homo sapiens
tatgcaagcagtt

SEQ ID NO: 2383418 - DNA, 18 bp, Homo sapiens
tatgcactaagtctcttt

SEQ ID NO: 2383419 - DNA, 16 bp, Homo sapiens
tatggtctaatgttta

SEQ ID NO: 2383420 - DNA, 14 bp, Homo sapiens
tatgttgacatttg

SEQ ID NO: 2383421 - DNA, 15 bp, Homo sapiens
tatgttgacatttgt

SEQ ID NO: 2383422 - DNA, 14 bp, Homo sapiens
tatgttggaatttt

SEQ ID NO: 2383423 - DNA, 16 bp, Homo sapiens
tatgtttagataaaat

SEQ ID NO: 2383424 - DNA, 13 bp, Homo sapiens
tatgtttttcagt

SEQ ID NO: 2383425 - DNA, 16 bp, Homo sapiens
tatgtttttcagttca

SEQ ID NO: 2383426 - DNA, 19 bp, Homo sapiens
tatgtttttcagttcaaag

SEQ ID NO: 2383427 - DNA, 14 bp, Homo sapiens
tattaaaaagtctt

SEQ ID NO: 2383428 - DNA, 16 bp, Homo sapiens
tattaaaggtatacaa

SEQ ID NO: 2383429 - DNA, 14 bp, Homo sapiens
tattaaagtttcaa

SEQ ID NO: 2383430 - DNA, 21 bp, Homo sapiens
tattaaagtttcaaaaatctg

SEQ ID NO: 2383431 - DNA, 12 bp, Homo sapiens
tattacaatatt

SEQ ID NO: 2383432 - DNA, 13 bp, Homo sapiens
tattacaatattt

SEQ ID NO: 2383433 - DNA, 14 bp, Homo sapiens
tattacaatatttg

SEQ ID NO: 2383434 - DNA, 17 bp, Homo sapiens
tattagaaaactttgtt

SEQ ID NO: 2383435 - DNA, 18 bp, Homo sapiens
tattagaaaactttgtta

SEQ ID NO: 2383436 - DNA, 19 bp, Homo sapiens
tattagaaaactttgttag

SEQ ID NO: 2383437 - DNA, 17 bp, Homo sapiens
tattagacttctgtttt

SEQ ID NO: 2383438 - DNA, 21 bp, Homo sapiens
tattagacttctgttttcaat

SEQ ID NO: 2383439 - DNA, 23 bp, Homo sapiens
tattagacttctgttttcaatct

SEQ ID NO: 2383440 - DNA, 12 bp, Homo sapiens
tattatatttgg

SEQ ID NO: 2383441 - DNA, 13 bp, Homo sapiens
tattatatttgga

SEQ ID NO: 2383442 - DNA, 22 bp, Homo sapiens
tattcagcaaggcgctaacttg

SEQ ID NO: 2383443 - DNA, 15 bp, Homo sapiens
tattctctgtacata

SEQ ID NO: 2383444 - DNA, 19 bp, Homo sapiens
tattctgggaatgtatagt

SEQ ID NO: 2383445 - DNA, 23 bp, Homo sapiens
tattctgggaatgtatagtattt

SEQ ID NO: 2383446 - DNA, 13 bp, Homo sapiens
tattctttgttaa

SEQ ID NO: 2383447 - DNA, 16 bp, Homo sapiens
tattgagagagatgtg

SEQ ID NO: 2383448 - DNA, 15 bp, Homo sapiens
tattgaggaaaaata

SEQ ID NO: 2383449 - DNA, 17 bp, Homo sapiens
tattgaggaaaaatatg

SEQ ID NO: 2383450 - DNA, 21 bp, Homo sapiens
tattgaggaaaaatatgtgaa

SEQ ID NO: 2383451 - DNA, 21 bp, Homo sapiens
tattgccaaacattaatgttg

SEQ ID NO: 2383452 - DNA, 14 bp, Homo sapiens
tatttaaaatttct

SEQ ID NO: 2383453 - DNA, 21 bp, Homo sapiens
tatttattctgggaatgtata

SEQ ID NO: 2383454 - DNA, 20 bp, Homo sapiens
tatttgaaaacagaaattgg

SEQ ID NO: 2383455 - DNA, 20 bp, Homo sapiens
tatttggatgcagagttcag

SEQ ID NO: 2383456 - DNA, 14 bp, Homo sapiens
tattttaatttcaa

SEQ ID NO: 2383457 - DNA, 23 bp, Homo sapiens
tattttagtggaccctgaaatgt

SEQ ID NO: 2383458 - DNA, 23 bp, Homo sapiens
ttcatgaaatgctatgtcatttc

SEQ ID NO: 2383459 - DNA, 23 bp, Homo sapiens
ttcatgtcctgtgtcagtttatg

SEQ ID NO: 2383460 - DNA, 22 bp, Homo sapiens
ttcattagcaaaaaaagttgta

SEQ ID NO: 2383461 - DNA, 23 bp, Homo sapiens
ttcattcatattacaatatttgt

SEQ ID NO: 2383462 - DNA, 14 bp, Homo sapiens
ttccagtattttag

SEQ ID NO: 2383463 - DNA, 18 bp, Homo sapiens
ttccatattagaaaactt

SEQ ID NO: 2383464 - DNA, 22 bp, Homo sapiens
ttcctctgctaaattgatgttg

SEQ ID NO: 2383465 - DNA, 13 bp, Homo sapiens
ttccttacataaa

SEQ ID NO: 2383466 - DNA, 16 bp, Homo sapiens
ttccttacataaacat

SEQ ID NO: 2383467 - DNA, 13 bp, Homo sapiens
ttccttgcataca

SEQ ID NO: 2383468 - DNA, 15 bp, Homo sapiens
ttctaaaactgtact

SEQ ID NO: 2383469 - DNA, 15 bp, Homo sapiens
ttctaaaatataaca

SEQ ID NO: 2383470 - DNA, 13 bp, Homo sapiens
ttctaaagtactg

SEQ ID NO: 2383471 - DNA, 17 bp, Homo sapiens
ttctaaagtactgagca

SEQ ID NO: 2383472 - DNA, 16 bp, Homo sapiens
ttctcagtttttctta

SEQ ID NO: 2383473 - DNA, 11 bp, Homo sapiens
ttctctgtaca

SEQ ID NO: 2383474 - DNA, 18 bp, Homo sapiens
ttctgaagttatatttcc

SEQ ID NO: 2383475 - DNA, 19 bp, Homo sapiens
ttctgaagttatatttcct

SEQ ID NO: 2383476 - DNA, 23 bp, Homo sapiens
ttctgggaatgtatagtatttga

SEQ ID NO: 2383477 - DNA, 13 bp, Homo sapiens
ttctgttacaaaa

SEQ ID NO: 2383478 - DNA, 20 bp, Homo sapiens
ttctgttacaaaatgtaact

SEQ ID NO: 2383479 - DNA, 12 bp, Homo sapiens
ttctgttttcaa

SEQ ID NO: 2383480 - DNA, 14 bp, Homo sapiens
ttctgttttcaatc

SEQ ID NO: 2383481 - DNA, 17 bp, Homo sapiens
ttcttattccatattag

SEQ ID NO: 2383482 - DNA, 18 bp, Homo sapiens
ttctttgaattttcattt

SEQ ID NO: 2383483 - DNA, 22 bp, Homo sapiens
ttctttgaattttcattttaca

SEQ ID NO: 2383484 - DNA, 19 bp, Homo sapiens
ttcttttgttttttgaagt

SEQ ID NO: 2383485 - DNA, 15 bp, Homo sapiens
ttgaattttcatttt

SEQ ID NO: 2383486 - DNA, 16 bp, Homo sapiens
ttgaattttcatttta

SEQ ID NO: 2383487 - DNA, 14 bp, Homo sapiens
ttgagagagatgtg

SEQ ID NO: 2383488 - DNA, 21 bp, Homo sapiens
ttgaggaaaaatatgtgaagg

SEQ ID NO: 2383489 - DNA, 22 bp, Homo sapiens
ttgataaatagtgttattgaga

SEQ ID NO: 2383490 - DNA, 17 bp, Homo sapiens
ttgatgcaatccttaca

SEQ ID NO: 2383491 - DNA, 19 bp, Homo sapiens
ttgatgcaatccttacaaa

SEQ ID NO: 2383492 - DNA, 20 bp, Homo sapiens
ttgatgcaatccttacaaat

SEQ ID NO: 2383493 - DNA, 22 bp, Homo sapiens
ttgatgcaatccttacaaatga

SEQ ID NO: 2383494 - DNA, 16 bp, Homo sapiens
ttgattcacatgtttt

SEQ ID NO: 2383495 - DNA, 23 bp, Homo sapiens
ttgattcacatgttttcaaatgg

SEQ ID NO: 2383496 - DNA, 15 bp, Homo sapiens
ttgcacaaaaagata

SEQ ID NO: 2383497 - DNA, 14 bp, Homo sapiens
ttgccaaacattaa

SEQ ID NO: 2383498 - DNA, 12 bp, Homo sapiens
ttgcttaaatgt

SEQ ID NO: 2383499 - DNA, 16 bp, Homo sapiens
ttgcttaaatgtgaat

SEQ ID NO: 2383500 - DNA, 20 bp, Homo sapiens
ttgcttaaatgtgaattact

SEQ ID NO: 2383501 - DNA, 21 bp, Homo sapiens
ttgcttttaaaactacttagc

SEQ ID NO: 2383502 - DNA, 16 bp, Homo sapiens
ttggaaacactaaatg

SEQ ID NO: 2383503 - DNA, 18 bp, Homo sapiens
ttggaaacactaaatgtt

SEQ ID NO: 2383504 - DNA, 21 bp, Homo sapiens
ttggaaacactaaatgttaaa

SEQ ID NO: 2383505 - DNA, 13 bp, Homo sapiens
ttggaaatttcac

SEQ ID NO: 2383506 - DNA, 14 bp, Homo sapiens
ttggaccattttcc

SEQ ID NO: 2383507 - DNA, 22 bp, Homo sapiens
ttggagttcattcatattacaa

SEQ ID NO: 2383508 - DNA, 13 bp, Homo sapiens
ttggatttgtaat

SEQ ID NO: 2383509 - DNA, 22 bp, Homo sapiens
ttggattttatgttgacatttg

SEQ ID NO: 2383510 - DNA, 22 bp, Homo sapiens
ttgggcaatattctctgtacat

SEQ ID NO: 2383511 - DNA, 15 bp, Homo sapiens
ttgggtgatcattca

SEQ ID NO: 2383512 - DNA, 14 bp, Homo sapiens
ttggtaccttgcac

SEQ ID NO: 2383513 - DNA, 18 bp, Homo sapiens
ttggttctatgcaaataa

SEQ ID NO: 2383514 - DNA, 19 bp, Homo sapiens
ttgtaaactttgaaatata

SEQ ID NO: 2383515 - DNA, 13 bp, Homo sapiens
ttgtaatgtaact

SEQ ID NO: 2383516 - DNA, 14 bp, Homo sapiens
ttgtaatgtaactg

SEQ ID NO: 2383517 - DNA, 15 bp, Homo sapiens
ttgtaatgtaactgc

SEQ ID NO: 2383518 - DNA, 19 bp, Homo sapiens
ttgtcattttcattagcaa

SEQ ID NO: 2383519 - DNA, 20 bp, Homo sapiens
ttgtctaagaaacattggaa

SEQ ID NO: 2383520 - DNA, 23 bp, Homo sapiens
ttgtctaagaaacattggaagca

SEQ ID NO: 2383521 - DNA, 17 bp, Homo sapiens
ttgtctgccccaagttt

SEQ ID NO: 2383522 - DNA, 20 bp, Homo sapiens
ttgtctgccccaagttttgt

SEQ ID NO: 2383523 - DNA, 21 bp, Homo sapiens
ttgtgaaatttttcatatttt

SEQ ID NO: 2383524 - DNA, 19 bp, Homo sapiens
ttgtgagtttgtttctttg

SEQ ID NO: 2383525 - DNA, 13 bp, Homo sapiens
ttgttaatttgga

SEQ ID NO: 2383526 - DNA, 20 bp, Homo sapiens
ttgttaggccaaagacaaat

SEQ ID NO: 2383527 - DNA, 14 bp, Homo sapiens
ttgtttctttgaat

SEQ ID NO: 2383528 - DNA, 21 bp, Homo sapiens
ttgttttgttgcactgaagtt

SEQ ID NO: 2383529 - DNA, 12 bp, Homo sapiens
ttgttttttgag

SEQ ID NO: 2383530 - DNA, 13 bp, Homo sapiens
ttgttttttgagt

SEQ ID NO: 2383531 - DNA, 17 bp, Homo sapiens
tttaaaaagtattgcca

SEQ ID NO: 2383532 - DNA, 17 bp, Homo sapiens
tttaaaatactgtagat

SEQ ID NO: 2383533 - DNA, 20 bp, Homo sapiens
tttaaaatcttattaaagtt

SEQ ID NO: 2383534 - DNA, 14 bp, Homo sapiens
tttaagcagaattg

SEQ ID NO: 2383535 - DNA, 22 bp, Homo sapiens
tttaagctaggaaaagaaatct

SEQ ID NO: 2383536 - DNA, 13 bp, Homo sapiens
tttacaaaggctg

SEQ ID NO: 2383537 - DNA, 23 bp, Homo sapiens
tttacaaaggctgtattcagcaa

SEQ ID NO: 2383538 - DNA, 19 bp, Homo sapiens
tttagtggaccctgaaatg

SEQ ID NO: 2383539 - DNA, 19 bp, Homo sapiens
tttagttttattttctaaa

SEQ ID NO: 2383540 - DNA, 17 bp, Homo sapiens
tttataactgaaatact

SEQ ID NO: 2383541 - DNA, 21 bp, Homo sapiens
tttatatcttggcaggtagga

SEQ ID NO: 2383542 - DNA, 11 bp, Homo sapiens
tttatgttgac

SEQ ID NO: 2383543 - DNA, 14 bp, Homo sapiens
tttatgttgacatt

SEQ ID NO: 2383544 - DNA, 17 bp, Homo sapiens
tttatgttgacatttgt

SEQ ID NO: 2383545 - DNA, 14 bp, Homo sapiens
tttatgttttggtc

SEQ ID NO: 2383546 - DNA, 21 bp, Homo sapiens
tttcaaaaatctgaagattgt

SEQ ID NO: 2383547 - DNA, 23 bp, Homo sapiens
tttcaaaaatctgaagattgttt

SEQ ID NO: 2383548 - DNA, 13 bp, Homo sapiens
tttcaagaacttg

SEQ ID NO: 2383549 - DNA, 14 bp, Homo sapiens
tttcaagcttattt

SEQ ID NO: 2383550 - DNA, 18 bp, Homo sapiens
tttcaataaagtttgatc

SEQ ID NO: 2383551 - DNA, 17 bp, Homo sapiens
tttcacaaatattaaaa

SEQ ID NO: 2383552 - DNA, 18 bp, Homo sapiens
tttcacaaatattaaaaa

SEQ ID NO: 2383553 - DNA, 20 bp, Homo sapiens
tttcacaaatattaaaaagt

SEQ ID NO: 2383554 - DNA, 16 bp, Homo sapiens
tttcagatttgcacaa

SEQ ID NO: 2383555 - DNA, 22 bp, Homo sapiens
tttcagatttgcacaaaaagat

SEQ ID NO: 2383556 - DNA, 14 bp, Homo sapiens
tttcagcatacata

SEQ ID NO: 2383557 - DNA, 19 bp, Homo sapiens
tttcagctaggaacaaatc

SEQ ID NO: 2383558 - DNA, 13 bp, Homo sapiens
tttcagttcaaag

SEQ ID NO: 2383559 - DNA, 18 bp, Homo sapiens
tttcatattttaatttca

SEQ ID NO: 2383560 - DNA, 17 bp, Homo sapiens
tttccagtattttagtg

SEQ ID NO: 2383561 - DNA, 16 bp, Homo sapiens
tttccttacataaaca

SEQ ID NO: 2383562 - DNA, 14 bp, Homo sapiens
tttctaaagtactg

SEQ ID NO: 2383563 - DNA, 14 bp, Homo sapiens
tttctagttattta

SEQ ID NO: 2383564 - DNA, 12 bp, Homo sapiens
tttctgtataga

SEQ ID NO: 2383565 - DNA, 13 bp, Homo sapiens
tttgaaatatatg

SEQ ID NO: 2383566 - DNA, 21 bp, Homo sapiens
tttgaaatatatggtctaatg

SEQ ID NO: 2383567 - DNA, 22 bp, Homo sapiens
tttgaaatatatggtctaatgt

SEQ ID NO: 2383568 - DNA, 23 bp, Homo sapiens
tttgaggttggaaaatatctttg

SEQ ID NO: 2383569 - DNA, 13 bp, Homo sapiens
tttgataaatagt

SEQ ID NO: 2383570 - DNA, 19 bp, Homo sapiens
tttgatcttcctctgctaa

SEQ ID NO: 2383571 - DNA, 18 bp, Homo sapiens
attttttggtattggcca

SEQ ID NO: 2383572 - DNA, 15 bp, Homo sapiens
atttttttccttaca

SEQ ID NO: 2383573 - DNA, 21 bp, Homo sapiens
caaaaaaagttgtatgatctg

SEQ ID NO: 2383574 - DNA, 19 bp, Homo sapiens
caaaaagataccttaaaat

SEQ ID NO: 2383575 - DNA, 15 bp, Homo sapiens
caaaaatctgaagat

SEQ ID NO: 2383576 - DNA, 18 bp, Homo sapiens
caaaaatctgaagattgt

SEQ ID NO: 2383577 - DNA, 11 bp, Homo sapiens
caaaatgtaac

SEQ ID NO: 2383578 - DNA, 15 bp, Homo sapiens
caaaatgtaactgtt

SEQ ID NO: 2383579 - DNA, 14 bp, Homo sapiens
caaacattaatgtt

SEQ ID NO: 2383580 - DNA, 15 bp, Homo sapiens
caaacattaatgttg

SEQ ID NO: 2383581 - DNA, 17 bp, Homo sapiens
caaacattaatgttgat

SEQ ID NO: 2383582 - DNA, 18 bp, Homo sapiens
caaacattaatgttgatt

SEQ ID NO: 2383583 - DNA, 19 bp, Homo sapiens
caaacattaatgttgattt

SEQ ID NO: 2383584 - DNA, 15 bp, Homo sapiens
caaacattagtactt

SEQ ID NO: 2383585 - DNA, 18 bp, Homo sapiens
caaaccctgtcaaacatt

SEQ ID NO: 2383586 - DNA, 15 bp, Homo sapiens
caaactgcacatgat

SEQ ID NO: 2383587 - DNA, 19 bp, Homo sapiens
caaactgcacatgatttca

SEQ ID NO: 2383588 - DNA, 22 bp, Homo sapiens
caaactgcacatgatttcacaa

SEQ ID NO: 2383589 - DNA, 13 bp, Homo sapiens
caaagacaaatag

SEQ ID NO: 2383590 - DNA, 22 bp, Homo sapiens
caaagtcatgatgtttttaaaa

SEQ ID NO: 2383591 - DNA, 22 bp, Homo sapiens
caaatattaaaaagtcttttaa

SEQ ID NO: 2383592 - DNA, 13 bp, Homo sapiens
caaatcttcctgg

SEQ ID NO: 2383593 - DNA, 17 bp, Homo sapiens
caaatgattgcttttaa

SEQ ID NO: 2383594 - DNA, 20 bp, Homo sapiens
caaatgattgcttttaaaat

SEQ ID NO: 2383595 - DNA, 18 bp, Homo sapiens
caaatggagttggagttc

SEQ ID NO: 2383596 - DNA, 21 bp, Homo sapiens
caaatggagttggagttcatt

SEQ ID NO: 2383597 - DNA, 15 bp, Homo sapiens
caaatggtacaaaac

SEQ ID NO: 2383598 - DNA, 19 bp, Homo sapiens
caaattatgctaagaattt

SEQ ID NO: 2383599 - DNA, 21 bp, Homo sapiens
caacaaactgcacatgatttc

SEQ ID NO: 2383600 - DNA, 12 bp, Homo sapiens
caacaattttca

SEQ ID NO: 2383601 - DNA, 13 bp, Homo sapiens
caacaattttcag

SEQ ID NO: 2383602 - DNA, 15 bp, Homo sapiens
caacaattttcagat

SEQ ID NO: 2383603 - DNA, 20 bp, Homo sapiens
caacagattggattttatgt

SEQ ID NO: 2383604 - DNA, 17 bp, Homo sapiens
caacttttttttctttt

SEQ ID NO: 2383605 - DNA, 13 bp, Homo sapiens
caagaacttgttt

SEQ ID NO: 2383606 - DNA, 15 bp, Homo sapiens
caagcagtttcaata

SEQ ID NO: 2383607 - DNA, 16 bp, Homo sapiens
caagcagtttcaataa

SEQ ID NO: 2383608 - DNA, 20 bp, Homo sapiens
caagcagtttcaataaagtt

SEQ ID NO: 2383609 - DNA, 14 bp, Homo sapiens
caagcttattttgg

SEQ ID NO: 2383610 - DNA, 13 bp, Homo sapiens
caaggtagaatga

SEQ ID NO: 2383611 - DNA, 21 bp, Homo sapiens
caagttttgtgaaatttttca

SEQ ID NO: 2383612 - DNA, 14 bp, Homo sapiens
caataaagtttgat

SEQ ID NO: 2383613 - DNA, 16 bp, Homo sapiens
caatattctctgtaca

SEQ ID NO: 2383614 - DNA, 23 bp, Homo sapiens
caatatttgtgtgctaaacgtgt

SEQ ID NO: 2383615 - DNA, 15 bp, Homo sapiens
caatccttacaaatg

SEQ ID NO: 2383616 - DNA, 16 bp, Homo sapiens
caatccttacaaatga

SEQ ID NO: 2383617 - DNA, 20 bp, Homo sapiens
cacaaatattaaaaagtctt

SEQ ID NO: 2383618 - DNA, 14 bp, Homo sapiens
cacacatcatctgt

SEQ ID NO: 2383619 - DNA, 22 bp, Homo sapiens
cacacatcatctgtaagctgtt

SEQ ID NO: 2383620 - DNA, 21 bp, Homo sapiens
cacagtgtaccattaaaatat

SEQ ID NO: 2383621 - DNA, 15 bp, Homo sapiens
cacatcatctgtaag

SEQ ID NO: 2383622 - DNA, 19 bp, Homo sapiens
cacatcatctgtaagctgt

SEQ ID NO: 2383623 - DNA, 19 bp, Homo sapiens
cacatgatttcacaaatat

SEQ ID NO: 2383624 - DNA, 15 bp, Homo sapiens
cacatgttttcaaat

SEQ ID NO: 2383625 - DNA, 16 bp, Homo sapiens
cactaaatgttaaaga

SEQ ID NO: 2383626 - DNA, 20 bp, Homo sapiens
cactaagtctcttttttaca

SEQ ID NO: 2383627 - DNA, 21 bp, Homo sapiens
cactaagtctcttttttacaa

SEQ ID NO: 2383628 - DNA, 13 bp, Homo sapiens
cactctaagatgt

SEQ ID NO: 2383629 - DNA, 16 bp, Homo sapiens
cactctaagatgttat

SEQ ID NO: 2383630 - DNA, 21 bp, Homo sapiens
cactctaagatgttatatttt

SEQ ID NO: 2383631 - DNA, 15 bp, Homo sapiens
cactgaagtttgata

SEQ ID NO: 2383632 - DNA, 13 bp, Homo sapiens
cactgaatctgta

SEQ ID NO: 2383633 - DNA, 14 bp, Homo sapiens
cactgaatctgtac

SEQ ID NO: 2383634 - DNA, 17 bp, Homo sapiens
cactgaatctgtacaga

SEQ ID NO: 2383635 - DNA, 21 bp, Homo sapiens
cacttcagggcagattttagt

SEQ ID NO: 2383636 - DNA, 23 bp, Homo sapiens
cacttcagggcagattttagttt

SEQ ID NO: 2383637 - DNA, 16 bp, Homo sapiens
cacttttccagtattt

SEQ ID NO: 2383638 - DNA, 20 bp, Homo sapiens
cagaaattggtaccttgcac

SEQ ID NO: 2383639 - DNA, 21 bp, Homo sapiens
cagagccgtaaaaactgaagt

SEQ ID NO: 2383640 - DNA, 18 bp, Homo sapiens
cagatcaaattaatacaa

SEQ ID NO: 2383641 - DNA, 19 bp, Homo sapiens
cagatcaaattaatacaat

SEQ ID NO: 2383642 - DNA, 12 bp, Homo sapiens
cagattggattt

SEQ ID NO: 2383643 - DNA, 15 bp, Homo sapiens
cagattggattttat

SEQ ID NO: 2383644 - DNA, 20 bp, Homo sapiens
cagatttgcacaaaaagata

SEQ ID NO: 2383645 - DNA, 12 bp, Homo sapiens
cagattttagtt

SEQ ID NO: 2383646 - DNA, 18 bp, Homo sapiens
cagcaaggcgctaacttg

SEQ ID NO: 2383647 - DNA, 20 bp, Homo sapiens
cagctaggaacaaatcttcc

SEQ ID NO: 2383648 - DNA, 21 bp, Homo sapiens
cagctaggaacaaatcttcct

SEQ ID NO: 2383649 - DNA, 24 bp, Homo sapiens
cagggcatgaaatgaacacaaatt

SEQ ID NO: 2383650 - DNA, 13 bp, Homo sapiens
caggtactttgtc

SEQ ID NO: 2383651 - DNA, 14 bp, Homo sapiens
caggttaaatgttt

SEQ ID NO: 2383652 - DNA, 20 bp, Homo sapiens
caggttaaatgttttgtaaa

SEQ ID NO: 2383653 - DNA, 14 bp, Homo sapiens
cagtataaagaata

SEQ ID NO: 2383654 - DNA, 15 bp, Homo sapiens
cagtataaagaatag

SEQ ID NO: 2383655 - DNA, 21 bp, Homo sapiens
cagtataaagaataggacttg

SEQ ID NO: 2383656 - DNA, 23 bp, Homo sapiens
cagtattttagtggaccctgaaa

SEQ ID NO: 2383657 - DNA, 18 bp, Homo sapiens
cagtgatattctttgtta

SEQ ID NO: 2383658 - DNA, 22 bp, Homo sapiens
cagtgtaccattaaaatatgca

SEQ ID NO: 2383659 - DNA, 21 bp, Homo sapiens
cagtgttttgacctttgatac

SEQ ID NO: 2383660 - DNA, 23 bp, Homo sapiens
cagttcaaagtcatgatgttttt

SEQ ID NO: 2383661 - DNA, 13 bp, Homo sapiens
cagtttatgtttt

SEQ ID NO: 2383662 - DNA, 17 bp, Homo sapiens
cagtttcaataaagttt

SEQ ID NO: 2383663 - DNA, 18 bp, Homo sapiens
cataattctgaagttata

SEQ ID NO: 2383664 - DNA, 20 bp, Homo sapiens
agaaagtgttctgttacaaa

SEQ ID NO: 2383665 - DNA, 19 bp, Homo sapiens
agaaatctatagaaagtgt

SEQ ID NO: 2383666 - DNA, 21 bp, Homo sapiens
agaaatctatagaaagtgttc

SEQ ID NO: 2383667 - DNA, 23 bp, Homo sapiens
agaaattggtaccttgcacacat

SEQ ID NO: 2383668 - DNA, 14 bp, Homo sapiens
agaactatcttcat

SEQ ID NO: 2383669 - DNA, 18 bp, Homo sapiens
agaactatcttcatctga

SEQ ID NO: 2383670 - DNA, 16 bp, Homo sapiens
agaagtcttcatgaaa

SEQ ID NO: 2383671 - DNA, 15 bp, Homo sapiens
agaataggacttgtt

SEQ ID NO: 2383672 - DNA, 20 bp, Homo sapiens
agaatgaccttgtaatgtaa

SEQ ID NO: 2383673 - DNA, 15 bp, Homo sapiens
agaatgactgatgtt

SEQ ID NO: 2383674 - DNA, 18 bp, Homo sapiens
agaatgcatgctttccat

SEQ ID NO: 2383675 - DNA, 12 bp, Homo sapiens
agaattggaaaa

SEQ ID NO: 2383676 - DNA, 18 bp, Homo sapiens
agaattggaaaagactaa

SEQ ID NO: 2383677 - DNA, 21 bp, Homo sapiens
agacaggagaagaaagaacta

SEQ ID NO: 2383678 - DNA, 14 bp, Homo sapiens
agactgtgtctgta

SEQ ID NO: 2383679 - DNA, 13 bp, Homo sapiens
agacttctgtttt

SEQ ID NO: 2383680 - DNA, 18 bp, Homo sapiens
agacttctgttttcaatc

SEQ ID NO: 2383681 - DNA, 12 bp, Homo sapiens
agagaaatacag

SEQ ID NO: 2383682 - DNA, 18 bp, Homo sapiens
agagagatgtgtaatttt

SEQ ID NO: 2383683 - DNA, 16 bp, Homo sapiens
agaggctaaaatgttt

SEQ ID NO: 2383684 - DNA, 17 bp, Homo sapiens
agaggctaaaatgtttt

SEQ ID NO: 2383685 - DNA, 16 bp, Homo sapiens
agataagttggaaaca

SEQ ID NO: 2383686 - DNA, 18 bp, Homo sapiens
agataccttaaaatttga

SEQ ID NO: 2383687 - DNA, 22 bp, Homo sapiens
agataccttaaaatttgaaaca

SEQ ID NO: 2383688 - DNA, 17 bp, Homo sapiens
agatcaaattaatacaa

SEQ ID NO: 2383689 - DNA, 23 bp, Homo sapiens
agatgtagcaaaccctgtcaaac

SEQ ID NO: 2383690 - DNA, 15 bp, Homo sapiens
agattggattttatg

SEQ ID NO: 2383691 - DNA, 16 bp, Homo sapiens
agattgtttatctaga

SEQ ID NO: 2383692 - DNA, 21 bp, Homo sapiens
agattgtttatctagatgtaa

SEQ ID NO: 2383693 - DNA, 22 bp, Homo sapiens
agattgtttatctagatgtaaa

SEQ ID NO: 2383694 - DNA, 12 bp, Homo sapiens
agatttgcacaa

SEQ ID NO: 2383695 - DNA, 17 bp, Homo sapiens
agatttgcacaaaaaga

SEQ ID NO: 2383696 - DNA, 20 bp, Homo sapiens
agattttagttttattttct

SEQ ID NO: 2383697 - DNA, 22 bp, Homo sapiens
agattttagttttattttctaa

SEQ ID NO: 2383698 - DNA, 21 bp, Homo sapiens
agcaaaccctgtcaaacatta

SEQ ID NO: 2383699 - DNA, 16 bp, Homo sapiens
agcaacaattttcaga

SEQ ID NO: 2383700 - DNA, 17 bp, Homo sapiens
agcaaggcgctaacttg

SEQ ID NO: 2383701 - DNA, 20 bp, Homo sapiens
agcaaggcgctaacttgctt

SEQ ID NO: 2383702 - DNA, 13 bp, Homo sapiens
agcagaattggaa

SEQ ID NO: 2383703 - DNA, 22 bp, Homo sapiens
agcaggttaaatgttttgtaaa

SEQ ID NO: 2383704 - DNA, 15 bp, Homo sapiens
agcagtgatattctt

SEQ ID NO: 2383705 - DNA, 19 bp, Homo sapiens
agcagtgatattctttgtt

SEQ ID NO: 2383706 - DNA, 17 bp, Homo sapiens
agcagtttcaataaagt

SEQ ID NO: 2383707 - DNA, 15 bp, Homo sapiens
agcatataaaatggc

SEQ ID NO: 2383708 - DNA, 17 bp, Homo sapiens
agccgtaaaaactgaag

SEQ ID NO: 2383709 - DNA, 20 bp, Homo sapiens
agccgtaaaaactgaagttc

SEQ ID NO: 2383710 - DNA, 24 bp, Homo sapiens
agctgtttggttttaaaatactgt

SEQ ID NO: 2383711 - DNA, 22 bp, Homo sapiens
agctttttttttttaattttgt

SEQ ID NO: 2383712 - DNA, 15 bp, Homo sapiens
aggaaaaatatgtga

SEQ ID NO: 2383713 - DNA, 16 bp, Homo sapiens
aggaaaaatatgtgaa

SEQ ID NO: 2383714 - DNA, 15 bp, Homo sapiens
aggaaaagaaatcta

SEQ ID NO: 2383715 - DNA, 16 bp, Homo sapiens
aggaaaagaaatctat

SEQ ID NO: 2383716 - DNA, 13 bp, Homo sapiens
aggaacaaatctt

SEQ ID NO: 2383717 - DNA, 17 bp, Homo sapiens
aggaacaaatcttcctg

SEQ ID NO: 2383718 - DNA, 21 bp, Homo sapiens
aggaccttcactctaagatgt

SEQ ID NO: 2383719 - DNA, 16 bp, Homo sapiens
aggcagtataaagaat

SEQ ID NO: 2383720 - DNA, 17 bp, Homo sapiens
aggccaaagacaaatag

SEQ ID NO: 2383721 - DNA, 13 bp, Homo sapiens
aggcgctaacttg

SEQ ID NO: 2383722 - DNA, 16 bp, Homo sapiens
aggctaaaatgttttc

SEQ ID NO: 2383723 - DNA, 18 bp, Homo sapiens
aggctaaaatgttttcag

SEQ ID NO: 2383724 - DNA, 17 bp, Homo sapiens
agggaagataagttgga

SEQ ID NO: 2383725 - DNA, 18 bp, Homo sapiens
agggaagataagttggaa

SEQ ID NO: 2383726 - DNA, 19 bp, Homo sapiens
agggaagataagttggaaa

SEQ ID NO: 2383727 - DNA, 12 bp, Homo sapiens
agggcatgaaat

SEQ ID NO: 2383728 - DNA, 13 bp, Homo sapiens
agggcatgaaatg

SEQ ID NO: 2383729 - DNA, 16 bp, Homo sapiens
aggggtgctttgcctg

SEQ ID NO: 2383730 - DNA, 23 bp, Homo sapiens
aggtactttgtctaagaaacatt

SEQ ID NO: 2383731 - DNA, 18 bp, Homo sapiens
aggtagaatgaccttgta

SEQ ID NO: 2383732 - DNA, 20 bp, Homo sapiens
aggtaggaatattatatttg

SEQ ID NO: 2383733 - DNA, 21 bp, Homo sapiens
aggtcatttccatgtatgcat

SEQ ID NO: 2383734 - DNA, 11 bp, Homo sapiens
aggttaaatgt

SEQ ID NO: 2383735 - DNA, 12 bp, Homo sapiens
aggttaaatgtt

SEQ ID NO: 2383736 - DNA, 19 bp, Homo sapiens
aggttaggcagtataaaga

SEQ ID NO: 2383737 - DNA, 17 bp, Homo sapiens
aggtttcgaaatgtaaa

SEQ ID NO: 2383738 - DNA, 20 bp, Homo sapiens
aggtttcgaaatgtaaatat

SEQ ID NO: 2383739 - DNA, 16 bp, Homo sapiens
agtacattctcagttt

SEQ ID NO: 2383740 - DNA, 17 bp, Homo sapiens
agtacattctcagtttt

SEQ ID NO: 2383741 - DNA, 13 bp, Homo sapiens
agtactttataga

SEQ ID NO: 2383742 - DNA, 19 bp, Homo sapiens
agtactttatagaagaatg

SEQ ID NO: 2383743 - DNA, 15 bp, Homo sapiens
agtaggcaagatggc

SEQ ID NO: 2383744 - DNA, 14 bp, Homo sapiens
agtattgccaaaca

SEQ ID NO: 2383745 - DNA, 17 bp, Homo sapiens
agtatttgaaaacagaa

SEQ ID NO: 2383746 - DNA, 13 bp, Homo sapiens
agtcatgatgttt

SEQ ID NO: 2383747 - DNA, 20 bp, Homo sapiens
agtcatgatgtttttaaaat

SEQ ID NO: 2383748 - DNA, 23 bp, Homo sapiens
agtcatgatgtttttaaaatctt

SEQ ID NO: 2383749 - DNA, 16 bp, Homo sapiens
agtctcttttttacaa

SEQ ID NO: 2383750 - DNA, 17 bp, Homo sapiens
agtctcttttttacaaa

SEQ ID NO: 2383751 - DNA, 18 bp, Homo sapiens
agtctcttttttacaaag

SEQ ID NO: 2383752 - DNA, 22 bp, Homo sapiens
agtctcttttttacaaaggctg

SEQ ID NO: 2383753 - DNA, 17 bp, Homo sapiens
agtcttcatgaaatgct

SEQ ID NO: 2383754 - DNA, 18 bp, Homo sapiens
agtcttttaaaaagtatt

SEQ ID NO: 2383755 - DNA, 20 bp, Homo sapiens
agtcttttaaaaagtattgc

SEQ ID NO: 2383756 - DNA, 15 bp, Homo sapiens
agtgatattctttgt

SEQ ID NO: 2383757 - DNA, 17 bp, Homo sapiens
agtgatattctttgtta

SEQ ID NO: 2383758 - DNA, 16 bp, Homo sapiens
agtggaccctgaaatg

SEQ ID NO: 2383759 - DNA, 17 bp, Homo sapiens
agtgttctgttacaaaa

SEQ ID NO: 2383760 - DNA, 18 bp, Homo sapiens
agtgttctgttacaaaat

SEQ ID NO: 2383761 - DNA, 16 bp, Homo sapiens
agttagcatacacatt

SEQ ID NO: 2383762 - DNA, 16 bp, Homo sapiens
agttagcctttatcta

SEQ ID NO: 2383763 - DNA, 15 bp, Homo sapiens
agttcaaagtcatga

SEQ ID NO: 2383764 - DNA, 20 bp, Homo sapiens
agttcaaagtcatgatgttt

SEQ ID NO: 2383765 - DNA, 14 bp, Homo sapiens
agttcattcatatt

SEQ ID NO: 2383766 - DNA, 15 bp, Homo sapiens
agttcattcatatta

SEQ ID NO: 2383767 - DNA, 21 bp, Homo sapiens
agttctgcctctgatgtattt

SEQ ID NO: 2383768 - DNA, 21 bp, Homo sapiens
agttgatattctaaaatataa

SEQ ID NO: 2383769 - DNA, 19 bp, Homo sapiens
agttggaaacactaaatgt

SEQ ID NO: 2383770 - DNA, 20 bp, Homo sapiens
agttggaaacactaaatgtt

SEQ ID NO: 2383771 - DNA, 19 bp, Homo sapiens
agttggagttcattcatat

SEQ ID NO: 2383772 - DNA, 20 bp, Homo sapiens
agttggagttcattcatatt

SEQ ID NO: 2383773 - DNA, 18 bp, Homo sapiens
agttgtatgatctgtgcc

SEQ ID NO: 2383774 - DNA, 12 bp, Homo sapiens
agtttatgtttt

SEQ ID NO: 2383775 - DNA, 15 bp, Homo sapiens
agtttcaaaaatctg

SEQ ID NO: 2383776 - DNA, 18 bp, Homo sapiens
agtttcaataaagtttga

SEQ ID NO: 2383777 - DNA, 14 bp, Homo sapiens
agtttgatcttcct

SEQ ID NO: 2383778 - DNA, 16 bp, Homo sapiens
agtttgtttctttgaa

SEQ ID NO: 2383779 - DNA, 18 bp, Homo sapiens
agtttgtttctttgaatt

SEQ ID NO: 2383780 - DNA, 23 bp, Homo sapiens
agtttgtttctttgaattttcat

SEQ ID NO: 2383781 - DNA, 14 bp, Homo sapiens
agttttattttcca

SEQ ID NO: 2383782 - DNA, 13 bp, Homo sapiens
agttttgtgaaat

SEQ ID NO: 2383783 - DNA, 19 bp, Homo sapiens
agttttgtgaaatttttca

SEQ ID NO: 2383784 - DNA, 12 bp, Homo sapiens
ataaaattgaag

SEQ ID NO: 2383785 - DNA, 22 bp, Homo sapiens
ataaacatcaggttaggcagta

SEQ ID NO: 2383786 - DNA, 16 bp, Homo sapiens
ataaaccagatcaaat

SEQ ID NO: 2383787 - DNA, 13 bp, Homo sapiens
ataacaacttttt

SEQ ID NO: 2383788 - DNA, 14 bp, Homo sapiens
ataacaactttttt

SEQ ID NO: 2383789 - DNA, 12 bp, Homo sapiens
ataactgaaata

SEQ ID NO: 2383790 - DNA, 19 bp, Homo sapiens
ataagttggaaacactaaa

SEQ ID NO: 2383791 - DNA, 21 bp, Homo sapiens
ataagttggaaacactaaatg

SEQ ID NO: 2383792 - DNA, 14 bp, Homo sapiens
ataatcctgcaaag

SEQ ID NO: 2383793 - DNA, 18 bp, Homo sapiens
ataattctgaagttatat

SEQ ID NO: 2383794 - DNA, 16 bp, Homo sapiens
atacaaacaagcatat

SEQ ID NO: 2383795 - DNA, 15 bp, Homo sapiens
ataccttaaaatttg

SEQ ID NO: 2383796 - DNA, 18 bp, Homo sapiens
ataccttaaaatttgaaa

SEQ ID NO: 2383797 - DNA, 19 bp, Homo sapiens
ataccttaaaatttgaaac

SEQ ID NO: 2383798 - DNA, 23 bp, Homo sapiens
ataccttaaaatttgaaacattg

SEQ ID NO: 2383799 - DNA, 18 bp, Homo sapiens
atactgtagataattaac

SEQ ID NO: 2383800 - DNA, 15 bp, Homo sapiens
atagaaagtgttctg

SEQ ID NO: 2383801 - DNA, 19 bp, Homo sapiens
atagaaagtgttctgttac

SEQ ID NO: 2383802 - DNA, 16 bp, Homo sapiens
atagaagaatgcatgc

SEQ ID NO: 2383803 - DNA, 14 bp, Homo sapiens
atagaagtcttcat

SEQ ID NO: 2383804 - DNA, 15 bp, Homo sapiens
atagaagtcttcatg

SEQ ID NO: 2383805 - DNA, 17 bp, Homo sapiens
atagaagtcttcatgaa

SEQ ID NO: 2383806 - DNA, 18 bp, Homo sapiens
atagaagtcttcatgaaa

SEQ ID NO: 2383807 - DNA, 23 bp, Homo sapiens
atagaagtcttcatgaaatgcta

SEQ ID NO: 2383808 - DNA, 17 bp, Homo sapiens
atagctcaaatattgaa

SEQ ID NO: 2383809 - DNA, 23 bp, Homo sapiens
ataggaagttagcctttatctac

SEQ ID NO: 2383810 - DNA, 16 bp, Homo sapiens
ataggacttgtttttg

SEQ ID NO: 2383811 - DNA, 13 bp, Homo sapiens
atagtatttgaaa

SEQ ID NO: 2383812 - DNA, 14 bp, Homo sapiens
atagtatttgaaaa

SEQ ID NO: 2383813 - DNA, 22 bp, Homo sapiens
atagtatttgaaaacagaaatt

SEQ ID NO: 2383814 - DNA, 13 bp, Homo sapiens
atagttgaagatt

SEQ ID NO: 2383815 - DNA, 23 bp, Homo sapiens
atataaaatggcaacaaactgca

SEQ ID NO: 2383816 - DNA, 18 bp, Homo sapiens
atatagcatttatggtaa

SEQ ID NO: 2383817 - DNA, 16 bp, Homo sapiens
atatatggtctaatgt

SEQ ID NO: 2383818 - DNA, 19 bp, Homo sapiens
atatatggtctaatgttta

SEQ ID NO: 2383819 - DNA, 13 bp, Homo sapiens
atatattttgtat

SEQ ID NO: 2383820 - DNA, 20 bp, Homo sapiens
atatattttgtatgcaagca

SEQ ID NO: 2383821 - DNA, 15 bp, Homo sapiens
atatcttggcaggta

SEQ ID NO: 2383822 - DNA, 12 bp, Homo sapiens
atattaatacag

SEQ ID NO: 2383823 - DNA, 13 bp, Homo sapiens
atattacaatatt

SEQ ID NO: 2383824 - DNA, 16 bp, Homo sapiens
atattagaaaactttg

SEQ ID NO: 2383825 - DNA, 17 bp, Homo sapiens
atattagaaaactttgt

SEQ ID NO: 2383826 - DNA, 18 bp, Homo sapiens
atattagaaaactttgtt

SEQ ID NO: 2383827 - DNA, 12 bp, Homo sapiens
atattatatttg

SEQ ID NO: 2383828 - DNA, 14 bp, Homo sapiens
atattctttgttaa

SEQ ID NO: 2383829 - DNA, 23 bp, Homo sapiens
atatttcctataccatttccgta

SEQ ID NO: 2383830 - DNA, 17 bp, Homo sapiens
atatttggatgcagagt

SEQ ID NO: 2383831 - DNA, 23 bp, Homo sapiens
atatttgtgtgctaaacgtgtat

SEQ ID NO: 2383832 - DNA, 15 bp, Homo sapiens
atattttaatttcaa

SEQ ID NO: 2383833 - DNA, 14 bp, Homo sapiens
atattttgtatgca

SEQ ID NO: 2383834 - DNA, 16 bp, Homo sapiens
atattttgtatgcaag

SEQ ID NO: 2383835 - DNA, 17 bp, Homo sapiens
atatttttcttaaaaag

SEQ ID NO: 2383836 - DNA, 14 bp, Homo sapiens
atatttttttcctt

SEQ ID NO: 2383837 - DNA, 17 bp, Homo sapiens
atatttttttccttaca

SEQ ID NO: 2383838 - DNA, 17 bp, Homo sapiens
atcaggttaggcagtat

SEQ ID NO: 2383839 - DNA, 16 bp, Homo sapiens
atcatctgtaagctgt

SEQ ID NO: 2383840 - DNA, 18 bp, Homo sapiens
atccttacaaatgattgc

SEQ ID NO: 2383841 - DNA, 15 bp, Homo sapiens
atcggttaacaaata

SEQ ID NO: 2383842 - DNA, 16 bp, Homo sapiens
atctaccaactttcaa

SEQ ID NO: 2383843 - DNA, 17 bp, Homo sapiens
atctaccaactttcaag

SEQ ID NO: 2383844 - DNA, 17 bp, Homo sapiens
atctagatgtaaatttt

SEQ ID NO: 2383845 - DNA, 13 bp, Homo sapiens
atctatagaaagt

SEQ ID NO: 2383846 - DNA, 16 bp, Homo sapiens
atctatagaaagtgtt

SEQ ID NO: 2383847 - DNA, 17 bp, Homo sapiens
atctcagccctgcaact

SEQ ID NO: 2383848 - DNA, 13 bp, Homo sapiens
atctgaagattgt

SEQ ID NO: 2383849 - DNA, 22 bp, Homo sapiens
atctgagagaggctaaaatgtt

SEQ ID NO: 2383850 - DNA, 23 bp, Homo sapiens
atctggtgtttcagcatacataa

SEQ ID NO: 2383851 - DNA, 17 bp, Homo sapiens
atctgtaagctgtttgg

SEQ ID NO: 2383852 - DNA, 13 bp, Homo sapiens
atcttattaaagt

SEQ ID NO: 2383853 - DNA, 14 bp, Homo sapiens
atcttattaaagtt

SEQ ID NO: 2383854 - DNA, 15 bp, Homo sapiens
atcttattaaagttt

SEQ ID NO: 2383855 - DNA, 16 bp, Homo sapiens
atcttattaaagtttc

SEQ ID NO: 2383856 - DNA, 18 bp, Homo sapiens
atcttattaaagtttcaa

SEQ ID NO: 2383857 - DNA, 23 bp, Homo sapiens
atcttcatctgagagaggctaaa

SEQ ID NO: 2383858 - DNA, 18 bp, Homo sapiens
atcttcctctgctaaatt

SEQ ID NO: 2383859 - DNA, 18 bp, Homo sapiens
atcttcctggtcgaaagt

SEQ ID NO: 2383860 - DNA, 20 bp, Homo sapiens
atcttcctggtcgaaagtta

SEQ ID NO: 2383861 - DNA, 22 bp, Homo sapiens
atcttcctggtcgaaagttagt

SEQ ID NO: 2383862 - DNA, 19 bp, Homo sapiens
atcttggcaggtaggaata

SEQ ID NO: 2383863 - DNA, 14 bp, Homo sapiens
atgaaatgctatgt

SEQ ID NO: 2383864 - DNA, 13 bp, Homo sapiens
atgaacacaaatt

SEQ ID NO: 2383865 - DNA, 15 bp, Homo sapiens
atgaacacaaattat

SEQ ID NO: 2383866 - DNA, 16 bp, Homo sapiens
atgaacacaaattatg

SEQ ID NO: 2383867 - DNA, 20 bp, Homo sapiens
atgaacacaaattatgctaa

SEQ ID NO: 2383868 - DNA, 17 bp, Homo sapiens
atgaagattcatgttta

SEQ ID NO: 2383869 - DNA, 13 bp, Homo sapiens
atgaccaatttta

SEQ ID NO: 2383870 - DNA, 20 bp, Homo sapiens
atgaccaattttaacttaga

SEQ ID NO: 2383871 - DNA, 15 bp, Homo sapiens
atgatctgtgccttt

SEQ ID NO: 2383872 - DNA, 19 bp, Homo sapiens
atgatctgtgcctttttta

SEQ ID NO: 2383873 - DNA, 20 bp, Homo sapiens
atgatgtttttaaaatctta

SEQ ID NO: 2383874 - DNA, 22 bp, Homo sapiens
atgatgtttttaaaatcttatt

SEQ ID NO: 2383875 - DNA, 14 bp, Homo sapiens
atgattgcttttaa

SEQ ID NO: 2383876 - DNA, 12 bp, Homo sapiens
atgatttcacaa

SEQ ID NO: 2383877 - DNA, 15 bp, Homo sapiens
atgatttcacaaata

SEQ ID NO: 2383878 - DNA, 17 bp, Homo sapiens
atgatttcacaaatatt

SEQ ID NO: 2383879 - DNA, 18 bp, Homo sapiens
atgatttcacaaatatta

SEQ ID NO: 2383880 - DNA, 16 bp, Homo sapiens
atgcaagcagtttcaa

SEQ ID NO: 2383881 - DNA, 18 bp, Homo sapiens
atgcaatccttacaaatg

SEQ ID NO: 2383882 - DNA, 15 bp, Homo sapiens
atgcatgctttccat

SEQ ID NO: 2383883 - DNA, 17 bp, Homo sapiens
atgcatgctttccatat

SEQ ID NO: 2383884 - DNA, 19 bp, Homo sapiens
atgcatgctttccatattt

SEQ ID NO: 2383885 - DNA, 12 bp, Homo sapiens
atgcctgctctt

SEQ ID NO: 2383886 - DNA, 14 bp, Homo sapiens
atgctatgtcattt

SEQ ID NO: 2383887 - DNA, 23 bp, Homo sapiens
atgctttccatatttttttcctt

SEQ ID NO: 2383888 - DNA, 14 bp, Homo sapiens
atggcaacaaactg

SEQ ID NO: 2383889 - DNA, 17 bp, Homo sapiens
atggcaacaaactgcac

SEQ ID NO: 2383890 - DNA, 19 bp, Homo sapiens
atggcaacaaactgcacat

SEQ ID NO: 2383891 - DNA, 20 bp, Homo sapiens
atggcaacaaactgcacatg

SEQ ID NO: 2383892 - DNA, 15 bp, Homo sapiens
atggcacagggcatg

SEQ ID NO: 2383893 - DNA, 14 bp, Homo sapiens
atgtaactgctctt

SEQ ID NO: 2383894 - DNA, 17 bp, Homo sapiens
atgtaactgttaccatt

SEQ ID NO: 2383895 - DNA, 23 bp, Homo sapiens
atgtaactgttaccattggaaat

SEQ ID NO: 2383896 - DNA, 23 bp, Homo sapiens
atgtagcaaaccctgtcaaacat

SEQ ID NO: 2383897 - DNA, 17 bp, Homo sapiens
atgtatagtatttgaaa

SEQ ID NO: 2383898 - DNA, 18 bp, Homo sapiens
atgtatagtatttgaaaa

SEQ ID NO: 2383899 - DNA, 17 bp, Homo sapiens
atgtatgcataataatc

SEQ ID NO: 2383900 - DNA, 14 bp, Homo sapiens
atgtattttgtgag

SEQ ID NO: 2383901 - DNA, 23 bp, Homo sapiens
atgtattttgtgagtttgtttct

SEQ ID NO: 2383902 - DNA, 11 bp, Homo sapiens
atgtcctgtgt

SEQ ID NO: 2383903 - DNA, 16 bp, Homo sapiens
atgtgaattactaact

SEQ ID NO: 2383904 - DNA, 18 bp, Homo sapiens
atgtgaattactaacttc

SEQ ID NO: 2383905 - DNA, 13 bp, Homo sapiens
atgtgacatttgt

SEQ ID NO: 2383906 - DNA, 23 bp, Homo sapiens
atgtgacatttgtcattttcatt

SEQ ID NO: 2383907 - DNA, 12 bp, Homo sapiens
atgtgtaatttt

SEQ ID NO: 2383908 - DNA, 15 bp, Homo sapiens
atgtgtaatttttct

SEQ ID NO: 2383909 - DNA, 18 bp, Homo sapiens
atgtgtaatttttctgta

SEQ ID NO: 2383910 - DNA, 22 bp, Homo sapiens
atgtgtaatttttctgtataga

SEQ ID NO: 2383911 - DNA, 19 bp, Homo sapiens
atgtgtgtgatgtgacatt

SEQ ID NO: 2383912 - DNA, 23 bp, Homo sapiens
atgttatatttttcttaaaaagt

SEQ ID NO: 2383913 - DNA, 14 bp, Homo sapiens
atgttctgtagcaa

SEQ ID NO: 2383914 - DNA, 12 bp, Homo sapiens
atgttgacattt

SEQ ID NO: 2383915 - DNA, 16 bp, Homo sapiens
atgttgacatttgttt

SEQ ID NO: 2383916 - DNA, 21 bp, Homo sapiens
atgttgatgcaatccttacaa

SEQ ID NO: 2383917 - DNA, 16 bp, Homo sapiens
atgtttaagcagaatt

SEQ ID NO: 2383918 - DNA, 12 bp, Homo sapiens
atgttttcagct

SEQ ID NO: 2383919 - DNA, 12 bp, Homo sapiens
atgtttttaaaa

SEQ ID NO: 2383920 - DNA, 16 bp, Homo sapiens
atgtttttcagttcaa

SEQ ID NO: 2383921 - DNA, 17 bp, Homo sapiens
atgtttttcagttcaaa

SEQ ID NO: 2383922 - DNA, 22 bp, Homo sapiens
atgtttttcagttcaaagtcat

SEQ ID NO: 2383923 - DNA, 14 bp, Homo sapiens
attaaaaagtcttt

SEQ ID NO: 2383924 - DNA, 15 bp, Homo sapiens
attaaaaagtctttt

SEQ ID NO: 2383925 - DNA, 18 bp, Homo sapiens
attaaaaagtcttttaaa

SEQ ID NO: 2383926 - DNA, 17 bp, Homo sapiens
attaaaggtatacaaat

SEQ ID NO: 2383927 - DNA, 13 bp, Homo sapiens
attaaagtttcaa

SEQ ID NO: 2383928 - DNA, 19 bp, Homo sapiens
attaaagtttcaaaaatct

SEQ ID NO: 2383929 - DNA, 14 bp, Homo sapiens
attactaacttcta

SEQ ID NO: 2383930 - DNA, 16 bp, Homo sapiens
attactaacttctaaa

SEQ ID NO: 2383931 - DNA, 12 bp, Homo sapiens
attagaaaactt

SEQ ID NO: 2383932 - DNA, 16 bp, Homo sapiens
attagaaaactttgtt

SEQ ID NO: 2383933 - DNA, 16 bp, Homo sapiens
attagcaaaaaaagtt

SEQ ID NO: 2383934 - DNA, 19 bp, Homo sapiens
attagcaaaaaaagttgta

SEQ ID NO: 2383935 - DNA, 18 bp, Homo sapiens
attagtactttatagaag

SEQ ID NO: 2383936 - DNA, 16 bp, Homo sapiens
attatatttggatgca

SEQ ID NO: 2383937 - DNA, 15 bp, Homo sapiens
attcaaagatgtgat

SEQ ID NO: 2383938 - DNA, 16 bp, Homo sapiens
attcacatgttttcaa

SEQ ID NO: 2383939 - DNA, 16 bp, Homo sapiens
attcaccagtacattc

SEQ ID NO: 2383940 - DNA, 23 bp, Homo sapiens
attcagcaaggcgctaacttgct

SEQ ID NO: 2383941 - DNA, 12 bp, Homo sapiens
attcatgtaaca

SEQ ID NO: 2383942 - DNA, 16 bp, Homo sapiens
attcatgtaacactgt

SEQ ID NO: 2383943 - DNA, 19 bp, Homo sapiens
attccatattagaaaactt

SEQ ID NO: 2383944 - DNA, 23 bp, Homo sapiens
attccatattagaaaactttgtt

SEQ ID NO: 2383945 - DNA, 16 bp, Homo sapiens
attctaaaatataaca

SEQ ID NO: 2383946 - DNA, 17 bp, Homo sapiens
attctctgtacatatta

SEQ ID NO: 2383947 - DNA, 20 bp, Homo sapiens
attctgaagttatatttcct

SEQ ID NO: 2383948 - DNA, 16 bp, Homo sapiens
attctgggaatgtata

SEQ ID NO: 2383949 - DNA, 19 bp, Homo sapiens
attctgggaatgtatagta

SEQ ID NO: 2383950 - DNA, 21 bp, Homo sapiens
attcttattccatattagaaa

SEQ ID NO: 2383951 - DNA, 14 bp, Homo sapiens
attgaatgtttaaa

SEQ ID NO: 2383952 - DNA, 21 bp, Homo sapiens
attgagagagatgtgtaattt

SEQ ID NO: 2383953 - DNA, 20 bp, Homo sapiens
attgaggaaaaatatgtgaa

SEQ ID NO: 2383954 - DNA, 12 bp, Homo sapiens
attgatgttgat

SEQ ID NO: 2383955 - DNA, 16 bp, Homo sapiens
attgatgttgatgcaa

SEQ ID NO: 2383956 - DNA, 13 bp, Homo sapiens
attgccaaacatt

SEQ ID NO: 2383957 - DNA, 21 bp, Homo sapiens
attgccaaacattaatgttga

SEQ ID NO: 2383958 - DNA, 15 bp, Homo sapiens
attggaaaagactaa

SEQ ID NO: 2383959 - DNA, 13 bp, Homo sapiens
attggaaatttca

SEQ ID NO: 2383960 - DNA, 22 bp, Homo sapiens
attggaagcaggttaaatgttt

SEQ ID NO: 2383961 - DNA, 18 bp, Homo sapiens
attggattttatgttgac

SEQ ID NO: 2383962 - DNA, 15 bp, Homo sapiens
attggtaccttgcac

SEQ ID NO: 2383963 - DNA, 19 bp, Homo sapiens
attggtaccttgcacacat

SEQ ID NO: 2383964 - DNA, 21 bp, Homo sapiens
attgttcaaactttctgcctt

SEQ ID NO: 2383965 - DNA, 16 bp, Homo sapiens
attgtttatctagatg

SEQ ID NO: 2383966 - DNA, 20 bp, Homo sapiens
attgtttatctagatgtaaa

SEQ ID NO: 2383967 - DNA, 17 bp, Homo sapiens
atttaggactgaaaata

SEQ ID NO: 2383968 - DNA, 21 bp, Homo sapiens
atttatattaattgagattat

SEQ ID NO: 2383969 - DNA, 16 bp, Homo sapiens
atttattctgggaatg

SEQ ID NO: 2383970 - DNA, 21 bp, Homo sapiens
atttattctgggaatgtatag

SEQ ID NO: 2383971 - DNA, 22 bp, Homo sapiens
atttattctgggaatgtatagt

SEQ ID NO: 2383972 - DNA, 14 bp, Homo sapiens
atttattgaggaaa

SEQ ID NO: 2383973 - DNA, 14 bp, Homo sapiens
atttcaagcttatt

SEQ ID NO: 2383974 - DNA, 15 bp, Homo sapiens
atttcacaaatatta

SEQ ID NO: 2383975 - DNA, 18 bp, Homo sapiens
atttcacaaatattaaaa

SEQ ID NO: 2383976 - DNA, 18 bp, Homo sapiens
atttcatgtcctgtgtca

SEQ ID NO: 2383977 - DNA, 23 bp, Homo sapiens
atttcatgtcctgtgtcagttta

SEQ ID NO: 2383978 - DNA, 18 bp, Homo sapiens
gtgaattactaacttcta

SEQ ID NO: 2383979 - DNA, 20 bp, Homo sapiens
gtgacatttgtcattttcat

SEQ ID NO: 2383980 - DNA, 12 bp, Homo sapiens
gtgagtttgttt

SEQ ID NO: 2383981 - DNA, 13 bp, Homo sapiens
gtgatgtgacatt

SEQ ID NO: 2383982 - DNA, 13 bp, Homo sapiens
gtgcaatatattt

SEQ ID NO: 2383983 - DNA, 23 bp, Homo sapiens
gtgcctatattaaaggtatacaa

SEQ ID NO: 2383984 - DNA, 18 bp, Homo sapiens
gtggaccctgaaatgtgt

SEQ ID NO: 2383985 - DNA, 15 bp, Homo sapiens
gtgtaatttttctgt

SEQ ID NO: 2383986 - DNA, 16 bp, Homo sapiens
gtgtaatttttctgta

SEQ ID NO: 2383987 - DNA, 15 bp, Homo sapiens
gtgtaccattaaaat

SEQ ID NO: 2383988 - DNA, 16 bp, Homo sapiens
gtgtatgtttttcagt

SEQ ID NO: 2383989 - DNA, 14 bp, Homo sapiens
gtgttagttaagaa

SEQ ID NO: 2383990 - DNA, 20 bp, Homo sapiens
gtgttctagtcattgtacta

SEQ ID NO: 2383991 - DNA, 14 bp, Homo sapiens
gtgttctgttacaa

SEQ ID NO: 2383992 - DNA, 15 bp, Homo sapiens
gtgttctgttacaaa

SEQ ID NO: 2383993 - DNA, 17 bp, Homo sapiens
gtgttctgttacaaaat

SEQ ID NO: 2383994 - DNA, 18 bp, Homo sapiens
gtgttctgttacaaaatg

SEQ ID NO: 2383995 - DNA, 19 bp, Homo sapiens
gtgttctgttacaaaatgt

SEQ ID NO: 2383996 - DNA, 19 bp, Homo sapiens
gttaaatgttttgtaaact

SEQ ID NO: 2383997 - DNA, 22 bp, Homo sapiens
gttaaatgttttgtaaactttg

SEQ ID NO: 2383998 - DNA, 17 bp, Homo sapiens
gttaatttggaccattt

SEQ ID NO: 2383999 - DNA, 20 bp, Homo sapiens
gttaatttggaccattttcc

SEQ ID NO: 2384000 - DNA, 22 bp, Homo sapiens
gttaatttggaccattttcctg

SEQ ID NO: 2384001 - DNA, 16 bp, Homo sapiens
gttacaaaatgtaact

SEQ ID NO: 2384002 - DNA, 16 bp, Homo sapiens
gttaccattggaaatt

SEQ ID NO: 2384003 - DNA, 20 bp, Homo sapiens
gttaccattggaaatttcac

SEQ ID NO: 2384004 - DNA, 13 bp, Homo sapiens
gttacttttcctt

SEQ ID NO: 2384005 - DNA, 21 bp, Homo sapiens
gttatatttttcttaaaaagt

SEQ ID NO: 2384006 - DNA, 22 bp, Homo sapiens
gttattgagagagatgtgtaat

SEQ ID NO: 2384007 - DNA, 20 bp, Homo sapiens
gttcaaagtcatgatgtttt

SEQ ID NO: 2384008 - DNA, 19 bp, Homo sapiens
gttctgttacaaaatgtaa

SEQ ID NO: 2384009 - DNA, 21 bp, Homo sapiens
gttctgttacaaaatgtaact

SEQ ID NO: 2384010 - DNA, 22 bp, Homo sapiens
gttctgttacaaaatgtaactg

SEQ ID NO: 2384011 - DNA, 22 bp, Homo sapiens
gttgatttctagttatttattc

SEQ ID NO: 2384012 - DNA, 12 bp, Homo sapiens
gttgcactgaag

SEQ ID NO: 2384013 - DNA, 14 bp, Homo sapiens
gttggaaacactaa

SEQ ID NO: 2384014 - DNA, 16 bp, Homo sapiens
gttggaaacactaaat

SEQ ID NO: 2384015 - DNA, 18 bp, Homo sapiens
gttggaaacactaaatgt

SEQ ID NO: 2384016 - DNA, 19 bp, Homo sapiens
gttggaaacactaaatgtt

SEQ ID NO: 2384017 - DNA, 14 bp, Homo sapiens
gttggagttcattc

SEQ ID NO: 2384018 - DNA, 12 bp, Homo sapiens
gtttatgttttg

SEQ ID NO: 2384019 - DNA, 15 bp, Homo sapiens
gtttcaaaaatctga

SEQ ID NO: 2384020 - DNA, 14 bp, Homo sapiens
gtttcaataaagtt

SEQ ID NO: 2384021 - DNA, 16 bp, Homo sapiens
gtttcaataaagtttg

SEQ ID NO: 2384022 - DNA, 17 bp, Homo sapiens
gtttcaataaagtttga

SEQ ID NO: 2384023 - DNA, 18 bp, Homo sapiens
gtttctttgaattttcat

SEQ ID NO: 2384024 - DNA, 21 bp, Homo sapiens
gtttgatcttcctctgctaaa

SEQ ID NO: 2384025 - DNA, 22 bp, Homo sapiens
gtttgatcttcctctgctaaat

SEQ ID NO: 2384026 - DNA, 14 bp, Homo sapiens
gttttaaaatactg

SEQ ID NO: 2384027 - DNA, 16 bp, Homo sapiens
gttttaaaatactgta

SEQ ID NO: 2384028 - DNA, 21 bp, Homo sapiens
gttttattttctaaagtactg

SEQ ID NO: 2384029 - DNA, 22 bp, Homo sapiens
gttttcagctaggaacaaatct

SEQ ID NO: 2384030 - DNA, 16 bp, Homo sapiens
gttttggtccactttt

SEQ ID NO: 2384031 - DNA, 21 bp, Homo sapiens
gttttggtccacttttccagt

SEQ ID NO: 2384032 - DNA, 13 bp, Homo sapiens
gttttgtgaaatt

SEQ ID NO: 2384033 - DNA, 18 bp, Homo sapiens
gttttgtgaaatttttca

SEQ ID NO: 2384034 - DNA, 19 bp, Homo sapiens
gttttgtgaaatttttcat

SEQ ID NO: 2384035 - DNA, 13 bp, Homo sapiens
gtttttaaaatct

SEQ ID NO: 2384036 - DNA, 17 bp, Homo sapiens
gtttttgttttgttgca

SEQ ID NO: 2384037 - DNA, 14 bp, Homo sapiens
taaaaagtctttta

SEQ ID NO: 2384038 - DNA, 16 bp, Homo sapiens
taaaaagtcttttaaa

SEQ ID NO: 2384039 - DNA, 17 bp, Homo sapiens
taaaactacttagcact

SEQ ID NO: 2384040 - DNA, 23 bp, Homo sapiens
taaaactgtactttgattcacat

SEQ ID NO: 2384041 - DNA, 20 bp, Homo sapiens
taaaatataacacagtttgt

SEQ ID NO: 2384042 - DNA, 13 bp, Homo sapiens
taaaatatgcact

SEQ ID NO: 2384043 - DNA, 19 bp, Homo sapiens
taaaatcttattaaagttt

SEQ ID NO: 2384044 - DNA, 23 bp, Homo sapiens
taaaatcttattaaagtttcaaa

SEQ ID NO: 2384045 - DNA, 18 bp, Homo sapiens
taaaatggcaacaaactg

SEQ ID NO: 2384046 - DNA, 12 bp, Homo sapiens
taaaatttgaaa

SEQ ID NO: 2384047 - DNA, 16 bp, Homo sapiens
taaaatttgaaacatt

SEQ ID NO: 2384048 - DNA, 18 bp, Homo sapiens
taaaattttaagctagga

SEQ ID NO: 2384049 - DNA, 16 bp, Homo sapiens
taaacatcaggttagg

SEQ ID NO: 2384050 - DNA, 19 bp, Homo sapiens
taaacatcaggttaggcag

SEQ ID NO: 2384051 - DNA, 18 bp, Homo sapiens
taaacgtgtatgtttttc

SEQ ID NO: 2384052 - DNA, 22 bp, Homo sapiens
taaacgtgtatgtttttcagtt

SEQ ID NO: 2384053 - DNA, 11 bp, Homo sapiens
taaactttgaa

SEQ ID NO: 2384054 - DNA, 14 bp, Homo sapiens
taaactttgaaata

SEQ ID NO: 2384055 - DNA, 17 bp, Homo sapiens
taaactttgaaatatat

SEQ ID NO: 2384056 - DNA, 18 bp, Homo sapiens
taaagaagaaagctttta

SEQ ID NO: 2384057 - DNA, 14 bp, Homo sapiens
taaagaataggact

SEQ ID NO: 2384058 - DNA, 16 bp, Homo sapiens
taaagatgtagcaaac

SEQ ID NO: 2384059 - DNA, 22 bp, Homo sapiens
taaagtactgagcagtgatatt

SEQ ID NO: 2384060 - DNA, 23 bp, Homo sapiens
taaagtactgagcagtgatattc

SEQ ID NO: 2384061 - DNA, 12 bp, Homo sapiens
taaagtttcaaa

SEQ ID NO: 2384062 - DNA, 17 bp, Homo sapiens
taaagtttcaaaaatct

SEQ ID NO: 2384063 - DNA, 20 bp, Homo sapiens
taaagtttcaaaaatctgaa

SEQ ID NO: 2384064 - DNA, 15 bp, Homo sapiens
taaagtttgatcttc

SEQ ID NO: 2384065 - DNA, 17 bp, Homo sapiens
taaagtttgatcttcct

SEQ ID NO: 2384066 - DNA, 16 bp, Homo sapiens
taaatagtgttattga

SEQ ID NO: 2384067 - DNA, 17 bp, Homo sapiens
taaatgttaaagatgta

SEQ ID NO: 2384068 - DNA, 18 bp, Homo sapiens
taaatgttaaagatgtag

SEQ ID NO: 2384069 - DNA, 22 bp, Homo sapiens
taaatgttaaagatgtagcaaa

SEQ ID NO: 2384070 - DNA, 12 bp, Homo sapiens
taaatgttttgt

SEQ ID NO: 2384071 - DNA, 14 bp, Homo sapiens
taaatgttttgtaa

SEQ ID NO: 2384072 - DNA, 16 bp, Homo sapiens
taaatgttttgtaaac

SEQ ID NO: 2384073 - DNA, 15 bp, Homo sapiens
taaattgatgttgat

SEQ ID NO: 2384074 - DNA, 11 bp, Homo sapiens
taactgctctt

SEQ ID NO: 2384075 - DNA, 15 bp, Homo sapiens
taactgctcttgggc

SEQ ID NO: 2384076 - DNA, 16 bp, Homo sapiens
taactgctcttgggca

SEQ ID NO: 2384077 - DNA, 23 bp, Homo sapiens
taactgctcttgggcaatattct

SEQ ID NO: 2384078 - DNA, 18 bp, Homo sapiens
taactgttaccattggaa

SEQ ID NO: 2384079 - DNA, 12 bp, Homo sapiens
taacttctaaaa

SEQ ID NO: 2384080 - DNA, 14 bp, Homo sapiens
taacttctaaaact

SEQ ID NO: 2384081 - DNA, 16 bp, Homo sapiens
taacttctaaaactgt

SEQ ID NO: 2384082 - DNA, 16 bp, Homo sapiens
taacttgcttaaatgt

SEQ ID NO: 2384083 - DNA, 17 bp, Homo sapiens
taacttgcttaaatgtg

SEQ ID NO: 2384084 - DNA, 19 bp, Homo sapiens
taacttgcttaaatgtgaa

SEQ ID NO: 2384085 - DNA, 15 bp, Homo sapiens
taagatgttatattt

SEQ ID NO: 2384086 - DNA, 19 bp, Homo sapiens
taagatgttatatttttct

SEQ ID NO: 2384087 - DNA, 18 bp, Homo sapiens
taagcaacaattttcaga

SEQ ID NO: 2384088 - DNA, 21 bp, Homo sapiens
taagcagaattggaaaagact

SEQ ID NO: 2384089 - DNA, 17 bp, Homo sapiens
taagctaggaaaagaaa

SEQ ID NO: 2384090 - DNA, 14 bp, Homo sapiens
taagtctctttttt

SEQ ID NO: 2384091 - DNA, 11 bp, Homo sapiens
taagtgaaatt

SEQ ID NO: 2384092 - DNA, 14 bp, Homo sapiens
taagtgaaatttat

SEQ ID NO: 2384093 - DNA, 24 bp, Homo sapiens
tgaaatgtgtgtgatgtgacattt

SEQ ID NO: 2384094 - DNA, 22 bp, Homo sapiens
tgaaatttattgaggaaaaata

SEQ ID NO: 2384095 - DNA, 12 bp, Homo sapiens
tgaaatttttca

SEQ ID NO: 2384096 - DNA, 13 bp, Homo sapiens
tgaaatttttcat

SEQ ID NO: 2384097 - DNA, 14 bp, Homo sapiens
tgaacacaaattat

SEQ ID NO: 2384098 - DNA, 16 bp, Homo sapiens
tgaagattgtttatct

SEQ ID NO: 2384099 - DNA, 22 bp, Homo sapiens
tgaagattgtttatctagatgt

SEQ ID NO: 2384100 - DNA, 22 bp, Homo sapiens
tgaagtacttaattgaagcttt

SEQ ID NO: 2384101 - DNA, 13 bp, Homo sapiens
tgaagttcatgaa

SEQ ID NO: 2384102 - DNA, 12 bp, Homo sapiens
tgaatctgtaca

SEQ ID NO: 2384103 - DNA, 13 bp, Homo sapiens
tgaatctgtacag

SEQ ID NO: 2384104 - DNA, 13 bp, Homo sapiens
tgaattactaact

SEQ ID NO: 2384105 - DNA, 15 bp, Homo sapiens
tgaattactaacttc

SEQ ID NO: 2384106 - DNA, 19 bp, Homo sapiens
tgaattactaacttctaaa

SEQ ID NO: 2384107 - DNA, 12 bp, Homo sapiens
tgaattcatgga

SEQ ID NO: 2384108 - DNA, 13 bp, Homo sapiens
tgaattttcattt

SEQ ID NO: 2384109 - DNA, 16 bp, Homo sapiens
tgaattttcattttac

SEQ ID NO: 2384110 - DNA, 21 bp, Homo sapiens
tgaattttcattttacagtta

SEQ ID NO: 2384111 - DNA, 15 bp, Homo sapiens
tgacatttgtcattt

SEQ ID NO: 2384112 - DNA, 16 bp, Homo sapiens
tgacatttgtcatttt

SEQ ID NO: 2384113 - DNA, 17 bp, Homo sapiens
tgacatttgtcattttc

SEQ ID NO: 2384114 - DNA, 19 bp, Homo sapiens
tgacatttgtcattttcat

SEQ ID NO: 2384115 - DNA, 20 bp, Homo sapiens
tgacatttgtcattttcatt

SEQ ID NO: 2384116 - DNA, 24 bp, Homo sapiens
tgacatttgtttggttatagtgca

SEQ ID NO: 2384117 - DNA, 13 bp, Homo sapiens
tgaccaattttaa

SEQ ID NO: 2384118 - DNA, 16 bp, Homo sapiens
tgaccaattttaactt

SEQ ID NO: 2384119 - DNA, 13 bp, Homo sapiens
tgaccttgtaatg

SEQ ID NO: 2384120 - DNA, 13 bp, Homo sapiens
tgactgatgttgt

SEQ ID NO: 2384121 - DNA, 13 bp, Homo sapiens
tgacttcaaggaa

SEQ ID NO: 2384122 - DNA, 16 bp, Homo sapiens
tgacttctattttcct

SEQ ID NO: 2384123 - DNA, 20 bp, Homo sapiens
tgagagaggctaaaatgttt

SEQ ID NO: 2384124 - DNA, 17 bp, Homo sapiens
tgagcagtgatattctt

SEQ ID NO: 2384125 - DNA, 14 bp, Homo sapiens
tgagtttgtttctt

SEQ ID NO: 2384126 - DNA, 14 bp, Homo sapiens
tgataaatagtgtt

SEQ ID NO: 2384127 - DNA, 20 bp, Homo sapiens
tgatattctaaaatataaca

SEQ ID NO: 2384128 - DNA, 15 bp, Homo sapiens
tgatattctttgtta

SEQ ID NO: 2384129 - DNA, 17 bp, Homo sapiens
tgatattctttgttaat

SEQ ID NO: 2384130 - DNA, 19 bp, Homo sapiens
tgatccccacactgcctta

SEQ ID NO: 2384131 - DNA, 16 bp, Homo sapiens
tgatcttcctctgcta

SEQ ID NO: 2384132 - DNA, 20 bp, Homo sapiens
tgatcttcctctgctaaatt

SEQ ID NO: 2384133 - DNA, 21 bp, Homo sapiens
tgatcttcctctgctaaattg

SEQ ID NO: 2384134 - DNA, 16 bp, Homo sapiens
tgatgaccaattttaa

SEQ ID NO: 2384135 - DNA, 19 bp, Homo sapiens
tgatgcaatccttacaaat

SEQ ID NO: 2384136 - DNA, 15 bp, Homo sapiens
tgatgtgacatttgt

SEQ ID NO: 2384137 - DNA, 16 bp, Homo sapiens
tgatgtttttaaaatc

SEQ ID NO: 2384138 - DNA, 17 bp, Homo sapiens
tgatgtttttaaaatct

SEQ ID NO: 2384139 - DNA, 19 bp, Homo sapiens
tgatgtttttaaaatctta

SEQ ID NO: 2384140 - DNA, 17 bp, Homo sapiens
tgattcacatgttttca

SEQ ID NO: 2384141 - DNA, 22 bp, Homo sapiens
tgattgcttttaaaattttaag

SEQ ID NO: 2384142 - DNA, 23 bp, Homo sapiens
tgatttcacaaatattaaaaagt

SEQ ID NO: 2384143 - DNA, 16 bp, Homo sapiens
tgcaatatattttgta

SEQ ID NO: 2384144 - DNA, 15 bp, Homo sapiens
tgcaatccttacaaa

SEQ ID NO: 2384145 - DNA, 16 bp, Homo sapiens
tgcaatccttacaaat

SEQ ID NO: 2384146 - DNA, 16 bp, Homo sapiens
tgcacacatcatctgt

SEQ ID NO: 2384147 - DNA, 12 bp, Homo sapiens
tgcacatgattt

SEQ ID NO: 2384148 - DNA, 14 bp, Homo sapiens
tgcacatgatttca

SEQ ID NO: 2384149 - DNA, 16 bp, Homo sapiens
tgcacatgatttcaca

SEQ ID NO: 2384150 - DNA, 21 bp, Homo sapiens
tgcacatgatttcacaaatat

SEQ ID NO: 2384151 - DNA, 22 bp, Homo sapiens
tgcacatgatttcacaaatatt

SEQ ID NO: 2384152 - DNA, 16 bp, Homo sapiens
tgcactaagtctcttt

SEQ ID NO: 2384153 - DNA, 13 bp, Homo sapiens
tgcactgaagttt

SEQ ID NO: 2384154 - DNA, 24 bp, Homo sapiens
tgcactgaagtttgataaatagtg

SEQ ID NO: 2384155 - DNA, 23 bp, Homo sapiens
tgcataataatcctgcaaagtac

SEQ ID NO: 2384156 - DNA, 15 bp, Homo sapiens
tgcatgctttccata

SEQ ID NO: 2384157 - DNA, 20 bp, Homo sapiens
tgccaaacattaatgttgat

SEQ ID NO: 2384158 - DNA, 22 bp, Homo sapiens
tgcctctgatgtattttgtgag

SEQ ID NO: 2384159 - DNA, 16 bp, Homo sapiens
tgctaaacgtgtatgt

SEQ ID NO: 2384160 - DNA, 18 bp, Homo sapiens
tgctaaacgtgtatgttt

SEQ ID NO: 2384161 - DNA, 17 bp, Homo sapiens
tgctatgtcatttcatg

SEQ ID NO: 2384162 - DNA, 18 bp, Homo sapiens
tgctcttgggcaatattc

SEQ ID NO: 2384163 - DNA, 24 bp, Homo sapiens
tgctcttgggcaatattctctgta

SEQ ID NO: 2384164 - DNA, 20 bp, Homo sapiens
tgctctttggcctgatgacc

SEQ ID NO: 2384165 - DNA, 22 bp, Homo sapiens
tgctttccatatttttttcctt

SEQ ID NO: 2384166 - DNA, 14 bp, Homo sapiens
tgcttttaaaacta

SEQ ID NO: 2384167 - DNA, 13 bp, Homo sapiens
tggaaacactaaa

SEQ ID NO: 2384168 - DNA, 23 bp, Homo sapiens
tggaaacactaaatgttaaagat

SEQ ID NO: 2384169 - DNA, 12 bp, Homo sapiens
tggaaatttcac

SEQ ID NO: 2384170 - DNA, 17 bp, Homo sapiens
tggaagcaggttaaatg

SEQ ID NO: 2384171 - DNA, 19 bp, Homo sapiens
tggaagcaggttaaatgtt

SEQ ID NO: 2384172 - DNA, 16 bp, Homo sapiens
tggaattttaagtctt

SEQ ID NO: 2384173 - DNA, 15 bp, Homo sapiens
tggaccattttcctg

SEQ ID NO: 2384174 - DNA, 14 bp, Homo sapiens
tggaccctgaaatg

SEQ ID NO: 2384175 - DNA, 21 bp, Homo sapiens
tggatttgtaattaaattgta

SEQ ID NO: 2384176 - DNA, 16 bp, Homo sapiens
tggattttatgttgac

SEQ ID NO: 2384177 - DNA, 22 bp, Homo sapiens
tggattttatgttgacatttgt

SEQ ID NO: 2384178 - DNA, 19 bp, Homo sapiens
tggcaacaaactgcacatg

SEQ ID NO: 2384179 - DNA, 17 bp, Homo sapiens
tggcaggtaggaatatt

SEQ ID NO: 2384180 - DNA, 23 bp, Homo sapiens
tggcaggtaggaatattatattt

SEQ ID NO: 2384181 - DNA, 20 bp, Homo sapiens
tgggaaattatctgccttat

SEQ ID NO: 2384182 - DNA, 21 bp, Homo sapiens
tgggaatgtatagtatttgaa

SEQ ID NO: 2384183 - DNA, 13 bp, Homo sapiens
tgggcaatattct

SEQ ID NO: 2384184 - DNA, 18 bp, Homo sapiens
tgggcaatattctctgta

SEQ ID NO: 2384185 - DNA, 19 bp, Homo sapiens
tgggcaatattctctgtac

SEQ ID NO: 2384186 - DNA, 16 bp, Homo sapiens
tgggttaataaatgaa

SEQ ID NO: 2384187 - DNA, 16 bp, Homo sapiens
tggtaatcatattaga

SEQ ID NO: 2384188 - DNA, 14 bp, Homo sapiens
tggtctaatgttta

SEQ ID NO: 2384189 - DNA, 21 bp, Homo sapiens
tggtctaatgtttaagcagaa

SEQ ID NO: 2384190 - DNA, 17 bp, Homo sapiens
tggtgagttgtgccttt

SEQ ID NO: 2384191 - DNA, 14 bp, Homo sapiens
tggttatagtgcaa

SEQ ID NO: 2384192 - DNA, 12 bp, Homo sapiens
tggttttaaaat

SEQ ID NO: 2384193 - DNA, 21 bp, Homo sapiens
tggttttaaaatactgtagat

SEQ ID NO: 2384194 - DNA, 16 bp, Homo sapiens
tgtaaactttgaaata

SEQ ID NO: 2384195 - DNA, 18 bp, Homo sapiens
tgtaaactttgaaatata

SEQ ID NO: 2384196 - DNA, 14 bp, Homo sapiens
tgtaactgttacca

SEQ ID NO: 2384197 - DNA, 17 bp, Homo sapiens
tgtaactgttaccattg

SEQ ID NO: 2384198 - DNA, 20 bp, Homo sapiens
tgtaactgttaccattggaa

SEQ ID NO: 2384199 - DNA, 12 bp, Homo sapiens
tgtaatgtaact

SEQ ID NO: 2384200 - DNA, 13 bp, Homo sapiens
tgtaatgtaactg

SEQ ID NO: 2384201 - DNA, 14 bp, Homo sapiens
tgtaatgtaactgc

SEQ ID NO: 2384202 - DNA, 21 bp, Homo sapiens
tgtacatattagcgacaacag

SEQ ID NO: 2384203 - DNA, 22 bp, Homo sapiens
tgtacatattagcgacaacaga

SEQ ID NO: 2384204 - DNA, 14 bp, Homo sapiens
tgtaccattaaaat

SEQ ID NO: 2384205 - DNA, 22 bp, Homo sapiens
ttcaattcatgtaacactgttg

SEQ ID NO: 2384206 - DNA, 11 bp, Homo sapiens
ttcacaaatat

SEQ ID NO: 2384207 - DNA, 12 bp, Homo sapiens
ttcacaaatatt

SEQ ID NO: 2384208 - DNA, 15 bp, Homo sapiens
ttcacatgttttcaa

SEQ ID NO: 2384209 - DNA, 20 bp, Homo sapiens
gcaaaccctgtcaaacatta

SEQ ID NO: 2384210 - DNA, 17 bp, Homo sapiens
gcaagatggcacagggc

SEQ ID NO: 2384211 - DNA, 22 bp, Homo sapiens
gcaagatggcacagggcatgaa

SEQ ID NO: 2384212 - DNA, 19 bp, Homo sapiens
gcaatatattttgtatgca

SEQ ID NO: 2384213 - DNA, 13 bp, Homo sapiens
gcaatccttacaa

SEQ ID NO: 2384214 - DNA, 14 bp, Homo sapiens
gcaatccttacaaa

SEQ ID NO: 2384215 - DNA, 16 bp, Homo sapiens
gcaatccttacaaatg

SEQ ID NO: 2384216 - DNA, 22 bp, Homo sapiens
gcacagggcatgaaatgaacac

SEQ ID NO: 2384217 - DNA, 13 bp, Homo sapiens
gcacatgatttca

SEQ ID NO: 2384218 - DNA, 14 bp, Homo sapiens
gcacatgatttcac

SEQ ID NO: 2384219 - DNA, 17 bp, Homo sapiens
gcacatgatttcacaaa

SEQ ID NO: 2384220 - DNA, 23 bp, Homo sapiens
gcactaagtctcttttttacaaa

SEQ ID NO: 2384221 - DNA, 14 bp, Homo sapiens
gcagagaaatacag

SEQ ID NO: 2384222 - DNA, 17 bp, Homo sapiens
gcagattttagttttat

SEQ ID NO: 2384223 - DNA, 14 bp, Homo sapiens
gcaggttaaatgtt

SEQ ID NO: 2384224 - DNA, 20 bp, Homo sapiens
gcagtataaagaataggact

SEQ ID NO: 2384225 - DNA, 20 bp, Homo sapiens
gcagtttcaataaagtttga

SEQ ID NO: 2384226 - DNA, 12 bp, Homo sapiens
gcatacaaacaa

SEQ ID NO: 2384227 - DNA, 15 bp, Homo sapiens
gcatataaaatggca

SEQ ID NO: 2384228 - DNA, 16 bp, Homo sapiens
gcatgaaatgaacaca

SEQ ID NO: 2384229 - DNA, 14 bp, Homo sapiens
gcatgctttccata

SEQ ID NO: 2384230 - DNA, 23 bp, Homo sapiens
gccaaacattaatgttgatttct

SEQ ID NO: 2384231 - DNA, 21 bp, Homo sapiens
gccataagcaacaattttcag

SEQ ID NO: 2384232 - DNA, 18 bp, Homo sapiens
gcctgctctttggcctga

SEQ ID NO: 2384233 - DNA, 21 bp, Homo sapiens
gcgctaacttgcttaaatgtg

SEQ ID NO: 2384234 - DNA, 22 bp, Homo sapiens
gcgctaacttgcttaaatgtga

SEQ ID NO: 2384235 - DNA, 19 bp, Homo sapiens
gctaaacgtgtatgttttt

SEQ ID NO: 2384236 - DNA, 22 bp, Homo sapiens
gctaaacgtgtatgtttttcag

SEQ ID NO: 2384237 - DNA, 17 bp, Homo sapiens
gctaaattgatgttgat

SEQ ID NO: 2384238 - DNA, 14 bp, Homo sapiens
gctaagaatttttt

SEQ ID NO: 2384239 - DNA, 16 bp, Homo sapiens
gctatgtcatttcatg

SEQ ID NO: 2384240 - DNA, 24 bp, Homo sapiens
gctctttggcctgatgaccaattt

SEQ ID NO: 2384241 - DNA, 19 bp, Homo sapiens
gctgtttggttttaaaata

SEQ ID NO: 2384242 - DNA, 13 bp, Homo sapiens
gcttaaatgtgaa

SEQ ID NO: 2384243 - DNA, 12 bp, Homo sapiens
gcttttaaaatt

SEQ ID NO: 2384244 - DNA, 15 bp, Homo sapiens
ggaaaagactaagat

SEQ ID NO: 2384245 - DNA, 16 bp, Homo sapiens
ggaaacactaaatgtt

SEQ ID NO: 2384246 - DNA, 23 bp, Homo sapiens
ggaaacactaaatgttaaagatg

SEQ ID NO: 2384247 - DNA, 16 bp, Homo sapiens
ggaagataagttggaa

SEQ ID NO: 2384248 - DNA, 21 bp, Homo sapiens
ggaatattatatttggatgca

SEQ ID NO: 2384249 - DNA, 21 bp, Homo sapiens
ggaatgtatagtatttgaaaa

SEQ ID NO: 2384250 - DNA, 14 bp, Homo sapiens
ggaccattttcctg

SEQ ID NO: 2384251 - DNA, 14 bp, Homo sapiens
ggaccctgaaatgt

SEQ ID NO: 2384252 - DNA, 21 bp, Homo sapiens
ggaccttcactctaagatgtt

SEQ ID NO: 2384253 - DNA, 19 bp, Homo sapiens
ggagttcattcatattaca

SEQ ID NO: 2384254 - DNA, 16 bp, Homo sapiens
ggattttatgttgaca

SEQ ID NO: 2384255 - DNA, 21 bp, Homo sapiens
ggattttatgttgacatttgt

SEQ ID NO: 2384256 - DNA, 18 bp, Homo sapiens
ggcaacaaactgcacatg

SEQ ID NO: 2384257 - DNA, 16 bp, Homo sapiens
ggcaatattctctgta

SEQ ID NO: 2384258 - DNA, 19 bp, Homo sapiens
ggcacagggcatgaaatga

SEQ ID NO: 2384259 - DNA, 13 bp, Homo sapiens
ggccaaagacaaa

SEQ ID NO: 2384260 - DNA, 13 bp, Homo sapiens
ggccataagcaac

SEQ ID NO: 2384261 - DNA, 19 bp, Homo sapiens
gggcaatattctctgtaca

SEQ ID NO: 2384262 - DNA, 22 bp, Homo sapiens
gggtaccactgaatctgtacag

SEQ ID NO: 2384263 - DNA, 19 bp, Homo sapiens
ggtaaaatcctctccagaa

SEQ ID NO: 2384264 - DNA, 13 bp, Homo sapiens
ggtaccactgaat

SEQ ID NO: 2384265 - DNA, 11 bp, Homo sapiens
ggtaccttgca

SEQ ID NO: 2384266 - DNA, 18 bp, Homo sapiens
ggtagaatgaccttgtaa

SEQ ID NO: 2384267 - DNA, 14 bp, Homo sapiens
ggttaaatgttttg

SEQ ID NO: 2384268 - DNA, 17 bp, Homo sapiens
ggttatagtgcaatata

SEQ ID NO: 2384269 - DNA, 20 bp, Homo sapiens
ggttttaaaatactgtagat

SEQ ID NO: 2384270 - DNA, 16 bp, Homo sapiens
gtaaagaagaaagctt

SEQ ID NO: 2384271 - DNA, 22 bp, Homo sapiens
gtaactgctcttgggcaatatt

SEQ ID NO: 2384272 - DNA, 13 bp, Homo sapiens
gtaactgttacca

SEQ ID NO: 2384273 - DNA, 20 bp, Homo sapiens
gtaactgttaccattggaaa

SEQ ID NO: 2384274 - DNA, 21 bp, Homo sapiens
gtaagctgtttggttttaaaa

SEQ ID NO: 2384275 - DNA, 12 bp, Homo sapiens
gtaatgtaactg

SEQ ID NO: 2384276 - DNA, 19 bp, Homo sapiens
gtaatgtaactgctcttgg

SEQ ID NO: 2384277 - DNA, 22 bp, Homo sapiens
gtacatattagcgacaacagat

SEQ ID NO: 2384278 - DNA, 18 bp, Homo sapiens
gtaccactgaatctgtac

SEQ ID NO: 2384279 - DNA, 14 bp, Homo sapiens
gtaccattaaaata

SEQ ID NO: 2384280 - DNA, 18 bp, Homo sapiens
gtaccattaaaatatgca

SEQ ID NO: 2384281 - DNA, 17 bp, Homo sapiens
gtaccttgcacacatca

SEQ ID NO: 2384282 - DNA, 17 bp, Homo sapiens
gtactgagcagtgatat

SEQ ID NO: 2384283 - DNA, 16 bp, Homo sapiens
gtactttgattcacat

SEQ ID NO: 2384284 - DNA, 18 bp, Homo sapiens
gtagcaaaccctgtcaaa

SEQ ID NO: 2384285 - DNA, 21 bp, Homo sapiens
gtagcaaaccctgtcaaacat

SEQ ID NO: 2384286 - DNA, 18 bp, Homo sapiens
gtaggaatattatatttg

SEQ ID NO: 2384287 - DNA, 22 bp, Homo sapiens
gtaggatatgcctgctctttgg

SEQ ID NO: 2384288 - DNA, 21 bp, Homo sapiens
gtatagaagtcttcatgaaat

SEQ ID NO: 2384289 - DNA, 21 bp, Homo sapiens
gtatagacaggagaagaaaga

SEQ ID NO: 2384290 - DNA, 13 bp, Homo sapiens
gtatagtatttga

SEQ ID NO: 2384291 - DNA, 16 bp, Homo sapiens
gtatagtatttgaaaa

SEQ ID NO: 2384292 - DNA, 13 bp, Homo sapiens
gtatgtttttcag

SEQ ID NO: 2384293 - DNA, 15 bp, Homo sapiens
gtattaattctcttt

SEQ ID NO: 2384294 - DNA, 23 bp, Homo sapiens
gtattcagcaaggcgctaacttg

SEQ ID NO: 2384295 - DNA, 17 bp, Homo sapiens
gtattgccaaacattaa

SEQ ID NO: 2384296 - DNA, 21 bp, Homo sapiens
gtattttgtgagtttgtttct

SEQ ID NO: 2384297 - DNA, 15 bp, Homo sapiens
gtcaaaattggattt

SEQ ID NO: 2384298 - DNA, 17 bp, Homo sapiens
gtcagtttatgttttgg

SEQ ID NO: 2384299 - DNA, 14 bp, Homo sapiens
gtcatgatgttttt

SEQ ID NO: 2384300 - DNA, 15 bp, Homo sapiens
gtcatgatgttttta

SEQ ID NO: 2384301 - DNA, 16 bp, Homo sapiens
gtcatgatgtttttaa

SEQ ID NO: 2384302 - DNA, 23 bp, Homo sapiens
gtcatgatgtttttaaaatctta

SEQ ID NO: 2384303 - DNA, 12 bp, Homo sapiens
gtcatttccatg

SEQ ID NO: 2384304 - DNA, 21 bp, Homo sapiens
gtcatttccatgtatgcataa

SEQ ID NO: 2384305 - DNA, 12 bp, Homo sapiens
gtcattttcatt

SEQ ID NO: 2384306 - DNA, 20 bp, Homo sapiens
gtccacttttccagtatttt

SEQ ID NO: 2384307 - DNA, 15 bp, Homo sapiens
gtctaagaaacattg

SEQ ID NO: 2384308 - DNA, 18 bp, Homo sapiens
gtctaagaaacattggaa

SEQ ID NO: 2384309 - DNA, 18 bp, Homo sapiens
gtctgccccaagttttgt

SEQ ID NO: 2384310 - DNA, 10 bp, Homo sapiens
gtcttttaaa

SEQ ID NO: 2384311 - DNA, 19 bp, Homo sapiens
gtcttttaaaaagtattgc

SEQ ID NO: 2384312 - DNA, 23 bp, Homo sapiens
gtcttttttttttaagtgaaatt

SEQ ID NO: 2384313 - DNA, 13 bp, Homo sapiens
gtgaaatttttca

SEQ ID NO: 2384314 - DNA, 16 bp, Homo sapiens
gtgaattactaacttc

SEQ ID NO: 2384315 - DNA, 16 bp, Homo sapiens
tttcctataccatttc

SEQ ID NO: 2384316 - DNA, 21 bp, Homo sapiens
tttcctgataataaatgtatt

SEQ ID NO: 2384317 - DNA, 19 bp, Homo sapiens
tttccttgcatacaaacaa

SEQ ID NO: 2384318 - DNA, 15 bp, Homo sapiens
tttctagttatttat

SEQ ID NO: 2384319 - DNA, 12 bp, Homo sapiens
tttcttaaaaag

SEQ ID NO: 2384320 - DNA, 16 bp, Homo sapiens
tttcttaatatatagc

SEQ ID NO: 2384321 - DNA, 22 bp, Homo sapiens
tttcttaatatatagcatttat

SEQ ID NO: 2384322 - DNA, 17 bp, Homo sapiens
tttctttgaattttcat

SEQ ID NO: 2384323 - DNA, 20 bp, Homo sapiens
tttctttgaattttcatttt

SEQ ID NO: 2384324 - DNA, 14 bp, Homo sapiens
tttgaaaacagaaa

SEQ ID NO: 2384325 - DNA, 18 bp, Homo sapiens
tttgaaacattgctttta

SEQ ID NO: 2384326 - DNA, 14 bp, Homo sapiens
tttgataaatagtg

SEQ ID NO: 2384327 - DNA, 13 bp, Homo sapiens
tttgattcacatg

SEQ ID NO: 2384328 - DNA, 18 bp, Homo sapiens
tttgattcacatgttttc

SEQ ID NO: 2384329 - DNA, 22 bp, Homo sapiens
tttgattcacatgttttcaaat

SEQ ID NO: 2384330 - DNA, 17 bp, Homo sapiens
tttgctgggagaatttt

SEQ ID NO: 2384331 - DNA, 17 bp, Homo sapiens
tttggaccattttcctg

SEQ ID NO: 2384332 - DNA, 19 bp, Homo sapiens
tttggtccacttttccagt

SEQ ID NO: 2384333 - DNA, 16 bp, Homo sapiens
tttggttatagtgcaa

SEQ ID NO: 2384334 - DNA, 18 bp, Homo sapiens
tttggttttaaaatactg

SEQ ID NO: 2384335 - DNA, 21 bp, Homo sapiens
tttgtaaactttgaaatatat

SEQ ID NO: 2384336 - DNA, 12 bp, Homo sapiens
tttgtatgcaag

SEQ ID NO: 2384337 - DNA, 18 bp, Homo sapiens
tttgtcattttcattagc

SEQ ID NO: 2384338 - DNA, 21 bp, Homo sapiens
tttgtcattttcattagcaaa

SEQ ID NO: 2384339 - DNA, 17 bp, Homo sapiens
tttgtgaaatttttcat

SEQ ID NO: 2384340 - DNA, 18 bp, Homo sapiens
tttgtgaaatttttcata

SEQ ID NO: 2384341 - DNA, 21 bp, Homo sapiens
tttgttgcactgaagtttgat

SEQ ID NO: 2384342 - DNA, 22 bp, Homo sapiens
tttgtttctttgaattttcatt

SEQ ID NO: 2384343 - DNA, 22 bp, Homo sapiens
tttgtttggttatagtgcaata

SEQ ID NO: 2384344 - DNA, 11 bp, Homo sapiens
tttgttttgtt

SEQ ID NO: 2384345 - DNA, 14 bp, Homo sapiens
tttgttttgttgca

SEQ ID NO: 2384346 - DNA, 19 bp, Homo sapiens
ttttaaaatactgtagata

SEQ ID NO: 2384347 - DNA, 14 bp, Homo sapiens
ttttaaaatcttat

SEQ ID NO: 2384348 - DNA, 13 bp, Homo sapiens
ttttaaaatttta

SEQ ID NO: 2384349 - DNA, 21 bp, Homo sapiens
ttttaagctaggaaaagaaat

SEQ ID NO: 2384350 - DNA, 14 bp, Homo sapiens
ttttaagtgaaatt

SEQ ID NO: 2384351 - DNA, 18 bp, Homo sapiens
ttttacaaaggctgtatt

SEQ ID NO: 2384352 - DNA, 17 bp, Homo sapiens
ttttaggtttatctttt

SEQ ID NO: 2384353 - DNA, 12 bp, Homo sapiens
ttttatgttgac

SEQ ID NO: 2384354 - DNA, 13 bp, Homo sapiens
ttttcagatttgc

SEQ ID NO: 2384355 - DNA, 18 bp, Homo sapiens
ttttcagatttgcacaaa

SEQ ID NO: 2384356 - DNA, 15 bp, Homo sapiens
ttttcagttcaaagt

SEQ ID NO: 2384357 - DNA, 21 bp, Homo sapiens
ttttcattagcaaaaaaagtt

SEQ ID NO: 2384358 - DNA, 22 bp, Homo sapiens
ttttcattagcaaaaaaagttg

SEQ ID NO: 2384359 - DNA, 17 bp, Homo sapiens
ttttccagtattttagt

SEQ ID NO: 2384360 - DNA, 15 bp, Homo sapiens
ttttccttacataaa

SEQ ID NO: 2384361 - DNA, 16 bp, Homo sapiens
ttttctcttatctgtg

SEQ ID NO: 2384362 - DNA, 13 bp, Homo sapiens
ttttcttaaaaag

SEQ ID NO: 2384363 - DNA, 15 bp, Homo sapiens
ttttgacctttgata

SEQ ID NO: 2384364 - DNA, 13 bp, Homo sapiens
ttttgtatgcaag

SEQ ID NO: 2384365 - DNA, 15 bp, Homo sapiens
ttttgttttgttgca

SEQ ID NO: 2384366 - DNA, 16 bp, Homo sapiens
ttttgttttttgagtc

SEQ ID NO: 2384367 - DNA, 12 bp, Homo sapiens
tttttaaaatct

SEQ ID NO: 2384368 - DNA, 22 bp, Homo sapiens
tttttaagactgtgtctgtatt

SEQ ID NO: 2384369 - DNA, 15 bp, Homo sapiens
tttttaagtgaaatt

SEQ ID NO: 2384370 - DNA, 15 bp, Homo sapiens
tttttccttacataa

SEQ ID NO: 2384371 - DNA, 19 bp, Homo sapiens
tttttccttacataaacat

SEQ ID NO: 2384372 - DNA, 14 bp, Homo sapiens
tttttgaagtgttg

SEQ ID NO: 2384373 - DNA, 20 bp, Homo sapiens
ttttttccttacataaacat

SEQ ID NO: 2384374 - DNA, 13 bp, Homo sapiens
ttttttgaagtgt

SEQ ID NO: 2384375 - DNA, 11 bp, Homo sapiens
tttttttcctt

SEQ ID NO: 2384376 - DNA, 12 bp, Homo sapiens
tttttttcctta

SEQ ID NO: 2384377 - DNA, 22 bp, Homo sapiens
actgctcttgggcaatattctc

SEQ ID NO: 2384378 - DNA, 20 bp, Homo sapiens
actgtactttgattcacatg

SEQ ID NO: 2384379 - DNA, 23 bp, Homo sapiens
actgtagataattaaccaaggta

SEQ ID NO: 2384380 - DNA, 16 bp, Homo sapiens
actgttaccattggaa

SEQ ID NO: 2384381 - DNA, 22 bp, Homo sapiens
actgttaccattggaaatttca

SEQ ID NO: 2384382 - DNA, 23 bp, Homo sapiens
acttctaaaactgtactttgatt

SEQ ID NO: 2384383 - DNA, 15 bp, Homo sapiens
acttctgttttcaat

SEQ ID NO: 2384384 - DNA, 17 bp, Homo sapiens
acttctgttttcaatct

SEQ ID NO: 2384385 - DNA, 22 bp, Homo sapiens
acttctgttttcaatctcgtat

SEQ ID NO: 2384386 - DNA, 15 bp, Homo sapiens
acttgcttaaatgtg

SEQ ID NO: 2384387 - DNA, 14 bp, Homo sapiens
acttgtttaataaa

SEQ ID NO: 2384388 - DNA, 18 bp, Homo sapiens
actttatagaagaatgca

SEQ ID NO: 2384389 - DNA, 10 bp, Homo sapiens
actttgaaat

SEQ ID NO: 2384390 - DNA, 13 bp, Homo sapiens
actttgattcaca

SEQ ID NO: 2384391 - DNA, 14 bp, Homo sapiens
actttgttaggcca

SEQ ID NO: 2384392 - DNA, 18 bp, Homo sapiens
actttgttaggccaaaga

SEQ ID NO: 2384393 - DNA, 22 bp, Homo sapiens
actttgttaggccaaagacaaa

SEQ ID NO: 2384394 - DNA, 11 bp, Homo sapiens
acttttccagt

SEQ ID NO: 2384395 - DNA, 15 bp, Homo sapiens
acttttccttgcata

SEQ ID NO: 2384396 - DNA, 21 bp, Homo sapiens
acttttccttgcatacaaaca

SEQ ID NO: 2384397 - DNA, 22 bp, Homo sapiens
acttttccttgcatacaaacaa

SEQ ID NO: 2384398 - DNA, 16 bp, Homo sapiens
agaaagaactatcttc

SEQ ID NO: 2384399 - DNA, 19 bp, Homo sapiens
agaaagtgttctgttacaa

SEQ ID NO: 2384400 - DNA, 17 bp, Homo sapiens
agtttcaataaagtttg

SEQ ID NO: 2384401 - DNA, 16 bp, Homo sapiens
agtttgatcttcctct

SEQ ID NO: 2384402 - DNA, 21 bp, Homo sapiens
agtttgatcttcctctgctaa

SEQ ID NO: 2384403 - DNA, 23 bp, Homo sapiens
agtttgatcttcctctgctaaat

SEQ ID NO: 2384404 - DNA, 20 bp, Homo sapiens
agtttgtttctttgaatttt

SEQ ID NO: 2384405 - DNA, 22 bp, Homo sapiens
agtttgtttctttgaattttca

SEQ ID NO: 2384406 - DNA, 15 bp, Homo sapiens
agttttgtgaaattt

SEQ ID NO: 2384407 - DNA, 16 bp, Homo sapiens
agttttgtgaaatttt

SEQ ID NO: 2384408 - DNA, 22 bp, Homo sapiens
ataaaatggcaacaaactgcac

SEQ ID NO: 2384409 - DNA, 15 bp, Homo sapiens
ataaagaataggact

SEQ ID NO: 2384410 - DNA, 23 bp, Homo sapiens
ataaagaataggacttgtttttg

SEQ ID NO: 2384411 - DNA, 22 bp, Homo sapiens
ataaagcgaaaaactcaaccaa

SEQ ID NO: 2384412 - DNA, 18 bp, Homo sapiens
ataagcaacaattttcag

SEQ ID NO: 2384413 - DNA, 22 bp, Homo sapiens
ataagcaacaattttcagattt

SEQ ID NO: 2384414 - DNA, 20 bp, Homo sapiens
ataattaaccaaggtagaat

SEQ ID NO: 2384415 - DNA, 17 bp, Homo sapiens
ataattctgaagttata

SEQ ID NO: 2384416 - DNA, 20 bp, Homo sapiens
atacagatctgtttattctg

SEQ ID NO: 2384417 - DNA, 15 bp, Homo sapiens
atacagccattttgt

SEQ ID NO: 2384418 - DNA, 14 bp, Homo sapiens
atacataactgaag

SEQ ID NO: 2384419 - DNA, 22 bp, Homo sapiens
atacataactgaagcatgtgaa

SEQ ID NO: 2384420 - DNA, 15 bp, Homo sapiens
ataccatttccgtaa

SEQ ID NO: 2384421 - DNA, 17 bp, Homo sapiens
ataccttaaaatttgaa

SEQ ID NO: 2384422 - DNA, 20 bp, Homo sapiens
atagaaagtgttctgttaca

SEQ ID NO: 2384423 - DNA, 23 bp, Homo sapiens
atagaaagtgttctgttacaaaa

SEQ ID NO: 2384424 - DNA, 13 bp, Homo sapiens
atagaagtcttca

SEQ ID NO: 2384425 - DNA, 21 bp, Homo sapiens
atagaagtcttcatgaaatgc

SEQ ID NO: 2384426 - DNA, 22 bp, Homo sapiens
atagacaggagaagaaagaact

SEQ ID NO: 2384427 - DNA, 17 bp, Homo sapiens
ataggaaggtcatttcc

SEQ ID NO: 2384428 - DNA, 13 bp, Homo sapiens
ataggacttgttt

SEQ ID NO: 2384429 - DNA, 15 bp, Homo sapiens
ataggacttgttttt

SEQ ID NO: 2384430 - DNA, 18 bp, Homo sapiens
atagtatttgaaaacaga

SEQ ID NO: 2384431 - DNA, 20 bp, Homo sapiens
atagtatttgaaaacagaaa

SEQ ID NO: 2384432 - DNA, 13 bp, Homo sapiens
atagtgcaatata

SEQ ID NO: 2384433 - DNA, 18 bp, Homo sapiens
atagtgcaatatattttg

SEQ ID NO: 2384434 - DNA, 20 bp, Homo sapiens
atagtgcaatatattttgta

SEQ ID NO: 2384435 - DNA, 19 bp, Homo sapiens
atataaaatggcaacaaac

SEQ ID NO: 2384436 - DNA, 17 bp, Homo sapiens
atatattttgtatgcaa

SEQ ID NO: 2384437 - DNA, 22 bp, Homo sapiens
atatattttgtatgcaagcagt

SEQ ID NO: 2384438 - DNA, 22 bp, Homo sapiens
atatcttggcaggtaggaatat

SEQ ID NO: 2384439 - DNA, 13 bp, Homo sapiens
atatggtctaatg

SEQ ID NO: 2384440 - DNA, 15 bp, Homo sapiens
atatggtctaatgtt

SEQ ID NO: 2384441 - DNA, 15 bp, Homo sapiens
atattaaaaagtctt

SEQ ID NO: 2384442 - DNA, 16 bp, Homo sapiens
atattaaaggtataca

SEQ ID NO: 2384443 - DNA, 20 bp, Homo sapiens
atattaaaggtatacaaata

SEQ ID NO: 2384444 - DNA, 22 bp, Homo sapiens
atattaaaggtatacaaataaa

SEQ ID NO: 2384445 - DNA, 15 bp, Homo sapiens
atattacaatatttg

SEQ ID NO: 2384446 - DNA, 17 bp, Homo sapiens
atattacaatatttgtg

SEQ ID NO: 2384447 - DNA, 14 bp, Homo sapiens
atattagaaaactt

SEQ ID NO: 2384448 - DNA, 15 bp, Homo sapiens
atattagaaaacttt

SEQ ID NO: 2384449 - DNA, 20 bp, Homo sapiens
atattagaaaactttgttag

SEQ ID NO: 2384450 - DNA, 18 bp, Homo sapiens
atatttcctataccattt

SEQ ID NO: 2384451 - DNA, 21 bp, Homo sapiens
atatttcctataccatttccg

SEQ ID NO: 2384452 - DNA, 13 bp, Homo sapiens
atatttgtaaata

SEQ ID NO: 2384453 - DNA, 14 bp, Homo sapiens
atattttaatttca

SEQ ID NO: 2384454 - DNA, 17 bp, Homo sapiens
atattttaatttcaagc

SEQ ID NO: 2384455 - DNA, 22 bp, Homo sapiens
atattttgtatgcaagcagttt

SEQ ID NO: 2384456 - DNA, 13 bp, Homo sapiens
atatttttcttaa

SEQ ID NO: 2384457 - DNA, 15 bp, Homo sapiens
atatttttcttaaaa

SEQ ID NO: 2384458 - DNA, 18 bp, Homo sapiens
atatttttcttaaaaagt

SEQ ID NO: 2384459 - DNA, 19 bp, Homo sapiens
atatttttcttaaaaagta

SEQ ID NO: 2384460 - DNA, 22 bp, Homo sapiens
atcaggttaggcagtataaaga

SEQ ID NO: 2384461 - DNA, 14 bp, Homo sapiens
atcatctgtaagct

SEQ ID NO: 2384462 - DNA, 12 bp, Homo sapiens
atctaccaactt

SEQ ID NO: 2384463 - DNA, 18 bp, Homo sapiens
atctaccaactttcaaga

SEQ ID NO: 2384464 - DNA, 15 bp, Homo sapiens
atctatagaaagtgt

SEQ ID NO: 2384465 - DNA, 17 bp, Homo sapiens
atctatagaaagtgttc

SEQ ID NO: 2384466 - DNA, 21 bp, Homo sapiens
atctgaagattgtttatctag

SEQ ID NO: 2384467 - DNA, 21 bp, Homo sapiens
atctgagagaggctaaaatgt

SEQ ID NO: 2384468 - DNA, 15 bp, Homo sapiens
atctgtaagctgttt

SEQ ID NO: 2384469 - DNA, 20 bp, Homo sapiens
atcttattaaagtttcaaaa

SEQ ID NO: 2384470 - DNA, 14 bp, Homo sapiens
atcttcctctgcta

SEQ ID NO: 2384471 - DNA, 19 bp, Homo sapiens
atcttcctctgctaaattg

SEQ ID NO: 2384472 - DNA, 16 bp, Homo sapiens
atgaaatgaacacaaa

SEQ ID NO: 2384473 - DNA, 20 bp, Homo sapiens
atgaccttgtaatgtaactg

SEQ ID NO: 2384474 - DNA, 23 bp, Homo sapiens
atgatctgtgccttttttatatc

SEQ ID NO: 2384475 - DNA, 21 bp, Homo sapiens
atgatgtttttaaaatcttat

SEQ ID NO: 2384476 - DNA, 15 bp, Homo sapiens
atgattgcttttaaa

SEQ ID NO: 2384477 - DNA, 17 bp, Homo sapiens
atgcaatccttacaaat

SEQ ID NO: 2384478 - DNA, 20 bp, Homo sapiens
atgcactaagtctctttttt

SEQ ID NO: 2384479 - DNA, 19 bp, Homo sapiens
atgcataataatcctgcaa

SEQ ID NO: 2384480 - DNA, 19 bp, Homo sapiens
atgcctgctctttggcctg

SEQ ID NO: 2384481 - DNA, 15 bp, Homo sapiens
atgctttccatattt

SEQ ID NO: 2384482 - DNA, 19 bp, Homo sapiens
atggcacagggcatgaaat

SEQ ID NO: 2384483 - DNA, 20 bp, Homo sapiens
atggcacagggcatgaaatg

SEQ ID NO: 2384484 - DNA, 15 bp, Homo sapiens
atggtaatcatatta

SEQ ID NO: 2384485 - DNA, 14 bp, Homo sapiens
atggtctaatgttt

SEQ ID NO: 2384486 - DNA, 16 bp, Homo sapiens
atggtctaatgtttaa

SEQ ID NO: 2384487 - DNA, 20 bp, Homo sapiens
atgtaactgctcttgggcaa

SEQ ID NO: 2384488 - DNA, 16 bp, Homo sapiens
atgtatagtatttgaa

SEQ ID NO: 2384489 - DNA, 13 bp, Homo sapiens
atgtatgcataat

SEQ ID NO: 2384490 - DNA, 13 bp, Homo sapiens
atgtattttgtga

SEQ ID NO: 2384491 - DNA, 15 bp, Homo sapiens
atgtattttgtgagt

SEQ ID NO: 2384492 - DNA, 19 bp, Homo sapiens
atgtattttgtgagtttgt

SEQ ID NO: 2384493 - DNA, 20 bp, Homo sapiens
atgtgaaggaccttcactct

SEQ ID NO: 2384494 - DNA, 14 bp, Homo sapiens
atgtgaattactaa

SEQ ID NO: 2384495 - DNA, 16 bp, Homo sapiens
aactttcaagaacttg

SEQ ID NO: 2384496 - DNA, 13 bp, Homo sapiens
aactttgaaatat

SEQ ID NO: 2384497 - DNA, 14 bp, Homo sapiens
aactttgaaatata

SEQ ID NO: 2384498 - DNA, 16 bp, Homo sapiens
aactttgaaatatatg

SEQ ID NO: 2384499 - DNA, 17 bp, Homo sapiens
aacttttttttcttttt

SEQ ID NO: 2384500 - DNA, 16 bp, Homo sapiens
aagaaagaactatctt

SEQ ID NO: 2384501 - DNA, 16 bp, Homo sapiens
aagaaatctatagaaa

SEQ ID NO: 2384502 - DNA, 14 bp, Homo sapiens
aagaactatcttca

SEQ ID NO: 2384503 - DNA, 12 bp, Homo sapiens
aagaacttgttt

SEQ ID NO: 2384504 - DNA, 14 bp, Homo sapiens
aagaattgaagata

SEQ ID NO: 2384505 - DNA, 20 bp, Homo sapiens
aagaattttttattttttgg

SEQ ID NO: 2384506 - DNA, 13 bp, Homo sapiens
aagataagttgga

SEQ ID NO: 2384507 - DNA, 15 bp, Homo sapiens
aagataagttggaaa

SEQ ID NO: 2384508 - DNA, 19 bp, Homo sapiens
aagataagttggaaacact

SEQ ID NO: 2384509 - DNA, 14 bp, Homo sapiens
aagatgtagcaaac

SEQ ID NO: 2384510 - DNA, 18 bp, Homo sapiens
aagatgtagcaaaccctg

SEQ ID NO: 2384511 - DNA, 18 bp, Homo sapiens
aagatgttatatttttct

SEQ ID NO: 2384512 - DNA, 13 bp, Homo sapiens
aagattgtttatc

SEQ ID NO: 2384513 - DNA, 20 bp, Homo sapiens
aagattgtttatctagatgt

SEQ ID NO: 2384514 - DNA, 12 bp, Homo sapiens
aagcaacaattt

SEQ ID NO: 2384515 - DNA, 14 bp, Homo sapiens
aagcagaattggaa

SEQ ID NO: 2384516 - DNA, 16 bp, Homo sapiens
aagcagaattggaaaa

SEQ ID NO: 2384517 - DNA, 13 bp, Homo sapiens
aagcagtttcaat

SEQ ID NO: 2384518 - DNA, 19 bp, Homo sapiens
aagcagtttcaataaagtt

SEQ ID NO: 2384519 - DNA, 22 bp, Homo sapiens
aagcatataaaatggcaacaaa

SEQ ID NO: 2384520 - DNA, 20 bp, Homo sapiens
aagctaggaaaagaaatcta

SEQ ID NO: 2384521 - DNA, 21 bp, Homo sapiens
aagctaggaaaagaaatctat

SEQ ID NO: 2384522 - DNA, 17 bp, Homo sapiens
aagctgtttggttttaa

SEQ ID NO: 2384523 - DNA, 22 bp, Homo sapiens
aaggcgctaacttgcttaaatg

SEQ ID NO: 2384524 - DNA, 23 bp, Homo sapiens
aaggcgctaacttgcttaaatgt

SEQ ID NO: 2384525 - DNA, 16 bp, Homo sapiens
aaggctgtattcagca

SEQ ID NO: 2384526 - DNA, 15 bp, Homo sapiens
aagtacaggtacttt

SEQ ID NO: 2384527 - DNA, 17 bp, Homo sapiens
aagtattgccaaacatt

SEQ ID NO: 2384528 - DNA, 13 bp, Homo sapiens
aagtcatgatgtt

SEQ ID NO: 2384529 - DNA, 17 bp, Homo sapiens
aagtcatgatgttttta

SEQ ID NO: 2384530 - DNA, 14 bp, Homo sapiens
aagtcttcatgaaa

SEQ ID NO: 2384531 - DNA, 16 bp, Homo sapiens
aagtcttttaaaaagt

SEQ ID NO: 2384532 - DNA, 14 bp, Homo sapiens
aagtgtatttaaaa

SEQ ID NO: 2384533 - DNA, 17 bp, Homo sapiens
aagtgttctgttacaaa

SEQ ID NO: 2384534 - DNA, 21 bp, Homo sapiens
aagtgttctgttacaaaatgt

SEQ ID NO: 2384535 - DNA, 23 bp, Homo sapiens
aagtgttggggtttggttttgtt

SEQ ID NO: 2384536 - DNA, 21 bp, Homo sapiens
aagttggaaacactaaatgtt

SEQ ID NO: 2384537 - DNA, 23 bp, Homo sapiens
aagttggaaacactaaatgttaa

SEQ ID NO: 2384538 - DNA, 22 bp, Homo sapiens
aagttgtatgatctgtgccttt

SEQ ID NO: 2384539 - DNA, 14 bp, Homo sapiens
aagtttcaaaaatc

SEQ ID NO: 2384540 - DNA, 15 bp, Homo sapiens
aagtttcaaaaatct

SEQ ID NO: 2384541 - DNA, 17 bp, Homo sapiens
aagtttcaaaaatctga

SEQ ID NO: 2384542 - DNA, 12 bp, Homo sapiens
aagtttgataaa

SEQ ID NO: 2384543 - DNA, 18 bp, Homo sapiens
aagtttgatcttcctctg

SEQ ID NO: 2384544 - DNA, 15 bp, Homo sapiens
aagttttgtgaaatt

SEQ ID NO: 2384545 - DNA, 19 bp, Homo sapiens
aagttttgtgaaatttttc

SEQ ID NO: 2384546 - DNA, 21 bp, Homo sapiens
aagttttgtgaaatttttcat

SEQ ID NO: 2384547 - DNA, 18 bp, Homo sapiens
aataaagtttgatcttcc

SEQ ID NO: 2384548 - DNA, 19 bp, Homo sapiens
aatatatggtctaatgttt

SEQ ID NO: 2384549 - DNA, 18 bp, Homo sapiens
aatatgcactaagtctct

SEQ ID NO: 2384550 - DNA, 13 bp, Homo sapiens
aatattaaaaagt

SEQ ID NO: 2384551 - DNA, 19 bp, Homo sapiens
aatattaaaaagtctttta

SEQ ID NO: 2384552 - DNA, 14 bp, Homo sapiens
aatattctctgtac

SEQ ID NO: 2384553 - DNA, 14 bp, Homo sapiens
aatattgaatgttt

SEQ ID NO: 2384554 - DNA, 17 bp, Homo sapiens
aatcatattagacttct

SEQ ID NO: 2384555 - DNA, 15 bp, Homo sapiens
aatctatagaaagtg

SEQ ID NO: 2384556 - DNA, 16 bp, Homo sapiens
aatctatagaaagtgt

SEQ ID NO: 2384557 - DNA, 18 bp, Homo sapiens
aatctatagaaagtgttc

SEQ ID NO: 2384558 - DNA, 23 bp, Homo sapiens
aatctatagaaagtgttctgtta

SEQ ID NO: 2384559 - DNA, 19 bp, Homo sapiens
aatcttattaaagtttcaa

SEQ ID NO: 2384560 - DNA, 20 bp, Homo sapiens
aatcttattaaagtttcaaa

SEQ ID NO: 2384561 - DNA, 19 bp, Homo sapiens
aatcttcctggtcgaaagt

SEQ ID NO: 2384562 - DNA, 23 bp, Homo sapiens
aatcttcctggtcgaaagttagt

SEQ ID NO: 2384563 - DNA, 15 bp, Homo sapiens
aatcttgctgtcaag

SEQ ID NO: 2384564 - DNA, 17 bp, Homo sapiens
aatgaacacaaattatg

SEQ ID NO: 2384565 - DNA, 18 bp, Homo sapiens
aatgaccttgtaatgtaa

SEQ ID NO: 2384566 - DNA, 20 bp, Homo sapiens
aatgaccttgtaatgtaact

SEQ ID NO: 2384567 - DNA, 12 bp, Homo sapiens
aatgattgcttt

SEQ ID NO: 2384568 - DNA, 21 bp, Homo sapiens
aatggagttggagttcattca

SEQ ID NO: 2384569 - DNA, 21 bp, Homo sapiens
aatggcaacaaactgcacatg

SEQ ID NO: 2384570 - DNA, 14 bp, Homo sapiens
aatggctgaagcca

SEQ ID NO: 2384571 - DNA, 22 bp, Homo sapiens
aatggtacaaaaccacagtgta

SEQ ID NO: 2384572 - DNA, 15 bp, Homo sapiens
aatgtaactgctctt

SEQ ID NO: 2384573 - DNA, 18 bp, Homo sapiens
aatgtaagcattacatga

SEQ ID NO: 2384574 - DNA, 19 bp, Homo sapiens
aatgtatagtatttgaaaa

SEQ ID NO: 2384575 - DNA, 22 bp, Homo sapiens
aatgtatagtatttgaaaacag

SEQ ID NO: 2384576 - DNA, 22 bp, Homo sapiens
aatgtattgttctcatgtaaga

SEQ ID NO: 2384577 - DNA, 23 bp, Homo sapiens
caacagattggattttatgttga

SEQ ID NO: 2384578 - DNA, 14 bp, Homo sapiens
caagaacttgttta

SEQ ID NO: 2384579 - DNA, 15 bp, Homo sapiens
caagaacttgtttaa

SEQ ID NO: 2384580 - DNA, 13 bp, Homo sapiens
caagatggcacag

SEQ ID NO: 2384581 - DNA, 13 bp, Homo sapiens
caagcagtttcaa

SEQ ID NO: 2384582 - DNA, 21 bp, Homo sapiens
cgacttacatagctcaaatat

SEQ ID NO: 2384583 - DNA, 14 bp, Homo sapiens
cggttaacaaataa

SEQ ID NO: 2384584 - DNA, 14 bp, Homo sapiens
cgtaattcttattc

SEQ ID NO: 2384585 - DNA, 13 bp, Homo sapiens
ctaaaactgtact

SEQ ID NO: 2384586 - DNA, 20 bp, Homo sapiens
ctaaaactgtactttgattc

SEQ ID NO: 2384587 - DNA, 14 bp, Homo sapiens
ctaaaatgttttca

SEQ ID NO: 2384588 - DNA, 15 bp, Homo sapiens
ctaaaatgttttcag

SEQ ID NO: 2384589 - DNA, 17 bp, Homo sapiens
ctaaacgtgtatgtttt

SEQ ID NO: 2384590 - DNA, 18 bp, Homo sapiens
ctaaacgtgtatgttttt

SEQ ID NO: 2384591 - DNA, 20 bp, Homo sapiens
ctaaagtactgagcagtgat

SEQ ID NO: 2384592 - DNA, 13 bp, Homo sapiens
ctaaatgttaaag

SEQ ID NO: 2384593 - DNA, 16 bp, Homo sapiens
ctaaatgttaaagatg

SEQ ID NO: 2384594 - DNA, 23 bp, Homo sapiens
ctaaatgttaaagatgtagcaaa

SEQ ID NO: 2384595 - DNA, 15 bp, Homo sapiens
ctaaattgatgttga

SEQ ID NO: 2384596 - DNA, 18 bp, Homo sapiens
ctaacttgcttaaatgtg

SEQ ID NO: 2384597 - DNA, 20 bp, Homo sapiens
ctaacttgcttaaatgtgaa

SEQ ID NO: 2384598 - DNA, 18 bp, Homo sapiens
ctaagaaacattggaagc

SEQ ID NO: 2384599 - DNA, 19 bp, Homo sapiens
ctaagaaacattggaagca

SEQ ID NO: 2384600 - DNA, 20 bp, Homo sapiens
ctaagatcggttaacaaata

SEQ ID NO: 2384601 - DNA, 18 bp, Homo sapiens
ctaagtctcttttttaca

SEQ ID NO: 2384602 - DNA, 13 bp, Homo sapiens
ctaccaactttca

SEQ ID NO: 2384603 - DNA, 16 bp, Homo sapiens
ctacttagcacttcag

SEQ ID NO: 2384604 - DNA, 14 bp, Homo sapiens
ctagatgtaaattt

SEQ ID NO: 2384605 - DNA, 16 bp, Homo sapiens
ctaggaacaaatcttc

SEQ ID NO: 2384606 - DNA, 16 bp, Homo sapiens
ctatagaaagtgttct

SEQ ID NO: 2384607 - DNA, 22 bp, Homo sapiens
ctatagaaagtgttctgttaca

SEQ ID NO: 2384608 - DNA, 19 bp, Homo sapiens
ctatattaaaggtatacaa

SEQ ID NO: 2384609 - DNA, 20 bp, Homo sapiens
ctcaaccaaatggtacaaaa

SEQ ID NO: 2384610 - DNA, 23 bp, Homo sapiens
ctcctagtaggggtaccactgaa

SEQ ID NO: 2384611 - DNA, 23 bp, Homo sapiens
ctcgtatagaagtcttcatgaaa

SEQ ID NO: 2384612 - DNA, 17 bp, Homo sapiens
ctctaagatgttatatt

SEQ ID NO: 2384613 - DNA, 21 bp, Homo sapiens
ctctattgtgcctatattaaa

SEQ ID NO: 2384614 - DNA, 16 bp, Homo sapiens
ctctgatgtattttgt

SEQ ID NO: 2384615 - DNA, 20 bp, Homo sapiens
ctctgctaaattgatgttga

SEQ ID NO: 2384616 - DNA, 16 bp, Homo sapiens
ctcttgggcaatattc

SEQ ID NO: 2384617 - DNA, 14 bp, Homo sapiens
ctcttttttacaaa

SEQ ID NO: 2384618 - DNA, 20 bp, Homo sapiens
ctgaaatgtgtgtgatgtga

SEQ ID NO: 2384619 - DNA, 22 bp, Homo sapiens
ctgaagattgtttatctagatg

SEQ ID NO: 2384620 - DNA, 14 bp, Homo sapiens
ctgaagttatattt

SEQ ID NO: 2384621 - DNA, 21 bp, Homo sapiens
ctgaagtttgataaatagtgt

SEQ ID NO: 2384622 - DNA, 15 bp, Homo sapiens
ctgaatctgtacaga

SEQ ID NO: 2384623 - DNA, 17 bp, Homo sapiens
ctgagcagtgatattct

SEQ ID NO: 2384624 - DNA, 14 bp, Homo sapiens
ctgattttttaaga

SEQ ID NO: 2384625 - DNA, 23 bp, Homo sapiens
ctgcaaagtacaggtactttgtc

SEQ ID NO: 2384626 - DNA, 17 bp, Homo sapiens
ctgcacatgatttcaca

SEQ ID NO: 2384627 - DNA, 18 bp, Homo sapiens
ctgcacatgatttcacaa

SEQ ID NO: 2384628 - DNA, 22 bp, Homo sapiens
ctgcacatgatttcacaaatat

SEQ ID NO: 2384629 - DNA, 17 bp, Homo sapiens
ctgctaaattgatgttg

SEQ ID NO: 2384630 - DNA, 22 bp, Homo sapiens
ctgctaaattgatgttgatgca

SEQ ID NO: 2384631 - DNA, 22 bp, Homo sapiens
ctgctagtgttctttctctttc

SEQ ID NO: 2384632 - DNA, 14 bp, Homo sapiens
ctgctctttggcct

SEQ ID NO: 2384633 - DNA, 19 bp, Homo sapiens
ctgggaatgtatagtattt

SEQ ID NO: 2384634 - DNA, 21 bp, Homo sapiens
ctgggaatgtatagtatttga

SEQ ID NO: 2384635 - DNA, 18 bp, Homo sapiens
ctggggaacgttctcttt

SEQ ID NO: 2384636 - DNA, 21 bp, Homo sapiens
ctgtactttgattcacatgtt

SEQ ID NO: 2384637 - DNA, 13 bp, Homo sapiens
ctgtcaaacatta

SEQ ID NO: 2384638 - DNA, 20 bp, Homo sapiens
ctgtgccttttttatatctt

SEQ ID NO: 2384639 - DNA, 13 bp, Homo sapiens
ctgttacaaaatg

SEQ ID NO: 2384640 - DNA, 22 bp, Homo sapiens
ctgttacaaaatgtaactgtta

SEQ ID NO: 2384641 - DNA, 17 bp, Homo sapiens
ctgttaccattggaaat

SEQ ID NO: 2384642 - DNA, 14 bp, Homo sapiens
cttaaaaagtaact

SEQ ID NO: 2384643 - DNA, 16 bp, Homo sapiens
cttaaaatttgaaaca

SEQ ID NO: 2384644 - DNA, 14 bp, Homo sapiens
cttaaatgtgaatt

SEQ ID NO: 2384645 - DNA, 22 bp, Homo sapiens
cttaaatgtgaattactaactt

SEQ ID NO: 2384646 - DNA, 19 bp, Homo sapiens
cttaatatatagcatttat

SEQ ID NO: 2384647 - DNA, 14 bp, Homo sapiens
cttagagctttttt

SEQ ID NO: 2384648 - DNA, 16 bp, Homo sapiens
cttattaaagtttcaa

SEQ ID NO: 2384649 - DNA, 17 bp, Homo sapiens
cttattaaagtttcaaa

SEQ ID NO: 2384650 - DNA, 16 bp, Homo sapiens
cttattccatattaga

SEQ ID NO: 2384651 - DNA, 22 bp, Homo sapiens
cttattccatattagaaaactt

SEQ ID NO: 2384652 - DNA, 15 bp, Homo sapiens
cttcagggcagattt

SEQ ID NO: 2384653 - DNA, 13 bp, Homo sapiens
cttcatgaaatgc

SEQ ID NO: 2384654 - DNA, 20 bp, Homo sapiens
cttctaaaactgtactttga

SEQ ID NO: 2384655 - DNA, 13 bp, Homo sapiens
cttgcacacatca

SEQ ID NO: 2384656 - DNA, 20 bp, Homo sapiens
cttgcacacatcatctgtaa

SEQ ID NO: 2384657 - DNA, 21 bp, Homo sapiens
cttgcatacaaacaagcatat

SEQ ID NO: 2384658 - DNA, 15 bp, Homo sapiens
cttgcttaaatgtga

SEQ ID NO: 2384659 - DNA, 23 bp, Homo sapiens
cttggcaggtaggaatattatat

SEQ ID NO: 2384660 - DNA, 13 bp, Homo sapiens
cttgggcaatatt

SEQ ID NO: 2384661 - DNA, 15 bp, Homo sapiens
cttgggcaatattct

SEQ ID NO: 2384662 - DNA, 20 bp, Homo sapiens
cttgggcaatattctctgta

SEQ ID NO: 2384663 - DNA, 21 bp, Homo sapiens
cttgggcaatattctctgtac

SEQ ID NO: 2384664 - DNA, 13 bp, Homo sapiens
cttgtaatgtaac

SEQ ID NO: 2384665 - DNA, 21 bp, Homo sapiens
ctttatctaccaactttcaag

SEQ ID NO: 2384666 - DNA, 13 bp, Homo sapiens
ctttcaagaactt

SEQ ID NO: 2384667 - DNA, 15 bp, Homo sapiens
ctttcaagaacttgt

SEQ ID NO: 2384668 - DNA, 16 bp, Homo sapiens
ctttgattcacatgtt

SEQ ID NO: 2384669 - DNA, 22 bp, Homo sapiens
ctttggcctgatgaccaatttt

SEQ ID NO: 2384670 - DNA, 23 bp, Homo sapiens
ctttgtctaagaaacattggaag

SEQ ID NO: 2384671 - DNA, 19 bp, Homo sapiens
cttttaaaaagtattgcca

SEQ ID NO: 2384672 - DNA, 21 bp, Homo sapiens
cttttaaaaagtattgccaaa

SEQ ID NO: 2384673 - DNA, 23 bp, Homo sapiens
cttttaaaaagtattgccaaaca

SEQ ID NO: 2384674 - DNA, 19 bp, Homo sapiens
cttttaaaactacttagca

SEQ ID NO: 2384675 - DNA, 18 bp, Homo sapiens
cttttccagtattttagt

SEQ ID NO: 2384676 - DNA, 16 bp, Homo sapiens
cttttcctaacattgt

SEQ ID NO: 2384677 - DNA, 20 bp, Homo sapiens
cttttccttgcatacaaaca

SEQ ID NO: 2384678 - DNA, 13 bp, Homo sapiens
cttttgttttttg

SEQ ID NO: 2384679 - DNA, 17 bp, Homo sapiens
cttttgttttttgaagt

SEQ ID NO: 2384680 - DNA, 15 bp, Homo sapiens
cttttttatatcttg

SEQ ID NO: 2384681 - DNA, 22 bp, Homo sapiens
cttttttttttaagtgaaattt

SEQ ID NO: 2384682 - DNA, 20 bp, Homo sapiens
gaaaaactcaaccaaatggt

SEQ ID NO: 2384683 - DNA, 17 bp, Homo sapiens
gaaaaattattgagcca

SEQ ID NO: 2384684 - DNA, 19 bp, Homo sapiens
gaaaattgcattgaagccc

SEQ ID NO: 2384685 - DNA, 17 bp, Homo sapiens
gaaacactaaatgttaa

SEQ ID NO: 2384686 - DNA, 18 bp, Homo sapiens
gaaacattgcttttaaaa

SEQ ID NO: 2384687 - DNA, 21 bp, Homo sapiens
gaaacattgcttttaaaacta

SEQ ID NO: 2384688 - DNA, 14 bp, Homo sapiens
gaaacattggaagc

SEQ ID NO: 2384689 - DNA, 18 bp, Homo sapiens
gaaacattggaagcaggt

SEQ ID NO: 2384690 - DNA, 19 bp, Homo sapiens
gaaatctatagaaagtgtt

SEQ ID NO: 2384691 - DNA, 14 bp, Homo sapiens
gaaatgaacacaaa

SEQ ID NO: 2384692 - DNA, 23 bp, Homo sapiens
gaaatgtgtgtgatgtgacattt

SEQ ID NO: 2384693 - DNA, 21 bp, Homo sapiens
gaaattatctgccttatacat

SEQ ID NO: 2384694 - DNA, 12 bp, Homo sapiens
gaaatttcacgt

SEQ ID NO: 2384695 - DNA, 12 bp, Homo sapiens
gaaatttttcat

SEQ ID NO: 2384696 - DNA, 19 bp, Homo sapiens
taaaattttaagctaggaa

SEQ ID NO: 2384697 - DNA, 17 bp, Homo sapiens
taaacatcaggttaggc

SEQ ID NO: 2384698 - DNA, 12 bp, Homo sapiens
taaactttgaaa

SEQ ID NO: 2384699 - DNA, 20 bp, Homo sapiens
taaagatgtagcaaaccctg

SEQ ID NO: 2384700 - DNA, 14 bp, Homo sapiens
taaagcgaaaaact

SEQ ID NO: 2384701 - DNA, 13 bp, Homo sapiens
taaagtttcaaaa

SEQ ID NO: 2384702 - DNA, 18 bp, Homo sapiens
taaagtttcaaaaatctg

SEQ ID NO: 2384703 - DNA, 24 bp, Homo sapiens
taaagtttcaaaaatctgaagatt

SEQ ID NO: 2384704 - DNA, 12 bp, Homo sapiens
taaagtttgatc

SEQ ID NO: 2384705 - DNA, 12 bp, Homo sapiens
taaatagtgtta

SEQ ID NO: 2384706 - DNA, 19 bp, Homo sapiens
taaatagtgttattgagag

SEQ ID NO: 2384707 - DNA, 14 bp, Homo sapiens
taaatgaaagctat

SEQ ID NO: 2384708 - DNA, 13 bp, Homo sapiens
taaatgtgaatta

SEQ ID NO: 2384709 - DNA, 22 bp, Homo sapiens
taaatgtgaattactaacttct

SEQ ID NO: 2384710 - DNA, 13 bp, Homo sapiens
taaatgttaaaga

SEQ ID NO: 2384711 - DNA, 15 bp, Homo sapiens
taaatgttttgtaaa

SEQ ID NO: 2384712 - DNA, 21 bp, Homo sapiens
taaatgttttgtaaactttga

SEQ ID NO: 2384713 - DNA, 12 bp, Homo sapiens
taaattgatgtt

SEQ ID NO: 2384714 - DNA, 19 bp, Homo sapiens
taaattgatgttgatgcaa

SEQ ID NO: 2384715 - DNA, 17 bp, Homo sapiens
taacaaataacaacttt

SEQ ID NO: 2384716 - DNA, 15 bp, Homo sapiens
taactgaaatacttt

SEQ ID NO: 2384717 - DNA, 14 bp, Homo sapiens
taactgttaccatt

SEQ ID NO: 2384718 - DNA, 18 bp, Homo sapiens
taacttgcttaaatgtga

SEQ ID NO: 2384719 - DNA, 21 bp, Homo sapiens
taagaatgactgatgttgtgt

SEQ ID NO: 2384720 - DNA, 15 bp, Homo sapiens
taagaattttttatt

SEQ ID NO: 2384721 - DNA, 17 bp, Homo sapiens
taagatcggttaacaaa

SEQ ID NO: 2384722 - DNA, 22 bp, Homo sapiens
taagatgttatatttttcttaa

SEQ ID NO: 2384723 - DNA, 22 bp, Homo sapiens
taagctaggaaaagaaatctat

SEQ ID NO: 2384724 - DNA, 17 bp, Homo sapiens
taagtctcttttttaca

SEQ ID NO: 2384725 - DNA, 19 bp, Homo sapiens
taagtctcttttttacaaa

SEQ ID NO: 2384726 - DNA, 21 bp, Homo sapiens
taagtctcttttttacaaagg

SEQ ID NO: 2384727 - DNA, 22 bp, Homo sapiens
taagttggaaacactaaatgtt

SEQ ID NO: 2384728 - DNA, 22 bp, Homo sapiens
taatgtttaagcagaattggaa

SEQ ID NO: 2384729 - DNA, 14 bp, Homo sapiens
taattctgaagtta

SEQ ID NO: 2384730 - DNA, 17 bp, Homo sapiens
taattctgaagttatat

SEQ ID NO: 2384731 - DNA, 22 bp, Homo sapiens
taattcttattccatattagaa

SEQ ID NO: 2384732 - DNA, 15 bp, Homo sapiens
tacaaaatgtaactg

SEQ ID NO: 2384733 - DNA, 19 bp, Homo sapiens
tacaaacaagcatataaaa

SEQ ID NO: 2384734 - DNA, 16 bp, Homo sapiens
tacaaaggctgtattc

SEQ ID NO: 2384735 - DNA, 17 bp, Homo sapiens
tacaaaggctgtattca

SEQ ID NO: 2384736 - DNA, 13 bp, Homo sapiens
tacaaatgattgc

SEQ ID NO: 2384737 - DNA, 19 bp, Homo sapiens
tacaaatgattgcttttaa

SEQ ID NO: 2384738 - DNA, 20 bp, Homo sapiens
tacaaatgattgcttttaaa

SEQ ID NO: 2384739 - DNA, 23 bp, Homo sapiens
tacaaatgattgcttttaaaatt

SEQ ID NO: 2384740 - DNA, 17 bp, Homo sapiens
tacaatatttgtgtgct

SEQ ID NO: 2384741 - DNA, 19 bp, Homo sapiens
tacagagccgtaaaaactg

SEQ ID NO: 2384742 - DNA, 22 bp, Homo sapiens
tacagagccgtaaaaactgaag

SEQ ID NO: 2384743 - DNA, 14 bp, Homo sapiens
tacaggtactttgt

SEQ ID NO: 2384744 - DNA, 16 bp, Homo sapiens
tacagttacttttcct

SEQ ID NO: 2384745 - DNA, 17 bp, Homo sapiens
tacagttacttttcctt

SEQ ID NO: 2384746 - DNA, 18 bp, Homo sapiens
tacattaactaattcaat

SEQ ID NO: 2384747 - DNA, 21 bp, Homo sapiens
tacattctcagtttttcttaa

SEQ ID NO: 2384748 - DNA, 12 bp, Homo sapiens
taccaactttca

SEQ ID NO: 2384749 - DNA, 21 bp, Homo sapiens
taccaactttcaagaacttgt

SEQ ID NO: 2384750 - DNA, 15 bp, Homo sapiens
taccattggaaattt

SEQ ID NO: 2384751 - DNA, 17 bp, Homo sapiens
taccattggaaatttca

SEQ ID NO: 2384752 - DNA, 19 bp, Homo sapiens
taccatttccgtaattctt

SEQ ID NO: 2384753 - DNA, 17 bp, Homo sapiens
taccttaaaatttgaaa

SEQ ID NO: 2384754 - DNA, 20 bp, Homo sapiens
taccttaaaatttgaaacat

SEQ ID NO: 2384755 - DNA, 12 bp, Homo sapiens
tactaacttcta

SEQ ID NO: 2384756 - DNA, 19 bp, Homo sapiens
tactaacttctaaaactgt

SEQ ID NO: 2384757 - DNA, 20 bp, Homo sapiens
tactaacttctaaaactgta

SEQ ID NO: 2384758 - DNA, 18 bp, Homo sapiens
tactgagcagtgatattc

SEQ ID NO: 2384759 - DNA, 16 bp, Homo sapiens
tactttatagaagaat

SEQ ID NO: 2384760 - DNA, 23 bp, Homo sapiens
tactttgattcacatgttttcaa

SEQ ID NO: 2384761 - DNA, 17 bp, Homo sapiens
tactttgtctaagaaac

SEQ ID NO: 2384762 - DNA, 20 bp, Homo sapiens
tactttgtctaagaaacatt

SEQ ID NO: 2384763 - DNA, 19 bp, Homo sapiens
tagaaagtgttctgttaca

SEQ ID NO: 2384764 - DNA, 22 bp, Homo sapiens
tagaaagtgttctgttacaaaa

SEQ ID NO: 2384765 - DNA, 21 bp, Homo sapiens
tagaatgaccttgtaatgtaa

SEQ ID NO: 2384766 - DNA, 15 bp, Homo sapiens
tagataattaaccaa

SEQ ID NO: 2384767 - DNA, 18 bp, Homo sapiens
tagcaaaaaaagttgtat

SEQ ID NO: 2384768 - DNA, 15 bp, Homo sapiens
tagcatttatggtaa

SEQ ID NO: 2384769 - DNA, 16 bp, Homo sapiens
taggaacaaatcttcc

SEQ ID NO: 2384770 - DNA, 22 bp, Homo sapiens
taggaacaaatcttcctggtcg

SEQ ID NO: 2384771 - DNA, 16 bp, Homo sapiens
taggaaggtcatttcc

SEQ ID NO: 2384772 - DNA, 19 bp, Homo sapiens
taggaaggtcatttccatg

SEQ ID NO: 2384773 - DNA, 21 bp, Homo sapiens
taggaagttagcctttatcta

SEQ ID NO: 2384774 - DNA, 16 bp, Homo sapiens
taggaatattatattt

SEQ ID NO: 2384775 - DNA, 17 bp, Homo sapiens
taggaatattatatttg

SEQ ID NO: 2384776 - DNA, 20 bp, Homo sapiens
taggaatattatatttggat

SEQ ID NO: 2384777 - DNA, 18 bp, Homo sapiens
taggatatgcctgctctt

SEQ ID NO: 2384778 - DNA, 15 bp, Homo sapiens
taggcagtataaaga

SEQ ID NO: 2384779 - DNA, 19 bp, Homo sapiens
taggcagtataaagaatag

SEQ ID NO: 2384780 - DNA, 14 bp, Homo sapiens
tagtactttataga

SEQ ID NO: 2384781 - DNA, 21 bp, Homo sapiens
tagtaggatatgcctgctctt

SEQ ID NO: 2384782 - DNA, 16 bp, Homo sapiens
tagtaggggtaccact

SEQ ID NO: 2384783 - DNA, 17 bp, Homo sapiens
tagtatttgaaaacaga

SEQ ID NO: 2384784 - DNA, 22 bp, Homo sapiens
tagtatttgaaaacagaaattg

SEQ ID NO: 2384785 - DNA, 22 bp, Homo sapiens
tagtgcaatatattttgtatgc

SEQ ID NO: 2384786 - DNA, 18 bp, Homo sapiens
tagtggaccctgaaatgt

SEQ ID NO: 2384787 - DNA, 22 bp, Homo sapiens
tagtgttattgagagagatgtg

SEQ ID NO: 2384788 - DNA, 15 bp, Homo sapiens
tagttagcatacaca

SEQ ID NO: 2384789 - DNA, 12 bp, Homo sapiens
tatagaaagtgt

SEQ ID NO: 2384790 - DNA, 21 bp, Homo sapiens
tatagaaagtgttctgttaca

SEQ ID NO: 2384791 - DNA, 14 bp, Homo sapiens
tatagaagtcttca

SEQ ID NO: 2384792 - DNA, 15 bp, Homo sapiens
tatagaagtcttcat

SEQ ID NO: 2384793 - DNA, 22 bp, Homo sapiens
tatagaagtcttcatgaaatgc

SEQ ID NO: 2384794 - DNA, 20 bp, Homo sapiens
tatagacaggagaagaaaga

SEQ ID NO: 2384795 - DNA, 17 bp, Homo sapiens
tatagtatttgaaaaca

SEQ ID NO: 2384796 - DNA, 18 bp, Homo sapiens
tatagtatttgaaaacag

SEQ ID NO: 2384797 - DNA, 20 bp, Homo sapiens
tatagtatttgaaaacagaa

SEQ ID NO: 2384798 - DNA, 16 bp, Homo sapiens
tatagtgcaatatatt

SEQ ID NO: 2384799 - DNA, 15 bp, Homo sapiens
tatatggtctaatgt

SEQ ID NO: 2384800 - DNA, 22 bp, Homo sapiens
tatatttcctataccatttccg

SEQ ID NO: 2384801 - DNA, 23 bp, Homo sapiens
tatatttggatgcagagttcagg

SEQ ID NO: 2384802 - DNA, 15 bp, Homo sapiens
tatctaccaactttc

SEQ ID NO: 2384803 - DNA, 20 bp, Homo sapiens
tatctaccaactttcaagaa

SEQ ID NO: 2384804 - DNA, 16 bp, Homo sapiens
tatcttggcaggtagg

SEQ ID NO: 2384805 - DNA, 16 bp, Homo sapiens
tatgcactaagtctct

SEQ ID NO: 2384806 - DNA, 17 bp, Homo sapiens
tatgcactaagtctctt

SEQ ID NO: 2384807 - DNA, 16 bp, Homo sapiens
tatgcctgctctttgg

SEQ ID NO: 2384808 - DNA, 14 bp, Homo sapiens
tatgctaagaattt

SEQ ID NO: 2384809 - DNA, 16 bp, Homo sapiens
tatgctaagaattttt

SEQ ID NO: 2384810 - DNA, 13 bp, Homo sapiens
tatggtctaatgt

SEQ ID NO: 2384811 - DNA, 23 bp, Homo sapiens
tatggtctaatgtttaagcagaa

SEQ ID NO: 2384812 - DNA, 15 bp, Homo sapiens
tatgtcatttcatgt

SEQ ID NO: 2384813 - DNA, 20 bp, Homo sapiens
tatgtttttcagttcaaagt

SEQ ID NO: 2384814 - DNA, 13 bp, Homo sapiens
tattaaaaagtct

SEQ ID NO: 2384815 - DNA, 15 bp, Homo sapiens
tattaaaaagtcttt

SEQ ID NO: 2384816 - DNA, 22 bp, Homo sapiens
tattaaaaagtcttttaaaaag

SEQ ID NO: 2384817 - DNA, 13 bp, Homo sapiens
tattaaaacattt

SEQ ID NO: 2384818 - DNA, 19 bp, Homo sapiens
tattaaaggtatacaaata

SEQ ID NO: 2384819 - DNA, 15 bp, Homo sapiens
tattaaagtttcaaa

SEQ ID NO: 2384820 - DNA, 22 bp, Homo sapiens
tattaaagtttcaaaaatctga

SEQ ID NO: 2384821 - DNA, 16 bp, Homo sapiens
tattagaaaactttgt

SEQ ID NO: 2384822 - DNA, 18 bp, Homo sapiens
tattagcgacaacagatt

SEQ ID NO: 2384823 - DNA, 23 bp, Homo sapiens
tattagcgacaacagattggatt

SEQ ID NO: 2384824 - DNA, 11 bp, Homo sapiens
tattatatttg

SEQ ID NO: 2384825 - DNA, 20 bp, Homo sapiens
tattccatattagaaaactt

SEQ ID NO: 2384826 - DNA, 14 bp, Homo sapiens
tattctaaaatata

SEQ ID NO: 2384827 - DNA, 17 bp, Homo sapiens
tattctgggaatgtata

SEQ ID NO: 2384828 - DNA, 12 bp, Homo sapiens
tattctttgtta

SEQ ID NO: 2384829 - DNA, 17 bp, Homo sapiens
tattgccaaacattaat

SEQ ID NO: 2384830 - DNA, 20 bp, Homo sapiens
tattggccataagcaacaat

SEQ ID NO: 2384831 - DNA, 16 bp, Homo sapiens
tattggtctgtccttt

SEQ ID NO: 2384832 - DNA, 19 bp, Homo sapiens
tatttcctataccatttcc

SEQ ID NO: 2384833 - DNA, 19 bp, Homo sapiens
tatttgaaaacagaaattg

SEQ ID NO: 2384834 - DNA, 15 bp, Homo sapiens
tatttggatgcagag

SEQ ID NO: 2384835 - DNA, 16 bp, Homo sapiens
tatttggatgcagagt

SEQ ID NO: 2384836 - DNA, 19 bp, Homo sapiens
tatttggatgcagagttca

SEQ ID NO: 2384837 - DNA, 12 bp, Homo sapiens
tatttgtgtgct

SEQ ID NO: 2384838 - DNA, 15 bp, Homo sapiens
tattttaatgtattg

SEQ ID NO: 2384839 - DNA, 14 bp, Homo sapiens
tattttctaaagta

SEQ ID NO: 2384840 - DNA, 16 bp, Homo sapiens
tattttgtatgcaagc

SEQ ID NO: 2384841 - DNA, 17 bp, Homo sapiens
tattttgtgagtttgtt

SEQ ID NO: 2384842 - DNA, 23 bp, Homo sapiens
tattttgtgagtttgtttctttg

SEQ ID NO: 2384843 - DNA, 11 bp, Homo sapiens
tcaaaaatctg

SEQ ID NO: 2384844 - DNA, 20 bp, Homo sapiens
tcaaaaatctgaagattgtt

SEQ ID NO: 2384845 - DNA, 14 bp, Homo sapiens
tcaaaattggattt

SEQ ID NO: 2384846 - DNA, 17 bp, Homo sapiens
tcaaacattagtacttt

SEQ ID NO: 2384847 - DNA, 18 bp, Homo sapiens
tcaaacattagtacttta

SEQ ID NO: 2384848 - DNA, 20 bp, Homo sapiens
tcaaacattagtactttata

SEQ ID NO: 2384849 - DNA, 15 bp, Homo sapiens
tcaaactttctgcct

SEQ ID NO: 2384850 - DNA, 16 bp, Homo sapiens
tcaaactttctgcctt

SEQ ID NO: 2384851 - DNA, 22 bp, Homo sapiens
tcaaagtcatgatgtttttaaa

SEQ ID NO: 2384852 - DNA, 16 bp, Homo sapiens
tcaaccaaatggtaca

SEQ ID NO: 2384853 - DNA, 20 bp, Homo sapiens
tcaaccaaatggtacaaaac

SEQ ID NO: 2384854 - DNA, 12 bp, Homo sapiens
tcaataaagttt

SEQ ID NO: 2384855 - DNA, 15 bp, Homo sapiens
tcaataaagtttgat

SEQ ID NO: 2384856 - DNA, 17 bp, Homo sapiens
tcaataaagtttgatct

SEQ ID NO: 2384857 - DNA, 18 bp, Homo sapiens
tcaataaagtttgatctt

SEQ ID NO: 2384858 - DNA, 19 bp, Homo sapiens
tcaataaagtttgatcttc

SEQ ID NO: 2384859 - DNA, 14 bp, Homo sapiens
tcacaaatattaaa

SEQ ID NO: 2384860 - DNA, 15 bp, Homo sapiens
tcacaaatattaaaa

SEQ ID NO: 2384861 - DNA, 20 bp, Homo sapiens
tcacaaatattaaaaagtct

SEQ ID NO: 2384862 - DNA, 18 bp, Homo sapiens
tcacatgttttcaaatgg

SEQ ID NO: 2384863 - DNA, 20 bp, Homo sapiens
tcacatgttttcaaatggag

SEQ ID NO: 2384864 - DNA, 14 bp, Homo sapiens
tcactctaagatgt

SEQ ID NO: 2384865 - DNA, 22 bp, Homo sapiens
tcactctaagatgttatatttt

SEQ ID NO: 2384866 - DNA, 22 bp, Homo sapiens
tcagattccaagtgtatttaaa

SEQ ID NO: 2384867 - DNA, 15 bp, Homo sapiens
tcagatttgcacaaa

SEQ ID NO: 2384868 - DNA, 20 bp, Homo sapiens
tcagatttgcacaaaaagat

SEQ ID NO: 2384869 - DNA, 22 bp, Homo sapiens
tcagcaaggcgctaacttgctt

SEQ ID NO: 2384870 - DNA, 19 bp, Homo sapiens
tcagctaggaacaaatctt

SEQ ID NO: 2384871 - DNA, 13 bp, Homo sapiens
tcagttcaaagtc

SEQ ID NO: 2384872 - DNA, 15 bp, Homo sapiens
tcagtttatgttttg

SEQ ID NO: 2384873 - DNA, 15 bp, Homo sapiens
tcataggaagttagc

SEQ ID NO: 2384874 - DNA, 14 bp, Homo sapiens
tcatattacaatat

SEQ ID NO: 2384875 - DNA, 21 bp, Homo sapiens
tcatgatgtttttaaaatctt

SEQ ID NO: 2384876 - DNA, 15 bp, Homo sapiens
tcatgtcctgtgtca

SEQ ID NO: 2384877 - DNA, 19 bp, Homo sapiens
tcatgtcctgtgtcagttt

SEQ ID NO: 2384878 - DNA, 12 bp, Homo sapiens
tcattagcaaaa

SEQ ID NO: 2384879 - DNA, 18 bp, Homo sapiens
tcattagcaaaaaaagtt

SEQ ID NO: 2384880 - DNA, 24 bp, Homo sapiens
tcattcaccagtacattctcagtt

SEQ ID NO: 2384881 - DNA, 23 bp, Homo sapiens
tcatttcatgtcctgtgtcagtt

SEQ ID NO: 2384882 - DNA, 22 bp, Homo sapiens
tcattttacagttacttttcct

SEQ ID NO: 2384883 - DNA, 11 bp, Homo sapiens
tcattttcatt

SEQ ID NO: 2384884 - DNA, 12 bp, Homo sapiens
tcattttcatta

SEQ ID NO: 2384885 - DNA, 17 bp, Homo sapiens
tccatatttttttcctt

SEQ ID NO: 2384886 - DNA, 19 bp, Homo sapiens
tccatgtagcctttaatat

SEQ ID NO: 2384887 - DNA, 20 bp, Homo sapiens
tccatgtatgcataataatc

SEQ ID NO: 2384888 - DNA, 15 bp, Homo sapiens
tcctctgctaaattg

SEQ ID NO: 2384889 - DNA, 18 bp, Homo sapiens
tcctctgctaaattgatg

SEQ ID NO: 2384890 - DNA, 16 bp, Homo sapiens
tccttacaaatgattg

SEQ ID NO: 2384891 - DNA, 20 bp, Homo sapiens
tccttacaaatgattgcttt

SEQ ID NO: 2384892 - DNA, 22 bp, Homo sapiens
tccttatttaagacatgtttaa

SEQ ID NO: 2384893 - DNA, 16 bp, Homo sapiens
tcgtatagaagtcttc

SEQ ID NO: 2384894 - DNA, 20 bp, Homo sapiens
tcgtatagaagtcttcatga

SEQ ID NO: 2384895 - DNA, 18 bp, Homo sapiens
tctaaaactgtactttga

SEQ ID NO: 2384896 - DNA, 19 bp, Homo sapiens
tctaaaactgtactttgat

SEQ ID NO: 2384897 - DNA, 16 bp, Homo sapiens
tctaaagtactgagca

SEQ ID NO: 2384898 - DNA, 14 bp, Homo sapiens
tctaagaaacattg

SEQ ID NO: 2384899 - DNA, 14 bp, Homo sapiens
tctaagatgttata

SEQ ID NO: 2384900 - DNA, 14 bp, Homo sapiens
tctaccaactttca

SEQ ID NO: 2384901 - DNA, 17 bp, Homo sapiens
tctaccaactttcaaga

SEQ ID NO: 2384902 - DNA, 22 bp, Homo sapiens
tctaccaactttcaagaacttg

SEQ ID NO: 2384903 - DNA, 12 bp, Homo sapiens
tctatagaaagt

SEQ ID NO: 2384904 - DNA, 13 bp, Homo sapiens
tctatagaaagtg

SEQ ID NO: 2384905 - DNA, 14 bp, Homo sapiens
tctatagaaagtgt

SEQ ID NO: 2384906 - DNA, 16 bp, Homo sapiens
tctatagaaagtgttc

SEQ ID NO: 2384907 - DNA, 18 bp, Homo sapiens
tctcagtttttcttaata

SEQ ID NO: 2384908 - DNA, 13 bp, Homo sapiens
tctcttatctgtg

SEQ ID NO: 2384909 - DNA, 15 bp, Homo sapiens
tctcttttttacaaa

SEQ ID NO: 2384910 - DNA, 14 bp, Homo sapiens
tctgaagattgttt

SEQ ID NO: 2384911 - DNA, 19 bp, Homo sapiens
tctgaagattgtttatcta

SEQ ID NO: 2384912 - DNA, 14 bp, Homo sapiens
tctgaagttatatt

SEQ ID NO: 2384913 - DNA, 19 bp, Homo sapiens
tctgaagttatatttccta

SEQ ID NO: 2384914 - DNA, 20 bp, Homo sapiens
tctgagagaggctaaaatgt

SEQ ID NO: 2384915 - DNA, 18 bp, Homo sapiens
tctgcctctgatgtattt

SEQ ID NO: 2384916 - DNA, 17 bp, Homo sapiens
tctgctaaattgatgtt

SEQ ID NO: 2384917 - DNA, 20 bp, Homo sapiens
tctgctaaattgatgttgat

SEQ ID NO: 2384918 - DNA, 23 bp, Homo sapiens
tctgtaagctgtttggttttaaa

SEQ ID NO: 2384919 - DNA, 12 bp, Homo sapiens
tctgttttcaat

SEQ ID NO: 2384920 - DNA, 18 bp, Homo sapiens
tcttattaaagtttcaaa

SEQ ID NO: 2384921 - DNA, 19 bp, Homo sapiens
tcttattaaagtttcaaaa

SEQ ID NO: 2384922 - DNA, 18 bp, Homo sapiens
tcttattccatattagaa

SEQ ID NO: 2384923 - DNA, 21 bp, Homo sapiens
tcttcctctgctaaattgatg

SEQ ID NO: 2384924 - DNA, 20 bp, Homo sapiens
tcttcctggtcgaaagttag

SEQ ID NO: 2384925 - DNA, 20 bp, Homo sapiens
tcttggaacacctggcatgt

SEQ ID NO: 2384926 - DNA, 22 bp, Homo sapiens
tcttgggcaatattctctgtac

SEQ ID NO: 2384927 - DNA, 16 bp, Homo sapiens
tctttgaattttcatt

SEQ ID NO: 2384928 - DNA, 19 bp, Homo sapiens
tctttgaattttcatttta

SEQ ID NO: 2384929 - DNA, 14 bp, Homo sapiens
tctttgttaatttg

SEQ ID NO: 2384930 - DNA, 18 bp, Homo sapiens
tcttttttacaaaggctg

SEQ ID NO: 2384931 - DNA, 19 bp, Homo sapiens
tcttttttacaaaggctgt

SEQ ID NO: 2384932 - DNA, 15 bp, Homo sapiens
tgaaaacagaaattg

SEQ ID NO: 2384933 - DNA, 17 bp, Homo sapiens
tgaaacattgcttttaa

SEQ ID NO: 2384934 - DNA, 22 bp, Homo sapiens
tgaaatgaacacaaattatgct

SEQ ID NO: 2384935 - DNA, 17 bp, Homo sapiens
tgaaatgctatgtcatt

SEQ ID NO: 2384936 - DNA, 21 bp, Homo sapiens
tgaaatgctatgtcatttcat

SEQ ID NO: 2384937 - DNA, 17 bp, Homo sapiens
tgaaatgtgtgtgatgt

SEQ ID NO: 2384938 - DNA, 13 bp, Homo sapiens
tgaaatttattga

SEQ ID NO: 2384939 - DNA, 18 bp, Homo sapiens
tgaaatttttcatatttt

SEQ ID NO: 2384940 - DNA, 17 bp, Homo sapiens
tgaacacaaattatgct

SEQ ID NO: 2384941 - DNA, 13 bp, Homo sapiens
tgaagattgttta

SEQ ID NO: 2384942 - DNA, 21 bp, Homo sapiens
tgaaggaccttcactctaaga

SEQ ID NO: 2384943 - DNA, 16 bp, Homo sapiens
tgaagttatatttcct

SEQ ID NO: 2384944 - DNA, 22 bp, Homo sapiens
tgaagttctgcctctgatgtat

SEQ ID NO: 2384945 - DNA, 15 bp, Homo sapiens
tgaattttcatttta

SEQ ID NO: 2384946 - DNA, 18 bp, Homo sapiens
tgacatttgtcattttca

SEQ ID NO: 2384947 - DNA, 12 bp, Homo sapiens
tgaccttgtaat

SEQ ID NO: 2384948 - DNA, 14 bp, Homo sapiens
tgaccttgtaatgt

SEQ ID NO: 2384949 - DNA, 21 bp, Homo sapiens
tgaccttgtaatgtaactgct

SEQ ID NO: 2384950 - DNA, 16 bp, Homo sapiens
tgagagagatgtgtaa

SEQ ID NO: 2384951 - DNA, 22 bp, Homo sapiens
tgagagagatgtgtaatttttc

SEQ ID NO: 2384952 - DNA, 18 bp, Homo sapiens
tgagagaggctaaaatgt

SEQ ID NO: 2384953 - DNA, 18 bp, Homo sapiens
tgaggaaaaatatgtgaa

SEQ ID NO: 2384954 - DNA, 20 bp, Homo sapiens
tgagtttgtttctttgaatt

SEQ ID NO: 2384955 - DNA, 17 bp, Homo sapiens
tgataaatagtgttatt

SEQ ID NO: 2384956 - DNA, 19 bp, Homo sapiens
tgatcattcaccagtacat

SEQ ID NO: 2384957 - DNA, 17 bp, Homo sapiens
tgatcttcctctgctaa

SEQ ID NO: 2384958 - DNA, 13 bp, Homo sapiens
tgatgtgacattt

SEQ ID NO: 2384959 - DNA, 18 bp, Homo sapiens
tgatgtgacatttgtcat

SEQ ID NO: 2384960 - DNA, 15 bp, Homo sapiens
tgatgttgatgcaat

SEQ ID NO: 2384961 - DNA, 19 bp, Homo sapiens
tgatgttgatgcaatcctt

SEQ ID NO: 2384962 - DNA, 18 bp, Homo sapiens
tgatgtttttaaaatctt

SEQ ID NO: 2384963 - DNA, 13 bp, Homo sapiens
tgattcacatgtt

SEQ ID NO: 2384964 - DNA, 21 bp, Homo sapiens
tgattcacatgttttcaaatg

SEQ ID NO: 2384965 - DNA, 20 bp, Homo sapiens
tgattgcttttaaaatttta

SEQ ID NO: 2384966 - DNA, 15 bp, Homo sapiens
tgatttcacaaatat

SEQ ID NO: 2384967 - DNA, 16 bp, Homo sapiens
tgatttcacaaatatt

SEQ ID NO: 2384968 - DNA, 21 bp, Homo sapiens
tgcaaagtacaggtactttgt

SEQ ID NO: 2384969 - DNA, 15 bp, Homo sapiens
tgcaagcagtttcaa

SEQ ID NO: 2384970 - DNA, 21 bp, Homo sapiens
tgcaagcagtttcaataaagt

SEQ ID NO: 2384971 - DNA, 23 bp, Homo sapiens
tgcaagcagtttcaataaagttt

SEQ ID NO: 2384972 - DNA, 14 bp, Homo sapiens
tgcaatatattttg

SEQ ID NO: 2384973 - DNA, 20 bp, Homo sapiens
tgcaatatattttgtatgca

SEQ ID NO: 2384974 - DNA, 14 bp, Homo sapiens
tgcaatccttacaa

SEQ ID NO: 2384975 - DNA, 17 bp, Homo sapiens
tgcaatccttacaaatg

SEQ ID NO: 2384976 - DNA, 20 bp, Homo sapiens
tgcaatccttacaaatgatt

SEQ ID NO: 2384977 - DNA, 17 bp, Homo sapiens
tgcacatgatttcacaa

SEQ ID NO: 2384978 - DNA, 18 bp, Homo sapiens
tgcacatgatttcacaaa

SEQ ID NO: 2384979 - DNA, 19 bp, Homo sapiens
tgcacatgatttcacaaat

SEQ ID NO: 2384980 - DNA, 23 bp, Homo sapiens
tgcacatgatttcacaaatatta

SEQ ID NO: 2384981 - DNA, 23 bp, Homo sapiens
tgcactaagtctcttttttacaa

SEQ ID NO: 2384982 - DNA, 10 bp, Homo sapiens
tgcactgaag

SEQ ID NO: 2384983 - DNA, 19 bp, Homo sapiens
tgcactgaagtttgataaa

SEQ ID NO: 2384984 - DNA, 19 bp, Homo sapiens
tgcagagttcagggaagat

SEQ ID NO: 2384985 - DNA, 23 bp, Homo sapiens
tgcataattctgaagttatattt

SEQ ID NO: 2384986 - DNA, 23 bp, Homo sapiens
tgcatacaaacaagcatataaaa

SEQ ID NO: 2384987 - DNA, 17 bp, Homo sapiens
tgcattgggtgatcatt

SEQ ID NO: 2384988 - DNA, 15 bp, Homo sapiens
tgcctatattaaagg

SEQ ID NO: 2384989 - DNA, 22 bp, Homo sapiens
tgcctatattaaaggtatacaa

SEQ ID NO: 2384990 - DNA, 23 bp, Homo sapiens
tgcctgctctttggcctgatgac

SEQ ID NO: 2384991 - DNA, 17 bp, Homo sapiens
tgctaaattgatgttga

SEQ ID NO: 2384992 - DNA, 18 bp, Homo sapiens
tgctaaattgatgttgat

SEQ ID NO: 2384993 - DNA, 21 bp, Homo sapiens
tgctaaattgatgttgatgca

SEQ ID NO: 2384994 - DNA, 19 bp, Homo sapiens
tgctaagaattttttattt

SEQ ID NO: 2384995 - DNA, 12 bp, Homo sapiens
tgcttaaatgtg

SEQ ID NO: 2384996 - DNA, 15 bp, Homo sapiens
tgcttaaatgtgaat

SEQ ID NO: 2384997 - DNA, 17 bp, Homo sapiens
tgcttaaatgtgaatta

SEQ ID NO: 2384998 - DNA, 13 bp, Homo sapiens
tgcttttaaaact

SEQ ID NO: 2384999 - DNA, 17 bp, Homo sapiens
tgcttttaaaactactt

SEQ ID NO: 2385000 - DNA, 13 bp, Homo sapiens
tgcttttaaaatt

SEQ ID NO: 2385001 - DNA, 16 bp, Homo sapiens
tggaaacactaaatgt

SEQ ID NO: 2385002 - DNA, 13 bp, Homo sapiens
tggaaatttcacg

SEQ ID NO: 2385003 - DNA, 14 bp, Homo sapiens
tggaaatttcacgt

SEQ ID NO: 2385004 - DNA, 20 bp, Homo sapiens
tggaagcaggttaaatgttt

SEQ ID NO: 2385005 - DNA, 17 bp, Homo sapiens
tggaattttaagtcttt

SEQ ID NO: 2385006 - DNA, 14 bp, Homo sapiens
tggaccattttcct

SEQ ID NO: 2385007 - DNA, 15 bp, Homo sapiens
tggaccctgaaatgt

SEQ ID NO: 2385008 - DNA, 18 bp, Homo sapiens
tggaccctgaaatgtgtg

SEQ ID NO: 2385009 - DNA, 14 bp, Homo sapiens
tggagagataggaa

SEQ ID NO: 2385010 - DNA, 17 bp, Homo sapiens
tggagttcattcatatt

SEQ ID NO: 2385011 - DNA, 15 bp, Homo sapiens
tggatttagcttgtt

SEQ ID NO: 2385012 - DNA, 13 bp, Homo sapiens
tggattttatgtt

SEQ ID NO: 2385013 - DNA, 15 bp, Homo sapiens
tggattttatgttga

SEQ ID NO: 2385014 - DNA, 13 bp, Homo sapiens
tggcaacaaactg

SEQ ID NO: 2385015 - DNA, 16 bp, Homo sapiens
tggcacagggcatgaa

SEQ ID NO: 2385016 - DNA, 19 bp, Homo sapiens
tggcacagggcatgaaatg

SEQ ID NO: 2385017 - DNA, 20 bp, Homo sapiens
tgggaatgtatagtatttga

SEQ ID NO: 2385018 - DNA, 23 bp, Homo sapiens
tgggaatgtatagtatttgaaaa

SEQ ID NO: 2385019 - DNA, 23 bp, Homo sapiens
tggtattggccataagcaacaat

SEQ ID NO: 2385020 - DNA, 14 bp, Homo sapiens
tggtccacttttcc

SEQ ID NO: 2385021 - DNA, 20 bp, Homo sapiens
tggttatagtgcaatatatt

SEQ ID NO: 2385022 - DNA, 16 bp, Homo sapiens
tggttttaaaatactg

SEQ ID NO: 2385023 - DNA, 14 bp, Homo sapiens
tgtaaactttgaaa

SEQ ID NO: 2385024 - DNA, 20 bp, Homo sapiens
tgtaaatattccttatttaa

SEQ ID NO: 2385025 - DNA, 22 bp, Homo sapiens
tgtaactgctcttgggcaatat

SEQ ID NO: 2385026 - DNA, 18 bp, Homo sapiens
tgtaatgtaactgctctt

SEQ ID NO: 2385027 - DNA, 16 bp, Homo sapiens
tgtaatttttctgtat

SEQ ID NO: 2385028 - DNA, 13 bp, Homo sapiens
tgtaccattaaaa

SEQ ID NO: 2385029 - DNA, 18 bp, Homo sapiens
tgtactttgattcacatg

SEQ ID NO: 2385030 - DNA, 20 bp, Homo sapiens
tgtactttgattcacatgtt

SEQ ID NO: 2385031 - DNA, 18 bp, Homo sapiens
tgtagcaaaccctgtcaa

SEQ ID NO: 2385032 - DNA, 16 bp, Homo sapiens
tgtatagtatttgaaa

SEQ ID NO: 2385033 - DNA, 17 bp, Homo sapiens
tgtatagtatttgaaaa

SEQ ID NO: 2385034 - DNA, 20 bp, Homo sapiens
tgtatgcaagcagtttcaat

SEQ ID NO: 2385035 - DNA, 13 bp, Homo sapiens
tgtatgtttttca

SEQ ID NO: 2385036 - DNA, 15 bp, Homo sapiens
tgtatgtttttcagt

SEQ ID NO: 2385037 - DNA, 15 bp, Homo sapiens
tgtattttgtgagtt

SEQ ID NO: 2385038 - DNA, 12 bp, Homo sapiens
tgtcaaacatta

SEQ ID NO: 2385039 - DNA, 20 bp, Homo sapiens
tgtcaaacattagtacttta

SEQ ID NO: 2385040 - DNA, 13 bp, Homo sapiens
ggtaagaaagctg

SEQ ID NO: 2385041 - DNA, 12 bp, Homo sapiens
ggtaccttgcac

SEQ ID NO: 2385042 - DNA, 23 bp, Homo sapiens
ggtaccttgcacacatcatctgt

SEQ ID NO: 2385043 - DNA, 24 bp, Homo sapiens
ggtaccttgcacacatcatctgta

SEQ ID NO: 2385044 - DNA, 23 bp, Homo sapiens
ggtagaggggtgctttgcctgtt

SEQ ID NO: 2385045 - DNA, 21 bp, Homo sapiens
ggtaggaatattatatttgga

SEQ ID NO: 2385046 - DNA, 20 bp, Homo sapiens
ggtccacttttccagtattt

SEQ ID NO: 2385047 - DNA, 15 bp, Homo sapiens
ggttatagtgcaata

SEQ ID NO: 2385048 - DNA, 13 bp, Homo sapiens
ggttctatgcaaa

SEQ ID NO: 2385049 - DNA, 13 bp, Homo sapiens
gtaaaaactgaag

SEQ ID NO: 2385050 - DNA, 14 bp, Homo sapiens
gtaaaaactgaagt

SEQ ID NO: 2385051 - DNA, 12 bp, Homo sapiens
gtaactgttacc

SEQ ID NO: 2385052 - DNA, 17 bp, Homo sapiens
gtaactgttaccattgg

SEQ ID NO: 2385053 - DNA, 18 bp, Homo sapiens
gtaagctgtttggtttta

SEQ ID NO: 2385054 - DNA, 12 bp, Homo sapiens
gtaatcatatta

SEQ ID NO: 2385055 - DNA, 14 bp, Homo sapiens
gtaatgtaactgct

SEQ ID NO: 2385056 - DNA, 16 bp, Homo sapiens
gtaattcttattccat

SEQ ID NO: 2385057 - DNA, 22 bp, Homo sapiens
gtaattcttattccatattaga

SEQ ID NO: 2385058 - DNA, 20 bp, Homo sapiens
gtacagagccgtaaaaactg

SEQ ID NO: 2385059 - DNA, 15 bp, Homo sapiens
gtacaggtactttgt

SEQ ID NO: 2385060 - DNA, 16 bp, Homo sapiens
gtacaggtactttgtc

SEQ ID NO: 2385061 - DNA, 20 bp, Homo sapiens
gtacaggtttttttggattt

SEQ ID NO: 2385062 - DNA, 15 bp, Homo sapiens
gtacattctcagttt

SEQ ID NO: 2385063 - DNA, 17 bp, Homo sapiens
gtaccactgaatctgta

SEQ ID NO: 2385064 - DNA, 15 bp, Homo sapiens
gtaccattaaaatat

SEQ ID NO: 2385065 - DNA, 13 bp, Homo sapiens
gtactttgattca

SEQ ID NO: 2385066 - DNA, 20 bp, Homo sapiens
gtactttgtctaagaaacat

SEQ ID NO: 2385067 - DNA, 23 bp, Homo sapiens
gtactttgtctaagaaacattgg

SEQ ID NO: 2385068 - DNA, 23 bp, Homo sapiens
gtagcaaaccctgtcaaacatta

SEQ ID NO: 2385069 - DNA, 19 bp, Homo sapiens
gtaggaatattatatttgg

SEQ ID NO: 2385070 - DNA, 20 bp, Homo sapiens
gtaggaatattatatttgga

SEQ ID NO: 2385071 - DNA, 17 bp, Homo sapiens
gtatagaagtcttcatg

SEQ ID NO: 2385072 - DNA, 16 bp, Homo sapiens
gtatagacaggagaag

SEQ ID NO: 2385073 - DNA, 14 bp, Homo sapiens
gtatagtatttgaa

SEQ ID NO: 2385074 - DNA, 14 bp, Homo sapiens
gtatgtttttcagt

SEQ ID NO: 2385075 - DNA, 15 bp, Homo sapiens
gtattgccaaacatt

SEQ ID NO: 2385076 - DNA, 21 bp, Homo sapiens
gtattgccaaacattaatgtt

SEQ ID NO: 2385077 - DNA, 20 bp, Homo sapiens
gtatttgaaaacagaaattg

SEQ ID NO: 2385078 - DNA, 17 bp, Homo sapiens
gtcaaacattagtactt

SEQ ID NO: 2385079 - DNA, 13 bp, Homo sapiens
gtcatttcatgtc

SEQ ID NO: 2385080 - DNA, 11 bp, Homo sapiens
gtcattttcat

SEQ ID NO: 2385081 - DNA, 14 bp, Homo sapiens
gtccacttttccag

SEQ ID NO: 2385082 - DNA, 17 bp, Homo sapiens
gtcctgtgtcagtttat

SEQ ID NO: 2385083 - DNA, 13 bp, Homo sapiens
gtcgaaagttagt

SEQ ID NO: 2385084 - DNA, 15 bp, Homo sapiens
gtctcttttttacaa

SEQ ID NO: 2385085 - DNA, 20 bp, Homo sapiens
gtctcttttttacaaaggct

SEQ ID NO: 2385086 - DNA, 16 bp, Homo sapiens
gtcttcatgaaatgct

SEQ ID NO: 2385087 - DNA, 14 bp, Homo sapiens
gtcttttaaaaagt

SEQ ID NO: 2385088 - DNA, 23 bp, Homo sapiens
gtcttttaaaaagtattgccaaa

SEQ ID NO: 2385089 - DNA, 14 bp, Homo sapiens
gtgaaatttttcat

SEQ ID NO: 2385090 - DNA, 23 bp, Homo sapiens
gtgaaggaccttcactctaagat

SEQ ID NO: 2385091 - DNA, 23 bp, Homo sapiens
gtgacatttgtcattttcattag

SEQ ID NO: 2385092 - DNA, 14 bp, Homo sapiens
gtgacgtcacagac

SEQ ID NO: 2385093 - DNA, 13 bp, Homo sapiens
gtgatattctttg

SEQ ID NO: 2385094 - DNA, 20 bp, Homo sapiens
gtgatattctttgttaattt

SEQ ID NO: 2385095 - DNA, 22 bp, Homo sapiens
gtgatattctttgttaatttgg

SEQ ID NO: 2385096 - DNA, 16 bp, Homo sapiens
gtgatgtgacatttgt

SEQ ID NO: 2385097 - DNA, 15 bp, Homo sapiens
gtgcaatatattttg

SEQ ID NO: 2385098 - DNA, 16 bp, Homo sapiens
gtgcaatatattttgt

SEQ ID NO: 2385099 - DNA, 20 bp, Homo sapiens
gtgcaatatattttgtatgc

SEQ ID NO: 2385100 - DNA, 14 bp, Homo sapiens
gtgctaaacgtgta

SEQ ID NO: 2385101 - DNA, 20 bp, Homo sapiens
gtgctaaacgtgtatgtttt

SEQ ID NO: 2385102 - DNA, 19 bp, Homo sapiens
gtggaccctgaaatgtgtg

SEQ ID NO: 2385103 - DNA, 21 bp, Homo sapiens
gtgtatgtttttcagttcaaa

SEQ ID NO: 2385104 - DNA, 22 bp, Homo sapiens
gtgttattgagagagatgtgta

SEQ ID NO: 2385105 - DNA, 13 bp, Homo sapiens
gttaaagatgtag

SEQ ID NO: 2385106 - DNA, 17 bp, Homo sapiens
gttaaatgttttgtaaa

SEQ ID NO: 2385107 - DNA, 12 bp, Homo sapiens
gttaacaaataa

SEQ ID NO: 2385108 - DNA, 17 bp, Homo sapiens
gttaacaaataacaact

SEQ ID NO: 2385109 - DNA, 14 bp, Homo sapiens
gttacaaaatgtaa

SEQ ID NO: 2385110 - DNA, 17 bp, Homo sapiens
gttacaaaatgtaactg

SEQ ID NO: 2385111 - DNA, 18 bp, Homo sapiens
gttacaaaatgtaactgt

SEQ ID NO: 2385112 - DNA, 17 bp, Homo sapiens
gttacttttccttgcat

SEQ ID NO: 2385113 - DNA, 19 bp, Homo sapiens
gttaggccaaagacaaata

SEQ ID NO: 2385114 - DNA, 22 bp, Homo sapiens
gttaggccaaagacaaatagta

SEQ ID NO: 2385115 - DNA, 14 bp, Homo sapiens
gttatagttgaaga

SEQ ID NO: 2385116 - DNA, 19 bp, Homo sapiens
gttattgagagagatgtgt

SEQ ID NO: 2385117 - DNA, 20 bp, Homo sapiens
gttattgagagagatgtgta

SEQ ID NO: 2385118 - DNA, 22 bp, Homo sapiens
gttatttattctgggaatgtat

SEQ ID NO: 2385119 - DNA, 13 bp, Homo sapiens
gttcaaagtcatg

SEQ ID NO: 2385120 - DNA, 13 bp, Homo sapiens
gttctgttacaaa

SEQ ID NO: 2385121 - DNA, 14 bp, Homo sapiens
gttctgttacaaaa

SEQ ID NO: 2385122 - DNA, 21 bp, Homo sapiens
gttgcactgaagtttgataaa

SEQ ID NO: 2385123 - DNA, 17 bp, Homo sapiens
gttggaaaatatctttg

SEQ ID NO: 2385124 - DNA, 20 bp, Homo sapiens
gttggagttcattcatatta

SEQ ID NO: 2385125 - DNA, 14 bp, Homo sapiens
gttgtatgatctgt

SEQ ID NO: 2385126 - DNA, 23 bp, Homo sapiens
gtttatgttttggtccacttttc

SEQ ID NO: 2385127 - DNA, 14 bp, Homo sapiens
gtttcaaaaatctg

SEQ ID NO: 2385128 - DNA, 12 bp, Homo sapiens
gtttctttgaat

SEQ ID NO: 2385129 - DNA, 20 bp, Homo sapiens
gtttctttgaattttcattt

SEQ ID NO: 2385130 - DNA, 21 bp, Homo sapiens
gtttctttgaattttcatttt

SEQ ID NO: 2385131 - DNA, 14 bp, Homo sapiens
gtttgataaatagt

SEQ ID NO: 2385132 - DNA, 15 bp, Homo sapiens
gtttgataaatagtg

SEQ ID NO: 2385133 - DNA, 19 bp, Homo sapiens
gttttaaaatactgtagat

SEQ ID NO: 2385134 - DNA, 13 bp, Homo sapiens
gttttcaaatgga

SEQ ID NO: 2385135 - DNA, 16 bp, Homo sapiens
gttttcaaatggagtt

SEQ ID NO: 2385136 - DNA, 16 bp, Homo sapiens
gttttgtaaactttga

SEQ ID NO: 2385137 - DNA, 21 bp, Homo sapiens
gttttgtaaactttgaaatat

SEQ ID NO: 2385138 - DNA, 14 bp, Homo sapiens
gttttgtgaaattt

SEQ ID NO: 2385139 - DNA, 22 bp, Homo sapiens
gttttgtgaaatttttcatatt

SEQ ID NO: 2385140 - DNA, 23 bp, Homo sapiens
gttttgtgaaatttttcatattt

SEQ ID NO: 2385141 - DNA, 12 bp, Homo sapiens
gtttttcagttc

SEQ ID NO: 2385142 - DNA, 21 bp, Homo sapiens
gtttttcagttcaaagtcatg

SEQ ID NO: 2385143 - DNA, 14 bp, Homo sapiens
gtttttgttttgtt

SEQ ID NO: 2385144 - DNA, 19 bp, Homo sapiens
gtttttgtttttgttttgt

SEQ ID NO: 2385145 - DNA, 16 bp, Homo sapiens
gttttttgaagtgttg

SEQ ID NO: 2385146 - DNA, 18 bp, Homo sapiens
taaaaaaataactgattt

SEQ ID NO: 2385147 - DNA, 15 bp, Homo sapiens
taaaactgtactttg

SEQ ID NO: 2385148 - DNA, 22 bp, Homo sapiens
taaaactgtactttgattcaca

SEQ ID NO: 2385149 - DNA, 17 bp, Homo sapiens
taaaatactgtagataa

SEQ ID NO: 2385150 - DNA, 20 bp, Homo sapiens
taaaatactgtagataatta

SEQ ID NO: 2385151 - DNA, 21 bp, Homo sapiens
taaaatactgtagataattaa

SEQ ID NO: 2385152 - DNA, 21 bp, Homo sapiens
taaaatataacacagtttgta

SEQ ID NO: 2385153 - DNA, 14 bp, Homo sapiens
taaaatatgcacta

SEQ ID NO: 2385154 - DNA, 15 bp, Homo sapiens
taaaatcttattaaa

SEQ ID NO: 2385155 - DNA, 17 bp, Homo sapiens
taaaatggcaacaaact

SEQ ID NO: 2385156 - DNA, 20 bp, Homo sapiens
taaaatggcaacaaactgca

SEQ ID NO: 2385157 - DNA, 13 bp, Homo sapiens
taaaatgttttca

SEQ ID NO: 2385158 - DNA, 23 bp, Homo sapiens
taaaatgttttcagctaggaaca

SEQ ID NO: 2385159 - DNA, 12 bp, Homo sapiens
aaaaactgaagt

SEQ ID NO: 2385160 - DNA, 15 bp, Homo sapiens
aaaaagtattgccaa

SEQ ID NO: 2385161 - DNA, 16 bp, Homo sapiens
aaaaagtattgccaaa

SEQ ID NO: 2385162 - DNA, 13 bp, Homo sapiens
aaaaatatgtgaa

SEQ ID NO: 2385163 - DNA, 23 bp, Homo sapiens
aaaaatctgaagattgtttatct

SEQ ID NO: 2385164 - DNA, 15 bp, Homo sapiens
aaaacagaaattggt

SEQ ID NO: 2385165 - DNA, 23 bp, Homo sapiens
aaaactcaaccaaatggtacaaa

SEQ ID NO: 2385166 - DNA, 15 bp, Homo sapiens
aaaactgtactttga

SEQ ID NO: 2385167 - DNA, 11 bp, Homo sapiens
aaaactttgtt

SEQ ID NO: 2385168 - DNA, 17 bp, Homo sapiens
aaaactttgttaggcca

SEQ ID NO: 2385169 - DNA, 19 bp, Homo sapiens
aaaactttgttaggccaaa

SEQ ID NO: 2385170 - DNA, 14 bp, Homo sapiens
aaaagtcttttaaa

SEQ ID NO: 2385171 - DNA, 19 bp, Homo sapiens
aaaagtcttttaaaaagta

SEQ ID NO: 2385172 - DNA, 11 bp, Homo sapiens
aaaatactgta

SEQ ID NO: 2385173 - DNA, 13 bp, Homo sapiens
aaaatatgtgaag

SEQ ID NO: 2385174 - DNA, 16 bp, Homo sapiens
aaaatattaatacaga

SEQ ID NO: 2385175 - DNA, 14 bp, Homo sapiens
aaaatctgaagatt

SEQ ID NO: 2385176 - DNA, 15 bp, Homo sapiens
aaaatctgaagattg

SEQ ID NO: 2385177 - DNA, 16 bp, Homo sapiens
aaaatcttattaaagt

SEQ ID NO: 2385178 - DNA, 22 bp, Homo sapiens
aaaatcttattaaagtttcaaa

SEQ ID NO: 2385179 - DNA, 12 bp, Homo sapiens
aaaatgtaactg

SEQ ID NO: 2385180 - DNA, 18 bp, Homo sapiens
aaaatgtaactgttacca

SEQ ID NO: 2385181 - DNA, 15 bp, Homo sapiens
aaaatttgaaacatt

SEQ ID NO: 2385182 - DNA, 16 bp, Homo sapiens
aaaatttgaaacattg

SEQ ID NO: 2385183 - DNA, 17 bp, Homo sapiens
aaaatttgaaacattgc

SEQ ID NO: 2385184 - DNA, 20 bp, Homo sapiens
aaaatttgaaacattgcttt

SEQ ID NO: 2385185 - DNA, 17 bp, Homo sapiens
aaacactaaatgttaaa

SEQ ID NO: 2385186 - DNA, 15 bp, Homo sapiens
aaacagaaattggta

SEQ ID NO: 2385187 - DNA, 17 bp, Homo sapiens
aaacattagtactttat

SEQ ID NO: 2385188 - DNA, 13 bp, Homo sapiens
aaacattgctttt

SEQ ID NO: 2385189 - DNA, 22 bp, Homo sapiens
aaacattggaagcaggttaaat

SEQ ID NO: 2385190 - DNA, 16 bp, Homo sapiens
aaacgtgtatgttttt

SEQ ID NO: 2385191 - DNA, 17 bp, Homo sapiens
aaactcaaccaaatggt

SEQ ID NO: 2385192 - DNA, 14 bp, Homo sapiens
aaactgcacatgat

SEQ ID NO: 2385193 - DNA, 17 bp, Homo sapiens
aaactgcacatgatttc

SEQ ID NO: 2385194 - DNA, 20 bp, Homo sapiens
aaactgtactttgattcaca

SEQ ID NO: 2385195 - DNA, 21 bp, Homo sapiens
aaactgtactttgattcacat

SEQ ID NO: 2385196 - DNA, 15 bp, Homo sapiens
aaactttgaaatata

SEQ ID NO: 2385197 - DNA, 22 bp, Homo sapiens
aaagaactatcttcatctgaga

SEQ ID NO: 2385198 - DNA, 14 bp, Homo sapiens
aaagaataggactt

SEQ ID NO: 2385199 - DNA, 11 bp, Homo sapiens
aaagacaaata

SEQ ID NO: 2385200 - DNA, 16 bp, Homo sapiens
aaagataccttaaaat

SEQ ID NO: 2385201 - DNA, 14 bp, Homo sapiens
aaagtacaggtact

SEQ ID NO: 2385202 - DNA, 18 bp, Homo sapiens
aaagtactgagcagtgat

SEQ ID NO: 2385203 - DNA, 19 bp, Homo sapiens
aaagtattgccaaacatta

SEQ ID NO: 2385204 - DNA, 15 bp, Homo sapiens
aaagtcttttaaaaa

SEQ ID NO: 2385205 - DNA, 21 bp, Homo sapiens
aaagtcttttaaaaagtattg

SEQ ID NO: 2385206 - DNA, 18 bp, Homo sapiens
aaagttgtatgatctgtg

SEQ ID NO: 2385207 - DNA, 19 bp, Homo sapiens
aaagttgtatgatctgtgc

SEQ ID NO: 2385208 - DNA, 23 bp, Homo sapiens
aaatactgtagataattaaccaa

SEQ ID NO: 2385209 - DNA, 13 bp, Homo sapiens
aaatagtaggcaa

SEQ ID NO: 2385210 - DNA, 22 bp, Homo sapiens
aaatagtaggcaagatggcaca

SEQ ID NO: 2385211 - DNA, 19 bp, Homo sapiens
aaatagtgttattgagaga

SEQ ID NO: 2385212 - DNA, 20 bp, Homo sapiens
aaatatatggtctaatgttt

SEQ ID NO: 2385213 - DNA, 19 bp, Homo sapiens
aaatatgcactaagtctct

SEQ ID NO: 2385214 - DNA, 20 bp, Homo sapiens
aaatatgtgaaggaccttca

SEQ ID NO: 2385215 - DNA, 13 bp, Homo sapiens
aaatctatagaaa

SEQ ID NO: 2385216 - DNA, 15 bp, Homo sapiens
aaatctatagaaagt

SEQ ID NO: 2385217 - DNA, 17 bp, Homo sapiens
aaatctatagaaagtgt

SEQ ID NO: 2385218 - DNA, 12 bp, Homo sapiens
aaatcttattaa

SEQ ID NO: 2385219 - DNA, 20 bp, Homo sapiens
aaatcttattaaagtttcaa

SEQ ID NO: 2385220 - DNA, 23 bp, Homo sapiens
aaatcttcctggtcgaaagttag

SEQ ID NO: 2385221 - DNA, 15 bp, Homo sapiens
aaatgaacacaaatt

SEQ ID NO: 2385222 - DNA, 16 bp, Homo sapiens
aaatgattgcttttaa

SEQ ID NO: 2385223 - DNA, 16 bp, Homo sapiens
aaatgctatgtcattt

SEQ ID NO: 2385224 - DNA, 13 bp, Homo sapiens
agcagtttcaata

SEQ ID NO: 2385225 - DNA, 14 bp, Homo sapiens
agcagtttcaataa

SEQ ID NO: 2385226 - DNA, 14 bp, Homo sapiens
agcatataaaatgg

SEQ ID NO: 2385227 - DNA, 19 bp, Homo sapiens
agcatataaaatggcaaca

SEQ ID NO: 2385228 - DNA, 16 bp, Homo sapiens
agccgtaaaaactgaa

SEQ ID NO: 2385229 - DNA, 20 bp, Homo sapiens
agctaggaaaagaaatctat

SEQ ID NO: 2385230 - DNA, 21 bp, Homo sapiens
agctaggaacaaatcttcctg

SEQ ID NO: 2385231 - DNA, 21 bp, Homo sapiens
agctctgggaaatttaataca

SEQ ID NO: 2385232 - DNA, 17 bp, Homo sapiens
agctgatagctcctcca

SEQ ID NO: 2385233 - DNA, 17 bp, Homo sapiens
agctgtttggttttaaa

SEQ ID NO: 2385234 - DNA, 19 bp, Homo sapiens
agctgtttggttttaaaat

SEQ ID NO: 2385235 - DNA, 23 bp, Homo sapiens
agctgtttggttttaaaatactg

SEQ ID NO: 2385236 - DNA, 20 bp, Homo sapiens
agcttattttggagagatag

SEQ ID NO: 2385237 - DNA, 13 bp, Homo sapiens
aggaaaaatatgt

SEQ ID NO: 2385238 - DNA, 14 bp, Homo sapiens
aggaaaaatatgtg

SEQ ID NO: 2385239 - DNA, 17 bp, Homo sapiens
aggaaaaatatgtgaag

SEQ ID NO: 2385240 - DNA, 14 bp, Homo sapiens
aggaacaaatcttc

SEQ ID NO: 2385241 - DNA, 16 bp, Homo sapiens
aggaacaaatcttcct

SEQ ID NO: 2385242 - DNA, 15 bp, Homo sapiens
aggaagatgttctgt

SEQ ID NO: 2385243 - DNA, 18 bp, Homo sapiens
aggaaggtcatttccatg

SEQ ID NO: 2385244 - DNA, 14 bp, Homo sapiens
aggaatattatatt

SEQ ID NO: 2385245 - DNA, 19 bp, Homo sapiens
aggaatattatatttggat

SEQ ID NO: 2385246 - DNA, 22 bp, Homo sapiens
aggaatattatatttggatgca

SEQ ID NO: 2385247 - DNA, 23 bp, Homo sapiens
aggaccttcactctaagatgtta

SEQ ID NO: 2385248 - DNA, 17 bp, Homo sapiens
aggatatgcctgctctt

SEQ ID NO: 2385249 - DNA, 22 bp, Homo sapiens
aggattgattcagctaagcaaa

SEQ ID NO: 2385250 - DNA, 15 bp, Homo sapiens
aggccaaagacaaat

SEQ ID NO: 2385251 - DNA, 18 bp, Homo sapiens
aggccaaagacaaatagt

SEQ ID NO: 2385252 - DNA, 15 bp, Homo sapiens
aggcgctaacttgct

SEQ ID NO: 2385253 - DNA, 13 bp, Homo sapiens
aggctaaaatgtt

SEQ ID NO: 2385254 - DNA, 17 bp, Homo sapiens
aggctaaaatgttttca

SEQ ID NO: 2385255 - DNA, 20 bp, Homo sapiens
agggaagataagttggaaac

SEQ ID NO: 2385256 - DNA, 19 bp, Homo sapiens
agggggaatattttaaaaa

SEQ ID NO: 2385257 - DNA, 13 bp, Homo sapiens
aggttaaatgttt

SEQ ID NO: 2385258 - DNA, 14 bp, Homo sapiens
aggttaaatgtttt

SEQ ID NO: 2385259 - DNA, 19 bp, Homo sapiens
aggttaaatgttttgtaaa

SEQ ID NO: 2385260 - DNA, 14 bp, Homo sapiens
agtagactccaaca

SEQ ID NO: 2385261 - DNA, 19 bp, Homo sapiens
agtaggggtaccactgaat

SEQ ID NO: 2385262 - DNA, 17 bp, Homo sapiens
agtattgccaaacatta

SEQ ID NO: 2385263 - DNA, 18 bp, Homo sapiens
agtattgccaaacattaa

SEQ ID NO: 2385264 - DNA, 12 bp, Homo sapiens
agtatttgaaaa

SEQ ID NO: 2385265 - DNA, 18 bp, Homo sapiens
agtatttgaaaacagaaa

SEQ ID NO: 2385266 - DNA, 20 bp, Homo sapiens
agtatttgaaaacagaaatt

SEQ ID NO: 2385267 - DNA, 14 bp, Homo sapiens
agtcatgatgtttt

SEQ ID NO: 2385268 - DNA, 19 bp, Homo sapiens
agtcatgatgtttttaaaa

SEQ ID NO: 2385269 - DNA, 21 bp, Homo sapiens
agtcatgatgtttttaaaatc

SEQ ID NO: 2385270 - DNA, 19 bp, Homo sapiens
agtctcttttttacaaagg

SEQ ID NO: 2385271 - DNA, 18 bp, Homo sapiens
agtcttcatgaaatgcta

SEQ ID NO: 2385272 - DNA, 23 bp, Homo sapiens
agtcttcatgaaatgctatgtca

SEQ ID NO: 2385273 - DNA, 18 bp, Homo sapiens
agtgatattctttgttaa

SEQ ID NO: 2385274 - DNA, 14 bp, Homo sapiens
agtgcaatatattt

SEQ ID NO: 2385275 - DNA, 16 bp, Homo sapiens
agtgcaatatattttg

SEQ ID NO: 2385276 - DNA, 19 bp, Homo sapiens
agtggaccctgaaatgtgt

SEQ ID NO: 2385277 - DNA, 19 bp, Homo sapiens
agtgtaccattaaaatatg

SEQ ID NO: 2385278 - DNA, 20 bp, Homo sapiens
agtgttattgagagagatgt

SEQ ID NO: 2385279 - DNA, 20 bp, Homo sapiens
agtgttctgttacaaaatgt

SEQ ID NO: 2385280 - DNA, 22 bp, Homo sapiens
agtgttctgttacaaaatgtaa

SEQ ID NO: 2385281 - DNA, 14 bp, Homo sapiens
agttacttttcctt

SEQ ID NO: 2385282 - DNA, 17 bp, Homo sapiens
agttacttttccttgca

SEQ ID NO: 2385283 - DNA, 18 bp, Homo sapiens
agttacttttccttgcat

SEQ ID NO: 2385284 - DNA, 17 bp, Homo sapiens
agttcattcatattaca

SEQ ID NO: 2385285 - DNA, 17 bp, Homo sapiens
agttgtgccttttataa

SEQ ID NO: 2385286 - DNA, 21 bp, Homo sapiens
agtttaattttgatatattca

SEQ ID NO: 2385287 - DNA, 16 bp, Homo sapiens
agtttcaaaaatctga

SEQ ID NO: 2385288 - DNA, 21 bp, Homo sapiens
agtttcaaaaatctgaagatt

SEQ ID NO: 2385289 - DNA, 16 bp, Homo sapiens
agtttcaataaagttt

SEQ ID NO: 2385290 - DNA, 21 bp, Homo sapiens
agtttcaataaagtttgatct

SEQ ID NO: 2385291 - DNA, 23 bp, Homo sapiens
agtttcaataaagtttgatcttc

SEQ ID NO: 2385292 - DNA, 18 bp, Homo sapiens
agtttgataaatagtgtt

SEQ ID NO: 2385293 - DNA, 17 bp, Homo sapiens
agtttgtttctttgaat

SEQ ID NO: 2385294 - DNA, 13 bp, Homo sapiens
agttttattttct

SEQ ID NO: 2385295 - DNA, 20 bp, Homo sapiens
agttttattttctaaagtac

SEQ ID NO: 2385296 - DNA, 21 bp, Homo sapiens
agttttattttctaaagtact

SEQ ID NO: 2385297 - DNA, 18 bp, Homo sapiens
agttttgtgaaatttttc

SEQ ID NO: 2385298 - DNA, 20 bp, Homo sapiens
agttttgtgaaatttttcat

SEQ ID NO: 2385299 - DNA, 12 bp, Homo sapiens
agtttttcttaa

SEQ ID NO: 2385300 - DNA, 14 bp, Homo sapiens
ataaaatggcaaca

SEQ ID NO: 2385301 - DNA, 16 bp, Homo sapiens
ataaaatggcaacaaa

SEQ ID NO: 2385302 - DNA, 19 bp, Homo sapiens
ataaacatcaggttaggca

SEQ ID NO: 2385303 - DNA, 13 bp, Homo sapiens
ataaagtttgatc

SEQ ID NO: 2385304 - DNA, 15 bp, Homo sapiens
ataaatagtgttatt

SEQ ID NO: 2385305 - DNA, 12 bp, Homo sapiens
ataagcaacaat

SEQ ID NO: 2385306 - DNA, 13 bp, Homo sapiens
ataagcaacaatt

SEQ ID NO: 2385307 - DNA, 19 bp, Homo sapiens
ataagcaacaattttcaga

SEQ ID NO: 2385308 - DNA, 20 bp, Homo sapiens
ataagcaacaattttcagat

SEQ ID NO: 2385309 - DNA, 13 bp, Homo sapiens
ataagttggaaac

SEQ ID NO: 2385310 - DNA, 16 bp, Homo sapiens
ataagttggaaacact

SEQ ID NO: 2385311 - DNA, 17 bp, Homo sapiens
ataagttggaaacacta

SEQ ID NO: 2385312 - DNA, 23 bp, Homo sapiens
ataagttggaaacactaaatgtt

SEQ ID NO: 2385313 - DNA, 16 bp, Homo sapiens
ataataaatgtattta

SEQ ID NO: 2385314 - DNA, 15 bp, Homo sapiens
ataatcctgcaaagt

SEQ ID NO: 2385315 - DNA, 18 bp, Homo sapiens
ataatcctgcaaagtaca

SEQ ID NO: 2385316 - DNA, 19 bp, Homo sapiens
ataattctgaagttatatt

SEQ ID NO: 2385317 - DNA, 20 bp, Homo sapiens
ataattctgaagttatattt

SEQ ID NO: 2385318 - DNA, 12 bp, Homo sapiens
atacaaataaat

SEQ ID NO: 2385319 - DNA, 21 bp, Homo sapiens
atacagatctgtttattctgt

SEQ ID NO: 2385320 - DNA, 18 bp, Homo sapiens
atagaaagtgttctgtta

SEQ ID NO: 2385321 - DNA, 22 bp, Homo sapiens
atagaaagtgttctgttacaaa

SEQ ID NO: 2385322 - DNA, 13 bp, Homo sapiens
atagaagaatgca

SEQ ID NO: 2385323 - DNA, 17 bp, Homo sapiens
atagaagaatgcatgct

SEQ ID NO: 2385324 - DNA, 18 bp, Homo sapiens
atagaagaatgcatgctt

SEQ ID NO: 2385325 - DNA, 23 bp, Homo sapiens
atagaagaatgcatgctttccat

SEQ ID NO: 2385326 - DNA, 20 bp, Homo sapiens
atagaagtcttcatgaaatg

SEQ ID NO: 2385327 - DNA, 21 bp, Homo sapiens
atagcctgtatggtttctact

SEQ ID NO: 2385328 - DNA, 15 bp, Homo sapiens
ataggaaggtcattt

SEQ ID NO: 2385329 - DNA, 19 bp, Homo sapiens
ataggaaggtcatttccat

SEQ ID NO: 2385330 - DNA, 22 bp, Homo sapiens
ataggaagttagcctttatcta

SEQ ID NO: 2385331 - DNA, 19 bp, Homo sapiens
atagtatttgaaaacagaa

SEQ ID NO: 2385332 - DNA, 17 bp, Homo sapiens
atagtgttattgagaga

SEQ ID NO: 2385333 - DNA, 14 bp, Homo sapiens
atataaaatggcaa

SEQ ID NO: 2385334 - DNA, 20 bp, Homo sapiens
atatagcatttatggtaatc

SEQ ID NO: 2385335 - DNA, 14 bp, Homo sapiens
atatatagcattta

SEQ ID NO: 2385336 - DNA, 16 bp, Homo sapiens
atatatagcatttatg

SEQ ID NO: 2385337 - DNA, 21 bp, Homo sapiens
gaaagaactatcttcatctga

SEQ ID NO: 2385338 - DNA, 14 bp, Homo sapiens
gaaagcttttaaaa

SEQ ID NO: 2385339 - DNA, 14 bp, Homo sapiens
gaaagtgttctgtt

SEQ ID NO: 2385340 - DNA, 16 bp, Homo sapiens
gaaagtgttctgttac

SEQ ID NO: 2385341 - DNA, 20 bp, Homo sapiens
gaaatatatggtctaatgtt

SEQ ID NO: 2385342 - DNA, 24 bp, Homo sapiens
gaaatatatggtctaatgtttaag

SEQ ID NO: 2385343 - DNA, 23 bp, Homo sapiens
gaaatctatagaaagtgttctgt

SEQ ID NO: 2385344 - DNA, 17 bp, Homo sapiens
gaaatgaacacaaatta

SEQ ID NO: 2385345 - DNA, 13 bp, Homo sapiens
gaaatgtaagcat

SEQ ID NO: 2385346 - DNA, 18 bp, Homo sapiens
gaaatgtgtgtgatgtga

SEQ ID NO: 2385347 - DNA, 15 bp, Homo sapiens
gaaattatctgcctt

SEQ ID NO: 2385348 - DNA, 21 bp, Homo sapiens
gaaatttattgaggaaaaata

SEQ ID NO: 2385349 - DNA, 11 bp, Homo sapiens
gaaatttcacg

SEQ ID NO: 2385350 - DNA, 16 bp, Homo sapiens
gaaatttcacgtcata

SEQ ID NO: 2385351 - DNA, 13 bp, Homo sapiens
gaaatttttcata

SEQ ID NO: 2385352 - DNA, 16 bp, Homo sapiens
gaaatttttcatattt

SEQ ID NO: 2385353 - DNA, 12 bp, Homo sapiens
gaactatcttca

SEQ ID NO: 2385354 - DNA, 14 bp, Homo sapiens
gaagaatgaagccc

SEQ ID NO: 2385355 - DNA, 14 bp, Homo sapiens
gaagataagttgga

SEQ ID NO: 2385356 - DNA, 18 bp, Homo sapiens
gaagataagttggaaaca

SEQ ID NO: 2385357 - DNA, 16 bp, Homo sapiens
gaagattgtttatcta

SEQ ID NO: 2385358 - DNA, 23 bp, Homo sapiens
gaagattgtttatctagatgtaa

SEQ ID NO: 2385359 - DNA, 19 bp, Homo sapiens
gaagcaggttaaatgtttt

SEQ ID NO: 2385360 - DNA, 15 bp, Homo sapiens
gaaggtcatttccat

SEQ ID NO: 2385361 - DNA, 15 bp, Homo sapiens
gaagtcttcatgaaa

SEQ ID NO: 2385362 - DNA, 11 bp, Homo sapiens
gaagttagcct

SEQ ID NO: 2385363 - DNA, 22 bp, Homo sapiens
gaagttagcctttatctaccaa

SEQ ID NO: 2385364 - DNA, 17 bp, Homo sapiens
gaagttctgcctctgat

SEQ ID NO: 2385365 - DNA, 15 bp, Homo sapiens
gaagtttgataaata

SEQ ID NO: 2385366 - DNA, 19 bp, Homo sapiens
gaagtttgataaatagtgt

SEQ ID NO: 2385367 - DNA, 21 bp, Homo sapiens
gaataggacttgtttttgttt

SEQ ID NO: 2385368 - DNA, 16 bp, Homo sapiens
gaatattatatttgga

SEQ ID NO: 2385369 - DNA, 18 bp, Homo sapiens
gaatattttaaaaataaa

SEQ ID NO: 2385370 - DNA, 15 bp, Homo sapiens
gaatgaccttgtaat

SEQ ID NO: 2385371 - DNA, 21 bp, Homo sapiens
gaatgcatgctttccatattt

SEQ ID NO: 2385372 - DNA, 15 bp, Homo sapiens
gaatgtatagtattt

SEQ ID NO: 2385373 - DNA, 17 bp, Homo sapiens
gaatgtatagtatttga

SEQ ID NO: 2385374 - DNA, 19 bp, Homo sapiens
gaatgtatagtatttgaaa

SEQ ID NO: 2385375 - DNA, 15 bp, Homo sapiens
gaattactaacttct

SEQ ID NO: 2385376 - DNA, 13 bp, Homo sapiens
gaattttcatttt

SEQ ID NO: 2385377 - DNA, 20 bp, Homo sapiens
gaattttcattttacagtta

SEQ ID NO: 2385378 - DNA, 22 bp, Homo sapiens
gaattttcattttacagttact

SEQ ID NO: 2385379 - DNA, 21 bp, Homo sapiens
gacaaatagtaggcaagatgg

SEQ ID NO: 2385380 - DNA, 19 bp, Homo sapiens
gacaacagattggatttta

SEQ ID NO: 2385381 - DNA, 12 bp, Homo sapiens
gacatttgtcat

SEQ ID NO: 2385382 - DNA, 19 bp, Homo sapiens
gacatttgtcattttcatt

SEQ ID NO: 2385383 - DNA, 14 bp, Homo sapiens
gaccattttcctgc

SEQ ID NO: 2385384 - DNA, 15 bp, Homo sapiens
gaccctgaaatgtgt

SEQ ID NO: 2385385 - DNA, 16 bp, Homo sapiens
gaccctgaaatgtgtg

SEQ ID NO: 2385386 - DNA, 20 bp, Homo sapiens
gaccctgaaatgtgtgtgat

SEQ ID NO: 2385387 - DNA, 22 bp, Homo sapiens
gaccttcactctaagatgttat

SEQ ID NO: 2385388 - DNA, 17 bp, Homo sapiens
gaccttgtaatgtaact

SEQ ID NO: 2385389 - DNA, 14 bp, Homo sapiens
gacttgtttttgtt

SEQ ID NO: 2385390 - DNA, 18 bp, Homo sapiens
gagaattttttctttgta

SEQ ID NO: 2385391 - DNA, 22 bp, Homo sapiens
gagagagatgtgtaatttttct

SEQ ID NO: 2385392 - DNA, 18 bp, Homo sapiens
gagagaggctaaaatgtt

SEQ ID NO: 2385393 - DNA, 20 bp, Homo sapiens
gagaggctaaaatgttttca

SEQ ID NO: 2385394 - DNA, 20 bp, Homo sapiens
gagatgtgtaatttttctgt

SEQ ID NO: 2385395 - DNA, 13 bp, Homo sapiens
gaggaaaaatatg

SEQ ID NO: 2385396 - DNA, 13 bp, Homo sapiens
gaggctaaaatgt

SEQ ID NO: 2385397 - DNA, 16 bp, Homo sapiens
gaggctaaaatgtttt

SEQ ID NO: 2385398 - DNA, 18 bp, Homo sapiens
gagttcattcatattaca

SEQ ID NO: 2385399 - DNA, 18 bp, Homo sapiens
gagtttgtttctttgaat

SEQ ID NO: 2385400 - DNA, 19 bp, Homo sapiens
gataccttaaaatttgaaa

SEQ ID NO: 2385401 - DNA, 21 bp, Homo sapiens
gataccttaaaatttgaaaca

SEQ ID NO: 2385402 - DNA, 17 bp, Homo sapiens
gatcttcctctgctaaa

SEQ ID NO: 2385403 - DNA, 18 bp, Homo sapiens
gatgaccaattttaactt

SEQ ID NO: 2385404 - DNA, 18 bp, Homo sapiens
gatgcaatccttacaaat

SEQ ID NO: 2385405 - DNA, 13 bp, Homo sapiens
gatgttatatttt

SEQ ID NO: 2385406 - DNA, 21 bp, Homo sapiens
gatgttatatttttcttaaaa

SEQ ID NO: 2385407 - DNA, 21 bp, Homo sapiens
gatgttgatgcaatccttaca

SEQ ID NO: 2385408 - DNA, 23 bp, Homo sapiens
gatgttgatgcaatccttacaaa

SEQ ID NO: 2385409 - DNA, 17 bp, Homo sapiens
gattcacatgttttcaa

SEQ ID NO: 2385410 - DNA, 18 bp, Homo sapiens
gattcacatgttttcaaa

SEQ ID NO: 2385411 - DNA, 14 bp, Homo sapiens
gattgcttttaaaa

SEQ ID NO: 2385412 - DNA, 16 bp, Homo sapiens
gattgcttttaaaatt

SEQ ID NO: 2385413 - DNA, 18 bp, Homo sapiens
gattgcttttaaaatttt

SEQ ID NO: 2385414 - DNA, 21 bp, Homo sapiens
gattgtttatctagatgtaaa

SEQ ID NO: 2385415 - DNA, 13 bp, Homo sapiens
gatttcacaaata

SEQ ID NO: 2385416 - DNA, 20 bp, Homo sapiens
gatttctagttatttattct

SEQ ID NO: 2385417 - DNA, 18 bp, Homo sapiens
gatttgtaattaaattgt

SEQ ID NO: 2385418 - DNA, 15 bp, Homo sapiens
gattttagttttatt

SEQ ID NO: 2385419 - DNA, 19 bp, Homo sapiens
gattttagttttattttct

SEQ ID NO: 2385420 - DNA, 22 bp, Homo sapiens
gattttagttttattttctaaa

SEQ ID NO: 2385421 - DNA, 16 bp, Homo sapiens
gattttatgttgacat

SEQ ID NO: 2385422 - DNA, 23 bp, Homo sapiens
gattttttaagactgtgtctgta

SEQ ID NO: 2385423 - DNA, 12 bp, Homo sapiens
gcaaaaaaagtt

SEQ ID NO: 2385424 - DNA, 20 bp, Homo sapiens
gcaaagtacaggtactttgt

SEQ ID NO: 2385425 - DNA, 23 bp, Homo sapiens
gcaacaaactgcacatgatttca

SEQ ID NO: 2385426 - DNA, 15 bp, Homo sapiens
gcaacaattttcaga

SEQ ID NO: 2385427 - DNA, 19 bp, Homo sapiens
gcaagatggcacagggcat

SEQ ID NO: 2385428 - DNA, 14 bp, Homo sapiens
gcaagcagtttcaa

SEQ ID NO: 2385429 - DNA, 16 bp, Homo sapiens
gcaaggcgctaacttg

SEQ ID NO: 2385430 - DNA, 12 bp, Homo sapiens
gcaatatatttt

SEQ ID NO: 2385431 - DNA, 15 bp, Homo sapiens
gcaatatattttgta

SEQ ID NO: 2385432 - DNA, 17 bp, Homo sapiens
gcaatattctctgtaca

SEQ ID NO: 2385433 - DNA, 19 bp, Homo sapiens
gcaatattctctgtacata

SEQ ID NO: 2385434 - DNA, 22 bp, Homo sapiens
gcaatattctctgtacatatta

SEQ ID NO: 2385435 - DNA, 19 bp, Homo sapiens
gcaatccttacaaatgatt

SEQ ID NO: 2385436 - DNA, 16 bp, Homo sapiens
gcacagggcatgaaat

SEQ ID NO: 2385437 - DNA, 18 bp, Homo sapiens
gcacagggcatgaaatga

SEQ ID NO: 2385438 - DNA, 12 bp, Homo sapiens
gcacatgatttc

SEQ ID NO: 2385439 - DNA, 15 bp, Homo sapiens
gcacatgatttcaca

SEQ ID NO: 2385440 - DNA, 20 bp, Homo sapiens
gcacatgatttcacaaatat

SEQ ID NO: 2385441 - DNA, 15 bp, Homo sapiens
gcactaagtctcttt

SEQ ID NO: 2385442 - DNA, 22 bp, Homo sapiens
gcactaagtctcttttttacaa

SEQ ID NO: 2385443 - DNA, 9 bp, Homo sapiens
gcactgaag

SEQ ID NO: 2385444 - DNA, 14 bp, Homo sapiens
gcactgaagtttga

SEQ ID NO: 2385445 - DNA, 19 bp, Homo sapiens
gcacttcagggcagatttt

SEQ ID NO: 2385446 - DNA, 13 bp, Homo sapiens
gcaggttaaatgt

SEQ ID NO: 2385447 - DNA, 23 bp, Homo sapiens
gcaggttaaatgttttgtaaact

SEQ ID NO: 2385448 - DNA, 17 bp, Homo sapiens
gcagtttcaataaagtt

SEQ ID NO: 2385449 - DNA, 22 bp, Homo sapiens
gcatataaaatggcaacaaact

SEQ ID NO: 2385450 - DNA, 17 bp, Homo sapiens
tattttccttaatcaaa

SEQ ID NO: 2385451 - DNA, 14 bp, Homo sapiens
tattttgtatgcaa

SEQ ID NO: 2385452 - DNA, 20 bp, Homo sapiens
tattttgtatgcaagcagtt

SEQ ID NO: 2385453 - DNA, 22 bp, Homo sapiens
tattttgtatgcaagcagtttc

SEQ ID NO: 2385454 - DNA, 14 bp, Homo sapiens
tattttgtgagttt

SEQ ID NO: 2385455 - DNA, 18 bp, Homo sapiens
tatttttttccttacata

SEQ ID NO: 2385456 - DNA, 15 bp, Homo sapiens
tcaaacattagtact

SEQ ID NO: 2385457 - DNA, 19 bp, Homo sapiens
tcaaacattagtactttat

SEQ ID NO: 2385458 - DNA, 17 bp, Homo sapiens
tcaaagtcatgatgttt

SEQ ID NO: 2385459 - DNA, 19 bp, Homo sapiens
tcaaagtcatgatgttttt

SEQ ID NO: 2385460 - DNA, 14 bp, Homo sapiens
tcaaccaaatggta

SEQ ID NO: 2385461 - DNA, 18 bp, Homo sapiens
tcaaccaaatggtacaaa

SEQ ID NO: 2385462 - DNA, 14 bp, Homo sapiens
tcaagcttattttg

SEQ ID NO: 2385463 - DNA, 14 bp, Homo sapiens
tcaataaagtttga

SEQ ID NO: 2385464 - DNA, 16 bp, Homo sapiens
tcaatctcgtatagaa

SEQ ID NO: 2385465 - DNA, 17 bp, Homo sapiens
tcaatctcgtatagaag

SEQ ID NO: 2385466 - DNA, 18 bp, Homo sapiens
tcaatctcgtatagaagt

SEQ ID NO: 2385467 - DNA, 21 bp, Homo sapiens
tcaatctcgtatagaagtctt

SEQ ID NO: 2385468 - DNA, 17 bp, Homo sapiens
tcacaaatattaaaaag

SEQ ID NO: 2385469 - DNA, 18 bp, Homo sapiens
tcacaaatattaaaaagt

SEQ ID NO: 2385470 - DNA, 21 bp, Homo sapiens
tcacaaatattaaaaagtctt

SEQ ID NO: 2385471 - DNA, 23 bp, Homo sapiens
tcacaaatattaaaaagtctttt

SEQ ID NO: 2385472 - DNA, 14 bp, Homo sapiens
tcacatgttttcaa

SEQ ID NO: 2385473 - DNA, 21 bp, Homo sapiens
tcaccagtacattctcagttt

SEQ ID NO: 2385474 - DNA, 21 bp, Homo sapiens
tcagattccaagtgtatttaa

SEQ ID NO: 2385475 - DNA, 19 bp, Homo sapiens
tcagcaaggcgctaacttg

SEQ ID NO: 2385476 - DNA, 20 bp, Homo sapiens
tcagcaaggcgctaacttgc

SEQ ID NO: 2385477 - DNA, 14 bp, Homo sapiens
tcagggcagatttt

SEQ ID NO: 2385478 - DNA, 18 bp, Homo sapiens
tcagggcagattttagtt

SEQ ID NO: 2385479 - DNA, 20 bp, Homo sapiens
tcagttcaaagtcatgatgt

SEQ ID NO: 2385480 - DNA, 21 bp, Homo sapiens
tcagttcaaagtcatgatgtt

SEQ ID NO: 2385481 - DNA, 21 bp, Homo sapiens
tcatatcctctataattgact

SEQ ID NO: 2385482 - DNA, 22 bp, Homo sapiens
tcatatcctctataattgactt

SEQ ID NO: 2385483 - DNA, 18 bp, Homo sapiens
tcatattagacttctgtt

SEQ ID NO: 2385484 - DNA, 13 bp, Homo sapiens
tcatatttaatat

SEQ ID NO: 2385485 - DNA, 16 bp, Homo sapiens
tcatattttaatttca

SEQ ID NO: 2385486 - DNA, 11 bp, Homo sapiens
tcatctgagag

SEQ ID NO: 2385487 - DNA, 11 bp, Homo sapiens
tcatctgtaag

SEQ ID NO: 2385488 - DNA, 18 bp, Homo sapiens
tcatgaaatgctatgtca

SEQ ID NO: 2385489 - DNA, 21 bp, Homo sapiens
tcatgaaatgctatgtcattt

SEQ ID NO: 2385490 - DNA, 13 bp, Homo sapiens
tcatgatgttttt

SEQ ID NO: 2385491 - DNA, 20 bp, Homo sapiens
tcatgatgtttttaaaatct

SEQ ID NO: 2385492 - DNA, 17 bp, Homo sapiens
tcattcaccagtacatt

SEQ ID NO: 2385493 - DNA, 23 bp, Homo sapiens
tcattcaccagtacattctcagt

SEQ ID NO: 2385494 - DNA, 20 bp, Homo sapiens
tcatttcatgtcctgtgtca

SEQ ID NO: 2385495 - DNA, 12 bp, Homo sapiens
tcatttccatgt

SEQ ID NO: 2385496 - DNA, 19 bp, Homo sapiens
tcattttacagttactttt

SEQ ID NO: 2385497 - DNA, 18 bp, Homo sapiens
tccatattagaaaacttt

SEQ ID NO: 2385498 - DNA, 16 bp, Homo sapiens
tccatatttttttcct

SEQ ID NO: 2385499 - DNA, 18 bp, Homo sapiens
tccatatttttttcctta

SEQ ID NO: 2385500 - DNA, 22 bp, Homo sapiens
tccatatttttttccttacata

SEQ ID NO: 2385501 - DNA, 23 bp, Homo sapiens
tccatatttttttccttacataa

SEQ ID NO: 2385502 - DNA, 14 bp, Homo sapiens
tccatttttcttgt

SEQ ID NO: 2385503 - DNA, 22 bp, Homo sapiens
tccgtcaaaattggatttgtaa

SEQ ID NO: 2385504 - DNA, 23 bp, Homo sapiens
tcctctgctaaattgatgttgat

SEQ ID NO: 2385505 - DNA, 23 bp, Homo sapiens
tcctgcattgggtgatcattcac

SEQ ID NO: 2385506 - DNA, 16 bp, Homo sapiens
tcctgtgtcagtttat

SEQ ID NO: 2385507 - DNA, 14 bp, Homo sapiens
tccttatttaagac

SEQ ID NO: 2385508 - DNA, 20 bp, Homo sapiens
tcggttaacaaataacaact

SEQ ID NO: 2385509 - DNA, 17 bp, Homo sapiens
tcgtatagaagtcttca

SEQ ID NO: 2385510 - DNA, 13 bp, Homo sapiens
tctaagaaacatt

SEQ ID NO: 2385511 - DNA, 16 bp, Homo sapiens
tctaagaaacattgga

SEQ ID NO: 2385512 - DNA, 18 bp, Homo sapiens
tctaagatgttatatttt

SEQ ID NO: 2385513 - DNA, 21 bp, Homo sapiens
tctaagatgttatatttttct

SEQ ID NO: 2385514 - DNA, 19 bp, Homo sapiens
tctaaggagatataatata

SEQ ID NO: 2385515 - DNA, 11 bp, Homo sapiens
tctaatgttta

SEQ ID NO: 2385516 - DNA, 18 bp, Homo sapiens
tctaatgtttaagcagaa

SEQ ID NO: 2385517 - DNA, 14 bp, Homo sapiens
tctagttatttatt

SEQ ID NO: 2385518 - DNA, 19 bp, Homo sapiens
tctatagaaagtgttctgt

SEQ ID NO: 2385519 - DNA, 14 bp, Homo sapiens
tctcgtatagaagt

SEQ ID NO: 2385520 - DNA, 16 bp, Homo sapiens
tctcttttttacaaag

SEQ ID NO: 2385521 - DNA, 17 bp, Homo sapiens
tctcttttttacaaagg

SEQ ID NO: 2385522 - DNA, 21 bp, Homo sapiens
tctgatgtattttgtgagttt

SEQ ID NO: 2385523 - DNA, 15 bp, Homo sapiens
tctgccccaagtttt

SEQ ID NO: 2385524 - DNA, 22 bp, Homo sapiens
tctgccccaagttttgtgaaat

SEQ ID NO: 2385525 - DNA, 14 bp, Homo sapiens
tctgcctctgatgt

SEQ ID NO: 2385526 - DNA, 20 bp, Homo sapiens
tctgcctctgatgtattttg

SEQ ID NO: 2385527 - DNA, 15 bp, Homo sapiens
tctgctaaattgatg

SEQ ID NO: 2385528 - DNA, 21 bp, Homo sapiens
tctgctaaattgatgttgatg

SEQ ID NO: 2385529 - DNA, 22 bp, Homo sapiens
tctgtacagagccgtaaaaact

SEQ ID NO: 2385530 - DNA, 20 bp, Homo sapiens
tctgtatagacaggagaaga

SEQ ID NO: 2385531 - DNA, 12 bp, Homo sapiens
tctgttacaaaa

SEQ ID NO: 2385532 - DNA, 22 bp, Homo sapiens
tctgttacaaaatgtaactgtt

SEQ ID NO: 2385533 - DNA, 12 bp, Homo sapiens
tcttattaaagt

SEQ ID NO: 2385534 - DNA, 22 bp, Homo sapiens
tcttattaaagtttcaaaaatc

SEQ ID NO: 2385535 - DNA, 14 bp, Homo sapiens
tcttcatgaaatgc

SEQ ID NO: 2385536 - DNA, 19 bp, Homo sapiens
tcttcctctgctaaattga

SEQ ID NO: 2385537 - DNA, 21 bp, Homo sapiens
tcttcctggtcgaaagttagt

SEQ ID NO: 2385538 - DNA, 13 bp, Homo sapiens
tctttgaattttc

SEQ ID NO: 2385539 - DNA, 14 bp, Homo sapiens
tctttgaattttca

SEQ ID NO: 2385540 - DNA, 21 bp, Homo sapiens
tctttgaattttcattttaca

SEQ ID NO: 2385541 - DNA, 21 bp, Homo sapiens
tctttgtatttattttaatgt

SEQ ID NO: 2385542 - DNA, 14 bp, Homo sapiens
tcttttaaaaagta

SEQ ID NO: 2385543 - DNA, 16 bp, Homo sapiens
tcttttaaaaagtatt

SEQ ID NO: 2385544 - DNA, 21 bp, Homo sapiens
tcttttgttttttgaagtgtt

SEQ ID NO: 2385545 - DNA, 23 bp, Homo sapiens
tcttttttttttaagtgaaattt

SEQ ID NO: 2385546 - DNA, 22 bp, Homo sapiens
tgaaaacagaaattggtacctt

SEQ ID NO: 2385547 - DNA, 15 bp, Homo sapiens
tgaaaatactcctga

SEQ ID NO: 2385548 - DNA, 16 bp, Homo sapiens
tgaaacattgctttta

SEQ ID NO: 2385549 - DNA, 18 bp, Homo sapiens
tgaaacattgcttttaaa

SEQ ID NO: 2385550 - DNA, 14 bp, Homo sapiens
tgaaatgaacacaa

SEQ ID NO: 2385551 - DNA, 17 bp, Homo sapiens
tgaaatgaacacaaatt

SEQ ID NO: 2385552 - DNA, 18 bp, Homo sapiens
tgaaatgaacacaaatta

SEQ ID NO: 2385553 - DNA, 16 bp, Homo sapiens
tgaaatgtgtgtgatg

SEQ ID NO: 2385554 - DNA, 23 bp, Homo sapiens
tgaaatttattgaggaaaaatat

SEQ ID NO: 2385555 - DNA, 14 bp, Homo sapiens
tgaaatttttcata

SEQ ID NO: 2385556 - DNA, 17 bp, Homo sapiens
tgaaatttttcatattt

SEQ ID NO: 2385557 - DNA, 20 bp, Homo sapiens
tgaaatttttcatattttaa

SEQ ID NO: 2385558 - DNA, 22 bp, Homo sapiens
tgaagctttttaaaaattgtaa

SEQ ID NO: 2385559 - DNA, 13 bp, Homo sapiens
tgaagttatattt

SEQ ID NO: 2385560 - DNA, 20 bp, Homo sapiens
tgaagtttgataaatagtgt

SEQ ID NO: 2385561 - DNA, 22 bp, Homo sapiens
tgaagtttgataaatagtgtta

SEQ ID NO: 2385562 - DNA, 12 bp, Homo sapiens
agtgtgagaatc

SEQ ID NO: 2385563 - DNA, 16 bp, Homo sapiens
agtgtgagcagtgagt

SEQ ID NO: 2385564 - DNA, 21 bp, Homo sapiens
agtgtgagcagtgagttacag

SEQ ID NO: 2385565 - DNA, 16 bp, Homo sapiens
agtgtgttgtctgtgc

SEQ ID NO: 2385566 - DNA, 20 bp, Homo sapiens
agtgtgttgtctgtgcagct

SEQ ID NO: 2385567 - DNA, 18 bp, Homo sapiens
agttaactttaagactga

SEQ ID NO: 2385568 - DNA, 17 bp, Homo sapiens
agttacagcgagaggca

SEQ ID NO: 2385569 - DNA, 16 bp, Homo sapiens
agttctagagaagagg

SEQ ID NO: 2385570 - DNA, 16 bp, Homo sapiens
agttctctcgtaactg

SEQ ID NO: 2385571 - DNA, 17 bp, Homo sapiens
agttctctcgtaactgg

SEQ ID NO: 2385572 - DNA, 22 bp, Homo sapiens
agttcttaaggattgtgatatt

SEQ ID NO: 2385573 - DNA, 22 bp, Homo sapiens
agtttggccgggtgcggtggct

SEQ ID NO: 2385574 - DNA, 17 bp, Homo sapiens
agtttgttgctgtcaag

SEQ ID NO: 2385575 - DNA, 15 bp, Homo sapiens
ataaaagcataaatg

SEQ ID NO: 2385576 - DNA, 16 bp, Homo sapiens
ataaaggttgacaata

SEQ ID NO: 2385577 - DNA, 12 bp, Homo sapiens
ataacttaaaat

SEQ ID NO: 2385578 - DNA, 16 bp, Homo sapiens
ataagcagatttaaca

SEQ ID NO: 2385579 - DNA, 14 bp, Homo sapiens
ataaggatcagaac

SEQ ID NO: 2385580 - DNA, 22 bp, Homo sapiens
ataaggatcagaacagcagagg

SEQ ID NO: 2385581 - DNA, 14 bp, Homo sapiens
ataatctatttaca

SEQ ID NO: 2385582 - DNA, 14 bp, Homo sapiens
ataattcttgtata

SEQ ID NO: 2385583 - DNA, 19 bp, Homo sapiens
ataattcttgtatattatg

SEQ ID NO: 2385584 - DNA, 15 bp, Homo sapiens
ataatttttaaagta

SEQ ID NO: 2385585 - DNA, 12 bp, Homo sapiens
ataccagtgtgg

SEQ ID NO: 2385586 - DNA, 22 bp, Homo sapiens
atagatgggtctggctgagctg

SEQ ID NO: 2385587 - DNA, 23 bp, Homo sapiens
atagatgggtctggctgagctga

SEQ ID NO: 2385588 - DNA, 19 bp, Homo sapiens
atatacacaggatcctatt

SEQ ID NO: 2385589 - DNA, 14 bp, Homo sapiens
atatgatatgtaaa

SEQ ID NO: 2385590 - DNA, 17 bp, Homo sapiens
atattataacttaaaaa

SEQ ID NO: 2385591 - DNA, 16 bp, Homo sapiens
atattgtattaagggc

SEQ ID NO: 2385592 - DNA, 12 bp, Homo sapiens
atattgtcagat

SEQ ID NO: 2385593 - DNA, 19 bp, Homo sapiens
atattttcttccaagcaaa

SEQ ID NO: 2385594 - DNA, 23 bp, Homo sapiens
atattttcttccaagcaaaggtg

SEQ ID NO: 2385595 - DNA, 23 bp, Homo sapiens
atatttttgtacgttatatattg

SEQ ID NO: 2385596 - DNA, 13 bp, Homo sapiens
atccaggactctg

SEQ ID NO: 2385597 - DNA, 18 bp, Homo sapiens
atcccctttcctccccac

SEQ ID NO: 2385598 - DNA, 20 bp, Homo sapiens
atcccctttcctccccacct

SEQ ID NO: 2385599 - DNA, 17 bp, Homo sapiens
atcctggccaacatggt

SEQ ID NO: 2385600 - DNA, 21 bp, Homo sapiens
atctagaatgtgttttctgaa

SEQ ID NO: 2385601 - DNA, 15 bp, Homo sapiens
atctatttacataaa

SEQ ID NO: 2385602 - DNA, 12 bp, Homo sapiens
atctccaaggac

SEQ ID NO: 2385603 - DNA, 12 bp, Homo sapiens
atctccaggatt

SEQ ID NO: 2385604 - DNA, 17 bp, Homo sapiens
atctctgtgtacccact

SEQ ID NO: 2385605 - DNA, 24 bp, Homo sapiens
atctctgtgtacccactcctcact

SEQ ID NO: 2385606 - DNA, 17 bp, Homo sapiens
atctggtagatttttaa

SEQ ID NO: 2385607 - DNA, 22 bp, Homo sapiens
atctgttttaaatttatttcaa

SEQ ID NO: 2385608 - DNA, 13 bp, Homo sapiens
atgaaagaggagg

SEQ ID NO: 2385609 - DNA, 12 bp, Homo sapiens
atgagctgaggg

SEQ ID NO: 2385610 - DNA, 13 bp, Homo sapiens
atgagctgagggg

SEQ ID NO: 2385611 - DNA, 21 bp, Homo sapiens
atgatatgtaaacataattct

SEQ ID NO: 2385612 - DNA, 23 bp, Homo sapiens
atgcatggtgcagttgacagcag

SEQ ID NO: 2385613 - DNA, 20 bp, Homo sapiens
atgccaaattgtagttcttg

SEQ ID NO: 2385614 - DNA, 13 bp, Homo sapiens
atgccagagcctg

SEQ ID NO: 2385615 - DNA, 18 bp, Homo sapiens
atgcgctgctcaacctct

SEQ ID NO: 2385616 - DNA, 21 bp, Homo sapiens
atgcgctgctcaacctctctc

SEQ ID NO: 2385617 - DNA, 13 bp, Homo sapiens
atgctcagccctg

SEQ ID NO: 2385618 - DNA, 18 bp, Homo sapiens
atgctcagccctgactgg

SEQ ID NO: 2385619 - DNA, 16 bp, Homo sapiens
atggaagattttaaat

SEQ ID NO: 2385620 - DNA, 15 bp, Homo sapiens
atggaatacagtgtt

SEQ ID NO: 2385621 - DNA, 16 bp, Homo sapiens
atggaatacagtgtta

SEQ ID NO: 2385622 - DNA, 22 bp, Homo sapiens
atggaatacagtgttattttct

SEQ ID NO: 2385623 - DNA, 22 bp, Homo sapiens
atggagtgacggtcccacactg

SEQ ID NO: 2385624 - DNA, 15 bp, Homo sapiens
atggatttgaagcaa

SEQ ID NO: 2385625 - DNA, 20 bp, Homo sapiens
atggtgcagttgacagcagg

SEQ ID NO: 2385626 - DNA, 22 bp, Homo sapiens
atgtcctccaacaataaagagc

SEQ ID NO: 2385627 - DNA, 21 bp, Homo sapiens
atgtcggcacgtcccatgtgc

SEQ ID NO: 2385628 - DNA, 23 bp, Homo sapiens
atgtctttgttggaaaagaatac

SEQ ID NO: 2385629 - DNA, 20 bp, Homo sapiens
cccagcactttgggaggcca

SEQ ID NO: 2385630 - DNA, 17 bp, Homo sapiens
cccagcctcctcccacc

SEQ ID NO: 2385631 - DNA, 20 bp, Homo sapiens
cccaggccaggccaccagga

SEQ ID NO: 2385632 - DNA, 14 bp, Homo sapiens
cccagggcatccca

SEQ ID NO: 2385633 - DNA, 17 bp, Homo sapiens
cccaggggcccacaggg

SEQ ID NO: 2385634 - DNA, 20 bp, Homo sapiens
cccaggtcctctgataccca

SEQ ID NO: 2385635 - DNA, 13 bp, Homo sapiens
cccatctccccct

SEQ ID NO: 2385636 - DNA, 14 bp, Homo sapiens
ccccaaagagcctg

SEQ ID NO: 2385637 - DNA, 17 bp, Homo sapiens
ccccaccttccccagac

SEQ ID NO: 2385638 - DNA, 15 bp, Homo sapiens
ccccaggccaggcca

SEQ ID NO: 2385639 - DNA, 23 bp, Homo sapiens
ccccagggggcggggtgcagaag

SEQ ID NO: 2385640 - DNA, 15 bp, Homo sapiens
ccccatcccctttcc

SEQ ID NO: 2385641 - DNA, 14 bp, Homo sapiens
ccccgggcctgcct

SEQ ID NO: 2385642 - DNA, 16 bp, Homo sapiens
ccccgggcctgcctct

SEQ ID NO: 2385643 - DNA, 17 bp, Homo sapiens
cccctcgtgtgactctc

SEQ ID NO: 2385644 - DNA, 15 bp, Homo sapiens
ccccttatccaggac

SEQ ID NO: 2385645 - DNA, 14 bp, Homo sapiens
cccggcccagagac

SEQ ID NO: 2385646 - DNA, 13 bp, Homo sapiens
cccggctccccct

SEQ ID NO: 2385647 - DNA, 14 bp, Homo sapiens
cccggctccccctg

SEQ ID NO: 2385648 - DNA, 14 bp, Homo sapiens
cccgggcctgcctc

SEQ ID NO: 2385649 - DNA, 13 bp, Homo sapiens
ccctatgctccag

SEQ ID NO: 2385650 - DNA, 12 bp, Homo sapiens
ccctcagggatc

SEQ ID NO: 2385651 - DNA, 22 bp, Homo sapiens
ccctcagggatcttgcattccc

SEQ ID NO: 2385652 - DNA, 13 bp, Homo sapiens
ccctcccaccatg

SEQ ID NO: 2385653 - DNA, 22 bp, Homo sapiens
ccctcccaccatgcgctgctca

SEQ ID NO: 2385654 - DNA, 14 bp, Homo sapiens
ccctctcttcccta

SEQ ID NO: 2385655 - DNA, 22 bp, Homo sapiens
ccctctgaatggtccagggttg

SEQ ID NO: 2385656 - DNA, 21 bp, Homo sapiens
ccctctgagaattccaaggag

SEQ ID NO: 2385657 - DNA, 14 bp, Homo sapiens
ccctcttccttccc

SEQ ID NO: 2385658 - DNA, 17 bp, Homo sapiens
ccctcttccttccccca

SEQ ID NO: 2385659 - DNA, 18 bp, Homo sapiens
ccctgaacatctgtgtgt

SEQ ID NO: 2385660 - DNA, 23 bp, Homo sapiens
ccctgagtggatctccaaggacc

SEQ ID NO: 2385661 - DNA, 16 bp, Homo sapiens
ccctgcttctcagccc

SEQ ID NO: 2385662 - DNA, 20 bp, Homo sapiens
ccctggcctcacgcccagcc

SEQ ID NO: 2385663 - DNA, 21 bp, Homo sapiens
ccctggcctcacgcccagcct

SEQ ID NO: 2385664 - DNA, 15 bp, Homo sapiens
ccctggcctggctct

SEQ ID NO: 2385665 - DNA, 19 bp, Homo sapiens
ccctggctgaccccaaaga

SEQ ID NO: 2385666 - DNA, 19 bp, Homo sapiens
ccctggtgcagaggtgagc

SEQ ID NO: 2385667 - DNA, 15 bp, Homo sapiens
cccttatccaggact

SEQ ID NO: 2385668 - DNA, 16 bp, Homo sapiens
cccttatccaggactc

SEQ ID NO: 2385669 - DNA, 18 bp, Homo sapiens
cccttggcgggcagccca

SEQ ID NO: 2385670 - DNA, 21 bp, Homo sapiens
cccttggcgggcagcccagcc

SEQ ID NO: 2385671 - DNA, 22 bp, Homo sapiens
cccttggcgggcagcccagcct

SEQ ID NO: 2385672 - DNA, 18 bp, Homo sapiens
ccgagcggtgtggggacc

SEQ ID NO: 2385673 - DNA, 14 bp, Homo sapiens
ccgcactcacccat

SEQ ID NO: 2385674 - DNA, 22 bp, Homo sapiens
ccgctggtgcctcccgggacga

SEQ ID NO: 2385675 - DNA, 16 bp, Homo sapiens
ccggcccagagacccc

SEQ ID NO: 2385676 - DNA, 15 bp, Homo sapiens
ccggctccccctgct

SEQ ID NO: 2385677 - DNA, 13 bp, Homo sapiens
ccgggcctgcctc

SEQ ID NO: 2385678 - DNA, 18 bp, Homo sapiens
ccgggcctgcctctgact

SEQ ID NO: 2385679 - DNA, 12 bp, Homo sapiens
ccgggctctgac

SEQ ID NO: 2385680 - DNA, 20 bp, Homo sapiens
ccgggtggaaaagaatccct

SEQ ID NO: 2385681 - DNA, 17 bp, Homo sapiens
cctacattccctggcct

SEQ ID NO: 2385682 - DNA, 19 bp, Homo sapiens
cctattatttccgggtgga

SEQ ID NO: 2385683 - DNA, 16 bp, Homo sapiens
cctcacgcccagcctc

SEQ ID NO: 2385684 - DNA, 12 bp, Homo sapiens
cctcactgcccc

SEQ ID NO: 2385685 - DNA, 13 bp, Homo sapiens
cctcattcccctc

SEQ ID NO: 2385686 - DNA, 22 bp, Homo sapiens
caactgaaaagactcagtgttc

SEQ ID NO: 2385687 - DNA, 19 bp, Homo sapiens
caagattttttttgtaact

SEQ ID NO: 2385688 - DNA, 20 bp, Homo sapiens
caagattttttttgtaactt

SEQ ID NO: 2385689 - DNA, 18 bp, Homo sapiens
caagcctcactattactt

SEQ ID NO: 2385690 - DNA, 14 bp, Homo sapiens
caagctggaagcac

SEQ ID NO: 2385691 - DNA, 21 bp, Homo sapiens
caaggactacgttaagggaag

SEQ ID NO: 2385692 - DNA, 22 bp, Homo sapiens
caaggtggggggatcacaaggt

SEQ ID NO: 2385693 - DNA, 22 bp, Homo sapiens
caagtgtggtagggacttaaaa

SEQ ID NO: 2385694 - DNA, 16 bp, Homo sapiens
caatggctaattccca

SEQ ID NO: 2385695 - DNA, 19 bp, Homo sapiens
caatggctaattcccagag

SEQ ID NO: 2385696 - DNA, 22 bp, Homo sapiens
caatggtgttgccctgagtgga

SEQ ID NO: 2385697 - DNA, 17 bp, Homo sapiens
caatgtgaccaggggtg

SEQ ID NO: 2385698 - DNA, 13 bp, Homo sapiens
caattatattgtc

SEQ ID NO: 2385699 - DNA, 17 bp, Homo sapiens
caattctacccagagcc

SEQ ID NO: 2385700 - DNA, 20 bp, Homo sapiens
caattctacccagagccttc

SEQ ID NO: 2385701 - DNA, 12 bp, Homo sapiens
cacaagctggaa

SEQ ID NO: 2385702 - DNA, 16 bp, Homo sapiens
cacaagctggaagcac

SEQ ID NO: 2385703 - DNA, 11 bp, Homo sapiens
cacaatatttt

SEQ ID NO: 2385704 - DNA, 21 bp, Homo sapiens
cacaatggctaattcccagag

SEQ ID NO: 2385705 - DNA, 14 bp, Homo sapiens
cacacgcaggaact

SEQ ID NO: 2385706 - DNA, 21 bp, Homo sapiens
cacacgcaggaactcccagca

SEQ ID NO: 2385707 - DNA, 22 bp, Homo sapiens
cacacgcaggaactcccagcaa

SEQ ID NO: 2385708 - DNA, 20 bp, Homo sapiens
cacacttgggcgctctgccc

SEQ ID NO: 2385709 - DNA, 21 bp, Homo sapiens
cacagaaacacaatattttgt

SEQ ID NO: 2385710 - DNA, 16 bp, Homo sapiens
cacagcagctgaacag

SEQ ID NO: 2385711 - DNA, 14 bp, Homo sapiens
caccaaggtcttca

SEQ ID NO: 2385712 - DNA, 20 bp, Homo sapiens
caccaaggtcttcagccatc

SEQ ID NO: 2385713 - DNA, 16 bp, Homo sapiens
caccagcttctccagg

SEQ ID NO: 2385714 - DNA, 19 bp, Homo sapiens
caccagcttctccaggctc

SEQ ID NO: 2385715 - DNA, 13 bp, Homo sapiens
caccatcctgctg

SEQ ID NO: 2385716 - DNA, 22 bp, Homo sapiens
caccatgcgctgctcaacctct

SEQ ID NO: 2385717 - DNA, 23 bp, Homo sapiens
cacccaataaacattaagattga

SEQ ID NO: 2385718 - DNA, 12 bp, Homo sapiens
caccccctcatt

SEQ ID NO: 2385719 - DNA, 18 bp, Homo sapiens
caccccttatccaggact

SEQ ID NO: 2385720 - DNA, 20 bp, Homo sapiens
caccccttatccaggactct

SEQ ID NO: 2385721 - DNA, 18 bp, Homo sapiens
caccctcccaccatgcgc

SEQ ID NO: 2385722 - DNA, 16 bp, Homo sapiens
caccttccccagactc

SEQ ID NO: 2385723 - DNA, 16 bp, Homo sapiens
caccttggactcctcc

SEQ ID NO: 2385724 - DNA, 22 bp, Homo sapiens
caccttggactcctcccacaat

SEQ ID NO: 2385725 - DNA, 20 bp, Homo sapiens
cacgcaggaactcccagcaa

SEQ ID NO: 2385726 - DNA, 13 bp, Homo sapiens
cacgcccagcctc

SEQ ID NO: 2385727 - DNA, 19 bp, Homo sapiens
cacgcccagcctcctccca

SEQ ID NO: 2385728 - DNA, 11 bp, Homo sapiens
cacgcctgccc

SEQ ID NO: 2385729 - DNA, 17 bp, Homo sapiens
cacgcctgtaatcccag

SEQ ID NO: 2385730 - DNA, 22 bp, Homo sapiens
cacgcctgtaatcccagcactt

SEQ ID NO: 2385731 - DNA, 13 bp, Homo sapiens
cacgtcccatgtg

SEQ ID NO: 2385732 - DNA, 17 bp, Homo sapiens
cactattacttgaactt

SEQ ID NO: 2385733 - DNA, 17 bp, Homo sapiens
cactcctcactgcccca

SEQ ID NO: 2385734 - DNA, 14 bp, Homo sapiens
cactctcccctccc

SEQ ID NO: 2385735 - DNA, 21 bp, Homo sapiens
cactctcccctccctcttcct

SEQ ID NO: 2385736 - DNA, 21 bp, Homo sapiens
cactgaatgcctcaatgtgac

SEQ ID NO: 2385737 - DNA, 13 bp, Homo sapiens
cactgcactccgg

SEQ ID NO: 2385738 - DNA, 22 bp, Homo sapiens
cactgccccaccagccacctct

SEQ ID NO: 2385739 - DNA, 20 bp, Homo sapiens
cactgctaggcgagtgccag

SEQ ID NO: 2385740 - DNA, 22 bp, Homo sapiens
cactggtgactgcgatcttcag

SEQ ID NO: 2385741 - DNA, 15 bp, Homo sapiens
cactttaaccctctc

SEQ ID NO: 2385742 - DNA, 18 bp, Homo sapiens
cactttaaccctctcttc

SEQ ID NO: 2385743 - DNA, 18 bp, Homo sapiens
cagaaacaggtgcatctg

SEQ ID NO: 2385744 - DNA, 21 bp, Homo sapiens
cagaaagatggatgtgctttg

SEQ ID NO: 2385745 - DNA, 21 bp, Homo sapiens
cagaactggacgcccagctga

SEQ ID NO: 2385746 - DNA, 22 bp, Homo sapiens
cagaataaagttctgagtgttt

SEQ ID NO: 2385747 - DNA, 21 bp, Homo sapiens
cagaataccttcttcgctgct

SEQ ID NO: 2385748 - DNA, 14 bp, Homo sapiens
cagactcagctcca

SEQ ID NO: 2385749 - DNA, 14 bp, Homo sapiens
gcctcctcccacca

SEQ ID NO: 2385750 - DNA, 13 bp, Homo sapiens
gcctcgcatgcca

SEQ ID NO: 2385751 - DNA, 12 bp, Homo sapiens
gcctgatgacag

SEQ ID NO: 2385752 - DNA, 12 bp, Homo sapiens
gcctgcagagag

SEQ ID NO: 2385753 - DNA, 18 bp, Homo sapiens
gcctgcagagagaagcct

SEQ ID NO: 2385754 - DNA, 14 bp, Homo sapiens
gcctgcccagcctc

SEQ ID NO: 2385755 - DNA, 20 bp, Homo sapiens
gcctgcctctgactcacact

SEQ ID NO: 2385756 - DNA, 21 bp, Homo sapiens
gcctggtagaattgggaagct

SEQ ID NO: 2385757 - DNA, 18 bp, Homo sapiens
gcctgtaatcccagcact

SEQ ID NO: 2385758 - DNA, 19 bp, Homo sapiens
gcctgtagtcccagccact

SEQ ID NO: 2385759 - DNA, 17 bp, Homo sapiens
gccttctcctgcctaca

SEQ ID NO: 2385760 - DNA, 23 bp, Homo sapiens
gccttctcctgcctacattccct

SEQ ID NO: 2385761 - DNA, 16 bp, Homo sapiens
gcgagattgggcctcc

SEQ ID NO: 2385762 - DNA, 16 bp, Homo sapiens
gcgagcatcctggcca

SEQ ID NO: 2385763 - DNA, 22 bp, Homo sapiens
gcgagtgccaggactccccagg

SEQ ID NO: 2385764 - DNA, 22 bp, Homo sapiens
gcgctttctggaaaagaggagt

SEQ ID NO: 2385765 - DNA, 18 bp, Homo sapiens
gcggagaccctgagtccg

SEQ ID NO: 2385766 - DNA, 19 bp, Homo sapiens
gctaggcgagtgccaggac

SEQ ID NO: 2385767 - DNA, 20 bp, Homo sapiens
gctaggcgagtgccaggact

SEQ ID NO: 2385768 - DNA, 22 bp, Homo sapiens
gctcacgcctgtaatcccagca

SEQ ID NO: 2385769 - DNA, 20 bp, Homo sapiens
gctcagccctgactggtgct

SEQ ID NO: 2385770 - DNA, 21 bp, Homo sapiens
gctcagccctgactggtgcta

SEQ ID NO: 2385771 - DNA, 14 bp, Homo sapiens
gctcagcccttcct

SEQ ID NO: 2385772 - DNA, 16 bp, Homo sapiens
gctctgacagccctgc

SEQ ID NO: 2385773 - DNA, 14 bp, Homo sapiens
gctctgccctccct

SEQ ID NO: 2385774 - DNA, 15 bp, Homo sapiens
gctctgccctccctg

SEQ ID NO: 2385775 - DNA, 13 bp, Homo sapiens
gctctttcagggg

SEQ ID NO: 2385776 - DNA, 18 bp, Homo sapiens
gctctttggggtcagcca

SEQ ID NO: 2385777 - DNA, 20 bp, Homo sapiens
gctgaagggaccttgaaggg

SEQ ID NO: 2385778 - DNA, 17 bp, Homo sapiens
gctgctagagaaggggg

SEQ ID NO: 2385779 - DNA, 19 bp, Homo sapiens
gctgctcaacctctctcct

SEQ ID NO: 2385780 - DNA, 23 bp, Homo sapiens
gctgctcaacctctctccttctg

SEQ ID NO: 2385781 - DNA, 13 bp, Homo sapiens
gctggacaaccca

SEQ ID NO: 2385782 - DNA, 15 bp, Homo sapiens
gctggacaacccaga

SEQ ID NO: 2385783 - DNA, 16 bp, Homo sapiens
gctggacaacccagaa

SEQ ID NO: 2385784 - DNA, 15 bp, Homo sapiens
gctggcaaaggtggc

SEQ ID NO: 2385785 - DNA, 15 bp, Homo sapiens
gctggtgctgtggcc

SEQ ID NO: 2385786 - DNA, 16 bp, Homo sapiens
gctgtggccagggtga

SEQ ID NO: 2385787 - DNA, 21 bp, Homo sapiens
gcttaaggagaggagaaactg

SEQ ID NO: 2385788 - DNA, 12 bp, Homo sapiens
gcttaggatgtt

SEQ ID NO: 2385789 - DNA, 17 bp, Homo sapiens
gcttccttagccttgct

SEQ ID NO: 2385790 - DNA, 22 bp, Homo sapiens
gcttcgcttccttagccttgct

SEQ ID NO: 2385791 - DNA, 14 bp, Homo sapiens
gcttctcagccccg

SEQ ID NO: 2385792 - DNA, 22 bp, Homo sapiens
gcttgcactttgtaacatgttt

SEQ ID NO: 2385793 - DNA, 14 bp, Homo sapiens
ggaaaagaatacag

SEQ ID NO: 2385794 - DNA, 21 bp, Homo sapiens
cgtcgctggacaacccagaac

SEQ ID NO: 2385795 - DNA, 13 bp, Homo sapiens
cgtgagccaggta

SEQ ID NO: 2385796 - DNA, 19 bp, Homo sapiens
cgtgcccaggggcccacag

SEQ ID NO: 2385797 - DNA, 20 bp, Homo sapiens
cgttaagggaaggaactctg

SEQ ID NO: 2385798 - DNA, 13 bp, Homo sapiens
cgttatatattgt

SEQ ID NO: 2385799 - DNA, 18 bp, Homo sapiens
ctaatgaagggaaaggat

SEQ ID NO: 2385800 - DNA, 23 bp, Homo sapiens
ctaatgaagggaaaggatatttt

SEQ ID NO: 2385801 - DNA, 20 bp, Homo sapiens
ctacagttgttttttgaaaa

SEQ ID NO: 2385802 - DNA, 14 bp, Homo sapiens
ctacattccctggc

SEQ ID NO: 2385803 - DNA, 17 bp, Homo sapiens
ctacattccctggcctg

SEQ ID NO: 2385804 - DNA, 13 bp, Homo sapiens
ctacccagagcct

SEQ ID NO: 2385805 - DNA, 18 bp, Homo sapiens
ctactatgccagatgcct

SEQ ID NO: 2385806 - DNA, 13 bp, Homo sapiens
ctactgtgactga

SEQ ID NO: 2385807 - DNA, 12 bp, Homo sapiens
ctagactttctc

SEQ ID NO: 2385808 - DNA, 15 bp, Homo sapiens
ctagagaagaggctg

SEQ ID NO: 2385809 - DNA, 20 bp, Homo sapiens
ctaggcgagtgccaggactc

SEQ ID NO: 2385810 - DNA, 15 bp, Homo sapiens
ctatacatttctgtt

SEQ ID NO: 2385811 - DNA, 22 bp, Homo sapiens
ctataggctggagaagctcacc

SEQ ID NO: 2385812 - DNA, 14 bp, Homo sapiens
ctatcatggagtga

SEQ ID NO: 2385813 - DNA, 14 bp, Homo sapiens
ctatgtatggaata

SEQ ID NO: 2385814 - DNA, 18 bp, Homo sapiens
ctattacttgaactttcc

SEQ ID NO: 2385815 - DNA, 20 bp, Homo sapiens
ctattacttgaactttccaa

SEQ ID NO: 2385816 - DNA, 14 bp, Homo sapiens
ctattatagccaca

SEQ ID NO: 2385817 - DNA, 16 bp, Homo sapiens
ctattctcaccaggaa

SEQ ID NO: 2385818 - DNA, 23 bp, Homo sapiens
ctatttgttttcttctgtatgtt

SEQ ID NO: 2385819 - DNA, 13 bp, Homo sapiens
ctcaccaggaagg

SEQ ID NO: 2385820 - DNA, 16 bp, Homo sapiens
ctcacccatgtgccaa

SEQ ID NO: 2385821 - DNA, 12 bp, Homo sapiens
ctcactgcccca

SEQ ID NO: 2385822 - DNA, 19 bp, Homo sapiens
ctcagccctgactggtgct

SEQ ID NO: 2385823 - DNA, 14 bp, Homo sapiens
ctcagcgaggtgta

SEQ ID NO: 2385824 - DNA, 13 bp, Homo sapiens
ctcagctccagaa

SEQ ID NO: 2385825 - DNA, 23 bp, Homo sapiens
ctcagctccagaataccttcttc

SEQ ID NO: 2385826 - DNA, 18 bp, Homo sapiens
ctccagaataccttcttc

SEQ ID NO: 2385827 - DNA, 21 bp, Homo sapiens
ctccagaataccttcttcgct

SEQ ID NO: 2385828 - DNA, 17 bp, Homo sapiens
ctccagttttcagttga

SEQ ID NO: 2385829 - DNA, 20 bp, Homo sapiens
ctcccaccaccctcccacca

SEQ ID NO: 2385830 - DNA, 15 bp, Homo sapiens
ctccccaccttcccc

SEQ ID NO: 2385831 - DNA, 17 bp, Homo sapiens
ctccccaccttccccag

SEQ ID NO: 2385832 - DNA, 21 bp, Homo sapiens
ctccccaggccaggccaccag

SEQ ID NO: 2385833 - DNA, 20 bp, Homo sapiens
ctcccctccctcttccttcc

SEQ ID NO: 2385834 - DNA, 12 bp, Homo sapiens
ctccctcttcct

SEQ ID NO: 2385835 - DNA, 18 bp, Homo sapiens
ctccctggcctcacgccc

SEQ ID NO: 2385836 - DNA, 16 bp, Homo sapiens
ctccgactgctaggga

SEQ ID NO: 2385837 - DNA, 22 bp, Homo sapiens
ctccggcctgatgacagagcga

SEQ ID NO: 2385838 - DNA, 14 bp, Homo sapiens
ctcctcccaccacc

SEQ ID NO: 2385839 - DNA, 19 bp, Homo sapiens
ctcctgcctacattccctg

SEQ ID NO: 2385840 - DNA, 21 bp, Homo sapiens
ctcctgcctacattccctggc

SEQ ID NO: 2385841 - DNA, 23 bp, Homo sapiens
ctcctgcctacattccctggcct

SEQ ID NO: 2385842 - DNA, 17 bp, Homo sapiens
ctcctgtgtggaagaag

SEQ ID NO: 2385843 - DNA, 17 bp, Homo sapiens
ctcgcccacaaactgat

SEQ ID NO: 2385844 - DNA, 17 bp, Homo sapiens
ctctacccggcccagag

SEQ ID NO: 2385845 - DNA, 18 bp, Homo sapiens
ctctacccggcccagaga

SEQ ID NO: 2385846 - DNA, 21 bp, Homo sapiens
ctctgagaattccaaggagtt

SEQ ID NO: 2385847 - DNA, 23 bp, Homo sapiens
tcccagcactttgggaggccaag

SEQ ID NO: 2385848 - DNA, 22 bp, Homo sapiens
tcccagccactcgggaggctga

SEQ ID NO: 2385849 - DNA, 13 bp, Homo sapiens
tccccaccttccc

SEQ ID NO: 2385850 - DNA, 16 bp, Homo sapiens
tccccaggccaggcca

SEQ ID NO: 2385851 - DNA, 23 bp, Homo sapiens
tccccaggccaggccaccaggat

SEQ ID NO: 2385852 - DNA, 18 bp, Homo sapiens
tcccccatcccctttcct

SEQ ID NO: 2385853 - DNA, 20 bp, Homo sapiens
tcccccatcccctttcctcc

SEQ ID NO: 2385854 - DNA, 13 bp, Homo sapiens
tccccctatgctc

SEQ ID NO: 2385855 - DNA, 15 bp, Homo sapiens
tcccctccctcttcc

SEQ ID NO: 2385856 - DNA, 13 bp, Homo sapiens
tcccctttcctcc

SEQ ID NO: 2385857 - DNA, 18 bp, Homo sapiens
tccctcttccttccccca

SEQ ID NO: 2385858 - DNA, 17 bp, Homo sapiens
tccctgaacatctgtgt

SEQ ID NO: 2385859 - DNA, 18 bp, Homo sapiens
tccctgaacatctgtgtg

SEQ ID NO: 2385860 - DNA, 19 bp, Homo sapiens
tccctggcctggctctcct

SEQ ID NO: 2385861 - DNA, 20 bp, Homo sapiens
tcctagaagagtcaggaagg

SEQ ID NO: 2385862 - DNA, 17 bp, Homo sapiens
tcctatacatttctgtt

SEQ ID NO: 2385863 - DNA, 14 bp, Homo sapiens
tcctattctcacca

SEQ ID NO: 2385864 - DNA, 22 bp, Homo sapiens
tcctcccaccaccctcccacca

SEQ ID NO: 2385865 - DNA, 14 bp, Homo sapiens
tcctccccaccttc

SEQ ID NO: 2385866 - DNA, 19 bp, Homo sapiens
tcctccccaccttccccag

SEQ ID NO: 2385867 - DNA, 14 bp, Homo sapiens
tcctgctgctgtgt

SEQ ID NO: 2385868 - DNA, 18 bp, Homo sapiens
tccttcccccatcccctt

SEQ ID NO: 2385869 - DNA, 21 bp, Homo sapiens
tccttggtgtgaccctctgaa

SEQ ID NO: 2385870 - DNA, 21 bp, Homo sapiens
tcgaggtagagtttgaaggag

SEQ ID NO: 2385871 - DNA, 22 bp, Homo sapiens
tctacccagagccttctcctgc

SEQ ID NO: 2385872 - DNA, 23 bp, Homo sapiens
tctacccagagccttctcctgcc

SEQ ID NO: 2385873 - DNA, 17 bp, Homo sapiens
tctacccggcccagaga

SEQ ID NO: 2385874 - DNA, 20 bp, Homo sapiens
tctagaatgtgttttctgaa

SEQ ID NO: 2385875 - DNA, 17 bp, Homo sapiens
tctagactttctcagtg

SEQ ID NO: 2385876 - DNA, 19 bp, Homo sapiens
tctcagccccgggcctgcc

SEQ ID NO: 2385877 - DNA, 22 bp, Homo sapiens
tctcagcgaggtgtaaagttgt

SEQ ID NO: 2385878 - DNA, 15 bp, Homo sapiens
tctcagtcagtaatt

SEQ ID NO: 2385879 - DNA, 23 bp, Homo sapiens
tctcagtgggacaaaccagagca

SEQ ID NO: 2385880 - DNA, 14 bp, Homo sapiens
tctccaaggaccag

SEQ ID NO: 2385881 - DNA, 16 bp, Homo sapiens
tctccaaggaccaggt

SEQ ID NO: 2385882 - DNA, 18 bp, Homo sapiens
gggatcttgcattcccag

SEQ ID NO: 2385883 - DNA, 13 bp, Homo sapiens
gggcaagggccat

SEQ ID NO: 2385884 - DNA, 16 bp, Homo sapiens
gggcagaagggagaag

SEQ ID NO: 2385885 - DNA, 18 bp, Homo sapiens
gggcagaagggagaagga

SEQ ID NO: 2385886 - DNA, 22 bp, Homo sapiens
gggcagtggtaagctctggctt

SEQ ID NO: 2385887 - DNA, 21 bp, Homo sapiens
gggccccttggcgggcagccc

SEQ ID NO: 2385888 - DNA, 17 bp, Homo sapiens
gggccgtgcccaggggc

SEQ ID NO: 2385889 - DNA, 21 bp, Homo sapiens
gggcctcctctccctgcacct

SEQ ID NO: 2385890 - DNA, 19 bp, Homo sapiens
gggcctgcctctgactcac

SEQ ID NO: 2385891 - DNA, 22 bp, Homo sapiens
gggcgcctgtagtcccagccac

SEQ ID NO: 2385892 - DNA, 22 bp, Homo sapiens
gggcgctctgccctccctggcc

SEQ ID NO: 2385893 - DNA, 21 bp, Homo sapiens
gggcgggagtgggggctgtgc

SEQ ID NO: 2385894 - DNA, 14 bp, Homo sapiens
gggcgggggagcca

SEQ ID NO: 2385895 - DNA, 20 bp, Homo sapiens
gggcgtcgctggacaaccca

SEQ ID NO: 2385896 - DNA, 14 bp, Homo sapiens
ggggaagggtggtc

SEQ ID NO: 2385897 - DNA, 18 bp, Homo sapiens
ggggattggagggaagac

SEQ ID NO: 2385898 - DNA, 16 bp, Homo sapiens
ggggcacgcctgccca

SEQ ID NO: 2385899 - DNA, 18 bp, Homo sapiens
ggggcacgcctgcccagc

SEQ ID NO: 2385900 - DNA, 19 bp, Homo sapiens
ggggcacgcctgcccagcc

SEQ ID NO: 2385901 - DNA, 16 bp, Homo sapiens
gggggagccaacagca

SEQ ID NO: 2385902 - DNA, 18 bp, Homo sapiens
gggggagccaacagcagc

SEQ ID NO: 2385903 - DNA, 17 bp, Homo sapiens
ggggtaggcagagcctt

SEQ ID NO: 2385904 - DNA, 17 bp, Homo sapiens
ggggtgatttcagagag

SEQ ID NO: 2385905 - DNA, 17 bp, Homo sapiens
ggggttgtgaggcctgg

SEQ ID NO: 2385906 - DNA, 22 bp, Homo sapiens
gggtggggaatgtttgggcaga

SEQ ID NO: 2385907 - DNA, 19 bp, Homo sapiens
gggttctttggaaggagtg

SEQ ID NO: 2385908 - DNA, 14 bp, Homo sapiens
gggttgtgaggcct

SEQ ID NO: 2385909 - DNA, 23 bp, Homo sapiens
gggttgtgaggcctggccaggca

SEQ ID NO: 2385910 - DNA, 16 bp, Homo sapiens
ggtagaattgggaagc

SEQ ID NO: 2385911 - DNA, 23 bp, Homo sapiens
ggtagaattgggaagctggggga

SEQ ID NO: 2385912 - DNA, 12 bp, Homo sapiens
ggtatctccagg

SEQ ID NO: 2385913 - DNA, 16 bp, Homo sapiens
ggtatctccaggattg

SEQ ID NO: 2385914 - DNA, 23 bp, Homo sapiens
ggtatctccaggattgaagagca

SEQ ID NO: 2385915 - DNA, 16 bp, Homo sapiens
ggtatgagctgagggg

SEQ ID NO: 2385916 - DNA, 12 bp, Homo sapiens
ggtcagccaggg

SEQ ID NO: 2385917 - DNA, 18 bp, Homo sapiens
ggtcagccagggccaggg

SEQ ID NO: 2385918 - DNA, 21 bp, Homo sapiens
ggtcctctgatacccagagca

SEQ ID NO: 2385919 - DNA, 13 bp, Homo sapiens
ggtcctgagacct

SEQ ID NO: 2385920 - DNA, 20 bp, Homo sapiens
ggtccttggtgtgaccctct

SEQ ID NO: 2385921 - DNA, 16 bp, Homo sapiens
ggtgaagaaaactcct

SEQ ID NO: 2385922 - DNA, 12 bp, Homo sapiens
ggtgagagctgc

SEQ ID NO: 2385923 - DNA, 20 bp, Homo sapiens
tggaggtcacattcaggaag

SEQ ID NO: 2385924 - DNA, 15 bp, Homo sapiens
tggatctccaaggac

SEQ ID NO: 2385925 - DNA, 16 bp, Homo sapiens
tggatctgtccaagga

SEQ ID NO: 2385926 - DNA, 20 bp, Homo sapiens
tggatctgtccaaggaaact

SEQ ID NO: 2385927 - DNA, 11 bp, Homo sapiens
tggcaggacca

SEQ ID NO: 2385928 - DNA, 14 bp, Homo sapiens
tggcaggaccagga

SEQ ID NO: 2385929 - DNA, 16 bp, Homo sapiens
tggcaggaccaggact

SEQ ID NO: 2385930 - DNA, 20 bp, Homo sapiens
tggccaggcaccccctggag

SEQ ID NO: 2385931 - DNA, 12 bp, Homo sapiens
tggccagggtga

SEQ ID NO: 2385932 - DNA, 18 bp, Homo sapiens
tggccagggtgagagctg

SEQ ID NO: 2385933 - DNA, 18 bp, Homo sapiens
tggcctcacgcccagcct

SEQ ID NO: 2385934 - DNA, 21 bp, Homo sapiens
tggcctcacgcccagcctcct

SEQ ID NO: 2385935 - DNA, 15 bp, Homo sapiens
tggcctggctctcct

SEQ ID NO: 2385936 - DNA, 16 bp, Homo sapiens
tggcctggctctcctg

SEQ ID NO: 2385937 - DNA, 15 bp, Homo sapiens
tggctcacccaagca

SEQ ID NO: 2385938 - DNA, 22 bp, Homo sapiens
tggctgaccccaaagagcctgg

SEQ ID NO: 2385939 - DNA, 14 bp, Homo sapiens
tggcttccaggtat

SEQ ID NO: 2385940 - DNA, 22 bp, Homo sapiens
tggcttccaggtatctccagga

SEQ ID NO: 2385941 - DNA, 23 bp, Homo sapiens
tggcttccaggtatctccaggat

SEQ ID NO: 2385942 - DNA, 17 bp, Homo sapiens
tgggagagccagctctc

SEQ ID NO: 2385943 - DNA, 23 bp, Homo sapiens
tgggattcccaccaaggtcttca

SEQ ID NO: 2385944 - DNA, 21 bp, Homo sapiens
tgggccactctcccctccctc

SEQ ID NO: 2385945 - DNA, 20 bp, Homo sapiens
tgggcctcctctccctgcac

SEQ ID NO: 2385946 - DNA, 11 bp, Homo sapiens
tggggcagtgg

SEQ ID NO: 2385947 - DNA, 13 bp, Homo sapiens
tggggtcagccag

SEQ ID NO: 2385948 - DNA, 15 bp, Homo sapiens
tggggtcagccaggg

SEQ ID NO: 2385949 - DNA, 19 bp, Homo sapiens
tggggtcagccagggccag

SEQ ID NO: 2385950 - DNA, 17 bp, Homo sapiens
tggggtggagggtcgcc

SEQ ID NO: 2385951 - DNA, 20 bp, Homo sapiens
tgggtagcaattctacccag

SEQ ID NO: 2385952 - DNA, 20 bp, Homo sapiens
tggtagaattggagagtaaa

SEQ ID NO: 2385953 - DNA, 18 bp, Homo sapiens
tggtagaattgggaagct

SEQ ID NO: 2385954 - DNA, 17 bp, Homo sapiens
tggtagggacttaaaaa

SEQ ID NO: 2385955 - DNA, 14 bp, Homo sapiens
tggtatgagctgag

SEQ ID NO: 2385956 - DNA, 15 bp, Homo sapiens
tggtatgagctgagg

SEQ ID NO: 2385957 - DNA, 21 bp, Homo sapiens
tggtcaaaccgcactcaccca

SEQ ID NO: 2385958 - DNA, 16 bp, Homo sapiens
tggtctgagcaccccc

SEQ ID NO: 2385959 - DNA, 18 bp, Homo sapiens
tggtgactgcgatcttca

SEQ ID NO: 2385960 - DNA, 14 bp, Homo sapiens
tggtgcaaatccta

SEQ ID NO: 2385961 - DNA, 18 bp, Homo sapiens
tggtgctataggctggag

SEQ ID NO: 2385962 - DNA, 23 bp, Homo sapiens
tggtgctataggctggagaagct

SEQ ID NO: 2385963 - DNA, 13 bp, Homo sapiens
tggtgctgtggcc

SEQ ID NO: 2385964 - DNA, 17 bp, Homo sapiens
tggtgctgtggccaggg

SEQ ID NO: 2385965 - DNA, 18 bp, Homo sapiens
tgtaaactgcattagaaa

SEQ ID NO: 2385966 - DNA, 13 bp, Homo sapiens
tgtaaatatttat

SEQ ID NO: 2385967 - DNA, 13 bp, Homo sapiens
tgtaccagtgtga

SEQ ID NO: 2385968 - DNA, 17 bp, Homo sapiens
tgtacgttatatattgt

SEQ ID NO: 2385969 - DNA, 23 bp, Homo sapiens
tgtcaatttccctgactcctcta

SEQ ID NO: 2385970 - DNA, 20 bp, Homo sapiens
tgtcagacctatttgacata

SEQ ID NO: 2385971 - DNA, 21 bp, Homo sapiens
tgtcagatattttttcagaaa

SEQ ID NO: 2385972 - DNA, 14 bp, Homo sapiens
tgtccctggtgcag

SEQ ID NO: 2385973 - DNA, 22 bp, Homo sapiens
tgtcctccaacaataaagagct

SEQ ID NO: 2385974 - DNA, 23 bp, Homo sapiens
tgtcctccaacaataaagagctc

SEQ ID NO: 2385975 - DNA, 19 bp, Homo sapiens
tgtctgattggctcaccca

SEQ ID NO: 2385976 - DNA, 18 bp, Homo sapiens
tgtgaattgcctgcagag

SEQ ID NO: 2385977 - DNA, 21 bp, Homo sapiens
tgtgacccagatcctcacaac

SEQ ID NO: 2385978 - DNA, 16 bp, Homo sapiens
tgtgaccctctgaatg

SEQ ID NO: 2385979 - DNA, 22 bp, Homo sapiens
tgtgactgatgttacatcacag

SEQ ID NO: 2385980 - DNA, 14 bp, Homo sapiens
tgtgagaatcaaaa

SEQ ID NO: 2385981 - DNA, 14 bp, Homo sapiens
tgtgagcagtgagt

SEQ ID NO: 2385982 - DNA, 20 bp, Homo sapiens
tgtgcatggaaatgtcctcc

SEQ ID NO: 2385983 - DNA, 21 bp, Homo sapiens
tgtgccgtgaactgcgtgcca

SEQ ID NO: 2385984 - DNA, 19 bp, Homo sapiens
tgtggccagggtgagagct

SEQ ID NO: 2385985 - DNA, 23 bp, Homo sapiens
tgtggtgggttctttggaaggag

SEQ ID NO: 2385986 - DNA, 19 bp, Homo sapiens
tgtgtgagcatctctgtgt

SEQ ID NO: 2385987 - DNA, 17 bp, Homo sapiens
tgtgtggaagaaggaaa

SEQ ID NO: 2385988 - DNA, 13 bp, Homo sapiens
tgtgttgtctgtg

SEQ ID NO: 2385989 - DNA, 21 bp, Homo sapiens
tgtgtttttgctatcacacag

SEQ ID NO: 2385990 - DNA, 12 bp, Homo sapiens
tgttacatcaca

SEQ ID NO: 2385991 - DNA, 22 bp, Homo sapiens
tgttgaatgcccacaggcaaat

SEQ ID NO: 2385992 - DNA, 21 bp, Homo sapiens
tgttggaaaagaatacagaaa

SEQ ID NO: 2385993 - DNA, 15 bp, Homo sapiens
tgttggctaatgaag

SEQ ID NO: 2385994 - DNA, 21 bp, Homo sapiens
tgttgtaaatatttatgtaaa

SEQ ID NO: 2385995 - DNA, 13 bp, Homo sapiens
tgttgtctgtgca

SEQ ID NO: 2385996 - DNA, 16 bp, Homo sapiens
tgtttattaacaaatt

SEQ ID NO: 2385997 - DNA, 19 bp, Homo sapiens
tgtttattaacaaattatg

SEQ ID NO: 2385998 - DNA, 23 bp, Homo sapiens
tgtttatttataagcagatttaa

SEQ ID NO: 2385999 - DNA, 16 bp, Homo sapiens
tgtttgtcagatatga

SEQ ID NO: 2386000 - DNA, 16 bp, Homo sapiens
tgtttgtgtgcatgaa

SEQ ID NO: 2386001 - DNA, 13 bp, Homo sapiens
tgtttttcatgaa

SEQ ID NO: 2386002 - DNA, 14 bp, Homo sapiens
tgttttttgaaaac

SEQ ID NO: 2386003 - DNA, 10 bp, Homo sapiens
ttcctttcct

SEQ ID NO: 2386004 - DNA, 21 bp, Homo sapiens
ttcctttcctctgcagcactt

SEQ ID NO: 2386005 - DNA, 19 bp, Homo sapiens
ttcgctgctagagaagggg

SEQ ID NO: 2386006 - DNA, 18 bp, Homo sapiens
ttctacccagagccttct

SEQ ID NO: 2386007 - DNA, 20 bp, Homo sapiens
ttctacccagagccttctcc

SEQ ID NO: 2386008 - DNA, 12 bp, Homo sapiens
ttctcaccagga

SEQ ID NO: 2386009 - DNA, 13 bp, Homo sapiens
ttctcaccaggaa

SEQ ID NO: 2386010 - DNA, 22 bp, Homo sapiens
ttctcagtcagtaattgccaaa

SEQ ID NO: 2386011 - DNA, 23 bp, Homo sapiens
ttctccgactgctagggagtggt

SEQ ID NO: 2386012 - DNA, 23 bp, Homo sapiens
ttctgcattttattctggatgga

SEQ ID NO: 2386013 - DNA, 20 bp, Homo sapiens
ttcttcattcaatacaagtg

SEQ ID NO: 2386014 - DNA, 21 bp, Homo sapiens
ttcttttaaaggggcagaaaa

SEQ ID NO: 2386015 - DNA, 22 bp, Homo sapiens
ttcttttgcccttcacagtgtt

SEQ ID NO: 2386016 - DNA, 15 bp, Homo sapiens
ttgaactttccaaaa

SEQ ID NO: 2386017 - DNA, 13 bp, Homo sapiens
ttgaatatattat

SEQ ID NO: 2386018 - DNA, 19 bp, Homo sapiens
ttgaggcctgccctcaggg

SEQ ID NO: 2386019 - DNA, 20 bp, Homo sapiens
ttgcaatggtgttgccctga

SEQ ID NO: 2386020 - DNA, 14 bp, Homo sapiens
ttgcattgaatata

SEQ ID NO: 2386021 - DNA, 17 bp, Homo sapiens
ttgcattgaatatatta

SEQ ID NO: 2386022 - DNA, 16 bp, Homo sapiens
ttgccaggcttaagga

SEQ ID NO: 2386023 - DNA, 14 bp, Homo sapiens
ttggaaaagaatac

SEQ ID NO: 2386024 - DNA, 22 bp, Homo sapiens
ttggaaaagaatacagaaagat

SEQ ID NO: 2386025 - DNA, 18 bp, Homo sapiens
ttggagagtaaaaactga

SEQ ID NO: 2386026 - DNA, 20 bp, Homo sapiens
ttggagagtaaaaactgaat

SEQ ID NO: 2386027 - DNA, 15 bp, Homo sapiens
ttggcacagaaacac

SEQ ID NO: 2386028 - DNA, 16 bp, Homo sapiens
ttggcacagaaacaca

SEQ ID NO: 2386029 - DNA, 20 bp, Homo sapiens
ttggcgggcagcccagcctc

SEQ ID NO: 2386030 - DNA, 15 bp, Homo sapiens
ttggggtcagccagg

SEQ ID NO: 2386031 - DNA, 16 bp, Homo sapiens
ttggggtctgccacca

SEQ ID NO: 2386032 - DNA, 14 bp, Homo sapiens
ttgtaacttcaaat

SEQ ID NO: 2386033 - DNA, 14 bp, Homo sapiens
ttgtaccagtgtga

SEQ ID NO: 2386034 - DNA, 15 bp, Homo sapiens
ttgtacgttatatat

SEQ ID NO: 2386035 - DNA, 19 bp, Homo sapiens
ttgtatattgtcagatatt

SEQ ID NO: 2386036 - DNA, 18 bp, Homo sapiens
ttgtcagatatgatatgt

SEQ ID NO: 2386037 - DNA, 14 bp, Homo sapiens
ttgtctgtgcagct

SEQ ID NO: 2386038 - DNA, 15 bp, Homo sapiens
ttgtggaacaaaagt

SEQ ID NO: 2386039 - DNA, 22 bp, Homo sapiens
ttgttcgccgcgtggaatgtga

SEQ ID NO: 2386040 - DNA, 20 bp, Homo sapiens
ttgttttcttctgtatgtta

SEQ ID NO: 2386041 - DNA, 21 bp, Homo sapiens
tttaaattcacaatagaaact

SEQ ID NO: 2386042 - DNA, 21 bp, Homo sapiens
tttacttgcattgaatatatt

SEQ ID NO: 2386043 - DNA, 12 bp, Homo sapiens
tttattaacaaa

SEQ ID NO: 2386044 - DNA, 18 bp, Homo sapiens
tttattaacaaattatgt

SEQ ID NO: 2386045 - DNA, 16 bp, Homo sapiens
tttcagaaatatgtgg

SEQ ID NO: 2386046 - DNA, 12 bp, Homo sapiens
tttcgctttcct

SEQ ID NO: 2386047 - DNA, 22 bp, Homo sapiens
tttcttttgcccttcacagtgt

SEQ ID NO: 2386048 - DNA, 19 bp, Homo sapiens
tttgatattaaaggagtta

SEQ ID NO: 2386049 - DNA, 14 bp, Homo sapiens
tttgtaacttcaaa

SEQ ID NO: 2386050 - DNA, 19 bp, Homo sapiens
tttgtacgttatatattgt

SEQ ID NO: 2386051 - DNA, 14 bp, Homo sapiens
tttgttgctgtcaa

SEQ ID NO: 2386052 - DNA, 13 bp, Homo sapiens
ttttaagacgtga

SEQ ID NO: 2386053 - DNA, 22 bp, Homo sapiens
ttttacttgcattgaatatatt

SEQ ID NO: 2386054 - DNA, 19 bp, Homo sapiens
ttttattgagaattttaaa

SEQ ID NO: 2386055 - DNA, 21 bp, Homo sapiens
ttttgaactaataaaagcata

SEQ ID NO: 2386056 - DNA, 17 bp, Homo sapiens
ttttgtaacttcaaata

SEQ ID NO: 2386057 - DNA, 13 bp, Homo sapiens
tttttgaaaacat

SEQ ID NO: 2386058 - DNA, 16 bp, Homo sapiens
tttttgtaacttcaaa

SEQ ID NO: 2386059 - DNA, 23 bp, Homo sapiens
tttttgtacgttatatattgtat

SEQ ID NO: 2386060 - DNA, 13 bp, Homo sapiens
tttttttgctggt

SEQ ID NO: 2386061 - DNA, 13 bp, Homo sapiens
aaaaaaatgacta

SEQ ID NO: 2386062 - DNA, 13 bp, Homo sapiens
aaaaagtttgttt

SEQ ID NO: 2386063 - DNA, 16 bp, Homo sapiens
aaaacatggtagaatt

SEQ ID NO: 2386064 - DNA, 13 bp, Homo sapiens
aaaactcaggatt

SEQ ID NO: 2386065 - DNA, 16 bp, Homo sapiens
aaaagactcagtgttc

SEQ ID NO: 2386066 - DNA, 18 bp, Homo sapiens
aaaagcaattatattgtc

SEQ ID NO: 2386067 - DNA, 21 bp, Homo sapiens
aaaagtgcaatgcgtgttgta

SEQ ID NO: 2386068 - DNA, 14 bp, Homo sapiens
aaaagttagctgag

SEQ ID NO: 2386069 - DNA, 17 bp, Homo sapiens
aaaatacataagaccat

SEQ ID NO: 2386070 - DNA, 18 bp, Homo sapiens
aaaatcttggcacagaaa

SEQ ID NO: 2386071 - DNA, 15 bp, Homo sapiens
aaaatgacagatgtt

SEQ ID NO: 2386072 - DNA, 17 bp, Homo sapiens
aaaatgacagatgttga

SEQ ID NO: 2386073 - DNA, 18 bp, Homo sapiens
aaaatgacagatgttgaa

SEQ ID NO: 2386074 - DNA, 16 bp, Homo sapiens
aaaatgtgacccagat

SEQ ID NO: 2386075 - DNA, 20 bp, Homo sapiens
aaacattaagattgaggcct

SEQ ID NO: 2386076 - DNA, 22 bp, Homo sapiens
aaactctgggaaataagagaga

SEQ ID NO: 2386077 - DNA, 14 bp, Homo sapiens
aaactgaatggaag

SEQ ID NO: 2386078 - DNA, 13 bp, Homo sapiens
aaactgagaaatg

SEQ ID NO: 2386079 - DNA, 20 bp, Homo sapiens
aaactgagaaatgaatgctg

SEQ ID NO: 2386080 - DNA, 20 bp, Homo sapiens
aaagatgtttgtcagatatg

SEQ ID NO: 2386081 - DNA, 21 bp, Homo sapiens
aaagatgtttgtcagatatga

SEQ ID NO: 2386082 - DNA, 13 bp, Homo sapiens
aaagcaattatat

SEQ ID NO: 2386083 - DNA, 15 bp, Homo sapiens
aaagcaattatattg

SEQ ID NO: 2386084 - DNA, 16 bp, Homo sapiens
aaagcaattatattgt

SEQ ID NO: 2386085 - DNA, 22 bp, Homo sapiens
aaagcaccagcttctccaggct

SEQ ID NO: 2386086 - DNA, 15 bp, Homo sapiens
aaagcataaatgcaa

SEQ ID NO: 2386087 - DNA, 23 bp, Homo sapiens
aaagccaacagtcaaaacagaga

SEQ ID NO: 2386088 - DNA, 16 bp, Homo sapiens
aaaggtataattttat

SEQ ID NO: 2386089 - DNA, 15 bp, Homo sapiens
aaagtatatatttat

SEQ ID NO: 2386090 - DNA, 23 bp, Homo sapiens
aaagttagtgtgttgtctgtgca

SEQ ID NO: 2386091 - DNA, 17 bp, Homo sapiens
aaataccagtgtggttt

SEQ ID NO: 2386092 - DNA, 13 bp, Homo sapiens
aaatagctctttc

SEQ ID NO: 2386093 - DNA, 19 bp, Homo sapiens
aaattagctgtgtgaaata

SEQ ID NO: 2386094 - DNA, 16 bp, Homo sapiens
aaattcacaatagaaa

SEQ ID NO: 2386095 - DNA, 13 bp, Homo sapiens
aacaataaagagc

SEQ ID NO: 2386096 - DNA, 15 bp, Homo sapiens
aacacaagctggaag

SEQ ID NO: 2386097 - DNA, 14 bp, Homo sapiens
aacacacaaaggta

SEQ ID NO: 2386098 - DNA, 15 bp, Homo sapiens
aacagccaacaggtg

SEQ ID NO: 2386099 - DNA, 19 bp, Homo sapiens
aacaggtggcaggaccagg

SEQ ID NO: 2386100 - DNA, 17 bp, Homo sapiens
aacagtcaaaacagaga

SEQ ID NO: 2386101 - DNA, 18 bp, Homo sapiens
aacataattcttgtatat

SEQ ID NO: 2386102 - DNA, 21 bp, Homo sapiens
aacattaagattgaggcctgc

SEQ ID NO: 2386103 - DNA, 22 bp, Homo sapiens
aaccaggattttgtgttttttc

SEQ ID NO: 2386104 - DNA, 18 bp, Homo sapiens
aaccgcactcacccatgt

SEQ ID NO: 2386105 - DNA, 20 bp, Homo sapiens
aacgcaaagggctgaaagcc

SEQ ID NO: 2386106 - DNA, 21 bp, Homo sapiens
aagagtagcaagttctagaga

SEQ ID NO: 2386107 - DNA, 16 bp, Homo sapiens
aagagtgggctgcatc

SEQ ID NO: 2386108 - DNA, 21 bp, Homo sapiens
aagatatatacacaggatcct

SEQ ID NO: 2386109 - DNA, 21 bp, Homo sapiens
aagatttgttttgtcaagtgt

SEQ ID NO: 2386110 - DNA, 14 bp, Homo sapiens
aagattttttttgt

SEQ ID NO: 2386111 - DNA, 16 bp, Homo sapiens
aagcacatgtttattt

SEQ ID NO: 2386112 - DNA, 19 bp, Homo sapiens
aagcaccagcttctccagg

SEQ ID NO: 2386113 - DNA, 21 bp, Homo sapiens
aagcaccagcttctccaggct

SEQ ID NO: 2386114 - DNA, 19 bp, Homo sapiens
aagcactgctaggcgagtg

SEQ ID NO: 2386115 - DNA, 19 bp, Homo sapiens
aagcctgttttgttggaag

SEQ ID NO: 2386116 - DNA, 11 bp, Homo sapiens
aagctggaagc

SEQ ID NO: 2386117 - DNA, 21 bp, Homo sapiens
aaggaaacttgaatcaaagca

SEQ ID NO: 2386118 - DNA, 21 bp, Homo sapiens
aaggaatctccagttttcagt

SEQ ID NO: 2386119 - DNA, 13 bp, Homo sapiens
aaggagttaagag

SEQ ID NO: 2386120 - DNA, 20 bp, Homo sapiens
aaggagttccatgaagacca

SEQ ID NO: 2386121 - DNA, 14 bp, Homo sapiens
aaggattgtgatat

SEQ ID NO: 2386122 - DNA, 17 bp, Homo sapiens
aaggattgtgatatttt

SEQ ID NO: 2386123 - DNA, 16 bp, Homo sapiens
aagggcattttaaaag

SEQ ID NO: 2386124 - DNA, 17 bp, Homo sapiens
aagggccatgctgaagg

SEQ ID NO: 2386125 - DNA, 13 bp, Homo sapiens
aagggtaaagaag

SEQ ID NO: 2386126 - DNA, 17 bp, Homo sapiens
aaggtttgtatattgtc

SEQ ID NO: 2386127 - DNA, 13 bp, Homo sapiens
aagtatatattta

SEQ ID NO: 2386128 - DNA, 22 bp, Homo sapiens
aagtgttgtaaatatttatgta

SEQ ID NO: 2386129 - DNA, 13 bp, Homo sapiens
aagttaacagaga

SEQ ID NO: 2386130 - DNA, 20 bp, Homo sapiens
aagttagtgtgttgtctgtg

SEQ ID NO: 2386131 - DNA, 18 bp, Homo sapiens
aagttctagagaagaggc

SEQ ID NO: 2386132 - DNA, 19 bp, Homo sapiens
aataaagttctgagtgttt

SEQ ID NO: 2386133 - DNA, 21 bp, Homo sapiens
aataataattatccagagttt

SEQ ID NO: 2386134 - DNA, 12 bp, Homo sapiens
aatacagtgtta

SEQ ID NO: 2386135 - DNA, 21 bp, Homo sapiens
aatagaaactcaccatgtaaa

SEQ ID NO: 2386136 - DNA, 14 bp, Homo sapiens
aatatagagatatt

SEQ ID NO: 2386137 - DNA, 20 bp, Homo sapiens
aatatagagatatttttgta

SEQ ID NO: 2386138 - DNA, 21 bp, Homo sapiens
aatgagggactggaaccaggg

SEQ ID NO: 2386139 - DNA, 16 bp, Homo sapiens
aatggctaattcccag

SEQ ID NO: 2386140 - DNA, 13 bp, Homo sapiens
aatgggtgatatg

SEQ ID NO: 2386141 - DNA, 20 bp, Homo sapiens
aatgtctcagcgaggtgtaa

SEQ ID NO: 2386142 - DNA, 16 bp, Homo sapiens
aattagctgtgtgaaa

SEQ ID NO: 2386143 - DNA, 12 bp, Homo sapiens
aattccaaggag

SEQ ID NO: 2386144 - DNA, 15 bp, Homo sapiens
aattcttgtatatta

SEQ ID NO: 2386145 - DNA, 14 bp, Homo sapiens
aattgccaaagctg

SEQ ID NO: 2386146 - DNA, 13 bp, Homo sapiens
acaaaacttcctg

SEQ ID NO: 2386147 - DNA, 21 bp, Homo sapiens
acaaagatgtttgtcagatat

SEQ ID NO: 2386148 - DNA, 19 bp, Homo sapiens
acaaaggtataattttatg

SEQ ID NO: 2386149 - DNA, 16 bp, Homo sapiens
acaataaagagctcaa

SEQ ID NO: 2386150 - DNA, 15 bp, Homo sapiens
acaataaatgtgctt

SEQ ID NO: 2386151 - DNA, 15 bp, Homo sapiens
acacaagctggaagc

SEQ ID NO: 2386152 - DNA, 16 bp, Homo sapiens
acacacgcaggaactc

SEQ ID NO: 2386153 - DNA, 24 bp, Homo sapiens
acacaggatcctattctcaccagg

SEQ ID NO: 2386154 - DNA, 17 bp, Homo sapiens
acaccccttatccagga

SEQ ID NO: 2386155 - DNA, 20 bp, Homo sapiens
acaccccttatccaggactc

SEQ ID NO: 2386156 - DNA, 14 bp, Homo sapiens
acacccggctcccc

SEQ ID NO: 2386157 - DNA, 24 bp, Homo sapiens
acaccgagtctctgtataatctat

SEQ ID NO: 2386158 - DNA, 19 bp, Homo sapiens
acacgcaggaactcccagc

SEQ ID NO: 2386159 - DNA, 21 bp, Homo sapiens
acacttgggcgctctgccctc

SEQ ID NO: 2386160 - DNA, 14 bp, Homo sapiens
acagaggtaactat

SEQ ID NO: 2386161 - DNA, 12 bp, Homo sapiens
acagatgttgaa

SEQ ID NO: 2386162 - DNA, 14 bp, Homo sapiens
acagcagctgaaca

SEQ ID NO: 2386163 - DNA, 23 bp, Homo sapiens
acagccaacaggtggcaggacca

SEQ ID NO: 2386164 - DNA, 15 bp, Homo sapiens
acagcgagaggcaga

SEQ ID NO: 2386165 - DNA, 22 bp, Homo sapiens
acagcgagaggcagagaaagaa

SEQ ID NO: 2386166 - DNA, 15 bp, Homo sapiens
acaggtggcaggacc

SEQ ID NO: 2386167 - DNA, 16 bp, Homo sapiens
acaggtggcaggacca

SEQ ID NO: 2386168 - DNA, 19 bp, Homo sapiens
acaggtggcaggaccagga

SEQ ID NO: 2386169 - DNA, 16 bp, Homo sapiens
acagtcaaaacagaga

SEQ ID NO: 2386170 - DNA, 12 bp, Homo sapiens
acagtgagccaa

SEQ ID NO: 2386171 - DNA, 13 bp, Homo sapiens
acagtgagccaag

SEQ ID NO: 2386172 - DNA, 15 bp, Homo sapiens
acagtgggtggtgga

SEQ ID NO: 2386173 - DNA, 9 bp, Homo sapiens
acagtgttt

SEQ ID NO: 2386174 - DNA, 21 bp, Homo sapiens
acagttgctgtcataagaatg

SEQ ID NO: 2386175 - DNA, 22 bp, Homo sapiens
acagttgctgtcataagaatga

SEQ ID NO: 2386176 - DNA, 16 bp, Homo sapiens
acatctgttttaaatt

SEQ ID NO: 2386177 - DNA, 21 bp, Homo sapiens
acatgtttacttttcagggca

SEQ ID NO: 2386178 - DNA, 23 bp, Homo sapiens
acatgtttatttattctgcattt

SEQ ID NO: 2386179 - DNA, 16 bp, Homo sapiens
acattcaggaagatga

SEQ ID NO: 2386180 - DNA, 13 bp, Homo sapiens
acattccctggcc

SEQ ID NO: 2386181 - DNA, 14 bp, Homo sapiens
acattccctggcct

SEQ ID NO: 2386182 - DNA, 15 bp, Homo sapiens
acattccctggcctg

SEQ ID NO: 2386183 - DNA, 22 bp, Homo sapiens
accaaagatatatacacaggat

SEQ ID NO: 2386184 - DNA, 15 bp, Homo sapiens
accaaggtcttcagc

SEQ ID NO: 2386185 - DNA, 16 bp, Homo sapiens
accacagcagctgaac

SEQ ID NO: 2386186 - DNA, 15 bp, Homo sapiens
accaccctcccacca

SEQ ID NO: 2386187 - DNA, 17 bp, Homo sapiens
accaccctcccaccatg

SEQ ID NO: 2386188 - DNA, 17 bp, Homo sapiens
accaccttggactcctc

SEQ ID NO: 2386189 - DNA, 18 bp, Homo sapiens
accagcttctccaggctc

SEQ ID NO: 2386190 - DNA, 19 bp, Homo sapiens
accaggactatagcccagg

SEQ ID NO: 2386191 - DNA, 16 bp, Homo sapiens
accagggcgcaagcct

SEQ ID NO: 2386192 - DNA, 14 bp, Homo sapiens
accatgcgctgctc

SEQ ID NO: 2386193 - DNA, 18 bp, Homo sapiens
acccactcctcactgccc

SEQ ID NO: 2386194 - DNA, 19 bp, Homo sapiens
acccactcctcactgcccc

SEQ ID NO: 2386195 - DNA, 13 bp, Homo sapiens
acccaggggtggg

SEQ ID NO: 2386196 - DNA, 15 bp, Homo sapiens
accccaaagagcctg

SEQ ID NO: 2386197 - DNA, 18 bp, Homo sapiens
accccagctagggctgga

SEQ ID NO: 2386198 - DNA, 15 bp, Homo sapiens
accccctcattcccc

SEQ ID NO: 2386199 - DNA, 12 bp, Homo sapiens
accccttccttt

SEQ ID NO: 2386200 - DNA, 22 bp, Homo sapiens
accccttcctttcctctgcagc

SEQ ID NO: 2386201 - DNA, 24 bp, Homo sapiens
accccttcctttcctctgcagcac

SEQ ID NO: 2386202 - DNA, 20 bp, Homo sapiens
accctcccaccatgcgctgc

SEQ ID NO: 2386203 - DNA, 13 bp, Homo sapiens
accctctcttccc

SEQ ID NO: 2386204 - DNA, 21 bp, Homo sapiens
accctctgaatggtccagggt

SEQ ID NO: 2386205 - DNA, 16 bp, Homo sapiens
acctgacaagcactgc

SEQ ID NO: 2386206 - DNA, 23 bp, Homo sapiens
acctgcttcatgctcagccctga

SEQ ID NO: 2386207 - DNA, 16 bp, Homo sapiens
accttccccagactca

SEQ ID NO: 2386208 - DNA, 20 bp, Homo sapiens
accttccccagactcagctc

SEQ ID NO: 2386209 - DNA, 17 bp, Homo sapiens
accttggactcctccca

SEQ ID NO: 2386210 - DNA, 12 bp, Homo sapiens
acgcctgcccag

SEQ ID NO: 2386211 - DNA, 15 bp, Homo sapiens
acgcctgcccagcct

SEQ ID NO: 2386212 - DNA, 16 bp, Homo sapiens
acgcctgcccagcctc

SEQ ID NO: 2386213 - DNA, 16 bp, Homo sapiens
acgcctgtaatcccag

SEQ ID NO: 2386214 - DNA, 18 bp, Homo sapiens
acgcctgtaatcccagca

SEQ ID NO: 2386215 - DNA, 21 bp, Homo sapiens
acgcctgtaatcccagcactt

SEQ ID NO: 2386216 - DNA, 13 bp, Homo sapiens
cacccatgtgcca

SEQ ID NO: 2386217 - DNA, 14 bp, Homo sapiens
caccccctcattcc

SEQ ID NO: 2386218 - DNA, 16 bp, Homo sapiens
caccccctcattcccc

SEQ ID NO: 2386219 - DNA, 19 bp, Homo sapiens
caccccttatccaggactc

SEQ ID NO: 2386220 - DNA, 19 bp, Homo sapiens
cacctaatcaggctgaggt

SEQ ID NO: 2386221 - DNA, 23 bp, Homo sapiens
  misc_feature (7)..(7): n is a, c, g or t
  misc_feature (14)..(14): n is a, c, g or t
cacctanccccccnacccccagt

SEQ ID NO: 2386222 - DNA, 18 bp, Homo sapiens
cacctcttgggcatgctc

SEQ ID NO: 2386223 - DNA, 23 bp, Homo sapiens
cacctcttgggcatgctcagccc

SEQ ID NO: 2386224 - DNA, 15 bp, Homo sapiens
caccttccccagact

SEQ ID NO: 2386225 - DNA, 21 bp, Homo sapiens
caccttccccagactcagctc

SEQ ID NO: 2386226 - DNA, 18 bp, Homo sapiens
caccttggactcctccca

SEQ ID NO: 2386227 - DNA, 12 bp, Homo sapiens
cacgatgaaaaa

SEQ ID NO: 2386228 - DNA, 15 bp, Homo sapiens
cacgatgaaaaactt

SEQ ID NO: 2386229 - DNA, 16 bp, Homo sapiens
cacgcaggaactccca

SEQ ID NO: 2386230 - DNA, 15 bp, Homo sapiens
cacgcctgcccagcc

SEQ ID NO: 2386231 - DNA, 16 bp, Homo sapiens
cacgcctgcccagcct

SEQ ID NO: 2386232 - DNA, 18 bp, Homo sapiens
cacgcctgtaatcccagc

SEQ ID NO: 2386233 - DNA, 16 bp, Homo sapiens
cactcacccatgtgcc

SEQ ID NO: 2386234 - DNA, 21 bp, Homo sapiens
cactcacccatgtgccaaggt

SEQ ID NO: 2386235 - DNA, 22 bp, Homo sapiens
cactcacccatgtgccaaggtg

SEQ ID NO: 2386236 - DNA, 12 bp, Homo sapiens
cactctcccctc

SEQ ID NO: 2386237 - DNA, 17 bp, Homo sapiens
cactctcccctccctct

SEQ ID NO: 2386238 - DNA, 22 bp, Homo sapiens
cactctcccctccctcttcctt

SEQ ID NO: 2386239 - DNA, 22 bp, Homo sapiens
cactgaagttaacagagacaga

SEQ ID NO: 2386240 - DNA, 14 bp, Homo sapiens
cactgccccaccag

SEQ ID NO: 2386241 - DNA, 17 bp, Homo sapiens
cactgccccaccagcca

SEQ ID NO: 2386242 - DNA, 20 bp, Homo sapiens
cactgccccaccagccacct

SEQ ID NO: 2386243 - DNA, 21 bp, Homo sapiens
cactgccccaccagccacctc

SEQ ID NO: 2386244 - DNA, 16 bp, Homo sapiens
cactggcaatgaaaaa

SEQ ID NO: 2386245 - DNA, 19 bp, Homo sapiens
cactttaaccctctcttcc

SEQ ID NO: 2386246 - DNA, 22 bp, Homo sapiens
cagaaacaggtgcatctgggga

SEQ ID NO: 2386247 - DNA, 14 bp, Homo sapiens
cagaacagcagagg

SEQ ID NO: 2386248 - DNA, 21 bp, Homo sapiens
cagaacagcagaggttctttt

SEQ ID NO: 2386249 - DNA, 15 bp, Homo sapiens
cagaattccttttct

SEQ ID NO: 2386250 - DNA, 19 bp, Homo sapiens
cagagaaagaagagacagg

SEQ ID NO: 2386251 - DNA, 21 bp, Homo sapiens
cagagaaagaagagacaggag

SEQ ID NO: 2386252 - DNA, 23 bp, Homo sapiens
cagagaaagaagagacaggaggg

SEQ ID NO: 2386253 - DNA, 11 bp, Homo sapiens
cagagaagttc

SEQ ID NO: 2386254 - DNA, 12 bp, Homo sapiens
cagagagggcag

SEQ ID NO: 2386255 - DNA, 15 bp, Homo sapiens
cagagcagagagcag

SEQ ID NO: 2386256 - DNA, 18 bp, Homo sapiens
cagagcattacgtgagcc

SEQ ID NO: 2386257 - DNA, 22 bp, Homo sapiens
cagagcattacgtgagccaggt

SEQ ID NO: 2386258 - DNA, 22 bp, Homo sapiens
cagagcccagggcatcccatgg

SEQ ID NO: 2386259 - DNA, 20 bp, Homo sapiens
cagagccttctcctgcctac

SEQ ID NO: 2386260 - DNA, 20 bp, Homo sapiens
cagaggagtccagggcggga

SEQ ID NO: 2386261 - DNA, 21 bp, Homo sapiens
cagaggtaaaagtgtgagcag

SEQ ID NO: 2386262 - DNA, 18 bp, Homo sapiens
cagatatgatatgtaaac

SEQ ID NO: 2386263 - DNA, 18 bp, Homo sapiens
cagcagctgaacagccaa

SEQ ID NO: 2386264 - DNA, 20 bp, Homo sapiens
cagcagctgaacagccaaat

SEQ ID NO: 2386265 - DNA, 18 bp, Homo sapiens
cagccaacaggtggcagg

SEQ ID NO: 2386266 - DNA, 19 bp, Homo sapiens
cagccaacaggtggcagga

SEQ ID NO: 2386267 - DNA, 14 bp, Homo sapiens
cagccactcgggag

SEQ ID NO: 2386268 - DNA, 14 bp, Homo sapiens
cagccaggaggaga

SEQ ID NO: 2386269 - DNA, 11 bp, Homo sapiens
cagccagggcc

SEQ ID NO: 2386270 - DNA, 14 bp, Homo sapiens
cagccccgggcctg

SEQ ID NO: 2386271 - DNA, 16 bp, Homo sapiens
cagccccgggcctgcc

SEQ ID NO: 2386272 - DNA, 20 bp, Homo sapiens
cagccccgggcctgcctctg

SEQ ID NO: 2386273 - DNA, 15 bp, Homo sapiens
cagcctcctcccacc

SEQ ID NO: 2386274 - DNA, 16 bp, Homo sapiens
cagcctcgcatgccag

SEQ ID NO: 2386275 - DNA, 17 bp, Homo sapiens
cagcctctgtccctctt

SEQ ID NO: 2386276 - DNA, 14 bp, Homo sapiens
cagctagggctgga

SEQ ID NO: 2386277 - DNA, 15 bp, Homo sapiens
cagctctctctaccc

SEQ ID NO: 2386278 - DNA, 15 bp, Homo sapiens
cagctgaacagccaa

SEQ ID NO: 2386279 - DNA, 13 bp, Homo sapiens
cagctgaggctgg

SEQ ID NO: 2386280 - DNA, 20 bp, Homo sapiens
cagctgaggctgggggcggg

SEQ ID NO: 2386281 - DNA, 16 bp, Homo sapiens
caggaactcccagcaa

SEQ ID NO: 2386282 - DNA, 21 bp, Homo sapiens
caggaagatgaaagaggaggt

SEQ ID NO: 2386283 - DNA, 21 bp, Homo sapiens
caggaagggggtccacccagc

SEQ ID NO: 2386284 - DNA, 14 bp, Homo sapiens
caggaccaggacta

SEQ ID NO: 2386285 - DNA, 21 bp, Homo sapiens
caggactatagcccaggtcct

SEQ ID NO: 2386286 - DNA, 15 bp, Homo sapiens
caggactccccaggc

SEQ ID NO: 2386287 - DNA, 16 bp, Homo sapiens
caggactccccaggcc

SEQ ID NO: 2386288 - DNA, 12 bp, Homo sapiens
caggagacaaga

SEQ ID NO: 2386289 - DNA, 19 bp, Homo sapiens
caggatcctattctcacca

SEQ ID NO: 2386290 - DNA, 20 bp, Homo sapiens
caggatcctattctcaccag

SEQ ID NO: 2386291 - DNA, 15 bp, Homo sapiens
caggattgaagagca

SEQ ID NO: 2386292 - DNA, 17 bp, Homo sapiens
caggattttgtgttttt

SEQ ID NO: 2386293 - DNA, 16 bp, Homo sapiens
caggcaccccctggag

SEQ ID NO: 2386294 - DNA, 17 bp, Homo sapiens
caggcaccccctggaga

SEQ ID NO: 2386295 - DNA, 21 bp, Homo sapiens
caggcaccccctggagagaag

SEQ ID NO: 2386296 - DNA, 18 bp, Homo sapiens
caggcaggggtgggagag

SEQ ID NO: 2386297 - DNA, 15 bp, Homo sapiens
caggccaccaggatg

SEQ ID NO: 2386298 - DNA, 16 bp, Homo sapiens
caggccaggccaccag

SEQ ID NO: 2386299 - DNA, 17 bp, Homo sapiens
cagggcatcccatgggg

SEQ ID NO: 2386300 - DNA, 17 bp, Homo sapiens
caggggtgggagagcca

SEQ ID NO: 2386301 - DNA, 21 bp, Homo sapiens
caggggtgggagagccagctc

SEQ ID NO: 2386302 - DNA, 14 bp, Homo sapiens
cagggtgagagctg

SEQ ID NO: 2386303 - DNA, 21 bp, Homo sapiens
cagggtgagagctgctctgga

SEQ ID NO: 2386304 - DNA, 18 bp, Homo sapiens
cagggtgggccactctcc

SEQ ID NO: 2386305 - DNA, 20 bp, Homo sapiens
cagggtgggccactctcccc

SEQ ID NO: 2386306 - DNA, 22 bp, Homo sapiens
caggtaatgagggactggaacc

SEQ ID NO: 2386307 - DNA, 14 bp, Homo sapiens
caggtatctccagg

SEQ ID NO: 2386308 - DNA, 16 bp, Homo sapiens
caggtatctccaggat

SEQ ID NO: 2386309 - DNA, 15 bp, Homo sapiens
caggtctagactttc

SEQ ID NO: 2386310 - DNA, 18 bp, Homo sapiens
caggtctagactttctca

SEQ ID NO: 2386311 - DNA, 21 bp, Homo sapiens
caggtggcaggaccaggacta

SEQ ID NO: 2386312 - DNA, 16 bp, Homo sapiens
caggtggtcctgagac

SEQ ID NO: 2386313 - DNA, 20 bp, Homo sapiens
caggtggtcctgagacctga

SEQ ID NO: 2386314 - DNA, 15 bp, Homo sapiens
cagtataaaagacaa

SEQ ID NO: 2386315 - DNA, 23 bp, Homo sapiens
cagtgagccaagatcgcgccact

SEQ ID NO: 2386316 - DNA, 17 bp, Homo sapiens
cagtggtaagctctggc

SEQ ID NO: 2386317 - DNA, 18 bp, Homo sapiens
cagtggtcaaaccgcact

SEQ ID NO: 2386318 - DNA, 14 bp, Homo sapiens
cagtgttattttct

SEQ ID NO: 2386319 - DNA, 23 bp, Homo sapiens
cataagaccataacagccaacag

SEQ ID NO: 2386320 - DNA, 16 bp, Homo sapiens
catacagaggtaacta

SEQ ID NO: 2386321 - DNA, 20 bp, Homo sapiens
catcagggtgggccactctc

SEQ ID NO: 2386322 - DNA, 18 bp, Homo sapiens
catccacacacgcaggaa

SEQ ID NO: 2386323 - DNA, 12 bp, Homo sapiens
catcccctttcc

SEQ ID NO: 2386324 - DNA, 21 bp, Homo sapiens
catcccctttcctccccacct

SEQ ID NO: 2386325 - DNA, 21 bp, Homo sapiens
catctctgtgtacccactcct

SEQ ID NO: 2386326 - DNA, 14 bp, Homo sapiens
ctggggccccttgg

SEQ ID NO: 2386327 - DNA, 19 bp, Homo sapiens
ctggtgctataggctggag

SEQ ID NO: 2386328 - DNA, 21 bp, Homo sapiens
ctggtgctataggctggagaa

SEQ ID NO: 2386329 - DNA, 23 bp, Homo sapiens
ctggtgctataggctggagaagc

SEQ ID NO: 2386330 - DNA, 18 bp, Homo sapiens
ctggtgctgtggccaggg

SEQ ID NO: 2386331 - DNA, 15 bp, Homo sapiens
ctgtaatcccagcac

SEQ ID NO: 2386332 - DNA, 17 bp, Homo sapiens
ctgtcaatttccctgac

SEQ ID NO: 2386333 - DNA, 11 bp, Homo sapiens
ctgtccaagga

SEQ ID NO: 2386334 - DNA, 13 bp, Homo sapiens
ctgtccctctttg

SEQ ID NO: 2386335 - DNA, 16 bp, Homo sapiens
ctgtccctctttgcct

SEQ ID NO: 2386336 - DNA, 15 bp, Homo sapiens
ctgtgtacccactcc

SEQ ID NO: 2386337 - DNA, 12 bp, Homo sapiens
ctgtgtgaaata

SEQ ID NO: 2386338 - DNA, 21 bp, Homo sapiens
ctgtgtgagcatctctgtgta

SEQ ID NO: 2386339 - DNA, 15 bp, Homo sapiens
cttaaaaaaatgaca

SEQ ID NO: 2386340 - DNA, 18 bp, Homo sapiens
cttaaaaaacttgtaaat

SEQ ID NO: 2386341 - DNA, 14 bp, Homo sapiens
cttcaaatccatcc

SEQ ID NO: 2386342 - DNA, 12 bp, Homo sapiens
cttcacagtgtt

SEQ ID NO: 2386343 - DNA, 14 bp, Homo sapiens
cttcccactggagg

SEQ ID NO: 2386344 - DNA, 12 bp, Homo sapiens
cttccccagact

SEQ ID NO: 2386345 - DNA, 18 bp, Homo sapiens
cttccccagactcagctc

SEQ ID NO: 2386346 - DNA, 15 bp, Homo sapiens
cttcctgcaaggact

SEQ ID NO: 2386347 - DNA, 13 bp, Homo sapiens
cttccttccccca

SEQ ID NO: 2386348 - DNA, 13 bp, Homo sapiens
cttcctttcctct

SEQ ID NO: 2386349 - DNA, 21 bp, Homo sapiens
cttctcagccccgggcctgcc

SEQ ID NO: 2386350 - DNA, 16 bp, Homo sapiens
cttgaagggtaaagaa

SEQ ID NO: 2386351 - DNA, 13 bp, Homo sapiens
cttgacccatctc

SEQ ID NO: 2386352 - DNA, 12 bp, Homo sapiens
cttgcattccca

SEQ ID NO: 2386353 - DNA, 15 bp, Homo sapiens
cttggactcctccca

SEQ ID NO: 2386354 - DNA, 16 bp, Homo sapiens
cttgggcgctctgccc

SEQ ID NO: 2386355 - DNA, 12 bp, Homo sapiens
ctttcctcccca

SEQ ID NO: 2386356 - DNA, 20 bp, Homo sapiens
ctttcctccccaccttcccc

SEQ ID NO: 2386357 - DNA, 21 bp, Homo sapiens
ctttcctccccaccttcccca

SEQ ID NO: 2386358 - DNA, 16 bp, Homo sapiens
ctttcctctgcagcac

SEQ ID NO: 2386359 - DNA, 18 bp, Homo sapiens
ctttcctctgcagcactt

SEQ ID NO: 2386360 - DNA, 15 bp, Homo sapiens
ctttgaaattgttta

SEQ ID NO: 2386361 - DNA, 17 bp, Homo sapiens
ctttgcctgtgtgagca

SEQ ID NO: 2386362 - DNA, 20 bp, Homo sapiens
ctttgcctgtgtgagcatct

SEQ ID NO: 2386363 - DNA, 11 bp, Homo sapiens
ctttggaagga

SEQ ID NO: 2386364 - DNA, 17 bp, Homo sapiens
ctttggaaggagtgaga

SEQ ID NO: 2386365 - DNA, 17 bp, Homo sapiens
ctttggggtcagccagg

SEQ ID NO: 2386366 - DNA, 21 bp, Homo sapiens
cttttgcccttcacagtgttt

SEQ ID NO: 2386367 - DNA, 13 bp, Homo sapiens
gaaaaaaatgact

SEQ ID NO: 2386368 - DNA, 16 bp, Homo sapiens
gaaaaaaatgactaaa

SEQ ID NO: 2386369 - DNA, 23 bp, Homo sapiens
gaaaaactctgggaaataagaga

SEQ ID NO: 2386370 - DNA, 20 bp, Homo sapiens
gaaaaacttccatgaggcca

SEQ ID NO: 2386371 - DNA, 21 bp, Homo sapiens
gaaaagaatccctgcagcctg

SEQ ID NO: 2386372 - DNA, 21 bp, Homo sapiens
gaaaagaggagtttcgaggta

SEQ ID NO: 2386373 - DNA, 14 bp, Homo sapiens
gaaacacaatattt

SEQ ID NO: 2386374 - DNA, 17 bp, Homo sapiens
gaaactcaccatgtaaa

SEQ ID NO: 2386375 - DNA, 15 bp, Homo sapiens
gaaagcctctggaaa

SEQ ID NO: 2386376 - DNA, 19 bp, Homo sapiens
gaaatccagtttcccacca

SEQ ID NO: 2386377 - DNA, 14 bp, Homo sapiens
gaacatttctagaa

SEQ ID NO: 2386378 - DNA, 20 bp, Homo sapiens
gaactctggcttccaggtat

SEQ ID NO: 2386379 - DNA, 16 bp, Homo sapiens
gaactggacgcccagc

SEQ ID NO: 2386380 - DNA, 14 bp, Homo sapiens
gaagaccacatcca

SEQ ID NO: 2386381 - DNA, 20 bp, Homo sapiens
gaagaccacatccacacacg

SEQ ID NO: 2386382 - DNA, 21 bp, Homo sapiens
gaagaccacatccacacacgc

SEQ ID NO: 2386383 - DNA, 22 bp, Homo sapiens
gaagaccacatccacacacgca

SEQ ID NO: 2386384 - DNA, 16 bp, Homo sapiens
gaagcaaagcaccagc

SEQ ID NO: 2386385 - DNA, 20 bp, Homo sapiens
gaagcctgttttgttggaag

SEQ ID NO: 2386386 - DNA, 22 bp, Homo sapiens
gaagcctgttttgttggaaggt

SEQ ID NO: 2386387 - DNA, 21 bp, Homo sapiens
gaagctgatgctttgcttcaa

SEQ ID NO: 2386388 - DNA, 13 bp, Homo sapiens
gaagctgggggaa

SEQ ID NO: 2386389 - DNA, 19 bp, Homo sapiens
gaagctgggggaagggtgg

SEQ ID NO: 2386390 - DNA, 20 bp, Homo sapiens
gaaggaactctggcttccag

SEQ ID NO: 2386391 - DNA, 23 bp, Homo sapiens
gaaggaactctggcttccaggta

SEQ ID NO: 2386392 - DNA, 15 bp, Homo sapiens
gaaggaggtgaggga

SEQ ID NO: 2386393 - DNA, 19 bp, Homo sapiens
gaaggggcacgcctgccca

SEQ ID NO: 2386394 - DNA, 22 bp, Homo sapiens
gaagggggattggagggaagac

SEQ ID NO: 2386395 - DNA, 22 bp, Homo sapiens
gaagggtggtctgagcaccccc

SEQ ID NO: 2386396 - DNA, 21 bp, Homo sapiens
gaaggtcactcttcctgcaag

SEQ ID NO: 2386397 - DNA, 13 bp, Homo sapiens
gaataaagttctg

SEQ ID NO: 2386398 - DNA, 14 bp, Homo sapiens
gaataaagttctga

SEQ ID NO: 2386399 - DNA, 14 bp, Homo sapiens
gaatacagaaagat

SEQ ID NO: 2386400 - DNA, 18 bp, Homo sapiens
gaatagtcgcgcaagcat

SEQ ID NO: 2386401 - DNA, 14 bp, Homo sapiens
gaatcaaaactctc

SEQ ID NO: 2386402 - DNA, 18 bp, Homo sapiens
gaatccctgcagcctggt

SEQ ID NO: 2386403 - DNA, 15 bp, Homo sapiens
gaatggtccagggtt

SEQ ID NO: 2386404 - DNA, 22 bp, Homo sapiens
gaatgtgagtgtgtttgtgtgc

SEQ ID NO: 2386405 - DNA, 16 bp, Homo sapiens
gaattccaaggagttc

SEQ ID NO: 2386406 - DNA, 13 bp, Homo sapiens
gaattgggaagct

SEQ ID NO: 2386407 - DNA, 16 bp, Homo sapiens
gacaaaccagagcaga

SEQ ID NO: 2386408 - DNA, 12 bp, Homo sapiens
gacaacccagaa

SEQ ID NO: 2386409 - DNA, 16 bp, Homo sapiens
gacaagcactgctagg

SEQ ID NO: 2386410 - DNA, 18 bp, Homo sapiens
gacaccccttatccagga

SEQ ID NO: 2386411 - DNA, 20 bp, Homo sapiens
gacaggagggcaagggccat

SEQ ID NO: 2386412 - DNA, 15 bp, Homo sapiens
gacaggtctagactt

SEQ ID NO: 2386413 - DNA, 20 bp, Homo sapiens
gacaggtctagactttctca

SEQ ID NO: 2386414 - DNA, 14 bp, Homo sapiens
gaccaggactatag

SEQ ID NO: 2386415 - DNA, 22 bp, Homo sapiens
gaccaggactatagcccaggtc

SEQ ID NO: 2386416 - DNA, 21 bp, Homo sapiens
gaccaggttattttaaaaaga

SEQ ID NO: 2386417 - DNA, 19 bp, Homo sapiens
gaccataacagccaacagg

SEQ ID NO: 2386418 - DNA, 20 bp, Homo sapiens
gaccccaaagagcctggaga

SEQ ID NO: 2386419 - DNA, 16 bp, Homo sapiens
gaccccttcctttcct

SEQ ID NO: 2386420 - DNA, 22 bp, Homo sapiens
gaccccttcctttcctctgcag

SEQ ID NO: 2386421 - DNA, 21 bp, Homo sapiens
gacggtttcaaaccaggattt

SEQ ID NO: 2386422 - DNA, 18 bp, Homo sapiens
gacgtgaatgtctcagcg

SEQ ID NO: 2386423 - DNA, 18 bp, Homo sapiens
gactaaaaatattataac

SEQ ID NO: 2386424 - DNA, 15 bp, Homo sapiens
gactcagctccagaa

SEQ ID NO: 2386425 - DNA, 12 bp, Homo sapiens
gactcagtgttc

SEQ ID NO: 2386426 - DNA, 13 bp, Homo sapiens
gactcctcccaca

SEQ ID NO: 2386427 - DNA, 15 bp, Homo sapiens
gactgctagggagtg

SEQ ID NO: 2386428 - DNA, 15 bp, Homo sapiens
gactggaaccaggga

SEQ ID NO: 2386429 - DNA, 15 bp, Homo sapiens
gagaaagactgatta

SEQ ID NO: 2386430 - DNA, 21 bp, Homo sapiens
gagaagaggctggtgctgtgg

SEQ ID NO: 2386431 - DNA, 17 bp, Homo sapiens
gagaaggatctagaatg

SEQ ID NO: 2386432 - DNA, 15 bp, Homo sapiens
gagaagggggattgg

SEQ ID NO: 2386433 - DNA, 16 bp, Homo sapiens
gagaagtttctggccc

SEQ ID NO: 2386434 - DNA, 16 bp, Homo sapiens
gagaattttaaattat

SEQ ID NO: 2386435 - DNA, 18 bp, Homo sapiens
gagacctgacaagcactg

SEQ ID NO: 2386436 - DNA, 23 bp, Homo sapiens
gtcttaagccttttgctcacaaa

SEQ ID NO: 2386437 - DNA, 22 bp, Homo sapiens
gtgaattgcctgcagagagaag

SEQ ID NO: 2386438 - DNA, 13 bp, Homo sapiens
gtgacggtcccac

SEQ ID NO: 2386439 - DNA, 22 bp, Homo sapiens
gtgacggtcccacactggtgac

SEQ ID NO: 2386440 - DNA, 15 bp, Homo sapiens
gtgagcatctctgtg

SEQ ID NO: 2386441 - DNA, 11 bp, Homo sapiens
gtgaggcctgg

SEQ ID NO: 2386442 - DNA, 17 bp, Homo sapiens
gtgcagaggtgagcaga

SEQ ID NO: 2386443 - DNA, 17 bp, Homo sapiens
gtgccaggactccccag

SEQ ID NO: 2386444 - DNA, 23 bp, Homo sapiens
gtgccaggactccccaggccagg

SEQ ID NO: 2386445 - DNA, 19 bp, Homo sapiens
gtgcccaggggcccacagg

SEQ ID NO: 2386446 - DNA, 18 bp, Homo sapiens
gtgctataggctggagaa

SEQ ID NO: 2386447 - DNA, 19 bp, Homo sapiens
gtgctataggctggagaag

SEQ ID NO: 2386448 - DNA, 15 bp, Homo sapiens
gtgctgtggccaggg

SEQ ID NO: 2386449 - DNA, 23 bp, Homo sapiens
gtgctgtggccagggtgagagct

SEQ ID NO: 2386450 - DNA, 17 bp, Homo sapiens
gtggatctgtccaagga

SEQ ID NO: 2386451 - DNA, 21 bp, Homo sapiens
gtgggacaaaccagagcagag

SEQ ID NO: 2386452 - DNA, 17 bp, Homo sapiens
gtgggccactctcccct

SEQ ID NO: 2386453 - DNA, 15 bp, Homo sapiens
gtgggctgcatctgg

SEQ ID NO: 2386454 - DNA, 22 bp, Homo sapiens
gtggtcaaaccgcactcaccca

SEQ ID NO: 2386455 - DNA, 15 bp, Homo sapiens
gtggtcctgagacct

SEQ ID NO: 2386456 - DNA, 14 bp, Homo sapiens
gtgtacccactcct

SEQ ID NO: 2386457 - DNA, 23 bp, Homo sapiens
gtgtgactctcttggattattta

SEQ ID NO: 2386458 - DNA, 19 bp, Homo sapiens
gtgtgagcatctctgtgta

SEQ ID NO: 2386459 - DNA, 13 bp, Homo sapiens
gtgtggctgtctg

SEQ ID NO: 2386460 - DNA, 19 bp, Homo sapiens
gtgttttctgaataacatt

SEQ ID NO: 2386461 - DNA, 23 bp, Homo sapiens
gttaactttaagactgagcacct

SEQ ID NO: 2386462 - DNA, 20 bp, Homo sapiens
gttagtgtgttgtctgtgca

SEQ ID NO: 2386463 - DNA, 17 bp, Homo sapiens
gttatatattgtattaa

SEQ ID NO: 2386464 - DNA, 23 bp, Homo sapiens
gttccatgaagaccacatccaca

SEQ ID NO: 2386465 - DNA, 22 bp, Homo sapiens
gttccctctgagaattccaagg

SEQ ID NO: 2386466 - DNA, 20 bp, Homo sapiens
gttgatcactggcaatgaaa

SEQ ID NO: 2386467 - DNA, 19 bp, Homo sapiens
gttgctgtcataagaatga

SEQ ID NO: 2386468 - DNA, 13 bp, Homo sapiens
gttgtgaggcctg

SEQ ID NO: 2386469 - DNA, 14 bp, Homo sapiens
gttgtgaggcctgg

SEQ ID NO: 2386470 - DNA, 18 bp, Homo sapiens
gtttattaacaaattatg

SEQ ID NO: 2386471 - DNA, 23 bp, Homo sapiens
gtttattaacaaattatgttaca

SEQ ID NO: 2386472 - DNA, 17 bp, Homo sapiens
gtttatttattctgcat

SEQ ID NO: 2386473 - DNA, 19 bp, Homo sapiens
gtttcatttctactgtgac

SEQ ID NO: 2386474 - DNA, 13 bp, Homo sapiens
taaaaagatttgt

SEQ ID NO: 2386475 - DNA, 15 bp, Homo sapiens
taaaagcataaatgc

SEQ ID NO: 2386476 - DNA, 19 bp, Homo sapiens
taaaatcttggcacagaaa

SEQ ID NO: 2386477 - DNA, 15 bp, Homo sapiens
taaacataattcttg

SEQ ID NO: 2386478 - DNA, 20 bp, Homo sapiens
taaacataattcttgtatat

SEQ ID NO: 2386479 - DNA, 20 bp, Homo sapiens
taaaggagttaagagtagca

SEQ ID NO: 2386480 - DNA, 21 bp, Homo sapiens
taaagttagtgtgttgtctgt

SEQ ID NO: 2386481 - DNA, 17 bp, Homo sapiens
taaattataacttaaaa

SEQ ID NO: 2386482 - DNA, 15 bp, Homo sapiens
taaatttatttcaaa

SEQ ID NO: 2386483 - DNA, 12 bp, Homo sapiens
taacaaattatg

SEQ ID NO: 2386484 - DNA, 15 bp, Homo sapiens
taaccctctcttccc

SEQ ID NO: 2386485 - DNA, 22 bp, Homo sapiens
taactagtcctgcagaggattt

SEQ ID NO: 2386486 - DNA, 18 bp, Homo sapiens
taacttaaaaaaatgaca

SEQ ID NO: 2386487 - DNA, 15 bp, Homo sapiens
taacttagcatgtgt

SEQ ID NO: 2386488 - DNA, 13 bp, Homo sapiens
taagacgtgaatg

SEQ ID NO: 2386489 - DNA, 13 bp, Homo sapiens
taagctctggctt

SEQ ID NO: 2386490 - DNA, 16 bp, Homo sapiens
taagcttatgtcagac

SEQ ID NO: 2386491 - DNA, 20 bp, Homo sapiens
taaggagaggagaaactgag

SEQ ID NO: 2386492 - DNA, 13 bp, Homo sapiens
taagggcatttta

SEQ ID NO: 2386493 - DNA, 18 bp, Homo sapiens
taattttatgaatgtctt

SEQ ID NO: 2386494 - DNA, 13 bp, Homo sapiens
taatttttaaagt

SEQ ID NO: 2386495 - DNA, 21 bp, Homo sapiens
tacagaaagatggatgtgctt

SEQ ID NO: 2386496 - DNA, 14 bp, Homo sapiens
tacagcgagaggca

SEQ ID NO: 2386497 - DNA, 19 bp, Homo sapiens
tacagcgagaggcagagaa

SEQ ID NO: 2386498 - DNA, 16 bp, Homo sapiens
tacagtgttattttct

SEQ ID NO: 2386499 - DNA, 18 bp, Homo sapiens
tacatacagaggtaacta

SEQ ID NO: 2386500 - DNA, 14 bp, Homo sapiens
tacattccctggcc

SEQ ID NO: 2386501 - DNA, 12 bp, Homo sapiens
taccacagcagc

SEQ ID NO: 2386502 - DNA, 15 bp, Homo sapiens
tacccagagccttct

SEQ ID NO: 2386503 - DNA, 16 bp, Homo sapiens
tacccagagccttctc

SEQ ID NO: 2386504 - DNA, 21 bp, Homo sapiens
tacccagagccttctcctgcc

SEQ ID NO: 2386505 - DNA, 22 bp, Homo sapiens
tacccagagccttctcctgcct

SEQ ID NO: 2386506 - DNA, 15 bp, Homo sapiens
taccttcttcgctgc

SEQ ID NO: 2386507 - DNA, 17 bp, Homo sapiens
tacttttgtaccagtgt

SEQ ID NO: 2386508 - DNA, 19 bp, Homo sapiens
tagaaactcaccatgtaaa

SEQ ID NO: 2386509 - DNA, 18 bp, Homo sapiens
tagaaattagctgtgtga

SEQ ID NO: 2386510 - DNA, 13 bp, Homo sapiens
tagaatgtgtttt

SEQ ID NO: 2386511 - DNA, 20 bp, Homo sapiens
tagaatgtgttttctgaata

SEQ ID NO: 2386512 - DNA, 19 bp, Homo sapiens
tagactttctcagtgggac

SEQ ID NO: 2386513 - DNA, 18 bp, Homo sapiens
tagaggaaaaaaatgact

SEQ ID NO: 2386514 - DNA, 21 bp, Homo sapiens
tagcaagttctagagaagagg

SEQ ID NO: 2386515 - DNA, 17 bp, Homo sapiens
tagctgagcgtggtggc

SEQ ID NO: 2386516 - DNA, 13 bp, Homo sapiens
taggatgtttttc

SEQ ID NO: 2386517 - DNA, 14 bp, Homo sapiens
taggcgagtgccag

SEQ ID NO: 2386518 - DNA, 17 bp, Homo sapiens
taggctggagaagctca

SEQ ID NO: 2386519 - DNA, 21 bp, Homo sapiens
taggctggagaagctcaccca

SEQ ID NO: 2386520 - DNA, 16 bp, Homo sapiens
tagtgtgttgtctgtg

SEQ ID NO: 2386521 - DNA, 16 bp, Homo sapiens
tataaaggttgacaat

SEQ ID NO: 2386522 - DNA, 18 bp, Homo sapiens
tataacttaaaaaaatga

SEQ ID NO: 2386523 - DNA, 19 bp, Homo sapiens
tataacttaaaaaaatgac

SEQ ID NO: 2386524 - DNA, 22 bp, Homo sapiens
tataacttaaaaaaatgacaga

SEQ ID NO: 2386525 - DNA, 18 bp, Homo sapiens
tataacttaaaatatttt

SEQ ID NO: 2386526 - DNA, 13 bp, Homo sapiens
tataatctattta

SEQ ID NO: 2386527 - DNA, 14 bp, Homo sapiens
tataatctatttac

SEQ ID NO: 2386528 - DNA, 20 bp, Homo sapiens
tataatcttccatacttctt

SEQ ID NO: 2386529 - DNA, 17 bp, Homo sapiens
tataattttatgaatgt

SEQ ID NO: 2386530 - DNA, 14 bp, Homo sapiens
tataggctggagaa

SEQ ID NO: 2386531 - DNA, 22 bp, Homo sapiens
tatattgtcctcccctatttta

SEQ ID NO: 2386532 - DNA, 16 bp, Homo sapiens
tatgagctgagggggg

SEQ ID NO: 2386533 - DNA, 19 bp, Homo sapiens
tatgttacatctgttttaa

SEQ ID NO: 2386534 - DNA, 22 bp, Homo sapiens
tatgttacatctgttttaaatt

SEQ ID NO: 2386535 - DNA, 14 bp, Homo sapiens
tattacttgaactt

SEQ ID NO: 2386536 - DNA, 21 bp, Homo sapiens
tattacttgaactttccaaaa

SEQ ID NO: 2386537 - DNA, 21 bp, Homo sapiens
tattatggaagattttaaatt

SEQ ID NO: 2386538 - DNA, 16 bp, Homo sapiens
tattgtcagatatttt

SEQ ID NO: 2386539 - DNA, 22 bp, Homo sapiens
tatttaagtttgttgctgtcaa

SEQ ID NO: 2386540 - DNA, 11 bp, Homo sapiens
tatttttgtac

SEQ ID NO: 2386541 - DNA, 14 bp, Homo sapiens
tatttttgtacgtt

SEQ ID NO: 2386542 - DNA, 15 bp, Homo sapiens
tcaaaacagagatgt

SEQ ID NO: 2386543 - DNA, 20 bp, Homo sapiens
tcaaaccgcactcacccatg

SEQ ID NO: 2386544 - DNA, 18 bp, Homo sapiens
tcaaatatagagatattt

SEQ ID NO: 2386545 - DNA, 15 bp, Homo sapiens
tcaaatccatccaga

SEQ ID NO: 2386546 - DNA, 13 bp, Homo sapiens
ttttttgtaactt

SEQ ID NO: 2386547 - DNA, 23 bp, Homo sapiens
tggaaaagaatccctgcagcctg

SEQ ID NO: 2386548 - DNA, 16 bp, Homo sapiens
tggaaaagaggagttt

SEQ ID NO: 2386549 - DNA, 14 bp, Homo sapiens
tggaatacagtgtt

SEQ ID NO: 2386550 - DNA, 15 bp, Homo sapiens
tggaatgtgagtgtg

SEQ ID NO: 2386551 - DNA, 13 bp, Homo sapiens
tggacaacccaga

SEQ ID NO: 2386552 - DNA, 14 bp, Homo sapiens
tggacaacccagaa

SEQ ID NO: 2386553 - DNA, 20 bp, Homo sapiens
tggacaccccttatccagga

SEQ ID NO: 2386554 - DNA, 22 bp, Homo sapiens
tggacaccccttatccaggact

SEQ ID NO: 2386555 - DNA, 23 bp, Homo sapiens
tggacaccccttatccaggactc

SEQ ID NO: 2386556 - DNA, 15 bp, Homo sapiens
tggacgcccagctga

SEQ ID NO: 2386557 - DNA, 13 bp, Homo sapiens
tggagagaagttt

SEQ ID NO: 2386558 - DNA, 16 bp, Homo sapiens
tggagggaagacaggt

SEQ ID NO: 2386559 - DNA, 22 bp, Homo sapiens
tggagggcaaggggtttccaca

SEQ ID NO: 2386560 - DNA, 18 bp, Homo sapiens
tggatctccaaggaccag

SEQ ID NO: 2386561 - DNA, 13 bp, Homo sapiens
tggatttgaagca

SEQ ID NO: 2386562 - DNA, 23 bp, Homo sapiens
tggcacaatggctaattcccaga

SEQ ID NO: 2386563 - DNA, 21 bp, Homo sapiens
tggccaggcaccccctggaga

SEQ ID NO: 2386564 - DNA, 13 bp, Homo sapiens
tggccagggtgag

SEQ ID NO: 2386565 - DNA, 16 bp, Homo sapiens
tggccatcagggtggg

SEQ ID NO: 2386566 - DNA, 19 bp, Homo sapiens
tggcccttcccactggagg

SEQ ID NO: 2386567 - DNA, 12 bp, Homo sapiens
tggcctggctct

SEQ ID NO: 2386568 - DNA, 16 bp, Homo sapiens
tggctctcctgtagct

SEQ ID NO: 2386569 - DNA, 20 bp, Homo sapiens
tggcttccaggtatctccag

SEQ ID NO: 2386570 - DNA, 17 bp, Homo sapiens
tgggcagaagggagaag

SEQ ID NO: 2386571 - DNA, 18 bp, Homo sapiens
tgggccactctcccctcc

SEQ ID NO: 2386572 - DNA, 18 bp, Homo sapiens
tgggggcgggggagccaa

SEQ ID NO: 2386573 - DNA, 14 bp, Homo sapiens
tggggtcagccagg

SEQ ID NO: 2386574 - DNA, 23 bp, Homo sapiens
tgggttctttggaaggagtgaga

SEQ ID NO: 2386575 - DNA, 22 bp, Homo sapiens
tggtctttcctatcatggagtg

SEQ ID NO: 2386576 - DNA, 20 bp, Homo sapiens
tggtgcagaggtgagcagag

SEQ ID NO: 2386577 - DNA, 23 bp, Homo sapiens
tggtgcagaggtgagcagaggag

SEQ ID NO: 2386578 - DNA, 20 bp, Homo sapiens
tggtgctgtggccagggtga

SEQ ID NO: 2386579 - DNA, 22 bp, Homo sapiens
tgtaaaatcttggcacagaaac

SEQ ID NO: 2386580 - DNA, 12 bp, Homo sapiens
tgtaaatattta

SEQ ID NO: 2386581 - DNA, 22 bp, Homo sapiens
tgtaaatgctgtcaactatgat

SEQ ID NO: 2386582 - DNA, 19 bp, Homo sapiens
tgtaggtgtctgcacccag

SEQ ID NO: 2386583 - DNA, 15 bp, Homo sapiens
tgtagtcccagccac

SEQ ID NO: 2386584 - DNA, 21 bp, Homo sapiens
tgtatattatggaagatttta

SEQ ID NO: 2386585 - DNA, 17 bp, Homo sapiens
tgtatggaatacagtgt

SEQ ID NO: 2386586 - DNA, 18 bp, Homo sapiens
tgtatggaatacagtgtt

SEQ ID NO: 2386587 - DNA, 17 bp, Homo sapiens
tgtattaagggcatttt

SEQ ID NO: 2386588 - DNA, 15 bp, Homo sapiens
tgtcagatatgatat

SEQ ID NO: 2386589 - DNA, 14 bp, Homo sapiens
tgtcataagaatga

SEQ ID NO: 2386590 - DNA, 15 bp, Homo sapiens
tgtcataagaatgaa

SEQ ID NO: 2386591 - DNA, 21 bp, Homo sapiens
tgtccctctttgcctgtgtga

SEQ ID NO: 2386592 - DNA, 18 bp, Homo sapiens
tgtcggcacgtcccatgt

SEQ ID NO: 2386593 - DNA, 20 bp, Homo sapiens
tgtctcagcgaggtgtaaag

SEQ ID NO: 2386594 - DNA, 14 bp, Homo sapiens
tgtctgcacccagg

SEQ ID NO: 2386595 - DNA, 22 bp, Homo sapiens
tgtgaattgcctgcagagagaa

SEQ ID NO: 2386596 - DNA, 14 bp, Homo sapiens
tgtgaccctctgaa

SEQ ID NO: 2386597 - DNA, 16 bp, Homo sapiens
tgtgagcatctctgtg

SEQ ID NO: 2386598 - DNA, 19 bp, Homo sapiens
tgtgagcatctctgtgtac

SEQ ID NO: 2386599 - DNA, 18 bp, Homo sapiens
tgtgataaggatcagaac

SEQ ID NO: 2386600 - DNA, 17 bp, Homo sapiens
tgtgccgtgaactgcgt

SEQ ID NO: 2386601 - DNA, 17 bp, Homo sapiens
tgtggctttctttcttt

SEQ ID NO: 2386602 - DNA, 13 bp, Homo sapiens
tgtgtacccactc

SEQ ID NO: 2386603 - DNA, 23 bp, Homo sapiens
tgtgtacccactcctcactgccc

SEQ ID NO: 2386604 - DNA, 13 bp, Homo sapiens
tgtgtgagcatct

SEQ ID NO: 2386605 - DNA, 13 bp, Homo sapiens
tgtgttttctgaa

SEQ ID NO: 2386606 - DNA, 14 bp, Homo sapiens
tgtgttttctgaat

SEQ ID NO: 2386607 - DNA, 20 bp, Homo sapiens
tgttaatggtgcaaatccta

SEQ ID NO: 2386608 - DNA, 13 bp, Homo sapiens
tgttggaaaagaa

SEQ ID NO: 2386609 - DNA, 15 bp, Homo sapiens
tgttggggcagtggt

SEQ ID NO: 2386610 - DNA, 22 bp, Homo sapiens
tgttttaaatttatttcaaaaa

SEQ ID NO: 2386611 - DNA, 13 bp, Homo sapiens
ttaaaaaacttgt

SEQ ID NO: 2386612 - DNA, 12 bp, Homo sapiens
ttaaaatatttt

SEQ ID NO: 2386613 - DNA, 16 bp, Homo sapiens
ttaactttaagactga

SEQ ID NO: 2386614 - DNA, 15 bp, Homo sapiens
ttaagacgtgaatgt

SEQ ID NO: 2386615 - DNA, 21 bp, Homo sapiens
ttaagactgagcacctgcttc

SEQ ID NO: 2386616 - DNA, 21 bp, Homo sapiens
ttacatctgttttaaatttat

SEQ ID NO: 2386617 - DNA, 21 bp, Homo sapiens
ttaccaatttaactagtcctg

SEQ ID NO: 2386618 - DNA, 15 bp, Homo sapiens
ttactacagttgttt

SEQ ID NO: 2386619 - DNA, 12 bp, Homo sapiens
ttacttgaactt

SEQ ID NO: 2386620 - DNA, 18 bp, Homo sapiens
ttagaggaaaaaaatgac

SEQ ID NO: 2386621 - DNA, 19 bp, Homo sapiens
ttagaggaaaaaaatgact

SEQ ID NO: 2386622 - DNA, 17 bp, Homo sapiens
ttagcatgtgttgaaaa

SEQ ID NO: 2386623 - DNA, 14 bp, Homo sapiens
ttagccttgctcag

SEQ ID NO: 2386624 - DNA, 16 bp, Homo sapiens
ttagctgtgtgaaata

SEQ ID NO: 2386625 - DNA, 19 bp, Homo sapiens
ttagtgtgttgtctgtgca

SEQ ID NO: 2386626 - DNA, 15 bp, Homo sapiens
ttataacttaaaaaa

SEQ ID NO: 2386627 - DNA, 20 bp, Homo sapiens
ttataatcttccatacttct

SEQ ID NO: 2386628 - DNA, 18 bp, Homo sapiens
ttatatattgtattaagg

SEQ ID NO: 2386629 - DNA, 12 bp, Homo sapiens
ttatccaggact

SEQ ID NO: 2386630 - DNA, 18 bp, Homo sapiens
ttatccaggactctgtca

SEQ ID NO: 2386631 - DNA, 22 bp, Homo sapiens
ttatggaagattttaaattcac

SEQ ID NO: 2386632 - DNA, 17 bp, Homo sapiens
ttattttctttgaaatt

SEQ ID NO: 2386633 - DNA, 13 bp, Homo sapiens
ttcacaatagaaa

SEQ ID NO: 2386634 - DNA, 21 bp, Homo sapiens
ttcagccatcaacaagagttg

SEQ ID NO: 2386635 - DNA, 22 bp, Homo sapiens
ttcaggggggttgtgaggcctg

SEQ ID NO: 2386636 - DNA, 16 bp, Homo sapiens
ttcagttgatcactgg

SEQ ID NO: 2386637 - DNA, 19 bp, Homo sapiens
ttccaggtatctccaggat

SEQ ID NO: 2386638 - DNA, 15 bp, Homo sapiens
ttcccaccaaggtct

SEQ ID NO: 2386639 - DNA, 13 bp, Homo sapiens
ttccccagactca

SEQ ID NO: 2386640 - DNA, 19 bp, Homo sapiens
ttccccagactcagctcca

SEQ ID NO: 2386641 - DNA, 21 bp, Homo sapiens
ttccccagactcagctccaga

SEQ ID NO: 2386642 - DNA, 22 bp, Homo sapiens
ttccctctgagaattccaagga

SEQ ID NO: 2386643 - DNA, 18 bp, Homo sapiens
ttccctgactcctctaag

SEQ ID NO: 2386644 - DNA, 19 bp, Homo sapiens
ttcctccccaccttcccca

SEQ ID NO: 2386645 - DNA, 15 bp, Homo sapiens
ttcctttcctctgca

SEQ ID NO: 2386646 - DNA, 17 bp, Homo sapiens
ttcgctgctagagaagg

SEQ ID NO: 2386647 - DNA, 13 bp, Homo sapiens
ttcgctttcctct

SEQ ID NO: 2386648 - DNA, 14 bp, Homo sapiens
ttctagagaagagg

SEQ ID NO: 2386649 - DNA, 22 bp, Homo sapiens
ttctagagaagaggctggtgct

SEQ ID NO: 2386650 - DNA, 18 bp, Homo sapiens
ttctcagccccgggcctg

SEQ ID NO: 2386651 - DNA, 17 bp, Homo sapiens
ttctgaataacatttgt

SEQ ID NO: 2386652 - DNA, 13 bp, Homo sapiens
ttcttaaagagtt

SEQ ID NO: 2386653 - DNA, 20 bp, Homo sapiens
ttcttaaggattgtgatatt

SEQ ID NO: 2386654 - DNA, 22 bp, Homo sapiens
ttcttaaggattgtgatatttt

SEQ ID NO: 2386655 - DNA, 16 bp, Homo sapiens
ttcttatcttctgcaa

SEQ ID NO: 2386656 - DNA, 18 bp, Homo sapiens
ttgaactttccaaaacct

SEQ ID NO: 2386657 - DNA, 13 bp, Homo sapiens
agttctagagaag

SEQ ID NO: 2386658 - DNA, 22 bp, Homo sapiens
agttctgagtgtttttactaca

SEQ ID NO: 2386659 - DNA, 22 bp, Homo sapiens
agttcttgtctgattggctcac

SEQ ID NO: 2386660 - DNA, 14 bp, Homo sapiens
agtttagaggaaaa

SEQ ID NO: 2386661 - DNA, 17 bp, Homo sapiens
agtttgatattaaagga

SEQ ID NO: 2386662 - DNA, 23 bp, Homo sapiens
ataaacattaagattgaggcctg

SEQ ID NO: 2386663 - DNA, 11 bp, Homo sapiens
ataaagagctc

SEQ ID NO: 2386664 - DNA, 22 bp, Homo sapiens
ataaaggttgacaataaatgtg

SEQ ID NO: 2386665 - DNA, 16 bp, Homo sapiens
ataacttaaaaaaatg

SEQ ID NO: 2386666 - DNA, 15 bp, Homo sapiens
ataatctatttacat

SEQ ID NO: 2386667 - DNA, 17 bp, Homo sapiens
ataattatccagagttt

SEQ ID NO: 2386668 - DNA, 15 bp, Homo sapiens
ataattttatgaatg

SEQ ID NO: 2386669 - DNA, 17 bp, Homo sapiens
caatggtgttgccctga

SEQ ID NO: 2386670 - DNA, 12 bp, Homo sapiens
caattatattgt

SEQ ID NO: 2386671 - DNA, 18 bp, Homo sapiens
cacaatctgggactttca

SEQ ID NO: 2386672 - DNA, 20 bp, Homo sapiens
cacaatctgggactttcact

SEQ ID NO: 2386673 - DNA, 18 bp, Homo sapiens
cacacaaaggtataattt

SEQ ID NO: 2386674 - DNA, 22 bp, Homo sapiens
cacacccggctccccctgcttc

SEQ ID NO: 2386675 - DNA, 20 bp, Homo sapiens
cacacgcaggaactcccagc

SEQ ID NO: 2386676 - DNA, 15 bp, Homo sapiens
cacactggtgactgc

SEQ ID NO: 2386677 - DNA, 21 bp, Homo sapiens
cacacttgggcgctctgccct

SEQ ID NO: 2386678 - DNA, 18 bp, Homo sapiens
cacagaaacacaatattt

SEQ ID NO: 2386679 - DNA, 19 bp, Homo sapiens
cacagcagctgaacagcca

SEQ ID NO: 2386680 - DNA, 21 bp, Homo sapiens
cacatccacacacgcaggaac

SEQ ID NO: 2386681 - DNA, 17 bp, Homo sapiens
cacattcaggaagatga

SEQ ID NO: 2386682 - DNA, 15 bp, Homo sapiens
caccaaggtcttcag

SEQ ID NO: 2386683 - DNA, 21 bp, Homo sapiens
caccaccctcccaccatgcgc

SEQ ID NO: 2386684 - DNA, 21 bp, Homo sapiens
caccaggatggcccttcccac

SEQ ID NO: 2386685 - DNA, 16 bp, Homo sapiens
cacccaagcaaggcca

SEQ ID NO: 2386686 - DNA, 16 bp, Homo sapiens
caccccttatccagga

SEQ ID NO: 2386687 - DNA, 17 bp, Homo sapiens
caccccttatccaggac

SEQ ID NO: 2386688 - DNA, 18 bp, Homo sapiens
cacccggctccccctgct

SEQ ID NO: 2386689 - DNA, 14 bp, Homo sapiens
caccctcccaccat

SEQ ID NO: 2386690 - DNA, 11 bp, Homo sapiens
caccttcccca

SEQ ID NO: 2386691 - DNA, 14 bp, Homo sapiens
caccttccccagac

SEQ ID NO: 2386692 - DNA, 20 bp, Homo sapiens
caccttccccagactcagct

SEQ ID NO: 2386693 - DNA, 17 bp, Homo sapiens
caccttggactcctccc

SEQ ID NO: 2386694 - DNA, 21 bp, Homo sapiens
caccttggactcctcccacaa

SEQ ID NO: 2386695 - DNA, 13 bp, Homo sapiens
cacgcaggaactc

SEQ ID NO: 2386696 - DNA, 15 bp, Homo sapiens
cacgcccagcctcct

SEQ ID NO: 2386697 - DNA, 22 bp, Homo sapiens
cacgcccagcctcctcccacca

SEQ ID NO: 2386698 - DNA, 20 bp, Homo sapiens
cacgcctgtaatcccagcac

SEQ ID NO: 2386699 - DNA, 21 bp, Homo sapiens
cacgcctgtaatcccagcact

SEQ ID NO: 2386700 - DNA, 12 bp, Homo sapiens
cacgtcccatgt

SEQ ID NO: 2386701 - DNA, 20 bp, Homo sapiens
cactccggcctgatgacaga

SEQ ID NO: 2386702 - DNA, 14 bp, Homo sapiens
cactcctcactgcc

SEQ ID NO: 2386703 - DNA, 15 bp, Homo sapiens
cactcctcactgccc

SEQ ID NO: 2386704 - DNA, 13 bp, Homo sapiens
cactctcccctcc

SEQ ID NO: 2386705 - DNA, 16 bp, Homo sapiens
cactctcccctccctc

SEQ ID NO: 2386706 - DNA, 18 bp, Homo sapiens
cactctcccctccctctt

SEQ ID NO: 2386707 - DNA, 15 bp, Homo sapiens
cactgccccaccagc

SEQ ID NO: 2386708 - DNA, 16 bp, Homo sapiens
cactgccccaccagcc

SEQ ID NO: 2386709 - DNA, 22 bp, Homo sapiens
cactgctaggcgagtgccagga

SEQ ID NO: 2386710 - DNA, 20 bp, Homo sapiens
cacttgggcgctctgccctc

SEQ ID NO: 2386711 - DNA, 16 bp, Homo sapiens
cactttaaccctctct

SEQ ID NO: 2386712 - DNA, 15 bp, Homo sapiens
cagaaatatgtggtt

SEQ ID NO: 2386713 - DNA, 12 bp, Homo sapiens
cagaacagcaga

SEQ ID NO: 2386714 - DNA, 19 bp, Homo sapiens
cagaactggacgcccagct

SEQ ID NO: 2386715 - DNA, 15 bp, Homo sapiens
cagaagggagaagga

SEQ ID NO: 2386716 - DNA, 20 bp, Homo sapiens
cagaaggggcacgcctgccc

SEQ ID NO: 2386717 - DNA, 15 bp, Homo sapiens
cagactcagctccag

SEQ ID NO: 2386718 - DNA, 16 bp, Homo sapiens
cagactcagctccaga

SEQ ID NO: 2386719 - DNA, 15 bp, Homo sapiens
cagagaaagaagaga

SEQ ID NO: 2386720 - DNA, 18 bp, Homo sapiens
cagagaaagaagagacag

SEQ ID NO: 2386721 - DNA, 20 bp, Homo sapiens
cagagaaagaagagacagga

SEQ ID NO: 2386722 - DNA, 16 bp, Homo sapiens
cagagaccccttcctt

SEQ ID NO: 2386723 - DNA, 14 bp, Homo sapiens
cagagagaagcctg

SEQ ID NO: 2386724 - DNA, 13 bp, Homo sapiens
cagagcagagagc

SEQ ID NO: 2386725 - DNA, 15 bp, Homo sapiens
cagagccttctcctg

SEQ ID NO: 2386726 - DNA, 19 bp, Homo sapiens
cagagcctttggatgacca

SEQ ID NO: 2386727 - DNA, 17 bp, Homo sapiens
cagaggagtccagggcg

SEQ ID NO: 2386728 - DNA, 20 bp, Homo sapiens
cagaggggtaggcagagcct

SEQ ID NO: 2386729 - DNA, 14 bp, Homo sapiens
cagaggtgagcaga

SEQ ID NO: 2386730 - DNA, 15 bp, Homo sapiens
cagatattttttcag

SEQ ID NO: 2386731 - DNA, 20 bp, Homo sapiens
cagatattttttcagaaata

SEQ ID NO: 2386732 - DNA, 16 bp, Homo sapiens
cagatcctcacaacca

SEQ ID NO: 2386733 - DNA, 14 bp, Homo sapiens
cagatggaaagaaa

SEQ ID NO: 2386734 - DNA, 23 bp, Homo sapiens
cagatgttgaatgcccacaggca

SEQ ID NO: 2386735 - DNA, 19 bp, Homo sapiens
cagcactttaaccctctct

SEQ ID NO: 2386736 - DNA, 21 bp, Homo sapiens
cagcactttaaccctctcttc

SEQ ID NO: 2386737 - DNA, 23 bp, Homo sapiens
cagcactttaaccctctcttccc

SEQ ID NO: 2386738 - DNA, 22 bp, Homo sapiens
cagccaacaggtggcaggacca

SEQ ID NO: 2386739 - DNA, 23 bp, Homo sapiens
cagccaacaggtggcaggaccag

SEQ ID NO: 2386740 - DNA, 21 bp, Homo sapiens
cagccactcgggaggctgaga

SEQ ID NO: 2386741 - DNA, 14 bp, Homo sapiens
cagcccagcctctg

SEQ ID NO: 2386742 - DNA, 22 bp, Homo sapiens
cagcccagcctctgtccctctt

SEQ ID NO: 2386743 - DNA, 19 bp, Homo sapiens
cagccccgggcctgcctct

SEQ ID NO: 2386744 - DNA, 21 bp, Homo sapiens
cagcctcgcatgccagagcct

SEQ ID NO: 2386745 - DNA, 21 bp, Homo sapiens
cagcctctgtccctctttgcc

SEQ ID NO: 2386746 - DNA, 20 bp, Homo sapiens
cagcgagaggcagagaaaga

SEQ ID NO: 2386747 - DNA, 15 bp, Homo sapiens
cagctagggctggac

SEQ ID NO: 2386748 - DNA, 19 bp, Homo sapiens
cagctccagaataccttct

SEQ ID NO: 2386749 - DNA, 23 bp, Homo sapiens
cagctctctctacccggcccaga

SEQ ID NO: 2386750 - DNA, 15 bp, Homo sapiens
caggaactcccagca

SEQ ID NO: 2386751 - DNA, 16 bp, Homo sapiens
caggactatagcccag

SEQ ID NO: 2386752 - DNA, 17 bp, Homo sapiens
caggactatagcccagg

SEQ ID NO: 2386753 - DNA, 17 bp, Homo sapiens
caggactccccaggcca

SEQ ID NO: 2386754 - DNA, 19 bp, Homo sapiens
caggactccccaggccagg

SEQ ID NO: 2386755 - DNA, 17 bp, Homo sapiens
caggagggcaagggcca

SEQ ID NO: 2386756 - DNA, 16 bp, Homo sapiens
caggccaccaggatgg

SEQ ID NO: 2386757 - DNA, 14 bp, Homo sapiens
caggccaggccacc

SEQ ID NO: 2386758 - DNA, 19 bp, Homo sapiens
cagggaaccctgcttgcac

SEQ ID NO: 2386759 - DNA, 17 bp, Homo sapiens
cagggatcttgcattcc

SEQ ID NO: 2386760 - DNA, 16 bp, Homo sapiens
caggggcccacaggga

SEQ ID NO: 2386761 - DNA, 16 bp, Homo sapiens
caggggtctccctgga

SEQ ID NO: 2386762 - DNA, 17 bp, Homo sapiens
caggggtctccctggag

SEQ ID NO: 2386763 - DNA, 19 bp, Homo sapiens
gacaccccttatccaggac

SEQ ID NO: 2386764 - DNA, 21 bp, Homo sapiens
gacaccccttatccaggactc

SEQ ID NO: 2386765 - DNA, 17 bp, Homo sapiens
gacaggagggcaagggc

SEQ ID NO: 2386766 - DNA, 23 bp, Homo sapiens
gaccaggggtgatttcagagagg

SEQ ID NO: 2386767 - DNA, 16 bp, Homo sapiens
gaccataacagccaac

SEQ ID NO: 2386768 - DNA, 15 bp, Homo sapiens
gacccagatcctcac

SEQ ID NO: 2386769 - DNA, 18 bp, Homo sapiens
gaccccaaagagcctgga

SEQ ID NO: 2386770 - DNA, 19 bp, Homo sapiens
gaccccaaagagcctggag

SEQ ID NO: 2386771 - DNA, 23 bp, Homo sapiens
gaccccaaagagcctggagaagc

SEQ ID NO: 2386772 - DNA, 16 bp, Homo sapiens
gaccccagctagggct

SEQ ID NO: 2386773 - DNA, 15 bp, Homo sapiens
gaccctctgaatggt

SEQ ID NO: 2386774 - DNA, 20 bp, Homo sapiens
gaccctctgaatggtccagg

SEQ ID NO: 2386775 - DNA, 23 bp, Homo sapiens
gaccctctgaatggtccagggtt

SEQ ID NO: 2386776 - DNA, 19 bp, Homo sapiens
gaccttgaagggtaaagaa

SEQ ID NO: 2386777 - DNA, 17 bp, Homo sapiens
gactatagcccaggtcc

SEQ ID NO: 2386778 - DNA, 15 bp, Homo sapiens
gactccccaggccag

SEQ ID NO: 2386779 - DNA, 16 bp, Homo sapiens
gactccccaggccagg

SEQ ID NO: 2386780 - DNA, 11 bp, Homo sapiens
gactcctccca

SEQ ID NO: 2386781 - DNA, 14 bp, Homo sapiens
gactgagcacctgc

SEQ ID NO: 2386782 - DNA, 15 bp, Homo sapiens
gactgagcacctgct

SEQ ID NO: 2386783 - DNA, 18 bp, Homo sapiens
gagaaagaagagacagga

SEQ ID NO: 2386784 - DNA, 19 bp, Homo sapiens
gagaaatgaatgctgagac

SEQ ID NO: 2386785 - DNA, 19 bp, Homo sapiens
gagaagggggattggaggg

SEQ ID NO: 2386786 - DNA, 17 bp, Homo sapiens
gagaagtttctggccct

SEQ ID NO: 2386787 - DNA, 21 bp, Homo sapiens
gagaagtttctggccctggct

SEQ ID NO: 2386788 - DNA, 19 bp, Homo sapiens
gagaccccttcctttcctc

SEQ ID NO: 2386789 - DNA, 12 bp, Homo sapiens
gagagccagctc

SEQ ID NO: 2386790 - DNA, 13 bp, Homo sapiens
gagcaagagctgg

SEQ ID NO: 2386791 - DNA, 12 bp, Homo sapiens
gagcacctgctt

SEQ ID NO: 2386792 - DNA, 22 bp, Homo sapiens
gagcatctctgtgtacccactc

SEQ ID NO: 2386793 - DNA, 21 bp, Homo sapiens
gagcattacgtgagccaggta

SEQ ID NO: 2386794 - DNA, 14 bp, Homo sapiens
gagccaacagcagc

SEQ ID NO: 2386795 - DNA, 17 bp, Homo sapiens
gagcccagggcatccca

SEQ ID NO: 2386796 - DNA, 12 bp, Homo sapiens
gagcctggagaa

SEQ ID NO: 2386797 - DNA, 13 bp, Homo sapiens
gagcctggagaag

SEQ ID NO: 2386798 - DNA, 14 bp, Homo sapiens
gagcctggagaagc

SEQ ID NO: 2386799 - DNA, 22 bp, Homo sapiens
gagctgaacccattttgagtga

SEQ ID NO: 2386800 - DNA, 20 bp, Homo sapiens
gaggaaaagtgcaatgcgtg

SEQ ID NO: 2386801 - DNA, 20 bp, Homo sapiens
gaggaggtttggggtctgcc

SEQ ID NO: 2386802 - DNA, 19 bp, Homo sapiens
gaggagtccagggcgggag

SEQ ID NO: 2386803 - DNA, 14 bp, Homo sapiens
gaggcctggccagg

SEQ ID NO: 2386804 - DNA, 15 bp, Homo sapiens
gaggcctggccaggc

SEQ ID NO: 2386805 - DNA, 19 bp, Homo sapiens
gaggcggagagtacagtga

SEQ ID NO: 2386806 - DNA, 14 bp, Homo sapiens
gaggctgagacagg

SEQ ID NO: 2386807 - DNA, 20 bp, Homo sapiens
gaggctggtgctgtggccag

SEQ ID NO: 2386808 - DNA, 18 bp, Homo sapiens
gagggcaagggccatgct

SEQ ID NO: 2386809 - DNA, 20 bp, Homo sapiens
gagggcaaggggtttccaca

SEQ ID NO: 2386810 - DNA, 18 bp, Homo sapiens
gaggtagagtttgaagga

SEQ ID NO: 2386811 - DNA, 23 bp, Homo sapiens
gaggtagagtttgaaggaggtga

SEQ ID NO: 2386812 - DNA, 16 bp, Homo sapiens
gaggtcacattcagga

SEQ ID NO: 2386813 - DNA, 19 bp, Homo sapiens
gaggtcacattcaggaaga

SEQ ID NO: 2386814 - DNA, 18 bp, Homo sapiens
gagtgacggtcccacact

SEQ ID NO: 2386815 - DNA, 15 bp, Homo sapiens
gagtgactcgagggt

SEQ ID NO: 2386816 - DNA, 13 bp, Homo sapiens
gagtgccaggact

SEQ ID NO: 2386817 - DNA, 19 bp, Homo sapiens
gagtgccaggactccccag

SEQ ID NO: 2386818 - DNA, 19 bp, Homo sapiens
gagtggatctccaaggacc

SEQ ID NO: 2386819 - DNA, 19 bp, Homo sapiens
gagttacagcgagaggcag

SEQ ID NO: 2386820 - DNA, 22 bp, Homo sapiens
gagtttgaaggaggtgagggat

SEQ ID NO: 2386821 - DNA, 22 bp, Homo sapiens
gatatttttgtacgttatatat

SEQ ID NO: 2386822 - DNA, 14 bp, Homo sapiens
gatcaagaaagtgt

SEQ ID NO: 2386823 - DNA, 15 bp, Homo sapiens
gatcagaacagcaga

SEQ ID NO: 2386824 - DNA, 18 bp, Homo sapiens
gatcctattctcaccagg

SEQ ID NO: 2386825 - DNA, 19 bp, Homo sapiens
gatcctcacaaccacctaa

SEQ ID NO: 2386826 - DNA, 16 bp, Homo sapiens
gatctagaatgtgttt

SEQ ID NO: 2386827 - DNA, 20 bp, Homo sapiens
gatctagaatgtgttttctg

SEQ ID NO: 2386828 - DNA, 16 bp, Homo sapiens
gatctccaaggaccag

SEQ ID NO: 2386829 - DNA, 15 bp, Homo sapiens
gatctgtccaaggaa

SEQ ID NO: 2386830 - DNA, 14 bp, Homo sapiens
gatgaaagaggagg

SEQ ID NO: 2386831 - DNA, 14 bp, Homo sapiens
gatgtctaatagtt

SEQ ID NO: 2386832 - DNA, 23 bp, Homo sapiens
gatgttacatcacagtgtttgca

SEQ ID NO: 2386833 - DNA, 12 bp, Homo sapiens
gattggctcacc

SEQ ID NO: 2386834 - DNA, 22 bp, Homo sapiens
gattggctcacccaagcaaggc

SEQ ID NO: 2386835 - DNA, 16 bp, Homo sapiens
gatttgaagcaaagca

SEQ ID NO: 2386836 - DNA, 21 bp, Homo sapiens
gattttaaattcacaatagaa

SEQ ID NO: 2386837 - DNA, 19 bp, Homo sapiens
gcaaagggctgaaagccat

SEQ ID NO: 2386838 - DNA, 18 bp, Homo sapiens
gcaaaggtggctctccag

SEQ ID NO: 2386839 - DNA, 20 bp, Homo sapiens
gcaagagaacatttctagaa

SEQ ID NO: 2386840 - DNA, 20 bp, Homo sapiens
gcaagcatttatgtttattt

SEQ ID NO: 2386841 - DNA, 22 bp, Homo sapiens
gcaaggactacgttaagggaag

SEQ ID NO: 2386842 - DNA, 17 bp, Homo sapiens
gcaagttctagagaaga

SEQ ID NO: 2386843 - DNA, 18 bp, Homo sapiens
gcaatgcgtgttgtacat

SEQ ID NO: 2386844 - DNA, 23 bp, Homo sapiens
gcaatggtgttgccctgagtgga

SEQ ID NO: 2386845 - DNA, 14 bp, Homo sapiens
gcaattatattgtc

SEQ ID NO: 2386846 - DNA, 15 bp, Homo sapiens
gcaattgcttaggat

SEQ ID NO: 2386847 - DNA, 18 bp, Homo sapiens
gcaccccctcattcccct

SEQ ID NO: 2386848 - DNA, 20 bp, Homo sapiens
gcaccccctcattcccctcg

SEQ ID NO: 2386849 - DNA, 18 bp, Homo sapiens
  misc_feature (9)..(9): n is a, c, g or t
gcacctgcnttgtccctg

SEQ ID NO: 2386850 - DNA, 12 bp, Homo sapiens
gcacgcctgccc

SEQ ID NO: 2386851 - DNA, 16 bp, Homo sapiens
gcacgcctgcccagcc

SEQ ID NO: 2386852 - DNA, 17 bp, Homo sapiens
gcactcacccatgtgcc

SEQ ID NO: 2386853 - DNA, 20 bp, Homo sapiens
gcactgctaggcgagtgcca

SEQ ID NO: 2386854 - DNA, 22 bp, Homo sapiens
gcactgctaggcgagtgccagg

SEQ ID NO: 2386855 - DNA, 16 bp, Homo sapiens
gcactttaaccctctc

SEQ ID NO: 2386856 - DNA, 22 bp, Homo sapiens
gcactttaaccctctcttccct

SEQ ID NO: 2386857 - DNA, 13 bp, Homo sapiens
gcagaagggagaa

SEQ ID NO: 2386858 - DNA, 15 bp, Homo sapiens
gcagagaaagaagag

SEQ ID NO: 2386859 - DNA, 22 bp, Homo sapiens
gcagagaaagaagagacaggag

SEQ ID NO: 2386860 - DNA, 13 bp, Homo sapiens
gcagaggtaaaag

SEQ ID NO: 2386861 - DNA, 16 bp, Homo sapiens
gcagaggtgagcagag

SEQ ID NO: 2386862 - DNA, 18 bp, Homo sapiens
gcagaggtgagcagagga

SEQ ID NO: 2386863 - DNA, 18 bp, Homo sapiens
gcagcactttaaccctct

SEQ ID NO: 2386864 - DNA, 13 bp, Homo sapiens
gcaggaccaggac

SEQ ID NO: 2386865 - DNA, 15 bp, Homo sapiens
gcaggaccaggacta

SEQ ID NO: 2386866 - DNA, 19 bp, Homo sapiens
gcaggggtccttggtgtga

SEQ ID NO: 2386867 - DNA, 16 bp, Homo sapiens
gcaggggtctgagcca

SEQ ID NO: 2386868 - DNA, 13 bp, Homo sapiens
gcaggggttccca

SEQ ID NO: 2386869 - DNA, 15 bp, Homo sapiens
gcaggtggtcctgag

SEQ ID NO: 2386870 - DNA, 16 bp, Homo sapiens
gcaggtggtcctgaga

SEQ ID NO: 2386871 - DNA, 19 bp, Homo sapiens
gcagtgagttacagcgaga

SEQ ID NO: 2386872 - DNA, 20 bp, Homo sapiens
gcagtgagttacagcgagag

SEQ ID NO: 2386873 - DNA, 17 bp, Homo sapiens
gcagttgacagcaggtg

SEQ ID NO: 2386874 - DNA, 21 bp, Homo sapiens
gcatcccatgggggtgctgca

SEQ ID NO: 2386875 - DNA, 20 bp, Homo sapiens
gcatctgggattcccaccaa

SEQ ID NO: 2386876 - DNA, 23 bp, Homo sapiens
gcatctgggattcccaccaaggt

SEQ ID NO: 2386877 - DNA, 20 bp, Homo sapiens
gcatgatgttaaccagaata

SEQ ID NO: 2386878 - DNA, 13 bp, Homo sapiens
gcattcccagtgg

SEQ ID NO: 2386879 - DNA, 16 bp, Homo sapiens
gcattgaatatattat

SEQ ID NO: 2386880 - DNA, 19 bp, Homo sapiens
gccaacaggtggcaggacc

SEQ ID NO: 2386881 - DNA, 20 bp, Homo sapiens
gccacacccggctccccctg

SEQ ID NO: 2386882 - DNA, 14 bp, Homo sapiens
gccaccatcctgct

SEQ ID NO: 2386883 - DNA, 15 bp, Homo sapiens
gccaccatcctgctg

SEQ ID NO: 2386884 - DNA, 23 bp, Homo sapiens
gccactctcccctccctcttcct

SEQ ID NO: 2386885 - DNA, 23 bp, Homo sapiens
gccagaaggggcacgcctgccca

SEQ ID NO: 2386886 - DNA, 10 bp, Homo sapiens
gccagctctc

SEQ ID NO: 2386887 - DNA, 17 bp, Homo sapiens
gccagctctctctaccc

SEQ ID NO: 2386888 - DNA, 17 bp, Homo sapiens
gccaggactccccaggc

SEQ ID NO: 2386889 - DNA, 21 bp, Homo sapiens
gccaggactccccaggccagg

SEQ ID NO: 2386890 - DNA, 22 bp, Homo sapiens
gccaggactccccaggccaggc

SEQ ID NO: 2386891 - DNA, 19 bp, Homo sapiens
gccaggcaccccctggaga

SEQ ID NO: 2386892 - DNA, 22 bp, Homo sapiens
gccaggcaggggtgggagagcc

SEQ ID NO: 2386893 - DNA, 16 bp, Homo sapiens
gccagggtgagagctg

SEQ ID NO: 2386894 - DNA, 17 bp, Homo sapiens
gccagggtgagagctgc

SEQ ID NO: 2386895 - DNA, 13 bp, Homo sapiens
gccatcagggtgg

SEQ ID NO: 2386896 - DNA, 24 bp, Homo sapiens
gccatcagggtgggccactctccc

SEQ ID NO: 2386897 - DNA, 15 bp, Homo sapiens
gccatgctgaaggga

SEQ ID NO: 2386898 - DNA, 17 bp, Homo sapiens
gcccagagaccccttcc

SEQ ID NO: 2386899 - DNA, 17 bp, Homo sapiens
gcccagcctcctcccac

SEQ ID NO: 2386900 - DNA, 16 bp, Homo sapiens
gcccagctgaggctgg

SEQ ID NO: 2386901 - DNA, 19 bp, Homo sapiens
gcccaggggcccacaggga

SEQ ID NO: 2386902 - DNA, 15 bp, Homo sapiens
gcccaggtcctctga

SEQ ID NO: 2386903 - DNA, 16 bp, Homo sapiens
gccccaccagccacct

SEQ ID NO: 2386904 - DNA, 23 bp, Homo sapiens
gccccaccagccacctcttgggc

SEQ ID NO: 2386905 - DNA, 14 bp, Homo sapiens
gccccgggcctgcc

SEQ ID NO: 2386906 - DNA, 15 bp, Homo sapiens
gccccgggcctgcct

SEQ ID NO: 2386907 - DNA, 18 bp, Homo sapiens
gccccgggcctgcctctg

SEQ ID NO: 2386908 - DNA, 14 bp, Homo sapiens
gccctccctggcct

SEQ ID NO: 2386909 - DNA, 21 bp, Homo sapiens
gccctgagtggatctccaagg

SEQ ID NO: 2386910 - DNA, 16 bp, Homo sapiens
gcccttcacagtgttt

SEQ ID NO: 2386911 - DNA, 14 bp, Homo sapiens
gccgtgcccagggg

SEQ ID NO: 2386912 - DNA, 23 bp, Homo sapiens
gccgtgctcgcccacaaactgat

SEQ ID NO: 2386913 - DNA, 20 bp, Homo sapiens
gccgtggccatcagggtggg

SEQ ID NO: 2386914 - DNA, 19 bp, Homo sapiens
gcctacattccctggcctg

SEQ ID NO: 2386915 - DNA, 21 bp, Homo sapiens
gcctacattccctggcctggc

SEQ ID NO: 2386916 - DNA, 17 bp, Homo sapiens
gcctcaatgtgaccagg

SEQ ID NO: 2386917 - DNA, 16 bp, Homo sapiens
gcctcacgcccagcct

SEQ ID NO: 2386918 - DNA, 13 bp, Homo sapiens
gcctcctcccacc

SEQ ID NO: 2386919 - DNA, 13 bp, Homo sapiens
gcctctgtccctc

SEQ ID NO: 2386920 - DNA, 14 bp, Homo sapiens
gcctgcagagagaa

SEQ ID NO: 2386921 - DNA, 17 bp, Homo sapiens
gcctgcagagagaagcc

SEQ ID NO: 2386922 - DNA, 12 bp, Homo sapiens
gcctggccaggc

SEQ ID NO: 2386923 - DNA, 15 bp, Homo sapiens
gcgagaggcagagaa

SEQ ID NO: 2386924 - DNA, 20 bp, Homo sapiens
gcgctctgccctccctggcc

SEQ ID NO: 2386925 - DNA, 18 bp, Homo sapiens
gcgctgctcaacctctct

SEQ ID NO: 2386926 - DNA, 15 bp, Homo sapiens
gcgctttctggaaaa

SEQ ID NO: 2386927 - DNA, 16 bp, Homo sapiens
gcggagagtacagtga

SEQ ID NO: 2386928 - DNA, 22 bp, Homo sapiens
gcggagagtacagtgagccaag

SEQ ID NO: 2386929 - DNA, 13 bp, Homo sapiens
gctagagaagggg

SEQ ID NO: 2386930 - DNA, 18 bp, Homo sapiens
gctaggcgagtgccagga

SEQ ID NO: 2386931 - DNA, 16 bp, Homo sapiens
gctcagccctgactgg

SEQ ID NO: 2386932 - DNA, 19 bp, Homo sapiens
gctcagccctgactggtgc

SEQ ID NO: 2386933 - DNA, 12 bp, Homo sapiens
gctccccctgct

SEQ ID NO: 2386934 - DNA, 17 bp, Homo sapiens
gctccccctgcttctca

SEQ ID NO: 2386935 - DNA, 12 bp, Homo sapiens
gctctcctgggg

SEQ ID NO: 2386936 - DNA, 19 bp, Homo sapiens
gctctgccctccctggcct

SEQ ID NO: 2386937 - DNA, 21 bp, Homo sapiens
gctctggaaaatgtgacccag

SEQ ID NO: 2386938 - DNA, 12 bp, Homo sapiens
gctctttcaggg

SEQ ID NO: 2386939 - DNA, 20 bp, Homo sapiens
gctctttggggtcagccagg

SEQ ID NO: 2386940 - DNA, 21 bp, Homo sapiens
gctctttggggtcagccaggg

SEQ ID NO: 2386941 - DNA, 15 bp, Homo sapiens
gctgagacaggagaa

SEQ ID NO: 2386942 - DNA, 21 bp, Homo sapiens
gctgaggggggccgtgcccag

SEQ ID NO: 2386943 - DNA, 23 bp, Homo sapiens
gctgaggggggccgtgcccaggg

SEQ ID NO: 2386944 - DNA, 14 bp, Homo sapiens
gctgctagagaagg

SEQ ID NO: 2386945 - DNA, 16 bp, Homo sapiens
gctggactctggcacc

SEQ ID NO: 2386946 - DNA, 12 bp, Homo sapiens
gctggagaagct

SEQ ID NO: 2386947 - DNA, 20 bp, Homo sapiens
gctgggggcgggggagccaa

SEQ ID NO: 2386948 - DNA, 17 bp, Homo sapiens
gctggtgctgtggccag

SEQ ID NO: 2386949 - DNA, 19 bp, Homo sapiens
gctggtgctgtggccaggg

SEQ ID NO: 2386950 - DNA, 18 bp, Homo sapiens
gctgtcataagaatgaat

SEQ ID NO: 2386951 - DNA, 13 bp, Homo sapiens
gctgtggccaggg

SEQ ID NO: 2386952 - DNA, 21 bp, Homo sapiens
gctgtggccagggtgagagct

SEQ ID NO: 2386953 - DNA, 23 bp, Homo sapiens
gcttaaggagaggagaaactgag

SEQ ID NO: 2386954 - DNA, 22 bp, Homo sapiens
gcttctcagccccgggcctgcc

SEQ ID NO: 2386955 - DNA, 12 bp, Homo sapiens
gcttctccaggc

SEQ ID NO: 2386956 - DNA, 19 bp, Homo sapiens
gcttgcactttgtaacatg

SEQ ID NO: 2386957 - DNA, 18 bp, Homo sapiens
ggaaaagaatacagaaag

SEQ ID NO: 2386958 - DNA, 22 bp, Homo sapiens
ggaaaagaatccctgcagcctg

SEQ ID NO: 2386959 - DNA, 22 bp, Homo sapiens
ggaaacaccgagtctctgtata

SEQ ID NO: 2386960 - DNA, 22 bp, Homo sapiens
ggaaagaaagcacctgttttta

SEQ ID NO: 2386961 - DNA, 22 bp, Homo sapiens
ggaactagagggatacactgaa

SEQ ID NO: 2386962 - DNA, 13 bp, Homo sapiens
ggaagacaggtct

SEQ ID NO: 2386963 - DNA, 19 bp, Homo sapiens
ggaagacaggtctagactt

SEQ ID NO: 2386964 - DNA, 16 bp, Homo sapiens
ggaagctgggggaagg

SEQ ID NO: 2386965 - DNA, 17 bp, Homo sapiens
ggaaggaactctggctt

SEQ ID NO: 2386966 - DNA, 23 bp, Homo sapiens
ggaaggaactctggcttccaggt

SEQ ID NO: 2386967 - DNA, 13 bp, Homo sapiens
ggaaggagtgaga

SEQ ID NO: 2386968 - DNA, 16 bp, Homo sapiens
ggaagggggtccaccc

SEQ ID NO: 2386969 - DNA, 18 bp, Homo sapiens
ggaaggtttgtatattgt

SEQ ID NO: 2386970 - DNA, 12 bp, Homo sapiens
ggaatacagtgt

SEQ ID NO: 2386971 - DNA, 21 bp, Homo sapiens
ggaccaggactatagcccagg

SEQ ID NO: 2386972 - DNA, 15 bp, Homo sapiens
ggactatagcccagg

SEQ ID NO: 2386973 - DNA, 12 bp, Homo sapiens
ggactcctccca

SEQ ID NO: 2386974 - DNA, 13 bp, Homo sapiens
ggactcctcccac

SEQ ID NO: 2386975 - DNA, 18 bp, Homo sapiens
ggactggaaccagggaga

SEQ ID NO: 2386976 - DNA, 14 bp, Homo sapiens
ggagagccagctct

SEQ ID NO: 2386977 - DNA, 19 bp, Homo sapiens
ggagagccagctctctcta

SEQ ID NO: 2386978 - DNA, 19 bp, Homo sapiens
ggagcaggggtctgagcca

SEQ ID NO: 2386979 - DNA, 14 bp, Homo sapiens
ggaggctgagacag

SEQ ID NO: 2386980 - DNA, 19 bp, Homo sapiens
ggaggctgagacaggagaa

SEQ ID NO: 2386981 - DNA, 22 bp, Homo sapiens
ggagggtcgccacacccggctc

SEQ ID NO: 2386982 - DNA, 20 bp, Homo sapiens
ggaggtcacattcaggaaga

SEQ ID NO: 2386983 - DNA, 15 bp, Homo sapiens
ggagttccatgaaga

SEQ ID NO: 2386984 - DNA, 20 bp, Homo sapiens
ggatcctattctcaccagga

SEQ ID NO: 2386985 - DNA, 13 bp, Homo sapiens
tctggaaaagagg

SEQ ID NO: 2386986 - DNA, 15 bp, Homo sapiens
tctggctgagctgaa

SEQ ID NO: 2386987 - DNA, 13 bp, Homo sapiens
tctggcttccagg

SEQ ID NO: 2386988 - DNA, 17 bp, Homo sapiens
tctgtataatctattta

SEQ ID NO: 2386989 - DNA, 13 bp, Homo sapiens
tctgtccaaggaa

SEQ ID NO: 2386990 - DNA, 12 bp, Homo sapiens
tctgtccctctt

SEQ ID NO: 2386991 - DNA, 15 bp, Homo sapiens
tctgtccctctttgc

SEQ ID NO: 2386992 - DNA, 15 bp, Homo sapiens
tcttccaaaggcata

SEQ ID NO: 2386993 - DNA, 13 bp, Homo sapiens
tcttccttccccc

SEQ ID NO: 2386994 - DNA, 23 bp, Homo sapiens
tcttgtcccctcttgacccatct

SEQ ID NO: 2386995 - DNA, 20 bp, Homo sapiens
tctttcaggggggttgtgag

SEQ ID NO: 2386996 - DNA, 14 bp, Homo sapiens
tctttgcctgtgtg

SEQ ID NO: 2386997 - DNA, 21 bp, Homo sapiens
tcttttgcccttcacagtgtt

SEQ ID NO: 2386998 - DNA, 16 bp, Homo sapiens
tgaaatctcagaattc

SEQ ID NO: 2386999 - DNA, 18 bp, Homo sapiens
tgaacactggcaacaaca

SEQ ID NO: 2387000 - DNA, 16 bp, Homo sapiens
tgaactaataaaagca

SEQ ID NO: 2387001 - DNA, 17 bp, Homo sapiens
tgaactttccaaaacct

SEQ ID NO: 2387002 - DNA, 17 bp, Homo sapiens
tgaagaaaactccttta

SEQ ID NO: 2387003 - DNA, 18 bp, Homo sapiens
tgaagcaaagcaccagct

SEQ ID NO: 2387004 - DNA, 17 bp, Homo sapiens
tgaaggaggtgagggat

SEQ ID NO: 2387005 - DNA, 18 bp, Homo sapiens
tgaagggaaaggatattt

SEQ ID NO: 2387006 - DNA, 20 bp, Homo sapiens
tgaagggaccttgaagggta

SEQ ID NO: 2387007 - DNA, 14 bp, Homo sapiens
tgaagttaacagag

SEQ ID NO: 2387008 - DNA, 15 bp, Homo sapiens
tgacaagcactgcta

SEQ ID NO: 2387009 - DNA, 19 bp, Homo sapiens
tgaccccaaagagcctgga

SEQ ID NO: 2387010 - DNA, 22 bp, Homo sapiens
tgaccccaaagagcctggagaa

SEQ ID NO: 2387011 - DNA, 15 bp, Homo sapiens
tgagaattccaagga

SEQ ID NO: 2387012 - DNA, 19 bp, Homo sapiens
tgagaatttaaaaataaga

SEQ ID NO: 2387013 - DNA, 19 bp, Homo sapiens
tgagagctgctctggaaaa

SEQ ID NO: 2387014 - DNA, 15 bp, Homo sapiens
tgagcatctctgtgt

SEQ ID NO: 2387015 - DNA, 16 bp, Homo sapiens
tgagcatctctgtgta

SEQ ID NO: 2387016 - DNA, 20 bp, Homo sapiens
tgagccaggtaatgagggac

SEQ ID NO: 2387017 - DNA, 21 bp, Homo sapiens
tgagccaggtaatgagggact

SEQ ID NO: 2387018 - DNA, 22 bp, Homo sapiens
tgaggccaaacgttttgaacta

SEQ ID NO: 2387019 - DNA, 19 bp, Homo sapiens
tgaggcctgccctcaggga

SEQ ID NO: 2387020 - DNA, 21 bp, Homo sapiens
tgaggctgggggcgggggagc

SEQ ID NO: 2387021 - DNA, 18 bp, Homo sapiens
tgagggactggaaccagg

SEQ ID NO: 2387022 - DNA, 18 bp, Homo sapiens
tgagttttattgagaatt

SEQ ID NO: 2387023 - DNA, 16 bp, Homo sapiens
tgataaggatcagaac

SEQ ID NO: 2387024 - DNA, 13 bp, Homo sapiens
tgatacccagagc

SEQ ID NO: 2387025 - DNA, 16 bp, Homo sapiens
tgatattaaaggagtt

SEQ ID NO: 2387026 - DNA, 15 bp, Homo sapiens
tgatcacactctggg

SEQ ID NO: 2387027 - DNA, 15 bp, Homo sapiens
tgatgacagagcgag

SEQ ID NO: 2387028 - DNA, 10 bp, Homo sapiens
tgatgttaac

SEQ ID NO: 2387029 - DNA, 12 bp, Homo sapiens
tgattggctcac

SEQ ID NO: 2387030 - DNA, 15 bp, Homo sapiens
tgcaattgcttagga

SEQ ID NO: 2387031 - DNA, 15 bp, Homo sapiens
tgcacccaggggtgg

SEQ ID NO: 2387032 - DNA, 18 bp, Homo sapiens
tgcagaggatttaactgt

SEQ ID NO: 2387033 - DNA, 16 bp, Homo sapiens
tgcagaggtgagcaga

SEQ ID NO: 2387034 - DNA, 20 bp, Homo sapiens
tgcagcactttaaccctctc

SEQ ID NO: 2387035 - DNA, 15 bp, Homo sapiens
tgcagcctggtagaa

SEQ ID NO: 2387036 - DNA, 17 bp, Homo sapiens
tgcagttgacagcaggt

SEQ ID NO: 2387037 - DNA, 18 bp, Homo sapiens
tgcatggaaatgtcctcc

SEQ ID NO: 2387038 - DNA, 14 bp, Homo sapiens
tgcattagaaatta

SEQ ID NO: 2387039 - DNA, 22 bp, Homo sapiens
tgccaggactccccaggccagg

SEQ ID NO: 2387040 - DNA, 23 bp, Homo sapiens
tgccaggactccccaggccaggc

SEQ ID NO: 2387041 - DNA, 17 bp, Homo sapiens
tgccccaccagccacct

SEQ ID NO: 2387042 - DNA, 14 bp, Homo sapiens
tgccctccctggcc

SEQ ID NO: 2387043 - DNA, 22 bp, Homo sapiens
tgccctgagtggatctccaagg

SEQ ID NO: 2387044 - DNA, 17 bp, Homo sapiens
tgcccttcacagtgttt

SEQ ID NO: 2387045 - DNA, 16 bp, Homo sapiens
tgcctgcagagagaag

SEQ ID NO: 2387046 - DNA, 18 bp, Homo sapiens
tgcctgcagagagaagcc

SEQ ID NO: 2387047 - DNA, 15 bp, Homo sapiens
tgcctgtgtgagcat

SEQ ID NO: 2387048 - DNA, 17 bp, Homo sapiens
tgcctgtgtgagcatct

SEQ ID NO: 2387049 - DNA, 21 bp, Homo sapiens
tgcggtggctcacgcctgtaa

SEQ ID NO: 2387050 - DNA, 19 bp, Homo sapiens
tgctaggcgagtgccagga

SEQ ID NO: 2387051 - DNA, 19 bp, Homo sapiens
tgctataggctggagaagc

SEQ ID NO: 2387052 - DNA, 23 bp, Homo sapiens
tgctataggctggagaagctcac

SEQ ID NO: 2387053 - DNA, 23 bp, Homo sapiens
tgctcaacctctctccttctggc

SEQ ID NO: 2387054 - DNA, 13 bp, Homo sapiens
tgctcagccctga

SEQ ID NO: 2387055 - DNA, 22 bp, Homo sapiens
tgctcagccctgactggtgcta

SEQ ID NO: 2387056 - DNA, 19 bp, Homo sapiens
tgctcagcccttcctagaa

SEQ ID NO: 2387057 - DNA, 19 bp, Homo sapiens
tgctcgcccacaaactgat

SEQ ID NO: 2387058 - DNA, 13 bp, Homo sapiens
tgctgaagggacc

SEQ ID NO: 2387059 - DNA, 22 bp, Homo sapiens
tgctgaagggaccttgaagggt

SEQ ID NO: 2387060 - DNA, 23 bp, Homo sapiens
tgctgcagccaggaggagaggaa

SEQ ID NO: 2387061 - DNA, 12 bp, Homo sapiens
tgctgtggccag

SEQ ID NO: 2387062 - DNA, 17 bp, Homo sapiens
tgcttcaaatccatcca

SEQ ID NO: 2387063 - DNA, 21 bp, Homo sapiens
tgcttctcagccccgggcctg

SEQ ID NO: 2387064 - DNA, 18 bp, Homo sapiens
tggaaaagaatccctgca

SEQ ID NO: 2387065 - DNA, 20 bp, Homo sapiens
tggaaggtttggtgtgtgga

SEQ ID NO: 2387066 - DNA, 15 bp, Homo sapiens
tggaatacagtgtta

SEQ ID NO: 2387067 - DNA, 11 bp, Homo sapiens
tggacaaccca

SEQ ID NO: 2387068 - DNA, 14 bp, Homo sapiens
tggagatgcagagg

SEQ ID NO: 2387069 - DNA, 21 bp, Homo sapiens
tggatctccaaggaccaggtt

SEQ ID NO: 2387070 - DNA, 18 bp, Homo sapiens
tggatctgtccaaggaaa

SEQ ID NO: 2387071 - DNA, 20 bp, Homo sapiens
tggatgaccagaacaaggtt

SEQ ID NO: 2387072 - DNA, 17 bp, Homo sapiens
tggcaggaccaggacta

SEQ ID NO: 2387073 - DNA, 17 bp, Homo sapiens
tggccagggtgagagct

SEQ ID NO: 2387074 - DNA, 18 bp, Homo sapiens
tggccgggtgcggtggct

SEQ ID NO: 2387075 - DNA, 15 bp, Homo sapiens
tggctaattcccaga

SEQ ID NO: 2387076 - DNA, 20 bp, Homo sapiens
tggctgaccccaaagagcct

SEQ ID NO: 2387077 - DNA, 21 bp, Homo sapiens
tggctgaccccaaagagcctg

SEQ ID NO: 2387078 - DNA, 15 bp, Homo sapiens
tggcttccaggtatc

SEQ ID NO: 2387079 - DNA, 21 bp, Homo sapiens
tggcttccaggtatctccagg

SEQ ID NO: 2387080 - DNA, 23 bp, Homo sapiens
tggctttctccgactgctaggga

SEQ ID NO: 2387081 - DNA, 17 bp, Homo sapiens
tgggaaataagagagaa

SEQ ID NO: 2387082 - DNA, 22 bp, Homo sapiens
tgggaaatggtatgagctgagg

SEQ ID NO: 2387083 - DNA, 23 bp, Homo sapiens
tgggacaaaccagagcagagagc

SEQ ID NO: 2387084 - DNA, 14 bp, Homo sapiens
tgggagagccagct

SEQ ID NO: 2387085 - DNA, 16 bp, Homo sapiens
tgggagagccagctct

SEQ ID NO: 2387086 - DNA, 22 bp, Homo sapiens
tgggaggcggagagtacagtga

SEQ ID NO: 2387087 - DNA, 15 bp, Homo sapiens
tgggcagaagggaga

SEQ ID NO: 2387088 - DNA, 14 bp, Homo sapiens
tgggccactctccc

SEQ ID NO: 2387089 - DNA, 15 bp, Homo sapiens
tgggccactctcccc

SEQ ID NO: 2387090 - DNA, 13 bp, Homo sapiens
tgggcgctctgcc

SEQ ID NO: 2387091 - DNA, 21 bp, Homo sapiens
tggggtcagccagggccaggg

SEQ ID NO: 2387092 - DNA, 15 bp, Homo sapiens
tgggtctggctgagc

SEQ ID NO: 2387093 - DNA, 17 bp, Homo sapiens
tgggtctggctgagctg

SEQ ID NO: 2387094 - DNA, 17 bp, Homo sapiens
gaactttccaaaaccta

SEQ ID NO: 2387095 - DNA, 22 bp, Homo sapiens
gaagaaaactcctttagcaggt

SEQ ID NO: 2387096 - DNA, 18 bp, Homo sapiens
gaagagacaggagggcaa

SEQ ID NO: 2387097 - DNA, 16 bp, Homo sapiens
gaagaggctggtgctg

SEQ ID NO: 2387098 - DNA, 17 bp, Homo sapiens
gaagatgaaagaggagg

SEQ ID NO: 2387099 - DNA, 14 bp, Homo sapiens
gaagcacatgttta

SEQ ID NO: 2387100 - DNA, 17 bp, Homo sapiens
gaagggaccttgaaggg

SEQ ID NO: 2387101 - DNA, 18 bp, Homo sapiens
gaagggaccttgaagggt

SEQ ID NO: 2387102 - DNA, 20 bp, Homo sapiens
gaagggaccttgaagggtaa

SEQ ID NO: 2387103 - DNA, 22 bp, Homo sapiens
gaaggggcacgcctgcccagcc

SEQ ID NO: 2387104 - DNA, 18 bp, Homo sapiens
gaagggggtccacccagc

SEQ ID NO: 2387105 - DNA, 19 bp, Homo sapiens
gaagggtggtctgagcacc

SEQ ID NO: 2387106 - DNA, 15 bp, Homo sapiens
gaagttaacagagac

SEQ ID NO: 2387107 - DNA, 20 bp, Homo sapiens
gaataaagttctgagtgttt

SEQ ID NO: 2387108 - DNA, 13 bp, Homo sapiens
gaatcaaaactct

SEQ ID NO: 2387109 - DNA, 13 bp, Homo sapiens
gaatcagaaacag

SEQ ID NO: 2387110 - DNA, 17 bp, Homo sapiens
gaatgcccacaggcaaa

SEQ ID NO: 2387111 - DNA, 20 bp, Homo sapiens
gaatgcctcaatgtgaccag

SEQ ID NO: 2387112 - DNA, 21 bp, Homo sapiens
gaatgcctcaatgtgaccagg

SEQ ID NO: 2387113 - DNA, 22 bp, Homo sapiens
gaatgcctcaatgtgaccaggg

SEQ ID NO: 2387114 - DNA, 13 bp, Homo sapiens
gaatggtccaggg

SEQ ID NO: 2387115 - DNA, 12 bp, Homo sapiens
gaatgtctcagc

SEQ ID NO: 2387116 - DNA, 22 bp, Homo sapiens
gaattgcctgcagagagaagcc

SEQ ID NO: 2387117 - DNA, 16 bp, Homo sapiens
gaattgggaagctggg

SEQ ID NO: 2387118 - DNA, 11 bp, Homo sapiens
gacaacccaga

SEQ ID NO: 2387119 - DNA, 17 bp, Homo sapiens
gacaccccttatccagg

SEQ ID NO: 2387120 - DNA, 17 bp, Homo sapiens
ggtggcaggaccaggac

SEQ ID NO: 2387121 - DNA, 18 bp, Homo sapiens
ggtggcaggaccaggact

SEQ ID NO: 2387122 - DNA, 12 bp, Homo sapiens
ggtgggccactc

SEQ ID NO: 2387123 - DNA, 13 bp, Homo sapiens
ggtggggaatgtt

SEQ ID NO: 2387124 - DNA, 15 bp, Homo sapiens
ggttcatctgagcaa

SEQ ID NO: 2387125 - DNA, 23 bp, Homo sapiens
ggttcccattttcgctttcctct

SEQ ID NO: 2387126 - DNA, 16 bp, Homo sapiens
ggttccctctgagaat

SEQ ID NO: 2387127 - DNA, 17 bp, Homo sapiens
ggttctttggaaggagt

SEQ ID NO: 2387128 - DNA, 14 bp, Homo sapiens
ggttgtgaggcctg

SEQ ID NO: 2387129 - DNA, 11 bp, Homo sapiens
gtaaatattta

SEQ ID NO: 2387130 - DNA, 19 bp, Homo sapiens
gtaactatcaatatttaag

SEQ ID NO: 2387131 - DNA, 11 bp, Homo sapiens
gtaacttcaaa

SEQ ID NO: 2387132 - DNA, 17 bp, Homo sapiens
gtaagctctggctttct

SEQ ID NO: 2387133 - DNA, 14 bp, Homo sapiens
gtaatgagggactg

SEQ ID NO: 2387134 - DNA, 15 bp, Homo sapiens
gtaatgagggactgg

SEQ ID NO: 2387135 - DNA, 15 bp, Homo sapiens
gtacccactcctcac

SEQ ID NO: 2387136 - DNA, 21 bp, Homo sapiens
gtacccactcctcactgcccc

SEQ ID NO: 2387137 - DNA, 18 bp, Homo sapiens
gtagaattgggaagctgg

SEQ ID NO: 2387138 - DNA, 14 bp, Homo sapiens
gtaggcagagcctt

SEQ ID NO: 2387139 - DNA, 14 bp, Homo sapiens
gtataatctattta

SEQ ID NO: 2387140 - DNA, 22 bp, Homo sapiens
gtcaatttccctgactcctcta

SEQ ID NO: 2387141 - DNA, 14 bp, Homo sapiens
gtcacattcaggaa

SEQ ID NO: 2387142 - DNA, 20 bp, Homo sapiens
gtcactcttcctgcaaggac

SEQ ID NO: 2387143 - DNA, 11 bp, Homo sapiens
gtcagccaggg

SEQ ID NO: 2387144 - DNA, 11 bp, Homo sapiens
gtccacccagc

SEQ ID NO: 2387145 - DNA, 17 bp, Homo sapiens
gtccagggcgggagtgg

SEQ ID NO: 2387146 - DNA, 16 bp, Homo sapiens
gtcccatgtgcatgga

SEQ ID NO: 2387147 - DNA, 22 bp, Homo sapiens
gtcctccaacaataaagagctc

SEQ ID NO: 2387148 - DNA, 23 bp, Homo sapiens
gtcctccaacaataaagagctca

SEQ ID NO: 2387149 - DNA, 14 bp, Homo sapiens
gtccttggtgtgac

SEQ ID NO: 2387150 - DNA, 17 bp, Homo sapiens
gtcgctggacaacccag

SEQ ID NO: 2387151 - DNA, 19 bp, Homo sapiens
gtcgctggacaacccagaa

SEQ ID NO: 2387152 - DNA, 16 bp, Homo sapiens
gtctccctggagtgca

SEQ ID NO: 2387153 - DNA, 17 bp, Homo sapiens
gtctctgtataatctat

SEQ ID NO: 2387154 - DNA, 20 bp, Homo sapiens
gtctctgtataatctattta

SEQ ID NO: 2387155 - DNA, 16 bp, Homo sapiens
ctgagcaccccctcat

SEQ ID NO: 2387156 - DNA, 16 bp, Homo sapiens
ctgagcacctgcttca

SEQ ID NO: 2387157 - DNA, 23 bp, Homo sapiens
ctgagcacctgcttcatgctcag

SEQ ID NO: 2387158 - DNA, 18 bp, Homo sapiens
ctgagccacagccgtgct

SEQ ID NO: 2387159 - DNA, 22 bp, Homo sapiens
ctgaggctgggggcgggggagc

SEQ ID NO: 2387160 - DNA, 21 bp, Homo sapiens
ctgaggggggccgtgcccagg

SEQ ID NO: 2387161 - DNA, 18 bp, Homo sapiens
ctgagtggatctccaagg

SEQ ID NO: 2387162 - DNA, 16 bp, Homo sapiens
ctgatgacagagcgag

SEQ ID NO: 2387163 - DNA, 16 bp, Homo sapiens
ctgattggctcaccca

SEQ ID NO: 2387164 - DNA, 16 bp, Homo sapiens
ctgcaattgcttagga

SEQ ID NO: 2387165 - DNA, 21 bp, Homo sapiens
ctgcatctgggattcccacca

SEQ ID NO: 2387166 - DNA, 12 bp, Homo sapiens
ctgcccagcctc

SEQ ID NO: 2387167 - DNA, 17 bp, Homo sapiens
ctgcccagcctcgcatg

SEQ ID NO: 2387168 - DNA, 20 bp, Homo sapiens
ctgcccagcctcgcatgcca

SEQ ID NO: 2387169 - DNA, 18 bp, Homo sapiens
ctgccccaccagccacct

SEQ ID NO: 2387170 - DNA, 19 bp, Homo sapiens
ctgcctacattccctggcc

SEQ ID NO: 2387171 - DNA, 23 bp, Homo sapiens
ctgcctacattccctggcctggc

SEQ ID NO: 2387172 - DNA, 14 bp, Homo sapiens
ctgcgatcttcaga

SEQ ID NO: 2387173 - DNA, 23 bp, Homo sapiens
ctgctaggcgagtgccaggactc

SEQ ID NO: 2387174 - DNA, 23 bp, Homo sapiens
ctgctcaacctctctccttctgg

SEQ ID NO: 2387175 - DNA, 13 bp, Homo sapiens
ctgctctggaaaa

SEQ ID NO: 2387176 - DNA, 19 bp, Homo sapiens
ctgctgggaccccagctag

SEQ ID NO: 2387177 - DNA, 14 bp, Homo sapiens
ctgcttctcagccc

SEQ ID NO: 2387178 - DNA, 18 bp, Homo sapiens
ctggaaaatgtgacccag

SEQ ID NO: 2387179 - DNA, 12 bp, Homo sapiens
ctggaagagagg

SEQ ID NO: 2387180 - DNA, 12 bp, Homo sapiens
aaaaaaatgaca

SEQ ID NO: 2387181 - DNA, 12 bp, Homo sapiens
aaaaaaatgact

SEQ ID NO: 2387182 - DNA, 20 bp, Homo sapiens
aaaaactctgggaaataaga

SEQ ID NO: 2387183 - DNA, 12 bp, Homo sapiens
aaaaactgaatg

SEQ ID NO: 2387184 - DNA, 16 bp, Homo sapiens
aaaaatattataactt

SEQ ID NO: 2387185 - DNA, 17 bp, Homo sapiens
aaaaatgacagatgttg

SEQ ID NO: 2387186 - DNA, 14 bp, Homo sapiens
aaaacatggtagaa

SEQ ID NO: 2387187 - DNA, 17 bp, Homo sapiens
aaaacttgtaaatgctg

SEQ ID NO: 2387188 - DNA, 14 bp, Homo sapiens
aaaagtgcaatgcg

SEQ ID NO: 2387189 - DNA, 16 bp, Homo sapiens
aaaagttcgaaagaaa

SEQ ID NO: 2387190 - DNA, 17 bp, Homo sapiens
aaaatcttggcacagaa

SEQ ID NO: 2387191 - DNA, 13 bp, Homo sapiens
aaaatgacagatg

SEQ ID NO: 2387192 - DNA, 20 bp, Homo sapiens
aaaattctcagtcagtaatt

SEQ ID NO: 2387193 - DNA, 21 bp, Homo sapiens
aaacatggtagaattggagag

SEQ ID NO: 2387194 - DNA, 16 bp, Homo sapiens
aaacctaaagaggaaa

SEQ ID NO: 2387195 - DNA, 23 bp, Homo sapiens
aaacctaaagaggaaaagtgcaa

SEQ ID NO: 2387196 - DNA, 19 bp, Homo sapiens
aaacgcaaagggctgaaag

SEQ ID NO: 2387197 - DNA, 23 bp, Homo sapiens
aaactacttttgtaccagtgtga

SEQ ID NO: 2387198 - DNA, 14 bp, Homo sapiens
aaactctgggaaat

SEQ ID NO: 2387199 - DNA, 17 bp, Homo sapiens
aaactgatttctcacgg

SEQ ID NO: 2387200 - DNA, 23 bp, Homo sapiens
aaacttccatgaggccaaacgtt

SEQ ID NO: 2387201 - DNA, 12 bp, Homo sapiens
aaacttgtaaat

SEQ ID NO: 2387202 - DNA, 15 bp, Homo sapiens
aaagaagtttgatat

SEQ ID NO: 2387203 - DNA, 15 bp, Homo sapiens
aaagaatacagaaag

SEQ ID NO: 2387204 - DNA, 19 bp, Homo sapiens
aaagaatccctgcagcctg

SEQ ID NO: 2387205 - DNA, 15 bp, Homo sapiens
aaaggatattttctt

SEQ ID NO: 2387206 - DNA, 14 bp, Homo sapiens
aaaggtataatttt

SEQ ID NO: 2387207 - DNA, 14 bp, Homo sapiens
aaagtgcaatgcgt

SEQ ID NO: 2387208 - DNA, 14 bp, Homo sapiens
aaagtgtgagcagt

SEQ ID NO: 2387209 - DNA, 20 bp, Homo sapiens
aaatatagagatatttttgt

SEQ ID NO: 2387210 - DNA, 15 bp, Homo sapiens
aaatatttatgtaaa

SEQ ID NO: 2387211 - DNA, 16 bp, Homo sapiens
aaatccagtttcccac

SEQ ID NO: 2387212 - DNA, 22 bp, Homo sapiens
aaatctcagaattccttttcta

SEQ ID NO: 2387213 - DNA, 17 bp, Homo sapiens
aaatcttggcacagaaa

SEQ ID NO: 2387214 - DNA, 20 bp, Homo sapiens
aaatgactaaaaatattata

SEQ ID NO: 2387215 - DNA, 17 bp, Homo sapiens
aaatgcaaacacacaaa

SEQ ID NO: 2387216 - DNA, 21 bp, Homo sapiens
aaatgcaaacacacaaaggta

SEQ ID NO: 2387217 - DNA, 13 bp, Homo sapiens
aaatgcatggagg

SEQ ID NO: 2387218 - DNA, 18 bp, Homo sapiens
aaattagctgtgtgaaat

SEQ ID NO: 2387219 - DNA, 17 bp, Homo sapiens
aaattataacttaaaat

SEQ ID NO: 2387220 - DNA, 19 bp, Homo sapiens
aaattataacttaaaatat

SEQ ID NO: 2387221 - DNA, 22 bp, Homo sapiens
aaattgtttaagtgttgtaaat

SEQ ID NO: 2387222 - DNA, 15 bp, Homo sapiens
aacaataaagagctc

SEQ ID NO: 2387223 - DNA, 17 bp, Homo sapiens
aacagcagaggttcttt

SEQ ID NO: 2387224 - DNA, 17 bp, Homo sapiens
aacataattcttgtata

SEQ ID NO: 2387225 - DNA, 19 bp, Homo sapiens
aaccacctaatcaggctga

SEQ ID NO: 2387226 - DNA, 18 bp, Homo sapiens
aaccagaataaagttctg

SEQ ID NO: 2387227 - DNA, 18 bp, Homo sapiens
aacccagaactggacgcc

SEQ ID NO: 2387228 - DNA, 18 bp, Homo sapiens
agcagctgaacagccaaa

SEQ ID NO: 2387229 - DNA, 17 bp, Homo sapiens
agcaggtggtcctgaga

SEQ ID NO: 2387230 - DNA, 15 bp, Homo sapiens
agcagttaactttaa

SEQ ID NO: 2387231 - DNA, 22 bp, Homo sapiens
agcagttaactttaagactgag

SEQ ID NO: 2387232 - DNA, 20 bp, Homo sapiens
agcatctctgtgtacccact

SEQ ID NO: 2387233 - DNA, 20 bp, Homo sapiens
agcattacgtgagccaggta

SEQ ID NO: 2387234 - DNA, 13 bp, Homo sapiens
agcatttatgttt

SEQ ID NO: 2387235 - DNA, 13 bp, Homo sapiens
agccaacagcagc

SEQ ID NO: 2387236 - DNA, 15 bp, Homo sapiens
agccaacaggtggca

SEQ ID NO: 2387237 - DNA, 17 bp, Homo sapiens
agccaacaggtggcagg

SEQ ID NO: 2387238 - DNA, 15 bp, Homo sapiens
agccacagccgtgct

SEQ ID NO: 2387239 - DNA, 15 bp, Homo sapiens
agccactcgggaggc

SEQ ID NO: 2387240 - DNA, 11 bp, Homo sapiens
agccagctctc

SEQ ID NO: 2387241 - DNA, 13 bp, Homo sapiens
agccagctctctc

SEQ ID NO: 2387242 - DNA, 11 bp, Homo sapiens
agccagggcca

SEQ ID NO: 2387243 - DNA, 17 bp, Homo sapiens
agccagggccaggggtc

SEQ ID NO: 2387244 - DNA, 18 bp, Homo sapiens
agccatcaacaagagttg

SEQ ID NO: 2387245 - DNA, 22 bp, Homo sapiens
agccatttgttggggcagtggt

SEQ ID NO: 2387246 - DNA, 17 bp, Homo sapiens
agcccagcctctgtccc

SEQ ID NO: 2387247 - DNA, 21 bp, Homo sapiens
agcccagcctctgtccctctt

SEQ ID NO: 2387248 - DNA, 23 bp, Homo sapiens
agcccagcctctgtccctctttg

SEQ ID NO: 2387249 - DNA, 17 bp, Homo sapiens
agccctgactggtgcta

SEQ ID NO: 2387250 - DNA, 23 bp, Homo sapiens
agccgtgctcgcccacaaactga

SEQ ID NO: 2387251 - DNA, 14 bp, Homo sapiens
agcctcctcccacc

SEQ ID NO: 2387252 - DNA, 20 bp, Homo sapiens
agcctcctcccaccaccctc

SEQ ID NO: 2387253 - DNA, 16 bp, Homo sapiens
agcctctgtccctctt

SEQ ID NO: 2387254 - DNA, 23 bp, Homo sapiens
agcctctgtccctctttgcctgt

SEQ ID NO: 2387255 - DNA, 11 bp, Homo sapiens
agcctggagaa

SEQ ID NO: 2387256 - DNA, 13 bp, Homo sapiens
agcctggagaagc

SEQ ID NO: 2387257 - DNA, 20 bp, Homo sapiens
agcctttggatgaccagaac

SEQ ID NO: 2387258 - DNA, 13 bp, Homo sapiens
agctagggctgga

SEQ ID NO: 2387259 - DNA, 22 bp, Homo sapiens
agctgaacagccaaatgcatgg

SEQ ID NO: 2387260 - DNA, 19 bp, Homo sapiens
agctgaacccattttgagt

SEQ ID NO: 2387261 - DNA, 12 bp, Homo sapiens
agctggaagcac

SEQ ID NO: 2387262 - DNA, 15 bp, Homo sapiens
agctgggggaagggt

SEQ ID NO: 2387263 - DNA, 23 bp, Homo sapiens
agctgtgtgaaataccagtgtgg

SEQ ID NO: 2387264 - DNA, 14 bp, Homo sapiens
aggaaaaaaatgac

SEQ ID NO: 2387265 - DNA, 17 bp, Homo sapiens
aggaaaagtgcaatgcg

SEQ ID NO: 2387266 - DNA, 14 bp, Homo sapiens
aggaactcccagca

SEQ ID NO: 2387267 - DNA, 16 bp, Homo sapiens
aggaactctggcttcc

SEQ ID NO: 2387268 - DNA, 12 bp, Homo sapiens
aggaccaggact

SEQ ID NO: 2387269 - DNA, 22 bp, Homo sapiens
aggaccaggactatagcccagg

SEQ ID NO: 2387270 - DNA, 19 bp, Homo sapiens
aggactatagcccaggtcc

SEQ ID NO: 2387271 - DNA, 20 bp, Homo sapiens
aggactatagcccaggtcct

SEQ ID NO: 2387272 - DNA, 17 bp, Homo sapiens
aggactccccaggccag

SEQ ID NO: 2387273 - DNA, 18 bp, Homo sapiens
aggactccccaggccagg

SEQ ID NO: 2387274 - DNA, 20 bp, Homo sapiens
aggactccccaggccaggcc

SEQ ID NO: 2387275 - DNA, 16 bp, Homo sapiens
aggagggcaagggcca

SEQ ID NO: 2387276 - DNA, 14 bp, Homo sapiens
aggagtccagggcg

SEQ ID NO: 2387277 - DNA, 17 bp, Homo sapiens
aggagtccagggcggga

SEQ ID NO: 2387278 - DNA, 16 bp, Homo sapiens
aggagttaagagtagc

SEQ ID NO: 2387279 - DNA, 16 bp, Homo sapiens
aggatctagaatgtgt

SEQ ID NO: 2387280 - DNA, 14 bp, Homo sapiens
aggatgtttttcat

SEQ ID NO: 2387281 - DNA, 16 bp, Homo sapiens
aggattttgtgttttt

SEQ ID NO: 2387282 - DNA, 15 bp, Homo sapiens
aggcagagaaagaag

SEQ ID NO: 2387283 - DNA, 21 bp, Homo sapiens
aggcagagaaagaagagacag

SEQ ID NO: 2387284 - DNA, 19 bp, Homo sapiens
aggcaggggtgggagagcc

SEQ ID NO: 2387285 - DNA, 14 bp, Homo sapiens
aggccaggccacca

SEQ ID NO: 2387286 - DNA, 18 bp, Homo sapiens
aggccaggccaccaggat

SEQ ID NO: 2387287 - DNA, 17 bp, Homo sapiens
aggcctgccctcaggga

SEQ ID NO: 2387288 - DNA, 16 bp, Homo sapiens
aggcctggccaggcac

SEQ ID NO: 2387289 - DNA, 24 bp, Homo sapiens
aggcggagagtacagtgagccaag

SEQ ID NO: 2387290 - DNA, 22 bp, Homo sapiens
aggctctttggggtcagccagg

SEQ ID NO: 2387291 - DNA, 23 bp, Homo sapiens
aggctctttggggtcagccaggg

SEQ ID NO: 2387292 - DNA, 14 bp, Homo sapiens
aggctgaggtgtct

SEQ ID NO: 2387293 - DNA, 12 bp, Homo sapiens
aggctggagaag

SEQ ID NO: 2387294 - DNA, 23 bp, Homo sapiens
aggctgggggcgggggagccaac

SEQ ID NO: 2387295 - DNA, 23 bp, Homo sapiens
aggctggtgctgtggccagggtg

SEQ ID NO: 2387296 - DNA, 14 bp, Homo sapiens
agggaccttgaagg

SEQ ID NO: 2387297 - DNA, 18 bp, Homo sapiens
agggactggaaccaggga

SEQ ID NO: 2387298 - DNA, 17 bp, Homo sapiens
agggacttaaaaaactt

SEQ ID NO: 2387299 - DNA, 14 bp, Homo sapiens
agggcaagggccat

SEQ ID NO: 2387300 - DNA, 15 bp, Homo sapiens
agggcgggagtgggg

SEQ ID NO: 2387301 - DNA, 22 bp, Homo sapiens
agggcgtcgctggacaacccag

SEQ ID NO: 2387302 - DNA, 14 bp, Homo sapiens
agggctgaaagcca

SEQ ID NO: 2387303 - DNA, 17 bp, Homo sapiens
aggggcacgcctgccca

SEQ ID NO: 2387304 - DNA, 19 bp, Homo sapiens
aggggcccacagggaaccc

SEQ ID NO: 2387305 - DNA, 17 bp, Homo sapiens
agggggattggagggaa

SEQ ID NO: 2387306 - DNA, 16 bp, Homo sapiens
aggggtccttggtgtg

SEQ ID NO: 2387307 - DNA, 13 bp, Homo sapiens
aggggtctccctg

SEQ ID NO: 2387308 - DNA, 17 bp, Homo sapiens
aggggtctccctggagt

SEQ ID NO: 2387309 - DNA, 22 bp, Homo sapiens
agggtcgccacacccggctccc

SEQ ID NO: 2387310 - DNA, 17 bp, Homo sapiens
agggtgggccactctcc

SEQ ID NO: 2387311 - DNA, 22 bp, Homo sapiens
agggtgggccactctcccctcc

SEQ ID NO: 2387312 - DNA, 20 bp, Homo sapiens
aggtaactatcaatatttaa

SEQ ID NO: 2387313 - DNA, 14 bp, Homo sapiens
aggtaatgagggac

SEQ ID NO: 2387314 - DNA, 20 bp, Homo sapiens
aggtagagtttgaaggaggt

SEQ ID NO: 2387315 - DNA, 11 bp, Homo sapiens
aggtataattt

SEQ ID NO: 2387316 - DNA, 13 bp, Homo sapiens
aggtatctccagg

SEQ ID NO: 2387317 - DNA, 14 bp, Homo sapiens
aggtatctccagga

SEQ ID NO: 2387318 - DNA, 20 bp, Homo sapiens
aggtcctctgatacccagag

SEQ ID NO: 2387319 - DNA, 13 bp, Homo sapiens
aggtctagacttt

SEQ ID NO: 2387320 - DNA, 15 bp, Homo sapiens
aggtctagactttct

SEQ ID NO: 2387321 - DNA, 17 bp, Homo sapiens
aggtctagactttctca

SEQ ID NO: 2387322 - DNA, 13 bp, Homo sapiens
aggtgagggatgt

SEQ ID NO: 2387323 - DNA, 23 bp, Homo sapiens
aggtgcatctggggaactagagg

SEQ ID NO: 2387324 - DNA, 14 bp, Homo sapiens
aggtgtctgcaccc

SEQ ID NO: 2387325 - DNA, 21 bp, Homo sapiens
aggtgtctgcacccaggggtg

SEQ ID NO: 2387326 - DNA, 22 bp, Homo sapiens
aggtttggtgtgtggagatgca

SEQ ID NO: 2387327 - DNA, 12 bp, Homo sapiens
aggtttgtatat

SEQ ID NO: 2387328 - DNA, 20 bp, Homo sapiens
aggtttgtatattgtcagat

SEQ ID NO: 2387329 - DNA, 21 bp, Homo sapiens
agtcaaaacagagatgtgata

SEQ ID NO: 2387330 - DNA, 18 bp, Homo sapiens
agtcctgcagaggattta

SEQ ID NO: 2387331 - DNA, 23 bp, Homo sapiens
agtctctgtataatctatttaca

SEQ ID NO: 2387332 - DNA, 22 bp, Homo sapiens
agtgagttacagcgagaggcag

SEQ ID NO: 2387333 - DNA, 19 bp, Homo sapiens
agtgcaatgcgtgttgtac

SEQ ID NO: 2387334 - DNA, 19 bp, Homo sapiens
agtgccaggactccccagg

SEQ ID NO: 2387335 - DNA, 15 bp, Homo sapiens
agtgggggctgtgcc

SEQ ID NO: 2387336 - DNA, 19 bp, Homo sapiens
agtggtaagctctggcttt

SEQ ID NO: 2387337 - DNA, 20 bp, Homo sapiens
agtggtctttcctatcatgg

SEQ ID NO: 2387338 - DNA, 20 bp, Homo sapiens
agtgtcatatgtaggtgtct

SEQ ID NO: 2387339 - DNA, 18 bp, Homo sapiens
aacctaaagaggaaaagt

SEQ ID NO: 2387340 - DNA, 20 bp, Homo sapiens
aacgttttgaactaataaaa

SEQ ID NO: 2387341 - DNA, 23 bp, Homo sapiens
aactacttttgtaccagtgtgaa

SEQ ID NO: 2387342 - DNA, 21 bp, Homo sapiens
aactcaccatgtaaaagagtc

SEQ ID NO: 2387343 - DNA, 22 bp, Homo sapiens
aactgaatggaaggtttgtata

SEQ ID NO: 2387344 - DNA, 17 bp, Homo sapiens
aactgagaaatgaatgc

SEQ ID NO: 2387345 - DNA, 22 bp, Homo sapiens
aactgcgtgccagtgtccccac

SEQ ID NO: 2387346 - DNA, 16 bp, Homo sapiens
aactgtgaacctggag

SEQ ID NO: 2387347 - DNA, 17 bp, Homo sapiens
aacttcaaatatagaga

SEQ ID NO: 2387348 - DNA, 11 bp, Homo sapiens
aagaagagaca

SEQ ID NO: 2387349 - DNA, 19 bp, Homo sapiens
aagacaggtctagactttc

SEQ ID NO: 2387350 - DNA, 14 bp, Homo sapiens
aagactcagtgttc

SEQ ID NO: 2387351 - DNA, 22 bp, Homo sapiens
aagagacaggagggcaagggcc

SEQ ID NO: 2387352 - DNA, 21 bp, Homo sapiens
aagagcctggagaagctgatg

SEQ ID NO: 2387353 - DNA, 21 bp, Homo sapiens
aagaggagtttcgaggtagag

SEQ ID NO: 2387354 - DNA, 23 bp, Homo sapiens
aagagtagcaagttctagagaag

SEQ ID NO: 2387355 - DNA, 23 bp, Homo sapiens
aagagttcttaaggattgtgata

SEQ ID NO: 2387356 - DNA, 15 bp, Homo sapiens
aagatggatgtgctt

SEQ ID NO: 2387357 - DNA, 20 bp, Homo sapiens
aagattttttttgtaacttc

SEQ ID NO: 2387358 - DNA, 22 bp, Homo sapiens
aagcctcactattacttgaact

SEQ ID NO: 2387359 - DNA, 11 bp, Homo sapiens
aagctctggct

SEQ ID NO: 2387360 - DNA, 14 bp, Homo sapiens
aagctggaagcaca

SEQ ID NO: 2387361 - DNA, 19 bp, Homo sapiens
aagctgggggaagggtggt

SEQ ID NO: 2387362 - DNA, 18 bp, Homo sapiens
aaggaactctggcttcca

SEQ ID NO: 2387363 - DNA, 20 bp, Homo sapiens
aaggaactctggcttccagg

SEQ ID NO: 2387364 - DNA, 19 bp, Homo sapiens
aaggaggtgagggatgtga

SEQ ID NO: 2387365 - DNA, 19 bp, Homo sapiens
aaggagtgagatcattttc

SEQ ID NO: 2387366 - DNA, 22 bp, Homo sapiens
aaggatcagaacagcagaggtt

SEQ ID NO: 2387367 - DNA, 19 bp, Homo sapiens
aagggccatgctgaaggga

SEQ ID NO: 2387368 - DNA, 16 bp, Homo sapiens
aagggggtccacccag

SEQ ID NO: 2387369 - DNA, 11 bp, Homo sapiens
aaggtataatt

SEQ ID NO: 2387370 - DNA, 20 bp, Homo sapiens
aagtgcaatgcgtgttgtac

SEQ ID NO: 2387371 - DNA, 17 bp, Homo sapiens
aagtgttgtaaatattt

SEQ ID NO: 2387372 - DNA, 18 bp, Homo sapiens
aagtgttgtaaatattta

SEQ ID NO: 2387373 - DNA, 14 bp, Homo sapiens
aagttagctgagcg

SEQ ID NO: 2387374 - DNA, 21 bp, Homo sapiens
aagttagctgagcgtggtggc

SEQ ID NO: 2387375 - DNA, 22 bp, Homo sapiens
aagttagtgtgttgtctgtgca

SEQ ID NO: 2387376 - DNA, 15 bp, Homo sapiens
aagttctgagtgttt

SEQ ID NO: 2387377 - DNA, 12 bp, Homo sapiens
aataaagagctc

SEQ ID NO: 2387378 - DNA, 13 bp, Homo sapiens
aataaagagctca

SEQ ID NO: 2387379 - DNA, 16 bp, Homo sapiens
aataaagttagtgtgt

SEQ ID NO: 2387380 - DNA, 16 bp, Homo sapiens
aatatagagatatttt

SEQ ID NO: 2387381 - DNA, 21 bp, Homo sapiens
aatatagagatatttttgtac

SEQ ID NO: 2387382 - DNA, 10 bp, Homo sapiens
aatcaaaact

SEQ ID NO: 2387383 - DNA, 14 bp, Homo sapiens
aatgaaaaattctc

SEQ ID NO: 2387384 - DNA, 21 bp, Homo sapiens
aatgaataataattatccaga

SEQ ID NO: 2387385 - DNA, 17 bp, Homo sapiens
aatgactaaaaatatta

SEQ ID NO: 2387386 - DNA, 20 bp, Homo sapiens
aatgcctcaatgtgaccagg

SEQ ID NO: 2387387 - DNA, 18 bp, Homo sapiens
aatggaaggtttgtatat

SEQ ID NO: 2387388 - DNA, 15 bp, Homo sapiens
aatggtatgagctga

SEQ ID NO: 2387389 - DNA, 18 bp, Homo sapiens
aatggtatgagctgaggg

SEQ ID NO: 2387390 - DNA, 16 bp, Homo sapiens
aatggtccagggttga

SEQ ID NO: 2387391 - DNA, 15 bp, Homo sapiens
aatgtgaccaggggt

SEQ ID NO: 2387392 - DNA, 17 bp, Homo sapiens
aatgtgaccaggggtga

SEQ ID NO: 2387393 - DNA, 17 bp, Homo sapiens
aatgtgagtgtgtttgt

SEQ ID NO: 2387394 - DNA, 15 bp, Homo sapiens
aattatccagagttt

SEQ ID NO: 2387395 - DNA, 14 bp, Homo sapiens
aattccaaaggaat

SEQ ID NO: 2387396 - DNA, 14 bp, Homo sapiens
aattcttgtatatt

SEQ ID NO: 2387397 - DNA, 19 bp, Homo sapiens
aattgcctgcagagagaag

SEQ ID NO: 2387398 - DNA, 16 bp, Homo sapiens
aattgggaagctgggg

SEQ ID NO: 2387399 - DNA, 12 bp, Homo sapiens
aattttatgaat

SEQ ID NO: 2387400 - DNA, 13 bp, Homo sapiens
aatttttaaagta

SEQ ID NO: 2387401 - DNA, 20 bp, Homo sapiens
aatttttaaagtatatattt

SEQ ID NO: 2387402 - DNA, 22 bp, Homo sapiens
acaaagatgtttgtcagatatg

SEQ ID NO: 2387403 - DNA, 11 bp, Homo sapiens
acaacccagaa

SEQ ID NO: 2387404 - DNA, 16 bp, Homo sapiens
acaagctggaagcaca

SEQ ID NO: 2387405 - DNA, 18 bp, Homo sapiens
acaagctggaagcacatg

SEQ ID NO: 2387406 - DNA, 20 bp, Homo sapiens
acaaggttccctctgagaat

SEQ ID NO: 2387407 - DNA, 13 bp, Homo sapiens
acaataaagagct

SEQ ID NO: 2387408 - DNA, 14 bp, Homo sapiens
acaataaagagctc

SEQ ID NO: 2387409 - DNA, 17 bp, Homo sapiens
acaatattttgtggctt

SEQ ID NO: 2387410 - DNA, 18 bp, Homo sapiens
acaattccaaaggaatct

SEQ ID NO: 2387411 - DNA, 14 bp, Homo sapiens
acacacgcaggaac

SEQ ID NO: 2387412 - DNA, 20 bp, Homo sapiens
acacacgcaggaactcccag

SEQ ID NO: 2387413 - DNA, 15 bp, Homo sapiens
acacagttgctgtca

SEQ ID NO: 2387414 - DNA, 17 bp, Homo sapiens
acacccggctccccctg

SEQ ID NO: 2387415 - DNA, 19 bp, Homo sapiens
acactgaagttaacagaga

SEQ ID NO: 2387416 - DNA, 15 bp, Homo sapiens
acagcagaggttctt

SEQ ID NO: 2387417 - DNA, 13 bp, Homo sapiens
acagccaacaggt

SEQ ID NO: 2387418 - DNA, 22 bp, Homo sapiens
atgtgcatggaaatgtcctcca

SEQ ID NO: 2387419 - DNA, 23 bp, Homo sapiens
atgttaaccagaataaagttctg

SEQ ID NO: 2387420 - DNA, 17 bp, Homo sapiens
atgttacatcacagtgt

SEQ ID NO: 2387421 - DNA, 22 bp, Homo sapiens
atgttgaatgcccacaggcaaa

SEQ ID NO: 2387422 - DNA, 17 bp, Homo sapiens
attaagattgaggcctg

SEQ ID NO: 2387423 - DNA, 22 bp, Homo sapiens
attaccccctcattgtttatta

SEQ ID NO: 2387424 - DNA, 16 bp, Homo sapiens
attacgtgagccaggt

SEQ ID NO: 2387425 - DNA, 14 bp, Homo sapiens
attacttgaacttt

SEQ ID NO: 2387426 - DNA, 15 bp, Homo sapiens
attagaaattagctg

SEQ ID NO: 2387427 - DNA, 16 bp, Homo sapiens
attatggaagatttta

SEQ ID NO: 2387428 - DNA, 17 bp, Homo sapiens
attatggaagattttaa

SEQ ID NO: 2387429 - DNA, 14 bp, Homo sapiens
attcacaatagaaa

SEQ ID NO: 2387430 - DNA, 17 bp, Homo sapiens
attcagtgcttcttaaa

SEQ ID NO: 2387431 - DNA, 14 bp, Homo sapiens
attcccaccaaggt

SEQ ID NO: 2387432 - DNA, 22 bp, Homo sapiens
attccctggcctggctctcctg

SEQ ID NO: 2387433 - DNA, 17 bp, Homo sapiens
attgagaattttaaatt

SEQ ID NO: 2387434 - DNA, 18 bp, Homo sapiens
attggagagtaaaaactg

SEQ ID NO: 2387435 - DNA, 13 bp, Homo sapiens
attggagggaaga

SEQ ID NO: 2387436 - DNA, 21 bp, Homo sapiens
attggctcacccaagcaaggc

SEQ ID NO: 2387437 - DNA, 18 bp, Homo sapiens
attgggaagctgggggaa

SEQ ID NO: 2387438 - DNA, 23 bp, Homo sapiens
attgtcagatattttttcagaaa

SEQ ID NO: 2387439 - DNA, 21 bp, Homo sapiens
attgtcctcccctattttaag

SEQ ID NO: 2387440 - DNA, 16 bp, Homo sapiens
atttaaaaataagaaa

SEQ ID NO: 2387441 - DNA, 18 bp, Homo sapiens
atttaccacagcagctga

SEQ ID NO: 2387442 - DNA, 17 bp, Homo sapiens
atttataagcagattta

SEQ ID NO: 2387443 - DNA, 23 bp, Homo sapiens
atttatgtaaactgcattagaaa

SEQ ID NO: 2387444 - DNA, 22 bp, Homo sapiens
attttaaattataacttaaaat

SEQ ID NO: 2387445 - DNA, 16 bp, Homo sapiens
attttaaattcacaat

SEQ ID NO: 2387446 - DNA, 23 bp, Homo sapiens
attttaagacgtgaatgtctcag

SEQ ID NO: 2387447 - DNA, 17 bp, Homo sapiens
atttttaaagtatatat

SEQ ID NO: 2387448 - DNA, 13 bp, Homo sapiens
attttttcagaaa

SEQ ID NO: 2387449 - DNA, 16 bp, Homo sapiens
caaaacttcctgtttg

SEQ ID NO: 2387450 - DNA, 13 bp, Homo sapiens
caaagagcctgga

SEQ ID NO: 2387451 - DNA, 16 bp, Homo sapiens
caaagagcctggagaa

SEQ ID NO: 2387452 - DNA, 17 bp, Homo sapiens
caaagagcctggagaag

SEQ ID NO: 2387453 - DNA, 18 bp, Homo sapiens
caaagagcctggagaagc

SEQ ID NO: 2387454 - DNA, 20 bp, Homo sapiens
caaagagtgggctgcatctg

SEQ ID NO: 2387455 - DNA, 18 bp, Homo sapiens
caaagatgtttgtcagat

SEQ ID NO: 2387456 - DNA, 17 bp, Homo sapiens
caaagggctgaaagcca

SEQ ID NO: 2387457 - DNA, 22 bp, Homo sapiens
caaatatagagatatttttgta

SEQ ID NO: 2387458 - DNA, 16 bp, Homo sapiens
caaatccatccagaat

SEQ ID NO: 2387459 - DNA, 18 bp, Homo sapiens
caacaggtggcaggacca

SEQ ID NO: 2387460 - DNA, 21 bp, Homo sapiens
caacaggtggcaggaccagga

SEQ ID NO: 2387461 - DNA, 18 bp, Homo sapiens
caacagtcaaaacagaga

SEQ ID NO: 2387462 - DNA, 16 bp, Homo sapiens
caggggtgggagagcc

SEQ ID NO: 2387463 - DNA, 15 bp, Homo sapiens
cagggtgagagctgc

SEQ ID NO: 2387464 - DNA, 22 bp, Homo sapiens
cagggtgagagctgctctggaa

SEQ ID NO: 2387465 - DNA, 17 bp, Homo sapiens
cagggtgggccactctc

SEQ ID NO: 2387466 - DNA, 18 bp, Homo sapiens
cagggttgatcacactct

SEQ ID NO: 2387467 - DNA, 21 bp, Homo sapiens
cagggttgatcacactctggg

SEQ ID NO: 2387468 - DNA, 21 bp, Homo sapiens
caggtcctctgatacccagag

SEQ ID NO: 2387469 - DNA, 17 bp, Homo sapiens
caggtggcaggaccagg

SEQ ID NO: 2387470 - DNA, 20 bp, Homo sapiens
caggtggcaggaccaggact

SEQ ID NO: 2387471 - DNA, 14 bp, Homo sapiens
cagtataaaagaca

SEQ ID NO: 2387472 - DNA, 19 bp, Homo sapiens
cagtcaaaacagagatgtg

SEQ ID NO: 2387473 - DNA, 16 bp, Homo sapiens
cagtcagtaattgcca

SEQ ID NO: 2387474 - DNA, 11 bp, Homo sapiens
cagtgggacaa

SEQ ID NO: 2387475 - DNA, 20 bp, Homo sapiens
cagtgggacaaaccagagca

SEQ ID NO: 2387476 - DNA, 22 bp, Homo sapiens
cagtgggacaaaccagagcaga

SEQ ID NO: 2387477 - DNA, 19 bp, Homo sapiens
cataaaatgggtgatatgc

SEQ ID NO: 2387478 - DNA, 11 bp, Homo sapiens
cataagaccat

SEQ ID NO: 2387479 - DNA, 21 bp, Homo sapiens
cataagaccataacagccaac

SEQ ID NO: 2387480 - DNA, 20 bp, Homo sapiens
cataagaccctaagcctcct

SEQ ID NO: 2387481 - DNA, 16 bp, Homo sapiens
cataattcttgtatat

SEQ ID NO: 2387482 - DNA, 17 bp, Homo sapiens
cataattcttgtatatt

SEQ ID NO: 2387483 - DNA, 12 bp, Homo sapiens
catcagggtggg

SEQ ID NO: 2387484 - DNA, 13 bp, Homo sapiens
catcagggtgggc

SEQ ID NO: 2387485 - DNA, 22 bp, Homo sapiens
catcagggtgggccactctccc

SEQ ID NO: 2387486 - DNA, 14 bp, Homo sapiens
catcccctttcctc

SEQ ID NO: 2387487 - DNA, 15 bp, Homo sapiens
catctgggattccca

SEQ ID NO: 2387488 - DNA, 16 bp, Homo sapiens
catctgggattcccac

SEQ ID NO: 2387489 - DNA, 19 bp, Homo sapiens
catgatgttaaccagaata

SEQ ID NO: 2387490 - DNA, 19 bp, Homo sapiens
catgccagagcctggggca

SEQ ID NO: 2387491 - DNA, 15 bp, Homo sapiens
catgctcagccctga

SEQ ID NO: 2387492 - DNA, 16 bp, Homo sapiens
catgctcagcccttcc

SEQ ID NO: 2387493 - DNA, 13 bp, Homo sapiens
catgctgaaggga

SEQ ID NO: 2387494 - DNA, 14 bp, Homo sapiens
catggacacccctt

SEQ ID NO: 2387495 - DNA, 22 bp, Homo sapiens
catggacaccccttatccagga

SEQ ID NO: 2387496 - DNA, 19 bp, Homo sapiens
catggtgcagttgacagca

SEQ ID NO: 2387497 - DNA, 21 bp, Homo sapiens
catgtgcatggaaatgtcctc

SEQ ID NO: 2387498 - DNA, 14 bp, Homo sapiens
catgtgttgaaaaa

SEQ ID NO: 2387499 - DNA, 15 bp, Homo sapiens
cattccctggcctgg

SEQ ID NO: 2387500 - DNA, 17 bp, Homo sapiens
cattgtttattaacaaa

SEQ ID NO: 2387501 - DNA, 18 bp, Homo sapiens
catttctactgtgactga

SEQ ID NO: 2387502 - DNA, 20 bp, Homo sapiens
cattttgagtgactcgaggg

SEQ ID NO: 2387503 - DNA, 22 bp, Homo sapiens
ccaaagagcctggagaagctga

SEQ ID NO: 2387504 - DNA, 11 bp, Homo sapiens
ccaacagcagc

SEQ ID NO: 2387505 - DNA, 20 bp, Homo sapiens
ccaagcaaaggtgaagagac

SEQ ID NO: 2387506 - DNA, 17 bp, Homo sapiens
ccaaggtcttcagccat

SEQ ID NO: 2387507 - DNA, 22 bp, Homo sapiens
ccacacacgcaggaactcccag

SEQ ID NO: 2387508 - DNA, 23 bp, Homo sapiens
ccacacacgcaggaactcccagc

SEQ ID NO: 2387509 - DNA, 21 bp, Homo sapiens
ccacacccggctccccctgct

SEQ ID NO: 2387510 - DNA, 14 bp, Homo sapiens
ccacactggtgact

SEQ ID NO: 2387511 - DNA, 16 bp, Homo sapiens
ccacagggaaccctgc

SEQ ID NO: 2387512 - DNA, 17 bp, Homo sapiens
ccacatccctttgaaac

SEQ ID NO: 2387513 - DNA, 15 bp, Homo sapiens
ccaccaccctcccac

SEQ ID NO: 2387514 - DNA, 22 bp, Homo sapiens
ccaccttccccagactcagctc

SEQ ID NO: 2387515 - DNA, 16 bp, Homo sapiens
ccaccttggactcctc

SEQ ID NO: 2387516 - DNA, 18 bp, Homo sapiens
ccaccttggactcctccc

SEQ ID NO: 2387517 - DNA, 19 bp, Homo sapiens
ccaccttggactcctccca

SEQ ID NO: 2387518 - DNA, 20 bp, Homo sapiens
ccaccttggactcctcccac

SEQ ID NO: 2387519 - DNA, 18 bp, Homo sapiens
ccactcctcactgcccca

SEQ ID NO: 2387520 - DNA, 20 bp, Homo sapiens
ccactcgggaggctgagaca

SEQ ID NO: 2387521 - DNA, 13 bp, Homo sapiens
ccactctcccctc

SEQ ID NO: 2387522 - DNA, 16 bp, Homo sapiens
ccactctcccctccct

SEQ ID NO: 2387523 - DNA, 20 bp, Homo sapiens
cctccaacaataaagagctc

SEQ ID NO: 2387524 - DNA, 22 bp, Homo sapiens
cctcccacaatctgggactttc

SEQ ID NO: 2387525 - DNA, 18 bp, Homo sapiens
cctccccaccttccccag

SEQ ID NO: 2387526 - DNA, 12 bp, Homo sapiens
cctcctcccacc

SEQ ID NO: 2387527 - DNA, 13 bp, Homo sapiens
cctcctcccacca

SEQ ID NO: 2387528 - DNA, 20 bp, Homo sapiens
cctcctgtgtggaagaagga

SEQ ID NO: 2387529 - DNA, 18 bp, Homo sapiens
cctcgcatgccagagcct

SEQ ID NO: 2387530 - DNA, 14 bp, Homo sapiens
cctctaagccactc

SEQ ID NO: 2387531 - DNA, 19 bp, Homo sapiens
cctctaagccactcttcca

SEQ ID NO: 2387532 - DNA, 14 bp, Homo sapiens
cctctctccttctg

SEQ ID NO: 2387533 - DNA, 14 bp, Homo sapiens
cctctgcagcactt

SEQ ID NO: 2387534 - DNA, 13 bp, Homo sapiens
cctctgtccctct

SEQ ID NO: 2387535 - DNA, 17 bp, Homo sapiens
cctctttgcctgtgtga

SEQ ID NO: 2387536 - DNA, 15 bp, Homo sapiens
cctgaacatctgtgt

SEQ ID NO: 2387537 - DNA, 19 bp, Homo sapiens
cctgaaggtgccactccag

SEQ ID NO: 2387538 - DNA, 14 bp, Homo sapiens
cctgacaagcactg

SEQ ID NO: 2387539 - DNA, 20 bp, Homo sapiens
cctgacaagcactgctaggc

SEQ ID NO: 2387540 - DNA, 21 bp, Homo sapiens
cctgactggtgctataggctg

SEQ ID NO: 2387541 - DNA, 20 bp, Homo sapiens
cctgagtggatctccaagga

SEQ ID NO: 2387542 - DNA, 16 bp, Homo sapiens
cctgcagagagaagcc

SEQ ID NO: 2387543 - DNA, 15 bp, Homo sapiens
cctgcagcctggtag

SEQ ID NO: 2387544 - DNA, 12 bp, Homo sapiens
cctggccaggca

SEQ ID NO: 2387545 - DNA, 17 bp, Homo sapiens
cctggcctggctctcct

SEQ ID NO: 2387546 - DNA, 23 bp, Homo sapiens
cctgggaggcggagagtacagtg

SEQ ID NO: 2387547 - DNA, 18 bp, Homo sapiens
cctgtagtcccagccact

SEQ ID NO: 2387548 - DNA, 17 bp, Homo sapiens
ccttatccaggactctg

SEQ ID NO: 2387549 - DNA, 12 bp, Homo sapiens
ccttcacagtgt

SEQ ID NO: 2387550 - DNA, 12 bp, Homo sapiens
ccttccccagac

SEQ ID NO: 2387551 - DNA, 13 bp, Homo sapiens
ccttcctttcctc

SEQ ID NO: 2387552 - DNA, 14 bp, Homo sapiens
ccttcttcgctgct

SEQ ID NO: 2387553 - DNA, 21 bp, Homo sapiens
ccttgaagggtaaagaagttt

SEQ ID NO: 2387554 - DNA, 18 bp, Homo sapiens
ccttgctcgctgtaaaat

SEQ ID NO: 2387555 - DNA, 22 bp, Homo sapiens
ccttggcgggcagcccagcctc

SEQ ID NO: 2387556 - DNA, 11 bp, Homo sapiens
cgagtgccagg

SEQ ID NO: 2387557 - DNA, 19 bp, Homo sapiens
cgcaaagggctgaaagcca

SEQ ID NO: 2387558 - DNA, 21 bp, Homo sapiens
cgcaagagaacatttctagaa

SEQ ID NO: 2387559 - DNA, 14 bp, Homo sapiens
cgcatgccagagcc

SEQ ID NO: 2387560 - DNA, 15 bp, Homo sapiens
cgcatgccagagcct

SEQ ID NO: 2387561 - DNA, 21 bp, Homo sapiens
cgcccagcctcctcccaccac

SEQ ID NO: 2387562 - DNA, 18 bp, Homo sapiens
cgcccagctgaggctggg

SEQ ID NO: 2387563 - DNA, 13 bp, Homo sapiens
cgcctgcccagcc

SEQ ID NO: 2387564 - DNA, 15 bp, Homo sapiens
cgcctgtagtcccag

SEQ ID NO: 2387565 - DNA, 21 bp, Homo sapiens
cgctctgccctccctggcctc

SEQ ID NO: 2387566 - DNA, 22 bp, Homo sapiens
cgctggacaacccagaactgga

SEQ ID NO: 2387567 - DNA, 21 bp, Homo sapiens
cgcttccttagccttgctcag

SEQ ID NO: 2387568 - DNA, 12 bp, Homo sapiens
cggcccagagac

SEQ ID NO: 2387569 - DNA, 19 bp, Homo sapiens
cggcccagagaccccttcc

SEQ ID NO: 2387570 - DNA, 15 bp, Homo sapiens
cggctccccctgctt

SEQ ID NO: 2387571 - DNA, 20 bp, Homo sapiens
cgggaggctgagacaggaga

SEQ ID NO: 2387572 - DNA, 14 bp, Homo sapiens
cgggcagcccagcc

SEQ ID NO: 2387573 - DNA, 17 bp, Homo sapiens
cgggcagcccagcctct

SEQ ID NO: 2387574 - DNA, 20 bp, Homo sapiens
cgggcagcccagcctctgtc

SEQ ID NO: 2387575 - DNA, 23 bp, Homo sapiens
cgggcgcctgtagtcccagccac

SEQ ID NO: 2387576 - DNA, 23 bp, Homo sapiens
cgggtggaaaagaatccctgcag

SEQ ID NO: 2387577 - DNA, 22 bp, Homo sapiens
cgtatgtcggcacgtcccatgt

SEQ ID NO: 2387578 - DNA, 21 bp, Homo sapiens
ctttggggtcagccagggcca

SEQ ID NO: 2387579 - DNA, 20 bp, Homo sapiens
cttttgcccttcacagtgtt

SEQ ID NO: 2387580 - DNA, 16 bp, Homo sapiens
cttttgtaccagtgtg

SEQ ID NO: 2387581 - DNA, 19 bp, Homo sapiens
gaaaaaaaagtttcagaga

SEQ ID NO: 2387582 - DNA, 22 bp, Homo sapiens
gaaaagaatccctgcagcctgg

SEQ ID NO: 2387583 - DNA, 12 bp, Homo sapiens
gaaaagaggagt

SEQ ID NO: 2387584 - DNA, 19 bp, Homo sapiens
gaaaatagctctttcaggg

SEQ ID NO: 2387585 - DNA, 15 bp, Homo sapiens
gaaacacaatatttt

SEQ ID NO: 2387586 - DNA, 20 bp, Homo sapiens
gaaactcaccatgtaaaaga

SEQ ID NO: 2387587 - DNA, 14 bp, Homo sapiens
gaaagcctctggaa

SEQ ID NO: 2387588 - DNA, 20 bp, Homo sapiens
gaaatccagtttcccaccac

SEQ ID NO: 2387589 - DNA, 17 bp, Homo sapiens
gaaatggtatgagctga

SEQ ID NO: 2387590 - DNA, 14 bp, Homo sapiens
gaacatctgtgtgt

SEQ ID NO: 2387591 - DNA, 15 bp, Homo sapiens
gaactaataaaagca

SEQ ID NO: 2387592 - DNA, 11 bp, Homo sapiens
gaactcccagc

SEQ ID NO: 2387593 - DNA, 17 bp, Homo sapiens
gaactctggcttccagg

SEQ ID NO: 2387594 - DNA, 17 bp, Homo sapiens
gaagctgggggaagggt

SEQ ID NO: 2387595 - DNA, 15 bp, Homo sapiens
gaaggaactctggct

SEQ ID NO: 2387596 - DNA, 22 bp, Homo sapiens
gaaggaactctggcttccaggt

SEQ ID NO: 2387597 - DNA, 13 bp, Homo sapiens
gaaggaggtgagg

SEQ ID NO: 2387598 - DNA, 12 bp, Homo sapiens
gaagggagaagg

SEQ ID NO: 2387599 - DNA, 16 bp, Homo sapiens
gaaggtttgtatattg

SEQ ID NO: 2387600 - DNA, 19 bp, Homo sapiens
gaagtttgatattaaagga

SEQ ID NO: 2387601 - DNA, 13 bp, Homo sapiens
gaatacagtgtta

SEQ ID NO: 2387602 - DNA, 11 bp, Homo sapiens
gaatatattat

SEQ ID NO: 2387603 - DNA, 12 bp, Homo sapiens
gaatatattata

SEQ ID NO: 2387604 - DNA, 15 bp, Homo sapiens
gaatcaaaactctcc

SEQ ID NO: 2387605 - DNA, 12 bp, Homo sapiens
gaatccctgcag

SEQ ID NO: 2387606 - DNA, 13 bp, Homo sapiens
gaatgctgagacc

SEQ ID NO: 2387607 - DNA, 11 bp, Homo sapiens
gaatgtctcag

SEQ ID NO: 2387608 - DNA, 12 bp, Homo sapiens
gaattccaagga

SEQ ID NO: 2387609 - DNA, 13 bp, Homo sapiens
gaattccaaggag

SEQ ID NO: 2387610 - DNA, 16 bp, Homo sapiens
gaattgcctgcagaga

SEQ ID NO: 2387611 - DNA, 20 bp, Homo sapiens
gaattgcctgcagagagaag

SEQ ID NO: 2387612 - DNA, 21 bp, Homo sapiens
gaattgcctgcagagagaagc

SEQ ID NO: 2387613 - DNA, 18 bp, Homo sapiens
gaatttaaaaataagaaa

SEQ ID NO: 2387614 - DNA, 20 bp, Homo sapiens
gacaccccttatccaggact

SEQ ID NO: 2387615 - DNA, 13 bp, Homo sapiens
gacagataactct

SEQ ID NO: 2387616 - DNA, 12 bp, Homo sapiens
gacagcaggtgg

SEQ ID NO: 2387617 - DNA, 22 bp, Homo sapiens
gaccaggggtgatttcagagag

SEQ ID NO: 2387618 - DNA, 16 bp, Homo sapiens
gacccagatcctcaca

SEQ ID NO: 2387619 - DNA, 20 bp, Homo sapiens
gacccagatcctcacaacca

SEQ ID NO: 2387620 - DNA, 21 bp, Homo sapiens
gaccccaaagagcctggagaa

SEQ ID NO: 2387621 - DNA, 19 bp, Homo sapiens
gaccctgagtccgggaggc

SEQ ID NO: 2387622 - DNA, 17 bp, Homo sapiens
gaccgggctctgacagc

SEQ ID NO: 2387623 - DNA, 20 bp, Homo sapiens
gacgcccagctgaggctggg

SEQ ID NO: 2387624 - DNA, 14 bp, Homo sapiens
gactcctcccacaa

SEQ ID NO: 2387625 - DNA, 17 bp, Homo sapiens
gactggaaccagggaga

SEQ ID NO: 2387626 - DNA, 19 bp, Homo sapiens
gactggtgctataggctgg

SEQ ID NO: 2387627 - DNA, 20 bp, Homo sapiens
gactggtgctataggctgga

SEQ ID NO: 2387628 - DNA, 22 bp, Homo sapiens
gactggtgctataggctggaga

SEQ ID NO: 2387629 - DNA, 23 bp, Homo sapiens
gactggtgctataggctggagaa

SEQ ID NO: 2387630 - DNA, 11 bp, Homo sapiens
gagaaactgag

SEQ ID NO: 2387631 - DNA, 23 bp, Homo sapiens
gagaagctgatgctttgcttcaa

SEQ ID NO: 2387632 - DNA, 15 bp, Homo sapiens
gagaattttaaatta

SEQ ID NO: 2387633 - DNA, 15 bp, Homo sapiens
gagacaggagggcaa

SEQ ID NO: 2387634 - DNA, 22 bp, Homo sapiens
gagaccaagactctgaaatctc

SEQ ID NO: 2387635 - DNA, 23 bp, Homo sapiens
gagaccaagactctgaaatctca

SEQ ID NO: 2387636 - DNA, 14 bp, Homo sapiens
gagaccccttcctt

SEQ ID NO: 2387637 - DNA, 20 bp, Homo sapiens
gagaccccttcctttcctct

SEQ ID NO: 2387638 - DNA, 15 bp, Homo sapiens
acctctctccttctg

SEQ ID NO: 2387639 - DNA, 19 bp, Homo sapiens
acctgcttcatgctcagcc

SEQ ID NO: 2387640 - DNA, 21 bp, Homo sapiens
acctgcttcatgctcagccct

SEQ ID NO: 2387641 - DNA, 14 bp, Homo sapiens
accttccccagact

SEQ ID NO: 2387642 - DNA, 21 bp, Homo sapiens
accttcttcgctgctagagaa

SEQ ID NO: 2387643 - DNA, 18 bp, Homo sapiens
accttggactcctcccac

SEQ ID NO: 2387644 - DNA, 14 bp, Homo sapiens
acgatgaaaaactt

SEQ ID NO: 2387645 - DNA, 17 bp, Homo sapiens
acgcaaagggctgaaag

SEQ ID NO: 2387646 - DNA, 21 bp, Homo sapiens
acgcaaagggctgaaagccat

SEQ ID NO: 2387647 - DNA, 16 bp, Homo sapiens
acgcaggaactcccag

SEQ ID NO: 2387648 - DNA, 12 bp, Homo sapiens
acgcccagcctc

SEQ ID NO: 2387649 - DNA, 19 bp, Homo sapiens
acgcccagcctcctcccac

SEQ ID NO: 2387650 - DNA, 19 bp, Homo sapiens
acgcccagctgaggctggg

SEQ ID NO: 2387651 - DNA, 21 bp, Homo sapiens
acggccttcaactgaaaagac

SEQ ID NO: 2387652 - DNA, 15 bp, Homo sapiens
acgtgagccaggtaa

SEQ ID NO: 2387653 - DNA, 14 bp, Homo sapiens
acgttatatattgt

SEQ ID NO: 2387654 - DNA, 16 bp, Homo sapiens
acgttatatattgtat

SEQ ID NO: 2387655 - DNA, 14 bp, Homo sapiens
actatagcccaggt

SEQ ID NO: 2387656 - DNA, 17 bp, Homo sapiens
actatcaatatttaagt

SEQ ID NO: 2387657 - DNA, 13 bp, Homo sapiens
actattacttgaa

SEQ ID NO: 2387658 - DNA, 18 bp, Homo sapiens
actcacccatgtgccaag

SEQ ID NO: 2387659 - DNA, 13 bp, Homo sapiens
actcaggattctc

SEQ ID NO: 2387660 - DNA, 12 bp, Homo sapiens
actccccaggcc

SEQ ID NO: 2387661 - DNA, 15 bp, Homo sapiens
actccccaggccagg

SEQ ID NO: 2387662 - DNA, 19 bp, Homo sapiens
actccggcctgatgacaga

SEQ ID NO: 2387663 - DNA, 15 bp, Homo sapiens
actcctcactgcccc

SEQ ID NO: 2387664 - DNA, 13 bp, Homo sapiens
actcctcccacaa

SEQ ID NO: 2387665 - DNA, 21 bp, Homo sapiens
actcctctaagccactcttcc

SEQ ID NO: 2387666 - DNA, 23 bp, Homo sapiens
actcctctaagccactcttccaa

SEQ ID NO: 2387667 - DNA, 18 bp, Homo sapiens
actctcaggatcaagaaa

SEQ ID NO: 2387668 - DNA, 11 bp, Homo sapiens
actctcccctc

SEQ ID NO: 2387669 - DNA, 20 bp, Homo sapiens
actctcccctccctcttcct

SEQ ID NO: 2387670 - DNA, 14 bp, Homo sapiens
actctggcacccag

SEQ ID NO: 2387671 - DNA, 23 bp, Homo sapiens
actctgtcaatttccctgactcc

SEQ ID NO: 2387672 - DNA, 16 bp, Homo sapiens
actcttcctgcaagga

SEQ ID NO: 2387673 - DNA, 19 bp, Homo sapiens
actgaaaagactcagtgtt

SEQ ID NO: 2387674 - DNA, 21 bp, Homo sapiens
actgaagttaacagagacaga

SEQ ID NO: 2387675 - DNA, 21 bp, Homo sapiens
actgaatgcctcaatgtgacc

SEQ ID NO: 2387676 - DNA, 15 bp, Homo sapiens
actgagaaatgaatg

SEQ ID NO: 2387677 - DNA, 21 bp, Homo sapiens
actgatgttacatcacagtgt

SEQ ID NO: 2387678 - DNA, 16 bp, Homo sapiens
actgcattagaaatta

SEQ ID NO: 2387679 - DNA, 12 bp, Homo sapiens
actgccccacca

SEQ ID NO: 2387680 - DNA, 15 bp, Homo sapiens
actgccccaccagcc

SEQ ID NO: 2387681 - DNA, 18 bp, Homo sapiens
actgctaggcgagtgcca

SEQ ID NO: 2387682 - DNA, 22 bp, Homo sapiens
actgctaggcgagtgccaggac

SEQ ID NO: 2387683 - DNA, 15 bp, Homo sapiens
actggaaccagggag

SEQ ID NO: 2387684 - DNA, 23 bp, Homo sapiens
actggtgctataggctggagaag

SEQ ID NO: 2387685 - DNA, 23 bp, Homo sapiens
actgtgatcaggctatgtatgga

SEQ ID NO: 2387686 - DNA, 14 bp, Homo sapiens
acttaaaaaaatga

SEQ ID NO: 2387687 - DNA, 15 bp, Homo sapiens
acttcaaatatagag

SEQ ID NO: 2387688 - DNA, 19 bp, Homo sapiens
acttgcattgaatatatta

SEQ ID NO: 2387689 - DNA, 19 bp, Homo sapiens
actttaaccctctcttccc

SEQ ID NO: 2387690 - DNA, 20 bp, Homo sapiens
actttaaccctctcttccct

SEQ ID NO: 2387691 - DNA, 17 bp, Homo sapiens
actttaagactgagcac

SEQ ID NO: 2387692 - DNA, 17 bp, Homo sapiens
acttttgtaccagtgtg

SEQ ID NO: 2387693 - DNA, 15 bp, Homo sapiens
agaaatatgtggttt

SEQ ID NO: 2387694 - DNA, 17 bp, Homo sapiens
agaaattagctgtgtga

SEQ ID NO: 2387695 - DNA, 18 bp, Homo sapiens
agaacagcagaggttctt

SEQ ID NO: 2387696 - DNA, 18 bp, Homo sapiens
agaactggacgcccagct

SEQ ID NO: 2387697 - DNA, 14 bp, Homo sapiens
agaagagtcaggaa

SEQ ID NO: 2387698 - DNA, 23 bp, Homo sapiens
agaagtttctggccctggctgac

SEQ ID NO: 2387699 - DNA, 12 bp, Homo sapiens
agaatacagaaa

SEQ ID NO: 2387700 - DNA, 18 bp, Homo sapiens
agaatacagaaagatgga

SEQ ID NO: 2387701 - DNA, 21 bp, Homo sapiens
agaatacagaaagatggatgt

SEQ ID NO: 2387702 - DNA, 13 bp, Homo sapiens
agaattttaaatt

SEQ ID NO: 2387703 - DNA, 23 bp, Homo sapiens
agacaggagggcaagggccatgc

SEQ ID NO: 2387704 - DNA, 19 bp, Homo sapiens
agaccctaagcctcctttt

SEQ ID NO: 2387705 - DNA, 12 bp, Homo sapiens
agacgtgaatgt

SEQ ID NO: 2387706 - DNA, 12 bp, Homo sapiens
agactcagtgtt

SEQ ID NO: 2387707 - DNA, 17 bp, Homo sapiens
agagaaagaagagacag

SEQ ID NO: 2387708 - DNA, 22 bp, Homo sapiens
agagaagggggattggagggaa

SEQ ID NO: 2387709 - DNA, 20 bp, Homo sapiens
agagaccccttcctttcctc

SEQ ID NO: 2387710 - DNA, 15 bp, Homo sapiens
agagagggcagaggg

SEQ ID NO: 2387711 - DNA, 14 bp, Homo sapiens
agagcagagagcag

SEQ ID NO: 2387712 - DNA, 22 bp, Homo sapiens
agagcattacgtgagccaggta

SEQ ID NO: 2387713 - DNA, 23 bp, Homo sapiens
ggaaaagaatccctgcagcctgg

SEQ ID NO: 2387714 - DNA, 19 bp, Homo sapiens
ggaaatggtatgagctgag

SEQ ID NO: 2387715 - DNA, 13 bp, Homo sapiens
ggaaccagggaga

SEQ ID NO: 2387716 - DNA, 11 bp, Homo sapiens
ggaactcccag

SEQ ID NO: 2387717 - DNA, 23 bp, Homo sapiens
ggaagcacatgtttatttattct

SEQ ID NO: 2387718 - DNA, 22 bp, Homo sapiens
ggaagctgggggaagggtggtc

SEQ ID NO: 2387719 - DNA, 19 bp, Homo sapiens
ggaaggtttggtgtgtgga

SEQ ID NO: 2387720 - DNA, 14 bp, Homo sapiens
ggacaacccagaac

SEQ ID NO: 2387721 - DNA, 20 bp, Homo sapiens
ggacaccccttatccaggac

SEQ ID NO: 2387722 - DNA, 11 bp, Homo sapiens
ggaccaggact

SEQ ID NO: 2387723 - DNA, 20 bp, Homo sapiens
ggacgcccagctgaggctgg

SEQ ID NO: 2387724 - DNA, 21 bp, Homo sapiens
ggactacgttaagggaaggaa

SEQ ID NO: 2387725 - DNA, 16 bp, Homo sapiens
ggactccccaggccag

SEQ ID NO: 2387726 - DNA, 17 bp, Homo sapiens
ggactccccaggccagg

SEQ ID NO: 2387727 - DNA, 18 bp, Homo sapiens
ggactccccaggccaggc

SEQ ID NO: 2387728 - DNA, 15 bp, Homo sapiens
ggactcctcccacaa

SEQ ID NO: 2387729 - DNA, 14 bp, Homo sapiens
ggactggaaccagg

SEQ ID NO: 2387730 - DNA, 22 bp, Homo sapiens
ggactggaaccagggagaccga

SEQ ID NO: 2387731 - DNA, 20 bp, Homo sapiens
ggagagtacagtgagccaag

SEQ ID NO: 2387732 - DNA, 18 bp, Homo sapiens
ggaggctgagacaggaga

SEQ ID NO: 2387733 - DNA, 23 bp, Homo sapiens
ggagggcaagggccatgctgaag

SEQ ID NO: 2387734 - DNA, 14 bp, Homo sapiens
ggagttccatgaag

SEQ ID NO: 2387735 - DNA, 19 bp, Homo sapiens
ggagttccatgaagaccac

SEQ ID NO: 2387736 - DNA, 22 bp, Homo sapiens
ggagttccctgaacatctgtgt

SEQ ID NO: 2387737 - DNA, 16 bp, Homo sapiens
ggatcagaacagcaga

SEQ ID NO: 2387738 - DNA, 17 bp, Homo sapiens
ggatcagaacagcagag

SEQ ID NO: 2387739 - DNA, 17 bp, Homo sapiens
ggatcttgcattcccag

SEQ ID NO: 2387740 - DNA, 22 bp, Homo sapiens
ggatggcccttcccactggagg

SEQ ID NO: 2387741 - DNA, 22 bp, Homo sapiens
ggattcccaccaaggtcttcag

SEQ ID NO: 2387742 - DNA, 17 bp, Homo sapiens
ggattttgtgttttttc

SEQ ID NO: 2387743 - DNA, 20 bp, Homo sapiens
ggcaaaggtggctctccagt

SEQ ID NO: 2387744 - DNA, 19 bp, Homo sapiens
ggcaagggccatgctgaag

SEQ ID NO: 2387745 - DNA, 22 bp, Homo sapiens
ggcacaatggctaattcccaga

SEQ ID NO: 2387746 - DNA, 21 bp, Homo sapiens
ggcacgtcccatgtgcatgga

SEQ ID NO: 2387747 - DNA, 18 bp, Homo sapiens
ggcagagaaagaagagac

SEQ ID NO: 2387748 - DNA, 22 bp, Homo sapiens
ggcagagcctttggatgaccag

SEQ ID NO: 2387749 - DNA, 19 bp, Homo sapiens
ggcagcccagcctctgtcc

SEQ ID NO: 2387750 - DNA, 14 bp, Homo sapiens
ggcaggaccaggac

SEQ ID NO: 2387751 - DNA, 15 bp, Homo sapiens
ggcaggggtgggaga

SEQ ID NO: 2387752 - DNA, 20 bp, Homo sapiens
ggcagtggtaagctctggct

SEQ ID NO: 2387753 - DNA, 14 bp, Homo sapiens
ggccaccaggatgg

SEQ ID NO: 2387754 - DNA, 19 bp, Homo sapiens
ggccactctcccctccctc

SEQ ID NO: 2387755 - DNA, 22 bp, Homo sapiens
ggccactctcccctccctcttc

SEQ ID NO: 2387756 - DNA, 19 bp, Homo sapiens
ggccaggcaggggtgggag

SEQ ID NO: 2387757 - DNA, 17 bp, Homo sapiens
ggccaggccaccaggat

SEQ ID NO: 2387758 - DNA, 17 bp, Homo sapiens
ggccaggggtctccctg

SEQ ID NO: 2387759 - DNA, 17 bp, Homo sapiens
ggccatgctgaagggac

SEQ ID NO: 2387760 - DNA, 15 bp, Homo sapiens
ggcctcacgcccagc

SEQ ID NO: 2387761 - DNA, 14 bp, Homo sapiens
ggcctgatgacaga

SEQ ID NO: 2387762 - DNA, 16 bp, Homo sapiens
ggcgagtgccaggact

SEQ ID NO: 2387763 - DNA, 18 bp, Homo sapiens
ggcgcctgtagtcccagc

SEQ ID NO: 2387764 - DNA, 18 bp, Homo sapiens
ggcgctctgccctccctg

SEQ ID NO: 2387765 - DNA, 20 bp, Homo sapiens
ggcgctctgccctccctggc

SEQ ID NO: 2387766 - DNA, 22 bp, Homo sapiens
ggcgctctgccctccctggcct

SEQ ID NO: 2387767 - DNA, 21 bp, Homo sapiens
ggcggagagtacagtgagcca

SEQ ID NO: 2387768 - DNA, 17 bp, Homo sapiens
ggcgggagtgggggctg

SEQ ID NO: 2387769 - DNA, 16 bp, Homo sapiens
ggcgggcagcccagcc

SEQ ID NO: 2387770 - DNA, 19 bp, Homo sapiens
ggctaattcccagagtgtg

SEQ ID NO: 2387771 - DNA, 19 bp, Homo sapiens
ggctatgtatggaatacag

SEQ ID NO: 2387772 - DNA, 11 bp, Homo sapiens
ggctgaaagcc

SEQ ID NO: 2387773 - DNA, 19 bp, Homo sapiens
ggctgaccccaaagagcct

SEQ ID NO: 2387774 - DNA, 15 bp, Homo sapiens
ggctgagacaggaga

SEQ ID NO: 2387775 - DNA, 21 bp, Homo sapiens
ggcttccaggtatctccagga

SEQ ID NO: 2387776 - DNA, 15 bp, Homo sapiens
gggaaaggatatttt

SEQ ID NO: 2387777 - DNA, 12 bp, Homo sapiens
gggaaccctgct

SEQ ID NO: 2387778 - DNA, 14 bp, Homo sapiens
gggagagccagctc

SEQ ID NO: 2387779 - DNA, 17 bp, Homo sapiens
gcaccagcttctccagg

SEQ ID NO: 2387780 - DNA, 18 bp, Homo sapiens
gcaccagcttctccaggc

SEQ ID NO: 2387781 - DNA, 20 bp, Homo sapiens
gcaccagcttctccaggctc

SEQ ID NO: 2387782 - DNA, 17 bp, Homo sapiens
gcaccccctcattcccc

SEQ ID NO: 2387783 - DNA, 14 bp, Homo sapiens
gcaccccctggaga

SEQ ID NO: 2387784 - DNA, 18 bp, Homo sapiens
gcacgcctgcccagcctc

SEQ ID NO: 2387785 - DNA, 23 bp, Homo sapiens
gcactcacccatgtgccaaggtg

SEQ ID NO: 2387786 - DNA, 23 bp, Homo sapiens
gcactgctaggcgagtgccagga

SEQ ID NO: 2387787 - DNA, 18 bp, Homo sapiens
gcactttaaccctctctt

SEQ ID NO: 2387788 - DNA, 21 bp, Homo sapiens
gcactttaaccctctcttccc

SEQ ID NO: 2387789 - DNA, 23 bp, Homo sapiens
gcactttaaccctctcttcccta

SEQ ID NO: 2387790 - DNA, 16 bp, Homo sapiens
gcagagaaagaagaga

SEQ ID NO: 2387791 - DNA, 18 bp, Homo sapiens
gcagagaaagaagagaca

SEQ ID NO: 2387792 - DNA, 23 bp, Homo sapiens
gcagagaaagaagagacaggagg

SEQ ID NO: 2387793 - DNA, 12 bp, Homo sapiens
gcagagagaagc

SEQ ID NO: 2387794 - DNA, 17 bp, Homo sapiens
gcagaggagtccagggc

SEQ ID NO: 2387795 - DNA, 20 bp, Homo sapiens
gcagaggtaaaagtgtgagc

SEQ ID NO: 2387796 - DNA, 21 bp, Homo sapiens
gcagaggtaaaagtgtgagca

SEQ ID NO: 2387797 - DNA, 15 bp, Homo sapiens
gcagatggaaagaaa

SEQ ID NO: 2387798 - DNA, 11 bp, Homo sapiens
gcagcacttta

SEQ ID NO: 2387799 - DNA, 21 bp, Homo sapiens
gcagcactttaaccctctctt

SEQ ID NO: 2387800 - DNA, 16 bp, Homo sapiens
gcagccaggaggagag

SEQ ID NO: 2387801 - DNA, 13 bp, Homo sapiens
gcagcccagcctc

SEQ ID NO: 2387802 - DNA, 15 bp, Homo sapiens
gcaggaactcccagc

SEQ ID NO: 2387803 - DNA, 15 bp, Homo sapiens
gcaggggtctgagcc

SEQ ID NO: 2387804 - DNA, 17 bp, Homo sapiens
gcaggggtgggagagcc

SEQ ID NO: 2387805 - DNA, 20 bp, Homo sapiens
gcaggggtgggagagccagc

SEQ ID NO: 2387806 - DNA, 15 bp, Homo sapiens
gcagttgacagcagg

SEQ ID NO: 2387807 - DNA, 15 bp, Homo sapiens
gcatgaaagagaaag

SEQ ID NO: 2387808 - DNA, 17 bp, Homo sapiens
gcatgctcagcccttcc

SEQ ID NO: 2387809 - DNA, 23 bp, Homo sapiens
gccaacaggtggcaggaccagga

SEQ ID NO: 2387810 - DNA, 17 bp, Homo sapiens
gccacctcttgggcatg

SEQ ID NO: 2387811 - DNA, 23 bp, Homo sapiens
gccactcgggaggctgagacagg

SEQ ID NO: 2387812 - DNA, 13 bp, Homo sapiens
gccactcttccaa

SEQ ID NO: 2387813 - DNA, 15 bp, Homo sapiens
gccaggactccccag

SEQ ID NO: 2387814 - DNA, 19 bp, Homo sapiens
gccaggactccccaggcca

SEQ ID NO: 2387815 - DNA, 14 bp, Homo sapiens
gccaggcaggggtg

SEQ ID NO: 2387816 - DNA, 20 bp, Homo sapiens
gccaggcaggggtgggagag

SEQ ID NO: 2387817 - DNA, 15 bp, Homo sapiens
gccaggccaccagga

SEQ ID NO: 2387818 - DNA, 16 bp, Homo sapiens
gccaggccaccaggat

SEQ ID NO: 2387819 - DNA, 13 bp, Homo sapiens
gccagggccaggg

SEQ ID NO: 2387820 - DNA, 18 bp, Homo sapiens
gccaggggtctccctgga

SEQ ID NO: 2387821 - DNA, 15 bp, Homo sapiens
gccagggtgagagct

SEQ ID NO: 2387822 - DNA, 17 bp, Homo sapiens
gccatcaacaagagttg

SEQ ID NO: 2387823 - DNA, 22 bp, Homo sapiens
gccatcagggtgggccactctc

SEQ ID NO: 2387824 - DNA, 23 bp, Homo sapiens
gccatcagggtgggccactctcc

SEQ ID NO: 2387825 - DNA, 20 bp, Homo sapiens
gcccagcctcctcccaccac

SEQ ID NO: 2387826 - DNA, 16 bp, Homo sapiens
gcccagcctctgtccc

SEQ ID NO: 2387827 - DNA, 13 bp, Homo sapiens
gccccaccagcca

SEQ ID NO: 2387828 - DNA, 17 bp, Homo sapiens
gccccaccagccacctc

SEQ ID NO: 2387829 - DNA, 18 bp, Homo sapiens
gccccaccagccacctct

SEQ ID NO: 2387830 - DNA, 19 bp, Homo sapiens
gccccgggcctgcctctga

SEQ ID NO: 2387831 - DNA, 23 bp, Homo sapiens
gccccgggcctgcctctgactca

SEQ ID NO: 2387832 - DNA, 13 bp, Homo sapiens
gccctccctggcc

SEQ ID NO: 2387833 - DNA, 12 bp, Homo sapiens
gcccttcccact

SEQ ID NO: 2387834 - DNA, 16 bp, Homo sapiens
gcccttcccactggag

SEQ ID NO: 2387835 - DNA, 13 bp, Homo sapiens
gcccttcctagaa

SEQ ID NO: 2387836 - DNA, 19 bp, Homo sapiens
gccgcgtggaatgtgagtg

SEQ ID NO: 2387837 - DNA, 19 bp, Homo sapiens
gccgggtgcggtggctcac

SEQ ID NO: 2387838 - DNA, 18 bp, Homo sapiens
gcctacattccctggcct

SEQ ID NO: 2387839 - DNA, 15 bp, Homo sapiens
gcctcacgcccagcc

SEQ ID NO: 2387840 - DNA, 18 bp, Homo sapiens
gcctcacgcccagcctcc

SEQ ID NO: 2387841 - DNA, 19 bp, Homo sapiens
gcctcacgcccagcctcct

SEQ ID NO: 2387842 - DNA, 19 bp, Homo sapiens
gtttacttttcagggcatc

SEQ ID NO: 2387843 - DNA, 22 bp, Homo sapiens
gtttccacgatgaaaaacttcc

SEQ ID NO: 2387844 - DNA, 14 bp, Homo sapiens
gtttcccaccacct

SEQ ID NO: 2387845 - DNA, 13 bp, Homo sapiens
gtttgtatattgt

SEQ ID NO: 2387846 - DNA, 23 bp, Homo sapiens
gttttgaactaataaaagcataa

SEQ ID NO: 2387847 - DNA, 12 bp, Homo sapiens
gttttttgaaaa

SEQ ID NO: 2387848 - DNA, 19 bp, Homo sapiens
taaaagcaattatattgtc

SEQ ID NO: 2387849 - DNA, 18 bp, Homo sapiens
taaaagcataaatgcaaa

SEQ ID NO: 2387850 - DNA, 18 bp, Homo sapiens
taaaagtgtgagcagtga

SEQ ID NO: 2387851 - DNA, 20 bp, Homo sapiens
taaaatcttggcacagaaac

SEQ ID NO: 2387852 - DNA, 12 bp, Homo sapiens
taaagagttctt

SEQ ID NO: 2387853 - DNA, 20 bp, Homo sapiens
taaaggttgacaataaatgt

SEQ ID NO: 2387854 - DNA, 17 bp, Homo sapiens
taaagttctgagtgttt

SEQ ID NO: 2387855 - DNA, 22 bp, Homo sapiens
taaagttgttcgccgcgtggaa

SEQ ID NO: 2387856 - DNA, 17 bp, Homo sapiens
taaatttatttcaaaaa

SEQ ID NO: 2387857 - DNA, 16 bp, Homo sapiens
taacactataaaggtt

SEQ ID NO: 2387858 - DNA, 19 bp, Homo sapiens
taaccctctcttccctatt

SEQ ID NO: 2387859 - DNA, 16 bp, Homo sapiens
taacttaaaatatttt

SEQ ID NO: 2387860 - DNA, 17 bp, Homo sapiens
taacttcaaatatagag

SEQ ID NO: 2387861 - DNA, 18 bp, Homo sapiens
taacttcaaatatagaga

SEQ ID NO: 2387862 - DNA, 19 bp, Homo sapiens
taagaccataacagccaac

SEQ ID NO: 2387863 - DNA, 20 bp, Homo sapiens
taagacgtgaatgtctcagc

SEQ ID NO: 2387864 - DNA, 15 bp, Homo sapiens
taaggattgtgatat

SEQ ID NO: 2387865 - DNA, 14 bp, Homo sapiens
taagtgttgtaaat

SEQ ID NO: 2387866 - DNA, 14 bp, Homo sapiens
taatctatttacat

SEQ ID NO: 2387867 - DNA, 15 bp, Homo sapiens
taatgagggactgga

SEQ ID NO: 2387868 - DNA, 16 bp, Homo sapiens
taattcttgtatatta

SEQ ID NO: 2387869 - DNA, 20 bp, Homo sapiens
tacactgaagttaacagaga

SEQ ID NO: 2387870 - DNA, 14 bp, Homo sapiens
tacagtgagccaag

SEQ ID NO: 2387871 - DNA, 19 bp, Homo sapiens
tacagtgttattttctttg

SEQ ID NO: 2387872 - DNA, 13 bp, Homo sapiens
tacatacagaggt

SEQ ID NO: 2387873 - DNA, 15 bp, Homo sapiens
tacattccctggcct

SEQ ID NO: 2387874 - DNA, 11 bp, Homo sapiens
taccagtgtgg

SEQ ID NO: 2387875 - DNA, 20 bp, Homo sapiens
tacccagagccttctcctgc

SEQ ID NO: 2387876 - DNA, 23 bp, Homo sapiens
tacccagagccttctcctgccta

SEQ ID NO: 2387877 - DNA, 13 bp, Homo sapiens
tacccggcccaga

SEQ ID NO: 2387878 - DNA, 14 bp, Homo sapiens
tacgttatatattg

SEQ ID NO: 2387879 - DNA, 23 bp, Homo sapiens
tactacagttgttttttgaaaac

SEQ ID NO: 2387880 - DNA, 16 bp, Homo sapiens
tgttttttgaaaacat

SEQ ID NO: 2387881 - DNA, 16 bp, Homo sapiens
ttaacaattccaaagg

SEQ ID NO: 2387882 - DNA, 13 bp, Homo sapiens
ttaaccagaataa

SEQ ID NO: 2387883 - DNA, 13 bp, Homo sapiens
ttaaccctctctt

SEQ ID NO: 2387884 - DNA, 19 bp, Homo sapiens
ttaagacgtgaatgtctca

SEQ ID NO: 2387885 - DNA, 20 bp, Homo sapiens
ttaaggattgtgatattttt

SEQ ID NO: 2387886 - DNA, 15 bp, Homo sapiens
ttacagcgagaggca

SEQ ID NO: 2387887 - DNA, 21 bp, Homo sapiens
ttacagcgagaggcagagaaa

SEQ ID NO: 2387888 - DNA, 16 bp, Homo sapiens
ttactatgcacaattt

SEQ ID NO: 2387889 - DNA, 15 bp, Homo sapiens
ttacttgaactttcc

SEQ ID NO: 2387890 - DNA, 19 bp, Homo sapiens
ttacttgcattgaatatat

SEQ ID NO: 2387891 - DNA, 15 bp, Homo sapiens
ttagctgtgtgaaat

SEQ ID NO: 2387892 - DNA, 14 bp, Homo sapiens
ttataagcagattt

SEQ ID NO: 2387893 - DNA, 15 bp, Homo sapiens
ttatgttacatctgt

SEQ ID NO: 2387894 - DNA, 13 bp, Homo sapiens
ttattgagaattt

SEQ ID NO: 2387895 - DNA, 16 bp, Homo sapiens
ttcaaaccaggatttt

SEQ ID NO: 2387896 - DNA, 13 bp, Homo sapiens
ttcagaaatatgt

SEQ ID NO: 2387897 - DNA, 14 bp, Homo sapiens
ttcaggaagatgaa

SEQ ID NO: 2387898 - DNA, 21 bp, Homo sapiens
ttcaggggggttgtgaggcct

SEQ ID NO: 2387899 - DNA, 14 bp, Homo sapiens
ttccacgatgaaaa

SEQ ID NO: 2387900 - DNA, 17 bp, Homo sapiens
ttccaggtatctccagg

SEQ ID NO: 2387901 - DNA, 18 bp, Homo sapiens
ttccatgaagaccacatc

SEQ ID NO: 2387902 - DNA, 17 bp, Homo sapiens
ttccccagactcagctc

SEQ ID NO: 2387903 - DNA, 21 bp, Homo sapiens
ttcccccatcccctttcctcc

SEQ ID NO: 2387904 - DNA, 17 bp, Homo sapiens
ttccctgaacatctgtg

SEQ ID NO: 2387905 - DNA, 18 bp, Homo sapiens
ttccctgaacatctgtgt

SEQ ID NO: 2387906 - DNA, 12 bp, Homo sapiens
ttccctggcctg

SEQ ID NO: 2387907 - DNA, 21 bp, Homo sapiens
agccaacagtcaaaacagaga

SEQ ID NO: 2387908 - DNA, 19 bp, Homo sapiens
agccactcgggaggctgag

SEQ ID NO: 2387909 - DNA, 21 bp, Homo sapiens
agccaggaggagaggaaagga

SEQ ID NO: 2387910 - DNA, 13 bp, Homo sapiens
agccagggccagg

SEQ ID NO: 2387911 - DNA, 14 bp, Homo sapiens
agccagggccaggg

SEQ ID NO: 2387912 - DNA, 21 bp, Homo sapiens
agcccagggcatcccatgggg

SEQ ID NO: 2387913 - DNA, 23 bp, Homo sapiens
agcccaggtcctctgatacccag

SEQ ID NO: 2387914 - DNA, 22 bp, Homo sapiens
agcctcctcccaccaccctccc

SEQ ID NO: 2387915 - DNA, 16 bp, Homo sapiens
agcctggggcatccca

SEQ ID NO: 2387916 - DNA, 16 bp, Homo sapiens
agccttgctcaggtgc

SEQ ID NO: 2387917 - DNA, 18 bp, Homo sapiens
agcctttggatgaccaga

SEQ ID NO: 2387918 - DNA, 17 bp, Homo sapiens
agctcacccaataaaca

SEQ ID NO: 2387919 - DNA, 13 bp, Homo sapiens
agctgaggggggc

SEQ ID NO: 2387920 - DNA, 23 bp, Homo sapiens
agctgaggggggccgtgcccagg

SEQ ID NO: 2387921 - DNA, 19 bp, Homo sapiens
agctggcaaaggtggctct

SEQ ID NO: 2387922 - DNA, 18 bp, Homo sapiens
agctgggggaagggtggt

SEQ ID NO: 2387923 - DNA, 15 bp, Homo sapiens
aggaaaaaaatgact

SEQ ID NO: 2387924 - DNA, 13 bp, Homo sapiens
aggaactcccagc

SEQ ID NO: 2387925 - DNA, 21 bp, Homo sapiens
aggaactctggcttccaggta

SEQ ID NO: 2387926 - DNA, 16 bp, Homo sapiens
aggactatagcccagg

SEQ ID NO: 2387927 - DNA, 16 bp, Homo sapiens
aggaggagaggaaagg

SEQ ID NO: 2387928 - DNA, 20 bp, Homo sapiens
aggagggcaagggccatgct

SEQ ID NO: 2387929 - DNA, 13 bp, Homo sapiens
aggaggtgaggga

SEQ ID NO: 2387930 - DNA, 14 bp, Homo sapiens
aggaggtgagggat

SEQ ID NO: 2387931 - DNA, 20 bp, Homo sapiens
aggatcctattctcaccagg

SEQ ID NO: 2387932 - DNA, 21 bp, Homo sapiens
aggatcctattctcaccagga

SEQ ID NO: 2387933 - DNA, 13 bp, Homo sapiens
aggattgaagagc

SEQ ID NO: 2387934 - DNA, 15 bp, Homo sapiens
aggcaccccctggag

SEQ ID NO: 2387935 - DNA, 20 bp, Homo sapiens
aggcaccccctggagagaag

SEQ ID NO: 2387936 - DNA, 17 bp, Homo sapiens
aggcagagaaagaagag

SEQ ID NO: 2387937 - DNA, 23 bp, Homo sapiens
aggcaggggtgggagagccagct

SEQ ID NO: 2387938 - DNA, 12 bp, Homo sapiens
aggccaccagga

SEQ ID NO: 2387939 - DNA, 13 bp, Homo sapiens
aggccaccaggat

SEQ ID NO: 2387940 - DNA, 16 bp, Homo sapiens
aggccaggccaccagg

SEQ ID NO: 2387941 - DNA, 17 bp, Homo sapiens
aggccaggccaccagga

SEQ ID NO: 2387942 - DNA, 19 bp, Homo sapiens
aggccaggccaccaggatg

SEQ ID NO: 2387943 - DNA, 11 bp, Homo sapiens
aggcctggcca

SEQ ID NO: 2387944 - DNA, 14 bp, Homo sapiens
aggcgagtgccagg

SEQ ID NO: 2387945 - DNA, 13 bp, Homo sapiens
aggctgagacagg

SEQ ID NO: 2387946 - DNA, 15 bp, Homo sapiens
aggctgagacaggag

SEQ ID NO: 2387947 - DNA, 18 bp, Homo sapiens
aggctgagacaggagaat

SEQ ID NO: 2387948 - DNA, 14 bp, Homo sapiens
aggctggagaagct

SEQ ID NO: 2387949 - DNA, 16 bp, Homo sapiens
agggaaactattgtcc

SEQ ID NO: 2387950 - DNA, 15 bp, Homo sapiens
agggaagacaggtct

SEQ ID NO: 2387951 - DNA, 15 bp, Homo sapiens
agggaccttgaaggg

SEQ ID NO: 2387952 - DNA, 15 bp, Homo sapiens
agggactggaaccag

SEQ ID NO: 2387953 - DNA, 15 bp, Homo sapiens
agggagaaggatcta

SEQ ID NO: 2387954 - DNA, 16 bp, Homo sapiens
agggagaaggatctag

SEQ ID NO: 2387955 - DNA, 19 bp, Homo sapiens
agggatcttgcattcccag

SEQ ID NO: 2387956 - DNA, 20 bp, Homo sapiens
agggatcttgcattcccagt

SEQ ID NO: 2387957 - DNA, 22 bp, Homo sapiens
agggatcttgcattcccagtgg

SEQ ID NO: 2387958 - DNA, 23 bp, Homo sapiens
agggatgtgaattgcctgcagag

SEQ ID NO: 2387959 - DNA, 22 bp, Homo sapiens
agggcaagggccatgctgaagg

SEQ ID NO: 2387960 - DNA, 17 bp, Homo sapiens
agggcatcttagcttct

SEQ ID NO: 2387961 - DNA, 20 bp, Homo sapiens
agggccaggggtctccctgg

SEQ ID NO: 2387962 - DNA, 23 bp, Homo sapiens
agggcgtcgctggacaacccaga

SEQ ID NO: 2387963 - DNA, 22 bp, Homo sapiens
agggctggactctggcacccag

SEQ ID NO: 2387964 - DNA, 20 bp, Homo sapiens
aggggcacgcctgcccagcc

SEQ ID NO: 2387965 - DNA, 22 bp, Homo sapiens
aggggcacgcctgcccagcctc

SEQ ID NO: 2387966 - DNA, 21 bp, Homo sapiens
aggggggttgtgaggcctggc

SEQ ID NO: 2387967 - DNA, 23 bp, Homo sapiens
agggtcgccacacccggctcccc

SEQ ID NO: 2387968 - DNA, 18 bp, Homo sapiens
agggtgggccactctccc

SEQ ID NO: 2387969 - DNA, 23 bp, Homo sapiens
agggtgggccactctcccctccc

SEQ ID NO: 2387970 - DNA, 18 bp, Homo sapiens
agggttactatgcacaat

SEQ ID NO: 2387971 - DNA, 21 bp, Homo sapiens
agggttgttaatggtgcaaat

SEQ ID NO: 2387972 - DNA, 17 bp, Homo sapiens
aggtaactatcaatatt

SEQ ID NO: 2387973 - DNA, 21 bp, Homo sapiens
aggtagagtttgaaggaggtg

SEQ ID NO: 2387974 - DNA, 15 bp, Homo sapiens
aggtatctccaggat

SEQ ID NO: 2387975 - DNA, 19 bp, Homo sapiens
aggtcactagatggcgagc

SEQ ID NO: 2387976 - DNA, 16 bp, Homo sapiens
aggtctagactttctc

SEQ ID NO: 2387977 - DNA, 16 bp, Homo sapiens
aggtcttcagccatca

SEQ ID NO: 2387978 - DNA, 19 bp, Homo sapiens
aggtggctctccagttagt

SEQ ID NO: 2387979 - DNA, 23 bp, Homo sapiens
aggtgggaaatggtatgagctga

SEQ ID NO: 2387980 - DNA, 14 bp, Homo sapiens
aggtgtaaagttgt

SEQ ID NO: 2387981 - DNA, 16 bp, Homo sapiens
aggttccctctgagaa

SEQ ID NO: 2387982 - DNA, 13 bp, Homo sapiens
aggtttgtatatt

SEQ ID NO: 2387983 - DNA, 18 bp, Homo sapiens
agtataaatggttgtctg

SEQ ID NO: 2387984 - DNA, 14 bp, Homo sapiens
agtcaaaacagaga

SEQ ID NO: 2387985 - DNA, 14 bp, Homo sapiens
agtgcaatgcgtgt

SEQ ID NO: 2387986 - DNA, 17 bp, Homo sapiens
agtgggctgcatctggg

SEQ ID NO: 2387987 - DNA, 18 bp, Homo sapiens
agtgggtggtggatctgt

SEQ ID NO: 2387988 - DNA, 22 bp, Homo sapiens
agtgttattttctttgaaattg

SEQ ID NO: 2387989 - DNA, 19 bp, Homo sapiens
agtgtttcgacagctgatt

SEQ ID NO: 2387990 - DNA, 22 bp, Homo sapiens
agttacagcgagaggcagagaa

SEQ ID NO: 2387991 - DNA, 21 bp, Homo sapiens
agttagtgtgttgtctgtgca

SEQ ID NO: 2387992 - DNA, 14 bp, Homo sapiens
agttctagagaaga

SEQ ID NO: 2387993 - DNA, 17 bp, Homo sapiens
agttctagagaagaggc

SEQ ID NO: 2387994 - DNA, 14 bp, Homo sapiens
agttctgagtgttt

SEQ ID NO: 2387995 - DNA, 21 bp, Homo sapiens
agttgttcgccgcgtggaatg

SEQ ID NO: 2387996 - DNA, 19 bp, Homo sapiens
agtttagaggaaaaaaatg

SEQ ID NO: 2387997 - DNA, 21 bp, Homo sapiens
agtttagaggaaaaaaatgac

SEQ ID NO: 2387998 - DNA, 12 bp, Homo sapiens
agtttcagagaa

SEQ ID NO: 2387999 - DNA, 16 bp, Homo sapiens
agtttctggccctggc

SEQ ID NO: 2388000 - DNA, 21 bp, Homo sapiens
agtttgaaggaggtgagggat

SEQ ID NO: 2388001 - DNA, 21 bp, Homo sapiens
agttttattgagaattttaaa

SEQ ID NO: 2388002 - DNA, 20 bp, Homo sapiens
ataaaagcataaatgcaaac

SEQ ID NO: 2388003 - DNA, 21 bp, Homo sapiens
ataaaggttgacaataaatgt

SEQ ID NO: 2388004 - DNA, 21 bp, Homo sapiens
ataaagttctgagtgttttta

SEQ ID NO: 2388005 - DNA, 19 bp, Homo sapiens
ataacttaaaaaaatgaca

SEQ ID NO: 2388006 - DNA, 19 bp, Homo sapiens
ataattttatgaatgtctt

SEQ ID NO: 2388007 - DNA, 18 bp, Homo sapiens
ataatttttaaagtatat

SEQ ID NO: 2388008 - DNA, 21 bp, Homo sapiens
ataatttttaaagtatatatt

SEQ ID NO: 2388009 - DNA, 23 bp, Homo sapiens
atacagtgttattttctttgaaa

SEQ ID NO: 2388010 - DNA, 20 bp, Homo sapiens
atagagatatttttgtacgt

SEQ ID NO: 2388011 - DNA, 22 bp, Homo sapiens
atagccacatccctttgaaaca

SEQ ID NO: 2388012 - DNA, 14 bp, Homo sapiens
atagcccaggtcct

SEQ ID NO: 2388013 - DNA, 13 bp, Homo sapiens
ataggctggagaa

SEQ ID NO: 2388014 - DNA, 16 bp, Homo sapiens
atattatggaagattt

SEQ ID NO: 2388015 - DNA, 18 bp, Homo sapiens
atcactggcaatgaaaaa

SEQ ID NO: 2388016 - DNA, 20 bp, Homo sapiens
cggtggctcacgcctgtaat

SEQ ID NO: 2388017 - DNA, 20 bp, Homo sapiens
cgtcgctggacaacccagaa

SEQ ID NO: 2388018 - DNA, 14 bp, Homo sapiens
cgtgaactgcgtgc

SEQ ID NO: 2388019 - DNA, 21 bp, Homo sapiens
cgtgagccaggtaatgaggga

SEQ ID NO: 2388020 - DNA, 14 bp, Homo sapiens
cgttatatattgta

SEQ ID NO: 2388021 - DNA, 22 bp, Homo sapiens
ctaaaaatattataacttaaaa

SEQ ID NO: 2388022 - DNA, 13 bp, Homo sapiens
ctaataaaagcat

SEQ ID NO: 2388023 - DNA, 14 bp, Homo sapiens
ctaattcccagagt

SEQ ID NO: 2388024 - DNA, 22 bp, Homo sapiens
ctacattccctggcctggctct

SEQ ID NO: 2388025 - DNA, 20 bp, Homo sapiens
ctacccagagccttctcctg

SEQ ID NO: 2388026 - DNA, 14 bp, Homo sapiens
ctacccggcccaga

SEQ ID NO: 2388027 - DNA, 16 bp, Homo sapiens
ctacccggcccagaga

SEQ ID NO: 2388028 - DNA, 22 bp, Homo sapiens
ctactctcaggatcaagaaagt

SEQ ID NO: 2388029 - DNA, 20 bp, Homo sapiens
ctacttttgtaccagtgtga

SEQ ID NO: 2388030 - DNA, 12 bp, Homo sapiens
ctagagaagagg

SEQ ID NO: 2388031 - DNA, 17 bp, Homo sapiens
ctagagaagaggctggt

SEQ ID NO: 2388032 - DNA, 16 bp, Homo sapiens
ctaggcgagtgccagg

SEQ ID NO: 2388033 - DNA, 16 bp, Homo sapiens
ctagggagtggtcttt

SEQ ID NO: 2388034 - DNA, 15 bp, Homo sapiens
ctatcaatatttaag

SEQ ID NO: 2388035 - DNA, 18 bp, Homo sapiens
ctatcaatatttaagttt

SEQ ID NO: 2388036 - DNA, 22 bp, Homo sapiens
ctattgtcccctagcaaggcat

SEQ ID NO: 2388037 - DNA, 19 bp, Homo sapiens
ctattttaagacgtgaatg

SEQ ID NO: 2388038 - DNA, 20 bp, Homo sapiens
ctcaacctctctccttctgg

SEQ ID NO: 2388039 - DNA, 14 bp, Homo sapiens
ctcaatgtgaccag

SEQ ID NO: 2388040 - DNA, 18 bp, Homo sapiens
ctcaatgtgaccaggggt

SEQ ID NO: 2388041 - DNA, 21 bp, Homo sapiens
ctcacacttgggcgctctgcc

SEQ ID NO: 2388042 - DNA, 23 bp, Homo sapiens
ctcacacttgggcgctctgccct

SEQ ID NO: 2388043 - DNA, 14 bp, Homo sapiens
ctcacgcccagcct

SEQ ID NO: 2388044 - DNA, 18 bp, Homo sapiens
ctcacgcccagcctcctc

SEQ ID NO: 2388045 - DNA, 22 bp, Homo sapiens
ctcacgcccagcctcctcccac

SEQ ID NO: 2388046 - DNA, 17 bp, Homo sapiens
ctcagccccgggcctgc

SEQ ID NO: 2388047 - DNA, 20 bp, Homo sapiens
ctcagccccgggcctgcctc

SEQ ID NO: 2388048 - DNA, 18 bp, Homo sapiens
ctcagccctgactggtgc

SEQ ID NO: 2388049 - DNA, 22 bp, Homo sapiens
ctcagctccagaataccttctt

SEQ ID NO: 2388050 - DNA, 22 bp, Homo sapiens
ctcagtgggacaaaccagagca

SEQ ID NO: 2388051 - DNA, 14 bp, Homo sapiens
ctcattcccctcgt

SEQ ID NO: 2388052 - DNA, 19 bp, Homo sapiens
ctccaggattgaagagcat

SEQ ID NO: 2388053 - DNA, 14 bp, Homo sapiens
ctcccaccatgcgc

SEQ ID NO: 2388054 - DNA, 15 bp, Homo sapiens
ctcccctattttaag

SEQ ID NO: 2388055 - DNA, 16 bp, Homo sapiens
ctccctcttccttccc

SEQ ID NO: 2388056 - DNA, 12 bp, Homo sapiens
ctccctggagtg

SEQ ID NO: 2388057 - DNA, 12 bp, Homo sapiens
ctccctggcctc

SEQ ID NO: 2388058 - DNA, 20 bp, Homo sapiens
ctccggcctgatgacagagc

SEQ ID NO: 2388059 - DNA, 15 bp, Homo sapiens
ctcctcactgcccca

SEQ ID NO: 2388060 - DNA, 12 bp, Homo sapiens
ctcctcccacca

SEQ ID NO: 2388061 - DNA, 13 bp, Homo sapiens
ctcctgcctacat

SEQ ID NO: 2388062 - DNA, 19 bp, Homo sapiens
ctcgggaggctgagacagg

SEQ ID NO: 2388063 - DNA, 17 bp, Homo sapiens
ctctcccctccctcttc

SEQ ID NO: 2388064 - DNA, 19 bp, Homo sapiens
ctctcccctccctcttcct

SEQ ID NO: 2388065 - DNA, 22 bp, Homo sapiens
ctctcccctccctcttccttcc

SEQ ID NO: 2388066 - DNA, 17 bp, Homo sapiens
ctctcgtaactggtttc

SEQ ID NO: 2388067 - DNA, 22 bp, Homo sapiens
ctctgacagccctgcggagacc

SEQ ID NO: 2388068 - DNA, 18 bp, Homo sapiens
ctctggaaaactcaggat

SEQ ID NO: 2388069 - DNA, 21 bp, Homo sapiens
ctctggaaaactcaggattct

SEQ ID NO: 2388070 - DNA, 20 bp, Homo sapiens
ctctggaaaatgtgacccag

SEQ ID NO: 2388071 - DNA, 12 bp, Homo sapiens
ctctggcttcca

SEQ ID NO: 2388072 - DNA, 13 bp, Homo sapiens
ctctgtccctctt

SEQ ID NO: 2388073 - DNA, 18 bp, Homo sapiens
ctctgtccctctttgcct

SEQ ID NO: 2388074 - DNA, 20 bp, Homo sapiens
ctctgtccctctttgcctgt

SEQ ID NO: 2388075 - DNA, 14 bp, Homo sapiens
ctctttgcctgtgt

SEQ ID NO: 2388076 - DNA, 16 bp, Homo sapiens
ctctttgcctgtgtga

SEQ ID NO: 2388077 - DNA, 20 bp, Homo sapiens
ctctttgcctgtgtgagcat

SEQ ID NO: 2388078 - DNA, 23 bp, Homo sapiens
ctgaaagccatttgttggggcag

SEQ ID NO: 2388079 - DNA, 19 bp, Homo sapiens
ctgaaatctcagaattcct

SEQ ID NO: 2388080 - DNA, 19 bp, Homo sapiens
ctgaacatctgtgtgtgtc

SEQ ID NO: 2388081 - DNA, 16 bp, Homo sapiens
ctgaagttaacagaga

SEQ ID NO: 2388082 - DNA, 14 bp, Homo sapiens
ctgaatggtccagg

SEQ ID NO: 2388083 - DNA, 20 bp, Homo sapiens
ctgaccccaaagagcctgga

SEQ ID NO: 2388084 - DNA, 22 bp, Homo sapiens
ctgagaatttaaaaataagaaa

SEQ ID NO: 2388085 - DNA, 20 bp, Homo sapiens
ctgagacctgacaagcactg

SEQ ID NO: 2388086 - DNA, 17 bp, Homo sapiens
ctgagcaagagctggca

SEQ ID NO: 2388087 - DNA, 14 bp, Homo sapiens
ctgagcaccccctc

SEQ ID NO: 2388088 - DNA, 21 bp, Homo sapiens
ctgagcaccccctcattcccc

SEQ ID NO: 2388089 - DNA, 13 bp, Homo sapiens
ctgagcacctgct

SEQ ID NO: 2388090 - DNA, 15 bp, Homo sapiens
ctgatacccagagca

SEQ ID NO: 2388091 - DNA, 17 bp, Homo sapiens
ctgatgacagagcgaga

SEQ ID NO: 2388092 - DNA, 22 bp, Homo sapiens
ctgatgctttgcttcaaatcca

SEQ ID NO: 2388093 - DNA, 20 bp, Homo sapiens
ctgcaattgcttaggatgtt

SEQ ID NO: 2388094 - DNA, 19 bp, Homo sapiens
ctgcagcactttaaccctc

SEQ ID NO: 2388095 - DNA, 14 bp, Homo sapiens
ctgccaccatcctg

SEQ ID NO: 2388096 - DNA, 14 bp, Homo sapiens
ctgccccaccagcc

SEQ ID NO: 2388097 - DNA, 16 bp, Homo sapiens
ctgccccaccagccac

SEQ ID NO: 2388098 - DNA, 13 bp, Homo sapiens
ctgccctcaggga

SEQ ID NO: 2388099 - DNA, 15 bp, Homo sapiens
ctgcctacattccct

SEQ ID NO: 2388100 - DNA, 17 bp, Homo sapiens
ctgcgatcttcagagca

SEQ ID NO: 2388101 - DNA, 19 bp, Homo sapiens
ctgcgtgccagtgtcccca

SEQ ID NO: 2388102 - DNA, 18 bp, Homo sapiens
ctgctaggcgagtgccag

SEQ ID NO: 2388103 - DNA, 20 bp, Homo sapiens
ctgctaggcgagtgccagga

SEQ ID NO: 2388104 - DNA, 22 bp, Homo sapiens
ctgctaggcgagtgccaggact

SEQ ID NO: 2388105 - DNA, 15 bp, Homo sapiens
ctgctcaacctctct

SEQ ID NO: 2388106 - DNA, 18 bp, Homo sapiens
ctgctcaacctctctcct

SEQ ID NO: 2388107 - DNA, 15 bp, Homo sapiens
ctggaaaactcagga

SEQ ID NO: 2388108 - DNA, 15 bp, Homo sapiens
ctggaaaagaggagt

SEQ ID NO: 2388109 - DNA, 12 bp, Homo sapiens
ctggaagcacat

SEQ ID NO: 2388110 - DNA, 15 bp, Homo sapiens
ctggaagcacatgtt

SEQ ID NO: 2388111 - DNA, 12 bp, Homo sapiens
ctggacaaccca

SEQ ID NO: 2388112 - DNA, 16 bp, Homo sapiens
ctggacaacccagaac

SEQ ID NO: 2388113 - DNA, 22 bp, Homo sapiens
ctggacgcccagctgaggctgg

SEQ ID NO: 2388114 - DNA, 14 bp, Homo sapiens
ctggactctggcac

SEQ ID NO: 2388115 - DNA, 13 bp, Homo sapiens
ctggagaagctga

SEQ ID NO: 2388116 - DNA, 15 bp, Homo sapiens
ctggagaagctgatg

SEQ ID NO: 2388117 - DNA, 17 bp, Homo sapiens
ctggagaagctgatgct

SEQ ID NO: 2388118 - DNA, 13 bp, Homo sapiens
ctggagtgcagtt

SEQ ID NO: 2388119 - DNA, 21 bp, Homo sapiens
ctggatggatttgaagcaaag

SEQ ID NO: 2388120 - DNA, 18 bp, Homo sapiens
ctggcaaaggtggctctc

SEQ ID NO: 2388121 - DNA, 22 bp, Homo sapiens
ctggcctcacgcccagcctcct

SEQ ID NO: 2388122 - DNA, 19 bp, Homo sapiens
ctggcgcaagagaacattt

SEQ ID NO: 2388123 - DNA, 14 bp, Homo sapiens
ctggcttccaggta

SEQ ID NO: 2388124 - DNA, 23 bp, Homo sapiens
ctggcttccaggtatctccagga

SEQ ID NO: 2388125 - DNA, 17 bp, Homo sapiens
ctgggaaataagagaga

SEQ ID NO: 2388126 - DNA, 23 bp, Homo sapiens
gagaggaaaggacatgggtagca

SEQ ID NO: 2388127 - DNA, 16 bp, Homo sapiens
gagaggcagagaaaga

SEQ ID NO: 2388128 - DNA, 19 bp, Homo sapiens
gagagtacagtgagccaag

SEQ ID NO: 2388129 - DNA, 12 bp, Homo sapiens
gagatgcagagg

SEQ ID NO: 2388130 - DNA, 16 bp, Homo sapiens
gagatgcagaggtaaa

SEQ ID NO: 2388131 - DNA, 14 bp, Homo sapiens
gagattgggcctcc

SEQ ID NO: 2388132 - DNA, 12 bp, Homo sapiens
gagcaagagctg

SEQ ID NO: 2388133 - DNA, 12 bp, Homo sapiens
gagcaccccctc

SEQ ID NO: 2388134 - DNA, 18 bp, Homo sapiens
gagcaccccctcattccc

SEQ ID NO: 2388135 - DNA, 19 bp, Homo sapiens
gagcagaggagtccagggc

SEQ ID NO: 2388136 - DNA, 17 bp, Homo sapiens
gagcaggggtctgagcc

SEQ ID NO: 2388137 - DNA, 15 bp, Homo sapiens
gagcctggagaagct

SEQ ID NO: 2388138 - DNA, 17 bp, Homo sapiens
gagcctttggatgacca

SEQ ID NO: 2388139 - DNA, 18 bp, Homo sapiens
gagcgctttctggaaaag

SEQ ID NO: 2388140 - DNA, 16 bp, Homo sapiens
gaggcagagaaagaag

SEQ ID NO: 2388141 - DNA, 20 bp, Homo sapiens
gaggcctgccctcagggatc

SEQ ID NO: 2388142 - DNA, 13 bp, Homo sapiens
gaggcctggccag

SEQ ID NO: 2388143 - DNA, 17 bp, Homo sapiens
gaggcctggccaggcac

SEQ ID NO: 2388144 - DNA, 16 bp, Homo sapiens
gaggctgagacaggag

SEQ ID NO: 2388145 - DNA, 14 bp, Homo sapiens
gaggggtaggcaga

SEQ ID NO: 2388146 - DNA, 19 bp, Homo sapiens
gagggtcgccacacccggc

SEQ ID NO: 2388147 - DNA, 20 bp, Homo sapiens
gagggttgggttcatctgag

SEQ ID NO: 2388148 - DNA, 18 bp, Homo sapiens
gaggtaactatcaatatt

SEQ ID NO: 2388149 - DNA, 19 bp, Homo sapiens
gaggtagagtttgaaggag

SEQ ID NO: 2388150 - DNA, 12 bp, Homo sapiens
gaggtgagcaga

SEQ ID NO: 2388151 - DNA, 15 bp, Homo sapiens
gagtccagggcggga

SEQ ID NO: 2388152 - DNA, 15 bp, Homo sapiens
gagtgacggtcccac

SEQ ID NO: 2388153 - DNA, 20 bp, Homo sapiens
gagtgacggtcccacactgg

SEQ ID NO: 2388154 - DNA, 18 bp, Homo sapiens
gagtgactcgagggttgg

SEQ ID NO: 2388155 - DNA, 14 bp, Homo sapiens
gagtgccaggactc

SEQ ID NO: 2388156 - DNA, 20 bp, Homo sapiens
gagtgccaggactccccagg

SEQ ID NO: 2388157 - DNA, 22 bp, Homo sapiens
gagtggatctccaaggaccagg

SEQ ID NO: 2388158 - DNA, 20 bp, Homo sapiens
gagttacagcgagaggcaga

SEQ ID NO: 2388159 - DNA, 17 bp, Homo sapiens
gagttccatgaagacca

SEQ ID NO: 2388160 - DNA, 21 bp, Homo sapiens
gagttcttaaggattgtgata

SEQ ID NO: 2388161 - DNA, 15 bp, Homo sapiens
gagtttcgaggtaga

SEQ ID NO: 2388162 - DNA, 11 bp, Homo sapiens
gataactctcc

SEQ ID NO: 2388163 - DNA, 21 bp, Homo sapiens
gatattttttcagaaatatgt

SEQ ID NO: 2388164 - DNA, 13 bp, Homo sapiens
gatcattttctta

SEQ ID NO: 2388165 - DNA, 20 bp, Homo sapiens
gatcctattctcaccaggaa

SEQ ID NO: 2388166 - DNA, 21 bp, Homo sapiens
gatctagaatgtgttttctga

SEQ ID NO: 2388167 - DNA, 22 bp, Homo sapiens
gatctagaatgtgttttctgaa

SEQ ID NO: 2388168 - DNA, 14 bp, Homo sapiens
gatcttcagagcag

SEQ ID NO: 2388169 - DNA, 23 bp, Homo sapiens
gatgcagaggtaaaagtgtgagc

SEQ ID NO: 2388170 - DNA, 15 bp, Homo sapiens
gatggaaagaaagca

SEQ ID NO: 2388171 - DNA, 15 bp, Homo sapiens
gatggcccttcccac

SEQ ID NO: 2388172 - DNA, 21 bp, Homo sapiens
gatgtgaattgcctgcagaga

SEQ ID NO: 2388173 - DNA, 14 bp, Homo sapiens
gatgttaaccagaa

SEQ ID NO: 2388174 - DNA, 16 bp, Homo sapiens
gatgtttttcatgaaa

SEQ ID NO: 2388175 - DNA, 15 bp, Homo sapiens
gatttaactgtgaac

SEQ ID NO: 2388176 - DNA, 21 bp, Homo sapiens
gattttttttgtaacttcaaa

SEQ ID NO: 2388177 - DNA, 13 bp, Homo sapiens
gcaaagcaccagc

SEQ ID NO: 2388178 - DNA, 21 bp, Homo sapiens
gcaaagcaccagcttctccag

SEQ ID NO: 2388179 - DNA, 22 bp, Homo sapiens
gcaaagcaccagcttctccagg

SEQ ID NO: 2388180 - DNA, 23 bp, Homo sapiens
gcaaagcaccagcttctccaggc

SEQ ID NO: 2388181 - DNA, 16 bp, Homo sapiens
gcaacacaagctggaa

SEQ ID NO: 2388182 - DNA, 17 bp, Homo sapiens
gcaacacaagctggaag

SEQ ID NO: 2388183 - DNA, 23 bp, Homo sapiens
gcaacacaagctggaagcacatg

SEQ ID NO: 2388184 - DNA, 20 bp, Homo sapiens
gcaagttctagagaagaggc

SEQ ID NO: 2388185 - DNA, 21 bp, Homo sapiens
gcaagttctagagaagaggct

SEQ ID NO: 2388186 - DNA, 15 bp, Homo sapiens
gcaatgaaaaattct

SEQ ID NO: 2388187 - DNA, 20 bp, Homo sapiens
gcacagaaacacaatatttt

SEQ ID NO: 2388188 - DNA, 16 bp, Homo sapiens
gcaccagcttctccag

SEQ ID NO: 2388189 - DNA, 14 bp, Homo sapiens
gcacgtcccatgtg

SEQ ID NO: 2388190 - DNA, 15 bp, Homo sapiens
gcagaagggagaagg

SEQ ID NO: 2388191 - DNA, 13 bp, Homo sapiens
gcagagagaagcc

SEQ ID NO: 2388192 - DNA, 14 bp, Homo sapiens
gcagagagaagcct

SEQ ID NO: 2388193 - DNA, 16 bp, Homo sapiens
gcagagagaagcctgt

SEQ ID NO: 2388194 - DNA, 19 bp, Homo sapiens
gcagaggggtaggcagagc

SEQ ID NO: 2388195 - DNA, 23 bp, Homo sapiens
gcagaggtaaaagtgtgagcagt

SEQ ID NO: 2388196 - DNA, 14 bp, Homo sapiens
gcagcccagcctct

SEQ ID NO: 2388197 - DNA, 22 bp, Homo sapiens
gcagcctggtagaattgggaag

SEQ ID NO: 2388198 - DNA, 14 bp, Homo sapiens
gcaggaactcccag

SEQ ID NO: 2388199 - DNA, 15 bp, Homo sapiens
gcaggacaggagaca

SEQ ID NO: 2388200 - DNA, 14 bp, Homo sapiens
gcaggggtctgagc

SEQ ID NO: 2388201 - DNA, 17 bp, Homo sapiens
gcaggggtctgagccac

SEQ ID NO: 2388202 - DNA, 15 bp, Homo sapiens
gcaggggtgggagag

SEQ ID NO: 2388203 - DNA, 18 bp, Homo sapiens
gcaggggtgggagagcca

SEQ ID NO: 2388204 - DNA, 19 bp, Homo sapiens
gcaggggtgggagagccag

SEQ ID NO: 2388205 - DNA, 21 bp, Homo sapiens
gcaggtggtcctgagacctga

SEQ ID NO: 2388206 - DNA, 18 bp, Homo sapiens
gcagtggtaagctctggc

SEQ ID NO: 2388207 - DNA, 15 bp, Homo sapiens
gcatgccagagcctg

SEQ ID NO: 2388208 - DNA, 20 bp, Homo sapiens
gcatgccagagcctggggca

SEQ ID NO: 2388209 - DNA, 16 bp, Homo sapiens
gcatgctcagcccttc

SEQ ID NO: 2388210 - DNA, 22 bp, Homo sapiens
gcatgctcagcccttcctagaa

SEQ ID NO: 2388211 - DNA, 13 bp, Homo sapiens
gcatggtgcagtt

SEQ ID NO: 2388212 - DNA, 18 bp, Homo sapiens
gcattacgtgagccaggt

SEQ ID NO: 2388213 - DNA, 16 bp, Homo sapiens
gcattcctacaaagat

SEQ ID NO: 2388214 - DNA, 19 bp, Homo sapiens
gcattcctacaaagatgtt

SEQ ID NO: 2388215 - DNA, 13 bp, Homo sapiens
gcattgcatggac

SEQ ID NO: 2388216 - DNA, 12 bp, Homo sapiens
gcattttattct

SEQ ID NO: 2388217 - DNA, 20 bp, Homo sapiens
gccaacagtcaaaacagaga

SEQ ID NO: 2388218 - DNA, 18 bp, Homo sapiens
gccaagatcgcgccactg

SEQ ID NO: 2388219 - DNA, 15 bp, Homo sapiens
gccacacccggctcc

SEQ ID NO: 2388220 - DNA, 22 bp, Homo sapiens
gccacacccggctccccctgct

SEQ ID NO: 2388221 - DNA, 12 bp, Homo sapiens
gccaccaggatg

SEQ ID NO: 2388222 - DNA, 17 bp, Homo sapiens
gccaccaggatggccct

SEQ ID NO: 2388223 - DNA, 15 bp, Homo sapiens
gccacctcttgggca

SEQ ID NO: 2388224 - DNA, 22 bp, Homo sapiens
gccactctcccctccctcttcc

SEQ ID NO: 2388225 - DNA, 15 bp, Homo sapiens
gccactgcactccgg

SEQ ID NO: 2388226 - DNA, 21 bp, Homo sapiens
gccagaaggggcacgcctgcc

SEQ ID NO: 2388227 - DNA, 16 bp, Homo sapiens
gccagagcctggggca

SEQ ID NO: 2388228 - DNA, 19 bp, Homo sapiens
gccagagcctggggcatcc

SEQ ID NO: 2388229 - DNA, 21 bp, Homo sapiens
gccaggggtctccctggagtg

SEQ ID NO: 2388230 - DNA, 16 bp, Homo sapiens
gccaggtaatgaggga

SEQ ID NO: 2388231 - DNA, 14 bp, Homo sapiens
gccatgctgaaggg

SEQ ID NO: 2388232 - DNA, 14 bp, Homo sapiens
gcccacaaactgat

SEQ ID NO: 2388233 - DNA, 12 bp, Homo sapiens
gcccacagggaa

SEQ ID NO: 2388234 - DNA, 16 bp, Homo sapiens
gcccagagaccccttc

SEQ ID NO: 2388235 - DNA, 18 bp, Homo sapiens
gcccagagaccccttcct

SEQ ID NO: 2388236 - DNA, 20 bp, Homo sapiens
tcaacctctctccttctggc

SEQ ID NO: 2388237 - DNA, 21 bp, Homo sapiens
tcaagattttttttgtaactt

SEQ ID NO: 2388238 - DNA, 13 bp, Homo sapiens
tcaatatttaagt

SEQ ID NO: 2388239 - DNA, 21 bp, Homo sapiens
tcaatttccctgactcctcta

SEQ ID NO: 2388240 - DNA, 16 bp, Homo sapiens
tcacaatagaaactca

SEQ ID NO: 2388241 - DNA, 11 bp, Homo sapiens
tcacagtgttt

SEQ ID NO: 2388242 - DNA, 13 bp, Homo sapiens
tcacattcaggaa

SEQ ID NO: 2388243 - DNA, 21 bp, Homo sapiens
tcaccacttcaatagatcaaa

SEQ ID NO: 2388244 - DNA, 21 bp, Homo sapiens
tcacgcccagcctcctcccac

SEQ ID NO: 2388245 - DNA, 19 bp, Homo sapiens
tcacgcctgtaatcccagc

SEQ ID NO: 2388246 - DNA, 21 bp, Homo sapiens
tcacgcctgtaatcccagcac

SEQ ID NO: 2388247 - DNA, 17 bp, Homo sapiens
tcactagatggcgagca

SEQ ID NO: 2388248 - DNA, 16 bp, Homo sapiens
tcactattacttgaac

SEQ ID NO: 2388249 - DNA, 12 bp, Homo sapiens
tcagaaatatgt

SEQ ID NO: 2388250 - DNA, 14 bp, Homo sapiens
tcagagcaggggtc

SEQ ID NO: 2388251 - DNA, 23 bp, Homo sapiens
tcagatattttttcagaaatatg

SEQ ID NO: 2388252 - DNA, 16 bp, Homo sapiens
tcagccagggccaggg

SEQ ID NO: 2388253 - DNA, 18 bp, Homo sapiens
tcagccagggccaggggt

SEQ ID NO: 2388254 - DNA, 19 bp, Homo sapiens
tcagctccagaataccttc

SEQ ID NO: 2388255 - DNA, 20 bp, Homo sapiens
tcaggaagatgaaagaggag

SEQ ID NO: 2388256 - DNA, 20 bp, Homo sapiens
tcaggaagggaaagccagaa

SEQ ID NO: 2388257 - DNA, 15 bp, Homo sapiens
tcagggatcttgcat

SEQ ID NO: 2388258 - DNA, 20 bp, Homo sapiens
tcaggggggttgtgaggcct

SEQ ID NO: 2388259 - DNA, 18 bp, Homo sapiens
tcagggtgggccactctc

SEQ ID NO: 2388260 - DNA, 21 bp, Homo sapiens
tcagggtgggccactctcccc

SEQ ID NO: 2388261 - DNA, 23 bp, Homo sapiens
tcagggtgggccactctcccctc

SEQ ID NO: 2388262 - DNA, 20 bp, Homo sapiens
tcagtgggacaaaccagagc

SEQ ID NO: 2388263 - DNA, 23 bp, Homo sapiens
tcagtgggacaaaccagagcaga

SEQ ID NO: 2388264 - DNA, 21 bp, Homo sapiens
tcattttcttatcttctgcaa

SEQ ID NO: 2388265 - DNA, 23 bp, Homo sapiens
tccaaaggaatctccagttttca

SEQ ID NO: 2388266 - DNA, 19 bp, Homo sapiens
tccaacaataaagagctca

SEQ ID NO: 2388267 - DNA, 21 bp, Homo sapiens
tccaaggagttccatgaagac

SEQ ID NO: 2388268 - DNA, 22 bp, Homo sapiens
tccagaataaaacgcaaagggc

SEQ ID NO: 2388269 - DNA, 16 bp, Homo sapiens
tccaggtatctccagg

SEQ ID NO: 2388270 - DNA, 12 bp, Homo sapiens
tccagtggtgaa

SEQ ID NO: 2388271 - DNA, 19 bp, Homo sapiens
tccagtggtgaagaaaact

SEQ ID NO: 2388272 - DNA, 14 bp, Homo sapiens
tccagttagttctc

SEQ ID NO: 2388273 - DNA, 20 bp, Homo sapiens
tccatgaagaccacatccac

SEQ ID NO: 2388274 - DNA, 23 bp, Homo sapiens
tccatgaagaccacatccacaca

SEQ ID NO: 2388275 - DNA, 18 bp, Homo sapiens
tcccacactggtgactgc

SEQ ID NO: 2388276 - DNA, 18 bp, Homo sapiens
tcccaccaaggtcttcag

SEQ ID NO: 2388277 - DNA, 22 bp, Homo sapiens
tcccaccaccctcccaccatgc

SEQ ID NO: 2388278 - DNA, 16 bp, Homo sapiens
tcccagccactcggga

SEQ ID NO: 2388279 - DNA, 12 bp, Homo sapiens
tccccagactca

SEQ ID NO: 2388280 - DNA, 17 bp, Homo sapiens
tccccagactcagctcc

SEQ ID NO: 2388281 - DNA, 21 bp, Homo sapiens
tccccagactcagctccagaa

SEQ ID NO: 2388282 - DNA, 12 bp, Homo sapiens
tccccaggccag

SEQ ID NO: 2388283 - DNA, 14 bp, Homo sapiens
tccccaggccaggc

SEQ ID NO: 2388284 - DNA, 12 bp, Homo sapiens
tcccctccctct

SEQ ID NO: 2388285 - DNA, 16 bp, Homo sapiens
tcccctccctcttcct

SEQ ID NO: 2388286 - DNA, 18 bp, Homo sapiens
tcccctccctcttccttc

SEQ ID NO: 2388287 - DNA, 19 bp, Homo sapiens
tcccctcgtgtgactctct

SEQ ID NO: 2388288 - DNA, 12 bp, Homo sapiens
tcccctttcctc

SEQ ID NO: 2388289 - DNA, 22 bp, Homo sapiens
tccctctgagaattccaaggag

SEQ ID NO: 2388290 - DNA, 15 bp, Homo sapiens
tccctcttccttccc

SEQ ID NO: 2388291 - DNA, 13 bp, Homo sapiens
tccctctttgcct

SEQ ID NO: 2388292 - DNA, 16 bp, Homo sapiens
tccctgaacatctgtg

SEQ ID NO: 2388293 - DNA, 12 bp, Homo sapiens
tccctggcctca

SEQ ID NO: 2388294 - DNA, 14 bp, Homo sapiens
tccctggcctggct

SEQ ID NO: 2388295 - DNA, 13 bp, Homo sapiens
tccctggtgcaga

SEQ ID NO: 2388296 - DNA, 14 bp, Homo sapiens
tccctggtgcagag

SEQ ID NO: 2388297 - DNA, 15 bp, Homo sapiens
tcctacaaagatgtt

SEQ ID NO: 2388298 - DNA, 22 bp, Homo sapiens
tcctagaagagtcaggaaggga

SEQ ID NO: 2388299 - DNA, 15 bp, Homo sapiens
tcctattctcaccag

SEQ ID NO: 2388300 - DNA, 18 bp, Homo sapiens
tcctatttggggcttgca

SEQ ID NO: 2388301 - DNA, 12 bp, Homo sapiens
tcctcactgccc

SEQ ID NO: 2388302 - DNA, 14 bp, Homo sapiens
tcctcactgcccca

SEQ ID NO: 2388303 - DNA, 22 bp, Homo sapiens
tcctcactgccccaccagccac

SEQ ID NO: 2388304 - DNA, 21 bp, Homo sapiens
tcctccaacaataaagagctc

SEQ ID NO: 2388305 - DNA, 17 bp, Homo sapiens
tcctcccctattttaag

SEQ ID NO: 2388306 - DNA, 15 bp, Homo sapiens
tcctctgatacccag

SEQ ID NO: 2388307 - DNA, 22 bp, Homo sapiens
tcctgcctacattccctggcct

SEQ ID NO: 2388308 - DNA, 10 bp, Homo sapiens
tcgccacacc

SEQ ID NO: 2388309 - DNA, 16 bp, Homo sapiens
tcgccacacccggctc

SEQ ID NO: 2388310 - DNA, 23 bp, Homo sapiens
tcgccacacccggctccccctgc

SEQ ID NO: 2388311 - DNA, 16 bp, Homo sapiens
tcgggaggctgagaca

SEQ ID NO: 2388312 - DNA, 21 bp, Homo sapiens
tcgttcctatacatttctgtt

SEQ ID NO: 2388313 - DNA, 16 bp, Homo sapiens
tctacccggcccagag

SEQ ID NO: 2388314 - DNA, 19 bp, Homo sapiens
tctacccggcccagagacc

SEQ ID NO: 2388315 - DNA, 13 bp, Homo sapiens
tctagagaagagg

SEQ ID NO: 2388316 - DNA, 21 bp, Homo sapiens
tctagattaccccctcattgt

SEQ ID NO: 2388317 - DNA, 12 bp, Homo sapiens
tctcaccaggaa

SEQ ID NO: 2388318 - DNA, 12 bp, Homo sapiens
tctctccttctg

SEQ ID NO: 2388319 - DNA, 20 bp, Homo sapiens
tctctcgtaactggtttcat

SEQ ID NO: 2388320 - DNA, 19 bp, Homo sapiens
tctctggcccttcttgcct

SEQ ID NO: 2388321 - DNA, 16 bp, Homo sapiens
tctctgtataatctat

SEQ ID NO: 2388322 - DNA, 21 bp, Homo sapiens
tctgacagccctgcggagacc

SEQ ID NO: 2388323 - DNA, 16 bp, Homo sapiens
tctgagcaccccctca

SEQ ID NO: 2388324 - DNA, 24 bp, Homo sapiens
tctgagtgtttttactacagttgt

SEQ ID NO: 2388325 - DNA, 16 bp, Homo sapiens
tctgatacccagagca

SEQ ID NO: 2388326 - DNA, 15 bp, Homo sapiens
tctgcacccaggggt

SEQ ID NO: 2388327 - DNA, 20 bp, Homo sapiens
tctgcagcactttaaccctc

SEQ ID NO: 2388328 - DNA, 17 bp, Homo sapiens
tctgccctccctggcct

SEQ ID NO: 2388329 - DNA, 20 bp, Homo sapiens
tctggaaaactcaggattct

SEQ ID NO: 2388330 - DNA, 14 bp, Homo sapiens
tctgtataatctat

SEQ ID NO: 2388331 - DNA, 21 bp, Homo sapiens
tcttaagccttttgctcacaa

SEQ ID NO: 2388332 - DNA, 23 bp, Homo sapiens
tcttaaggattgtgatattttta

SEQ ID NO: 2388333 - DNA, 15 bp, Homo sapiens
tcttatcttctgcaa

SEQ ID NO: 2388334 - DNA, 18 bp, Homo sapiens
tcttccaagcaaaggtga

SEQ ID NO: 2388335 - DNA, 18 bp, Homo sapiens
tcttcctgcaaggactac

SEQ ID NO: 2388336 - DNA, 14 bp, Homo sapiens
tcttccttccccca

SEQ ID NO: 2388337 - DNA, 15 bp, Homo sapiens
tcttccttcccccat

SEQ ID NO: 2388338 - DNA, 20 bp, Homo sapiens
tcttcgctgctagagaaggg

SEQ ID NO: 2388339 - DNA, 15 bp, Homo sapiens
tctttgcctgtgtga

SEQ ID NO: 2388340 - DNA, 16 bp, Homo sapiens
tctttgcctgtgtgag

SEQ ID NO: 2388341 - DNA, 21 bp, Homo sapiens
tctttgcctgtgtgagcatct

SEQ ID NO: 2388342 - DNA, 18 bp, Homo sapiens
tctttggaaggagtgaga

SEQ ID NO: 2388343 - DNA, 13 bp, Homo sapiens
tgaaaaattctca

SEQ ID NO: 2388344 - DNA, 23 bp, Homo sapiens
tgaaaacatggtagaattggaga

SEQ ID NO: 2388345 - DNA, 22 bp, Homo sapiens
tgaagggaaaggatattttctt

SEQ ID NO: 2388346 - DNA, 15 bp, Homo sapiens
acttgaactttccaa

SEQ ID NO: 2388347 - DNA, 19 bp, Homo sapiens
acttgggcgctctgccctc

SEQ ID NO: 2388348 - DNA, 15 bp, Homo sapiens
actttgggaggccaa

SEQ ID NO: 2388349 - DNA, 19 bp, Homo sapiens
actttgggaggccaaggtg

SEQ ID NO: 2388350 - DNA, 17 bp, Homo sapiens
agaaagcacctgttttt

SEQ ID NO: 2388351 - DNA, 18 bp, Homo sapiens
agaaagcacctgttttta

SEQ ID NO: 2388352 - DNA, 15 bp, Homo sapiens
agaaattagctgtgt

SEQ ID NO: 2388353 - DNA, 13 bp, Homo sapiens
agaagggagaagg

SEQ ID NO: 2388354 - DNA, 20 bp, Homo sapiens
agaagtttgatattaaagga

SEQ ID NO: 2388355 - DNA, 17 bp, Homo sapiens
agaataaagttctgagt

SEQ ID NO: 2388356 - DNA, 14 bp, Homo sapiens
agaatcaaaactct

SEQ ID NO: 2388357 - DNA, 14 bp, Homo sapiens
agaatccctgcagc

SEQ ID NO: 2388358 - DNA, 17 bp, Homo sapiens
agaatccctgcagcctg

SEQ ID NO: 2388359 - DNA, 13 bp, Homo sapiens
agaattccaagga

SEQ ID NO: 2388360 - DNA, 21 bp, Homo sapiens
agaattggagagtaaaaactg

SEQ ID NO: 2388361 - DNA, 21 bp, Homo sapiens
agacaaaacttcctgtttgtg

SEQ ID NO: 2388362 - DNA, 14 bp, Homo sapiens
agacaggagggcaa

SEQ ID NO: 2388363 - DNA, 17 bp, Homo sapiens
agaccaagactctgaaa

SEQ ID NO: 2388364 - DNA, 13 bp, Homo sapiens
agaccccttcctt

SEQ ID NO: 2388365 - DNA, 15 bp, Homo sapiens
agaccccttcctttc

SEQ ID NO: 2388366 - DNA, 18 bp, Homo sapiens
agaccccttcctttcctc

SEQ ID NO: 2388367 - DNA, 19 bp, Homo sapiens
agacctgacaagcactgct

SEQ ID NO: 2388368 - DNA, 17 bp, Homo sapiens
agacgtgaatgtctcag

SEQ ID NO: 2388369 - DNA, 18 bp, Homo sapiens
agacgtgaatgtctcagc

SEQ ID NO: 2388370 - DNA, 19 bp, Homo sapiens
agacgtgaatgtctcagcg

SEQ ID NO: 2388371 - DNA, 11 bp, Homo sapiens
agactcagctc

SEQ ID NO: 2388372 - DNA, 13 bp, Homo sapiens
agactcagtgttc

SEQ ID NO: 2388373 - DNA, 17 bp, Homo sapiens
agactgagcacctgctt

SEQ ID NO: 2388374 - DNA, 12 bp, Homo sapiens
agactgattacc

SEQ ID NO: 2388375 - DNA, 15 bp, Homo sapiens
agagaaagaagagac

SEQ ID NO: 2388376 - DNA, 16 bp, Homo sapiens
agagaacatttctaga

SEQ ID NO: 2388377 - DNA, 12 bp, Homo sapiens
agagaagaggct

SEQ ID NO: 2388378 - DNA, 14 bp, Homo sapiens
agagaccccttcct

SEQ ID NO: 2388379 - DNA, 11 bp, Homo sapiens
agagagaagcc

SEQ ID NO: 2388380 - DNA, 17 bp, Homo sapiens
agagcattacgtgagcc

SEQ ID NO: 2388381 - DNA, 21 bp, Homo sapiens
agagcattacgtgagccaggt

SEQ ID NO: 2388382 - DNA, 17 bp, Homo sapiens
agagcattgcatggaca

SEQ ID NO: 2388383 - DNA, 12 bp, Homo sapiens
agagccagctct

SEQ ID NO: 2388384 - DNA, 13 bp, Homo sapiens
agagccagctctc

SEQ ID NO: 2388385 - DNA, 14 bp, Homo sapiens
agagccagctctct

SEQ ID NO: 2388386 - DNA, 16 bp, Homo sapiens
agagccagctctctct

SEQ ID NO: 2388387 - DNA, 13 bp, Homo sapiens
agagcctggagaa

SEQ ID NO: 2388388 - DNA, 19 bp, Homo sapiens
agagccttctcctgcctac

SEQ ID NO: 2388389 - DNA, 22 bp, Homo sapiens
agaggaaaggacatgggtagca

SEQ ID NO: 2388390 - DNA, 16 bp, Homo sapiens
agaggtaaaagtgtga

SEQ ID NO: 2388391 - DNA, 18 bp, Homo sapiens
agaggtaaaagtgtgagc

SEQ ID NO: 2388392 - DNA, 15 bp, Homo sapiens
agagtaaaaactgaa

SEQ ID NO: 2388393 - DNA, 16 bp, Homo sapiens
agatatgatatgtaaa

SEQ ID NO: 2388394 - DNA, 17 bp, Homo sapiens
agatatgatatgtaaac

SEQ ID NO: 2388395 - DNA, 17 bp, Homo sapiens
agatatttttgtacgtt

SEQ ID NO: 2388396 - DNA, 18 bp, Homo sapiens
agatattttttcagaaat

SEQ ID NO: 2388397 - DNA, 19 bp, Homo sapiens
agatattttttcagaaata

SEQ ID NO: 2388398 - DNA, 21 bp, Homo sapiens
agatattttttcagaaatatg

SEQ ID NO: 2388399 - DNA, 15 bp, Homo sapiens
agatcgcgccactgc

SEQ ID NO: 2388400 - DNA, 13 bp, Homo sapiens
agatgaaagagga

SEQ ID NO: 2388401 - DNA, 17 bp, Homo sapiens
agatgaaagaggaggtt

SEQ ID NO: 2388402 - DNA, 17 bp, Homo sapiens
agatgggtctggctgag

SEQ ID NO: 2388403 - DNA, 21 bp, Homo sapiens
agatgggtctggctgagctga

SEQ ID NO: 2388404 - DNA, 17 bp, Homo sapiens
agatgtgataaggatca

SEQ ID NO: 2388405 - DNA, 24 bp, Homo sapiens
agatgtttgtcagatatgatatgt

SEQ ID NO: 2388406 - DNA, 13 bp, Homo sapiens
agattgaggcctg

SEQ ID NO: 2388407 - DNA, 19 bp, Homo sapiens
agattgaggcctgccctca

SEQ ID NO: 2388408 - DNA, 13 bp, Homo sapiens
agattttaaattc

SEQ ID NO: 2388409 - DNA, 12 bp, Homo sapiens
agcaaagagtgg

SEQ ID NO: 2388410 - DNA, 16 bp, Homo sapiens
agcaaagagtgggctg

SEQ ID NO: 2388411 - DNA, 18 bp, Homo sapiens
agcaacacaagctggaag

SEQ ID NO: 2388412 - DNA, 17 bp, Homo sapiens
agcaagagctggcaaag

SEQ ID NO: 2388413 - DNA, 23 bp, Homo sapiens
agcaattctacccagagccttct

SEQ ID NO: 2388414 - DNA, 18 bp, Homo sapiens
agcaccagcttctccagg

SEQ ID NO: 2388415 - DNA, 19 bp, Homo sapiens
agcaccagcttctccaggc

SEQ ID NO: 2388416 - DNA, 20 bp, Homo sapiens
agcaccagcttctccaggct

SEQ ID NO: 2388417 - DNA, 21 bp, Homo sapiens
agcaccagcttctccaggctc

SEQ ID NO: 2388418 - DNA, 12 bp, Homo sapiens
agcaccccctca

SEQ ID NO: 2388419 - DNA, 16 bp, Homo sapiens
agcaccccctcattcc

SEQ ID NO: 2388420 - DNA, 21 bp, Homo sapiens
agcaccccctcattcccctcg

SEQ ID NO: 2388421 - DNA, 23 bp, Homo sapiens
agcactgctaggcgagtgccagg

SEQ ID NO: 2388422 - DNA, 15 bp, Homo sapiens
agcactttgggaggc

SEQ ID NO: 2388423 - DNA, 17 bp, Homo sapiens
agcaggtgggaaatggt

SEQ ID NO: 2388424 - DNA, 13 bp, Homo sapiens
agcaggtggtcct

SEQ ID NO: 2388425 - DNA, 13 bp, Homo sapiens
agcataaatgcaa

SEQ ID NO: 2388426 - DNA, 15 bp, Homo sapiens
agcatctctgtgtac

SEQ ID NO: 2388427 - DNA, 16 bp, Homo sapiens
agcatgtgttgaaaaa

SEQ ID NO: 2388428 - DNA, 18 bp, Homo sapiens
agcattacgtgagccagg

SEQ ID NO: 2388429 - DNA, 19 bp, Homo sapiens
agcattacgtgagccaggt

SEQ ID NO: 2388430 - DNA, 13 bp, Homo sapiens
agcattgcatgga

SEQ ID NO: 2388431 - DNA, 12 bp, Homo sapiens
agccaacagcag

SEQ ID NO: 2388432 - DNA, 21 bp, Homo sapiens
agccaacaggtggcaggacca

SEQ ID NO: 2388433 - DNA, 23 bp, Homo sapiens
agccaacaggtggcaggaccagg

SEQ ID NO: 2388434 - DNA, 11 bp, Homo sapiens
agccacatccc

SEQ ID NO: 2388435 - DNA, 23 bp, Homo sapiens
agccagaaggggcacgcctgccc

SEQ ID NO: 2388436 - DNA, 15 bp, Homo sapiens
agccagctctctcta

SEQ ID NO: 2388437 - DNA, 23 bp, Homo sapiens
agccaggtaatgagggactggaa

SEQ ID NO: 2388438 - DNA, 18 bp, Homo sapiens
agccatttgttggggcag

SEQ ID NO: 2388439 - DNA, 15 bp, Homo sapiens
agcccagcctctgtc

SEQ ID NO: 2388440 - DNA, 17 bp, Homo sapiens
agccccgggcctgcctc

SEQ ID NO: 2388441 - DNA, 22 bp, Homo sapiens
agcctcactattacttgaactt

SEQ ID NO: 2388442 - DNA, 16 bp, Homo sapiens
agcctcctcccaccac

SEQ ID NO: 2388443 - DNA, 21 bp, Homo sapiens
agcctcctcccaccaccctcc

SEQ ID NO: 2388444 - DNA, 14 bp, Homo sapiens
agcctcgcatgcca

SEQ ID NO: 2388445 - DNA, 15 bp, Homo sapiens
agcctctgtccctct

SEQ ID NO: 2388446 - DNA, 14 bp, Homo sapiens
agcctggagaagct

SEQ ID NO: 2388447 - DNA, 22 bp, Homo sapiens
agcctggtagaattgggaagct

SEQ ID NO: 2388448 - DNA, 18 bp, Homo sapiens
agcctgttttgttggaag

SEQ ID NO: 2388449 - DNA, 12 bp, Homo sapiens
agccttgctcag

SEQ ID NO: 2388450 - DNA, 16 bp, Homo sapiens
agcgctttctggaaaa

SEQ ID NO: 2388451 - DNA, 17 bp, Homo sapiens
agcgctttctggaaaag

SEQ ID NO: 2388452 - DNA, 19 bp, Homo sapiens
agctccagaataccttctt

SEQ ID NO: 2388453 - DNA, 22 bp, Homo sapiens
agctgaggggggccgtgcccag

SEQ ID NO: 2388454 - DNA, 15 bp, Homo sapiens
agctgctctggaaaa

SEQ ID NO: 2388455 - DNA, 12 bp, Homo sapiens
agcttctccagg

SEQ ID NO: 2388456 - DNA, 16 bp, Homo sapiens
aggaaaagtgcaatgc

SEQ ID NO: 2388457 - DNA, 20 bp, Homo sapiens
cattcccctcgtgtgactct

SEQ ID NO: 2388458 - DNA, 13 bp, Homo sapiens
cattccctggcct

SEQ ID NO: 2388459 - DNA, 22 bp, Homo sapiens
cattttaaaagcaattatattg

SEQ ID NO: 2388460 - DNA, 17 bp, Homo sapiens
cattttgagtgactcga

SEQ ID NO: 2388461 - DNA, 14 bp, Homo sapiens
ccaaagagcctgga

SEQ ID NO: 2388462 - DNA, 15 bp, Homo sapiens
ccaaagagcctggag

SEQ ID NO: 2388463 - DNA, 15 bp, Homo sapiens
ccaacaataaagagc

SEQ ID NO: 2388464 - DNA, 15 bp, Homo sapiens
ccaacatggtgaaac

SEQ ID NO: 2388465 - DNA, 16 bp, Homo sapiens
ccaagatcgcgccact

SEQ ID NO: 2388466 - DNA, 14 bp, Homo sapiens
ccaaggaccaggtt

SEQ ID NO: 2388467 - DNA, 19 bp, Homo sapiens
ccaaggtcttcagccatca

SEQ ID NO: 2388468 - DNA, 17 bp, Homo sapiens
ccacacccggctccccc

SEQ ID NO: 2388469 - DNA, 18 bp, Homo sapiens
ccacacccggctccccct

SEQ ID NO: 2388470 - DNA, 20 bp, Homo sapiens
ccacacccggctccccctgc

SEQ ID NO: 2388471 - DNA, 13 bp, Homo sapiens
ccacactggtgac

SEQ ID NO: 2388472 - DNA, 20 bp, Homo sapiens
ccacagttgctgctcctttg

SEQ ID NO: 2388473 - DNA, 22 bp, Homo sapiens
ccaccaccctcccaccatgcgc

SEQ ID NO: 2388474 - DNA, 23 bp, Homo sapiens
ccaccaccctcccaccatgcgct

SEQ ID NO: 2388475 - DNA, 22 bp, Homo sapiens
ccaccaccttggactcctccca

SEQ ID NO: 2388476 - DNA, 13 bp, Homo sapiens
ccaccagccacct

SEQ ID NO: 2388477 - DNA, 15 bp, Homo sapiens
ccaccagccacctct

SEQ ID NO: 2388478 - DNA, 19 bp, Homo sapiens
ccacctcttgggcatgctc

SEQ ID NO: 2388479 - DNA, 11 bp, Homo sapiens
ccaccttcccc

SEQ ID NO: 2388480 - DNA, 12 bp, Homo sapiens
ccaccttcccca

SEQ ID NO: 2388481 - DNA, 17 bp, Homo sapiens
ccaccttggactcctcc

SEQ ID NO: 2388482 - DNA, 22 bp, Homo sapiens
ccaccttggactcctcccacaa

SEQ ID NO: 2388483 - DNA, 23 bp, Homo sapiens
ccaccttggactcctcccacaat

SEQ ID NO: 2388484 - DNA, 23 bp, Homo sapiens
ccactcgggaggctgagacagga

SEQ ID NO: 2388485 - DNA, 13 bp, Homo sapiens
ccacttcaataga

SEQ ID NO: 2388486 - DNA, 22 bp, Homo sapiens
ccagaacaaggttccctctgag

SEQ ID NO: 2388487 - DNA, 22 bp, Homo sapiens
ccagaaggggcacgcctgccca

SEQ ID NO: 2388488 - DNA, 14 bp, Homo sapiens
ccagactcagctcc

SEQ ID NO: 2388489 - DNA, 18 bp, Homo sapiens
ccagagaccccttccttt

SEQ ID NO: 2388490 - DNA, 21 bp, Homo sapiens
ccagagcattacgtgagccag

SEQ ID NO: 2388491 - DNA, 14 bp, Homo sapiens
ccagagcccagggc

SEQ ID NO: 2388492 - DNA, 13 bp, Homo sapiens
ccagagccttctc

SEQ ID NO: 2388493 - DNA, 21 bp, Homo sapiens
ccagccactcgggaggctgag

SEQ ID NO: 2388494 - DNA, 16 bp, Homo sapiens
ccagcctcgcatgcca

SEQ ID NO: 2388495 - DNA, 18 bp, Homo sapiens
ccagcctcgcatgccaga

SEQ ID NO: 2388496 - DNA, 20 bp, Homo sapiens
ccagctagggctggactctg

SEQ ID NO: 2388497 - DNA, 14 bp, Homo sapiens
ccagctctctctac

SEQ ID NO: 2388498 - DNA, 14 bp, Homo sapiens
ccagcttctccagg

SEQ ID NO: 2388499 - DNA, 16 bp, Homo sapiens
ccagcttctccaggct

SEQ ID NO: 2388500 - DNA, 19 bp, Homo sapiens
ccaggactccccaggccag

SEQ ID NO: 2388501 - DNA, 19 bp, Homo sapiens
ccaggaggagaggaaagga

SEQ ID NO: 2388502 - DNA, 16 bp, Homo sapiens
ccaggcaccccctgga

SEQ ID NO: 2388503 - DNA, 19 bp, Homo sapiens
ccaggcaccccctggagag

SEQ ID NO: 2388504 - DNA, 21 bp, Homo sapiens
ccaggcaccccctggagagaa

SEQ ID NO: 2388505 - DNA, 15 bp, Homo sapiens
ccaggccaccaggat

SEQ ID NO: 2388506 - DNA, 12 bp, Homo sapiens
ccaggccaggcc

SEQ ID NO: 2388507 - DNA, 15 bp, Homo sapiens
ccagggcatcccatg

SEQ ID NO: 2388508 - DNA, 15 bp, Homo sapiens
ccagggccaggggtc

SEQ ID NO: 2388509 - DNA, 19 bp, Homo sapiens
ccagggcgggagtgggggc

SEQ ID NO: 2388510 - DNA, 19 bp, Homo sapiens
ccaggggcccacagggaac

SEQ ID NO: 2388511 - DNA, 18 bp, Homo sapiens
ccaggggtctccctggag

SEQ ID NO: 2388512 - DNA, 19 bp, Homo sapiens
ccaggggtctccctggagt

SEQ ID NO: 2388513 - DNA, 20 bp, Homo sapiens
ccaggggtgatttcagagag

SEQ ID NO: 2388514 - DNA, 22 bp, Homo sapiens
ccagggtgagagctgctctgga

SEQ ID NO: 2388515 - DNA, 22 bp, Homo sapiens
ccagggttgatcacactctggg

SEQ ID NO: 2388516 - DNA, 23 bp, Homo sapiens
ccaggtaatgagggactggaacc

SEQ ID NO: 2388517 - DNA, 17 bp, Homo sapiens
ccaggtatctccaggat

SEQ ID NO: 2388518 - DNA, 15 bp, Homo sapiens
ccataacagccaaca

SEQ ID NO: 2388519 - DNA, 21 bp, Homo sapiens
ccatagatgggtctggctgag

SEQ ID NO: 2388520 - DNA, 14 bp, Homo sapiens
ccatcccctttcct

SEQ ID NO: 2388521 - DNA, 20 bp, Homo sapiens
ccatcccctttcctccccac

SEQ ID NO: 2388522 - DNA, 18 bp, Homo sapiens
ccatgcgctgctcaacct

SEQ ID NO: 2388523 - DNA, 23 bp, Homo sapiens
ccatgcgctgctcaacctctctc

SEQ ID NO: 2388524 - DNA, 15 bp, Homo sapiens
ccatgtccaatggag

SEQ ID NO: 2388525 - DNA, 18 bp, Homo sapiens
cccaaagagcctggagaa

SEQ ID NO: 2388526 - DNA, 22 bp, Homo sapiens
cccaccaccttggactcctccc

SEQ ID NO: 2388527 - DNA, 13 bp, Homo sapiens
cccaccttcccca

SEQ ID NO: 2388528 - DNA, 14 bp, Homo sapiens
cccaccttccccag

SEQ ID NO: 2388529 - DNA, 18 bp, Homo sapiens
cccaccttccccagactc

SEQ ID NO: 2388530 - DNA, 19 bp, Homo sapiens
cccactcctcactgcccca

SEQ ID NO: 2388531 - DNA, 15 bp, Homo sapiens
cccagagtgtgaaac

SEQ ID NO: 2388532 - DNA, 22 bp, Homo sapiens
cccagcactttgggaggccaag

SEQ ID NO: 2388533 - DNA, 18 bp, Homo sapiens
cccagcctcgcatgccag

SEQ ID NO: 2388534 - DNA, 23 bp, Homo sapiens
cccagcctcgcatgccagagcct

SEQ ID NO: 2388535 - DNA, 13 bp, Homo sapiens
cccaggccaggcc

SEQ ID NO: 2388536 - DNA, 17 bp, Homo sapiens
cccaggccaggccacca

SEQ ID NO: 2388537 - DNA, 22 bp, Homo sapiens
cccaggccaggccaccaggatg

SEQ ID NO: 2388538 - DNA, 18 bp, Homo sapiens
cccagggcatcccatggg

SEQ ID NO: 2388539 - DNA, 19 bp, Homo sapiens
cccagggcatcccatgggg

SEQ ID NO: 2388540 - DNA, 15 bp, Homo sapiens
cccaggtcctctgat

SEQ ID NO: 2388541 - DNA, 12 bp, Homo sapiens
cccatccccttt

SEQ ID NO: 2388542 - DNA, 14 bp, Homo sapiens
cccatcccctttcc

SEQ ID NO: 2388543 - DNA, 16 bp, Homo sapiens
cccatcccctttcctc

SEQ ID NO: 2388544 - DNA, 19 bp, Homo sapiens
cccatcccctttcctcccc

SEQ ID NO: 2388545 - DNA, 13 bp, Homo sapiens
cccatgtgccaag

SEQ ID NO: 2388546 - DNA, 17 bp, Homo sapiens
cccattttgagtgactc

SEQ ID NO: 2388547 - DNA, 15 bp, Homo sapiens
ccccaccagccacct

SEQ ID NO: 2388548 - DNA, 17 bp, Homo sapiens
ccccaccagccacctct

SEQ ID NO: 2388549 - DNA, 16 bp, Homo sapiens
ccccaccttccccaga

SEQ ID NO: 2388550 - DNA, 17 bp, Homo sapiens
ccccagctagggctgga

SEQ ID NO: 2388551 - DNA, 22 bp, Homo sapiens
ccccaggccaggccaccaggat

SEQ ID NO: 2388552 - DNA, 13 bp, Homo sapiens
cccctgcttctca

SEQ ID NO: 2388553 - DNA, 16 bp, Homo sapiens
ccccttatccaggact

SEQ ID NO: 2388554 - DNA, 15 bp, Homo sapiens
ccccttcctttcctc

SEQ ID NO: 2388555 - DNA, 21 bp, Homo sapiens
ccccttcctttcctctgcagc

SEQ ID NO: 2388556 - DNA, 17 bp, Homo sapiens
ccccttggcgggcagcc

SEQ ID NO: 2388557 - DNA, 18 bp, Homo sapiens
cccggagcaggggtctga

SEQ ID NO: 2388558 - DNA, 16 bp, Homo sapiens
cccggctccccctgct

SEQ ID NO: 2388559 - DNA, 13 bp, Homo sapiens
cccgggcctgcct

SEQ ID NO: 2388560 - DNA, 15 bp, Homo sapiens
cccgggcctgcctct

SEQ ID NO: 2388561 - DNA, 22 bp, Homo sapiens
cccgggcctgcctctgactcac

SEQ ID NO: 2388562 - DNA, 12 bp, Homo sapiens
ccctattttaag

SEQ ID NO: 2388563 - DNA, 12 bp, Homo sapiens
ccctccctggcc

SEQ ID NO: 2388564 - DNA, 14 bp, Homo sapiens
ccctccctggcctc

SEQ ID NO: 2388565 - DNA, 15 bp, Homo sapiens
ccctccctggcctca

SEQ ID NO: 2388566 - DNA, 21 bp, Homo sapiens
ccctctttgcctgtgtgagca

SEQ ID NO: 2388567 - DNA, 19 bp, Homo sapiens
ctggaggtcacattcagga

SEQ ID NO: 2388568 - DNA, 18 bp, Homo sapiens
ctggcctcacgcccagcc

SEQ ID NO: 2388569 - DNA, 16 bp, Homo sapiens
ctggcctggctctcct

SEQ ID NO: 2388570 - DNA, 17 bp, Homo sapiens
ctggcctggctctcctg

SEQ ID NO: 2388571 - DNA, 23 bp, Homo sapiens
ctggctctcctgtagctctcctg

SEQ ID NO: 2388572 - DNA, 22 bp, Homo sapiens
ctggctgaccccaaagagcctg

SEQ ID NO: 2388573 - DNA, 23 bp, Homo sapiens
ctggctgaccccaaagagcctgg

SEQ ID NO: 2388574 - DNA, 15 bp, Homo sapiens
ctggcttccaggtat

SEQ ID NO: 2388575 - DNA, 16 bp, Homo sapiens
ctgggaaataagagag

SEQ ID NO: 2388576 - DNA, 22 bp, Homo sapiens
ctgggaccccagctagggctgg

SEQ ID NO: 2388577 - DNA, 17 bp, Homo sapiens
ctgggattcccaccaag

SEQ ID NO: 2388578 - DNA, 16 bp, Homo sapiens
ctgggggaagggtggt

SEQ ID NO: 2388579 - DNA, 18 bp, Homo sapiens
ctggtagaattgggaagc

SEQ ID NO: 2388580 - DNA, 22 bp, Homo sapiens
ctggtgactgcgatcttcagag

SEQ ID NO: 2388581 - DNA, 16 bp, Homo sapiens
ctggtgctgtggccag

SEQ ID NO: 2388582 - DNA, 15 bp, Homo sapiens
ctgtagtcccagcca

SEQ ID NO: 2388583 - DNA, 23 bp, Homo sapiens
ctgtagtcccagccactcgggag

SEQ ID NO: 2388584 - DNA, 14 bp, Homo sapiens
ctgtataatctatt

SEQ ID NO: 2388585 - DNA, 18 bp, Homo sapiens
ctgtataatctatttaca

SEQ ID NO: 2388586 - DNA, 18 bp, Homo sapiens
ctgtccctctttgcctgt

SEQ ID NO: 2388587 - DNA, 14 bp, Homo sapiens
ctgtgactgatgtt

SEQ ID NO: 2388588 - DNA, 23 bp, Homo sapiens
ctgtgtttttgctatcacacagt

SEQ ID NO: 2388589 - DNA, 22 bp, Homo sapiens
ctgttttaaatttatttcaaaa

SEQ ID NO: 2388590 - DNA, 17 bp, Homo sapiens
cttaaaaaaatgacaga

SEQ ID NO: 2388591 - DNA, 20 bp, Homo sapiens
cttaaggattgtgatatttt

SEQ ID NO: 2388592 - DNA, 12 bp, Homo sapiens
cttatccaggac

SEQ ID NO: 2388593 - DNA, 13 bp, Homo sapiens
cttatccaggact

SEQ ID NO: 2388594 - DNA, 15 bp, Homo sapiens
cttatccaggactct

SEQ ID NO: 2388595 - DNA, 19 bp, Homo sapiens
cttatccaggactctgtca

SEQ ID NO: 2388596 - DNA, 16 bp, Homo sapiens
cttcaaatatagagat

SEQ ID NO: 2388597 - DNA, 14 bp, Homo sapiens
cttcacagtgtttc

SEQ ID NO: 2388598 - DNA, 14 bp, Homo sapiens
cttcagccatcaac

SEQ ID NO: 2388599 - DNA, 15 bp, Homo sapiens
cttcatgctcagccc

SEQ ID NO: 2388600 - DNA, 19 bp, Homo sapiens
cttccaggtatctccagga

SEQ ID NO: 2388601 - DNA, 13 bp, Homo sapiens
cttccccagactc

SEQ ID NO: 2388602 - DNA, 23 bp, Homo sapiens
cttccccagactcagctccagaa

SEQ ID NO: 2388603 - DNA, 11 bp, Homo sapiens
cttcctttcct

SEQ ID NO: 2388604 - DNA, 20 bp, Homo sapiens
cttcgctgctagagaagggg

SEQ ID NO: 2388605 - DNA, 19 bp, Homo sapiens
cttctgcaattgcttagga

SEQ ID NO: 2388606 - DNA, 19 bp, Homo sapiens
cttcttcgctgctagagaa

SEQ ID NO: 2388607 - DNA, 13 bp, Homo sapiens
cttgaactttcca

SEQ ID NO: 2388608 - DNA, 14 bp, Homo sapiens
cttgaactttccaa

SEQ ID NO: 2388609 - DNA, 16 bp, Homo sapiens
cttgaactttccaaaa

SEQ ID NO: 2388610 - DNA, 14 bp, Homo sapiens
cttgcattcccagt

SEQ ID NO: 2388611 - DNA, 16 bp, Homo sapiens
cttgctcaggtgcaag

SEQ ID NO: 2388612 - DNA, 16 bp, Homo sapiens
cttggactcctcccac

SEQ ID NO: 2388613 - DNA, 14 bp, Homo sapiens
cttgggcatgctca

SEQ ID NO: 2388614 - DNA, 22 bp, Homo sapiens
cttggggggtttttactccagt

SEQ ID NO: 2388615 - DNA, 23 bp, Homo sapiens
cttgtctgattggctcacccaag

SEQ ID NO: 2388616 - DNA, 20 bp, Homo sapiens
ctttatcaccaggatgtcac

SEQ ID NO: 2388617 - DNA, 22 bp, Homo sapiens
ctttccaaaacctaaagaggaa

SEQ ID NO: 2388618 - DNA, 15 bp, Homo sapiens
ctttcctccccacct

SEQ ID NO: 2388619 - DNA, 17 bp, Homo sapiens
ctttcctccccaccttc

SEQ ID NO: 2388620 - DNA, 19 bp, Homo sapiens
ctttcctccccaccttccc

SEQ ID NO: 2388621 - DNA, 22 bp, Homo sapiens
ctttgaaacaagataactgaga

SEQ ID NO: 2388622 - DNA, 12 bp, Homo sapiens
ctttgcctgtgt

SEQ ID NO: 2388623 - DNA, 13 bp, Homo sapiens
ctttgcctgtgtg

SEQ ID NO: 2388624 - DNA, 21 bp, Homo sapiens
ctttgcctgtgtgagcatctc

SEQ ID NO: 2388625 - DNA, 20 bp, Homo sapiens
ctttgcttcaaatccatcca

SEQ ID NO: 2388626 - DNA, 22 bp, Homo sapiens
cttttaaaggggcagaaaaact

SEQ ID NO: 2388627 - DNA, 23 bp, Homo sapiens
cttttaaaggggcagaaaaactc

SEQ ID NO: 2388628 - DNA, 17 bp, Homo sapiens
cttttgtaccagtgtga

SEQ ID NO: 2388629 - DNA, 19 bp, Homo sapiens
gaaaagaatacagaaagat

SEQ ID NO: 2388630 - DNA, 14 bp, Homo sapiens
gaaaagtgcaatgc

SEQ ID NO: 2388631 - DNA, 18 bp, Homo sapiens
gaaacaccgagtctctgt

SEQ ID NO: 2388632 - DNA, 11 bp, Homo sapiens
gaaagaagaga

SEQ ID NO: 2388633 - DNA, 15 bp, Homo sapiens
gaaagaagagacagg

SEQ ID NO: 2388634 - DNA, 16 bp, Homo sapiens
gaaatggtatgagctg

SEQ ID NO: 2388635 - DNA, 16 bp, Homo sapiens
gaaattagctgtgtga

SEQ ID NO: 2388636 - DNA, 19 bp, Homo sapiens
gaaattagctgtgtgaaat

SEQ ID NO: 2388637 - DNA, 22 bp, Homo sapiens
gaaattgtttaagtgttgtaaa

SEQ ID NO: 2388638 - DNA, 22 bp, Homo sapiens
gaacagccaaatgcatggtgca

SEQ ID NO: 2388639 - DNA, 23 bp, Homo sapiens
gaacagccaaatgcatggtgcag

SEQ ID NO: 2388640 - DNA, 18 bp, Homo sapiens
gaaccagggagaccgagc

SEQ ID NO: 2388641 - DNA, 19 bp, Homo sapiens
gaactcccagcaacacaag

SEQ ID NO: 2388642 - DNA, 16 bp, Homo sapiens
gaagagtcaggaaggg

SEQ ID NO: 2388643 - DNA, 13 bp, Homo sapiens
gaagatgaaagag

SEQ ID NO: 2388644 - DNA, 17 bp, Homo sapiens
gaagctgatgctttgct

SEQ ID NO: 2388645 - DNA, 17 bp, Homo sapiens
gaaggaggtgagggatg

SEQ ID NO: 2388646 - DNA, 21 bp, Homo sapiens
gaagggagaaggatctagaat

SEQ ID NO: 2388647 - DNA, 17 bp, Homo sapiens
gaagggggtccacccag

SEQ ID NO: 2388648 - DNA, 13 bp, Homo sapiens
gaagggtaaagaa

SEQ ID NO: 2388649 - DNA, 23 bp, Homo sapiens
gaaggtcactcttcctgcaagga

SEQ ID NO: 2388650 - DNA, 20 bp, Homo sapiens
gaaggtttggtgtgtggaga

SEQ ID NO: 2388651 - DNA, 15 bp, Homo sapiens
gaaggtttgtatatt

SEQ ID NO: 2388652 - DNA, 22 bp, Homo sapiens
gaataataattatccagagttt

SEQ ID NO: 2388653 - DNA, 20 bp, Homo sapiens
gaatacagtgttattttctt

SEQ ID NO: 2388654 - DNA, 22 bp, Homo sapiens
gaatcaaagcagttaactttaa

SEQ ID NO: 2388655 - DNA, 22 bp, Homo sapiens
gaatgcccacaggcaaatgcat

SEQ ID NO: 2388656 - DNA, 21 bp, Homo sapiens
gaatgctgagacccccggagc

SEQ ID NO: 2388657 - DNA, 14 bp, Homo sapiens
gaatggtccagggt

SEQ ID NO: 2388658 - DNA, 22 bp, Homo sapiens
gaatgtctttgttggaaaagaa

SEQ ID NO: 2388659 - DNA, 16 bp, Homo sapiens
gacagcaggtgggaaa

SEQ ID NO: 2388660 - DNA, 18 bp, Homo sapiens
gacagccctgcggagacc

SEQ ID NO: 2388661 - DNA, 16 bp, Homo sapiens
gaccccaaagagcctg

SEQ ID NO: 2388662 - DNA, 17 bp, Homo sapiens
gaccccttcctttcctc

SEQ ID NO: 2388663 - DNA, 18 bp, Homo sapiens
gaccccttcctttcctct

SEQ ID NO: 2388664 - DNA, 20 bp, Homo sapiens
gaccctgagtccgggaggca

SEQ ID NO: 2388665 - DNA, 16 bp, Homo sapiens
gacggtcccacactgg

SEQ ID NO: 2388666 - DNA, 19 bp, Homo sapiens
gacgtgaatgtctcagcga

SEQ ID NO: 2388667 - DNA, 18 bp, Homo sapiens
gactccccaggccaggcc

SEQ ID NO: 2388668 - DNA, 22 bp, Homo sapiens
gactctgtcaatttccctgact

SEQ ID NO: 2388669 - DNA, 16 bp, Homo sapiens
gactgagcacctgctt

SEQ ID NO: 2388670 - DNA, 20 bp, Homo sapiens
gactgcgatcttcagagcag

SEQ ID NO: 2388671 - DNA, 22 bp, Homo sapiens
gagaaactgagaaatgaatgct

SEQ ID NO: 2388672 - DNA, 13 bp, Homo sapiens
gagaaagaagaga

SEQ ID NO: 2388673 - DNA, 20 bp, Homo sapiens
gagaaatgaatgctgagacc

SEQ ID NO: 2388674 - DNA, 13 bp, Homo sapiens
gagaagaggctgg

SEQ ID NO: 2388675 - DNA, 21 bp, Homo sapiens
gagaagggggattggagggaa

SEQ ID NO: 2388676 - DNA, 22 bp, Homo sapiens
gggaatgtttgggcagaaggga

SEQ ID NO: 2388677 - DNA, 16 bp, Homo sapiens
gggagccaacagcagc

SEQ ID NO: 2388678 - DNA, 17 bp, Homo sapiens
gggaggctgagacagga

SEQ ID NO: 2388679 - DNA, 13 bp, Homo sapiens
gggatcacaaggt

SEQ ID NO: 2388680 - DNA, 22 bp, Homo sapiens
gggatgtgaattgcctgcagag

SEQ ID NO: 2388681 - DNA, 19 bp, Homo sapiens
gggcagaagggagaaggat

SEQ ID NO: 2388682 - DNA, 21 bp, Homo sapiens
gggcagtggtaagctctggct

SEQ ID NO: 2388683 - DNA, 15 bp, Homo sapiens
gggcatgctcagccc

SEQ ID NO: 2388684 - DNA, 19 bp, Homo sapiens
gggccactctcccctccct

SEQ ID NO: 2388685 - DNA, 23 bp, Homo sapiens
gggccaggggtctccctggagtg

SEQ ID NO: 2388686 - DNA, 14 bp, Homo sapiens
gggccatgctgaag

SEQ ID NO: 2388687 - DNA, 13 bp, Homo sapiens
gggccgtgcccag

SEQ ID NO: 2388688 - DNA, 22 bp, Homo sapiens
gggcgtcgctggacaacccaga

SEQ ID NO: 2388689 - DNA, 18 bp, Homo sapiens
gggcttcgcttccttagc

SEQ ID NO: 2388690 - DNA, 20 bp, Homo sapiens
ggggattggagggaagacag

SEQ ID NO: 2388691 - DNA, 17 bp, Homo sapiens
gggggagccaacagcag

SEQ ID NO: 2388692 - DNA, 16 bp, Homo sapiens
gggggtccacccagca

SEQ ID NO: 2388693 - DNA, 20 bp, Homo sapiens
gggtccacccagcaaagagt

SEQ ID NO: 2388694 - DNA, 15 bp, Homo sapiens
gggtctggctgagct

SEQ ID NO: 2388695 - DNA, 16 bp, Homo sapiens
gggtgatttcagagag

SEQ ID NO: 2388696 - DNA, 21 bp, Homo sapiens
gggtggtctgagcaccccctc

SEQ ID NO: 2388697 - DNA, 14 bp, Homo sapiens
ggtatgagctgagg

SEQ ID NO: 2388698 - DNA, 15 bp, Homo sapiens
ggtatgagctgaggg

SEQ ID NO: 2388699 - DNA, 22 bp, Homo sapiens
ggtcaaaccgcactcacccatg

SEQ ID NO: 2388700 - DNA, 22 bp, Homo sapiens
ggtcactcttcctgcaaggact

SEQ ID NO: 2388701 - DNA, 13 bp, Homo sapiens
ggtcagccagggc

SEQ ID NO: 2388702 - DNA, 13 bp, Homo sapiens
ggtcccacactgg

SEQ ID NO: 2388703 - DNA, 21 bp, Homo sapiens
ggtcgccacacccggctcccc

SEQ ID NO: 2388704 - DNA, 17 bp, Homo sapiens
ggtctgagcaccccctc

SEQ ID NO: 2388705 - DNA, 18 bp, Homo sapiens
ggtctgagcaccccctca

SEQ ID NO: 2388706 - DNA, 14 bp, Homo sapiens
ggtcttcagccatc

SEQ ID NO: 2388707 - DNA, 23 bp, Homo sapiens
ggtgactgcgatcttcagagcag

SEQ ID NO: 2388708 - DNA, 16 bp, Homo sapiens
ggtgctgtggccaggg

SEQ ID NO: 2388709 - DNA, 14 bp, Homo sapiens
ggtggcaggaccag

SEQ ID NO: 2388710 - DNA, 22 bp, Homo sapiens
ggtgggaaatggtatgagctga

SEQ ID NO: 2388711 - DNA, 15 bp, Homo sapiens
ggtgggccactctcc

SEQ ID NO: 2388712 - DNA, 20 bp, Homo sapiens
ggtggggggatcacaaggtc

SEQ ID NO: 2388713 - DNA, 14 bp, Homo sapiens
ggtggtggatctgt

SEQ ID NO: 2388714 - DNA, 17 bp, Homo sapiens
ggtgtaaagttgttcgc

SEQ ID NO: 2388715 - DNA, 14 bp, Homo sapiens
ggttgatcacactc

SEQ ID NO: 2388716 - DNA, 13 bp, Homo sapiens
ggttgtgaggcct

SEQ ID NO: 2388717 - DNA, 15 bp, Homo sapiens
gtaaaagtgtgagca

SEQ ID NO: 2388718 - DNA, 23 bp, Homo sapiens
gtaaacataattcttgtatatta

SEQ ID NO: 2388719 - DNA, 22 bp, Homo sapiens
gtaacatgtttacttttcaggg

SEQ ID NO: 2388720 - DNA, 14 bp, Homo sapiens
gtaatcccagcact

SEQ ID NO: 2388721 - DNA, 16 bp, Homo sapiens
gtacgttatatattgt

SEQ ID NO: 2388722 - DNA, 18 bp, Homo sapiens
gtacgttatatattgtat

SEQ ID NO: 2388723 - DNA, 21 bp, Homo sapiens
gtagcaagttctagagaagag

SEQ ID NO: 2388724 - DNA, 15 bp, Homo sapiens
gtaggcagagccttt

SEQ ID NO: 2388725 - DNA, 17 bp, Homo sapiens
gtataaatggttgtctg

SEQ ID NO: 2388726 - DNA, 13 bp, Homo sapiens
gtatctccaggat

SEQ ID NO: 2388727 - DNA, 14 bp, Homo sapiens
gtatctccaggatt

SEQ ID NO: 2388728 - DNA, 12 bp, Homo sapiens
gtatgagctgag

SEQ ID NO: 2388729 - DNA, 13 bp, Homo sapiens
gtcaaaccgcact

SEQ ID NO: 2388730 - DNA, 22 bp, Homo sapiens
gtcaagattttttttgtaactt

SEQ ID NO: 2388731 - DNA, 15 bp, Homo sapiens
gtcagccagggccag

SEQ ID NO: 2388732 - DNA, 16 bp, Homo sapiens
gtcagccagggccagg

SEQ ID NO: 2388733 - DNA, 14 bp, Homo sapiens
gtccacccagcaaa

SEQ ID NO: 2388734 - DNA, 17 bp, Homo sapiens
gtcccacactggtgact

SEQ ID NO: 2388735 - DNA, 23 bp, Homo sapiens
gtccctctttgcctgtgtgagca

SEQ ID NO: 2388736 - DNA, 13 bp, Homo sapiens
gtcctgagacctg

SEQ ID NO: 2388737 - DNA, 16 bp, Homo sapiens
gtcgccacacccggct

SEQ ID NO: 2388738 - DNA, 23 bp, Homo sapiens
gtcgccacacccggctccccctg

SEQ ID NO: 2388739 - DNA, 22 bp, Homo sapiens
gtcggcacgtcccatgtgcatg

SEQ ID NO: 2388740 - DNA, 15 bp, Homo sapiens
gtctgagcaccccct

SEQ ID NO: 2388741 - DNA, 20 bp, Homo sapiens
gtctgattggctcacccaag

SEQ ID NO: 2388742 - DNA, 13 bp, Homo sapiens
gtctgcacccagg

SEQ ID NO: 2388743 - DNA, 17 bp, Homo sapiens
gtctgcacccaggggtg

SEQ ID NO: 2388744 - DNA, 18 bp, Homo sapiens
gtctgccaccatcctgct

SEQ ID NO: 2388745 - DNA, 15 bp, Homo sapiens
gtctggctgagctga

SEQ ID NO: 2388746 - DNA, 13 bp, Homo sapiens
gtctgtgcagctg

SEQ ID NO: 2388747 - DNA, 12 bp, Homo sapiens
gtgaacctggag

SEQ ID NO: 2388748 - DNA, 20 bp, Homo sapiens
gtgaataaagttagtgtgtt

SEQ ID NO: 2388749 - DNA, 20 bp, Homo sapiens
gtgaattgcctgcagagaga

SEQ ID NO: 2388750 - DNA, 14 bp, Homo sapiens
gtgaccaggggtga

SEQ ID NO: 2388751 - DNA, 15 bp, Homo sapiens
gtgacggtcccacac

SEQ ID NO: 2388752 - DNA, 17 bp, Homo sapiens
gtgactgcgatcttcag

SEQ ID NO: 2388753 - DNA, 17 bp, Homo sapiens
gtgagcagaggagtcca

SEQ ID NO: 2388754 - DNA, 19 bp, Homo sapiens
gtgatttcagagagggcag

SEQ ID NO: 2388755 - DNA, 19 bp, Homo sapiens
gtgcagttgacagcaggtg

SEQ ID NO: 2388756 - DNA, 20 bp, Homo sapiens
gtgcagttgacagcaggtgg

SEQ ID NO: 2388757 - DNA, 18 bp, Homo sapiens
gtgccaggactccccagg

SEQ ID NO: 2388758 - DNA, 23 bp, Homo sapiens
gtggatctccaaggaccaggtta

SEQ ID NO: 2388759 - DNA, 15 bp, Homo sapiens
gtggcaggaccagga

SEQ ID NO: 2388760 - DNA, 16 bp, Homo sapiens
gtggccatcagggtgg

SEQ ID NO: 2388761 - DNA, 20 bp, Homo sapiens
gtgggacaaaccagagcaga

SEQ ID NO: 2388762 - DNA, 19 bp, Homo sapiens
gtgggccactctcccctcc

SEQ ID NO: 2388763 - DNA, 16 bp, Homo sapiens
gtgggtggtggatctg

SEQ ID NO: 2388764 - DNA, 20 bp, Homo sapiens
gtggtggatctgtccaagga

SEQ ID NO: 2388765 - DNA, 21 bp, Homo sapiens
gtgtctgcacccaggggtggg

SEQ ID NO: 2388766 - DNA, 14 bp, Homo sapiens
gtgtgaataaagtt

SEQ ID NO: 2388767 - DNA, 23 bp, Homo sapiens
gtgtggtgggttctttggaagga

SEQ ID NO: 2388768 - DNA, 16 bp, Homo sapiens
gtgtgttgtctgtgca

SEQ ID NO: 2388769 - DNA, 14 bp, Homo sapiens
gtgttgtctgtgca

SEQ ID NO: 2388770 - DNA, 17 bp, Homo sapiens
gtgttgtctgtgcagct

SEQ ID NO: 2388771 - DNA, 23 bp, Homo sapiens
gttaacagagacagataactctc

SEQ ID NO: 2388772 - DNA, 17 bp, Homo sapiens
gttaactttaagactga

SEQ ID NO: 2388773 - DNA, 14 bp, Homo sapiens
gttaagggaaggaa

SEQ ID NO: 2388774 - DNA, 18 bp, Homo sapiens
gttccctgaacatctgtg

SEQ ID NO: 2388775 - DNA, 15 bp, Homo sapiens
gttctagagaagagg

SEQ ID NO: 2388776 - DNA, 18 bp, Homo sapiens
gttctttggaaggagtga

SEQ ID NO: 2388777 - DNA, 13 bp, Homo sapiens
gttcttttaaagg

SEQ ID NO: 2388778 - DNA, 15 bp, Homo sapiens
gttggaaaagaatac

SEQ ID NO: 2388779 - DNA, 14 bp, Homo sapiens
gttgtaaatattta

SEQ ID NO: 2388780 - DNA, 14 bp, Homo sapiens
gttgtctgtgcagc

SEQ ID NO: 2388781 - DNA, 17 bp, Homo sapiens
gtttacttttcagggca

SEQ ID NO: 2388782 - DNA, 14 bp, Homo sapiens
gtttgtgtgcatga

SEQ ID NO: 2388783 - DNA, 19 bp, Homo sapiens
gttttaaatttatttcaaa

SEQ ID NO: 2388784 - DNA, 17 bp, Homo sapiens
gttttgaactaataaaa

SEQ ID NO: 2388785 - DNA, 22 bp, Homo sapiens
gttttgaactaataaaagcata

SEQ ID NO: 2388786 - DNA, 20 bp, Homo sapiens
ttgacataacactataaagg

SEQ ID NO: 2388787 - DNA, 13 bp, Homo sapiens
ttgagaattttaa

SEQ ID NO: 2388788 - DNA, 14 bp, Homo sapiens
ttgcccttcacagt

SEQ ID NO: 2388789 - DNA, 16 bp, Homo sapiens
ttgcccttcacagtgt

SEQ ID NO: 2388790 - DNA, 17 bp, Homo sapiens
ttgcccttcacagtgtt

SEQ ID NO: 2388791 - DNA, 13 bp, Homo sapiens
ttgcctgcagaga

SEQ ID NO: 2388792 - DNA, 19 bp, Homo sapiens
ttgcctgcagagagaagcc

SEQ ID NO: 2388793 - DNA, 20 bp, Homo sapiens
ttgcctgtgtgagcatctct

SEQ ID NO: 2388794 - DNA, 24 bp, Homo sapiens
ttgcttaggatgtttttcatgaaa

SEQ ID NO: 2388795 - DNA, 19 bp, Homo sapiens
ttggaaaagaatacagaaa

SEQ ID NO: 2388796 - DNA, 14 bp, Homo sapiens
ttggactcctccca

SEQ ID NO: 2388797 - DNA, 23 bp, Homo sapiens
ttggcacagaaacacaatatttt

SEQ ID NO: 2388798 - DNA, 23 bp, Homo sapiens
ttggccgtggccatcagggtggg

SEQ ID NO: 2388799 - DNA, 22 bp, Homo sapiens
ttggctcacccaagcaaggcca

SEQ ID NO: 2388800 - DNA, 19 bp, Homo sapiens
ttgggcagaagggagaagg

SEQ ID NO: 2388801 - DNA, 20 bp, Homo sapiens
ttgggcagaagggagaagga

SEQ ID NO: 2388802 - DNA, 16 bp, Homo sapiens
ttgggttcatctgagc

SEQ ID NO: 2388803 - DNA, 12 bp, Homo sapiens
ttgtaaatattt

SEQ ID NO: 2388804 - DNA, 19 bp, Homo sapiens
ttgtaaatatttatgtaaa

SEQ ID NO: 2388805 - DNA, 13 bp, Homo sapiens
ttgtaacttcaaa

SEQ ID NO: 2388806 - DNA, 22 bp, Homo sapiens
ttgtacatacagaggtaactat

SEQ ID NO: 2388807 - DNA, 18 bp, Homo sapiens
ttgtatattatggaagat

SEQ ID NO: 2388808 - DNA, 19 bp, Homo sapiens
ttgtcctcccctattttaa

SEQ ID NO: 2388809 - DNA, 22 bp, Homo sapiens
tttaaaggggcagaaaaactct

SEQ ID NO: 2388810 - DNA, 18 bp, Homo sapiens
tttaaccctctcttccct

SEQ ID NO: 2388811 - DNA, 20 bp, Homo sapiens
tttaagtttgttgctgtcaa

SEQ ID NO: 2388812 - DNA, 13 bp, Homo sapiens
tttactccagtgg

SEQ ID NO: 2388813 - DNA, 21 bp, Homo sapiens
tttactccagtggtgaagaaa

SEQ ID NO: 2388814 - DNA, 22 bp, Homo sapiens
tttatgtaaactgcattagaaa

SEQ ID NO: 2388815 - DNA, 19 bp, Homo sapiens
tttccacgatgaaaaactt

SEQ ID NO: 2388816 - DNA, 22 bp, Homo sapiens
tttcccaccaccttggactcct

SEQ ID NO: 2388817 - DNA, 24 bp, Homo sapiens
tttcctactctcaggatcaagaaa

SEQ ID NO: 2388818 - DNA, 12 bp, Homo sapiens
tttcctccccac

SEQ ID NO: 2388819 - DNA, 14 bp, Homo sapiens
tttctgttcatctt

SEQ ID NO: 2388820 - DNA, 15 bp, Homo sapiens
tttgaactaataaaa

SEQ ID NO: 2388821 - DNA, 19 bp, Homo sapiens
tttgaaggaggtgagggat

SEQ ID NO: 2388822 - DNA, 20 bp, Homo sapiens
tttgggcagaagggagaagg

SEQ ID NO: 2388823 - DNA, 13 bp, Homo sapiens
tttgtaacttcaa

SEQ ID NO: 2388824 - DNA, 15 bp, Homo sapiens
tttgtaacttcaaat

SEQ ID NO: 2388825 - DNA, 15 bp, Homo sapiens
tttgtaccagtgtga

SEQ ID NO: 2388826 - DNA, 23 bp, Homo sapiens
tttgttggaaggtttggtgtgtg

SEQ ID NO: 2388827 - DNA, 21 bp, Homo sapiens
ttttaaattataacttaaaat

SEQ ID NO: 2388828 - DNA, 22 bp, Homo sapiens
ttttaagacgtgaatgtctcag

SEQ ID NO: 2388829 - DNA, 17 bp, Homo sapiens
ttttctgaataacattt

SEQ ID NO: 2388830 - DNA, 19 bp, Homo sapiens
ttttgctggtgtctgagct

SEQ ID NO: 2388831 - DNA, 11 bp, Homo sapiens
ttttgtaactt

SEQ ID NO: 2388832 - DNA, 16 bp, Homo sapiens
ttttgtaacttcaaat

SEQ ID NO: 2388833 - DNA, 16 bp, Homo sapiens
tttttactacagttgt

SEQ ID NO: 2388834 - DNA, 14 bp, Homo sapiens
tttttgtaacttca

SEQ ID NO: 2388835 - DNA, 12 bp, Homo sapiens
ttttttgaaaac

SEQ ID NO: 2388836 - DNA, 22 bp, Homo sapiens
acaggatcctattctcaccagg

SEQ ID NO: 2388837 - DNA, 14 bp, Homo sapiens
acaggcaaatgcat

SEQ ID NO: 2388838 - DNA, 15 bp, Homo sapiens
acaggtctagacttt

SEQ ID NO: 2388839 - DNA, 17 bp, Homo sapiens
acaggtctagactttct

SEQ ID NO: 2388840 - DNA, 21 bp, Homo sapiens
acaggtggcaggaccaggact

SEQ ID NO: 2388841 - DNA, 19 bp, Homo sapiens
acagtgtttcgacagctga

SEQ ID NO: 2388842 - DNA, 17 bp, Homo sapiens
acatctgttttaaattt

SEQ ID NO: 2388843 - DNA, 20 bp, Homo sapiens
acattaagattgaggcctgc

SEQ ID NO: 2388844 - DNA, 13 bp, Homo sapiens
accagaacaaggt

SEQ ID NO: 2388845 - DNA, 20 bp, Homo sapiens
accaggactatagcccaggt

SEQ ID NO: 2388846 - DNA, 14 bp, Homo sapiens
accagggcgcaagc

SEQ ID NO: 2388847 - DNA, 21 bp, Homo sapiens
accagtgtggtttgtgtttga

SEQ ID NO: 2388848 - DNA, 15 bp, Homo sapiens
acccaagcaaggcca

SEQ ID NO: 2388849 - DNA, 19 bp, Homo sapiens
acccagaactggacgccca

SEQ ID NO: 2388850 - DNA, 23 bp, Homo sapiens
acccagagcattacgtgagccag

SEQ ID NO: 2388851 - DNA, 24 bp, Homo sapiens
acccagagcattacgtgagccagg

SEQ ID NO: 2388852 - DNA, 17 bp, Homo sapiens
acccagagccttctcct

SEQ ID NO: 2388853 - DNA, 18 bp, Homo sapiens
acccagagccttctcctg

SEQ ID NO: 2388854 - DNA, 14 bp, Homo sapiens
acccagatcctcac

SEQ ID NO: 2388855 - DNA, 18 bp, Homo sapiens
  misc_feature (7)..(7): n is a, c, g or t
acccagnagggcgtcgct

SEQ ID NO: 2388856 - DNA, 20 bp, Homo sapiens
acccattttgagtgactcga

SEQ ID NO: 2388857 - DNA, 14 bp, Homo sapiens
accccaaagagcct

SEQ ID NO: 2388858 - DNA, 21 bp, Homo sapiens
accccaaagagcctggagaag

SEQ ID NO: 2388859 - DNA, 22 bp, Homo sapiens
accccaaagagcctggagaagc

SEQ ID NO: 2388860 - DNA, 21 bp, Homo sapiens
accccagctagggctggactc

SEQ ID NO: 2388861 - DNA, 17 bp, Homo sapiens
accccttatccaggact

SEQ ID NO: 2388862 - DNA, 16 bp, Homo sapiens
accccttcctttcctc

SEQ ID NO: 2388863 - DNA, 22 bp, Homo sapiens
acccggcccagagaccccttcc

SEQ ID NO: 2388864 - DNA, 21 bp, Homo sapiens
accctcccaccatgcgctgct

SEQ ID NO: 2388865 - DNA, 12 bp, Homo sapiens
accctctcttcc

SEQ ID NO: 2388866 - DNA, 20 bp, Homo sapiens
accgagcgctttctggaaaa

SEQ ID NO: 2388867 - DNA, 14 bp, Homo sapiens
acctatttgacata

SEQ ID NO: 2388868 - DNA, 17 bp, Homo sapiens
agaggcagagaaagaag

SEQ ID NO: 2388869 - DNA, 20 bp, Homo sapiens
agaggcagagaaagaagaga

SEQ ID NO: 2388870 - DNA, 21 bp, Homo sapiens
agaggcagagaaagaagagac

SEQ ID NO: 2388871 - DNA, 14 bp, Homo sapiens
agaggctggtgctg

SEQ ID NO: 2388872 - DNA, 16 bp, Homo sapiens
agaggctggtgctgtg

SEQ ID NO: 2388873 - DNA, 21 bp, Homo sapiens
agaggctggtgctgtggccag

SEQ ID NO: 2388874 - DNA, 22 bp, Homo sapiens
agaggctggtgctgtggccagg

SEQ ID NO: 2388875 - DNA, 19 bp, Homo sapiens
agaggtaaaagtgtgagca

SEQ ID NO: 2388876 - DNA, 23 bp, Homo sapiens
agaggtaaaagtgtgagcagtga

SEQ ID NO: 2388877 - DNA, 19 bp, Homo sapiens
agagtacagtgagccaaga

SEQ ID NO: 2388878 - DNA, 22 bp, Homo sapiens
agagtagcaagttctagagaag

SEQ ID NO: 2388879 - DNA, 13 bp, Homo sapiens
agagtttgaagga

SEQ ID NO: 2388880 - DNA, 14 bp, Homo sapiens
agataactgagaat

SEQ ID NO: 2388881 - DNA, 19 bp, Homo sapiens
agatgggtctggctgagct

SEQ ID NO: 2388882 - DNA, 15 bp, Homo sapiens
agatgtttgtcagat

SEQ ID NO: 2388883 - DNA, 19 bp, Homo sapiens
agattttaaattcacaata

SEQ ID NO: 2388884 - DNA, 22 bp, Homo sapiens
agattttaaattcacaatagaa

SEQ ID NO: 2388885 - DNA, 17 bp, Homo sapiens
agattttttttgtaact

SEQ ID NO: 2388886 - DNA, 22 bp, Homo sapiens
agcaaagagtgggctgcatctg

SEQ ID NO: 2388887 - DNA, 22 bp, Homo sapiens
agcaaagcaccagcttctccag

SEQ ID NO: 2388888 - DNA, 14 bp, Homo sapiens
agcaacacaagctg

SEQ ID NO: 2388889 - DNA, 13 bp, Homo sapiens
agcaagagctggc

SEQ ID NO: 2388890 - DNA, 17 bp, Homo sapiens
agcaagttctagagaag

SEQ ID NO: 2388891 - DNA, 14 bp, Homo sapiens
agcaattatattgt

SEQ ID NO: 2388892 - DNA, 15 bp, Homo sapiens
agcaattatattgtc

SEQ ID NO: 2388893 - DNA, 17 bp, Homo sapiens
agcaccagcttctccag

SEQ ID NO: 2388894 - DNA, 13 bp, Homo sapiens
agcaccccctcat

SEQ ID NO: 2388895 - DNA, 18 bp, Homo sapiens
agcaccccctcattcccc

SEQ ID NO: 2388896 - DNA, 20 bp, Homo sapiens
agcacctgcttcatgctcag

SEQ ID NO: 2388897 - DNA, 13 bp, Homo sapiens
agcacctgttttt

SEQ ID NO: 2388898 - DNA, 22 bp, Homo sapiens
agcactgctaggcgagtgccag

SEQ ID NO: 2388899 - DNA, 19 bp, Homo sapiens
agcactttaaccctctctt

SEQ ID NO: 2388900 - DNA, 21 bp, Homo sapiens
agcactttaaccctctcttcc

SEQ ID NO: 2388901 - DNA, 22 bp, Homo sapiens
agcactttaaccctctcttccc

SEQ ID NO: 2388902 - DNA, 19 bp, Homo sapiens
agcagaggagtccagggcg

SEQ ID NO: 2388903 - DNA, 18 bp, Homo sapiens
agcagatttaacaattcc

SEQ ID NO: 2388904 - DNA, 22 bp, Homo sapiens
ccactctcccctccctcttcct

SEQ ID NO: 2388905 - DNA, 13 bp, Homo sapiens
ccagactcagctc

SEQ ID NO: 2388906 - DNA, 14 bp, Homo sapiens
ccagagcagagagc

SEQ ID NO: 2388907 - DNA, 20 bp, Homo sapiens
ccagagcattacgtgagcca

SEQ ID NO: 2388908 - DNA, 22 bp, Homo sapiens
ccagagcattacgtgagccagg

SEQ ID NO: 2388909 - DNA, 23 bp, Homo sapiens
ccagagcattacgtgagccaggt

SEQ ID NO: 2388910 - DNA, 18 bp, Homo sapiens
ccagagccttctcctgcc

SEQ ID NO: 2388911 - DNA, 14 bp, Homo sapiens
ccagatcctcacaa

SEQ ID NO: 2388912 - DNA, 14 bp, Homo sapiens
ccagcctcctccca

SEQ ID NO: 2388913 - DNA, 18 bp, Homo sapiens
ccagcctcctcccaccac

SEQ ID NO: 2388914 - DNA, 14 bp, Homo sapiens
ccagctagggctgg

SEQ ID NO: 2388915 - DNA, 15 bp, Homo sapiens
ccagctgaggctggg

SEQ ID NO: 2388916 - DNA, 15 bp, Homo sapiens
ccagcttctccaggc

SEQ ID NO: 2388917 - DNA, 22 bp, Homo sapiens
ccaggaagggggtccacccagc

SEQ ID NO: 2388918 - DNA, 18 bp, Homo sapiens
ccaggactatagcccagg

SEQ ID NO: 2388919 - DNA, 22 bp, Homo sapiens
ccaggactatagcccaggtcct

SEQ ID NO: 2388920 - DNA, 17 bp, Homo sapiens
ccaggactccccaggcc

SEQ ID NO: 2388921 - DNA, 21 bp, Homo sapiens
ccaggactccccaggccaggc

SEQ ID NO: 2388922 - DNA, 23 bp, Homo sapiens
ccaggatggcccttcccactgga

SEQ ID NO: 2388923 - DNA, 18 bp, Homo sapiens
ccaggattgaagagcatt

SEQ ID NO: 2388924 - DNA, 15 bp, Homo sapiens
ccaggattttgtgtt

SEQ ID NO: 2388925 - DNA, 18 bp, Homo sapiens
ccaggcaggggtgggaga

SEQ ID NO: 2388926 - DNA, 12 bp, Homo sapiens
ccaggccaccag

SEQ ID NO: 2388927 - DNA, 18 bp, Homo sapiens
ccaggccaggccaccagg

SEQ ID NO: 2388928 - DNA, 22 bp, Homo sapiens
ccaggctctttggggtcagcca

SEQ ID NO: 2388929 - DNA, 23 bp, Homo sapiens
ccaggctctttggggtcagccag

SEQ ID NO: 2388930 - DNA, 13 bp, Homo sapiens
ccagggagaccga

SEQ ID NO: 2388931 - DNA, 18 bp, Homo sapiens
ccaggggcccacagggaa

SEQ ID NO: 2388932 - DNA, 17 bp, Homo sapiens
ccaggggtctccctgga

SEQ ID NO: 2388933 - DNA, 15 bp, Homo sapiens
ccagggtgagagctg

SEQ ID NO: 2388934 - DNA, 16 bp, Homo sapiens
ccagggttgatcacac

SEQ ID NO: 2388935 - DNA, 15 bp, Homo sapiens
ccaggtatctccagg

SEQ ID NO: 2388936 - DNA, 13 bp, Homo sapiens
ccaggtcctctga

SEQ ID NO: 2388937 - DNA, 14 bp, Homo sapiens
ccaggtcctctgat

SEQ ID NO: 2388938 - DNA, 22 bp, Homo sapiens
ccaggtcctctgatacccagag

SEQ ID NO: 2388939 - DNA, 24 bp, Homo sapiens
ccatcagggtgggccactctcccc

SEQ ID NO: 2388940 - DNA, 15 bp, Homo sapiens
ccatcccctttcctc

SEQ ID NO: 2388941 - DNA, 19 bp, Homo sapiens
ccatgcgctgctcaacctc

SEQ ID NO: 2388942 - DNA, 13 bp, Homo sapiens
ccatgctgaaggg

SEQ ID NO: 2388943 - DNA, 19 bp, Homo sapiens
cccaaagagcctggagaag

SEQ ID NO: 2388944 - DNA, 21 bp, Homo sapiens
cccaataaacattaagattga

SEQ ID NO: 2388945 - DNA, 19 bp, Homo sapiens
cccaccatgcgctgctcaa

SEQ ID NO: 2388946 - DNA, 15 bp, Homo sapiens
cccaccttccccaga

SEQ ID NO: 2388947 - DNA, 23 bp, Homo sapiens
cccactcctcactgccccaccag

SEQ ID NO: 2388948 - DNA, 14 bp, Homo sapiens
cccagactcagctc

SEQ ID NO: 2388949 - DNA, 21 bp, Homo sapiens
cccagagaccccttcctttcc

SEQ ID NO: 2388950 - DNA, 23 bp, Homo sapiens
cccagagaccccttcctttcctc

SEQ ID NO: 2388951 - DNA, 17 bp, Homo sapiens
cccagagccttctcctg

SEQ ID NO: 2388952 - DNA, 17 bp, Homo sapiens
cccagagtgtgaaactt

SEQ ID NO: 2388953 - DNA, 22 bp, Homo sapiens
cccagcaacacaagctggaagc

SEQ ID NO: 2388954 - DNA, 17 bp, Homo sapiens
cagactcagctccagaa

SEQ ID NO: 2388955 - DNA, 22 bp, Homo sapiens
cagagaaagaagagacaggagg

SEQ ID NO: 2388956 - DNA, 15 bp, Homo sapiens
cagagaccccttcct

SEQ ID NO: 2388957 - DNA, 22 bp, Homo sapiens
cagagaccccttcctttcctct

SEQ ID NO: 2388958 - DNA, 12 bp, Homo sapiens
cagagagaagcc

SEQ ID NO: 2388959 - DNA, 23 bp, Homo sapiens
cagagcaggggtccttggtgtga

SEQ ID NO: 2388960 - DNA, 21 bp, Homo sapiens
cagagcattacgtgagccagg

SEQ ID NO: 2388961 - DNA, 24 bp, Homo sapiens
cagagcctggggcatcccagagcc

SEQ ID NO: 2388962 - DNA, 18 bp, Homo sapiens
cagagcctttggatgacc

SEQ ID NO: 2388963 - DNA, 19 bp, Homo sapiens
cagaggagtccagggcggg

SEQ ID NO: 2388964 - DNA, 18 bp, Homo sapiens
cagaggtaaaagtgtgag

SEQ ID NO: 2388965 - DNA, 15 bp, Homo sapiens
cagaggtgagcagag

SEQ ID NO: 2388966 - DNA, 17 bp, Homo sapiens
cagaggtgagcagagga

SEQ ID NO: 2388967 - DNA, 18 bp, Homo sapiens
cagaggtgagcagaggag

SEQ ID NO: 2388968 - DNA, 22 bp, Homo sapiens
cagaggtgagcagaggagtcca

SEQ ID NO: 2388969 - DNA, 15 bp, Homo sapiens
cagatatgatatgta

SEQ ID NO: 2388970 - DNA, 19 bp, Homo sapiens
cagcaaagagtgggctgca

SEQ ID NO: 2388971 - DNA, 17 bp, Homo sapiens
cagcaacacaagctgga

SEQ ID NO: 2388972 - DNA, 18 bp, Homo sapiens
cagcactttaaccctctc

SEQ ID NO: 2388973 - DNA, 18 bp, Homo sapiens
cagcagatggaaagaaag

SEQ ID NO: 2388974 - DNA, 15 bp, Homo sapiens
cagccagggccaggg

SEQ ID NO: 2388975 - DNA, 15 bp, Homo sapiens
cagcccagcctctgt

SEQ ID NO: 2388976 - DNA, 15 bp, Homo sapiens
cagcctcgcatgcca

SEQ ID NO: 2388977 - DNA, 23 bp, Homo sapiens
cagcctctgtccctctttgcctg

SEQ ID NO: 2388978 - DNA, 18 bp, Homo sapiens
cagcctggtagaattggg

SEQ ID NO: 2388979 - DNA, 18 bp, Homo sapiens
cagcgagaggcagagaaa

SEQ ID NO: 2388980 - DNA, 14 bp, Homo sapiens
cagcttctccaggc

SEQ ID NO: 2388981 - DNA, 15 bp, Homo sapiens
cagcttctccaggct

SEQ ID NO: 2388982 - DNA, 14 bp, Homo sapiens
caggaactcccagc

SEQ ID NO: 2388983 - DNA, 17 bp, Homo sapiens
caggaactcccagcaac

SEQ ID NO: 2388984 - DNA, 18 bp, Homo sapiens
caggaagggggtccaccc

SEQ ID NO: 2388985 - DNA, 13 bp, Homo sapiens
caggaccaggact

SEQ ID NO: 2388986 - DNA, 18 bp, Homo sapiens
caggactccccaggccag

SEQ ID NO: 2388987 - DNA, 20 bp, Homo sapiens
caggactccccaggccaggc

SEQ ID NO: 2388988 - DNA, 21 bp, Homo sapiens
caggatcctattctcaccagg

SEQ ID NO: 2388989 - DNA, 22 bp, Homo sapiens
caggatcctattctcaccagga

SEQ ID NO: 2388990 - DNA, 15 bp, Homo sapiens
caggcaccccctgga

SEQ ID NO: 2388991 - DNA, 18 bp, Homo sapiens
caggcaccccctggagag

SEQ ID NO: 2388992 - DNA, 18 bp, Homo sapiens
caggccaggccaccagga

SEQ ID NO: 2388993 - DNA, 23 bp, Homo sapiens
caggctctttggggtcagccagg

SEQ ID NO: 2388994 - DNA, 11 bp, Homo sapiens
caggctgaggt

SEQ ID NO: 2388995 - DNA, 22 bp, Homo sapiens
cagggaaccctgcttgcacttt

SEQ ID NO: 2388996 - DNA, 19 bp, Homo sapiens
cagggagaccgagcgcttt

SEQ ID NO: 2388997 - DNA, 13 bp, Homo sapiens
cagggcgcaagcc

SEQ ID NO: 2388998 - DNA, 20 bp, Homo sapiens
caggggggttgtgaggcctg

SEQ ID NO: 2388999 - DNA, 14 bp, Homo sapiens
caggggtctgagcc

SEQ ID NO: 2389000 - DNA, 20 bp, Homo sapiens
caggggtgatttcagagagg

SEQ ID NO: 2389001 - DNA, 17 bp, Homo sapiens
ctctgatacccagagca

SEQ ID NO: 2389002 - DNA, 15 bp, Homo sapiens
ctctgccctccctgg

SEQ ID NO: 2389003 - DNA, 17 bp, Homo sapiens
ctctggaaaactcagga

SEQ ID NO: 2389004 - DNA, 21 bp, Homo sapiens
ctctggaaaatgtgacccaga

SEQ ID NO: 2389005 - DNA, 21 bp, Homo sapiens
ctctggaagagaggaatgcct

SEQ ID NO: 2389006 - DNA, 13 bp, Homo sapiens
ctctggcacccag

SEQ ID NO: 2389007 - DNA, 14 bp, Homo sapiens
ctctggcttccagg

SEQ ID NO: 2389008 - DNA, 15 bp, Homo sapiens
ctctgtccctctttg

SEQ ID NO: 2389009 - DNA, 22 bp, Homo sapiens
ctcttccttcccccatcccctt

SEQ ID NO: 2389010 - DNA, 20 bp, Homo sapiens
ctcttgggcatgctcagccc

SEQ ID NO: 2389011 - DNA, 18 bp, Homo sapiens
ctgaaaagactcagtgtt

SEQ ID NO: 2389012 - DNA, 16 bp, Homo sapiens
ctgaacatctgtgtgt

SEQ ID NO: 2389013 - DNA, 15 bp, Homo sapiens
ctgaataacatttgt

SEQ ID NO: 2389014 - DNA, 20 bp, Homo sapiens
ctgaataacatttgtgtggt

SEQ ID NO: 2389015 - DNA, 17 bp, Homo sapiens
ctgaatgctctgtgcga

SEQ ID NO: 2389016 - DNA, 20 bp, Homo sapiens
ctgacagccctgcggagacc

SEQ ID NO: 2389017 - DNA, 22 bp, Homo sapiens
ctgagaaatgaatgctgagacc

SEQ ID NO: 2389018 - DNA, 16 bp, Homo sapiens
ctgagaattccaagga

SEQ ID NO: 2389019 - DNA, 13 bp, Homo sapiens
ctgagacaggaga

SEQ ID NO: 2389020 - DNA, 15 bp, Homo sapiens
ctgagcaagagctgg

SEQ ID NO: 2389021 - DNA, 20 bp, Homo sapiens
ctgagcaagagctggcaaag

SEQ ID NO: 2389022 - DNA, 16 bp, Homo sapiens
ctgaggggggccgtgc

SEQ ID NO: 2389023 - DNA, 20 bp, Homo sapiens
ctgaggggggccgtgcccag

SEQ ID NO: 2389024 - DNA, 22 bp, Homo sapiens
ctgaggggggccgtgcccaggg

SEQ ID NO: 2389025 - DNA, 14 bp, Homo sapiens
ctgatacccagagc

SEQ ID NO: 2389026 - DNA, 20 bp, Homo sapiens
ctgatgttacatcacagtgt

SEQ ID NO: 2389027 - DNA, 14 bp, Homo sapiens
ctgattggctcacc

SEQ ID NO: 2389028 - DNA, 12 bp, Homo sapiens
ctgatttctcac

SEQ ID NO: 2389029 - DNA, 14 bp, Homo sapiens
ctgcagagagaagc

SEQ ID NO: 2389030 - DNA, 20 bp, Homo sapiens
ctgcagcctggtagaattgg

SEQ ID NO: 2389031 - DNA, 20 bp, Homo sapiens
ctgcattttattctggatgg

SEQ ID NO: 2389032 - DNA, 15 bp, Homo sapiens
ctgccccaccagcca

SEQ ID NO: 2389033 - DNA, 12 bp, Homo sapiens
ctgccctcaggg

SEQ ID NO: 2389034 - DNA, 14 bp, Homo sapiens
ctgccctccctggc

SEQ ID NO: 2389035 - DNA, 20 bp, Homo sapiens
ctgccctccctggcctcacg

SEQ ID NO: 2389036 - DNA, 18 bp, Homo sapiens
ctgcctacattccctggc

SEQ ID NO: 2389037 - DNA, 20 bp, Homo sapiens
ctgcctacattccctggcct

SEQ ID NO: 2389038 - DNA, 21 bp, Homo sapiens
ctgcctacattccctggcctg

SEQ ID NO: 2389039 - DNA, 19 bp, Homo sapiens
ctgcgatcttcagagcagg

SEQ ID NO: 2389040 - DNA, 20 bp, Homo sapiens
ctgcgatcttcagagcaggg

SEQ ID NO: 2389041 - DNA, 15 bp, Homo sapiens
ctgctagagaagggg

SEQ ID NO: 2389042 - DNA, 19 bp, Homo sapiens
ctgctaggcgagtgccagg

SEQ ID NO: 2389043 - DNA, 13 bp, Homo sapiens
ctgctgctgtgtt

SEQ ID NO: 2389044 - DNA, 23 bp, Homo sapiens
ctgctgggaccccagctagggct

SEQ ID NO: 2389045 - DNA, 22 bp, Homo sapiens
ctgcttctcagccccgggcctg

SEQ ID NO: 2389046 - DNA, 14 bp, Homo sapiens
ctggaaaagaggag

SEQ ID NO: 2389047 - DNA, 13 bp, Homo sapiens
ctggacaacccag

SEQ ID NO: 2389048 - DNA, 18 bp, Homo sapiens
ctggactctggcacccag

SEQ ID NO: 2389049 - DNA, 17 bp, Homo sapiens
ctggagagaagtttctg

SEQ ID NO: 2389050 - DNA, 21 bp, Homo sapiens
ctggcaatgaaaaattctcag

SEQ ID NO: 2389051 - DNA, 22 bp, Homo sapiens
ctggcaatgaaaaattctcagt

SEQ ID NO: 2389052 - DNA, 12 bp, Homo sapiens
ctggccctggct

SEQ ID NO: 2389053 - DNA, 18 bp, Homo sapiens
ctggctctcctgtagctc

SEQ ID NO: 2389054 - DNA, 19 bp, Homo sapiens
ctggctgaccccaaagagc

SEQ ID NO: 2389055 - DNA, 15 bp, Homo sapiens
ctggctttctccgac

SEQ ID NO: 2389056 - DNA, 16 bp, Homo sapiens
ctgggaccccagctag

SEQ ID NO: 2389057 - DNA, 22 bp, Homo sapiens
ctgggaggcggagagtacagtg

SEQ ID NO: 2389058 - DNA, 13 bp, Homo sapiens
ctggggcatccca

SEQ ID NO: 2389059 - DNA, 18 bp, Homo sapiens
ctgggggcgggggagcca

SEQ ID NO: 2389060 - DNA, 23 bp, Homo sapiens
ctgggggcttcgcttccttagcc

SEQ ID NO: 2389061 - DNA, 22 bp, Homo sapiens
ctgggtttattacatggcagtg

SEQ ID NO: 2389062 - DNA, 23 bp, Homo sapiens
ctgggtttattacatggcagtgt

SEQ ID NO: 2389063 - DNA, 21 bp, Homo sapiens
ctggtgactgcgatcttcaga

SEQ ID NO: 2389064 - DNA, 19 bp, Homo sapiens
ctggtgcagaggtgagcag

SEQ ID NO: 2389065 - DNA, 23 bp, Homo sapiens
ctggtgcagaggtgagcagagga

SEQ ID NO: 2389066 - DNA, 22 bp, Homo sapiens
ctggtgctataggctggagaag

SEQ ID NO: 2389067 - DNA, 12 bp, Homo sapiens
ctggtgctgtgg

SEQ ID NO: 2389068 - DNA, 23 bp, Homo sapiens
ctggtttcatttctactgtgact

SEQ ID NO: 2389069 - DNA, 14 bp, Homo sapiens
ctgtaatcccagca

SEQ ID NO: 2389070 - DNA, 15 bp, Homo sapiens
ctgtagctctcctgg

SEQ ID NO: 2389071 - DNA, 17 bp, Homo sapiens
ctgtagtcccagccact

SEQ ID NO: 2389072 - DNA, 19 bp, Homo sapiens
ctgtataatctatttacat

SEQ ID NO: 2389073 - DNA, 18 bp, Homo sapiens
ctgtcaatttccctgact

SEQ ID NO: 2389074 - DNA, 19 bp, Homo sapiens
ctgtcaatttccctgactc

SEQ ID NO: 2389075 - DNA, 19 bp, Homo sapiens
ctgtcataagaatgaataa

SEQ ID NO: 2389076 - DNA, 16 bp, Homo sapiens
ctgtgtacccactcct

SEQ ID NO: 2389077 - DNA, 20 bp, Homo sapiens
ctgtgtacccactcctcact

SEQ ID NO: 2389078 - DNA, 19 bp, Homo sapiens
ctgtgtgaaataccagtgt

SEQ ID NO: 2389079 - DNA, 12 bp, Homo sapiens
ctgtgtgagcat

SEQ ID NO: 2389080 - DNA, 16 bp, Homo sapiens
ctgtgtgtgtccccct

SEQ ID NO: 2389081 - DNA, 12 bp, Homo sapiens
ctgttttaaatt

SEQ ID NO: 2389082 - DNA, 12 bp, Homo sapiens
cttaaaaaactt

SEQ ID NO: 2389083 - DNA, 13 bp, Homo sapiens
cttaaaatatttt

SEQ ID NO: 2389084 - DNA, 14 bp, Homo sapiens
cttaaaatatttta

SEQ ID NO: 2389085 - DNA, 14 bp, Homo sapiens
cttaaacctgggag

SEQ ID NO: 2389086 - DNA, 20 bp, Homo sapiens
cttaagccttttgctcacaa

SEQ ID NO: 2389087 - DNA, 23 bp, Homo sapiens
cttagcttctattatagccacat

SEQ ID NO: 2389088 - DNA, 17 bp, Homo sapiens
cttcatgctcagccctg

SEQ ID NO: 2389089 - DNA, 19 bp, Homo sapiens
cttcatgctcagccctgac

SEQ ID NO: 2389090 - DNA, 16 bp, Homo sapiens
cttccaagcaaaggtg

SEQ ID NO: 2389091 - DNA, 17 bp, Homo sapiens
cttccccagactcagct

SEQ ID NO: 2389092 - DNA, 19 bp, Homo sapiens
cttccccagactcagctcc

SEQ ID NO: 2389093 - DNA, 20 bp, Homo sapiens
cttccccagactcagctcca

SEQ ID NO: 2389094 - DNA, 22 bp, Homo sapiens
cttcccccatcccctttcctcc

SEQ ID NO: 2389095 - DNA, 12 bp, Homo sapiens
cttccttccccc

SEQ ID NO: 2389096 - DNA, 12 bp, Homo sapiens
cttctccaggct

SEQ ID NO: 2389097 - DNA, 14 bp, Homo sapiens
cttctcctgcctac

SEQ ID NO: 2389098 - DNA, 14 bp, Homo sapiens
cttgaggagtgtga

SEQ ID NO: 2389099 - DNA, 22 bp, Homo sapiens
cttgaggagtgtgagaatcaaa

SEQ ID NO: 2389100 - DNA, 18 bp, Homo sapiens
cttgcattgaatatatta

SEQ ID NO: 2389101 - DNA, 20 bp, Homo sapiens
cttgctcgctgtaaaatctt

SEQ ID NO: 2389102 - DNA, 13 bp, Homo sapiens
cttggactcctcc

SEQ ID NO: 2389103 - DNA, 14 bp, Homo sapiens
cttggactcctccc

SEQ ID NO: 2389104 - DNA, 23 bp, Homo sapiens
cttggggggtttttactccagtg

SEQ ID NO: 2389105 - DNA, 19 bp, Homo sapiens
cttggtgtgaccctctgaa

SEQ ID NO: 2389106 - DNA, 18 bp, Homo sapiens
ctttcctatcatggagtg

SEQ ID NO: 2389107 - DNA, 11 bp, Homo sapiens
ctttcctcccc

SEQ ID NO: 2389108 - DNA, 14 bp, Homo sapiens
ctttgcctgtgtga

SEQ ID NO: 2389109 - DNA, 18 bp, Homo sapiens
ctttgcctgtgtgagcat

SEQ ID NO: 2389110 - DNA, 15 bp, Homo sapiens
ctttggaaggagtga

SEQ ID NO: 2389111 - DNA, 14 bp, Homo sapiens
tactccagtggtga

SEQ ID NO: 2389112 - DNA, 19 bp, Homo sapiens
tactccagtggtgaagaaa

SEQ ID NO: 2389113 - DNA, 13 bp, Homo sapiens
tactgtgactgat

SEQ ID NO: 2389114 - DNA, 16 bp, Homo sapiens
tacttgaactttccaa

SEQ ID NO: 2389115 - DNA, 17 bp, Homo sapiens
tacttgaactttccaaa

SEQ ID NO: 2389116 - DNA, 22 bp, Homo sapiens
tacttgaactttccaaaaccta

SEQ ID NO: 2389117 - DNA, 15 bp, Homo sapiens
tagactttctcagtg

SEQ ID NO: 2389118 - DNA, 17 bp, Homo sapiens
tagagatatttttgtac

SEQ ID NO: 2389119 - DNA, 21 bp, Homo sapiens
tagattaccccctcattgttt

SEQ ID NO: 2389120 - DNA, 16 bp, Homo sapiens
tagcaaggcatgatgt

SEQ ID NO: 2389121 - DNA, 22 bp, Homo sapiens
tagcaggtggtcctgagacctg

SEQ ID NO: 2389122 - DNA, 19 bp, Homo sapiens
tagccacatccctttgaaa

SEQ ID NO: 2389123 - DNA, 19 bp, Homo sapiens
tagcccaggtcctctgata

SEQ ID NO: 2389124 - DNA, 18 bp, Homo sapiens
tagccttgctcaggtgca

SEQ ID NO: 2389125 - DNA, 19 bp, Homo sapiens
taggatgtttttcatgaaa

SEQ ID NO: 2389126 - DNA, 12 bp, Homo sapiens
taggctggagaa

SEQ ID NO: 2389127 - DNA, 19 bp, Homo sapiens
taggctggagaagctcacc

SEQ ID NO: 2389128 - DNA, 13 bp, Homo sapiens
tagggacttaaaa

SEQ ID NO: 2389129 - DNA, 18 bp, Homo sapiens
tagtgtgttgtctgtgca

SEQ ID NO: 2389130 - DNA, 16 bp, Homo sapiens
tataaaagacaaaact

SEQ ID NO: 2389131 - DNA, 18 bp, Homo sapiens
tataatctatttacataa

SEQ ID NO: 2389132 - DNA, 19 bp, Homo sapiens
tataatttttaaagtatat

SEQ ID NO: 2389133 - DNA, 13 bp, Homo sapiens
tatacatttctgt

SEQ ID NO: 2389134 - DNA, 19 bp, Homo sapiens
tatagagatatttttgtac

SEQ ID NO: 2389135 - DNA, 21 bp, Homo sapiens
tatagagatatttttgtacgt

SEQ ID NO: 2389136 - DNA, 16 bp, Homo sapiens
tatatattgtattaag

SEQ ID NO: 2389137 - DNA, 15 bp, Homo sapiens
tatattgtattaagg

SEQ ID NO: 2389138 - DNA, 19 bp, Homo sapiens
tatattgtcagatattttt

SEQ ID NO: 2389139 - DNA, 11 bp, Homo sapiens
tatccaggact

SEQ ID NO: 2389140 - DNA, 23 bp, Homo sapiens
tatctccaggattgaagagcatt

SEQ ID NO: 2389141 - DNA, 14 bp, Homo sapiens
tatggaatacagtg

SEQ ID NO: 2389142 - DNA, 23 bp, Homo sapiens
tatggaatacagtgttattttct

SEQ ID NO: 2389143 - DNA, 14 bp, Homo sapiens
tatgtaaacataat

SEQ ID NO: 2389144 - DNA, 19 bp, Homo sapiens
tatgtaaactgcattagaa

SEQ ID NO: 2389145 - DNA, 20 bp, Homo sapiens
tatgtatggaatacagtgtt

SEQ ID NO: 2389146 - DNA, 12 bp, Homo sapiens
tattacttgaac

SEQ ID NO: 2389147 - DNA, 15 bp, Homo sapiens
tattataacttaaaa

SEQ ID NO: 2389148 - DNA, 16 bp, Homo sapiens
tattataacttaaaaa

SEQ ID NO: 2389149 - DNA, 12 bp, Homo sapiens
tattgtattaag

SEQ ID NO: 2389150 - DNA, 19 bp, Homo sapiens
tcaagattttttttgtaac

SEQ ID NO: 2389151 - DNA, 17 bp, Homo sapiens
tcaatatttaagtttgt

SEQ ID NO: 2389152 - DNA, 17 bp, Homo sapiens
tcacaaaacctggcaca

SEQ ID NO: 2389153 - DNA, 14 bp, Homo sapiens
tcacaatagaaact

SEQ ID NO: 2389154 - DNA, 23 bp, Homo sapiens
tcacacagtgggtggtggatctg

SEQ ID NO: 2389155 - DNA, 14 bp, Homo sapiens
tcacagtgtttgca

SEQ ID NO: 2389156 - DNA, 12 bp, Homo sapiens
tcacccatgtgc

SEQ ID NO: 2389157 - DNA, 14 bp, Homo sapiens
tcacgcccagcctc

SEQ ID NO: 2389158 - DNA, 16 bp, Homo sapiens
tcacgcccagcctcct

SEQ ID NO: 2389159 - DNA, 18 bp, Homo sapiens
tcactattacttgaactt

SEQ ID NO: 2389160 - DNA, 19 bp, Homo sapiens
tcactcttcctgcaaggac

SEQ ID NO: 2389161 - DNA, 22 bp, Homo sapiens
tcactgaatgcctcaatgtgac

SEQ ID NO: 2389162 - DNA, 22 bp, Homo sapiens
tcagatattttttcagaaatat

SEQ ID NO: 2389163 - DNA, 16 bp, Homo sapiens
tcaggatcaagaaagt

SEQ ID NO: 2389164 - DNA, 17 bp, Homo sapiens
tcaggatcaagaaagtg

SEQ ID NO: 2389165 - DNA, 13 bp, Homo sapiens
tcaggctgaggtg

SEQ ID NO: 2389166 - DNA, 16 bp, Homo sapiens
tcattcaatacaagtg

SEQ ID NO: 2389167 - DNA, 23 bp, Homo sapiens
tcattgtttattaacaaattatg

SEQ ID NO: 2389168 - DNA, 15 bp, Homo sapiens
tcatttctactgtga

SEQ ID NO: 2389169 - DNA, 18 bp, Homo sapiens
tcatttctactgtgactg

SEQ ID NO: 2389170 - DNA, 18 bp, Homo sapiens
tccaacaataaagagctc

SEQ ID NO: 2389171 - DNA, 11 bp, Homo sapiens
tccaagcaaag

SEQ ID NO: 2389172 - DNA, 22 bp, Homo sapiens
tccaatcccatagatgggtctg

SEQ ID NO: 2389173 - DNA, 19 bp, Homo sapiens
tccacacacgcaggaactc

SEQ ID NO: 2389174 - DNA, 19 bp, Homo sapiens
tccaggattgaagagcatt

SEQ ID NO: 2389175 - DNA, 22 bp, Homo sapiens
tccaggctctttggggtcagcc

SEQ ID NO: 2389176 - DNA, 18 bp, Homo sapiens
tccagggttgatcacact

SEQ ID NO: 2389177 - DNA, 15 bp, Homo sapiens
tccaggtatctccag

SEQ ID NO: 2389178 - DNA, 15 bp, Homo sapiens
tccagtatggaagaa

SEQ ID NO: 2389179 - DNA, 22 bp, Homo sapiens
tccagtatggaagaatggggtg

SEQ ID NO: 2389180 - DNA, 12 bp, Homo sapiens
tccagtttccca

SEQ ID NO: 2389181 - DNA, 21 bp, Homo sapiens
tccatgaagaccacatccaca

SEQ ID NO: 2389182 - DNA, 20 bp, Homo sapiens
tcccaccaccttggactcct

SEQ ID NO: 2389183 - DNA, 19 bp, Homo sapiens
tcccaccatgcgctgctca

SEQ ID NO: 2389184 - DNA, 15 bp, Homo sapiens
tctccagttttcagt

SEQ ID NO: 2389185 - DNA, 15 bp, Homo sapiens
tctcccctccctctt

SEQ ID NO: 2389186 - DNA, 22 bp, Homo sapiens
tctcccctccctcttccttccc

SEQ ID NO: 2389187 - DNA, 12 bp, Homo sapiens
tctcctgcctac

SEQ ID NO: 2389188 - DNA, 23 bp, Homo sapiens
tctcctgcctacattccctggcc

SEQ ID NO: 2389189 - DNA, 19 bp, Homo sapiens
tctctacccggcccagaga

SEQ ID NO: 2389190 - DNA, 22 bp, Homo sapiens
tctctgtataatctatttacat

SEQ ID NO: 2389191 - DNA, 16 bp, Homo sapiens
tctgaataacatttgt

SEQ ID NO: 2389192 - DNA, 15 bp, Homo sapiens
tctgagcaagagctg

SEQ ID NO: 2389193 - DNA, 17 bp, Homo sapiens
tctgagcaagagctggc

SEQ ID NO: 2389194 - DNA, 14 bp, Homo sapiens
tctgagcaccccct

SEQ ID NO: 2389195 - DNA, 15 bp, Homo sapiens
tctgagcaccccctc

SEQ ID NO: 2389196 - DNA, 14 bp, Homo sapiens
tctgatacccagag

SEQ ID NO: 2389197 - DNA, 15 bp, Homo sapiens
tctggaaaactcagg

SEQ ID NO: 2389198 - DNA, 18 bp, Homo sapiens
tctggaaaatgtgaccca

SEQ ID NO: 2389199 - DNA, 13 bp, Homo sapiens
tctggaagagagg

SEQ ID NO: 2389200 - DNA, 20 bp, Homo sapiens
tctggaagagaggaatgcct

SEQ ID NO: 2389201 - DNA, 12 bp, Homo sapiens
tctggcacccag

SEQ ID NO: 2389202 - DNA, 18 bp, Homo sapiens
tctggctgaacactggca

SEQ ID NO: 2389203 - DNA, 14 bp, Homo sapiens
tctggctgagctga

SEQ ID NO: 2389204 - DNA, 21 bp, Homo sapiens
tctggctgagctgaacccatt

SEQ ID NO: 2389205 - DNA, 22 bp, Homo sapiens
tctggcttccaggtatctccag

SEQ ID NO: 2389206 - DNA, 24 bp, Homo sapiens
tctggcttccaggtatctccagga

SEQ ID NO: 2389207 - DNA, 23 bp, Homo sapiens
tctggctttctccgactgctagg

SEQ ID NO: 2389208 - DNA, 18 bp, Homo sapiens
tctgggaaataagagaga

SEQ ID NO: 2389209 - DNA, 20 bp, Homo sapiens
tctggtagatttttaacgaa

SEQ ID NO: 2389210 - DNA, 17 bp, Homo sapiens
tctgtccctctttgcct

SEQ ID NO: 2389211 - DNA, 23 bp, Homo sapiens
tctgtgtgtgtccccctatgctc

SEQ ID NO: 2389212 - DNA, 24 bp, Homo sapiens
tcttccaagcaaaggtgaagagac

SEQ ID NO: 2389213 - DNA, 11 bp, Homo sapiens
tcttccttccc

SEQ ID NO: 2389214 - DNA, 12 bp, Homo sapiens
tcttccttcccc

SEQ ID NO: 2389215 - DNA, 18 bp, Homo sapiens
tctttgcctgtgtgagca

SEQ ID NO: 2389216 - DNA, 18 bp, Homo sapiens
tctttggggtcagccagg

SEQ ID NO: 2389217 - DNA, 14 bp, Homo sapiens
tgaaaaaaaagttt

SEQ ID NO: 2389218 - DNA, 16 bp, Homo sapiens
tgaaaaaaaagtttca

SEQ ID NO: 2389219 - DNA, 19 bp, Homo sapiens
tgaaaacatggtagaattg

SEQ ID NO: 2389220 - DNA, 19 bp, Homo sapiens
tgaacccattttgagtgac

SEQ ID NO: 2389221 - DNA, 16 bp, Homo sapiens
tgaactgcgtgccagt

SEQ ID NO: 2389222 - DNA, 14 bp, Homo sapiens
tgaactttccaaaa

SEQ ID NO: 2389223 - DNA, 20 bp, Homo sapiens
tgaagaccacatccacacac

SEQ ID NO: 2389224 - DNA, 16 bp, Homo sapiens
tgaagatgtctaatag

SEQ ID NO: 2389225 - DNA, 18 bp, Homo sapiens
tgaatatattataatctt

SEQ ID NO: 2389226 - DNA, 23 bp, Homo sapiens
tgaatgcccacaggcaaatgcat

SEQ ID NO: 2389227 - DNA, 14 bp, Homo sapiens
tgaatgctgagacc

SEQ ID NO: 2389228 - DNA, 15 bp, Homo sapiens
tgaatggtccagggt

SEQ ID NO: 2389229 - DNA, 19 bp, Homo sapiens
tgacagatgttgaatgccc

SEQ ID NO: 2389230 - DNA, 21 bp, Homo sapiens
tgacataacactataaaggtt

SEQ ID NO: 2389231 - DNA, 22 bp, Homo sapiens
tgaccaggggtgatttcagaga

SEQ ID NO: 2389232 - DNA, 23 bp, Homo sapiens
tgaccctctgaatggtccagggt

SEQ ID NO: 2389233 - DNA, 19 bp, Homo sapiens
tgacggtcccacactggtg

SEQ ID NO: 2389234 - DNA, 22 bp, Homo sapiens
tgactaaaaatattataactta

SEQ ID NO: 2389235 - DNA, 17 bp, Homo sapiens
tgactgcgatcttcaga

SEQ ID NO: 2389236 - DNA, 16 bp, Homo sapiens
tgagaatcaaaactct

SEQ ID NO: 2389237 - DNA, 15 bp, Homo sapiens
tgagaattttaaatt

SEQ ID NO: 2389238 - DNA, 23 bp, Homo sapiens
tgagaattttaaattataactta

SEQ ID NO: 2389239 - DNA, 21 bp, Homo sapiens
tgagcacctgcttcatgctca

SEQ ID NO: 2389240 - DNA, 12 bp, Homo sapiens
tgagcatctctg

SEQ ID NO: 2389241 - DNA, 17 bp, Homo sapiens
tgaggcctgccctcagg

SEQ ID NO: 2389242 - DNA, 21 bp, Homo sapiens
tgaggcctgccctcagggatc

SEQ ID NO: 2389243 - DNA, 14 bp, Homo sapiens
tgaggcctggccag

SEQ ID NO: 2389244 - DNA, 20 bp, Homo sapiens
tgaggggggccgtgcccagg

SEQ ID NO: 2389245 - DNA, 22 bp, Homo sapiens
tgaggggggccgtgcccagggg

SEQ ID NO: 2389246 - DNA, 22 bp, Homo sapiens
tgagtgtttttactacagttgt

SEQ ID NO: 2389247 - DNA, 20 bp, Homo sapiens
tgataaggatcagaacagca

SEQ ID NO: 2389248 - DNA, 13 bp, Homo sapiens
tgatattaaagga

SEQ ID NO: 2389249 - DNA, 23 bp, Homo sapiens
tgatattaaaggagttaagagta

SEQ ID NO: 2389250 - DNA, 12 bp, Homo sapiens
tgatcacactct

SEQ ID NO: 2389251 - DNA, 13 bp, Homo sapiens
tgatcacactctg

SEQ ID NO: 2389252 - DNA, 22 bp, Homo sapiens
tgatgttaaccagaataaagtt

SEQ ID NO: 2389253 - DNA, 19 bp, Homo sapiens
  misc_feature (10)..(10): n is a, c, g or t
tgcacctgcnttgtccctg

SEQ ID NO: 2389254 - DNA, 13 bp, Homo sapiens
tgcagagagaagc

SEQ ID NO: 2389255 - DNA, 15 bp, Homo sapiens
tgcagagagaagcct

SEQ ID NO: 2389256 - DNA, 11 bp, Homo sapiens
tgcagcacttt

SEQ ID NO: 2389257 - DNA, 19 bp, Homo sapiens
tgcatctgggattcccacc

SEQ ID NO: 2389258 - DNA, 20 bp, Homo sapiens
tgcatctgggattcccacca

SEQ ID NO: 2389259 - DNA, 19 bp, Homo sapiens
gagacctgacaagcactgc

SEQ ID NO: 2389260 - DNA, 13 bp, Homo sapiens
gagagccagctct

SEQ ID NO: 2389261 - DNA, 14 bp, Homo sapiens
gagagccagctctc

SEQ ID NO: 2389262 - DNA, 17 bp, Homo sapiens
gagagccagctctctct

SEQ ID NO: 2389263 - DNA, 19 bp, Homo sapiens
gagaggaatgcctgtgtga

SEQ ID NO: 2389264 - DNA, 14 bp, Homo sapiens
gagagggcagaggg

SEQ ID NO: 2389265 - DNA, 20 bp, Homo sapiens
gagcaagcatttatgtttat

SEQ ID NO: 2389266 - DNA, 17 bp, Homo sapiens
gagcaccccctcattcc

SEQ ID NO: 2389267 - DNA, 16 bp, Homo sapiens
gagcaggggtctgagc

SEQ ID NO: 2389268 - DNA, 18 bp, Homo sapiens
gagcattacgtgagccag

SEQ ID NO: 2389269 - DNA, 22 bp, Homo sapiens
gagccaggtaatgagggactgg

SEQ ID NO: 2389270 - DNA, 13 bp, Homo sapiens
gagccttctcctg

SEQ ID NO: 2389271 - DNA, 18 bp, Homo sapiens
gagccttctcctgcctac

SEQ ID NO: 2389272 - DNA, 23 bp, Homo sapiens
gagctgaacccattttgagtgac

SEQ ID NO: 2389273 - DNA, 16 bp, Homo sapiens
gagctgctctggaaaa

SEQ ID NO: 2389274 - DNA, 16 bp, Homo sapiens
gaggaaaagtgcaatg

SEQ ID NO: 2389275 - DNA, 16 bp, Homo sapiens
gaggagaaactgagaa

SEQ ID NO: 2389276 - DNA, 16 bp, Homo sapiens
gaggagtttcgaggta

SEQ ID NO: 2389277 - DNA, 20 bp, Homo sapiens
gaggagtttcgaggtagagt

SEQ ID NO: 2389278 - DNA, 17 bp, Homo sapiens
gaggcagagaaagaaga

SEQ ID NO: 2389279 - DNA, 12 bp, Homo sapiens
gaggccaaggtg

SEQ ID NO: 2389280 - DNA, 16 bp, Homo sapiens
gaggcctggccaggca

SEQ ID NO: 2389281 - DNA, 22 bp, Homo sapiens
gagggcaagggccatgctgaag

SEQ ID NO: 2389282 - DNA, 18 bp, Homo sapiens
gaggggtaggcagagcct

SEQ ID NO: 2389283 - DNA, 21 bp, Homo sapiens
gaggtcacattcaggaagatg

SEQ ID NO: 2389284 - DNA, 12 bp, Homo sapiens
gagtgccaggac

SEQ ID NO: 2389285 - DNA, 16 bp, Homo sapiens
gagtggatctccaagg

SEQ ID NO: 2389286 - DNA, 22 bp, Homo sapiens
gatacactgaagttaacagaga

SEQ ID NO: 2389287 - DNA, 16 bp, Homo sapiens
gatattaaaggagtta

SEQ ID NO: 2389288 - DNA, 20 bp, Homo sapiens
gatattttcttccaagcaaa

SEQ ID NO: 2389289 - DNA, 13 bp, Homo sapiens
gatctccaaggac

SEQ ID NO: 2389290 - DNA, 19 bp, Homo sapiens
gatctccaaggaccaggtt

SEQ ID NO: 2389291 - DNA, 13 bp, Homo sapiens
gatgaccagaaca

SEQ ID NO: 2389292 - DNA, 21 bp, Homo sapiens
gatgggtctggctgagctgaa

SEQ ID NO: 2389293 - DNA, 21 bp, Homo sapiens
gatgtgctttgcattcctaca

SEQ ID NO: 2389294 - DNA, 20 bp, Homo sapiens
gatgttacatcacagtgttt

SEQ ID NO: 2389295 - DNA, 23 bp, Homo sapiens
gatgttgaatgcccacaggcaaa

SEQ ID NO: 2389296 - DNA, 22 bp, Homo sapiens
gattcccaccaaggtcttcagc

SEQ ID NO: 2389297 - DNA, 13 bp, Homo sapiens
gattgaggcctgc

SEQ ID NO: 2389298 - DNA, 22 bp, Homo sapiens
gattgaggcctgccctcaggga

SEQ ID NO: 2389299 - DNA, 20 bp, Homo sapiens
gattttgtgttttttcgttc

SEQ ID NO: 2389300 - DNA, 15 bp, Homo sapiens
gcaaagggctgaaag

SEQ ID NO: 2389301 - DNA, 15 bp, Homo sapiens
gcaagggccatgctg

SEQ ID NO: 2389302 - DNA, 19 bp, Homo sapiens
gcaagggccatgctgaagg

SEQ ID NO: 2389303 - DNA, 16 bp, Homo sapiens
gcaatgaaaaattctc

SEQ ID NO: 2389304 - DNA, 20 bp, Homo sapiens
gcaatggtgttgccctgagt

SEQ ID NO: 2389305 - DNA, 16 bp, Homo sapiens
gcaattatattgtcct

SEQ ID NO: 2389306 - DNA, 21 bp, Homo sapiens
gcaattctacccagagccttc

SEQ ID NO: 2389307 - DNA, 13 bp, Homo sapiens
ggtgagggatgtg

SEQ ID NO: 2389308 - DNA, 18 bp, Homo sapiens
ggtgcagaggtgagcaga

SEQ ID NO: 2389309 - DNA, 19 bp, Homo sapiens
ggtgctgtggccagggtga

SEQ ID NO: 2389310 - DNA, 15 bp, Homo sapiens
ggtggcaggaccagg

SEQ ID NO: 2389311 - DNA, 16 bp, Homo sapiens
ggtgtctgcacccagg

SEQ ID NO: 2389312 - DNA, 18 bp, Homo sapiens
ggtgtgtggagatgcaga

SEQ ID NO: 2389313 - DNA, 15 bp, Homo sapiens
ggttctttggaagga

SEQ ID NO: 2389314 - DNA, 16 bp, Homo sapiens
ggttgtgaggcctggc

SEQ ID NO: 2389315 - DNA, 21 bp, Homo sapiens
ggttgtgaggcctggccaggc

SEQ ID NO: 2389316 - DNA, 22 bp, Homo sapiens
ggttgtgaggcctggccaggca

SEQ ID NO: 2389317 - DNA, 12 bp, Homo sapiens
ggtttgaaagcc

SEQ ID NO: 2389318 - DNA, 19 bp, Homo sapiens
ggtttgtgtttgagtttta

SEQ ID NO: 2389319 - DNA, 17 bp, Homo sapiens
gtagcaattctacccag

SEQ ID NO: 2389320 - DNA, 14 bp, Homo sapiens
gtataaaagacaaa

SEQ ID NO: 2389321 - DNA, 21 bp, Homo sapiens
gtcaaaccgcactcacccatg

SEQ ID NO: 2389322 - DNA, 22 bp, Homo sapiens
gtcaaaccgcactcacccatgt

SEQ ID NO: 2389323 - DNA, 18 bp, Homo sapiens
gtcaagattttttttgta

SEQ ID NO: 2389324 - DNA, 19 bp, Homo sapiens
gtcactcttcctgcaagga

SEQ ID NO: 2389325 - DNA, 12 bp, Homo sapiens
gtcagccagggc

SEQ ID NO: 2389326 - DNA, 14 bp, Homo sapiens
gtcagccagggcca

SEQ ID NO: 2389327 - DNA, 16 bp, Homo sapiens
gtcatctggtagattt

SEQ ID NO: 2389328 - DNA, 19 bp, Homo sapiens
gtccagggcgggagtgggg

SEQ ID NO: 2389329 - DNA, 13 bp, Homo sapiens
gtccctctttgcc

SEQ ID NO: 2389330 - DNA, 20 bp, Homo sapiens
gtccctctttgcctgtgtga

SEQ ID NO: 2389331 - DNA, 21 bp, Homo sapiens
gtcctccaacaataaagagct

SEQ ID NO: 2389332 - DNA, 15 bp, Homo sapiens
gtcctcccctatttt

SEQ ID NO: 2389333 - DNA, 19 bp, Homo sapiens
gtcgccacacccggctccc

SEQ ID NO: 2389334 - DNA, 22 bp, Homo sapiens
gtcgccacacccggctccccct

SEQ ID NO: 2389335 - DNA, 18 bp, Homo sapiens
gtcgctggacaacccaga

SEQ ID NO: 2389336 - DNA, 15 bp, Homo sapiens
gtctgcacccagggg

SEQ ID NO: 2389337 - DNA, 17 bp, Homo sapiens
gtgaaataccagtgtgg

SEQ ID NO: 2389338 - DNA, 13 bp, Homo sapiens
gtgaccctctgaa

SEQ ID NO: 2389339 - DNA, 21 bp, Homo sapiens
gtgaccctctgaatggtccag

SEQ ID NO: 2389340 - DNA, 19 bp, Homo sapiens
gtgacggtcccacactggt

SEQ ID NO: 2389341 - DNA, 16 bp, Homo sapiens
gtgagcatctctgtgt

SEQ ID NO: 2389342 - DNA, 13 bp, Homo sapiens
gtgaggcctggcc

SEQ ID NO: 2389343 - DNA, 16 bp, Homo sapiens
gtgaggcctggccagg

SEQ ID NO: 2389344 - DNA, 21 bp, Homo sapiens
gtgcaatgcgtgttgtacata

SEQ ID NO: 2389345 - DNA, 15 bp, Homo sapiens
gtgcagttgacagca

SEQ ID NO: 2389346 - DNA, 22 bp, Homo sapiens
gtgccgtgaactgcgtgccagt

SEQ ID NO: 2389347 - DNA, 14 bp, Homo sapiens
gtgctgtggccagg

SEQ ID NO: 2389348 - DNA, 18 bp, Homo sapiens
gtgctgtggccagggtga

SEQ ID NO: 2389349 - DNA, 18 bp, Homo sapiens
gtggatctgtccaaggaa

SEQ ID NO: 2389350 - DNA, 13 bp, Homo sapiens
gtggcaggaccag

SEQ ID NO: 2389351 - DNA, 17 bp, Homo sapiens
gtggcaggaccaggact

SEQ ID NO: 2389352 - DNA, 18 bp, Homo sapiens
gtggccatcagggtgggc

SEQ ID NO: 2389353 - DNA, 22 bp, Homo sapiens
gtggctcacgcctgtaatccca

SEQ ID NO: 2389354 - DNA, 13 bp, Homo sapiens
gtggctctccagt

SEQ ID NO: 2389355 - DNA, 12 bp, Homo sapiens
gtgggtggtgga

SEQ ID NO: 2389356 - DNA, 16 bp, Homo sapiens
gtggtaagctctggct

SEQ ID NO: 2389357 - DNA, 22 bp, Homo sapiens
gtggtgggttctttggaaggag

SEQ ID NO: 2389358 - DNA, 14 bp, Homo sapiens
gtgtctgcacccag

SEQ ID NO: 2389359 - DNA, 17 bp, Homo sapiens
gtgtgagcatctctgtg

SEQ ID NO: 2389360 - DNA, 21 bp, Homo sapiens
gtgtgttgtctgtgcagctgc

SEQ ID NO: 2389361 - DNA, 13 bp, Homo sapiens
gtgttgtctgtgc

SEQ ID NO: 2389362 - DNA, 20 bp, Homo sapiens
gttaaccagaataaagttct

SEQ ID NO: 2389363 - DNA, 13 bp, Homo sapiens
gttaagggaagga

SEQ ID NO: 2389364 - DNA, 22 bp, Homo sapiens
gttaagggaaggaactctggct

SEQ ID NO: 2389365 - DNA, 21 bp, Homo sapiens
gttacagcgagaggcagagaa

SEQ ID NO: 2389366 - DNA, 17 bp, Homo sapiens
gttacatcacagtgttt

SEQ ID NO: 2389367 - DNA, 11 bp, Homo sapiens
gttagctgagc

SEQ ID NO: 2389368 - DNA, 23 bp, Homo sapiens
gttagggtgctctggaagagagg

SEQ ID NO: 2389369 - DNA, 18 bp, Homo sapiens
gttagtgtgttgtctgtg

SEQ ID NO: 2389370 - DNA, 13 bp, Homo sapiens
gttatatattgta

SEQ ID NO: 2389371 - DNA, 14 bp, Homo sapiens
gttatatattgtat

SEQ ID NO: 2389372 - DNA, 21 bp, Homo sapiens
gttatatattgtattaagggc

SEQ ID NO: 2389373 - DNA, 23 bp, Homo sapiens
gttatatattgtattaagggcat

SEQ ID NO: 2389374 - DNA, 20 bp, Homo sapiens
gttcatctgagcaagagctg

SEQ ID NO: 2389375 - DNA, 19 bp, Homo sapiens
gttccctgaacatctgtgt

SEQ ID NO: 2389376 - DNA, 12 bp, Homo sapiens
gttgacagcagg

SEQ ID NO: 2389377 - DNA, 23 bp, Homo sapiens
tgcatggacaccccttatccagg

SEQ ID NO: 2389378 - DNA, 13 bp, Homo sapiens
tgcattagaaatt

SEQ ID NO: 2389379 - DNA, 18 bp, Homo sapiens
tgccaaattgtagttctt

SEQ ID NO: 2389380 - DNA, 21 bp, Homo sapiens
tgccaggactccccaggccag

SEQ ID NO: 2389381 - DNA, 20 bp, Homo sapiens
tgcccaggggcccacaggga

SEQ ID NO: 2389382 - DNA, 14 bp, Homo sapiens
tgccccaccagcca

SEQ ID NO: 2389383 - DNA, 18 bp, Homo sapiens
tgccccaccagccacctc

SEQ ID NO: 2389384 - DNA, 20 bp, Homo sapiens
tgcctacattccctggcctg

SEQ ID NO: 2389385 - DNA, 18 bp, Homo sapiens
tgcctcaatgtgaccagg

SEQ ID NO: 2389386 - DNA, 19 bp, Homo sapiens
tgcctcaatgtgaccaggg

SEQ ID NO: 2389387 - DNA, 15 bp, Homo sapiens
tgcctgcagagagaa

SEQ ID NO: 2389388 - DNA, 13 bp, Homo sapiens
tgcctgtgtgagc

SEQ ID NO: 2389389 - DNA, 16 bp, Homo sapiens
tgcgatcttcagagca

SEQ ID NO: 2389390 - DNA, 17 bp, Homo sapiens
tgcgatcttcagagcag

SEQ ID NO: 2389391 - DNA, 17 bp, Homo sapiens
tgctaggcgagtgccag

SEQ ID NO: 2389392 - DNA, 20 bp, Homo sapiens
tgctataggctggagaagct

SEQ ID NO: 2389393 - DNA, 19 bp, Homo sapiens
tgctcaacctctctccttc

SEQ ID NO: 2389394 - DNA, 19 bp, Homo sapiens
tgctctggaaaatgtgacc

SEQ ID NO: 2389395 - DNA, 23 bp, Homo sapiens
tgctctggaaaatgtgacccaga

SEQ ID NO: 2389396 - DNA, 14 bp, Homo sapiens
tgctgtggccaggg

SEQ ID NO: 2389397 - DNA, 23 bp, Homo sapiens
tgcttaggatgtttttcatgaaa

SEQ ID NO: 2389398 - DNA, 19 bp, Homo sapiens
tgcttcaaatccatccaga

SEQ ID NO: 2389399 - DNA, 17 bp, Homo sapiens
tgcttcatgctcagccc

SEQ ID NO: 2389400 - DNA, 22 bp, Homo sapiens
tggaaaagaatccctgcagcct

SEQ ID NO: 2389401 - DNA, 21 bp, Homo sapiens
tggaacaaaagttcgaaagaa

SEQ ID NO: 2389402 - DNA, 14 bp, Homo sapiens
tggaagattttaaa

SEQ ID NO: 2389403 - DNA, 16 bp, Homo sapiens
tggagaagctcaccca

SEQ ID NO: 2389404 - DNA, 11 bp, Homo sapiens
tggagagaagt

SEQ ID NO: 2389405 - DNA, 15 bp, Homo sapiens
tggagagtaaaaact

SEQ ID NO: 2389406 - DNA, 13 bp, Homo sapiens
tggagatgcagag

SEQ ID NO: 2389407 - DNA, 20 bp, Homo sapiens
tggagggcaaggggtttcca

SEQ ID NO: 2389408 - DNA, 22 bp, Homo sapiens
aactcccagcaacacaagctgg

SEQ ID NO: 2389409 - DNA, 21 bp, Homo sapiens
aactcctttagcaggtggtcc

SEQ ID NO: 2389410 - DNA, 18 bp, Homo sapiens
aactgagaaatgaatgct

SEQ ID NO: 2389411 - DNA, 14 bp, Homo sapiens
aactgcgtgccagt

SEQ ID NO: 2389412 - DNA, 19 bp, Homo sapiens
aacttagcatgtgttgaaa

SEQ ID NO: 2389413 - DNA, 15 bp, Homo sapiens
aacttgtaaatgctg

SEQ ID NO: 2389414 - DNA, 14 bp, Homo sapiens
aagaatacagaaag

SEQ ID NO: 2389415 - DNA, 14 bp, Homo sapiens
aagagcctggagaa

SEQ ID NO: 2389416 - DNA, 13 bp, Homo sapiens
aagattttaaatt

SEQ ID NO: 2389417 - DNA, 16 bp, Homo sapiens
aagattttttttgtaa

SEQ ID NO: 2389418 - DNA, 19 bp, Homo sapiens
aagattttttttgtaactt

SEQ ID NO: 2389419 - DNA, 17 bp, Homo sapiens
aagcaaagcaccagctt

SEQ ID NO: 2389420 - DNA, 11 bp, Homo sapiens
aagcaaaggtg

SEQ ID NO: 2389421 - DNA, 13 bp, Homo sapiens
aagcaattatatt

SEQ ID NO: 2389422 - DNA, 20 bp, Homo sapiens
aagcaccagcttctccaggc

SEQ ID NO: 2389423 - DNA, 21 bp, Homo sapiens
aaggaatagtcgcgcaagcat

SEQ ID NO: 2389424 - DNA, 15 bp, Homo sapiens
aaggaggtgagggat

SEQ ID NO: 2389425 - DNA, 21 bp, Homo sapiens
aaggcatgatgttaaccagaa

SEQ ID NO: 2389426 - DNA, 14 bp, Homo sapiens
aagggcattttaaa

SEQ ID NO: 2389427 - DNA, 19 bp, Homo sapiens
aaggggcacgcctgcccag

SEQ ID NO: 2389428 - DNA, 22 bp, Homo sapiens
aaggttgacaataaatgtgctt

SEQ ID NO: 2389429 - DNA, 13 bp, Homo sapiens
aaggtttggtgtg

SEQ ID NO: 2389430 - DNA, 22 bp, Homo sapiens
aagtgtcatatgtaggtgtctg

SEQ ID NO: 2389431 - DNA, 15 bp, Homo sapiens
aagtgtgagcagtga

SEQ ID NO: 2389432 - DNA, 23 bp, Homo sapiens
aagtgttggctaatgaagggaaa

SEQ ID NO: 2389433 - DNA, 16 bp, Homo sapiens
aagttacttattctag

SEQ ID NO: 2389434 - DNA, 21 bp, Homo sapiens
aagttagtgtgttgtctgtgc

SEQ ID NO: 2389435 - DNA, 14 bp, Homo sapiens
aagtttgtttttaa

SEQ ID NO: 2389436 - DNA, 13 bp, Homo sapiens
aataacatttgtg

SEQ ID NO: 2389437 - DNA, 18 bp, Homo sapiens
aataattatccagagttt

SEQ ID NO: 2389438 - DNA, 13 bp, Homo sapiens
aatagaaactcac

SEQ ID NO: 2389439 - DNA, 19 bp, Homo sapiens
aatagctctttcagggggg

SEQ ID NO: 2389440 - DNA, 11 bp, Homo sapiens
aatatagagat

SEQ ID NO: 2389441 - DNA, 18 bp, Homo sapiens
aatatagagatatttttg

SEQ ID NO: 2389442 - DNA, 13 bp, Homo sapiens
aatatattataat

SEQ ID NO: 2389443 - DNA, 16 bp, Homo sapiens
aatatattataatctt

SEQ ID NO: 2389444 - DNA, 18 bp, Homo sapiens
aatatttaagtttgttgc

SEQ ID NO: 2389445 - DNA, 23 bp, Homo sapiens
aatatttaagtttgttgctgtca

SEQ ID NO: 2389446 - DNA, 15 bp, Homo sapiens
aatatttatgtaaac

SEQ ID NO: 2389447 - DNA, 18 bp, Homo sapiens
aatcaaaactctcctaca

SEQ ID NO: 2389448 - DNA, 23 bp, Homo sapiens
aatctatttacataaaatgggtg

SEQ ID NO: 2389449 - DNA, 19 bp, Homo sapiens
aatcttggggggtttttac

SEQ ID NO: 2389450 - DNA, 15 bp, Homo sapiens
aatgaataataatta

SEQ ID NO: 2389451 - DNA, 24 bp, Homo sapiens
aatgactaaaaatattataactta

SEQ ID NO: 2389452 - DNA, 14 bp, Homo sapiens
aatgagggactgga

SEQ ID NO: 2389453 - DNA, 23 bp, Homo sapiens
aatgcgtgttgtacatacagagg

SEQ ID NO: 2389454 - DNA, 13 bp, Homo sapiens
aatggtccagggt

SEQ ID NO: 2389455 - DNA, 14 bp, Homo sapiens
aatggtccagggtt

SEQ ID NO: 2389456 - DNA, 18 bp, Homo sapiens
aatgtctttgttggaaaa

SEQ ID NO: 2389457 - DNA, 22 bp, Homo sapiens
aatgtctttgttggaaaagaat

SEQ ID NO: 2389458 - DNA, 23 bp, Homo sapiens
aatgtttgggcagaagggagaag

SEQ ID NO: 2389459 - DNA, 23 bp, Homo sapiens
aattccaaggagttccatgaaga

SEQ ID NO: 2389460 - DNA, 20 bp, Homo sapiens
aattcttgtatattatggaa

SEQ ID NO: 2389461 - DNA, 20 bp, Homo sapiens
aattgtttaagtgttgtaaa

SEQ ID NO: 2389462 - DNA, 23 bp, Homo sapiens
acaaagatgtttgtcagatatga

SEQ ID NO: 2389463 - DNA, 24 bp, Homo sapiens
acaaagatgtttgtcagatatgat

SEQ ID NO: 2389464 - DNA, 17 bp, Homo sapiens
acaaagccaacagtcaa

SEQ ID NO: 2389465 - DNA, 22 bp, Homo sapiens
acaaattatgttacatctgttt

SEQ ID NO: 2389466 - DNA, 19 bp, Homo sapiens
acaaggttccctctgagaa

SEQ ID NO: 2389467 - DNA, 21 bp, Homo sapiens
acacacgcaggaactcccagc

SEQ ID NO: 2389468 - DNA, 20 bp, Homo sapiens
acacagtgggtggtggatct

SEQ ID NO: 2389469 - DNA, 18 bp, Homo sapiens
acaccccttatccaggac

SEQ ID NO: 2389470 - DNA, 19 bp, Homo sapiens
acaccccttatccaggact

SEQ ID NO: 2389471 - DNA, 13 bp, Homo sapiens
acagaggtaacta

SEQ ID NO: 2389472 - DNA, 23 bp, Homo sapiens
acagccaaatgcatggtgcagtt

SEQ ID NO: 2389473 - DNA, 19 bp, Homo sapiens
acagcgagaggcagagaaa

SEQ ID NO: 2389474 - DNA, 21 bp, Homo sapiens
acaggatcctattctcaccag

SEQ ID NO: 2389475 - DNA, 22 bp, Homo sapiens
acagggaaccctgcttgcactt

SEQ ID NO: 2389476 - DNA, 17 bp, Homo sapiens
acagtcaaaacagagat

SEQ ID NO: 2389477 - DNA, 18 bp, Homo sapiens
acagtcaaaacagagatg

SEQ ID NO: 2389478 - DNA, 16 bp, Homo sapiens
acagtgttattttctt

SEQ ID NO: 2389479 - DNA, 20 bp, Homo sapiens
acagtgttattttctttgaa

SEQ ID NO: 2389480 - DNA, 21 bp, Homo sapiens
acatgtttatttattctgcat

SEQ ID NO: 2389481 - DNA, 12 bp, Homo sapiens
acatttctagaa

SEQ ID NO: 2389482 - DNA, 23 bp, Homo sapiens
accaaagatatatacacaggatc

SEQ ID NO: 2389483 - DNA, 16 bp, Homo sapiens
accaagactctgaaat

SEQ ID NO: 2389484 - DNA, 19 bp, Homo sapiens
accaaggtcttcagccatc

SEQ ID NO: 2389485 - DNA, 21 bp, Homo sapiens
accacagcagctgaacagcca

SEQ ID NO: 2389486 - DNA, 23 bp, Homo sapiens
accacatccacacacgcaggaac

SEQ ID NO: 2389487 - DNA, 18 bp, Homo sapiens
accacctaatcaggctga

SEQ ID NO: 2389488 - DNA, 19 bp, Homo sapiens
accaccttggactcctccc

SEQ ID NO: 2389489 - DNA, 15 bp, Homo sapiens
accagagcagagagc

SEQ ID NO: 2389490 - DNA, 20 bp, Homo sapiens
accagcttctccaggctctt

SEQ ID NO: 2389491 - DNA, 21 bp, Homo sapiens
accaggactatagcccaggtc

SEQ ID NO: 2389492 - DNA, 14 bp, Homo sapiens
accaggatggccct

SEQ ID NO: 2389493 - DNA, 24 bp, Homo sapiens
accaggggtgatttcagagagggc

SEQ ID NO: 2389494 - DNA, 16 bp, Homo sapiens
accatgcgctgctcaa

SEQ ID NO: 2389495 - DNA, 15 bp, Homo sapiens
acccagagccttctc

SEQ ID NO: 2389496 - DNA, 20 bp, Homo sapiens
acccagagccttctcctgcc

SEQ ID NO: 2389497 - DNA, 23 bp, Homo sapiens
acccagagccttctcctgcctac

SEQ ID NO: 2389498 - DNA, 19 bp, Homo sapiens
accccaaagagcctggaga

SEQ ID NO: 2389499 - DNA, 11 bp, Homo sapiens
acccccagtgt

SEQ ID NO: 2389500 - DNA, 16 bp, Homo sapiens
accccctcattcccct

SEQ ID NO: 2389501 - DNA, 17 bp, Homo sapiens
accccctcattcccctc

SEQ ID NO: 2389502 - DNA, 16 bp, Homo sapiens
accccctcattgttta

SEQ ID NO: 2389503 - DNA, 15 bp, Homo sapiens
accccttatccagga

SEQ ID NO: 2389504 - DNA, 18 bp, Homo sapiens
accccttatccaggactc

SEQ ID NO: 2389505 - DNA, 18 bp, Homo sapiens
accccttcctttcctctg

SEQ ID NO: 2389506 - DNA, 17 bp, Homo sapiens
acccggctccccctgct

SEQ ID NO: 2389507 - DNA, 19 bp, Homo sapiens
acccggctccccctgcttc

SEQ ID NO: 2389508 - DNA, 12 bp, Homo sapiens
accctcccacca

SEQ ID NO: 2389509 - DNA, 19 bp, Homo sapiens
accctctgaatggtccagg

SEQ ID NO: 2389510 - DNA, 22 bp, Homo sapiens
accctctgaatggtccagggtt

SEQ ID NO: 2389511 - DNA, 17 bp, Homo sapiens
accgagtctctgtataa

SEQ ID NO: 2389512 - DNA, 16 bp, Homo sapiens
acctaatcaggctgag

SEQ ID NO: 2389513 - DNA, 23 bp, Homo sapiens
  misc_feature (6)..(6): n is a, c, g or t
  misc_feature (13)..(13): n is a, c, g or t
acctanccccccnacccccagtg

SEQ ID NO: 2389514 - DNA, 22 bp, Homo sapiens
acctcttgggcatgctcagccc

SEQ ID NO: 2389515 - DNA, 17 bp, Homo sapiens
acgcaggaactcccagc

SEQ ID NO: 2389516 - DNA, 14 bp, Homo sapiens
acgcccagcctcct

SEQ ID NO: 2389517 - DNA, 15 bp, Homo sapiens
acgcccagcctcctc

SEQ ID NO: 2389518 - DNA, 13 bp, Homo sapiens
caactgaaaagac

SEQ ID NO: 2389519 - DNA, 14 bp, Homo sapiens
caactgaaaagact

SEQ ID NO: 2389520 - DNA, 22 bp, Homo sapiens
caagaaatccagtttcccacca

SEQ ID NO: 2389521 - DNA, 21 bp, Homo sapiens
caagattttttttgtaacttc

SEQ ID NO: 2389522 - DNA, 12 bp, Homo sapiens
caagctggaagc

SEQ ID NO: 2389523 - DNA, 13 bp, Homo sapiens
caagctggaagca

SEQ ID NO: 2389524 - DNA, 18 bp, Homo sapiens
caagctggaagcacatgt

SEQ ID NO: 2389525 - DNA, 20 bp, Homo sapiens
caagggccatgctgaaggga

SEQ ID NO: 2389526 - DNA, 16 bp, Homo sapiens
caaggttccctctgag

SEQ ID NO: 2389527 - DNA, 17 bp, Homo sapiens
caaggttccctctgaga

SEQ ID NO: 2389528 - DNA, 23 bp, Homo sapiens
caagtgtggtagggacttaaaaa

SEQ ID NO: 2389529 - DNA, 16 bp, Homo sapiens
caagttctagagaaga

SEQ ID NO: 2389530 - DNA, 19 bp, Homo sapiens
caagttctagagaagaggc

SEQ ID NO: 2389531 - DNA, 23 bp, Homo sapiens
caatagaaactcaccatgtaaaa

SEQ ID NO: 2389532 - DNA, 14 bp, Homo sapiens
caatgcgtgttgta

SEQ ID NO: 2389533 - DNA, 18 bp, Homo sapiens
caatggctaattcccaga

SEQ ID NO: 2389534 - DNA, 22 bp, Homo sapiens
ccccaaagagcctggagaagct

SEQ ID NO: 2389535 - DNA, 19 bp, Homo sapiens
ccccagactcagctccaga

SEQ ID NO: 2389536 - DNA, 12 bp, Homo sapiens
ccccaggccagg

SEQ ID NO: 2389537 - DNA, 11 bp, Homo sapiens
cccccatcccc

SEQ ID NO: 2389538 - DNA, 14 bp, Homo sapiens
ccccctatgctcca

SEQ ID NO: 2389539 - DNA, 13 bp, Homo sapiens
cccctatgctcca

SEQ ID NO: 2389540 - DNA, 20 bp, Homo sapiens
cccctccctcttccttcccc

SEQ ID NO: 2389541 - DNA, 19 bp, Homo sapiens
cccctcgtgtgactctctt

SEQ ID NO: 2389542 - DNA, 23 bp, Homo sapiens
cccctcgtgtgactctcttggat

SEQ ID NO: 2389543 - DNA, 18 bp, Homo sapiens
cccctgcttctcagcccc

SEQ ID NO: 2389544 - DNA, 14 bp, Homo sapiens
ccccttatccagga

SEQ ID NO: 2389545 - DNA, 13 bp, Homo sapiens
ccccttcctttcc

SEQ ID NO: 2389546 - DNA, 14 bp, Homo sapiens
cccctttcctcccc

SEQ ID NO: 2389547 - DNA, 22 bp, Homo sapiens
cccggcccagagaccccttcct

SEQ ID NO: 2389548 - DNA, 16 bp, Homo sapiens
cccgggcctgcctctg

SEQ ID NO: 2389549 - DNA, 18 bp, Homo sapiens
ccctcactgaatgcctca

SEQ ID NO: 2389550 - DNA, 12 bp, Homo sapiens
ccctcattcccc

SEQ ID NO: 2389551 - DNA, 16 bp, Homo sapiens
ccctcccaccatgcgc

SEQ ID NO: 2389552 - DNA, 13 bp, Homo sapiens
ccctctcttccct

SEQ ID NO: 2389553 - DNA, 17 bp, Homo sapiens
ccctctcttccctatta

SEQ ID NO: 2389554 - DNA, 19 bp, Homo sapiens
ccctcttgacccatctccc

SEQ ID NO: 2389555 - DNA, 15 bp, Homo sapiens
ccctgaacatctgtg

SEQ ID NO: 2389556 - DNA, 16 bp, Homo sapiens
ccctgaacatctgtgt

SEQ ID NO: 2389557 - DNA, 12 bp, Homo sapiens
ccctgcttctca

SEQ ID NO: 2389558 - DNA, 13 bp, Homo sapiens
ccctggagagaag

SEQ ID NO: 2389559 - DNA, 13 bp, Homo sapiens
cccttatccagga

SEQ ID NO: 2389560 - DNA, 16 bp, Homo sapiens
cccttcacagtgtttc

SEQ ID NO: 2389561 - DNA, 20 bp, Homo sapiens
cccttcctttcctctgcagc

SEQ ID NO: 2389562 - DNA, 18 bp, Homo sapiens
ccgagcgctttctggaaa

SEQ ID NO: 2389563 - DNA, 19 bp, Homo sapiens
ccgagcgctttctggaaaa

SEQ ID NO: 2389564 - DNA, 20 bp, Homo sapiens
ccggagcaggggtctgagcc

SEQ ID NO: 2389565 - DNA, 19 bp, Homo sapiens
ccggcccagagaccccttc

SEQ ID NO: 2389566 - DNA, 15 bp, Homo sapiens
ccgggcctgcctctg

SEQ ID NO: 2389567 - DNA, 15 bp, Homo sapiens
cctaaagaggaaaag

SEQ ID NO: 2389568 - DNA, 22 bp, Homo sapiens
cctaaagaggaaaagtgcaatg

SEQ ID NO: 2389569 - DNA, 16 bp, Homo sapiens
cctacattccctggcc

SEQ ID NO: 2389570 - DNA, 13 bp, Homo sapiens
cctactgaatgct

SEQ ID NO: 2389571 - DNA, 23 bp, Homo sapiens
  misc_feature (5)..(5): n is a, c, g or t
  misc_feature (12)..(12): n is a, c, g or t
cctanccccccnacccccagtgt

SEQ ID NO: 2389572 - DNA, 14 bp, Homo sapiens
cctcaatgtgacca

SEQ ID NO: 2389573 - DNA, 14 bp, Homo sapiens
cctcacgcccagcc

SEQ ID NO: 2389574 - DNA, 17 bp, Homo sapiens
cctcacgcccagcctcc

SEQ ID NO: 2389575 - DNA, 18 bp, Homo sapiens
cctcacgcccagcctcct

SEQ ID NO: 2389576 - DNA, 23 bp, Homo sapiens
cctcacgcccagcctcctcccac

SEQ ID NO: 2389577 - DNA, 20 bp, Homo sapiens
cctcactattacttgaactt

SEQ ID NO: 2389578 - DNA, 23 bp, Homo sapiens
cctcagggatcttgcattcccag

SEQ ID NO: 2389579 - DNA, 15 bp, Homo sapiens
cctcattcccctcgt

SEQ ID NO: 2389580 - DNA, 18 bp, Homo sapiens
cctccaacaataaagagc

SEQ ID NO: 2389581 - DNA, 21 bp, Homo sapiens
cctcccaccaccctcccacca

SEQ ID NO: 2389582 - DNA, 15 bp, Homo sapiens
cctccccaccttccc

SEQ ID NO: 2389583 - DNA, 17 bp, Homo sapiens
cctccctcttccttccc

SEQ ID NO: 2389584 - DNA, 18 bp, Homo sapiens
cctccttttgcttgaaac

SEQ ID NO: 2389585 - DNA, 23 bp, Homo sapiens
cctcgcatgccagagcctggggc

SEQ ID NO: 2389586 - DNA, 16 bp, Homo sapiens
cctctctccttctggc

SEQ ID NO: 2389587 - DNA, 19 bp, Homo sapiens
cctctgagaattccaagga

SEQ ID NO: 2389588 - DNA, 13 bp, Homo sapiens
cctcttccttccc

SEQ ID NO: 2389589 - DNA, 14 bp, Homo sapiens
cctcttccttcccc

SEQ ID NO: 2389590 - DNA, 22 bp, Homo sapiens
cctcttgggcatgctcagccct

SEQ ID NO: 2389591 - DNA, 20 bp, Homo sapiens
cctgaacatctgtgtgtgtc

SEQ ID NO: 2389592 - DNA, 13 bp, Homo sapiens
cctgactcctcta

SEQ ID NO: 2389593 - DNA, 23 bp, Homo sapiens
cctgactggtgctataggctgga

SEQ ID NO: 2389594 - DNA, 13 bp, Homo sapiens
cctgagtggatct

SEQ ID NO: 2389595 - DNA, 13 bp, Homo sapiens
cctgatgacagag

SEQ ID NO: 2389596 - DNA, 13 bp, Homo sapiens
cctgcaaggacta

SEQ ID NO: 2389597 - DNA, 11 bp, Homo sapiens
cctgcagagag

SEQ ID NO: 2389598 - DNA, 13 bp, Homo sapiens
cctgcccagcctc

SEQ ID NO: 2389599 - DNA, 15 bp, Homo sapiens
cctgcccagcctcgc

SEQ ID NO: 2389600 - DNA, 21 bp, Homo sapiens
cctgcccagcctcgcatgcca

SEQ ID NO: 2389601 - DNA, 15 bp, Homo sapiens
cctgcctctgactca

SEQ ID NO: 2389602 - DNA, 17 bp, Homo sapiens
cctgcttcatgctcagc

SEQ ID NO: 2389603 - DNA, 13 bp, Homo sapiens
cctggccaggcac

SEQ ID NO: 2389604 - DNA, 21 bp, Homo sapiens
cctggccaggcaccccctgga

SEQ ID NO: 2389605 - DNA, 19 bp, Homo sapiens
cctggcctcacgcccagcc

SEQ ID NO: 2389606 - DNA, 23 bp, Homo sapiens
cctggcctcacgcccagcctcct

SEQ ID NO: 2389607 - DNA, 16 bp, Homo sapiens
cctggcctggctctcc

SEQ ID NO: 2389608 - DNA, 15 bp, Homo sapiens
cctggctctcctgta

SEQ ID NO: 2389609 - DNA, 23 bp, Homo sapiens
cctggctgaccccaaagagcctg

SEQ ID NO: 2389610 - DNA, 14 bp, Homo sapiens
cctgggaggcggag

SEQ ID NO: 2389611 - DNA, 15 bp, Homo sapiens
cctggtgcagaggtg

SEQ ID NO: 2389612 - DNA, 13 bp, Homo sapiens
cctgtagtcccag

SEQ ID NO: 2389613 - DNA, 19 bp, Homo sapiens
cctgtagtcccagccactc

SEQ ID NO: 2389614 - DNA, 21 bp, Homo sapiens
cctgtgtggaagaaggaaaca

SEQ ID NO: 2389615 - DNA, 18 bp, Homo sapiens
cctgttttgttggaaggt

SEQ ID NO: 2389616 - DNA, 13 bp, Homo sapiens
ccttcaactgaaa

SEQ ID NO: 2389617 - DNA, 24 bp, Homo sapiens
ccttcaactgaaaagactcagtgt

SEQ ID NO: 2389618 - DNA, 19 bp, Homo sapiens
ccttccccagactcagctc

SEQ ID NO: 2389619 - DNA, 22 bp, Homo sapiens
ccttcctttcctctgcagcact

SEQ ID NO: 2389620 - DNA, 19 bp, Homo sapiens
ccttggtgtgaccctctga

SEQ ID NO: 2389621 - DNA, 16 bp, Homo sapiens
cctttggatgaccaga

SEQ ID NO: 2389622 - DNA, 14 bp, Homo sapiens
cgagtgccaggact

SEQ ID NO: 2389623 - DNA, 20 bp, Homo sapiens
cgccacacccggctccccct

SEQ ID NO: 2389624 - DNA, 15 bp, Homo sapiens
cgcccacaaactgat

SEQ ID NO: 2389625 - DNA, 19 bp, Homo sapiens
cgcccagcctcctcccacc

SEQ ID NO: 2389626 - DNA, 15 bp, Homo sapiens
cgcctgcccagcctc

SEQ ID NO: 2389627 - DNA, 18 bp, Homo sapiens
cgcctgcccagcctcgca

SEQ ID NO: 2389628 - DNA, 19 bp, Homo sapiens
cgctctgccctccctggcc

SEQ ID NO: 2389629 - DNA, 15 bp, Homo sapiens
cgctgctagagaagg

SEQ ID NO: 2389630 - DNA, 18 bp, Homo sapiens
cgctgctcaacctctctc

SEQ ID NO: 2389631 - DNA, 16 bp, Homo sapiens
cgctggacaacccaga

SEQ ID NO: 2389632 - DNA, 17 bp, Homo sapiens
cgctggacaacccagaa

SEQ ID NO: 2389633 - DNA, 18 bp, Homo sapiens
cggagagtacagtgagcc

SEQ ID NO: 2389634 - DNA, 16 bp, Homo sapiens
cggcacgtcccatgtg

SEQ ID NO: 2389635 - DNA, 21 bp, Homo sapiens
cggcccagagaccccttcctt

SEQ ID NO: 2389636 - DNA, 13 bp, Homo sapiens
cgggaggctgaga

SEQ ID NO: 2389637 - DNA, 19 bp, Homo sapiens
cgggaggctgagacaggag

SEQ ID NO: 2389638 - DNA, 23 bp, Homo sapiens
cgggaggctgagacaggagaatc

SEQ ID NO: 2389639 - DNA, 15 bp, Homo sapiens
cgggcagcccagcct

SEQ ID NO: 2389640 - DNA, 16 bp, Homo sapiens
cgggcagcccagcctc

SEQ ID NO: 2389641 - DNA, 21 bp, Homo sapiens
cgggcagcccagcctctgtcc

SEQ ID NO: 2389642 - DNA, 19 bp, Homo sapiens
cggtttcaaaccaggattt

SEQ ID NO: 2389643 - DNA, 23 bp, Homo sapiens
cgtatgtcggcacgtcccatgtg

SEQ ID NO: 2389644 - DNA, 14 bp, Homo sapiens
cgtgaatgtctcag

SEQ ID NO: 2389645 - DNA, 15 bp, Homo sapiens
cgtgaatgtctcagc

SEQ ID NO: 2389646 - DNA, 23 bp, Homo sapiens
cagtgagttacagcgagaggcag

SEQ ID NO: 2389647 - DNA, 15 bp, Homo sapiens
cagtggtaagctctg

SEQ ID NO: 2389648 - DNA, 20 bp, Homo sapiens
cagtggtaagctctggcttt

SEQ ID NO: 2389649 - DNA, 14 bp, Homo sapiens
cagtggtgaagaaa

SEQ ID NO: 2389650 - DNA, 17 bp, Homo sapiens
cagtggtgaagaaaact

SEQ ID NO: 2389651 - DNA, 19 bp, Homo sapiens
cagttaactttaagactga

SEQ ID NO: 2389652 - DNA, 14 bp, Homo sapiens
cagttgacagcagg

SEQ ID NO: 2389653 - DNA, 12 bp, Homo sapiens
cataagaatgaa

SEQ ID NO: 2389654 - DNA, 21 bp, Homo sapiens
cataagaatgaataataatta

SEQ ID NO: 2389655 - DNA, 16 bp, Homo sapiens
cataagaccctaagcc

SEQ ID NO: 2389656 - DNA, 15 bp, Homo sapiens
catcccctttcctcc

SEQ ID NO: 2389657 - DNA, 16 bp, Homo sapiens
catcccctttcctccc

SEQ ID NO: 2389658 - DNA, 17 bp, Homo sapiens
catcccctttcctcccc

SEQ ID NO: 2389659 - DNA, 19 bp, Homo sapiens
catcccctttcctccccac

SEQ ID NO: 2389660 - DNA, 22 bp, Homo sapiens
catcccgctggtgcctcccggg

SEQ ID NO: 2389661 - DNA, 18 bp, Homo sapiens
catctgagcaagagctgg

SEQ ID NO: 2389662 - DNA, 21 bp, Homo sapiens
catctgtgtgtgtccccctat

SEQ ID NO: 2389663 - DNA, 19 bp, Homo sapiens
catgcgctgctcaacctct

SEQ ID NO: 2389664 - DNA, 17 bp, Homo sapiens
catgctcagcccttcct

SEQ ID NO: 2389665 - DNA, 21 bp, Homo sapiens
catgctcagcccttcctagaa

SEQ ID NO: 2389666 - DNA, 19 bp, Homo sapiens
catgctgaagggaccttga

SEQ ID NO: 2389667 - DNA, 23 bp, Homo sapiens
catggacaccccttatccaggac

SEQ ID NO: 2389668 - DNA, 21 bp, Homo sapiens
catggtgcagttgacagcagg

SEQ ID NO: 2389669 - DNA, 16 bp, Homo sapiens
catgtaaaagagtcat

SEQ ID NO: 2389670 - DNA, 13 bp, Homo sapiens
cattacgtgagcc

SEQ ID NO: 2389671 - DNA, 16 bp, Homo sapiens
cattcaatacaagtgt

SEQ ID NO: 2389672 - DNA, 14 bp, Homo sapiens
catttatgtttatt

SEQ ID NO: 2389673 - DNA, 20 bp, Homo sapiens
cattttaaaagcaattatat

SEQ ID NO: 2389674 - DNA, 23 bp, Homo sapiens
cattttaaaagcaattatattgt

SEQ ID NO: 2389675 - DNA, 21 bp, Homo sapiens
cattttcgctttcctctggtt

SEQ ID NO: 2389676 - DNA, 12 bp, Homo sapiens
ccaaagagcctg

SEQ ID NO: 2389677 - DNA, 21 bp, Homo sapiens
ccaaagatatatacacaggat

SEQ ID NO: 2389678 - DNA, 17 bp, Homo sapiens
ccaaatgcatggtgcag

SEQ ID NO: 2389679 - DNA, 22 bp, Homo sapiens
ccaaatgcatggtgcagttgac

SEQ ID NO: 2389680 - DNA, 16 bp, Homo sapiens
ccaacaataaagagct

SEQ ID NO: 2389681 - DNA, 17 bp, Homo sapiens
ccaacaataaagagctc

SEQ ID NO: 2389682 - DNA, 14 bp, Homo sapiens
ccaacaggtggcag

SEQ ID NO: 2389683 - DNA, 15 bp, Homo sapiens
ccaacaggtggcagg

SEQ ID NO: 2389684 - DNA, 13 bp, Homo sapiens
ccaaggaccaggt

SEQ ID NO: 2389685 - DNA, 15 bp, Homo sapiens
ccacacacgcaggaa

SEQ ID NO: 2389686 - DNA, 20 bp, Homo sapiens
ccacatccacacacgcagga

SEQ ID NO: 2389687 - DNA, 11 bp, Homo sapiens
ccaccaaggtc

SEQ ID NO: 2389688 - DNA, 17 bp, Homo sapiens
ccaccaaggtcttcagc

SEQ ID NO: 2389689 - DNA, 14 bp, Homo sapiens
ccaccagccacctc

SEQ ID NO: 2389690 - DNA, 16 bp, Homo sapiens
ccaccagccacctctt

SEQ ID NO: 2389691 - DNA, 17 bp, Homo sapiens
ccaccagccacctcttg

SEQ ID NO: 2389692 - DNA, 20 bp, Homo sapiens
ccacctcttgggcatgctca

SEQ ID NO: 2389693 - DNA, 20 bp, Homo sapiens
ccaccttccccagactcagc

SEQ ID NO: 2389694 - DNA, 13 bp, Homo sapiens
ccactcctcactg

SEQ ID NO: 2389695 - DNA, 11 bp, Homo sapiens
ccactggaggt

SEQ ID NO: 2389696 - DNA, 16 bp, Homo sapiens
ccagagaccccttcct

SEQ ID NO: 2389697 - DNA, 20 bp, Homo sapiens
ccagagaccccttcctttcc

SEQ ID NO: 2389698 - DNA, 21 bp, Homo sapiens
ccagagaccccttcctttcct

SEQ ID NO: 2389699 - DNA, 17 bp, Homo sapiens
ccagagccttctcctgc

SEQ ID NO: 2389700 - DNA, 21 bp, Homo sapiens
ccagcaaagagtgggctgcat

SEQ ID NO: 2389701 - DNA, 15 bp, Homo sapiens
ccagcaacacaagct

SEQ ID NO: 2389702 - DNA, 21 bp, Homo sapiens
ccagcaacacaagctggaagc

SEQ ID NO: 2389703 - DNA, 17 bp, Homo sapiens
ccagcactttgggaggc

SEQ ID NO: 2389704 - DNA, 19 bp, Homo sapiens
ccagcactttgggaggcca

SEQ ID NO: 2389705 - DNA, 21 bp, Homo sapiens
ccagcactttgggaggccaag

SEQ ID NO: 2389706 - DNA, 12 bp, Homo sapiens
ccagccacctct

SEQ ID NO: 2389707 - DNA, 15 bp, Homo sapiens
ccagccacctcttgg

SEQ ID NO: 2389708 - DNA, 22 bp, Homo sapiens
ccagccactcgggaggctgaga

SEQ ID NO: 2389709 - DNA, 22 bp, Homo sapiens
ccagcctcgcatgccagagcct

SEQ ID NO: 2389710 - DNA, 12 bp, Homo sapiens
ccagcctctgtc

SEQ ID NO: 2389711 - DNA, 15 bp, Homo sapiens
ccagctagggctgga

SEQ ID NO: 2389712 - DNA, 16 bp, Homo sapiens
ccagctagggctggac

SEQ ID NO: 2389713 - DNA, 21 bp, Homo sapiens
ccaggaagggggtccacccag

SEQ ID NO: 2389714 - DNA, 19 bp, Homo sapiens
ccaggactatagcccaggt

SEQ ID NO: 2389715 - DNA, 20 bp, Homo sapiens
ccaggactatagcccaggtc

SEQ ID NO: 2389716 - DNA, 22 bp, Homo sapiens
ccaggactccccaggccaggcc

SEQ ID NO: 2389717 - DNA, 18 bp, Homo sapiens
ccaggaggagaggaaagg

SEQ ID NO: 2389718 - DNA, 17 bp, Homo sapiens
ccaggattgaagagcat

SEQ ID NO: 2389719 - DNA, 17 bp, Homo sapiens
ccaggcaccccctggag

SEQ ID NO: 2389720 - DNA, 19 bp, Homo sapiens
ccaggcaggggtgggagag

SEQ ID NO: 2389721 - DNA, 14 bp, Homo sapiens
ccaggccaccagga

SEQ ID NO: 2389722 - DNA, 23 bp, Homo sapiens
ccaggcttaaggagaggagaaac

SEQ ID NO: 2389723 - DNA, 16 bp, Homo sapiens
ccaggggtctccctgg

SEQ ID NO: 2389724 - DNA, 19 bp, Homo sapiens
ccaggggtgatttcagaga

SEQ ID NO: 2389725 - DNA, 21 bp, Homo sapiens
ccaggggtgatttcagagagg

SEQ ID NO: 2389726 - DNA, 14 bp, Homo sapiens
ccagggtgagagct

SEQ ID NO: 2389727 - DNA, 16 bp, Homo sapiens
ccagggtgagagctgc

SEQ ID NO: 2389728 - DNA, 17 bp, Homo sapiens
ccagggtgagagctgct

SEQ ID NO: 2389729 - DNA, 16 bp, Homo sapiens
ccaggtaatgagggac

SEQ ID NO: 2389730 - DNA, 18 bp, Homo sapiens
ccaggtaatgagggactg

SEQ ID NO: 2389731 - DNA, 16 bp, Homo sapiens
ccaggtatctccagga

SEQ ID NO: 2389732 - DNA, 18 bp, Homo sapiens
ccaggtatctccaggatt

SEQ ID NO: 2389733 - DNA, 18 bp, Homo sapiens
ccagtgtccccacgtatg

SEQ ID NO: 2389734 - DNA, 13 bp, Homo sapiens
ccagtttcccacc

SEQ ID NO: 2389735 - DNA, 14 bp, Homo sapiens
ccagtttcccacca

SEQ ID NO: 2389736 - DNA, 13 bp, Homo sapiens
ccatcagggtggg

SEQ ID NO: 2389737 - DNA, 22 bp, Homo sapiens
ccatcagggtgggccactctcc

SEQ ID NO: 2389738 - DNA, 18 bp, Homo sapiens
ccatcccctttcctcccc

SEQ ID NO: 2389739 - DNA, 16 bp, Homo sapiens
ccatgctgaagggacc

SEQ ID NO: 2389740 - DNA, 13 bp, Homo sapiens
cccaccaccctcc

SEQ ID NO: 2389741 - DNA, 17 bp, Homo sapiens
cccaccttccccagact

SEQ ID NO: 2389742 - DNA, 18 bp, Homo sapiens
cccactcctcactgcccc

SEQ ID NO: 2389743 - DNA, 16 bp, Homo sapiens
cccagactcagctcca

SEQ ID NO: 2389744 - DNA, 21 bp, Homo sapiens
cccagagcattacgtgagcca

SEQ ID NO: 2389745 - DNA, 14 bp, Homo sapiens
cccagagccttctc

SEQ ID NO: 2389746 - DNA, 15 bp, Homo sapiens
cccagcaacacaagc

SEQ ID NO: 2389747 - DNA, 20 bp, Homo sapiens
cccagcaacacaagctggaa

SEQ ID NO: 2389748 - DNA, 18 bp, Homo sapiens
cccagcctcctcccacca

SEQ ID NO: 2389749 - DNA, 13 bp, Homo sapiens
cccagcctctgtc

SEQ ID NO: 2389750 - DNA, 16 bp, Homo sapiens
cccagcctctgtccct

SEQ ID NO: 2389751 - DNA, 17 bp, Homo sapiens
cccagcctctgtccctc

SEQ ID NO: 2389752 - DNA, 15 bp, Homo sapiens
cccagctagggctgg

SEQ ID NO: 2389753 - DNA, 16 bp, Homo sapiens
cccagctagggctgga

SEQ ID NO: 2389754 - DNA, 23 bp, Homo sapiens
cccatcccctttcctccccacct

SEQ ID NO: 2389755 - DNA, 23 bp, Homo sapiens
cccatgtgcatggaaatgtcctc

SEQ ID NO: 2389756 - DNA, 15 bp, Homo sapiens
ccccaaagagcctgg

SEQ ID NO: 2389757 - DNA, 15 bp, Homo sapiens
ctggacaacccagaa

SEQ ID NO: 2389758 - DNA, 15 bp, Homo sapiens
ctggactctggcacc

SEQ ID NO: 2389759 - DNA, 19 bp, Homo sapiens
ctggagaagctgatgcttt

SEQ ID NO: 2389760 - DNA, 21 bp, Homo sapiens
ctggaggtcacattcaggaag

SEQ ID NO: 2389761 - DNA, 22 bp, Homo sapiens
ctggaggtcacattcaggaaga

SEQ ID NO: 2389762 - DNA, 21 bp, Homo sapiens
ctggcaaaggtggctctccag

SEQ ID NO: 2389763 - DNA, 22 bp, Homo sapiens
ctggcaaaggtggctctccagt

SEQ ID NO: 2389764 - DNA, 23 bp, Homo sapiens
ctggcctcacgcccagcctcctc

SEQ ID NO: 2389765 - DNA, 13 bp, Homo sapiens
ctggctgagctga

SEQ ID NO: 2389766 - DNA, 12 bp, Homo sapiens
ctggcttccagg

SEQ ID NO: 2389767 - DNA, 16 bp, Homo sapiens
ctggcttccaggtatc

SEQ ID NO: 2389768 - DNA, 22 bp, Homo sapiens
ctggcttccaggtatctccagg

SEQ ID NO: 2389769 - DNA, 22 bp, Homo sapiens
ctggctttctccgactgctagg

SEQ ID NO: 2389770 - DNA, 23 bp, Homo sapiens
ctgggaccccagctagggctgga

SEQ ID NO: 2389771 - DNA, 15 bp, Homo sapiens
ctgggattcccacca

SEQ ID NO: 2389772 - DNA, 20 bp, Homo sapiens
ctgggattcccaccaaggtc

SEQ ID NO: 2389773 - DNA, 13 bp, Homo sapiens
ctgggggaagggt

SEQ ID NO: 2389774 - DNA, 16 bp, Homo sapiens
ctgggggcgggggagc

SEQ ID NO: 2389775 - DNA, 19 bp, Homo sapiens
ctgggggcgggggagccaa

SEQ ID NO: 2389776 - DNA, 20 bp, Homo sapiens
ctggtagaattgggaagctg

SEQ ID NO: 2389777 - DNA, 20 bp, Homo sapiens
ctggtgcagaggtgagcaga

SEQ ID NO: 2389778 - DNA, 20 bp, Homo sapiens
ctggtgctataggctggaga

SEQ ID NO: 2389779 - DNA, 17 bp, Homo sapiens
ctggtgctgtggccagg

SEQ ID NO: 2389780 - DNA, 19 bp, Homo sapiens
ctggtgctgtggccagggt

SEQ ID NO: 2389781 - DNA, 20 bp, Homo sapiens
ctggtgctgtggccagggtg

SEQ ID NO: 2389782 - DNA, 23 bp, Homo sapiens
ctggtgctgtggccagggtgaga

SEQ ID NO: 2389783 - DNA, 16 bp, Homo sapiens
ctgtaatcccagcact

SEQ ID NO: 2389784 - DNA, 14 bp, Homo sapiens
ctgtagctctcctg

SEQ ID NO: 2389785 - DNA, 14 bp, Homo sapiens
ctgtagtcccagcc

SEQ ID NO: 2389786 - DNA, 18 bp, Homo sapiens
ctgtagtcccagccactc

SEQ ID NO: 2389787 - DNA, 22 bp, Homo sapiens
ctgtccctctttgcctgtgtga

SEQ ID NO: 2389788 - DNA, 16 bp, Homo sapiens
ctgtcttccactgtac

SEQ ID NO: 2389789 - DNA, 14 bp, Homo sapiens
ctgtgaacctggag

SEQ ID NO: 2389790 - DNA, 14 bp, Homo sapiens
ctgtgtacccactc

SEQ ID NO: 2389791 - DNA, 21 bp, Homo sapiens
ctgtgtgaaataccagtgtgg

SEQ ID NO: 2389792 - DNA, 20 bp, Homo sapiens
ctgtgtgagcatctctgtgt

SEQ ID NO: 2389793 - DNA, 19 bp, Homo sapiens
cttaaggagaggagaaact

SEQ ID NO: 2389794 - DNA, 22 bp, Homo sapiens
cttaaggagaggagaaactgag

SEQ ID NO: 2389795 - DNA, 18 bp, Homo sapiens
cttagcatgtgttgaaaa

SEQ ID NO: 2389796 - DNA, 19 bp, Homo sapiens
cttcaaatatagagatatt

SEQ ID NO: 2389797 - DNA, 16 bp, Homo sapiens
cttcaaatccatccag

SEQ ID NO: 2389798 - DNA, 17 bp, Homo sapiens
cttcaaatccatccaga

SEQ ID NO: 2389799 - DNA, 13 bp, Homo sapiens
cttcacagtgttt

SEQ ID NO: 2389800 - DNA, 12 bp, Homo sapiens
cttcagagcagg

SEQ ID NO: 2389801 - DNA, 18 bp, Homo sapiens
cttccaggtatctccagg

SEQ ID NO: 2389802 - DNA, 20 bp, Homo sapiens
cttccaggtatctccaggat

SEQ ID NO: 2389803 - DNA, 15 bp, Homo sapiens
cttcccactggaggt

SEQ ID NO: 2389804 - DNA, 13 bp, Homo sapiens
cttcccccatccc

SEQ ID NO: 2389805 - DNA, 21 bp, Homo sapiens
cttcccccatcccctttcctc

SEQ ID NO: 2389806 - DNA, 23 bp, Homo sapiens
cttcccccatcccctttcctccc

SEQ ID NO: 2389807 - DNA, 13 bp, Homo sapiens
cttcctgcaagga

SEQ ID NO: 2389808 - DNA, 12 bp, Homo sapiens
cttcctttcctc

SEQ ID NO: 2389809 - DNA, 14 bp, Homo sapiens
cttcctttcctctg

SEQ ID NO: 2389810 - DNA, 17 bp, Homo sapiens
cttcctttcctctgcag

SEQ ID NO: 2389811 - DNA, 19 bp, Homo sapiens
cttctattatagccacatc

SEQ ID NO: 2389812 - DNA, 20 bp, Homo sapiens
cttctcagccccgggcctgc

SEQ ID NO: 2389813 - DNA, 23 bp, Homo sapiens
cttctcagccccgggcctgcctc

SEQ ID NO: 2389814 - DNA, 15 bp, Homo sapiens
cttctcctgcctaca

SEQ ID NO: 2389815 - DNA, 13 bp, Homo sapiens
cttcttaaagagt

SEQ ID NO: 2389816 - DNA, 15 bp, Homo sapiens
cttgaactttccaaa

SEQ ID NO: 2389817 - DNA, 16 bp, Homo sapiens
cttgacccatctcccc

SEQ ID NO: 2389818 - DNA, 16 bp, Homo sapiens
cttgcattcccagtgg

SEQ ID NO: 2389819 - DNA, 18 bp, Homo sapiens
cttggactcctcccacaa

SEQ ID NO: 2389820 - DNA, 19 bp, Homo sapiens
cttggcgggcagcccagcc

SEQ ID NO: 2389821 - DNA, 18 bp, Homo sapiens
ctttaaccctctcttccc

SEQ ID NO: 2389822 - DNA, 19 bp, Homo sapiens
ctttaaccctctcttccct

SEQ ID NO: 2389823 - DNA, 15 bp, Homo sapiens
ctttaagactgagca

SEQ ID NO: 2389824 - DNA, 21 bp, Homo sapiens
ctttcaggggggttgtgaggc

SEQ ID NO: 2389825 - DNA, 13 bp, Homo sapiens
ctttcctccccac

SEQ ID NO: 2389826 - DNA, 19 bp, Homo sapiens
cttttgtaccagtgtgaat

SEQ ID NO: 2389827 - DNA, 22 bp, Homo sapiens
gaaaaaaaagtttcagagaagt

SEQ ID NO: 2389828 - DNA, 20 bp, Homo sapiens
gaaaactcctttagcaggtg

SEQ ID NO: 2389829 - DNA, 16 bp, Homo sapiens
gaaaagaatacagaaa

SEQ ID NO: 2389830 - DNA, 18 bp, Homo sapiens
gaaaagaatacagaaaga

SEQ ID NO: 2389831 - DNA, 20 bp, Homo sapiens
gaaaagaggagtttcgaggt

SEQ ID NO: 2389832 - DNA, 22 bp, Homo sapiens
gaaaccaaagatatatacacag

SEQ ID NO: 2389833 - DNA, 16 bp, Homo sapiens
gaaagaaaaaacaaaa

SEQ ID NO: 2389834 - DNA, 14 bp, Homo sapiens
gaaagccatttgtt

SEQ ID NO: 2389835 - DNA, 21 bp, Homo sapiens
gaaatggtatgagctgagggg

SEQ ID NO: 2389836 - DNA, 21 bp, Homo sapiens
gaacaaaagttcgaaagaaaa

SEQ ID NO: 2389837 - DNA, 15 bp, Homo sapiens
gaacaactactgtga

SEQ ID NO: 2389838 - DNA, 17 bp, Homo sapiens
gaactcccagcaacaca

SEQ ID NO: 2389839 - DNA, 16 bp, Homo sapiens
gaactctggcttccag

SEQ ID NO: 2389840 - DNA, 19 bp, Homo sapiens
gaactctggcttccaggta

SEQ ID NO: 2389841 - DNA, 19 bp, Homo sapiens
gaactggacgcccagctga

SEQ ID NO: 2389842 - DNA, 13 bp, Homo sapiens
caggggtctgagc

SEQ ID NO: 2389843 - DNA, 15 bp, Homo sapiens
caggggtctgagcca

SEQ ID NO: 2389844 - DNA, 13 bp, Homo sapiens
caggggtgggaga

SEQ ID NO: 2389845 - DNA, 23 bp, Homo sapiens
caggggtgggagagccagctctc

SEQ ID NO: 2389846 - DNA, 19 bp, Homo sapiens
cagggtgggccactctccc

SEQ ID NO: 2389847 - DNA, 23 bp, Homo sapiens
cagggtgggccactctcccctcc

SEQ ID NO: 2389848 - DNA, 15 bp, Homo sapiens
caggtaatgagggac

SEQ ID NO: 2389849 - DNA, 17 bp, Homo sapiens
caggtaatgagggactg

SEQ ID NO: 2389850 - DNA, 15 bp, Homo sapiens
caggtatctccagga

SEQ ID NO: 2389851 - DNA, 22 bp, Homo sapiens
caggtatctccaggattgaaga

SEQ ID NO: 2389852 - DNA, 22 bp, Homo sapiens
caggtcctctgatacccagagc

SEQ ID NO: 2389853 - DNA, 15 bp, Homo sapiens
caggtggcaggacca

SEQ ID NO: 2389854 - DNA, 16 bp, Homo sapiens
caggtggcaggaccag

SEQ ID NO: 2389855 - DNA, 18 bp, Homo sapiens
caggtggcaggaccagga

SEQ ID NO: 2389856 - DNA, 16 bp, Homo sapiens
cagtataaaagacaaa

SEQ ID NO: 2389857 - DNA, 15 bp, Homo sapiens
cagtcaaaacagaga

SEQ ID NO: 2389858 - DNA, 18 bp, Homo sapiens
cagtgagttacagcgaga

SEQ ID NO: 2389859 - DNA, 16 bp, Homo sapiens
cgtgaatgtctcagcg

SEQ ID NO: 2389860 - DNA, 16 bp, Homo sapiens
cgtgccagtgtcccca

SEQ ID NO: 2389861 - DNA, 14 bp, Homo sapiens
ctaagcctcctttt

SEQ ID NO: 2389862 - DNA, 20 bp, Homo sapiens
ctaatcaggctgaggtgtct

SEQ ID NO: 2389863 - DNA, 15 bp, Homo sapiens
ctacattccctggcc

SEQ ID NO: 2389864 - DNA, 16 bp, Homo sapiens
ctacattccctggcct

SEQ ID NO: 2389865 - DNA, 15 bp, Homo sapiens
ctacccggcccagag

SEQ ID NO: 2389866 - DNA, 22 bp, Homo sapiens
ctacttttgtaccagtgtgaat

SEQ ID NO: 2389867 - DNA, 22 bp, Homo sapiens
ctagagggatacactgaagtta

SEQ ID NO: 2389868 - DNA, 19 bp, Homo sapiens
ctaggcgagtgccaggact

SEQ ID NO: 2389869 - DNA, 21 bp, Homo sapiens
  misc_feature (4)..(4): n is a, c, g or t
  misc_feature (11)..(11): n is a, c, g or t
ctanccccccnacccccagtg

SEQ ID NO: 2389870 - DNA, 15 bp, Homo sapiens
ctatagcccaggtcc

SEQ ID NO: 2389871 - DNA, 16 bp, Homo sapiens
ctataggctggagaag

SEQ ID NO: 2389872 - DNA, 17 bp, Homo sapiens
ctataggctggagaagc

SEQ ID NO: 2389873 - DNA, 14 bp, Homo sapiens
ctatcaatatttaa

SEQ ID NO: 2389874 - DNA, 14 bp, Homo sapiens
ctatcacacagtgg

SEQ ID NO: 2389875 - DNA, 20 bp, Homo sapiens
ctatgatatggtaaaagtta

SEQ ID NO: 2389876 - DNA, 15 bp, Homo sapiens
ctattacttgaactt

SEQ ID NO: 2389877 - DNA, 16 bp, Homo sapiens
ctattacttgaacttt

SEQ ID NO: 2389878 - DNA, 16 bp, Homo sapiens
ctcaacctctctcctt

SEQ ID NO: 2389879 - DNA, 20 bp, Homo sapiens
ctcacacttgggcgctctgc

SEQ ID NO: 2389880 - DNA, 22 bp, Homo sapiens
ctcacacttgggcgctctgccc

SEQ ID NO: 2389881 - DNA, 15 bp, Homo sapiens
ctcactgccccacca

SEQ ID NO: 2389882 - DNA, 19 bp, Homo sapiens
ctcagccccgggcctgcct

SEQ ID NO: 2389883 - DNA, 23 bp, Homo sapiens
ctcagccccgggcctgcctctga

SEQ ID NO: 2389884 - DNA, 20 bp, Homo sapiens
ctcagtgggacaaaccagag

SEQ ID NO: 2389885 - DNA, 13 bp, Homo sapiens
ctcattcccctcg

SEQ ID NO: 2389886 - DNA, 18 bp, Homo sapiens
ctccaacaataaagagct

SEQ ID NO: 2389887 - DNA, 20 bp, Homo sapiens
ctccaacaataaagagctca

SEQ ID NO: 2389888 - DNA, 14 bp, Homo sapiens
ctccaaggaccagg

SEQ ID NO: 2389889 - DNA, 15 bp, Homo sapiens
ctccaaggaccaggt

SEQ ID NO: 2389890 - DNA, 14 bp, Homo sapiens
ctcccacaatctgg

SEQ ID NO: 2389891 - DNA, 14 bp, Homo sapiens
ctcccaccaccctc

SEQ ID NO: 2389892 - DNA, 15 bp, Homo sapiens
ctcccaccaccctcc

SEQ ID NO: 2389893 - DNA, 22 bp, Homo sapiens
ctcccaccaccctcccaccatg

SEQ ID NO: 2389894 - DNA, 21 bp, Homo sapiens
ctcccagcaacacaagctgga

SEQ ID NO: 2389895 - DNA, 16 bp, Homo sapiens
ctccccaccttcccca

SEQ ID NO: 2389896 - DNA, 12 bp, Homo sapiens
ctccccaggcca

SEQ ID NO: 2389897 - DNA, 15 bp, Homo sapiens
ctccccaggccaggc

SEQ ID NO: 2389898 - DNA, 14 bp, Homo sapiens
ctcccctccctctt

SEQ ID NO: 2389899 - DNA, 19 bp, Homo sapiens
ctcccctccctcttccttc

SEQ ID NO: 2389900 - DNA, 15 bp, Homo sapiens
ctccctcttccttcc

SEQ ID NO: 2389901 - DNA, 19 bp, Homo sapiens
ctccctcttccttccccca

SEQ ID NO: 2389902 - DNA, 19 bp, Homo sapiens
ctcctcactgccccaccag

SEQ ID NO: 2389903 - DNA, 13 bp, Homo sapiens
ctcctcccacaat

SEQ ID NO: 2389904 - DNA, 16 bp, Homo sapiens
ctcctcccaccaccct

SEQ ID NO: 2389905 - DNA, 13 bp, Homo sapiens
ctcctctaagcca

SEQ ID NO: 2389906 - DNA, 14 bp, Homo sapiens
ctcctttagcaggt

SEQ ID NO: 2389907 - DNA, 23 bp, Homo sapiens
ctcgagggttgggttcatctgag

SEQ ID NO: 2389908 - DNA, 17 bp, Homo sapiens
ctcgcatgccagagcct

SEQ ID NO: 2389909 - DNA, 21 bp, Homo sapiens
ctcgggaggctgagacaggag

SEQ ID NO: 2389910 - DNA, 19 bp, Homo sapiens
ctctaagccactcttccaa

SEQ ID NO: 2389911 - DNA, 19 bp, Homo sapiens
ctctacccggcccagagac

SEQ ID NO: 2389912 - DNA, 14 bp, Homo sapiens
ctctcaggatcaag

SEQ ID NO: 2389913 - DNA, 12 bp, Homo sapiens
ctctcccctccc

SEQ ID NO: 2389914 - DNA, 15 bp, Homo sapiens
ctctcccctccctct

SEQ ID NO: 2389915 - DNA, 21 bp, Homo sapiens
ctctctacccggcccagagac

SEQ ID NO: 2389916 - DNA, 15 bp, Homo sapiens
ctctctccttctggc

SEQ ID NO: 2389917 - DNA, 13 bp, Homo sapiens
ctctcttccctat

SEQ ID NO: 2389918 - DNA, 17 bp, Homo sapiens
ctctgaatggtccaggg

SEQ ID NO: 2389919 - DNA, 18 bp, Homo sapiens
ctctgaatggtccagggt

SEQ ID NO: 2389920 - DNA, 16 bp, Homo sapiens
ctctgactcacacttg

SEQ ID NO: 2389921 - DNA, 19 bp, Homo sapiens
ctctgagaattccaaggag

SEQ ID NO: 2389922 - DNA, 14 bp, Homo sapiens
ctctgccctccctg

SEQ ID NO: 2389923 - DNA, 16 bp, Homo sapiens
ctctgccctccctggc

SEQ ID NO: 2389924 - DNA, 19 bp, Homo sapiens
ctctggaaaatgtgaccca

SEQ ID NO: 2389925 - DNA, 13 bp, Homo sapiens
ctctggcttccag

SEQ ID NO: 2389926 - DNA, 17 bp, Homo sapiens
ctctggcttccaggtat

SEQ ID NO: 2389927 - DNA, 22 bp, Homo sapiens
ctctgtataatctatttacata

SEQ ID NO: 2389928 - DNA, 12 bp, Homo sapiens
ctctgtccctct

SEQ ID NO: 2389929 - DNA, 17 bp, Homo sapiens
ctctgtgtacccactcc

SEQ ID NO: 2389930 - DNA, 23 bp, Homo sapiens
ctctgtgtacccactcctcactg

SEQ ID NO: 2389931 - DNA, 12 bp, Homo sapiens
ctcttccttccc

SEQ ID NO: 2389932 - DNA, 13 bp, Homo sapiens
ctcttccttcccc

SEQ ID NO: 2389933 - DNA, 22 bp, Homo sapiens
ctcttgggcatgctcagccctt

SEQ ID NO: 2389934 - DNA, 20 bp, Homo sapiens
ctctttggggtcagccaggg

SEQ ID NO: 2389935 - DNA, 22 bp, Homo sapiens
ctgaatgcctcaatgtgaccag

SEQ ID NO: 2389936 - DNA, 12 bp, Homo sapiens
ctgaatgctctg

SEQ ID NO: 2389937 - DNA, 15 bp, Homo sapiens
ctgaatggtccaggg

SEQ ID NO: 2389938 - DNA, 16 bp, Homo sapiens
ctgaatggtccagggt

SEQ ID NO: 2389939 - DNA, 17 bp, Homo sapiens
ctgactcctctaagcca

SEQ ID NO: 2389940 - DNA, 19 bp, Homo sapiens
ctgactcctctaagccact

SEQ ID NO: 2389941 - DNA, 22 bp, Homo sapiens
ctgactggtgctataggctgga

SEQ ID NO: 2389942 - DNA, 15 bp, Homo sapiens
ctgagaattccaagg

SEQ ID NO: 2389943 - DNA, 15 bp, Homo sapiens
ctgagacaggagaat

SEQ ID NO: 2389944 - DNA, 16 bp, Homo sapiens
ctgagcaagagctggc

SEQ ID NO: 2389945 - DNA, 12 bp, Homo sapiens
aaaaacttgtaa

SEQ ID NO: 2389946 - DNA, 18 bp, Homo sapiens
aaaaacttgtaaatgctg

SEQ ID NO: 2389947 - DNA, 13 bp, Homo sapiens
aaaaagatttgtt

SEQ ID NO: 2389948 - DNA, 20 bp, Homo sapiens
aaaaatgactaaaaatatta

SEQ ID NO: 2389949 - DNA, 16 bp, Homo sapiens
aaaagaatacagaaag

SEQ ID NO: 2389950 - DNA, 17 bp, Homo sapiens
aaaagatttgttttgtc

SEQ ID NO: 2389951 - DNA, 19 bp, Homo sapiens
aaaatattataacttaaaa

SEQ ID NO: 2389952 - DNA, 21 bp, Homo sapiens
aaaatgactaaaaatattata

SEQ ID NO: 2389953 - DNA, 20 bp, Homo sapiens
aaacacaaaagttagctgag

SEQ ID NO: 2389954 - DNA, 14 bp, Homo sapiens
aaacacaatatttt

SEQ ID NO: 2389955 - DNA, 21 bp, Homo sapiens
aaacataattcttgtatatta

SEQ ID NO: 2389956 - DNA, 15 bp, Homo sapiens
aaacattaagattga

SEQ ID NO: 2389957 - DNA, 14 bp, Homo sapiens
aaactgcattagaa

SEQ ID NO: 2389958 - DNA, 11 bp, Homo sapiens
aaacttgtaaa

SEQ ID NO: 2389959 - DNA, 17 bp, Homo sapiens
aaagaatacagaaagat

SEQ ID NO: 2389960 - DNA, 15 bp, Homo sapiens
aaagaatccctgcag

SEQ ID NO: 2389961 - DNA, 16 bp, Homo sapiens
aaagagttcttaagga

SEQ ID NO: 2389962 - DNA, 16 bp, Homo sapiens
aaagatggatgtgctt

SEQ ID NO: 2389963 - DNA, 23 bp, Homo sapiens
aaagtatatatttatttaagctt

SEQ ID NO: 2389964 - DNA, 15 bp, Homo sapiens
aaagtgcaatgcgtg

SEQ ID NO: 2389965 - DNA, 19 bp, Homo sapiens
aaagtgttggctaatgaag

SEQ ID NO: 2389966 - DNA, 14 bp, Homo sapiens
aaagttagctgagc

SEQ ID NO: 2389967 - DNA, 20 bp, Homo sapiens
aaatattataacttaaaaaa

SEQ ID NO: 2389968 - DNA, 15 bp, Homo sapiens
aaatcctactgaatg

SEQ ID NO: 2389969 - DNA, 14 bp, Homo sapiens
aaatgacagatgtt

SEQ ID NO: 2389970 - DNA, 16 bp, Homo sapiens
aaattataacttaaaa

SEQ ID NO: 2389971 - DNA, 20 bp, Homo sapiens
aaattatgttacatctgttt

SEQ ID NO: 2389972 - DNA, 11 bp, Homo sapiens
aaattcttttt

SEQ ID NO: 2389973 - DNA, 18 bp, Homo sapiens
aacacaagctggaagcac

SEQ ID NO: 2389974 - DNA, 16 bp, Homo sapiens
aacagcagaggttctt

SEQ ID NO: 2389975 - DNA, 16 bp, Homo sapiens
aacagccaacaggtgg

SEQ ID NO: 2389976 - DNA, 21 bp, Homo sapiens
aacaggtggcaggaccaggac

SEQ ID NO: 2389977 - DNA, 22 bp, Homo sapiens
aacaggtggcaggaccaggact

SEQ ID NO: 2389978 - DNA, 20 bp, Homo sapiens
aacatgtttacttttcaggg

SEQ ID NO: 2389979 - DNA, 13 bp, Homo sapiens
aaccctctcttcc

SEQ ID NO: 2389980 - DNA, 15 bp, Homo sapiens
aaccctctcttccct

SEQ ID NO: 2389981 - DNA, 16 bp, Homo sapiens
aaccctctcttcccta

SEQ ID NO: 2389982 - DNA, 16 bp, Homo sapiens
aacctctctccttctg

SEQ ID NO: 2389983 - DNA, 11 bp, Homo sapiens
aacgaatgaag

SEQ ID NO: 2389984 - DNA, 15 bp, Homo sapiens
aactaataaaagcat

SEQ ID NO: 2389985 - DNA, 17 bp, Homo sapiens
aactatcaatatttaag

SEQ ID NO: 2389986 - DNA, 18 bp, Homo sapiens
aactatgatatggtaaaa

SEQ ID NO: 2389987 - DNA, 18 bp, Homo sapiens
aactcctttagcaggtgg

SEQ ID NO: 2389988 - DNA, 16 bp, Homo sapiens
aactctggcttccagg

SEQ ID NO: 2389989 - DNA, 20 bp, Homo sapiens
aactctggcttccaggtatc

SEQ ID NO: 2389990 - DNA, 12 bp, Homo sapiens
aactgaaaagac

SEQ ID NO: 2389991 - DNA, 14 bp, Homo sapiens
aactgatttctcac

SEQ ID NO: 2389992 - DNA, 16 bp, Homo sapiens
aactgcattagaaatt

SEQ ID NO: 2389993 - DNA, 14 bp, Homo sapiens
aacttaaaatattt

SEQ ID NO: 2389994 - DNA, 16 bp, Homo sapiens
aacttagcatgtgttg

SEQ ID NO: 2389995 - DNA, 18 bp, Homo sapiens
aacttgtaaatgctgtca

SEQ ID NO: 2389996 - DNA, 18 bp, Homo sapiens
aagaaagcacctgttttt

SEQ ID NO: 2389997 - DNA, 20 bp, Homo sapiens
aagaaagcacctgtttttac

SEQ ID NO: 2389998 - DNA, 10 bp, Homo sapiens
aagaagagac

SEQ ID NO: 2389999 - DNA, 14 bp, Homo sapiens
aagaagagacagga

SEQ ID NO: 2390000 - DNA, 13 bp, Homo sapiens
aagaatacagaaa

SEQ ID NO: 2390001 - DNA, 19 bp, Homo sapiens
aagactgagcacctgcttc

SEQ ID NO: 2390002 - DNA, 11 bp, Homo sapiens
aagagcctgga

SEQ ID NO: 2390003 - DNA, 13 bp, Homo sapiens
aagagcctggaga

SEQ ID NO: 2390004 - DNA, 17 bp, Homo sapiens
aagagcctggagaagct

SEQ ID NO: 2390005 - DNA, 20 bp, Homo sapiens
aagaggagtttcgaggtaga

SEQ ID NO: 2390006 - DNA, 20 bp, Homo sapiens
aagatcgcgccactgcactc

SEQ ID NO: 2390007 - DNA, 16 bp, Homo sapiens
aagatgtttgtcagat

SEQ ID NO: 2390008 - DNA, 15 bp, Homo sapiens
aagattttttttgta

SEQ ID NO: 2390009 - DNA, 17 bp, Homo sapiens
aagcaaaggtgaagaga

SEQ ID NO: 2390010 - DNA, 16 bp, Homo sapiens
aagcaattatattgtc

SEQ ID NO: 2390011 - DNA, 23 bp, Homo sapiens
aagcactgctaggcgagtgccag

SEQ ID NO: 2390012 - DNA, 22 bp, Homo sapiens
aagcataaatgcaaacacacaa

SEQ ID NO: 2390013 - DNA, 17 bp, Homo sapiens
aagccaacagtcaaaac

SEQ ID NO: 2390014 - DNA, 13 bp, Homo sapiens
aagcctctggaaa

SEQ ID NO: 2390015 - DNA, 15 bp, Homo sapiens
aagctgggggaaggg

SEQ ID NO: 2390016 - DNA, 22 bp, Homo sapiens
aaggaactctggcttccaggta

SEQ ID NO: 2390017 - DNA, 17 bp, Homo sapiens
aaggaatctccagtttt

SEQ ID NO: 2390018 - DNA, 21 bp, Homo sapiens
aaggacggccttcaactgaaa

SEQ ID NO: 2390019 - DNA, 21 bp, Homo sapiens
aaggactacgttaagggaagg

SEQ ID NO: 2390020 - DNA, 18 bp, Homo sapiens
aagggaaggaactctggc

SEQ ID NO: 2390021 - DNA, 16 bp, Homo sapiens
aagggccatgctgaag

SEQ ID NO: 2390022 - DNA, 18 bp, Homo sapiens
aagggtggtctgagcacc

SEQ ID NO: 2390023 - DNA, 23 bp, Homo sapiens
aaggtggggtatttaccacagca

SEQ ID NO: 2390024 - DNA, 16 bp, Homo sapiens
aaggttccctctgaga

SEQ ID NO: 2390025 - DNA, 24 bp, Homo sapiens
aagtgtcatatgtaggtgtctgca

SEQ ID NO: 2390026 - DNA, 19 bp, Homo sapiens
aggaaaagtgcaatgcgtg

SEQ ID NO: 2390027 - DNA, 23 bp, Homo sapiens
aggaactcccagcaacacaagct

SEQ ID NO: 2390028 - DNA, 17 bp, Homo sapiens
aggaagatgaaagagga

SEQ ID NO: 2390029 - DNA, 20 bp, Homo sapiens
aggactacgttaagggaagg

SEQ ID NO: 2390030 - DNA, 18 bp, Homo sapiens
aggactatagcccaggtc

SEQ ID NO: 2390031 - DNA, 16 bp, Homo sapiens
aggactccccaggcca

SEQ ID NO: 2390032 - DNA, 19 bp, Homo sapiens
aggactccccaggccaggc

SEQ ID NO: 2390033 - DNA, 14 bp, Homo sapiens
aggacttcccgagc

SEQ ID NO: 2390034 - DNA, 14 bp, Homo sapiens
aggagtgagatcat

SEQ ID NO: 2390035 - DNA, 17 bp, Homo sapiens
aggagttaagagtagca

SEQ ID NO: 2390036 - DNA, 22 bp, Homo sapiens
aggatctagaatgtgttttctg

SEQ ID NO: 2390037 - DNA, 14 bp, Homo sapiens
aggattgaagagca

SEQ ID NO: 2390038 - DNA, 22 bp, Homo sapiens
aggattgaagagcattgcatgg

SEQ ID NO: 2390039 - DNA, 18 bp, Homo sapiens
aggcagagaaagaagaga

SEQ ID NO: 2390040 - DNA, 22 bp, Homo sapiens
aggcagagaaagaagagacagg

SEQ ID NO: 2390041 - DNA, 17 bp, Homo sapiens
aggcaggggtgggagag

SEQ ID NO: 2390042 - DNA, 22 bp, Homo sapiens
aggcaggggtgggagagccagc

SEQ ID NO: 2390043 - DNA, 16 bp, Homo sapiens
aggcctgccctcaggg

SEQ ID NO: 2390044 - DNA, 13 bp, Homo sapiens
aggcctggccagg

SEQ ID NO: 2390045 - DNA, 14 bp, Homo sapiens
aggcctggccaggc

SEQ ID NO: 2390046 - DNA, 15 bp, Homo sapiens
aggcctggccaggca

SEQ ID NO: 2390047 - DNA, 15 bp, Homo sapiens
aggcgagtgccagga

SEQ ID NO: 2390048 - DNA, 18 bp, Homo sapiens
aggcgagtgccaggactc

SEQ ID NO: 2390049 - DNA, 15 bp, Homo sapiens
aggcggagagtacag

SEQ ID NO: 2390050 - DNA, 21 bp, Homo sapiens
aggctctttggggtcagccag

SEQ ID NO: 2390051 - DNA, 20 bp, Homo sapiens
aggctggtgctgtggccagg

SEQ ID NO: 2390052 - DNA, 22 bp, Homo sapiens
aggctggtgctgtggccagggt

SEQ ID NO: 2390053 - DNA, 21 bp, Homo sapiens
agggaagacaggtctagactt

SEQ ID NO: 2390054 - DNA, 12 bp, Homo sapiens
agggacttaaaa

SEQ ID NO: 2390055 - DNA, 13 bp, Homo sapiens
agggacttaaaaa

SEQ ID NO: 2390056 - DNA, 14 bp, Homo sapiens
agggatacactgaa

SEQ ID NO: 2390057 - DNA, 13 bp, Homo sapiens
agggcaagggcca

SEQ ID NO: 2390058 - DNA, 17 bp, Homo sapiens
agggcaaggggtttcca

SEQ ID NO: 2390059 - DNA, 13 bp, Homo sapiens
agggcattttaaa

SEQ ID NO: 2390060 - DNA, 21 bp, Homo sapiens
agggccaggggtctccctgga

SEQ ID NO: 2390061 - DNA, 18 bp, Homo sapiens
agggccatgctgaaggga

SEQ ID NO: 2390062 - DNA, 19 bp, Homo sapiens
agggccatgctgaagggac

SEQ ID NO: 2390063 - DNA, 21 bp, Homo sapiens
agggcgtcgctggacaaccca

SEQ ID NO: 2390064 - DNA, 16 bp, Homo sapiens
aggggcacgcctgccc

SEQ ID NO: 2390065 - DNA, 17 bp, Homo sapiens
aggggcagaaaaactct

SEQ ID NO: 2390066 - DNA, 14 bp, Homo sapiens
aggggcccacaggg

SEQ ID NO: 2390067 - DNA, 21 bp, Homo sapiens
aggggcccacagggaaccctg

SEQ ID NO: 2390068 - DNA, 16 bp, Homo sapiens
agggggtccacccagc

SEQ ID NO: 2390069 - DNA, 19 bp, Homo sapiens
aggggtaggcagagccttt

SEQ ID NO: 2390070 - DNA, 16 bp, Homo sapiens
aggggtctccctggag

SEQ ID NO: 2390071 - DNA, 13 bp, Homo sapiens
aggggtgatttca

SEQ ID NO: 2390072 - DNA, 17 bp, Homo sapiens
aggggtgatttcagaga

SEQ ID NO: 2390073 - DNA, 22 bp, Homo sapiens
aggggtgatttcagagagggca

SEQ ID NO: 2390074 - DNA, 15 bp, Homo sapiens
aggggtgggagagcc

SEQ ID NO: 2390075 - DNA, 18 bp, Homo sapiens
aggggtgggagagccagc

SEQ ID NO: 2390076 - DNA, 18 bp, Homo sapiens
agggtcgccacacccggc

SEQ ID NO: 2390077 - DNA, 20 bp, Homo sapiens
agggtggtctgagcaccccc

SEQ ID NO: 2390078 - DNA, 23 bp, Homo sapiens
agggttgggttcatctgagcaag

SEQ ID NO: 2390079 - DNA, 17 bp, Homo sapiens
aggtaaaagtgtgagca

SEQ ID NO: 2390080 - DNA, 23 bp, Homo sapiens
aggtagagtttgaaggaggtgag

SEQ ID NO: 2390081 - DNA, 15 bp, Homo sapiens
aggtataattttatg

SEQ ID NO: 2390082 - DNA, 15 bp, Homo sapiens
aggtgagcagaggag

SEQ ID NO: 2390083 - DNA, 17 bp, Homo sapiens
aggtgcaagtgccccag

SEQ ID NO: 2390084 - DNA, 14 bp, Homo sapiens
aggtggcaggacca

SEQ ID NO: 2390085 - DNA, 17 bp, Homo sapiens
aggtggcaggaccagga

SEQ ID NO: 2390086 - DNA, 19 bp, Homo sapiens
aggtggcaggaccaggact

SEQ ID NO: 2390087 - DNA, 15 bp, Homo sapiens
aggtggctctccagt

SEQ ID NO: 2390088 - DNA, 17 bp, Homo sapiens
aggtggctctccagtta

SEQ ID NO: 2390089 - DNA, 23 bp, Homo sapiens
aggtggggtatttaccacagcag

SEQ ID NO: 2390090 - DNA, 16 bp, Homo sapiens
aggtgtctgcacccag

SEQ ID NO: 2390091 - DNA, 16 bp, Homo sapiens
agtagcaagttctaga

SEQ ID NO: 2390092 - DNA, 22 bp, Homo sapiens
agtagcaagttctagagaagag

SEQ ID NO: 2390093 - DNA, 14 bp, Homo sapiens
agtccagggcggga

SEQ ID NO: 2390094 - DNA, 20 bp, Homo sapiens
agtccagggcgggagtgggg

SEQ ID NO: 2390095 - DNA, 17 bp, Homo sapiens
agtcctgcagaggattt

SEQ ID NO: 2390096 - DNA, 24 bp, Homo sapiens
agtgccaggactccccaggccagg

SEQ ID NO: 2390097 - DNA, 14 bp, Homo sapiens
agtggatctccaag

SEQ ID NO: 2390098 - DNA, 18 bp, Homo sapiens
agtggatctccaaggacc

SEQ ID NO: 2390099 - DNA, 23 bp, Homo sapiens
agtggatctccaaggaccaggtt

SEQ ID NO: 2390100 - DNA, 16 bp, Homo sapiens
agtggtaagctctggc

SEQ ID NO: 2390101 - DNA, 22 bp, Homo sapiens
agtggtcaaaccgcactcaccc

SEQ ID NO: 2390102 - DNA, 21 bp, Homo sapiens
agtgtggtagggacttaaaaa

SEQ ID NO: 2390103 - DNA, 16 bp, Homo sapiens
agtgttcctatttggg

SEQ ID NO: 2390104 - DNA, 20 bp, Homo sapiens
agtgttcctatttggggctt

SEQ ID NO: 2390105 - DNA, 15 bp, Homo sapiens
agttctagagaagag

SEQ ID NO: 2390106 - DNA, 20 bp, Homo sapiens
agttctagagaagaggctgg

SEQ ID NO: 2390107 - DNA, 15 bp, Homo sapiens
agttctgagtgtttt

SEQ ID NO: 2390108 - DNA, 13 bp, Homo sapiens
agttgacagcagg

SEQ ID NO: 2390109 - DNA, 14 bp, Homo sapiens
agttgctgtcataa

SEQ ID NO: 2390110 - DNA, 13 bp, Homo sapiens
agttgtcttgtcc

SEQ ID NO: 2390111 - DNA, 18 bp, Homo sapiens
agtttcagagaagttctg

SEQ ID NO: 2390112 - DNA, 16 bp, Homo sapiens
agttttattgagaatt

SEQ ID NO: 2390113 - DNA, 18 bp, Homo sapiens
ataaaagcataaatgcaa

SEQ ID NO: 2390114 - DNA, 15 bp, Homo sapiens
ataaagttagtgtgt

SEQ ID NO: 2390115 - DNA, 23 bp, Homo sapiens
ataacactataaaggttgacaat

SEQ ID NO: 2390116 - DNA, 12 bp, Homo sapiens
ataactgagaat

SEQ ID NO: 2390117 - DNA, 12 bp, Homo sapiens
ataacttaaaaa

SEQ ID NO: 2390118 - DNA, 16 bp, Homo sapiens
ataacttaaaatattt

SEQ ID NO: 2390119 - DNA, 20 bp, Homo sapiens
ataagagagaacaactactg

SEQ ID NO: 2390120 - DNA, 20 bp, Homo sapiens
ataaggatcagaacagcaga

SEQ ID NO: 2390121 - DNA, 23 bp, Homo sapiens
atacagaaagatggatgtgcttt

SEQ ID NO: 2390122 - DNA, 15 bp, Homo sapiens
atacagaggtaacta

SEQ ID NO: 2390123 - DNA, 18 bp, Homo sapiens
atacagaggtaactatca

SEQ ID NO: 2390124 - DNA, 14 bp, Homo sapiens
atacagtgttattt

SEQ ID NO: 2390125 - DNA, 15 bp, Homo sapiens
atacagtgttatttt

SEQ ID NO: 2390126 - DNA, 14 bp, Homo sapiens
ataccttcttcgct

SEQ ID NO: 2390127 - DNA, 21 bp, Homo sapiens
atagaaactcaccatgtaaaa

SEQ ID NO: 2390128 - DNA, 13 bp, Homo sapiens
atagatgggtctg

SEQ ID NO: 2390129 - DNA, 14 bp, Homo sapiens
ataggctggagaag

SEQ ID NO: 2390130 - DNA, 21 bp, Homo sapiens
ataggctggagaagctcaccc

SEQ ID NO: 2390131 - DNA, 16 bp, Homo sapiens
atatgatatgtaaaca

SEQ ID NO: 2390132 - DNA, 17 bp, Homo sapiens
atatgtaggtgtctgca

SEQ ID NO: 2390133 - DNA, 14 bp, Homo sapiens
atattaaaggagtt

SEQ ID NO: 2390134 - DNA, 15 bp, Homo sapiens
atattgtcagatatt

SEQ ID NO: 2390135 - DNA, 16 bp, Homo sapiens
atattgtcagatattt

SEQ ID NO: 2390136 - DNA, 18 bp, Homo sapiens
caccaccttggactcctc

SEQ ID NO: 2390137 - DNA, 20 bp, Homo sapiens
caccaccttggactcctccc

SEQ ID NO: 2390138 - DNA, 16 bp, Homo sapiens
caccagccacctcttg

SEQ ID NO: 2390139 - DNA, 11 bp, Homo sapiens
caccaggaagg

SEQ ID NO: 2390140 - DNA, 13 bp, Homo sapiens
caccaggatggcc

SEQ ID NO: 2390141 - DNA, 17 bp, Homo sapiens
caccatgcgctgctcaa

SEQ ID NO: 2390142 - DNA, 13 bp, Homo sapiens
caccccaccaggg

SEQ ID NO: 2390143 - DNA, 11 bp, Homo sapiens
caccccctcat

SEQ ID NO: 2390144 - DNA, 15 bp, Homo sapiens
cacccggctccccct

SEQ ID NO: 2390145 - DNA, 13 bp, Homo sapiens
cacctcttgggca

SEQ ID NO: 2390146 - DNA, 17 bp, Homo sapiens
cacgcaggaactcccag

SEQ ID NO: 2390147 - DNA, 19 bp, Homo sapiens
cacgcaggaactcccagca

SEQ ID NO: 2390148 - DNA, 14 bp, Homo sapiens
cacgcctgcccagc

SEQ ID NO: 2390149 - DNA, 17 bp, Homo sapiens
cacgcctgcccagcctc

SEQ ID NO: 2390150 - DNA, 20 bp, Homo sapiens
cacgcctgcccagcctcgca

SEQ ID NO: 2390151 - DNA, 19 bp, Homo sapiens
cacgcctgtaatcccagca

SEQ ID NO: 2390152 - DNA, 18 bp, Homo sapiens
cactcgggaggctgagac

SEQ ID NO: 2390153 - DNA, 22 bp, Homo sapiens
cactcgggaggctgagacagga

SEQ ID NO: 2390154 - DNA, 11 bp, Homo sapiens
cactcttccaa

SEQ ID NO: 2390155 - DNA, 17 bp, Homo sapiens
cactcttcctgcaagga

SEQ ID NO: 2390156 - DNA, 19 bp, Homo sapiens
cactgaagttaacagagac

SEQ ID NO: 2390157 - DNA, 21 bp, Homo sapiens
cactgctaggcgagtgccagg

SEQ ID NO: 2390158 - DNA, 20 bp, Homo sapiens
cactttaaccctctcttccc

SEQ ID NO: 2390159 - DNA, 16 bp, Homo sapiens
cagaaaaactctggga

SEQ ID NO: 2390160 - DNA, 19 bp, Homo sapiens
cagaaaaactctgggaaat

SEQ ID NO: 2390161 - DNA, 19 bp, Homo sapiens
cagaaagatggatgtgctt

SEQ ID NO: 2390162 - DNA, 21 bp, Homo sapiens
cagaacaaggttccctctgag

SEQ ID NO: 2390163 - DNA, 21 bp, Homo sapiens
cagaaggggcacgcctgccca

SEQ ID NO: 2390164 - DNA, 15 bp, Homo sapiens
cagaataccttcttc

SEQ ID NO: 2390165 - DNA, 23 bp, Homo sapiens
cagaataccttcttcgctgctag

SEQ ID NO: 2390166 - DNA, 13 bp, Homo sapiens
cagactcagctcc

SEQ ID NO: 2390167 - DNA, 20 bp, Homo sapiens
cagagaccccttcctttcct

SEQ ID NO: 2390168 - DNA, 21 bp, Homo sapiens
cagagaccccttcctttcctc

SEQ ID NO: 2390169 - DNA, 19 bp, Homo sapiens
cagagcattacgtgagcca

SEQ ID NO: 2390170 - DNA, 20 bp, Homo sapiens
cagagcattacgtgagccag

SEQ ID NO: 2390171 - DNA, 23 bp, Homo sapiens
cagagcattacgtgagccaggta

SEQ ID NO: 2390172 - DNA, 14 bp, Homo sapiens
cagagcctggggca

SEQ ID NO: 2390173 - DNA, 13 bp, Homo sapiens
cagagccttctcc

SEQ ID NO: 2390174 - DNA, 19 bp, Homo sapiens
cagagccttctcctgccta

SEQ ID NO: 2390175 - DNA, 21 bp, Homo sapiens
cagagccttctcctgcctaca

SEQ ID NO: 2390176 - DNA, 16 bp, Homo sapiens
cagagcctttggatga

SEQ ID NO: 2390177 - DNA, 20 bp, Homo sapiens
cagagcctttggatgaccag

SEQ ID NO: 2390178 - DNA, 16 bp, Homo sapiens
cagaggagtccagggc

SEQ ID NO: 2390179 - DNA, 21 bp, Homo sapiens
cagaggagtccagggcgggag

SEQ ID NO: 2390180 - DNA, 15 bp, Homo sapiens
cagaggggtaggcag

SEQ ID NO: 2390181 - DNA, 21 bp, Homo sapiens
cagaggggtaggcagagcctt

SEQ ID NO: 2390182 - DNA, 20 bp, Homo sapiens
cagaggtaaaagtgtgagca

SEQ ID NO: 2390183 - DNA, 22 bp, Homo sapiens
cagaggtaactatcaatattta

SEQ ID NO: 2390184 - DNA, 23 bp, Homo sapiens
cagagtttagaggaaaaaaatga

SEQ ID NO: 2390185 - DNA, 16 bp, Homo sapiens
cagcaacacaagctgg

SEQ ID NO: 2390186 - DNA, 21 bp, Homo sapiens
cagcaacacaagctggaagca

SEQ ID NO: 2390187 - DNA, 17 bp, Homo sapiens
cagcactttaaccctct

SEQ ID NO: 2390188 - DNA, 20 bp, Homo sapiens
cagcactttaaccctctctt

SEQ ID NO: 2390189 - DNA, 24 bp, Homo sapiens
cagcactttaaccctctcttccct

SEQ ID NO: 2390190 - DNA, 17 bp, Homo sapiens
cagcagatggaaagaaa

SEQ ID NO: 2390191 - DNA, 22 bp, Homo sapiens
cagccacctcttgggcatgctc

SEQ ID NO: 2390192 - DNA, 23 bp, Homo sapiens
cagccactcgggaggctgagaca

SEQ ID NO: 2390193 - DNA, 12 bp, Homo sapiens
cagccagggcca

SEQ ID NO: 2390194 - DNA, 12 bp, Homo sapiens
cagcccagcctc

SEQ ID NO: 2390195 - DNA, 21 bp, Homo sapiens
cagcccagcctctgtccctct

SEQ ID NO: 2390196 - DNA, 17 bp, Homo sapiens
cagccccgggcctgcct

SEQ ID NO: 2390197 - DNA, 16 bp, Homo sapiens
cagcctcctcccacca

SEQ ID NO: 2390198 - DNA, 20 bp, Homo sapiens
cagcctcctcccaccaccct

SEQ ID NO: 2390199 - DNA, 13 bp, Homo sapiens
cagcgagaggcag

SEQ ID NO: 2390200 - DNA, 13 bp, Homo sapiens
cagctagggctgg

SEQ ID NO: 2390201 - DNA, 16 bp, Homo sapiens
cagctccagaatacct

SEQ ID NO: 2390202 - DNA, 16 bp, Homo sapiens
cagctctctctacccg

SEQ ID NO: 2390203 - DNA, 12 bp, Homo sapiens
cagcttctccag

SEQ ID NO: 2390204 - DNA, 13 bp, Homo sapiens
cagcttctccagg

SEQ ID NO: 2390205 - DNA, 23 bp, Homo sapiens
caggaagggggtccacccagcaa

SEQ ID NO: 2390206 - DNA, 13 bp, Homo sapiens
caggacaggagac

SEQ ID NO: 2390207 - DNA, 18 bp, Homo sapiens
caggactatagcccaggt

SEQ ID NO: 2390208 - DNA, 16 bp, Homo sapiens
caggagggcaagggcc

SEQ ID NO: 2390209 - DNA, 19 bp, Homo sapiens
caggagggcaagggccatg

SEQ ID NO: 2390210 - DNA, 23 bp, Homo sapiens
caggatggcccttcccactggag

SEQ ID NO: 2390211 - DNA, 13 bp, Homo sapiens
caggattgaagag

SEQ ID NO: 2390212 - DNA, 20 bp, Homo sapiens
caggcaggggtgggagagcc

SEQ ID NO: 2390213 - DNA, 13 bp, Homo sapiens
caggccaccagga

SEQ ID NO: 2390214 - DNA, 22 bp, Homo sapiens
caggctctttggggtcagccag

SEQ ID NO: 2390215 - DNA, 22 bp, Homo sapiens
cagggagaccgagcgctttctg

SEQ ID NO: 2390216 - DNA, 19 bp, Homo sapiens
cagggatcttgcattccca

SEQ ID NO: 2390217 - DNA, 19 bp, Homo sapiens
caggggggttgtgaggcct

SEQ ID NO: 2390218 - DNA, 15 bp, Homo sapiens
caggggtgggagagc

SEQ ID NO: 2390219 - DNA, 22 bp, Homo sapiens
caggggtgggagagccagctct

SEQ ID NO: 2390220 - DNA, 15 bp, Homo sapiens
cagggtgggccactc

SEQ ID NO: 2390221 - DNA, 20 bp, Homo sapiens
caggtaatgagggactggaa

SEQ ID NO: 2390222 - DNA, 23 bp, Homo sapiens
caggtaatgagggactggaacca

SEQ ID NO: 2390223 - DNA, 18 bp, Homo sapiens
caggtatctccaggattg

SEQ ID NO: 2390224 - DNA, 17 bp, Homo sapiens
caggtctagactttctc

SEQ ID NO: 2390225 - DNA, 22 bp, Homo sapiens
cagtgagttacagcgagaggca

SEQ ID NO: 2390226 - DNA, 23 bp, Homo sapiens
cagtggtgaagaaaactccttta

SEQ ID NO: 2390227 - DNA, 16 bp, Homo sapiens
cagttgacagcaggtg

SEQ ID NO: 2390228 - DNA, 20 bp, Homo sapiens
cataagaccataacagccaa

SEQ ID NO: 2390229 - DNA, 18 bp, Homo sapiens
cataattcttgtatatta

SEQ ID NO: 2390230 - DNA, 17 bp, Homo sapiens
catacagaggtaactat

SEQ ID NO: 2390231 - DNA, 23 bp, Homo sapiens
catcagggtgggccactctcccc

SEQ ID NO: 2390232 - DNA, 13 bp, Homo sapiens
catcccctttcct

SEQ ID NO: 2390233 - DNA, 19 bp, Homo sapiens
catccctttgaaacaagat

SEQ ID NO: 2390234 - DNA, 15 bp, Homo sapiens
catctgagcaagagc

SEQ ID NO: 2390235 - DNA, 19 bp, Homo sapiens
catgaaagagaaagactga

SEQ ID NO: 2390236 - DNA, 13 bp, Homo sapiens
catgaagaccaca

SEQ ID NO: 2390237 - DNA, 17 bp, Homo sapiens
catgaagaccacatcca

SEQ ID NO: 2390238 - DNA, 20 bp, Homo sapiens
catgctcagccctgactggt

SEQ ID NO: 2390239 - DNA, 23 bp, Homo sapiens
catgggggtgctgcagccaggag

SEQ ID NO: 2390240 - DNA, 14 bp, Homo sapiens
catgtaaaagagtc

SEQ ID NO: 2390241 - DNA, 19 bp, Homo sapiens
catgtttacttttcagggc

SEQ ID NO: 2390242 - DNA, 16 bp, Homo sapiens
cattacgtgagccagg

SEQ ID NO: 2390243 - DNA, 18 bp, Homo sapiens
cattagaaattagctgtg

SEQ ID NO: 2390244 - DNA, 17 bp, Homo sapiens
cattcaggaagatgaaa

SEQ ID NO: 2390245 - DNA, 22 bp, Homo sapiens
ctacccagagccttctcctgcc

SEQ ID NO: 2390246 - DNA, 16 bp, Homo sapiens
ctacgttaagggaagg

SEQ ID NO: 2390247 - DNA, 19 bp, Homo sapiens
ctagagaagaggctggtgc

SEQ ID NO: 2390248 - DNA, 21 bp, Homo sapiens
ctagattaccccctcattgtt

SEQ ID NO: 2390249 - DNA, 19 bp, Homo sapiens
ctagccttgaggagtgtga

SEQ ID NO: 2390250 - DNA, 15 bp, Homo sapiens
ctaggcgagtgccag

SEQ ID NO: 2390251 - DNA, 17 bp, Homo sapiens
ctaggcgagtgccagga

SEQ ID NO: 2390252 - DNA, 18 bp, Homo sapiens
ctaggcgagtgccaggac

SEQ ID NO: 2390253 - DNA, 11 bp, Homo sapiens
ctagggctgga

SEQ ID NO: 2390254 - DNA, 15 bp, Homo sapiens
ctataggctggagaa

SEQ ID NO: 2390255 - DNA, 18 bp, Homo sapiens
ctataggctggagaagct

SEQ ID NO: 2390256 - DNA, 13 bp, Homo sapiens
ctatcaatattta

SEQ ID NO: 2390257 - DNA, 22 bp, Homo sapiens
ctatgtatggaatacagtgtta

SEQ ID NO: 2390258 - DNA, 21 bp, Homo sapiens
ctattacttgaactttccaaa

SEQ ID NO: 2390259 - DNA, 18 bp, Homo sapiens
ctattatagccacatccc

SEQ ID NO: 2390260 - DNA, 15 bp, Homo sapiens
ctattctcaccagga

SEQ ID NO: 2390261 - DNA, 14 bp, Homo sapiens
ctcaacctctctcc

SEQ ID NO: 2390262 - DNA, 15 bp, Homo sapiens
ctcaacctctctcct

SEQ ID NO: 2390263 - DNA, 15 bp, Homo sapiens
ctcaatgtgaccagg

SEQ ID NO: 2390264 - DNA, 16 bp, Homo sapiens
ctcaatgtgaccaggg

SEQ ID NO: 2390265 - DNA, 14 bp, Homo sapiens
ctcaccatgtaaaa

SEQ ID NO: 2390266 - DNA, 17 bp, Homo sapiens
ctcacgcccagcctcct

SEQ ID NO: 2390267 - DNA, 20 bp, Homo sapiens
ctcactattacttgaacttt

SEQ ID NO: 2390268 - DNA, 13 bp, Homo sapiens
ctcactgccccac

SEQ ID NO: 2390269 - DNA, 19 bp, Homo sapiens
ctcactgccccaccagcca

SEQ ID NO: 2390270 - DNA, 22 bp, Homo sapiens
ctcactgccccaccagccacct

SEQ ID NO: 2390271 - DNA, 21 bp, Homo sapiens
ctcagccccgggcctgcctct

SEQ ID NO: 2390272 - DNA, 13 bp, Homo sapiens
ctcagccctgact

SEQ ID NO: 2390273 - DNA, 12 bp, Homo sapiens
ctcattcccctc

SEQ ID NO: 2390274 - DNA, 12 bp, Homo sapiens
ctccaaggacca

SEQ ID NO: 2390275 - DNA, 16 bp, Homo sapiens
ctccagtatggaagaa

SEQ ID NO: 2390276 - DNA, 22 bp, Homo sapiens
ctccagtatggaagaatggggt

SEQ ID NO: 2390277 - DNA, 23 bp, Homo sapiens
ctcccacaatctgggactttcac

SEQ ID NO: 2390278 - DNA, 20 bp, Homo sapiens
ctcccaccatgcgctgctca

SEQ ID NO: 2390279 - DNA, 17 bp, Homo sapiens
ctccccaggccaggcca

SEQ ID NO: 2390280 - DNA, 14 bp, Homo sapiens
ctcccctattttaa

SEQ ID NO: 2390281 - DNA, 19 bp, Homo sapiens
ctcccctattttaagacgt

SEQ ID NO: 2390282 - DNA, 16 bp, Homo sapiens
ctcccctccctcttcc

SEQ ID NO: 2390283 - DNA, 17 bp, Homo sapiens
ctccctcttccttcccc

SEQ ID NO: 2390284 - DNA, 22 bp, Homo sapiens
ctccctggagtgcagtttccaa

SEQ ID NO: 2390285 - DNA, 17 bp, Homo sapiens
ctcctcactgccccacc

SEQ ID NO: 2390286 - DNA, 14 bp, Homo sapiens
ctcctcccacaatc

SEQ ID NO: 2390287 - DNA, 20 bp, Homo sapiens
ctcctcccacaatctgggac

SEQ ID NO: 2390288 - DNA, 23 bp, Homo sapiens
ctcctcccaccaccctcccacca

SEQ ID NO: 2390289 - DNA, 15 bp, Homo sapiens
ctcctctccctgcac

SEQ ID NO: 2390290 - DNA, 22 bp, Homo sapiens
ctcctgcctacattccctggcc

SEQ ID NO: 2390291 - DNA, 17 bp, Homo sapiens
ctcctgtagctctcctg

SEQ ID NO: 2390292 - DNA, 20 bp, Homo sapiens
ctcctttagcaggtggtcct

SEQ ID NO: 2390293 - DNA, 15 bp, Homo sapiens
ctcgggaggctgaga

SEQ ID NO: 2390294 - DNA, 14 bp, Homo sapiens
ctcgtaactggttt

SEQ ID NO: 2390295 - DNA, 13 bp, Homo sapiens
ctctaagccactc

SEQ ID NO: 2390296 - DNA, 21 bp, Homo sapiens
ctctacccggcccagagaccc

SEQ ID NO: 2390297 - DNA, 16 bp, Homo sapiens
ctctcccctccctctt

SEQ ID NO: 2390298 - DNA, 16 bp, Homo sapiens
ctctcgtaactggttt

SEQ ID NO: 2390299 - DNA, 18 bp, Homo sapiens
ctctctacccggcccaga

SEQ ID NO: 2390300 - DNA, 20 bp, Homo sapiens
ctctctacccggcccagaga

SEQ ID NO: 2390301 - DNA, 22 bp, Homo sapiens
ctctctctacccggcccagaga

SEQ ID NO: 2390302 - DNA, 18 bp, Homo sapiens
ctctgagaattccaagga

SEQ ID NO: 2390303 - DNA, 19 bp, Homo sapiens
ctctgccctccctggcctc

SEQ ID NO: 2390304 - DNA, 18 bp, Homo sapiens
ctctggcttccaggtatc

SEQ ID NO: 2390305 - DNA, 19 bp, Homo sapiens
ctctgggaaataagagaga

SEQ ID NO: 2390306 - DNA, 14 bp, Homo sapiens
ctcttcctgcaagg

SEQ ID NO: 2390307 - DNA, 20 bp, Homo sapiens
ctcttccttcccccatcccc

SEQ ID NO: 2390308 - DNA, 17 bp, Homo sapiens
ctctttggggtcagcca

SEQ ID NO: 2390309 - DNA, 19 bp, Homo sapiens
ctctttggggtcagccagg

SEQ ID NO: 2390310 - DNA, 19 bp, Homo sapiens
ctgaaaagactcagtgttc

SEQ ID NO: 2390311 - DNA, 15 bp, Homo sapiens
ctgaacatctgtgtg

SEQ ID NO: 2390312 - DNA, 23 bp, Homo sapiens
ctgaatgcctcaatgtgaccagg

SEQ ID NO: 2390313 - DNA, 22 bp, Homo sapiens
ctgaatggaaggtttgtatatt

SEQ ID NO: 2390314 - DNA, 18 bp, Homo sapiens
ctgaatggtccagggttg

SEQ ID NO: 2390315 - DNA, 23 bp, Homo sapiens
ctgaccccaaagagcctggagaa

SEQ ID NO: 2390316 - DNA, 12 bp, Homo sapiens
ctgagcaagagc

SEQ ID NO: 2390317 - DNA, 14 bp, Homo sapiens
ctgagcaagagctg

SEQ ID NO: 2390318 - DNA, 18 bp, Homo sapiens
ctgagcaccccctcattc

SEQ ID NO: 2390319 - DNA, 17 bp, Homo sapiens
ctgagcacctgcttcat

SEQ ID NO: 2390320 - DNA, 22 bp, Homo sapiens
ctgagcttcagtataaaagaca

SEQ ID NO: 2390321 - DNA, 23 bp, Homo sapiens
ctgaggggggccgtgcccagggg

SEQ ID NO: 2390322 - DNA, 16 bp, Homo sapiens
ctgagtccgggaggca

SEQ ID NO: 2390323 - DNA, 15 bp, Homo sapiens
ctgatgacagagcga

SEQ ID NO: 2390324 - DNA, 17 bp, Homo sapiens
ctgatgctttgcttcaa

SEQ ID NO: 2390325 - DNA, 15 bp, Homo sapiens
ctgcaattgcttagg

SEQ ID NO: 2390326 - DNA, 11 bp, Homo sapiens
ctgcacccagg

SEQ ID NO: 2390327 - DNA, 12 bp, Homo sapiens
ctgcacccaggg

SEQ ID NO: 2390328 - DNA, 13 bp, Homo sapiens
ctgcacccagggg

SEQ ID NO: 2390329 - DNA, 20 bp, Homo sapiens
ctgcactccggcctgatgac

SEQ ID NO: 2390330 - DNA, 12 bp, Homo sapiens
ctgcagcacttt

SEQ ID NO: 2390331 - DNA, 15 bp, Homo sapiens
ctgcattagaaatta

SEQ ID NO: 2390332 - DNA, 19 bp, Homo sapiens
ctgcattttattctggatg

SEQ ID NO: 2390333 - DNA, 17 bp, Homo sapiens
ctgccaccatcctgctg

SEQ ID NO: 2390334 - DNA, 19 bp, Homo sapiens
ctgccaccatcctgctgct

SEQ ID NO: 2390335 - DNA, 19 bp, Homo sapiens
ctgccccaccagccacctc

SEQ ID NO: 2390336 - DNA, 20 bp, Homo sapiens
ctgccccaccagccacctct

SEQ ID NO: 2390337 - DNA, 16 bp, Homo sapiens
ctgccctccctggcct

SEQ ID NO: 2390338 - DNA, 17 bp, Homo sapiens
ctgccctccctggcctc

SEQ ID NO: 2390339 - DNA, 16 bp, Homo sapiens
ctgcctacattccctg

SEQ ID NO: 2390340 - DNA, 22 bp, Homo sapiens
ctgcctacattccctggcctgg

SEQ ID NO: 2390341 - DNA, 18 bp, Homo sapiens
ctgcggagaccctgagtc

SEQ ID NO: 2390342 - DNA, 15 bp, Homo sapiens
ctgctaggcgagtgc

SEQ ID NO: 2390343 - DNA, 14 bp, Homo sapiens
ctgctcaacctctc

SEQ ID NO: 2390344 - DNA, 22 bp, Homo sapiens
ctgctcaacctctctccttctg

SEQ ID NO: 2390345 - DNA, 22 bp, Homo sapiens
ctgctgggaccccagctagggc

SEQ ID NO: 2390346 - DNA, 21 bp, Homo sapiens
ctgcttcatgctcagccctga

SEQ ID NO: 2390347 - DNA, 17 bp, Homo sapiens
ctggaaaactcaggatt

SEQ ID NO: 2390348 - DNA, 13 bp, Homo sapiens
ctggaagagagga

SEQ ID NO: 2390349 - DNA, 14 bp, Homo sapiens
ctggacaacccaga

SEQ ID NO: 2390350 - DNA, 17 bp, Homo sapiens
ctggacgcccagctgag

SEQ ID NO: 2390351 - DNA, 19 bp, Homo sapiens
ctggacgcccagctgaggc

SEQ ID NO: 2390352 - DNA, 18 bp, Homo sapiens
ctggagaagctcacccaa

SEQ ID NO: 2390353 - DNA, 19 bp, Homo sapiens
ctggagaagctcacccaat

SEQ ID NO: 2390354 - DNA, 12 bp, Homo sapiens
ctggagagaagt

SEQ ID NO: 2390355 - DNA, 20 bp, Homo sapiens
gcctacattccctggcctgg

SEQ ID NO: 2390356 - DNA, 17 bp, Homo sapiens
gcctcacgcccagcctc

SEQ ID NO: 2390357 - DNA, 23 bp, Homo sapiens
gcctcacgcccagcctcctccca

SEQ ID NO: 2390358 - DNA, 19 bp, Homo sapiens
gcctcactattacttgaac

SEQ ID NO: 2390359 - DNA, 14 bp, Homo sapiens
gcctcgcatgccag

SEQ ID NO: 2390360 - DNA, 20 bp, Homo sapiens
gcctcgcatgccagagcctg

SEQ ID NO: 2390361 - DNA, 14 bp, Homo sapiens
gcctctgtccctct

SEQ ID NO: 2390362 - DNA, 22 bp, Homo sapiens
gcctctgtccctctttgcctgt

SEQ ID NO: 2390363 - DNA, 17 bp, Homo sapiens
gcctgatgacagagcga

SEQ ID NO: 2390364 - DNA, 16 bp, Homo sapiens
gcctgcagagagaagc

SEQ ID NO: 2390365 - DNA, 13 bp, Homo sapiens
gcctgcccagcct

SEQ ID NO: 2390366 - DNA, 22 bp, Homo sapiens
gcctgcccagcctcgcatgcca

SEQ ID NO: 2390367 - DNA, 14 bp, Homo sapiens
gcctgccctcaggg

SEQ ID NO: 2390368 - DNA, 16 bp, Homo sapiens
gcctgcctctgactca

SEQ ID NO: 2390369 - DNA, 12 bp, Homo sapiens
gcctggagaagc

SEQ ID NO: 2390370 - DNA, 13 bp, Homo sapiens
gcctggagaagct

SEQ ID NO: 2390371 - DNA, 13 bp, Homo sapiens
gcctggccaggca

SEQ ID NO: 2390372 - DNA, 15 bp, Homo sapiens
gcctggccaggcacc

SEQ ID NO: 2390373 - DNA, 15 bp, Homo sapiens
gcctggctctcctgt

SEQ ID NO: 2390374 - DNA, 13 bp, Homo sapiens
gcctgtgtgagca

SEQ ID NO: 2390375 - DNA, 16 bp, Homo sapiens
gcctgtgtgagcatct

SEQ ID NO: 2390376 - DNA, 18 bp, Homo sapiens
gcctgtgtgagcatctct

SEQ ID NO: 2390377 - DNA, 22 bp, Homo sapiens
gcctgtgtgagcatctctgtgt

SEQ ID NO: 2390378 - DNA, 20 bp, Homo sapiens
gcctttggatgaccagaaca

SEQ ID NO: 2390379 - DNA, 21 bp, Homo sapiens
gcgagtgccaggactccccag

SEQ ID NO: 2390380 - DNA, 15 bp, Homo sapiens
gcgcatggtgcagtg

SEQ ID NO: 2390381 - DNA, 22 bp, Homo sapiens
gcgctctgccctccctggcctc

SEQ ID NO: 2390382 - DNA, 13 bp, Homo sapiens
gcgctgctcaacc

SEQ ID NO: 2390383 - DNA, 21 bp, Homo sapiens
gcgctgctcaacctctctcct

SEQ ID NO: 2390384 - DNA, 15 bp, Homo sapiens
gcggagagtacagtg

SEQ ID NO: 2390385 - DNA, 19 bp, Homo sapiens
gcgggagtgggggctgtgc

SEQ ID NO: 2390386 - DNA, 15 bp, Homo sapiens
gcgggcagcccagcc

SEQ ID NO: 2390387 - DNA, 21 bp, Homo sapiens
gcgggcagcccagcctctgtc

SEQ ID NO: 2390388 - DNA, 17 bp, Homo sapiens
gcgggggagccaacagc

SEQ ID NO: 2390389 - DNA, 20 bp, Homo sapiens
gcgggggagccaacagcagc

SEQ ID NO: 2390390 - DNA, 20 bp, Homo sapiens
gcgtcgctggacaacccaga

SEQ ID NO: 2390391 - DNA, 21 bp, Homo sapiens
gctaggcgagtgccaggactc

SEQ ID NO: 2390392 - DNA, 12 bp, Homo sapiens
gctagggctgga

SEQ ID NO: 2390393 - DNA, 13 bp, Homo sapiens
gctagggctggac

SEQ ID NO: 2390394 - DNA, 13 bp, Homo sapiens
gctatcacacagt

SEQ ID NO: 2390395 - DNA, 22 bp, Homo sapiens
gctatgtatggaatacagtgtt

SEQ ID NO: 2390396 - DNA, 14 bp, Homo sapiens
gctcaacctctctc

SEQ ID NO: 2390397 - DNA, 15 bp, Homo sapiens
gctcaacctctctcc

SEQ ID NO: 2390398 - DNA, 18 bp, Homo sapiens
gctcagcccttcctagaa

SEQ ID NO: 2390399 - DNA, 13 bp, Homo sapiens
gctcaggtgcaag

SEQ ID NO: 2390400 - DNA, 12 bp, Homo sapiens
gctctgccctcc

SEQ ID NO: 2390401 - DNA, 18 bp, Homo sapiens
gctctgccctccctggcc

SEQ ID NO: 2390402 - DNA, 20 bp, Homo sapiens
gctctgccctccctggcctc

SEQ ID NO: 2390403 - DNA, 22 bp, Homo sapiens
gctctgccctccctggcctcac

SEQ ID NO: 2390404 - DNA, 22 bp, Homo sapiens
gctctggaaaatgtgacccaga

SEQ ID NO: 2390405 - DNA, 18 bp, Homo sapiens
gctgaccccaaagagcct

SEQ ID NO: 2390406 - DNA, 22 bp, Homo sapiens
gctgcatctgggattcccacca

SEQ ID NO: 2390407 - DNA, 12 bp, Homo sapiens
gctgctctggaa

SEQ ID NO: 2390408 - DNA, 14 bp, Homo sapiens
gctgctctggaaaa

SEQ ID NO: 2390409 - DNA, 20 bp, Homo sapiens
gctggcaaaggtggctctcc

SEQ ID NO: 2390410 - DNA, 14 bp, Homo sapiens
gctgtaaaatcttg

SEQ ID NO: 2390411 - DNA, 17 bp, Homo sapiens
gctgtggccagggtgag

SEQ ID NO: 2390412 - DNA, 19 bp, Homo sapiens
gctgtggccagggtgagag

SEQ ID NO: 2390413 - DNA, 22 bp, Homo sapiens
gcttccaggtatctccaggatt

SEQ ID NO: 2390414 - DNA, 22 bp, Homo sapiens
gctttctggaaaagaggagttt

SEQ ID NO: 2390415 - DNA, 20 bp, Homo sapiens
gctttgcattcctacaaaga

SEQ ID NO: 2390416 - DNA, 14 bp, Homo sapiens
ggaaaagtgcaatg

SEQ ID NO: 2390417 - DNA, 16 bp, Homo sapiens
ggaaaggatattttct

SEQ ID NO: 2390418 - DNA, 21 bp, Homo sapiens
ggaactagagggatacactga

SEQ ID NO: 2390419 - DNA, 18 bp, Homo sapiens
ggaagggaaagccagaag

SEQ ID NO: 2390420 - DNA, 12 bp, Homo sapiens
ggacaacccaga

SEQ ID NO: 2390421 - DNA, 13 bp, Homo sapiens
ggacaacccagaa

SEQ ID NO: 2390422 - DNA, 19 bp, Homo sapiens
ggacaccccttatccagga

SEQ ID NO: 2390423 - DNA, 21 bp, Homo sapiens
ggacaccccttatccaggact

SEQ ID NO: 2390424 - DNA, 19 bp, Homo sapiens
ggactccccaggccaggcc

SEQ ID NO: 2390425 - DNA, 15 bp, Homo sapiens
ggactggaaccaggg

SEQ ID NO: 2390426 - DNA, 12 bp, Homo sapiens
ggagaaggatct

SEQ ID NO: 2390427 - DNA, 14 bp, Homo sapiens
ggagaaggatctag

SEQ ID NO: 2390428 - DNA, 16 bp, Homo sapiens
ggagaccctgagtccg

SEQ ID NO: 2390429 - DNA, 17 bp, Homo sapiens
ggagagccagctctctc

SEQ ID NO: 2390430 - DNA, 17 bp, Homo sapiens
ggagagtacagtgagcc

SEQ ID NO: 2390431 - DNA, 15 bp, Homo sapiens
ggaggctgagacagg

SEQ ID NO: 2390432 - DNA, 21 bp, Homo sapiens
ggagggcaagggccatgctga

SEQ ID NO: 2390433 - DNA, 13 bp, Homo sapiens
ggaggtgagggat

SEQ ID NO: 2390434 - DNA, 21 bp, Homo sapiens
ggagtgggggctgtgccgtga

SEQ ID NO: 2390435 - DNA, 13 bp, Homo sapiens
ggatctccaagga

SEQ ID NO: 2390436 - DNA, 14 bp, Homo sapiens
ggatctccaaggac

SEQ ID NO: 2390437 - DNA, 16 bp, Homo sapiens
ggatctgtccaaggaa

SEQ ID NO: 2390438 - DNA, 16 bp, Homo sapiens
ggatcttgcattccca

SEQ ID NO: 2390439 - DNA, 22 bp, Homo sapiens
ggatcttgcattcccagtggtc

SEQ ID NO: 2390440 - DNA, 22 bp, Homo sapiens
ggatgtgaattgcctgcagaga

SEQ ID NO: 2390441 - DNA, 18 bp, Homo sapiens
ggatgtttttcatgaaaa

SEQ ID NO: 2390442 - DNA, 13 bp, Homo sapiens
ggatttgaagcaa

SEQ ID NO: 2390443 - DNA, 20 bp, Homo sapiens
ggcacaatggctaattccca

SEQ ID NO: 2390444 - DNA, 18 bp, Homo sapiens
ggcaccccctggagagaa

SEQ ID NO: 2390445 - DNA, 14 bp, Homo sapiens
ggcacgcctgccca

SEQ ID NO: 2390446 - DNA, 15 bp, Homo sapiens
ggcagaagggagaag

SEQ ID NO: 2390447 - DNA, 14 bp, Homo sapiens
ggcatgctcagccc

SEQ ID NO: 2390448 - DNA, 11 bp, Homo sapiens
ggccaccagga

SEQ ID NO: 2390449 - DNA, 20 bp, Homo sapiens
ggccactctcccctccctct

SEQ ID NO: 2390450 - DNA, 16 bp, Homo sapiens
ggccatgctgaaggga

SEQ ID NO: 2390451 - DNA, 20 bp, Homo sapiens
ggcccacagggaaccctgct

SEQ ID NO: 2390452 - DNA, 17 bp, Homo sapiens
ggcccagagaccccttc

SEQ ID NO: 2390453 - DNA, 22 bp, Homo sapiens
ggcccagagaccccttcctttc

SEQ ID NO: 2390454 - DNA, 23 bp, Homo sapiens
ggcccagagaccccttcctttcc

SEQ ID NO: 2390455 - DNA, 13 bp, Homo sapiens
ggccgtgcccagg

SEQ ID NO: 2390456 - DNA, 18 bp, Homo sapiens
ggcctcacgcccagcctc

SEQ ID NO: 2390457 - DNA, 16 bp, Homo sapiens
ggcctgccctcaggga

SEQ ID NO: 2390458 - DNA, 14 bp, Homo sapiens
ggcctggccaggca

SEQ ID NO: 2390459 - DNA, 20 bp, Homo sapiens
ggcggagagtacagtgagcc

SEQ ID NO: 2390460 - DNA, 22 bp, Homo sapiens
ggcgtcgctggacaacccagaa

SEQ ID NO: 2390461 - DNA, 23 bp, Homo sapiens
ggctaattcccagagtgtgaaac

SEQ ID NO: 2390462 - DNA, 22 bp, Homo sapiens
ggctctttggggtcagccaggg

SEQ ID NO: 2390463 - DNA, 14 bp, Homo sapiens
gggaaataagagag

SEQ ID NO: 2390464 - DNA, 18 bp, Homo sapiens
gggaagctgggggaaggg

SEQ ID NO: 2390465 - DNA, 14 bp, Homo sapiens
gtttttactccagt

SEQ ID NO: 2390466 - DNA, 13 bp, Homo sapiens
taaaaaaatgaca

SEQ ID NO: 2390467 - DNA, 17 bp, Homo sapiens
taaaagcataaatgcaa

SEQ ID NO: 2390468 - DNA, 12 bp, Homo sapiens
taaaagttactt

SEQ ID NO: 2390469 - DNA, 16 bp, Homo sapiens
taaactgcattagaaa

SEQ ID NO: 2390470 - DNA, 17 bp, Homo sapiens
taaagtatatatttatt

SEQ ID NO: 2390471 - DNA, 17 bp, Homo sapiens
taaattcacaatagaaa

SEQ ID NO: 2390472 - DNA, 14 bp, Homo sapiens
taaccctctcttcc

SEQ ID NO: 2390473 - DNA, 16 bp, Homo sapiens
taactatcaatattta

SEQ ID NO: 2390474 - DNA, 18 bp, Homo sapiens
taactatcaatatttaag

SEQ ID NO: 2390475 - DNA, 19 bp, Homo sapiens
taagacgtgaatgtctcag

SEQ ID NO: 2390476 - DNA, 21 bp, Homo sapiens
taagcagatttaacaattcca

SEQ ID NO: 2390477 - DNA, 19 bp, Homo sapiens
taaggatcagaacagcaga

SEQ ID NO: 2390478 - DNA, 22 bp, Homo sapiens
taatgaagggaaaggatatttt

SEQ ID NO: 2390479 - DNA, 15 bp, Homo sapiens
taattcttgtatatt

SEQ ID NO: 2390480 - DNA, 23 bp, Homo sapiens
tacacaggatcctattctcacca

SEQ ID NO: 2390481 - DNA, 11 bp, Homo sapiens
tacacagttgc

SEQ ID NO: 2390482 - DNA, 20 bp, Homo sapiens
tacagcgagaggcagagaaa

SEQ ID NO: 2390483 - DNA, 12 bp, Homo sapiens
tacagtgagcca

SEQ ID NO: 2390484 - DNA, 19 bp, Homo sapiens
tacccactcctcactgccc

SEQ ID NO: 2390485 - DNA, 22 bp, Homo sapiens
tacccggcccagagaccccttc

SEQ ID NO: 2390486 - DNA, 14 bp, Homo sapiens
tacgtgagccaggt

SEQ ID NO: 2390487 - DNA, 21 bp, Homo sapiens
tactacagttgttttttgaaa

SEQ ID NO: 2390488 - DNA, 18 bp, Homo sapiens
tagaatgtgttttctgaa

SEQ ID NO: 2390489 - DNA, 21 bp, Homo sapiens
tagactttctcagtgggacaa

SEQ ID NO: 2390490 - DNA, 17 bp, Homo sapiens
tagaggaaaaaaatgac

SEQ ID NO: 2390491 - DNA, 22 bp, Homo sapiens
tagaggaaaaaaatgactaaaa

SEQ ID NO: 2390492 - DNA, 16 bp, Homo sapiens
tagatgggtctggctg

SEQ ID NO: 2390493 - DNA, 20 bp, Homo sapiens
tagatgggtctggctgagct

SEQ ID NO: 2390494 - DNA, 15 bp, Homo sapiens
tagcaggtggtcctg

SEQ ID NO: 2390495 - DNA, 18 bp, Homo sapiens
taggatgtttttcatgaa

SEQ ID NO: 2390496 - DNA, 13 bp, Homo sapiens
taggcagagcctt

SEQ ID NO: 2390497 - DNA, 18 bp, Homo sapiens
taggcgagtgccaggact

SEQ ID NO: 2390498 - DNA, 14 bp, Homo sapiens
taggctggagaagc

SEQ ID NO: 2390499 - DNA, 15 bp, Homo sapiens
taggctggagaagct

SEQ ID NO: 2390500 - DNA, 22 bp, Homo sapiens
tataattttatgaatgtctttg

SEQ ID NO: 2390501 - DNA, 13 bp, Homo sapiens
tatagcccaggtc

SEQ ID NO: 2390502 - DNA, 12 bp, Homo sapiens
tatatattgtat

SEQ ID NO: 2390503 - DNA, 15 bp, Homo sapiens
tatcatggagtgacg

SEQ ID NO: 2390504 - DNA, 24 bp, Homo sapiens
tatggaatacagtgttattttctt

SEQ ID NO: 2390505 - DNA, 18 bp, Homo sapiens
tatgtaaacataattctt

SEQ ID NO: 2390506 - DNA, 16 bp, Homo sapiens
tattaacaaattatgt

SEQ ID NO: 2390507 - DNA, 16 bp, Homo sapiens
tattacatggcagtgt

SEQ ID NO: 2390508 - DNA, 14 bp, Homo sapiens
tattctcaccagga

SEQ ID NO: 2390509 - DNA, 15 bp, Homo sapiens
tattctcaccaggaa

SEQ ID NO: 2390510 - DNA, 16 bp, Homo sapiens
tattgtattaagggca

SEQ ID NO: 2390511 - DNA, 17 bp, Homo sapiens
tatttataagcagattt

SEQ ID NO: 2390512 - DNA, 16 bp, Homo sapiens
tatttatttaagctta

SEQ ID NO: 2390513 - DNA, 13 bp, Homo sapiens
tcaaaccaggatt

SEQ ID NO: 2390514 - DNA, 14 bp, Homo sapiens
tcaaaccaggattt

SEQ ID NO: 2390515 - DNA, 18 bp, Homo sapiens
tcaagattttttttgtaa

SEQ ID NO: 2390516 - DNA, 18 bp, Homo sapiens
tcaatttccctgactcct

SEQ ID NO: 2390517 - DNA, 21 bp, Homo sapiens
tcacaaaacctggcacaatgg

SEQ ID NO: 2390518 - DNA, 14 bp, Homo sapiens
tcacagtgtttcga

SEQ ID NO: 2390519 - DNA, 18 bp, Homo sapiens
tcacagtgtttgcaatgg

SEQ ID NO: 2390520 - DNA, 13 bp, Homo sapiens
tcacgcccagcct

SEQ ID NO: 2390521 - DNA, 15 bp, Homo sapiens
tcacgcccagcctcc

SEQ ID NO: 2390522 - DNA, 17 bp, Homo sapiens
tcacgcccagcctcctc

SEQ ID NO: 2390523 - DNA, 18 bp, Homo sapiens
tcactgccccaccagcca

SEQ ID NO: 2390524 - DNA, 19 bp, Homo sapiens
tcactgccccaccagccac

SEQ ID NO: 2390525 - DNA, 22 bp, Homo sapiens
tcactgccccaccagccacctc

SEQ ID NO: 2390526 - DNA, 23 bp, Homo sapiens
tcactgccccaccagccacctct

SEQ ID NO: 2390527 - DNA, 13 bp, Homo sapiens
tcagccagggcca

SEQ ID NO: 2390528 - DNA, 14 bp, Homo sapiens
tcagccagggccag

SEQ ID NO: 2390529 - DNA, 18 bp, Homo sapiens
tcagccccgggcctgcct

SEQ ID NO: 2390530 - DNA, 19 bp, Homo sapiens
tcagccccgggcctgcctc

SEQ ID NO: 2390531 - DNA, 22 bp, Homo sapiens
tcagctccagaataccttcttc

SEQ ID NO: 2390532 - DNA, 13 bp, Homo sapiens
tcagggtgggcca

SEQ ID NO: 2390533 - DNA, 20 bp, Homo sapiens
tcagtgttccctttcctact

SEQ ID NO: 2390534 - DNA, 23 bp, Homo sapiens
tcatggagtgacggtcccacact

SEQ ID NO: 2390535 - DNA, 12 bp, Homo sapiens
tcattcccctcg

SEQ ID NO: 2390536 - DNA, 19 bp, Homo sapiens
tcatttctactgtgactga

SEQ ID NO: 2390537 - DNA, 17 bp, Homo sapiens
tccaacaataaagagct

SEQ ID NO: 2390538 - DNA, 14 bp, Homo sapiens
tccacacacgcagg

SEQ ID NO: 2390539 - DNA, 13 bp, Homo sapiens
tccagtttcccac

SEQ ID NO: 2390540 - DNA, 20 bp, Homo sapiens
tccattaacttagcatgtgt

SEQ ID NO: 2390541 - DNA, 22 bp, Homo sapiens
tccattaacttagcatgtgttg

SEQ ID NO: 2390542 - DNA, 21 bp, Homo sapiens
tcccaccaccctcccaccatg

SEQ ID NO: 2390543 - DNA, 21 bp, Homo sapiens
tcccaccaccttggactcctc

SEQ ID NO: 2390544 - DNA, 18 bp, Homo sapiens
tcccatgggggtgctgca

SEQ ID NO: 2390545 - DNA, 21 bp, Homo sapiens
tcccatgggggtgctgcagcc

SEQ ID NO: 2390546 - DNA, 23 bp, Homo sapiens
tcccatgggggtgctgcagccag

SEQ ID NO: 2390547 - DNA, 13 bp, Homo sapiens
tcccatgtgcatg

SEQ ID NO: 2390548 - DNA, 16 bp, Homo sapiens
tccccaccttccccag

SEQ ID NO: 2390549 - DNA, 20 bp, Homo sapiens
tccccaccttccccagactc

SEQ ID NO: 2390550 - DNA, 19 bp, Homo sapiens
tccccaggccaggccacca

SEQ ID NO: 2390551 - DNA, 21 bp, Homo sapiens
tccccctatgctccagtatgg

SEQ ID NO: 2390552 - DNA, 13 bp, Homo sapiens
tccccctgcttct

SEQ ID NO: 2390553 - DNA, 20 bp, Homo sapiens
tccccctgcttctcagcccc

SEQ ID NO: 2390554 - DNA, 14 bp, Homo sapiens
tcccctccctcttc

SEQ ID NO: 2390555 - DNA, 19 bp, Homo sapiens
tccctgaacatctgtgtgt

SEQ ID NO: 2390556 - DNA, 23 bp, Homo sapiens
  misc_feature (14)..(14): n is a, c, g or t
tccctgcacctgcnttgtccctg

SEQ ID NO: 2390557 - DNA, 21 bp, Homo sapiens
tccggcctgatgacagagcga

SEQ ID NO: 2390558 - DNA, 16 bp, Homo sapiens
tcctatacatttctgt

SEQ ID NO: 2390559 - DNA, 17 bp, Homo sapiens
tcctattctcaccagga

SEQ ID NO: 2390560 - DNA, 19 bp, Homo sapiens
tcctccaacaataaagagc

SEQ ID NO: 2390561 - DNA, 13 bp, Homo sapiens
tcctcccacaatc

SEQ ID NO: 2390562 - DNA, 20 bp, Homo sapiens
tcctcccaccaccctcccac

SEQ ID NO: 2390563 - DNA, 20 bp, Homo sapiens
tcctccccaccttccccaga

SEQ ID NO: 2390564 - DNA, 22 bp, Homo sapiens
tcctccccaccttccccagact

SEQ ID NO: 2390565 - DNA, 20 bp, Homo sapiens
tcctctaagccactcttcca

SEQ ID NO: 2390566 - DNA, 21 bp, Homo sapiens
tcctctaagccactcttccaa

SEQ ID NO: 2390567 - DNA, 14 bp, Homo sapiens
tcctctgcagcact

SEQ ID NO: 2390568 - DNA, 21 bp, Homo sapiens
tcctgcctacattccctggcc

SEQ ID NO: 2390569 - DNA, 23 bp, Homo sapiens
tcctgcctacattccctggcctg

SEQ ID NO: 2390570 - DNA, 15 bp, Homo sapiens
tcctgctgctgtgtt

SEQ ID NO: 2390571 - DNA, 9 bp, Homo sapiens
tccttcccc

SEQ ID NO: 2390572 - DNA, 23 bp, Homo sapiens
tccttcccccatcccctttcctc

SEQ ID NO: 2390573 - DNA, 13 bp, Homo sapiens
tccttttgcttga

SEQ ID NO: 2390574 - DNA, 14 bp, Homo sapiens
tcgctggacaaccc

SEQ ID NO: 2390575 - DNA, 17 bp, Homo sapiens
aaaacgcaaagggctga

SEQ ID NO: 2390576 - DNA, 13 bp, Homo sapiens
aaaagatttgttt

SEQ ID NO: 2390577 - DNA, 13 bp, Homo sapiens
aaaagcataaatg

SEQ ID NO: 2390578 - DNA, 15 bp, Homo sapiens
aaaagcataaatgca

SEQ ID NO: 2390579 - DNA, 13 bp, Homo sapiens
aaaagtgcaatgc

SEQ ID NO: 2390580 - DNA, 16 bp, Homo sapiens
aaaatattataactta

SEQ ID NO: 2390581 - DNA, 13 bp, Homo sapiens
aaaatattttata

SEQ ID NO: 2390582 - DNA, 17 bp, Homo sapiens
aaaatattttataattt

SEQ ID NO: 2390583 - DNA, 18 bp, Homo sapiens
aaaatattttataatttt

SEQ ID NO: 2390584 - DNA, 19 bp, Homo sapiens
aaaatgtgacccagatcct

SEQ ID NO: 2390585 - DNA, 16 bp, Homo sapiens
aaacagagatgtgata

SEQ ID NO: 2390586 - DNA, 13 bp, Homo sapiens
aaacataattctt

SEQ ID NO: 2390587 - DNA, 16 bp, Homo sapiens
aaactcaccatgtaaa

SEQ ID NO: 2390588 - DNA, 18 bp, Homo sapiens
aaactcaccatgtaaaag

SEQ ID NO: 2390589 - DNA, 13 bp, Homo sapiens
aaactgatttctc

SEQ ID NO: 2390590 - DNA, 17 bp, Homo sapiens
aaactgcattagaaatt

SEQ ID NO: 2390591 - DNA, 12 bp, Homo sapiens
aaagaagagaca

SEQ ID NO: 2390592 - DNA, 15 bp, Homo sapiens
aaagactcagtgttc

SEQ ID NO: 2390593 - DNA, 22 bp, Homo sapiens
aaagagtgggctgcatctggga

SEQ ID NO: 2390594 - DNA, 17 bp, Homo sapiens
aaagatatatacacagg

SEQ ID NO: 2390595 - DNA, 23 bp, Homo sapiens
aaagcagttaactttaagactga

SEQ ID NO: 2390596 - DNA, 12 bp, Homo sapiens
aaaggatatttt

SEQ ID NO: 2390597 - DNA, 21 bp, Homo sapiens
aaaggcataagaccctaagcc

SEQ ID NO: 2390598 - DNA, 14 bp, Homo sapiens
aaagggaaactatt

SEQ ID NO: 2390599 - DNA, 18 bp, Homo sapiens
aaaggggcagaaaaactc

SEQ ID NO: 2390600 - DNA, 14 bp, Homo sapiens
aaagtatatattta

SEQ ID NO: 2390601 - DNA, 22 bp, Homo sapiens
aaagtgtgagcagtgagttaca

SEQ ID NO: 2390602 - DNA, 12 bp, Homo sapiens
aaataagagaga

SEQ ID NO: 2390603 - DNA, 17 bp, Homo sapiens
aaatccagtttcccacc

SEQ ID NO: 2390604 - DNA, 17 bp, Homo sapiens
aaatgactaaaaatatt

SEQ ID NO: 2390605 - DNA, 17 bp, Homo sapiens
aaattagctgtgtgaaa

SEQ ID NO: 2390606 - DNA, 22 bp, Homo sapiens
aaattataacttaaaatatttt

SEQ ID NO: 2390607 - DNA, 20 bp, Homo sapiens
aaattctcagtcagtaattg

SEQ ID NO: 2390608 - DNA, 20 bp, Homo sapiens
aacaaattatgttacatctg

SEQ ID NO: 2390609 - DNA, 14 bp, Homo sapiens
aacaataaagagct

SEQ ID NO: 2390610 - DNA, 15 bp, Homo sapiens
aacactataaaggtt

SEQ ID NO: 2390611 - DNA, 19 bp, Homo sapiens
aacactggcaacaacaaag

SEQ ID NO: 2390612 - DNA, 13 bp, Homo sapiens
aacagagatgtga

SEQ ID NO: 2390613 - DNA, 21 bp, Homo sapiens
aacagcagaggttcttttaaa

SEQ ID NO: 2390614 - DNA, 9 bp, Homo sapiens
aacagcagc

SEQ ID NO: 2390615 - DNA, 16 bp, Homo sapiens
aacaggtggcaggacc

SEQ ID NO: 2390616 - DNA, 23 bp, Homo sapiens
aacaggtggcaggaccaggacta

SEQ ID NO: 2390617 - DNA, 11 bp, Homo sapiens
aacatctgtgt

SEQ ID NO: 2390618 - DNA, 23 bp, Homo sapiens
aaccctctcttccctattatttc

SEQ ID NO: 2390619 - DNA, 22 bp, Homo sapiens
aacctgggaggcggagagtaca

SEQ ID NO: 2390620 - DNA, 18 bp, Homo sapiens
aacgcaaagggctgaaag

SEQ ID NO: 2390621 - DNA, 22 bp, Homo sapiens
aactatcaatatttaagtttgt

SEQ ID NO: 2390622 - DNA, 17 bp, Homo sapiens
aactctggcttccaggt

SEQ ID NO: 2390623 - DNA, 18 bp, Homo sapiens
aactctggcttccaggta

SEQ ID NO: 2390624 - DNA, 20 bp, Homo sapiens
aactgaaaagactcagtgtt

SEQ ID NO: 2390625 - DNA, 14 bp, Homo sapiens
aactgcattagaaa

SEQ ID NO: 2390626 - DNA, 17 bp, Homo sapiens
aactggacgcccagctg

SEQ ID NO: 2390627 - DNA, 13 bp, Homo sapiens
aacttaaaatatt

SEQ ID NO: 2390628 - DNA, 16 bp, Homo sapiens
aacttaaaatatttta

SEQ ID NO: 2390629 - DNA, 16 bp, Homo sapiens
aacttcaaatatagag

SEQ ID NO: 2390630 - DNA, 19 bp, Homo sapiens
aagaaaatacataagacca

SEQ ID NO: 2390631 - DNA, 18 bp, Homo sapiens
aagacgtgaatgtctcag

SEQ ID NO: 2390632 - DNA, 15 bp, Homo sapiens
aagactgagcacctg

SEQ ID NO: 2390633 - DNA, 16 bp, Homo sapiens
aagagcctggagaagc

SEQ ID NO: 2390634 - DNA, 19 bp, Homo sapiens
aagaggaaaagtgcaatgc

SEQ ID NO: 2390635 - DNA, 17 bp, Homo sapiens
aagaggctggtgctgtg

SEQ ID NO: 2390636 - DNA, 13 bp, Homo sapiens
atcagaacagcag

SEQ ID NO: 2390637 - DNA, 14 bp, Homo sapiens
atcagaacagcaga

SEQ ID NO: 2390638 - DNA, 15 bp, Homo sapiens
atcaggctatgtatg

SEQ ID NO: 2390639 - DNA, 13 bp, Homo sapiens
atcaggctgaggt

SEQ ID NO: 2390640 - DNA, 20 bp, Homo sapiens
atcagggtgggccactctcc

SEQ ID NO: 2390641 - DNA, 22 bp, Homo sapiens
atcattttcttatcttctgcaa

SEQ ID NO: 2390642 - DNA, 15 bp, Homo sapiens
atccaggactctgtc

SEQ ID NO: 2390643 - DNA, 22 bp, Homo sapiens
atcccatgggggtgctgcagcc

SEQ ID NO: 2390644 - DNA, 14 bp, Homo sapiens
atcccctttcctcc

SEQ ID NO: 2390645 - DNA, 17 bp, Homo sapiens
atccctatgggattcag

SEQ ID NO: 2390646 - DNA, 18 bp, Homo sapiens
atcctattctcaccagga

SEQ ID NO: 2390647 - DNA, 12 bp, Homo sapiens
atctatttacat

SEQ ID NO: 2390648 - DNA, 16 bp, Homo sapiens
atctccaaggaccagg

SEQ ID NO: 2390649 - DNA, 20 bp, Homo sapiens
atctccaggattgaagagca

SEQ ID NO: 2390650 - DNA, 23 bp, Homo sapiens
atctctgtgtacccactcctcac

SEQ ID NO: 2390651 - DNA, 22 bp, Homo sapiens
atctgagcaagagctggcaaag

SEQ ID NO: 2390652 - DNA, 14 bp, Homo sapiens
atctgtccaaggaa

SEQ ID NO: 2390653 - DNA, 14 bp, Homo sapiens
atctgttttaaatt

SEQ ID NO: 2390654 - DNA, 14 bp, Homo sapiens
atcttcagagcagg

SEQ ID NO: 2390655 - DNA, 18 bp, Homo sapiens
atcttcagagcaggggtc

SEQ ID NO: 2390656 - DNA, 13 bp, Homo sapiens
atgaaaaattctc

SEQ ID NO: 2390657 - DNA, 17 bp, Homo sapiens
atgaagggaaaggatat

SEQ ID NO: 2390658 - DNA, 14 bp, Homo sapiens
atgactaaaaatat

SEQ ID NO: 2390659 - DNA, 14 bp, Homo sapiens
atgagggactggaa

SEQ ID NO: 2390660 - DNA, 20 bp, Homo sapiens
atgagggactggaaccaggg

SEQ ID NO: 2390661 - DNA, 23 bp, Homo sapiens
atgcagaggtaaaagtgtgagca

SEQ ID NO: 2390662 - DNA, 23 bp, Homo sapiens
atgctctgtgcgagggttactat

SEQ ID NO: 2390663 - DNA, 22 bp, Homo sapiens
atgctgtcaactatgatatggt

SEQ ID NO: 2390664 - DNA, 17 bp, Homo sapiens
atggaatacagtgttat

SEQ ID NO: 2390665 - DNA, 21 bp, Homo sapiens
atggacaccccttatccagga

SEQ ID NO: 2390666 - DNA, 14 bp, Homo sapiens
atggatttgaagca

SEQ ID NO: 2390667 - DNA, 18 bp, Homo sapiens
atggcagtgttcctattt

SEQ ID NO: 2390668 - DNA, 16 bp, Homo sapiens
atggctaattcccaga

SEQ ID NO: 2390669 - DNA, 23 bp, Homo sapiens
atgggattcagtgcttcttaaag

SEQ ID NO: 2390670 - DNA, 20 bp, Homo sapiens
atggtgttgccctgagtgga

SEQ ID NO: 2390671 - DNA, 23 bp, Homo sapiens
atgtaaacataattcttgtatat

SEQ ID NO: 2390672 - DNA, 20 bp, Homo sapiens
atgtctttgttggaaaagaa

SEQ ID NO: 2390673 - DNA, 15 bp, Homo sapiens
atgtgccaaggtggg

SEQ ID NO: 2390674 - DNA, 14 bp, Homo sapiens
atgtgttgaaaaaa

SEQ ID NO: 2390675 - DNA, 14 bp, Homo sapiens
atgtgttttctgaa

SEQ ID NO: 2390676 - DNA, 16 bp, Homo sapiens
attacttgaactttcc

SEQ ID NO: 2390677 - DNA, 22 bp, Homo sapiens
attataacttaaaaaaatgaca

SEQ ID NO: 2390678 - DNA, 16 bp, Homo sapiens
attcaggaagatgaaa

SEQ ID NO: 2390679 - DNA, 15 bp, Homo sapiens
attcccaccaaggtc

SEQ ID NO: 2390680 - DNA, 13 bp, Homo sapiens
attccctggcctg

SEQ ID NO: 2390681 - DNA, 14 bp, Homo sapiens
attctcaccaggaa

SEQ ID NO: 2390682 - DNA, 18 bp, Homo sapiens
atttaagcttatgtcaga

SEQ ID NO: 2390683 - DNA, 12 bp, Homo sapiens
atttaagtttgt

SEQ ID NO: 2390684 - DNA, 21 bp, Homo sapiens
atttaagtttgttgctgtcaa

SEQ ID NO: 2390685 - DNA, 22 bp, Homo sapiens
atttaagtttgttgctgtcaag

SEQ ID NO: 2390686 - DNA, 17 bp, Homo sapiens
atttaccacagcagctg

SEQ ID NO: 2390687 - DNA, 14 bp, Homo sapiens
atttataagcagat

SEQ ID NO: 2390688 - DNA, 22 bp, Homo sapiens
atttataagcagatttaacaat

SEQ ID NO: 2390689 - DNA, 14 bp, Homo sapiens
atttatttcaaaaa

SEQ ID NO: 2390690 - DNA, 15 bp, Homo sapiens
atttctactgtgact

SEQ ID NO: 2390691 - DNA, 16 bp, Homo sapiens
atttgaagcaaagcac

SEQ ID NO: 2390692 - DNA, 21 bp, Homo sapiens
atttggggcttgcatgccaaa

SEQ ID NO: 2390693 - DNA, 21 bp, Homo sapiens
attttaaaagcaattatattg

SEQ ID NO: 2390694 - DNA, 22 bp, Homo sapiens
attttaaaagcaattatattgt

SEQ ID NO: 2390695 - DNA, 17 bp, Homo sapiens
attttaagacgtgaatg

SEQ ID NO: 2390696 - DNA, 19 bp, Homo sapiens
attttcttatcttctgcaa

SEQ ID NO: 2390697 - DNA, 21 bp, Homo sapiens
attttcttccaagcaaaggtg

SEQ ID NO: 2390698 - DNA, 14 bp, Homo sapiens
attttgagtgactc

SEQ ID NO: 2390699 - DNA, 20 bp, Homo sapiens
atttttgtacgttatatatt

SEQ ID NO: 2390700 - DNA, 22 bp, Homo sapiens
attttttcagaaatatgtggtt

SEQ ID NO: 2390701 - DNA, 16 bp, Homo sapiens
attttttttgtaactt

SEQ ID NO: 2390702 - DNA, 20 bp, Homo sapiens
caaaaagggaaactattgtc

SEQ ID NO: 2390703 - DNA, 17 bp, Homo sapiens
caaaagttagctgagcg

SEQ ID NO: 2390704 - DNA, 20 bp, Homo sapiens
caaaattaccaaaaatcttg

SEQ ID NO: 2390705 - DNA, 12 bp, Homo sapiens
caaaccaggatt

SEQ ID NO: 2390706 - DNA, 16 bp, Homo sapiens
caaactgatttctcac

SEQ ID NO: 2390707 - DNA, 15 bp, Homo sapiens
caaagagcctggaga

SEQ ID NO: 2390708 - DNA, 23 bp, Homo sapiens
caaagatatatacacaggatcct

SEQ ID NO: 2390709 - DNA, 16 bp, Homo sapiens
caaagatgtttgtcag

SEQ ID NO: 2390710 - DNA, 22 bp, Homo sapiens
caaagatgtttgtcagatatga

SEQ ID NO: 2390711 - DNA, 21 bp, Homo sapiens
caaagcaccagcttctccagg

SEQ ID NO: 2390712 - DNA, 22 bp, Homo sapiens
caaaggaatctccagttttcag

SEQ ID NO: 2390713 - DNA, 18 bp, Homo sapiens
caaagggctgaaagccat

SEQ ID NO: 2390714 - DNA, 13 bp, Homo sapiens
caaaggtggctct

SEQ ID NO: 2390715 - DNA, 14 bp, Homo sapiens
caacaataaagagc

SEQ ID NO: 2390716 - DNA, 17 bp, Homo sapiens
caacaataaagagctca

SEQ ID NO: 2390717 - DNA, 10 bp, Homo sapiens
caacagcagc

SEQ ID NO: 2390718 - DNA, 18 bp, Homo sapiens
caagcactgctaggcgag

SEQ ID NO: 2390719 - DNA, 23 bp, Homo sapiens
caagcactgctaggcgagtgcca

SEQ ID NO: 2390720 - DNA, 21 bp, Homo sapiens
caaggagttccatgaagacca

SEQ ID NO: 2390721 - DNA, 23 bp, Homo sapiens
caaggagttccatgaagaccaca

SEQ ID NO: 2390722 - DNA, 21 bp, Homo sapiens
caagggccatgctgaagggac

SEQ ID NO: 2390723 - DNA, 18 bp, Homo sapiens
caaggttccctctgagaa

SEQ ID NO: 2390724 - DNA, 13 bp, Homo sapiens
caagttctagaga

SEQ ID NO: 2390725 - DNA, 18 bp, Homo sapiens
caagttctagagaagagg

SEQ ID NO: 2390726 - DNA, 21 bp, Homo sapiens
caagttctagagaagaggctg

SEQ ID NO: 2390727 - DNA, 12 bp, Homo sapiens
caataaagagct

SEQ ID NO: 2390728 - DNA, 14 bp, Homo sapiens
caataaagagctca

SEQ ID NO: 2390729 - DNA, 13 bp, Homo sapiens
cacaagctggaag

SEQ ID NO: 2390730 - DNA, 14 bp, Homo sapiens
cacaagctggaagc

SEQ ID NO: 2390731 - DNA, 15 bp, Homo sapiens
cacaagctggaagca

SEQ ID NO: 2390732 - DNA, 13 bp, Homo sapiens
cacacaaaggtat

SEQ ID NO: 2390733 - DNA, 20 bp, Homo sapiens
cacacccggctccccctgct

SEQ ID NO: 2390734 - DNA, 19 bp, Homo sapiens
cacacgcaggaactcccag

SEQ ID NO: 2390735 - DNA, 23 bp, Homo sapiens
cacacttgggcgctctgccctcc

SEQ ID NO: 2390736 - DNA, 19 bp, Homo sapiens
cacaggatcctattctcac

SEQ ID NO: 2390737 - DNA, 24 bp, Homo sapiens
cacaggatcctattctcaccagga

SEQ ID NO: 2390738 - DNA, 21 bp, Homo sapiens
caccaaggtcttcagccatca

SEQ ID NO: 2390739 - DNA, 19 bp, Homo sapiens
caccaccttggactcctcc

SEQ ID NO: 2390740 - DNA, 23 bp, Homo sapiens
caccaccttggactcctcccaca

SEQ ID NO: 2390741 - DNA, 12 bp, Homo sapiens
caccagccacct

SEQ ID NO: 2390742 - DNA, 17 bp, Homo sapiens
caccagcttctccaggc

SEQ ID NO: 2390743 - DNA, 15 bp, Homo sapiens
caccaggatggccct

SEQ ID NO: 2390744 - DNA, 16 bp, Homo sapiens
caccatgcgctgctca

SEQ ID NO: 2390745 - DNA, 13 bp, Homo sapiens
ccctcattcccct

SEQ ID NO: 2390746 - DNA, 14 bp, Homo sapiens
ccctcattcccctc

SEQ ID NO: 2390747 - DNA, 15 bp, Homo sapiens
ccctcattcccctcg

SEQ ID NO: 2390748 - DNA, 13 bp, Homo sapiens
ccctccctggcct

SEQ ID NO: 2390749 - DNA, 15 bp, Homo sapiens
ccctctcttccctat

SEQ ID NO: 2390750 - DNA, 19 bp, Homo sapiens
ccctctgaatggtccaggg

SEQ ID NO: 2390751 - DNA, 20 bp, Homo sapiens
ccctctgagaattccaagga

SEQ ID NO: 2390752 - DNA, 12 bp, Homo sapiens
ccctcttccttc

SEQ ID NO: 2390753 - DNA, 16 bp, Homo sapiens
ccctcttccttccccc

SEQ ID NO: 2390754 - DNA, 22 bp, Homo sapiens
ccctcttgacccatctccccct

SEQ ID NO: 2390755 - DNA, 17 bp, Homo sapiens
ccctgaacatctgtgtg

SEQ ID NO: 2390756 - DNA, 20 bp, Homo sapiens
ccctgagtggatctccaagg

SEQ ID NO: 2390757 - DNA, 21 bp, Homo sapiens
ccctgagtggatctccaagga

SEQ ID NO: 2390758 - DNA, 22 bp, Homo sapiens
  misc_feature (13)..(13): n is a, c, g or t
ccctgcacctgcnttgtccctg

SEQ ID NO: 2390759 - DNA, 13 bp, Homo sapiens
ccctgcagcctgg

SEQ ID NO: 2390760 - DNA, 15 bp, Homo sapiens
ccctggagtgcagtt

SEQ ID NO: 2390761 - DNA, 10 bp, Homo sapiens
ccctggcctc

SEQ ID NO: 2390762 - DNA, 19 bp, Homo sapiens
ccctggcctggctctcctg

SEQ ID NO: 2390763 - DNA, 15 bp, Homo sapiens
ccctggtgcagaggt

SEQ ID NO: 2390764 - DNA, 14 bp, Homo sapiens
cccttatccaggac

SEQ ID NO: 2390765 - DNA, 16 bp, Homo sapiens
cccttcccactggagg

SEQ ID NO: 2390766 - DNA, 15 bp, Homo sapiens
cccttcctttcctct

SEQ ID NO: 2390767 - DNA, 16 bp, Homo sapiens
cccttcctttcctctg

SEQ ID NO: 2390768 - DNA, 18 bp, Homo sapiens
ccggcccagagacccctt

SEQ ID NO: 2390769 - DNA, 12 bp, Homo sapiens
ccggctccccct

SEQ ID NO: 2390770 - DNA, 13 bp, Homo sapiens
ccggctccccctg

SEQ ID NO: 2390771 - DNA, 20 bp, Homo sapiens
ccgtgcccaggggcccacag

SEQ ID NO: 2390772 - DNA, 20 bp, Homo sapiens
cctaaagaggaaaagtgcaa

SEQ ID NO: 2390773 - DNA, 15 bp, Homo sapiens
cctacattccctggc

SEQ ID NO: 2390774 - DNA, 18 bp, Homo sapiens
cctacattccctggcctg

SEQ ID NO: 2390775 - DNA, 15 bp, Homo sapiens
cctattctcaccagg

SEQ ID NO: 2390776 - DNA, 16 bp, Homo sapiens
cctattctcaccagga

SEQ ID NO: 2390777 - DNA, 19 bp, Homo sapiens
cctattctcaccaggaagg

SEQ ID NO: 2390778 - DNA, 16 bp, Homo sapiens
cctcaatgtgaccagg

SEQ ID NO: 2390779 - DNA, 13 bp, Homo sapiens
cctcactgcccca

SEQ ID NO: 2390780 - DNA, 14 bp, Homo sapiens
cctcactgccccac

SEQ ID NO: 2390781 - DNA, 15 bp, Homo sapiens
cctcactgccccacc

SEQ ID NO: 2390782 - DNA, 17 bp, Homo sapiens
cctcactgccccaccag

SEQ ID NO: 2390783 - DNA, 19 bp, Homo sapiens
cctcactgccccaccagcc

SEQ ID NO: 2390784 - DNA, 20 bp, Homo sapiens
cctcactgccccaccagcca

SEQ ID NO: 2390785 - DNA, 14 bp, Homo sapiens
cctcattcccctcg

SEQ ID NO: 2390786 - DNA, 14 bp, Homo sapiens
cctccccaccttcc

SEQ ID NO: 2390787 - DNA, 19 bp, Homo sapiens
cctccccaccttccccaga

SEQ ID NO: 2390788 - DNA, 23 bp, Homo sapiens
cctccccaccttccccagactca

SEQ ID NO: 2390789 - DNA, 20 bp, Homo sapiens
cctccctcttccttccccca

SEQ ID NO: 2390790 - DNA, 12 bp, Homo sapiens
cctccctggcct

SEQ ID NO: 2390791 - DNA, 24 bp, Homo sapiens
cctccctggcctcacgcccagcct

SEQ ID NO: 2390792 - DNA, 22 bp, Homo sapiens
cctcgcatgccagagcctgggg

SEQ ID NO: 2390793 - DNA, 11 bp, Homo sapiens
cctctcttccc

SEQ ID NO: 2390794 - DNA, 15 bp, Homo sapiens
cctctgatacccaga

SEQ ID NO: 2390795 - DNA, 18 bp, Homo sapiens
cctctgatacccagagca

SEQ ID NO: 2390796 - DNA, 16 bp, Homo sapiens
cctctgcagcacttta

SEQ ID NO: 2390797 - DNA, 24 bp, Homo sapiens
cctcttgggcatgctcagcccttc

SEQ ID NO: 2390798 - DNA, 16 bp, Homo sapiens
cctctttgcctgtgtg

SEQ ID NO: 2390799 - DNA, 21 bp, Homo sapiens
cctctttgcctgtgtgagcat

SEQ ID NO: 2390800 - DNA, 18 bp, Homo sapiens
cctgagtggatctccaag

SEQ ID NO: 2390801 - DNA, 23 bp, Homo sapiens
cctgagtggatctccaaggacca

SEQ ID NO: 2390802 - DNA, 16 bp, Homo sapiens
cctgatgacagagcga

SEQ ID NO: 2390803 - DNA, 13 bp, Homo sapiens
cctgcagagagaa

SEQ ID NO: 2390804 - DNA, 15 bp, Homo sapiens
cctgcagagagaagc

SEQ ID NO: 2390805 - DNA, 14 bp, Homo sapiens
cctgccctcaggga

SEQ ID NO: 2390806 - DNA, 19 bp, Homo sapiens
cctgcctacattccctggc

SEQ ID NO: 2390807 - DNA, 22 bp, Homo sapiens
cctgcctacattccctggcctg

SEQ ID NO: 2390808 - DNA, 16 bp, Homo sapiens
  misc_feature (6)..(6): n is a, c, g or t
cctgcnttgtccctgg

SEQ ID NO: 2390809 - DNA, 20 bp, Homo sapiens
cctgctgctgtgtttttgct

SEQ ID NO: 2390810 - DNA, 11 bp, Homo sapiens
cctggagaagc

SEQ ID NO: 2390811 - DNA, 20 bp, Homo sapiens
cctggcctcacgcccagcct

SEQ ID NO: 2390812 - DNA, 14 bp, Homo sapiens
cctggcctggctct

SEQ ID NO: 2390813 - DNA, 16 bp, Homo sapiens
cctgggaggcggagag

SEQ ID NO: 2390814 - DNA, 22 bp, Homo sapiens
cctggggccccttggcgggcag

SEQ ID NO: 2390815 - DNA, 18 bp, Homo sapiens
cctggtagaattgggaag

SEQ ID NO: 2390816 - DNA, 17 bp, Homo sapiens
cctgtaatcccagcact

SEQ ID NO: 2390817 - DNA, 21 bp, Homo sapiens
cctgtgtgagcatctctgtgt

SEQ ID NO: 2390818 - DNA, 17 bp, Homo sapiens
cctgttttgttggaagg

SEQ ID NO: 2390819 - DNA, 13 bp, Homo sapiens
ccttccccagact

SEQ ID NO: 2390820 - DNA, 23 bp, Homo sapiens
ccttccccagactcagctccaga

SEQ ID NO: 2390821 - DNA, 22 bp, Homo sapiens
ccttcccccatcccctttcctc

SEQ ID NO: 2390822 - DNA, 12 bp, Homo sapiens
ccttcctttcct

SEQ ID NO: 2390823 - DNA, 17 bp, Homo sapiens
ccttcctttcctctgca

SEQ ID NO: 2390824 - DNA, 15 bp, Homo sapiens
ccttctcctgcctac

SEQ ID NO: 2390825 - DNA, 16 bp, Homo sapiens
ccttggactcctccca

SEQ ID NO: 2390826 - DNA, 20 bp, Homo sapiens
ccttggcgggcagcccagcc

SEQ ID NO: 2390827 - DNA, 21 bp, Homo sapiens
ccttggcgggcagcccagcct

SEQ ID NO: 2390828 - DNA, 13 bp, Homo sapiens
cctttcctcccca

SEQ ID NO: 2390829 - DNA, 16 bp, Homo sapiens
cctttcctccccacct

SEQ ID NO: 2390830 - DNA, 14 bp, Homo sapiens
cctttcctctgcag

SEQ ID NO: 2390831 - DNA, 18 bp, Homo sapiens
ccttttgcttgaaaccaa

SEQ ID NO: 2390832 - DNA, 19 bp, Homo sapiens
cgacggtttcaaaccagga

SEQ ID NO: 2390833 - DNA, 15 bp, Homo sapiens
cgagcatcctggcca

SEQ ID NO: 2390834 - DNA, 18 bp, Homo sapiens
cgagcgctttctggaaaa

SEQ ID NO: 2390835 - DNA, 14 bp, Homo sapiens
cgaggtagagtttg

SEQ ID NO: 2390836 - DNA, 17 bp, Homo sapiens
cgcaggaactcccagca

SEQ ID NO: 2390837 - DNA, 20 bp, Homo sapiens
cgccactgcactccggcctg

SEQ ID NO: 2390838 - DNA, 14 bp, Homo sapiens
cgcctgcccagcct

SEQ ID NO: 2390839 - DNA, 17 bp, Homo sapiens
cgcctgtaatcccagca

SEQ ID NO: 2390840 - DNA, 18 bp, Homo sapiens
cgcctgtagtcccagcca

SEQ ID NO: 2390841 - DNA, 15 bp, Homo sapiens
cgctctgccctccct

SEQ ID NO: 2390842 - DNA, 16 bp, Homo sapiens
cgctgctagagaaggg

SEQ ID NO: 2390843 - DNA, 13 bp, Homo sapiens
cgctgctcaacct

SEQ ID NO: 2390844 - DNA, 14 bp, Homo sapiens
cggagaccctgagt

SEQ ID NO: 2390845 - DNA, 15 bp, Homo sapiens
cggagaccctgagtc

SEQ ID NO: 2390846 - DNA, 17 bp, Homo sapiens
cggagagtacagtgagc

SEQ ID NO: 2390847 - DNA, 19 bp, Homo sapiens
cggagagtacagtgagcca

SEQ ID NO: 2390848 - DNA, 20 bp, Homo sapiens
cggcccagagaccccttcct

SEQ ID NO: 2390849 - DNA, 19 bp, Homo sapiens
cggccttcaactgaaaaga

SEQ ID NO: 2390850 - DNA, 18 bp, Homo sapiens
cggctccccctgcttctc

SEQ ID NO: 2390851 - DNA, 22 bp, Homo sapiens
cggctccccctgcttctcagcc

SEQ ID NO: 2390852 - DNA, 16 bp, Homo sapiens
cgggaggctgagacag

SEQ ID NO: 2390853 - DNA, 15 bp, Homo sapiens
cgggcctgcctctga

SEQ ID NO: 2390854 - DNA, 17 bp, Homo sapiens
cgggcctgcctctgact

SEQ ID NO: 2390855 - DNA, 15 bp, Homo sapiens
cgggctctgacagcc

SEQ ID NO: 2390856 - DNA, 21 bp, Homo sapiens
gcccagcctcctcccaccacc

SEQ ID NO: 2390857 - DNA, 13 bp, Homo sapiens
gcccagcctctgt

SEQ ID NO: 2390858 - DNA, 14 bp, Homo sapiens
gcccagcctctgtc

SEQ ID NO: 2390859 - DNA, 15 bp, Homo sapiens
gcccagcctctgtcc

SEQ ID NO: 2390860 - DNA, 20 bp, Homo sapiens
gcccagcctctgtccctctt

SEQ ID NO: 2390861 - DNA, 17 bp, Homo sapiens
gcccagggcatcccatg

SEQ ID NO: 2390862 - DNA, 20 bp, Homo sapiens
gcccaggggcccacagggaa

SEQ ID NO: 2390863 - DNA, 16 bp, Homo sapiens
gcccaggtcctctgat

SEQ ID NO: 2390864 - DNA, 15 bp, Homo sapiens
gccccaccagccacc

SEQ ID NO: 2390865 - DNA, 24 bp, Homo sapiens
gccccgggcctgcctctgactcac

SEQ ID NO: 2390866 - DNA, 23 bp, Homo sapiens
gccctgagtggatctccaaggac

SEQ ID NO: 2390867 - DNA, 14 bp, Homo sapiens
gccctgcggagacc

SEQ ID NO: 2390868 - DNA, 13 bp, Homo sapiens
gccgggtgcggtg

SEQ ID NO: 2390869 - DNA, 15 bp, Homo sapiens
gccgtgcccaggggc

SEQ ID NO: 2390870 - DNA, 20 bp, Homo sapiens
gcctcacgcccagcctcctc

SEQ ID NO: 2390871 - DNA, 19 bp, Homo sapiens
gcctcctcccaccaccctc

SEQ ID NO: 2390872 - DNA, 11 bp, Homo sapiens
gcctgcagaga

SEQ ID NO: 2390873 - DNA, 12 bp, Homo sapiens
gcctgcctctga

SEQ ID NO: 2390874 - DNA, 15 bp, Homo sapiens
gcctggagaagctga

SEQ ID NO: 2390875 - DNA, 13 bp, Homo sapiens
gcctggctctcct

SEQ ID NO: 2390876 - DNA, 20 bp, Homo sapiens
gcctgtaatcccagcacttt

SEQ ID NO: 2390877 - DNA, 20 bp, Homo sapiens
gcctgtgtgagcatctctgt

SEQ ID NO: 2390878 - DNA, 14 bp, Homo sapiens
gccttctcctgcct

SEQ ID NO: 2390879 - DNA, 16 bp, Homo sapiens
gcgagaggcagagaaa

SEQ ID NO: 2390880 - DNA, 13 bp, Homo sapiens
gcgaggtgtaaag

SEQ ID NO: 2390881 - DNA, 14 bp, Homo sapiens
gcgaggtgtaaagt

SEQ ID NO: 2390882 - DNA, 15 bp, Homo sapiens
gcgagtgccaggact

SEQ ID NO: 2390883 - DNA, 16 bp, Homo sapiens
gcgcctgtagtcccag

SEQ ID NO: 2390884 - DNA, 15 bp, Homo sapiens
gcgctctgccctccc

SEQ ID NO: 2390885 - DNA, 20 bp, Homo sapiens
gcggagagtacagtgagcca

SEQ ID NO: 2390886 - DNA, 20 bp, Homo sapiens
gcgggcgcctgtagtcccag

SEQ ID NO: 2390887 - DNA, 13 bp, Homo sapiens
gcggggtgcagaa

SEQ ID NO: 2390888 - DNA, 21 bp, Homo sapiens
gctaatgaagggaaaggatat

SEQ ID NO: 2390889 - DNA, 20 bp, Homo sapiens
gctaattcccagagtgtgaa

SEQ ID NO: 2390890 - DNA, 16 bp, Homo sapiens
gctaggcgagtgccag

SEQ ID NO: 2390891 - DNA, 16 bp, Homo sapiens
gctataggctggagaa

SEQ ID NO: 2390892 - DNA, 19 bp, Homo sapiens
gctataggctggagaagct

SEQ ID NO: 2390893 - DNA, 20 bp, Homo sapiens
gctcaacctctctccttctg

SEQ ID NO: 2390894 - DNA, 20 bp, Homo sapiens
gctcacccaataaacattaa

SEQ ID NO: 2390895 - DNA, 21 bp, Homo sapiens
gctcacgcctgtaatcccagc

SEQ ID NO: 2390896 - DNA, 15 bp, Homo sapiens
gctcaggtgcaagtg

SEQ ID NO: 2390897 - DNA, 21 bp, Homo sapiens
gctccccctgcttctcagccc

SEQ ID NO: 2390898 - DNA, 16 bp, Homo sapiens
gctcgcccacaaactg

SEQ ID NO: 2390899 - DNA, 22 bp, Homo sapiens
gctctctctacccggcccagag

SEQ ID NO: 2390900 - DNA, 23 bp, Homo sapiens
gctctctctacccggcccagaga

SEQ ID NO: 2390901 - DNA, 17 bp, Homo sapiens
gctctgccctccctggc

SEQ ID NO: 2390902 - DNA, 14 bp, Homo sapiens
gctctggaagagag

SEQ ID NO: 2390903 - DNA, 15 bp, Homo sapiens
gctctggaagagagg

SEQ ID NO: 2390904 - DNA, 22 bp, Homo sapiens
gctctttggggtcagccagggc

SEQ ID NO: 2390905 - DNA, 23 bp, Homo sapiens
gctctttggggtcagccagggcc

SEQ ID NO: 2390906 - DNA, 13 bp, Homo sapiens
gctgaaagccatt

SEQ ID NO: 2390907 - DNA, 22 bp, Homo sapiens
gctgaacccattttgagtgact

SEQ ID NO: 2390908 - DNA, 19 bp, Homo sapiens
gctgaccccaaagagcctg

SEQ ID NO: 2390909 - DNA, 21 bp, Homo sapiens
gctgaggtgtcttaagccttt

SEQ ID NO: 2390910 - DNA, 14 bp, Homo sapiens
gctggacaacccag

SEQ ID NO: 2390911 - DNA, 15 bp, Homo sapiens
gctggactctggcac

SEQ ID NO: 2390912 - DNA, 19 bp, Homo sapiens
gctggactctggcacccag

SEQ ID NO: 2390913 - DNA, 16 bp, Homo sapiens
gctggagaagctcacc

SEQ ID NO: 2390914 - DNA, 22 bp, Homo sapiens
gctgggaccccagctagggctg

SEQ ID NO: 2390915 - DNA, 15 bp, Homo sapiens
gctgggggaagggtg

SEQ ID NO: 2390916 - DNA, 16 bp, Homo sapiens
gctgggggaagggtgg

SEQ ID NO: 2390917 - DNA, 14 bp, Homo sapiens
gctgtggccagggt

SEQ ID NO: 2390918 - DNA, 22 bp, Homo sapiens
gctgtggccagggtgagagctg

SEQ ID NO: 2390919 - DNA, 14 bp, Homo sapiens
gcttcatgctcagc

SEQ ID NO: 2390920 - DNA, 18 bp, Homo sapiens
gcttcatgctcagccctg

SEQ ID NO: 2390921 - DNA, 19 bp, Homo sapiens
gcttccaggtatctccagg

SEQ ID NO: 2390922 - DNA, 20 bp, Homo sapiens
gcttccaggtatctccagga

SEQ ID NO: 2390923 - DNA, 21 bp, Homo sapiens
gcttccaggtatctccaggat

SEQ ID NO: 2390924 - DNA, 13 bp, Homo sapiens
gcttctcagcccc

SEQ ID NO: 2390925 - DNA, 15 bp, Homo sapiens
gcttcttaaagagtt

SEQ ID NO: 2390926 - DNA, 22 bp, Homo sapiens
gctttgcattcctacaaagatg

SEQ ID NO: 2390927 - DNA, 14 bp, Homo sapiens
ggaaaaaaatgact

SEQ ID NO: 2390928 - DNA, 21 bp, Homo sapiens
ggaaaagaggagtttcgaggt

SEQ ID NO: 2390929 - DNA, 17 bp, Homo sapiens
ggaaccagggagaccga

SEQ ID NO: 2390930 - DNA, 13 bp, Homo sapiens
ggaactcccagca

SEQ ID NO: 2390931 - DNA, 22 bp, Homo sapiens
ggaactcccagcaacacaagct

SEQ ID NO: 2390932 - DNA, 19 bp, Homo sapiens
ggaactctggcttccaggt

SEQ ID NO: 2390933 - DNA, 20 bp, Homo sapiens
ggaactctggcttccaggta

SEQ ID NO: 2390934 - DNA, 18 bp, Homo sapiens
ggaagattttaaattcac

SEQ ID NO: 2390935 - DNA, 16 bp, Homo sapiens
ggaaggaactctggct

SEQ ID NO: 2390936 - DNA, 18 bp, Homo sapiens
ggaaggaactctggcttc

SEQ ID NO: 2390937 - DNA, 19 bp, Homo sapiens
ggaatgtttgggcagaagg

SEQ ID NO: 2390938 - DNA, 21 bp, Homo sapiens
ggaatgtttgggcagaaggga

SEQ ID NO: 2390939 - DNA, 18 bp, Homo sapiens
ggaccccagctagggctg

SEQ ID NO: 2390940 - DNA, 20 bp, Homo sapiens
ggaccccagctagggctgga

SEQ ID NO: 2390941 - DNA, 14 bp, Homo sapiens
ggactccccaggcc

SEQ ID NO: 2390942 - DNA, 17 bp, Homo sapiens
ggactggaaccagggag

SEQ ID NO: 2390943 - DNA, 13 bp, Homo sapiens
ggagaagctgatg

SEQ ID NO: 2390944 - DNA, 16 bp, Homo sapiens
ggagaagctgatgctt

SEQ ID NO: 2390945 - DNA, 20 bp, Homo sapiens
ggagaaggatctagaatgtg

SEQ ID NO: 2390946 - DNA, 15 bp, Homo sapiens
ggagagccagctctc

SEQ ID NO: 2390947 - DNA, 14 bp, Homo sapiens
ggagccaacagcag

SEQ ID NO: 2390948 - DNA, 15 bp, Homo sapiens
ggagccaacagcagc

SEQ ID NO: 2390949 - DNA, 12 bp, Homo sapiens
ggaggcggagag

SEQ ID NO: 2390950 - DNA, 20 bp, Homo sapiens
ggaggcggagagtacagtga

SEQ ID NO: 2390951 - DNA, 19 bp, Homo sapiens
ggaggtcacattcaggaag

SEQ ID NO: 2390952 - DNA, 23 bp, Homo sapiens
ggaggtcacattcaggaagatga

SEQ ID NO: 2390953 - DNA, 13 bp, Homo sapiens
ggagtgggggctg

SEQ ID NO: 2390954 - DNA, 14 bp, Homo sapiens
ggatcctattctca

SEQ ID NO: 2390955 - DNA, 23 bp, Homo sapiens
ggatcctattctcaccaggaagg

SEQ ID NO: 2390956 - DNA, 21 bp, Homo sapiens
ggatctccaaggaccaggtta

SEQ ID NO: 2390957 - DNA, 14 bp, Homo sapiens
ggatgaccagaaca

SEQ ID NO: 2390958 - DNA, 17 bp, Homo sapiens
ggcaacgacggtttcaa

SEQ ID NO: 2390959 - DNA, 21 bp, Homo sapiens
ggcaagggccatgctgaaggg

SEQ ID NO: 2390960 - DNA, 21 bp, Homo sapiens
ggcacagaaacacaatatttt

SEQ ID NO: 2390961 - DNA, 14 bp, Homo sapiens
ggcaccccctggag

SEQ ID NO: 2390962 - DNA, 15 bp, Homo sapiens
ggcaccccctggaga

SEQ ID NO: 2390963 - DNA, 20 bp, Homo sapiens
ggcaccccctggagagaagt

SEQ ID NO: 2390964 - DNA, 13 bp, Homo sapiens
ggcacgcctgccc

SEQ ID NO: 2390965 - DNA, 18 bp, Homo sapiens
ggcacgcctgcccagcct

SEQ ID NO: 2390966 - DNA, 22 bp, Homo sapiens
tgaaggtcactcttcctgcaag

SEQ ID NO: 2390967 - DNA, 18 bp, Homo sapiens
tgaatgtctcagcgaggt

SEQ ID NO: 2390968 - DNA, 22 bp, Homo sapiens
tgaattgcctgcagagagaagc

SEQ ID NO: 2390969 - DNA, 14 bp, Homo sapiens
tgacaataaatgtg

SEQ ID NO: 2390970 - DNA, 14 bp, Homo sapiens
tgacagcaggtggg

SEQ ID NO: 2390971 - DNA, 22 bp, Homo sapiens
tgaccctctgaatggtccaggg

SEQ ID NO: 2390972 - DNA, 23 bp, Homo sapiens
tgacggtcccacactggtgactg

SEQ ID NO: 2390973 - DNA, 14 bp, Homo sapiens
tgactaaaaatatt

SEQ ID NO: 2390974 - DNA, 21 bp, Homo sapiens
tgactcgagggttgggttcat

SEQ ID NO: 2390975 - DNA, 16 bp, Homo sapiens
tgagaaatgaatgctg

SEQ ID NO: 2390976 - DNA, 16 bp, Homo sapiens
tgagaattccaaggag

SEQ ID NO: 2390977 - DNA, 16 bp, Homo sapiens
tgagagctgctctgga

SEQ ID NO: 2390978 - DNA, 23 bp, Homo sapiens
tgagcaccccctcattcccctcg

SEQ ID NO: 2390979 - DNA, 20 bp, Homo sapiens
tgagcagaggagtccagggc

SEQ ID NO: 2390980 - DNA, 14 bp, Homo sapiens
tgagcatctctgtg

SEQ ID NO: 2390981 - DNA, 23 bp, Homo sapiens
tgagcatctctgtgtacccactc

SEQ ID NO: 2390982 - DNA, 16 bp, Homo sapiens
tgaggcctggccaggc

SEQ ID NO: 2390983 - DNA, 17 bp, Homo sapiens
tgaggcctggccaggca

SEQ ID NO: 2390984 - DNA, 15 bp, Homo sapiens
tgatatgtaaacata

SEQ ID NO: 2390985 - DNA, 21 bp, Homo sapiens
tgatatgtaaacataattctt

SEQ ID NO: 2390986 - DNA, 13 bp, Homo sapiens
tgattacacagtt

SEQ ID NO: 2390987 - DNA, 23 bp, Homo sapiens
tgcaaacacacaaaggtataatt

SEQ ID NO: 2390988 - DNA, 20 bp, Homo sapiens
  misc_feature (10)..(10): n is a, c, g or t
tgcacctgcnttgtccctgg

SEQ ID NO: 2390989 - DNA, 13 bp, Homo sapiens
tgcagaggattta

SEQ ID NO: 2390990 - DNA, 20 bp, Homo sapiens
tgcagaggtgagcagaggag

SEQ ID NO: 2390991 - DNA, 22 bp, Homo sapiens
tgcagcactttaaccctctctt

SEQ ID NO: 2390992 - DNA, 23 bp, Homo sapiens
tgcatggtgcagttgacagcagg

SEQ ID NO: 2390993 - DNA, 23 bp, Homo sapiens
tgcattagaaattagctgtgtga

SEQ ID NO: 2390994 - DNA, 13 bp, Homo sapiens
tgcattgaatata

SEQ ID NO: 2390995 - DNA, 15 bp, Homo sapiens
tgcattgaatatatt

SEQ ID NO: 2390996 - DNA, 16 bp, Homo sapiens
tgcattgaatatatta

SEQ ID NO: 2390997 - DNA, 19 bp, Homo sapiens
tgccaccatcctgctgctg

SEQ ID NO: 2390998 - DNA, 23 bp, Homo sapiens
tgccagagcctggggcatcccag

SEQ ID NO: 2390999 - DNA, 12 bp, Homo sapiens
tgccaggactcc

SEQ ID NO: 2391000 - DNA, 15 bp, Homo sapiens
tgccccaccagccac

SEQ ID NO: 2391001 - DNA, 12 bp, Homo sapiens
tgccctcaggga

SEQ ID NO: 2391002 - DNA, 15 bp, Homo sapiens
tgccctccctggcct

SEQ ID NO: 2391003 - DNA, 16 bp, Homo sapiens
tgccctccctggcctc

SEQ ID NO: 2391004 - DNA, 23 bp, Homo sapiens
tgccctccctggcctcacgccca

SEQ ID NO: 2391005 - DNA, 14 bp, Homo sapiens
tgcctacattccct

SEQ ID NO: 2391006 - DNA, 17 bp, Homo sapiens
tgcctacattccctggc

SEQ ID NO: 2391007 - DNA, 23 bp, Homo sapiens
tgcctcaatgtgaccaggggtga

SEQ ID NO: 2391008 - DNA, 14 bp, Homo sapiens
tgcctctgactcac

SEQ ID NO: 2391009 - DNA, 18 bp, Homo sapiens
tgcgatcttcagagcagg

SEQ ID NO: 2391010 - DNA, 15 bp, Homo sapiens
tgcgctgctcaacct

SEQ ID NO: 2391011 - DNA, 14 bp, Homo sapiens
tgctaaaacttcac

SEQ ID NO: 2391012 - DNA, 21 bp, Homo sapiens
tgctaggcgagtgccaggact

SEQ ID NO: 2391013 - DNA, 20 bp, Homo sapiens
tgctcaacctctctccttct

SEQ ID NO: 2391014 - DNA, 21 bp, Homo sapiens
tgctcaacctctctccttctg

SEQ ID NO: 2391015 - DNA, 17 bp, Homo sapiens
tgctcaggtgcaagtgc

SEQ ID NO: 2391016 - DNA, 16 bp, Homo sapiens
tgctctggaagagagg

SEQ ID NO: 2391017 - DNA, 13 bp, Homo sapiens
tgctgcagccagg

SEQ ID NO: 2391018 - DNA, 17 bp, Homo sapiens
tgctgtggccagggtga

SEQ ID NO: 2391019 - DNA, 23 bp, Homo sapiens
tgctgtggccagggtgagagctg

SEQ ID NO: 2391020 - DNA, 14 bp, Homo sapiens
tgcttaggatgttt

SEQ ID NO: 2391021 - DNA, 20 bp, Homo sapiens
tggaaatgtcctccaacaat

SEQ ID NO: 2391022 - DNA, 16 bp, Homo sapiens
tggaagattttaaatt

SEQ ID NO: 2391023 - DNA, 21 bp, Homo sapiens
tggaaggtttgtatattgtca

SEQ ID NO: 2391024 - DNA, 22 bp, Homo sapiens
tggaatacagtgttattttctt

SEQ ID NO: 2391025 - DNA, 21 bp, Homo sapiens
tggacaccccttatccaggac

SEQ ID NO: 2391026 - DNA, 22 bp, Homo sapiens
tggacgcccagctgaggctggg

SEQ ID NO: 2391027 - DNA, 13 bp, Homo sapiens
tggactcctccca

SEQ ID NO: 2391028 - DNA, 14 bp, Homo sapiens
tggactcctcccac

SEQ ID NO: 2391029 - DNA, 16 bp, Homo sapiens
tggactcctcccacaa

SEQ ID NO: 2391030 - DNA, 23 bp, Homo sapiens
tggagagaagtttctggccctgg

SEQ ID NO: 2391031 - DNA, 18 bp, Homo sapiens
tggaggtcacattcagga

SEQ ID NO: 2391032 - DNA, 22 bp, Homo sapiens
tggaggtcacattcaggaagat

SEQ ID NO: 2391033 - DNA, 13 bp, Homo sapiens
tggagttcagaga

SEQ ID NO: 2391034 - DNA, 14 bp, Homo sapiens
tggatctccaagga

SEQ ID NO: 2391035 - DNA, 13 bp, Homo sapiens
tggatgaccagaa

SEQ ID NO: 2391036 - DNA, 14 bp, Homo sapiens
tggcacagaaacac

SEQ ID NO: 2391037 - DNA, 19 bp, Homo sapiens
tggccagggtgagagctgc

SEQ ID NO: 2391038 - DNA, 17 bp, Homo sapiens
tggccgggtgcggtggc

SEQ ID NO: 2391039 - DNA, 19 bp, Homo sapiens
tggcctcacgcccagcctc

SEQ ID NO: 2391040 - DNA, 15 bp, Homo sapiens
tggcgggcagcccag

SEQ ID NO: 2391041 - DNA, 23 bp, Homo sapiens
tggcgggcagcccagcctctgtc

SEQ ID NO: 2391042 - DNA, 17 bp, Homo sapiens
tggcgggcgcctgtagt

SEQ ID NO: 2391043 - DNA, 22 bp, Homo sapiens
tggctttctccgactgctaggg

SEQ ID NO: 2391044 - DNA, 23 bp, Homo sapiens
tgggaaatggtatgagctgaggg

SEQ ID NO: 2391045 - DNA, 12 bp, Homo sapiens
tgggaagctggg

SEQ ID NO: 2391046 - DNA, 22 bp, Homo sapiens
tgggaccccagctagggctgga

SEQ ID NO: 2391047 - DNA, 20 bp, Homo sapiens
tgggattcccaccaaggtct

SEQ ID NO: 2391048 - DNA, 18 bp, Homo sapiens
tgggcagaagggagaagg

SEQ ID NO: 2391049 - DNA, 19 bp, Homo sapiens
tgggcagaagggagaagga

SEQ ID NO: 2391050 - DNA, 17 bp, Homo sapiens
tgggcatgctcagccct

SEQ ID NO: 2391051 - DNA, 20 bp, Homo sapiens
tgggccactctcccctccct

SEQ ID NO: 2391052 - DNA, 22 bp, Homo sapiens
tgggcgctctgccctccctggc

SEQ ID NO: 2391053 - DNA, 19 bp, Homo sapiens
tggggcaacgacggtttca

SEQ ID NO: 2391054 - DNA, 19 bp, Homo sapiens
tgggggcgggggagccaac

SEQ ID NO: 2391055 - DNA, 20 bp, Homo sapiens
tggggtatttaccacagcag

SEQ ID NO: 2391056 - DNA, 24 bp, Homo sapiens
tggggtatttaccacagcagctga

SEQ ID NO: 2391057 - DNA, 18 bp, Homo sapiens
tggggtcagccagggcca

SEQ ID NO: 2391058 - DNA, 14 bp, Homo sapiens
tgggtggtggatct

SEQ ID NO: 2391059 - DNA, 14 bp, Homo sapiens
tggtaagctctggc

SEQ ID NO: 2391060 - DNA, 15 bp, Homo sapiens
tggtaagctctggct

SEQ ID NO: 2391061 - DNA, 14 bp, Homo sapiens
tggtcaaaccgcac

SEQ ID NO: 2391062 - DNA, 17 bp, Homo sapiens
tggtcaaaccgcactca

SEQ ID NO: 2391063 - DNA, 14 bp, Homo sapiens
tggtccagggttga

SEQ ID NO: 2391064 - DNA, 18 bp, Homo sapiens
tggtctgagcaccccctc

SEQ ID NO: 2391065 - DNA, 20 bp, Homo sapiens
tggtctgagcaccccctcat

SEQ ID NO: 2391066 - DNA, 18 bp, Homo sapiens
tggtgcagaggtgagcag

SEQ ID NO: 2391067 - DNA, 19 bp, Homo sapiens
tggtgcagaggtgagcaga

SEQ ID NO: 2391068 - DNA, 12 bp, Homo sapiens
tggtgctgtggc

SEQ ID NO: 2391069 - DNA, 18 bp, Homo sapiens
tggtgtgaccctctgaat

SEQ ID NO: 2391070 - DNA, 20 bp, Homo sapiens
tggtttccacgatgaaaaac

SEQ ID NO: 2391071 - DNA, 21 bp, Homo sapiens
tggtttccacgatgaaaaact

SEQ ID NO: 2391072 - DNA, 13 bp, Homo sapiens
tgtaacttcaaat

SEQ ID NO: 2391073 - DNA, 12 bp, Homo sapiens
tgtaccagtgtg

SEQ ID NO: 2391074 - DNA, 16 bp, Homo sapiens
tgtacccactcctcac

SEQ ID NO: 2391075 - DNA, 14 bp, Homo sapiens
acgcctgcccagcc

SEQ ID NO: 2391076 - DNA, 16 bp, Homo sapiens
acggtttcaaaccagg

SEQ ID NO: 2391077 - DNA, 17 bp, Homo sapiens
acgttatatattgtatt

SEQ ID NO: 2391078 - DNA, 22 bp, Homo sapiens
actaataaaagcataaatgcaa

SEQ ID NO: 2391079 - DNA, 20 bp, Homo sapiens
actatagcccaggtcctctg

SEQ ID NO: 2391080 - DNA, 16 bp, Homo sapiens
actatcaatatttaag

SEQ ID NO: 2391081 - DNA, 22 bp, Homo sapiens
actcagctccagaataccttct

SEQ ID NO: 2391082 - DNA, 19 bp, Homo sapiens
actccccaggccaggccac

SEQ ID NO: 2391083 - DNA, 19 bp, Homo sapiens
actcctcactgccccacca

SEQ ID NO: 2391084 - DNA, 20 bp, Homo sapiens
actcctcactgccccaccag

SEQ ID NO: 2391085 - DNA, 20 bp, Homo sapiens
actcgggaggctgagacagg

SEQ ID NO: 2391086 - DNA, 22 bp, Homo sapiens
actctcaggatcaagaaagtgt

SEQ ID NO: 2391087 - DNA, 17 bp, Homo sapiens
actctcccctccctctt

SEQ ID NO: 2391088 - DNA, 19 bp, Homo sapiens
actctgggaaataagagag

SEQ ID NO: 2391089 - DNA, 17 bp, Homo sapiens
actgaagttaacagaga

SEQ ID NO: 2391090 - DNA, 16 bp, Homo sapiens
actgagaaatgaatgc

SEQ ID NO: 2391091 - DNA, 13 bp, Homo sapiens
actgatttctcac

SEQ ID NO: 2391092 - DNA, 19 bp, Homo sapiens
actggaggtcacattcagg

SEQ ID NO: 2391093 - DNA, 21 bp, Homo sapiens
actggtgactgcgatcttcag

SEQ ID NO: 2391094 - DNA, 11 bp, Homo sapiens
actgtgactga

SEQ ID NO: 2391095 - DNA, 15 bp, Homo sapiens
acttaaaaaaatgac

SEQ ID NO: 2391096 - DNA, 16 bp, Homo sapiens
acttaaaaaaatgaca

SEQ ID NO: 2391097 - DNA, 17 bp, Homo sapiens
acttaaaaaaatgacag

SEQ ID NO: 2391098 - DNA, 23 bp, Homo sapiens
acttaaaaaacttgtaaatgctg

SEQ ID NO: 2391099 - DNA, 17 bp, Homo sapiens
acttcaaatatagagat

SEQ ID NO: 2391100 - DNA, 16 bp, Homo sapiens
acttgaatcaaagcag

SEQ ID NO: 2391101 - DNA, 14 bp, Homo sapiens
acttgtaaatgctg

SEQ ID NO: 2391102 - DNA, 15 bp, Homo sapiens
actttaaccctctct

SEQ ID NO: 2391103 - DNA, 18 bp, Homo sapiens
actttaaccctctcttcc

SEQ ID NO: 2391104 - DNA, 21 bp, Homo sapiens
agaaaactcctttagcaggtg

SEQ ID NO: 2391105 - DNA, 12 bp, Homo sapiens
agaaagaagaga

SEQ ID NO: 2391106 - DNA, 13 bp, Homo sapiens
agaaagaagagac

SEQ ID NO: 2391107 - DNA, 13 bp, Homo sapiens
agaaatgaatgct

SEQ ID NO: 2391108 - DNA, 13 bp, Homo sapiens
agaacagcagagg

SEQ ID NO: 2391109 - DNA, 19 bp, Homo sapiens
agaagaatccgagtgtttg

SEQ ID NO: 2391110 - DNA, 12 bp, Homo sapiens
agaagagacagg

SEQ ID NO: 2391111 - DNA, 22 bp, Homo sapiens
agaagaggctggtgctgtggcc

SEQ ID NO: 2391112 - DNA, 16 bp, Homo sapiens
agaagagtcaggaagg

SEQ ID NO: 2391113 - DNA, 14 bp, Homo sapiens
agaagggagaagga

SEQ ID NO: 2391114 - DNA, 23 bp, Homo sapiens
agaagggggattggagggaagac

SEQ ID NO: 2391115 - DNA, 19 bp, Homo sapiens
agacaggagggcaagggcc

SEQ ID NO: 2391116 - DNA, 16 bp, Homo sapiens
agacctatttgacata

SEQ ID NO: 2391117 - DNA, 17 bp, Homo sapiens
agacctgacaagcactg

SEQ ID NO: 2391118 - DNA, 15 bp, Homo sapiens
agactcagctccaga

SEQ ID NO: 2391119 - DNA, 14 bp, Homo sapiens
agactttctcagtg

SEQ ID NO: 2391120 - DNA, 14 bp, Homo sapiens
agagaaagaagaga

SEQ ID NO: 2391121 - DNA, 16 bp, Homo sapiens
agagaaagaagagaca

SEQ ID NO: 2391122 - DNA, 19 bp, Homo sapiens
agagaccccttcctttcct

SEQ ID NO: 2391123 - DNA, 21 bp, Homo sapiens
agagaccccttcctttcctct

SEQ ID NO: 2391124 - DNA, 13 bp, Homo sapiens
agagcagagagca

SEQ ID NO: 2391125 - DNA, 22 bp, Homo sapiens
agagcaggggtccttggtgtga

SEQ ID NO: 2391126 - DNA, 14 bp, Homo sapiens
agagcctggagaag

SEQ ID NO: 2391127 - DNA, 17 bp, Homo sapiens
agagcctggagaagctg

SEQ ID NO: 2391128 - DNA, 16 bp, Homo sapiens
agagcctggggcatcc

SEQ ID NO: 2391129 - DNA, 20 bp, Homo sapiens
agagccttctcctgcctaca

SEQ ID NO: 2391130 - DNA, 21 bp, Homo sapiens
agagccttctcctgcctacat

SEQ ID NO: 2391131 - DNA, 23 bp, Homo sapiens
agagcctttggatgaccagaaca

SEQ ID NO: 2391132 - DNA, 14 bp, Homo sapiens
agagctgctctgga

SEQ ID NO: 2391133 - DNA, 15 bp, Homo sapiens
agagctgctctggaa

SEQ ID NO: 2391134 - DNA, 22 bp, Homo sapiens
agagctgctctggaaaatgtga

SEQ ID NO: 2391135 - DNA, 23 bp, Homo sapiens
agagctgctctggaaaatgtgac

SEQ ID NO: 2391136 - DNA, 16 bp, Homo sapiens
agaggaaaaaaatgac

SEQ ID NO: 2391137 - DNA, 14 bp, Homo sapiens
agaggagaaactga

SEQ ID NO: 2391138 - DNA, 19 bp, Homo sapiens
agaggagtccagggcggga

SEQ ID NO: 2391139 - DNA, 13 bp, Homo sapiens
agaggcagagaaa

SEQ ID NO: 2391140 - DNA, 22 bp, Homo sapiens
agaggcagagaaagaagagaca

SEQ ID NO: 2391141 - DNA, 13 bp, Homo sapiens
agaggtgagcaga

SEQ ID NO: 2391142 - DNA, 16 bp, Homo sapiens
agagtacagtgagcca

SEQ ID NO: 2391143 - DNA, 18 bp, Homo sapiens
agagtgggctgcatctgg

SEQ ID NO: 2391144 - DNA, 12 bp, Homo sapiens
agatatttttgt

SEQ ID NO: 2391145 - DNA, 14 bp, Homo sapiens
agatatttttgtac

SEQ ID NO: 2391146 - DNA, 22 bp, Homo sapiens
agatattttttcagaaatatgt

SEQ ID NO: 2391147 - DNA, 20 bp, Homo sapiens
agatcgcgccactgcactcc

SEQ ID NO: 2391148 - DNA, 23 bp, Homo sapiens
agatgaaagaggaggtttggggt

SEQ ID NO: 2391149 - DNA, 17 bp, Homo sapiens
agatggaaagaaagcac

SEQ ID NO: 2391150 - DNA, 20 bp, Homo sapiens
agatggcgagcatcctggcc

SEQ ID NO: 2391151 - DNA, 22 bp, Homo sapiens
agatgggtctggctgagctgaa

SEQ ID NO: 2391152 - DNA, 18 bp, Homo sapiens
agatgtctaatagttatt

SEQ ID NO: 2391153 - DNA, 22 bp, Homo sapiens
agattgaggcctgccctcaggg

SEQ ID NO: 2391154 - DNA, 18 bp, Homo sapiens
agattttttttgtaactt

SEQ ID NO: 2391155 - DNA, 19 bp, Homo sapiens
agattttttttgtaacttc

SEQ ID NO: 2391156 - DNA, 15 bp, Homo sapiens
agcaaagcaccagct

SEQ ID NO: 2391157 - DNA, 17 bp, Homo sapiens
agcaacacaagctggaa

SEQ ID NO: 2391158 - DNA, 20 bp, Homo sapiens
agcaacacaagctggaagca

SEQ ID NO: 2391159 - DNA, 23 bp, Homo sapiens
agcaagagctggcaaaggtggct

SEQ ID NO: 2391160 - DNA, 21 bp, Homo sapiens
agcaagttctagagaagaggc

SEQ ID NO: 2391161 - DNA, 14 bp, Homo sapiens
agcaattctaccca

SEQ ID NO: 2391162 - DNA, 14 bp, Homo sapiens
agcaccccctcatt

SEQ ID NO: 2391163 - DNA, 21 bp, Homo sapiens
agcacctgcttcatgctcagc

SEQ ID NO: 2391164 - DNA, 20 bp, Homo sapiens
agcactttaaccctctcttc

SEQ ID NO: 2391165 - DNA, 19 bp, Homo sapiens
agcactttgggaggccaag

SEQ ID NO: 2391166 - DNA, 21 bp, Homo sapiens
agcactttgggaggccaaggt

SEQ ID NO: 2391167 - DNA, 22 bp, Homo sapiens
agcactttgggaggccaaggtg

SEQ ID NO: 2391168 - DNA, 17 bp, Homo sapiens
agcagaggagtccaggg

SEQ ID NO: 2391169 - DNA, 17 bp, Homo sapiens
agcagatggaaagaaag

SEQ ID NO: 2391170 - DNA, 22 bp, Homo sapiens
agcaggggtccttggtgtgacc

SEQ ID NO: 2391171 - DNA, 18 bp, Homo sapiens
agcaggtggtcctgagac

SEQ ID NO: 2391172 - DNA, 20 bp, Homo sapiens
agcaggtggtcctgagacct

SEQ ID NO: 2391173 - DNA, 21 bp, Homo sapiens
agcaggtggtcctgagacctg

SEQ ID NO: 2391174 - DNA, 14 bp, Homo sapiens
agcataaatgcaaa

SEQ ID NO: 2391175 - DNA, 19 bp, Homo sapiens
agccaagatcgcgccactg

SEQ ID NO: 2391176 - DNA, 23 bp, Homo sapiens
agccacatccctttgaaacaaga

SEQ ID NO: 2391177 - DNA, 12 bp, Homo sapiens
agccacctcttg

SEQ ID NO: 2391178 - DNA, 22 bp, Homo sapiens
agccagaaggggcacgcctgcc

SEQ ID NO: 2391179 - DNA, 14 bp, Homo sapiens
agccagctctctct

SEQ ID NO: 2391180 - DNA, 16 bp, Homo sapiens
agccaggaggagagga

SEQ ID NO: 2391181 - DNA, 12 bp, Homo sapiens
agccagggccag

SEQ ID NO: 2391182 - DNA, 18 bp, Homo sapiens
agccaggtaatgagggac

SEQ ID NO: 2391183 - DNA, 17 bp, Homo sapiens
agccatttgttggggca

SEQ ID NO: 2391184 - DNA, 11 bp, Homo sapiens
agcccagcctc

SEQ ID NO: 2391185 - DNA, 16 bp, Homo sapiens
agccccgggcctgcct

SEQ ID NO: 2391186 - DNA, 15 bp, Homo sapiens
aacgttttgaactaa

SEQ ID NO: 2391187 - DNA, 14 bp, Homo sapiens
aactaataaaagca

SEQ ID NO: 2391188 - DNA, 16 bp, Homo sapiens
aactatcaatatttaa

SEQ ID NO: 2391189 - DNA, 18 bp, Homo sapiens
aactatcaatatttaagt

SEQ ID NO: 2391190 - DNA, 19 bp, Homo sapiens
aactatcaatatttaagtt

SEQ ID NO: 2391191 - DNA, 15 bp, Homo sapiens
aactcaccatgtaaa

SEQ ID NO: 2391192 - DNA, 16 bp, Homo sapiens
aactcaccatgtaaaa

SEQ ID NO: 2391193 - DNA, 19 bp, Homo sapiens
agccccgggcctgcctctg

SEQ ID NO: 2391194 - DNA, 18 bp, Homo sapiens
agcctcactattacttga

SEQ ID NO: 2391195 - DNA, 23 bp, Homo sapiens
agcctcactattacttgaacttt

SEQ ID NO: 2391196 - DNA, 13 bp, Homo sapiens
agccttctcctgc

SEQ ID NO: 2391197 - DNA, 21 bp, Homo sapiens
agcgctttctggaaaagagga

SEQ ID NO: 2391198 - DNA, 21 bp, Homo sapiens
agctcacccaataaacattaa

SEQ ID NO: 2391199 - DNA, 14 bp, Homo sapiens
agctgctctggaaa

SEQ ID NO: 2391200 - DNA, 13 bp, Homo sapiens
agctgtgtgaaat

SEQ ID NO: 2391201 - DNA, 14 bp, Homo sapiens
agctgtgtgaaata

SEQ ID NO: 2391202 - DNA, 23 bp, Homo sapiens
agcttctattatagccacatccc

SEQ ID NO: 2391203 - DNA, 14 bp, Homo sapiens
agcttctccaggct

SEQ ID NO: 2391204 - DNA, 15 bp, Homo sapiens
agcttctccaggctc

SEQ ID NO: 2391205 - DNA, 23 bp, Homo sapiens
agcttctccaggctctttggggt

SEQ ID NO: 2391206 - DNA, 18 bp, Homo sapiens
aggaaaagtgcaatgcgt

SEQ ID NO: 2391207 - DNA, 13 bp, Homo sapiens
aggaactctggct

SEQ ID NO: 2391208 - DNA, 18 bp, Homo sapiens
aggaactctggcttccag

SEQ ID NO: 2391209 - DNA, 19 bp, Homo sapiens
aggaactctggcttccagg

SEQ ID NO: 2391210 - DNA, 15 bp, Homo sapiens
aggaagatgaaagag

SEQ ID NO: 2391211 - DNA, 16 bp, Homo sapiens
aggaatgcctgtgtga

SEQ ID NO: 2391212 - DNA, 23 bp, Homo sapiens
aggaccaggactatagcccaggt

SEQ ID NO: 2391213 - DNA, 19 bp, Homo sapiens
aggactacgttaagggaag

SEQ ID NO: 2391214 - DNA, 13 bp, Homo sapiens
aggactccccagg

SEQ ID NO: 2391215 - DNA, 13 bp, Homo sapiens
aggagaaactgag

SEQ ID NO: 2391216 - DNA, 18 bp, Homo sapiens
aggagacaagaaatccag

SEQ ID NO: 2391217 - DNA, 23 bp, Homo sapiens
aggaggtttggggtctgccacca

SEQ ID NO: 2391218 - DNA, 21 bp, Homo sapiens
aggagtgagatcattttctta

SEQ ID NO: 2391219 - DNA, 16 bp, Homo sapiens
aggagtgtgagaatca

SEQ ID NO: 2391220 - DNA, 19 bp, Homo sapiens
aggagtttcgaggtagagt

SEQ ID NO: 2391221 - DNA, 15 bp, Homo sapiens
aggatcaagaaagtg

SEQ ID NO: 2391222 - DNA, 22 bp, Homo sapiens
aggatcctattctcaccaggaa

SEQ ID NO: 2391223 - DNA, 17 bp, Homo sapiens
aggattttgtgtttttt

SEQ ID NO: 2391224 - DNA, 16 bp, Homo sapiens
aggcaccccctggaga

SEQ ID NO: 2391225 - DNA, 17 bp, Homo sapiens
aggcaccccctggagag

SEQ ID NO: 2391226 - DNA, 19 bp, Homo sapiens
aggcaccccctggagagaa

SEQ ID NO: 2391227 - DNA, 13 bp, Homo sapiens
aggcagagaaaga

SEQ ID NO: 2391228 - DNA, 19 bp, Homo sapiens
aggcagagaaagaagagac

SEQ ID NO: 2391229 - DNA, 15 bp, Homo sapiens
aggcaggggtgggag

SEQ ID NO: 2391230 - DNA, 16 bp, Homo sapiens
aggcaggggtgggaga

SEQ ID NO: 2391231 - DNA, 18 bp, Homo sapiens
aggcaggggtgggagagc

SEQ ID NO: 2391232 - DNA, 23 bp, Homo sapiens
aggccaaaattaccaaaaatctt

SEQ ID NO: 2391233 - DNA, 22 bp, Homo sapiens
aggcctgccctcagggatcttg

SEQ ID NO: 2391234 - DNA, 17 bp, Homo sapiens
aggcgagtgccaggact

SEQ ID NO: 2391235 - DNA, 24 bp, Homo sapiens
aggcgagtgccaggactccccagg

SEQ ID NO: 2391236 - DNA, 20 bp, Homo sapiens
aggcggagagtacagtgagc

SEQ ID NO: 2391237 - DNA, 14 bp, Homo sapiens
aggctgagacagga

SEQ ID NO: 2391238 - DNA, 13 bp, Homo sapiens
aggctggagaagc

SEQ ID NO: 2391239 - DNA, 20 bp, Homo sapiens
aggctggagaagctcaccca

SEQ ID NO: 2391240 - DNA, 22 bp, Homo sapiens
aggctgggggcgggggagccaa

SEQ ID NO: 2391241 - DNA, 22 bp, Homo sapiens
aggcttaaggagaggagaaact

SEQ ID NO: 2391242 - DNA, 23 bp, Homo sapiens
aggcttaaggagaggagaaactg

SEQ ID NO: 2391243 - DNA, 18 bp, Homo sapiens
agggaaaggatattttct

SEQ ID NO: 2391244 - DNA, 18 bp, Homo sapiens
agggaaggaactctggct

SEQ ID NO: 2391245 - DNA, 23 bp, Homo sapiens
agggaaggaactctggcttccag

SEQ ID NO: 2391246 - DNA, 22 bp, Homo sapiens
agggagaaggatctagaatgtg

SEQ ID NO: 2391247 - DNA, 22 bp, Homo sapiens
agggatgtgaattgcctgcaga

SEQ ID NO: 2391248 - DNA, 17 bp, Homo sapiens
aggggtaggcagagcct

SEQ ID NO: 2391249 - DNA, 15 bp, Homo sapiens
aggggtctccctgga

SEQ ID NO: 2391250 - DNA, 19 bp, Homo sapiens
aggggtctccctggagtgc

SEQ ID NO: 2391251 - DNA, 14 bp, Homo sapiens
aggggtctgagcca

SEQ ID NO: 2391252 - DNA, 19 bp, Homo sapiens
agggtcgccacacccggct

SEQ ID NO: 2391253 - DNA, 14 bp, Homo sapiens
agggtgagagctgc

SEQ ID NO: 2391254 - DNA, 17 bp, Homo sapiens
agggtggtctgagcacc

SEQ ID NO: 2391255 - DNA, 14 bp, Homo sapiens
agggttgatcacac

SEQ ID NO: 2391256 - DNA, 22 bp, Homo sapiens
aggtaactatcaatatttaagt

SEQ ID NO: 2391257 - DNA, 13 bp, Homo sapiens
aggtaatgaggga

SEQ ID NO: 2391258 - DNA, 17 bp, Homo sapiens
aggtaatgagggactgg

SEQ ID NO: 2391259 - DNA, 17 bp, Homo sapiens
aggtagagtttgaagga

SEQ ID NO: 2391260 - DNA, 15 bp, Homo sapiens
aggtcacattcagga

SEQ ID NO: 2391261 - DNA, 18 bp, Homo sapiens
aggtcacattcaggaaga

SEQ ID NO: 2391262 - DNA, 19 bp, Homo sapiens
aggtcacattcaggaagat

SEQ ID NO: 2391263 - DNA, 21 bp, Homo sapiens
aggtcactcttcctgcaagga

SEQ ID NO: 2391264 - DNA, 23 bp, Homo sapiens
aggtcactcttcctgcaaggact

SEQ ID NO: 2391265 - DNA, 20 bp, Homo sapiens
aggtctagactttctcagtg

SEQ ID NO: 2391266 - DNA, 21 bp, Homo sapiens
aggtgcatctggggaactaga

SEQ ID NO: 2391267 - DNA, 14 bp, Homo sapiens
aggtggctctccag

SEQ ID NO: 2391268 - DNA, 22 bp, Homo sapiens
aggtggggtatttaccacagca

SEQ ID NO: 2391269 - DNA, 19 bp, Homo sapiens
aggtggtcctgagacctga

SEQ ID NO: 2391270 - DNA, 17 bp, Homo sapiens
aggtgtctgcacccagg

SEQ ID NO: 2391271 - DNA, 21 bp, Homo sapiens
aggttgacaataaatgtgctt

SEQ ID NO: 2391272 - DNA, 16 bp, Homo sapiens
aggtttggtgtgtgga

SEQ ID NO: 2391273 - DNA, 20 bp, Homo sapiens
agtagcaagttctagagaag

SEQ ID NO: 2391274 - DNA, 14 bp, Homo sapiens
agtataaaagacaa

SEQ ID NO: 2391275 - DNA, 13 bp, Homo sapiens
agtcaggaaggga

SEQ ID NO: 2391276 - DNA, 14 bp, Homo sapiens
agtgactcgagggt

SEQ ID NO: 2391277 - DNA, 13 bp, Homo sapiens
agtgccaggactc

SEQ ID NO: 2391278 - DNA, 23 bp, Homo sapiens
agtgccaggactccccaggccag

SEQ ID NO: 2391279 - DNA, 21 bp, Homo sapiens
agtgcttcttaaagagttctt

SEQ ID NO: 2391280 - DNA, 15 bp, Homo sapiens
agtgggacaaaccag

SEQ ID NO: 2391281 - DNA, 21 bp, Homo sapiens
agtgggacaaaccagagcaga

SEQ ID NO: 2391282 - DNA, 23 bp, Homo sapiens
agtggtcaaaccgcactcaccca

SEQ ID NO: 2391283 - DNA, 17 bp, Homo sapiens
agtgtgttgtctgtgca

SEQ ID NO: 2391284 - DNA, 18 bp, Homo sapiens
agtgttccctttcctact

SEQ ID NO: 2391285 - DNA, 12 bp, Homo sapiens
agttaacagaga

SEQ ID NO: 2391286 - DNA, 14 bp, Homo sapiens
agttaagagtagca

SEQ ID NO: 2391287 - DNA, 23 bp, Homo sapiens
agttacagcgagaggcagagaaa

SEQ ID NO: 2391288 - DNA, 23 bp, Homo sapiens
agttagttctctcgtaactggtt

SEQ ID NO: 2391289 - DNA, 22 bp, Homo sapiens
agttccatgaagaccacatcca

SEQ ID NO: 2391290 - DNA, 22 bp, Homo sapiens
agttccctgaacatctgtgtgt

SEQ ID NO: 2391291 - DNA, 21 bp, Homo sapiens
ggatcctattctcaccaggaa

SEQ ID NO: 2391292 - DNA, 15 bp, Homo sapiens
ggatctgtccaagga

SEQ ID NO: 2391293 - DNA, 23 bp, Homo sapiens
ggattcccaccaaggtcttcagc

SEQ ID NO: 2391294 - DNA, 15 bp, Homo sapiens
ggcaaggggtttcca

SEQ ID NO: 2391295 - DNA, 16 bp, Homo sapiens
ggcaccccctggagag

SEQ ID NO: 2391296 - DNA, 19 bp, Homo sapiens
ggcaccccctggagagaag

SEQ ID NO: 2391297 - DNA, 15 bp, Homo sapiens
ggcacgtcccatgtg

SEQ ID NO: 2391298 - DNA, 17 bp, Homo sapiens
ggcagagaaagaagaga

SEQ ID NO: 2391299 - DNA, 21 bp, Homo sapiens
ggcagagaaagaagagacagg

SEQ ID NO: 2391300 - DNA, 17 bp, Homo sapiens
ggcaggggtgggagagc

SEQ ID NO: 2391301 - DNA, 24 bp, Homo sapiens
ggcatcccatgggggtgctgcagc

SEQ ID NO: 2391302 - DNA, 16 bp, Homo sapiens
ggccactctcccctcc

SEQ ID NO: 2391303 - DNA, 21 bp, Homo sapiens
ggccactctcccctccctctt

SEQ ID NO: 2391304 - DNA, 15 bp, Homo sapiens
ggccaggccaccagg

SEQ ID NO: 2391305 - DNA, 16 bp, Homo sapiens
ggccaggccaccagga

SEQ ID NO: 2391306 - DNA, 16 bp, Homo sapiens
ggccagggtgagagct

SEQ ID NO: 2391307 - DNA, 18 bp, Homo sapiens
ggcccagagaccccttcc

SEQ ID NO: 2391308 - DNA, 21 bp, Homo sapiens
ggccccttggcgggcagccca

SEQ ID NO: 2391309 - DNA, 23 bp, Homo sapiens
ggccccttggcgggcagcccagc

SEQ ID NO: 2391310 - DNA, 17 bp, Homo sapiens
ggcctcacgcccagcct

SEQ ID NO: 2391311 - DNA, 20 bp, Homo sapiens
ggcctcacgcccagcctcct

SEQ ID NO: 2391312 - DNA, 21 bp, Homo sapiens
ggcctcacgcccagcctcctc

SEQ ID NO: 2391313 - DNA, 18 bp, Homo sapiens
ggcctgatgacagagcga

SEQ ID NO: 2391314 - DNA, 18 bp, Homo sapiens
ggcctgcctctgactcac

SEQ ID NO: 2391315 - DNA, 13 bp, Homo sapiens
ggcctggccaggc

SEQ ID NO: 2391316 - DNA, 15 bp, Homo sapiens
ggcgagtgccaggac

SEQ ID NO: 2391317 - DNA, 14 bp, Homo sapiens
ggcgctctgccctc

SEQ ID NO: 2391318 - DNA, 21 bp, Homo sapiens
ggcgctctgccctccctggcc

SEQ ID NO: 2391319 - DNA, 18 bp, Homo sapiens
ggcgggggagccaacagc

SEQ ID NO: 2391320 - DNA, 20 bp, Homo sapiens
ggcgtcgctggacaacccag

SEQ ID NO: 2391321 - DNA, 19 bp, Homo sapiens
ggctcacccaagcaaggcc

SEQ ID NO: 2391322 - DNA, 22 bp, Homo sapiens
ggctcacgcctgtaatcccagc

SEQ ID NO: 2391323 - DNA, 23 bp, Homo sapiens
ggctcacgcctgtaatcccagca

SEQ ID NO: 2391324 - DNA, 23 bp, Homo sapiens
ggctccccctgcttctcagcccc

SEQ ID NO: 2391325 - DNA, 13 bp, Homo sapiens
ggctctccagtta

SEQ ID NO: 2391326 - DNA, 22 bp, Homo sapiens
ggctgaccccaaagagcctgga

SEQ ID NO: 2391327 - DNA, 23 bp, Homo sapiens
ggctgcatctgggattcccacca

SEQ ID NO: 2391328 - DNA, 19 bp, Homo sapiens
ggctggtgctgtggccagg

SEQ ID NO: 2391329 - DNA, 15 bp, Homo sapiens
ggcttaaggagagga

SEQ ID NO: 2391330 - DNA, 14 bp, Homo sapiens
ggcttgcatgccaa

SEQ ID NO: 2391331 - DNA, 20 bp, Homo sapiens
gggaagacaggtctagactt

SEQ ID NO: 2391332 - DNA, 14 bp, Homo sapiens
gggaagctggggga

SEQ ID NO: 2391333 - DNA, 21 bp, Homo sapiens
gggaagctgggggaagggtgg

SEQ ID NO: 2391334 - DNA, 17 bp, Homo sapiens
gggaaggaactctggct

SEQ ID NO: 2391335 - DNA, 21 bp, Homo sapiens
gggaccccagctagggctgga

SEQ ID NO: 2391336 - DNA, 15 bp, Homo sapiens
gggagccaacagcag

SEQ ID NO: 2391337 - DNA, 20 bp, Homo sapiens
gggaggcggagagtacagtg

SEQ ID NO: 2391338 - DNA, 13 bp, Homo sapiens
gggcagcccagcc

SEQ ID NO: 2391339 - DNA, 14 bp, Homo sapiens
gggccgtgcccagg

SEQ ID NO: 2391340 - DNA, 14 bp, Homo sapiens
gggcgctctgccct

SEQ ID NO: 2391341 - DNA, 15 bp, Homo sapiens
gggcgggagtggggg

SEQ ID NO: 2391342 - DNA, 17 bp, Homo sapiens
ggggagccaacagcagc

SEQ ID NO: 2391343 - DNA, 18 bp, Homo sapiens
gggggtttttactccagt

SEQ ID NO: 2391344 - DNA, 18 bp, Homo sapiens
ggggtgatttcagagagg

SEQ ID NO: 2391345 - DNA, 17 bp, Homo sapiens
gggtcagccagggccag

SEQ ID NO: 2391346 - DNA, 19 bp, Homo sapiens
gggtcagccagggccaggg

SEQ ID NO: 2391347 - DNA, 20 bp, Homo sapiens
gggtcgccacacccggctcc

SEQ ID NO: 2391348 - DNA, 15 bp, Homo sapiens
gggtctccctggagt

SEQ ID NO: 2391349 - DNA, 22 bp, Homo sapiens
gggtgatttcagagagggcaga

SEQ ID NO: 2391350 - DNA, 16 bp, Homo sapiens
gggtggtctgagcacc

SEQ ID NO: 2391351 - DNA, 18 bp, Homo sapiens
gggttctgggagttccct

SEQ ID NO: 2391352 - DNA, 16 bp, Homo sapiens
gggttctttggaagga

SEQ ID NO: 2391353 - DNA, 21 bp, Homo sapiens
gggttgggttcatctgagcaa

SEQ ID NO: 2391354 - DNA, 23 bp, Homo sapiens
ggtaaaagtgtgagcagtgagtt

SEQ ID NO: 2391355 - DNA, 23 bp, Homo sapiens
ggtagagtttgaaggaggtgagg

SEQ ID NO: 2391356 - DNA, 14 bp, Homo sapiens
ggtaggcagagcct

SEQ ID NO: 2391357 - DNA, 16 bp, Homo sapiens
ggtccacccagcaaag

SEQ ID NO: 2391358 - DNA, 21 bp, Homo sapiens
ggtccagggttgatcacactc

SEQ ID NO: 2391359 - DNA, 13 bp, Homo sapiens
ggtcgccacaccc

SEQ ID NO: 2391360 - DNA, 16 bp, Homo sapiens
ggtcgccacacccggc

SEQ ID NO: 2391361 - DNA, 17 bp, Homo sapiens
ggtcgccacacccggct

SEQ ID NO: 2391362 - DNA, 16 bp, Homo sapiens
ggtctgagcaccccct

SEQ ID NO: 2391363 - DNA, 19 bp, Homo sapiens
ggtctttcctatcatggag

SEQ ID NO: 2391364 - DNA, 18 bp, Homo sapiens
ggtgcagttgacagcagg

SEQ ID NO: 2391365 - DNA, 17 bp, Homo sapiens
ggtgctataggctggag

SEQ ID NO: 2391366 - DNA, 21 bp, Homo sapiens
ggtgctataggctggagaagc

SEQ ID NO: 2391367 - DNA, 16 bp, Homo sapiens
tatttttgtacgttat

SEQ ID NO: 2391368 - DNA, 19 bp, Homo sapiens
tcaaaagaatcagaaacag

SEQ ID NO: 2391369 - DNA, 19 bp, Homo sapiens
tcaacctctctccttctgg

SEQ ID NO: 2391370 - DNA, 23 bp, Homo sapiens
tcaactgaaaagactcagtgttc

SEQ ID NO: 2391371 - DNA, 20 bp, Homo sapiens
tcaagattttttttgtaact

SEQ ID NO: 2391372 - DNA, 22 bp, Homo sapiens
tcaagattttttttgtaacttc

SEQ ID NO: 2391373 - DNA, 15 bp, Homo sapiens
tcaagtgtcatatgt

SEQ ID NO: 2391374 - DNA, 12 bp, Homo sapiens
tcaatatttaag

SEQ ID NO: 2391375 - DNA, 13 bp, Homo sapiens
tcacactctgggt

SEQ ID NO: 2391376 - DNA, 22 bp, Homo sapiens
tcacagtgtttgcaatggtgtt

SEQ ID NO: 2391377 - DNA, 23 bp, Homo sapiens
tcacagtgtttgcaatggtgttg

SEQ ID NO: 2391378 - DNA, 19 bp, Homo sapiens
tcacccaagcaaggccaaa

SEQ ID NO: 2391379 - DNA, 23 bp, Homo sapiens
tcacgcccagcctcctcccacca

SEQ ID NO: 2391380 - DNA, 20 bp, Homo sapiens
tcacgcctgtaatcccagca

SEQ ID NO: 2391381 - DNA, 18 bp, Homo sapiens
tcactcttcctgcaagga

SEQ ID NO: 2391382 - DNA, 20 bp, Homo sapiens
tcactgccccaccagccacc

SEQ ID NO: 2391383 - DNA, 21 bp, Homo sapiens
tcactgccccaccagccacct

SEQ ID NO: 2391384 - DNA, 16 bp, Homo sapiens
tcactggcaatgaaaa

SEQ ID NO: 2391385 - DNA, 21 bp, Homo sapiens
tcagatattttttcagaaata

SEQ ID NO: 2391386 - DNA, 12 bp, Homo sapiens
tcagccagggcc

SEQ ID NO: 2391387 - DNA, 18 bp, Homo sapiens
tcagccatcaacaagagt

SEQ ID NO: 2391388 - DNA, 19 bp, Homo sapiens
tcaggaagggaaagccaga

SEQ ID NO: 2391389 - DNA, 20 bp, Homo sapiens
tcagggtgggccactctccc

SEQ ID NO: 2391390 - DNA, 21 bp, Homo sapiens
tcatccctatgggattcagtg

SEQ ID NO: 2391391 - DNA, 13 bp, Homo sapiens
tcattcccctcgt

SEQ ID NO: 2391392 - DNA, 12 bp, Homo sapiens
tccaaggagttc

SEQ ID NO: 2391393 - DNA, 18 bp, Homo sapiens
tccaatggagttcagaga

SEQ ID NO: 2391394 - DNA, 15 bp, Homo sapiens
tccacacacgcagga

SEQ ID NO: 2391395 - DNA, 12 bp, Homo sapiens
tccacccagcaa

SEQ ID NO: 2391396 - DNA, 23 bp, Homo sapiens
tccaggctctttggggtcagcca

SEQ ID NO: 2391397 - DNA, 17 bp, Homo sapiens
tccaggtatctccagga

SEQ ID NO: 2391398 - DNA, 18 bp, Homo sapiens
tccaggtatctccaggat

SEQ ID NO: 2391399 - DNA, 14 bp, Homo sapiens
tccagtttcccacc

SEQ ID NO: 2391400 - DNA, 18 bp, Homo sapiens
tcccaccaccctcccacc

SEQ ID NO: 2391401 - DNA, 20 bp, Homo sapiens
tcccaccatgcgctgctcaa

SEQ ID NO: 2391402 - DNA, 20 bp, Homo sapiens
tcccagccactcgggaggct

SEQ ID NO: 2391403 - DNA, 15 bp, Homo sapiens
tccccaccttcccca

SEQ ID NO: 2391404 - DNA, 16 bp, Homo sapiens
tccccagactcagctc

SEQ ID NO: 2391405 - DNA, 22 bp, Homo sapiens
tccccaggccaggccaccagga

SEQ ID NO: 2391406 - DNA, 21 bp, Homo sapiens
tccctctgagaattccaagga

SEQ ID NO: 2391407 - DNA, 16 bp, Homo sapiens
tccctcttccttcccc

SEQ ID NO: 2391408 - DNA, 17 bp, Homo sapiens
tccctctttgcctgtgt

SEQ ID NO: 2391409 - DNA, 16 bp, Homo sapiens
tccctggtgcagaggt

SEQ ID NO: 2391410 - DNA, 19 bp, Homo sapiens
tccggcggcgagctctggc

SEQ ID NO: 2391411 - DNA, 14 bp, Homo sapiens
tcctacaaagatgt

SEQ ID NO: 2391412 - DNA, 16 bp, Homo sapiens
tcctattctcaccagg

SEQ ID NO: 2391413 - DNA, 18 bp, Homo sapiens
tcctattctcaccaggaa

SEQ ID NO: 2391414 - DNA, 20 bp, Homo sapiens
tcctattctcaccaggaagg

SEQ ID NO: 2391415 - DNA, 16 bp, Homo sapiens
tcctcactgccccacc

SEQ ID NO: 2391416 - DNA, 19 bp, Homo sapiens
tcctcactgccccaccagc

SEQ ID NO: 2391417 - DNA, 15 bp, Homo sapiens
tcctcccaccaccct

SEQ ID NO: 2391418 - DNA, 24 bp, Homo sapiens
tcctcccaccaccctcccaccatg

SEQ ID NO: 2391419 - DNA, 17 bp, Homo sapiens
tcctccccaccttcccc

SEQ ID NO: 2391420 - DNA, 23 bp, Homo sapiens
tcctccccaccttccccagactc

SEQ ID NO: 2391421 - DNA, 15 bp, Homo sapiens
tcctctgcagcactt

SEQ ID NO: 2391422 - DNA, 22 bp, Homo sapiens
tcctgtagctctcctggggttc

SEQ ID NO: 2391423 - DNA, 22 bp, Homo sapiens
tccttcccccatcccctttcct

SEQ ID NO: 2391424 - DNA, 11 bp, Homo sapiens
tcctttcctct

SEQ ID NO: 2391425 - DNA, 15 bp, Homo sapiens
tcctttcctctgcag

SEQ ID NO: 2391426 - DNA, 22 bp, Homo sapiens
tcgccacacccggctccccctg

SEQ ID NO: 2391427 - DNA, 17 bp, Homo sapiens
tcgctggacaacccaga

SEQ ID NO: 2391428 - DNA, 18 bp, Homo sapiens
tcgctggacaacccagaa

SEQ ID NO: 2391429 - DNA, 14 bp, Homo sapiens
tctacccagagcct

SEQ ID NO: 2391430 - DNA, 16 bp, Homo sapiens
tctagagaagaggctg

SEQ ID NO: 2391431 - DNA, 20 bp, Homo sapiens
tctcagccccgggcctgcct

SEQ ID NO: 2391432 - DNA, 13 bp, Homo sapiens
tctcccctccctc

SEQ ID NO: 2391433 - DNA, 17 bp, Homo sapiens
tctcccctccctcttcc

SEQ ID NO: 2391434 - DNA, 17 bp, Homo sapiens
tctccgactgctaggga

SEQ ID NO: 2391435 - DNA, 18 bp, Homo sapiens
tctctacccggcccagag

SEQ ID NO: 2391436 - DNA, 14 bp, Homo sapiens
tctctccttctggc

SEQ ID NO: 2391437 - DNA, 18 bp, Homo sapiens
tctgagaattccaaggag

SEQ ID NO: 2391438 - DNA, 16 bp, Homo sapiens
tctgagcaagagctgg

SEQ ID NO: 2391439 - DNA, 15 bp, Homo sapiens
tctgagcttcagtat

SEQ ID NO: 2391440 - DNA, 18 bp, Homo sapiens
tctgattggctcacccaa

SEQ ID NO: 2391441 - DNA, 16 bp, Homo sapiens
tctgccctccctggcc

SEQ ID NO: 2391442 - DNA, 18 bp, Homo sapiens
tctgccctccctggcctc

SEQ ID NO: 2391443 - DNA, 15 bp, Homo sapiens
tgggtggtggatctg

SEQ ID NO: 2391444 - DNA, 17 bp, Homo sapiens
tgggttctttggaagga

SEQ ID NO: 2391445 - DNA, 13 bp, Homo sapiens
tggtaagctctgg

SEQ ID NO: 2391446 - DNA, 16 bp, Homo sapiens
tggtatgagctgaggg

SEQ ID NO: 2391447 - DNA, 20 bp, Homo sapiens
tggtcaaaccgcactcaccc

SEQ ID NO: 2391448 - DNA, 14 bp, Homo sapiens
tggtcctgagacct

SEQ ID NO: 2391449 - DNA, 22 bp, Homo sapiens
tggtgctataggctggagaagc

SEQ ID NO: 2391450 - DNA, 21 bp, Homo sapiens
tgtaaaatcttggcacagaaa

SEQ ID NO: 2391451 - DNA, 12 bp, Homo sapiens
tgtaacttcaaa

SEQ ID NO: 2391452 - DNA, 14 bp, Homo sapiens
tgtaacttcaaata

SEQ ID NO: 2391453 - DNA, 14 bp, Homo sapiens
tgtaccagtgtgaa

SEQ ID NO: 2391454 - DNA, 19 bp, Homo sapiens
tgtagttcttgtctgattg

SEQ ID NO: 2391455 - DNA, 14 bp, Homo sapiens
tgtataatctattt

SEQ ID NO: 2391456 - DNA, 23 bp, Homo sapiens
tgtatattatggaagattttaaa

SEQ ID NO: 2391457 - DNA, 19 bp, Homo sapiens
tgtatattgtcagatattt

SEQ ID NO: 2391458 - DNA, 13 bp, Homo sapiens
tgtcaagattttt

SEQ ID NO: 2391459 - DNA, 19 bp, Homo sapiens
tgtcaatttccctgactcc

SEQ ID NO: 2391460 - DNA, 23 bp, Homo sapiens
tgtcagatattttttcagaaata

SEQ ID NO: 2391461 - DNA, 16 bp, Homo sapiens
tgtcataagaatgaat

SEQ ID NO: 2391462 - DNA, 21 bp, Homo sapiens
tgtcatatgtaggtgtctgca

SEQ ID NO: 2391463 - DNA, 14 bp, Homo sapiens
tgtcccctcttgac

SEQ ID NO: 2391464 - DNA, 20 bp, Homo sapiens
tgtccctctttgcctgtgtg

SEQ ID NO: 2391465 - DNA, 17 bp, Homo sapiens
tgtccctggtgcagagg

SEQ ID NO: 2391466 - DNA, 13 bp, Homo sapiens
tgtctgtgcagct

SEQ ID NO: 2391467 - DNA, 15 bp, Homo sapiens
tgtctgtgcagctgc

SEQ ID NO: 2391468 - DNA, 19 bp, Homo sapiens
tgtctttgttggaaaagaa

SEQ ID NO: 2391469 - DNA, 19 bp, Homo sapiens
tgtgagcaagcatttatgt

SEQ ID NO: 2391470 - DNA, 18 bp, Homo sapiens
tgtgagcatctctgtgta

SEQ ID NO: 2391471 - DNA, 18 bp, Homo sapiens
tgtgaggcctggccaggc

SEQ ID NO: 2391472 - DNA, 22 bp, Homo sapiens
tgtgagtgtgtttgtgtgcatg

SEQ ID NO: 2391473 - DNA, 13 bp, Homo sapiens
tgtgcttatgttt

SEQ ID NO: 2391474 - DNA, 22 bp, Homo sapiens
tgtggtagggacttaaaaaact

SEQ ID NO: 2391475 - DNA, 22 bp, Homo sapiens
tgtggtgggttctttggaagga

SEQ ID NO: 2391476 - DNA, 20 bp, Homo sapiens
tgtgtgaaataccagtgtgg

SEQ ID NO: 2391477 - DNA, 17 bp, Homo sapiens
tgtgtgagcaagcattt

SEQ ID NO: 2391478 - DNA, 14 bp, Homo sapiens
tgtgtgagcatctc

SEQ ID NO: 2391479 - DNA, 16 bp, Homo sapiens
tgtgtgagcatctctg

SEQ ID NO: 2391480 - DNA, 14 bp, Homo sapiens
tgtgtgtcccccta

SEQ ID NO: 2391481 - DNA, 14 bp, Homo sapiens
tgtgttgtctgtgc

SEQ ID NO: 2391482 - DNA, 15 bp, Homo sapiens
tgtgttgtctgtgca

SEQ ID NO: 2391483 - DNA, 23 bp, Homo sapiens
tgtgttttctgaataacatttgt

SEQ ID NO: 2391484 - DNA, 16 bp, Homo sapiens
tgttaaccagaataaa

SEQ ID NO: 2391485 - DNA, 19 bp, Homo sapiens
tgttattttctttgaaatt

SEQ ID NO: 2391486 - DNA, 23 bp, Homo sapiens
tgttgaaaaaaaagtttcagaga

SEQ ID NO: 2391487 - DNA, 22 bp, Homo sapiens
tgttgtacatacagaggtaact

SEQ ID NO: 2391488 - DNA, 21 bp, Homo sapiens
tgtttaagtgttgtaaatatt

SEQ ID NO: 2391489 - DNA, 20 bp, Homo sapiens
tgtttatgtaggtacttcac

SEQ ID NO: 2391490 - DNA, 14 bp, Homo sapiens
tgtttattaacaaa

SEQ ID NO: 2391491 - DNA, 22 bp, Homo sapiens
tgtttatttataagcagattta

SEQ ID NO: 2391492 - DNA, 16 bp, Homo sapiens
tgtttgggcagaaggg

SEQ ID NO: 2391493 - DNA, 20 bp, Homo sapiens
tgtttgtgtgcatgaaagag

SEQ ID NO: 2391494 - DNA, 14 bp, Homo sapiens
ttaaaaaaatgaca

SEQ ID NO: 2391495 - DNA, 21 bp, Homo sapiens
ttaaaggggcagaaaaactct

SEQ ID NO: 2391496 - DNA, 21 bp, Homo sapiens
ttaaattataacttaaaatat

SEQ ID NO: 2391497 - DNA, 14 bp, Homo sapiens
ttaacagagacaga

SEQ ID NO: 2391498 - DNA, 16 bp, Homo sapiens
ttaaccctctcttccc

SEQ ID NO: 2391499 - DNA, 17 bp, Homo sapiens
ttaaccctctcttccct

SEQ ID NO: 2391500 - DNA, 16 bp, Homo sapiens
ttaagacgtgaatgtc

SEQ ID NO: 2391501 - DNA, 20 bp, Homo sapiens
ttaagacgtgaatgtctcag

SEQ ID NO: 2391502 - DNA, 20 bp, Homo sapiens
ttaagagtagcaagttctag

SEQ ID NO: 2391503 - DNA, 21 bp, Homo sapiens
ttaaggagaggagaaactgag

SEQ ID NO: 2391504 - DNA, 14 bp, Homo sapiens
ttacatctgtttta

SEQ ID NO: 2391505 - DNA, 18 bp, Homo sapiens
ttacatctgttttaaatt

SEQ ID NO: 2391506 - DNA, 12 bp, Homo sapiens
ttacgtgagcca

SEQ ID NO: 2391507 - DNA, 13 bp, Homo sapiens
ttactacagttgt

SEQ ID NO: 2391508 - DNA, 17 bp, Homo sapiens
ttacttgaactttccaa

SEQ ID NO: 2391509 - DNA, 18 bp, Homo sapiens
ttacttgaactttccaaa

SEQ ID NO: 2391510 - DNA, 22 bp, Homo sapiens
ttaggcgcccatggtacaagga

SEQ ID NO: 2391511 - DNA, 18 bp, Homo sapiens
ttagtgtgttgtctgtgc

SEQ ID NO: 2391512 - DNA, 22 bp, Homo sapiens
ttagtgtgttgtctgtgcagct

SEQ ID NO: 2391513 - DNA, 13 bp, Homo sapiens
ttataacttaaaa

SEQ ID NO: 2391514 - DNA, 22 bp, Homo sapiens
ttatagccacatccctttgaaa

SEQ ID NO: 2391515 - DNA, 11 bp, Homo sapiens
ttatatattgt

SEQ ID NO: 2391516 - DNA, 13 bp, Homo sapiens
ttatatattgtat

SEQ ID NO: 2391517 - DNA, 19 bp, Homo sapiens
ttatggaagattttaaatt

SEQ ID NO: 2391518 - DNA, 19 bp, Homo sapiens
ttattaacaaattatgtta

SEQ ID NO: 2391519 - DNA, 13 bp, Homo sapiens
ttattctagatta

SEQ ID NO: 2391520 - DNA, 19 bp, Homo sapiens
ttattgagaattttaaatt

SEQ ID NO: 2391521 - DNA, 14 bp, Homo sapiens
ttcaactgaaaaga

SEQ ID NO: 2391522 - DNA, 12 bp, Homo sapiens
ttcacagtgttt

SEQ ID NO: 2391523 - DNA, 20 bp, Homo sapiens
ttcagagagggcagaggggt

SEQ ID NO: 2391524 - DNA, 18 bp, Homo sapiens
ttcagttgatcactggca

SEQ ID NO: 2391525 - DNA, 16 bp, Homo sapiens
ttccaaaacctaaaga

SEQ ID NO: 2391526 - DNA, 19 bp, Homo sapiens
ttccacgatgaaaaacttc

SEQ ID NO: 2391527 - DNA, 18 bp, Homo sapiens
ttccaggtatctccagga

SEQ ID NO: 2391528 - DNA, 21 bp, Homo sapiens
ttcccagagtgtgaaacttcc

SEQ ID NO: 2391529 - DNA, 22 bp, Homo sapiens
ttccccagactcagctccagaa

SEQ ID NO: 2391530 - DNA, 20 bp, Homo sapiens
ttcccccatcccctttcctc

SEQ ID NO: 2391531 - DNA, 21 bp, Homo sapiens
ttccctattatttccgggtgg

SEQ ID NO: 2391532 - DNA, 11 bp, Homo sapiens
ttccctctgag

SEQ ID NO: 2391533 - DNA, 23 bp, Homo sapiens
ttccctctgagaattccaaggag

SEQ ID NO: 2391534 - DNA, 16 bp, Homo sapiens
ttccctgaacatctgt

SEQ ID NO: 2391535 - DNA, 20 bp, Homo sapiens
ttccctgaacatctgtgtgt

SEQ ID NO: 2391536 - DNA, 21 bp, Homo sapiens
ttccctggcctggctctcctg

SEQ ID NO: 2391537 - DNA, 23 bp, Homo sapiens
ttccttcccccatcccctttcct

SEQ ID NO: 2391538 - DNA, 12 bp, Homo sapiens
ttctagagaaga

SEQ ID NO: 2391539 - DNA, 20 bp, Homo sapiens
ttctgagtgtttttactaca

SEQ ID NO: 2391540 - DNA, 18 bp, Homo sapiens
ttctggaaaagaggagtt

SEQ ID NO: 2391541 - DNA, 19 bp, Homo sapiens
ttctggctgaacactggca

SEQ ID NO: 2391542 - DNA, 15 bp, Homo sapiens
ttcttatcttctgca

SEQ ID NO: 2391543 - DNA, 21 bp, Homo sapiens
ttcttcattcaatacaagtgt

SEQ ID NO: 2391544 - DNA, 21 bp, Homo sapiens
ttcttgcctactatgccagat

SEQ ID NO: 2391545 - DNA, 19 bp, Homo sapiens
ttcttgtctgattggctca

SEQ ID NO: 2391546 - DNA, 15 bp, Homo sapiens
ttctttgaaattgtt

SEQ ID NO: 2391547 - DNA, 23 bp, Homo sapiens
ttcttttgcccttcacagtgttt

SEQ ID NO: 2391548 - DNA, 18 bp, Homo sapiens
ttgaaggaggtgagggat

SEQ ID NO: 2391549 - DNA, 18 bp, Homo sapiens
ttgaagggtaaagaagtt

SEQ ID NO: 2391550 - DNA, 19 bp, Homo sapiens
ttgaatatattataatctt

SEQ ID NO: 2391551 - DNA, 18 bp, Homo sapiens
ttgacaataaatgtgctt

SEQ ID NO: 2391552 - DNA, 13 bp, Homo sapiens
ttgaggagtgtga

SEQ ID NO: 2391553 - DNA, 14 bp, Homo sapiens
ttgagtgactcgag

SEQ ID NO: 2391554 - DNA, 18 bp, Homo sapiens
ttgcccttcacagtgttt

SEQ ID NO: 2391555 - DNA, 20 bp, Homo sapiens
ttgcctgcagagagaagcct

SEQ ID NO: 2391556 - DNA, 19 bp, Homo sapiens
ttgctcaggtgcaagtgcc

SEQ ID NO: 2391557 - DNA, 20 bp, Homo sapiens
ttgctggtgtctgagcttca

SEQ ID NO: 2391558 - DNA, 22 bp, Homo sapiens
ttggccgggtgcggtggctcac

SEQ ID NO: 2391559 - DNA, 12 bp, Homo sapiens
ttggctcaccca

SEQ ID NO: 2391560 - DNA, 13 bp, Homo sapiens
ttggggtcagcca

SEQ ID NO: 2391561 - DNA, 16 bp, Homo sapiens
ttggtgtgtggagatg

SEQ ID NO: 2391562 - DNA, 13 bp, Homo sapiens
ttgtaaatattta

SEQ ID NO: 2391563 - DNA, 15 bp, Homo sapiens
ttgtaacttcaaata

SEQ ID NO: 2391564 - DNA, 16 bp, Homo sapiens
ttgtacgttatatatt

SEQ ID NO: 2391565 - DNA, 21 bp, Homo sapiens
ttgtatattatggaagatttt

SEQ ID NO: 2391566 - DNA, 16 bp, Homo sapiens
ttgtatattgtcagat

SEQ ID NO: 2391567 - DNA, 14 bp, Homo sapiens
ttgtcccctcttga

SEQ ID NO: 2391568 - DNA, 18 bp, Homo sapiens
ttgtccctggtgcagagg

SEQ ID NO: 2391569 - DNA, 20 bp, Homo sapiens
tttaaaagcaattatattgt

SEQ ID NO: 2391570 - DNA, 16 bp, Homo sapiens
tttaaaggggcagaaa

SEQ ID NO: 2391571 - DNA, 20 bp, Homo sapiens
tttaaattataacttaaaat

SEQ ID NO: 2391572 - DNA, 19 bp, Homo sapiens
tttaaattcacaatagaaa

SEQ ID NO: 2391573 - DNA, 22 bp, Homo sapiens
tttaacgaatgaagatgtctaa

SEQ ID NO: 2391574 - DNA, 20 bp, Homo sapiens
tttataagcagatttaacaa

SEQ ID NO: 2391575 - DNA, 14 bp, Homo sapiens
tttattgagaattt

SEQ ID NO: 2391576 - DNA, 20 bp, Homo sapiens
tttcagaaatatgtggtttc

SEQ ID NO: 2391577 - DNA, 21 bp, Homo sapiens
tttcagttgatcactggcaat

SEQ ID NO: 2391578 - DNA, 13 bp, Homo sapiens
tttcccaccacct

SEQ ID NO: 2391579 - DNA, 14 bp, Homo sapiens
tttcctccccacct

SEQ ID NO: 2391580 - DNA, 17 bp, Homo sapiens
tttcctccccaccttcc

SEQ ID NO: 2391581 - DNA, 19 bp, Homo sapiens
tttcctccccaccttcccc

SEQ ID NO: 2391582 - DNA, 14 bp, Homo sapiens
tttcctctgcagca

SEQ ID NO: 2391583 - DNA, 15 bp, Homo sapiens
tttcgctttcctctg

SEQ ID NO: 2391584 - DNA, 19 bp, Homo sapiens
tttgcctgtgtgagcatct

SEQ ID NO: 2391585 - DNA, 11 bp, Homo sapiens
tttgtaacttc

SEQ ID NO: 2391586 - DNA, 18 bp, Homo sapiens
tttgtacgttatatattg

SEQ ID NO: 2391587 - DNA, 16 bp, Homo sapiens
ttttaaagtatatatt

SEQ ID NO: 2391588 - DNA, 15 bp, Homo sapiens
ttttactccagtggt

SEQ ID NO: 2391589 - DNA, 14 bp, Homo sapiens
ttttctttgaaatt

SEQ ID NO: 2391590 - DNA, 20 bp, Homo sapiens
ttttgaactaataaaagcat

SEQ ID NO: 2391591 - DNA, 15 bp, Homo sapiens
ttttgtaacttcaaa

SEQ ID NO: 2391592 - DNA, 14 bp, Homo sapiens
tttttcagaaatat

SEQ ID NO: 2391593 - DNA, 21 bp, Homo sapiens
tttttgtacgttatatattgt

SEQ ID NO: 2391594 - DNA, 14 bp, Homo sapiens
tttttttgtaactt

SEQ ID NO: 2391595 - DNA, 19 bp, Homo sapiens
ataatttttaaagtatata

SEQ ID NO: 2391596 - DNA, 14 bp, Homo sapiens
atacacaggatcct

SEQ ID NO: 2391597 - DNA, 21 bp, Homo sapiens
atacactgaagttaacagaga

SEQ ID NO: 2391598 - DNA, 16 bp, Homo sapiens
atacagaggtaactat

SEQ ID NO: 2391599 - DNA, 15 bp, Homo sapiens
atagctctttcaggg

SEQ ID NO: 2391600 - DNA, 16 bp, Homo sapiens
ataggctggagaagct

SEQ ID NO: 2391601 - DNA, 18 bp, Homo sapiens
ataggctggagaagctca

SEQ ID NO: 2391602 - DNA, 14 bp, Homo sapiens
atatttaagtttgt

SEQ ID NO: 2391603 - DNA, 15 bp, Homo sapiens
atatttaagtttgtt

SEQ ID NO: 2391604 - DNA, 22 bp, Homo sapiens
atatttttgtacgttatatatt

SEQ ID NO: 2391605 - DNA, 23 bp, Homo sapiens
atcactggcaatgaaaaattctc

SEQ ID NO: 2391606 - DNA, 19 bp, Homo sapiens
atccacacacgcaggaact

SEQ ID NO: 2391607 - DNA, 22 bp, Homo sapiens
atccagagtttagaggaaaaaa

SEQ ID NO: 2391608 - DNA, 15 bp, Homo sapiens
atccagtttcccacc

SEQ ID NO: 2391609 - DNA, 19 bp, Homo sapiens
atccagtttcccaccacct

SEQ ID NO: 2391610 - DNA, 23 bp, Homo sapiens
atcccagagcccagggcatccca

SEQ ID NO: 2391611 - DNA, 12 bp, Homo sapiens
atcccctttcct

SEQ ID NO: 2391612 - DNA, 15 bp, Homo sapiens
atcccctttcctccc

SEQ ID NO: 2391613 - DNA, 19 bp, Homo sapiens
atcccctttcctccccacc

SEQ ID NO: 2391614 - DNA, 22 bp, Homo sapiens
atccgagtgtttgccaggctta

SEQ ID NO: 2391615 - DNA, 20 bp, Homo sapiens
atcctattctcaccaggaag

SEQ ID NO: 2391616 - DNA, 23 bp, Homo sapiens
atcgttcctatacatttctgttc

SEQ ID NO: 2391617 - DNA, 14 bp, Homo sapiens
atctatttacataa

SEQ ID NO: 2391618 - DNA, 19 bp, Homo sapiens
atctctgtgtacccactcc

SEQ ID NO: 2391619 - DNA, 22 bp, Homo sapiens
atctctgtgtacccactcctca

SEQ ID NO: 2391620 - DNA, 14 bp, Homo sapiens
atctgggactttca

SEQ ID NO: 2391621 - DNA, 19 bp, Homo sapiens
atctgtgtgtgtcccccta

SEQ ID NO: 2391622 - DNA, 16 bp, Homo sapiens
atgacagatgttgaat

SEQ ID NO: 2391623 - DNA, 23 bp, Homo sapiens
atgactaaaaatattataactta

SEQ ID NO: 2391624 - DNA, 13 bp, Homo sapiens
atgagggactgga

SEQ ID NO: 2391625 - DNA, 22 bp, Homo sapiens
atgatatgtaaacataattctt

SEQ ID NO: 2391626 - DNA, 19 bp, Homo sapiens
atgcatggtgcagttgaca

SEQ ID NO: 2391627 - DNA, 12 bp, Homo sapiens
atgctgaaggga

SEQ ID NO: 2391628 - DNA, 17 bp, Homo sapiens
atggaagattttaaatt

SEQ ID NO: 2391629 - DNA, 17 bp, Homo sapiens
atggaaggtttgtatat

SEQ ID NO: 2391630 - DNA, 23 bp, Homo sapiens
atggacaccccttatccaggact

SEQ ID NO: 2391631 - DNA, 11 bp, Homo sapiens
atggagtgacg

SEQ ID NO: 2391632 - DNA, 17 bp, Homo sapiens
atggctaattcccagag

SEQ ID NO: 2391633 - DNA, 19 bp, Homo sapiens
atgggtctggctgagctga

SEQ ID NO: 2391634 - DNA, 23 bp, Homo sapiens
atggtaaaagttacttattctag

SEQ ID NO: 2391635 - DNA, 20 bp, Homo sapiens
atggtatgagctgagggggg

SEQ ID NO: 2391636 - DNA, 18 bp, Homo sapiens
atggtgcagttgacagca

SEQ ID NO: 2391637 - DNA, 15 bp, Homo sapiens
atgtaggtgtctgca

SEQ ID NO: 2391638 - DNA, 21 bp, Homo sapiens
atgtaggtgtctgcacccagg

SEQ ID NO: 2391639 - DNA, 20 bp, Homo sapiens
atgtatggaatacagtgtta

SEQ ID NO: 2391640 - DNA, 21 bp, Homo sapiens
atgtatggaatacagtgttat

SEQ ID NO: 2391641 - DNA, 23 bp, Homo sapiens
atgtcctccaacaataaagagct

SEQ ID NO: 2391642 - DNA, 20 bp, Homo sapiens
atgtcggcacgtcccatgtg

SEQ ID NO: 2391643 - DNA, 20 bp, Homo sapiens
atgttacatctgttttaaat

SEQ ID NO: 2391644 - DNA, 16 bp, Homo sapiens
atgttagggtgctctg

SEQ ID NO: 2391645 - DNA, 13 bp, Homo sapiens
atgtttatttata

SEQ ID NO: 2391646 - DNA, 21 bp, Homo sapiens
atgtttatttattctgcattt

SEQ ID NO: 2391647 - DNA, 14 bp, Homo sapiens
attaacaaattatg

SEQ ID NO: 2391648 - DNA, 15 bp, Homo sapiens
attaacttagcatgt

SEQ ID NO: 2391649 - DNA, 20 bp, Homo sapiens
attaagattgaggcctgccc

SEQ ID NO: 2391650 - DNA, 18 bp, Homo sapiens
attaccaaaaatcttggg

SEQ ID NO: 2391651 - DNA, 13 bp, Homo sapiens
attacgtgagcca

SEQ ID NO: 2391652 - DNA, 14 bp, Homo sapiens
attacgtgagccag

SEQ ID NO: 2391653 - DNA, 18 bp, Homo sapiens
attacttgaactttccaa

SEQ ID NO: 2391654 - DNA, 15 bp, Homo sapiens
attataacttaaaat

SEQ ID NO: 2391655 - DNA, 20 bp, Homo sapiens
attatggaagattttaaatt

SEQ ID NO: 2391656 - DNA, 13 bp, Homo sapiens
attcacaatagaa

SEQ ID NO: 2391657 - DNA, 14 bp, Homo sapiens
attcagtgcttctt

SEQ ID NO: 2391658 - DNA, 19 bp, Homo sapiens
attcagtgcttcttaaaga

SEQ ID NO: 2391659 - DNA, 13 bp, Homo sapiens
attctcaccagga

SEQ ID NO: 2391660 - DNA, 16 bp, Homo sapiens
attctcaccaggaagg

SEQ ID NO: 2391661 - DNA, 12 bp, Homo sapiens
attcttgtatat

SEQ ID NO: 2391662 - DNA, 12 bp, Homo sapiens
attgaggcctgc

SEQ ID NO: 2391663 - DNA, 14 bp, Homo sapiens
attgcctgcagaga

SEQ ID NO: 2391664 - DNA, 17 bp, Homo sapiens
attgggaagctggggga

SEQ ID NO: 2391665 - DNA, 21 bp, Homo sapiens
attgtttaagtgttgtaaata

SEQ ID NO: 2391666 - DNA, 21 bp, Homo sapiens
atttaccacagcagctgaaca

SEQ ID NO: 2391667 - DNA, 12 bp, Homo sapiens
atttatgtaaac

SEQ ID NO: 2391668 - DNA, 18 bp, Homo sapiens
atttccctgactcctcta

SEQ ID NO: 2391669 - DNA, 14 bp, Homo sapiens
atttccgggtggaa

SEQ ID NO: 2391670 - DNA, 16 bp, Homo sapiens
atttctactgtgactg

SEQ ID NO: 2391671 - DNA, 17 bp, Homo sapiens
atttctactgtgactga

SEQ ID NO: 2391672 - DNA, 12 bp, Homo sapiens
attttataattt

SEQ ID NO: 2391673 - DNA, 13 bp, Homo sapiens
attttgagtgact

SEQ ID NO: 2391674 - DNA, 23 bp, Homo sapiens
attttgagtgactcgagggttgg

SEQ ID NO: 2391675 - DNA, 20 bp, Homo sapiens
attttgtggctttctttctt

SEQ ID NO: 2391676 - DNA, 22 bp, Homo sapiens
atttttgtacgttatatattgt

SEQ ID NO: 2391677 - DNA, 19 bp, Homo sapiens
caaaacagagatgtgataa

SEQ ID NO: 2391678 - DNA, 15 bp, Homo sapiens
caaaagaatcagaaa

SEQ ID NO: 2391679 - DNA, 19 bp, Homo sapiens
caaaagaatcagaaacagg

SEQ ID NO: 2391680 - DNA, 17 bp, Homo sapiens
caaaagttcgaaagaaa

SEQ ID NO: 2391681 - DNA, 22 bp, Homo sapiens
caaagagtgggctgcatctggg

SEQ ID NO: 2391682 - DNA, 12 bp, Homo sapiens
caaagcaccagc

SEQ ID NO: 2391683 - DNA, 19 bp, Homo sapiens
caaaggaatctccagtttt

SEQ ID NO: 2391684 - DNA, 21 bp, Homo sapiens
caaagggctgaaagccatttg

SEQ ID NO: 2391685 - DNA, 14 bp, Homo sapiens
caaaggtggctctc

SEQ ID NO: 2391686 - DNA, 18 bp, Homo sapiens
caaatgcatggtgcagtt

SEQ ID NO: 2391687 - DNA, 22 bp, Homo sapiens
caacaggtggcaggaccaggac

SEQ ID NO: 2391688 - DNA, 14 bp, Homo sapiens
caacagtcaaaaca

SEQ ID NO: 2391689 - DNA, 22 bp, Homo sapiens
caactatgatatggtaaaagtt

SEQ ID NO: 2391690 - DNA, 22 bp, Homo sapiens
gtctgagcaccccctcattccc

SEQ ID NO: 2391691 - DNA, 12 bp, Homo sapiens
gtctgtgcagct

SEQ ID NO: 2391692 - DNA, 16 bp, Homo sapiens
gtgaaacttcctaagt

SEQ ID NO: 2391693 - DNA, 18 bp, Homo sapiens
gtgaactgcgtgccagtg

SEQ ID NO: 2391694 - DNA, 13 bp, Homo sapiens
gtgaatgtctcag

SEQ ID NO: 2391695 - DNA, 23 bp, Homo sapiens
gtgaattgcctgcagagagaagc

SEQ ID NO: 2391696 - DNA, 21 bp, Homo sapiens
gtgactgatgttacatcacag

SEQ ID NO: 2391697 - DNA, 17 bp, Homo sapiens
gtgagcatctctgtgta

SEQ ID NO: 2391698 - DNA, 20 bp, Homo sapiens
gtgagccaggtaatgaggga

SEQ ID NO: 2391699 - DNA, 14 bp, Homo sapiens
gtgaggcctggcca

SEQ ID NO: 2391700 - DNA, 17 bp, Homo sapiens
gtgagttacagcgagag

SEQ ID NO: 2391701 - DNA, 20 bp, Homo sapiens
gtgcagaggtgagcagagga

SEQ ID NO: 2391702 - DNA, 21 bp, Homo sapiens
gtgcagaggtgagcagaggag

SEQ ID NO: 2391703 - DNA, 15 bp, Homo sapiens
gtgcatgaaagagaa

SEQ ID NO: 2391704 - DNA, 21 bp, Homo sapiens
gtgccaggactccccaggcca

SEQ ID NO: 2391705 - DNA, 15 bp, Homo sapiens
gtgcggtggctcacg

SEQ ID NO: 2391706 - DNA, 16 bp, Homo sapiens
gtgctataggctggag

SEQ ID NO: 2391707 - DNA, 21 bp, Homo sapiens
gtgctataggctggagaagct

SEQ ID NO: 2391708 - DNA, 18 bp, Homo sapiens
gtgctcgcccacaaactg

SEQ ID NO: 2391709 - DNA, 13 bp, Homo sapiens
gtgctgcagccag

SEQ ID NO: 2391710 - DNA, 16 bp, Homo sapiens
gtgctgtggccagggt

SEQ ID NO: 2391711 - DNA, 17 bp, Homo sapiens
gtgctgtggccagggtg

SEQ ID NO: 2391712 - DNA, 20 bp, Homo sapiens
gtggaaaagaatccctgcag

SEQ ID NO: 2391713 - DNA, 19 bp, Homo sapiens
gtggagggtcgccacaccc

SEQ ID NO: 2391714 - DNA, 17 bp, Homo sapiens
gtggatctccaaggacc

SEQ ID NO: 2391715 - DNA, 18 bp, Homo sapiens
gtggatctccaaggacca

SEQ ID NO: 2391716 - DNA, 19 bp, Homo sapiens
gtggatctccaaggaccag

SEQ ID NO: 2391717 - DNA, 13 bp, Homo sapiens
gtggccagggtga

SEQ ID NO: 2391718 - DNA, 23 bp, Homo sapiens
gtggctcacgcctgtaatcccag

SEQ ID NO: 2391719 - DNA, 17 bp, Homo sapiens
gtgggggctgtgccgtg

SEQ ID NO: 2391720 - DNA, 15 bp, Homo sapiens
gtggtgaagaaaact

SEQ ID NO: 2391721 - DNA, 16 bp, Homo sapiens
gtgtacccactcctca

SEQ ID NO: 2391722 - DNA, 21 bp, Homo sapiens
gtgtacccactcctcactgcc

SEQ ID NO: 2391723 - DNA, 13 bp, Homo sapiens
gtgtgagcagtga

SEQ ID NO: 2391724 - DNA, 18 bp, Homo sapiens
gtgtgagcatctctgtgt

SEQ ID NO: 2391725 - DNA, 21 bp, Homo sapiens
gtgttggctaatgaagggaaa

SEQ ID NO: 2391726 - DNA, 13 bp, Homo sapiens
gtgttttctgaat

SEQ ID NO: 2391727 - DNA, 18 bp, Homo sapiens
gtgttttctgaataacat

SEQ ID NO: 2391728 - DNA, 19 bp, Homo sapiens
gttacagcgagaggcagag

SEQ ID NO: 2391729 - DNA, 17 bp, Homo sapiens
gttagtgtgttgtctgt

SEQ ID NO: 2391730 - DNA, 19 bp, Homo sapiens
gttagtgtgttgtctgtgc

SEQ ID NO: 2391731 - DNA, 16 bp, Homo sapiens
gttatatattgtatta

SEQ ID NO: 2391732 - DNA, 23 bp, Homo sapiens
gttattttctttgaaattgttta

SEQ ID NO: 2391733 - DNA, 12 bp, Homo sapiens
gttccctctgag

SEQ ID NO: 2391734 - DNA, 14 bp, Homo sapiens
gttccctctgagaa

SEQ ID NO: 2391735 - DNA, 21 bp, Homo sapiens
gttccctgaacatctgtgtgt

SEQ ID NO: 2391736 - DNA, 16 bp, Homo sapiens
gttcgccgcgtggaat

SEQ ID NO: 2391737 - DNA, 23 bp, Homo sapiens
gttctagagaagaggctggtgct

SEQ ID NO: 2391738 - DNA, 14 bp, Homo sapiens
gttctgagtgtttt

SEQ ID NO: 2391739 - DNA, 12 bp, Homo sapiens
gttcttgtctga

SEQ ID NO: 2391740 - DNA, 20 bp, Homo sapiens
gttggaaaagaatacagaaa

SEQ ID NO: 2391741 - DNA, 22 bp, Homo sapiens
gttggaaaagaatacagaaaga

SEQ ID NO: 2391742 - DNA, 15 bp, Homo sapiens
gttgggttcatctga

SEQ ID NO: 2391743 - DNA, 20 bp, Homo sapiens
gttgtaaatatttatgtaaa

SEQ ID NO: 2391744 - DNA, 22 bp, Homo sapiens
gttgtgaggcctggccaggcac

SEQ ID NO: 2391745 - DNA, 19 bp, Homo sapiens
gttgttttttgaaaacatg

SEQ ID NO: 2391746 - DNA, 12 bp, Homo sapiens
gtttaagtgttg

SEQ ID NO: 2391747 - DNA, 13 bp, Homo sapiens
gtttattaacaaa

SEQ ID NO: 2391748 - DNA, 17 bp, Homo sapiens
gtttgaaggaggtgagg

SEQ ID NO: 2391749 - DNA, 21 bp, Homo sapiens
gtttgggcagaagggagaagg

SEQ ID NO: 2391750 - DNA, 16 bp, Homo sapiens
gtttttactacagttg

SEQ ID NO: 2391751 - DNA, 15 bp, Homo sapiens
taaaaaacttgtaaa

SEQ ID NO: 2391752 - DNA, 14 bp, Homo sapiens
taaaagtgtgagca

SEQ ID NO: 2391753 - DNA, 10 bp, Homo sapiens
taaagagctc

SEQ ID NO: 2391754 - DNA, 20 bp, Homo sapiens
taaagaggaaaagtgcaatg

SEQ ID NO: 2391755 - DNA, 16 bp, Homo sapiens
taaaggagttaagagt

SEQ ID NO: 2391756 - DNA, 14 bp, Homo sapiens
taaagtatatattt

SEQ ID NO: 2391757 - DNA, 10 bp, Homo sapiens
taaatattta

SEQ ID NO: 2391758 - DNA, 22 bp, Homo sapiens
taaattataacttaaaatattt

SEQ ID NO: 2391759 - DNA, 16 bp, Homo sapiens
taaccctctcttccct

SEQ ID NO: 2391760 - DNA, 14 bp, Homo sapiens
taagacgtgaatgt

SEQ ID NO: 2391761 - DNA, 21 bp, Homo sapiens
taagggaaggaactctggctt

SEQ ID NO: 2391762 - DNA, 15 bp, Homo sapiens
taatcaggctgaggt

SEQ ID NO: 2391763 - DNA, 16 bp, Homo sapiens
tacagcgagaggcaga

SEQ ID NO: 2391764 - DNA, 20 bp, Homo sapiens
tacagttgttttttgaaaac

SEQ ID NO: 2391765 - DNA, 21 bp, Homo sapiens
tacatacagaggtaactatca

SEQ ID NO: 2391766 - DNA, 16 bp, Homo sapiens
tacattccctggcctg

SEQ ID NO: 2391767 - DNA, 11 bp, Homo sapiens
taccagtgtga

SEQ ID NO: 2391768 - DNA, 14 bp, Homo sapiens
tacccactcctcac

SEQ ID NO: 2391769 - DNA, 16 bp, Homo sapiens
tacccactcctcactg

SEQ ID NO: 2391770 - DNA, 13 bp, Homo sapiens
tacccagagcatt

SEQ ID NO: 2391771 - DNA, 17 bp, Homo sapiens
tacccagagccttctcc

SEQ ID NO: 2391772 - DNA, 18 bp, Homo sapiens
tacttcttcattcaatac

SEQ ID NO: 2391773 - DNA, 17 bp, Homo sapiens
tagaagagtcaggaagg

SEQ ID NO: 2391774 - DNA, 22 bp, Homo sapiens
tagaattgggaagctgggggaa

SEQ ID NO: 2391775 - DNA, 22 bp, Homo sapiens
tagatgggtctggctgagctga

SEQ ID NO: 2391776 - DNA, 17 bp, Homo sapiens
tagcaagttctagagaa

SEQ ID NO: 2391777 - DNA, 18 bp, Homo sapiens
tagcaagttctagagaag

SEQ ID NO: 2391778 - DNA, 19 bp, Homo sapiens
tagcaagttctagagaaga

SEQ ID NO: 2391779 - DNA, 23 bp, Homo sapiens
tagcaggtggtcctgagacctga

SEQ ID NO: 2391780 - DNA, 14 bp, Homo sapiens
tagctgtgtgaaat

SEQ ID NO: 2391781 - DNA, 12 bp, Homo sapiens
taggcagagcct

SEQ ID NO: 2391782 - DNA, 16 bp, Homo sapiens
taggcagagcctttgg

SEQ ID NO: 2391783 - DNA, 14 bp, Homo sapiens
tagggacttaaaaa

SEQ ID NO: 2391784 - DNA, 23 bp, Homo sapiens
tagggctggactctggcacccag

SEQ ID NO: 2391785 - DNA, 15 bp, Homo sapiens
tataatctatttaca

SEQ ID NO: 2391786 - DNA, 21 bp, Homo sapiens
tatagccacatccctttgaaa

SEQ ID NO: 2391787 - DNA, 21 bp, Homo sapiens
tatattgtcctcccctatttt

SEQ ID NO: 2391788 - DNA, 12 bp, Homo sapiens
tatgagctgagg

SEQ ID NO: 2391789 - DNA, 13 bp, Homo sapiens
tatgagctgaggg

SEQ ID NO: 2391790 - DNA, 17 bp, Homo sapiens
tatggaatacagtgtta

SEQ ID NO: 2391791 - DNA, 23 bp, Homo sapiens
tatgtaaactgcattagaaatta

SEQ ID NO: 2391792 - DNA, 19 bp, Homo sapiens
tatgtggtttccacgatga

SEQ ID NO: 2391793 - DNA, 18 bp, Homo sapiens
tattaacaaattatgtta

SEQ ID NO: 2391794 - DNA, 15 bp, Homo sapiens
tattaagggcatttt

SEQ ID NO: 2391795 - DNA, 18 bp, Homo sapiens
tattgagaattttaaatt

SEQ ID NO: 2391796 - DNA, 20 bp, Homo sapiens
tattgtcctcccctatttta

SEQ ID NO: 2391797 - DNA, 16 bp, Homo sapiens
tatttaagcttatgtc

SEQ ID NO: 2391798 - DNA, 14 bp, Homo sapiens
tatttataagcaga

SEQ ID NO: 2391799 - DNA, 17 bp, Homo sapiens
tattttaagacgtgaat

SEQ ID NO: 2391800 - DNA, 14 bp, Homo sapiens
tattttctttgaaa

SEQ ID NO: 2391801 - DNA, 20 bp, Homo sapiens
aagtgttgtaaatatttatg

SEQ ID NO: 2391802 - DNA, 15 bp, Homo sapiens
aagttacttattcta

SEQ ID NO: 2391803 - DNA, 15 bp, Homo sapiens
aagttcgaaagaaaa

SEQ ID NO: 2391804 - DNA, 17 bp, Homo sapiens
aagttctagagaagagg

SEQ ID NO: 2391805 - DNA, 21 bp, Homo sapiens
aagttctagagaagaggctgg

SEQ ID NO: 2391806 - DNA, 11 bp, Homo sapiens
aataataatta

SEQ ID NO: 2391807 - DNA, 16 bp, Homo sapiens
aatccgagtgtttgcc

SEQ ID NO: 2391808 - DNA, 15 bp, Homo sapiens
aatctgggactttca

SEQ ID NO: 2391809 - DNA, 17 bp, Homo sapiens
aatgaaaaattctcagt

SEQ ID NO: 2391810 - DNA, 20 bp, Homo sapiens
aatgagggactggaaccagg

SEQ ID NO: 2391811 - DNA, 20 bp, Homo sapiens
aatgcaaacacacaaaggta

SEQ ID NO: 2391812 - DNA, 17 bp, Homo sapiens
aatgctgtcaactatga

SEQ ID NO: 2391813 - DNA, 20 bp, Homo sapiens
aatggaaggtttgtatattg

SEQ ID NO: 2391814 - DNA, 18 bp, Homo sapiens
aatgtttgggcagaaggg

SEQ ID NO: 2391815 - DNA, 17 bp, Homo sapiens
aattataacttaaaata

SEQ ID NO: 2391816 - DNA, 23 bp, Homo sapiens
aattataacttaaaatattttat

SEQ ID NO: 2391817 - DNA, 19 bp, Homo sapiens
aattccttttctaactctc

SEQ ID NO: 2391818 - DNA, 16 bp, Homo sapiens
aattcttgtatattat

SEQ ID NO: 2391819 - DNA, 15 bp, Homo sapiens
aattgtttaagtgtt

SEQ ID NO: 2391820 - DNA, 12 bp, Homo sapiens
aattttaaatta

SEQ ID NO: 2391821 - DNA, 19 bp, Homo sapiens
aatttttaaagtatatatt

SEQ ID NO: 2391822 - DNA, 22 bp, Homo sapiens
aatttttaaagtatatatttat

SEQ ID NO: 2391823 - DNA, 16 bp, Homo sapiens
acaaactgatttctca

SEQ ID NO: 2391824 - DNA, 17 bp, Homo sapiens
acaaactgatttctcac

SEQ ID NO: 2391825 - DNA, 21 bp, Homo sapiens
acaaccacctaatcaggctga

SEQ ID NO: 2391826 - DNA, 21 bp, Homo sapiens
acaaggaatagtcgcgcaagc

SEQ ID NO: 2391827 - DNA, 16 bp, Homo sapiens
acaatctgggactttc

SEQ ID NO: 2391828 - DNA, 21 bp, Homo sapiens
acaatggctaattcccagagt

SEQ ID NO: 2391829 - DNA, 14 bp, Homo sapiens
acaattccaaagga

SEQ ID NO: 2391830 - DNA, 14 bp, Homo sapiens
acacaagctggaag

SEQ ID NO: 2391831 - DNA, 22 bp, Homo sapiens
acacagttgctgtcataagaat

SEQ ID NO: 2391832 - DNA, 14 bp, Homo sapiens
acactggtgactgc

SEQ ID NO: 2391833 - DNA, 14 bp, Homo sapiens
acagcgagaggcag

SEQ ID NO: 2391834 - DNA, 18 bp, Homo sapiens
acaggagggcaagggcca

SEQ ID NO: 2391835 - DNA, 23 bp, Homo sapiens
acagggaaccctgcttgcacttt

SEQ ID NO: 2391836 - DNA, 20 bp, Homo sapiens
acaggtggcaggaccaggac

SEQ ID NO: 2391837 - DNA, 22 bp, Homo sapiens
acagtgttattttctttgaaat

SEQ ID NO: 2391838 - DNA, 17 bp, Homo sapiens
acagtgtttgcaatggt

SEQ ID NO: 2391839 - DNA, 15 bp, Homo sapiens
acagttgctgtcata

SEQ ID NO: 2391840 - DNA, 14 bp, Homo sapiens
acataagaccataa

SEQ ID NO: 2391841 - DNA, 16 bp, Homo sapiens
acattccctggcctgg

SEQ ID NO: 2391842 - DNA, 14 bp, Homo sapiens
accaccctcccacc

SEQ ID NO: 2391843 - DNA, 20 bp, Homo sapiens
accaccttggactcctccca

SEQ ID NO: 2391844 - DNA, 21 bp, Homo sapiens
accaccttggactcctcccac

SEQ ID NO: 2391845 - DNA, 22 bp, Homo sapiens
accaccttggactcctcccaca

SEQ ID NO: 2391846 - DNA, 15 bp, Homo sapiens
accagcttctccagg

SEQ ID NO: 2391847 - DNA, 16 bp, Homo sapiens
accagcttctccaggc

SEQ ID NO: 2391848 - DNA, 21 bp, Homo sapiens
accagggagaccgagcgcttt

SEQ ID NO: 2391849 - DNA, 19 bp, Homo sapiens
accatgcgctgctcaacct

SEQ ID NO: 2391850 - DNA, 14 bp, Homo sapiens
acccatgtgccaag

SEQ ID NO: 2391851 - DNA, 17 bp, Homo sapiens
acccatgtgccaaggtg

SEQ ID NO: 2391852 - DNA, 15 bp, Homo sapiens
accccagctagggct

SEQ ID NO: 2391853 - DNA, 20 bp, Homo sapiens
acccccagtgtggctgtctg

SEQ ID NO: 2391854 - DNA, 11 bp, Homo sapiens
accccctcatt

SEQ ID NO: 2391855 - DNA, 18 bp, Homo sapiens
accccctcattcccctcg

SEQ ID NO: 2391856 - DNA, 12 bp, Homo sapiens
accccctggaga

SEQ ID NO: 2391857 - DNA, 16 bp, Homo sapiens
accccttatccaggac

SEQ ID NO: 2391858 - DNA, 11 bp, Homo sapiens
accccttcctt

SEQ ID NO: 2391859 - DNA, 15 bp, Homo sapiens
accccttcctttcct

SEQ ID NO: 2391860 - DNA, 17 bp, Homo sapiens
accccttcctttcctct

SEQ ID NO: 2391861 - DNA, 14 bp, Homo sapiens
acccggcccagaga

SEQ ID NO: 2391862 - DNA, 12 bp, Homo sapiens
acccggctcccc

SEQ ID NO: 2391863 - DNA, 21 bp, Homo sapiens
acccggctccccctgcttctc

SEQ ID NO: 2391864 - DNA, 16 bp, Homo sapiens
accctaagcctccttt

SEQ ID NO: 2391865 - DNA, 14 bp, Homo sapiens
accctctcttccct

SEQ ID NO: 2391866 - DNA, 23 bp, Homo sapiens
accctgctgggaccccagctagg

SEQ ID NO: 2391867 - DNA, 18 bp, Homo sapiens
accgagcgctttctggaa

SEQ ID NO: 2391868 - DNA, 17 bp, Homo sapiens
acctaatcaggctgagg

SEQ ID NO: 2391869 - DNA, 12 bp, Homo sapiens
acctctctcctt

SEQ ID NO: 2391870 - DNA, 23 bp, Homo sapiens
acctcttgggcatgctcagccct

SEQ ID NO: 2391871 - DNA, 9 bp, Homo sapiens
accttcccc

SEQ ID NO: 2391872 - DNA, 15 bp, Homo sapiens
accttccccagactc

SEQ ID NO: 2391873 - DNA, 13 bp, Homo sapiens
accttggactcct

SEQ ID NO: 2391874 - DNA, 15 bp, Homo sapiens
accttggactcctcc

SEQ ID NO: 2391875 - DNA, 16 bp, Homo sapiens
accttggactcctccc

SEQ ID NO: 2391876 - DNA, 18 bp, Homo sapiens
acgcccagctgaggctgg

SEQ ID NO: 2391877 - DNA, 20 bp, Homo sapiens
acgcctgtaatcccagcact

SEQ ID NO: 2391878 - DNA, 21 bp, Homo sapiens
acggtcccacactggtgactg

SEQ ID NO: 2391879 - DNA, 23 bp, Homo sapiens
acgtatgtcggcacgtcccatgt

SEQ ID NO: 2391880 - DNA, 22 bp, Homo sapiens
acgtgagccaggtaatgaggga

SEQ ID NO: 2391881 - DNA, 23 bp, Homo sapiens
acgtgagccaggtaatgagggac

SEQ ID NO: 2391882 - DNA, 21 bp, Homo sapiens
acgttaagggaaggaactctg

SEQ ID NO: 2391883 - DNA, 15 bp, Homo sapiens
acgttatatattgta

SEQ ID NO: 2391884 - DNA, 15 bp, Homo sapiens
actacgttaagggaa

SEQ ID NO: 2391885 - DNA, 20 bp, Homo sapiens
actacttttgtaccagtgtg

SEQ ID NO: 2391886 - DNA, 15 bp, Homo sapiens
actattacttgaact

SEQ ID NO: 2391887 - DNA, 15 bp, Homo sapiens
actcaccatgtaaaa

SEQ ID NO: 2391888 - DNA, 18 bp, Homo sapiens
actccagtggtgaagaaa

SEQ ID NO: 2391889 - DNA, 23 bp, Homo sapiens
actccggcctgatgacagagcga

SEQ ID NO: 2391890 - DNA, 22 bp, Homo sapiens
actcgggaggctgagacaggag

SEQ ID NO: 2391891 - DNA, 16 bp, Homo sapiens
actctcccctccctct

SEQ ID NO: 2391892 - DNA, 19 bp, Homo sapiens
actctcccctccctcttcc

SEQ ID NO: 2391893 - DNA, 22 bp, Homo sapiens
actctcccctccctcttccttc

SEQ ID NO: 2391894 - DNA, 14 bp, Homo sapiens
actctggcttccag

SEQ ID NO: 2391895 - DNA, 13 bp, Homo sapiens
actctgggaaata

SEQ ID NO: 2391896 - DNA, 15 bp, Homo sapiens
actcttcctgcaagg

SEQ ID NO: 2391897 - DNA, 16 bp, Homo sapiens
actgaatgctctgtgc

SEQ ID NO: 2391898 - DNA, 22 bp, Homo sapiens
actgatgttacatcacagtgtt

SEQ ID NO: 2391899 - DNA, 17 bp, Homo sapiens
actgccccaccagccac

SEQ ID NO: 2391900 - DNA, 19 bp, Homo sapiens
actgccccaccagccacct

SEQ ID NO: 2391901 - DNA, 18 bp, Homo sapiens
actgcgatcttcagagca

SEQ ID NO: 2391902 - DNA, 19 bp, Homo sapiens
actgctaggcgagtgccag

SEQ ID NO: 2391903 - DNA, 20 bp, Homo sapiens
actgctaggcgagtgccagg

SEQ ID NO: 2391904 - DNA, 21 bp, Homo sapiens
actgctaggcgagtgccagga

SEQ ID NO: 2391905 - DNA, 16 bp, Homo sapiens
actggaaccagggaga

SEQ ID NO: 2391906 - DNA, 17 bp, Homo sapiens
actggacgcccagctga

SEQ ID NO: 2391907 - DNA, 14 bp, Homo sapiens
actggaggtcacat

SEQ ID NO: 2391908 - DNA, 20 bp, Homo sapiens
actggaggtcacattcagga

SEQ ID NO: 2391909 - DNA, 23 bp, Homo sapiens
actggaggtcacattcaggaaga

SEQ ID NO: 2391910 - DNA, 13 bp, Homo sapiens
acttaaaaaaatg

SEQ ID NO: 2391911 - DNA, 17 bp, Homo sapiens
atattgtcagatatttt

SEQ ID NO: 2391912 - DNA, 14 bp, Homo sapiens
atattttataattt

SEQ ID NO: 2391913 - DNA, 18 bp, Homo sapiens
atattttttcagaaatat

SEQ ID NO: 2391914 - DNA, 18 bp, Homo sapiens
atcaacaagagttgtctt

SEQ ID NO: 2391915 - DNA, 15 bp, Homo sapiens
atcaagaaagtgttg

SEQ ID NO: 2391916 - DNA, 16 bp, Homo sapiens
atcactggcaatgaaa

SEQ ID NO: 2391917 - DNA, 22 bp, Homo sapiens
atcactggcaatgaaaaattct

SEQ ID NO: 2391918 - DNA, 12 bp, Homo sapiens
atcatggagtga

SEQ ID NO: 2391919 - DNA, 13 bp, Homo sapiens
atcccctttcctc

SEQ ID NO: 2391920 - DNA, 16 bp, Homo sapiens
atcccctttcctcccc

SEQ ID NO: 2391921 - DNA, 14 bp, Homo sapiens
atcctgctgctgtg

SEQ ID NO: 2391922 - DNA, 19 bp, Homo sapiens
atcctgtgacccctcccca

SEQ ID NO: 2391923 - DNA, 20 bp, Homo sapiens
atctcagaattccttttcta

SEQ ID NO: 2391924 - DNA, 17 bp, Homo sapiens
atctgagcaagagctgg

SEQ ID NO: 2391925 - DNA, 22 bp, Homo sapiens
atctgggattcccaccaaggtc

SEQ ID NO: 2391926 - DNA, 13 bp, Homo sapiens
atctgtccaagga

SEQ ID NO: 2391927 - DNA, 17 bp, Homo sapiens
atcttctgcaattgctt

SEQ ID NO: 2391928 - DNA, 21 bp, Homo sapiens
atgaagatgtctaatagttat

SEQ ID NO: 2391929 - DNA, 12 bp, Homo sapiens
atgacagagcga

SEQ ID NO: 2391930 - DNA, 16 bp, Homo sapiens
atgactaaaaatatta

SEQ ID NO: 2391931 - DNA, 13 bp, Homo sapiens
atgatatgtaaac

SEQ ID NO: 2391932 - DNA, 15 bp, Homo sapiens
atgcctcaatgtgac

SEQ ID NO: 2391933 - DNA, 13 bp, Homo sapiens
atgcgctgctcaa

SEQ ID NO: 2391934 - DNA, 20 bp, Homo sapiens
atgctgtcaactatgatatg

SEQ ID NO: 2391935 - DNA, 22 bp, Homo sapiens
atggaaggtttgtatattgtca

SEQ ID NO: 2391936 - DNA, 22 bp, Homo sapiens
atggacaccccttatccaggac

SEQ ID NO: 2391937 - DNA, 12 bp, Homo sapiens
atggatgtgctt

SEQ ID NO: 2391938 - DNA, 18 bp, Homo sapiens
atggcccttcccactgga

SEQ ID NO: 2391939 - DNA, 22 bp, Homo sapiens
atgggggtgctgcagccaggag

SEQ ID NO: 2391940 - DNA, 17 bp, Homo sapiens
atgggtctggctgagct

SEQ ID NO: 2391941 - DNA, 14 bp, Homo sapiens
atggtatgagctga

SEQ ID NO: 2391942 - DNA, 18 bp, Homo sapiens
atggttgtctgtttttgt

SEQ ID NO: 2391943 - DNA, 21 bp, Homo sapiens
atgtaaaagagtcatctggta

SEQ ID NO: 2391944 - DNA, 18 bp, Homo sapiens
atgtatggaatacagtgt

SEQ ID NO: 2391945 - DNA, 18 bp, Homo sapiens
atgtgaattgcctgcaga

SEQ ID NO: 2391946 - DNA, 20 bp, Homo sapiens
atgtgacccagatcctcaca

SEQ ID NO: 2391947 - DNA, 20 bp, Homo sapiens
atgtgataaggatcagaaca

SEQ ID NO: 2391948 - DNA, 13 bp, Homo sapiens
atgtgccaaggtg

SEQ ID NO: 2391949 - DNA, 15 bp, Homo sapiens
atgtgttttctgaat

SEQ ID NO: 2391950 - DNA, 18 bp, Homo sapiens
atgtttgggcagaaggga

SEQ ID NO: 2391951 - DNA, 23 bp, Homo sapiens
atgtttgggcagaagggagaagg

SEQ ID NO: 2391952 - DNA, 15 bp, Homo sapiens
atgtttttcatgaaa

SEQ ID NO: 2391953 - DNA, 20 bp, Homo sapiens
attaacaaattatgttacat

SEQ ID NO: 2391954 - DNA, 19 bp, Homo sapiens
attacctcctgtgtggaag

SEQ ID NO: 2391955 - DNA, 20 bp, Homo sapiens
attacgtgagccaggtaatg

SEQ ID NO: 2391956 - DNA, 13 bp, Homo sapiens
attacttgaactt

SEQ ID NO: 2391957 - DNA, 20 bp, Homo sapiens
attagaaattagctgtgtga

SEQ ID NO: 2391958 - DNA, 23 bp, Homo sapiens
attagaaattagctgtgtgaaat

SEQ ID NO: 2391959 - DNA, 16 bp, Homo sapiens
attagctgtgtgaaat

SEQ ID NO: 2391960 - DNA, 15 bp, Homo sapiens
attataacttaaaaa

SEQ ID NO: 2391961 - DNA, 16 bp, Homo sapiens
attataacttaaaata

SEQ ID NO: 2391962 - DNA, 20 bp, Homo sapiens
attataacttaaaatatttt

SEQ ID NO: 2391963 - DNA, 12 bp, Homo sapiens
attccctggcct

SEQ ID NO: 2391964 - DNA, 19 bp, Homo sapiens
attccctggcctggctctc

SEQ ID NO: 2391965 - DNA, 20 bp, Homo sapiens
attccctggcctggctctcc

SEQ ID NO: 2391966 - DNA, 18 bp, Homo sapiens
attcctacaaagatgttt

SEQ ID NO: 2391967 - DNA, 22 bp, Homo sapiens
attctggatggatttgaagcaa

SEQ ID NO: 2391968 - DNA, 13 bp, Homo sapiens
attgagaatttta

SEQ ID NO: 2391969 - DNA, 21 bp, Homo sapiens
attgagaattttaaattataa

SEQ ID NO: 2391970 - DNA, 21 bp, Homo sapiens
attgaggcctgccctcaggga

SEQ ID NO: 2391971 - DNA, 15 bp, Homo sapiens
attgcctgcagagag

SEQ ID NO: 2391972 - DNA, 16 bp, Homo sapiens
attgcctgcagagaga

SEQ ID NO: 2391973 - DNA, 17 bp, Homo sapiens
attgcctgcagagagaa

SEQ ID NO: 2391974 - DNA, 14 bp, Homo sapiens
attgtcagatattt

SEQ ID NO: 2391975 - DNA, 23 bp, Homo sapiens
attgtcctcccctattttaagac

SEQ ID NO: 2391976 - DNA, 15 bp, Homo sapiens
atttaccacagcagc

SEQ ID NO: 2391977 - DNA, 18 bp, Homo sapiens
atttctactgtgactgat

SEQ ID NO: 2391978 - DNA, 19 bp, Homo sapiens
attttaaaaagatttgttt

SEQ ID NO: 2391979 - DNA, 20 bp, Homo sapiens
attttaaaagcaattatatt

SEQ ID NO: 2391980 - DNA, 16 bp, Homo sapiens
attttatgaatgtctt

SEQ ID NO: 2391981 - DNA, 15 bp, Homo sapiens
attttctttgaaatt

SEQ ID NO: 2391982 - DNA, 15 bp, Homo sapiens
attttttttgtaact

SEQ ID NO: 2391983 - DNA, 22 bp, Homo sapiens
caaagccaacagtcaaaacaga

SEQ ID NO: 2391984 - DNA, 14 bp, Homo sapiens
caaagggctgaaag

SEQ ID NO: 2391985 - DNA, 14 bp, Homo sapiens
caaaggtataattt

SEQ ID NO: 2391986 - DNA, 19 bp, Homo sapiens
caacaaagccaacagtcaa

SEQ ID NO: 2391987 - DNA, 16 bp, Homo sapiens
caacaataaagagctc

SEQ ID NO: 2391988 - DNA, 17 bp, Homo sapiens
caacacaagctggaagc

SEQ ID NO: 2391989 - DNA, 20 bp, Homo sapiens
caacacaagctggaagcaca

SEQ ID NO: 2391990 - DNA, 23 bp, Homo sapiens
caacaggtggcaggaccaggact

SEQ ID NO: 2391991 - DNA, 16 bp, Homo sapiens
caacctctctccttct

SEQ ID NO: 2391992 - DNA, 16 bp, Homo sapiens
caagagaacatttcta

SEQ ID NO: 2391993 - DNA, 15 bp, Homo sapiens
caagataactgagaa

SEQ ID NO: 2391994 - DNA, 16 bp, Homo sapiens
caagataactgagaat

SEQ ID NO: 2391995 - DNA, 16 bp, Homo sapiens
caagatcgcgccactg

SEQ ID NO: 2391996 - DNA, 19 bp, Homo sapiens
caagcaaaggtgaagagac

SEQ ID NO: 2391997 - DNA, 19 bp, Homo sapiens
caaggagttccatgaagac

SEQ ID NO: 2391998 - DNA, 14 bp, Homo sapiens
caagggccatgctg

SEQ ID NO: 2391999 - DNA, 16 bp, Homo sapiens
caaggtcttcagccat

SEQ ID NO: 2392000 - DNA, 15 bp, Homo sapiens
caaggttccctctga

SEQ ID NO: 2392001 - DNA, 19 bp, Homo sapiens
caaggttccctctgagaat

SEQ ID NO: 2392002 - DNA, 23 bp, Homo sapiens
caagttctagagaagaggctggt

SEQ ID NO: 2392003 - DNA, 17 bp, Homo sapiens
caataaatgtgcttatg

SEQ ID NO: 2392004 - DNA, 20 bp, Homo sapiens
caatatttaagtttgttgct

SEQ ID NO: 2392005 - DNA, 15 bp, Homo sapiens
caatctgggactttc

SEQ ID NO: 2392006 - DNA, 18 bp, Homo sapiens
caatctgggactttcact

SEQ ID NO: 2392007 - DNA, 17 bp, Homo sapiens
caatggagttcagagat

SEQ ID NO: 2392008 - DNA, 17 bp, Homo sapiens
caatggctaattcccag

SEQ ID NO: 2392009 - DNA, 23 bp, Homo sapiens
caatggctaattcccagagtgtg

SEQ ID NO: 2392010 - DNA, 13 bp, Homo sapiens
caatgtgaccagg

SEQ ID NO: 2392011 - DNA, 15 bp, Homo sapiens
caattccaaaggaat

SEQ ID NO: 2392012 - DNA, 18 bp, Homo sapiens
cacaaaagttagctgagc

SEQ ID NO: 2392013 - DNA, 16 bp, Homo sapiens
cacaaaggtataattt

SEQ ID NO: 2392014 - DNA, 20 bp, Homo sapiens
cacaatggctaattcccaga

SEQ ID NO: 2392015 - DNA, 19 bp, Homo sapiens
cacacttgggcgctctgcc

SEQ ID NO: 2392016 - DNA, 13 bp, Homo sapiens
cacagaaacacaa

SEQ ID NO: 2392017 - DNA, 20 bp, Homo sapiens
cacaggatcctattctcacc

SEQ ID NO: 2392018 - DNA, 23 bp, Homo sapiens
cacaggatcctattctcaccagg

SEQ ID NO: 2392019 - DNA, 10 bp, Homo sapiens
cacagtgttt

SEQ ID NO: 2392020 - DNA, 14 bp, Homo sapiens
cacattcaggaaga

SEQ ID NO: 2392021 - DNA, 14 bp, Homo sapiens
ccctgaacatctgt

SEQ ID NO: 2392022 - DNA, 14 bp, Homo sapiens
ccctgactggtgct

SEQ ID NO: 2392023 - DNA, 19 bp, Homo sapiens
ccctgagtggatctccaag

SEQ ID NO: 2392024 - DNA, 22 bp, Homo sapiens
ccctgagtggatctccaaggac

SEQ ID NO: 2392025 - DNA, 12 bp, Homo sapiens
ccctgcagcctg

SEQ ID NO: 2392026 - DNA, 13 bp, Homo sapiens
ccctgcggagacc

SEQ ID NO: 2392027 - DNA, 11 bp, Homo sapiens
ccctggcctca

SEQ ID NO: 2392028 - DNA, 20 bp, Homo sapiens
ccctggcctggctctcctgt

SEQ ID NO: 2392029 - DNA, 23 bp, Homo sapiens
ccctggctgaccccaaagagcct

SEQ ID NO: 2392030 - DNA, 12 bp, Homo sapiens
cccttatccagg

SEQ ID NO: 2392031 - DNA, 13 bp, Homo sapiens
cccttcctttcct

SEQ ID NO: 2392032 - DNA, 14 bp, Homo sapiens
cccttcctttcctc

SEQ ID NO: 2392033 - DNA, 19 bp, Homo sapiens
cccttcctttcctctgcag

SEQ ID NO: 2392034 - DNA, 20 bp, Homo sapiens
cccttggcgggcagcccagc

SEQ ID NO: 2392035 - DNA, 23 bp, Homo sapiens
cccttggcgggcagcccagcctc

SEQ ID NO: 2392036 - DNA, 12 bp, Homo sapiens
ccctttcctccc

SEQ ID NO: 2392037 - DNA, 13 bp, Homo sapiens
ccctttcctcccc

SEQ ID NO: 2392038 - DNA, 19 bp, Homo sapiens
ccggagcaggggtctgagc

SEQ ID NO: 2392039 - DNA, 20 bp, Homo sapiens
ccggcccagagaccccttcc

SEQ ID NO: 2392040 - DNA, 21 bp, Homo sapiens
ccggcctgatgacagagcgag

SEQ ID NO: 2392041 - DNA, 12 bp, Homo sapiens
ccgtgcccaggg

SEQ ID NO: 2392042 - DNA, 17 bp, Homo sapiens
cctaatcaggctgaggt

SEQ ID NO: 2392043 - DNA, 20 bp, Homo sapiens
cctagaagagtcaggaaggg

SEQ ID NO: 2392044 - DNA, 11 bp, Homo sapiens
cctattctcac

SEQ ID NO: 2392045 - DNA, 13 bp, Homo sapiens
cctattctcacca

SEQ ID NO: 2392046 - DNA, 15 bp, Homo sapiens
cctcacgcccagcct

SEQ ID NO: 2392047 - DNA, 17 bp, Homo sapiens
cctcactgaatgcctca

SEQ ID NO: 2392048 - DNA, 19 bp, Homo sapiens
cctccaacaataaagagct

SEQ ID NO: 2392049 - DNA, 15 bp, Homo sapiens
cctcccaccaccctc

SEQ ID NO: 2392050 - DNA, 20 bp, Homo sapiens
cctcccaccaccctcccacc

SEQ ID NO: 2392051 - DNA, 16 bp, Homo sapiens
cctcccaccatgcgct

SEQ ID NO: 2392052 - DNA, 21 bp, Homo sapiens
cctcccaccatgcgctgctca

SEQ ID NO: 2392053 - DNA, 16 bp, Homo sapiens
cctccccaccttcccc

SEQ ID NO: 2392054 - DNA, 12 bp, Homo sapiens
cctccctcttcc

SEQ ID NO: 2392055 - DNA, 18 bp, Homo sapiens
cctccctcttccttcccc

SEQ ID NO: 2392056 - DNA, 13 bp, Homo sapiens
cctccctggcctc

SEQ ID NO: 2392057 - DNA, 14 bp, Homo sapiens
cctccctggcctca

SEQ ID NO: 2392058 - DNA, 12 bp, Homo sapiens
cctctcttccct

SEQ ID NO: 2392059 - DNA, 19 bp, Homo sapiens
cctctgatacccagagcat

SEQ ID NO: 2392060 - DNA, 20 bp, Homo sapiens
cctctgatacccagagcatt

SEQ ID NO: 2392061 - DNA, 16 bp, Homo sapiens
cctctgtccctctttg

SEQ ID NO: 2392062 - DNA, 18 bp, Homo sapiens
cctctttgcctgtgtgag

SEQ ID NO: 2392063 - DNA, 19 bp, Homo sapiens
cctgacaagcactgctagg

SEQ ID NO: 2392064 - DNA, 15 bp, Homo sapiens
cctgactcctctaag

SEQ ID NO: 2392065 - DNA, 20 bp, Homo sapiens
cctgactcctctaagccact

SEQ ID NO: 2392066 - DNA, 14 bp, Homo sapiens
cctgagtggatctc

SEQ ID NO: 2392067 - DNA, 19 bp, Homo sapiens
cctgagtggatctccaagg

SEQ ID NO: 2392068 - DNA, 12 bp, Homo sapiens
cctgcaaggact

SEQ ID NO: 2392069 - DNA, 16 bp, Homo sapiens
cctgcccagcctcgca

SEQ ID NO: 2392070 - DNA, 20 bp, Homo sapiens
cctgcctacattccctggcc

SEQ ID NO: 2392071 - DNA, 21 bp, Homo sapiens
cctgcctacattccctggcct

SEQ ID NO: 2392072 - DNA, 20 bp, Homo sapiens
cctgcggagaccctgagtcc

SEQ ID NO: 2392073 - DNA, 14 bp, Homo sapiens
cctgcttcatgctc

SEQ ID NO: 2392074 - DNA, 16 bp, Homo sapiens
cctgcttcatgctcag

SEQ ID NO: 2392075 - DNA, 15 bp, Homo sapiens
cctgcttctcagccc

SEQ ID NO: 2392076 - DNA, 17 bp, Homo sapiens
cctggagaagctgatgc

SEQ ID NO: 2392077 - DNA, 14 bp, Homo sapiens
cctggagtgcagtt

SEQ ID NO: 2392078 - DNA, 21 bp, Homo sapiens
cctggcctcacgcccagcctc

SEQ ID NO: 2392079 - DNA, 12 bp, Homo sapiens
cctggcctggct

SEQ ID NO: 2392080 - DNA, 22 bp, Homo sapiens
cctggctgaccccaaagagcct

SEQ ID NO: 2392081 - DNA, 21 bp, Homo sapiens
cctggtgcagaggtgagcaga

SEQ ID NO: 2392082 - DNA, 22 bp, Homo sapiens
cctgtgtgagcatctctgtgta

SEQ ID NO: 2392083 - DNA, 13 bp, Homo sapiens
ccttatccaggac

SEQ ID NO: 2392084 - DNA, 14 bp, Homo sapiens
ccttatccaggact

SEQ ID NO: 2392085 - DNA, 15 bp, Homo sapiens
ccttatccaggactc

SEQ ID NO: 2392086 - DNA, 14 bp, Homo sapiens
ccttccccagactc

SEQ ID NO: 2392087 - DNA, 20 bp, Homo sapiens
ccttcccccatcccctttcc

SEQ ID NO: 2392088 - DNA, 21 bp, Homo sapiens
ccttcccccatcccctttcct

SEQ ID NO: 2392089 - DNA, 23 bp, Homo sapiens
ccttcccccatcccctttcctcc

SEQ ID NO: 2392090 - DNA, 14 bp, Homo sapiens
ccttcctttcctct

SEQ ID NO: 2392091 - DNA, 19 bp, Homo sapiens
ccttcctttcctctgcagc

SEQ ID NO: 2392092 - DNA, 14 bp, Homo sapiens
ccttctcctgccta

SEQ ID NO: 2392093 - DNA, 13 bp, Homo sapiens
ccttcttcgctgc

SEQ ID NO: 2392094 - DNA, 18 bp, Homo sapiens
ccttggactcctcccaca

SEQ ID NO: 2392095 - DNA, 15 bp, Homo sapiens
ccttggcgggcagcc

SEQ ID NO: 2392096 - DNA, 12 bp, Homo sapiens
cctttcctcccc

SEQ ID NO: 2392097 - DNA, 19 bp, Homo sapiens
cctttcctctgcagcactt

SEQ ID NO: 2392098 - DNA, 21 bp, Homo sapiens
cctttcctctgcagcacttta

SEQ ID NO: 2392099 - DNA, 19 bp, Homo sapiens
cctttggatgaccagaaca

SEQ ID NO: 2392100 - DNA, 14 bp, Homo sapiens
cgagaggcagagaa

SEQ ID NO: 2392101 - DNA, 15 bp, Homo sapiens
cgagaggcagagaaa

SEQ ID NO: 2392102 - DNA, 23 bp, Homo sapiens
cgagcgctttctggaaaagagga

SEQ ID NO: 2392103 - DNA, 20 bp, Homo sapiens
cgaggtagagtttgaaggag

SEQ ID NO: 2392104 - DNA, 18 bp, Homo sapiens
cgcactcacccatgtgcc

SEQ ID NO: 2392105 - DNA, 15 bp, Homo sapiens
cgcaggaactcccag

SEQ ID NO: 2392106 - DNA, 18 bp, Homo sapiens
cgcaggaactcccagcaa

SEQ ID NO: 2392107 - DNA, 21 bp, Homo sapiens
cgccacacccggctccccctg

SEQ ID NO: 2392108 - DNA, 16 bp, Homo sapiens
cgctctgccctccctg

SEQ ID NO: 2392109 - DNA, 18 bp, Homo sapiens
cgctctgccctccctggc

SEQ ID NO: 2392110 - DNA, 20 bp, Homo sapiens
cgctctgccctccctggcct

SEQ ID NO: 2392111 - DNA, 15 bp, Homo sapiens
cgctggacaacccag

SEQ ID NO: 2392112 - DNA, 22 bp, Homo sapiens
cgctttctggaaaagaggagtt

SEQ ID NO: 2392113 - DNA, 21 bp, Homo sapiens
cggagagtacagtgagccaag

SEQ ID NO: 2392114 - DNA, 19 bp, Homo sapiens
cggagcaggggtctgagcc

SEQ ID NO: 2392115 - DNA, 15 bp, Homo sapiens
cggcacgtcccatgt

SEQ ID NO: 2392116 - DNA, 17 bp, Homo sapiens
cggcccagagacccctt

SEQ ID NO: 2392117 - DNA, 14 bp, Homo sapiens
cggctccccctgct

SEQ ID NO: 2392118 - DNA, 17 bp, Homo sapiens
cgggaggctgagacagg

SEQ ID NO: 2392119 - DNA, 18 bp, Homo sapiens
cgggaggctgagacagga

SEQ ID NO: 2392120 - DNA, 13 bp, Homo sapiens
cgggcctgcctct

SEQ ID NO: 2392121 - DNA, 19 bp, Homo sapiens
cgggggagccaacagcagc

SEQ ID NO: 2392122 - DNA, 12 bp, Homo sapiens
cggggtgcagaa

SEQ ID NO: 2392123 - DNA, 14 bp, Homo sapiens
cggtcccacactgg

SEQ ID NO: 2392124 - DNA, 11 bp, Homo sapiens
cggtggctcac

SEQ ID NO: 2392125 - DNA, 18 bp, Homo sapiens
cgtgaactgcgtgccagt

SEQ ID NO: 2392126 - DNA, 12 bp, Homo sapiens
cgtgagccaggt

SEQ ID NO: 2392127 - DNA, 15 bp, Homo sapiens
cgttatatattgtat

SEQ ID NO: 2392128 - DNA, 20 bp, Homo sapiens
ctaagccactcttccaaagg

SEQ ID NO: 2392129 - DNA, 16 bp, Homo sapiens
ctaattcccagagtgt

SEQ ID NO: 2392130 - DNA, 22 bp, Homo sapiens
ctacagttgttttttgaaaaca

SEQ ID NO: 2392131 - DNA, 18 bp, Homo sapiens
ctacccagagccttctcc

SEQ ID NO: 2392132 - DNA, 12 bp, Homo sapiens
gagaccccttcc

SEQ ID NO: 2392133 - DNA, 15 bp, Homo sapiens
gagaccccttccttt

SEQ ID NO: 2392134 - DNA, 17 bp, Homo sapiens
gagaccccttcctttcc

SEQ ID NO: 2392135 - DNA, 19 bp, Homo sapiens
gagaggagaaactgagaaa

SEQ ID NO: 2392136 - DNA, 16 bp, Homo sapiens
gagagtacagtgagcc

SEQ ID NO: 2392137 - DNA, 14 bp, Homo sapiens
gagatgcagaggta

SEQ ID NO: 2392138 - DNA, 14 bp, Homo sapiens
gagcaagagctggc

SEQ ID NO: 2392139 - DNA, 23 bp, Homo sapiens
gagcacctgcttcatgctcagcc

SEQ ID NO: 2392140 - DNA, 20 bp, Homo sapiens
gagcaggggtccttggtgtg

SEQ ID NO: 2392141 - DNA, 18 bp, Homo sapiens
gagcaggggtctgagcca

SEQ ID NO: 2392142 - DNA, 17 bp, Homo sapiens
gagcattacgtgagcca

SEQ ID NO: 2392143 - DNA, 20 bp, Homo sapiens
gagcattacgtgagccaggt

SEQ ID NO: 2392144 - DNA, 21 bp, Homo sapiens
gagccaagatcgcgccactgc

SEQ ID NO: 2392145 - DNA, 18 bp, Homo sapiens
gagccaggtaatgaggga

SEQ ID NO: 2392146 - DNA, 19 bp, Homo sapiens
gagccaggtaatgagggac

SEQ ID NO: 2392147 - DNA, 19 bp, Homo sapiens
gagctgaacccattttgag

SEQ ID NO: 2392148 - DNA, 23 bp, Homo sapiens
gagctgaggggggccgtgcccag

SEQ ID NO: 2392149 - DNA, 20 bp, Homo sapiens
gagctggcaaaggtggctct

SEQ ID NO: 2392150 - DNA, 14 bp, Homo sapiens
gaggaaaagtgcaa

SEQ ID NO: 2392151 - DNA, 18 bp, Homo sapiens
gaggagtccagggcggga

SEQ ID NO: 2392152 - DNA, 18 bp, Homo sapiens
gaggatttaactgtgaac

SEQ ID NO: 2392153 - DNA, 19 bp, Homo sapiens
gaggcagagaaagaagaga

SEQ ID NO: 2392154 - DNA, 21 bp, Homo sapiens
gaggcagagaaagaagagaca

SEQ ID NO: 2392155 - DNA, 23 bp, Homo sapiens
gaggcctgccctcagggatcttg

SEQ ID NO: 2392156 - DNA, 22 bp, Homo sapiens
gaggctggtgctgtggccaggg

SEQ ID NO: 2392157 - DNA, 21 bp, Homo sapiens
gagggtcgccacacccggctc

SEQ ID NO: 2392158 - DNA, 22 bp, Homo sapiens
gaggtaaaagtgtgagcagtga

SEQ ID NO: 2392159 - DNA, 21 bp, Homo sapiens
gaggtaactatcaatatttaa

SEQ ID NO: 2392160 - DNA, 22 bp, Homo sapiens
gaggtcacattcaggaagatga

SEQ ID NO: 2392161 - DNA, 22 bp, Homo sapiens
gagtagcaagttctagagaaga

SEQ ID NO: 2392162 - DNA, 12 bp, Homo sapiens
gagtccagggcg

SEQ ID NO: 2392163 - DNA, 20 bp, Homo sapiens
gagtccagggcgggagtggg

SEQ ID NO: 2392164 - DNA, 22 bp, Homo sapiens
gagtgccaggactccccaggcc

SEQ ID NO: 2392165 - DNA, 17 bp, Homo sapiens
gagtggatctccaagga

SEQ ID NO: 2392166 - DNA, 21 bp, Homo sapiens
gagtgggggctgtgccgtgaa

SEQ ID NO: 2392167 - DNA, 22 bp, Homo sapiens
gagtgtgtttgtgtgcatgaaa

SEQ ID NO: 2392168 - DNA, 18 bp, Homo sapiens
gagttacagcgagaggca

SEQ ID NO: 2392169 - DNA, 15 bp, Homo sapiens
gagttccatgaagac

SEQ ID NO: 2392170 - DNA, 20 bp, Homo sapiens
gatacactgaagttaacaga

SEQ ID NO: 2392171 - DNA, 19 bp, Homo sapiens
gatatgtaaacataattct

SEQ ID NO: 2392172 - DNA, 12 bp, Homo sapiens
gatatttttgta

SEQ ID NO: 2392173 - DNA, 23 bp, Homo sapiens
gatcattttcttatcttctgcaa

SEQ ID NO: 2392174 - DNA, 19 bp, Homo sapiens
gatcctattctcaccagga

SEQ ID NO: 2392175 - DNA, 20 bp, Homo sapiens
gatctccaaggaccaggtta

SEQ ID NO: 2392176 - DNA, 14 bp, Homo sapiens
gatgacagagcgag

SEQ ID NO: 2392177 - DNA, 18 bp, Homo sapiens
gatgaccagaacaaggtt

SEQ ID NO: 2392178 - DNA, 15 bp, Homo sapiens
gatggatttgaagca

SEQ ID NO: 2392179 - DNA, 22 bp, Homo sapiens
gatggcccttcccactggaggt

SEQ ID NO: 2392180 - DNA, 22 bp, Homo sapiens
gatgtgaattgcctgcagagag

SEQ ID NO: 2392181 - DNA, 23 bp, Homo sapiens
gatgtgaattgcctgcagagaga

SEQ ID NO: 2392182 - DNA, 20 bp, Homo sapiens
gattacctcctgtgtggaag

SEQ ID NO: 2392183 - DNA, 16 bp, Homo sapiens
gattcccaccaaggtc

SEQ ID NO: 2392184 - DNA, 18 bp, Homo sapiens
gattggctcacccaagca

SEQ ID NO: 2392185 - DNA, 17 bp, Homo sapiens
gcaaacacacaaaggta

SEQ ID NO: 2392186 - DNA, 22 bp, Homo sapiens
gcaaagggctgaaagccatttg

SEQ ID NO: 2392187 - DNA, 19 bp, Homo sapiens
gcaacacaagctggaagca

SEQ ID NO: 2392188 - DNA, 19 bp, Homo sapiens
gcaccagcttctccaggct

SEQ ID NO: 2392189 - DNA, 20 bp, Homo sapiens
gcacctgcttcatgctcagc

SEQ ID NO: 2392190 - DNA, 17 bp, Homo sapiens
gcacgcctgcccagcct

SEQ ID NO: 2392191 - DNA, 19 bp, Homo sapiens
gcactcacccatgtgccaa

SEQ ID NO: 2392192 - DNA, 20 bp, Homo sapiens
gcactcacccatgtgccaag

SEQ ID NO: 2392193 - DNA, 17 bp, Homo sapiens
gcactccggcctgatga

SEQ ID NO: 2392194 - DNA, 21 bp, Homo sapiens
gcactgctaggcgagtgccag

SEQ ID NO: 2392195 - DNA, 20 bp, Homo sapiens
gcactttaaccctctcttcc

SEQ ID NO: 2392196 - DNA, 22 bp, Homo sapiens
gcagagagcaggacaggagaca

SEQ ID NO: 2392197 - DNA, 18 bp, Homo sapiens
gcagaggagtccagggcg

SEQ ID NO: 2392198 - DNA, 15 bp, Homo sapiens
gcagaggtgagcaga

SEQ ID NO: 2392199 - DNA, 19 bp, Homo sapiens
gcagaggtgagcagaggag

SEQ ID NO: 2392200 - DNA, 19 bp, Homo sapiens
gcagcactttaaccctctc

SEQ ID NO: 2392201 - DNA, 17 bp, Homo sapiens
gcagccaggaggagagg

SEQ ID NO: 2392202 - DNA, 16 bp, Homo sapiens
gcaggaactcccagca

SEQ ID NO: 2392203 - DNA, 12 bp, Homo sapiens
gcaggaccagga

SEQ ID NO: 2392204 - DNA, 14 bp, Homo sapiens
gcaggaccaggact

SEQ ID NO: 2392205 - DNA, 21 bp, Homo sapiens
gcagtgttcctatttggggct

SEQ ID NO: 2392206 - DNA, 13 bp, Homo sapiens
gcatcccatgggg

SEQ ID NO: 2392207 - DNA, 16 bp, Homo sapiens
gcatctgggattccca

SEQ ID NO: 2392208 - DNA, 14 bp, Homo sapiens
gcatgctcagccct

SEQ ID NO: 2392209 - DNA, 23 bp, Homo sapiens
gcatggacaccccttatccagga

SEQ ID NO: 2392210 - DNA, 15 bp, Homo sapiens
gcattacgtgagcca

SEQ ID NO: 2392211 - DNA, 17 bp, Homo sapiens
gcattacgtgagccagg

SEQ ID NO: 2392212 - DNA, 13 bp, Homo sapiens
gcattagaaatta

SEQ ID NO: 2392213 - DNA, 15 bp, Homo sapiens
gcattttaaaagcaa

SEQ ID NO: 2392214 - DNA, 22 bp, Homo sapiens
gcattttaaaagcaattatatt

SEQ ID NO: 2392215 - DNA, 12 bp, Homo sapiens
gccaacagcagc

SEQ ID NO: 2392216 - DNA, 16 bp, Homo sapiens
gccaacaggtggcagg

SEQ ID NO: 2392217 - DNA, 22 bp, Homo sapiens
gccaacaggtggcaggaccagg

SEQ ID NO: 2392218 - DNA, 14 bp, Homo sapiens
gccaacatggtgaa

SEQ ID NO: 2392219 - DNA, 15 bp, Homo sapiens
gccactctcccctcc

SEQ ID NO: 2392220 - DNA, 17 bp, Homo sapiens
gccactctcccctccct

SEQ ID NO: 2392221 - DNA, 20 bp, Homo sapiens
gccaggcaccccctggagag

SEQ ID NO: 2392222 - DNA, 21 bp, Homo sapiens
gccaggcaccccctggagaga

SEQ ID NO: 2392223 - DNA, 19 bp, Homo sapiens
gccaggccaccaggatggc

SEQ ID NO: 2392224 - DNA, 23 bp, Homo sapiens
gccagggtgagagctgctctgga

SEQ ID NO: 2392225 - DNA, 21 bp, Homo sapiens
gcccacaaactgatttctcac

SEQ ID NO: 2392226 - DNA, 19 bp, Homo sapiens
gcccacagggaaccctgct

SEQ ID NO: 2392227 - DNA, 23 bp, Homo sapiens
gcccagagaccccttcctttcct

SEQ ID NO: 2392228 - DNA, 16 bp, Homo sapiens
gcccagcctcctccca

SEQ ID NO: 2392229 - DNA, 18 bp, Homo sapiens
gcccagcctcctcccacc

SEQ ID NO: 2392230 - DNA, 19 bp, Homo sapiens
gcccagcctcctcccacca

SEQ ID NO: 2392231 - DNA, 12 bp, Homo sapiens
gcccagcctctg

SEQ ID NO: 2392232 - DNA, 14 bp, Homo sapiens
gccccaccagccac

SEQ ID NO: 2392233 - DNA, 20 bp, Homo sapiens
gccccagggggcggggtgca

SEQ ID NO: 2392234 - DNA, 17 bp, Homo sapiens
gccccgggcctgcctct

SEQ ID NO: 2392235 - DNA, 15 bp, Homo sapiens
gccctccctggcctc

SEQ ID NO: 2392236 - DNA, 22 bp, Homo sapiens
gccctgagtggatctccaagga

SEQ ID NO: 2392237 - DNA, 16 bp, Homo sapiens
gccgggtgcggtggct

SEQ ID NO: 2392238 - DNA, 12 bp, Homo sapiens
gccgtgcccagg

SEQ ID NO: 2392239 - DNA, 16 bp, Homo sapiens
gcctacattccctggc

SEQ ID NO: 2392240 - DNA, 17 bp, Homo sapiens
gcctacattccctggcc

SEQ ID NO: 2392241 - DNA, 15 bp, Homo sapiens
tcgctggacaaccca

SEQ ID NO: 2392242 - DNA, 22 bp, Homo sapiens
tctacccggcccagagacccct

SEQ ID NO: 2392243 - DNA, 14 bp, Homo sapiens
tctagactttctca

SEQ ID NO: 2392244 - DNA, 23 bp, Homo sapiens
tctagattaccccctcattgttt

SEQ ID NO: 2392245 - DNA, 15 bp, Homo sapiens
tctcaccaggaaggg

SEQ ID NO: 2392246 - DNA, 21 bp, Homo sapiens
tctcagccccgggcctgcctc

SEQ ID NO: 2392247 - DNA, 22 bp, Homo sapiens
tctcagccccgggcctgcctct

SEQ ID NO: 2392248 - DNA, 23 bp, Homo sapiens
tctcagccccgggcctgcctctg

SEQ ID NO: 2392249 - DNA, 20 bp, Homo sapiens
tctcaggatcaagaaagtgt

SEQ ID NO: 2392250 - DNA, 19 bp, Homo sapiens
tctccaggattgaagagca

SEQ ID NO: 2392251 - DNA, 14 bp, Homo sapiens
tctcctgcctacat

SEQ ID NO: 2392252 - DNA, 12 bp, Homo sapiens
tctcttccctat

SEQ ID NO: 2392253 - DNA, 13 bp, Homo sapiens
tctgaatggtcca

SEQ ID NO: 2392254 - DNA, 20 bp, Homo sapiens
tctgagaattccaaggagtt

SEQ ID NO: 2392255 - DNA, 19 bp, Homo sapiens
tctgagcaccccctcattc

SEQ ID NO: 2392256 - DNA, 20 bp, Homo sapiens
tctgagcaccccctcattcc

SEQ ID NO: 2392257 - DNA, 21 bp, Homo sapiens
tctgagcaccccctcattccc

SEQ ID NO: 2392258 - DNA, 22 bp, Homo sapiens
tctgagcaccccctcattcccc

SEQ ID NO: 2392259 - DNA, 13 bp, Homo sapiens
tctgattggctca

SEQ ID NO: 2392260 - DNA, 17 bp, Homo sapiens
tctgattggctcaccca

SEQ ID NO: 2392261 - DNA, 13 bp, Homo sapiens
tctgcacccaggg

SEQ ID NO: 2392262 - DNA, 21 bp, Homo sapiens
tctgcagcactttaaccctct

SEQ ID NO: 2392263 - DNA, 23 bp, Homo sapiens
tctgcagcactttaaccctctct

SEQ ID NO: 2392264 - DNA, 10 bp, Homo sapiens
tctgccacca

SEQ ID NO: 2392265 - DNA, 17 bp, Homo sapiens
tctgccaccatcctgct

SEQ ID NO: 2392266 - DNA, 19 bp, Homo sapiens
tctgccctccctggcctca

SEQ ID NO: 2392267 - DNA, 19 bp, Homo sapiens
tctggaaaactcaggattc

SEQ ID NO: 2392268 - DNA, 15 bp, Homo sapiens
tctggcgcaagagaa

SEQ ID NO: 2392269 - DNA, 15 bp, Homo sapiens
tctggcttccaggta

SEQ ID NO: 2392270 - DNA, 15 bp, Homo sapiens
tctgggagttccctg

SEQ ID NO: 2392271 - DNA, 12 bp, Homo sapiens
tctgtccaagga

SEQ ID NO: 2392272 - DNA, 18 bp, Homo sapiens
tctgtccctctttgcctg

SEQ ID NO: 2392273 - DNA, 16 bp, Homo sapiens
tcttcagagcaggggt

SEQ ID NO: 2392274 - DNA, 13 bp, Homo sapiens
tcttcagccatca

SEQ ID NO: 2392275 - DNA, 16 bp, Homo sapiens
tcttcagccatcaaca

SEQ ID NO: 2392276 - DNA, 19 bp, Homo sapiens
tcttcgctgctagagaagg

SEQ ID NO: 2392277 - DNA, 17 bp, Homo sapiens
tctttggaaggagtgag

SEQ ID NO: 2392278 - DNA, 24 bp, Homo sapiens
tctttggaaggagtgagatcattt

SEQ ID NO: 2392279 - DNA, 21 bp, Homo sapiens
tctttggggtcagccagggcc

SEQ ID NO: 2392280 - DNA, 18 bp, Homo sapiens
tctttgttggaaaagaat

SEQ ID NO: 2392281 - DNA, 12 bp, Homo sapiens
tgaaaaacttcc

SEQ ID NO: 2392282 - DNA, 21 bp, Homo sapiens
tgaaacaagataactgagaat

SEQ ID NO: 2392283 - DNA, 18 bp, Homo sapiens
tgaaagagaaagactgat

SEQ ID NO: 2392284 - DNA, 14 bp, Homo sapiens
tgaaagccatttgt

SEQ ID NO: 2392285 - DNA, 15 bp, Homo sapiens
tgaaagcctctggaa

SEQ ID NO: 2392286 - DNA, 14 bp, Homo sapiens
tgaaataccagtgt

SEQ ID NO: 2392287 - DNA, 16 bp, Homo sapiens
tgaaataccagtgtgg

SEQ ID NO: 2392288 - DNA, 19 bp, Homo sapiens
tgaaatctcagaattcctt

SEQ ID NO: 2392289 - DNA, 18 bp, Homo sapiens
tgaaattgtttaagtgtt

SEQ ID NO: 2392290 - DNA, 23 bp, Homo sapiens
tgaaattgtttaagtgttgtaaa

SEQ ID NO: 2392291 - DNA, 13 bp, Homo sapiens
tgaacatctgtgt

SEQ ID NO: 2392292 - DNA, 15 bp, Homo sapiens
tgaacatctgtgtgt

SEQ ID NO: 2392293 - DNA, 23 bp, Homo sapiens
tgaagagaccaagactctgaaat

SEQ ID NO: 2392294 - DNA, 17 bp, Homo sapiens
tgaagcaaagcaccagc

SEQ ID NO: 2392295 - DNA, 13 bp, Homo sapiens
tgaaggaggtgag

SEQ ID NO: 2392296 - DNA, 21 bp, Homo sapiens
tgaagggaaaggatattttct

SEQ ID NO: 2392297 - DNA, 22 bp, Homo sapiens
tgaataaagttagtgtgttgtc

SEQ ID NO: 2392298 - DNA, 17 bp, Homo sapiens
tgaatgcctcaatgtga

SEQ ID NO: 2392299 - DNA, 14 bp, Homo sapiens
tgaatggtccaggg

SEQ ID NO: 2392300 - DNA, 16 bp, Homo sapiens
tgaattgcctgcagag

SEQ ID NO: 2392301 - DNA, 17 bp, Homo sapiens
tgacataacactataaa

SEQ ID NO: 2392302 - DNA, 21 bp, Homo sapiens
tgacggtcccacactggtgac

SEQ ID NO: 2392303 - DNA, 17 bp, Homo sapiens
tgactcctctaagccac

SEQ ID NO: 2392304 - DNA, 16 bp, Homo sapiens
tgactgcgatcttcag

SEQ ID NO: 2392305 - DNA, 13 bp, Homo sapiens
tgagaattttaaa

SEQ ID NO: 2392306 - DNA, 15 bp, Homo sapiens
tgagacaggagaatc

SEQ ID NO: 2392307 - DNA, 13 bp, Homo sapiens
tgagcaccccctc

SEQ ID NO: 2392308 - DNA, 12 bp, Homo sapiens
tgagcacctgct

SEQ ID NO: 2392309 - DNA, 23 bp, Homo sapiens
tgagcagtgagttacagcgagag

SEQ ID NO: 2392310 - DNA, 21 bp, Homo sapiens
tgagcatctctgtgtacccac

SEQ ID NO: 2392311 - DNA, 16 bp, Homo sapiens
tgaggagtgtgagaat

SEQ ID NO: 2392312 - DNA, 18 bp, Homo sapiens
tgaggcctgccctcaggg

SEQ ID NO: 2392313 - DNA, 15 bp, Homo sapiens
tgaggcctggccagg

SEQ ID NO: 2392314 - DNA, 18 bp, Homo sapiens
tgaggtgtcttaagcctt

SEQ ID NO: 2392315 - DNA, 18 bp, Homo sapiens
tgatcactggcaatgaaa

SEQ ID NO: 2392316 - DNA, 14 bp, Homo sapiens
tgattacacagttg

SEQ ID NO: 2392317 - DNA, 20 bp, Homo sapiens
tgattacctcctgtgtggaa

SEQ ID NO: 2392318 - DNA, 11 bp, Homo sapiens
tgatttctcac

SEQ ID NO: 2392319 - DNA, 14 bp, Homo sapiens
tgcagagagaagcc

SEQ ID NO: 2392320 - DNA, 20 bp, Homo sapiens
tgcagaggtaaaagtgtgag

SEQ ID NO: 2392321 - DNA, 15 bp, Homo sapiens
tgcagaggtgagcag

SEQ ID NO: 2392322 - DNA, 19 bp, Homo sapiens
tgcagcactttaaccctct

SEQ ID NO: 2392323 - DNA, 23 bp, Homo sapiens
tgcagcactttaaccctctcttc

SEQ ID NO: 2392324 - DNA, 23 bp, Homo sapiens
tgcagccaggaggagaggaaagg

SEQ ID NO: 2392325 - DNA, 16 bp, Homo sapiens
tgcagttgacagcagg

SEQ ID NO: 2392326 - DNA, 12 bp, Homo sapiens
tgcagtttccaa

SEQ ID NO: 2392327 - DNA, 23 bp, Homo sapiens
tgcatctgggattcccaccaagg

SEQ ID NO: 2392328 - DNA, 22 bp, Homo sapiens
tgcatgccaaattgtagttctt

SEQ ID NO: 2392329 - DNA, 14 bp, Homo sapiens
tgcattcccagtgg

SEQ ID NO: 2392330 - DNA, 14 bp, Homo sapiens
tgcattgaatatat

SEQ ID NO: 2392331 - DNA, 15 bp, Homo sapiens
tgccaccatcctgct

SEQ ID NO: 2392332 - DNA, 21 bp, Homo sapiens
tgccagatgcctttatggctg

SEQ ID NO: 2392333 - DNA, 16 bp, Homo sapiens
tgccaggactccccag

SEQ ID NO: 2392334 - DNA, 12 bp, Homo sapiens
tgccccaccagc

SEQ ID NO: 2392335 - DNA, 23 bp, Homo sapiens
tgccctgagtggatctccaagga

SEQ ID NO: 2392336 - DNA, 19 bp, Homo sapiens
tgcctacattccctggcct

SEQ ID NO: 2392337 - DNA, 14 bp, Homo sapiens
tgcctgcagagaga

SEQ ID NO: 2392338 - DNA, 23 bp, Homo sapiens
tgcctgtgtgagcatctctgtgt

SEQ ID NO: 2392339 - DNA, 18 bp, Homo sapiens
tgctaggcgagtgccagg

SEQ ID NO: 2392340 - DNA, 22 bp, Homo sapiens
tgctaggcgagtgccaggactc

SEQ ID NO: 2392341 - DNA, 14 bp, Homo sapiens
tgctatcacacagt

SEQ ID NO: 2392342 - DNA, 13 bp, Homo sapiens
tgctcaacctctc

SEQ ID NO: 2392343 - DNA, 16 bp, Homo sapiens
tgctcaacctctctcc

SEQ ID NO: 2392344 - DNA, 17 bp, Homo sapiens
tgctcagccctgactgg

SEQ ID NO: 2392345 - DNA, 14 bp, Homo sapiens
tgctgctgtgtttt

SEQ ID NO: 2392346 - DNA, 22 bp, Homo sapiens
tgctgggaccccagctagggct

SEQ ID NO: 2392347 - DNA, 14 bp, Homo sapiens
tgcttctcagcccc

SEQ ID NO: 2392348 - DNA, 22 bp, Homo sapiens
tgcttgcactttgtaacatgtt

SEQ ID NO: 2392349 - DNA, 14 bp, Homo sapiens
tggaaaagaataca

SEQ ID NO: 2392350 - DNA, 19 bp, Homo sapiens
tggaaaagaatacagaaag

SEQ ID NO: 2392351 - DNA, 14 bp, Homo sapiens
acgtgaatgtctca

SEQ ID NO: 2392352 - DNA, 15 bp, Homo sapiens
acgtgaatgtctcag

SEQ ID NO: 2392353 - DNA, 14 bp, Homo sapiens
acgtgagccaggta

SEQ ID NO: 2392354 - DNA, 19 bp, Homo sapiens
acgttatatattgtattaa

SEQ ID NO: 2392355 - DNA, 13 bp, Homo sapiens
actaaaaatatta

SEQ ID NO: 2392356 - DNA, 15 bp, Homo sapiens
actagatggcgagca

SEQ ID NO: 2392357 - DNA, 18 bp, Homo sapiens
actataaaggttgacaat

SEQ ID NO: 2392358 - DNA, 18 bp, Homo sapiens
actatcaatatttaagtt

SEQ ID NO: 2392359 - DNA, 16 bp, Homo sapiens
actatgcacaatttaa

SEQ ID NO: 2392360 - DNA, 16 bp, Homo sapiens
actattacttgaactt

SEQ ID NO: 2392361 - DNA, 17 bp, Homo sapiens
actcacccatgtgccaa

SEQ ID NO: 2392362 - DNA, 21 bp, Homo sapiens
actcacccatgtgccaaggtg

SEQ ID NO: 2392363 - DNA, 14 bp, Homo sapiens
actcagctccagaa

SEQ ID NO: 2392364 - DNA, 16 bp, Homo sapiens
actccagtggtgaaga

SEQ ID NO: 2392365 - DNA, 13 bp, Homo sapiens
actccccaggcca

SEQ ID NO: 2392366 - DNA, 22 bp, Homo sapiens
actcctcactgccccaccagcc

SEQ ID NO: 2392367 - DNA, 12 bp, Homo sapiens
actcctcccaca

SEQ ID NO: 2392368 - DNA, 19 bp, Homo sapiens
actctcaggatcaagaaag

SEQ ID NO: 2392369 - DNA, 12 bp, Homo sapiens
actctcccctcc

SEQ ID NO: 2392370 - DNA, 13 bp, Homo sapiens
actctcccctccc

SEQ ID NO: 2392371 - DNA, 14 bp, Homo sapiens
actctcccctccct

SEQ ID NO: 2392372 - DNA, 15 bp, Homo sapiens
actctggcttccagg

SEQ ID NO: 2392373 - DNA, 17 bp, Homo sapiens
actctggcttccaggta

SEQ ID NO: 2392374 - DNA, 14 bp, Homo sapiens
actgccccaccagc

SEQ ID NO: 2392375 - DNA, 20 bp, Homo sapiens
actgccccaccagccacctc

SEQ ID NO: 2392376 - DNA, 22 bp, Homo sapiens
actgccccaccagccacctctt

SEQ ID NO: 2392377 - DNA, 19 bp, Homo sapiens
actgcgatcttcagagcag

SEQ ID NO: 2392378 - DNA, 23 bp, Homo sapiens
actgctaggcgagtgccaggact

SEQ ID NO: 2392379 - DNA, 22 bp, Homo sapiens
actggacgcccagctgaggctg

SEQ ID NO: 2392380 - DNA, 21 bp, Homo sapiens
actggaggtcacattcaggaa

SEQ ID NO: 2392381 - DNA, 12 bp, Homo sapiens
actggtgactgc

SEQ ID NO: 2392382 - DNA, 18 bp, Homo sapiens
actgtgaacctggagggc

SEQ ID NO: 2392383 - DNA, 22 bp, Homo sapiens
acttaaaaaaatgacagatgtt

SEQ ID NO: 2392384 - DNA, 13 bp, Homo sapiens
acttaaaaaactt

SEQ ID NO: 2392385 - DNA, 13 bp, Homo sapiens
acttaaaatattt

SEQ ID NO: 2392386 - DNA, 17 bp, Homo sapiens
acttccatgaggccaaa

SEQ ID NO: 2392387 - DNA, 20 bp, Homo sapiens
acttgaactttccaaaacct

SEQ ID NO: 2392388 - DNA, 16 bp, Homo sapiens
acttgggcgctctgcc

SEQ ID NO: 2392389 - DNA, 14 bp, Homo sapiens
actttccaaaacct

SEQ ID NO: 2392390 - DNA, 14 bp, Homo sapiens
actttgggaggcca

SEQ ID NO: 2392391 - DNA, 20 bp, Homo sapiens
actttgggaggccaaggtgg

SEQ ID NO: 2392392 - DNA, 21 bp, Homo sapiens
acttttgtaccagtgtgaata

SEQ ID NO: 2392393 - DNA, 14 bp, Homo sapiens
agaaacacaatatt

SEQ ID NO: 2392394 - DNA, 19 bp, Homo sapiens
agaaagatggatgtgcttt

SEQ ID NO: 2392395 - DNA, 14 bp, Homo sapiens
agaaatatgtggtt

SEQ ID NO: 2392396 - DNA, 17 bp, Homo sapiens
agaagaggctggtgctg

SEQ ID NO: 2392397 - DNA, 17 bp, Homo sapiens
agaagagtcaggaaggg

SEQ ID NO: 2392398 - DNA, 16 bp, Homo sapiens
agaagcctgttttgtt

SEQ ID NO: 2392399 - DNA, 19 bp, Homo sapiens
agaaggggcacgcctgccc

SEQ ID NO: 2392400 - DNA, 16 bp, Homo sapiens
agaagtttctggccct

SEQ ID NO: 2392401 - DNA, 21 bp, Homo sapiens
agaataaagttctgagtgttt

SEQ ID NO: 2392402 - DNA, 12 bp, Homo sapiens
agaatccctgca

SEQ ID NO: 2392403 - DNA, 16 bp, Homo sapiens
agaatccctgcagcct

SEQ ID NO: 2392404 - DNA, 17 bp, Homo sapiens
agaatgtgttttctgaa

SEQ ID NO: 2392405 - DNA, 18 bp, Homo sapiens
agaatgtgttttctgaat

SEQ ID NO: 2392406 - DNA, 14 bp, Homo sapiens
agaattccaaggag

SEQ ID NO: 2392407 - DNA, 20 bp, Homo sapiens
agaattccaaggagttccat

SEQ ID NO: 2392408 - DNA, 13 bp, Homo sapiens
agaattgggaagc

SEQ ID NO: 2392409 - DNA, 14 bp, Homo sapiens
agaattgggaagct

SEQ ID NO: 2392410 - DNA, 15 bp, Homo sapiens
agaattttaaattat

SEQ ID NO: 2392411 - DNA, 18 bp, Homo sapiens
agaattttaaattataac

SEQ ID NO: 2392412 - DNA, 15 bp, Homo sapiens
agacaggtctagact

SEQ ID NO: 2392413 - DNA, 19 bp, Homo sapiens
agaccccttcctttcctct

SEQ ID NO: 2392414 - DNA, 21 bp, Homo sapiens
agaccgagcgctttctggaaa

SEQ ID NO: 2392415 - DNA, 17 bp, Homo sapiens
agactcagctccagaat

SEQ ID NO: 2392416 - DNA, 16 bp, Homo sapiens
agactctgaaatctca

SEQ ID NO: 2392417 - DNA, 20 bp, Homo sapiens
agactctgaaatctcagaat

SEQ ID NO: 2392418 - DNA, 16 bp, Homo sapiens
agactgagcacctgct

SEQ ID NO: 2392419 - DNA, 14 bp, Homo sapiens
agagacaggagggc

SEQ ID NO: 2392420 - DNA, 15 bp, Homo sapiens
agagacaggagggca

SEQ ID NO: 2392421 - DNA, 20 bp, Homo sapiens
agagagaacaactactgtga

SEQ ID NO: 2392422 - DNA, 19 bp, Homo sapiens
agagcattacgtgagccag

SEQ ID NO: 2392423 - DNA, 20 bp, Homo sapiens
agagcattacgtgagccagg

SEQ ID NO: 2392424 - DNA, 18 bp, Homo sapiens
agagccagctctctctac

SEQ ID NO: 2392425 - DNA, 15 bp, Homo sapiens
agagcctggagaagc

SEQ ID NO: 2392426 - DNA, 16 bp, Homo sapiens
agagcctggagaagct

SEQ ID NO: 2392427 - DNA, 21 bp, Homo sapiens
agagcctttggatgaccagaa

SEQ ID NO: 2392428 - DNA, 16 bp, Homo sapiens
agagctgctctggaaa

SEQ ID NO: 2392429 - DNA, 15 bp, Homo sapiens
agagctggcaaaggt

SEQ ID NO: 2392430 - DNA, 18 bp, Homo sapiens
agagctggcaaaggtggc

SEQ ID NO: 2392431 - DNA, 17 bp, Homo sapiens
agaggaaaaaaatgact

SEQ ID NO: 2392432 - DNA, 14 bp, Homo sapiens
agaggcagagaaag

SEQ ID NO: 2392433 - DNA, 18 bp, Homo sapiens
agaggcagagaaagaaga

SEQ ID NO: 2392434 - DNA, 20 bp, Homo sapiens
agaggtaaaagtgtgagcag

SEQ ID NO: 2392435 - DNA, 22 bp, Homo sapiens
agaggtaaaagtgtgagcagtg

SEQ ID NO: 2392436 - DNA, 21 bp, Homo sapiens
agaggtaactatcaatattta

SEQ ID NO: 2392437 - DNA, 12 bp, Homo sapiens
agagtagcaagt

SEQ ID NO: 2392438 - DNA, 23 bp, Homo sapiens
agagtagcaagttctagagaaga

SEQ ID NO: 2392439 - DNA, 19 bp, Homo sapiens
agagtttgaaggaggtgag

SEQ ID NO: 2392440 - DNA, 23 bp, Homo sapiens
agatatttttgtacgttatatat

SEQ ID NO: 2392441 - DNA, 23 bp, Homo sapiens
agatgggtctggctgagctgaac

SEQ ID NO: 2392442 - DNA, 17 bp, Homo sapiens
agatgtttgtcagatat

SEQ ID NO: 2392443 - DNA, 19 bp, Homo sapiens
agatgtttgtcagatatga

SEQ ID NO: 2392444 - DNA, 21 bp, Homo sapiens
agattaccccctcattgttta

SEQ ID NO: 2392445 - DNA, 16 bp, Homo sapiens
agatttttaacgaatg

SEQ ID NO: 2392446 - DNA, 20 bp, Homo sapiens
agcaagcatttatgtttatt

SEQ ID NO: 2392447 - DNA, 20 bp, Homo sapiens
agcaagttctagagaagagg

SEQ ID NO: 2392448 - DNA, 23 bp, Homo sapiens
agcaagttctagagaagaggctg

SEQ ID NO: 2392449 - DNA, 20 bp, Homo sapiens
agcaccccctcattcccctc

SEQ ID NO: 2392450 - DNA, 21 bp, Homo sapiens
agcactgctaggcgagtgcca

SEQ ID NO: 2392451 - DNA, 17 bp, Homo sapiens
agcactttaaccctctc

SEQ ID NO: 2392452 - DNA, 18 bp, Homo sapiens
agcactttaaccctctct

SEQ ID NO: 2392453 - DNA, 23 bp, Homo sapiens
agcactttaaccctctcttccct

SEQ ID NO: 2392454 - DNA, 22 bp, Homo sapiens
agcagaggagtccagggcggga

SEQ ID NO: 2392455 - DNA, 15 bp, Homo sapiens
agcagatggaaagaa

SEQ ID NO: 2392456 - DNA, 15 bp, Homo sapiens
agcaggggtctgagc

SEQ ID NO: 2392457 - DNA, 23 bp, Homo sapiens
agcagtgagttacagcgagaggc

SEQ ID NO: 2392458 - DNA, 12 bp, Homo sapiens
agcatctctgtg

SEQ ID NO: 2392459 - DNA, 21 bp, Homo sapiens
agcatctctgtgtacccactc

SEQ ID NO: 2392460 - DNA, 17 bp, Homo sapiens
agcattacgtgagccag

SEQ ID NO: 2392461 - DNA, 22 bp, Homo sapiens
catgatgttaaccagaataaag

SEQ ID NO: 2392462 - DNA, 13 bp, Homo sapiens
catgctcagccct

SEQ ID NO: 2392463 - DNA, 23 bp, Homo sapiens
catgctcagccctgactggtgct

SEQ ID NO: 2392464 - DNA, 18 bp, Homo sapiens
catgctgaagggaccttg

SEQ ID NO: 2392465 - DNA, 21 bp, Homo sapiens
catggacaccccttatccagg

SEQ ID NO: 2392466 - DNA, 21 bp, Homo sapiens
catgtttacttttcagggcat

SEQ ID NO: 2392467 - DNA, 17 bp, Homo sapiens
cattaacttagcatgtg

SEQ ID NO: 2392468 - DNA, 17 bp, Homo sapiens
cattacgtgagccaggt

SEQ ID NO: 2392469 - DNA, 11 bp, Homo sapiens
cattcccctcg

SEQ ID NO: 2392470 - DNA, 14 bp, Homo sapiens
cattccctggcctg

SEQ ID NO: 2392471 - DNA, 18 bp, Homo sapiens
cattccctggcctggctc

SEQ ID NO: 2392472 - DNA, 16 bp, Homo sapiens
cattttaaaagcaatt

SEQ ID NO: 2392473 - DNA, 16 bp, Homo sapiens
ccaaagagcctggaga

SEQ ID NO: 2392474 - DNA, 17 bp, Homo sapiens
ccaaagagcctggagaa

SEQ ID NO: 2392475 - DNA, 18 bp, Homo sapiens
ccaaagagcctggagaag

SEQ ID NO: 2392476 - DNA, 20 bp, Homo sapiens
ccaaagagcctggagaagct

SEQ ID NO: 2392477 - DNA, 18 bp, Homo sapiens
ccaacaggtggcaggacc

SEQ ID NO: 2392478 - DNA, 19 bp, Homo sapiens
ccaacaggtggcaggacca

SEQ ID NO: 2392479 - DNA, 23 bp, Homo sapiens
ccaacaggtggcaggaccaggac

SEQ ID NO: 2392480 - DNA, 19 bp, Homo sapiens
ccaacagtcaaaacagaga

SEQ ID NO: 2392481 - DNA, 16 bp, Homo sapiens
ccacaaactgatttct

SEQ ID NO: 2392482 - DNA, 18 bp, Homo sapiens
ccacacacgcaggaactc

SEQ ID NO: 2392483 - DNA, 14 bp, Homo sapiens
ccacagcagctgaa

SEQ ID NO: 2392484 - DNA, 15 bp, Homo sapiens
ccacatccacacacg

SEQ ID NO: 2392485 - DNA, 22 bp, Homo sapiens
ccacatccacacacgcaggaac

SEQ ID NO: 2392486 - DNA, 14 bp, Homo sapiens
ccaccaccctccca

SEQ ID NO: 2392487 - DNA, 12 bp, Homo sapiens
ccaccaccttgg

SEQ ID NO: 2392488 - DNA, 15 bp, Homo sapiens
ccaccatgcgctgct

SEQ ID NO: 2392489 - DNA, 18 bp, Homo sapiens
ccaccatgcgctgctcaa

SEQ ID NO: 2392490 - DNA, 20 bp, Homo sapiens
ccaccctcccaccatgcgct

SEQ ID NO: 2392491 - DNA, 17 bp, Homo sapiens
ccacctaatcaggctga

SEQ ID NO: 2392492 - DNA, 23 bp, Homo sapiens
ccacctcttgggcatgctcagcc

SEQ ID NO: 2392493 - DNA, 15 bp, Homo sapiens
ccaccttccccagac

SEQ ID NO: 2392494 - DNA, 16 bp, Homo sapiens
ccaccttccccagact

SEQ ID NO: 2392495 - DNA, 18 bp, Homo sapiens
ccaccttccccagactca

SEQ ID NO: 2392496 - DNA, 15 bp, Homo sapiens
ccactctcccctccc

SEQ ID NO: 2392497 - DNA, 18 bp, Homo sapiens
ccactctcccctccctct

SEQ ID NO: 2392498 - DNA, 23 bp, Homo sapiens
ccactctcccctccctcttcctt

SEQ ID NO: 2392499 - DNA, 18 bp, Homo sapiens
ccagaaggggcacgcctg

SEQ ID NO: 2392500 - DNA, 19 bp, Homo sapiens
ccagaaggggcacgcctgc

SEQ ID NO: 2392501 - DNA, 20 bp, Homo sapiens
ccagaaggggcacgcctgcc

SEQ ID NO: 2392502 - DNA, 23 bp, Homo sapiens
ccagaaggggcacgcctgcccag

SEQ ID NO: 2392503 - DNA, 17 bp, Homo sapiens
ccagagaccccttcctt

SEQ ID NO: 2392504 - DNA, 22 bp, Homo sapiens
ccagagaccccttcctttcctc

SEQ ID NO: 2392505 - DNA, 23 bp, Homo sapiens
ccagagccttctcctgcctacat

SEQ ID NO: 2392506 - DNA, 12 bp, Homo sapiens
ccagagtgtgaa

SEQ ID NO: 2392507 - DNA, 17 bp, Homo sapiens
ccagatcctcacaacca

SEQ ID NO: 2392508 - DNA, 23 bp, Homo sapiens
ccagccacctcttgggcatgctc

SEQ ID NO: 2392509 - DNA, 20 bp, Homo sapiens
ccagccactcgggaggctga

SEQ ID NO: 2392510 - DNA, 16 bp, Homo sapiens
ccagcctcctcccacc

SEQ ID NO: 2392511 - DNA, 13 bp, Homo sapiens
ccagcctctgtcc

SEQ ID NO: 2392512 - DNA, 16 bp, Homo sapiens
ccagctctctctaccc

SEQ ID NO: 2392513 - DNA, 14 bp, Homo sapiens
ccagctgaggctgg

SEQ ID NO: 2392514 - DNA, 17 bp, Homo sapiens
ccagcttctccaggctc

SEQ ID NO: 2392515 - DNA, 18 bp, Homo sapiens
ccagcttctccaggctct

SEQ ID NO: 2392516 - DNA, 15 bp, Homo sapiens
ccaggactccccagg

SEQ ID NO: 2392517 - DNA, 20 bp, Homo sapiens
ccaggatggcccttcccact

SEQ ID NO: 2392518 - DNA, 16 bp, Homo sapiens
ccaggattgaagagca

SEQ ID NO: 2392519 - DNA, 18 bp, Homo sapiens
ccaggcaccccctggaga

SEQ ID NO: 2392520 - DNA, 16 bp, Homo sapiens
ccaggcaggggtggga

SEQ ID NO: 2392521 - DNA, 12 bp, Homo sapiens
ccagggccaggg

SEQ ID NO: 2392522 - DNA, 20 bp, Homo sapiens
ccagggcgggagtgggggct

SEQ ID NO: 2392523 - DNA, 23 bp, Homo sapiens
ccagggtgagagctgctctggaa

SEQ ID NO: 2392524 - DNA, 17 bp, Homo sapiens
ccagtgtggctgtctgc

SEQ ID NO: 2392525 - DNA, 12 bp, Homo sapiens
ccagtttcccac

SEQ ID NO: 2392526 - DNA, 13 bp, Homo sapiens
ccataacagccaa

SEQ ID NO: 2392527 - DNA, 14 bp, Homo sapiens
ccatcagggtgggc

SEQ ID NO: 2392528 - DNA, 13 bp, Homo sapiens
ccatcccctttcc

SEQ ID NO: 2392529 - DNA, 21 bp, Homo sapiens
ccatcccctttcctccccacc

SEQ ID NO: 2392530 - DNA, 14 bp, Homo sapiens
ccatgcgctgctca

SEQ ID NO: 2392531 - DNA, 19 bp, Homo sapiens
ccatgggggtgctgcagcc

SEQ ID NO: 2392532 - DNA, 22 bp, Homo sapiens
ccatgtgcatggaaatgtcctc

SEQ ID NO: 2392533 - DNA, 12 bp, Homo sapiens
ccattttcgctt

SEQ ID NO: 2392534 - DNA, 13 bp, Homo sapiens
cccacaaactgat

SEQ ID NO: 2392535 - DNA, 20 bp, Homo sapiens
cccaccaccctcccaccatg

SEQ ID NO: 2392536 - DNA, 23 bp, Homo sapiens
cccaccaccctcccaccatgcgc

SEQ ID NO: 2392537 - DNA, 18 bp, Homo sapiens
cccaccaccttggactcc

SEQ ID NO: 2392538 - DNA, 20 bp, Homo sapiens
cccaccaccttggactcctc

SEQ ID NO: 2392539 - DNA, 23 bp, Homo sapiens
cccaccaccttggactcctccca

SEQ ID NO: 2392540 - DNA, 12 bp, Homo sapiens
cccaccagccac

SEQ ID NO: 2392541 - DNA, 15 bp, Homo sapiens
cccaccagccacctc

SEQ ID NO: 2392542 - DNA, 17 bp, Homo sapiens
cccaccagccacctctt

SEQ ID NO: 2392543 - DNA, 17 bp, Homo sapiens
cccagagaccccttcct

SEQ ID NO: 2392544 - DNA, 22 bp, Homo sapiens
cccagagcattacgtgagccag

SEQ ID NO: 2392545 - DNA, 20 bp, Homo sapiens
cccagagccttctcctgcct

SEQ ID NO: 2392546 - DNA, 23 bp, Homo sapiens
cccagagccttctcctgcctaca

SEQ ID NO: 2392547 - DNA, 12 bp, Homo sapiens
cccagatcctca

SEQ ID NO: 2392548 - DNA, 17 bp, Homo sapiens
cccagcctcgcatgcca

SEQ ID NO: 2392549 - DNA, 17 bp, Homo sapiens
cccagctagggctggac

SEQ ID NO: 2392550 - DNA, 13 bp, Homo sapiens
cccagctgaggct

SEQ ID NO: 2392551 - DNA, 16 bp, Homo sapiens
cccagggcatcccatg

SEQ ID NO: 2392552 - DNA, 21 bp, Homo sapiens
cccagggcatcccatgggggt

SEQ ID NO: 2392553 - DNA, 18 bp, Homo sapiens
cccaggggcccacaggga

SEQ ID NO: 2392554 - DNA, 17 bp, Homo sapiens
cccatcccctttcctcc

SEQ ID NO: 2392555 - DNA, 23 bp, Homo sapiens
cccatgggggtgctgcagccagg

SEQ ID NO: 2392556 - DNA, 18 bp, Homo sapiens
cccattttgagtgactcg

SEQ ID NO: 2392557 - DNA, 19 bp, Homo sapiens
ccccaaagagcctggagaa

SEQ ID NO: 2392558 - DNA, 20 bp, Homo sapiens
ccccaaagagcctggagaag

SEQ ID NO: 2392559 - DNA, 19 bp, Homo sapiens
ccccaccagccacctcttg

SEQ ID NO: 2392560 - DNA, 13 bp, Homo sapiens
ccccaccttcccc

SEQ ID NO: 2392561 - DNA, 17 bp, Homo sapiens
ccccagactcagctcca

SEQ ID NO: 2392562 - DNA, 13 bp, Homo sapiens
ccccaggccaggc

SEQ ID NO: 2392563 - DNA, 11 bp, Homo sapiens
ccccctcattc

SEQ ID NO: 2392564 - DNA, 18 bp, Homo sapiens
ccccctgcttctcagccc

SEQ ID NO: 2392565 - DNA, 12 bp, Homo sapiens
ccccctggagag

SEQ ID NO: 2392566 - DNA, 14 bp, Homo sapiens
cccctccctcttcc

SEQ ID NO: 2392567 - DNA, 15 bp, Homo sapiens
cccctggagagaagt

SEQ ID NO: 2392568 - DNA, 14 bp, Homo sapiens
ccccttcctttcct

SEQ ID NO: 2392569 - DNA, 23 bp, Homo sapiens
ccccttcctttcctctgcagcac

SEQ ID NO: 2392570 - DNA, 18 bp, Homo sapiens
cccggctccccctgcttc

SEQ ID NO: 2392571 - DNA, 19 bp, Homo sapiens
ggcacgcctgcccagcctc

SEQ ID NO: 2392572 - DNA, 14 bp, Homo sapiens
ggcagagaaagaag

SEQ ID NO: 2392573 - DNA, 13 bp, Homo sapiens
ggcagcccagcct

SEQ ID NO: 2392574 - DNA, 14 bp, Homo sapiens
ggcagcccagcctc

SEQ ID NO: 2392575 - DNA, 18 bp, Homo sapiens
ggcagcccagcctctgtc

SEQ ID NO: 2392576 - DNA, 22 bp, Homo sapiens
ggcagcccagcctctgtccctc

SEQ ID NO: 2392577 - DNA, 15 bp, Homo sapiens
ggcaggaccaggact

SEQ ID NO: 2392578 - DNA, 16 bp, Homo sapiens
ggcaggggtgggagag

SEQ ID NO: 2392579 - DNA, 18 bp, Homo sapiens
ggcaggggtgggagagcc

SEQ ID NO: 2392580 - DNA, 14 bp, Homo sapiens
ggccatcagggtgg

SEQ ID NO: 2392581 - DNA, 16 bp, Homo sapiens
ggcccagagacccctt

SEQ ID NO: 2392582 - DNA, 19 bp, Homo sapiens
ggccccttggcgggcagcc

SEQ ID NO: 2392583 - DNA, 22 bp, Homo sapiens
ggccgtggccatcagggtgggc

SEQ ID NO: 2392584 - DNA, 17 bp, Homo sapiens
ggcctgccctcagggat

SEQ ID NO: 2392585 - DNA, 15 bp, Homo sapiens
ggcctggctctcctg

SEQ ID NO: 2392586 - DNA, 20 bp, Homo sapiens
ggcgcctgtagtcccagcca

SEQ ID NO: 2392587 - DNA, 13 bp, Homo sapiens
ggcgctctgccct

SEQ ID NO: 2392588 - DNA, 23 bp, Homo sapiens
ggcgctctgccctccctggcctc

SEQ ID NO: 2392589 - DNA, 19 bp, Homo sapiens
ggcggagagtacagtgagc

SEQ ID NO: 2392590 - DNA, 15 bp, Homo sapiens
ggcgggagtgggggc

SEQ ID NO: 2392591 - DNA, 14 bp, Homo sapiens
ggcgggggagccaa

SEQ ID NO: 2392592 - DNA, 21 bp, Homo sapiens
ggcgggggagccaacagcagc

SEQ ID NO: 2392593 - DNA, 18 bp, Homo sapiens
ggctgaccccaaagagcc

SEQ ID NO: 2392594 - DNA, 20 bp, Homo sapiens
ggctgaccccaaagagcctg

SEQ ID NO: 2392595 - DNA, 18 bp, Homo sapiens
ggctgagacaggagaatc

SEQ ID NO: 2392596 - DNA, 18 bp, Homo sapiens
ggctgggggcgggggagc

SEQ ID NO: 2392597 - DNA, 21 bp, Homo sapiens
ggctgggggcgggggagccaa

SEQ ID NO: 2392598 - DNA, 22 bp, Homo sapiens
ggctgggggcgggggagccaac

SEQ ID NO: 2392599 - DNA, 12 bp, Homo sapiens
ggcttccaggta

SEQ ID NO: 2392600 - DNA, 23 bp, Homo sapiens
gggaatgtttgggcagaagggag

SEQ ID NO: 2392601 - DNA, 19 bp, Homo sapiens
gggactggaaccagggaga

SEQ ID NO: 2392602 - DNA, 15 bp, Homo sapiens
gggagagccagctct

SEQ ID NO: 2392603 - DNA, 14 bp, Homo sapiens
gggagccaacagca

SEQ ID NO: 2392604 - DNA, 18 bp, Homo sapiens
gggaggcggagagtacag

SEQ ID NO: 2392605 - DNA, 15 bp, Homo sapiens
gggaggctgagacag

SEQ ID NO: 2392606 - DNA, 15 bp, Homo sapiens
gggattcccaccaag

SEQ ID NO: 2392607 - DNA, 18 bp, Homo sapiens
gggcacgcctgcccagcc

SEQ ID NO: 2392608 - DNA, 14 bp, Homo sapiens
gggcagaagggaga

SEQ ID NO: 2392609 - DNA, 17 bp, Homo sapiens
gggccactctcccctcc

SEQ ID NO: 2392610 - DNA, 18 bp, Homo sapiens
gggccactctcccctccc

SEQ ID NO: 2392611 - DNA, 15 bp, Homo sapiens
gggccatgctgaagg

SEQ ID NO: 2392612 - DNA, 23 bp, Homo sapiens
gggcgctctgccctccctggcct

SEQ ID NO: 2392613 - DNA, 20 bp, Homo sapiens
gggcgggggagccaacagca

SEQ ID NO: 2392614 - DNA, 21 bp, Homo sapiens
gggcgtcgctggacaacccag

SEQ ID NO: 2392615 - DNA, 23 bp, Homo sapiens
gggcgtcgctggacaacccagaa

SEQ ID NO: 2392616 - DNA, 23 bp, Homo sapiens
gggctctgacagccctgcggaga

SEQ ID NO: 2392617 - DNA, 20 bp, Homo sapiens
gggctggactctggcaccca

SEQ ID NO: 2392618 - DNA, 23 bp, Homo sapiens
ggggccaggcaggggtgggagag

SEQ ID NO: 2392619 - DNA, 24 bp, Homo sapiens
gggggtttttactccagtggtgaa

SEQ ID NO: 2392620 - DNA, 22 bp, Homo sapiens
ggggtatttaccacagcagctg

SEQ ID NO: 2392621 - DNA, 18 bp, Homo sapiens
ggggtccacccagcaaag

SEQ ID NO: 2392622 - DNA, 12 bp, Homo sapiens
gggtcagccagg

SEQ ID NO: 2392623 - DNA, 13 bp, Homo sapiens
gggtcagccaggg

SEQ ID NO: 2392624 - DNA, 20 bp, Homo sapiens
gggtctgccaccatcctgct

SEQ ID NO: 2392625 - DNA, 16 bp, Homo sapiens
gggtgggagagccagc

SEQ ID NO: 2392626 - DNA, 15 bp, Homo sapiens
gggtgggccactctc

SEQ ID NO: 2392627 - DNA, 21 bp, Homo sapiens
gggttgtgaggcctggccagg

SEQ ID NO: 2392628 - DNA, 18 bp, Homo sapiens
ggtagaattgggaagctg

SEQ ID NO: 2392629 - DNA, 23 bp, Homo sapiens
ggtagcaattctacccagagcct

SEQ ID NO: 2392630 - DNA, 13 bp, Homo sapiens
ggtatctccagga

SEQ ID NO: 2392631 - DNA, 14 bp, Homo sapiens
ggtatctccaggat

SEQ ID NO: 2392632 - DNA, 17 bp, Homo sapiens
ggtcacattcaggaaga

SEQ ID NO: 2392633 - DNA, 21 bp, Homo sapiens
ggtcacattcaggaagatgaa

SEQ ID NO: 2392634 - DNA, 21 bp, Homo sapiens
ggtcactcttcctgcaaggac

SEQ ID NO: 2392635 - DNA, 15 bp, Homo sapiens
ggtcagccagggcca

SEQ ID NO: 2392636 - DNA, 13 bp, Homo sapiens
ggtccagggttga

SEQ ID NO: 2392637 - DNA, 22 bp, Homo sapiens
ggtctgagcaccccctcattcc

SEQ ID NO: 2392638 - DNA, 15 bp, Homo sapiens
ggtctgagccacagc

SEQ ID NO: 2392639 - DNA, 12 bp, Homo sapiens
ggtctgccacca

SEQ ID NO: 2392640 - DNA, 15 bp, Homo sapiens
ggtctggctgagctg

SEQ ID NO: 2392641 - DNA, 12 bp, Homo sapiens
ggtgagggatgt

SEQ ID NO: 2392642 - DNA, 15 bp, Homo sapiens
ggtgatttcagagag

SEQ ID NO: 2392643 - DNA, 12 bp, Homo sapiens
ggtgcaaatcct

SEQ ID NO: 2392644 - DNA, 22 bp, Homo sapiens
ggtgcagaggtgagcagaggag

SEQ ID NO: 2392645 - DNA, 20 bp, Homo sapiens
ggtgcagttgacagcaggtg

SEQ ID NO: 2392646 - DNA, 19 bp, Homo sapiens
ggtgctataggctggagaa

SEQ ID NO: 2392647 - DNA, 13 bp, Homo sapiens
ggtgggagagcca

SEQ ID NO: 2392648 - DNA, 19 bp, Homo sapiens
ggtgggttctttggaagga

SEQ ID NO: 2392649 - DNA, 17 bp, Homo sapiens
ggtggtcctgagacctg

SEQ ID NO: 2392650 - DNA, 18 bp, Homo sapiens
ggtggtcctgagacctga

SEQ ID NO: 2392651 - DNA, 21 bp, Homo sapiens
ggtggtggatctgtccaagga

SEQ ID NO: 2392652 - DNA, 13 bp, Homo sapiens
ggttccctctgag

SEQ ID NO: 2392653 - DNA, 21 bp, Homo sapiens
ggttgtctgtttttgtaactt

SEQ ID NO: 2392654 - DNA, 13 bp, Homo sapiens
ggtttgtatattg

SEQ ID NO: 2392655 - DNA, 12 bp, Homo sapiens
gtaaatatttat

SEQ ID NO: 2392656 - DNA, 12 bp, Homo sapiens
gtaacatgttta

SEQ ID NO: 2392657 - DNA, 13 bp, Homo sapiens
gtaagctctggct

SEQ ID NO: 2392658 - DNA, 16 bp, Homo sapiens
gtaatcccagcacttt

SEQ ID NO: 2392659 - DNA, 20 bp, Homo sapiens
gtacccactcctcactgccc

SEQ ID NO: 2392660 - DNA, 15 bp, Homo sapiens
gtacgttatatattg

SEQ ID NO: 2392661 - DNA, 20 bp, Homo sapiens
gtagagtttgaaggaggtga

SEQ ID NO: 2392662 - DNA, 20 bp, Homo sapiens
gtagcaagttctagagaaga

SEQ ID NO: 2392663 - DNA, 13 bp, Homo sapiens
gtaggcagagcct

SEQ ID NO: 2392664 - DNA, 12 bp, Homo sapiens
gtagtcccagcc

SEQ ID NO: 2392665 - DNA, 12 bp, Homo sapiens
gtataaatggtt

SEQ ID NO: 2392666 - DNA, 14 bp, Homo sapiens
gtatgagctgaggg

SEQ ID NO: 2392667 - DNA, 17 bp, Homo sapiens
gtatggaatacagtgtt

SEQ ID NO: 2392668 - DNA, 18 bp, Homo sapiens
gtatggaatacagtgtta

SEQ ID NO: 2392669 - DNA, 19 bp, Homo sapiens
gtattaagggcattttaaa

SEQ ID NO: 2392670 - DNA, 16 bp, Homo sapiens
gtcacattcaggaaga

SEQ ID NO: 2392671 - DNA, 18 bp, Homo sapiens
gtcatatgtaggtgtctg

SEQ ID NO: 2392672 - DNA, 22 bp, Homo sapiens
gtccaaggaaacttgaatcaaa

SEQ ID NO: 2392673 - DNA, 21 bp, Homo sapiens
gtccagggcgggagtgggggc

SEQ ID NO: 2392674 - DNA, 16 bp, Homo sapiens
gtcctcccctatttta

SEQ ID NO: 2392675 - DNA, 18 bp, Homo sapiens
gtcctcccctattttaag

SEQ ID NO: 2392676 - DNA, 19 bp, Homo sapiens
gtcctctgatacccagagc

SEQ ID NO: 2392677 - DNA, 22 bp, Homo sapiens
gtccttggtgtgaccctctgaa

SEQ ID NO: 2392678 - DNA, 16 bp, Homo sapiens
gtcgctggacaaccca

SEQ ID NO: 2392679 - DNA, 17 bp, Homo sapiens
gtcggcacgtcccatgt

SEQ ID NO: 2392680 - DNA, 11 bp, Homo sapiens
gtctgtgcagc

SEQ ID NO: 2392681 - DNA, 21 bp, Homo sapiens
tgtacccactcctcactgccc

SEQ ID NO: 2392682 - DNA, 15 bp, Homo sapiens
tgtacgttatatatt

SEQ ID NO: 2392683 - DNA, 20 bp, Homo sapiens
tgtaggtgtctgcacccagg

SEQ ID NO: 2392684 - DNA, 16 bp, Homo sapiens
tgtatggaatacagtg

SEQ ID NO: 2392685 - DNA, 19 bp, Homo sapiens
tgtatggaatacagtgtta

SEQ ID NO: 2392686 - DNA, 15 bp, Homo sapiens
tgtcaactatgatat

SEQ ID NO: 2392687 - DNA, 20 bp, Homo sapiens
tgtcagatattttttcagaa

SEQ ID NO: 2392688 - DNA, 17 bp, Homo sapiens
tgtcataagaatgaata

SEQ ID NO: 2392689 - DNA, 14 bp, Homo sapiens
tgtccaaggaaact

SEQ ID NO: 2392690 - DNA, 21 bp, Homo sapiens
tgtccccacgtatgtcggcac

SEQ ID NO: 2392691 - DNA, 15 bp, Homo sapiens
tgtccctctttgcct

SEQ ID NO: 2392692 - DNA, 21 bp, Homo sapiens
tgtcctccaacaataaagagc

SEQ ID NO: 2392693 - DNA, 15 bp, Homo sapiens
tgtctgcacccaggg

SEQ ID NO: 2392694 - DNA, 16 bp, Homo sapiens
tgtctgcacccagggg

SEQ ID NO: 2392695 - DNA, 15 bp, Homo sapiens
tgtgaccaggggtga

SEQ ID NO: 2392696 - DNA, 12 bp, Homo sapiens
tgtgactctctt

SEQ ID NO: 2392697 - DNA, 14 bp, Homo sapiens
tgtgaggcctggcc

SEQ ID NO: 2392698 - DNA, 20 bp, Homo sapiens
tgtgatcaggctatgtatgg

SEQ ID NO: 2392699 - DNA, 17 bp, Homo sapiens
tgtgcatgaaagagaaa

SEQ ID NO: 2392700 - DNA, 17 bp, Homo sapiens
tgtgctttgcattccta

SEQ ID NO: 2392701 - DNA, 20 bp, Homo sapiens
tgtggccagggtgagagctg

SEQ ID NO: 2392702 - DNA, 20 bp, Homo sapiens
tgtgtggtgggttctttgga

SEQ ID NO: 2392703 - DNA, 18 bp, Homo sapiens
tgtgttgtctgtgcagct

SEQ ID NO: 2392704 - DNA, 13 bp, Homo sapiens
tgttgccctgagt

SEQ ID NO: 2392705 - DNA, 13 bp, Homo sapiens
tgttgctgtcaag

SEQ ID NO: 2392706 - DNA, 14 bp, Homo sapiens
tgttgtaaatattt

SEQ ID NO: 2392707 - DNA, 23 bp, Homo sapiens
tgttgtacatacagaggtaacta

SEQ ID NO: 2392708 - DNA, 14 bp, Homo sapiens
tgttgtctgtgcag

SEQ ID NO: 2392709 - DNA, 13 bp, Homo sapiens
tgtttattaacaa

SEQ ID NO: 2392710 - DNA, 22 bp, Homo sapiens
tgtttgggcagaagggagaagg

SEQ ID NO: 2392711 - DNA, 14 bp, Homo sapiens
tgtttgtgtgcatg

SEQ ID NO: 2392712 - DNA, 12 bp, Homo sapiens
tgttttctgaat

SEQ ID NO: 2392713 - DNA, 17 bp, Homo sapiens
tgttttctgaataacat

SEQ ID NO: 2392714 - DNA, 14 bp, Homo sapiens
tgtttttcatgaaa

SEQ ID NO: 2392715 - DNA, 19 bp, Homo sapiens
tgttttttgaaaacatggt

SEQ ID NO: 2392716 - DNA, 22 bp, Homo sapiens
ttaaaagcaattatattgtcct

SEQ ID NO: 2392717 - DNA, 14 bp, Homo sapiens
ttaaaatattttat

SEQ ID NO: 2392718 - DNA, 12 bp, Homo sapiens
ttaaaggagtta

SEQ ID NO: 2392719 - DNA, 13 bp, Homo sapiens
ttaaagtatatat

SEQ ID NO: 2392720 - DNA, 16 bp, Homo sapiens
ttaaagtatatattta

SEQ ID NO: 2392721 - DNA, 15 bp, Homo sapiens
ttaagggcattttaa

SEQ ID NO: 2392722 - DNA, 21 bp, Homo sapiens
ttaagtgttgtaaatatttat

SEQ ID NO: 2392723 - DNA, 15 bp, Homo sapiens
ttacgtgagccaggt

SEQ ID NO: 2392724 - DNA, 17 bp, Homo sapiens
ttagaggaaaaaaatga

SEQ ID NO: 2392725 - DNA, 10 bp, Homo sapiens
ttagctgagc

SEQ ID NO: 2392726 - DNA, 17 bp, Homo sapiens
ttataacttaaaatatt

SEQ ID NO: 2392727 - DNA, 16 bp, Homo sapiens
ttataagcagatttaa

SEQ ID NO: 2392728 - DNA, 12 bp, Homo sapiens
ttatattgtcct

SEQ ID NO: 2392729 - DNA, 21 bp, Homo sapiens
ttcaaaagaatcagaaacagg

SEQ ID NO: 2392730 - DNA, 22 bp, Homo sapiens
ttcacagtgtttcgacagctga

SEQ ID NO: 2392731 - DNA, 22 bp, Homo sapiens
ttcatgaaaatagctctttcag

SEQ ID NO: 2392732 - DNA, 14 bp, Homo sapiens
ttcatgctcagccc

SEQ ID NO: 2392733 - DNA, 17 bp, Homo sapiens
ttcatgctcagccctga

SEQ ID NO: 2392734 - DNA, 16 bp, Homo sapiens
ttccaaggagttccat

SEQ ID NO: 2392735 - DNA, 23 bp, Homo sapiens
ttcccccatcccctttcctcccc

SEQ ID NO: 2392736 - DNA, 17 bp, Homo sapiens
ttcctaagtataaatgg

SEQ ID NO: 2392737 - DNA, 16 bp, Homo sapiens
ttcctacaaagatgtt

SEQ ID NO: 2392738 - DNA, 23 bp, Homo sapiens
ttcctccccaccttccccagact

SEQ ID NO: 2392739 - DNA, 16 bp, Homo sapiens
ttcctctgcagcactt

SEQ ID NO: 2392740 - DNA, 11 bp, Homo sapiens
ttcctttcctc

SEQ ID NO: 2392741 - DNA, 18 bp, Homo sapiens
ttccttttctaactctcc

SEQ ID NO: 2392742 - DNA, 22 bp, Homo sapiens
ttctacccagagccttctcctg

SEQ ID NO: 2392743 - DNA, 13 bp, Homo sapiens
ttctactgtgact

SEQ ID NO: 2392744 - DNA, 18 bp, Homo sapiens
ttctccaggctctttggg

SEQ ID NO: 2392745 - DNA, 14 bp, Homo sapiens
ttctgagtgttttt

SEQ ID NO: 2392746 - DNA, 18 bp, Homo sapiens
ttcttcgctgctagagaa

SEQ ID NO: 2392747 - DNA, 21 bp, Homo sapiens
ttcttttgcccttcacagtgt

SEQ ID NO: 2392748 - DNA, 19 bp, Homo sapiens
ttgaaattgtttaagtgtt

SEQ ID NO: 2392749 - DNA, 19 bp, Homo sapiens
ttgaagggtaaagaagttt

SEQ ID NO: 2392750 - DNA, 20 bp, Homo sapiens
ttgagtgactcgagggttgg

SEQ ID NO: 2392751 - DNA, 17 bp, Homo sapiens
ttgcctactatgccaga

SEQ ID NO: 2392752 - DNA, 15 bp, Homo sapiens
ttgcctgcagagaga

SEQ ID NO: 2392753 - DNA, 14 bp, Homo sapiens
ttgcctgtgtgagc

SEQ ID NO: 2392754 - DNA, 21 bp, Homo sapiens
ttgctgtcataagaatgaata

SEQ ID NO: 2392755 - DNA, 13 bp, Homo sapiens
ttgcttgaaacca

SEQ ID NO: 2392756 - DNA, 13 bp, Homo sapiens
ttggactcctccc

SEQ ID NO: 2392757 - DNA, 13 bp, Homo sapiens
ttggagagtaaaa

SEQ ID NO: 2392758 - DNA, 17 bp, Homo sapiens
ttggagagtaaaaactg

SEQ ID NO: 2392759 - DNA, 22 bp, Homo sapiens
ttggccgtggccatcagggtgg

SEQ ID NO: 2392760 - DNA, 16 bp, Homo sapiens
ttggggtcagccaggg

SEQ ID NO: 2392761 - DNA, 16 bp, Homo sapiens
ttgtaaatatttatgt

SEQ ID NO: 2392762 - DNA, 16 bp, Homo sapiens
ttgtaacttcaaatat

SEQ ID NO: 2392763 - DNA, 16 bp, Homo sapiens
ttgtaccagtgtgaat

SEQ ID NO: 2392764 - DNA, 18 bp, Homo sapiens
ttgtacgttatatattgt

SEQ ID NO: 2392765 - DNA, 20 bp, Homo sapiens
ttgtacgttatatattgtat

SEQ ID NO: 2392766 - DNA, 20 bp, Homo sapiens
ttgtatattatggaagattt

SEQ ID NO: 2392767 - DNA, 11 bp, Homo sapiens
ttgtctgtgca

SEQ ID NO: 2392768 - DNA, 17 bp, Homo sapiens
ttgttaatggtgcaaat

SEQ ID NO: 2392769 - DNA, 21 bp, Homo sapiens
ttgttggaaaagaatacagaa

SEQ ID NO: 2392770 - DNA, 18 bp, Homo sapiens
ttgttttcttctgtatgt

SEQ ID NO: 2392771 - DNA, 16 bp, Homo sapiens
tttaagacgtgaatgt

SEQ ID NO: 2392772 - DNA, 21 bp, Homo sapiens
tttaagacgtgaatgtctcag

SEQ ID NO: 2392773 - DNA, 18 bp, Homo sapiens
tttacttgcattgaatat

SEQ ID NO: 2392774 - DNA, 23 bp, Homo sapiens
tttcatccctatgggattcagtg

SEQ ID NO: 2392775 - DNA, 20 bp, Homo sapiens
tttccacagttgctgctcct

SEQ ID NO: 2392776 - DNA, 19 bp, Homo sapiens
tttcccaccaccttggact

SEQ ID NO: 2392777 - DNA, 14 bp, Homo sapiens
tttccctgactcct

SEQ ID NO: 2392778 - DNA, 17 bp, Homo sapiens
tttcttatcttctgcaa

SEQ ID NO: 2392779 - DNA, 14 bp, Homo sapiens
tttgcattcctaca

SEQ ID NO: 2392780 - DNA, 22 bp, Homo sapiens
tttgcctgtgtgagcatctctg

SEQ ID NO: 2392781 - DNA, 19 bp, Homo sapiens
tttggtgtgtggagatgca

SEQ ID NO: 2392782 - DNA, 12 bp, Homo sapiens
tttgtatattgt

SEQ ID NO: 2392783 - DNA, 15 bp, Homo sapiens
tttgttgctgtcaag

SEQ ID NO: 2392784 - DNA, 18 bp, Homo sapiens
ttttaaaagcaattatat

SEQ ID NO: 2392785 - DNA, 21 bp, Homo sapiens
ttttaaaagcaattatattgt

SEQ ID NO: 2392786 - DNA, 15 bp, Homo sapiens
ttttcagaaatatgt

SEQ ID NO: 2392787 - DNA, 18 bp, Homo sapiens
ttttgcccttcacagtgt

SEQ ID NO: 2392788 - DNA, 20 bp, Homo sapiens
ttttgtacgttatatattgt

SEQ ID NO: 2392789 - DNA, 18 bp, Homo sapiens
tttttgtaacttcaaata

SEQ ID NO: 2392790 - DNA, 11 bp, Homo sapiens
ttttttgtaac

SEQ ID NO: 2392791 - DNA, 23 bp, Homo sapiens
aaaagggcatctcaatggcatgg

SEQ ID NO: 2392792 - DNA, 16 bp, Homo sapiens
aaaatcaccctgactg

SEQ ID NO: 2392793 - DNA, 13 bp, Homo sapiens
aaaatgtttactg

SEQ ID NO: 2392794 - DNA, 19 bp, Homo sapiens
aaaatgtttactgtaaatt

SEQ ID NO: 2392795 - DNA, 16 bp, Homo sapiens
aaacaaataatcacat

SEQ ID NO: 2392796 - DNA, 21 bp, Homo sapiens
aaaggctcaatttggtgctca

SEQ ID NO: 2392797 - DNA, 19 bp, Homo sapiens
aaaggggcgagcacccacg

SEQ ID NO: 2392798 - DNA, 23 bp, Homo sapiens
aaagtatttttgattaacaatgt

SEQ ID NO: 2392799 - DNA, 20 bp, Homo sapiens
aaatcaccctgactgtgggg

SEQ ID NO: 2392800 - DNA, 18 bp, Homo sapiens
aaatctagagtttataca

SEQ ID NO: 2392801 - DNA, 13 bp, Homo sapiens
aaatgtactggta

SEQ ID NO: 2392802 - DNA, 17 bp, Homo sapiens
aaatgtactggtaattg

SEQ ID NO: 2392803 - DNA, 19 bp, Homo sapiens
aaatgtttactgtaaattt

SEQ ID NO: 2392804 - DNA, 16 bp, Homo sapiens
aaattcttactctgga

SEQ ID NO: 2392805 - DNA, 19 bp, Homo sapiens
aaattgattaaggctttct

SEQ ID NO: 2392806 - DNA, 16 bp, Homo sapiens
aacaaataatcacatt

SEQ ID NO: 2392807 - DNA, 19 bp, Homo sapiens
aacaataaaagtgtccatt

SEQ ID NO: 2392808 - DNA, 16 bp, Homo sapiens
aacacctgatctggcc

SEQ ID NO: 2392809 - DNA, 21 bp, Homo sapiens
aacagactcaatgtccccctc

SEQ ID NO: 2392810 - DNA, 15 bp, Homo sapiens
aacagttgcacagca

SEQ ID NO: 2392811 - DNA, 12 bp, Homo sapiens
aacatatctaaa

SEQ ID NO: 2392812 - DNA, 21 bp, Homo sapiens
aacatctcgagccccctggat

SEQ ID NO: 2392813 - DNA, 16 bp, Homo sapiens
aacccccagcccctcc

SEQ ID NO: 2392814 - DNA, 16 bp, Homo sapiens
aacctcaatgccctgc

SEQ ID NO: 2392815 - DNA, 21 bp, Homo sapiens
aactctgcactccatggccac

SEQ ID NO: 2392816 - DNA, 21 bp, Homo sapiens
aactggcttgtacatttttaa

SEQ ID NO: 2392817 - DNA, 15 bp, Homo sapiens
aactgttggctaaga

SEQ ID NO: 2392818 - DNA, 19 bp, Homo sapiens
aacttattgtggcccagat

SEQ ID NO: 2392819 - DNA, 22 bp, Homo sapiens
aagaaaagcagacgcagcagct

SEQ ID NO: 2392820 - DNA, 19 bp, Homo sapiens
aagaagtggggcagcagca

SEQ ID NO: 2392821 - DNA, 12 bp, Homo sapiens
aagactacctgg

SEQ ID NO: 2392822 - DNA, 14 bp, Homo sapiens
aagatcccatttga

SEQ ID NO: 2392823 - DNA, 17 bp, Homo sapiens
aagcagacgcagcagct

SEQ ID NO: 2392824 - DNA, 19 bp, Homo sapiens
aagcagttttgtaaatgta

SEQ ID NO: 2392825 - DNA, 23 bp, Homo sapiens
aagcagttttgtaaatgtactgg

SEQ ID NO: 2392826 - DNA, 13 bp, Homo sapiens
aaggaaggcgtgt

SEQ ID NO: 2392827 - DNA, 19 bp, Homo sapiens
aaggaatttctaaggacat

SEQ ID NO: 2392828 - DNA, 18 bp, Homo sapiens
aaggacctccccctgtgt

SEQ ID NO: 2392829 - DNA, 22 bp, Homo sapiens
aaggcaggagtgctgccctctc

SEQ ID NO: 2392830 - DNA, 23 bp, Homo sapiens
aaggctctgttccacatatattt

SEQ ID NO: 2392831 - DNA, 16 bp, Homo sapiens
aaggggcgagcaccca

SEQ ID NO: 2392832 - DNA, 19 bp, Homo sapiens
aaggtcacatagctgggat

SEQ ID NO: 2392833 - DNA, 14 bp, Homo sapiens
aaggtcatggtctg

SEQ ID NO: 2392834 - DNA, 18 bp, Homo sapiens
aagtatttttgattaaca

SEQ ID NO: 2392835 - DNA, 23 bp, Homo sapiens
aagtatttttgattaacaatgta

SEQ ID NO: 2392836 - DNA, 15 bp, Homo sapiens
aagtcaacttagcat

SEQ ID NO: 2392837 - DNA, 21 bp, Homo sapiens
aagtggcataggagtgtgtta

SEQ ID NO: 2392838 - DNA, 19 bp, Homo sapiens
aagtgtttttgtgcagctg

SEQ ID NO: 2392839 - DNA, 21 bp, Homo sapiens
aagttcatgggcacctcatgg

SEQ ID NO: 2392840 - DNA, 14 bp, Homo sapiens
aataagcagcaaat

SEQ ID NO: 2392841 - DNA, 17 bp, Homo sapiens
aataatcacattgactt

SEQ ID NO: 2392842 - DNA, 19 bp, Homo sapiens
aatactggtaccttccccc

SEQ ID NO: 2392843 - DNA, 21 bp, Homo sapiens
aatatgcttatattgttcact

SEQ ID NO: 2392844 - DNA, 15 bp, Homo sapiens
aatcaccctgactgt

SEQ ID NO: 2392845 - DNA, 23 bp, Homo sapiens
aatctagagtttatacagtgtac

SEQ ID NO: 2392846 - DNA, 19 bp, Homo sapiens
aatgaaacaaataatcaca

SEQ ID NO: 2392847 - DNA, 12 bp, Homo sapiens
aatgccctgcca

SEQ ID NO: 2392848 - DNA, 13 bp, Homo sapiens
aatgccctgccat

SEQ ID NO: 2392849 - DNA, 19 bp, Homo sapiens
aatggcgtgaacccgggag

SEQ ID NO: 2392850 - DNA, 23 bp, Homo sapiens
aatggcgtgaacccgggaggtgg

SEQ ID NO: 2392851 - DNA, 15 bp, Homo sapiens
aatgtccccctcacc

SEQ ID NO: 2392852 - DNA, 13 bp, Homo sapiens
aatgtttactgta

SEQ ID NO: 2392853 - DNA, 14 bp, Homo sapiens
aatgtttactgtaa

SEQ ID NO: 2392854 - DNA, 17 bp, Homo sapiens
aatgtttactgtaaatt

SEQ ID NO: 2392855 - DNA, 21 bp, Homo sapiens
aattaaggccagaggcccatt

SEQ ID NO: 2392856 - DNA, 12 bp, Homo sapiens
aattgtacaata

SEQ ID NO: 2392857 - DNA, 16 bp, Homo sapiens
aattttcctttgtcat

SEQ ID NO: 2392858 - DNA, 13 bp, Homo sapiens
acaaataatcaca

SEQ ID NO: 2392859 - DNA, 18 bp, Homo sapiens
acaaggccctttaacttg

SEQ ID NO: 2392860 - DNA, 22 bp, Homo sapiens
acaataaaagtgtccattgaaa

SEQ ID NO: 2392861 - DNA, 20 bp, Homo sapiens
acaccacccagagcaccctc

SEQ ID NO: 2392862 - DNA, 17 bp, Homo sapiens
acacctgatctggccca

SEQ ID NO: 2392863 - DNA, 18 bp, Homo sapiens
acactttcactggggatc

SEQ ID NO: 2392864 - DNA, 20 bp, Homo sapiens
acagaaagaaaaatgcatta

SEQ ID NO: 2392865 - DNA, 22 bp, Homo sapiens
acagaaagaaaaatgcattatt

SEQ ID NO: 2392866 - DNA, 14 bp, Homo sapiens
acagggcatgcctg

SEQ ID NO: 2392867 - DNA, 16 bp, Homo sapiens
acagggcatgcctggc

SEQ ID NO: 2392868 - DNA, 13 bp, Homo sapiens
acagtccctcctg

SEQ ID NO: 2392869 - DNA, 14 bp, Homo sapiens
acagtccctcctgt

SEQ ID NO: 2392870 - DNA, 19 bp, Homo sapiens
acagtgtacatgtacatag

SEQ ID NO: 2392871 - DNA, 13 bp, Homo sapiens
acagttgcacagc

SEQ ID NO: 2392872 - DNA, 13 bp, Homo sapiens
acatagtaaagta

SEQ ID NO: 2392873 - DNA, 14 bp, Homo sapiens
acatatctaaagtc

SEQ ID NO: 2392874 - DNA, 15 bp, Homo sapiens
acatatctaaagtca

SEQ ID NO: 2392875 - DNA, 16 bp, Homo sapiens
acatctcgagccccct

SEQ ID NO: 2392876 - DNA, 12 bp, Homo sapiens
acattcctcagc

SEQ ID NO: 2392877 - DNA, 16 bp, Homo sapiens
acattcctcagctgcc

SEQ ID NO: 2392878 - DNA, 15 bp, Homo sapiens
acatttattccttcc

SEQ ID NO: 2392879 - DNA, 14 bp, Homo sapiens
accaactctgcact

SEQ ID NO: 2392880 - DNA, 15 bp, Homo sapiens
accaactctgcactc

SEQ ID NO: 2392881 - DNA, 12 bp, Homo sapiens
accacccagagc

SEQ ID NO: 2392882 - DNA, 19 bp, Homo sapiens
accatcctggcccctccag

SEQ ID NO: 2392883 - DNA, 13 bp, Homo sapiens
accattccacatc

SEQ ID NO: 2392884 - DNA, 20 bp, Homo sapiens
accattgacctcagctgcac

SEQ ID NO: 2392885 - DNA, 22 bp, Homo sapiens
accattgacctcagctgcacat

SEQ ID NO: 2392886 - DNA, 14 bp, Homo sapiens
acccacctccaccc

SEQ ID NO: 2392887 - DNA, 19 bp, Homo sapiens
acccaggctagagtgcaat

SEQ ID NO: 2392888 - DNA, 20 bp, Homo sapiens
accccagaatcccctgggga

SEQ ID NO: 2392889 - DNA, 23 bp, Homo sapiens
acccgagcccagctacattcctc

SEQ ID NO: 2392890 - DNA, 17 bp, Homo sapiens
acccgtaggcagcctct

SEQ ID NO: 2392891 - DNA, 18 bp, Homo sapiens
accctcccccaccattcc

SEQ ID NO: 2392892 - DNA, 23 bp, Homo sapiens
accctctggttgtgggcttggac

SEQ ID NO: 2392893 - DNA, 16 bp, Homo sapiens
accctcttctctgggc

SEQ ID NO: 2392894 - DNA, 22 bp, Homo sapiens
accctcttctctgggcccagag

SEQ ID NO: 2392895 - DNA, 14 bp, Homo sapiens
accctgactgtggg

SEQ ID NO: 2392896 - DNA, 18 bp, Homo sapiens
accctgccctgctgagca

SEQ ID NO: 2392897 - DNA, 16 bp, Homo sapiens
accctgcctgagccca

SEQ ID NO: 2392898 - DNA, 19 bp, Homo sapiens
accctgcctgagcccagga

SEQ ID NO: 2392899 - DNA, 14 bp, Homo sapiens
accctgtaatggtt

SEQ ID NO: 2392900 - DNA, 23 bp, Homo sapiens
acccttaaacagttgcacagcat

SEQ ID NO: 2392901 - DNA, 11 bp, Homo sapiens
acccttcctgc

SEQ ID NO: 2392902 - DNA, 17 bp, Homo sapiens
acccttcctgccaagcc

SEQ ID NO: 2392903 - DNA, 18 bp, Homo sapiens
acccttcctgccaagcca

SEQ ID NO: 2392904 - DNA, 13 bp, Homo sapiens
acccttcctgcgc

SEQ ID NO: 2392905 - DNA, 14 bp, Homo sapiens
accggtcccagcct

SEQ ID NO: 2392906 - DNA, 15 bp, Homo sapiens
accggtcccagcctg

SEQ ID NO: 2392907 - DNA, 18 bp, Homo sapiens
acctcaatgccctgccat

SEQ ID NO: 2392908 - DNA, 13 bp, Homo sapiens
acctcagctgcac

SEQ ID NO: 2392909 - DNA, 20 bp, Homo sapiens
acctcagctgcacattcctg

SEQ ID NO: 2392910 - DNA, 17 bp, Homo sapiens
acctccacccccgccac

SEQ ID NO: 2392911 - DNA, 20 bp, Homo sapiens
acctccacccccgccacggc

SEQ ID NO: 2392912 - DNA, 21 bp, Homo sapiens
acctccccctgtgtggccctg

SEQ ID NO: 2392913 - DNA, 20 bp, Homo sapiens
acctcctccactcactccag

SEQ ID NO: 2392914 - DNA, 23 bp, Homo sapiens
acctcgagatgggtgctggtcct

SEQ ID NO: 2392915 - DNA, 14 bp, Homo sapiens
acctgatctggccc

SEQ ID NO: 2392916 - DNA, 19 bp, Homo sapiens
acctgatctggcccaagct

SEQ ID NO: 2392917 - DNA, 23 bp, Homo sapiens
acctgatctggcccaagctgggc

SEQ ID NO: 2392918 - DNA, 14 bp, Homo sapiens
acctgatcttacag

SEQ ID NO: 2392919 - DNA, 21 bp, Homo sapiens
acctgatttattgaaattttt

SEQ ID NO: 2392920 - DNA, 14 bp, Homo sapiens
acctgccaggcctc

SEQ ID NO: 2392921 - DNA, 22 bp, Homo sapiens
acctggccggtaggctgctggc

SEQ ID NO: 2392922 - DNA, 17 bp, Homo sapiens
accttcccccagctttc

SEQ ID NO: 2392923 - DNA, 20 bp, Homo sapiens
accttcccccagctttccat

SEQ ID NO: 2392924 - DNA, 15 bp, Homo sapiens
accttcctgcccagg

SEQ ID NO: 2392925 - DNA, 15 bp, Homo sapiens
accttctatcctctg

SEQ ID NO: 2392926 - DNA, 18 bp, Homo sapiens
accttgggcaagtccctt

SEQ ID NO: 2392927 - DNA, 19 bp, Homo sapiens
acgagggaggaacacctga

SEQ ID NO: 2392928 - DNA, 21 bp, Homo sapiens
acgcagcagctgggacccctc

SEQ ID NO: 2392929 - DNA, 23 bp, Homo sapiens
acgcagcagctgggacccctccc

SEQ ID NO: 2392930 - DNA, 14 bp, Homo sapiens
acgcccctccccag

SEQ ID NO: 2392931 - DNA, 17 bp, Homo sapiens
acgcccctccccagccc

SEQ ID NO: 2392932 - DNA, 21 bp, Homo sapiens
acgcccctccccagcccccac

SEQ ID NO: 2392933 - DNA, 10 bp, Homo sapiens
acggccaccc

SEQ ID NO: 2392934 - DNA, 11 bp, Homo sapiens
acggccaccct

SEQ ID NO: 2392935 - DNA, 15 bp, Homo sapiens
acggccaccctcctt

SEQ ID NO: 2392936 - DNA, 16 bp, Homo sapiens
acgtgagagaatctgc

SEQ ID NO: 2392937 - DNA, 18 bp, Homo sapiens
acgtgagagaatctgcct

SEQ ID NO: 2392938 - DNA, 12 bp, Homo sapiens
actaataaagtg

SEQ ID NO: 2392939 - DNA, 14 bp, Homo sapiens
actaataaagtgcc

SEQ ID NO: 2392940 - DNA, 17 bp, Homo sapiens
actaatacagctgagct

SEQ ID NO: 2392941 - DNA, 18 bp, Homo sapiens
actacatgggccagccct

SEQ ID NO: 2392942 - DNA, 16 bp, Homo sapiens
actacccgagcccagc

SEQ ID NO: 2392943 - DNA, 20 bp, Homo sapiens
actacccgagcccagctaca

SEQ ID NO: 2392944 - DNA, 13 bp, Homo sapiens
actactcagcatg

SEQ ID NO: 2392945 - DNA, 15 bp, Homo sapiens
actataatggttgga

SEQ ID NO: 2392946 - DNA, 14 bp, Homo sapiens
actcactccagccc

SEQ ID NO: 2392947 - DNA, 19 bp, Homo sapiens
actccacagggactgttct

SEQ ID NO: 2392948 - DNA, 13 bp, Homo sapiens
actccagcctggg

SEQ ID NO: 2392949 - DNA, 18 bp, Homo sapiens
actccgggaccattgacc

SEQ ID NO: 2392950 - DNA, 17 bp, Homo sapiens
actcctgagtggggcca

SEQ ID NO: 2392951 - DNA, 16 bp, Homo sapiens
actcgagaccatcctg

SEQ ID NO: 2392952 - DNA, 20 bp, Homo sapiens
actcgagaccatcctggccc

SEQ ID NO: 2392953 - DNA, 21 bp, Homo sapiens
actcgagaccatcctggcccc

SEQ ID NO: 2392954 - DNA, 22 bp, Homo sapiens
actcgagaccatcctggcccct

SEQ ID NO: 2392955 - DNA, 13 bp, Homo sapiens
actctgcactcca

SEQ ID NO: 2392956 - DNA, 17 bp, Homo sapiens
actctgcactccatggc

SEQ ID NO: 2392957 - DNA, 18 bp, Homo sapiens
actctgctcccagcccct

SEQ ID NO: 2392958 - DNA, 23 bp, Homo sapiens
actctggagcaacctactgtcta

SEQ ID NO: 2392959 - DNA, 19 bp, Homo sapiens
actgagccgtgcagctggg

SEQ ID NO: 2392960 - DNA, 15 bp, Homo sapiens
actgatgctcctgaa

SEQ ID NO: 2392961 - DNA, 19 bp, Homo sapiens
actgcactccagcctgggt

SEQ ID NO: 2392962 - DNA, 13 bp, Homo sapiens
actggctacagta

SEQ ID NO: 2392963 - DNA, 14 bp, Homo sapiens
actggcttgtacat

SEQ ID NO: 2392964 - DNA, 15 bp, Homo sapiens
actggcttgtacatt

SEQ ID NO: 2392965 - DNA, 16 bp, Homo sapiens
actggcttgtacattt

SEQ ID NO: 2392966 - DNA, 18 bp, Homo sapiens
actggcttgtacattttt

SEQ ID NO: 2392967 - DNA, 19 bp, Homo sapiens
actggggatcccgtgctgg

SEQ ID NO: 2392968 - DNA, 16 bp, Homo sapiens
actggtaattgtacaa

SEQ ID NO: 2392969 - DNA, 17 bp, Homo sapiens
actggtaattgtacaat

SEQ ID NO: 2392970 - DNA, 17 bp, Homo sapiens
actgtctaagcagtttt

SEQ ID NO: 2392971 - DNA, 22 bp, Homo sapiens
actgtctaagcagttttgtaaa

SEQ ID NO: 2392972 - DNA, 22 bp, Homo sapiens
actgtgacctgctcctgcccac

SEQ ID NO: 2392973 - DNA, 20 bp, Homo sapiens
actgtttcactactcagcat

SEQ ID NO: 2392974 - DNA, 17 bp, Homo sapiens
acttactataatggttg

SEQ ID NO: 2392975 - DNA, 21 bp, Homo sapiens
acttagcattttctgcatctc

SEQ ID NO: 2392976 - DNA, 22 bp, Homo sapiens
acttagcattttctgcatctcc

SEQ ID NO: 2392977 - DNA, 14 bp, Homo sapiens
acttgaatccattg

SEQ ID NO: 2392978 - DNA, 14 bp, Homo sapiens
acttgacattcctt

SEQ ID NO: 2392979 - DNA, 18 bp, Homo sapiens
acttggggacaccccaga

SEQ ID NO: 2392980 - DNA, 19 bp, Homo sapiens
acttgtcttctagtttaga

SEQ ID NO: 2392981 - DNA, 14 bp, Homo sapiens
actttcccttcccc

SEQ ID NO: 2392982 - DNA, 20 bp, Homo sapiens
agaaaccatcctctcccttc

SEQ ID NO: 2392983 - DNA, 13 bp, Homo sapiens
agaaagtcacaga

SEQ ID NO: 2392984 - DNA, 14 bp, Homo sapiens
agaaagtgagcagt

SEQ ID NO: 2392985 - DNA, 13 bp, Homo sapiens
agaaatctatttc

SEQ ID NO: 2392986 - DNA, 23 bp, Homo sapiens
agaaccggtcccagcctgggctc

SEQ ID NO: 2392987 - DNA, 14 bp, Homo sapiens
agaactgtactgtt

SEQ ID NO: 2392988 - DNA, 18 bp, Homo sapiens
agaactgtactgttttct

SEQ ID NO: 2392989 - DNA, 19 bp, Homo sapiens
agaagcaaaggcaggaggt

SEQ ID NO: 2392990 - DNA, 15 bp, Homo sapiens
agaccatcctggccc

SEQ ID NO: 2392991 - DNA, 20 bp, Homo sapiens
agaccatcctggcccctcca

SEQ ID NO: 2392992 - DNA, 16 bp, Homo sapiens
agaccctcttctctgg

SEQ ID NO: 2392993 - DNA, 14 bp, Homo sapiens
agaccctgcctgag

SEQ ID NO: 2392994 - DNA, 20 bp, Homo sapiens
agacctgaaggacctccccc

SEQ ID NO: 2392995 - DNA, 15 bp, Homo sapiens
agaccttccacaaag

SEQ ID NO: 2392996 - DNA, 19 bp, Homo sapiens
agacttagatctgagccct

SEQ ID NO: 2392997 - DNA, 16 bp, Homo sapiens
agagaggcgtcctggt

SEQ ID NO: 2392998 - DNA, 17 bp, Homo sapiens
agagcaccctctggttg

SEQ ID NO: 2392999 - DNA, 15 bp, Homo sapiens
agagcagcctggcca

SEQ ID NO: 2393000 - DNA, 19 bp, Homo sapiens
agagccccgccccaccccg

SEQ ID NO: 2393001 - DNA, 21 bp, Homo sapiens
agagcctcttgtggaccccgc

SEQ ID NO: 2393002 - DNA, 16 bp, Homo sapiens
agagcttattggccac

SEQ ID NO: 2393003 - DNA, 19 bp, Homo sapiens
agagcttattggccactgg

SEQ ID NO: 2393004 - DNA, 17 bp, Homo sapiens
agaggcgtcctggtgag

SEQ ID NO: 2393005 - DNA, 22 bp, Homo sapiens
agagggggatgcccctggccct

SEQ ID NO: 2393006 - DNA, 15 bp, Homo sapiens
agagttaaaatgttt

SEQ ID NO: 2393007 - DNA, 16 bp, Homo sapiens
agagtttatacagtgt

SEQ ID NO: 2393008 - DNA, 19 bp, Homo sapiens
agagtttatacagtgtaca

SEQ ID NO: 2393009 - DNA, 21 bp, Homo sapiens
agagtttatacagtgtacatg

SEQ ID NO: 2393010 - DNA, 15 bp, Homo sapiens
agatcccctcagaag

SEQ ID NO: 2393011 - DNA, 13 bp, Homo sapiens
agatctgagccct

SEQ ID NO: 2393012 - DNA, 16 bp, Homo sapiens
agatgggacaattaga

SEQ ID NO: 2393013 - DNA, 22 bp, Homo sapiens
agcaaaggcaggaggtgggtga

SEQ ID NO: 2393014 - DNA, 16 bp, Homo sapiens
agcaaataaacaacta

SEQ ID NO: 2393015 - DNA, 16 bp, Homo sapiens
agcactcgagaccatc

SEQ ID NO: 2393016 - DNA, 18 bp, Homo sapiens
agcactcgagaccatcct

SEQ ID NO: 2393017 - DNA, 21 bp, Homo sapiens
agcactcgagaccatcctggc

SEQ ID NO: 2393018 - DNA, 19 bp, Homo sapiens
agcactttgggaagctgag

SEQ ID NO: 2393019 - DNA, 20 bp, Homo sapiens
agcagaagacaaggcatgta

SEQ ID NO: 2393020 - DNA, 16 bp, Homo sapiens
agcagacgcagcagct

SEQ ID NO: 2393021 - DNA, 12 bp, Homo sapiens
agcagcctggcc

SEQ ID NO: 2393022 - DNA, 17 bp, Homo sapiens
agcagtgttagcttagt

SEQ ID NO: 2393023 - DNA, 14 bp, Homo sapiens
agcagttttgtaaa

SEQ ID NO: 2393024 - DNA, 20 bp, Homo sapiens
cctgtgtggccctggacaca

SEQ ID NO: 2393025 - DNA, 23 bp, Homo sapiens
cctgtgtggccctggacacagcc

SEQ ID NO: 2393026 - DNA, 22 bp, Homo sapiens
cctgttgccacactttcactgg

SEQ ID NO: 2393027 - DNA, 20 bp, Homo sapiens
ccttaaacagttgcacagca

SEQ ID NO: 2393028 - DNA, 19 bp, Homo sapiens
ccttaacacctgatctggc

SEQ ID NO: 2393029 - DNA, 13 bp, Homo sapiens
ccttccccactct

SEQ ID NO: 2393030 - DNA, 20 bp, Homo sapiens
ccttcccccagctttccatc

SEQ ID NO: 2393031 - DNA, 20 bp, Homo sapiens
ccttcccgccgcccgacccc

SEQ ID NO: 2393032 - DNA, 14 bp, Homo sapiens
ccttcctgcccagg

SEQ ID NO: 2393033 - DNA, 16 bp, Homo sapiens
ccttcctgtggcctca

SEQ ID NO: 2393034 - DNA, 19 bp, Homo sapiens
ccttgagaccctcttctct

SEQ ID NO: 2393035 - DNA, 20 bp, Homo sapiens
ccttgagaccctcttctctg

SEQ ID NO: 2393036 - DNA, 19 bp, Homo sapiens
ccttgcccgccagcctcag

SEQ ID NO: 2393037 - DNA, 17 bp, Homo sapiens
ccttgccggggcctgga

SEQ ID NO: 2393038 - DNA, 20 bp, Homo sapiens
ccttgccggggcctggactg

SEQ ID NO: 2393039 - DNA, 19 bp, Homo sapiens
ccttgctctacctggccgg

SEQ ID NO: 2393040 - DNA, 21 bp, Homo sapiens
ccttgggcaagtcccttgacc

SEQ ID NO: 2393041 - DNA, 14 bp, Homo sapiens
cctttaagccaaga

SEQ ID NO: 2393042 - DNA, 11 bp, Homo sapiens
cgaactggcta

SEQ ID NO: 2393043 - DNA, 19 bp, Homo sapiens
cgagaccatcctggcccct

SEQ ID NO: 2393044 - DNA, 12 bp, Homo sapiens
cgagagcagcct

SEQ ID NO: 2393045 - DNA, 16 bp, Homo sapiens
cgagagcagcctggcc

SEQ ID NO: 2393046 - DNA, 17 bp, Homo sapiens
cgagagcagcctggcca

SEQ ID NO: 2393047 - DNA, 13 bp, Homo sapiens
cgagcccagctac

SEQ ID NO: 2393048 - DNA, 18 bp, Homo sapiens
cgagctctgtcctctgtc

SEQ ID NO: 2393049 - DNA, 18 bp, Homo sapiens
cgagggaggaacacctga

SEQ ID NO: 2393050 - DNA, 19 bp, Homo sapiens
cgaggtcctcctggcctga

SEQ ID NO: 2393051 - DNA, 15 bp, Homo sapiens
cgcaagtccccagcc

SEQ ID NO: 2393052 - DNA, 23 bp, Homo sapiens
cgcacagggcatgcctggcctga

SEQ ID NO: 2393053 - DNA, 17 bp, Homo sapiens
cgcagcgcctccaccct

SEQ ID NO: 2393054 - DNA, 21 bp, Homo sapiens
cgcagcgcctccaccctgccc

SEQ ID NO: 2393055 - DNA, 12 bp, Homo sapiens
cgccacggccac

SEQ ID NO: 2393056 - DNA, 13 bp, Homo sapiens
cgccacggccacc

SEQ ID NO: 2393057 - DNA, 14 bp, Homo sapiens
cgccacggccaccc

SEQ ID NO: 2393058 - DNA, 20 bp, Homo sapiens
cgccactgcactccagcctg

SEQ ID NO: 2393059 - DNA, 23 bp, Homo sapiens
cgccactgcactccagcctgggt

SEQ ID NO: 2393060 - DNA, 19 bp, Homo sapiens
cgcccattcgtctgtccca

SEQ ID NO: 2393061 - DNA, 17 bp, Homo sapiens
cgccccaccccgtcctg

SEQ ID NO: 2393062 - DNA, 18 bp, Homo sapiens
cgccccatgggccctcag

SEQ ID NO: 2393063 - DNA, 11 bp, Homo sapiens
cgctgctgcta

SEQ ID NO: 2393064 - DNA, 21 bp, Homo sapiens
cgctggagccgcttccccagc

SEQ ID NO: 2393065 - DNA, 14 bp, Homo sapiens
cgctgtcggtgttt

SEQ ID NO: 2393066 - DNA, 14 bp, Homo sapiens
cgcttccccagctc

SEQ ID NO: 2393067 - DNA, 23 bp, Homo sapiens
cggccatgagggctggagaccag

SEQ ID NO: 2393068 - DNA, 16 bp, Homo sapiens
cggcccacgccagctg

SEQ ID NO: 2393069 - DNA, 17 bp, Homo sapiens
cggcccacgccagctgg

SEQ ID NO: 2393070 - DNA, 18 bp, Homo sapiens
ctgagtggggcttcctgg

SEQ ID NO: 2393071 - DNA, 22 bp, Homo sapiens
ctgagtggggcttcctgggcag

SEQ ID NO: 2393072 - DNA, 22 bp, Homo sapiens
ctgatctggcccaagctgggct

SEQ ID NO: 2393073 - DNA, 23 bp, Homo sapiens
ctgattcgaggtcctcctggcct

SEQ ID NO: 2393074 - DNA, 15 bp, Homo sapiens
ctgatttcaaggtcc

SEQ ID NO: 2393075 - DNA, 22 bp, Homo sapiens
ctgatttcaaggtccgagctct

SEQ ID NO: 2393076 - DNA, 12 bp, Homo sapiens
ctgcacattcct

SEQ ID NO: 2393077 - DNA, 18 bp, Homo sapiens
ctgcacattcctggcccc

SEQ ID NO: 2393078 - DNA, 21 bp, Homo sapiens
ctgcacattcctggccccggg

SEQ ID NO: 2393079 - DNA, 15 bp, Homo sapiens
ctgcactccagcctg

SEQ ID NO: 2393080 - DNA, 16 bp, Homo sapiens
ctgcactccagcctgg

SEQ ID NO: 2393081 - DNA, 20 bp, Homo sapiens
ctgcactccagcctgggtga

SEQ ID NO: 2393082 - DNA, 12 bp, Homo sapiens
ctgcactccatg

SEQ ID NO: 2393083 - DNA, 16 bp, Homo sapiens
ctgcactccatggcca

SEQ ID NO: 2393084 - DNA, 18 bp, Homo sapiens
ctgcactccatggccacc

SEQ ID NO: 2393085 - DNA, 22 bp, Homo sapiens
ctgcactccatggccaccccgt

SEQ ID NO: 2393086 - DNA, 15 bp, Homo sapiens
ctgcatcttgctctg

SEQ ID NO: 2393087 - DNA, 22 bp, Homo sapiens
ctgcatcttgctctgtggcctt

SEQ ID NO: 2393088 - DNA, 23 bp, Homo sapiens
ctgcatcttgctctgtggccttg

SEQ ID NO: 2393089 - DNA, 18 bp, Homo sapiens
ctgccaggccctccagca

SEQ ID NO: 2393090 - DNA, 23 bp, Homo sapiens
ctgccattaaatccgcaaacagc

SEQ ID NO: 2393091 - DNA, 13 bp, Homo sapiens
ctgccccctggct

SEQ ID NO: 2393092 - DNA, 17 bp, Homo sapiens
ctgccctgctgagcaca

SEQ ID NO: 2393093 - DNA, 18 bp, Homo sapiens
ctgccctgctgagcacag

SEQ ID NO: 2393094 - DNA, 16 bp, Homo sapiens
ctgccctttccctgca

SEQ ID NO: 2393095 - DNA, 22 bp, Homo sapiens
ctgcctcactgtgacctgctcc

SEQ ID NO: 2393096 - DNA, 19 bp, Homo sapiens
ctgcctctatccctggcca

SEQ ID NO: 2393097 - DNA, 20 bp, Homo sapiens
ctgcctctatccctggccac

SEQ ID NO: 2393098 - DNA, 21 bp, Homo sapiens
ctgcctgtggccttgcccgcc

SEQ ID NO: 2393099 - DNA, 19 bp, Homo sapiens
ctgccttttagttcctgtg

SEQ ID NO: 2393100 - DNA, 23 bp, Homo sapiens
ctgccttttagttcctgtgcaca

SEQ ID NO: 2393101 - DNA, 13 bp, Homo sapiens
ctgcgtccctgct

SEQ ID NO: 2393102 - DNA, 18 bp, Homo sapiens
ctgcgtccctgctcagcc

SEQ ID NO: 2393103 - DNA, 19 bp, Homo sapiens
ctgcgtccctgctcagccc

SEQ ID NO: 2393104 - DNA, 17 bp, Homo sapiens
ctgctactacccgagcc

SEQ ID NO: 2393105 - DNA, 21 bp, Homo sapiens
ctgctactacccgagcccagc

SEQ ID NO: 2393106 - DNA, 16 bp, Homo sapiens
ctgctcagcccatccc

SEQ ID NO: 2393107 - DNA, 12 bp, Homo sapiens
ctgctccgaggg

SEQ ID NO: 2393108 - DNA, 18 bp, Homo sapiens
ctgctcctgcccacgtgc

SEQ ID NO: 2393109 - DNA, 14 bp, Homo sapiens
ctgctccttcctgt

SEQ ID NO: 2393110 - DNA, 15 bp, Homo sapiens
ctgctgccccctggc

SEQ ID NO: 2393111 - DNA, 23 bp, Homo sapiens
ctgctttttctctgcttccagtt

SEQ ID NO: 2393112 - DNA, 17 bp, Homo sapiens
ctggacacagcccaccc

SEQ ID NO: 2393113 - DNA, 19 bp, Homo sapiens
ctggacacagcccaccctc

SEQ ID NO: 2393114 - DNA, 15 bp, Homo sapiens
ctggacaccacccag

SEQ ID NO: 2393115 - DNA, 14 bp, Homo sapiens
ctggactgcacagg

SEQ ID NO: 2393116 - DNA, 18 bp, Homo sapiens
ctggactgcacaggcagc

SEQ ID NO: 2393117 - DNA, 19 bp, Homo sapiens
ctggagcaacctactgtct

SEQ ID NO: 2393118 - DNA, 20 bp, Homo sapiens
ctggagcagcagctgaggcc

SEQ ID NO: 2393119 - DNA, 23 bp, Homo sapiens
ctggagccgcttccccagctcag

SEQ ID NO: 2393120 - DNA, 23 bp, Homo sapiens
ctggagcctgcaggcaggtgggg

SEQ ID NO: 2393121 - DNA, 17 bp, Homo sapiens
ctggatgtcccctgtcc

SEQ ID NO: 2393122 - DNA, 10 bp, Homo sapiens
ctggccaccc

SEQ ID NO: 2393123 - DNA, 15 bp, Homo sapiens
ctggccaccctggcc

SEQ ID NO: 2393124 - DNA, 16 bp, Homo sapiens
ctggccaccctggccc

SEQ ID NO: 2393125 - DNA, 13 bp, Homo sapiens
ctggccacctgcc

SEQ ID NO: 2393126 - DNA, 19 bp, Homo sapiens
ctggccacctgccaggcct

SEQ ID NO: 2393127 - DNA, 22 bp, Homo sapiens
ctggccacctgccaggcctccc

SEQ ID NO: 2393128 - DNA, 19 bp, Homo sapiens
ctggccccgggctctggcc

SEQ ID NO: 2393129 - DNA, 21 bp, Homo sapiens
ctggcccctccagaccctgcc

SEQ ID NO: 2393130 - DNA, 14 bp, Homo sapiens
ctggccctgcctca

SEQ ID NO: 2393131 - DNA, 15 bp, Homo sapiens
ctggccctgcctcac

SEQ ID NO: 2393132 - DNA, 21 bp, Homo sapiens
ctggccgcaagtccccagccc

SEQ ID NO: 2393133 - DNA, 21 bp, Homo sapiens
ctggccggtaggctgctggcg

SEQ ID NO: 2393134 - DNA, 15 bp, Homo sapiens
ctggcctgagcgcag

SEQ ID NO: 2393135 - DNA, 15 bp, Homo sapiens
ctggcctgaggaccc

SEQ ID NO: 2393136 - DNA, 13 bp, Homo sapiens
ctggctggggatg

SEQ ID NO: 2393137 - DNA, 13 bp, Homo sapiens
ctggcttgtacat

SEQ ID NO: 2393138 - DNA, 14 bp, Homo sapiens
ctggctttggcgcc

SEQ ID NO: 2393139 - DNA, 22 bp, Homo sapiens
ctggcttttctggctggggatg

SEQ ID NO: 2393140 - DNA, 12 bp, Homo sapiens
ctgggacccctc

SEQ ID NO: 2393141 - DNA, 17 bp, Homo sapiens
ctgggcacccacctcca

SEQ ID NO: 2393142 - DNA, 23 bp, Homo sapiens
ctgggctcactacatgggccagc

SEQ ID NO: 2393143 - DNA, 22 bp, Homo sapiens
ctgggctccctttaagccaaga

SEQ ID NO: 2393144 - DNA, 11 bp, Homo sapiens
aggccctccag

SEQ ID NO: 2393145 - DNA, 15 bp, Homo sapiens
aggccctttaacttg

SEQ ID NO: 2393146 - DNA, 18 bp, Homo sapiens
aggccttctgatttcaag

SEQ ID NO: 2393147 - DNA, 15 bp, Homo sapiens
aggcgagtttcccca

SEQ ID NO: 2393148 - DNA, 19 bp, Homo sapiens
aggctgctgccccctggct

SEQ ID NO: 2393149 - DNA, 22 bp, Homo sapiens
agggcagaagagaaaccatcct

SEQ ID NO: 2393150 - DNA, 23 bp, Homo sapiens
agggcagaagagaaaccatcctc

SEQ ID NO: 2393151 - DNA, 19 bp, Homo sapiens
agggcatctcaatggcatg

SEQ ID NO: 2393152 - DNA, 13 bp, Homo sapiens
aggggcgagcacc

SEQ ID NO: 2393153 - DNA, 13 bp, Homo sapiens
agggtgtttcctc

SEQ ID NO: 2393154 - DNA, 17 bp, Homo sapiens
agggtgtttcctctaaa

SEQ ID NO: 2393155 - DNA, 21 bp, Homo sapiens
aggtaacttattgtggcccag

SEQ ID NO: 2393156 - DNA, 15 bp, Homo sapiens
aggtcctcctggcct

SEQ ID NO: 2393157 - DNA, 18 bp, Homo sapiens
aggttattatgattagct

SEQ ID NO: 2393158 - DNA, 19 bp, Homo sapiens
agtatttttgattaacaat

SEQ ID NO: 2393159 - DNA, 13 bp, Homo sapiens
agtcacctcctcc

SEQ ID NO: 2393160 - DNA, 20 bp, Homo sapiens
agtcacctcctccactcact

SEQ ID NO: 2393161 - DNA, 16 bp, Homo sapiens
agtgactaaaccattg

SEQ ID NO: 2393162 - DNA, 17 bp, Homo sapiens
agtgactaaaccattgt

SEQ ID NO: 2393163 - DNA, 16 bp, Homo sapiens
agtgactgaaaatggc

SEQ ID NO: 2393164 - DNA, 23 bp, Homo sapiens
agtgccacttgacattccttgtc

SEQ ID NO: 2393165 - DNA, 19 bp, Homo sapiens
agtgcttcaagggtaatct

SEQ ID NO: 2393166 - DNA, 21 bp, Homo sapiens
agtggccaagagatgcagtgc

SEQ ID NO: 2393167 - DNA, 13 bp, Homo sapiens
agtggcggggccc

SEQ ID NO: 2393168 - DNA, 22 bp, Homo sapiens
agtgggacccatagatcttctg

SEQ ID NO: 2393169 - DNA, 23 bp, Homo sapiens
agtgggacccatagatcttctga

SEQ ID NO: 2393170 - DNA, 21 bp, Homo sapiens
agtggggccagggtgggaggg

SEQ ID NO: 2393171 - DNA, 17 bp, Homo sapiens
agttcgagagcagcctg

SEQ ID NO: 2393172 - DNA, 18 bp, Homo sapiens
agttcgagagcagcctgg

SEQ ID NO: 2393173 - DNA, 21 bp, Homo sapiens
agttcgagagcagcctggcca

SEQ ID NO: 2393174 - DNA, 20 bp, Homo sapiens
agttgcacagcatctcagct

SEQ ID NO: 2393175 - DNA, 20 bp, Homo sapiens
agttggggcggcccacgcca

SEQ ID NO: 2393176 - DNA, 15 bp, Homo sapiens
agttggggctgttca

SEQ ID NO: 2393177 - DNA, 17 bp, Homo sapiens
agtttatacagtgtaca

SEQ ID NO: 2393178 - DNA, 22 bp, Homo sapiens
agtttatacagtgtacatgtac

SEQ ID NO: 2393179 - DNA, 13 bp, Homo sapiens
ataaagtgactga

SEQ ID NO: 2393180 - DNA, 20 bp, Homo sapiens
atacaaaaattagccgggca

SEQ ID NO: 2393181 - DNA, 16 bp, Homo sapiens
atacagtgtacatgta

SEQ ID NO: 2393182 - DNA, 18 bp, Homo sapiens
atacagtgtacatgtaca

SEQ ID NO: 2393183 - DNA, 18 bp, Homo sapiens
atacttgcattccagagt

SEQ ID NO: 2393184 - DNA, 16 bp, Homo sapiens
atagaactgtactgtt

SEQ ID NO: 2393185 - DNA, 11 bp, Homo sapiens
atagcctttcc

SEQ ID NO: 2393186 - DNA, 15 bp, Homo sapiens
atagctcagggtaag

SEQ ID NO: 2393187 - DNA, 12 bp, Homo sapiens
atagtaaagtat

SEQ ID NO: 2393188 - DNA, 19 bp, Homo sapiens
atcagccttttcagcaggt

SEQ ID NO: 2393189 - DNA, 17 bp, Homo sapiens
atccaccttcctgccca

SEQ ID NO: 2393190 - DNA, 17 bp, Homo sapiens
atcccagtctctgccag

SEQ ID NO: 2393191 - DNA, 18 bp, Homo sapiens
atccctggccacctgcca

SEQ ID NO: 2393192 - DNA, 22 bp, Homo sapiens
atccctggccacctgccaggcc

SEQ ID NO: 2393193 - DNA, 19 bp, Homo sapiens
atcctcctaaagacctcca

SEQ ID NO: 2393194 - DNA, 15 bp, Homo sapiens
atcctctcccttctt

SEQ ID NO: 2393195 - DNA, 14 bp, Homo sapiens
atcctggcccctcc

SEQ ID NO: 2393196 - DNA, 14 bp, Homo sapiens
cccccatcgctctg

SEQ ID NO: 2393197 - DNA, 13 bp, Homo sapiens
cccccgccacggc

SEQ ID NO: 2393198 - DNA, 17 bp, Homo sapiens
cccccgccacggccacc

SEQ ID NO: 2393199 - DNA, 22 bp, Homo sapiens
ccccctggatgtcccctgtccc

SEQ ID NO: 2393200 - DNA, 10 bp, Homo sapiens
ccccctggct

SEQ ID NO: 2393201 - DNA, 21 bp, Homo sapiens
ccccgccacggccaccctcct

SEQ ID NO: 2393202 - DNA, 24 bp, Homo sapiens
ccccggctgcttggcagttgcagt

SEQ ID NO: 2393203 - DNA, 16 bp, Homo sapiens
cccctcatcagccttt

SEQ ID NO: 2393204 - DNA, 13 bp, Homo sapiens
cccctccagaccc

SEQ ID NO: 2393205 - DNA, 17 bp, Homo sapiens
cccctccagaccctgcc

SEQ ID NO: 2393206 - DNA, 19 bp, Homo sapiens
cccctccagaccctgcctg

SEQ ID NO: 2393207 - DNA, 15 bp, Homo sapiens
cccctccccagcccc

SEQ ID NO: 2393208 - DNA, 16 bp, Homo sapiens
cccctcctctagctct

SEQ ID NO: 2393209 - DNA, 13 bp, Homo sapiens
cccctcgctgctg

SEQ ID NO: 2393210 - DNA, 15 bp, Homo sapiens
cccctgaggtcagga

SEQ ID NO: 2393211 - DNA, 21 bp, Homo sapiens
cccctggatgtcccctgtccc

SEQ ID NO: 2393212 - DNA, 13 bp, Homo sapiens
cccctggccctgc

SEQ ID NO: 2393213 - DNA, 14 bp, Homo sapiens
cccctggccctgcc

SEQ ID NO: 2393214 - DNA, 23 bp, Homo sapiens
cccctggggagaacccttcctgc

SEQ ID NO: 2393215 - DNA, 11 bp, Homo sapiens
cccctgtccca

SEQ ID NO: 2393216 - DNA, 12 bp, Homo sapiens
cccctgtcccac

SEQ ID NO: 2393217 - DNA, 17 bp, Homo sapiens
cccctgtcccaccaact

SEQ ID NO: 2393218 - DNA, 12 bp, Homo sapiens
cccgagcccagc

SEQ ID NO: 2393219 - DNA, 13 bp, Homo sapiens
cccgagcccagct

SEQ ID NO: 2393220 - DNA, 21 bp, Homo sapiens
cccgagcccagctacattcct

SEQ ID NO: 2393221 - DNA, 18 bp, Homo sapiens
cccgccacggccaccctc

SEQ ID NO: 2393222 - DNA, 14 bp, Homo sapiens
cccgccagcctcag

SEQ ID NO: 2393223 - DNA, 16 bp, Homo sapiens
cccgccagcctcagtg

SEQ ID NO: 2393224 - DNA, 14 bp, Homo sapiens
cccgcccctcgctg

SEQ ID NO: 2393225 - DNA, 17 bp, Homo sapiens
cccggatgacttgggga

SEQ ID NO: 2393226 - DNA, 15 bp, Homo sapiens
cccggcgctgagtgg

SEQ ID NO: 2393227 - DNA, 23 bp, Homo sapiens
cccggctgcttggcagttgcagt

SEQ ID NO: 2393228 - DNA, 19 bp, Homo sapiens
cccgggaggtggagcttgc

SEQ ID NO: 2393229 - DNA, 17 bp, Homo sapiens
cccgggctctggccacc

SEQ ID NO: 2393230 - DNA, 16 bp, Homo sapiens
cccgtaggcagcctct

SEQ ID NO: 2393231 - DNA, 14 bp, Homo sapiens
cccgtgctggaaga

SEQ ID NO: 2393232 - DNA, 15 bp, Homo sapiens
ccctcacccccacct

SEQ ID NO: 2393233 - DNA, 22 bp, Homo sapiens
ccctcagcgtctccccatgctg

SEQ ID NO: 2393234 - DNA, 15 bp, Homo sapiens
ccctcatcagccttt

SEQ ID NO: 2393235 - DNA, 14 bp, Homo sapiens
ccctccagaccctg

SEQ ID NO: 2393236 - DNA, 14 bp, Homo sapiens
ccctcccaacctca

SEQ ID NO: 2393237 - DNA, 18 bp, Homo sapiens
ccctcccaacctcaatgc

SEQ ID NO: 2393238 - DNA, 21 bp, Homo sapiens
ccctccgttcctcctcagcct

SEQ ID NO: 2393239 - DNA, 16 bp, Homo sapiens
ccctcctctagctctg

SEQ ID NO: 2393240 - DNA, 21 bp, Homo sapiens
ccctcgctgctgctactaccc

SEQ ID NO: 2393241 - DNA, 16 bp, Homo sapiens
ccctgcatatgcttct

SEQ ID NO: 2393242 - DNA, 14 bp, Homo sapiens
ccctgccctgctga

SEQ ID NO: 2393243 - DNA, 15 bp, Homo sapiens
ccctgccctgctgag

SEQ ID NO: 2393244 - DNA, 17 bp, Homo sapiens
ccctgccctgctgagca

SEQ ID NO: 2393245 - DNA, 22 bp, Homo sapiens
ccctgcctctatccctggccac

SEQ ID NO: 2393246 - DNA, 21 bp, Homo sapiens
ccctgcctgagcccaggagct

SEQ ID NO: 2393247 - DNA, 19 bp, Homo sapiens
ccctggacacagcccaccc

SEQ ID NO: 2393248 - DNA, 22 bp, Homo sapiens
ccctggatgtcccctgtcccac

SEQ ID NO: 2393249 - DNA, 16 bp, Homo sapiens
ccctggccctgcctca

SEQ ID NO: 2393250 - DNA, 18 bp, Homo sapiens
ccctggccctgcctcact

SEQ ID NO: 2393251 - DNA, 18 bp, Homo sapiens
ccctggggagaacccttc

SEQ ID NO: 2393252 - DNA, 19 bp, Homo sapiens
ccctggggagaacccttcc

SEQ ID NO: 2393253 - DNA, 15 bp, Homo sapiens
ccctggggcatccac

SEQ ID NO: 2393254 - DNA, 17 bp, Homo sapiens
ccctgtcccaccaactc

SEQ ID NO: 2393255 - DNA, 16 bp, Homo sapiens
ccctgtgtggccctgg

SEQ ID NO: 2393256 - DNA, 17 bp, Homo sapiens
cccttccccactctgct

SEQ ID NO: 2393257 - DNA, 23 bp, Homo sapiens
cccttcccctgtgactcctccct

SEQ ID NO: 2393258 - DNA, 12 bp, Homo sapiens
cccttcctgcca

SEQ ID NO: 2393259 - DNA, 21 bp, Homo sapiens
ccctttaagccaagagagcct

SEQ ID NO: 2393260 - DNA, 17 bp, Homo sapiens
ccctttgccagccaccc

SEQ ID NO: 2393261 - DNA, 21 bp, Homo sapiens
ccgagcccagctacattcctc

SEQ ID NO: 2393262 - DNA, 21 bp, Homo sapiens
ctgggctgttgtgtctggagc

SEQ ID NO: 2393263 - DNA, 20 bp, Homo sapiens
ctggggagaacccttcctgc

SEQ ID NO: 2393264 - DNA, 15 bp, Homo sapiens
ctgggtctcactcct

SEQ ID NO: 2393265 - DNA, 15 bp, Homo sapiens
ctgggttccctaggc

SEQ ID NO: 2393266 - DNA, 13 bp, Homo sapiens
ctggtgaggacaa

SEQ ID NO: 2393267 - DNA, 15 bp, Homo sapiens
ctggtgggaggcccg

SEQ ID NO: 2393268 - DNA, 18 bp, Homo sapiens
ctggtgtcttgagaccag

SEQ ID NO: 2393269 - DNA, 20 bp, Homo sapiens
ctggtttttcatttccattg

SEQ ID NO: 2393270 - DNA, 21 bp, Homo sapiens
ctgtaaatttttgttctttta

SEQ ID NO: 2393271 - DNA, 15 bp, Homo sapiens
ctgtaatcccagcac

SEQ ID NO: 2393272 - DNA, 14 bp, Homo sapiens
ctgtaatggttggg

SEQ ID NO: 2393273 - DNA, 14 bp, Homo sapiens
ctgtactgttttct

SEQ ID NO: 2393274 - DNA, 20 bp, Homo sapiens
ctgtactgttttctgggcca

SEQ ID NO: 2393275 - DNA, 14 bp, Homo sapiens
ctgtatcttccttt

SEQ ID NO: 2393276 - DNA, 16 bp, Homo sapiens
ctgtattcccagctac

SEQ ID NO: 2393277 - DNA, 14 bp, Homo sapiens
ctgtcccaccaact

SEQ ID NO: 2393278 - DNA, 19 bp, Homo sapiens
ctgtcccaccaactctgca

SEQ ID NO: 2393279 - DNA, 23 bp, Homo sapiens
ctgtcccagagcttattggccac

SEQ ID NO: 2393280 - DNA, 23 bp, Homo sapiens
ctgtcggtgtttggaggctgctg

SEQ ID NO: 2393281 - DNA, 14 bp, Homo sapiens
ctgtctaagcagtt

SEQ ID NO: 2393282 - DNA, 21 bp, Homo sapiens
ctgtctaagcagttttgtaaa

SEQ ID NO: 2393283 - DNA, 23 bp, Homo sapiens
ctgtctaagcagttttgtaaatg

SEQ ID NO: 2393284 - DNA, 14 bp, Homo sapiens
ctgtggccttgccc

SEQ ID NO: 2393285 - DNA, 17 bp, Homo sapiens
ctgtggccttgcccgcc

SEQ ID NO: 2393286 - DNA, 17 bp, Homo sapiens
ctgtggccttggccctg

SEQ ID NO: 2393287 - DNA, 13 bp, Homo sapiens
ctgtgggtgggga

SEQ ID NO: 2393288 - DNA, 16 bp, Homo sapiens
ctgtgggtggggaagg

SEQ ID NO: 2393289 - DNA, 21 bp, Homo sapiens
ctgtgggtggggaaggaaggc

SEQ ID NO: 2393290 - DNA, 11 bp, Homo sapiens
ctgtgtggccc

SEQ ID NO: 2393291 - DNA, 17 bp, Homo sapiens
ctgtgtggccctggaca

SEQ ID NO: 2393292 - DNA, 22 bp, Homo sapiens
ctgttcatggcaagtggggctg

SEQ ID NO: 2393293 - DNA, 17 bp, Homo sapiens
ctgttgtgtctggagcc

SEQ ID NO: 2393294 - DNA, 14 bp, Homo sapiens
ctgtttatatcttc

SEQ ID NO: 2393295 - DNA, 21 bp, Homo sapiens
ctgttttcatggacagctgag

SEQ ID NO: 2393296 - DNA, 20 bp, Homo sapiens
cttaaacagttgcacagcat

SEQ ID NO: 2393297 - DNA, 21 bp, Homo sapiens
cttagcattttctgcatctcc

SEQ ID NO: 2393298 - DNA, 20 bp, Homo sapiens
cttccccactctgctcccag

SEQ ID NO: 2393299 - DNA, 23 bp, Homo sapiens
cttccccactctgctcccagccc

SEQ ID NO: 2393300 - DNA, 17 bp, Homo sapiens
cttccctacccttcctg

SEQ ID NO: 2393301 - DNA, 18 bp, Homo sapiens
cttccctacccttcctgc

SEQ ID NO: 2393302 - DNA, 22 bp, Homo sapiens
cttcctcgcacagggcatgcct

SEQ ID NO: 2393303 - DNA, 14 bp, Homo sapiens
cttcctgcccaggg

SEQ ID NO: 2393304 - DNA, 18 bp, Homo sapiens
ggtatttatcattcaaga

SEQ ID NO: 2393305 - DNA, 13 bp, Homo sapiens
ggtcatggtctga

SEQ ID NO: 2393306 - DNA, 17 bp, Homo sapiens
ggtcccagcctgggctc

SEQ ID NO: 2393307 - DNA, 20 bp, Homo sapiens
ggtcccagcctgggctcctc

SEQ ID NO: 2393308 - DNA, 16 bp, Homo sapiens
ggtccgagctctgtcc

SEQ ID NO: 2393309 - DNA, 17 bp, Homo sapiens
ggtccgagctctgtcct

SEQ ID NO: 2393310 - DNA, 18 bp, Homo sapiens
ggtccgagctctgtcctc

SEQ ID NO: 2393311 - DNA, 19 bp, Homo sapiens
ggtctgagtggggcttcct

SEQ ID NO: 2393312 - DNA, 16 bp, Homo sapiens
ggtgagaatagaatct

SEQ ID NO: 2393313 - DNA, 11 bp, Homo sapiens
ggtgctggtcc

SEQ ID NO: 2393314 - DNA, 22 bp, Homo sapiens
ggtggagcttgcaatgagccaa

SEQ ID NO: 2393315 - DNA, 14 bp, Homo sapiens
ggtggcatgtgcct

SEQ ID NO: 2393316 - DNA, 18 bp, Homo sapiens
ggtgggatttgctcctgg

SEQ ID NO: 2393317 - DNA, 16 bp, Homo sapiens
ggtgtcatctgctcct

SEQ ID NO: 2393318 - DNA, 22 bp, Homo sapiens
ggtgtcatctgctccttcctgt

SEQ ID NO: 2393319 - DNA, 16 bp, Homo sapiens
ggtgtcttgagaccag

SEQ ID NO: 2393320 - DNA, 22 bp, Homo sapiens
ggtgtttggaggctgctgcccc

SEQ ID NO: 2393321 - DNA, 19 bp, Homo sapiens
gtaaatactggtaccttcc

SEQ ID NO: 2393322 - DNA, 15 bp, Homo sapiens
gtaaatctagagttt

SEQ ID NO: 2393323 - DNA, 17 bp, Homo sapiens
gtaactgccctttccct

SEQ ID NO: 2393324 - DNA, 14 bp, Homo sapiens
gtaattagtttaaa

SEQ ID NO: 2393325 - DNA, 13 bp, Homo sapiens
gtaattgtacaat

SEQ ID NO: 2393326 - DNA, 12 bp, Homo sapiens
gtacatagtaaa

SEQ ID NO: 2393327 - DNA, 18 bp, Homo sapiens
gtacatagtaaagtattt

SEQ ID NO: 2393328 - DNA, 23 bp, Homo sapiens
gtacatgtacatagtaaagtatt

SEQ ID NO: 2393329 - DNA, 15 bp, Homo sapiens
gtactggtaattgta

SEQ ID NO: 2393330 - DNA, 18 bp, Homo sapiens
gtagaagcaaaggcagga

SEQ ID NO: 2393331 - DNA, 13 bp, Homo sapiens
gtaggcagcctct

SEQ ID NO: 2393332 - DNA, 17 bp, Homo sapiens
gtaggctgctggcgcct

SEQ ID NO: 2393333 - DNA, 21 bp, Homo sapiens
gtaggttattatgattagctt

SEQ ID NO: 2393334 - DNA, 19 bp, Homo sapiens
gtatttttgattaacaatg

SEQ ID NO: 2393335 - DNA, 20 bp, Homo sapiens
gtatttttgattaacaatgt

SEQ ID NO: 2393336 - DNA, 19 bp, Homo sapiens
gtcaccaaggtggcttctc

SEQ ID NO: 2393337 - DNA, 16 bp, Homo sapiens
gtcacctcctccactc

SEQ ID NO: 2393338 - DNA, 23 bp, Homo sapiens
gtcagcccctcatcagccttttc

SEQ ID NO: 2393339 - DNA, 18 bp, Homo sapiens
gtcatctgctccttcctg

SEQ ID NO: 2393340 - DNA, 15 bp, Homo sapiens
gtcatgcgtccactt

SEQ ID NO: 2393341 - DNA, 19 bp, Homo sapiens
gtcatggtctgagtggggc

SEQ ID NO: 2393342 - DNA, 16 bp, Homo sapiens
gtccattgccacggcc

SEQ ID NO: 2393343 - DNA, 21 bp, Homo sapiens
gtcccaccaactctgcactcc

SEQ ID NO: 2393344 - DNA, 23 bp, Homo sapiens
gtcccaccaactctgcactccat

SEQ ID NO: 2393345 - DNA, 21 bp, Homo sapiens
gtcccagagcttattggccac

SEQ ID NO: 2393346 - DNA, 16 bp, Homo sapiens
gtcccagcctgggctc

SEQ ID NO: 2393347 - DNA, 13 bp, Homo sapiens
gtccccctcaccc

SEQ ID NO: 2393348 - DNA, 15 bp, Homo sapiens
gtccccctcaccccc

SEQ ID NO: 2393349 - DNA, 14 bp, Homo sapiens
gtccctgctcagcc

SEQ ID NO: 2393350 - DNA, 15 bp, Homo sapiens
gtccctgctcagccc

SEQ ID NO: 2393351 - DNA, 18 bp, Homo sapiens
gtccctgctcagcccatc

SEQ ID NO: 2393352 - DNA, 20 bp, Homo sapiens
gtccctgctcagcccatccc

SEQ ID NO: 2393353 - DNA, 24 bp, Homo sapiens
gtccctgctcagcccatcccctgc

SEQ ID NO: 2393354 - DNA, 16 bp, Homo sapiens
gtcctctgtcagtcat

SEQ ID NO: 2393355 - DNA, 21 bp, Homo sapiens
gtcggtgtttggaggctgctg

SEQ ID NO: 2393356 - DNA, 20 bp, Homo sapiens
gtctaagcagttttgtaaat

SEQ ID NO: 2393357 - DNA, 18 bp, Homo sapiens
gtctccccatgctgggct

SEQ ID NO: 2393358 - DNA, 19 bp, Homo sapiens
gtctccccatgctgggctc

SEQ ID NO: 2393359 - DNA, 20 bp, Homo sapiens
gtctccccatgctgggctca

SEQ ID NO: 2393360 - DNA, 13 bp, Homo sapiens
gtctcccttagat

SEQ ID NO: 2393361 - DNA, 20 bp, Homo sapiens
gtctgagtggggcttcctgg

SEQ ID NO: 2393362 - DNA, 20 bp, Homo sapiens
gtcttgagaccagcctgcca

SEQ ID NO: 2393363 - DNA, 22 bp, Homo sapiens
gtcttgagaccagcctgccagg

SEQ ID NO: 2393364 - DNA, 13 bp, Homo sapiens
gtgacctgctcct

SEQ ID NO: 2393365 - DNA, 18 bp, Homo sapiens
gtgacctgctcctgccca

SEQ ID NO: 2393366 - DNA, 17 bp, Homo sapiens
gtgagagaatctgcctg

SEQ ID NO: 2393367 - DNA, 12 bp, Homo sapiens
gtgaggccaaga

SEQ ID NO: 2393368 - DNA, 23 bp, Homo sapiens
gtgatttttttttttttcctgtc

SEQ ID NO: 2393369 - DNA, 18 bp, Homo sapiens
gtgccacttgacattcct

SEQ ID NO: 2393370 - DNA, 19 bp, Homo sapiens
gtgccacttgacattcctt

SEQ ID NO: 2393371 - DNA, 13 bp, Homo sapiens
gtgccctggggca

SEQ ID NO: 2393372 - DNA, 23 bp, Homo sapiens
gtgctcaataaagaagcccatgg

SEQ ID NO: 2393373 - DNA, 15 bp, Homo sapiens
gtgctcacgtgtcct

SEQ ID NO: 2393374 - DNA, 12 bp, Homo sapiens
gtgcttgtgcct

SEQ ID NO: 2393375 - DNA, 13 bp, Homo sapiens
gtggcatgtgcct

SEQ ID NO: 2393376 - DNA, 21 bp, Homo sapiens
gtggccctggacacagcccac

SEQ ID NO: 2393377 - DNA, 23 bp, Homo sapiens
gtggccttgcccgccagcctcag

SEQ ID NO: 2393378 - DNA, 15 bp, Homo sapiens
gtggcggggcccctg

SEQ ID NO: 2393379 - DNA, 13 bp, Homo sapiens
gtggctcatgcct

SEQ ID NO: 2393380 - DNA, 22 bp, Homo sapiens
gtgggacccatagatcttctga

SEQ ID NO: 2393381 - DNA, 13 bp, Homo sapiens
gtggggcttcctg

SEQ ID NO: 2393382 - DNA, 17 bp, Homo sapiens
gtgtttggaggctgctg

SEQ ID NO: 2393383 - DNA, 14 bp, Homo sapiens
gttaaaatgtttac

SEQ ID NO: 2393384 - DNA, 18 bp, Homo sapiens
gttaaaatgtttactgta

SEQ ID NO: 2393385 - DNA, 17 bp, Homo sapiens
gttcagcggagctagca

SEQ ID NO: 2393386 - DNA, 17 bp, Homo sapiens
gttccatgcctggccct

SEQ ID NO: 2393387 - DNA, 13 bp, Homo sapiens
gttcctcctcagc

SEQ ID NO: 2393388 - DNA, 16 bp, Homo sapiens
gttcctcctcagcctc

SEQ ID NO: 2393389 - DNA, 17 bp, Homo sapiens
gttcctcctcagcctcc

SEQ ID NO: 2393390 - DNA, 23 bp, Homo sapiens
gttcctggacaccacccagagca

SEQ ID NO: 2393391 - DNA, 18 bp, Homo sapiens
gttgcacagtccctcctg

SEQ ID NO: 2393392 - DNA, 23 bp, Homo sapiens
gttggagttgattcatgtgcttg

SEQ ID NO: 2393393 - DNA, 21 bp, Homo sapiens
gttggctaagaagaaatgcaa

SEQ ID NO: 2393394 - DNA, 22 bp, Homo sapiens
gttggggcggcccacgccagct

SEQ ID NO: 2393395 - DNA, 13 bp, Homo sapiens
gttgtctacatta

SEQ ID NO: 2393396 - DNA, 15 bp, Homo sapiens
gtttactgtaaattt

SEQ ID NO: 2393397 - DNA, 13 bp, Homo sapiens
gtttatacagtgt

SEQ ID NO: 2393398 - DNA, 19 bp, Homo sapiens
gtttccccactaataaagt

SEQ ID NO: 2393399 - DNA, 14 bp, Homo sapiens
gtttcttttgcaat

SEQ ID NO: 2393400 - DNA, 18 bp, Homo sapiens
gtttggaggctgctgccc

SEQ ID NO: 2393401 - DNA, 23 bp, Homo sapiens
gtttgttgcacagtccctcctgt

SEQ ID NO: 2393402 - DNA, 21 bp, Homo sapiens
gttttcatggacagctgagca

SEQ ID NO: 2393403 - DNA, 13 bp, Homo sapiens
gttttgtaaatgt

SEQ ID NO: 2393404 - DNA, 23 bp, Homo sapiens
gttttgtaaatgtactggtaatt

SEQ ID NO: 2393405 - DNA, 22 bp, Homo sapiens
taaaaccttccatgtcaagatt

SEQ ID NO: 2393406 - DNA, 16 bp, Homo sapiens
taaaagtgtccattga

SEQ ID NO: 2393407 - DNA, 18 bp, Homo sapiens
taaaagtgtccattgaaa

SEQ ID NO: 2393408 - DNA, 14 bp, Homo sapiens
taaaatgtttactg

SEQ ID NO: 2393409 - DNA, 16 bp, Homo sapiens
taaaatgtttactgta

SEQ ID NO: 2393410 - DNA, 19 bp, Homo sapiens
taaaatgtttactgtaaat

SEQ ID NO: 2393411 - DNA, 20 bp, Homo sapiens
taaaatgtttactgtaaatt

SEQ ID NO: 2393412 - DNA, 18 bp, Homo sapiens
taaacagttgcacagcat

SEQ ID NO: 2393413 - DNA, 22 bp, Homo sapiens
taaacagttgcacagcatctca

SEQ ID NO: 2393414 - DNA, 19 bp, Homo sapiens
taaagtatttttgattaac

SEQ ID NO: 2393415 - DNA, 18 bp, Homo sapiens
taaagtcatcatgaactg

SEQ ID NO: 2393416 - DNA, 23 bp, Homo sapiens
taaatctagagtttatacagtgt

SEQ ID NO: 2393417 - DNA, 14 bp, Homo sapiens
taaattcttactct

SEQ ID NO: 2393418 - DNA, 15 bp, Homo sapiens
taacatatctaaagt

SEQ ID NO: 2393419 - DNA, 18 bp, Homo sapiens
taacatatctaaagtcat

SEQ ID NO: 2393420 - DNA, 22 bp, Homo sapiens
taagattttctgggataacagt

SEQ ID NO: 2393421 - DNA, 20 bp, Homo sapiens
tccacccccgccacggccac

SEQ ID NO: 2393422 - DNA, 21 bp, Homo sapiens
tccacccccgccacggccacc

SEQ ID NO: 2393423 - DNA, 14 bp, Homo sapiens
tccaccctgccctg

SEQ ID NO: 2393424 - DNA, 18 bp, Homo sapiens
tccaccctgccctgctga

SEQ ID NO: 2393425 - DNA, 16 bp, Homo sapiens
tccaccttcctgccca

SEQ ID NO: 2393426 - DNA, 18 bp, Homo sapiens
tccaccttcctgcccagg

SEQ ID NO: 2393427 - DNA, 19 bp, Homo sapiens
tccaccttcctgcccaggg

SEQ ID NO: 2393428 - DNA, 16 bp, Homo sapiens
tccactcactccagcc

SEQ ID NO: 2393429 - DNA, 17 bp, Homo sapiens
tccactcactccagccc

SEQ ID NO: 2393430 - DNA, 17 bp, Homo sapiens
tccactttcccttcccc

SEQ ID NO: 2393431 - DNA, 14 bp, Homo sapiens
tccagaccctgcct

SEQ ID NO: 2393432 - DNA, 17 bp, Homo sapiens
tccagaccctgcctgag

SEQ ID NO: 2393433 - DNA, 20 bp, Homo sapiens
tccagaccctgcctgagccc

SEQ ID NO: 2393434 - DNA, 22 bp, Homo sapiens
tccagagttaaaatgtttactg

SEQ ID NO: 2393435 - DNA, 19 bp, Homo sapiens
tccaggatcctcctggagc

SEQ ID NO: 2393436 - DNA, 20 bp, Homo sapiens
tccaggatcctcctggagca

SEQ ID NO: 2393437 - DNA, 23 bp, Homo sapiens
tccagttggagttgattcatgtg

SEQ ID NO: 2393438 - DNA, 13 bp, Homo sapiens
tccatctgaggac

SEQ ID NO: 2393439 - DNA, 18 bp, Homo sapiens
tccatgcctggcccttgc

SEQ ID NO: 2393440 - DNA, 12 bp, Homo sapiens
tccatggccacc

SEQ ID NO: 2393441 - DNA, 19 bp, Homo sapiens
tccatgtctatgctccctc

SEQ ID NO: 2393442 - DNA, 15 bp, Homo sapiens
tccattgaaagtgct

SEQ ID NO: 2393443 - DNA, 14 bp, Homo sapiens
tccattgccacggc

SEQ ID NO: 2393444 - DNA, 13 bp, Homo sapiens
tcccaccaactct

SEQ ID NO: 2393445 - DNA, 17 bp, Homo sapiens
tcccaccaactctgcac

SEQ ID NO: 2393446 - DNA, 23 bp, Homo sapiens
tcccagagcttattggccactgg

SEQ ID NO: 2393447 - DNA, 16 bp, Homo sapiens
tcccagcccctacctt

SEQ ID NO: 2393448 - DNA, 23 bp, Homo sapiens
tggggcggcccacgccagctggc

SEQ ID NO: 2393449 - DNA, 16 bp, Homo sapiens
tggggcttcctgggca

SEQ ID NO: 2393450 - DNA, 22 bp, Homo sapiens
tgggggctgcgtccctgctcag

SEQ ID NO: 2393451 - DNA, 24 bp, Homo sapiens
tgggtagtgaattggcttccttga

SEQ ID NO: 2393452 - DNA, 18 bp, Homo sapiens
tgggtgacagagcaagac

SEQ ID NO: 2393453 - DNA, 16 bp, Homo sapiens
tgggtgctggtcctgt

SEQ ID NO: 2393454 - DNA, 15 bp, Homo sapiens
tggtaggtaaatcta

SEQ ID NO: 2393455 - DNA, 23 bp, Homo sapiens
tggtcaggggtgagacctgaagg

SEQ ID NO: 2393456 - DNA, 20 bp, Homo sapiens
tggtctgagtggggcttcct

SEQ ID NO: 2393457 - DNA, 17 bp, Homo sapiens
tggtgctcacgtgtcct

SEQ ID NO: 2393458 - DNA, 18 bp, Homo sapiens
tggtgctcacgtgtcctt

SEQ ID NO: 2393459 - DNA, 17 bp, Homo sapiens
tggtggcatgtgcctgt

SEQ ID NO: 2393460 - DNA, 21 bp, Homo sapiens
tggtgggaggcccggggccct

SEQ ID NO: 2393461 - DNA, 19 bp, Homo sapiens
tggtgggatttgctcctgg

SEQ ID NO: 2393462 - DNA, 16 bp, Homo sapiens
tggtgtcttgagacca

SEQ ID NO: 2393463 - DNA, 18 bp, Homo sapiens
tggtgtcttgagaccagc

SEQ ID NO: 2393464 - DNA, 16 bp, Homo sapiens
tgtaaatgtactggta

SEQ ID NO: 2393465 - DNA, 19 bp, Homo sapiens
tgtaaatgtactggtaatt

SEQ ID NO: 2393466 - DNA, 20 bp, Homo sapiens
tgtaaatgtactggtaattg

SEQ ID NO: 2393467 - DNA, 20 bp, Homo sapiens
tgtacatagtaaagtatttt

SEQ ID NO: 2393468 - DNA, 15 bp, Homo sapiens
tgtacatgtacatag

SEQ ID NO: 2393469 - DNA, 16 bp, Homo sapiens
tgtacatgtacatagt

SEQ ID NO: 2393470 - DNA, 18 bp, Homo sapiens
tgtactggtaattgtaca

SEQ ID NO: 2393471 - DNA, 19 bp, Homo sapiens
tgtactggtaattgtacaa

SEQ ID NO: 2393472 - DNA, 20 bp, Homo sapiens
tgtactggtaattgtacaat

SEQ ID NO: 2393473 - DNA, 15 bp, Homo sapiens
tgtcaagattcagct

SEQ ID NO: 2393474 - DNA, 19 bp, Homo sapiens
tgtcaccagcaacatctcg

SEQ ID NO: 2393475 - DNA, 14 bp, Homo sapiens
tgtcatctgctcct

SEQ ID NO: 2393476 - DNA, 20 bp, Homo sapiens
tgtcatctgctccttcctgt

SEQ ID NO: 2393477 - DNA, 18 bp, Homo sapiens
tgtccaggagaccttcca

SEQ ID NO: 2393478 - DNA, 17 bp, Homo sapiens
tgtcctctgtcagtcat

SEQ ID NO: 2393479 - DNA, 18 bp, Homo sapiens
tgtcttgagaccagcctg

SEQ ID NO: 2393480 - DNA, 19 bp, Homo sapiens
tgtcttgagaccagcctgc

SEQ ID NO: 2393481 - DNA, 14 bp, Homo sapiens
tgtgacctgctcct

SEQ ID NO: 2393482 - DNA, 22 bp, Homo sapiens
tgtgcagctgacttttctgacc

SEQ ID NO: 2393483 - DNA, 21 bp, Homo sapiens
tgtgcctgtattcccagctac

SEQ ID NO: 2393484 - DNA, 13 bp, Homo sapiens
tgtgcttgtgcct

SEQ ID NO: 2393485 - DNA, 15 bp, Homo sapiens
tgtggcccagataag

SEQ ID NO: 2393486 - DNA, 12 bp, Homo sapiens
tgtgggtgggga

SEQ ID NO: 2393487 - DNA, 14 bp, Homo sapiens
tgttccatgcctgg

SEQ ID NO: 2393488 - DNA, 22 bp, Homo sapiens
tgttccatgcctggcccttgcc

SEQ ID NO: 2393489 - DNA, 23 bp, Homo sapiens
tgttcctggacaccacccagagc

SEQ ID NO: 2393490 - DNA, 22 bp, Homo sapiens
tgttcttttaaagactacctgg

SEQ ID NO: 2393491 - DNA, 15 bp, Homo sapiens
tgttgcacagtccct

SEQ ID NO: 2393492 - DNA, 17 bp, Homo sapiens
tgttgccacactttcac

SEQ ID NO: 2393493 - DNA, 14 bp, Homo sapiens
tgtttactgtaaat

SEQ ID NO: 2393494 - DNA, 16 bp, Homo sapiens
tgtttggaggctgctg

SEQ ID NO: 2393495 - DNA, 17 bp, Homo sapiens
ttaaaatgtttactgta

SEQ ID NO: 2393496 - DNA, 18 bp, Homo sapiens
ttaaacagttgcacagca

SEQ ID NO: 2393497 - DNA, 19 bp, Homo sapiens
ttaaattcttactctggag

SEQ ID NO: 2393498 - DNA, 13 bp, Homo sapiens
ttaacaatgtatt

SEQ ID NO: 2393499 - DNA, 21 bp, Homo sapiens
ttaacaatgtattttaataac

SEQ ID NO: 2393500 - DNA, 12 bp, Homo sapiens
ttactgtaaatt

SEQ ID NO: 2393501 - DNA, 12 bp, Homo sapiens
ttagctttgtca

SEQ ID NO: 2393502 - DNA, 17 bp, Homo sapiens
ttagtgactaaaccatt

SEQ ID NO: 2393503 - DNA, 23 bp, Homo sapiens
ttagtgactaaaccattgtgcat

SEQ ID NO: 2393504 - DNA, 12 bp, Homo sapiens
ttagttcctgtg

SEQ ID NO: 2393505 - DNA, 19 bp, Homo sapiens
ttatacagtgtacatgtac

SEQ ID NO: 2393506 - DNA, 20 bp, Homo sapiens
ttatacagtgtacatgtaca

SEQ ID NO: 2393507 - DNA, 14 bp, Homo sapiens
ttatcctgttttca

SEQ ID NO: 2393508 - DNA, 18 bp, Homo sapiens
ttatctatgatgtttctt

SEQ ID NO: 2393509 - DNA, 17 bp, Homo sapiens
ttcaagatcccatttga

SEQ ID NO: 2393510 - DNA, 11 bp, Homo sapiens
ttcaagattcc

SEQ ID NO: 2393511 - DNA, 14 bp, Homo sapiens
ttcaagggtaatct

SEQ ID NO: 2393512 - DNA, 14 bp, Homo sapiens
ttcactactcagca

SEQ ID NO: 2393513 - DNA, 15 bp, Homo sapiens
ttccacatccccacc

SEQ ID NO: 2393514 - DNA, 21 bp, Homo sapiens
ttccccagctcagagccccgc

SEQ ID NO: 2393515 - DNA, 21 bp, Homo sapiens
ttccctgcatatgcttctgat

SEQ ID NO: 2393516 - DNA, 14 bp, Homo sapiens
ttcctcagctgcca

SEQ ID NO: 2393517 - DNA, 18 bp, Homo sapiens
ttcctcgcacagggcatg

SEQ ID NO: 2393518 - DNA, 23 bp, Homo sapiens
ttcctcgcacagggcatgcctgg

SEQ ID NO: 2393519 - DNA, 23 bp, Homo sapiens
ttcctggccccgggctctggcca

SEQ ID NO: 2393520 - DNA, 24 bp, Homo sapiens
ttcctggccccgggctctggccac

SEQ ID NO: 2393521 - DNA, 16 bp, Homo sapiens
ttccttgtcaccagca

SEQ ID NO: 2393522 - DNA, 17 bp, Homo sapiens
ttcgagagcagcctggc

SEQ ID NO: 2393523 - DNA, 20 bp, Homo sapiens
ttcgaggtcctcctggcctg

SEQ ID NO: 2393524 - DNA, 19 bp, Homo sapiens
ttctatagcagtcatcatt

SEQ ID NO: 2393525 - DNA, 13 bp, Homo sapiens
ttctggctgggga

SEQ ID NO: 2393526 - DNA, 12 bp, Homo sapiens
ttcttactctgg

SEQ ID NO: 2393527 - DNA, 19 bp, Homo sapiens
ttctttggtaggtaaatct

SEQ ID NO: 2393528 - DNA, 13 bp, Homo sapiens
ttgaactgagccg

SEQ ID NO: 2393529 - DNA, 18 bp, Homo sapiens
ttgaatgggggaggccca

SEQ ID NO: 2393530 - DNA, 20 bp, Homo sapiens
ttgaattgggggagtcatgg

SEQ ID NO: 2393531 - DNA, 16 bp, Homo sapiens
ttgacctcagctgcac

SEQ ID NO: 2393532 - DNA, 18 bp, Homo sapiens
ttgacctcagctgcacat

SEQ ID NO: 2393533 - DNA, 23 bp, Homo sapiens
ttgacctcagctgcacattcctg

SEQ ID NO: 2393534 - DNA, 14 bp, Homo sapiens
ttgagaaagtcaca

SEQ ID NO: 2393535 - DNA, 17 bp, Homo sapiens
ttgagaccagcctgcca

SEQ ID NO: 2393536 - DNA, 22 bp, Homo sapiens
ttgcatacattcttcaagatcc

SEQ ID NO: 2393537 - DNA, 15 bp, Homo sapiens
ttgccacggccatga

SEQ ID NO: 2393538 - DNA, 23 bp, Homo sapiens
ttgcccgccagcctcagtgccac

SEQ ID NO: 2393539 - DNA, 23 bp, Homo sapiens
ttgcgccactgcactccagcctg

SEQ ID NO: 2393540 - DNA, 14 bp, Homo sapiens
ttgctctacctggc

SEQ ID NO: 2393541 - DNA, 15 bp, Homo sapiens
ttgctctacctggcc

SEQ ID NO: 2393542 - DNA, 16 bp, Homo sapiens
ttgctctacctggccg

SEQ ID NO: 2393543 - DNA, 15 bp, Homo sapiens
ttgctgaatgcaaga

SEQ ID NO: 2393544 - DNA, 14 bp, Homo sapiens
ttggaggctgctgc

SEQ ID NO: 2393545 - DNA, 17 bp, Homo sapiens
ttggaggctgctgcccc

SEQ ID NO: 2393546 - DNA, 22 bp, Homo sapiens
ttggccacaagaataagcagca

SEQ ID NO: 2393547 - DNA, 19 bp, Homo sapiens
ttggccactgggtctcact

SEQ ID NO: 2393548 - DNA, 20 bp, Homo sapiens
ttggccactgggtctcactc

SEQ ID NO: 2393549 - DNA, 21 bp, Homo sapiens
ttggcgccccatgggccctca

SEQ ID NO: 2393550 - DNA, 11 bp, Homo sapiens
ttgggaagctg

SEQ ID NO: 2393551 - DNA, 23 bp, Homo sapiens
ttggggcggcccacgccagctgg

SEQ ID NO: 2393552 - DNA, 16 bp, Homo sapiens
ttggtaggtaaatcta

SEQ ID NO: 2393553 - DNA, 22 bp, Homo sapiens
ttgtcatttcctttgttgtcta

SEQ ID NO: 2393554 - DNA, 23 bp, Homo sapiens
ttgtgcagctgacttttctgacc

SEQ ID NO: 2393555 - DNA, 16 bp, Homo sapiens
ttgtgcctacctggcc

SEQ ID NO: 2393556 - DNA, 21 bp, Homo sapiens
ttgtggcccagataaggcttt

SEQ ID NO: 2393557 - DNA, 12 bp, Homo sapiens
ttgttgtctaca

SEQ ID NO: 2393558 - DNA, 16 bp, Homo sapiens
ttgttgtctacattaa

SEQ ID NO: 2393559 - DNA, 15 bp, Homo sapiens
tttaaagtttccttt

SEQ ID NO: 2393560 - DNA, 17 bp, Homo sapiens
tttacatttattccttc

SEQ ID NO: 2393561 - DNA, 19 bp, Homo sapiens
tttactgctttttctctgc

SEQ ID NO: 2393562 - DNA, 12 bp, Homo sapiens
tttagttcctgt

SEQ ID NO: 2393563 - DNA, 19 bp, Homo sapiens
tttagttcctgtgcacagc

SEQ ID NO: 2393564 - DNA, 19 bp, Homo sapiens
tcttccctacccttcctgc

SEQ ID NO: 2393565 - DNA, 15 bp, Homo sapiens
tcttctctgggccca

SEQ ID NO: 2393566 - DNA, 22 bp, Homo sapiens
tcttctgtaaaatgggtatatt

SEQ ID NO: 2393567 - DNA, 19 bp, Homo sapiens
tcttgagaccagcctgcca

SEQ ID NO: 2393568 - DNA, 18 bp, Homo sapiens
tcttgagtttttcaggta

SEQ ID NO: 2393569 - DNA, 15 bp, Homo sapiens
tcttttcctctagga

SEQ ID NO: 2393570 - DNA, 18 bp, Homo sapiens
tgaaacaaataatcacat

SEQ ID NO: 2393571 - DNA, 16 bp, Homo sapiens
tgaactctctctcttt

SEQ ID NO: 2393572 - DNA, 11 bp, Homo sapiens
tgaactggctt

SEQ ID NO: 2393573 - DNA, 17 bp, Homo sapiens
tgaactggcttgtacat

SEQ ID NO: 2393574 - DNA, 18 bp, Homo sapiens
tgaactggcttgtacatt

SEQ ID NO: 2393575 - DNA, 16 bp, Homo sapiens
tgaagaccaaatgata

SEQ ID NO: 2393576 - DNA, 17 bp, Homo sapiens
tgaaggacctccccctg

SEQ ID NO: 2393577 - DNA, 21 bp, Homo sapiens
tgaagttaaaggtatttatca

SEQ ID NO: 2393578 - DNA, 18 bp, Homo sapiens
tgacattccttgtcacca

SEQ ID NO: 2393579 - DNA, 21 bp, Homo sapiens
tgacattccttgtcaccagca

SEQ ID NO: 2393580 - DNA, 21 bp, Homo sapiens
tgacctcagctgcacattcct

SEQ ID NO: 2393581 - DNA, 13 bp, Homo sapiens
tgacctgctcctg

SEQ ID NO: 2393582 - DNA, 18 bp, Homo sapiens
tgacctgctcctgcccac

SEQ ID NO: 2393583 - DNA, 19 bp, Homo sapiens
tgactcccctttctcttct

SEQ ID NO: 2393584 - DNA, 15 bp, Homo sapiens
tgagaaagtcacaga

SEQ ID NO: 2393585 - DNA, 19 bp, Homo sapiens
tgagagggggatgcccctg

SEQ ID NO: 2393586 - DNA, 22 bp, Homo sapiens
tgagagggggatgcccctggcc

SEQ ID NO: 2393587 - DNA, 14 bp, Homo sapiens
tgagcccaggagct

SEQ ID NO: 2393588 - DNA, 17 bp, Homo sapiens
tgagccgtgcagctggg

SEQ ID NO: 2393589 - DNA, 16 bp, Homo sapiens
gagagcagcctggcca

SEQ ID NO: 2393590 - DNA, 17 bp, Homo sapiens
gagagcagcctggccaa

SEQ ID NO: 2393591 - DNA, 12 bp, Homo sapiens
gagatgaagtta

SEQ ID NO: 2393592 - DNA, 16 bp, Homo sapiens
gagatgcagtgccagg

SEQ ID NO: 2393593 - DNA, 21 bp, Homo sapiens
gagcaacaagtagagatgaag

SEQ ID NO: 2393594 - DNA, 20 bp, Homo sapiens
gagcacagacggaggaagcc

SEQ ID NO: 2393595 - DNA, 23 bp, Homo sapiens
gagcagcagctgaggccccaggg

SEQ ID NO: 2393596 - DNA, 14 bp, Homo sapiens
gagcagcctggcca

SEQ ID NO: 2393597 - DNA, 16 bp, Homo sapiens
gagccattctgtccca

SEQ ID NO: 2393598 - DNA, 18 bp, Homo sapiens
gagcccagctacattcct

SEQ ID NO: 2393599 - DNA, 21 bp, Homo sapiens
gagcccagctacattcctcag

SEQ ID NO: 2393600 - DNA, 13 bp, Homo sapiens
gagccccctggat

SEQ ID NO: 2393601 - DNA, 15 bp, Homo sapiens
gagccctccctcttc

SEQ ID NO: 2393602 - DNA, 21 bp, Homo sapiens
gagccctccctcttcccagca

SEQ ID NO: 2393603 - DNA, 22 bp, Homo sapiens
gagccctccctcttcccagcac

SEQ ID NO: 2393604 - DNA, 17 bp, Homo sapiens
gagccgcttccccagct

SEQ ID NO: 2393605 - DNA, 19 bp, Homo sapiens
gagccgcttccccagctca

SEQ ID NO: 2393606 - DNA, 16 bp, Homo sapiens
gagccggcactgcatg

SEQ ID NO: 2393607 - DNA, 15 bp, Homo sapiens
gagccgtgcagctgg

SEQ ID NO: 2393608 - DNA, 20 bp, Homo sapiens
gagcctcttgtggaccccgc

SEQ ID NO: 2393609 - DNA, 20 bp, Homo sapiens
gagcgcagcgcctccaccct

SEQ ID NO: 2393610 - DNA, 23 bp, Homo sapiens
gagctagcagaagacaaggcatg

SEQ ID NO: 2393611 - DNA, 15 bp, Homo sapiens
gagctctgtcctctg

SEQ ID NO: 2393612 - DNA, 20 bp, Homo sapiens
gagcttgcaatgagccaaga

SEQ ID NO: 2393613 - DNA, 17 bp, Homo sapiens
gaggacagagtgccctg

SEQ ID NO: 2393614 - DNA, 13 bp, Homo sapiens
gaggaccaaagat

SEQ ID NO: 2393615 - DNA, 19 bp, Homo sapiens
gaggcccaatgaggtggct

SEQ ID NO: 2393616 - DNA, 18 bp, Homo sapiens
gaggccccagggctgtgg

SEQ ID NO: 2393617 - DNA, 15 bp, Homo sapiens
gaggcgtcctggtga

SEQ ID NO: 2393618 - DNA, 20 bp, Homo sapiens
gaggcgtcctggtgaggaca

SEQ ID NO: 2393619 - DNA, 11 bp, Homo sapiens
gaggctgctgc

SEQ ID NO: 2393620 - DNA, 13 bp, Homo sapiens
gaggctgctgccc

SEQ ID NO: 2393621 - DNA, 15 bp, Homo sapiens
gagggtgtttcctct

SEQ ID NO: 2393622 - DNA, 16 bp, Homo sapiens
gaggtcctcctggcct

SEQ ID NO: 2393623 - DNA, 14 bp, Homo sapiens
gagtggggcttcct

SEQ ID NO: 2393624 - DNA, 18 bp, Homo sapiens
gagttcgagagcagcctg

SEQ ID NO: 2393625 - DNA, 22 bp, Homo sapiens
gagtttatacagtgtacatgta

SEQ ID NO: 2393626 - DNA, 22 bp, Homo sapiens
gagtttccccactaataaagtg

SEQ ID NO: 2393627 - DNA, 23 bp, Homo sapiens
gataattaaggccagaggcccat

SEQ ID NO: 2393628 - DNA, 13 bp, Homo sapiens
gatcccctgaggt

SEQ ID NO: 2393629 - DNA, 21 bp, Homo sapiens
gatctgagccctccctcttcc

SEQ ID NO: 2393630 - DNA, 21 bp, Homo sapiens
gatctggcccaagctgggctc

SEQ ID NO: 2393631 - DNA, 12 bp, Homo sapiens
gatcttctgaaa

SEQ ID NO: 2393632 - DNA, 16 bp, Homo sapiens
gatcttctgaaatgaa

SEQ ID NO: 2393633 - DNA, 13 bp, Homo sapiens
gatgcccctggcc

SEQ ID NO: 2393634 - DNA, 17 bp, Homo sapiens
gatgcccctggccctgc

SEQ ID NO: 2393635 - DNA, 19 bp, Homo sapiens
gatgcccctggccctgcct

SEQ ID NO: 2393636 - DNA, 21 bp, Homo sapiens
gatgcccctggccctgcctca

SEQ ID NO: 2393637 - DNA, 22 bp, Homo sapiens
gatgggacaattagataaatgt

SEQ ID NO: 2393638 - DNA, 13 bp, Homo sapiens
gatggggcccaca

SEQ ID NO: 2393639 - DNA, 20 bp, Homo sapiens
gatggggcctgggctgttgt

SEQ ID NO: 2393640 - DNA, 16 bp, Homo sapiens
gatgggtgctggtcct

SEQ ID NO: 2393641 - DNA, 19 bp, Homo sapiens
gatgggtgctggtcctgtt

SEQ ID NO: 2393642 - DNA, 18 bp, Homo sapiens
gatggttactgaggacca

SEQ ID NO: 2393643 - DNA, 14 bp, Homo sapiens
gattaacaatgtat

SEQ ID NO: 2393644 - DNA, 18 bp, Homo sapiens
gcacagcatctcagctca

SEQ ID NO: 2393645 - DNA, 22 bp, Homo sapiens
gcacagggcatgcctggcctga

SEQ ID NO: 2393646 - DNA, 15 bp, Homo sapiens
gcacagtccctcctg

SEQ ID NO: 2393647 - DNA, 16 bp, Homo sapiens
gcacagtccctcctgt

SEQ ID NO: 2393648 - DNA, 14 bp, Homo sapiens
gcacccacctccac

SEQ ID NO: 2393649 - DNA, 18 bp, Homo sapiens
gcacccacctccaccccc

SEQ ID NO: 2393650 - DNA, 19 bp, Homo sapiens
gcacctcatggactccagg

SEQ ID NO: 2393651 - DNA, 14 bp, Homo sapiens
gcacctgtcacctt

SEQ ID NO: 2393652 - DNA, 17 bp, Homo sapiens
gcactccatggccaccc

SEQ ID NO: 2393653 - DNA, 18 bp, Homo sapiens
gcactccatggccacccc

SEQ ID NO: 2393654 - DNA, 16 bp, Homo sapiens
gcactcgagaccatcc

SEQ ID NO: 2393655 - DNA, 18 bp, Homo sapiens
gcactcgagaccatcctg

SEQ ID NO: 2393656 - DNA, 19 bp, Homo sapiens
gcactttgggaagctgagg

SEQ ID NO: 2393657 - DNA, 16 bp, Homo sapiens
gcagaaccggtcccag

SEQ ID NO: 2393658 - DNA, 21 bp, Homo sapiens
gcagaaccggtcccagcctgg

SEQ ID NO: 2393659 - DNA, 22 bp, Homo sapiens
gcagaaccggtcccagcctggg

SEQ ID NO: 2393660 - DNA, 18 bp, Homo sapiens
gcagcagctgggacccct

SEQ ID NO: 2393661 - DNA, 15 bp, Homo sapiens
gcagcctggccaaca

SEQ ID NO: 2393662 - DNA, 14 bp, Homo sapiens
gcagcgccagggct

SEQ ID NO: 2393663 - DNA, 15 bp, Homo sapiens
gcagcgcctccaccc

SEQ ID NO: 2393664 - DNA, 19 bp, Homo sapiens
gcagcgcctccaccctgcc

SEQ ID NO: 2393665 - DNA, 12 bp, Homo sapiens
gcagctgaggcc

SEQ ID NO: 2393666 - DNA, 13 bp, Homo sapiens
gcagctgaggccc

SEQ ID NO: 2393667 - DNA, 16 bp, Homo sapiens
gcagctgggacccctc

SEQ ID NO: 2393668 - DNA, 20 bp, Homo sapiens
gcagctgggatttgaaccag

SEQ ID NO: 2393669 - DNA, 22 bp, Homo sapiens
gcaggaggacagagtgccctgg

SEQ ID NO: 2393670 - DNA, 17 bp, Homo sapiens
gcatatgttccatgcct

SEQ ID NO: 2393671 - DNA, 19 bp, Homo sapiens
gcatccaccttcctgccca

SEQ ID NO: 2393672 - DNA, 22 bp, Homo sapiens
gcatcttgctctgtggccttgg

SEQ ID NO: 2393673 - DNA, 14 bp, Homo sapiens
gcatgcctggcctg

SEQ ID NO: 2393674 - DNA, 19 bp, Homo sapiens
gcatgcctggcctgaggac

SEQ ID NO: 2393675 - DNA, 16 bp, Homo sapiens
gcatgtagggggagcc

SEQ ID NO: 2393676 - DNA, 23 bp, Homo sapiens
gcatgtgcctgtattcccagcta

SEQ ID NO: 2393677 - DNA, 17 bp, Homo sapiens
gccaagagagcctcttg

SEQ ID NO: 2393678 - DNA, 16 bp, Homo sapiens
gccaccccgtgccacc

SEQ ID NO: 2393679 - DNA, 23 bp, Homo sapiens
gccacccctcctctagctctggt

SEQ ID NO: 2393680 - DNA, 13 bp, Homo sapiens
gccaccctggccc

SEQ ID NO: 2393681 - DNA, 23 bp, Homo sapiens
gccaccctggcccgcccctcgct

SEQ ID NO: 2393682 - DNA, 21 bp, Homo sapiens
gtttatacagtgtacatgtac

SEQ ID NO: 2393683 - DNA, 21 bp, Homo sapiens
gtttccccactaataaagtgc

SEQ ID NO: 2393684 - DNA, 22 bp, Homo sapiens
gtttccccactaataaagtgcc

SEQ ID NO: 2393685 - DNA, 12 bp, Homo sapiens
gtttcctctaaa

SEQ ID NO: 2393686 - DNA, 12 bp, Homo sapiens
gttttgtaaatg

SEQ ID NO: 2393687 - DNA, 16 bp, Homo sapiens
gttttgtaaatgtact

SEQ ID NO: 2393688 - DNA, 22 bp, Homo sapiens
gttttgtaaatgtactggtaat

SEQ ID NO: 2393689 - DNA, 20 bp, Homo sapiens
taaaatcaccctgactgtgg

SEQ ID NO: 2393690 - DNA, 15 bp, Homo sapiens
taaaatgtttactgt

SEQ ID NO: 2393691 - DNA, 18 bp, Homo sapiens
taaagactacctgggacc

SEQ ID NO: 2393692 - DNA, 22 bp, Homo sapiens
taaagtcatcatgaactggctt

SEQ ID NO: 2393693 - DNA, 21 bp, Homo sapiens
taaatctagagtttatacagt

SEQ ID NO: 2393694 - DNA, 17 bp, Homo sapiens
taaatgtactggtaatt

SEQ ID NO: 2393695 - DNA, 23 bp, Homo sapiens
taaatgtactggtaattgtacaa

SEQ ID NO: 2393696 - DNA, 14 bp, Homo sapiens
taacaatgtatttt

SEQ ID NO: 2393697 - DNA, 16 bp, Homo sapiens
taacaatgtattttaa

SEQ ID NO: 2393698 - DNA, 13 bp, Homo sapiens
taacatatctaaa

SEQ ID NO: 2393699 - DNA, 16 bp, Homo sapiens
taacatatctaaagtc

SEQ ID NO: 2393700 - DNA, 18 bp, Homo sapiens
taacttgtcttctagttt

SEQ ID NO: 2393701 - DNA, 22 bp, Homo sapiens
taagcagttttgtaaatgtact

SEQ ID NO: 2393702 - DNA, 21 bp, Homo sapiens
taatcagtagttcactttaat

SEQ ID NO: 2393703 - DNA, 15 bp, Homo sapiens
taatcttgggtttct

SEQ ID NO: 2393704 - DNA, 19 bp, Homo sapiens
taatgaaggtcataagttt

SEQ ID NO: 2393705 - DNA, 12 bp, Homo sapiens
taattagtttaa

SEQ ID NO: 2393706 - DNA, 11 bp, Homo sapiens
taattgtacaa

SEQ ID NO: 2393707 - DNA, 22 bp, Homo sapiens
tacaggatggttactgaggacc

SEQ ID NO: 2393708 - DNA, 14 bp, Homo sapiens
tacatagtaaagta

SEQ ID NO: 2393709 - DNA, 15 bp, Homo sapiens
tacatagtaaagtat

SEQ ID NO: 2393710 - DNA, 16 bp, Homo sapiens
tacatagtaaagtatt

SEQ ID NO: 2393711 - DNA, 16 bp, Homo sapiens
tacatgggccagccct

SEQ ID NO: 2393712 - DNA, 15 bp, Homo sapiens
tacatgtacatagta

SEQ ID NO: 2393713 - DNA, 13 bp, Homo sapiens
tacattcctcagc

SEQ ID NO: 2393714 - DNA, 19 bp, Homo sapiens
tacattcctcagctgccaa

SEQ ID NO: 2393715 - DNA, 20 bp, Homo sapiens
tacattcctcagctgccaag

SEQ ID NO: 2393716 - DNA, 23 bp, Homo sapiens
tacattcctcagctgccaagcac

SEQ ID NO: 2393717 - DNA, 20 bp, Homo sapiens
tacattcttcaagatcccat

SEQ ID NO: 2393718 - DNA, 22 bp, Homo sapiens
tacccaaggtcacatagctggg

SEQ ID NO: 2393719 - DNA, 13 bp, Homo sapiens
tacccgagcccag

SEQ ID NO: 2393720 - DNA, 16 bp, Homo sapiens
tacccgagcccagcta

SEQ ID NO: 2393721 - DNA, 11 bp, Homo sapiens
tacccttcctg

SEQ ID NO: 2393722 - DNA, 12 bp, Homo sapiens
tacccttcctgc

SEQ ID NO: 2393723 - DNA, 16 bp, Homo sapiens
tacctgtaattagttt

SEQ ID NO: 2393724 - DNA, 22 bp, Homo sapiens
taccttcccccagctttccatc

SEQ ID NO: 2393725 - DNA, 16 bp, Homo sapiens
tactgatgctcctgaa

SEQ ID NO: 2393726 - DNA, 13 bp, Homo sapiens
tactgctttttct

SEQ ID NO: 2393727 - DNA, 19 bp, Homo sapiens
tactggtaccttcccccag

SEQ ID NO: 2393728 - DNA, 18 bp, Homo sapiens
tactgtctaagcagtttt

SEQ ID NO: 2393729 - DNA, 16 bp, Homo sapiens
tactgttttctgggcc

SEQ ID NO: 2393730 - DNA, 15 bp, Homo sapiens
tagatcttctgaaat

SEQ ID NO: 2393731 - DNA, 16 bp, Homo sapiens
tagatcttctgaaatg

SEQ ID NO: 2393732 - DNA, 17 bp, Homo sapiens
tagcattttctgcatct

SEQ ID NO: 2393733 - DNA, 12 bp, Homo sapiens
taggcagcctct

SEQ ID NO: 2393734 - DNA, 16 bp, Homo sapiens
taggtaaatctagagt

SEQ ID NO: 2393735 - DNA, 22 bp, Homo sapiens
taggttattatgattagctttg

SEQ ID NO: 2393736 - DNA, 18 bp, Homo sapiens
tagtgaattggcttcctt

SEQ ID NO: 2393737 - DNA, 17 bp, Homo sapiens
tagttcctgtgcacagc

SEQ ID NO: 2393738 - DNA, 16 bp, Homo sapiens
tagttgagaaagtcac

SEQ ID NO: 2393739 - DNA, 15 bp, Homo sapiens
tatacagtgtacatg

SEQ ID NO: 2393740 - DNA, 17 bp, Homo sapiens
tatacagtgtacatgta

SEQ ID NO: 2393741 - DNA, 19 bp, Homo sapiens
tatacagtgtacatgtaca

SEQ ID NO: 2393742 - DNA, 17 bp, Homo sapiens
tatattgttcacttctt

SEQ ID NO: 2393743 - DNA, 16 bp, Homo sapiens
tatatttccacttctt

SEQ ID NO: 2393744 - DNA, 16 bp, Homo sapiens
tatatttcctcttctg

SEQ ID NO: 2393745 - DNA, 13 bp, Homo sapiens
tatccctggccac

SEQ ID NO: 2393746 - DNA, 12 bp, Homo sapiens
tatctaaagtca

SEQ ID NO: 2393747 - DNA, 22 bp, Homo sapiens
tatctaaagtcatcatgaactg

SEQ ID NO: 2393748 - DNA, 20 bp, Homo sapiens
tatgcttatattgttcactt

SEQ ID NO: 2393749 - DNA, 14 bp, Homo sapiens
tattatgattagct

SEQ ID NO: 2393750 - DNA, 17 bp, Homo sapiens
tattgacgaactggcta

SEQ ID NO: 2393751 - DNA, 22 bp, Homo sapiens
tattgacgaactggctacagta

SEQ ID NO: 2393752 - DNA, 21 bp, Homo sapiens
tattgatgataatacccacat

SEQ ID NO: 2393753 - DNA, 13 bp, Homo sapiens
tatttccacttct

SEQ ID NO: 2393754 - DNA, 15 bp, Homo sapiens
tatttgtcattcctc

SEQ ID NO: 2393755 - DNA, 21 bp, Homo sapiens
tattttaataacatatctaaa

SEQ ID NO: 2393756 - DNA, 19 bp, Homo sapiens
tcaactcttgagtttttca

SEQ ID NO: 2393757 - DNA, 14 bp, Homo sapiens
tcaagattcagcta

SEQ ID NO: 2393758 - DNA, 13 bp, Homo sapiens
tcaatgccctgcc

SEQ ID NO: 2393759 - DNA, 21 bp, Homo sapiens
tcaccaaggtggcttctcctt

SEQ ID NO: 2393760 - DNA, 13 bp, Homo sapiens
tcaccagcaacat

SEQ ID NO: 2393761 - DNA, 21 bp, Homo sapiens
tcaccagcaacatctcgagcc

SEQ ID NO: 2393762 - DNA, 14 bp, Homo sapiens
tcaccctgactgtg

SEQ ID NO: 2393763 - DNA, 23 bp, Homo sapiens
tcaccctgtaatggttgggacca

SEQ ID NO: 2393764 - DNA, 14 bp, Homo sapiens
tcactactcagcat

SEQ ID NO: 2393765 - DNA, 18 bp, Homo sapiens
tcactgcaacctctacct

SEQ ID NO: 2393766 - DNA, 14 bp, Homo sapiens
tcactgtgacctgc

SEQ ID NO: 2393767 - DNA, 15 bp, Homo sapiens
tcactgtttcactac

SEQ ID NO: 2393768 - DNA, 13 bp, Homo sapiens
tcagagccccgcc

SEQ ID NO: 2393769 - DNA, 18 bp, Homo sapiens
tcagagccccgccccacc

SEQ ID NO: 2393770 - DNA, 20 bp, Homo sapiens
tcagagccccgccccacccc

SEQ ID NO: 2393771 - DNA, 21 bp, Homo sapiens
tcagagccccgccccaccccg

SEQ ID NO: 2393772 - DNA, 16 bp, Homo sapiens
tcagcccatcccctgc

SEQ ID NO: 2393773 - DNA, 17 bp, Homo sapiens
tcagcccatcccctgcc

SEQ ID NO: 2393774 - DNA, 20 bp, Homo sapiens
tcagcccatcccctgcctct

SEQ ID NO: 2393775 - DNA, 20 bp, Homo sapiens
tcagcccctcatcagccttt

SEQ ID NO: 2393776 - DNA, 23 bp, Homo sapiens
tcagcgtctccccatgctgggct

SEQ ID NO: 2393777 - DNA, 22 bp, Homo sapiens
tcaggagttcgagagcagcctg

SEQ ID NO: 2393778 - DNA, 18 bp, Homo sapiens
tcaggatgagaacacact

SEQ ID NO: 2393779 - DNA, 15 bp, Homo sapiens
tcagggtaagctgct

SEQ ID NO: 2393780 - DNA, 15 bp, Homo sapiens
tcagtcatgcgtcca

SEQ ID NO: 2393781 - DNA, 21 bp, Homo sapiens
tcagtgccacttgacattcct

SEQ ID NO: 2393782 - DNA, 17 bp, Homo sapiens
tcatagccttatgagtt

SEQ ID NO: 2393783 - DNA, 16 bp, Homo sapiens
tcatcagccttttcag

SEQ ID NO: 2393784 - DNA, 18 bp, Homo sapiens
tcatctgctccttcctgt

SEQ ID NO: 2393785 - DNA, 13 bp, Homo sapiens
tcatgaactggct

SEQ ID NO: 2393786 - DNA, 17 bp, Homo sapiens
tcatgaactggcttgta

SEQ ID NO: 2393787 - DNA, 12 bp, Homo sapiens
tcatgaggctga

SEQ ID NO: 2393788 - DNA, 13 bp, Homo sapiens
tcatggacagctg

SEQ ID NO: 2393789 - DNA, 16 bp, Homo sapiens
tcatggacagctgagc

SEQ ID NO: 2393790 - DNA, 17 bp, Homo sapiens
tcatggcaagtggggct

SEQ ID NO: 2393791 - DNA, 16 bp, Homo sapiens
tcatgtgcttgtgcct

SEQ ID NO: 2393792 - DNA, 22 bp, Homo sapiens
tcatgtgcttgtgcctacctgg

SEQ ID NO: 2393793 - DNA, 18 bp, Homo sapiens
tcattattgagtcaccat

SEQ ID NO: 2393794 - DNA, 21 bp, Homo sapiens
tcatttcctttgttgtctaca

SEQ ID NO: 2393795 - DNA, 16 bp, Homo sapiens
tcatttgacatttagt

SEQ ID NO: 2393796 - DNA, 23 bp, Homo sapiens
tccaaactgtatcttcctttact

SEQ ID NO: 2393797 - DNA, 19 bp, Homo sapiens
tccacatccccaccttcca

SEQ ID NO: 2393798 - DNA, 23 bp, Homo sapiens
tccacccccgccacggccaccct

SEQ ID NO: 2393799 - DNA, 15 bp, Homo sapiens
tccaccttcctgccc

SEQ ID NO: 2393800 - DNA, 12 bp, Homo sapiens
tccactcactcc

SEQ ID NO: 2393801 - DNA, 13 bp, Homo sapiens
tccactcactcca

SEQ ID NO: 2393802 - DNA, 15 bp, Homo sapiens
tccactcactccagc

SEQ ID NO: 2393803 - DNA, 18 bp, Homo sapiens
tccactcactccagccca

SEQ ID NO: 2393804 - DNA, 19 bp, Homo sapiens
tccacttactataatggtt

SEQ ID NO: 2393805 - DNA, 18 bp, Homo sapiens
tccactttcccttcccct

SEQ ID NO: 2393806 - DNA, 13 bp, Homo sapiens
tccagaccctgcc

SEQ ID NO: 2393807 - DNA, 17 bp, Homo sapiens
tccagagctaggctgtg

SEQ ID NO: 2393808 - DNA, 19 bp, Homo sapiens
tccagagttaaaatgttta

SEQ ID NO: 2393809 - DNA, 14 bp, Homo sapiens
tccaggatcctcct

SEQ ID NO: 2393810 - DNA, 16 bp, Homo sapiens
tccaggatcctcctgg

SEQ ID NO: 2393811 - DNA, 23 bp, Homo sapiens
tccaggatcctcctggagcagca

SEQ ID NO: 2393812 - DNA, 21 bp, Homo sapiens
tccatcttccctacccttcct

SEQ ID NO: 2393813 - DNA, 18 bp, Homo sapiens
tccatgaaccctgcccca

SEQ ID NO: 2393814 - DNA, 14 bp, Homo sapiens
tccatgcctggccc

SEQ ID NO: 2393815 - DNA, 16 bp, Homo sapiens
tccatgcctggccctt

SEQ ID NO: 2393816 - DNA, 13 bp, Homo sapiens
tccatggccaccc

SEQ ID NO: 2393817 - DNA, 14 bp, Homo sapiens
tccatggccacccc

SEQ ID NO: 2393818 - DNA, 14 bp, Homo sapiens
tccatgtcaagatt

SEQ ID NO: 2393819 - DNA, 23 bp, Homo sapiens
tccatgtcaagattcagctagtg

SEQ ID NO: 2393820 - DNA, 15 bp, Homo sapiens
tccattgccacggcc

SEQ ID NO: 2393821 - DNA, 16 bp, Homo sapiens
tcccaacctcaatgcc

SEQ ID NO: 2393822 - DNA, 16 bp, Homo sapiens
tcccaccaactctgca

SEQ ID NO: 2393823 - DNA, 20 bp, Homo sapiens
tcccagcactttgggaagct

SEQ ID NO: 2393824 - DNA, 21 bp, Homo sapiens
tcccagcactttgggaagctg

SEQ ID NO: 2393825 - DNA, 15 bp, Homo sapiens
tcccagcctgggctc

SEQ ID NO: 2393826 - DNA, 16 bp, Homo sapiens
tcccagcctgggctcc

SEQ ID NO: 2393827 - DNA, 14 bp, Homo sapiens
tcccattcaagatt

SEQ ID NO: 2393828 - DNA, 16 bp, Homo sapiens
tcccattcaagattcc

SEQ ID NO: 2393829 - DNA, 16 bp, Homo sapiens
tccccaccttccaagg

SEQ ID NO: 2393830 - DNA, 19 bp, Homo sapiens
tccccactctgctcccagc

SEQ ID NO: 2393831 - DNA, 18 bp, Homo sapiens
tccccctcacccccacct

SEQ ID NO: 2393832 - DNA, 15 bp, Homo sapiens
tccccctgtgtggcc

SEQ ID NO: 2393833 - DNA, 11 bp, Homo sapiens
tcccctgaggt

SEQ ID NO: 2393834 - DNA, 12 bp, Homo sapiens
tcccctgtccca

SEQ ID NO: 2393835 - DNA, 16 bp, Homo sapiens
tcccgccgcccgaccc

SEQ ID NO: 2393836 - DNA, 15 bp, Homo sapiens
tcccgtgctggaaga

SEQ ID NO: 2393837 - DNA, 14 bp, Homo sapiens
tccctcctgttgcc

SEQ ID NO: 2393838 - DNA, 17 bp, Homo sapiens
tccctcctgttgccaca

SEQ ID NO: 2393839 - DNA, 22 bp, Homo sapiens
ctccctttgccagccacccctc

SEQ ID NO: 2393840 - DNA, 23 bp, Homo sapiens
ctccctttgccagccacccctcc

SEQ ID NO: 2393841 - DNA, 20 bp, Homo sapiens
ctccgggaccattgacctca

SEQ ID NO: 2393842 - DNA, 21 bp, Homo sapiens
ctcctagccctcctgaggggt

SEQ ID NO: 2393843 - DNA, 12 bp, Homo sapiens
ctcctccactca

SEQ ID NO: 2393844 - DNA, 17 bp, Homo sapiens
ctcctctagctctggtg

SEQ ID NO: 2393845 - DNA, 18 bp, Homo sapiens
ctcctgcccacgtgcagc

SEQ ID NO: 2393846 - DNA, 16 bp, Homo sapiens
ctcctgtcagcccctc

SEQ ID NO: 2393847 - DNA, 14 bp, Homo sapiens
ctcctgttgccaca

SEQ ID NO: 2393848 - DNA, 15 bp, Homo sapiens
ctcctgttgccacac

SEQ ID NO: 2393849 - DNA, 21 bp, Homo sapiens
ctccttcccgccgcccgaccc

SEQ ID NO: 2393850 - DNA, 16 bp, Homo sapiens
ctccttcctgtggcct

SEQ ID NO: 2393851 - DNA, 14 bp, Homo sapiens
ctcgagaccatcct

SEQ ID NO: 2393852 - DNA, 20 bp, Homo sapiens
ctcgagaccatcctggcccc

SEQ ID NO: 2393853 - DNA, 21 bp, Homo sapiens
ctcgagaccatcctggcccct

SEQ ID NO: 2393854 - DNA, 22 bp, Homo sapiens
ctcgagaccatcctggcccctc

SEQ ID NO: 2393855 - DNA, 16 bp, Homo sapiens
ctcgagccccctggat

SEQ ID NO: 2393856 - DNA, 23 bp, Homo sapiens
ctcgagccccctggatgtcccct

SEQ ID NO: 2393857 - DNA, 17 bp, Homo sapiens
ctcgcacagggcatgcc

SEQ ID NO: 2393858 - DNA, 21 bp, Homo sapiens
ctcgcacagggcatgcctggc

SEQ ID NO: 2393859 - DNA, 23 bp, Homo sapiens
ctcgcacagggcatgcctggcct

SEQ ID NO: 2393860 - DNA, 18 bp, Homo sapiens
ctcggtatagttttgtca

SEQ ID NO: 2393861 - DNA, 15 bp, Homo sapiens
ctctatccctggcca

SEQ ID NO: 2393862 - DNA, 16 bp, Homo sapiens
ctctatccctggccac

SEQ ID NO: 2393863 - DNA, 19 bp, Homo sapiens
ctctatccctggccacctg

SEQ ID NO: 2393864 - DNA, 13 bp, Homo sapiens
ctctcccatggtg

SEQ ID NO: 2393865 - DNA, 17 bp, Homo sapiens
ctctgcactccatggcc

SEQ ID NO: 2393866 - DNA, 19 bp, Homo sapiens
ctctgcactccatggccac

SEQ ID NO: 2393867 - DNA, 23 bp, Homo sapiens
ctctgcactccatggccaccccg

SEQ ID NO: 2393868 - DNA, 16 bp, Homo sapiens
ctctgcatcttgctct

SEQ ID NO: 2393869 - DNA, 12 bp, Homo sapiens
ctctgctcccag

SEQ ID NO: 2393870 - DNA, 11 bp, Homo sapiens
ctctggccacc

SEQ ID NO: 2393871 - DNA, 14 bp, Homo sapiens
ctctggccaccctg

SEQ ID NO: 2393872 - DNA, 19 bp, Homo sapiens
ctctggccaccctggcccg

SEQ ID NO: 2393873 - DNA, 22 bp, Homo sapiens
ctctggccaccctggcccgccc

SEQ ID NO: 2393874 - DNA, 15 bp, Homo sapiens
ctctggtgggaggcc

SEQ ID NO: 2393875 - DNA, 17 bp, Homo sapiens
ctctggtgggaggcccg

SEQ ID NO: 2393876 - DNA, 16 bp, Homo sapiens
ctcttctctgggccca

SEQ ID NO: 2393877 - DNA, 20 bp, Homo sapiens
ctcttctctgggcccagaga

SEQ ID NO: 2393878 - DNA, 17 bp, Homo sapiens
ctctttaaaaacatttt

SEQ ID NO: 2393879 - DNA, 13 bp, Homo sapiens
ctgaaaagggcat

SEQ ID NO: 2393880 - DNA, 21 bp, Homo sapiens
ctgaaggacctccccctgtgt

SEQ ID NO: 2393881 - DNA, 22 bp, Homo sapiens
ctgaataaatacccattgaact

SEQ ID NO: 2393882 - DNA, 15 bp, Homo sapiens
ctgacttttctgacc

SEQ ID NO: 2393883 - DNA, 23 bp, Homo sapiens
ctgagcatatgttccatgcctgg

SEQ ID NO: 2393884 - DNA, 13 bp, Homo sapiens
ctgagcccaggag

SEQ ID NO: 2393885 - DNA, 18 bp, Homo sapiens
ctgagccctccctcttcc

SEQ ID NO: 2393886 - DNA, 19 bp, Homo sapiens
ctgagccctccctcttccc

SEQ ID NO: 2393887 - DNA, 20 bp, Homo sapiens
ctgagccctccctcttccca

SEQ ID NO: 2393888 - DNA, 22 bp, Homo sapiens
ctgagccctccctcttcccagc

SEQ ID NO: 2393889 - DNA, 23 bp, Homo sapiens
ctgagcgcagcgcctccaccctg

SEQ ID NO: 2393890 - DNA, 14 bp, Homo sapiens
ctgagtcacctcct

SEQ ID NO: 2393891 - DNA, 15 bp, Homo sapiens
ctgagtcacctcctc

SEQ ID NO: 2393892 - DNA, 19 bp, Homo sapiens
ctgagtcacctcctccact

SEQ ID NO: 2393893 - DNA, 21 bp, Homo sapiens
ctgagtgaggagtggacgctg

SEQ ID NO: 2393894 - DNA, 13 bp, Homo sapiens
ctgatctggccca

SEQ ID NO: 2393895 - DNA, 16 bp, Homo sapiens
ctgatctggcccaagc

SEQ ID NO: 2393896 - DNA, 13 bp, Homo sapiens
ctgatgctcctga

SEQ ID NO: 2393897 - DNA, 16 bp, Homo sapiens
ctgatttattgaaatt

SEQ ID NO: 2393898 - DNA, 17 bp, Homo sapiens
ctgatttattgaaattt

SEQ ID NO: 2393899 - DNA, 16 bp, Homo sapiens
ctgcacattcctggcc

SEQ ID NO: 2393900 - DNA, 13 bp, Homo sapiens
ctgcactccagcc

SEQ ID NO: 2393901 - DNA, 19 bp, Homo sapiens
ctgcactccagcctgggtg

SEQ ID NO: 2393902 - DNA, 15 bp, Homo sapiens
ctgcactccatggcc

SEQ ID NO: 2393903 - DNA, 17 bp, Homo sapiens
ctgcactccatggccac

SEQ ID NO: 2393904 - DNA, 17 bp, Homo sapiens
ctgcatatgcttctgat

SEQ ID NO: 2393905 - DNA, 18 bp, Homo sapiens
ctgcatcttgctctgtgg

SEQ ID NO: 2393906 - DNA, 14 bp, Homo sapiens
ctgccaggcctccc

SEQ ID NO: 2393907 - DNA, 22 bp, Homo sapiens
ctgcccaggggacgtggcgctg

SEQ ID NO: 2393908 - DNA, 18 bp, Homo sapiens
ctgccccactcctgtcag

SEQ ID NO: 2393909 - DNA, 12 bp, Homo sapiens
ctgccccctggc

SEQ ID NO: 2393910 - DNA, 20 bp, Homo sapiens
ctgccccctggctttggcgc

SEQ ID NO: 2393911 - DNA, 19 bp, Homo sapiens
ctgccctgctgagcacaga

SEQ ID NO: 2393912 - DNA, 12 bp, Homo sapiens
ctgcctcactgt

SEQ ID NO: 2393913 - DNA, 13 bp, Homo sapiens
ctgcctcactgtg

SEQ ID NO: 2393914 - DNA, 12 bp, Homo sapiens
ctgcctgagccc

SEQ ID NO: 2393915 - DNA, 16 bp, Homo sapiens
ctgcctgagcccagga

SEQ ID NO: 2393916 - DNA, 19 bp, Homo sapiens
ctgcctgagcccaggagct

SEQ ID NO: 2393917 - DNA, 13 bp, Homo sapiens
ctgcctgtggcct

SEQ ID NO: 2393918 - DNA, 20 bp, Homo sapiens
ctgccttttagttcctgtgc

SEQ ID NO: 2393919 - DNA, 15 bp, Homo sapiens
ctgcgtccctgctca

SEQ ID NO: 2393920 - DNA, 16 bp, Homo sapiens
ctgctactacccgagc

SEQ ID NO: 2393921 - DNA, 19 bp, Homo sapiens
ctgctactacccgagccca

SEQ ID NO: 2393922 - DNA, 22 bp, Homo sapiens
ctgctactacccgagcccagct

SEQ ID NO: 2393923 - DNA, 14 bp, Homo sapiens
ctgctcagcccatc

SEQ ID NO: 2393924 - DNA, 20 bp, Homo sapiens
ctgctcagcccatcccctgc

SEQ ID NO: 2393925 - DNA, 22 bp, Homo sapiens
ctgctcagcccatcccctgcct

SEQ ID NO: 2393926 - DNA, 13 bp, Homo sapiens
ctgctcctgccca

SEQ ID NO: 2393927 - DNA, 18 bp, Homo sapiens
ctggaagacttagatctg

SEQ ID NO: 2393928 - DNA, 16 bp, Homo sapiens
ctggacacagcccacc

SEQ ID NO: 2393929 - DNA, 18 bp, Homo sapiens
ctggacacagcccaccct

SEQ ID NO: 2393930 - DNA, 21 bp, Homo sapiens
ctggacacagcccaccctctg

SEQ ID NO: 2393931 - DNA, 22 bp, Homo sapiens
ctggagaccagaacagcatggc

SEQ ID NO: 2393932 - DNA, 19 bp, Homo sapiens
ctggagcagcagctgaggc

SEQ ID NO: 2393933 - DNA, 21 bp, Homo sapiens
ctggagccgcttccccagctc

SEQ ID NO: 2393934 - DNA, 20 bp, Homo sapiens
ctggatgtcccctgtcccac

SEQ ID NO: 2393935 - DNA, 22 bp, Homo sapiens
ctggatgtcccctgtcccacca

SEQ ID NO: 2393936 - DNA, 14 bp, Homo sapiens
ctggccaccctggc

SEQ ID NO: 2393937 - DNA, 16 bp, Homo sapiens
ctggccacctgccagg

SEQ ID NO: 2393938 - DNA, 15 bp, Homo sapiens
ctggcccaagctggg

SEQ ID NO: 2393939 - DNA, 23 bp, Homo sapiens
ctggccccgggctctggccaccc

SEQ ID NO: 2393940 - DNA, 14 bp, Homo sapiens
cccttgccggggcc

SEQ ID NO: 2393941 - DNA, 15 bp, Homo sapiens
cccttgccggggcct

SEQ ID NO: 2393942 - DNA, 15 bp, Homo sapiens
ccctttaagccaaga

SEQ ID NO: 2393943 - DNA, 20 bp, Homo sapiens
ccgagcccagctacattcct

SEQ ID NO: 2393944 - DNA, 12 bp, Homo sapiens
ccgatggggccc

SEQ ID NO: 2393945 - DNA, 13 bp, Homo sapiens
ccgccacggccac

SEQ ID NO: 2393946 - DNA, 19 bp, Homo sapiens
ccgccacggccaccctcct

SEQ ID NO: 2393947 - DNA, 14 bp, Homo sapiens
ccgccagcctcagt

SEQ ID NO: 2393948 - DNA, 16 bp, Homo sapiens
ccgccagcctcagtgc

SEQ ID NO: 2393949 - DNA, 14 bp, Homo sapiens
ccgcttccccagct

SEQ ID NO: 2393950 - DNA, 11 bp, Homo sapiens
ccgggcatggt

SEQ ID NO: 2393951 - DNA, 13 bp, Homo sapiens
ccgggctctggcc

SEQ ID NO: 2393952 - DNA, 16 bp, Homo sapiens
ccgggctctggccacc

SEQ ID NO: 2393953 - DNA, 18 bp, Homo sapiens
ccgggctctggccaccct

SEQ ID NO: 2393954 - DNA, 22 bp, Homo sapiens
ccggggcctggactgcacaggc

SEQ ID NO: 2393955 - DNA, 15 bp, Homo sapiens
ccgtaggcagcctct

SEQ ID NO: 2393956 - DNA, 12 bp, Homo sapiens
ccgttcctcctc

SEQ ID NO: 2393957 - DNA, 21 bp, Homo sapiens
ccgttcctcctcagcctccct

SEQ ID NO: 2393958 - DNA, 16 bp, Homo sapiens
cctacccttcctgcca

SEQ ID NO: 2393959 - DNA, 15 bp, Homo sapiens
cctacctggccgcaa

SEQ ID NO: 2393960 - DNA, 22 bp, Homo sapiens
cctaccttgagaccctcttctc

SEQ ID NO: 2393961 - DNA, 22 bp, Homo sapiens
cctacgagggaggaacacctga

SEQ ID NO: 2393962 - DNA, 19 bp, Homo sapiens
cctactgtctaagcagttt

SEQ ID NO: 2393963 - DNA, 14 bp, Homo sapiens
cctcaaccctccgt

SEQ ID NO: 2393964 - DNA, 14 bp, Homo sapiens
cctcaatgccctgc

SEQ ID NO: 2393965 - DNA, 17 bp, Homo sapiens
cctcagcgtctccccat

SEQ ID NO: 2393966 - DNA, 15 bp, Homo sapiens
cctcagctgccaagc

SEQ ID NO: 2393967 - DNA, 17 bp, Homo sapiens
cctcagctgccaagcac

SEQ ID NO: 2393968 - DNA, 19 bp, Homo sapiens
cctcagctgccaagcactc

SEQ ID NO: 2393969 - DNA, 15 bp, Homo sapiens
cctcagtgccacttg

SEQ ID NO: 2393970 - DNA, 23 bp, Homo sapiens
cctcagtgccacttgacattcct

SEQ ID NO: 2393971 - DNA, 15 bp, Homo sapiens
cctcatcagcctttt

SEQ ID NO: 2393972 - DNA, 19 bp, Homo sapiens
cctcatcagccttttcagc

SEQ ID NO: 2393973 - DNA, 21 bp, Homo sapiens
cctcatccaaactgtatcttc

SEQ ID NO: 2393974 - DNA, 16 bp, Homo sapiens
cctccacccccgccac

SEQ ID NO: 2393975 - DNA, 21 bp, Homo sapiens
cctccactcactccagcccaa

SEQ ID NO: 2393976 - DNA, 12 bp, Homo sapiens
cctcccaacctc

SEQ ID NO: 2393977 - DNA, 22 bp, Homo sapiens
cctcccccaccattccacatcc

SEQ ID NO: 2393978 - DNA, 13 bp, Homo sapiens
cctcccttcccca

SEQ ID NO: 2393979 - DNA, 13 bp, Homo sapiens
cctcctccactca

SEQ ID NO: 2393980 - DNA, 14 bp, Homo sapiens
cctcctccactcac

SEQ ID NO: 2393981 - DNA, 13 bp, Homo sapiens
cctcctctagctc

SEQ ID NO: 2393982 - DNA, 20 bp, Homo sapiens
cctcctggagcagcagctga

SEQ ID NO: 2393983 - DNA, 17 bp, Homo sapiens
cctcctgttgccacact

SEQ ID NO: 2393984 - DNA, 16 bp, Homo sapiens
cctccttcccgccgcc

SEQ ID NO: 2393985 - DNA, 21 bp, Homo sapiens
cctccttcccgccgcccgacc

SEQ ID NO: 2393986 - DNA, 12 bp, Homo sapiens
cctcgctgctgc

SEQ ID NO: 2393987 - DNA, 17 bp, Homo sapiens
cctcgctgctgctacta

SEQ ID NO: 2393988 - DNA, 14 bp, Homo sapiens
cctcgggctggtgt

SEQ ID NO: 2393989 - DNA, 14 bp, Homo sapiens
cctctagctctggt

SEQ ID NO: 2393990 - DNA, 14 bp, Homo sapiens
cctctatccctggc

SEQ ID NO: 2393991 - DNA, 23 bp, Homo sapiens
cctctatccctggccacctgcca

SEQ ID NO: 2393992 - DNA, 22 bp, Homo sapiens
cctctcctagccctcctgaggg

SEQ ID NO: 2393993 - DNA, 12 bp, Homo sapiens
cctctctgctat

SEQ ID NO: 2393994 - DNA, 21 bp, Homo sapiens
cctctgtcagtcatgcgtcca

SEQ ID NO: 2393995 - DNA, 22 bp, Homo sapiens
cctcttgtggaccccgcctgcc

SEQ ID NO: 2393996 - DNA, 12 bp, Homo sapiens
cctgactgtggg

SEQ ID NO: 2393997 - DNA, 16 bp, Homo sapiens
cctgagcccaggagct

SEQ ID NO: 2393998 - DNA, 21 bp, Homo sapiens
cctgagcgcagcgcctccacc

SEQ ID NO: 2393999 - DNA, 21 bp, Homo sapiens
cctgatctggcccaagctggg

SEQ ID NO: 2394000 - DNA, 17 bp, Homo sapiens
cctgatcttacagaaaa

SEQ ID NO: 2394001 - DNA, 15 bp, Homo sapiens
cctgcaggcaggtgg

SEQ ID NO: 2394002 - DNA, 15 bp, Homo sapiens
cctgcatatgcttct

SEQ ID NO: 2394003 - DNA, 22 bp, Homo sapiens
cctgccctgctgagcacagacg

SEQ ID NO: 2394004 - DNA, 13 bp, Homo sapiens
cctgcctgagccc

SEQ ID NO: 2394005 - DNA, 14 bp, Homo sapiens
cctgctcagcccat

SEQ ID NO: 2394006 - DNA, 16 bp, Homo sapiens
cctgctcagcccatcc

SEQ ID NO: 2394007 - DNA, 21 bp, Homo sapiens
cctgctcagcccatcccctgc

SEQ ID NO: 2394008 - DNA, 13 bp, Homo sapiens
cctgctcctgccc

SEQ ID NO: 2394009 - DNA, 19 bp, Homo sapiens
cctgctcctgcccacgtgc

SEQ ID NO: 2394010 - DNA, 14 bp, Homo sapiens
cctgctgagcacag

SEQ ID NO: 2394011 - DNA, 18 bp, Homo sapiens
cctggacacagcccaccc

SEQ ID NO: 2394012 - DNA, 23 bp, Homo sapiens
cctggacacagcccaccctctgt

SEQ ID NO: 2394013 - DNA, 16 bp, Homo sapiens
cctggactgcacaggc

SEQ ID NO: 2394014 - DNA, 15 bp, Homo sapiens
cctggatgtcccctg

SEQ ID NO: 2394015 - DNA, 22 bp, Homo sapiens
cctggccacctgccaggcctcc

SEQ ID NO: 2394016 - DNA, 22 bp, Homo sapiens
cctggccccgggctctggccac

SEQ ID NO: 2394017 - DNA, 21 bp, Homo sapiens
cctggcccctccagaccctgc

SEQ ID NO: 2394018 - DNA, 15 bp, Homo sapiens
cctggcccgcccctc

SEQ ID NO: 2394019 - DNA, 15 bp, Homo sapiens
cctggccctgcctca

SEQ ID NO: 2394020 - DNA, 17 bp, Homo sapiens
cctggccctgcctcact

SEQ ID NO: 2394021 - DNA, 19 bp, Homo sapiens
cctggccctgcctcactgt

SEQ ID NO: 2394022 - DNA, 13 bp, Homo sapiens
cctggcccttgcc

SEQ ID NO: 2394023 - DNA, 19 bp, Homo sapiens
cctggcccttgccggggcc

SEQ ID NO: 2394024 - DNA, 21 bp, Homo sapiens
cctggcccttgccggggcctg

SEQ ID NO: 2394025 - DNA, 20 bp, Homo sapiens
cctggccgcaagtccccagc

SEQ ID NO: 2394026 - DNA, 17 bp, Homo sapiens
cctggccggtaggctgc

SEQ ID NO: 2394027 - DNA, 14 bp, Homo sapiens
cctggcctgaggac

SEQ ID NO: 2394028 - DNA, 18 bp, Homo sapiens
cctggcttttctggctgg

SEQ ID NO: 2394029 - DNA, 18 bp, Homo sapiens
cctgggcacccacctcca

SEQ ID NO: 2394030 - DNA, 22 bp, Homo sapiens
cctgggcagttggggcggccca

SEQ ID NO: 2394031 - DNA, 19 bp, Homo sapiens
cctggggcatccaccttcc

SEQ ID NO: 2394032 - DNA, 23 bp, Homo sapiens
cctgggtgacagagcaagactcc

SEQ ID NO: 2394033 - DNA, 15 bp, Homo sapiens
cctgtaatcccagca

SEQ ID NO: 2394034 - DNA, 16 bp, Homo sapiens
cctgtaatcccagcac

SEQ ID NO: 2394035 - DNA, 23 bp, Homo sapiens
cctgtaatggttgggaccaggcc

SEQ ID NO: 2394036 - DNA, 15 bp, Homo sapiens
cctgtattcccagct

SEQ ID NO: 2394037 - DNA, 19 bp, Homo sapiens
cctgtcccaccaactctgc

SEQ ID NO: 2394038 - DNA, 20 bp, Homo sapiens
cctgtcccaccaactctgca

SEQ ID NO: 2394039 - DNA, 12 bp, Homo sapiens
cctgtgcacagc

SEQ ID NO: 2394040 - DNA, 13 bp, Homo sapiens
cctgtgcacagcc

SEQ ID NO: 2394041 - DNA, 11 bp, Homo sapiens
cctgtggcctc

SEQ ID NO: 2394042 - DNA, 17 bp, Homo sapiens
cctgtggccttgcccgc

SEQ ID NO: 2394043 - DNA, 19 bp, Homo sapiens
cctgtggccttgcccgcca

SEQ ID NO: 2394044 - DNA, 18 bp, Homo sapiens
cctgtgtggccctggaca

SEQ ID NO: 2394045 - DNA, 23 bp, Homo sapiens
ccttagcagggaaggctggtctc

SEQ ID NO: 2394046 - DNA, 18 bp, Homo sapiens
ccttccccactctgctcc

SEQ ID NO: 2394047 - DNA, 17 bp, Homo sapiens
ccttcccccagctttcc

SEQ ID NO: 2394048 - DNA, 14 bp, Homo sapiens
ccttcctgccaagc

SEQ ID NO: 2394049 - DNA, 16 bp, Homo sapiens
catagctgggatttga

SEQ ID NO: 2394050 - DNA, 16 bp, Homo sapiens
catagtaaagtatttt

SEQ ID NO: 2394051 - DNA, 14 bp, Homo sapiens
catatctaaagtca

SEQ ID NO: 2394052 - DNA, 13 bp, Homo sapiens
catatgcttctga

SEQ ID NO: 2394053 - DNA, 21 bp, Homo sapiens
catcatgaactggcttgtaca

SEQ ID NO: 2394054 - DNA, 14 bp, Homo sapiens
catccaccttcctg

SEQ ID NO: 2394055 - DNA, 16 bp, Homo sapiens
catccaccttcctgcc

SEQ ID NO: 2394056 - DNA, 17 bp, Homo sapiens
catccaccttcctgccc

SEQ ID NO: 2394057 - DNA, 18 bp, Homo sapiens
catccaccttcctgccca

SEQ ID NO: 2394058 - DNA, 11 bp, Homo sapiens
catccccacct

SEQ ID NO: 2394059 - DNA, 14 bp, Homo sapiens
catcccctgcctct

SEQ ID NO: 2394060 - DNA, 15 bp, Homo sapiens
catcctctcccttct

SEQ ID NO: 2394061 - DNA, 18 bp, Homo sapiens
catcctctcccttcttac

SEQ ID NO: 2394062 - DNA, 19 bp, Homo sapiens
catcctggcccctccagac

SEQ ID NO: 2394063 - DNA, 21 bp, Homo sapiens
catctcagctcatcttcactg

SEQ ID NO: 2394064 - DNA, 15 bp, Homo sapiens
catctcgagccccct

SEQ ID NO: 2394065 - DNA, 16 bp, Homo sapiens
catctcgagccccctg

SEQ ID NO: 2394066 - DNA, 19 bp, Homo sapiens
catctcgagccccctggat

SEQ ID NO: 2394067 - DNA, 15 bp, Homo sapiens
catctgctccttcct

SEQ ID NO: 2394068 - DNA, 13 bp, Homo sapiens
catcttgctctgt

SEQ ID NO: 2394069 - DNA, 19 bp, Homo sapiens
catcttgctctgtggcctt

SEQ ID NO: 2394070 - DNA, 18 bp, Homo sapiens
catgaactggcttgtaca

SEQ ID NO: 2394071 - DNA, 21 bp, Homo sapiens
catgccagcgcagcgccaggg

SEQ ID NO: 2394072 - DNA, 20 bp, Homo sapiens
catgcccacgcccctcccca

SEQ ID NO: 2394073 - DNA, 11 bp, Homo sapiens
catgcctggcc

SEQ ID NO: 2394074 - DNA, 12 bp, Homo sapiens
catgcctggccc

SEQ ID NO: 2394075 - DNA, 22 bp, Homo sapiens
catgcctggcccttgccggggc

SEQ ID NO: 2394076 - DNA, 12 bp, Homo sapiens
catgcctggcct

SEQ ID NO: 2394077 - DNA, 13 bp, Homo sapiens
catgcctggcctg

SEQ ID NO: 2394078 - DNA, 23 bp, Homo sapiens
catggaaacaagatgaaattcca

SEQ ID NO: 2394079 - DNA, 12 bp, Homo sapiens
catggccacccc

SEQ ID NO: 2394080 - DNA, 23 bp, Homo sapiens
catggccgcgtcacttctctgat

SEQ ID NO: 2394081 - DNA, 17 bp, Homo sapiens
catgggcacctcatgga

SEQ ID NO: 2394082 - DNA, 13 bp, Homo sapiens
catgggccagccc

SEQ ID NO: 2394083 - DNA, 19 bp, Homo sapiens
catgtcaagattcagctag

SEQ ID NO: 2394084 - DNA, 18 bp, Homo sapiens
catgtctatgctccctct

SEQ ID NO: 2394085 - DNA, 20 bp, Homo sapiens
catgttcctggacaccaccc

SEQ ID NO: 2394086 - DNA, 17 bp, Homo sapiens
cattaaatcacttgaat

SEQ ID NO: 2394087 - DNA, 20 bp, Homo sapiens
cattattgacgaactggcta

SEQ ID NO: 2394088 - DNA, 22 bp, Homo sapiens
cattccacatccccaccttcca

SEQ ID NO: 2394089 - DNA, 14 bp, Homo sapiens
cattcctcagctgc

SEQ ID NO: 2394090 - DNA, 19 bp, Homo sapiens
cattcctcccattcaagat

SEQ ID NO: 2394091 - DNA, 20 bp, Homo sapiens
cattcgtctgtcccagagct

SEQ ID NO: 2394092 - DNA, 17 bp, Homo sapiens
cattcttcaagatccca

SEQ ID NO: 2394093 - DNA, 14 bp, Homo sapiens
cattgaaagtgctt

SEQ ID NO: 2394094 - DNA, 22 bp, Homo sapiens
catttttaaattcttactctgg

SEQ ID NO: 2394095 - DNA, 20 bp, Homo sapiens
ccaaatgatagaactgtact

SEQ ID NO: 2394096 - DNA, 15 bp, Homo sapiens
ccaacctcaatgccc

SEQ ID NO: 2394097 - DNA, 22 bp, Homo sapiens
ccaacctcaatgccctgccatt

SEQ ID NO: 2394098 - DNA, 23 bp, Homo sapiens
ccaacctcaatgccctgccatta

SEQ ID NO: 2394099 - DNA, 16 bp, Homo sapiens
ccaactctgcactcca

SEQ ID NO: 2394100 - DNA, 15 bp, Homo sapiens
ccaagaaagccaaca

SEQ ID NO: 2394101 - DNA, 16 bp, Homo sapiens
ccaagagagcctcttg

SEQ ID NO: 2394102 - DNA, 17 bp, Homo sapiens
ccaagatcccctcagaa

SEQ ID NO: 2394103 - DNA, 20 bp, Homo sapiens
ccaagcactcgagaccatcc

SEQ ID NO: 2394104 - DNA, 22 bp, Homo sapiens
ccaagcactcgagaccatcctg

SEQ ID NO: 2394105 - DNA, 13 bp, Homo sapiens
ccaaggtggcttc

SEQ ID NO: 2394106 - DNA, 21 bp, Homo sapiens
ccaatcccttctccacttact

SEQ ID NO: 2394107 - DNA, 22 bp, Homo sapiens
ccaatgaggtggctcatgcctg

SEQ ID NO: 2394108 - DNA, 23 bp, Homo sapiens
ccacatccccaccttccaaggaa

SEQ ID NO: 2394109 - DNA, 19 bp, Homo sapiens
ccaccaactctgcactcca

SEQ ID NO: 2394110 - DNA, 14 bp, Homo sapiens
ccacccagagcacc

SEQ ID NO: 2394111 - DNA, 13 bp, Homo sapiens
ccaccctctgtga

SEQ ID NO: 2394112 - DNA, 13 bp, Homo sapiens
ccaccctggcccg

SEQ ID NO: 2394113 - DNA, 14 bp, Homo sapiens
ccacctccaccccc

SEQ ID NO: 2394114 - DNA, 19 bp, Homo sapiens
ccacctgccaggcctccct

SEQ ID NO: 2394115 - DNA, 20 bp, Homo sapiens
ccacctgccaggcctccctc

SEQ ID NO: 2394116 - DNA, 15 bp, Homo sapiens
ccaccttcctgccca

SEQ ID NO: 2394117 - DNA, 15 bp, Homo sapiens
ccacgcccctcccca

SEQ ID NO: 2394118 - DNA, 21 bp, Homo sapiens
ccacggccaccctccttcccg

SEQ ID NO: 2394119 - DNA, 14 bp, Homo sapiens
ccacgggaccttct

SEQ ID NO: 2394120 - DNA, 17 bp, Homo sapiens
ccacgtgagagaatctg

SEQ ID NO: 2394121 - DNA, 22 bp, Homo sapiens
ccacgtgagagaatctgcctgt

SEQ ID NO: 2394122 - DNA, 16 bp, Homo sapiens
ccacgtgcagcacctg

SEQ ID NO: 2394123 - DNA, 17 bp, Homo sapiens
ccacgtgcagcacctgt

SEQ ID NO: 2394124 - DNA, 18 bp, Homo sapiens
ccacgtgcagcacctgtc

SEQ ID NO: 2394125 - DNA, 21 bp, Homo sapiens
ccacgtgcagcacctgtcacc

SEQ ID NO: 2394126 - DNA, 15 bp, Homo sapiens
ccactcactccagcc

SEQ ID NO: 2394127 - DNA, 12 bp, Homo sapiens
ccactctgctcc

SEQ ID NO: 2394128 - DNA, 13 bp, Homo sapiens
ccactctgctccc

SEQ ID NO: 2394129 - DNA, 19 bp, Homo sapiens
ccactgcactccagcctgg

SEQ ID NO: 2394130 - DNA, 15 bp, Homo sapiens
ccactgggtctcact

SEQ ID NO: 2394131 - DNA, 19 bp, Homo sapiens
ccactgggtctcactcctg

SEQ ID NO: 2394132 - DNA, 18 bp, Homo sapiens
ccacttactataatggtt

SEQ ID NO: 2394133 - DNA, 16 bp, Homo sapiens
ccacttgacattcctt

SEQ ID NO: 2394134 - DNA, 14 bp, Homo sapiens
ccagaacagcatgg

SEQ ID NO: 2394135 - DNA, 16 bp, Homo sapiens
ccagaacagcatggcc

SEQ ID NO: 2394136 - DNA, 16 bp, Homo sapiens
ccagaatcccctgggg

SEQ ID NO: 2394137 - DNA, 17 bp, Homo sapiens
ccagaatcccctgggga

SEQ ID NO: 2394138 - DNA, 16 bp, Homo sapiens
ccagaccctgcctgag

SEQ ID NO: 2394139 - DNA, 18 bp, Homo sapiens
ccagaccctgcctgagcc

SEQ ID NO: 2394140 - DNA, 21 bp, Homo sapiens
ccagaccctgcctgagcccag

SEQ ID NO: 2394141 - DNA, 19 bp, Homo sapiens
ccagagcttattggccact

SEQ ID NO: 2394142 - DNA, 16 bp, Homo sapiens
ccagagttaaaatgtt

SEQ ID NO: 2394143 - DNA, 21 bp, Homo sapiens
ccagagttaaaatgtttactg

SEQ ID NO: 2394144 - DNA, 23 bp, Homo sapiens
ccagcaacatctcgagccccctg

SEQ ID NO: 2394145 - DNA, 18 bp, Homo sapiens
ccagcactttgggaagct

SEQ ID NO: 2394146 - DNA, 24 bp, Homo sapiens
ccagcactttgggaagctgaggca

SEQ ID NO: 2394147 - DNA, 18 bp, Homo sapiens
ccagccatgcccacgccc

SEQ ID NO: 2394148 - DNA, 17 bp, Homo sapiens
ccagcccccacccatgc

SEQ ID NO: 2394149 - DNA, 18 bp, Homo sapiens
ccagcccccacccatgcc

SEQ ID NO: 2394150 - DNA, 17 bp, Homo sapiens
ccagcccttgctctacc

SEQ ID NO: 2394151 - DNA, 17 bp, Homo sapiens
ccagcctatatttcctc

SEQ ID NO: 2394152 - DNA, 17 bp, Homo sapiens
ccagcctcagtgccact

SEQ ID NO: 2394153 - DNA, 18 bp, Homo sapiens
ccagcctcagtgccactt

SEQ ID NO: 2394154 - DNA, 21 bp, Homo sapiens
ccagcgcagcgccagggctca

SEQ ID NO: 2394155 - DNA, 20 bp, Homo sapiens
ccagctacattcctcagctg

SEQ ID NO: 2394156 - DNA, 21 bp, Homo sapiens
ccagctacattcctcagctgc

SEQ ID NO: 2394157 - DNA, 19 bp, Homo sapiens
ccagctactcatgaggctg

SEQ ID NO: 2394158 - DNA, 16 bp, Homo sapiens
ccagctcagagccccg

SEQ ID NO: 2394159 - DNA, 17 bp, Homo sapiens
ccagctcagagccccgc

SEQ ID NO: 2394160 - DNA, 20 bp, Homo sapiens
ccaggagctgagtcacctcc

SEQ ID NO: 2394161 - DNA, 14 bp, Homo sapiens
ccaggatcctcctg

SEQ ID NO: 2394162 - DNA, 16 bp, Homo sapiens
ccaggccctccagcag

SEQ ID NO: 2394163 - DNA, 12 bp, Homo sapiens
ccaggccttctg

SEQ ID NO: 2394164 - DNA, 22 bp, Homo sapiens
ccagggactaagcagcccagaa

SEQ ID NO: 2394165 - DNA, 23 bp, Homo sapiens
tgaaatccgaacagttggggctg

SEQ ID NO: 2394166 - DNA, 21 bp, Homo sapiens
tgaaatgaaacaaataatcac

SEQ ID NO: 2394167 - DNA, 19 bp, Homo sapiens
tgaaatttttctctttaaa

SEQ ID NO: 2394168 - DNA, 20 bp, Homo sapiens
tgaacgtacccaaggtcaca

SEQ ID NO: 2394169 - DNA, 19 bp, Homo sapiens
tgaactggcttgtacattt

SEQ ID NO: 2394170 - DNA, 21 bp, Homo sapiens
tgaataaatacccattgaact

SEQ ID NO: 2394171 - DNA, 23 bp, Homo sapiens
tgacaggcactattctaatcagt

SEQ ID NO: 2394172 - DNA, 20 bp, Homo sapiens
tgacattccttgtcaccagc

SEQ ID NO: 2394173 - DNA, 13 bp, Homo sapiens
tgacccccatcgc

SEQ ID NO: 2394174 - DNA, 12 bp, Homo sapiens
tgacgaactggc

SEQ ID NO: 2394175 - DNA, 14 bp, Homo sapiens
tgacgaactggcta

SEQ ID NO: 2394176 - DNA, 21 bp, Homo sapiens
tgactcctcccttccccactc

SEQ ID NO: 2394177 - DNA, 24 bp, Homo sapiens
tgactcctcccttccccactctgc

SEQ ID NO: 2394178 - DNA, 19 bp, Homo sapiens
tgacttggggacaccccag

SEQ ID NO: 2394179 - DNA, 21 bp, Homo sapiens
tgagaccagcctgccaggccc

SEQ ID NO: 2394180 - DNA, 14 bp, Homo sapiens
tgagaccctcttct

SEQ ID NO: 2394181 - DNA, 20 bp, Homo sapiens
tgagaccctcttctctgggc

SEQ ID NO: 2394182 - DNA, 22 bp, Homo sapiens
tgagacctgaaggacctccccc

SEQ ID NO: 2394183 - DNA, 17 bp, Homo sapiens
tgagagaatctgcctgt

SEQ ID NO: 2394184 - DNA, 23 bp, Homo sapiens
tgagagggggatgcccctggccc

SEQ ID NO: 2394185 - DNA, 21 bp, Homo sapiens
tgagcacagacggaggaagcc

SEQ ID NO: 2394186 - DNA, 14 bp, Homo sapiens
tgagccagaaattg

SEQ ID NO: 2394187 - DNA, 18 bp, Homo sapiens
tgagccgtgcagctggga

SEQ ID NO: 2394188 - DNA, 20 bp, Homo sapiens
tgagcgcagcgcctccaccc

SEQ ID NO: 2394189 - DNA, 20 bp, Homo sapiens
tgaggcaggaggatcccctg

SEQ ID NO: 2394190 - DNA, 21 bp, Homo sapiens
tgaggccccagggctgtgggt

SEQ ID NO: 2394191 - DNA, 16 bp, Homo sapiens
tgaggctgaggcagga

SEQ ID NO: 2394192 - DNA, 15 bp, Homo sapiens
tgaggttctcatttt

SEQ ID NO: 2394193 - DNA, 14 bp, Homo sapiens
tgagtcacctcctc

SEQ ID NO: 2394194 - DNA, 17 bp, Homo sapiens
tgagtggggcttcctgg

SEQ ID NO: 2394195 - DNA, 17 bp, Homo sapiens
tgatagaactgtactgt

SEQ ID NO: 2394196 - DNA, 16 bp, Homo sapiens
tgatctggcccaagct

SEQ ID NO: 2394197 - DNA, 14 bp, Homo sapiens
tgattaacaatgta

SEQ ID NO: 2394198 - DNA, 15 bp, Homo sapiens
tgattaacaatgtat

SEQ ID NO: 2394199 - DNA, 15 bp, Homo sapiens
tgcaatgagccaaga

SEQ ID NO: 2394200 - DNA, 16 bp, Homo sapiens
tgcacaggcagcaagg

SEQ ID NO: 2394201 - DNA, 20 bp, Homo sapiens
tgcacagtccctcctgttgc

SEQ ID NO: 2394202 - DNA, 14 bp, Homo sapiens
tgcacattcctggc

SEQ ID NO: 2394203 - DNA, 16 bp, Homo sapiens
tgcacattcctggccc

SEQ ID NO: 2394204 - DNA, 15 bp, Homo sapiens
tgcactccagcctgg

SEQ ID NO: 2394205 - DNA, 17 bp, Homo sapiens
tgcactccatggccacc

SEQ ID NO: 2394206 - DNA, 13 bp, Homo sapiens
tgcagcacctgtc

SEQ ID NO: 2394207 - DNA, 21 bp, Homo sapiens
tgcattattgacgaactggct

SEQ ID NO: 2394208 - DNA, 22 bp, Homo sapiens
tgccacactttcactggggatc

SEQ ID NO: 2394209 - DNA, 22 bp, Homo sapiens
tgccagccacccctcctctagc

SEQ ID NO: 2394210 - DNA, 21 bp, Homo sapiens
tgccagcgcagcgccagggct

SEQ ID NO: 2394211 - DNA, 16 bp, Homo sapiens
tgccaggccctccagc

SEQ ID NO: 2394212 - DNA, 15 bp, Homo sapiens
tgggaccaggccaat

SEQ ID NO: 2394213 - DNA, 18 bp, Homo sapiens
tgggaccaggccaatccc

SEQ ID NO: 2394214 - DNA, 14 bp, Homo sapiens
tgggacccctccca

SEQ ID NO: 2394215 - DNA, 17 bp, Homo sapiens
tgggacctgatttattg

SEQ ID NO: 2394216 - DNA, 23 bp, Homo sapiens
tgggaggcccggggcccttcctc

SEQ ID NO: 2394217 - DNA, 19 bp, Homo sapiens
tgggatttgaactgagccg

SEQ ID NO: 2394218 - DNA, 13 bp, Homo sapiens
tgggcaagtccct

SEQ ID NO: 2394219 - DNA, 17 bp, Homo sapiens
tgggcacccacctccac

SEQ ID NO: 2394220 - DNA, 18 bp, Homo sapiens
tgggcacccacctccacc

SEQ ID NO: 2394221 - DNA, 13 bp, Homo sapiens
tgggccctcagcg

SEQ ID NO: 2394222 - DNA, 20 bp, Homo sapiens
tgggctcactacatgggcca

SEQ ID NO: 2394223 - DNA, 23 bp, Homo sapiens
tgggctcactacatgggccagcc

SEQ ID NO: 2394224 - DNA, 21 bp, Homo sapiens
tgggctgttgtgtctggagcc

SEQ ID NO: 2394225 - DNA, 22 bp, Homo sapiens
tgggctgttgtgtctggagcct

SEQ ID NO: 2394226 - DNA, 15 bp, Homo sapiens
tggggacaccccaga

SEQ ID NO: 2394227 - DNA, 20 bp, Homo sapiens
tggggatcccgtgctggaag

SEQ ID NO: 2394228 - DNA, 19 bp, Homo sapiens
tggggcatccaccttcctg

SEQ ID NO: 2394229 - DNA, 22 bp, Homo sapiens
tggggcggcccacgccagctgg

SEQ ID NO: 2394230 - DNA, 13 bp, Homo sapiens
tggggctgttcat

SEQ ID NO: 2394231 - DNA, 15 bp, Homo sapiens
tggggcttaatgaag

SEQ ID NO: 2394232 - DNA, 14 bp, Homo sapiens
tggggcttcctggg

SEQ ID NO: 2394233 - DNA, 15 bp, Homo sapiens
tggggcttcctgggc

SEQ ID NO: 2394234 - DNA, 17 bp, Homo sapiens
tggggcttcctgggcag

SEQ ID NO: 2394235 - DNA, 13 bp, Homo sapiens
tgggtctcactcc

SEQ ID NO: 2394236 - DNA, 17 bp, Homo sapiens
tgggtgagcgggtgggg

SEQ ID NO: 2394237 - DNA, 18 bp, Homo sapiens
tgggtgagcgggtggggt

SEQ ID NO: 2394238 - DNA, 13 bp, Homo sapiens
tgggtgctggtcc

SEQ ID NO: 2394239 - DNA, 15 bp, Homo sapiens
tggtaattgtacaat

SEQ ID NO: 2394240 - DNA, 22 bp, Homo sapiens
tggtgggaggcccggggccctt

SEQ ID NO: 2394241 - DNA, 16 bp, Homo sapiens
tggttgtgggcttgga

SEQ ID NO: 2394242 - DNA, 13 bp, Homo sapiens
tgtaatcccagca

SEQ ID NO: 2394243 - DNA, 17 bp, Homo sapiens
tgtacatagtaaagtat

SEQ ID NO: 2394244 - DNA, 18 bp, Homo sapiens
tgtacatagtaaagtatt

SEQ ID NO: 2394245 - DNA, 13 bp, Homo sapiens
tgtacatgtacat

SEQ ID NO: 2394246 - DNA, 18 bp, Homo sapiens
tgtactgttttctgggcc

SEQ ID NO: 2394247 - DNA, 22 bp, Homo sapiens
tgtaggttattatgattagctt

SEQ ID NO: 2394248 - DNA, 16 bp, Homo sapiens
tgtcaagattcagcta

SEQ ID NO: 2394249 - DNA, 17 bp, Homo sapiens
tgtcaccagcaacatct

SEQ ID NO: 2394250 - DNA, 17 bp, Homo sapiens
tgtccattgccacggcc

SEQ ID NO: 2394251 - DNA, 16 bp, Homo sapiens
tgtcccaccaactctg

SEQ ID NO: 2394252 - DNA, 20 bp, Homo sapiens
tgtcccaccaactctgcact

SEQ ID NO: 2394253 - DNA, 22 bp, Homo sapiens
tgtcccaccaactctgcactcc

SEQ ID NO: 2394254 - DNA, 22 bp, Homo sapiens
tgtcccagagcttattggccac

SEQ ID NO: 2394255 - DNA, 13 bp, Homo sapiens
tgtccccctcacc

SEQ ID NO: 2394256 - DNA, 13 bp, Homo sapiens
tgtcccctgtccc

SEQ ID NO: 2394257 - DNA, 19 bp, Homo sapiens
tgtcccctgtcccaccaac

SEQ ID NO: 2394258 - DNA, 20 bp, Homo sapiens
tgtcccctgtcccaccaact

SEQ ID NO: 2394259 - DNA, 16 bp, Homo sapiens
tgtctatgctccctct

SEQ ID NO: 2394260 - DNA, 17 bp, Homo sapiens
tgtctggagcctgcagg

SEQ ID NO: 2394261 - DNA, 19 bp, Homo sapiens
tgtctggagcctgcaggca

SEQ ID NO: 2394262 - DNA, 22 bp, Homo sapiens
tgtcttgagaccagcctgccag

SEQ ID NO: 2394263 - DNA, 23 bp, Homo sapiens
tgtcttgagaccagcctgccagg

SEQ ID NO: 2394264 - DNA, 15 bp, Homo sapiens
tgtgacctgctcctg

SEQ ID NO: 2394265 - DNA, 19 bp, Homo sapiens
tgtgacctgctcctgccca

SEQ ID NO: 2394266 - DNA, 16 bp, Homo sapiens
tgtgcctacctggccg

SEQ ID NO: 2394267 - DNA, 20 bp, Homo sapiens
tgtgcttgtgcctacctggc

SEQ ID NO: 2394268 - DNA, 16 bp, Homo sapiens
tgtggccttggccctg

SEQ ID NO: 2394269 - DNA, 18 bp, Homo sapiens
tgtgtctggagcctgcag

SEQ ID NO: 2394270 - DNA, 12 bp, Homo sapiens
tgtgtggccctg

SEQ ID NO: 2394271 - DNA, 23 bp, Homo sapiens
tgttcaggcagaaccggtcccag

SEQ ID NO: 2394272 - DNA, 18 bp, Homo sapiens
tgttccatgcctggccct

SEQ ID NO: 2394273 - DNA, 22 bp, Homo sapiens
tgttgagagggggatgcccctg

SEQ ID NO: 2394274 - DNA, 20 bp, Homo sapiens
tgttgcacagtccctcctgt

SEQ ID NO: 2394275 - DNA, 21 bp, Homo sapiens
tgttgtctacattaaatcact

SEQ ID NO: 2394276 - DNA, 13 bp, Homo sapiens
tgttgtgtctgga

SEQ ID NO: 2394277 - DNA, 17 bp, Homo sapiens
tgttgtgtctggagcct

SEQ ID NO: 2394278 - DNA, 12 bp, Homo sapiens
tgtttactgtaa

SEQ ID NO: 2394279 - DNA, 17 bp, Homo sapiens
tgtttcactactcagca

SEQ ID NO: 2394280 - DNA, 20 bp, Homo sapiens
tgttttcatggacagctgag

SEQ ID NO: 2394281 - DNA, 20 bp, Homo sapiens
ttaaaatgtttactgtaaat

SEQ ID NO: 2394282 - DNA, 17 bp, Homo sapiens
ttaaacagttgcacagc

SEQ ID NO: 2394283 - DNA, 22 bp, Homo sapiens
ttacagaaaataccacctcgag

SEQ ID NO: 2394284 - DNA, 20 bp, Homo sapiens
ttagcattttctgcatctcc

SEQ ID NO: 2394285 - DNA, 16 bp, Homo sapiens
ttagctttgtcactgt

SEQ ID NO: 2394286 - DNA, 15 bp, Homo sapiens
ttagtgactaaacca

SEQ ID NO: 2394287 - DNA, 18 bp, Homo sapiens
ttagttcctgtgcacagc

SEQ ID NO: 2394288 - DNA, 16 bp, Homo sapiens
ttatacagtgtacatg

SEQ ID NO: 2394289 - DNA, 17 bp, Homo sapiens
ttattgacgaactggct

SEQ ID NO: 2394290 - DNA, 12 bp, Homo sapiens
ttattggccact

SEQ ID NO: 2394291 - DNA, 24 bp, Homo sapiens
ttattgtggcccagataaggcttt

SEQ ID NO: 2394292 - DNA, 23 bp, Homo sapiens
ttcatctatgagggtgtttcctc

SEQ ID NO: 2394293 - DNA, 16 bp, Homo sapiens
ttccacatccccacct

SEQ ID NO: 2394294 - DNA, 18 bp, Homo sapiens
ttccagagctaggctgtg

SEQ ID NO: 2394295 - DNA, 18 bp, Homo sapiens
ttccccactaataaagtg

SEQ ID NO: 2394296 - DNA, 15 bp, Homo sapiens
ttccccactctgctc

SEQ ID NO: 2394297 - DNA, 20 bp, Homo sapiens
ttccccactctgctcccagc

SEQ ID NO: 2394298 - DNA, 22 bp, Homo sapiens
ttccccactctgctcccagccc

SEQ ID NO: 2394299 - DNA, 15 bp, Homo sapiens
ttccctaattctgcc

SEQ ID NO: 2394300 - DNA, 15 bp, Homo sapiens
ttcctcagctgccaa

SEQ ID NO: 2394301 - DNA, 15 bp, Homo sapiens
ttcctcgcacagggc

SEQ ID NO: 2394302 - DNA, 11 bp, Homo sapiens
ttcctgcccag

SEQ ID NO: 2394303 - DNA, 15 bp, Homo sapiens
ttccttgtcaccagc

SEQ ID NO: 2394304 - DNA, 16 bp, Homo sapiens
ttcgagagcagcctgg

SEQ ID NO: 2394305 - DNA, 18 bp, Homo sapiens
ttcgagagcagcctggcc

SEQ ID NO: 2394306 - DNA, 12 bp, Homo sapiens
ttcgtctgtccc

SEQ ID NO: 2394307 - DNA, 18 bp, Homo sapiens
ttcgtctgtcccagagct

SEQ ID NO: 2394308 - DNA, 16 bp, Homo sapiens
ttctatagcagtcatc

SEQ ID NO: 2394309 - DNA, 18 bp, Homo sapiens
ttctgggccagtgagcca

SEQ ID NO: 2394310 - DNA, 21 bp, Homo sapiens
ttcttacaccgtgaggccaag
